United States Patent 7,361,468 (METHODS FOR GENOTYPING POLYMORPHISMS IN HUMANS) - sequence listing, part 3

SEQ ID NO: 61464 - DNA, 50 bp, homo sapien
attacactgactggggcctgggccaratccattccatttgccatagggaa

SEQ ID NO: 61465 - DNA, 50 bp, homo sapien
tctctttattgactgattcaagctamgtaaccaagagtcatctcaaatgt

SEQ ID NO: 61466 - DNA, 50 bp, homo sapien
ttttcaagtgggagtaaagaagcaamagtgatcccggcatggcattctag

SEQ ID NO: 61467 - DNA, 50 bp, homo sapien
taccacgaacacttggggccgcagaraggtctgaatcccggacacttggt

SEQ ID NO: 61468 - DNA, 50 bp, homo sapien
ggggtgggcatagaccttccatgtcstctctgggcgtgccatgctcccag

SEQ ID NO: 61469 - DNA, 50 bp, homo sapien
ctatgaaatctgactctaactccacrtagaaagtatcagaattgaattga

SEQ ID NO: 61470 - DNA, 50 bp, homo sapien
gatattccagaaatgtatggtcagaytacactatagtaaagcaaaggaat

SEQ ID NO: 61471 - DNA, 50 bp, homo sapien
  misc_feature (8)..(8): n is a, c, g, or t
agtgacantggtgtgattaagccaaytgataaaagtgctaagttcacatt

SEQ ID NO: 61472 - DNA, 50 bp, homo sapien
ccacgattactctttggtgccaggawccaaaccaaggcctgcctaacact

SEQ ID NO: 61473 - DNA, 50 bp, homo sapien
aatccactcccttttctaaaaagtgyaatgccagatgtcatggagtagtt

SEQ ID NO: 61474 - DNA, 50 bp, homo sapien
gtctctcccaagggatggccaaaaarcagtatttgtgcagatgtgagcag

SEQ ID NO: 61475 - DNA, 50 bp, homo sapien
ggatgctagagagctgatactctgayggttgagagggagccaaactccat

SEQ ID NO: 61476 - DNA, 50 bp, homo sapien
agttcaaaagtgtataaatccgacartgaatattttatggagactgctat

SEQ ID NO: 61477 - DNA, 50 bp, homo sapien
ctttgtcttcctgacctgattaggcycttttgatagttacattctcccat

SEQ ID NO: 61478 - DNA, 50 bp, homo sapien
ttgaaggaggaaatgaatttagaaasgactgtgttgactcttgaggaaag

SEQ ID NO: 61479 - DNA, 50 bp, homo sapien
tatctgccttctcccaacaaaactarggacatcctcatagaaaagaaggg

SEQ ID NO: 61480 - DNA, 50 bp, homo sapien
tatttagagagacagatcacattcayataacatgtgaatgtgagtgtatt

SEQ ID NO: 61481 - DNA, 50 bp, homo sapien
agaggacttttattattgcttgttaygtacagtattagtcatatcttgct

SEQ ID NO: 61482 - DNA, 50 bp, homo sapien
tcatatcttgctaacactcagtgaaytgccctcagctgatcctctgccct

SEQ ID NO: 61483 - DNA, 50 bp, homo sapien
gtgagagttttaatcctgttgtggtmaactcgcctttctttgcttgctat

SEQ ID NO: 61484 - DNA, 50 bp, homo sapien
tcctgtcatgtcacatgcatttctaygtcgattttaacataatcacgtgt

SEQ ID NO: 61485 - DNA, 50 bp, homo sapien
gggggtttgggaggtaagctgtatayggaccttgatcttccaaggatata

SEQ ID NO: 61486 - DNA, 50 bp, homo sapien
aaatagcccaggtcagcatggcttgmactatttttaactccaggtactag

SEQ ID NO: 61487 - DNA, 50 bp, homo sapien
atttctagattcaggatttaatcaaygtgggagaagcagttgctttaact

SEQ ID NO: 61488 - DNA, 50 bp, homo sapien
tatctctgctccagccagctctgtgyaggccttattgtactattcaaagt

SEQ ID NO: 61489 - DNA, 50 bp, homo sapien
ttgaataaagaaattttgggctaaargtcatgtgtgataataaaataaca

SEQ ID NO: 61490 - DNA, 50 bp, homo sapien
cagcagctacattagtcatcacagamgcttatgttagtttttttcctgac

SEQ ID NO: 61491 - DNA, 50 bp, homo sapien
gtatgaaccagtaagatacatgatayatgagatggatggatggatggata

SEQ ID NO: 61492 - DNA, 50 bp, homo sapien
gtggctcaagccggtcgaggcagcaytgaagacacgtgggttgtttgcaa

SEQ ID NO: 61493 - DNA, 50 bp, homo sapien
cagaggcagcacctggatgaccccayggatatgacgtttctttttttttt

SEQ ID NO: 61494 - DNA, 50 bp, homo sapien
ctgtctaaagggataagggctttccygaagtcacattattttcttatcca

SEQ ID NO: 61495 - DNA, 50 bp, homo sapien
attgtaagctgtttgagggcaaatgycatgccttattcatttttgcatcc

SEQ ID NO: 61496 - DNA, 50 bp, homo sapien
ttcactacagaactttgtaaatctakgctgtataaatcttggtttaaatt

SEQ ID NO: 61497 - DNA, 50 bp, homo sapien
ctacctgtatctccaccttgtcatcractttgagtgtctgagagcagctg

SEQ ID NO: 61498 - DNA, 50 bp, homo sapien
ttggcatcaatagattaaaagagcaraactatatgatcctctcaagagtt

SEQ ID NO: 61499 - DNA, 50 bp, homo sapien
tctagatgtgcagttgtaccataaargactgagagtctttatcactaata

SEQ ID NO: 61500 - DNA, 50 bp, homo sapien
gttacctaccccaactctgagaacamaatagagagtgagtttgaagaaaa

SEQ ID NO: 61501 - DNA, 50 bp, homo sapien
gtgccatgttctgtgctaggccctgragaggcaaagacacctcatctatt

SEQ ID NO: 61502 - DNA, 50 bp, homo sapien
gccccaatgccctgcttgttaacaaytccccagaatccctcaagtctcca

SEQ ID NO: 61503 - DNA, 50 bp, homo sapien
gcctgcaaaggatggcctgtcagctyagcagtctgtgtgctttctagagt

SEQ ID NO: 61504 - DNA, 50 bp, homo sapien
taggagtcacagatattttcgtatcrcccacagttgttataaatatctca

SEQ ID NO: 61505 - DNA, 50 bp, homo sapien
ctaccttatagaagcaatgcttagargaactccttaatgcttgcaaatgc

SEQ ID NO: 61506 - DNA, 50 bp, homo sapien
acagagttaaaacaactgggttggawcatgctaaaaggagataatattac

SEQ ID NO: 61507 - DNA, 50 bp, homo sapien
aggttcatatactcatcaaaaccaaygatacagccttctatccacatatt

SEQ ID NO: 61508 - DNA, 50 bp, homo sapien
cctaaacatagaagtggtctgacagsttccgtggtcccttagtgtcctat

SEQ ID NO: 61509 - DNA, 50 bp, homo sapien
agagcacctaatagtgcttggtacasaataagcattcaataaatgttggc

SEQ ID NO: 61510 - DNA, 50 bp, homo sapien
tgggggcggtcgtagcctatgcttcygaacaggcatcttcctccccagac

SEQ ID NO: 61511 - DNA, 50 bp, homo sapien
tggatagtgatactaactgaggtacyataggcaggaaagaccaacctata

SEQ ID NO: 61512 - DNA, 50 bp, homo sapien
aggatccaataatgtaaaattcacaygtctagcgtcccatgaaaacatta

SEQ ID NO: 61513 - DNA, 50 bp, homo sapien
gttagtaagattagtaagaaaataaygacaaattcgcctttagaaatctt

SEQ ID NO: 61514 - DNA, 50 bp, homo sapien
taatcagaagaacacattggaattamcagggaagcattttaaaaactcac

SEQ ID NO: 61515 - DNA, 50 bp, homo sapien
gccttctaaagattctaccatgtcayctacaagtccttcctaaagagttt

SEQ ID NO: 61516 - DNA, 50 bp, homo sapien
attgatcttgtcctctccttgaccargataattcaattctgttctcaatg

SEQ ID NO: 61517 - DNA, 50 bp, homo sapien
ggtgaacttccaaggtagactggctraatgagcagcaagtctcctcagac

SEQ ID NO: 61518 - DNA, 50 bp, homo sapien
tggattttgggatttgggatgctcartcggtaactatactgtaaatattc

SEQ ID NO: 61519 - DNA, 50 bp, homo sapien
agggccactggtatatagtatgtgayctcacccaattcaccaaagacgta

SEQ ID NO: 61520 - DNA, 50 bp, homo sapien
actctctcttatcttcgttctacaayatcccaatagaaacattagagtca

SEQ ID NO: 61521 - DNA, 50 bp, homo sapien
ggattctaccctatctaaatagttaygtctttggtgaattgggtgaggtc

SEQ ID NO: 61522 - DNA, 50 bp, homo sapien
attaagggcccaataagcttgcacaraggaaggtagaaacagacaggaga

SEQ ID NO: 61523 - DNA, 50 bp, homo sapien
gggccttgtgctcagtgacagaccasagtcccatcactgagagagcaggg

SEQ ID NO: 61524 - DNA, 50 bp, homo sapien
atatcaataaaattattacatgaaargtcatttatttatttatatattta

SEQ ID NO: 61525 - DNA, 50 bp, homo sapien
cgttttagcaggtgcacagtcctagmacaacatactggtactggctcata

SEQ ID NO: 61526 - DNA, 50 bp, homo sapien
taacagtaatatattctatagtctcraatagctaggatattgaatgtttc

SEQ ID NO: 61527 - DNA, 50 bp, homo sapien
aagacaccgttaagagtgaaaaggcrattcatagaatggcataagatata

SEQ ID NO: 61528 - DNA, 50 bp, homo sapien
tatttgtatccactttaatttggcaycttgcatggcacgggtttggagat

SEQ ID NO: 61529 - DNA, 50 bp, homo sapien
ataaaattggggaaataatagcacargtttagattttgtgaggactaaat

SEQ ID NO: 61530 - DNA, 50 bp, homo sapien
ggtatttttgtccaaatttacaagaraatctaattggcttagattgattt

SEQ ID NO: 61531 - DNA, 50 bp, homo sapien
ttatggcatgcacattagagaagaasaactgagactcgagaagggcgaag

SEQ ID NO: 61532 - DNA, 50 bp, homo sapien
cactcttggactggtaagagacagartatagttaagcccgtgatgagtat

SEQ ID NO: 61533 - DNA, 50 bp, homo sapien
tgggtgtccagcacagcactacgcasgtgtactcatcatcccatctactt

SEQ ID NO: 61534 - DNA, 50 bp, homo sapien
ggtggacagaggtcttcacagatgamcctatattgtacaccgtattatat

SEQ ID NO: 61535 - DNA, 50 bp, homo sapien
ggagagacaacagagggatacgagamctcaaaacttcagcagtctcttct

SEQ ID NO: 61536 - DNA, 50 bp, homo sapien
aaaacaaaaatacaaacagaacaaawcacttagctgcttgacattacaaa

SEQ ID NO: 61537 - DNA, 50 bp, homo sapien
atcactgttaagacagatattctgamagctatggcaaacttgctatatta

SEQ ID NO: 61538 - DNA, 50 bp, homo sapien
tgaaaaacattcaatgagtgttggtkgatccaagtctattccccacctca

SEQ ID NO: 61539 - DNA, 50 bp, homo sapien
gaaaggctacagattttcttcagcaktcattattacatataataaacatt

SEQ ID NO: 61540 - DNA, 50 bp, homo sapien
agaatgaatattcatacattccactscaaatattaatgtgttgctcgcct

SEQ ID NO: 61541 - DNA, 50 bp, homo sapien
acaatagtagtccttgagagtcttawgtgtgtaaatatttgtaacatgtc

SEQ ID NO: 61542 - DNA, 50 bp, homo sapien
acaggttccgcaatcacaggcaaaasgatgagagaggggtaaaaggcctc

SEQ ID NO: 61543 - DNA, 50 bp, homo sapien
tggagaaatttgtaccctcatacacmgctactggggatgtaaaatagtgc

SEQ ID NO: 61544 - DNA, 50 bp, homo sapien
agaagtgagcagtgccccttgttgaygaagagaacctgtgagcttttggt

SEQ ID NO: 61545 - DNA, 50 bp, homo sapien
acaattgtttctatgcatttatatarcccattccttttccagatgtcttc

SEQ ID NO: 61546 - DNA, 50 bp, homo sapien
taagcaggtctggcatactggataamctctgccagcttctgactgtgcaa

SEQ ID NO: 61547 - DNA, 50 bp, homo sapien
tattatgtggcttgaatgctaattgmacactaagtgaggacaaaaataat

SEQ ID NO: 61548 - DNA, 50 bp, homo sapien
ggaaacattaccaccattccttggargtctgtaaggctaatatggctacc

SEQ ID NO: 61549 - DNA, 50 bp, homo sapien
ttcctctagattgtaaactacaagaraggaatagccacagctaaatggaa

SEQ ID NO: 61550 - DNA, 50 bp, homo sapien
tgaattatattgcaaagcagtgctcrccaacatttttcatatcatgacac

SEQ ID NO: 61551 - DNA, 50 bp, homo sapien
tactgggtacaagatgaaataaaaasactacgaaattttatttcatttaa

SEQ ID NO: 61552 - DNA, 50 bp, homo sapien
aatttttttcttatttcaagattcamaaaaaatgttctaggtgtccaagg

SEQ ID NO: 61553 - DNA, 50 bp, homo sapien
aagtgaaaagatgataaccaccatcrtgcaaacatgcaaaactataaaac

SEQ ID NO: 61554 - DNA, 50 bp, homo sapien
ctccagaatacagaagagggtacacrcgccaaagcacttcccatgagcat

SEQ ID NO: 61555 - DNA, 50 bp, homo sapien
tctcacaaaaaaagtcagccactgaraagtaatagtgcctgtgaagatgc

SEQ ID NO: 61556 - DNA, 50 bp, homo sapien
taactgcatgtgtcctactgaaatasactgatgtcccagggaacactgag

SEQ ID NO: 61557 - DNA, 50 bp, homo sapien
aatttaatattttgtattgagaacamgtataaactcaaatcttttagtga

SEQ ID NO: 61558 - DNA, 50 bp, homo sapien
ttgacttttcatatgcatcttgcaargttctgtaaagcaggactttctct

SEQ ID NO: 61559 - DNA, 50 bp, homo sapien
ctggcctcgtttctacctctggataygttcactaacttaaaaacaccact

SEQ ID NO: 61560 - DNA, 50 bp, homo sapien
ataggcagatcaatcaattggtctcragcaaaagcacaaaagtaaaagtg

SEQ ID NO: 61561 - DNA, 50 bp, homo sapien
tgatatagcatgataataaatagcaraatagtagggcggttttaatttac

SEQ ID NO: 61562 - DNA, 50 bp, homo sapien
taacaaataccatatacttgataatratatagcatgataataaatagcaa

SEQ ID NO: 61563 - DNA, 50 bp, homo sapien
gctgtaagaggaaattttgccctaayctaagaaagtagggaaagcttcag

SEQ ID NO: 61564 - DNA, 50 bp, homo sapien
cattcaaacagggctcctcagtcaayattaaatctgttatactttgttct

SEQ ID NO: 61565 - DNA, 50 bp, homo sapien
tgatcaatccaaacttgatcaaatasattaaccagcacaaagcatgctca

SEQ ID NO: 61566 - DNA, 50 bp, homo sapien
ctatttcacaattttgcttaagttayatgttccaacaaaacattacacac

SEQ ID NO: 61567 - DNA, 50 bp, homo sapien
cttcagagctgtgccacctctgccartattcgtgccagcaagtggatgcc

SEQ ID NO: 61568 - DNA, 50 bp, homo sapien
tcattggctcttcacgtttctataayatactttcttgcttgtaaaaagtc

SEQ ID NO: 61569 - DNA, 50 bp, homo sapien
gttgaactaattcacattttcaccartagtgttcacgtgttcctgtttct

SEQ ID NO: 61570 - DNA, 50 bp, homo sapien
cagatccaccattatacatttaaatyatccagtctgctatgtggcttttc

SEQ ID NO: 61571 - DNA, 50 bp, homo sapien
tctgtaaactaaagaattccccctaygagacatgctaggcctcaaagatt

SEQ ID NO: 61572 - DNA, 50 bp, homo sapien
acccatgtaagctatgaccaagttamacaagtataaatggaagtgacatt

SEQ ID NO: 61573 - DNA, 50 bp, homo sapien
cagagtgccatagggtagacgcataygatacccttggttaaatcataaaa

SEQ ID NO: 61574 - DNA, 50 bp, homo sapien
gaggaaaatgtcatctaaagtaacakaataggtgctgaaagtagtgatat

SEQ ID NO: 61575 - DNA, 50 bp, homo sapien
gaggcaggaattactccaacttcccraaaccttcagaaaacagccctggt

SEQ ID NO: 61576 - DNA, 50 bp, homo sapien
agattctttcatctgagcatcaagcmaattagtttagcatctggggtaac

SEQ ID NO: 61577 - DNA, 50 bp, homo sapien
ttaggcactgcaataaacaggcaagrcagggagattaggggaccacagga

SEQ ID NO: 61578 - DNA, 50 bp, homo sapien
ggtaacctattccaaagcaccctatwccaaagctctctcccctagtgttg

SEQ ID NO: 61579 - DNA, 50 bp, homo sapien
tcagtgaatccagactgatggtccamtgagtcttgtttctcggagctcct

SEQ ID NO: 61580 - DNA, 50 bp, homo sapien
actcggtatgtattgaactgatgaaygaaggtgtgcttgaagaacaagtc

SEQ ID NO: 61581 - DNA, 50 bp, homo sapien
cagtacatacatgctctataaacacrggactcttaaaataaatctatgac

SEQ ID NO: 61582 - DNA, 50 bp, homo sapien
cattgtactaaccattcatctcagartatgtctggtcactagaaataaat

SEQ ID NO: 61583 - DNA, 50 bp, homo sapien
agggaaagcttctccgtgaaatcgaygagctggtgttcagaaaatgagta

SEQ ID NO: 61584 - DNA, 50 bp, homo sapien
cagccctggaaacagaactcaaaacmattcgcaggtacccactggaaagc

SEQ ID NO: 61585 - DNA, 50 bp, homo sapien
gcatgaaatataacctactgggaaaycaaagagtagatgacaggaagggt

SEQ ID NO: 61586 - DNA, 50 bp, homo sapien
cgtactaaaggcagtacagaggaaawttattactgcaggaaagcgaataa

SEQ ID NO: 61587 - DNA, 50 bp, homo sapien
taattatcccatgcatagcgtttccrgcagaagtacagaaagacaaacag

SEQ ID NO: 61588 - DNA, 50 bp, homo sapien
ctcccaggccctctctcctattcacrgtacctaacagtaagccagttggc

SEQ ID NO: 61589 - DNA, 50 bp, homo sapien
taaagccattatttcactctccttawgctatcttatttaaaaagccctac

SEQ ID NO: 61590 - DNA, 50 bp, homo sapien
tttgtttattaattttttaagtgtasagaggcacaagataagcataaaca

SEQ ID NO: 61591 - DNA, 50 bp, homo sapien
tatgggaaaacttcaagcagcccaayatagatgtaagtggagtccctgaa

SEQ ID NO: 61592 - DNA, 50 bp, homo sapien
aggtcaccagcaggttagcaagaagragaacccaagtgctctgagtctgg

SEQ ID NO: 61593 - DNA, 50 bp, homo sapien
ggaatgtagtggtaggaaagttgccrtgactccacaccagccttttggcc

SEQ ID NO: 61594 - DNA, 50 bp, homo sapien
tacatggaccccaaatgtttaaatgwagtgattagacatacaaatctgta

SEQ ID NO: 61595 - DNA, 50 bp, homo sapien
cactgattgcatatctaactattagycaataaactagaccacccttcttg

SEQ ID NO: 61596 - DNA, 50 bp, homo sapien
tactgaatgcaaatgtatgaagaagkctcttgcgcccagtagccactggt

SEQ ID NO: 61597 - DNA, 50 bp, homo sapien
gaaagctttctgctgtcagggaatamagactttaatagagaaggcattat

SEQ ID NO: 61598 - DNA, 50 bp, homo sapien
caggatgaaactaagattcaagtgayaaagtagcttctccaaattttcag

SEQ ID NO: 61599 - DNA, 50 bp, homo sapien
agaagaaaaaatggaataagaaagcmaccaaaattcaaagtgttaacatt

SEQ ID NO: 61600 - DNA, 50 bp, homo sapien
catggagccatgaacatcaaaagcaractagataaatcaatacagaactg

SEQ ID NO: 61601 - DNA, 50 bp, homo sapien
tccaactgtaggcatattgaaagtawcatgctgaacaccaaaaacaaaca

SEQ ID NO: 61602 - DNA, 50 bp, homo sapien
aaatggaaataattcattctattcckatttagaaaacattctagaaagtg

SEQ ID NO: 61603 - DNA, 50 bp, homo sapien
gagtagacttcaggtactatattgaygactgtctacctcatcttacaacc

SEQ ID NO: 61604 - DNA, 50 bp, homo sapien
gaaatatgaagttgcctttggatcaygtaacagaataagcctggatgtag

SEQ ID NO: 61605 - DNA, 50 bp, homo sapien
ccctccctttattctgattatttaakaagtaatgtccagttgctcccatg

SEQ ID NO: 61606 - DNA, 50 bp, homo sapien
tagacggtcaagattttaaaaaataycaattatctgagtaagtcaaggaa

SEQ ID NO: 61607 - DNA, 50 bp, homo sapien
ttaaaatacagttattcttcaatagsatgagggttggtgctaggacctcc

SEQ ID NO: 61608 - DNA, 50 bp, homo sapien
ctttcatgttgaaaaagtctgaaacrgagaacccaatgatatttaaaata

SEQ ID NO: 61609 - DNA, 50 bp, homo sapien
cagcagaagcttttgtcagtgacccragaaattaagctgagacagcttct

SEQ ID NO: 61610 - DNA, 50 bp, homo sapien
agccaggattcaaacctaggttatcrgaataatgcagcaaagcccaaacc

SEQ ID NO: 61611 - DNA, 50 bp, homo sapien
acccgaatgaaagtagttctcagaargccagaagtagttctcagagactc

SEQ ID NO: 61612 - DNA, 50 bp, homo sapien
tgaacaatctgcaatgggttttaccrctctagcagctgtgaatccattct

SEQ ID NO: 61613 - DNA, 50 bp, homo sapien
aagggcaagaaaactacctaagacaygggaaagaaccacccaaattgcag

SEQ ID NO: 61614 - DNA, 50 bp, homo sapien
ctttctgctcctgccctgcctctaaytgatttagtaccaagcgttcaagg

SEQ ID NO: 61615 - DNA, 50 bp, homo sapien
atgagcctcaaggtatgatgcaatayggaaaaggagggaagagagtggga

SEQ ID NO: 61616 - DNA, 50 bp, homo sapien
accagcgatgattggaaaatgatacyctacatacaaaatacttacttctc

SEQ ID NO: 61617 - DNA, 50 bp, homo sapien
gtcacaaacttgggaaaagctcgtakatttgaggcagctgtccagataat

SEQ ID NO: 61618 - DNA, 50 bp, homo sapien
ccactcattctctcacgagtatccastggaattttccagaagcaatatga

SEQ ID NO: 61619 - DNA, 50 bp, homo sapien
ctccttcactgttcctacagcctacrccttttggaaacacttggtacctc

SEQ ID NO: 61620 - DNA, 50 bp, homo sapien
taggagcagccttatggaactgagcscttaacctatggggtctacgttaa

SEQ ID NO: 61621 - DNA, 50 bp, homo sapien
atgtatgtacatgtatggatataaaycaatatgctaattctaacaatcac

SEQ ID NO: 61622 - DNA, 50 bp, homo sapien
tctacccaaaacaattgattattgaraataggactctgctcatcctgctg

SEQ ID NO: 61623 - DNA, 50 bp, homo sapien
ggtaacattaaaaaatccataagtcrtttaggagcaaatctaactcatct

SEQ ID NO: 61624 - DNA, 50 bp, homo sapien
ttttgttaaatgaagacaattgaccractgtgcgtggaatcaatgtgcag

SEQ ID NO: 61625 - DNA, 50 bp, homo sapien
ttaggagagataaacagggggatacmcaatattcacaaagataaggtttg

SEQ ID NO: 61626 - DNA, 50 bp, homo sapien
tggacccccagattggaagaaggcargtttaatgttcttaatgatgggac

SEQ ID NO: 61627 - DNA, 50 bp, homo sapien
gaagatcacttgcagtctttgtttgsatatataagaactatgaatggact

SEQ ID NO: 61628 - DNA, 50 bp, homo sapien
ggatgctggtgtggcctgggccgacygagtatctgtatcagctgccgtct

SEQ ID NO: 61629 - DNA, 50 bp, homo sapien
aagaagcaacagacgaagcatctaaycttgtgaataaaatgattgattta

SEQ ID NO: 61630 - DNA, 50 bp, homo sapien
aggctcaagaaggaaaacagatgaaygatttcagtaggattcaaaaggag

SEQ ID NO: 61631 - DNA, 50 bp, homo sapien
agcatcttgtatgcagtgagtgttaygaattttctttttgttaaaatgaa

SEQ ID NO: 61632 - DNA, 50 bp, homo sapien
tctttcctcctgctaaaattttcctsaaacagaacaaaagggaaagtcag

SEQ ID NO: 61633 - DNA, 50 bp, homo sapien
gtgccaaaggtagcatagctgaaaamacaggtatctttgggtaaatttag

SEQ ID NO: 61634 - DNA, 50 bp, homo sapien
gctatgctacctttggcacctccaayagttttgctccactgaccatgcat

SEQ ID NO: 61635 - DNA, 50 bp, homo sapien
ctccttgcctataagttcttacttayccatactgtctgtatttagagttg

SEQ ID NO: 61636 - DNA, 50 bp, homo sapien
tcgtaaagctcacgtatcgcataacscagaacttctctatttaaggaata

SEQ ID NO: 61637 - DNA, 50 bp, homo sapien
tgcaaatttgagctgtagtgaaggtraaaccagggcaatattactgaata

SEQ ID NO: 61638 - DNA, 50 bp, homo sapien
aatgtgaagagaatgttccagatacyaacgggttgtgggtggtcctatcc

SEQ ID NO: 61639 - DNA, 50 bp, homo sapien
tttaggatccatattagatgatgacraaattgtagataccttaagaaaat

SEQ ID NO: 61640 - DNA, 50 bp, homo sapien
gtgagtgattagcacaggttacatcwctagtaaacaaaagaagcaatctc

SEQ ID NO: 61641 - DNA, 50 bp, homo sapien
tcaactttgactagttagagaatcayacagaaatcattataaagtgctta

SEQ ID NO: 61642 - DNA, 50 bp, homo sapien
tcataaaaatacatatatagtgaaayttaccagatcatttagaaagtttt

SEQ ID NO: 61643 - DNA, 50 bp, homo sapien
aaggctttgaacagtttaaatccagrcattccttcttggtgtttaagctc

SEQ ID NO: 61644 - DNA, 50 bp, homo sapien
tcttccttttcctatagcacaggtcycaaaagttctctccagggcctcct

SEQ ID NO: 61645 - DNA, 50 bp, homo sapien
atactttggctgaaagaaagcaaaayctttacaaagcccttggtgtttgg

SEQ ID NO: 61646 - DNA, 50 bp, homo sapien
gaaatatatgaggcaggttgttttayacggcactgtaccctttaggaaac

SEQ ID NO: 61647 - DNA, 50 bp, homo sapien
aattcaaggagtcgaaattcctaaasagagcatttttcctagagtggcag

SEQ ID NO: 61648 - DNA, 50 bp, homo sapien
tcataccatgcaccacatacagaaaycaatccaaaaaggataataaactt

SEQ ID NO: 61649 - DNA, 50 bp, homo sapien
ctttaaagcagaatcccttgtacaayggaaaactaactacaattggggac

SEQ ID NO: 61650 - DNA, 50 bp, homo sapien
ctaaacatgccctgttatgtggccamgacttactggagctcatttaaact

SEQ ID NO: 61651 - DNA, 50 bp, homo sapien
aaggctttccagaacgtagtctatgytggacacttccttctgcctctctg

SEQ ID NO: 61652 - DNA, 50 bp, homo sapien
ggtcacagaagtcatctgtgctgatygttgtagtgtgaggaatagtgtag

SEQ ID NO: 61653 - DNA, 50 bp, homo sapien
gtggcagatattgtcagatacttccraatagatcatacattttatttccc

SEQ ID NO: 61654 - DNA, 50 bp, homo sapien
gaacaaagaaattatggcacattccracaattaaatactacctagcaata

SEQ ID NO: 61655 - DNA, 50 bp, homo sapien
cgtgagtacagttctgagacaattgyatcgcttagcagtgtagatgtagc

SEQ ID NO: 61656 - DNA, 50 bp, homo sapien
accattttttgcatctttaggcaagycctgatacttaatgtcccttattt

SEQ ID NO: 61657 - DNA, 50 bp, homo sapien
atgtgtcagttttcatgatgatatakgctttaatttctctaggacaaata

SEQ ID NO: 61658 - DNA, 50 bp, homo sapien
agtaaaattaataagcatttggaaasagactatttggatataagtcacga

SEQ ID NO: 61659 - DNA, 50 bp, homo sapien
tgtgacgtttccatctggaaatgctraaataaggttcctcttccccacca

SEQ ID NO: 61660 - DNA, 50 bp, homo sapien
tccaagctcttttagcctcaacatcytcatctgcaaactaggggtttgaa

SEQ ID NO: 61661 - DNA, 50 bp, homo sapien
aatttaactctcatagcaaccttgamgcacagggagacttactcaaggtt

SEQ ID NO: 61662 - DNA, 50 bp, homo sapien
tatttacaaacacaagagttgtacargaataaacataacaaaaacataaa

SEQ ID NO: 61663 - DNA, 50 bp, homo sapien
ctcctcttagacttggctggaatacrcttctctgcattttagactctggt

SEQ ID NO: 61664 - DNA, 50 bp, homo sapien
atttttggtgctagtagtgggaattrtgatagagattaagcattaaaaca

SEQ ID NO: 61665 - DNA, 50 bp, homo sapien
tattttattatatacgtgaaaagaayacaagaacaagggaagagcctagt

SEQ ID NO: 61666 - DNA, 50 bp, homo sapien
acatatatacattatgtggctcaggyataaaaaatgataggacatgatga

SEQ ID NO: 61667 - DNA, 50 bp, homo sapien
tcaacgtccactcttgcctccaatgkatatgataatgttatggtatctct

SEQ ID NO: 61668 - DNA, 50 bp, homo sapien
tccatatattattgaacttgtccagragcgatcatcctaccaggtgctag

SEQ ID NO: 61669 - DNA, 50 bp, homo sapien
atatttagtaagctatgaattagaamcagagtagtcttttattatagttt

SEQ ID NO: 61670 - DNA, 50 bp, homo sapien
aaccacagtatctgcagacacttatkaaaggggtagtgctggtaaatgat

SEQ ID NO: 61671 - DNA, 50 bp, homo sapien
ccttaaatttcccataatttagtaaygtcataagtcaacatgaaatattt

SEQ ID NO: 61672 - DNA, 50 bp, homo sapien
aaaaatggtatcaaagtttgactaayctacagagacaaaagaaacactaa

SEQ ID NO: 61673 - DNA, 50 bp, homo sapien
aaatataaacacttaattctgttgakatgttttgattaattattcctgat

SEQ ID NO: 61674 - DNA, 50 bp, homo sapien
cctgcttcagcattgaaaaagtacaytcattaaccaactgaatacaaaaa

SEQ ID NO: 61675 - DNA, 50 bp, homo sapien
agtagaaaagcaaacaagtaaatcartgatataatttgaaaactgataag

SEQ ID NO: 61676 - DNA, 50 bp, homo sapien
agttgggagacatattcctgtcatayattatcaagtctgttggtattcaa

SEQ ID NO: 61677 - DNA, 50 bp, homo sapien
atcagatccagaatagtgtttgatgmaaagtggaatgctaataaatgttg

SEQ ID NO: 61678 - DNA, 50 bp, homo sapien
ttaaagtcccttttatcagggttaaygtgggtgatctgagtcctaaatga

SEQ ID NO: 61679 - DNA, 50 bp, homo sapien
cagagagagattcagtgtacaaaaakagctgagataccactggattcaat

SEQ ID NO: 61680 - DNA, 50 bp, homo sapien
atttcaagcttcagtttatcctctcygaatgttcacaggaaaaaaaaaaa

SEQ ID NO: 61681 - DNA, 50 bp, homo sapien
catgttaatttttcagacatgtatawctttactgaaacttcttccttgga

SEQ ID NO: 61682 - DNA, 50 bp, homo sapien
ccagctaccatgatcattttgtcatragcccattgagcaatcactatatt

SEQ ID NO: 61683 - DNA, 50 bp, homo sapien
tatgtagtttcacaataatttaatcragttgtctttcaagcaaaaaaaaa

SEQ ID NO: 61684 - DNA, 50 bp, homo sapien
ttcctctgcaccatgaggagttccargtctccggatcccacactcagctt

SEQ ID NO: 61685 - DNA, 50 bp, homo sapien
atgaagatgaacttagtgtgattagytgtaattagctgaaattaaatttt

SEQ ID NO: 61686 - DNA, 50 bp, homo sapien
gattctccctcttttaatctctcaasaaagataggcagaggaatttatta

SEQ ID NO: 61687 - DNA, 50 bp, homo sapien
tgaattttttttctaatccattgacygatggcccagaacaatataaataa

SEQ ID NO: 61688 - DNA, 50 bp, homo sapien
tggttgctgttactaagatttcctgmagatacctgaaaataaatgaaatg

SEQ ID NO: 61689 - DNA, 50 bp, homo sapien
ttactgtcctcagtgattttgcaccractctagtcttggactgagtttaa

SEQ ID NO: 61690 - DNA, 50 bp, homo sapien
aaaattcaataaaaatccataactayactcaatcacaattatgaatgatg

SEQ ID NO: 61691 - DNA, 50 bp, homo sapien
gaattgtcttcagatacacggcttgrcaacttaattatgttgcttctcaa

SEQ ID NO: 61692 - DNA, 50 bp, homo sapien
taaaatgtggctaattgccttttccrattaaggaacaatgtggaggtgag

SEQ ID NO: 61693 - DNA, 50 bp, homo sapien
atcatagcatataatacagtggtaaycatccagggctgttaggggagcta

SEQ ID NO: 61694 - DNA, 50 bp, homo sapien
tgtatttagatagcctctagcatccraaagagtaagagtgtagttactta

SEQ ID NO: 61695 - DNA, 50 bp, homo sapien
ctgacttgtgatttagcatgataaarggcctggaaaagtgggaatgaaat

SEQ ID NO: 61696 - DNA, 50 bp, homo sapien
ctcaactgaggagacagttggataarcatacctttttgaatgtccgtgac

SEQ ID NO: 61697 - DNA, 50 bp, homo sapien
gacaccaatcaacttaagtggataayaataaattcctctgcctatctttg

SEQ ID NO: 61698 - DNA, 50 bp, homo sapien
gcctcaggtcagaaggcttacccaaygtgaagcaaggtcatagggtccag

SEQ ID NO: 61699 - DNA, 50 bp, homo sapien
gttcaagtgaagcaagtagatgtcamgaattattatcccatttaataggt

SEQ ID NO: 61700 - DNA, 50 bp, homo sapien
taggaacttggagttgcatgtttacsatactattaagtgtaaaatcaaat

SEQ ID NO: 61701 - DNA, 50 bp, homo sapien
aaatgctagtatctaaagagagagaytaaagactgctagagaaatcattg

SEQ ID NO: 61702 - DNA, 50 bp, homo sapien
actgactctccaggcaggtcttaaasatatgcttcacttgaccaatttgt

SEQ ID NO: 61703 - DNA, 50 bp, homo sapien
ccttgagaaaaagaatgcaaactaaytataccatttacaagtttatatat

SEQ ID NO: 61704 - DNA, 50 bp, homo sapien
ttcaaaggaaatagaaaagaattccygaggacagataataaaaaagataa

SEQ ID NO: 61705 - DNA, 50 bp, homo sapien
aacaattttatatacctgaatgggaygtcattgttttagagcgcaatata

SEQ ID NO: 61706 - DNA, 50 bp, homo sapien
aatatgcaaagagaccataaaaaaamcaatactttagcatgattatttct

SEQ ID NO: 61707 - DNA, 50 bp, homo sapien
tctgtctttagcttgccttcttttcrctccctaaatatttcaaaggaaat

SEQ ID NO: 61708 - DNA, 50 bp, homo sapien
acactcttccctccaccactgaacasagctataaaacctagacagaatgc

SEQ ID NO: 61709 - DNA, 50 bp, homo sapien
ccagatttgtgatttataaaattacraatgattgggcttctggttattaa

SEQ ID NO: 61710 - DNA, 50 bp, homo sapien
gctttaatagcatctgggcatcagascttgttatgggccaaatcgtctcc

SEQ ID NO: 61711 - DNA, 50 bp, homo sapien
cactgggggttcctggattcctgagyagtatagaggcagggtaggaggtt

SEQ ID NO: 61712 - DNA, 50 bp, homo sapien
tcatccctccagtcataaaatacaartcagatcttaattcaagcagctag

SEQ ID NO: 61713 - DNA, 50 bp, homo sapien
atcgatttttagtaaattcaccaagscttgcaactatcaccataaatctg

SEQ ID NO: 61714 - DNA, 50 bp, homo sapien
aactaacgaattgtactttttctaaratatacgtgaattttatgcctatt

SEQ ID NO: 61715 - DNA, 50 bp, homo sapien
gggtgcgtgtgtgttaaagctccatyagtgattcttaaatgcaattaggt

SEQ ID NO: 61716 - DNA, 50 bp, homo sapien
attgcagtgatatgattgcatttgarctaccgtgtaactgtctagtcttc

SEQ ID NO: 61717 - DNA, 50 bp, homo sapien
tttaggaatcacaaacacgagagcawaaaataggcataaaattcacgtat

SEQ ID NO: 61718 - DNA, 50 bp, homo sapien
cccatgtgcaaattcaagcagagaartcaactgtacctttcacatgttta

SEQ ID NO: 61719 - DNA, 50 bp, homo sapien
aagtctattaatagctttgggaacaytgaatcaagcaaaattaagcgggt

SEQ ID NO: 61720 - DNA, 50 bp, homo sapien
tcagagaacatgccacctcaatgtakcctccagtttatgttgtaagaaaa

SEQ ID NO: 61721 - DNA, 50 bp, homo sapien
cactgctgccaaagccctggagataycagtgttagaagtttaaatgcata

SEQ ID NO: 61722 - DNA, 50 bp, homo sapien
aaaggcaatgattaaacaaggaaaaygagtggtgagtcaatattctccaa

SEQ ID NO: 61723 - DNA, 50 bp, homo sapien
tagaatgcatgtttaacttgatgcargaatacaagagaaagaatgcagtt

SEQ ID NO: 61724 - DNA, 50 bp, homo sapien
gttctgtacaattccgtgtactactkaaatgcaaattattatcagtatta

SEQ ID NO: 61725 - DNA, 50 bp, homo sapien
ttgtctacgaagctctcctattctayggctttatgatgcttttttctttc

SEQ ID NO: 61726 - DNA, 50 bp, homo sapien
gaaaaactgaaagaagatagactcasagaaggttccatctataatggttt

SEQ ID NO: 61727 - DNA, 50 bp, homo sapien
cccataccccattgatgaatgcttakgtcatttccaatctttgttattac

SEQ ID NO: 61728 - DNA, 50 bp, homo sapien
tccatgatttttgttaatggtaacayctgacctcttacaagcactataaa

SEQ ID NO: 61729 - DNA, 50 bp, homo sapien
ggcctggggctgaaagtcaccagttrccagagctgcaaattttttaatgt

SEQ ID NO: 61730 - DNA, 50 bp, homo sapien
cctccttcaaactgaagagacataaygacttgtggaattcagcatcaaat

SEQ ID NO: 61731 - DNA, 50 bp, homo sapien
acctagttacttcacagaaattttayggaaggcattggatttttcattaa

SEQ ID NO: 61732 - DNA, 50 bp, homo sapien
gattctttataataaactccaaatckaggacaatccttaactagtaccta

SEQ ID NO: 61733 - DNA, 50 bp, homo sapien
caactagtaatgcaatacagaatcawccataccgattgtttccaagtgcc

SEQ ID NO: 61734 - DNA, 50 bp, homo sapien
atgtgacaacataaataaaccttgargcatatgtgacaacatgaataaac

SEQ ID NO: 61735 - DNA, 50 bp, homo sapien
tagttttatttatcaacttatacctrtcatatagcacagcatctggcaca

SEQ ID NO: 61736 - DNA, 50 bp, homo sapien
agtttttatgtgtaacatattttcayggtgaatttttataaattttattt

SEQ ID NO: 61737 - DNA, 50 bp, homo sapien
atggtggtgaggggaaaatgggccamacctgatgtagatccctggcagtg

SEQ ID NO: 61738 - DNA, 50 bp, homo sapien
tgggtggggaaaggggagtgagaaaktatgaagttgccaatcttattagg

SEQ ID NO: 61739 - DNA, 50 bp, homo sapien
tcatcaattataatagtaaccgatayatagtaagacttcagcacatattt

SEQ ID NO: 61740 - DNA, 50 bp, homo sapien
taagtagatatcctcttaattttgargttccgtttaatcaagatggaaat

SEQ ID NO: 61741 - DNA, 50 bp, homo sapien
ccatgagaatttgtttacttacctaycactttaaagggacacagtcatgt

SEQ ID NO: 61742 - DNA, 50 bp, homo sapien
agagagttcatgcatattgttcagasacggtgctctatattgctcagatt

SEQ ID NO: 61743 - DNA, 50 bp, homo sapien
tagtcctgggcttttctttgatagaracttttcattattgatacaatttc

SEQ ID NO: 61744 - DNA, 50 bp, homo sapien
aaattttctagacacaaaatctaacyatgaacagagaatagaaaatattt

SEQ ID NO: 61745 - DNA, 50 bp, homo sapien
gttcagaagtattcaggctatgaacyggatgcatattttatcctacacat

SEQ ID NO: 61746 - DNA, 50 bp, homo sapien
ttttctccagttttgagtggatttarccaatatattttgtggggtttttt

SEQ ID NO: 61747 - DNA, 50 bp, homo sapien
agagatccaaaaatgaaagagagaaktatcttgcaagtgacttgtagggc

SEQ ID NO: 61748 - DNA, 50 bp, homo sapien
tacctaaacttatactggaatcttgyaatctatttctaatattctgatat

SEQ ID NO: 61749 - DNA, 50 bp, homo sapien
ttgtgaaaggtagagtcaatcgatayggaaaagttcattttgtcttattt

SEQ ID NO: 61750 - DNA, 50 bp, homo sapien
gaagcctcccaaaggtctttgccacrcagtcatgtaagaagttacaacat

SEQ ID NO: 61751 - DNA, 50 bp, homo sapien
tatcttcttgaggaatatctatataygcgctaaaaatccttttctaaaat

SEQ ID NO: 61752 - DNA, 50 bp, homo sapien
tgtgaattatagggtcactttatgargatcaaggaaatagatttcttaac

SEQ ID NO: 61753 - DNA, 50 bp, homo sapien
agataaccccaagctataaaatgcasgccgagtagaaaagttattaccaa

SEQ ID NO: 61754 - DNA, 50 bp, homo sapien
ttttcttaagcacatgagtgaataartgaattatatccccatagacagca

SEQ ID NO: 61755 - DNA, 50 bp, homo sapien
tatacactgcagcctggaatggggaytatagtttacttttggatcctgca

SEQ ID NO: 61756 - DNA, 50 bp, homo sapien
acctctgtggaccaggagaacgagaraatgcatagatcgaagaggggagg

SEQ ID NO: 61757 - DNA, 50 bp, homo sapien
gaagttctaagaggttacattgaccmagttagaaagctaaaaagtacaaa

SEQ ID NO: 61758 - DNA, 50 bp, homo sapien
gtggagctggtcaggtggagaatgcygagacaatgttttaaagcatattt

SEQ ID NO: 61759 - DNA, 50 bp, homo sapien
aaccaaacaggcataccactcactcwctgtaaagttcacgaataaattat

SEQ ID NO: 61760 - DNA, 50 bp, homo sapien
atgcctgcagttttcatcagtaattmcaacatggaaaacaaatctatttc

SEQ ID NO: 61761 - DNA, 50 bp, homo sapien
tttacttttttggtgtcaaaccatcrgagagaaatgtcaccatcttctcc

SEQ ID NO: 61762 - DNA, 50 bp, homo sapien
ctaagagtaatagctctgaaattcartatctagcttgcatattactgcta

SEQ ID NO: 61763 - DNA, 50 bp, homo sapien
ctaaggctagtacttcatttttagayggatttctatgaagaaaatagata

SEQ ID NO: 61764 - DNA, 50 bp, homo sapien
gcactatattaatacaggtgacatcraaggactataatccatctatcttt

SEQ ID NO: 61765 - DNA, 50 bp, homo sapien
gatgtataatgatatgactagttaayggtatcagtttgttgaaaactata

SEQ ID NO: 61766 - DNA, 50 bp, homo sapien
tcctataggggctctgcacctttcayggcctttgagttattttacaactc

SEQ ID NO: 61767 - DNA, 50 bp, homo sapien
ttgcttattcctttcagtatccttawcaataaatgtgtgtcttctttgga

SEQ ID NO: 61768 - DNA, 50 bp, homo sapien
cccatttttttttctcgacaaacccragttatctctgtagttcctaatcc

SEQ ID NO: 61769 - DNA, 50 bp, homo sapien
ataaaaatagatctttcttaaagtayctaaaatataaagctttttccttt

SEQ ID NO: 61770 - DNA, 50 bp, homo sapien
taacttttttttttagtatctgtacragtcataattttacctttttgaaa

SEQ ID NO: 61771 - DNA, 50 bp, homo sapien
taaagctccttttcaattcctcgaaygagtgacatcccaacaacattgta

SEQ ID NO: 61772 - DNA, 50 bp, homo sapien
cctaacacagaagtcagaaagaaagwaataggaggtttggaacatctctt

SEQ ID NO: 61773 - DNA, 50 bp, homo sapien
gcattttatgctacatatatcttagwattttatgatacatataaagcatg

SEQ ID NO: 61774 - DNA, 50 bp, homo sapien
atgtggcctagttgtatgtaactgayggagtataataaaataaaatccac

SEQ ID NO: 61775 - DNA, 50 bp, homo sapien
aaatatttataatagtgcctttaaartccttgttttctgatcctgacaac

SEQ ID NO: 61776 - DNA, 50 bp, homo sapien
gggtaaaagagtgggtcaaattcccraaagaaagataactgtgaggagga

SEQ ID NO: 61777 - DNA, 50 bp, homo sapien
agaaataacagtaacacaatcttcasaagtagataatatttttaaacttg

SEQ ID NO: 61778 - DNA, 50 bp, homo sapien
cacgtcgatctgtggaaatgaattcyaggctgtgcattactgagaagatg

SEQ ID NO: 61779 - DNA, 50 bp, homo sapien
attgaacaaactgtttgaataggaayctagctgtatctaacaaataataa

SEQ ID NO: 61780 - DNA, 50 bp, homo sapien
tgaacatatacaactgagaagggacrctgagaaagccctggacaaatatc

SEQ ID NO: 61781 - DNA, 50 bp, homo sapien
acatgccttatccaagaaagtttaartgattagccaatcgggactagttt

SEQ ID NO: 61782 - DNA, 50 bp, homo sapien
aatgtagcacctgtttagagaacagsaactagctctggttggcagggcta

SEQ ID NO: 61783 - DNA, 50 bp, homo sapien
ataacagtgtcctgttggcacattcrcttccagggctggggctgtgatac

SEQ ID NO: 61784 - DNA, 50 bp, homo sapien
gtattctagatattaaagtagaaaakaatttcagcatcatatttcatata

SEQ ID NO: 61785 - DNA, 50 bp, homo sapien
agctttttcttgcaaagatgaagggwactggtattggtctcatcttgcat

SEQ ID NO: 61786 - DNA, 50 bp, homo sapien
cacttcactcagctcctgaaaagcartatctacaatggattccctggcac

SEQ ID NO: 61787 - DNA, 50 bp, homo sapien
tagttccccaatttatcaattacaarggaaggactagcttcttgctgctg

SEQ ID NO: 61788 - DNA, 50 bp, homo sapien
atcacaacacatcctgaaagctaccrgaaggaggatacagtaatggagtc

SEQ ID NO: 61789 - DNA, 50 bp, homo sapien
gcaaggatttccaaactattaaaacyatcaagaaacagcagtgtaaggaa

SEQ ID NO: 61790 - DNA, 50 bp, homo sapien
ttagcaaaatgtttgtttaaagccaytagtattagtacaatagcagcata

SEQ ID NO: 61791 - DNA, 50 bp, homo sapien
atcaggaaatacttaaatatcttcaygtgtacttaagaacacaatacatt

SEQ ID NO: 61792 - DNA, 50 bp, homo sapien
aaattactaattttaagctgttgaamtagaaatttttctccttacccata

SEQ ID NO: 61793 - DNA, 50 bp, homo sapien
tgtatattttatggtaattattttgkattccagaagaatatttcagtcca

SEQ ID NO: 61794 - DNA, 50 bp, homo sapien
aagggggaagactgggaaaatacagkatagcaattagaactggatctcct

SEQ ID NO: 61795 - DNA, 50 bp, homo sapien
tgaagttaggaggagatcgatggaamatgtactactggtcttgaggagga

SEQ ID NO: 61796 - DNA, 50 bp, homo sapien
cttggccaattctgtatccctcatasaataaatcagaggtacatcgctat

SEQ ID NO: 61797 - DNA, 50 bp, homo sapien
agtgtttgataacattccaaaggcasaatacataaattcttatattatag

SEQ ID NO: 61798 - DNA, 50 bp, homo sapien
tttctgatcactttatttgtagaagragttcctagcctacatggaaagtt

SEQ ID NO: 61799 - DNA, 50 bp, homo sapien
catctggaaatacttagtggtattayaaacagttaaggagttcacccaga

SEQ ID NO: 61800 - DNA, 50 bp, homo sapien
catatgtaaatgtggacattcaaccragacaactgtactgtgacaaaggg

SEQ ID NO: 61801 - DNA, 50 bp, homo sapien
atcctgagaatgaaatgacccaatayggaaagacttttgatacatacagt

SEQ ID NO: 61802 - DNA, 50 bp, homo sapien
tgttgttcttgatcatgttttgtcayaattttgttcatttgcttcatgtt

SEQ ID NO: 61803 - DNA, 50 bp, homo sapien
ctggcacatcttccatttgggatgakgaaatctctaccacagcaggggga

SEQ ID NO: 61804 - DNA, 50 bp, homo sapien
gtgttggtagatttgtagatgtaaarttcccctcaatcatcttgaggacc

SEQ ID NO: 61805 - DNA, 50 bp, homo sapien
tgtaccctatgacatcatgtggaacrgctttccagtgctaaccgtatgaa

SEQ ID NO: 61806 - DNA, 50 bp, homo sapien
gtctcactaacatacctatttcatcygaaatccaccttcttttcttttgc

SEQ ID NO: 61807 - DNA, 50 bp, homo sapien
gctgaaggcaatgctgatgaagatcmaaatagctgtcctttcttatatac

SEQ ID NO: 61808 - DNA, 50 bp, homo sapien
gtgcctctccctagacattccagagycaacataaaacaacaacaacaaca

SEQ ID NO: 61809 - DNA, 50 bp, homo sapien
gcttgggatgctgactggtttgccarcatggtaaattgaattctagagtt

SEQ ID NO: 61810 - DNA, 50 bp, homo sapien
tatgcatgtaaaagcccttaatacartgccagccaatgcttgccattatg

SEQ ID NO: 61811 - DNA, 50 bp, homo sapien
cttgccttttatcagtatgggcaaartcttctatcagagtcttgcttgca

SEQ ID NO: 61812 - DNA, 50 bp, homo sapien
atattgcttatgtttcttcttgttaygtactagggagagactgtggtctc

SEQ ID NO: 61813 - DNA, 50 bp, homo sapien
ataatgtactaccaatatcttatcakgtttgttctttcctttaaacttca

SEQ ID NO: 61814 - DNA, 50 bp, homo sapien
gattgggtaagagaaaataaaggaakttggtaagagatggattgggaaag

SEQ ID NO: 61815 - DNA, 50 bp, homo sapien
ttaaggagtttcactctaatttaagracaatggaaaactattgttttaag

SEQ ID NO: 61816 - DNA, 50 bp, homo sapien
aggcattcttttagaaactcacagcrcatatcagccaggcgcagactctg

SEQ ID NO: 61817 - DNA, 50 bp, homo sapien
agatagcaacttctgggtctttgacyatctgctctttctccagcattatt

SEQ ID NO: 61818 - DNA, 50 bp, homo sapien
ccacactgtctcctagaagctcacarattattttcaagaactctttcttc

SEQ ID NO: 61819 - DNA, 50 bp, homo sapien
tgcatccattttctgtggatatttayactggatgttttctcgtccctctc

SEQ ID NO: 61820 - DNA, 50 bp, homo sapien
ttttgtttagcaattctaccattaayactaatttctaagcaagtcagtcc

SEQ ID NO: 61821 - DNA, 50 bp, homo sapien
tttgagtgcagaaagtctcatataaktatttactcactgtgtgttgatta

SEQ ID NO: 61822 - DNA, 50 bp, homo sapien
gattttttccttggagtctgttaatraggaatttttggaggtgtcttttt

SEQ ID NO: 61823 - DNA, 50 bp, homo sapien
acaaataaaatttgattgacattaartataagtaactggaaattattgtt

SEQ ID NO: 61824 - DNA, 50 bp, homo sapien
aatatttgatgtgaaaatggttttawacaactcagcatgaaattgactta

SEQ ID NO: 61825 - DNA, 50 bp, homo sapien
ttactacagcatctcatggttaaaamaaaaatgtactgacatgccagaaa

SEQ ID NO: 61826 - DNA, 50 bp, homo sapien
tatatgcaagagaattcaaacttacrgaaaattaatgttattcaaggtca

SEQ ID NO: 61827 - DNA, 50 bp, homo sapien
cataaattgtctcttagtttttatgrcaactctattatatgcaagagaat

SEQ ID NO: 61828 - DNA, 50 bp, homo sapien
gctcaagtatgttaacatcaagcttstaggatagtttgttgcgtgaaaca

SEQ ID NO: 61829 - DNA, 50 bp, homo sapien
aaaatagatggtgtaggaaggatgayactgaaagacacaaacactaattg

SEQ ID NO: 61830 - DNA, 50 bp, homo sapien
cgatgatgtccacaaaaatcactgamacggacaggtggacaggagcgcaa

SEQ ID NO: 61831 - DNA, 50 bp, homo sapien
gttatagataagtttccctcaaatawataactgtcactatagccactatt

SEQ ID NO: 61832 - DNA, 50 bp, homo sapien
gcctggaagtgaggcatctaattcayaaaatagtggctatagtgacagtt

SEQ ID NO: 61833 - DNA, 50 bp, homo sapien
ccttgcttccccatgcttggagcaayttctgaccagtactcaatccaaat

SEQ ID NO: 61834 - DNA, 50 bp, homo sapien
acttgatttcctcaaaatagtgcacrcccttagcagtgccttgcccagct

SEQ ID NO: 61835 - DNA, 50 bp, homo sapien
ggggaggaaggatcccatgtggaatraaccatgttaccaggacaagagag

SEQ ID NO: 61836 - DNA, 50 bp, homo sapien
gaaaatggataaatgagctgtagtayatgtataaaagagtcaaaacagag

SEQ ID NO: 61837 - DNA, 50 bp, homo sapien
cattttttacctcactcaagggtcayagtaattattaaaacagtcatcgg

SEQ ID NO: 61838 - DNA, 50 bp, homo sapien
caaacattgatttatgtgattaaaamaagtgaatgaagggcagttgagga

SEQ ID NO: 61839 - DNA, 50 bp, homo sapien
tgagccactgtgcctggctgtaatayggtgcttttctattacacaatgcc

SEQ ID NO: 61840 - DNA, 50 bp, homo sapien
cccttctatcaacacaacagtaggaraaactccagctggcatatcggtct

SEQ ID NO: 61841 - DNA, 50 bp, homo sapien
cctccatacccaacctctcttctgarcactttaaaacaaatactgtaaaa

SEQ ID NO: 61842 - DNA, 50 bp, homo sapien
gccgaaaggtttcacccacttgtagrcatagctgtggggcacatgaagac

SEQ ID NO: 61843 - DNA, 50 bp, homo sapien
acatacttccttaatttacatcttayatctcacaaatttttccagatttc

SEQ ID NO: 61844 - DNA, 50 bp, homo sapien
ttgtgtaatataatgcatttgtacawcttttaagaattatggatctgtat

SEQ ID NO: 61845 - DNA, 50 bp, homo sapien
tgctagagattctcatccaaagaacygagataactgatcatctttagata

SEQ ID NO: 61846 - DNA, 50 bp, homo sapien
tgtagatcagattgccattaaaacamtctagcttaagtattttgctatta

SEQ ID NO: 61847 - DNA, 50 bp, homo sapien
tcttttaaagtccctgtgtccccaaytacaactgaactgggtttaaaaaa

SEQ ID NO: 61848 - DNA, 50 bp, homo sapien
tgccactaagaaaatacggttggtamgcaatgaatggagacatgttttca

SEQ ID NO: 61849 - DNA, 50 bp, homo sapien
aataaaagtacaacggctgtaatacrgggataataaagtattttgatgaa

SEQ ID NO: 61850 - DNA, 50 bp, homo sapien
catttaatcataactcacttgaaatraaacatgagccattagtctagaac

SEQ ID NO: 61851 - DNA, 50 bp, homo sapien
ttactctgacgataattgcacatagragaatagttaatgattaacaacac

SEQ ID NO: 61852 - DNA, 50 bp, homo sapien
ttccagtgattgtgcaacagtttacsgaaagctaatggcttttcctatca

SEQ ID NO: 61853 - DNA, 50 bp, homo sapien
agagggtatgtattcctttttaagaycagtgtttagtataatgtctagac

SEQ ID NO: 61854 - DNA, 50 bp, homo sapien
attgaagctgacaattgcaagtaagratacagtttgcccctgtaaattaa

SEQ ID NO: 61855 - DNA, 50 bp, homo sapien
gtaataatacacaattgcagggtcaygttcatgtatagaaaaccgaaatc

SEQ ID NO: 61856 - DNA, 50 bp, homo sapien
cattcctgaaacagcagaagtatgayaaaatatgctggaaaactgcagag

SEQ ID NO: 61857 - DNA, 50 bp, homo sapien
atcactttcagcagatagaagcagakaaaatactaatacactctatgagg

SEQ ID NO: 61858 - DNA, 50 bp, homo sapien
agctaaacaagatcagaacccatctkaaaattcttgagtcagtcatcaag

SEQ ID NO: 61859 - DNA, 50 bp, homo sapien
gataaaatactaatacactctatgargctaacattatcctaataccaaaa

SEQ ID NO: 61860 - DNA, 50 bp, homo sapien
ctcaaattttgttgaacaatctatayggaaagcaatatccacctctgaac

SEQ ID NO: 61861 - DNA, 50 bp, homo sapien
gacttttgcatctatgttcttaagcratactggtctatagttttcttttc

SEQ ID NO: 61862 - DNA, 50 bp, homo sapien
aatctatacagtttcagttctgttaygagaaatgctattgcaaaaccaaa

SEQ ID NO: 61863 - DNA, 50 bp, homo sapien
ataatataaatgagaatcccatcacraattattatttctaagatatttgc

SEQ ID NO: 61864 - DNA, 50 bp, homo sapien
cctgaccatgaggaagactccggtcrccaaatggctaaaaaatctccctc

SEQ ID NO: 61865 - DNA, 50 bp, homo sapien
tatcttagcaagaaatgttgaaatamgaaacacttcggaagtgacattaa

SEQ ID NO: 61866 - DNA, 50 bp, homo sapien
tgcatttacgcacacattgcaccaartgaagctaacttatgcaccctatc

SEQ ID NO: 61867 - DNA, 50 bp, homo sapien
tgacagtgcatctgtttacagcctgrtatactgaatattttaagcctact

SEQ ID NO: 61868 - DNA, 50 bp, homo sapien
acatcagattttcagtgtagatcgamcagccttctgctggaagaagatgc

SEQ ID NO: 61869 - DNA, 50 bp, homo sapien
aaacgagagtccactgccctgaaaartaagtcctatcctaggcagcattt

SEQ ID NO: 61870 - DNA, 50 bp, homo sapien
tcccccaaattctgcgtgctcggatyttaccacatacttgtcacctccct

SEQ ID NO: 61871 - DNA, 50 bp, homo sapien
ttaccataatattttattaaggcagwcacttagcttagaaatgtgtattt

SEQ ID NO: 61872 - DNA, 50 bp, homo sapien
gctccgtcccctgccccacactgaasagttcattcttacaagtcatcacc

SEQ ID NO: 61873 - DNA, 50 bp, homo sapien
tacttttctatgaggttttaggagakaatctatttcttagccctctccag

SEQ ID NO: 61874 - DNA, 50 bp, homo sapien
agggagttaaaatgagatactaaaamattttgactagtccaaaagaagtc

SEQ ID NO: 61875 - DNA, 50 bp, homo sapien
aagtagttgcctgaagtataatctargtatgagtagaaactttcagttgt

SEQ ID NO: 61876 - DNA, 50 bp, homo sapien
atttagcgaattttttcccatggacrgattccttcttttcttttcatctc

SEQ ID NO: 61877 - DNA, 50 bp, homo sapien
acctcagacccacagcactgcatctyagaacactgcaatacagggagaag

SEQ ID NO: 61878 - DNA, 50 bp, homo sapien
ataaagaaactgtggtatatatgtaygaagaaatactactaaagctataa

SEQ ID NO: 61879 - DNA, 50 bp, homo sapien
tgacctggaaggatctgagacaggakatgcgcccattagaaggcgaggcg

SEQ ID NO: 61880 - DNA, 50 bp, homo sapien
cgatgccttcgctgctcctcatagaygtactaccaaccactggtaattat

SEQ ID NO: 61881 - DNA, 50 bp, homo sapien
cctttcatatcaatgggaacatcaaytagagaacactgattacactgtag

SEQ ID NO: 61882 - DNA, 50 bp, homo sapien
agttgcttcaaattgagcatgaaacsactcagcgtccagagcaaaggaaa

SEQ ID NO: 61883 - DNA, 50 bp, homo sapien
gactctaacagttgctgctcaatgayacctgcagacactgagttcagctt

SEQ ID NO: 61884 - DNA, 50 bp, homo sapien
catttacatctagccctaagagaaamagcgagattgttaaagagaagaat

SEQ ID NO: 61885 - DNA, 50 bp, homo sapien
gttagaattttgttcttagaataaawttacatccgtcccctggtgccagg

SEQ ID NO: 61886 - DNA, 50 bp, homo sapien
tcctgattctaagccactcttcataytaattggcaaagcatgacatatct

SEQ ID NO: 61887 - DNA, 50 bp, homo sapien
gaagtacagtatctttggaggttagycagtaattagcaccttttcctaaa

SEQ ID NO: 61888 - DNA, 50 bp, homo sapien
cattttgcaacaatataacttacaarctcattacagttatatatcccact

SEQ ID NO: 61889 - DNA, 50 bp, homo sapien
tgctgcactggctgggacctctctcrcaaagttagaaaggagtgttgtca

SEQ ID NO: 61890 - DNA, 50 bp, homo sapien
tactgagaatctgacccaaaccacaygaacctcagagacagcctgggatg

SEQ ID NO: 61891 - DNA, 50 bp, homo sapien
agtccctcagagactcggcatcaaaygttctataaaaagcaatttttcaa

SEQ ID NO: 61892 - DNA, 50 bp, homo sapien
atcttgcagagttgctgtgaatagckaagaaaaatgcaagcgacttcagg

SEQ ID NO: 61893 - DNA, 50 bp, homo sapien
cccttttaagcccttctctcagttgkataaaatctgttctgctgtgggtg

SEQ ID NO: 61894 - DNA, 50 bp, homo sapien
atccctggggacctctggcccttggkaacctctcagtaccatcacagagg

SEQ ID NO: 61895 - DNA, 50 bp, homo sapien
gcttgtggaggaagagttctgggcaygtccagtgtttaagattcatggct

SEQ ID NO: 61896 - DNA, 50 bp, homo sapien
cagaaagggggagcaactgggccaargttcatcaggtagtaagtggcaga

SEQ ID NO: 61897 - DNA, 50 bp, homo sapien
acgccccctttgaagcctcagaacaygattgcaaatgacacctgtgacgt

SEQ ID NO: 61898 - DNA, 50 bp, homo sapien
tcctgtatttcatttgagcagcattsaaagtctctgcctttcctagctgc

SEQ ID NO: 61899 - DNA, 50 bp, homo sapien
tcaaaggtgtgattaaggtacctatraaatccactttgatgtaacataaa

SEQ ID NO: 61900 - DNA, 50 bp, homo sapien
agtttgtatttgaaaggtttgaatargtttttcagaccacggttctacaa

SEQ ID NO: 61901 - DNA, 50 bp, homo sapien
aaaactcaatcaatacattcgaaacrcagatattttgcttactgaggctt

SEQ ID NO: 61902 - DNA, 50 bp, homo sapien
ctacctcatggggtgattatagggarcaattaagaagaaggcgtgaaaat

SEQ ID NO: 61903 - DNA, 50 bp, homo sapien
tcacaaccctctccaagggacaggcygataagaattttggttgcttctag

SEQ ID NO: 61904 - DNA, 50 bp, homo sapien
atgctttccaatgacatcttgtgttyatgatattctgtcttcatagtcac

SEQ ID NO: 61905 - DNA, 50 bp, homo sapien
gaaagaattgtttgggatgttcagasaaggacatctttattgaagcagct

SEQ ID NO: 61906 - DNA, 50 bp, homo sapien
ttttgtggtgcttctgttgaaaacckaaatcccctcctgaataaaaggga

SEQ ID NO: 61907 - DNA, 50 bp, homo sapien
cctgagaatcgaatgacttaagatcmatcctggcttccccgccggctgaa

SEQ ID NO: 61908 - DNA, 50 bp, homo sapien
agcacattctatcaaaatccagtatracaaagtacaccttcttcttaaca

SEQ ID NO: 61909 - DNA, 50 bp, homo sapien
aagtattctgattctgcggggattasagttttgaagtgttattctgtcat

SEQ ID NO: 61910 - DNA, 50 bp, homo sapien
atgaagcctaggaaaccatagacacygatgtatcgccagcataaaagaac

SEQ ID NO: 61911 - DNA, 50 bp, homo sapien
aaatgcatttaaagactacttacacsaagggcattatcattatacccaaa

SEQ ID NO: 61912 - DNA, 50 bp, homo sapien
ggggaaatctgcgtcacatgggcgayagaaggtccctcgaatccctcaat

SEQ ID NO: 61913 - DNA, 50 bp, homo sapien
ctccaggaatgaggcctaggccccargagattccaacatgttctcaaggt

SEQ ID NO: 61914 - DNA, 50 bp, homo sapien
ttggatgcaggcttccatttcattaracaagaatagggcccaaatatttt

SEQ ID NO: 61915 - DNA, 50 bp, homo sapien
gtacctacagtgagaaaagcaaggastcatcaacacaatcagaaactcac

SEQ ID NO: 61916 - DNA, 50 bp, homo sapien
aagacaacatagaagttatggagacsaaagtaggtgaagaatctttagga

SEQ ID NO: 61917 - DNA, 50 bp, homo sapien
atgagaactgaataatctttgcctgraatggcattacactctagaatttc

SEQ ID NO: 61918 - DNA, 50 bp, homo sapien
tagatgcaaatggtaaaagtgaataraggtcggggagtggagaaggtggc

SEQ ID NO: 61919 - DNA, 50 bp, homo sapien
ctttgctatgcttctgatttgagacraagatactgtaatgttttgtgctt

SEQ ID NO: 61920 - DNA, 50 bp, homo sapien
tcatccatactcatattcaacataayagtggaagtactagccagtgtaat

SEQ ID NO: 61921 - DNA, 50 bp, homo sapien
ctttgtatacattactgtcaagtttyttattccatgtttaatcctaaaga

SEQ ID NO: 61922 - DNA, 50 bp, homo sapien
agaggcacaaaagtggataaaaaccyaatagtgcagacctggagctaggc

SEQ ID NO: 61923 - DNA, 50 bp, homo sapien
gtcgcagaattcattagaggacatcrgagttgttgcgtggtggttcctgt

SEQ ID NO: 61924 - DNA, 50 bp, homo sapien
tttgattaactttgatgccataattscttagtttggagtcatctgatgtt

SEQ ID NO: 61925 - DNA, 50 bp, homo sapien
ttctagatttttttcctttacctcartgaatcatctacatatcgcacact

SEQ ID NO: 61926 - DNA, 50 bp, homo sapien
cagttaccatgctaaatagaaacaaygcaaaaggtttaggcaaaataaca

SEQ ID NO: 61927 - DNA, 50 bp, homo sapien
taataataataggaacacacattggrcaatcctaaatacaccacttattc

SEQ ID NO: 61928 - DNA, 50 bp, homo sapien
cgtcttccctttataccacaatttcyaaaagtcattgattcccaccacat

SEQ ID NO: 61929 - DNA, 50 bp, homo sapien
ggcttctgctggttgaaattacaggwataagtggtgtatttaggattgtc

SEQ ID NO: 61930 - DNA, 50 bp, homo sapien
ttaaggtttaaaatattgatcttccwatgaaatagctctcatcggtacaa

SEQ ID NO: 61931 - DNA, 50 bp, homo sapien
aacctaacagagcaataaatcaaaasagggtaacattttagacaggaaga

SEQ ID NO: 61932 - DNA, 50 bp, homo sapien
gtttttccttgtagctttttttgtgygagcctctgagattttttttcctt

SEQ ID NO: 61933 - DNA, 50 bp, homo sapien
aggacaggagcacttcctaccacaaytggtccttcttttgtctttaactt

SEQ ID NO: 61934 - DNA, 50 bp, homo sapien
cggccacctgctccactgtactcggmaaacacacaactacattttgtttg

SEQ ID NO: 61935 - DNA, 50 bp, homo sapien
aacaagaaagttatttaaaaaaacaracttcacaagagattatggatgtt

SEQ ID NO: 61936 - DNA, 50 bp, homo sapien
tcctggctgccgtctctccgggatcrcagttggctggaaggaagggtctg

SEQ ID NO: 61937 - DNA, 50 bp, homo sapien
tcttttttaattgaatgaggagtagraaatctgaccattttagtggactt

SEQ ID NO: 61938 - DNA, 50 bp, homo sapien
taggactaagcagagacaacatcccragaaactaatgtcatgctagaata

SEQ ID NO: 61939 - DNA, 50 bp, homo sapien
aacctcagcctgttttagcctttcarcattcgagaaagatgtttttccaa

SEQ ID NO: 61940 - DNA, 50 bp, homo sapien
tgaaaaagttggcctatatttatccyatttgtaagtggtagttcttgagc

SEQ ID NO: 61941 - DNA, 50 bp, homo sapien
ttggagttaagcattttgagattcasattctaccttgctcaagaactacc

SEQ ID NO: 61942 - DNA, 50 bp, homo sapien
atcttaatttgcagtaagtgggtaaytcgagaaagaaggacatgaccttt

SEQ ID NO: 61943 - DNA, 50 bp, homo sapien
tttctatctcttccttaggaaactgsatagattaatgcacaagcaaggaa

SEQ ID NO: 61944 - DNA, 50 bp, homo sapien
gaaactggatagattaatgcacaagyaaggaaagagattcctgtcctcct

SEQ ID NO: 61945 - DNA, 50 bp, homo sapien
acaagttggctttgctggaagttttrtaagaaatcagattgaacttttaa

SEQ ID NO: 61946 - DNA, 50 bp, homo sapien
ccacttagtactcgttgaggatgaayagataatgacacggaaataaagat

SEQ ID NO: 61947 - DNA, 50 bp, homo sapien
taaaagtcaaacatcaacattagtastaactctggcattgtagcgatatc

SEQ ID NO: 61948 - DNA, 50 bp, homo sapien
ccacttgagaggccctgagtgagaamtgtcaaattgaactatgtctgcct

SEQ ID NO: 61949 - DNA, 50 bp, homo sapien
atgagatagttatagtcctaactttmaaaagagaaaatgtaacataggac

SEQ ID NO: 61950 - DNA, 50 bp, homo sapien
ctgtcagtgggaatgttgtgaagtawgtgtttgttaagagtgaagcatat

SEQ ID NO: 61951 - DNA, 50 bp, homo sapien
gtcaggattacagggaaattacaaasacttacatggaaaaattaagcaaa

SEQ ID NO: 61952 - DNA, 50 bp, homo sapien
tatactcaaaatacctttgtctgaargagcgacaggagcatctacggttg

SEQ ID NO: 61953 - DNA, 32 bp, homo sapien
tagttgcccatggatgyaagcattaattcatg

SEQ ID NO: 61954 - DNA, 50 bp, homo sapien
tctgctgttgttttttggatgttcawtacacttcaattagacacagttgg

SEQ ID NO: 61955 - DNA, 50 bp, homo sapien
ctagtcctctcgaaagttaaacataytataaagcaatagtagccaaaatg

SEQ ID NO: 61956 - DNA, 50 bp, homo sapien
gtgtttgtaacttcattttcaaaaargtcattagaggctgggtagacatg

SEQ ID NO: 61957 - DNA, 50 bp, homo sapien
tctagtcatctgctaatcatcaattraatgaatcgctaattctcagttac

SEQ ID NO: 61958 - DNA, 50 bp, homo sapien
ggatttcatcagcctcctgtccatcmagaggtatgttttgctttcccatc

SEQ ID NO: 61959 - DNA, 50 bp, homo sapien
agagaacaacaagtagtgtaagtccygaaataaggatacctacttctcac

SEQ ID NO: 61960 - DNA, 50 bp, homo sapien
atacacagcctaacagtgaggaacaktcagatcgtctctaatatcatagg

SEQ ID NO: 61961 - DNA, 50 bp, homo sapien
ttccttgtgaatgattccagtcttcscggtcggttcaggagaaagaaaaa

SEQ ID NO: 61962 - DNA, 50 bp, homo sapien
ttcattcatgcacttgaagggcttaratcaacactttacacattctgagg

SEQ ID NO: 61963 - DNA, 50 bp, homo sapien
tgtctcttgttgactttaggaatccyggaatgtggccctaggaaggaaaa

SEQ ID NO: 61964 - DNA, 50 bp, homo sapien
acgttactttccagaggaagagatgsagacttcatagacctatttaagta

SEQ ID NO: 61965 - DNA, 50 bp, homo sapien
acaaccattccttcacaattagaacraattcatcagccataatgctgtag

SEQ ID NO: 61966 - DNA, 50 bp, homo sapien
accagcaccatttctgatgagtagamccacagcataagctagtaaactgt

SEQ ID NO: 61967 - DNA, 50 bp, homo sapien
tctgtactacttactatttctattayggcaacttctttgaagaaggcatt

SEQ ID NO: 61968 - DNA, 50 bp, homo sapien
aactccttgtgggaaagtgcactaamgatgctgagtacaaaaactttgta

SEQ ID NO: 61969 - DNA, 50 bp, homo sapien
tgttcccttaacattgatcatgaacractttccttacattcgatatgttc

SEQ ID NO: 61970 - DNA, 50 bp, homo sapien
ctgaatagttgcaatagaattcaaaytttacattcagtcatttctactag

SEQ ID NO: 61971 - DNA, 50 bp, homo sapien
caagccatcatattgtattacaagayggatttcggcagaatattgttaag

SEQ ID NO: 61972 - DNA, 50 bp, homo sapien
aatgaaggtcagaatctgcctgataygtataaaatgtcttattataaaag

SEQ ID NO: 61973 - DNA, 50 bp, homo sapien
cttaggatcatcactaaacataaaaygatacacaaaccaagtggctacca

SEQ ID NO: 61974 - DNA, 50 bp, homo sapien
actgtctaatctagaccctgaatacygaaaaggctctctccctgacctga

SEQ ID NO: 61975 - DNA, 50 bp, homo sapien
tgcatatggatgcatgttataggtaygtgatatttgtgtgcatgtgttgt

SEQ ID NO: 61976 - DNA, 50 bp, homo sapien
gaaagttgagaggataactggctcaygttaaacaaagtttatgggaagcc

SEQ ID NO: 61977 - DNA, 50 bp, homo sapien
ttaactcatattcaagcaagtaatcmgatcgtctactggatctaacattc

SEQ ID NO: 61978 - DNA, 50 bp, homo sapien
cctaaatatgctctgcaaggaatttkcccaacaaaggcacttctctagtt

SEQ ID NO: 61979 - DNA, 50 bp, homo sapien
cctctgagtctagacaggctcggagrcaagagtacatggcttgagtgact

SEQ ID NO: 61980 - DNA, 50 bp, homo sapien
catcactttgctaacattcccttcgycaaaatgagttaagtgtccagctt

SEQ ID NO: 61981 - DNA, 50 bp, homo sapien
accaaactgctggcaccatggctccraggatttatctcaggttttgaatc

SEQ ID NO: 61982 - DNA, 50 bp, homo sapien
cattttctcagcagtcctatgtaacyggggcaacaatcagtagtaattct

SEQ ID NO: 61983 - DNA, 50 bp, homo sapien
cctctaccctagaatgactcaagccyatttctagttttacgtattagttc

SEQ ID NO: 61984 - DNA, 50 bp, homo sapien
aggtgctcttaactcaaggataattraagcatgagctcaggctcagagag

SEQ ID NO: 61985 - DNA, 50 bp, homo sapien
tatgaacccacagcatctgccctacyatctgctccaatactaaccctgtc

SEQ ID NO: 61986 - DNA, 50 bp, homo sapien
gcctaaaaattcttgaaaacgggtcraagtggagagaatgggaggatgag

SEQ ID NO: 61987 - DNA, 50 bp, homo sapien
gacaaatttatcaagcatcttcaaartatacagtactagtctaagcatta

SEQ ID NO: 61988 - DNA, 50 bp, homo sapien
tcttgcactgttgtcacttggttcartcagagcacctgagaaggctgttc

SEQ ID NO: 61989 - DNA, 50 bp, homo sapien
aagagaaaaagataagattactcaaygatagagatgaattaaggtaaatt

SEQ ID NO: 61990 - DNA, 50 bp, homo sapien
ctcacatcagacgtttatctataggsacatctgtgacttcatggcccatg

SEQ ID NO: 61991 - DNA, 50 bp, homo sapien
atgtatgcttccttgatttctcttgygtctgcagtcatgcatctaatata

SEQ ID NO: 61992 - DNA, 50 bp, homo sapien
tctattttgttttgccatttaggtcwctttttaatctttaacttgtagtt

SEQ ID NO: 61993 - DNA, 50 bp, homo sapien
ccttgaggaagaaggaaaaggcatcrcttgagggcatgtgacaagtgctc

SEQ ID NO: 61994 - DNA, 50 bp, homo sapien
cgtagatggtgattctaaggagaacrcttgtctctttttatattaatctc

SEQ ID NO: 61995 - DNA, 50 bp, homo sapien
tagaaagcttagacgctgctggatayagatatgtaaaagtgtgagtcaga

SEQ ID NO: 61996 - DNA, 50 bp, homo sapien
tttttaacaaagtacttatgccagaygagacatagttgatataatattaa

SEQ ID NO: 61997 - DNA, 50 bp, homo sapien
ctctgcttctcaaggttgactcttcyacattctatgggacattaagtccc

SEQ ID NO: 61998 - DNA, 50 bp, homo sapien
tgtaatgttgcttttctggtgacacygcacaatacatctacaaattaaga

SEQ ID NO: 61999 - DNA, 50 bp, homo sapien
ttgcacactgttatgaatataaggawactcactatagtgtaaaccagcat

SEQ ID NO: 62000 - DNA, 50 bp, homo sapien
tcccgtttgctgaaaacctaccttaragactggaacttgataatgacata

SEQ ID NO: 62001 - DNA, 50 bp, homo sapien
aaattcatgctcatctttaatatackgttagtgtgtgagtagaaattttt

SEQ ID NO: 62002 - DNA, 50 bp, homo sapien
agggcaaaaagcatgtctaatcaccyatctagtctcaacatctagtgcca

SEQ ID NO: 62003 - DNA, 50 bp, homo sapien
ataataatagcaatgaataagctgasgtactttaaaggaaggagaattaa

SEQ ID NO: 62004 - DNA, 50 bp, homo sapien
taacattgaagttgttctgaagatarcctattcagtggattagaaatata

SEQ ID NO: 62005 - DNA, 50 bp, homo sapien
ccctttcaaaatactttttcctccamatgactccataagatagacaaggt

SEQ ID NO: 62006 - DNA, 50 bp, homo sapien
atgctttttactatagatagtttccmagggacgacttaggacttttcaag

SEQ ID NO: 62007 - DNA, 50 bp, homo sapien
agacatcagcttgcctctatagtaarggtcatacttgctaaatcagattt

SEQ ID NO: 62008 - DNA, 50 bp, homo sapien
cgctagagagaaaccagttggtaaartgttgtctgcaggtaatgctcggt

SEQ ID NO: 62009 - DNA, 50 bp, homo sapien
gtccaaattatttgtccaacagcacrtagttaatatgaagtagagctaga

SEQ ID NO: 62010 - DNA, 50 bp, homo sapien
acacacaaatacacacttcagttcaygctataaaatgttataaaatgtgt

SEQ ID NO: 62011 - DNA, 50 bp, homo sapien
gttattgattgtgaggaggtatatgmaattattgtgagggaaatagcaga

SEQ ID NO: 62012 - DNA, 50 bp, homo sapien
ccaagagcgctggaaaaacctgagasagaatgtcagagaccaaatagctc

SEQ ID NO: 62013 - DNA, 50 bp, homo sapien
taaatatgctcatcttggggcaggaygttctccttctgtaagtctctaga

SEQ ID NO: 62014 - DNA, 50 bp, homo sapien
atctaaaatgagattcattacaaaartgtatgttaataaagaacaccatt

SEQ ID NO: 62015 - DNA, 50 bp, homo sapien
tggacacaacactgtgaagatttaastccaagagaacaaagccagaggaa

SEQ ID NO: 62016 - DNA, 50 bp, homo sapien
acatataaatatctgatgaataggayacaaaatgtgaaatcatctgagta

SEQ ID NO: 62017 - DNA, 50 bp, homo sapien
cgagaaagaacttgaccaagatcctkacgttgcccagggctgcctggcgt

SEQ ID NO: 62018 - DNA, 50 bp, homo sapien
cgaaagcatagctgacgtgataagayatacaaacaaaattaatgggataa

SEQ ID NO: 62019 - DNA, 50 bp, homo sapien
gaagctaaacgaggctagagatgagycaccagatgtccaggggacaaagt

SEQ ID NO: 62020 - DNA, 50 bp, homo sapien
taataaacttgctttcacttaaaaarttttcattgcattattgatgactt

SEQ ID NO: 62021 - DNA, 50 bp, homo sapien
ggtaccatgttcaataaatcactgargacagaagtatactcaatcctctt

SEQ ID NO: 62022 - DNA, 50 bp, homo sapien
actgagtattgggaacgcccaagaamgtttgaagcccttgtctcatttaa

SEQ ID NO: 62023 - DNA, 50 bp, homo sapien
atacacacatcaaaacaccctaagaratgccttcctgtgtgtacataaat

SEQ ID NO: 62024 - DNA, 50 bp, homo sapien
gtgtacatttgagtgtgaggtagtaygtttctgcatgttagtgtgtgcat

SEQ ID NO: 62025 - DNA, 50 bp, homo sapien
acacgatgatctgaatatttagagaraaaccttacagaactaaggtagta

SEQ ID NO: 62026 - DNA, 50 bp, homo sapien
atagttggctggttttctcagctagrtttcaactagagagccaggataag

SEQ ID NO: 62027 - DNA, 50 bp, homo sapien
atatctgaagtcccattttgattgcyagctccacaaacatatattagggc

SEQ ID NO: 62028 - DNA, 50 bp, homo sapien
aggattttgccagctctgaaaagttyaaaattttgctacaccactacatt

SEQ ID NO: 62029 - DNA, 50 bp, homo sapien
aaagtgagagaagccagcacatatgyaacaagaagcggctggtctgcttg

SEQ ID NO: 62030 - DNA, 50 bp, homo sapien
tatttcagtcattaagaagatatgaktataagtctgtacttacttgtgat

SEQ ID NO: 62031 - DNA, 50 bp, homo sapien
tatccacaagtatctgcagttcaaartcagatgtatcaaacttcaacatt

SEQ ID NO: 62032 - DNA, 50 bp, homo sapien
gtggatttccagaagctaaaaatgayaacgggcttttattaggaacccaa

SEQ ID NO: 62033 - DNA, 50 bp, homo sapien
agccaggctttggagtcactcattcmgggttagaatcatggttctgtcat

SEQ ID NO: 62034 - DNA, 50 bp, homo sapien
gcattctgaacaccatctcaaagacsagtggtactaaaatcttagttacc

SEQ ID NO: 62035 - DNA, 50 bp, homo sapien
ccacacccctcttatcacgagtcctrcgggaaaccagctgcctatgggta

SEQ ID NO: 62036 - DNA, 50 bp, homo sapien
agaatctagagtgttaaagctgaaaragacacagtaagttgtccagagcc

SEQ ID NO: 62037 - DNA, 50 bp, homo sapien
gggagaacatcgtaagcaattatgcmaacacattaaataaaggaaaagag

SEQ ID NO: 62038 - DNA, 50 bp, homo sapien
aattactataacaaacctttatatcycaacattataaatcagtagtcctc

SEQ ID NO: 62039 - DNA, 50 bp, homo sapien
caagatgtctacctccatactttcakgtaattactctcacaactctggtt

SEQ ID NO: 62040 - DNA, 50 bp, homo sapien
aaatttcaagagaattgatagatacyacctaaacaaagctaggttctgct

SEQ ID NO: 62041 - DNA, 50 bp, homo sapien
tactttacattcgcctattttaccaygggttacagacaagaacaaattgg

SEQ ID NO: 62042 - DNA, 50 bp, homo sapien
gtcacactctttcctatgcttagaamtcagaagctcctcttactgtctat

SEQ ID NO: 62043 - DNA, 50 bp, homo sapien
cctaatttaagggtatgctgactaaktacagacagcatttataaggtaaa

SEQ ID NO: 62044 - DNA, 50 bp, homo sapien
ggtaataataatcttgaaattgtaayggagtttttcatatctttaaggtg

SEQ ID NO: 62045 - DNA, 50 bp, homo sapien
gtgaatatatgttgcaatgataaaawctgttggaatcattatgcagacag

SEQ ID NO: 62046 - DNA, 50 bp, homo sapien
ctgctgtgaatctattacctgtaacyggtccttgtctcctctaagcctgt

SEQ ID NO: 62047 - DNA, 50 bp, homo sapien
gttttgtttgcactgccacggtttaygttttcacaccacaatcagaaata

SEQ ID NO: 62048 - DNA, 50 bp, homo sapien
gtctggttcaactgttacctcaagasaagagggtcaatctcccctcaact

SEQ ID NO: 62049 - DNA, 50 bp, homo sapien
aatattttccatcgaggtatgtgatwaatatacaatttaaaatttttaat

SEQ ID NO: 62050 - DNA, 50 bp, homo sapien
actctttcctttaagacaataaagargttatagggattggagacctttat

SEQ ID NO: 62051 - DNA, 50 bp, homo sapien
gtaatctatgtataaatgcttcttartaaaattgtgtcattccatgattt

SEQ ID NO: 62052 - DNA, 50 bp, homo sapien
gacctaactgtcactactggagttcratatggcccccaaaagagcaccct

SEQ ID NO: 62053 - DNA, 50 bp, homo sapien
ctcagtgctgtattctggattttctsaacgctaacttcctgtttactaat

SEQ ID NO: 62054 - DNA, 50 bp, homo sapien
tttttgcttgccacaagtcttgaatracaagtaacaaacatctatttaga

SEQ ID NO: 62055 - DNA, 50 bp, homo sapien
ctaacttctaatgagcttcaacccaytctctaaaatgtcatgcctcgtgt

SEQ ID NO: 62056 - DNA, 50 bp, homo sapien
gccatcaatggcatgagatgtttatsaggtcccactaattttgaagactt

SEQ ID NO: 62057 - DNA, 50 bp, homo sapien
cttaatgtgatctgctgttaatgaawacttagaatacaacccaattatag

SEQ ID NO: 62058 - DNA, 50 bp, homo sapien
aagcacttgcagttcaatcacctcawctttttttgttgttccttatgcga

SEQ ID NO: 62059 - DNA, 50 bp, homo sapien
gaccactgattgatctaatggattgsagtgtatatgaggaaggcttcagg

SEQ ID NO: 62060 - DNA, 50 bp, homo sapien
gaaggtcatgacctgggagctccaaytcttccctttattttaccttattt

SEQ ID NO: 62061 - DNA, 50 bp, homo sapien
atgcttattgattgcttgaaagtctragaaagaatatgcaggactgagga

SEQ ID NO: 62062 - DNA, 50 bp, homo sapien
ggtctagcttggaatgggaaaagcaytgaagctcgaaagtggtaaagaaa

SEQ ID NO: 62063 - DNA, 50 bp, homo sapien
agtgagaagccttgactctataatckctaagttcccttcttatccttaac

SEQ ID NO: 62064 - DNA, 50 bp, homo sapien
gccaaaaggctgagaaatgatcaggytaaatcgccaggtcaggcttgatg

SEQ ID NO: 62065 - DNA, 50 bp, homo sapien
gtagtcccaacatcccagtaaagaamcatgcatacagaaggcgattggag

SEQ ID NO: 62066 - DNA, 50 bp, homo sapien
gatgaatttaaacaaattattcaaarttcaatatgaaataggttggagac

SEQ ID NO: 62067 - DNA, 50 bp, homo sapien
tctccttaccatcacgatacttatckcgtttccatcataacttccgtgta

SEQ ID NO: 62068 - DNA, 50 bp, homo sapien
aataaatttagtacaaattgtggttsttgaattgtctaaattgactttct

SEQ ID NO: 62069 - DNA, 50 bp, homo sapien
gttctggttgctctgaataggactarctactttgttttttactgaaggac

SEQ ID NO: 62070 - DNA, 50 bp, homo sapien
aataataaactgtcaaccaactttaraaatgactgaatccctttcctcat

SEQ ID NO: 62071 - DNA, 50 bp, homo sapien
gtaacagaggaagagactgaaaattraacaccaacatttacagcctaaac

SEQ ID NO: 62072 - DNA, 50 bp, homo sapien
ctggttttctccaagcttttaatggkaagcataaatgtttgggatcagct

SEQ ID NO: 62073 - DNA, 50 bp, homo sapien
tgtgcatagcagcacggttgacaatmaccaagacatagaagtgactaaat

SEQ ID NO: 62074 - DNA, 50 bp, homo sapien
ggaggactaaaggtggctatgtagasccggttcgcagtcaagctgagctg

SEQ ID NO: 62075 - DNA, 50 bp, homo sapien
ccttgttattttctctagacattacyggactcactaacgcagtggcccga

SEQ ID NO: 62076 - DNA, 50 bp, homo sapien
ctacccaacccagccttaggcaatcwctaatgtactttctgtctctttga

SEQ ID NO: 62077 - DNA, 50 bp, homo sapien
agaatccttgaattcatgaacctagrctaggacttgacaaactgtagctc

SEQ ID NO: 62078 - DNA, 50 bp, homo sapien
gaatctcactgtgttctctcttaccyggggtcctttagcatgtcaccttc

SEQ ID NO: 62079 - DNA, 50 bp, homo sapien
acagccatacgcacttgtttatatayagtctgtggctccttccactctat

SEQ ID NO: 62080 - DNA, 50 bp, homo sapien
aaaatacctgtttcggagaatgaacyataaaactatccggagtgggtcgg

SEQ ID NO: 62081 - DNA, 50 bp, homo sapien
acaaataccagaggaacttcctgaaygtttagatcctgaaaaactgtttt

SEQ ID NO: 62082 - DNA, 50 bp, homo sapien
caaatcaaaatctgtaatcttcttakagagacataactttgggtatatac

SEQ ID NO: 62083 - DNA, 50 bp, homo sapien
atactattctgcatagtccattaccyatatatctgtggttaatatctctg

SEQ ID NO: 62084 - DNA, 50 bp, homo sapien
agtgggactggggtgcctccataggraagacgccatttcagcaaagtctt

SEQ ID NO: 62085 - DNA, 50 bp, homo sapien
ctaggacctgctgcaagaattactaygcactcaagttctctgcacactga

SEQ ID NO: 62086 - DNA, 50 bp, homo sapien
cctttgactcccggaggtattagcasagtatcttgctgtgtacctcatta

SEQ ID NO: 62087 - DNA, 50 bp, homo sapien
aacaaaattagaattcaaataccaaytgtagagagatatgaatgagccaa

SEQ ID NO: 62088 - DNA, 50 bp, homo sapien
gtctggaagaggtaaagggaaaagcrgcagtctctggaggatgtgtgtaa

SEQ ID NO: 62089 - DNA, 50 bp, homo sapien
ttaatagtgagaatatcaaaatagcmcttagagtacaataatcatgtaat

SEQ ID NO: 62090 - DNA, 50 bp, homo sapien
cctatatttaatgtaactggttggcrctattcaggtcaaagtcaatttaa

SEQ ID NO: 62091 - DNA, 50 bp, homo sapien
ttacagaggtaagttttgcaacagaraaaagtcaatataatgtgaaaact

SEQ ID NO: 62092 - DNA, 50 bp, homo sapien
tgggaatatctgtctcggaataccartgagaatataccttcagaaatcac

SEQ ID NO: 62093 - DNA, 50 bp, homo sapien
gggtgtagaattatgcaacgtttgarcaacacacacaaattgtgtttacc

SEQ ID NO: 62094 - DNA, 50 bp, homo sapien
gcattttaaaaagtgggaatgtaacmatgttggactctttcttacaatac

SEQ ID NO: 62095 - DNA, 50 bp, homo sapien
ctatctctttctttcgtgttcttaasggccaaacacttctcggtgatgaa

SEQ ID NO: 62096 - DNA, 50 bp, homo sapien
ttcatcatatgaggttccttagtcartaatttccaatagctttcatgtga

SEQ ID NO: 62097 - DNA, 50 bp, homo sapien
ctcatagtctgctgtgagtgacctaygggccccaggacaaaatacagttc

SEQ ID NO: 62098 - DNA, 50 bp, homo sapien
tgggcctcttggactgcaccagatargctatgctaacaatgtgatttatg

SEQ ID NO: 62099 - DNA, 50 bp, homo sapien
gacaacatctattaatcctccagcaktaaaattagtcaattacctacttt

SEQ ID NO: 62100 - DNA, 50 bp, homo sapien
ggattcattagttatgacttatagcrcttagtttaatacccactcttttc

SEQ ID NO: 62101 - DNA, 50 bp, homo sapien
tagaattatgctgttgcagatacaaractgtttatgtcctgaaagaaatt

SEQ ID NO: 62102 - DNA, 50 bp, homo sapien
atacagctagtgctttagatgttcasagctttgagggagcgacagggaat

SEQ ID NO: 62103 - DNA, 50 bp, homo sapien
agaaaaatgaaagtcatgaaggcacmatatatttttggagcttgtctgta

SEQ ID NO: 62104 - DNA, 50 bp, homo sapien
ttacgactaacgcttatatgcttccratttttaaatgtccaagtccacat

SEQ ID NO: 62105 - DNA, 50 bp, homo sapien
attatttcaaattaaggcatcataasttattaacagtgattttagcagcc

SEQ ID NO: 62106 - DNA, 50 bp, homo sapien
gttgtgcaatgagccaattaatgcawgagtctaagaagtgaccagttgtg

SEQ ID NO: 62107 - DNA, 50 bp, homo sapien
atgtccttacaagtcaccattttccyatattgaccacaacactgaatctt

SEQ ID NO: 62108 - DNA, 50 bp, homo sapien
cttgtggatttccggctctctcgtargcttgctaaataccagggtaaaca

SEQ ID NO: 62109 - DNA, 50 bp, homo sapien
tattaagctgtatgtagtacttgccrccttattttatttggatatgtaga

SEQ ID NO: 62110 - DNA, 50 bp, homo sapien
tgcctttcctttaaatatggagttcraaacatttctgtaccttctgaaat

SEQ ID NO: 62111 - DNA, 50 bp, homo sapien
cagttccacactctgattatcccacwatgtgaccatttatttccccactg

SEQ ID NO: 62112 - DNA, 50 bp, homo sapien
gagcttatctataggttttctacacyagagcataagaaacacctatatta

SEQ ID NO: 62113 - DNA, 50 bp, homo sapien
tttactgaacttcaataatagcctgsattttttccacattttaaaatttt

SEQ ID NO: 62114 - DNA, 50 bp, homo sapien
aattttaaaataaaatctatctcacrgtgaattatcaaatatttgagata

SEQ ID NO: 62115 - DNA, 50 bp, homo sapien
tctagagctgtcagagcatttgataytgagttgggtgctaactgtaacgc

SEQ ID NO: 62116 - DNA, 50 bp, homo sapien
cctactctttctcctctctttgctawctcaatgaatggcaccccatcctt

SEQ ID NO: 62117 - DNA, 50 bp, homo sapien
gccactgacaaaagacaaagtccaawaaaagatgatgctctaaaagggat

SEQ ID NO: 62118 - DNA, 50 bp, homo sapien
gtcaggacctgagctctgctattgarccaagtaaacagcagggatgggtt

SEQ ID NO: 62119 - DNA, 50 bp, homo sapien
tcttctatcactttataattacacamgctaataggattcattccatcaca

SEQ ID NO: 62120 - DNA, 50 bp, homo sapien
tccaaaagccttattaccagagacartatgtgttaagaccttggaaagag

SEQ ID NO: 62121 - DNA, 50 bp, homo sapien
gacacagcaaaaaaagaagttgtcaytagtggatatactgaggtttggca

SEQ ID NO: 62122 - DNA, 50 bp, homo sapien
actgcagcctgttttattatcatgaygttttgcttctagttatgtgcttt

SEQ ID NO: 62123 - DNA, 50 bp, homo sapien
gcattttacttttaggccagaattayacaatacaaaaatcaagattttgc

SEQ ID NO: 62124 - DNA, 50 bp, homo sapien
gatggagaacaggaattagtcataaraatagctcacatgtatgtgctaca

SEQ ID NO: 62125 - DNA, 50 bp, homo sapien
gtttgcccagggcttattaaatctcwcattcttaaaaacattttatcaat

SEQ ID NO: 62126 - DNA, 50 bp, homo sapien
ggagcaatttggccagattaatgaayaccttgagtttgaggtggctgcag

SEQ ID NO: 62127 - DNA, 50 bp, homo sapien
aaataatccatggagaaagaggatamaaggcctgagaaggagcagtcgta

SEQ ID NO: 62128 - DNA, 50 bp, homo sapien
taactgtgcacacacacagctacgawtatgtatatcaatatttgcataag

SEQ ID NO: 62129 - DNA, 50 bp, homo sapien
aaataacattaataatagtcaaatamctttaataatagtcaaaataacaa

SEQ ID NO: 62130 - DNA, 50 bp, homo sapien
catttacgcattaggcaagtctgatmtttggttatgatgaagaggacgaa

SEQ ID NO: 62131 - DNA, 50 bp, homo sapien
tacattctaaacagtttgaaaagacragtctcaaagagggacctctacgt

SEQ ID NO: 62132 - DNA, 50 bp, homo sapien
taaaattgtagagatacagggaagaktagcatgactaccgtgcaaggatg

SEQ ID NO: 62133 - DNA, 50 bp, homo sapien
agtgccacacacaggcgagtgttaaygttttaaagcgaaaaagttctgca

SEQ ID NO: 62134 - DNA, 50 bp, homo sapien
gagctaaggtattgatgactcttaakggcttaatgttatccttctttgtt

SEQ ID NO: 62135 - DNA, 50 bp, homo sapien
agacagggccttgatgttctccaaaytctttcatccccaacaatcccatg

SEQ ID NO: 62136 - DNA, 50 bp, homo sapien
atcaaaacaagaggttccctgatgargaatgacaggagataaggctggaa

SEQ ID NO: 62137 - DNA, 50 bp, homo sapien
tctcctgattttgctcctaactctaygactgctccttctcaggcctttta

SEQ ID NO: 62138 - DNA, 50 bp, homo sapien
ttcagaaaaagcatgctgttggagakaacgggaggcatcacttttacaat

SEQ ID NO: 62139 - DNA, 50 bp, homo sapien
ttatttccaaccacacaatcttaaakaattcagtctccattaccacctct

SEQ ID NO: 62140 - DNA, 50 bp, homo sapien
tgctaggaaaagcttgctaaagtaartggtggttggaataaacacccaca

SEQ ID NO: 62141 - DNA, 50 bp, homo sapien
cttaatatgaagctaatgtagctccwtctttaatgatcacacaaataggc

SEQ ID NO: 62142 - DNA, 50 bp, homo sapien
caatatcccaaaattagcataactgrcagaaatgcagaggcatcaacaac

SEQ ID NO: 62143 - DNA, 50 bp, homo sapien
ccactccacaccctttttcctgttaygccaacattccaaggccttgggac

SEQ ID NO: 62144 - DNA, 50 bp, homo sapien
acaaatcttgatttatttttggtcayattatcttaatcattgagttggct

SEQ ID NO: 62145 - DNA, 50 bp, homo sapien
gcacatctaaaacaagataaagagasgtgaaaaataaagggatggaaaag

SEQ ID NO: 62146 - DNA, 50 bp, homo sapien
gttatgtggaaagagttctgaattcraaggtcagaaaccatccttctggc

SEQ ID NO: 62147 - DNA, 50 bp, homo sapien
tctagagacatgaggatactgataasatttttttgactttgcctttcagg

SEQ ID NO: 62148 - DNA, 50 bp, homo sapien
gtttttaaggttagataagaattaarcatctgggctgggcatggtggctc

SEQ ID NO: 62149 - DNA, 50 bp, homo sapien
agttaattttattatccattcagggrcttatataccagtttgttatacag

SEQ ID NO: 62150 - DNA, 50 bp, homo sapien
aagatgctaaaatattttatcttaaygcctagaaaagcaatgttttctcc

SEQ ID NO: 62151 - DNA, 50 bp, homo sapien
aatggtaataatgctattggtgataygagaaatattttgaatgggaaggt

SEQ ID NO: 62152 - DNA, 50 bp, homo sapien
catctattctctaaatataacatcarttgactttccactgtattctcaat

SEQ ID NO: 62153 - DNA, 50 bp, homo sapien
acaatgtcagtttttcaggattatgracatccatgagaacacatgtaata

SEQ ID NO: 62154 - DNA, 50 bp, homo sapien
tactcataaacttcggaagtgaacayataaccctttacggtttcctaggc

SEQ ID NO: 62155 - DNA, 50 bp, homo sapien
taaagtaattgaaaatgcgtatacayggttttaatagcaaattagattca

SEQ ID NO: 62156 - DNA, 50 bp, homo sapien
ggtttgtcttcacaaaagttagtaartctctgtgccaaaacctggatgat

SEQ ID NO: 62157 - DNA, 50 bp, homo sapien
ctgtaaatgtgtaaggcaaaataccrcctggtccctgctgccccctgagc

SEQ ID NO: 62158 - DNA, 50 bp, homo sapien
actgttaaacttttggactagtcackcttgtggtccttagtaagctggta

SEQ ID NO: 62159 - DNA, 50 bp, homo sapien
tgtttaaagtctaagtgagaaataartcttaacagttacagtaattaaca

SEQ ID NO: 62160 - DNA, 50 bp, homo sapien
ccttgggctacaacccctgattcctmtaagatttttgtgtccccatcctc

SEQ ID NO: 62161 - DNA, 50 bp, homo sapien
tgttaaaagtttaataattgcaaggkatagtgaaagctagaagattaact

SEQ ID NO: 62162 - DNA, 50 bp, homo sapien
taaaacctacacatatcctctcgtayactttgtctctaaactgcttataa

SEQ ID NO: 62163 - DNA, 50 bp, homo sapien
ggctctatagctatcatgagaaataygtccaagaggaaataatcagatag

SEQ ID NO: 62164 - DNA, 50 bp, homo sapien
ctaaggaggcagaggtttgccctagmgtaggtatcatcagaaaatacggc

SEQ ID NO: 62165 - DNA, 50 bp, homo sapien
acgagactcgactctcaggaagctcraggtagcaatgagtgtatgactca

SEQ ID NO: 62166 - DNA, 50 bp, homo sapien
gtgtttcctctacagctaaatactayatgtttaatgggagaaaattaaaa

SEQ ID NO: 62167 - DNA, 50 bp, homo sapien
gtgtgtttgtattttacttaataccracagattttgtactaaaaatatca

SEQ ID NO: 62168 - DNA, 50 bp, homo sapien
tatgacctaatgttctatgattacartatccacgatttctgatttagtga

SEQ ID NO: 62169 - DNA, 50 bp, homo sapien
ttgctgtgaataaggaatagtcttayaatatgcgttttgatactaaattc

SEQ ID NO: 62170 - DNA, 50 bp, homo sapien
ctataattttcaaaagtctctgatayctgtgtgtacctgtttgtacatgt

SEQ ID NO: 62171 - DNA, 50 bp, homo sapien
acaactaagatgaacattgactcaaytccaacctgtggttcttaccttcg

SEQ ID NO: 62172 - DNA, 50 bp, homo sapien
tatatggcagacaatagctgtggaasaggaataataaacagcaactaact

SEQ ID NO: 62173 - DNA, 50 bp, homo sapien
cttgcttcaagattaacgtccaagcrgcagaagctactggcctaattttg

SEQ ID NO: 62174 - DNA, 50 bp, homo sapien
aagaatccagataagtccagggtcastcatccaaaactttgcctaaattt

SEQ ID NO: 62175 - DNA, 50 bp, homo sapien
tcactttgctgtaagaataaatcacragaaaatgtgcaacttggaggttc

SEQ ID NO: 62176 - DNA, 50 bp, homo sapien
taccaatgtgaagtgttatttgtgtsaagtaattgagttcctagatgttc

SEQ ID NO: 62177 - DNA, 50 bp, homo sapien
acacatcctgttaaagtctcagaatkattagaacccagaaactaaatgct

SEQ ID NO: 62178 - DNA, 50 bp, homo sapien
cacattaaatcccttccattcattayaaaaaaggattcatatcacacatc

SEQ ID NO: 62179 - DNA, 50 bp, homo sapien
tagttaagagaggataactgctaggyaaaaagactgagtagaagcaaaaa

SEQ ID NO: 62180 - DNA, 50 bp, homo sapien
atgaaaaggatgtgattgactaaccraaatagaatatagacatatagaaa

SEQ ID NO: 62181 - DNA, 50 bp, homo sapien
aattcagacaaaggtaagatacttargtacacagagttagaaataaaaat

SEQ ID NO: 62182 - DNA, 50 bp, homo sapien
ggaaattgcccaagtcctagaagaamacagaagcggcatcaacatccctt

SEQ ID NO: 62183 - DNA, 50 bp, homo sapien
tagaggtgcttagtatagaaccttcygaacagctgacgtttagacctaaa

SEQ ID NO: 62184 - DNA, 50 bp, homo sapien
tgggttaaaactagaataaggtccartgatatttttctctgaatctcttg

SEQ ID NO: 62185 - DNA, 50 bp, homo sapien
actactgaaatagaatagctgaaaawcagatccaaacatacaaggtaact

SEQ ID NO: 62186 - DNA, 50 bp, homo sapien
agagtcctgttttaaagatattagamagcatagaacggtgtggggagggg

SEQ ID NO: 62187 - DNA, 50 bp, homo sapien
ttggtccgagactaatagagagttgragtaaaagcttgaccaaggacctt

SEQ ID NO: 62188 - DNA, 50 bp, homo sapien
gatttccccccttagaaatgtgaacsaagaaacggaagctgaaattgcta

SEQ ID NO: 62189 - DNA, 50 bp, homo sapien
gagataaaagttggaaaatagatcaraacgcacgtacactattatttttc

SEQ ID NO: 62190 - DNA, 50 bp, homo sapien
tgtgaagtgttctcgatggttctcaragaggtatgcttttctgccgtgag

SEQ ID NO: 62191 - DNA, 50 bp, homo sapien
tctttggaagaaaataataaagctasaaattcctccagtttactgtaaga

SEQ ID NO: 62192 - DNA, 50 bp, homo sapien
aaccatttaggcatactattggtatyactttatttgccttattatttttt

SEQ ID NO: 62193 - DNA, 50 bp, homo sapien
ttcaatctaccagaagatcctcataycaaacttaccccaagagttgtttt

SEQ ID NO: 62194 - DNA, 50 bp, homo sapien
tagtctctttcataagtgctgaaatyattatagtaacagaatggccaacg

SEQ ID NO: 62195 - DNA, 50 bp, homo sapien
cccctgaggaaagcgtgtaacaagasctttaatcaatggaaaggccaccc

SEQ ID NO: 62196 - DNA, 50 bp, homo sapien
aactccaaaaaggactgtttataaarttgtaagcaatgcatagagtagga

SEQ ID NO: 62197 - DNA, 50 bp, homo sapien
caccccgtcttgggccaatccttcascaacgcccgtgatctccatgctgg

SEQ ID NO: 62198 - DNA, 50 bp, homo sapien
atgccaaaattattttcaacagtgaygctagtgtatggtaatatcagaaa

SEQ ID NO: 62199 - DNA, 50 bp, homo sapien
attccgtcaactctaacattatccasagcatgtagaggaaaatcaccaaa

SEQ ID NO: 62200 - DNA, 50 bp, homo sapien
agttaccttctaatttaatttttcaycgatctcttcagatgaagttcttg

SEQ ID NO: 62201 - DNA, 50 bp, homo sapien
atcacagcgggtaatattacgggtaycttaaagcaaggagtgcttttgcc

SEQ ID NO: 62202 - DNA, 50 bp, homo sapien
aggataatccgtcatctatacaaagraaaacttaccccagtgaagtggtt

SEQ ID NO: 62203 - DNA, 50 bp, homo sapien
tgcatatctcaagccagataggtagyattgaaataagtgggagacaacaa

SEQ ID NO: 62204 - DNA, 50 bp, homo sapien
gagaggtgaggctgagcagtccaaartatttgataacactgaaagagcgt

SEQ ID NO: 62205 - DNA, 50 bp, homo sapien
ggtttctggtactaatagattctcawgttgcatagctctcgtgacctggc

SEQ ID NO: 62206 - DNA, 50 bp, homo sapien
actctgcccattaatatactgtccawctttcttgaagcccaagtgaaatt

SEQ ID NO: 62207 - DNA, 50 bp, homo sapien
tacatctctctctctttgacgttgaycttcctgccacactcttatgaaga

SEQ ID NO: 62208 - DNA, 50 bp, homo sapien
accactcagagctggacttctggacrcctaagcaaagaaggaagtcctac

SEQ ID NO: 62209 - DNA, 50 bp, homo sapien
cataaattcgcatggcattaatcaartgagatcagatctgtagcactaag

SEQ ID NO: 62210 - DNA, 50 bp, homo sapien
tgacgtattggctaaaattcataaaytcgcatggcattaatcaaatgaga

SEQ ID NO: 62211 - DNA, 50 bp, homo sapien
gaccaatgatccatccagttcaaaawctaaagcctccgaaaatgtatttt

SEQ ID NO: 62212 - DNA, 50 bp, homo sapien
agaatgatgattaaaactgattttayagagcaagtatttgtcgtattagt

SEQ ID NO: 62213 - DNA, 50 bp, homo sapien
acccccacttcaaaataaccacaaasagaagtcccagaaattcaatgcaa

SEQ ID NO: 62214 - DNA, 50 bp, homo sapien
tacatggcattgttgaactcacagarcgaggcttattgattaaataactt

SEQ ID NO: 62215 - DNA, 50 bp, homo sapien
tgggtgccgggtcttttccacggcawaccttccttcccgatttccatctg

SEQ ID NO: 62216 - DNA, 50 bp, homo sapien
ttataaaatgctacgggaatttagcrgagaacgaagtcacctgaaaagaa

SEQ ID NO: 62217 - DNA, 50 bp, homo sapien
ctaaattacctctccatgtttaaaawcaaagccttgaagtgccaactgta

SEQ ID NO: 62218 - DNA, 50 bp, homo sapien
tggggactacagttttgaactcaaakaagggagttgtagctctggagggg

SEQ ID NO: 62219 - DNA, 50 bp, homo sapien
acaacaaaaaacacccacataggaaytggaataaagacttactgccaacc

SEQ ID NO: 62220 - DNA, 50 bp, homo sapien
attttaataactcaaagtattcaaawtttagggttgcaattaatttcaga

SEQ ID NO: 62221 - DNA, 50 bp, homo sapien
gcctcaacagaaatctccgatatgayaagttacaattgtaagtgatgctt

SEQ ID NO: 62222 - DNA, 50 bp, homo sapien
tgaacaattattagtaaagatgtgaygtataactagcaaagaaaagtgac

SEQ ID NO: 62223 - DNA, 50 bp, homo sapien
gttccctgctgtgctgaagttttcarcgcagtgcctaagccttagccctt

SEQ ID NO: 62224 - DNA, 50 bp, homo sapien
gtgtgatagatgaatcaatttaaaartggagaataacacatgggagataa

SEQ ID NO: 62225 - DNA, 50 bp, homo sapien
accatgcctttacctattacaacgaygcttcttacgatatatagtaatcg

SEQ ID NO: 62226 - DNA, 50 bp, homo sapien
ggtgcaggttaaaagacattgtagcrtcagagatatgtctgaggtttcaa

SEQ ID NO: 62227 - DNA, 50 bp, homo sapien
gtgtcctatctagaagaaaatttagrcattacatagaacacacaagtatc

SEQ ID NO: 62228 - DNA, 50 bp, homo sapien
ctatagagttgggaatgatagaaaakagacttccaagcctcagatgggga

SEQ ID NO: 62229 - DNA, 50 bp, homo sapien
aaagtatgacatgggatctttttcakctatggacttgccagcagtcttct

SEQ ID NO: 62230 - DNA, 50 bp, homo sapien
gcgaaatccaaatgcagtgaagttckccttgcagtccagtgtccatggcc

SEQ ID NO: 62231 - DNA, 50 bp, homo sapien
tgcaaggtggcaattggtgttcctcraaaaaggtgtctgtggttaaggaa

SEQ ID NO: 62232 - DNA, 50 bp, homo sapien
ctgtggcatcagtcatttcctgggayggataaaaatgcagagtggagaga

SEQ ID NO: 62233 - DNA, 50 bp, homo sapien
tcagcggagtttgtgacgaacccatmatgagaagctgatgtggaactagg

SEQ ID NO: 62234 - DNA, 50 bp, homo sapien
attcctatttaaatcgtgttacacamaaaaaattgaattttaaaaaccat

SEQ ID NO: 62235 - DNA, 50 bp, homo sapien
ggtattttccatagaccctagaatcrtgctggaccacagtaggtattcaa

SEQ ID NO: 62236 - DNA, 50 bp, homo sapien
gaagctgcccccatttgagaagccaytgagtacgtgaagaaaaataggtt

SEQ ID NO: 62237 - DNA, 50 bp, homo sapien
attaatgcctatataatctctttcawcctagaagacagacttcctagaac

SEQ ID NO: 62238 - DNA, 50 bp, homo sapien
gcttcctcaagcatcagacaatgcamctactttaggaaataacactgtat

SEQ ID NO: 62239 - DNA, 50 bp, homo sapien
cactttatccaatgacactagtttayccaatggcacagtgaagtccaagg

SEQ ID NO: 62240 - DNA, 50 bp, homo sapien
aacgacctcagtaaaggggatgcagrtaaaagttgctgtcctgagtaact

SEQ ID NO: 62241 - DNA, 50 bp, homo sapien
aaaagagttttgatcatattaggtamacaatcaacacaatgggtcggatt

SEQ ID NO: 62242 - DNA, 50 bp, homo sapien
tgtgactagtatgaaagtgaaagacrgaaacagatattctataaaaacag

SEQ ID NO: 62243 - DNA, 50 bp, homo sapien
aacttattaagctggaaactgatccsgaagtataaactaatgttttgatg

SEQ ID NO: 62244 - DNA, 50 bp, homo sapien
ctgagttatgtgaacaaatgggagarctaattgaaatgattaaataacac

SEQ ID NO: 62245 - DNA, 50 bp, homo sapien
tatgtgcttatattaggtcagtatayggttctatttcatgtaaaataaga

SEQ ID NO: 62246 - DNA, 50 bp, homo sapien
ttatctataaactactcctatagacyaccttgttatcctatttcattttt

SEQ ID NO: 62247 - DNA, 50 bp, homo sapien
cacaggacatctgctttgtgaagacygtccataatgaagtcaacagaata

SEQ ID NO: 62248 - DNA, 50 bp, homo sapien
tgggatcaaggtcctatgaataagamaatgccatatacaaagagaaactg

SEQ ID NO: 62249 - DNA, 50 bp, homo sapien
acccagacctgcagtttactgagaasgtaggtgatccgtggtttggatgg

SEQ ID NO: 62250 - DNA, 50 bp, homo sapien
atgagacacactgcctttatcttcaygttattccacatagtaaaatgaat

SEQ ID NO: 62251 - DNA, 50 bp, homo sapien
gaggaagacatacttagggaaatgawcacaaacactactgtaccaaatag

SEQ ID NO: 62252 - DNA, 50 bp, homo sapien
ggtgtcacatagaatagataagttcmgaatagtcacaatttcacatagct

SEQ ID NO: 62253 - DNA, 50 bp, homo sapien
tcaacctgaggagatcagaacactcygaccaatgttaacttcataataga

SEQ ID NO: 62254 - DNA, 50 bp, homo sapien
tttctaaatatctcttggatctatcyatttgttcctgccaactcaaccct

SEQ ID NO: 62255 - DNA, 50 bp, homo sapien
aactattatcatgttgtaggtctcartgaataactcatctaaatactgaa

SEQ ID NO: 62256 - DNA, 50 bp, homo sapien
taacttctttactgcaaggtttttakgacctgtgtcttgtgccgacctcc

SEQ ID NO: 62257 - DNA, 50 bp, homo sapien
gttttctggtggaggggacattctaygactctctaagtgtatcccggaat

SEQ ID NO: 62258 - DNA, 50 bp, homo sapien
attgaccttttttcctgcccaatagwacaacaggatacacagcaaggaaa

SEQ ID NO: 62259 - DNA, 50 bp, homo sapien
aaagatcagttcactttaggctgaaytaggagttagaatccagactaaac

SEQ ID NO: 62260 - DNA, 50 bp, homo sapien
agaaatatttagcctattcttggatwaagtgctaattttagggagattca

SEQ ID NO: 62261 - DNA, 50 bp, homo sapien
cctcactgcatattgctttaacaaartttattcctgtctggatgggctac

SEQ ID NO: 62262 - DNA, 50 bp, homo sapien
cattgccagaatcttctgtaggacartcttactagaaatcagtaatcctg

SEQ ID NO: 62263 - DNA, 50 bp, homo sapien
cttattgatttgcaaggtgctgtggwagataacttttattttcccaaagc

SEQ ID NO: 62264 - DNA, 50 bp, homo sapien
gctgtgtacaaatttaacatttttamccatggcaagacatctagagtaac

SEQ ID NO: 62265 - DNA, 50 bp, homo sapien
atggataaacaaaatgtggtgtgtawgtgtaaaatttcgccacaaaaagg

SEQ ID NO: 62266 - DNA, 50 bp, homo sapien
tgcaatatatgttatttaaagtactragatcattgttacctctgtgattg

SEQ ID NO: 62267 - DNA, 50 bp, homo sapien
gagaatgaaggtggaagaactgtagmggcagcaaagctctgtgtggagat

SEQ ID NO: 62268 - DNA, 50 bp, homo sapien
aatttcttgacatctatgtaatccartcttcttccaggttgcaatatatg

SEQ ID NO: 62269 - DNA, 50 bp, homo sapien
ctctctacccaaagacagaacctggmgaatgaaggtggaagaactgtagc

SEQ ID NO: 62270 - DNA, 50 bp, homo sapien
aaactgattgtccttgagatgggacygcaatagaaatccgggcagcccga

SEQ ID NO: 62271 - DNA, 50 bp, homo sapien
taggatcagtctcaaattcttgagayaaattcattaattcaccggctcat

SEQ ID NO: 62272 - DNA, 50 bp, homo sapien
aggggactaaagcaatgataggatargtaattaagaccctgaaaacgaca

SEQ ID NO: 62273 - DNA, 50 bp, homo sapien
attagtaacatcatgacaaaaattcwaactatatgtccagccttggaatt

SEQ ID NO: 62274 - DNA, 50 bp, homo sapien
tctctagagtactgagctataaacascggagaaggacaatatgcagccca

SEQ ID NO: 62275 - DNA, 50 bp, homo sapien
gtttttgggaggctggggctaggcaygtgtatttttctttttttttttga

SEQ ID NO: 62276 - DNA, 50 bp, homo sapien
cgggaggctgaagcgtcctctataawggcggtgagaggcctggcagagtc

SEQ ID NO: 62277 - DNA, 50 bp, homo sapien
aattacattcctggaattggttaggracagattactttcttgggttttag

SEQ ID NO: 62278 - DNA, 50 bp, homo sapien
cagaggctacctacctcagggcctgwcttggcatccaaccagaaggtcag

SEQ ID NO: 62279 - DNA, 50 bp, homo sapien
ttcccaagccttatagcactaaacartggtttgcagttcaaggtgctctt

SEQ ID NO: 62280 - DNA, 50 bp, homo sapien
aaataagccaaagcaatcatggacamgatcgacagttcctcttacatttt

SEQ ID NO: 62281 - DNA, 50 bp, homo sapien
tgagtcaagttatcggttgacatccwcctgatcaccaccatgcagcaaag

SEQ ID NO: 62282 - DNA, 50 bp, homo sapien
aaccagatgggatgaatccagtaacyatgtgcaatgggatatgtgctcgc

SEQ ID NO: 62283 - DNA, 50 bp, homo sapien
agctctagaaactgtctctattgaaygcctcatcatccttcactgacttc

SEQ ID NO: 62284 - DNA, 50 bp, homo sapien
ctcctgccccagcctcccaagagctsaaactataagcacgtgccaccaca

SEQ ID NO: 62285 - DNA, 50 bp, homo sapien
tactgacatgtgctacaacgtggatsaatcttggaaacatcaggctgagc

SEQ ID NO: 62286 - DNA, 50 bp, homo sapien
aagcaagccattcttggtttttgacrtctgaaaagccctgcattccttcc

SEQ ID NO: 62287 - DNA, 50 bp, homo sapien
tggggttccaaatgctctggttatcrggacagagaaatatcttaaacatt

SEQ ID NO: 62288 - DNA, 50 bp, homo sapien
aagaccttcctcaatttgataatacracaagctagccatgtgaaaattga

SEQ ID NO: 62289 - DNA, 50 bp, homo sapien
agaaggaaattgtaatgagagactayctttgggaaatgtgattaaaactg

SEQ ID NO: 62290 - DNA, 50 bp, homo sapien
gtaaaaataagaagatacagtgtaartctcacctgttttcattctagatt

SEQ ID NO: 62291 - DNA, 50 bp, homo sapien
ctgagcaagaacactgaagtacacargaagcatgtccaatattcagagaa

SEQ ID NO: 62292 - DNA, 50 bp, homo sapien
ttgaaactctagccatcactgtgaaktggcataccgtggaagggtgccag

SEQ ID NO: 62293 - DNA, 50 bp, homo sapien
ttaactaaaacatacctgctagcaasagaaactggaaaacctccaagggt

SEQ ID NO: 62294 - DNA, 50 bp, homo sapien
tgtagccagggggagttgatttgcayggaaaacaattgaaaggggaacag

SEQ ID NO: 62295 - DNA, 50 bp, homo sapien
acactcaaagcaacaaagttaacaamggaatgaaagcttacttttgaggc

SEQ ID NO: 62296 - DNA, 50 bp, homo sapien
gcaagtcatacttgtatttcttgaaraaaggaatggaaaagatgaaaagg

SEQ ID NO: 62297 - DNA, 50 bp, homo sapien
aaaattggagtttgcctagtcctgcraagttctgttccaaaagggaaata

SEQ ID NO: 62298 - DNA, 50 bp, homo sapien
ctcaactacaaaaaatattcagttgsaagaaaaaataggagacttttcct

SEQ ID NO: 62299 - DNA, 50 bp, homo sapien
tgatcacttattaaaaaattaggagsatctttactcaatattacatttaa

SEQ ID NO: 62300 - DNA, 50 bp, homo sapien
ttgttgtcaggatagtggatgacacrgtaccctcagcatccaggaatggc

SEQ ID NO: 62301 - DNA, 50 bp, homo sapien
catattatatggtaacacactaatasacagatcttgaaagtctagaaatt

SEQ ID NO: 62302 - DNA, 50 bp, homo sapien
tattaatcattttgaatagaaaatargtgacgtaagatgttggcagctgc

SEQ ID NO: 62303 - DNA, 50 bp, homo sapien
tggatattaataaggtgagtaaaaartgtttaaataagccacccttgagt

SEQ ID NO: 62304 - DNA, 50 bp, homo sapien
aaagtagtagctgtatacacaatagwagttgctaactgaaatgatctttt

SEQ ID NO: 62305 - DNA, 50 bp, homo sapien
taggtagcaagatgaaccacaataarggacttaacaacgtctagaacttt

SEQ ID NO: 62306 - DNA, 50 bp, homo sapien
tattctcttcatttttaaaatggggrcatcatctttccttatgacatctt

SEQ ID NO: 62307 - DNA, 50 bp, homo sapien
atatcctctgattctacatttagcartagatcccaacaatgttgacttgc

SEQ ID NO: 62308 - DNA, 50 bp, homo sapien
aggttctggacataaccctcattagycattgatgtgattcggctgtggtc

SEQ ID NO: 62309 - DNA, 50 bp, homo sapien
attttaattagaatatttgttcctaygctcacaagtgagattgctctcta

SEQ ID NO: 62310 - DNA, 50 bp, homo sapien
gaaccagcaatggaagattccaatayagcgataacacagaagtatcaaaa

SEQ ID NO: 62311 - DNA, 50 bp, homo sapien
ttgcttttaagaacctttagagaacrataattactaatataatatggagt

SEQ ID NO: 62312 - DNA, 50 bp, homo sapien
tctagagttacctaaaagccatccasagtgaataaggtgggtattgaaca

SEQ ID NO: 62313 - DNA, 50 bp, homo sapien
aaccaacccaattttaaacgtaatcrgagggtatataaacacctcacaaa

SEQ ID NO: 62314 - DNA, 50 bp, homo sapien
cacactctatacggtaggcaaacacyggaatttgttctgtgcatttaaat

SEQ ID NO: 62315 - DNA, 50 bp, homo sapien
attccctggcatctgctaacacttaycactgtcattactgtctttttgct

SEQ ID NO: 62316 - DNA, 50 bp, homo sapien
tatacaacctctgactgagcattagkccccatcatcagattctaggcctg

SEQ ID NO: 62317 - DNA, 50 bp, homo sapien
gggtcaagttgaactattttctagcrataacccagagatcctttctagga

SEQ ID NO: 62318 - DNA, 50 bp, homo sapien
agaaaagtaatgagttgaaaaaatargatggagtttacttcccataacca

SEQ ID NO: 62319 - DNA, 50 bp, homo sapien
tgagtataagcactatctggtaaagyccatcaaaagaagagcatctctgt

SEQ ID NO: 62320 - DNA, 50 bp, homo sapien
aacatcttgactatgtttgacacttkaaaactaattactagcaaggatct

SEQ ID NO: 62321 - DNA, 50 bp, homo sapien
aatgattacttatgtaatcagttccrcagaggctggtaaatagcaggaac

SEQ ID NO: 62322 - DNA, 50 bp, homo sapien
tattcactctgtcctttaatttttawattgtgctggtcacatagccactc

SEQ ID NO: 62323 - DNA, 50 bp, homo sapien
atgtccctaggtgctatacatagaaygctgatttgctgtatcccaaatat

SEQ ID NO: 62324 - DNA, 50 bp, homo sapien
gtctctgatgaaatcacatgtctaamaatctcagcatgcttttaatcaac

SEQ ID NO: 62325 - DNA, 50 bp, homo sapien
aggtcaaatcctgggtatgattgacyatataacacgactgcacttggagt

SEQ ID NO: 62326 - DNA, 50 bp, homo sapien
gaaaatgacacttcccatagtgtcaraattgtggtctattggagaattct

SEQ ID NO: 62327 - DNA, 50 bp, homo sapien
tgtgctaataatagcactgacatcayatggttgtaataaatttgaacagg

SEQ ID NO: 62328 - DNA, 50 bp, homo sapien
attatgagtatttgttggcaagatayagtgctattaattggaaagagtta

SEQ ID NO: 62329 - DNA, 50 bp, homo sapien
gacatttcaggttttagttaattagyagcttgctctgtgtctgttccaag

SEQ ID NO: 62330 - DNA, 50 bp, homo sapien
gggcagtcatgtaaccatctaagaaytgtaaatcagaagcaaaggacaga

SEQ ID NO: 62331 - DNA, 50 bp, homo sapien
ctttctaaaccctatagttcagtcartaaatgctacgttctaggcctcca

SEQ ID NO: 62332 - DNA, 50 bp, homo sapien
gaagtgacaatataatggtagctgtrgtttattgagtactgattacatgg

SEQ ID NO: 62333 - DNA, 50 bp, homo sapien
agttatttttctttatatacctggaygttcatgtaagaaattatactttt

SEQ ID NO: 62334 - DNA, 50 bp, homo sapien
ggtctcagagcacgtggaatggatgyacttcttgaaattaaaaaaacagt

SEQ ID NO: 62335 - DNA, 50 bp, homo sapien
ctactgttgtgaatccaagctattawgttctgtaatttaaattattaaca

SEQ ID NO: 62336 - DNA, 50 bp, homo sapien
tgcgcccacttgctgcgcatatccaygttttgggctggaggtgttgatgt

SEQ ID NO: 62337 - DNA, 50 bp, homo sapien
ttctccctaagatagttatgaggaayatgtgatagggaaccccttctctt

SEQ ID NO: 62338 - DNA, 50 bp, homo sapien
agagatacatatcagagtatgcaagragtcactttaaaaaatgctagaag

SEQ ID NO: 62339 - DNA, 50 bp, homo sapien
tgcaaagcaacttttatgtcatagcratttcattatacatcccaaaagac

SEQ ID NO: 62340 - DNA, 50 bp, homo sapien
gctatgcctcttccttaatatcagasaatttgtatgtttaaatttagttt

SEQ ID NO: 62341 - DNA, 50 bp, homo sapien
ttatacttaaaagaaaatactttaartgtcccaattttgtatcctgcaaa

SEQ ID NO: 62342 - DNA, 50 bp, homo sapien
tgcctaaccatggtatgctgggtgaytatgtaatctgaacttctcatcat

SEQ ID NO: 62343 - DNA, 50 bp, homo sapien
tggagtctccaggacactcgtctcaytagatgtttacgtggggaccaaaa

SEQ ID NO: 62344 - DNA, 50 bp, homo sapien
gatggcccatgattaaaatcaggaarcattgagctgtcttgggtgaattg

SEQ ID NO: 62345 - DNA, 50 bp, homo sapien
atatttcctatttcctacctaacgawgttacagaaaacttattacagatt

SEQ ID NO: 62346 - DNA, 50 bp, homo sapien
tgcctaatttgttttagcatcaaaastcttcttttaaaagacatcttgaa

SEQ ID NO: 62347 - DNA, 50 bp, homo sapien
ttgaatctcatggttcctggacatcrcttctcaattccagctttgctact

SEQ ID NO: 62348 - DNA, 50 bp, homo sapien
ctgatgacaaattttcacagtttttrtctatctgaagttgtgttgtattt

SEQ ID NO: 62349 - DNA, 50 bp, homo sapien
ttttgcttcatcactgtagacttttycagataggataatttctgtcttca

SEQ ID NO: 62350 - DNA, 50 bp, homo sapien
ctggcaagaactataatcctattaamccctcaataatgtgtaaacataca

SEQ ID NO: 62351 - DNA, 50 bp, homo sapien
gcaagtgctggattgttggcctatgyatgttatattttcgtgaagaaaaa

SEQ ID NO: 62352 - DNA, 50 bp, homo sapien
cctgacccaggctaggagcagttgakgccttcatagaataaccacatgtt

SEQ ID NO: 62353 - DNA, 50 bp, homo sapien
attaactattttctttgacctatcarttgaggccatgaggccaataccaa

SEQ ID NO: 62354 - DNA, 50 bp, homo sapien
ctactaggcaatgccaatggagcaayctgtgcattcccgttcaagtttga

SEQ ID NO: 62355 - DNA, 50 bp, homo sapien
ccttcagtaggcttcttattggaaasttaatgttcagaaatatcactcac

SEQ ID NO: 62356 - DNA, 50 bp, homo sapien
ctatgatgcatagtttggttatagaygaactcagaaccacttttcttgta

SEQ ID NO: 62357 - DNA, 50 bp, homo sapien
gtattaaaagaggcttgcactttaargaagaatgtggagaattttctttt

SEQ ID NO: 62358 - DNA, 50 bp, homo sapien
atgagacacacagagattgttcgaamgggattaaagctctggagcatgag

SEQ ID NO: 62359 - DNA, 50 bp, homo sapien
gatgctctgttggtagttataaacaycgtagttcaagataaactatcgga

SEQ ID NO: 62360 - DNA, 50 bp, homo sapien
tgccatggggttacatccatctccakgagaacaatgcaataattatttca

SEQ ID NO: 62361 - DNA, 50 bp, homo sapien
atttccaaacaaatgtgaaacatggwagtgtctatcttatagttgtataa

SEQ ID NO: 62362 - DNA, 50 bp, homo sapien
ccttacagtagaggatttctgcgcaygttaacaaatctcaccgctgagca

SEQ ID NO: 62363 - DNA, 50 bp, homo sapien
acacaggccacaattttcttcatgasaatgtggtcacggttattcagagg

SEQ ID NO: 62364 - DNA, 50 bp, homo sapien
ttaccaaaaaataccacaaagcaaawtgagcaaatagcgtatctggacct

SEQ ID NO: 62365 - DNA, 50 bp, homo sapien
ccatcacaactagattgtcattataygtgagaatttgagggacaccctcc

SEQ ID NO: 62366 - DNA, 50 bp, homo sapien
ctccagtcattccccacaatgcaccragtggtcttcctaaaatgtgagtc

SEQ ID NO: 62367 - DNA, 50 bp, homo sapien
aggacagaaagaaaagtaaaagagasgttgaaagatcaaactaaccagat

SEQ ID NO: 62368 - DNA, 32 bp, homo sapien
tagtacatctccgcatragtcatattttgtac

SEQ ID NO: 62369 - DNA, 50 bp, homo sapien
gtcaagggcagtttctgtttctcacrgtcaagggcagtttctgttgctcg

SEQ ID NO: 62370 - DNA, 50 bp, homo sapien
ctttagataaacttaaggaaaagacygattgctctatgctcatggcaacc

SEQ ID NO: 62371 - DNA, 50 bp, homo sapien
ccagtagctatttgtgatttccgcgwagtaatcacctactgtattgcttt

SEQ ID NO: 62372 - DNA, 50 bp, homo sapien
aagtgaaagaaatagctctaatttarcccaaactactacaaagacaattg

SEQ ID NO: 62373 - DNA, 50 bp, homo sapien
taattcattactacaaataaataaasctgccagataaattatccaaactg

SEQ ID NO: 62374 - DNA, 50 bp, homo sapien
ttagtaggcttgagagagagccagarggctagcatggttggagtgcactg

SEQ ID NO: 62375 - DNA, 50 bp, homo sapien
tttctgaggtgctgaacttagtaaamacgtagggtcattatctttctaaa

SEQ ID NO: 62376 - DNA, 50 bp, homo sapien
ctgcttcatttcatatcttatttaaygttatgttcataaaatctggaagt

SEQ ID NO: 62377 - DNA, 50 bp, homo sapien
ggtcaggatatcaagacaaaaggccragggcatacctgggtgtactaggt

SEQ ID NO: 62378 - DNA, 50 bp, homo sapien
aacagggtctttcttcaagctaataygatattgtgatttatttgtatact

SEQ ID NO: 62379 - DNA, 50 bp, homo sapien
ttggcacctgagaagacccagaacamattcactttaaaaagtatcacgtg

SEQ ID NO: 62380 - DNA, 50 bp, homo sapien
tggttaagtagttcattattttaccrggaaatagagtctgtaaataaata

SEQ ID NO: 62381 - DNA, 50 bp, homo sapien
ataatcagggtttgtttttgttgtckaaacatcactaaggtaaaaaacct

SEQ ID NO: 62382 - DNA, 50 bp, homo sapien
atgacagttttcatgataaaatcagyatagaggagtatgtgcaattttgc

SEQ ID NO: 62383 - DNA, 50 bp, homo sapien
attgtactgatagttctaactcaatsatgttcttagtctggcacaataaa

SEQ ID NO: 62384 - DNA, 50 bp, homo sapien
tttgcttttacaatgaattagacagmattatccctataatgctgtttggt

SEQ ID NO: 62385 - DNA, 50 bp, homo sapien
tttattattttgtctagtctacagartagtgcccattgcaagacgcttct

SEQ ID NO: 62386 - DNA, 50 bp, homo sapien
agagaagccatagcctgtgttttaayagaacatacatagtttcattcatt

SEQ ID NO: 62387 - DNA, 50 bp, homo sapien
gcgaagagtcactcttggggtatcartgagagaagaggctgggcatcaga

SEQ ID NO: 62388 - DNA, 50 bp, homo sapien
ctcagttgttgcacaatggtatgaawatgtttaacactactgaactgcac

SEQ ID NO: 62389 - DNA, 32 bp, homo sapien
agaggatttagccatgmaactattctggtgta

SEQ ID NO: 62390 - DNA, 50 bp, homo sapien
catccaaaggccgagaaatattgaastctactcccagcatacccagctac

SEQ ID NO: 62391 - DNA, 50 bp, homo sapien
tctctatgggggaaggccatgaatarcctcttgcctgtatgttgagaaga

SEQ ID NO: 62392 - DNA, 50 bp, homo sapien
cagcagtttctactaagagtgagaayaggtgtccttttggcctgacagtc

SEQ ID NO: 62393 - DNA, 50 bp, homo sapien
ccagtcaagttgacacttagtactartaatcacatgaggtttaacggtgt

SEQ ID NO: 62394 - DNA, 50 bp, homo sapien
gaagtttgaaggaaagacacgaagcragggagttggagctcatcaaaggg

SEQ ID NO: 62395 - DNA, 50 bp, homo sapien
cacccctgtactgatgagaaaagtaragcagcgaaggggagggtactgag

SEQ ID NO: 62396 - DNA, 50 bp, homo sapien
gaacagaagtgcgcaattgtaaatayagtgaatttcacaagcttccactt

SEQ ID NO: 62397 - DNA, 50 bp, homo sapien
gtctgggcttgattccagatacaacrcacattttgcccaagccagctgct

SEQ ID NO: 62398 - DNA, 50 bp, homo sapien
gcaaaacagtccagtgttattatgasgatttttgttagtccttagcactt

SEQ ID NO: 62399 - DNA, 50 bp, homo sapien
gtgcccctaagcatggaactcctaaygaggtgtctcttataatggtggct

SEQ ID NO: 62400 - DNA, 50 bp, homo sapien
acaggctgaatctttatctgtagaasagcagtgagcaaactatagcctgt

SEQ ID NO: 62401 - DNA, 50 bp, homo sapien
tttccttctagtcagttccgttctamaggagccaccattataagagacac

SEQ ID NO: 62402 - DNA, 50 bp, homo sapien
ctttgtggaagaagtggtatctacaytgggtctgaaaggatatgagacac

SEQ ID NO: 62403 - DNA, 50 bp, homo sapien
cctgccacatcaattatagaagcagsttattgaaatgaaggtgccacaag

SEQ ID NO: 62404 - DNA, 50 bp, homo sapien
ttgaaggaaagattactctgcaacaytcatggttcaaatgtgattcaggt

SEQ ID NO: 62405 - DNA, 50 bp, homo sapien
gtaggttatcatatttttgtagccarcgtccttattaaagcactaattgt

SEQ ID NO: 62406 - DNA, 50 bp, homo sapien
tggaatgcccatcatgtgctagacastactaccaatactttgatagatat

SEQ ID NO: 62407 - DNA, 50 bp, homo sapien
caaacttcccataaaggagaatcaastgagattttaataggaagataaaa

SEQ ID NO: 62408 - DNA, 50 bp, homo sapien
ccagacagcacttttttcttagaagkccatttatttggaggatactttta

SEQ ID NO: 62409 - DNA, 50 bp, homo sapien
gtagaggaaggctggttatcacttayagttgcagttcagatttgtttagc

SEQ ID NO: 62410 - DNA, 50 bp, homo sapien
tgtatagcagtacagtgtttgtgttktacgctgttattgtgagtcaaaaa

SEQ ID NO: 62411 - DNA, 50 bp, homo sapien
cctctcatccattaaatctaagctartgctatctcgctccattctacttt

SEQ ID NO: 62412 - DNA, 50 bp, homo sapien
cctttcctactgttgttcttgccgcrctatctttttagcactcagcagca

SEQ ID NO: 62413 - DNA, 50 bp, homo sapien
tgatgtctccccgcgtcttaggtccragggtatcatcgcagatcatcccc

SEQ ID NO: 62414 - DNA, 50 bp, homo sapien
aactttttctattcaataacgaaaasctgggtgctatatttgttttagcc

SEQ ID NO: 62415 - DNA, 50 bp, homo sapien
acagaggtcttggacagtgtctctarttgtcccggttatagctgtggtta

SEQ ID NO: 62416 - DNA, 50 bp, homo sapien
agctaagttgtgaatttgacagaggwcttggacagtgtctctaattgtcc

SEQ ID NO: 62417 - DNA, 50 bp, homo sapien
ccttagggaaaggcgatgatcataargacatggacatcatcaccaaattc

SEQ ID NO: 62418 - DNA, 50 bp, homo sapien
cttgacttaatctctttcatacgtgracttttctgcccacgcttgtattc

SEQ ID NO: 62419 - DNA, 50 bp, homo sapien
ttccatagcaacaggactatagaaayctcaaggggctatcactgtagatg

SEQ ID NO: 62420 - DNA, 50 bp, homo sapien
ttcctgagatgatatttccaaaaccrgatctcatctctttgaatccttgg

SEQ ID NO: 62421 - DNA, 50 bp, homo sapien
gctggtgtaaggtaatagctatgacsaccatcctcatcctacagaagaga

SEQ ID NO: 62422 - DNA, 50 bp, homo sapien
gagaaacactgagtttacagtttackgcgtgtagaatttttaaattgaga

SEQ ID NO: 62423 - DNA, 50 bp, homo sapien
ccctccaatgcttgtcaagaattacyggatctgagaaacactgagtttac

SEQ ID NO: 62424 - DNA, 50 bp, homo sapien
cctactttcatgggatgtataatctraatgaggaagatgaacattaaagt

SEQ ID NO: 62425 - DNA, 50 bp, homo sapien
ctctgggctcacttctctttcttcaygaagtgtctcagcaagtactattt

SEQ ID NO: 62426 - DNA, 50 bp, homo sapien
ggacttgaagttttgaaatctttaayaggcatacaaatggctgcaccact

SEQ ID NO: 62427 - DNA, 50 bp, homo sapien
acatgcaaacaaagacattttggcascctttaatacatcctgaaactaac

SEQ ID NO: 62428 - DNA, 50 bp, homo sapien
tgcacatatccatgaatcctgagtgmatttaagaaaagaattctccataa

SEQ ID NO: 62429 - DNA, 50 bp, homo sapien
ttgagctcagcaggcatgcttgtacsgatccagctgaaggagtaggactt

SEQ ID NO: 62430 - DNA, 50 bp, homo sapien
aggtctgtgaccagtttcttccaacmagttacttctaggcattcctacta

SEQ ID NO: 62431 - DNA, 50 bp, homo sapien
tcacctttgtttgcatgtgaaatcarggttcttttcaaacacatcttcaa

SEQ ID NO: 62432 - DNA, 50 bp, homo sapien
tctgcattttaaaaactctccaagayatggtttaaaagatgagagtagaa

SEQ ID NO: 62433 - DNA, 50 bp, homo sapien
tagcccaaatccttatttatgtttaygaaatttgcaactctgacatgata

SEQ ID NO: 62434 - DNA, 50 bp, homo sapien
gaacttggcgtttgggggaattggarcttagtgaactttagatgaactgg

SEQ ID NO: 62435 - DNA, 50 bp, homo sapien
tttgtgtctgaatgtggcaagatagwcatgctattaaaaatattctttag

SEQ ID NO: 62436 - DNA, 50 bp, homo sapien
gcaccgcccattgtgagatttgtaasaaaaattaatatgaatggagttaa

SEQ ID NO: 62437 - DNA, 50 bp, homo sapien
caagatttctcactgggtaatgagaraaagaccatttatcagacatgcaa

SEQ ID NO: 62438 - DNA, 50 bp, homo sapien
agaatggtcaattttgtgtcataagragaagacagcaggccgagaattcc

SEQ ID NO: 62439 - DNA, 50 bp, homo sapien
taagccctccatcagaaagggtgacmgtcaaagaaagtctctttaagggt

SEQ ID NO: 62440 - DNA, 50 bp, homo sapien
gaagctattataagcccaactatgcraccagcaacattacatactttatt

SEQ ID NO: 62441 - DNA, 50 bp, homo sapien
ttggctgctctgaaatctgcaataargaaaattagacaacccaatacacg

SEQ ID NO: 62442 - DNA, 50 bp, homo sapien
agcatggtttgctttatatgtgttargtacccaaataaacaacagttttt

SEQ ID NO: 62443 - DNA, 50 bp, homo sapien
atatcaactttatgggtgacaattayattggaaaggacagtgaatgcgat

SEQ ID NO: 62444 - DNA, 50 bp, homo sapien
tctttgcgttctcatttgaaatgcamgtatccctttgagtgagaaaactc

SEQ ID NO: 62445 - DNA, 50 bp, homo sapien
gcatatgtatctaatggacatttcaycttggcttaaaataattgacaaat

SEQ ID NO: 62446 - DNA, 50 bp, homo sapien
cttcccccacattggtataaaaagawgaacttgtattgcatgccaggaac

SEQ ID NO: 62447 - DNA, 50 bp, homo sapien
taaaaatcaattgctgtttccaaggsattggcactcattctgtttactta

SEQ ID NO: 62448 - DNA, 50 bp, homo sapien
atgccaggaacccgaatgtccagtcrcttgtctccttggagtgcacctct

SEQ ID NO: 62449 - DNA, 50 bp, homo sapien
cactaaaagtcagtcagaccttgaasgacggttactttcttttttttttc

SEQ ID NO: 62450 - DNA, 50 bp, homo sapien
tgttagcgttcaactcaacagaaaaygactagatttgcatatctccctct

SEQ ID NO: 62451 - DNA, 50 bp, homo sapien
ctattatatttgattcatcgatttarctctaccacatagcttcgtgacat

SEQ ID NO: 62452 - DNA, 50 bp, homo sapien
tggaggtgctctgttaaaatgccaaygggactggaagtgaaaccctatta

SEQ ID NO: 62453 - DNA, 50 bp, homo sapien
aacttgtcttgcaaatttctaggagwgtagggagaaaatcttgccaaaac

SEQ ID NO: 62454 - DNA, 50 bp, homo sapien
taggtgatggatggataataccctaygcaaaatggccaggtttctatgtg

SEQ ID NO: 62455 - DNA, 50 bp, homo sapien
aacttagcaaactgtaaatggaatayaattttttttagagtaaacacatc

SEQ ID NO: 62456 - DNA, 50 bp, homo sapien
ttaatgacaaatgattggttccctgragtctcagtttggattttgatata

SEQ ID NO: 62457 - DNA, 50 bp, homo sapien
aatatgttttacactcatgttatgtraaattaaaccatcgtaagtcttca

SEQ ID NO: 62458 - DNA, 50 bp, homo sapien
ccaggattgagaaccactcttagacygataactcctgtgaaattggagag

SEQ ID NO: 62459 - DNA, 50 bp, homo sapien
attattttcctttccatacatatgaytatcaaaggcaaggtaggggagag

SEQ ID NO: 62460 - DNA, 50 bp, homo sapien
cattttaggcattattctcatgatcmcttgtatcttggttctatagtgag

SEQ ID NO: 62461 - DNA, 50 bp, homo sapien
cttatttgcacgttatttactctcawtgaatgctgagctttcctttgttg

SEQ ID NO: 62462 - DNA, 50 bp, homo sapien
ggcttgacaatcttccaactgacctmctgatttccatcccaatgaaggat

SEQ ID NO: 62463 - DNA, 50 bp, homo sapien
caagctcttgtaccttattttggctraagacttccttcaccgtgcttctc

SEQ ID NO: 62464 - DNA, 50 bp, homo sapien
accatgaaatacagagcactctatamacaagagaacctatttgagctcaa

SEQ ID NO: 62465 - DNA, 50 bp, homo sapien
attccccttgaatctttttgtcaccrgaagttctgagtagtttatgtccc

SEQ ID NO: 62466 - DNA, 50 bp, homo sapien
tggcagtttcttgcaaagctaaatgkagtcttaccataggatccagcagt

SEQ ID NO: 62467 - DNA, 50 bp, homo sapien
tctgaagacataaaacataaaatcartacacagtggatcagaataaatac

SEQ ID NO: 62468 - DNA, 50 bp, homo sapien
actggacttgttcacttccatgaaamcttgaatctttttctattgttaaa

SEQ ID NO: 62469 - DNA, 50 bp, homo sapien
gtcttcttggagcttacagtctagtygggttagatagaaataaagtaaac

SEQ ID NO: 62470 - DNA, 50 bp, homo sapien
attgtgtaccaagcattattgtacaytcagggaatcatttccccatttct

SEQ ID NO: 62471 - DNA, 50 bp, homo sapien
acttgtctattgttttcttttccaasagtatacttatctggctttggtat

SEQ ID NO: 62472 - DNA, 32 bp, homo sapien
ttctgactgtagctatmataagagataattta

SEQ ID NO: 62473 - DNA, 50 bp, homo sapien
tatccagttgaaaaatggtcaacacmtcataaatgatttcatgctggaca

SEQ ID NO: 62474 - DNA, 50 bp, homo sapien
atactgtattggttcctaacagtgaycaataggaattcctttaccctgct

SEQ ID NO: 62475 - DNA, 50 bp, homo sapien
acatttcatactattgtaggctgaasatttgtataaaatctagaccaatt

SEQ ID NO: 62476 - DNA, 50 bp, homo sapien
aaaagagcagacggtccagaaacagwcccatacgaaacatatgaagaagt

SEQ ID NO: 62477 - DNA, 50 bp, homo sapien
agctgtttatgtgtccaataccattyaacaaggcgatgtttgctctaggc

SEQ ID NO: 62478 - DNA, 50 bp, homo sapien
atgtgtcacttttgtaataaaggaaygaaacaatgcataaaaggatttct

SEQ ID NO: 62479 - DNA, 50 bp, homo sapien
acaactattatacagaggttggttcsaaaagcatggcattcattcattct

SEQ ID NO: 62480 - DNA, 50 bp, homo sapien
cagatccattattacagatctaccaytactacggattatccattatcacg

SEQ ID NO: 62481 - DNA, 50 bp, homo sapien
atgatgagacacaatatagaattaartgatagaggcaaaagcttttttac

SEQ ID NO: 62482 - DNA, 50 bp, homo sapien
agagaagcacacttggtagctcttawtaaaatttctacagctgtgttgag

SEQ ID NO: 62483 - DNA, 50 bp, homo sapien
ccaataccaaagacattgaagctaayaatatcttctcctccacttgctga

SEQ ID NO: 62484 - DNA, 50 bp, homo sapien
tttaactcataaacataactttacaytgccctaaacaaacataactaaat

SEQ ID NO: 62485 - DNA, 50 bp, homo sapien
aatggggctccatgacactttatctsaattggatttttttttaaagatct

SEQ ID NO: 62486 - DNA, 50 bp, homo sapien
aacatttcaatctgacctcaaaaagmaggcttgttaccaaaaaaaatagc

SEQ ID NO: 62487 - DNA, 50 bp, homo sapien
tctcactgtgttctcacacggtacaygcaaaaaaggtaatctgtatctct

SEQ ID NO: 62488 - DNA, 50 bp, homo sapien
tagccatcgtttcatcaagctttgcratgataccaggaatctgttgcacc

SEQ ID NO: 62489 - DNA, 50 bp, homo sapien
agatttttgcatcaatattcatcagraatacttgtctattgttttctttt

SEQ ID NO: 62490 - DNA, 50 bp, homo sapien
aggagtaactgtctatacgtgaagarcttgtggccaaaccggcagaatat

SEQ ID NO: 62491 - DNA, 50 bp, homo sapien
ttctttgtgtttccagcgagaaaggrcaagaaattattagaagagaattg

SEQ ID NO: 62492 - DNA, 50 bp, homo sapien
tgcagaggtgctaatttatatacaawtctatgtgcattcatttcaatttt

SEQ ID NO: 62493 - DNA, 50 bp, homo sapien
atatcctttgcatttgcctaggattraagaaaagcagtaaagtggtacat

SEQ ID NO: 62494 - DNA, 50 bp, homo sapien
aggtgggtttcgttgtttgtttttcrccagagaatggtctatgcaagact

SEQ ID NO: 62495 - DNA, 50 bp, homo sapien
atggctatgggaagtttcatgtgaawtcttttggagattctgaaagtctg

SEQ ID NO: 62496 - DNA, 50 bp, homo sapien
agatttaatatcactagatacatacractgagaagtaacaccccaaactg

SEQ ID NO: 62497 - DNA, 50 bp, homo sapien
acaaagtcaatgattctccaatggcygaataaatatctttcaatcacaca

SEQ ID NO: 62498 - DNA, 50 bp, homo sapien
gcttttgcatgcataaaacaaagacygtactgacaagccaataataaaat

SEQ ID NO: 62499 - DNA, 50 bp, homo sapien
gggtctctaaagatagcatagcagayagtggaagtatagctaatggcagg

SEQ ID NO: 62500 - DNA, 50 bp, homo sapien
aaaaagggctgaaaataaatatctasgtgtaactataggttgccataaaa

SEQ ID NO: 62501 - DNA, 50 bp, homo sapien
tttaatgccagcgtgaatctggttayggcaccaagaaggcggtagtcact

SEQ ID NO: 62502 - DNA, 50 bp, homo sapien
tagctggtgaaaattagttatatgtyaagcccttgaaattaaaaaaaaac

SEQ ID NO: 62503 - DNA, 50 bp, homo sapien
ctcaaataggcttattgaggtataayggatacgcaataaactgcctatat

SEQ ID NO: 62504 - DNA, 50 bp, homo sapien
tcaacccaagaacatcatttgacaarctagaaagaatgataagtaaaaca

SEQ ID NO: 62505 - DNA, 50 bp, homo sapien
gaccacattttgagaaccactggtayggaggaagtaaactacttgagact

SEQ ID NO: 62506 - DNA, 50 bp, homo sapien
cctccgtctcccaaagtgctgtcacracgcccgaccgacaaaatagcttt

SEQ ID NO: 62507 - DNA, 50 bp, homo sapien
tcacacttcctaccactctcactcgmcattcctgaggaagccactcagaa

SEQ ID NO: 62508 - DNA, 50 bp, homo sapien
ctatacagcatgggcatgccagacawagagaagattcatttaccagcatg

SEQ ID NO: 62509 - DNA, 50 bp, homo sapien
ggtaatacatatgacagtattctacrgaagttacacacagacattggtat

SEQ ID NO: 62510 - DNA, 50 bp, homo sapien
tataaaccacatgattaaactgttayggtgatcatcagggacagtgtaaa

SEQ ID NO: 62511 - DNA, 50 bp, homo sapien
tcaggataaaccctagaagaatttamgatttgccccttggggcttcatgc

SEQ ID NO: 62512 - DNA, 50 bp, homo sapien
atgtcaagaaataaatatccaggaaytatcccaaacagatgtattattca

SEQ ID NO: 62513 - DNA, 50 bp, homo sapien
ccatcatcattaactgctttgatacrgattatgcaaagtaaggattcatt

SEQ ID NO: 62514 - DNA, 50 bp, homo sapien
agcatgggaacagcaaggctgaaaartagcccagatgcaatggggttcag

SEQ ID NO: 62515 - DNA, 50 bp, homo sapien
cctcaactcaaatcttaggaaacaarccttcatttcagggcatccaggta

SEQ ID NO: 62516 - DNA, 50 bp, homo sapien
agttattaatcaagaactgtagaaargagtctaatgacactagaaattca

SEQ ID NO: 62517 - DNA, 50 bp, homo sapien
tttgattcattgtatactttaaatasagtaggtatgcatttaattccctt

SEQ ID NO: 62518 - DNA, 50 bp, homo sapien
tactcaaattccagaaatgttcgagragtgcctactctgtgtgtggttag

SEQ ID NO: 62519 - DNA, 50 bp, homo sapien
gttaatgacagattaatcattgaagragtaaatattaataaactggaaga

SEQ ID NO: 62520 - DNA, 50 bp, homo sapien
tccaccaagctaagtgaaccctcaarcacaaaacacaagttgcaccaaat

SEQ ID NO: 62521 - DNA, 50 bp, homo sapien
tcttattgggaagaactgttttccaytgaaatttccataattggccaaca

SEQ ID NO: 62522 - DNA, 50 bp, homo sapien
tcagtgaatttacagcgtgggataawatgtgaccactgaatgtagaaaca

SEQ ID NO: 62523 - DNA, 50 bp, homo sapien
gccagagatgctgctaaacatctgckacggtttggatatggtttgtcccc

SEQ ID NO: 62524 - DNA, 50 bp, homo sapien
ggaaatcttcaaaggtcttccagtcrcagtgaacatttttcaatgacata

SEQ ID NO: 62525 - DNA, 50 bp, homo sapien
ttgagatgcccagcaaacctgctaayattgttcattcaaaccttttcttc

SEQ ID NO: 62526 - DNA, 50 bp, homo sapien
attttgcccattccgagcacctatawctacagaaaagcaaacaacttgag

SEQ ID NO: 62527 - DNA, 50 bp, homo sapien
tatcccttagtccataaatctaatcwctcctttatttctattaaatggac

SEQ ID NO: 62528 - DNA, 50 bp, homo sapien
aagttttctgtctgctgtaataccaratccacaatctacattccatgtta

SEQ ID NO: 62529 - DNA, 50 bp, homo sapien
cattcttgacctctttgtgggattakgttctcctgatcatctcctcctca

SEQ ID NO: 62530 - DNA, 50 bp, homo sapien
ttcaaatattgactttaccacttacygctctaacttgtactttattcacc

SEQ ID NO: 62531 - DNA, 50 bp, homo sapien
gcaggatattcacatctggaactcaraaaaaagatgtgggttggagatac

SEQ ID NO: 62532 - DNA, 50 bp, homo sapien
aactatggtttatttatagtcaaaasgcaacatctctttacagttacaga

SEQ ID NO: 62533 - DNA, 50 bp, homo sapien
tccagccagctaatgtgatggacacsgtatctggagagtcctgcatttca

SEQ ID NO: 62534 - DNA, 50 bp, homo sapien
aacatgatctcaagatacagaaataygagaaagtaaatgtgaatgattgt

SEQ ID NO: 62535 - DNA, 50 bp, homo sapien
taacccacacttccaagccgatgaarttatggtgaacatccaggtctgct

SEQ ID NO: 62536 - DNA, 50 bp, homo sapien
aaatagacatatataaaactgactcratgtgtccccaacatgatctcaag

SEQ ID NO: 62537 - DNA, 50 bp, homo sapien
atgaaaaaactgtagcacatcatcamctgtgtaatagtttggaggattat

SEQ ID NO: 62538 - DNA, 50 bp, homo sapien
cctgtgggaagttcaaagccagctcrtagacagtatctgctttctctgtc

SEQ ID NO: 62539 - DNA, 50 bp, homo sapien
tatcagcttcagaagtcctagtttgyatcatctaaattaggtatggtgag

SEQ ID NO: 62540 - DNA, 50 bp, homo sapien
gtatggtttaaatcactgacaattaygtatagtaaggatacccctcagag

SEQ ID NO: 62541 - DNA, 50 bp, homo sapien
aatatatgtgtgatgtttcaacacaytgtagttcttattatctttggtgt

SEQ ID NO: 62542 - DNA, 50 bp, homo sapien
atcagtgtactgcaaaagtatgtgckaaacttcaacgcaaaagtatgcac

SEQ ID NO: 62543 - DNA, 50 bp, homo sapien
catcccatcacttgtttcattcttayaccatttcaaggccacctcttagt

SEQ ID NO: 62544 - DNA, 50 bp, homo sapien
caaagctacagtaattaagacactaygatattagcaaaggaataggcaaa

SEQ ID NO: 62545 - DNA, 50 bp, homo sapien
acctcttagtgttgctctacctatcmacaacagagctctatcccctgtgc

SEQ ID NO: 62546 - DNA, 50 bp, homo sapien
ggaatcttttggaggatactacaaamtcattacttgtgtgtttcattaac

SEQ ID NO: 62547 - DNA, 50 bp, homo sapien
taagtgttcagtttctatttcctgaygttgtagaatgccaggtagggctg

SEQ ID NO: 62548 - DNA, 50 bp, homo sapien
atacagacaatagaaaacattaaagsctattcatactgttagtacaaaat

SEQ ID NO: 62549 - DNA, 50 bp, homo sapien
gtgaactttgatggtaacagaggaakatacgacagatgtgtgtttgaatt

SEQ ID NO: 62550 - DNA, 50 bp, homo sapien
cctccgactgcttggcagatggaaargcatttaaagtggaaactgaagga

SEQ ID NO: 62551 - DNA, 50 bp, homo sapien
caacataatctgaaagtttggcaacsacattttacagaagaaaaaaaatg

SEQ ID NO: 62552 - DNA, 50 bp, homo sapien
gtgtgtatataggctatcatgaaatycaaacctcgtcaggaaagaaaatg

SEQ ID NO: 62553 - DNA, 50 bp, homo sapien
tcgttattggtcatggaaaatatgcygtgactagtcacagactaatgata

SEQ ID NO: 62554 - DNA, 50 bp, homo sapien
agtaacatctcagggtgttcattaaygctgaagtttgcaaaggcaacaaa

SEQ ID NO: 62555 - DNA, 50 bp, homo sapien
aaaatatttaaacaacatttgacgaygtttccgaattttctgtaactaca

SEQ ID NO: 62556 - DNA, 50 bp, homo sapien
taggttatgtcatgtaagcacgtatkagattgttttagtttttgaaacag

SEQ ID NO: 62557 - DNA, 50 bp, homo sapien
tggaaaaaaataggaatttaacaggmgcttcaggtttgttggcagtttaa

SEQ ID NO: 62558 - DNA, 50 bp, homo sapien
aggaaagcttcagttgtgattcacakatttaatcccaggtaggcaaaaca

SEQ ID NO: 62559 - DNA, 50 bp, homo sapien
gaaaccaccaaccacattcacatacrtgccataagtccctgaaatgcagt

SEQ ID NO: 62560 - DNA, 50 bp, homo sapien
taatgcagatcaaatgaatgaaatayggcatcttactatacctttaatat

SEQ ID NO: 62561 - DNA, 50 bp, homo sapien
caatagcatgttgtgataagtaccaygaagaaataaacactgtgaagtga

SEQ ID NO: 62562 - DNA, 50 bp, homo sapien
gacatttaggtaagagattaaattgwagtgccatttctgatataagttat

SEQ ID NO: 62563 - DNA, 50 bp, homo sapien
aatttgttatcatttatgatgcaaaygtactgttgatgctataaatcaac

SEQ ID NO: 62564 - DNA, 50 bp, homo sapien
gataatccagcctacagcactacagraggttttgggttacacaagccatg

SEQ ID NO: 62565 - DNA, 50 bp, homo sapien
gtcacaaagggagagcaggaaaaaamctttgtagtcatctttagtccaga

SEQ ID NO: 62566 - DNA, 50 bp, homo sapien
tcccagagaaagtatctgttgcagaygtagtagatacataataatacagt

SEQ ID NO: 62567 - DNA, 50 bp, homo sapien
ttgagttcagctatgtggtcaatgaktaagtcatgcctatgtaagaaaac

SEQ ID NO: 62568 - DNA, 50 bp, homo sapien
ctcctatgatgacctaatcgggacarttgtgaaagtcttcaagacaggaa

SEQ ID NO: 62569 - DNA, 50 bp, homo sapien
attcactgagcactcccgaacattamatattattctttttgctgatgact

SEQ ID NO: 62570 - DNA, 50 bp, homo sapien
atttgattaagatcccttttgaaagwataacagaaataacttagaatcag

SEQ ID NO: 62571 - DNA, 50 bp, homo sapien
ggaatatgagtcaaactgtagaaaaytacttcacccttatagtcaacatt

SEQ ID NO: 62572 - DNA, 50 bp, homo sapien
tttttctttttttttgccaattgtaygcttttaaatcaagttttaccctg

SEQ ID NO: 62573 - DNA, 50 bp, homo sapien
ttcacccaaacattctatcagtttayagtcatcagcaatagatgggagta

SEQ ID NO: 62574 - DNA, 50 bp, homo sapien
caatgattcaagagggagaggacaarggtgtaaagtcagactgtttcact

SEQ ID NO: 62575 - DNA, 50 bp, homo sapien
gggttgtaatatgaggaaactggcaytaaccctcatgcattcagtctctc

SEQ ID NO: 62576 - DNA, 50 bp, homo sapien
ttctagatctggtaccattaattaayatgctgaagagtcaaactactggg

SEQ ID NO: 62577 - DNA, 50 bp, homo sapien
cttgccaaagtttcagtatatttcartcagcatttaaatggtaggtaggg

SEQ ID NO: 62578 - DNA, 50 bp, homo sapien
aatgcttcacagaaagctaaataaaygcctatgtactgtggtggttccat

SEQ ID NO: 62579 - DNA, 50 bp, homo sapien
gtaatccttttattggcttctattaygagtacaaaaaagtactgaaaatt

SEQ ID NO: 62580 - DNA, 50 bp, homo sapien
tgctccttagaattgttgctttggtracatgtggagaaggatggtggttg

SEQ ID NO: 62581 - DNA, 50 bp, homo sapien
gtgttgcgtatgtgttttactttacygcatcattttaaaaattaagttgg

SEQ ID NO: 62582 - DNA, 50 bp, homo sapien
caggaagagaaaatccattctgaaayatctggatgaagatactaagtgaa

SEQ ID NO: 62583 - DNA, 50 bp, homo sapien
ttgtcctctctttctggcatctccartagtaatcatgtctcttctaggtt

SEQ ID NO: 62584 - DNA, 50 bp, homo sapien
ttttttagcctttgctgatggctcakaccatctaaaaacacctccatcac

SEQ ID NO: 62585 - DNA, 50 bp, homo sapien
gtgactctgacttggaagggaaagasagcggatcattattcagtttttag

SEQ ID NO: 62586 - DNA, 50 bp, homo sapien
agtggcacagatgtggacaagtcccratatgatcaaaatggagtttcaga

SEQ ID NO: 62587 - DNA, 50 bp, homo sapien
agctattatgtatcataattcttaastaatcaaaatgcttttagtccttt

SEQ ID NO: 62588 - DNA, 50 bp, homo sapien
tttatagacatcgttctcattgccaktcatttaaaaatgaagcaaagtgt

SEQ ID NO: 62589 - DNA, 50 bp, homo sapien
cctgtattaagtgattaaggtgactwagtatccacatatagccaaaaaat

SEQ ID NO: 62590 - DNA, 50 bp, homo sapien
aaaaaaagaaggaaagaaaaatctcmatgacgtcctgtaggacagttttt

SEQ ID NO: 62591 - DNA, 50 bp, homo sapien
atgttatttaataaagatttggatgyagcataaaataccaggggaaaagg

SEQ ID NO: 62592 - DNA, 50 bp, homo sapien
gtgataacagatacagagaactgacrcattaaaagaaaaagactgtgtac

SEQ ID NO: 62593 - DNA, 50 bp, homo sapien
ttccagtgtatttgccagaaaatacrcttttacactttagcttaactgga

SEQ ID NO: 62594 - DNA, 50 bp, homo sapien
gcagactgtgttataattacttaaasacactgtaatcaaaatagcttcat

SEQ ID NO: 62595 - DNA, 50 bp, homo sapien
ctacgacctctccttcagaatacttsaaagttgtgtccaatttgtttgta

SEQ ID NO: 62596 - DNA, 50 bp, homo sapien
gaaatacattgcttaaacataataamataaaatcacaaaacccaattgac

SEQ ID NO: 62597 - DNA, 50 bp, homo sapien
aacaacacattcctgggaatctaaamggctacatacatgtgtcaggttct

SEQ ID NO: 62598 - DNA, 50 bp, homo sapien
tggcgaagaagttgaaggtttccagmgatcacatgtggaatcagatggtc

SEQ ID NO: 62599 - DNA, 50 bp, homo sapien
atattccatttatttaaaattctggwacactcaaactggcgcatagttac

SEQ ID NO: 62600 - DNA, 50 bp, homo sapien
aggcccctgaaaaccagttagcaccratcttgtacatatttatagcatac

SEQ ID NO: 62601 - DNA, 50 bp, homo sapien
ttctgaatattccttgaggtctatayaatttttacttgggattttctgag

SEQ ID NO: 62602 - DNA, 50 bp, homo sapien
atttcaggaatgatgaaacaataaaygagaatctggtattaataatctgt

SEQ ID NO: 62603 - DNA, 50 bp, homo sapien
gtttatctatctctgtcttttcctayacaattagcacctcatgatctggg

SEQ ID NO: 62604 - DNA, 50 bp, homo sapien
caaaaacaaaattatcccttgactayaatatgtggcacaagaaaaatcat

SEQ ID NO: 62605 - DNA, 50 bp, homo sapien
caaaatattagctaaccaaatccaasagttcattaaaaaggtcagaacag

SEQ ID NO: 62606 - DNA, 50 bp, homo sapien
ccttccagtgaatgatttaccgaacsaagctcttgcactcttccaaacat

SEQ ID NO: 62607 - DNA, 50 bp, homo sapien
tgggggagagatttttcaacctacayccatcttgtttactccttgaatcc

SEQ ID NO: 62608 - DNA, 50 bp, homo sapien
aagaaagttgaaatgctgcatagctyttttactcagattcagctgttttt

SEQ ID NO: 62609 - DNA, 50 bp, homo sapien
taacagggactgcctaacacaatgaygataagtgccctgcaaacaaagga

SEQ ID NO: 62610 - DNA, 50 bp, homo sapien
agaaagagctctttataaatcattcrgaaaaatagcactctcaatggaaa

SEQ ID NO: 62611 - DNA, 50 bp, homo sapien
attgtgctcctctagtactaggtacstgtcctgagcatgcagatgtcttg

SEQ ID NO: 62612 - DNA, 50 bp, homo sapien
gtctttcagggatccaccaaccaggycaaaataaacagcagttctttgaa

SEQ ID NO: 62613 - DNA, 50 bp, homo sapien
atcagaatcttagttctcttattcaytccaaaaacgtatgaggctgcagc

SEQ ID NO: 62614 - DNA, 50 bp, homo sapien
tggaatgaaaggtaaaaaccacactwagtagcattgtcagtaaaagtagc

SEQ ID NO: 62615 - DNA, 50 bp, homo sapien
tatgccctgctggctttgatgatgcyaattgctatattggggaggcccat

SEQ ID NO: 62616 - DNA, 50 bp, homo sapien
aaaccaaagactttttcattcttaargtggttaaatattatcagaattga

SEQ ID NO: 62617 - DNA, 50 bp, homo sapien
caaatagggggtgcgaagttagaccrccatatagactcccggtgctgcaa

SEQ ID NO: 62618 - DNA, 50 bp, homo sapien
acttctccaggtctcaaatgagacaygaacactgtggaagaaagtcagag

SEQ ID NO: 62619 - DNA, 50 bp, homo sapien
aagcaaaaaatgtaggccaggcaaaytcacatcaaatcaagacacctata

SEQ ID NO: 62620 - DNA, 50 bp, homo sapien
aaaaagccaaaacaaacagttcacayggaaacataagcctttgaaatgct

SEQ ID NO: 62621 - DNA, 50 bp, homo sapien
tattcttttatggtgttacagagtcrgaaaagtaattttaccagaagaga

SEQ ID NO: 62622 - DNA, 50 bp, homo sapien
ttaaagatttttacatttgggttgargaacactgattggatacgtggata

SEQ ID NO: 62623 - DNA, 50 bp, homo sapien
tgctattataaaatcaccttcaggartagcagtactttgaactttaaaaa

SEQ ID NO: 62624 - DNA, 50 bp, homo sapien
agaaacaaattaggatacatccatamaatagaacactacttagcggtaac

SEQ ID NO: 62625 - DNA, 50 bp, homo sapien
catctacttaacaccttttcttctgwattcctagttctgtattaatcgga

SEQ ID NO: 62626 - DNA, 50 bp, homo sapien
gtacatctttacattccaactagaargatgccctttggacctgaaggtag

SEQ ID NO: 62627 - DNA, 50 bp, homo sapien
gttttcaggatttggggacacctgaracaactttgtaagagtctctcaaa

SEQ ID NO: 62628 - DNA, 50 bp, homo sapien
cactaagtttcattggtagagagaaytggtatctttccacatatcatact

SEQ ID NO: 62629 - DNA, 50 bp, homo sapien
catcaataatgtggtggtatctctayataactcaacacagcaaaacttaa

SEQ ID NO: 62630 - DNA, 50 bp, homo sapien
tcctcctggctgcatatcggtgcackctgggtaactacagatgtcttctt

SEQ ID NO: 62631 - DNA, 50 bp, homo sapien
tgtcccttcccataaaatctgataaygtagccaagctaggggaaagtaag

SEQ ID NO: 62632 - DNA, 50 bp, homo sapien
actctatatgtagtatatattcatcrataccaattggttctattaaatta

SEQ ID NO: 62633 - DNA, 50 bp, homo sapien
atcaattctgtgggggtgtcataatktggtcctgatacactgttcttggc

SEQ ID NO: 62634 - DNA, 50 bp, homo sapien
ccaggaatatttgaatttcatctcastgactggttggtttttatcttatg

SEQ ID NO: 62635 - DNA, 50 bp, homo sapien
ttccatttaaatgtaaaacatacatraaaaagatctccgtcagcagaaag

SEQ ID NO: 62636 - DNA, 50 bp, homo sapien
cagccctgacaggtcatcaagaaaaygggtgcaatggatcaaaaagagaa

SEQ ID NO: 62637 - DNA, 50 bp, homo sapien
gggtatgttaataactgtcatctacrcatctatttctccaagtctaaaga

SEQ ID NO: 62638 - DNA, 50 bp, homo sapien
cctcctccttcctgtgtttactctaygctctatggtagtgaagtgcacat

SEQ ID NO: 62639 - DNA, 50 bp, homo sapien
gtttaaatttgtacaactactttgcragatggtttaattctatatggtaa

SEQ ID NO: 62640 - DNA, 50 bp, homo sapien
acagcctctcctccccaagataccaygaaattattcaaactagccaatcc

SEQ ID NO: 62641 - DNA, 50 bp, homo sapien
tccttgaggtaactctgctgtaataygctaccttttttctctctttaata

SEQ ID NO: 62642 - DNA, 50 bp, homo sapien
tcaacattctggccaactcttggtayggtgagatcttaaatttttgcaat

SEQ ID NO: 62643 - DNA, 50 bp, homo sapien
gtgtctagatttttgattttgcttayggatattaagttgttccagtgcca

SEQ ID NO: 62644 - DNA, 50 bp, homo sapien
agtgggtcctctattataatacttayggtgccttatagttttcttatttg

SEQ ID NO: 62645 - DNA, 50 bp, homo sapien
tgagacaaccagaggtgcatttttgratagagccattgataacccaatat

SEQ ID NO: 62646 - DNA, 32 bp, homo sapien
tttctgtgctgatttgyatatatattatgata

SEQ ID NO: 62647 - DNA, 50 bp, homo sapien
aaggttataacccatgcactccctcyatatattttttttattttaagttc

SEQ ID NO: 62648 - DNA, 50 bp, homo sapien
aggttgggtcagcggtattccagccrattaaaagaagagttggcaaacat

SEQ ID NO: 62649 - DNA, 50 bp, homo sapien
aatgctatctagggcttcgtttcacrcactattctatatctaatatacac

SEQ ID NO: 62650 - DNA, 50 bp, homo sapien
aaactccctaggagttgctgggtatygagaaccaaactttgcttcctgcc

SEQ ID NO: 62651 - DNA, 50 bp, homo sapien
aatagctcatactgggttaccaacargagcaaaagagaaagaggctgtta

SEQ ID NO: 62652 - DNA, 50 bp, homo sapien
atgtgcaaccccactgacttatccamggcctcatggaaggcttatttcct

SEQ ID NO: 62653 - DNA, 50 bp, homo sapien
cactatattgatactgaacttagtgsagatacctgattggcacagctctc

SEQ ID NO: 62654 - DNA, 50 bp, homo sapien
agccattatccagtgttcctagaatyatgccagtgagaaaggtacaaaaa

SEQ ID NO: 62655 - DNA, 50 bp, homo sapien
acctgtggagtggtcaaggagcttgkatctgggagcacaggcatgtatgg

SEQ ID NO: 62656 - DNA, 50 bp, homo sapien
atgatctctatctcttattcatggaygtaccccaattttcagtagacgct

SEQ ID NO: 62657 - DNA, 50 bp, homo sapien
ggacccaatagagttatgtcaaaaaytatggatgtgtaagaaccaggcag

SEQ ID NO: 62658 - DNA, 50 bp, homo sapien
gacactaagacctctgacgtgtttaygctgcaaaggcacatttgcagtcg

SEQ ID NO: 62659 - DNA, 50 bp, homo sapien
cacttattattttgggcatcaattascaccttagcaaaaattgactgaaa

SEQ ID NO: 62660 - DNA, 50 bp, homo sapien
taaggttagtccctgctgttatagcygaagcaagtagcattccaggtagt

SEQ ID NO: 62661 - DNA, 50 bp, homo sapien
gcctacgatactaaggggtctaataygtgcaaccaaagataccagttatt

SEQ ID NO: 62662 - DNA, 50 bp, homo sapien
tatccctctgacagacaaagaaaaayagagtacctaagtagcctgtctga

SEQ ID NO: 62663 - DNA, 50 bp, homo sapien
atattatgctgtaatacactgttcamatattatgagattctaatggttaa

SEQ ID NO: 62664 - DNA, 50 bp, homo sapien
tgatggttttataagcatatggcatytcctcagcttggacttctctctcc

SEQ ID NO: 62665 - DNA, 50 bp, homo sapien
tacagaagatctggtgaatgacttayaaggaccaaagagaagaaagtaca

SEQ ID NO: 62666 - DNA, 50 bp, homo sapien
atttcaaaaatgttaaatggtacgtyaattctccctttattcttcatgct

SEQ ID NO: 62667 - DNA, 50 bp, homo sapien
cttggagtatttccaagaacagtgartcaaacttggggccagggcatggc

SEQ ID NO: 62668 - DNA, 50 bp, homo sapien
ggggcacgtgatatgtagtcttttayagcgaatagacaatcagaaacagc

SEQ ID NO: 62669 - DNA, 50 bp, homo sapien
tgtcattcacgacctggtcctaggcyacctttcccgtctcatttcttgcc

SEQ ID NO: 62670 - DNA, 50 bp, homo sapien
agtacacaaaaattgagttttctaakttaccagcagcaatcaattagaga

SEQ ID NO: 62671 - DNA, 50 bp, homo sapien
ctgaactcctctttcagacactttamatagtgctactccttggtttaaat

SEQ ID NO: 62672 - DNA, 50 bp, homo sapien
gaaaaatgtgtaaaagtcatcaatgwagtaattaagtgctcagaaacaag

SEQ ID NO: 62673 - DNA, 50 bp, homo sapien
agtggcgctatttccccaagaatgaygtaaaattctcttcttcaaacaca

SEQ ID NO: 62674 - DNA, 50 bp, homo sapien
gatgaaagagttgacaattcatgtarcataaagcacctttggatagtcaa

SEQ ID NO: 62675 - DNA, 50 bp, homo sapien
tgttcaaaggaaaaataaacttaacrccctatcaaatcattacaaagtgg

SEQ ID NO: 62676 - DNA, 50 bp, homo sapien
taaaaattaccttatattcttgttaygaaaacggacgtgcccaggacaaa

SEQ ID NO: 62677 - DNA, 50 bp, homo sapien
aatggttactctataaagagattaaraaagaaagtcaagggagggtaagg

SEQ ID NO: 62678 - DNA, 50 bp, homo sapien
aacttggcacatgaagttttaaatamggaacacaatgaccaacttatttg

SEQ ID NO: 62679 - DNA, 50 bp, homo sapien
agctctgtatctttcttttgttcaaytgagatcattctgttttccattat

SEQ ID NO: 62680 - DNA, 50 bp, homo sapien
gtggtagcagcaggaggttggtttaragtagcttaattgtattgtctgcc

SEQ ID NO: 62681 - DNA, 50 bp, homo sapien
gaatttacaaaagatctgccagtaaycaatggtcaggcttctccccttag

SEQ ID NO: 62682 - DNA, 50 bp, homo sapien
agctaatttatttgtttatcgtggtrtaacaggcactgcatgaatctggt

SEQ ID NO: 62683 - DNA, 50 bp, homo sapien
atttgagacatttacaaaagttgccrataaggaaaacatgaaaacatttt

SEQ ID NO: 62684 - DNA, 50 bp, homo sapien
aaaacccaccaaaagcaacaaaaaakaaatatccagctgtttcttctctt

SEQ ID NO: 62685 - DNA, 50 bp, homo sapien
gtatgtcacacaatacacatctacaygcaaagcccagatgggtgaagttg

SEQ ID NO: 62686 - DNA, 50 bp, homo sapien
gcaattgatcaataccaaactttgcraaaaactagtgtgggtatgttgca

SEQ ID NO: 62687 - DNA, 50 bp, homo sapien
aagtcaaacctagtctcaagctctcyaaggtgacatactttcctctagtt

SEQ ID NO: 62688 - DNA, 50 bp, homo sapien
gacagatcaactagttgatgccaatygatactctgacaaggatctcatct

SEQ ID NO: 62689 - DNA, 50 bp, homo sapien
tataaaacctgtctgcgggacagttragaaaatggaagatgaggtacagg

SEQ ID NO: 62690 - DNA, 50 bp, homo sapien
ttagatgttgattacttgtatttcasagtgtatagaaaccccagcaccat

SEQ ID NO: 62691 - DNA, 50 bp, homo sapien
cagacaagaggttctgattctgagakgtgtagactcccttgggactttag

SEQ ID NO: 62692 - DNA, 50 bp, homo sapien
aaagaaaagcacctaaatgtttctcrcaaagctttggttcttaattctaa

SEQ ID NO: 62693 - DNA, 50 bp, homo sapien
atgaaatagtaattccagggcatgaygtaaatgtgggaaaataagacaaa

SEQ ID NO: 62694 - DNA, 50 bp, homo sapien
tgatttttttttcatttgtttcacayagaagagttaatcaagtcatgatt

SEQ ID NO: 62695 - DNA, 50 bp, homo sapien
gactgaaattaatagctttgcaattkaagaaccaaataagaaaatactcc

SEQ ID NO: 62696 - DNA, 50 bp, homo sapien
ttcaagaaatttcaaataggaaatcrcttcccttgccttcagaaatggga

SEQ ID NO: 62697 - DNA, 50 bp, homo sapien
gttctgaaggagaaaagacaaaaggycctaagagatctaagagaatttca

SEQ ID NO: 62698 - DNA, 50 bp, homo sapien
tgcttagtcccttgattgttcttcawctcctattactgtcttatatttta

SEQ ID NO: 62699 - DNA, 50 bp, homo sapien
ggggccctgtgttgctaaggaattamtgcaggcactgagaaaagtctcag

SEQ ID NO: 62700 - DNA, 50 bp, homo sapien
aagaaaaataggttatcattcttgcrcatgttcttgattaggatgtacag

SEQ ID NO: 62701 - DNA, 50 bp, homo sapien
aatgacaaaatgtccaacacttcaaktattttcctttagaaactgtacat

SEQ ID NO: 62702 - DNA, 50 bp, homo sapien
gagtatcagttgttgatgaattcaaygctggcttaatgacaaaatgtcca

SEQ ID NO: 62703 - DNA, 50 bp, homo sapien
tatgatacccatggaggtcaatactsaaaacttaaagtttacccagaaaa

SEQ ID NO: 62704 - DNA, 50 bp, homo sapien
tcctactgacctcctttaagtttccrccatggtatctgttccatgcacta

SEQ ID NO: 62705 - DNA, 50 bp, homo sapien
cacccaggaaagaatcattctgataratcaaattttaccactccacgagt

SEQ ID NO: 62706 - DNA, 50 bp, homo sapien
tctttctttccccctcgctctggagrcaatttgctacaataatcgatttt

SEQ ID NO: 62707 - DNA, 50 bp, homo sapien
tatctggtaaacccaaataatctatmaaaaatccactagaaccaataaat

SEQ ID NO: 62708 - DNA, 50 bp, homo sapien
tgaaagcttcccccttctctagtacygccataaacactttgctggcactg

SEQ ID NO: 62709 - DNA, 50 bp, homo sapien
aatttggaaagaattgcactcttaamaaaattgagtgtatctctctattt

SEQ ID NO: 62710 - DNA, 50 bp, homo sapien
aacacgagttattctagcataactgrcctttattgcaaattgccttattt

SEQ ID NO: 62711 - DNA, 50 bp, homo sapien
gaccataaagtttgatgcctcctaartcgtacattgtgggaatttaggga

SEQ ID NO: 62712 - DNA, 50 bp, homo sapien
tgagtcactatcacaactacagaatraagcatgctgcataacctttctgt

SEQ ID NO: 62713 - DNA, 50 bp, homo sapien
ccaataaataaatacataccatagarcataaacctacccagccacagaaa

SEQ ID NO: 62714 - DNA, 50 bp, homo sapien
ctgtcaccctttttatgttttgtaaygcttagtaactacgtgataggtac

SEQ ID NO: 62715 - DNA, 50 bp, homo sapien
tggaaattctacttgtatatgatggwgtaggtagatgaagagaattacat

SEQ ID NO: 62716 - DNA, 50 bp, homo sapien
actaaggcagtttatcttgggataaragaggaagaaattcaagatatatt

SEQ ID NO: 62717 - DNA, 50 bp, homo sapien
taacctaatgttgtttctgttaaacygaaattgctgtttatggcagactt

SEQ ID NO: 62718 - DNA, 50 bp, homo sapien
gtgattaatccattttgccttcattmttcagtggtttggcatatagattg

SEQ ID NO: 62719 - DNA, 50 bp, homo sapien
aatatacagtgctcggtacactgtaracacccagaaactgttgaaataga

SEQ ID NO: 62720 - DNA, 50 bp, homo sapien
tccaactttcagagatctttaaggcyatctggaagctttggatataagac

SEQ ID NO: 62721 - DNA, 50 bp, homo sapien
aatgctaaaagggctctattgaaaamgtatatttcttacaacctccacta

SEQ ID NO: 62722 - DNA, 50 bp, homo sapien
gaaacttaaaagatgagtattaccaraaacaaagcctagaaaaggagaga

SEQ ID NO: 62723 - DNA, 50 bp, homo sapien
aaaagcccatgatgcagtcaggtgamacttaaaagatgagtattaccaaa

SEQ ID NO: 62724 - DNA, 50 bp, homo sapien
cttcttaatctccttgggattcttayattaggtgtacaataatcctgtta

SEQ ID NO: 62725 - DNA, 50 bp, homo sapien
ttggactcatctctacaccaccatayaattatcactgcttgtaattcttt

SEQ ID NO: 62726 - DNA, 50 bp, homo sapien
tacaagtatgcgatcttcctttgaaygcactgagttaggaaaaacatgcc

SEQ ID NO: 62727 - DNA, 50 bp, homo sapien
accaagcttttgaaaaatgttgaacratgtcccacagtcctcctcctgca

SEQ ID NO: 62728 - DNA, 50 bp, homo sapien
aatacatcttatcagtttaataaagrcaccaagataacattaacatgatt

SEQ ID NO: 62729 - DNA, 50 bp, homo sapien
cactgatgttttgaggcctttccagyggtagagttcaagagttcttaatt

SEQ ID NO: 62730 - DNA, 50 bp, homo sapien
tgaagttctgtgtgttaaaattcaargagttgttcacccaaaaaagcaac

SEQ ID NO: 62731 - DNA, 50 bp, homo sapien
ataatttatttaaataaactttttaygctgagataaggatctgcgtttgt

SEQ ID NO: 62732 - DNA, 50 bp, homo sapien
ctgagtgaactcactgccaagatccrcgtaagaatatttaaagtcacaga

SEQ ID NO: 62733 - DNA, 50 bp, homo sapien
acggcactcctcctgtatgctagacyctagtccaggtgtgagggacacca

SEQ ID NO: 62734 - DNA, 50 bp, homo sapien
ccctagtaggaaagtaaccttgaaaygaccaatgcactcttttttttttt

SEQ ID NO: 62735 - DNA, 50 bp, homo sapien
ctagaagattccagaaaactgaaacrtctgtactgtaaaggccattcctt

SEQ ID NO: 62736 - DNA, 50 bp, homo sapien
ttaagccaacaagattttgcttacawccctagtaggaaagtaaccttgaa

SEQ ID NO: 62737 - DNA, 50 bp, homo sapien
tatgcaaaatttggttatatgtgaargtgagtgcatctcctgggaaaaag

SEQ ID NO: 62738 - DNA, 50 bp, homo sapien
ataggaaatcaggtacaatactaagrataatgaacatttactcagcactc

SEQ ID NO: 62739 - DNA, 50 bp, homo sapien
gttcagagttgcttttgccaccaaakgtacttctaacaaacttatgaaaa

SEQ ID NO: 62740 - DNA, 50 bp, homo sapien
ataattctataaatactctcatataytaagaaccgctgaggatgttgata

SEQ ID NO: 62741 - DNA, 50 bp, homo sapien
gccttctttctgctttgtaccttgcrattctttcggctttggactccaga

SEQ ID NO: 62742 - DNA, 50 bp, homo sapien
taataaacagcaagcctttcctgggwattgtgtaaggttttacagtgtaa

SEQ ID NO: 62743 - DNA, 50 bp, homo sapien
aggtaaaaaaaaacacttttaccagrcaggacattgcaaggccacagaga

SEQ ID NO: 62744 - DNA, 50 bp, homo sapien
catcaggtattcatagtaagacctasgccccaaacctcatcattattttg

SEQ ID NO: 62745 - DNA, 50 bp, homo sapien
ctttcctcttttcctccatagggtayaggataacagaaaagtccttgatg

SEQ ID NO: 62746 - DNA, 50 bp, homo sapien
aggagtaaatgaccagttaagccagwggacgacccacccaggtgagagat

SEQ ID NO: 62747 - DNA, 50 bp, homo sapien
gcccaaattcagaaagcccaaagctstatgatgaccctgttggtaaagta

SEQ ID NO: 62748 - DNA, 50 bp, homo sapien
agagttatctagtccttgtaggtaayggcacatttaatcaagataatgat

SEQ ID NO: 62749 - DNA, 50 bp, homo sapien
ttttgcataaggtgtaaggtttaggwcaagatttataatttgcctatgat

SEQ ID NO: 62750 - DNA, 50 bp, homo sapien
ccacattccaatctgagggaacaaayggagcacccacctgagcagcttca

SEQ ID NO: 62751 - DNA, 50 bp, homo sapien
aggtaatttcacccattctcagaaawgtatttttattccagattgttttc

SEQ ID NO: 62752 - DNA, 50 bp, homo sapien
tcaactgcgtagaccaggcaaccagwctcattagttattggaaatgctat

SEQ ID NO: 62753 - DNA, 50 bp, homo sapien
ctactttattagctgagaacacttaygaatctaaaaatacttcgttttgg

SEQ ID NO: 62754 - DNA, 50 bp, homo sapien
cttctgtgactgggtcctgaaaatcmaaacaagtcgaccaatcatcagga

SEQ ID NO: 62755 - DNA, 50 bp, homo sapien
tgcagaagagcagctttggaatgaargatattaggagaggcaagtgaatt

SEQ ID NO: 62756 - DNA, 50 bp, homo sapien
ataaataagacatgttctccattcaraagaaatctacaatctcagctggg

SEQ ID NO: 62757 - DNA, 50 bp, homo sapien
gctgttttgggccccctatgctcaasttacctgacctctgaacttaactc

SEQ ID NO: 62758 - DNA, 50 bp, homo sapien
atactttgttaataaacacaagcaarttaaagaagctcaaaatgagataa

SEQ ID NO: 62759 - DNA, 50 bp, homo sapien
agaaggacatgagcactaatctgacmagaaatttaagttttgatctggac

SEQ ID NO: 62760 - DNA, 50 bp, homo sapien
tgtgaagaaagtaaaacagttgtgcrttaaatagttacttgcttagggct

SEQ ID NO: 62761 - DNA, 50 bp, homo sapien
agagactcaagcacagccacgtggtraaagaagatttatagacaaaaaag

SEQ ID NO: 62762 - DNA, 50 bp, homo sapien
ggcagaggactgagttggaacagccygagagctcagaggagagccaggga

SEQ ID NO: 62763 - DNA, 50 bp, homo sapien
tcagtagaaaatggcagctacgatayaaagttaattttgatctcatactg

SEQ ID NO: 62764 - DNA, 50 bp, homo sapien
cttctctttaaaagagccctgacgtrcatacttgtgttctctccaattat

SEQ ID NO: 62765 - DNA, 50 bp, homo sapien
atagtcaccttttattaggtgtaggmagtcataaccttattgttccagaa

SEQ ID NO: 62766 - DNA, 50 bp, homo sapien
acacaaagcatactcatctaggacawggatcaacaagcttttccataaag

SEQ ID NO: 62767 - DNA, 50 bp, homo sapien
gtcaagagagtagcctcaggaaaatrggaagaagaaatggagcaagatag

SEQ ID NO: 62768 - DNA, 50 bp, homo sapien
tatttcctagatttgtaagcaaagasagcgttatctggctagatgtagct

SEQ ID NO: 62769 - DNA, 50 bp, homo sapien
atctaaaaacaacaactaaatttgasgtttccagctttagagactcaatg

SEQ ID NO: 62770 - DNA, 50 bp, homo sapien
ttgaaaatcagaatctgtgattaccrcgatcccgtatctaggataacgct

SEQ ID NO: 62771 - DNA, 50 bp, homo sapien
gaagccacaatttaagaaatagtgasaactcctttccacatgcaagtctc

SEQ ID NO: 62772 - DNA, 50 bp, homo sapien
gaagatgactctgcaaaatgggcaaygagctttataaatatcttcctctt

SEQ ID NO: 62773 - DNA, 50 bp, homo sapien
caaaaagacaggaggctttactagcsataacgtggtaagccagagagcaa

SEQ ID NO: 62774 - DNA, 50 bp, homo sapien
aaagaaaactcaaaacaagttggtaytacatgtaacaatgacaaagcaat

SEQ ID NO: 62775 - DNA, 50 bp, homo sapien
tgaatgcacactgcaaataaaatgcrctgtaaactgcttgacgtttattt

SEQ ID NO: 62776 - DNA, 50 bp, homo sapien
tcctagaaaagtaaactaagaattcrcagtaatagccgggcatggtggct

SEQ ID NO: 62777 - DNA, 50 bp, homo sapien
tctacctctgcaaatgttctgtttakgaagacctctacagcatcatttgt

SEQ ID NO: 62778 - DNA, 50 bp, homo sapien
aagactttctctaactgtttattgayggtacattgaattactatttttca

SEQ ID NO: 62779 - DNA, 50 bp, homo sapien
gtccttaagcgcaaggtccaaataaygttgacctttgtattcccagcatc

SEQ ID NO: 62780 - DNA, 50 bp, homo sapien
acatatggtggtttaatttgtatgamcacttttttcttctactactgaga

SEQ ID NO: 62781 - DNA, 50 bp, homo sapien
tctgtcaacaacagcaacaaaagtaraacagctagaaactccagggaaca

SEQ ID NO: 62782 - DNA, 50 bp, homo sapien
ccacctgagaatctggaaaagaataytaaattacaagtgcgaaaccaggg

SEQ ID NO: 62783 - DNA, 50 bp, homo sapien
gtcttgttgttgggaacattggttaygacttccatctcgatctgctactt

SEQ ID NO: 62784 - DNA, 50 bp, homo sapien
aacactctgttttatcttagaagcartaagtgggagaatgggattctaga

SEQ ID NO: 62785 - DNA, 50 bp, homo sapien
ttacctagaaattgaaattaacattyaactctcaggtctccaagtccaaa

SEQ ID NO: 62786 - DNA, 50 bp, homo sapien
aaggcaatcctttaagctatattccyagttttactgtggcatttgctgat

SEQ ID NO: 62787 - DNA, 50 bp, homo sapien
gaggaaagaaaaaaaatttgatggamagaacttggagattgtgttgctga

SEQ ID NO: 62788 - DNA, 50 bp, homo sapien
aatcttcattctgaacaacaaaaaaytgacgtatatcttttgagatctag

SEQ ID NO: 62789 - DNA, 50 bp, homo sapien
atgggtttacatgaaatactatgtasccatgaaaaacagtgaaatcacgc

SEQ ID NO: 62790 - DNA, 50 bp, homo sapien
tactttgaagattactaagagcacargtttaaatacctatagtaactatc

SEQ ID NO: 62791 - DNA, 50 bp, homo sapien
ctgcaggtaaatcttgaaagaaaggragtcaagtatctatcttgactctc

SEQ ID NO: 62792 - DNA, 50 bp, homo sapien
ccaagttatataattgtgaatgttayaatacagacttgaatgtgaatgca

SEQ ID NO: 62793 - DNA, 50 bp, homo sapien
cagcaggaagtgctgttcagtgatgkctgagtgctggccacacaggctct

SEQ ID NO: 62794 - DNA, 50 bp, homo sapien
tatatttattaaattatacattcacraactggggaaatgacaagaggatg

SEQ ID NO: 62795 - DNA, 50 bp, homo sapien
taaagtggtctgtgtctctgaggagytaccatttgagcagagccccagaa

SEQ ID NO: 62796 - DNA, 50 bp, homo sapien
ctgctgtctatcctttgatcttagaractcattattatagatctctccat

SEQ ID NO: 62797 - DNA, 50 bp, homo sapien
tcacacaacttgtctttcctattcartctacttcatttggacctaatgga

SEQ ID NO: 62798 - DNA, 32 bp, homo sapien
cttgttagaaattgacygctaattaatattat

SEQ ID NO: 62799 - DNA, 50 bp, homo sapien
attttacaaggaagatgttggaaacygcgagtgaagtttgggactgggca

SEQ ID NO: 62800 - DNA, 50 bp, homo sapien
tggatgatgttctgtggtccctttayaaagcctcttgcatcccaaatgtg

SEQ ID NO: 62801 - DNA, 50 bp, homo sapien
tttagttcatctgttctttcgttcarcccttagagaggtcatgtagtagc

SEQ ID NO: 62802 - DNA, 50 bp, homo sapien
catgaccacaggttccatgatgctaygtctctatgtaggcgtattttcag

SEQ ID NO: 62803 - DNA, 50 bp, homo sapien
tgcttctcatcaatttgcttggatgraaaccacctaagaaagacattttt

SEQ ID NO: 62804 - DNA, 50 bp, homo sapien
acaatcaaagagtgctcgttctttcrctgatcttttccccttgcaaatac

SEQ ID NO: 62805 - DNA, 50 bp, homo sapien
ctgcaggagttgtatcctagggaccrattgctcttcatctttgccacacc

SEQ ID NO: 62806 - DNA, 50 bp, homo sapien
gtggtagacacagagatgcacaagayagagactaccctggggaagactgg

SEQ ID NO: 62807 - DNA, 50 bp, homo sapien
ggcccaagagttttggctggttccartagggagagattttgtctagagat

SEQ ID NO: 62808 - DNA, 50 bp, homo sapien
agaggctgaaatagtcccatcttacrcttttggtctccctcacagcatct

SEQ ID NO: 62809 - DNA, 50 bp, homo sapien
ttttcagtcatggatctattaattcmataacttcattgagtgcctcctct

SEQ ID NO: 62810 - DNA, 50 bp, homo sapien
aaatccattataaagatcattattakgtaacaaccttgaaaacgctaagc

SEQ ID NO: 62811 - DNA, 50 bp, homo sapien
agttcagaagagatttaaccctccartagaacaaagagaagagacttgct

SEQ ID NO: 62812 - DNA, 50 bp, homo sapien
tgctcggaaatggattcctgttactkcataagaaacctttccaagcattt

SEQ ID NO: 62813 - DNA, 50 bp, homo sapien
ttaattaaaagaaaattcttagccaktattatttcaaatatttctctttt

SEQ ID NO: 62814 - DNA, 50 bp, homo sapien
atttatatttttaaatggcattgtamtaaaaattatgaagattcacagta

SEQ ID NO: 62815 - DNA, 50 bp, homo sapien
tcgcttcctattagctgtgctaaacwattctaaaaggtttaatgaccttt

SEQ ID NO: 62816 - DNA, 50 bp, homo sapien
aacacagacacatttattccatgcamgaccatacaagtgaggagttgttg

SEQ ID NO: 62817 - DNA, 50 bp, homo sapien
ttgctttttaacattcaccagaacayaaagcagagagctcccaattgtta

SEQ ID NO: 62818 - DNA, 50 bp, homo sapien
agaatgcctaacttaacacacattgycaatgcattcaaggagtgctgtgg

SEQ ID NO: 62819 - DNA, 50 bp, homo sapien
cagcatcaattacgccaccagaagawctaaagtagcaaagaacaagacag

SEQ ID NO: 62820 - DNA, 50 bp, homo sapien
tatgttcaagtcctaatccccatacycatgtaagtgaccttattgggaaa

SEQ ID NO: 62821 - DNA, 50 bp, homo sapien
tttgaatttgtaagctctctaacaayggcaaagagaataataaaatacaa

SEQ ID NO: 62822 - DNA, 50 bp, homo sapien
tgattaatggggaaaaagcatttacrgatcagagtcaacaaaataatttt

SEQ ID NO: 62823 - DNA, 50 bp, homo sapien
gagagagtgaggggaggattcctcasgatgcgttgacagtccaggcttga

SEQ ID NO: 62824 - DNA, 50 bp, homo sapien
taggaatattgatgtacaaaaagaaycagataaatgatggaatccagttg

SEQ ID NO: 62825 - DNA, 50 bp, homo sapien
tccatgtaaattctgtcattaaaaaygatgccagaagtgtggtagttgag

SEQ ID NO: 62826 - DNA, 50 bp, homo sapien
tgtttctagaccaccagtactcctamagaccaaaattaattgctagtttt

SEQ ID NO: 62827 - DNA, 50 bp, homo sapien
ttgagatcgatgttagaacatcacamaaaagggcttatttcattaaatta

SEQ ID NO: 62828 - DNA, 50 bp, homo sapien
cttcaaaaatgagacagattgtcccygataaattacaaaaagaattaaac

SEQ ID NO: 62829 - DNA, 50 bp, homo sapien
agctatcataaccactgtgcaaatcrcccaacaaagagagtgtccttcat

SEQ ID NO: 62830 - DNA, 50 bp, homo sapien
tttgtgtactaggactagaggttcayatgagcagggaattgataaataaa

SEQ ID NO: 62831 - DNA, 50 bp, homo sapien
ttataaaatttctcccaattgtacarcttaagaataaaccaacataagag

SEQ ID NO: 62832 - DNA, 50 bp, homo sapien
ttaaaatgtggaggaagatacatagycaagatgcatatattaaatgggat

SEQ ID NO: 62833 - DNA, 50 bp, homo sapien
tgtggcctgtgctttattttctggaygttctccttcccttccccccacca

SEQ ID NO: 62834 - DNA, 50 bp, homo sapien
agccaattacaattctttttacatasttggttgcttcccttgctggagat

SEQ ID NO: 62835 - DNA, 50 bp, homo sapien
atgtattttctcttagagcatctcckgcataattgagattaatttttagg

SEQ ID NO: 62836 - DNA, 50 bp, homo sapien
atttcaaatacgagtagcatagaatyaagcttgaaacccataggaactga

SEQ ID NO: 62837 - DNA, 50 bp, homo sapien
ttttgtacctttttgatagttaatckactccattaggaacaatattctgc

SEQ ID NO: 62838 - DNA, 50 bp, homo sapien
gtaacagataatattgtcaacaatcrcattaataaaaattaaaatttctt

SEQ ID NO: 62839 - DNA, 50 bp, homo sapien
cagctccagctgtagtatctgttaamctctggtgctggtagtgatacatt

SEQ ID NO: 62840 - DNA, 50 bp, homo sapien
aaactgtattcactacagaaaagaamtgcttgtgttacacattgaaggtc

SEQ ID NO: 62841 - DNA, 50 bp, homo sapien
tcatcagggattcgctgctatccagrctagaaagggagagcaccactcca

SEQ ID NO: 62842 - DNA, 50 bp, homo sapien
agtaatcattcaatacagtattacartaatccaatgtcaatacattttat

SEQ ID NO: 62843 - DNA, 50 bp, homo sapien
gttttatattgcacgttaggaaagayggtagaggtaaatctcagtattaa

SEQ ID NO: 62844 - DNA, 50 bp, homo sapien
atttgcatttattcaattcatgatamgtgtttactaaaacaaaacacatt

SEQ ID NO: 62845 - DNA, 50 bp, homo sapien
aagatgacaagcagtgagtcagtgamaatcagagtatacagctgtccata

SEQ ID NO: 62846 - DNA, 50 bp, homo sapien
tttatgaaatgattctaaggatctcrattccctctctgtcatgtgtttat

SEQ ID NO: 62847 - DNA, 50 bp, homo sapien
tggagcccgccagcactgggagatcratgtgaactggaattttcaacaca

SEQ ID NO: 62848 - DNA, 50 bp, homo sapien
catccatgttttagcatatgtcagcmctacaatcctttttaaacctgaat

SEQ ID NO: 62849 - DNA, 50 bp, homo sapien
taaatgacttacttttgggagacctracaggttttgaaattcacaatact

SEQ ID NO: 62850 - DNA, 50 bp, homo sapien
caaagataatactcaaaaatcttcaygttcgaattattttactatatttt

SEQ ID NO: 62851 - DNA, 50 bp, homo sapien
aaaacagtagccgattacctttctartaaaaacatgaaaagtggctagtg

SEQ ID NO: 62852 - DNA, 50 bp, homo sapien
tctgtcagacaagatagagaatagasgatttgagcagacagcttccaaat

SEQ ID NO: 62853 - DNA, 50 bp, homo sapien
acaggaaatgaacagggtcattaaaytagagtagaaagtggttttatata

SEQ ID NO: 62854 - DNA, 50 bp, homo sapien
ttataggagaacttattattcttcamcaggaaagtatatttcataatcct

SEQ ID NO: 62855 - DNA, 50 bp, homo sapien
aggtgcaagaggctaagctggctaakctggtgagtgacagggctgtgtgg

SEQ ID NO: 62856 - DNA, 50 bp, homo sapien
cctttactttctaactggaaaaatgmcatcttatagaacaaggaactgga

SEQ ID NO: 62857 - DNA, 50 bp, homo sapien
atcaatctctacttttctttcttaaygttccagcctgtgtcacctcccta

SEQ ID NO: 62858 - DNA, 50 bp, homo sapien
taactactatttctagggaactaaawttgaagacctcattttaacataaa

SEQ ID NO: 62859 - DNA, 50 bp, homo sapien
gaacaggctgtttatatttcttccckatccaaagttttagtattattatt

SEQ ID NO: 62860 - DNA, 50 bp, homo sapien
tttccagtgcactagatgaaaaatascaatgaagagtagaataaagacaa

SEQ ID NO: 62861 - DNA, 50 bp, homo sapien
ttttggccttgtctaaactgaacagyctcataaatgtaagtccacctgga

SEQ ID NO: 62862 - DNA, 50 bp, homo sapien
tgcttcctgtaaaataggcactctaygtttcataaggtagaaataaaaaa

SEQ ID NO: 62863 - DNA, 50 bp, homo sapien
tacaggcaaatatcatgggagaatarcctctactggcattttaatttctt

SEQ ID NO: 62864 - DNA, 50 bp, homo sapien
cctagatcctgagtatgattccatcrgaagaagcaaatactgagttgaac

SEQ ID NO: 62865 - DNA, 50 bp, homo sapien
tatcccaaaagaaccaaggttgatawccaagagcgaaaatgtttccctct

SEQ ID NO: 62866 - DNA, 50 bp, homo sapien
agcaggggctacaacccatatttgayagttcagggaagtgaaatggagag

SEQ ID NO: 62867 - DNA, 50 bp, homo sapien
aaaatgaaagaaaaagaaagcagcaytctgtgtttctgtgggcacgacct

SEQ ID NO: 62868 - DNA, 50 bp, homo sapien
tgaacctgcatgaacatcagctagayggctaagtggtggcacatagattc

SEQ ID NO: 62869 - DNA, 50 bp, homo sapien
gagccatgtcatggttaccaagctamagtttttgttcattatgtatcttc

SEQ ID NO: 62870 - DNA, 50 bp, homo sapien
aatatgttccagctgtctaggtcacygctttggagtactatttatttgta

SEQ ID NO: 62871 - DNA, 50 bp, homo sapien
ataacatggcctatcatgaggaagarcgagaaataactgcaaagaagcaa

SEQ ID NO: 62872 - DNA, 50 bp, homo sapien
tctagagcaaacgggacaagtgagaragtgataaaatttgagaatcacaa

SEQ ID NO: 62873 - DNA, 50 bp, homo sapien
tggaaccaatgaacatcttctgaacygaatacactgactatagttgaaaa

SEQ ID NO: 62874 - DNA, 50 bp, homo sapien
tctttggttttaatgtttaaatataygaacggtggtgatataaaataaaa

SEQ ID NO: 62875 - DNA, 50 bp, homo sapien
cctgcagatttttgaaccaaggaagscttcatatttatgtaagccttttc

SEQ ID NO: 62876 - DNA, 50 bp, homo sapien
cggcgggattccaactaggaaacgamagtgctattttggagttgaagaag

SEQ ID NO: 62877 - DNA, 50 bp, homo sapien
gtgaaaaccagattaagaacccctayggttgcagaaatcaacttgctact

SEQ ID NO: 62878 - DNA, 50 bp, homo sapien
gttgaaaattaccaatacctgataaygtgcattgaaatgagcaggtattt

SEQ ID NO: 62879 - DNA, 50 bp, homo sapien
tcaagaaaaccatcgctttcactcartattcatggagagggcataggtgt

SEQ ID NO: 62880 - DNA, 50 bp, homo sapien
tatccttgacttaatgaccctattayacatatcaaagtcttcctggatct

SEQ ID NO: 62881 - DNA, 50 bp, homo sapien
cagtaattcaggtgaaaataataggrcatgaactgaagagctgtgatgaa

SEQ ID NO: 62882 - DNA, 50 bp, homo sapien
aagaatgaagtggctctcaacatcawcttctgggtaaagctctaggcgtt

SEQ ID NO: 62883 - DNA, 50 bp, homo sapien
ggacagtgtcttattcatctttaaaygcctagagctttacccagaagttg

SEQ ID NO: 62884 - DNA, 50 bp, homo sapien
aaagccaacagagggtagcagggcaragtctactcttagtatcactgaat

SEQ ID NO: 62885 - DNA, 50 bp, homo sapien
tctgccattgcaatcagaaacataartgaatatgaggaaactacccttcc

SEQ ID NO: 62886 - DNA, 50 bp, homo sapien
ccattggctctcagttctagtccaaratgaaaagcatatccttgtgtgat

SEQ ID NO: 62887 - DNA, 50 bp, homo sapien
taattataaacttctatttcttaagyctcatagttggtgcttaagtgttc

SEQ ID NO: 62888 - DNA, 50 bp, homo sapien
cggttcagaagatgttcattggttcsattggtccgtgctccataaaaacc

SEQ ID NO: 62889 - DNA, 50 bp, homo sapien
gggaatcttggggtcatgaaatgtaygagctggaaggagttacgcagggt

SEQ ID NO: 62890 - DNA, 50 bp, homo sapien
aaaggaaatcatcagactgatgggcmaagttataggagctttaaccatct

SEQ ID NO: 62891 - DNA, 50 bp, homo sapien
ggattcctgtctccacctgaacaatraaggagttacctagatgaaccctg

SEQ ID NO: 62892 - DNA, 50 bp, homo sapien
aacttgttcttaaaatacacatcaargtacagaaaacagccaaaaagcaa

SEQ ID NO: 62893 - DNA, 50 bp, homo sapien
tgaagttgagactcatacccgagcaycttagcttttgcccaccccacgct

SEQ ID NO: 62894 - DNA, 50 bp, homo sapien
tgttcactatctgaaaatttcttgarctttatacttaaatgtgtaccctt

SEQ ID NO: 62895 - DNA, 50 bp, homo sapien
gtacaatagaaaagaagaaaatataygctatcacaggaacacagaaggtg

SEQ ID NO: 62896 - DNA, 50 bp, homo sapien
ctagactggctctctgcgtccacctyttctcttgttatcccagggattca

SEQ ID NO: 62897 - DNA, 50 bp, homo sapien
gattcttactcatgatcaccttaaaytgaaactcgattaaaattatattg

SEQ ID NO: 62898 - DNA, 50 bp, homo sapien
tgcagtatcagccaccaactgactawaggacactggggactttttcccag

SEQ ID NO: 62899 - DNA, 50 bp, homo sapien
aacaaaatcatacctggaattagaasagtgaatgtctttagaaatgatct

SEQ ID NO: 62900 - DNA, 50 bp, homo sapien
gtttgcaatgaaaaattaacattcargaggctaggagtctaacaatgtat

SEQ ID NO: 62901 - DNA, 50 bp, homo sapien
ttttcaccaaggtctactggcacatraaaataagtaagtcaggctccaac

SEQ ID NO: 62902 - DNA, 50 bp, homo sapien
cgagtaacaaaagatggtctaataayaggttcaatccaggacaattagtt

SEQ ID NO: 62903 - DNA, 50 bp, homo sapien
gggactggcaggctgggcccactgasacattattgtttcaatggtactta

SEQ ID NO: 62904 - DNA, 50 bp, homo sapien
acgatgttacagaggagtagagaaasacaacctcaataagagcagtagct

SEQ ID NO: 62905 - DNA, 50 bp, homo sapien
ttgtgtttttccacaatggaacctgyactttaatagtctaagaattcctg

SEQ ID NO: 62906 - DNA, 50 bp, homo sapien
acagagggtgagagattgtaactcayagtggcctcacagggcgaggaggg

SEQ ID NO: 62907 - DNA, 50 bp, homo sapien
tgcatcattgctattctcagctgacsagatttagtttgagcttttctttc

SEQ ID NO: 62908 - DNA, 50 bp, homo sapien
tcttctttatccacatgaaaacccartgcgtacagtaggcttaaaagcaa

SEQ ID NO: 62909 - DNA, 50 bp, homo sapien
cccttgctatggcttcagagcaggarctaatctggttattcttaggcagt

SEQ ID NO: 62910 - DNA, 50 bp, homo sapien
aagtaaacattcttcccatgttatamttccctgtctttccagtttcctac

SEQ ID NO: 62911 - DNA, 50 bp, homo sapien
tgccagaggattacgtaaaagatgcrctctgcccaggagggtctctgtgg

SEQ ID NO: 62912 - DNA, 50 bp, homo sapien
cttagagacattccaactgtgttaamtatccagaggacaaagttctgaga

SEQ ID NO: 62913 - DNA, 50 bp, homo sapien
ccatgattaccaagggatgactgtawgttctattcagaaatgagaaccca

SEQ ID NO: 62914 - DNA, 50 bp, homo sapien
gggataacatgctggatctctgttaygccaccaatttaaatacatgccag

SEQ ID NO: 62915 - DNA, 50 bp, homo sapien
tattacaaagaataaaaatatagtcratcccctgtatccttgggttccac

SEQ ID NO: 62916 - DNA, 50 bp, homo sapien
caaaagggcttggcattcctttagawctgatgttattaacactttggcaa

SEQ ID NO: 62917 - DNA, 50 bp, homo sapien
gtggccacgtggatggattcttcccragggagcataatagtagagcattt

SEQ ID NO: 62918 - DNA, 50 bp, homo sapien
atgtttacttgcatgattcttagttraaacttcactcactggtgatactg

SEQ ID NO: 62919 - DNA, 50 bp, homo sapien
tggctgggagatactgtgctaagtcmtttctttgccatcagaaggctgaa

SEQ ID NO: 62920 - DNA, 50 bp, homo sapien
ctaactgtatctctttgtgggtcaasagtaattatgcatgaacgctcttt

SEQ ID NO: 62921 - DNA, 50 bp, homo sapien
gatgtgtatgagtgaacatctaacaygacttagctattcaccgtgatagg

SEQ ID NO: 62922 - DNA, 50 bp, homo sapien
cttaggaagtacctggtgactgtgcraaactctctttctgggctgcggca

SEQ ID NO: 62923 - DNA, 50 bp, homo sapien
ttgaaaataccagttgagggaaaaaygaatttagagtattttttaaaggc

SEQ ID NO: 62924 - DNA, 50 bp, homo sapien
accctagtcccattccagctctccartaagcaagagtcttgcaaatgaca

SEQ ID NO: 62925 - DNA, 50 bp, homo sapien
attcaaattcactagcaggccataartacagctttttctgtgaacaataa

SEQ ID NO: 62926 - DNA, 50 bp, homo sapien
aagaaataatagctgaaatgttaccwaactagatgaaaactataaaccaa

SEQ ID NO: 62927 - DNA, 50 bp, homo sapien
agagcaaattattcttcctaagaacratattccatgcaggaagccagagt

SEQ ID NO: 62928 - DNA, 50 bp, homo sapien
aaatgaggagttttggccatggacarctttaggaaaaggcattttaaaac

SEQ ID NO: 62929 - DNA, 50 bp, homo sapien
caggggaggacaagaatttgcactcrattttaaacataatgtcatatatt

SEQ ID NO: 62930 - DNA, 50 bp, homo sapien
tcatgcagcacacatgtgaacaagayacaatgaaaaactgctagtaatcc

SEQ ID NO: 62931 - DNA, 50 bp, homo sapien
tctatctctatccctagctctgtctytatcatctctatctctatctctat

SEQ ID NO: 62932 - DNA, 50 bp, homo sapien
aatctgaaacatttatgcatttaacraaagactatcaaaatacataaggc

SEQ ID NO: 62933 - DNA, 50 bp, homo sapien
ggcttttgtgctagttctaggcgcayttccttggactcaggtgagcctgc

SEQ ID NO: 62934 - DNA, 50 bp, homo sapien
aaaggataaaatatgaaaatgtagamctatccaaaggaatgaagagtggc

SEQ ID NO: 62935 - DNA, 50 bp, homo sapien
cactgccccgtctaatacacaccagyatgattcttaatccccacagtcat

SEQ ID NO: 62936 - DNA, 50 bp, homo sapien
gtggagggagggaataaagggaaaawataatcaatccttaggataaaaaa

SEQ ID NO: 62937 - DNA, 50 bp, homo sapien
tggtatttttacggcttcgtaaatcyattctttgcctaatgccttagcca

SEQ ID NO: 62938 - DNA, 50 bp, homo sapien
aaaagacatcaatcttgactgacgaygatccccggagcttctcttgcagg

SEQ ID NO: 62939 - DNA, 50 bp, homo sapien
gatattgtttgcagttgtgacaaggyacaatgaatctctggtatgacctt

SEQ ID NO: 62940 - DNA, 50 bp, homo sapien
gtcattcacatattggtgaaaaaccraaaacaagttctattgagaaggat

SEQ ID NO: 62941 - DNA, 50 bp, homo sapien
tcagaagatgtgggtctattattaargctatcattaagaagacagaggag

SEQ ID NO: 62942 - DNA, 50 bp, homo sapien
tttaaggaattgaactgtttggacayatacaaagtatcttttgtacactt

SEQ ID NO: 62943 - DNA, 50 bp, homo sapien
cctgcggccctggatctatgctcccrcctttcacctgtgcagaaggcccc

SEQ ID NO: 62944 - DNA, 50 bp, homo sapien
ataagagataaaggagaattcaagartagacagtggagacctaagccaac

SEQ ID NO: 62945 - DNA, 50 bp, homo sapien
tcaaactcagtggcatacaatcctgsagtcctggagacccagagctactg

SEQ ID NO: 62946 - DNA, 50 bp, homo sapien
ttttgagagtgtactattagttccayattgtgttaaacatctgttttgtg

SEQ ID NO: 62947 - DNA, 50 bp, homo sapien
gtgggcaatcagctaaatgggcaaayggagcgagcagacgtctcatacaa

SEQ ID NO: 62948 - DNA, 50 bp, homo sapien
aatctgcagtgctagtctgtggcatsaagttagattactttcaatgagaa

SEQ ID NO: 62949 - DNA, 50 bp, homo sapien
aagactgtcaaggtcatgaaaaaccrgcaaggcctgagaaacagtcaccg

SEQ ID NO: 62950 - DNA, 50 bp, homo sapien
cttccacattgatgacagttttacayatagttttgtgaatctcctcacta

SEQ ID NO: 62951 - DNA, 50 bp, homo sapien
ttcttactgaatgtgatgatggtcayggatatttaaggagtatttcattt

SEQ ID NO: 62952 - DNA, 50 bp, homo sapien
gtggattgtacctttacagacataawtacatattcagtcataatatctat

SEQ ID NO: 62953 - DNA, 50 bp, homo sapien
tctttgatgctttactctcaaaggargactgcttggaaaacttggatgtt

SEQ ID NO: 62954 - DNA, 50 bp, homo sapien
tcttctaaggatgccagtcatatggkattcaggctgccctattccactgt

SEQ ID NO: 62955 - DNA, 50 bp, homo sapien
actaatacactgccccttctcctaaytcttctaattgtttcttcttagta

SEQ ID NO: 62956 - DNA, 50 bp, homo sapien
gagataacatcctggacctgtccacrcttacttttgaaacaaagcagatg

SEQ ID NO: 62957 - DNA, 50 bp, homo sapien
tctctggcccctggccctttaaatgycactatacactgccttctagagat

SEQ ID NO: 62958 - DNA, 50 bp, homo sapien
cctagtaatgggttactatggtgatraggattaggataatggagatggcg

SEQ ID NO: 62959 - DNA, 50 bp, homo sapien
catcaatgtgagaatctaaaagcaaygtacggtgtgtccatttgcaggga

SEQ ID NO: 62960 - DNA, 50 bp, homo sapien
cgccctgaaactgggcttgagcttcmccttatctgtgtttcagaatgatc

SEQ ID NO: 62961 - DNA, 50 bp, homo sapien
atgtataagactaaaaatctcagtcyatgccttctacttttattgaacat

SEQ ID NO: 62962 - DNA, 50 bp, homo sapien
tcacaccttcacctcaactgtcatayggcctggggtataatactgaatct

SEQ ID NO: 62963 - DNA, 50 bp, homo sapien
tagctttttactcccttatgcttcastatttgcccttgtgtctttataaa

SEQ ID NO: 62964 - DNA, 50 bp, homo sapien
ggaactgtattttgtatctgttttcraaggaagagagtagcagattaatt

SEQ ID NO: 62965 - DNA, 50 bp, homo sapien
catcagcctgtgcatggacactttargctaaatagtcagtgctttagtgt

SEQ ID NO: 62966 - DNA, 50 bp, homo sapien
aggaaacaaaagctcagaatggttargtaacttgccaaaggtgacatcgc

SEQ ID NO: 62967 - DNA, 50 bp, homo sapien
tggtgtcagctgcaattatttgaacytgtctttttttacagagctgttat

SEQ ID NO: 62968 - DNA, 50 bp, homo sapien
ttccagtcctcaggcaagtgatcaaytcattcaatgtttcagagcatgga

SEQ ID NO: 62969 - DNA, 50 bp, homo sapien
aacatgctgaatgaataatatggtawcaatagcagcaaattaagtaaatt

SEQ ID NO: 62970 - DNA, 50 bp, homo sapien
tttctgtgtgactgctaaaggaccaygccaatgcaacctgagaatgccgg

SEQ ID NO: 62971 - DNA, 50 bp, homo sapien
tacttttactttataggtgagtagayagaggtagttttagtaagctgggc

SEQ ID NO: 62972 - DNA, 50 bp, homo sapien
aagtagtttattttttttaatttcargtgatgtaatttaaaacctaagtt

SEQ ID NO: 62973 - DNA, 50 bp, homo sapien
cccaagggtgcccagccttagctctkgtccctctcgatgctgtcagagaa

SEQ ID NO: 62974 - DNA, 50 bp, homo sapien
tatcctgtattattcaggtgtatccmagtatcccattataacaacaaggg

SEQ ID NO: 62975 - DNA, 50 bp, homo sapien
attaatgaattagttaagcctgttargtcctctgtgcatccttcctccta

SEQ ID NO: 62976 - DNA, 50 bp, homo sapien
gaattgaatggagatagaatcaacamaagagacaagaaatacggcaaaga

SEQ ID NO: 62977 - DNA, 50 bp, homo sapien
ggggaaagattcttatttccagtgargtgttaaaaactacctcatgtttt

SEQ ID NO: 62978 - DNA, 50 bp, homo sapien
gggatgctctcagatcagcaactgtraaaggaacagaagcagagggagaa

SEQ ID NO: 62979 - DNA, 50 bp, homo sapien
ccatttactggcttttaaacatggaygacttaacttcaacctctcctgtg

SEQ ID NO: 62980 - DNA, 50 bp, homo sapien
aagattcgtccctaatatcacctggragtaggaattctggagcaaaacaa

SEQ ID NO: 62981 - DNA, 50 bp, homo sapien
ccaaactatatcaataattccatcawtctaaagtctttaatttagaaaag

SEQ ID NO: 62982 - DNA, 50 bp, homo sapien
agaactagagcgcttcccactaaccraagattatttaactttagcatcaa

SEQ ID NO: 62983 - DNA, 50 bp, homo sapien
aaagtagcaaatatattactgaagargattagacacagagaaaaacgtca

SEQ ID NO: 62984 - DNA, 50 bp, homo sapien
aacacatacaggattgaaattaagawagacaacagtatcagagttgtcac

SEQ ID NO: 62985 - DNA, 50 bp, homo sapien
ttatcagattaagacatttgggtaamataatagaccctgaactagaggca

SEQ ID NO: 62986 - DNA, 50 bp, homo sapien
caagctaaaatataatgtcctattaycaattgttttcatgcttttgcttt

SEQ ID NO: 62987 - DNA, 50 bp, homo sapien
ttctcaaatatctgaatggtaataayatggaaaatctttagtctcacatg

SEQ ID NO: 62988 - DNA, 50 bp, homo sapien
atttttgcattaatgcatcccatcayggccttgttagcaatgtgtgacgt

SEQ ID NO: 62989 - DNA, 50 bp, homo sapien
gtttaggaagtgaacagacctaaagwaaaacattcaggcaataagatcac

SEQ ID NO: 62990 - DNA, 50 bp, homo sapien
agtcttgtgagtctagcgttatcgaygcacagagacctctgaagtgagct

SEQ ID NO: 62991 - DNA, 50 bp, homo sapien
cattactggtttcatttaaagccaartatcacacacattatatacatcct

SEQ ID NO: 62992 - DNA, 50 bp, homo sapien
gagcctctgttgcaacctgacgcctstgctttccttccagatcatgctgc

SEQ ID NO: 62993 - DNA, 50 bp, homo sapien
ccaaaggaacaaatgaaactgatacratcatgtcaaaggtatggatgata

SEQ ID NO: 62994 - DNA, 50 bp, homo sapien
catataatttttcacttagcagagaygaaataccaaaacagatgggtata

SEQ ID NO: 62995 - DNA, 50 bp, homo sapien
tcaatgcctggggcaatggctaacayacattaggattcaaaatgtgtttt

SEQ ID NO: 62996 - DNA, 50 bp, homo sapien
gaaaggaattcaaatataaagtccgsagtaaccttggtaaaggtgtcatc

SEQ ID NO: 62997 - DNA, 50 bp, homo sapien
caaagacctcctgttttgttaaatamtaaaactccagtatttctactggg

SEQ ID NO: 62998 - DNA, 50 bp, homo sapien
tcttttctgagtcaaattctctgtcratgaaatattaatagttaaaagtt

SEQ ID NO: 62999 - DNA, 50 bp, homo sapien
agggtttccccatccttggtggtgcyggactccagttcttgtaccctcta

SEQ ID NO: 63000 - DNA, 50 bp, homo sapien
tttgcatgataacgtcaggttagtayggacacaaagtgtctttggatctc

SEQ ID NO: 63001 - DNA, 50 bp, homo sapien
acctgttgttttgccaaaagcctacrtgtgctgttatggccttcttcaac

SEQ ID NO: 63002 - DNA, 50 bp, homo sapien
tgctgaggggctattattttatgagygcatgatatctgctagcatttcaa

SEQ ID NO: 63003 - DNA, 50 bp, homo sapien
tctaactataaccaaaagcagcagaygtgagcttatatgtgggagattaa

SEQ ID NO: 63004 - DNA, 50 bp, homo sapien
aacccaggttagtctgacagtaaagycgccagtgctcttcacctgggggc

SEQ ID NO: 63005 - DNA, 50 bp, homo sapien
cttaaaactctgagaaatttgaatgsaacagtcacatattgttttaagta

SEQ ID NO: 63006 - DNA, 50 bp, homo sapien
tgcagctggctccttgacatccctakgcttctatgcttttgttttcatca

SEQ ID NO: 63007 - DNA, 50 bp, homo sapien
tcacattgtttttccctcatttggtwaattcataaaatatgtgtagtgga

SEQ ID NO: 63008 - DNA, 50 bp, homo sapien
aggaaatggtgtctcataagatcaaygctctatgaacaaatttaaagact

SEQ ID NO: 63009 - DNA, 50 bp, homo sapien
ctgtctttcaactgaactgctactaygcactttgaaaaattccaagggaa

SEQ ID NO: 63010 - DNA, 50 bp, homo sapien
gggatagtcaaatatttgctcgcacmatttgagaatgtatacttactaaa

SEQ ID NO: 63011 - DNA, 50 bp, homo sapien
ctaggaatgtgtgggaggtccatggwtgctatgtgtctggcagtccacac

SEQ ID NO: 63012 - DNA, 50 bp, homo sapien
atgaaaaggtaattaaaaattcacamggaaatgtaaaggacataaactag

SEQ ID NO: 63013 - DNA, 50 bp, homo sapien
aaattggcctacttatatatggacarctgatttgcaaccaacgtgcacag

SEQ ID NO: 63014 - DNA, 50 bp, homo sapien
aggaatggcatgttctcagtttgacyaggtcacgttttacttgcttttat

SEQ ID NO: 63015 - DNA, 50 bp, homo sapien
gcacagtgatggattttaaagccacrcattccatagagagaggaagggtg

SEQ ID NO: 63016 - DNA, 50 bp, homo sapien
tttaacaaaataaaataatatagatkgacgaaggggacaaagcaatgaac

SEQ ID NO: 63017 - DNA, 50 bp, homo sapien
ggactcagaatagacatagaggataygcgtctgtaatgtgtgtccaagaa

SEQ ID NO: 63018 - DNA, 50 bp, homo sapien
cctctcccacatctccttgtactcartctttcttctaggagtgcacatga

SEQ ID NO: 63019 - DNA, 50 bp, homo sapien
ttcagcaacttgaaaaaataaaaaasgatgatataggaatagatggaatc

SEQ ID NO: 63020 - DNA, 50 bp, homo sapien
agaggtagaattggcagaacttggayctttgttgaaactggttcttttca

SEQ ID NO: 63021 - DNA, 50 bp, homo sapien
ccaacattaacgtatatataacatcraacatatgaaccatagctttcaat

SEQ ID NO: 63022 - DNA, 50 bp, homo sapien
ggaaaggatgtaatgaattgattgayggatatttgttttcaaagaattaa

SEQ ID NO: 63023 - DNA, 50 bp, homo sapien
acccatagtacaactccagtaggaaytgttggacagatgactgaatgagg

SEQ ID NO: 63024 - DNA, 50 bp, homo sapien
agcaagttaatatgttttagaatgaytcagtgtgaagaatggattggatc

SEQ ID NO: 63025 - DNA, 50 bp, homo sapien
tatgaggaataagagataatattcaygtttttgacttaagcaagtgtcat

SEQ ID NO: 63026 - DNA, 50 bp, homo sapien
cacagaaacttcaaatggcatgcccwcttagtaatgaaaacatctatttg

SEQ ID NO: 63027 - DNA, 50 bp, homo sapien
tagagctgaaaactggcatgagctasagagagattcaagctactgtaggg

SEQ ID NO: 63028 - DNA, 50 bp, homo sapien
tcaacaagatattttgcatcatttcytttgtattatctttttgaaatcta

SEQ ID NO: 63029 - DNA, 50 bp, homo sapien
gagaaatggaaagtcacctaattaargtcagttaactagcaagtggtaga

SEQ ID NO: 63030 - DNA, 50 bp, homo sapien
aggggagggactgtagaaattagaayataagggcttcctaacaaatcata

SEQ ID NO: 63031 - DNA, 50 bp, homo sapien
tcccagacagatctcgtcaaggtccraagagtgcaataggtgatgactga

SEQ ID NO: 63032 - DNA, 50 bp, homo sapien
ttggccagaaaggtttacagtgcaakgtactgtcttctatgtatttgact

SEQ ID NO: 63033 - DNA, 50 bp, homo sapien
ggacaagacctggcatgttgtcatcmagtatggctggagggaggctccag

SEQ ID NO: 63034 - DNA, 50 bp, homo sapien
taaaagtctcccattcaactattcargtcattcagctctctagagatgca

SEQ ID NO: 63035 - DNA, 50 bp, homo sapien
tttatttcttctgtgttattgtctawcttgaataagttttacatatgtgt

SEQ ID NO: 63036 - DNA, 50 bp, homo sapien
atcatcccttggtctgttctctcaayattactttcaattaactaacaggc

SEQ ID NO: 63037 - DNA, 50 bp, homo sapien
aaaatcaggggacagtctataattayggtatgatggctaaagctggaaaa

SEQ ID NO: 63038 - DNA, 50 bp, homo sapien
gtttgtattcaagcacgtcacacaaracaagaggcacttactgcggagct

SEQ ID NO: 63039 - DNA, 50 bp, homo sapien
ttgagtactaaagaagaattattacractggcggagcagcatctatgaat

SEQ ID NO: 63040 - DNA, 50 bp, homo sapien
caaaggttaggacccagtatcttcarggtagcatttttgaacctgccact

SEQ ID NO: 63041 - DNA, 50 bp, homo sapien
gttgtataactgtaattattagtaaygtgcagacttatctctgatactct

SEQ ID NO: 63042 - DNA, 50 bp, homo sapien
atcacagtttcaacagacttatctcragcagtcttgtcttccagctgctg

SEQ ID NO: 63043 - DNA, 50 bp, homo sapien
ttctaatattcatgtggaaatacaawagagcctaaataggtagagcgatc

SEQ ID NO: 63044 - DNA, 50 bp, homo sapien
aagcccctaattgtaaataaaacggktagcagctctaaggtgtggcttta

SEQ ID NO: 63045 - DNA, 50 bp, homo sapien
gggaccctcccagacctcgtccttcragacttcttcatttttttgagact

SEQ ID NO: 63046 - DNA, 50 bp, homo sapien
tcttgactgctgggggagcttattcrcctggaccacctggaaggaagatg

SEQ ID NO: 63047 - DNA, 50 bp, homo sapien
atggacataaattgtgcaccattgayagtagcacacaaatgccaaatgcc

SEQ ID NO: 63048 - DNA, 50 bp, homo sapien
gatatagtgatcagtctttctaccaygggtccaagaaatgtatttttttt

SEQ ID NO: 63049 - DNA, 50 bp, homo sapien
atttctgaactgagctgtgtttgcakattggagccaccataggccaaaga

SEQ ID NO: 63050 - DNA, 50 bp, homo sapien
aggtgatttttctaaatcagaaaccrgatcatcccagtctcctgttcaga

SEQ ID NO: 63051 - DNA, 50 bp, homo sapien
caatcaccgctgaagccctgaaaackgacccacctaagccgcaaaactta

SEQ ID NO: 63052 - DNA, 50 bp, homo sapien
ttaatttagatatttagcattataamcttttaacactgatttagctgtat

SEQ ID NO: 63053 - DNA, 50 bp, homo sapien
taatagaactttttctaccacttaayccatgttgattattatttttgaga

SEQ ID NO: 63054 - DNA, 50 bp, homo sapien
tcttagggctggctagagtaagtgtraacaggtcaaaaaataagttaaga

SEQ ID NO: 63055 - DNA, 50 bp, homo sapien
agacaagcaaagttaagaatgcctasagggcaatttattacaggaagaaa

SEQ ID NO: 63056 - DNA, 50 bp, homo sapien
atttactcttcctaaattgtatctayatacttaaactgtctaccagaaac

SEQ ID NO: 63057 - DNA, 50 bp, homo sapien
taagtctttcctcatagtttgctcaragattgtagtttactcattcaaaa

SEQ ID NO: 63058 - DNA, 50 bp, homo sapien
ttcaatgtttacctatgtttagatawaaaaatactgttgtgttacagttg

SEQ ID NO: 63059 - DNA, 50 bp, homo sapien
aaaatcaacctttgctttgctttttstactagcatagagagcctaatctc

SEQ ID NO: 63060 - DNA, 50 bp, homo sapien
ataaatgttcttttactaaaagtgcrccattaagaatattgcacaaggaa

SEQ ID NO: 63061 - DNA, 50 bp, homo sapien
aaagaatttatattttgagggcatgmaaacatttgacagaccttgatggt

SEQ ID NO: 63062 - DNA, 50 bp, homo sapien
ctctacaggtggattgctggcctcaytagttcatttaagaacatctgaat

SEQ ID NO: 63063 - DNA, 50 bp, homo sapien
agcaaaatattaataggaactgtccygaataccagtagaataaatggtat

SEQ ID NO: 63064 - DNA, 50 bp, homo sapien
aagaaaaagagacaacctcctagaamtaatacatgagattaacatggtca

SEQ ID NO: 63065 - DNA, 50 bp, homo sapien
tcttgaactcctgacctcaggaaaaygcctaatacttttgatgtcctttt

SEQ ID NO: 63066 - DNA, 50 bp, homo sapien
gtttcttttgaaatattagaagaacygaagtcactaggattgaattccca

SEQ ID NO: 63067 - DNA, 50 bp, homo sapien
cctttcctaagactaaaccatcaacrcaattctttcctcatccattttaa

SEQ ID NO: 63068 - DNA, 50 bp, homo sapien
ttttaaaaataaaatttctgggtcasctcttagcaagttccacctaaatg

SEQ ID NO: 63069 - DNA, 50 bp, homo sapien
acactgtgtattttgagacttgaaakgtgtaccatggttatactaaggat

SEQ ID NO: 63070 - DNA, 50 bp, homo sapien
tttgactacaacagaactgacccttyaaattccatagctaatttatgaaa

SEQ ID NO: 63071 - DNA, 50 bp, homo sapien
ggccaattcccttgatcaacgtaatrgtaaaaattcttaacagaatacta

SEQ ID NO: 63072 - DNA, 50 bp, homo sapien
ctcacagtatacccagataacaaccygcatattgtatacctcctaaatat

SEQ ID NO: 63073 - DNA, 50 bp, homo sapien
atcaccatttactgagcaattcatamgttcaaataaccatgtaatgcttc

SEQ ID NO: 63074 - DNA, 50 bp, homo sapien
aaaaattatataaaatacactgcaaygatttaaggtatcaaatttgatga

SEQ ID NO: 63075 - DNA, 50 bp, homo sapien
actgtaagcaactgaaatttttgaawctggattttgtagtcacttgcagc

SEQ ID NO: 63076 - DNA, 50 bp, homo sapien
tatgttctaatctagtagttatttgyaaggtaaaaggtgagtggaaaatt

SEQ ID NO: 63077 - DNA, 50 bp, homo sapien
ccagcaataaactgaaaaacctttgyatgttctaatctagtagttatttg

SEQ ID NO: 63078 - DNA, 50 bp, homo sapien
aaataaataattttacacctttgtcrcattgcatttgtaggaaacagtta

SEQ ID NO: 63079 - DNA, 50 bp, homo sapien
agatccactccacctagtcactcaargataagggctgactgaggcattac

SEQ ID NO: 63080 - DNA, 50 bp, homo sapien
tttattttcttccaaactgtttgacygtaaatagatacaaatacgagagc

SEQ ID NO: 63081 - DNA, 50 bp, homo sapien
tataggtgaggaatacagaaacaaaktatccaaatagcctgcattacgct

SEQ ID NO: 63082 - DNA, 50 bp, homo sapien
cagacttacaacagctatagcagcargaataccctccttatttacaaatt

SEQ ID NO: 63083 - DNA, 50 bp, homo sapien
gtattaaattggataatttcttgatyagtacaattatgtgatttttgtca

SEQ ID NO: 63084 - DNA, 50 bp, homo sapien
ccttatttacaaatttcaaatctcargtaagtgcatctaactagcaaaac

SEQ ID NO: 63085 - DNA, 50 bp, homo sapien
gttttgcatgagtttaaaacacaaarctggtagtcaaagaaatcaatcac

SEQ ID NO: 63086 - DNA, 50 bp, homo sapien
cccctcacaatttattactcataagscatttatatcatttgcttccctgt

SEQ ID NO: 63087 - DNA, 50 bp, homo sapien
gttacctctatttaagatgactccawtaaaacttctatggtttgcattat

SEQ ID NO: 63088 - DNA, 50 bp, homo sapien
tatgctgttaatatgcaattaatatmacttgaggatatgctatgtcagtg

SEQ ID NO: 63089 - DNA, 50 bp, homo sapien
tttctgagacgaactgacatgataarccattggaattcacttagtgcagg

SEQ ID NO: 63090 - DNA, 50 bp, homo sapien
tttaagccctggttcttctccattcrccagtacattgttccacagcgctc

SEQ ID NO: 63091 - DNA, 50 bp, homo sapien
tttcttgcccttctttcagagatacraattccataaatctcacatggggt

SEQ ID NO: 63092 - DNA, 50 bp, homo sapien
gtgatgatgatgatttccaaacagaktaggctgaattcatacacataagt

SEQ ID NO: 63093 - DNA, 50 bp, homo sapien
aagaaatcatctgtatcttattgtcyctctgaatgctaaatgtgaatggc

SEQ ID NO: 63094 - DNA, 50 bp, homo sapien
ggcccaggtaaaatatgtgttgaacragttgttttgtcttactctacaat

SEQ ID NO: 63095 - DNA, 50 bp, homo sapien
ctctctgaaatcatttgccaatatcwcttggtttgttcattttcttgtaa

SEQ ID NO: 63096 - DNA, 50 bp, homo sapien
tagcattacctatttttgataagccratgttgacctttaacacttctctc

SEQ ID NO: 63097 - DNA, 50 bp, homo sapien
aatactgtagactggtagaagaggtsaatactgtagatataatatgtttt

SEQ ID NO: 63098 - DNA, 50 bp, homo sapien
gccttatattaagtgaatctgtgtarccttgaaggaaattgagcttttct

SEQ ID NO: 63099 - DNA, 50 bp, homo sapien
aattaattaaacaatggcagtaattmaaatgtatccaattctctataatt

SEQ ID NO: 63100 - DNA, 50 bp, homo sapien
caccacatatcagctctgtcggtaaytacaaaatgttctacttatcaaaa

SEQ ID NO: 63101 - DNA, 50 bp, homo sapien
acaagtcacaagatgatacttaaaaytatgcaacaacagacatgtacgtt

SEQ ID NO: 63102 - DNA, 50 bp, homo sapien
tacttctagcataaaagattggaaartattgtgaatatggagccttgaca

SEQ ID NO: 63103 - DNA, 50 bp, homo sapien
atatgtgtgtgtgtgtgtttgtgtayatactcttgtcaaattctaattaa

SEQ ID NO: 63104 - DNA, 50 bp, homo sapien
catagcttattgtctatgcaactcastcaaaaaggatacagagtaagctg

SEQ ID NO: 63105 - DNA, 50 bp, homo sapien
tggagtagcaaggctcatggattgaraaatgattaactataacatgggta

SEQ ID NO: 63106 - DNA, 50 bp, homo sapien
actgtgctatctagtgtgaaaatcarggaaagctgatggctcctctctgt

SEQ ID NO: 63107 - DNA, 50 bp, homo sapien
acatcttcattatttaaaacctggakcatgtgaacactgttctttaaaat

SEQ ID NO: 63108 - DNA, 50 bp, homo sapien
aacattttaatatttaaaaatctgcyatagtgcaattgcaaatcctcaga

SEQ ID NO: 63109 - DNA, 50 bp, homo sapien
caagatcttcccttacctaacttcawtccaaaatatttgttgccaaataa

SEQ ID NO: 63110 - DNA, 50 bp, homo sapien
actctactcatttgccatccaaataygatagaagatgctgctcattccta

SEQ ID NO: 63111 - DNA, 50 bp, homo sapien
catatttatcttttgtgaggcgtgayggagaagccagcaaatgtttcagt

SEQ ID NO: 63112 - DNA, 50 bp, homo sapien
tgtgtgcattgctttaaaaatatgcyacctactgtgcacagaaaataacc

SEQ ID NO: 63113 - DNA, 50 bp, homo sapien
ataaaacggctttcttatattgaaartactgggtgatgtagttgaaatca

SEQ ID NO: 63114 - DNA, 50 bp, homo sapien
agagcggatagacataataggcaatycttttgtgtgtgtgtgtgtgtgtg

SEQ ID NO: 63115 - DNA, 50 bp, homo sapien
tttggaaactcacaacttcaaaaaartgttcgctgttgtggaaagtttcc

SEQ ID NO: 63116 - DNA, 50 bp, homo sapien
tccatcttgatgataactaagctgawtatgaacaactatgtgctcttaag

SEQ ID NO: 63117 - DNA, 50 bp, homo sapien
aatgtatttgaaattaattattttargtgtctctcaactctcccaatagt

SEQ ID NO: 63118 - DNA, 50 bp, homo sapien
cctcttccttagaatttggtcagtawgtaagtgtatacactgcttatggc

SEQ ID NO: 63119 - DNA, 50 bp, homo sapien
ggaaattaagtatattgatattcacmgaacaccaatttttaaatgtattt

SEQ ID NO: 63120 - DNA, 50 bp, homo sapien
aaaagaaatgtgtgagtgtacaatayaggaaatccacttgaagaaaatat

SEQ ID NO: 63121 - DNA, 50 bp, homo sapien
aactttttacataatcaaaggctaaygaatgattatcttttgaggattct

SEQ ID NO: 63122 - DNA, 50 bp, homo sapien
ttacatatattcctgttattgtctcrctgctaagtaatattactggatgg

SEQ ID NO: 63123 - DNA, 50 bp, homo sapien
ttgatacatttttgtcgataaggaarataatcagagtgggatagaagcat

SEQ ID NO: 63124 - DNA, 50 bp, homo sapien
tgatatgaacaaaattactactaacygcctattcagccttaggattcctg

SEQ ID NO: 63125 - DNA, 50 bp, homo sapien
aaaataaagataattgattagttaaygtatttttggatatgtgcaatttg

SEQ ID NO: 63126 - DNA, 50 bp, homo sapien
tggccagagatgccaacctaaagtamaatagtgatgattatataaaaatt

SEQ ID NO: 63127 - DNA, 50 bp, homo sapien
aaggaaatgggtccatgctaactaaygaaaattggatatacataggtctt

SEQ ID NO: 63128 - DNA, 50 bp, homo sapien
tattcaataaggtttgtgacagcaakctctaatcacacatattgacattt

SEQ ID NO: 63129 - DNA, 50 bp, homo sapien
tttaccctttcacaaactattttatraactaggtccaagttgtgattcga

SEQ ID NO: 63130 - DNA, 50 bp, homo sapien
agaaagaggttaagagctttgaatamgattatgtgactaaaatttctatt

SEQ ID NO: 63131 - DNA, 50 bp, homo sapien
ccaggctaaataactaattagagaarcataacatctttttttaaaacaag

SEQ ID NO: 63132 - DNA, 50 bp, homo sapien
agaaagactctgctagcttattacayatagataaagtgagtgtataggtt

SEQ ID NO: 63133 - DNA, 50 bp, homo sapien
gttttctgtttcctattcctggctasatgagatttctcctaagtctatcc

SEQ ID NO: 63134 - DNA, 50 bp, homo sapien
ggtttaaacagtccaccttttagtamgtgcttagatattcagctcctccc

SEQ ID NO: 63135 - DNA, 50 bp, homo sapien
atgaaccaaaatgttttcctgagagwcagataatttacatcctaacaact

SEQ ID NO: 63136 - DNA, 50 bp, homo sapien
tgatgcttggtgtggtgtattaaatmattcatgcagagatgcataaacac

SEQ ID NO: 63137 - DNA, 50 bp, homo sapien
atatccaataaaactcttaataaacygtgaagtgatatgccaattgctgt

SEQ ID NO: 63138 - DNA, 50 bp, homo sapien
agtgatattatttataacatcaaacrctaggagaatcacaaagagctgac

SEQ ID NO: 63139 - DNA, 50 bp, homo sapien
attttgtacagctttcagagtttcaygtattaagtcatcagatatattta

SEQ ID NO: 63140 - DNA, 50 bp, homo sapien
ttctgaacacaataaactattttgawgatcttgggtggaatttttggtgt

SEQ ID NO: 63141 - DNA, 50 bp, homo sapien
ttagacatagtctcagatgcctattktattaccgagagagtagtctgact

SEQ ID NO: 63142 - DNA, 50 bp, homo sapien
tatagacaaatgagcaacagttcatygtgtttcaaatattccttcctctc

SEQ ID NO: 63143 - DNA, 50 bp, homo sapien
tgtaggaggtgacagttaaatgctayagtctttgatagattggtgtcaag

SEQ ID NO: 63144 - DNA, 50 bp, homo sapien
agacttatccctggaggctgtaatcscaactctaagacagcaccacacaa

SEQ ID NO: 63145 - DNA, 50 bp, homo sapien
ttaatagtttcatttgcatctactcrcacattcaacttttcattcagttc

SEQ ID NO: 63146 - DNA, 50 bp, homo sapien
ttaagccacatttctatacttatacmcttgaaaagagctgactccaaatc

SEQ ID NO: 63147 - DNA, 50 bp, homo sapien
aaattttagttaatcaaattgtaccrgcattaacctgcatttccagaaaa

SEQ ID NO: 63148 - DNA, 50 bp, homo sapien
tttactctaacaaagcagttaactasggatttcgcctttatacatgtttt

SEQ ID NO: 63149 - DNA, 50 bp, homo sapien
ttaataacttgacttttataactaayttactgacaattacttattgagta

SEQ ID NO: 63150 - DNA, 50 bp, homo sapien
tccatgtatagagacagaagatttaygttccagatcaaagacaatccaac

SEQ ID NO: 63151 - DNA, 50 bp, homo sapien
aagtgaagggagagccagtgcgttayatggccagagcaggagcaagaggg

SEQ ID NO: 63152 - DNA, 50 bp, homo sapien
aaaagctttttttaagctgctaaaawtagatgaaatgtgaaaaaggtgaa

SEQ ID NO: 63153 - DNA, 50 bp, homo sapien
taaaaagtttcactctattggtactrttaactgccaaccactttgaaggc

SEQ ID NO: 63154 - DNA, 50 bp, homo sapien
gcccctgctatgtgctcctgaagcawtctgttcttccctcatcattactt

SEQ ID NO: 63155 - DNA, 50 bp, homo sapien
gtagacagcaaatgcacaacgattayaagaggaactgatgtagagtggag

SEQ ID NO: 63156 - DNA, 50 bp, homo sapien
gaaacataaggttctaaggctcttgytggaaaccataatcagaactggag

SEQ ID NO: 63157 - DNA, 50 bp, homo sapien
tcacaatttatgttggaaaaatcacsagagtattgcttgaactagcaact

SEQ ID NO: 63158 - DNA, 50 bp, homo sapien
attgtcatatatatttgaactcttcrctcttggactatgactttgaaata

SEQ ID NO: 63159 - DNA, 50 bp, homo sapien
ctgtttagtaacataaagagagaaaratgatccaaattgacaaatggaat

SEQ ID NO: 63160 - DNA, 50 bp, homo sapien
ctgttttcctctctaaagttttgtckgttcaaactagatgacaaacatgc

SEQ ID NO: 63161 - DNA, 50 bp, homo sapien
gaaacccgctcccgaaggacaccacrttgaacccctggccaccaagctac

SEQ ID NO: 63162 - DNA, 50 bp, homo sapien
ctgattgttatgagctagtatttaakgattcatacctttctgccatattt

SEQ ID NO: 63163 - DNA, 50 bp, homo sapien
aagaataaatctgagtctcttaatgscaatacccaagcgctgatgttctt

SEQ ID NO: 63164 - DNA, 50 bp, homo sapien
gtgagatgtcatatatgtgtgcaaarccagaacacatttcacaatttgta

SEQ ID NO: 63165 - DNA, 50 bp, homo sapien
cacaagtgattcatgagggtccgcamaattatgtagaagcagaattgtgt

SEQ ID NO: 63166 - DNA, 50 bp, homo sapien
caaggtgttagcaggatctactccaytataaccatagattgcaggtttgc

SEQ ID NO: 63167 - DNA, 50 bp, homo sapien
ggtactttttacatcttttatgtgaycttgtaaaccccttggcagaaatt

SEQ ID NO: 63168 - DNA, 50 bp, homo sapien
taaccaatagttaacaaataattcaytcatttcattggcatcatcagtcc

SEQ ID NO: 63169 - DNA, 50 bp, homo sapien
agtgcacaattcaaatataagctgamcaaccttaattggaatatctatcc

SEQ ID NO: 63170 - DNA, 50 bp, homo sapien
atagtagcatccttaacatgacatayactgtgctcctaaatactgctcct

SEQ ID NO: 63171 - DNA, 50 bp, homo sapien
tgaagtcacactttcctcaaatgcckgaataaaaagatgaatctacaatc

SEQ ID NO: 63172 - DNA, 50 bp, homo sapien
atttacactcccaacattagtttctraaaattccagttgctgcacactct

SEQ ID NO: 63173 - DNA, 50 bp, homo sapien
atttgaattaatttctgaaacgttgyatatatcatgctagataattttta

SEQ ID NO: 63174 - DNA, 50 bp, homo sapien
acttaacacaggagctagtgtaccaygacattaggaaagtacccttggga

SEQ ID NO: 63175 - DNA, 50 bp, homo sapien
gatgacgtagagtgacacatcctgartaaggctataaggattgtggagac

SEQ ID NO: 63176 - DNA, 50 bp, homo sapien
atcgttgaatgttgaagaccttgccrtgttaagtgatgtagagaaaggtc

SEQ ID NO: 63177 - DNA, 50 bp, homo sapien
ctttctgaaagaaattttcaaggggratagaataaaggaaaccaaaatat

SEQ ID NO: 63178 - DNA, 50 bp, homo sapien
tatggtgtcacagggttgactacagmacttgactatgcacaagtttgggt

SEQ ID NO: 63179 - DNA, 50 bp, homo sapien
gaaaataaacaatgcaatatcatctraattctcaaattaaagtttctatt

SEQ ID NO: 63180 - DNA, 50 bp, homo sapien
aaactctccattcagtagaaaactakgccatgcagaaaggctcactagag

SEQ ID NO: 63181 - DNA, 50 bp, homo sapien
gagaaaggaaatcatttatccactcrctttcacattttcattgatcaaat

SEQ ID NO: 63182 - DNA, 50 bp, homo sapien
ctcaggtggtgtgtattccaaaacamattacttccattatattttcttcg

SEQ ID NO: 63183 - DNA, 50 bp, homo sapien
tttataggctgtagtaaactttccaygctgtccaagtggattcatgtttc

SEQ ID NO: 63184 - DNA, 50 bp, homo sapien
attaaagcatacattttattatgtgrtttttcctgcttaaaatcccctgg

SEQ ID NO: 63185 - DNA, 50 bp, homo sapien
aaaataaccagcatattttaccatamatctacacagtatctagacatatc

SEQ ID NO: 63186 - DNA, 50 bp, homo sapien
agccttggtctcctccaatcaattaytgacttaacaatcagaaagatgct

SEQ ID NO: 63187 - DNA, 50 bp, homo sapien
tggccctccttatgtgcagatcttayatcgtctgaatagtgtattttcga

SEQ ID NO: 63188 - DNA, 50 bp, homo sapien
tataaatatggagcaaagatatcaarcataccagtaatgcttgctgaata

SEQ ID NO: 63189 - DNA, 50 bp, homo sapien
agtgagttgttggagcaagatatacrgcaactgaacaaggaggagaaact

SEQ ID NO: 63190 - DNA, 50 bp, homo sapien
agattaaaatcgataacattgaacayctattacatcctacattttagaca

SEQ ID NO: 63191 - DNA, 50 bp, homo sapien
tgcatgcatgggttctacttcctagraatattggcagtgtcaactatttt

SEQ ID NO: 63192 - DNA, 50 bp, homo sapien
agcaccatgattagagctcttcttaygtgtagttttatcacctatcaaac

SEQ ID NO: 63193 - DNA, 50 bp, homo sapien
ggcaaagtgatcccctacccagtaasgtctgagaaaatcatggacacacc

SEQ ID NO: 63194 - DNA, 50 bp, homo sapien
gcatcccgtctcttcaaaggactccraaaacatggtccagggatagtgct

SEQ ID NO: 63195 - DNA, 50 bp, homo sapien
ctgcccgtgtggtatttcttcttctsatttctcgccacgagtcatctttt

SEQ ID NO: 63196 - DNA, 50 bp, homo sapien
tatcagtttctgtaataataatccaktcattttcctaaagagcattctta

SEQ ID NO: 63197 - DNA, 50 bp, homo sapien
atgacaaactcctatttgttaatackctacaaaacatagtttgacatgct

SEQ ID NO: 63198 - DNA, 50 bp, homo sapien
tcctctaactctcaatacctcctatsaagccactaacaaaattcaaaaat

SEQ ID NO: 63199 - DNA, 50 bp, homo sapien
ctctaagttttaacaaaaaattacamggtctacaaagaggtaataaagta

SEQ ID NO: 63200 - DNA, 50 bp, homo sapien
attcaaaaattccacttccttaataygaagcacagctgcccaacttttca

SEQ ID NO: 63201 - DNA, 50 bp, homo sapien
agtttggagagaagacattcatttargtcactgaggaattgtaatcaata

SEQ ID NO: 63202 - DNA, 50 bp, homo sapien
tttatagtctatagtttattactaayatggttcctctagcattcttgtgg

SEQ ID NO: 63203 - DNA, 50 bp, homo sapien
ccaaggctgggaatctatcttgagartggaatttgccacttattcaataa

SEQ ID NO: 63204 - DNA, 50 bp, homo sapien
gttctgaatgttgccctttgtgccaygtcagaaaatatgttaacttacct

SEQ ID NO: 63205 - DNA, 50 bp, homo sapien
ttatcatgtgggagggcatctaatcyacctatcctcttgctgatgatctt

SEQ ID NO: 63206 - DNA, 50 bp, homo sapien
ttgggaatccctttcccagtgatcayactatttcacctcctagatttggc

SEQ ID NO: 63207 - DNA, 50 bp, homo sapien
actacactattaaaactgtgtcttaygcatattagctttgaatgaaggtt

SEQ ID NO: 63208 - DNA, 50 bp, homo sapien
acaaatattttagcttcatccattayaaactgaagaatctactacatgca

SEQ ID NO: 63209 - DNA, 50 bp, homo sapien
tgatgcaatgcaatatgaaacacttraaatacaaggaataaaataccacc

SEQ ID NO: 63210 - DNA, 50 bp, homo sapien
ccttttgtgtcgttatatctgaaaasaagagcgaaatcggggcaatgctg

SEQ ID NO: 63211 - DNA, 50 bp, homo sapien
acttcatgaaggattgagacagatgytttagtttggaaatctatataacg

SEQ ID NO: 63212 - DNA, 50 bp, homo sapien
gtttcctccagtcctctgttgcctarggtaaatttgacggaatatattcc

SEQ ID NO: 63213 - DNA, 50 bp, homo sapien
ttataattgttacttattgtatccaktctgataggtgtgaagcgatgcct

SEQ ID NO: 63214 - DNA, 50 bp, homo sapien
atgaatacctagtttagttgctggawtatgaatatgaatagaatggtgct

SEQ ID NO: 63215 - DNA, 50 bp, homo sapien
acttagacagactagctgcactcaayctgtttttatttttaagaccacta

SEQ ID NO: 63216 - DNA, 50 bp, homo sapien
atgcaaacatactgcaatctcaataycttcaatgacagaaaactcactac

SEQ ID NO: 63217 - DNA, 50 bp, homo sapien
aaaccagttttattttagtgtgacayatccttttttcttgtaactgagaa

SEQ ID NO: 63218 - DNA, 50 bp, homo sapien
caagcaacaaataaatttatcaatawctatgatttaaaaaccacctttct

SEQ ID NO: 63219 - DNA, 50 bp, homo sapien
ctagaaacagaaaatgtatactcaarcaacaaataaatttatcaataact

SEQ ID NO: 63220 - DNA, 50 bp, homo sapien
gagtagatgaatgcccattagaaaawtcagcacaaaatctaaaatggtcc

SEQ ID NO: 63221 - DNA, 50 bp, homo sapien
gtttttatttttaagaccactactcygagactttaaatgaaagagagcat

SEQ ID NO: 63222 - DNA, 50 bp, homo sapien
atgattaagttaaacaaactctaggraaaatgtcacattaaaataatgac

SEQ ID NO: 63223 - DNA, 50 bp, homo sapien
gagagcctgggagaggcctgggagasagcctgcttagtgttcacttgata

SEQ ID NO: 63224 - DNA, 50 bp, homo sapien
ttttaaaaatagtggcaagggagatwaattacttttaaatggctttctat

SEQ ID NO: 63225 - DNA, 50 bp, homo sapien
aaaatgtgaaaaagtgggtgaaactsactcatccttaagcccaactcaag

SEQ ID NO: 63226 - DNA, 50 bp, homo sapien
acccactttttcacattttagggctsaccttctctctgggcaaacaagtt

SEQ ID NO: 63227 - DNA, 50 bp, homo sapien
aatgtatctgacagtctcttgcccartaaactcagagactgttaggactt

SEQ ID NO: 63228 - DNA, 50 bp, homo sapien
agcattaatgacaggttggaaagacyggagagatcagagtcacacaggaa

SEQ ID NO: 63229 - DNA, 50 bp, homo sapien
agagtatgtgaagtaatctaaaagarctacatattaccattgaaaaatag

SEQ ID NO: 63230 - DNA, 50 bp, homo sapien
ttgataacataattgtatggtattcrctaggagatacttggacccaaaaa

SEQ ID NO: 63231 - DNA, 50 bp, homo sapien
tacctttgctaaaacctgcactcaayctgtttttatttttaagaccacta

SEQ ID NO: 63232 - DNA, 50 bp, homo sapien
cagggaggggtgaaatgacgagaaaygaagtatcatcaggttcaccttgt

SEQ ID NO: 63233 - DNA, 50 bp, homo sapien
ttctcttaacaacaatcatagaatcratgtaacaatctgtcttcaaaagt

SEQ ID NO: 63234 - DNA, 50 bp, homo sapien
cctatcttatacagacctgatttcaygacactatccaagtaccattagaa

SEQ ID NO: 63235 - DNA, 50 bp, homo sapien
attagatctctcttcctctaactaaygaaactttcttctctctctgatag

SEQ ID NO: 63236 - DNA, 50 bp, homo sapien
aagagaggagatttgcttattgtgamaaagggaaagagtggagggtgtat

SEQ ID NO: 63237 - DNA, 50 bp, homo sapien
ataagataggctttgtcacaaaacaraatagtatattgaccccaaagcct

SEQ ID NO: 63238 - DNA, 50 bp, homo sapien
tgattaatgtgacataatgccagcarcttatactaaaatggttttatggg

SEQ ID NO: 63239 - DNA, 50 bp, homo sapien
aatgatactttgacacctgagaatamaaatgtgtcctgaaaaagatttta

SEQ ID NO: 63240 - DNA, 50 bp, homo sapien
gattttaggaggtacctgaaaactaygttaaatgaaaaactaaaatcagc

SEQ ID NO: 63241 - DNA, 50 bp, homo sapien
gaccattcagacttccaaagtataakagctaagaatatgatgatcacttt

SEQ ID NO: 63242 - DNA, 50 bp, homo sapien
cgaaagcaatattacatatatttcawagagacttgacactggttgatgag

SEQ ID NO: 63243 - DNA, 50 bp, homo sapien
atgttaccctaattcacatagaatcraagtaatctctttacatatcattt

SEQ ID NO: 63244 - DNA, 50 bp, homo sapien
gatttaactctgaaggacccagaggmatttttgtacctgaagcttttaat

SEQ ID NO: 63245 - DNA, 50 bp, homo sapien
cagctgaggaccaaataccagacacrcagtttcttgacagatgctgagga

SEQ ID NO: 63246 - DNA, 50 bp, homo sapien
caagaaattatccaatttaatactcrgatttcatatacgtaaaaattgaa

SEQ ID NO: 63247 - DNA, 50 bp, homo sapien
agaattatgaaggaattgggacaaasatgtgagaatggctggttcatcac

SEQ ID NO: 63248 - DNA, 50 bp, homo sapien
aaagagggcaattctttggtgctgayagtaagtgaacgaaatgaatcttc

SEQ ID NO: 63249 - DNA, 50 bp, homo sapien
gctcttggccttatttcatgttcccrctttctaagcacattaggttttcc

SEQ ID NO: 63250 - DNA, 50 bp, homo sapien
tgtgatgatggaatttcagttataakgctgaatgaattgggaaaaataat

SEQ ID NO: 63251 - DNA, 50 bp, homo sapien
ataatgcatgcatatgaatcacctaygaagatttgtgtcagacatttcat

SEQ ID NO: 63252 - DNA, 50 bp, homo sapien
tggatctagcatttcaacccaggtcsatctactttataatgatagaacac

SEQ ID NO: 63253 - DNA, 50 bp, homo sapien
tcactgacagagaatatgagttaacsaagaaagaaaattgggaaaaataa

SEQ ID NO: 63254 - DNA, 50 bp, homo sapien
ctcgagctgcactatagcttgcttayccttatacagtacaggaattaata

SEQ ID NO: 63255 - DNA, 50 bp, homo sapien
ggattgaggcagtattgtcaaaggtraaatattctgccccagagcccaaa

SEQ ID NO: 63256 - DNA, 50 bp, homo sapien
ggctacaaaaaggctcaaaagttatsaagtgtgttaaggcaagtccttgg

SEQ ID NO: 63257 - DNA, 50 bp, homo sapien
ccctcttcctcctctctaaattcggrataaggtagtggtaagataacaaa

SEQ ID NO: 63258 - DNA, 50 bp, homo sapien
tgtgatagctaagccttaatgtgaaygagatcacaaagagatagtgcatg

SEQ ID NO: 63259 - DNA, 50 bp, homo sapien
actgataaagtttgtgcacatttggyaggtttaagcttgtaataaaacat

SEQ ID NO: 63260 - DNA, 50 bp, homo sapien
gaaggttgttccaagatctaatgaaygtctctagccctttcacctcaagt

SEQ ID NO: 63261 - DNA, 50 bp, homo sapien
aaatgtttaagaaattgtttaagacrtactagagctttgtactagacagg

SEQ ID NO: 63262 - DNA, 50 bp, homo sapien
tcaattaaactgtatggaatttatcrgagtttaataatcagtgtccttgc

SEQ ID NO: 63263 - DNA, 50 bp, homo sapien
tacgggttcaggtctcggaaatacasagttctggtttaagttaaatttcc

SEQ ID NO: 63264 - DNA, 50 bp, homo sapien
acaaattgcaagctctgctgactcaratatattatgactagaaagttaag

SEQ ID NO: 63265 - DNA, 50 bp, homo sapien
tctctagagagattaaaagctgaacygtaagaggcaagatttttaaaaat

SEQ ID NO: 63266 - DNA, 50 bp, homo sapien
aaataatgcctagtgctactgagaarttactatttgtgtcagtcatttgg

SEQ ID NO: 63267 - DNA, 50 bp, homo sapien
ataaaaacaatatctttaaatgtaaygaggtaaggagtgactttgaacac

SEQ ID NO: 63268 - DNA, 50 bp, homo sapien
aaaatccatggctccaagtactaacrgactgtccaaaatactgcattctt

SEQ ID NO: 63269 - DNA, 50 bp, homo sapien
gaaattgaacagggcctaaaagataygtagatatataacaaaacactttg

SEQ ID NO: 63270 - DNA, 50 bp, homo sapien
ataaagagaagaggttattttggctyatgcttctacaaactgtacaagga

SEQ ID NO: 63271 - DNA, 50 bp, homo sapien
attccattgttgcatctgtctaaatraagatgtcaccactgagtcacaga

SEQ ID NO: 63272 - DNA, 50 bp, homo sapien
tttcaactgaattttcagtagaaatraaagcgttcctaaatggtataact

SEQ ID NO: 63273 - DNA, 50 bp, homo sapien
tcctcagaatcatgattgagaacatyaactctcctttattgacctacaga

SEQ ID NO: 63274 - DNA, 50 bp, homo sapien
gtacgtcgaggcctagagagattaarttgcttgtccaagttcacagagct

SEQ ID NO: 63275 - DNA, 50 bp, homo sapien
aagtggcaaagaaagtgcaatagacracaactactacaccatctatatag

SEQ ID NO: 63276 - DNA, 50 bp, homo sapien
agtagggtatgccaagtgttagaatyacaattagatataaattagacaaa

SEQ ID NO: 63277 - DNA, 50 bp, homo sapien
ggacacagtcacaatcaagaggctarcaaagaagcaataataagattata

SEQ ID NO: 63278 - DNA, 50 bp, homo sapien
tttattgaccactgagggacgcacargaatatgatataaaacacaatcct

SEQ ID NO: 63279 - DNA, 50 bp, homo sapien
cttaaatcaaacttttgttgtcctcygattttatcagagcatagcaaagt

SEQ ID NO: 63280 - DNA, 50 bp, homo sapien
tttaggaagacttttagcaaactcartcgctcaggagctgattctcagct

SEQ ID NO: 63281 - DNA, 50 bp, homo sapien
gcattactttcatctaactaagaggyccaatggagttgttttctttctca

SEQ ID NO: 63282 - DNA, 50 bp, homo sapien
cagttggaattacaggacacttttaygttcgaagttacgtatttttctaa

SEQ ID NO: 63283 - DNA, 50 bp, homo sapien
aattatgaaggccacttgtaagagaygtgaagaagcatgccaacgctttg

SEQ ID NO: 63284 - DNA, 50 bp, homo sapien
actgcacaggattgcataagatgtawgtatatttaacataataaaacata

SEQ ID NO: 63285 - DNA, 50 bp, homo sapien
aaaaattatgacaataccaaatgcawataaagttgaggagaaactgaatc

SEQ ID NO: 63286 - DNA, 50 bp, homo sapien
catggaaagctatgaaggcattagarcggatatataaatttctggtgatg

SEQ ID NO: 63287 - DNA, 50 bp, homo sapien
gtgataccccttaaatcctctcttarccatcatgagataactagaattga

SEQ ID NO: 63288 - DNA, 50 bp, homo sapien
tcaggtgtcagatctcagaagaaaaytcaagtatcacagggaagatcaga

SEQ ID NO: 63289 - DNA, 50 bp, homo sapien
ggatatactgcaacatttataaacarcggtaaagtgtagaattataaaga

SEQ ID NO: 63290 - DNA, 50 bp, homo sapien
aagtgtaaatgagtatgaggctactktttccatccactagtgactcagca

SEQ ID NO: 63291 - DNA, 50 bp, homo sapien
tgtgtcctgttggatcacctgaatamagctgaatagtttttttttttttt

SEQ ID NO: 63292 - DNA, 50 bp, homo sapien
gagctgtgcactttcattatcctcaraaatctattaagaaatcatcttat

SEQ ID NO: 63293 - DNA, 50 bp, homo sapien
gggaaacaagactataaacctgacawggattccaatcttaaaaaaatcag

SEQ ID NO: 63294 - DNA, 50 bp, homo sapien
tctttcagggaaataatgattgaaartatcttacgttagattctaagaac

SEQ ID NO: 63295 - DNA, 50 bp, homo sapien
actcattgatgacagatgtactaaartcctgagaggagaagtgtcctggt

SEQ ID NO: 63296 - DNA, 50 bp, homo sapien
cagtcttatcagcccaagtcacatawctgttacctatctgacctatatat

SEQ ID NO: 63297 - DNA, 50 bp, homo sapien
aattatggagacatttcaaacgttgsagtaaaaattgacatcattggcaa

SEQ ID NO: 63298 - DNA, 50 bp, homo sapien
aaagatctcaccatgtccggtgggcratagactggggaaggaaggaaggt

SEQ ID NO: 63299 - DNA, 50 bp, homo sapien
tgttaaagagcgtggagtctccagtyacattgcttgtattcaaatccaga

SEQ ID NO: 63300 - DNA, 50 bp, homo sapien
taggaaggggttgtcgttaatctacyagagtgatgagaagtagaaagaaa

SEQ ID NO: 63301 - DNA, 50 bp, homo sapien
acatcatgaaagcatatgaaagtatraaattaactgacagagcagataca

SEQ ID NO: 63302 - DNA, 50 bp, homo sapien
acataagatttcacgctgattattcwtcctacgttgtatacctgccaagt

SEQ ID NO: 63303 - DNA, 50 bp, homo sapien
tggtgcagggtagggacttaatacayatttgttgactatatttgttttca

SEQ ID NO: 63304 - DNA, 50 bp, homo sapien
cttggaagctctattatatttcaaaygtgatagctactctccaaaggtat

SEQ ID NO: 63305 - DNA, 50 bp, homo sapien
tatctaattttctcattaccatttaytaaaacgattgtatgtatactaaa

SEQ ID NO: 63306 - DNA, 50 bp, homo sapien
cacaaaggcaatgataaaagctctamgagttagcttgaatatttcaaaac

SEQ ID NO: 63307 - DNA, 50 bp, homo sapien
tcattagagttcagtttatcgtttargccagtcaataattttgggatgac

SEQ ID NO: 63308 - DNA, 50 bp, homo sapien
gttaccaagggcctactatgtgcacygatgctcacatgcttgacttccac

SEQ ID NO: 63309 - DNA, 50 bp, homo sapien
tctttcctcttttcctcttgtaggaygctttatagtctctgcgaagcagt

SEQ ID NO: 63310 - DNA, 50 bp, homo sapien
tcttcctctctggctctaggcaccaraactataagacaataaattcctgt

SEQ ID NO: 63311 - DNA, 50 bp, homo sapien
cggtaacactgatgaatacagtattraagtgaatgctgaagatggaaaaa

SEQ ID NO: 63312 - DNA, 50 bp, homo sapien
gtcttccatcatccagttgcctaaaycacttatctgggaatcatttctag

SEQ ID NO: 63313 - DNA, 50 bp, homo sapien
gagggcattaggagtttcggaagtcrcactaagaagtttggactttatct

SEQ ID NO: 63314 - DNA, 50 bp, homo sapien
ctaaaaataattctattttattaaaraaagcaaatgttaacatattgaga

SEQ ID NO: 63315 - DNA, 50 bp, homo sapien
tgtaagggaactcactgtacttctawcttcgcaatttttccataaatcta

SEQ ID NO: 63316 - DNA, 50 bp, homo sapien
gtgggctgagatcacaccaatccacragaatccgtctcaaaaagaaagaa

SEQ ID NO: 63317 - DNA, 50 bp, homo sapien
aattgtatatttgttagagttaatgraccaatattgatatattattatta

SEQ ID NO: 63318 - DNA, 50 bp, homo sapien
tcttggttcatggcactctcagtgtytccgtaaatttgtctagcatttta

SEQ ID NO: 63319 - DNA, 50 bp, homo sapien
acgctttctggagatttattccatcracacagtattgacaggaggccatt

SEQ ID NO: 63320 - DNA, 50 bp, homo sapien
catctaggaaagaacagagcagaaamaattttgaactataaagaaatgta

SEQ ID NO: 63321 - DNA, 50 bp, homo sapien
tattgttggtataaacgtccaagtakgtggagcaaaatcacagaggaaaa

SEQ ID NO: 63322 - DNA, 50 bp, homo sapien
ttacttagattgcctgttccaatcartaaagctactaaaatgttctgaag

SEQ ID NO: 63323 - DNA, 50 bp, homo sapien
tctgaaacaaggtgagcctatttcargaagagacattggcaatggtgcat

SEQ ID NO: 63324 - DNA, 50 bp, homo sapien
ccgtgattttgaacacggatttgaayatgtgatatgaacaagtgattttc

SEQ ID NO: 63325 - DNA, 50 bp, homo sapien
ctatgtcaaaatgtgtagttttaaaytcagactcgaaagccaagataagc

SEQ ID NO: 63326 - DNA, 50 bp, homo sapien
agcttgaagggcaccacttggaaaayggtaaatgtaatctatgacaggtg

SEQ ID NO: 63327 - DNA, 50 bp, homo sapien
ttgtttgagacagatgacaaagaacwccattgtatgtgctaatcgtgcaa

SEQ ID NO: 63328 - DNA, 50 bp, homo sapien
cccttccttccaaccaatgtaaacaygcagtgcaaatctattgtatgatt

SEQ ID NO: 63329 - DNA, 50 bp, homo sapien
tgtttccaaggttacagtattatagytggtacataaagaaccaggatttg

SEQ ID NO: 63330 - DNA, 50 bp, homo sapien
gcagctccttccttgattagatttcratattccaatcgctagacccttgc

SEQ ID NO: 63331 - DNA, 50 bp, homo sapien
tcactactgagagtaacagattaagsacaagaagtgaattttatgaggaa

SEQ ID NO: 63332 - DNA, 50 bp, homo sapien
aattgtcatgagaagagaggagaagraagtagctgttttcacaggaactg

SEQ ID NO: 63333 - DNA, 50 bp, homo sapien
tttagtgctcatcaggcacaatgacragcatgttttagcatcttagaaaa

SEQ ID NO: 63334 - DNA, 50 bp, homo sapien
aaagtgtatgaggtgagactggttaytcctccgtgcactatctccacaag

SEQ ID NO: 63335 - DNA, 50 bp, homo sapien
acatctttttcagtcttcccgtcatkagccttacttcccctgttcgagac

SEQ ID NO: 63336 - DNA, 50 bp, homo sapien
ccaaaatatacaatagagatggctasattcctagagattgcacttcgggg

SEQ ID NO: 63337 - DNA, 50 bp, homo sapien
gcctggctcagtcagtaagtggtgasgtgaagagtactggaattcttgtc

SEQ ID NO: 63338 - DNA, 50 bp, homo sapien
aggccaatattaagatttgagaaacragaaagagccagtaaagaaaagtg

SEQ ID NO: 63339 - DNA, 50 bp, homo sapien
aataagattactgtcactaaaatgaratatgagatctggactagccagtt

SEQ ID NO: 63340 - DNA, 50 bp, homo sapien
cacacaacttagtatgttagtttacrcgccagaaaaagctaaataaagtt

SEQ ID NO: 63341 - DNA, 50 bp, homo sapien
tagtacactattgactatgggagtayatcacaggaaaatagggcttagta

SEQ ID NO: 63342 - DNA, 50 bp, homo sapien
tagctaacagaagagaatgaaagtargaacaactaaataagaaatggcaa

SEQ ID NO: 63343 - DNA, 50 bp, homo sapien
tgtggctattgggtttcaactttagmatttatggaagaatcaatgtttga

SEQ ID NO: 63344 - DNA, 50 bp, homo sapien
atggatcagtaccttatttaatggargtcattgttagaattttgcatttt

SEQ ID NO: 63345 - DNA, 50 bp, homo sapien
aaccgattggttcactagaggcaacrgaatccatgagaccatagcaaaca

SEQ ID NO: 63346 - DNA, 50 bp, homo sapien
gatcccaatgggcatctgtatgtcaygagttgttgctgagaagctgagat

SEQ ID NO: 63347 - DNA, 50 bp, homo sapien
ctggtttctagaacctgaatgtaaaracagaataaggcaagtagtactct

SEQ ID NO: 63348 - DNA, 50 bp, homo sapien
tgtgatcatttgcaatgtgacacgaygttagctgcttttcataagcgcgt

SEQ ID NO: 63349 - DNA, 50 bp, homo sapien
acataaagtttaactaacttgccaakaatcatgcatgcagtgaatgacaa

SEQ ID NO: 63350 - DNA, 50 bp, homo sapien
acacacatatacacacgtgtaagackagtacctcttcagagttcacagtc

SEQ ID NO: 63351 - DNA, 50 bp, homo sapien
tccaaaatttcagatgagttcctgayaggttactggccacgagcagtagt

SEQ ID NO: 63352 - DNA, 50 bp, homo sapien
gctgcttgttagtctttatcattttyttacatggctatataaataaacta

SEQ ID NO: 63353 - DNA, 50 bp, homo sapien
gttttttcttagtgatttgagttccktgtatgttgtcagatgcaaaattc

SEQ ID NO: 63354 - DNA, 50 bp, homo sapien
ttcagacatttagttgtctattggcyacattaccccactcctcccctgcc

SEQ ID NO: 63355 - DNA, 50 bp, homo sapien
tttttagaagaaacccttcagctaartcgtagatgacaatttttttaagt

SEQ ID NO: 63356 - DNA, 50 bp, homo sapien
ctgatctgttatttcctcaaccctaycaatgtttaaaaacattagaacct

SEQ ID NO: 63357 - DNA, 50 bp, homo sapien
gagaaagaaaaaatttccttgaaacraagtctaataaagtattgtgaaaa

SEQ ID NO: 63358 - DNA, 50 bp, homo sapien
gaagaactgaattgaggtcagggaarctataaacctttgagtgcttttgt

SEQ ID NO: 63359 - DNA, 50 bp, homo sapien
ttttcttattgtttaataaatgctcraaatattccttaagtaacatagta

SEQ ID NO: 63360 - DNA, 50 bp, homo sapien
tacacagttcactactggcagttaakgtatttcagtgtcttctgtttttt

SEQ ID NO: 63361 - DNA, 50 bp, homo sapien
gccatgcacacaggtaatacactttsaaagggcactttacactccacata

SEQ ID NO: 63362 - DNA, 50 bp, homo sapien
actgccccatttgagaaatgaggtcrccaagtgatggattctcccaagct

SEQ ID NO: 63363 - DNA, 50 bp, homo sapien
tttatttttgagctttataaaatggyatcgtatatgaaccttctgagatg

SEQ ID NO: 63364 - DNA, 50 bp, homo sapien
tacaacttatttttttttaactggckagtaccagaagatttacaaatgta

SEQ ID NO: 63365 - DNA, 50 bp, homo sapien
caaatattcataggttttcctcccayggaattgcaaattatactcattat

SEQ ID NO: 63366 - DNA, 50 bp, homo sapien
actctggttccacaagataattacargtatccagcaaaaacgttttccat

SEQ ID NO: 63367 - DNA, 50 bp, homo sapien
ctggggacccaggtgtaatcaccaarttaatccccctgttattttcctgt

SEQ ID NO: 63368 - DNA, 50 bp, homo sapien
aaacattttggcaagcgattgtcctrtgaaagactagggttatggatcaa

SEQ ID NO: 63369 - DNA, 50 bp, homo sapien
aggtaaaatctctaataaccagaaayctcatatacattctattttgtctt

SEQ ID NO: 63370 - DNA, 50 bp, homo sapien
tcaacacttaacaaagttgcagtgcsacatgaaggggcaagaaactagaa

SEQ ID NO: 63371 - DNA, 50 bp, homo sapien
atcttataaacaaaacaaaaaacaayggatagataagaaatggttctgac

SEQ ID NO: 63372 - DNA, 50 bp, homo sapien
tgtattcacaacaccacatacttttrtcttttacttctatacccatctct

SEQ ID NO: 63373 - DNA, 50 bp, homo sapien
ctcagaagaagaaactaaactgagargtatcaaagactatgaggaaagaa

SEQ ID NO: 63374 - DNA, 50 bp, homo sapien
tcattgtttacttgattttggaatcrctcttctcacacctgttccaacaa

SEQ ID NO: 63375 - DNA, 50 bp, homo sapien
aagaaatggttctgactctcttaacrattatgatgggatgatacctgggc

SEQ ID NO: 63376 - DNA, 50 bp, homo sapien
tgcagtcttcttttcttcactttccrtagaactctagcttgtgtctccac

SEQ ID NO: 63377 - DNA, 50 bp, homo sapien
ttaacgattatgatgggatgataccygggctcaaggtgaaaccactcata

SEQ ID NO: 63378 - DNA, 50 bp, homo sapien
tggtaactactgttgtttctcctttktatcacagcatcatacttaagagt

SEQ ID NO: 63379 - DNA, 50 bp, homo sapien
gttttaggttattcaacgtgtaaccraaaacataaaggaaaccttgtttc

SEQ ID NO: 63380 - DNA, 50 bp, homo sapien
gaaagagagagccattgaattcagargagaaaattatctgattcttagca

SEQ ID NO: 63381 - DNA, 50 bp, homo sapien
tttagactgaacaggaatggctaaayaacactgtaagacagcagcaagga

SEQ ID NO: 63382 - DNA, 50 bp, homo sapien
atgtatttatttatcatctattgtaygtgggtactgaaggaatacagaaa

SEQ ID NO: 63383 - DNA, 50 bp, homo sapien
acagtttatttgaaaactttgaagckgagtggagaataacaaagttgtga

SEQ ID NO: 63384 - DNA, 50 bp, homo sapien
tggcttatacctaggggctgtgctgrataaaaaacacatatctcataaaa

SEQ ID NO: 63385 - DNA, 50 bp, homo sapien
ctgggttacaagtccctcagataaamatgtcttccagtatccatacaaat

SEQ ID NO: 63386 - DNA, 50 bp, homo sapien
agtccaggaatgttaggggtaccagracctcatcactttctctatgaaac

SEQ ID NO: 63387 - DNA, 50 bp, homo sapien
agcaacttcagctaccaatgattatyaactctccttttaaaaaactgaaa

SEQ ID NO: 63388 - DNA, 50 bp, homo sapien
cgggttactataagaagttccagtamcacagtcttcctgcatgtgggctc

SEQ ID NO: 63389 - DNA, 50 bp, homo sapien
cattaaatcactactgtgcatacttwaagccaggtattatctgtgtagta

SEQ ID NO: 63390 - DNA, 50 bp, homo sapien
aaatatgttatagaagaaaaattcaraatatactcatcagtttttttaat

SEQ ID NO: 63391 - DNA, 50 bp, homo sapien
aagcagtacaatgaatgagcttatayagttatttcatcagaaataggcac

SEQ ID NO: 63392 - DNA, 50 bp, homo sapien
gtagtattccatgtgtatatgtaccrctaaaatggaattttacatcaaca

SEQ ID NO: 63393 - DNA, 50 bp, homo sapien
gtatttgtctttgttctttacagagyctcattatattgctcgaatatcat

SEQ ID NO: 63394 - DNA, 50 bp, homo sapien
ataaaaattgctaacaataaatgtgytacttggaatttgctagtagttaa

SEQ ID NO: 63395 - DNA, 50 bp, homo sapien
cagatatatggagagtcaatgctgaraggttaggtatggggtgctaagga

SEQ ID NO: 63396 - DNA, 50 bp, homo sapien
agcctatctgttacaattaatgagcyaatgtcgataaattattaaagtca

SEQ ID NO: 63397 - DNA, 50 bp, homo sapien
caggtcagtctactcctcatgctagycctaaaggttgactagccttggat

SEQ ID NO: 63398 - DNA, 50 bp, homo sapien
tagaatgttttactgttagtgatagwacattagtgtggagttttgaatga

SEQ ID NO: 63399 - DNA, 50 bp, homo sapien
ctacttgcttgtggaatatttttgayatgtttttccctaaattcagggat

SEQ ID NO: 63400 - DNA, 50 bp, homo sapien
tactgtaaaaacagactcagttagaytacgttgggttacaccattaagag

SEQ ID NO: 63401 - DNA, 50 bp, homo sapien
tgccttggcaagaacaatctggtcaragaattagatgccatgagattaac

SEQ ID NO: 63402 - DNA, 50 bp, homo sapien
caagtaaatatctgataattaatcaragatacagcatatctgacagtaag

SEQ ID NO: 63403 - DNA, 50 bp, homo sapien
gactcatgataggaatagaagttacraaatgactgcagcgggtgatgagc

SEQ ID NO: 63404 - DNA, 50 bp, homo sapien
agatctatgtgaggataagaaaatckcagcatttcaaaaagaggaaaagg

SEQ ID NO: 63405 - DNA, 50 bp, homo sapien
caccccatagatgtttgtagagtgargtgaataaattaatgggagagaaa

SEQ ID NO: 63406 - DNA, 50 bp, homo sapien
gaagaacatagaggatactgagacarctcatgaagactctgtggttaaat

SEQ ID NO: 63407 - DNA, 50 bp, homo sapien
caaatgctagttacgactcagccacrttgcatactctgattattctgaat

SEQ ID NO: 63408 - DNA, 50 bp, homo sapien
caaacaccttttacttaagaaaaagyagcggctgttcttagaagtagacc

SEQ ID NO: 63409 - DNA, 50 bp, homo sapien
ggcatacagtacttctggtttttatwcaagtcttctagaacaatttgatg

SEQ ID NO: 63410 - DNA, 50 bp, homo sapien
cacacgaatatatataaaaacatcarattaagggcaagtgcatcagttat

SEQ ID NO: 63411 - DNA, 50 bp, homo sapien
ttcatttccctgaatttgtttcttcyaaggctacctacaaaaatattgat

SEQ ID NO: 63412 - DNA, 50 bp, homo sapien
ggtggggggttggttttgagatgaartggttccacctaagattctcaagc

SEQ ID NO: 63413 - DNA, 50 bp, homo sapien
tagtgtggtttgttttacagttagtsaagctgatgaatagacaagaagag

SEQ ID NO: 63414 - DNA, 50 bp, homo sapien
ctcttggcaacatttccaaatttcaratacttcaaacgtgacctctggct

SEQ ID NO: 63415 - DNA, 50 bp, homo sapien
tggttaagtaaataaataagttacarccatgtctgttttccaatgttatg

SEQ ID NO: 63416 - DNA, 50 bp, homo sapien
aacccttagaatctagcacataggawctcaataagtatcattagagtaaa

SEQ ID NO: 63417 - DNA, 50 bp, homo sapien
gatatacaatttgacaccagaggtasaggaattcctacacatgtctacca

SEQ ID NO: 63418 - DNA, 50 bp, homo sapien
tcaacccacaggaaacaattaggaarccatataacacagtgaatattgat

SEQ ID NO: 63419 - DNA, 50 bp, homo sapien
aaagattgaaagagcacataccaagraagaatctgctacgtgtggtgaca

SEQ ID NO: 63420 - DNA, 50 bp, homo sapien
tacaacagtctggctctatggtgacraagcaaggaagtatctgcatcgca

SEQ ID NO: 63421 - DNA, 50 bp, homo sapien
cccagaacagctatctaatgttgtcrcttacatcaccatttcctcagtca

SEQ ID NO: 63422 - DNA, 50 bp, homo sapien
actttgtcctcagatgggtactgcckaactagccatcaagaaagggctgt

SEQ ID NO: 63423 - DNA, 50 bp, homo sapien
tgctgaaatggaactctggctcataractaaatcatttgggtataggaag

SEQ ID NO: 63424 - DNA, 50 bp, homo sapien
ataatcttcctttccccataaagacragcataatcaccaggagtgatatt

SEQ ID NO: 63425 - DNA, 50 bp, homo sapien
gccaatatataagaaagtgtttaagsaagataaaacgcaaagtacatttt

SEQ ID NO: 63426 - DNA, 50 bp, homo sapien
cattgtctctagtcatgctctttcartaatgttcctgactgtctcaaata

SEQ ID NO: 63427 - DNA, 50 bp, homo sapien
gatgacagaaaggttgaatccctacrtgataagaaactgcatgactcttg

SEQ ID NO: 63428 - DNA, 50 bp, homo sapien
tttaatcagctagacccaagcttatmaattttgtaaagagaggtcatttt

SEQ ID NO: 63429 - DNA, 50 bp, homo sapien
ctgaggcagaaagaccagttagaagrctcatgacatacactgtcctggca

SEQ ID NO: 63430 - DNA, 50 bp, homo sapien
tcattaagtgttctctcccttaaaaygaaacacatgacatgcaccagtcc

SEQ ID NO: 63431 - DNA, 50 bp, homo sapien
tttcattatcaacatgtctatgaaaktatctggcttaaaacacctgatac

SEQ ID NO: 63432 - DNA, 50 bp, homo sapien
gcctttcaggggtggtctaaataaawtgcttccggacattatccttctga

SEQ ID NO: 63433 - DNA, 50 bp, homo sapien
aaatctgaaaataaatatttgttackcatagacctgtaagtgaaaggagt

SEQ ID NO: 63434 - DNA, 50 bp, homo sapien
gaatcagaattttgtgtttcttctaygaactgtggaaatctagagctgta

SEQ ID NO: 63435 - DNA, 50 bp, homo sapien
atcacgaacaaatcggaaaattaagrcctttgtagtgctcttataggaga

SEQ ID NO: 63436 - DNA, 50 bp, homo sapien
tctgtagtcattcttacgctgcttaygaaacagttactatcctgaatgaa

SEQ ID NO: 63437 - DNA, 50 bp, homo sapien
tctatgtatcacaatagcatcattaygtagtaacaacacagtatttctcg

SEQ ID NO: 63438 - DNA, 50 bp, homo sapien
gagtctgagattaagaaaattggaargtggtactcaaagagatagaagtt

SEQ ID NO: 63439 - DNA, 50 bp, homo sapien
agtctggaaatttggacactccttasctttcaaatctcatctccagctag

SEQ ID NO: 63440 - DNA, 50 bp, homo sapien
tgaaacactgtactggctttatacgrccttatatttatattcccactatt

SEQ ID NO: 63441 - DNA, 50 bp, homo sapien
gttgccaagcattgtgtaggaatcaraattgttagcagaagcaatgaatt

SEQ ID NO: 63442 - DNA, 50 bp, homo sapien
ctagtcctcatgtctatgaattaaascaggatcagtttccattaggtcaa

SEQ ID NO: 63443 - DNA, 50 bp, homo sapien
tttcacctttcgttccactgctcaamattgtttagatttccagaattgac

SEQ ID NO: 63444 - DNA, 50 bp, homo sapien
agttacttcgtctatctaggctgaakaattctaatctgttgctagataca

SEQ ID NO: 63445 - DNA, 50 bp, homo sapien
gtgataacccattagaaggcaatgaycttttctgtagattcaatgtagaa

SEQ ID NO: 63446 - DNA, 50 bp, homo sapien
acaactgatctcatttacaaaattcyatgaagatttcactctgtccaggt

SEQ ID NO: 63447 - DNA, 50 bp, homo sapien
acataatacttaacattacaaatagraaaagatgggcttctttagcaaaa

SEQ ID NO: 63448 - DNA, 50 bp, homo sapien
ttccaccaaacacacatagtaattawcaacctgaggtccacatcaggatt

SEQ ID NO: 63449 - DNA, 50 bp, homo sapien
agtctttcactattttcacctgctawctgaggctcccagacctcccttgg

SEQ ID NO: 63450 - DNA, 50 bp, homo sapien
aaactgtccagaccatcaagagtacrcatattcaaaatatcattgtgaat

SEQ ID NO: 63451 - DNA, 50 bp, homo sapien
tgatacctatgattttatatcctctragagacaagtgaaactggcttttt

SEQ ID NO: 63452 - DNA, 50 bp, homo sapien
cagctgagctttgcctcatagaatckctcttaggtgtcatccagtcccat

SEQ ID NO: 63453 - DNA, 50 bp, homo sapien
ccatttgggggttactatttgtgaaytgctttttaatatcctttgccaat

SEQ ID NO: 63454 - DNA, 50 bp, homo sapien
gcccaaccatcaaaataaagatgcaytcttaactgcagtcatgcaagtta

SEQ ID NO: 63455 - DNA, 50 bp, homo sapien
gggaaaaacttccagtatcacaaacrggacaatgaaagatgtgtttagag

SEQ ID NO: 63456 - DNA, 50 bp, homo sapien
ttccttagaatctggacatctttaaygttttgttgtaacatcttgactac

SEQ ID NO: 63457 - DNA, 50 bp, homo sapien
cctattccaaatggatctgattataygttctgtactgttttccatagatc

SEQ ID NO: 63458 - DNA, 50 bp, homo sapien
actctcatgttccaggaatatctcakagcattttaccaaaacttagatca

SEQ ID NO: 63459 - DNA, 50 bp, homo sapien
tgttggttgggcaggtgtaataccarggtgtgtcatcgtcatcatggttt

SEQ ID NO: 63460 - DNA, 50 bp, homo sapien
ggtggctacagagggaatagctaacmgagtttcaggtgacagaaggagga

SEQ ID NO: 63461 - DNA, 50 bp, homo sapien
aggtcaagacttagattttgccttcraggaattcgtagtacaggaggaga

SEQ ID NO: 63462 - DNA, 50 bp, homo sapien
ccagactcttcagtaagaagccatcygatcatgaaagaaagggacgagga

SEQ ID NO: 63463 - DNA, 50 bp, homo sapien
aaaacacctaagtggatatgaaaaasggcatagaaattgaaatcagaaga

SEQ ID NO: 63464 - DNA, 50 bp, homo sapien
acttcccacttcttcattctgtaaaygccaagggtcaccccgcctaggct

SEQ ID NO: 63465 - DNA, 50 bp, homo sapien
ccagaattacttgcagctgtggttayaaagcaaatccaacagcgggcaga

SEQ ID NO: 63466 - DNA, 50 bp, homo sapien
atgtgggtctagggtggcattcacaratattaacaggcttttcctatgaa

SEQ ID NO: 63467 - DNA, 50 bp, homo sapien
gagtcgggaaactggccttcataaastgagtgacttgaggggaagctgag

SEQ ID NO: 63468 - DNA, 50 bp, homo sapien
ttatatgtaggacaaaatgtaatcaygggaatattcaattaaaaagtcaa

SEQ ID NO: 63469 - DNA, 50 bp, homo sapien
cacagaaacagttgtgcatgataaargcgtggggccaaggcacagaagct

SEQ ID NO: 63470 - DNA, 50 bp, homo sapien
gaatccaagtggcttccacattcagraaaatccaaggggaaacccctacc

SEQ ID NO: 63471 - DNA, 50 bp, homo sapien
aatataattagcaagaaaatctctgwagttttagtttatatttttgtttc

SEQ ID NO: 63472 - DNA, 50 bp, homo sapien
agcattaacacattgtgctgagcatraaaataaatcagaagtccttgaac

SEQ ID NO: 63473 - DNA, 50 bp, homo sapien
agatgctgatgtgagcaggtatcaaraaagctgacgtgaatatcctcatc

SEQ ID NO: 63474 - DNA, 50 bp, homo sapien
cattctgatggagtcctggaaatagrttcttggagacacagctatgtatt

SEQ ID NO: 63475 - DNA, 50 bp, homo sapien
ttgttaatccttctaagtgtcattgyaattatagctgtattcagcctatg

SEQ ID NO: 63476 - DNA, 50 bp, homo sapien
gtctgggcacaagtaggacacctgcsactattaagatggaaaagagataa

SEQ ID NO: 63477 - DNA, 50 bp, homo sapien
ctgcagcgtttcagggaaaatgtgasagtatcctagaaaccatagctcta

SEQ ID NO: 63478 - DNA, 50 bp, homo sapien
agattagagccacagcctgttagcaratcgccctcattccagtgcttcct

SEQ ID NO: 63479 - DNA, 50 bp, homo sapien
gctatgaattaaaccatctgacaccracttaccttggcagggagggatgg

SEQ ID NO: 63480 - DNA, 50 bp, homo sapien
gacagtagtaaagatagaattagaaytgaggtgaataaaggccgagggta

SEQ ID NO: 63481 - DNA, 50 bp, homo sapien
tgagcttcctggactaaaccatctcrcgtgggtccactagcagcgctcag

SEQ ID NO: 63482 - DNA, 50 bp, homo sapien
tcatgatacaatgataccacaaaatratcgttatctttttcttcctattc

SEQ ID NO: 63483 - DNA, 50 bp, homo sapien
ttgtgcagttttctcatatataaaayggaagtaataagctcagatctcaa

SEQ ID NO: 63484 - DNA, 50 bp, homo sapien
taggctaaaacaaggcccaatcccgyaggaattagaataagtgttcatca

SEQ ID NO: 63485 - DNA, 50 bp, homo sapien
atcaactagtatatttgttcttataygtaggtgacacacggtcatttcaa

SEQ ID NO: 63486 - DNA, 50 bp, homo sapien
agttggtgttgtttattacaaacaasaattgaaatgagatcaactagtat

SEQ ID NO: 63487 - DNA, 50 bp, homo sapien
ttgtttaatggtagtcataaacccargtattcaaaaaatagaggtttttt

SEQ ID NO: 63488 - DNA, 50 bp, homo sapien
aattcagaaggcatgttaagtagacmaaaaacatgaagcaaagttagagc

SEQ ID NO: 63489 - DNA, 50 bp, homo sapien
ttatcttacacagatataaatccaarataaaggttccaattgatttggct

SEQ ID NO: 63490 - DNA, 50 bp, homo sapien
aatagttaacctgcctctagaaatayggttaatgagggtgggttcaatgg

SEQ ID NO: 63491 - DNA, 50 bp, homo sapien
tgaggaagcctcccagacaagcgtcracatgaaggggtattttgtatttg

SEQ ID NO: 63492 - DNA, 50 bp, homo sapien
attcagatggcagtgattgaaaaagsctttgacagttatttctatcagag

SEQ ID NO: 63493 - DNA, 50 bp, homo sapien
ccaccaacccattaaactgactcacraatagaaatgggttttctccatct

SEQ ID NO: 63494 - DNA, 50 bp, homo sapien
tactgtggcttttataactacaccaygactgaattattttagttgttata

SEQ ID NO: 63495 - DNA, 50 bp, homo sapien
gtatccatatctgtactatacttcasggaacctatccaaaggaaataata

SEQ ID NO: 63496 - DNA, 50 bp, homo sapien
caacttccgggcactgtgccacgcasggaaacagtgataaccaggcaatg

SEQ ID NO: 63497 - DNA, 50 bp, homo sapien
attttgtagcataccttgcagtgaawtataacagtatgactaagctctag

SEQ ID NO: 63498 - DNA, 50 bp, homo sapien
aagactttaccctgtgctaaacacargataagacccaatcagttctttcc

SEQ ID NO: 63499 - DNA, 50 bp, homo sapien
ataattatgttatgtgttgttaaackgttaaatgttcaatctgttaggat

SEQ ID NO: 63500 - DNA, 50 bp, homo sapien
atactggcattcttcatactggaackcctaagaatgcattattgttgtga

SEQ ID NO: 63501 - DNA, 50 bp, homo sapien
cccctccaagggctttccagatgaargaaccagtaacaaaaagaaaaaac

SEQ ID NO: 63502 - DNA, 50 bp, homo sapien
atcatgagattgtggaactactaacrgaaagctgtgatttgaacttggct

SEQ ID NO: 63503 - DNA, 50 bp, homo sapien
aagtcattttctccctgtaagttagragtagagaatacagagggggctta

SEQ ID NO: 63504 - DNA, 50 bp, homo sapien
ttgaataaataccaaggagtgtgctwgctagattgtatgttaagtgtatg

SEQ ID NO: 63505 - DNA, 50 bp, homo sapien
cctttactagagagcaggcattaccyaaactgatttcagcaaattccagc

SEQ ID NO: 63506 - DNA, 50 bp, homo sapien
atctgcatgtaggaatgtgcccaccraaagggtgatattccacatgctgc

SEQ ID NO: 63507 - DNA, 50 bp, homo sapien
aggtcttcagtatattttacataccrgaaaggagataccattaatatgtt

SEQ ID NO: 63508 - DNA, 50 bp, homo sapien
aaggaaaaaacatttagctactgatwataactcaagtgaaatttataaaa

SEQ ID NO: 63509 - DNA, 50 bp, homo sapien
gcagagaccacccatatggatccggycacagttggagactcataattaga

SEQ ID NO: 63510 - DNA, 50 bp, homo sapien
gtaattttttcacactgctgatacartactttctatgagtttattgtgtt

SEQ ID NO: 63511 - DNA, 50 bp, homo sapien
ctttttctttggcatgctatcttggyaaggtaggaccccagcccagggcc

SEQ ID NO: 63512 - DNA, 50 bp, homo sapien
tgtacttggcagtattctgatccacraggagaaaaatgatcaataaggct

SEQ ID NO: 63513 - DNA, 50 bp, homo sapien
aatactggggcttagtagtgcagaaytcaaaatctcatagcctaagagaa

SEQ ID NO: 63514 - DNA, 50 bp, homo sapien
ctcctcccaggcaactaacacttaamcaggggagaaggaaagaacgtgag

SEQ ID NO: 63515 - DNA, 50 bp, homo sapien
agcggaatgaaaatagctaacatcamaatcagtgaccagaaaagaaagcc

SEQ ID NO: 63516 - DNA, 50 bp, homo sapien
agggtggatctgaatattttccaggwcagatgtagggtagtcttgttaga

SEQ ID NO: 63517 - DNA, 50 bp, homo sapien
ttcccctttctttcctgctccaggargtatatcagaatgcaagtgagtaa

SEQ ID NO: 63518 - DNA, 50 bp, homo sapien
ctgggagaagcaggaaatgattgacrcttcaggcacttggtgagtagcaa

SEQ ID NO: 63519 - DNA, 50 bp, homo sapien
catccagtgacagcttaattgagcaraacactaggctcataaacctcttt

SEQ ID NO: 63520 - DNA, 50 bp, homo sapien
aacttgacatttgctcggtctacatstgatcctaagggttccagataaga

SEQ ID NO: 63521 - DNA, 50 bp, homo sapien
agactccatggaccattactccaatmacttttgccagagtcttcggcatc

SEQ ID NO: 63522 - DNA, 50 bp, homo sapien
atgttatataataatcttccaagacmgttacagattaatctgaataccta

SEQ ID NO: 63523 - DNA, 50 bp, homo sapien
gcttcagtttgtcagacacagtcagrtccgttagcaaacacagctctccc

SEQ ID NO: 63524 - DNA, 50 bp, homo sapien
gaatgagagccaaaagggagcaggargtttatgctatttgtatgcccttt

SEQ ID NO: 63525 - DNA, 50 bp, homo sapien
ccacgtaaaagctagtccagaaaacyggtatgaaagtcagttggcttgct

SEQ ID NO: 63526 - DNA, 50 bp, homo sapien
tggtgttatctagctgttaactgaastatgcacagaaaactgacactttc

SEQ ID NO: 63527 - DNA, 50 bp, homo sapien
aaatctacttagcctagtcagggaarattaaaaaacatttccattctaga

SEQ ID NO: 63528 - DNA, 50 bp, homo sapien
ctttcagaacctttctatggaaacarattatgagttagaataaacacagg

SEQ ID NO: 63529 - DNA, 50 bp, homo sapien
aaatgttgccctttgccacattacaytgaacactggatgcatgtggaaag

SEQ ID NO: 63530 - DNA, 50 bp, homo sapien
agcaaatagacaaaaatatgcttaaygttgttcataataattaaaattac

SEQ ID NO: 63531 - DNA, 50 bp, homo sapien
taattcaacttctttcacctaaataygcttactaagtacaccctataata

SEQ ID NO: 63532 - DNA, 50 bp, homo sapien
ctagtaaccctaaagccaagtatatmaaacatctaggtatatgagataag

SEQ ID NO: 63533 - DNA, 50 bp, homo sapien
ggaagataaggcatgaaaattattasgcaaataaccaaccctactgtctt

SEQ ID NO: 63534 - DNA, 50 bp, homo sapien
tcctccttccatagaatgagtttaaytgttagagagttctttaacgaact

SEQ ID NO: 63535 - DNA, 50 bp, homo sapien
ctatggtgaaccatgatcaagtctgyttagaaaggaaagagggccaggtg

SEQ ID NO: 63536 - DNA, 50 bp, homo sapien
gtctcggcctggaaagaaatccaggragcgtaagagaactcaagttagtc

SEQ ID NO: 63537 - DNA, 50 bp, homo sapien
tatattgacaagaggtgtgtacgacmgaaagtctatagaatcattactga

SEQ ID NO: 63538 - DNA, 50 bp, homo sapien
gttttagaattaccacttcacaactrcagagtaacctagatgcctacctt

SEQ ID NO: 63539 - DNA, 50 bp, homo sapien
tgaagaaaaagactgctgaaaaagaragcactaagcctattatagaaatg

SEQ ID NO: 63540 - DNA, 50 bp, homo sapien
tcagatgattttagtttagcacgtgyattctcaagcttggtattattgaa

SEQ ID NO: 63541 - DNA, 50 bp, homo sapien
acaagaaaaggcatcaatgctttgcrattgaacctacacaatgacctgat

SEQ ID NO: 63542 - DNA, 50 bp, homo sapien
atctgcagtgtcatttggttcacttygctactactgaagcattgcttctc

SEQ ID NO: 63543 - DNA, 50 bp, homo sapien
ttgtttaccttttttcaatgctgacrcagagtgatttaaaaaatgaaatc

SEQ ID NO: 63544 - DNA, 50 bp, homo sapien
atgaactcaggataaaaagcaccacragttttaccaccctgacaagtcat

SEQ ID NO: 63545 - DNA, 50 bp, homo sapien
ctcagtgattttcacttattaagtarcatcacaagccatgaaaatattct

SEQ ID NO: 63546 - DNA, 50 bp, homo sapien
tctgacacctcttgtctttgggcatraagttttgatagtgaggtgtctta

SEQ ID NO: 63547 - DNA, 50 bp, homo sapien
aaaacaaagaccaaatcaatcaagaygctgaaacaagtcaacaactcatt

SEQ ID NO: 63548 - DNA, 50 bp, homo sapien
atactgtacagtagagttaagttcawtcagtgggtggattctgctgataa

SEQ ID NO: 63549 - DNA, 50 bp, homo sapien
aaacccattcatatttgttgtagtarctgaaatacttttcttcctttcat

SEQ ID NO: 63550 - DNA, 50 bp, homo sapien
tccttatcagactcagaatagagacyaggactgtactgccaagtaggggc

SEQ ID NO: 63551 - DNA, 50 bp, homo sapien
ctagcagcatctcaacttcatattcratagacctcagatttggagggtct

SEQ ID NO: 63552 - DNA, 50 bp, homo sapien
tgtcagggtcaaccttcaggaaaaayctgggacttctggctcagcccttc

SEQ ID NO: 63553 - DNA, 50 bp, homo sapien
caagcaattcacaaagtacttataartcataaaccagctgttttggccct

SEQ ID NO: 63554 - DNA, 50 bp, homo sapien
aaaaagaagttatgatcatataaaartattgctagtcaggaatttctgac

SEQ ID NO: 63555 - DNA, 50 bp, homo sapien
caaacaattaataaatataagtaaartgagctatgtttattttaggtttg

SEQ ID NO: 63556 - DNA, 50 bp, homo sapien
tatgattcctgccatagcaaaaaaamcaccttttaatctctagatagctg

SEQ ID NO: 63557 - DNA, 50 bp, homo sapien
aaaaggaaaatggcagtttgaaaaaycttttgacgttgagtaaaatataa

SEQ ID NO: 63558 - DNA, 50 bp, homo sapien
gagaatgacagagagaggtacactaractctaagactattatgaagtcca

SEQ ID NO: 63559 - DNA, 50 bp, homo sapien
ctggttttgctacaaggactacaccrattcaccaaattaatcaggtagat

SEQ ID NO: 63560 - DNA, 50 bp, homo sapien
ggacatctgtgtttacagtttgccawtcagcatctacaaaaagaaggaga

SEQ ID NO: 63561 - DNA, 50 bp, homo sapien
tgtagaatagaaaatgttttttaaartctgtgaatcagaactctatgaat

SEQ ID NO: 63562 - DNA, 50 bp, homo sapien
gatgagaaaaaaatttacacatacartaccagttgatattaggagaacca

SEQ ID NO: 63563 - DNA, 50 bp, homo sapien
ctactccctgctgtgtcacatcacawcttacgagtcacttgtttctttcg

SEQ ID NO: 63564 - DNA, 50 bp, homo sapien
aactccacataagatactgtggacayatatttaaaacaaagttttttgtt

SEQ ID NO: 63565 - DNA, 50 bp, homo sapien
caagaactatttcacataggaaagamgacaaaaatatatgggcaaaacag

SEQ ID NO: 63566 - DNA, 50 bp, homo sapien
tttttgtcttctttcctatgtgaaayagttcttgaacagacagctttgac

SEQ ID NO: 63567 - DNA, 50 bp, homo sapien
ggaagttcaattcctagtttctaacrgtgcttttgttttctcctggccta

SEQ ID NO: 63568 - DNA, 50 bp, homo sapien
caattttaacatttattcattctgargcaaaacactggaacatagaataa

SEQ ID NO: 63569 - DNA, 50 bp, homo sapien
gaaatctgaggtaagatgaaccacaytgaattcctgaaaacatggtacct

SEQ ID NO: 63570 - DNA, 50 bp, homo sapien
agctcaattatctttactaccttcgraaatacagtatctctccacgtggg

SEQ ID NO: 63571 - DNA, 50 bp, homo sapien
aacctgatgcgaacactggactagarcaaaaatactaaaagaaatgtcaa

SEQ ID NO: 63572 - DNA, 50 bp, homo sapien
ttccttttttcttttcacctaataarcctgtcctactcaccctgcaatgt

SEQ ID NO: 63573 - DNA, 50 bp, homo sapien
tttctagattaagagatgaagggaaytatgcaaaaaaggatggtgtgtag

SEQ ID NO: 63574 - DNA, 50 bp, homo sapien
gtttgtatttatttttgtaaaaaggrattagaatttatatgacatgatag

SEQ ID NO: 63575 - DNA, 50 bp, homo sapien
ggggaaaaaaactagcttattattaraattatcttcgttctatcatgtca

SEQ ID NO: 63576 - DNA, 50 bp, homo sapien
tattaaatcactgggagagtctttamaaaacagagatgtctgggtcctat

SEQ ID NO: 63577 - DNA, 50 bp, homo sapien
cgtcaatgtctctcaactttgcagaytcaaataaatccaaattcaaattc

SEQ ID NO: 63578 - DNA, 50 bp, homo sapien
gcccagaagctgatgttgctaggaaraaaaatcccatgggaaaaaaatct

SEQ ID NO: 63579 - DNA, 50 bp, homo sapien
gaaacatgactattaactgactggamtcatctaggtatgttccgtctctc

SEQ ID NO: 63580 - DNA, 50 bp, homo sapien
cttaatttgctgtatgaagtacaacygaggatgcctcacttcatgctgta

SEQ ID NO: 63581 - DNA, 50 bp, homo sapien
gtacatatgtagtagttcagaaatarcaattggcatcctaggtaagtatg

SEQ ID NO: 63582 - DNA, 50 bp, homo sapien
tgtaacccatgtataaaacatggtayggaaaacattatatgtatatgaaa

SEQ ID NO: 63583 - DNA, 50 bp, homo sapien
gatgacactgacataacacagtgtcraaaaagtgaaaattcacagaccac

SEQ ID NO: 63584 - DNA, 50 bp, homo sapien
cctgagttttatgaccttctaattcrccgagcccaaggtcacaaattatt

SEQ ID NO: 63585 - DNA, 50 bp, homo sapien
tagtggcgtttgaggtgtttctgacyatcttgcttgttcatttcaccctg

SEQ ID NO: 63586 - DNA, 50 bp, homo sapien
tccaaccatgtgtttctaagtgtcaycttcactctcatcctctttcagtt

SEQ ID NO: 63587 - DNA, 50 bp, homo sapien
gcactgtgtttgggggataataataygtcactcccgcttatgcatcagag

SEQ ID NO: 63588 - DNA, 50 bp, homo sapien
cagttttatatttataattcaggaasgcacttttccaaactactgcatgc

SEQ ID NO: 63589 - DNA, 50 bp, homo sapien
cccctaccctttctccccaagtgacraggcttttgagcaatggagagagg

SEQ ID NO: 63590 - DNA, 50 bp, homo sapien
gatcaataacttttctgagaatgtcygaacacatactccctagtggtcat

SEQ ID NO: 63591 - DNA, 50 bp, homo sapien
gcctagaaaatgaacagctttctaaygatgaccaggccttgtatcagaat

SEQ ID NO: 63592 - DNA, 50 bp, homo sapien
ttatggaaagcatgttgagatatgamgtgtatggtggagaaaatgaggta

SEQ ID NO: 63593 - DNA, 50 bp, homo sapien
ccaccttacatatactgtaggtgaaragggggtattcgcttgactttgga

SEQ ID NO: 63594 - DNA, 50 bp, homo sapien
aaacccattctacggcttccctcaakgcttcagacatacctggttgagct

SEQ ID NO: 63595 - DNA, 50 bp, homo sapien
cctccaatgaacaacgaatatatgaygtagtgagaaataaaccttttcac

SEQ ID NO: 63596 - DNA, 50 bp, homo sapien
aaaattttttatagaaggatttcaayggaagttctcaaaaaataagtttc

SEQ ID NO: 63597 - DNA, 50 bp, homo sapien
tcctctgatttaatataggagtgaaygcacaggtggaaaatacaggctct

SEQ ID NO: 63598 - DNA, 50 bp, homo sapien
ttattaaaaatgttataagagacaaycatcaatatagatgaatatattgc

SEQ ID NO: 63599 - DNA, 50 bp, homo sapien
cctacctgtacccttttcggcttcamaaactcctcagaaatgcactcacc

SEQ ID NO: 63600 - DNA, 50 bp, homo sapien
catccttctccatgccctgggaaacygacttttatagactgcaaaagtat

SEQ ID NO: 63601 - DNA, 50 bp, homo sapien
aatggtacatatggaatacttagaaracttaattactttcctctacataa

SEQ ID NO: 63602 - DNA, 50 bp, homo sapien
ctgtccctggcaaagatctctagcartctttccctcttacctgggtttta

SEQ ID NO: 63603 - DNA, 50 bp, homo sapien
actttacagaagaggtgatattttayctggacattcaaatacacacagaa

SEQ ID NO: 63604 - DNA, 50 bp, homo sapien
ctgattctcctttaagcttattaaaytccatgacacagtcatcatactta

SEQ ID NO: 63605 - DNA, 50 bp, homo sapien
tgccctaatccagctagctatagaawataaggtcttacaattatagggtc

SEQ ID NO: 63606 - DNA, 50 bp, homo sapien
aaacagtcatgcccatcatcttatcygacttcaccacaacctggttcaaa

SEQ ID NO: 63607 - DNA, 50 bp, homo sapien
tgagacaccgtaactgaagagcaatsagaagtcttagattttatcttaaa

SEQ ID NO: 63608 - DNA, 50 bp, homo sapien
tgcttgagaaagctgatgctaataaygatggagcaaaccaggtggggtcg

SEQ ID NO: 63609 - DNA, 50 bp, homo sapien
aaaattggaccaatatgtcattttakaagaaactttgtaatccacagata

SEQ ID NO: 63610 - DNA, 50 bp, homo sapien
gtgtccatttttagatgtaatcaaaycttatctacctgtttttctattct

SEQ ID NO: 63611 - DNA, 50 bp, homo sapien
caattgtgcatcaaagatgttaatayagagaccattatgtagaaacaaat

SEQ ID NO: 63612 - DNA, 50 bp, homo sapien
ataactttcttcgagttaatacggayatgttctgaaattctaaaattaaa

SEQ ID NO: 63613 - DNA, 50 bp, homo sapien
gcctcttctccaggagaatttgtcasaaacaaacagcagtgactatttaa

SEQ ID NO: 63614 - DNA, 50 bp, homo sapien
ttcaagaaaaagagcaaaaaggttayagaactgagtcaaattcatcaaat

SEQ ID NO: 63615 - DNA, 50 bp, homo sapien
catagcccagagccaatctgtgcaayaggatatgtccttcagtgtatagc

SEQ ID NO: 63616 - DNA, 50 bp, homo sapien
cttctctgatctatataactagactwagccttttatatgcagttttccct

SEQ ID NO: 63617 - DNA, 50 bp, homo sapien
aagaaaactaaacacactataagcaktgcaaaaatacaaaagatgtataa

SEQ ID NO: 63618 - DNA, 50 bp, homo sapien
atcagaacagcagtgttgtttagcakaaaagttaaaagcttcaaaggaat

SEQ ID NO: 63619 - DNA, 50 bp, homo sapien
aattaatttttaagctagtctcaaarcacctaagagaagatagattaaag

SEQ ID NO: 63620 - DNA, 50 bp, homo sapien
ttactttctatagtaagtctgggcayattacagaatttgggggagattac

SEQ ID NO: 63621 - DNA, 50 bp, homo sapien
tctagcatccatcgtattattttatkaggaaattcattcatgatatgctg

SEQ ID NO: 63622 - DNA, 50 bp, homo sapien
cacatgtcctcagaattaagtgtgayggcatgttgtaaacttggtaaaaa

SEQ ID NO: 63623 - DNA, 50 bp, homo sapien
tgcaaattttatctcaatatagagawgagttttttaacagagctatcctg

SEQ ID NO: 63624 - DNA, 50 bp, homo sapien
tccaaatcctgtgttctcaataaagyccaattcctgtcaggatagctctg

SEQ ID NO: 63625 - DNA, 50 bp, homo sapien
aagaagaaatatcaaagtgctttacraaaaaatatcataatcatgaaatc

SEQ ID NO: 63626 - DNA, 50 bp, homo sapien
atctagaacacacttacagaatagamatttatagaattactcattgactg

SEQ ID NO: 63627 - DNA, 50 bp, homo sapien
tgtttgaatgtttcctaggtgccaartattctgctatgcattttaacata

SEQ ID NO: 63628 - DNA, 50 bp, homo sapien
ctggggaaggagaaagtaaatcatayctagtttatccattattctgaata

SEQ ID NO: 63629 - DNA, 50 bp, homo sapien
aagatataaagcaataataaaaccakagtacacatttcttttggcacctt

SEQ ID NO: 63630 - DNA, 50 bp, homo sapien
aaatttttctcacttaactatgttckattcatctgcacttccaaaatgtt

SEQ ID NO: 63631 - DNA, 50 bp, homo sapien
ttaaatttcatctggtgtttaaataktatgatttatttgtgagaaagttt

SEQ ID NO: 63632 - DNA, 50 bp, homo sapien
tgaaagacatgcattcaattcaatayaagtagaatctgagaatacagtaa

SEQ ID NO: 63633 - DNA, 50 bp, homo sapien
tgtaggaaacaaactacaacgggaayaaagatccatgacaaaagtcaaat

SEQ ID NO: 63634 - DNA, 50 bp, homo sapien
ggtcctcaggttgaaggccttgaaaragagggaaagaggtcctctagcaa

SEQ ID NO: 63635 - DNA, 50 bp, homo sapien
acattaggtaggaatattgatggtamgatatcctgtatatggcctcatca

SEQ ID NO: 63636 - DNA, 50 bp, homo sapien
aaagtgttcttcacatacttacaaaytgacatctaaacagtcggggtttt

SEQ ID NO: 63637 - DNA, 50 bp, homo sapien
ttgaatgtcacagaaataatgcacaytccataatctcaaacataacccat

SEQ ID NO: 63638 - DNA, 50 bp, homo sapien
aaaagccatcaaatgaaaaaaatgargcaggaactggctaaattagcaaa

SEQ ID NO: 63639 - DNA, 50 bp, homo sapien
gaatggggagttgctattcaataggyataaaatttcagttatgcaagatg

SEQ ID NO: 63640 - DNA, 50 bp, homo sapien
atccacataatttctttgctgaagcrccttttgaaatattttcttaaaaa

SEQ ID NO: 63641 - DNA, 50 bp, homo sapien
agaagtgtcaataaatcattagagcrgacattcagtgtttccagtaaata

SEQ ID NO: 63642 - DNA, 50 bp, homo sapien
ccttcgatacattataaaccctccaygaatgacgcttccctctaaccctt

SEQ ID NO: 63643 - DNA, 50 bp, homo sapien
ttattttttataagacacattaaggragactgattttgtataaaaatgtc

SEQ ID NO: 63644 - DNA, 50 bp, homo sapien
ctggaagatctagccttaactttacygctgtcttggtaggtaactctgga

SEQ ID NO: 63645 - DNA, 50 bp, homo sapien
taaataagcacttgaagtgatagtayctgagtgtccgtaggcaaatgtta

SEQ ID NO: 63646 - DNA, 50 bp, homo sapien
acatctaacgtcctggaccctatcaratttaacatttattcagtgcacat

SEQ ID NO: 63647 - DNA, 50 bp, homo sapien
atagcattgatgttgatacgagacastgatatgagacttggcacatcact

SEQ ID NO: 63648 - DNA, 50 bp, homo sapien
atcattctggtccttggtaggaatayagtcacttagaacactgggaaaat

SEQ ID NO: 63649 - DNA, 50 bp, homo sapien
gctggtacagcaagccttcactcacrctcttctgtccaattgttttaaac

SEQ ID NO: 63650 - DNA, 50 bp, homo sapien
taaatctattctttaacctctcctgmaaccaaatgtagccaattaaaaat

SEQ ID NO: 63651 - DNA, 50 bp, homo sapien
ttcataatacttgcctatcagaggtyaaaatttccagatattcagttcta

SEQ ID NO: 63652 - DNA, 50 bp, homo sapien
aggtacggattaatgtattagtttcratctgcaagaagatgtctagttat

SEQ ID NO: 63653 - DNA, 50 bp, homo sapien
atcaatgattacctaaggctacggasataaagcctaaagcagaattcaac

SEQ ID NO: 63654 - DNA, 50 bp, homo sapien
ctccagcacctacctcttccacagcmatcaacagggcctatcttcacaag

SEQ ID NO: 63655 - DNA, 50 bp, homo sapien
ttgactgagaactcaacctaacagayagcctcatgcctggtacatagaaa

SEQ ID NO: 63656 - DNA, 50 bp, homo sapien
aaccaaatgtctggggtcctactaayaccatctcctttctttactcacct

SEQ ID NO: 63657 - DNA, 50 bp, homo sapien
ttgtaaggttaatcgtcgtggtgaaygcctatatttaatgtgtcaatgga

SEQ ID NO: 63658 - DNA, 50 bp, homo sapien
gaatgtcaataaagctagccataatyagtatcaaggaatgtctccaagac

SEQ ID NO: 63659 - DNA, 50 bp, homo sapien
tacattttctgagatatgtcccttaygttgatttagcttgtatgatcagt

SEQ ID NO: 63660 - DNA, 50 bp, homo sapien
tcatctagaagcatcttattaaaaakgatcagaatttaatacagcaggat

SEQ ID NO: 63661 - DNA, 50 bp, homo sapien
aaaacccctcatttgtgtaccgtggraatgtgatttagacatttcggtct

SEQ ID NO: 63662 - DNA, 50 bp, homo sapien
ggcccctctctcagaatccttccatraagctgttcccaacatgtcattaa

SEQ ID NO: 63663 - DNA, 50 bp, homo sapien
tgtaaacatctagacacacaatgtaygctaaatgtactactttaatttct

SEQ ID NO: 63664 - DNA, 50 bp, homo sapien
tacatttatatatgacgatatatgasccttgaggatggcatgtggaggac

SEQ ID NO: 63665 - DNA, 50 bp, homo sapien
cggggtctggacccaggactcgatayctttgtggactttctgatttttga

SEQ ID NO: 63666 - DNA, 50 bp, homo sapien
agcctcctcaacaaaagttcaagaaygagaagagcatatttctgaaaagg

SEQ ID NO: 63667 - DNA, 50 bp, homo sapien
gtttataacactcttggattagaaakttagagccatgggagcttccaagg

SEQ ID NO: 63668 - DNA, 50 bp, homo sapien
tctactttggagctctcgcatctcayaagaaagctgcccctcactgctgg

SEQ ID NO: 63669 - DNA, 50 bp, homo sapien
ctcccaattcctggaacataacaatraacaaaggagaaacaaggaattac

SEQ ID NO: 63670 - DNA, 50 bp, homo sapien
gctcaggataagttagtttgaaataratcttagagaagtaaatgcaagac

SEQ ID NO: 63671 - DNA, 50 bp, homo sapien
tacctggctcagggtccctcactccrcataggtggccaaggtgtggggga

SEQ ID NO: 63672 - DNA, 50 bp, homo sapien
aaattcatttgttagcagtatgacaytggaaaatataatgcaacttcttt

SEQ ID NO: 63673 - DNA, 50 bp, homo sapien
agataatcccagcccttagcatcaastcatcttcagtctttgagtccttc

SEQ ID NO: 63674 - DNA, 50 bp, homo sapien
taaaagagacagtagaaattgaagamaacgataaaatttaagaagaacga

SEQ ID NO: 63675 - DNA, 50 bp, homo sapien
gttaaaaggagaacaactatgatgcytcagcggtgaccattcctggagga

SEQ ID NO: 63676 - DNA, 50 bp, homo sapien
gtatgtgttaaacatacattatgaamcacaggcttctaatgaaaatcagc

SEQ ID NO: 63677 - DNA, 50 bp, homo sapien
aatgaaaatcagcagtctctaaatarcttcaccagaacccaatccaacca

SEQ ID NO: 63678 - DNA, 50 bp, homo sapien
gctgaattctgggggaatgttgccartatcgttgtttcaaatgagataat

SEQ ID NO: 63679 - DNA, 50 bp, homo sapien
ttcaactatgttagctgttcctttgyttggctacgtccatgtgtctgatt

SEQ ID NO: 63680 - DNA, 50 bp, homo sapien
taggactcacatccagagagtagtaygtaatagttggtatctgacactgt

SEQ ID NO: 63681 - DNA, 50 bp, homo sapien
tatgtttacttcaagtgggcattccyagttatttttaagctgaaatgtga

SEQ ID NO: 63682 - DNA, 50 bp, homo sapien
caaaggatgcataaattacacctacragtcatattccattgcagatgaat

SEQ ID NO: 63683 - DNA, 50 bp, homo sapien
acttgagtgagtatgtcatggcatcrcagaatatgagtttgggaataact

SEQ ID NO: 63684 - DNA, 50 bp, homo sapien
ttctgtatgtcacatatactttttayatcctaatatgtggctttattttc

SEQ ID NO: 63685 - DNA, 50 bp, homo sapien
atatcaatttgcactgaggggaaacyggaatcatatcctaactatgcagc

SEQ ID NO: 63686 - DNA, 50 bp, homo sapien
tcttaaataaatcaggagttaacgcygattgtgatgagaactcaggagaa

SEQ ID NO: 63687 - DNA, 50 bp, homo sapien
ttgctcctcagaacaagtctcaagarcatttattagtttgaaccatgtga

SEQ ID NO: 63688 - DNA, 50 bp, homo sapien
tgggagtcctctgagctcttatgcayggtggaaaaagcatgagatttgac

SEQ ID NO: 63689 - DNA, 50 bp, homo sapien
atcaagaaaatattgcaatgaccatsagcaaaaggtttagaaaaaaaatt

SEQ ID NO: 63690 - DNA, 50 bp, homo sapien
ggacaggaccctgtaggaatcttctygctgaggttagttaaaccactggt

SEQ ID NO: 63691 - DNA, 50 bp, homo sapien
ttggctgctcctcttctgctggaaaractcaaagccatccatctagagac

SEQ ID NO: 63692 - DNA, 50 bp, homo sapien
tgataatctaaaactctatgtttaayatactgcccttcttaataggaatg

SEQ ID NO: 63693 - DNA, 50 bp, homo sapien
gtctgtcctgatacttccaatgtaartgtggaaaaactcaagtttcataa

SEQ ID NO: 63694 - DNA, 50 bp, homo sapien
tcaggcacaactccaagacgagacaytggagaagaaccaagctaggcctg

SEQ ID NO: 63695 - DNA, 50 bp, homo sapien
catctcccacaatgactctggtaccygcacttaagatgccgcatgtggct

SEQ ID NO: 63696 - DNA, 50 bp, homo sapien
cactcacctagacagggaaaatactrtaacacaatgataaggaagaaagt

SEQ ID NO: 63697 - DNA, 50 bp, homo sapien
tctgctctgcaccatcagtgataacrttgaaagttgacaagcattctgta

SEQ ID NO: 63698 - DNA, 50 bp, homo sapien
gaacttcccagccggcagaatagtgmgcgaaaataaatgtcttttcttta

SEQ ID NO: 63699 - DNA, 50 bp, homo sapien
atacaggttagcaagtctttaagtaycccagattgaatagtgcttatcta

SEQ ID NO: 63700 - DNA, 50 bp, homo sapien
gaagtctgcactcagattgccttagragacttttaaagttctagttcctc

SEQ ID NO: 63701 - DNA, 50 bp, homo sapien
acacgtgggaatggtttcacttgcckcaactcgcccaggcgctgcccgca

SEQ ID NO: 63702 - DNA, 50 bp, homo sapien
cactctccctcaagtcactcttacamattatagcttcaagaagataaaga

SEQ ID NO: 63703 - DNA, 50 bp, homo sapien
tcatctcttcctgtttcaggccaatratcagttgcaaaaactaccttgct

SEQ ID NO: 63704 - DNA, 50 bp, homo sapien
cagaaaaataccatggaacaatgttyaagattaaatacttgacaccaatg

SEQ ID NO: 63705 - DNA, 50 bp, homo sapien
ggctgacatcccaggaaaggcagcarattagatgagcacaggagcagaga

SEQ ID NO: 63706 - DNA, 50 bp, homo sapien
tgcttagaaaagctccataggtatgyaataaaggaaaaaaaaaaggcagg

SEQ ID NO: 63707 - DNA, 50 bp, homo sapien
ttctcattaatcaatgttgagtaaayaaaagaataccattaattttatgt

SEQ ID NO: 63708 - DNA, 50 bp, homo sapien
gcttacaaaattctttgctgatacartctatgttccatttacattgtaat

SEQ ID NO: 63709 - DNA, 50 bp, homo sapien
atcagtttgtattgactgcagtttayacttttctctgaagtgagatgtaa

SEQ ID NO: 63710 - DNA, 50 bp, homo sapien
ataatgtatttgagatgaacaatgamtaatttttaaatatgtccacataa

SEQ ID NO: 63711 - DNA, 50 bp, homo sapien
ctattcagaaataaaaaagacccaaytaccaacacacacagccacagggg

SEQ ID NO: 63712 - DNA, 50 bp, homo sapien
ccagattctgggtttaaagatgagaragtattacagggtttccataaacc

SEQ ID NO: 63713 - DNA, 50 bp, homo sapien
caaggtattttaacattgctgtcatkaaaagtagtataaattatgatacg

SEQ ID NO: 63714 - DNA, 50 bp, homo sapien
ccctggggtgggcatacaaatcacaratgaatggattaacaatactattc

SEQ ID NO: 63715 - DNA, 50 bp, homo sapien
gtgttgctttagaatctacagctcaygtatgtagtagattgcttacgtgg

SEQ ID NO: 63716 - DNA, 50 bp, homo sapien
tggttatcttaataagaaatcctacraataattagcgtggtagtaaaagc

SEQ ID NO: 63717 - DNA, 50 bp, homo sapien
tccccttttccctcagcctctgacckaaagacctcatctttgcaggagcc

SEQ ID NO: 63718 - DNA, 50 bp, homo sapien
gacatctgactaatccagaaagagasctgaaggtgggagagaccctgcca

SEQ ID NO: 63719 - DNA, 50 bp, homo sapien
atatgtgcatgcgctcacacatacawgcataaatattttgggctctgttt

SEQ ID NO: 63720 - DNA, 50 bp, homo sapien
ccacagatgatactccatgctagggmattaactacttgttgaaaagcact

SEQ ID NO: 63721 - DNA, 50 bp, homo sapien
gttcagtaaaggtcctagtagaaggygcttaccatatttcagcagaatgc

SEQ ID NO: 63722 - DNA, 50 bp, homo sapien
caaataaagccattctcctgtataayaaccccaatgccatcatcatacct

SEQ ID NO: 63723 - DNA, 50 bp, homo sapien
ctacactgatctgggagaaaattaaygaagtagcatcagtaatgtatata

SEQ ID NO: 63724 - DNA, 50 bp, homo sapien
ggccatgatatcttggaaaagtctcyaccatatttgatgctccatgcccc

SEQ ID NO: 63725 - DNA, 50 bp, homo sapien
gtcaaatgctttgaaaaagacttaayactctctcatttcatagcatactg

SEQ ID NO: 63726 - DNA, 50 bp, homo sapien
ggattgacctggctagcagatcagayagggagaaaatgaacacctgaaac

SEQ ID NO: 63727 - DNA, 50 bp, homo sapien
gtttgtggtaatgaaaagtacataaytgagtattctccccctccaaaatc

SEQ ID NO: 63728 - DNA, 50 bp, homo sapien
ccacgacccaaagagcctcacagaayagatttcggaaagtacgtgtgcgt

SEQ ID NO: 63729 - DNA, 50 bp, homo sapien
tttcatttttatgttttttatttgcragatttccagtcagcatttctgtg

SEQ ID NO: 63730 - DNA, 50 bp, homo sapien
gaagtggtgtgcagcacagtatacargcatatcactgctggtttccaatt

SEQ ID NO: 63731 - DNA, 50 bp, homo sapien
agaggagaaggaacgagcaatgagayagataatataaactgtgagtgctg

SEQ ID NO: 63732 - DNA, 50 bp, homo sapien
atgttacacaaaataaaaatgaagarcatctgataaacttgtatacaaac

SEQ ID NO: 63733 - DNA, 50 bp, homo sapien
ttgacagactttatctttgaaaatgycctcagctgtgccaaaaagaataa

SEQ ID NO: 63734 - DNA, 50 bp, homo sapien
tacacacaattatttctttcttggaygtgagctaatttctattggacatt

SEQ ID NO: 63735 - DNA, 50 bp, homo sapien
aggccaagagcaacaatttcaggtargcaccctccatgaatggctgccaa

SEQ ID NO: 63736 - DNA, 50 bp, homo sapien
ttaagaatagagtttccatttaaaarcaccaaggcagttgtcagaacagg

SEQ ID NO: 63737 - DNA, 50 bp, homo sapien
gggatatttcaaatgccgccatggarattacctttgctataactgttcgg

SEQ ID NO: 63738 - DNA, 50 bp, homo sapien
ttgttcccaaaagcaaagttgtggasaagataaagtagtaagataatctt

SEQ ID NO: 63739 - DNA, 50 bp, homo sapien
ccccatgatcttctctcattaaacayttatttctggcaattaaacttatt

SEQ ID NO: 63740 - DNA, 50 bp, homo sapien
ctgcagttctggctatttccaaaccrcctgctactataggtaatagcaga

SEQ ID NO: 63741 - DNA, 50 bp, homo sapien
aaaattatctttcttcaaacttctaygcttctttatttgacaataagaat

SEQ ID NO: 63742 - DNA, 50 bp, homo sapien
agccaagcaatttgttgtgaaagaaygtaagaaatactgagaatgagaaa

SEQ ID NO: 63743 - DNA, 50 bp, homo sapien
ctgaagtaattagaacacatacaacraccttttcatgatggatcttccaa

SEQ ID NO: 63744 - DNA, 50 bp, homo sapien
cgtagatataaatgttgaggcttaayggcattgacactgaataaccctgg

SEQ ID NO: 63745 - DNA, 50 bp, homo sapien
atatccatgattcactgtaacaaaaytgaagggttaggaagccagagaga

SEQ ID NO: 63746 - DNA, 50 bp, homo sapien
tatttggggcctgtttgtgtattcaygtggagagagttagcattcttggt

SEQ ID NO: 63747 - DNA, 50 bp, homo sapien
atatgccttttttggcaaagcacctrtttgaatcttttgcctagttttac

SEQ ID NO: 63748 - DNA, 50 bp, homo sapien
taatcttggagaactgaatcatggayagccccaagtgttctagtgcttcc

SEQ ID NO: 63749 - DNA, 50 bp, homo sapien
ctgaccacatgcacataattctccakgtttcagtcactaactttgtaagg

SEQ ID NO: 63750 - DNA, 50 bp, homo sapien
tttctccaggccagaactggttgtaygtctatcttaccatattgctacct

SEQ ID NO: 63751 - DNA, 50 bp, homo sapien
aaatactgagttacacttaataagcrcatttctctttgttatatcagcta

SEQ ID NO: 63752 - DNA, 50 bp, homo sapien
aggtcattctaaaagggaaacccaamtgagaatgaagagtgtctcagggc

SEQ ID NO: 63753 - DNA, 50 bp, homo sapien
aagaaagtccctatgtacggtgttcrtcaattcctatggtataaatattc

SEQ ID NO: 63754 - DNA, 50 bp, homo sapien
atgtactgatggttatgctaattacyaaagactgtcaaatcaggacccaa

SEQ ID NO: 63755 - DNA, 50 bp, homo sapien
gatgtgaagaaatggaacccttgcayagtgttagtgggcatgcaaaactg

SEQ ID NO: 63756 - DNA, 50 bp, homo sapien
taatgtgcgtaaaacaacttaaaaamtacacaagatatcacctaaaaata

SEQ ID NO: 63757 - DNA, 50 bp, homo sapien
aaatcaaaagggaggaaatatcgcckgccccagtcttaagtgattcccat

SEQ ID NO: 63758 - DNA, 50 bp, homo sapien
ctcagagaatgtacatatctctacaygactgactttagattgggagggtg

SEQ ID NO: 63759 - DNA, 50 bp, homo sapien
aacatgagatttacttatctgatctrtacgtaaccaatctctcgttctgg

SEQ ID NO: 63760 - DNA, 50 bp, homo sapien
ctgctgttaaaccatgtgtcccttaycaagaatgtgccgtcagcttttgg

SEQ ID NO: 63761 - DNA, 50 bp, homo sapien
attagagaaatgctattggataggcmaggtaccatgatttgacaatgttt

SEQ ID NO: 63762 - DNA, 50 bp, homo sapien
gaatagaaaatttacagttagtttcraaggaagattttcttttttacagc

SEQ ID NO: 63763 - DNA, 50 bp, homo sapien
gttctgaagctttaccaggtcaaacyggagaagaacccaacaagtaactc

SEQ ID NO: 63764 - DNA, 50 bp, homo sapien
agggaaaccgagtttgaatcacttcragttcaacagttttccagcacgtg

SEQ ID NO: 63765 - DNA, 50 bp, homo sapien
gttccctgaaagcagctactatctgktttttgtctcagttctatcccagc

SEQ ID NO: 63766 - DNA, 50 bp, homo sapien
aagctgtctctgaatttgatgaggtkgtagagttggatcctttggcattg

SEQ ID NO: 63767 - DNA, 50 bp, homo sapien
ctgttgtgcctgacaggcaccatctyggttagctgtgggaccactggtgt

SEQ ID NO: 63768 - DNA, 50 bp, homo sapien
agtaatctctagagcctgaggactaygctcgattcctgtgttcttggaaa

SEQ ID NO: 63769 - DNA, 50 bp, homo sapien
aaaaactaggtaaaggctggtagttraactaagtctgtttggctccaaag

SEQ ID NO: 63770 - DNA, 50 bp, homo sapien
caatcagtattatcatctgaatttayaagccgcacattggtaaaggtaga

SEQ ID NO: 63771 - DNA, 50 bp, homo sapien
atgcagtagcccaaaccatggggtcmaattatgcagatatttaaatcttc

SEQ ID NO: 63772 - DNA, 50 bp, homo sapien
gctaattgttaaggcgacatttgtarattaatctctgacttgagctaagt

SEQ ID NO: 63773 - DNA, 50 bp, homo sapien
aatatttctaagagccagctttcccractcaatcacctctatactcacat

SEQ ID NO: 63774 - DNA, 50 bp, homo sapien
tgcttacttgaagcaagtccaagttraatacatgttactgtttttaaaag

SEQ ID NO: 63775 - DNA, 50 bp, homo sapien
catgatcctggtactgagaatgaaartcatagatgaacagccttgaaaca

SEQ ID NO: 63776 - DNA, 50 bp, homo sapien
aataagatgcctaggctacagtttaycatagcaacagtgctaaaaataag

SEQ ID NO: 63777 - DNA, 50 bp, homo sapien
tgaatttttgtatctctaccttacarcttcagaccacagggagttaaaat

SEQ ID NO: 63778 - DNA, 50 bp, homo sapien
aagtggtgcctgaagagaggctcacrtcaagtggaagtcttcaccgaacc

SEQ ID NO: 63779 - DNA, 50 bp, homo sapien
aagttcaattattattgagccatcaygaaattgtgtttacagaatcacac

SEQ ID NO: 63780 - DNA, 50 bp, homo sapien
attttcttttcttatatactcaatcycacttttgtaattggagttgttcc

SEQ ID NO: 63781 - DNA, 50 bp, homo sapien
ggagcagagatacttaaaaagaatcmcatgagtgaagcaaagtcaagcca

SEQ ID NO: 63782 - DNA, 50 bp, homo sapien
ctaagtaccccggagaagacttgatragggaaaccaggtgtgtgccggga

SEQ ID NO: 63783 - DNA, 50 bp, homo sapien
agaacgctctgggcctttcctaagaygagaaggctgtgaaagcagggatg

SEQ ID NO: 63784 - DNA, 50 bp, homo sapien
accaaagctcacaaaatctgctgtayccaggaattccaacctacatgtga

SEQ ID NO: 63785 - DNA, 50 bp, homo sapien
atgattcagacttctacccagtaggrcaatatttcagcagggttatgcat

SEQ ID NO: 63786 - DNA, 50 bp, homo sapien
agaatggggaacttacttgattcaaytgataactaattatagagcaccta

SEQ ID NO: 63787 - DNA, 50 bp, homo sapien
attcctgagctggtagatttatacaytgaatttctcagagaaagtggtat

SEQ ID NO: 63788 - DNA, 50 bp, homo sapien
actgcctctcctagctggttcctcayaggttacagtttggaagcctccca

SEQ ID NO: 63789 - DNA, 50 bp, homo sapien
gatcctacctgtgatctagtggaackaatagacatttctggcttgtggtt

SEQ ID NO: 63790 - DNA, 50 bp, homo sapien
ttccaggatcattaggtccatgtctyaatacagcaacacaattttacatt

SEQ ID NO: 63791 - DNA, 50 bp, homo sapien
actccatactggagagaaacttttcraatgtaaagaatgtggcaaggcct

SEQ ID NO: 63792 - DNA, 50 bp, homo sapien
agaagcattcatggatttcccctgcratgagtagattataacccctggga

SEQ ID NO: 63793 - DNA, 50 bp, homo sapien
tgggcatggaggctgataggcaaaasattgttaaaccagaagtactgatt

SEQ ID NO: 63794 - DNA, 50 bp, homo sapien
tggccttgagctggaaggaagagtcraaaaagtagagggagaggcatggc

SEQ ID NO: 63795 - DNA, 50 bp, homo sapien
cctgtacaaatgtgaattctacttcwaagagctaccagataaagaacggc

SEQ ID NO: 63796 - DNA, 50 bp, homo sapien
gcagaagaataatttaactcacaaartagcctgcatggacagagccctta

SEQ ID NO: 63797 - DNA, 50 bp, homo sapien
atcaatagaattttgttcaaataaawtagactatagactaaaaacaattt

SEQ ID NO: 63798 - DNA, 50 bp, homo sapien
ttctaagcacctgtatctttagtagragtgctgccacttccatccttgat

SEQ ID NO: 63799 - DNA, 50 bp, homo sapien
ttcctatgggtacctgattcagagayaaccactgataatcaattcgtgca

SEQ ID NO: 63800 - DNA, 50 bp, homo sapien
cagattcaagcaaccaggatcaaaartattcaggaaaggctgggcgcagc

SEQ ID NO: 63801 - DNA, 50 bp, homo sapien
gaaaacaccccagtggaaactgcatraatgattgataagagctgagagct

SEQ ID NO: 63802 - DNA, 50 bp, homo sapien
acttaatacaccaggcaactctaaaytacatgtgtatacacatatataca

SEQ ID NO: 63803 - DNA, 50 bp, homo sapien
gaagaagtttgatgattatgaacacyattgagggtcaccataaattcgcc

SEQ ID NO: 63804 - DNA, 50 bp, homo sapien
caaggttgccatgataatgtacctartaactctccttgggcaaaaaggca

SEQ ID NO: 63805 - DNA, 50 bp, homo sapien
agttaaataaaaatagtgggaaaacsatctcaacacaccccactctagaa

SEQ ID NO: 63806 - DNA, 50 bp, homo sapien
aagtccccctctttcagtgtcttcckcgttctatatggcacccccaccta

SEQ ID NO: 63807 - DNA, 50 bp, homo sapien
tggaagatcattttgcaccaacgtaracgtgtaacagccagactcaaggg

SEQ ID NO: 63808 - DNA, 50 bp, homo sapien
caggagggaaggatgtctgcgggcaygacccaggaatctgagagaccctc

SEQ ID NO: 63809 - DNA, 50 bp, homo sapien
tgttttgcataaagactttcagacgsagtttaaatgaaaaaccccagctc

SEQ ID NO: 63810 - DNA, 50 bp, homo sapien
gtaaagtctacacctgccattagtaygtaagaagagagaggtcaaagggg

SEQ ID NO: 63811 - DNA, 50 bp, homo sapien
ttgagggtgaacttctcttacttaargtcaaccaattgtagatgttaacc

SEQ ID NO: 63812 - DNA, 50 bp, homo sapien
accaaccaagtatctgctgtattcartagactcacctgacacataaagac

SEQ ID NO: 63813 - DNA, 50 bp, homo sapien
gccagctgactggaaattcaggcagragttggtactgtatccttgaggca

SEQ ID NO: 63814 - DNA, 50 bp, homo sapien
ttaagctaaaggggcggaagaagatrtggacacaaaagcaagcaggagta

SEQ ID NO: 63815 - DNA, 50 bp, homo sapien
tgaacaaagggactgtgttcataacygccggtagttcctccaggggctag

SEQ ID NO: 63816 - DNA, 50 bp, homo sapien
tgttctagatgatattacttggaacrcaatgcaaggagatgttgtctcac

SEQ ID NO: 63817 - DNA, 50 bp, homo sapien
tccagctctaaaacactaactctgaygaggaatgaaatatattttctggc

SEQ ID NO: 63818 - DNA, 50 bp, homo sapien
catcttactcttctgtgtgagaaaaraggcttataatgaaagcagagaac

SEQ ID NO: 63819 - DNA, 50 bp, homo sapien
caccaatataatgtcatgtcagagtmaaaagaataaaggtgtgttgtatc

SEQ ID NO: 63820 - DNA, 50 bp, homo sapien
gtgccccaaatagccaagcatatctraatcaaattcgaatttcttgttgc

SEQ ID NO: 63821 - DNA, 50 bp, homo sapien
tggaaagcaatggcactaggttgcayatacagcctctaacaagcaagctc

SEQ ID NO: 63822 - DNA, 50 bp, homo sapien
ctatttatagataagggaattgcagwcaaattggttaaataacttgttca

SEQ ID NO: 63823 - DNA, 50 bp, homo sapien
atttccctccactgaacttagaaaakactcttcaaaagataatggtgtta

SEQ ID NO: 63824 - DNA, 50 bp, homo sapien
cctcctgtcatgtgtccttgccttamactatcgtctgcagagctgaacaa

SEQ ID NO: 63825 - DNA, 50 bp, homo sapien
ttatcttccatgtctttgcctagtckcagacctcattacttttcacttaa

SEQ ID NO: 63826 - DNA, 50 bp, homo sapien
tgctattatacattcatagattataracaaactcttatatttctattgca

SEQ ID NO: 63827 - DNA, 50 bp, homo sapien
gttggtatttttatttcagccattayaataggtgtgttcacatctcatca

SEQ ID NO: 63828 - DNA, 50 bp, homo sapien
tctgaggagcagcctaagcaaatgayctctccttaacctcagttgaaacc

SEQ ID NO: 63829 - DNA, 50 bp, homo sapien
ggtcctgaagcccaggaatgatcacyggcggaatttttggtactaccata

SEQ ID NO: 63830 - DNA, 50 bp, homo sapien
cattttaacatgtgcttcagaaaacrggaaaggtaaaagtcacttccaaa

SEQ ID NO: 63831 - DNA, 50 bp, homo sapien
taaaaagtgctaggcaaaaataacaygaattggttgtgagtaattagtct

SEQ ID NO: 63832 - DNA, 50 bp, homo sapien
acaaggtacctagcacaacatctacrcataacaggagcacaatttgtgct

SEQ ID NO: 63833 - DNA, 50 bp, homo sapien
atgaaaaatatattcaaaaaactaayagtagatggaaatgtcacaaacct

SEQ ID NO: 63834 - DNA, 50 bp, homo sapien
agggaggaggcacaaattactgctawtaagaatggcaagggtagcattta

SEQ ID NO: 63835 - DNA, 50 bp, homo sapien
agggacagccgcattaactttagaayctgctaagtgtacatattaaatcg

SEQ ID NO: 63836 - DNA, 50 bp, homo sapien
tagcctttcttcaaaaaccaaggcamtcaggagacattaagatctgagtt

SEQ ID NO: 63837 - DNA, 50 bp, homo sapien
aaatttgtcacacagcattaagtaamtattgtaggcttcttccaggtcca

SEQ ID NO: 63838 - DNA, 50 bp, homo sapien
gggttaataatacctacatcatagargttatagtgtattaaaaatagcac

SEQ ID NO: 63839 - DNA, 50 bp, homo sapien
tccctctgccgacctgggcaattcarcctattggtgtggagggtctgtgt

SEQ ID NO: 63840 - DNA, 50 bp, homo sapien
tatgaaaaactgccctgaagctagartcaagaaaattaagtttaaaactg

SEQ ID NO: 63841 - DNA, 50 bp, homo sapien
  misc_feature (2)..(2): n is a, c, g, or t
cntgtgcagtaggagctttgtgatcygcttggctgacctggagctgatgt

SEQ ID NO: 63842 - DNA, 50 bp, homo sapien
aatcctgttttaggtgatcttaacayacacactaactggctgcttgcatc

SEQ ID NO: 63843 - DNA, 50 bp, homo sapien
ggggcagaggcaagacattccccacrcctctctgggctagcctcagcatg

SEQ ID NO: 63844 - DNA, 50 bp, homo sapien
aagggaatcaagctggaagtttgtarcccaaatattcattctcatctaca

SEQ ID NO: 63845 - DNA, 50 bp, homo sapien
gtctgttccctgcctctccagaatcractgtgtcccatcttcttggtcag

SEQ ID NO: 63846 - DNA, 50 bp, homo sapien
cgtgaaaggtgttaagaaaatcatcrctgaaatatggtttccaaaaattg

SEQ ID NO: 63847 - DNA, 50 bp, homo sapien
tctcaaatgactttccatctattaarctattttccaccatttcccttggc

SEQ ID NO: 63848 - DNA, 50 bp, homo sapien
tgcactcaggaaggacattactaagyactcaggactctggctgcattttc

SEQ ID NO: 63849 - DNA, 50 bp, homo sapien
accggtgttggactgcccaggtttaragtttctcaggcttgtgcgtgctc

SEQ ID NO: 63850 - DNA, 50 bp, homo sapien
cactgtctagaattttgctggtcacyatgacagaggaaaaagataacctg

SEQ ID NO: 63851 - DNA, 50 bp, homo sapien
gtagagagagtctaggtttgtctaayacacttcaaatttttgtctctttt

SEQ ID NO: 63852 - DNA, 50 bp, homo sapien
atttaaatctaagattacctggaaaytaagcaggagaaagaaaaaagcag

SEQ ID NO: 63853 - DNA, 50 bp, homo sapien
tgaccttatttactgaaaccaaagcratgtcagacgatgtaaacttctga

SEQ ID NO: 63854 - DNA, 50 bp, homo sapien
gcagttatagctgactttaagtaaarcagacgataatatgtgtgagcttt

SEQ ID NO: 63855 - DNA, 50 bp, homo sapien
tgctagtactgtaactcttggactcraaggtatcccatgaaaagggccac

SEQ ID NO: 63856 - DNA, 50 bp, homo sapien
cacagagatgaaataacttccttcartccccacagctaataatgacaaaa

SEQ ID NO: 63857 - DNA, 50 bp, homo sapien
ccaggtgtagttagctcaggtgagartaatacatacaggtagcacatatg

SEQ ID NO: 63858 - DNA, 50 bp, homo sapien
ccaattttctagagcttttctctaaygttttactataggtgtttcatagt

SEQ ID NO: 63859 - DNA, 50 bp, homo sapien
acccactttcaccactttaatctacrtaacactggaagtcctatccaaag

SEQ ID NO: 63860 - DNA, 50 bp, homo sapien
aataacttttaaaaatcaagtagaamctctgaagctgaaaaatgtaattg

SEQ ID NO: 63861 - DNA, 50 bp, homo sapien
ttactgggttatttattgaatgtgcygaaaattcaatgagagtagttgga

SEQ ID NO: 63862 - DNA, 50 bp, homo sapien
gaaagactcctgatgaatatagaaaygagcttctggtttgtctccaacaa

SEQ ID NO: 63863 - DNA, 50 bp, homo sapien
agatcgcataatttagtttagaatamagagatcttgtcacctttcctcta

SEQ ID NO: 63864 - DNA, 50 bp, homo sapien
ttaagattaaataaaggactttctastaatcaagagtgattggtttttct

SEQ ID NO: 63865 - DNA, 50 bp, homo sapien
gttaaagcactaatagcatcttccayggaggtatacttcagagtgaatat

SEQ ID NO: 63866 - DNA, 50 bp, homo sapien
acatactagctcatttgatcttcccrataacccattttgtggatgaggaa

SEQ ID NO: 63867 - DNA, 50 bp, homo sapien
ttatacaacaaacacatatgcattaycaagaaaagatgagtttagcaaaa

SEQ ID NO: 63868 - DNA, 50 bp, homo sapien
atgaagcaccaagttttgatcccagyattaagttgcctcttggcacctag

SEQ ID NO: 63869 - DNA, 50 bp, homo sapien
tttgcctgaaagatcaaaattaccaygaagtcaggcagtcctggccagct

SEQ ID NO: 63870 - DNA, 50 bp, homo sapien
aaacctttgaattatcaacattgaawtctttatataaattttggttattt

SEQ ID NO: 63871 - DNA, 50 bp, homo sapien
aatcttggcagattttgcaggaaacygttatgtggccatcactggaaaaa

SEQ ID NO: 63872 - DNA, 50 bp, homo sapien
tttgggaaactttaaagatgacctamaaagattttgcaattttcttctca

SEQ ID NO: 63873 - DNA, 50 bp, homo sapien
gcctcaagagaagttaacaatctcayatccaaaaaggattctccactctt

SEQ ID NO: 63874 - DNA, 50 bp, homo sapien
aagatcctcaaatcaaatgactgtawgaataatttggtgaatcccagtgg

SEQ ID NO: 63875 - DNA, 50 bp, homo sapien
tgtttactataaagaataccaaatasataaaatactgaagtgtacaatat

SEQ ID NO: 63876 - DNA, 50 bp, homo sapien
tggtgatttgtataactgagctttcratttcaaaaattaaaaagttctct

SEQ ID NO: 63877 - DNA, 50 bp, homo sapien
cttaggcagatcattctacatccatragtctcagtatcttaatctggaaa

SEQ ID NO: 63878 - DNA, 50 bp, homo sapien
agagtcttcgtcccacttgagacaakagcctagttctagtccagttccac

SEQ ID NO: 63879 - DNA, 50 bp, homo sapien
tgggattgggcaagcgagccatgtarggcacaatatttgatggggcactt

SEQ ID NO: 63880 - DNA, 50 bp, homo sapien
ttatagaacctacctccctgttgtamagatgagcaaactaagcacagcct

SEQ ID NO: 63881 - DNA, 50 bp, homo sapien
attaaaatgcaggctatcccacacasacaaaacagcctgtcagttaaaac

SEQ ID NO: 63882 - DNA, 50 bp, homo sapien
aacctaaagcatatgtagttaaatayattagaagtcaagccctgattaat

SEQ ID NO: 63883 - DNA, 50 bp, homo sapien
catagatccttgactttgggatctayctgtaaaaatgattattatttttc

SEQ ID NO: 63884 - DNA, 50 bp, homo sapien
atctgattcagatgagactgtgtacrttgaacttctgagctgatgctgga

SEQ ID NO: 63885 - DNA, 50 bp, homo sapien
ctggcctgtctacctgtaggaatcartaagttcttctttcgcttaagcca

SEQ ID NO: 63886 - DNA, 50 bp, homo sapien
cggatggtcctgatcgtgtcactccrgaacatggacgttatcaaggacag

SEQ ID NO: 63887 - DNA, 50 bp, homo sapien
aagtaatgggtcctggcaataactayggattttattttctttgttggtct

SEQ ID NO: 63888 - DNA, 50 bp, homo sapien
tgttctcctggttagacttaaagtaygtattggtggtattttcatccagg

SEQ ID NO: 63889 - DNA, 50 bp, homo sapien
caacaggcaattgagaaaacgtccayattaagtgggtgggaaaagctgac

SEQ ID NO: 63890 - DNA, 50 bp, homo sapien
tcttaaagaatacttaccatggaaaygtactttattaaccacaccctgat

SEQ ID NO: 63891 - DNA, 50 bp, homo sapien
aaatgtctgccaagctttttgttaaytcctcttcactattcctttcttct

SEQ ID NO: 63892 - DNA, 50 bp, homo sapien
caagccagccaaatcaaataattcckactgtcctcaggtttatttcatgc

SEQ ID NO: 63893 - DNA, 50 bp, homo sapien
caccagctgtaaataacagacacacygagagaacatgtcacaaaaccacg

SEQ ID NO: 63894 - DNA, 50 bp, homo sapien
acacaagaagggaagaggtgactaaycctgactgatgggaagcttccaac

SEQ ID NO: 63895 - DNA, 50 bp, homo sapien
ggtggatatctgagtttcttttctcrcacttgaaagtttgagtaaaaaaa

SEQ ID NO: 63896 - DNA, 50 bp, homo sapien
ctccgctactaaaacagtccatgtayccagggagcttgctaatcaatttt

SEQ ID NO: 63897 - DNA, 50 bp, homo sapien
ttttgtagaactatggttgtagctaraacgcctgtattttattttcacac

SEQ ID NO: 63898 - DNA, 50 bp, homo sapien
aatatttccataaagactcgatgaartaaaacaaaacaaaaatttttgat

SEQ ID NO: 63899 - DNA, 50 bp, homo sapien
accatattgggatgctatataaaaaytcaaaacccagacaagactgggaa

SEQ ID NO: 63900 - DNA, 50 bp, homo sapien
actcttctctttagtatttaaaacaytgagaaactttcattatctttccc

SEQ ID NO: 63901 - DNA, 50 bp, homo sapien
tcagatccaggaagcccaaaggagaycaagtaagatgaatataaagaaac

SEQ ID NO: 63902 - DNA, 50 bp, homo sapien
ctttaaatgcttattgctttcatgaygtatcttttcctattcatctactt

SEQ ID NO: 63903 - DNA, 50 bp, homo sapien
atgtgattctgactcagagaaattayatggtgtctggaaagggggcatgt

SEQ ID NO: 63904 - DNA, 50 bp, homo sapien
ataggtgacagccaggtttgcagagrctgcctttccatgtcacgttcacc

SEQ ID NO: 63905 - DNA, 50 bp, homo sapien
catatcccatctcattccaaaaatcrgcttactggtaacttctttcaata

SEQ ID NO: 63906 - DNA, 50 bp, homo sapien
aagcagactccatagaggcgagaatraagtataacaatcataatgtcttg

SEQ ID NO: 63907 - DNA, 50 bp, homo sapien
gcttgagtgctggaccaaagggctgraatcaccaatcaattgaggataaa

SEQ ID NO: 63908 - DNA, 50 bp, homo sapien
gacactgcatgataacttacgaattrtatattgcaagttatggatgataa

SEQ ID NO: 63909 - DNA, 50 bp, homo sapien
aaatattcttaggtccaagatttaarctgtgaattaatgactggaaattt

SEQ ID NO: 63910 - DNA, 50 bp, homo sapien
actcttaaatttatccttcaccaatwaaaaggttaagaattataaatact

SEQ ID NO: 63911 - DNA, 50 bp, homo sapien
aatctagcctgatttttgtggtcaaratcacccttacttatctctgaaaa

SEQ ID NO: 63912 - DNA, 50 bp, homo sapien
ctctgaaaatattacaacaatgggargttaagaagaaagaaatgtcaatg

SEQ ID NO: 63913 - DNA, 50 bp, homo sapien
gctaaggcctcagattaactctaaamagaaattcaattacataaattcat

SEQ ID NO: 63914 - DNA, 50 bp, homo sapien
tttactttgattgtccatcattccartcaacctgcaagagatacatccac

SEQ ID NO: 63915 - DNA, 50 bp, homo sapien
tcctacagaactcctggcaaataccraatgcactaattaaattaataact

SEQ ID NO: 63916 - DNA, 50 bp, homo sapien
aatatcctatcatcatatatgaccasacaattttaagaaagtgaggttga

SEQ ID NO: 63917 - DNA, 50 bp, homo sapien
tcaaagcaacattgatttcttgtaayggccagtattttgtgaaaaataaa

SEQ ID NO: 63918 - DNA, 50 bp, homo sapien
acatttgtactgtaaaagtcagcacwaaaatcaatgagttttaaaggaca

SEQ ID NO: 63919 - DNA, 50 bp, homo sapien
cagccaaaacactgtgagtgaccaawgggtgaaagggtgaaagtgtgaaa

SEQ ID NO: 63920 - DNA, 50 bp, homo sapien
aataggcaaacatgcacataaaaaamattcaacaccactgaccatcagtg

SEQ ID NO: 63921 - DNA, 50 bp, homo sapien
cattggcctaagattggcaataataygtttatcactaggcccatctcatc

SEQ ID NO: 63922 - DNA, 50 bp, homo sapien
aaatgctagttaacagctttgttacragagtagaaggagtaataccagca

SEQ ID NO: 63923 - DNA, 50 bp, homo sapien
taccagcagagaacacataaataagragcaaatttctccacatgaatgat

SEQ ID NO: 63924 - DNA, 50 bp, homo sapien
accattcatacccgcttgcttcttayaataagttctaggccttcaggtgg

SEQ ID NO: 63925 - DNA, 50 bp, homo sapien
tcatggtcagctttcctagatacagkcaaatagtattccaaagtatttat

SEQ ID NO: 63926 - DNA, 50 bp, homo sapien
ctggggacatacataaagtctacackacatcctgaaggatggaacctctt

SEQ ID NO: 63927 - DNA, 50 bp, homo sapien
ttacaatatcctcgtaaggattaaawgagattattatatgtgtggaggtt

SEQ ID NO: 63928 - DNA, 50 bp, homo sapien
gaattcataaagtgttatagacctamatgtaaaatttgaaactataaaac

SEQ ID NO: 63929 - DNA, 50 bp, homo sapien
tgacaccatggcaactagtacagtaraaagaacttgggcttcagagtcag

SEQ ID NO: 63930 - DNA, 50 bp, homo sapien
ttaaaaagcaacactagggccataaytagtattcataaatgtcctcctcc

SEQ ID NO: 63931 - DNA, 50 bp, homo sapien
atacattaggttacaattccacacastaatactcaaattttgtctattcc

SEQ ID NO: 63932 - DNA, 50 bp, homo sapien
aatgatggggcaagtatatgacaacygcgacagcaactcatgttcaaagg

SEQ ID NO: 63933 - DNA, 50 bp, homo sapien
tactgttctcaaaataaatgttatamatagtggcaaagagcacaaattct

SEQ ID NO: 63934 - DNA, 50 bp, homo sapien
agaaagtgctgttattagtagtatayatattatcatcaaattaggcccca

SEQ ID NO: 63935 - DNA, 50 bp, homo sapien
ggaccatttctctctgtatccagccragtagctgtgttgaaggtatcacc

SEQ ID NO: 63936 - DNA, 50 bp, homo sapien
aaaaatgctccaagtaattgatatayagtttacattgcacatataaagca

SEQ ID NO: 63937 - DNA, 50 bp, homo sapien
ctcaaaattttagacgggtgatcaargtaggcagacacacataagtgaag

SEQ ID NO: 63938 - DNA, 50 bp, homo sapien
cttacttaacaaaataaaatactgaygactttatgctaatgccctgcctc

SEQ ID NO: 63939 - DNA, 50 bp, homo sapien
cataaaaatacaggttaattaaacaraaatggtcagtgagggagtgaatg

SEQ ID NO: 63940 - DNA, 50 bp, homo sapien
atctccaaaacggacttaaaatcackctttatgaagcaacacagaaataa

SEQ ID NO: 63941 - DNA, 50 bp, homo sapien
ttcctctctgtctagggttatagaawgattttattttcattttaagataa

SEQ ID NO: 63942 - DNA, 50 bp, homo sapien
tactatttctatccatgtctttaacrgcatctttttgaaaagaggtatag

SEQ ID NO: 63943 - DNA, 50 bp, homo sapien
agtcagctaattttcccatcttagtyaatgatactgccagtcattcaggt

SEQ ID NO: 63944 - DNA, 50 bp, homo sapien
tgtaccgtgtcttaagtgtctgctaygatcttaatatgtctcccaaaatt

SEQ ID NO: 63945 - DNA, 50 bp, homo sapien
ttgaaggaagtagtgatggtggaaamttatgattcaactcatttctagac

SEQ ID NO: 63946 - DNA, 50 bp, homo sapien
tatgagccccactgtggatctgtacrtttccttagggcattggagcttca

SEQ ID NO: 63947 - DNA, 50 bp, homo sapien
tcttttcacctgtaagatgacaaaaraaattactagccccatagaatttt

SEQ ID NO: 63948 - DNA, 50 bp, homo sapien
agctgataccagagattgagagttcrctatccaggggcactgcacagttt

SEQ ID NO: 63949 - DNA, 50 bp, homo sapien
aactattttctttgaagttgtagtcrccagaaatgacctgtctctgactt

SEQ ID NO: 63950 - DNA, 50 bp, homo sapien
caataaagggggcaggtaatctatarcaaagatcagtgattggaagggga

SEQ ID NO: 63951 - DNA, 50 bp, homo sapien
ttgagctagatgattcctgtttagamcctcaaaataattcttgcaagaga

SEQ ID NO: 63952 - DNA, 50 bp, homo sapien
gcacaaggtgtcgaagagcctaacartactcaaaattcacatgataaaat

SEQ ID NO: 63953 - DNA, 50 bp, homo sapien
atgtttctctcctgagctaaaggtayccactgaggaaaggaattttgtgg

SEQ ID NO: 63954 - DNA, 50 bp, homo sapien
aacatcacatttgacaggaataaagmattatgctgatggaggagatggag

SEQ ID NO: 63955 - DNA, 50 bp, homo sapien
ggtgaacttgttgtccaaagctcagmattgcttatctcactgtaaagtcc

SEQ ID NO: 63956 - DNA, 50 bp, homo sapien
aacactgtccaaaaacatgagttaamatagacagcattctactgggcatc

SEQ ID NO: 63957 - DNA, 50 bp, homo sapien
tagctgctaccccagagcagggaaartctcaagcaaacaactgccctgtg

SEQ ID NO: 63958 - DNA, 50 bp, homo sapien
ggtttaaatttcagtaagattttcarggcagaatgagacttccggcaact

SEQ ID NO: 63959 - DNA, 50 bp, homo sapien
cctaccgagccttcctcttgcctctstctgactctccatcctgagggaag

SEQ ID NO: 63960 - DNA, 50 bp, homo sapien
atcaggagctaggccatgagtaaggygacttgactttgaaaggccaggaa

SEQ ID NO: 63961 - DNA, 50 bp, homo sapien
tctgcctagtctacctcctaaacatytcttgaatctatcacttctctcca

SEQ ID NO: 63962 - DNA, 50 bp, homo sapien
cctcagcattctcactatagttctayaactaggaatgattataactctta

SEQ ID NO: 63963 - DNA, 50 bp, homo sapien
ttaccaagcagaacatagaacttagrcattagcattagggttggcattat

SEQ ID NO: 63964 - DNA, 50 bp, homo sapien
gcccagtaattgtcatgtactcttcmagatgagaaaacactggtgaacaa

SEQ ID NO: 63965 - DNA, 50 bp, homo sapien
gatgagaaaacactggtgaacaaaaygatgagaaatccctaccctcatgg

SEQ ID NO: 63966 - DNA, 50 bp, homo sapien
ttttgaaagtgttttcttaatctcawaatagggactgaagaaattacggt

SEQ ID NO: 63967 - DNA, 50 bp, homo sapien
gatataattttccattgtttgtctcyatcataatttccgtaactattccc

SEQ ID NO: 63968 - DNA, 50 bp, homo sapien
ctttatgtgctcataacttatcaaawcacattatcttctacagatatagg

SEQ ID NO: 63969 - DNA, 50 bp, homo sapien
gacaagattgtggggaaacatgaacrgtgcagtttgtttttggcatagca

SEQ ID NO: 63970 - DNA, 50 bp, homo sapien
ggaaatatatgtaaactgtccagcakataaaatacacacaatagatgcta

SEQ ID NO: 63971 - DNA, 50 bp, homo sapien
tttaattcttttggtaattcagaaaytagttgactatattaatgtaggtc

SEQ ID NO: 63972 - DNA, 50 bp, homo sapien
tactattccttcattcacagcccacraaagagtatataaaatttcacaat

SEQ ID NO: 63973 - DNA, 50 bp, homo sapien
taaaaatatcaaggttttaattacayctatcaatatttaacatattgagc

SEQ ID NO: 63974 - DNA, 50 bp, homo sapien
ccgtacttgattttaaaagccttcasgggtgtctatgtgtatatcacact

SEQ ID NO: 63975 - DNA, 50 bp, homo sapien
tgctacaacaaaattagctaaaaccrattatttagacacactgacccact

SEQ ID NO: 63976 - DNA, 50 bp, homo sapien
catcaaaaaagaaagcaaccctcaayggacggctgcagaagacagtaaag

SEQ ID NO: 63977 - DNA, 50 bp, homo sapien
accaagatgctaggatggtagtgctmaccttgaagaagcaatgaaactgg

SEQ ID NO: 63978 - DNA, 50 bp, homo sapien
attaatcttttggcaacatacataaygattcgactcataaagactcaaaa

SEQ ID NO: 63979 - DNA, 50 bp, homo sapien
aaataaacaagataattttagatagycaagagagcaatgaagaaaataaa

SEQ ID NO: 63980 - DNA, 50 bp, homo sapien
cactggccattactgtttgtgggtakcttccccaaggcttctgaagagaa

SEQ ID NO: 63981 - DNA, 50 bp, homo sapien
aagcaatattcaaataaattagtcaytcaatcactaattcatttatttaa

SEQ ID NO: 63982 - DNA, 50 bp, homo sapien
tcccccactgaatttcaatgtgtagycaattttagccccattctggattt

SEQ ID NO: 63983 - DNA, 50 bp, homo sapien
ccacaaatgcaggactgtggcatgaraaacattctgaaaaataacaactc

SEQ ID NO: 63984 - DNA, 50 bp, homo sapien
atgttttccaaaatcagcaaactaamaatggttttataatacaaaaaggt

SEQ ID NO: 63985 - DNA, 50 bp, homo sapien
ttataacatcttacgtcttaaaaacrcatacttcctcaaagtgctatatg

SEQ ID NO: 63986 - DNA, 50 bp, homo sapien
tgagcctgtagctatacattttttaygctctgagaaagatatagttatct

SEQ ID NO: 63987 - DNA, 50 bp, homo sapien
cttcccagagagacgaattcagggawgttgctccacggtggctccgaccc

SEQ ID NO: 63988 - DNA, 50 bp, homo sapien
ccagcctgctgaaaagtaattatacrccaggcccaacaggctcctataga

SEQ ID NO: 63989 - DNA, 50 bp, homo sapien
tttagttctctggaaatatgaagcarataaatagtgtgtgtttgtatata

SEQ ID NO: 63990 - DNA, 50 bp, homo sapien
acaaaagctgcccatatttaatgtakgcaatttgatgagtttagccatgt

SEQ ID NO: 63991 - DNA, 50 bp, homo sapien
attccagtagagtaaattcataacartgtaagcagccttatccagaaaca

SEQ ID NO: 63992 - DNA, 50 bp, homo sapien
ctaggagctgaaatatcgactccaaycagtggatcaggacattacagcct

SEQ ID NO: 63993 - DNA, 50 bp, homo sapien
tgtttatgttggcacttgcagttgarataaagggctgttaatatagaaag

SEQ ID NO: 63994 - DNA, 50 bp, homo sapien
gattgtggagaatttggacagcaaarcatacctgtacatgttgggatccc

SEQ ID NO: 63995 - DNA, 50 bp, homo sapien
aacatatagttgctattaattatgarctgtatcttcttaatcaaatgatt

SEQ ID NO: 63996 - DNA, 50 bp, homo sapien
agactagttctctcactagatcaaayatacaagtcaattgttttcagtca

SEQ ID NO: 63997 - DNA, 50 bp, homo sapien
actaaataataaaatggtaaagtggratacaaatatatcaataactgtat

SEQ ID NO: 63998 - DNA, 50 bp, homo sapien
tgcttttccttgagcttcatgatctmatacaaatgcactgttttagttct

SEQ ID NO: 63999 - DNA, 50 bp, homo sapien
caattgttctttattttacttcttcrcagaatggtgcttaactcagtgcc

SEQ ID NO: 64000 - DNA, 50 bp, homo sapien
gttacaaaagcagtacagctctcaartcgggcatggtcttcaatactcac

SEQ ID NO: 64001 - DNA, 50 bp, homo sapien
aaataaaaacattgaacatggtaccygaaatgtttatcatgaaagctcaa

SEQ ID NO: 64002 - DNA, 50 bp, homo sapien
gaattttctcctggagatggtggccraatgatcttcaagggctccagtcc

SEQ ID NO: 64003 - DNA, 50 bp, homo sapien
caattaggatatttatctcagaatasattaatttcagagttgaaggatct

SEQ ID NO: 64004 - DNA, 50 bp, homo sapien
ccccaaagagttaagatgttcattcycataatttcatgccaaattaattt

SEQ ID NO: 64005 - DNA, 50 bp, homo sapien
gtaggagaaatgcaatctgcaatcamataactgcttctctttaggtcatt

SEQ ID NO: 64006 - DNA, 50 bp, homo sapien
aaaatcagacacagaatcatcagaarcaccaaattaatggtaatgatttc

SEQ ID NO: 64007 - DNA, 50 bp, homo sapien
cttggagaaacactgttcttgttaasattatagttaggggcaaatcacct

SEQ ID NO: 64008 - DNA, 50 bp, homo sapien
tatcaatagagaccgtttcactgaaycctggaacacaagagagagtagtt

SEQ ID NO: 64009 - DNA, 50 bp, homo sapien
tttttggtgctattattatgttcacrctacagattttaaaataaattgca

SEQ ID NO: 64010 - DNA, 50 bp, homo sapien
tcctagatgattcgtattcacattayattttgagaagcatgactagacca

SEQ ID NO: 64011 - DNA, 50 bp, homo sapien
tcactgtaggcctgccttgcactcaycaagtcctggagaggactaaatac

SEQ ID NO: 64012 - DNA, 50 bp, homo sapien
caataaatgcagtaaaaagtcttccyatggcttctcttatctgactgaaa

SEQ ID NO: 64013 - DNA, 50 bp, homo sapien
caagataggcacatgatcaaatacamacagatggaaagctaaagtccagg

SEQ ID NO: 64014 - DNA, 50 bp, homo sapien
taatggttccgtatgtaccaacttgsaaaaagcggaaaatctattcatgg

SEQ ID NO: 64015 - DNA, 50 bp, homo sapien
cttctagatctgtagaaacacatcaragctttttaaatcctctatagcca

SEQ ID NO: 64016 - DNA, 50 bp, homo sapien
ctttcgaacatgcccggctgcatacrtagcagtctgttctttgtctgcca

SEQ ID NO: 64017 - DNA, 50 bp, homo sapien
gagtaactggcatggttttgtcttcwatccctgtagtttctccttacaca

SEQ ID NO: 64018 - DNA, 50 bp, homo sapien
tctgatttcatgcctttattcagatkatcctacatatgaccttttttcta

SEQ ID NO: 64019 - DNA, 50 bp, homo sapien
aagatttcctactatttgtaaattasatacagttcaatactacttataca

SEQ ID NO: 64020 - DNA, 50 bp, homo sapien
tgttgtagaggcttcaacacatataragtaaatgagtagcagtagtatat

SEQ ID NO: 64021 - DNA, 50 bp, homo sapien
ttgtttgaaaagatttgcttctaaawatgtccctggataagttggtttct

SEQ ID NO: 64022 - DNA, 50 bp, homo sapien
ggtgtggcctggggggtcctgtgtamctctacatcagatatttgtcaacc

SEQ ID NO: 64023 - DNA, 50 bp, homo sapien
ataacccagtgtcaagtagctcttayagcagtgcaagaacaaaccaatac

SEQ ID NO: 64024 - DNA, 50 bp, homo sapien
ctgggcagaatccatacagccaccarcgtgtagagacctgatgccaagag

SEQ ID NO: 64025 - DNA, 50 bp, homo sapien
agaataacttccatatataagagtaygctagaaatatatactcaaaaagt

SEQ ID NO: 64026 - DNA, 50 bp, homo sapien
gttaaggttactttgtttcataatakaatcaaagcaagcttaattacctg

SEQ ID NO: 64027 - DNA, 50 bp, homo sapien
ttaaagtgcattgcaaactataaaaycttacaaaaggtgagaaatcacat

SEQ ID NO: 64028 - DNA, 50 bp, homo sapien
tttaggtgtaacactctaggaagtakgagttttaatgcttccttgatttt

SEQ ID NO: 64029 - DNA, 50 bp, homo sapien
ggctatttcacaggaacctcagatamaatactttcccctaaagcctgctc

SEQ ID NO: 64030 - DNA, 50 bp, homo sapien
actgaatatgttatagggatagaaamtaatgacagagaaaaaacaaaatt

SEQ ID NO: 64031 - DNA, 50 bp, homo sapien
tcattcaagtctgtagaaagctataraagaagtcaaggtaagcatacttt

SEQ ID NO: 64032 - DNA, 50 bp, homo sapien
agaaaatagctccatggaactggtcrgaactagttacacataaccccagt

SEQ ID NO: 64033 - DNA, 50 bp, homo sapien
gccccatctaatgctcaagctgtaaygctaccttagtttctccaattaac

SEQ ID NO: 64034 - DNA, 50 bp, homo sapien
ccaaatttaaccaagaaaaacctgamaggtaatgaagttgtctcagaccg

SEQ ID NO: 64035 - DNA, 50 bp, homo sapien
taaaattctgtagcactaagcacaaygaggagggaagttctgcatgcctc

SEQ ID NO: 64036 - DNA, 50 bp, homo sapien
ccctaagagattgattggcttatagraaagtttgaatgaatccaattcta

SEQ ID NO: 64037 - DNA, 50 bp, homo sapien
gcatatcccagcacctggaaagaaayatcagagcaaaacggccctcagaa

SEQ ID NO: 64038 - DNA, 50 bp, homo sapien
ttatgatatataaaatccataaaagragagagtcatgcttaaaattatgc

SEQ ID NO: 64039 - DNA, 50 bp, homo sapien
gagtttcattatagacaattgggctsagaagaccctgaataaatcttatt

SEQ ID NO: 64040 - DNA, 50 bp, homo sapien
ttctctcctggccaccagcagaaacygagtagagaataaactctcaggct

SEQ ID NO: 64041 - DNA, 50 bp, homo sapien
ccctgaaggtcaagtagccttcccaygtatttatagcctgggtttatgtc

SEQ ID NO: 64042 - DNA, 50 bp, homo sapien
acagagcagaagagcaggctggctaygcattcttaacgagtctgcctcta

SEQ ID NO: 64043 - DNA, 50 bp, homo sapien
gcttcctggatctgaatttttactayctttttcaggcttaggaagttttc

SEQ ID NO: 64044 - DNA, 50 bp, homo sapien
ataattcttttcaaccctggccttaygatgctaagggcacagttctcccc

SEQ ID NO: 64045 - DNA, 50 bp, homo sapien
atggagaacctcatttcgagtgaaarcactgtccttgatacacacagaaa

SEQ ID NO: 64046 - DNA, 50 bp, homo sapien
ccaaacagcacatgattattcgtcaracagtttcgtattccagatactgg

SEQ ID NO: 64047 - DNA, 50 bp, homo sapien
atttaaataaggctctacctcaaagwcctttgcacagtttattggtgtca

SEQ ID NO: 64048 - DNA, 50 bp, homo sapien
gtcctgctgcttcctagacatgtaargccccagttttaggaagctctgaa

SEQ ID NO: 64049 - DNA, 50 bp, homo sapien
acaagcttttctttataaatatctargacattccatgtatccaaaaccat

SEQ ID NO: 64050 - DNA, 50 bp, homo sapien
atctctaaatcacagatcaaagaacmactgaatggaatcatgtatgttgt

SEQ ID NO: 64051 - DNA, 50 bp, homo sapien
ctgacttcgggaacaaatgaagtaaygattacagaggacttagcatgtgc

SEQ ID NO: 64052 - DNA, 50 bp, homo sapien
tacacagaagagagctactagagacrttgctggcatgcagtcatgttgaa

SEQ ID NO: 64053 - DNA, 50 bp, homo sapien
gagattgagaactcgtttaacatcayagagttggcaggtggaaaccagca

SEQ ID NO: 64054 - DNA, 50 bp, homo sapien
gagatgtgctgtaagagtcatgtacrcattggattttgaagactcagaat

SEQ ID NO: 64055 - DNA, 50 bp, homo sapien
atacaatttcagatggaagctgctcragtggaaaactaaggtcattgcct

SEQ ID NO: 64056 - DNA, 50 bp, homo sapien
tatttggcttccttagttcaacatcwatgaaaaggaagcagagcaaagta

SEQ ID NO: 64057 - DNA, 50 bp, homo sapien
cacttggttttctattaaattaacakcatataatctggatggagtttcca

SEQ ID NO: 64058 - DNA, 50 bp, homo sapien
cacattaggctttatcagttactacracagcttggatgagtttacctatt

SEQ ID NO: 64059 - DNA, 50 bp, homo sapien
caagacaccatgacatacacattaayagaacagagtagagagtccagaaa

SEQ ID NO: 64060 - DNA, 50 bp, homo sapien
aagaaaattttgcaagctttctcaayaacctgtcttaatgtttccaacca

SEQ ID NO: 64061 - DNA, 50 bp, homo sapien
tgttttaaatatttccaaggaagaarattttgcaagctttctcaacaacc

SEQ ID NO: 64062 - DNA, 50 bp, homo sapien
gtaaaattaaggaatggtgagcttcyatatacgtattagacttttgacta

SEQ ID NO: 64063 - DNA, 50 bp, homo sapien
catctggctgagatgatttagaacarctacaaataagtactcatttataa

SEQ ID NO: 64064 - DNA, 50 bp, homo sapien
atggaaacaatatttttaactactcratttgccaaacaaaaattgctttg

SEQ ID NO: 64065 - DNA, 50 bp, homo sapien
gttattccctttttcagtttttatargtttctgaaatacagcagacttga

SEQ ID NO: 64066 - DNA, 50 bp, homo sapien
caaactcataatggttactcatccayatccactagttcacagcacaaagc

SEQ ID NO: 64067 - DNA, 50 bp, homo sapien
caatgtgccatgttctctgcaaatamtaccacacttcatcctcaaaaaaa

SEQ ID NO: 64068 - DNA, 50 bp, homo sapien
aggtttttaattcagattttagctgycacgcatttcatgtactggctcta

SEQ ID NO: 64069 - DNA, 50 bp, homo sapien
cagaaacgaaacaattaggaatacawctgaaaaacagccgtccaggattc

SEQ ID NO: 64070 - DNA, 50 bp, homo sapien
agtcttgctggcatcttctgggtacyaaggcactcaattttggctatgga

SEQ ID NO: 64071 - DNA, 50 bp, homo sapien
ggtagatattgttacagcccttaagraaacaatctccctcatctcatctg

SEQ ID NO: 64072 - DNA, 50 bp, homo sapien
agttgtgttgtgagtgattaaatccmactgtccatatatcaaatactaat

SEQ ID NO: 64073 - DNA, 50 bp, homo sapien
gcttgggaagcgttaatgagtggccrgtgttattaactatgtgcaaggtc

SEQ ID NO: 64074 - DNA, 50 bp, homo sapien
tccattatgataactacgaacgtttygtctttggtggctaagtgctacaa

SEQ ID NO: 64075 - DNA, 50 bp, homo sapien
tgtgtttaacttacgaaggataccaycagttttttaatgtcccaccactc

SEQ ID NO: 64076 - DNA, 50 bp, homo sapien
cctttgtgattgatagtttctaaccrcggagttcagacaaattaaaaagc

SEQ ID NO: 64077 - DNA, 50 bp, homo sapien
ctctttcgaaaccaatttgacaacaygaaaataacgtaaagcagccttaa

SEQ ID NO: 64078 - DNA, 50 bp, homo sapien
tactgaaagtgctcttttagacttayagtgacaccaatttctataatatc

SEQ ID NO: 64079 - DNA, 50 bp, homo sapien
ttttctcctccaaaccaaatgtgttraggcactaggcatgcagtctcccc

SEQ ID NO: 64080 - DNA, 50 bp, homo sapien
tgtcccattttcctaagaacaattayattggaaagtcctaacttgataaa

SEQ ID NO: 64081 - DNA, 50 bp, homo sapien
ggtccctggacggagaatccagtatyggtggcccactggctcctgctggc

SEQ ID NO: 64082 - DNA, 50 bp, homo sapien
accttttcttgcttttcagtttaatrgctgagaaataagtatggtggggg

SEQ ID NO: 64083 - DNA, 50 bp, homo sapien
ctaagtttggaaagataatacagaaygtactgatatgtaagtttagtttt

SEQ ID NO: 64084 - DNA, 50 bp, homo sapien
caacaaaagcctgatatatttgtatkaaggctgcagagaggtttggaaag

SEQ ID NO: 64085 - DNA, 50 bp, homo sapien
aactctctgcataatcgattctatamctcactgaatgctggtgataatca

SEQ ID NO: 64086 - DNA, 50 bp, homo sapien
ttatttctcatggctgccagtaatawacacgaaagaagaactaaatatag

SEQ ID NO: 64087 - DNA, 50 bp, homo sapien
gaatggatgactagaatttgatgtgyactagacgttcaattgtgtatatt

SEQ ID NO: 64088 - DNA, 50 bp, homo sapien
tagggatggcctactggcaacaacasgaaagaatggagccttcagactcc

SEQ ID NO: 64089 - DNA, 50 bp, homo sapien
ttagaacccagccatttctaccatcrtagcccaagccattttctctcacc

SEQ ID NO: 64090 - DNA, 50 bp, homo sapien
ctagaagatcatactgtttctattcsaactcacaattggaggactggatt

SEQ ID NO: 64091 - DNA, 50 bp, homo sapien
tgttaaactctcattcttaactgtasatcttcttttcccagagtaatgga

SEQ ID NO: 64092 - DNA, 50 bp, homo sapien
accaggcttttataaatttcatacartcttcagaatgcattaataacata

SEQ ID NO: 64093 - DNA, 50 bp, homo sapien
acagaagacattttctaatatgcaargacttaaatagtatatttcccttt

SEQ ID NO: 64094 - DNA, 50 bp, homo sapien
gctgctcaacaacttattctacttakattcatgtcagtgatgaatgaatg

SEQ ID NO: 64095 - DNA, 50 bp, homo sapien
acttactgtgtgaattttgactcaastattcctttttacccaatgtaatc

SEQ ID NO: 64096 - DNA, 50 bp, homo sapien
cccaatattggtatttggaagtaccragggtcaaagatggtggagaatga

SEQ ID NO: 64097 - DNA, 50 bp, homo sapien
caaaatctaaatatgtatcaacagamaaaatctataaaaaacttaaacaa

SEQ ID NO: 64098 - DNA, 50 bp, homo sapien
gatccaattaagacttgggtcccctkagataatgagtggaagagtgtggt

SEQ ID NO: 64099 - DNA, 50 bp, homo sapien
gttagttgtgagtgggtatttatagractagcactgtactttcattttga

SEQ ID NO: 64100 - DNA, 50 bp, homo sapien
aatataaagcaattacacgatcaaawttacaaaacaaaaagctaataaca

SEQ ID NO: 64101 - DNA, 50 bp, homo sapien
cttctgcaatgtctagtttcattaawcctctccagtattttatctcacac

SEQ ID NO: 64102 - DNA, 50 bp, homo sapien
tgctggtgggtacagctctttgttamcctggtaggcacccagatggcaga

SEQ ID NO: 64103 - DNA, 50 bp, homo sapien
ggtgtggggccttctcctgtagcaakataattacagtcatcagccacaat

SEQ ID NO: 64104 - DNA, 50 bp, homo sapien
ctccatgctcttatttccttctcacyacagagaactgggctaatcaaagt

SEQ ID NO: 64105 - DNA, 50 bp, homo sapien
gttcaaaaaatcattttgtgaagaasacctatattacattccaaaggtaa

SEQ ID NO: 64106 - DNA, 50 bp, homo sapien
atgtgtgttatttaaaaatacccttwaaggcatggctaaatgacaaaaac

SEQ ID NO: 64107 - DNA, 50 bp, homo sapien
ggtttctgactttggcaagttgctcsatctctccaagactgtttttggaa

SEQ ID NO: 64108 - DNA, 50 bp, homo sapien
atatttgcaaaaaagaaaaatccaaytaaatgattgtcataaggtttaaa

SEQ ID NO: 64109 - DNA, 50 bp, homo sapien
caaatctacagccatgcaacactaargctgaaaatttaaatgcataagtt

SEQ ID NO: 64110 - DNA, 50 bp, homo sapien
catgaaagttttaattttccttatamctttgcaaataccaactcacagta

SEQ ID NO: 64111 - DNA, 50 bp, homo sapien
aaatctacacacacacagcccattayggggactctcatggcctcacgcta

SEQ ID NO: 64112 - DNA, 50 bp, homo sapien
ccccaagagtctctgcggagaagaargctaccccctaagactgaggccat

SEQ ID NO: 64113 - DNA, 50 bp, homo sapien
tgttggcttcaaggttttttctctcrcatatccagccaacactgcgaatc

SEQ ID NO: 64114 - DNA, 50 bp, homo sapien
ttattctccattctccacttcgtacrccacatatacataagagttttcaa

SEQ ID NO: 64115 - DNA, 50 bp, homo sapien
cagaatgatgtagaagaggtcttcaraatgaaacaaaacctctgcaccag

SEQ ID NO: 64116 - DNA, 50 bp, homo sapien
ctgtgaatgatgagaccgttgtttaraagccaggcttagcctgagtccgg

SEQ ID NO: 64117 - DNA, 50 bp, homo sapien
aacacgcccatggcagcagctcgtawcacaggaaactattgctaaggtaa

SEQ ID NO: 64118 - DNA, 50 bp, homo sapien
tcttcttcttaaaatagacagagtayagtttgtttacaaaagagaaatgg

SEQ ID NO: 64119 - DNA, 50 bp, homo sapien
ctgttaactttttagctttaaattasaaaagcgattctgtagtatgaagt

SEQ ID NO: 64120 - DNA, 50 bp, homo sapien
gaaggaagtgactatcagagtacgtraagaacatctcatggaaagttaga

SEQ ID NO: 64121 - DNA, 50 bp, homo sapien
tactatggaagaagagataatttaaygaaaggcacatttatattctaaga

SEQ ID NO: 64122 - DNA, 50 bp, homo sapien
aaaaacaacccagtaatcttccttcraattcatgaaacactgggaaattc

SEQ ID NO: 64123 - DNA, 50 bp, homo sapien
aattgtcactttcagtactaggacarctagccaaagagattttagtttcg

SEQ ID NO: 64124 - DNA, 50 bp, homo sapien
aaagcttagcaggtgtttttacttayttattgaactttgtagagagaggg

SEQ ID NO: 64125 - DNA, 50 bp, homo sapien
atgttctatgggaagggaatgaaccrgtgttttccatttgccacactcta

SEQ ID NO: 64126 - DNA, 50 bp, homo sapien
attccaaatgttctccattcattctkaaatcagatctatcaaaatccttg

SEQ ID NO: 64127 - DNA, 50 bp, homo sapien
ttactgggctacacaattccacctaraaaaggcgaatgagcggaaattca

SEQ ID NO: 64128 - DNA, 50 bp, homo sapien
gtcatgctcctttgtctttcagcccrcgaatgtcatagagtttggagtcg

SEQ ID NO: 64129 - DNA, 50 bp, homo sapien
ttgttatctctgggtagcaggattayagagcattttctttttaagaatat

SEQ ID NO: 64130 - DNA, 50 bp, homo sapien
tgatacagcctgactcttcctaaccragaatggaaatctcttgagtgttt

SEQ ID NO: 64131 - DNA, 50 bp, homo sapien
ccatgcttctagaaaaaggatagggmatcaccaaagcagttgagaagcaa

SEQ ID NO: 64132 - DNA, 50 bp, homo sapien
tataattagcaaaccatggctaatartaataatcaggagtcataagaaaa

SEQ ID NO: 64133 - DNA, 50 bp, homo sapien
aagaaaggtacaccattaaaaaaacrgagatgttaatccaagaagaatgc

SEQ ID NO: 64134 - DNA, 50 bp, homo sapien
caaggatgggctgaaatctaaaatargagaacatgtaacatccattggca

SEQ ID NO: 64135 - DNA, 50 bp, homo sapien
tccaccatggttgctcaatggaattyaacaagaagaaatataacaaaagt

SEQ ID NO: 64136 - DNA, 50 bp, homo sapien
aagcagcaaggtcacctgcttacaasttaggaaaaaatcagagacaacac

SEQ ID NO: 64137 - DNA, 50 bp, homo sapien
aaactaaaacatacagtaattatttrtaggaatccaaaacatgaagggga

SEQ ID NO: 64138 - DNA, 32 bp, homo sapien
gttcaaagaggctaaamcgtggatccatcaat

SEQ ID NO: 64139 - DNA, 50 bp, homo sapien
acctttctgggaactatcacaaaggyaatgaagttgaaacttttgtatta

SEQ ID NO: 64140 - DNA, 50 bp, homo sapien
caatgtccttgctgaaaagcctatayaaaataaaataaaaatcctttacc

SEQ ID NO: 64141 - DNA, 50 bp, homo sapien
aagggatttaactttctaggtgccaytgattctttcactgtgcaaggtaa

SEQ ID NO: 64142 - DNA, 50 bp, homo sapien
cgtttaatgcacagtggacacatcaracttcccaatgtccttgctgaaaa

SEQ ID NO: 64143 - DNA, 50 bp, homo sapien
ctctacatgtagatataggtattaayataagcatatgtgtaacatatatg

SEQ ID NO: 64144 - DNA, 50 bp, homo sapien
tattctttggaattataaaatgtctyaagtgaggtattcagtatattgag

SEQ ID NO: 64145 - DNA, 50 bp, homo sapien
tcaaattctatttcactgatagatargcaagttggaaagagctagatttt

SEQ ID NO: 64146 - DNA, 50 bp, homo sapien
agctgttccctggtacttcttttgcwataaaaagagaaccacttcccaaa

SEQ ID NO: 64147 - DNA, 50 bp, homo sapien
tttctgtaaaattattgaagtatacsaagccataataatcaatcccttag

SEQ ID NO: 64148 - DNA, 50 bp, homo sapien
agaattggaagcaatatgctgactgmaaaaacgaccttagagatcaggaa

SEQ ID NO: 64149 - DNA, 50 bp, homo sapien
tttccacaataagcttgaccagtatraaggccaggtatgcacctcacccc

SEQ ID NO: 64150 - DNA, 50 bp, homo sapien
agacaggttgctccaagaagcagaarcagagtcatagtcaggagcagaaa

SEQ ID NO: 64151 - DNA, 50 bp, homo sapien
agaatcctaccaccaaaccgtaagartaattggcactagttcctctgaat

SEQ ID NO: 64152 - DNA, 50 bp, homo sapien
ttacttcttcttgcacatggtaatayattcattatgtagcagagtttaaa

SEQ ID NO: 64153 - DNA, 50 bp, homo sapien
aagcgttttagaaacttagttatgasaacatgtgaaattttatttcagac

SEQ ID NO: 64154 - DNA, 50 bp, homo sapien
agactagttctttcatttggaatacrcagtgattaacatggtatcacagt

SEQ ID NO: 64155 - DNA, 50 bp, homo sapien
gatgaaaatagatgctgatggagacragtggggtcctctgtgcctcagcc

SEQ ID NO: 64156 - DNA, 50 bp, homo sapien
taacacggtagagagcaatttgacargagggtaaggtcagtactttagat

SEQ ID NO: 64157 - DNA, 50 bp, homo sapien
tggggggagtgtgaacgtgaggtacrgagtggtaagaaacaagccttgta

SEQ ID NO: 64158 - DNA, 50 bp, homo sapien
tggaagaaaacaaaacagagtaacasggtagagagcaatttgacaagagg

SEQ ID NO: 64159 - DNA, 50 bp, homo sapien
cacaaactttggagtgccagaaataycatacttctgtgtttatttaaaag

SEQ ID NO: 64160 - DNA, 50 bp, homo sapien
gggcccagaaaggtcttactaactaygtggcatttgagcttggccttcag

SEQ ID NO: 64161 - DNA, 50 bp, homo sapien
tactaaatggttaatagcaaactccyaaaaataaaatgttttttgactta

SEQ ID NO: 64162 - DNA, 50 bp, homo sapien
ccacaatagaagttgcctcattacaytcaccataataatacagtataact

SEQ ID NO: 64163 - DNA, 50 bp, homo sapien
gtgcaactgtatagacatatggcctsaagagtatacacaggtttagccca

SEQ ID NO: 64164 - DNA, 50 bp, homo sapien
cctatgtcataatacttccacttgtwaacataaaaaagtcattacatgta

SEQ ID NO: 64165 - DNA, 50 bp, homo sapien
tatctggagtactacaatatcttccyagactggagaggttttagaatatt

SEQ ID NO: 64166 - DNA, 50 bp, homo sapien
tccttaaaagtctgttagtttaaccrtgtatctgactggccagatagtct

SEQ ID NO: 64167 - DNA, 50 bp, homo sapien
agtagtttgcaacaagaagcatccakattgataggaaaacaataaaggca

SEQ ID NO: 64168 - DNA, 50 bp, homo sapien
aaaagaacagtctatgggagtatcargttggtttcaatattctagatatt

SEQ ID NO: 64169 - DNA, 50 bp, homo sapien
agatgtgggacagagcagggcaagartaatacgaagctataacataagct

SEQ ID NO: 64170 - DNA, 50 bp, homo sapien
tgtataatagaaggggtggcatgtcsaaagactcagaaattcaatttaaa

SEQ ID NO: 64171 - DNA, 50 bp, homo sapien
tcaatttaaaaaatagtcagtgccarttgaaacacatataccagctaagt

SEQ ID NO: 64172 - DNA, 50 bp, homo sapien
tttccttttgctggattctccacagygttcatcatcactaaaatcagaat

SEQ ID NO: 64173 - DNA, 50 bp, homo sapien
aacttttgtcttcttgagaacaaacyagcccttttgagactcaaatgtct

SEQ ID NO: 64174 - DNA, 50 bp, homo sapien
gagcaattgtcttcacatgtaaacasaattcaaaaatttcactcttgttt

SEQ ID NO: 64175 - DNA, 50 bp, homo sapien
aactcttagcacataaagcctgtgcrttataagcaggatacgtcttggtg

SEQ ID NO: 64176 - DNA, 50 bp, homo sapien
ggccaaagtatcctgtgctggtttcyagtatacttcttgagaattcactt

SEQ ID NO: 64177 - DNA, 50 bp, homo sapien
cccatgaaggcagagactttggtagraaggttttcataggaaagatacaa

SEQ ID NO: 64178 - DNA, 50 bp, homo sapien
tcacattccaaaagtggagaaactamctcttgaacttcaaagaaaaattt

SEQ ID NO: 64179 - DNA, 50 bp, homo sapien
cttgtaaaaactaagagctaaaagtsggtcacacaagatatacatgctcc

SEQ ID NO: 64180 - DNA, 50 bp, homo sapien
ataccaaacaaaaaggcacttatgayacttagagatctctagataagcca

SEQ ID NO: 64181 - DNA, 50 bp, homo sapien
tcaaaatcctgctatgtttatagggycaccttacatttgtggaaatatac

SEQ ID NO: 64182 - DNA, 50 bp, homo sapien
aggactggctttccctatccttgaamaatgatagcatgactttgtattgc

SEQ ID NO: 64183 - DNA, 50 bp, homo sapien
ccccaaacccttccttcttatttagsccatcactcctcaaaccctgagaa

SEQ ID NO: 64184 - DNA, 50 bp, homo sapien
tataatgagagtgatataacaacaaygagatgtctcagtttaaacacaac

SEQ ID NO: 64185 - DNA, 50 bp, homo sapien
atattttatcatccataaaaattacractcagaagatgaatttattagcg

SEQ ID NO: 64186 - DNA, 50 bp, homo sapien
tatcatgtgataagaatgaaaaaatsatggggtacaagtctgagtggagg

SEQ ID NO: 64187 - DNA, 50 bp, homo sapien
agcattatcagccagcttctatggarcctccagatgatggatagccctct

SEQ ID NO: 64188 - DNA, 50 bp, homo sapien
cattcactgtgtaagcacactgtcaragcactaagcacgcactagaaatg

SEQ ID NO: 64189 - DNA, 50 bp, homo sapien
atccctcttatggatgattgttccaktatttccctacaggttacagctgc

SEQ ID NO: 64190 - DNA, 50 bp, homo sapien
ctgagttgtcagtatgttatcactakaaaacaaagaaaaatgattaataa

SEQ ID NO: 64191 - DNA, 50 bp, homo sapien
agcagggtaaaccttttcctgagtgyagagggaaggtagagggataaagg

SEQ ID NO: 64192 - DNA, 50 bp, homo sapien
cacttacttcctgctgggtttttaasacaatcctgcccatgtatccctct

SEQ ID NO: 64193 - DNA, 50 bp, homo sapien
atctgttcacctctctgagaaatcaygtgccattaaggaagcactgctga

SEQ ID NO: 64194 - DNA, 50 bp, homo sapien
atgtagtatgttcaaaagacatgtaygagaataatcacagcagcagtatt

SEQ ID NO: 64195 - DNA, 50 bp, homo sapien
attccatttatataaatgtgcaaagragtaactgcgagggggcttgaaag

SEQ ID NO: 64196 - DNA, 50 bp, homo sapien
agacaagtacacagatcatagtgtamaactcaatgaatattcacaaagtg

SEQ ID NO: 64197 - DNA, 50 bp, homo sapien
aaaaagcagattctgcaactatggcmctttctacagtgtccttcttccat

SEQ ID NO: 64198 - DNA, 50 bp, homo sapien
gagtgacttcagtctggttcccaaaytcttatcactgagcacctatttta

SEQ ID NO: 64199 - DNA, 50 bp, homo sapien
actcaaatttcaccttgatacgagakaacttcaaacattctccagcaaaa

SEQ ID NO: 64200 - DNA, 50 bp, homo sapien
gctgagttgctaagaggaaagcacaytaacaagggagataatatgtgaag

SEQ ID NO: 64201 - DNA, 50 bp, homo sapien
ttctacgtctagatagctgacatttkattctcctctaagaaaaataaagc

SEQ ID NO: 64202 - DNA, 50 bp, homo sapien
ctgacttccgtgctacatgatgacaragaatttcctaatccaaatatctt

SEQ ID NO: 64203 - DNA, 50 bp, homo sapien
atgaaaagtagctagttgaagaataygattgccttacaaatgctttagag

SEQ ID NO: 64204 - DNA, 50 bp, homo sapien
attagagagctgttagagaaaatatmagtggtaacagattaacaaactat

SEQ ID NO: 64205 - DNA, 50 bp, homo sapien
ggcctcactgagaaggtgaggtagamgcaaaattatttaagtgaaggggg

SEQ ID NO: 64206 - DNA, 50 bp, homo sapien
agaagtggttttgtttagcagtagayataaccaacatattatagctgcat

SEQ ID NO: 64207 - DNA, 50 bp, homo sapien
acagataacagagaagatagacgtgyacatttatccctttgttttcatgc

SEQ ID NO: 64208 - DNA, 50 bp, homo sapien
tcaccacagtcaagtgatgcatgacrgtacttagagagtcccacaggtga

SEQ ID NO: 64209 - DNA, 50 bp, homo sapien
aggaagaatctccagaaatgatgttkgtatcactacttacaatctttcac

SEQ ID NO: 64210 - DNA, 50 bp, homo sapien
gaaatgcagcaagccatgaaaatttwaaaggactagaatgaattgagaag

SEQ ID NO: 64211 - DNA, 50 bp, homo sapien
atccaatgacgaaaagtgatccggtmaaagttacggtggcagaaacttcc

SEQ ID NO: 64212 - DNA, 50 bp, homo sapien
gacaacagaaataggtcccaaagtayataaaatatgggtattatcaggta

SEQ ID NO: 64213 - DNA, 50 bp, homo sapien
ctcatagcaacatgaagaatgatgaytactttttgttgtgcctaataaac

SEQ ID NO: 64214 - DNA, 50 bp, homo sapien
gaaaaaacatgcagcagagcattccytactctatcctatgggttccttga

SEQ ID NO: 64215 - DNA, 50 bp, homo sapien
gaaccatttcagtttgggagttctawagttgttggagaggggactatgcc

SEQ ID NO: 64216 - DNA, 50 bp, homo sapien
aaaatgtttatgttggaagttacaartgactgtctaattataccggctac

SEQ ID NO: 64217 - DNA, 50 bp, homo sapien
agtgacctgtgtcatgttaaacattstgtagttaacaccactgaaataga

SEQ ID NO: 64218 - DNA, 50 bp, homo sapien
actgcagtatttgggccagagtgcaycgttcttcacagcacattccctca

SEQ ID NO: 64219 - DNA, 50 bp, homo sapien
ggttctaggccccacagttatattargccaagactctgggcaagagtcag

SEQ ID NO: 64220 - DNA, 50 bp, homo sapien
tcaacatcaacagtcaaaatgtgaayagaccagtcaaatcctctggatat

SEQ ID NO: 64221 - DNA, 50 bp, homo sapien
tatagtgaaccccataagggtggacsattcaaagtttcttgctgtgagca

SEQ ID NO: 64222 - DNA, 50 bp, homo sapien
ctactggggaacgacaagtcgcatckataactggggatgaggaggtctcc

SEQ ID NO: 64223 - DNA, 50 bp, homo sapien
aactgatgccactttctacaagtacygctaacctgatctttacttattgg

SEQ ID NO: 64224 - DNA, 50 bp, homo sapien
aatgtacacacttcaatttacatgcratgagataaaattgttaatgtttg

SEQ ID NO: 64225 - DNA, 50 bp, homo sapien
ctggaaggggtgtggaaaagaatgaygtttgctgatcttggagaatattt

SEQ ID NO: 64226 - DNA, 50 bp, homo sapien
aatagtgtttggcacatagcaaactytatgaactactgttttgttctttt

SEQ ID NO: 64227 - DNA, 50 bp, homo sapien
ctgttctcagcctagtgggagaaaasataagtaaatgagcaattgcactc

SEQ ID NO: 64228 - DNA, 50 bp, homo sapien
tcaaagtgggtgggaggtatagatakagcatgcagtgtttcccaactcat

SEQ ID NO: 64229 - DNA, 50 bp, homo sapien
gtggtctgtatgacatagttatccakcttattgcctgaaaaaagaagagg

SEQ ID NO: 64230 - DNA, 50 bp, homo sapien
aacctgtagtttccaaggattcatayaggtacccttcatttgtgaggaca

SEQ ID NO: 64231 - DNA, 50 bp, homo sapien
accattcaaatattaaaacgtgacawcttataccaataacaaacaaacaa

SEQ ID NO: 64232 - DNA, 50 bp, homo sapien
ttttctccccttttagaactaccaasgtaatggaagctgaaagaggaggc

SEQ ID NO: 64233 - DNA, 50 bp, homo sapien
atctttccttgccttgcgtgattttwaaaaatgattgtcagattcagtca

SEQ ID NO: 64234 - DNA, 50 bp, homo sapien
ttaactctagaaattcagtagcccartaaggatctatgaaaagtgtgctt

SEQ ID NO: 64235 - DNA, 50 bp, homo sapien
tttcactgctcaaaaaccaaggtagygaggttggccaatccatttaaggt

SEQ ID NO: 64236 - DNA, 50 bp, homo sapien
ccattctttcaaaatagatgtgataraaacagtgcaacctgtgtgtctct

SEQ ID NO: 64237 - DNA, 50 bp, homo sapien
acaaccaacctggataggtcaactgsagtcccattataacacgcacctca

SEQ ID NO: 64238 - DNA, 50 bp, homo sapien
cacatatatttattttatgaccatgratattataactctaaatctatgtt

SEQ ID NO: 64239 - DNA, 50 bp, homo sapien
tcattattgttgttttgccgatgaakaaatgggtcaccaagaggtagaga

SEQ ID NO: 64240 - DNA, 50 bp, homo sapien
ctccttcaatgtctgtgagaagaagsctgaagggtgagctaagtccatcc

SEQ ID NO: 64241 - DNA, 50 bp, homo sapien
agatggcactcctctagtcatctcayatcccaagtcttctcagaccccac

SEQ ID NO: 64242 - DNA, 50 bp, homo sapien
ttctattccagactcaaagaccatargatgccatttccatattgtaatct

SEQ ID NO: 64243 - DNA, 50 bp, homo sapien
ccttgcactttttcttcctaattctyacctcaatttgtaattaatggttt

SEQ ID NO: 64244 - DNA, 50 bp, homo sapien
tgaaccgggagcgggtttcatggtayagtagatcaatattgttccttcta

SEQ ID NO: 64245 - DNA, 50 bp, homo sapien
gcaaatcataatttgcatttggaaartattttaataatgttcacaaggta

SEQ ID NO: 64246 - DNA, 50 bp, homo sapien
cgtagatctagatgtaacttgccaaraaaagcagttgtaggacacaaaga

SEQ ID NO: 64247 - DNA, 50 bp, homo sapien
aaaaaaaaaggagaggtattaaaaaraagatccagtatttggatgctcct

SEQ ID NO: 64248 - DNA, 50 bp, homo sapien
atgggtgtcagccatgaaggcaatayccaagtagaggagcataggaactg

SEQ ID NO: 64249 - DNA, 50 bp, homo sapien
atacagaacactctatacgcatatgmaagttaatttataacatacaatag

SEQ ID NO: 64250 - DNA, 50 bp, homo sapien
gttactaagaggaatgttcttacagygatgttaccaagcacatacaaaca

SEQ ID NO: 64251 - DNA, 50 bp, homo sapien
tgaatgggtatcactacatgccagamcggtgcatcagccaagccgaggca

SEQ ID NO: 64252 - DNA, 50 bp, homo sapien
atttgatcacggttttattaatggaygtgaaccaatgtacaagctggtga

SEQ ID NO: 64253 - DNA, 50 bp, homo sapien
gtaccgtatgtgactcaatagaccaytgctttaataacaatgaatgcatt

SEQ ID NO: 64254 - DNA, 50 bp, homo sapien
gcagagtgtgggaaatcaaggttgcratcaaataccatgtttgatttatc

SEQ ID NO: 64255 - DNA, 50 bp, homo sapien
caattttgttcatcctgccttcatayaagagtaacagcccattcttggat

SEQ ID NO: 64256 - DNA, 50 bp, homo sapien
agaaagagggaattatctcctggagyagttcgtaaagcatactgttttat

SEQ ID NO: 64257 - DNA, 50 bp, homo sapien
tgttataaaggaaaatcataacatcraaggaagtaagtacagacttctca

SEQ ID NO: 64258 - DNA, 50 bp, homo sapien
tactctgaaaactgcagcaagtctcrgaaagggtcttcctaaatgctccc

SEQ ID NO: 64259 - DNA, 50 bp, homo sapien
ctgtcagtgtagaccgaattagctaygaatgtgaaaccggagatcacata

SEQ ID NO: 64260 - DNA, 50 bp, homo sapien
gggaatcacaagtcctagtcaaagtrgttgggatggtgctgacccaccct

SEQ ID NO: 64261 - DNA, 50 bp, homo sapien
cattattgaggcagctcatgtacacwttttttttgggttggtattcttta

SEQ ID NO: 64262 - DNA, 50 bp, homo sapien
cagttaatgggctggttactgtcacrcacaagcactgtcccagcatttgc

SEQ ID NO: 64263 - DNA, 50 bp, homo sapien
ggcatcctaataaatggtatgggtcytagcactgaggaacaaaaatggag

SEQ ID NO: 64264 - DNA, 50 bp, homo sapien
acatatttaaagttctcagaattgaytataacttttctcacctctgagct

SEQ ID NO: 64265 - DNA, 50 bp, homo sapien
tggggtgggggtacagtatggcaaaytctaaaagcccgtagtacttgaac

SEQ ID NO: 64266 - DNA, 50 bp, homo sapien
tgtacctgatggaattggaaaggaarattattggttgctatcaacaaatc

SEQ ID NO: 64267 - DNA, 50 bp, homo sapien
ctctttatgtacacacatgataagawcgcagagaaatattaatgagtaaa

SEQ ID NO: 64268 - DNA, 50 bp, homo sapien
atccttctccaagaacctgggtcagsaaaaattgtaatactcagagaact

SEQ ID NO: 64269 - DNA, 50 bp, homo sapien
acagtttttaagatgcttctgttagycagaaaacaagcgtaagcataaag

SEQ ID NO: 64270 - DNA, 50 bp, homo sapien
ttacactgtaaaaccagaataagtaygagagaatcatggaggaaatgaag

SEQ ID NO: 64271 - DNA, 50 bp, homo sapien
cacagaaaaagcagttccagttaaaygacttaactcaggtcttccagcta

SEQ ID NO: 64272 - DNA, 50 bp, homo sapien
aaaccagggtacttattctcttaacrattttctcccctaactctagggaa

SEQ ID NO: 64273 - DNA, 50 bp, homo sapien
cctactattgccaggtagctggaatmcattggtccaaccatgggctttgg

SEQ ID NO: 64274 - DNA, 50 bp, homo sapien
ttaacactgattgcataaaaagtatwaaaaatggtaatgcctaatatagc

SEQ ID NO: 64275 - DNA, 50 bp, homo sapien
tttctcaataaaaagtgtgacataamaaaggaaggtaaacctgcttttgg

SEQ ID NO: 64276 - DNA, 50 bp, homo sapien
agatagtcaactacttggtaaggggmaataatagacctgaagtacagtca

SEQ ID NO: 64277 - DNA, 50 bp, homo sapien
aggtcttacaatcttcataggcaggraacaaattccatagcacttccatt

SEQ ID NO: 64278 - DNA, 50 bp, homo sapien
atagtgggtttgtagattgtttagastaaagatttcgcgagtcttagaaa

SEQ ID NO: 64279 - DNA, 50 bp, homo sapien
gactgagaacacaaggatttcctacyctgcgcattagtgaatggcttttt

SEQ ID NO: 64280 - DNA, 50 bp, homo sapien
aaatgtagagtctgtctgcagtatcrgaattgggagtgattaggaagaaa

SEQ ID NO: 64281 - DNA, 50 bp, homo sapien
cagacaggagtgctggcatattagayggaaaaccaggctaggattggtgt

SEQ ID NO: 64282 - DNA, 50 bp, homo sapien
gtgactagggagtctatgaatacagraactttattttaagaaaaggaaac

SEQ ID NO: 64283 - DNA, 50 bp, homo sapien
ccttggtttgaggatgatcttatcaraaaggaagctaagagtgaccagct

SEQ ID NO: 64284 - DNA, 50 bp, homo sapien
tggaaatattcctcacttcctacaaygtcctatgctcactagcattgttt

SEQ ID NO: 64285 - DNA, 50 bp, homo sapien
ctgaaaacaatgcagaaaggtcttgyctctaaagcccgctatattttaac

SEQ ID NO: 64286 - DNA, 50 bp, homo sapien
atgacactgaggacaaaacacaagarcgtataggtagggacagtgaacta

SEQ ID NO: 64287 - DNA, 50 bp, homo sapien
ttttaccctttgcccaagatagtagwcataaaacaacttccaaaaaccaa

SEQ ID NO: 64288 - DNA, 50 bp, homo sapien
tagggtgtgtgctcctcagtgattaygcactcattccaatggagtaggag

SEQ ID NO: 64289 - DNA, 50 bp, homo sapien
aaattgttcaaggtcaatcaagcacraatttcaaaataatacgaattttg

SEQ ID NO: 64290 - DNA, 50 bp, homo sapien
cgcctgatatataaaacacatgaatraatatggtggcttatagttgatac

SEQ ID NO: 64291 - DNA, 50 bp, homo sapien
gggggaagcataattaatattaccaycaaagtcatagccattatgagatt

SEQ ID NO: 64292 - DNA, 50 bp, homo sapien
attattactattattattatcactastaccagacctagcttttgtcacca

SEQ ID NO: 64293 - DNA, 50 bp, homo sapien
ttgtagcacatggagagccctcgtgragagcaaaaaactttttgtaaatt

SEQ ID NO: 64294 - DNA, 50 bp, homo sapien
ttgaaatgtgttagctcaagaacctsaagagacaggaggcaggacgcctg

SEQ ID NO: 64295 - DNA, 50 bp, homo sapien
tagaagtcaaacagagtgattaaggyagtactccaagctggagaatgaat

SEQ ID NO: 64296 - DNA, 50 bp, homo sapien
aggtactaggagggtcagagagaaaygcctgcttacctctaggaattggt

SEQ ID NO: 64297 - DNA, 50 bp, homo sapien
tctctgaccctcctagtacctgaagmaaaaattatatggaataaggctga

SEQ ID NO: 64298 - DNA, 50 bp, homo sapien
taatttcccaagaagaaactggccaygtgtcataggttctctagaaccag

SEQ ID NO: 64299 - DNA, 50 bp, homo sapien
ttgtacacagcagaactgggactcartcatatcagggttgattccagagc

SEQ ID NO: 64300 - DNA, 50 bp, homo sapien
tgggaaagtcagtattcttagtgtcytcatctttgagtctgcaaattagg

SEQ ID NO: 64301 - DNA, 50 bp, homo sapien
attcatacacacagatatctgagacygaagactaaacattaaaatgaatc

SEQ ID NO: 64302 - DNA, 50 bp, homo sapien
gataccaagtcaagtcaaggccaacrctgtcatggagatgggggacaatg

SEQ ID NO: 64303 - DNA, 50 bp, homo sapien
gcaatgatgataaacacactgaatamggtaaatatttcctgggagcctaa

SEQ ID NO: 64304 - DNA, 50 bp, homo sapien
aaagaggctgcttgttgtccaagtayatctttagtgtatagaattccagg

SEQ ID NO: 64305 - DNA, 50 bp, homo sapien
gtcaggatatacattatgtaggaagyaacactgtagacaggactggaagg

SEQ ID NO: 64306 - DNA, 50 bp, homo sapien
attcaatcaataaattgtaatatacrgaaaaaacaaagactaagtgccac

SEQ ID NO: 64307 - DNA, 50 bp, homo sapien
tgccaacctattagagctattttaaygttctctaagcatattatttgcac

SEQ ID NO: 64308 - DNA, 50 bp, homo sapien
agccagcatccctataagtgactaastaggagtattgggtatattttcaa

SEQ ID NO: 64309 - DNA, 50 bp, homo sapien
aaatcatgagcaaaagaatgtcaaamacggtatctgacactataactggt

SEQ ID NO: 64310 - DNA, 50 bp, homo sapien
aactaaatagccccaagaaaacattsaagcctcttaatttttgtttattt

SEQ ID NO: 64311 - DNA, 50 bp, homo sapien
tataagaggaagtcactatcagatamataagttaaaaatgtataattttt

SEQ ID NO: 64312 - DNA, 50 bp, homo sapien
cccctccaagagggattatgtacccrcgtagcttcgtacaactcgcaata

SEQ ID NO: 64313 - DNA, 50 bp, homo sapien
gcaaactttccctgttctgagctcartagtgtttagattctgtttctcta

SEQ ID NO: 64314 - DNA, 50 bp, homo sapien
tcagttgttctttttctgtcttcccyattatcagcagctgttataagccc

SEQ ID NO: 64315 - DNA, 50 bp, homo sapien
gctgggaagtaatagaaccaatcaaygtagatgtatcaggaactttccat

SEQ ID NO: 64316 - DNA, 50 bp, homo sapien
gcaggtttgggctacccagaaacagktggcatctttggtagtgtcaagcc

SEQ ID NO: 64317 - DNA, 50 bp, homo sapien
ataaatcattagctcagcagagacaygtttcctgaatttatggaggaagt

SEQ ID NO: 64318 - DNA, 50 bp, homo sapien
aaaaaaagggagagttaaggatacasgtcatttttgtcttagtagggatg

SEQ ID NO: 64319 - DNA, 50 bp, homo sapien
gataatatgaattctaaagcatgcaragattcacaagttcatgtttgcaa

SEQ ID NO: 64320 - DNA, 50 bp, homo sapien
gcaaactcaggcacacagaagtttaycaatctgtttcagattatatggct

SEQ ID NO: 64321 - DNA, 50 bp, homo sapien
gtgaaaaaaacaggcagttgtgaaaytcatagtactctcatggacgaagg

SEQ ID NO: 64322 - DNA, 50 bp, homo sapien
ttggatccagtaggaggatcaagcartgaacttggtagtgaacatgtgat

SEQ ID NO: 64323 - DNA, 50 bp, homo sapien
ccttggacaaacacaactctaaccaygcacactcagtaggaaatgttgat

SEQ ID NO: 64324 - DNA, 50 bp, homo sapien
tggaacacgtaagaagattcagttcraaagaggcaatgcctgggctcttg

SEQ ID NO: 64325 - DNA, 50 bp, homo sapien
aatacatcagcattaaagaccattayggaaatccagctgccttagcagat

SEQ ID NO: 64326 - DNA, 50 bp, homo sapien
cctagccaaaaatcccttactctcasggaagatgaaatttctttcaatcc

SEQ ID NO: 64327 - DNA, 50 bp, homo sapien
ctccaccccatggccatatcggataytacagctcccagcgtctggctgat

SEQ ID NO: 64328 - DNA, 50 bp, homo sapien
tacaactttaataatcgggaaaatgyagatttgtattacaatttcggaac

SEQ ID NO: 64329 - DNA, 50 bp, homo sapien
ccctgggatgactcttagagaatgaygggcttaaaaaaatgattaatggc

SEQ ID NO: 64330 - DNA, 50 bp, homo sapien
gtacatttctatctaataaagtgagyatagtgcacattcagaagcatagt

SEQ ID NO: 64331 - DNA, 50 bp, homo sapien
gataaataatatgatatgtttgtaartgcatatctgtatagtttatccct

SEQ ID NO: 64332 - DNA, 50 bp, homo sapien
ccatcatacctccaccagaaaccacraaggctaatgttctagagacccaa

SEQ ID NO: 64333 - DNA, 50 bp, homo sapien
cctggcagacatagttatcttatgayggatcactatgagcggtgataact

SEQ ID NO: 64334 - DNA, 50 bp, homo sapien
ctcttagatccattttagagacaagwcatggacatcctggtggactaagt

SEQ ID NO: 64335 - DNA, 50 bp, homo sapien
tgtgaagacactaaagtatcgcacasataaaacactacaagctcatagta

SEQ ID NO: 64336 - DNA, 50 bp, homo sapien
tgggccaacagtagaggagtagtgastgaagatttttgcaaagaaacctt

SEQ ID NO: 64337 - DNA, 50 bp, homo sapien
cagaaatatataatcttcagtccttrtccacattttgccaaaagtcacaa

SEQ ID NO: 64338 - DNA, 50 bp, homo sapien
ttttcccctagttactattactccayacttcaaggtcaaatgccaataaa

SEQ ID NO: 64339 - DNA, 50 bp, homo sapien
cttagaatagctaaatagactcacayggcaaaaggaaaatggctgttttt

SEQ ID NO: 64340 - DNA, 50 bp, homo sapien
aagctagaagtctaacatgggtctcrctctaagctcagatcaaggtattg

SEQ ID NO: 64341 - DNA, 50 bp, homo sapien
ggcaccaggttttatgtacttacaayctttgaaggaagccaaaccttttc

SEQ ID NO: 64342 - DNA, 50 bp, homo sapien
caatgctgaaagacaattagacagcraaaagcacagcctcagctaaaatg

SEQ ID NO: 64343 - DNA, 50 bp, homo sapien
acctttggctatgtctgattctcctsactgtgtaagtatatggtatacac

SEQ ID NO: 64344 - DNA, 50 bp, homo sapien
tcacttcaaatcatagacactgttaraacacaatttatttttttttaatt

SEQ ID NO: 64345 - DNA, 50 bp, homo sapien
tatatcctttctgtgggctaccaaarcacctatgaccactgtttaaaata

SEQ ID NO: 64346 - DNA, 50 bp, homo sapien
ggtttgacttgactgtgttgttgaawttactactaggtctgggtggttta

SEQ ID NO: 64347 - DNA, 50 bp, homo sapien
cactttgggctcaaatacagttgcayaagtctgtcttatattctaaaaac

SEQ ID NO: 64348 - DNA, 50 bp, homo sapien
taattgaaagagcaagaatttagagkcagaattatggtaaaagtcattct

SEQ ID NO: 64349 - DNA, 50 bp, homo sapien
aaaaggagtcaaaagggtgatactayctctgtttagcagatgtggggatt

SEQ ID NO: 64350 - DNA, 50 bp, homo sapien
agaacaaatgaaggcactccaggtarcgagttcagtgtagtcagaggcaa

SEQ ID NO: 64351 - DNA, 50 bp, homo sapien
ttcaaaatatgtagctacaataaacragtttccttcaagcttgttaatgt

SEQ ID NO: 64352 - DNA, 50 bp, homo sapien
ctctcatgttaatatcttctaactarcttggagtttttatgaaactttgg

SEQ ID NO: 64353 - DNA, 50 bp, homo sapien
tgaagcatttggttatggggtgaacrcaaatcaaatattgtgagatgttt

SEQ ID NO: 64354 - DNA, 50 bp, homo sapien
tatcacccattgtagttccctatgakagatttttttatgtggatatttat

SEQ ID NO: 64355 - DNA, 50 bp, homo sapien
caaatgaaaatcaaagcaacgtatcraaagctatgggatacagcaaaagc

SEQ ID NO: 64356 - DNA, 50 bp, homo sapien
gttcgtttaaatttttctattttgasaaaggtatttactgttaagacttc

SEQ ID NO: 64357 - DNA, 50 bp, homo sapien
gcttgcagtgatggacacccaaataygctggcttgatcattacacagtct

SEQ ID NO: 64358 - DNA, 50 bp, homo sapien
agccgggggacccgcctgaagtttaygaacgcgtcctttgtttgctgaga

SEQ ID NO: 64359 - DNA, 50 bp, homo sapien
aaatgtgggcatgaagcagggagtaraacctaatgaacttatgagactcc

SEQ ID NO: 64360 - DNA, 50 bp, homo sapien
aaatagaatgaagcccaatttcttgkatcggccagcatttgagtctcctg

SEQ ID NO: 64361 - DNA, 50 bp, homo sapien
tatggacatttgcaggggcctaaaasctagactctgctctgggaaacagg

SEQ ID NO: 64362 - DNA, 50 bp, homo sapien
ggtacagtgttttacacagaacaccrgattggcaataactaagaaggtgg

SEQ ID NO: 64363 - DNA, 50 bp, homo sapien
ctatcatagtgtgtattccaagcacrgatttatatgtgtgctatagtggg

SEQ ID NO: 64364 - DNA, 50 bp, homo sapien
gaaggtaagtggaagacagagcgaaygcttgatactttttgtccgccttg

SEQ ID NO: 64365 - DNA, 50 bp, homo sapien
tttgtttgctatattgcaacagtgayggttttcaggtttgtacatatatc

SEQ ID NO: 64366 - DNA, 50 bp, homo sapien
taattgcttaatctttgaatttatawgtttgaaagttcatgatagtttct

SEQ ID NO: 64367 - DNA, 50 bp, homo sapien
attactcttgcatctctatggctaamtgatactctgagagttttcatgaa

SEQ ID NO: 64368 - DNA, 50 bp, homo sapien
tgctgttcatctcatgcccataaatkaataaaccggtgatcagcaaatca

SEQ ID NO: 64369 - DNA, 50 bp, homo sapien
gtatgaagaaaatgaaatagaatgayatggtattaggtatctattgctga

SEQ ID NO: 64370 - DNA, 50 bp, homo sapien
ggtagaggagagacgttctttttttyggttatctgtgatagatggtatga

SEQ ID NO: 64371 - DNA, 50 bp, homo sapien
cctttcttggtgatttcttgattcakgttattttagcttcttggctttgt

SEQ ID NO: 64372 - DNA, 50 bp, homo sapien
gcagaaaaagaaacaatgaatatgastaaatagttacagaaattatgcaa

SEQ ID NO: 64373 - DNA, 50 bp, homo sapien
tgtcttgggagcttgttaaaagggcygattccttgctgtggctcacgcct

SEQ ID NO: 64374 - DNA, 50 bp, homo sapien
ggttaccagtagagaagatattttaygcactgactggtctcaataaaggc

SEQ ID NO: 64375 - DNA, 50 bp, homo sapien
aagaatatcaatgactccttccaaaytaaaaatgtattaaagctagagac

SEQ ID NO: 64376 - DNA, 50 bp, homo sapien
agatgatgctggcatatagtaagcamtgaaaagtagtaaaaagacaaaat

SEQ ID NO: 64377 - DNA, 50 bp, homo sapien
agcccattatagctcttaagatacaygatacagaaggctagggcaaatgc

SEQ ID NO: 64378 - DNA, 50 bp, homo sapien
ttaattaatgtgctaaaagatttcayggataaggtagacagcatgccaaa

SEQ ID NO: 64379 - DNA, 50 bp, homo sapien
tcccactttcatatgttctctaatayctacaagatgtgtgtttctttttc

SEQ ID NO: 64380 - DNA, 50 bp, homo sapien
agtttcatgtggtgaatataatagamccatcagattttaaaatataattg

SEQ ID NO: 64381 - DNA, 50 bp, homo sapien
tttaagatttcagctttcatttagayagaagaatacatgtataggtttgt

SEQ ID NO: 64382 - DNA, 50 bp, homo sapien
agtgttatgaaagaggaggtctaatsaagtacaaacactcagagaattct

SEQ ID NO: 64383 - DNA, 50 bp, homo sapien
ggagagccttcaagttatgattaggwatgacaattgtgaaagaagagaag

SEQ ID NO: 64384 - DNA, 50 bp, homo sapien
tccctccagaggatgcagagtacaargcacatccttcttggaggaggaga

SEQ ID NO: 64385 - DNA, 50 bp, homo sapien
aacaaagaatgctcatagaggatgamgacagggtacagatgtaatagggt

SEQ ID NO: 64386 - DNA, 50 bp, homo sapien
agaatagtccagaggaaaagaaagaratctgaggtaggtgcatgccagct

SEQ ID NO: 64387 - DNA, 50 bp, homo sapien
ttagtatatttactgagggtaaaatwatgagcaaagggagagggataaaa

SEQ ID NO: 64388 - DNA, 50 bp, homo sapien
tgtgtaactaaaacaaggcagcttaygaacaaacatttaaagaaagggtc

SEQ ID NO: 64389 - DNA, 50 bp, homo sapien
agggccaagaacaagtactcagaatmagtcatttggaaaatacagattta

SEQ ID NO: 64390 - DNA, 50 bp, homo sapien
tcttacctgtcattccttaggaagaygaaacatgaataaaagcattagaa

SEQ ID NO: 64391 - DNA, 50 bp, homo sapien
tacaataaaatttgagaaccattgcyctataaagaaaaagaatgaatgtt

SEQ ID NO: 64392 - DNA, 50 bp, homo sapien
cacaaagttcaccgtagttctaagargttcaccacatggtgacttatgtg

SEQ ID NO: 64393 - DNA, 50 bp, homo sapien
agtggttgcctcactgaaaagaaacyggtagctaggaaacagggatagga

SEQ ID NO: 64394 - DNA, 50 bp, homo sapien
attttcacagtgacaccttttcttaygtcacatgaattccttatctgttc

SEQ ID NO: 64395 - DNA, 50 bp, homo sapien
tcaagacttaaattattgaacaaagwattttggaaagcttaatatgccct

SEQ ID NO: 64396 - DNA, 50 bp, homo sapien
taagaggccctagggtgatgctaaayggcaaattagatacatgtctgctg

SEQ ID NO: 64397 - DNA, 50 bp, homo sapien
ggaacagagtatactggttaattgarcttctgattaagtatgggttaatg

SEQ ID NO: 64398 - DNA, 50 bp, homo sapien
tgtacttagattgtgttgctgagaartcaaaggtctcttcaacttcagca

SEQ ID NO: 64399 - DNA, 50 bp, homo sapien
atcataaggatggaaagagcttggaragttctcacaacaagaggccagtg

SEQ ID NO: 64400 - DNA, 50 bp, homo sapien
gcagaatttgtataaggaatagagayggtacacatggagcactcaccttg

SEQ ID NO: 64401 - DNA, 50 bp, homo sapien
ctttccatccttatgatggttcttayggtcttcaaatttgctgcttattt

SEQ ID NO: 64402 - DNA, 50 bp, homo sapien
ttcacatggaccacctataggagaayctgtagcacagccttgtaagatgc

SEQ ID NO: 64403 - DNA, 50 bp, homo sapien
gatgtctttcagtttttatggaacaycacctctggaaattcaaaagatct

SEQ ID NO: 64404 - DNA, 50 bp, homo sapien
cacatgtaaaataactctcaaaaaayatggtttctctctttctcgttctt

SEQ ID NO: 64405 - DNA, 50 bp, homo sapien
aaaatgatcaaattctatacaaatarcccaatatatcataaccctttctt

SEQ ID NO: 64406 - DNA, 50 bp, homo sapien
aagctgacaccatcctacagacttgraccagttgtattaagagaaaaggt

SEQ ID NO: 64407 - DNA, 50 bp, homo sapien
caccagcccaacttgatccagccaakcttatagtaggcttatgtacattt

SEQ ID NO: 64408 - DNA, 50 bp, homo sapien
aaaatatagcacagcatgttgcatamagaaagtgtgtcattaagaagggg

SEQ ID NO: 64409 - DNA, 50 bp, homo sapien
tatcttaagtaggttttcacatttargagctattttgaaataaaacctaa

SEQ ID NO: 64410 - DNA, 50 bp, homo sapien
tcaataggtttatgtttaagtagaasaaatacatatatggatgattgttc

SEQ ID NO: 64411 - DNA, 50 bp, homo sapien
gtacatgttctatgcatgtatatgayatttatttctatgggtttgtagat

SEQ ID NO: 64412 - DNA, 50 bp, homo sapien
aacagagtttaaaaaaagaaatatayggtaatgattgatgggaagtgaaa

SEQ ID NO: 64413 - DNA, 50 bp, homo sapien
tcagttttacttatactatcttaaayggactgaacagatacatttagcag

SEQ ID NO: 64414 - DNA, 50 bp, homo sapien
agatgtttgtggtgaggagtgaatcratgtttccattattgtgcctttga

SEQ ID NO: 64415 - DNA, 50 bp, homo sapien
tgggggtttttctgcacatgtgtcakcttgattagccccaaggtgccttc

SEQ ID NO: 64416 - DNA, 32 bp, homo sapien
tatatttatgtcctgcygattgagtatattca

SEQ ID NO: 64417 - DNA, 50 bp, homo sapien
gatcctaccatgtctcagatgatccrcattagaccaagtggtgggggagg

SEQ ID NO: 64418 - DNA, 50 bp, homo sapien
tctccatcattcttccttataatcaygcttcgactctcccctccaggacc

SEQ ID NO: 64419 - DNA, 50 bp, homo sapien
gatgacattaatgattaaggtgaagmagaattataattcagaggcctttt

SEQ ID NO: 64420 - DNA, 50 bp, homo sapien
aagttatttttaaacttagattaaaygcatattattgatataggataatg

SEQ ID NO: 64421 - DNA, 50 bp, homo sapien
gcaaggctagaaccctgatttccaarcccatcattaaaacctgtgccatg

SEQ ID NO: 64422 - DNA, 50 bp, homo sapien
aaaatggagctgagaggaggttaaakaagatattgcaagagatctagctt

SEQ ID NO: 64423 - DNA, 50 bp, homo sapien
taatccgagatgcagtggatagttayataagtattttcagcaccattaag

SEQ ID NO: 64424 - DNA, 50 bp, homo sapien
aaccaggacacagaagaacaggaatwattcttcagacctgcagtatatgt

SEQ ID NO: 64425 - DNA, 50 bp, homo sapien
cattttaaaaaattatctggaaaacratcatggctacaccagcctttttt

SEQ ID NO: 64426 - DNA, 50 bp, homo sapien
tcagaaatatcgacttcctgtcctaygaaccaagagattgtgatttaata

SEQ ID NO: 64427 - DNA, 50 bp, homo sapien
tctcttctgtatctcttcagacaacsaaacgcctgtttttgtaaaataaa

SEQ ID NO: 64428 - DNA, 50 bp, homo sapien
aaaccaacaggttctactcaaccacrctttacttcctgctttcttgtgga

SEQ ID NO: 64429 - DNA, 50 bp, homo sapien
aatattttggcttagtgtctgatagraatccctgtaaaattgtggattgt

SEQ ID NO: 64430 - DNA, 50 bp, homo sapien
tggcatgcttgggaatgtacaaaacygacaaagggctcagaaacttgtga

SEQ ID NO: 64431 - DNA, 50 bp, homo sapien
taccctttctctagtctaaatggaargcagaattacacagttaaccaaag

SEQ ID NO: 64432 - DNA, 50 bp, homo sapien
tattctgtgcttattggcaaacgaayggactgcagtaactcccaattgct

SEQ ID NO: 64433 - DNA, 50 bp, homo sapien
ataacatcctacctttcatcttaccygcacatggctaccaggaccatgat

SEQ ID NO: 64434 - DNA, 50 bp, homo sapien
gagtgacataaagtccttaacattayctcctcgtggttacagatcagcat

SEQ ID NO: 64435 - DNA, 50 bp, homo sapien
cagagtcagtgtcttgtaatttcagyagaaaaatctaactcactagcctc

SEQ ID NO: 64436 - DNA, 50 bp, homo sapien
agatggacaataatgaaaatatcaaytctatctaggatttcctgtatatt

SEQ ID NO: 64437 - DNA, 50 bp, homo sapien
ctttccacatctatattccttttcayggatttataaagagatgttctaga

SEQ ID NO: 64438 - DNA, 50 bp, homo sapien
agtgttattgttacttgcactagaargcagggaatagcattatttatata

SEQ ID NO: 64439 - DNA, 50 bp, homo sapien
aagcaggctcaagctgcagttcaggyagccctgtcatttgtaccacatga

SEQ ID NO: 64440 - DNA, 50 bp, homo sapien
ccatactagagtttttacactacaawcagcgcagacataggtttttcttt

SEQ ID NO: 64441 - DNA, 50 bp, homo sapien
aattcatctcaatttcctcagtaaaytcctttagctcaggagagaaacat

SEQ ID NO: 64442 - DNA, 50 bp, homo sapien
ttaaaacccatcttctgcaaattcakctcaatttcctcagtaaactcctt

SEQ ID NO: 64443 - DNA, 50 bp, homo sapien
acaggttttagggtagagaagaaggyaaaatgcaagcagatttatgtcta

SEQ ID NO: 64444 - DNA, 50 bp, homo sapien
aatatgtgtaagagaagagatttgaygcaggatatgtgtgcattttgtat

SEQ ID NO: 64445 - DNA, 50 bp, homo sapien
gatggctcacactcaggtgaaaagayagccagctgaatgtgtgtgtgtgt

SEQ ID NO: 64446 - DNA, 50 bp, homo sapien
agaatccctaaaatcaatatttcccmaagagtttcttatatttcagatgt

SEQ ID NO: 64447 - DNA, 50 bp, homo sapien
aaaataatcaaactgtattatgagayatgagtaataatatctgttaaaaa

SEQ ID NO: 64448 - DNA, 50 bp, homo sapien
gtcaggtccctaaaatatgaaacacygaaatcagacatccagctgttaga

SEQ ID NO: 64449 - DNA, 50 bp, homo sapien
cgaaggcacagaaattaaataactcyctgaagtatgtacagcaaggaaga

SEQ ID NO: 64450 - DNA, 50 bp, homo sapien
gttactcatggccgctgacctagaawgagtcttgaacccagattaggcct

SEQ ID NO: 64451 - DNA, 50 bp, homo sapien
tacacctttactgtcctacctcaggratctataaattctccaggtctatg

SEQ ID NO: 64452 - DNA, 50 bp, homo sapien
tcagacaaccaagattgaccgtggckcttttcagttaatccactttgcca

SEQ ID NO: 64453 - DNA, 50 bp, homo sapien
gattttattttttcatttaatagtamggagatttcagattctaaattttt

SEQ ID NO: 64454 - DNA, 50 bp, homo sapien
aaggttaaaggatgaatggacaacargaattcagccctgtccccaataga

SEQ ID NO: 64455 - DNA, 50 bp, homo sapien
ctcaccacagacaacacgtgggctcyatgagtactgaggttctagattag

SEQ ID NO: 64456 - DNA, 50 bp, homo sapien
caggcctcccaactcaacacatctargactgaatccatcatcttcctccc

SEQ ID NO: 64457 - DNA, 50 bp, homo sapien
cacctgcatgtcttcttttctggtaycacagttctcaagaaagttcttac

SEQ ID NO: 64458 - DNA, 50 bp, homo sapien
cattgtaagattaatttagttaataygtgaaaaagtttagaagagtccct

SEQ ID NO: 64459 - DNA, 50 bp, homo sapien
ataagccctgtgtgtagcgattacakagtctcattgaagttttacaacac

SEQ ID NO: 64460 - DNA, 50 bp, homo sapien
aaatgtgtagaactgttaactgagayggcttcgagtcttccttctggaat

SEQ ID NO: 64461 - DNA, 50 bp, homo sapien
ctgcagaggtgatggtgaattgttarcccttctcaatagtttatgaacag

SEQ ID NO: 64462 - DNA, 50 bp, homo sapien
aacctaaacttggatcaagatcatartaagattctctgggttgttactgc

SEQ ID NO: 64463 - DNA, 50 bp, homo sapien
tgggttgttactgctgtgaatagaargtcctaaattccaaatggacaggg

SEQ ID NO: 64464 - DNA, 50 bp, homo sapien
ttgcaagaaagaaaagattccaatgyatataaggcagaaaccaatggcaa

SEQ ID NO: 64465 - DNA, 50 bp, homo sapien
gtccagaatgagtcaacactcaacasatacgagatgtttcaaacaccttt

SEQ ID NO: 64466 - DNA, 50 bp, homo sapien
agccgggttggattttctagccccaygctttacagatgttcagatttctt

SEQ ID NO: 64467 - DNA, 50 bp, homo sapien
agaagagcagtaagtttgcttctcartaaagggttaggacccagtggggg

SEQ ID NO: 64468 - DNA, 50 bp, homo sapien
tgtctgggctatcagactctatgacrcctcattcagaagattctacaccc

SEQ ID NO: 64469 - DNA, 50 bp, homo sapien
gtacagtggtacctagaacctttcayagtttcagactcagtgctcagatc

SEQ ID NO: 64470 - DNA, 50 bp, homo sapien
ccctctaggtccttcctccttgactytggatttaaagcttttttaggaat

SEQ ID NO: 64471 - DNA, 50 bp, homo sapien
atgttaagcttcttgcttctggacgyatagatgagagcaaacccatatgc

SEQ ID NO: 64472 - DNA, 50 bp, homo sapien
ctcggcactaactcttggagatacaycttattagccttcccagggtgcta

SEQ ID NO: 64473 - DNA, 50 bp, homo sapien
tgacaggtgtgaggtccaggtacacycggtcagattctctctcatttggg

SEQ ID NO: 64474 - DNA, 50 bp, homo sapien
aatttgcccattcaacagctgtcagsctctttttggaaataataggggtc

SEQ ID NO: 64475 - DNA, 50 bp, homo sapien
atcaaagtcctggtgaaaaacaaacrtcatgctcaaatgaggtaatggaa

SEQ ID NO: 64476 - DNA, 50 bp, homo sapien
ataatcataataaacacttccattgsaaatagaaagatggacacatatag

SEQ ID NO: 64477 - DNA, 50 bp, homo sapien
ttgcccagtaagtaaatacatgaagraaatatactaatactgtggagtag

SEQ ID NO: 64478 - DNA, 50 bp, homo sapien
ctaggtacaaggaaggtaagaaatayagcagtaaccaacaggaactatgc

SEQ ID NO: 64479 - DNA, 50 bp, homo sapien
atttgataaatgaatggtgcataaarggaaaggatcttctcccattcata

SEQ ID NO: 64480 - DNA, 50 bp, homo sapien
tctgagggatatgagagatgttatakagaacagaaattagttgcagttat

SEQ ID NO: 64481 - DNA, 50 bp, homo sapien
caaacagacataatagtagcaaaackcagaatatcttcagtgctttatag

SEQ ID NO: 64482 - DNA, 50 bp, homo sapien
acttctatcgatttccaatacaaccmatatgtctttgcacctctgtgtgc

SEQ ID NO: 64483 - DNA, 50 bp, homo sapien
tcttgtgtgatcctagcccttagtcrcagttcactggagctgaacaaagc

SEQ ID NO: 64484 - DNA, 50 bp, homo sapien
ctgtgctgagatgctcggatggaaayggacacgtgcagcacacagtgggt

SEQ ID NO: 64485 - DNA, 50 bp, homo sapien
gactaatagtttaataaagggacacsgcaagtttctaatagagagaggtt

SEQ ID NO: 64486 - DNA, 50 bp, homo sapien
ttcactgctctgtctccagcagttasggttcattcttaggttctgaaatc

SEQ ID NO: 64487 - DNA, 50 bp, homo sapien
atacctcgaatcttactacaacagtraacttaacacaaaaaaggacattt

SEQ ID NO: 64488 - DNA, 50 bp, homo sapien
agaggcgagggcccagctagccaaayttaggtccaccattgcttggctct

SEQ ID NO: 64489 - DNA, 50 bp, homo sapien
tgtgttcgtgattccgaatcctaaawacaaccgtcctaggcttgtctctc

SEQ ID NO: 64490 - DNA, 50 bp, homo sapien
aaagagatcatgaggaaaataaaagyttataactcataatatggatcaaa

SEQ ID NO: 64491 - DNA, 50 bp, homo sapien
tttaatctccaaatccaacaaaacaytccacggcccattgtcaggagcac

SEQ ID NO: 64492 - DNA, 50 bp, homo sapien
gcccacctcaaggagtctttgcaacycaaaagtcacaaatgtctctggga

SEQ ID NO: 64493 - DNA, 50 bp, homo sapien
tgtgcaaacttggagatctcaattcwgaattacttatagaaatttaagac

SEQ ID NO: 64494 - DNA, 50 bp, homo sapien
tcatgttcacaacatcactgaacacmggtattattattcctatcttctag

SEQ ID NO: 64495 - DNA, 50 bp, homo sapien
actttggcctccttccctgctttaaytgattgatctcatcatgaggaaga

SEQ ID NO: 64496 - DNA, 50 bp, homo sapien
cactactttagctatatctttttacmatagtttgaaattattatacatat

SEQ ID NO: 64497 - DNA, 50 bp, homo sapien
ttgccaggggtaaaaaaaagccatcygtctggcattgcacaatccagcac

SEQ ID NO: 64498 - DNA, 50 bp, homo sapien
gcctaacttaaatcataaaattaatraaaatcaggcatcttaagagctta

SEQ ID NO: 64499 - DNA, 50 bp, homo sapien
aagatgaatgtgtataatggtcttamagggatggagagtcaatatgggga

SEQ ID NO: 64500 - DNA, 50 bp, homo sapien
tgagtttcatgtattttctccattaygagatgagctcttagaggacagag

SEQ ID NO: 64501 - DNA, 50 bp, homo sapien
agtatgacaaccttacatgtcctacragaatgaaaacccgttgttatttt

SEQ ID NO: 64502 - DNA, 50 bp, homo sapien
ttattatttactatttaaaaactgcmaaagtgtatagaaagtgggtagag

SEQ ID NO: 64503 - DNA, 50 bp, homo sapien
agggcagacccacttgttaacattaygactgtattgcattttagggcagg

SEQ ID NO: 64504 - DNA, 50 bp, homo sapien
tccccagggcttttggaggaatatakaagagtttggcgaaggggccttga

SEQ ID NO: 64505 - DNA, 50 bp, homo sapien
ggggattaggatttggacatttccckttaggaaccacgattcagcccact

SEQ ID NO: 64506 - DNA, 50 bp, homo sapien
ctggaagaatgttgaaggcagatcargttagtaatatgtttccttggaca

SEQ ID NO: 64507 - DNA, 50 bp, homo sapien
ctacttgcttagagggctccactatsaaagtaaagttcataccatccttg

SEQ ID NO: 64508 - DNA, 50 bp, homo sapien
tgaaggctttggaaaccaattccaaycattgaagaaatttgaaattattt

SEQ ID NO: 64509 - DNA, 50 bp, homo sapien
atgttcagctttctgcctctgatgcmttaccatatagaatccggctcttt

SEQ ID NO: 64510 - DNA, 50 bp, homo sapien
gacagagtgagactctgtctaaaaartaaataaatgagactttgtcagct

SEQ ID NO: 64511 - DNA, 50 bp, homo sapien
caactagttcagaaattttcgtactkaatcaacaagaagttacttgcaat

SEQ ID NO: 64512 - DNA, 50 bp, homo sapien
gctccagggcttatgctcttaccaastcaatttaatccaacatgcttcat

SEQ ID NO: 64513 - DNA, 50 bp, homo sapien
aatgtttttaatggcatagctagtcmcaaagatttatcaattgctttact

SEQ ID NO: 64514 - DNA, 50 bp, homo sapien
tgatctctagaaatcattgctgtaaycacaggatggaaaatacagtcaac

SEQ ID NO: 64515 - DNA, 50 bp, homo sapien
catgttatctccctacatcctcagarcaacaacgtgatcgtatgtacatg

SEQ ID NO: 64516 - DNA, 50 bp, homo sapien
attataacaaagaagcactacagaarttcaatgtgggcggcaaaattctt

SEQ ID NO: 64517 - DNA, 50 bp, homo sapien
tgtcctgggaagcagttatgtttctyggaagcagtttaatctcttgagta

SEQ ID NO: 64518 - DNA, 50 bp, homo sapien
ttctatggattcaggagagtttgccwctatctccctttacaggtgtacca

SEQ ID NO: 64519 - DNA, 50 bp, homo sapien
ctcagaacttagcatccgccaggaawtcgcaaacatctgccggcctatgt

SEQ ID NO: 64520 - DNA, 50 bp, homo sapien
tggtctagacatgcaagaagcgcacrggaattttaacagcaaatacttct

SEQ ID NO: 64521 - DNA, 50 bp, homo sapien
caaataaggtgaattcaaacagggaygaatgaagaaaatatctcagggtg

SEQ ID NO: 64522 - DNA, 50 bp, homo sapien
ccagtccattagcagcaacgtcaggkattgaattcttagggcagcaggct

SEQ ID NO: 64523 - DNA, 50 bp, homo sapien
atttagtggtagagtcagtgtaaaartaccagaatccaggcacgatttcc

SEQ ID NO: 64524 - DNA, 50 bp, homo sapien
aagagaatgtcactgatgattttgayactaactaaactgttaagtggagc

SEQ ID NO: 64525 - DNA, 50 bp, homo sapien
agactcttagaggactggagtatgarattagaaaattgaagtcacttttc

SEQ ID NO: 64526 - DNA, 50 bp, homo sapien
catatgttaaatctgtgttctttaayatatatgcattcttgagcaagata

SEQ ID NO: 64527 - DNA, 50 bp, homo sapien
ctactttatctccagtactcggtaartctaggcattcaatgacaatgaat

SEQ ID NO: 64528 - DNA, 50 bp, homo sapien
taaacatttgcaattgatttaatgayaggaaatgctaatgttgaacccca

SEQ ID NO: 64529 - DNA, 50 bp, homo sapien
tgtagattagagaagcaatataatamatatgcaaagcacagtggtcctct

SEQ ID NO: 64530 - DNA, 50 bp, homo sapien
atggaagaataactaaaataacttaygtggaccttatttctaaaacagaa

SEQ ID NO: 64531 - DNA, 50 bp, homo sapien
ccccagtgctgccatcccgcacagcyacgtttccacagtggattatctct

SEQ ID NO: 64532 - DNA, 50 bp, homo sapien
tcattttcgtagccaatatttgaaartgactacaaatcatgtgcctctcc

SEQ ID NO: 64533 - DNA, 50 bp, homo sapien
taaaagaatcatctctgttcacaatkattactactgataccaccactatt

SEQ ID NO: 64534 - DNA, 50 bp, homo sapien
accactattattgctactgctatacrcaaccacacaatcaaacatacaca

SEQ ID NO: 64535 - DNA, 50 bp, homo sapien
atttatcccacaatgcttagtatcayctgcgtacaatgctaggtactagg

SEQ ID NO: 64536 - DNA, 50 bp, homo sapien
atactgtatgttttttgaataatgayaaaagcatgtaacataacacaaac

SEQ ID NO: 64537 - DNA, 50 bp, homo sapien
agagatgggacaccacgagggattargcaccagctagataagagccctgg

SEQ ID NO: 64538 - DNA, 50 bp, homo sapien
ttgggtgaacatgggaaaatggaaasaacagccagagaaggtgaacatag

SEQ ID NO: 64539 - DNA, 50 bp, homo sapien
tcctgctagaattttgaagtgtcttraaatttcccaggattctttatttt

SEQ ID NO: 64540 - DNA, 50 bp, homo sapien
catggtccattctctgctaggtttaygaggacttgaaatcatcagaaaag

SEQ ID NO: 64541 - DNA, 50 bp, homo sapien
ttcctaagcaactaaaatcagcccawtgaagaaaatagttaacatcagca

SEQ ID NO: 64542 - DNA, 50 bp, homo sapien
tgagctgtattttagaaaattatgcrcaattaacaataagataatgacaa

SEQ ID NO: 64543 - DNA, 50 bp, homo sapien
tggctaatgtgtagatcattaactcrggtctgactcacattaaattttgt

SEQ ID NO: 64544 - DNA, 50 bp, homo sapien
aagacattgagggtgatagctctcaraaacttaatactgcttaaacacta

SEQ ID NO: 64545 - DNA, 50 bp, homo sapien
gcctgtaagcacagaaatggtaacaytagtatttgagaaacattattcta

SEQ ID NO: 64546 - DNA, 50 bp, homo sapien
ccactgtagattagttttgcctatcyaggaatttttaatgaatgaacagc

SEQ ID NO: 64547 - DNA, 50 bp, homo sapien
tgtacatgctttgttgatacctgacraaagaagtcaacaattttttttat

SEQ ID NO: 64548 - DNA, 50 bp, homo sapien
agacgcagtgataatgttctacaagwcactgacctaattttatgtacaaa

SEQ ID NO: 64549 - DNA, 50 bp, homo sapien
tattcccacccagagcccagtgtaaytgctttattgtatcaaattattgt

SEQ ID NO: 64550 - DNA, 50 bp, homo sapien
aataaaatttacagaatttaaaataygccatagtccctgataataataga

SEQ ID NO: 64551 - DNA, 50 bp, homo sapien
gaggtggatcctttgaatggtatcamcttatgactgaattgggcattcca

SEQ ID NO: 64552 - DNA, 50 bp, homo sapien
atttatcagctgactgggatggcatmaaccccaaccagctccctgttccc

SEQ ID NO: 64553 - DNA, 50 bp, homo sapien
tatcctgcaaagatatctgtgttgaraatattactggaaaaatcatttag

SEQ ID NO: 64554 - DNA, 50 bp, homo sapien
aagtgactcatactattaagaatccrgatccaataaactggtaataatgc

SEQ ID NO: 64555 - DNA, 50 bp, homo sapien
tatgccagtgttcctgtgggagagcrtcctagccagggggttgtagggtg

SEQ ID NO: 64556 - DNA, 50 bp, homo sapien
gagctgtttcaaataggtcatagatraaagtgtgaaacaaacttagagaa

SEQ ID NO: 64557 - DNA, 50 bp, homo sapien
gagtctgaaagtatggctgatctgaraagtggcaggaaaaagacagctta

SEQ ID NO: 64558 - DNA, 50 bp, homo sapien
cagcattttctagaaaacagtggtayctccattggtaaagatgattggaa

SEQ ID NO: 64559 - DNA, 50 bp, homo sapien
gcgatgtcacctctttgtcagagaascaccagctccaacttgctcatgaa

SEQ ID NO: 64560 - DNA, 50 bp, homo sapien
ttgtttggaaaataattaatcagcaytatgacaaacacatgacatagtgc

SEQ ID NO: 64561 - DNA, 50 bp, homo sapien
ttgtattcattgttactggaacttayaggccatttaaatctgtgagaaca

SEQ ID NO: 64562 - DNA, 50 bp, homo sapien
ataaaaggtaatatatgtgtaaatgraatattattctacattacaaagga

SEQ ID NO: 64563 - DNA, 50 bp, homo sapien
gtgtcacatattggtgtatcgattcytattgactttatttgtgtatggtg

SEQ ID NO: 64564 - DNA, 50 bp, homo sapien
tagctaactgcttttataatgtttamagtgaaattaacacgtagcaatta

SEQ ID NO: 64565 - DNA, 50 bp, homo sapien
aagtagctccaggaggtttcagataycatgccagagtataaatgcccttt

SEQ ID NO: 64566 - DNA, 50 bp, homo sapien
ggaacctctctcaggcaatggtcacrctaggcaaaggcttctgctacccc

SEQ ID NO: 64567 - DNA, 50 bp, homo sapien
ggaggctattaattggggccattaaktcagtcattctacaacatcctggg

SEQ ID NO: 64568 - DNA, 50 bp, homo sapien
tagaccagtggatttaccctaatgamctttttgaatttcgagggtaaaga

SEQ ID NO: 64569 - DNA, 50 bp, homo sapien
gaatgagaaaatgtaggaactaatcrgataggaggtggaggaaaggacag

SEQ ID NO: 64570 - DNA, 50 bp, homo sapien
atcatctactgttttcacttgtatcyataaagttcataaattatttagca

SEQ ID NO: 64571 - DNA, 50 bp, homo sapien
atttaaattcatttttctctaattaktaatgacaagaatgaaataatacc

SEQ ID NO: 64572 - DNA, 50 bp, homo sapien
gcaaagaacaaatactaagaaacagracatagtgcattctaggggccaga

SEQ ID NO: 64573 - DNA, 50 bp, homo sapien
gtagaagtcatgctgtgtgtaaacartataatgacaagttataaaaaatt

SEQ ID NO: 64574 - DNA, 50 bp, homo sapien
aagatgaggaaggtaaatgaaaatcycatgtttataaagatctaggatgc

SEQ ID NO: 64575 - DNA, 50 bp, homo sapien
taggtaagacactcctaagatagaargtacaaaggaagaacccagactag

SEQ ID NO: 64576 - DNA, 50 bp, homo sapien
aagctccctttgtcctggaggcatcsgaaatcggttcagatctgtttgca

SEQ ID NO: 64577 - DNA, 50 bp, homo sapien
tcttggatgtttaatttctcatcccwaatgatccttttcctattctttaa

SEQ ID NO: 64578 - DNA, 50 bp, homo sapien
gaggaggagatgactttcaaacaaamgatcaggaagatttcagggacgag

SEQ ID NO: 64579 - DNA, 50 bp, homo sapien
tggccctgactttttgttcacataaygttttcaaggttcctcgaagttgt

SEQ ID NO: 64580 - DNA, 50 bp, homo sapien
gatttttagtttttgagggtatgtgyaaatgtagataaatgggcatatgc

SEQ ID NO: 64581 - DNA, 50 bp, homo sapien
gtgtgaaccatcgcacccggccagaygaacatttttaatccataggaaga

SEQ ID NO: 64582 - DNA, 50 bp, homo sapien
cactcacatgccacatccaattctaygcaagccagtgtgggttcctcaac

SEQ ID NO: 64583 - DNA, 50 bp, homo sapien
tggaaccctttaagtattgagggatragttacagtggaaatactatagag

SEQ ID NO: 64584 - DNA, 50 bp, homo sapien
tttttcattaagtttaacttttgtcyaagttctggcaccaaacatttatc

SEQ ID NO: 64585 - DNA, 50 bp, homo sapien
acaatttttcttaagagctaaatgamcctcgttaggtggattttcctctc

SEQ ID NO: 64586 - DNA, 50 bp, homo sapien
atggaatactatacagtgaagaaaamgactactgctacattgttgcatct

SEQ ID NO: 64587 - DNA, 50 bp, homo sapien
ggcaaaatattgagagtacagagacygaagtaggtaagactaagagctct

SEQ ID NO: 64588 - DNA, 50 bp, homo sapien
tcttgggtcagagccctcaccaggakcgtggcccatcactcagcccctgc

SEQ ID NO: 64589 - DNA, 50 bp, homo sapien
ctcttcaggtcggatcataagcctcrgaacgtgtcatacatcccataaac

SEQ ID NO: 64590 - DNA, 50 bp, homo sapien
tcccctgctagaatatgccagatcaytgaaggcagatatctttgctttgt

SEQ ID NO: 64591 - DNA, 50 bp, homo sapien
gaaatattttaaaggaggactccgaycaccgagctttggtgttgatactg

SEQ ID NO: 64592 - DNA, 50 bp, homo sapien
tgaatacagaccatgctcagagttgwagtgtaaacctcttcaggtcggat

SEQ ID NO: 64593 - DNA, 50 bp, homo sapien
agctatcaccctgctgccatttgtcytccaaacttctcaaaaatgtggtt

SEQ ID NO: 64594 - DNA, 50 bp, homo sapien
caattgcctctctttccacctttgawatgcagtaaaagaaatctagagat

SEQ ID NO: 64595 - DNA, 50 bp, homo sapien
ggcaaattcacctattctataagtaygcagtgactcaacaagccttttga

SEQ ID NO: 64596 - DNA, 50 bp, homo sapien
gaatccatctcagcatgcttctccartacatcagtagtaacacaatgcta

SEQ ID NO: 64597 - DNA, 50 bp, homo sapien
tttctgcataatccctgtggtctgayctggtaattcaaaggaaaagaata

SEQ ID NO: 64598 - DNA, 50 bp, homo sapien
agtaaagaaaggaagatgcagatgcygttaaaactaagttgtggctgtca

SEQ ID NO: 64599 - DNA, 50 bp, homo sapien
taggtaacagaaaaggcgaacgcaarcataataagttgtcagccagttca

SEQ ID NO: 64600 - DNA, 50 bp, homo sapien
agtctagacagaggacaaaaatgaasgcaacctcacagacgaagctccaa

SEQ ID NO: 64601 - DNA, 50 bp, homo sapien
aatgtgggaatacgcacaatttcaayttaataatagatacttatggcttt

SEQ ID NO: 64602 - DNA, 50 bp, homo sapien
caggacaaatacaactctacttttcycaataggaggtaaacttgtgtgac

SEQ ID NO: 64603 - DNA, 50 bp, homo sapien
gaaggcttttttgaggatattgttayggctttcagaatcacggagctccc

SEQ ID NO: 64604 - DNA, 50 bp, homo sapien
attaaagtgaaaaggtaaggtaaatsatcagcttttcacagtaatagaaa

SEQ ID NO: 64605 - DNA, 50 bp, homo sapien
atttgcctagagcttcaagacagtcrctatctatgaattgctggaaaaaa

SEQ ID NO: 64606 - DNA, 50 bp, homo sapien
aaatctttttgagatgcatacattaygttgattcatggaaattattcata

SEQ ID NO: 64607 - DNA, 50 bp, homo sapien
gtagagacagggtctcactaaaaaaytatgttgcctaggctagtcttgaa

SEQ ID NO: 64608 - DNA, 50 bp, homo sapien
ttacaaaaatatgtttttgattccaytgatggtcagttacaagcgataac

SEQ ID NO: 64609 - DNA, 50 bp, homo sapien
attatataaattactaacagttttayaagcagaaaatgtacatgctattt

SEQ ID NO: 64610 - DNA, 50 bp, homo sapien
ttgactcatatactacgcactgtttygtgtaaggctttttccactcagtg

SEQ ID NO: 64611 - DNA, 50 bp, homo sapien
ggaggaaagggtgggcgaaggagccragagtaagacaagccgaagggtgg

SEQ ID NO: 64612 - DNA, 50 bp, homo sapien
aaaccgcaaccatatttaccgccttsaaggacagaaaacagaaagattta

SEQ ID NO: 64613 - DNA, 50 bp, homo sapien
ggtgaacatacaggtacattgcaaakcattaggaggaaaagtacttcata

SEQ ID NO: 64614 - DNA, 50 bp, homo sapien
aaaaaatgtgagtgtgtgcatagaayatttggtaagcattattgtctctg

SEQ ID NO: 64615 - DNA, 50 bp, homo sapien
tcagtgagtgaaccactacatgtaartataacaaggtagatggatttcaa

SEQ ID NO: 64616 - DNA, 50 bp, homo sapien
gaagaaacaaaatcatctgaggagcraaagtatgcagtagatttattgtt

SEQ ID NO: 64617 - DNA, 50 bp, homo sapien
catactctgctgaccaaaatttaaaygctagctaaaaaggattctgggaa

SEQ ID NO: 64618 - DNA, 50 bp, homo sapien
ttatccaaggttttataagatctctsaagttgcaaatgtagattttcaat

SEQ ID NO: 64619 - DNA, 50 bp, homo sapien
gttagggccaggatgctgtgattggratacaaaatattcagccccaaacc

SEQ ID NO: 64620 - DNA, 50 bp, homo sapien
atgggctactttttctaattctttaygtgcttggtaatttgtgagtggat

SEQ ID NO: 64621 - DNA, 50 bp, homo sapien
gagtaaattacgctcccaatgaacawctcttcactattacttaagactga

SEQ ID NO: 64622 - DNA, 50 bp, homo sapien
taacacatatgcccctgggtgaatgkataagcaacaagcaacgtgtgatg

SEQ ID NO: 64623 - DNA, 50 bp, homo sapien
agttcttcaaggaacatgttgaaaartgatgttataaaaaagatagagcc

SEQ ID NO: 64624 - DNA, 50 bp, homo sapien
aggtccttataatttctctgggtaakatttggtttgaattaaagctaaga

SEQ ID NO: 64625 - DNA, 50 bp, homo sapien
taatagagcaagtggaaaaaactgayggtattcaagatatatttttaatc

SEQ ID NO: 64626 - DNA, 50 bp, homo sapien
ggtagcaaagtaactggtgccaatcmaagcaggtgagctttcttcctctc

SEQ ID NO: 64627 - DNA, 50 bp, homo sapien
gttggaggcacaaattgtctgttaarctcagtggaagcgaagtcactcaa

SEQ ID NO: 64628 - DNA, 50 bp, homo sapien
cataaaatatgatattttggtccagraggctgtaactgtaaatgagacat

SEQ ID NO: 64629 - DNA, 50 bp, homo sapien
gacagatgttaacaaggatatcaaaygttaggtagtgagacaggatggag

SEQ ID NO: 64630 - DNA, 50 bp, homo sapien
tgaatttggtgaaaaactacgtttamaaatacacattatgggtcacattt

SEQ ID NO: 64631 - DNA, 50 bp, homo sapien
aatactcagaagatagctgcagcaargtaattgtcctcgttacaggagtc

SEQ ID NO: 64632 - DNA, 50 bp, homo sapien
gtacatcaccattctttggtttgtamacatattcctctcttcagtgtcag

SEQ ID NO: 64633 - DNA, 50 bp, homo sapien
aaaagatatctaaagctggtcttcargcgttttcagaaaattctacacag

SEQ ID NO: 64634 - DNA, 50 bp, homo sapien
tctgtttctagaaattatcaggaagratcatgagagtatcctgagttaag

SEQ ID NO: 64635 - DNA, 50 bp, homo sapien
atgataaaatggtgtttcagtaacgraagtatggcagcagaaatccacgt

SEQ ID NO: 64636 - DNA, 50 bp, homo sapien
ggtttggcaaaggttcttaaaatgasgcacaaaaagcacaaattctacaa

SEQ ID NO: 64637 - DNA, 50 bp, homo sapien
gatcagtctatttcagccaatctaaygaattctttacatatgagacctgt

SEQ ID NO: 64638 - DNA, 50 bp, homo sapien
ttctgtggccagctgtatggacttckaagtggataatatataaatagggg

SEQ ID NO: 64639 - DNA, 50 bp, homo sapien
ttctacccactgtttttgtttagtawtgatgccttgcagtcctaatgatc

SEQ ID NO: 64640 - DNA, 50 bp, homo sapien
gctcttcatgaatattcctttcataygtgagctacacagaactgggcttc

SEQ ID NO: 64641 - DNA, 50 bp, homo sapien
tagaaggagaggaaaatctaagagasgccaagtaacacagttaagagaaa

SEQ ID NO: 64642 - DNA, 50 bp, homo sapien
cagggtgaatcattttatgtctaaaycaattgctcaaagtttacttcata

SEQ ID NO: 64643 - DNA, 50 bp, homo sapien
cctccagcagcctttcaacacatgcrctgcacacatgcccccatgtgtct

SEQ ID NO: 64644 - DNA, 50 bp, homo sapien
atttgctgcacgtctaaagggcacayggtatattattcagccttagaaaa

SEQ ID NO: 64645 - DNA, 50 bp, homo sapien
attatccttttgtgaacttcaaacakaccgtgtcaacgtttctccttgcc

SEQ ID NO: 64646 - DNA, 50 bp, homo sapien
atgtgattcatcaaaagaataagcawcagaaagtcagtctcctatacgtc

SEQ ID NO: 64647 - DNA, 50 bp, homo sapien
actgacttcttcaagccaaaattaaygtataagcagatggcctttggact

SEQ ID NO: 64648 - DNA, 50 bp, homo sapien
aattaaagctttctctttttattackaaatttcattgacaattaaaaatg

SEQ ID NO: 64649 - DNA, 50 bp, homo sapien
ggaattggtcagcattactgaatacygccaggaagtcagtgaggaaaagc

SEQ ID NO: 64650 - DNA, 50 bp, homo sapien
tcttgactatgactccttcatctgamaaaccctcagtgaaacatcttctg

SEQ ID NO: 64651 - DNA, 50 bp, homo sapien
cattaccaatataatggcaacttaaratacgaagcttttgatgaaattgt

SEQ ID NO: 64652 - DNA, 50 bp, homo sapien
gaatctgcaaatctatgtctttcagyaagtttaggaaattttggatcatt

SEQ ID NO: 64653 - DNA, 50 bp, homo sapien
ctctcctctacctagcaactcagccragaggatgttttcagagaaactct

SEQ ID NO: 64654 - DNA, 50 bp, homo sapien
ttttatttttcccctcagtaagactktaccattcatcattacaggaaaag

SEQ ID NO: 64655 - DNA, 50 bp, homo sapien
cctcctgtgaatcgctctgaataaartgttcccagctgaggttttggagt

SEQ ID NO: 64656 - DNA, 50 bp, homo sapien
ggataatattctttgcatgtacacawtatgttttctttatccattcatct

SEQ ID NO: 64657 - DNA, 50 bp, homo sapien
ggtattgtaaatttgatcctaaatcmaagggtatccctagaaggacccac

SEQ ID NO: 64658 - DNA, 50 bp, homo sapien
atcaaagggcatcaaggggaaaaaaygatatgtaatgactgacattaacc

SEQ ID NO: 64659 - DNA, 50 bp, homo sapien
gggctcttttctggaaaagggattaygctggatctgagtggacctagggg

SEQ ID NO: 64660 - DNA, 50 bp, homo sapien
tgcaaatgtctgctcataactgttasgattatactgtcttccagtagttg

SEQ ID NO: 64661 - DNA, 50 bp, homo sapien
gcaagggcgataaaatgttctaggasatccactaggagatacaggagggg

SEQ ID NO: 64662 - DNA, 50 bp, homo sapien
gaaagcaaaatccaaaaatattaaamagatgcaagctgtcattcaagcaa

SEQ ID NO: 64663 - DNA, 50 bp, homo sapien
ctaaaaagagctggcaaaagcccaaygaatctgaaaacagtttaaaatga

SEQ ID NO: 64664 - DNA, 50 bp, homo sapien
tctttttggttggcagggctttttcrcagaagaatacacgggtactatcg

SEQ ID NO: 64665 - DNA, 50 bp, homo sapien
gaggcagaatttgtcatactgcactyagatgctttcaaaggaaaaaaaat

SEQ ID NO: 64666 - DNA, 50 bp, homo sapien
ttaaattggtagactgagtaaagaaratcatgttcaccaacacgggtggg

SEQ ID NO: 64667 - DNA, 50 bp, homo sapien
gccgaccgccacacacctgtacatgraaagttacgtggaaggcgtcccct

SEQ ID NO: 64668 - DNA, 50 bp, homo sapien
agctgtccactaatacatattaaaakgtcccattggttgacgaagggaag

SEQ ID NO: 64669 - DNA, 50 bp, homo sapien
catctttcatatatgttcataattcyaaactacagatataaaattcaatg

SEQ ID NO: 64670 - DNA, 50 bp, homo sapien
aaaacaacatcatatttaaacttcaygcagatttattctctttttttttt

SEQ ID NO: 64671 - DNA, 50 bp, homo sapien
attgaagacaatagtgtttttgataygtgaataagtatctccatgtgtaa

SEQ ID NO: 64672 - DNA, 50 bp, homo sapien
aaaattgtcaccctataaccacaaasagcatttaagcatttcaatatgtc

SEQ ID NO: 64673 - DNA, 50 bp, homo sapien
tgccaactcaaataagtctgtccatraaattcccttttctcccctcagaa

SEQ ID NO: 64674 - DNA, 50 bp, homo sapien
aaacataagcaatctgtcaacaattsaatgtcagtgtaatcctttctttt

SEQ ID NO: 64675 - DNA, 50 bp, homo sapien
tggggtagctgctgtcattttaggaygggcctcagactaaacagaactaa

SEQ ID NO: 64676 - DNA, 50 bp, homo sapien
agcacttccgatataccatgcactaygctcggtgcagcacaagttgtaaa

SEQ ID NO: 64677 - DNA, 50 bp, homo sapien
cccttctctaccacattcatctatcrctagttagagcataatgggatgga

SEQ ID NO: 64678 - DNA, 50 bp, homo sapien
tgggtaactgaggctgaccctgcctstcttatattcttactctagaatgg

SEQ ID NO: 64679 - DNA, 50 bp, homo sapien
gagtgtttcccactgtaaacctgaaygtaaagaagaattaaaagcacagt

SEQ ID NO: 64680 - DNA, 50 bp, homo sapien
ttccaaacttcctagaaacctttgaktatcaagatccacatttgcttctc

SEQ ID NO: 64681 - DNA, 50 bp, homo sapien
gattcttaagtctctggccaaaacartctttgtcattcttctactgccaa

SEQ ID NO: 64682 - DNA, 50 bp, homo sapien
ccttagagtgattttgttgatgacartattttaagttatcaaaataaata

SEQ ID NO: 64683 - DNA, 50 bp, homo sapien
gcttaccctaaatcatacaactaggsatatggcaaactcaggaaaaaaag

SEQ ID NO: 64684 - DNA, 50 bp, homo sapien
caaaaggtcctcagcctccatcaatrttagagaaatgcaaattaaccatc

SEQ ID NO: 64685 - DNA, 50 bp, homo sapien
tttgcaaatgaagcctactgcatcarcttaggtcatatgttacaataaaa

SEQ ID NO: 64686 - DNA, 50 bp, homo sapien
acaactacataaatattcttgtagcrgattcagacagtgtagcagtaggt

SEQ ID NO: 64687 - DNA, 50 bp, homo sapien
gaaaggaagtgggtaactaggggtcrtgtcttgaagctacatttgcaaat

SEQ ID NO: 64688 - DNA, 50 bp, homo sapien
ccactactagtttcccgatggcacaktctcctgctcaagctcagctgtct

SEQ ID NO: 64689 - DNA, 50 bp, homo sapien
tttgattttggccttctaagacctasaacagaaaaaccaagggagcttcc

SEQ ID NO: 64690 - DNA, 50 bp, homo sapien
ttttaggtgagtgtggttacgaaaaygggatgatggagcctttgacaact

SEQ ID NO: 64691 - DNA, 50 bp, homo sapien
gtaaaaaattgacatgtttcattttrgtaaccttgaactaatattcagca

SEQ ID NO: 64692 - DNA, 50 bp, homo sapien
tgtcagtattaaaaaataaatatacsaacagtacaagccagggaacataa

SEQ ID NO: 64693 - DNA, 50 bp, homo sapien
ttctagaaggataccagttagtgtcmagtgaatggattagctgactgcca

SEQ ID NO: 64694 - DNA, 50 bp, homo sapien
aagatatatggatgcttataaggagraagtgttagaatgttgtaggattt

SEQ ID NO: 64695 - DNA, 50 bp, homo sapien
gaatgtcccagactggagattacagygcattctttctagcactaaagaca

SEQ ID NO: 64696 - DNA, 50 bp, homo sapien
gtggggaggacaaaaaaagtcttcayaaaattgttgtctgtcttgctgag

SEQ ID NO: 64697 - DNA, 50 bp, homo sapien
tacagctcagctgggcttcagggccyaaatttctggctcaaatcctagct

SEQ ID NO: 64698 - DNA, 50 bp, homo sapien
ttttctggtttctttctctgtggaakttcaacaactcagcctgtgctgtt

SEQ ID NO: 64699 - DNA, 50 bp, homo sapien
ggatgaagaggctgcactgaggttasagaaatggtgccttcatggtccca

SEQ ID NO: 64700 - DNA, 50 bp, homo sapien
taaggatataatttcaatagaaaagycaatcctttaagtggaatcagttt

SEQ ID NO: 64701 - DNA, 50 bp, homo sapien
caaggtatacaacaggtgcttactawatgagactttaagttccccgaggt

SEQ ID NO: 64702 - DNA, 50 bp, homo sapien
ctttgcaatcttgagatcctattccyactctttaacaggaagcatgcttg

SEQ ID NO: 64703 - DNA, 50 bp, homo sapien
tggggttaattatgttaaagtcacaragatttcaattttctgccgccttc

SEQ ID NO: 64704 - DNA, 50 bp, homo sapien
ggtcaggtgcctacctgctaacgtarccaaattgctaggacagcatcctt

SEQ ID NO: 64705 - DNA, 50 bp, homo sapien
accaaaggctgtcttgaatttcagaytacattaacatagtggcatgtctg

SEQ ID NO: 64706 - DNA, 50 bp, homo sapien
tgctcaccctatgttctaatgatcartatttctgcagtaacatcttgcag

SEQ ID NO: 64707 - DNA, 50 bp, homo sapien
gtacgaccaaatgattctggaataayaggacataagcaaatgactaaaat

SEQ ID NO: 64708 - DNA, 50 bp, homo sapien
gctggaagcattcacttggcttgggmatatccttttcatgttcccaggaa

SEQ ID NO: 64709 - DNA, 50 bp, homo sapien
ctgctcatcagaaagttgtcaaacartgtagtaatgtgaagaaagtaaaa

SEQ ID NO: 64710 - DNA, 50 bp, homo sapien
gggtgagaactataccggggaagcarcgtcttcatctccagtgagcttat

SEQ ID NO: 64711 - DNA, 50 bp, homo sapien
ctattaggtttacaaaagactctcargtgtatcagaatcatcgaaagcaa

SEQ ID NO: 64712 - DNA, 50 bp, homo sapien
ctgtccagtctcaggtggatgaagaytcagcattccaattcaatataaga

SEQ ID NO: 64713 - DNA, 50 bp, homo sapien
acgacatagatgatgtgtttaaagcycggaatgaaaaggcacagaataca

SEQ ID NO: 64714 - DNA, 50 bp, homo sapien
tgcaaaccttctgtgtagagcaaagrcctgtcaatcaaagtgcaactcac

SEQ ID NO: 64715 - DNA, 50 bp, homo sapien
ccaacagagaagagccagttcatgcrgacaggagatacagcgggaagtca

SEQ ID NO: 64716 - DNA, 50 bp, homo sapien
cactttaaaaactaataaactctaastaatgtgatttcacttttctaata

SEQ ID NO: 64717 - DNA, 50 bp, homo sapien
aaaataaagatgtcaattctcctcaratttatatacagtttcctttctaa

SEQ ID NO: 64718 - DNA, 50 bp, homo sapien
ggctgacagttcttccctccaagcarattattacttatctatccacccag

SEQ ID NO: 64719 - DNA, 50 bp, homo sapien
gaagcaattgtagtaattccttatgyaataaaccagtaagaactaattta

SEQ ID NO: 64720 - DNA, 50 bp, homo sapien
tttcttttgtgttgtgcttgtgagaktcatccgtgttgttccacattgag

SEQ ID NO: 64721 - DNA, 50 bp, homo sapien
tctatacccaatagaaaagctcacaragatgcatctaaagacctgccaag

SEQ ID NO: 64722 - DNA, 50 bp, homo sapien
taaccaaccccttattaatgaacctwagaacctaaatgttctttccattt

SEQ ID NO: 64723 - DNA, 50 bp, homo sapien
gattgttggtgtgtgacagtctcatkataaactaagaattcaaaagcact

SEQ ID NO: 64724 - DNA, 50 bp, homo sapien
aggtaaagtgataaagtaagatgggmaaatattacaaatgtcctagatgt

SEQ ID NO: 64725 - DNA, 50 bp, homo sapien
aagtagcatcaaggaccatgtacaayaaagagctattagaacaaaagagg

SEQ ID NO: 64726 - DNA, 50 bp, homo sapien
gtccacacacttcctggcactacgcraacaaaggaaatcaacactgggat

SEQ ID NO: 64727 - DNA, 50 bp, homo sapien
atcaaatgatttgagaggaaaggaasaagaggaccctgagatggtctgaa

SEQ ID NO: 64728 - DNA, 50 bp, homo sapien
acaccaagagagggtcttgaatctcrtgtaggaagaaattcaaggtgagt

SEQ ID NO: 64729 - DNA, 50 bp, homo sapien
atcggccagtccttctaaagctggayatagtggaggcaggcttcagtctc

SEQ ID NO: 64730 - DNA, 50 bp, homo sapien
cctgctgggagaaagattgtaaatargcagggtggtgagaggaagaagga

SEQ ID NO: 64731 - DNA, 50 bp, homo sapien
ggcaaagagagaacatggaagaacarggatacttaagatcctgctgggag

SEQ ID NO: 64732 - DNA, 50 bp, homo sapien
agcagctgctcttggctgaactcttrgagaggcaggcagacaggcttatg

SEQ ID NO: 64733 - DNA, 50 bp, homo sapien
tacatgggtcttcatttccttttgargtagatgtttatcagaaaaaaatg

SEQ ID NO: 64734 - DNA, 50 bp, homo sapien
catatgtagtcttagacataaatcayacatatttggcacaagggatttct

SEQ ID NO: 64735 - DNA, 50 bp, homo sapien
tagtgacacctttgcagtgtgtacawattgtgggaagaatttgcactgtt

SEQ ID NO: 64736 - DNA, 50 bp, homo sapien
ttttcgatgtctatagaaaggggtaraaatcagagagtaccagaattgca

SEQ ID NO: 64737 - DNA, 50 bp, homo sapien
aagagacagcccagtgctcactcacratactaaagtaatttagggcccca

SEQ ID NO: 64738 - DNA, 50 bp, homo sapien
atggcagttttctaaaatagatatayatgagtaaagagaaccacacaaag

SEQ ID NO: 64739 - DNA, 50 bp, homo sapien
ctgcaagaatgagcccagaataaaayctcagtgcagcatgcaaagtaaat

SEQ ID NO: 64740 - DNA, 50 bp, homo sapien
gtgcagcatgcaaagtaaatgtcatyttgagtgttaatggattgatcaac

SEQ ID NO: 64741 - DNA, 50 bp, homo sapien
agagtcagaaatataaaagtagtcaygaaactcaatctctcaaagaagta

SEQ ID NO: 64742 - DNA, 50 bp, homo sapien
ccgtaggtatttctgaattgtgacckagtttgcctagcacagcgttttca

SEQ ID NO: 64743 - DNA, 50 bp, homo sapien
ccacctcagcctcccaaagtgatggrccacctgatttgtgaactccctgg

SEQ ID NO: 64744 - DNA, 50 bp, homo sapien
aaaccagacttgggatttatattagragtaccacaaactgggtggcttaa

SEQ ID NO: 64745 - DNA, 50 bp, homo sapien
tggggagtggagtcaaaagccattgyaaaatttgaaaccaagtcccacaa

SEQ ID NO: 64746 - DNA, 50 bp, homo sapien
atagtctagaagttgttcataggaawttccagttgacttgtcttccagtt

SEQ ID NO: 64747 - DNA, 50 bp, homo sapien
aaaagcacatcctgaatacaaccaayacgccgccatgatgctggctgctg

SEQ ID NO: 64748 - DNA, 50 bp, homo sapien
ataatatcttgtacataatagggcamattttgactcatctggggtcattt

SEQ ID NO: 64749 - DNA, 50 bp, homo sapien
gccccaggttggcctctctggtctasgacatgggaaagagatctctagag

SEQ ID NO: 64750 - DNA, 50 bp, homo sapien
gggtagaaatggaaggtctcaataayggtattcaaatgactgctggggaa

SEQ ID NO: 64751 - DNA, 50 bp, homo sapien
tctccttagagcctaggacttaaagraaaactccatggttttagagagac

SEQ ID NO: 64752 - DNA, 50 bp, homo sapien
aatagtcataataattacaaacttamaaaattaccatgaggataaaatgt

SEQ ID NO: 64753 - DNA, 50 bp, homo sapien
agatctagaattcatggcataagaartagtttataagtccacgcatctag

SEQ ID NO: 64754 - DNA, 50 bp, homo sapien
aaatgccatgatgtaaatttgtatgmaagttgtgtgaacattaaggaatt

SEQ ID NO: 64755 - DNA, 50 bp, homo sapien
gtacaccaccccattttaacactcaycatagctcagaatgttccaggcta

SEQ ID NO: 64756 - DNA, 50 bp, homo sapien
ggtgggacactcccgtgtcacacaarttcatctttgcctatcaaatgccg

SEQ ID NO: 64757 - DNA, 50 bp, homo sapien
tataaaacacttagaatacaacatarcaataagtattcgggtttaacaat

SEQ ID NO: 64758 - DNA, 50 bp, homo sapien
agtcttttaaaaaaaaaggagtttcyctcaaacagcagttaacttagtaa

SEQ ID NO: 64759 - DNA, 50 bp, homo sapien
atacatagttggccaccaaacttgtsaaaacagtgtcaattttagcatgc

SEQ ID NO: 64760 - DNA, 50 bp, homo sapien
ggtgatacaaccacatttacctgaaygcatgaaaatatacataaatacac

SEQ ID NO: 64761 - DNA, 50 bp, homo sapien
cggctctcgtggtggattgaacaacrctaaattggttcagagtacttgtt

SEQ ID NO: 64762 - DNA, 50 bp, homo sapien
taagagaattaaggcagagaagagaygggagccacttagcagagggccat

SEQ ID NO: 64763 - DNA, 50 bp, homo sapien
tggctgtgctaggtcatgagcttgayattctcacaacatagaaaatatgt

SEQ ID NO: 64764 - DNA, 50 bp, homo sapien
taaaacctggggttccaggagataayttagtaatgcactacatagaatat

SEQ ID NO: 64765 - DNA, 50 bp, homo sapien
gctttgctttgtggtgattggactaygatctgtgatggtcaggccacagc

SEQ ID NO: 64766 - DNA, 50 bp, homo sapien
ggttacgcacatacaaaatcggcaargctagtcttctcttagaacagtca

SEQ ID NO: 64767 - DNA, 50 bp, homo sapien
ggattctgtttttattttagcatgaycctaaaactgccaacaaaatatca

SEQ ID NO: 64768 - DNA, 50 bp, homo sapien
cccttactaccacttcacaccataaratgatacattctatggttttctgg

SEQ ID NO: 64769 - DNA, 50 bp, homo sapien
aataattccttaatgtatctgcttcraaagtttggatttctatgtgtaat

SEQ ID NO: 64770 - DNA, 50 bp, homo sapien
tatacgtgtaagatatttattacaaractttaagagtcggagaatctaga

SEQ ID NO: 64771 - DNA, 50 bp, homo sapien
ctttaaatcacaagggatggaaaacrgaagctttatgacatactcaggtc

SEQ ID NO: 64772 - DNA, 50 bp, homo sapien
tccatagaatattggttttgtaacawcgaatacaatccaatatataacat

SEQ ID NO: 64773 - DNA, 50 bp, homo sapien
tgatctttcataaagcagaatggtaygtatcggattgttttaatgttata

SEQ ID NO: 64774 - DNA, 50 bp, homo sapien
cacaatcctcatgaatgcgcttagarcccttacattagataccccagaga

SEQ ID NO: 64775 - DNA, 50 bp, homo sapien
attttaccaaactgtgtatagggacrgcgagtgtgaccaatctgtctgca

SEQ ID NO: 64776 - DNA, 50 bp, homo sapien
gtggccagcctgggttggagctgtgkaatctccagcaagggacgtggccc

SEQ ID NO: 64777 - DNA, 50 bp, homo sapien
taataaatccatgcaactggaactcygaaaacaatcacttctagatcttt

SEQ ID NO: 64778 - DNA, 50 bp, homo sapien
aggtaggtataaatgaataaaacaascaaattgcaagcagaaataacagt

SEQ ID NO: 64779 - DNA, 50 bp, homo sapien
aattaatgtcaccaattaatagcaaygaatgtcaccagttctttgaagaa

SEQ ID NO: 64780 - DNA, 50 bp, homo sapien
aagtattcaaatgcaaacacagatayaggagagtcttggttctcaaactt

SEQ ID NO: 64781 - DNA, 50 bp, homo sapien
agggaagaggagaagaaagagggcaygcgagtcccactcctcatgccaga

SEQ ID NO: 64782 - DNA, 50 bp, homo sapien
aaacagaacctgacaaaataaggtckcattgttcaaacatgtgtgacttc

SEQ ID NO: 64783 - DNA, 50 bp, homo sapien
cggcctcaagtaagaaacattaaaargtaaccagatatattgcccagaaa

SEQ ID NO: 64784 - DNA, 50 bp, homo sapien
aatgagggaagcccttgggcaaagawcatgtcccgggcacaagagtctgg

SEQ ID NO: 64785 - DNA, 50 bp, homo sapien
atgcaaaaggaaacaactagaaaatsatctaaagtcttattgaataagtt

SEQ ID NO: 64786 - DNA, 50 bp, homo sapien
ataatcctgggcataatgtggcagcygaatttctgaagataccatcagtg

SEQ ID NO: 64787 - DNA, 50 bp, homo sapien
atgcccttttcttgacaaatctggtkagttctcaaggagtattactgaaa

SEQ ID NO: 64788 - DNA, 50 bp, homo sapien
atgaaagaggaaaagggctgactgayatttttattttaaatttaaaatac

SEQ ID NO: 64789 - DNA, 50 bp, homo sapien
tgtaaaaaggatgctaagaagaagaracaaacacacagggtctttgtacc

SEQ ID NO: 64790 - DNA, 50 bp, homo sapien
aagaagacttctcattatcataacayacccaagaatgtgttctcatctcc

SEQ ID NO: 64791 - DNA, 50 bp, homo sapien
aaaggcttcacgctgtctgaatgccraccagacaatctgtgttcccaatc

SEQ ID NO: 64792 - DNA, 50 bp, homo sapien
tagataccctagaaactagttctccyactggtgtaaaaaggatgctaaga

SEQ ID NO: 64793 - DNA, 50 bp, homo sapien
ttttagctgtaagggtatagtgacakcatcttatctcacagccaagagtg

SEQ ID NO: 64794 - DNA, 50 bp, homo sapien
aaatttctgaggctgaccaggacccracactgagatgtcagataaattag

SEQ ID NO: 64795 - DNA, 50 bp, homo sapien
ctgacatttctgtgaggaggccaaayaatacacagttatagagatactaa

SEQ ID NO: 64796 - DNA, 50 bp, homo sapien
aatagagggtatgaatcagtatgtgyagctgaatatccttctgttctctg

SEQ ID NO: 64797 - DNA, 50 bp, homo sapien
actcaaatattctataaatcctagawataaaggaagcagtgtgtgtgtaa

SEQ ID NO: 64798 - DNA, 50 bp, homo sapien
ctgtgtattaacaaagagagcaggayacaaacatgagtggaagaaggcca

SEQ ID NO: 64799 - DNA, 50 bp, homo sapien
actaacacatgactactaaaatcagscttttttcatttctgctgtaactc

SEQ ID NO: 64800 - DNA, 50 bp, homo sapien
aataaacatctctggaattgggtaaytggatgtcctagtccataaccacc

SEQ ID NO: 64801 - DNA, 50 bp, homo sapien
cattgcccagtattgtggaatgagaraggacttgtttgtctgggctatgc

SEQ ID NO: 64802 - DNA, 50 bp, homo sapien
agtttcttataatgtaatgaatgtayggcagataatggtccaatagtgca

SEQ ID NO: 64803 - DNA, 50 bp, homo sapien
tgttgatgaaactgtaagagaaaggsattttaatgtttacttaaggccca

SEQ ID NO: 64804 - DNA, 50 bp, homo sapien
cacttagtgaacaactcatgttaaasagtacagtaggaccgcattttcaa

SEQ ID NO: 64805 - DNA, 50 bp, homo sapien
tgaatccaaattttaaacggtaagakaattttcatacacacattagccaa

SEQ ID NO: 64806 - DNA, 50 bp, homo sapien
ggcatttttggaaatgggtggaagaygcaatagaaaagtctgcagactca

SEQ ID NO: 64807 - DNA, 50 bp, homo sapien
cagacaaaatatctagttgtatgtayaaaaaaggaaaaagaaaagcttct

SEQ ID NO: 64808 - DNA, 50 bp, homo sapien
aatgaaaccaactaggtcaagcaatrttatcctcttttatgtcactgaat

SEQ ID NO: 64809 - DNA, 50 bp, homo sapien
ttaagtgagtcactttctaagtcaarcaattgaatcttttccaggactat

SEQ ID NO: 64810 - DNA, 50 bp, homo sapien
ctcccagaactacagttgggcagtaycaatcatcctgaaatacccctatt

SEQ ID NO: 64811 - DNA, 50 bp, homo sapien
ctggagagaaatttggcaattcctawtaaagcaacatagacatttacctt

SEQ ID NO: 64812 - DNA, 50 bp, homo sapien
atcagtagacactcaacaaatggtarcagctataattaaagagaaatcag

SEQ ID NO: 64813 - DNA, 50 bp, homo sapien
atgggaaggttgggaaatttaaaaamgaccctgctactactgcatattct

SEQ ID NO: 64814 - DNA, 50 bp, homo sapien
tctgacacattggtcagagtatcaaygtatttatttgtctgggagtattc

SEQ ID NO: 64815 - DNA, 50 bp, homo sapien
tgatggccatcctgatataattttcratggcaatgggggtgaggtatctt

SEQ ID NO: 64816 - DNA, 50 bp, homo sapien
agtatcaatgtatttatttgtctggkagtattcatacctaatgtggagtt

SEQ ID NO: 64817 - DNA, 50 bp, homo sapien
ataaacaaatcagtcagatggacacraaagatgaaaaacaataaatcagg

SEQ ID NO: 64818 - DNA, 50 bp, homo sapien
acacagacatctatcacaaatgcacrctgttctccttgctcctgcaggtt

SEQ ID NO: 64819 - DNA, 50 bp, homo sapien
atcactaatccatcacaacattcatstcctctgagtccaggtatggcccc

SEQ ID NO: 64820 - DNA, 50 bp, homo sapien
caaacgagcaaatacacagaaagatyaggtttgccaacacttgactgcaa

SEQ ID NO: 64821 - DNA, 50 bp, homo sapien
tttttccttcatgcaattttgtggcyatgtttccgtgtcagaacaagtag

SEQ ID NO: 64822 - DNA, 50 bp, homo sapien
atgcctggacactctgtggatttcamatagcacagcctctagacagtgct

SEQ ID NO: 64823 - DNA, 50 bp, homo sapien
gctgacatcagcctagtgaccagaasaatccctgtctgtcccttcctcct

SEQ ID NO: 64824 - DNA, 50 bp, homo sapien
tttctaaaggccacatgcaaacgccrctttctttacattgtttattattt

SEQ ID NO: 64825 - DNA, 50 bp, homo sapien
acttctgctcagcaacaagaatgcaratgtgccctgaagccttgtttgca

SEQ ID NO: 64826 - DNA, 50 bp, homo sapien
aacatggtgaattaggttattagaasgttggaacatctctgaagctcaaa

SEQ ID NO: 64827 - DNA, 50 bp, homo sapien
ctgctgtttcctgctccctacaaacmgtttctactccgctagatgccctt

SEQ ID NO: 64828 - DNA, 50 bp, homo sapien
atttattattctactttctacagttytgatttcattctctgacaggttct

SEQ ID NO: 64829 - DNA, 50 bp, homo sapien
gatccaaatctgtcacccactcttasaagtaactacagggggctccgtag

SEQ ID NO: 64830 - DNA, 50 bp, homo sapien
ccctccaaagatgcaaagatctccayggtcctgacacccggaagaataat

SEQ ID NO: 64831 - DNA, 50 bp, homo sapien
taaggtcaagaaattttcccagagcraggagataaatattttaaaataat

SEQ ID NO: 64832 - DNA, 50 bp, homo sapien
tggatgtccattattcacttaagtayagattaggaatactgacaaatact

SEQ ID NO: 64833 - DNA, 50 bp, homo sapien
tagcacttaccacgttgtaatgtaayttaactcttcacagggttcttgac

SEQ ID NO: 64834 - DNA, 50 bp, homo sapien
ctgccatttccagagctctctcaacygcgcatgtttgaaaatgcaattgt

SEQ ID NO: 64835 - DNA, 50 bp, homo sapien
acctctgaagcttctggttgaatgaygacaagggcccactggcaggcagc

SEQ ID NO: 64836 - DNA, 50 bp, homo sapien
ttttatggacaaaagcaatgatagaygggttctttgtacaaaagatttca

SEQ ID NO: 64837 - DNA, 50 bp, homo sapien
ctaatgagtaactggttcatagctaycaaacgataaacattatgacctta

SEQ ID NO: 64838 - DNA, 50 bp, homo sapien
ctccagctgcatccatgctggtaccwaggacatgactttgttcttttttt

SEQ ID NO: 64839 - DNA, 50 bp, homo sapien
actgggaataagaaaggaaaaaataygggtctacaaggagttcttgggga

SEQ ID NO: 64840 - DNA, 50 bp, homo sapien
gacttatctgtttaccctggcataastcttttaatttaattgcacttaga

SEQ ID NO: 64841 - DNA, 50 bp, homo sapien
agagttgaagaagaaaaaggatctasgatgacatagataataatagtggg

SEQ ID NO: 64842 - DNA, 50 bp, homo sapien
gaagttttttctaagaatacaagcartgaaaccgaaaaccctattaaact

SEQ ID NO: 64843 - DNA, 50 bp, homo sapien
tgggaaatgctatattttagacaagyatattgcaagctcaaaacaaacaa

SEQ ID NO: 64844 - DNA, 50 bp, homo sapien
tggcagaagcccctttacagcaagayatttaccgtttgtctgaaaatagc

SEQ ID NO: 64845 - DNA, 50 bp, homo sapien
cacttttccacctaggtattcaataygtccttctcttttgagtttttccc

SEQ ID NO: 64846 - DNA, 50 bp, homo sapien
gacaagaagaagcctagtgtagtgcyctcaatttacaacacggaaaacag

SEQ ID NO: 64847 - DNA, 50 bp, homo sapien
aatataaatgctccagctacaacaayttaaagagattgacaggacaaaaa

SEQ ID NO: 64848 - DNA, 50 bp, homo sapien
tctttgtccacacaggcagagattcrctacatctggaacttggctcctcc

SEQ ID NO: 64849 - DNA, 50 bp, homo sapien
ttgggatcccactaaatgtcagaaaytaaggttcattccatccagccatt

SEQ ID NO: 64850 - DNA, 50 bp, homo sapien
ataaacacaaatcaagcaaacactcrgaaaattttaacagtatggcaaaa

SEQ ID NO: 64851 - DNA, 50 bp, homo sapien
gcccgggagccagacggattctcgaratggagcaattacatttaaagcga

SEQ ID NO: 64852 - DNA, 50 bp, homo sapien
cagaacttactttgctataactgaartgattgagtagacttctgcctcaa

SEQ ID NO: 64853 - DNA, 50 bp, homo sapien
ttcaaaaaagactgacatctcactawaacataaccttcattttcaaaatt

SEQ ID NO: 64854 - DNA, 50 bp, homo sapien
agatgaggaacttggctaagagcaasaatgatcatactggctagtttgca

SEQ ID NO: 64855 - DNA, 50 bp, homo sapien
cacaaagaatttaatactcttgttaygaaaggaaaaatctttcctatgtc

SEQ ID NO: 64856 - DNA, 50 bp, homo sapien
atcgatagggagtgacagttgatttyaaagcttaatgcaagacaagaaag

SEQ ID NO: 64857 - DNA, 50 bp, homo sapien
tccagggttgcattatcaggtctacyaggcttaaaacagaagtaaagtgg

SEQ ID NO: 64858 - DNA, 50 bp, homo sapien
tgtgccctttattattttgaggtaartatctctaatgaacatagacacaa

SEQ ID NO: 64859 - DNA, 50 bp, homo sapien
tcctcatctataagacaggatatgcrctgtgtctaataccagtagctggc

SEQ ID NO: 64860 - DNA, 50 bp, homo sapien
tttcattcatggtctaagaatgggayggaaaacttgcaaccttcctgacc

SEQ ID NO: 64861 - DNA, 50 bp, homo sapien
ttagaaagattatgttaaatgaatawaaagaggaatgatagatttagagg

SEQ ID NO: 64862 - DNA, 50 bp, homo sapien
ccaagctgacttcctgaatcgggcastcactcactcactcgttcactcag

SEQ ID NO: 64863 - DNA, 50 bp, homo sapien
ctaaaaactgtaatgttaaaactgawgaagttgatgatcataaagttgat

SEQ ID NO: 64864 - DNA, 50 bp, homo sapien
cattgtcctctatggagttgtgtcayctatcagcgggctattaatttagg

SEQ ID NO: 64865 - DNA, 50 bp, homo sapien
ttaactagcttttcaacactttaaayatagaaatgattcaccgtgacttt

SEQ ID NO: 64866 - DNA, 50 bp, homo sapien
gaccagaggtgagcccatgggagaaytctggaaaatggtgtaaaacatgt

SEQ ID NO: 64867 - DNA, 50 bp, homo sapien
cagaggctcttgtctaacagctaagsaacaggctacagctgaacatatta

SEQ ID NO: 64868 - DNA, 50 bp, homo sapien
ctggtactgctgcattctttgtggcraaaaattaatatgtgaataattgg

SEQ ID NO: 64869 - DNA, 50 bp, homo sapien
agattcacagtacctacttgatagayagaaatttaggaactagctacaat

SEQ ID NO: 64870 - DNA, 50 bp, homo sapien
tagaggaccaagtttttcataagtaygtctgggcttcatgactggctgat

SEQ ID NO: 64871 - DNA, 50 bp, homo sapien
tggttggaaatgctttgtatagccayatcttagaatattaggtgactagg

SEQ ID NO: 64872 - DNA, 50 bp, homo sapien
caaagagatgtgcatgagtgctttaracacaagagcaagttagcgaagag

SEQ ID NO: 64873 - DNA, 50 bp, homo sapien
agaggacactaaggagaaataatgastaaatgcaatttgatatcctggat

SEQ ID NO: 64874 - DNA, 50 bp, homo sapien
aaacctccagacagcaaaataaatakctctaattatgagtgtaacaccct

SEQ ID NO: 64875 - DNA, 50 bp, homo sapien
gtaggtaactttacaacacacaaatkatcttatcctatatatcttccctt

SEQ ID NO: 64876 - DNA, 50 bp, homo sapien
aaatggaggaggaagtgatagctgargttggttaattaaatgctctgatc

SEQ ID NO: 64877 - DNA, 50 bp, homo sapien
gagtaatatttttattaatggtgtasatggtctcaaaactagttagtgtt

SEQ ID NO: 64878 - DNA, 50 bp, homo sapien
tgaatcctatgcgcatgcctggcaaygttctgggtgctggatcacagtga

SEQ ID NO: 64879 - DNA, 50 bp, homo sapien
agaggaaggttatttttatgtcataygtgctttggtaaaattttgcagga

SEQ ID NO: 64880 - DNA, 50 bp, homo sapien
gatcatccaagttgtccttccaaccyggagaccaatctcagacctccgtg

SEQ ID NO: 64881 - DNA, 50 bp, homo sapien
cccgacggtattaccacagtaccaayttgcctctggctaaataaacaaac

SEQ ID NO: 64882 - DNA, 50 bp, homo sapien
atatattcaatatttggcctagatamaagttgcaggtatctgggttaaca

SEQ ID NO: 64883 - DNA, 50 bp, homo sapien
gggaaactgaagctccgagaagctayacggtttgcctttggcaggctagg

SEQ ID NO: 64884 - DNA, 50 bp, homo sapien
tatgctttatgttatatatcaatgamaatagaggtaacttctgtgttcag

SEQ ID NO: 64885 - DNA, 50 bp, homo sapien
attttaaagttcatgtaggtgttgayaatgatttccctttcaagccagaa

SEQ ID NO: 64886 - DNA, 50 bp, homo sapien
cacctaaaatctactttcctagcaarcttccagtgtacaatgcaatatta

SEQ ID NO: 64887 - DNA, 50 bp, homo sapien
actttacactgctccaagggtaacawtgaacatatttgggcactgatccc

SEQ ID NO: 64888 - DNA, 50 bp, homo sapien
ccatattagtcttttggactttacaytgctccaagggtaacattgaacat

SEQ ID NO: 64889 - DNA, 50 bp, homo sapien
atgctgcaaaccagagagcaaggacmacatggaagatgcagaggaagggc

SEQ ID NO: 64890 - DNA, 50 bp, homo sapien
aaagtttttttccctaggttttagawcttagtcatctcattcatattata

SEQ ID NO: 64891 - DNA, 50 bp, homo sapien
aattagtatttacctgtatcttttgyagtgtttaaattttctaaaatgtg

SEQ ID NO: 64892 - DNA, 50 bp, homo sapien
tcaagacctcacaagactagccttgsagcctgaaagggatttatccaccc

SEQ ID NO: 64893 - DNA, 50 bp, homo sapien
gcaccaacattcagctagtattaaaractttgctcacaactattgcaagg

SEQ ID NO: 64894 - DNA, 50 bp, homo sapien
tcaggggcacgcacagtaggctgaaytgcaacgagagcacttggcaatcc

SEQ ID NO: 64895 - DNA, 50 bp, homo sapien
gggtgaatggcagtagtctccatacragcagatagaattgatcttgtgtt

SEQ ID NO: 64896 - DNA, 50 bp, homo sapien
acaatgtattattggtgcaaagatascctgaaagtttagtaaaatgggtg

SEQ ID NO: 64897 - DNA, 50 bp, homo sapien
agaaatgctgttcttcaaaacgatayattaagaaaatgaaaagacaagcc

SEQ ID NO: 64898 - DNA, 50 bp, homo sapien
gagaacagaattggtacctggttaayctctaagtaaagcacagtgcataa

SEQ ID NO: 64899 - DNA, 50 bp, homo sapien
cagtaaaccatatgtgaaaactgaaytgctacattacactacaccctagc

SEQ ID NO: 64900 - DNA, 50 bp, homo sapien
ctagataagatggacgaattcacaawatactaatacagaccaaaacagaa

SEQ ID NO: 64901 - DNA, 50 bp, homo sapien
agagcccctggctgagagcacccaartgttatattgttctatcagcatta

SEQ ID NO: 64902 - DNA, 50 bp, homo sapien
atattagccacccctaacacctttaygtcacaggttttctgagaacttct

SEQ ID NO: 64903 - DNA, 50 bp, homo sapien
acatgttctattgcctcatgcagtastacattttagagcgcaagaatgtt

SEQ ID NO: 64904 - DNA, 50 bp, homo sapien
gagaccacagaaaacagtccagatarctgatgatgagagtctagaataca

SEQ ID NO: 64905 - DNA, 50 bp, homo sapien
gaaatggtaactaccagagtaagtayatgtgtttgttgttatttaaatct

SEQ ID NO: 64906 - DNA, 50 bp, homo sapien
ggactaagtagagagaaaattattgracaaactattgaattcaacaattg

SEQ ID NO: 64907 - DNA, 50 bp, homo sapien
ctattgcacagtactttagccattasaagagaacattaaaaaaattaaat

SEQ ID NO: 64908 - DNA, 50 bp, homo sapien
agaaggaagtgggctaaacctcacamagtatagacatacacaaatacaaa

SEQ ID NO: 64909 - DNA, 50 bp, homo sapien
gtcacactaaggaatcaatgactaaygaaaaaactaccaaagtatcctac

SEQ ID NO: 64910 - DNA, 50 bp, homo sapien
aacgtgattatattcaatgaaattcrgaagatgtaagacaagcgagaaca

SEQ ID NO: 64911 - DNA, 50 bp, homo sapien
ttgctgttggagttctgccatatagycacctgtgtttcatagccggctat

SEQ ID NO: 64912 - DNA, 50 bp, homo sapien
ttctatcccatatgaatatgaacttyctgatcctcttataactggaatag

SEQ ID NO: 64913 - DNA, 50 bp, homo sapien
tgccaaaacgtgattttaggtcatayagcaataaatgcattccagaattc

SEQ ID NO: 64914 - DNA, 50 bp, homo sapien
aatcttactttacttcctaaaatacrctaataaaatcagattaggaatgg

SEQ ID NO: 64915 - DNA, 50 bp, homo sapien
tcctatattattttatcctcttaaaktctgatggtctttggctccactga

SEQ ID NO: 64916 - DNA, 50 bp, homo sapien
agagaagtaacatcttaataatagtwaatctccctagctgaactaggttt

SEQ ID NO: 64917 - DNA, 50 bp, homo sapien
tggggaaaggaatttgcctgaacaaracactaaaaagataaaataggctg

SEQ ID NO: 64918 - DNA, 50 bp, homo sapien
agcagaagataatgaaatctgtaagraatttaaacgatcaaatctttgca

SEQ ID NO: 64919 - DNA, 50 bp, homo sapien
tgatagtttttctgacagagtgagakgtacttttcctgtcccaggcctgg

SEQ ID NO: 64920 - DNA, 50 bp, homo sapien
gccgccatctccaagttctgcactaygagcattcccaaactgaaagacta

SEQ ID NO: 64921 - DNA, 50 bp, homo sapien
aatagactctaaagacctcttaagamcattaaacaagcatcatatccgtc

SEQ ID NO: 64922 - DNA, 50 bp, homo sapien
atatgaaaggacaaatgtttaaactyactatgtctgaacaacaatcctcc

SEQ ID NO: 64923 - DNA, 50 bp, homo sapien
ttggtctcctcattaatactttggtwaattgatgcatatttttgagttac

SEQ ID NO: 64924 - DNA, 50 bp, homo sapien
agactccttataagaaagaactaagracagtaagaaggaaggttttgagg

SEQ ID NO: 64925 - DNA, 50 bp, homo sapien
cagaagaaagctctaaatccaaaaaytgttaagctctgagatggttcaaa

SEQ ID NO: 64926 - DNA, 50 bp, homo sapien
ttggatttagagctttcttctggacmatggaatgaagaatgcccaaacat

SEQ ID NO: 64927 - DNA, 50 bp, homo sapien
gcatggcagagggtacaggacctaawatggtttttctgtgtccccaccca

SEQ ID NO: 64928 - DNA, 50 bp, homo sapien
tagccacctttcacacaacttcctcyggaaacacttgtgaattcctaagc

SEQ ID NO: 64929 - DNA, 50 bp, homo sapien
tttctatccttggtatttggagaagsctctctcggatctgcttggtgcga

SEQ ID NO: 64930 - DNA, 50 bp, homo sapien
atggttagctcaggtgtgaaagtaaraacaggctgccacgtggggacagt

SEQ ID NO: 64931 - DNA, 50 bp, homo sapien
tgaatatttatgagcatgatgacaarttaacacctaaaactggttttccg

SEQ ID NO: 64932 - DNA, 50 bp, homo sapien
ggccttatgtatgggaaaccacgaastatacatgcgaagaaggaagcctg

SEQ ID NO: 64933 - DNA, 50 bp, homo sapien
gcttggtagaagataacctgagactraggagatttctgattgaggggtgg

SEQ ID NO: 64934 - DNA, 50 bp, homo sapien
ccatcattctcacatctacccttgtwaacggatgctagattttctttaga

SEQ ID NO: 64935 - DNA, 50 bp, homo sapien
taataaaagtcagaaaaatcttccamgtcaactctcttgattgaaacaca

SEQ ID NO: 64936 - DNA, 50 bp, homo sapien
ctctattaatccagtatttagaacaygccccagtacgcagcagatgccaa

SEQ ID NO: 64937 - DNA, 50 bp, homo sapien
gtgttccttatatatcagaggaataygaaaggtgaggagcgtgtaagaag

SEQ ID NO: 64938 - DNA, 50 bp, homo sapien
ctgagcagcatttatgagctacttgracaaggctaagcttctatgtcagg

SEQ ID NO: 64939 - DNA, 50 bp, homo sapien
cccttcctctcttctacttaaaaaawtagtacttagcatcttctaacata

SEQ ID NO: 64940 - DNA, 50 bp, homo sapien
gaataagccatatctgacacctatgraataatgtttactttagtggcata

SEQ ID NO: 64941 - DNA, 50 bp, homo sapien
ccctacagagaagcagaggtcataayggtgctgttccctgttctgtgtcc

SEQ ID NO: 64942 - DNA, 50 bp, homo sapien
tttgagaaatagactgtagaaaagaygacaatgtttattctcattagtca

SEQ ID NO: 64943 - DNA, 50 bp, homo sapien
aaatgctgagtatgtagagcacaaaytgcatgtgatttctagaactgaga

SEQ ID NO: 64944 - DNA, 50 bp, homo sapien
ttatagcttgaatatgtcctactaarcaaagctgtaatgtggaaaagttt

SEQ ID NO: 64945 - DNA, 50 bp, homo sapien
gggtttgattttgcaaaaagatatcraagcagtaaggactccagtgggta

SEQ ID NO: 64946 - DNA, 50 bp, homo sapien
aaaaccgggatctatttaaaatcagyccgacttccccacggagcctgaat

SEQ ID NO: 64947 - DNA, 50 bp, homo sapien
caccaaggtttgactgcattcggtarctccacgctttggtcaaactgggg

SEQ ID NO: 64948 - DNA, 50 bp, homo sapien
ggaaagaaacagagttaagaaaaaamtaagactgcaatatgcccctggag

SEQ ID NO: 64949 - DNA, 50 bp, homo sapien
aacatcaattttcccatggctacaaygagggtactaataatatctttgcc

SEQ ID NO: 64950 - DNA, 50 bp, homo sapien
gagtgaaaacaaagaagggctggtartacatcatctctaagaatttagct

SEQ ID NO: 64951 - DNA, 50 bp, homo sapien
tatttttgtataaatatgtatccatkaatatagtgtttcgtgttttaaac

SEQ ID NO: 64952 - DNA, 50 bp, homo sapien
gactaccatcgttgcagggacaagaraaaacattcctttggcgctatagt

SEQ ID NO: 64953 - DNA, 50 bp, homo sapien
ttatacttcttatttaaaagcctacratttgaatgtttgcctttgatacc

SEQ ID NO: 64954 - DNA, 50 bp, homo sapien
tgtcagcatatatgtatgtatatggkaaaataattggtggagatattatt

SEQ ID NO: 64955 - DNA, 50 bp, homo sapien
tcatttttagattaacttacgtctcwcttctcttacacaaaaacctcagg

SEQ ID NO: 64956 - DNA, 50 bp, homo sapien
cagcaagaggaccggtgtgactggakcgaagtaagctggaagctacatta

SEQ ID NO: 64957 - DNA, 50 bp, homo sapien
ctataaataccgggtgtgtaagtatragagtgtaaaaatgtatatttttc

SEQ ID NO: 64958 - DNA, 50 bp, homo sapien
agtgagcttgttgactgagggactcsattttccatttgtaggcgggcaga

SEQ ID NO: 64959 - DNA, 50 bp, homo sapien
gtgataaaagaacaaggtacggatgwgtaaagcacatggacaaagccaga

SEQ ID NO: 64960 - DNA, 50 bp, homo sapien
ctacaatgtgagtcttggggtgaagycaaaagttgagttgtgtagcaagg

SEQ ID NO: 64961 - DNA, 50 bp, homo sapien
tagtggaaaatgtatgtttatacaakatctaaggacagtactttgggtga

SEQ ID NO: 64962 - DNA, 50 bp, homo sapien
tacctaacacctgactctatcctgaygtactgttctctaactcaaactct

SEQ ID NO: 64963 - DNA, 50 bp, homo sapien
gatattactgaggtggaaaatgtcasacttgggtcatctcagattgtatg

SEQ ID NO: 64964 - DNA, 50 bp, homo sapien
ggtctgaggaaacctctgggtgaccrcttgatgctggtacaaagatttgt

SEQ ID NO: 64965 - DNA, 50 bp, homo sapien
atttttacacagtgtagcattttttwaagtctgttacagtgtaaagtaac

SEQ ID NO: 64966 - DNA, 50 bp, homo sapien
agtaatttaatcttcaacaaaaacartatgttgaccttaatacattggta

SEQ ID NO: 64967 - DNA, 50 bp, homo sapien
tagaactctaattttaatgccaagcwctcattaataattaactgaaagtg

SEQ ID NO: 64968 - DNA, 50 bp, homo sapien
aataacccacaaagcagaataaatamcagttgctcatgtacaataatcac

SEQ ID NO: 64969 - DNA, 50 bp, homo sapien
ccagattacttaagtattcctttcascatgttctattatgtttcttatca

SEQ ID NO: 64970 - DNA, 50 bp, homo sapien
gatagcacaagtgtgagattttaaartgtgattgtttggacacagtaatt

SEQ ID NO: 64971 - DNA, 50 bp, homo sapien
atgacaggcctctgccaccaacacarggcatagtctatttcctccaggga

SEQ ID NO: 64972 - DNA, 50 bp, homo sapien
gaggctggtctctatggtttccttgsatccttcttgcaatcctgctatag

SEQ ID NO: 64973 - DNA, 50 bp, homo sapien
atgagggaaagacatcacccagagtraatgaacagcatgtacaaagctaa

SEQ ID NO: 64974 - DNA, 50 bp, homo sapien
attatgagtattacactatccatagrgaagtttgtttgagacctaaactg

SEQ ID NO: 64975 - DNA, 50 bp, homo sapien
agaactgtctaatgggggcatcaaartatcagccataaaaaaccataaaa

SEQ ID NO: 64976 - DNA, 50 bp, homo sapien
ttgagtgcaattgcaagagaataggyctgagtcttgctgtagtaagttag

SEQ ID NO: 64977 - DNA, 50 bp, homo sapien
gctgagagatgggaaacatgtgcccracacctttctttttctatggtgag

SEQ ID NO: 64978 - DNA, 50 bp, homo sapien
tttaaggcagagaaaccatatttaasctagaacttcaggcaaagggccga

SEQ ID NO: 64979 - DNA, 50 bp, homo sapien
cttcatgaatatattcttgcttaccrattcttaggagaaacatctcttgc

SEQ ID NO: 64980 - DNA, 50 bp, homo sapien
tggaagagactggtggagggtatctratagaagcatcttagtagaatgag

SEQ ID NO: 64981 - DNA, 50 bp, homo sapien
tcacagttgaattaagacattgggtytgcatattgaactttttgcaagaa

SEQ ID NO: 64982 - DNA, 50 bp, homo sapien
ctgaagggttttctgtgtcagatacyactgcccctcataacgggggtggg

SEQ ID NO: 64983 - DNA, 50 bp, homo sapien
taattgcacaatgtgtttcatgcgtyttcctcctcctatgttaggatgat

SEQ ID NO: 64984 - DNA, 50 bp, homo sapien
tatgggccacgttttttgaaacatgkaaggacaatgaagtcatcgcttag

SEQ ID NO: 64985 - DNA, 50 bp, homo sapien
caaaataacagcaaattaacctgaawtgactacatagctttcctcatttt

SEQ ID NO: 64986 - DNA, 50 bp, homo sapien
cagtgtgcagtgattattgcaatgaytaatgtattgataagataatatga

SEQ ID NO: 64987 - DNA, 50 bp, homo sapien
ataatatgaaaacacagaattcaaasagcagtgaactgagattagaattg

SEQ ID NO: 64988 - DNA, 50 bp, homo sapien
cttcctgtccacattgcatttgtaakaatgaaacttgcgtgagttgcacg

SEQ ID NO: 64989 - DNA, 50 bp, homo sapien
aaactagattcttagttattcattaraagatactgagtaaactcctctag

SEQ ID NO: 64990 - DNA, 50 bp, homo sapien
acctttctgctctgatagcaacattkaaggagagactattgttgcattga

SEQ ID NO: 64991 - DNA, 50 bp, homo sapien
gttaatctaaatgaataaattaacaytgataaacgtacctttctgctctg

SEQ ID NO: 64992 - DNA, 50 bp, homo sapien
gcaatatgtgattgtcctttattccrtattaaaacatttccctaatattt

SEQ ID NO: 64993 - DNA, 50 bp, homo sapien
gtagccagggtctagagaattcactrtgatcttctattctgtctgggctt

SEQ ID NO: 64994 - DNA, 50 bp, homo sapien
tccatcacccctcatggcccatcacyggagccttccacctgtgtccactt

SEQ ID NO: 64995 - DNA, 50 bp, homo sapien
aagattcattgttaatataaaagtayaaaattgcaacctatgaattaaga

SEQ ID NO: 64996 - DNA, 50 bp, homo sapien
ttttccatccacagattgagttaatyttttgagctatggtctccttgacg

SEQ ID NO: 64997 - DNA, 50 bp, homo sapien
atgatttttttttctcttggaggaartaacgacctaaataaatgtcatgt

SEQ ID NO: 64998 - DNA, 50 bp, homo sapien
aaacacaagtgaggtcctttcctgaratccccaagctgtacaggcacata

SEQ ID NO: 64999 - DNA, 50 bp, homo sapien
ctaatgattttgattgtattgttttktctataactttgtgttcctgcact

SEQ ID NO: 65000 - DNA, 50 bp, homo sapien
agctcaagaaaaggtgctttccagtyaaatatacatctggggtttggggc

SEQ ID NO: 65001 - DNA, 50 bp, homo sapien
gtgatcgtctgtatgggtttcattasagggcattagagagcgtctgttag

SEQ ID NO: 65002 - DNA, 50 bp, homo sapien
ggccttgaaggttcagaaagtattaracatgaaaagctagagagagaata

SEQ ID NO: 65003 - DNA, 50 bp, homo sapien
caaagaccagaatgccaagtatgaawcagtgtatttcacttaggctcacc

SEQ ID NO: 65004 - DNA, 50 bp, homo sapien
actgggtcccttcctttttctcttaycagtcaaagacataacataaagac

SEQ ID NO: 65005 - DNA, 50 bp, homo sapien
aatacccagaccaagaacacgtacartattatgcttaaatattgatgtca

SEQ ID NO: 65006 - DNA, 50 bp, homo sapien
agcaaattgtggtatggtctcacttrcaatggaatatcatccagccataa

SEQ ID NO: 65007 - DNA, 50 bp, homo sapien
cagccataagaaggaatgaggttccratgcatgctaccatgtggctgaac

SEQ ID NO: 65008 - DNA, 50 bp, homo sapien
gccctccctcatgggtttcagttaayggcaactttagagacagaaccacc

SEQ ID NO: 65009 - DNA, 50 bp, homo sapien
ctggaaaaaaacattggattacatayttcgaagtgacttaaaggatgaat

SEQ ID NO: 65010 - DNA, 50 bp, homo sapien
ctacctttggactctgtgtctgaaaygcaaatgttaaaaatttaatggta

SEQ ID NO: 65011 - DNA, 50 bp, homo sapien
acatttttttaaataattgattggaytcaagaagcaccacaaggccagaa

SEQ ID NO: 65012 - DNA, 50 bp, homo sapien
agtctgcagttcttctagtctctaamccattcctcataattaaacaatgt

SEQ ID NO: 65013 - DNA, 50 bp, homo sapien
aacggaaaagacagatgatcagctarttccacaaataagttaggtgttaa

SEQ ID NO: 65014 - DNA, 50 bp, homo sapien
gattattgctcaatataggtttttcmaagagagccacagtccagttcaca

SEQ ID NO: 65015 - DNA, 50 bp, homo sapien
catctaggactttcatagctacagargagaagttgattcctggcttcaaa

SEQ ID NO: 65016 - DNA, 50 bp, homo sapien
gaagaaaaaacaaaaaaagtttaccrgcttacagtctttattgtctggtg

SEQ ID NO: 65017 - DNA, 50 bp, homo sapien
ttctcagacacaatgttaatataaayacagcactgatccaatcagataac

SEQ ID NO: 65018 - DNA, 50 bp, homo sapien
aaatcttcatgaactttgattttacratagattcttagatatgacacaaa

SEQ ID NO: 65019 - DNA, 50 bp, homo sapien
catggggtgttttataaacagtgaayatgcaacaacaaggaaaggctttc

SEQ ID NO: 65020 - DNA, 50 bp, homo sapien
cctgagaaactagcactatccagaarttatagtgagcaacttccctaggc

SEQ ID NO: 65021 - DNA, 50 bp, homo sapien
caatgccaaactttctgtaatgcacratcagaaatgcataaagaatcaag

SEQ ID NO: 65022 - DNA, 50 bp, homo sapien
atgtggtcagtattactcaagtttcyaaccaaggaactcaggcttgcaga

SEQ ID NO: 65023 - DNA, 50 bp, homo sapien
acaggtgttgctgcaaagttgttgcsgagatataccagaataccctaatc

SEQ ID NO: 65024 - DNA, 50 bp, homo sapien
tagatctctaaacttatttatcctayacagctgcaagtttataacctttg

SEQ ID NO: 65025 - DNA, 50 bp, homo sapien
atacaaagttagcatgacaacaaaartatagcttgaccaattgaatatga

SEQ ID NO: 65026 - DNA, 50 bp, homo sapien
tttattgtaatattacctttattacratggtctggaaccaaacccccaat

SEQ ID NO: 65027 - DNA, 50 bp, homo sapien
cctctgcgttgacgctaaatttgtayggcaatggcccttaggggctggac

SEQ ID NO: 65028 - DNA, 50 bp, homo sapien
cttatccagagggcttaaccaaaccragagaatgtgtgtgtgtatctacc

SEQ ID NO: 65029 - DNA, 50 bp, homo sapien
gactaaaagtgttgtaagccttattmaagtatcaccttgataatcttctc

SEQ ID NO: 65030 - DNA, 50 bp, homo sapien
gtttggggaccaaaccagaagatgckaagtgttttggggacacatgtggt

SEQ ID NO: 65031 - DNA, 50 bp, homo sapien
tccaaactccctccccagagatgatyattgctaacattttcatgtatttc

SEQ ID NO: 65032 - DNA, 50 bp, homo sapien
acactggagcaataccattctctaayagacagtcatgctcctgtttccct

SEQ ID NO: 65033 - DNA, 50 bp, homo sapien
tgtatggacacacacacagacacackatttgtctctatttttgctccttt

SEQ ID NO: 65034 - DNA, 50 bp, homo sapien
ctttcccttgtggaggctcctttacmatgtggccatcttcagtctttcct

SEQ ID NO: 65035 - DNA, 50 bp, homo sapien
gaaggaagaaaagaatggttgaatgmcagctacaaataggtgagttcaga

SEQ ID NO: 65036 - DNA, 50 bp, homo sapien
tagacaagatcactagagaatgttakgtaagtattagtagatcctcattc

SEQ ID NO: 65037 - DNA, 50 bp, homo sapien
aaactaacaaagggctaaagtttacrtcataaagtgtcaatgcataaatc

SEQ ID NO: 65038 - DNA, 50 bp, homo sapien
caccatcacctactgtggactgtgcraatggatggtctaaatgagataag

SEQ ID NO: 65039 - DNA, 50 bp, homo sapien
aacatttataacaaacttaacatacrgtaagcaatcaatcaatgataact

SEQ ID NO: 65040 - DNA, 50 bp, homo sapien
cctgtgtttataggaccttaaacaaytatttgatgttagaatatgaatcc

SEQ ID NO: 65041 - DNA, 50 bp, homo sapien
aactcggatacccatcatcaataacrccttgttccatggcggggagctgc

SEQ ID NO: 65042 - DNA, 50 bp, homo sapien
tgtccgcctttttactacttcatacyggttgcgagcacatcgagtagccc

SEQ ID NO: 65043 - DNA, 50 bp, homo sapien
tctaaggagaagttatctttacagarcttcagtatttccaatggccatac

SEQ ID NO: 65044 - DNA, 50 bp, homo sapien
attttgagtgtttgtttcctgagacmactcctggtgataatttttatatc

SEQ ID NO: 65045 - DNA, 50 bp, homo sapien
cattctggctgatgtagaaaaagctsaaggcaattatagttttacataac

SEQ ID NO: 65046 - DNA, 50 bp, homo sapien
cagaacttcagtatttccaatggccwtacatttactaaatatagcaataa

SEQ ID NO: 65047 - DNA, 50 bp, homo sapien
ccagggagcaatttctatgcctgagwttgagaagggaacaagggaaagag

SEQ ID NO: 65048 - DNA, 50 bp, homo sapien
aattaacattgatcttagttgattcyagttcataattcattctgatacaa

SEQ ID NO: 65049 - DNA, 50 bp, homo sapien
ctcagatgtttcttctcttctcatcycaggaaataatcactgtcttattt

SEQ ID NO: 65050 - DNA, 50 bp, homo sapien
tgaggcagcaccatatgttacagaasaagacacatctggcttgaaggcca

SEQ ID NO: 65051 - DNA, 50 bp, homo sapien
tgtctctgtcatgagctcagtggttmaacaatattctttggcacctgaat

SEQ ID NO: 65052 - DNA, 50 bp, homo sapien
cctgtagataataggagaagcccaayggaatggcttaaaatggacaatgt

SEQ ID NO: 65053 - DNA, 50 bp, homo sapien
aatataataggtgatagagtatagargattgaagaagtttgactatgaag

SEQ ID NO: 65054 - DNA, 50 bp, homo sapien
tttcttcaaataaacagtgctcagargtttggtttcctgaaagtcccagg

SEQ ID NO: 65055 - DNA, 50 bp, homo sapien
tcctgaggtagaccagcatagtttcraatagaccctggaatggatttgaa

SEQ ID NO: 65056 - DNA, 50 bp, homo sapien
tgtcttctcttacttctcctagtcartactatgctggagtatctagttag

SEQ ID NO: 65057 - DNA, 50 bp, homo sapien
catctttctatgctaataaagataartgctacttttagtagctgtacact

SEQ ID NO: 65058 - DNA, 50 bp, homo sapien
ttattcatacgcaaataaggaaggamggagttgtaaatattatgggccta

SEQ ID NO: 65059 - DNA, 50 bp, homo sapien
ttcctctctagtgtgttaactcctaygatgcttagctcttgagtgtattt

SEQ ID NO: 65060 - DNA, 50 bp, homo sapien
acgaaatattcattgagtaacttctrtgtgccaggtaccttacaaaatag

SEQ ID NO: 65061 - DNA, 50 bp, homo sapien
taacttctatgtgccaggtaccttamaaaataggccctgccctgtaagaa

SEQ ID NO: 65062 - DNA, 50 bp, homo sapien
aaggtctaatttctcatgtgtttcargatctctaaaatccagaagtgaaa

SEQ ID NO: 65063 - DNA, 50 bp, homo sapien
agagcatcacagaccctctcagccaygaattaacttgctctttttctacc

SEQ ID NO: 65064 - DNA, 50 bp, homo sapien
cactggcagagcacggaccatggaarcatcttttggcagcaccagagaac

SEQ ID NO: 65065 - DNA, 50 bp, homo sapien
ttcccttagcagttttactaacttayatcctcatcaacagtgtataagca

SEQ ID NO: 65066 - DNA, 50 bp, homo sapien
ggatttgtagactttgaaattaacaratcaaagacaccagatctctgtag

SEQ ID NO: 65067 - DNA, 50 bp, homo sapien
aaaagttcctcctctcctggataatmatcctaaattgaattgtataccaa

SEQ ID NO: 65068 - DNA, 50 bp, homo sapien
ctgtatttcccattggcataatgaaytagtaagcataaattggaattcca

SEQ ID NO: 65069 - DNA, 50 bp, homo sapien
tatacattctacgtaaagacccacargtttatctggctgtaaataaaatt

SEQ ID NO: 65070 - DNA, 50 bp, homo sapien
aacaagttttagaggaagtatctgawattagaccaaagtctcagaaaaaa

SEQ ID NO: 65071 - DNA, 50 bp, homo sapien
gtgcagtttacttctaactatctcamgggaaattattctgacttcttccc

SEQ ID NO: 65072 - DNA, 50 bp, homo sapien
cctgaaaggcagatctgaatccaggkaaagaatcattgtgactaggtggg

SEQ ID NO: 65073 - DNA, 50 bp, homo sapien
tctggtagatttgaacagtgggacaygctgaaagaaactcagaggacaga

SEQ ID NO: 65074 - DNA, 50 bp, homo sapien
tcagtagctggcaggtgtattagacmaacgagacttaggtaaggaatgga

SEQ ID NO: 65075 - DNA, 50 bp, homo sapien
gagggaccaagaatatcaaatcccasagagagaggaagggctgtgaaggt

SEQ ID NO: 65076 - DNA, 50 bp, homo sapien
aaaatccagtgacttaccaaagaaaytcctctgttttctagcaatctatg

SEQ ID NO: 65077 - DNA, 50 bp, homo sapien
agtgctgcagaaaggtcctgtgagcrctggtaatcaagagtttcagaaag

SEQ ID NO: 65078 - DNA, 50 bp, homo sapien
gaggagttaattaaaattgttccctsaaaacaccagcccaatatccttgc

SEQ ID NO: 65079 - DNA, 50 bp, homo sapien
aatcatagatagtgggaagccattgstgcattttaaatgtgagtatgatt

SEQ ID NO: 65080 - DNA, 50 bp, homo sapien
tccccattcttaccatcaaatgtackgactaaagccctaactgaactgaa

SEQ ID NO: 65081 - DNA, 50 bp, homo sapien
gagcagacctactccaaaggtatggwcattccaagctttcaactgaatgc

SEQ ID NO: 65082 - DNA, 50 bp, homo sapien
attatatccactccatactccaccawtaaggacgtgtggaaccacttcag

SEQ ID NO: 65083 - DNA, 50 bp, homo sapien
cctttaagggtaagactataagcagraaaatcagttgggagtccatgtgt

SEQ ID NO: 65084 - DNA, 50 bp, homo sapien
ttgggtactgaaagacatgcagagayaatcagaatgttatttgatggaaa

SEQ ID NO: 65085 - DNA, 50 bp, homo sapien
agtactagcctagtaggagaagaaaygctgtgcaggtgctctagaagaat

SEQ ID NO: 65086 - DNA, 50 bp, homo sapien
taaagaggaaaattgcaacctaatgwactagacaagtaccttcagagcca

SEQ ID NO: 65087 - DNA, 50 bp, homo sapien
tatgtttcaagtcacattacagaacrgaaagtagaagaataacttacagc

SEQ ID NO: 65088 - DNA, 50 bp, homo sapien
gggggacactactgtattgcaaagaygttaattctccccaaatttatcta

SEQ ID NO: 65089 - DNA, 50 bp, homo sapien
ctattgaacaattttttagcttccawcattacaaaagagaagtccaatgt

SEQ ID NO: 65090 - DNA, 50 bp, homo sapien
gtacagagaatagtgcgaaagtaatracaatataaataacagtataaatt

SEQ ID NO: 65091 - DNA, 50 bp, homo sapien
tatgttttcctcataaacaatgagartaacgatgttctgtgtttcctttt

SEQ ID NO: 65092 - DNA, 50 bp, homo sapien
ctccatttcccctccaattgccagayggttttaggcaacttacaagaaaa

SEQ ID NO: 65093 - DNA, 50 bp, homo sapien
taagatttttgagagtatacagcacrctaggaagattactactactacta

SEQ ID NO: 65094 - DNA, 50 bp, homo sapien
ttaagaatacctggagtcattcaaakggttccatgtcatgattccaattc

SEQ ID NO: 65095 - DNA, 50 bp, homo sapien
acacagatatcagctattaactagcygatttgcaaaaacgtcagataaaa

SEQ ID NO: 65096 - DNA, 50 bp, homo sapien
catagataagtgggaacatcaaaccyacaattgctgtttatgaccttagc

SEQ ID NO: 65097 - DNA, 50 bp, homo sapien
aaagaaacattaggaactatgtgaaygctttcaatgagagagttttgcat

SEQ ID NO: 65098 - DNA, 50 bp, homo sapien
gatagtttccaaccttttgcatacasgtaattcatacatacacatatata

SEQ ID NO: 65099 - DNA, 50 bp, homo sapien
tgctcaataaatattcgtagactaartgaataaatagactaaggtaagaa

SEQ ID NO: 65100 - DNA, 50 bp, homo sapien
tccctcattcatatgctatttaagasattccaattttcctgaacattctc

SEQ ID NO: 65101 - DNA, 50 bp, homo sapien
gtaaagggaagtatttgagtaaatayagcctgaacaccaatcagagatag

SEQ ID NO: 65102 - DNA, 50 bp, homo sapien
gcgcattaccccataaaacttgagaygaggtgagatctgagtataaagat

SEQ ID NO: 65103 - DNA, 50 bp, homo sapien
acattgcttttgggaatgcaaactgrtatagccactctggaaaacagcca

SEQ ID NO: 65104 - DNA, 50 bp, homo sapien
ttaaccttacactgccattttgaaamttaagtaaaataatgcatataaag

SEQ ID NO: 65105 - DNA, 50 bp, homo sapien
tactaactaattgggttggttttcaygagaagcttttggaatcaacctct

SEQ ID NO: 65106 - DNA, 50 bp, homo sapien
agctttctcaaaatgaaaatttatcwcttctcagaagactctctaaatta

SEQ ID NO: 65107 - DNA, 50 bp, homo sapien
tgtttttccacatgacagctcctcasatatttaaacaaacttatattgct

SEQ ID NO: 65108 - DNA, 50 bp, homo sapien
ccccaatacattgtttgagctctttygcatttattttatttagacatgca

SEQ ID NO: 65109 - DNA, 50 bp, homo sapien
cacagaaaagcaggtgttagagtagmagtacattaaagagagagagacag

SEQ ID NO: 65110 - DNA, 50 bp, homo sapien
atttggacagaaagctcttggcacarcagtgatacctaaggataaattat

SEQ ID NO: 65111 - DNA, 50 bp, homo sapien
tggcttgtacataatcttaaaaccaycattgactccagatctttttgtta

SEQ ID NO: 65112 - DNA, 50 bp, homo sapien
acattcaacagctattaaacaagtcrcacccttcttcctgcagtctttaa

SEQ ID NO: 65113 - DNA, 50 bp, homo sapien
gcacgaagcagatctgctgtaacagrcagtatgtgcctcactgatgggca

SEQ ID NO: 65114 - DNA, 50 bp, homo sapien
caagaaattgaaaatgacctaaaggracatcaataatggaatggaaaaat

SEQ ID NO: 65115 - DNA, 50 bp, homo sapien
taattactaattttgatgcttctaartcttcatgaacaatccagtttctc

SEQ ID NO: 65116 - DNA, 50 bp, homo sapien
agcaaattttaatattgaaattaaartgttttaaggactcttcattgatt

SEQ ID NO: 65117 - DNA, 50 bp, homo sapien
agctattttacagcagaagtacacargcaaaggagttaataattccccat

SEQ ID NO: 65118 - DNA, 50 bp, homo sapien
actgtcacttttctctttggttttcyaaatcttaactttatacaaatttt

SEQ ID NO: 65119 - DNA, 50 bp, homo sapien
ctcaagtatcatctccttcataaaartttcctcagccagaggcctttctc

SEQ ID NO: 65120 - DNA, 50 bp, homo sapien
ttcaataaccttagggccattatgargaaaagaactacaactaatgggta

SEQ ID NO: 65121 - DNA, 50 bp, homo sapien
gaatctatcattgctaaatattcaaraaggctataaattttaaagtaata

SEQ ID NO: 65122 - DNA, 50 bp, homo sapien
gcatccccaaagcatgtcaatatcaraataagacagagctgacatttttc

SEQ ID NO: 65123 - DNA, 50 bp, homo sapien
tagggattgttatttcagacaagaayttcaccctacaaagtaaaggcaag

SEQ ID NO: 65124 - DNA, 50 bp, homo sapien
ggcccacacgaacctattttgaagaygagaggaacacagccgtgttgtct

SEQ ID NO: 65125 - DNA, 50 bp, homo sapien
aaagtagtttacacttgagccaatayatgatttttcaggacaagccatgt

SEQ ID NO: 65126 - DNA, 50 bp, homo sapien
acatcaataactaaaaacactacaamtagagcattgctggtgagagcctg

SEQ ID NO: 65127 - DNA, 50 bp, homo sapien
aatcatggtagtatcacctttagagycggtactgattgagaagtacaaaa

SEQ ID NO: 65128 - DNA, 50 bp, homo sapien
tcctaaggctagttgcttaactttcratggcctcattttatttagctgtt

SEQ ID NO: 65129 - DNA, 50 bp, homo sapien
tctgagcaccagtggggatatcacaytcaactaacagctaaataaaatga

SEQ ID NO: 65130 - DNA, 50 bp, homo sapien
actgtaactgttacttcagtgcctayactttctaagggttttattttgat

SEQ ID NO: 65131 - DNA, 50 bp, homo sapien
cttctaactagctgtttgaatcttasagttgtctaattgctatacagcag

SEQ ID NO: 65132 - DNA, 50 bp, homo sapien
atatttctagaattgtaagagtaaakttaggaagattcaaactaaaatgg

SEQ ID NO: 65133 - DNA, 50 bp, homo sapien
ctaccaaatagtcccaactcctacartatgactccaaactatcttttctg

SEQ ID NO: 65134 - DNA, 50 bp, homo sapien
tatactttataatactgcattacgawaaaagttgtttaggttcttagctc

SEQ ID NO: 65135 - DNA, 50 bp, homo sapien
cattttaaacataactcttctccacmgaacttgggtgtttcacaatcttg

SEQ ID NO: 65136 - DNA, 50 bp, homo sapien
gctaggaaggcaataaaggataagaygtgtttgagaaatagcaagaattt

SEQ ID NO: 65137 - DNA, 50 bp, homo sapien
atgcttgtgtgagctaaggaaagaayaggcattttgaagctgtaaagttg

SEQ ID NO: 65138 - DNA, 50 bp, homo sapien
aggatggtgaaaggatctagaagtayagtattcagtttccagaagggaag

SEQ ID NO: 65139 - DNA, 50 bp, homo sapien
tgatgtggaggattcacacagtgctraagggttggataaactaactgtgg

SEQ ID NO: 65140 - DNA, 50 bp, homo sapien
gcctggacatctctctctgctctgtsaagcttccaaaccgtttacattca

SEQ ID NO: 65141 - DNA, 50 bp, homo sapien
atcaaaactgcatttttactccctamatttacacaaaaatgtattctaat

SEQ ID NO: 65142 - DNA, 50 bp, homo sapien
caaggagaaaaaagagagaagcaaaytgtggtttcagaaatgttactggt

SEQ ID NO: 65143 - DNA, 50 bp, homo sapien
ggctgtctgtagggactgagctccgyagcttcacctgaacgtagatgcgg

SEQ ID NO: 65144 - DNA, 50 bp, homo sapien
gtttctttcctatgttcaagtcaagscagggaattatggaaatggtggag

SEQ ID NO: 65145 - DNA, 50 bp, homo sapien
tcttgctgtgggtcttttgtgggcayggttatatattttttctctcttta

SEQ ID NO: 65146 - DNA, 50 bp, homo sapien
agtggtcaaaacctggctactggaargaaatgcaatggaatcgctccgcg

SEQ ID NO: 65147 - DNA, 50 bp, homo sapien
aatagtttctgataatttaatcccastagagaaaacactcatttacatat

SEQ ID NO: 65148 - DNA, 50 bp, homo sapien
attgaaagaggaagataaccatcacwctctaaatttaggtcccatgactg

SEQ ID NO: 65149 - DNA, 50 bp, homo sapien
aagttctataggagttcagaatggaragacattatcaaaggcagtgtggg

SEQ ID NO: 65150 - DNA, 50 bp, homo sapien
ctgtcagcatatttctgtaactctayggattgcttaattcagaggtaagg

SEQ ID NO: 65151 - DNA, 50 bp, homo sapien
cagccaccacttatgaagtcagtaawtaatattcaatttgcctagagctt

SEQ ID NO: 65152 - DNA, 50 bp, homo sapien
tttatttttgtcattttatatagtcratatccgtgtagacttagctatgt

SEQ ID NO: 65153 - DNA, 50 bp, homo sapien
acaaccttcagacatgaagaaaataratacaggcttcttgatgaatgact

SEQ ID NO: 65154 - DNA, 50 bp, homo sapien
atagagaaatatctttatgaccttgmgattgccagtgagttcttcaacag

SEQ ID NO: 65155 - DNA, 50 bp, homo sapien
actaaggaaagaagagacatactatraaactgtaattcagtagtactgtg

SEQ ID NO: 65156 - DNA, 50 bp, homo sapien
aaattgtgtcatttgtggcaacatargtaagcttaaaggacattatgtta

SEQ ID NO: 65157 - DNA, 50 bp, homo sapien
attttccaatagctaatttagaagtyacatacaatgctgattaacactcc

SEQ ID NO: 65158 - DNA, 50 bp, homo sapien
tggagagagtgtatcaattctttggkaactccttaaatgtacaataatac

SEQ ID NO: 65159 - DNA, 50 bp, homo sapien
ctttcccctgccagaagtatcctcartctccatggtctacaatatactcc

SEQ ID NO: 65160 - DNA, 50 bp, homo sapien
cagaagacaatagaaagcacaagaaratggcatacatgccaatgatgtag

SEQ ID NO: 65161 - DNA, 50 bp, homo sapien
gcgctgccgcggggctggtgtctacycttcagtaagtggtcaaaacctgg

SEQ ID NO: 65162 - DNA, 50 bp, homo sapien
gctgactgttttcgaggtcaagcaaytccgtcggtagcttgctatttttc

SEQ ID NO: 65163 - DNA, 50 bp, homo sapien
gacagagacctacaagagcccagaargtggtaatatttttgagtggtaag

SEQ ID NO: 65164 - DNA, 50 bp, homo sapien
ctatcctctgttcttaaaaaggatasatgtttaacttatctattgctatg

SEQ ID NO: 65165 - DNA, 32 bp, homo sapien
acatactgaaagaaaaratactctcaagtcta

SEQ ID NO: 65166 - DNA, 50 bp, homo sapien
ctttcttgcattcagtatcagaatamtactatacccttgcaataaaagat

SEQ ID NO: 65167 - DNA, 50 bp, homo sapien
ctgtgtaaggattcaaagatgaaaamgatgaaatcactgctcctaaggag

SEQ ID NO: 65168 - DNA, 50 bp, homo sapien
gccagttctttacagtaaggtagacraagtaatgatcactcctttctcaa

SEQ ID NO: 65169 - DNA, 50 bp, homo sapien
caacttgctccctagtaagaaatccragatacctctatcctgggttactt

SEQ ID NO: 65170 - DNA, 50 bp, homo sapien
acatagtaagctgtgtcaaccatcaragggtttaaagcaacgggacaaaa

SEQ ID NO: 65171 - DNA, 50 bp, homo sapien
aatactttaattggcccatttcagaygtagattgttttaggctaactttt

SEQ ID NO: 65172 - DNA, 50 bp, homo sapien
tggagttctgtaacttggagaagaayctatgcttagcctgcttagtagta

SEQ ID NO: 65173 - DNA, 50 bp, homo sapien
cagtggaccctgcttggatgcataaytggaacttgaggtcaaggactgac

SEQ ID NO: 65174 - DNA, 50 bp, homo sapien
gagtaccagtttagccacctggtgamaagttgattataaaggatcacttt

SEQ ID NO: 65175 - DNA, 50 bp, homo sapien
tgcaaattcgtaacattctacctacwaacctctttctcagctctccctgc

SEQ ID NO: 65176 - DNA, 50 bp, homo sapien
aaaccagttctgatccaaatccctaraagtattgctgttttgggggtgac

SEQ ID NO: 65177 - DNA, 50 bp, homo sapien
ctaatcctagtgggagatataagtcratgcccaagtttcatctccagagg

SEQ ID NO: 65178 - DNA, 50 bp, homo sapien
ctcttcaagttctcttggatgcttayggaaacggaatattgcttttgcaa

SEQ ID NO: 65179 - DNA, 50 bp, homo sapien
ctgtattaaagggtttgggtaaaacrgaattgcagctggaaaatggaaga

SEQ ID NO: 65180 - DNA, 50 bp, homo sapien
tataatagatcttgcttttccagtcyatatctggcttttcaggctcaccc

SEQ ID NO: 65181 - DNA, 50 bp, homo sapien
tgcaacactcctatttgagctgtaartaaaccagatggctcctgccaact

SEQ ID NO: 65182 - DNA, 50 bp, homo sapien
tatgccagtgtatttcccacttttaygatcctgactcagactaagaaata

SEQ ID NO: 65183 - DNA, 50 bp, homo sapien
catggttggtagatcaatcataatcmaaaagcatcatctaatagagcaaa

SEQ ID NO: 65184 - DNA, 50 bp, homo sapien
tcagtgttgacaaacatatccacaamtgttcatcctgcaatcacccatac

SEQ ID NO: 65185 - DNA, 50 bp, homo sapien
agaggctctaggaaaggaaaaggaarctccctatgctctcccacagagca

SEQ ID NO: 65186 - DNA, 50 bp, homo sapien
ctacccagtgcctccagctcactagsaaagaacggaggactaacagaacc

SEQ ID NO: 65187 - DNA, 50 bp, homo sapien
ggactgagaatgtgtagggccacagraggatatcgtataagcacagtaga

SEQ ID NO: 65188 - DNA, 50 bp, homo sapien
ctctccaaaccaaagaatcaggccaygctgttcctctactatactccaaa

SEQ ID NO: 65189 - DNA, 50 bp, homo sapien
actcaggccaatactacattacgaayactgcacagtagcaaaacctatag

SEQ ID NO: 65190 - DNA, 50 bp, homo sapien
acaatgtctctgagtttgctatttcyacttcataatatttttaacaagat

SEQ ID NO: 65191 - DNA, 50 bp, homo sapien
caaacataaagagaaaagccagtccraaaagcagaatgagtctagatgcc

SEQ ID NO: 65192 - DNA, 50 bp, homo sapien
agggtattaaagtcagatggattggmcatatgattcaactgaatgattta

SEQ ID NO: 65193 - DNA, 50 bp, homo sapien
tgtcatggtcccaagatggttattamgatctcagacatcaagggaccatt

SEQ ID NO: 65194 - DNA, 50 bp, homo sapien
ctgtacctcttttttaacattaaagyaagagtgttccaagactcctcaat

SEQ ID NO: 65195 - DNA, 50 bp, homo sapien
aaatccctatctcctcagggtataaktccctaagacaattatatgagact

SEQ ID NO: 65196 - DNA, 50 bp, homo sapien
gaattttgatatactgtattttcacygcaattttctaaataatatataac

SEQ ID NO: 65197 - DNA, 50 bp, homo sapien
ttagttatgacatctattctttgggracagtaaaaccacatgaatgcttt

SEQ ID NO: 65198 - DNA, 50 bp, homo sapien
ataaccaattaatcttcttgacagcraagtctccagttaaaaaatacgag

SEQ ID NO: 65199 - DNA, 50 bp, homo sapien
gcaaattaatcttttacaagctactsagcagtgaggttagaagataaaca

SEQ ID NO: 65200 - DNA, 50 bp, homo sapien
attcaacctccctgggcatgtaaaamcaggctaagaacagtacctgcctt

SEQ ID NO: 65201 - DNA, 50 bp, homo sapien
ttgagtctgcaaaggagagattaggwattgaagagagtataaaacaagtc

SEQ ID NO: 65202 - DNA, 50 bp, homo sapien
aagaatacgttagagaaatgagaaaygaaactcacatcctttcatattgt

SEQ ID NO: 65203 - DNA, 50 bp, homo sapien
aatttggttttcagaatatctgctaygtccaacctgggctcggtcaggct

SEQ ID NO: 65204 - DNA, 50 bp, homo sapien
tagctgtggggccctccaacatgggmaaaactgagttgtgacccttccac

SEQ ID NO: 65205 - DNA, 50 bp, homo sapien
tcactttgtgagtgaaatgacttaaygtggtttagagttttttgtttgtt

SEQ ID NO: 65206 - DNA, 50 bp, homo sapien
agagaatgtattggacagcaagagaygaagttgagggatgaattctagga

SEQ ID NO: 65207 - DNA, 50 bp, homo sapien
ctgcaaagattcaaccaattgatgartaaaatatacatgccgactgtaaa

SEQ ID NO: 65208 - DNA, 50 bp, homo sapien
agcagatatactttaaattatgtccygcagaatactattgcaagtcatct

SEQ ID NO: 65209 - DNA, 50 bp, homo sapien
gctgaagacttttgggttccatgtaygaaggtgaaaaatcatttatcgaa

SEQ ID NO: 65210 - DNA, 50 bp, homo sapien
ccttctgcaatgggctttgcaggtaygatttcaacttcaaatctttctat

SEQ ID NO: 65211 - DNA, 50 bp, homo sapien
atgtgagaaattgacctggaagggartaacctaaggtagaaaaagtaaaa

SEQ ID NO: 65212 - DNA, 50 bp, homo sapien
gcttctctagaattaggaagtgaggycatcaaaggggagaggacccttaa

SEQ ID NO: 65213 - DNA, 50 bp, homo sapien
ttaactattgctggaatgattctaayagaccacctttagaaggaagtgat

SEQ ID NO: 65214 - DNA, 50 bp, homo sapien
tacttaataatactctgctgtctaaratccttttcatgtcatttgaacat

SEQ ID NO: 65215 - DNA, 50 bp, homo sapien
agagggggtaggtctgatggtgcatkaaacagtcacaaatagcaattaca

SEQ ID NO: 65216 - DNA, 50 bp, homo sapien
agaaaaccttttccattgctcaagcsactatactcctcagaaaatttcag

SEQ ID NO: 65217 - DNA, 50 bp, homo sapien
atcagaacttgctgaattaagccccwgcttttgaaatgtcttgcatattg

SEQ ID NO: 65218 - DNA, 50 bp, homo sapien
tgtcaacctttatgttaagctgatgrtaaaagaagtttcattcttacctt

SEQ ID NO: 65219 - DNA, 50 bp, homo sapien
agtttctggttttcttttgtatcagyttcctccattatctctaagaatgt

SEQ ID NO: 65220 - DNA, 50 bp, homo sapien
ggtatgcagggctagtattctcgaarccaattttacatatgactagcagc

SEQ ID NO: 65221 - DNA, 50 bp, homo sapien
ctagaccatttccaagaatgataaaycacagagaagggcattctttcttt

SEQ ID NO: 65222 - DNA, 50 bp, homo sapien
ttcttttgtcccagactgttccagartaaaggttaagtatggaaatgtca

SEQ ID NO: 65223 - DNA, 50 bp, homo sapien
ttaaaatataaaaatgattttttccraaaagacacagttgcactcttata

SEQ ID NO: 65224 - DNA, 50 bp, homo sapien
catcaccgacaagagttaacacttayctagcgctgtgtgccaagcactga

SEQ ID NO: 65225 - DNA, 50 bp, homo sapien
ctaagaattccttggcctgcataccmgctgttgaatggggcacagaattg

SEQ ID NO: 65226 - DNA, 50 bp, homo sapien
ccaagataggtatacaaaaggtgacyatcagattctcaggactcccatta

SEQ ID NO: 65227 - DNA, 50 bp, homo sapien
caggtagcaacaacaacaaaagtatragaatagttccagtcctcaaagtt

SEQ ID NO: 65228 - DNA, 50 bp, homo sapien
aaagaggagattggaaggtagcaatsagaacaggaggaaagattgtacag

SEQ ID NO: 65229 - DNA, 50 bp, homo sapien
gcctccagctaaaccagagattcacscttttagcagaaacttggataata

SEQ ID NO: 65230 - DNA, 50 bp, homo sapien
atccatggcataattttcctctcccraaaataatgatcctgacagcaatc

SEQ ID NO: 65231 - DNA, 50 bp, homo sapien
gtgagctagaatctttgctcctagcrgaaaaggttttgttttgcccttat

SEQ ID NO: 65232 - DNA, 50 bp, homo sapien
acatttacaaggtaatgttgaataaygaagacattaaggataattttttt

SEQ ID NO: 65233 - DNA, 50 bp, homo sapien
aaagtacagacttaatagtaggtaarggttgttttcacaaggcatagcaa

SEQ ID NO: 65234 - DNA, 50 bp, homo sapien
agtacttcagagcatttttcagttasagtcatgccagcctttgcaatgga

SEQ ID NO: 65235 - DNA, 50 bp, homo sapien
gtgctgcccaactctgctctacaagmaatatgaggaagggggcttctcta

SEQ ID NO: 65236 - DNA, 50 bp, homo sapien
actctgtgtaggattagctatattayctccatgtcacaggtggggaaaca

SEQ ID NO: 65237 - DNA, 50 bp, homo sapien
aaggaccagaagtagcaaagagcaamgtataattatgtactctgagggtc

SEQ ID NO: 65238 - DNA, 50 bp, homo sapien
atcccactatgaattacttgacctcyaaaatttcattatttaaattaagt

SEQ ID NO: 65239 - DNA, 50 bp, homo sapien
gtaataaaacattgtgatcaagtgascttttaccataagtgcttatttag

SEQ ID NO: 65240 - DNA, 50 bp, homo sapien
aggccagataggttttatttgtaacmcaagagaaagattatacatcccca

SEQ ID NO: 65241 - DNA, 50 bp, homo sapien
agctttttgttttgaaaatgtttaaratctcccatctatgaaaatataat

SEQ ID NO: 65242 - DNA, 50 bp, homo sapien
ttgtcaacaatcatagacagtatacrcggaaagaaaaagccagtaatttt

SEQ ID NO: 65243 - DNA, 50 bp, homo sapien
agccctgttctcataaattgtgtgaytagcaactcagttcagttctgata

SEQ ID NO: 65244 - DNA, 50 bp, homo sapien
ggatgcattgtttgccaggacagacrgaacttcagtaagagttatctggc

SEQ ID NO: 65245 - DNA, 50 bp, homo sapien
tggggtctgtgttggaagatctggayaacttagacggcccgggtggctga

SEQ ID NO: 65246 - DNA, 50 bp, homo sapien
tttctttaagtggtagaaatcagaaycactcaaatgcagtgcactgagaa

SEQ ID NO: 65247 - DNA, 50 bp, homo sapien
agcagatgagttttacttgaaataayggaaaaggtaagcagaaaaagagg

SEQ ID NO: 65248 - DNA, 50 bp, homo sapien
agctagttaatttcacgcaaaaagaraataaggacaatctggtaatagca

SEQ ID NO: 65249 - DNA, 50 bp, homo sapien
ggtatttcaaggggatgccctgatastaatgggagacaatctcagatgca

SEQ ID NO: 65250 - DNA, 50 bp, homo sapien
atgactgatatcaggcttatcactaycattggtctcatatttaacttgac

SEQ ID NO: 65251 - DNA, 50 bp, homo sapien
ataatcaccagcctatagaaagtctyttatgccatggatctgcttgaggt

SEQ ID NO: 65252 - DNA, 50 bp, homo sapien
tgtctactagaaaatgacaaaatccrcatactaaagatcccttttgctta

SEQ ID NO: 65253 - DNA, 50 bp, homo sapien
gggtcttgtgaaccttggctccctgytcatatttatagagaattgtacac

SEQ ID NO: 65254 - DNA, 50 bp, homo sapien
acaaaatctatcattatggtagtgawcaaacatataatatattaataaat

SEQ ID NO: 65255 - DNA, 50 bp, homo sapien
tgttttatataaaaattaatttcaawcagctcaaatatttaaatgcaaaa

SEQ ID NO: 65256 - DNA, 50 bp, homo sapien
attcatgtgtaaatttaagtaacagyacaaggtaagagatgtggtaaggc

SEQ ID NO: 65257 - DNA, 50 bp, homo sapien
tgcctaacactgcattacacaatacrgaagtgatcattccagtcagagcc

SEQ ID NO: 65258 - DNA, 50 bp, homo sapien
aaattaaacatttttcctgttaagakagttcctagtaaatgaaatgtttt

SEQ ID NO: 65259 - DNA, 50 bp, homo sapien
tcatgatgagctctaaaacatggaamaggcaagtcaatcttctaaatctc

SEQ ID NO: 65260 - DNA, 50 bp, homo sapien
ttggaagctgacccaagaactgcaaraaacagtcaattgtgctactacta

SEQ ID NO: 65261 - DNA, 50 bp, homo sapien
aattattgaggagattccacgtctgkatatggttctgctcagagaccttt

SEQ ID NO: 65262 - DNA, 50 bp, homo sapien
ctctttagtgttggcactatgtgttwattgcttagtacataagccttaat

SEQ ID NO: 65263 - DNA, 50 bp, homo sapien
tccttaggtgttcatttgtatataasagcaaggcactgtgggtatataag

SEQ ID NO: 65264 - DNA, 50 bp, homo sapien
actagagtagatgcagcatagaagcrtagaacgtttaggaaagaatcaat

SEQ ID NO: 65265 - DNA, 50 bp, homo sapien
aaaatccccagcactctgttgtccayctttagcatttatcctgcctttgt

SEQ ID NO: 65266 - DNA, 50 bp, homo sapien
gtacaggaaaggaggtgcaattgacraggaagagggtatagactggaaag

SEQ ID NO: 65267 - DNA, 50 bp, homo sapien
caaacttcgccttttagcatcagaayctcatcttttttcttaattcatac

SEQ ID NO: 65268 - DNA, 50 bp, homo sapien
accattaaaatgatgcaagctctgarcacaaggagacaatgtacattttt

SEQ ID NO: 65269 - DNA, 50 bp, homo sapien
ccactttgacaaacctatatgggaaytgaaggtttgattgatgaaagagc

SEQ ID NO: 65270 - DNA, 50 bp, homo sapien
gatatgcagataagctttgcaagaawctagtgagaccaaaataagataca

SEQ ID NO: 65271 - DNA, 50 bp, homo sapien
caaagaaacattactgtattttttcrctgaagaagggagagagggatgga

SEQ ID NO: 65272 - DNA, 50 bp, homo sapien
caagaatacttaaagttccagagtayatatgcagttaacaatatagtctc

SEQ ID NO: 65273 - DNA, 50 bp, homo sapien
tatttcattcagcacaagatgacaamatagcagtctgcttctaaatgttg

SEQ ID NO: 65274 - DNA, 50 bp, homo sapien
acattgcacaattggataactaatayttgtacacacaaaagaggattaat

SEQ ID NO: 65275 - DNA, 50 bp, homo sapien
atggaaactgaagctctaagaaaaargtaacatgttctcctgctctgctg

SEQ ID NO: 65276 - DNA, 50 bp, homo sapien
aagcacattcccaataatattctgcstattgctctccatcttagagtctg

SEQ ID NO: 65277 - DNA, 50 bp, homo sapien
tcctggtattacaacaatcttttacygcacctctatgtgaaagagttcct

SEQ ID NO: 65278 - DNA, 50 bp, homo sapien
gttttggagggcagcactaagagccratcatacagagatcacaggaagct

SEQ ID NO: 65279 - DNA, 50 bp, homo sapien
aggactttgcagattttaacgtgtawctctatggtctaggacaacaacac

SEQ ID NO: 65280 - DNA, 50 bp, homo sapien
catttaccatgcagagactctcacaraaggaactcctgaagaatgtgttt

SEQ ID NO: 65281 - DNA, 50 bp, homo sapien
aatacctgtatgtcttcttccatcarctttttttaaatttaatttttaat

SEQ ID NO: 65282 - DNA, 50 bp, homo sapien
ctgatattccttatgtggccaccaartataaacagatttagtgtcacaaa

SEQ ID NO: 65283 - DNA, 50 bp, homo sapien
ctaggttccctttaaaatgacgagarcttccaaagtgactgctactagca

SEQ ID NO: 65284 - DNA, 50 bp, homo sapien
gggagtgttcctggaagatgcttcaratgtgaaatagattgggacttgag

SEQ ID NO: 65285 - DNA, 50 bp, homo sapien
caaaggtgattggatggccaagcgaraagtgcaaagagcatcagctgcat

SEQ ID NO: 65286 - DNA, 50 bp, homo sapien
tagaaaaaaagtggcagcagcctcawcttgagtaattagaaagtctagcc

SEQ ID NO: 65287 - DNA, 50 bp, homo sapien
gtggtccatgctttactgattggtawctccaacaaagagctaccagttag

SEQ ID NO: 65288 - DNA, 50 bp, homo sapien
taacaattatgaagcatttaagacartcagaagaaattattcactcattt

SEQ ID NO: 65289 - DNA, 50 bp, homo sapien
tttctgtgcctggcagtaaggcgccsataaactctgaaaagccctcccac

SEQ ID NO: 65290 - DNA, 50 bp, homo sapien
tgtacaggtgaattaccctaagcaayatgagagatgtaagaaacagagta

SEQ ID NO: 65291 - DNA, 50 bp, homo sapien
gactcgaaattgcactcagggcaaaygtcaactccactgtacttgcttat

SEQ ID NO: 65292 - DNA, 50 bp, homo sapien
gaaagaaacactaaaggaatgaaccraaatacagcatttgtagttctcag

SEQ ID NO: 65293 - DNA, 50 bp, homo sapien
taagggacatgaaggatggcattaaraacgtaaacatatacctacaggag

SEQ ID NO: 65294 - DNA, 50 bp, homo sapien
tcagtgaacagagtcttaatgaatayagtaaaatgtacattcatccctca

SEQ ID NO: 65295 - DNA, 50 bp, homo sapien
ctaatgcctgatgatcaaggtggcamagtttcatccccaaaccatcccct

SEQ ID NO: 65296 - DNA, 50 bp, homo sapien
tggaattataatgagtagatgatatmaaatgaaacttagtagagaaaatc

SEQ ID NO: 65297 - DNA, 50 bp, homo sapien
cctaaataaccagcagcaacacccargtttagcagcagtactacatcaag

SEQ ID NO: 65298 - DNA, 50 bp, homo sapien
tgggagtagaggagggatgaagagtkgctagagtttcttcttgatatgat

SEQ ID NO: 65299 - DNA, 50 bp, homo sapien
aaatgtttctcttctctcactccacmgtatcttattatggctctaatgtg

SEQ ID NO: 65300 - DNA, 50 bp, homo sapien
aagtccactgttgctgcacgcccaartcgcattctctacatcgctctatc

SEQ ID NO: 65301 - DNA, 50 bp, homo sapien
ccttagaaaaggacaaatccatccaygggtgataacttgtgctttaaaga

SEQ ID NO: 65302 - DNA, 50 bp, homo sapien
tgtatctatctactctgtttacctawgtatctatttatctttaatctttg

SEQ ID NO: 65303 - DNA, 50 bp, homo sapien
ttgacataattgaataatggaatgamaaaaatcttacatggcaaattgga

SEQ ID NO: 65304 - DNA, 50 bp, homo sapien
actgatcttagttctttggcattcaygttctctttaaagaatgtataaag

SEQ ID NO: 65305 - DNA, 50 bp, homo sapien
ttaatttcttgaattttgcatgttaraatgtgaacatcatcttttattct

SEQ ID NO: 65306 - DNA, 50 bp, homo sapien
ttgttcaaggatgttgatagaaacayggcaactcagtaaaggaggatggg

SEQ ID NO: 65307 - DNA, 50 bp, homo sapien
tattacactgctatatcagagccaaygcttatattagccctggaggtcac

SEQ ID NO: 65308 - DNA, 50 bp, homo sapien
tcattaacattagtcatgtgggagayaggagaagaagctctgcagaaaag

SEQ ID NO: 65309 - DNA, 50 bp, homo sapien
agtctgtacctgttcagtacctatasagctactcctgtcctccttttttt

SEQ ID NO: 65310 - DNA, 50 bp, homo sapien
aagagacagagaaagagatggtgtaragagtttattcaaagggttaataa

SEQ ID NO: 65311 - DNA, 50 bp, homo sapien
gaaaaaatggtgtggacaagaatacratacagtacttaggatgcaggctt

SEQ ID NO: 65312 - DNA, 50 bp, homo sapien
ctcccaacatataaaagagatttcaktaggtgcattggaatgaagaaaat

SEQ ID NO: 65313 - DNA, 50 bp, homo sapien
aaaaattaaaaattaaaacactgggwaagaatgagataggatctgctcag

SEQ ID NO: 65314 - DNA, 50 bp, homo sapien
atctgaactctcaaaagattgaagayaaacacaatgactatatattgata

SEQ ID NO: 65315 - DNA, 50 bp, homo sapien
ctcaatttctgttgagcaatttcaayttcactcttttcttggtaaataaa

SEQ ID NO: 65316 - DNA, 50 bp, homo sapien
ttatttcaaaggctcaagccctaatwactcaacagagtctagatgtacta

SEQ ID NO: 65317 - DNA, 50 bp, homo sapien
tgaataatgttcaagtaattgataaytgtcacaaatgtaattgttctctt

SEQ ID NO: 65318 - DNA, 50 bp, homo sapien
atgtgattaaatttgaatcactgtayaataactcatgtagagcataaata

SEQ ID NO: 65319 - DNA, 50 bp, homo sapien
actattcttctttgtcaggcatttcrcagctttgtgtctcgggaatacaa

SEQ ID NO: 65320 - DNA, 50 bp, homo sapien
aggggttaaatatcagtcataagatyaataatggtagagttaggacaatt

SEQ ID NO: 65321 - DNA, 50 bp, homo sapien
tctggatcttcaatgtacagaacgaygcagttgaaggaggaatgatcgca

SEQ ID NO: 65322 - DNA, 50 bp, homo sapien
tgggctgcccttgttcttgtgctaawgttatttttgaaaggtttaagctc

SEQ ID NO: 65323 - DNA, 50 bp, homo sapien
tccttgaatgcaaatagacttattgygaagaatgtacttcaggcagaaga

SEQ ID NO: 65324 - DNA, 50 bp, homo sapien
agcacatggttttgtgaactggtggmcctacaagtaagtaatgttaataa

SEQ ID NO: 65325 - DNA, 50 bp, homo sapien
ccacagcatctatgcagattaggacsagccagtgggaagaaagcgattag

SEQ ID NO: 65326 - DNA, 50 bp, homo sapien
atgcaacaaggaatgaaaggtaaaartgttgtgcattgtatagatcagta

SEQ ID NO: 65327 - DNA, 50 bp, homo sapien
aaattagtagaagaacattagaaaaytgagcaatgcctcagccttgactt

SEQ ID NO: 65328 - DNA, 50 bp, homo sapien
tgtatgaggacccagctctttgaaakataactgataactagtgagccttt

SEQ ID NO: 65329 - DNA, 50 bp, homo sapien
gaaggtctaacagttcgttgatgatyacctcatttctctaccccagtccg

SEQ ID NO: 65330 - DNA, 50 bp, homo sapien
catcaaaaccgagtgattgaaggagmatgagaacgagatggactttggtc

SEQ ID NO: 65331 - DNA, 50 bp, homo sapien
gaattgtgaactaatttgtgtcctaygtacatcttaatttaagactctag

SEQ ID NO: 65332 - DNA, 50 bp, homo sapien
tcctatctccaaaaaagttcccaatkagtgcaaatctgtcaggataatat

SEQ ID NO: 65333 - DNA, 50 bp, homo sapien
gagtttggtctacatcaaatcttaamtatcatcttaattaagaaaatcat

SEQ ID NO: 65334 - DNA, 50 bp, homo sapien
gggagaagatgaggagttcagttttkgtcatgttcaatttgacatttatt

SEQ ID NO: 65335 - DNA, 50 bp, homo sapien
ttagtccataaagaaagatagagcaraaaatacctacaagtaggcaagta

SEQ ID NO: 65336 - DNA, 50 bp, homo sapien
aagcaaagcacagtttgaatgaagcragaggtcttatttacaatttaata

SEQ ID NO: 65337 - DNA, 50 bp, homo sapien
ttgggatctttcacagattcgttcayttgaacatcatagcagccctatgt

SEQ ID NO: 65338 - DNA, 50 bp, homo sapien
agagcaggtctttttgtcaagataartggtctggactgggttgcagaaga

SEQ ID NO: 65339 - DNA, 50 bp, homo sapien
tattctacatgtaaaggaattgattraagaagaaaaaaaagactcactat

SEQ ID NO: 65340 - DNA, 50 bp, homo sapien
cttgaatgctgacattattgattcaygatttccaccggttgtagaagaac

SEQ ID NO: 65341 - DNA, 50 bp, homo sapien
gaggcacttaggttactgctataaartgagggcaaagaggaatgtggcca

SEQ ID NO: 65342 - DNA, 50 bp, homo sapien
cttggagctattgtaaatgctattawccttaacacttggtttataattat

SEQ ID NO: 65343 - DNA, 50 bp, homo sapien
cttgtatctccaatgtgtccctatayagctcaggccaccatcatctcttg

SEQ ID NO: 65344 - DNA, 50 bp, homo sapien
tcataatctaggacaaatatgatacygacaggctattaataaagccagtt

SEQ ID NO: 65345 - DNA, 50 bp, homo sapien
ttgaaacttcttgctcatctggtaayatatcctaaaatgcataccgaaac

SEQ ID NO: 65346 - DNA, 50 bp, homo sapien
ttttttctcttccaatgattatttaygtagctaaggttaactgggtggtt

SEQ ID NO: 65347 - DNA, 50 bp, homo sapien
cagccaaagctgtagaccactgaccracagggcccaggcagggaacataa

SEQ ID NO: 65348 - DNA, 50 bp, homo sapien
atttgcagcaggactaaaactgctaraggatcaacctgtgcacagggtct

SEQ ID NO: 65349 - DNA, 50 bp, homo sapien
gaaggatcctggtgaggtccaataaygcagccaagctgtgacacatctct

SEQ ID NO: 65350 - DNA, 50 bp, homo sapien
ctcataggctcattgtgtccataaartaaactaatacatatagagagctt

SEQ ID NO: 65351 - DNA, 50 bp, homo sapien
ttgatctgttttaaattccctacaaytaacactactcaagatttaaaacg

SEQ ID NO: 65352 - DNA, 50 bp, homo sapien
gataccacatttggagtctgcccacyagttgggtatatgacctgggacaa

SEQ ID NO: 65353 - DNA, 50 bp, homo sapien
ccacatcaatgtagggaagctactamaatgtctaagcctcagtgttgtca

SEQ ID NO: 65354 - DNA, 50 bp, homo sapien
cttgtacttttatttgtttctcttgyaatgcttaatattgggccttgcac

SEQ ID NO: 65355 - DNA, 50 bp, homo sapien
tttattatctttgaaataagtgtackcatctggaattattttcccagaac

SEQ ID NO: 65356 - DNA, 50 bp, homo sapien
tgagagctgaaattttcagccaagcraatacagacttattaaatgttcta

SEQ ID NO: 65357 - DNA, 50 bp, homo sapien
gaaatcaatctctttaggctttctawctttaacagagtcaattttggtta

SEQ ID NO: 65358 - DNA, 50 bp, homo sapien
ttgctaaataagacaaatgaagagaraacaagattatatcaagatgtatt

SEQ ID NO: 65359 - DNA, 50 bp, homo sapien
ttgagtacttaaggctgtggccaacmaagagaagttcagtatgttgacta

SEQ ID NO: 65360 - DNA, 50 bp, homo sapien
gcctagaaatcttgcctttgctaagyacctcggtagatttttatgcacag

SEQ ID NO: 65361 - DNA, 50 bp, homo sapien
gaggagcagggagttacggactgaakggatctgatcaagctagaattaag

SEQ ID NO: 65362 - DNA, 50 bp, homo sapien
attatggtccatacaatgtggtccaygtatagatatagttttctccccaa

SEQ ID NO: 65363 - DNA, 50 bp, homo sapien
tggtaactttgctgagtccggcagawcaaacaggatttagcttgggaagt

SEQ ID NO: 65364 - DNA, 50 bp, homo sapien
gggacccaacagagcaagattataayggtgagcagacaggcagtgtggta

SEQ ID NO: 65365 - DNA, 50 bp, homo sapien
tgcatgtgcactgtgtccctcggcawagaggtcaacaaacaccaacctct

SEQ ID NO: 65366 - DNA, 50 bp, homo sapien
aaatagatctgggttaaatgtcaggyccattatttattggctgtgtttca

SEQ ID NO: 65367 - DNA, 50 bp, homo sapien
agcattttccagtgtttgttagcacrctaggtcaaataaatggcattaaa

SEQ ID NO: 65368 - DNA, 50 bp, homo sapien
aatcagtattagtgtagtgacaaagygaaagaaaagggtagttcagagat

SEQ ID NO: 65369 - DNA, 50 bp, homo sapien
tacagtattgaagaggaaagagtccrgattgttaaccctgtattcacttc

SEQ ID NO: 65370 - DNA, 50 bp, homo sapien
aagtgacatatagtccagttctagckcatgattttttaaaggaagttgtt

SEQ ID NO: 65371 - DNA, 50 bp, homo sapien
gtagggcattaaattcagtaaattcsaaatataaatatctatacagagaa

SEQ ID NO: 65372 - DNA, 50 bp, homo sapien
cacaagggtttgttatgatgattcartaaagtacaatcatccgtcaatac

SEQ ID NO: 65373 - DNA, 50 bp, homo sapien
tttagagcagctttattcataaccayccaaacttggaagcaataaaaatg

SEQ ID NO: 65374 - DNA, 50 bp, homo sapien
atcgtcatcactcttctcgtggaaayaagaaattcaactaaatgaactct

SEQ ID NO: 65375 - DNA, 50 bp, homo sapien
ctggactattatgtgggacaggacckctaaagacatactttatattaata

SEQ ID NO: 65376 - DNA, 50 bp, homo sapien
tttgagaaacatttcgtgagccccarctgagagtctattatgctgtgctg

SEQ ID NO: 65377 - DNA, 50 bp, homo sapien
tactaattgcggccatgacctgaacmaagatcagtagacagcaagctcca

SEQ ID NO: 65378 - DNA, 50 bp, homo sapien
ggaaggattctatgctgtgccctcargattgaaactctcattgcaaaaat

SEQ ID NO: 65379 - DNA, 50 bp, homo sapien
gcacaggccggattgtagaaaccacrgagtgacaggtgagtgaaggtgga

SEQ ID NO: 65380 - DNA, 50 bp, homo sapien
ctgttcactcttttcaaatgtactargcagataagtcacctctcctcctt

SEQ ID NO: 65381 - DNA, 50 bp, homo sapien
atcaggaagatgacttccaccgatgyacaagtttctaagggatagggacc

SEQ ID NO: 65382 - DNA, 50 bp, homo sapien
tatatgttagttattgttcctctcaycgtggtcatgacatcttccttacc

SEQ ID NO: 65383 - DNA, 50 bp, homo sapien
gaatgttggaacttgcatgataatamtactaatgtgttgtatctcttagg

SEQ ID NO: 65384 - DNA, 50 bp, homo sapien
cagaaagttgtttcaaacttcaaaaytaccaatagctcctatattctatt

SEQ ID NO: 65385 - DNA, 50 bp, homo sapien
gaaaacaaagccaatatggtgtaccrattaaggacctagactcaaaccag

SEQ ID NO: 65386 - DNA, 50 bp, homo sapien
tatgtaccaggctaagaaattggaasttaatgctcaaggtaactgaatga

SEQ ID NO: 65387 - DNA, 50 bp, homo sapien
actgaataaatgaacacacttaagayacctagcacaagttaaatatagaa

SEQ ID NO: 65388 - DNA, 50 bp, homo sapien
tggcccaaagagacaccaaagagcakatagaaataggtgagacctcttaa

SEQ ID NO: 65389 - DNA, 50 bp, homo sapien
aatgttcaggattttgattgatgggycatatattagcctggtgcaaaaat

SEQ ID NO: 65390 - DNA, 50 bp, homo sapien
cagctctgcctttactgaaatttcakctggagaaaggtccacaggtgagg

SEQ ID NO: 65391 - DNA, 50 bp, homo sapien
aattcaatagaataaaataagcttawggaactgctgaattgtaagtaaat

SEQ ID NO: 65392 - DNA, 50 bp, homo sapien
gggctgtgctagctttaggtttgacscagtgcagtcgcagtggtggtggc

SEQ ID NO: 65393 - DNA, 50 bp, homo sapien
gataaaccaaccatcgcctgtcaccrtgttctttggctgctttgttgttc

SEQ ID NO: 65394 - DNA, 50 bp, homo sapien
ttgcaatgtcttgtttatattaggaraattgtgaagtgggttttacaatg

SEQ ID NO: 65395 - DNA, 50 bp, homo sapien
ttcccagccctggcatggtgactccragagctaatcctaaattttctgat

SEQ ID NO: 65396 - DNA, 50 bp, homo sapien
gattcaacagtaaacagcaagaacgratcaaatataatcaaaataacggg

SEQ ID NO: 65397 - DNA, 50 bp, homo sapien
cacctctccatattagagtaaaccasagcattccctcgtaggcctccctt

SEQ ID NO: 65398 - DNA, 50 bp, homo sapien
tctcagagggccgcacacattttaayaggaaactcttgataatagagctc

SEQ ID NO: 65399 - DNA, 50 bp, homo sapien
ttaatggatctgaattaggctttgaygagctctattatcaagagtttcct

SEQ ID NO: 65400 - DNA, 50 bp, homo sapien
ttcatagataaggaaagtgagatgcsaaaaagattaataactcaaagtca

SEQ ID NO: 65401 - DNA, 50 bp, homo sapien
gtttctgccaaatgaggtaacaccasgttctataggaatcacagaagtaa

SEQ ID NO: 65402 - DNA, 50 bp, homo sapien
gaatctctgaagcaggaagtgaacaygggaaattcctgttacacatggta

SEQ ID NO: 65403 - DNA, 50 bp, homo sapien
aagtattactcttgcccataggccasttaacagctttgtgctttactctc

SEQ ID NO: 65404 - DNA, 50 bp, homo sapien
ggaggaagagggaagatttagataarggaagataagtgtgtacacgtgca

SEQ ID NO: 65405 - DNA, 50 bp, homo sapien
gaccatttcagaaggcctggaagtcyagctatgttaataacattcaaatc

SEQ ID NO: 65406 - DNA, 50 bp, homo sapien
tcacaaatgtgataaatgttcatgayagaggaaacatagggttcaatggg

SEQ ID NO: 65407 - DNA, 50 bp, homo sapien
atcaggcagctagtaattagcaacaytgggatccaaactcaggtctgtct

SEQ ID NO: 65408 - DNA, 50 bp, homo sapien
acttggaagtgttggagcactgttargtactattgtgggagaggtgcagg

SEQ ID NO: 65409 - DNA, 50 bp, homo sapien
aggtgtacaattttgggcaagttgaytagtgtctctatgttacccccacc

SEQ ID NO: 65410 - DNA, 50 bp, homo sapien
gcctagagtagaaaaaattaacataraaatcttcaattgttaagtgtttc

SEQ ID NO: 65411 - DNA, 50 bp, homo sapien
aaaaatatgataaaagtgaagaatakatccagaacatataatccatttat

SEQ ID NO: 65412 - DNA, 50 bp, homo sapien
acaatgctttcagaatcctgaggaargaacaatgatttacaaacagaaat

SEQ ID NO: 65413 - DNA, 50 bp, homo sapien
aagtctattgaagctgaactttatargtagtcacaattacagaatgaggt

SEQ ID NO: 65414 - DNA, 50 bp, homo sapien
agagcaagactgtctcaatcaatcartcactggggcagtagtccagtctt

SEQ ID NO: 65415 - DNA, 50 bp, homo sapien
aataacataaacgatactaacctaaygagaagatatgtggagaggtgtgt

SEQ ID NO: 65416 - DNA, 50 bp, homo sapien
ccttgcttatctcacttcccacatgyaatcgtgagtaaatactgctagct

SEQ ID NO: 65417 - DNA, 50 bp, homo sapien
aattgaacaataaataaataatagayggtgcctgagacttccaatattta

SEQ ID NO: 65418 - DNA, 50 bp, homo sapien
aaagagttccaagaagagtgctgcartagacagactggggtcggtagcca

SEQ ID NO: 65419 - DNA, 50 bp, homo sapien
tgtcacagcctgttgatatccagttytcaaatgaccatcagtcttaggga

SEQ ID NO: 65420 - DNA, 50 bp, homo sapien
acaaggtcattctaagggtatgcttmaattattgctataaggggcactta

SEQ ID NO: 65421 - DNA, 50 bp, homo sapien
tgtctcatttatctgcgtattcccaygatatcagcaaatgataggtcccc

SEQ ID NO: 65422 - DNA, 50 bp, homo sapien
actaacctacaaaccaccaactgcarcgccaggatgaatgaactggtgat

SEQ ID NO: 65423 - DNA, 50 bp, homo sapien
aaacgttgccttaccacaactaccaytccttttgcccacggattggggaa

SEQ ID NO: 65424 - DNA, 50 bp, homo sapien
agttgttctcaatgagaatactctcyatccatagccattcctgtttagca

SEQ ID NO: 65425 - DNA, 50 bp, homo sapien
gcattgatctccctctgcgttgacaygaacatcatactgaagctgacatc

SEQ ID NO: 65426 - DNA, 50 bp, homo sapien
attgagcagcgaggtaaagctgataraagaaaatatgttcctagatatat

SEQ ID NO: 65427 - DNA, 50 bp, homo sapien
ctttgccttcctcaccaaagttaccrcacaatgggtccacaggttccacc

SEQ ID NO: 65428 - DNA, 50 bp, homo sapien
ttggatggtggttgtttttatttaaytgtaggtgctcccaaccatcgaaa

SEQ ID NO: 65429 - DNA, 50 bp, homo sapien
atgtcatcatcccacttgaagatgamaaggtagttctcaaaagcaatgaa

SEQ ID NO: 65430 - DNA, 50 bp, homo sapien
ctaatagattcatatttgtatgaagmaaacctctcaaacaagcaattcat

SEQ ID NO: 65431 - DNA, 50 bp, homo sapien
attgcaattaattgcagtacttgccrgaaaggagcatgtagtctagttga

SEQ ID NO: 65432 - DNA, 50 bp, homo sapien
cactccagttgtgataaccaaatacrtctccagacactgtcaaatgtccc

SEQ ID NO: 65433 - DNA, 50 bp, homo sapien
tatcttagcattcttcatactggatyataaaggccaacttcccccatgat

SEQ ID NO: 65434 - DNA, 50 bp, homo sapien
ttatcagaacatgaagaaaaggaaasggccaattgatcaaagtttggtct

SEQ ID NO: 65435 - DNA, 50 bp, homo sapien
gcagttcattgagttttgacaaatakatggacccatgtaactgccttgcc

SEQ ID NO: 65436 - DNA, 50 bp, homo sapien
tgtccgttccttcctctttggtccasgtaatgactccttctctcagtagt

SEQ ID NO: 65437 - DNA, 50 bp, homo sapien
gaaaatagtgtcaatctaatacggaraatgtcatgttagaagcaataata

SEQ ID NO: 65438 - DNA, 50 bp, homo sapien
acacacagattaaatgtcagtgtggkaacatgcacttgtgttttctaatt

SEQ ID NO: 65439 - DNA, 50 bp, homo sapien
gtattttcttacataaaacattccartcacttgtttattacttctatttt

SEQ ID NO: 65440 - DNA, 50 bp, homo sapien
tagagtcaattgactgtaggtgatamacatatacacaaaataccttcaca

SEQ ID NO: 65441 - DNA, 50 bp, homo sapien
caccatgtttaccatatttcatgccracactccattcttttgacatatct

SEQ ID NO: 65442 - DNA, 50 bp, homo sapien
aaactggggaagactcttggaatccsggagaccttgcaagatcctctggg

SEQ ID NO: 65443 - DNA, 50 bp, homo sapien
accacagctatgaggtgataaaggcractataatgacagctctcaccaag

SEQ ID NO: 65444 - DNA, 50 bp, homo sapien
aaaaacactgaatgaataaatgaaaygatgaacacccagcctcagagctc

SEQ ID NO: 65445 - DNA, 50 bp, homo sapien
gtttagatttaaattttgatgtgacwattacaatggtgaatttaattcaa

SEQ ID NO: 65446 - DNA, 50 bp, homo sapien
tacctagtccttctgcatcttatacrctgactcatttttaacagagctta

SEQ ID NO: 65447 - DNA, 50 bp, homo sapien
tgaatttgatagataactctcttcaratgatttcaaggactaacagacca

SEQ ID NO: 65448 - DNA, 50 bp, homo sapien
gcttttaaaactgctattggattcaraactcaaattagctgctggtatgc

SEQ ID NO: 65449 - DNA, 50 bp, homo sapien
aggagaatttgtgtgattttgaaaaygtagcttatcctatatgagtctaa

SEQ ID NO: 65450 - DNA, 50 bp, homo sapien
ctgaggcagaggcttgctgtttcaayataagccatgggtatccttctgta

SEQ ID NO: 65451 - DNA, 50 bp, homo sapien
agatatcagatgtagaaaggaaataycacaattaacctttggatttagga

SEQ ID NO: 65452 - DNA, 50 bp, homo sapien
aagcttcacaacattaagtgcatcayattaaagagagaaaaggatctact

SEQ ID NO: 65453 - DNA, 50 bp, homo sapien
atgtgataccagaccattcattactraagatcaacttttattgaaagaat

SEQ ID NO: 65454 - DNA, 50 bp, homo sapien
acaacacgctatggtatactaaggtkaaataatacatcaatcagagtaca

SEQ ID NO: 65455 - DNA, 50 bp, homo sapien
aattggatttataaatttaccctgcrtcattttgcatagttcagcaagtc

SEQ ID NO: 65456 - DNA, 50 bp, homo sapien
catatgtatttttatcattgtggacyactctctgaaattatgtatttaac

SEQ ID NO: 65457 - DNA, 50 bp, homo sapien
atttctagatagtagcaaggaatgamtacattaaaatttttaaatatgtt

SEQ ID NO: 65458 - DNA, 50 bp, homo sapien
tgaataaagcgctaaaatattatgarcaagtaaacacatttttaaggcct

SEQ ID NO: 65459 - DNA, 50 bp, homo sapien
tgttgtcttgtcatcaatgacaacaytcactcaatgggtccagagtcact

SEQ ID NO: 65460 - DNA, 50 bp, homo sapien
tacatttagctgacagatgtttgcartaatcataattaatgttccaatca

SEQ ID NO: 65461 - DNA, 50 bp, homo sapien
agaccatagggtttcatgagctacaraaggttgcaaaacatgtaagaggc

SEQ ID NO: 65462 - DNA, 50 bp, homo sapien
atgcgaagctgctctgagtccttccratgacaattattttgtgataaata

SEQ ID NO: 65463 - DNA, 50 bp, homo sapien
accaaaatctctcttcttcgataaasttcccaggaggtaacccaatttct

SEQ ID NO: 65464 - DNA, 50 bp, homo sapien
ctgttgctatttcaccattaaggacsaaaggaactcacaaggaccagaga

SEQ ID NO: 65465 - DNA, 50 bp, homo sapien
ttctaaaagttctcattgaactaatsatgtttataagtagcctgtacttt

SEQ ID NO: 65466 - DNA, 50 bp, homo sapien
attttactttcatctcatagagccaygacctttgtttaatcaagtttaga

SEQ ID NO: 65467 - DNA, 50 bp, homo sapien
agatgttatattgacaagaatgagamcacattttatgactattttgaagg

SEQ ID NO: 65468 - DNA, 50 bp, homo sapien
atcagtggtagtctgtcagaattccmtgtgggcctgtggtggtggtggtt

SEQ ID NO: 65469 - DNA, 50 bp, homo sapien
caatactatgctttcaactcttgtamatccaaaattattttaatatgaaa

SEQ ID NO: 65470 - DNA, 32 bp, homo sapien
agctattaatgtaataygtccacttatataaa

SEQ ID NO: 65471 - DNA, 50 bp, homo sapien
acatgcacttattttagatagatgaygccatgatataaaaaagaagctac

SEQ ID NO: 65472 - DNA, 50 bp, homo sapien
ttcaccttgggatctattcactgacscttctgcatacatgggaattcttt

SEQ ID NO: 65473 - DNA, 50 bp, homo sapien
gaaatcacatataagcaatgtatgasacaaaattataaagcatcacacaa

SEQ ID NO: 65474 - DNA, 50 bp, homo sapien
aattttcaaacatgaagtgagaagartaacttcctaaagttaaggctaat

SEQ ID NO: 65475 - DNA, 50 bp, homo sapien
ccatacacaaaaattaaaatgtgtcrtagagctgaatgcagtaactaaaa

SEQ ID NO: 65476 - DNA, 50 bp, homo sapien
acattctggagatactcatatatggrcaaaagaaattagagcaggcatgc

SEQ ID NO: 65477 - DNA, 50 bp, homo sapien
tttctgatgaagaaactaaactccakatatatttgcatgttatttatgga

SEQ ID NO: 65478 - DNA, 50 bp, homo sapien
ccacctaggatctttttcgttactcmaagtgaactgattatggacctaat

SEQ ID NO: 65479 - DNA, 50 bp, homo sapien
aaaaccaaagaaaggacttttaaaaygatcttccacagtttgtgttgtga

SEQ ID NO: 65480 - DNA, 50 bp, homo sapien
aaaaatactgaagctcattctctgakaagtaaaattttttgaaaccctac

SEQ ID NO: 65481 - DNA, 50 bp, homo sapien
ttgtaaagaactatataagcacggtraaacaattggagcaagttgaaaga

SEQ ID NO: 65482 - DNA, 50 bp, homo sapien
tttttgccactacatcattggataawcttaatcaccattttgtttacact

SEQ ID NO: 65483 - DNA, 50 bp, homo sapien
cattttgtttacacttttagcaacawtaaacactactgtctaatagatta

SEQ ID NO: 65484 - DNA, 50 bp, homo sapien
cctttatgtcttccaaaatgctttayacagttactctcacttagtcctaa

SEQ ID NO: 65485 - DNA, 50 bp, homo sapien
ttgttcatttttatgcttagtttcarcaaagtatagacagctatttagaa

SEQ ID NO: 65486 - DNA, 50 bp, homo sapien
agactggagaaaacatttccaatatwaactctacccacagtctgctttgg

SEQ ID NO: 65487 - DNA, 50 bp, homo sapien
tccacaagagattggacaaaaaaaawtcttactgtgtcttcatctcttct

SEQ ID NO: 65488 - DNA, 50 bp, homo sapien
attctcacacttttgttagcattaaygtactatggcctgaaatatttaaa

SEQ ID NO: 65489 - DNA, 50 bp, homo sapien
agattatggcagcagtggaggtttgycactaggatttcccctcagtaaga

SEQ ID NO: 65490 - DNA, 50 bp, homo sapien
cattgttactatacatgatacctaaytaactgtattgaattaatgcatgg

SEQ ID NO: 65491 - DNA, 50 bp, homo sapien
tggtagccaaaaatggcaacaaaaartggtagctacattgagcataataa

SEQ ID NO: 65492 - DNA, 50 bp, homo sapien
aaaaatagaaaaaagaacttgtggakgtagtaaattatagtactgaataa

SEQ ID NO: 65493 - DNA, 50 bp, homo sapien
ctagttgagaacctcttgaaactttstatttagtcgttagtttctctgcc

SEQ ID NO: 65494 - DNA, 50 bp, homo sapien
tggaggtagtaaattatagtactgartaacaaaaaaaatattcactcatg

SEQ ID NO: 65495 - DNA, 50 bp, homo sapien
gtaggtacatactggatttcaaagaytgtataaaaaaacagaatgcaaaa

SEQ ID NO: 65496 - DNA, 50 bp, homo sapien
aaagcctgagtttatgtatggaaagkatccatctgttggtcaatactctg

SEQ ID NO: 65497 - DNA, 50 bp, homo sapien
acacattttcctggcctatagttacygggcacaataaaaggtgtgaaaac

SEQ ID NO: 65498 - DNA, 50 bp, homo sapien
agattatagtcaaaagtggctttcakacctgattcagctataatttttta

SEQ ID NO: 65499 - DNA, 50 bp, homo sapien
taacattggatttgaaaattgcctayaaataccactttaaactccagagg

SEQ ID NO: 65500 - DNA, 50 bp, homo sapien
agtacaatgactaaagggaatcctamaatgctcggagggctacactcctg

SEQ ID NO: 65501 - DNA, 50 bp, homo sapien
aagacctcattgtctaatggaaaacrgatataaatgatgcaatacactaa

SEQ ID NO: 65502 - DNA, 50 bp, homo sapien
ttaacaatcaatacccatacttcacrgagcttagacttttaactgtggca

SEQ ID NO: 65503 - DNA, 50 bp, homo sapien
gaacttctaatttatctccaaattcyatatccccttcttggtcttcattc

SEQ ID NO: 65504 - DNA, 50 bp, homo sapien
aatatatagatgatcctttactatcrgataaattgagagactgcatcttt

SEQ ID NO: 65505 - DNA, 50 bp, homo sapien
ctggaggattccagaaatagctgcawagttacaaattaaggatgttttat

SEQ ID NO: 65506 - DNA, 50 bp, homo sapien
gtgtattagaaatattttcaaatcargtgaaataaacatttagcatttga

SEQ ID NO: 65507 - DNA, 50 bp, homo sapien
tctctttgtatgcaaatgtgtttccrctaactccatgcaaaagccctgtg

SEQ ID NO: 65508 - DNA, 50 bp, homo sapien
attatatacatctaatgggagataargctagaaggagcattagagaagac

SEQ ID NO: 65509 - DNA, 50 bp, homo sapien
cagaacttgctctaaggaagagtacracagtgtttaatcatgtgttagat

SEQ ID NO: 65510 - DNA, 50 bp, homo sapien
gaggaaacaagagtatgagcgcatarcatcaatctgtccctacaaaattg

SEQ ID NO: 65511 - DNA, 50 bp, homo sapien
aagctggggaatgcacgggttgaccytacagaaaagaaaattcaccggca

SEQ ID NO: 65512 - DNA, 50 bp, homo sapien
gaagacaatctgccatctgccaaaaygtgataatttagcaacaaaagcat

SEQ ID NO: 65513 - DNA, 50 bp, homo sapien
ttgtgaaaacatcattgtttttaagrcattaggagagcaattaaactttc

SEQ ID NO: 65514 - DNA, 50 bp, homo sapien
gggatctcttccaggagtctgaataygagaaaagagtctctgaagtgtgt

SEQ ID NO: 65515 - DNA, 50 bp, homo sapien
ctgtttgcatgttaaccttaaaagaycaatccaggactcttctgaaagct

SEQ ID NO: 65516 - DNA, 50 bp, homo sapien
gattctaagctaagtaaatgctaaastctcccagaaagacagctatctgt

SEQ ID NO: 65517 - DNA, 50 bp, homo sapien
ataagagctaggttaagcaaacacarataggtttctttacttcagttttt

SEQ ID NO: 65518 - DNA, 50 bp, homo sapien
cattcttttaaatgttccataaagaygatagagacttagaaacatggtta

SEQ ID NO: 65519 - DNA, 50 bp, homo sapien
tcatgcacacccctcagtatatgaargatcttgaatataccagcacagca

SEQ ID NO: 65520 - DNA, 32 bp, homo sapien
agcagccacctgctttstgtcattatagataa

SEQ ID NO: 65521 - DNA, 50 bp, homo sapien
tgtgagcagtcagtgaacttttataraacgaagacagaaacaaagttgag

SEQ ID NO: 65522 - DNA, 50 bp, homo sapien
ataaacacagctgatggaaacctacsacaaatgtaaatagaacacacacc

SEQ ID NO: 65523 - DNA, 50 bp, homo sapien
ctacatttacacactatgatagagakgacttgaatcactctatggtttct

SEQ ID NO: 65524 - DNA, 50 bp, homo sapien
gtacatttcattacatgttaattacrcttctataaaactgttttacaaac

SEQ ID NO: 65525 - DNA, 50 bp, homo sapien
aatggaatttaccacagtacaggaartcctcagtcaataccaatgcccat

SEQ ID NO: 65526 - DNA, 50 bp, homo sapien
aagttagacttatcaatgaggagtgratattggtgttcctttaacatcat

SEQ ID NO: 65527 - DNA, 50 bp, homo sapien
catggctgaatccttcaggtctccartattataaggaactcctaccagga

SEQ ID NO: 65528 - DNA, 50 bp, homo sapien
cacacacacactcatcccatttttcmagttaggttgtaaaatggactgtt

SEQ ID NO: 65529 - DNA, 50 bp, homo sapien
gattggaacatgaatatcggtgtatwtcaaattttcctgggtgatttcaa

SEQ ID NO: 65530 - DNA, 50 bp, homo sapien
agtagattgccttctatagaggtatyaaaatttctaaagacatatgataa

SEQ ID NO: 65531 - DNA, 50 bp, homo sapien
tgctgtcaagataattgtgtgataamtggtgaaactttgtctacaatgac

SEQ ID NO: 65532 - DNA, 50 bp, homo sapien
tagcaaataaaattcaacaatgcatkaaagaacactcatcatgaccaagt

SEQ ID NO: 65533 - DNA, 50 bp, homo sapien
catataagagctgctaatactacaaygaggaggaagaaatttctcttcaa

SEQ ID NO: 65534 - DNA, 50 bp, homo sapien
agtcttctccagctcatacatcttayagtttattaataaagtatggggat

SEQ ID NO: 65535 - DNA, 50 bp, homo sapien
gcctagttagtgaactcacagctaayagtagattcaaaatgatgggaaaa

SEQ ID NO: 65536 - DNA, 50 bp, homo sapien
ggtctttcattttactaattctaaarcatatggcctctggctgagtactt

SEQ ID NO: 65537 - DNA, 50 bp, homo sapien
tttacagcaagatttgttgtttttayacatttgtacttgaaccaaaaaaa

SEQ ID NO: 65538 - DNA, 50 bp, homo sapien
gtcaaacagtttgggcactcataggycatgataataaaagaggattcttc

SEQ ID NO: 65539 - DNA, 50 bp, homo sapien
tggacatttcaattatgtgaatcaawaaactacagaatttgaatttacct

SEQ ID NO: 65540 - DNA, 50 bp, homo sapien
tctatcttattatgctttcccgcatmaaatgatccatccatccatgcagc

SEQ ID NO: 65541 - DNA, 50 bp, homo sapien
tttctactagatgagattactcattraaactaaacatacagcattgcttt

SEQ ID NO: 65542 - DNA, 50 bp, homo sapien
atgcagtccatgctgaaataagctayaagtgcagcttcacaaaataggct

SEQ ID NO: 65543 - DNA, 50 bp, homo sapien
gctacaagtgcagcttcacaaaatargctaggttgtagctggcttttctg

SEQ ID NO: 65544 - DNA, 50 bp, homo sapien
aacagaaatctgtgaaaaactctacraatctatgactttgaataaagtat

SEQ ID NO: 65545 - DNA, 50 bp, homo sapien
attgacaaataactacagagagaacrgtcagaaactggaagagagcaggg

SEQ ID NO: 65546 - DNA, 50 bp, homo sapien
ttcaagttgccaatggtctcactaaytgatatgtcaataataatccaaat

SEQ ID NO: 65547 - DNA, 50 bp, homo sapien
cttaacatactctaaacacctaacaygataattagtactggtggatgctc

SEQ ID NO: 65548 - DNA, 50 bp, homo sapien
ccatgtgtatttcaagtatgggatgyatataatctcaagccaaagtgggg

SEQ ID NO: 65549 - DNA, 50 bp, homo sapien
ctttatttgaaaaattaggccaaatmatgactttacaaattgatactctt

SEQ ID NO: 65550 - DNA, 50 bp, homo sapien
ttaccaacaaaagagacacacgcaaratttggattgctaaagggaaagca

SEQ ID NO: 65551 - DNA, 50 bp, homo sapien
tagaaggacctatagtactgagaaasgtgagattcatgcagaagacccag

SEQ ID NO: 65552 - DNA, 50 bp, homo sapien
taccacatagtaacatgatgctttayagcgggcaaagatgattttatgtc

SEQ ID NO: 65553 - DNA, 50 bp, homo sapien
aaatcagaacctgggtcatatcaagractagcaataatgagcactgaaat

SEQ ID NO: 65554 - DNA, 50 bp, homo sapien
tttggatgaaaggcagtacttattasagagaaagacagttttcaattaag

SEQ ID NO: 65555 - DNA, 50 bp, homo sapien
attgattaccactagctggaacaackgaatacagatagaggatcactgga

SEQ ID NO: 65556 - DNA, 50 bp, homo sapien
gtcaaaaacaacacttgtgcattacsaaggagtaattaagggcagacata

SEQ ID NO: 65557 - DNA, 50 bp, homo sapien
aaagttcttctccaatttgacgacartaagttgatatataacatgaagaa

SEQ ID NO: 65558 - DNA, 50 bp, homo sapien
actaaatggcaaattatatactcaaygttcaacaagaaagtctttaaatc

SEQ ID NO: 65559 - DNA, 50 bp, homo sapien
tacataataatatatgggaaatataratcagtgcaaacttattagtagat

SEQ ID NO: 65560 - DNA, 50 bp, homo sapien
atacacaaaaactccaagcaaaatarcattgagtagacacataaagtttt

SEQ ID NO: 65561 - DNA, 50 bp, homo sapien
tgctctttctgtgcctagtttttgasgtatgctcctatgctcctatatta

SEQ ID NO: 65562 - DNA, 50 bp, homo sapien
ggacagaaagcaaaacttatcaaaaycctttggtgcaaactaactctttt

SEQ ID NO: 65563 - DNA, 50 bp, homo sapien
tgctttctgtccaaataggcttgtayggttgatgaaactaacttaagagt

SEQ ID NO: 65564 - DNA, 50 bp, homo sapien
atgatatgatatgatatgatagataygttattactgctacagttatatac

SEQ ID NO: 65565 - DNA, 50 bp, homo sapien
tatccattatacccagtattctgatwactctggtatgttgatattttcca

SEQ ID NO: 65566 - DNA, 50 bp, homo sapien
tttctgtattgattttaacaacacgwcattttataattaagaaaaaccta

SEQ ID NO: 65567 - DNA, 50 bp, homo sapien
taatatacataaatgcacatataaakttgccactagtttggagtattaaa

SEQ ID NO: 65568 - DNA, 50 bp, homo sapien
ctcaataaattttcactggctatatmaataagaatgcaattgcagcatga

SEQ ID NO: 65569 - DNA, 50 bp, homo sapien
tgttctttcaagtctggtcaaactcyttccttttggtgatgttttctgca

SEQ ID NO: 65570 - DNA, 50 bp, homo sapien
ctttatgtaggtctttagaactgatmacatctgtgtcctttcagaggcat

SEQ ID NO: 65571 - DNA, 50 bp, homo sapien
aaaaagtgacaaaagatactactgcycaagtttcattgatgtccaaaata

SEQ ID NO: 65572 - DNA, 50 bp, homo sapien
ctgtgacattttgttaactgaggtawgctgactgttttttcagacaggtt

SEQ ID NO: 65573 - DNA, 50 bp, homo sapien
agaagccacagaacagttgtgtttakcagtcaagtgcagagctcagagat

SEQ ID NO: 65574 - DNA, 50 bp, homo sapien
aaaaatctgatctttaaatgagttargggcattgttacataatcgctggt

SEQ ID NO: 65575 - DNA, 50 bp, homo sapien
tttttggtggatggttctttctctgkgctcaagaagtttcacatgtatgt

SEQ ID NO: 65576 - DNA, 50 bp, homo sapien
taaagtttcaatttagatcttgcctraaaactttcaatagcaagaagaca

SEQ ID NO: 65577 - DNA, 50 bp, homo sapien
caggtttacaagttggacatacccarggagagatctttagctgtaaccca

SEQ ID NO: 65578 - DNA, 50 bp, homo sapien
atcctttgttgtcatgtatattatargatgttgagcagcatccttggcct

SEQ ID NO: 65579 - DNA, 50 bp, homo sapien
ctggaacaagaattaaaaatgagtcyatgatggtcctcacggctccaagg

SEQ ID NO: 65580 - DNA, 50 bp, homo sapien
agggacagagctggtatttaaagtcratatctaagctcttcttccagaag

SEQ ID NO: 65581 - DNA, 50 bp, homo sapien
ttgaactcacattgggaagttgtctraaacattatatgtggtctttgggc

SEQ ID NO: 65582 - DNA, 50 bp, homo sapien
gggttgtttcttaaaaaaaattcacrcaactgacaggaggaattgtcttt

SEQ ID NO: 65583 - DNA, 50 bp, homo sapien
atcataatttgtcattttataatacsaaaaacacaggggtcaaactgatc

SEQ ID NO: 65584 - DNA, 50 bp, homo sapien
ctggcctagaatttatttttaatgaygacttctgatataatggctccctt

SEQ ID NO: 65585 - DNA, 50 bp, homo sapien
tacaccatcttttccaaacatgaacrggaaaaattattctatttgctact

SEQ ID NO: 65586 - DNA, 50 bp, homo sapien
ttgctgtaatttaagaaaatcacgayaactgtctattatggtttctagat

SEQ ID NO: 65587 - DNA, 50 bp, homo sapien
tatgatgtcacatgagaaatatttgwaaagactagttgtttagcctgagt

SEQ ID NO: 65588 - DNA, 50 bp, homo sapien
aataatctaaagctgtagattcatcrctaggtattattagagtaagcgaa

SEQ ID NO: 65589 - DNA, 50 bp, homo sapien
gcttacacatagcaaacgtgttccayaatttcatcctactcaggctaaac

SEQ ID NO: 65590 - DNA, 50 bp, homo sapien
aatataagtctttctatcttcaaagracccattaaatacactaaatatgc

SEQ ID NO: 65591 - DNA, 50 bp, homo sapien
ctcatctgcccaatgaaatttataaygccttgtcaaatttttataaaatt

SEQ ID NO: 65592 - DNA, 50 bp, homo sapien
acagtaagatcatgccttttgttcamgtgacatcttttatcaaagactct

SEQ ID NO: 65593 - DNA, 50 bp, homo sapien
gtaataaagccctttcccaatcgtawcattgtagctttttgcctgttttt

SEQ ID NO: 65594 - DNA, 50 bp, homo sapien
attattttgattcctgtattttttcragtttccattagctctcttagctt

SEQ ID NO: 65595 - DNA, 50 bp, homo sapien
gtaaattaccagtttctcatggctartaaaagataactaggattctgtct

SEQ ID NO: 65596 - DNA, 50 bp, homo sapien
cttcatgggcatcttactgttaaaayacatttcctttcaaagaatataga

SEQ ID NO: 65597 - DNA, 50 bp, homo sapien
gtgaccataccatgaggagtacctayattccagttaactaatttccatgg

SEQ ID NO: 65598 - DNA, 50 bp, homo sapien
aacccctatgactgccagtgctaatygtgtcattacagaaattgtatcct

SEQ ID NO: 65599 - DNA, 50 bp, homo sapien
ttatattctcagaatcaccaggaacrcttcttcattgtcagcattgagaa

SEQ ID NO: 65600 - DNA, 50 bp, homo sapien
tgtttgctgtcttgaaagttctataycattttgagctttaaaaatggcat

SEQ ID NO: 65601 - DNA, 50 bp, homo sapien
cttttgcctgtatgttgtggaataartgtagaagggagctatttactaat

SEQ ID NO: 65602 - DNA, 50 bp, homo sapien
gaccacttacttgtgctaaaccccaygagaggtgttgtatgcacaccaaa

SEQ ID NO: 65603 - DNA, 50 bp, homo sapien
ctttactctacactgtaatatactayccaatctttcaaaaaatattgaac

SEQ ID NO: 65604 - DNA, 50 bp, homo sapien
ttctctaaaattatgctgagtatgtygactgatccaattgatatgattta

SEQ ID NO: 65605 - DNA, 50 bp, homo sapien
aatacctaggaattgatataaccaaygaggtaaaagatctctgcaagaaa

SEQ ID NO: 65606 - DNA, 50 bp, homo sapien
tttcctaaatggggaagtttaaatasgtcttgatgagtaatgggaggtga

SEQ ID NO: 65607 - DNA, 50 bp, homo sapien
aaggaatcttctacagttagtcctayagcaatgcaagcttcaaatagctt

SEQ ID NO: 65608 - DNA, 50 bp, homo sapien
aggagcattggactgaaggaactaaygtacaacttcatatttattgatca

SEQ ID NO: 65609 - DNA, 50 bp, homo sapien
ctattgtctagacactgactttatcrctgctcttgaaaagttttctatct

SEQ ID NO: 65610 - DNA, 50 bp, homo sapien
ttacagctataactaattgctataaygaatctaaagtattaataatacaa

SEQ ID NO: 65611 - DNA, 50 bp, homo sapien
tgaagatttctcagctagtaacaaaygcaagcttagaacctaggagtaca

SEQ ID NO: 65612 - DNA, 50 bp, homo sapien
ccatctggcctggacttaacatatgraatctggctccctgcatcatgctg

SEQ ID NO: 65613 - DNA, 50 bp, homo sapien
acagattttatcccagctccacaaaytttaggagaaacacacacacacac

SEQ ID NO: 65614 - DNA, 50 bp, homo sapien
aatttccacagagatacatgcattaractagaccaagctgaatgacattt

SEQ ID NO: 65615 - DNA, 50 bp, homo sapien
ccttgagaagatttaatgagattggyacaaaatgacttagattataagga

SEQ ID NO: 65616 - DNA, 50 bp, homo sapien
ctatgagatgttgataggttttttaygtccagatgtttttaattgttctg

SEQ ID NO: 65617 - DNA, 50 bp, homo sapien
cattagaaatagcagactcaattatwtaaaagccattatgcagttccttt

SEQ ID NO: 65618 - DNA, 50 bp, homo sapien
aatagaccaaagaatttaaggctaayaaggacaactgtgagagaatgatt

SEQ ID NO: 65619 - DNA, 50 bp, homo sapien
attgatgaacccatgaaacggtacgmatagcactgcaaatgccagtgagt

SEQ ID NO: 65620 - DNA, 50 bp, homo sapien
cctagagaaacatattggagcctgckcttcctggtttctcatttgtgttc

SEQ ID NO: 65621 - DNA, 50 bp, homo sapien
gcatgtcacagaagccttatgagtgratctattaaaaggatactactttg

SEQ ID NO: 65622 - DNA, 50 bp, homo sapien
ccctaaaggttatactagccatacamaccacaatttctagaacttaaata

SEQ ID NO: 65623 - DNA, 50 bp, homo sapien
tcaatagaaaatagtttaacaagtgrcaagagctaacaaatgtaggccag

SEQ ID NO: 65624 - DNA, 50 bp, homo sapien
taccctactatgttttgactatcaartattgtatgtaggcttgatgtatc

SEQ ID NO: 65625 - DNA, 50 bp, homo sapien
attttcagtttgaaatgaaagtaccrcatttgttccactctacttttatt

SEQ ID NO: 65626 - DNA, 32 bp, homo sapien
tttaagctcattcaaaytgttggctgaaaaca

SEQ ID NO: 65627 - DNA, 50 bp, homo sapien
aattggtttccaacacttttgactayagcatctcaatattataattgtaa

SEQ ID NO: 65628 - DNA, 50 bp, homo sapien
cagtagaatctgacttttttgataayctgttcttaattatttctgccctt

SEQ ID NO: 65629 - DNA, 50 bp, homo sapien
agtgccatccaggaactagagactaragtaaaaatccttaaaattacccc

SEQ ID NO: 65630 - DNA, 50 bp, homo sapien
tgtcattctgaaatgctacaaaggckctgtcaaaaagatgaccctattta

SEQ ID NO: 65631 - DNA, 50 bp, homo sapien
gtgtattatgagattgaactaggctytgaggagataattaaatgctaaga

SEQ ID NO: 65632 - DNA, 50 bp, homo sapien
gcatttccaagtaaaaacagtagacrgactctaagattatttgctataat

SEQ ID NO: 65633 - DNA, 50 bp, homo sapien
tttctctccctcataggctggtaaamgagagacatgatctgagtgtcaac

SEQ ID NO: 65634 - DNA, 50 bp, homo sapien
gtggacagagctgtggttccaacatmagtaaaacattatttccaaaataa

SEQ ID NO: 65635 - DNA, 50 bp, homo sapien
gcacatagaaagtcctcagcaaatgyagaaactgaataatatgttcaagg

SEQ ID NO: 65636 - DNA, 50 bp, homo sapien
gggtctttctccacacttcttccctyaaaacagtttgcaaggttcattcc

SEQ ID NO: 65637 - DNA, 50 bp, homo sapien
tggtgcctgccctattcactacatakagaattgtgaggagtaaaggaaac

SEQ ID NO: 65638 - DNA, 50 bp, homo sapien
atgaaataaatgtactgagtccaaakatattcattcaaataactggcttc

SEQ ID NO: 65639 - DNA, 50 bp, homo sapien
gagagaattcaacatggcaagattcracttgaggtttaaactcacttagc

SEQ ID NO: 65640 - DNA, 50 bp, homo sapien
agtctctcagttaaattcctattcartatcttcaactcagtcctaaattt

SEQ ID NO: 65641 - DNA, 50 bp, homo sapien
ctataactcctatggcatccactgtraagcaaggagttagatgttgctgc

SEQ ID NO: 65642 - DNA, 50 bp, homo sapien
attatattatcttattcataatccartcggaaagctgttatgagtaccac

SEQ ID NO: 65643 - DNA, 50 bp, homo sapien
gtagtgttttcatgttggtatgcaaygtatgtgacatcaaccttccattc

SEQ ID NO: 65644 - DNA, 50 bp, homo sapien
aatctaaagactgtagttggaagatyaattattgatacataaatggtttc

SEQ ID NO: 65645 - DNA, 50 bp, homo sapien
cattcttggctttatatcaccatgaraatatgttttagtttataacacat

SEQ ID NO: 65646 - DNA, 50 bp, homo sapien
atatgtacattttgaatattttaacsaatgttgatgagaaacaaaataaa

SEQ ID NO: 65647 - DNA, 50 bp, homo sapien
tttttacagaagccgctcatgagggsatagactacttgcattccctctta

SEQ ID NO: 65648 - DNA, 50 bp, homo sapien
tagtaatattcataatactgatacamcataaattttataaccatttactt

SEQ ID NO: 65649 - DNA, 50 bp, homo sapien
acagacaaataacattataagaagayatgataggatgaaatataaaaaag

SEQ ID NO: 65650 - DNA, 50 bp, homo sapien
tcactcacgctgttgcttttctgtcraatatcctccctcctgtctgctct

SEQ ID NO: 65651 - DNA, 50 bp, homo sapien
tatattaaggcaagagccacacttcragatgtaagcctatctagaaatta

SEQ ID NO: 65652 - DNA, 50 bp, homo sapien
tagaagaaagaaaagtgaggggtcastagacagcattttgttgctctctc

SEQ ID NO: 65653 - DNA, 50 bp, homo sapien
ggtgacatttatcactttaggacaaygatactagctaatcttcactgaag

SEQ ID NO: 65654 - DNA, 50 bp, homo sapien
ccataaattaaaatgaaaaataggarcttagtatcagatatgtgaatccg

SEQ ID NO: 65655 - DNA, 50 bp, homo sapien
aatacatagaggattcaaaagaaaaragaataaagcatgcttacaggatc

SEQ ID NO: 65656 - DNA, 50 bp, homo sapien
ttaatagctcttgtcatgctctttaycttaggtcactctgcttgttttcc

SEQ ID NO: 65657 - DNA, 50 bp, homo sapien
taaccctacacattcagtagcagacrcaattatatcccattcacactcaa

SEQ ID NO: 65658 - DNA, 50 bp, homo sapien
ttccactcttttacagtgttgaaaawacagtagtgaaacaaatacagaag

SEQ ID NO: 65659 - DNA, 50 bp, homo sapien
agatacgcaatcttcttactgccaayggatcaataggagcaaatatactg

SEQ ID NO: 65660 - DNA, 50 bp, homo sapien
ggggcatccgccatccacttgagccrctgtttactcttttgtaaaatggt

SEQ ID NO: 65661 - DNA, 50 bp, homo sapien
aaagataaaagatttcaaataaacarattaaagactggaaatccataaaa

SEQ ID NO: 65662 - DNA, 50 bp, homo sapien
aaactgcaaggccatgactttgaaaractcaacacgtggtctttccttag

SEQ ID NO: 65663 - DNA, 50 bp, homo sapien
aatgttataaagaagtttgtaccaaytatctcaaagaaagtttttttttt

SEQ ID NO: 65664 - DNA, 50 bp, homo sapien
gtatgtcattaatacaattaaaacakgggatcttaaagatattatgggct

SEQ ID NO: 65665 - DNA, 50 bp, homo sapien
tagaggtcactgatatgtaccattgyaacttggaaggaattccatatatt

SEQ ID NO: 65666 - DNA, 50 bp, homo sapien
agaaatggggagctgcagcaaacaargatcagaagggtaaggagagaaga

SEQ ID NO: 65667 - DNA, 50 bp, homo sapien
gattgattaacatccacagccatcargatcattcaggaaaacataacctc

SEQ ID NO: 65668 - DNA, 50 bp, homo sapien
tttcttctgataaaaatttttccackatcattttctaaaaaaagaaaaaa

SEQ ID NO: 65669 - DNA, 50 bp, homo sapien
atcaagggggaacattctcactcagragcctattgttactgccaaccaaa

SEQ ID NO: 65670 - DNA, 50 bp, homo sapien
taaaagtcttttaatcatccaatggraatttaatggacaccttctgtatg

SEQ ID NO: 65671 - DNA, 50 bp, homo sapien
atgataggtcacagaacaccctgagwgcattttgagtgggtctgatatgg

SEQ ID NO: 65672 - DNA, 50 bp, homo sapien
tgggcctaattgtatttacagttcayactcatatatagagcactggtaga

SEQ ID NO: 65673 - DNA, 50 bp, homo sapien
cttggcctagagaactgatgagaaakgaagagtaaccacagaactaggag

SEQ ID NO: 65674 - DNA, 50 bp, homo sapien
tctgtgtcaaggtactattctaagcmctttatttgtattaactcatttaa

SEQ ID NO: 65675 - DNA, 50 bp, homo sapien
agtcttcatgaaagtgaacagatacyactgctgaatttatctgtgctcct

SEQ ID NO: 65676 - DNA, 50 bp, homo sapien
tctcttctctctggaactttctccaycatatcagcgtgaactgaggtttg

SEQ ID NO: 65677 - DNA, 50 bp, homo sapien
ggacacaaacattcagaccatagcargatcccttaagaagacaaagtact

SEQ ID NO: 65678 - DNA, 50 bp, homo sapien
ggcttcccacctctgttattatcackgctagttctcatcagggaagtgag

SEQ ID NO: 65679 - DNA, 50 bp, homo sapien
ttgaaatttcactagtcttatctatyagagttttagcacaaaacagatcc

SEQ ID NO: 65680 - DNA, 50 bp, homo sapien
gctcggcaatttaagtgtagatatamatcatccgagggagaaggagagag

SEQ ID NO: 65681 - DNA, 50 bp, homo sapien
cttcctgccctgtccctggtccacawtactctctctccttctccctcgga

SEQ ID NO: 65682 - DNA, 32 bp, homo sapien
ctctatccattaatcaytatacctcacacaga

SEQ ID NO: 65683 - DNA, 50 bp, homo sapien
cttttatccctttgaaaatttcccaytacagcttcagaataatcatgggc

SEQ ID NO: 65684 - DNA, 50 bp, homo sapien
gctgtgtgctgagggaactgtcagaraagggctatgtgggagtgcatgcc

SEQ ID NO: 65685 - DNA, 50 bp, homo sapien
gagaatgaaaaaggatatattggtckaatcagatttgcatttttaaaaga

SEQ ID NO: 65686 - DNA, 50 bp, homo sapien
ttctatttttttttttttatcaaagyattgtgtaattcgttcatcaagaa

SEQ ID NO: 65687 - DNA, 50 bp, homo sapien
gaatcaggatactctatcctcataamcacatagatttgtgggtgatcatg

SEQ ID NO: 65688 - DNA, 50 bp, homo sapien
aaaaaaagtggaatttgaaatgaaartgcagtctgtcttttatgagttat

SEQ ID NO: 65689 - DNA, 50 bp, homo sapien
tatgtgcttggtatagttcctggtayagagctattagtgtttatcctagg

SEQ ID NO: 65690 - DNA, 50 bp, homo sapien
acttcagagacagccaaatctcaacygcacgttcttggagaaacctgaga

SEQ ID NO: 65691 - DNA, 50 bp, homo sapien
tatgtattttactggatattccaatyatggcaaattttttaaccattctt

SEQ ID NO: 65692 - DNA, 50 bp, homo sapien
ctagtaagagtgtcaaaatgagtagragaaaatggtttatgtcatacagg

SEQ ID NO: 65693 - DNA, 50 bp, homo sapien
caagatgctggtgacaccactgagaygtgagagagaagcacatggggcag

SEQ ID NO: 65694 - DNA, 50 bp, homo sapien
tcctttgcttctctttccacttctarcataccactaatcaacacagttac

SEQ ID NO: 65695 - DNA, 50 bp, homo sapien
atcaaatatttccatcactccacaaygtgcccttatgcacctttatatag

SEQ ID NO: 65696 - DNA, 50 bp, homo sapien
gagctcgctcctctctgaagccatarcactcaatagacttaaatgttgac

SEQ ID NO: 65697 - DNA, 50 bp, homo sapien
caatttagtcttaaggaggagactcraaatgttggtaagcagcagcactt

SEQ ID NO: 65698 - DNA, 50 bp, homo sapien
ggtcaggtgttttcctcccaggagartgtgtatttttaaagcgccaagaa

SEQ ID NO: 65699 - DNA, 50 bp, homo sapien
tgaattagcatataagtaaagactcragatacagttgtggctggagccat

SEQ ID NO: 65700 - DNA, 50 bp, homo sapien
tgtgtgatgggcacctgatctacacsaagagaacagggctgtctgcagaa

SEQ ID NO: 65701 - DNA, 50 bp, homo sapien
ttttttgcttttctaactgatagacygctctggaaaaattgctaaggttt

SEQ ID NO: 65702 - DNA, 50 bp, homo sapien
tccattctaaagaactttgtcaattsaatcagatgaaatataaatatata

SEQ ID NO: 65703 - DNA, 50 bp, homo sapien
aaaaaattgccaacaaagaagatccsagaaccagataacataactggtat

SEQ ID NO: 65704 - DNA, 50 bp, homo sapien
gcacccaagactattttgcactagamaaggtcaactttttttttttaatt

SEQ ID NO: 65705 - DNA, 50 bp, homo sapien
agatacattttaatgaaatcatttasaggaaatcgctgaaagtaaaaagt

SEQ ID NO: 65706 - DNA, 50 bp, homo sapien
aaaagttccctggcagcagttctaawtgtcatggccctgaaaactcgtta

SEQ ID NO: 65707 - DNA, 50 bp, homo sapien
taaagtttaatttaaaaattaagcayggtaagagattaacaataactaat

SEQ ID NO: 65708 - DNA, 50 bp, homo sapien
aaaagggaggagtaaaggaacaagaygagtgaataatggagtccactatg

SEQ ID NO: 65709 - DNA, 50 bp, homo sapien
acctctaaaagaaagcacattatttraaacgataaagctgtatagttaat

SEQ ID NO: 65710 - DNA, 50 bp, homo sapien
tggatcttacctataaagtaaataayaatgaagtaaagagggcagaggtg

SEQ ID NO: 65711 - DNA, 50 bp, homo sapien
acatttgaaagggattcctaaattgyagcaaatcagttctattggcctta

SEQ ID NO: 65712 - DNA, 50 bp, homo sapien
ataggagcaggcaggaccccatgaasagcactggaatcagtgtccagaga

SEQ ID NO: 65713 - DNA, 50 bp, homo sapien
agttaggtgcttttggttactgatargagcattgggattcaaatattctt

SEQ ID NO: 65714 - DNA, 50 bp, homo sapien
gatatgttcatttagctgctgtggaygaataggcattaaaaataagtatg

SEQ ID NO: 65715 - DNA, 50 bp, homo sapien
cttggcctctctaagcctcattttcyacctttgagaatgggataatgata

SEQ ID NO: 65716 - DNA, 50 bp, homo sapien
ggcactgtgctaagtgcttgacctamattgttttattttatctcatgaaa

SEQ ID NO: 65717 - DNA, 50 bp, homo sapien
aaggaaagttaacaagtcttttaggmactacctcattataccattaaata

SEQ ID NO: 65718 - DNA, 50 bp, homo sapien
tattgcaaaactctggtgaccttgarcttcaattttgatagccatgtaag

SEQ ID NO: 65719 - DNA, 50 bp, homo sapien
catttgagaaaaaaagatacatttgrattttataccacacacattgtacc

SEQ ID NO: 65720 - DNA, 50 bp, homo sapien
ttcaacttaaacttacgtagccaggsactccttttactaaagacatttcc

SEQ ID NO: 65721 - DNA, 50 bp, homo sapien
agaacaggatggtgtcataaactgascagttcttatcatccataccctca

SEQ ID NO: 65722 - DNA, 50 bp, homo sapien
gaagatctagatgtattgcaattcarcacaacataataatctgattggag

SEQ ID NO: 65723 - DNA, 50 bp, homo sapien
cttgaccttagcccatcaaaactaaygtgactggagatcacaaaaggaaa

SEQ ID NO: 65724 - DNA, 50 bp, homo sapien
ttcttattagaaacaccagctggaayagttacttgataaaatgatgtctg

SEQ ID NO: 65725 - DNA, 50 bp, homo sapien
cttgtgatatggcttaatttttctamctttatcaagaattttcacgctta

SEQ ID NO: 65726 - DNA, 50 bp, homo sapien
attttctttctaaacttcaggtatgmataaaccaatttaacttgcccagc

SEQ ID NO: 65727 - DNA, 50 bp, homo sapien
ataagtagcagagccgaatgtgcaarcacctatttactaccattcatttt

SEQ ID NO: 65728 - DNA, 50 bp, homo sapien
tgggttgtaagttccttcctagaatyactcatggagtcagtgtctctaga

SEQ ID NO: 65729 - DNA, 50 bp, homo sapien
tctttggcagcagacagtgcataaaygtaatacctgagagaagagaaaca

SEQ ID NO: 65730 - DNA, 50 bp, homo sapien
tgtttaattggcattatctgtggaaraaatgctttattaactgagacacc

SEQ ID NO: 65731 - DNA, 50 bp, homo sapien
ttagaagaccattttgcagagtgcaktacacagaatgttttcaggacacc

SEQ ID NO: 65732 - DNA, 50 bp, homo sapien
agtgagagatggcatgtatttgttamaattttagcagccagcaaggcaat

SEQ ID NO: 65733 - DNA, 50 bp, homo sapien
aacaaaagccaacagtgacataaaayggaaatataagtccttctttggca

SEQ ID NO: 65734 - DNA, 50 bp, homo sapien
caggatcaaactccaattgcctatarccataaacaggctactaacacaca

SEQ ID NO: 65735 - DNA, 50 bp, homo sapien
tcagatatggactccagtcatagtayaacgcttcagcctactgcaaatcc

SEQ ID NO: 65736 - DNA, 50 bp, homo sapien
ctattgcatcactggatagagagaamcttaatgccagagcaagtaaaggg

SEQ ID NO: 65737 - DNA, 50 bp, homo sapien
tagtgggaataggaggacccttgaastgctccgggtagtgagtagctctt

SEQ ID NO: 65738 - DNA, 50 bp, homo sapien
tcaatagcaatgtcacaagacctatygcaagccctcagttgaatctctct

SEQ ID NO: 65739 - DNA, 50 bp, homo sapien
attttaccactaaggcatggaattaygagattgaactgaagtgaactcaa

SEQ ID NO: 65740 - DNA, 50 bp, homo sapien
atactcattgtttaggaatgacttawcctgaatgtgtagactaatgacat

SEQ ID NO: 65741 - DNA, 50 bp, homo sapien
tctaatctgtcttgtccttcaagaayagatttaattatattttttggttg

SEQ ID NO: 65742 - DNA, 50 bp, homo sapien
ccgtaaattcttagccaatgtttaamagtagtgatatatgtagggactaa

SEQ ID NO: 65743 - DNA, 50 bp, homo sapien
ggcagtgcaaccatttaggatttacmgcctggaatatcacgttttagcaa

SEQ ID NO: 65744 - DNA, 50 bp, homo sapien
atttctctgggtagcctgtaaaaacsgtggaatgaggcatgttgaaatcc

SEQ ID NO: 65745 - DNA, 50 bp, homo sapien
gtcaaaattatttacatttatgtaaygtttgcaatgtatttattgactag

SEQ ID NO: 65746 - DNA, 50 bp, homo sapien
tgggcaagagaattaaatggaacatkacctcctgttagattgtatggcct

SEQ ID NO: 65747 - DNA, 50 bp, homo sapien
ggaccaaccacgtgccttgtcactasatgtaattaagagcaagtccattg

SEQ ID NO: 65748 - DNA, 50 bp, homo sapien
gtgcattagaagtttagcaatatttmtgactgcctggtagatgtcagtaa

SEQ ID NO: 65749 - DNA, 50 bp, homo sapien
ctgtacctatgcaacctccttttaaratgcataattcaatcaacacagtt

SEQ ID NO: 65750 - DNA, 50 bp, homo sapien
tctttttttatacatcgatggtcagyaatttggcaggtcttctttcacca

SEQ ID NO: 65751 - DNA, 50 bp, homo sapien
cagggctgttgttaggatttgatgarccgatttaatccctgacacagtgg

SEQ ID NO: 65752 - DNA, 50 bp, homo sapien
atattgtttaatctgtggaacctcawtatataaacaaataaaagcagagc

SEQ ID NO: 65753 - DNA, 50 bp, homo sapien
atctatctatggctgagtttagccaygccttgctggtgttttccctccct

SEQ ID NO: 65754 - DNA, 50 bp, homo sapien
gaataagagcagacagggtccagaaygcaggggatcagagagaagatgca

SEQ ID NO: 65755 - DNA, 50 bp, homo sapien
tatttcattaaacatttattcgataygatttaacaaatatttgaagaatg

SEQ ID NO: 65756 - DNA, 50 bp, homo sapien
ggcaaactacaagaacccatgattayttgtccattaaggcaatccatcga

SEQ ID NO: 65757 - DNA, 50 bp, homo sapien
cccagaaagaaaaatgcacctcttcracattgatctgtttttggagttta

SEQ ID NO: 65758 - DNA, 50 bp, homo sapien
cttactctcacttccaactaatttcscagatgcattatcacttcagaaca

SEQ ID NO: 65759 - DNA, 50 bp, homo sapien
acaaggtatgccctcctgtaaatacrccttaagtaaactagattggctga

SEQ ID NO: 65760 - DNA, 50 bp, homo sapien
atcccaatatagaatgatagaaaagkaaagagtaactacaataaaaataa

SEQ ID NO: 65761 - DNA, 50 bp, homo sapien
tattgaaaagactatccttggtccaytgacttatcttggcaccatatatg

SEQ ID NO: 65762 - DNA, 50 bp, homo sapien
aggcatgttgaaatggatgcttaatracaatgtaggtgtctagaatccta

SEQ ID NO: 65763 - DNA, 50 bp, homo sapien
aaatgcagtctaggacacaagtaccrcaatttctaggcgaggcctagtgc

SEQ ID NO: 65764 - DNA, 50 bp, homo sapien
tgggaggtttatgcatacacaatgayatgttaggattaacctgatagtat

SEQ ID NO: 65765 - DNA, 50 bp, homo sapien
aaaaaaaaatgtgtgtttgttactayagcaagctttcaagagaggatata

SEQ ID NO: 65766 - DNA, 50 bp, homo sapien
ttaattgtttaaagctcaacttatgraacaccaccaaaagcctcctttgg

SEQ ID NO: 65767 - DNA, 50 bp, homo sapien
cattctcacactgctaataaggacaygctgactgggtaatttataaagaa

SEQ ID NO: 65768 - DNA, 50 bp, homo sapien
gcggtgttcagttctctcagttggayatgaatgttgctcttgttgctcta

SEQ ID NO: 65769 - DNA, 50 bp, homo sapien
atgggtgtccctaatccttgctaacsatttttctgcttaaggtgttgaat

SEQ ID NO: 65770 - DNA, 50 bp, homo sapien
cctcaacatacagattcttcagcggygttcagttctctcagttggatatg

SEQ ID NO: 65771 - DNA, 50 bp, homo sapien
aatcaacattctccagtcaaagggaytcagtcaagtatcagcatgagacg

SEQ ID NO: 65772 - DNA, 50 bp, homo sapien
ctgttccatgctcttgcaacacaagyaatgctataggtctttatttctct

SEQ ID NO: 65773 - DNA, 50 bp, homo sapien
agatgttttggtagattatcttttcyaactgataaattttttaaattggg

SEQ ID NO: 65774 - DNA, 50 bp, homo sapien
tttagttaattgaaaatgattgtcaracctatttgtagatgtcaaacaag

SEQ ID NO: 65775 - DNA, 50 bp, homo sapien
cctccaaaaaatctgttgaagtataygcaaggagcaaagtctcaaaactc

SEQ ID NO: 65776 - DNA, 50 bp, homo sapien
caagaatcgtcctacagccccttagrtttcgttgcactatcagggaaggg

SEQ ID NO: 65777 - DNA, 50 bp, homo sapien
attcgatgttttggggcagctgatarcttgtgtagccatgactattgagt

SEQ ID NO: 65778 - DNA, 50 bp, homo sapien
caaactatggctccaagcaagataawcacaacaagcaaggactttatttt

SEQ ID NO: 65779 - DNA, 50 bp, homo sapien
gcgtcatgttttgatggtgcttttayatgcaagggctatgtagggcttta

SEQ ID NO: 65780 - DNA, 50 bp, homo sapien
gaacagacatgtgcttctgtacagcrttatttatcaacaagtaaagctgt

SEQ ID NO: 65781 - DNA, 50 bp, homo sapien
ataaatgagaatttacatgaaataaytaaaaaactgatagatgctcttct

SEQ ID NO: 65782 - DNA, 50 bp, homo sapien
gtctagagttagtcatgccttagaayatgcccatgaacaatctccccaca

SEQ ID NO: 65783 - DNA, 50 bp, homo sapien
tggtggcccagacaataaaaggagaygctaaagaactggtcttgggaagg

SEQ ID NO: 65784 - DNA, 50 bp, homo sapien
tcagcttttcttctcatgatgtgtayatttaaggatacaaatttacttcg

SEQ ID NO: 65785 - DNA, 50 bp, homo sapien
acagcctagacgctctgcatacacamaaaagaaataaagtacgtacaaac

SEQ ID NO: 65786 - DNA, 50 bp, homo sapien
aagtgttccaaatacaggtctctcayaaacagataataaagcatcctaca

SEQ ID NO: 65787 - DNA, 50 bp, homo sapien
tacctgtagttgtgggaaactaatastaggaaacgtaattggtgcatatc

SEQ ID NO: 65788 - DNA, 50 bp, homo sapien
ccttacctgtttttaatagttacaartctgttatttaccatggcagatcg

SEQ ID NO: 65789 - DNA, 50 bp, homo sapien
taagtagtttgctgcactcattacasaagtttttcaattagtattcacaa

SEQ ID NO: 65790 - DNA, 50 bp, homo sapien
aaagagtgtgaatgattcactattcrctgtcagataaattatttttaaca

SEQ ID NO: 65791 - DNA, 50 bp, homo sapien
gccttttacttgcttgcagctgttawctctaatccctataacagtaccca

SEQ ID NO: 65792 - DNA, 50 bp, homo sapien
gaacctagaaaaaaggcctgaaatasaaacatacatttgggagttatcag

SEQ ID NO: 65793 - DNA, 50 bp, homo sapien
tgagaactctgccttcagatgctccratttgggaagcttccaattaccag

SEQ ID NO: 65794 - DNA, 50 bp, homo sapien
ctaggttctagattcatatatcctayaacctaactgatgtctccatttgt

SEQ ID NO: 65795 - DNA, 50 bp, homo sapien
gggtggaggcagagaaagaagccaasttgcctgatgtgttgccaagtgcc

SEQ ID NO: 65796 - DNA, 50 bp, homo sapien
aagtgttttccttcatcttcggaaaytgggtaaagaatctagacccttaa

SEQ ID NO: 65797 - DNA, 50 bp, homo sapien
gcagatttgccagaaagtgttccagscaaaagaaactgcaaacttaaaat

SEQ ID NO: 65798 - DNA, 50 bp, homo sapien
tattcactgcctgaactttttcacawtgagcctgcagaaattttatttta

SEQ ID NO: 65799 - DNA, 50 bp, homo sapien
aggattatttgcaacttgtgacacaygagctaatattcttatacaaaaag

SEQ ID NO: 65800 - DNA, 50 bp, homo sapien
catatactctaatagtaatttttgaragaaagtgaaaacaagactaattt

SEQ ID NO: 65801 - DNA, 50 bp, homo sapien
attccaataggggactacagtgtatracgaaatgctattgagtaactcat

SEQ ID NO: 65802 - DNA, 50 bp, homo sapien
tttatttggaacttcaagcactctayggtgatttcctttcagagttcttt

SEQ ID NO: 65803 - DNA, 50 bp, homo sapien
actcaaatagcatctgcacatatgarccagcttttgatagagaataatat

SEQ ID NO: 65804 - DNA, 50 bp, homo sapien
tcagtaataggcagaaaatagctaayataacaacagaacataacagactc

SEQ ID NO: 65805 - DNA, 32 bp, homo sapien
gtccaatcagcccggarcttctgatgaatttg

SEQ ID NO: 65806 - DNA, 50 bp, homo sapien
cctagaattgctccgtgtaatttgaygatgaggacatctttctgtttctt

SEQ ID NO: 65807 - DNA, 50 bp, homo sapien
aggtacaagtccacaaagagagaccyagcggcccagcagcagcctcctgg

SEQ ID NO: 65808 - DNA, 50 bp, homo sapien
attggagtctccctaagtttcacatyaaccctcattctataacacagagc

SEQ ID NO: 65809 - DNA, 50 bp, homo sapien
tgataaacactgtaaaaataaaaaakttggagagcttaccagtgcttctg

SEQ ID NO: 65810 - DNA, 50 bp, homo sapien
ctagtttttggcattctgtcagtcaytgaatgtccttcgtcagatcacag

SEQ ID NO: 65811 - DNA, 50 bp, homo sapien
ggtatagacttaaagtgtgtaggaarcaatgaggtcagggtaatgacggg

SEQ ID NO: 65812 - DNA, 50 bp, homo sapien
acctaatcgcagctaactttattgtrtacaaactcataatgtgctaggca

SEQ ID NO: 65813 - DNA, 50 bp, homo sapien
tcctttgtctcgtgcatttgaaatcracatactaccttgtgttctgtacc

SEQ ID NO: 65814 - DNA, 50 bp, homo sapien
caagtttactaggaatcacggctgcragggtgtagagaaaaaggcatttc

SEQ ID NO: 65815 - DNA, 50 bp, homo sapien
aatgcagatgatgccaactttactasgttatgtgagaagtgaatgagaaa

SEQ ID NO: 65816 - DNA, 50 bp, homo sapien
aaaaaacatttccctactgcttacaraatagaagtcactagttgactgca

SEQ ID NO: 65817 - DNA, 50 bp, homo sapien
gttacattggtacaatcattttgaargacttaccaagagtttaatacagt

SEQ ID NO: 65818 - DNA, 50 bp, homo sapien
aggatgaccctagcaatatggtatgscaaacattactagtgttcgcccag

SEQ ID NO: 65819 - DNA, 50 bp, homo sapien
aacacacccaaacgagaggctcttcrattatttttattccttgcacgcct

SEQ ID NO: 65820 - DNA, 50 bp, homo sapien
tgtctgttacacaaggatggtaacawgttggaaagaaaatgagacaagca

SEQ ID NO: 65821 - DNA, 50 bp, homo sapien
atccaagtgacagagcccatttcagsatggcgactaaggctgatgatgtt

SEQ ID NO: 65822 - DNA, 50 bp, homo sapien
cagacacaggtgagccttacctgacraagtcatgattgtcatcccgagga

SEQ ID NO: 65823 - DNA, 50 bp, homo sapien
tggtaaggtggtatctggtctagcamaaaatcggatatgtggttattaca

SEQ ID NO: 65824 - DNA, 50 bp, homo sapien
tctctttggatattaatgtggatgtyaaaatgtgggtttatttgatgagt

SEQ ID NO: 65825 - DNA, 50 bp, homo sapien
accaacaaaatattcctcagagaaawtagagatccaaataaattgaaagc

SEQ ID NO: 65826 - DNA, 50 bp, homo sapien
ctgataaacagagagttgctgtatayagaggtggtgctgtgggcttgttt

SEQ ID NO: 65827 - DNA, 50 bp, homo sapien
gggagaaacaaaatcaccagcagaaygaagaaaaaatagagaaatgtccc

SEQ ID NO: 65828 - DNA, 50 bp, homo sapien
ccctgactttaatctttgccttgtamagtagcaccatatataagtccatt

SEQ ID NO: 65829 - DNA, 50 bp, homo sapien
aaatatctttaaaaatttgtcagtcrgaactacctttggagttttaattt

SEQ ID NO: 65830 - DNA, 50 bp, homo sapien
atgtttgaccctaacaggtagtcaaygccctcagcctagagagtcgggtt

SEQ ID NO: 65831 - DNA, 50 bp, homo sapien
ctgaatcatctcttggcctaaactaycatttcagtttctccttaggcaag

SEQ ID NO: 65832 - DNA, 50 bp, homo sapien
tgtaggtgaaagtcagaagcggatayattttggctcggtattaggaaaaa

SEQ ID NO: 65833 - DNA, 50 bp, homo sapien
aatgctgttaggtatgaaattaggaraactacagaggtttaatgactctg

SEQ ID NO: 65834 - DNA, 50 bp, homo sapien
aaaatacaggctagtggtgtagattraaatgcctcaaagaagacagcatg

SEQ ID NO: 65835 - DNA, 50 bp, homo sapien
cataacattaattcactcttcttaaytcacatcatgaattaaagagaaca

SEQ ID NO: 65836 - DNA, 50 bp, homo sapien
tccaatatcatcctatacagcaaaaygaaatagcttagaatcacctgttg

SEQ ID NO: 65837 - DNA, 50 bp, homo sapien
gcagtcattctgcaattacgttcacycttcttcaagctggctccaagtat

SEQ ID NO: 65838 - DNA, 50 bp, homo sapien
aatccaaaagtaagtaaaaatgctaygcacagagttgttcacacagtgta

SEQ ID NO: 65839 - DNA, 50 bp, homo sapien
attgcaaagctatgtacccgtgacartgtaaatgaaaggtttgattgtgc

SEQ ID NO: 65840 - DNA, 50 bp, homo sapien
aacactgaatgaacatgtttgccatsaatatttttgcccacagacgttcc

SEQ ID NO: 65841 - DNA, 50 bp, homo sapien
gccaaatgagcccgggatctagccascacaaaaatccatgtctacaggta

SEQ ID NO: 65842 - DNA, 50 bp, homo sapien
taaattcacacttatgatcaaattcrcatctaaaattaactattgcattg

SEQ ID NO: 65843 - DNA, 50 bp, homo sapien
gcatgagttgaataacaccacttcaratttatagctgggaggcggtgcaa

SEQ ID NO: 65844 - DNA, 50 bp, homo sapien
gtcttcgtccatccacacgctccagwatttctcttttgtagtaatatctg

SEQ ID NO: 65845 - DNA, 50 bp, homo sapien
tttccagagagcagcctgcacggtcmctggctcagacagtccactgttct

SEQ ID NO: 65846 - DNA, 50 bp, homo sapien
atatggacttggggaaagggatcaakaaatcattcagttgtttgtgctta

SEQ ID NO: 65847 - DNA, 50 bp, homo sapien
atctttgctgtgacttagatcattartaacctgcctttctgcttttcatc

SEQ ID NO: 65848 - DNA, 50 bp, homo sapien
gccctgaggatccatatgtagggtamgcataactgtgaactgagccagta

SEQ ID NO: 65849 - DNA, 50 bp, homo sapien
acattttaatctcagtttactcccaraatttcctcagagcaatcttttaa

SEQ ID NO: 65850 - DNA, 50 bp, homo sapien
atccgattcttaggtcaaatatgtaygataattatccttgatagagtctg

SEQ ID NO: 65851 - DNA, 50 bp, homo sapien
attggggccagctggctttgccttakaatcaaagtttctcacaattaaat

SEQ ID NO: 65852 - DNA, 50 bp, homo sapien
attaagtaaaaataaaaattaatttsaaaactattgtggtgtagtgaata

SEQ ID NO: 65853 - DNA, 50 bp, homo sapien
aacaatctggcaatttctcataaacraacgcccactctgtgacccataaa

SEQ ID NO: 65854 - DNA, 50 bp, homo sapien
ccacattttgccaatgaagaaaccamatctttaaaagcacagaggatgga

SEQ ID NO: 65855 - DNA, 50 bp, homo sapien
tctcaggaaacacagttttgtactayatgccatctactgtctgaaaacaa

SEQ ID NO: 65856 - DNA, 50 bp, homo sapien
acccacagtgatgaatcatgctttcragatgtagggaagtcataaacaca

SEQ ID NO: 65857 - DNA, 50 bp, homo sapien
ttttttccctcataagttttctaaartcatccatacattgctttcatata

SEQ ID NO: 65858 - DNA, 50 bp, homo sapien
tttcatgtttccttagttaattacastacaataaatggggctatggaaac

SEQ ID NO: 65859 - DNA, 50 bp, homo sapien
tagaaaatcttgttttcagataactraggtgtatatgcattttcaaaata

SEQ ID NO: 65860 - DNA, 50 bp, homo sapien
ataatctgttcagtgaggagtataarcttgagtattacagtctggttcag

SEQ ID NO: 65861 - DNA, 50 bp, homo sapien
tagaaaataatctttcctcaaatccrttaaatttttccatctctggtttc

SEQ ID NO: 65862 - DNA, 50 bp, homo sapien
gcattatcagaaagactagttagagrcaatctaggagagaaacgctagaa

SEQ ID NO: 65863 - DNA, 50 bp, homo sapien
cttaacatccctgtaatatatcctayggctcaggtctgcgacacggtccc

SEQ ID NO: 65864 - DNA, 50 bp, homo sapien
tgacaaagcactgggttagacacaamgtttatgactacagagaacaacgt

SEQ ID NO: 65865 - DNA, 50 bp, homo sapien
ctcaaaattcttagtatttcctctcwataaacacctaggggatacgctgg

SEQ ID NO: 65866 - DNA, 50 bp, homo sapien
aaaacataggtagataaatttagtgwaacattggtcttgaacaaacatgt

SEQ ID NO: 65867 - DNA, 50 bp, homo sapien
ctctctagcttaaagtaatctgtaaycttcctggccatttatttactcca

SEQ ID NO: 65868 - DNA, 50 bp, homo sapien
aagaaaggttagcctgttaccaataytattcaaggacatctttttgatct

SEQ ID NO: 65869 - DNA, 50 bp, homo sapien
gcatttttagatgtatagcacttgargtttcagaagaaggagaaaaaaca

SEQ ID NO: 65870 - DNA, 50 bp, homo sapien
gttgtttattttccatatgcccttawcagtgtaaaatgctttacatacaa

SEQ ID NO: 65871 - DNA, 50 bp, homo sapien
gacgttaccacattcaaaggttcaaratgaatagcaaggctcttttattt

SEQ ID NO: 65872 - DNA, 50 bp, homo sapien
tgatctttttattgcattaaagttaytggtgctttaagacttggtccatc

SEQ ID NO: 65873 - DNA, 50 bp, homo sapien
tatgtgtgcatctcctgtcttgtaarcattaaacaaatgaagacatatgc

SEQ ID NO: 65874 - DNA, 50 bp, homo sapien
aggttggagaaaactggcctacttgyatgaattttgtgcatcacaaggaa

SEQ ID NO: 65875 - DNA, 50 bp, homo sapien
ggttggttttctgagaaaggaaaaakataaactgtgtaactttctcaagt

SEQ ID NO: 65876 - DNA, 50 bp, homo sapien
aatgggagagggcttaaattacccamgagtatccattctaaagaatcaga

SEQ ID NO: 65877 - DNA, 50 bp, homo sapien
caaattcacttccctaactgactacmattaggggtttctaaagcagggaa

SEQ ID NO: 65878 - DNA, 50 bp, homo sapien
tgcagtccagagtttcagggatccaygtagaagttgcatcattttttgtg

SEQ ID NO: 65879 - DNA, 50 bp, homo sapien
aaaagggagcacatccatcctaaaarctgcatataatttttaaaatgtgg

SEQ ID NO: 65880 - DNA, 50 bp, homo sapien
ttgaattaagtactatgagtttgcawatgttaggaatacaacacaatgga

SEQ ID NO: 65881 - DNA, 50 bp, homo sapien
aaagaattctggggcacctgctaatkactatgacacctgattatgcacct

SEQ ID NO: 65882 - DNA, 50 bp, homo sapien
cacactacaaatacatatgcccttasatattctacttttgttttcatttg

SEQ ID NO: 65883 - DNA, 50 bp, homo sapien
attttccaagctactttaaaagcaasggttagaagaataattatcatgag

SEQ ID NO: 65884 - DNA, 50 bp, homo sapien
aagtgaggtgtattgggccagaacaytgcctaggagtttgttacaaatgg

SEQ ID NO: 65885 - DNA, 50 bp, homo sapien
gttttcaatttcagatacatgagagraagatcaaaatatttaatttaaat

SEQ ID NO: 65886 - DNA, 50 bp, homo sapien
gggttcttttcacttaacccattgcratctgaaaacatgggggtttgttt

SEQ ID NO: 65887 - DNA, 50 bp, homo sapien
atagaaatgttagtttaggctctgamgtttatgtttctctttgccaccgt

SEQ ID NO: 65888 - DNA, 50 bp, homo sapien
cctgagattcattttaatgaggaacrgattctaatgaatgaacttagcct

SEQ ID NO: 65889 - DNA, 50 bp, homo sapien
tttactaagcctgttatttcctataygcacagaagcagtgagaggaatgt

SEQ ID NO: 65890 - DNA, 50 bp, homo sapien
cagtttcctgtctgtagaatggaaawcataacagtagtcacttcctgact

SEQ ID NO: 65891 - DNA, 50 bp, homo sapien
accattcctctgtttattccagcccrtgatgttggagagacaaaactgaa

SEQ ID NO: 65892 - DNA, 50 bp, homo sapien
agaggaatggttctataattctagckcagagacttccagttctagtaata

SEQ ID NO: 65893 - DNA, 50 bp, homo sapien
attggggatccatactgaggatccasagatctaattactggtcctgaagc

SEQ ID NO: 65894 - DNA, 50 bp, homo sapien
aaacagtttggtaatgaggcatgagragttaactgtacatcagaacatgc

SEQ ID NO: 65895 - DNA, 50 bp, homo sapien
ttttatttctgatgctttgggtcaaytgtgagataaggatgtgcatatgt

SEQ ID NO: 65896 - DNA, 50 bp, homo sapien
gggcagcctcaggagagtggggcttytcacatgcagtccagagtttcagg

SEQ ID NO: 65897 - DNA, 50 bp, homo sapien
catgtggttgactgccttttgatacsatttacaggaactggcagagaaaa

SEQ ID NO: 65898 - DNA, 50 bp, homo sapien
tctgaaatgtccttgcattccaaaaytaagctatcaatccaattaaatca

SEQ ID NO: 65899 - DNA, 50 bp, homo sapien
agcatggctgagtggtctaaggcacyggattgagaaataaattctagatc

SEQ ID NO: 65900 - DNA, 50 bp, homo sapien
agttttggtcccatctaaccaagccraaagttgagatttgaaggttgatt

SEQ ID NO: 65901 - DNA, 50 bp, homo sapien
gggaccttgtgatcctgtgagttaayacttattaataaactcccatatat

SEQ ID NO: 65902 - DNA, 50 bp, homo sapien
cagtcagttctctgccaacctgctasctgactaaaaagctatgatcaatt

SEQ ID NO: 65903 - DNA, 50 bp, homo sapien
tttcagaaaatagtatgtgaaacacsagtttatgaaattatttagttgtg

SEQ ID NO: 65904 - DNA, 50 bp, homo sapien
ctcttacttgtctttgagagtttcastaaccctgggggaaagagaaaaca

SEQ ID NO: 65905 - DNA, 50 bp, homo sapien
gataccccactgttgtctctaattcraagtatcaaagtttcagacaaaag

SEQ ID NO: 65906 - DNA, 50 bp, homo sapien
tctagaaaccaacacatcaccataargaatgacagaattattattaacca

SEQ ID NO: 65907 - DNA, 50 bp, homo sapien
acttgtttcaaaatggcagtttcatsatctataatatgctatggtgtctt

SEQ ID NO: 65908 - DNA, 50 bp, homo sapien
gtgggtgaagcagaaagcagaaatayagttcacttgctgcagctgaactt

SEQ ID NO: 65909 - DNA, 50 bp, homo sapien
cacatgactatgggatactttattgmaaaacacagttctagtgtattatt

SEQ ID NO: 65910 - DNA, 50 bp, homo sapien
acatgcttctgttcatatttctgccrctaatagaagatgagatgaatttc

SEQ ID NO: 65911 - DNA, 50 bp, homo sapien
accccattcaaacatcacaataacayccccatttttccaacagggaaatt

SEQ ID NO: 65912 - DNA, 50 bp, homo sapien
atgtttctctataattattgtcacamagttataccatacaggtaattcca

SEQ ID NO: 65913 - DNA, 50 bp, homo sapien
tttattatatgtaccacaaatttgaygttattctacatttttctttattt

SEQ ID NO: 65914 - DNA, 50 bp, homo sapien
gttaactattgtcacataagttatcrctcaacattaagtagcttaagaca

SEQ ID NO: 65915 - DNA, 50 bp, homo sapien
ttgttgtttcagcttgttttaataakaatcttgaaaataatgatagcatt

SEQ ID NO: 65916 - DNA, 50 bp, homo sapien
acaaagaaatagcaacgcaacaaaamactatacaacaatataatacaaat

SEQ ID NO: 65917 - DNA, 50 bp, homo sapien
tcgaaaagtattgtaagcttcactaragtataaaacactcagttacctca

SEQ ID NO: 65918 - DNA, 50 bp, homo sapien
gattgtcatcattacttccagttccragagtagaaaatggagactctgag

SEQ ID NO: 65919 - DNA, 50 bp, homo sapien
atgttgtttttcttaatctactaacwctttagtcacaaaacattgatatt

SEQ ID NO: 65920 - DNA, 50 bp, homo sapien
gtataaaagtatagtcctatcctcayacttcctgtacatcctccctgatt

SEQ ID NO: 65921 - DNA, 50 bp, homo sapien
gagttccactgagagctgatgttatyaacaacgttctatatgatttattt

SEQ ID NO: 65922 - DNA, 50 bp, homo sapien
atagttcctaatcaaattctggccaygtatataaagattcctctagaagt

SEQ ID NO: 65923 - DNA, 50 bp, homo sapien
cattggtgcacttttgcctccaatawctcatatctgacattcttctttga

SEQ ID NO: 65924 - DNA, 50 bp, homo sapien
gtaatgattgccggtggctcctatamctaactttgtggtttacttctaga

SEQ ID NO: 65925 - DNA, 50 bp, homo sapien
cgctcctttctttgaagctcaactaytacaactccattaaagtgagaaga

SEQ ID NO: 65926 - DNA, 50 bp, homo sapien
caaagcttctaactacaacctggacragacctctggaactggagagagga

SEQ ID NO: 65927 - DNA, 50 bp, homo sapien
ttaattgacttttttttatcgactamggatttttgagaggcaaaatcaga

SEQ ID NO: 65928 - DNA, 50 bp, homo sapien
ctcattgttgggcatgtttcgtatgyaacagtaattaaccagtataacac

SEQ ID NO: 65929 - DNA, 50 bp, homo sapien
agaatggacaattctaagtacggagkcccaaatttcctgtagcagatatg

SEQ ID NO: 65930 - DNA, 50 bp, homo sapien
acaataatttcaaaggcagtacttayaaactttagctctaagataagaga

SEQ ID NO: 65931 - DNA, 50 bp, homo sapien
attgtgttagacatgtgaatgaagaygctttgtatactaccacccaagtc

SEQ ID NO: 65932 - DNA, 50 bp, homo sapien
gtgtaccttgtatgcattagatagayggtaaaaatgaaatgactggctgg

SEQ ID NO: 65933 - DNA, 50 bp, homo sapien
ctagaaattccacatgttgattccaratataagagtaattatgccatata

SEQ ID NO: 65934 - DNA, 50 bp, homo sapien
aaagtggctgactcttagatgtcaamggtaaagaaggattgagaaaagga

SEQ ID NO: 65935 - DNA, 50 bp, homo sapien
catacatacaaatgcacactaaaagycggttgttcctggtagaaccaaag

SEQ ID NO: 65936 - DNA, 50 bp, homo sapien
tagtaagagtaaaaatgtgcataggmataactcctgtgagaaactgttat

SEQ ID NO: 65937 - DNA, 50 bp, homo sapien
attatggagcttctgcaataggacastcatggtatgaaatagagaggaat

SEQ ID NO: 65938 - DNA, 50 bp, homo sapien
attaagtaaattgctaataatattgrcaaagatgataactatatttataa

SEQ ID NO: 65939 - DNA, 50 bp, homo sapien
tctttgcaatcttgaacttacatcarggaaattacatgtcagactatgcc

SEQ ID NO: 65940 - DNA, 50 bp, homo sapien
aatgtaatacatattctgagcaaatyattcaagaagaaaaaaacatacta

SEQ ID NO: 65941 - DNA, 50 bp, homo sapien
agatcttaccatcttccaagagaacygaaacagagctatccttagaccca

SEQ ID NO: 65942 - DNA, 50 bp, homo sapien
tttcactgtactcaggctgcagaaarcaagtatcaatttatgtttggctt

SEQ ID NO: 65943 - DNA, 50 bp, homo sapien
aattttaaagatattcaaattcaccraagcatttaatatgtaagctcaaa

SEQ ID NO: 65944 - DNA, 50 bp, homo sapien
caaagccatctataatagtttaaaayatgatgcctgacacacagtgaaat

SEQ ID NO: 65945 - DNA, 50 bp, homo sapien
catcattttaacttttctgtcataaktgtattgcataagcctgaagagac

SEQ ID NO: 65946 - DNA, 50 bp, homo sapien
ttatgcttctaaatcaggtcataccrctagaaaacaatgtgggtttgcct

SEQ ID NO: 65947 - DNA, 50 bp, homo sapien
catgaaccacatacaggtatagagamgagaaatatgaaccaagttggtaa

SEQ ID NO: 65948 - DNA, 50 bp, homo sapien
ttggtattaacctcaagttttattayattgttatccatagcatttcacta

SEQ ID NO: 65949 - DNA, 50 bp, homo sapien
attaaggaaaagaagtgtatctggargaatctagtcaaaatgtgaaagta

SEQ ID NO: 65950 - DNA, 50 bp, homo sapien
accttctacatattctgtgttctaartgtgcaggaaatctggctgatttg

SEQ ID NO: 65951 - DNA, 50 bp, homo sapien
ttgagcactctactaggattttagayatgtcagtgaaaaagaaaaacaga

SEQ ID NO: 65952 - DNA, 50 bp, homo sapien
ggttagaattttgtgaagacgagagraagttgtattttaggtaggtgagc

SEQ ID NO: 65953 - DNA, 50 bp, homo sapien
tcccatcattgatattcttagcatgyaattttacagaatggcaattagga

SEQ ID NO: 65954 - DNA, 50 bp, homo sapien
acactcccatcaaccagtgcctctgrataaggaaacttcaaaggggtggt

SEQ ID NO: 65955 - DNA, 50 bp, homo sapien
gtaaactgataaatttgaccacacaktcagtatctctctacacccctcat

SEQ ID NO: 65956 - DNA, 50 bp, homo sapien
tactgtcaatttctatagtgaagaaraaccgtatgtttgtaatttcctta

SEQ ID NO: 65957 - DNA, 50 bp, homo sapien
tttattaaatgttgtctccacatccygaaaggtatatctgtctatcagag

SEQ ID NO: 65958 - DNA, 50 bp, homo sapien
acaaggacttacaatttatatgaacmctgaatgtttttagacactgaaaa

SEQ ID NO: 65959 - DNA, 50 bp, homo sapien
tctttttctgtatcccagattgtcargcctaatacgcagagcttagaaag

SEQ ID NO: 65960 - DNA, 50 bp, homo sapien
tcacagattcttcttctctttcccayataaagaacattttcaaatctctc

SEQ ID NO: 65961 - DNA, 50 bp, homo sapien
agtttatttgaaaggaaccttaaaartctggtgagttcgaacttctcaag

SEQ ID NO: 65962 - DNA, 50 bp, homo sapien
attcatgtacaagtttttgtgtaagwtaaatttccatctttccaggataa

SEQ ID NO: 65963 - DNA, 50 bp, homo sapien
caaagaacatttttgaaacaattaasaattatagatatgtacaaactgtt

SEQ ID NO: 65964 - DNA, 50 bp, homo sapien
tcagtgacacattagaattaatctgragtataagagaatagttcagtact

SEQ ID NO: 65965 - DNA, 50 bp, homo sapien
ctttggtcttatactcaatcccagargctttagcaatagcaatgttttat

SEQ ID NO: 65966 - DNA, 50 bp, homo sapien
catatacttctggaaaaaacatcacractctaaattataaacccaggcac

SEQ ID NO: 65967 - DNA, 50 bp, homo sapien
agtttccatgcctccaattagagaayggctatgtcatatagagcaaaaaa

SEQ ID NO: 65968 - DNA, 50 bp, homo sapien
tattcaggaaacaaatatgtgtagakctattatcctcatctttcctgtgt

SEQ ID NO: 65969 - DNA, 50 bp, homo sapien
atatgctggcagaagggagttctcamtatggaaaatttaatgaaataaag

SEQ ID NO: 65970 - DNA, 50 bp, homo sapien
gaccataacatggagtaagactaggsataaacagaatggacattaagata

SEQ ID NO: 65971 - DNA, 50 bp, homo sapien
taagggaactgtgtgataaattgtcyctggaactctcagtctttgtgtga

SEQ ID NO: 65972 - DNA, 50 bp, homo sapien
gtaatagaaaaccacttagttagatyaagataaaacccttctgagtcaga

SEQ ID NO: 65973 - DNA, 50 bp, homo sapien
agaccttactgaggtaatagggaagwccattccaatatttaggggagaaa

SEQ ID NO: 65974 - DNA, 50 bp, homo sapien
tgtctgtaagtatgtctttggatagrataagcatattttaatattaactt

SEQ ID NO: 65975 - DNA, 50 bp, homo sapien
gtattgggagagtgtgtgtatccackaacttcttcatttcttctagatgt

SEQ ID NO: 65976 - DNA, 50 bp, homo sapien
tctgagaaatagcaccaatggcctakgagttgatgaaaatgaaatttttt

SEQ ID NO: 65977 - DNA, 50 bp, homo sapien
atcaccagatgatagaaggaggacawaatcgtgcatataaacagacatct

SEQ ID NO: 65978 - DNA, 50 bp, homo sapien
tatttttctttatcatttattccaartcatcctcccttcagttagaaaaa

SEQ ID NO: 65979 - DNA, 50 bp, homo sapien
aatgaagtcttctgtttcagaagaaraattcaaaggatatttttcactta

SEQ ID NO: 65980 - DNA, 50 bp, homo sapien
attatttttctttgcagttatggacragtgtaagccatactttaattggt

SEQ ID NO: 65981 - DNA, 50 bp, homo sapien
ttaattggtatcagagacattttgcygactttagagaaaaaatgtaatga

SEQ ID NO: 65982 - DNA, 50 bp, homo sapien
tagaatactataccattccctaaaasctcaacaaggcttggaattttccc

SEQ ID NO: 65983 - DNA, 50 bp, homo sapien
ttaaaatgacagcttggtcaccaaamacttatgccacaagtgagctacga

SEQ ID NO: 65984 - DNA, 50 bp, homo sapien
agaggtcataatatgtgtctaaatgycaaagcaaacttattatatggata

SEQ ID NO: 65985 - DNA, 50 bp, homo sapien
attctcttcgagataggcacccttayaaaaagtgaagtcttccatgatgt

SEQ ID NO: 65986 - DNA, 50 bp, homo sapien
ctgggaagggggaaatatctcacagyatgattttattacagggctttttg

SEQ ID NO: 65987 - DNA, 50 bp, homo sapien
agtaaatgttttcagtaaatctggaraggaagtatgatagtttctggaaa

SEQ ID NO: 65988 - DNA, 50 bp, homo sapien
tcctaatcacataatacatttttcaygctctagcgaagtaaatacaatta

SEQ ID NO: 65989 - DNA, 50 bp, homo sapien
caaatcatgaaagaacttcaattcasaatcgacacaaagagaaaaaaaca

SEQ ID NO: 65990 - DNA, 50 bp, homo sapien
tgtgtggataatccacaaaaccaaawtataactaaggaaattgctgctta

SEQ ID NO: 65991 - DNA, 50 bp, homo sapien
agtccggtcttctctctggtgtgtasgctttgctttaaatcaaaggaaaa

SEQ ID NO: 65992 - DNA, 50 bp, homo sapien
ccttgcattgttagatgaactttaaktctagctgacaaaaaaaactttgg

SEQ ID NO: 65993 - DNA, 50 bp, homo sapien
cttggactcatgtctgctgaaggcamactagagtcaatttcagaaacttg

SEQ ID NO: 65994 - DNA, 50 bp, homo sapien
acatgtaattaccatctgacatggcrtttgcacatttggacatttgtctt

SEQ ID NO: 65995 - DNA, 50 bp, homo sapien
tctaaattcaacctttacttatctcrcataccaaaagcaacagtgtgcta

SEQ ID NO: 65996 - DNA, 50 bp, homo sapien
attaggaaggctataactctgaataytaaattaggacactgaggatattt

SEQ ID NO: 65997 - DNA, 50 bp, homo sapien
tttcagccaagagaccaattaataaygcaagaaaaaaggtttattaagga

SEQ ID NO: 65998 - DNA, 50 bp, homo sapien
tgcagagattaggctgtgcacattaytccagaactgttattctgcccaac

SEQ ID NO: 65999 - DNA, 50 bp, homo sapien
gaaatgtctagtgttctgaaattacraaattatgcatgatacactgatgt

SEQ ID NO: 66000 - DNA, 50 bp, homo sapien
ctttttattgtaatttggaaagcaasttatcttttgggttgattgatgtt

SEQ ID NO: 66001 - DNA, 50 bp, homo sapien
ttgttcattgagtcataggttagcakgactggaactattctttagttaaa

SEQ ID NO: 66002 - DNA, 50 bp, homo sapien
catttagcgaacatctttgcagtcaytaatgtttgcatgtaagaatccta

SEQ ID NO: 66003 - DNA, 50 bp, homo sapien
gtattttgagcaatgggtagaaataygctccaaactgcaaatccatctga

SEQ ID NO: 66004 - DNA, 50 bp, homo sapien
ctaaaggaagtttttctaagaagtayatccaccttcctgttcaatttgga

SEQ ID NO: 66005 - DNA, 50 bp, homo sapien
tgaatgtagttaatttttgctcacastggtatttcaagctggcccaccca

SEQ ID NO: 66006 - DNA, 50 bp, homo sapien
agcaaaacttacagatctcaccaaaraattgtactgagtagaaagtatat

SEQ ID NO: 66007 - DNA, 50 bp, homo sapien
aagctactacttcatcttgttaaacrcgcacagcctcttctgagcaggaa

SEQ ID NO: 66008 - DNA, 50 bp, homo sapien
tacaccaccttagtgactttattcaragcttaccaattcatttactcaac

SEQ ID NO: 66009 - DNA, 50 bp, homo sapien
atgttacgaatattgttgaaatgacraccaaggctttagaatattatgta

SEQ ID NO: 66010 - DNA, 50 bp, homo sapien
gcattgggtttattatttcattggcygaggaacttaattcccagtgctgt

SEQ ID NO: 66011 - DNA, 50 bp, homo sapien
aaagttttgttgataaattgaaatgyaaacagtacaaacaaactttttga

SEQ ID NO: 66012 - DNA, 50 bp, homo sapien
ttttcataaaataatatggtaaagamctccacatgctacatggagtacag

SEQ ID NO: 66013 - DNA, 50 bp, homo sapien
atttgacactgaggaaataacaaaawttgaggataatctgtatttaatct

SEQ ID NO: 66014 - DNA, 50 bp, homo sapien
tcttccctcatcttgtccttgaaaamaattccacctcttatttgcatgat

SEQ ID NO: 66015 - DNA, 50 bp, homo sapien
ggagggcaattaataaataaaccttsaaattattggaaacgttgtctctg

SEQ ID NO: 66016 - DNA, 50 bp, homo sapien
atgttatattgaaattcctggaacayggtcagctttattttgtctcccct

SEQ ID NO: 66017 - DNA, 50 bp, homo sapien
gacagacagcatataatctgtcaaayagaatttcaaacccagatccacct

SEQ ID NO: 66018 - DNA, 50 bp, homo sapien
tctagaagtttgggggaagtcatcargatcacataggtaagatgatattt

SEQ ID NO: 66019 - DNA, 50 bp, homo sapien
tcatctctttccttttaaattccagmaataattcagtttagttaggtctc

SEQ ID NO: 66020 - DNA, 50 bp, homo sapien
gcaacgatacctaagttcctggtcaygatagctaagtcccaacattatat

SEQ ID NO: 66021 - DNA, 50 bp, homo sapien
catcaggcctcctttgtcttacctaygagcaggaaaacagatacaaagtt

SEQ ID NO: 66022 - DNA, 50 bp, homo sapien
atgagcttaagactttgaacaagatragttgagattaaacacccactttg

SEQ ID NO: 66023 - DNA, 50 bp, homo sapien
gtagaaagcaatcctccagagatgargaaggaagtgtttatacaaccaat

SEQ ID NO: 66024 - DNA, 50 bp, homo sapien
agccagtttctatgtaagagatccargtactctgagactgccatgctgtg

SEQ ID NO: 66025 - DNA, 50 bp, homo sapien
acttgggactgccacagaatccaccraaggtttcccaatcactcctcaat

SEQ ID NO: 66026 - DNA, 50 bp, homo sapien
catctgatcatatcactttggaagakaatattaaaatggcagttttccta

SEQ ID NO: 66027 - DNA, 50 bp, homo sapien
gccagttttgcatttctttgccttasacagtattaaattagtcaaacaat

SEQ ID NO: 66028 - DNA, 50 bp, homo sapien
ttgttaaggggaaaaaattaacttayggtgtagtgattagagggaaacgt

SEQ ID NO: 66029 - DNA, 50 bp, homo sapien
gtgctttaagatgaatgttatcaaaycaaggcagtgttggtacagtacag

SEQ ID NO: 66030 - DNA, 50 bp, homo sapien
ctgcatggcttactttaagtaaaatragaaatcagttacatttggtcgga

SEQ ID NO: 66031 - DNA, 50 bp, homo sapien
gaatttatgtggtttattatatatcraaaactaactataaacataccctt

SEQ ID NO: 66032 - DNA, 50 bp, homo sapien
tgtccaaatacctatgaatggtaaamcttttgagactatgacttcctgtt

SEQ ID NO: 66033 - DNA, 50 bp, homo sapien
atggaatttatctgatgaataattcytaaaatacgcaaatatgtaaagct

SEQ ID NO: 66034 - DNA, 50 bp, homo sapien
tagactagcattttgatctttctccrcagtgagttgacaattattcaaag

SEQ ID NO: 66035 - DNA, 50 bp, homo sapien
tctcattgctgctactaggctagagratggtaaacttgttctaaagagcc

SEQ ID NO: 66036 - DNA, 50 bp, homo sapien
gtcatccacaacaagtacagaaaaayataggttactcttcagaatattta

SEQ ID NO: 66037 - DNA, 50 bp, homo sapien
aatgaccataaaacatgtttatgacyacctaaagacagtaaacaatagtt

SEQ ID NO: 66038 - DNA, 50 bp, homo sapien
gagtgtctaataacagtgagactaamaatattttctacaaaatcaataat

SEQ ID NO: 66039 - DNA, 50 bp, homo sapien
caaggcatttggaattgagaaaatamactggtttgtggaattgatggcta

SEQ ID NO: 66040 - DNA, 50 bp, homo sapien
aaccacaaatatgattacatgtagcwattcatctattctattacaaacca

SEQ ID NO: 66041 - DNA, 50 bp, homo sapien
gacattgttagatcagtctgttctcmgttttcttttgcagagtagagtcc

SEQ ID NO: 66042 - DNA, 50 bp, homo sapien
tttaccctttttaggagtacacatcyataagcatttacaaacctattaca

SEQ ID NO: 66043 - DNA, 50 bp, homo sapien
atttaattttgtatctgggtgtgaaytactaagtaatagtttgaatgtaa

SEQ ID NO: 66044 - DNA, 50 bp, homo sapien
gcctattgtaagcatatctttaaaasggttctctgtgtttatccaaacat

SEQ ID NO: 66045 - DNA, 50 bp, homo sapien
tatatgagaagtatattaaaaaaatsaaggtcagaactgaagtcaagtac

SEQ ID NO: 66046 - DNA, 50 bp, homo sapien
tcaaatggtttccaagccatttaacsatgtcccagaacaaaatgcaagaa

SEQ ID NO: 66047 - DNA, 50 bp, homo sapien
gttgtctggtgtagccaccttcatcracgatcgtagctagatcttctaga

SEQ ID NO: 66048 - DNA, 50 bp, homo sapien
aaatttaagcacttgttaagagttargagttatgcagtcctgagaatata

SEQ ID NO: 66049 - DNA, 50 bp, homo sapien
gggaaggcatataatatgtagcgagraagtagatcaaggctccctttatc

SEQ ID NO: 66050 - DNA, 50 bp, homo sapien
gcatattgacaacaacgaaaaagacrataaaatagctggagtcttggaat

SEQ ID NO: 66051 - DNA, 50 bp, homo sapien
aagcatgcatgagtgtgaataggatkatcaacagtatcaaatttgtattt

SEQ ID NO: 66052 - DNA, 50 bp, homo sapien
gtatatcttcttcctttccgtgaacscttgtgtgttgtttatttcagata

SEQ ID NO: 66053 - DNA, 50 bp, homo sapien
aagtcagcataagtgagaataatgartacctattgcatactctattttat

SEQ ID NO: 66054 - DNA, 50 bp, homo sapien
aacaggtctcctaccttgttccctamactgagagcttctcagagccttta

SEQ ID NO: 66055 - DNA, 50 bp, homo sapien
ggcactcaagaggcaaaagctaatayatgtgatgaaagaacacaaagcaa

SEQ ID NO: 66056 - DNA, 50 bp, homo sapien
tcatgattttagattatatgctaatkgctctccactcccatgagagccag

SEQ ID NO: 66057 - DNA, 50 bp, homo sapien
cacagaatagaaccattcttttgatkgcactgattggaacagtatttttc

SEQ ID NO: 66058 - DNA, 50 bp, homo sapien
cattcatttacagaaagaattactgwaactcaaacagctaaaataaattg

SEQ ID NO: 66059 - DNA, 50 bp, homo sapien
gaggagactatttccatccaaagacycatgcttgataattggatgtttga

SEQ ID NO: 66060 - DNA, 50 bp, homo sapien
atcagaaatatttcctttttcaccartgacgtccatagtcttccacatat

SEQ ID NO: 66061 - DNA, 50 bp, homo sapien
agactgtccagatcctgtgttgcctrttgatttcaagtctgggggccatc

SEQ ID NO: 66062 - DNA, 50 bp, homo sapien
ctgggacctgaggataagagtatcaygtaaaatagaagtgataggctatt

SEQ ID NO: 66063 - DNA, 50 bp, homo sapien
tggttccctgtattcttatagtcaaygtactgttaaatccattcaataag

SEQ ID NO: 66064 - DNA, 50 bp, homo sapien
tatagttgtatttgaatatatgatayaatgatggcacatattcaaaaaca

SEQ ID NO: 66065 - DNA, 50 bp, homo sapien
cgtgacccaggctccctgaggaatcygaattgtgaaaggagtctgaagtg

SEQ ID NO: 66066 - DNA, 50 bp, homo sapien
ttcttataaggtggttgtgttaatamaatgagataacgcatgagattgcc

SEQ ID NO: 66067 - DNA, 50 bp, homo sapien
gaccaaatgaaacaatatactaagargtttgaatgtacctggcatattgt

SEQ ID NO: 66068 - DNA, 50 bp, homo sapien
tgttgtggcatatgccaggacttaaytgtagccataatttcatgttgagc

SEQ ID NO: 66069 - DNA, 50 bp, homo sapien
tccatttaacattaaagcttaccgargagagaggcttctaatgaggatct

SEQ ID NO: 66070 - DNA, 50 bp, homo sapien
tgcttttccagaactgtctaaaggayatctattcgtatttaaaataatac

SEQ ID NO: 66071 - DNA, 50 bp, homo sapien
agggggcacgacacagtctaggagayggacaatgagtgtggctgaagcat

SEQ ID NO: 66072 - DNA, 50 bp, homo sapien
aagacattttgaatagaagactttargttattagaaatgtgggagagatc

SEQ ID NO: 66073 - DNA, 50 bp, homo sapien
aattggatttgaaggtaattgtctaygtctgtgttacactgatgtccagc

SEQ ID NO: 66074 - DNA, 50 bp, homo sapien
gaagtgtcaccaagcctctttcctckatctatggcaagcccatgctcttg

SEQ ID NO: 66075 - DNA, 50 bp, homo sapien
aagatattttcatgactgtgaaaccraatgactatatttatgaatgtgtt

SEQ ID NO: 66076 - DNA, 50 bp, homo sapien
gtgccctcaataaaaagaaatcacamggctgttcatgtgtagtctgaatt

SEQ ID NO: 66077 - DNA, 50 bp, homo sapien
caatacccactattttcactaagccmagatgctttattaagaaattagag

SEQ ID NO: 66078 - DNA, 50 bp, homo sapien
atccattacttttctcttggtttcaygtttattaatgttacctatgataa

SEQ ID NO: 66079 - DNA, 50 bp, homo sapien
aatctatggatctcttctcgtctcartaggctatcatgctagctcaggtg

SEQ ID NO: 66080 - DNA, 50 bp, homo sapien
aattcatcacatatgaataaaagtgycacaagtggtatatgagtgtgtat

SEQ ID NO: 66081 - DNA, 50 bp, homo sapien
agctcctaaatatccattcacagatyctaccacaacagtgtttccaaacc

SEQ ID NO: 66082 - DNA, 50 bp, homo sapien
tcttctagattttatcctgagatatwcactgttttgcctttggcctcaat

SEQ ID NO: 66083 - DNA, 50 bp, homo sapien
cagtaagcgccaaagaggacagggarattataggcctttgcatcctctgc

SEQ ID NO: 66084 - DNA, 50 bp, homo sapien
agtgtactcttactgttccatatcarataaagttggttactgttcaatat

SEQ ID NO: 66085 - DNA, 50 bp, homo sapien
aaatgagaaaactgaaggctagcaakataacccagctgatgatgactgga

SEQ ID NO: 66086 - DNA, 50 bp, homo sapien
ttaaaaagaatgaagtagctctacaygacagattataaaatatttccaaa

SEQ ID NO: 66087 - DNA, 50 bp, homo sapien
ctgaatatgtagctttccattacaayagtatgcaagccaagatgaaacca

SEQ ID NO: 66088 - DNA, 50 bp, homo sapien
ttttaatttgcctaaagatgatagcsattttgagctgtggttagggataa

SEQ ID NO: 66089 - DNA, 50 bp, homo sapien
gaggggaatccatagatggaagaacragtgtaagaattactacgtggtga

SEQ ID NO: 66090 - DNA, 50 bp, homo sapien
tcttcttctccaaacacgaacataayacagtacctggcatgtcgtaggtg

SEQ ID NO: 66091 - DNA, 50 bp, homo sapien
ctcactctctgaagatttttagaagracactagactcagttatcacatta

SEQ ID NO: 66092 - DNA, 50 bp, homo sapien
aattaagagtgacatttttttctacyggcttctccgaataaagtgttcta

SEQ ID NO: 66093 - DNA, 50 bp, homo sapien
tcttctcacttcccctttgttagaaytgtcctcttctctgcagatccttg

SEQ ID NO: 66094 - DNA, 50 bp, homo sapien
ctgaaggatcttttgctgaaattaaygaactccaataatgctcccgctta

SEQ ID NO: 66095 - DNA, 50 bp, homo sapien
agacattgattgtctcacgattgaaraggctagtaggaaaatatcgatct

SEQ ID NO: 66096 - DNA, 50 bp, homo sapien
aaacgacaatgatacccacaccatasagaatggctaagtctcgacaagga

SEQ ID NO: 66097 - DNA, 50 bp, homo sapien
aaacaaatatttagtccatatcaaakctgaattggttcttctaagacagc

SEQ ID NO: 66098 - DNA, 50 bp, homo sapien
tctgtagattactttaaacgtataayaaagtccttcagcgaaaaaaatag

SEQ ID NO: 66099 - DNA, 50 bp, homo sapien
gccaaagtttctgagatgcctatccrgcctttccctgttatcttttatag

SEQ ID NO: 66100 - DNA, 50 bp, homo sapien
cttagtttttgcttctaacttctccrggaataatgctgcaggaaatttgt

SEQ ID NO: 66101 - DNA, 50 bp, homo sapien
agcaatgagtcaacaatcccaacttygttccactacaggcatgtagggga

SEQ ID NO: 66102 - DNA, 50 bp, homo sapien
gttccaggaaaccccagggcctcccracatgtggtcttttctgctccagg

SEQ ID NO: 66103 - DNA, 50 bp, homo sapien
caatttaattgcaatgcaaggaatasataaaaatccttagtttttgcttc

SEQ ID NO: 66104 - DNA, 50 bp, homo sapien
tatatttaatcatgtcactatcttayatttaaaatccaatcaacatgaaa

SEQ ID NO: 66105 - DNA, 50 bp, homo sapien
aaatgaaaatggaaacataatgtacraaatctataggacatagcaaaagc

SEQ ID NO: 66106 - DNA, 50 bp, homo sapien
ccctgagaactttatgtacgttcaarttcctcaattattgttagttccca

SEQ ID NO: 66107 - DNA, 50 bp, homo sapien
aagccattccctgaatatggataaarttgcttctgtgtttaatgtggtag

SEQ ID NO: 66108 - DNA, 50 bp, homo sapien
cagcatcagttgcttccctaggtgcrataattaacaaagctcattttgca

SEQ ID NO: 66109 - DNA, 50 bp, homo sapien
tgtccccattttgcaggcatgaaagmaaaggcctggaaaggttatgtagt

SEQ ID NO: 66110 - DNA, 50 bp, homo sapien
cagagccactaatggaacatcatcayggtagaagtggttgatcacgttgg

SEQ ID NO: 66111 - DNA, 50 bp, homo sapien
gattttcagcctcaaggatgacaatmaactccagatttccagaatcaatg

SEQ ID NO: 66112 - DNA, 50 bp, homo sapien
agcagtaactcaggagtatctaaagraaggagggtagatggagaacaaga

SEQ ID NO: 66113 - DNA, 50 bp, homo sapien
caggtgcccaggcaagaatagacccrttgcttcaaatcccaggaagccct

SEQ ID NO: 66114 - DNA, 50 bp, homo sapien
gacagagatttccttaaacgcctagrtacaataagtttctcagcctttgc

SEQ ID NO: 66115 - DNA, 50 bp, homo sapien
taaggaaatctctgtccaatcattaraagaccagtaagctaacaagcaga

SEQ ID NO: 66116 - DNA, 50 bp, homo sapien
tggaggctttagccactggacaatckaacaatgtgatttgtgatggggtc

SEQ ID NO: 66117 - DNA, 50 bp, homo sapien
ggaaaaaaacaaacacctcttgagaygctagaaatgtatgacatatgggg

SEQ ID NO: 66118 - DNA, 50 bp, homo sapien
gtggagagggcaccaaggtcaaagtwtgtctcctcatagctttgcagagg

SEQ ID NO: 66119 - DNA, 50 bp, homo sapien
agagagacctgagggtagcttaggarcggacctagatgggagacttctgc

SEQ ID NO: 66120 - DNA, 50 bp, homo sapien
aaaaatagatttgtatgtcttcccawtcacattttttggaagtctagaaa

SEQ ID NO: 66121 - DNA, 50 bp, homo sapien
tccagattttcctgctaatcctacargcacaagataatattcggccagtt

SEQ ID NO: 66122 - DNA, 50 bp, homo sapien
aaaggtttctgtagctaatactctayggactgaaacacaataaaattcaa

SEQ ID NO: 66123 - DNA, 50 bp, homo sapien
agtcttcttatatcaaccattttcakagctttggcttatttatttattta

SEQ ID NO: 66124 - DNA, 50 bp, homo sapien
gcagagatcacaaggaaatacaaacrccactgtgacacagttacaagaaa

SEQ ID NO: 66125 - DNA, 50 bp, homo sapien
gacattttacaaattcaaaaggataygcactggctttttctgaagtattt

SEQ ID NO: 66126 - DNA, 50 bp, homo sapien
aacagttaggcaacctgaacttcacraagggaatgaaactcctcatggga

SEQ ID NO: 66127 - DNA, 50 bp, homo sapien
acagcgtttgagctaagtcttaaatkaagtgcaagaatttccctaattgt

SEQ ID NO: 66128 - DNA, 50 bp, homo sapien
attttaatacacttgccttttgatcrcagtcttagagctaaagttttcct

SEQ ID NO: 66129 - DNA, 50 bp, homo sapien
tctatgggacttcctaagggtcagartatggtacaagtacattgcgataa

SEQ ID NO: 66130 - DNA, 50 bp, homo sapien
aaacctaacatcaaatttcagttaargtagtggttacttgagctctagaa

SEQ ID NO: 66131 - DNA, 50 bp, homo sapien
aaatactcaactttaagtcaagtatrtaatgacaaaaactacttcactga

SEQ ID NO: 66132 - DNA, 50 bp, homo sapien
tttggacaactggcaaagagtttgargttagaaaaattagtgatcataca

SEQ ID NO: 66133 - DNA, 50 bp, homo sapien
agttgtgatttcatctatgatggaaygtatcttgacaaaatcctggagaa

SEQ ID NO: 66134 - DNA, 50 bp, homo sapien
tgagacttaaaacctgtccctaacamaaattgcctggcatatcaatgagg

SEQ ID NO: 66135 - DNA, 50 bp, homo sapien
tgggtaggaatctgccaggtgcttcrccaagtgagtagatctgaacttga

SEQ ID NO: 66136 - DNA, 50 bp, homo sapien
tcattttaaaaaacacagagagagaycttaatttgcacactgcaaaaaac

SEQ ID NO: 66137 - DNA, 50 bp, homo sapien
aggattattttgctaatgtttgaaarcttctcatcattttaaaaaacaca

SEQ ID NO: 66138 - DNA, 50 bp, homo sapien
gaatacttgaaaaaactctcaaagcratcaaagaatttggcatagtgatt

SEQ ID NO: 66139 - DNA, 50 bp, homo sapien
acaagtatgtgctggagaaatgaaasctccataaacggtattgtgttgaa

SEQ ID NO: 66140 - DNA, 50 bp, homo sapien
acctttccccagaggcttatgagagrcgtatgactcacaagtgaaaaaat

SEQ ID NO: 66141 - DNA, 50 bp, homo sapien
ggctttgatagtgtttgagtacctgwtgtaccagcagccagaccaatact

SEQ ID NO: 66142 - DNA, 50 bp, homo sapien
aaagacaggagaactcacatcagtakaaagagcgctggatttgaaggcag

SEQ ID NO: 66143 - DNA, 50 bp, homo sapien
tcgtggtctgcaagtaaagtaatacrcactccaaaactataatataggtg

SEQ ID NO: 66144 - DNA, 50 bp, homo sapien
gataaagagaagcaagagaatagtaracacaaaaatgaggatcatagtgg

SEQ ID NO: 66145 - DNA, 50 bp, homo sapien
gagcccagaatcggatggtctagcaycttttttgaattatgaattttatg

SEQ ID NO: 66146 - DNA, 50 bp, homo sapien
gatcttgtcttgaaggatggatagaygttcaacagaggaagcctatggct

SEQ ID NO: 66147 - DNA, 50 bp, homo sapien
attcatttggtttctattgttataargagacattatttgacacaataaac

SEQ ID NO: 66148 - DNA, 50 bp, homo sapien
gcaggatgtatttgctgatcatctaygtgagaacttgtgccaagagctgc

SEQ ID NO: 66149 - DNA, 50 bp, homo sapien
ttcctagtttatgaatagctagatgytaattatttggaatacggcagtca

SEQ ID NO: 66150 - DNA, 50 bp, homo sapien
tccactgaaggaatatactacaattwaaccattctgttgtaggtgacatt

SEQ ID NO: 66151 - DNA, 50 bp, homo sapien
catggccccatgtagagtgaaaacaytggagctgggagaaactagtcatg

SEQ ID NO: 66152 - DNA, 50 bp, homo sapien
ttgactgttgattgaaatcttcaaartgacaaggccatgtggaagacagt

SEQ ID NO: 66153 - DNA, 50 bp, homo sapien
taatcgctgtgctgtcttactggtaygtggtaaaacatgcacaaacatat

SEQ ID NO: 66154 - DNA, 50 bp, homo sapien
gttggttgaatgaatgaatgagtgamtaaatgcttgatatgagacaatcc

SEQ ID NO: 66155 - DNA, 50 bp, homo sapien
agatcaaacgggtctggaagagtccygaatgcaaagagaagtcactcagg

SEQ ID NO: 66156 - DNA, 50 bp, homo sapien
acctaacccagagcctaatatatgayaagcacttaaaaaataccatgaat

SEQ ID NO: 66157 - DNA, 50 bp, homo sapien
ttttgtctttcccatgacgagttacrgaaggtagaacctttaacaacaaa

SEQ ID NO: 66158 - DNA, 50 bp, homo sapien
acctgggtctgacctggaagcgctcrtgcagccagaccctgaaggcctgg

SEQ ID NO: 66159 - DNA, 50 bp, homo sapien
tggaaagcaaacaagctgaggttcasaaagtttgaggagggcaggcagtg

SEQ ID NO: 66160 - DNA, 50 bp, homo sapien
atatgcgattatgtcaatgttattargaattaagtagttatcagaaaaaa

SEQ ID NO: 66161 - DNA, 50 bp, homo sapien
ctttggggagccattcccaacaagtytggctacgagtcccccactttcca

SEQ ID NO: 66162 - DNA, 50 bp, homo sapien
agtgttttcctttaatctgtatttgyttgaatggtgaagtcagaaacttt

SEQ ID NO: 66163 - DNA, 50 bp, homo sapien
ataattgactttttcattaaaatcaraatgtgaagaacaataagtgtttc

SEQ ID NO: 66164 - DNA, 50 bp, homo sapien
gtttcactctagacttacagtatcartcacaaactgcatttcaatgagat

SEQ ID NO: 66165 - DNA, 50 bp, homo sapien
tgtgcattcttcttagagaggtaaaygattcttctcattgagtagtttgg

SEQ ID NO: 66166 - DNA, 50 bp, homo sapien
aaagttgaggtttacatactttatamatttgacatgtaaaagggtcaggc

SEQ ID NO: 66167 - DNA, 50 bp, homo sapien
catatgcaaagaccccacagtaaaaktgaactcacctggactcaaagtgt

SEQ ID NO: 66168 - DNA, 50 bp, homo sapien
accattcaagttcttttataaatccrttcactacccatccatccatttct

SEQ ID NO: 66169 - DNA, 50 bp, homo sapien
tatctagagatggtacttaggcattrggactttaaaaaataacttcttta

SEQ ID NO: 66170 - DNA, 50 bp, homo sapien
gaaattaaggggacactaagaaattyactattcaagataaataacatttt

SEQ ID NO: 66171 - DNA, 50 bp, homo sapien
tctgggtgggaagatgacaccagcasgcttagagtaactggcccaaggtc

SEQ ID NO: 66172 - DNA, 50 bp, homo sapien
tcctaaggaatcaagtaagcattacrgtaatcacactttgttaaccaatt

SEQ ID NO: 66173 - DNA, 50 bp, homo sapien
acaaagttcaatattctgattatccmaataaaagtatctgtttctggtaa

SEQ ID NO: 66174 - DNA, 50 bp, homo sapien
cctcatagagatgggctgtcataaaycagatattcttcagttcctaaaaa

SEQ ID NO: 66175 - DNA, 50 bp, homo sapien
ttttgtttaattttagctatagaaarcacaataatcttatataataaaat

SEQ ID NO: 66176 - DNA, 50 bp, homo sapien
agtttgagatccctgcatctgtactrtatctttatcactgaattttctct

SEQ ID NO: 66177 - DNA, 50 bp, homo sapien
gctcagccacatgggcttccactcamcaaggctgacttggctacagtcac

SEQ ID NO: 66178 - DNA, 50 bp, homo sapien
cagaaaggtctagactaactcggaawattgccttgataataactaatgtt

SEQ ID NO: 66179 - DNA, 50 bp, homo sapien
ttcagataataattaaataagaccaytgagcactcaacatagaggtaata

SEQ ID NO: 66180 - DNA, 50 bp, homo sapien
taatgcttgcagatagtcagtaaagmataaagctaaagcttggactgtaa

SEQ ID NO: 66181 - DNA, 50 bp, homo sapien
ggccctgttaatctcctgaacctaakattcatttgtaaaataaaataatg

SEQ ID NO: 66182 - DNA, 50 bp, homo sapien
tctccccagtatttttgacccgtcaytggttgaatccatgaatgtggagc

SEQ ID NO: 66183 - DNA, 50 bp, homo sapien
gtgtgtttgcatgtttagtacggcayaaattcttcaaagacctgatggtc

SEQ ID NO: 66184 - DNA, 50 bp, homo sapien
ttagaaaatttaaaattgcagactaygtcaatcgtgttggagtgtaaaga

SEQ ID NO: 66185 - DNA, 50 bp, homo sapien
gtagctatggcttctctttcactaaktgtgctgttgcagaaattgaggac

SEQ ID NO: 66186 - DNA, 50 bp, homo sapien
aatgctagaattaaaatatggttaaygataatggtctccactaaaagtgc

SEQ ID NO: 66187 - DNA, 50 bp, homo sapien
tatatgcattaaaatggagtattacrcagcctttaaaaagaaggaaatcc

SEQ ID NO: 66188 - DNA, 50 bp, homo sapien
gggtaaagtaaagctgttcattcccycattcaatgcatcttttcttgatt

SEQ ID NO: 66189 - DNA, 50 bp, homo sapien
ttccttatttgtgtgacttatcttaracagcatctactttgttttctaaa

SEQ ID NO: 66190 - DNA, 50 bp, homo sapien
aggccaaagcttatggaataaatccyactcagaagagaagataggcacag

SEQ ID NO: 66191 - DNA, 50 bp, homo sapien
aataaaaaagagctcaagttcagtgwcaaaacaacaagcagcagagtagg

SEQ ID NO: 66192 - DNA, 50 bp, homo sapien
gttttaaatctaaattccaggtttamaaaatgccaagtagagcaaaaata

SEQ ID NO: 66193 - DNA, 50 bp, homo sapien
gttattcctgttgtccaagaatagaygcggcaagtagctgaaatgaagtt

SEQ ID NO: 66194 - DNA, 50 bp, homo sapien
acatcctcctccatggtcagatctaygtaaacggaatcatcttgtctaca

SEQ ID NO: 66195 - DNA, 50 bp, homo sapien
actttatcactcccacctacactgasaatccactgggggtaacatctgtg

SEQ ID NO: 66196 - DNA, 50 bp, homo sapien
ctccggagaattttagagctaggttwaaaacacagtttgataaatacatc

SEQ ID NO: 66197 - DNA, 50 bp, homo sapien
catttattgagcctataatatatgarccagctacgagttggatgtagact

SEQ ID NO: 66198 - DNA, 50 bp, homo sapien
taccttagaagccacacaaatgaagraaattatgaattggtcttttcttg

SEQ ID NO: 66199 - DNA, 50 bp, homo sapien
tggaatgatcttactcatcaagaccrattccagacttcaaacacccatgt

SEQ ID NO: 66200 - DNA, 50 bp, homo sapien
ctagatttttaaaagaaatttcccamagcataaggatactttcgtttata

SEQ ID NO: 66201 - DNA, 50 bp, homo sapien
gtgatgcaaatctgaaataggtagcrcaatggctctgaacaatggatcct

SEQ ID NO: 66202 - DNA, 50 bp, homo sapien
gtcttgcctggagctatccagataamgtgtttttggttacatcaacaaat

SEQ ID NO: 66203 - DNA, 50 bp, homo sapien
ctgaagatgaacagttatactatgamgcaagtctaaacatttgcaacaag

SEQ ID NO: 66204 - DNA, 50 bp, homo sapien
aatgcattgtgagaagttctgattawactggttctgccattaactctctc

SEQ ID NO: 66205 - DNA, 50 bp, homo sapien
cccgggtctttttttaaggaagctamcctaagatgcatctcttcccaaaa

SEQ ID NO: 66206 - DNA, 50 bp, homo sapien
cttgtactttagaattcgataatatsactaaatacttcaaagtatcatta

SEQ ID NO: 66207 - DNA, 50 bp, homo sapien
atctttctttattcatttattagtcsagagcacaaacttctaaggatttt

SEQ ID NO: 66208 - DNA, 50 bp, homo sapien
gtacatatatcttactgtgcagttayataatgtatattcgtttatataat

SEQ ID NO: 66209 - DNA, 50 bp, homo sapien
ttcaagtctcttatgtctaaactcamaaagtctacaaatattttaaaatc

SEQ ID NO: 66210 - DNA, 50 bp, homo sapien
aataatcttttctatatctttcataygtgtgttggtaagggagatttatt

SEQ ID NO: 66211 - DNA, 50 bp, homo sapien
caacaatctacattcagcttgatgtraaactaccacatagactgtctagt

SEQ ID NO: 66212 - DNA, 50 bp, homo sapien
acaaaatatttgttaactgaagaaawttgttaaagtgatcaagttttcaa

SEQ ID NO: 66213 - DNA, 50 bp, homo sapien
cttcaccagaatcactgttcaatgtycatattcctacccacagtaacttg

SEQ ID NO: 66214 - DNA, 50 bp, homo sapien
agtgctgggagccagagtcgctatasagataaaactgaatcctattacct

SEQ ID NO: 66215 - DNA, 50 bp, homo sapien
gaagtttctttgataatattctatcygaaagaccttggatacaaaaaaaa

SEQ ID NO: 66216 - DNA, 50 bp, homo sapien
tggacttaccttgtgctctatttaaraaatcctccttcctctttcccacg

SEQ ID NO: 66217 - DNA, 50 bp, homo sapien
ttaagtggatgataattctcagagaycaaagagcaagagtttttgctata

SEQ ID NO: 66218 - DNA, 50 bp, homo sapien
atttttccccacagatatatacttarcatacagccataatttggtgaaat

SEQ ID NO: 66219 - DNA, 50 bp, homo sapien
gaggtgttataacacagtggtggtargcaatgatatttttgtcttccagg

SEQ ID NO: 66220 - DNA, 50 bp, homo sapien
ctacagatcaaaattatttaatttgmaactgaaaagcagtctgtgttcag

SEQ ID NO: 66221 - DNA, 50 bp, homo sapien
aataattgttggcataagagaataaytgtgctatctattgccaagagttt

SEQ ID NO: 66222 - DNA, 50 bp, homo sapien
aacatgtgttcaactctggaagatayggtcaaacaaatttccagtggttg

SEQ ID NO: 66223 - DNA, 50 bp, homo sapien
tctctggggaagcctagacttcagayttactaagcaaaaactttcaatta

SEQ ID NO: 66224 - DNA, 50 bp, homo sapien
ttttcatctcccccttttggcattayaggagttcagaaaatcaaccacag

SEQ ID NO: 66225 - DNA, 50 bp, homo sapien
agcaactgtgataaaagataaacagytgaagaatctgggtgaagagtaca

SEQ ID NO: 66226 - DNA, 50 bp, homo sapien
attagttgagtacaacagtcaacaaktgaatactgcctatggatcattat

SEQ ID NO: 66227 - DNA, 50 bp, homo sapien
aagttaacaggggccagatcatgccrgattttacgggctgtcataaggac

SEQ ID NO: 66228 - DNA, 50 bp, homo sapien
ttgtaccaattatacagttagcagtyaatatagacaagatttgaactcaa

SEQ ID NO: 66229 - DNA, 50 bp, homo sapien
gcttcaaaacccatattcaaagctcyacagtgaaccaaatgataaggcat

SEQ ID NO: 66230 - DNA, 50 bp, homo sapien
tgggatttaactgtgaaaaagccaaygacaaagctttcttatgggcagaa

SEQ ID NO: 66231 - DNA, 50 bp, homo sapien
gagtcttgggggtaagtcctctccartcaataggtcttccagaaggggag

SEQ ID NO: 66232 - DNA, 50 bp, homo sapien
aatataatggtgagataggtatagartagactgtctcagttcaaaagaga

SEQ ID NO: 66233 - DNA, 50 bp, homo sapien
gccagaaggtaaggaaggcacaaacraacatccaattcacagtaatagga

SEQ ID NO: 66234 - DNA, 50 bp, homo sapien
gtcagaaatctctattcatcttcatyagaaagggattcagataaaataac

SEQ ID NO: 66235 - DNA, 50 bp, homo sapien
cctcagggagtagagagtagatagcrgcagtttggctcaggaatggcttc

SEQ ID NO: 66236 - DNA, 50 bp, homo sapien
aattcttaaataagcataggaatgcraatactatcaaattgttttctttt

SEQ ID NO: 66237 - DNA, 50 bp, homo sapien
gcagtttggctcaggaatggcttccrcgtgtgcatagtgtagtggtggtt

SEQ ID NO: 66238 - DNA, 50 bp, homo sapien
tctgtcagctgagctcagagcctgtraagactctatgtgtctccagtagt

SEQ ID NO: 66239 - DNA, 50 bp, homo sapien
tgttagagactgactctcactgtaargactgtattggagaaaagaaagga

SEQ ID NO: 66240 - DNA, 50 bp, homo sapien
gtgaatagtaaagctttctgtgaagwcatactgaagttaagcttatatta

SEQ ID NO: 66241 - DNA, 50 bp, homo sapien
tagacttttggcttacaccaactagmaccagatcttggaaggagaaaagg

SEQ ID NO: 66242 - DNA, 50 bp, homo sapien
tattaaataacagccataggtgtgcraaggatttacaaatggatagccac

SEQ ID NO: 66243 - DNA, 50 bp, homo sapien
gcataatttttgtgtttttttctgcrgtgattcagcaattactacattgc

SEQ ID NO: 66244 - DNA, 50 bp, homo sapien
gtgtcacattgttggtaaaacgaaayctgattaagactttgaaaggatat

SEQ ID NO: 66245 - DNA, 50 bp, homo sapien
cttaagagaacaataacaatgtctakggattcttgatacggctgaggctg

SEQ ID NO: 66246 - DNA, 50 bp, homo sapien
ttctgagatcccaaacatttcctcamagatcctacaaaaatagtttccaa

SEQ ID NO: 66247 - DNA, 50 bp, homo sapien
ggtttctcaagaatatgaagtgctcratgtaatttagagcaatctgcaca

SEQ ID NO: 66248 - DNA, 50 bp, homo sapien
gaaggtatgcaaagaaaagagatgamgttcgcaaggactggccagatttc

SEQ ID NO: 66249 - DNA, 50 bp, homo sapien
tctggcagtctctggttggtcggtcygaatgcctggagacagacagaaat

SEQ ID NO: 66250 - DNA, 50 bp, homo sapien
ccccgggagtgctcaattgtagatayatggtttcttggggactgttgtgg

SEQ ID NO: 66251 - DNA, 50 bp, homo sapien
ccctagaaagccttgagagaagatayccatggccaacttggagatgggga

SEQ ID NO: 66252 - DNA, 50 bp, homo sapien
taatgggctgtcttcagaaacacagygagtggccctgtgctggttccacc

SEQ ID NO: 66253 - DNA, 50 bp, homo sapien
aactgggcttgtgggacaaagtaaayggaatgagagccccaacaaaaaca

SEQ ID NO: 66254 - DNA, 50 bp, homo sapien
cccacccactctgtgtttccatagamggtgctcagggatcacttggggga

SEQ ID NO: 66255 - DNA, 50 bp, homo sapien
cccactccctgcaacccaggtcttgyatctgccaccggccaacccaaaga

SEQ ID NO: 66256 - DNA, 50 bp, homo sapien
ttttagctttcctttctagttcagaycttcatttccttaacctggatagc

SEQ ID NO: 66257 - DNA, 50 bp, homo sapien
gaacattctccttgttacacaatacrcagaacctgccacagttttaaagt

SEQ ID NO: 66258 - DNA, 50 bp, homo sapien
aagatacaaccctattaaaaaatcawgggaaggaaaagcacaaaatctga

SEQ ID NO: 66259 - DNA, 50 bp, homo sapien
aaaggagagagcaacagagattctargcacagaagcaccctgcatgaagg

SEQ ID NO: 66260 - DNA, 50 bp, homo sapien
ggatttccctaaacaagcaaaaacaytgaaactacagtatgcaggacatg

SEQ ID NO: 66261 - DNA, 50 bp, homo sapien
cacatctctcctaacagaggactagratgacctactcttccctgaccttt

SEQ ID NO: 66262 - DNA, 50 bp, homo sapien
cttcggtttcttcatctgaaatggamattttaaatacctaccctgatttt

SEQ ID NO: 66263 - DNA, 50 bp, homo sapien
tttttttttaacctgagtgtaattcratctggaagaaacagctacaaaca

SEQ ID NO: 66264 - DNA, 50 bp, homo sapien
agtgtggctttgggttcctgggatarcttgtctttgtctcacagtgtcct

SEQ ID NO: 66265 - DNA, 50 bp, homo sapien
tcttttgtttggagcctttgatcaaycagtaagctactcaacttagtcct

SEQ ID NO: 66266 - DNA, 50 bp, homo sapien
atgtaatcagggttgagaacaactargagagatagttatgttacaatgga

SEQ ID NO: 66267 - DNA, 50 bp, homo sapien
aagttctttctgagacagcgcaaatraaaccgcttctttctgggaggtgt

SEQ ID NO: 66268 - DNA, 50 bp, homo sapien
agggcgtctggcctttgttcggaccrctaagcctcatcctcctccggatg

SEQ ID NO: 66269 - DNA, 50 bp, homo sapien
cactaagcccaccaggcacaggctaygtctcgcagggcgtctgccaggtg

SEQ ID NO: 66270 - DNA, 50 bp, homo sapien
cagggcttctaccaagatctgtgacyaaaccaggccatttcccagctgct

SEQ ID NO: 66271 - DNA, 50 bp, homo sapien
gcataaacggtatgttttaaaattaygtatatgtgtgataaaaccatatt

SEQ ID NO: 66272 - DNA, 50 bp, homo sapien
gtataacaaaggttaccaaagactarggggagagacaggtaggaagttat

SEQ ID NO: 66273 - DNA, 50 bp, homo sapien
agcataggctttacagacctagtccygattcttgcttctactgcttactt

SEQ ID NO: 66274 - DNA, 50 bp, homo sapien
tgggcttaatttcacagaaaataccrcacacatgacctgagtatcattca

SEQ ID NO: 66275 - DNA, 50 bp, homo sapien
atttgacctagaccacttggctttcygatagcatgggaaatgaggctgac

SEQ ID NO: 66276 - DNA, 50 bp, homo sapien
ctcaaggaaatcacagtctgttggcrgagataagtagtaatggtgcctaa

SEQ ID NO: 66277 - DNA, 50 bp, homo sapien
agctagcctaacatttcttagctagyatgcggcaaagaagaaatttagac

SEQ ID NO: 66278 - DNA, 50 bp, homo sapien
gaggaatggcttattttctgatgacyacatgtgggactatttcaaccgcc

SEQ ID NO: 66279 - DNA, 50 bp, homo sapien
cagctcttcccacaaagctattagcragccaaaccagtttcactgcttcc

SEQ ID NO: 66280 - DNA, 50 bp, homo sapien
ggaatattacacgtgaaaactggccsaacatcatttattattaaagtcca

SEQ ID NO: 66281 - DNA, 50 bp, homo sapien
agtaggtttgtgccgttatgtagtamaccccagtgaatattcttctttca

SEQ ID NO: 66282 - DNA, 50 bp, homo sapien
accagctaagagtgattacataaagmatggaccttttatctctatagaaa

SEQ ID NO: 66283 - DNA, 50 bp, homo sapien
aatcaggaaagggaagggagtctcgsaattggttgaaattgaaatcagtg

SEQ ID NO: 66284 - DNA, 50 bp, homo sapien
tcttgccctgctgctattaactagcratatcactagccatccgacttcaa

SEQ ID NO: 66285 - DNA, 50 bp, homo sapien
acacttccttcattttaatttgccaygcttcatcttttctaaatgttcat

SEQ ID NO: 66286 - DNA, 50 bp, homo sapien
atggagagcaaatcgcttctatcatrttctgagtctcagttttctcaact

SEQ ID NO: 66287 - DNA, 50 bp, homo sapien
aagttttttgccaaatttgaatatamtactagagacactctaatttaaaa

SEQ ID NO: 66288 - DNA, 50 bp, homo sapien
aagtaaagacatacatggtcgataascttgaatgatttgttctgaaatta

SEQ ID NO: 66289 - DNA, 50 bp, homo sapien
tcaggatgcaaaattacattcacccraaccaggtgattaaaaagttgaag

SEQ ID NO: 66290 - DNA, 50 bp, homo sapien
aatctttccattatgccacatgaagwctaatagccagaaatgacaactaa

SEQ ID NO: 66291 - DNA, 50 bp, homo sapien
aatagccagcacatagtaggtgttcrgaaagaatcggctggttatgtgct

SEQ ID NO: 66292 - DNA, 50 bp, homo sapien
ctgctgaatccatgagtgatggagtyggctctttcctggtgagtgtgggt

SEQ ID NO: 66293 - DNA, 50 bp, homo sapien
gaattaaaagcacaaccccaaaagaktgatggcgtctccatcttaggacc

SEQ ID NO: 66294 - DNA, 50 bp, homo sapien
actctaagaaggaattcaggttcackataacatcagcaagcagtccacac

SEQ ID NO: 66295 - DNA, 50 bp, homo sapien
ctgacctatgtcttcaggaatcttasagtctactaaagagagaaacagtt

SEQ ID NO: 66296 - DNA, 50 bp, homo sapien
tgggtgtgttctcgtggagacatgayagagatctggtgaatcatctgtat

SEQ ID NO: 66297 - DNA, 50 bp, homo sapien
taaccctgactctgttggagcataamgatgttgcaactgaagatattata

SEQ ID NO: 66298 - DNA, 50 bp, homo sapien
actgcctaaatgccttcctgagcgaktactgggtagcctgatctcagtta

SEQ ID NO: 66299 - DNA, 50 bp, homo sapien
tacagggagatgggcaaggctcccartaagattttctcctttcaatatgt

SEQ ID NO: 66300 - DNA, 50 bp, homo sapien
caaattacctagattctagtcaccaygctaatgtctcacacatgctctct

SEQ ID NO: 66301 - DNA, 50 bp, homo sapien
gaggctcaaagagagtaaacaacccrttcaagacaatcaactaagtggta

SEQ ID NO: 66302 - DNA, 50 bp, homo sapien
gatgagaagtcagtgtttccacacawcctttgttcctgtgtttccaaact

SEQ ID NO: 66303 - DNA, 50 bp, homo sapien
tcccttttctgttattgcttccttgmaattctagttgagctgaaatctat

SEQ ID NO: 66304 - DNA, 50 bp, homo sapien
cttggagctagtgacttagccattasaggttttagtcatagacattattt

SEQ ID NO: 66305 - DNA, 50 bp, homo sapien
ttcttgtttccaatattatgggacaygaaatctttgagattctagaaagt

SEQ ID NO: 66306 - DNA, 50 bp, homo sapien
actttctaagacagtttccttacaaytctgcacagttataacaatcagaa

SEQ ID NO: 66307 - DNA, 50 bp, homo sapien
tattaaccctaatggtacacatagtrgattcatagtacacattcactgaa

SEQ ID NO: 66308 - DNA, 50 bp, homo sapien
cattgtatgtagagctttcaaaatargcccactcccaggactaccagagt

SEQ ID NO: 66309 - DNA, 50 bp, homo sapien
ccttctaaatatcctagcttcagtcraatgttgcagcttgtaacaaaatt

SEQ ID NO: 66310 - DNA, 50 bp, homo sapien
aaaaacccatagaattatttcaaaaratatagaccaagtgtggtggctca

SEQ ID NO: 66311 - DNA, 50 bp, homo sapien
tcacagaggaggtggctttttgaatsaaatgtgtgagagtttgctggtag

SEQ ID NO: 66312 - DNA, 50 bp, homo sapien
aaatttgcagagtgcctcactcaggwatatgagaatcttcagtctgctgg

SEQ ID NO: 66313 - DNA, 50 bp, homo sapien
cttttccaagcgtgagtccatgatargtacccagattcaacgcaattcca

SEQ ID NO: 66314 - DNA, 50 bp, homo sapien
tcttgaggagcttggtggtggaaccygttctcactccagtctgttccaat

SEQ ID NO: 66315 - DNA, 50 bp, homo sapien
gatgatgatatcatccacctctttgwtatagacccaggggagcaagtgct

SEQ ID NO: 66316 - DNA, 50 bp, homo sapien
cacatgtaaaaatggctttgcaaacygtttaattggaataaatatacgca

SEQ ID NO: 66317 - DNA, 50 bp, homo sapien
gagtgttcattttcactttagtaaaygaggaacataactagatggaaagt

SEQ ID NO: 66318 - DNA, 50 bp, homo sapien
tctggttgaccacagggctaattcamggtgactaattctgccccgccttc

SEQ ID NO: 66319 - DNA, 50 bp, homo sapien
gtcttcaatgcgtgtttcaaccctcrcacaaattaacaacgggagtttat

SEQ ID NO: 66320 - DNA, 50 bp, homo sapien
gagaataattgctcagaagctaatcrtaaagtggacccagctttcaagaa

SEQ ID NO: 66321 - DNA, 50 bp, homo sapien
  misc_feature (5)..(5): n is a, c, g, or t
ctccncagggtacataaatgcagccmgagagaatagccagagtcttcagc

SEQ ID NO: 66322 - DNA, 50 bp, homo sapien
acctttaaacaaataccgtttcattkcctccgatttataatgcaaatatt

SEQ ID NO: 66323 - DNA, 50 bp, homo sapien
cctgctctccagcaccaggttgccayaatgactaagactggctgctgcag

SEQ ID NO: 66324 - DNA, 50 bp, homo sapien
aacagtcctggcccttccctttcccrgcaacttatttctatactcatcat

SEQ ID NO: 66325 - DNA, 50 bp, homo sapien
tgattgaggtaatgttggattgttaygtcttgctcacagtaaagtagagg

SEQ ID NO: 66326 - DNA, 50 bp, homo sapien
ttgcactgtgcccagtctggtgaagrataaatgtttctgttgcaccatgt

SEQ ID NO: 66327 - DNA, 50 bp, homo sapien
gaccaaggcatgccatgggtcacctragaacttactgccattatcaggtt

SEQ ID NO: 66328 - DNA, 50 bp, homo sapien
tgcattttgaacacctctagctcaawtactttcatacagatcttccccga

SEQ ID NO: 66329 - DNA, 50 bp, homo sapien
gtcccagtgtcactgctctttccaaytgatattatcaccctggtttttta

SEQ ID NO: 66330 - DNA, 50 bp, homo sapien
gatgataatagcagttgtatgtcgaygagctccagtaaaaccttccagca

SEQ ID NO: 66331 - DNA, 50 bp, homo sapien
aacacttcatcttacacattttagcmcttagtagttgctgaaaacatata

SEQ ID NO: 66332 - DNA, 50 bp, homo sapien
tgctaaaaagacatgggataaactcracatccattctcaatttttaaaaa

SEQ ID NO: 66333 - DNA, 50 bp, homo sapien
tatgtaaacctacagtgaacctgacyaaggcacaagttcaagtgacttat

SEQ ID NO: 66334 - DNA, 50 bp, homo sapien
ctcagctactttatcagttaattacrcataaaatctgttgccttaaaata

SEQ ID NO: 66335 - DNA, 50 bp, homo sapien
actgcgacccactcgtgcaccgtacyggagtttgtggatgactctagcag

SEQ ID NO: 66336 - DNA, 50 bp, homo sapien
tgctcataatgactgcttactgttayagttcttttccaagtttcccttgg

SEQ ID NO: 66337 - DNA, 50 bp, homo sapien
ggacatggcttcttcaatgttgaaastggaaaaaaccaaaccaggatgag

SEQ ID NO: 66338 - DNA, 50 bp, homo sapien
agctctggaattgcctttttcttgaygcttccaccttactgaaaaaactg

SEQ ID NO: 66339 - DNA, 50 bp, homo sapien
acacgagaacacgcttttcagactgsagagtcaacaatcacaacagtctg

SEQ ID NO: 66340 - DNA, 50 bp, homo sapien
tgccaggacacgcatgtacacaaacrctcactgacccgacgacaggccca

SEQ ID NO: 66341 - DNA, 50 bp, homo sapien
taactgttgtttaactttaaaacaarctactgttctctaaactagtacta

SEQ ID NO: 66342 - DNA, 50 bp, homo sapien
acaaacattaacccataccttatacrctgcccagaaagctcaaaacggac

SEQ ID NO: 66343 - DNA, 50 bp, homo sapien
agttttccattgtgaacactgagaaygttgaggaccactcgtgtgttcac

SEQ ID NO: 66344 - DNA, 50 bp, homo sapien
tgttcccctcccagagctgtggtgargttcaaatgagctaatggtcatga

SEQ ID NO: 66345 - DNA, 50 bp, homo sapien
ctagagaatgcaaattcagcttttcrttgaagctactacattccagatag

SEQ ID NO: 66346 - DNA, 50 bp, homo sapien
ccagctctgtctcctctatttgttcraccttgggcaagctacttaaattt

SEQ ID NO: 66347 - DNA, 50 bp, homo sapien
caaagtaaattttgtccttgaagtgyatgtttacctcctcattatgtttt

SEQ ID NO: 66348 - DNA, 50 bp, homo sapien
tcaaatgcattcaaaatgtgatagtmaatgttgagactggttttcctgta

SEQ ID NO: 66349 - DNA, 50 bp, homo sapien
tgggaagtcatcaagaagtttaagtyacgagctggcaaaatgaattaata

SEQ ID NO: 66350 - DNA, 50 bp, homo sapien
gctagggttaagaaccaatgctgtartaacaatttttaagggtgtgaaac

SEQ ID NO: 66351 - DNA, 50 bp, homo sapien
agtttagtcttccattgattgataaytgcttaaaacctttatttccattc

SEQ ID NO: 66352 - DNA, 50 bp, homo sapien
tgctgctgcagctggtctcaaagccrtaattgatatttatcatctcccta

SEQ ID NO: 66353 - DNA, 50 bp, homo sapien
caattcagaactggcaagccatggcsaaaggacagcacgttcatatccac

SEQ ID NO: 66354 - DNA, 32 bp, homo sapien
aactcctcaaaagaatkaaggcggaacatgac

SEQ ID NO: 66355 - DNA, 50 bp, homo sapien
aacacaggtgaggcattaaagggaartcaagagtccctaggctctttggc

SEQ ID NO: 66356 - DNA, 50 bp, homo sapien
cacagtccagcccactgccagacaargagcctaagacctgactccaggga

SEQ ID NO: 66357 - DNA, 50 bp, homo sapien
atcctcactcagctttctttttcaarctgccgacacttcagatgaaaccc

SEQ ID NO: 66358 - DNA, 50 bp, homo sapien
cagtcaacagctcagtattttgtcakaggaacacttgctaaaggaaaaac

SEQ ID NO: 66359 - DNA, 50 bp, homo sapien
atctctctcaaaggccagctgttagsaaatatagtctattgtgtcgctgt

SEQ ID NO: 66360 - DNA, 50 bp, homo sapien
tgcctctctactggtttgctcccgawagtcaggagagtgggtggggctga

SEQ ID NO: 66361 - DNA, 50 bp, homo sapien
ttgctttttgttccacaaaagtgaaratttgcataaaaatgcataagaag

SEQ ID NO: 66362 - DNA, 50 bp, homo sapien
tagcagtctcaaacaaactcttctayagcaaactgttgcgatggtatagt

SEQ ID NO: 66363 - DNA, 50 bp, homo sapien
ttgggactctgttaaaacttcactgyagtaatgcctttctctagactata

SEQ ID NO: 66364 - DNA, 50 bp, homo sapien
tcctaattactttccagtgtactacyaccaacaattcatcaacgagcatt

SEQ ID NO: 66365 - DNA, 50 bp, homo sapien
gctgatattttacaagcccacaatayacagttttttatgagtccataaaa

SEQ ID NO: 66366 - DNA, 50 bp, homo sapien
agctagcacagtgtctgcccattaartgctggtctccctggttccctatg

SEQ ID NO: 66367 - DNA, 50 bp, homo sapien
agaaggtaagagtaaatctaaagaakgtggtgatctggatactaaatgat

SEQ ID NO: 66368 - DNA, 50 bp, homo sapien
aagaagatacgatacacctattttasaggtggctgaataacacccatggc

SEQ ID NO: 66369 - DNA, 50 bp, homo sapien
aaaaaggggtcaaatgtaaaatgacrgaatggtgaggacattggcaggag

SEQ ID NO: 66370 - DNA, 50 bp, homo sapien
caatctctgcggtgctgagctgtccygcgtgtggtgatttgttgggcagc

SEQ ID NO: 66371 - DNA, 50 bp, homo sapien
acctaccccaagttcaaatacaccamgtgctctgaatgacagctggtgtg

SEQ ID NO: 66372 - DNA, 50 bp, homo sapien
aatgttatggtatatataatatctamcacaattttaaacaaaacaaaaca

SEQ ID NO: 66373 - DNA, 50 bp, homo sapien
ttactgcagcataactaagcctaaaragactcatatttctatcttgaaag

SEQ ID NO: 66374 - DNA, 50 bp, homo sapien
aaatgccatcaaagcatagttaatcrgaattgaattaaatcataattgga

SEQ ID NO: 66375 - DNA, 50 bp, homo sapien
gcctgaaggtccttcccattcccgaytacatggtttaaacttctatttgt

SEQ ID NO: 66376 - DNA, 50 bp, homo sapien
ttaacttatccacattgttcttcaaygtcctactctgtaagatggaagta

SEQ ID NO: 66377 - DNA, 50 bp, homo sapien
ggagttttgagggttttaagtgaaayagtgcctgagaaggagactatagg

SEQ ID NO: 66378 - DNA, 50 bp, homo sapien
accatgtggcacattttatatgacaygagaaaaaatggtcaaaagatctc

SEQ ID NO: 66379 - DNA, 50 bp, homo sapien
cattttgatctttatcctttatgtcyttttctctgaatgtatttttttgt

SEQ ID NO: 66380 - DNA, 50 bp, homo sapien
cccaaagcattaatcttcatattccyagtggccatctaagtacctagcac

SEQ ID NO: 66381 - DNA, 50 bp, homo sapien
tttgactctgtatcttaaaatgggawctgagccttctgactcaagccaga

SEQ ID NO: 66382 - DNA, 50 bp, homo sapien
aaaaaaaagcaaacatacagcatagraagtccccaagtgaatgttcccta

SEQ ID NO: 66383 - DNA, 50 bp, homo sapien
ttttgaggggatatttgtagtttcaracaggattctgggaattagtgact

SEQ ID NO: 66384 - DNA, 50 bp, homo sapien
ctcccacgaggtaactgcaggaatayagataaagggtgagagagaacaat

SEQ ID NO: 66385 - DNA, 50 bp, homo sapien
acactgattaaatatataactacatmatttcagcagtatgccttcagctc

SEQ ID NO: 66386 - DNA, 50 bp, homo sapien
acagtacacccctcctgttctatgcygagcaatgaaacagaagcctttgc

SEQ ID NO: 66387 - DNA, 50 bp, homo sapien
acagcagcagtagttgtagctttcayagcagtgcttcctggcctttgcac

SEQ ID NO: 66388 - DNA, 50 bp, homo sapien
ttctgtaaaatttagcatccctttayagtaaaaatccacaagaaactagc

SEQ ID NO: 66389 - DNA, 50 bp, homo sapien
ctcagggagaaagtgctgtgattgaytggtcatgtctgacgtgggcatgg

SEQ ID NO: 66390 - DNA, 50 bp, homo sapien
cccatgggacatttaatgaaaattasgcacctgtcctggtgttctcatcc

SEQ ID NO: 66391 - DNA, 50 bp, homo sapien
tgccgttgagtaacaggccatcatayagtgtaagctccgagtcactaaac

SEQ ID NO: 66392 - DNA, 50 bp, homo sapien
agttgcaaagttccactgaaaaagamacagttaatcccaatctctgaact

SEQ ID NO: 66393 - DNA, 50 bp, homo sapien
aagaaaagcaaggcaaacaaatacasaaattttaagcaaataaaaggaaa

SEQ ID NO: 66394 - DNA, 50 bp, homo sapien
cgctgtgtcaacacgggaccttgaasgttttgctggaaaggtgtcacttt

SEQ ID NO: 66395 - DNA, 50 bp, homo sapien
gggatgggaagttgctaggcagtaaraacgtagtaaaggcagcctgccag

SEQ ID NO: 66396 - DNA, 50 bp, homo sapien
gtgggtgtagagctggtgccgttccyatcgacagcagccatgctgtcact

SEQ ID NO: 66397 - DNA, 50 bp, homo sapien
attttacgttgtctataatcattaartcactccctgtgtaatttgtgaga

SEQ ID NO: 66398 - DNA, 50 bp, homo sapien
aagagaaacaggttttctgcacagaygatgtgggaagcatcactgagagc

SEQ ID NO: 66399 - DNA, 50 bp, homo sapien
cgacagcagccatgctgtcactgtgygggttatccatgctctggcctccc

SEQ ID NO: 66400 - DNA, 50 bp, homo sapien
gttgttataatttgtttatatttgaygtttataatttgtctaataaaata

SEQ ID NO: 66401 - DNA, 50 bp, homo sapien
gcgcctggcctctattcttgttttcyatgtccatttatattcgcacagag

SEQ ID NO: 66402 - DNA, 50 bp, homo sapien
gaaaggaatcacccaggaatcattaraaacataaatccttagcccttacc

SEQ ID NO: 66403 - DNA, 50 bp, homo sapien
attacccttgtgatcagagaaaatayaatctaaggtcttaatgaatccgt

SEQ ID NO: 66404 - DNA, 50 bp, homo sapien
ttatgtaaccttgaactaggaatgcraaaagaaaattatgtagagcaggg

SEQ ID NO: 66405 - DNA, 50 bp, homo sapien
ccagacacctagcttaaatggagtcrgaaagaaccactagtcaaggcata

SEQ ID NO: 66406 - DNA, 50 bp, homo sapien
atcactccagaatcctttgtttctayggtttccagatgtttccaatgtct

SEQ ID NO: 66407 - DNA, 50 bp, homo sapien
tcaaaaagattcagaaaatgaaggayaaatagacagcaaatttggcaaaa

SEQ ID NO: 66408 - DNA, 50 bp, homo sapien
aggtttaccttaaggtaaaagagccratattccatcaggtaattttttgt

SEQ ID NO: 66409 - DNA, 50 bp, homo sapien
agctagctcatttacaccttctctayatgatcagccaatgttgttgttgc

SEQ ID NO: 66410 - DNA, 50 bp, homo sapien
tgtgtgctcaagccttgggaaaattyaacaactggaataattcgtatcag

SEQ ID NO: 66411 - DNA, 50 bp, homo sapien
atctcttaaagacattttttaaagcraataattatggagtccttcctatg

SEQ ID NO: 66412 - DNA, 50 bp, homo sapien
agattaagaaaaataaataaataacrgtgctaggaaaccagggaagagag

SEQ ID NO: 66413 - DNA, 50 bp, homo sapien
ggagtccacaactgaaatggcactarggaattataataataaaagcaata

SEQ ID NO: 66414 - DNA, 50 bp, homo sapien
tatgcagggatacaacagagatgagwaataaatattaaacaaactttatt

SEQ ID NO: 66415 - DNA, 50 bp, homo sapien
ataacaggacctacattattttatawggtagacaaattgagtgtcagtag

SEQ ID NO: 66416 - DNA, 50 bp, homo sapien
atatcaatggaaaatgtggaaaaaartactgatagcagcagctcatagaa

SEQ ID NO: 66417 - DNA, 50 bp, homo sapien
ctgggaaccttctgttctcttcccarctgacaaggaaacttcactatcac

SEQ ID NO: 66418 - DNA, 50 bp, homo sapien
attatttgtgatggaagaaaggagcratagatagaagactgataggttaa

SEQ ID NO: 66419 - DNA, 50 bp, homo sapien
tatttcctccatgcatgcattaaacyggatgctgtcagatactattgcag

SEQ ID NO: 66420 - DNA, 50 bp, homo sapien
cccatgaaacacagaaaatccaaagragaggaaattagtaagtaccatga

SEQ ID NO: 66421 - DNA, 50 bp, homo sapien
ttgttaatttttacactgatccctayaaaatcagggtaggtatttaaaat

SEQ ID NO: 66422 - DNA, 50 bp, homo sapien
aggagtgtttagtaacttctgcacaraggactcatccatctcttgcttat

SEQ ID NO: 66423 - DNA, 50 bp, homo sapien
acgatctctaatgtatcatggtttayaaatgagtctgaagtgacgcttgg

SEQ ID NO: 66424 - DNA, 50 bp, homo sapien
tttttttccccaaaaaccacgttaaragacagtccagaaatgagattgct

SEQ ID NO: 66425 - DNA, 50 bp, homo sapien
tggccggcccaccaccatagaatccraggcacagaggctgggacacaagt

SEQ ID NO: 66426 - DNA, 50 bp, homo sapien
ctaaggccattcattcaactaaaackaagttatactgatttattgaagac

SEQ ID NO: 66427 - DNA, 50 bp, homo sapien
ctaagacagctagagcctctgcagamctctcatgtgattctcaccaggac

SEQ ID NO: 66428 - DNA, 50 bp, homo sapien
cctctgaaaggatgagtacaatgaakattgagagctaatagaaattttca

SEQ ID NO: 66429 - DNA, 50 bp, homo sapien
gctgctttgatgggaaagctcttccratgtctggagtctgggaagagagt

SEQ ID NO: 66430 - DNA, 50 bp, homo sapien
cttaactgtgacctctgctcagggayctacaagactacaatcaagctatt

SEQ ID NO: 66431 - DNA, 50 bp, homo sapien
tagagaaacctagaatagatcttgaygacaacatgacccagaatgcctgg

SEQ ID NO: 66432 - DNA, 50 bp, homo sapien
ctccactgccaaatctgataaaagamctccctttgaagaccttcctcctg

SEQ ID NO: 66433 - DNA, 50 bp, homo sapien
atatatagcattctggtgatcatagrccattttgatctccacactgttcc

SEQ ID NO: 66434 - DNA, 50 bp, homo sapien
actgtttttcttggtgaaataatcartacaaggtagttgcaagtttagaa

SEQ ID NO: 66435 - DNA, 50 bp, homo sapien
aaataaaagataaactcgaaaccaayttacagtgtcagtataaaatctct

SEQ ID NO: 66436 - DNA, 50 bp, homo sapien
gagaactccccaaagcagcagtagaytaccctaaagtaaaactgtccttc

SEQ ID NO: 66437 - DNA, 50 bp, homo sapien
tatgcaattgtgcagtaggttagcaraattatctgagcttccatactcat

SEQ ID NO: 66438 - DNA, 50 bp, homo sapien
taattgtgttaaatgtgcctcataasttacattcccggtgaggctgtcat

SEQ ID NO: 66439 - DNA, 50 bp, homo sapien
tctagttgatcaatcctatttataamccctttctgattttaaactttgta

SEQ ID NO: 66440 - DNA, 50 bp, homo sapien
atatgcaatgaaagtctggtaaatayagaacagtgtgataaaggctacct

SEQ ID NO: 66441 - DNA, 50 bp, homo sapien
agaattttgcaagatggttgttaaartagaacatcgttaaaattaagttg

SEQ ID NO: 66442 - DNA, 50 bp, homo sapien
gggatttctacaattccctcttgacyaacagtgtgaatctacttgttcca

SEQ ID NO: 66443 - DNA, 50 bp, homo sapien
tttctagattgtggatcttcaggtamattctgtcactttcacttcacttc

SEQ ID NO: 66444 - DNA, 50 bp, homo sapien
actgacgacattagcaaagacctccraagtgtttcctctgtaccaggctc

SEQ ID NO: 66445 - DNA, 50 bp, homo sapien
attgattccacaccacttattgattycacaccacttactgattacacact

SEQ ID NO: 66446 - DNA, 50 bp, homo sapien
attaaaaagtaaaaaagaaaagggawgcaggataaatgatgaatttaaag

SEQ ID NO: 66447 - DNA, 50 bp, homo sapien
tggagaggaacatttgctttacggasaggtggatgtctgtaggggaccct

SEQ ID NO: 66448 - DNA, 50 bp, homo sapien
atgctagcaggaaagtcattagaaakacaatggaaggttgtgacagaagt

SEQ ID NO: 66449 - DNA, 50 bp, homo sapien
gacatctgtttaaaaatatctgaaaygtaatcaggtgaaataaggacttt

SEQ ID NO: 66450 - DNA, 50 bp, homo sapien
tagagccagtaaaaagtcccttggaragattggtctggtacctggttttt

SEQ ID NO: 66451 - DNA, 50 bp, homo sapien
gtcatggccccatttcataagactcraagctcattttcagggcatagagg

SEQ ID NO: 66452 - DNA, 50 bp, homo sapien
ccacattggctctatgttcagagagygtctaccctcaagttttcaagatt

SEQ ID NO: 66453 - DNA, 50 bp, homo sapien
tgtgatcttcttcaaccccaatttawatcattaggctgattcaaacacat

SEQ ID NO: 66454 - DNA, 50 bp, homo sapien
gctatattgaaatatgcttatcttayggtacttcaaaatgtaataaattt

SEQ ID NO: 66455 - DNA, 50 bp, homo sapien
caaacttggctgtgtgttggaatcaycttatcactattgttaattttgta

SEQ ID NO: 66456 - DNA, 50 bp, homo sapien
tgttttccctcattttaggagacaaytcctctatcacctttccaatacac

SEQ ID NO: 66457 - DNA, 50 bp, homo sapien
aacaactgtcgaagctaagtaaagaratattctagtattcagtccatttt

SEQ ID NO: 66458 - DNA, 50 bp, homo sapien
ctatcaaataaatgtgagccagaagrtttttaatgggagaaattaacttt

SEQ ID NO: 66459 - DNA, 50 bp, homo sapien
atacaaaattgtaagatgataattaygtttttttaagccattaaatttgt

SEQ ID NO: 66460 - DNA, 50 bp, homo sapien
actgaatcagaaactctggtgatacrgcccagtaatctgttttttaacaa

SEQ ID NO: 66461 - DNA, 50 bp, homo sapien
tgtatctttcctataatttttctcaycaccctgaccaatctcctacatct

SEQ ID NO: 66462 - DNA, 50 bp, homo sapien
agggtcataagaatcacaagataaaygcaaagtgcaaaggcaataatggg

SEQ ID NO: 66463 - DNA, 50 bp, homo sapien
gtaaacatagttgaatctaaatcagsaaagataagaggaaaatggaaata

SEQ ID NO: 66464 - DNA, 50 bp, homo sapien
accttcaaatataaaataatagtaasatcacaactttttaaaagtaaatt

SEQ ID NO: 66465 - DNA, 50 bp, homo sapien
aatgttgatttactacaatatacagwatgagaacaaagaagttgccacca

SEQ ID NO: 66466 - DNA, 50 bp, homo sapien
aatgagaacaaagaagttgccaccawtatgtgatgcaaatgtctactgca

SEQ ID NO: 66467 - DNA, 50 bp, homo sapien
tgaagggtacattcataatcatgtgraattgttccagctccttttgggca

SEQ ID NO: 66468 - DNA, 50 bp, homo sapien
aatgactatccttcactctttttccraatttctcaccctgggaattatca

SEQ ID NO: 66469 - DNA, 50 bp, homo sapien
caacagccacctgtaatgtaaaaaargagaaataagaaaataaaaggtct

SEQ ID NO: 66470 - DNA, 50 bp, homo sapien
tcattcaccctctggtctgacctcayggatttcttacatgcctagatacc

SEQ ID NO: 66471 - DNA, 50 bp, homo sapien
caaaaggtccaagttacctctcagayatcaggcagatgattaattgtact

SEQ ID NO: 66472 - DNA, 50 bp, homo sapien
tcattcatatttgtctagtgtttackctcagtcaagtattagggcactag

SEQ ID NO: 66473 - DNA, 50 bp, homo sapien
ttcctgctcatggtaggaacacgaaraaatagataccatttatttatgta

SEQ ID NO: 66474 - DNA, 50 bp, homo sapien
gaactgtctgaagggacaaaagtgaratgttcagcagggtaaatagggga

SEQ ID NO: 66475 - DNA, 50 bp, homo sapien
ttggcatgtttgaggttaatgagaamattcattttaagtgacatactaga

SEQ ID NO: 66476 - DNA, 50 bp, homo sapien
tttttgcctgagatgcaaatgagttwaaaagtaacaaaatatatgaacaa

SEQ ID NO: 66477 - DNA, 50 bp, homo sapien
cttgtgaagaatacacattaaaatcmcttcattgtgtttagcagtctaaa

SEQ ID NO: 66478 - DNA, 50 bp, homo sapien
atccttcttgacaatacgcaaactargcacccataagatattattaactg

SEQ ID NO: 66479 - DNA, 50 bp, homo sapien
gattaaaggccttttgtaaccaatayacttagaaatttgtctagctagtt

SEQ ID NO: 66480 - DNA, 50 bp, homo sapien
ctgcttcatggctgtctcagtcctaytaaaatcaccatgtccctctttct

SEQ ID NO: 66481 - DNA, 50 bp, homo sapien
atttaaagctcctcataccaattcaytacctcaaaaactatttgagagtt

SEQ ID NO: 66482 - DNA, 50 bp, homo sapien
agagaaatgcagccacgaagggtcasgagaattagtatagttacctggag

SEQ ID NO: 66483 - DNA, 50 bp, homo sapien
gggaataaacttttatttcaagcaaygagttctctggtttgctaaatgaa

SEQ ID NO: 66484 - DNA, 50 bp, homo sapien
aaaccaacttaaatgtctagttatayctaataatttcttacttcatttag

SEQ ID NO: 66485 - DNA, 50 bp, homo sapien
agttcagagacctttccctgtatcartaaaaaagcctttgcaaataattt

SEQ ID NO: 66486 - DNA, 50 bp, homo sapien
cacatatcacctgtacactatcatcrccagaccattgtttatgccattct

SEQ ID NO: 66487 - DNA, 50 bp, homo sapien
aatcacctgtaatagacagtgtaaawcagcaaaagcaatacaataggata

SEQ ID NO: 66488 - DNA, 50 bp, homo sapien
ttagtagtgattctaatttgttccayagataaaactaggggaatttcaag

SEQ ID NO: 66489 - DNA, 50 bp, homo sapien
ggctcacctgaatatggtgacctagmagtctctgttaaaccagtgaatat

SEQ ID NO: 66490 - DNA, 50 bp, homo sapien
cggctcaaagattataagcgatcaargataaccaaattaaagcaatttga

SEQ ID NO: 66491 - DNA, 50 bp, homo sapien
aatgcagctgggtaattgtggatacyagttacagcagatgtagtggtcat

SEQ ID NO: 66492 - DNA, 50 bp, homo sapien
cacactttaatgcagaaactcatgtraataatctgtttcactccttttaa

SEQ ID NO: 66493 - DNA, 50 bp, homo sapien
ttgctgttagatttacaaataagtaygttgttattactgacatgcaaaat

SEQ ID NO: 66494 - DNA, 50 bp, homo sapien
tattgaatttgtaccatagtatccayataaaagcatctcgcagagaaata

SEQ ID NO: 66495 - DNA, 50 bp, homo sapien
atggtttaacctgtagggagtctcasagagtgttgaaaatcataactgca

SEQ ID NO: 66496 - DNA, 50 bp, homo sapien
cttctcataaaaaatctgtactctayggcaggggactcagatctttggta

SEQ ID NO: 66497 - DNA, 50 bp, homo sapien
aatgtataatggagcccgaattaagrctaatagacacattacaggagtcc

SEQ ID NO: 66498 - DNA, 50 bp, homo sapien
gaagagtccgagggaggaaagccackgctaaagaagagatacatgcacct

SEQ ID NO: 66499 - DNA, 50 bp, homo sapien
tccccctttctcgcctctatgtaatyaggctgtattttatatccttctgc

SEQ ID NO: 66500 - DNA, 50 bp, homo sapien
ccgatgaatttaacggtctggccaayttgagagagatttagaaatgcacc

SEQ ID NO: 66501 - DNA, 50 bp, homo sapien
aattgtatcctctgttgtacataatraaacaagcggtttggcgtgaggcg

SEQ ID NO: 66502 - DNA, 50 bp, homo sapien
aataagctctatatttttgaaatacsaagactaagatgtaaacttcgatc

SEQ ID NO: 66503 - DNA, 50 bp, homo sapien
gtctgtgacacatggcatcactcttraaatttgagacaggtttggtgcct

SEQ ID NO: 66504 - DNA, 50 bp, homo sapien
aagctgactatgccatgaaaaatgaygttgctcaattttaatcagaatgg

SEQ ID NO: 66505 - DNA, 50 bp, homo sapien
gatcagacatcataataaatataccrcagaacttaaatgctaggttaaga

SEQ ID NO: 66506 - DNA, 50 bp, homo sapien
atggattgaacattatatacacaagraattttacccactgtattgcattt

SEQ ID NO: 66507 - DNA, 50 bp, homo sapien
taaaatgtgaaagaaggtaataggastataggtgaatatttttaatttct

SEQ ID NO: 66508 - DNA, 50 bp, homo sapien
aggaaagtatgaagattggttcctayctggagtgtgagcccttaatttta

SEQ ID NO: 66509 - DNA, 50 bp, homo sapien
gtcttcaggaaatgtattaaaacacytcacgcctcaggttgcttattggt

SEQ ID NO: 66510 - DNA, 50 bp, homo sapien
cttgctctaagttaatgaagttaaamcactgtttctcaaccctgaccata

SEQ ID NO: 66511 - DNA, 50 bp, homo sapien
caaggggaaagtgatctaatacatgmcatgggtggaatactcagatccag

SEQ ID NO: 66512 - DNA, 50 bp, homo sapien
caacatgtatttgggttagtctgaamactgttgattaaatgtaccacatg

SEQ ID NO: 66513 - DNA, 50 bp, homo sapien
atcagtttcctcatatatgcaccackattttatgctatacaagtttttaa

SEQ ID NO: 66514 - DNA, 50 bp, homo sapien
gaaaaacctgtagctaaaattataaytactcaatggtgaaagactgaatg

SEQ ID NO: 66515 - DNA, 50 bp, homo sapien
ggaaaggagagcatggtaatctcaaktaggctaaattaggcttaatgtaa

SEQ ID NO: 66516 - DNA, 50 bp, homo sapien
agctgcaattttagctggtgctaaakatagttggaaaacctattttataa

SEQ ID NO: 66517 - DNA, 50 bp, homo sapien
gttagatgctttctgtaatggaaaastgattggctttaaaaataagaaaa

SEQ ID NO: 66518 - DNA, 50 bp, homo sapien
ccaaaacatataacaaacaattggawaccaactaaaacaccctatagtga

SEQ ID NO: 66519 - DNA, 50 bp, homo sapien
ctacttggatatttatatctttctcsaaatttgaaaagttttctgctacg

SEQ ID NO: 66520 - DNA, 50 bp, homo sapien
aattcttaagggcccacaattttcartatggtaattaagcagtggcttaa

SEQ ID NO: 66521 - DNA, 50 bp, homo sapien
cattttgcaatgttaaatcatgtacyacttctcaaccctttaaggtaagt

SEQ ID NO: 66522 - DNA, 50 bp, homo sapien
taagcaccacttcatagactatgaaraggcaattagaactcaagatttca

SEQ ID NO: 66523 - DNA, 50 bp, homo sapien
ttcacacataagaaagcataattgaygataggtaagagagggagaatatg

SEQ ID NO: 66524 - DNA, 50 bp, homo sapien
attaaaattttcaaatgcaattaaargagtttcttgaactacttaattca

SEQ ID NO: 66525 - DNA, 50 bp, homo sapien
ttcaccaaaaatctccaaagctattrggactatgcactagaggaagcaaa

SEQ ID NO: 66526 - DNA, 50 bp, homo sapien
gtgagtttaagagaaatagtatgttwaaaatggccagcatgtagaatata

SEQ ID NO: 66527 - DNA, 50 bp, homo sapien
tcacctgttaatgtataaatgctgayagtgacagataacaggtgaataat

SEQ ID NO: 66528 - DNA, 50 bp, homo sapien
tgctgtgataaatgctgatgatacayagtgaacgaaaatactgggataga

SEQ ID NO: 66529 - DNA, 50 bp, homo sapien
agatttattcagtgttctagatgaastacaacagacacaggtctctcaga

SEQ ID NO: 66530 - DNA, 50 bp, homo sapien
gagaatgaaatgagtatttgactgcytaacttttcagggcactatctgag

SEQ ID NO: 66531 - DNA, 50 bp, homo sapien
gacaccatattatagaaaattatagmaaattatgtactgaataattactg

SEQ ID NO: 66532 - DNA, 50 bp, homo sapien
gcttggtttgtgaattatctaatggygaataaagagaatgaaatgagtat

SEQ ID NO: 66533 - DNA, 50 bp, homo sapien
gaaaaaataaatacatcttcctaacwatcttaactgatgcctcacaactc

SEQ ID NO: 66534 - DNA, 50 bp, homo sapien
actagatattgaataaatgcaattcyagctgaaatgggcaaatgaaattt

SEQ ID NO: 66535 - DNA, 50 bp, homo sapien
aaggtgggtgaaatttgcagggtaaratactagatatgagagaactgtgt

SEQ ID NO: 66536 - DNA, 50 bp, homo sapien
tcctttgacttcttcctcagtatcascaaaatctgttttttgaggccatg

SEQ ID NO: 66537 - DNA, 50 bp, homo sapien
gctttttggtgataataggaaaatargttgttttaatatatgtagatggg

SEQ ID NO: 66538 - DNA, 50 bp, homo sapien
gcaaattacaacacttaatatgaaayctgtagagttgctaaatattgagc

SEQ ID NO: 66539 - DNA, 50 bp, homo sapien
aggcctattggacacacactatgtawgtagcattctagcctgaccactct

SEQ ID NO: 66540 - DNA, 50 bp, homo sapien
gctattaaaggaatacattaaaaacycttgaaaccatctttgcttcactt

SEQ ID NO: 66541 - DNA, 50 bp, homo sapien
aaccaataatttacttgtttatgtcwctctccttaagattgtcaattcaa

SEQ ID NO: 66542 - DNA, 50 bp, homo sapien
agcttatatcagcattaagtgtagcygataagagatgtggaagcataatt

SEQ ID NO: 66543 - DNA, 50 bp, homo sapien
gatcatggtacactttagccttgatkaactccttggctcaagcaatcctg

SEQ ID NO: 66544 - DNA, 50 bp, homo sapien
tacaaatggccgcaatcccatcagayattggtgtagtcatactccaaaca

SEQ ID NO: 66545 - DNA, 50 bp, homo sapien
cctggccttcagaactgtacaattayaaatttgtgaagaatgtcattggt

SEQ ID NO: 66546 - DNA, 50 bp, homo sapien
ttctaagattttatctttgcctttckcttttcagcatttgaatactacat

SEQ ID NO: 66547 - DNA, 50 bp, homo sapien
tatagaatctctttgtaccttagttkttacatcttcaaagtgggaataat

SEQ ID NO: 66548 - DNA, 50 bp, homo sapien
aagatgactgaggtttaatatatgastgctgactttgcctagagaagaac

SEQ ID NO: 66549 - DNA, 50 bp, homo sapien
gaaaatagaggggatgggacagatawtaatagggtagtactgatgtgact

SEQ ID NO: 66550 - DNA, 50 bp, homo sapien
gcaagcagtactaagctaagcagtaytaagccaagaccacagctgaggga

SEQ ID NO: 66551 - DNA, 50 bp, homo sapien
gtctaggcttccaggcctgtgatgakaagggctgccatgaagatctctga

SEQ ID NO: 66552 - DNA, 50 bp, homo sapien
ggatctgcagctcctctactaaacaraaattgtatcatcaatgttagcaa

SEQ ID NO: 66553 - DNA, 50 bp, homo sapien
tacacgataatagccatgaaccttargagtcagcctggtatgtattagct

SEQ ID NO: 66554 - DNA, 50 bp, homo sapien
cacaactttactttttgttacttcaygctttaattcgtagtcaaacttgc

SEQ ID NO: 66555 - DNA, 50 bp, homo sapien
tataaatgaagtaggaagtaaagtasagttctcaactgctcataatctag

SEQ ID NO: 66556 - DNA, 50 bp, homo sapien
tagattttttaaagtatcaacacggrtaagcaaagaaatgctgttctcta

SEQ ID NO: 66557 - DNA, 50 bp, homo sapien
gctgctatgtaatgggtgttgtacamatggtagttcttatttgtgcagcc

SEQ ID NO: 66558 - DNA, 50 bp, homo sapien
ttaatcatcctctgcttaggatggtyttgcttgccaagttttccctgtat

SEQ ID NO: 66559 - DNA, 50 bp, homo sapien
tgatctatccaagtgggtatttctarcaaattgaaagtatttaattgaaa

SEQ ID NO: 66560 - DNA, 50 bp, homo sapien
tatgcctactatgtgccattcaccaytctacaggcttcatacaggtaaaa

SEQ ID NO: 66561 - DNA, 50 bp, homo sapien
ttttttcataataaaatggttccacygaaggatagtgatttgttttgagg

SEQ ID NO: 66562 - DNA, 50 bp, homo sapien
tcctcactgacccaaatgccatttcyaggtggatcagaggaagggagaga

SEQ ID NO: 66563 - DNA, 50 bp, homo sapien
tgaaatgacctttttagtattacacrgaagatctgggactcaaaattaac

SEQ ID NO: 66564 - DNA, 50 bp, homo sapien
acagttgcagaaaatcctcaaaagarctaccatagacacaaagttaactg

SEQ ID NO: 66565 - DNA, 50 bp, homo sapien
attagaccctttagagagtgtaagargttgagatagtatgcacagaacaa

SEQ ID NO: 66566 - DNA, 50 bp, homo sapien
ttccctatttaactgtaagataattwaaaaaaaacaaatctagatagagt

SEQ ID NO: 66567 - DNA, 50 bp, homo sapien
tagttaacatattgaattgctataarataaaataaaatgacataatatga

SEQ ID NO: 66568 - DNA, 50 bp, homo sapien
cgtttcttggttaatcctggccatamctttgtacataatctttgtacagt

SEQ ID NO: 66569 - DNA, 50 bp, homo sapien
gaatggttatcagatacagtaggaayaaaattgtgtaaaaactaagaagg

SEQ ID NO: 66570 - DNA, 50 bp, homo sapien
ccaggtacccaatcagttcctgccartactaatctttccagtccactaac

SEQ ID NO: 66571 - DNA, 50 bp, homo sapien
tatttaagtaaaaatatgtgtttaasgcttttgtttcatgttaatccctt

SEQ ID NO: 66572 - DNA, 50 bp, homo sapien
tgactggttaacaatgaataaatgcragtattgtctctactgttcaagca

SEQ ID NO: 66573 - DNA, 50 bp, homo sapien
ctgcctcatgaaagaatggattggaygccctgctttcctatttccatagt

SEQ ID NO: 66574 - DNA, 50 bp, homo sapien
atgaggagtactgtcagagtaccaaygaatttttccttgtggcccaaggg

SEQ ID NO: 66575 - DNA, 50 bp, homo sapien
ctgtatttataggatttttaaaacawatggtggtgttatatcttgtatct

SEQ ID NO: 66576 - DNA, 50 bp, homo sapien
ctctttttaacagaaaattatctatragtcaccaacaattgccattgctc

SEQ ID NO: 66577 - DNA, 50 bp, homo sapien
tatacataatctctgctaaagtgtayataaagttgtagtatttcctatga

SEQ ID NO: 66578 - DNA, 50 bp, homo sapien
gctacatgatgttccaaggaataacyaactaatttcctgcatatgatggc

SEQ ID NO: 66579 - DNA, 50 bp, homo sapien
catttctgctttcttatcacataaamcattatgccatgatctatcccact

SEQ ID NO: 66580 - DNA, 50 bp, homo sapien
gtccctgcctctgtagctggtcacaraaattaggctgataatcatggatc

SEQ ID NO: 66581 - DNA, 50 bp, homo sapien
aagaaaagaacttcttgaaggcatawcaatggaaactatccaaatttagc

SEQ ID NO: 66582 - DNA, 50 bp, homo sapien
aagtcagcctataaaatgaaagacartatttgcaaaacatatatcatatg

SEQ ID NO: 66583 - DNA, 50 bp, homo sapien
atattcacttattattacaagaaaayacgggtacaatctaaggagacctc

SEQ ID NO: 66584 - DNA, 50 bp, homo sapien
tctattgtatttgaaaaaggaatgartcagcaatatgttatacctttata

SEQ ID NO: 66585 - DNA, 50 bp, homo sapien
tacacagtctgcagcttttttcatartatctccaaattggaagcaaccca

SEQ ID NO: 66586 - DNA, 50 bp, homo sapien
gtcaataaaaatggagaaagagttaygcctatacaattgccacaaaagtt

SEQ ID NO: 66587 - DNA, 50 bp, homo sapien
agtttcctttgtatataccaatagasgcatttaaaaattgccttctggac

SEQ ID NO: 66588 - DNA, 50 bp, homo sapien
gccactaaaaacttgacaaaggtagyggtcagctgtggtatcgaaatgtg

SEQ ID NO: 66589 - DNA, 50 bp, homo sapien
gaagttttcaacacatggtcaaatamtaagaaaacaatcagattgtttag

SEQ ID NO: 66590 - DNA, 50 bp, homo sapien
agggtacaattataaaggaagatcaygtatttggtgttaacatgtggtct

SEQ ID NO: 66591 - DNA, 50 bp, homo sapien
ctatgctgctggttttcagatgatakaagggaccatataagcaaaggatg

SEQ ID NO: 66592 - DNA, 50 bp, homo sapien
taaaataatcatcatcataatatttyctgacatgtgaacattatatgaaa

SEQ ID NO: 66593 - DNA, 50 bp, homo sapien
actttattattgataaacattaaaaytgaatttcatataatgttcacatg

SEQ ID NO: 66594 - DNA, 50 bp, homo sapien
gtgctgttaagtgaactactggaatraggacacagggaataacagaacta

SEQ ID NO: 66595 - DNA, 32 bp, homo sapien
cctgactggcccagtayagccgatggaagtca

SEQ ID NO: 66596 - DNA, 50 bp, homo sapien
tgagagactgagaagtcactatgacmaaattaacctactttcttgggaga

SEQ ID NO: 66597 - DNA, 50 bp, homo sapien
gaatgtggagaaatacaaattaatargtgttaaatatgtgcaggaaattg

SEQ ID NO: 66598 - DNA, 50 bp, homo sapien
agcaacataggtaggattcagagtcmattaatgtttgaatattacagata

SEQ ID NO: 66599 - DNA, 50 bp, homo sapien
atattgctgaaggctctgttactaaycattattatacatcattatacatt

SEQ ID NO: 66600 - DNA, 50 bp, homo sapien
ttggactataaattccttagaacacraatattgtagccatcttcagattg

SEQ ID NO: 66601 - DNA, 50 bp, homo sapien
tttcattaattttaaaaatctgacartcttttattgagtgctttgaccta

SEQ ID NO: 66602 - DNA, 50 bp, homo sapien
tgaatccttttcttttgatgccaaaygtcatatctcctccactaaaattg

SEQ ID NO: 66603 - DNA, 50 bp, homo sapien
tgtcaagctgggaatttagtgttaamggtgtaggaattagatggtcaagc

SEQ ID NO: 66604 - DNA, 50 bp, homo sapien
ctgagtcataaaaacgtgcattttaraaagaagaaacagtctttccaaag

SEQ ID NO: 66605 - DNA, 50 bp, homo sapien
tggaagaaaggagcatccttatctcygaacatgccaagaataatatgaac

SEQ ID NO: 66606 - DNA, 50 bp, homo sapien
gttcgaagtttgacacattcatagaraacaagagaaagttcccaggagga

SEQ ID NO: 66607 - DNA, 50 bp, homo sapien
ttatttgaatgtatttcagagaggcraaagaatacaaattgcttcaaaat

SEQ ID NO: 66608 - DNA, 50 bp, homo sapien
gggaataatttgtagccagtttagcyagtggaataatatttgagttagtt

SEQ ID NO: 66609 - DNA, 50 bp, homo sapien
ttgcatggggtaagaatacatgtgayggtaatagaagttgctggggcaga

SEQ ID NO: 66610 - DNA, 50 bp, homo sapien
tccctcttttgacacgtgggtattayggttcacaatgagattttgatggg

SEQ ID NO: 66611 - DNA, 50 bp, homo sapien
attatctggaaatgagtcatgttcartctattttatcatatcttgatttc

SEQ ID NO: 66612 - DNA, 50 bp, homo sapien
gttctgaaagacatggataggatacyggaaaaattcttaaaagaataaaa

SEQ ID NO: 66613 - DNA, 50 bp, homo sapien
cttacttacaaacatctgaattgtasctgaaactctgaaattattataga

SEQ ID NO: 66614 - DNA, 50 bp, homo sapien
atctggctgcattctgccttaccaargacctctggatattttgagttgtt

SEQ ID NO: 66615 - DNA, 50 bp, homo sapien
ataagtctaccatgttaaatggcttraactttatcctatggagggcagag

SEQ ID NO: 66616 - DNA, 50 bp, homo sapien
tagactgatggttataaaaatgtaarcctgtatgtgactgatttcagtga

SEQ ID NO: 66617 - DNA, 50 bp, homo sapien
aatcaactttgcttagattatcagcmaaaaattagagtttttattcaatg

SEQ ID NO: 66618 - DNA, 50 bp, homo sapien
caattggacctaataaacatctacakaatattctatccaacattgataga

SEQ ID NO: 66619 - DNA, 50 bp, homo sapien
gtccattttataaatgtgacactcargttttagcaaacaataagctatgc

SEQ ID NO: 66620 - DNA, 50 bp, homo sapien
ttaaagaagtgtcagacactgttcaracactgagacttaaggacaagtga

SEQ ID NO: 66621 - DNA, 50 bp, homo sapien
ttactttgctacaaatttcattacaytggcgctgaagttgctatacagtt

SEQ ID NO: 66622 - DNA, 50 bp, homo sapien
tctgaggcttgcattactgtaaaaaracagacaatgaaactagcaagaaa

SEQ ID NO: 66623 - DNA, 50 bp, homo sapien
ttcttaccttttctgttatctaagaycctattctttgagttggctatgaa

SEQ ID NO: 66624 - DNA, 50 bp, homo sapien
ggagtaagagacagaaagcctgtcaraggagaccagttaggaattgtaac

SEQ ID NO: 66625 - DNA, 50 bp, homo sapien
tctgataattacatgtcaggtgaaastggaatcttctgtactattcagtc

SEQ ID NO: 66626 - DNA, 50 bp, homo sapien
atgacactttttactctcagaaacakaaaagaaggtgaaaagtctttcga

SEQ ID NO: 66627 - DNA, 50 bp, homo sapien
gagctgaccacctaggccaaatgaasttactgattctgctttttctttag

SEQ ID NO: 66628 - DNA, 50 bp, homo sapien
aatcaagtgtgtatataccctaagamaactatttgctgtgccaataatca

SEQ ID NO: 66629 - DNA, 50 bp, homo sapien
gctgttgtactgggaatagcgtaagwcatctgttataccaaggaccttaa

SEQ ID NO: 66630 - DNA, 50 bp, homo sapien
caacaccttacatttaagagtaagaygaagctttccacagtatcaagcat

SEQ ID NO: 66631 - DNA, 50 bp, homo sapien
acagacatgctgtcagaacttatcarggaaagagcaagaagcaagcttga

SEQ ID NO: 66632 - DNA, 50 bp, homo sapien
aatacaatttatagttcactcactcygaaacatgctggagggtatttgaa

SEQ ID NO: 66633 - DNA, 50 bp, homo sapien
actgtgccttctaatttaaggcatartacctaagactgcatccactaggt

SEQ ID NO: 66634 - DNA, 50 bp, homo sapien
gagatttttgatgctgtttgttacastgatcagctaccctacctaataca

SEQ ID NO: 66635 - DNA, 50 bp, homo sapien
aatggtatttgtgtagctaaacatakatctaaacatagaacagatacagt

SEQ ID NO: 66636 - DNA, 50 bp, homo sapien
aaaacagattcttttcagatttcaaratatccttcttaaatgttttggag

SEQ ID NO: 66637 - DNA, 50 bp, homo sapien
agaatttaaggagatgaaatctccaycttcgagatactcacagtccaatg

SEQ ID NO: 66638 - DNA, 50 bp, homo sapien
catttttcttttggaatttctaccarggattctggcctattcaagggaac

SEQ ID NO: 66639 - DNA, 50 bp, homo sapien
agaaggtgtaagccataaaccttgasaacttccacatgatggtaaacctg

SEQ ID NO: 66640 - DNA, 50 bp, homo sapien
gttactatatgccagactgtccggawgcagaatttaaggagatgaaatct

SEQ ID NO: 66641 - DNA, 50 bp, homo sapien
taacatgttacatattgtccttctcragtctatgaaaccatatccttcac

SEQ ID NO: 66642 - DNA, 50 bp, homo sapien
tgggatcagactagattattgagtayattgtaactatgctaggaagttga

SEQ ID NO: 66643 - DNA, 50 bp, homo sapien
tttgttgacactcctctcctatagamatgatctcttcccttggcttgtga

SEQ ID NO: 66644 - DNA, 50 bp, homo sapien
ttattcatgaggcctgagcttcaacyggccaatcatgtttctgccccatg

SEQ ID NO: 66645 - DNA, 50 bp, homo sapien
ttctttaatatgtcttgcagatatgrttatagagaaaagagcaaaaactt

SEQ ID NO: 66646 - DNA, 50 bp, homo sapien
gctcaacgtgtgcttgctcttctctsaactcatatcacatttatcaatat

SEQ ID NO: 66647 - DNA, 50 bp, homo sapien
gaaaactagtagaaatatcacttcayggatggcttttgctgggtgttgaa

SEQ ID NO: 66648 - DNA, 50 bp, homo sapien
tttccaaaccccaaacgaggacacakggtctgacactaggctataaactg

SEQ ID NO: 66649 - DNA, 50 bp, homo sapien
tattaactatggtttggtcaggaagycattctagttatttagaagggaag

SEQ ID NO: 66650 - DNA, 50 bp, homo sapien
gtacccttatatggagatacatggamaaagaagatcctactccttacttt

SEQ ID NO: 66651 - DNA, 50 bp, homo sapien
tctcctagtctggtgcattcaggctracattctgcaagtctgagccaaca

SEQ ID NO: 66652 - DNA, 50 bp, homo sapien
tagcaataatggcaactgcaacaatytgacttgacaacctagaagtataa

SEQ ID NO: 66653 - DNA, 50 bp, homo sapien
aggaaatagtgtttgttaaaatgcaygtgtacagttttctaaagaaaagt

SEQ ID NO: 66654 - DNA, 50 bp, homo sapien
gctgagaaaaaagtaaatgctcatayataagattagcaaggtatggtggg

SEQ ID NO: 66655 - DNA, 50 bp, homo sapien
tagaggtgatacttagtcccagttaycaacaattggtgttgcctttttca

SEQ ID NO: 66656 - DNA, 50 bp, homo sapien
aagacatcagccctgctaactcttcygaaatttaacagtatttctaaaat

SEQ ID NO: 66657 - DNA, 50 bp, homo sapien
ttattctgactaccacacaagggaaktagcaagagaccagtgtgtaattt

SEQ ID NO: 66658 - DNA, 50 bp, homo sapien
acaggagttctcgatccttcctgctraaagcctctgagaaccctgcctct

SEQ ID NO: 66659 - DNA, 50 bp, homo sapien
gttatgtattttccccaggtttaacratattggtctggaaaataaagaga

SEQ ID NO: 66660 - DNA, 50 bp, homo sapien
cttgtagaatttccttgatgtattayaaagtcccatttattcattctaca

SEQ ID NO: 66661 - DNA, 50 bp, homo sapien
ccttgagggcaggcactatgtccaaytaatctttcatctatcagtcccaa

SEQ ID NO: 66662 - DNA, 50 bp, homo sapien
gtaactactacctcataacatagtgmaatatgagtaatttataaattttt

SEQ ID NO: 66663 - DNA, 50 bp, homo sapien
ccaatgtcctcaagctagtctaacartaaagaaaagtacagaatgctaaa

SEQ ID NO: 66664 - DNA, 50 bp, homo sapien
ttaggaatctagacaatagggcagcwaacaagagcctacaggtcaaatca

SEQ ID NO: 66665 - DNA, 50 bp, homo sapien
aggtatcttactagataagcgcacaraagagttctttactagacatgatg

SEQ ID NO: 66666 - DNA, 50 bp, homo sapien
aaaagctattttatcctggagctgamaagtacattgagcattaaaagtgg

SEQ ID NO: 66667 - DNA, 50 bp, homo sapien
gatgtgtggatgtcccatggtattayataggcaggactgtagcaattgtg

SEQ ID NO: 66668 - DNA, 50 bp, homo sapien
aattaacctattgtttctattaaaayggctccttgaaggccaatagtgtg

SEQ ID NO: 66669 - DNA, 50 bp, homo sapien
agtgctgtgagacagttcagctccawcatttcatgaacagtgtccatcaa

SEQ ID NO: 66670 - DNA, 50 bp, homo sapien
cagaaaacagagaagagtccttacaytgatcttcctactcatctatgagg

SEQ ID NO: 66671 - DNA, 50 bp, homo sapien
aagtaacaaatgattatagcaattayagtgggtgagtgcaatgagagggg

SEQ ID NO: 66672 - DNA, 50 bp, homo sapien
tgccttttaagtgtagacatctgagraactctatagcttagaagtctaca

SEQ ID NO: 66673 - DNA, 50 bp, homo sapien
agctgatgcccttctgatcaactacsacattcatgccaatgactgaacaa

SEQ ID NO: 66674 - DNA, 50 bp, homo sapien
tgcctatttctcatgtaggtacaaaytagatattgtctactctttccctc

SEQ ID NO: 66675 - DNA, 50 bp, homo sapien
tcagtcattgtaacccttaatcattraatcatatctaaagacctgtatat

SEQ ID NO: 66676 - DNA, 50 bp, homo sapien
tacttctcttaaaacattgtaagacragttgctacattacaaaagtcata

SEQ ID NO: 66677 - DNA, 50 bp, homo sapien
caaggttaataattcagaagactaarataaatcagaaagtatttcttaat

SEQ ID NO: 66678 - DNA, 50 bp, homo sapien
gctgaaatgggtggatgatgggaaayctggtcagccacgaatgttacagt

SEQ ID NO: 66679 - DNA, 50 bp, homo sapien
attaaattgacttctcctttcaggayatgaatcaataaagctgacttagc

SEQ ID NO: 66680 - DNA, 50 bp, homo sapien
ataaagtcatcccccagaattcgtaygggcttagttccaggatttccaca

SEQ ID NO: 66681 - DNA, 50 bp, homo sapien
atagttttagtcaacattagtgatayaaagttggattcagttcattgata

SEQ ID NO: 66682 - DNA, 50 bp, homo sapien
gtttcaggctgctgcgatgctccaartagatacaaacagcagtaaagcat

SEQ ID NO: 66683 - DNA, 50 bp, homo sapien
gatactgtatatatgtactttacagycatagaattttagttgcagcatgc

SEQ ID NO: 66684 - DNA, 50 bp, homo sapien
tttgtgatctgaaagtaggcagacayattaggtggaaaatatttttagga

SEQ ID NO: 66685 - DNA, 50 bp, homo sapien
taaattactctaaataaaaattactsaattgtatggtgattatttgtgta

SEQ ID NO: 66686 - DNA, 50 bp, homo sapien
cgaacagaagtttcctagaggaaagyctcctttggaatatgtccaggaaa

SEQ ID NO: 66687 - DNA, 50 bp, homo sapien
aaacagctaatattgtaagcataaaraagcagtagatatctgtcaacttt

SEQ ID NO: 66688 - DNA, 50 bp, homo sapien
aacaacatgctcaaagtcaaataacragcagttttcaagctggtcagtct

SEQ ID NO: 66689 - DNA, 50 bp, homo sapien
taaattttctcttctctatagcttamaaaataatctccataattaagttt

SEQ ID NO: 66690 - DNA, 50 bp, homo sapien
actcttatcattttttccaacttcartcagcatctcttcagagcttgcag

SEQ ID NO: 66691 - DNA, 50 bp, homo sapien
atacaaagaataagtgtactgaaaasacagggaaccattacaggatatac

SEQ ID NO: 66692 - DNA, 50 bp, homo sapien
gttttgttatgagaaggattcagackaaagcaatgtgcaagggagaagga

SEQ ID NO: 66693 - DNA, 50 bp, homo sapien
ttaatcattgaccataaaataatacraaatgttttaacacttaaaaccaa

SEQ ID NO: 66694 - DNA, 50 bp, homo sapien
gttttaaagttctacctatcagattrtcagtaaaacaagtgaaataataa

SEQ ID NO: 66695 - DNA, 50 bp, homo sapien
ttacagatgaggaaactgggttgaamtatctcatcatacattagaaaaca

SEQ ID NO: 66696 - DNA, 50 bp, homo sapien
ttcttttctagcttgagtacttttayagtaattgttttatgtatacttga

SEQ ID NO: 66697 - DNA, 50 bp, homo sapien
gaaaattttgtcacttacagacaatygttatcttgctatgttccttctca

SEQ ID NO: 66698 - DNA, 50 bp, homo sapien
aggtgagtctctcatcctacaggccragtttagatatttcctagagattt

SEQ ID NO: 66699 - DNA, 50 bp, homo sapien
ttcttttaaatcatctcagagacaartcttccaaatgggcaattcagaaa

SEQ ID NO: 66700 - DNA, 50 bp, homo sapien
tatgtgttttagtctttgatgagackggtcaatcttaaaaacagtcaggt

SEQ ID NO: 66701 - DNA, 50 bp, homo sapien
caaacaaacaaagaatcaaagaaacmaacaagttgttattctgcgcatct

SEQ ID NO: 66702 - DNA, 50 bp, homo sapien
ggaaaaggtggaggactctaaagaamgagaaatagcatgaacatcacttc

SEQ ID NO: 66703 - DNA, 50 bp, homo sapien
gctgtatttccatcaccatttccggrcaagcttgtgcttctggcatcatc

SEQ ID NO: 66704 - DNA, 50 bp, homo sapien
tccttctgccattagaccttttgccracaagtgtttaatcactcacttct

SEQ ID NO: 66705 - DNA, 50 bp, homo sapien
aaaaagcactgaatgatttttaaagkcgtgtgttttcagtatgttagcta

SEQ ID NO: 66706 - DNA, 50 bp, homo sapien
tattcttctcatacatgtgccatatmaaacattagattagtttaatttaa

SEQ ID NO: 66707 - DNA, 50 bp, homo sapien
acatttaaaagtgaggtgatttaaawatgacaagtaccataagcaattgc

SEQ ID NO: 66708 - DNA, 50 bp, homo sapien
agagtcagaactgctttattaacaaytggataggcattcaataccctagt

SEQ ID NO: 66709 - DNA, 50 bp, homo sapien
taatcattgcagaaatgctttaaaayctgtaattagagttgcataaagat

SEQ ID NO: 66710 - DNA, 50 bp, homo sapien
actagattaagatgagcacctatcaytctattggcctttttaaggtaaga

SEQ ID NO: 66711 - DNA, 50 bp, homo sapien
gaaaataattgttccagttgagttcyaagagttgaaagagtttctccatc

SEQ ID NO: 66712 - DNA, 50 bp, homo sapien
gccaaaaataaaatctcataatcaamaaagaggatagagcaatatctgag

SEQ ID NO: 66713 - DNA, 50 bp, homo sapien
catgaagtaaaataaaaagtagtaartgaaagtaccttcagacatctcca

SEQ ID NO: 66714 - DNA, 50 bp, homo sapien
gacatctccataatattaacattaargtcaattgttttaataatcaaaca

SEQ ID NO: 66715 - DNA, 50 bp, homo sapien
gtgcaccttaatcttcaatatgccakgtgaaatcattagaaccaaagtgt

SEQ ID NO: 66716 - DNA, 50 bp, homo sapien
tagttcttttttatttatgcactgcwataatggtaacaaatttcaagcag

SEQ ID NO: 66717 - DNA, 50 bp, homo sapien
tttgccttgctggaatactcctcgayacactagacttcaaattaccttca

SEQ ID NO: 66718 - DNA, 50 bp, homo sapien
atccatctttctctacatagtcctawagggaaacacatgcacagaaaaat

SEQ ID NO: 66719 - DNA, 50 bp, homo sapien
agcggcttccagtctgtggtgcaaasaaagaaatactattctctagtgca

SEQ ID NO: 66720 - DNA, 50 bp, homo sapien
cagtaggacaggatagagccataaakttcttttgcataataggaaaggcc

SEQ ID NO: 66721 - DNA, 50 bp, homo sapien
gctggtctagaattcctggccttaastgaccctcctatctgggacttcca

SEQ ID NO: 66722 - DNA, 50 bp, homo sapien
cctaatagacagtcctggtgacaatytgagtaggttacatgactttactc

SEQ ID NO: 66723 - DNA, 50 bp, homo sapien
aaaaaatacagaaattatagtataargtggaatgtgaaaaagatcacatg

SEQ ID NO: 66724 - DNA, 50 bp, homo sapien
atgatcaaatgatatttgaccagggwaataagactattgagtgcacaaag

SEQ ID NO: 66725 - DNA, 50 bp, homo sapien
ggtttaatgttagaacatgtccctargagtaagtagattacggtttaaaa

SEQ ID NO: 66726 - DNA, 50 bp, homo sapien
ttgatttaaataccaccagttagcayagtaatgtagagtccagcctttaa

SEQ ID NO: 66727 - DNA, 50 bp, homo sapien
tgttcaatactgtcaaaacttttgcyctgcttaataaagattttccacta

SEQ ID NO: 66728 - DNA, 50 bp, homo sapien
ggtcatttgtaatattttgtgataaygtatgtggaagactttaaaactag

SEQ ID NO: 66729 - DNA, 50 bp, homo sapien
ctgtaaccagtattttcactcaatartatgtcaaggacatctgtcaatta

SEQ ID NO: 66730 - DNA, 50 bp, homo sapien
gattttgatggactccgataatacamctgagtttcttgatctttaaatat

SEQ ID NO: 66731 - DNA, 50 bp, homo sapien
ttgaaaattattttgttacggtaatragagttcaagttggagacttcctg

SEQ ID NO: 66732 - DNA, 50 bp, homo sapien
aagctcagttgccctgatagtagcaygtttctgtttctgatgtacctttt

SEQ ID NO: 66733 - DNA, 50 bp, homo sapien
tgttaggtcatgtgagaggtaataarcactagacaagtcgttgaaaaatt

SEQ ID NO: 66734 - DNA, 50 bp, homo sapien
tcacctgattcctggtgttgcctcamaatttactactggtgctcacagaa

SEQ ID NO: 66735 - DNA, 50 bp, homo sapien
tgctctcagcaatttgcaagatggartactatatttttaaaaatcaggta

SEQ ID NO: 66736 - DNA, 50 bp, homo sapien
taatgtgtcatccacccttagcctayacttcacatgagttttcgtccttt

SEQ ID NO: 66737 - DNA, 50 bp, homo sapien
ttttttttgcatttgtatatgaaaawtcaatagtaaatgctgatttcctt

SEQ ID NO: 66738 - DNA, 50 bp, homo sapien
ttatgttgttattaaaatacttaaarctatgaattggcttatatttgagt

SEQ ID NO: 66739 - DNA, 50 bp, homo sapien
ttgaacagcgttattttcaacaatayaaccatccttatttgttgtatcat

SEQ ID NO: 66740 - DNA, 50 bp, homo sapien
taacagtttataaagtgggtttgcaygttattaccttaggtagtagatta

SEQ ID NO: 66741 - DNA, 50 bp, homo sapien
tataaccatccttatttgttgtatcrtttctatttttgagattgctgcat

SEQ ID NO: 66742 - DNA, 50 bp, homo sapien
gatttcagttaggaatcttcctattkaagcctcttgataaactgaataaa

SEQ ID NO: 66743 - DNA, 50 bp, homo sapien
tatttggctcttaaagtactattcckgtattctagctactctctcccaag

SEQ ID NO: 66744 - DNA, 50 bp, homo sapien
tattgctttccttgtacatcagtcartcttgctcttgaaaaccatcccct

SEQ ID NO: 66745 - DNA, 50 bp, homo sapien
ccattagctgacatgctactcacaaycaggatgtcaggagggaggttggg

SEQ ID NO: 66746 - DNA, 50 bp, homo sapien
cttcctcatgcccaaaatggctgttygtaggaatggaaggagaggggtgt

SEQ ID NO: 66747 - DNA, 50 bp, homo sapien
gtattttgggagggatttggggactsaattaatggaacatatcaaggtta

SEQ ID NO: 66748 - DNA, 50 bp, homo sapien
gagaaataatgtattctactttgagycatacagctgtgaagaggaaaggc

SEQ ID NO: 66749 - DNA, 50 bp, homo sapien
gcctgcttcttatctgagaaaattakggaaaggatttagtttcagaatag

SEQ ID NO: 66750 - DNA, 50 bp, homo sapien
gatttggtaatctctccattcttgasgttcataaaatagcagatcttaaa

SEQ ID NO: 66751 - DNA, 50 bp, homo sapien
gtttaacctaagattaagattaatcrcagcattatttacaacagccaaga

SEQ ID NO: 66752 - DNA, 50 bp, homo sapien
ctgcactccattctgtacttgagtascttaagtgatcttatttaaagtat

SEQ ID NO: 66753 - DNA, 50 bp, homo sapien
acaccatgaagtttattctctagcawaattgatgattgtacttctaacag

SEQ ID NO: 66754 - DNA, 50 bp, homo sapien
atgtctagattgcctgtgaggacaayaatttgtttttttaggtgaggaaa

SEQ ID NO: 66755 - DNA, 50 bp, homo sapien
acggtcctctgttgccctctggcctrtagaacagcatgcatttgggtttg

SEQ ID NO: 66756 - DNA, 50 bp, homo sapien
agcaacctggatttgcagccaagacrcccatgagagtaccttcctctccc

SEQ ID NO: 66757 - DNA, 50 bp, homo sapien
tgggtcctcaccaatatctgagagayggaaaataacagaaatctcaaaac

SEQ ID NO: 66758 - DNA, 50 bp, homo sapien
aaatgacaattacctagaaaattcayaaatccatcccacgccattctgtt

SEQ ID NO: 66759 - DNA, 50 bp, homo sapien
agctaattttttttctctttgtttcytttttagacataccagggtctaga

SEQ ID NO: 66760 - DNA, 50 bp, homo sapien
aaagaggagcagttctgatcaaaaaygtgcttacagaaagagaatgaaaa

SEQ ID NO: 66761 - DNA, 50 bp, homo sapien
agaaagtctaactatctttgtttgcmgaaacatgatcctgtatctagaaa

SEQ ID NO: 66762 - DNA, 50 bp, homo sapien
ctctttgcagaccctgtttaattggrattgttaatgcaagactgtgagga

SEQ ID NO: 66763 - DNA, 50 bp, homo sapien
taattctgtcagaaatgtacgtggcyattagttaaccttacaagcactct

SEQ ID NO: 66764 - DNA, 50 bp, homo sapien
attataggtcacttaccttagaagargttcaagagggactgttacatgcg

SEQ ID NO: 66765 - DNA, 50 bp, homo sapien
tcttcctcattttccaagtcctatamccaatgttcatttccttgattcta

SEQ ID NO: 66766 - DNA, 50 bp, homo sapien
ggatttagtaacacatgtcaatgacracttttgcaagagcagttttacta

SEQ ID NO: 66767 - DNA, 50 bp, homo sapien
ctagaatcttactttggctttttttkgtccaactctagttattctctgaa

SEQ ID NO: 66768 - DNA, 50 bp, homo sapien
ttcccttcaaattcagaaattttacsaaggcatttataggcttgaagctt

SEQ ID NO: 66769 - DNA, 50 bp, homo sapien
caccttctctagcctccgtgtcctayagatccaactaatacattacccta

SEQ ID NO: 66770 - DNA, 50 bp, homo sapien
gttgaatccacgggtatgaaacttaygaatatgaacaacgaacaactgtg

SEQ ID NO: 66771 - DNA, 50 bp, homo sapien
cttatgaatatgaacaacgaacaacygtgatgcaaatgagaaaatgagac

SEQ ID NO: 66772 - DNA, 50 bp, homo sapien
gtggagaaacaggctcagaatgtaamcaacttgcttctctgaatctatag

SEQ ID NO: 66773 - DNA, 50 bp, homo sapien
ctcaaaatttggggagggctaataawgtaataatctatgtcttacatcct

SEQ ID NO: 66774 - DNA, 50 bp, homo sapien
acagtagaatcttgctctaatgataygccaagaaactttcaagatgtatt

SEQ ID NO: 66775 - DNA, 50 bp, homo sapien
ctactaaaactatttcaaaaaatcargaagcgtctcctccctaactcatt

SEQ ID NO: 66776 - DNA, 50 bp, homo sapien
cgataaattcttgaggtgatgaatamcctaaatacactgacttgaatatt

SEQ ID NO: 66777 - DNA, 50 bp, homo sapien
attactctaaacattaaccaaactcyatgttctaagtaagaaataaaatg

SEQ ID NO: 66778 - DNA, 50 bp, homo sapien
acagcaagaaatgcctgtttttatcragaaagatccagtgattcttatga

SEQ ID NO: 66779 - DNA, 50 bp, homo sapien
acactatctcaatgttaggaaatggraaatttgtagaaatttggggaaca

SEQ ID NO: 66780 - DNA, 50 bp, homo sapien
aaaagagcccaggttgtcattcctaygtcagataaatcacactttaaact

SEQ ID NO: 66781 - DNA, 50 bp, homo sapien
tacatgtctccttcagccttagaaaytgaatgtgttgactttttttccta

SEQ ID NO: 66782 - DNA, 50 bp, homo sapien
tatacatttgtttggcatttgtctaycattcccaaaacaacctcagattt

SEQ ID NO: 66783 - DNA, 50 bp, homo sapien
agtaaagttggcctaagggcaatcaragcatccccaagaatgacaaggaa

SEQ ID NO: 66784 - DNA, 50 bp, homo sapien
ggtaatagtcttagcttactgtgtakgttttagaatgatggagggtttag

SEQ ID NO: 66785 - DNA, 50 bp, homo sapien
cacgtatttttttggataatggatarcaattgacatgatcgtgattatag

SEQ ID NO: 66786 - DNA, 50 bp, homo sapien
attaaactgaggatgtgaagaatgaytatgtgagtataatatttttgtag

SEQ ID NO: 66787 - DNA, 50 bp, homo sapien
atttctcctagacttagtgtcctcayattaaaaaaaggtgtaaataataa

SEQ ID NO: 66788 - DNA, 50 bp, homo sapien
tcttattgatatatgattatgctgcygaattgtgaatttaatttggggca

SEQ ID NO: 66789 - DNA, 50 bp, homo sapien
cagctctctagcattagttgcatccyacttgtgatttgtgttgtcaattt

SEQ ID NO: 66790 - DNA, 50 bp, homo sapien
tttcaatcttatttgaggggtgttcrcaaaaacaatatacatcaacaaag

SEQ ID NO: 66791 - DNA, 50 bp, homo sapien
ataactgagatgatccttagcataarttaaatagccatcagataggtaat

SEQ ID NO: 66792 - DNA, 50 bp, homo sapien
aaagttaatataatggctgcgggaastatttagataatctcacagcagaa

SEQ ID NO: 66793 - DNA, 50 bp, homo sapien
agaaacaatgactagaaatctaaagsctaattccaaagagaggattcatt

SEQ ID NO: 66794 - DNA, 50 bp, homo sapien
tgtggaaaagtaatcagggaaaatgycataaaatggtttgaatgctaggg

SEQ ID NO: 66795 - DNA, 50 bp, homo sapien
tgagaagtaaaatattacatgtggaraagtaatcagggaaaatgtcataa

SEQ ID NO: 66796 - DNA, 50 bp, homo sapien
agagatttgattagggtagaaagtakatctatataaaatgattaatattg

SEQ ID NO: 66797 - DNA, 50 bp, homo sapien
tataatctgtgaaaatacactctaarccatatcttaaccaattcataata

SEQ ID NO: 66798 - DNA, 50 bp, homo sapien
tcattttctagttctgcattctttcrctaactgtagacaaaataagtcat

SEQ ID NO: 66799 - DNA, 50 bp, homo sapien
cttgtcataaacagtagtagtattayaggatttaactggtagaagtccaa

SEQ ID NO: 66800 - DNA, 50 bp, homo sapien
ctgcatctcctggaagattattagckccctacgttctcaaacctcttctg

SEQ ID NO: 66801 - DNA, 50 bp, homo sapien
agaatggggatggctttagagaaaargcgattggttagtttgtgggcatg

SEQ ID NO: 66802 - DNA, 50 bp, homo sapien
ttaaaagagcactttttatgagaaaygtggcccttaatgtcagaaatcat

SEQ ID NO: 66803 - DNA, 50 bp, homo sapien
cattctcctccataatgtcttcatcractatcccagggagaaacaagcaa

SEQ ID NO: 66804 - DNA, 50 bp, homo sapien
tccaggaggatccatgaacctgtaamattgcaaatggtatgtttttgtta

SEQ ID NO: 66805 - DNA, 50 bp, homo sapien
tctaataagaaacttaggtaacttcraatccttgtttttatgggtaaaat

SEQ ID NO: 66806 - DNA, 50 bp, homo sapien
tgtgcataatggagggactagtataycaattacaccaagttcaattacac

SEQ ID NO: 66807 - DNA, 50 bp, homo sapien
gttccctcattactccttctcatacygatcattccatcttttaacataaa

SEQ ID NO: 66808 - DNA, 50 bp, homo sapien
atcctgaatcaatactagatgactcraattgcaagttagcacaggtttca

SEQ ID NO: 66809 - DNA, 50 bp, homo sapien
atcaagtagtaatctgtataaaccasagagtcagaatttatgttaaaaga

SEQ ID NO: 66810 - DNA, 50 bp, homo sapien
cagttatagtcacaaagctattaaayggtaaaccaggattcaattttttt

SEQ ID NO: 66811 - DNA, 50 bp, homo sapien
tcctcattatgtgtctagtgcagaasttaatgcttttctaagtgagctca

SEQ ID NO: 66812 - DNA, 50 bp, homo sapien
ttaggccagtgcttctatattatgawcatcttccacttatctgggtcagc

SEQ ID NO: 66813 - DNA, 50 bp, homo sapien
ggtttgatcatttattagtctttaayaagttggaaagaacataaatggcc

SEQ ID NO: 66814 - DNA, 50 bp, homo sapien
ttattagtgataagaagaggtggtawccaatccaataaatccattagtaa

SEQ ID NO: 66815 - DNA, 50 bp, homo sapien
actggaaaaattagttctccttgacygatctattaaatataaatttggat

SEQ ID NO: 66816 - DNA, 50 bp, homo sapien
aaccatgcagtgatgtgtgccataastccttaaaatacaaataaccacaa

SEQ ID NO: 66817 - DNA, 50 bp, homo sapien
tcaagtgattttcagaatggttaaartacagcattcttggagcctgatat

SEQ ID NO: 66818 - DNA, 50 bp, homo sapien
cagatcttcttcctcctacacagaaytattttttgctaagtctttgcaaa

SEQ ID NO: 66819 - DNA, 50 bp, homo sapien
ctggccagctctcaacataggtctcygaagaagctggggaacagggcaaa

SEQ ID NO: 66820 - DNA, 50 bp, homo sapien
tcaagaaattttctcatgtcatcaarattgtcagatgtataggtataaat

SEQ ID NO: 66821 - DNA, 50 bp, homo sapien
atttggccatcttgccagccacctaygtttgttattatccatccattcat

SEQ ID NO: 66822 - DNA, 50 bp, homo sapien
tgtaatgggaattgtttccaggttaycctttcatcataagaattcactaa

SEQ ID NO: 66823 - DNA, 50 bp, homo sapien
gagacttgatgcagtttaacacaacyatggaataaatggaaggagtagag

SEQ ID NO: 66824 - DNA, 50 bp, homo sapien
caaaattctttttgatatttgaaaakctttagttttgatttacgcccaga

SEQ ID NO: 66825 - DNA, 50 bp, homo sapien
gacaagcatcagctgacttcaggaayatataaaagatgttgtttaacatc

SEQ ID NO: 66826 - DNA, 50 bp, homo sapien
ttaatgttaagctagatctttcaggsactaccccatgccaaacacaggtg

SEQ ID NO: 66827 - DNA, 50 bp, homo sapien
ctaggaggcacaattttacatcatayctgaagcagagatctcgagaagat

SEQ ID NO: 66828 - DNA, 50 bp, homo sapien
tcccgccttttgtgttatatcctgtmaatccttgaaggggcaaactatcc

SEQ ID NO: 66829 - DNA, 50 bp, homo sapien
ctacttgatctgcttctgaaagaggracaataaaacttcccactgctacg

SEQ ID NO: 66830 - DNA, 50 bp, homo sapien
tcacttctcttgttcaccagaaaaamtgtactgcactgctgtaatagtaa

SEQ ID NO: 66831 - DNA, 50 bp, homo sapien
ccacagtgatgtgatatatgaaaaasagttttaaatacttagactgtttg

SEQ ID NO: 66832 - DNA, 50 bp, homo sapien
gttattttgacaaaacacaaatcacygggaacagctgagctgcttgtaca

SEQ ID NO: 66833 - DNA, 50 bp, homo sapien
agcactttggctgtaactcattggastctagtctcataatgttaggatat

SEQ ID NO: 66834 - DNA, 50 bp, homo sapien
ctcaggcttgaattgcgtttactatraagaatgcaattagaagtcagtta

SEQ ID NO: 66835 - DNA, 50 bp, homo sapien
tctgaaactgaccatctattacttcrattcaactctcatacacaggcaaa

SEQ ID NO: 66836 - DNA, 50 bp, homo sapien
ttccttcaaggaacataaaatctccrtagggaaatagacacaaacaacag

SEQ ID NO: 66837 - DNA, 50 bp, homo sapien
agaatctgacattagcttgtgcaccraattatgcaagtcattcctccttc

SEQ ID NO: 66838 - DNA, 50 bp, homo sapien
tcccacacacaagaatgtcaaagcamagtcccaggattacagccgtgtgc

SEQ ID NO: 66839 - DNA, 50 bp, homo sapien
tctaaaaattagttctataaagtcaratctcctgattcctaacctactgc

SEQ ID NO: 66840 - DNA, 50 bp, homo sapien
attgtgttgagaataaatgagaggcrctaaagggaaagaggagaccagcc

SEQ ID NO: 66841 - DNA, 50 bp, homo sapien
gctttctcctcagtaattttcttaaygtcatctgaagacttgtctactgc

SEQ ID NO: 66842 - DNA, 50 bp, homo sapien
taccaaataaatgctcagtttcaccrgctctcttacactaatgtgaacac

SEQ ID NO: 66843 - DNA, 50 bp, homo sapien
ccatactggccactgcagtccatttrtgcaaaataatcatttttttgcac

SEQ ID NO: 66844 - DNA, 50 bp, homo sapien
acatctttactaactttggatactaracagagatttatttatgaaaacaa

SEQ ID NO: 66845 - DNA, 50 bp, homo sapien
tgaactaaggcactatttcagttttstccttctgccacatccctacgaaa

SEQ ID NO: 66846 - DNA, 50 bp, homo sapien
atctgacttcaagaattattgtaaakatacgtgatcaaattagggtaaaa

SEQ ID NO: 66847 - DNA, 50 bp, homo sapien
cctaccacaagagtatttgatattamgactgaagtagtgttaatatcttt

SEQ ID NO: 66848 - DNA, 50 bp, homo sapien
aacaaatgacacaatttaaacatgakatatggctggatgcagtggctcac

SEQ ID NO: 66849 - DNA, 50 bp, homo sapien
aaattaaacacagtggaatagacaamagttgcttttaaaactttaccaaa

SEQ ID NO: 66850 - DNA, 50 bp, homo sapien
ttaagcatttatacttattatctcamgttgaatattatacacagaatttc

SEQ ID NO: 66851 - DNA, 50 bp, homo sapien
tataagtatctgaatccaaagcttcrcaaattatacttactgtgtgttat

SEQ ID NO: 66852 - DNA, 50 bp, homo sapien
attattgttatcttactcatgctaamtgtatagtaaagttcatacaattt

SEQ ID NO: 66853 - DNA, 50 bp, homo sapien
ctcccctaggtacctgacaccaagakaaatgctttttacaggataatgaa

SEQ ID NO: 66854 - DNA, 50 bp, homo sapien
attaactgacctatactgattgatayattctgttttagactgactgtatt

SEQ ID NO: 66855 - DNA, 50 bp, homo sapien
tgtttgatattgtttatactggaaamctatgagaggcaaatatataaggg

SEQ ID NO: 66856 - DNA, 50 bp, homo sapien
actatggtccttgagatgttcactayggacgaaactattctggtgtctct

SEQ ID NO: 66857 - DNA, 50 bp, homo sapien
ttaatgttaggatgttcatgcaatarcaaagattaaagataatgaagtat

SEQ ID NO: 66858 - DNA, 50 bp, homo sapien
aagaaataagtacatatttcttatasgatattacacattattctaaattt

SEQ ID NO: 66859 - DNA, 50 bp, homo sapien
tgtttcattgatattcttaaatgacragacaatttcctttggttgtgtcc

SEQ ID NO: 66860 - DNA, 50 bp, homo sapien
catatcataatttcaaactctgagcwctaaaatatactctgatttctcct

SEQ ID NO: 66861 - DNA, 50 bp, homo sapien
cctctagagtggctccctttgcacayagtgaataacagatgcctgtcatt

SEQ ID NO: 66862 - DNA, 50 bp, homo sapien
gtctctagatttacctacctatttgyaaaaaacatagagaacagtgaaac

SEQ ID NO: 66863 - DNA, 50 bp, homo sapien
aaaagcaggagctcatcctagaatayacaccaggttagtagagaaagtag

SEQ ID NO: 66864 - DNA, 50 bp, homo sapien
gccttcatctcctaacagctctacayatatctacgtggtgccttctctac

SEQ ID NO: 66865 - DNA, 50 bp, homo sapien
tacttctcagacatattcaggcatargaatctcttcccatgactaccaat

SEQ ID NO: 66866 - DNA, 50 bp, homo sapien
tgtcatgttgtaaagcatttctcacwatgtggctagtctttctaaccaga

SEQ ID NO: 66867 - DNA, 50 bp, homo sapien
tttaagtccctgaaactggacatgartaacaaagtttcagataccacatc

SEQ ID NO: 66868 - DNA, 50 bp, homo sapien
ctgctaaactactgcagctcaaccartgaattaatcggagttaaattttt

SEQ ID NO: 66869 - DNA, 50 bp, homo sapien
aaaagtaaaatgtcccaatggaaggyggacagcggccatcttcttatttt

SEQ ID NO: 66870 - DNA, 50 bp, homo sapien
acaatccaattaaatgaatagttagrattactccttgaacataatagcaa

SEQ ID NO: 66871 - DNA, 50 bp, homo sapien
gctcatagtttagttccacaagctaytaagcaatgagaatcttgagaaac

SEQ ID NO: 66872 - DNA, 50 bp, homo sapien
aagttggaaaagtggaaccatttttkagtgtgacttcatttctcttctga

SEQ ID NO: 66873 - DNA, 50 bp, homo sapien
attttcataatcaaaacttcatgaamatttctcaaggtgacatcattaat

SEQ ID NO: 66874 - DNA, 50 bp, homo sapien
ctgggtgctagcatgaaggagaaaarcaagataaattaaagagctttacc

SEQ ID NO: 66875 - DNA, 50 bp, homo sapien
tagtagttgtggtaggtggctcagasaagttcctaaaaaggtagggctgt

SEQ ID NO: 66876 - DNA, 50 bp, homo sapien
actcttgattttcaaaatggctgtawcttgtaagcaaaaatgatcatgct

SEQ ID NO: 66877 - DNA, 50 bp, homo sapien
tgcttgattcatttcattgctctctrtcaatacctggagaatctgctgtc

SEQ ID NO: 66878 - DNA, 50 bp, homo sapien
aaaatttaacattcaattagaggaartagagttgaaaacgaatctagaat

SEQ ID NO: 66879 - DNA, 50 bp, homo sapien
gtggagaaacaggagcagacagagaygatacaatgtagagaattcaaaga

SEQ ID NO: 66880 - DNA, 50 bp, homo sapien
atgagatctggacaggcacctggcartccaaattgtcctcataaactgca

SEQ ID NO: 66881 - DNA, 50 bp, homo sapien
caacaacggttcctgtaagtgaaggmatttagacatcagagaatccaata

SEQ ID NO: 66882 - DNA, 50 bp, homo sapien
tcagaaagtgacattccttacttacmacaggtcagaaccctgtacgggga

SEQ ID NO: 66883 - DNA, 50 bp, homo sapien
ggtaggagacacttgaacaataactsagatgacatacaatgccagtaaga

SEQ ID NO: 66884 - DNA, 50 bp, homo sapien
aaaatcaatgcatcactgttttattygtccagaaagactaaaatctatct

SEQ ID NO: 66885 - DNA, 50 bp, homo sapien
caaactccatcagcacattattgaaraaacactgattaaaggaaaaaagt

SEQ ID NO: 66886 - DNA, 50 bp, homo sapien
tctctctgcttagctatcatgttaayccttcagatctgaaagcatgtgcc

SEQ ID NO: 66887 - DNA, 50 bp, homo sapien
agtatagagaacattggcagcagaayattaaaactacatgatggtcaatg

SEQ ID NO: 66888 - DNA, 50 bp, homo sapien
cacctctaaaacagggtaacttatayggcaacaaacatttgcagaccttc

SEQ ID NO: 66889 - DNA, 50 bp, homo sapien
ttccttgagtctacttagaattagckctttcactggtaaaaagtttattc

SEQ ID NO: 66890 - DNA, 50 bp, homo sapien
aaggtatgcaataaatattattttaraagaacacttcagagccaagaggg

SEQ ID NO: 66891 - DNA, 50 bp, homo sapien
caggttctcaaatgaaagtgattgartaattgaacatgactgattcatca

SEQ ID NO: 66892 - DNA, 50 bp, homo sapien
gatcattatgatcattgggcatttaratattccagttggttggtgcaggt

SEQ ID NO: 66893 - DNA, 50 bp, homo sapien
ttcactactaccttactttcccggamtaggagttctttgagtgctggatc

SEQ ID NO: 66894 - DNA, 50 bp, homo sapien
ttctacttttgacctcttacaaaaartgttgctctgaaaatgcttggaca

SEQ ID NO: 66895 - DNA, 50 bp, homo sapien
attcagtaaaagatgcagtcactacyattctaaaaaccttaattaagtaa

SEQ ID NO: 66896 - DNA, 50 bp, homo sapien
ggaactatgaaaaacactaagccaartagtataatgtgttaaccagttct

SEQ ID NO: 66897 - DNA, 50 bp, homo sapien
taatgactccagtgagatagtagatractttgtaaaactcttcagaattg

SEQ ID NO: 66898 - DNA, 50 bp, homo sapien
tacattcttttaggaaaaacatagakagtagaagccttgcaccgtgattt

SEQ ID NO: 66899 - DNA, 50 bp, homo sapien
cagaattccacttctaattcctacayggtctttgggaagcagtacacagt

SEQ ID NO: 66900 - DNA, 50 bp, homo sapien
tgtaagaatgctcatggcagtaccaraaacaacccaaatgctctttatac

SEQ ID NO: 66901 - DNA, 50 bp, homo sapien
gtcactgttactaactaatagtagaygatcaaagttggaagtaaagagat

SEQ ID NO: 66902 - DNA, 50 bp, homo sapien
aaatatatattaagaagtttatttaygaagcttgtgactttatagctatc

SEQ ID NO: 66903 - DNA, 50 bp, homo sapien
atccatattccatcacaagctctctracaagtttatcagtgctcctgata

SEQ ID NO: 66904 - DNA, 50 bp, homo sapien
ccttatttgagctcacttcattagamaaaagtcataccccaaaatatttt

SEQ ID NO: 66905 - DNA, 50 bp, homo sapien
atttgatttctgctcactgctgataktagcacatttatatttcatggttt

SEQ ID NO: 66906 - DNA, 50 bp, homo sapien
agaagattttagtctttgtcatcaaractgcgtaacatttaacactccac

SEQ ID NO: 66907 - DNA, 50 bp, homo sapien
ttaattgaagaaacccggtggtaagwatataggtgttcactgtacaatta

SEQ ID NO: 66908 - DNA, 50 bp, homo sapien
agactatggcacatagcattatatayagagtgacctttgggagcctcacc

SEQ ID NO: 66909 - DNA, 50 bp, homo sapien
gagatacagttactctttcaatccartagagaccacttgatttaccactc

SEQ ID NO: 66910 - DNA, 50 bp, homo sapien
cctattgtagttaaatttgtaatccrgataattatataaaagcacagtta

SEQ ID NO: 66911 - DNA, 50 bp, homo sapien
aaaatcagcagatatccagcttcaartaacagttaccctgatcatgttaa

SEQ ID NO: 66912 - DNA, 50 bp, homo sapien
atgtatatgtatatttataaacgtaygctatgtataattttatagttagt

SEQ ID NO: 66913 - DNA, 50 bp, homo sapien
tcagttcttttcgaatgtatcatacygctctttctctataggagataaga

SEQ ID NO: 66914 - DNA, 50 bp, homo sapien
tatttttggcaatcagacttcaagcygaataaactcaggaaacataatta

SEQ ID NO: 66915 - DNA, 50 bp, homo sapien
cttatctctgatctccttaggctaaytcttctcaatcaatttggccatgg

SEQ ID NO: 66916 - DNA, 50 bp, homo sapien
tatttctatttgctgctttttggaayaaatgagaggttcctggctcttcc

SEQ ID NO: 66917 - DNA, 50 bp, homo sapien
aatatctatcactttctacccagaayaaaaatgagcaagatatgaaaaag

SEQ ID NO: 66918 - DNA, 50 bp, homo sapien
attagaatggctgtatctatttaacraaaacaagagaaaataaactcatc

SEQ ID NO: 66919 - DNA, 50 bp, homo sapien
atggagcctcctagaacctcagacargtaacccaggaagagggccaccac

SEQ ID NO: 66920 - DNA, 50 bp, homo sapien
gtgcatattggttcagtacttctaartgaaaaataggaggaggaaattga

SEQ ID NO: 66921 - DNA, 50 bp, homo sapien
atataccaaagtctacaagcgaaatmattcccaagggcatctgggccagc

SEQ ID NO: 66922 - DNA, 50 bp, homo sapien
ctggcctgtgaataagataggctgartacaagacacacaatgagtgtcca

SEQ ID NO: 66923 - DNA, 50 bp, homo sapien
attcaaatcttagcacgtcctcttakagctctgtagatccaagttacgta

SEQ ID NO: 66924 - DNA, 50 bp, homo sapien
aacatagctattctttgagatgctamacatgtaattctataataaagtag

SEQ ID NO: 66925 - DNA, 50 bp, homo sapien
ctgtgaggtaatatgaatgaataaakgaagcagaatacattatttcagcc

SEQ ID NO: 66926 - DNA, 50 bp, homo sapien
gaaattctgagcatcaataataggasatactttcactatttgtatatatg

SEQ ID NO: 66927 - DNA, 50 bp, homo sapien
tttctcccatgatgtaatgctcttayaataacaggttttgtggggtcctc

SEQ ID NO: 66928 - DNA, 50 bp, homo sapien
atggaagaacataacaggggccacartgaagctcgaggaatcagagaaaa

SEQ ID NO: 66929 - DNA, 50 bp, homo sapien
tagctagaatttattgaaaacccacyatatgcaagattctaggcccttct

SEQ ID NO: 66930 - DNA, 50 bp, homo sapien
ttttatgtgcttactgaggtgcataygtgaagacttgaatacataatgag

SEQ ID NO: 66931 - DNA, 50 bp, homo sapien
aggcactaatggggatacattgaaamaattcctgcaaacagagctgatgt

SEQ ID NO: 66932 - DNA, 50 bp, homo sapien
ccacaggcatttaagtcagccaaagratattgttaccttaaagcactatt

SEQ ID NO: 66933 - DNA, 50 bp, homo sapien
taatgttgagaatttgacaaaggtgrattagctactaggttatccagggt

SEQ ID NO: 66934 - DNA, 50 bp, homo sapien
ttacataacaatatttgaagtgtccrccgtttatatctgctgtgtgaatt

SEQ ID NO: 66935 - DNA, 50 bp, homo sapien
ttttgttggttaaagataaacttggracattctccacagggaagtgatgg

SEQ ID NO: 66936 - DNA, 50 bp, homo sapien
tctttacctttatgtctcctgtagcrcgtttaaagggatcaagaaatgtt

SEQ ID NO: 66937 - DNA, 50 bp, homo sapien
taaaaagggcaaagtgctttactacwcaaatatcttactgcactttgaac

SEQ ID NO: 66938 - DNA, 50 bp, homo sapien
ttagatgaggagttcagccaacttawagaaggaaactgttgtgttaaact

SEQ ID NO: 66939 - DNA, 50 bp, homo sapien
tcactaccatgaaaaaaatgcacctraaaattaagataaaatttcatcat

SEQ ID NO: 66940 - DNA, 50 bp, homo sapien
atctaatagaggaggaaatgctaacyggcccagctctaaactctgagatg

SEQ ID NO: 66941 - DNA, 50 bp, homo sapien
aagcaactagctatgctgcaggaccracagagggaatctggttaaggatt

SEQ ID NO: 66942 - DNA, 50 bp, homo sapien
gcagatttcagaaggaatttcagaasaatatttgatgttatccaagggga

SEQ ID NO: 66943 - DNA, 50 bp, homo sapien
tttatacccaacaatgtactaataaygtcagattcaaaattcataaaagt

SEQ ID NO: 66944 - DNA, 50 bp, homo sapien
gttttgatatatgtatacattgtgayatgattactgcaatcaggttagtt

SEQ ID NO: 66945 - DNA, 50 bp, homo sapien
attgacaactggatatgtcactaacrgcatacattataatgctctattct

SEQ ID NO: 66946 - DNA, 50 bp, homo sapien
ctgttagtgacatatccagttgtcartcagatggtcacttatccaagcag

SEQ ID NO: 66947 - DNA, 50 bp, homo sapien
atgcactttgagacttcttagttacraacaaccattccagggagtttaaa

SEQ ID NO: 66948 - DNA, 50 bp, homo sapien
caaattctactccacttcttagtaakttaagctagtcacttaagctcgtt

SEQ ID NO: 66949 - DNA, 50 bp, homo sapien
gggagtgtgttccaagtggagtagayagcaggaaccaaggcatagacatg

SEQ ID NO: 66950 - DNA, 50 bp, homo sapien
tagtcataaggaaaagcccaatttarctatggaagggaccacacaagagg

SEQ ID NO: 66951 - DNA, 50 bp, homo sapien
acactgctatatgggtgtgtataaarttgtaagaatctaataaattgagc

SEQ ID NO: 66952 - DNA, 50 bp, homo sapien
ctgtctttatcatttatagggcaccrgaagcctagatgacatttctcatt

SEQ ID NO: 66953 - DNA, 50 bp, homo sapien
tcttacttttatttgaattaccaaakatccttggacattgacaaaagcgt

SEQ ID NO: 66954 - DNA, 50 bp, homo sapien
tcataagcctccactgtcttctatayagcttagtctttttttatctctcc

SEQ ID NO: 66955 - DNA, 50 bp, homo sapien
cctgcaaatcacatatgtacatgacmatctaaatatgaccatacacagaa

SEQ ID NO: 66956 - DNA, 50 bp, homo sapien
acaaagactaaaacaaatccaaaaasatgcatatttgttttctctaggct

SEQ ID NO: 66957 - DNA, 50 bp, homo sapien
aggaaatgaaagatttcaggtgctcraagataggcctaaaggtcacattc

SEQ ID NO: 66958 - DNA, 50 bp, homo sapien
atggttttttaaagaaaagataccaygctgcaaagtctcttgaaaatggg

SEQ ID NO: 66959 - DNA, 50 bp, homo sapien
ccagcctacttctgcttatatcccawtggccagaaatgtgttatatcgtt

SEQ ID NO: 66960 - DNA, 50 bp, homo sapien
tctttcctaaaagttagcttatgtcyttggaaatggaaatggaagtggtg

SEQ ID NO: 66961 - DNA, 50 bp, homo sapien
catgtattaattagtgataataatgscaaccgtgttggtgtgatggagtt

SEQ ID NO: 66962 - DNA, 50 bp, homo sapien
tgacaaatatgattgatatattttaygaaaacaaacacctaaaaagaagt

SEQ ID NO: 66963 - DNA, 50 bp, homo sapien
gcacaattattcatccagtcatccaytgattgattttgctagctatatac

SEQ ID NO: 66964 - DNA, 50 bp, homo sapien
ctgcagtgatggaaaagtacaaaagraaagagagatattgaattcacttt

SEQ ID NO: 66965 - DNA, 50 bp, homo sapien
tgatcaaggtaggatctaaacatcartcttcataaatccagaatctcaat

SEQ ID NO: 66966 - DNA, 50 bp, homo sapien
aaaaaaaattgatacagccctgagayaagatagcaaatatgtactgctgt

SEQ ID NO: 66967 - DNA, 50 bp, homo sapien
taatgcaaacactcctgagtcctttygaaaccactgtccatggaggcaag

SEQ ID NO: 66968 - DNA, 50 bp, homo sapien
aacctgtctattatgacccttattaygctaactccttacctaaacactat

SEQ ID NO: 66969 - DNA, 50 bp, homo sapien
atgaatgaacctatctgaaataaaargactgtaaattagtgtagtttatt

SEQ ID NO: 66970 - DNA, 50 bp, homo sapien
gatagatagatgatagactatgataragatgataggtagatagatagatg

SEQ ID NO: 66971 - DNA, 50 bp, homo sapien
tcactgatgattcatatataagccaygtggactcaaataaattctcatcc

SEQ ID NO: 66972 - DNA, 50 bp, homo sapien
taaaaatgagaataaaataattgttstcatagagttcctaatatatatca

SEQ ID NO: 66973 - DNA, 50 bp, homo sapien
atggctgccaaagctgtattaaccayatccacatgctcggcagaaaggtg

SEQ ID NO: 66974 - DNA, 50 bp, homo sapien
aagggtcttaattcagttcagatackgagagcctactgtaatttaccatg

SEQ ID NO: 66975 - DNA, 50 bp, homo sapien
gaaggtaacctaaaatgaggcgagamctcctatttctgttttacaaggct

SEQ ID NO: 66976 - DNA, 50 bp, homo sapien
agttctgatggcagtgaaaagtactsaaagactccctaatacatgaactc

SEQ ID NO: 66977 - DNA, 50 bp, homo sapien
agtcagtttaatacgaagcaaaaacsttctctcatttgtgcagccggatg

SEQ ID NO: 66978 - DNA, 50 bp, homo sapien
ggcccaagagggccctttcttgaatyagtatgctactctcatcagctgta

SEQ ID NO: 66979 - DNA, 50 bp, homo sapien
cttgggattagcctcttcctcattayggagctgattttctagtctgtgga

SEQ ID NO: 66980 - DNA, 50 bp, homo sapien
ctttagggggctcttattttgcctaygacactggttaatttcatctctat

SEQ ID NO: 66981 - DNA, 50 bp, homo sapien
ctctggtttcactttcttaccttgtwaaaaaagcattggataattattat

SEQ ID NO: 66982 - DNA, 50 bp, homo sapien
tgatagacctagcagagacttaggaracctaatgtacactttgaattcag

SEQ ID NO: 66983 - DNA, 50 bp, homo sapien
tcttacattttatccatctcaaaaaygaagttctttaattttaggatttt

SEQ ID NO: 66984 - DNA, 50 bp, homo sapien
ctgcacttaagatgctggatttaaargccaagtcccaaactttgggtttt

SEQ ID NO: 66985 - DNA, 50 bp, homo sapien
ttttccttctggaactgccagcatcrtgagattatagtttgccttataga

SEQ ID NO: 66986 - DNA, 50 bp, homo sapien
gttccatattgctctttgtgatatascagctttttaactgaccccacatt

SEQ ID NO: 66987 - DNA, 50 bp, homo sapien
tatttacaatatcagaagataaaaawtaagtatccataatgaaatcactg

SEQ ID NO: 66988 - DNA, 50 bp, homo sapien
aaaaaagtgattacattccaacaaartgacaatgtttaaggaggctcact

SEQ ID NO: 66989 - DNA, 50 bp, homo sapien
attttttaaaaaataaagaccataartacccaagttattagatttttcca

SEQ ID NO: 66990 - DNA, 50 bp, homo sapien
tctccctctcttctatgcaggaagcrgcctttagagagtaagcaaacaaa

SEQ ID NO: 66991 - DNA, 50 bp, homo sapien
gagggaaatatcatggttcaaaggckcattgacaaaccaacatccagtat

SEQ ID NO: 66992 - DNA, 50 bp, homo sapien
gtgtaaaacctctgagtagtcaaaartatgaatccctgttgtgtcaaaga

SEQ ID NO: 66993 - DNA, 50 bp, homo sapien
atgcattctttgtgaaggaaaaataygattaaattgcatcttccagacta

SEQ ID NO: 66994 - DNA, 50 bp, homo sapien
atttttgacttttcctcagaccatarggaatctgctaccaggccataagc

SEQ ID NO: 66995 - DNA, 50 bp, homo sapien
tcattggatatgtagcattcccttcyatccattacaaacagcactaatga

SEQ ID NO: 66996 - DNA, 50 bp, homo sapien
taaacatattcaactgacaagaaaartatttaaaagtaataaaccccccc

SEQ ID NO: 66997 - DNA, 50 bp, homo sapien
aatagtataaagaattgtgacaacaytagaagagagaaaaataaaagcag

SEQ ID NO: 66998 - DNA, 50 bp, homo sapien
ttttccctgtgtttctgcgtgtcccragaacatagtggatgcccaatctt

SEQ ID NO: 66999 - DNA, 50 bp, homo sapien
agcaatatctcactgtctaagattaygagaaacagttataccttagggca

SEQ ID NO: 67000 - DNA, 50 bp, homo sapien
caagtgctataatatttagacacggyaaaggagatttctaatataagaag

SEQ ID NO: 67001 - DNA, 50 bp, homo sapien
cttgctgttatcttagtgtttataastaagggatccaagtcaactttgtt

SEQ ID NO: 67002 - DNA, 50 bp, homo sapien
tattcttgtaaaagccactgtgcackctttaattattcaggaccccggac

SEQ ID NO: 67003 - DNA, 50 bp, homo sapien
cacagtcagatgaaaagtgagaagaycacattaagttgggagccagcata

SEQ ID NO: 67004 - DNA, 50 bp, homo sapien
cgaaagccaactgtttctaatatcckgcatgctgctgaggccattaacaa

SEQ ID NO: 67005 - DNA, 50 bp, homo sapien
acctataatttgttttactgaggaamctgactagggaagacaacctctcc

SEQ ID NO: 67006 - DNA, 50 bp, homo sapien
acgtgggagtctaacactgtctaaarcacatagtgggaactcagggtttg

SEQ ID NO: 67007 - DNA, 50 bp, homo sapien
ctaaaacagaggaagttatcacttaygacactatcactcagagataacta

SEQ ID NO: 67008 - DNA, 50 bp, homo sapien
aaaccttcctccagtagcaatatgaytaattatttctctatgaagcccca

SEQ ID NO: 67009 - DNA, 50 bp, homo sapien
gcctttctggatcatcggtaacttamaataatggataaaagtaaataaga

SEQ ID NO: 67010 - DNA, 50 bp, homo sapien
tgcttgccttgctcctgcctcattcractgcaaaaggaatagaaatgcat

SEQ ID NO: 67011 - DNA, 50 bp, homo sapien
ctggaggtagaaaaccattaggagamcactgcaatagtccaggcaagaga

SEQ ID NO: 67012 - DNA, 50 bp, homo sapien
aaagtctttacatctccagttatcamtgagcccactggtgtggtaaagac

SEQ ID NO: 67013 - DNA, 50 bp, homo sapien
ccttgttacatgagtaataacaaacsctagcggaatggatgagatcactt

SEQ ID NO: 67014 - DNA, 50 bp, homo sapien
aaggtgaagaaggaatgaccaatgargtaacaagaaaactgtgggagggt

SEQ ID NO: 67015 - DNA, 50 bp, homo sapien
ttcacttgtgtatttaatatgcgtckaaaacgaaaaagcccaagagagaa

SEQ ID NO: 67016 - DNA, 50 bp, homo sapien
tcttgtatttttttcccagaaacctsacgtcttagatgctgctgagaaat

SEQ ID NO: 67017 - DNA, 50 bp, homo sapien
tacactcactaagatggaagaaggcrctgggatcctggaacaagggaagg

SEQ ID NO: 67018 - DNA, 50 bp, homo sapien
aagaaaatctccttttgatccattaygtcagtcagaaatcgctgtttcca

SEQ ID NO: 67019 - DNA, 50 bp, homo sapien
tcaaagcagtttggagtatattagtsaacatgcatatttgttttccaaag

SEQ ID NO: 67020 - DNA, 50 bp, homo sapien
ttcattcaaaagtattatttaactastactaagtgtcaggctaggggcca

SEQ ID NO: 67021 - DNA, 50 bp, homo sapien
caggaaaggggcctaaagggccttayaatcacctaccagacatctccatc

SEQ ID NO: 67022 - DNA, 50 bp, homo sapien
atagatgagatctaaagagggaatcycagaatcacagttttagagctgac

SEQ ID NO: 67023 - DNA, 50 bp, homo sapien
atatagagtaaaatgatactatagtsaagtaagttatgtgtcatctcaca

SEQ ID NO: 67024 - DNA, 50 bp, homo sapien
caaattaaaatagctattataaaaargacgagatatatgtaggcaaaggt

SEQ ID NO: 67025 - DNA, 50 bp, homo sapien
ttacaaagtgctctcatatgattcaygccttttgagtctcacaaccatcc

SEQ ID NO: 67026 - DNA, 50 bp, homo sapien
tgtatttttaaaaagttaatttgacraagttcacaggcaagataaaggga

SEQ ID NO: 67027 - DNA, 50 bp, homo sapien
ggttttttcccttgcaaaatgaagasattgaatgaagtgggctttgaagt

SEQ ID NO: 67028 - DNA, 50 bp, homo sapien
aagtcacatagaagtttactggcagratggagtgagtctaaaatcaaggt

SEQ ID NO: 67029 - DNA, 50 bp, homo sapien
gtcctaatgcatttgtttaaattcayagaatgtacaacaccaagagcaaa

SEQ ID NO: 67030 - DNA, 50 bp, homo sapien
tggtaaatatagccttgtggcataayttgcggtccagtaatgtgatgtct

SEQ ID NO: 67031 - DNA, 50 bp, homo sapien
atccagatatcctgaaaatacaccargctttattaacaaaactctaaatg

SEQ ID NO: 67032 - DNA, 50 bp, homo sapien
taatcaatagtttactagtcctgaaytgatcacatagtgttacatgagtt

SEQ ID NO: 67033 - DNA, 50 bp, homo sapien
ttaattcaaacttagtttaatcatamatttcatgtttatcttggttgatt

SEQ ID NO: 67034 - DNA, 50 bp, homo sapien
tttattatttttcataaaggtcttasgcattaattaatttcaaggtaatt

SEQ ID NO: 67035 - DNA, 50 bp, homo sapien
tggcaatgacagcaagcttgtataakgaggtgttttgtgttttacagcaa

SEQ ID NO: 67036 - DNA, 50 bp, homo sapien
ctttccagaggtccctatgggatatsaaataaagtgcagaccttaagcta

SEQ ID NO: 67037 - DNA, 50 bp, homo sapien
agaatttgctaagaattctgagatascagttcagtggacgaaaaaatgtc

SEQ ID NO: 67038 - DNA, 50 bp, homo sapien
aaagatggtgaagttgaagaaatatkaagcctaagtatttgctgcagctt

SEQ ID NO: 67039 - DNA, 50 bp, homo sapien
acaaagcttgttactctaatgaagayattttatcactttgtctattaata

SEQ ID NO: 67040 - DNA, 50 bp, homo sapien
attattcttttgaactgaaagtcagkagaccttgattttagactcactcc

SEQ ID NO: 67041 - DNA, 50 bp, homo sapien
agatggggtgtgtgaattcagaaatraagttggatttacattaatcatag

SEQ ID NO: 67042 - DNA, 50 bp, homo sapien
cactataggtaggagatatgggaaaratatgaataatttccatgaattcc

SEQ ID NO: 67043 - DNA, 50 bp, homo sapien
gatttagtcctaagatctcaataaayggttttcatgctgatgaaaatgac

SEQ ID NO: 67044 - DNA, 50 bp, homo sapien
atagtgtttcagttagtctgtattaygaaaggggactgaatagagaattt

SEQ ID NO: 67045 - DNA, 50 bp, homo sapien
ctccacattgctagagaaaaacacaraatcgtagtgatcagctttacttt

SEQ ID NO: 67046 - DNA, 50 bp, homo sapien
cccttacagcttaaaactgggatatmatataaaagcgttaaacttctctg

SEQ ID NO: 67047 - DNA, 50 bp, homo sapien
tttttctctgtaactctaatcagaartaatctgtcaagcagtcaatttat

SEQ ID NO: 67048 - DNA, 50 bp, homo sapien
tgaacacttaatattatgtgtcttayaacttttagccattctagctacca

SEQ ID NO: 67049 - DNA, 50 bp, homo sapien
actttcagtaactttacgtcttagtsaacacttaatattatgtgtcttat

SEQ ID NO: 67050 - DNA, 50 bp, homo sapien
ttaatatgcagcagaaattggctatrataaatttttatccctttggtttc

SEQ ID NO: 67051 - DNA, 50 bp, homo sapien
cttttacagataagaaaattgagttycagggcagtaagttaatttgctag

SEQ ID NO: 67052 - DNA, 50 bp, homo sapien
gatagaagaaaatcacataagtcgakgcaagttatggtaatatcttaatt

SEQ ID NO: 67053 - DNA, 50 bp, homo sapien
aatgtaacggtaatgaatagagacakgtgagaacaccatgatgaagctgg

SEQ ID NO: 67054 - DNA, 50 bp, homo sapien
taaataaaatgttttaaattccttaracctggtcgggcacggtggctcat

SEQ ID NO: 67055 - DNA, 50 bp, homo sapien
cactccttgtaactacctgtttttaygaattccaacagcatacccccatt

SEQ ID NO: 67056 - DNA, 50 bp, homo sapien
acactattaattaacctgtacagaarattaaatgaagcaagagcaaaatt

SEQ ID NO: 67057 - DNA, 50 bp, homo sapien
atttatgtctatcaattttcctttamgcccttcttcagcttcctacccaa

SEQ ID NO: 67058 - DNA, 50 bp, homo sapien
tcctagaaacaaaacaaaagagactkactacattatacaagtagtttcta

SEQ ID NO: 67059 - DNA, 50 bp, homo sapien
gaaaacacatggtgtgagtccaaagraggtgttttcctgaagaactgtct

SEQ ID NO: 67060 - DNA, 50 bp, homo sapien
cccccctcccttcgcccctctaggartcagacctgttgtagggagatgct

SEQ ID NO: 67061 - DNA, 50 bp, homo sapien
tgaaattacattaggttagaggcaargcacatttctaattggattctgtc

SEQ ID NO: 67062 - DNA, 50 bp, homo sapien
tttaatgtcaagagatggcctgtttycagatcttctctttgatgatataa

SEQ ID NO: 67063 - DNA, 50 bp, homo sapien
ggttgtgagcatttagcaagcattcrataaattgtaactactttatttta

SEQ ID NO: 67064 - DNA, 50 bp, homo sapien
taaacagctcatgggaacagtacaaytgtaaaacttgggagatgcactaa

SEQ ID NO: 67065 - DNA, 50 bp, homo sapien
tcgaaggtgtgcatatatgttgaatsacattttagggacatggtgttttt

SEQ ID NO: 67066 - DNA, 50 bp, homo sapien
aaagtaatactggtgacattcagtargtgatgtagtctatttgagtgtct

SEQ ID NO: 67067 - DNA, 50 bp, homo sapien
ttgagagaaaggattagtcaaaaaamatagaggaaagatgacatctttca

SEQ ID NO: 67068 - DNA, 50 bp, homo sapien
tttttcatgggtgttactcgactgayagtaccttcctgacatttgtacct

SEQ ID NO: 67069 - DNA, 50 bp, homo sapien
caattgggaaagagaaagagataaayggtactcaaataggaagagaggaa

SEQ ID NO: 67070 - DNA, 50 bp, homo sapien
acattttgagaatttcatgtaactaygtcatactttgttttaaacttaac

SEQ ID NO: 67071 - DNA, 50 bp, homo sapien
acatatattgaacaccatggcatcasagtgatatctccaatttcagtcta

SEQ ID NO: 67072 - DNA, 50 bp, homo sapien
aagaatatacattttttagggactamgtacaccagaacctgacagcaaaa

SEQ ID NO: 67073 - DNA, 50 bp, homo sapien
tctagtctgactgatctgtttcttaycaaggattccaaaatggtggcatt

SEQ ID NO: 67074 - DNA, 50 bp, homo sapien
aaaatataatatgcaatcaagaagaygctaaaaggatagtagatagcatt

SEQ ID NO: 67075 - DNA, 50 bp, homo sapien
actgatacacactaaaacattttacrataatcaccagtaggcatcttgaa

SEQ ID NO: 67076 - DNA, 50 bp, homo sapien
tgtgttctaacatgtaattcctgacrttgagcttcactgtgtaatgaaat

SEQ ID NO: 67077 - DNA, 50 bp, homo sapien
tttcttagtataaaagtgattgattyaaggactattcttttggtcagttt

SEQ ID NO: 67078 - DNA, 50 bp, homo sapien; identical to SEQ ID NO: 67075

SEQ ID NO: 67079 - DNA, 50 bp, homo sapien
aacttttaaaaagtaataactaacayaccggaacgcaaaaagccaaaagc

SEQ ID NO: 67080 - DNA, 50 bp, homo sapien
atttctctagcttgctgaaataatgscaaattttataatatgatactagc

SEQ ID NO: 67081 - DNA, 50 bp, homo sapien
tgcaaatctcaaaatatgttccagcycatatactctttctaccatggaag

SEQ ID NO: 67082 - DNA, 50 bp, homo sapien
gtttactattttttttgtatcagtgmaaccatggctctgggacattttag

SEQ ID NO: 67083 - DNA, 50 bp, homo sapien
attttaagatcatcaattcatgttgmcaaatattaagcatccagaaaaaa

SEQ ID NO: 67084 - DNA, 50 bp, homo sapien
ataatgttgtgtactaatcttatcayattttcagtgaagaattttcttct

SEQ ID NO: 67085 - DNA, 50 bp, homo sapien
ttggctggtaaaatagagataagacraatagttccttatagtagactcat

SEQ ID NO: 67086 - DNA, 50 bp, homo sapien
caatttaaaatatgactgattaaaayattccctgacttggccagacctgt

SEQ ID NO: 67087 - DNA, 50 bp, homo sapien
gaatagaatagtgcctcaaatctcartactaacgttgaatatgaatgacc

SEQ ID NO: 67088 - DNA, 50 bp, homo sapien
ccctgtaaatgtaattgcctaacaaktattagttgccattagtaaatgag

SEQ ID NO: 67089 - DNA, 50 bp, homo sapien
ggtaagacttcatttgcctagaggawtatttggctttataatgtttgaaa

SEQ ID NO: 67090 - DNA, 50 bp, homo sapien
gtattatcactcttagatactgtaaygaaacacaatttaaaactcaaaaa

SEQ ID NO: 67091 - DNA, 50 bp, homo sapien
ctcaatgtaggcaattgtttcagaartgttcactttattgttatgcttta

SEQ ID NO: 67092 - DNA, 50 bp, homo sapien
taggaaacccctccttgttttgcttsaacctataggtaatttcattcact

SEQ ID NO: 67093 - DNA, 50 bp, homo sapien
catgtctgtgacaagaaaggaccaasgcaacaacaaataaacagctaaga

SEQ ID NO: 67094 - DNA, 50 bp, homo sapien
taagctgatgataaacttacaaatgytaccagtgtggattacagctaaag

SEQ ID NO: 67095 - DNA, 50 bp, homo sapien
ggccaattcttctgctttcattggcyacagtataaatgggaacaaattta

SEQ ID NO: 67096 - DNA, 50 bp, homo sapien
attaagaaaagaaaatcacagaagcwcttaataaaatagagagaaaggaa

SEQ ID NO: 67097 - DNA, 50 bp, homo sapien
ctaggtgtctgggacagactcactgwagtaaataagagtgaaaacacaag

SEQ ID NO: 67098 - DNA, 50 bp, homo sapien
taatcatgtggtactacttgactttyaacattatacacatgaattacttt

SEQ ID NO: 67099 - DNA, 50 bp, homo sapien
tggatatgacattctagtaggagaaraagataactaagatgtaaatagac

SEQ ID NO: 67100 - DNA, 50 bp, homo sapien
cagggtaaagacacaactatggctcrcgactccacataaattctgacagg

SEQ ID NO: 67101 - DNA, 50 bp, homo sapien
acgactccacataaattctgacaggycttgtgttgtgttgggatgctgaa

SEQ ID NO: 67102 - DNA, 50 bp, homo sapien
attacaaatttaatgataattactaygaacatttacagtatataatttta

SEQ ID NO: 67103 - DNA, 50 bp, homo sapien
tgataaaggtcagaatcataccagcraagacttcagatatttgacttttc

SEQ ID NO: 67104 - DNA, 50 bp, homo sapien
ccttatctacgcaaaacattctatcygaaatgcatgactttgttttatgt

SEQ ID NO: 67105 - DNA, 50 bp, homo sapien
agaaaatcagtatcaacatggaaaarcatagtataggatccctaccttat

SEQ ID NO: 67106 - DNA, 50 bp, homo sapien
tatcagacaaaaggaaaaatagtaaytgcagaagtaagctataaaattca

SEQ ID NO: 67107 - DNA, 50 bp, homo sapien
tgatttaaatagtctatttcagattraacaatttttggaattactggctt

SEQ ID NO: 67108 - DNA, 50 bp, homo sapien
ctattgttttgcaatacgcttttcawactttttgtgtttgaattttctac

SEQ ID NO: 67109 - DNA, 50 bp, homo sapien
attctggctgtcaagactatttttaragaacattttcccttcatttttct

SEQ ID NO: 67110 - DNA, 50 bp, homo sapien
gaatatttgtatccattatctcttaytaaaaatcaaatgttttaataatt

SEQ ID NO: 67111 - DNA, 50 bp, homo sapien
tagggaatgcttatacgctactgatrgaatgtaaattagttcagccctgt

SEQ ID NO: 67112 - DNA, 50 bp, homo sapien
cactattcacaaaataaggaatcaasagaaataaggaatgagcacaaaca

SEQ ID NO: 67113 - DNA, 50 bp, homo sapien
gtgagcttgtgaaaacaatgtccgayggaactaatgatgaaagggcctgg

SEQ ID NO: 67114 - DNA, 50 bp, homo sapien
ttggtgtcctaagaacttagcttgaygactagtacttgggcaacacttaa

SEQ ID NO: 67115 - DNA, 50 bp, homo sapien
atatgtatcagttatggccttcagamaaattgcagcagctggggctgtag

SEQ ID NO: 67116 - DNA, 50 bp, homo sapien
tttgaattatcttttggcatatcgasccatatagttaagttgatttccaa

SEQ ID NO: 67117 - DNA, 50 bp, homo sapien
gattagctgccaggatctgacttacytaggtgattttatttagtgtcccc

SEQ ID NO: 67118 - DNA, 50 bp, homo sapien
aacaaagatgactaatgtatattgaytaatgcatttgagacttgacaaag

SEQ ID NO: 67119 - DNA, 50 bp, homo sapien
aaaagatgtgttacctttcctcaaayaagcataaatggaataatgatgat

SEQ ID NO: 67120 - DNA, 50 bp, homo sapien
aatttggtttggttactaagtctatmataactggaaatggaaagcctgtc

SEQ ID NO: 67121 - DNA, 50 bp, homo sapien
acttactcctttttagcttctccaayattcttggtttatttcctgttctt

SEQ ID NO: 67122 - DNA, 50 bp, homo sapien
gttttaaagtttggttggtggtacartagtgaggttaagacagctaagtc

SEQ ID NO: 67123 - DNA, 50 bp, homo sapien
aaaacctctgccagagttcatagacyatattcacattaaacacactgata

SEQ ID NO: 67124 - DNA, 50 bp, homo sapien
agaaaaatgtgaaaggataaatacawcatacacagagagtttgagtacta

SEQ ID NO: 67125 - DNA, 50 bp, homo sapien
agttataagaattgctatactaaacrattttctggttttactatgacatc

SEQ ID NO: 67126 - DNA, 50 bp, homo sapien
tctgctagctcttttgggcccgagaygacaaggcaccatagtatcagtca

SEQ ID NO: 67127 - DNA, 50 bp, homo sapien
aaagcttgagagacaatttaatacayctgcaagttataagaattgctata

SEQ ID NO: 67128 - DNA, 50 bp, homo sapien
tgttccactgtatgaagttatgtaayatagccattatatagtactttaaa

SEQ ID NO: 67129 - DNA, 50 bp, homo sapien
aaattatttgtagaacttcaattcaraatctaagccatagagtcctaatt

SEQ ID NO: 67130 - DNA, 50 bp, homo sapien
tagaatggctgttataaaaaaggcamatataacagatgctggtgaggatg

SEQ ID NO: 67131 - DNA, 50 bp, homo sapien
aaacgagaatacaaaagaccgattakactagtcaggttctgtttcttaaa

SEQ ID NO: 67132 - DNA, 50 bp, homo sapien
attacttttgcaccaacctacaatasaagaaaatattgggagatgcggct

SEQ ID NO: 67133 - DNA, 50 bp, homo sapien
ggccatgggaatcaagagatctacartgcaggaatcttttgatttggtgg

SEQ ID NO: 67134 - DNA, 50 bp, homo sapien
gatctagaagttctattagtgcctargtaactctcatgagcaggcagaag

SEQ ID NO: 67135 - DNA, 50 bp, homo sapien
caacttcccttccctcattctcctayatcaattaattcacagagatttgc

SEQ ID NO: 67136 - DNA, 50 bp, homo sapien
ccataaagggaagaactctacagaargagcccttaaatctatatgcaaac

SEQ ID NO: 67137 - DNA, 50 bp, homo sapien
gccttgtgttacctctgaggaagcaytctaacttattggccaaaagactg

SEQ ID NO: 67138 - DNA, 50 bp, homo sapien
cttctgataagattatttttcaagaytatttcactaagtggatagagact

SEQ ID NO: 67139 - DNA, 50 bp, homo sapien
ctcttccaccaggagattgcttcaayttacagcttacctctgcctgcgat

SEQ ID NO: 67140 - DNA, 50 bp, homo sapien
aagtacaaacataagtgaagtcctayagatccgaggagtcaaataacagt

SEQ ID NO: 67141 - DNA, 50 bp, homo sapien
ttcccttagtcggctctagttggaaytggctggctacaacatttctttaa

SEQ ID NO: 67142 - DNA, 50 bp, homo sapien
taaaaccaaaaaacaatgcctttagwcaagtgtgatatggaggatgttga

SEQ ID NO: 67143 - DNA, 50 bp, homo sapien
tcttttcctggtttgttaattctgcyaaaatgtcattcttgtcaaaatgt

SEQ ID NO: 67144 - DNA, 50 bp, homo sapien
tatgcatgtataaataaaatgccatsagtattacctactgctgaaatttt

SEQ ID NO: 67145 - DNA, 50 bp, homo sapien
tgtagttttgaattttagtgattaayggaattggtgctattaatagaaat

SEQ ID NO: 67146 - DNA, 50 bp, homo sapien
catgaatgttctcttcattgctcctraagtatatatcccaaacctaatta

SEQ ID NO: 67147 - DNA, 50 bp, homo sapien
ggcatgggcagtgtcaataataacamtataatttgcagcttggggaattt

SEQ ID NO: 67148 - DNA, 50 bp, homo sapien
agttccagaaactgtgtaggactaayatgtctatttactagtgatacatt

SEQ ID NO: 67149 - DNA, 50 bp, homo sapien
taagcattactcacattactgaaggrcatcccaaatagtctagttcaagg

SEQ ID NO: 67150 - DNA, 50 bp, homo sapien
agtataattagaatacctggccttasattataagaaaggagaaatgacaa

SEQ ID NO: 67151 - DNA, 50 bp, homo sapien
aattatttaatactttgtaattttawccaatgactcatcttttaaaaatt

SEQ ID NO: 67152 - DNA, 50 bp, homo sapien
aagtgccttaataatgtcagtggaayggaaagacatggtatggaggcttt

SEQ ID NO: 67153 - DNA, 50 bp, homo sapien
aagtgcttatacacatatgcatatcratgccccagaccaattgaattttc

SEQ ID NO: 67154 - DNA, 50 bp, homo sapien
aactcacgtatcaatttgcataataygtgtttatttaggaggtgattctt

SEQ ID NO: 67155 - DNA, 50 bp, homo sapien
gggctgattgctaatggaattagaastcacctgcaagaagggtgcagtga

SEQ ID NO: 67156 - DNA, 50 bp, homo sapien
acagtttggggaggtatctctttaamaattattaccagtataacaagact

SEQ ID NO: 67157 - DNA, 50 bp, homo sapien
ggattctgaatgcaaagaaaatactsagatagctttactagtttatagtg

SEQ ID NO: 67158 - DNA, 50 bp, homo sapien
tgaccattactttaacctttatgacratgtatgtttactgcaatataccc

SEQ ID NO: 67159 - DNA, 50 bp, homo sapien
cttatccatatgctttcttcaaaacytatttcaaaacctacataacaaat

SEQ ID NO: 67160 - DNA, 50 bp, homo sapien
agagtgacaagttactagttggtgasgcacatgatacacatttaaactca

SEQ ID NO: 67161 - DNA, 50 bp, homo sapien
ctgtgaagaatgtcaatggtagttcraagggatagcattgaatctataaa

SEQ ID NO: 67162 - DNA, 50 bp, homo sapien
tctgtacttctaacagatagaatccsaattacagagcttcctacagtaat

SEQ ID NO: 67163 - DNA, 50 bp, homo sapien
agaactccttagataaataaaggcartatgctcataagcagacaagatct

SEQ ID NO: 67164 - DNA, 50 bp, homo sapien
gaaggtaattataatttgggtaaaasgtgataagaacagtagtaattatt

SEQ ID NO: 67165 - DNA, 50 bp, homo sapien
tgtctttttggttatcttgttttaayattttgtctggaagaagagagaag

SEQ ID NO: 67166 - DNA, 50 bp, homo sapien
actgaagattgaaaaacagaaaccasagtaacaaaggagtcattcgcaat

SEQ ID NO: 67167 - DNA, 50 bp, homo sapien
ggctggtgacgatgtttcttattgcraatgactcctttgttactgtggtt

SEQ ID NO: 67168 - DNA, 50 bp, homo sapien
actgatcatattctatttctataacygagttaccatagagagactggatc

SEQ ID NO: 67169 - DNA, 50 bp, homo sapien
ggcttgccccagggtgcctaggaaaygagaaaaacgaatagaaagttttg

SEQ ID NO: 67170 - DNA, 50 bp, homo sapien
tgttgaaagaacaatgaagaatctcmattatatcaggaatttgtacatta

SEQ ID NO: 67171 - DNA, 50 bp, homo sapien
ttagccacacaagctaagataaacaygtcagtaggtaaagtcctctgtga

SEQ ID NO: 67172 - DNA, 50 bp, homo sapien
gagatacagctgcaccatggcaaacyggtgaagcaacattagctgatgtt

SEQ ID NO: 67173 - DNA, 50 bp, homo sapien
cacctccaatttccagatcaaaacasagtgtgcctttgtatatacttcaa

SEQ ID NO: 67174 - DNA, 50 bp, homo sapien
gccgctctgtgaatcctgtgttaccrtaaaggacaactgatttagatggt

SEQ ID NO: 67175 - DNA, 50 bp, homo sapien
cggggaaatatcccagacaaaaacaygtgggtgaagtgcagagcacaaat

SEQ ID NO: 67176 - DNA, 50 bp, homo sapien
gcctaggtgtgggagagaaggacaasaagtagtgtgaaacaacagaagaa

SEQ ID NO: 67177 - DNA, 50 bp, homo sapien
ccatgtattagaagaactgatgacasgcttaatcattgtagttttcctca

SEQ ID NO: 67178 - DNA, 50 bp, homo sapien
catgggaatgttaaccaataatgaayaaagtaggtaataaattctgtgat

SEQ ID NO: 67179 - DNA, 50 bp, homo sapien
taacttcatatagatattaaggcgayggctccaggattttcacacagctc

SEQ ID NO: 67180 - DNA, 50 bp, homo sapien
agaatttaaaaggaacacatgacaaytatattgaggcatcaaatgtagat

SEQ ID NO: 67181 - DNA, 50 bp, homo sapien
aggctgtttataaatcatgcaaaatsaattactgagtaaatgaggattct

SEQ ID NO: 67182 - DNA, 50 bp, homo sapien
gcaggcaagagacgagaaatagggarcttcagtgcaagaacaataagagg

SEQ ID NO: 67183 - DNA, 50 bp, homo sapien
agagacttgtgcaagattccatgacragtcagcagctgtgttgagataag

SEQ ID NO: 67184 - DNA, 50 bp, homo sapien
ttgcacttaggaacattgggattgaytgcatttgtgtgttagaaaagtgg

SEQ ID NO: 67185 - DNA, 50 bp, homo sapien
taaagctgtcattcaaaaatattaawtgatttgacaaaggagcacaaatg

SEQ ID NO: 67186 - DNA, 50 bp, homo sapien
taagttctatgctaatgacattatasgtagtgacaggaataagaatagcc

SEQ ID NO: 67187 - DNA, 50 bp, homo sapien
tcaaaatacaaaaataaattattgawtaaccaaattcttacatgtggata

SEQ ID NO: 67188 - DNA, 50 bp, homo sapien
tataggccatttgctataatgaatasctttttaaacagatatattctcat

SEQ ID NO: 67189 - DNA, 50 bp, homo sapien
aggtctaaaatgtgtacatttataartcatatactaatgagtcacatctc

SEQ ID NO: 67190 - DNA, 50 bp, homo sapien
tttctaggtcacaccctatgcttttyatcttcctcacatttgcttgaatt

SEQ ID NO: 67191 - DNA, 50 bp, homo sapien
agagctaatcctcttgtgccagtcarccaagctgtgaatacaaaagttct

SEQ ID NO: 67192 - DNA, 50 bp, homo sapien
taaagataaaatattctagggatgcratgccagaaatctacattaagggc

SEQ ID NO: 67193 - DNA, 50 bp, homo sapien
catttcttctgcaatttccttatttstctcagccttcatggaattgaagc

SEQ ID NO: 67194 - DNA, 50 bp, homo sapien
tggcacttcagacgcattacacctaycattaagctcatcttgtttataca

SEQ ID NO: 67195 - DNA, 50 bp, homo sapien
aacctgtcctttgacgctttgaagcyaaacattgacttctcttctctagc

SEQ ID NO: 67196 - DNA, 50 bp, homo sapien
gtgtcctctcttctaagctccaaaayaactgtagtctcaagatgaagtta

SEQ ID NO: 67197 - DNA, 50 bp, homo sapien
gagggaaactgagggaagaacactgragaatatccaaatttaactgatgg

SEQ ID NO: 67198 - DNA, 50 bp, homo sapien
ccctgccacctgttttttcttctccygaatgcatttactgtgttacttct

SEQ ID NO: 67199 - DNA, 50 bp, homo sapien
ggagatgtcttgcttctcaccttgcrcctagttactcagtctctgctttg

SEQ ID NO: 67200 - DNA, 50 bp, homo sapien
acttgcctcaaatcacctgatgctaygtttctatgattatgccaagtttt

SEQ ID NO: 67201 - DNA, 50 bp, homo sapien
ctacacaacttagtttaaacctttasaaatagactgcttgcctggaagta

SEQ ID NO: 67202 - DNA, 50 bp, homo sapien
attaacttataagattatctcctgcrtagagagacgatagtctagcaaat

SEQ ID NO: 67203 - DNA, 50 bp, homo sapien
ctttacaaatagactgcttgcctggwagtaccgtctgtttacccattgcg

SEQ ID NO: 67204 - DNA, 50 bp, homo sapien
gtcctattgaactttaaggaatggcygatgcccagtcattatttcagttt

SEQ ID NO: 67205 - DNA, 50 bp, homo sapien
gcagtgaaaacaactatctaactcakaccaatgggtggcctagtcaacct

SEQ ID NO: 67206 - DNA, 50 bp, homo sapien
atgactgcaatccatacttgtaaaawtatcaataataatatttgataatt

SEQ ID NO: 67207 - DNA, 50 bp, homo sapien
gatttgcagactggctcttaaaagcktccacctgtaaatgccatatttct

SEQ ID NO: 67208 - DNA, 50 bp, homo sapien
ttctgaagcaaaaaaggttatatgaygatttgcagactggctcttaaaag

SEQ ID NO: 67209 - DNA, 50 bp, homo sapien
ttttaggactttcacttacatctcaytagcaggaactgtatcagattggc

SEQ ID NO: 67210 - DNA, 50 bp, homo sapien
aacatgatattggagaatatcttaaygaccttggagtggagcagaaaaat

SEQ ID NO: 67211 - DNA, 50 bp, homo sapien
atgtactacagaaaacagggattgtraatataatagaagtttctttttca

SEQ ID NO: 67212 - DNA, 50 bp, homo sapien
cttgccatgctatgtatgtcaaaggycaccttctgtcttgccttgtcctg

SEQ ID NO: 67213 - DNA, 50 bp, homo sapien
catatgaccatctcacctcatgatcraatgatcctaaatccctcactaac

SEQ ID NO: 67214 - DNA, 50 bp, homo sapien
catcccatgcatataaacctcaatcyagtaaacatttgaaaccactattc

SEQ ID NO: 67215 - DNA, 50 bp, homo sapien
ttcttcatgggtggagaggcatacayatacagggagaaaaggaattgata

SEQ ID NO: 67216 - DNA, 50 bp, homo sapien
tggtgctccttgttgcatttggagaratcttgaattatcatcattagact

SEQ ID NO: 67217 - DNA, 50 bp, homo sapien
ttcatttggaatactgtccaagattmaacctttctacgcatcaaacactg

SEQ ID NO: 67218 - DNA, 50 bp, homo sapien
tttcctccttgtagtttatcctcgarccaaaacaaattaactttaggtcc

SEQ ID NO: 67219 - DNA, 50 bp, homo sapien
ttaaggacaggtagtatcaggccaascaaaagtgggaggtgaaaatatga

SEQ ID NO: 67220 - DNA, 50 bp, homo sapien
ctaactttctgtttgatcagtcacaytacatcacaccctgccttagtatt

SEQ ID NO: 67221 - DNA, 50 bp, homo sapien
gagatatttagttaatgccgtctaayatcctaaattatatcctctatgtc

SEQ ID NO: 67222 - DNA, 50 bp, homo sapien
acccactcccccatctgtacaaaaamtgttttacaaaattagctggccat

SEQ ID NO: 67223 - DNA, 50 bp, homo sapien
ataaaacaaaacaccagctaagttgyattatgtaagaaactcattagttc

SEQ ID NO: 67224 - DNA, 50 bp, homo sapien
ttaggtagctgtgcacaggtacaaaygatttaagattacactcctgggat

SEQ ID NO: 67225 - DNA, 50 bp, homo sapien
gtatctacaaaatttcagaaaagaarggtgaattgtaaattaatgtgact

SEQ ID NO: 67226 - DNA, 50 bp, homo sapien
tccacacttataaatgcagtagttayaggctttggtaatgagatcatgaa

SEQ ID NO: 67227 - DNA, 50 bp, homo sapien
tctcaacatatctacctatatattargatacatgcattcccagggtttct

SEQ ID NO: 67228 - DNA, 50 bp, homo sapien
ataaattttatttatgtcaatctaaygggacctatacaatttagctagaa

SEQ ID NO: 67229 - DNA, 50 bp, homo sapien
ctagcatgtaggaaaacttccaccckaattttgaattgtcccatgtaaca

SEQ ID NO: 67230 - DNA, 50 bp, homo sapien
cacagctgatgcaaaagaagcctaaratagaaagaaaggcttatcttgaa

SEQ ID NO: 67231 - DNA, 50 bp, homo sapien
atgagacaacatctaatatacttgasgattgtattagatgaatggcaagt

SEQ ID NO: 67232 - DNA, 50 bp, homo sapien
tataaatatatgtggatacaatgacyctagtattctaaatatgcagaaaa

SEQ ID NO: 67233 - DNA, 50 bp, homo sapien
ttgagtatctatctaaaagaaaaggmattatgtcataaagatacctatac

SEQ ID NO: 67234 - DNA, 50 bp, homo sapien
agggaaaggaagaagcattaataagmcatgacagaaatgggctgatgact

SEQ ID NO: 67235 - DNA, 50 bp, homo sapien
atgctcttaatgtgatttgtttacartctttctgttttattgcagccggg

SEQ ID NO: 67236 - DNA, 50 bp, homo sapien
gaaggggatgactggttcttcagatratatgctatgaaacagatcagaca

SEQ ID NO: 67237 - DNA, 50 bp, homo sapien
ctgaagttatacagtgttgtgtcaakttcttgggattcaattcaatactt

SEQ ID NO: 67238 - DNA, 50 bp, homo sapien
ctcacctttattggctacagagaaarttcaggtcattattttttatttaa

SEQ ID NO: 67239 - DNA, 50 bp, homo sapien
cttagttcttactgaattaaatggaragtgacttgacaactcttggccag

SEQ ID NO: 67240 - DNA, 50 bp, homo sapien
gttttagccaatcaaactctctacastcaaatcatcttcacagtattaca

SEQ ID NO: 67241 - DNA, 50 bp, homo sapien
ttccctttaagaaaatattcttttcsatattctttgtactaccagtatat

SEQ ID NO: 67242 - DNA, 50 bp, homo sapien
ttggcttcataagtgaaataagcaartaacctctgttctcagaaaaaaag

SEQ ID NO: 67243 - DNA, 50 bp, homo sapien
tctagaaggcacattttctgcgcaarttcccaaagctccttgaccttcca

SEQ ID NO: 67244 - DNA, 50 bp, homo sapien
gaatcaagatcacaatgaagtaccaytttaacccaccagactggcaacaa

SEQ ID NO: 67245 - DNA, 50 bp, homo sapien
atgagatgtgatttgaggacataaawgttgagggcccttggtatcatacc

SEQ ID NO: 67246 - DNA, 50 bp, homo sapien
tcattgctaacccttttcaaaaggcrgcctaaatttcttgctttgctaag

SEQ ID NO: 67247 - DNA, 50 bp, homo sapien
ttctcaaaatattcttgtatatttakcacacatcagcaagattacaagca

SEQ ID NO: 67248 - DNA, 50 bp, homo sapien
acttattctgtgacttaaaatggacyctaggagatgaagaatgagccagc

SEQ ID NO: 67249 - DNA, 50 bp, homo sapien
cctcattgtgtattttctgtaatgaytttcagagtgcacatgtttagcaa

SEQ ID NO: 67250 - DNA, 50 bp, homo sapien
gatgatgtaaaacactttttgtgacrtgtaataaatgttcaataaatatt

SEQ ID NO: 67251 - DNA, 50 bp, homo sapien
tagctctagtttaccaatgagaaaaygaaggcataaaaagagtaattaat

SEQ ID NO: 67252 - DNA, 50 bp, homo sapien
tagaagtaaatagaatttaaaaggarcccttctctgtttacactgaattc

SEQ ID NO: 67253 - DNA, 50 bp, homo sapien
agctgccatagccaattatagggacyacagtggcagaaggccaaaggtca

SEQ ID NO: 67254 - DNA, 50 bp, homo sapien
ttatagtaattgttgacaccgtcaakaaatgtttggttccaaagtaacat

SEQ ID NO: 67255 - DNA, 50 bp, homo sapien
agagatataatataactgcattcgaktcaacacattcttcttctgaggtt

SEQ ID NO: 67256 - DNA, 50 bp, homo sapien
ggaaaatttaagttgtctggctttaygatgatgtcctaggagttttgtgg

SEQ ID NO: 67257 - DNA, 50 bp, homo sapien
aatgccattacagatttagtgtctawgaaggaatactttaagagtaagtg

SEQ ID NO: 67258 - DNA, 50 bp, homo sapien
aggccatgcttccagatggttgatcsaaacacagttgttcatttctgtca

SEQ ID NO: 67259 - DNA, 50 bp, homo sapien
atatgcattttctttctttggactakgagagatagacatcctgtagttgt

SEQ ID NO: 67260 - DNA, 50 bp, homo sapien
aagactgcaactcgttaagaccatcrtcatctctcaacccaacaactgta

SEQ ID NO: 67261 - DNA, 50 bp, homo sapien
catggtctgctgaagatatgatgaakaattcaggatatagagtgcagggt

SEQ ID NO: 67262 - DNA, 50 bp, homo sapien
atgaacgaaagcagatagaagacgayaaaatatcagaaaatattgtttgt

SEQ ID NO: 67263 - DNA, 50 bp, homo sapien
aaatagaaatgtatgatgatgcaaakgaacgaaagcagatagaagacgat

SEQ ID NO: 67264 - DNA, 50 bp, homo sapien
cttccaagtgcatttgttaaacaatkattatgaaactctatcaccttccc

SEQ ID NO: 67265 - DNA, 50 bp, homo sapien
ttttgtgggttttagttgcaatgackgtgtaattttcagaggttatgtgg

SEQ ID NO: 67266 - DNA, 50 bp, homo sapien
gcatttgccttgcgtctaggaggaaytgaaggcttagtactcaaatactc

SEQ ID NO: 67267 - DNA, 50 bp, homo sapien
ttttacctttaattgtgatttccagyctaattctcagcatccaccattag

SEQ ID NO: 67268 - DNA, 50 bp, homo sapien
tgaagtatcatagtagtactaatacrgagtggtaaggcttgcagtttgct

SEQ ID NO: 67269 - DNA, 50 bp, homo sapien
gtctagtggacaagacagggctctamactgataatccaagatggtgaata

SEQ ID NO: 67270 - DNA, 50 bp, homo sapien
gcgacaaagtgtggttatggtaagtyttgagagaaatgagcatccatttt

SEQ ID NO: 67271 - DNA, 50 bp, homo sapien
ttctttcacctgaaatgagaatagcscaaactgaggaaattaatcagtgg

SEQ ID NO: 67272 - DNA, 50 bp, homo sapien
tggtttggatgctcaattctttcttraactacaaaagcaatcttctagaa

SEQ ID NO: 67273 - DNA, 50 bp, homo sapien
ggattaaatatgaacttttcctcaayggtttgatggatcaaagttatagt

SEQ ID NO: 67274 - DNA, 50 bp, homo sapien
agctattgccagacctgttcatctastagaggagcaatggattacatgca

SEQ ID NO: 67275 - DNA, 50 bp, homo sapien
gatatttattcctaatgggagcctcraacccacttctgggaggggccatt

SEQ ID NO: 67276 - DNA, 50 bp, homo sapien
cagctttattgaattaaattcagttraacataccaatattgacctcctta

SEQ ID NO: 67277 - DNA, 50 bp, homo sapien
tgtgggagagttcattgagatgttaygagttattatctttcaagtgtagg

SEQ ID NO: 67278 - DNA, 50 bp, homo sapien
atctctctcccctctgcctcttctayaattctcctggccttttgaaaagc

SEQ ID NO: 67279 - DNA, 50 bp, homo sapien
tgcacaggctgaggctgtatagccaratctaaacatttgagctctgtttc

SEQ ID NO: 67280 - DNA, 50 bp, homo sapien
aagaagacagcctggatatcaaagtkaatgtgcctcatcagcatatccat

SEQ ID NO: 67281 - DNA, 50 bp, homo sapien
agttgtaatacattttcttagtttaygcttgtctgggagagaccatttat

SEQ ID NO: 67282 - DNA, 50 bp, homo sapien
tacctcttaatatttcctcactaatmtctataagggcagcaagttgccaa

SEQ ID NO: 67283 - DNA, 50 bp, homo sapien
aggtcatgtttaagtaccagctacartggagtgcatgaggctggggagca

SEQ ID NO: 67284 - DNA, 50 bp, homo sapien
ttctgtcacaaaggaatttggaatcragatagtttgggattgagccactc

SEQ ID NO: 67285 - DNA, 50 bp, homo sapien
gaatagttccctttatgcatttggaktatattcttaactctatctgtaaa

SEQ ID NO: 67286 - DNA, 50 bp, homo sapien
gcccaacaggcaaacatgactgcaaygtaaacagccagtactcaccatgt

SEQ ID NO: 67287 - DNA, 50 bp, homo sapien
tagccctaaccttaatcacttatctsaaataaacacttccggtcagtggc

SEQ ID NO: 67288 - DNA, 50 bp, homo sapien
cctatattaaaccatgatttattacygaaattatactactaataattttc

SEQ ID NO: 67289 - DNA, 50 bp, homo sapien
cttacttggctataatgctgccttaygaaaatactaagtgtatgaaaata

SEQ ID NO: 67290 - DNA, 50 bp, homo sapien
aattgtaactggtagaagaacataaytaacattccaatttcacagaccta

SEQ ID NO: 67291 - DNA, 50 bp, homo sapien
gcgagtttgcagttacattgctgagractgcatatttttctgttttgttt

SEQ ID NO: 67292 - DNA, 50 bp, homo sapien
tctaaactgggtgttactttagacakaaatgctcatacacttttggctga

SEQ ID NO: 67293 - DNA, 50 bp, homo sapien
tcaaactcatgatgacctacctgaartgtgtgcacccaggacagtccatt

SEQ ID NO: 67294 - DNA, 50 bp, homo sapien
tgttctttagcatgtggtttatcacsaagttatccaatccactctgaagg

SEQ ID NO: 67295 - DNA, 50 bp, homo sapien
gctatttgtgaatgaattaaatatgragacaggatgccaactctgggcat

SEQ ID NO: 67296 - DNA, 50 bp, homo sapien
ctttcataatagctaatagccttaamaattctctctccattttgttccct

SEQ ID NO: 67297 - DNA, 50 bp, homo sapien
gacctgaaaccataaaagacatagamgataacatcagaaaaaacctccta

SEQ ID NO: 67298 - DNA, 50 bp, homo sapien
aaactagaataaatataaaatagaaygatgaatgctaaaatcatggtgtg

SEQ ID NO: 67299 - DNA, 50 bp, homo sapien
agtgatgtctgcgaggtcactgaaasgaaagacttaaaggagtagctcaa

SEQ ID NO: 67300 - DNA, 50 bp, homo sapien
actactatgtaccagatggtattctmaactctttataggaaagctcactg

SEQ ID NO: 67301 - DNA, 50 bp, homo sapien
atatagacaggttttcaggactttgyaaaaatgggcatgaaaatggagta

SEQ ID NO: 67302 - DNA, 50 bp, homo sapien
ggcaaattcttatgcagagtgacaarttacttaaaagctttgaggatttt

SEQ ID NO: 67303 - DNA, 50 bp, homo sapien
aatttcttgacgtgtccatgagttaragacagctgagaaaggtttcatta

SEQ ID NO: 67304 - DNA, 50 bp, homo sapien
tatattagtggcatgtcagttcccaygattgtacacatagtttcaaacat

SEQ ID NO: 67305 - DNA, 50 bp, homo sapien
ttcagtattatctgtaatatcactcmaagatagattcccagtggacataa

SEQ ID NO: 67306 - DNA, 50 bp, homo sapien
ggaaggaccaacagattttctggccrtgtgtctactgccataaccctttg

SEQ ID NO: 67307 - DNA, 50 bp, homo sapien
ttagtgccactggctgaggtctcacraaatgtcagattttcttgtattgg

SEQ ID NO: 67308 - DNA, 50 bp, homo sapien
tggtaacaaggggtggagacaaatayaggaacccagttgacatggtcctt

SEQ ID NO: 67309 - DNA, 50 bp, homo sapien
ttttatctgctgttattctgattackcagtctccttatgaatctaatttt

SEQ ID NO: 67310 - DNA, 50 bp, homo sapien
catgttacaaccatttgtccaagaamaactttctgcataaccctcaatta

SEQ ID NO: 67311 - DNA, 50 bp, homo sapien
tctattttatatttattctagtttaygtattcaatattcttgtcctccca

SEQ ID NO: 67312 - DNA, 50 bp, homo sapien
ggaaatacattcctagaggacaatcytaatctagtcattaacatagttga

SEQ ID NO: 67313 - DNA, 50 bp, homo sapien
cactgcctgaagagctgcaagagacmaggaatatcatgaacagtggtatc

SEQ ID NO: 67314 - DNA, 50 bp, homo sapien
ccaaccacccaagttggatggggaawtgtagacagagtggatataattta

SEQ ID NO: 67315 - DNA, 50 bp, homo sapien
aaggggaaagagccaagagtcaaackaggaatcgtgttagaaaagtggga

SEQ ID NO: 67316 - DNA, 50 bp, homo sapien
ttcctcatttgcgaatgagcatagcratataattagcttcaaagcactat

SEQ ID NO: 67317 - DNA, 50 bp, homo sapien
aataatgctacagatcccttagaacrgactagaaaatgtattcagcattt

SEQ ID NO: 67318 - DNA, 50 bp, homo sapien
aaacgattcaagggcagtttttcacrgcaccttgatgaaggtggaacaaa

SEQ ID NO: 67319 - DNA, 50 bp, homo sapien
aatggaactttggaaaaaactgtctraagtaattcatgtctaatagagta

SEQ ID NO: 67320 - DNA, 50 bp, homo sapien
tatacagccttgtaatctccttgccragctgaagggctgctgcatttcta

SEQ ID NO: 67321 - DNA, 50 bp, homo sapien
agatgagcttatgctgcagttcaagmctaaagcctatctgccgtagagcc

SEQ ID NO: 67322 - DNA, 50 bp, homo sapien
tagaaaagtaagcaaaaaacataaaygagcagctcccagtacaagaaatc

SEQ ID NO: 67323 - DNA, 50 bp, homo sapien
gacagtggtgtggtcagatttatgcytgtagaaaaaacaatcccacattc

SEQ ID NO: 67324 - DNA, 50 bp, homo sapien
cactctcttccaatgtcttctatgcsataagcacaacttgctttcagagc

SEQ ID NO: 67325 - DNA, 50 bp, homo sapien
taataataaacaaagttgagaccaawcataatatttagtatcccccacta

SEQ ID NO: 67326 - DNA, 50 bp, homo sapien
taggaaactccacatttagaatttargtttatatttttcctgcacctatt

SEQ ID NO: 67327 - DNA, 50 bp, homo sapien
acttggataacctgaagattaagagmcacaaaagtttgatgaactcttag

SEQ ID NO: 67328 - DNA, 50 bp, homo sapien
tttaaatggaacaaataatcctctargtttaccttaccctgaataactaa

SEQ ID NO: 67329 - DNA, 50 bp, homo sapien
cagtcctatccatgatattaacacarcaatgcttattctggcaaaaaaaa

SEQ ID NO: 67330 - DNA, 50 bp, homo sapien
atgctgttctgtaacttacaggaaaygtctaaattcacattcattcaatg

SEQ ID NO: 67331 - DNA, 50 bp, homo sapien
tgcttatatttgagaagagtggaaawccttcatgaaatgagaacaaggag

SEQ ID NO: 67332 - DNA, 50 bp, homo sapien
ctttgtagcccactcctttgcttcartagcagactatcataaaacttgat

SEQ ID NO: 67333 - DNA, 50 bp, homo sapien
agttttgagaattctgtagttctatyagtccattctcatgggtcttgggc

SEQ ID NO: 67334 - DNA, 50 bp, homo sapien
tcatcccctattctagcttgacacayaaccttcttctagtttaattcacc

SEQ ID NO: 67335 - DNA, 50 bp, homo sapien
tcattaaccaactaatattgttaaawgtctactataagaaggccttcagg

SEQ ID NO: 67336 - DNA, 50 bp, homo sapien
ctacatacttgtactgcatgagtaayagggcactgtcatgatgtgtcact

SEQ ID NO: 67337 - DNA, 50 bp, homo sapien
tgatttgcaaagctgaccagcaaaaygtttctaatgggacctctcccaga

SEQ ID NO: 67338 - DNA, 50 bp, homo sapien
acaattttaactcagtcatttgataygtgtattagccttgtgaataatta

SEQ ID NO: 67339 - DNA, 50 bp, homo sapien
cttatttctaaatcagtttattttcyttctattgaattgtttgtgttctt

SEQ ID NO: 67340 - DNA, 50 bp, homo sapien
actactaaggtgtacatcctttggamcttcttgtttttatctaactattc

SEQ ID NO: 67341 - DNA, 50 bp, homo sapien
taagactcttgataacatctaaacargtatttttcaagtctagactgttt

SEQ ID NO: 67342 - DNA, 50 bp, homo sapien
agttggagaagggagatcatcacaaractctttattctccaacttctgat

SEQ ID NO: 67343 - DNA, 50 bp, homo sapien
gtggggaatcttgatcaaaggaaaasaggagatgagaggagctcgggcag

SEQ ID NO: 67344 - DNA, 50 bp, homo sapien
tcctattagcaatataagcaatttgraagggtacttctgataggtttcaa

SEQ ID NO: 67345 - DNA, 50 bp, homo sapien
ggtagttttgtcttcaataaagtagraatgacttggctcctacctagatg

SEQ ID NO: 67346 - DNA, 50 bp, homo sapien
atgtttctgtagcaaaacctggcttmaaattagaattgcataatccatgc

SEQ ID NO: 67347 - DNA, 50 bp, homo sapien
taaaatccatccaaatgacttaaaaraggaagtagaaatggaataaactt

SEQ ID NO: 67348 - DNA, 50 bp, homo sapien
tgctgtcgcttttgcttcactggaayacagtctttctaccattcttgcct

SEQ ID NO: 67349 - DNA, 50 bp, homo sapien
cctcttcacagtcatctgagaacctrgaggaagatgctgtttacaagacc

SEQ ID NO: 67350 - DNA, 50 bp, homo sapien
cagaagttgtacaggtttatgtctcratagcagagctaagcaaggagcag

SEQ ID NO: 67351 - DNA, 50 bp, homo sapien
aggtgaaaattagttactaaggtaaktaagcatgatttaaagcaaaagaa

SEQ ID NO: 67352 - DNA, 50 bp, homo sapien
tgcctactctaagaccattctgccartgatagtgttgaacctgcaagtcc

SEQ ID NO: 67353 - DNA, 50 bp, homo sapien
tatctggccataatcaaagttatgtyctccaatctaaacaaattgcctta

SEQ ID NO: 67354 - DNA, 50 bp, homo sapien
ttctgggaggctcactggactgttcyttttggttagcaagatatacgcct

SEQ ID NO: 67355 - DNA, 50 bp, homo sapien
gttatagaacaataaattgatatgcrgatgaattatccaaaatatctatc

SEQ ID NO: 67356 - DNA, 50 bp, homo sapien
tccaaaatatctatcaggaaagtaayacaagtagtgctattatctaaatg

SEQ ID NO: 67357 - DNA, 50 bp, homo sapien
aaaattgtagatggacctctaattayattttatctttccaggggagagca

SEQ ID NO: 67358 - DNA, 50 bp, homo sapien
tcagtagtaatgaacacacattacaytgagaagactggaagggtccagca

SEQ ID NO: 67359 - DNA, 50 bp, homo sapien
tattagtatcccatgggaaagagaaytgggacaacctcaacaatgagttg

SEQ ID NO: 67360 - DNA, 50 bp, homo sapien
ttcctctcctcagtatatacccagasaaatgagtatttatgttcacaaaa

SEQ ID NO: 67361 - DNA, 50 bp, homo sapien
tgatagttaacaaagcatttgtctcrctagcacatgtgaaagtacttctt

SEQ ID NO: 67362 - DNA, 50 bp, homo sapien
gaaggaattggaaagcaataaaaacygaactagtccaagaaggctttatg

SEQ ID NO: 67363 - DNA, 50 bp, homo sapien
cctctagaacgtcatcaaatctccayagtagtaaacaactttgtattcca

SEQ ID NO: 67364 - DNA, 50 bp, homo sapien
attttacttctataattataagctcratcctagggtatgaatgtttgtgt

SEQ ID NO: 67365 - DNA, 50 bp, homo sapien
tgtttttcatttggatatgacaaatrtttaatgctgatactaaattattg

SEQ ID NO: 67366 - DNA, 50 bp, homo sapien
atttattcactaattgcttgggagargatattggaatttcaacagaaata

SEQ ID NO: 67367 - DNA, 50 bp, homo sapien
gaaaccaacaacaacaaaaacaaacratgtgacaaagagtattaaactaa

SEQ ID NO: 67368 - DNA, 50 bp, homo sapien
ttaccagacctgtatccaacctccartgcaagtaacatgaagattatctg

SEQ ID NO: 67369 - DNA, 50 bp, homo sapien
ctgaatgcccctgttattattaacamccttattctacacttgaaggagct

SEQ ID NO: 67370 - DNA, 50 bp, homo sapien
atccatgcactgccagagtggatatkttgttagccagcatgaaaacaacc

SEQ ID NO: 67371 - DNA, 50 bp, homo sapien
cctttagcccttccaacctagaaacracttatttttgaagctttggatag

SEQ ID NO: 67372 - DNA, 50 bp, homo sapien
tgttgggaaaggcaggagtgtcaaaygtcggacagaactccagacagaga

SEQ ID NO: 67373 - DNA, 50 bp, homo sapien
ataggttcatgttatacccaaagtcrcaaatgctttatgacaagtatgaa

SEQ ID NO: 67374 - DNA, 50 bp, homo sapien
ctgtggaagacatagcactattttaragtggaagtcctccaccatttcgt

SEQ ID NO: 67375 - DNA, 50 bp, homo sapien
gtcaagagatgaaaaagatctggacyaagatagtggcaatagtaggtaag

SEQ ID NO: 67376 - DNA, 50 bp, homo sapien
tcctctccattctcctctttaataayagtgttctccatggctttgtcctt

SEQ ID NO: 67377 - DNA, 50 bp, homo sapien
aatgtcactgttttaaaacttccacmgcgattgactttcataacagcatc

SEQ ID NO: 67378 - DNA, 50 bp, homo sapien
gccttataataatgcctcacattcartagttgctgatatcataagaattt

SEQ ID NO: 67379 - DNA, 50 bp, homo sapien
taagaatttagtgatttctgattgargagtggtggttattttgtagatct

SEQ ID NO: 67380 - DNA, 50 bp, homo sapien
cagcgatggttatacaggctcccaaktacactgatctgatctttacaaat

SEQ ID NO: 67381 - DNA, 50 bp, homo sapien
tatacagcagtttaaatatctcttayctggacaataacaatggccttcta

SEQ ID NO: 67382 - DNA, 50 bp, homo sapien
gaggctttgtaaactatctaaaatgwatctcttatctttaattgggaaaa

SEQ ID NO: 67383 - DNA, 50 bp, homo sapien
actaagaatatcctgagttagtagaygtattagagttctctagagaaata

SEQ ID NO: 67384 - DNA, 50 bp, homo sapien
taattagtcatcagggactccagcakatttggcatttcatgaattctgcc

SEQ ID NO: 67385 - DNA, 50 bp, homo sapien
aatatatcagcaaaaactatttccaratgtcacattctgagcttccaggt

SEQ ID NO: 67386 - DNA, 50 bp, homo sapien
gaagattttggcgtgtggcagttcaygtggatcaatctagcagcagagtg

SEQ ID NO: 67387 - DNA, 50 bp, homo sapien
gtcaatagagtattcttatgacaatrtatctgtgaggattcccagagtag

SEQ ID NO: 67388 - DNA, 50 bp, homo sapien
gtaagtatgttttggtatgacacaaygtatatttgtttctctgggttaca

SEQ ID NO: 67389 - DNA, 50 bp, homo sapien
cattaaaagagacttacagcaaatasagacaatgcaaagtcctctgaaca

SEQ ID NO: 67390 - DNA, 50 bp, homo sapien
agtaggcaatagccattttgctaaawccatattgagtgccaaccatgttc

SEQ ID NO: 67391 - DNA, 50 bp, homo sapien
acagtggatgactcctaaggcttagratcacaattagtacccagcacttc

SEQ ID NO: 67392 - DNA, 50 bp, homo sapien
agttttactttgtgttctcatcatamcctgtgctttcctttctctgagaa

SEQ ID NO: 67393 - DNA, 50 bp, homo sapien
tgaggccatgtgaattacgataagaygcatggtaaattctcagagaaagg

SEQ ID NO: 67394 - DNA, 50 bp, homo sapien
cataagaatgagataatatgtatgamaaaccatataaatatcaataatag

SEQ ID NO: 67395 - DNA, 50 bp, homo sapien
ggtgagggagatttcacaccattgaygattcaggttaatgcttcacaaat

SEQ ID NO: 67396 - DNA, 50 bp, homo sapien
gcacagctgagacaacagctggaatrattatgtaaaacattaataaatga

SEQ ID NO: 67397 - DNA, 50 bp, homo sapien
ttaatttaatgagatgaacaaaatayaatggacctaataactgtctttga

SEQ ID NO: 67398 - DNA, 50 bp, homo sapien
tactttattctgaatccaattatacraatcatgtccaaccaaacaaaagc

SEQ ID NO: 67399 - DNA, 50 bp, homo sapien
tattctagaacttgtcctaacctaarcttatgtgtgatttctttcatttt

SEQ ID NO: 67400 - DNA, 50 bp, homo sapien
cccttgagtttatctgtacatttaaygcaatatcaacaaataaaacagag

SEQ ID NO: 67401 - DNA, 50 bp, homo sapien
actgggctctctggacttttcagatwagacaagactgttatgtttatggg

SEQ ID NO: 67402 - DNA, 50 bp, homo sapien
catctagaaatatttttctcttgccrcatttagctttgggttaattgttt

SEQ ID NO: 67403 - DNA, 50 bp, homo sapien
tttttattacatgccttggtgtagawaactttttacttactgtgccagac

SEQ ID NO: 67404 - DNA, 50 bp, homo sapien
acccatttatggacaaatagtaaacractctccctctagttttggtaact

SEQ ID NO: 67405 - DNA, 50 bp, homo sapien
gaacggaaacaaaatggaagaattayactaggaaaatacacacacacaaa

SEQ ID NO: 67406 - DNA, 50 bp, homo sapien
gctctcattatatttccagcttctawactaaggagaatacaatgaagata

SEQ ID NO: 67407 - DNA, 50 bp, homo sapien
tagtttataaattgtaatcctaatcyataatgtgatgaaaatggtcaatg

SEQ ID NO: 67408 - DNA, 50 bp, homo sapien
taagttagctggctcaccactgtcayttgtactcacacctgagtgaagtt

SEQ ID NO: 67409 - DNA, 50 bp, homo sapien
atgcccagaaaataagaagtgttcartaagaaagtgtggagttgatttgc

SEQ ID NO: 67410 - DNA, 50 bp, homo sapien
aaacagaacattaggtaaatgtaagwaatatctaagcagtattcccaatg

SEQ ID NO: 67411 - DNA, 50 bp, homo sapien
attcatctttcacctaattctcgtcrggccagtcacttccattccatttg

SEQ ID NO: 67412 - DNA, 50 bp, homo sapien
ctgctcactttttattcattcttcamgacttaagtcaggattttccccag

SEQ ID NO: 67413 - DNA, 50 bp, homo sapien
gaaggatgaattaagttgctcgatayctctttctgtcctttggtttttta

SEQ ID NO: 67414 - DNA, 50 bp, homo sapien
ttcaacttccactaccacacaagaamgaggattatcggggaacctgatgc

SEQ ID NO: 67415 - DNA, 50 bp, homo sapien
tatttttctgaaaaacactcgctcaygttcaccctaatataaccttattg

SEQ ID NO: 67416 - DNA, 50 bp, homo sapien
tggtttcctgaattcagtggaagaasaaatgcttaagagattttcaaata

SEQ ID NO: 67417 - DNA, 50 bp, homo sapien
tgtacattactgtagatttcataaayactctacacttaggctaccctaag

SEQ ID NO: 67418 - DNA, 50 bp, homo sapien
aacaccacacacctactatggccaarctacattatagccaatatgtgaac

SEQ ID NO: 67419 - DNA, 50 bp, homo sapien
acaagagttctgtaatgaagcttgayaattgttaatgccagtgtgctctc

SEQ ID NO: 67420 - DNA, 50 bp, homo sapien
ggctataaggtaaacaaatagatcaygttcaaataagaatacttgcttgg

SEQ ID NO: 67421 - DNA, 50 bp, homo sapien
gacattgttaatttgtcatttccatkttttctatttaacatagacacagg

SEQ ID NO: 67422 - DNA, 50 bp, homo sapien
tctagagtcttgaagaaacctgctaygttttttggatccaagcaagtatt

SEQ ID NO: 67423 - DNA, 50 bp, homo sapien
gttcaaagattacagagaaaattccracagcatctgtttcaacagggagg

SEQ ID NO: 67424 - DNA, 50 bp, homo sapien
acaacaactggctgctgaataatacracatcttctcatgctacagctcag

SEQ ID NO: 67425 - DNA, 50 bp, homo sapien
gacagaaaagcagaaccaagtataayatgaagtcctagaagatgaaagag

SEQ ID NO: 67426 - DNA, 50 bp, homo sapien
tgagtcacacagatatgatataaacrgcaccttagtctaaacttatgcaa

SEQ ID NO: 67427 - DNA, 50 bp, homo sapien
aaagggattatattaacagtgcatartaaagtctgttatttctcccgaac

SEQ ID NO: 67428 - DNA, 50 bp, homo sapien
ccatgggagatatatacgcaccatgraaatttgcaattgctacaaatcaa

SEQ ID NO: 67429 - DNA, 50 bp, homo sapien
gggttagaaacagtcatattttagcwgatcaaaacaagaaagttaaaaca

SEQ ID NO: 67430 - DNA, 50 bp, homo sapien
tgtttgtccaggcctccattgcagartccaggggtatgctggtaagtgtt

SEQ ID NO: 67431 - DNA, 50 bp, homo sapien
cctagtggttctgcccactattacaytggcaaaaatagacacatgggaga

SEQ ID NO: 67432 - DNA, 50 bp, homo sapien
ttcaattcttctggctaacttctcaytcttaatgtctccatttgtttttc

SEQ ID NO: 67433 - DNA, 50 bp, homo sapien
gtccgttggtcagagtgggagcttaygggtatcaagtgagagattttagg

SEQ ID NO: 67434 - DNA, 50 bp, homo sapien
tgctagtgtctgggtgcctcaacagyccttgtttattcctatgacataca

SEQ ID NO: 67435 - DNA, 50 bp, homo sapien
cctgttttagcactgtgtatccaccrgtagtcacttccctccaagattac

SEQ ID NO: 67436 - DNA, 50 bp, homo sapien
atacaacaaagtgaaattactgctcraaaattaataagcaatccaaattg

SEQ ID NO: 67437 - DNA, 50 bp, homo sapien
gaaggaagttaaatttttctaaggasaagcagataaagtataagcagatc

SEQ ID NO: 67438 - DNA, 50 bp, homo sapien
caagttacactatggagactgtggcragacccactggtagaatcacagta

SEQ ID NO: 67439 - DNA, 50 bp, homo sapien
ttaattggtattccaaattcattgarcagggtgctaaaaacaacccaaat

SEQ ID NO: 67440 - DNA, 50 bp, homo sapien
catcattccatggatcttgattgaawtcccttatttatgaaacaagcttg

SEQ ID NO: 67441 - DNA, 50 bp, homo sapien
ttactttttgtcaatcatttccccartggcgtgaagtcagaaacagcaga

SEQ ID NO: 67442 - DNA, 50 bp, homo sapien
ttattaaaagtaccataattagtaawctgaaaatttatgattcagaagga

SEQ ID NO: 67443 - DNA, 50 bp, homo sapien
taatcttacatctacaattcaattawcaggcaccaaactgtgaaccaaga

SEQ ID NO: 67444 - DNA, 50 bp, homo sapien
tctggtacttgtattaaaacttgacygatacagaacggcctaccttatgg

SEQ ID NO: 67445 - DNA, 50 bp, homo sapien
gtaagacatttttcttattttgtagragaaatataaacatggtgaaaagg

SEQ ID NO: 67446 - DNA, 50 bp, homo sapien
ctccatttccatctttaacttgcacsgatcctctaccataccttttatcc

SEQ ID NO: 67447 - DNA, 50 bp, homo sapien
caagatgaagtcacttttgtctccaygtgtttatgacccagaatatggtt

SEQ ID NO: 67448 - DNA, 50 bp, homo sapien
tgtgctctgttccaagggacaaatayctcaaggtgaaagggaaagcagct

SEQ ID NO: 67449 - DNA, 50 bp, homo sapien
caaattataggctatgatgcatatakcattcttgcctgttctagagggtt

SEQ ID NO: 67450 - DNA, 50 bp, homo sapien
acttagaagtggattacacaattacmcgtagcaaagaatctaaaattgcc

SEQ ID NO: 67451 - DNA, 50 bp, homo sapien
tgctgttattggaaacaacctccaayagagtaagcctaaatctgcatgat

SEQ ID NO: 67452 - DNA, 50 bp, homo sapien
tggaggttacttttctaccaaataaytagatatactgcatacctcaaagt

SEQ ID NO: 67453 - DNA, 50 bp, homo sapien
gctaagattttgtacaggctgattaycatatatgtcatttaccaaggcta

SEQ ID NO: 67454 - DNA, 50 bp, homo sapien
actttcctccttaagtaaatgtaaakagtgggaaatcaagaaagttgctt

SEQ ID NO: 67455 - DNA, 50 bp, homo sapien
agctgttctgctgccttgattaaacrggttttcttgactatattagaatg

SEQ ID NO: 67456 - DNA, 50 bp, homo sapien
cactttgccttcacagtccattctayaaaacgggctccgaatgtgcactg

SEQ ID NO: 67457 - DNA, 50 bp, homo sapien
ccatttgattctctgttacaggcatrataggaaataaaatatgtgtatgt

SEQ ID NO: 67458 - DNA, 50 bp, homo sapien
tatttcttgttttctgtggttcttcrcccagacataatcccctcacccaa

SEQ ID NO: 67459 - DNA, 50 bp, homo sapien
cgcctgagttctgcgtgtccttgggmaacttgctgtgtgaccttgagcaa

SEQ ID NO: 67460 - DNA, 50 bp, homo sapien
ggtgctgaacaaaggctttattcaamctcttgcaggctaacatctccgaa

SEQ ID NO: 67461 - DNA, 50 bp, homo sapien
taggggagagaggcattttttttaasaggcactactataccaggcaaagg

SEQ ID NO: 67462 - DNA, 50 bp, homo sapien
attcagggctctaaaaacgctggccracttgaatgtgtgaatacagttat

SEQ ID NO: 67463 - DNA, 50 bp, homo sapien
agcacaggtcagtgattcctgagagmggagaaccaaatgagggagccctc

SEQ ID NO: 67464 - DNA, 50 bp, homo sapien
cagaacagttaagaggctttcccagsatccatgcaagcagcaatgccagg

SEQ ID NO: 67465 - DNA, 50 bp, homo sapien
gcactacctagttagtgctttgtctyctatagtagattatttttcagcaa

SEQ ID NO: 67466 - DNA, 50 bp, homo sapien
agtaatggctaacatttatttagccktcactatataccagttactaagat

SEQ ID NO: 67467 - DNA, 50 bp, homo sapien
gttggcatggttggaaataaatatayccgagtgttgtcagcaatgtcatc

SEQ ID NO: 67468 - DNA, 50 bp, homo sapien
gatttgagaaactgaactgttcccargcggaaagataaaatgtgaagctg

SEQ ID NO: 67469 - DNA, 50 bp, homo sapien
ccctaaatccagtggcataaaactaygagcattaatttcttgctcacaca

SEQ ID NO: 67470 - DNA, 50 bp, homo sapien
tctgagtgactgattcactaggaaargtacaggtaagaaaggaaatgaga

SEQ ID NO: 67471 - DNA, 50 bp, homo sapien
tggaccatttatcctagctcttggcraggaaaatacggccattagtcaaa

SEQ ID NO: 67472 - DNA, 50 bp, homo sapien
cacaccaagccaatccagttggccamgataagccacttccaccaactgcc

SEQ ID NO: 67473 - DNA, 50 bp, homo sapien
aatgatttcagaagtcattttcaagraatacgtcctttaactggtagatt

SEQ ID NO: 67474 - DNA, 50 bp, homo sapien
tgctcactcacaatcttacatccttyaaaaggcagccgagtgaatgtgga

SEQ ID NO: 67475 - DNA, 50 bp, homo sapien
atggcagaatataaaaacaaatgtaygtatgaggcacataaccaaaatta

SEQ ID NO: 67476 - DNA, 50 bp, homo sapien
aggggtcaatcatgatgtttctggtrtagggaagagtttggaatgcatcc

SEQ ID NO: 67477 - DNA, 50 bp, homo sapien
ggaaagacacacctaaaaacaactayacacatgaagaaaggtgtttattt

SEQ ID NO: 67478 - DNA, 50 bp, homo sapien
atccttgctcagcagaaacaatgcascatggcctgtcactgtggagtgtt

SEQ ID NO: 67479 - DNA, 50 bp, homo sapien
acacattccctttgaaggatagtccmgaacaaaggatattaatagttaat

SEQ ID NO: 67480 - DNA, 50 bp, homo sapien
cattcttaatgcagatttaaaataarcaggtattaggctcctggacccga

SEQ ID NO: 67481 - DNA, 50 bp, homo sapien
gtatggcataataagtaacagcttaractttagagagagagaatgtgtgt

SEQ ID NO: 67482 - DNA, 50 bp, homo sapien
cctgctacaagttagtcataggcacraggaagggagtgaaaaaagaaatt

SEQ ID NO: 67483 - DNA, 50 bp, homo sapien
gtaaaactctggctctgttacacggragaacattttttacagaccgttat

SEQ ID NO: 67484 - DNA, 50 bp, homo sapien
acacccacttggaccatgttaatcaratcagtttgttccaacaatttctt

SEQ ID NO: 67485 - DNA, 50 bp, homo sapien
ccgttttcttttaaattaaacttacrctgaatgataaagagaaacaatga

SEQ ID NO: 67486 - DNA, 50 bp, homo sapien
gtagaaggggttttatcatcttccaygggtttaaacaggaaaagagtaac

SEQ ID NO: 67487 - DNA, 50 bp, homo sapien
tgctgcctaaggtgcaacaggaacaygcagagtggaagggttgtaggtca

SEQ ID NO: 67488 - DNA, 50 bp, homo sapien
tgtatacacatatattggtatcaaargggataaaagccaatttgtctgtt

SEQ ID NO: 67489 - DNA, 50 bp, homo sapien
ctctctcatcaatcctattaggtaamatgcacttcccaagtggggagaaa

SEQ ID NO: 67490 - DNA, 50 bp, homo sapien
tctttgcaccatacatccctcacaastatctctcattatcaaagggggaa

SEQ ID NO: 67491 - DNA, 50 bp, homo sapien
ctacaaaatgtctgtggatgtctgtsaatgtctttcccagctgttgtaga

SEQ ID NO: 67492 - DNA, 50 bp, homo sapien
catccatgtgacgaacactatcggarcttggtgatccaagagcgggcaaa

SEQ ID NO: 67493 - DNA, 50 bp, homo sapien
acatgagagctcatctcattcagaayctcacttccagattaaatcacgtg

SEQ ID NO: 67494 - DNA, 50 bp, homo sapien
tggttaaaaacacataacacttaccrtttatcatttttgagtatacagtt

SEQ ID NO: 67495 - DNA, 50 bp, homo sapien
gccaaaggacagagatccagaggacragtattgatatgagggttttggaa

SEQ ID NO: 67496 - DNA, 50 bp, homo sapien
agtatgtgactaaacagaataacctyacctggcatcaaaatgcaaccttg

SEQ ID NO: 67497 - DNA, 50 bp, homo sapien
tccaggaggaaagagcaactctaaaygcttgcttgagagccaagctgcag

SEQ ID NO: 67498 - DNA, 50 bp, homo sapien
aaatatttgctgaataaataatccaygtaagagaggcaccctggccgggc

SEQ ID NO: 67499 - DNA, 50 bp, homo sapien
aaaaaaaaaaaaaaaaagtcaacaasatacgcatggagatatttttttaa

SEQ ID NO: 67500 - DNA, 50 bp, homo sapien
aagcaacggcaataccatttataaaycaggttttgagtccatctcgagca

SEQ ID NO: 67501 - DNA, 50 bp, homo sapien
ttgatgtaaccctctttagcataaastgatttgaaagccaagttatatag

SEQ ID NO: 67502 - DNA, 50 bp, homo sapien
ataaaatgtgattaaaggatatatarccttcagatgtaatttacagtttt

SEQ ID NO: 67503 - DNA, 50 bp, homo sapien
ggtatgtttcccctagctggtgaacrcacaggttaaggatcttgggttat

SEQ ID NO: 67504 - DNA, 50 bp, homo sapien
gatgaagatatcatctttcaaacagrgaatcagaatcaccacctgaggaa

SEQ ID NO: 67505 - DNA, 50 bp, homo sapien
accaactttattacatttaaccttcrcaacaaccttaacttagagactat

SEQ ID NO: 67506 - DNA, 50 bp, homo sapien
ggggaatgctgttgggatcctggctyagttaatgagaacaccatcactgt

SEQ ID NO: 67507 - DNA, 50 bp, homo sapien
aataggattaagcaaatttgaagagytaggcaaattatttcattggaacc

SEQ ID NO: 67508 - DNA, 50 bp, homo sapien
gggaaagccctgtgtaaattgccaaragctgagtaaatataaagtgctct

SEQ ID NO: 67509 - DNA, 50 bp, homo sapien
tggtttgtccctattatggtctattyaacatccgggatgagatatttgga

SEQ ID NO: 67510 - DNA, 50 bp, homo sapien
taatcaataagacaagactcagataygaccaagatgttggaactatcatc

SEQ ID NO: 67511 - DNA, 50 bp, homo sapien
atcaccttgtaaagcctgataatagraattgcaagaggccaagagaattg

SEQ ID NO: 67512 - DNA, 50 bp, homo sapien
caatcagttcagtttgaatggatcayggaattctgagtcaattcttgatt

SEQ ID NO: 67513 - DNA, 50 bp, homo sapien
aatttataattttttgatttccaagraagaagtctccaggcccagatagc

SEQ ID NO: 67514 - DNA, 50 bp, homo sapien
gaaaattatgtccgtaactaaccaargggtgaattgtccatcacagcagt

SEQ ID NO: 67515 - DNA, 50 bp, homo sapien
agaactcgacaccatcaatcaacatyatctaattaacatttatgggacat

SEQ ID NO: 67516 - DNA, 50 bp, homo sapien
tcctttactagtctcagtttttaagyctctgggtctctctcagctgctgc

SEQ ID NO: 67517 - DNA, 50 bp, homo sapien
ctttcctttccctcccaggctacackgtggagatattgtttggagagagg

SEQ ID NO: 67518 - DNA, 50 bp, homo sapien
tatggacaggttttacaactattgaracagttctaatcaactgtaggaat

SEQ ID NO: 67519 - DNA, 50 bp, homo sapien
atctttgttgctcctgtaataagccwatccctgtgcattgtacaatgtcc

SEQ ID NO: 67520 - DNA, 50 bp, homo sapien
gaacatatgatactttggtccattayaaccctgttagaccatagcccttg

SEQ ID NO: 67521 - DNA, 50 bp, homo sapien
ggaatcctgatctaaatacatttcartataagcacaaggcatccaacaga

SEQ ID NO: 67522 - DNA, 50 bp, homo sapien
ggtgacttgtgatgcttatacagtcrctagaacttaggcctgtgcagtga

SEQ ID NO: 67523 - DNA, 50 bp, homo sapien
gtgtcaatacatcagggagatataayactgagaaaaatataagcatttaa

SEQ ID NO: 67524 - DNA, 50 bp, homo sapien
cctcagtttgaaaacaagtgaccacrgacagtaatttgaatacacaaaca

SEQ ID NO: 67525 - DNA, 50 bp, homo sapien
tcacctcaccagtgtcactgcagccrgatccctaaccccattcttgatga

SEQ ID NO: 67526 - DNA, 50 bp, homo sapien
ggatggatatgaagagatactagaargtggaatagtgagccagcaatagt

SEQ ID NO: 67527 - DNA, 50 bp, homo sapien
tcacaaatactaacccctgattatgyaagctaagcactgtacctctcatt

SEQ ID NO: 67528 - DNA, 50 bp, homo sapien
gaagtgagggatgcagggaaacttcyaaagcctaggaattcttgggaaaa

SEQ ID NO: 67529 - DNA, 50 bp, homo sapien
gctattcctctattaaatgtcagcaycttcagggcaaaaattcagaggga

SEQ ID NO: 67530 - DNA, 50 bp, homo sapien
attctaaatctgtatttcaaatctcwatattatacttatgttttaggata

SEQ ID NO: 67531 - DNA, 50 bp, homo sapien
ctctggggacatttagttggcccaaycatgatgaattaggtgccccttca

SEQ ID NO: 67532 - DNA, 50 bp, homo sapien
ctagaatgagagccaagaagtgaaasagaatatggtctgatgaagcaact

SEQ ID NO: 67533 - DNA, 50 bp, homo sapien
tatgtaaatttttgattggtaaagaycttggaaatgaaatcttaattaat

SEQ ID NO: 67534 - DNA, 50 bp, homo sapien
aggctggagtgcagttggtattcacyggtgtgaccctagtacactgcagc

SEQ ID NO: 67535 - DNA, 50 bp, homo sapien
caatttactgtctctttcaatcagartcggtttctttggctttacctttg

SEQ ID NO: 67536 - DNA, 50 bp, homo sapien
ataaaggatatctacaaaaaacctayacagctacaacacatttaataaat

SEQ ID NO: 67537 - DNA, 50 bp, homo sapien
catcacagatgaggaagtgaaactcrgataaattaaattcagatcacaca

SEQ ID NO: 67538 - DNA, 50 bp, homo sapien
tccctgcagtttaattatcctcaacrttactgccataccctacatttttg

SEQ ID NO: 67539 - DNA, 50 bp, homo sapien
ggaactcctccttgactcattctatkaagctagcatcatcccgataccaa

SEQ ID NO: 67540 - DNA, 50 bp, homo sapien
taactctttcccaattctatacccasttctttacctcaccacaacacctc

SEQ ID NO: 67541 - DNA, 50 bp, homo sapien
aagggttgctcagagcagcaaaatayagatgtaagttgtcagaagtggaa

SEQ ID NO: 67542 - DNA, 50 bp, homo sapien
gtatatcagagatgtaggctgttcayaatacttgccattactagttattc

SEQ ID NO: 67543 - DNA, 50 bp, homo sapien
aaggagggctacttgactggcgcaayggtgatacggcatcggtgccttcc

SEQ ID NO: 67544 - DNA, 50 bp, homo sapien
ccctggtagcactctaagtctaaagkagtctaagtctcagtcatcctctg

SEQ ID NO: 67545 - DNA, 50 bp, homo sapien
gttgcttctcagtgctatgaccacartatttttctccattcacccttgtt

SEQ ID NO: 67546 - DNA, 50 bp, homo sapien
accactgcaattgttccctaacttaygtgcctaatccatttttaaattcc

SEQ ID NO: 67547 - DNA, 50 bp, homo sapien
catagcactgagaagcaaccaactgmagaagaagtggagactttccagcg

SEQ ID NO: 67548 - DNA, 50 bp, homo sapien
catttattattagttgcagttagaawtcaaagttgacaggtctaccaaaa

SEQ ID NO: 67549 - DNA, 50 bp, homo sapien
gacataggctctaaaggtgaggttgmataagttgcttgcagactcttgat

SEQ ID NO: 67550 - DNA, 50 bp, homo sapien
caaacttctctgtctctcatctattyatgaatttcctttcagttgcattc

SEQ ID NO: 67551 - DNA, 50 bp, homo sapien
gataccagagcaataaggtataatamgtcaaggaaaaaagaattcccatt

SEQ ID NO: 67552 - DNA, 50 bp, homo sapien
ttttgaggataggtaaagaggattayggtcatccagaggagaaactgagg

SEQ ID NO: 67553 - DNA, 50 bp, homo sapien
cgtttagagacaccatagaattgtayagaaccttaggtatcaaactgggt

SEQ ID NO: 67554 - DNA, 50 bp, homo sapien
gacaactgtaaaatgatttgagagasaatcttggaaaacttgaatactcc

SEQ ID NO: 67555 - DNA, 50 bp, homo sapien
tagctgtattgtttttttaaaggaargataacaatgccttgtgaaaaatt

SEQ ID NO: 67556 - DNA, 50 bp, homo sapien
ttagaagagcaactttcatctcacasgatagtgatctaaggagtcaggat

SEQ ID NO: 67557 - DNA, 50 bp, homo sapien
agagaagactctgcaatctttctccragaaatcccttctctaagaaaggc

SEQ ID NO: 67558 - DNA, 50 bp, homo sapien
ccttccttggtagttacagtgcttcragagacacaattcagtctaagtta

SEQ ID NO: 67559 - DNA, 50 bp, homo sapien
ttttgttttatttggagcaattatasatagtactgcatttttaattttgg

SEQ ID NO: 67560 - DNA, 50 bp, homo sapien
cctccctgacctcgtcttctactacyatcttctatgttcacttctttcca

SEQ ID NO: 67561 - DNA, 50 bp, homo sapien
ctaagtagttcatttttttgagtgckgatgtaaatgatattgtattttta

SEQ ID NO: 67562 - DNA, 50 bp, homo sapien
cctggttaagtggatttttggactamattatccagtttgacttaaagtca

SEQ ID NO: 67563 - DNA, 50 bp, homo sapien
ttgtctatacctaatattcttttccyaatcatttttctcctttccctctc

SEQ ID NO: 67564 - DNA, 50 bp, homo sapien
acgagtcacagtaatctttcttccaygtaaatagctgtattcttctacag

SEQ ID NO: 67565 - DNA, 50 bp, homo sapien
gaatcagtgttaggcttgtttcattmaataggatgtagtagaattccttc

SEQ ID NO: 67566 - DNA, 50 bp, homo sapien
cggggctggtggcctcgagtgtaaarttcaggtaggaaatagcaaacatg

SEQ ID NO: 67567 - DNA, 50 bp, homo sapien
tggctatccaagttcccatttaaatsaagaaggagcaccatggtctaatc

SEQ ID NO: 67568 - DNA, 50 bp, homo sapien
agtaaactagtagatttccctgacayggtaattggccttactgtctagag

SEQ ID NO: 67569 - DNA, 50 bp, homo sapien
atatgttataaacgtcaacataagakaagtagtttggggtgcattttctg

SEQ ID NO: 67570 - DNA, 50 bp, homo sapien
ctctcctaggttctccctgtgaagaycatactggcaatgaagtgttgtag

SEQ ID NO: 67571 - DNA, 50 bp, homo sapien
tagattgctctcctgtgctctttcaytacactccatagagttttttatcc

SEQ ID NO: 67572 - DNA, 50 bp, homo sapien
gtttcaatctatctgtagtgcagcawcactgagagaacaagccctgctat

SEQ ID NO: 67573 - DNA, 50 bp, homo sapien
gaattgccaagaggaaggtcttaaasgaatagcttcttgggtgtctctcc

SEQ ID NO: 67574 - DNA, 50 bp, homo sapien
agcttggacacttcacaagtcaagaragtgttgccttacttctttgtttc

SEQ ID NO: 67575 - DNA, 50 bp, homo sapien
aagaaacatctattgtttagcagccragagtatgaagggaactactacta

SEQ ID NO: 67576 - DNA, 50 bp, homo sapien
tagttgttgggtctacagtccaaackgaagggtatgatggtggaaacttg

SEQ ID NO: 67577 - DNA, 50 bp, homo sapien
ttaattttcatgcctcatttctcccraggttcccgctgtccatattttac

SEQ ID NO: 67578 - DNA, 50 bp, homo sapien
atatttgcttgcaagcttctatggcrctgccgaattctacagtaaatatt

SEQ ID NO: 67579 - DNA, 50 bp, homo sapien
cagaagggtggaggtagagagaatgraaattaaaatatagctttttatac

SEQ ID NO: 67580 - DNA, 50 bp, homo sapien
gcaggaccaactagggcaaaataatsaagaggccacatttcaggccttac

SEQ ID NO: 67581 - DNA, 50 bp, homo sapien
gacttaagtggtttataaaaggtcamaaagctaaatacaggacagagtca

SEQ ID NO: 67582 - DNA, 50 bp, homo sapien
ttgctaataatctctaacttcagtamgctttgcagggttgtttgagacag

SEQ ID NO: 67583 - DNA, 50 bp, homo sapien
aaaaacagtattgttgtctcagtacwattagattaaaagagtacaggact

SEQ ID NO: 67584 - DNA, 50 bp, homo sapien
aaaaggccacccactcctatttgctrggcatcgaccacccaaactgctgg

SEQ ID NO: 67585 - DNA, 50 bp, homo sapien
ctttgaagccctttcgtatgttttawcttgattctcacaacaaaatcaag

SEQ ID NO: 67586 - DNA, 50 bp, homo sapien
cctctttgacttggatttgtgataaraaagtaagttttgggagggcgagg

SEQ ID NO: 67587 - DNA, 50 bp, homo sapien
ttgtcgccagatatgtcaataggtaygcctaggaaaggcctccatggttc

SEQ ID NO: 67588 - DNA, 50 bp, homo sapien
tgttgggacttcaagaggactcttarcacatcggcaggtgttggttttag

SEQ ID NO: 67589 - DNA, 50 bp, homo sapien
ggcagtgtctaattccactagaaaarttttacctacaatttaaacttaaa

SEQ ID NO: 67590 - DNA, 50 bp, homo sapien
ctgaatccgatgtatctgagttacayctatgagctacttaataaatatat

SEQ ID NO: 67591 - DNA, 50 bp, homo sapien
agaaacctctgctttcctgattgtcraattcctcttacttgattaccttc

SEQ ID NO: 67592 - DNA, 50 bp, homo sapien
tttgacaaatggattataaagagacrcgtaggctaagaaaatacttactc

SEQ ID NO: 67593 - DNA, 50 bp, homo sapien
tcacctcaatttaattaagatcacartacaaggaccgcaagcaacaaaaa

SEQ ID NO: 67594 - DNA, 50 bp, homo sapien
gatagacatttattggtttcttttckaatagagatcttgctgaaatgtat

SEQ ID NO: 67595 - DNA, 50 bp, homo sapien
cattcattgcctaccttggctcttgrcactagagttccagagatgtgggt

SEQ ID NO: 67596 - DNA, 50 bp, homo sapien
atcagcagctagcactagatgattayaatgtagatggcttaatacctcat

SEQ ID NO: 67597 - DNA, 50 bp, homo sapien
agtacagacagtaatatagtacagamaattcatttgagcagtgaaaataa

SEQ ID NO: 67598 - DNA, 50 bp, homo sapien
aagcgccggggcatgtggaagttcawctccgcgccggaagcacggtgtgc

SEQ ID NO: 67599 - DNA, 50 bp, homo sapien
agatcaggtccatgaggagtaaagayattatacaaaacaatgttgagtgg

SEQ ID NO: 67600 - DNA, 50 bp, homo sapien
attttcctcttctgtactgtgagagrattgaactagataatctgagtttc

SEQ ID NO: 67601 - DNA, 50 bp, homo sapien
aaacagttgaaatccatcaacactgkagtagggttgtcattctcttatga

SEQ ID NO: 67602 - DNA, 50 bp, homo sapien
atcaaaataattgcttttgcacaaaractaaccttccccagctttatttt

SEQ ID NO: 67603 - DNA, 50 bp, homo sapien
gagtgtccagttgaaagagccagctycacaaccagacacacccaagttcc

SEQ ID NO: 67604 - DNA, 50 bp, homo sapien
cccagatgtccatcataaaacgtacraaacagcttggaaataggtactgt

SEQ ID NO: 67605 - DNA, 50 bp, homo sapien
gtgtgttgaataaggagacagttaaktctgaggcagccctcatttttttt

SEQ ID NO: 67606 - DNA, 50 bp, homo sapien
cctaaacaaatgtgtgcaaaggttaragaactagaatacaatagaaaccc

SEQ ID NO: 67607 - DNA, 50 bp, homo sapien
gagactgaagatacacacaagttaayaggcatacagcaagaggggagtga

SEQ ID NO: 67608 - DNA, 50 bp, homo sapien
agtgccctgacatgttaggagtggcragattactaaatcaacgtgataaa

SEQ ID NO: 67609 - DNA, 50 bp, homo sapien
ggaagaaagtgagagtcatactgaayatacttaagtttagagagaaggat

SEQ ID NO: 67610 - DNA, 50 bp, homo sapien
aagtgccttgctcagcttcagcgtayagacaatgctcaatacatgttgga

SEQ ID NO: 67611 - DNA, 50 bp, homo sapien
ttattgtatttcctttcctatgaagrattattacagtttctactagtctt

SEQ ID NO: 67612 - DNA, 50 bp, homo sapien
agacgttgctgtgggtctcaagaacratctgtgaaaaaacagttttgggg

SEQ ID NO: 67613 - DNA, 50 bp, homo sapien
tccaaatacccagtgtcttaattatygtagctatatagtaaatcttaaaa

SEQ ID NO: 67614 - DNA, 50 bp, homo sapien
ggcataagaaagactccagggacatwaatatctggtgcagtcacagagtc

SEQ ID NO: 67615 - DNA, 50 bp, homo sapien
aacacctcctttgacatttatttaargaatcatattttcaggagcaagaa

SEQ ID NO: 67616 - DNA, 50 bp, homo sapien
aatagaataattttagagtttttgaytaatacacaagaggtcaaaaaggg

SEQ ID NO: 67617 - DNA, 50 bp, homo sapien
actctctcctccttgtcgcctgtcarattcctacttgtctatcaaggtct

SEQ ID NO: 67618 - DNA, 50 bp, homo sapien
attttcctacaccaaatcatgagttycttgagtgtgagaaataacttatt

SEQ ID NO: 67619 - DNA, 50 bp, homo sapien
ttcaggcaaacgctggaaagcacaaygtgggttgaaactggtaagcagtc

SEQ ID NO: 67620 - DNA, 50 bp, homo sapien
agagagaagacattcttgacccaacrgtagtgaaagttctccaccattat

SEQ ID NO: 67621 - DNA, 50 bp, homo sapien
gagaaaaagaatgaaatgtaatatayggcactgagaacacactatgggag

SEQ ID NO: 67622 - DNA, 50 bp, homo sapien
tttaaaataaattttgggtataacamatccttagcttgttcttcccaatt

SEQ ID NO: 67623 - DNA, 50 bp, homo sapien
agaacaggaattgaagcacataaccraagtcatcagcacaggcacatgcc

SEQ ID NO: 67624 - DNA, 50 bp, homo sapien
acctagaatatgcagctatataagamagttaaataaacaagtctgcttag

SEQ ID NO: 67625 - DNA, 50 bp, homo sapien
caggttttcatggaagaagaagaacractaagctgcctctagaaaaaatt

SEQ ID NO: 67626 - DNA, 50 bp, homo sapien
attgcgtgataaacgattgctctcaygattatgacttacagcttcccatc

SEQ ID NO: 67627 - DNA, 50 bp, homo sapien
aagggaaaaaagaaagtaatgactgygctttggcccccaaaatgttatct

SEQ ID NO: 67628 - DNA, 50 bp, homo sapien
acccagtcacctactgcaagcactarcatgataagggcaaaactgttccc

SEQ ID NO: 67629 - DNA, 50 bp, homo sapien
cacatagctctacctccattcatttrccgccttacctggaaaagcagcct

SEQ ID NO: 67630 - DNA, 50 bp, homo sapien
tatacatatgatttcccatctttgcyataattttgatttattttagtact

SEQ ID NO: 67631 - DNA, 50 bp, homo sapien
tcaactaattcaagaggcatgctaartctccattgttttctgtagttcag

SEQ ID NO: 67632 - DNA, 50 bp, homo sapien
gttttctagattttattcataattamaattccaagctttgatcattcttt

SEQ ID NO: 67633 - DNA, 50 bp, homo sapien
gcttgttactgtagcatgacttcacraaagctgactggtcaaaagtaatt

SEQ ID NO: 67634 - DNA, 50 bp, homo sapien
tgccatttaatgctcatgcattttayaactctttgcatgcattctgttaa

SEQ ID NO: 67635 - DNA, 50 bp, homo sapien
gctcccaagctatgacattgtagaaktgagggatagttaggcctggggtt

SEQ ID NO: 67636 - DNA, 50 bp, homo sapien
gaatttttttccttcaaaattttcartaacaaagcattgcagatcctgtt

SEQ ID NO: 67637 - DNA, 50 bp, homo sapien
atgaaaaatgtaatttgctaggtcaycattgagtaggaatgtctggaaca

SEQ ID NO: 67638 - DNA, 50 bp, homo sapien
caggtaaagactttctgctaccaaarttgttcaaagcctgacttaattga

SEQ ID NO: 67639 - DNA, 50 bp, homo sapien
aagacctctcttcttgcctcttctastaataaggatttcctttctaccag

SEQ ID NO: 67640 - DNA, 50 bp, homo sapien
cccacacatggcagctgagggtagakgctaagctttatagattactcttg

SEQ ID NO: 67641 - DNA, 50 bp, homo sapien
cttgttcctttgaggagctcaaagasgaatcaggatccagctctctgcca

SEQ ID NO: 67642 - DNA, 50 bp, homo sapien
tgctcctgactcttagtttcaacccrcttgccatgatttccccatttcca

SEQ ID NO: 67643 - DNA, 50 bp, homo sapien
tgctctgaggggcaggagttatccaratcccacttctcagctgagttcaa

SEQ ID NO: 67644 - DNA, 50 bp, homo sapien
tcagacagtctggacatgtactgtaycacttaccagatatacaaagagca

SEQ ID NO: 67645 - DNA, 50 bp, homo sapien
aacgtggtctagaatttttcacaaarctgaatggtattcatctttcacct

SEQ ID NO: 67646 - DNA, 50 bp, homo sapien
attcatctttcacctccaattcctasaccaactacatagaatacgggagt

SEQ ID NO: 67647 - DNA, 50 bp, homo sapien
gtgtgtgtgtttgaattagtggtatsagaggctctattgactttaatttt

SEQ ID NO: 67648 - DNA, 50 bp, homo sapien
cctaataaacataatgataactcccwtttttggagcccttgatgtgtcag

SEQ ID NO: 67649 - DNA, 50 bp, homo sapien
gtgtggtagtcaagggaaatattaayaggtcttgcatacacacacaatag

SEQ ID NO: 67650 - DNA, 50 bp, homo sapien
ggcaaagaggagaagtatcggttacragcttcactgttcatcagtgcaaa

SEQ ID NO: 67651 - DNA, 50 bp, homo sapien
actggataagcttgatctaatctaayctgatttaatcactatcccaagac

SEQ ID NO: 67652 - DNA, 50 bp, homo sapien
accatgtttgcctactcaaggaatcsaaaactgttttatatgccaagtta

SEQ ID NO: 67653 - DNA, 50 bp, homo sapien
atgtgcatgcagtgggttattaaaayggatggcaggctccacagtgatgt

SEQ ID NO: 67654 - DNA, 50 bp, homo sapien
tccataagcatacaatgtttcagtgmgtacacagtcaacaccactatgaa

SEQ ID NO: 67655 - DNA, 50 bp, homo sapien
gtcaattagtttccaatgcttgtcarttctgcctttaatttcctattatc

SEQ ID NO: 67656 - DNA, 50 bp, homo sapien
gggccacttgaagttagggtgcacartaccaatgcaagctgctatcacaa

SEQ ID NO: 67657 - DNA, 50 bp, homo sapien
actcactgaagactacccttagtgcygatgccttgttcagctttgctgct

SEQ ID NO: 67658 - DNA, 50 bp, homo sapien
ggcatagatgacttttgaaatgacayagtgtgagatgtgcccttgagaga

SEQ ID NO: 67659 - DNA, 50 bp, homo sapien
cttgcctgaatacctgacaaaattgygtgatatgacaaaatggagttgtt

SEQ ID NO: 67660 - DNA, 50 bp, homo sapien
atttgattgaatgatttgagtctaaraacaaggcagtgtgaatatgtaaa

SEQ ID NO: 67661 - DNA, 50 bp, homo sapien
acttcctttgtgcctttaacgctgcmagttggagagacattttcagaaat

SEQ ID NO: 67662 - DNA, 50 bp, homo sapien
agtgtagtctctgtatagtttcttayaaatgagtcttggggtgttggttc

SEQ ID NO: 67663 - DNA, 50 bp, homo sapien
acacaattaataatttggaagctcartatgcctgttatacttctgggcac

SEQ ID NO: 67664 - DNA, 50 bp, homo sapien
tcttcagctactgatttttagaacamcacagggctgcggaagagaggtaa

SEQ ID NO: 67665 - DNA, 50 bp, homo sapien
agaacgccatacttcttaacataaaytgcatgtaagagcttttttccttg

SEQ ID NO: 67666 - DNA, 50 bp, homo sapien
ttttaggttcctatcacataaaatcrctgtttatttgcctagaatggaca

SEQ ID NO: 67667 - DNA, 50 bp, homo sapien
tgtctgctcttgctcttcaagttgaycttttatgatgtcttttccttctg

SEQ ID NO: 67668 - DNA, 50 bp, homo sapien
catgttagattcccaaaatgataggmcagttcatggatagttcttacaaa

SEQ ID NO: 67669 - DNA, 50 bp, homo sapien
cagctttcaatctagccactatcaamtgatataaaaatatgaatcaccaa

SEQ ID NO: 67670 - DNA, 50 bp, homo sapien
ccttgatttcttttcctgtcatgccrccttgctccctggctattagttga

SEQ ID NO: 67671 - DNA, 50 bp, homo sapien
tagctagctaactatttatctcaatkatcttgaaatccttttcctcttca

SEQ ID NO: 67672 - DNA, 50 bp, homo sapien
ggcatcatagacagtgcttggtatartaagcagtaggtagactttgaggt

SEQ ID NO: 67673 - DNA, 50 bp, homo sapien
tatgttcacagccttaactgctgggmatttgagaagtctcagcagtagca

SEQ ID NO: 67674 - DNA, 50 bp, homo sapien
ttcatcacagaactatcacaaataaygcctagagtatttcttttagaaaa

SEQ ID NO: 67675 - DNA, 50 bp, homo sapien
gccactagatgatggagtgaattgcrgtatttaacaagaatagagtttga

SEQ ID NO: 67676 - DNA, 50 bp, homo sapien
tgtcagaaagacttcacagtataaarttgtttcgctttttcggaagacaa

SEQ ID NO: 67677 - DNA, 50 bp, homo sapien
ctataaagaactgcctgtgactaagyaatttataaggaaaagaggtttaa

SEQ ID NO: 67678 - DNA, 50 bp, homo sapien
ataaacctctctgaagatgtgcttckttattaatttcattcttgcttctt

SEQ ID NO: 67679 - DNA, 50 bp, homo sapien
caagtatgaattatccatcttgttcrttcttctgcttcaggaccagaact

SEQ ID NO: 67680 - DNA, 50 bp, homo sapien
agtatatagggaggtgattctggaaygtttgtttttcattataatcatgt

SEQ ID NO: 67681 - DNA, 50 bp, homo sapien
acctgaattcccatgtagcctctatsctgaccttaggcagcaagtcattc

SEQ ID NO: 67682 - DNA, 50 bp, homo sapien
ttaactctttagtcttggctgtgctmtgaaacctggaagtcgcccaagtc

SEQ ID NO: 67683 - DNA, 50 bp, homo sapien
gtagaattaataactttgagcattawaaacttccaaactgcatgtggttt

SEQ ID NO: 67684 - DNA, 50 bp, homo sapien
aactacactcaaaccagatatcttayatgggaagaattaatttttaaact

SEQ ID NO: 67685 - DNA, 50 bp, homo sapien
tattatctgtcttttttattatggcraatgagagtgatatctcattatga

SEQ ID NO: 67686 - DNA, 50 bp, homo sapien
gtagagaaactggaaacctcgtatayaggaaaatgaaaaaatggtacagc

SEQ ID NO: 67687 - DNA, 50 bp, homo sapien
tgtcatttctattcacgaggcaaaayctgtatctcagtttggtgaatagt

SEQ ID NO: 67688 - DNA, 50 bp, homo sapien
caggaattcatggtgatggtcattcraagagattaccacaacatttttga

SEQ ID NO: 67689 - DNA, 50 bp, homo sapien
gataagtcagccagtacatgataacrcgatttcaaaaagaagctcctcct

SEQ ID NO: 67690 - DNA, 50 bp, homo sapien
gatttcaaaaagaagctcctcctaawtcaggcctgtcccgtgattcagcc

SEQ ID NO: 67691 - DNA, 50 bp, homo sapien
attaaaatgggatcatattatacacsttgttctgtatcttgcttcttcac

SEQ ID NO: 67692 - DNA, 50 bp, homo sapien
actctaagccggtcattgcgataggmcctaatgaatgagaaattgtccct

SEQ ID NO: 67693 - DNA, 50 bp, homo sapien
ctgtatgcctccaaagcctgtggtaygtaaagacttgtgaggaaaagtaa

SEQ ID NO: 67694 - DNA, 50 bp, homo sapien
gggaaaagatattgaagcagaccatratatgatacctatattggagttag

SEQ ID NO: 67695 - DNA, 50 bp, homo sapien
agaagcaaggaaatatgactgataaytgaacaggggaaaagatattgaag

SEQ ID NO: 67696 - DNA, 50 bp, homo sapien
tttttctaacaaaaatagctctagcytcagtacccgccatgccatagctc

SEQ ID NO: 67697 - DNA, 32 bp, homo sapien
agcatagagaatcatamaaattatttagtgaa

SEQ ID NO: 67698 - DNA, 50 bp, homo sapien
aatccttggagaatgtttgtctgcaygatatttggtacctggcgtatcta

SEQ ID NO: 67699 - DNA, 32 bp, homo sapien
aagtagagtgctttctrtgtacctgctgagga

SEQ ID NO: 67700 - DNA, 50 bp, homo sapien
ctaaatccagacaaaccacatggtgragtgtgaagaaactcagatgtgtt

SEQ ID NO: 67701 - DNA, 50 bp, homo sapien
gtagaaagaaccagagatgtttaccrccaagaggcaaaggcctgagagga

SEQ ID NO: 67702 - DNA, 50 bp, homo sapien
ttagaaaaggaaaacaggttttgaaytatatatggtgaattaaacataag

SEQ ID NO: 67703 - DNA, 50 bp, homo sapien
tgaagaaactacctcaaggtgaagaygtgatccactgtggctaaaaatca

SEQ ID NO: 67704 - DNA, 50 bp, homo sapien
ctaaaatgagagtgaacgttataagmccataaagacaaataaaacggaga

SEQ ID NO: 67705 - DNA, 50 bp, homo sapien
gcagtatagcaagaccccatctctaycaatattttgaaaaaactagccag

SEQ ID NO: 67706 - DNA, 50 bp, homo sapien
cattcccctaatgaagttttctgtgkaatgtgaaatataaagcaggtaag

SEQ ID NO: 67707 - DNA, 50 bp, homo sapien
tgccattcacatttcatttcttgtgrcacctaacttttcagccttacagt

SEQ ID NO: 67708 - DNA, 50 bp, homo sapien
ttgtagcaatctaggttattaattayagtggcctgaatttgtgaggtggg

SEQ ID NO: 67709 - DNA, 50 bp, homo sapien
ttatagcaaatcttatcaccatgaaygtaatgaatcttcctgccaagtta

SEQ ID NO: 67710 - DNA, 50 bp, homo sapien
tagaggagggtggtaaaaaccagttsagagaaatttgtagatgttaattg

SEQ ID NO: 67711 - DNA, 50 bp, homo sapien
tagtattggtagtttctagtagactygagctgctgtgggggtctgtgcat

SEQ ID NO: 67712 - DNA, 32 bp, homo sapien
gcttttcagacaaagaygtagtgggggtgagt

SEQ ID NO: 67713 - DNA, 50 bp, homo sapien
tggctgtgatgtcctggctcttgaayggttctacctctcactcactcaca

SEQ ID NO: 67714 - DNA, 50 bp, homo sapien
ttagattctctccaacgttaggttcyaggagttttgtagttttacagttc

SEQ ID NO: 67715 - DNA, 50 bp, homo sapien
atatatcaaatgagtataatagtagyagctggccgatgaaggtgctgtga

SEQ ID NO: 67716 - DNA, 50 bp, homo sapien
gccaatggattgaaaaggaagaggayaaataagcattgttcacctaaaat

SEQ ID NO: 67717 - DNA, 50 bp, homo sapien
ggctgctgtagtaaagtattgcgaamtggatggactacaacaacagaaat

SEQ ID NO: 67718 - DNA, 50 bp, homo sapien
acatcagttcacttggctaatatacraggaggattctatcagagaaatgt

SEQ ID NO: 67719 - DNA, 50 bp, homo sapien
ttgcgtcctggtgaatgttcactggwtgaattttgggttttataatgaaa

SEQ ID NO: 67720 - DNA, 50 bp, homo sapien
agaaatacaggcagctgtctatatcygataggctacagttctggaagtgt

SEQ ID NO: 67721 - DNA, 50 bp, homo sapien
taaaagaaatcaggtaacagtgtctygttttcccttttacatccctgtgg

SEQ ID NO: 67722 - DNA, 50 bp, homo sapien
gctttagctattgaagacttcacaaygcaggggtagaaaacaggttcctc

SEQ ID NO: 67723 - DNA, 50 bp, homo sapien
tgtaaccaataaagagttcacaggtraatgaaaggaaatcagtgagaaat

SEQ ID NO: 67724 - DNA, 50 bp, homo sapien
attcattcaaccacttatatttgtaragaccattaagtgccaggcatttt

SEQ ID NO: 67725 - DNA, 50 bp, homo sapien
atcttgaccgcaggaaatcttctaargagcctctatgggtcattcatgca

SEQ ID NO: 67726 - DNA, 50 bp, homo sapien
cccttggctttggcagacttcctgtygatgggccaaacggtgttgcccgg

SEQ ID NO: 67727 - DNA, 50 bp, homo sapien
tgccccaccaaaatgaacacataaayaagaaatgcaagatccaagaaaca

SEQ ID NO: 67728 - DNA, 50 bp, homo sapien
ttttattaaacttctgccttgttcayagtctgatttctttaaggccttat

SEQ ID NO: 67729 - DNA, 50 bp, homo sapien
cacacacaccaacatagtctttaaayctgtcacaaaaatgggatataaag

SEQ ID NO: 67730 - DNA, 50 bp, homo sapien
acatcacatccatcattgtatctcaygttagctccatcagccttctccag

SEQ ID NO: 67731 - DNA, 50 bp, homo sapien
agatgggcagtctactaaattaagcrgaagagttctacagcaagtgaaga

SEQ ID NO: 67732 - DNA, 50 bp, homo sapien
tgtctgttgccaacgcccatgatcaytccactgtatcaacatcttgcact

SEQ ID NO: 67733 - DNA, 50 bp, homo sapien
tatcaacatcttgcactgcaggacasagagaagtaatattctaacatttg

SEQ ID NO: 67734 - DNA, 50 bp, homo sapien
ctaggttatccaaaatggatgctgarcagatttttaaaattctctgggaa

SEQ ID NO: 67735 - DNA, 50 bp, homo sapien
aaatacatgaagtggtgtgtgttacratattgactctgattaaattttaa

SEQ ID NO: 67736 - DNA, 50 bp, homo sapien
caggtttctttcttaggtgacttttyggagaagattagggaatgtagagg

SEQ ID NO: 67737 - DNA, 50 bp, homo sapien
cattcacaaaattaagattcaaggarcactgtatattgagttccttagta

SEQ ID NO: 67738 - DNA, 50 bp, homo sapien
ccctactgaaagctgctctcactacracaaacgaaagggtggaaatgtgc

SEQ ID NO: 67739 - DNA, 50 bp, homo sapien
tggcttcttcattcagagttatggamcagaaaattgaaagtggcatggca

SEQ ID NO: 67740 - DNA, 50 bp, homo sapien
cgcagagtactttttatagatatgcraaatcctttcgaattgatacttct

SEQ ID NO: 67741 - DNA, 50 bp, homo sapien
agtactgccttatttcttacaaagcrctagactataaagaaacgcatgag

SEQ ID NO: 67742 - DNA, 50 bp, homo sapien
agaatcgcattcttctgagatttgtyaatttcccttctctctagctctga

SEQ ID NO: 67743 - DNA, 50 bp, homo sapien
tttcactttagattctgagaaagtcragaaacagttatcaactccagtct

SEQ ID NO: 67744 - DNA, 50 bp, homo sapien
tagaatctggttgccttctaatttgsgccaaaatctctgaccactatgga

SEQ ID NO: 67745 - DNA, 50 bp, homo sapien
aggtcttttatatccataacactcayggttgttttccttctctgcctgaa

SEQ ID NO: 67746 - DNA, 50 bp, homo sapien
caaacccttttgcgaactgcgcacaygagggatctaagttgcacgctcct

SEQ ID NO: 67747 - DNA, 50 bp, homo sapien
ttgcaagtggaaatacgtacataaartcaagcaaatgataaatgtagaaa

SEQ ID NO: 67748 - DNA, 50 bp, homo sapien
actcacgcggtcaattgattgttgamcaaggaacagagtaattccattga

SEQ ID NO: 67749 - DNA, 50 bp, homo sapien
aatgggtagaacatccagataaaaaygtctactaggctttgggaactgaa

SEQ ID NO: 67750 - DNA, 50 bp, homo sapien
aactgaagacatgtactaattaccaycaaagaatgtgtgtgaacaggaga

SEQ ID NO: 67751 - DNA, 50 bp, homo sapien
gctagagtaaggaccataaggaagtraatatcccagtcctgtttgagaag

SEQ ID NO: 67752 - DNA, 50 bp, homo sapien
tgagccaacttaaccttatcaataaygggataagcttttgccaactggtg

SEQ ID NO: 67753 - DNA, 50 bp, homo sapien
aggcccaccttcttcattatgttcarcttaacttaaacctgtatttccat

SEQ ID NO: 67754 - DNA, 50 bp, homo sapien
aaaatgactaagataatgggtaaggmtgagaaagctgtaaaataattatc

SEQ ID NO: 67755 - DNA, 50 bp, homo sapien
aacatgggttttggtgtcaattgaamctaccagtattctaatactgatcc

SEQ ID NO: 67756 - DNA, 50 bp, homo sapien
tgtgccagcgatatctcagccatcawtcttgcatccaattttcctgttta

SEQ ID NO: 67757 - DNA, 50 bp, homo sapien
atctgtacaaaattctacaactagasctggttggatcagtattagaatac

SEQ ID NO: 67758 - DNA, 50 bp, homo sapien
aaaccttgctaatctttcagaaacartttgaaccttagcttgtatcataa

SEQ ID NO: 67759 - DNA, 50 bp, homo sapien
gtagtgactcaacttggggtggttgsccagctcattagccacccaggggt

SEQ ID NO: 67760 - DNA, 50 bp, homo sapien
caattagtgatcccctattcccttasaaaatcaaactccttaaaaatccc

SEQ ID NO: 67761 - DNA, 50 bp, homo sapien
cctgggaactctcctgagagaataarcttttgacaaacactctttgaaag

SEQ ID NO: 67762 - DNA, 50 bp, homo sapien
tcattgagtttgggcccatggacaaygcatacaagggaaatcttggaact

SEQ ID NO: 67763 - DNA, 50 bp, homo sapien
tttttgggcccagattacagtaacaygagaggttttgttggccacttggt

SEQ ID NO: 67764 - DNA, 50 bp, homo sapien
aatctaaaacaaaccaatttattaaycaaccatttactttattggcttaa

SEQ ID NO: 67765 - DNA, 50 bp, homo sapien
cccgcagctgttagagggctattccyaagagtttctagggttgaagtttc

SEQ ID NO: 67766 - DNA, 50 bp, homo sapien
atgcatttgctattttaccccgtggygtgctatgttgtctttgactttag

SEQ ID NO: 67767 - DNA, 50 bp, homo sapien
gcctccccttgtggtgtgtctgtcaygaacccagtcagccttcctcagac

SEQ ID NO: 67768 - DNA, 50 bp, homo sapien
aggaagttaggtctcaaattaacaamctgatatcacatcaagaggaacta

SEQ ID NO: 67769 - DNA, 50 bp, homo sapien
ttaaaccatcagatcttgtgagaackccttcactatcatgagaacagcat

SEQ ID NO: 67770 - DNA, 50 bp, homo sapien
taagggagtttagcttagtcccagcrtataacaattacttgcaaagtaaa

SEQ ID NO: 67771 - DNA, 50 bp, homo sapien
gctaatgagagaagacaaatctaacyagaagaggagacccggtgaacaca

SEQ ID NO: 67772 - DNA, 50 bp, homo sapien
acaatggtgaacatgccaactgaacwataaaatccagatgacaataaaat

SEQ ID NO: 67773 - DNA, 50 bp, homo sapien
agcatctcagagtgttttcccaggayggacgatttatcccattcggtaga

SEQ ID NO: 67774 - DNA, 50 bp, homo sapien
tcagagcctcagttgcctaatcgatsgaaagagggcatcggatcagattt

SEQ ID NO: 67775 - DNA, 50 bp, homo sapien
tgccatcagaaaactcattaaccacraaggctgtgggggccaatcaggcc

SEQ ID NO: 67776 - DNA, 50 bp, homo sapien
tggcaatggcctccatagtttcttamgtaaccaattaacaagtcaagtca

SEQ ID NO: 67777 - DNA, 50 bp, homo sapien
ctctgtcacaattaccaaacttcacyatgatagcacaaaagcagccacag

SEQ ID NO: 67778 - DNA, 50 bp, homo sapien
ataatctgcagtgtttttttgtacaragtgagcatgcaataaatggtaat

SEQ ID NO: 67779 - DNA, 50 bp, homo sapien
gacatgtgtcactttcgctcacgaaycattgacaaaactagccacatggc

SEQ ID NO: 67780 - DNA, 50 bp, homo sapien
actttgaaacctgtcagcttggcagraaatgtaatgcttctatctctggt

SEQ ID NO: 67781 - DNA, 50 bp, homo sapien
tctcccaccatcccccaaacttggaycatctataatcgtccatatctcag

SEQ ID NO: 67782 - DNA, 50 bp, homo sapien
attactacattttgcttgttatcctraatttgatggaatcatcaaaatcg

SEQ ID NO: 67783 - DNA, 50 bp, homo sapien
ttctactctcagaatcacctagatcrgatactgcagatgtttttagcttc

SEQ ID NO: 67784 - DNA, 50 bp, homo sapien
aggacacggaggacattacagagaartaaattgcatggcaataatagttc

SEQ ID NO: 67785 - DNA, 50 bp, homo sapien
accaagaaaccaagaagtcaaaaaayctcactctgcttaacgttatgttg

SEQ ID NO: 67786 - DNA, 50 bp, homo sapien
aaaatcaaccttgaataagaagagtkaagaagaatgtatctattagagtc

SEQ ID NO: 67787 - DNA, 50 bp, homo sapien
aagaatgacgtgatgaggcaggtgaygtattaaagtatttggcacagcgt

SEQ ID NO: 67788 - DNA, 50 bp, homo sapien
atctgagttaccgatgactggggctraataaaggtcatccactttctaag

SEQ ID NO: 67789 - DNA, 50 bp, homo sapien
tttcttcctcaaattctagaattggycaaaatattattcgaaagggaaag

SEQ ID NO: 67790 - DNA, 50 bp, homo sapien
aagaccctaccttctaataccatcaycttgagagttagaattcctttcaa

SEQ ID NO: 67791 - DNA, 50 bp, homo sapien
ctaacactctgtatagcttaggacascaacttcagtaatttggacctcag

SEQ ID NO: 67792 - DNA, 50 bp, homo sapien
acaacaattacagtgctctacaggamagatacaaattcagattgcagtgt

SEQ ID NO: 67793 - DNA, 50 bp, homo sapien
atgcagagggaggtggggatgtctcragttagcaggtaaaagcaatgttc

SEQ ID NO: 67794 - DNA, 50 bp, homo sapien
taggtgtaacaggaagttagagaaaratcagttattacatcaaaatatta

SEQ ID NO: 67795 - DNA, 50 bp, homo sapien
cctaagctgagtcctagagttcaaarggaaatgaaagtgaagtaaggaga

SEQ ID NO: 67796 - DNA, 50 bp, homo sapien
tcctagtcttttgaaattcaaaaacygcgaatggcctctttgttctctgt

SEQ ID NO: 67797 - DNA, 50 bp, homo sapien
acctatctatctatctatctgataarctctttaattgcctggcagtactt

SEQ ID NO: 67798 - DNA, 50 bp, homo sapien
aaaaggggaaaagaaatccctattgraacaagcatcccacatcttcttga

SEQ ID NO: 67799 - DNA, 50 bp, homo sapien
cccatctgcaatgccatcatagggarcacaactgtttaactgaacggacc

SEQ ID NO: 67800 - DNA, 50 bp, homo sapien
atgggagtggagatagtcctttagcscagaggaaaaaatgattggctttc

SEQ ID NO: 67801 - DNA, 50 bp, homo sapien
atccatggctgctacatttgaatccrctcaatagaataatcaaaagttca

SEQ ID NO: 67802 - DNA, 50 bp, homo sapien
aatcccttagtgctcggcggcctgaygaatcaagtgcgtgctatccagtg

SEQ ID NO: 67803 - DNA, 50 bp, homo sapien
cccgagctctctccctcgtagccaamgaatgtgatttttctgtgcttatt

SEQ ID NO: 67804 - DNA, 50 bp, homo sapien
tcttcagtcagattagatactacccraagctgatacacaacctttgactc

SEQ ID NO: 67805 - DNA, 50 bp, homo sapien
ttaaaattaatcagaggatcagttamggattaaaatgcaatattgaactc

SEQ ID NO: 67806 - DNA, 50 bp, homo sapien
cttttaacctcaagtggaccagaaamaaagtcaaggaggtgcccaccagc

SEQ ID NO: 67807 - DNA, 50 bp, homo sapien
tgctttcattagtccaaattagagamccttggctaatatgctgtttccaa

SEQ ID NO: 67808 - DNA, 50 bp, homo sapien
tcaagctgtacctcctgcactagacyaactgtaagagtgagacagatgcc

SEQ ID NO: 67809 - DNA, 50 bp, homo sapien
gaccacgaagcacatcagttcccacracaagggatggaaaatatgaaagc

SEQ ID NO: 67810 - DNA, 50 bp, homo sapien
taatttttcctatttgttatcatgakgatggttagttgagtatcatcctg

SEQ ID NO: 67811 - DNA, 50 bp, homo sapien
taaggcccaattctttcatccttctraattataaagaatgacacagggat

SEQ ID NO: 67812 - DNA, 50 bp, homo sapien
gctctgttccaggggaagtactaaayaatttgcttctacgaaaatcaata

SEQ ID NO: 67813 - DNA, 50 bp, homo sapien
gaactatgagtaaggcaaagaacacrcagctacagggacaaagaagagtg

SEQ ID NO: 67814 - DNA, 50 bp, homo sapien
taaataatggtttatcaagagcatayctattcaggccaagtgtcagccaa

SEQ ID NO: 67815 - DNA, 50 bp, homo sapien
aaattcaggtcttacaactttccacrcattgagtttcacgtgagatcttc

SEQ ID NO: 67816 - DNA, 50 bp, homo sapien
tgacgggctgaaaggtttggtttacrtgcagatgttttcaatgttgtgta

SEQ ID NO: 67817 - DNA, 50 bp, homo sapien
ccttctggttcaagaaaggctacgamtccttattaagttgctgtagtatt

SEQ ID NO: 67818 - DNA, 50 bp, homo sapien
atgaaaaaagaaatgttttaattaascacaatagtatttgtttatgttaa

SEQ ID NO: 67819 - DNA, 50 bp, homo sapien
tgaattacgcatgtgagggacctagkctgtgctccttatgagaatctaac

SEQ ID NO: 67820 - DNA, 50 bp, homo sapien
tggattaaacactttgcaaaacactyacaaataggttcagtgcatttggt

SEQ ID NO: 67821 - DNA, 50 bp, homo sapien
gtctgaatcatcattgtattaaaccrctcatccttaacaaatgcccaagc

SEQ ID NO: 67822 - DNA, 50 bp, homo sapien
tctgaaacccacttaaaaatgtccaygtgatcagtgtcttcctttcctgc

SEQ ID NO: 67823 - DNA, 50 bp, homo sapien
tgacctgggcctggacagtacagaaytctttaattataccagctaccact

SEQ ID NO: 67824 - DNA, 50 bp, homo sapien
gagagttggggggaggagaaagtaargtatttatgagaggagtggtagag

SEQ ID NO: 67825 - DNA, 50 bp, homo sapien
tgccttggagatgggtataataagcraggttagatcctaagatgctttgc

SEQ ID NO: 67826 - DNA, 50 bp, homo sapien
aagaaaaatcaccttgatgagagccwtattttaggaagtggaaattggca

SEQ ID NO: 67827 - DNA, 50 bp, homo sapien
tagatctacagaattaaattgcatamctgtgaacagacacttttcaaaag

SEQ ID NO: 67828 - DNA, 50 bp, homo sapien
agtgggggcattcctggacaaagacwtggagttaggaatagctttggcat

SEQ ID NO: 67829 - DNA, 50 bp, homo sapien
gttgttttctttttgctttaagttcrgctctcaaaatcatttgatgacaa

SEQ ID NO: 67830 - DNA, 50 bp, homo sapien
gctgggaatttctttaagaattgtaygcacattgtatcaaaatgtgcaaa

SEQ ID NO: 67831 - DNA, 50 bp, homo sapien
gaaaccaggaacgcagtgccgtttayagtagctgccaaaaaacaacaaac

SEQ ID NO: 67832 - DNA, 50 bp, homo sapien
ttcaagctacgaacgtgaggtcaccraaagcgttgggaagagatatgtac

SEQ ID NO: 67833 - DNA, 50 bp, homo sapien
acactgtagaggcctgagtttcatayggaaagggctgtgtttgaggcata

SEQ ID NO: 67834 - DNA, 50 bp, homo sapien
agacgttcattagaaatcagagaagmcttttcctttgagtaaaggacccg

SEQ ID NO: 67835 - DNA, 50 bp, homo sapien
agcagggcagagatcttggtatataygtcttgcctcaagctcaggaaaag

SEQ ID NO: 67836 - DNA, 50 bp, homo sapien
catcgggcttcttcttgttgatgtcratttccaagtactctgggcgctca

SEQ ID NO: 67837 - DNA, 50 bp, homo sapien
atgtctgtttgcctttgataagcagyaaagggtaaataaatgggaaatgg

SEQ ID NO: 67838 - DNA, 50 bp, homo sapien
tcttgctgcaaaggagagatacgatkataacattagatgccactcattgt

SEQ ID NO: 67839 - DNA, 50 bp, homo sapien
cctccaactcttgtgcaagctcaatragaacagggactgactcttcttcg

SEQ ID NO: 67840 - DNA, 50 bp, homo sapien
caggattatacagctattactgcaayctaattttaaactttttcaccacc

SEQ ID NO: 67841 - DNA, 50 bp, homo sapien
gaaatcggtatcactgggttgaaagmaagttgtctgcacctcttccagct

SEQ ID NO: 67842 - DNA, 50 bp, homo sapien
ctggtttgtaagccaaaattgaccastgaaaaaaattaggttcctaaaac

SEQ ID NO: 67843 - DNA, 50 bp, homo sapien
gtaaatatggtcaacaataatttackatatgctttcaaaaagctagaaga

SEQ ID NO: 67844 - DNA, 50 bp, homo sapien
cattattgtagtgattgagtattcayctgtaagatagtgacagacatcct

SEQ ID NO: 67845 - DNA, 50 bp, homo sapien
agtttgttaggactgttgtagcaaarttccataaataccttgtggtttaa

SEQ ID NO: 67846 - DNA, 50 bp, homo sapien
atgtattgcatataggtttaggagasagcattatctgggcatcgacagac

SEQ ID NO: 67847 - DNA, 50 bp, homo sapien
tttcattcactcatagcttctaactmactgaaggagctaggaccattatg

SEQ ID NO: 67848 - DNA, 50 bp, homo sapien
aacttgctttcaacccagtgataccsatttccaacttctggactctagac

SEQ ID NO: 67849 - DNA, 50 bp, homo sapien
gaataccaggattttaaatgagagaktattttacacatttattttagtca

SEQ ID NO: 67850 - DNA, 50 bp, homo sapien
gctggtcttgaattcctgagtttgarccatcttccagcctcagactccca

SEQ ID NO: 67851 - DNA, 50 bp, homo sapien
atgatcttaagctgtattattagggwtttaggtcagtcaatggccttcaa

SEQ ID NO: 67852 - DNA, 50 bp, homo sapien
gaacgtggagtcatcttggaggtcamatgcgtcgtttgcagcacgcaggc

SEQ ID NO: 67853 - DNA, 50 bp, homo sapien
atacgcatatctcatacaataagaargttatcgttaactgcccgtgtatg

SEQ ID NO: 67854 - DNA, 50 bp, homo sapien
tggcggcagaaaccctggagccaacrccttcgactgcccgatgctgggag

SEQ ID NO: 67855 - DNA, 50 bp, homo sapien
atgagggaatggtgaacaaataaaayggtaaataagtcattaattccaag

SEQ ID NO: 67856 - DNA, 50 bp, homo sapien
ggcaaataaataaataaacaaatacyacgaaggcagccagaaagcccacg

SEQ ID NO: 67857 - DNA, 50 bp, homo sapien
tttttattcatgctgtttgggatacrctgtgcttcctagatctgtggaat

SEQ ID NO: 67858 - DNA, 50 bp, homo sapien
tccaactgcatgtgggctggcaacargttagtacccccacaggatggagt

SEQ ID NO: 67859 - DNA, 50 bp, homo sapien
aaacatttatgggctctgctcttaaytgtctctttgcctacttggaccct

SEQ ID NO: 67860 - DNA, 50 bp, homo sapien
gtatgagaagaacacataatacaaakaacatacaagaaatgaccaggaat

SEQ ID NO: 67861 - DNA, 50 bp, homo sapien
tgcattccgacacaatacacttgacygggccaggtcctgggatcttcatt

SEQ ID NO: 67862 - DNA, 50 bp, homo sapien
taccctggactacactataacctccyaattagtcttcctacagcccctta

SEQ ID NO: 67863 - DNA, 50 bp, homo sapien
ggggaaattttcatgcctgaactagsaaactttgaataataagaggtttt

SEQ ID NO: 67864 - DNA, 50 bp, homo sapien
ttttgggaaattttgaaacatacgcmgaagtagagatgtagcataagagg

SEQ ID NO: 67865 - DNA, 50 bp, homo sapien
ttctccaggccctaaacatcacctayatgaggcttgagcatcccgattct

SEQ ID NO: 67866 - DNA, 50 bp, homo sapien
tatggtgagattgactgtttattccyaattgcactggacaatgtggtgaa

SEQ ID NO: 67867 - DNA, 50 bp, homo sapien
ctagacagatgaactactttaaaaawtttcagatctgaattcctcctact

SEQ ID NO: 67868 - DNA, 50 bp, homo sapien
gcagaggatggtaaatgtaagaacarctaaacttaactgggtcttcactg

SEQ ID NO: 67869 - DNA, 50 bp, homo sapien
cttagcttcccttcctttgggaaacsttccatcccttgctctagtctaga

SEQ ID NO: 67870 - DNA, 50 bp, homo sapien
ctggtggctcctcagcggtgaccaaygccggcactgcaggtgcacacaga

SEQ ID NO: 67871 - DNA, 50 bp, homo sapien
ggtggagtcatagaaccagactacawatcaaagttttctcaagcaggatg

SEQ ID NO: 67872 - DNA, 50 bp, homo sapien
ctttcctgaaatatcagatcactcargttattagaagacagaagcaactt

SEQ ID NO: 67873 - DNA, 50 bp, homo sapien
gaggacctcattctttaaaactttcrttaaacatggtgaatttcctttat

SEQ ID NO: 67874 - DNA, 50 bp, homo sapien
acagtgtgagttagctacaggtgaamtaactctaggtctgaggttcttgg

SEQ ID NO: 67875 - DNA, 50 bp, homo sapien
accaatggcgcaaacaagagtgcacrgaagtgaaaaatgcggtaacacct

SEQ ID NO: 67876 - DNA, 50 bp, homo sapien
ttcctaaagcacttcaaatcttatamaattccttatcaaattacactatt

SEQ ID NO: 67877 - DNA, 50 bp, homo sapien
ggtagccattaatattactgctatamacaagggagttcagaaatttaaat

SEQ ID NO: 67878 - DNA, 50 bp, homo sapien
gcgaagtcttaggtaaggtgttttayagcggagcacacatgttatatgta

SEQ ID NO: 67879 - DNA, 50 bp, homo sapien
gcctaggcaaagaagtaagtcttcamgcagggagacctgttctgagaaga

SEQ ID NO: 67880 - DNA, 50 bp, homo sapien
tactgtatgattcctctcattcccaytgatttcagaaacagtgtttggag

SEQ ID NO: 67881 - DNA, 50 bp, homo sapien
ccataataaaactgttgtgttaagcrataagcagcttcttcatgtgaaac

SEQ ID NO: 67882 - DNA, 50 bp, homo sapien
ttttctttttccaaactctctacaayggaaattttcaatcacgtgccaaa

SEQ ID NO: 67883 - DNA, 50 bp, homo sapien
ctgtacagtttgagtcctttacagaygttgagagtgctggctttggaatc

SEQ ID NO: 67884 - DNA, 50 bp, homo sapien
aagatactttgttgtccaggaagaaygtctaaatcacaaataataccaca

SEQ ID NO: 67885 - DNA, 50 bp, homo sapien
aggtggcccagcgccatgaagagaargtgtatctgtccagaggggatgag

SEQ ID NO: 67886 - DNA, 50 bp, homo sapien
ctctggatatgatatatttcctttcyctgactacttttaagatttttcac

SEQ ID NO: 67887 - DNA, 50 bp, homo sapien
tagtttagcaggtcaaagcaccgtawcttggggtattggtttctgagccc

SEQ ID NO: 67888 - DNA, 50 bp, homo sapien
aaccccttctttgtttctcccggaartgatgataaattcatgggtttgcc

SEQ ID NO: 67889 - DNA, 50 bp, homo sapien
aacccagggggtcatagggaaatgartaaactacaaagtttccttagtat

SEQ ID NO: 67890 - DNA, 50 bp, homo sapien
cttgcatctagtaagcacttggaagyaaatgcatgttgaaataaattgtg

SEQ ID NO: 67891 - DNA, 50 bp, homo sapien
atgtatagtgaaagagaaagatatcrcacacagaaaaagaaagaaagagt

SEQ ID NO: 67892 - DNA, 50 bp, homo sapien
cccaagcacagggaggatggttccaytgcctgctaggagcctctgatgct

SEQ ID NO: 67893 - DNA, 50 bp, homo sapien
aaaggcatgcccacttttggacatamggtttgagcttgaaaaatgtattt

SEQ ID NO: 67894 - DNA, 50 bp, homo sapien
cgagccccagacccatagatacaaaytcctaatggacgtgtccgtgtgga

SEQ ID NO: 67895 - DNA, 50 bp, homo sapien
gccatgtgacagtactaaagtgaccrgcatgtcagtgaagcatgaaatgg

SEQ ID NO: 67896 - DNA, 50 bp, homo sapien
gaaaaatgacagcgattatggctgtsacagaaatatcattacgttctaat

SEQ ID NO: 67897 - DNA, 50 bp, homo sapien
tgttttgtgtttaaaacagtggagawattgtagattcagaaagggagagc

SEQ ID NO: 67898 - DNA, 50 bp, homo sapien
tctgggagggctatccgagtcatacragggcaagaaaatagctcttatcg

SEQ ID NO: 67899 - DNA, 50 bp, homo sapien
cccttctcttcccaagctcaggaaaygtcagctgtaatcagtagggcatt

SEQ ID NO: 67900 - DNA, 50 bp, homo sapien
taggcactcaataaatatgtattgayagactgattagacaatgctttgtt

SEQ ID NO: 67901 - DNA, 50 bp, homo sapien
actctacctacttcaggtgacctaaraaaaatcacaggagctgatctaat

SEQ ID NO: 67902 - DNA, 50 bp, homo sapien
aaagcacctaaaataattcctgataygtaataagaactaactaaatggta

SEQ ID NO: 67903 - DNA, 50 bp, homo sapien
ttgttccagacactagaaccgacaayaagatataatccttgccttaaaaa

SEQ ID NO: 67904 - DNA, 50 bp, homo sapien
acaaaaactgcatggccagcaagggmagtgttatacgctcactttactaa

SEQ ID NO: 67905 - DNA, 50 bp, homo sapien
acttttaacaaatcccttaaatgaayaggtttacactctgacccgagggc

SEQ ID NO: 67906 - DNA, 50 bp, homo sapien
tcatagagtcgttgcaccttactacygaatagaagttgaggggttatttg

SEQ ID NO: 67907 - DNA, 50 bp, homo sapien
gatttctagaaatattcttgagagaygctataataaaaatttagctactt

SEQ ID NO: 67908 - DNA, 50 bp, homo sapien
gtgtgaagatattgactgaccagagrcagaaagctttacaaggaacacaa

SEQ ID NO: 67909 - DNA, 50 bp, homo sapien
agacaaggtcagtttagtaacttgargagtgtgattaagcccaaacctct

SEQ ID NO: 67910 - DNA, 50 bp, homo sapien
ctttttaaaaacctttctcttcttaygtatacaggttgttggtgttagac

SEQ ID NO: 67911 - DNA, 50 bp, homo sapien
gaagcaaattttgcaaagatatgacrgtaaagtatgactcaagacttcgg

SEQ ID NO: 67912 - DNA, 50 bp, homo sapien
aggtttcctttagccaaaacattctraaattatgaggttacacaattgag

SEQ ID NO: 67913 - DNA, 50 bp, homo sapien
aaatggattataattgcattgtgtaygagaatagatactagtgtttttgt

SEQ ID NO: 67914 - DNA, 50 bp, homo sapien
tcatttaacagtatgttctgggaatygctccatatcaatagagatctttc

SEQ ID NO: 67915 - DNA, 50 bp, homo sapien
gacccatgcctggcctaagtttataygcaaggacaaaaacttcttcatta

SEQ ID NO: 67916 - DNA, 50 bp, homo sapien
gaggcaccatcactggggtatcagcyatctcatctcaggatcccacctta

SEQ ID NO: 67917 - DNA, 50 bp, homo sapien
ttaggttaattaatttagatttaacrcccatgcttaactggttttattgt

SEQ ID NO: 67918 - DNA, 50 bp, homo sapien
gttatcgtcaatacatacgcagtcartagaattatttaaatgctcctgtg

SEQ ID NO: 67919 - DNA, 50 bp, homo sapien
gagagagtagcaagagacagcgtaargcctcccttttccaccagaaccct

SEQ ID NO: 67920 - DNA, 50 bp, homo sapien
tttctatctgggtttccatggctcaratgagataatacatgaaaattcct

SEQ ID NO: 67921 - DNA, 50 bp, homo sapien
ggaaaattgtcctcggttgagaagcmctagaatagagaaatatcaaatta

SEQ ID NO: 67922 - DNA, 50 bp, homo sapien
cggcccttaatgtatacctattaacrgccaggtacgatgactcacgcctg

SEQ ID NO: 67923 - DNA, 50 bp, homo sapien
taggaaggtttcaggcatgccaatcyaccgagtcagttgggaatgctttt

SEQ ID NO: 67924 - DNA, 50 bp, homo sapien
ggtgagctacggccaccattcagtgsatgcgttctgggaagacttggcgg

SEQ ID NO: 67925 - DNA, 50 bp, homo sapien
ttcgtctttgtccatgctggtttctwacacaaggaggcagatgaaatagc

SEQ ID NO: 67926 - DNA, 50 bp, homo sapien
acacaaaaaaagtaaaaatatcttayggtatcacaagaaagaacggtatc

SEQ ID NO: 67927 - DNA, 50 bp, homo sapien
gatggagaattcattgatatttccaygcagttagaagaaaaacagaaaaa

SEQ ID NO: 67928 - DNA, 50 bp, homo sapien
tgtcatttttttaatgtggagttcaygtaactttgaagatagaaatgaaa

SEQ ID NO: 67929 - DNA, 50 bp, homo sapien
tccatgcaaagactgggaaaaagaayatccagatcaagggaaacagcatg

SEQ ID NO: 67930 - DNA, 50 bp, homo sapien
gccatcatcctttatcatttgcagargtagtataaagattaaaggggtag

SEQ ID NO: 67931 - DNA, 50 bp, homo sapien
tatctcatctgaaaatgtcatcccastgtcatcttgacagcaaaaatgtg

SEQ ID NO: 67932 - DNA, 50 bp, homo sapien
ggttaaaaattattttaagagtcccrggaaaagacagaaggatagcatac

SEQ ID NO: 67933 - DNA, 50 bp, homo sapien
ttagttcaggcatatattctctggcrgaaactctgaatttccagcatctt

SEQ ID NO: 67934 - DNA, 50 bp, homo sapien
tgatctagtttattgcttgatagacmctggaaagcagaataatgcttaac

SEQ ID NO: 67935 - DNA, 50 bp, homo sapien
gatatctcaccattttctcctatagrccacttcctcttttagttcaggca

SEQ ID NO: 67936 - DNA, 50 bp, homo sapien
agagtgggtggggagaatgaatagamataaacctagaataatgataaatg

SEQ ID NO: 67937 - DNA, 50 bp, homo sapien
tggccaaaatatgtattttaaacaawcctctcaacaattatgtaaggtgg

SEQ ID NO: 67938 - DNA, 50 bp, homo sapien
gatgttggccaaagaaagttactcasagaagtggaaggtgatgggatggg

SEQ ID NO: 67939 - DNA, 50 bp, homo sapien
gtgaatggaatgtgatgttctatagycaaagcaaacctgtatgttttctg

SEQ ID NO: 67940 - DNA, 50 bp, homo sapien
cactttgagaactgcagcactagaaygattcccagctgggggtccttgga

SEQ ID NO: 67941 - DNA, 50 bp, homo sapien
atttattatccctttgacagcaaaayctggcctttcctgaattcatctgg

SEQ ID NO: 67942 - DNA, 50 bp, homo sapien
attgcacaagggactacagaacccayggtgttgtggagaagaatgccact

SEQ ID NO: 67943 - DNA, 50 bp, homo sapien
tttacatctgtggtgtagtttcccaygattttgtccttcagatgcaactg

SEQ ID NO: 67944 - DNA, 50 bp, homo sapien
ttgatccaaggtctggagggtatackgtagagctgagatgttaatggtga

SEQ ID NO: 67945 - DNA, 50 bp, homo sapien
tgcaatgctgtgaagatagtgtattraaatgtcaaaagtcacaggtgtca

SEQ ID NO: 67946 - DNA, 50 bp, homo sapien
ccttttcagggaatgtatcttaggaracagctgacaataaatgcagaggt

SEQ ID NO: 67947 - DNA, 50 bp, homo sapien
tggactacaatgctactcttctggaycatggtagaaattttaaaatctta

SEQ ID NO: 67948 - DNA, 50 bp, homo sapien
actgttggggcagataggatttgacyatagtggtgtgatctggcctacct

SEQ ID NO: 67949 - DNA, 50 bp, homo sapien
acggtaagagtgacattctgtaacckataatgtaagtgtgttttacagag

SEQ ID NO: 67950 - DNA, 50 bp, homo sapien
ctcacagggttgttgcaagacatgayggtaagagtgacattctgtaaccg

SEQ ID NO: 67951 - DNA, 50 bp, homo sapien
actgtgggaagaattggaattattaygtgttttctcattcatgaatgcag

SEQ ID NO: 67952 - DNA, 50 bp, homo sapien
ggggcctttccaagaaacctgaaaayttgattgtacataaaaagacttca

SEQ ID NO: 67953 - DNA, 50 bp, homo sapien
aggttaattcagtgctacgtctgtakgttatttaaaatcttctgtgcccc

SEQ ID NO: 67954 - DNA, 50 bp, homo sapien
aagcaaagtaggattaatattctcayacagaggtggatggttgtctctac

SEQ ID NO: 67955 - DNA, 50 bp, homo sapien
ttatattaattcccaggttcaaccaygctgataattctttatataaattt

SEQ ID NO: 67956 - DNA, 50 bp, homo sapien
aaagagagcagaacagggaaacttamagagcagatcattccaagcacatt

SEQ ID NO: 67957 - DNA, 50 bp, homo sapien
cttgggaaaagataagcaccaaaagratggtcagaacatttgttacattt

SEQ ID NO: 67958 - DNA, 50 bp, homo sapien
tactttgcagccagggcttgggttaragttgcaggaagtggcctggattt

SEQ ID NO: 67959 - DNA, 50 bp, homo sapien
gtaaggcggctgagaggtggtataayatctagttagaggtatccagaaag

SEQ ID NO: 67960 - DNA, 50 bp, homo sapien
catggagtggtggcaggatagagccsaatattcaaaaagagagaaagaga

SEQ ID NO: 67961 - DNA, 50 bp, homo sapien
aaaaaaataagtgggtacaagacacsacgtaagtttcttcttctgcaccc

SEQ ID NO: 67962 - DNA, 50 bp, homo sapien
aggctcatcacatgaagcatgtggcstgtactttctaaacattccctagt

SEQ ID NO: 67963 - DNA, 50 bp, homo sapien
aatatttaccacttaattgaatcctkaagatatcagtggtagatggttta

SEQ ID NO: 67964 - DNA, 50 bp, homo sapien
ttctgcccaacagaagagagtgaaartgcaggaataatctatcacttgag

SEQ ID NO: 67965 - DNA, 50 bp, homo sapien
aatcaaagcaacactaaaactattaycttaatggcatatacacccaatgt

SEQ ID NO: 67966 - DNA, 50 bp, homo sapien
gcatagctagcccatcacattgatasagggacttcaactttatctgtaat

SEQ ID NO: 67967 - DNA, 50 bp, homo sapien
atataaagtaagcagtaaactggaakgtgccatgcactgaggaatgctgc

SEQ ID NO: 67968 - DNA, 50 bp, homo sapien
aggatggattatgtccaggacctcawtaacacctaatttagatgactgag

SEQ ID NO: 67969 - DNA, 50 bp, homo sapien
ccacaaaaaaagggctcttcgaaaakattaagtgcatgactcttagatac

SEQ ID NO: 67970 - DNA, 50 bp, homo sapien
agggattaaatggaaatttagagtcratgtttcatatttgaatgaacgta

SEQ ID NO: 67971 - DNA, 50 bp, homo sapien
agctgcacagtataaaattacaaaarctcgggtgctggtggctttgcaga

SEQ ID NO: 67972 - DNA, 50 bp, homo sapien
agatggagcccagtcctattccccartctgatgctaagataatacacatt

SEQ ID NO: 67973 - DNA, 50 bp, homo sapien
agtaaaaaaaagaacagaagagaaaratcgtgtcgtaaactccaaagttt

SEQ ID NO: 67974 - DNA, 50 bp, homo sapien
agcaattctgatttaactatgtatasatttgccatctcagccaggcttcc

SEQ ID NO: 67975 - DNA, 50 bp, homo sapien
gaatgaagatacagatgtgtgactcrtttgcatatcggagacggtggaga

SEQ ID NO: 67976 - DNA, 50 bp, homo sapien
ctctcttcagagctggacaacaagaygagaaagtctctaaacaaatgaga

SEQ ID NO: 67977 - DNA, 50 bp, homo sapien
tatttccagtgtggaggtcagagagycaaacctttgaggtggaggctccc

SEQ ID NO: 67978 - DNA, 50 bp, homo sapien
cacatttgctcaggatgcactaactragtcctgatgtcgttgcatagcag

SEQ ID NO: 67979 - DNA, 50 bp, homo sapien
gtgccctgctctgtgcacacgtaagkatctccctgaaagggccactgctg

SEQ ID NO: 67980 - DNA, 50 bp, homo sapien
ctaactaaagttgattgtcttttcaytcctgactccctattgtctatact

SEQ ID NO: 67981 - DNA, 50 bp, homo sapien
ggatattagctaagcaagatgatttygggaatgattttttgtttgtttgt

SEQ ID NO: 67982 - DNA, 50 bp, homo sapien
cattcccgaaatcatcttgcttagckaatatccattcctcgtttgattct

SEQ ID NO: 67983 - DNA, 50 bp, homo sapien
agttaaatatcttattccaggtatargtagcccctgttaaattttgctaa

SEQ ID NO: 67984 - DNA, 50 bp, homo sapien
cttgaaagaatattatgcttacagayatgaaataggtttgattcaggact

SEQ ID NO: 67985 - DNA, 50 bp, homo sapien
attttattatccctgttttgaaataygtcatgcatggccgggtgcagcgg

SEQ ID NO: 67986 - DNA, 50 bp, homo sapien
taatacaccaaatattgcttttacaytgaaattgtgttcacatgtcttct

SEQ ID NO: 67987 - DNA, 50 bp, homo sapien
attaatgtggttttataaccatactyactccctaaaagtgttttgtttgt

SEQ ID NO: 67988 - DNA, 50 bp, homo sapien
tatttgttgcacttttacaatatcaraatctcctcattgcttgcattaaa

SEQ ID NO: 67989 - DNA, 50 bp, homo sapien
cttgcttcaacactgagcattttgartaagactggtagtttgaaaaatta

SEQ ID NO: 67990 - DNA, 50 bp, homo sapien
ataatggcaccaattatttcttcaaktatgaaggcaccaatgggatggaa

SEQ ID NO: 67991 - DNA, 50 bp, homo sapien
gagtgtgagtgaagaggcacctgttkaaaataaggaggtcaggaaggcac

SEQ ID NO: 67992 - DNA, 50 bp, homo sapien
tcggccccacattgaaatagtccccragtgctagtaactgcagtttggtg

SEQ ID NO: 67993 - DNA, 50 bp, homo sapien
tgagacaccaaggggctggacagackatttccagggatcgccattgctac

SEQ ID NO: 67994 - DNA, 50 bp, homo sapien
ggtccatagtatcctttatagagagsagaagttcagaggactcaaggtgg

SEQ ID NO: 67995 - DNA, 50 bp, homo sapien
tttatatagaatgattggatggagartattgaaaaagagagagagagaaa

SEQ ID NO: 67996 - DNA, 50 bp, homo sapien
tgagtcacctaacttttactgaagakgaaaaatataattaaatttctaaa

SEQ ID NO: 67997 - DNA, 50 bp, homo sapien
gaactaattctcacctaaggtatcayggcaagtgcctgagtcctctgtgc

SEQ ID NO: 67998 - DNA, 50 bp, homo sapien
attcagctcaaactctcaatcactckcgtaatctgttgcagacaccgcag

SEQ ID NO: 67999 - DNA, 50 bp, homo sapien
ggcacataggaaacttcctcatgggwatctgagttcacgggttgagtctg

SEQ ID NO: 68000 - DNA, 50 bp, homo sapien
caaaatctattaaagaatttttgacrgattttaatgaagaaatagacaat

SEQ ID NO: 68001 - DNA, 50 bp, homo sapien
ataagtgttttttccattttggtcaragaacacactgaggtttatttata

SEQ ID NO: 68002 - DNA, 50 bp, homo sapien
taattacctctctgaaattcctaaamtcttctggaaagttcaggcaaaat

SEQ ID NO: 68003 - DNA, 50 bp, homo sapien
tgactggctcatggaaaagtgtgcaragtatagcgttaaacataatttaa

SEQ ID NO: 68004 - DNA, 50 bp, homo sapien
gctagactaactggaatcatccaccragcatggtatcacatctcaacaat

SEQ ID NO: 68005 - DNA, 50 bp, homo sapien
catctaaggataacgttctaaaaccratgcttagtttcaaataatgctaa

SEQ ID NO: 68006 - DNA, 50 bp, homo sapien
gtggttagtaaacaaaaggaagaatsaccttggccttagggttataacca

SEQ ID NO: 68007 - DNA, 50 bp, homo sapien
gagcttcaacagcttattttttaaastggtgatgagtgaagagtactggt

SEQ ID NO: 68008 - DNA, 50 bp, homo sapien
tatcaggtttgattttcaggttttcragatgggactctgataggagaagc

SEQ ID NO: 68009 - DNA, 50 bp, homo sapien
atggagaaggacctaggattaaataracgagaaggatgctctgggagggc

SEQ ID NO: 68010 - DNA, 50 bp, homo sapien
tagaccatatagtcctactaataaayacttgtgcaaaacagaaatacttt

SEQ ID NO: 68011 - DNA, 50 bp, homo sapien
gtatctctgtattgttgacaagaagmaaatttagtaggaacacaaggcaa

SEQ ID NO: 68012 - DNA, 50 bp, homo sapien
ctgtagtagacatcactattataaaytgatccccccagaggctgtaccaa

SEQ ID NO: 68013 - DNA, 50 bp, homo sapien
ctggattcgagttaaaatcatctcckctgtagttctcctgattaccatca

SEQ ID NO: 68014 - DNA, 50 bp, homo sapien
atggtggaaatgtgcaaggatgttayatgaattgtgttggttggcctaaa

SEQ ID NO: 68015 - DNA, 50 bp, homo sapien
catgcacacccaaaatctgtacacawcccatattgtcctgccaaggagca

SEQ ID NO: 68016 - DNA, 50 bp, homo sapien
agcagcttggtttccaaacatacggragaaatttttcatcaaaagaagga

SEQ ID NO: 68017 - DNA, 50 bp, homo sapien
ttctctccagttgctgtaaaactaaycaaggctctaaattctgcatctga

SEQ ID NO: 68018 - DNA, 50 bp, homo sapien
gtttttcttctaactgtgagtctaaygtttctcagttttattccaagtgc

SEQ ID NO: 68019 - DNA, 50 bp, homo sapien
actcagcttccattacgtagtcacayatcgcaaactaaacgtatttttaa

SEQ ID NO: 68020 - DNA, 50 bp, homo sapien
agctgccaagtgacatcctgaatatyacagaagatctaggaatcagctgg

SEQ ID NO: 68021 - DNA, 50 bp, homo sapien
cctgaaaacatatgcactgaaaaatwaattatgaatgtatctagcagcac

SEQ ID NO: 68022 - DNA, 50 bp, homo sapien
acttctgtatctgctataatggctarcaaaatcttacataaagtaagtac

SEQ ID NO: 68023 - DNA, 50 bp, homo sapien
tttagggatctgctgtcattctcgtrcgcctctctagaaggctgaatgat

SEQ ID NO: 68024 - DNA, 50 bp, homo sapien
ctgtggaatgaaggcaattatgttaygaaagagcaagtaaaatccaccaa

SEQ ID NO: 68025 - DNA, 50 bp, homo sapien
tgcacctatgatgtactaggtactayggaggagacaacaaattaggatgc

SEQ ID NO: 68026 - DNA, 50 bp, homo sapien
attattatttgttcttaacctcatarcatttccacgagtgtcaaatcctg

SEQ ID NO: 68027 - DNA, 50 bp, homo sapien
ggcccattacattgaaaatattatayggattggacctaatgagtgagaac

SEQ ID NO: 68028 - DNA, 50 bp, homo sapien
ccaattgctttaggataatggggaaygtaataaggccaatgaattctatg

SEQ ID NO: 68029 - DNA, 50 bp, homo sapien
aggccttcagactgaaataaaaggaygttagatagtgagcaaagtcaagg

SEQ ID NO: 68030 - DNA, 50 bp, homo sapien
ccagagagtatcatgacacttaatcyacctgtggccatgtccttgtattg

SEQ ID NO: 68031 - DNA, 50 bp, homo sapien
agaatacttataacatgatcatctcragaaattggagtattgttggcatc

SEQ ID NO: 68032 - DNA, 50 bp, homo sapien
ttgcctggctaaggagtgagaatcayggtctaatcagtggttttcctcat

SEQ ID NO: 68033 - DNA, 50 bp, homo sapien
cttttaaaaagagaacacacaagatracgatgactgctacaggacttggc

SEQ ID NO: 68034 - DNA, 50 bp, homo sapien
acaagaaagctcaatctgatccacayatattcacaatacctggtgtcctg

SEQ ID NO: 68035 - DNA, 50 bp, homo sapien
catacaaatttatttaatctgtatayaaagagacttcagaatgaagacgg

SEQ ID NO: 68036 - DNA, 50 bp, homo sapien
tttatttctgttgtgtggatcctcayagtgacgctgcaaggtaggtgcat

SEQ ID NO: 68037 - DNA, 50 bp, homo sapien
gttaatgcatagaaaaatgcctagaraacattcacccgtaagtatcaccc

SEQ ID NO: 68038 - DNA, 50 bp, homo sapien
taaattgctgcaggtatgcgggactraaataaggtgtcagtacctcacac

SEQ ID NO: 68039 - DNA, 50 bp, homo sapien
ttaccttattgttattaagatgttcraaaagctcaagaattctaaaaagc

SEQ ID NO: 68040 - DNA, 50 bp, homo sapien
tcataaataattaggcaggaacttarcccaaatctagttctttgaccacc

SEQ ID NO: 68041 - DNA, 50 bp, homo sapien
tatgactgctgttgtctacgctacgwccttaacaatgccaataccttcat

SEQ ID NO: 68042 - DNA, 50 bp, homo sapien
gtagctttctaaataaaaccctttcwagctggagagagatccatgagcat

SEQ ID NO: 68043 - DNA, 50 bp, homo sapien
gccggatccagagcgctgggattcarcaggagtgccaggagaattcaaca

SEQ ID NO: 68044 - DNA, 50 bp, homo sapien
gttacaacaacacgacaacaggtgayattgagaaggaagatctcatttag

SEQ ID NO: 68045 - DNA, 50 bp, homo sapien
gctccctgcatgtgtctggaagaacygcttttccagctctccaggacatt

SEQ ID NO: 68046 - DNA, 50 bp, homo sapien
ttaaagacaaatcatagaacatgccyagtgaaagacatttcctgccgaga

SEQ ID NO: 68047 - DNA, 50 bp, homo sapien
ctggaatggatggaacggagagaatsaaagctgcccatgggtgaagagat

SEQ ID NO: 68048 - DNA, 50 bp, homo sapien
gactttctcatgagtctaattcaggyatgcagtaagttaaaagaagaatc

SEQ ID NO: 68049 - DNA, 50 bp, homo sapien
aaaaagaagatagaaacttgacaggkataaatatggttcatcttctgatt

SEQ ID NO: 68050 - DNA, 50 bp, homo sapien
gtgttgagatatcaaactgatggtakaattcaaatggtccataaacatat

SEQ ID NO: 68051 - DNA, 50 bp, homo sapien
ctaacacactacctttgacatatgaraactttgaatatatctgaccactg

SEQ ID NO: 68052 - DNA, 50 bp, homo sapien
acacgcaggtggataaaataaagaargtcagtttaagtaagcacgcagta

SEQ ID NO: 68053 - DNA, 50 bp, homo sapien
ttttttgcatttagcatagtcttctraagtagtaggagcatacgtttttg

SEQ ID NO: 68054 - DNA, 50 bp, homo sapien
cttgagaaaccagtagttgcttgacytatgttttttgcatttagcatagt

SEQ ID NO: 68055 - DNA, 50 bp, homo sapien
tctcctctctaaaatgaaggttctcyatggataatttctaagttctctcc

SEQ ID NO: 68056 - DNA, 50 bp, homo sapien
ttcatgttatacttgtggcatatcargaccgtgcatatcaacaaaggtgt

SEQ ID NO: 68057 - DNA, 50 bp, homo sapien
tcaagcaactttcttgcctttagacwctcaaattatgctaatatattctt

SEQ ID NO: 68058 - DNA, 50 bp, homo sapien
aatacataaagtacctaaaatagcayctaaagactccaaaagcagctagt

SEQ ID NO: 68059 - DNA, 50 bp, homo sapien
ttcctgcagtgctaagtgattcttayggctcctggatgtttagatggctc

SEQ ID NO: 68060 - DNA, 50 bp, homo sapien
ttacagagcacatagtccagttttcyattgtttcattaccttagctgagg

SEQ ID NO: 68061 - DNA, 50 bp, homo sapien
atatactcacatggtgggataaaatragagtaagctatccagtctcttct

SEQ ID NO: 68062 - DNA, 50 bp, homo sapien
agtggaagacagtttaatatttgacrgctttgaaccatttttttttctct

SEQ ID NO: 68063 - DNA, 50 bp, homo sapien
agtttaagtaacttatagtgagagayggaagctcctcttagcaacactga

SEQ ID NO: 68064 - DNA, 50 bp, homo sapien
aattcaagctgctctctaattttccygcaagtagagccaggatttgtagt

SEQ ID NO: 68065 - DNA, 50 bp, homo sapien
actataagttacttaaacttgctacraagacttcacaagtgtgttataaa

SEQ ID NO: 68066 - DNA, 50 bp, homo sapien
agctcttcagaataaacagcagtaayatgtactagaaatcagtgaataaa

SEQ ID NO: 68067 - DNA, 50 bp, homo sapien
aagagctcatgactagcacactaggwacggccatagatttttgtattttt

SEQ ID NO: 68068 - DNA, 50 bp, homo sapien
tgatgctgaaatgattatttactatraacaaagcaaagagcaccaagctg

SEQ ID NO: 68069 - DNA, 50 bp, homo sapien
cctaaatcatgccttggattgaactsagctttgaatgtctccaatgttgg

SEQ ID NO: 68070 - DNA, 50 bp, homo sapien
ttgcagtgctcataaacccttaacaytggagagtaatataacaggaatat

SEQ ID NO: 68071 - DNA, 50 bp, homo sapien
aatgttacacatacaacacatatgamtacacaacagacagaagatccagt

SEQ ID NO: 68072 - DNA, 50 bp, homo sapien
ttcttcttcctcttgcagccggtacrgaaaggtgtaagtggtggctgaaa

SEQ ID NO: 68073 - DNA, 50 bp, homo sapien
tctatacctgtcaccttcaggcttasctcagatcgatcaggctcactaaa

SEQ ID NO: 68074 - DNA, 50 bp, homo sapien
taattttattataacttcttaaagaygactgaagcaataaagcatagtgc

SEQ ID NO: 68075 - DNA, 50 bp, homo sapien
ttggagtaatttccaatggcatcaamctattcaaggcataagaagaaagt

SEQ ID NO: 68076 - DNA, 50 bp, homo sapien
aacatataggtcttgatcttctcatyagtaaatctgaggcttatgttcta

SEQ ID NO: 68077 - DNA, 50 bp, homo sapien
acctgctgaccgagcatcggaacaayggttcatagaggaagacatcccag

SEQ ID NO: 68078 - DNA, 50 bp, homo sapien
ccaagtagagaggatactgttatgamggctcagaggtgccaggttgcata

SEQ ID NO: 68079 - DNA, 50 bp, homo sapien
gaatccacacttactgcctactttaygccttagggatccttgagaatttc

SEQ ID NO: 68080 - DNA, 50 bp, homo sapien
acccacatcctcaaaggtgaagtaartgctctaaggtccatcctctggaa

SEQ ID NO: 68081 - DNA, 50 bp, homo sapien
ttgaagtagcaaccaaagctgtccaraaacttgttcagcatatatgcctt

SEQ ID NO: 68082 - DNA, 50 bp, homo sapien
ggtggtctttctccatcccaacttamgtatgaaagagaggagaggagaac

SEQ ID NO: 68083 - DNA, 50 bp, homo sapien
tatgacagagcacctaatataatcamtaaatgacacatgacaccatacct

SEQ ID NO: 68084 - DNA, 50 bp, homo sapien
tttttttgtaaaggaactcaaaataygataggtccagaattgtctacaaa

SEQ ID NO: 68085 - DNA, 50 bp, homo sapien
gccaaatattgattcagtggttgccrgaccaaatgtgtgtcttgtggtaa

SEQ ID NO: 68086 - DNA, 50 bp, homo sapien
atgtgcctttggtaacagtatttctsacaacaaagcaatattgtctcaca

SEQ ID NO: 68087 - DNA, 50 bp, homo sapien
ctcttcggctaatgatgcaatgtccwctttaatttgtttgtatagacata

SEQ ID NO: 68088 - DNA, 50 bp, homo sapien
cgggcacctccactccctccagttaygctttatgtatacaccaagcatcc

SEQ ID NO: 68089 - DNA, 50 bp, homo sapien
tggggcttagtactgaagctgactcrcggttacactcaattaagtgtgaa

SEQ ID NO: 68090 - DNA, 50 bp, homo sapien
tctgtcatatctacatcatatgcagragaattagaaacttaaatatatac

SEQ ID NO: 68091 - DNA, 50 bp, homo sapien
tttttggtccaattgttcacattgaygaagagtgcagttaaatggcacat

SEQ ID NO: 68092 - DNA, 50 bp, homo sapien
aaaaagtgctctgcaagaagtcttamtaacgttcctatccatgtttgtta

SEQ ID NO: 68093 - DNA, 50 bp, homo sapien
cacataagaaatcactcataatgccrgactgtggactgaggtttccagac

SEQ ID NO: 68094 - DNA, 50 bp, homo sapien
ctgtcagcttaaacacaaatgttacygcttatcttttcttaaaaaaaaaa

SEQ ID NO: 68095 - DNA, 50 bp, homo sapien
aaaaataacaatcacataagttaccratcaataagatttctctcactcct

SEQ ID NO: 68096 - DNA, 50 bp, homo sapien
atctaaatatgggagttctccattayacaaagacctcaagccaggatgaa

SEQ ID NO: 68097 - DNA, 50 bp, homo sapien
tgagattacgaagtgtacatatgggycattaaagctgttttggaataaac

SEQ ID NO: 68098 - DNA, 50 bp, homo sapien
catacttgccttatctgactaaaaaygtttctcaagaggataaactatac

SEQ ID NO: 68099 - DNA, 50 bp, homo sapien
aagcaatcatttattgacacgtcaawtgtttgcataccagttgtctgttt

SEQ ID NO: 68100 - DNA, 50 bp, homo sapien
attgtgtggaggaatcctggaattcrgaaaagcaggacgaaagaaaggaa

SEQ ID NO: 68101 - DNA, 50 bp, homo sapien
atcaacaaagaaatattatatttaamctgcaatatagaccaaatggaccc

SEQ ID NO: 68102 - DNA, 50 bp, homo sapien
gtgtgttgttatctaatatcagtaamgtaaaatattggtattaaatatct

SEQ ID NO: 68103 - DNA, 50 bp, homo sapien
agtatctgcagaaagaatgccttcayggaaccccaccattgtcctaaaca

SEQ ID NO: 68104 - DNA, 50 bp, homo sapien
gaataagagaggaggcctcaattaaytattgttcatggcctctagaagag

SEQ ID NO: 68105 - DNA, 50 bp, homo sapien
gcttctaaaagatggcttcacagtaygtaatttaatccccacagcaaggc

SEQ ID NO: 68106 - DNA, 50 bp, homo sapien
gcgcccgggctaaataaaatatttcycattaagcatttagtaccataaat

SEQ ID NO: 68107 - DNA, 50 bp, homo sapien
tggttattagcattttcagtaaggasgtatgtttagtaaacagccctcat

SEQ ID NO: 68108 - DNA, 50 bp, homo sapien
gagtttgggaaaaaagaaagtggcargtcatatcatttcctgtaatgtaa

SEQ ID NO: 68109 - DNA, 50 bp, homo sapien
caggaaaccatgtcccagagagagarggtcgttaatttatgagaagtcac

SEQ ID NO: 68110 - DNA, 50 bp, homo sapien
tttctaatctgagtatatccaaataktaaaaccttattcactaaaacagc

SEQ ID NO: 68111 - DNA, 50 bp, homo sapien
gtgcgggatttaagttgtaagtgaaraggactgcgtcaagaggcaggata

SEQ ID NO: 68112 - DNA, 50 bp, homo sapien
gttaaagtcagttgattggcaaatgwaattcctcttcccatataattcaa

SEQ ID NO: 68113 - DNA, 50 bp, homo sapien
attagttgttgctgaaagtgggaackgtatgaaatgagtcacgtgtccct

SEQ ID NO: 68114 - DNA, 50 bp, homo sapien
gaacgtgccactgtggtagtcataastgttgttttccaaatatttccaaa

SEQ ID NO: 68115 - DNA, 50 bp, homo sapien
ttttagttagttagttcaagatttasagatagaataaccagattgtttgg

SEQ ID NO: 68116 - DNA, 50 bp, homo sapien
gaagaagggttctatggtaaatgccraaagtgaaccttcaacgaagtgag

SEQ ID NO: 68117 - DNA, 50 bp, homo sapien
ttattgtttggatgttttaccgtggycatgtattacttttgaaataagct

SEQ ID NO: 68118 - DNA, 50 bp, homo sapien
ggagcactcctcagcatgtccaacarcagtctgtggagaactactttttt

SEQ ID NO: 68119 - DNA, 50 bp, homo sapien
ttttcagcataggtcactgaggaaayttagaccccaaaggtgatgtggct

SEQ ID NO: 68120 - DNA, 50 bp, homo sapien
acagaaatttgttgtatggatatttkgcatgatatattgaagcaaagggc

SEQ ID NO: 68121 - DNA, 50 bp, homo sapien
tactcccctgtgattactctgatackgtaaagtaatgaaaaacctgatgc

SEQ ID NO: 68122 - DNA, 50 bp, homo sapien
ttctgagtgtacactttcagaaacasaatgaaggctttccatattgtcac

SEQ ID NO: 68123 - DNA, 50 bp, homo sapien
ataaagtagcaacctaggctaccaamtcgtaaagacgttctttgctggct

SEQ ID NO: 68124 - DNA, 50 bp, homo sapien
agtatttttatggaaggatttctaaygatacattttaatgtgctcaaaaa

SEQ ID NO: 68125 - DNA, 50 bp, homo sapien
ttagtatttgttatttttttctaaaycaccttcagtgtatatgtctccaa

SEQ ID NO: 68126 - DNA, 50 bp, homo sapien
tccttatctgaacctataatgaaackgtgctatgaactaagaagtatggt

SEQ ID NO: 68127 - DNA, 50 bp, homo sapien
caaattctagaattcttggtagacartcactactacctgaaagatttatg

SEQ ID NO: 68128 - DNA, 50 bp, homo sapien
cctggcttacaccatccttgaaatcstgtgctcaggggattcccccagct

SEQ ID NO: 68129 - DNA, 50 bp, homo sapien
catccattttactgggcttagaatcyattgctgatatttcccactcagtg

SEQ ID NO: 68130 - DNA, 50 bp, homo sapien
aagaaacagagatgagacgggaaagraaaatatctcagtgtaaactttgt

SEQ ID NO: 68131 - DNA, 50 bp, homo sapien
ctactgatatatgtaccaacaggaasgaatatcaagataattatgatcat

SEQ ID NO: 68132 - DNA, 50 bp, homo sapien
agatgggactgcagaattttcatgcygaggatcagaagacctattgtatc

SEQ ID NO: 68133 - DNA, 50 bp, homo sapien
tggactttgtagatgagtaaactgasattaagaggttaaaattttaaaac

SEQ ID NO: 68134 - DNA, 50 bp, homo sapien
gagggaaacattgtggattgaccacstaatctcatcataccctccttctg

SEQ ID NO: 68135 - DNA, 50 bp, homo sapien
tcattgctaggaattatctgcaacartaatgaatatctccttgttctttt

SEQ ID NO: 68136 - DNA, 50 bp, homo sapien
ctgagaactgccaatcatctagtcawaagtgataaaactaagtcacggta

SEQ ID NO: 68137 - DNA, 50 bp, homo sapien
aagactgcttacttaagtgagtaaaytctatctagctcattctttgatct

SEQ ID NO: 68138 - DNA, 50 bp, homo sapien
cttttatttttctttttagatcaggytggttaggcagataagtgggcata

SEQ ID NO: 68139 - DNA, 50 bp, homo sapien
ttcattcaatcataaaaagagcacarctatctaggatttagaagtttagg

SEQ ID NO: 68140 - DNA, 50 bp, homo sapien
caagcttattcccatctaatgctacyacttattgatgccatatcatgagc

SEQ ID NO: 68141 - DNA, 50 bp, homo sapien
caactatgctacacagaagtttagawatgaaggagataattgttccatga

SEQ ID NO: 68142 - DNA, 50 bp, homo sapien
tctgcactacctgtataaccagtaawtcatgatctgtagggacagggaaa

SEQ ID NO: 68143 - DNA, 50 bp, homo sapien
attcttttttgcgtatttgcattgcrtcttctttgattgcctcttcacat

SEQ ID NO: 68144 - DNA, 50 bp, homo sapien
aaaagaacactaggatggatcttgamaaaaatagttaaaagggccttaag

SEQ ID NO: 68145 - DNA, 50 bp, homo sapien
ggaggagagaagcttttcaatagaaygcttgttatccagagaagctaata

SEQ ID NO: 68146 - DNA, 50 bp, homo sapien
gatatttctaacatggatagtaagcrgaaagtaaaactgtgattccttgt

SEQ ID NO: 68147 - DNA, 50 bp, homo sapien
ttgcatatcccatagaaaccaaaaamcttagacatcattttattttattt

SEQ ID NO: 68148 - DNA, 50 bp, homo sapien
gtgggtgtgaaaaatgaattgagaawgtagggaacaattttcttggccat

SEQ ID NO: 68149 - DNA, 50 bp, homo sapien
tgaggtataaatcaatgatcctagcytaatgtgctatttttttcctatca

SEQ ID NO: 68150 - DNA, 50 bp, homo sapien
aagctcccccgggccacatatcgtcrtggcagaacatagatttgaaccaa

SEQ ID NO: 68151 - DNA, 50 bp, homo sapien
aggaaatactatggcagcagataacmctgagagaaaaatgagaatcagta

SEQ ID NO: 68152 - DNA, 50 bp, homo sapien
ttgaagaaccacagagggaagagtaracaccatacagctcacactgactc

SEQ ID NO: 68153 - DNA, 50 bp, homo sapien
ataaacaaaaaactgtgtttaggatraaagaagatggaaatagagatgga

SEQ ID NO: 68154 - DNA, 50 bp, homo sapien
ttaaggacctttctgatgttccttcrcttactgattgagagaaaaacaaa

SEQ ID NO: 68155 - DNA, 50 bp, homo sapien
tctgaaatcacaggtaaagagatgaygatggcataaattataattgatgg

SEQ ID NO: 68156 - DNA, 50 bp, homo sapien
cagtctcctaagacttcaccctaacsttttattcaagccatcagctacca

SEQ ID NO: 68157 - DNA, 50 bp, homo sapien
gagcaaagcttggttagaatgtgtakgacactgattaatatactttcaaa

SEQ ID NO: 68158 - DNA, 50 bp, homo sapien
attctaaatgcttactacccagttayaaatgctatgaatcttccaacatc

SEQ ID NO: 68159 - DNA, 50 bp, homo sapien
tgaggctaactaaacttctccagatmgcaggatagctgaacaggagcatg

SEQ ID NO: 68160 - DNA, 50 bp, homo sapien
cttttataaggctctaatcccattcwtaagggcagagtctccatgatcta

SEQ ID NO: 68161 - DNA, 50 bp, homo sapien
agcgtgctacagcatcaagtcttacyaggggcttcaacaacggttccaac

SEQ ID NO: 68162 - DNA, 50 bp, homo sapien
tttttgtgattagatctcaacatacraatattaaaggaacccaagcattc

SEQ ID NO: 68163 - DNA, 50 bp, homo sapien
ccttgccacaaggaaatgaaatctamactgacgattacggagatttctgc

SEQ ID NO: 68164 - DNA, 50 bp, homo sapien
ccttaaaaataatttgcagatacaargctggttttttttttccccaaaaa

SEQ ID NO: 68165 - DNA, 50 bp, homo sapien
aacatggaagaatatctttaagaccraggctaggtaaagagttcttagac

SEQ ID NO: 68166 - DNA, 50 bp, homo sapien
tagataaaaggaggctttgaacaaakaacttgatagcagaaaacctgctt

SEQ ID NO: 68167 - DNA, 50 bp, homo sapien
attaattattatggtgtattatttawgtaagcctaggcaaatcaatcagt

SEQ ID NO: 68168 - DNA, 50 bp, homo sapien
atggacagacccagtttacattcaawtgttttcctcagtattttcctcac

SEQ ID NO: 68169 - DNA, 50 bp, homo sapien
gatattcattgtacagtctttgataygttaccctggctctcctaagcctt

SEQ ID NO: 68170 - DNA, 50 bp, homo sapien
ttcataactttatgagacactcttastaccatactcaaaatactgattct

SEQ ID NO: 68171 - DNA, 50 bp, homo sapien
tttgaaagggaatatggccctggaartgagtagaaatggcttgatgtagg

SEQ ID NO: 68172 - DNA, 50 bp, homo sapien
cattgccaaagcttgtcgattcattmaaaaattcattcatttctgcacat

SEQ ID NO: 68173 - DNA, 50 bp, homo sapien
tttttcctggtctgttatttttaacmctgtaatctacctagaaattattt

SEQ ID NO: 68174 - DNA, 50 bp, homo sapien
agtagtgacaggtagtaattccaaaygaacctagtttaaacaagagggaa

SEQ ID NO: 68175 - DNA, 50 bp, homo sapien
gagtaatttcacatgataagtttatraagtaaatatatcaaaacaaaagg

SEQ ID NO: 68176 - DNA, 50 bp, homo sapien
aaatatctgcagattgagaatgaccyatctttatgttttgatagctttat

SEQ ID NO: 68177 - DNA, 50 bp, homo sapien
acaactctatacaagtttctagcaakcccagctgtccacagagtctagaa

SEQ ID NO: 68178 - DNA, 50 bp, homo sapien
ataatcttctacaaaggagaaaacayggagctgggaacaataatgaaatc

SEQ ID NO: 68179 - DNA, 50 bp, homo sapien
tattatgctttgtaaaactcttaaaratttgattgtgtgaaatgcaaaag

SEQ ID NO: 68180 - DNA, 50 bp, homo sapien
aaagatccttttttccacttagttcmataaatattccggggaagcatggc

SEQ ID NO: 68181 - DNA, 50 bp, homo sapien
gaactcaggctggaagctctgcacarctcctaattttggagattaaacaa

SEQ ID NO: 68182 - DNA, 50 bp, homo sapien
ttcagtcaggagttttagttgctcaratatttttatgaaacagtttaagg

SEQ ID NO: 68183 - DNA, 50 bp, homo sapien
agaggtcagcaaaatcctagttaccmatcagttggcttgctgtgcttggt

SEQ ID NO: 68184 - DNA, 50 bp, homo sapien
atatctgaatgaaaagtagcacagaygatgtaaatgttcttctgtatctt

SEQ ID NO: 68185 - DNA, 50 bp, homo sapien
tcaaggaagggttatgtagctaaaaytgcaatgagaagttcacagccatt

SEQ ID NO: 68186 - DNA, 50 bp, homo sapien
tgggagaattctcagtgtttattaaytgctggtgatcctctcttctagga

SEQ ID NO: 68187 - DNA, 50 bp, homo sapien
aacccctgtgattttcataaagttaycagttagaagataaaacattgagg

SEQ ID NO: 68188 - DNA, 50 bp, homo sapien
aaatgagaaaaaaatttatatgaaaygctcaattgtaacaacaaaaggca

SEQ ID NO: 68189 - DNA, 50 bp, homo sapien
acgtattgcactactaaattacaaamtaacatatcactatcctattaaaa

SEQ ID NO: 68190 - DNA, 50 bp, homo sapien
gatcataagggctaagtttctcattyctctggctctgtctccccagttat

SEQ ID NO: 68191 - DNA, 50 bp, homo sapien
gctgaattatggctttttcttttccmataggatttacatgtacactcatc

SEQ ID NO: 68192 - DNA, 50 bp, homo sapien
taaagtcagcaaatctgtgattcaaraagacaccttactaaagggtcagg

SEQ ID NO: 68193 - DNA, 50 bp, homo sapien
cgttggctgatctttcaacttccaamttctttacaacttccaacatttta

SEQ ID NO: 68194 - DNA, 50 bp, homo sapien
ctttacaacttccaacattttattcrcccttaaagttcatcttaaatgta

SEQ ID NO: 68195 - DNA, 50 bp, homo sapien
ctctctggcaagagatctgtggaagrgaactgagaaaaattcttacagag

SEQ ID NO: 68196 - DNA, 50 bp, homo sapien
gaagtgaataattttatgcatttacmcacgtagttaaacatgtaaatttt

SEQ ID NO: 68197 - DNA, 50 bp, homo sapien
atgagttctgctcttgacctttttcwaccaaatatgtagtcacctacaaa

SEQ ID NO: 68198 - DNA, 50 bp, homo sapien
tcctggctctagaactcacagggcawaatgtatgtttaagaaccttgggc

SEQ ID NO: 68199 - DNA, 50 bp, homo sapien
caagcaaggcaggtcttattaagccracaatgcataggcaagccttggtg

SEQ ID NO: 68200 - DNA, 50 bp, homo sapien
gttcattaagtggcaagagtctatcrctttcagctcacaaatagctcaca

SEQ ID NO: 68201 - DNA, 50 bp, homo sapien
accatgcactatccctatttttttaycttgtatcatgagtcatttgtggt

SEQ ID NO: 68202 - DNA, 50 bp, homo sapien
agcccatgtgcactctcccagcttcygctaatacatgttgattaggttct

SEQ ID NO: 68203 - DNA, 50 bp, homo sapien
aaaataatcgtccagactttcagcastagattgagactaatttaggccaa

SEQ ID NO: 68204 - DNA, 50 bp, homo sapien
aaattctgtttcctttggactcataygtttatagaggtattggggtaagt

SEQ ID NO: 68205 - DNA, 50 bp, homo sapien
tagcaagtttgtctccctacaattawacaaatactcagaatgttaagtaa

SEQ ID NO: 68206 - DNA, 50 bp, homo sapien
ctggtgttctcactccttgtggtaawaaactctcaggggctggaggacta

SEQ ID NO: 68207 - DNA, 50 bp, homo sapien
caaggttttaataggcaataggcaaygatcaattaaaacagggctgtcat

SEQ ID NO: 68208 - DNA, 50 bp, homo sapien
aaatgtttacttactctatggtgcayactaagttaaaaaagaggtagaaa

SEQ ID NO: 68209 - DNA, 50 bp, homo sapien
accctaggagcctattttctttgtasactatgttataatttatttgaaga

SEQ ID NO: 68210 - DNA, 50 bp, homo sapien
ttcatccttctaaatctgattcttasgataacttttcactggaagctaca

SEQ ID NO: 68211 - DNA, 50 bp, homo sapien
gaactctagaaggactaaaatatgtkaaaatacaggttttttctgatttc

SEQ ID NO: 68212 - DNA, 50 bp, homo sapien
ctggaagaggcctgctttggaaatarggtgtacactgtttagaccttagc

SEQ ID NO: 68213 - DNA, 50 bp, homo sapien
taggataaatagaatgggtgtgagamagaaaatcatgaaaaaaattcctt

SEQ ID NO: 68214 - DNA, 50 bp, homo sapien
taaattacagtaaaaatggctacaaycagaacgattaacaggtgaaaaat

SEQ ID NO: 68215 - DNA, 50 bp, homo sapien
gagggactcgaagagatagataaaakgaggaatccctaccccaggtgagg

SEQ ID NO: 68216 - DNA, 50 bp, homo sapien
ttaacctgtgtggcttctgtaagggwattcacaggaagaaggggataaat

SEQ ID NO: 68217 - DNA, 50 bp, homo sapien
cttctccgtcttcctgagcactttaraaataccttgagtgtagtactgaa

SEQ ID NO: 68218 - DNA, 50 bp, homo sapien
agccttcaagtggttacagattcaargggtatgttgttttttaaaggcac

SEQ ID NO: 68219 - DNA, 50 bp, homo sapien
gatcacggagactggactgggtggaygttttcccgtgagattatattgga

SEQ ID NO: 68220 - DNA, 50 bp, homo sapien
cgccttgcagtgtggctatttcatcsgagtctggaagtgaggagtgacca

SEQ ID NO: 68221 - DNA, 50 bp, homo sapien
atgttcagtttcttctggggtttgamtagacaggcttttatcaaagtcac

SEQ ID NO: 68222 - DNA, 50 bp, homo sapien
tctcttcagttggtgactgacacaayattcatagtccatttggaacccaa

SEQ ID NO: 68223 - DNA, 50 bp, homo sapien
aaaatcaattctgcttgaacatagcygctaaattcccaaatcgacaccag

SEQ ID NO: 68224 - DNA, 50 bp, homo sapien
gctagattatacaaatgttaagaacrctgtctgcagttaattcttcaaac

SEQ ID NO: 68225 - DNA, 50 bp, homo sapien
aaagaattaaatttatatattgaagraacctacggtgtaccttgaaaatt

SEQ ID NO: 68226 - DNA, 50 bp, homo sapien
ggtcatttaaaattaatagataccarattagcttccaacttctcaaaagc

SEQ ID NO: 68227 - DNA, 50 bp, homo sapien
caagtgaactacagtaagatcccaaragaactgaaaaggctaccttttat

SEQ ID NO: 68228 - DNA, 50 bp, homo sapien
aactgaaaaggctaccttttataaaytctcaaaactggctaggtaggaat

SEQ ID NO: 68229 - DNA, 50 bp, homo sapien
ggcaaatcatcctgaattgtttcccrgagctagcatgtttgagcaccggc

SEQ ID NO: 68230 - DNA, 50 bp, homo sapien
gtttggaggaggatgtaccatgagayatttctgtgctaaatatatttagc

SEQ ID NO: 68231 - DNA, 50 bp, homo sapien
tgacacaataatgaagcaacctttcyaatacattcaagaagctggaaact

SEQ ID NO: 68232 - DNA, 50 bp, homo sapien
aaagttactatatcctctgcatttamaataatacctagtatataacaaca

SEQ ID NO: 68233 - DNA, 50 bp, homo sapien
atagttactagttaatctttgaatasagctaacagatttagcaaataaga

SEQ ID NO: 68234 - DNA, 50 bp, homo sapien
attgctgggaagaaaaagcctcatamatgcaaatatgaaccagattaact

SEQ ID NO: 68235 - DNA, 50 bp, homo sapien
ccctgcctgaagagatttggctctgyagatataggattatgtaaactaga

SEQ ID NO: 68236 - DNA, 50 bp, homo sapien
tttgtggataatattacttattaaayattgaaatgtcatttttctttcaa

SEQ ID NO: 68237 - DNA, 50 bp, homo sapien
aataaaacatgcaacttccaaccaayggtgtgaaaatacttggaatcaaa

SEQ ID NO: 68238 - DNA, 50 bp, homo sapien
gaaatagaatgtattagagaaatgartatgtaaatacccaagaagaaacc

SEQ ID NO: 68239 - DNA, 50 bp, homo sapien
tttctcacctgcataatgtagtcaaygatacctatttcctaagtttgtag

SEQ ID NO: 68240 - DNA, 50 bp, homo sapien
ctattctgcatttcctagtaaacccrctctctaagcttcttattctatta

SEQ ID NO: 68241 - DNA, 50 bp, homo sapien
aaaatcaagtctgataatacatttarggttactcagctccagatgccctt

SEQ ID NO: 68242 - DNA, 50 bp, homo sapien
tttgccctgcagaccaaagtagagcratcagagactcatttgtgtaacaa

SEQ ID NO: 68243 - DNA, 50 bp, homo sapien
aaaaccaaagacaggctttagatgcraggaacaatatggcaggaagtttc

SEQ ID NO: 68244 - DNA, 50 bp, homo sapien
actcatttgtgtaacagacactgagkattgttccctgtgcactggcaaca

SEQ ID NO: 68245 - DNA, 50 bp, homo sapien
agacacttactgagatgcctttgagraaaatggtaacagcagctccagtt

SEQ ID NO: 68246 - DNA, 50 bp, homo sapien
tagaactatcaaaatgaaaaaagacygacaatatctatttggctgttggg

SEQ ID NO: 68247 - DNA, 50 bp, homo sapien
acttttgcaccaaccaaacaggtgtkaaattgactcatcgagaatatttc

SEQ ID NO: 68248 - DNA, 50 bp, homo sapien
cccattcgaatctgctcagaacacamataatgacttcagacaagaaggac

SEQ ID NO: 68249 - DNA, 50 bp, homo sapien
actggtaaagagatgtttttaactakatctgaggtaaatgatctgagtgc

SEQ ID NO: 68250 - DNA, 50 bp, homo sapien
tagctgctgttattactctctaccaygtgaatggaaaaaacacaattctt

SEQ ID NO: 68251 - DNA, 50 bp, homo sapien
accttcccttggatacctctaacaaygggaatctcactgtttcacaggca

SEQ ID NO: 68252 - DNA, 50 bp, homo sapien
caggttcaggtatcagtttcaactaygcttataatttgtgctctaaagtc

SEQ ID NO: 68253 - DNA, 50 bp, homo sapien
atgaggatgagtcagagatattcaargattgatcacaaaatgttttcctt

SEQ ID NO: 68254 - DNA, 50 bp, homo sapien
taaaccgtaaatgcaattgatgaaayattcaaatctacacaccgaaataa

SEQ ID NO: 68255 - DNA, 50 bp, homo sapien
gactcaacaaatatggacaaggtctkaaaattctgttggcacttcataaa

SEQ ID NO: 68256 - DNA, 50 bp, homo sapien
taaattaactgaactcatttgcagamtcctccatctgtgacctatcatca

SEQ ID NO: 68257 - DNA, 50 bp, homo sapien
ttgtcagtttataaatattatttaargattgtattgactccatatgactt

SEQ ID NO: 68258 - DNA, 50 bp, homo sapien
ctaatgctttcagtattttgtattcrcttctttggatcataagagatatg

SEQ ID NO: 68259 - DNA, 50 bp, homo sapien
cttcatcctctgcatcctttcgttasaataatcacgtcttcaaattaagg

SEQ ID NO: 68260 - DNA, 50 bp, homo sapien
cagcactttccaagtctacaatgaawttaagttcagggatatgaaactgt

SEQ ID NO: 68261 - DNA, 50 bp, homo sapien
tgtctgcgaattgccaaaaagtccayacgttgatgcatacataaatagca

SEQ ID NO: 68262 - DNA, 50 bp, homo sapien
ttttctgggaaagaaaaagcttaaarttctacttcaaattgctcctcttt

SEQ ID NO: 68263 - DNA, 50 bp, homo sapien
ttggctaatttgataaaatctataamacaaacctctaaaggatcataaat

SEQ ID NO: 68264 - DNA, 50 bp, homo sapien
agagcacatagagaagagatttaagwatggagtcctaggacactccatac

SEQ ID NO: 68265 - DNA, 50 bp, homo sapien
actggacatcaagttacatgtaagcygatttttaacctagatttccaaat

SEQ ID NO: 68266 - DNA, 50 bp, homo sapien
tttctagagcaaatgctggattgaargacactaaacagaactgaaagcag

SEQ ID NO: 68267 - DNA, 50 bp, homo sapien
aggtttacttgtcattatctttacaracgtgggttcagtaaatgtgtgac

SEQ ID NO: 68268 - DNA, 50 bp, homo sapien
gcaaaataaggtgaggagtaatatasagagaaaaccaagtgtttactttc

SEQ ID NO: 68269 - DNA, 50 bp, homo sapien
catatcactggccagtccatttggtyaactcctcatttattctttgggta

SEQ ID NO: 68270 - DNA, 50 bp, homo sapien
aataacagtgatttgtacttaatgarcacctaaagtgataataagtcctt

SEQ ID NO: 68271 - DNA, 50 bp, homo sapien
tttcattttcaatatgagataagacrgtatattactaaaagtgcaagatt

SEQ ID NO: 68272 - DNA, 50 bp, homo sapien
actcaactctcaaccaactggatccraaaacatcctacagaatactccac

SEQ ID NO: 68273 - DNA, 50 bp, homo sapien
gaatcatgaggtttaccaacgtttargagatcagcaaaggaagaacaatc

SEQ ID NO: 68274 - DNA, 50 bp, homo sapien
aatgcaggagagctcatcttcacaaytaaattacattgtctttgagggaa

SEQ ID NO: 68275 - DNA, 50 bp, homo sapien
taggaagacatttttccatcccaacrcaatgcagtaatctccaaactttc

SEQ ID NO: 68276 - DNA, 50 bp, homo sapien
tggtagactgatataactgctttacrcgtgctaactcatttcacaatagc

SEQ ID NO: 68277 - DNA, 50 bp, homo sapien
atggaaaaatgtcttcctaatctgaraaatctttttatcatcattcaggc

SEQ ID NO: 68278 - DNA, 50 bp, homo sapien
tgcactgtcccctcgcttctagttaygctgaaggtgagggatttctgtgg

SEQ ID NO: 68279 - DNA, 50 bp, homo sapien
gctaacaccatccttagagcaagcamtcaacaaatgtttttacctcttcc

SEQ ID NO: 68280 - DNA, 50 bp, homo sapien
tagcctacaaaccaaaaaagaaagcygaataacagatgcatttaaagctg

SEQ ID NO: 68281 - DNA, 50 bp, homo sapien
acttttggcttatcacttcctttcarcaataatcatagctacctctgggg

SEQ ID NO: 68282 - DNA, 50 bp, homo sapien
aagaagagaggaaggagagggatacrgaattgaaattgaggaaaggaagg

SEQ ID NO: 68283 - DNA, 32 bp, homo sapien
actggttaaaaatgcakgtgaaagacagtgtg

SEQ ID NO: 68284 - DNA, 50 bp, homo sapien
ccgtaaaaactgggtggaatgattgmgtaaaagtgatttttctgtttaca

SEQ ID NO: 68285 - DNA, 50 bp, homo sapien
aattttcagtctcacagattggtaamtattcatccttcaagtcctaacta

SEQ ID NO: 68286 - DNA, 50 bp, homo sapien
atatctcatgtctaccttcaaaacayagtaaatttctgtttctcacaaat

SEQ ID NO: 68287 - DNA, 50 bp, homo sapien
gacatctaaattgacttctcctttarcaagatctcacaacaacaatgagc

SEQ ID NO: 68288 - DNA, 50 bp, homo sapien
aagataacagtatgcagatgatttcraatattgagtaatccaattttctg

SEQ ID NO: 68289 - DNA, 50 bp, homo sapien
ttctctattctccattcagcagtcarcatgatcagatcatatcaatccct

SEQ ID NO: 68290 - DNA, 50 bp, homo sapien
ttggcttcatgatccaaattgtggcracgtatttccaggcaacaagatag

SEQ ID NO: 68291 - DNA, 50 bp, homo sapien
aattcagcaaaatgaaaatcacagcrgagataatatatcaagtgtactca

SEQ ID NO: 68292 - DNA, 50 bp, homo sapien
ctgtgctgaacactggaggtataaaragagtgaacgattcaaacagcccc

SEQ ID NO: 68293 - DNA, 50 bp, homo sapien
ttggttcaatatagcaagtatcctayagcaatattttattttaaaacatt

SEQ ID NO: 68294 - DNA, 50 bp, homo sapien
accatctgtgccctcaaaaagataaygtatagcgagactgaagaatagag

SEQ ID NO: 68295 - DNA, 50 bp, homo sapien
gccactgtgcccggccggaataccayagaatatgatttttaaaaaatgtt

SEQ ID NO: 68296 - DNA, 50 bp, homo sapien
caagctgctattcttttacagattarctatttgttattgcgcattcagca

SEQ ID NO: 68297 - DNA, 50 bp, homo sapien
gattttgataatggtttcatagatayatgtcaaaacttaccaaatgtgga

SEQ ID NO: 68298 - DNA, 50 bp, homo sapien
ggttaagatggtaattgttatgaagmatgaaatgaatgataaacagatat

SEQ ID NO: 68299 - DNA, 50 bp, homo sapien
taacagaaagactattaaaaaatcaytatctggggtagaagatttataat

SEQ ID NO: 68300 - DNA, 50 bp, homo sapien
aaggagttaagtcgtactgaagccarcattgtaactcaattttctggact

SEQ ID NO: 68301 - DNA, 50 bp, homo sapien
taggatacattagaatttctccacaygtaaaaagtaaggataaataattt

SEQ ID NO: 68302 - DNA, 50 bp, homo sapien
ttgatttcgttttgggtttttgttcrctcgtgtatgttattttggcatgt

SEQ ID NO: 68303 - DNA, 50 bp, homo sapien
aaattgagcctttaaatatatgaagyatcatgttgcaattgacggaaaca

SEQ ID NO: 68304 - DNA, 50 bp, homo sapien
tgttgaattgtttcttctaaaagcayctactaaaaacagtcctcttttta

SEQ ID NO: 68305 - DNA, 50 bp, homo sapien
gctgcagcctcctattgactaggtcygtgttaagtgtattctttggaatg

SEQ ID NO: 68306 - DNA, 50 bp, homo sapien
cgttcgcaccactttgcggaaagcasgagctaacagtgagaccgacagag

SEQ ID NO: 68307 - DNA, 50 bp, homo sapien
tacatcaaataaagcaagtcttaccraatttattagtttgtcatctgtca

SEQ ID NO: 68308 - DNA, 50 bp, homo sapien
gtccctggctacaaaaactaccatckctaaatttcagaatgttcctgtga

SEQ ID NO: 68309 - DNA, 50 bp, homo sapien
aacattgtctctcaattgaatgggaraagtcttagcaaccttacaaatta

SEQ ID NO: 68310 - DNA, 50 bp, homo sapien
cagatgggtggcaggttaacttccaycttacagaggaggaactgggtctc

SEQ ID NO: 68311 - DNA, 50 bp, homo sapien
ccacccagactctaaactttgagacrgtataagaagtagcttaaaagaaa

SEQ ID NO: 68312 - DNA, 50 bp, homo sapien
caagggaaattctactggtgtaacaygattgggaataacttcctaaagaa

SEQ ID NO: 68313 - DNA, 50 bp, homo sapien
attagcctttcacatttctaaacaarcaatatcaaattcctttttaaaaa

SEQ ID NO: 68314 - DNA, 50 bp, homo sapien
gaatgctgatggccaaaattattgaygatagtgtgtaagaaagagggtga

SEQ ID NO: 68315 - DNA, 50 bp, homo sapien
agtgagtggtaagtgtaaacttagcyggaaagcccacatagcaagaaagc

SEQ ID NO: 68316 - DNA, 50 bp, homo sapien
ctgaattcatcccctcaatggaatayctttgggccatctgaaaactacac

SEQ ID NO: 68317 - DNA, 50 bp, homo sapien
cagaagaaaactcagttctggtccasattccatgatatagagcaagagga

SEQ ID NO: 68318 - DNA, 50 bp, homo sapien
ctttcagaagcatagcaatattatcrcctatccttccaattcaaccactt

SEQ ID NO: 68319 - DNA, 50 bp, homo sapien
ccagctcagccatagagggatagacyaacaagcagggtcttggggtcccc

SEQ ID NO: 68320 - DNA, 50 bp, homo sapien
tagtttcttatgaacatttgtatttyagttgcatcagttgtaatgcctcc

SEQ ID NO: 68321 - DNA, 50 bp, homo sapien
atgtccaccctcctagatttcctgargctcctcatatttgtatgtgtttc

SEQ ID NO: 68322 - DNA, 50 bp, homo sapien
ctttgaaacactctaatctcataacyaaacagagttgaagaacagtagtc

SEQ ID NO: 68323 - DNA, 50 bp, homo sapien
cagcaaataaatgtttgaattattamaccagagaatacagttacaagcct

SEQ ID NO: 68324 - DNA, 50 bp, homo sapien
gctgtcagaatgatggtaaatggtaratgagttggccttggaagtattca

SEQ ID NO: 68325 - DNA, 50 bp, homo sapien
tgccccagcacaactgcagtagaaasaagtacaaagaaccagaattcttt

SEQ ID NO: 68326 - DNA, 50 bp, homo sapien
aggggattcatgtctcctggctctcrgttcagagattcagcttctctgtc

SEQ ID NO: 68327 - DNA, 50 bp, homo sapien
cagaacactgatgaagatagtaaccsaaacttgacacttgaacgcattaa

SEQ ID NO: 68328 - DNA, 50 bp, homo sapien
tttctgtgattctctatagattccaytaatccttcttttgtaagagttga

SEQ ID NO: 68329 - DNA, 50 bp, homo sapien
cacaagtgatggtttattctgcctayaccattaattagaaaatgatagtt

SEQ ID NO: 68330 - DNA, 50 bp, homo sapien
cacatctgtgaatgtgagtgttaacwactgtagcttttaaaaaagtaata

SEQ ID NO: 68331 - DNA, 50 bp, homo sapien
ttaaatataaaattttaggaaaagaygttacatgtcatgaatgtgcactc

SEQ ID NO: 68332 - DNA, 50 bp, homo sapien
tgcaggaagtgtgtgtgaaatgaccsaaaagataagagggtagagaaacc

SEQ ID NO: 68333 - DNA, 50 bp, homo sapien
gagatctgaggaaaccacccagaatrtagcacagagagatacaaagaaga

SEQ ID NO: 68334 - DNA, 50 bp, homo sapien
taattttacattattctctactctcraattaatgaaataaaggccttact

SEQ ID NO: 68335 - DNA, 50 bp, homo sapien
attgtgactagaggaggagcatttayatcttaactacaaagatatgtgtg

SEQ ID NO: 68336 - DNA, 50 bp, homo sapien
atgccctgaccacactttggtgatartagttgttagatcatctttcaagg

SEQ ID NO: 68337 - DNA, 50 bp, homo sapien
ttgcctagtaaagggtttcactatamaatcaacataaaatactaagtttc

SEQ ID NO: 68338 - DNA, 50 bp, homo sapien
gaatggaaaggttgctgaatacaggmaaaagtggtatgtagtaacattaa

SEQ ID NO: 68339 - DNA, 50 bp, homo sapien
ttctctttctccccaatctttccaaytgtccaccacgtttcctcatctct

SEQ ID NO: 68340 - DNA, 50 bp, homo sapien
ttatgtaaaacagacccattagctaygtttactcaggcacatggaagaag

SEQ ID NO: 68341 - DNA, 50 bp, homo sapien
tgttatggacttatgtttaattagayaaagtgaaatgaggtaattatttt

SEQ ID NO: 68342 - DNA, 50 bp, homo sapien
ctcagtaagaacagtaagtgatgcayggaagaaataaatgtggttctccc

SEQ ID NO: 68343 - DNA, 50 bp, homo sapien
aatattgagagtagggctatgatcaytatatacatcactgagtccacagt

SEQ ID NO: 68344 - DNA, 50 bp, homo sapien
taaggttttaagattttgtgtacgayattgtatttcagccagcaattatt

SEQ ID NO: 68345 - DNA, 50 bp, homo sapien
attacaggacaaaatatacaaagackcaaacattccattaagcaaaagag

SEQ ID NO: 68346 - DNA, 50 bp, homo sapien
accaaacctgtttcctattttgcggyaaatcgtttcacattgattaagtc

SEQ ID NO: 68347 - DNA, 50 bp, homo sapien
tgtgtcagcagcagctttgctctacrttcttttcaatccaagatcaaggc

SEQ ID NO: 68348 - DNA, 50 bp, homo sapien
atttgcttccattgatcatctaatcyaattccttcagtgactattctaca

SEQ ID NO: 68349 - DNA, 50 bp, homo sapien
tgatactactctcactgaaggctcartattaccaatcctaatggttttgc

SEQ ID NO: 68350 - DNA, 50 bp, homo sapien
gtttcctctattaagaatgtatatgkaactatgtaaactaagtttgggtc

SEQ ID NO: 68351 - DNA, 50 bp, homo sapien
ggatacaccaccctgaattacctggragaacgatagatggccgaacaaaa

SEQ ID NO: 68352 - DNA, 50 bp, homo sapien
tccttcccaaaacctcgaactttcaygtcctgtttgcccttggcagcagt

SEQ ID NO: 68353 - DNA, 50 bp, homo sapien
tctatttttaatctgaggaaccttcmtaatgctttctgtagtagctgcac

SEQ ID NO: 68354 - DNA, 50 bp, homo sapien
gtaaccaaactaatgggtacgtatcratagattaataatctagagggaag

SEQ ID NO: 68355 - DNA, 50 bp, homo sapien
gtagagggttttcagcattcatatcragacagaggtcaaactagctatgc

SEQ ID NO: 68356 - DNA, 50 bp, homo sapien
tagctttgtcataaggtcttcatcaycaaatcctggttcttatccttgag

SEQ ID NO: 68357 - DNA, 50 bp, homo sapien
tacgataaaatagaaaaaagtcaacmaagtccaacagtgaacaactgctg

SEQ ID NO: 68358 - DNA, 50 bp, homo sapien
tgattatataaaattatggaagtatraagtggtggagatcttagaacaaa

SEQ ID NO: 68359 - DNA, 50 bp, homo sapien
tatacacctaatggcttattccctayaaaatgaactattatggtgtcaga

SEQ ID NO: 68360 - DNA, 50 bp, homo sapien
ctgttgcaattggtctctagttgtcraataaatccaaaggacattttcca

SEQ ID NO: 68361 - DNA, 50 bp, homo sapien
cagtgcttggataagacgtggcttgyagtcaattctctaggagtgctgcg

SEQ ID NO: 68362 - DNA, 50 bp, homo sapien
aggtggagctgagtccaggaggaagwctgaggaaataaaagtgtgtaaaa

SEQ ID NO: 68363 - DNA, 50 bp, homo sapien
aatcactacagttctcagatttacascttttttttgtcattggcttgatg

SEQ ID NO: 68364 - DNA, 50 bp, homo sapien
ctgtacgctttttaaagagttttatmagctgttggaaatctatgcaatta

SEQ ID NO: 68365 - DNA, 50 bp, homo sapien
tgaggaaatccattctgattttatcsaggtttccattttgctttaatcta

SEQ ID NO: 68366 - DNA, 50 bp, homo sapien
aatacagagattagagtgctaagcawctaccaagaccagaaaattctgca

SEQ ID NO: 68367 - DNA, 50 bp, homo sapien
gctttaatctaatgagaaaatagtcyatgctggtagtaaccaaaggagtt

SEQ ID NO: 68368 - DNA, 50 bp, homo sapien
agagaagctccagggaatttattcargagtagaaggaagtacctaccaat

SEQ ID NO: 68369 - DNA, 50 bp, homo sapien
gttcaaaacatatcaactattccaamagtacataattctgaggattttac

SEQ ID NO: 68370 - DNA, 50 bp, homo sapien
ggcttgtaaggcaatggaagtacatraaataatcctaggccttccaccat

SEQ ID NO: 68371 - DNA, 50 bp, homo sapien
tcaaaatttctagaagtgacgctcartaacccaaagcaggccattatttt

SEQ ID NO: 68372 - DNA, 50 bp, homo sapien
aataagatatttgataagtgaaagayattgcaaggtttcaggaattgctc

SEQ ID NO: 68373 - DNA, 50 bp, homo sapien
tgaagcaacataggactttataccamctactaatgtagagcttagattac

SEQ ID NO: 68374 - DNA, 50 bp, homo sapien
gcttatgttaatctattcttcatccycttaacaaatacttgtatatctat

SEQ ID NO: 68375 - DNA, 50 bp, homo sapien
aatgtcagccaaccaatagaaggatwaaccataaaggggacaaaagacta

SEQ ID NO: 68376 - DNA, 50 bp, homo sapien
acaggtagtttcaatgcatcaccaayggcacaagtggaagccttggcttt

SEQ ID NO: 68377 - DNA, 50 bp, homo sapien
actgtagtgagtaatgggtataatayggtttttcaaaatgatgactacag

SEQ ID NO: 68378 - DNA, 50 bp, homo sapien
aaatgtccatcagaaccatttcaagyattaaggcagagaaagttttaatt

SEQ ID NO: 68379 - DNA, 50 bp, homo sapien
acaggctttgagctacaaacaaaagycaagcactccaaatctagggaatt

SEQ ID NO: 68380 - DNA, 50 bp, homo sapien
tctctagagatggatgcgtcttatgyaggtagaaagaaaatgaaatggct

SEQ ID NO: 68381 - DNA, 50 bp, homo sapien
ctaccataacatttctaatgcagtaragaaggaatcaattttaagaggaa

SEQ ID NO: 68382 - DNA, 50 bp, homo sapien
atctaggtcacagctacttaaaaaamtcttaagtcatataaaatgttctg

SEQ ID NO: 68383 - DNA, 50 bp, homo sapien
atgtgttattacaactctttgaagcygagatagagcagttcttatataaa

SEQ ID NO: 68384 - DNA, 50 bp, homo sapien
gtccctgttactccatcttgccccartagtttgtgctttacgtaaaaagt

SEQ ID NO: 68385 - DNA, 50 bp, homo sapien
tgttaatcctgaagaatttattagcycctttctagcattgctttagacgt

SEQ ID NO: 68386 - DNA, 50 bp, homo sapien
agacatgaaatattactctgagagaygaaaaaggaggaccttataagtac

SEQ ID NO: 68387 - DNA, 50 bp, homo sapien
cagctttccaataatgttaacaatgmaaaattatcacaatatttgcaaag

SEQ ID NO: 68388 - DNA, 50 bp, homo sapien
agatgtcttgagcagaagacagctastagccccaagtcacacagaaacat

SEQ ID NO: 68389 - DNA, 50 bp, homo sapien
tcctgagtgaatgagtttacattaayacagttgcagatttgctatggaga

SEQ ID NO: 68390 - DNA, 50 bp, homo sapien
cccaaggaaattaggagggaccataygagtaattctatcaaaaaaatatg

SEQ ID NO: 68391 - DNA, 50 bp, homo sapien
gatctcactcaggtgaatattaagawtagttggaaaagaataataaacac

SEQ ID NO: 68392 - DNA, 50 bp, homo sapien
tatgcctgcaggatattaagggaaaygaattttgtgttctggctgagagg

SEQ ID NO: 68393 - DNA, 50 bp, homo sapien
caataataagtaaacagaaacaataygtgcaactccaagtctcttaagac

SEQ ID NO: 68394 - DNA, 50 bp, homo sapien
tgaaatgatttttgcagttagttacygaaccacacacacactctttttat

SEQ ID NO: 68395 - DNA, 50 bp, homo sapien
agagaatgttacagtctttgtttcaytatatttggataataattacagta

SEQ ID NO: 68396 - DNA, 50 bp, homo sapien
aggggtcattgaggtattccaggcaygttgcttatatattaaatggccct

SEQ ID NO: 68397 - DNA, 50 bp, homo sapien
ttctttgagctttttgtatttggatktctggatctctatcaaggccagga

SEQ ID NO: 68398 - DNA, 50 bp, homo sapien
aaactccccaaggatgttaatgtaakcttctatctgtcaattacctctcc

SEQ ID NO: 68399 - DNA, 50 bp, homo sapien
tggagttgctcagaagaatagctgaygggaactttaagatgtcttgtttt

SEQ ID NO: 68400 - DNA, 50 bp, homo sapien
atgggagattgattgacattacccarattctcaaatgattgatttaatta

SEQ ID NO: 68401 - DNA, 50 bp, homo sapien
agaaatcaaatggtacactggtttargatagtctctattattttcaaacc

SEQ ID NO: 68402 - DNA, 50 bp, homo sapien
agctgcaagattgaaacagctgtatmagcaaaggatgcagttgttggagg

SEQ ID NO: 68403 - DNA, 50 bp, homo sapien
ttgaaagtacactcttcatcaaatamattaacttgcctagtgttccacac

SEQ ID NO: 68404 - DNA, 50 bp, homo sapien
tattcaacccctcctgactactgaastgggaaacattttaggtttcctga

SEQ ID NO: 68405 - DNA, 50 bp, homo sapien
ttgcttaataaaaatcctatctcatkaactcaatttattatttagtttat

SEQ ID NO: 68406 - DNA, 50 bp, homo sapien
ataactatgtcattgtctttcatgarcgatctctatgtaaaagcattgat

SEQ ID NO: 68407 - DNA, 50 bp, homo sapien
agaagtttgtcactcctgggaaaaaygtgtgtatttatgcatgtttcagc

SEQ ID NO: 68408 - DNA, 50 bp, homo sapien
aatgactggttctgattagccaactrtcaacatcgggtacattgtgaaag

SEQ ID NO: 68409 - DNA, 50 bp, homo sapien
tttcttcatctatggaggactgcaaycattatcattatttcccagaacct

SEQ ID NO: 68410 - DNA, 50 bp, homo sapien
ggtagaaaatatacagtttaagtaayaggaatgcatccatgagatatcag

SEQ ID NO: 68411 - DNA, 50 bp, homo sapien
cctaagacaaagatagatgtttggaygaccatgaaaatttgagaggccca

SEQ ID NO: 68412 - DNA, 50 bp, homo sapien
cagatttataaaaggtattcaaaggscacataatgtttggttgagttagg

SEQ ID NO: 68413 - DNA, 50 bp, homo sapien
caaatattgactcatcagtagaatcrcttacacaacacagcatttcaatt

SEQ ID NO: 68414 - DNA, 50 bp, homo sapien
atatgggatatcagcttgatcctaaytcattttgttttagaaaatgaagc

SEQ ID NO: 68415 - DNA, 50 bp, homo sapien
ttgaaatatagttagtgtgacagagraagtgaattttaattttatttaat

SEQ ID NO: 68416 - DNA, 50 bp, homo sapien
agcccaggcaggaggcaagactctayttcagtctagctcagcattcctgc

SEQ ID NO: 68417 - DNA, 50 bp, homo sapien
tgttgagaattgctttatggttaagyatgtggtcaattttagagtatgtg

SEQ ID NO: 68418 - DNA, 50 bp, homo sapien
tgttctgttatgcatagccctaacckatcactacatgttttacattaata

SEQ ID NO: 68419 - DNA, 50 bp, homo sapien
tgagaaccacacctgacaagagatcrattacatcactggcttcttctgct

SEQ ID NO: 68420 - DNA, 50 bp, homo sapien
ggcaaactggttctcaaagaaaatartagacatggactgttagagaaata

SEQ ID NO: 68421 - DNA, 50 bp, homo sapien
taatatttttataatttccaggcaamcagaactcatgaaaatttttttta

SEQ ID NO: 68422 - DNA, 50 bp, homo sapien
ggaagaccagactgtggagagccttsaacaccaggcctaggagttgaatg

SEQ ID NO: 68423 - DNA, 50 bp, homo sapien
gtgacaaaaagatatcattgtaaaaytaagggataaaatgagaaacggaa

SEQ ID NO: 68424 - DNA, 32 bp, homo sapien
actaattctggaactgyatgccagacagagag

SEQ ID NO: 68425 - DNA, 50 bp, homo sapien
gtttaaaatttaatcagatgcatcaygtgttttagttaagcagcataata

SEQ ID NO: 68426 - DNA, 50 bp, homo sapien
aacctttcttccctttctatgtaatyatgattttacttcaggccttcttt

SEQ ID NO: 68427 - DNA, 50 bp, homo sapien
agttggaactctgtgtcagggctccracttcatatttccccttggtgttg

SEQ ID NO: 68428 - DNA, 50 bp, homo sapien
ctctgaatatggggcccagaaacatktaataggccctctacgtgattccg

SEQ ID NO: 68429 - DNA, 50 bp, homo sapien
gtctgttataaattagcttcaaaacyttacatgaattgaacaacttcctc

SEQ ID NO: 68430 - DNA, 50 bp, homo sapien
ttacatgaattgaacaacttcctccrcagtaactgaacacatatcagaga

SEQ ID NO: 68431 - DNA, 50 bp, homo sapien
cactcaatctatgttacttagataayactgcaagatccataatttaagaa

SEQ ID NO: 68432 - DNA, 50 bp, homo sapien
gtcttcaagtaaactcccatggaaartattcacagacacagaaaaacaaa

SEQ ID NO: 68433 - DNA, 50 bp, homo sapien
aatcttttgtgtctcctcttttaatracacatgctaagtcaagatatttc

SEQ ID NO: 68434 - DNA, 50 bp, homo sapien
acttaagtaactgctacttcgaggayaggcgatatagatgtactgccaac

SEQ ID NO: 68435 - DNA, 50 bp, homo sapien
tattcaagtagtagttgtcaaaattraaagtgttattctttactccacag

SEQ ID NO: 68436 - DNA, 50 bp, homo sapien
tcttctgcatcaattaagatgttcaygtggtcttttttccttcattctgt

SEQ ID NO: 68437 - DNA, 50 bp, homo sapien
taaatgttcttcctatttgttcttawatcaattttgttaaagaatatcag

SEQ ID NO: 68438 - DNA, 50 bp, homo sapien
aaatcaattttgttaaagaatatcasaaactttatagacgtgattaaatc

SEQ ID NO: 68439 - DNA, 50 bp, homo sapien
gtctcctttgcccaccatttaagtgygataatttgtcagtgtttttattt

SEQ ID NO: 68440 - DNA, 50 bp, homo sapien
ccaggctgttgacctggaaagaaccyactgcttattttgccttcccttcc

SEQ ID NO: 68441 - DNA, 50 bp, homo sapien
ctaatgaaagcctggaatgatagtarctttattgctgatttgcaggcaga

SEQ ID NO: 68442 - DNA, 50 bp, homo sapien
ttctcactgaggaatgagaagagagracattttggaaaatagaagcctgt

SEQ ID NO: 68443 - DNA, 50 bp, homo sapien
gccgtcagacaataattgtatcctgmaagcctacatacatcactaaataa

SEQ ID NO: 68444 - DNA, 50 bp, homo sapien
acccggcaacattcttctatttagcracaaagaactatttggagagaggt

SEQ ID NO: 68445 - DNA, 50 bp, homo sapien
aagcaccttgaatgcactcttggagyatgatccctctcaatctgaagact

SEQ ID NO: 68446 - DNA, 50 bp, homo sapien
ttttttctaagacatacacacttackgaccaatctgaacatccatttaac

SEQ ID NO: 68447 - DNA, 50 bp, homo sapien
gttttcaaaaagaaaaaccatgtagrctttgaaccaggaaaaaaaaaaac

SEQ ID NO: 68448 - DNA, 50 bp, homo sapien
agcttctctagatatgcctagtcaayagcagttaaataataacaacaata

SEQ ID NO: 68449 - DNA, 50 bp, homo sapien
ttttggtatctagaacatacatttcraactattctttcagaactaatgag

SEQ ID NO: 68450 - DNA, 50 bp, homo sapien
aaatgtaagacattatttggcagtamcagtgcaaatatctacccagttag

SEQ ID NO: 68451 - DNA, 50 bp, homo sapien
gatgggtgttttaggcttcgagaacrctatgaataggaggtagcaaatgc

SEQ ID NO: 68452 - DNA, 50 bp, homo sapien
aacacatttatttaaagtgacagcasatagcttgttttgtaaaaatattg

SEQ ID NO: 68453 - DNA, 50 bp, homo sapien
actaggatgtgtgagagcaagcacaygggtcccagcatcagctcaagctg

SEQ ID NO: 68454 - DNA, 50 bp, homo sapien
accccacatcctcccattgttgctasagtgacccgaatctgatactgtaa

SEQ ID NO: 68455 - DNA, 50 bp, homo sapien
gatgcacagttgatctcttattgcamgcattttggcacattcgtgggaga

SEQ ID NO: 68456 - DNA, 50 bp, homo sapien
agggaattgaaaccaaaattgtaacyagatggtctctcattcaagaagtt

SEQ ID NO: 68457 - DNA, 50 bp, homo sapien
tcgaacttgaactgctcaggcaagamctttcaagtaagaagaaacacacc

SEQ ID NO: 68458 - DNA, 50 bp, homo sapien
accctaggataaaatcagcctcatgraaaggtacccagcagccctcctgc

SEQ ID NO: 68459 - DNA, 50 bp, homo sapien
aatcctcttccttctacctcaacaasaaagacaattaaactttcaaatca

SEQ ID NO: 68460 - DNA, 50 bp, homo sapien
ccatgctttctatgtatacaaaatargatggtgagtgcacatgtattcac

SEQ ID NO: 68461 - DNA, 50 bp, homo sapien
gtggagcaaacacataaacgggcaastatctcaaaggataatcataagga

SEQ ID NO: 68462 - DNA, 50 bp, homo sapien
tctcagacaatgcaattgaggcaaakataacattaagtaacttgttcaca

SEQ ID NO: 68463 - DNA, 50 bp, homo sapien
cagcataatcaccaatcacaggagtytatcacagtttttttcttcttctt

SEQ ID NO: 68464 - DNA, 50 bp, homo sapien
tggcccaaggcatgtccagaaataamatccgaggcccaaagcctgtaatc

SEQ ID NO: 68465 - DNA, 50 bp, homo sapien
agtgcagtggtgggattataattcayggtagctttaaattcctgggctca

SEQ ID NO: 68466 - DNA, 50 bp, homo sapien
gataaaatggagaatgtaagtattgyagaagaaatgtatattaatagaca

SEQ ID NO: 68467 - DNA, 50 bp, homo sapien
acaaccagtgccaccttcattggaaycatggtaaatttgggataaatgtt

SEQ ID NO: 68468 - DNA, 50 bp, homo sapien
gcagaacagcctaggcaaagccgcartcgtgaaaggtaggcctgggtaag

SEQ ID NO: 68469 - DNA, 50 bp, homo sapien
taatgtatgcattcaactctcagaawtaagcttttcttttgactgaggag

SEQ ID NO: 68470 - DNA, 50 bp, homo sapien
aagatagttttgctggtggagatacmatttttttaatctaataattccgg

SEQ ID NO: 68471 - DNA, 50 bp, homo sapien
tcccattttgttactagtatcactarcatttgagctggaagccagatagt

SEQ ID NO: 68472 - DNA, 50 bp, homo sapien
gttgtgggctctgagggaacaaatasagtagggaagtctgtgaatttgga

SEQ ID NO: 68473 - DNA, 50 bp, homo sapien
taatttatatataagcataaagatayggcaagcagttagttttacaaatc

SEQ ID NO: 68474 - DNA, 50 bp, homo sapien
cccaacgcctgatgcttaagcctggwaacttcaagaaatccatatgcagg

SEQ ID NO: 68475 - DNA, 50 bp, homo sapien
atttaaataccataagtacagtgcawactcatatatctataaaataaggg

SEQ ID NO: 68476 - DNA, 50 bp, homo sapien
gcaactgctgaggctatggaaactcmaatctttttggtcatcttattttc

SEQ ID NO: 68477 - DNA, 50 bp, homo sapien
ttcaagatttatgtaagaataagtamaatgactctgtgtcttaactgtat

SEQ ID NO: 68478 - DNA, 50 bp, homo sapien
tagagtaaatacttaagagagtgggratactaggtcatatggtaagtgta

SEQ ID NO: 68479 - DNA, 50 bp, homo sapien
gtaaatcaagcaaacttcttaggcakgtcaatattaaataaattaaaaat

SEQ ID NO: 68480 - DNA, 50 bp, homo sapien
tcagttatcaactcagcacgacttcraagggtcaggaagatgctcttaga

SEQ ID NO: 68481 - DNA, 50 bp, homo sapien
ttggagccagcagtagacaacacaaktcagcagttttacagacagacgcg

SEQ ID NO: 68482 - DNA, 50 bp, homo sapien
ttcccaacctctcaacatttttgtgracttcccaaaatcatttaaattaa

SEQ ID NO: 68483 - DNA, 50 bp, homo sapien
ctgctttctccacttcatccccaaaytgaatcttctcttcaagcctaaag

SEQ ID NO: 68484 - DNA, 50 bp, homo sapien
ttatcttctttgctagatagtaaatyacccaaggaacattcccagagtgc

SEQ ID NO: 68485 - DNA, 50 bp, homo sapien
agtgatgttagtttgtttggtgcacycatatttgttcttggaccttcact

SEQ ID NO: 68486 - DNA, 50 bp, homo sapien
atttattaactattcgctatgaaccragcattggcctagatacttcacat

SEQ ID NO: 68487 - DNA, 50 bp, homo sapien
aagtgtgctgcaaactagatgtagcrcaaaatattaaagcaaagttttat

SEQ ID NO: 68488 - DNA, 50 bp, homo sapien
ggacagcttccagtgtgaatccctayaatggaacacgttaaaagtggtat

SEQ ID NO: 68489 - DNA, 50 bp, homo sapien
atgagttggatgtcgattagattacrgataggactaaatcatattctgta

SEQ ID NO: 68490 - DNA, 50 bp, homo sapien
ccattcttgggacctggactatgatrgccacagcagctaaagatgccagg

SEQ ID NO: 68491 - DNA, 50 bp, homo sapien
tcaaaaaagtacagcagttagggacrctaggcatatactaagaaacagtt

SEQ ID NO: 68492 - DNA, 50 bp, homo sapien
tgacatctgctgcacttagaggaaartagtcattctctctaatatatttg

SEQ ID NO: 68493 - DNA, 50 bp, homo sapien
gaagaacttgggaagttgtgggtgaygaatacttgggttctatagaagaa

SEQ ID NO: 68494 - DNA, 50 bp, homo sapien
ctagagctagaatgcaaatctcctaygcactgactatgtgaggacgttta

SEQ ID NO: 68495 - DNA, 50 bp, homo sapien
gttacatgtaaataaatgcattgacyattacagagatttggttgtagggt

SEQ ID NO: 68496 - DNA, 50 bp, homo sapien
ccctgccatcatggagcatacgttcyagtgtaaagagataatgaaaatac

SEQ ID NO: 68497 - DNA, 50 bp, homo sapien
atgtgtttaagcccttagcctctacraagtccaacgacaactccctaatt

SEQ ID NO: 68498 - DNA, 50 bp, homo sapien
aaaataacacttatatagtcaccaawctatttatagctgccaggacatat

SEQ ID NO: 68499 - DNA, 50 bp, homo sapien
aggcctgaaattaatatatatttaarccttctcagataattttctagaca

SEQ ID NO: 68500 - DNA, 50 bp, homo sapien
gctggaagaaccaccacatcttgtastaaccttttgttctgctttgcttc

SEQ ID NO: 68501 - DNA, 50 bp, homo sapien
gaaaagatgtaaatttacaaggaacygctggaaatgaagttttaaaatca

SEQ ID NO: 68502 - DNA, 50 bp, homo sapien
gaccctgttaagtggatgaaaacaargtgtggattgggagaatggaatat

SEQ ID NO: 68503 - DNA, 50 bp, homo sapien
tcccttgtcctttaaattcagtttarcacttctaatatctaataaatgag

SEQ ID NO: 68504 - DNA, 50 bp, homo sapien
aattagaaatacaaaaatagtagaaytgctatgtccaggagatttaatac

SEQ ID NO: 68505 - DNA, 50 bp, homo sapien
ataggagatcatgtgtaacaggcacmaaaggaggagttttaagaaaaatg

SEQ ID NO: 68506 - DNA, 50 bp, homo sapien
tttcttgtttactgcctggtgcatarcagctactcaagaaaatattttgg

SEQ ID NO: 68507 - DNA, 50 bp, homo sapien
tgttagctattttactatttcatcayagattcttataggacagtggccac

SEQ ID NO: 68508 - DNA, 50 bp, homo sapien
acggatttttaaggaatggaagcaaytattatatcaacgacacatacaca

SEQ ID NO: 68509 - DNA, 50 bp, homo sapien
ccgttagccacctacactgtcaaaaraggttataaaatgtatcgtttaac

SEQ ID NO: 68510 - DNA, 50 bp, homo sapien
gaagtgtttaaagggaatataagtayggatttttaaggaatggaagcaat

SEQ ID NO: 68511 - DNA, 50 bp, homo sapien
attaaaaaagaaaataattaacggaygatagtgtttatcaacctactgtg

SEQ ID NO: 68512 - DNA, 50 bp, homo sapien
ggataggaattgtgtttcaaatcaamatacagccagccgtgaccatatgc

SEQ ID NO: 68513 - DNA, 50 bp, homo sapien
gcagatagaaagggtacattagacaraaccaaatgtaccagtcactcaaa

SEQ ID NO: 68514 - DNA, 50 bp, homo sapien
aattcactttacattctcatcttggrataacagatgtttgaaatacacgt

SEQ ID NO: 68515 - DNA, 50 bp, homo sapien
ggcacttatgaaaaactcgcagctarcatctaacttaatagtagaaactg

SEQ ID NO: 68516 - DNA, 50 bp, homo sapien
taataatacatatatatgtatataawcacatctataattatttctctgtc

SEQ ID NO: 68517 - DNA, 50 bp, homo sapien
tataaaaattgcacaataaatcaatraactagggcagaatagagggcaaa

SEQ ID NO: 68518 - DNA, 50 bp, homo sapien
ggtatattcacagatgaactgtttaygcacatgaattggaaggggtcata

SEQ ID NO: 68519 - DNA, 50 bp, homo sapien
tggtattgttattctccttgtaaaaycttttaatggctccctatcatgtg

SEQ ID NO: 68520 - DNA, 50 bp, homo sapien
gtcaaagaccaaattttagaacaaawaatgctcctagcacctccgacact

SEQ ID NO: 68521 - DNA, 50 bp, homo sapien
atggttttcctctccagcacccattkcctccttactcaagcaatggccct

SEQ ID NO: 68522 - DNA, 50 bp, homo sapien
tgctgagcaacagcagaaaactcaaygtatttgcttgctactaggagctt

SEQ ID NO: 68523 - DNA, 50 bp, homo sapien
catagcttcttctctgctaagtagcrataacatctacctattgacctcca

SEQ ID NO: 68524 - DNA, 50 bp, homo sapien
acagatttgaaccattgtattgattractagtatggaaacagtctttttg

SEQ ID NO: 68525 - DNA, 50 bp, homo sapien
gcttatataccatctcgaggttatasaaaggttgcacactgcacgctcag

SEQ ID NO: 68526 - DNA, 50 bp, homo sapien
ctgtttttttttttttctaaaatctraattgaatggcacaaatacacagt

SEQ ID NO: 68527 - DNA, 50 bp, homo sapien
tctagtgatgagaaaataatgaagcracggggctccattcccatttgcct

SEQ ID NO: 68528 - DNA, 50 bp, homo sapien
gccctccatcactcatcactcaaggmagtaatggaacaccttccacaacc

SEQ ID NO: 68529 - DNA, 50 bp, homo sapien
taagatgatccttggtggctttaccmaacctaaataatactaaagtcaaa

SEQ ID NO: 68530 - DNA, 50 bp, homo sapien
ctaccatcggaaaatctgcaaaaaaygagtgaaaagaaaacacgtctcag

SEQ ID NO: 68531 - DNA, 50 bp, homo sapien
attacactctaagtataagagtgaaytagaaataaaccaaacatctattt

SEQ ID NO: 68532 - DNA, 50 bp, homo sapien
gttttgctttacatagccaaattaastacctgaaataaaatatagaatat

SEQ ID NO: 68533 - DNA, 50 bp, homo sapien
aaacttaataatcagattttttaaaygtccttctgatattcatgcagaca

SEQ ID NO: 68534 - DNA, 50 bp, homo sapien
ggatgtcccccttcctaagcacatarctaatgactcctccttctgtgcta

SEQ ID NO: 68535 - DNA, 50 bp, homo sapien
gctggcaaatgaatatagagaaatayggtgaggtgaaaaaagaaagagaa

SEQ ID NO: 68536 - DNA, 50 bp, homo sapien
ccattaatttctgttactagttgtcyggagcttcctaggttcttactctt

SEQ ID NO: 68537 - DNA, 50 bp, homo sapien
actcactcagttgtgaataggaaggkctctctgtgatctggccacagctt

SEQ ID NO: 68538 - DNA, 50 bp, homo sapien
gaagcaccctgtttaaggccaccgargctataagaaatttaaaatgttat

SEQ ID NO: 68539 - DNA, 50 bp, homo sapien
aaatatcttagcaaagccattaagasgtagctaacaaattccagatcctg

SEQ ID NO: 68540 - DNA, 50 bp, homo sapien
tcaatatcgacttgcaagtgaaaacrgtttctgatattgtatgtgtatga

SEQ ID NO: 68541 - DNA, 50 bp, homo sapien
atgagtaatccattgttcatactaaygctctttatgactagaattttgta

SEQ ID NO: 68542 - DNA, 50 bp, homo sapien
gttcctgattaaggatacattttgayactggagtgctggaaagggaagat

SEQ ID NO: 68543 - DNA, 50 bp, homo sapien
atgtggagaaaatcactttgttccawctgagaagaaatggttgagcactg

SEQ ID NO: 68544 - DNA, 50 bp, homo sapien
aattaaagaattagtctaggatatasaaatggtttcaccctcaatgtcac

SEQ ID NO: 68545 - DNA, 50 bp, homo sapien
tctgcctttttatgttgtggtccaartaactctgagcttttctcatgttg

SEQ ID NO: 68546 - DNA, 50 bp, homo sapien
agccaggctaccctctagttctaggscaatctactgctatcactcacttg

SEQ ID NO: 68547 - DNA, 50 bp, homo sapien
tgggaggttcctaagagaacgctaarcatgggatcaaaagagtgacacct

SEQ ID NO: 68548 - DNA, 50 bp, homo sapien
ttgggtaggtgcctaaattgacagaygatgttttctttgaaatcactctt

SEQ ID NO: 68549 - DNA, 50 bp, homo sapien
tgtggctagtagctactgtatcaaayagtgtagagaacattttcatcaac

SEQ ID NO: 68550 - DNA, 50 bp, homo sapien
aggcccccagacaataagataaggcycagctgtgaagtgttgatgctgga

SEQ ID NO: 68551 - DNA, 50 bp, homo sapien
atcttgttacctctattttatcagargaagaaactgaaacacagagatga

SEQ ID NO: 68552 - DNA, 50 bp, homo sapien
ggtataatgagattggagagaagacrgatctaattcccaaacaactgaag

SEQ ID NO: 68553 - DNA, 50 bp, homo sapien
aaccaaaatagcaagtagatactcayatattgaatagatcacctaaggca

SEQ ID NO: 68554 - DNA, 50 bp, homo sapien
aaggcagaaaagagtgaataatgaamatatgatgtaaaaaatccagtaat

SEQ ID NO: 68555 - DNA, 50 bp, homo sapien
gcaaatggctttgcctgcatggaaartgaagtgaattgaagcaaatgaca

SEQ ID NO: 68556 - DNA, 50 bp, homo sapien
ttcaatctctcttggttccttcccasgtatgtaaatatgctcaagcctca

SEQ ID NO: 68557 - DNA, 50 bp, homo sapien
cttatgaacaaaaccttcttgggccrgagcctaaacattacttatataaa

SEQ ID NO: 68558 - DNA, 50 bp, homo sapien
gtgttgcttttcacaaagaacaacayaagtagtcactaatctgagactgt

SEQ ID NO: 68559 - DNA, 50 bp, homo sapien
taattatcttttaggcttcataaggrcaactctgcattctaatagtggca

SEQ ID NO: 68560 - DNA, 50 bp, homo sapien
caaggttctgacttgactttttccaygggaagcaacttcatttctcaact

SEQ ID NO: 68561 - DNA, 50 bp, homo sapien
ttcttagaatggcttatttggtgaayacctttggaatactcatagtcata

SEQ ID NO: 68562 - DNA, 50 bp, homo sapien
gagatgagactggaaatgtggacacraggccaatgagtgtacagctgccg

SEQ ID NO: 68563 - DNA, 50 bp, homo sapien
ccacatccccttcctctctgctatgkaatgtatctgtcctttctgcttgt

SEQ ID NO: 68564 - DNA, 50 bp, homo sapien
cagagctctgattatttggcctaacmaggactgaatacacaaaaacattt

SEQ ID NO: 68565 - DNA, 50 bp, homo sapien
aatgtaggatgctgtttaatgtaagscatttcatgttgctatcacagaac

SEQ ID NO: 68566 - DNA, 50 bp, homo sapien
taatacatttgtctggaaaaccaaastgtatttagaatctgctatctgct

SEQ ID NO: 68567 - DNA, 50 bp, homo sapien
gtgcagtaaccttggatagaaatacyaatgacctagtctagtggttacca

SEQ ID NO: 68568 - DNA, 50 bp, homo sapien
aaaaaaaaccataaatcttcaggtasctaactagtcattaatttaaaaat

SEQ ID NO: 68569 - DNA, 50 bp, homo sapien
gagtctgtcagtagtagattaggtasagaacttttatacagttgagggtg

SEQ ID NO: 68570 - DNA, 50 bp, homo sapien
tcagatcaaattaaatactctgacckatattatgcagcagagataggact

SEQ ID NO: 68571 - DNA, 50 bp, homo sapien
tttagcgaatattactgtaatattcrctatacaccatataatcaaatttt

SEQ ID NO: 68572 - DNA, 50 bp, homo sapien
aaaaaatcatctttaagacacattcrcaaataaaaaagataaaatctaac

SEQ ID NO: 68573 - DNA, 50 bp, homo sapien
aaaaagcagcactattataaaatgaygacatattcaatgctgaacaaaga

SEQ ID NO: 68574 - DNA, 50 bp, homo sapien
tttggcactgaagtgaataaatcacycttaatctggcatgtgaatgcata

SEQ ID NO: 68575 - DNA, 50 bp, homo sapien
aaggaccatttttatgcattttgacyatcttttacactacttttcttaat

SEQ ID NO: 68576 - DNA, 50 bp, homo sapien
tctgtagtaaatagaaagagcatgtyaggaaaatgaaaaactttggacct

SEQ ID NO: 68577 - DNA, 50 bp, homo sapien
tgtcctgtttcaagtttaaactatargccagtaagttgtaatttttttca

SEQ ID NO: 68578 - DNA, 50 bp, homo sapien
acaaaagtattttgcatttgttatcrccttttctactgttctatccccac

SEQ ID NO: 68579 - DNA, 50 bp, homo sapien
tgcccagaggtcaagtcttctgcacrcgcttcagcctcacctcttgcagc

SEQ ID NO: 68580 - DNA, 50 bp, homo sapien
cttatatagtgttctgggtttaacamtatattataatgaaatatgttcat

SEQ ID NO: 68581 - DNA, 50 bp, homo sapien
aacctgggtcgtttatttaacttacygctaatctcaatgtctcagttacc

SEQ ID NO: 68582 - DNA, 50 bp, homo sapien
taatccctaaatgatctcttatatgmagctgtataccacagatgataaac

SEQ ID NO: 68583 - DNA, 50 bp, homo sapien; identical to SEQ ID NO: 67943

SEQ ID NO: 68584 - DNA, 50 bp, homo sapien
aactaaagaagtcagcacagaaaaayttcagggttgtgaaaatagcctgc

SEQ ID NO: 68585 - DNA, 50 bp, homo sapien
gtcataagtgaacctggatgagagaygaagtacgtaaaacattttttgtc

SEQ ID NO: 68586 - DNA, 50 bp, homo sapien
gaatctagaaaggaagaaccatatcrtcaatgtcatgtgacctgatccat

SEQ ID NO: 68587 - DNA, 50 bp, homo sapien
tcaaatatacctgatgatgatacagrcctatacccttgatggatgtaaat

SEQ ID NO: 68588 - DNA, 32 bp, homo sapien
atgctctgaaatctccrcttatctcttaactt

SEQ ID NO: 68589 - DNA, 50 bp, homo sapien
tacaaatatggagtgggattgagaaygaaagttgaagaaagagacgggtt

SEQ ID NO: 68590 - DNA, 50 bp, homo sapien
tctataggtatggtgacatttgccaytgaatcttacatgtgagccattca

SEQ ID NO: 68591 - DNA, 50 bp, homo sapien
acagtctgataacttttcatccaagmaaggcttaaagtattactatttca

SEQ ID NO: 68592 - DNA, 50 bp, homo sapien
ggttaaaaattattttaagagtcccrggaaaagacagaaggttagcatac

SEQ ID NO: 68593 - DNA, 50 bp, homo sapien
ctgaaaccttaatgtttcagaaaacscatgagacttttgcattttctcct

SEQ ID NO: 68594 - DNA, 50 bp, homo sapien
tctgcataatttctaattggattcaygagtaaaaaaccaacaacattttt

SEQ ID NO: 68595 - DNA, 50 bp, homo sapien
atgattactgcaggtaagcaatttawcatatccattatcttccatagtta

SEQ ID NO: 68596 - DNA, 50 bp, homo sapien
gccaatacgaggttcacaatagacamggaaaagtctccctaaatatccag

SEQ ID NO: 68597 - DNA, 50 bp, homo sapien
acctctgtatttctattcctcaacargccaaattcagtgaatcaccaaag

SEQ ID NO: 68598 - DNA, 50 bp, homo sapien
tactgataaataccatatgaaaacaygactaaaagactgatttaagaaac

SEQ ID NO: 68599 - DNA, 50 bp, homo sapien
aacaccagttctgttgtgcaagaaargctaacggtagttcttcaatctga

SEQ ID NO: 68600 - DNA, 50 bp, homo sapien
aaagtctgagggaatgaattaaacasgtattttgagcaaattgattacta

SEQ ID NO: 68601 - DNA, 50 bp, homo sapien
ttgtgggaataatgttaaaatgatgyatttcctctaagactggctgcaca

SEQ ID NO: 68602 - DNA, 50 bp, homo sapien
tcttgttcaagatgattattttgaasaaaacactgaatttgcatgtcatg

SEQ ID NO: 68603 - DNA, 50 bp, homo sapien
gccattaaattaactcaaaggggtaraatatgagtctgctctagattgct

SEQ ID NO: 68604 - DNA, 50 bp, homo sapien
tcaaacttcattagagatttaacagkaacagtacagtatagtagaataca

SEQ ID NO: 68605 - DNA, 50 bp, homo sapien
agggacattacagagcacagtaagayccatagtgaaaaaccgaatattcc

SEQ ID NO: 68606 - DNA, 50 bp, homo sapien
actggatcatgagggtggtccttgaygaatggtttagagccatcccctcg

SEQ ID NO: 68607 - DNA, 50 bp, homo sapien
tgggagctaacagggcacacaaacartaatttttaatagccagagccaga

SEQ ID NO: 68608 - DNA, 50 bp, homo sapien
tttgataaatggggacatatttttawcaagtttagcactccgttaaacaa

SEQ ID NO: 68609 - DNA, 50 bp, homo sapien
actaaatgaaaatatactagtcacayatctaaagaggagcaacatttaaa

SEQ ID NO: 68610 - DNA, 50 bp, homo sapien
tttctactgagaaattaaatgtaaamttaaaggattatccctttccaaaa

SEQ ID NO: 68611 - DNA, 50 bp, homo sapien
gcagtatactacctgggcatcactgygaattatttagagcccccaggctc

SEQ ID NO: 68612 - DNA, 50 bp, homo sapien
atttgggaaataatttttaaaaaacrcttcacagatagttgtgaaaatca

SEQ ID NO: 68613 - DNA, 50 bp, homo sapien
agctgcatgatcttaaagaaagctaygattttaataaataattactgaat

SEQ ID NO: 68614 - DNA, 50 bp, homo sapien
tgataatgaggctgaaagtccataartgaagcctgtattttaaatcaagt

SEQ ID NO: 68615 - DNA, 50 bp, homo sapien
agtaagtaaaatgggattacaaaacygacagagattcatgcaaatgaaca

SEQ ID NO: 68616 - DNA, 50 bp, homo sapien
taagtttgggaaaatattggtggtargtcacaagtaggcctggactactt

SEQ ID NO: 68617 - DNA, 50 bp, homo sapien
gtttggcattgactttgtgcctcaamtctgatagctgaacattcatcttg

SEQ ID NO: 68618 - DNA, 50 bp, homo sapien
aattctgttaagtcagaaccttgtayacactaatgagagtacatcatgtg

SEQ ID NO: 68619 - DNA, 50 bp, homo sapien
gttatggatagattcatttcgttgargtctctcattttgtgaggtgggct

SEQ ID NO: 68620 - DNA, 50 bp, homo sapien
tctgtgtatcctacagtgggagaacygaaagagaggtgctggtattaacc

SEQ ID NO: 68621 - DNA, 50 bp, homo sapien
aagatcgtaagaggaaaataaatagrcaaatattgcttagactaacagcg

SEQ ID NO: 68622 - DNA, 50 bp, homo sapien
aaagtgaacataatttatctgataarctcattgctgcaagttattgatct

SEQ ID NO: 68623 - DNA, 50 bp, homo sapien
agagaaagcctcattgagaagacacrctaaggaggccatgtggctggagg

SEQ ID NO: 68624 - DNA, 50 bp, homo sapien
tttagtcatcattaatcaatgccaarcgaaaaaatcttaagatgtattta

SEQ ID NO: 68625 - DNA, 50 bp, homo sapien
aagtcaaatggattctctattgttawgtatttatcatcaatttataaaaa

SEQ ID NO: 68626 - DNA, 50 bp, homo sapien
cagattgggcaatgcagccgggcctyaaaataataaataaggttcaactg

SEQ ID NO: 68627 - DNA, 50 bp, homo sapien
gtctgaacagatgaaataaggtaaastcaaagagcataatatgacgatgg

SEQ ID NO: 68628 - DNA, 50 bp, homo sapien
aaggtaaagtcaaagagcataatatracgatggatgtagataggacacag

SEQ ID NO: 68629 - DNA, 50 bp, homo sapien
aaaggacagactgatggaacattatyactgtgaaaggaaaatatcttggg

SEQ ID NO: 68630 - DNA, 50 bp, homo sapien
tttggagttttactggctttcaaccrggaagacaagatttcctgtttcca

SEQ ID NO: 68631 - DNA, 50 bp, homo sapien
tactggacttgaatggttaataaaaktgcacaatgttgttggtggcagtg

SEQ ID NO: 68632 - DNA, 50 bp, homo sapien
atcacaaatttttcagatggttcaayggttattctattaaatatggagca

SEQ ID NO: 68633 - DNA, 50 bp, homo sapien
attgctaagtgccattaaattgcacraaatatcaaaatacagtgaggaac

SEQ ID NO: 68634 - DNA, 50 bp, homo sapien
tgggttttaccactttggattctackgaaaggctacactttacctctgac

SEQ ID NO: 68635 - DNA, 50 bp, homo sapien
atcatatagtggtcactctagtcaasaattttgcatctgacgatttttca

SEQ ID NO: 68636 - DNA, 50 bp, homo sapien
acaaccaggccgatagtgtaaaatcractgtctcaccataaaatcttaaa

SEQ ID NO: 68637 - DNA, 50 bp, homo sapien
aaatggtagaagattctcaggtagaygaaaattatgtcggccgggggcgg

SEQ ID NO: 68638 - DNA, 50 bp, homo sapien
atatttcctggatctgaatgtcctcrcttgtataagaagaaggttcaatt

SEQ ID NO: 68639 - DNA, 50 bp, homo sapien
tatttaaaaccctagaggtatctccrcataagtgttttctatattatttg

SEQ ID NO: 68640 - DNA, 50 bp, homo sapien
tccattctcatggattggaagaatcratgtattagtctgtttttatattg

SEQ ID NO: 68641 - DNA, 50 bp, homo sapien
tgaatgcacttcataaattacaaaasaacttagaacactgaaaagcttca

SEQ ID NO: 68642 - DNA, 50 bp, homo sapien
tttcctggaacgtagtcaacagtttrtgtgcaactcaacagggaataaga

SEQ ID NO: 68643 - DNA, 50 bp, homo sapien
aaatcctggatctgccctcatagctsaatgacgggttaaatgcttcacct

SEQ ID NO: 68644 - DNA, 50 bp, homo sapien
cagtgccaactgaacactcttaacaraagtcctgagagtcattagtgtgt

SEQ ID NO: 68645 - DNA, 50 bp, homo sapien
gggaccttcccagctgtgttaaataraagataccaccctttggtcagttc

SEQ ID NO: 68646 - DNA, 50 bp, homo sapien
tgaaaagggcattactatttggtaayccaggtcttgatcttaattcaaac

SEQ ID NO: 68647 - DNA, 50 bp, homo sapien
ctaaagacaaaaagatgccaagtcamatcattggataaagcaatatgaaa

SEQ ID NO: 68648 - DNA, 50 bp, homo sapien
tgctcaatactaaactcttccaaacmgttggatctatcactggaattctg

SEQ ID NO: 68649 - DNA, 50 bp, homo sapien
gaaaagaacgaagtaactgagaagargaaataggaatatgaatttaaaat

SEQ ID NO: 68650 - DNA, 50 bp, homo sapien
tagaatatacattattttcatctacraatggaacaatctgtaagattgac

SEQ ID NO: 68651 - DNA, 50 bp, homo sapien
gttgaactacatatattaaatcaaargaagaggccatttgactatctaag

SEQ ID NO: 68652 - DNA, 50 bp, homo sapien
gaaagtagaagttgctagtcaataartcattctcagatatatttccccaa

SEQ ID NO: 68653 - DNA, 50 bp, homo sapien
tatcaggatgcctggcaccaaaatayggatggaaagagcctgggatttgc

SEQ ID NO: 68654 - DNA, 50 bp, homo sapien
aagagcttattgcagttaatcatackacatattataaccccccaaaaaag

SEQ ID NO: 68655 - DNA, 50 bp, homo sapien
actgtatgtgagaaatcttgacataytggattggaattaagagaaactaa

SEQ ID NO: 68656 - DNA, 50 bp, homo sapien
actcattgagaaagagtgtccagacyaaggcttaattgcagaaactttta

SEQ ID NO: 68657 - DNA, 50 bp, homo sapien
ggataataacaagtcagtgcaaagaraggtcttccaaaggagagaaaaaa

SEQ ID NO: 68658 - DNA, 50 bp, homo sapien
acctaacaatatgcttcattatacayagcgggcatttaattgagcctgct

SEQ ID NO: 68659 - DNA, 50 bp, homo sapien
cttaaaaaacaactggaggagtgaaycatcgcttagattgggcagagaca

SEQ ID NO: 68660 - DNA, 50 bp, homo sapien
tgtcttaggcaagcaatttgttttayagggctcgtacattcagaaaagaa

SEQ ID NO: 68661 - DNA, 50 bp, homo sapien
agaaagcagcaaatttagggttccaygtagatgcagtatatttatattaa

SEQ ID NO: 68662 - DNA, 50 bp, homo sapien
taccaagctgtctaaccttgtataaytggagaccaagaaggaaagaagag

SEQ ID NO: 68663 - DNA, 50 bp, homo sapien
tacacacaagaggcttcaataaataygtgttgtgtgagtgaataaatgcc

SEQ ID NO: 68664 - DNA, 50 bp, homo sapien
gttactttttgattcagataaaacaygcttgggaaaaagtacctggaggc

SEQ ID NO: 68665 - DNA, 50 bp, homo sapien
gatgttttgtttttctctataggcamctcataagttacaatgccaaagtc

SEQ ID NO: 68666 - DNA, 50 bp, homo sapien
gtaatgccttgaagtgaaatgcacayggctgttagtcagacaaacagctg

SEQ ID NO: 68667 - DNA, 50 bp, homo sapien
ttcaaaatgaaagcaattctaacgaytaagtataaagaagtctgacgaag

SEQ ID NO: 68668 - DNA, 50 bp, homo sapien
ctggttggggatctgagtaaatgacrgtaccacaagcagaatgagcttag

SEQ ID NO: 68669 - DNA, 50 bp, homo sapien
tgacaagttcctatcaattctacaakctatataatcagttctacaatttg

SEQ ID NO: 68670 - DNA, 50 bp, homo sapien
caggtagacatgttaggacctaaacyagatgttgttaatgcctgttcaga

SEQ ID NO: 68671 - DNA, 50 bp, homo sapien
tgcgtttgtaaaccagctcactgaayaagaaagccttgattagcatttgc

SEQ ID NO: 68672 - DNA, 50 bp, homo sapien
tagtgctcataaggaagtcatagagkacacttatgggatgagctcctgaa

SEQ ID NO: 68673 - DNA, 50 bp, homo sapien
gatcaattcttattttgctgaaaacmgtgtatccagcagctaagtgtcca

SEQ ID NO: 68674 - DNA, 50 bp, homo sapien
aaagatggaataaagattaattaacragagaatcatgctgttgaactgaa

SEQ ID NO: 68675 - DNA, 50 bp, homo sapien
taaaaagtttctgaactagatcatayaataaaactccataaatcttgaaa

SEQ ID NO: 68676 - DNA, 50 bp, homo sapien
atcctgtattgtggcttactgtagcwcttcatattcccttgaattttaga

SEQ ID NO: 68677 - DNA, 50 bp, homo sapien
aggggaatagcattgctcacccttcyactggacaaagaaatgataatcta

SEQ ID NO: 68678 - DNA, 50 bp, homo sapien
ctgttttcagtttctcagaatggtaygataaaatcttacagtacaattgt

SEQ ID NO: 68679 - DNA, 50 bp, homo sapien
catccagagaaatatttcattacacrgaaacattcatgatatacactgtt

SEQ ID NO: 68680 - DNA, 50 bp, homo sapien
ctggtgggtgaatggcaaacttacartgaacacagaattaaaggatcctg

SEQ ID NO: 68681 - DNA, 50 bp, homo sapien
tatgttgagaagttgcatcccattcratctattctcgtcaccatcagaaa

SEQ ID NO: 68682 - DNA, 50 bp, homo sapien
gcatctgcatcccagattgtgggaasagagatggcccaggtaaacgaagg

SEQ ID NO: 68683 - DNA, 50 bp, homo sapien
cgctatcaaagtgaagaaggccaagmagaagtctctaaaaccaatcatct

SEQ ID NO: 68684 - DNA, 50 bp, homo sapien
tatttctactaatcgttctattagakgctggacattatggatatcctgtt

SEQ ID NO: 68685 - DNA, 50 bp, homo sapien
cagaagcatgtgcagagattgatagyaatgctgaattaatgcagcatgtt

SEQ ID NO: 68686 - DNA, 50 bp, homo sapien
attgtaattgttctagtctgctgttsaaagtttccactgcattttgtatt

SEQ ID NO: 68687 - DNA, 50 bp, homo sapien
ttagaaaggtattttaaaaatccaaygaggatggagaataaatttccttt

SEQ ID NO: 68688 - DNA, 50 bp, homo sapien
tatagcagctgcttccaatgttatcrgagtataattgattttaattattt

SEQ ID NO: 68689 - DNA, 50 bp, homo sapien
tattatgcacttccagaaggtagacrtttactctcccctcatcaccagga

SEQ ID NO: 68690 - DNA, 50 bp, homo sapien
taaatctgacttcgtattgtgactayagaacataaaagctgttctcctgt

SEQ ID NO: 68691 - DNA, 50 bp, homo sapien
ttatttgctacattttcagcaaatawgaaagaaaagttaatgttttatta

SEQ ID NO: 68692 - DNA, 50 bp, homo sapien
caggacatgaggaaagcacaaaagasatggaaaaacgatcaagtaaccat

SEQ ID NO: 68693 - DNA, 50 bp, homo sapien
tgaaaaggaaatctttctaaaaataygatccaaagaattggccaaaagaa

SEQ ID NO: 68694 - DNA, 50 bp, homo sapien
gcaagagggcagagagagccttattytgtggcagggcggctaaagaatca

SEQ ID NO: 68695 - DNA, 50 bp, homo sapien
ataagcaatttctctcctcttattaygtgaattgtctaggttgcagctca

SEQ ID NO: 68696 - DNA, 50 bp, homo sapien
tggaaacctgaattagtccttctccrcttataatcacaaactggtcagaa

SEQ ID NO: 68697 - DNA, 50 bp, homo sapien
aaaatataatttcaataaaaactgayggtaaaaagcacccagacaaccag

SEQ ID NO: 68698 - DNA, 50 bp, homo sapien
tttgaatctcttcattgtaacttcamacaacataggtagtttgcaagaga

SEQ ID NO: 68699 - DNA, 50 bp, homo sapien
aaagtctcagtcaacagtcccaaaakaaatgttgcctgttgctgggaaag

SEQ ID NO: 68700 - DNA, 50 bp, homo sapien
caccctgttggaattgagtgggcaaygaagccttccaggtattagagaca

SEQ ID NO: 68701 - DNA, 50 bp, homo sapien
taaaaggactccccactgaatcacartctttcatcataaatgattaaatt

SEQ ID NO: 68702 - DNA, 50 bp, homo sapien
ttcctttggtgttgttaacatagaargcagtgaataatttctgctcattg

SEQ ID NO: 68703 - DNA, 50 bp, homo sapien
tttacaagaactcagtgaaacaacasgacttctaatgagctctctcttca

SEQ ID NO: 68704 - DNA, 50 bp, homo sapien
aacgttcctaaggatgacttcctgaygaaactttacaagaactcagtgaa

SEQ ID NO: 68705 - DNA, 50 bp, homo sapien
gattgctaagttgtaaataactccasatcaaaatgctgagaaactcatta

SEQ ID NO: 68706 - DNA, 50 bp, homo sapien
taaaatcacaattgctctaaagggaytcatttaaataaaagtcatccaag

SEQ ID NO: 68707 - DNA, 50 bp, homo sapien
tgcttgcatctgactgccctgtaaawggctaagctgccatgtagtttagt

SEQ ID NO: 68708 - DNA, 50 bp, homo sapien
tgggcattttacatatattttctgayttaatttttaataacaaactgcaa

SEQ ID NO: 68709 - DNA, 50 bp, homo sapien
cagaggatttacttcttatccttaargtttcttggatgacttttatttaa

SEQ ID NO: 68710 - DNA, 50 bp, homo sapien
gtttagcaggctccaaagtctgtgayctctgtgctttgttttcattttct

SEQ ID NO: 68711 - DNA, 50 bp, homo sapien
tccgccagttgtattagagactttcratacagtgaagcagaagctggaca

SEQ ID NO: 68712 - DNA, 50 bp, homo sapien
tagagggtatgatgctggaattcatwaaaaaagggtcgttaaaaggaggg

SEQ ID NO: 68713 - DNA, 50 bp, homo sapien
ttctcgcaaagaaactcgctgtaagktgaaggcctgatcacaacattcct

SEQ ID NO: 68714 - DNA, 50 bp, homo sapien
tccttggaagaaaagacataaccagmccatgtgacctgacaagtctcgtc

SEQ ID NO: 68715 - DNA, 50 bp, homo sapien
tgctgttcagattaagagacgtcaayatggaaggtacagtcctcctggga

SEQ ID NO: 68716 - DNA, 50 bp, homo sapien
tgactcttttacctaaaaaacagaaygtcaatgattacatcatgctccca

SEQ ID NO: 68717 - DNA, 50 bp, homo sapien
aaagtgcacacatattcatcatgtaygtatttgtattggggacaatttta

SEQ ID NO: 68718 - DNA, 50 bp, homo sapien
tactggtgcccaagagaactttcaasatataagccagcagtaaaatatgt

SEQ ID NO: 68719 - DNA, 50 bp, homo sapien
attaaaacaatagaaaaagagttaargtaagcagcagaagagaagtgcta

SEQ ID NO: 68720 - DNA, 50 bp, homo sapien
ctacattctctggccaaagaaataayctgttagagtcagcatctggcagc

SEQ ID NO: 68721 - DNA, 50 bp, homo sapien
tcaaggtgaaatctggagttgaggcrcatagagagtcaatagggcctaca

SEQ ID NO: 68722 - DNA, 50 bp, homo sapien
aatattttccacagcaaaattatcayaagggtgcatggagtcttccaatc

SEQ ID NO: 68723 - DNA, 50 bp, homo sapien
tctgttattaagcctctctcgctccrctccttggtagcaattttcctaat

SEQ ID NO: 68724 - DNA, 50 bp, homo sapien
cacaaagaaatgaagattccagaaawggttaaaatgaagataaacgtaaa

SEQ ID NO: 68725 - DNA, 50 bp, homo sapien
ggctatgccacctaggctccttgaayctccgttttcttatctctgtagat

SEQ ID NO: 68726 - DNA, 50 bp, homo sapien
aaaaattaactcaagctggattaaargtttaaacataagacctcaaacaa

SEQ ID NO: 68727 - DNA, 50 bp, homo sapien
gtagtgaatacctctccacagtagaygctttgaataggcacatgattcta

SEQ ID NO: 68728 - DNA, 50 bp, homo sapien
cttggccgagactataacaggctcartattccaccactaaaaattcattt

SEQ ID NO: 68729 - DNA, 50 bp, homo sapien
tgtgcgatttgcaactttctccaaayagtacagatagcatgcaattcaga

SEQ ID NO: 68730 - DNA, 50 bp, homo sapien
ctaagtctcttctttgggcagaactyaagacattttgccaagcacagttt

SEQ ID NO: 68731 - DNA, 50 bp, homo sapien
gactaaaatcacttacttcaactacyaaaataaaatgcccttcatttaaa

SEQ ID NO: 68732 - DNA, 50 bp, homo sapien
agctatattttaaactacaccttcartcttggttattgcatggtaaattc

SEQ ID NO: 68733 - DNA, 50 bp, homo sapien
aagcctaggttttatgctgtttatayatctttactgctttttttgagctc

SEQ ID NO: 68734 - DNA, 50 bp, homo sapien
gtagaaagattgaagagataggacaytatttatttttttaaccaacaaaa

SEQ ID NO: 68735 - DNA, 50 bp, homo sapien
taacagttgctgggtacctcaagcckcggggaatcagaagtagccagggt

SEQ ID NO: 68736 - DNA, 50 bp, homo sapien
gtacagaaatcaacaaccttaacatrtgcaaataataagcagttaaaaga

SEQ ID NO: 68737 - DNA, 50 bp, homo sapien
gttgagagaattatattagttaatayggtaaaccaagcaatggctcagta

SEQ ID NO: 68738 - DNA, 50 bp, homo sapien
cctccttcctacttacttttgattcratttgttcttttcccaacccctta

SEQ ID NO: 68739 - DNA, 50 bp, homo sapien
taagggcaagccaaagctatttgtcygaattacccagtagcacgtgattt

SEQ ID NO: 68740 - DNA, 50 bp, homo sapien
tgattttgcaagctttccagctacayagacttagaactttgcttatagag

SEQ ID NO: 68741 - DNA, 50 bp, homo sapien
tgttagtgcttggagggcttgttaaycacagatcgctgggctttacctcc

SEQ ID NO: 68742 - DNA, 50 bp, homo sapien
ctggcaatattacatttcctgcagayaagactgcttctggagtgacatgc

SEQ ID NO: 68743 - DNA, 50 bp, homo sapien
ctcaagatggctttgtctctggagamctattttttttctgctctcccttt

SEQ ID NO: 68744 - DNA, 50 bp, homo sapien
tggagaagatagaaaaccctaatatmaaacatgaaacaaatgctgagaaa

SEQ ID NO: 68745 - DNA, 50 bp, homo sapien
accaccaaaataacctgacaaattayccaaattatataaagccatagcac

SEQ ID NO: 68746 - DNA, 50 bp, homo sapien
tcctaccaatgctcatataggaggamattctgcaaacaatggaaaggaat

SEQ ID NO: 68747 - DNA, 50 bp, homo sapien
gttcgtaaataatttagaacctaaartatgctatttacaatgcttatgga

SEQ ID NO: 68748 - DNA, 50 bp, homo sapien
taaaacacatggcctaccaaaattawatcttaacatcattagcttttaaa

SEQ ID NO: 68749 - DNA, 50 bp, homo sapien
tcatcaactacctgttcattaaaacrcatggcctaccaaaattatatctt

SEQ ID NO: 68750 - DNA, 50 bp, homo sapien
cttgttgctccaaaggatgctgtgaratattatatctagtcaagtagcca

SEQ ID NO: 68751 - DNA, 50 bp, homo sapien
acaaatagaagtgcctaattaacaarcatttcttccattctagatgaaat

SEQ ID NO: 68752 - DNA, 50 bp, homo sapien
ttaagtacgtcaagggatagcctgamgttaaaatctttttaaaaaattgg

SEQ ID NO: 68753 - DNA, 50 bp, homo sapien
gtttctacattagcaatgactcatgmtgtaaaattggaatgtttagaaaa

SEQ ID NO: 68754 - DNA, 50 bp, homo sapien
agtgacacatttaaaaaccaattacrctagacgctacgcagctgacttcc

SEQ ID NO: 68755 - DNA, 50 bp, homo sapien
atttgtggaggatactcaggaaaccrataaagataattaaaagtttaaaa

SEQ ID NO: 68756 - DNA, 50 bp, homo sapien
aagtagtagttttggtaagattaacragccagactctaaaatgatcatga

SEQ ID NO: 68757 - DNA, 50 bp, homo sapien
tcctgataccaggagtattttgacarcagcttataaggtagatttgatga

SEQ ID NO: 68758 - DNA, 50 bp, homo sapien
cacatgtaagtatttttatgtatgayatattgacacctctaagttgttca

SEQ ID NO: 68759 - DNA, 50 bp, homo sapien
agagagagaagaaaaagctcggttcraagttgtcacttattttcaggtta

SEQ ID NO: 68760 - DNA, 50 bp, homo sapien
gacaacagatagaacaaactagagcrcagaaaatacaagtaagaaaatta

SEQ ID NO: 68761 - DNA, 50 bp, homo sapien
ttaaaaggggaattttttcgaaaatyagtgtcatgacaacagatagaaca

SEQ ID NO: 68762 - DNA, 50 bp, homo sapien
ctaagtcattgcaataggaaggaagraaaagacttagaagcagttccatt

SEQ ID NO: 68763 - DNA, 50 bp, homo sapien
aataaacaggaaccagtacatgaaaygatttgcaagccatgttaagaagt

SEQ ID NO: 68764 - DNA, 50 bp, homo sapien
ccactgcaacctttcaattagccatwaccagacttagccatagcagcatt

SEQ ID NO: 68765 - DNA, 50 bp, homo sapien
atggctgcccttcttgagatcagctsatggtgtaatatgtctgttttcta

SEQ ID NO: 68766 - DNA, 50 bp, homo sapien
ctctcttttgttgaaccgatcaaacyttaaccgtctggtttctcattctc

SEQ ID NO: 68767 - DNA, 50 bp, homo sapien
tgtcacactgttagctaccttttcayatgtgtagttttatatcctcagat

SEQ ID NO: 68768 - DNA, 50 bp, homo sapien
agctataattttcaatattaatttcmataagctaatttggattactacat

SEQ ID NO: 68769 - DNA, 50 bp, homo sapien
taggtcatatctagtatcatagttarggttgaaatctaagtttctattag

SEQ ID NO: 68770 - DNA, 50 bp, homo sapien
gctaacacaaaaaatttagtgtttasgtcatatctagtatcatagttaag

SEQ ID NO: 68771 - DNA, 50 bp, homo sapien
agcagttagaaagcttaaaaattcargaggtatttctggctgggcgcagt

SEQ ID NO: 68772 - DNA, 50 bp, homo sapien
cacattaccagtgtaaaaatatgacrgtacatacgtatgaaacaatgcca

SEQ ID NO: 68773 - DNA, 50 bp, homo sapien
gccctgcaaagacctatattatgggmagcctaggagatgtcctgatatga

SEQ ID NO: 68774 - DNA, 50 bp, homo sapien
aattacacatatttgaaattctgctwtccaacgaatcactgtctcttaat

SEQ ID NO: 68775 - DNA, 50 bp, homo sapien
ttacaccccatgccattgctgtgaayaagctatgagctaagatattatta

SEQ ID NO: 68776 - DNA, 50 bp, homo sapien
tccaggtgtcccagattgaattcgcycttttatttttgctttatatgacc

SEQ ID NO: 68777 - DNA, 50 bp, homo sapien
ttacgaaacccacagagatattacarctacaatttagcacaagtagatgg

SEQ ID NO: 68778 - DNA, 50 bp, homo sapien
agagaataaagatattaccagatcayaaaccattctggagcttttcgcct

SEQ ID NO: 68779 - DNA, 50 bp, homo sapien
ggagaaatactttagagagggaaaakagagacatatctcattctgcattt

SEQ ID NO: 68780 - DNA, 50 bp, homo sapien
ttaggagtttgttttacattgagcaragactagtgcatagtgaggcagag

SEQ ID NO: 68781 - DNA, 50 bp, homo sapien
ctctaagactgctttagctcaacgtkggatgaatgccatttgtctggcac

SEQ ID NO: 68782 - DNA, 50 bp, homo sapien
ggactctcctttgctttggccatcarcgaaaggaggtaagggatgttgag

SEQ ID NO: 68783 - DNA, 50 bp, homo sapien
ctttttctgacttgttctgaaaatayacttctactttcaagcttctgtga

SEQ ID NO: 68784 - DNA, 50 bp, homo sapien
gacaggttaagatgatattcagccamgaaaatacctattacatcttggta

SEQ ID NO: 68785 - DNA, 50 bp, homo sapien
tataggtaggattgatttaagtggargattagacaatgggaaaaagaagg

SEQ ID NO: 68786 - DNA, 50 bp, homo sapien
tttagctcttccctgtttgaataacmcctataatgctgattatagtaata

SEQ ID NO: 68787 - DNA, 50 bp, homo sapien
atgtttttgcatgtagctactaaacsagaatgaagaatagataatgcagt

SEQ ID NO: 68788 - DNA, 50 bp, homo sapien
ccaaactgccagataggttgtaagamtatactgtacactcacaccaatag

SEQ ID NO: 68789 - DNA, 50 bp, homo sapien
aataatactgatactcaggaaacaaygattcaaggagtatgactcaaaaa

SEQ ID NO: 68790 - DNA, 50 bp, homo sapien
atctgaattatttaaaatgtcttatracagaatacttatgataaacatca

SEQ ID NO: 68791 - DNA, 50 bp, homo sapien
cataatgagagtcagatgaaaataasacaatggttggagtgctcaaagag

SEQ ID NO: 68792 - DNA, 50 bp, homo sapien
tcttgaacaaaggattttattaagcygcaggaattaaccaatatgatatt

SEQ ID NO: 68793 - DNA, 50 bp, homo sapien
acttacttagaagtctgtcccataamaataaacacacacaaaattcagga

SEQ ID NO: 68794 - DNA, 50 bp, homo sapien
ataaggtggaggaacttggagataayggtgagtaatatgtttaagttcac

SEQ ID NO: 68795 - DNA, 50 bp, homo sapien
ctctcaatatttattgcatcatccartactctgaaaattgagagtatgtg

SEQ ID NO: 68796 - DNA, 50 bp, homo sapien
ggagaagtatgattggacaaaaggcratatgatctaacggtaattagctg

SEQ ID NO: 68797 - DNA, 50 bp, homo sapien
gcttgcttttatcaactactcagcakatgtcttaaactctagacatgtgg

SEQ ID NO: 68798 - DNA, 50 bp, homo sapien
ctggcaccagccctatattagttgayggccaagaaggtcttaccactcaa

SEQ ID NO: 68799 - DNA, 50 bp, homo sapien
aaatcttctttgaattggggcataastgttatcctaggagtgctttgaaa

SEQ ID NO: 68800 - DNA, 50 bp, homo sapien
gatggaaagcagcacatgtgtcctgmagaaatgacgaccagtctagagca

SEQ ID NO: 68801 - DNA, 50 bp, homo sapien
tcatcagctatatttgataactccaraagaatacatacccgatctaatag

SEQ ID NO: 68802 - DNA, 50 bp, homo sapien
ttaagtgaaggggacagccgagggayatattttaccatgacagccttgta

SEQ ID NO: 68803 - DNA, 50 bp, homo sapien
agaatcacaacagggatttcaactawctggggactgggaagaagaatgag

SEQ ID NO: 68804 - DNA, 50 bp, homo sapien
aactgtcacttgagctcagaccaatractattctcagtctagactggcca

SEQ ID NO: 68805 - DNA, 50 bp, homo sapien
tcacttgtctagataaattaaacaaygccagatattgagttatctgaata

SEQ ID NO: 68806 - DNA, 50 bp, homo sapien
acttgagacttactacttgttaagasattcaaaatatacctataaagcct

SEQ ID NO: 68807 - DNA, 50 bp, homo sapien
tgccccattactagtgtcctacttcmcaatataaatttctgagactgaaa

SEQ ID NO: 68808 - DNA, 50 bp, homo sapien
gaaaaggagaagagacagacggaacraaagcccacagctttgggaaggcc

SEQ ID NO: 68809 - DNA, 50 bp, homo sapien
acaattggaaagaaacctagaagccrctcaagagggcctttaatactgga

SEQ ID NO: 68810 - DNA, 50 bp, homo sapien
ctgattggaaaatattaaataacatracgattcattaacttcacaataat

SEQ ID NO: 68811 - DNA, 50 bp, homo sapien
atattggcagcagctgacaatgagamgttagaatattcagacactgtgct

SEQ ID NO: 68812 - DNA, 50 bp, homo sapien
ggtgacattccatctcttgtgccaaytgaaagtcttagctcctccagagg

SEQ ID NO: 68813 - DNA, 50 bp, homo sapien
aagctatacaaattgttgagaataayatctatgtgagcaatcacattggc

SEQ ID NO: 68814 - DNA, 50 bp, homo sapien
tcaccaaataatcttttctataaaaygctcaaatgttgctcaaaactctc

SEQ ID NO: 68815 - DNA, 50 bp, homo sapien
ggcgatagcaaactcatggctgaaaygtaggaggagagagaagagcaggt

SEQ ID NO: 68816 - DNA, 50 bp, homo sapien
taaaactatgtttcatgccagaaaayttgacagctgctactctgtaattt

SEQ ID NO: 68817 - DNA, 50 bp, homo sapien
aggcactgaattctgctaacaactgraagagaacaccaagctccagaagg

SEQ ID NO: 68818 - DNA, 50 bp, homo sapien
gtctagcatggatacctggttattayatatagctagcctgaaaagaacat

SEQ ID NO: 68819 - DNA, 50 bp, homo sapien
agtgagtttccatgtgtgttctataygttttgtaatttgaggatgtgaac

SEQ ID NO: 68820 - DNA, 50 bp, homo sapien
aaaaatgcatattcaggctgagtttwaaaagggaccgtaaatcactaggt

SEQ ID NO: 68821 - DNA, 50 bp, homo sapien
aggtgtgtagtttaattcaggagaarggataacattgagctccaatcttt

SEQ ID NO: 68822 - DNA, 50 bp, homo sapien
ggagctggggagcaaactttctatamcctgaacactgaccccacgctcca

SEQ ID NO: 68823 - DNA, 50 bp, homo sapien
taaagaatagaacctgcatataaaayggccagtccagtattgaagtggtg

SEQ ID NO: 68824 - DNA, 50 bp, homo sapien
aaccctgtaagtattgttattattaygagcattttaaaatatgaagaaat

SEQ ID NO: 68825 - DNA, 50 bp, homo sapien
taagcagatttgtattctactcagamtcttaccctattatgtaaaagcta

SEQ ID NO: 68826 - DNA, 50 bp, homo sapien
gtgtgtgttgggggaggagttgggaygaaggtatcaataaaggaagaaaa

SEQ ID NO: 68827 - DNA, 50 bp, homo sapien
tgtctggagacattttagattgccaygattagggatgaggttcccctgga

SEQ ID NO: 68828 - DNA, 50 bp, homo sapien
tagtgattgttggttgatgtgtctayctgcactcactaatttgagtttct

SEQ ID NO: 68829 - DNA, 50 bp, homo sapien
atattttctagatcatgccagtcacragagaagatttattgactgtgatc

SEQ ID NO: 68830 - DNA, 50 bp, homo sapien
acttctttccacctttgaagtcccaygtaagtgtctctcattagcagatg

SEQ ID NO: 68831 - DNA, 50 bp, homo sapien
gttttttctttgtattgacattaacyagtgaatctattagtttccattac

SEQ ID NO: 68832 - DNA, 50 bp, homo sapien
cataatcagtgtacagtgtagtatcragctgggccttccattatagctac

SEQ ID NO: 68833 - DNA, 50 bp, homo sapien
tgatatgctttccaggtgtagggatyaattctgtaattctcctttttagc

SEQ ID NO: 68834 - DNA, 50 bp, homo sapien
acctccaggttaaaatttatcaatarctactgaaataccttaaaaacatt

SEQ ID NO: 68835 - DNA, 50 bp, homo sapien
acaagtgcaactggcaaaaccagctygtggacaaacatatctgcctcttg

SEQ ID NO: 68836 - DNA, 50 bp, homo sapien
ctgaaggtggtttccagtgcattccygaagagagcaacagagcaaagagg

SEQ ID NO: 68837 - DNA, 50 bp, homo sapien
cctcttggtaaacctaaactgtggamgcagaactaccccagggaccttaa

SEQ ID NO: 68838 - DNA, 50 bp, homo sapien
tgtttttataaacaaattaaaactartacatcctacatattatgtgatta

SEQ ID NO: 68839 - DNA, 50 bp, homo sapien
tttgcaggatcctgggagtagggtaygagtatcttttttggtggggggcc

SEQ ID NO: 68840 - DNA, 50 bp, homo sapien
aggaatgatcaaagctggggctcatraaaacaaaacgtttacactctcct

SEQ ID NO: 68841 - DNA, 50 bp, homo sapien
gatcagtactaagcatgacaattacyacactataaactacactaaaactt

SEQ ID NO: 68842 - DNA, 50 bp, homo sapien
gaattctatgatctagtcaacgtacrcaactaaagaaatgtcaaaggaat

SEQ ID NO: 68843 - DNA, 50 bp, homo sapien
agagtttgtgacctctcttccctcgsaatggtgtctttacttgtttttga

SEQ ID NO: 68844 - DNA, 50 bp, homo sapien
agtgtttcttaaaaaggcaaatgacrgtaataaatcaaccttagaataag

SEQ ID NO: 68845 - DNA, 50 bp, homo sapien
tagcacagaaactttggaagacaatytgacactttcttattaaactaaac

SEQ ID NO: 68846 - DNA, 50 bp, homo sapien
agtgcccaagataacatggtcaggarcggtaaagcatataggtaggtcta

SEQ ID NO: 68847 - DNA, 50 bp, homo sapien
tattgaacataaattgtttgccaagygagacagattcaatctctgccttc

SEQ ID NO: 68848 - DNA, 50 bp, homo sapien
taaaagttctatataatatacacacmaagttaaacaggcgtgtaagtata

SEQ ID NO: 68849 - DNA, 50 bp, homo sapien
tggcaaacaatttatgttcaatataygtttgttgattaagagatgtaagt

SEQ ID NO: 68850 - DNA, 50 bp, homo sapien
tccaacctcaggacccagattatatrgggaaacagataaggatagaaatg

SEQ ID NO: 68851 - DNA, 50 bp, homo sapien
ctgctggcctggaagtctccattagyagaagccaagagagtgctgtagaa

SEQ ID NO: 68852 - DNA, 50 bp, homo sapien
ggcatgtcagaagattgttcaggtaraaaatagagagatagtgcctgctt

SEQ ID NO: 68853 - DNA, 50 bp, homo sapien
gtgaaaccaaggaaaactataacttrtctcccagcctttctcaacagcag

SEQ ID NO: 68854 - DNA, 50 bp, homo sapien
agtggctaaaatgaagaagagataayaccaaaggataaaaagcaggcaaa

SEQ ID NO: 68855 - DNA, 50 bp, homo sapien
tcccacaggtttataggagaggacayctgcaggaactaagcaggcagaaa

SEQ ID NO: 68856 - DNA, 50 bp, homo sapien
tctctaacacttcaaataggagacakggattagccccttttaaaatagtg

SEQ ID NO: 68857 - DNA, 50 bp, homo sapien
tcccttatggattgggtcagacccawggacttatttcacagcagaaataa

SEQ ID NO: 68858 - DNA, 50 bp, homo sapien
ataaacaataatccaagatataattkcacaaacatgtacaagtcaagatg

SEQ ID NO: 68859 - DNA, 50 bp, homo sapien
aagacagcagacacagtatgaggaayataagagtgaatagggaaacctaa

SEQ ID NO: 68860 - DNA, 50 bp, homo sapien
agaggcatcttgtatgtgttgttaartctccctttcccatttattgatga

SEQ ID NO: 68861 - DNA, 50 bp, homo sapien
agataggcccctgacttctggcagaraagaaatgattatccctatcgtat

SEQ ID NO: 68862 - DNA, 50 bp, homo sapien
gaactactgctccacagatctactcraacaagaaagccctttttatggca

SEQ ID NO: 68863 - DNA, 50 bp, homo sapien
tacactcaggtttgagaatcactgargaacaaagtggtaggaaggtattg

SEQ ID NO: 68864 - DNA, 50 bp, homo sapien
tctacatgagcacagctactgcttgwataaggttgtcttccccaacatca

SEQ ID NO: 68865 - DNA, 50 bp, homo sapien
gagcccacgcacaaggagggagagamtaggcagagcacgggccaccagac

SEQ ID NO: 68866 - DNA, 50 bp, homo sapien
tttgcatcacgatcatggttggcaayttattccatgtttaccactcttcc

SEQ ID NO: 68867 - DNA, 50 bp, homo sapien
tcagaatttgggggaagtagttgttytcagatgtggggatcttagtatat

SEQ ID NO: 68868 - DNA, 50 bp, homo sapien
gtgatgtcactattgacatgcaaacsaagaattaactcgtaacaggaccc

SEQ ID NO: 68869 - DNA, 50 bp, homo sapien
ataagtagcctctaggaactatacaycaactttaggaagtaaagatggac

SEQ ID NO: 68870 - DNA, 50 bp, homo sapien
ggtggagggaccttcctatgtgtaaygcattgttaggtagagcacctggc

SEQ ID NO: 68871 - DNA, 50 bp, homo sapien
tgaagagaacatctggaccattatamacatatgcaaagttattatttcta

SEQ ID NO: 68872 - DNA, 50 bp, homo sapien
ttcagttaattcttaaaacaacctcmatgtcaaagataccatgaatcctc

SEQ ID NO: 68873 - DNA, 50 bp, homo sapien
aatattctgtttattgtactccagayatttcaacgacaaaacccagaaaa

SEQ ID NO: 68874 - DNA, 50 bp, homo sapien
aggagccactaaagcataggctttarattcttttgatagtgatgtcacta

SEQ ID NO: 68875 - DNA, 50 bp, homo sapien
cctgtctcaggatacattttagggaygagagaaattcaggtggcagccac

SEQ ID NO: 68876 - DNA, 50 bp, homo sapien
acagctgaataaacatatgaaaaaartgaatctcaatctttacttcatat

SEQ ID NO: 68877 - DNA, 50 bp, homo sapien
tcccactcagattgcttcaagagacsaacagaacacagggatcaaaaaca

SEQ ID NO: 68878 - DNA, 50 bp, homo sapien
actctagaaaactgtgacaatgttayagcaatacaaattatcttgccact

SEQ ID NO: 68879 - DNA, 50 bp, homo sapien
acttgcaggatataactacacttacygaatttctgacttgttagagcatg

SEQ ID NO: 68880 - DNA, 50 bp, homo sapien
tgttgtgttatcgcgtgtgctttccraagtatattagttgcttttgctat

SEQ ID NO: 68881 - DNA, 50 bp, homo sapien
cagtacaccagtgtttgtactggaayatctgtggcaaacccggagtgtgt

SEQ ID NO: 68882 - DNA, 50 bp, homo sapien
aaactcagcaaatttgtacacttaamactggcaaattatattgttatgta

SEQ ID NO: 68883 - DNA, 50 bp, homo sapien
ctgccctcaaagaacttgtagtcaaytggagaagacagacaagtaactag

SEQ ID NO: 68884 - DNA, 50 bp, homo sapien
tccttcattattatttcaagttttaratacatagctaagggaatatgctg

SEQ ID NO: 68885 - DNA, 50 bp, homo sapien
tttatgtactttttggattatcttawgaccagacaggagtttcctgagtt

SEQ ID NO: 68886 - DNA, 50 bp, homo sapien
tgttgtttttatgtctactgaccacsagctactatttctccttcctctat

SEQ ID NO: 68887 - DNA, 50 bp, homo sapien
ccatcagcacccaaggcagatatagsaaggcagtcagccattcctcctag

SEQ ID NO: 68888 - DNA, 50 bp, homo sapien
ttagttggtcaatattaatttggcaycaactgtgtgtagagaattgtgtt

SEQ ID NO: 68889 - DNA, 50 bp, homo sapien
gggtcggcggtagagcagagataccrgaataaactaagttgttcattttc

SEQ ID NO: 68890 - DNA, 50 bp, homo sapien
gtctacaagtaaaagtgcttgatgcygatattgggaacctgaatgtgaaa

SEQ ID NO: 68891 - DNA, 50 bp, homo sapien
actttaaaagaacaatgaaataccaytgatggctaaacttaggatgagac

SEQ ID NO: 68892 - DNA, 50 bp, homo sapien
cacataggctgtgtgacaaaggttargccataagtctctctggccttggg

SEQ ID NO: 68893 - DNA, 50 bp, homo sapien
aggatctttaaaacatcattcttccyaccttctggaatagtctagatcta

SEQ ID NO: 68894 - DNA, 50 bp, homo sapien
ggagtgcctgctgcccaaagaacccrctattgctttacatctttgggctt

SEQ ID NO: 68895 - DNA, 50 bp, homo sapien
tgagaaaaatccagcgaggtaaagcrgagtgtccttttcagacatctaga

SEQ ID NO: 68896 - DNA, 50 bp, homo sapien
ggtgtggtgctgtttactggaacaartggtttattttattgcctaaattt

SEQ ID NO: 68897 - DNA, 50 bp, homo sapien
cagtttcagatttagctatgaccgcygagttaagattactgaactttcgc

SEQ ID NO: 68898 - DNA, 50 bp, homo sapien
ccttatcaatgacatctattcattaytataaagttccaaagagcaggaat

SEQ ID NO: 68899 - DNA, 50 bp, homo sapien
tatgacttcgcttttgttctgtgtgyattaggtatttatgttgctcttca

SEQ ID NO: 68900 - DNA, 50 bp, homo sapien
actctgagaaagatacctaacaaggmacatgatagaaatctggttataac

SEQ ID NO: 68901 - DNA, 50 bp, homo sapien
gctttatgcaattatatttttgtacsatgtgttaatgtaatgacattttt

SEQ ID NO: 68902 - DNA, 50 bp, homo sapien
tggaattggaatttcataaacacaasacaatgaaagaacacctatgtgat

SEQ ID NO: 68903 - DNA, 50 bp, homo sapien
gcaataatcaaggatttgccataatmtaaggaaaaatgatgtaggattaa

SEQ ID NO: 68904 - DNA, 50 bp, homo sapien
aaagaaaagagtctgagttaggatayctaaagctgaaagccctgaacaca

SEQ ID NO: 68905 - DNA, 50 bp, homo sapien
ttatgaaattccaattccactgtgaratattcccgaactcattttatcag

SEQ ID NO: 68906 - DNA, 50 bp, homo sapien
taaggctcctgattaactgcactgaygtaagaaggcagaagcgtggataa

SEQ ID NO: 68907 - DNA, 50 bp, homo sapien
ttgaagcttttcagtttcctttgcaycttcatgagaggtcaacacataca

SEQ ID NO: 68908 - DNA, 50 bp, homo sapien
tctaataagatcaatcagtgtttcartaatgcaggaatctgtgattgtta

SEQ ID NO: 68909 - DNA, 50 bp, homo sapien
agatataacaacaacaacaataatartaatgtcaaggtgtttatgcatat

SEQ ID NO: 68910 - DNA, 50 bp, homo sapien
tgataaaatttttaaccagacaacartgttctatcatgaaattatatata

SEQ ID NO: 68911 - DNA, 50 bp, homo sapien
atattctgtaactacttggcaagaaygttacaaatgaaatcaaaacattt

SEQ ID NO: 68912 - DNA, 50 bp, homo sapien
ccaccaggataaaggtcactgtgcargtcaaaggtcacagaagagggagt

SEQ ID NO: 68913 - DNA, 50 bp, homo sapien
aagtgcctccacaagtctaatttaawtcttccatgctccagggtaagtcc

SEQ ID NO: 68914 - DNA, 50 bp, homo sapien
tgcattgggacactggtaagcctaamaaggacctcagttcctgagtgcct

SEQ ID NO: 68915 - DNA, 50 bp, homo sapien
gaagcctaatggataatggcgataaygtcagctttcatggcaggaaacaa

SEQ ID NO: 68916 - DNA, 50 bp, homo sapien
aaatttctttcagttcctgttagttyaaagactggttgacatatcagcta

SEQ ID NO: 68917 - DNA, 50 bp, homo sapien
ggcatacataaagggaaattacagawcattaaattctagtagaaacagtt

SEQ ID NO: 68918 - DNA, 50 bp, homo sapien
  misc_feature (12)..(12): n is a, c, g, or t
ctgtgagctcangcctctcacctgayttctacagggctcttcccaaggac

SEQ ID NO: 68919 - DNA, 50 bp, homo sapien
ctctgaggttttctgacaatgaacakggtaagtataataatctcagaata

SEQ ID NO: 68920 - DNA, 50 bp, homo sapien
cttctaaaacatatcatgttcgattyaaggaataccattaagtaatattt

SEQ ID NO: 68921 - DNA, 50 bp, homo sapien
tacgtgctttgtactgggtttatcaygtattttctaatcgaagaaatttc

SEQ ID NO: 68922 - DNA, 50 bp, homo sapien
ctttctagattggtgagggatcgtayggtatgaaacccccttctgagaaa

SEQ ID NO: 68923 - DNA, 50 bp, homo sapien
gctctaggagagacactgaaagtaaratgattatcagtagttcttctgtt

SEQ ID NO: 68924 - DNA, 32 bp, homo sapien
agacatagaagaatcaycttaaaagaaaaagc

SEQ ID NO: 68925 - DNA, 50 bp, homo sapien
atacctcttggacaatgtgtgaatamagagttcaggtttccaaatttaaa

SEQ ID NO: 68926 - DNA, 50 bp, homo sapien
gcaaattattcaactttacacattarcaaacattcaggtattggaaaaca

SEQ ID NO: 68927 - DNA, 50 bp, homo sapien
tttcagaatgcaaattggatatgaasatgccagtttgtcctcagtcagcc

SEQ ID NO: 68928 - DNA, 50 bp, homo sapien
cattattgagcatcttttgaatatayggagacacaaacacatattgggtt

SEQ ID NO: 68929 - DNA, 50 bp, homo sapien
atgaacacgttagcgccttacctggrataacgtcctatgttttagctata

SEQ ID NO: 68930 - DNA, 50 bp, homo sapien
ttatcagaaaacaggtgataggagasagcccgtaaataaatgttgtctct

SEQ ID NO: 68931 - DNA, 50 bp, homo sapien
tgttcctccagtttcagtgaaatccrggaaaagcgtacaagcctcacttc

SEQ ID NO: 68932 - DNA, 50 bp, homo sapien
accacctccaaaagatccagttcccrgaatgtgtttgcctgtgccttcat

SEQ ID NO: 68933 - DNA, 50 bp, homo sapien
ctcccagccctcttagtggaataacragatgactgttcagaccctaccat

SEQ ID NO: 68934 - DNA, 50 bp, homo sapien
ggactgtcatacctaacacctcagaragtggaaattccagcactgttgct

SEQ ID NO: 68935 - DNA, 50 bp, homo sapien
cagataagtgagactatcttcttcaygttgtatctaccagttggcatgta

SEQ ID NO: 68936 - DNA, 50 bp, homo sapien
tctactgggaagccttctgctgacayaagcaagtgctccacgaatcattg

SEQ ID NO: 68937 - DNA, 50 bp, homo sapien
taggcttttgggaaggctacttgaargaatggaatcagttttgcctgact

SEQ ID NO: 68938 - DNA, 50 bp, homo sapien
gagagatgactaaatggatactggtsaatgttgcatctcttagagggaat

SEQ ID NO: 68939 - DNA, 50 bp, homo sapien
tctctgaacagaacgcaggagcaccyattatgcctgactctagatccctg

SEQ ID NO: 68940 - DNA, 50 bp, homo sapien
aaaccctgaaagacaaaaaagtagamctaataagtggaaagagatccctt

SEQ ID NO: 68941 - DNA, 50 bp, homo sapien
tctttccttttcatctctgttgctcractgcactctctgacctacctgct

SEQ ID NO: 68942 - DNA, 50 bp, homo sapien
aggacatatgttaagcatggtctcaytaagaaccaggacagctgccttgt

SEQ ID NO: 68943 - DNA, 50 bp, homo sapien
ggagagcatggggcctccaacggggyaaataatgcaagccatgtctccct

SEQ ID NO: 68944 - DNA, 50 bp, homo sapien
gttaaatccaactatgagtttttccracccccatcgcttaacaccttttt

SEQ ID NO: 68945 - DNA, 50 bp, homo sapien
gcactggttttctggagatgctccartgcggattcaatttgtgggtccaa

SEQ ID NO: 68946 - DNA, 50 bp, homo sapien
attatgttgtcttgtcacacattctsaaacactggtgagagaggcagtga

SEQ ID NO: 68947 - DNA, 50 bp, homo sapien
tacatggcagacacaatcgtatgccraaggttgtttcctctcttatccct

SEQ ID NO: 68948 - DNA, 50 bp, homo sapien
tctatctagacatctttcttcaaacygtcagaagactgaatagagaaaca

SEQ ID NO: 68949 - DNA, 50 bp, homo sapien
aagtcttagctttgctatttcctgamaatgtcatttggattattattact

SEQ ID NO: 68950 - DNA, 50 bp, homo sapien
ttggaagtatttacaaatgctaaaayatgcttatcctatgacccagcaat

SEQ ID NO: 68951 - DNA, 50 bp, homo sapien
catcacaattctatattccttctacratcaactaaatgtgtattatgatg

SEQ ID NO: 68952 - DNA, 50 bp, homo sapien
ctgttgaagcactcaaatccttatayatattagggccaggactagggtga

SEQ ID NO: 68953 - DNA, 50 bp, homo sapien
agacaattaggattaaaaggtgtagmagtcccatagcttgggcctccctg

SEQ ID NO: 68954 - DNA, 50 bp, homo sapien
gcctatacattgatgagcagtactcyaaatatttactgttttattcaagc

SEQ ID NO: 68955 - DNA, 50 bp, homo sapien
tgattgatttttaccagaatctgacmagttactaaacaatacaaggtaaa

SEQ ID NO: 68956 - DNA, 50 bp, homo sapien
ggtgaggtggttggttaagtacttayggaatttctatagctcttttccag

SEQ ID NO: 68957 - DNA, 50 bp, homo sapien
agcaaactgaatcatgtcaaagccartagaggaggttgataactaagagt

SEQ ID NO: 68958 - DNA, 50 bp, homo sapien
tccttttatgtcctttctattgatawctatcctcaccctcaaccctgtca

SEQ ID NO: 68959 - DNA, 50 bp, homo sapien
ttcctaagccttacaccagatccacraaatcagaatctccaagggtagag

SEQ ID NO: 68960 - DNA, 50 bp, homo sapien
ataatttgatgttatttgaattattscagtccatagaaaaagatgacgag

SEQ ID NO: 68961 - DNA, 50 bp, homo sapien
cccaccatccacctagagaaagaacmaataaacatctattcatgagtcag

SEQ ID NO: 68962 - DNA, 50 bp, homo sapien
ttcccctccctcctggggatatctasgattttgacactaatcttgttacc

SEQ ID NO: 68963 - DNA, 50 bp, homo sapien
tatcagagttgcaatttcagtctcckaacctgggtcattgtaacaacatc

SEQ ID NO: 68964 - DNA, 50 bp, homo sapien
ctttcctacattgaaataccttggcrcctttatccaaaactggccaacaa

SEQ ID NO: 68965 - DNA, 50 bp, homo sapien
caggagaactgctcttgctccatgcrctgacaaattaatcatcatctggt

SEQ ID NO: 68966 - DNA, 50 bp, homo sapien
atataacatagaatttaccatcatarctatttaaatgtacaattcattgg

SEQ ID NO: 68967 - DNA, 50 bp, homo sapien
tcatttttatttattgctagactcgytttgctaacattttgttttaggat

SEQ ID NO: 68968 - DNA, 50 bp, homo sapien
ggcaaagtttttatgagataacttayggtttttgttttaatgtatctgta

SEQ ID NO: 68969 - DNA, 50 bp, homo sapien
ccccataagtacatgctccaattcarccccaggtggctcttttcctcccg

SEQ ID NO: 68970 - DNA, 50 bp, homo sapien
aggcctgccctcatggggtccagtgyagcccgggagagagatgctcacac

SEQ ID NO: 68971 - DNA, 50 bp, homo sapien
ctgaaattatattccttgtcataaaygttttactttttaatcatcctttt

SEQ ID NO: 68972 - DNA, 50 bp, homo sapien
cttaatgacatgctttctttaacaaycttccaaacctatcatctaggaca

SEQ ID NO: 68973 - DNA, 50 bp, homo sapien
ttatatttgagatccactaatacaayaggaaaaaatagtgtataaaacat

SEQ ID NO: 68974 - DNA, 50 bp, homo sapien
tttttcaacaaaaatgatagatgatkagatgcaaaagatacaatcactgg

SEQ ID NO: 68975 - DNA, 50 bp, homo sapien
aattagagatgttcagtcaatattgsaatgctaaggctgacctaacagag

SEQ ID NO: 68976 - DNA, 50 bp, homo sapien
tcatggggccccctgtatgtccagargatataaaactattccagaggggg

SEQ ID NO: 68977 - DNA, 50 bp, homo sapien
tgtttggttgaagacggcataagaaygacataaaccaaatcaaaatagtc

SEQ ID NO: 68978 - DNA, 50 bp, homo sapien
ggaagcagggtccatggcagagaaaytccaatgataaagaaaaactcctt

SEQ ID NO: 68979 - DNA, 50 bp, homo sapien
gctcatgggcagctgggtttagagayagctgattttcatattcttaggct

SEQ ID NO: 68980 - DNA, 50 bp, homo sapien
caacagatacaggcaatcactttaaygtactaatagattccatcaaggaa

SEQ ID NO: 68981 - DNA, 50 bp, homo sapien
aatgtataaacatttcagattgccartaaaccctgtatgtatcattatcc

SEQ ID NO: 68982 - DNA, 50 bp, homo sapien
tcacagtgagtgtaaagaaaacaaaygattaagaggaacttctggccagg

SEQ ID NO: 68983 - DNA, 50 bp, homo sapien
atgagatgggccccttatggaaaaaytagtagatctaatacaaaaatctg

SEQ ID NO: 68984 - DNA, 50 bp, homo sapien
ctttcatttaattcactttgaaacayatattctgatctcagctatactgg

SEQ ID NO: 68985 - DNA, 50 bp, homo sapien
aatgggatgctagttcctggtatggwcagttaaaacggagtggacaatgc

SEQ ID NO: 68986 - DNA, 50 bp, homo sapien
cgactaaatactaacccatcgataaytgccatacatataaataaactgaa

SEQ ID NO: 68987 - DNA, 50 bp, homo sapien
cacaagaatcttcacaacagggaaargttggagacattcgagttggtcaa

SEQ ID NO: 68988 - DNA, 50 bp, homo sapien
tagttggcaggattgtaagtagaccraattctaatttttcccaacacata

SEQ ID NO: 68989 - DNA, 50 bp, homo sapien
cctaagagaatgttctctgtgggagraaagatattacagttgatttttca

SEQ ID NO: 68990 - DNA, 50 bp, homo sapien
tccaagaaaatttcttcagtgatacragaatcttagagttaggaagataa

SEQ ID NO: 68991 - DNA, 50 bp, homo sapien
ctctctgatgagccaatcataaagayggtaaagagtctatttgtgcccag

SEQ ID NO: 68992 - DNA, 50 bp, homo sapien
gggaatgagaatttaacccaggagargggaatgctttaagaaaatctcat

SEQ ID NO: 68993 - DNA, 50 bp, homo sapien
agactctcatttttcatttcctacarcatatttaaatcttagggcaaatt

SEQ ID NO: 68994 - DNA, 50 bp, homo sapien
cttcctccaatgtctgaacttttacraccataatagcaaatggctcatat

SEQ ID NO: 68995 - DNA, 50 bp, homo sapien
ttgctttctagaatgaaaaatggaartctgtatactcataaggaaaatct

SEQ ID NO: 68996 - DNA, 50 bp, homo sapien
cccatttagagctctgaattaggagracagtgtctaagaattccaggccc

SEQ ID NO: 68997 - DNA, 50 bp, homo sapien
aggaagaagctgggataggcatccaratggcaagagtgctccctcccacc

SEQ ID NO: 68998 - DNA, 50 bp, homo sapien
agaaatcattcttctacagtgagtgwaaatttcaaaaaagataacaaaaa

SEQ ID NO: 68999 - DNA, 50 bp, homo sapien
cacttcctccaggccatttccatcayggagagagtgtaatagactggcca

SEQ ID NO: 69000 - DNA, 50 bp, homo sapien
acattggttcctgtgtcctctgtccraatccctattgagaacaccactgc

SEQ ID NO: 69001 - DNA, 50 bp, homo sapien
gttctttcttctccatagctgtttcrctgtcagacaagtaaaagaggaac

SEQ ID NO: 69002 - DNA, 50 bp, homo sapien
tgtgcttggtttcttgtttgtgaaaygaatagttagatttgagtaatagt

SEQ ID NO: 69003 - DNA, 50 bp, homo sapien
agagcaaggctgcactagctcaaaaygggtcccaaaggttatttccaacc

SEQ ID NO: 69004 - DNA, 50 bp, homo sapien
actcagataatggagcgcatttcatmtaacactaattttcctcctctagc

SEQ ID NO: 69005 - DNA, 50 bp, homo sapien
ctgaaggagacacccttcagcctggsatgagttaagttcagtcctgcctg

SEQ ID NO: 69006 - DNA, 50 bp, homo sapien
tatcatttgcatgtatgtcacctctycttgaatgtagagctacacctccg

SEQ ID NO: 69007 - DNA, 50 bp, homo sapien
cattataactttctagaattatcctraatggttcaaagtaagcagttttc

SEQ ID NO: 69008 - DNA, 50 bp, homo sapien
ctgcctttcaggagaattataaatayctgccctagtaaactcagcgtggc

SEQ ID NO: 69009 - DNA, 50 bp, homo sapien
tatgaggtattatgttgatgcaaacratgactaacccttcaaggacattc

SEQ ID NO: 69010 - DNA, 50 bp, homo sapien
aaatgaaggttggaaaacaaaatcargtaattatactgtgtattctacaa

SEQ ID NO: 69011 - DNA, 50 bp, homo sapien
tcagtttctgcatacagttttcatcrcctaaaagtaggtgtcaaatatct

SEQ ID NO: 69012 - DNA, 50 bp, homo sapien
tgggtgcttcgtccgactccttcaartaattgtttctaggctctgcctct

SEQ ID NO: 69013 - DNA, 50 bp, homo sapien
cagtgataagaagaggatagtcaacraggaatctaccctagggctgacag

SEQ ID NO: 69014 - DNA, 50 bp, homo sapien
ttgtaacactaattacatttgtgaamctgtttaatggtggcctctactac

SEQ ID NO: 69015 - DNA, 50 bp, homo sapien
agtgtaggtatccaaagataaagcartgaggatttatttcacttctcttt

SEQ ID NO: 69016 - DNA, 50 bp, homo sapien
gagagataaaaaaagactgaaattgyaagacctcttccaattcttttgtt

SEQ ID NO: 69017 - DNA, 50 bp, homo sapien
cccatcctttagcaccccaatgaaaygcaatcttcttcactgtactatgc

SEQ ID NO: 69018 - DNA, 50 bp, homo sapien
atctcagcttcctggaaagttaggcratgagtccactaaatgaaattcca

SEQ ID NO: 69019 - DNA, 50 bp, homo sapien
cacacactccctccttctaaaactcragctgattcttaagagcagtggag

SEQ ID NO: 69020 - DNA, 50 bp, homo sapien
ctctttgctatggaatcgggctccaracaaacttatctgtaaagtagcag

SEQ ID NO: 69021 - DNA, 50 bp, homo sapien
cagacaatgcaacagagaagaaatamagatggctaaaaaacagggacaaa

SEQ ID NO: 69022 - DNA, 50 bp, homo sapien
ttgaaaaattacatgttggatacaakgttctttattcatgtgatgagtac

SEQ ID NO: 69023 - DNA, 50 bp, homo sapien
caattttaaggtgattaaagtagcaygttcccaatatttttaaatgtgca

SEQ ID NO: 69024 - DNA, 50 bp, homo sapien
taacacatctgcttgtaaattctatragtcattagctatatgctcattaa

SEQ ID NO: 69025 - DNA, 50 bp, homo sapien
attggggtgctaaaggatggggttcrcaccaaattgaaaacctgagagtt

SEQ ID NO: 69026 - DNA, 50 bp, homo sapien
tgagcatcacttcctagcagtgaacsctttaagaaaacacgtctgcatta

SEQ ID NO: 69027 - DNA, 50 bp, homo sapien
ctccctgaatgcttagcctgggctarcatattttcaaacatttgctatca

SEQ ID NO: 69028 - DNA, 50 bp, homo sapien
acataaaccaagttaaagcttgttcsaatagtaaaagcaacccagttcat

SEQ ID NO: 69029 - DNA, 50 bp, homo sapien
tctactgctctatgttcctaggacasaaggcatctatctacaaatgccat

SEQ ID NO: 69030 - DNA, 50 bp, homo sapien
ggtatttccttccttcaagtaaggtsactccagaaagttaaaggtcaagg

SEQ ID NO: 69031 - DNA, 50 bp, homo sapien
agcaaagaaacttttacacctggcawctatcccttgacctttaactttct

SEQ ID NO: 69032 - DNA, 50 bp, homo sapien
tacagtagaacaacacccaaagtaartatcaccattaacatttacatatg

SEQ ID NO: 69033 - DNA, 50 bp, homo sapien
gtctggtggcttccaactgaacccgyagtcgaagggtggaaaacaacatc

SEQ ID NO: 69034 - DNA, 50 bp, homo sapien
gaaatgtcacttcctgtgtactgacmagaagactgaaaaattgatttgcc

SEQ ID NO: 69035 - DNA, 50 bp, homo sapien
gagcatcactcattggttcataaaaragcaagaccatctaaattgatgat

SEQ ID NO: 69036 - DNA, 50 bp, homo sapien
aacacaaccagccagcggatgtagayaggtttacgtggctttacagaaca

SEQ ID NO: 69037 - DNA, 50 bp, homo sapien
agatctggcttatatttttccactawcttcttaggtatctggtgccttta

SEQ ID NO: 69038 - DNA, 50 bp, homo sapien
tgaattattaagcatttgaatagaakgaatcaatttctggggtatgaggg

SEQ ID NO: 69039 - DNA, 50 bp, homo sapien
gaaggtttagaggtgtcagtaggtawggagtgactgaacactattttaaa

SEQ ID NO: 69040 - DNA, 32 bp, homo sapien
gaattctggagttatayggcttatcaacatca

SEQ ID NO: 69041 - DNA, 50 bp, homo sapien
cctaggaggaaagtgagaaatcacartggagatgggaaaatcaagtgttc

SEQ ID NO: 69042 - DNA, 50 bp, homo sapien
cctgtgcttcctccacggccagtcaytcatgggttccaagtctgttgttt

SEQ ID NO: 69043 - DNA, 50 bp, homo sapien
tttagatctggtatggccatagtacygaatttcatttatgatttaacata

SEQ ID NO: 69044 - DNA, 50 bp, homo sapien
acaccagtatttctggagtatttctwtagagaggatccagctagtcataa

SEQ ID NO: 69045 - DNA, 50 bp, homo sapien
ttcagttaccaccattcttttcactsaattttagagttctttcaagaagc

SEQ ID NO: 69046 - DNA, 50 bp, homo sapien
agatgtgtgctcattggcattttagraaaattcatcttgtagcagtgagg

SEQ ID NO: 69047 - DNA, 50 bp, homo sapien
aatggataaattccacagtacattaygtgaaaaatcaagttaaaaagcag

SEQ ID NO: 69048 - DNA, 50 bp, homo sapien
gaaacaagataaatgctactttagakgtatgcacagcatgctatgggacc

SEQ ID NO: 69049 - DNA, 50 bp, homo sapien
attctgcatttttcccaactgcaaartctatcatctctctgcagcctcac

SEQ ID NO: 69050 - DNA, 50 bp, homo sapien
ttgccttgcctctcacaatccaagcrtctgaaaattgtactttttgatat

SEQ ID NO: 69051 - DNA, 50 bp, homo sapien
attcaatctaattactcggtgatttkttcaatatttcacattaaagacaa

SEQ ID NO: 69052 - DNA, 50 bp, homo sapien
tttgtgcctttacgttcctaaaatayacttgggtgacttcatggaagagg

SEQ ID NO: 69053 - DNA, 50 bp, homo sapien
aacacagggcactgctttcagagctkcatttacctcccattgaggtctca

SEQ ID NO: 69054 - DNA, 50 bp, homo sapien
cactatacttgcctaggtaactaacrcatggattatacattttaatgtgt

SEQ ID NO: 69055 - DNA, 50 bp, homo sapien
tcctcccaccgtacttgctcagataycaggtggttgtgcagatatccagc

SEQ ID NO: 69056 - DNA, 50 bp, homo sapien
agataatagcatttgtaatcttacaytgaagaacaagaaggtaaattaca

SEQ ID NO: 69057 - DNA, 50 bp, homo sapien
aaaaaggggaagagtagacactgctraaggaaagaacttaaaagtcagga

SEQ ID NO: 69058 - DNA, 50 bp, homo sapien
aaaaggcaagaaagcggtttctcccragagtctccagaaggaaccaggtc

SEQ ID NO: 69059 - DNA, 50 bp, homo sapien
tgcagcagtcacaggaaaccaattcrgaaccatcagggactagtcagaaa

SEQ ID NO: 69060 - DNA, 50 bp, homo sapien
tttctaacttgctcttcagacttaaygctcagtattaccttcctcactat

SEQ ID NO: 69061 - DNA, 50 bp, homo sapien
aagagtagttaaccttctactatgayatcccagaaggtaagtctgaatca

SEQ ID NO: 69062 - DNA, 50 bp, homo sapien
gctacattatggtggcagtaacagakgtttatttttcattcactctacgc

SEQ ID NO: 69063 - DNA, 50 bp, homo sapien
agtaatctctgtgctccattctcagmccttatctttcatagtctctttac

SEQ ID NO: 69064 - DNA, 50 bp, homo sapien
ttcaatgatgtggatctgagaaatasagacaacatgaaaaaacaggagga

SEQ ID NO: 69065 - DNA, 50 bp, homo sapien
gctactcgttctctgacaatgaatastacaccatctacatgatctgcaaa

SEQ ID NO: 69066 - DNA, 50 bp, homo sapien
tttagatgctactttatggcctgcaragaactgtaatttgtaataaagaa

SEQ ID NO: 69067 - DNA, 50 bp, homo sapien
tcagggaagaaaagataatatactayaggtagaagccagagagaagattt

SEQ ID NO: 69068 - DNA, 50 bp, homo sapien
ttaattaaaaaattaaatatggtgargacattttccgtttttagtattta

SEQ ID NO: 69069 - DNA, 50 bp, homo sapien
cagatgtctctttttctgactaatawagttgattttactcacatttattc

SEQ ID NO: 69070 - DNA, 50 bp, homo sapien
ttcttcaacatggaatctaatgtgartatgattaacccaaccatactgac

SEQ ID NO: 69071 - DNA, 50 bp, homo sapien
aattcttagagatttcaacaactaargtaggtgatccttccaacaccata

SEQ ID NO: 69072 - DNA, 50 bp, homo sapien
ccaccccaattttcaatttcaatcaygttcttaagagttttttttcaatt

SEQ ID NO: 69073 - DNA, 50 bp, homo sapien
attgttgtctttagaaaaatctcaasttcacaaatatctttccagtttca

SEQ ID NO: 69074 - DNA, 50 bp, homo sapien
gtgtaggagatttagtcctcatatcrataccagggaatactgaattaaaa

SEQ ID NO: 69075 - DNA, 50 bp, homo sapien
aaagacacatgactaccaaatgtaakgtgctatcctggacagcatccagg

SEQ ID NO: 69076 - DNA, 50 bp, homo sapien
aaatccagtattagggatttaaatayatgagatgcacaggagtgagtaat

SEQ ID NO: 69077 - DNA, 50 bp, homo sapien
tgaggaaggagaaaacaaggattcaracagattaataataaaaccacaaa

SEQ ID NO: 69078 - DNA, 50 bp, homo sapien
agagggtgaaggaggtacaaaggcaygtcttacttgatggcaggcaagag

SEQ ID NO: 69079 - DNA, 50 bp, homo sapien
gctcctcatactatttctccccaggrcattcagatgcagaagcctcacat

SEQ ID NO: 69080 - DNA, 50 bp, homo sapien
ttaaacgggcattttcctgggtaccragcatgtagtgggggttcaacaaa

SEQ ID NO: 69081 - DNA, 50 bp, homo sapien
aatgagttatgtgattgtcaaaacartgttgcataatgttaaaagaaaaa

SEQ ID NO: 69082 - DNA, 50 bp, homo sapien
actgttgttaaagaatagattcacargacaaatatttcaagtaaaagtca

SEQ ID NO: 69083 - DNA, 50 bp, homo sapien
ggtcctcctagtattttgtaacatasacccacaaacacaattcagaaaac

SEQ ID NO: 69084 - DNA, 50 bp, homo sapien
accattcctctggttatgttgtttaytgatatcctgcctccgtgtcaggc

SEQ ID NO: 69085 - DNA, 50 bp, homo sapien
ttactctgtcaagtttagatcgtgamtatagaggcaaaaatagcaattat

SEQ ID NO: 69086 - DNA, 50 bp, homo sapien
agagctgaggttcctataattggatrgataagacaggatgtaggaagaat

SEQ ID NO: 69087 - DNA, 50 bp, homo sapien
atatccattatttgcatagcaacaaytaggaaatagcctacatgtccaaa

SEQ ID NO: 69088 - DNA, 50 bp, homo sapien
aataaacccattttaaatgcgtgaargcgagtgtgatgagattgttcctc

SEQ ID NO: 69089 - DNA, 50 bp, homo sapien
aatggcatggaccttaacagacaaawctcgaaaaaaattcgcccttaggg

SEQ ID NO: 69090 - DNA, 50 bp, homo sapien
tggttatccaactgcttctcaaactkaattgatcatggaaatacctatgt

SEQ ID NO: 69091 - DNA, 50 bp, homo sapien
agcaggccctatggatccagctccckctcacagataccctgggtttgatg

SEQ ID NO: 69092 - DNA, 50 bp, homo sapien
tgtcgcacgttttcattttgatacartctgtttatctgtctgtcccctcc

SEQ ID NO: 69093 - DNA, 50 bp, homo sapien
tcattttaaagaatcacaaagcacaytgtcattaagaaaatcacataata

SEQ ID NO: 69094 - DNA, 50 bp, homo sapien
ttctgcttcctctgaaatatctttcrattttgagcttcattttcagggaa

SEQ ID NO: 69095 - DNA, 50 bp, homo sapien
taaaaaatatgaagcttagcaaaaamtagtgattacatgtagcaattaca

SEQ ID NO: 69096 - DNA, 50 bp, homo sapien
ctcttgatgcctgaagagtttctacmatttctataagcccatcctacaag

SEQ ID NO: 69097 - DNA, 50 bp, homo sapien
agaaatactgtgaaagaggaaaacayaagattcacgaggggccagaggag

SEQ ID NO: 69098 - DNA, 50 bp, homo sapien
ttttgaactccattttgtcagaacaytgtctttgtagactaacaatttag

SEQ ID NO: 69099 - DNA, 50 bp, homo sapien
agtgaccccagaccctaattttaagygatctacagtctggtgagagattc

SEQ ID NO: 69100 - DNA, 50 bp, homo sapien
tacaaatatatattttctctgactcrattatgtggaaagtgttttgcctc

SEQ ID NO: 69101 - DNA, 50 bp, homo sapien
ttggtcaaaagtgcatttgcaaatcsttggttcacaataagtttgttaaa

SEQ ID NO: 69102 - DNA, 50 bp, homo sapien
ttagcatataaatatatgaatagtcstaaaatagagggaaatatttaaca

SEQ ID NO: 69103 - DNA, 50 bp, homo sapien
aacatgctcagagggacaatgggacyacataattgaagttggcaccaaac

SEQ ID NO: 69104 - DNA, 50 bp, homo sapien
ctgatgttgtccatctcactaggccraggaaacccagctatgctcccagg

SEQ ID NO: 69105 - DNA, 50 bp, homo sapien
actttgtggttagtgcttgctgttaygtccaaggcatctatattattatg

SEQ ID NO: 69106 - DNA, 50 bp, homo sapien
attatattcaaatcatctcagagccrgaaaagggttttttgtaacattta

SEQ ID NO: 69107 - DNA, 50 bp, homo sapien
tttatattcaattcttgtcacctatyaatctattcttacacccataatgt

SEQ ID NO: 69108 - DNA, 50 bp, homo sapien
aatcagcttttctcactctattgcayggaatatatagtatttcctcaaca

SEQ ID NO: 69109 - DNA, 50 bp, homo sapien
aaacagatgctacaggcaacatatcmcataattgtgcctagtaggtgaag

SEQ ID NO: 69110 - DNA, 50 bp, homo sapien
gcagataaagatgtggctaaggagastattctaaggcagatgccaagtgt

SEQ ID NO: 69111 - DNA, 50 bp, homo sapien
ttaggtacattttcacaccttactayggaaaacataattttactgcctgc

SEQ ID NO: 69112 - DNA, 50 bp, homo sapien
gtctttaaagacaatacattaggtayattttcacaccttactatggaaaa

SEQ ID NO: 69113 - DNA, 50 bp, homo sapien
aagacatgaaaatatttgtcctatawgtcaaccactatacacttcatgaa

SEQ ID NO: 69114 - DNA, 50 bp, homo sapien
gtcccaggcctacaacacatagctaycctgtgagattttattcagatgaa

SEQ ID NO: 69115 - DNA, 50 bp, homo sapien
atctttaatatctcccttttaccacrgagttgaggcagcagctgcattac

SEQ ID NO: 69116 - DNA, 50 bp, homo sapien
ttcggctgctgtgtagggtatgagaygaagtaccaagagatggcattaga

SEQ ID NO: 69117 - DNA, 50 bp, homo sapien
acacatatgtatatgtatagctttgycaccagtatctaaatacctctcta

SEQ ID NO: 69118 - DNA, 50 bp, homo sapien
tatttaacaaatgatgttggttcaaytggttagtaattttgcaaaagaaa

SEQ ID NO: 69119 - DNA, 50 bp, homo sapien
atagagtatgacattagggaacttcrgaaggtagtgttgagagatccagg

SEQ ID NO: 69120 - DNA, 50 bp, homo sapien
gtatagtatcccaagttggaatctgsagcttagttgagaatttggggtca

SEQ ID NO: 69121 - DNA, 50 bp, homo sapien
accccgtgtgacttggttaagtgaayatctgctgccttttagttcttttc

SEQ ID NO: 69122 - DNA, 50 bp, homo sapien
aaaactcttcaggagtattattcagkcaattgtgtgtatagtgtattgga

SEQ ID NO: 69123 - DNA, 50 bp, homo sapien
tagccccaattctaccaatataatasattttcatggtatctagaatcaaa

SEQ ID NO: 69124 - DNA, 50 bp, homo sapien
tgggtatagagcaatttcatgtcaasaccttacgatatgtttatcccatc

SEQ ID NO: 69125 - DNA, 50 bp, homo sapien
agacattttcctttaattacttgaartgggtttacttgctttaaagttac

SEQ ID NO: 69126 - DNA, 50 bp, homo sapien
caagatcaggtaaattgggagacacraaactgggacatccagagacatga

SEQ ID NO: 69127 - DNA, 50 bp, homo sapien
gcacattctgttgatgttgtgtcaayggactctccccataaatagtattt

SEQ ID NO: 69128 - DNA, 50 bp, homo sapien
tctttaatatgcataaatatgtggaygaatagtctcctccaatccctcag

SEQ ID NO: 69129 - DNA, 50 bp, homo sapien
gataagcctttctcaactttaccaakcaccctgtaggccagcttacaaag

SEQ ID NO: 69130 - DNA, 50 bp, homo sapien
atgatgaatggatgacgaggagataraagcttgtgtcacaggatttgata

SEQ ID NO: 69131 - DNA, 50 bp, homo sapien
accatggcaagacactaaaggattamgatggaatgaactggggagatccc

SEQ ID NO: 69132 - DNA, 50 bp, homo sapien
attgcaaactaaggtaagaatttcaraagggaccaggctacaacttgagg

SEQ ID NO: 69133 - DNA, 50 bp, homo sapien
gtcatgttgccctttgggacgagcayggtacaaaacccagattttcctct

SEQ ID NO: 69134 - DNA, 50 bp, homo sapien
tagaatcatatatcactgagatgtayagtatgctctttctagatttcaca

SEQ ID NO: 69135 - DNA, 50 bp, homo sapien
tttctacatagccgtgtagctggtgrcaatgaaattcagatattactttt

SEQ ID NO: 69136 - DNA, 50 bp, homo sapien
tcgttttaccaaacagtgctaactawctaaaatagcaataactaactcct

SEQ ID NO: 69137 - DNA, 50 bp, homo sapien
ttcttgttggaaagtagagattaaamcattttcctcaggttgcatggaaa

SEQ ID NO: 69138 - DNA, 50 bp, homo sapien
tttctctctgtctctgtatccaggartaaacacattttgaatttgatgtt

SEQ ID NO: 69139 - DNA, 50 bp, homo sapien
atctgggtcacaaaaattggatttayaccataagtgctaatcttaatacc

SEQ ID NO: 69140 - DNA, 50 bp, homo sapien
cacgtggaacatttctagtttgggtraatactgacagacatagggaactt

SEQ ID NO: 69141 - DNA, 50 bp, homo sapien
ctattagctccaaggttgttaactckgacaagctcctgacaaatagactc

SEQ ID NO: 69142 - DNA, 50 bp, homo sapien
agaaatcagcattgagcaaggatcaycagaaaatccataattctccaagt

SEQ ID NO: 69143 - DNA, 50 bp, homo sapien
tgctgtagcttttttttttgtacctrgttctatggttacctttacactgc

SEQ ID NO: 69144 - DNA, 50 bp, homo sapien
cacaagtctctgcaagtctcttgtcrcttttctgacctaataaactgcta

SEQ ID NO: 69145 - DNA, 50 bp, homo sapien
ctgagaaaaggaactgttgttgcctrtaactgtaagacataaactccaaa

SEQ ID NO: 69146 - DNA, 50 bp, homo sapien
gcatttaggcaccctaaaagaagagycacttaatccccagtgtggctgga

SEQ ID NO: 69147 - DNA, 50 bp, homo sapien
ttacctccctgtctaaacacgtaaaygacaaattaggtgacccatgaagg

SEQ ID NO: 69148 - DNA, 50 bp, homo sapien
attaagcactcctcaatagtaaagayagaggaagtaaggactagattacc

SEQ ID NO: 69149 - DNA, 50 bp, homo sapien
aactcagagagtgattattcaactamaatttagtccttcggtttcccatc

SEQ ID NO: 69150 - DNA, 50 bp, homo sapien
gatgtaagacctcacagaatttacaytggagcctaagtaacagtgcacca

SEQ ID NO: 69151 - DNA, 50 bp, homo sapien
aagtagtcagctgaactcacctgatytagcacctgggtcttagcagacat

SEQ ID NO: 69152 - DNA, 50 bp, homo sapien
ccctggtaatgatattgtcacagaastcagcccactgaataaattaatat

SEQ ID NO: 69153 - DNA, 50 bp, homo sapien
agattttacatgcttttccatgaacrctaatttcctgtatgaagagggaa

SEQ ID NO: 69154 - DNA, 50 bp, homo sapien
cttctgtgttgagcaacttcctcaayaatcctcaaagacctgttgcattc

SEQ ID NO: 69155 - DNA, 50 bp, homo sapien
ccatggtccaaaacaccttagaagcrcaaggaaattacaaattctgtggt

SEQ ID NO: 69156 - DNA, 50 bp, homo sapien
ctaggccaacaaaattaagtggtaarttaaataactctgaccataagcct

SEQ ID NO: 69157 - DNA, 50 bp, homo sapien
agatctaaagatggttaacccatcartatgtataataaactcatttgtgt

SEQ ID NO: 69158 - DNA, 50 bp, homo sapien
accaggatgtaaacaaataaagcctraataaccaaaatatgtgatatcag

SEQ ID NO: 69159 - DNA, 50 bp, homo sapien
acatatctaaggaaagcattttaatycctatcaagagacagaagtactgc

SEQ ID NO: 69160 - DNA, 50 bp, homo sapien
aattggtgcacttcttttatcctaayctcagtggcctcaggaaaatgtcc

SEQ ID NO: 69161 - DNA, 50 bp, homo sapien
tatggagaaacatttggctagaaackgaatgctgtatttattttcataga

SEQ ID NO: 69162 - DNA, 50 bp, homo sapien
taccccagccagattggtcattatcrgaaagtcaaaagtaatagatgttg

SEQ ID NO: 69163 - DNA, 50 bp, homo sapien
tgaactgtacggcatataaatcatayctcaattaaaaacaaaaacaaaaa

SEQ ID NO: 69164 - DNA, 50 bp, homo sapien
atttccaatggagagacagatgcaayggtacaggtcctgtgatgcagctg

SEQ ID NO: 69165 - DNA, 50 bp, homo sapien
aagaaggaattgttcttgtgtattakcaggcattaggcaatttgctgcca

SEQ ID NO: 69166 - DNA, 50 bp, homo sapien
ttagtttatgggagatgaatagccaygttttcagaaaagaatggttaagc

SEQ ID NO: 69167 - DNA, 50 bp, homo sapien
aggtgtggaagtttccataaaattcwattagtccaatggtcatagggctg

SEQ ID NO: 69168 - DNA, 50 bp, homo sapien
gaaggtactgagtaactattaagcaycattatggttaatatgtttgctga

SEQ ID NO: 69169 - DNA, 50 bp, homo sapien
atttcaagattcatgttaaatacacraactaatattattcaaaccataaa

SEQ ID NO: 69170 - DNA, 50 bp, homo sapien
gtttttgtttttaatctggatagcartagtcacaataataccgtattttg

SEQ ID NO: 69171 - DNA, 50 bp, homo sapien
taccactttgatttctgttcaagaargaaatatattcagtattataaaga

SEQ ID NO: 69172 - DNA, 50 bp, homo sapien
tgaactgagaagaaaagcaagtcaawttaatcaatccccttcagcctccc

SEQ ID NO: 69173 - DNA, 50 bp, homo sapien
ctgtacctgagggtatagtctgtacyagaggaataaaaggatccgactgc

SEQ ID NO: 69174 - DNA, 50 bp, homo sapien
cccatttctgatcctgttgatgagastgatggcaaatgcaccccagcact

SEQ ID NO: 69175 - DNA, 50 bp, homo sapien
cccttgtcttcatagggaccatttcratatcctcacttcctgtgggcatt

SEQ ID NO: 69176 - DNA, 50 bp, homo sapien
atttccaatagtgtacttattccaayggtgactcaacccagtggcaactt

SEQ ID NO: 69177 - DNA, 50 bp, homo sapien
agaggaacgttggtaaaaataataargttcaaaagccagtaatatcaggg

SEQ ID NO: 69178 - DNA, 50 bp, homo sapien
caactttgtgggggatctctttttastgaggtatactgtgggaacattgc

SEQ ID NO: 69179 - DNA, 50 bp, homo sapien
ggacaagagtgtccagggtgcatttyaaacccttgagcgtaaagtcatgg

SEQ ID NO: 69180 - DNA, 50 bp, homo sapien
gagttgactttcagtaaatcacgtcragagagctggtgtttattctgtga

SEQ ID NO: 69181 - DNA, 50 bp, homo sapien
tttttatacaacttagaaattgatcyaaggatactggcagcccattctac

SEQ ID NO: 69182 - DNA, 50 bp, homo sapien
ggagatggagcctttgggatatgatyagataatgagggcacatgggatta

SEQ ID NO: 69183 - DNA, 50 bp, homo sapien
ctttaatcttggtgccatcgttggcyagtgtactgactattattaaggca

SEQ ID NO: 69184 - DNA, 50 bp, homo sapien
caacacatttttactgatactaattyaatgggtgtgtagtgtgacctgtt

SEQ ID NO: 69185 - DNA, 50 bp, homo sapien
ttgagaaagctgatttaggccaatargaaggtaaaaatgagacaaccatc

SEQ ID NO: 69186 - DNA, 50 bp, homo sapien
cacagtgagcatattgtggtattgcrctgtaatttcaatttatactgaaa

SEQ ID NO: 69187 - DNA, 50 bp, homo sapien
gtggatgctgttgcaggcaggatacyaaagcaatgttttgtgtcagcagc

SEQ ID NO: 69188 - DNA, 50 bp, homo sapien
ttttttgtagaaaatagttacaaagsattgggtcagtttactaccttccc

SEQ ID NO: 69189 - DNA, 50 bp, homo sapien
attttagagcatagagttcttacagrgtacatgtgtctgtcttatctaat

SEQ ID NO: 69190 - DNA, 50 bp, homo sapien
tccctccagagaacctagggatccayagaagagtttctttggggtgtaga

SEQ ID NO: 69191 - DNA, 50 bp, homo sapien
tatttaggtaaatcaaatcaattttygatgctcatggaagatctcctcct

SEQ ID NO: 69192 - DNA, 50 bp, homo sapien
aataaaaacgacaacgacccactaamcttttcaccttttcttcccatcac

SEQ ID NO: 69193 - DNA, 50 bp, homo sapien
ctgaaaatcaacaagaaaagtacagwaactccattagataaaaaagcaaa

SEQ ID NO: 69194 - DNA, 50 bp, homo sapien
ttggccacagaaaaaccaggaaataycaaaatatccaacaatacaagatt

SEQ ID NO: 69195 - DNA, 50 bp, homo sapien
ctgaagtacaggaaatgggctacacmactgggacactgaattctgaaatg

SEQ ID NO: 69196 - DNA, 50 bp, homo sapien
gagcacagaggaaccaactggtagarcaacaatcaatatatgctggctat

SEQ ID NO: 69197 - DNA, 50 bp, homo sapien
ggtcattattgaatatccgtgtcccrgactcagctaaaagccccaagaga

SEQ ID NO: 69198 - DNA, 50 bp, homo sapien
aaatgcataggaaaatattattggaraatgcttaagggagctgtatgcct

SEQ ID NO: 69199 - DNA, 50 bp, homo sapien
tttctccatctctggtggtagggtakaggataaagtggagagagtcttac

SEQ ID NO: 69200 - DNA, 50 bp, homo sapien
ctgaaatgtgtgctgttattttagcrtaagctcatttgtactcactggct

SEQ ID NO: 69201 - DNA, 50 bp, homo sapien
tttctctcacttaggttttgaaaagragctggatattagacaattcaagg

SEQ ID NO: 69202 - DNA, 50 bp, homo sapien
aaagtctcttaaaaaccaagtgttayattgtgccatgctgctctgctgct

SEQ ID NO: 69203 - DNA, 50 bp, homo sapien
tgaggaaaagagattacagagcgtargtggcatgggtttacctaaggcag

SEQ ID NO: 69204 - DNA, 50 bp, homo sapien
gctggtaagtatcagagaattgggcrtgagtttagagtgctgactgtcag

SEQ ID NO: 69205 - DNA, 50 bp, homo sapien
ggcagaggcttggcaacattgatcaycagagttaaggagggcatagcagc

SEQ ID NO: 69206 - DNA, 50 bp, homo sapien
cttctgacggtattcttaggttagaygcctaggtaagattcttgcatttt

SEQ ID NO: 69207 - DNA, 50 bp, homo sapien
agctgataaaaattccttggaaaaaytggccaccttgtttttacaaggtt

SEQ ID NO: 69208 - DNA, 50 bp, homo sapien
tactctatgcattgaaaggacagtcrtttagataagaacttaagttacat

SEQ ID NO: 69209 - DNA, 50 bp, homo sapien
cttgctgctcctattcttactggaakcttacttaaaatggggtagaaaag

SEQ ID NO: 69210 - DNA, 50 bp, homo sapien
gtaaatgagtataaagcaatccagargaggttaaaataaatacatttaag

SEQ ID NO: 69211 - DNA, 50 bp, homo sapien
caaagcaatgcattaatgacttcaaraatgacttcaaataaatttgccca

SEQ ID NO: 69212 - DNA, 50 bp, homo sapien
atttgcttgaattaatgccatactcraggcctatgtcgcaagggatctga

SEQ ID NO: 69213 - DNA, 50 bp, homo sapien
tgtgtataactgacaattggttgtartaaaaatgacaaagtcagttacat

SEQ ID NO: 69214 - DNA, 50 bp, homo sapien
tgacatccactcattatctggaatamaagaaaaccatggaatgttcattt

SEQ ID NO: 69215 - DNA, 50 bp, homo sapien
agatgccagaattcatagaaggaaaycattaaatgcaaaggaggagtgat

SEQ ID NO: 69216 - DNA, 50 bp, homo sapien
tgtgttattttaagcatagctctagkccctttctagccattcgaggtttt

SEQ ID NO: 69217 - DNA, 50 bp, homo sapien
gccctttcattttagaaggagatcayaataggagagcccctctctgccag

SEQ ID NO: 69218 - DNA, 50 bp, homo sapien
gtctgcgagaggcaaactgacttgartacttctgagcatctatcgagtct

SEQ ID NO: 69219 - DNA, 50 bp, homo sapien
aatttctagatttttgaaaatacaaygtgggccaaacaaaataatgctta

SEQ ID NO: 69220 - DNA, 50 bp, homo sapien
attaacctttctctaggttagtggarataatcaagcctgacttgagtgct

SEQ ID NO: 69221 - DNA, 50 bp, homo sapien
ggcctcatttctctcctctgaatcgragctaccataaccaccttccttcc

SEQ ID NO: 69222 - DNA, 50 bp, homo sapien
ttattttataaaagaatttgaaccamggatgagttgggctttaatagtga

SEQ ID NO: 69223 - DNA, 50 bp, homo sapien
gaaattagccctatatgcaagtccakctcttttctcattgttctgagttt

SEQ ID NO: 69224 - DNA, 50 bp, homo sapien
agttcaagaaaaattcagagtaaaaygtagagaacagtcctcattttttt

SEQ ID NO: 69225 - DNA, 50 bp, homo sapien
tagcctgtcccagagaagaaaagaaygcagggaggaaggagtcttgacat

SEQ ID NO: 69226 - DNA, 50 bp, homo sapien
ccactctgctggtcccttgctcttgraggacggaccccacagatattggg

SEQ ID NO: 69227 - DNA, 50 bp, homo sapien
ccactgccacacacataattcaaacygaagatgtcttttgttttccagaa

SEQ ID NO: 69228 - DNA, 50 bp, homo sapien
tatacccaaaaaacatgtctttaatkatggcctggtaaactcctgctggt

SEQ ID NO: 69229 - DNA, 50 bp, homo sapien
accaaaacgtttgtttttctcctgartgaaaccaccatgcccaaaaatgg

SEQ ID NO: 69230 - DNA, 50 bp, homo sapien
tcagatctttatgaaattatctttayggaactggaccgacaacaagcttt

SEQ ID NO: 69231 - DNA, 50 bp, homo sapien
gttagttccttcccacatgactatcsctactggctgccttatccttacac

SEQ ID NO: 69232 - DNA, 50 bp, homo sapien
ggagaagcaaaggaaaagatgcctaycaaagactgagtcgtgagatgtgc

SEQ ID NO: 69233 - DNA, 50 bp, homo sapien
cttatttctggacattctataggcamccctttatttgtttggattttatt

SEQ ID NO: 69234 - DNA, 50 bp, homo sapien
ggtttagttagcagctcttctgctcrctttcttagaggggtcttcagcct

SEQ ID NO: 69235 - DNA, 50 bp, homo sapien
ttaatctgtttttccatatcttcaargtcagtgtaccataattcatttct

SEQ ID NO: 69236 - DNA, 50 bp, homo sapien
ggacttgagagttgcagagactttayagatctttaggttcaatctctcca

SEQ ID NO: 69237 - DNA, 50 bp, homo sapien
atgctttatttgagaagtacacactyaaggcagtgaaagtaaggaaaaac

SEQ ID NO: 69238 - DNA, 50 bp, homo sapien
ttatgaatccttgcaagttcccttamgcctttctgaagcaaaaacagtat

SEQ ID NO: 69239 - DNA, 50 bp, homo sapien
ctagataccacaaggctacaaacacrgataatacaattgctgccttgatc

SEQ ID NO: 69240 - DNA, 50 bp, homo sapien
ttgacaggggacactgctaactaackcccatatcaaaagagaaatcataa

SEQ ID NO: 69241 - DNA, 50 bp, homo sapien
tacctgtcgaccacatccatccttasctctctgatcaccttactatttaa

SEQ ID NO: 69242 - DNA, 50 bp, homo sapien
tcaggtattcatgcttatccaatcaragggcttttttttcttcccatggt

SEQ ID NO: 69243 - DNA, 50 bp, homo sapien
gtcatcaactctgtgttcttaatggrcatatatcttctcctaagggtatt

SEQ ID NO: 69244 - DNA, 50 bp, homo sapien
aatattgtggcaaagccaaggtacaractcacgtgcattaaaatatgctt

SEQ ID NO: 69245 - DNA, 50 bp, homo sapien
caagtataatataataagctaatagwatacgaatatagaggaagatatct

SEQ ID NO: 69246 - DNA, 50 bp, homo sapien
aaattgactcagaaaaataatcaacsaaagcgttcctcattcctttaacg

SEQ ID NO: 69247 - DNA, 50 bp, homo sapien
tatgaggaacctccaaactgttagasactttttcttgatgactgttgatt

SEQ ID NO: 69248 - DNA, 50 bp, homo sapien
acaaatcttctgtcttaaatagtaasggtaatgctaattgttaaaaaaaa

SEQ ID NO: 69249 - DNA, 50 bp, homo sapien
agtaagtctcattgctatccctatayaccaaggtttgctatttgctactc

SEQ ID NO: 69250 - DNA, 50 bp, homo sapien
gagattgaaggagaaatcgaaggaaytgtgtcaagacatctgaaaataga

SEQ ID NO: 69251 - DNA, 50 bp, homo sapien
acagataaagaactaaaattatggaraaccagacacgagttcttatgcaa

SEQ ID NO: 69252 - DNA, 50 bp, homo sapien
ttcattttcttggcaaagatttttasgccatgtgaaaagtatctttcagg

SEQ ID NO: 69253 - DNA, 50 bp, homo sapien
tcttccccgtggacttaagttacatyaccataagcagcagtagcaacagc

SEQ ID NO: 69254 - DNA, 50 bp, homo sapien
atcattcactctttgcctttaaaaartcacaataatgtgcaaagaagaga

SEQ ID NO: 69255 - DNA, 50 bp, homo sapien
tgaataactttgtaaaacccaagcayataatttctacaatatccctatta

SEQ ID NO: 69256 - DNA, 50 bp, homo sapien
tctatgtatttatttgactttctagyagtagcatagtaaaaggctgatca

SEQ ID NO: 69257 - DNA, 50 bp, homo sapien
atctgtcacctgcatgcatacttatwtggccaatagcgtttaatatagct

SEQ ID NO: 69258 - DNA, 50 bp, homo sapien
atcatactctcctcatttgactatarcaacttacaagcacaaaagatgat

SEQ ID NO: 69259 - DNA, 50 bp, homo sapien
ttgagatcaagttttgataaggaagsatagaaagaaatccgtgcacagaa

SEQ ID NO: 69260 - DNA, 50 bp, homo sapien
gtgaccatacatcctagttttcctcrgagagtcttagtttacaactgtta

SEQ ID NO: 69261 - DNA, 50 bp, homo sapien
ttatcaatttacgttacttagcttgratacataataagaattgtttttcc

SEQ ID NO: 69262 - DNA, 50 bp, homo sapien
ttagcaaagattttattttattaaayggagttcaaacatttaaggtgctc

SEQ ID NO: 69263 - DNA, 50 bp, homo sapien
tgaaactctccttaatatagacttaygattatttcccttctgtctactct

SEQ ID NO: 69264 - DNA, 50 bp, homo sapien
tttcatatctggttacttagcactaygtaaatctccttgggcctattgta

SEQ ID NO: 69265 - DNA, 50 bp, homo sapien
gccaaacagcacagtacagcagaaargatctaaatttgggaattatactg

SEQ ID NO: 69266 - DNA, 50 bp, homo sapien
cttctaagaagaaaaaggtaatacaygcttatagtctgaatttagctaca

SEQ ID NO: 69267 - DNA, 50 bp, homo sapien
aaaagcacattaggacacataaaaaygaagagcaccaacactggcctcag

SEQ ID NO: 69268 - DNA, 50 bp, homo sapien
ttctggcttccccatcaaatgcaggraaaatgtacaggctcatatgccat

SEQ ID NO: 69269 - DNA, 50 bp, homo sapien
gtaatacagcacctgatataccgaayggttttaaaatgtcagaagtcaga

SEQ ID NO: 69270 - DNA, 50 bp, homo sapien
ctccttcaaattcaccctattccagsatgcacttggcctcagggcatcac

SEQ ID NO: 69271 - DNA, 50 bp, homo sapien
agaaacaaacatagtagaaaacaaasagggaagatacggttagaaagact

SEQ ID NO: 69272 - DNA, 50 bp, homo sapien
actcagtgtctcttaatatttgcaaytcccttgcctatagtcagccactt

SEQ ID NO: 69273 - DNA, 50 bp, homo sapien
caagtgctaggtactcacaattcagyatacccagtttaagtggacctgag

SEQ ID NO: 69274 - DNA, 50 bp, homo sapien
attttcaaaaataattaagaaacagsagtatcatgaaaacaacatccaac

SEQ ID NO: 69275 - DNA, 50 bp, homo sapien
atgccatgaggtcccttgcagtgcarcatggagctatatttgggtgagaa

SEQ ID NO: 69276 - DNA, 50 bp, homo sapien
caggcagtttacttttaattgcctcratagctactcaataaatatttgta

SEQ ID NO: 69277 - DNA, 50 bp, homo sapien
ttcatcaacatatcaccagtttcaartacaattccttgcatgttgtaggt

SEQ ID NO: 69278 - DNA, 50 bp, homo sapien
acaaatgaatctgtggatgcatcaasctatcgtcagtcaaacccctttaa

SEQ ID NO: 69279 - DNA, 50 bp, homo sapien
ggatggggcttcagggatgctgtcaktatttatgtctaatctcatttagt

SEQ ID NO: 69280 - DNA, 50 bp, homo sapien
tacagatggtacttatgcatgaaacyctttagaattcctctcttaacatt

SEQ ID NO: 69281 - DNA, 50 bp, homo sapien
tttaaatattctctagtttcctttakaattattccacagtaataatttct

SEQ ID NO: 69282 - DNA, 50 bp, homo sapien
ttaattcatagtattttgagcttaakatttaaacctgatatgcattttct

SEQ ID NO: 69283 - DNA, 50 bp, homo sapien
ggtaaatgacaaagtaaaatagtaartacccatctatgaataacatagtc

SEQ ID NO: 69284 - DNA, 50 bp, homo sapien
gagtttcatagaccagctctaaaacmatatctgtcagacaaaaagtctat

SEQ ID NO: 69285 - DNA, 50 bp, homo sapien
attatgtccttaacactgtgtttaaytactaaaggggacaagacagtttt

SEQ ID NO: 69286 - DNA, 50 bp, homo sapien
tttctgattctgtctgtaataggtcmatgtttagaacttagtgtcagtct

SEQ ID NO: 69287 - DNA, 50 bp, homo sapien
aatatgagcaccgaggtatgaaactrtcacacgcaggctcaatgctttaa

SEQ ID NO: 69288 - DNA, 50 bp, homo sapien
taaagccaggcttttcctagagcaaytaaacagctgaacaaaacacaagg

SEQ ID NO: 69289 - DNA, 50 bp, homo sapien
cttctacccatcaacatttttctcawcttataatgccatctcaactagca

SEQ ID NO: 69290 - DNA, 50 bp, homo sapien
cttcgtacatttcttagcccactgtwaaatggtaaaaccgctatgtaaaa

SEQ ID NO: 69291 - DNA, 50 bp, homo sapien
cattcagtttactgcttgctaagaayttaattggtaaaatgcaaattgct

SEQ ID NO: 69292 - DNA, 50 bp, homo sapien
acacgtgcacacatgatagctccaawcgcattgtttaagaaaaaacaaaa

SEQ ID NO: 69293 - DNA, 50 bp, homo sapien
cataaaatttgttgtgttcaagataygatacgggcaagtgaagacactag

SEQ ID NO: 69294 - DNA, 50 bp, homo sapien
ttggtatagtttttatttcatattcrcaattatttaaacaacatacagca

SEQ ID NO: 69295 - DNA, 50 bp, homo sapien
ttcgatctaattctaaactctattcyattccattgtttctgcaccaaaac

SEQ ID NO: 69296 - DNA, 50 bp, homo sapien
atgttgggaaaatcccaagtaaatgsagagaagatgttcacgcacagaaa

SEQ ID NO: 69297 - DNA, 50 bp, homo sapien
tagaatgtaattcaacaagttataayagtcctatgaaataatatcacaag

SEQ ID NO: 69298 - DNA, 50 bp, homo sapien
ttgttcttcagaagatccaacagtcsaatttctgagctttccatgtatat

SEQ ID NO: 69299 - DNA, 50 bp, homo sapien
atcaaatgtgatgtagcaattactaycttaactacaatacatggtgtaaa

SEQ ID NO: 69300 - DNA, 50 bp, homo sapien
gtactactctataaagaaatacaaarcaggatactaatgccaagtaatat

SEQ ID NO: 69301 - DNA, 50 bp, homo sapien
gataagatctttaataacagttatcycttctcaattctaacataacagga

SEQ ID NO: 69302 - DNA, 50 bp, homo sapien
ggtcatacattgaaaagagaaaagtrtgcaaaacattaaacaaaagaaaa

SEQ ID NO: 69303 - DNA, 50 bp, homo sapien
tcacgtttctagaggagtggccaagmcttctgtaaagtttcttttccatt

SEQ ID NO: 69304 - DNA, 50 bp, homo sapien
cgttgccactctgcttaaataaaaaycttcacagcttaaatcaaaacctt

SEQ ID NO: 69305 - DNA, 50 bp, homo sapien
caaaatacttgttagacatttgaacrgactccaaatccctcttgggatca

SEQ ID NO: 69306 - DNA, 50 bp, homo sapien
cccaaatttcagtgacttaacaatastaactctcaccttcatgcagagca

SEQ ID NO: 69307 - DNA, 50 bp, homo sapien
ttttgcttagttacttggagaaaaayttgtgaaacacgagggtaagagaa

SEQ ID NO: 69308 - DNA, 50 bp, homo sapien
gaagaagagaggggctgaaagttatygccaatagccagtgatttaataat

SEQ ID NO: 69309 - DNA, 50 bp, homo sapien
gaatttcaacaaaaaaggagtgtgargttattaagacatttgttaatgga

SEQ ID NO: 69310 - DNA, 50 bp, homo sapien
agcagtattagagaatttaatttgtwaaaatcacaaagcaagaaagaagc

SEQ ID NO: 69311 - DNA, 50 bp, homo sapien
agcaattttatagcaaacctaagacyatctggatgaaattcttgatgatg

SEQ ID NO: 69312 - DNA, 50 bp, homo sapien
attaataaaaacagataggtgatgayagatgatagagaaagatagagaaa

SEQ ID NO: 69313 - DNA, 50 bp, homo sapien
tggagtcagtgattcacatctgaagraagggagtatagagcaaatctttc

SEQ ID NO: 69314 - DNA, 50 bp, homo sapien
ttaaaaatctctgacaagttcttgayatgcaaatatttcatgttgttgat

SEQ ID NO: 69315 - DNA, 50 bp, homo sapien
gcccagaacatacactgccattagarcttgatcagtcttaacatcagtga

SEQ ID NO: 69316 - DNA, 50 bp, homo sapien
aaagacttgaacttcaaaattttcaragtaaatgctatggcacatactag

SEQ ID NO: 69317 - DNA, 50 bp, homo sapien
tgactcggatgaaagacttctaaaaygatttcaaatttcaaacatccact

SEQ ID NO: 69318 - DNA, 50 bp, homo sapien
aaagtatggagatatgtaagtttgasgtgaagtgggcttggagctgtcct

SEQ ID NO: 69319 - DNA, 50 bp, homo sapien
cacatttccacatttaaagctgtgaygaagaaatatttaaatttaaagcc

SEQ ID NO: 69320 - DNA, 50 bp, homo sapien
accccaatgtaaagatctggtaacaytctgattcacttacttggatcagc

SEQ ID NO: 69321 - DNA, 50 bp, homo sapien
aaaatgtcattaaaatacttcaacaktccgtgtctaactcttctgaaact

SEQ ID NO: 69322 - DNA, 50 bp, homo sapien
ttgggctcacccagatagataattcraaataatatgctcatcttaagttc

SEQ ID NO: 69323 - DNA, 50 bp, homo sapien
agcccagcttaaaacaggcttaaagmaggaagaatttatgcagcctcagt

SEQ ID NO: 69324 - DNA, 50 bp, homo sapien
cacttacatgaaactctgtagagaartacctcagctatactgcaggcccc

SEQ ID NO: 69325 - DNA, 50 bp, homo sapien
catttagaaacccaggattggcatgragaccttgaatccagggatacgtg

SEQ ID NO: 69326 - DNA, 50 bp, homo sapien
ggaaatttgaagaaatatagtcctakgaacacaaggaacttcaggcacag

SEQ ID NO: 69327 - DNA, 50 bp, homo sapien
ttgtggccaaccagctaatgtttcartatttgagaaaaataacagtttgt

SEQ ID NO: 69328 - DNA, 50 bp, homo sapien
aataagatccttgattctctggaaasgtagcctgacaaattaaccaacct

SEQ ID NO: 69329 - DNA, 50 bp, homo sapien
gaaaactgcgctcttagccactacawtataaaggttccacattactttta

SEQ ID NO: 69330 - DNA, 50 bp, homo sapien
aattaactcagaaaaagctgaaagayattctacttttaaaagcacagaaa

SEQ ID NO: 69331 - DNA, 50 bp, homo sapien
cctagggggtctcctaaagcagatamagattgaatcacaacaccaagtcc

SEQ ID NO: 69332 - DNA, 50 bp, homo sapien
tttcttctcattgcatttgggtccaygtttatctggagaagtaaatagag

SEQ ID NO: 69333 - DNA, 50 bp, homo sapien
atcaaccaccaaagtcattattcaarcatagtggttctcaacggggtgat

SEQ ID NO: 69334 - DNA, 50 bp, homo sapien
agtttcagacaggtacactaccttaygcaataatacacagccagtatcct

SEQ ID NO: 69335 - DNA, 50 bp, homo sapien
caagagtttgtttttttaaagagtartgttctcatctttcccattcttca

SEQ ID NO: 69336 - DNA, 50 bp, homo sapien
atttgactctgaaaggctggttatargaaacccataaatcttccagtagt

SEQ ID NO: 69337 - DNA, 50 bp, homo sapien
aataaccttgtgagttgaatcagaarcacggtcccattttgcagataatg

SEQ ID NO: 69338 - DNA, 50 bp, homo sapien
gtagcaattggctacctttaagtacsaactttcagtaattcttgccactt

SEQ ID NO: 69339 - DNA, 50 bp, homo sapien
aactacctacccatgtgctattcacragcatgttttagtttatgcaatat

SEQ ID NO: 69340 - DNA, 50 bp, homo sapien
aaatacagaaaataatgtagcaaacrcttgtgtactattagatgcttttt

SEQ ID NO: 69341 - DNA, 50 bp, homo sapien
tgagcttccaggaaatgcacctttaygtgatatactcacttttaagctca

SEQ ID NO: 69342 - DNA, 50 bp, homo sapien
aatgtgtcccctacctgcaggaagartgacctcccattcctagcagaaat

SEQ ID NO: 69343 - DNA, 50 bp, homo sapien
tgaactctacaattaatgggagaatmaatcatatgataatttgttggctc

SEQ ID NO: 69344 - DNA, 50 bp, homo sapien
cattttctctcactgaaaatgtatartaagcctatagtggtatctatgtc

SEQ ID NO: 69345 - DNA, 50 bp, homo sapien
gtaagcacattttctgcaatcttacraagccatttagcaataaaaatttg

SEQ ID NO: 69346 - DNA, 50 bp, homo sapien
aatataaattattatatacaaatggrtgtcttttacagcaatagactcca

SEQ ID NO: 69347 - DNA, 50 bp, homo sapien
aatttgcacattctaagactcaagaygacaatacaacatagtgtaaaaat

SEQ ID NO: 69348 - DNA, 50 bp, homo sapien
agttcaagtctaggtcctgtggtaartatgaaagagcccaaaacacttgc

SEQ ID NO: 69349 - DNA, 50 bp, homo sapien
ctgtttttcggtttatgggagacacraacagttcaatactgttcttcttt

SEQ ID NO: 69350 - DNA, 50 bp, homo sapien
gatttagatgtattttgtcaattgaycgcttgaaactgatatgtcaaata

SEQ ID NO: 69351 - DNA, 50 bp, homo sapien
gctctctatcccacatttaagagtgrcacccatttgcaaagtaggtcttt

SEQ ID NO: 69352 - DNA, 50 bp, homo sapien
agatttccaggtccgtggagtcaggrattgtatattatttatcctagtat

SEQ ID NO: 69353 - DNA, 50 bp, homo sapien
tagtcttaacttcaaaacagggacamtgtaattatgttctttgcaagaaa

SEQ ID NO: 69354 - DNA, 50 bp, homo sapien
ttaaaataccctgttatttagaggayaaactctggtggtagaccatctga

SEQ ID NO: 69355 - DNA, 50 bp, homo sapien
ggtctggaaacctgggcttttatccygactatgctattaactaccacttt

SEQ ID NO: 69356 - DNA, 50 bp, homo sapien
atcaatggtggcctcacctattgtaraaccagtgtataattttatatagt

SEQ ID NO: 69357 - DNA, 50 bp, homo sapien
aataaagagttaagggcaatttacasaaaccttcacatgttgacaggacg

SEQ ID NO: 69358 - DNA, 50 bp, homo sapien
accttcatcacataccagttgtatayagtatgcacctaacagtcacatca

SEQ ID NO: 69359 - DNA, 50 bp, homo sapien
ctggtaggaaggaccattattatcayggagactaaaatataaggcagatt

SEQ ID NO: 69360 - DNA, 50 bp, homo sapien
agaagacacttaagaggagagagacyatacaacttttggcaggttgcttc

SEQ ID NO: 69361 - DNA, 50 bp, homo sapien
ttattatgctattgttgatttaggaytaaaaatattggctttactaaaag

SEQ ID NO: 69362 - DNA, 50 bp, homo sapien
tgtgtctctggatttgcatagagaartgaagcatcatgaaaaagtttcta

SEQ ID NO: 69363 - DNA, 50 bp, homo sapien
cctactctgagtcaggttcaacaacsactttctttaaatggtagcttgta

SEQ ID NO: 69364 - DNA, 50 bp, homo sapien
attgccttggaagctgtgaacctgayacaaaatgttgctgcatgcttttg

SEQ ID NO: 69365 - DNA, 50 bp, homo sapien
ctctactattcagcaaatattgagcrcctactctgagtcaggttcaacaa

SEQ ID NO: 69366 - DNA, 50 bp, homo sapien
ctttcaaaaaacagaaggtagaccarattcgatattcaggtcttccctag

SEQ ID NO: 69367 - DNA, 50 bp, homo sapien
acaaagtttaagtgaatacggaaaasgtgaaacagggatagtgagcattt

SEQ ID NO: 69368 - DNA, 50 bp, homo sapien
taataactacttgttaatgaataaarcagtagaaaattgttgtgccatat

SEQ ID NO: 69369 - DNA, 50 bp, homo sapien
atttgccttcccacagtttttccacrctacagatatcagacattatgatc

SEQ ID NO: 69370 - DNA, 50 bp, homo sapien
aggactccactgtaacactgttttgyactagatatatacaacaaaaatct

SEQ ID NO: 69371 - DNA, 50 bp, homo sapien
gacaactttacactaagctgaataaygttcatttactcaaaagctagtct

SEQ ID NO: 69372 - DNA, 50 bp, homo sapien
accatgttggatttctgaaaatttckcataaagaggtctctcaatagttc

SEQ ID NO: 69373 - DNA, 50 bp, homo sapien
tcagttttcttggtagtgtttttcargatagccccatcccaactggtttg

SEQ ID NO: 69374 - DNA, 50 bp, homo sapien
aatatgaatattcctgaatgagtcartgaagtcagattttgctgggtcct

SEQ ID NO: 69375 - DNA, 50 bp, homo sapien
tcaaaattcacaaatctaaagactgyagcaagactcttgagataccttgt

SEQ ID NO: 69376 - DNA, 50 bp, homo sapien
agatgagctgaggcctaaaggaccaygcaaatagtgctggtttcattctt

SEQ ID NO: 69377 - DNA, 50 bp, homo sapien
cagctaccactcagattaacctgatragcacttgtgtattatttgcactt

SEQ ID NO: 69378 - DNA, 50 bp, homo sapien
tcctgttctgtgacctctgtaataasttgcctggtatggtacttgtaggc

SEQ ID NO: 69379 - DNA, 50 bp, homo sapien
gagaaattttcatctagagttatgamtggaaacagaaaagctcaccaaaa

SEQ ID NO: 69380 - DNA, 50 bp, homo sapien
aagcttagaaggtatgtcagattacraaacccagctgaaaccttttgagc

SEQ ID NO: 69381 - DNA, 50 bp, homo sapien
cagcattcaaatgtacacttttctargcccaaccttatatctacataaat

SEQ ID NO: 69382 - DNA, 50 bp, homo sapien
cctttggctgattttcctaatttatrttgcacttacaacacctgacacga

SEQ ID NO: 69383 - DNA, 50 bp, homo sapien
acacgttcacagccagctacaggagmgtttgggtcagcctattaagcaca

SEQ ID NO: 69384 - DNA, 50 bp, homo sapien
gttgttataaaagattaaccacagamaaaatgaataaagttgtaagaaaa

SEQ ID NO: 69385 - DNA, 50 bp, homo sapien
gtgtgccatagacacagtcttcacayagatttggcaaaccatcctagttt

SEQ ID NO: 69386 - DNA, 50 bp, homo sapien
tctttctcaccatatcacaataccaktagttatttcttttctccaaccac

SEQ ID NO: 69387 - DNA, 50 bp, homo sapien
tttgaaagagcatagcttttacacaytagcttaccaggacatagttaaaa

SEQ ID NO: 69388 - DNA, 50 bp, homo sapien
cacaaaggccttagcacacacaaacratacaaagttgaattagaagaaat

SEQ ID NO: 69389 - DNA, 50 bp, homo sapien
taagtaacttgccctgcattaaacartaatttaaccacaaagctgagact

SEQ ID NO: 69390 - DNA, 50 bp, homo sapien
tctgagaaagtctctccattgaactmaacaactgtccaataggtagagca

SEQ ID NO: 69391 - DNA, 50 bp, homo sapien
tttaagtttcagctgggtatctataraacagagatagtgggtggtggtgg

SEQ ID NO: 69392 - DNA, 50 bp, homo sapien
taagtaggctttgcatttaaaaccakactgtagcaatcaatgtgtggttg

SEQ ID NO: 69393 - DNA, 50 bp, homo sapien
atgtgaactatgtggtaatgaataamgtctttctgagaaacatgaatgga

SEQ ID NO: 69394 - DNA, 50 bp, homo sapien
aaaattgtccaggtatttcaatggcrataggacagtcttttcaatgaata

SEQ ID NO: 69395 - DNA, 50 bp, homo sapien
tttttctctttttgaccaaataactracatctattaattctcgcaattaa

SEQ ID NO: 69396 - DNA, 50 bp, homo sapien
acatcccagtctgttcctatctcaaracctttgaatttgctgtttcctca

SEQ ID NO: 69397 - DNA, 50 bp, homo sapien
ttatgatggtcatgccagtaagagayaaaaaggagagaaaatttacctct

SEQ ID NO: 69398 - DNA, 50 bp, homo sapien
caagacaaagaagcttgtgcaataaragagtagcaagaaaaaaagggtaa

SEQ ID NO: 69399 - DNA, 50 bp, homo sapien
agggtgaggattaaacagaaattcartataaactctccaggacaccaggt

SEQ ID NO: 69400 - DNA, 50 bp, homo sapien
gtatgaaaaatagtcccaacttagaygaccattgattttgcatgtgtgat

SEQ ID NO: 69401 - DNA, 50 bp, homo sapien
ttaagcgaaatgcagaacaatgattraacgcattttccaaggtcaatatt

SEQ ID NO: 69402 - DNA, 50 bp, homo sapien
gaaaaagtggactgaacaaaaacagrattccatgttagtctaaccaacag

SEQ ID NO: 69403 - DNA, 50 bp, homo sapien
ggtctacataattgagctaaaaaaamtttcttgagcatttttcctcacag

SEQ ID NO: 69404 - DNA, 50 bp, homo sapien
taatatgcataaagaattcatattargcctgagacattagcctaagaact

SEQ ID NO: 69405 - DNA, 50 bp, homo sapien
tagaatttttttaaaacttactaaawtctaatggatatcaaggaaatact

SEQ ID NO: 69406 - DNA, 50 bp, homo sapien
attgttgaaggcttaatatttacaartcactgtatggatgctttattatg

SEQ ID NO: 69407 - DNA, 50 bp, homo sapien
cagatttgtggttactttcaatgacrattcatatgccttcattcattaga

SEQ ID NO: 69408 - DNA, 50 bp, homo sapien
aaatcacgtagcttttcatcagccawaaagaaagaatctgattgagcctg

SEQ ID NO: 69409 - DNA, 50 bp, homo sapien
gtagagtcaactgttttgctaatgaygctaaataaataacagtggtcaca

SEQ ID NO: 69410 - DNA, 50 bp, homo sapien
tatgtactgtatgtattgtatgtaamtgcctactttgttttggatgttgt

SEQ ID NO: 69411 - DNA, 50 bp, homo sapien
gtctagacaggagcgaatatccaggraccaatatgtgtgcttatttgtag

SEQ ID NO: 69412 - DNA, 50 bp, homo sapien
atatttgagagggaatgaatgatacygagttcagtttgggagatccagga

SEQ ID NO: 69413 - DNA, 50 bp, homo sapien
actaatacagaagtttccacatgtarctaagtatccatacattaaagtga

SEQ ID NO: 69414 - DNA, 50 bp, homo sapien
ggttttttttattttctggtagcackcagtatcctgggataataacagag

SEQ ID NO: 69415 - DNA, 50 bp, homo sapien
tccccatgacctaattgacagttaartgttcgcttcttgtgtagctggag

SEQ ID NO: 69416 - DNA, 50 bp, homo sapien
ttctttttgacactgaaattgggacraagcaggtgcttgatagttgttga

SEQ ID NO: 69417 - DNA, 50 bp, homo sapien
ttatgtgggatctgagaacctgtagragagctgcagctggggctatactg

SEQ ID NO: 69418 - DNA, 50 bp, homo sapien
gccatcccttaagcggcctctctcamcttcatactaaaatatctataaag

SEQ ID NO: 69419 - DNA, 50 bp, homo sapien
ttttaataaaaatttctctcaggtayatgtgaatggtagatataaatttc

SEQ ID NO: 69420 - DNA, 50 bp, homo sapien
agtgtattatgtggtattagtgatarcatctttctaacaatagtattcac

SEQ ID NO: 69421 - DNA, 50 bp, homo sapien
ggggttgagtcttgaatctgagacaytataggaaattactaaatgtactg

SEQ ID NO: 69422 - DNA, 50 bp, homo sapien
agaatatgttccgacctcagcaagcraccacgtactttgattatgtagca

SEQ ID NO: 69423 - DNA, 50 bp, homo sapien
taggaaggaaggggaaaatcacagartaaaaccagatgcttttgtaaatt

SEQ ID NO: 69424 - DNA, 50 bp, homo sapien
atttggtgtcaaagaagctgaagccratattgtgatacgttctactaaaa

SEQ ID NO: 69425 - DNA, 50 bp, homo sapien
agctccttgtgtatgttgagcgtgcrcatattgatggatgttagatccat

SEQ ID NO: 69426 - DNA, 50 bp, homo sapien
cgtgattatcctacagctcatggtcytgtgcaaattaataacagcattca

SEQ ID NO: 69427 - DNA, 50 bp, homo sapien
accaaacacctggctgagtctcataygttatttaattcatatactatctt

SEQ ID NO: 69428 - DNA, 50 bp, homo sapien
cacatgaatcaccccagatacaatcrcatgaagcagaggaaacactgagc

SEQ ID NO: 69429 - DNA, 50 bp, homo sapien
ttcagtctgagagaatgacgagatayatgaaaatgaggacaagttataca

SEQ ID NO: 69430 - DNA, 50 bp, homo sapien
tgtccgagagcaagccatgccaaaasttgctggattcaaaccacaacagc

SEQ ID NO: 69431 - DNA, 50 bp, homo sapien
ttctagaagaaaatttaggagaacamctttatgatttggagctaggcaaa

SEQ ID NO: 69432 - DNA, 50 bp, homo sapien
atgatagtttatgtagtatttgagastaatcagcaggaacaaatactttt

SEQ ID NO: 69433 - DNA, 50 bp, homo sapien
ttcgaggttatttggatgtttcagaygagatagggcacattcaggatggt

SEQ ID NO: 69434 - DNA, 50 bp, homo sapien
ctgcaaaacggaacaagcattaaacygtgagtcaaaaatctagattctat

SEQ ID NO: 69435 - DNA, 50 bp, homo sapien
atttttctaacattagccttcagatratacttaaagcagacgttcccagc

SEQ ID NO: 69436 - DNA, 50 bp, homo sapien
ttctagcagttatgttttaattaagratgtagctattgtttgaatgtgtc

SEQ ID NO: 69437 - DNA, 50 bp, homo sapien
gagattagtaaaacaagcatacctaraagtaacagctgagatcaagagat

SEQ ID NO: 69438 - DNA, 50 bp, homo sapien
tataccagaatcaggttggaagttgstatcttattgccataaatcatctg

SEQ ID NO: 69439 - DNA, 50 bp, homo sapien
tctttgattttctaatatgcagatgraagaatgctataacaccagaagga

SEQ ID NO: 69440 - DNA, 50 bp, homo sapien
taaatcatctgttttgtcagtcttaygatttctattttaatgttaatcca

SEQ ID NO: 69441 - DNA, 50 bp, homo sapien
atactggttcatgtttattaaaatcrcaagtaaagctataatcaaaacca

SEQ ID NO: 69442 - DNA, 50 bp, homo sapien
aatgatatcagcctaatagtaaagtyggagttctttggcttttctacacc

SEQ ID NO: 69443 - DNA, 50 bp, homo sapien
ttgttaaaaagatgcaacatttctayctccaagaagtttgaaatatataa

SEQ ID NO: 69444 - DNA, 50 bp, homo sapien
aaagggataaagatatttgaaactgratcttccatgccttatttgagttg

SEQ ID NO: 69445 - DNA, 50 bp, homo sapien
caataaggtctgaaataatgaggttytgctatgtaagtaaaataaaactc

SEQ ID NO: 69446 - DNA, 50 bp, homo sapien
taacacaagttatatcacaggaatarggagttatcttacatataggatat

SEQ ID NO: 69447 - DNA, 50 bp, homo sapien
ttgcaaattaaaatttgacctttaasgatactctttattgatctatttaa

SEQ ID NO: 69448 - DNA, 50 bp, homo sapien
ggattcaccccaggcagtgcagctcygacttttgacacttaacagcttca

SEQ ID NO: 69449 - DNA, 50 bp, homo sapien
tgatgttaaatttctaaaagggcaargaaagtagaattgatcaggtagca

SEQ ID NO: 69450 - DNA, 50 bp, homo sapien
cctgatcacatttctttcttataacmcttgttcactgcagaaaggagcat

SEQ ID NO: 69451 - DNA, 50 bp, homo sapien
acatgcaatttaatacaattgtgcartaataagattcaattcagtaacta

SEQ ID NO: 69452 - DNA, 50 bp, homo sapien
atatttttcctaattaatagccacasaagtagcttctaataccccagctt

SEQ ID NO: 69453 - DNA, 50 bp, homo sapien
agctctatcaaactgacagcatttcraagtagaacacttaaaaattatat

SEQ ID NO: 69454 - DNA, 50 bp, homo sapien
aatatatcaggaaccaccgatattcrtgagatatgccatatatttttatt

SEQ ID NO: 69455 - DNA, 50 bp, homo sapien
ggaataatctttaatcaacaaaggayaggagtcagtaaataaatgctcga

SEQ ID NO: 69456 - DNA, 50 bp, homo sapien
ggtataatgtcagtattctctttaayggtaaacatcagcattttggtgcc

SEQ ID NO: 69457 - DNA, 50 bp, homo sapien
gagcatctcgtagctgagaactttaygtgaagaagctagtcatacaaaat

SEQ ID NO: 69458 - DNA, 50 bp, homo sapien
gcctgtttagttgacttgaagcatasagtgaactgctcatagtagaaagt

SEQ ID NO: 69459 - DNA, 50 bp, homo sapien
aactattcctacatagttataaggaygtgtgccaattattactactaata

SEQ ID NO: 69460 - DNA, 50 bp, homo sapien
ggagaaaatatatactacacaggtamccttgttttacagctgaagcaaag

SEQ ID NO: 69461 - DNA, 50 bp, homo sapien
atggcttgaatatccctaaatcaccwaatccatccgctcttacttcctgt

SEQ ID NO: 69462 - DNA, 50 bp, homo sapien
tatttctcccgagaaattcaatggayacatgataaggtgtgttgacatta

SEQ ID NO: 69463 - DNA, 50 bp, homo sapien
aatccttacctccaatgcgtactcaytcccaacaaccactatctaaactt

SEQ ID NO: 69464 - DNA, 50 bp, homo sapien
cacgtggttaggaattggagaaagcyatacctgaaacccaagtctagatg

SEQ ID NO: 69465 - DNA, 50 bp, homo sapien
ggggtacctgcttggagccgatacarctagtcttctcattttatattcca

SEQ ID NO: 69466 - DNA, 50 bp, homo sapien
gtatcctgacaagatgtatctgacarccaagttattaataggatggcaat

SEQ ID NO: 69467 - DNA, 50 bp, homo sapien
ggaggtgtggtgtcagaggttaatcraagacagaagttgggtaggctaag

SEQ ID NO: 69468 - DNA, 50 bp, homo sapien
aattatggcttattatattaaaacastatgatagaagagaaattacaata

SEQ ID NO: 69469 - DNA, 50 bp, homo sapien
ggtggatgggtgcagcaaacaattaygacacttgtctacctatgtaacaa

SEQ ID NO: 69470 - DNA, 50 bp, homo sapien
aaggtataattggcatgcatttagasattggatccctcaaattacagatt

SEQ ID NO: 69471 - DNA, 50 bp, homo sapien
ctcactgaaagaggagagatttaagrccattcagcagcatcttattttat

SEQ ID NO: 69472 - DNA, 50 bp, homo sapien
ttaattatatcacaaattagcactawattaactttgtcattaaaagttag

SEQ ID NO: 69473 - DNA, 50 bp, homo sapien
tcattcttcaatgttttaacaggaawctcagaaccagtggaagagtgtac

SEQ ID NO: 69474 - DNA, 50 bp, homo sapien
aaaataacagaatgggcaattcctayataatgttcatgattgtttgttga

SEQ ID NO: 69475 - DNA, 50 bp, homo sapien
aaaaattcaaataaacttttcaacaracaatcatgaacattatataggaa

SEQ ID NO: 69476 - DNA, 50 bp, homo sapien
ctatcaaatagacagctataccgcayataattaagcagtgctaagcagtg

SEQ ID NO: 69477 - DNA, 50 bp, homo sapien
aacagtttttagtgaactcctattaygtgctgagattcattaagctctta

SEQ ID NO: 69478 - DNA, 50 bp, homo sapien
gtggaggcagcatactcacctcataraaaaccttggcccacatgtgacca

SEQ ID NO: 69479 - DNA, 50 bp, homo sapien
tctggtgtctaaaacactattgagaytagatgcagaggtaccaattctgt

SEQ ID NO: 69480 - DNA, 50 bp, homo sapien
gggtatttttgacaacttctaatgawaaaccagttcaaatattttcatca

SEQ ID NO: 69481 - DNA, 50 bp, homo sapien
tcatataattaatatttcactacccratattttatcatttgatatcttag

SEQ ID NO: 69482 - DNA, 50 bp, homo sapien
atttgtcctcagacctttgaagttayggctcttcttgcttctagttatgg

SEQ ID NO: 69483 - DNA, 50 bp, homo sapien
tgaagcagcatgaactctctctggayggttttggaatttcatgcccaaat

SEQ ID NO: 69484 - DNA, 50 bp, homo sapien
agtagacacctggcaagacacctggyacgtttacttacaggaaatcctgt

SEQ ID NO: 69485 - DNA, 50 bp, homo sapien
caagtatattcacagtaatataaaaytgatgattcacacataagggaatt

SEQ ID NO: 69486 - DNA, 50 bp, homo sapien
atcaatacatgaaaattgaggactgygtatcaacaaatttagctcaagtg

SEQ ID NO: 69487 - DNA, 50 bp, homo sapien
gcatggaacaatgaatcagagtcaakttctaattatatgcataaaatgat

SEQ ID NO: 69488 - DNA, 50 bp, homo sapien
gttttgtttcccagaaaatacaaacrgagagagttggtaatagtaaaatg

SEQ ID NO: 69489 - DNA, 50 bp, homo sapien
aattagttcataggatcactaaacamatagttgaatattaaccagtttta

SEQ ID NO: 69490 - DNA, 50 bp, homo sapien
agggtaagggaagagaatagttcaasgagaaggtcaaggtcagcagggtc

SEQ ID NO: 69491 - DNA, 50 bp, homo sapien
gatgacctgccattcagaaactgacratgaataatacactctgacaccag

SEQ ID NO: 69492 - DNA, 50 bp, homo sapien
gttaagggatagactctgtattttcycactaggacatctccagggcctat

SEQ ID NO: 69493 - DNA, 50 bp, homo sapien
gcattagcatacaatacagttggaayggttagcatgtaataataataatg

SEQ ID NO: 69494 - DNA, 50 bp, homo sapien
ctattgtctcttctagggaaggcatmagtggaatacagaacagtgaaggc

SEQ ID NO: 69495 - DNA, 50 bp, homo sapien
gtaattatagcatgtaactaattcakctaattctcactgacttctcttat

SEQ ID NO: 69496 - DNA, 50 bp, homo sapien
tttttcctatttttaaatgtgattayggtgattacctaagaccattagtg

SEQ ID NO: 69497 - DNA, 50 bp, homo sapien
aaatgtactgtcctttattatgatayaccttaaatttgcataaagctttt

SEQ ID NO: 69498 - DNA, 50 bp, homo sapien
tttaattatctacaaatataacgtgraaattcattgatggtagaccattt

SEQ ID NO: 69499 - DNA, 50 bp, homo sapien
attaccatatagttctaacttactamgccaaagatacagtcttagacttt

SEQ ID NO: 69500 - DNA, 50 bp, homo sapien
ccataattgtgtcagcccattcttartaaatctaattacatgtatgtgta

SEQ ID NO: 69501 - DNA, 50 bp, homo sapien
aaccctgaactcgtgggtatttgtayattcaggtagtagttgcgtcccta

SEQ ID NO: 69502 - DNA, 50 bp, homo sapien
atccagtctgtggctcaatagaaacygtgaagaatcatcttctagaatag

SEQ ID NO: 69503 - DNA, 50 bp, homo sapien
gttgtgggtttggcaatggtaagaamagatagcctcaaagaaaactcata

SEQ ID NO: 69504 - DNA, 50 bp, homo sapien
ttttctttcataaccgagcttatackcagttgttctgtgacattaacaca

SEQ ID NO: 69505 - DNA, 50 bp, homo sapien
ctaagattgaagcctagttctatcayctattgtctatgtgagctcagaaa

SEQ ID NO: 69506 - DNA, 50 bp, homo sapien
tctaataaagggtgattatttcccamgctggcatttccttgttttctcct

SEQ ID NO: 69507 - DNA, 50 bp, homo sapien
ttgtccctaggagaacaagaaatacsagaaacatttttattgcagtcctt

SEQ ID NO: 69508 - DNA, 50 bp, homo sapien
gggcagtgttgccctttgggatgtamatttgagttattaatagtctagca

SEQ ID NO: 69509 - DNA, 50 bp, homo sapien
gtattgagtgctcagtgaatgttacyggttttcatattattctaaagaga

SEQ ID NO: 69510 - DNA, 50 bp, homo sapien
ttaagctttgcaatttctgttaaagycaacttcataaagaaagtttatgt

SEQ ID NO: 69511 - DNA, 50 bp, homo sapien
ctgtcattcacaagctcctgttagcwcttatatgccaagcactgctgtag

SEQ ID NO: 69512 - DNA, 50 bp, homo sapien
gaaaaccagtaacattcactgagcaytcaatacatgtaaaacattttgat

SEQ ID NO: 69513 - DNA, 50 bp, homo sapien
tttccttgcctgccagaggtaattayacatgttgttttaaatggtcttgg

SEQ ID NO: 69514 - DNA, 50 bp, homo sapien
ataaccagaaaagaattataagtacrgatgcaatttgattctgccataga

SEQ ID NO: 69515 - DNA, 50 bp, homo sapien
atggaaaaaaaaaaaggtctttgatkaactagtttgatgtgtggtttcaa

SEQ ID NO: 69516 - DNA, 50 bp, homo sapien
aaattttatgtatcttttacagggtsagagtagataattgctggtaagaa

SEQ ID NO: 69517 - DNA, 50 bp, homo sapien
gactggggtaagagaataagtaccartgcaatctctccttcttccaccct

SEQ ID NO: 69518 - DNA, 50 bp, homo sapien
aattgcatacagattttgagtcatayaagttagctttgtagaattaagtt

SEQ ID NO: 69519 - DNA, 50 bp, homo sapien
tctgaaaaatacattattaataatcyatcctaaaagcaagctcgtgtgtg

SEQ ID NO: 69520 - DNA, 50 bp, homo sapien
atgaaaggtgatgtcaaatttctcaraatagatgtaccgctttgtcttat

SEQ ID NO: 69521 - DNA, 50 bp, homo sapien
cagttcttcctttccttttaatgaartctctactgtccacaatcagtgaa

SEQ ID NO: 69522 - DNA, 50 bp, homo sapien
aagcagctgggataatgaggactgasagtgccaaaatcttcttcactcag

SEQ ID NO: 69523 - DNA, 50 bp, homo sapien
taaatccatggaatagaaatgtttayagaaagattgaacagcacgtccaa

SEQ ID NO: 69524 - DNA, 50 bp, homo sapien
ctaataaagagtcaataatctccaayggacgctctgtacatgagcctatc

SEQ ID NO: 69525 - DNA, 50 bp, homo sapien
ttaataataatttgtttgccttactraaacttagaggtagtcatgagaaa

SEQ ID NO: 69526 - DNA, 50 bp, homo sapien
aattagaggagattatgatcgggcargtgctattgattctcataattata

SEQ ID NO: 69527 - DNA, 50 bp, homo sapien
tataagattcagtatcgcattttaawagtgttcacgtaagtacagctctg

SEQ ID NO: 69528 - DNA, 50 bp, homo sapien
ctatgcatctatgtttgccaagttaygtgttttctattttatcctctaga

SEQ ID NO: 69529 - DNA, 50 bp, homo sapien
gcaaagaaacttggcctctgagtacmgatttcacagggtaaaagcaaaac

SEQ ID NO: 69530 - DNA, 50 bp, homo sapien
taaactagtgtaagaattcggtgaamctacttggttaagatataatttaa

SEQ ID NO: 69531 - DNA, 50 bp, homo sapien
tggggtattcaagaaactaaacaaasttaataaggtgttgtcttccttct

SEQ ID NO: 69532 - DNA, 50 bp, homo sapien
tccttctttctttcatgccaaaattkaagactttgcaaaggacagaagac

SEQ ID NO: 69533 - DNA, 50 bp, homo sapien
gtaaaacgatagaagggtaaaatcasatgaatattttgcaatgctcatgt

SEQ ID NO: 69534 - DNA, 50 bp, homo sapien
aaatggaaacccttcattctcagccrcatcaagaagaaaatttgtgtttt

SEQ ID NO: 69535 - DNA, 50 bp, homo sapien
tttatggaattgattcttcaaatacyaatactcatggagctgaggagaga

SEQ ID NO: 69536 - DNA, 50 bp, homo sapien
tttatgaattaagactattagtagakattaaatcagcctgatgaacaatc

SEQ ID NO: 69537 - DNA, 50 bp, homo sapien
ctgaggccagatgtaaaaacctcagrtctccttcacgccactcacttgat

SEQ ID NO: 69538 - DNA, 50 bp, homo sapien
aatagagattctcttgcagtaaataygcaggcctgctgtaactgtatttt

SEQ ID NO: 69539 - DNA, 50 bp, homo sapien
tgtgaactgtgattactttgggacaytgttctttccacctaactcctggg

SEQ ID NO: 69540 - DNA, 50 bp, homo sapien
aacagtttaaaatattgactgtaatraagttctatgggttttacttctcc

SEQ ID NO: 69541 - DNA, 50 bp, homo sapien
gagctatgatagcaataaattctaayagtttcttctcttatttggaggca

SEQ ID NO: 69542 - DNA, 50 bp, homo sapien
tccacaactagggaaaaagcaggtcsaaatgcctgagggcttagttttcc

SEQ ID NO: 69543 - DNA, 50 bp, homo sapien
ctaaaagttgcaaacaaacagcagartattttgaacgatggaagcatctg

SEQ ID NO: 69544 - DNA, 50 bp, homo sapien
aaaaacaactggttaagtaaggaaarttatagaccagtggttcccagcct

SEQ ID NO: 69545 - DNA, 50 bp, homo sapien
atactatgtccataaacataaaggayaagttaggcatagaggagtgagaa

SEQ ID NO: 69546 - DNA, 50 bp, homo sapien
gcccacatgtagatcaggaattagamtaaatctaggagtactacattagg

SEQ ID NO: 69547 - DNA, 50 bp, homo sapien
taccacaatgtattttatttattaayctattggctgaagtataatatgcc

SEQ ID NO: 69548 - DNA, 50 bp, homo sapien
ggagccccacgttggcaacctacgcrgaaacatttgctcagttcagcgat

SEQ ID NO: 69549 - DNA, 50 bp, homo sapien
aatatgttatggaagatgggataaaygtagttaacatagactgttccgac

SEQ ID NO: 69550 - DNA, 50 bp, homo sapien
aagggcacctctctgacagcattaamatttcaaaaatttgatacataaag

SEQ ID NO: 69551 - DNA, 50 bp, homo sapien
cacaaccttttgtgctacacattacrcagcaaatttaagttgtgacaact

SEQ ID NO: 69552 - DNA, 50 bp, homo sapien
gcacacttcttaatgacaaaaagtgratttaaccagtaatagagtcccca

SEQ ID NO: 69553 - DNA, 50 bp, homo sapien
agttattccgagaaggattcagttamgtttgttcatcttttggaatcatt

SEQ ID NO: 69554 - DNA, 50 bp, homo sapien
tatcaaggtacaaatgaatccgcatraagttcagcagcttcagtgccatt

SEQ ID NO: 69555 - DNA, 50 bp, homo sapien
ataagaaaacaaatggtgtagaaaaytactgtactggaggacagaggacc

SEQ ID NO: 69556 - DNA, 50 bp, homo sapien
gttacaataaagagaattgcctttcmatatgaatgaaaacataagaaagc

SEQ ID NO: 69557 - DNA, 50 bp, homo sapien
caatacaaaagcattgttgaatatayaggtatccttgaaagggatagttc

SEQ ID NO: 69558 - DNA, 50 bp, homo sapien
gacacttgattaataaagaacagtcraacccacaataacagtggattgga

SEQ ID NO: 69559 - DNA, 50 bp, homo sapien
aaatctgaaatttgagcaacacagarctttgggggtttgccaccttttta

SEQ ID NO: 69560 - DNA, 50 bp, homo sapien
actactactatataatggatgctgayatgtgtaagacattttacatctga

SEQ ID NO: 69561 - DNA, 50 bp, homo sapien
gagaaatttgatccgtatagccagaygtaagtaataccagagtggctcca

SEQ ID NO: 69562 - DNA, 50 bp, homo sapien
taaaggtttcaagcatagaaccttaragtaagctatacttagcagaagtc

SEQ ID NO: 69563 - DNA, 50 bp, homo sapien
catgaggacaggggcctgtacaagarggtttgaagaataactgacattgt

SEQ ID NO: 69564 - DNA, 50 bp, homo sapien
aggaaaaggataggaatgcaaaaacsgtctaactcatctgtggtcccact

SEQ ID NO: 69565 - DNA, 50 bp, homo sapien
aaggaaaaaagcaaagatgacctcaygtggtattaatgactaaagacatt

SEQ ID NO: 69566 - DNA, 50 bp, homo sapien
atttacaagtaaaggcccaggattcratgtctattgctctttctactagt

SEQ ID NO: 69567 - DNA, 50 bp, homo sapien
ttcccttttaatacatgcgaagtttycttaagacagacaggtataaacaa

SEQ ID NO: 69568 - DNA, 50 bp, homo sapien
tctttcccatgtaaattatctgcagkagagaaacgttaaacagaaacaaa

SEQ ID NO: 69569 - DNA, 50 bp, homo sapien
tttttatttttttgtgaatctctaartacattaagtaggattttttagtt

SEQ ID NO: 69570 - DNA, 50 bp, homo sapien
ctaattttagcttgtaccacgttaartctgacaacattcacactggcctg

SEQ ID NO: 69571 - DNA, 50 bp, homo sapien
cacacaccaactatacaagaagatayactacagaaaagcaaattaaaagg

SEQ ID NO: 69572 - DNA, 50 bp, homo sapien
attcacctgaatggattcttcacatyagctgtctctcacctccgaataaa

SEQ ID NO: 69573 - DNA, 50 bp, homo sapien
tgacaatttggtcagatgtattgtcmgaagtaggaaagggtgtgcttttc

SEQ ID NO: 69574 - DNA, 50 bp, homo sapien
gttgtctgaaaagctagcaattatcrgaagactgaatttaacatttatat

SEQ ID NO: 69575 - DNA, 50 bp, homo sapien
gaaaatgtttcaacacgaaagaaaargacagtgtatggttgtctgaaaag

SEQ ID NO: 69576 - DNA, 50 bp, homo sapien
aaggctatggaatatcctgcaatcastaaaacttgggcttaattcaacat

SEQ ID NO: 69577 - DNA, 50 bp, homo sapien
gtttgctgttactcctaaatagttaygaaaaacagaagtccttccagaga

SEQ ID NO: 69578 - DNA, 50 bp, homo sapien
aagtttgcacttggaaagatcaccayggcagaaatgcatgaatagcttag

SEQ ID NO: 69579 - DNA, 50 bp, homo sapien
cccaagtggggagagtgctatccagractgtccacttaaaaccaaccacc

SEQ ID NO: 69580 - DNA, 50 bp, homo sapien
ttaggttaattgtgtggtttacattkgtagcttaatcaaggtcatgtgtg

SEQ ID NO: 69581 - DNA, 50 bp, homo sapien
agagagagggatagctttaataagcractgatattttactaaggttaaga

SEQ ID NO: 69582 - DNA, 50 bp, homo sapien
gtaaatatttttatttatggtttgcragagacaaggctttgacattgtta

SEQ ID NO: 69583 - DNA, 50 bp, homo sapien
attagattttaaaatggttctcacastcattaaaactcctaaaccagcac

SEQ ID NO: 69584 - DNA, 50 bp, homo sapien
aacatgaaattaggtacatgacaggwaggccttataatttaccagaagac

SEQ ID NO: 69585 - DNA, 50 bp, homo sapien
ggcagattaacaaaccttcacacaartctaaattttattactaaattaat

SEQ ID NO: 69586 - DNA, 50 bp, homo sapien
aatgaaaggaggttctatccaagttsaaatctgagaaagaagtttctaga

SEQ ID NO: 69587 - DNA, 50 bp, homo sapien
gccctgggggaaaaaattactctcaygcattactggtaggaatgcaaagt

SEQ ID NO: 69588 - DNA, 50 bp, homo sapien
tcataagaaaccagtgttgttattaygaatgatggtacaaccaggtgtct

SEQ ID NO: 69589 - DNA, 50 bp, homo sapien
tactttcagagaaaagaagttgaacraagaatggagctgttaattacaaa

SEQ ID NO: 69590 - DNA, 50 bp, homo sapien
taagtcctattctttcctctttttcwacatgttaatatatgcactggaca

SEQ ID NO: 69591 - DNA, 50 bp, homo sapien
cataatattcctttaagcaaaagacrgaattaaaagactctaagatgtaa

SEQ ID NO: 69592 - DNA, 50 bp, homo sapien
taagcagacttgtactattcaacaasattatgcattcttcagcttttccc

SEQ ID NO: 69593 - DNA, 50 bp, homo sapien
aatccctcatagctttgcactcaacraaactccaaatcctaaagctactc

SEQ ID NO: 69594 - DNA, 50 bp, homo sapien
tcccagtgattctgttaataagggaygtgagatcataagtatttatttta

SEQ ID NO: 69595 - DNA, 50 bp, homo sapien
ctgattaactaactttctgagttacrcctagagtacatggaaaaaaatga

SEQ ID NO: 69596 - DNA, 50 bp, homo sapien
tgaaggagagaaaggatgagaaagarataggtttgtagaagaatacacag

SEQ ID NO: 69597 - DNA, 50 bp, homo sapien
ccagttattacactacaatatttccrcttgaccagattgaatcaatacaa

SEQ ID NO: 69598 - DNA, 50 bp, homo sapien
atcatttactttctgtatggtcttgratatctatgatgctattacatgaa

SEQ ID NO: 69599 - DNA, 50 bp, homo sapien
caaaattagaaaatcacaagtgtacrgaattaggaaattataaagtatgg

SEQ ID NO: 69600 - DNA, 50 bp, homo sapien
tgaggagtgccattatattagagtcragaaaaaaagtgggagggaggagg

SEQ ID NO: 69601 - DNA, 50 bp, homo sapien
tatagcaatcgtcatgctggcactartaaattgaaaggtacaatattaca

SEQ ID NO: 69602 - DNA, 50 bp, homo sapien
aaaacattgtggtcactcctaaaagraacctagcacccattagcagtctc

SEQ ID NO: 69603 - DNA, 50 bp, homo sapien
tctgacttaaattttccttttaccawcacagtggtgacttctgataaaaa

SEQ ID NO: 69604 - DNA, 50 bp, homo sapien
gggaaaagtctattacagaatgcaayggagtaggtgttgtataagactat

SEQ ID NO: 69605 - DNA, 50 bp, homo sapien
ttcttaggaagtaagttatacaacartgaatggttagagggagaaaattc

SEQ ID NO: 69606 - DNA, 50 bp, homo sapien
aaagggggaagatctaactacagtayatgaagatgggtagctccaagaaa

SEQ ID NO: 69607 - DNA, 50 bp, homo sapien
tttcaggcattttgagaaatttgcaygtactcaaaagtcttgttacgttc

SEQ ID NO: 69608 - DNA, 50 bp, homo sapien
ctatatgagatgttggtgatactcaygatatttccaattttttaattatt

SEQ ID NO: 69609 - DNA, 50 bp, homo sapien
agatagtgaatgggagagattcaaaytaggcactctgaatccagtggcaa

SEQ ID NO: 69610 - DNA, 50 bp, homo sapien
actcttggtccatctgatgcacttayggttaccttaagatttgaaagcat

SEQ ID NO: 69611 - DNA, 50 bp, homo sapien
catttatagctttgctctgatatccyaatacctactagtccattcctggt

SEQ ID NO: 69612 - DNA, 50 bp, homo sapien
acaaaatataccaagtcttaggagcmattttttcatcatccacgaatatt

SEQ ID NO: 69613 - DNA, 50 bp, homo sapien
gcatctgagaggacccatgtaggaamtaattcttctatataagtgaccct

SEQ ID NO: 69614 - DNA, 50 bp, homo sapien
atgtgtatactttttttagatttatsagtcccatgtccaaatccgaagaa

SEQ ID NO: 69615 - DNA, 50 bp, homo sapien
ttgggctaaatacctagataccttasatacttagggctaaagaaaatgac

SEQ ID NO: 69616 - DNA, 50 bp, homo sapien
ttctaagccatcattaaataggtccyaaataaaaactattcagtgtgcac

SEQ ID NO: 69617 - DNA, 50 bp, homo sapien
ttcaagttgatggatccccacattaygaggttattgctgttattaacagt

SEQ ID NO: 69618 - DNA, 50 bp, homo sapien
aagagaatcagacttcatagccacgwtgtacctccttccaatctgtccag

SEQ ID NO: 69619 - DNA, 50 bp, homo sapien
tcccaatatggctagaaatattcagratgcagcctcattccttagccttc

SEQ ID NO: 69620 - DNA, 50 bp, homo sapien
gggtgaaaaaaaagtcttactttacygcagactccaatgtcattttttga

SEQ ID NO: 69621 - DNA, 50 bp, homo sapien
ccacctactaacaattccttgaacamagttaaatagtttttaaaagcagc

SEQ ID NO: 69622 - DNA, 50 bp, homo sapien
aagaatagtagcattgatatcttgaracagcaatactatgtttttctctc

SEQ ID NO: 69623 - DNA, 50 bp, homo sapien
acttgcacagtatctgaaggaacaartgttttagtaccaagaggctccac

SEQ ID NO: 69624 - DNA, 50 bp, homo sapien
aacctacaaatccaatgtcattggarcttttcttctatattttcttctaa

SEQ ID NO: 69625 - DNA, 50 bp, homo sapien
tggtatacatatatacatacttatasctaaacatgtctgtatatatgcac

SEQ ID NO: 69626 - DNA, 50 bp, homo sapien
ttactttagccattgtcctcagtagkaacttttatcgcagttcctcataa

SEQ ID NO: 69627 - DNA, 50 bp, homo sapien
gctaagagatagaaggtatattccaytcacatgtattttgaagcatcttt

SEQ ID NO: 69628 - DNA, 50 bp, homo sapien
ggagagcagcaatgttagtaactaayggaaagtcaatttctgtttcattt

SEQ ID NO: 69629 - DNA, 50 bp, homo sapien
aattgttttaaatgagaatctttgayggcaacctctaattattttgacat

SEQ ID NO: 69630 - DNA, 50 bp, homo sapien
ctggctttgcccaatgtaaccttagsaaacatgatacaagcagaccctgg

SEQ ID NO: 69631 - DNA, 50 bp, homo sapien
aagcaataaaggaaaaatttgccgaytaagaaaggtctgactgttttgtg

SEQ ID NO: 69632 - DNA, 50 bp, homo sapien
agcttactgaaaggcttcgatcacayatataaaaagtgccgtcttggctg

SEQ ID NO: 69633 - DNA, 50 bp, homo sapien
ggttcagtataaggttgacagagcaytcagttattgggggtgttagatgg

SEQ ID NO: 69634 - DNA, 50 bp, homo sapien
gaaacttatgttggttatactatagmaaaattctgtcattctaaaagtaa

SEQ ID NO: 69635 - DNA, 50 bp, homo sapien
actgtgcttctctcaaaactttaaamtattctacagagcccccgtgattt

SEQ ID NO: 69636 - DNA, 50 bp, homo sapien
tgtctctggttcctcatcagtaaagyggattcacctgtttgctattggac

SEQ ID NO: 69637 - DNA, 50 bp, homo sapien
ggaaaaatgggaaactagttcaggcmattttagtcttccaaaggccttta

SEQ ID NO: 69638 - DNA, 50 bp, homo sapien
tatactccgttaaaggaatctattaycttacttgagaatttataatagaa

SEQ ID NO: 69639 - DNA, 50 bp, homo sapien
acacaaaattctaccaatttggccartaaaggctccataacatgcaacac

SEQ ID NO: 69640 - DNA, 50 bp, homo sapien
gagagacagagactctgacaatcggrtctccatgaacacatgtttttttt

SEQ ID NO: 69641 - DNA, 50 bp, homo sapien
gaaaagtgacaggacactagagaagraatatggaaagacatttctgaagt

SEQ ID NO: 69642 - DNA, 50 bp, homo sapien
atcgattatcatcacttcaatcttasactttggtaaagtaaacaaccatt

SEQ ID NO: 69643 - DNA, 50 bp, homo sapien
tccaaaactttcttttacatatacaycacttcccaaattacactttttgt

SEQ ID NO: 69644 - DNA, 50 bp, homo sapien
gtttaaagagcaatctttgtaataamtaagctcatgatgtttgggatcag

SEQ ID NO: 69645 - DNA, 50 bp, homo sapien
agtctcaagcttttctaagtttaaasagcaatctttgtaataactaagct

SEQ ID NO: 69646 - DNA, 50 bp, homo sapien
tgattttaaaataattggttttgtcmattaatatcactcaagaattgtat

SEQ ID NO: 69647 - DNA, 50 bp, homo sapien
gacatgagaaccacatacagattatyagatgttgaacttcaacttgcaca

SEQ ID NO: 69648 - DNA, 50 bp, homo sapien
gcaaagagactggtatagccatttaygaatgaacatcttcactattgtga

SEQ ID NO: 69649 - DNA, 50 bp, homo sapien
cagtgaattatatccaatgactccastgattttttccatgtagatagaca

SEQ ID NO: 69650 - DNA, 50 bp, homo sapien
agctgcaccaactgcaggatttttasgttttgaatttatatcctcaacct

SEQ ID NO: 69651 - DNA, 50 bp, homo sapien
aagaaacttgcctaagtttataccasaagtaaatggatggctaaagactt

SEQ ID NO: 69652 - DNA, 50 bp, homo sapien
ttatttcttggtatttgagatactaygttgacatattttggcaagtgaat

SEQ ID NO: 69653 - DNA, 50 bp, homo sapien
taccctgcacctggctcagagcttgycaggtagtgagtgcctggttatta

SEQ ID NO: 69654 - DNA, 50 bp, homo sapien
gattgagtctgcccagggtcagatargaatgcttctcagaagagtaaata

SEQ ID NO: 69655 - DNA, 50 bp, homo sapien
ttttaaagttttcattcacatggaaycttcaactataaatttacattttt

SEQ ID NO: 69656 - DNA, 50 bp, homo sapien
atgtatcattttattacgctgctaaraaaacctgtaatttaaggactttt

SEQ ID NO: 69657 - DNA, 50 bp, homo sapien
tcacaagttcccgtgagtgactaacrgcaggatataaaatttctgccatt

SEQ ID NO: 69658 - DNA, 50 bp, homo sapien
acattagttcagtctaaatttattarcaagacccagaaaatcttatagca

SEQ ID NO: 69659 - DNA, 50 bp, homo sapien
tctcatgatagtcagtgagttctcamgaggtctactggttctgcaagtgt

SEQ ID NO: 69660 - DNA, 50 bp, homo sapien
gttaagtgcaactcagggatttctargtagattattcacaaattggagtg

SEQ ID NO: 69661 - DNA, 50 bp, homo sapien
aatgatgaaatgagttaagtctttasgctactgttgggaaggaatgattg

SEQ ID NO: 69662 - DNA, 50 bp, homo sapien
cctgttgtaagtcacttatgtagaasagttaaactatcaaaatgtagacg

SEQ ID NO: 69663 - DNA, 50 bp, homo sapien
aacataaaaagggaagtccgaagggmaatccaacatgcagtccctggagg

SEQ ID NO: 69664 - DNA, 50 bp, homo sapien
atggcatttgatatggtttccaagcygacccaagctctatttagctctgc

SEQ ID NO: 69665 - DNA, 50 bp, homo sapien
ttgcatatttttcgcttaatatgaaygatttcctgatgataacctggaga

SEQ ID NO: 69666 - DNA, 50 bp, homo sapien
ctgaatctttttgaatactaccaaaygctccaaattctttcacagagcct

SEQ ID NO: 69667 - DNA, 50 bp, homo sapien
gttgcctcatactctctcctcacagraaaaggcagattgaggctgctggg

SEQ ID NO: 69668 - DNA, 50 bp, homo sapien
aacatcatctaatttcacattcttamaggaaatttgtgtgtgaagggaga

SEQ ID NO: 69669 - DNA, 50 bp, homo sapien
aacaaacaaaaaacctcgaacattgytatggtctcttccagctgacaaga

SEQ ID NO: 69670 - DNA, 50 bp, homo sapien
cttcttgacctctagtcccttgattsaaaatttaactctgatttaaggga

SEQ ID NO: 69671 - DNA, 50 bp, homo sapien
ctctagtaaaaatactgttacttaawagctctgtaaccttgagaaaaaca

SEQ ID NO: 69672 - DNA, 50 bp, homo sapien
ccgtgtgtgacacaacaaagtttgarcagagattacctctctagagcagt

SEQ ID NO: 69673 - DNA, 50 bp, homo sapien
ccaaattctctagaacataaaacctraggcaaagattacttgctaagtct

SEQ ID NO: 69674 - DNA, 50 bp, homo sapien
tgtaaaatgtcacataatgtaccaastgaaatgagaaaacaataaaaatg

SEQ ID NO: 69675 - DNA, 50 bp, homo sapien
attactgcccaaacttgcgtttttamatctttctctcataattttaacct

SEQ ID NO: 69676 - DNA, 50 bp, homo sapien
tgaatacttttaggacactgctggaygattaagtcctagctcttattatt

SEQ ID NO: 69677 - DNA, 50 bp, homo sapien
cagtgtcaggaggcatgctaattgtrtgggatcacttaccctgaaatatg

SEQ ID NO: 69678 - DNA, 50 bp, homo sapien
tgagggaaagtcaagtgttagaacartagctgtaaaaggcaagagtatga

SEQ ID NO: 69679 - DNA, 50 bp, homo sapien
accatcaagctgagtcctgttgagcrtagcagagatgaagccagttcaca

SEQ ID NO: 69680 - DNA, 50 bp, homo sapien
ggtgttgttttcatgtctgctaatayattcttcagcccaaagaacaagga

SEQ ID NO: 69681 - DNA, 50 bp, homo sapien
actccagattccagggcttagtttakgtcatgaggtcacatttatttcat

SEQ ID NO: 69682 - DNA, 50 bp, homo sapien
gctctgaaggtaataagaaaaagtaygatgttatttagtgtattgttaaa

SEQ ID NO: 69683 - DNA, 50 bp, homo sapien
attcctgtttcacaagtttgctatargtattgaatacgataaggaaaatg

SEQ ID NO: 69684 - DNA, 50 bp, homo sapien
taattcactgatggcattagaaagaytattgaggcaaacaactaacaaaa

SEQ ID NO: 69685 - DNA, 50 bp, homo sapien
tccaaaattaataaaatagagtaaasctattgctcccttcttaaaataca

SEQ ID NO: 69686 - DNA, 50 bp, homo sapien
actaatgttattttcattatgatgcycttcacttttactattttatccac

SEQ ID NO: 69687 - DNA, 50 bp, homo sapien
ctctgtgatatcttggaaaaagcagrattaagagtcagaagacttaatct

SEQ ID NO: 69688 - DNA, 50 bp, homo sapien
ataggtttctgaatctgaaagggtcrcaacaattctctgaaagccacgga

SEQ ID NO: 69689 - DNA, 50 bp, homo sapien
gattttttaaaaagtcttgcaggtaytacattttccccctcttctaggtg

SEQ ID NO: 69690 - DNA, 50 bp, homo sapien
cctgtctatactcctcagttatcatsagtcttggcaagaagctctgaaga

SEQ ID NO: 69691 - DNA, 50 bp, homo sapien
gtggatgatgaggatggggagatgaygagtttaattttggcttggttaaa

SEQ ID NO: 69692 - DNA, 50 bp, homo sapien
tatattccctgaaattcttggtaaaytctaaatggttcagttcctgaaat

SEQ ID NO: 69693 - DNA, 50 bp, homo sapien
ttcttgccattttcaccagatggacyctatcgtaacaatcaattttttag

SEQ ID NO: 69694 - DNA, 50 bp, homo sapien
caagatttccagcctgcaaagcttcrcctctagggaatctatggccttct

SEQ ID NO: 69695 - DNA, 50 bp, homo sapien
actgtaatacaaaagcatgcctaggracactagcacctaactcaatatgc

SEQ ID NO: 69696 - DNA, 50 bp, homo sapien
gtgagttttcaatttatgaagccaayaggttaaggccattttcagcagtt

SEQ ID NO: 69697 - DNA, 50 bp, homo sapien
agatgaagggagaacttgtacattaraagagacttaagaaacgtaacaac

SEQ ID NO: 69698 - DNA, 50 bp, homo sapien
gagttagggtggtcaaactctaaaargattcacattgaaatagtcatctt

SEQ ID NO: 69699 - DNA, 50 bp, homo sapien
tgttttgtttcccagtgggagcagcraagtactatgtggtcactttagtg

SEQ ID NO: 69700 - DNA, 50 bp, homo sapien
tcaactctgaatcataggttcttccrtttctgttatgaaagaggttaata

SEQ ID NO: 69701 - DNA, 50 bp, homo sapien
ggattaatgggtagggaagtgccttraagttggactagagtatttgactg

SEQ ID NO: 69702 - DNA, 50 bp, homo sapien
ttattttttaatgttggttgtgatcyactaaatttattttcacagtccac

SEQ ID NO: 69703 - DNA, 50 bp, homo sapien
actgaaatggcataaaatgcaattcragttttaagaagaaataattatgg

SEQ ID NO: 69704 - DNA, 50 bp, homo sapien
ccctcctggatgtgttatccatatcratgtactggctgttaaaattcatg

SEQ ID NO: 69705 - DNA, 50 bp, homo sapien
taagacagtatttgcaacataacagkctcttcgtaaatacatttgggcag

SEQ ID NO: 69706 - DNA, 50 bp, homo sapien
accccagctccaaagaaaaagaaaaytttgcctcaggaagtgtggaagtc

SEQ ID NO: 69707 - DNA, 50 bp, homo sapien
ggaaatcctcaccagcttgtgagtayaaataaaatcacagagacacgatt

SEQ ID NO: 69708 - DNA, 50 bp, homo sapien
ctaccaatttctctccccaacattcrcctaactacatattttgactgttg

SEQ ID NO: 69709 - DNA, 50 bp, homo sapien
tgtatttcttcagagacaatctggarcatatcttttttgtcaaatgtgag

SEQ ID NO: 69710 - DNA, 50 bp, homo sapien
taaatatttgtttcctttttatccaygtcacgtatatgtaacaggatatg

SEQ ID NO: 69711 - DNA, 50 bp, homo sapien
acattttctgaattgcagtctaataytcaaaatttcccatgatatctaag

SEQ ID NO: 69712 - DNA, 50 bp, homo sapien
ataatccccttgacaaaatattaaamagcagtatctccccctgaccattg

SEQ ID NO: 69713 - DNA, 50 bp, homo sapien
ataactgcattttatagatgaggacractttacttggaagactttgtaaa

SEQ ID NO: 69714 - DNA, 50 bp, homo sapien
ttatttggtgttgttgcaaaaaaaaytccaaattcagaggcttaaaataa

SEQ ID NO: 69715 - DNA, 50 bp, homo sapien
tctgaagaaacttgtcctctctctawgtcaaaatttctttcaggctgtta

SEQ ID NO: 69716 - DNA, 50 bp, homo sapien
actttgaaacccatttgtttcaaagmataactgtaaaaatatgtgtatga

SEQ ID NO: 69717 - DNA, 50 bp, homo sapien
caggctagtggatgtccccttttacraattctcatagcacatgaatcttt

SEQ ID NO: 69718 - DNA, 50 bp, homo sapien
gttttctggaggctggttagcaaagratttagatttagattcaaattata

SEQ ID NO: 69719 - DNA, 50 bp, homo sapien
ccagttattctggcacacattgaaawctcaagacatcaagagaaacaaac

SEQ ID NO: 69720 - DNA, 50 bp, homo sapien
ttttaggctcatatattaccttgcasatttcccaaaaatttcagaaattg

SEQ ID NO: 69721 - DNA, 50 bp, homo sapien
aagaaaaaaatggatgattaaaaacrcactagaattaaaaatttcttttc

SEQ ID NO: 69722 - DNA, 50 bp, homo sapien
taaagtgacattacaactgacaccayaggaattgaaaggaccattagttg

SEQ ID NO: 69723 - DNA, 50 bp, homo sapien
caacatttggagggtctctctcaaakgcagttttcctggaatatttctta

SEQ ID NO: 69724 - DNA, 50 bp, homo sapien
caaactaagtagaccagtcatattaytaaggcaattatttaatatatata

SEQ ID NO: 69725 - DNA, 50 bp, homo sapien
tagtatagagtaatttgctgcttgaygcaataaatacaatgttaaaaatt

SEQ ID NO: 69726 - DNA, 50 bp, homo sapien
atctagaaacaatggctacagttcarggagactctaaaataaaaggaaac

SEQ ID NO: 69727 - DNA, 50 bp, homo sapien
tacgtgtatgacaacttacacataaytataggtaccttaaagacgtctta

SEQ ID NO: 69728 - DNA, 50 bp, homo sapien
tgacccattatattaacaaacaccaygtccttgtgctgaagttatggaag

SEQ ID NO: 69729 - DNA, 50 bp, homo sapien
ccctctcttatgaagtttgtaagtayatcagacccactgagatgattcag

SEQ ID NO: 69730 - DNA, 50 bp, homo sapien
gaagagattgaaggaaacagggcttyctttatggacaccttttctgtatg

SEQ ID NO: 69731 - DNA, 50 bp, homo sapien
agaccccatttctataaacataagtraagttaagctaaaaaatgcctggc

SEQ ID NO: 69732 - DNA, 50 bp, homo sapien
actgtcctttcccagaatgtattagragagcaaatgtacccaaatatatt

SEQ ID NO: 69733 - DNA, 50 bp, homo sapien
agatcctaatatagtctatacactawaactttttattaatcattttatcc

SEQ ID NO: 69734 - DNA, 50 bp, homo sapien
ttaatagaagtttttaagctgacaayagatggatacatcaccatactcta

SEQ ID NO: 69735 - DNA, 50 bp, homo sapien
cactgatttcaagctaccgacgtgcrtcaaccagccttaaaaattcctga

SEQ ID NO: 69736 - DNA, 50 bp, homo sapien
acagtctaacttagaagccatattcmaattcagccatttataccactaat

SEQ ID NO: 69737 - DNA, 50 bp, homo sapien
cacctagcaaggatagatttataccratatgccacctacatagtccaggt

SEQ ID NO: 69738 - DNA, 50 bp, homo sapien
ctccttgtagcaaggctttaaatacrattattcagtactctcaatgtccc

SEQ ID NO: 69739 - DNA, 50 bp, homo sapien
tgtttaggaaattcattaaaatcagyctacctaaaattgaatttatgatc

SEQ ID NO: 69740 - DNA, 50 bp, homo sapien
agttctagaagcaacatttgtagaaraatcataaaacgagggtagatatt

SEQ ID NO: 69741 - DNA, 50 bp, homo sapien
agtaaagcattttaggagagatgaamggccccatgagacagaaattagct

SEQ ID NO: 69742 - DNA, 50 bp, homo sapien
tctaggaattgtctctgactaaataygagtaatgtgcacactggcccttc

SEQ ID NO: 69743 - DNA, 50 bp, homo sapien
gcagctgcccaattataataacctcraggcaaagaagttggtcaggagtg

SEQ ID NO: 69744 - DNA, 50 bp, homo sapien
gcttttaagatttgagtttaaaataktactgattgaaaaaataaattttt

SEQ ID NO: 69745 - DNA, 50 bp, homo sapien
ctcttttccatggtgtaaattctgcyaccatcactgatttcaagctaccg

SEQ ID NO: 69746 - DNA, 50 bp, homo sapien
ccctctggatctcttaattagcctaygtttcttaaataaaaatttatttt

SEQ ID NO: 69747 - DNA, 50 bp, homo sapien
ggcacattacaaaattcacaaaataraggacatattacccaaccaattct

SEQ ID NO: 69748 - DNA, 50 bp, homo sapien
tttccacttttccccttctctatcargaaaaatgctacttaacattttcc

SEQ ID NO: 69749 - DNA, 50 bp, homo sapien
ggaaaaatgaaagtaaaccaagcaastgtgcatcagagaaactcaggaag

SEQ ID NO: 69750 - DNA, 50 bp, homo sapien
tcacttactaagtgtctactatgtawcagataattacaataagataaatt

SEQ ID NO: 69751 - DNA, 50 bp, homo sapien
ggtttttcatttattctatgattatkccaacattcacttactaagtgtct

SEQ ID NO: 69752 - DNA, 50 bp, homo sapien
ggtttatagagttatactcagttacygacagatctaaaatgaacttcttc

SEQ ID NO: 69753 - DNA, 50 bp, homo sapien
agagagggcggcaaataattgggaamaataaaaccatctgccacaagaac

SEQ ID NO: 69754 - DNA, 50 bp, homo sapien
gagagtgattactatgtttaattgcraagtcttacaaaaatttcaaacca

SEQ ID NO: 69755 - DNA, 50 bp, homo sapien
actgttcttagatgattttgtttacwcctatgacattaacttgtgaatat

SEQ ID NO: 69756 - DNA, 50 bp, homo sapien
tttcttaacaaatctttttcccgttsaatctatcttatgagttgtattta

SEQ ID NO: 69757 - DNA, 50 bp, homo sapien
catttttgaacactatattatctttrtgcagtatcccttcagaaagtctt

SEQ ID NO: 69758 - DNA, 50 bp, homo sapien
tgtgtgtgtgtgtgcctgtctgtctsagaaaagggatatactattcttta

SEQ ID NO: 69759 - DNA, 50 bp, homo sapien
aatgagtagtgtgctaagaaataaarattaatgttactcttgttttagat

SEQ ID NO: 69760 - DNA, 50 bp, homo sapien
tttctctagaggaagctgttgcccaytgcattaatacatgtgacatattg

SEQ ID NO: 69761 - DNA, 50 bp, homo sapien
gaagccatatacgacacctatggacrcacctcttacttaatgtgatggag

SEQ ID NO: 69762 - DNA, 50 bp, homo sapien
ctggaacacagaggcacctaacctayaccaggaaaagtgatgttgacttt

SEQ ID NO: 69763 - DNA, 50 bp, homo sapien
ttttcatgcattattgattatcaaakaaagcctgtgaatggatattatta

SEQ ID NO: 69764 - DNA, 50 bp, homo sapien
tcctcattatgttattaatcccatckagctaatatttcttttatcttttg

SEQ ID NO: 69765 - DNA, 50 bp, homo sapien
ttatactttcctcacaaaatgctgaygctaatgtaaagcacagaagttga

SEQ ID NO: 69766 - DNA, 50 bp, homo sapien
tcaggctgtaattttgtacctttcawtttcaacaaatatcttcctattcc

SEQ ID NO: 69767 - DNA, 50 bp, homo sapien
aatttactattactaccaagactacyaagattataactatacacagagat

SEQ ID NO: 69768 - DNA, 50 bp, homo sapien
tatatatggcagaataaatggttackaagtttgagaatatgtgaatttta

SEQ ID NO: 69769 - DNA, 50 bp, homo sapien
actacacctatcattttcaatgtaayctaattttgatgataaatcatatg

SEQ ID NO: 69770 - DNA, 50 bp, homo sapien
tgggaagagtaagaaaggagaccccraaagaaggaataacagagtaaaga

SEQ ID NO: 69771 - DNA, 50 bp, homo sapien
ttaatgtcaaataaaggctgacaacygagtaaaataaacttatagcaagt

SEQ ID NO: 69772 - DNA, 50 bp, homo sapien
tttctttctctttttttgtggtcttyagtaagttgtatgttgtaagtact

SEQ ID NO: 69773 - DNA, 50 bp, homo sapien
aaggagagtaataagacaaaaattgraatgacaataataaataaaagtgg

SEQ ID NO: 69774 - DNA, 50 bp, homo sapien
attagaaaaacaaaagagaggcctaygaaaaggttccaaaccaaagcctt

SEQ ID NO: 69775 - DNA, 50 bp, homo sapien
tatataatataaattcaggcatcatsaagtatttatgtgtggtctttata

SEQ ID NO: 69776 - DNA, 50 bp, homo sapien
tagtcttccctggagttttgcaagayctaaagttaattagagtctcttag

SEQ ID NO: 69777 - DNA, 50 bp, homo sapien
agcatatacaaaggaaagtataagaygtgaagctttgcaggttagagttc

SEQ ID NO: 69778 - DNA, 50 bp, homo sapien
catataatgtttcttttttgtcatasaagatacttcaaaggatggcaaac

SEQ ID NO: 69779 - DNA, 50 bp, homo sapien
acataagtcatactgaattaagggcycattctactccagtaagactttgt

SEQ ID NO: 69780 - DNA, 50 bp, homo sapien
ttactaggcagccaagttcatcaaakattattatgttttcccctgaatct

SEQ ID NO: 69781 - DNA, 50 bp, homo sapien
tatgcatgtaactactaaaaaatagsatcaatagtttatttaataagcat

SEQ ID NO: 69782 - DNA, 50 bp, homo sapien
tataaaatattagtctggcattacamacttgatgattattaactaatatt

SEQ ID NO: 69783 - DNA, 50 bp, homo sapien
accgactctctttgataaccagacartgaggctcagatattacacaaaga

SEQ ID NO: 69784 - DNA, 50 bp, homo sapien
ttgtggcataggagatggaaagaaargaatgatttcaaagtaagtggaga

SEQ ID NO: 69785 - DNA, 50 bp, homo sapien
catggacacttaaactctacctattwttgataaactctctcagaaaactg

SEQ ID NO: 69786 - DNA, 50 bp, homo sapien
acacacacactcctgcagtatttaasccaaatgtcataattcaaagacag

SEQ ID NO: 69787 - DNA, 50 bp, homo sapien
aatatttatggattattatgccatarcagagagtaaatgcttgggtaagg

SEQ ID NO: 69788 - DNA, 50 bp, homo sapien
aataagataatcagatcacagccaakagtcaaatatttcataaatgccaa

SEQ ID NO: 69789 - DNA, 50 bp, homo sapien
gcaaggttacatgcagattgggaaaytgaacgtttgtttacatttaccta

SEQ ID NO: 69790 - DNA, 50 bp, homo sapien
agaaaacttataatgtataattcccrgccaaagtaaagtatgatgtaatt

SEQ ID NO: 69791 - DNA, 50 bp, homo sapien
aacctgtcttcgaaagagccctctayataacctttaaaagagatgcatgt

SEQ ID NO: 69792 - DNA, 50 bp, homo sapien
aaaaatcaatgaaactacgtatcagscatttcttagtaataagccacatt

SEQ ID NO: 69793 - DNA, 50 bp, homo sapien
agagatgccccagagcattcaagaaragtcaggaaattaaggaactgaat

SEQ ID NO: 69794 - DNA, 50 bp, homo sapien
ttctacatgtacttatgttggcatasagaaaattctgtttttttctaaaa

SEQ ID NO: 69795 - DNA, 50 bp, homo sapien
cattaactttgttggtaggtctggaktcaactgtagatgttaagctgcct

SEQ ID NO: 69796 - DNA, 50 bp, homo sapien
ccttgtgaacacctgagtgaggcaaytgatgatcacagtgtctatgccaa

SEQ ID NO: 69797 - DNA, 50 bp, homo sapien
attaaaattaatttgaaattcgaaartgacttgggtattagatacaactg

SEQ ID NO: 69798 - DNA, 50 bp, homo sapien
ctagtagattcaatcttgtgtgttayataatattttctgatttttaactt

SEQ ID NO: 69799 - DNA, 50 bp, homo sapien
aacacatcatttactcaagactttcrctcctaggaatctatccaaaaaat

SEQ ID NO: 69800 - DNA, 50 bp, homo sapien
aggttggttaataatacaatttcaaytccttctttcataaggttacttta

SEQ ID NO: 69801 - DNA, 50 bp, homo sapien
tgttttcgttgagcttattgctgtayattgtggtcttcagttatatatat

SEQ ID NO: 69802 - DNA, 50 bp, homo sapien
gagaggagaaaaatacatgagagacragaatacctctataagagaaggaa

SEQ ID NO: 69803 - DNA, 50 bp, homo sapien
gtaggaattaaataatctgaattagmaaaacaaaaacatacacataatct

SEQ ID NO: 69804 - DNA, 50 bp, homo sapien
tgaatttagaaattaattgataaggratgattgacatatgagatggctct

SEQ ID NO: 69805 - DNA, 50 bp, homo sapien
taactgtgtatctgaaaagaattagkaccctctctaacttaatcacagtt

SEQ ID NO: 69806 - DNA, 50 bp, homo sapien
tatgtacatctattttgtatcaatgraaataaaaagcaaaacacttcagg

SEQ ID NO: 69807 - DNA, 50 bp, homo sapien
ctagtaacgtgctgaaactaaccagwcatatggcttaaatagatgtgtca

SEQ ID NO: 69808 - DNA, 50 bp, homo sapien
gggcttctgaaacggaatttccaacrgtaatgatgggattcaagacacac

SEQ ID NO: 69809 - DNA, 50 bp, homo sapien
tctatggccagctcatgcacaatacygacttataaaaagcaatgatgaaa

SEQ ID NO: 69810 - DNA, 50 bp, homo sapien
agtaaaatcagtagagattaataaasagctagaaactacaatgaagtaaa

SEQ ID NO: 69811 - DNA, 50 bp, homo sapien
caaagttgaaaaactgacactacctractttcatacttactatgtacata

SEQ ID NO: 69812 - DNA, 50 bp, homo sapien
agtttatatagatgcaaaagactcasagcaatcaatacaatattgaaata

SEQ ID NO: 69813 - DNA, 50 bp, homo sapien
ttattctcacaaaacgaggtgcaatkataagttaacatctaggtttcagt

SEQ ID NO: 69814 - DNA, 50 bp, homo sapien
gccttacggggttgttgtgggagatyaaattcgttagcacactacaaact

SEQ ID NO: 69815 - DNA, 50 bp, homo sapien
ctatataaagggctaagtgaatatgractaaaagcagcttacaaataggg

SEQ ID NO: 69816 - DNA, 50 bp, homo sapien
atcaaactcacagccaatatcataawcattccaacaaaagctggaaacat

SEQ ID NO: 69817 - DNA, 50 bp, homo sapien
tgtgataatggtatctgtctaataakgttgctatagaaatgaaatgacta

SEQ ID NO: 69818 - DNA, 50 bp, homo sapien
agaaagtaaatgttgctggaacacasagaccatcatgctgggccttatga

SEQ ID NO: 69819 - DNA, 50 bp, homo sapien
atcaaacactatgtataatttcaaaytgtagcattaataggagatacttc

SEQ ID NO: 69820 - DNA, 50 bp, homo sapien
ggacacaaaaatatgggtatttcaarttaagcagtgaaaagatcacagag

SEQ ID NO: 69821 - DNA, 50 bp, homo sapien
aaataatatattaatctaagacttcrgaaagaaacaaacccacaaataat

SEQ ID NO: 69822 - DNA, 50 bp, homo sapien
tttagtaatcctacatgagagattcygacagtttcttgccactgtatgca

SEQ ID NO: 69823 - DNA, 50 bp, homo sapien
tataataccagctgatgtcacatgawgaatagagaataaaataattagta

SEQ ID NO: 69824 - DNA, 50 bp, homo sapien
tccaattacggactgagatggttaaratactgactctattccttgtaact

SEQ ID NO: 69825 - DNA, 50 bp, homo sapien
aagacttaggcttatataattagtaragatgatttgatagacatatacaa

SEQ ID NO: 69826 - DNA, 50 bp, homo sapien
ctaaatttattctatatgtcagataygtaggacaaaaatatctatggatt

SEQ ID NO: 69827 - DNA, 50 bp, homo sapien
ccagcacagttcgccacagacttgamtaactccaaaatctacccttgaat

SEQ ID NO: 69828 - DNA, 50 bp, homo sapien
tgtccctttcttatgttgtatcaggyatgtaagagcagagggtatacagt

SEQ ID NO: 69829 - DNA, 50 bp, homo sapien
cattttgtatgttcagtatatataartaatcccacaaatttagactgtat

SEQ ID NO: 69830 - DNA, 50 bp, homo sapien
aacactgtgtaagtttgcgctattayagttattttaaactgtttttatat

SEQ ID NO: 69831 - DNA, 50 bp, homo sapien
cctacatgacacctctgcttgctaayacttgtgggtgatcattgctttgg

SEQ ID NO: 69832 - DNA, 50 bp, homo sapien
acctgctgattgaggacagagattakactaaggttaccatagggcagagg

SEQ ID NO: 69833 - DNA, 50 bp, homo sapien
accattcctcaaacagtcttaacccrcaaatgcttatgtctttgccagta

SEQ ID NO: 69834 - DNA, 50 bp, homo sapien
aggagtttgtgtggctcttacaaaartcctcaatttcagaacattttcta

SEQ ID NO: 69835 - DNA, 50 bp, homo sapien
cattatagtcttaatatgcaactctytaatggctaataatgttgaaaaca

SEQ ID NO: 69836 - DNA, 50 bp, homo sapien
gcagaaatggatcctattctagcaasaccctcaatgaataagagaagctg

SEQ ID NO: 69837 - DNA, 50 bp, homo sapien
gagagagagagagtatacaaatatgraaataaatagaagaaactgctgaa

SEQ ID NO: 69838 - DNA, 50 bp, homo sapien
cagatccctatcttggtctgtgtatragattgctgaaggaaatgccctca

SEQ ID NO: 69839 - DNA, 50 bp, homo sapien
cccagagatacagagctcgtaagtgytcaaattcagattggaacacaaaa

SEQ ID NO: 69840 - DNA, 50 bp, homo sapien
atttgaagaacaaatatggaagaaamatttaaagatactgagggaataaa

SEQ ID NO: 69841 - DNA, 50 bp, homo sapien
ttataagcctcaatgcctgcaactgmataagaaagtggtaaccatctcat

SEQ ID NO: 69842 - DNA, 50 bp, homo sapien
ggtgaccttcaatagagatgcatcaragaaagtgaggtctggagacgggg

SEQ ID NO: 69843 - DNA, 50 bp, homo sapien
acatggataaacctggagaacataawcctaagtgaaaaagaaaaaaaaaa

SEQ ID NO: 69844 - DNA, 50 bp, homo sapien
gcatcaatttatatttctactaacartatgtgagagttcatacttctcca

SEQ ID NO: 69845 - DNA, 50 bp, homo sapien
caagccctggatttgaggtaaattayatatggcatttgaaatgctaaaat

SEQ ID NO: 69846 - DNA, 50 bp, homo sapien
taatttgttatgctacaataggtaaytaatacacaaagaaatatatgcct

SEQ ID NO: 69847 - DNA, 50 bp, homo sapien
ttctctttgtaacttaacaacttcaraataaatactggatatctaactaa

SEQ ID NO: 69848 - DNA, 50 bp, homo sapien
gtggcaggaatggctgaggaactatyagttagatatccagtatttatttt

SEQ ID NO: 69849 - DNA, 50 bp, homo sapien
ttctcttttcactgatgaaaacaacsctttgcttgcggatgggcagagaa

SEQ ID NO: 69850 - DNA, 50 bp, homo sapien
actgtatgttatcaatttaatccaaygacaggcaatgatatttgaggaaa

SEQ ID NO: 69851 - DNA, 50 bp, homo sapien
gctcgctgaaggcctgagaggcaaaygtcaagtgtgtgaactctaatgcc

SEQ ID NO: 69852 - DNA, 50 bp, homo sapien
ctgtgtatatgtgattaatcagattraaatgaaagtgcagacagctcacg

SEQ ID NO: 69853 - DNA, 50 bp, homo sapien
atctgtaagagagaatgttcctgacmaaaatcagccagaagcccctctcc

SEQ ID NO: 69854 - DNA, 50 bp, homo sapien
caagcctgtgataaagctctctcacyctaaaactaataaatactcttagt

SEQ ID NO: 69855 - DNA, 50 bp, homo sapien
gctaaaactagaaataataaaggaartaactccaaatatgagaaaaataa

SEQ ID NO: 69856 - DNA, 50 bp, homo sapien
ctttgtctttcctctgctcgccttgyaaatcttcaacatctaatcaaatc

SEQ ID NO: 69857 - DNA, 50 bp, homo sapien
tgtccttggtaagagccgacactgcrgactgtaatgtttcccctacagag

SEQ ID NO: 69858 - DNA, 50 bp, homo sapien
cacacaaagcccaactcttgaaatargaaagtggtatagaaattgacttg

SEQ ID NO: 69859 - DNA, 50 bp, homo sapien
ggtctttcatcttctctgctcctcamaacaataagcttgttcatgcattt

SEQ ID NO: 69860 - DNA, 50 bp, homo sapien
tgttttgtatattctgagagctgaaraaatggaggtagagaaggaaaaaa

SEQ ID NO: 69861 - DNA, 50 bp, homo sapien
caattttcttacggtcctgagacaasttacctaccacctcaagaatctcc

SEQ ID NO: 69862 - DNA, 50 bp, homo sapien
tgaatgtttctttgtgattaaatgtraacaattgctcctttaaggtaaag

SEQ ID NO: 69863 - DNA, 50 bp, homo sapien
tacctaccacctcaagaatctccacsaacagttaaacggcacagtgtcga

SEQ ID NO: 69864 - DNA, 50 bp, homo sapien
ttcttaacttagtacttttaattacwctaataaggaagtttcaggacacg

SEQ ID NO: 69865 - DNA, 50 bp, homo sapien
ctgatcagaatacactgctttcaacyaaaacattattagcattgatttct

SEQ ID NO: 69866 - DNA, 50 bp, homo sapien
acaggcatgcactaccatgcttggtwaatttttgtacttttagtagagac

SEQ ID NO: 69867 - DNA, 50 bp, homo sapien
ctccgtaaatcatgcttgcttgtacygaaatgcttgtattagggaacaga

SEQ ID NO: 69868 - DNA, 50 bp, homo sapien
atgtgaaggttcgatagcatttcccwattttggttgggaaataaacatat

SEQ ID NO: 69869 - DNA, 50 bp, homo sapien
tacaataaggcactaaatgtaacaasgttaaaaatcagcaatatagaagc

SEQ ID NO: 69870 - DNA, 50 bp, homo sapien
gtcacctaccataccttgaaaggcakaccacataccaaacaagttgtaga

SEQ ID NO: 69871 - DNA, 50 bp, homo sapien
agacttcatttctacattattaaacwccagataatgatgaggcaatctct

SEQ ID NO: 69872 - DNA, 50 bp, homo sapien
caaaaaaaaattgttttcaaccatcygaaccataaattatacttccaatt

SEQ ID NO: 69873 - DNA, 50 bp, homo sapien
atagaattcctctctcagatcctaaygtgggaaaacaggtgattatttat

SEQ ID NO: 69874 - DNA, 50 bp, homo sapien
ttaagcatcaaatctctaactgtgawtaactcttctaaaacatgtggtat

SEQ ID NO: 69875 - DNA, 50 bp, homo sapien
atggcctttataaataatcccactaygtatcttctttttcagtctgtgag

SEQ ID NO: 69876 - DNA, 50 bp, homo sapien
tacagtccttgccccatatggtgaawgagaatcaacagaaaataaggcat

SEQ ID NO: 69877 - DNA, 50 bp, homo sapien
gggaacctcaatagattccaacagcrattcctttagagcagacacagtaa

SEQ ID NO: 69878 - DNA, 50 bp, homo sapien
cactctataaaacatgcagtaattaygataaacactaaaataaacttctt

SEQ ID NO: 69879 - DNA, 50 bp, homo sapien
gccatcttactaaggtaatcagaatragaaaaaactgaaaattgatgtca

SEQ ID NO: 69880 - DNA, 50 bp, homo sapien
aaaaggggcttatttctaataacaaygaagattaaccattacacaaggca

SEQ ID NO: 69881 - DNA, 50 bp, homo sapien
tgttttcctttaacctgatacttgcygacaattcaccagagaggtgagcc

SEQ ID NO: 69882 - DNA, 50 bp, homo sapien
tatagtcattttagttcaaagtctgmaattaaaactgcaaagtaatttcc

SEQ ID NO: 69883 - DNA, 50 bp, homo sapien
atccagctgttgtccatttccagaaraggagtgaatagtggcttaacaga

SEQ ID NO: 69884 - DNA, 50 bp, homo sapien
agccagattctggatataccttgaargtggagtcaaaaagatttgaaagg

SEQ ID NO: 69885 - DNA, 50 bp, homo sapien
gctggcaacgtcttccatcttttcayaagcagaacacaggcatcgcagat

SEQ ID NO: 69886 - DNA, 50 bp, homo sapien
ttctccccttttttcaagccctgcakatctttttcctggttgtctaatta

SEQ ID NO: 69887 - DNA, 50 bp, homo sapien
ccacataaatccaagtgcacaagagycaaagtgaaaagaaatgaaaatga

SEQ ID NO: 69888 - DNA, 50 bp, homo sapien
cctcaaggggtttcctctctgaaaaygtccatggataatttaagaagcta

SEQ ID NO: 69889 - DNA, 50 bp, homo sapien
ttactttccttacaggaaacaaatayatcggaaggtgctttaaacatttt

SEQ ID NO: 69890 - DNA, 50 bp, homo sapien
ttaagaagctattccaaaggcactartagcctcaacagtttgaaataggt

SEQ ID NO: 69891 - DNA, 50 bp, homo sapien
tctagaaatgaaagctgaaatgccartgactcctgagaaaggggtccacc

SEQ ID NO: 69892 - DNA, 50 bp, homo sapien
tttgtccacatggtcattatttgacygtacatgtgtgggtttatttctgg

SEQ ID NO: 69893 - DNA, 50 bp, homo sapien
cacagaatcccaaatgcaaagttcayggaagaccgagtgtttgcctcgct

SEQ ID NO: 69894 - DNA, 50 bp, homo sapien
ttacatgaatatattcattttgaaaraaagtgtatatgcaagttgcacat

SEQ ID NO: 69895 - DNA, 50 bp, homo sapien
catgtagttcctagagaggatgaagktagccttgttgagctaggtgaaga

SEQ ID NO: 69896 - DNA, 50 bp, homo sapien
tactccacgacccaggctcattctayctaactacatagccagcttttctg

SEQ ID NO: 69897 - DNA, 50 bp, homo sapien
caaacctagaaagggtaccaatgatyctatatttgtgtgagtgaatggtt

SEQ ID NO: 69898 - DNA, 50 bp, homo sapien
aagattcccaatattatcaggtccarctaaaactttaccagtttgcaaat

SEQ ID NO: 69899 - DNA, 50 bp, homo sapien
aggactgaataactctaccagagaamttaaacaccagtaaggtcaaaact

SEQ ID NO: 69900 - DNA, 50 bp, homo sapien
gggaaaaattattttgatacgatctraagtgtaaattgcgtgcatttcag

SEQ ID NO: 69901 - DNA, 50 bp, homo sapien
ataacagaggtcctaaaatcttagaragagctacaagttggatgctaacc

SEQ ID NO: 69902 - DNA, 50 bp, homo sapien
atgcaattgacctgaattatttcaamaactgcattttccttccatttcac

SEQ ID NO: 69903 - DNA, 50 bp, homo sapien
tatgggtcaaaaccagtgtctcatayttcttacctttcccattctctctt

SEQ ID NO: 69904 - DNA, 50 bp, homo sapien
tgccctcatgaaagtatactttctcratttccatgcctttgctctctgaa

SEQ ID NO: 69905 - DNA, 50 bp, homo sapien
tggtggacagggctagaaaacagcargattgtgacctgtttgtgttaatg

SEQ ID NO: 69906 - DNA, 50 bp, homo sapien
agttagctattgtcttcatcacctayagctccgtggagctattcattgta

SEQ ID NO: 69907 - DNA, 50 bp, homo sapien
tgtcttctagttcaaagatttttaayggttgtcaggaagtcttcttcagt

SEQ ID NO: 69908 - DNA, 50 bp, homo sapien
gattctaacgagtggccagggttgaractattgcattaagaggataaaaa

SEQ ID NO: 69909 - DNA, 50 bp, homo sapien
tgaaaaatttgaaaaatcccttatarcatcttaaaatacttatattcaca

SEQ ID NO: 69910 - DNA, 50 bp, homo sapien
ggcaagtccaaggttctgtatgaaaygcccctgctctgtgcagcctctcc

SEQ ID NO: 69911 - DNA, 50 bp, homo sapien
tttccaacctacagggctataagagmataaattcatgttgtaagccacta

SEQ ID NO: 69912 - DNA, 50 bp, homo sapien
aaacttagggaaagtcttaaccttayagtaggcaccagaagtacaattat

SEQ ID NO: 69913 - DNA, 50 bp, homo sapien
tacattttgtataaactggactataygaatgcattttgaaatatgttttt

SEQ ID NO: 69914 - DNA, 50 bp, homo sapien
atggtgtatgttaacatcttttcacraatcaattactatcacatggtggc

SEQ ID NO: 69915 - DNA, 50 bp, homo sapien
agatctgccatttacaggtaactackaatttcagatcagttattcaaacc

SEQ ID NO: 69916 - DNA, 50 bp, homo sapien
ctggcagacatcagcttaataaaacrattgcactttgcctcaccaataat

SEQ ID NO: 69917 - DNA, 50 bp, homo sapien
gaacatgtttgattttgttgatggartatctcagactcactcagcttacg

SEQ ID NO: 69918 - DNA, 50 bp, homo sapien
tctacctaactgttcacattgaccaycaaattgtgacttcctgaaaggat

SEQ ID NO: 69919 - DNA, 50 bp, homo sapien
cttactcatttttgtgtctccaataygcagcacactgtatttaataaata

SEQ ID NO: 69920 - DNA, 50 bp, homo sapien
cagaacacaaagacttgaaaaactakgcaagatggtaaagatactataga

SEQ ID NO: 69921 - DNA, 50 bp, homo sapien
tgaaaggcaatcaaaaattacaccayagaagttccaaccatgctaggttt

SEQ ID NO: 69922 - DNA, 50 bp, homo sapien
tagcttacagcatattggtaggcaaygggtatttctacaatgcttcagag

SEQ ID NO: 69923 - DNA, 50 bp, homo sapien
aagtcttaattatatcattttgaaaytcaggtgcatagtaatggttatac

SEQ ID NO: 69924 - DNA, 50 bp, homo sapien
gggggcacataacaaatgtccactawaggattccagtgtgttcccacagt

SEQ ID NO: 69925 - DNA, 50 bp, homo sapien
gaaaaggcaagtgtagaagggagagraaaattctgtaacacttttttttc

SEQ ID NO: 69926 - DNA, 50 bp, homo sapien
attttcaagctcaatcatggctgccraaggccctgacattttgctgcctg

SEQ ID NO: 69927 - DNA, 50 bp, homo sapien
acctttgaaccatgagatatcttgcyaaatgtttcaactgtatgtaaatg

SEQ ID NO: 69928 - DNA, 50 bp, homo sapien
tgaagtaatactggagatcaaattaygcaaatatgctgcatgactaaatt

SEQ ID NO: 69929 - DNA, 50 bp, homo sapien
atcactaagtttgttgttgtctcaaratttcagaatttgtattttttata

SEQ ID NO: 69930 - DNA, 50 bp, homo sapien
ataaggcaacctacatgttccattgytttttcttagagaagatttcaggt

SEQ ID NO: 69931 - DNA, 50 bp, homo sapien
gacatcagtgcaatggagaaagacartgaaggtctaaggatgttttatct

SEQ ID NO: 69932 - DNA, 50 bp, homo sapien
ttaaatgagattggtgaatatcaaastgtttccccactgtaagaggctgt

SEQ ID NO: 69933 - DNA, 50 bp, homo sapien
ggaaactttgtgagaagaagaaaatkgagtccttgctggctggatgcaac

SEQ ID NO: 69934 - DNA, 50 bp, homo sapien
gcaatgggtctgattgggtagtcaaygcactttgttaaattagtcaatgg

SEQ ID NO: 69935 - DNA, 50 bp, homo sapien
tctcttttctctgcctgattcaagayataccatgactttcaagggcccct

SEQ ID NO: 69936 - DNA, 50 bp, homo sapien
acttagagccacagactgaattaacrcactaaggaagaggcggaggttgc

SEQ ID NO: 69937 - DNA, 50 bp, homo sapien
gagaaagagtaagaaatatctcatgygtagtatgtaaatcagagtagagc

SEQ ID NO: 69938 - DNA, 50 bp, homo sapien
tgtttgaaaatgttgtaagatgctamgtcattcatatatatgttgttgaa

SEQ ID NO: 69939 - DNA, 50 bp, homo sapien
atttttttctatctaaacgtggtgaygatgaatacataaacatcagattt

SEQ ID NO: 69940 - DNA, 50 bp, homo sapien
gagggaggtgtgctggtgtgttaagyaggtagttcatgtggatctatttc

SEQ ID NO: 69941 - DNA, 50 bp, homo sapien
gctgctaatacgaagtagccagggayatttgtctttctatcactggtgcc

SEQ ID NO: 69942 - DNA, 50 bp, homo sapien
agaaccttagtaatataggatagtargaaataaagcatttaaaaaaggaa

SEQ ID NO: 69943 - DNA, 50 bp, homo sapien
gaaggcaaaaatagagaccacaggtyataagaaaaagttatgcacagtca

SEQ ID NO: 69944 - DNA, 50 bp, homo sapien
gttacctagaggctgagaagtcccaygtggcgaaatctccacaaacacat

SEQ ID NO: 69945 - DNA, 50 bp, homo sapien
ttccaagctttactccaatgaatggyaattttcaaactattccttggagc

SEQ ID NO: 69946 - DNA, 50 bp, homo sapien
aaacagtacctacctcatagaactcygaggattaaagggtttaatatata

SEQ ID NO: 69947 - DNA, 50 bp, homo sapien
aacagcctactaatgggtttccatgyaccaataaaattccttcaatctat

SEQ ID NO: 69948 - DNA, 50 bp, homo sapien
aaagggtgatgatcaattctcttaayagtaaagtagatatccaggtgcag

SEQ ID NO: 69949 - DNA, 50 bp, homo sapien
atctgtcaatgtctcttttcaaggcmctatgaatgggacatagattccag

SEQ ID NO: 69950 - DNA, 50 bp, homo sapien
ataattcatcacccacatcctccaarctattcatagtcttcaggatatat

SEQ ID NO: 69951 - DNA, 50 bp, homo sapien
attggggatagaaggagatagactcracaggcttaccacctggatgtgag

SEQ ID NO: 69952 - DNA, 50 bp, homo sapien
cacataagtaggtgattctgtggacyacttagcaaaatctgctaacccag

SEQ ID NO: 69953 - DNA, 50 bp, homo sapien
aatataaatagaatataacctaaacrcattgaaaattagtaaacacatac

SEQ ID NO: 69954 - DNA, 50 bp, homo sapien
taacaaatgctacataaacttggagraaggacaagactatcagagataca

SEQ ID NO: 69955 - DNA, 50 bp, homo sapien
tatattgccagaaaatgttttaatcyatatttattggcttgaaaacatgt

SEQ ID NO: 69956 - DNA, 50 bp, homo sapien
ggttaatttattgcattttcttaatragacgatacatgccttcacacttt

SEQ ID NO: 69957 - DNA, 50 bp, homo sapien
aacaggactcacctgtgcttcaccayatcttgacaacattattattttac

SEQ ID NO: 69958 - DNA, 50 bp, homo sapien
gataaacaagttgcatatagtaacamgcaagttctgtgttagaggagagt

SEQ ID NO: 69959 - DNA, 50 bp, homo sapien
gaatgtgaacattttgaaacttgccrggatgacagtgaaaaaagcaataa

SEQ ID NO: 69960 - DNA, 50 bp, homo sapien
ttggatgacattgaactgaacactcrctgccatgctataaggcaaaaact

SEQ ID NO: 69961 - DNA, 50 bp, homo sapien
aaacccaaagtgctcaatagctataygttggatgacattgaactgaacac

SEQ ID NO: 69962 - DNA, 50 bp, homo sapien
ttctcaagaggattttggtagcatgraactcaaatgttatcttggtccat

SEQ ID NO: 69963 - DNA, 50 bp, homo sapien
atcaatattctctatttatccttcamctcatgccattcctttcctccttt

SEQ ID NO: 69964 - DNA, 50 bp, homo sapien
cagttttgtactgatctttggttaartaaacattttcacatgacctagaa

SEQ ID NO: 69965 - DNA, 50 bp, homo sapien
aatatgattagttacagtagttgaargcaagaaccaaatccgggctgtct

SEQ ID NO: 69966 - DNA, 50 bp, homo sapien
aatttgaactattagatgaactgtcragaatgtaattatttctctctccc

SEQ ID NO: 69967 - DNA, 50 bp, homo sapien
attgccaaccagagttcttggtatgycagttaatgccccaggagtgttga

SEQ ID NO: 69968 - DNA, 50 bp, homo sapien
ccagctgccgcctgtgtggcaaataytactacagttacatagctagtagc

SEQ ID NO: 69969 - DNA, 50 bp, homo sapien
ctccctgcacaagctcaaagttgccraagaataggtctgcgtttgtttca

SEQ ID NO: 69970 - DNA, 50 bp, homo sapien
ataaataattggataaaagacaatgmaaaagaacttcagactggaaggca

SEQ ID NO: 69971 - DNA, 50 bp, homo sapien
caacaatgatgcaaagcgaactcaarggaagaggcttccctgggaagctg

SEQ ID NO: 69972 - DNA, 50 bp, homo sapien
cttcctcctgctagctactaggaaaygttatcttccaagacagcttggtt

SEQ ID NO: 69973 - DNA, 50 bp, homo sapien
ggagaaatatttattaagtgtctgckatcttctgggcacattctttgagc

SEQ ID NO: 69974 - DNA, 50 bp, homo sapien
aagctcctcaactggaaaatactcaygtgaaagtttaaaggaaaagcaca

SEQ ID NO: 69975 - DNA, 50 bp, homo sapien
gatgtcacccccactctcccttcaaygatactgctataaagacaagctgg

SEQ ID NO: 69976 - DNA, 50 bp, homo sapien
ctccgaaaacatgaagtccaaagtgktggccattacctacaagtcccttt

SEQ ID NO: 69977 - DNA, 50 bp, homo sapien
aggctgtagggactttccgtcactcygaaaacatgaagtccaaagtggtg

SEQ ID NO: 69978 - DNA, 50 bp, homo sapien
tacatagaaacactgttagaaaacawctttcaaatagctttctactgaag

SEQ ID NO: 69979 - DNA, 50 bp, homo sapien
ggaagtgtggcctcggtgcaaatatracaatagatttcagagcacagcta

SEQ ID NO: 69980 - DNA, 50 bp, homo sapien
attactgttttcttgatttctgttayggtgcaatccattcatttttctat

SEQ ID NO: 69981 - DNA, 50 bp, homo sapien
gagcgagatgccaatttctttgacaygctatctttcagactgggccattg

SEQ ID NO: 69982 - DNA, 50 bp, homo sapien
tttgtcatacttcactgtattcacayacttcttttggatgactttgaaat

SEQ ID NO: 69983 - DNA, 50 bp, homo sapien
agtaaatcatatacaaataagaaagractttgagatggtgaaatcacaca

SEQ ID NO: 69984 - DNA, 50 bp, homo sapien
gtccagacaagaagggcatacgttgyggcaaggatggaggtcatggaatg

SEQ ID NO: 69985 - DNA, 50 bp, homo sapien
gggaccaccatagcataggcagtccrtcattgaccaaaacatcgttatgt

SEQ ID NO: 69986 - DNA, 50 bp, homo sapien
tgtctataagtcaatctctacctctyacttttaatttgctgggaggaatc

SEQ ID NO: 69987 - DNA, 50 bp, homo sapien
tgtgtttcctgatagaagcatttctrcattaaacatgaggacttccaagg

SEQ ID NO: 69988 - DNA, 50 bp, homo sapien
gtatttcccctatttccatagctacrcagataggtaagataggaaagttg

SEQ ID NO: 69989 - DNA, 50 bp, homo sapien
ctcatcgctatggctctatgttggayaattttactttaatcatactgcct

SEQ ID NO: 69990 - DNA, 50 bp, homo sapien
tccactctcatctcctactactcccrtcttgctcactctgcttcagccag

SEQ ID NO: 69991 - DNA, 50 bp, homo sapien
aagaagaaagacctcacacatttatyaagaattcatgagctctttgacct

SEQ ID NO: 69992 - DNA, 50 bp, homo sapien
atacatgttaattcatttgatctaamtctcagaaccaggtacatataccc

SEQ ID NO: 69993 - DNA, 50 bp, homo sapien
catttatgtaataatgtagtttatcrcacgatcatattaaagaagaaaaa

SEQ ID NO: 69994 - DNA, 50 bp, homo sapien
catagctcgtttatatcaataatgcrgattaaaatatttgctaatgaact

SEQ ID NO: 69995 - DNA, 50 bp, homo sapien
ctacaggtctaacatagagtcgctgracaatgtttgagtttagaacataa

SEQ ID NO: 69996 - DNA, 50 bp, homo sapien
ctcttagaaaataaaaaatggaagayaatttcctaaatgtgataaagggc

SEQ ID NO: 69997 - DNA, 50 bp, homo sapien
aatgtactttctaccagcaatgtaartatgatttatgtgactcctcccag

SEQ ID NO: 69998 - DNA, 50 bp, homo sapien
ccaacttttctgccttgtgagagacwatttctttttagttatatgaaatg

SEQ ID NO: 69999 - DNA, 50 bp, homo sapien
ctgggaatgcttcctgccccctgtakagaaaagactagcaagaaacttgg

SEQ ID NO: 70000 - DNA, 50 bp, homo sapien
gcagcgaggaagatgggagcgtcaasgttggtcaacacacagtggtgaaa

SEQ ID NO: 70001 - DNA, 50 bp, homo sapien
aacattctgttgcttttttttggtawctgctatgaggtatgaaacatatc

SEQ ID NO: 70002 - DNA, 50 bp, homo sapien
tttttcttaactgcttttaaaaatgyatctctttacctttggttttaagc

SEQ ID NO: 70003 - DNA, 50 bp, homo sapien
ctcaaaagctttctttgtaaagtcarcgcatctgtggactccttgttgtc

SEQ ID NO: 70004 - DNA, 50 bp, homo sapien
tctggttggcatgtctgtttagcaarttagagcctggaattataataatg

SEQ ID NO: 70005 - DNA, 50 bp, homo sapien
ttaaaagggtgatttggagtaaaaaygaatagtacagacctcaaaaaccg

SEQ ID NO: 70006 - DNA, 50 bp, homo sapien
ggcagagtctcaataacatttatagycaataaccagggaaaaggaagggt

SEQ ID NO: 70007 - DNA, 50 bp, homo sapien
caatgtataggagcaagtgtatgaarttctgaaggaagggctttctaggt

SEQ ID NO: 70008 - DNA, 50 bp, homo sapien
ctcctgttttgaaaggagggacttayctttgtggtcatgtatttgacacc

SEQ ID NO: 70009 - DNA, 50 bp, homo sapien
catgcagccagaaaggaagataagckaaattatgagcagacttaaaactc

SEQ ID NO: 70010 - DNA, 50 bp, homo sapien
taaaattacatttaataatatgtcaratgttagatcttatgattttgttc

SEQ ID NO: 70011 - DNA, 50 bp, homo sapien
tgatgggacctaaaagtttactctgraaatgtacgttaaagcccataaat

SEQ ID NO: 70012 - DNA, 50 bp, homo sapien
tgttttatggaaaatatctgattackaattcatagaacagaacattatga

SEQ ID NO: 70013 - DNA, 50 bp, homo sapien
gcccttaggaacaaagtttagtatgyaatgagtgacgagctctataatat

SEQ ID NO: 70014 - DNA, 50 bp, homo sapien
cataagtatggaaattttaatttcaygtgtgtacctgagagcatgtggcc

SEQ ID NO: 70015 - DNA, 50 bp, homo sapien
gaacaaattactggaatttaagcaaygtgaaatctcatcactttagcaat

SEQ ID NO: 70016 - DNA, 50 bp, homo sapien
attgaaaataaagaagttgtatgaaygaatgccatcatattttttcctcc

SEQ ID NO: 70017 - DNA, 50 bp, homo sapien
ggtttcaaactgtttcctaacctctraggcatttcagaagctcctcacct

SEQ ID NO: 70018 - DNA, 50 bp, homo sapien
gaaaaatgtgtgttctctaataatayacagagtggaaaaaaccactgaat

SEQ ID NO: 70019 - DNA, 50 bp, homo sapien
  misc_feature (4)..(4): n is a, c, g, or t
tcanaacaccctgtgaggcaggaagrccagatttccttaccttgcttgag

SEQ ID NO: 70020 - DNA, 50 bp, homo sapien
tgtgaacagcgtcctctaagacctcrcttaaaatatcctcacctctttga

SEQ ID NO: 70021 - DNA, 50 bp, homo sapien
aaggctatatgtgaacataactgtgyaagttggtagaatatttaagaact

SEQ ID NO: 70022 - DNA, 50 bp, homo sapien
ttaggtcagccagaaccacgtttccracatgcagatctaatcatgttgtc

SEQ ID NO: 70023 - DNA, 50 bp, homo sapien
tcatgaagttgtgaggatccagtgamatacttaaggtacctaggagggct

SEQ ID NO: 70024 - DNA, 50 bp, homo sapien
aaaacacagtgtctcattaaactttkgtcagttatgtcctatatgtgcgc

SEQ ID NO: 70025 - DNA, 50 bp, homo sapien
ccaccactatttgctacattaaatcrcttctcaatttactaattctataa

SEQ ID NO: 70026 - DNA, 50 bp, homo sapien
agtggtcttcctagcatctaacagamaataagaggttcacaccaaagcca

SEQ ID NO: 70027 - DNA, 50 bp, homo sapien
aaagttggcaagaaatgcaagatttrtgagtcatgaaaatgttaattttg

SEQ ID NO: 70028 - DNA, 50 bp, homo sapien
ttgttctgtatgcatatttgcctggrtttggccttatccaatgaaataca

SEQ ID NO: 70029 - DNA, 50 bp, homo sapien
atacagttttgagagttgtcacccartggcagttgaaattaggagggcta

SEQ ID NO: 70030 - DNA, 50 bp, homo sapien
tctgagatgacgtgagtggcatgcayaacatatttagaagggcacctcct

SEQ ID NO: 70031 - DNA, 50 bp, homo sapien
ctatctttcgtttgaattctgccaaytagtttgagaaaatttttgttaca

SEQ ID NO: 70032 - DNA, 50 bp, homo sapien
tgcttgattgtagctctttttccaarcgttctgcccgtaaattagctgat

SEQ ID NO: 70033 - DNA, 50 bp, homo sapien
atgggtaaaaatagactcaatgaagrttcagagggctgccacattaaata

SEQ ID NO: 70034 - DNA, 50 bp, homo sapien
gtccaaacatttttagtacatgatcragaagactaactagacagcttgag

SEQ ID NO: 70035 - DNA, 50 bp, homo sapien
tggtgaaataacggggcaggtaaatraactccaagaatgttaaggtattt

SEQ ID NO: 70036 - DNA, 50 bp, homo sapien
taaatgaatggatggtaggaatctasgaaaatggatataattaccccatt

SEQ ID NO: 70037 - DNA, 50 bp, homo sapien
ttttctgcttctatgctgtgagctarggcataagaaaaaagtctagagaa

SEQ ID NO: 70038 - DNA, 50 bp, homo sapien
taatctcctctcatgtggtaagttaygatagaattatttaaaaaattgct

SEQ ID NO: 70039 - DNA, 50 bp, homo sapien
catgtgcctccaacttaccagagagwcataccaccaccagtttctgttat

SEQ ID NO: 70040 - DNA, 50 bp, homo sapien
atcttaacatttcttgcttttctctraacatcatttcacatttacctaac

SEQ ID NO: 70041 - DNA, 50 bp, homo sapien
agaaaacctttattatgggtattgaycttagaaagtaattgcctcaaggg

SEQ ID NO: 70042 - DNA, 50 bp, homo sapien
tcatcgctaatgccattttaagaatsaagggcaatgatacttaagcaggg

SEQ ID NO: 70043 - DNA, 50 bp, homo sapien
cgacgtctacgttttgcactccacawtgtaaactattaaaaaccccagcc

SEQ ID NO: 70044 - DNA, 50 bp, homo sapien
gtgaagattggaaaagatacaaggawtaaaaagtctcagaaatggtaatg

SEQ ID NO: 70045 - DNA, 50 bp, homo sapien
tgtgcgttttgtaagttaatggatamgaatgactgaagttagtaaaacat

SEQ ID NO: 70046 - DNA, 50 bp, homo sapien
aatgtggtaggcaaaattccagaatkgttccctaagatattcctaattcc

SEQ ID NO: 70047 - DNA, 50 bp, homo sapien
acaatgctcaagctctatatcatcaraaggtttaatagaagaaagaaacc

SEQ ID NO: 70048 - DNA, 50 bp, homo sapien
gcatatacttggccacaaattccacrttaattcttagatctgtagcagtg

SEQ ID NO: 70049 - DNA, 50 bp, homo sapien
aaagtgacatccagatttatgcaaaygttatgactgcaaagtgcatttca

SEQ ID NO: 70050 - DNA, 50 bp, homo sapien
ctttcatttatttatttgcttgcttrggattttcatattgatgtttataa

SEQ ID NO: 70051 - DNA, 50 bp, homo sapien
gtaatcctgattatctgtgcaaaggrataatgtttcccataatacattgc

SEQ ID NO: 70052 - DNA, 50 bp, homo sapien
cgtttttagtcttttaaggaagagayaaagccgtggtctacattttcatc

SEQ ID NO: 70053 - DNA, 50 bp, homo sapien
taaatttctgctgttcctagcaggaragcatcatactccttcagtttttg

SEQ ID NO: 70054 - DNA, 50 bp, homo sapien
agactaccatttcagttggctgtaayagactagtgaaattaaaaattgtt

SEQ ID NO: 70055 - DNA, 50 bp, homo sapien
atagtaaaatgcaagaggcaagagayaacctgaaggaatgactgataaac

SEQ ID NO: 70056 - DNA, 50 bp, homo sapien
taaataatatgtatagtctattcagktatctaaacaaggggatttcctgg

SEQ ID NO: 70057 - DNA, 50 bp, homo sapien
agcaggttggcaatctgcaacagagmaaattccaaggctcctctccaagg

SEQ ID NO: 70058 - DNA, 50 bp, homo sapien
accttactaagtcacaagatgctctsaaaagcttgataacaccatgggat

SEQ ID NO: 70059 - DNA, 50 bp, homo sapien
cagacactcaactccaattttctgayagtaaccattgtaaaaaaatattg

SEQ ID NO: 70060 - DNA, 50 bp, homo sapien
gctggaagtatcagggaagacctcamaaagattccaggctttatggagtg

SEQ ID NO: 70061 - DNA, 50 bp, homo sapien
tggcttataactgtgtaagccttcakacattgagtccaatcagtacttgc

SEQ ID NO: 70062 - DNA, 50 bp, homo sapien
aagcaaagatgtgcaacatttaaatwacctgagaaaatcctttaaatgct

SEQ ID NO: 70063 - DNA, 50 bp, homo sapien
attaaaatatcaaggaacttacccayggatatacacctagtgagtggcag

SEQ ID NO: 70064 - DNA, 50 bp, homo sapien
taagacttctcaccacctaattaatragaaataactgaacactaatatga

SEQ ID NO: 70065 - DNA, 50 bp, homo sapien
aaaaataatcctctgttgaaataacygaaaaaatggtctccctgggcccc

SEQ ID NO: 70066 - DNA, 50 bp, homo sapien
gagaaatgtgctagagcagttcttascattttctgtagcatcttcctaga

SEQ ID NO: 70067 - DNA, 50 bp, homo sapien
ccacctagataataataattcctaartccctatgcctagctgagaccata

SEQ ID NO: 70068 - DNA, 50 bp, homo sapien
caagttcagtaaaaatgtcagcaaayagaggagttacagtaatcaaagaa

SEQ ID NO: 70069 - DNA, 50 bp, homo sapien
tctagatgctaaaatacagttatcaratatggaattaaaaaaagctatgt

SEQ ID NO: 70070 - DNA, 50 bp, homo sapien
ccatgggtgaccatcgttctctttckcaaaagtaaatctgcctgtgtccc

SEQ ID NO: 70071 - DNA, 50 bp, homo sapien
gctggctccttaaatatatagacaaygtaggatttcaacccattcttaga

SEQ ID NO: 70072 - DNA, 50 bp, homo sapien
taggctagaggcaagattccagggaygaggaaaagacttaagagagccct

SEQ ID NO: 70073 - DNA, 50 bp, homo sapien
cctaaaagataaatattttaaggatragcaatcacaaggcaagcaaagca

SEQ ID NO: 70074 - DNA, 50 bp, homo sapien
gcaccttagataaatctgtccttatraaggtagctcaagacaccatgtag

SEQ ID NO: 70075 - DNA, 50 bp, homo sapien
aaattgctttcttttcttggataccrggatataacattggatcttgggag

SEQ ID NO: 70076 - DNA, 50 bp, homo sapien
agcaggaatggtggtaccaataataraagtgataatcaccaatatcatca

SEQ ID NO: 70077 - DNA, 50 bp, homo sapien
ggaagccagaattaggattgtcagarctgagaaagcagaagcaatgcatg

SEQ ID NO: 70078 - DNA, 50 bp, homo sapien
acctaacatttaattttgtactctaytggctgttctgtgtatattatatc

SEQ ID NO: 70079 - DNA, 50 bp, homo sapien
aattgtagaggtatataccatgggcrgaaagaaagcagtgtcgaatcctg

SEQ ID NO: 70080 - DNA, 50 bp, homo sapien
agggttcatctggcattcctttagckccctaccttgctggcttccttcca

SEQ ID NO: 70081 - DNA, 50 bp, homo sapien
tgggagataaggtatgagattgctasgagtatctaagtgcatgagtagtt

SEQ ID NO: 70082 - DNA, 50 bp, homo sapien
gcctgatattacagtaagtcgatagwaaagtactcaaaataatttgactt

SEQ ID NO: 70083 - DNA, 50 bp, homo sapien
acaaagccctctgccatttccatcarctattactggacatgaatgtgccc

SEQ ID NO: 70084 - DNA, 50 bp, homo sapien
ttactttttgaaactgtacaagaaayattgatgtcatagacaatatctca

SEQ ID NO: 70085 - DNA, 50 bp, homo sapien
ggcactcattagttcaagagcaaacrgtttcctatgcttcctgccttggg

SEQ ID NO: 70086 - DNA, 50 bp, homo sapien
tcagcactggatgtgtagcaaaaaawttaggaacttctctggtctatatc

SEQ ID NO: 70087 - DNA, 50 bp, homo sapien
attagtataattatttaatgaataayggtctccctgcagtagatggtaaa

SEQ ID NO: 70088 - DNA, 50 bp, homo sapien
aaggatatccacagtaatactattcmtaacaaccctcaactggaaacagc

SEQ ID NO: 70089 - DNA, 50 bp, homo sapien
agtacaatctggaatcaaatcctgtygttgtaggtaaaattttattggag

SEQ ID NO: 70090 - DNA, 50 bp, homo sapien
tcctggatcctagggacctgagttgraatcccagttctgctatcttcttg

SEQ ID NO: 70091 - DNA, 50 bp, homo sapien
aactctttattttgtctgtatattamatcttagcaaacaaagcccacctt

SEQ ID NO: 70092 - DNA, 50 bp, homo sapien
tatccatacatcctctttacattccygcttttagatgtcttctgtgttgc

SEQ ID NO: 70093 - DNA, 50 bp, homo sapien
tgggaaaaaagtaaacatctctcacrctggactggcattgcaaaaatcca

SEQ ID NO: 70094 - DNA, 50 bp, homo sapien
gtcaccctttacaaaacagtttgcakattcctgatctaaaagatagttgt

SEQ ID NO: 70095 - DNA, 50 bp, homo sapien
tacaatcagtgtgtttgtgattctaygcactgtgatcttgaggaattatc

SEQ ID NO: 70096 - DNA, 50 bp, homo sapien
cagtagcctattttatttttgtcaarctgaaattagccatgtccatcagt

SEQ ID NO: 70097 - DNA, 50 bp, homo sapien
actgaatgtctctacttagatagaamattcaaactcaacaggccccaaat

SEQ ID NO: 70098 - DNA, 50 bp, homo sapien
ttctgggccactggttgagggctcawtctgtatcagtttcctcttctgcc

SEQ ID NO: 70099 - DNA, 50 bp, homo sapien
tgctgtactgataaatcaggtatccraaggacagatagaagaatgtggta

SEQ ID NO: 70100 - DNA, 50 bp, homo sapien
agatgtttactttttgtcttcattayctttgtagtgttttaaggatctct

SEQ ID NO: 70101 - DNA, 50 bp, homo sapien
acagatattgactacctcttctctgwgcttagaattgcatttaagtggca

SEQ ID NO: 70102 - DNA, 50 bp, homo sapien
atgggagaaaaataagaaggagtccrattatagttgatgccaagggctac

SEQ ID NO: 70103 - DNA, 50 bp, homo sapien
aatggactgccctcagataagagtgmattagtccagggccgtgctgaggg

SEQ ID NO: 70104 - DNA, 50 bp, homo sapien
cattggaaatatgatataacaccaastcttcttcaactgtatcatataga

SEQ ID NO: 70105 - DNA, 50 bp, homo sapien
ggtcaaccatcgtacatagcacataraagatttgactgggaccacatagt

SEQ ID NO: 70106 - DNA, 50 bp, homo sapien
gacatcaggagaagctgaggagagcsacttcctatgttcattgctgactg

SEQ ID NO: 70107 - DNA, 50 bp, homo sapien
atgtcaatctaattaggtaatttaaytgactgcaatacagactaataaga

SEQ ID NO: 70108 - DNA, 50 bp, homo sapien
gattctgtttaaaagaaatgccaacygtcttagtcaaatttagaaagaag

SEQ ID NO: 70109 - DNA, 50 bp, homo sapien
caatgatgatgagcttttcttcatawgattgttggccgcatagatgtctt

SEQ ID NO: 70110 - DNA, 50 bp, homo sapien
tgaccttaaagactatgaccttaaaracaatgtccagttagattgtcctt

SEQ ID NO: 70111 - DNA, 50 bp, homo sapien
cacccctgtggcacattccaaggacrgtcagcttcgttctagggctgccc

SEQ ID NO: 70112 - DNA, 50 bp, homo sapien
gaaatcacctgattcatgcagggaaracaatgtgagacttcacccaatta

SEQ ID NO: 70113 - DNA, 50 bp, homo sapien
cggcctggaggaatagaaagatgaaytggacagggaggctctttcaaagg

SEQ ID NO: 70114 - DNA, 50 bp, homo sapien
ctgaagcttatggtctatttgagaaygatgaggtattcaccgcctgccaa

SEQ ID NO: 70115 - DNA, 50 bp, homo sapien
tgcttttgtggtgtaataatcgtcckcaacctcaggtccttttacttatt

SEQ ID NO: 70116 - DNA, 50 bp, homo sapien
ccctggtaagataggtatttgttgastaaatggacaaatggggatggttt

SEQ ID NO: 70117 - DNA, 50 bp, homo sapien
tatttttctaagtgaagactaaggaragaaacaatacaaattaccccttc

SEQ ID NO: 70118 - DNA, 50 bp, homo sapien
tgtattttaatgtgaatcagacatayaggttcaatccattttggtattca

SEQ ID NO: 70119 - DNA, 50 bp, homo sapien
aaatcaagtattttactggattactraagacactaaataggtgttaaagg

SEQ ID NO: 70120 - DNA, 50 bp, homo sapien
ttttgatgggagtacagacttccccsattttcttgatgagttctctccgt

SEQ ID NO: 70121 - DNA, 50 bp, homo sapien
actgcaaattctcacattattactayacatgacggagagaactcatcaag

SEQ ID NO: 70122 - DNA, 50 bp, homo sapien
ttttggaacaagattttgcaagataygggaaaggaaaaaaaggagcatgg

SEQ ID NO: 70123 - DNA, 50 bp, homo sapien
atgatgtacttgtgtaaattttgcaygcctttgcttcattgttcttccac

SEQ ID NO: 70124 - DNA, 50 bp, homo sapien
acacccaacaaataagaacgcgacarcaaagtgtgctcaggacacctctg

SEQ ID NO: 70125 - DNA, 50 bp, homo sapien
tgtttcaggatagccaaattggatargtagtaaggacaagtgttttttta

SEQ ID NO: 70126 - DNA, 50 bp, homo sapien
gacaacacaaattattcaggagataytaaagtgcattgttcaccatcgta

SEQ ID NO: 70127 - DNA, 50 bp, homo sapien
tatttctttatagcattttgtacaasttacagttatgaaactgccattat

SEQ ID NO: 70128 - DNA, 50 bp, homo sapien
aacttgggagtccaacgtttgagaasaggaagcctccagcacgggagaaa

SEQ ID NO: 70129 - DNA, 50 bp, homo sapien
gcacccacctctatcacagatttacmacactgtattataacaatccattc

SEQ ID NO: 70130 - DNA, 50 bp, homo sapien
tgcaatgcaaaccagccgagaagcgsagcatgaccaagatcaacaatcac

SEQ ID NO: 70131 - DNA, 50 bp, homo sapien
ctagttccagttccagttcagttgcyctttgtcaatctcaaagagccctt

SEQ ID NO: 70132 - DNA, 50 bp, homo sapien
gatgaaaatgtcccatatctgatccyaaggtgtttacaccttggcaggag

SEQ ID NO: 70133 - DNA, 50 bp, homo sapien
ctccgccagcacttcctctgcatcaytcttaaccctttgccagccgaccc

SEQ ID NO: 70134 - DNA, 50 bp, homo sapien
tttttttaactctttcttctcttcartcggattatagagttggagcaaat

SEQ ID NO: 70135 - DNA, 50 bp, homo sapien
tcacactgatattaattaattgaacrgaatggaaaacacttagagtagag

SEQ ID NO: 70136 - DNA, 50 bp, homo sapien
ccataaacactattgaactcaactayctgattcagagcaggcttcagcac

SEQ ID NO: 70137 - DNA, 50 bp, homo sapien
acaaaactgcatattcactataaatwaaccacataaagacagaagatgag

SEQ ID NO: 70138 - DNA, 50 bp, homo sapien
ttgtgggattggcctctttaagttargtggtattacctggactgtgggac

SEQ ID NO: 70139 - DNA, 50 bp, homo sapien
cacccttccccttgagtttgggcagkacttgtttattgttataggaccta

SEQ ID NO: 70140 - DNA, 50 bp, homo sapien
tctattgtaagatggtcagctcagartggaaaacgcatttggaaaaatgt

SEQ ID NO: 70141 - DNA, 50 bp, homo sapien
cataggctttcccttgcttgcaacaktaagatcatctcagtaataaagag

SEQ ID NO: 70142 - DNA, 50 bp, homo sapien
tgctccccaactaatggtccttaccyaacttcaactgtgatgcacctgga

SEQ ID NO: 70143 - DNA, 50 bp, homo sapien
tcctggtatattagcataaccagtarcttgtagatatcatagtccaataa

SEQ ID NO: 70144 - DNA, 50 bp, homo sapien
ttctcttgagtgaagattcccataartgttgctttgtaaatgtgtccagg

SEQ ID NO: 70145 - DNA, 50 bp, homo sapien
ttctagaatcctaaaagtcattgctrgagaggctttaggatcaaggggtc

SEQ ID NO: 70146 - DNA, 50 bp, homo sapien
ttagaagagaaattttgcctcaaaarcgacctgggaacctgacctcagga

SEQ ID NO: 70147 - DNA, 50 bp, homo sapien
gcttccagacccctgtttgcaatcaycacttgtacaccagagcttctcac

SEQ ID NO: 70148 - DNA, 50 bp, homo sapien
tttcttagaacccattcttcctacarctactttcctcatttccagcaaag

SEQ ID NO: 70149 - DNA, 50 bp, homo sapien
caaatcctctccatcatagctgttaytgccacttaaagatgaaggaagag

SEQ ID NO: 70150 - DNA, 50 bp, homo sapien
tggagagttttccagattggcttgarcagagaggttgaagaatcatggga

SEQ ID NO: 70151 - DNA, 50 bp, homo sapien
tttggggagttttccataactcttgmagcttagctatgtgtgagttcact

SEQ ID NO: 70152 - DNA, 50 bp, homo sapien
tcatgtccaccgtctacctactaccrccatgagaataggcctgggcttgc

SEQ ID NO: 70153 - DNA, 50 bp, homo sapien
tgactgcccccagaagctgcaaaaarcaaggattttccctttgcacctcc

SEQ ID NO: 70154 - DNA, 50 bp, homo sapien
atagaccccaacacgacgagcattcyctattcgatttttccatcttctgt

SEQ ID NO: 70155 - DNA, 50 bp, homo sapien
ccatgatgtttactcaatgttttcargtggaactttcaaggttatagtct

SEQ ID NO: 70156 - DNA, 50 bp, homo sapien
gccagctttatacgctcaatactaartagttctcacccattctgtgagtt

SEQ ID NO: 70157 - DNA, 50 bp, homo sapien
catgcacttgtgtttgactggtatawactgttactccattctctattaca

SEQ ID NO: 70158 - DNA, 50 bp, homo sapien
ccacatctaggcctcatctttaaaakgttctgacttctgctctttccttc

SEQ ID NO: 70159 - DNA, 50 bp, homo sapien
actgcttttcaagccatcatttccawtaaggaactttgtactccagccaa

SEQ ID NO: 70160 - DNA, 50 bp, homo sapien
gacaaggatgcagtgaggaccaaatratatatatgcagataaatgtaaaa

SEQ ID NO: 70161 - DNA, 50 bp, homo sapien
ttatcagttcctgaggaagataggayagaatttgctgaaagaacccatgt

SEQ ID NO: 70162 - DNA, 50 bp, homo sapien
agttgggtaaggactagtgtagagartcgcagctgtttctgaaatctgcc

SEQ ID NO: 70163 - DNA, 50 bp, homo sapien
tgacagtaactactttttaatttacygatgccatgaacagtccaaggaaa

SEQ ID NO: 70164 - DNA, 50 bp, homo sapien
ggtggagagtggaatggagggtatcraaagcagctaataggtgattgcac

SEQ ID NO: 70165 - DNA, 50 bp, homo sapien
ctgccctggccttccagctggaactyaaccggatgcgtaacttcgatctg

SEQ ID NO: 70166 - DNA, 50 bp, homo sapien
ggtggagggctctaacagtctgaatyaagctaaggaattactcacacata

SEQ ID NO: 70167 - DNA, 50 bp, homo sapien
tggtttcttggtggaaattggtcccsgaaaagaaagcaactgacagtact

SEQ ID NO: 70168 - DNA, 50 bp, homo sapien
tatttcaggacactgatgaaactggktatctgcgttcgcttgtcatcctt

SEQ ID NO: 70169 - DNA, 50 bp, homo sapien
tgaggaagccactgtgagaaagtcakgcttcagctcagatctgaataacc

SEQ ID NO: 70170 - DNA, 50 bp, homo sapien
taggtatacttctagcatgtgcctargccttaatatttatttcatctact

SEQ ID NO: 70171 - DNA, 50 bp, homo sapien
tagatgcttttactggtccctttcaktcctaaaattatatgattctaaac

SEQ ID NO: 70172 - DNA, 50 bp, homo sapien
acacaggagacatggcgataaacccragaggaaggggcctactctcaagg

SEQ ID NO: 70173 - DNA, 50 bp, homo sapien
gggggtagcaggaaaaactagcccayagccagagatggtaccataaggag

SEQ ID NO: 70174 - DNA, 50 bp, homo sapien
tcttttgtaaagtgaggatctcctawctctggcaggatcctggtgaggag

SEQ ID NO: 70175 - DNA, 50 bp, homo sapien
ggaaccagactctttgaatttacatkacagctattctacttattactgcc

SEQ ID NO: 70176 - DNA, 50 bp, homo sapien
tttccattcaccatggttttagggaycatagagaaggatgacaagcgaac

SEQ ID NO: 70177 - DNA, 50 bp, homo sapien
tgccacaggcatttctacatctgcartatctccaataaatatgctaagcc

SEQ ID NO: 70178 - DNA, 50 bp, homo sapien
catagtaatagtcctgatttggagayggatgacaaggcaacaccaaagct

SEQ ID NO: 70179 - DNA, 50 bp, homo sapien
aattacaaactaatgcaatgagaggkatattcaacaagtgtctgagcctg

SEQ ID NO: 70180 - DNA, 50 bp, homo sapien
acttcattccctaccctttcttgaaygcactagcagtgtcaaaggttagc

SEQ ID NO: 70181 - DNA, 50 bp, homo sapien
gtcgatattaagaaggcaaaatgtargttctctattagttgaacagaaca

SEQ ID NO: 70182 - DNA, 50 bp, homo sapien
ttgcttaataacaaatggaaacatayatacattcgggtctaggaaaagat

SEQ ID NO: 70183 - DNA, 50 bp, homo sapien
gtaggttctctattagttgaacagarcaatcaaggaaccctgtgtctggc

SEQ ID NO: 70184 - DNA, 50 bp, homo sapien
gttagaactacaaacatgaatttcascaatgatttagattcccaggctta

SEQ ID NO: 70185 - DNA, 50 bp, homo sapien
attatagtcctcagatgacaggtaakgttttatgtcaaaaattgaggaac

SEQ ID NO: 70186 - DNA, 50 bp, homo sapien
gccagggacatatgaatccttgtgckctgatctttccactggagtttaag

SEQ ID NO: 70187 - DNA, 50 bp, homo sapien
aaaaaggtcattaggaaaatattaargaaatctggataaagaattgactt

SEQ ID NO: 70188 - DNA, 50 bp, homo sapien
tttaaagttttacctggttttatcayagctctatgctgagtcatctccct

SEQ ID NO: 70189 - DNA, 50 bp, homo sapien
tgcctaatacacctgaatagatacaracattctagtgggcatgtttaaaa

SEQ ID NO: 70190 - DNA, 50 bp, homo sapien
aagcactactttattatgtgtttgcrgagaactactagatggtctgggga

SEQ ID NO: 70191 - DNA, 50 bp, homo sapien
cttgaaactcatgaaatcctttgaaygcagtaaaaataatgctagtaatt

SEQ ID NO: 70192 - DNA, 50 bp, homo sapien
tgaatgaatgagtatggaagaactamactatgtatcattaggagagtgaa

SEQ ID NO: 70193 - DNA, 50 bp, homo sapien
ttagctagttggcatcattttttgaycccaggttagaaatgatcatgata

SEQ ID NO: 70194 - DNA, 50 bp, homo sapien
ggaatgaatggtaaggatcatggaargtttcctagaagaggtaacatttt

SEQ ID NO: 70195 - DNA, 50 bp, homo sapien
tgtctgtgatagtgaaatgcttaaarttccccaaaacacaatgccattca

SEQ ID NO: 70196 - DNA, 50 bp, homo sapien
ttgattggtgataattgggtgtagayagtaaatacacattagcagaattt

SEQ ID NO: 70197 - DNA, 50 bp, homo sapien
tgctgtccataccactaaccaatgayggaaaatatgtactgttaaacgat

SEQ ID NO: 70198 - DNA, 50 bp, homo sapien
cagatgacgatgatggaaatccaaaygaacatagaggcgcagaatccgaa

SEQ ID NO: 70199 - DNA, 50 bp, homo sapien
tgtatttataattcagcttatctcayaattggacctaatagcatttcttt

SEQ ID NO: 70200 - DNA, 50 bp, homo sapien
agaaaaaacattgataaggtccatarctgaatggaaggaacaaaatacaa

SEQ ID NO: 70201 - DNA, 50 bp, homo sapien
cgagtagagaaatagagaaaaactamactttatggcattgttgagctact

SEQ ID NO: 70202 - DNA, 50 bp, homo sapien
tgtgcatgatccagtatgttgtaaarattcacttactgcctttatctaat

SEQ ID NO: 70203 - DNA, 50 bp, homo sapien
tcctttccctttatttactaattttyacaatagtttgttcactagtatcc

SEQ ID NO: 70204 - DNA, 50 bp, homo sapien
aaacacccctgagtttattagtacartggttttaagcttttcgatctgat

SEQ ID NO: 70205 - DNA, 50 bp, homo sapien
aaaaattttattaaaaaaatcctccragaatgaatcacctcaacgcaaat

SEQ ID NO: 70206 - DNA, 50 bp, homo sapien
caatagtgtgattggagttataagcraaggactaatatttcttttttcaa

SEQ ID NO: 70207 - DNA, 50 bp, homo sapien
cttccccaaatcactgagatccaacygcaggtgaacaaaagggctccagt

SEQ ID NO: 70208 - DNA, 50 bp, homo sapien
agtgaatgaaaaaggtgaagactacrgtttacacacacacacacatagac

SEQ ID NO: 70209 - DNA, 50 bp, homo sapien
taaagttataccatttttacaatgascatatgtctcttttatatttaaaa

SEQ ID NO: 70210 - DNA, 50 bp, homo sapien
ttattccacttgattttcaaaacaasttaatgatgtaggtattgttattc

SEQ ID NO: 70211 - DNA, 50 bp, homo sapien
aaaaagtgaaaaataaagaggaaaamtaatctgaacttttatattaggta

SEQ ID NO: 70212 - DNA, 50 bp, homo sapien
ttaggcagctgttgaggtaaacaaaytaagtttaatgctcgaagatagtg

SEQ ID NO: 70213 - DNA, 50 bp, homo sapien
tttcatggtgagggaatggatacccygagaggataaatgactaaatgctc

SEQ ID NO: 70214 - DNA, 50 bp, homo sapien
atgatgcatttttatttattttgaamtatttgcttcggatcattgataaa

SEQ ID NO: 70215 - DNA, 50 bp, homo sapien
tggatctaggagaagagttcttatcsgagcatgacccagagcctctagac

SEQ ID NO: 70216 - DNA, 50 bp, homo sapien
aaagagctgggatttggtggatcaargtcctggaggatcaagaaaagatg

SEQ ID NO: 70217 - DNA, 50 bp, homo sapien
ttttttttcctgccacttgccacaakacccttggctgcatgtaacagaaa

SEQ ID NO: 70218 - DNA, 50 bp, homo sapien
taagaaggatccacgacctttgggarcctcgctgtttctggccttctgct

SEQ ID NO: 70219 - DNA, 50 bp, homo sapien
gcagtccacaatattcttagtaaaayccttcatcctgataatatttacct

SEQ ID NO: 70220 - DNA, 50 bp, homo sapien
ttacaatcagaaatattggttaatargacactgctgtatctgtggccatg

SEQ ID NO: 70221 - DNA, 50 bp, homo sapien
aatgcagaagatactcgggtgtcccyaagtcccactccaaccctgttgaa

SEQ ID NO: 70222 - DNA, 50 bp, homo sapien
cagacacaaccagcaaggcagaggargtatgtacaatcctacattcatca

SEQ ID NO: 70223 - DNA, 50 bp, homo sapien
tctcttagttttgaaaaatgtgccaygatggagtaagaggttgacatcaa

SEQ ID NO: 70224 - DNA, 50 bp, homo sapien
tggaatcaaagttccagtatacttaygaaatgcctgtttaggggattacc

SEQ ID NO: 70225 - DNA, 50 bp, homo sapien
aactgtttttccctatcttcaacaaygtcgttctctgcttcccatgtgtg

SEQ ID NO: 70226 - DNA, 50 bp, homo sapien
gattttggttactactttttctcackaattttgtgatttaaggggatatt

SEQ ID NO: 70227 - DNA, 50 bp, homo sapien
agacaaatacttaaccttgagatcaraaacataaaagaagcaaaatagga

SEQ ID NO: 70228 - DNA, 50 bp, homo sapien
gaatgatggggtaaaacaaaggaackcaacttctctgcataacaatgtta

SEQ ID NO: 70229 - DNA, 50 bp, homo sapien
taacaccaacaacaataaagaaatcycgtagtaagcaagtttgtttaact

SEQ ID NO: 70230 - DNA, 50 bp, homo sapien
tctagagatctgatgtacaacatgargattacaggtaataaaataccgta

SEQ ID NO: 70231 - DNA, 50 bp, homo sapien
atgggaaaggtgacttgggataaaaracttgtgcacatttgtaagctaaa

SEQ ID NO: 70232 - DNA, 50 bp, homo sapien
taaaactgcctcatgcttaattaacmggaaatccattatctttttcttga

SEQ ID NO: 70233 - DNA, 50 bp, homo sapien
gtcaagtgatgagttctggtaaatarcaataaccttggaatgcaaatctt

SEQ ID NO: 70234 - DNA, 50 bp, homo sapien
aatactatttactataccctttttgsaattctaccattctcatcgcttct

SEQ ID NO: 70235 - DNA, 50 bp, homo sapien
ttactaataataacagtaatgacaayaataagaacaaaagtgatcattta

SEQ ID NO: 70236 - DNA, 50 bp, homo sapien
ctattgacacagaatggctaaattcrctgttaagtcacacaattgaacac

SEQ ID NO: 70237 - DNA, 50 bp, homo sapien
cctcactcccaagggaaagagaaaakacgcggctgggctgcacataccca

SEQ ID NO: 70238 - DNA, 50 bp, homo sapien
cagagtgagtttctaaacattctccrgctgcatttcataatactaacgat

SEQ ID NO: 70239 - DNA, 50 bp, homo sapien
gcactgggaattcaggggtagacacratagcctcaggcctttctgtatgg

SEQ ID NO: 70240 - DNA, 50 bp, homo sapien
catttccaaacaagagtcagcctacrcgaatgaaacttttcgtgatcacc

SEQ ID NO: 70241 - DNA, 50 bp, homo sapien
ttctatgtattggattctgaggctaygatggtaagttggatatttctcct

SEQ ID NO: 70242 - DNA, 50 bp, homo sapien
ggctcacctgtgccttgaacattcartgaagaagctgaaccaacacaggt

SEQ ID NO: 70243 - DNA, 50 bp, homo sapien
caggcagctgtcatgagaattaacakgattacagatgtaagggcctggaa

SEQ ID NO: 70244 - DNA, 50 bp, homo sapien
aaacaaatggatattttttaaattcrcattaaagacactctttccccaaa

SEQ ID NO: 70245 - DNA, 50 bp, homo sapien
tccatttgttttagcagtacaaccaygtttagagacttgggctcttctgg

SEQ ID NO: 70246 - DNA, 50 bp, homo sapien
tttgaaacaaatcttacccacacacmaattattgagctcacaaggaagga

SEQ ID NO: 70247 - DNA, 50 bp, homo sapien
tgtggtggtgccacatgtaataaagragggagagacaagctcagtctaga

SEQ ID NO: 70248 - DNA, 50 bp, homo sapien
caagtctaaactccaccattaactakccctctttgactcagtagttttgt

SEQ ID NO: 70249 - DNA, 50 bp, homo sapien
tattcacaagagaattctactctatygactatattgacaattatttttat

SEQ ID NO: 70250 - DNA, 50 bp, homo sapien
gcacaccaccatgcccagagttgtcrcaatgcaaagtttacagtatttac

SEQ ID NO: 70251 - DNA, 50 bp, homo sapien
gtctaaacacattatcaggatttcgsaaccagtggtaagaataggggtcg

SEQ ID NO: 70252 - DNA, 50 bp, homo sapien
ctgtcagtaggcgcttcctattaaastaaagggtaaatctgcgagtgtcc

SEQ ID NO: 70253 - DNA, 50 bp, homo sapien
atgagccaggcgctgtgtttggcccragatgattcattatttttgttttg

SEQ ID NO: 70254 - DNA, 50 bp, homo sapien
aattcccagctgggacattgccctakcctagcaaagacaccactgttgtc

SEQ ID NO: 70255 - DNA, 50 bp, homo sapien
gtgggttgtttgaaatgtgtgataartgatgaaattattagagctctggg

SEQ ID NO: 70256 - DNA, 50 bp, homo sapien
gagtccctaatgcagtcgtcatttakccaccagtccactacgtgttgaca

SEQ ID NO: 70257 - DNA, 50 bp, homo sapien
tgtaaaatattcagtatcacttaacwaatctatgttggaaatggattgta

SEQ ID NO: 70258 - DNA, 50 bp, homo sapien
catctaattagccaccctgtaccaaytcaagattctaaaggatacaggtt

SEQ ID NO: 70259 - DNA, 50 bp, homo sapien
taatttgggagaacttcttgttaaaygctaatctcccacacacacctttt

SEQ ID NO: 70260 - DNA, 50 bp, homo sapien
cactaaataaccataagtagtcaaasttcaaattcaggtgtcacaatctt

SEQ ID NO: 70261 - DNA, 50 bp, homo sapien
accagagacctgattatattcgtcaygttccaaggggtgtccttaacaag

SEQ ID NO: 70262 - DNA, 50 bp, homo sapien
gcatgagctccagtcattatggaagycaaatttgtttacccatgagcttc

SEQ ID NO: 70263 - DNA, 50 bp, homo sapien
tttggcaagttctttcttttattcaycatttttgtctaccctttgactcc

SEQ ID NO: 70264 - DNA, 50 bp, homo sapien
aggtaatctaatttcggggaaggaakcgggagagctaactggtcatcaag

SEQ ID NO: 70265 - DNA, 50 bp, homo sapien
ccgccttgggatctgcatttctgtayctcgaattgcccttcagagcagct

SEQ ID NO: 70266 - DNA, 50 bp, homo sapien
gcaaaagcagctcataaacttctaargcaagcaggagataaatatcctta

SEQ ID NO: 70267 - DNA, 50 bp, homo sapien
cccatatttctctctactcccaaaaracagattgcacagcactatgccca

SEQ ID NO: 70268 - DNA, 50 bp, homo sapien
agtatatgtgctgccaaagcgtgcayatttctaccaaattctaaatatgt

SEQ ID NO: 70269 - DNA, 50 bp, homo sapien
ggtcagtattcaatttatataaatgmgaacacactgagcatgctgttctg

SEQ ID NO: 70270 - DNA, 50 bp, homo sapien
tccctggagagcttattaaaacaackttaggctccacccctaagtttccc

SEQ ID NO: 70271 - DNA, 50 bp, homo sapien
agaccgtgcacaaagcccttcctcasgttttccttgctagcaaagtcctg

SEQ ID NO: 70272 - DNA, 50 bp, homo sapien
ttcacaatagggacgcattcatacaytgatatgcaaggaaaaaccaaacc

SEQ ID NO: 70273 - DNA, 50 bp, homo sapien
cattgtaaagaaattccaactcaagkatccaaatttcaggtcagtcatga

SEQ ID NO: 70274 - DNA, 50 bp, homo sapien
gcccagaaagagtctagtggaaatamgtttacttgctgttaagtgggcac

SEQ ID NO: 70275 - DNA, 50 bp, homo sapien
gcttgggtttggattccaccaatcakctccatttgtatcaatgtccaagt

SEQ ID NO: 70276 - DNA, 50 bp, homo sapien
ttgatattagagctaagtctatgcgkaaggtcttggttcacacaaaggta

SEQ ID NO: 70277 - DNA, 50 bp, homo sapien
tttggaacgtacacttttgtaacaawtctatctatattacctatctatct

SEQ ID NO: 70278 - DNA, 50 bp, homo sapien
gccttgcctgggctctgggccactcmgaaaactggatgaagactggaacc

SEQ ID NO: 70279 - DNA, 50 bp, homo sapien
ttccagcaaaagcagtttgaacgtcmaggaagtaggagtaggagactcac

SEQ ID NO: 70280 - DNA, 50 bp, homo sapien
aaaggagttcgatcgttggactcccrgaatccagtgttcttcacacactg

SEQ ID NO: 70281 - DNA, 50 bp, homo sapien
actgaaatagcgtttcacaatcagcrcttaaggtcagtagcaagaagctt

SEQ ID NO: 70282 - DNA, 50 bp, homo sapien
gaatgacttacttaaggttacacaayttctaagggagagagtctagaact

SEQ ID NO: 70283 - DNA, 50 bp, homo sapien
gggggttgaggaagttcatattcccyagatgatgcccaagaatgactttg

SEQ ID NO: 70284 - DNA, 50 bp, homo sapien
tgccagaaaaaaaatctaattcacamgggctatctcataataaacattgc

SEQ ID NO: 70285 - DNA, 50 bp, homo sapien
ggcagctcctttaggttacaaaagargatagctgctaataaaactttaaa

SEQ ID NO: 70286 - DNA, 50 bp, homo sapien
gctgcaaaggaggctggggacatgakactctgatttagttggtcagggag

SEQ ID NO: 70287 - DNA, 50 bp, homo sapien
ccactagtggaatcaccagcttaggyggctatagagtgcttgaaatgagt

SEQ ID NO: 70288 - DNA, 50 bp, homo sapien
ctttggtgccttgtaagtgatatcargttcgtagctcttgcagacatctc

SEQ ID NO: 70289 - DNA, 50 bp, homo sapien
gtttcaaaacaatctgtctcatatcyactcccaaaagaaatcaggcataa

SEQ ID NO: 70290 - DNA, 50 bp, homo sapien
atgatttttttccatcatggcaacaytgagttgattccatcgatttttgc

SEQ ID NO: 70291 - DNA, 50 bp, homo sapien
gccaaagctttcttttgaaaagagaytcctgtttgaaagccatgactatg

SEQ ID NO: 70292 - DNA, 50 bp, homo sapien
tgagtattccaatatgtgatgattcwaaactctatcctaaaccatatcac

SEQ ID NO: 70293 - DNA, 50 bp, homo sapien
cagcaacccttagaactatggagtaygcaattgtgccactgtggccccac

SEQ ID NO: 70294 - DNA, 50 bp, homo sapien
caggtctcttgactctttatagggarcccatgccattctggttggaagct

SEQ ID NO: 70295 - DNA, 50 bp, homo sapien
tgtcaggcacgtgtttagtgcttcaygggttacttcactgagtcctcccc

SEQ ID NO: 70296 - DNA, 50 bp, homo sapien
attcctgtcctcaaggaagtaacaayctaggagagagaattaatgccacg

SEQ ID NO: 70297 - DNA, 50 bp, homo sapien
ggttgggtatggccagtgtctgttaygactgattgatgcccatgaaattc

SEQ ID NO: 70298 - DNA, 50 bp, homo sapien
ggtaggcattgtcccccttctacagrccgaaacaccaaggcacgcatgtc

SEQ ID NO: 70299 - DNA, 50 bp, homo sapien
cttaataacccacggccgagctaaargaattgttatctaacagctaggtc

SEQ ID NO: 70300 - DNA, 50 bp, homo sapien
atgtatgtcctcaaagtaatccctcrccatgttagagatgggtaagaaag

SEQ ID NO: 70301 - DNA, 50 bp, homo sapien
ctttaaaaaacacctacaactccaasgacacatgactgacccaagtctca

SEQ ID NO: 70302 - DNA, 50 bp, homo sapien
tgcaaaactacttgcatatttataayaggtacgtagcagtattgtttttc

SEQ ID NO: 70303 - DNA, 50 bp, homo sapien
aagcagaaaagatctggaacaaacartgtgctcagaaaagaaaggacaag

SEQ ID NO: 70304 - DNA, 50 bp, homo sapien
taagcttccttttggcctgaaacatsgttcatggtgactaattcgtctaa

SEQ ID NO: 70305 - DNA, 50 bp, homo sapien
agtccctgataccacagagtcgcatmacacagtgccccagaccacatacc

SEQ ID NO: 70306 - DNA, 50 bp, homo sapien
ctacaagtgaaaattccaatatcacractaccattttgtaaacttcataa

SEQ ID NO: 70307 - DNA, 50 bp, homo sapien
tcaagctacaagatcttcctgtgacragcacaaactttgagaagcatctt

SEQ ID NO: 70308 - DNA, 50 bp, homo sapien
aaatccctgacccagaaaatagtgaraaatgaaaatcatgtttcaagcca

SEQ ID NO: 70309 - DNA, 50 bp, homo sapien
tgaaggaggactagctggctgttacscataagaaaaaccaagcattctag

SEQ ID NO: 70310 - DNA, 50 bp, homo sapien
attatgactagatttgttaatttacyggagaaagacattataagtgtctg

SEQ ID NO: 70311 - DNA, 50 bp, homo sapien
cacaatttttggtgggaaaaataacrgaaccaataactgttagaactgat

SEQ ID NO: 70312 - DNA, 50 bp, homo sapien
cataggaaattgctagtttccaaagyccttttcatgatgtcttcttgcag

SEQ ID NO: 70313 - DNA, 50 bp, homo sapien
tctagttttttggttcaatgttcaartcttcctgaatcttggtgcttctt

SEQ ID NO: 70314 - DNA, 50 bp, homo sapien
attcatattctcactgcaaataatcygatagaatcatggaagaactttct

SEQ ID NO: 70315 - DNA, 50 bp, homo sapien
tattttgctttttgttgatttctcaytattctgcattggagtcaattcct

SEQ ID NO: 70316 - DNA, 50 bp, homo sapien
tcagccctttacaagagatgaagaarataagttctgggcccttgtaggtt

SEQ ID NO: 70317 - DNA, 50 bp, homo sapien
gacaccgggggctgatccgcgcctaygagtttgcggtggaccagctggcc

SEQ ID NO: 70318 - DNA, 50 bp, homo sapien
ccagatagaggttcagcttcacaaasgcgttctctgggcacacagcgtca

SEQ ID NO: 70319 - DNA, 50 bp, homo sapien
tcctgaattcatattttttgaataakgatatgtccagtggtttatgcaac

SEQ ID NO: 70320 - DNA, 50 bp, homo sapien
gagttttatacacgtgaaaaattgargcttggagaagtgaacttgaccca

SEQ ID NO: 70321 - DNA, 50 bp, homo sapien
ggaaagagcttgtacaaatctaggtraaaggaaaccaacctagagaagtg

SEQ ID NO: 70322 - DNA, 50 bp, homo sapien
cacccatgacctgagctatcataaaytctggtctgccctagggttctgac

SEQ ID NO: 70323 - DNA, 50 bp, homo sapien
cctagggttctgaccagagacttgaraccaaaaacttcagtagctcaact

SEQ ID NO: 70324 - DNA, 50 bp, homo sapien
gacctctgagaagtgactctcattgygtgaattcaagtcacatgttcatt

SEQ ID NO: 70325 - DNA, 50 bp, homo sapien
aggcccagatgtttacatacaactcrcatttctctgaagattcctctttc

SEQ ID NO: 70326 - DNA, 50 bp, homo sapien
acttctcagaggtctgggagaattawgagtaaagtgactttctttgtcca

SEQ ID NO: 70327 - DNA, 50 bp, homo sapien
taacaatgtagtgtacagttgcatakatttaaacttcataaaatgaatca

SEQ ID NO: 70328 - DNA, 50 bp, homo sapien
gagagaagttaagcagtaagtcattyatttggacaatagatagaccaaca

SEQ ID NO: 70329 - DNA, 50 bp, homo sapien
acacctctttctcttcatcacaaacrccctagttcaatccaccatcattg

SEQ ID NO: 70330 - DNA, 50 bp, homo sapien
ctccttccctgcttttctctaatcaygaaagctgagcctgcagtgaagat

SEQ ID NO: 70331 - DNA, 50 bp, homo sapien
tgcattttaaaaactataactccaawgctcatttgattgtggccctagtc

SEQ ID NO: 70332 - DNA, 50 bp, homo sapien
agtccagcaaagttgaatgtcatacraagtcatggttataagggatgctt

SEQ ID NO: 70333 - DNA, 50 bp, homo sapien
atgtatttgccactcctgtgctagaraaattttaggaggtggctggggcg

SEQ ID NO: 70334 - DNA, 50 bp, homo sapien
taaccccagggagtttatgttctaaygtgggtggatgcatggatgtggtc

SEQ ID NO: 70335 - DNA, 50 bp, homo sapien
tctccacacatcacccttttcaccaytaggagttggtactggtcttaaag

SEQ ID NO: 70336 - DNA, 50 bp, homo sapien
aaagtaaccacaaaacagtcaagacyatccttaaatgaagctcctctgtg

SEQ ID NO: 70337 - DNA, 50 bp, homo sapien
tccgttttctgttgattgatgttgtraatttaactcaggatttcgtctta

SEQ ID NO: 70338 - DNA, 50 bp, homo sapien
tgtaggcttgttttatccttagtgtyaacagttccagaaaaaagagggct

SEQ ID NO: 70339 - DNA, 50 bp, homo sapien
aaattaaaccccagcaagcagtcttyctgcaatggtgctgtctgtccacc

SEQ ID NO: 70340 - DNA, 50 bp, homo sapien
gtaattcgccttcatttccatagagycatttaggccactggtccccaacc

SEQ ID NO: 70341 - DNA, 50 bp, homo sapien
tcattctacacttgcacaagggtccragagtgaagcctctgttagagttg

SEQ ID NO: 70342 - DNA, 50 bp, homo sapien
tttttaaaaggagtccaacttaagarctgccagattaaaacgggcttgct

SEQ ID NO: 70343 - DNA, 50 bp, homo sapien
acaggcattcagacttctgtcccagycactgttttggcagaatgagccag

SEQ ID NO: 70344 - DNA, 50 bp, homo sapien
aaatgttttttaaaaaggaatgcatrtacactatcaaattttgtgcagag

SEQ ID NO: 70345 - DNA, 50 bp, homo sapien
tatcatagaatgtaggtgttgaatasttgaagggaacaatcaaggttggg

SEQ ID NO: 70346 - DNA, 50 bp, homo sapien
tcagaaccatggaaggtgcttaatcygtttgggctactacaaaaaaatac

SEQ ID NO: 70347 - DNA, 50 bp, homo sapien
ggtatctctgaaggccatgttgtaamctactgaatagaacatgaccacca

SEQ ID NO: 70348 - DNA, 50 bp, homo sapien
acttgaaataattttattcttagcawccagaatagaaacctaactcatgg

SEQ ID NO: 70349 - DNA, 50 bp, homo sapien
acattgtttataaaagaaacagctamaacagtaaagactcagaaagatta

SEQ ID NO: 70350 - DNA, 50 bp, homo sapien
aggtggctgggaagacgaaacgccayggtgcctagaaacagcccacacgg

SEQ ID NO: 70351 - DNA, 50 bp, homo sapien
ttcttataccttattctaagatagtwacttggtcagctagatccttttga

SEQ ID NO: 70352 - DNA, 50 bp, homo sapien
aggataactgcctaatctccctggawctcattttatctttagatgtggat

SEQ ID NO: 70353 - DNA, 50 bp, homo sapien
attttcttgattctccatatgcctgracatttgattggatgcccaaaatt

SEQ ID NO: 70354 - DNA, 50 bp, homo sapien
acaggaaggtggccttccaatctaaygcaccatctatgagaaaaagagta

SEQ ID NO: 70355 - DNA, 50 bp, homo sapien
cttcttagtgtatacgcaatctttaygttttctaaagtgaacacatatta

SEQ ID NO: 70356 - DNA, 50 bp, homo sapien
ctgctctgcagattacatgaaaagaracctattctatatctcagtccaat

SEQ ID NO: 70357 - DNA, 50 bp, homo sapien
tccttggtctccatatgagttcctcratacaacttgtcttctgtcattta

SEQ ID NO: 70358 - DNA, 50 bp, homo sapien
aaaactgtcttaaaagaaaatctatyccatgctctatctttcagagacct

SEQ ID NO: 70359 - DNA, 50 bp, homo sapien
ttactttgatattctctgagtgttayctctctattaatatgtgagcctgg

SEQ ID NO: 70360 - DNA, 50 bp, homo sapien
ttctgcccagcctgtctgacagctcrcaaggttggtgttgcaggcatatg

SEQ ID NO: 70361 - DNA, 50 bp, homo sapien
acaaagagacacagccagtccattarcagatacatcagctcatccacatg

SEQ ID NO: 70362 - DNA, 50 bp, homo sapien
ggaatcatccatttagtgatttacckatatccagcagaatgctaagcata

SEQ ID NO: 70363 - DNA, 50 bp, homo sapien
ttgcttctgaggatttcatttattckcaacctcggttagctttttttctc

SEQ ID NO: 70364 - DNA, 50 bp, homo sapien
aattgggctcctgctagagtgtttgsaataacttggagaatttcttactt

SEQ ID NO: 70365 - DNA, 50 bp, homo sapien
atggatgatcataaatgcctcctaakgatttagctgtgctctatctaatc

SEQ ID NO: 70366 - DNA, 50 bp, homo sapien
gtccaggtatgaatgggtggatataygtaaaggccaaaacagcacagcat

SEQ ID NO: 70367 - DNA, 50 bp, homo sapien
tcccatttttccagctgtagaaacaygtctcctaatacagataggctatc

SEQ ID NO: 70368 - DNA, 50 bp, homo sapien
acccccagctgatgatagtattgccrgagaatatctctctgctgtcagtc

SEQ ID NO: 70369 - DNA, 50 bp, homo sapien
gtggcacattacagtatccactacaytaggtattagctactatgcgatta

SEQ ID NO: 70370 - DNA, 50 bp, homo sapien
aggtggaaagcagcacataaatcaamaacttctgggtcctcagacgccac

SEQ ID NO: 70371 - DNA, 50 bp, homo sapien
agagtttaagaccttctattctatgycaggataaaaattgctacacccat

SEQ ID NO: 70372 - DNA, 50 bp, homo sapien
tcctccattataaattacccaagtaragagaaagagacatagtcttgtac

SEQ ID NO: 70373 - DNA, 50 bp, homo sapien
aaccacaaatgttttgtaatgcatgwcccaaagtgttcttgtgtgtttgg

SEQ ID NO: 70374 - DNA, 50 bp, homo sapien
aacaattatataccatcaagttaaamtcttctagtcatggagaagtgagg

SEQ ID NO: 70375 - DNA, 50 bp, homo sapien
aatatagacatgactgcacaaagatrctaataacaaacagagtctcaaga

SEQ ID NO: 70376 - DNA, 50 bp, homo sapien
ctacccaggcccatacctcggtcaartgcagtcatcagccaggaaagaac

SEQ ID NO: 70377 - DNA, 50 bp, homo sapien
tggcaatgtcgtaacccacttcctayagcctcatttgagagcttttgatt

SEQ ID NO: 70378 - DNA, 50 bp, homo sapien
ttattaatcagtcaattccacgttaycaggcaaggctctgccaggggaag

SEQ ID NO: 70379 - DNA, 50 bp, homo sapien
taaggcttcgtcccggcaatggcgtracatcaccaggccacatggtggat

SEQ ID NO: 70380 - DNA, 50 bp, homo sapien
gagggatggtctcatacctgagtgasaactttgcaaaagtagtagtgtgt

SEQ ID NO: 70381 - DNA, 50 bp, homo sapien
tagttctcccacctaggagaagttgsatttgtatttcaagcagaaaaact

SEQ ID NO: 70382 - DNA, 50 bp, homo sapien
agatgtttgtgtaagtctttgctgayggtttttcaggctcttctgttctt

SEQ ID NO: 70383 - DNA, 50 bp, homo sapien
gttggcagcagagtcagggttcaaakataggcgtgtctgaccggcagcct

SEQ ID NO: 70384 - DNA, 50 bp, homo sapien
aatggactgggtacaaggatgaacaygtcattgaacaattaccttacctg

SEQ ID NO: 70385 - DNA, 50 bp, homo sapien
acagtagttgcttattttattggccrtctctctgactgggtttggagctt

SEQ ID NO: 70386 - DNA, 50 bp, homo sapien
tcctgggtattacaaagagctcataygtgtagtgtttgtttatgtgcaaa

SEQ ID NO: 70387 - DNA, 50 bp, homo sapien
agaactggcattcctttgatgaatgsaaactccaaaattgccctgattga

SEQ ID NO: 70388 - DNA, 50 bp, homo sapien
taaaagacaattagccaaaactataygcatcaggtatttggtagtgctca

SEQ ID NO: 70389 - DNA, 50 bp, homo sapien
gttctcacagagaaaggaggttggcygaagactgattaggtttacatgaa

SEQ ID NO: 70390 - DNA, 50 bp, homo sapien
tgatgcttttgaatgtggttaaggtraatttgatcagatggattgaggat

SEQ ID NO: 70391 - DNA, 50 bp, homo sapien
ccaaagaatgtaactcacaagtaaaycgatcactgtacatcagtctccta

SEQ ID NO: 70392 - DNA, 50 bp, homo sapien
cctttctccatccccagagattcaaygtgatttaatcggcaaaccttttt

SEQ ID NO: 70393 - DNA, 50 bp, homo sapien
ttttttcttattccggtcctcctcastgacattccggagcaccctgatgg

SEQ ID NO: 70394 - DNA, 50 bp, homo sapien
ctcgctaaattcgtgtgatgttccartgaaaacagacatacatttttatt

SEQ ID NO: 70395 - DNA, 50 bp, homo sapien
gaacttcaaatcctctgctaggagaygagttggagaaattcatcaattac

SEQ ID NO: 70396 - DNA, 50 bp, homo sapien
gtgctcaggagattacaacagaccckataatcctcagaagacttttcaac

SEQ ID NO: 70397 - DNA, 50 bp, homo sapien
tttgtacatatgtgaacctgtaggcracggatgtgatagtgttgtgtcca

SEQ ID NO: 70398 - DNA, 50 bp, homo sapien
cactgccaggccgggcagggaaaaaytgtgtgctcaggagattacaacag

SEQ ID NO: 70399 - DNA, 50 bp, homo sapien
ttaatgaagatgactgatggtactcsaaatcaccttatagacacctctat

SEQ ID NO: 70400 - DNA, 50 bp, homo sapien
tccggaggaagtgggcattaaatcgragcaggagggaagggggttagaca

SEQ ID NO: 70401 - DNA, 50 bp, homo sapien
agaatgcagatgacacatgattgaargctgggaaatccatcagcatctta

SEQ ID NO: 70402 - DNA, 50 bp, homo sapien
agtgacttgtctgaggcagccctackaacaggtgccagagttgggattca

SEQ ID NO: 70403 - DNA, 50 bp, homo sapien
gttccagctaaatttctttagtgtgwataccaaaacatgatcttctctcc

SEQ ID NO: 70404 - DNA, 50 bp, homo sapien
acagccctgtggcctgataatggacyggaaacaggaggacacaggagaca

SEQ ID NO: 70405 - DNA, 50 bp, homo sapien
caaccaaggttacaataacagaaaakctcttgtgagggaaaaagtattga

SEQ ID NO: 70406 - DNA, 50 bp, homo sapien
cgacttcaggatgggttaggcaggcratttggtttggtacctcttaagtc

SEQ ID NO: 70407 - DNA, 50 bp, homo sapien
gacaaagtgtattcacattcatcacrgtaatgacaatgtcctatatcttt

SEQ ID NO: 70408 - DNA, 50 bp, homo sapien
taagatgcagaactgggggagatgcracgtatgactcaattcccttgagc

SEQ ID NO: 70409 - DNA, 50 bp, homo sapien
caagcccaacagataatgggtgttcrataattattatgactctaacccag

SEQ ID NO: 70410 - DNA, 50 bp, homo sapien
gcttgtctggctcgagctgtaaaatragaatgaagtatttgagggctgtg

SEQ ID NO: 70411 - DNA, 50 bp, homo sapien
gagggaggagagctccctggtcctaygcactttattgattccttatgccg

SEQ ID NO: 70412 - DNA, 50 bp, homo sapien
agactcttaccataaggaagaataawgggtgctggtagaaaaaaaatgac

SEQ ID NO: 70413 - DNA, 50 bp, homo sapien
ctgctctagtcctgccacaagcctamctttgtgcaaataagaaaaatctg

SEQ ID NO: 70414 - DNA, 50 bp, homo sapien
ctatggctatggctctatggtgagayctagcatgtctatccctccttatc

SEQ ID NO: 70415 - DNA, 50 bp, homo sapien
ttctaaaccatcacgataaggaataygtgagaaagttttgagacaggatt

SEQ ID NO: 70416 - DNA, 50 bp, homo sapien
catcgcacagaaaaagcctgggataratgagcaatgatggatctagatag

SEQ ID NO: 70417 - DNA, 50 bp, homo sapien
gtcagtcaggagccaggtatctcacragttataaagagatgtgaggagag

SEQ ID NO: 70418 - DNA, 50 bp, homo sapien
cagcctggggcaagatcagaggtaaygtattagagaaaaggcagagtcat

SEQ ID NO: 70419 - DNA, 50 bp, homo sapien
tgtattgtatccattgacttgataartgatagaaatttattttaggtttt

SEQ ID NO: 70420 - DNA, 50 bp, homo sapien
gctgacacccattgcagttgtaggartcatttttgtgaagtgagacagtc

SEQ ID NO: 70421 - DNA, 50 bp, homo sapien
ggtctttttttataacatcgttaacrggtaccattaaatattctgagagg

SEQ ID NO: 70422 - DNA, 50 bp, homo sapien
tgccttttgttgttagactctgtcayaggtaatgtcctgattttcatttt

SEQ ID NO: 70423 - DNA, 50 bp, homo sapien
catgtactgtatcatgggggatcaartaatagacggggaggtttttcctt

SEQ ID NO: 70424 - DNA, 50 bp, homo sapien
agttttctgcactcaaaatatataayggcatttgttgacttggaaacttc

SEQ ID NO: 70425 - DNA, 50 bp, homo sapien
gataacatattttaaagctcaggtayaagaactaaatggatttcatgaaa

SEQ ID NO: 70426 - DNA, 50 bp, homo sapien
gcaaaataatacatgtgaataagaargagcctacggagggcagcacatgc

SEQ ID NO: 70427 - DNA, 50 bp, homo sapien
ttcatacaactccttggattttatayactcttggaagctcttctctgagt

SEQ ID NO: 70428 - DNA, 50 bp, homo sapien
tatagaacttgggggtatcccattcrattaaggcaactcatatacatgta

SEQ ID NO: 70429 - DNA, 50 bp, homo sapien
tgacagcatatttctggcttattctsaagggtattaagtgtaagagagac

SEQ ID NO: 70430 - DNA, 50 bp, homo sapien
cctgcagatgtgggacagctgtttgyacttagcagttaagtgtccctgca

SEQ ID NO: 70431 - DNA, 50 bp, homo sapien
agggtgctgctagggttccaaggtgyaaatgatgattccagaaaacaagg

SEQ ID NO: 70432 - DNA, 50 bp, homo sapien
tggcataattttaaaccaattctaarcccttctgaagctgggaattttta

SEQ ID NO: 70433 - DNA, 50 bp, homo sapien
ccagtgctcatggggaggagaacgamtcaccctgctgggacaaatattat

SEQ ID NO: 70434 - DNA, 50 bp, homo sapien
gcagctcataaacaccagtcaggaayggatggtacttccaacactgcttt

SEQ ID NO: 70435 - DNA, 50 bp, homo sapien
gcttgataaaaacattataaataaaygtgcataggacggaaaccctgtaa

SEQ ID NO: 70436 - DNA, 50 bp, homo sapien
agctgtctaatgacttctgaatgaaygataactcacattgaagggctgct

SEQ ID NO: 70437 - DNA, 50 bp, homo sapien
gttacttcataatccagtttcattasatttactgtgcactggcacgaata

SEQ ID NO: 70438 - DNA, 50 bp, homo sapien
taattagagagtgctgcttgatgaaygagaggacaggagagtgaaggact

SEQ ID NO: 70439 - DNA, 50 bp, homo sapien
atgctgtgtaacaaaccacatccaarctcaatgttctaaaagattaatca

SEQ ID NO: 70440 - DNA, 50 bp, homo sapien
acatgacaacccatgatgtggaaacratctaataatagcaaacgatgaca

SEQ ID NO: 70441 - DNA, 50 bp, homo sapien
acaaacactcttcttgctcactcaaytgcctaaaaacgaatggcctttct

SEQ ID NO: 70442 - DNA, 50 bp, homo sapien
tgggatgtgtagttgcttttcagacygaccacaagtccagaggaattttt

SEQ ID NO: 70443 - DNA, 50 bp, homo sapien
tggggctagatgccatttctggtcaracaattgtggccggaagaaatgag

SEQ ID NO: 70444 - DNA, 50 bp, homo sapien
ggaagtaacccttctgaatggactayataacttgggtgaaaaagagacca

SEQ ID NO: 70445 - DNA, 50 bp, homo sapien
tttatctatttttgaacagttagtaygtgcatatggtttaacactcaaaa

SEQ ID NO: 70446 - DNA, 50 bp, homo sapien
tgcataccttcacgattcatatacarcctaatcttatatggctttgttca

SEQ ID NO: 70447 - DNA, 50 bp, homo sapien
caaccacaatactgcttcctaatacrgctgagggggacatttccagttaa

SEQ ID NO: 70448 - DNA, 50 bp, homo sapien
ctggtttttttaaatatttcaaggamctgacctgtaaaatgccactggaa

SEQ ID NO: 70449 - DNA, 50 bp, homo sapien
tcctcctatgactcaagccagtcacygaaaacaagctcgatcttaggggt

SEQ ID NO: 70450 - DNA, 50 bp, homo sapien
atcaagagatgatttgtcactgagcraagtttaatctctaaaataagcac

SEQ ID NO: 70451 - DNA, 50 bp, homo sapien
caacaagaatggaacaagaacggcarcaagaatggaattgggggatctgg

SEQ ID NO: 70452 - DNA, 50 bp, homo sapien
accatgctacaaacagatacgctgckatacaggctttgtggttccattta

SEQ ID NO: 70453 - DNA, 50 bp, homo sapien
aaaagtctagatttggttcaccaagraagtccacgccagatactttgacc

SEQ ID NO: 70454 - DNA, 50 bp, homo sapien
gtttaacattccaatgcaagttttcmgcttattggcacatctcaagtgtt

SEQ ID NO: 70455 - DNA, 50 bp, homo sapien
cttttactgtttcatattagacctgygttctacctaactgatttttgagt

SEQ ID NO: 70456 - DNA, 50 bp, homo sapien
tatgtattgctttatgtgtcagtcaytagtgtatattgatttgcagcaat

SEQ ID NO: 70457 - DNA, 50 bp, homo sapien
actagggaaagtgtgtacatttatcyaaggtgaaataaggttgccattaa

SEQ ID NO: 70458 - DNA, 50 bp, homo sapien
aattgtgaaccatcagaatagaaacratgcaatacttaaacattatgaga

SEQ ID NO: 70459 - DNA, 50 bp, homo sapien
agttcatcagctataagaaaataagrccattcaaacattttaccaattca

SEQ ID NO: 70460 - DNA, 50 bp, homo sapien
aaaattcaacacagcccaacaggaargttttacctggcagatcccagacc

SEQ ID NO: 70461 - DNA, 50 bp, homo sapien
ggtcatcaaagagacaccaaaatgargttcaagaatgtacaggaaggcag

SEQ ID NO: 70462 - DNA, 50 bp, homo sapien
atgtgcagcagcacctacaaaactckatatgatcaaagtttccttaagtg

SEQ ID NO: 70463 - DNA, 50 bp, homo sapien
acttgacacctctttctgtctcataygcaccttcattcattgaaaaatga

SEQ ID NO: 70464 - DNA, 50 bp, homo sapien
tgagtaaactcttgctttctccaatmtgaaaggtgtgagcccattcaagg

SEQ ID NO: 70465 - DNA, 50 bp, homo sapien
acccaatctcagctcttgcaggacckctattctggttctgagcccgtgac

SEQ ID NO: 70466 - DNA, 50 bp, homo sapien
ccctgcttttggttgtccctcttcaygggtcatggcagcctgagtgacat

SEQ ID NO: 70467 - DNA, 50 bp, homo sapien
cagatcttattgagtttgtgtctaayatgcaatcctctaacatgaggcct

SEQ ID NO: 70468 - DNA, 50 bp, homo sapien
ataggactgaagtttataaaacgacrccctagagaaagtagactatgctg

SEQ ID NO: 70469 - DNA, 50 bp, homo sapien
tctttctactgaagaagttaaaaacrattcccagaagaagtgaagcttgc

SEQ ID NO: 70470 - DNA, 50 bp, homo sapien
catataatgaataaggtaagcttcayatcacatactaatccaagaaagta

SEQ ID NO: 70471 - DNA, 50 bp, homo sapien
catctctaattcctttcctgtatgtsaatctgttagcacttcagtcaagc

SEQ ID NO: 70472 - DNA, 50 bp, homo sapien
gtttgccaaaattgtgacacacttawaggactgaagtttataaaacgacg

SEQ ID NO: 70473 - DNA, 50 bp, homo sapien
ttttcctatactatcagatcacaatsaacattacagacaagatatacaag

SEQ ID NO: 70474 - DNA, 50 bp, homo sapien
taccacgaccctaaacgtggtacaakaacatgtcctgatattttaaacaa

SEQ ID NO: 70475 - DNA, 50 bp, homo sapien
acagcaacagtaaagtatatctttaraaagtgtatcttctgaatctttta

SEQ ID NO: 70476 - DNA, 50 bp, homo sapien
atcaggagtagcttatccaataatgraacactcagtttggtcaaaagaaa

SEQ ID NO: 70477 - DNA, 50 bp, homo sapien
ttaaccattttcttattgctctcaaygtctaaatatctcttggtagagaa

SEQ ID NO: 70478 - DNA, 50 bp, homo sapien
ccatgaagatgaagataaaatagcasaaaacgctgaaaattccaaaacca

SEQ ID NO: 70479 - DNA, 50 bp, homo sapien
cagttctggaggtaaaaaatataaarcaggtcattgggctgctttccttc

SEQ ID NO: 70480 - DNA, 50 bp, homo sapien
agtgctgactactgtgctaagtcgarcaggagaatttttaagataagagc

SEQ ID NO: 70481 - DNA, 50 bp, homo sapien
acaatgtcctgaaaggcagctaagaktactttagactcacgactagtgtc

SEQ ID NO: 70482 - DNA, 50 bp, homo sapien
ggccagagttaaacattgaggaatgracctaaaatgttgactaaaagatg

SEQ ID NO: 70483 - DNA, 50 bp, homo sapien
ttaaaaagtatcaaaatatctaccaratctgtgccaatggcaaaagtctc

SEQ ID NO: 70484 - DNA, 50 bp, homo sapien
aatggggactttctgacccttggaaktgtaaacaaatgcctccaaaactt

SEQ ID NO: 70485 - DNA, 50 bp, homo sapien
agtgaataattcataaatatgacaawgatcttcatggtgaaataaaagta

SEQ ID NO: 70486 - DNA, 50 bp, homo sapien
tgcttccttcttccacctccaacttrtatcaaccccatttgagaatatct

SEQ ID NO: 70487 - DNA, 50 bp, homo sapien
aattggactggccactccttttgaartgaagttcatcaatgtctacaacc

SEQ ID NO: 70488 - DNA, 50 bp, homo sapien
ctacattttgagcacctattttgaamactttatgtcacttaatcttcaga

SEQ ID NO: 70489 - DNA, 50 bp, homo sapien
cagaagtggagccccacaaggagacrgagatgattggatgacacggcagg

SEQ ID NO: 70490 - DNA, 50 bp, homo sapien
ctgtatacctcacgagtggtaccaaycaaagcagctatttagtgtttcag

SEQ ID NO: 70491 - DNA, 50 bp, homo sapien
ttttccgcgtcagaggactgccactragtacacgggaacctgcagaggcg

SEQ ID NO: 70492 - DNA, 50 bp, homo sapien
gtagctaatctgaacctctggattcrgtaattggtagtacttacctccca

SEQ ID NO: 70493 - DNA, 50 bp, homo sapien
cggtgcagagcaggtacctgggcagrtgcaaagagctgagccggcaagtt

SEQ ID NO: 70494 - DNA, 50 bp, homo sapien
ttcacattgttaatgcatgtgcttayaaaccatctatatctactattcag

SEQ ID NO: 70495 - DNA, 50 bp, homo sapien
aaatagtgatttcttattagattcasattattttttaaaaagcaaagatg

SEQ ID NO: 70496 - DNA, 50 bp, homo sapien
ttgtcctaaaatttagaattataacracagagaaagccatgggctaatac

SEQ ID NO: 70497 - DNA, 50 bp, homo sapien
ctgactttaaactactaacttgacawcacagaatatggggctgggaagat

SEQ ID NO: 70498 - DNA, 50 bp, homo sapien
cagagaggctgaatagaaagtgtaawatgtagaataggtgagcagagatt

SEQ ID NO: 70499 - DNA, 50 bp, homo sapien
ctgcctcttgtattcttctgggcttktgattcctggtataaatgttctcc

SEQ ID NO: 70500 - DNA, 50 bp, homo sapien
gggatacctatagatttcacacacartggtaagaaacaatacaaaaagat

SEQ ID NO: 70501 - DNA, 50 bp, homo sapien
acaagagtcgatgaaggaatgtgaargtactcgaaatcctgacttttatc

SEQ ID NO: 70502 - DNA, 50 bp, homo sapien
atatgtgttaatatgtgtaagtagcycagaacagggcctggctcagggat

SEQ ID NO: 70503 - DNA, 50 bp, homo sapien
cttaatttatgggcgtggtaaccaasttcaatggattagcatccttcttc

SEQ ID NO: 70504 - DNA, 50 bp, homo sapien
tgtaaagagaagcactgtttcctaaytgttgcagataaagtccaaggaca

SEQ ID NO: 70505 - DNA, 50 bp, homo sapien
catgtaaggtaacattcacaaatccyggagattagagcatggatatcttt

SEQ ID NO: 70506 - DNA, 50 bp, homo sapien
tattcacagggcttcagaaaactacyggcaggtccctcacagtaaggaag

SEQ ID NO: 70507 - DNA, 50 bp, homo sapien
gagactctatcattaatcagcctcaraaatgtgaaggtgcttgtcaacct

SEQ ID NO: 70508 - DNA, 50 bp, homo sapien
gtgcctcagataaattaaaagaatayacagctatacagggactgtagaaa

SEQ ID NO: 70509 - DNA, 50 bp, homo sapien
ctcacgggccaggctgtctattacarcacccagaattcctgctctccttc

SEQ ID NO: 70510 - DNA, 50 bp, homo sapien
aaaaaaaaaccctttctttcaaaaamatttctaagtctgtgttcctgtta

SEQ ID NO: 70511 - DNA, 50 bp, homo sapien
aaataatttcctaagaacataaatawctaaagacaaatgagcatatcaca

SEQ ID NO: 70512 - DNA, 50 bp, homo sapien
gtccaacaggattatcttgaaaacayatcccgaacctgagcacttcccac

SEQ ID NO: 70513 - DNA, 50 bp, homo sapien
tgggagagccccaattaaaagtatcyttgcagttttccttaatcacaccc

SEQ ID NO: 70514 - DNA, 50 bp, homo sapien
aacaaaaaacatcaaaagactatgaraaacagtgattggatgtttggggt

SEQ ID NO: 70515 - DNA, 50 bp, homo sapien
aaaactttcaatttgatagccaataygtaagcatcagacaatttcacata

SEQ ID NO: 70516 - DNA, 50 bp, homo sapien
acggagatcattcctatcatcattgrcccacattgtggtttgaaggcagc

SEQ ID NO: 70517 - DNA, 50 bp, homo sapien
gctcagcctcctcctggaactttcaygcctgtaaactggggaccatcagg

SEQ ID NO: 70518 - DNA, 50 bp, homo sapien
ggatggcagaattaattctaagatayagggttcaaaggagtctcaacttt

SEQ ID NO: 70519 - DNA, 50 bp, homo sapien
gtgattttttaaaaatgatctttccyggaaaaccgtgtctttcctgcctt

SEQ ID NO: 70520 - DNA, 50 bp, homo sapien
actaatgggactggcttatttttacraggtcattggcatatgaacctttg

SEQ ID NO: 70521 - DNA, 50 bp, homo sapien
tgttttgattctcctgacaaccttcyctttttggactttaacaaagcata

SEQ ID NO: 70522 - DNA, 50 bp, homo sapien
gtggagctcaatgagctccctgaaaragtaatgccacagtagggtgcaga

SEQ ID NO: 70523 - DNA, 50 bp, homo sapien
ggatgggaacacagggtgcaatgagraagggtactctagcctgcctgggc

SEQ ID NO: 70524 - DNA, 50 bp, homo sapien
gcttcccacactgtcaagcaggagcratttgtgtcccatggctttgaggg

SEQ ID NO: 70525 - DNA, 50 bp, homo sapien
ttctcctgacctgtattccagttcaytcattctaatattctcttaagcca

SEQ ID NO: 70526 - DNA, 50 bp, homo sapien
ttaaattatgatctattgattccaarcagctagtgtgaaaaataatttca

SEQ ID NO: 70527 - DNA, 50 bp, homo sapien
ggatggtgtgtatgttcagtttgggwcacactaggattaagacgcctgtt

SEQ ID NO: 70528 - DNA, 50 bp, homo sapien
gcaccatttgtatgataatagctaaygtctctcaagcaccagctacatgc

SEQ ID NO: 70529 - DNA, 50 bp, homo sapien
aattgagaagatcttgtactaaaaaragttaaaatgtctcattaatttgt

SEQ ID NO: 70530 - DNA, 50 bp, homo sapien
acctagactaactgtaggtcattgayaagccaaacatctgattaagaatc

SEQ ID NO: 70531 - DNA, 50 bp, homo sapien
tctcctgcttcagtcccttatcctgkcagattaaaaaaaaaagagtcaac

SEQ ID NO: 70532 - DNA, 50 bp, homo sapien
ggagagaagacgtttcaagtcccagyatagaaaacgccagtcctactgct

SEQ ID NO: 70533 - DNA, 50 bp, homo sapien
atgaagtcacatttatgaatgcctayggtgtccaagtgcgggtctccggg

SEQ ID NO: 70534 - DNA, 50 bp, homo sapien
ggaagattcaataaacatctgtcccratagagctgtaaagtgaaggaggg

SEQ ID NO: 70535 - DNA, 50 bp, homo sapien
cagcctgaaacaaaccaatttaagaygcatgaatgagaaacaagatttta

SEQ ID NO: 70536 - DNA, 50 bp, homo sapien
cacgatcagcacgtgcatgtccttayctgaaagcttgccactcaaatgtg

SEQ ID NO: 70537 - DNA, 50 bp, homo sapien
atcacacagtatacaacatcagttcygaaaatcaactatacttcttctaa

SEQ ID NO: 70538 - DNA, 50 bp, homo sapien
ctaaattggttggcaaaattttaagragcaacaggaaatttgcacagtct

SEQ ID NO: 70539 - DNA, 50 bp, homo sapien
acgtttggattagatatcctctaagrgaactttcagctctaaggctctgt

SEQ ID NO: 70540 - DNA, 50 bp, homo sapien
tacctttcctccctctccacacaackgcatctcgacctgggccaagcaca

SEQ ID NO: 70541 - DNA, 32 bp, homo sapien
gggactataggaaacaygcctggggtccactt

SEQ ID NO: 70542 - DNA, 50 bp, homo sapien
agcaagaaagcaaataacttgatcaraaatggacaaatagcctaaatgga

SEQ ID NO: 70543 - DNA, 50 bp, homo sapien
cattagaaatactgatatataaagamgaactatgtgagatgatgaatatg

SEQ ID NO: 70544 - DNA, 50 bp, homo sapien
gagtctgtgcaagatgggaatctaaytggagatctctgacagaagctaga

SEQ ID NO: 70545 - DNA, 50 bp, homo sapien
ataatttgcatttttgatgacattcscagcaacagtgttttaactatgaa

SEQ ID NO: 70546 - DNA, 50 bp, homo sapien
taggggatccaagttctctttttcgycaatgatgtagctgttagagaact

SEQ ID NO: 70547 - DNA, 50 bp, homo sapien
aagagatttggagctattgggatggmatgaacatattttgcatgtgagaa

SEQ ID NO: 70548 - DNA, 50 bp, homo sapien
gcatttgttaaaagaataagaatackagacagcaatattaagatgtgaag

SEQ ID NO: 70549 - DNA, 50 bp, homo sapien
ggaaattcagaggctgaagagagacratcacttgaagacaggagttagag

SEQ ID NO: 70550 - DNA, 50 bp, homo sapien
caggaaggaagaaaactcattaatarcttacttatgacaatagctggtta

SEQ ID NO: 70551 - DNA, 50 bp, homo sapien
atccctagaagttccattttggccaktaaaaatatctcttatacctcagg

SEQ ID NO: 70552 - DNA, 50 bp, homo sapien
tgagcacataaacccaagcctcaatragttccataaattcttcagatttt

SEQ ID NO: 70553 - DNA, 50 bp, homo sapien
tttctcccacattcaggaaaaatatrgccctgaggattgacatgcccagg

SEQ ID NO: 70554 - DNA, 50 bp, homo sapien
ggggcctccgtgtccttgtctggacsatgggtgtaaagaagccacatttc

SEQ ID NO: 70555 - DNA, 50 bp, homo sapien
ggctctgcgtatccttggttctaaarttcctactgcaatgaaacagggca

SEQ ID NO: 70556 - DNA, 50 bp, homo sapien
gcccagcctgacttgaatctttgaaygagttcctaaccattcctatccag

SEQ ID NO: 70557 - DNA, 50 bp, homo sapien
aaagcccttatgcatcaaataaacamgcaaatactgagagcttaccttgc

SEQ ID NO: 70558 - DNA, 50 bp, homo sapien
cctcctcctctggctcctgagtcacrcctaagcttttgaagcaaatgtct

SEQ ID NO: 70559 - DNA, 50 bp, homo sapien
tgtgttgaaggactcatgtgttgaartctttgttttctttttgttgttgt

SEQ ID NO: 70560 - DNA, 50 bp, homo sapien
ggaaaattttataattccctctgaakgtttagcagaagcactgcacctgg

SEQ ID NO: 70561 - DNA, 50 bp, homo sapien
tttagccaacctggtatctactttcycttcttctaataaaagtgcacgga

SEQ ID NO: 70562 - DNA, 50 bp, homo sapien
gtttagtaatgttatccatctgttcycttaaccatatacatctagaggct

SEQ ID NO: 70563 - DNA, 50 bp, homo sapien
ttttgtaaaaattaaaaacaacacakgacgaagagattaatggggcactc

SEQ ID NO: 70564 - DNA, 50 bp, homo sapien
aaggcgctctgtaatctctgaccccrtagcatccttctgacctcattttc

SEQ ID NO: 70565 - DNA, 50 bp, homo sapien
tgttatcttctagaatgcaaatgagycttttttccttcatcccaattaat

SEQ ID NO: 70566 - DNA, 50 bp, homo sapien
aataaaatgtttaaaactgttaaaaragagttgacaatagagtttgtgat

SEQ ID NO: 70567 - DNA, 50 bp, homo sapien
tgagcttatatttcttgatggaaagkaactagggaataaactgtgtggtg

SEQ ID NO: 70568 - DNA, 50 bp, homo sapien
aataaaagactgtttcatctgcagcragcatctgttatttagtgtagcca

SEQ ID NO: 70569 - DNA, 50 bp, homo sapien
cacctctttgtgaggtcttgacaatyagggaatcattttctagaattcct

SEQ ID NO: 70570 - DNA, 50 bp, homo sapien
tagagttattctcacaatcacagaaytaagacctcaagttaaagtgcttg

SEQ ID NO: 70571 - DNA, 50 bp, homo sapien
catatcatgatctcaccaaattcacsagtttactgtaatttggaaacata

SEQ ID NO: 70572 - DNA, 50 bp, homo sapien
tgagacatggacagggagcctcattyttcctaaatctgctttcactgaca

SEQ ID NO: 70573 - DNA, 50 bp, homo sapien
ctcatgagctccatgaaattgtttayaaaagtctatgtcaggtcgggcat

SEQ ID NO: 70574 - DNA, 50 bp, homo sapien
agtttatggttgtattgctaaactaygcaggccctcttggctcctgctaa

SEQ ID NO: 70575 - DNA, 50 bp, homo sapien
tgaaggttttacatttaaatcttcayctattaagtttgaatatgggatga

SEQ ID NO: 70576 - DNA, 50 bp, homo sapien
gtgaggacacaacccagaagaataaratcagaggactgacgtgactcaag

SEQ ID NO: 70577 - DNA, 50 bp, homo sapien
aaaggagtaaaggcaactcaatgaarccaaagtctttgacagccttttca

SEQ ID NO: 70578 - DNA, 50 bp, homo sapien
gcatctgtgcccgagtaggtaggcaygaggacatttgtcactgcatggtt

SEQ ID NO: 70579 - DNA, 50 bp, homo sapien
tcatagtgatgagtgcaggatacatraaggagctttaaaaaatagagaaa

SEQ ID NO: 70580 - DNA, 50 bp, homo sapien
cacggttatgaatattacacataccrcaaattcctcaagtcaaaattagc

SEQ ID NO: 70581 - DNA, 50 bp, homo sapien
attccgcctaaaagggaactgttagyaccatcctccaaatagttcaagcc

SEQ ID NO: 70582 - DNA, 50 bp, homo sapien
gtctgcatgtttttgttttggtataygatatgagatacgaacaaaaatgg

SEQ ID NO: 70583 - DNA, 50 bp, homo sapien
gaaacagttaactggccattagtacygatttgccataaattgcttttcat

SEQ ID NO: 70584 - DNA, 50 bp, homo sapien
atcgaaagaaaacactgagaatcaamctataaagtcccttctgagaaaac

SEQ ID NO: 70585 - DNA, 50 bp, homo sapien
tacccacactcaaatttatgttaaayaacaacctcaatgaaatcactctt

SEQ ID NO: 70586 - DNA, 50 bp, homo sapien
caagtatgtcaatattgaaaactaartagcaaaaagaggtcaaaattcct

SEQ ID NO: 70587 - DNA, 50 bp, homo sapien
cacagtaaggttatacttcacaactrctagggtggctgtaattaaaagac

SEQ ID NO: 70588 - DNA, 50 bp, homo sapien
aacacaatatgaagtaaatagctaasattttgagatgtgatgagtaccat

SEQ ID NO: 70589 - DNA, 50 bp, homo sapien
tgatgaggatgtggagaaatggaaarcttcataattcctggtgagaatat

SEQ ID NO: 70590 - DNA, 50 bp, homo sapien
aaaaacattttaagcattccttaacyctgaattttctatacgttacccac

SEQ ID NO: 70591 - DNA, 50 bp, homo sapien
ttattttatctatttataacaacgaktatgtggttgaaataagagtatga

SEQ ID NO: 70592 - DNA, 50 bp, homo sapien
taaacaacatatgagtcccaacaagrtaagagagaaaaagtgaagatccc

SEQ ID NO: 70593 - DNA, 50 bp, homo sapien
taagtagcaatctctcctttaaacarccctactgattgccactttatttt

SEQ ID NO: 70594 - DNA, 50 bp, homo sapien
taatatattacaaggctatacaaatyataacagtgtggtactggcattaa

SEQ ID NO: 70595 - DNA, 50 bp, homo sapien
ccaatgagtgttattaattctagtcrttatccatcaagacactgttcaga

SEQ ID NO: 70596 - DNA, 50 bp, homo sapien
tatcaaaaatagtaaaatgcttaagrataaatttaatcaagaaactgaaa

SEQ ID NO: 70597 - DNA, 50 bp, homo sapien
agtgacttgccttggtacataaatcsaactgatggcagacccggggctcc

SEQ ID NO: 70598 - DNA, 50 bp, homo sapien
ataaattgaggaaccagctgatgatrttcaaggatgttttttaattaggt

SEQ ID NO: 70599 - DNA, 50 bp, homo sapien
atgaaatgaaagaatgcaaaccatgyaagtctaaacaaaattggaattta

SEQ ID NO: 70600 - DNA, 50 bp, homo sapien
ttctgagacatgaaattattgggctraaaactgaaaacagtaaaatattt

SEQ ID NO: 70601 - DNA, 50 bp, homo sapien
tggtattaacatttagaagcatacargtttttttaaaggcatgaacaatt

SEQ ID NO: 70602 - DNA, 50 bp, homo sapien
aagaccatccactggttggaccgaaygactgaaacttttgaactgtttcc

SEQ ID NO: 70603 - DNA, 50 bp, homo sapien
ttaaactagttttgaagccatctaaytctactaatatgcattccttccag

SEQ ID NO: 70604 - DNA, 50 bp, homo sapien
attggcagtgacttgttacaacagcrcagacaactcacagagatggcaaa

SEQ ID NO: 70605 - DNA, 50 bp, homo sapien
cagtcccaatgtagactcataagccyaggtttgaactggttagatcattg

SEQ ID NO: 70606 - DNA, 50 bp, homo sapien
atcagcctaagaaagaaaagtatccsaacttcttcctatgtatgaagttc

SEQ ID NO: 70607 - DNA, 50 bp, homo sapien
gcacttatagcaggactgggggaaaytagtgaggccctttgcccttccgc

SEQ ID NO: 70608 - DNA, 50 bp, homo sapien
cttagtagagaaagatttctttaaayggatacaaaaagcacaaaacataa

SEQ ID NO: 70609 - DNA, 50 bp, homo sapien
attacgagaggaagataactttaacrgcatcacctgacccaggcagggct

SEQ ID NO: 70610 - DNA, 50 bp, homo sapien
caagtggaaaatttaaaaccttacargaccagtcagaaaaagaatagttt

SEQ ID NO: 70611 - DNA, 50 bp, homo sapien
ctatcctggagggccctacattcaaytggctgctaacctaacatcacttc

SEQ ID NO: 70612 - DNA, 50 bp, homo sapien
gaggtattctttgaccaaaagtaaaytgaacctgggaagatggaataaga

SEQ ID NO: 70613 - DNA, 50 bp, homo sapien
ctcaatgtaggattgcttttactatkacaaaattaattgtccaaacaata

SEQ ID NO: 70614 - DNA, 50 bp, homo sapien
caggtccctcacctgttacccaagayggttattccagattttcataattc

SEQ ID NO: 70615 - DNA, 50 bp, homo sapien
gtctaagttgcgaatttctcaattayatgaacaagactctagcggaaacc

SEQ ID NO: 70616 - DNA, 50 bp, homo sapien
tcatgagaattgagaatgagaaatarctatgcctagaattggggcttaag

SEQ ID NO: 70617 - DNA, 50 bp, homo sapien
aaacagagattagttaaattctggawgtcagtactcccttgtgatcacac

SEQ ID NO: 70618 - DNA, 50 bp, homo sapien
tccccttactaggcagctacaaccaygctttgttgtgatgggtctagcct

SEQ ID NO: 70619 - DNA, 50 bp, homo sapien
catggccatgttagcacttataacaytgtaatttttgctagactctaggt

SEQ ID NO: 70620 - DNA, 50 bp, homo sapien
gtggagcagccaaatccaaatctcaytaggtcaattactaagatactagg

SEQ ID NO: 70621 - DNA, 50 bp, homo sapien
taattttctcaggattgcaggacaaygaacatagcaggtttgggatgaag

SEQ ID NO: 70622 - DNA, 50 bp, homo sapien
aaaccagagctggcagtgtttcaacsgtcgaacatctgggcatttgtaaa

SEQ ID NO: 70623 - DNA, 50 bp, homo sapien
gctcccaaagtaggttatgctctaaytgatgagacagccaacaaatacag

SEQ ID NO: 70624 - DNA, 50 bp, homo sapien
tttcccttttttatttgaagtatcaycagttgcaaaagcaaactaaaaat

SEQ ID NO: 70625 - DNA, 50 bp, homo sapien
gctccatctcaattttctcaagccayaatgtgaggagaggaaaaaatcta

SEQ ID NO: 70626 - DNA, 50 bp, homo sapien
aatatagggaccactggggagagaayggtgttaatgaaatcaaaatgaga

SEQ ID NO: 70627 - DNA, 50 bp, homo sapien
agaactagtgctttagagattaaatragagatagcagtaataacttttct

SEQ ID NO: 70628 - DNA, 50 bp, homo sapien
aggcagtattgaatggagtcatagakaagaaagatttggaggaagacaat

SEQ ID NO: 70629 - DNA, 50 bp, homo sapien
catagcaactagcgttgcaccattakcttttattcaaatgtacaaagcct

SEQ ID NO: 70630 - DNA, 50 bp, homo sapien
atatttaccagtcaggatgctttcarctacgtgcaatctaatttaaccca

SEQ ID NO: 70631 - DNA, 50 bp, homo sapien
ttgtgcgagtcacaaagatggaatgratatggtttctgccgttgggagct

SEQ ID NO: 70632 - DNA, 50 bp, homo sapien
agagcaaagtatacaggaaatgacartgggcaataagaaaactctggaaa

SEQ ID NO: 70633 - DNA, 50 bp, homo sapien
agcatcctgactggtaaatatgataragtatatgctgacccagacctgaa

SEQ ID NO: 70634 - DNA, 50 bp, homo sapien
atcagagtttagagacttaggcattygttcttatcaggtttatctgtagc

SEQ ID NO: 70635 - DNA, 50 bp, homo sapien
ctcagcaaataatttttcagttacaratgcagggttcacattctctcttc

SEQ ID NO: 70636 - DNA, 50 bp, homo sapien
cttttgtatattaacattgtattctraagccttactctaatagtttatta

SEQ ID NO: 70637 - DNA, 50 bp, homo sapien
aactttctcaactggataacgaatayctacaaaagaacttatagctaaca

SEQ ID NO: 70638 - DNA, 50 bp, homo sapien
tgtggtcagtgaatttgccttttaakatattgaatcaggaaagcatataa

SEQ ID NO: 70639 - DNA, 50 bp, homo sapien
ttactacagtgaatatttcacagtckaattgttcataatagaaggaaaag

SEQ ID NO: 70640 - DNA, 50 bp, homo sapien
ctaggtttgaattatgtgaacaaagragttgaaaagaaagtcctaggttt

SEQ ID NO: 70641 - DNA, 50 bp, homo sapien
tagtatgcattgccttgtaaaaacaytggtcaagtcgggatgtagtcggc

SEQ ID NO: 70642 - DNA, 50 bp, homo sapien
ttaacacttcctgagaaactgctgayggtggatggagttgtaacagggat

SEQ ID NO: 70643 - DNA, 50 bp, homo sapien
atgaaacagcttagttacataataakaaaagttgatattcttgaaccaac

SEQ ID NO: 70644 - DNA, 50 bp, homo sapien
caggaagcctaaggtgatcgctctcygactcatagcactagatgctagaa

SEQ ID NO: 70645 - DNA, 50 bp, homo sapien
aaaacatatctggaagctctgcaacrgtattcaggtaacttgttttatat

SEQ ID NO: 70646 - DNA, 50 bp, homo sapien
gcaattgtcccaaaacatgcatagawcgtaagttgcaaattttgggtttg

SEQ ID NO: 70647 - DNA, 50 bp, homo sapien
aaaggggctgcagatgtacctcctayattagacctccactccagacacac

SEQ ID NO: 70648 - DNA, 50 bp, homo sapien
ggattctagaacctgcccagtattgyttggttggagcattttcttcagta

SEQ ID NO: 70649 - DNA, 50 bp, homo sapien
atatattggctgtaaccatctccatwaaagattgctaagtgaaaaaccaa

SEQ ID NO: 70650 - DNA, 50 bp, homo sapien
tgtttattaaagaactagcggtggarcataaatggatgttgaaatagaac

SEQ ID NO: 70651 - DNA, 50 bp, homo sapien
aaaaaaaaaaaaatcataagagacastactttcaggaatataatgctagt

SEQ ID NO: 70652 - DNA, 50 bp, homo sapien
cccggatggagaggaaattttgcagkcatactggaggaaaccagggctgg

SEQ ID NO: 70653 - DNA, 50 bp, homo sapien
ctacaaacacattaagctactcctcygagcaaaagccttcatcttagcat

SEQ ID NO: 70654 - DNA, 50 bp, homo sapien
ctaaaaccatcagtaagacggatcaygctaagatgaaggcttttgctcag

SEQ ID NO: 70655 - DNA, 50 bp, homo sapien
gacacagaagtactttggcgcagacyatgtcctaggttaacaataccagg

SEQ ID NO: 70656 - DNA, 50 bp, homo sapien
gactgacgtacaaggagccttaggaygacaagagcagttagctatgaagg

SEQ ID NO: 70657 - DNA, 50 bp, homo sapien
gtgtgttcaagtgcagtctctgtctratgatgcttcaaaaatagccagac

SEQ ID NO: 70658 - DNA, 50 bp, homo sapien
aacaggagagaaatttcatgctctaygttcttggtgtgaccgtgctaatt

SEQ ID NO: 70659 - DNA, 50 bp, homo sapien
taatcactataggttgctatcacttyaaactcaacttttattcagtaggt

SEQ ID NO: 70660 - DNA, 50 bp, homo sapien
gataatttttagtgacagccaaatawctgttagctgaggcaatcaatcag

SEQ ID NO: 70661 - DNA, 50 bp, homo sapien
tttgatgtgagtgtaattggtgcaayatttttagaggacaaagattagac

SEQ ID NO: 70662 - DNA, 50 bp, homo sapien
aacatttttagaggacaaagattagrcctcaaaagagtctggcccaggcc

SEQ ID NO: 70663 - DNA, 50 bp, homo sapien
tcagatgctgatgatcactgcttacyctattaaatgctcacagctcactc

SEQ ID NO: 70664 - DNA, 50 bp, homo sapien
aaatttcaaaactgcaactcttcaartcaaacaaactgagtatcacagat

SEQ ID NO: 70665 - DNA, 50 bp, homo sapien
ctctcatgccatccctttatagataygattttgagctctgggtattgagt

SEQ ID NO: 70666 - DNA, 50 bp, homo sapien
cagataattttgtcttattatctcamagattacttgtttcagccatacac

SEQ ID NO: 70667 - DNA, 50 bp, homo sapien
ttattattatttagaaatttgcactyaccattaagaatgatcaaaatata

SEQ ID NO: 70668 - DNA, 50 bp, homo sapien
tcaatagcccatcagtgtacattcaycttcccattccatgccaaggctgt

SEQ ID NO: 70669 - DNA, 50 bp, homo sapien
aggaaaaacacatattcttcagaaaygcaattgatatctaactttagaaa

SEQ ID NO: 70670 - DNA, 50 bp, homo sapien
caaattaatgagattgtgaattccarcatgctcagagtgctacctgactg

SEQ ID NO: 70671 - DNA, 50 bp, homo sapien
gctttattcctttactatttggtacyaatgcggctcaactagaaggaagt

SEQ ID NO: 70672 - DNA, 50 bp, homo sapien
tgactagaggtaaaagttcatgaaasaccagctatttgataatgacattt

SEQ ID NO: 70673 - DNA, 50 bp, homo sapien
gaaatacctactgtgtgcgttaacaygtaatttagtacatattttctctt

SEQ ID NO: 70674 - DNA, 50 bp, homo sapien
agttgtatctaaaaacctaagccaayataccttttatgactgagcacaaa

SEQ ID NO: 70675 - DNA, 50 bp, homo sapien
ggtgccaattccttaacagaatcagsaggcaatgctaaaaatatcacaac

SEQ ID NO: 70676 - DNA, 50 bp, homo sapien
ataaatatgcttaccctgcaataagraattcaactctcaaaagtcagaga

SEQ ID NO: 70677 - DNA, 50 bp, homo sapien
ctctgcccatactgacaatactgacscagttgttaactcctgtgacctca

SEQ ID NO: 70678 - DNA, 50 bp, homo sapien
aaagttatgacaacgttgcttatccygctttttaaaagttaagtatttag

SEQ ID NO: 70679 - DNA, 50 bp, homo sapien
agcaagagtatgtggagcttttcctmaacacgtgcgtgcacacacatgca

SEQ ID NO: 70680 - DNA, 50 bp, homo sapien
tccgtttcacagaatctcagaaaacmggaagtcctatggatttgcaccat

SEQ ID NO: 70681 - DNA, 50 bp, homo sapien
taggatgaattccctcttacaaactsactgttaaacacaagtacatataa

SEQ ID NO: 70682 - DNA, 50 bp, homo sapien
aacatcttcccagttctctctttaaygctatgtctatgagagttatgatt

SEQ ID NO: 70683 - DNA, 50 bp, homo sapien
tttttattttatttttattttttgcyacttatcctgaagttctaaaaatc

SEQ ID NO: 70684 - DNA, 50 bp, homo sapien
tgactcttcattgtgatgaattcaartagtccagaaatgtattcttaaaa

SEQ ID NO: 70685 - DNA, 50 bp, homo sapien
gctctgaataaggctaaccatcaaartaccaaaaacactgaataaaacct

SEQ ID NO: 70686 - DNA, 50 bp, homo sapien
ctccctaggcaatttcatcaccactsaaagctaccactttaagtacttta

SEQ ID NO: 70687 - DNA, 50 bp, homo sapien
ttctacgggaaatacaatatctgccytgcaatgttgctaaatgagacaaa

SEQ ID NO: 70688 - DNA, 50 bp, homo sapien
cataataggaattctaggcagaagcracagtataactaaagtatgatggc

SEQ ID NO: 70689 - DNA, 50 bp, homo sapien
aaacatgcagcaaaggttttgaaacyctgagagatgggaactgctacggt

SEQ ID NO: 70690 - DNA, 50 bp, homo sapien
tactcacgggaatccagttaggagaytaggcattggctgagaggagctcc

SEQ ID NO: 70691 - DNA, 50 bp, homo sapien
attgagtaggaaagattagacaaccrggtaaagaagtagttagttacagc

SEQ ID NO: 70692 - DNA, 50 bp, homo sapien
ttctgctttagaactatatgaacaarcatagtaataattatatcaatgta

SEQ ID NO: 70693 - DNA, 50 bp, homo sapien
agaggcaggaaaatgttctgagtccrctgacggcatggcaggcagcctga

SEQ ID NO: 70694 - DNA, 50 bp, homo sapien
cagcaccttgcagttccctttgttamgacttaaattggctcatttagttt

SEQ ID NO: 70695 - DNA, 50 bp, homo sapien
ttttaaatgagactgcattatatcartttttctacatgttgctttcctta

SEQ ID NO: 70696 - DNA, 50 bp, homo sapien
gccagaaagttaaacaacagtctctratttttttatttttatttttttac

SEQ ID NO: 70697 - DNA, 50 bp, homo sapien
ctaataaagatgaccttataagtgcrgtcttccaggggactactagagag

SEQ ID NO: 70698 - DNA, 50 bp, homo sapien
cacttgagactatggcagagtgagartatcaaaaagcaagcaaacatagc

SEQ ID NO: 70699 - DNA, 50 bp, homo sapien
agcattgatgctagcatattgtcatratcacttcattttattgtgagtta

SEQ ID NO: 70700 - DNA, 50 bp, homo sapien
ttctataattcggccatttcaagaaygtaatgtgagtggaatagtacagt

SEQ ID NO: 70701 - DNA, 50 bp, homo sapien
ccctccacccctccaagatctggcayggaaattctttcaattgtctcacc

SEQ ID NO: 70702 - DNA, 50 bp, homo sapien
tttaaatcatcccattcatatctcaragcaaaggtgataataaggaagtg

SEQ ID NO: 70703 - DNA, 50 bp, homo sapien
gagacaacacacttatattgtttcascaagattaacattttagagtattt

SEQ ID NO: 70704 - DNA, 50 bp, homo sapien
ctaaggtacacacaaaaaatcaccartcgttcatgttgatcatcagttgg

SEQ ID NO: 70705 - DNA, 50 bp, homo sapien
ggagctagagtgctatactgagtccsatgaaggcagtatatgttcagtaa

SEQ ID NO: 70706 - DNA, 50 bp, homo sapien
ataattgtgtgagccaaattccatartaaatctcctcataaatctatata

SEQ ID NO: 70707 - DNA, 50 bp, homo sapien
ttccaaatgtatcttctattacttcyctatatgaacattctcctccttct

SEQ ID NO: 70708 - DNA, 50 bp, homo sapien
aatgctttgtgcatgtaattgactayagagacatggcctctaacccagag

SEQ ID NO: 70709 - DNA, 50 bp, homo sapien
aacggtgggaggagcatgatctgaamtcatacagaaagttgtaatacctg

SEQ ID NO: 70710 - DNA, 50 bp, homo sapien
tctgataaactaaaacactcagaagrtatttccttgggttgaagggggca

SEQ ID NO: 70711 - DNA, 50 bp, homo sapien
cctctctaagaaccttctagtctaartaatactgaataatacttcaccac

SEQ ID NO: 70712 - DNA, 50 bp, homo sapien
tctcattctagattttaaaatctcaktactatttatacttaaatattatc

SEQ ID NO: 70713 - DNA, 50 bp, homo sapien
gtctgatgctgcaatgggcacagaaratagaagcagggagagggtgcatt

SEQ ID NO: 70714 - DNA, 50 bp, homo sapien
gccccctgtaatctgcctgcctacaracaatgataaactcccacctgccc

SEQ ID NO: 70715 - DNA, 50 bp, homo sapien
gtccaatgataattgtggctgaacayagattacaaatctcctgaggacag

SEQ ID NO: 70716 - DNA, 50 bp, homo sapien
agtgcatattgtgtgcagccatgtargctaaaataatgttgctgtcctca

SEQ ID NO: 70717 - DNA, 50 bp, homo sapien
ttttggcagcagtcgtgctgtagaakaattactaaagaaagatctacaga

SEQ ID NO: 70718 - DNA, 50 bp, homo sapien
catgtgtgacacttccatgttgacargcccggaaaggcctcatttttaac

SEQ ID NO: 70719 - DNA, 50 bp, homo sapien
tgagaagagtgaacttttctaaagarttaatgtacagagcatgagcagag

SEQ ID NO: 70720 - DNA, 50 bp, homo sapien
acacataaacacattcttccctataycattacctcgaaatgtacgtattt

SEQ ID NO: 70721 - DNA, 50 bp, homo sapien
tagcacaaggtaattgtgtcttcaaygtaccctgttggctggcgatcctg

SEQ ID NO: 70722 - DNA, 50 bp, homo sapien
gcagtgcagacatcgtcaaaattcakacaagaggaaattttcatgcagaa

SEQ ID NO: 70723 - DNA, 50 bp, homo sapien
atttttttcattttggatattccatragaaatagatggttgagcagttgc

SEQ ID NO: 70724 - DNA, 50 bp, homo sapien
aatataacttttaattttcatttcayaggtactcatttaatacactgaca

SEQ ID NO: 70725 - DNA, 50 bp, homo sapien
taaaacccacgacaattgtgtctatyctggagtttccctggcaagagaaa

SEQ ID NO: 70726 - DNA, 50 bp, homo sapien
aatagcattcatacaatggagaccartgaagttgctgaaacgaaaagtcc

SEQ ID NO: 70727 - DNA, 50 bp, homo sapien
acttcactggtctccattgtatgaaygctattgtgcccttgcccagttcc

SEQ ID NO: 70728 - DNA, 50 bp, homo sapien
ctgtggttaaggttgaatgaggtaarattaaaagtaaaagtctgggccgg

SEQ ID NO: 70729 - DNA, 50 bp, homo sapien
ccatgtttaatgacaggagaggagayggcgcaggatcactcagggaatga

SEQ ID NO: 70730 - DNA, 50 bp, homo sapien
caacatttactgaataatgtggataygaaaaaatgatatgtggtcttgat

SEQ ID NO: 70731 - DNA, 50 bp, homo sapien
ctcttcctctgtagacagcactgaartacagatcactgaaatgactgact

SEQ ID NO: 70732 - DNA, 50 bp, homo sapien
ccacaaaagaggtgcagataaagcamtaaaggaatttagaagagagtaat

SEQ ID NO: 70733 - DNA, 50 bp, homo sapien
tctagaatgagcgattaccttatcaytgccttgaattcctcatgggaccc

SEQ ID NO: 70734 - DNA, 50 bp, homo sapien
ccctgtctttcccatttacttgtggycgatgagttgtgctaactacatca

SEQ ID NO: 70735 - DNA, 50 bp, homo sapien
catttcaattgctactgtgttttgcscagagttaggacaattcatagggg

SEQ ID NO: 70736 - DNA, 50 bp, homo sapien
tcacaatttttcactgttgggtagaragcatgaaagtcgctttctagaaa

SEQ ID NO: 70737 - DNA, 50 bp, homo sapien
tgttattttgctgtagattttgtgamgttatattgcacagccaataagaa

SEQ ID NO: 70738 - DNA, 50 bp, homo sapien
tgtatatatatgtcattatgttgaaytgaatttctgttaactgtaaccat

SEQ ID NO: 70739 - DNA, 50 bp, homo sapien
tgtatatttcttcattcaatctttaratgctttttgaaaagaagagctca

SEQ ID NO: 70740 - DNA, 50 bp, homo sapien
agcattttcaaatggcttggcatacrgtacaaaaacaggctagacaaagt

SEQ ID NO: 70741 - DNA, 50 bp, homo sapien
aaagaccgtaacagaaaaagatagargtactgctataatgttctcacatc

SEQ ID NO: 70742 - DNA, 50 bp, homo sapien
gaaagaatttcagaaaagctaaagawatttgggatctaagaatattggct

SEQ ID NO: 70743 - DNA, 50 bp, homo sapien
agtaaatgcaaatttaaaatttagaygcaaaaaaagagatgctaccattt

SEQ ID NO: 70744 - DNA, 50 bp, homo sapien
atattctctagatcgttttgaattgrataaagactcttgttcttgacagt

SEQ ID NO: 70745 - DNA, 50 bp, homo sapien
tttgcaatataaaagggtgtctgtawcttaagagtgataggctatctttt

SEQ ID NO: 70746 - DNA, 50 bp, homo sapien
tacttaaaggaaaggtacaaataaascatagcaaaaaacaaatatgttta

SEQ ID NO: 70747 - DNA, 50 bp, homo sapien
ttattatgaataattttgagggttgmaattaagaagaaatggataaatgt

SEQ ID NO: 70748 - DNA, 50 bp, homo sapien
aaagaaggtagactctgtgagttccrgagattataccaacgtttaccttg

SEQ ID NO: 70749 - DNA, 50 bp, homo sapien
tttctttctatctcggatgctcttaygcttttagaattgcaaatttggca

SEQ ID NO: 70750 - DNA, 50 bp, homo sapien
cctcctaacaaccttgtgaaaataaygttcaaagaggttgcccaaagtat

SEQ ID NO: 70751 - DNA, 50 bp, homo sapien
taaaatatgcattatcttcacatgaraaggtttcagtttataaatgctta

SEQ ID NO: 70752 - DNA, 50 bp, homo sapien
tcctatagcattggatctagctttcmaaacagtgatagggaggaagtaac

SEQ ID NO: 70753 - DNA, 50 bp, homo sapien
tctcgccagttgagtaaatgctgtayataagtgcagagttttgtagatct

SEQ ID NO: 70754 - DNA, 50 bp, homo sapien
tattgagacttcctttatgaccaaamatgtggttgatcttggagaatgtt

SEQ ID NO: 70755 - DNA, 50 bp, homo sapien
tcaatgtctgtcaaagggaggttgaygaaatattatgcaactctttaaaa

SEQ ID NO: 70756 - DNA, 50 bp, homo sapien
tagattcttcctgagaaaacagtgayctgcagcacaaactgattatgcca

SEQ ID NO: 70757 - DNA, 50 bp, homo sapien
gttaggaagctgtctttataacaacrgagacgtgaaaattatggttcccc

SEQ ID NO: 70758 - DNA, 50 bp, homo sapien
catgactcaatcaatgaatggatggmaaatccactcatgtcatcgagaca

SEQ ID NO: 70759 - DNA, 50 bp, homo sapien
aggcagcagaagcatcattggtgcaratgcaggtattgtaactgctattc

SEQ ID NO: 70760 - DNA, 50 bp, homo sapien
tcaagtgttccaaatacaatttgcaytaaaaagattggcattattttcct

SEQ ID NO: 70761 - DNA, 50 bp, homo sapien
aaaatagctcacgtgaatcattgtaraggccagaatatgtagagacttga

SEQ ID NO: 70762 - DNA, 50 bp, homo sapien
ttgttttggtttctcttttagcagcyctattccagaaacttaatatggta

SEQ ID NO: 70763 - DNA, 50 bp, homo sapien
ggaactaagtgaaattcttgcttaaytatgtctgattctatgctttttat

SEQ ID NO: 70764 - DNA, 50 bp, homo sapien
gaggggagcaaatcatgttaaagggyagtaacagccaacatgacacagtg

SEQ ID NO: 70765 - DNA, 50 bp, homo sapien
agagcataaggaaattaaatataatmatatggcctcagtaaacagaaaaa

SEQ ID NO: 70766 - DNA, 50 bp, homo sapien
gctcttcataaaaatgttgttaaatyaattagtggtataaacaaaataat

SEQ ID NO: 70767 - DNA, 50 bp, homo sapien
atactcatgatttaataccgtacttsaaacagctgcacctggaaactgag

SEQ ID NO: 70768 - DNA, 50 bp, homo sapien
cccctcacctggacttcgacattctmaaatctgcaactatccatttatag

SEQ ID NO: 70769 - DNA, 50 bp, homo sapien
ttcttaaatacatctattcagtaagwcacactaaagcaatggttctcaaa

SEQ ID NO: 70770 - DNA, 50 bp, homo sapien
aagtcctcaattcattaaaagagcayctgtgaaaatatatgtataaaact

SEQ ID NO: 70771 - DNA, 50 bp, homo sapien
tttgctatatttcagaatagtattcmcatttgaagttttatacatatatt

SEQ ID NO: 70772 - DNA, 50 bp, homo sapien
ctatctttgatgttctgaaatttcartacgatggtttaagtattcctttt

SEQ ID NO: 70773 - DNA, 50 bp, homo sapien; identical to SEQ ID NO: 70612

SEQ ID NO: 70774 - DNA, 50 bp, homo sapien
ctgtctctcccattagcttacaacckctatgagggcagagaacatgtctg

SEQ ID NO: 70775 - DNA, 50 bp, homo sapien
gagccaccgcacccggcctataacgracagtcttgattcgccttcgcagc

SEQ ID NO: 70776 - DNA, 50 bp, homo sapien
ccagaaactgaatcaaaggcaatgaraatatttatgacaaaacacattat

SEQ ID NO: 70777 - DNA, 50 bp, homo sapien
caccaagactataatccctgagtccratagtgtattttcttttaaaaaga

SEQ ID NO: 70778 - DNA, 50 bp, homo sapien
ttgttaatataaaagtgtagcaccaygtattgacctcatgtagcatcaag

SEQ ID NO: 70779 - DNA, 50 bp, homo sapien
tttctaagccaacaaaggagaagttytggctctgagatcagattagtttt

SEQ ID NO: 70780 - DNA, 50 bp, homo sapien
tgggagctttgaatgtcaatataaarccttatttgcacagttgtgcactt

SEQ ID NO: 70781 - DNA, 50 bp, homo sapien
tatatcataacacatatcataccaasaacacatcagctgccaaaagaaag

SEQ ID NO: 70782 - DNA, 50 bp, homo sapien
cttgaattttttatctcatgccaagrctaagacatataattgaaaaaatg

SEQ ID NO: 70783 - DNA, 50 bp, homo sapien
aggaggtgctgatgtctcagtcttcrtctactttctcagtcttgatccac

SEQ ID NO: 70784 - DNA, 50 bp, homo sapien
atattttttaaaattagtcagaacayggaaataaggcaaaggatggcaca

SEQ ID NO: 70785 - DNA, 50 bp, homo sapien
atgctgaagagttgaattctcatgckcagccacggaagtagcaaggatgc

SEQ ID NO: 70786 - DNA, 50 bp, homo sapien
catgaggatagactggatgccaatayatggttcttcttccttggcaggag

SEQ ID NO: 70787 - DNA, 50 bp, homo sapien
cagtagctataatatttatgtgatgraatagtcaagtataaaataatatt

SEQ ID NO: 70788 - DNA, 50 bp, homo sapien
ttctaaaagccatcatatttggatastaaagaagtcaaaaacaggttgtc

SEQ ID NO: 70789 - DNA, 50 bp, homo sapien
tatgaatatttctaagacgtgtgtasgtgtatatgtgtgcttcctcactc

SEQ ID NO: 70790 - DNA, 50 bp, homo sapien
attcccagtttataaattaaaattargtaatcaccacagacagtaccacc

SEQ ID NO: 70791 - DNA, 50 bp, homo sapien
tgctgttgctggtaacttttatcackaagttaagatttctacagaactaa

SEQ ID NO: 70792 - DNA, 50 bp, homo sapien
aacactaagtcatgcacagaaaataygggaaatctcactcaaatatggaa

SEQ ID NO: 70793 - DNA, 50 bp, homo sapien
tgtgaaagctggtagtacacctaagscatcctcttcaaaatcttcagaaa

SEQ ID NO: 70794 - DNA, 50 bp, homo sapien
taaagagtgtttcattctttagctgrtaagttgattaaagtaaacactgg

SEQ ID NO: 70795 - DNA, 50 bp, homo sapien
agatatttctatcaatcgtgactgayccttacaagagtgattagaagccc

SEQ ID NO: 70796 - DNA, 50 bp, homo sapien
tttttagtttcagccagcattatgasccttacttaattatcactcttacg

SEQ ID NO: 70797 - DNA, 50 bp, homo sapien
gttctcacttttcattgccttattaygatctgtgtgtatgggcttgtttc

SEQ ID NO: 70798 - DNA, 50 bp, homo sapien
ttggcagagtttagggagtcaatcaygtggctatttgcctccaaagctcc

SEQ ID NO: 70799 - DNA, 50 bp, homo sapien
tgaaacgtgaagaatggaataggtgwaattcatcaaaatgttatgtcatc

SEQ ID NO: 70800 - DNA, 50 bp, homo sapien
agactaggaaagaaagttgaaatgamattgtctattgatataaaaaggag

SEQ ID NO: 70801 - DNA, 50 bp, homo sapien
ggctatcacttccttttttttgctaygagaatgctctattaggcaaaacc

SEQ ID NO: 70802 - DNA, 50 bp, homo sapien
tcttttccctccaaggcagctggatyagttatatttcacctggagtccat

SEQ ID NO: 70803 - DNA, 50 bp, homo sapien
aattctacctcatcggatctcgtaargagttatttccctgtattctcttt

SEQ ID NO: 70804 - DNA, 50 bp, homo sapien
aggagagagcactgtgggaattcaartccgtttcaaaaccaagttttcgt

SEQ ID NO: 70805 - DNA, 50 bp, homo sapien
tgtgaaatgagcaagctgctgagtayggggtgagtagtgattacatatac

SEQ ID NO: 70806 - DNA, 50 bp, homo sapien
cactaggtgtcaaaaaatagaactaraagtcaacaagtgatctaaaacaa

SEQ ID NO: 70807 - DNA, 50 bp, homo sapien
tttactagaaattcatatctactaawgtgtttggatttattctgaagact

SEQ ID NO: 70808 - DNA, 50 bp, homo sapien
ctatttaatatcttttgagaaatgaraacagtaaatattttcagagtttt

SEQ ID NO: 70809 - DNA, 50 bp, homo sapien
acttcaatcttcaatcttaaagcaayttctgttctatggactgagcgatg

SEQ ID NO: 70810 - DNA, 50 bp, homo sapien
cttaggaaatgtaagatgtctaatarctgccaatcaattgtactattgtt

SEQ ID NO: 70811 - DNA, 50 bp, homo sapien
ataattttccactggctggttccaaytacctaataaagcagaggagaaaa

SEQ ID NO: 70812 - DNA, 50 bp, homo sapien
cgatcaagtaatttttgagtgaaaayatcaagtagataaaaatcccaaga

SEQ ID NO: 70813 - DNA, 50 bp, homo sapien
cccatgttttctggcaagtttttatyaggccttcctcctttacatttctt

SEQ ID NO: 70814 - DNA, 50 bp, homo sapien
ttggtatttctcgttatcaagcatakgtggtatagtagcagaagtcaaaa

SEQ ID NO: 70815 - DNA, 50 bp, homo sapien
tttgttttgtttttttctcttttcasgtctgttagatacttaaagggcat

SEQ ID NO: 70816 - DNA, 50 bp, homo sapien
aaataccaaacgtgtgacaactatamaactacaccatcatatattatctc

SEQ ID NO: 70817 - DNA, 50 bp, homo sapien
atacgacttcaaaaatatgctaagaygcttgacttattaaggactttaac

SEQ ID NO: 70818 - DNA, 50 bp, homo sapien
ctcatcgctgcatcatatttctaccsatggtgttgttgctgaaagggccc

SEQ ID NO: 70819 - DNA, 50 bp, homo sapien
aacgaatccctgattagtttgcaagkagtagctagtagacttctgtgtca

SEQ ID NO: 70820 - DNA, 50 bp, homo sapien
tggcatcgaaggaaatcccaagtaarctggaagcacaattaggtcaggga

SEQ ID NO: 70821 - DNA, 50 bp, homo sapien
aaagtgagggaaataaaataggaaartgaatattggatttggaagcaagg

SEQ ID NO: 70822 - DNA, 50 bp, homo sapien
ctacccgctaccaggctcactctcayggtggttctggggatgatgtgcac

SEQ ID NO: 70823 - DNA, 50 bp, homo sapien
acgtggggcgtcctagccttcggacygggaacctgataggagacgaatag

SEQ ID NO: 70824 - DNA, 50 bp, homo sapien
catcattctagagtccctggagggtygtgaatagcagtgccctgcaggcc

SEQ ID NO: 70825 - DNA, 50 bp, homo sapien
gggatttcatgaagactgtttttggrcatctgttcctggcggggtggctc

SEQ ID NO: 70826 - DNA, 50 bp, homo sapien
ttcttaaaaatccaattagaaaaccrgtagtaggcaaaaccataaacaga

SEQ ID NO: 70827 - DNA, 50 bp, homo sapien
gttcataaccaatatgaaatttagcrgaagtaacttgacctcatggaatt

SEQ ID NO: 70828 - DNA, 50 bp, homo sapien
aaatccttacaggagcatctaggaayggtttttccagacaatttagtttt

SEQ ID NO: 70829 - DNA, 50 bp, homo sapien
atgttgattaataaaaggcacataarcagcaaactaatatagtctggctc

SEQ ID NO: 70830 - DNA, 50 bp, homo sapien
taaggaaaggaatgaatgattccggraagttaacttgtattcaattgacc

SEQ ID NO: 70831 - DNA, 50 bp, homo sapien
aatgtttgcttgtttgtggcctttasttatgcagtataggagaggtaata

SEQ ID NO: 70832 - DNA, 50 bp, homo sapien
gaaaacctaatttaggagtatattcyggtaacaaagagctaaaagtctca

SEQ ID NO: 70833 - DNA, 50 bp, homo sapien
ccagtgatgtcaacttatgaggatarctaatacattggccatgcatcagg

SEQ ID NO: 70834 - DNA, 50 bp, homo sapien
tgacctcttctggtttccattggcartcgagtggaaaactgcttttagca

SEQ ID NO: 70835 - DNA, 50 bp, homo sapien
ctcctaccaggatttgcctgcaaacyactcttctccctcactgcctgctt

SEQ ID NO: 70836 - DNA, 50 bp, homo sapien
gcagcagaagaaaaggttacagataycaggtaccaggcagcgggaaaaaa

SEQ ID NO: 70837 - DNA, 50 bp, homo sapien
ttgattgcctgatcatgacactaaayaaatgtcttctttaaaaaatgttt

SEQ ID NO: 70838 - DNA, 50 bp, homo sapien
atcatcacagtggttttgattcactraacttctgcaggggtggtcgataa

SEQ ID NO: 70839 - DNA, 50 bp, homo sapien
ctaagttctgatatctgcattgctcrccagacatgtatgtcaaggacctt

SEQ ID NO: 70840 - DNA, 50 bp, homo sapien
atcaatagtcattatgtcaaaattayagaaggctattaatggatttaaaa

SEQ ID NO: 70841 - DNA, 50 bp, homo sapien
attcaacacattctgaacacctactrtgagtcacgagccagggttaacct

SEQ ID NO: 70842 - DNA, 50 bp, homo sapien
tcaatagaagtcatgctttcagttaytttggataaatatccaaaagtagg

SEQ ID NO: 70843 - DNA, 50 bp, homo sapien
gggccaggtaaggagcagtaggcctrgcaaggagagagaggagctggtga

SEQ ID NO: 70844 - DNA, 50 bp, homo sapien
caactaggattattgctaaaagcccrgacattttaatgcctatttctcta

SEQ ID NO: 70845 - DNA, 50 bp, homo sapien
atgtgaaaaatagtacagtctgttasaatggctcatgcctgtaatcccag

SEQ ID NO: 70846 - DNA, 50 bp, homo sapien
agtgaccacagtatttccaactaggkaaagaaagcaaaagttaaaaaaaa

SEQ ID NO: 70847 - DNA, 50 bp, homo sapien
tttaacatacatagcgataaatccartggaaactcccaaatacttctata

SEQ ID NO: 70848 - DNA, 50 bp, homo sapien
ctataatcaaggaaaaaagtagtcartagaaatgggtattgagggtcagg

SEQ ID NO: 70849 - DNA, 50 bp, homo sapien
tttccccagcggaatgaagaaaaagscaatattgaaagatgtgtgagagc

SEQ ID NO: 70850 - DNA, 50 bp, homo sapien
tgtggatgatgtattgcagggagttkgtatgacactgtcttcctttaatg

SEQ ID NO: 70851 - DNA, 50 bp, homo sapien
aatctagaaatagtgattgttaaaaytgcctataagtacacaatataaac

SEQ ID NO: 70852 - DNA, 50 bp, homo sapien
cacagaacagggacatgtgtagaaasgtgtatggcccttgggaggtggtg

SEQ ID NO: 70853 - DNA, 50 bp, homo sapien
catttcagatatcatttggattaackgctcacctcatgccaaaaccctgt

SEQ ID NO: 70854 - DNA, 50 bp, homo sapien
tcacgtcaactgacaattattataastgaaatggtacatagagatgtcag

SEQ ID NO: 70855 - DNA, 50 bp, homo sapien
ttgtcaataactttattaaatcccawtcttaagacaacaagcctataaga

SEQ ID NO: 70856 - DNA, 50 bp, homo sapien
gcttacaaagagcagggctgggtagraataagaaattcaaaggaggtgag

SEQ ID NO: 70857 - DNA, 50 bp, homo sapien
ttttagaaacgtttttacatgttaaytgatattcttttgcattatcctga

SEQ ID NO: 70858 - DNA, 50 bp, homo sapien
agagcaatgtttcctgtagggtccaytgcatcgaggctacggcagagctc

SEQ ID NO: 70859 - DNA, 50 bp, homo sapien
cacctacttagtgcatccatggaagrcattctacccagagtcataagaga

SEQ ID NO: 70860 - DNA, 50 bp, homo sapien
aattagtatcgaatcctattcttaargatgaggaacctgagtactggaga

SEQ ID NO: 70861 - DNA, 50 bp, homo sapien
taagatattactcgcttatccagaayagcctacgagaagcaaagtttaat

SEQ ID NO: 70862 - DNA, 50 bp, homo sapien
aaaggcacgttgaattgtctctatayggattacatcacattttcttaaaa

SEQ ID NO: 70863 - DNA, 50 bp, homo sapien
gaataaacatgtttcgaaaagtgtcraatgctatagcagtataacaatta

SEQ ID NO: 70864 - DNA, 50 bp, homo sapien
gccgtatgtaaactataatgtttcasgtaaatataagttaaccatgttat

SEQ ID NO: 70865 - DNA, 50 bp, homo sapien
gagttgctttcactcaaaactaaaamtatcctccttattccagctattct

SEQ ID NO: 70866 - DNA, 50 bp, homo sapien
acaattagcttcagaagaagaaatayacgtacaacactgctaataccatt

SEQ ID NO: 70867 - DNA, 50 bp, homo sapien
attcttttgctctctcttctatgtayctatcatgtcaacgtatgtgtgtc

SEQ ID NO: 70868 - DNA, 50 bp, homo sapien
gagatttaaagaaggggctgtttatraagacatgggcagtgtttttttgt

SEQ ID NO: 70869 - DNA, 50 bp, homo sapien
ttgtatttacatagatggaagatatraattgagatgaactgtactgataa

SEQ ID NO: 70870 - DNA, 50 bp, homo sapien
atatcctatattagagggaattcacrgagctatgattctgcttgtcctta

SEQ ID NO: 70871 - DNA, 50 bp, homo sapien
cttgggcacacagcagctggtatgamctcagagcttttgctttctttctc

SEQ ID NO: 70872 - DNA, 50 bp, homo sapien
aaaggaaggacctagaagtctgcatragatttcccaaggatccttggctg

SEQ ID NO: 70873 - DNA, 50 bp, homo sapien
tttaacacagaagtgacttgttataygatttctgcaagaaaaccattttg

SEQ ID NO: 70874 - DNA, 50 bp, homo sapien
tcaaattcaattggccttagaattayagaaggttagagctgagtcttaag

SEQ ID NO: 70875 - DNA, 50 bp, homo sapien
ctatgaggcagttcacatgaggccartaaacctggtgtaaacaaaccatc

SEQ ID NO: 70876 - DNA, 50 bp, homo sapien
gggatttgttccataaagaataaacmagcaaagattgagattatacttag

SEQ ID NO: 70877 - DNA, 50 bp, homo sapien
accaaagtatttttaagaatgtcaartagtgcttatgtatggctattaac

SEQ ID NO: 70878 - DNA, 50 bp, homo sapien
ttctcctcttgtgtcttccacattcygttgatggttgaaacaaaacttat

SEQ ID NO: 70879 - DNA, 50 bp, homo sapien
aagatggagacttcacaggctatcartcacaaacctgggagggaaacatc

SEQ ID NO: 70880 - DNA, 50 bp, homo sapien
  misc_feature (7)..(7): n is a, c, g, or t
aaattanacacagaaaaaggattaayaaattcagacaggttaatagaaaa

SEQ ID NO: 70881 - DNA, 50 bp, homo sapien
tcaccctcaaagtgatcacaacttaraggaactcaaatagacatcaacaa

SEQ ID NO: 70882 - DNA, 50 bp, homo sapien
tacagattaaatctatgaagaacaaytgctaaataataaagcaaaaaata

SEQ ID NO: 70883 - DNA, 50 bp, homo sapien
gaactacctgggactgattttcttcyctctcttttatattttcatggaat

SEQ ID NO: 70884 - DNA, 50 bp, homo sapien
gattcagcaggtctgtgtgtacggcragcatttgttagaagtacaaattc

SEQ ID NO: 70885 - DNA, 50 bp, homo sapien
gcaattctgattctccaattctccartaagttgcccctacatgttcactt

SEQ ID NO: 70886 - DNA, 50 bp, homo sapien
aaataactaaatagatgattaagctraatagaccaaaaaagtcaattcat

SEQ ID NO: 70887 - DNA, 50 bp, homo sapien
cagcacaaaatggactaagacaaagrccaaacctgaatgtcataaataat

SEQ ID NO: 70888 - DNA, 50 bp, homo sapien
gtctttgggtgctttggatatttggrttccagtcctttatgtgaatttct

SEQ ID NO: 70889 - DNA, 50 bp, homo sapien
aaagtgggatgtaagatggctcaagyatgtacgacgttttcagtttcaat

SEQ ID NO: 70890 - DNA, 50 bp, homo sapien
atctctttactgacaaacagtattaycattattttcaaactcattcaatg

SEQ ID NO: 70891 - DNA, 50 bp, homo sapien
catcacaaaatggcatttcaacatgsaatggatgaggaaccgtctccaaa

SEQ ID NO: 70892 - DNA, 50 bp, homo sapien
ggaacactgagatcagtctctggaaygtgggatctaattccatcttttta

SEQ ID NO: 70893 - DNA, 50 bp, homo sapien
ctctcaatttcaaggttgaacatcaygaaaacaaaatgcatacatattta

SEQ ID NO: 70894 - DNA, 50 bp, homo sapien
actcacttaattgctgaggtgtgacracaaaacatattagtaaatttata

SEQ ID NO: 70895 - DNA, 50 bp, homo sapien
ttgagaattttttttctctgatagamtacatgttccatgaaggcagggat

SEQ ID NO: 70896 - DNA, 50 bp, homo sapien
ctaaatattatagaattaatcctaaygtcagtatgaaggggtaaaaaagt

SEQ ID NO: 70897 - DNA, 50 bp, homo sapien
ctgtaatcctcttacacacattgagwccattttaacatctttgtatctac

SEQ ID NO: 70898 - DNA, 50 bp, homo sapien
gggcgaagtactgtgttgagcactayggtagatacaaagatgttaaaatg

SEQ ID NO: 70899 - DNA, 50 bp, homo sapien
ttcttagtaatatttctttgcattcyaaggtttatcgctctaatcccaca

SEQ ID NO: 70900 - DNA, 50 bp, homo sapien
cacatttactttccctaagtggtaaratcttgatttctttgtgtaaactt

SEQ ID NO: 70901 - DNA, 50 bp, homo sapien
gaaggcattcaggtctcagtttggawcacaggtagtacgtaaagcctgag

SEQ ID NO: 70902 - DNA, 50 bp, homo sapien
catatttaatagcagccctgatttawaatagtgggaattaggtgatcctg

SEQ ID NO: 70903 - DNA, 50 bp, homo sapien
attccaactgtactgtgctctgttaygatttattgccatccaattttttc

SEQ ID NO: 70904 - DNA, 50 bp, homo sapien
ctaaatgtaaaattgtagagcatccrctagagttttgctttcatcccagc

SEQ ID NO: 70905 - DNA, 50 bp, homo sapien
tgacttacacaactatcaaatgctgwaggggaagctatacaaattgacaa

SEQ ID NO: 70906 - DNA, 50 bp, homo sapien
ttcacagcttttagacgcatcactcstatatctgcctccgcctctgcatg

SEQ ID NO: 70907 - DNA, 50 bp, homo sapien
aggtcttagtaactttttgttgactyacacaactatcaaatgctgaaggg

SEQ ID NO: 70908 - DNA, 50 bp, homo sapien
gagtttgatcaatagtggagctaaayttatatataggggagacgtaagaa

SEQ ID NO: 70909 - DNA, 50 bp, homo sapien
tggcaaatattaactctttgcagatyactaaagcaacagtaaagactttg

SEQ ID NO: 70910 - DNA, 50 bp, homo sapien
cacctcccagtgtaagatctcaaacrgtatgcaagaaatcaattagatga

SEQ ID NO: 70911 - DNA, 50 bp, homo sapien
attcttaagagttctaggattttcaraataaacaatgagcatcggcttcc

SEQ ID NO: 70912 - DNA, 50 bp, homo sapien
agatagaaacttaaatataaagtacscggaagtcaaaatgtttgaaatga

SEQ ID NO: 70913 - DNA, 50 bp, homo sapien
aagaaaaactcctgattaggagtctraaatacgaaggaagttggttaaga

SEQ ID NO: 70914 - DNA, 50 bp, homo sapien
aaagatgcctgtgatctaggaggaaycagtgccttcagcccagtatcaag

SEQ ID NO: 70915 - DNA, 50 bp, homo sapien
gtgggtgctaattgtctaatattaaygcacatagagtgaagacagatgca

SEQ ID NO: 70916 - DNA, 50 bp, homo sapien
cccaagcttcttgaatttacaactcrctgaaagaaagaggggaaagagct

SEQ ID NO: 70917 - DNA, 50 bp, homo sapien
agtagggggcatctgagcagtagccrgagagcagatcatgtagggctttg

SEQ ID NO: 70918 - DNA, 50 bp, homo sapien
ttatggccttatctgaaatcacctcraatgatatttaccagttagtactt

SEQ ID NO: 70919 - DNA, 50 bp, homo sapien
aacttcttcctgggttttgccaagayagtttagaatttcagcattggctg

SEQ ID NO: 70920 - DNA, 50 bp, homo sapien
atctggctacccacacctggatttakgttcccatggcccacaactgaaaa

SEQ ID NO: 70921 - DNA, 50 bp, homo sapien
tgtcttctgacactggaatctaacaytaatacatttatatatatacaaat

SEQ ID NO: 70922 - DNA, 50 bp, homo sapien
actattatagaagacaggttgtatakgtatctccataatctgatatatat

SEQ ID NO: 70923 - DNA, 50 bp, homo sapien
cagagtataaaactccagtcacaaaktcccttttcttattctttttgcaa

SEQ ID NO: 70924 - DNA, 50 bp, homo sapien
tggagggatcattcaagtataatgcrccctcattaggatccaaaaggatc

SEQ ID NO: 70925 - DNA, 50 bp, homo sapien
tcactcaacaggtttcaatgggggarcaaataacaatacgcaaggttaat

SEQ ID NO: 70926 - DNA, 50 bp, homo sapien
cttcttatgttttagctcccaagtgyatagaactgctacctgagaaggtt

SEQ ID NO: 70927 - DNA, 50 bp, homo sapien
aatgagaagcagttgaagggctgagkattcctagttaatgaggagtcaaa

SEQ ID NO: 70928 - DNA, 50 bp, homo sapien
cctgaaatactccagatggatggctsacataaccaaatagggctatttat

SEQ ID NO: 70929 - DNA, 50 bp, homo sapien
ctgatacattaattatgcaaaaatgrcaaatcctcttttctaaagctaaa

SEQ ID NO: 70930 - DNA, 50 bp, homo sapien
tccacttccctggaattttcctgtgyaccctgggtctaccctttagacct

SEQ ID NO: 70931 - DNA, 50 bp, homo sapien
tccttttccctcctaactttagaaakgtttgcgagattaaagcagggtta

SEQ ID NO: 70932 - DNA, 50 bp, homo sapien
tgaagaacctctggacatatactgarggcttaaccttgaatatggataaa

SEQ ID NO: 70933 - DNA, 32 bp, homo sapien
cccaaggatccttagarataataaatcactgt

SEQ ID NO: 70934 - DNA, 50 bp, homo sapien
tgataattaaactctataaaaattakcccatgctagtaaccatgacactg

SEQ ID NO: 70935 - DNA, 50 bp, homo sapien
ctgtaagataatgttgacctagttaraaattgagaacaggcaaaatgaaa

SEQ ID NO: 70936 - DNA, 50 bp, homo sapien
ttctcttaactttttagggccccgckcaaagcactatataaaactccgga

SEQ ID NO: 70937 - DNA, 50 bp, homo sapien
gagtatatttatgaaaatggaactckgaaacatattgccaaactgtccct

SEQ ID NO: 70938 - DNA, 50 bp, homo sapien
agaaacttaaataaacagactactamatttgtctacataaagtatggcta

SEQ ID NO: 70939 - DNA, 50 bp, homo sapien
caaaggagtgagtttagctttagacmatttgaatttgaaatgtttgtggg

SEQ ID NO: 70940 - DNA, 50 bp, homo sapien
tgttttctaaatgcactcctcttccracctttcgtcataaactgagacta

SEQ ID NO: 70941 - DNA, 50 bp, homo sapien
gcatttgaaattcttctgaagatgamtcctatgttttcagtcctcctctc

SEQ ID NO: 70942 - DNA, 50 bp, homo sapien
ttgataggattagctatgtagtatgyattatgtggagggattagctagct

SEQ ID NO: 70943 - DNA, 50 bp, homo sapien
gcctaaaatttttaaactcactttayccaaaacttcagaaaggaaaaaaa

SEQ ID NO: 70944 - DNA, 50 bp, homo sapien
aggaagctttgctccttttacttcaygccaatttgatcaatagtgtttac

SEQ ID NO: 70945 - DNA, 50 bp, homo sapien
ctatagcccatcagccatctttacaraagaccaaacccaggaagtggcct

SEQ ID NO: 70946 - DNA, 50 bp, homo sapien
agacagaaaagttatcaaggattcayaccaaagaccatttgccaaggact

SEQ ID NO: 70947 - DNA, 50 bp, homo sapien
agcaatagagaccatattccaattcraagtaactattatcaagtgctcac

SEQ ID NO: 70948 - DNA, 50 bp, homo sapien
gcatgtttgattttgttctatgaaayatggatttgctcagaagaatcctc

SEQ ID NO: 70949 - DNA, 50 bp, homo sapien
tgatgcttttgtctcatttgtctcaraattatttccttcacattgacttt

SEQ ID NO: 70950 - DNA, 50 bp, homo sapien
atttaaacttggagttgatttcaacyggactaagccaatttcaatagtgg

SEQ ID NO: 70951 - DNA, 50 bp, homo sapien
acatgccagagctgccttgaccaatyattgaagtaggtgtcaaatgactc

SEQ ID NO: 70952 - DNA, 50 bp, homo sapien
tctgtctctaggtgctagcgattctraacagatatctattccaaaacgta

SEQ ID NO: 70953 - DNA, 50 bp, homo sapien
ttaacctttctttccagctgaaacaraatattaagcagttagaagtgatc

SEQ ID NO: 70954 - DNA, 50 bp, homo sapien
ttgtcattaaatccaaggaaacagarcctgtggtggctcctgccccggaa

SEQ ID NO: 70955 - DNA, 50 bp, homo sapien
tctctttctctttgtgaccttgcctygtcagtgttctgttcctactgttt

SEQ ID NO: 70956 - DNA, 50 bp, homo sapien
ttctaggctgcggtgaggattccacratgttggtgaagagatcagcacac

SEQ ID NO: 70957 - DNA, 50 bp, homo sapien
gaaaccttgcatataagaataagaaygtcttccatttcaagactgtgcac

SEQ ID NO: 70958 - DNA, 50 bp, homo sapien
cagaggacactgatcaagcacttacratcttccagtgaaacccctattga

SEQ ID NO: 70959 - DNA, 50 bp, homo sapien
aatagatatggagatccttacataaygcttgcaaattcagaaccaatcat

SEQ ID NO: 70960 - DNA, 50 bp, homo sapien
agaaagtaagtctttattgatggcaycgcacttgcctatattctagagct

SEQ ID NO: 70961 - DNA, 50 bp, homo sapien
tataatcgctgtcttgcatttattckcagtgaacttacccctctctcttc

SEQ ID NO: 70962 - DNA, 50 bp, homo sapien
gctagtacaagaaaagaaataagatyggagaagaacaaaatgaaattaaa

SEQ ID NO: 70963 - DNA, 50 bp, homo sapien
tacctatggaaaggaaaagagagccygctttatgcactttaatttcacca

SEQ ID NO: 70964 - DNA, 50 bp, homo sapien
actgtaacttcttaaaggtatgaacyaagtcttattgcctttgtatctcc

SEQ ID NO: 70965 - DNA, 50 bp, homo sapien
aagaactataagcaactgtatacaaycttgcaaattattacttaaaatcc

SEQ ID NO: 70966 - DNA, 50 bp, homo sapien
acacctatggcgtgatcatggactayttcatgtcttaagttacaaatgga

SEQ ID NO: 70967 - DNA, 50 bp, homo sapien
agattggggtctcaaagctgattggracctttgaataaatgggtaagtgt

SEQ ID NO: 70968 - DNA, 50 bp, homo sapien
ttattgggatagatgaacttggtgayggaaataagttacatattgtttag

SEQ ID NO: 70969 - DNA, 50 bp, homo sapien
tgcctgtcctgcggatgtctactgartctaaaggaatgctcatttcctaa

SEQ ID NO: 70970 - DNA, 50 bp, homo sapien
agtcagtttccatcgcatcttgctawtagatgagcccaagtcaagaaaca

SEQ ID NO: 70971 - DNA, 50 bp, homo sapien
ttaagccccagatttatgaagtctamgaaaatcaaaattttatcaaaaaa

SEQ ID NO: 70972 - DNA, 50 bp, homo sapien
tgaaatagagacactggcaaagagayaatattagagtagagggataggga

SEQ ID NO: 70973 - DNA, 50 bp, homo sapien
tctttgtgatgccagcaggtacttaygttcaatgtctggatcagttattt

SEQ ID NO: 70974 - DNA, 50 bp, homo sapien
tcccatggatctagccagtggaacaygaaggagaaggcagagaaggcctt

SEQ ID NO: 70975 - DNA, 50 bp, homo sapien
ctccacgtcaatatatgtagcctaastcgtatgttattaatagaagcatg

SEQ ID NO: 70976 - DNA, 50 bp, homo sapien
tagaaagagtaatctttgtctgtcayatatatttcaaatattttttccag

SEQ ID NO: 70977 - DNA, 50 bp, homo sapien
catacagctatttaaaaagtggaackgctgatacacacaacatgggatct

SEQ ID NO: 70978 - DNA, 50 bp, homo sapien
gggaagctccatcactaagtctaatrgttcctactgccagaatagaagac

SEQ ID NO: 70979 - DNA, 50 bp, homo sapien
atatggacgtggtcatagaggtggasaatcataaaattgtcagctcattg

SEQ ID NO: 70980 - DNA, 50 bp, homo sapien
tcataaaattgtcagctcattgatayaaattttaccagcctccctactgc

SEQ ID NO: 70981 - DNA, 50 bp, homo sapien
cttggttaatatgtaaaatgtcaccratgttttaaacctacagacccggg

SEQ ID NO: 70982 - DNA, 50 bp, homo sapien
caatgaaactctaaattgcaaatcakaatgtagaaatcttaagtagaaaa

SEQ ID NO: 70983 - DNA, 50 bp, homo sapien
ggggagggggactgattgttttgccyaagaaacagcagcccttgctctgc

SEQ ID NO: 70984 - DNA, 50 bp, homo sapien
tgcgggaccatttggacagtttcaargaactctggatccattccaccatc

SEQ ID NO: 70985 - DNA, 50 bp, homo sapien
aatgtttgaaactgtcaagtcaaaartagatatgtatgtctgtctttaga

SEQ ID NO: 70986 - DNA, 50 bp, homo sapien
aagtcctattaatgtgagctatgacyattgctttgacatttgtgatattg

SEQ ID NO: 70987 - DNA, 50 bp, homo sapien
ggctgagccagatgcaactggtaacyagataactaggtaacaagcccaac

SEQ ID NO: 70988 - DNA, 50 bp, homo sapien
agagaagagcttcacaaatttctgcyagttgtatatatatggtgtattca

SEQ ID NO: 70989 - DNA, 50 bp, homo sapien
aagaagttgaggttcatggaagtcartgaatcacgtatgtctctcctccc

SEQ ID NO: 70990 - DNA, 50 bp, homo sapien
gcaggggtttattactgacagcacaygaagggaaatggaaagccatgctg

SEQ ID NO: 70991 - DNA, 50 bp, homo sapien
ccctccactaaaatcttttttctcaragtaaccaatgaccttcgcatttc

SEQ ID NO: 70992 - DNA, 50 bp, homo sapien
acaattttcactgtttcagtgttaaygctagtatcttcaatgtttataaa

SEQ ID NO: 70993 - DNA, 50 bp, homo sapien
gtcaatctgcgctgctcagtgctgcyatctaaaagactagctcagaaggg

SEQ ID NO: 70994 - DNA, 50 bp, homo sapien
taagaaaatgcctcctgattggtaaraatctggagacctctcctcctttg

SEQ ID NO: 70995 - DNA, 50 bp, homo sapien
tggattttgagtaaagcagattgccyaccataatgtaagtgagcctcatg

SEQ ID NO: 70996 - DNA, 50 bp, homo sapien
ctgtctcttttacaaattttgagagyagagaatagactatgtcttatgag

SEQ ID NO: 70997 - DNA, 50 bp, homo sapien
cattcagtccaatcaagttgacaccsgatcactcaatatcaaccgccaca

SEQ ID NO: 70998 - DNA, 50 bp, homo sapien
tacaggggattaaagatagagatgawatatatgaatttgtaatactggtt

SEQ ID NO: 70999 - DNA, 50 bp, homo sapien
agtgctttgttgatttctgtattcamgactaccctcattagatgcttaca

SEQ ID NO: 71000 - DNA, 50 bp, homo sapien
aaacagctctcaacactgtaatctayaacactcatctgctcgaaagcgcc

SEQ ID NO: 71001 - DNA, 50 bp, homo sapien
aaagaaatcaagctttcaaccccaaygtttataatcctagagttgatact

SEQ ID NO: 71002 - DNA, 50 bp, homo sapien
atgtgtcaaaggacttgattagattmaaaagatacccaagaactgattta

SEQ ID NO: 71003 - DNA, 50 bp, homo sapien
ttcttaatttgctttatcctttggaygcttagagttcatttcaagtaatt

SEQ ID NO: 71004 - DNA, 50 bp, homo sapien
taataatgagtgcatacatcaccaaytgagtttttttactttcaaaatat

SEQ ID NO: 71005 - DNA, 50 bp, homo sapien
ggttactacaccaatttatcgtcacragatatctgaacatgatgttggac

SEQ ID NO: 71006 - DNA, 50 bp, homo sapien
tcttgggttctgaggttagttttgcrctagtaaaatagttgccatatatg

SEQ ID NO: 71007 - DNA, 50 bp, homo sapien
ttctgttctataatggaatgatatgraatatgtagcaactgttataaaat

SEQ ID NO: 71008 - DNA, 50 bp, homo sapien
gtttgtccaagatacaaaagtggaaycaaaaaggaagtagcttagcacgg

SEQ ID NO: 71009 - DNA, 50 bp, homo sapien
gatccactgcacggagtaagaaatakgaagataagtgcagtgaagtgact

SEQ ID NO: 71010 - DNA, 50 bp, homo sapien
acttgggggcagaagacaagagaagsctgtaaatccgttatgcatactga

SEQ ID NO: 71011 - DNA, 50 bp, homo sapien
gaaggtacacaagtgtgtgctacaaraagcaaccaaggagcagtgacatt

SEQ ID NO: 71012 - DNA, 50 bp, homo sapien
ggaaacaaatatgtttctagtagacraaagacttatttttaaaaacccta

SEQ ID NO: 71013 - DNA, 50 bp, homo sapien
acttgatgttagccttaaggagacartggtcatgaaggcagtaatgaaga

SEQ ID NO: 71014 - DNA, 50 bp, homo sapien
tagtaatttgcttcatcactaccttyaagggattttacaaatggagtttc

SEQ ID NO: 71015 - DNA, 50 bp, homo sapien
tggcactgttctgagatctctgtaakaatgttatctttctcatgagaaat

SEQ ID NO: 71016 - DNA, 50 bp, homo sapien
ggcaagctggagacccagggaaccaytgatgctgcagtccagaatacaaa

SEQ ID NO: 71017 - DNA, 50 bp, homo sapien
tgtataaactgtcactaaaattgcayggcgctgggatttgccaggtgcga

SEQ ID NO: 71018 - DNA, 50 bp, homo sapien
atgggaggtatcaattaaagatgatraaatgcctgatttggaaaacagag

SEQ ID NO: 71019 - DNA, 50 bp, homo sapien
ccgcatcaagctccatggccttaatkactcagtccttggtctaaggagac

SEQ ID NO: 71020 - DNA, 50 bp, homo sapien
tccacaatcaattctcattgtatgakacctaatgtttgaaggtgctatgc

SEQ ID NO: 71021 - DNA, 50 bp, homo sapien
cctttcccacctttgcccagaaataktagtttgctttcaacctttggaaa

SEQ ID NO: 71022 - DNA, 50 bp, homo sapien
ccaactagccttcattgcagccaacyatcttaaaagcttcagttgttgtt

SEQ ID NO: 71023 - DNA, 50 bp, homo sapien
ccaagccaattatgatgacaaaattygaagatttacaagaacagatttca

SEQ ID NO: 71024 - DNA, 50 bp, homo sapien
aatgtttatttagctcagtactttamatacacttgctcaatgactttttt

SEQ ID NO: 71025 - DNA, 50 bp, homo sapien
ggaattttccatagaggcttgaacawataatttactacagggtttatata

SEQ ID NO: 71026 - DNA, 50 bp, homo sapien
attaatttttgaggatatatacaacragaggtcttcaataaacccagaaa

SEQ ID NO: 71027 - DNA, 50 bp, homo sapien
tcatgtctggatttctgatttagttkcaagatgtaaaaatcctacatagt

SEQ ID NO: 71028 - DNA, 50 bp, homo sapien
ctactgtctagatgccttagagaacygtagtgagaatttaacaagagagc

SEQ ID NO: 71029 - DNA, 50 bp, homo sapien
gtactcaacttttattacaaactgcyctgtaacgttgctcttctttgatt

SEQ ID NO: 71030 - DNA, 50 bp, homo sapien
agctccaaaatcctgaactttttgascattgattgacatgatgctcaaag

SEQ ID NO: 71031 - DNA, 50 bp, homo sapien
attaggagaactggttctgtcaaaascctaacttacggcttcgttcattc

SEQ ID NO: 71032 - DNA, 50 bp, homo sapien
ttctggacatttttatttttcatacsctgctctcaaatacaatgggtatc

SEQ ID NO: 71033 - DNA, 50 bp, homo sapien
ctcgacccttactactgtgacctatrgcatgtccttgaggatcacatctg

SEQ ID NO: 71034 - DNA, 50 bp, homo sapien
tccctcacttctgataatattgaacsaactccattttagtttctgtccct

SEQ ID NO: 71035 - DNA, 50 bp, homo sapien
atttcagggaaacaataagtatcaartctaaattatatgacctctaatat

SEQ ID NO: 71036 - DNA, 50 bp, homo sapien
caaaaacttaggcaaagatcttttayttgtggttaggcttacaccattcc

SEQ ID NO: 71037 - DNA, 50 bp, homo sapien
ttggttttctcaactgtggtaagaaragaaaaattatgctttggataatt

SEQ ID NO: 71038 - DNA, 50 bp, homo sapien
attccaggccaatattcttttactcycaattccttctattaatataccac

SEQ ID NO: 71039 - DNA, 50 bp, homo sapien
tctccagttctgctctggcctactawctgttaccactgagagaacaacat

SEQ ID NO: 71040 - DNA, 50 bp, homo sapien
atattaaaattgacaccacaataggwcctagttccaggcataataacaca

SEQ ID NO: 71041 - DNA, 50 bp, homo sapien
tttcaacttcttcttcaacttatcarggccatttgaatctagatcttgat

SEQ ID NO: 71042 - DNA, 50 bp, homo sapien
aatcagaatataaaacaattctataygacaaaacactataaaaattaaaa

SEQ ID NO: 71043 - DNA, 50 bp, homo sapien
ttttctgtcacacatgctccattaayatgatatggctggggcacaagaac

SEQ ID NO: 71044 - DNA, 50 bp, homo sapien
tgtgttaggactattgactggaacgyttttggccgacatgattaaaaaaa

SEQ ID NO: 71045 - DNA, 50 bp, homo sapien
tatttttttgtcacattaatcttgartaacttggctttgttagcaataaa

SEQ ID NO: 71046 - DNA, 50 bp, homo sapien
ttgagtaacttggctttgttagcaakaaaaaaatagcattctaaaaaccg

SEQ ID NO: 71047 - DNA, 50 bp, homo sapien
tctatggttgcaacattgaggttaawtagaattgcaaagagaggcttgga

SEQ ID NO: 71048 - DNA, 50 bp, homo sapien
tgttgataaatgtgtttctgaaaagyatattccacagctatgtgtcctga

SEQ ID NO: 71049 - DNA, 50 bp, homo sapien
tttttaaaaagagttctgctactaawatatgttagaattgtgtgactggc

SEQ ID NO: 71050 - DNA, 50 bp, homo sapien
tctggtcataatctcatcttttcaakgtctctcatcctctagaagaactg

SEQ ID NO: 71051 - DNA, 50 bp, homo sapien
aaattgggaagtgtgaaaaattgtgygaaattaatattggcatgcaaaaa

SEQ ID NO: 71052 - DNA, 50 bp, homo sapien
atttgaaaatatacagccagaggaartataagaaaaaagaataaaaaaag

SEQ ID NO: 71053 - DNA, 50 bp, homo sapien
gtgcttacacctatctttactactargcaggtgccctggaagcctccagg

SEQ ID NO: 71054 - DNA, 50 bp, homo sapien
tactctcatggatcttataacctcartatctccgtagaggggtccagaag

SEQ ID NO: 71055 - DNA, 50 bp, homo sapien
ctccatcatcatgattggttaaggcraagggaatacacagagagaatgtg

SEQ ID NO: 71056 - DNA, 50 bp, homo sapien
aaagtgcagccaacattaagaaaaayttcctgcaggtgttctagaataaa

SEQ ID NO: 71057 - DNA, 50 bp, homo sapien
tgtttttatatactttccagatttarcctcctttttgtaattcttttctt

SEQ ID NO: 71058 - DNA, 50 bp, homo sapien
agaggaaggctggggtctcccatacrgccaaatgataataatccaggaac

SEQ ID NO: 71059 - DNA, 50 bp, homo sapien
aatactcccatttgtggtagtttaamgtcctgatgtttaaggcagtccag

SEQ ID NO: 71060 - DNA, 50 bp, homo sapien
tggccctgaaacccagagaatgctcraatagattttctatattacaaact

SEQ ID NO: 71061 - DNA, 50 bp, homo sapien
aggaatccagcaaagattcaggaaaractcagcataactcatggggcctg

SEQ ID NO: 71062 - DNA, 50 bp, homo sapien
agagcatggagttgaagctactctcrctttttaggtgtgttagaatagca

SEQ ID NO: 71063 - DNA, 50 bp, homo sapien
gcctcctggcaggcctagaatggtarcagtatggtcaccagttgagaacc

SEQ ID NO: 71064 - DNA, 50 bp, homo sapien
atcgtcttctagagtttggcttgcaytatagttacccgtgcacaaatctg

SEQ ID NO: 71065 - DNA, 50 bp, homo sapien
atctctcttattctatttgtaaaaawgagattagattcaatagttttcat

SEQ ID NO: 71066 - DNA, 50 bp, homo sapien
gtttgtttttagacacaattcattayagccgttctttctctagagttgtt

SEQ ID NO: 71067 - DNA, 50 bp, homo sapien
ctctcttctgcttttctcagaaataygtttccagacttctcagtgagaat

SEQ ID NO: 71068 - DNA, 50 bp, homo sapien
aacaacaaaaaacttctggagtaaargcatttgaaatttgtagattagag

SEQ ID NO: 71069 - DNA, 50 bp, homo sapien
aacaggtggatgtctggaagttttcyctacctaacactttcacatataaa

SEQ ID NO: 71070 - DNA, 50 bp, homo sapien
acctttccttcagcatacttcaaacmattcctttaaactatgtttgacct

SEQ ID NO: 71071 - DNA, 50 bp, homo sapien
attttcaatactcaactgtaaattcwattttgtattcagtggaaagatca

SEQ ID NO: 71072 - DNA, 50 bp, homo sapien
ccttattaaatttcacttcgctggawtattacacttactttgatgctcaa

SEQ ID NO: 71073 - DNA, 50 bp, homo sapien
atacaggagaaagctgaggttcacamaagtagatttcttctccgacatcc

SEQ ID NO: 71074 - DNA, 50 bp, homo sapien
ggttcacaaaagtagatttcttctcygacatcctgaataataaacagaaa

SEQ ID NO: 71075 - DNA, 50 bp, homo sapien
ttctctctgcaaactacttggcatgratagttgcttcttctagagtgaat

SEQ ID NO: 71076 - DNA, 50 bp, homo sapien
tttttaataaatcaaatttctatagscaagtagtaggaaacaatttaaaa

SEQ ID NO: 71077 - DNA, 50 bp, homo sapien
aaaataaatcaatcaagcagttcaartggtgaggaaatatagagcacaga

SEQ ID NO: 71078 - DNA, 50 bp, homo sapien
gaatgtctgagaagttcagatttccmataatcaaaaagtaatccttcaca

SEQ ID NO: 71079 - DNA, 50 bp, homo sapien
gtataatatgttctcacttccatgtraaaaaatccctctgtgtgtatgca

SEQ ID NO: 71080 - DNA, 50 bp, homo sapien
tttaatgttgactttggagttggcayactggaaaagaattagaggtaaga

SEQ ID NO: 71081 - DNA, 50 bp, homo sapien
gtgggcctatcttttactaagaggaraagaatgtgcagtcccacccacag

SEQ ID NO: 71082 - DNA, 50 bp, homo sapien
caggctgaggagccaaagatgaggasagaaggcattaccaacatctgtat

SEQ ID NO: 71083 - DNA, 50 bp, homo sapien
tttgtaaaactgtccctttcctcacrgtattgtggtatgacatttctcac

SEQ ID NO: 71084 - DNA, 50 bp, homo sapien
taatgttgtgttacactagattgtasagccatgcagtaaaatgtttgagt

SEQ ID NO: 71085 - DNA, 50 bp, homo sapien
tggggggaaaaaaacccacagtgackattgtgtttcctatcattcttttt

SEQ ID NO: 71086 - DNA, 50 bp, homo sapien
ggaatgatgtccctcagtcatcaagragaagttgtataatattcagtgta

SEQ ID NO: 71087 - DNA, 50 bp, homo sapien
taggtgaattaaaataaaacacaaayggctttcaatgatcacaagaatga

SEQ ID NO: 71088 - DNA, 50 bp, homo sapien
ttctctctctgagattttttgatgcrtttgggtaagtaaatcaaatatat

SEQ ID NO: 71089 - DNA, 50 bp, homo sapien
agcataaaccttattagctttccatyatcccgaagaactagaactattat

SEQ ID NO: 71090 - DNA, 50 bp, homo sapien
gtcaatatggagtgcctttctcttartaaatttagacagcattctagaac

SEQ ID NO: 71091 - DNA, 50 bp, homo sapien
aggtgacttaagtttgctaaaacatmatggccttttgcatttatggagtg

SEQ ID NO: 71092 - DNA, 50 bp, homo sapien
gaatcaggatcagagtcttagagatrgtatcccaggtgacttaagtttgc

SEQ ID NO: 71093 - DNA, 50 bp, homo sapien
cagtcagcatatcatagatctagcaycagtacaagacagcgtgttccctg

SEQ ID NO: 71094 - DNA, 50 bp, homo sapien
ctttatccagtcactagtaggaatayaagcttcacagtctatctaaaata

SEQ ID NO: 71095 - DNA, 50 bp, homo sapien
tcttttcttatttccccagatttcaygggttgacactttcctaatttcca

SEQ ID NO: 71096 - DNA, 50 bp, homo sapien
attttaatgctgacacacagagtaayaatcccatggcccagcactacgtc

SEQ ID NO: 71097 - DNA, 50 bp, homo sapien
tgccaagtaggaattcttctttaccrctgtatagcaattttattttccag

SEQ ID NO: 71098 - DNA, 50 bp, homo sapien
attaaccaaacctctttatctgaaayggtaggtacatcactctccactca

SEQ ID NO: 71099 - DNA, 50 bp, homo sapien
cttatcctggctaagtgacaatcaaraaagtctgtgccactatggatgat

SEQ ID NO: 71100 - DNA, 50 bp, homo sapien
agagaatgaagagatgataccaggaraaagactcagcccaccactgctgg

SEQ ID NO: 71101 - DNA, 50 bp, homo sapien
gttacagcaatggcatctgggccaamaagtttaataatataatccttaat

SEQ ID NO: 71102 - DNA, 50 bp, homo sapien
gtaaaagtgtttttataaggtatcaygtaataatagtgttggcattatta

SEQ ID NO: 71103 - DNA, 50 bp, homo sapien
ttttcacatatttgtgttatttgtayatttgtttgtcaataggaagacag

SEQ ID NO: 71104 - DNA, 50 bp, homo sapien
acaacactgtcagttgctgtcctgargaaggtggccaggagctctagaag

SEQ ID NO: 71105 - DNA, 50 bp, homo sapien
aaaatgccttagacaaagctccctgmataagaatctgacaagtaatccaa

SEQ ID NO: 71106 - DNA, 50 bp, homo sapien
tcaagccatgctaatcctttaccccractgcagatgcatggacattagga

SEQ ID NO: 71107 - DNA, 50 bp, homo sapien
gtgcttggatcctgtcttcaaatacrggtaagagttaaagggttgagata

SEQ ID NO: 71108 - DNA, 50 bp, homo sapien
tttcttccccaagtattacactagamcctgggtgataaaaagatgcataa

SEQ ID NO: 71109 - DNA, 50 bp, homo sapien
agttgagagttctgtgatttggatcygactcattatgacacatctgtttt

SEQ ID NO: 71110 - DNA, 50 bp, homo sapien
ggagaaatagtgtacgtgttggagakactcagacagggtactaggaaaaa

SEQ ID NO: 71111 - DNA, 50 bp, homo sapien
tttacttttaactactatttattacmtaccaactcaagagtgatttggga

SEQ ID NO: 71112 - DNA, 50 bp, homo sapien
aaaggagagagccttgcaagtatcayaccattccttacgacccacctggg

SEQ ID NO: 71113 - DNA, 50 bp, homo sapien
cggtcctgggaggaacatagtaggamgtggtcattttatttagaaagtgt

SEQ ID NO: 71114 - DNA, 50 bp, homo sapien
ctttcttctttggggatgaagagtayggactttgttatcaggcagacgtg

SEQ ID NO: 71115 - DNA, 50 bp, homo sapien
agcatctattatgaacgttcaaggamtataaaagtaaggtaaaagctttt

SEQ ID NO: 71116 - DNA, 50 bp, homo sapien
ttacttcttatgtttcctaaagtaaycattgaattatttgggtaaaactt

SEQ ID NO: 71117 - DNA, 50 bp, homo sapien
gggatgagaacactgtgacaacaaakaatgcctatcagtggtggtcatgc

SEQ ID NO: 71118 - DNA, 50 bp, homo sapien
attatgaagcatagtatttatggcaytctaattcagttacaaactcacac

SEQ ID NO: 71119 - DNA, 50 bp, homo sapien
aacaaaaactttgggccatggtggawtcaatctaaatatatcctttttgc

SEQ ID NO: 71120 - DNA, 50 bp, homo sapien
cactgcaagtgtggcagtcaaagaaycttaaacgaaagctgatgggggtc

SEQ ID NO: 71121 - DNA, 50 bp, homo sapien
atcacttgaatgatttaccttaagaraacaggaggatcatgtttactgta

SEQ ID NO: 71122 - DNA, 50 bp, homo sapien
tgtttgcagtgtttattttttcaggracaaaacgaaataaactgagtgat

SEQ ID NO: 71123 - DNA, 50 bp, homo sapien
caaccacactttctcagaaaagccaygctgtctatacaagggaaaagcac

SEQ ID NO: 71124 - DNA, 50 bp, homo sapien
gacagtatatcacagacacagctacraagataaagtgccatgtatgatgg

SEQ ID NO: 71125 - DNA, 50 bp, homo sapien
ctggacatcttgaggagaagcaaacstgccatcttagaatttctgatatg

SEQ ID NO: 71126 - DNA, 50 bp, homo sapien
agagtccaagtcttccagactgtgaygaactgggcaaattaacaagttgt

SEQ ID NO: 71127 - DNA, 50 bp, homo sapien
ctatcgatctcatctctcacacacaygagtttatggacaagaatacttct

SEQ ID NO: 71128 - DNA, 50 bp, homo sapien
cgtatattgaactgttatggataaaraaattgcggctcagagagattaac

SEQ ID NO: 71129 - DNA, 50 bp, homo sapien
agggtggcctggtgggatagataatsactgctataaggaagggtctggga

SEQ ID NO: 71130 - DNA, 50 bp, homo sapien
tactggcccatccaacaaatgaggaraatggaacatatcaggcggtgtaa

SEQ ID NO: 71131 - DNA, 50 bp, homo sapien
agatgcaaagtagtgggaaatggagwagtgttaatcttatgcacattagc

SEQ ID NO: 71132 - DNA, 50 bp, homo sapien
aagaaccacttttagtgagtgaaaastacttgggacacttagaagcagtg

SEQ ID NO: 71133 - DNA, 50 bp, homo sapien
aggttcttgtaggccaggcaaccagkagtcctgaactgagaaaacaccag

SEQ ID NO: 71134 - DNA, 50 bp, homo sapien
agtcattacctacagacgaaattcaygcatcacaattctttctgtccttg

SEQ ID NO: 71135 - DNA, 50 bp, homo sapien
gagactgctagcttttataatccttyctcaactagttctggaattctgag

SEQ ID NO: 71136 - DNA, 50 bp, homo sapien
atttgtatattgtatgtacatgacawcacggtcaatgatgagttccaagt

SEQ ID NO: 71137 - DNA, 50 bp, homo sapien
ggtctactaattttgaacatgattaktaagagtacacagaaggttcatca

SEQ ID NO: 71138 - DNA, 50 bp, homo sapien
ctttttattttaaagtagaatcagtsaaattgctttcagtttttttctcg

SEQ ID NO: 71139 - DNA, 50 bp, homo sapien
agaattaatccagaactatagatacraattcaggaaagcatcagcaaatt

SEQ ID NO: 71140 - DNA, 50 bp, homo sapien
cttgttgttttaatacagaggatcasattctagttttgcataagtatact

SEQ ID NO: 71141 - DNA, 50 bp, homo sapien
ctgctttttctgcagtaatcccatarctttctattcacatttcttttatg

SEQ ID NO: 71142 - DNA, 50 bp, homo sapien
aaattatttttgaagattgaataaayggcatgtacttgaaacagttctcg

SEQ ID NO: 71143 - DNA, 50 bp, homo sapien
ggctaagcacagtgtaacacaaagaygatccataaataataacttttaaa

SEQ ID NO: 71144 - DNA, 50 bp, homo sapien
taaaaggcaagttcttagtaaataaygaaaatgtatgagccttagtgggt

SEQ ID NO: 71145 - DNA, 50 bp, homo sapien
tgttttatctagtttggctaaatacracttatggttcaaagagaaaatgc

SEQ ID NO: 71146 - DNA, 50 bp, homo sapien
agtcagcaatccgcgtattattttarctcatttcagcgtctttaacactg

SEQ ID NO: 71147 - DNA, 50 bp, homo sapien
tacaatgctctgaaaatcagttccayatagttttgtacataaaactccac

SEQ ID NO: 71148 - DNA, 50 bp, homo sapien
gaataggtctcatttccagagctcaycattaggagtctgatcattattat

SEQ ID NO: 71149 - DNA, 50 bp, homo sapien
ctgttgcctctccagaattgccgtcyacgctaagccttttgcccacatct

SEQ ID NO: 71150 - DNA, 50 bp, homo sapien
tctgaggtcagatgattctttgttaygaagcttacactcattttggggag

SEQ ID NO: 71151 - DNA, 50 bp, homo sapien
tctttttgagaggacaaccactgatwacaaattttcctgctatttttatt

SEQ ID NO: 71152 - DNA, 50 bp, homo sapien
tgcttcataacttctctttgtctgasaatattaataaactgtctctgtca

SEQ ID NO: 71153 - DNA, 50 bp, homo sapien
tcctaatggtgagctctggaaatgaracctattctgctttgctggcagtg

SEQ ID NO: 71154 - DNA, 50 bp, homo sapien
gggctttcaggtagtaaaataggccygaatacagcaaatcactttgttga

SEQ ID NO: 71155 - DNA, 50 bp, homo sapien
gcagttatcaacttccgaaaatttawcattgctaccatgctttatctttt

SEQ ID NO: 71156 - DNA, 50 bp, homo sapien
tctctaccttctttgtagatctgtgwataaagctctttgtaatgaggcca

SEQ ID NO: 71157 - DNA, 50 bp, homo sapien
tgtcctgtgcctcaggatctcttacycatagttgtattgttttttcattt

SEQ ID NO: 71158 - DNA, 50 bp, homo sapien
gtgtttgaaatctctggtctaggtamcatcatatttaaagttatactgga

SEQ ID NO: 71159 - DNA, 50 bp, homo sapien
tgacagagctgaacctggtagcatasgcatctcatgatgacattcttctt

SEQ ID NO: 71160 - DNA, 50 bp, homo sapien
tcacattgtatcttaatcctagatcyaattttgcacccttgcccagccta

SEQ ID NO: 71161 - DNA, 50 bp, homo sapien
catagaaaaagaagatagtgttagaractgggaatctgtctttgttaatt

SEQ ID NO: 71162 - DNA, 50 bp, homo sapien
ttttgtttcttcctccttcttagtarctgagaagcaatatagagcaggca

SEQ ID NO: 71163 - DNA, 50 bp, homo sapien
tctttgctacattcagctgtagatayagattcagatatccccaggaaaat

SEQ ID NO: 71164 - DNA, 50 bp, homo sapien
atcatccatctgataaagaagaggcsaaggcgaggaagagtcctgatctc

SEQ ID NO: 71165 - DNA, 50 bp, homo sapien
gaccagccagggtgataagaatgccrattaaatgcacacctgatttgttt

SEQ ID NO: 71166 - DNA, 50 bp, homo sapien
tcttcccttgctaacactacatgaastccacgctagcccccaggtcacag

SEQ ID NO: 71167 - DNA, 50 bp, homo sapien
tgtaaaagggagcaggataatctcaygtttgctgatccaatgggggaagg

SEQ ID NO: 71168 - DNA, 50 bp, homo sapien
tgctgtggacttgtctaatggtataygaaacaagagcagtcaactgagtt

SEQ ID NO: 71169 - DNA, 50 bp, homo sapien
aaatgaattataaaggtcacataaayatattgttgaaagtaataatggca

SEQ ID NO: 71170 - DNA, 50 bp, homo sapien
gtgttgtgatggatattctagtgcayggacatataccttgaagggggaag

SEQ ID NO: 71171 - DNA, 50 bp, homo sapien
taagtccatgcaaaaacttgtacacraaagcccatgtgagcattaaaaag

SEQ ID NO: 71172 - DNA, 50 bp, homo sapien
gctgcaatgtttaattagtttttackctcacgtgaagtgctttgattgta

SEQ ID NO: 71173 - DNA, 50 bp, homo sapien
cacagtgggagccaggatcacgcaasagaggtggagtattaacacagctt

SEQ ID NO: 71174 - DNA, 50 bp, homo sapien
ccagagcaatgcatatttatcattaygcctcattgttaccatctgcagag

SEQ ID NO: 71175 - DNA, 50 bp, homo sapien
aatactacaactggcatgaaccagaygatataaaagtaacaatttacaga

SEQ ID NO: 71176 - DNA, 50 bp, homo sapien
ggtgctttagctggacttgaaatgcratagaacaacaaagctttattact

SEQ ID NO: 71177 - DNA, 50 bp, homo sapien
aaaaagcacttaaagctcctttagayattcggtcaagcaacattgctttc

SEQ ID NO: 71178 - DNA, 50 bp, homo sapien
attaaaaccatttctgtgtagtataratcataaatataatttgttttcta

SEQ ID NO: 71179 - DNA, 50 bp, homo sapien
caaagacgaccctggaaaaaatacayctttatctaatttcaaatcaaaac

SEQ ID NO: 71180 - DNA, 50 bp, homo sapien
taatgctagggctgcatataaatcasaacgtgtcaattcaggtttcatgt

SEQ ID NO: 71181 - DNA, 50 bp, homo sapien
aaaataaagctgtgaacacgtatctyaaaacacataggtgcaaataatag

SEQ ID NO: 71182 - DNA, 50 bp, homo sapien
gaattcatataagagcataatgctayagtgcgcttccaagacaaaaacag

SEQ ID NO: 71183 - DNA, 50 bp, homo sapien
attttacatccatccatagcctcaawtgcttgaaactagtattctcgtga

SEQ ID NO: 71184 - DNA, 50 bp, homo sapien
gagcccctggcctaagtgttccataygtaagctcctttctatttagtgtc

SEQ ID NO: 71185 - DNA, 50 bp, homo sapien
taaacttgcaagctgttttttatttycctcctatgttgattcacattaaa

SEQ ID NO: 71186 - DNA, 50 bp, homo sapien
aataaataaatcaaatttaaaaacargtagcacaaagcttaagaaaacac

SEQ ID NO: 71187 - DNA, 50 bp, homo sapien
cttattgttcatgactgaatgttaasctccctgaatgcttcctggaaacc

SEQ ID NO: 71188 - DNA, 50 bp, homo sapien
cttttattgaactacacattgccaasattatatgggtttacactgagaga

SEQ ID NO: 71189 - DNA, 50 bp, homo sapien
gcagccaagattcaatgcttggaaakgaagtttaagttggaggacaaaca

SEQ ID NO: 71190 - DNA, 50 bp, homo sapien
atgttgctaatgtattttacttcaasatagggaacaaactttttaagtat

SEQ ID NO: 71191 - DNA, 50 bp, homo sapien
tagtaagatactcccctcacttctcrtgttttcttagcacttggtagtag

SEQ ID NO: 71192 - DNA, 50 bp, homo sapien
taatctacaacacatttaatatatamaaatatctgagtccaacaatgtta

SEQ ID NO: 71193 - DNA, 50 bp, homo sapien
attcacgattagcgatatacatttcratattaaccagtgagtcataggat

SEQ ID NO: 71194 - DNA, 50 bp, homo sapien
tagtttatttgctttactctaatacrtagctgtaacacaaataacataag

SEQ ID NO: 71195 - DNA, 50 bp, homo sapien
tcaacttctagagcttgagggaatayacagaaacaactaggaaatccatg

SEQ ID NO: 71196 - DNA, 50 bp, homo sapien
atctagacatttcacttgggtcttayatattccatttctcttctcatcat

SEQ ID NO: 71197 - DNA, 32 bp, homo sapien
tgaatttattcaataaygttaaaagcatagat

SEQ ID NO: 71198 - DNA, 50 bp, homo sapien
agttgtgaattcccttagcatatgaytgtctctattatatgctaaaagaa

SEQ ID NO: 71199 - DNA, 50 bp, homo sapien
tccctgaattagcatttgaatatgastggtatggtcctccaggtttgctt

SEQ ID NO: 71200 - DNA, 50 bp, homo sapien
cctaacctggtgttattggctaaacygcatcgccctatctccaaaacaga

SEQ ID NO: 71201 - DNA, 50 bp, homo sapien
aaatcttttgttattgtgacactaayagtttcctgagatgtttaaggaga

SEQ ID NO: 71202 - DNA, 50 bp, homo sapien
tatgcaaaggactcaaaggtaactcrcgagaatactagtttcaagcattg

SEQ ID NO: 71203 - DNA, 50 bp, homo sapien
atacatgggataaaaataaaagttcyatcttcctaagccactatattttt

SEQ ID NO: 71204 - DNA, 50 bp, homo sapien
acagggacagggactgatcctggaawtggcctggcagtgtactcacccag

SEQ ID NO: 71205 - DNA, 50 bp, homo sapien
tccccacacctgagatcttgttttgmattttgactaaatgaagcttcttt

SEQ ID NO: 71206 - DNA, 50 bp, homo sapien
catggatgaatcgccagtgtattacrataagtgaaataaggcactcacga

SEQ ID NO: 71207 - DNA, 50 bp, homo sapien
aaaattggggagtaggcacattgaartcttgcgtcctagtggtgactaat

SEQ ID NO: 71208 - DNA, 32 bp, homo sapien
gcttagcactaggatgyaagttgcaggacagc

SEQ ID NO: 71209 - DNA, 50 bp, homo sapien
attcattcattgtcttttctgaaaayggatggccaagattctaaaacact

SEQ ID NO: 71210 - DNA, 50 bp, homo sapien
ttaataatatttagctagcagaggaytcaatgatgcaagatattagagta

SEQ ID NO: 71211 - DNA, 50 bp, homo sapien
gttggcacttacaatttagctgttcraaataatctattattagcactaat

SEQ ID NO: 71212 - DNA, 50 bp, homo sapien
gaagctgaccagaaaaatatggtaaratgtctggacactctttgagagcc

SEQ ID NO: 71213 - DNA, 50 bp, homo sapien
cttagatattaattactttttgaaayatatgcgaattatttttaatttta

SEQ ID NO: 71214 - DNA, 50 bp, homo sapien
cttttagcatttaaaccacagataarcttaccattagaagtaaaaagcca

SEQ ID NO: 71215 - DNA, 50 bp, homo sapien
atcagtgagtttccaaaagaaaatgscttcagtaccacaaaattaacaaa

SEQ ID NO: 71216 - DNA, 50 bp, homo sapien
caaaaggcttttcataatttataccrgaggaatccaccttcttggaaagc

SEQ ID NO: 71217 - DNA, 50 bp, homo sapien
aatgcaatttttactgaatttttgtyaaatataggaaatacagatttatt

SEQ ID NO: 71218 - DNA, 50 bp, homo sapien
gccaccagtgggtggatgagataaaygaactgactttcttccaccaggcg

SEQ ID NO: 71219 - DNA, 50 bp, homo sapien
agattccagaaaaaactgtttcctcragtctgtaagtaaaatgaagtgtt

SEQ ID NO: 71220 - DNA, 50 bp, homo sapien
attcctggaagtcatttgagtaagayagatactgagatatatttaaaggc

SEQ ID NO: 71221 - DNA, 50 bp, homo sapien
tttttattcagcaataacaagttacyaaatgagctaggttctgaggagag

SEQ ID NO: 71222 - DNA, 50 bp, homo sapien
gacatgatttagtaaatcttaaaaaygttcagcctaaatgtttggatctg

SEQ ID NO: 71223 - DNA, 50 bp, homo sapien
tgacctagcaaggtgtatgtctggargatttccttgcaccactcagaaga

SEQ ID NO: 71224 - DNA, 50 bp, homo sapien
atgatacaccatttcctccaattatyactaaatgcttgtttgccttattt

SEQ ID NO: 71225 - DNA, 50 bp, homo sapien
cagctgcctcctttcgttttcttcaygttcattcaaagccaggatcctta

SEQ ID NO: 71226 - DNA, 50 bp, homo sapien
tcatcttgtctgaaaatatttgaaaygttcatctgtaggaaaaagaagtc

SEQ ID NO: 71227 - DNA, 50 bp, homo sapien
tttaaaactaacacagacacccaaayagccagttgttagtacatcaaacc

SEQ ID NO: 71228 - DNA, 50 bp, homo sapien
tctctagaatgtcaattgcgtgaggwaagagtccattatgttcatttctg

SEQ ID NO: 71229 - DNA, 50 bp, homo sapien
tgctctactttttgcaaagcatttaycatcgtttaatatacaatataatt

SEQ ID NO: 71230 - DNA, 50 bp, homo sapien
aatgactgaagtcaatggaagaagaygagaggatgcacagagagacacac

SEQ ID NO: 71231 - DNA, 50 bp, homo sapien
tccccttcaccttgctcagaatctakgttgaaatttttaaagtccatttt

SEQ ID NO: 71232 - DNA, 50 bp, homo sapien
tccttcctaccaccaccataactacygcaatatgattcaggcagtcctat

SEQ ID NO: 71233 - DNA, 50 bp, homo sapien
tgccgatttcaagcagaaggataaaragtaatcaatgcatatctgtttag

SEQ ID NO: 71234 - DNA, 50 bp, homo sapien
aagtgacctttcatccgagtcttgarggaagagtgagaaaaggagcaatt

SEQ ID NO: 71235 - DNA, 50 bp, homo sapien
gtaactgcttattgattaggacggayaaactatcaatattattaaattag

SEQ ID NO: 71236 - DNA, 50 bp, homo sapien
gttgtttgtttttcagtgttccttcrcagatcccatactgaattccattt

SEQ ID NO: 71237 - DNA, 50 bp, homo sapien
caacataaaagtgaatccaatatgaratgatatgacatacttttgtaaag

SEQ ID NO: 71238 - DNA, 50 bp, homo sapien
tatcaagaataactaaagcctttcawtgttacactatgcaatccctagcc

SEQ ID NO: 71239 - DNA, 50 bp, homo sapien
aattttttctttattgccatagcaastaagtctgtttttactgctcaagt

SEQ ID NO: 71240 - DNA, 50 bp, homo sapien
agtctattaactaacagtgtagctaratatacttttatttttataacatt

SEQ ID NO: 71241 - DNA, 50 bp, homo sapien
aaaagcttcaaggacagggtcaccayaatttctttcataagaggtgagta

SEQ ID NO: 71242 - DNA, 50 bp, homo sapien
catattgatgctgattagaaatgaargcccttattatacagaggtagccc

SEQ ID NO: 71243 - DNA, 50 bp, homo sapien
ggatattatgattattgttcaaagaktcaatattagtgtcttagtgtgtt

SEQ ID NO: 71244 - DNA, 50 bp, homo sapien
ccttgaacactaaggccttaaatcayggtactaataacaatagccaacat

SEQ ID NO: 71245 - DNA, 50 bp, homo sapien
gccttacagataaaatgaacagttaygtgttacagggaattggcgtatac

SEQ ID NO: 71246 - DNA, 50 bp, homo sapien
cagtaacattatatttcagtaaacaygtagctgctaaaatcataaatata

SEQ ID NO: 71247 - DNA, 50 bp, homo sapien
tccagccctcagtctgtaatgaatcrgttgaattcagagacagagcagtc

SEQ ID NO: 71248 - DNA, 50 bp, homo sapien
aaaaaggggaacctgatgcaatgaaytaaagggcatggaggagccagaaa

SEQ ID NO: 71249 - DNA, 50 bp, homo sapien
aactactcatttaggaggaatttcartacaatttcacagtacagttttat

SEQ ID NO: 71250 - DNA, 50 bp, homo sapien
acagcacagctttcaacaaatcaaayggtttattcctagttctcaatgtg

SEQ ID NO: 71251 - DNA, 50 bp, homo sapien
cccacagatgagtttttggattaaargccagcgatggctgagggaattgg

SEQ ID NO: 71252 - DNA, 50 bp, homo sapien
tttaggtgttgaaacccaacagtagraaatggaattatagagctggaaag

SEQ ID NO: 71253 - DNA, 50 bp, homo sapien
atttttgtttgagactactgtctgaytacaccaactagttagatttcaac

SEQ ID NO: 71254 - DNA, 50 bp, homo sapien
ttggtgtaataaactaagtcatagaycctattgaaagagtaatgctaaat

SEQ ID NO: 71255 - DNA, 50 bp, homo sapien
aatatttggaatgtattaataactcrgaacatgtcatttcctaaataaac

SEQ ID NO: 71256 - DNA, 50 bp, homo sapien
ttccaccccaagctttgggaaagccrataacttatattccctgggtttgg

SEQ ID NO: 71257 - DNA, 50 bp, homo sapien
ctaggatcctgtcctgctttacctgmttctcaaatgacagaaagcttagc

SEQ ID NO: 71258 - DNA, 50 bp, homo sapien
gaccagacaaaaaactatcaatccasacttaattccttgctcctaagttc

SEQ ID NO: 71259 - DNA, 50 bp, homo sapien
catgagagaggaaactgcagtaataragtagccagattaagaaggacctt

SEQ ID NO: 71260 - DNA, 50 bp, homo sapien
aaagactattagagagattgttgtcrcgtatggatgtctttcaaagcaat

SEQ ID NO: 71261 - DNA, 50 bp, homo sapien
ttatggctgcaaaatgctcggcacastgtctggcaactccttactattta

SEQ ID NO: 71262 - DNA, 50 bp, homo sapien
taaaaaagcaaagcaactattttctwacaatgatacactaactaacttag

SEQ ID NO: 71263 - DNA, 50 bp, homo sapien
taaaatggatttagaggtcatttagraagttttagagttttccagggcag

SEQ ID NO: 71264 - DNA, 50 bp, homo sapien
actagaccttagcagatcctgccagwttgcaccttattagcagtataatt

SEQ ID NO: 71265 - DNA, 50 bp, homo sapien
caggaagaaacagattgttcctatakatttagaatccaggtaaataagca

SEQ ID NO: 71266 - DNA, 50 bp, homo sapien
atgcccacgttccatgatttaatacrataaaagctaatttcttgctacac

SEQ ID NO: 71267 - DNA, 50 bp, homo sapien
ttgcttaactgaattacagagtgcaraagtactatacagccaaatgaaga

SEQ ID NO: 71268 - DNA, 50 bp, homo sapien
aaaataagtctgaattaaagagtcamaattgcagtttatttcagagaaat

SEQ ID NO: 71269 - DNA, 50 bp, homo sapien
ttagttgtgaatttttctgccatgarcatgtatgaccaaaacaaacacac

SEQ ID NO: 71270 - DNA, 50 bp, homo sapien
cttgttttagagtattttctcattgyatttaacgttcaaaagaaagctca

SEQ ID NO: 71271 - DNA, 50 bp, homo sapien
gtagtttattgtgtaattgaccccargaaatatcaataacagtgtgaaga

SEQ ID NO: 71272 - DNA, 50 bp, homo sapien
caggtgagttatagttgacattttaygtgtaatagatatttcagagtttg

SEQ ID NO: 71273 - DNA, 50 bp, homo sapien
aggtccctaatattttctccagaacraagagcccatgtcttcagtgccat

SEQ ID NO: 71274 - DNA, 50 bp, homo sapien
aacaggtacaaatcctcagcagccaygttgtttatctaaattcagcccag

SEQ ID NO: 71275 - DNA, 50 bp, homo sapien
gcaatatgttaaaactggcacggaayctttgaatagcttttgaattttta

SEQ ID NO: 71276 - DNA, 50 bp, homo sapien
ggttcttcagctgacacttaaaggaygctcagtggtgttcaggaaaatgg

SEQ ID NO: 71277 - DNA, 50 bp, homo sapien
attctatattaacttagtgttgtaartaactaaaagcaggcaacagatga

SEQ ID NO: 71278 - DNA, 50 bp, homo sapien
aattcacctgtgtcttgatacaaaawaggagaacaaaagtactactgcag

SEQ ID NO: 71279 - DNA, 50 bp, homo sapien
gaattccataaactacgaaactatasaaacataaataaggtttaattaca

SEQ ID NO: 71280 - DNA, 50 bp, homo sapien
ctcataactggtaatgtccagaaaaygcactcactttatagagacagggt

SEQ ID NO: 71281 - DNA, 50 bp, homo sapien
cttggaatgtctacctaccataaaaraattttcatcctgtgacttgatca

SEQ ID NO: 71282 - DNA, 50 bp, homo sapien
ccccaaaatttcatgaatcaaagagracaacagttaagttcccactaaga

SEQ ID NO: 71283 - DNA, 50 bp, homo sapien
catgtttgcctggtttatattcgtcraaaatttagacttgaaaattcttc

SEQ ID NO: 71284 - DNA, 50 bp, homo sapien
tccttagctcctcataactaaagcamagtcagcctcgaccagagaagagg

SEQ ID NO: 71285 - DNA, 50 bp, homo sapien
ttttggaggttgtgaataatgcctckcaacatgaagatgttttatatctc

SEQ ID NO: 71286 - DNA, 50 bp, homo sapien
ttgaatagactcattaaactcgatarcccttaattggcagacacacagga

SEQ ID NO: 71287 - DNA, 50 bp, homo sapien
ccacatatggaaggtcaaatttcacrctctcacctgattttaacaacttg

SEQ ID NO: 71288 - DNA, 50 bp, homo sapien
agaagtagagtaaaagtaaatgacamgtaaagctcatgaaatgcataatg

SEQ ID NO: 71289 - DNA, 50 bp, homo sapien
ttgagtttatcttaattatttccaamcattaagattcctttttattattt

SEQ ID NO: 71290 - DNA, 50 bp, homo sapien
gccattgatcttagaaggaaaattcygcactggtgctgctccaagagata

SEQ ID NO: 71291 - DNA, 50 bp, homo sapien
atattttttatgtgtttagtcaaaayttattaccttggtctcaattttct

SEQ ID NO: 71292 - DNA, 50 bp, homo sapien
tgccagccctgccaggggcactatgraggaaagagatgctgcctatgttc

SEQ ID NO: 71293 - DNA, 50 bp, homo sapien
ccgacatatcaaggacttttgaagaratagcttattataataacagtcta

SEQ ID NO: 71294 - DNA, 50 bp, homo sapien
tggaagcagcagcaaatattggaaastaatggaacttagcataaagccct

SEQ ID NO: 71295 - DNA, 50 bp, homo sapien
tgaaaactgtgattcaagcactggarattttacattttgaatttcatttc

SEQ ID NO: 71296 - DNA, 50 bp, homo sapien
gtccctgcagtcttaagattcacaartaagtaacatagtagctttgagtg

SEQ ID NO: 71297 - DNA, 50 bp, homo sapien
ggcataaccttgacattgctctcaaycctgaatttcttctttttgagcat

SEQ ID NO: 71298 - DNA, 50 bp, homo sapien
aatattgacacagagtattcccttcraaaattatctttctgactaaatac

SEQ ID NO: 71299 - DNA, 50 bp, homo sapien
cagcaaaaaatctatgaaggtaatcygaggcctttaaagagagctttgag

SEQ ID NO: 71300 - DNA, 50 bp, homo sapien
aaaaagacaagtacaaataagctcgragtgtgaagattagaataaatacc

SEQ ID NO: 71301 - DNA, 50 bp, homo sapien
gcagttattgcctgagtgcaaagaarcaaaccaaaatggtaagaaataag

SEQ ID NO: 71302 - DNA, 50 bp, homo sapien
gacataatgtattaactagtgtttcrccaaaaatgacaaaacccatgcca

SEQ ID NO: 71303 - DNA, 50 bp, homo sapien
tattgagagttttccagttgacccartgatgtcctttagaacaaaagaaa

SEQ ID NO: 71304 - DNA, 50 bp, homo sapien
aatagtttactttctgcacacctgamtaatgacatgtattaaccttggtg

SEQ ID NO: 71305 - DNA, 50 bp, homo sapien
agacatacttactactctttggaaawtcataacacaggcccatcagaatt

SEQ ID NO: 71306 - DNA, 50 bp, homo sapien
tgcatctctttgtattttatagaaaygtgcttgatggagattcaaccaga

SEQ ID NO: 71307 - DNA, 50 bp, homo sapien
gtggaaccacagaattaattgataayggaagtgctgcagagacaatatcc

SEQ ID NO: 71308 - DNA, 50 bp, homo sapien
tctcttactgagaattgtcagatatraatagttgaatcctccttctttca

SEQ ID NO: 71309 - DNA, 50 bp, homo sapien
gtgggggaaccttcaggagaggacartctgagttcttggccagctggact

SEQ ID NO: 71310 - DNA, 50 bp, homo sapien
gtttactaaacctccaaagcataagratttttggttacttgaatcaagcc

SEQ ID NO: 71311 - DNA, 50 bp, homo sapien
gccagggggtataggtagcaattagyaacttaaaattatcctcagtgagg

SEQ ID NO: 71312 - DNA, 50 bp, homo sapien
tccaaccccaaagccagttcagttakcagggactcagtaatgctctgagg

SEQ ID NO: 71313 - DNA, 50 bp, homo sapien
tggccagaacagagttcatttcagaraagtggtaagaaatgagagtagag

SEQ ID NO: 71314 - DNA, 50 bp, homo sapien
ggctttgagaatgcctgtaaattcayggctatggtaaaaggggaggtagc

SEQ ID NO: 71315 - DNA, 50 bp, homo sapien
cttcacagtctcatgatcgacgccaygaaaggagggaaggtgtgtactgt

SEQ ID NO: 71316 - DNA, 50 bp, homo sapien
aaaacgaagtgatctgtttgacttgytgatgattccataggaggcattct

SEQ ID NO: 71317 - DNA, 50 bp, homo sapien
aactggctatggggaaattcctaatraatgatctcaactttaccatagta

SEQ ID NO: 71318 - DNA, 50 bp, homo sapien
ttcttacgtattggttgctgaaaacyaaaggggcttttgaaggcaggatg

SEQ ID NO: 71319 - DNA, 50 bp, homo sapien
caaaaatgtgtcctgtcattatttaygtacgtcttgaattgtcctggtta

SEQ ID NO: 71320 - DNA, 50 bp, homo sapien
taatatagcttaactatttggtctckactcataatttccaacttggcagt

SEQ ID NO: 71321 - DNA, 50 bp, homo sapien
atctcccttattatcttattcttcaragtccttcactatactttgcgata

SEQ ID NO: 71322 - DNA, 50 bp, homo sapien
tagttcctggatctcacactgaatcmaatatatgctccagggttatacta

SEQ ID NO: 71323 - DNA, 50 bp, homo sapien
tactgaatacattggttccttagacrgcatcaacaagcatatttttaaga

SEQ ID NO: 71324 - DNA, 50 bp, homo sapien
ggagtccagggccatcctctttaatrctgaattatgccacagtggagtga

SEQ ID NO: 71325 - DNA, 50 bp, homo sapien
gttcatcatggcctcgaacccaagcrcctctaaaaacaagataattgctg

SEQ ID NO: 71326 - DNA, 50 bp, homo sapien
ttgtagttgacgtgaattacactccrgagaattggaggcttctttttctc

SEQ ID NO: 71327 - DNA, 50 bp, homo sapien
cacagcaactggcctcatgattttawctatatctatattattcctaagtc

SEQ ID NO: 71328 - DNA, 50 bp, homo sapien
cagagacagaagagtactacatctayattcagcttggaaaagagaatgag

SEQ ID NO: 71329 - DNA, 32 bp, homo sapien
atgtaactgtaaaaaayagataacaatttcaa

SEQ ID NO: 71330 - DNA, 50 bp, homo sapien
gagggcaaattcctatcttcaaatgsagcatcctcaagtgctcacaacag

SEQ ID NO: 71331 - DNA, 50 bp, homo sapien
tcacagtggccagggcatgggaactyagctttctccaacccttggcccca

SEQ ID NO: 71332 - DNA, 50 bp, homo sapien
gtgtttggaaggtgctgcacgagacmaattttgtttttaagaggtgagga

SEQ ID NO: 71333 - DNA, 50 bp, homo sapien
gctaagtcattaggactcaaacctaytacattccttagctagagtccatc

SEQ ID NO: 71334 - DNA, 50 bp, homo sapien
catatatgtggacatccagtagttaygcagcaaatcttcagcaacgcagg

SEQ ID NO: 71335 - DNA, 50 bp, homo sapien
agccttcccaatgactaagtggggcratttcaggtcataaaagatgccct

SEQ ID NO: 71336 - DNA, 50 bp, homo sapien
gtgggtggaatgcaaggcatcgaagsacattacctaatggaggtgggcgt

SEQ ID NO: 71337 - DNA, 50 bp, homo sapien
gatgggtacactgaagctcattgaaytggcttaaacaggccaaaagggta

SEQ ID NO: 71338 - DNA, 50 bp, homo sapien
tatttagaccattgatgtttaaagtrattgttgatgtagttgaattaata

SEQ ID NO: 71339 - DNA, 50 bp, homo sapien
ctattcaataacttattctaaaataycaagcaaattagaaattatcctat

SEQ ID NO: 71340 - DNA, 50 bp, homo sapien
cacttaacaagctgctccaaacatakagaatgtaagtagaagaagttagc

SEQ ID NO: 71341 - DNA, 50 bp, homo sapien
tatcttctttaaaatgttttcaggamaagcgcgtattgataatttagatt

SEQ ID NO: 71342 - DNA, 50 bp, homo sapien
ttatttccattgagactgtcagaaaytataaatgtaagaggacatcgggc

SEQ ID NO: 71343 - DNA, 50 bp, homo sapien
gcgcgtattgataatttagattgtayggcttattggcccaatgggggtag

SEQ ID NO: 71344 - DNA, 50 bp, homo sapien
agttcctataaagggtcatggctacwcttatataaaacttcaaacaaaat

SEQ ID NO: 71345 - DNA, 50 bp, homo sapien
ggattttcataggcttcacatgaagraaatagctttgtcattagtttttg

SEQ ID NO: 71346 - DNA, 50 bp, homo sapien
attcttaggaaactctgcctaagacrccacactctgttggaaatatattg

SEQ ID NO: 71347 - DNA, 50 bp, homo sapien
aaacttgtggcataagatcgatcaayggtattaacccgaattgaatcaaa

SEQ ID NO: 71348 - DNA, 50 bp, homo sapien
aggctctcaatataaatggaataaastctatgaaactctttgaagactga

SEQ ID NO: 71349 - DNA, 50 bp, homo sapien
aaatatgcatagtttcaagattacawgtcaactgtccttggaagagaact

SEQ ID NO: 71350 - DNA, 50 bp, homo sapien
ggatggcgaaaacttctcaaagtccmtaacatttatctgacacctcaact

SEQ ID NO: 71351 - DNA, 50 bp, homo sapien
tatcagcacactcagaattgtagaayaaagagtgttgtggttactgcttc

SEQ ID NO: 71352 - DNA, 50 bp, homo sapien
cccctagaactcagtaaagcacaacsgtgaaagcctctcatctaggccat

SEQ ID NO: 71353 - DNA, 50 bp, homo sapien
caccccaggataagattgccctatcrcagagttatagcactttcaaatgc

SEQ ID NO: 71354 - DNA, 50 bp, homo sapien
ggtgggaagggcttgctgtgatcaawtctctcttgccctttaaaaacgtt

SEQ ID NO: 71355 - DNA, 50 bp, homo sapien
tttgggttgagttgcctatctgtctraaagcattaggaacttcattgctt

SEQ ID NO: 71356 - DNA, 50 bp, homo sapien
gcagaagtttcttctctcacagttayaggagctagaggtttgcaatcaag

SEQ ID NO: 71357 - DNA, 50 bp, homo sapien
atgtcaggcagaattgagacaaacargagaaaattgcctcaagattttct

SEQ ID NO: 71358 - DNA, 50 bp, homo sapien
tgtcattaagtagcacatccaggacygaaattcaactccatcccacaaca

SEQ ID NO: 71359 - DNA, 50 bp, homo sapien
tggtgatactgtcattcaacaaacaygtactaagagctcactacagatcc

SEQ ID NO: 71360 - DNA, 50 bp, homo sapien
gcagtatcacctccattttgctaaaycgaggtcaagatagggtgtgcccc

SEQ ID NO: 71361 - DNA, 50 bp, homo sapien
tagtgtatcctgtctatttaactcarcttccttccctgccttttttctca

SEQ ID NO: 71362 - DNA, 50 bp, homo sapien
tttttgtgataccttttatgaaataygatctcgcattacttctatatttg

SEQ ID NO: 71363 - DNA, 50 bp, homo sapien
attttgcattaaagtagaattttaaraagaagccaaatgcattcatgtat

SEQ ID NO: 71364 - DNA, 50 bp, homo sapien
gggccaagctcctccctgatgcaaayggcggaactccagtgcactgatca

SEQ ID NO: 71365 - DNA, 50 bp, homo sapien
atgacacgtgtggaattggaaatggratagaatagaaggctgattaacac

SEQ ID NO: 71366 - DNA, 50 bp, homo sapien
atcctgctgcatatcagagttactargggactttcgtgaattcagttgtg

SEQ ID NO: 71367 - DNA, 50 bp, homo sapien
cttcaacaaatcctctcaagtatacyctcaaaatatatccccaatctgcc

SEQ ID NO: 71368 - DNA, 50 bp, homo sapien
ttgccattccttatccatccagtgcmattaacctaagtgttctaattgcc

SEQ ID NO: 71369 - DNA, 50 bp, homo sapien
gacgaagtgaagaagtttgcagaaaragttctgaagtcttgtgagggaaa

SEQ ID NO: 71370 - DNA, 50 bp, homo sapien
ttccgcttcctcagaattttaacaartgcaccaaagtgacattccatatt

SEQ ID NO: 71371 - DNA, 50 bp, homo sapien
acagaaaaggtcacaggacaaacacygaaaagaatagagtagggacgtta

SEQ ID NO: 71372 - DNA, 50 bp, homo sapien
gtgcaaaatgttgcttaaaactcaartgtctatttcctatacagtgtttt

SEQ ID NO: 71373 - DNA, 50 bp, homo sapien
atggatgaaagctggaatataaaacracaaaggaatggatgtatcaaggg

SEQ ID NO: 71374 - DNA, 50 bp, homo sapien
ccctccaaatcgaatcattgacattrcatatgcccagtagtgtattagct

SEQ ID NO: 71375 - DNA, 50 bp, homo sapien
gagtgcttgacaaacataaaatggamatcttaggaacacttttacaccat

SEQ ID NO: 71376 - DNA, 50 bp, homo sapien
catctaagaagtaaagcacatttcayggaccgtgcatctcaaaggttttt

SEQ ID NO: 71377 - DNA, 50 bp, homo sapien
catatcaatacactcaacataaaagratgtccttctaagaggcagtaata

SEQ ID NO: 71378 - DNA, 50 bp, homo sapien
tttctccattttagacatagaaaaaraggcccagaagagttaaccagtcc

SEQ ID NO: 71379 - DNA, 50 bp, homo sapien
ctgtgtaagattatgtgtaagatgaygtaacctgaaaatatagattagaa

SEQ ID NO: 71380 - DNA, 50 bp, homo sapien
tctgataagtttgacgtcatacatayacatatacctataaaactgtcacc

SEQ ID NO: 71381 - DNA, 50 bp, homo sapien
tgccttccttaaatggctatttttcyaaatcaagttggtaaatatctata

SEQ ID NO: 71382 - DNA, 50 bp, homo sapien
ttatagctaaaagccctagatttaartgacagattaagaggctcggcagg

SEQ ID NO: 71383 - DNA, 50 bp, homo sapien
agacatgttgttcttgcataaacaakcaaaagaagctaaggaatcaactt

SEQ ID NO: 71384 - DNA, 50 bp, homo sapien
aatttgaaatggtgagtgaaaaacarggtaacctaatatgtagcaaggac

SEQ ID NO: 71385 - DNA, 50 bp, homo sapien
gatttacacctaaaataccaactccrtcatatcttcagaacaattcttct

SEQ ID NO: 71386 - DNA, 50 bp, homo sapien
ggctctcatctttacggtccctttcraggcttccaaagcccactgcaatg

SEQ ID NO: 71387 - DNA, 50 bp, homo sapien
ttttgcggaaaggtcaaacttttccrtagcagctgtgcccatttcttacc

SEQ ID NO: 71388 - DNA, 50 bp, homo sapien
tgagcgtgtattttcatttatttcaygagccctattctctgtggacttgt

SEQ ID NO: 71389 - DNA, 50 bp, homo sapien
gagaacaacttgacacatctatttcyagccagagcagcagtgactggcag

SEQ ID NO: 71390 - DNA, 50 bp, homo sapien
ctttcccagcagagactgagatcaaygctttatttatcttccccagtttc

SEQ ID NO: 71391 - DNA, 50 bp, homo sapien
acaggcctttgtggtcttctgaaaaygttctacgctctggttcataatcc

SEQ ID NO: 71392 - DNA, 50 bp, homo sapien
atcattgcctccctctaaatataaawtaaaatctcagctccttaacaaca

SEQ ID NO: 71393 - DNA, 50 bp, homo sapien
aggcttaggtaaaggcatgaaggtcrgaatgaatggagccaggttgggaa

SEQ ID NO: 71394 - DNA, 50 bp, homo sapien
cctaatctgatgagaaagcaagacaygaagagatcacaactcagtactta

SEQ ID NO: 71395 - DNA, 50 bp, homo sapien
ttccatttgaaacaggaagtggcgayaaaactacacatactgcattttta

SEQ ID NO: 71396 - DNA, 50 bp, homo sapien
tacttaaatatacatgtactagtcarctattgttttataatatactatac

SEQ ID NO: 71397 - DNA, 50 bp, homo sapien
ctcacaggtgattctgttgcacatayaacacccttaacaatcaattcaat

SEQ ID NO: 71398 - DNA, 50 bp, homo sapien
caggtgagacacagaggaggccactyaatgaagcacacgaaacaacagaa

SEQ ID NO: 71399 - DNA, 50 bp, homo sapien
agtttggtggggagaggggaatgccrtaaacagaagtatttttaaatatt

SEQ ID NO: 71400 - DNA, 50 bp, homo sapien
cctttccatgactccctaacagctawtaacagtccttacatggtatgtga

SEQ ID NO: 71401 - DNA, 50 bp, homo sapien
gtagccagccagcaaccttgggagaygtctttaaatcgtgtaaattggca

SEQ ID NO: 71402 - DNA, 50 bp, homo sapien
aacaacaacgacaacaacactatagkaacaaaacaacaaactaatacata

SEQ ID NO: 71403 - DNA, 50 bp, homo sapien
caatgaaagcatacagattttcaggwagtttatttaaatcatttaatagc

SEQ ID NO: 71404 - DNA, 50 bp, homo sapien
caaggtaatggaactgccaacatgamaatagcatcatattctccaaacac

SEQ ID NO: 71405 - DNA, 50 bp, homo sapien
cagagtacaatacaacaagtacagasaagcctttcagtctcacattcata

SEQ ID NO: 71406 - DNA, 50 bp, homo sapien
aggtagtgatttctaggcttatcatkactgtatcccaacaccttaaacac

SEQ ID NO: 71407 - DNA, 50 bp, homo sapien
tccaataggaagcagtgagatgcaayggttacagcaaaaaaattgaaaac

SEQ ID NO: 71408 - DNA, 50 bp, homo sapien
taatgaataagggaccttcgtacagrccctgaggcgacagattaacaggt

SEQ ID NO: 71409 - DNA, 50 bp, homo sapien
aggcataactgactttctatttatgmaaataatctgggagaagaaatgga

SEQ ID NO: 71410 - DNA, 50 bp, homo sapien
agcaaaatatattttcctatgatacygtatcttctggaaaaaaaatgctt

SEQ ID NO: 71411 - DNA, 50 bp, homo sapien
ttcttaggctgactaatagccgtatraaggagttgggcataaacctggag

SEQ ID NO: 71412 - DNA, 50 bp, homo sapien
gagacttggactaattcaagtttccrtttgtattctggtagatgctaact

SEQ ID NO: 71413 - DNA, 50 bp, homo sapien
tcatacattttctgttcctactaaaygtgggttggttgttttctagttga

SEQ ID NO: 71414 - DNA, 50 bp, homo sapien
gaatacatacataaaaattaatctasctatccacttaagctgtacatctt

SEQ ID NO: 71415 - DNA, 50 bp, homo sapien
atttcaacttttattttagattcacragtacataagcaggtttgttacat

SEQ ID NO: 71416 - DNA, 50 bp, homo sapien
tctgtgactgctgtgacatatttaaratgttagatgtatgttgtatatgt

SEQ ID NO: 71417 - DNA, 50 bp, homo sapien
tattctttttaagtatccaaggccawacctcaaatgtcttaaaaatgagg

SEQ ID NO: 71418 - DNA, 50 bp, homo sapien
atttctcactgtattcataaatcatwgcatcacattgtactccataaata

SEQ ID NO: 71419 - DNA, 50 bp, homo sapien
ccccaatctccaggtgaagctgagaraagttaaagcagcatccctgacca

SEQ ID NO: 71420 - DNA, 50 bp, homo sapien
ccctaaaagtccttcaaggctgggaygatacacaagaaacactgacttcc

SEQ ID NO: 71421 - DNA, 50 bp, homo sapien
gtacataagctacttgacccaatacycatgtgaaagtttattctgcttgg

SEQ ID NO: 71422 - DNA, 50 bp, homo sapien
gtgcctctctattttccagatagacrctacctaacttatgagacacaaca

SEQ ID NO: 71423 - DNA, 50 bp, homo sapien
gctttcttggtttgcagttagtgtgsagaatagtttttggtaagcaagga

SEQ ID NO: 71424 - DNA, 50 bp, homo sapien
acgtggagcactgacagtctgagccrcactaggaagctttggcagtcagt

SEQ ID NO: 71425 - DNA, 50 bp, homo sapien
aatcctatcttaaataatgaacttayagagagagatactaattttaatat

SEQ ID NO: 71426 - DNA, 50 bp, homo sapien
gaccctatgagaagaggtctctgaayctttggattaaaaaacaacacagc

SEQ ID NO: 71427 - DNA, 50 bp, homo sapien
caatctttatctagatattatagtamctcattttacttttaaacttgctt

SEQ ID NO: 71428 - DNA, 50 bp, homo sapien
ttgcttttacattttcaaaacaggartattttatccccaaacacctagac

SEQ ID NO: 71429 - DNA, 50 bp, homo sapien
cccagaatatcaacatttcttagcaytgagcttactctgggccatttcct

SEQ ID NO: 71430 - DNA, 50 bp, homo sapien
ttttgtcttatttctaaagagacaartggatggaaaaactttttggccct

SEQ ID NO: 71431 - DNA, 50 bp, homo sapien
cttcttccttctttatgcatccttarctcaacattattacaagttatctt

SEQ ID NO: 71432 - DNA, 50 bp, homo sapien
tcctcatctataaaatgagaattaarctacttacctctaagagtaagcat

SEQ ID NO: 71433 - DNA, 50 bp, homo sapien
taataataatactgatcttcactcayatcataatcgtcactcacaagttc

SEQ ID NO: 71434 - DNA, 50 bp, homo sapien
ccttttcttttttccccataagtgcratattctcctttatctctctgaag

SEQ ID NO: 71435 - DNA, 50 bp, homo sapien
ttagtttttaagagtttgtctgtaawtgctggcatagcacaattaaaagg

SEQ ID NO: 71436 - DNA, 50 bp, homo sapien
tgacttcaggctgttaccttccagaraatatttgaattcaaatgagtgat

SEQ ID NO: 71437 - DNA, 50 bp, homo sapien
aaaggcaaattccaaaggtataatcyaagatgaggcatcatgatcacaga

SEQ ID NO: 71438 - DNA, 50 bp, homo sapien
ttacatcttttttcatctctgttaayatcaaccatacagttaaacaagta

SEQ ID NO: 71439 - DNA, 50 bp, homo sapien
catataagcaaaaatatgaatggccrataatcaaatataaacaactgtac

SEQ ID NO: 71440 - DNA, 50 bp, homo sapien
tttgtcaaactgtactacaaaataamatttctgcagcaagcactttacag

SEQ ID NO: 71441 - DNA, 50 bp, homo sapien
gtccctggaggcagttctggtataaytgaaggtggagaaagataatattc

SEQ ID NO: 71442 - DNA, 50 bp, homo sapien
ttcccagaatgaattcccacgtaaayctaaagaatgctgatggagagaag

SEQ ID NO: 71443 - DNA, 50 bp, homo sapien
tgaagttcccttgctgtaaatcccayggcactcttgactcttttgttacg

SEQ ID NO: 71444 - DNA, 50 bp, homo sapien
aataatttcccaaataaattcctgcrtaacaagtaccaatggatgtgttt

SEQ ID NO: 71445 - DNA, 50 bp, homo sapien
caagctaacgtatctgtcattcttayaggcatctaatcagtgtgcttagg

SEQ ID NO: 71446 - DNA, 50 bp, homo sapien
tatatctaacactaaatttgatagarataggaaagcttttggcagtgaaa

SEQ ID NO: 71447 - DNA, 50 bp, homo sapien
taatcttttatctaatgtaagtataygttaccctgtgtctttaatagtaa

SEQ ID NO: 71448 - DNA, 32 bp, homo sapien
attagtcaatactgaaycactgctcctggggg

SEQ ID NO: 71449 - DNA, 50 bp, homo sapien
catcctcataaaataacactcagaawcattaattatttgttattattgga

SEQ ID NO: 71450 - DNA, 50 bp, homo sapien
ttttaataccatcctattttcaaaaygcccatataaaataaaataactct

SEQ ID NO: 71451 - DNA, 50 bp, homo sapien
actgattctaggaactgccctttggratttgaaaagcagaagccagggcc

SEQ ID NO: 71452 - DNA, 50 bp, homo sapien
aatttaactgggcacatttatcctgyatatttcgtggcaaagttaactaa

SEQ ID NO: 71453 - DNA, 50 bp, homo sapien
agcagctacttctgggtatcatcagktctctcctttggagatagtaacag

SEQ ID NO: 71454 - DNA, 50 bp, homo sapien
ttcatagatttcattataaatcacaratactagcttaaacttgatgtgtt

SEQ ID NO: 71455 - DNA, 50 bp, homo sapien
tattcagtctgaaaaaatgatacacwaccctattagccactcaactttgg

SEQ ID NO: 71456 - DNA, 50 bp, homo sapien
acaactacctttattgagtcgttaayaagagcatgatgcttggagaacat

SEQ ID NO: 71457 - DNA, 50 bp, homo sapien
gtctttggtaatcacaagttttgcawtttcctgttcaatttatcaattat

SEQ ID NO: 71458 - DNA, 50 bp, homo sapien
atgcttaagaatgggatagaaacacracttttcttaatgcttctgggcaa

SEQ ID NO: 71459 - DNA, 50 bp, homo sapien
aaagctcttctgttactattgtggcygacaccctacaggcagcctttctg

SEQ ID NO: 71460 - DNA, 50 bp, homo sapien
cagaaaatctcagaatgtattcaaaytggagtatacattaaatggaaaaa

SEQ ID NO: 71461 - DNA, 50 bp, homo sapien
acaatctgcatgtccacaatatatcrcaaatgctagcataggaaattgct

SEQ ID NO: 71462 - DNA, 50 bp, homo sapien
tagtaaatcatgagaaagatttgaastacatataattccatatagaagga

SEQ ID NO: 71463 - DNA, 50 bp, homo sapien
ccagtaatccgtattctgtatataastcagtcatttttttcaacgcaagt

SEQ ID NO: 71464 - DNA, 50 bp, homo sapien
caaatgaaagtgtcccatgcatgcayctgattagtggaacctcatcatgt

SEQ ID NO: 71465 - DNA, 50 bp, homo sapien
gtttgagtatgatagtgtttgtctayaatatgtgtgaataatttgttttc

SEQ ID NO: 71466 - DNA, 50 bp, homo sapien
tcttcttatctcaataatggaaccaycatcttcccaattactcaacccaa

SEQ ID NO: 71467 - DNA, 50 bp, homo sapien
aaaaattcaagcagaagttgttatgraatacctaaacagtcagaaacaga

SEQ ID NO: 71468 - DNA, 50 bp, homo sapien
tttcccgtgtccaatatttcattccrcttggttgtgggacaaggacccag

SEQ ID NO: 71469 - DNA, 50 bp, homo sapien
agctcctttattcacttgaagtaatmaaaatagttaaatcaacaatacaa

SEQ ID NO: 71470 - DNA, 50 bp, homo sapien
aatatcttaaaggcaaaggtgctaamtgacttcactatatcttatgcccc

SEQ ID NO: 71471 - DNA, 50 bp, homo sapien
atttactcgtgtactaaaaatatccraaagtattcaggtatgaggaaaag

SEQ ID NO: 71472 - DNA, 50 bp, homo sapien
aaaggtagatatcttggattgaaaakgtcaaaataaaaagttttgtgctt

SEQ ID NO: 71473 - DNA, 50 bp, homo sapien
atctgcttagtgtaacattacagaakgagttttcttcaactgcctggctc

SEQ ID NO: 71474 - DNA, 50 bp, homo sapien
tggtttctccctgatccagtacccaygaagttgctgatgggagggtcagg

SEQ ID NO: 71475 - DNA, 50 bp, homo sapien
ctggagaaaaaatagactattaaaawggaacaattatagtatcatatact

SEQ ID NO: 71476 - DNA, 50 bp, homo sapien
tgacaactaagttaactaggtaaaasagcaaccaagtcaccaatatgtgt

SEQ ID NO: 71477 - DNA, 50 bp, homo sapien
taggccaaacaacacttacacataarcatatctaacagttaacatccact

SEQ ID NO: 71478 - DNA, 50 bp, homo sapien
taatagatttctatactaggtgacaytgagaataaaaatggtcaatagct

SEQ ID NO: 71479 - DNA, 50 bp, homo sapien
cagtgcataagaggttaagacaaccratttgaaatctaatggaatttctg

SEQ ID NO: 71480 - DNA, 50 bp, homo sapien
caaataagcatttgccttagagacawctgcttattcctgtgttttagggc

SEQ ID NO: 71481 - DNA, 50 bp, homo sapien
tcctgaaacatactttacgccttcaktctctcctccacttcaaatcacat

SEQ ID NO: 71482 - DNA, 50 bp, homo sapien
tacaaaactaccagaaacaattaacmatatggcgttaacaaaccctcaca

SEQ ID NO: 71483 - DNA, 50 bp, homo sapien
ccagaatgcagtctgtaagagtcaartgttcccagtaattatagatttcc

SEQ ID NO: 71484 - DNA, 50 bp, homo sapien
tcttatttaccatctatagaatacaygtgtctgttaaaagcaattaataa

SEQ ID NO: 71485 - DNA, 50 bp, homo sapien
aagaaccttgagttttttcctcaaayggatctttacagacccttcatttt

SEQ ID NO: 71486 - DNA, 50 bp, homo sapien
gatctaaactcggcccatactattgrcaagaaagtctgccaactgattga

SEQ ID NO: 71487 - DNA, 50 bp, homo sapien
agagtcctcaacacaaagatgtatawgtcctttgatagtagaagataacg

SEQ ID NO: 71488 - DNA, 50 bp, homo sapien
tgtgataaatgtagccttcaacatartaataacatagtaagcacaaatta

SEQ ID NO: 71489 - DNA, 50 bp, homo sapien
gtggtttgggagcagctgattcactyagttgaaacatctgaatagcagag

SEQ ID NO: 71490 - DNA, 50 bp, homo sapien
agataaaatgctttgactgtgtaacyggattttcatcatttgattcttgt

SEQ ID NO: 71491 - DNA, 50 bp, homo sapien
tagatgtctgtactctgagttttaawggagcctcccatatgagcaatgta

SEQ ID NO: 71492 - DNA, 50 bp, homo sapien
tttactgtaagtaaacctctcatccracctcaacgaataaagatttgtta

SEQ ID NO: 71493 - DNA, 50 bp, homo sapien
gagcatagctgaaatcagccaaacckcctgtaagaaaatgcccaggattg

SEQ ID NO: 71494 - DNA, 50 bp, homo sapien
agagtgttgagttttggtttggcagscactttatttgatcagtttgatcc

SEQ ID NO: 71495 - DNA, 50 bp, homo sapien
ctatttttttatggagcagtagtaayggctaatatttttccatcttcctt

SEQ ID NO: 71496 - DNA, 50 bp, homo sapien
tcaaaacacaagcatcatatgttagraaaaagtgaaggaaaaagctggga

SEQ ID NO: 71497 - DNA, 50 bp, homo sapien
tttttatttagcacaaacgtgtataraatatctcaagcttgtataagtga

SEQ ID NO: 71498 - DNA, 50 bp, homo sapien
aatgagtctaagagaaattaacatgmaactgagatacctggattttgctt

SEQ ID NO: 71499 - DNA, 50 bp, homo sapien
aaagtagaggaggatttgacatagaragaagaaaaggtaatatgaccaca

SEQ ID NO: 71500 - DNA, 50 bp, homo sapien
aaatgtatcatgcaccattaaacaargtgtttcacacgtgtcactaaaca

SEQ ID NO: 71501 - DNA, 50 bp, homo sapien
agagttaatttgactaatttaatcarcatgcccttcaatgtatctactgg

SEQ ID NO: 71502 - DNA, 50 bp, homo sapien
tattttaagtctattgtttgtgttgyaaaaacttaggcataaattcatct

SEQ ID NO: 71503 - DNA, 50 bp, homo sapien
caaaagatatgttggaattagcaaakaatttaaaatagcaatttaaatta

SEQ ID NO: 71504 - DNA, 50 bp, homo sapien
gtgcttggatatatttgtaaaacatraaacactgacggttgatagcaaag

SEQ ID NO: 71505 - DNA, 50 bp, homo sapien
aacactgacggttgatagcaaagtarccagcatatggtaggtgccagata

SEQ ID NO: 71506 - DNA, 50 bp, homo sapien
caattaatgttgatggtttcgagttmgagagaagagagtttgcttataaa

SEQ ID NO: 71507 - DNA, 50 bp, homo sapien
tatagacttcaaccatagctacaaamtttaaaaatcaatcattttgtctg

SEQ ID NO: 71508 - DNA, 50 bp, homo sapien
tgaaaatttaatttacaaatctcacragaatattggttttatattataac

SEQ ID NO: 71509 - DNA, 50 bp, homo sapien
cttttattaaatcctgactgcaaacmtactaatggagagtacatttaatt

SEQ ID NO: 71510 - DNA, 50 bp, homo sapien
attaactccattacaccatttgagayatttccaaaggcagatcccttgtt

SEQ ID NO: 71511 - DNA, 50 bp, homo sapien
catttaattttaaatacgtcacctamctcattttagcaacagggaaactg

SEQ ID NO: 71512 - DNA, 50 bp, homo sapien
agttgcttggagtgggactgactacyaagtggcactaaaggaactttctg

SEQ ID NO: 71513 - DNA, 50 bp, homo sapien
aataatacatctgttttcccaaggayataacttacacatattatgaccaa

SEQ ID NO: 71514 - DNA, 50 bp, homo sapien
taagaaaacctacaactgctacctartagaaaaaaagtaagcagaatgta

SEQ ID NO: 71515 - DNA, 50 bp, homo sapien
attacaaaacccaacagagtagagawattattcattcagtttataatgaa

SEQ ID NO: 71516 - DNA, 50 bp, homo sapien
taattcagagttctccccatggataktagtggttcataactaaactagaa

SEQ ID NO: 71517 - DNA, 50 bp, homo sapien
agccatcccttatgaccacaatttckatggcttccttcaaaaatagccat

SEQ ID NO: 71518 - DNA, 50 bp, homo sapien
cgttttgtgagtgaactaagacacayagatgtacacccagatgcaattat

SEQ ID NO: 71519 - DNA, 50 bp, homo sapien
aataattttcttagaatttctcaagsctacctttgtttccaaggatattt

SEQ ID NO: 71520 - DNA, 50 bp, homo sapien
cctccacctcctcatactctaaaacragaaaacatcatgaggagtaggtt

SEQ ID NO: 71521 - DNA, 50 bp, homo sapien
ctgcatttgctgaagatgagtgaaaytggatgactccctgttgactatgc

SEQ ID NO: 71522 - DNA, 50 bp, homo sapien
atcgtgtcaatacaaaaagctaccawaggaatgcaggaggctgagtaaaa

SEQ ID NO: 71523 - DNA, 50 bp, homo sapien
aagccatcagtggatttcttttaccyaggaataatgttcatgctccttag

SEQ ID NO: 71524 - DNA, 50 bp, homo sapien
tacattctccagtcatgacatttgarccatcatacagtgtgtgtgaatat

SEQ ID NO: 71525 - DNA, 50 bp, homo sapien
attcaaagttaaaaaattgcttcaarttatttatttaaacttttgaagaa

SEQ ID NO: 71526 - DNA, 50 bp, homo sapien
atggctaggtatggtatgttttataygtatcctagtagagagttgtagtg

SEQ ID NO: 71527 - DNA, 50 bp, homo sapien
actacctcatgtttctgctaccataygattaaaacaatttacagttttcc

SEQ ID NO: 71528 - DNA, 50 bp, homo sapien
aaactttcgtttgagaagtcgtttgsaattctggataacgtcagcttctt

SEQ ID NO: 71529 - DNA, 50 bp, homo sapien
tgcctagaaagttgaagaggatgggmcttttcagttgaattgtttttgct

SEQ ID NO: 71530 - DNA, 50 bp, homo sapien
caccaaagtggtcaagagaaaggatmaacaccccatctacaattatcata

SEQ ID NO: 71531 - DNA, 50 bp, homo sapien
ggatagttgttcatactctacaacayagtgtcttcaaggacctctcctta

SEQ ID NO: 71532 - DNA, 50 bp, homo sapien
agtcctagtcttatttccttcctacrtatttgacctgttttcatttgttt

SEQ ID NO: 71533 - DNA, 50 bp, homo sapien
ccatcaatctagtacaagataatgcygctgtgctatgaatagaacaataa

SEQ ID NO: 71534 - DNA, 50 bp, homo sapien
tgggaagcctacgcttggccacattrcttatgtagaataacttgtaatcg

SEQ ID NO: 71535 - DNA, 50 bp, homo sapien
tgtggtaatttttatgacatccctargaaacaaatacagtgatgtagcac

SEQ ID NO: 71536 - DNA, 50 bp, homo sapien
attactcagtgctaaaaatgaactaygaaatcatgaaaatacaagaagga

SEQ ID NO: 71537 - DNA, 50 bp, homo sapien
cttaaaggtagacaggataggaccckgaaaaatatatttgaaaaaaatac

SEQ ID NO: 71538 - DNA, 50 bp, homo sapien
tccagggaagtgaactgcatatttargtactaaggaatgattgaagaaca

SEQ ID NO: 71539 - DNA, 50 bp, homo sapien
ttatagttagaataagtggttaaatyatcttatggaatgcctttcaatcc

SEQ ID NO: 71540 - DNA, 50 bp, homo sapien
tgtcactctctagcggtcagagatcyaccttcttaattccacgttgaggt

SEQ ID NO: 71541 - DNA, 50 bp, homo sapien
ttaataaataacttttgtaatatgaktagcttcttgaaattacaaacttc

SEQ ID NO: 71542 - DNA, 50 bp, homo sapien
agataaatgctaatgattccttaaayaaattctcacttttgataagagct

SEQ ID NO: 71543 - DNA, 50 bp, homo sapien
tgacaaggcattgtgcttaggactaygtaagaggtaagtaaaatgtgata

SEQ ID NO: 71544 - DNA, 50 bp, homo sapien
taattcattgtgtgttattgcattaraagtaccttgacacgcatagactg

SEQ ID NO: 71545 - DNA, 32 bp, homo sapien
tctcatccgggtcctcyatccacaggggctga

SEQ ID NO: 71546 - DNA, 50 bp, homo sapien
tggggaaacaacagcatctgccaaakaatggattgaagaagaaaaaagta

SEQ ID NO: 71547 - DNA, 50 bp, homo sapien
ctggaaactggatatagtaacttaarcaataattttcagataacaactcc

SEQ ID NO: 71548 - DNA, 50 bp, homo sapien
gtctgcactctattcacggataagamgcccatcaaactgaggccagtgct

SEQ ID NO: 71549 - DNA, 50 bp, homo sapien
ttaaacacttaatgtagataattccyatatacctctcttactactgacat

SEQ ID NO: 71550 - DNA, 50 bp, homo sapien
attaattaaaaaaatactccaaacawcatatacaaatacatttgagcttc

SEQ ID NO: 71551 - DNA, 50 bp, homo sapien
acctataacagataaaaatggaaatsagtagtcttaagagttgatagtac

SEQ ID NO: 71552 - DNA, 50 bp, homo sapien
aaaatgtatatgtgaaacaggtttgkaaatgtggtaagtttgcaaattta

SEQ ID NO: 71553 - DNA, 50 bp, homo sapien
aatctacactcctaggtctcagccayaagataatataaatctggtcaaat

SEQ ID NO: 71554 - DNA, 50 bp, homo sapien
ctgagtcccttgtgtgtaactagaawctacactcctaggtctcagccaca

SEQ ID NO: 71555 - DNA, 50 bp, homo sapien
ctgttactgattccctttttgacctstcatttcctcccttgaaagtactt

SEQ ID NO: 71556 - DNA, 50 bp, homo sapien
tattcacattactcctgtatttctaygatgcaatcaaaatttgttctcac

SEQ ID NO: 71557 - DNA, 50 bp, homo sapien
tattatttatctatctatattgtatwacctatcattatctaattgtctat

SEQ ID NO: 71558 - DNA, 50 bp, homo sapien
gacagaaaataacataatcctagcayaatttttagtcctacgtataaccg

SEQ ID NO: 71559 - DNA, 50 bp, homo sapien
gcaatttaaaaaattcaataatttcrcaaactcttatatcccaactaaaa

SEQ ID NO: 71560 - DNA, 50 bp, homo sapien
ttctgaaatctaccatctctgatatwaaataaccactgtgctctattatt

SEQ ID NO: 71561 - DNA, 50 bp, homo sapien
ttttatggatactatgatcatctggycaattctataggtatctgtgagtc

SEQ ID NO: 71562 - DNA, 50 bp, homo sapien
gggatgcagctacaatattgcccaamaagcacacatctaagagcaatgaa

SEQ ID NO: 71563 - DNA, 50 bp, homo sapien
tctttaatgaacatttgtaactatcyctttggcttatattgtttgtgaaa

SEQ ID NO: 71564 - DNA, 50 bp, homo sapien
agggttttctccctgtggtgagaaartacgccaggattcactaacagaaa

SEQ ID NO: 71565 - DNA, 50 bp, homo sapien
atttgctttggccagtaggatattakcacaaaaacctcaaacaaggagat

SEQ ID NO: 71566 - DNA, 50 bp, homo sapien
gcttgtacaaatttttgctttcatakgtaccccaaagtgtgaaagtccta

SEQ ID NO: 71567 - DNA, 50 bp, homo sapien
ttttgccctcaggataataatgagcyaaaaacttacttaattgcgtctga

SEQ ID NO: 71568 - DNA, 50 bp, homo sapien
gattgattgatgtaatattagaaaaygtaggattcagaaaactgaatgca

SEQ ID NO: 71569 - DNA, 50 bp, homo sapien
tgagtggagcttatatccctaccacraactataaaacaagtggaagatac

SEQ ID NO: 71570 - DNA, 50 bp, homo sapien
ctacattcacaccctgtcaacctagmatcgtgtgcacaagggcatttcca

SEQ ID NO: 71571 - DNA, 50 bp, homo sapien
gacaaacaatcaattatagccataamcttagtgtaaagaattataatata

SEQ ID NO: 71572 - DNA, 50 bp, homo sapien
taggcagcagcttagatcaatcacaractttttatgactatgaccttgct

SEQ ID NO: 71573 - DNA, 50 bp, homo sapien
aaaagagttaatagagatggaaagaycaatagaagatgctaacaagaagg

SEQ ID NO: 71574 - DNA, 50 bp, homo sapien
aatatccgaagtgcaggtgaaacccrcaatctgctctcatttgagggaac

SEQ ID NO: 71575 - DNA, 50 bp, homo sapien
tcatatccatctgatcctactagaayatattttgcttctattggaatata

SEQ ID NO: 71576 - DNA, 50 bp, homo sapien
atagatgagataaatagaaaataaakagtaagatgctagatttaaaccct

SEQ ID NO: 71577 - DNA, 50 bp, homo sapien
tatatgataatgacttggagcaagawgtttatagtggagatggtgagatg

SEQ ID NO: 71578 - DNA, 50 bp, homo sapien
atttctttcaaaaagaaatactccawgtcctaaagcaccaataatatagc

SEQ ID NO: 71579 - DNA, 50 bp, homo sapien
cttttgtgaaagattttgtatagacrctttgatggacaccaagatatgtt

SEQ ID NO: 71580 - DNA, 50 bp, homo sapien
ttaaagagtgatcatacacctccackggtaaagagctgaggaaaagagca

SEQ ID NO: 71581 - DNA, 50 bp, homo sapien
aaagatataataaaagtggtgttcaraatgattaaatggcaactactgca

SEQ ID NO: 71582 - DNA, 50 bp, homo sapien
ggaattaatttaacatacattaacamgggaagggcaagtacgagttgaat

SEQ ID NO: 71583 - DNA, 50 bp, homo sapien
gcaataaaatgccagctgtgcaaggwactgctattatatgattttactga

SEQ ID NO: 71584 - DNA, 50 bp, homo sapien
gctttctgctgtgtttagctaagggragccttattataagagtggacagg

SEQ ID NO: 71585 - DNA, 50 bp, homo sapien
ttagacttcaaaatgcaaggtgaacmaatacataggtgaatgaatgggaa

SEQ ID NO: 71586 - DNA, 50 bp, homo sapien
gcctctgtggacttgagagatgaccraatagcaaagaaagtattcataag

SEQ ID NO: 71587 - DNA, 50 bp, homo sapien
ttaaaagagttacatcaaacaataastcccgaaaagcacgtcatctctat

SEQ ID NO: 71588 - DNA, 50 bp, homo sapien
tccactttcttcattctttttctttyagatatcagctcaagatctgagtg

SEQ ID NO: 71589 - DNA, 50 bp, homo sapien
aaacatctgagatgacgaaaggacckcaaatttatttatttattgtgttt

SEQ ID NO: 71590 - DNA, 50 bp, homo sapien
tgagaatttcgtttgttaggttgcastgtcctccttggaagcaacttgga

SEQ ID NO: 71591 - DNA, 50 bp, homo sapien
ctatacaattcaaagctgtgtttacmagtagatgtaaatgagaatttcgt

SEQ ID NO: 71592 - DNA, 50 bp, homo sapien
cttggcaaggagccacattgacatgratatttaataaatgccttttgatc

SEQ ID NO: 71593 - DNA, 50 bp, homo sapien
aagaacagcataaaacttagagacaraggttagccctgggcaagaagagc

SEQ ID NO: 71594 - DNA, 50 bp, homo sapien
tttctaatattcctcacatttagcamcaggctgtttttacactaataaaa

SEQ ID NO: 71595 - DNA, 50 bp, homo sapien
ttaaacattcatggttctgcaacacsaatcttttatctgcaaaatttata

SEQ ID NO: 71596 - DNA, 50 bp, homo sapien
tgtttcgaagatattatctgcgattkaaattttttttctattggatgcag

SEQ ID NO: 71597 - DNA, 50 bp, homo sapien
cagtgcttgaagaaaataataatacrgagacatcagatctccagcctcaa

SEQ ID NO: 71598 - DNA, 50 bp, homo sapien
ttgaaaaagctcactgatgcaaagaygtaattttctctctcctccccaaa

SEQ ID NO: 71599 - DNA, 50 bp, homo sapien
gttgtggcaagatctgaagagaacaytggaaaagaggaccacccccagag

SEQ ID NO: 71600 - DNA, 50 bp, homo sapien
ccggttcaggatgactaatttcaaaygttatgttccagatttcagcccag

SEQ ID NO: 71601 - DNA, 50 bp, homo sapien
gggagcattatataagattattctawggatgctatctggaatgtatttca

SEQ ID NO: 71602 - DNA, 50 bp, homo sapien
cactttgtcaaaacaatgataaacawccgagtgaaaaagagagatttaat

SEQ ID NO: 71603 - DNA, 50 bp, homo sapien
tggagagttctgtagatatctataargtccatttgatccagtgctgagat

SEQ ID NO: 71604 - DNA, 50 bp, homo sapien
ctagatttatttgtagagataaggakaatgatattttaaaaggtcaaata

SEQ ID NO: 71605 - DNA, 50 bp, homo sapien
agacataataaaaccttcaaatcacycatgtagatgtcatgtaaaaagtc

SEQ ID NO: 71606 - DNA, 50 bp, homo sapien
caggtggtaaatccttgtagtattayatctttgtgaggcttaatctgtct

SEQ ID NO: 71607 - DNA, 50 bp, homo sapien
atttgagtgctttctctattctacaytatactagacaacgtgcatacaac

SEQ ID NO: 71608 - DNA, 50 bp, homo sapien
tgtaaaaaaaacttagggagaaaaastcaagagtgaaatccattttcaat

SEQ ID NO: 71609 - DNA, 50 bp, homo sapien
tttggtctaccttgaatcttttgccrcacagatatacagatattcatatg

SEQ ID NO: 71610 - DNA, 50 bp, homo sapien
tgttgaaagacagcccttagaccaamgtttacacaaatcagaactggaag

SEQ ID NO: 71611 - DNA, 50 bp, homo sapien
aagtagtattgctaacagagcatggmatcagtcagacccaaattaacaga

SEQ ID NO: 71612 - DNA, 50 bp, homo sapien
ggaacaatctggagaactagtgcaargaacaactgggagcctgatagaaa

SEQ ID NO: 71613 - DNA, 32 bp, homo sapien
aaagatacttacaataygttcacctgacataa

SEQ ID NO: 71614 - DNA, 50 bp, homo sapien
aacgatttctttcactatctgtgackaccataaaggaaagccagctcatt

SEQ ID NO: 71615 - DNA, 50 bp, homo sapien
cagggtctgttgggcaattcctaagratggttttggcatgctggtgactg

SEQ ID NO: 71616 - DNA, 50 bp, homo sapien
ttttaagtaagaaatagaaaattaamtatggaagaaaaactgaaatcaga

SEQ ID NO: 71617 - DNA, 50 bp, homo sapien
tctttagacagtgtacgacaaaacaracttttaccaggagacttgaatac

SEQ ID NO: 71618 - DNA, 50 bp, homo sapien
aaggattgatgcattcatttttttcrcttatttggtgctttcaaaaccaa

SEQ ID NO: 71619 - DNA, 50 bp, homo sapien
caacaagaaaggatatctgaacaacrgcactacaagtaaagtgatagaac

SEQ ID NO: 71620 - DNA, 50 bp, homo sapien
ttgaaatttttttagttctgccttaygaaaaagcctttttataccctgat

SEQ ID NO: 71621 - DNA, 50 bp, homo sapien
agaatgatgttcaccaatagctaggsatgattaatattgagtaaagattt

SEQ ID NO: 71622 - DNA, 50 bp, homo sapien
aatctgcaaaaaatgcagtatgcacraagggcaataaagcaaaacacaat

SEQ ID NO: 71623 - DNA, 50 bp, homo sapien
gaaaaaaaaagaaggtgccacatggkaagtccataactttccactgcctg

SEQ ID NO: 71624 - DNA, 50 bp, homo sapien
gccattttcattaaatttgtaatatragacagcattcctaaatggagact

SEQ ID NO: 71625 - DNA, 50 bp, homo sapien
gcaggcttctgagcctgggaagagargaagctttaaattagacaaatagg

SEQ ID NO: 71626 - DNA, 50 bp, homo sapien
gtattctcggcatgacaatctcggasagtagataaatcaagttcacttaa

SEQ ID NO: 71627 - DNA, 50 bp, homo sapien
gctccccttctttggatatcttttckctcatttgtcatatctctatatag

SEQ ID NO: 71628 - DNA, 50 bp, homo sapien
taagaacaaccgtctcacagtactcrgagatataatttgttgaattttta

SEQ ID NO: 71629 - DNA, 50 bp, homo sapien
agatcttagagctcctataatccaayctttcactcaaatggaaatcaaat

SEQ ID NO: 71630 - DNA, 50 bp, homo sapien
gagtagattttaagtgttttcatcayaaataaatggtaagtatgtgcggt

SEQ ID NO: 71631 - DNA, 50 bp, homo sapien
acaaatggctagcacatagtacgtgratatagccttacttccaaagtgac

SEQ ID NO: 71632 - DNA, 50 bp, homo sapien
actaccatttatataatgaaattgcrccatcataaattaactgtatttag

SEQ ID NO: 71633 - DNA, 50 bp, homo sapien
atttcttctgtattttcaaataatgycaggaaatgcatttttaaagtttt

SEQ ID NO: 71634 - DNA, 50 bp, homo sapien
gtgaaaactgaatgagtggattcacraaagtctatataaacccctgagac

SEQ ID NO: 71635 - DNA, 50 bp, homo sapien
atgtcttccctcctacactcaactawaacaattgagatgaaagacttctc

SEQ ID NO: 71636 - DNA, 50 bp, homo sapien
aaatctatgaaacacagctaaaacaktgttgaaaggaaagtttatagcac

SEQ ID NO: 71637 - DNA, 50 bp, homo sapien
gataagaatattcatgaagacaatawgtttacataaaaagacaaggccac

SEQ ID NO: 71638 - DNA, 50 bp, homo sapien
gcacagactgactgactttcaagtargactagttttcacttgctgctatt

SEQ ID NO: 71639 - DNA, 50 bp, homo sapien
aagcccatgcctagttcagctgaccrcaaggaataagcatgggaataaag

SEQ ID NO: 71640 - DNA, 50 bp, homo sapien
attaaggctttatcaaaagctatggrccaaaagagaggggaaataaagac

SEQ ID NO: 71641 - DNA, 50 bp, homo sapien
tgcacatcatccattgcaagaacccrataagtcactcaacacagctgcct

SEQ ID NO: 71642 - DNA, 50 bp, homo sapien
ggggactgtctgttttaccttcctcragaaacatagtgttttagaggtgc

SEQ ID NO: 71643 - DNA, 50 bp, homo sapien
acagtgagattagtgctataactgayactgatctaagcattccagaagat

SEQ ID NO: 71644 - DNA, 50 bp, homo sapien
tttcagtgaagatgaatataattgaygtatttagagcatcttttttaaga

SEQ ID NO: 71645 - DNA, 50 bp, homo sapien
aattgcatattgccttgctttaagayagtcctctgatacctgcatctgaa

SEQ ID NO: 71646 - DNA, 50 bp, homo sapien
acaatatcaccactatgcctgcaatraagtaacttataaacatgattata

SEQ ID NO: 71647 - DNA, 50 bp, homo sapien
ttgatattgaattaattgcgaagtasagaatgaaaaattttctctctttt

SEQ ID NO: 71648 - DNA, 50 bp, homo sapien
gtagagagagtgaagtagggtctaaycatcaatactgacatttagttttc

SEQ ID NO: 71649 - DNA, 50 bp, homo sapien
aattaggatggaaagactatttttcyatataaacgaatccatacattggc

SEQ ID NO: 71650 - DNA, 50 bp, homo sapien
gtctgccatctgacacattccctgtyaatttcttgagtttctcaactcca

SEQ ID NO: 71651 - DNA, 50 bp, homo sapien
aaatttgcaaattgttactttgactsagatcctggtctccatttttgtct

SEQ ID NO: 71652 - DNA, 50 bp, homo sapien
gtgaagaatattgaggtatagagatkttaaccacttggttgacatcacat

SEQ ID NO: 71653 - DNA, 50 bp, homo sapien
tgctaagcttggggaggtgctttaamtactttgcataattttaatactta

SEQ ID NO: 71654 - DNA, 50 bp, homo sapien
tttttagttgtattcagtaacaacaytggtaagcaataggatacatgcag

SEQ ID NO: 71655 - DNA, 50 bp, homo sapien
tcccctttaccctctttcatattcastatcattaccattacaaaattgtt

SEQ ID NO: 71656 - DNA, 50 bp, homo sapien
agcagaacatacacagagaattggargaccatattaaatgtgacaatgat

SEQ ID NO: 71657 - DNA, 50 bp, homo sapien
caataaaagtaattctaaaggaatcrcagaaaatgtagttcaagtattta

SEQ ID NO: 71658 - DNA, 50 bp, homo sapien
tcttttatgtctgaaaaatagaccaytcagtaaaaagctcaaatgctttg

SEQ ID NO: 71659 - DNA, 50 bp, homo sapien
aacacacttagcctcttgaagctaaycatgtatcaggaaatgagtaaaat

SEQ ID NO: 71660 - DNA, 50 bp, homo sapien
ttattcaaattgcatttacagtttcratggacagaaaattcttatgttat

SEQ ID NO: 71661 - DNA, 50 bp, homo sapien
ttaactactactaattgttaaagtcygaacatgtttggagttacaaatgt

SEQ ID NO: 71662 - DNA, 50 bp, homo sapien
ggaacaaggctctatttcacaatcartattcttgttagacggcattacga

SEQ ID NO: 71663 - DNA, 50 bp, homo sapien
tcaatattcttgttagacggcattaygacttcatggaattccgttaaaag

SEQ ID NO: 71664 - DNA, 50 bp, homo sapien
agttgtgtctgcatgtctgagtgtamaataatttaatgagataaatgtaa

SEQ ID NO: 71665 - DNA, 50 bp, homo sapien
tttcattgagcacatctaccaccaaytgatgaaccaaataattcaccttg

SEQ ID NO: 71666 - DNA, 50 bp, homo sapien
gatttttaaaaaaataagtgcacacragacattcaaatacttccctgtgc

SEQ ID NO: 71667 - DNA, 50 bp, homo sapien
tctcaacagaatctttcattatggasaagaaaactagaaaaagtaagtag

SEQ ID NO: 71668 - DNA, 50 bp, homo sapien
ggacagctgggatattagtaataaarggatgaaaagcgcaccctgaactc

SEQ ID NO: 71669 - DNA, 50 bp, homo sapien
agcaactatttttcaaagctaattaraagtgacacagcgattctcctttc

SEQ ID NO: 71670 - DNA, 50 bp, homo sapien
cagatagaaaatgatttttttaagaygcagtgacagcagtagaggacaaa

SEQ ID NO: 71671 - DNA, 50 bp, homo sapien
attttcctatgactacctgtcttcakaaactaagtgtaagtttgaattct

SEQ ID NO: 71672 - DNA, 50 bp, homo sapien
tgcaaacaatttgtttttggcattgmatgtaaagactatcatcatttact

SEQ ID NO: 71673 - DNA, 50 bp, homo sapien
tcaccaagaaattaattgggtgctgyatagttactcatagttgttctact

SEQ ID NO: 71674 - DNA, 50 bp, homo sapien
tttataatcctattttatatgtgaaygctccaaaaatttcaacaacatca

SEQ ID NO: 71675 - DNA, 50 bp, homo sapien
aaatactttaagaagtgatccaactraggtagtagatatgatggcattca

SEQ ID NO: 71676 - DNA, 50 bp, homo sapien
acaataactgagcaagagtaaacaayaatcactagagggttttaaaggcc

SEQ ID NO: 71677 - DNA, 50 bp, homo sapien
ctaatagacagaaaaattaatttcaycgagccatctacctgcacctgtgg

SEQ ID NO: 71678 - DNA, 50 bp, homo sapien
catatcttttctcttgtatatttcaygtggaaacaataaaaaaaactctt

SEQ ID NO: 71679 - DNA, 50 bp, homo sapien
tatctaaagcagaaaagcaatagatragatccacttttaatatctatccc

SEQ ID NO: 71680 - DNA, 50 bp, homo sapien
cccttaaaattgtgagtttaatttcycttttaatcagtggccatcagaaa

SEQ ID NO: 71681 - DNA, 50 bp, homo sapien
actagagaaagttcttaggcagagaygaaaaacacccagatgcccttgtt

SEQ ID NO: 71682 - DNA, 50 bp, homo sapien
attagctttttctctacctgagtgargttaacaatgcaaagacaaatttg

SEQ ID NO: 71683 - DNA, 50 bp, homo sapien
gaaaaacacccagatgcccttgttawgagtagccattagttctagacaaa

SEQ ID NO: 71684 - DNA, 50 bp, homo sapien
tactgaaagttcaatgaaactgacaygaaattgtaatacagatgccaatt

SEQ ID NO: 71685 - DNA, 50 bp, homo sapien
aaacaatattcactgcttgatgtggractccttttcctatacattatact

SEQ ID NO: 71686 - DNA, 50 bp, homo sapien
attcttatatcaaagaatgttcatawcaaaaattcaatctcatcctggga

SEQ ID NO: 71687 - DNA, 50 bp, homo sapien
catctagaaacagtttatgtgtccaygaagttgtgtatgtgtggtctgat

SEQ ID NO: 71688 - DNA, 50 bp, homo sapien
ttatatagacagaggtctgaatttgrtgacagacttaatatgggcacatg

SEQ ID NO: 71689 - DNA, 50 bp, homo sapien
aacagtcttgaaagattagttggttrtataggttactacaatatagagag

SEQ ID NO: 71690 - DNA, 50 bp, homo sapien
caaatgttatgatagataatcctgawgacctgaacatctatccacctggt

SEQ ID NO: 71691 - DNA, 50 bp, homo sapien
gatcaagtgaaagaggattgtgtaaracatcttttatgagttagatctaa

SEQ ID NO: 71692 - DNA, 50 bp, homo sapien
gtataggtttctataaacattaaccrcaatgaacatttaaataatcaata

SEQ ID NO: 71693 - DNA, 50 bp, homo sapien
aaaaagcagaaaaccaggaatcacamaagcacagggccctctcaggcact

SEQ ID NO: 71694 - DNA, 50 bp, homo sapien
agctacgatttattgctgtgtaatawccccttgtgcggaagtactatagc

SEQ ID NO: 71695 - DNA, 50 bp, homo sapien
aaagtcagtgaataagtctttttccygacacaaaagaggctttggttctt

SEQ ID NO: 71696 - DNA, 50 bp, homo sapien
ttaactgagctttctgtaaacaggarcattttaataagcgataaattttt

SEQ ID NO: 71697 - DNA, 50 bp, homo sapien
tatcaatatacaacaagatgcaaatmaggatgatgatacagtgtgccatt

SEQ ID NO: 71698 - DNA, 50 bp, homo sapien
aacatgtctctggaagcaaaatatakgaatttttaaaactacatgcatag

SEQ ID NO: 71699 - DNA, 50 bp, homo sapien
tcttattattttactacagttagtayaatagacaatcaagtaccctcctg

SEQ ID NO: 71700 - DNA, 50 bp, homo sapien
cctttagttttctaaaacattaaatragaattgccagtacggtgagaaat

SEQ ID NO: 71701 - DNA, 50 bp, homo sapien
acatcgtgatattttctaaggtgtaygatgaggttaccaaaagaccagaa

SEQ ID NO: 71702 - DNA, 50 bp, homo sapien
agtatgatttagggtgaattttacayacattctggttcctaacattttac

SEQ ID NO: 71703 - DNA, 50 bp, homo sapien
cagtcctgcctctgttcctcgttcawatggaatgccagctctcctaattg

SEQ ID NO: 71704 - DNA, 50 bp, homo sapien
acagggatcacaacacaatgctaacractgatatttatcactttctaaga

SEQ ID NO: 71705 - DNA, 50 bp, homo sapien
tatttaaatatatctatacaaaatamacataaatctagttaaattaataa

SEQ ID NO: 71706 - DNA, 50 bp, homo sapien
tgaaacatcttcccagataatttgakaacatttccaagaatcattcttca

SEQ ID NO: 71707 - DNA, 50 bp, homo sapien
tttcaatcatggaacatcagtattcyattatcaaactttcatcaatcctt

SEQ ID NO: 71708 - DNA, 50 bp, homo sapien
cacttgaactttgggaagtcataccraagttgttttacacattaaggaag

SEQ ID NO: 71709 - DNA, 50 bp, homo sapien
tatctatctacctatctaaaaagccraggtctactctaaactacctaata

SEQ ID NO: 71710 - DNA, 50 bp, homo sapien
atttattgaatactgtatattatgtyaaaattgtgatgattttgtaccag

SEQ ID NO: 71711 - DNA, 50 bp, homo sapien
tccttttagttttatttccacatagmattccttacaaatcattttcttta

SEQ ID NO: 71712 - DNA, 50 bp, homo sapien
actcactcatctttaaaaatacccarattgttcaaaccaccattttattt

SEQ ID NO: 71713 - DNA, 50 bp, homo sapien
tgcatgagtgtcataatactatggaraacacactattttttctcattgtt

SEQ ID NO: 71714 - DNA, 50 bp, homo sapien
tcacagacttacaatttaagtatcartaggacatgtgtggtgtgtttatg

SEQ ID NO: 71715 - DNA, 50 bp, homo sapien
aaaagcgaagggagagaaagtctgcrtacatatagcctcctcatgacaga

SEQ ID NO: 71716 - DNA, 50 bp, homo sapien
aggaaattagttctaaactctctaayctctcaataggaggagtgtcaaaa

SEQ ID NO: 71717 - DNA, 50 bp, homo sapien
ataatctagaaaatattccgatagawcatttcaaatagagcaatgcatat

SEQ ID NO: 71718 - DNA, 50 bp, homo sapien
aacaattatgacaatttaaataatcraaactaaggcacagtctaggtttc

SEQ ID NO: 71719 - DNA, 50 bp, homo sapien
agaaatggcaggacactgttgtgacrcctatatttactttaattttgcac

SEQ ID NO: 71720 - DNA, 50 bp, homo sapien
aggaataatgatataactcaattccrctgagaaattaaaatttaaataga

SEQ ID NO: 71721 - DNA, 50 bp, homo sapien
cctctgaatcttagtcttggtgaccrggaattgagaaacatctgttgctg

SEQ ID NO: 71722 - DNA, 50 bp, homo sapien
taatacagtcttgtaatgaaatattraaactatggaaattgaataaaaag

SEQ ID NO: 71723 - DNA, 50 bp, homo sapien
cccagtttatatttcaaatagctaaytcattccagtttatgggtaagaag

SEQ ID NO: 71724 - DNA, 50 bp, homo sapien
ctttcttaatagaaatagcataccaycataatctgaaaattacatctcct

SEQ ID NO: 71725 - DNA, 50 bp, homo sapien
gcttgccgttgtgattatttattgcrcgttaataacagttaaatttcctg

SEQ ID NO: 71726 - DNA, 50 bp, homo sapien
tttctgtaactcctcctatttattaygacaagagttggttctggaattga

SEQ ID NO: 71727 - DNA, 50 bp, homo sapien
agttgggtatggtcttgttgctacayggctaaattctgatttttgattga

SEQ ID NO: 71728 - DNA, 50 bp, homo sapien
tatccttttcctgatactgctgtacygagtaccttgcctatataggaaag

SEQ ID NO: 71729 - DNA, 50 bp, homo sapien
gaagcagcaagggttgtgtgaacaartgagcacagggtccagccagtgtg

SEQ ID NO: 71730 - DNA, 50 bp, homo sapien
ctgtgaacaggagaaataataaataycaggcaagacaagatcattgtaac

SEQ ID NO: 71731 - DNA, 50 bp, homo sapien
caagccaggtactactaaggatttgyaaagagaaaattaatttgctcaag

SEQ ID NO: 71732 - DNA, 50 bp, homo sapien
cgactaattatttgaaaataaattaygaagttcagtcaaataaaatgtat

SEQ ID NO: 71733 - DNA, 50 bp, homo sapien
gcttcccataaactacaagcaagaarcgaaagagactttagaaagctaaa

SEQ ID NO: 71734 - DNA, 50 bp, homo sapien
accatatccaatttaagctgtctccrccaaagggaagctagattgttatt

SEQ ID NO: 71735 - DNA, 50 bp, homo sapien
cagtatggttttaagattctacatakgctataggctttaaacttcaaatg

SEQ ID NO: 71736 - DNA, 50 bp, homo sapien
gtttttattaaattgaatcacatgcrctgactttggtatgtaaaactgac

SEQ ID NO: 71737 - DNA, 50 bp, homo sapien
acacattgcattaattgtgaaagaarcgtatatcattgtgttgtggttag

SEQ ID NO: 71738 - DNA, 50 bp, homo sapien
aataaacaattcagttagacaatgaycgtcattaacataagtatatctgt

SEQ ID NO: 71739 - DNA, 50 bp, homo sapien
actagagataattaacttgaggtaawcctgaatatagctcccacaattgt

SEQ ID NO: 71740 - DNA, 50 bp, homo sapien
acatctgagattggtgaccatcagayaacttcatgccttgataatagttc

SEQ ID NO: 71741 - DNA, 50 bp, homo sapien
aaggagattacagttgtaaggataascattaaagaataagtaagacctaa

SEQ ID NO: 71742 - DNA, 50 bp, homo sapien
atttctggacaccctactgcattaayaagacaataatgtggacactcttt

SEQ ID NO: 71743 - DNA, 50 bp, homo sapien
taacctactatttatggactatgaakgaaacaagggctattgctactttt

SEQ ID NO: 71744 - DNA, 50 bp, homo sapien
ctatttttttatttcctggctacaargtttcacatatagaaaatatggag

SEQ ID NO: 71745 - DNA, 50 bp, homo sapien
ataaatgtctagaatatgtaaccacrctcactcttgcaagttattatgtt

SEQ ID NO: 71746 - DNA, 50 bp, homo sapien
tatgtaccagacagagggtttagtasattttgctcttgtctcatttagtc

SEQ ID NO: 71747 - DNA, 50 bp, homo sapien
tttcaaatggaaatgctatagcagargtctgtaaaggatttgtgtaaaag

SEQ ID NO: 71748 - DNA, 50 bp, homo sapien
actatctacctagggaaacagacaayaacgcatcatagctgttcatttca

SEQ ID NO: 71749 - DNA, 50 bp, homo sapien
tgttgctctttctcaccttgtcacargattttatgttattcttcctcttt

SEQ ID NO: 71750 - DNA, 50 bp, homo sapien
gagaaattaccagtggaagaatacarattgagaagacattctaggaagaa

SEQ ID NO: 71751 - DNA, 50 bp, homo sapien
tcctaggataaagagagcttatctaytgaatgacctcagataaaatgcca

SEQ ID NO: 71752 - DNA, 50 bp, homo sapien
aaaatgcattatgtgtcttaggaaartgttcagaatctaaatcagtgatc

SEQ ID NO: 71753 - DNA, 50 bp, homo sapien
catgatataaactgttatgggatacwacaaattcgtaattttactggcac

SEQ ID NO: 71754 - DNA, 50 bp, homo sapien
tttataatgtgtctttggagatctarcagaatattattacacataggaca

SEQ ID NO: 71755 - DNA, 50 bp, homo sapien
cccatatctaatcttgttttatccayattgtattctattattgcttaact

SEQ ID NO: 71756 - DNA, 50 bp, homo sapien
ttgatctgtaatcttccaaggtcacrctaaggttgataagtatacttgag

SEQ ID NO: 71757 - DNA, 50 bp, homo sapien
tgattgaacagtgtatatagggacamcagcaatcataaataaaccaatag

SEQ ID NO: 71758 - DNA, 50 bp, homo sapien
actaatgcattatgaagatgaagtaytaagaggagcccagaacttagaca

SEQ ID NO: 71759 - DNA, 50 bp, homo sapien
cctgaattacgcgtggaaaaaaagcratatatacatccctttacttcacc

SEQ ID NO: 71760 - DNA, 50 bp, homo sapien
atatcactccagttgtaagaaatcarctgaaacatagcatgtctagatgt

SEQ ID NO: 71761 - DNA, 50 bp, homo sapien
taagaagttttctgtctttggtcctmaattcctaactcatcagtcaattt

SEQ ID NO: 71762 - DNA, 50 bp, homo sapien
aacacaacaaaatattgctgaactargcatcaagagaaccagcatgatct

SEQ ID NO: 71763 - DNA, 50 bp, homo sapien
agagttagcagtggtgctgtgcctayggttgtttgcaggccttctttttt

SEQ ID NO: 71764 - DNA, 50 bp, homo sapien
cagtccatttaacatgaagacatatwaaaggaagtacttgttaatctaaa

SEQ ID NO: 71765 - DNA, 50 bp, homo sapien
ctggccaaaacctattgccaagtacrcatttttgcagtttctggagtgtt

SEQ ID NO: 71766 - DNA, 50 bp, homo sapien
ataatctctgagagctacaaaatccrgtgcaaagctgttttattcttcca

SEQ ID NO: 71767 - DNA, 50 bp, homo sapien
tgcctaacagaatactcacaccagargtttcagtacttttaggggctgcc

SEQ ID NO: 71768 - DNA, 50 bp, homo sapien
acttagaaaaaagaggaaaaaagaaygtgaagactcaggactataaagaa

SEQ ID NO: 71769 - DNA, 50 bp, homo sapien
aaggccactttgtacacctgatacawcctcccaagtgaagtctatttttc

SEQ ID NO: 71770 - DNA, 50 bp, homo sapien
aattaaaagttactacgaattcagayagaaataattacatacttgaaaat

SEQ ID NO: 71771 - DNA, 50 bp, homo sapien
agactggcccagggaagtctaaccaytcattaatagggcattgcttgtta

SEQ ID NO: 71772 - DNA, 50 bp, homo sapien
tgttctcagaggattgacttctgtcycaaggtggtgttaagtaaaaaaaa

SEQ ID NO: 71773 - DNA, 50 bp, homo sapien
aagccccactgaagtaattggtagaraatgagtaacatgataaacacctg

SEQ ID NO: 71774 - DNA, 50 bp, homo sapien
ataactccaaggtgcaaggctcctaycttcaaggatcaatgaaaatatta

SEQ ID NO: 71775 - DNA, 50 bp, homo sapien
gcaagccccaatgttctctgattcakctaaacttatttaaggttttttta

SEQ ID NO: 71776 - DNA, 50 bp, homo sapien
gattaatatgcctaagtattttataracacaaaccgattataaagagaca

SEQ ID NO: 71777 - DNA, 50 bp, homo sapien
ttcattggtgagggtatttaaagacygagtagcttaatatttaaccacaa

SEQ ID NO: 71778 - DNA, 50 bp, homo sapien
ttgctcatcttaaaatgaggtatccrgaactaatcatgttcgttaagagt

SEQ ID NO: 71779 - DNA, 50 bp, homo sapien
aaaatatggtacttatacaccatacratactacacagttattaaaaagga

SEQ ID NO: 71780 - DNA, 50 bp, homo sapien
cagtctggttacttcagcttccccartcactgataactgctttttttagc

SEQ ID NO: 71781 - DNA, 50 bp, homo sapien
gccattaatgatactctgttaaaaayacatgagagtcatgaagataatat

SEQ ID NO: 71782 - DNA, 50 bp, homo sapien
aaaaagaaaggacagttcctaaatcraacataaactatcaattggctata

SEQ ID NO: 71783 - DNA, 50 bp, homo sapien
gctaaggctgactgagacaaatttamgtattagttggcagctgtaatcgt

SEQ ID NO: 71784 - DNA, 50 bp, homo sapien
agctctgagtcagcttacagtaacarggcataattttgttgtaacagtct

SEQ ID NO: 71785 - DNA, 50 bp, homo sapien
ttatcctttcacaaataaccttaackgacatctgaacaatttttgcttta

SEQ ID NO: 71786 - DNA, 50 bp, homo sapien
gcatttctcctttgaaccagttcaartgtattcagagaaacttctgacga

SEQ ID NO: 71787 - DNA, 50 bp, homo sapien
ttgtgatgttcttaatttcttatgcrgaccaaagaactaaccattttcat

SEQ ID NO: 71788 - DNA, 50 bp, homo sapien
aacacaaaaaaatatcgcaggcatgmaaaaagtacatttcacagagaatg

SEQ ID NO: 71789 - DNA, 50 bp, homo sapien
cagtcaaagtgttggtagcataatcratgtttccaattgtacctgctata

SEQ ID NO: 71790 - DNA, 50 bp, homo sapien
ccactggttcctttgacacctgagtyactattcaaaattcatgaatgaaa

SEQ ID NO: 71791 - DNA, 50 bp, homo sapien
gattttaagataaaaacctatactcrcattttgcaaatttttttgagttt

SEQ ID NO: 71792 - DNA, 50 bp, homo sapien
aaatccctatctagttttcaagtaasactaagcaaactgcataaaacata

SEQ ID NO: 71793 - DNA, 50 bp, homo sapien
ttttatggcatttatattgctttgayggacctcccatttagtgaaaagtt

SEQ ID NO: 71794 - DNA, 50 bp, homo sapien
tcggttttttatttctccatactctwacaatcacaactttggtttgctat

SEQ ID NO: 71795 - DNA, 50 bp, homo sapien
gacttcagtcattgaaattgagaacraatggtgtgtttctttgccagaag

SEQ ID NO: 71796 - DNA, 50 bp, homo sapien
tcagatatgaccaggttctgtcaatraagtgaaacaacatcggcaattat

SEQ ID NO: 71797 - DNA, 50 bp, homo sapien
acaagatgcatattaattcctgttgmaaataagctctctgaggtactgaa

SEQ ID NO: 71798 - DNA, 50 bp, homo sapien
catgactaacttctactctacagccrgatttatttcagaagagcagtcta

SEQ ID NO: 71799 - DNA, 50 bp, homo sapien
gagaaattcaaagcaattgaactcaygttggtgttgtccataaatatgaa

SEQ ID NO: 71800 - DNA, 50 bp, homo sapien
cataaattgtaaatgtagataaatckctaagtgcaatctctatgtatgct

SEQ ID NO: 71801 - DNA, 50 bp, homo sapien
cccataactaaacctcaaaaaagtayaatttattcacatcgtacttgggt

SEQ ID NO: 71802 - DNA, 50 bp, homo sapien
gtataatgaaacaaaccaatataatmatgagatcgtcaatttcttcttct

SEQ ID NO: 71803 - DNA, 50 bp, homo sapien
cagcattagtagatatcaacgatgasagcttcaaattctcagaccaccta

SEQ ID NO: 71804 - DNA, 50 bp, homo sapien
actattcttttatttcactagcttayctactcaataaacataagagtatt

SEQ ID NO: 71805 - DNA, 50 bp, homo sapien
atatacaatggatacacaaaagtcaraaccttagcatatgtggggatttc

SEQ ID NO: 71806 - DNA, 50 bp, homo sapien
cacatttttaacagaagcatatttcygaagttttgccaactcattattaa

SEQ ID NO: 71807 - DNA, 50 bp, homo sapien
attggaaaattattgtctaagcataygtactctgctttgttaagggttac

SEQ ID NO: 71808 - DNA, 50 bp, homo sapien
agtaacagagttatattttgttcacrtttttaacagaagcatatttccga

SEQ ID NO: 71809 - DNA, 50 bp, homo sapien
ttgttttaaatgttatcttagtgtcycattggtctgaggtttttcctctt

SEQ ID NO: 71810 - DNA, 50 bp, homo sapien
tttctaatacccactatgcatttagyaggacattgaacagaaaagtaaat

SEQ ID NO: 71811 - DNA, 50 bp, homo sapien
agagaaatgggaaaatattacagtgraaaaacagataaggcttcaggtat

SEQ ID NO: 71812 - DNA, 50 bp, homo sapien
tgaaaattaaatacagaattaaagargagccatttccatgagatcaaaga

SEQ ID NO: 71813 - DNA, 50 bp, homo sapien
acacctgtgtctctcttttacctgasgcctttagaatatatgcaatccaa

SEQ ID NO: 71814 - DNA, 50 bp, homo sapien
tttttacatttatcacatagaatacrggatgcctaacccttgtcatactt

SEQ ID NO: 71815 - DNA, 50 bp, homo sapien
ttctgtggcgtgaggaggaatgccawcacttactttggtatttttttcaa

SEQ ID NO: 71816 - DNA, 50 bp, homo sapien
agatgtgtaacttgaataagttacaytacacagttgaattgccaactcat

SEQ ID NO: 71817 - DNA, 50 bp, homo sapien
cgtatgaatgctagtaaggaaatcaraaggaagtaaactctggacccaaa

SEQ ID NO: 71818 - DNA, 50 bp, homo sapien
ctgtattctaaggattttaatgaaaygaaggcacattaaaatcataatcc

SEQ ID NO: 71819 - DNA, 50 bp, homo sapien
agtaattgaaaagctggagaaactakatccttccatgaacaactcaccaa

SEQ ID NO: 71820 - DNA, 50 bp, homo sapien
aggctgaatgaaagcctatcttttgmgagcatggtttagtgactatttca

SEQ ID NO: 71821 - DNA, 50 bp, homo sapien
attctcacagcactcaatttgcttckaatgtgttaattctgtaattggct

SEQ ID NO: 71822 - DNA, 50 bp, homo sapien
accatatatttttgcttaatacttcmctcttgtgcaatttatcatcagta

SEQ ID NO: 71823 - DNA, 50 bp, homo sapien
gattctttgtgaaacacatgacaaamattatcaaatatgaaatatctttg

SEQ ID NO: 71824 - DNA, 50 bp, homo sapien
actttatccttccagccgcaactcaratgacccaaagtcagacatcacat

SEQ ID NO: 71825 - DNA, 50 bp, homo sapien
atgcagaacatgtgttgatttctcaygtcaatactttactacccttgaag

SEQ ID NO: 71826 - DNA, 50 bp, homo sapien
gatttagataattataagacagttaktcatcaagatccatttattttctg

SEQ ID NO: 71827 - DNA, 50 bp, homo sapien
gtgcaaataaacacacactgatatayctggtaagcaatgagaggcaacat

SEQ ID NO: 71828 - DNA, 50 bp, homo sapien
ttcctagaaaatcatacttaccaatracatttgtgaaattactaatagag

SEQ ID NO: 71829 - DNA, 50 bp, homo sapien
taaaacatatcattttgtaaaagaarataacataatccagaatgtacaca

SEQ ID NO: 71830 - DNA, 50 bp, homo sapien
taatactttttgagcccttttttgartagactctaatttgaaaaggctgc

SEQ ID NO: 71831 - DNA, 50 bp, homo sapien
gcctggaggcaggaattgatggacartaaaagagattttttgacttgatg

SEQ ID NO: 71832 - DNA, 50 bp, homo sapien
agtacatggtaggtacttttcaggawagagttatgttgaacagcttgaca

SEQ ID NO: 71833 - DNA, 50 bp, homo sapien
ccactgagcacatagcattatgacakaactattcctgagacatggggaga

SEQ ID NO: 71834 - DNA, 50 bp, homo sapien
tttcacattggtagcacctatatttygaaggtgacacattaaagccatag

SEQ ID NO: 71835 - DNA, 50 bp, homo sapien
gacactaaatccagacaggaaacagraggagacttgtgaactaagccttt

SEQ ID NO: 71836 - DNA, 50 bp, homo sapien
aaataggggaaataatttgtgtctartaacggagccttaatttctttcat

SEQ ID NO: 71837 - DNA, 50 bp, homo sapien
ttataaaattctcctaatccagtatsagtagatttaacagctcttaacat

SEQ ID NO: 71838 - DNA, 50 bp, homo sapien
ccccttctggatagctgctgacaagractgctgttcacatgtgttctgaa

SEQ ID NO: 71839 - DNA, 50 bp, homo sapien
tgacattctccactatagtgctatawgactgcttcacagacatgtcttaa

SEQ ID NO: 71840 - DNA, 50 bp, homo sapien
taggttactacatctgctggtctaastgtagcatagaagagggaagaaga

SEQ ID NO: 71841 - DNA, 50 bp, homo sapien
acttagtttagagtagtattttctgraacatgatataactatctataaca

SEQ ID NO: 71842 - DNA, 50 bp, homo sapien
taaggtttgggagatttcagatagtraaactgcatggtaatttagatttt

SEQ ID NO: 71843 - DNA, 50 bp, homo sapien
tagttctaaatcaatttttggtctgyaaatctatttcctaactgaagaga

SEQ ID NO: 71844 - DNA, 50 bp, homo sapien
aatgacactactgaatttgtgagatmagtctgcaaactgaattatatacc

SEQ ID NO: 71845 - DNA, 50 bp, homo sapien
tgatcatttgccttttggctttagargtgggcttatctgagacaaagaga

SEQ ID NO: 71846 - DNA, 50 bp, homo sapien
tgtggatctttaaaccattacctcartatcttgattactatatctttgca

SEQ ID NO: 71847 - DNA, 50 bp, homo sapien
agatgctgagggccaaaagggtggakaatgtggatatcatgcatttgcct

SEQ ID NO: 71848 - DNA, 50 bp, homo sapien
ttaaaccaattctcttcagtaataarcatcaagtgacattgagaagaggc

SEQ ID NO: 71849 - DNA, 50 bp, homo sapien
caatttgatgttctgtgtagaagacrattggtgaaggcttctattcagcc

SEQ ID NO: 71850 - DNA, 50 bp, homo sapien
catctagagtattctatgtcccatargcatttcaagacacgcaagaaaga

SEQ ID NO: 71851 - DNA, 50 bp, homo sapien
tctttcttgctagcaccaagataaakgttcctactccaaagagcaacatc

SEQ ID NO: 71852 - DNA, 50 bp, homo sapien
tgcttggtaacatgatgaccattcamtcataaaattaatgtccacccaga

SEQ ID NO: 71853 - DNA, 50 bp, homo sapien
actaatttggaaggcataataatgaygtaggagtaaaataatcaacagta

SEQ ID NO: 71854 - DNA, 50 bp, homo sapien
tccctaaaactacaaaagaataatakgaccttacactttgtaataaaaaa

SEQ ID NO: 71855 - DNA, 50 bp, homo sapien
tattacagagaatttaaggataataraggcaaatactcctaattgcctaa

SEQ ID NO: 71856 - DNA, 50 bp, homo sapien
atttaaatatacatctaacttgaaakcactttttgagctctaagtaagaa

SEQ ID NO: 71857 - DNA, 50 bp, homo sapien
gctatggctttgtcttttatagccaygcaatctaatgtctgatacatttt

SEQ ID NO: 71858 - DNA, 50 bp, homo sapien
aaacaatcctatttaatttattccaycagtcaatcaatatgtattaagca

SEQ ID NO: 71859 - DNA, 50 bp, homo sapien
tatgataattatcttcataattatcrcagtaactgaacttccattgagtg

SEQ ID NO: 71860 - DNA, 50 bp, homo sapien
aaattctggtattatttacagcaacmattctaaattaaatatgaggattc

SEQ ID NO: 71861 - DNA, 50 bp, homo sapien
gcacttattgcattaagaagaaccayattaaatctgttcagagtaatttc

SEQ ID NO: 71862 - DNA, 50 bp, homo sapien
aaaataactttaaaaagttcactaaycatttactaatcattttctattga

SEQ ID NO: 71863 - DNA, 50 bp, homo sapien
aaacaagaacacctaactaaatagcytttcatctttccttcaaagcaaga

SEQ ID NO: 71864 - DNA, 50 bp, homo sapien
cctgcttatttatctggcataataarctatttgggcgggatgagggagat

SEQ ID NO: 71865 - DNA, 50 bp, homo sapien
gaactaatccccagcaactactaackgtgtgaactcactgatctccctga

SEQ ID NO: 71866 - DNA, 50 bp, homo sapien
tatctgaaaaatggcataaataatartatcatatcatgagaattaaaata

SEQ ID NO: 71867 - DNA, 50 bp, homo sapien
atatgaggtgtggaattttccactayggtgttatgtcagtacttaataag

SEQ ID NO: 71868 - DNA, 50 bp, homo sapien
atagctctacattcagtagaaataaycacacgtaagtgtttttgaatgac

SEQ ID NO: 71869 - DNA, 50 bp, homo sapien
aagagaacacctccaagcaaaaaaasgtcacacttaggcacagccctcag

SEQ ID NO: 71870 - DNA, 50 bp, homo sapien
actatagactagagtgctacatatargtcaatctgaaaaggtggaagaga

SEQ ID NO: 71871 - DNA, 50 bp, homo sapien
gtaccattttgtacatatctaataarcattgatacattttcgttgaataa

SEQ ID NO: 71872 - DNA, 50 bp, homo sapien
tatttgtttttgtaacagagcattayggcaacattggaaaaaataaattc

SEQ ID NO: 71873 - DNA, 50 bp, homo sapien
aaagctttcagtttcttctcattcartatgatgtaagctgtgggtttgtt

SEQ ID NO: 71874 - DNA, 50 bp, homo sapien
tttaggatgtttaccactgatgtcawgattaaaaaattacctgtagtcag

SEQ ID NO: 71875 - DNA, 50 bp, homo sapien
tctacctctttcttagtttcttcaastactctagttcaccctgagcttta

SEQ ID NO: 71876 - DNA, 50 bp, homo sapien
tgtagcttctaacaatattttgggakacttaccataagagttgcaaacaa

SEQ ID NO: 71877 - DNA, 50 bp, homo sapien
attccatgtgatgtgatcaaaaaaawtaagctgaaaattagaaaagtaat

SEQ ID NO: 71878 - DNA, 50 bp, homo sapien
cagcagaacatggtagaaataatacyggtttggaagttgagtattcctga

SEQ ID NO: 71879 - DNA, 50 bp, homo sapien
tttcttttttctaaatatggactaartggaatgacagcaataataagtaa

SEQ ID NO: 71880 - DNA, 50 bp, homo sapien
cctgagtaactccctgatttggctgrattggagaacaagagatcatgccc

SEQ ID NO: 71881 - DNA, 50 bp, homo sapien
ccctggaccattgattgccctatatyagacattatactaagtgcatagaa

SEQ ID NO: 71882 - DNA, 50 bp, homo sapien
tttcagtttattacattaaaattgarctactagaaacatagtaagaataa

SEQ ID NO: 71883 - DNA, 50 bp, homo sapien
ttccccttggcattatgcttagaaarttattccccatgaaaagattatat

SEQ ID NO: 71884 - DNA, 50 bp, homo sapien
atctatttacaagactctaacttaayattagcagattgcagactctataa

SEQ ID NO: 71885 - DNA, 50 bp, homo sapien
ccgtggataccaacagacaactgtaygctaacagaaaattatacctacat

SEQ ID NO: 71886 - DNA, 50 bp, homo sapien
tttattttaactcatttatttgtaamctgcggtgcccacccagactagaa

SEQ ID NO: 71887 - DNA, 50 bp, homo sapien
taaaagaatctattaatgggccctawaaaattagctatgtacattatttt

SEQ ID NO: 71888 - DNA, 50 bp, homo sapien
tagaatatacaatatgaatctgaaamgagagtcatattaatagagtatcc

SEQ ID NO: 71889 - DNA, 50 bp, homo sapien
tttatggttgtgagaaaacactcgawgattggaacaacagattagtttca

SEQ ID NO: 71890 - DNA, 50 bp, homo sapien
aaaaattgttatttttgaatgtcacyatttgattatcatcatcattatta

SEQ ID NO: 71891 - DNA, 50 bp, homo sapien
cttttctctgtccttttacctggacygcagggttagatttcagccctcgt

SEQ ID NO: 71892 - DNA, 50 bp, homo sapien
ccaccaaatttatcacctaagctggyatcccctagaattagctttccctt

SEQ ID NO: 71893 - DNA, 50 bp, homo sapien
aaagaatcaaggatagtaatgagaayattgttaaaatgatcagccatgag

SEQ ID NO: 71894 - DNA, 50 bp, homo sapien
aaataaataaatctaacttaagatgyaattttgagggtcttgctttgggt

SEQ ID NO: 71895 - DNA, 50 bp, homo sapien
agggccttgccagggcaggactaacsaaatcctaggtgaattaacatggt

SEQ ID NO: 71896 - DNA, 50 bp, homo sapien
ttcctctataggatgagtttcatcarattgaagtgctggtttctggttta

SEQ ID NO: 71897 - DNA, 50 bp, homo sapien
gcttctaagtgcagtattagtgatayaaccagagtatataagagactcat

SEQ ID NO: 71898 - DNA, 50 bp, homo sapien
cttcagtcagagtttttcttattacygggtgattatgcatttatcttctt

SEQ ID NO: 71899 - DNA, 50 bp, homo sapien
catgcccacccctggacaaatgacartgatcagaggactgaaagaatgtg

SEQ ID NO: 71900 - DNA, 50 bp, homo sapien
agtaacttatgtaattagggagatayatagctagctacttttactataaa

SEQ ID NO: 71901 - DNA, 50 bp, homo sapien
ctttgatgaaagtggccaaattttawcataacagaatgaaaaatagtcat

SEQ ID NO: 71902 - DNA, 50 bp, homo sapien
tgtaaacatagcaacttttagacagraacgtatacttcaaaaggaatcct

SEQ ID NO: 71903 - DNA, 50 bp, homo sapien
tctggaataaatgtttctcattaccracgaaggactatgaatccatggcc

SEQ ID NO: 71904 - DNA, 50 bp, homo sapien
cctcttatagtgacattgtcaggaaytgcatgaataacaaccttcaaata

SEQ ID NO: 71905 - DNA, 50 bp, homo sapien
aattcctgacaatgtcactataagargttgcttttatatgggtacaacaa

SEQ ID NO: 71906 - DNA, 50 bp, homo sapien
atgaaactcaaatgtcttaccacttraaatataacacagcttttatgtga

SEQ ID NO: 71907 - DNA, 50 bp, homo sapien
gtacattcagtgcatatctgtagaaytgtatcatttcagtaaaatggaga

SEQ ID NO: 71908 - DNA, 50 bp, homo sapien
tctgttactttcattttttagctcaktatatttagcacataatttgattt

SEQ ID NO: 71909 - DNA, 50 bp, homo sapien
tgtgcggagatcacgcagcaagaaaygaagaaagagagagagcatggagg

SEQ ID NO: 71910 - DNA, 50 bp, homo sapien
tgtaggacatataaacttttcaaaasatccaagaatataaagaggtacat

SEQ ID NO: 71911 - DNA, 50 bp, homo sapien
aggacctgaatacatgttagtttccrttttcttctgttccaccctctcca

SEQ ID NO: 71912 - DNA, 50 bp, homo sapien
gattaaattatgaactcttaaagaaytaaaccctatgcatttctagaaaa

SEQ ID NO: 71913 - DNA, 50 bp, homo sapien
aaataaagggaaattacttcctatcycaagaaaagataatccatcctgat

SEQ ID NO: 71914 - DNA, 50 bp, homo sapien
gtatttttattttcacaacttacatyggttttcagatttaagcaccataa

SEQ ID NO: 71915 - DNA, 50 bp, homo sapien
tctttcaaatcatttcatatatgacwgcttagttcacttacttttaaggc

SEQ ID NO: 71916 - DNA, 50 bp, homo sapien
tttctgtgtattaatgtacaatgggycaaaattatcagaagcatattaca

SEQ ID NO: 71917 - DNA, 50 bp, homo sapien
aacgaagctttaacagcaaacaaagraggtttatttaattactgaaaaga

SEQ ID NO: 71918 - DNA, 50 bp, homo sapien
ttactctcaggagtgttcatgccaayacagagtggttttttgacacagtt

SEQ ID NO: 71919 - DNA, 50 bp, homo sapien
gtctgctactaactaagggtgacaasatactaacaagaggaagcctccct

SEQ ID NO: 71920 - DNA, 50 bp, homo sapien
gtaaatatgagctaatcatatttacrgatacatcgaaaagggaaattaga

SEQ ID NO: 71921 - DNA, 50 bp, homo sapien
aatccataatgtctaccagcatcaayagtagaaagatctatggaaaacac

SEQ ID NO: 71922 - DNA, 50 bp, homo sapien
ttatctaactatctgtacctataaaygcagaaatgtaaggttatgtcatg

SEQ ID NO: 71923 - DNA, 50 bp, homo sapien
aagctgttttcttgtactcaagggaygcttgtaaggaaaaaaataactga

SEQ ID NO: 71924 - DNA, 50 bp, homo sapien
tacccaatttactattataactatayggaaaagctaattaagtatcaaaa

SEQ ID NO: 71925 - DNA, 50 bp, homo sapien
agcaaattagctttcccgaggtacayatttaaaccagaatactgcactag

SEQ ID NO: 71926 - DNA, 50 bp, homo sapien
aatcctatgaaaagactcatcctaartgccagagtatgacttgaggacac

SEQ ID NO: 71927 - DNA, 50 bp, homo sapien
cacacacactagctcatgagaaagaygaaaatttataccacgtggacttc

SEQ ID NO: 71928 - DNA, 50 bp, homo sapien
tgggcaaggacttcttaggagctaarccaaatatccaagtggcagacatg

SEQ ID NO: 71929 - DNA, 50 bp, homo sapien
ggtcatatgagtctgcagtagatacrggtactttcctcaggggtttcaaa

SEQ ID NO: 71930 - DNA, 50 bp, homo sapien
aaataacatctagagtaacctaaatmatcaggagaacttgtattcagtac

SEQ ID NO: 71931 - DNA, 50 bp, homo sapien
ctgctgagtaaagaagctgttcaagratggagtgataatttatgtcagtt

SEQ ID NO: 71932 - DNA, 50 bp, homo sapien
tcagagatcttaaaaagtaattgaamacacttgccacgtctcgataccgt

SEQ ID NO: 71933 - DNA, 50 bp, homo sapien
ccaacctgatatgatgctataacaamagggtcttccatctctggggtatt

SEQ ID NO: 71934 - DNA, 50 bp, homo sapien
tttgtgtgtgcaaaaatcaaagtagragggcattgaaggaaataagtgag

SEQ ID NO: 71935 - DNA, 50 bp, homo sapien
atgtgtgaagttgaacatcagtaggwatatttttgttctcaaatatacac

SEQ ID NO: 71936 - DNA, 50 bp, homo sapien
ttttaagctgcttgaatcgtagaacracttgtcacatacctttatcccag

SEQ ID NO: 71937 - DNA, 50 bp, homo sapien
tatactgtatcactcttcttttctarcgctttgttgcaatagtttgaaac

SEQ ID NO: 71938 - DNA, 50 bp, homo sapien
taaataatggttaaaatcttgataawctcaataaaccaatctctctaaac

SEQ ID NO: 71939 - DNA, 50 bp, homo sapien
taaaatttgtttatttcttctttcayatactccgtcttttcagaaaggat

SEQ ID NO: 71940 - DNA, 50 bp, homo sapien
ttacaagtatttcctgaagcaaacawgtcattttttgcttggtttcacat

SEQ ID NO: 71941 - DNA, 50 bp, homo sapien
aatgtatttctactataaatattcamagatggtttttccttactaatcag

SEQ ID NO: 71942 - DNA, 50 bp, homo sapien
aaccatagtcacctgactgtgctaamactagagcctatttcttctctata

SEQ ID NO: 71943 - DNA, 50 bp, homo sapien
ctcaatgggtatttaaccttgacaaraataaagtatttaaaaatatcaat

SEQ ID NO: 71944 - DNA, 50 bp, homo sapien
accatcattcaatccaacacagtagktttcactatcaccattgctacata

SEQ ID NO: 71945 - DNA, 50 bp, homo sapien
aagctaaacataaagacctaaaatayaccaacagaactaagagcatatta

SEQ ID NO: 71946 - DNA, 50 bp, homo sapien
acctacaatttataggcattcctgayagagaagaaaacaaagtaagccac

SEQ ID NO: 71947 - DNA, 50 bp, homo sapien
acagctattctagagagtgtcttaargttctttctaatgttaaggccttg

SEQ ID NO: 71948 - DNA, 50 bp, homo sapien
gaatattttaccactcattatacgaygtttatcctctcagtgtatcaacc

SEQ ID NO: 71949 - DNA, 50 bp, homo sapien
cttactctgtctaaaaggaagtttayatttatgaggacaaaggagatgga

SEQ ID NO: 71950 - DNA, 50 bp, homo sapien
tccacaggttagggaaaccacgtgakgattatgccagtagctaagtatgt

SEQ ID NO: 71951 - DNA, 50 bp, homo sapien
ttggtaagctaaagaaagcttgatcyatggatatttgggtaggtatttga

SEQ ID NO: 71952 - DNA, 50 bp, homo sapien
aagaggcacatacatttgtgaagaartgcttaaattaactaaaagtgaga

SEQ ID NO: 71953 - DNA, 50 bp, homo sapien
tcctggggtcaatgtctgagaacaaygttttacatatcatttaaggtaaa

SEQ ID NO: 71954 - DNA, 50 bp, homo sapien
gtggaaaggaatagtgatcaataccyacatgaactaacttataacacagt

SEQ ID NO: 71955 - DNA, 50 bp, homo sapien
agaccttcgtcgcattagattctcakaggtgcgtcaaccctatgtgaact

SEQ ID NO: 71956 - DNA, 50 bp, homo sapien
caactctagacttgccctaacaaagyctaaagccaaaccctcaaaagctt

SEQ ID NO: 71957 - DNA, 50 bp, homo sapien
ttctccaattccctgatgccaagaasgtgtccaacaattcaattaaattc

SEQ ID NO: 71958 - DNA, 50 bp, homo sapien
tcactttatcatgaagctattgggargttatataagataaaagctgtatg

SEQ ID NO: 71959 - DNA, 50 bp, homo sapien
cttgagggacagagcccttgagctgyggcatctgtgctaactgcatagct

SEQ ID NO: 71960 - DNA, 50 bp, homo sapien
actactataactagctaagtgacaawtccctaggcgtctaacagagactg

SEQ ID NO: 71961 - DNA, 50 bp, homo sapien
tcaagacaatttatctaaacctatcyatatgtatgcctcaattttattct

SEQ ID NO: 71962 - DNA, 50 bp, homo sapien
tctggaggctgggagttgaagataargataccagctgggtacgatccatg

SEQ ID NO: 71963 - DNA, 50 bp, homo sapien
tcacacacattcattagcttatagawcaaaaagtattaatttcctgcctt

SEQ ID NO: 71964 - DNA, 50 bp, homo sapien
cagtgaaaccttaagtgatgaggacytagatttgaccccagttctactga

SEQ ID NO: 71965 - DNA, 50 bp, homo sapien
cacccgaattctaggcaagattttgrtgaccaggtagtataattgaccta

SEQ ID NO: 71966 - DNA, 50 bp, homo sapien
atgaaacatttaagtataagttaaasgaactggaatttttgtcgtggagt

SEQ ID NO: 71967 - DNA, 50 bp, homo sapien
tattctagcagttcccaacctatcaraaagaacacagatttggaaaaatg

SEQ ID NO: 71968 - DNA, 50 bp, homo sapien
cccatgagtttcctttttgcgtacaytacattaaccagagtcagtttcta

SEQ ID NO: 71969 - DNA, 50 bp, homo sapien
atatgagcaaaaatattagatactayaccttgtgcttcagagaaataaaa

SEQ ID NO: 71970 - DNA, 50 bp, homo sapien
ttgggcagagaagtaaagagaaagaygatggactctggtgagtacaataa

SEQ ID NO: 71971 - DNA, 50 bp, homo sapien
tagtgtctgcattgtccgggagatayctttttatgccgttttatggcttg

SEQ ID NO: 71972 - DNA, 50 bp, homo sapien
gtagttgtgttttcttactggaatckctgatattaccaatgatgctgaga

SEQ ID NO: 71973 - DNA, 50 bp, homo sapien
ctttcatctgatgccatgagaaagcytgtcaatcctgctgtcagattact

SEQ ID NO: 71974 - DNA, 50 bp, homo sapien
gtctacttaaccaaaacataggctgyaattctcagtggtgatctcattta

SEQ ID NO: 71975 - DNA, 50 bp, homo sapien
tttggaaatgttacatattttgctgmagtatattctcattttaagcagta

SEQ ID NO: 71976 - DNA, 50 bp, homo sapien
aatgtatgttttaaatataatctacragtataatgtgctgaagaggatca

SEQ ID NO: 71977 - DNA, 50 bp, homo sapien
aatttttgttaagatacaggttcacyatgagtataaataacttaaaaaga

SEQ ID NO: 71978 - DNA, 50 bp, homo sapien
attgattgaagtttgtgggaacatgratggcagttgtgaataaacaggaa

SEQ ID NO: 71979 - DNA, 50 bp, homo sapien
aaaatacactccaaaatgtgattcaratataatctcctgaaatagtaaga

SEQ ID NO: 71980 - DNA, 50 bp, homo sapien
atatagcactttattatactgaaacygttatattgattcaccatgggagt

SEQ ID NO: 71981 - DNA, 50 bp, homo sapien
ggatagattccttctaggactaagaygataggattctgtgaatatataag

SEQ ID NO: 71982 - DNA, 50 bp, homo sapien
atgtgatctaaatttcaactttggartagagaattagtcttacattttac

SEQ ID NO: 71983 - DNA, 50 bp, homo sapien
tgacgggaatttcaattactactgawctaatggtatgtcctggactctat

SEQ ID NO: 71984 - DNA, 50 bp, homo sapien
ttttcctgctgtctgagttgattcargatctcattaaaaactttgcttac

SEQ ID NO: 71985 - DNA, 50 bp, homo sapien
gataagcagaaggatgagcaaacacrgaagaggagaggaggaagagggaa

SEQ ID NO: 71986 - DNA, 50 bp, homo sapien
ttttttttatttttggataatgctcrgacaaatctgttttatggggtatc

SEQ ID NO: 71987 - DNA, 32 bp, homo sapien
tgcatttgtgctgtgcragttcttctctccaa

SEQ ID NO: 71988 - DNA, 50 bp, homo sapien
acattgattaactaatagtaaagtasagcaagatttatgttgtcaaaatc

SEQ ID NO: 71989 - DNA, 50 bp, homo sapien
ccaatttatctttcttcaatctttayaatgttccatttggtaaatatatg

SEQ ID NO: 71990 - DNA, 50 bp, homo sapien
tggcaaagctaaaacatactgatacracactggtagaatataatatttct

SEQ ID NO: 71991 - DNA, 50 bp, homo sapien
atattttctatctatagtatctggcraaatctaagagttttgcaatttac

SEQ ID NO: 71992 - DNA, 50 bp, homo sapien
tgttctgccatgttgtttgcttctgraatttcttccccatgaagatgata

SEQ ID NO: 71993 - DNA, 50 bp, homo sapien
tgctatgactgccttatgtgggataygacattgtacaagattacaagatt

SEQ ID NO: 71994 - DNA, 50 bp, homo sapien
tgttggcaatttttctcaatgaccawtatgtctaccaacattttcttttt

SEQ ID NO: 71995 - DNA, 50 bp, homo sapien
ggatgtctttgcattttttaggatcrgttgtccttgtgcctggaacattt

SEQ ID NO: 71996 - DNA, 50 bp, homo sapien
aatagtcgtgttactacgatattaaygtttccctgattcttggagttaca

SEQ ID NO: 71997 - DNA, 50 bp, homo sapien
aaagaatcctcaaatatacataccayagtttcataaaaatgtacaaatat

SEQ ID NO: 71998 - DNA, 50 bp, homo sapien
tagagctgtataactctcaagttaawtcgtaagacaaaatggactactaa

SEQ ID NO: 71999 - DNA, 50 bp, homo sapien
acttcttcatgtctgagtgattattmtttatttgctaataatatggcatt

SEQ ID NO: 72000 - DNA, 50 bp, homo sapien
ggcaaactgctgtattaagatgctayagaagaggatttgtctaagcttcc

SEQ ID NO: 72001 - DNA, 50 bp, homo sapien
acagtgaaaactgctacccctaaaayaggagaaactgacaggtgaataca

SEQ ID NO: 72002 - DNA, 50 bp, homo sapien
aaattgcatatttataagtgctgtawtgaaaagaaagagacttgtgacca

SEQ ID NO: 72003 - DNA, 50 bp, homo sapien
cttccacccttggttaattcctaggyagcctatcagaagtgttcagttgg

SEQ ID NO: 72004 - DNA, 50 bp, homo sapien
aaaactggttaaagtaccattttcayataaagcatgcactttaataccag

SEQ ID NO: 72005 - DNA, 50 bp, homo sapien
agggcatggataagacaatggagaargataattgatagactacaataatt

SEQ ID NO: 72006 - DNA, 50 bp, homo sapien
ttggctctgtatagtctttggttacyactactaacattcttaccaaaaga

SEQ ID NO: 72007 - DNA, 50 bp, homo sapien
ccataatttttctatttctgtcttayggtaaaactgacattcctattttt

SEQ ID NO: 72008 - DNA, 50 bp, homo sapien
ggtagatccccctaggggactgtagraatggagtcaaattctctacaagc

SEQ ID NO: 72009 - DNA, 50 bp, homo sapien
aaactgagctttggaggaaataaaartgttgcgcatgtttacacaaataa

SEQ ID NO: 72010 - DNA, 50 bp, homo sapien
actagttctgaaacggtctccatctstttggtcttgtccacactggaaac

SEQ ID NO: 72011 - DNA, 50 bp, homo sapien
aatattctagaaagattgtttaaaaygaagacacttggaacactctcaag

SEQ ID NO: 72012 - DNA, 50 bp, homo sapien
ataacacctaggaactggtccatcaraggagcttctttacctgtcatgat

SEQ ID NO: 72013 - DNA, 50 bp, homo sapien
tattaactatgattttattaagtaaygagtccattattttaatgtgcatt

SEQ ID NO: 72014 - DNA, 50 bp, homo sapien
acatgttcaagcttcaatttcatcartaaatgaactccaactacttacct

SEQ ID NO: 72015 - DNA, 50 bp, homo sapien
tttctttgcatttagttaataatctsaacattcattgatacataagagta

SEQ ID NO: 72016 - DNA, 50 bp, homo sapien
atgaaactaaggcagaaatgttctakgatatgagtaaaaagaaagacgtt

SEQ ID NO: 72017 - DNA, 50 bp, homo sapien
gattaagagtcagtcaggcttaggamctactctctttcaaactaagagga

SEQ ID NO: 72018 - DNA, 50 bp, homo sapien
gaggagtttattaatgagaagaaacrgaaggtaaggcatttggttaaaag

SEQ ID NO: 72019 - DNA, 50 bp, homo sapien
atagcatcatccatttaatttcagaytaccacttatagatggaattctgt

SEQ ID NO: 72020 - DNA, 50 bp, homo sapien
cagtcatgatggcatggggtggtaartcaaatgacagaattgatcttgag

SEQ ID NO: 72021 - DNA, 50 bp, homo sapien
taggtcaaaatcaagatgtccacacrataagttacttttaagggctgtga

SEQ ID NO: 72022 - DNA, 50 bp, homo sapien
cacagttaatggcatgggcaaatttratgtaagagggcaaaagtattttg

SEQ ID NO: 72023 - DNA, 50 bp, homo sapien
gctgtactctagagtagttattgcaytcagaataagataaaaattggaat

SEQ ID NO: 72024 - DNA, 50 bp, homo sapien
tatcttactattattaaataagaacrcgactcaatctaatcttaaaatga

SEQ ID NO: 72025 - DNA, 50 bp, homo sapien
accacacacaagcactaacctttctkattccctttctcactctgatatgc

SEQ ID NO: 72026 - DNA, 50 bp, homo sapien
atcattttggcattattttggggacratagaggtaaatgtacctacttcc

SEQ ID NO: 72027 - DNA, 50 bp, homo sapien
tctttatcatctaaagtctgcataamtgtgggatgcctccaccacacaca

SEQ ID NO: 72028 - DNA, 32 bp, homo sapien
taattatagtaaaatasatgtaacagaaatgt

SEQ ID NO: 72029 - DNA, 50 bp, homo sapien
gaaatacatgtgtaaaaattactaayctgaagaagcatagtttcctgaaa

SEQ ID NO: 72030 - DNA, 50 bp, homo sapien
ataataacacagttcactacagtacyaagaattaagactacttggccagg

SEQ ID NO: 72031 - DNA, 50 bp, homo sapien
gggccatgtattctgcaaacacatayactaccgttgctttgatgaccccg

SEQ ID NO: 72032 - DNA, 50 bp, homo sapien
tcacgataggtaggccaaaagtagastaatagtattgtgatataatgatg

SEQ ID NO: 72033 - DNA, 50 bp, homo sapien
taaatagcttaactgcaaaattaatwaaacagaagaaataatcagtcaac

SEQ ID NO: 72034 - DNA, 50 bp, homo sapien
attcagatgggacactaattacttaygcagttcatttaccaagatgcaca

SEQ ID NO: 72035 - DNA, 50 bp, homo sapien
ttgcatagacaatgtataattaatargtgagtcatccttgagaatgatag

SEQ ID NO: 72036 - DNA, 50 bp, homo sapien
tgacctgtatccctgagaatatttcracttttgtctgtttttaatctgtg

SEQ ID NO: 72037 - DNA, 50 bp, homo sapien
aaatactgaagaattttaagtgagcrattataaggttaaattagcatttt

SEQ ID NO: 72038 - DNA, 50 bp, homo sapien
gtggaaatataaaatcctaatatagracttggacattatttaataaatta

SEQ ID NO: 72039 - DNA, 50 bp, homo sapien
attaaattttccatttactgtacaaytaagtgattttgagtagtaagcaa

SEQ ID NO: 72040 - DNA, 50 bp, homo sapien
agaattatattggtctggataaggtmactgccataacaaaaagaccaaat

SEQ ID NO: 72041 - DNA, 50 bp, homo sapien
ctaatttattcaagtcaaaaaataargatcgcattctgcttccaagacac

SEQ ID NO: 72042 - DNA, 50 bp, homo sapien
tccacaaacaagtgtttgatacttcmctctctttcaaacccacagctaat

SEQ ID NO: 72043 - DNA, 50 bp, homo sapien
tggaccacagtaaaggagttggagaygctggaagggccatagcagaaaat

SEQ ID NO: 72044 - DNA, 50 bp, homo sapien
ctcccaaaatgctaggattacaagckctacttaattttcttcaagataga

SEQ ID NO: 72045 - DNA, 50 bp, homo sapien
tctataatttttgttttctatttgartataactatcaaagcaagacttca

SEQ ID NO: 72046 - DNA, 50 bp, homo sapien
caaacagtgacaaaacacactagcakgtatatttggcatctgttcactgt

SEQ ID NO: 72047 - DNA, 50 bp, homo sapien
aagaagtaatttcaaatcgttttaaratataaatgaatatgtgaagtaat

SEQ ID NO: 72048 - DNA, 50 bp, homo sapien
aatttcatcctagaaaacaggcttayattttatcataatgagtcatctta

SEQ ID NO: 72049 - DNA, 50 bp, homo sapien
gcagttttattcttatttattttggyaattattggagagattttgaatca

SEQ ID NO: 72050 - DNA, 50 bp, homo sapien
gaagaaaaatcacccgagaagaaatragtatctaccttaaatggtatcta

SEQ ID NO: 72051 - DNA, 50 bp, homo sapien
gattctcccccctctttatttactgyataattttgacataggcatataac

SEQ ID NO: 72052 - DNA, 50 bp, homo sapien
actttatactgtaaaaatcttttgcygagagggactgcagatggaagtag

SEQ ID NO: 72053 - DNA, 50 bp, homo sapien
ttagaattcaatccaggctgatataratggaaaatttagaggagattgaa

SEQ ID NO: 72054 - DNA, 50 bp, homo sapien
gtttatagggtgtagagattacagarggtcttattcagtaggaggtcatt

SEQ ID NO: 72055 - DNA, 50 bp, homo sapien
ttttctctccctggcagtgtgtacaraagcgaagactacaggctgaaatt

SEQ ID NO: 72056 - DNA, 50 bp, homo sapien
cagctcaaggctaaaagtgaacacastccgtataactgaactaatggttt

SEQ ID NO: 72057 - DNA, 50 bp, homo sapien
atgaccacatcattatcactactcayaaatcactgcatctctatcaaaag

SEQ ID NO: 72058 - DNA, 50 bp, homo sapien
gtaatctgaagagaaacataagtcartatttttaaggcataatatatggg

SEQ ID NO: 72059 - DNA, 50 bp, homo sapien
catccatgatgagctagtttctctamaatgcatgcttagtttaaatccta

SEQ ID NO: 72060 - DNA, 50 bp, homo sapien
atgtgtgtgtctctgtgtgccatgarctgacataatagaaccattttgtc

SEQ ID NO: 72061 - DNA, 50 bp, homo sapien
ttcacagaaatcagcaccatgtgtawgatattttcaattctggttaattt

SEQ ID NO: 72062 - DNA, 50 bp, homo sapien
aggtttatcttgaaaaagatctgcarcgtctcaacagggtaacaactgat

SEQ ID NO: 72063 - DNA, 50 bp, homo sapien
cttctgtgtttacttgtcagttaaayggattttgttttctatgtcctttt

SEQ ID NO: 72064 - DNA, 50 bp, homo sapien
agaaaagaactcagtatctcatagawggttaataaggttccatgaagaaa

SEQ ID NO: 72065 - DNA, 50 bp, homo sapien
ctggtcagcatggttaatagagatgmacttgtgtggaacttcaggtcaca

SEQ ID NO: 72066 - DNA, 50 bp, homo sapien
atttataatgattttcagaaggtagraaaagaattgaccagttatttctg

SEQ ID NO: 72067 - DNA, 50 bp, homo sapien
ttcccaaagtacagagggccactacyttctgagaaacagttttactaggt

SEQ ID NO: 72068 - DNA, 50 bp, homo sapien
tggatgggtttttgaataggaaaatyagtttcaagatattgttctctgac

SEQ ID NO: 72069 - DNA, 50 bp, homo sapien
gccagttatacttccagctttctgtygggaaatcctcttaagttgacccc

SEQ ID NO: 72070 - DNA, 50 bp, homo sapien
ttctccagctacatacttatgcataktctctttgtgaaaatagaccatat

SEQ ID NO: 72071 - DNA, 50 bp, homo sapien
tgactgacagctcaaagtgttgtgaytatagttaaatgaaataatgtgcc

SEQ ID NO: 72072 - DNA, 50 bp, homo sapien
tgtttcaaatatcaaaggacatggarataacaagattagagaactggtga

SEQ ID NO: 72073 - DNA, 50 bp, homo sapien
atttttcagcatttgttggtcatcaygttaatagttttcttccttcatgg

SEQ ID NO: 72074 - DNA, 50 bp, homo sapien
ataataatggaattgacttcatagartcattcaacggatcaaacaaaatg

SEQ ID NO: 72075 - DNA, 50 bp, homo sapien
atactaaaaaaaaccacagtataacmagtacatttaaaaaatctcttagc

SEQ ID NO: 72076 - DNA, 50 bp, homo sapien
aataacaagtggaattgaggtggtayataaatttgcatacagggctaaag

SEQ ID NO: 72077 - DNA, 50 bp, homo sapien
aaaaactgcaattactgtagaattgyaaatcctgaacttctggccacgag

SEQ ID NO: 72078 - DNA, 50 bp, homo sapien
ctaatgctctcactagagctctgtaytaaacgatttgctcagagagcaat

SEQ ID NO: 72079 - DNA, 50 bp, homo sapien
ttttattttttaatgaattaatatasgtatactagctttctttttgtggg

SEQ ID NO: 72080 - DNA, 50 bp, homo sapien
ggatgatgttgaaagcgtaatggtakgaagtaaaatgcagcattttgaga

SEQ ID NO: 72081 - DNA, 50 bp, homo sapien
agactattgtagcaacagtagttaartaattatgcctctacatcctttcc

SEQ ID NO: 72082 - DNA, 50 bp, homo sapien
tagggatgtgcatttagaaagatcaycatgcatgcactggagaaaatgga

SEQ ID NO: 72083 - DNA, 50 bp, homo sapien
cctcagcaatgtcgctagtagtccarggattccatctggattgtggaggt

SEQ ID NO: 72084 - DNA, 50 bp, homo sapien
aactatacccacttggttttgtcacygagatggttcaaagtgagccaatt

SEQ ID NO: 72085 - DNA, 50 bp, homo sapien
cgatccctctaggttggcgtttctcractcagcagtacgtcattcctgct

SEQ ID NO: 72086 - DNA, 50 bp, homo sapien
gcttcaagcccccggaaaagctcaaygccagatttcattctctgcccctg

SEQ ID NO: 72087 - DNA, 50 bp, homo sapien
ctctctagtcagtgtagttggcttaytcaaagcagagagtgccagggcac

SEQ ID NO: 72088 - DNA, 50 bp, homo sapien
ataaattatcagaactggttacctaygaaagactaagtataaattttgaa

SEQ ID NO: 72089 - DNA, 50 bp, homo sapien
gtagaaaatacatagcatattctagyctgttaggtgaacaaatacttttc

SEQ ID NO: 72090 - DNA, 50 bp, homo sapien
ctgtttataatacagatctgaaggaragataggcaaatattgatttaaaa

SEQ ID NO: 72091 - DNA, 50 bp, homo sapien
ttttgtgtctcattcacatcctatawccctacatgtccaccatctttctg

SEQ ID NO: 72092 - DNA, 50 bp, homo sapien
tcctaccaccccaactaaactggcamaatgtcttatgagtcccttggctg

SEQ ID NO: 72093 - DNA, 50 bp, homo sapien
gacagtcatagagctcatttgtccaytgatgtcttacagatgttgtggtt

SEQ ID NO: 72094 - DNA, 50 bp, homo sapien
aaacctacaatcgttggaaagattgyacttgattcttagtctcttagacc

SEQ ID NO: 72095 - DNA, 50 bp, homo sapien
atcaggtgcattatgaatgagcaaasataaaaaagaaatctcaagaatct

SEQ ID NO: 72096 - DNA, 50 bp, homo sapien
tagaatattcagactaagagatcaakggtaacatgtcataaggcttcctt

SEQ ID NO: 72097 - DNA, 50 bp, homo sapien
caattaatctttgacaaaagaccaarggtgatacagtgaagaaaagatat

SEQ ID NO: 72098 - DNA, 50 bp, homo sapien
tagggattttgtgttgattaaaggarccataattgatattaacaagcagt

SEQ ID NO: 72099 - DNA, 50 bp, homo sapien
ctatgagtatgcaagctactacttamtactgagccaagtaacaaactata

SEQ ID NO: 72100 - DNA, 50 bp, homo sapien
cttaaacttatttatgaaatcgtccyaattgatgtaaagagccatttatt

SEQ ID NO: 72101 - DNA, 50 bp, homo sapien
aagaagtgtagtctgtttttcaaaaraatagtaagctagtttttcaaaaa

SEQ ID NO: 72102 - DNA, 50 bp, homo sapien
aggcacacagaacagaattgtttcayggcgttctgtagaataaatagcaa

SEQ ID NO: 72103 - DNA, 50 bp, homo sapien
tttgctaaagtgatatgatctgatamaattcatcacagcattgatagacc

SEQ ID NO: 72104 - DNA, 50 bp, homo sapien
cttaattcaattttcttcagtcctakaatagtcagcacatgcagttattt

SEQ ID NO: 72105 - DNA, 50 bp, homo sapien
ggtaaatctagaaaaactggcgtaaytaacctcagctgatattctacagt

SEQ ID NO: 72106 - DNA, 50 bp, homo sapien
agtaatactaccttagatgtgaaaayactaatattagcaccagacttcag

SEQ ID NO: 72107 - DNA, 50 bp, homo sapien
gcaatacaaaattgatgggaatatawcttttaatcagcaatatggaaagc

SEQ ID NO: 72108 - DNA, 50 bp, homo sapien
ccagtaactgagacaatgctattaaycttacttgttctaccttctacaca

SEQ ID NO: 72109 - DNA, 50 bp, homo sapien
atttaacaaaatgattttaacagatygaatgggagttcttacatccttaa

SEQ ID NO: 72110 - DNA, 50 bp, homo sapien
aaagacattgaaataataacttcaartagttggtaaaaataactgtcaaa

SEQ ID NO: 72111 - DNA, 50 bp, homo sapien
acagtctcaagttatttttactaaaycacaattattaacaagccaaaaat

SEQ ID NO: 72112 - DNA, 50 bp, homo sapien
gtaaggacaaggtgagaagtaagaaratgacagagttgatattcctattc

SEQ ID NO: 72113 - DNA, 50 bp, homo sapien
cttaatatgtgctaaatacctaacaygtaccaggcattgcattatgcatt

SEQ ID NO: 72114 - DNA, 50 bp, homo sapien
aaaaaaaaaagaatgtcgcattcaaygtttgtatctgtacacaaggttgt

SEQ ID NO: 72115 - DNA, 50 bp, homo sapien
aaagaggtattccagcttgtataacmgtctagccacttgaacaccaagtt

SEQ ID NO: 72116 - DNA, 50 bp, homo sapien
atttttatgtttcatatcacttcaamatctttaaccaagttttaaatgag

SEQ ID NO: 72117 - DNA, 50 bp, homo sapien
ctaaagactgtaactggtagggaaarttacctctcatccttggtcagtct

SEQ ID NO: 72118 - DNA, 50 bp, homo sapien
ttggggctaaaagtcagaccatctckaggtcattgagaattcttccttat

SEQ ID NO: 72119 - DNA, 50 bp, homo sapien
acacactcacaatcctaagagaacargaagattctgtaatgcagatcacc

SEQ ID NO: 72120 - DNA, 50 bp, homo sapien
gctaggtccttatgtcatctgtatcratccaatggtatatcttccttttt

SEQ ID NO: 72121 - DNA, 50 bp, homo sapien
cacatattgagtgtatatggagtcaraatctacaaggaagaacaccaaat

SEQ ID NO: 72122 - DNA, 50 bp, homo sapien
atataatttagatcatgaacaaccarcacatggatttgagttgaattttt

SEQ ID NO: 72123 - DNA, 50 bp, homo sapien
agagcctgatgaccacaggaaggtayaaaagcactagctacagctcttca

SEQ ID NO: 72124 - DNA, 50 bp, homo sapien
tgtttgttactgatcatataactccyaaacagttactgctatgtaaacac

SEQ ID NO: 72125 - DNA, 50 bp, homo sapien
tgcagaacctggagaactggatgagkatatgtgtggcaagttgttcataa

SEQ ID NO: 72126 - DNA, 50 bp, homo sapien
gttttagaagcttgttaatgtttcaygtgcataaaaataaataattaaaa

SEQ ID NO: 72127 - DNA, 50 bp, homo sapien
gttctttttgtcttttacctttatgyatattgtcaaaagattgttttcca

SEQ ID NO: 72128 - DNA, 50 bp, homo sapien
aatgtaataggataacaattgcatasaaatacataatattttaagtgctt

SEQ ID NO: 72129 - DNA, 50 bp, homo sapien
gacaatgcaaagacaagaaatgttaycatgggagaagagctgagatgaag

SEQ ID NO: 72130 - DNA, 50 bp, homo sapien
agaaaatatgctaagtgacagtgccratattctagaaatcagaaacaaaa

SEQ ID NO: 72131 - DNA, 50 bp, homo sapien
tgatacctacaacaccactgtttacratttgtccctaatggtgaccacaa

SEQ ID NO: 72132 - DNA, 50 bp, homo sapien
gaaaattgtaaagtcaaactactcaygacccgtgcacatctactacatga

SEQ ID NO: 72133 - DNA, 50 bp, homo sapien
acaccctccagctacaacttatagaygtgataaaattccagacgctagat

SEQ ID NO: 72134 - DNA, 50 bp, homo sapien
ctggcaataacttgcttatatgccamatttatactatcatacttggagaa

SEQ ID NO: 72135 - DNA, 50 bp, homo sapien
gtagtaaacagcgtggaaaatagccrgagtggcaaagccagattcaaagt

SEQ ID NO: 72136 - DNA, 50 bp, homo sapien
aaggggcctgataaaaccattttatracattgtctcacccagctgctgat

SEQ ID NO: 72137 - DNA, 50 bp, homo sapien
cactgtgccaaatgctgtgatagaaraacaatattgtatgaactggtttt

SEQ ID NO: 72138 - DNA, 50 bp, homo sapien
tgcctatgtagccactacaagtttgsaaggttattggatccttaagtgac

SEQ ID NO: 72139 - DNA, 50 bp, homo sapien
atgattaaaaaaataaaacaagtccraaagcaagaagtctcaagtcttct

SEQ ID NO: 72140 - DNA, 50 bp, homo sapien
gaatgtttttacctcttctatggaamttcactacagccatcagttgcacc

SEQ ID NO: 72141 - DNA, 50 bp, homo sapien
atggtgtcttcatcgttttttggtamcttctatctgcatgccatcctagt

SEQ ID NO: 72142 - DNA, 50 bp, homo sapien
caaccacatgtaagactaaccttgaytagagtggcaaatgtcatttataa

SEQ ID NO: 72143 - DNA, 50 bp, homo sapien
ttcaattcagcctacttccacaagckctcattttgtagtaattaattcat

SEQ ID NO: 72144 - DNA, 50 bp, homo sapien
agattcatttccttaaacgtattggwatcgtcatctgggctatgaaaatg

SEQ ID NO: 72145 - DNA, 50 bp, homo sapien
acgatgtaaaaaattatctattgackgacggagccttctcaagggccaga

SEQ ID NO: 72146 - DNA, 50 bp, homo sapien
ttagcttcatcagctgccaaaacaartaaaatagactgcagggcttaaac

SEQ ID NO: 72147 - DNA, 50 bp, homo sapien
aatactgggaagccactcctcatacwaagtcaaaacctcctctctgtcat

SEQ ID NO: 72148 - DNA, 50 bp, homo sapien
tgctatgggaacatcttgatgctcaygcccatgtcttgatagaagatatc

SEQ ID NO: 72149 - DNA, 50 bp, homo sapien
atttgggttttctttaaaaagctacygcatgtaagacatactgtttcaga

SEQ ID NO: 72150 - DNA, 50 bp, homo sapien
ttatcaaaataacttcagtctctaayatgtttactaagaaattataattt

SEQ ID NO: 72151 - DNA, 50 bp, homo sapien
ctaggagaaatggctttacatgaatkaactctactctggctttagaagtt

SEQ ID NO: 72152 - DNA, 50 bp, homo sapien
gtgtgtgacaagtttaccgtgggagkaatataaagtgtgagaatcaagtt

SEQ ID NO: 72153 - DNA, 50 bp, homo sapien
ctgtattcactttcttgcagtcccayaaaatgtctctcaaatcctagagt

SEQ ID NO: 72154 - DNA, 50 bp, homo sapien
ccagagttccagtctggtaaatcatyagcttttaggtggtcttcaagtcc

SEQ ID NO: 72155 - DNA, 50 bp, homo sapien
gcccctagaagtgacactcaatcacycaagactctagtgaaaatataaag

SEQ ID NO: 72156 - DNA, 50 bp, homo sapien
cgccacccttccctttttgagtacawcatttattgccttcttagctttgg

SEQ ID NO: 72157 - DNA, 50 bp, homo sapien
gccaatgcaaaagatgtgtcctaaaygtaggtgatagctgtccagttacc

SEQ ID NO: 72158 - DNA, 50 bp, homo sapien
aatactccgagttgttttacaagaamattatgaactattaactaaaattt

SEQ ID NO: 72159 - DNA, 50 bp, homo sapien
gaaaatagactaatacacaagagtascttaatatgataacatctgccact

SEQ ID NO: 72160 - DNA, 50 bp, homo sapien
aatggtatgaccatcttccctccaasaaaagaactagatcaagttttaaa

SEQ ID NO: 72161 - DNA, 50 bp, homo sapien
ctcttaagggtagagatttcaaagaygtaactttcaccaacaacagatgg

SEQ ID NO: 72162 - DNA, 50 bp, homo sapien
tacacaaagtaggaagagaagaaatktgggttcctggtattcctctcaga

SEQ ID NO: 72163 - DNA, 50 bp, homo sapien
ttccccatagacacattgtttactaraatttgcatcttatttaatcttct

SEQ ID NO: 72164 - DNA, 50 bp, homo sapien
gttttgttaaacaatgatggttaaartagtcattcctctccatttatcta

SEQ ID NO: 72165 - DNA, 50 bp, homo sapien
taaatttgcacaaaaaggactataamatgaggcaaaatggtaaattctat

SEQ ID NO: 72166 - DNA, 50 bp, homo sapien
cctgtgatttcgactagtttctatcrcctcatatagttcatgaaacatgg

SEQ ID NO: 72167 - DNA, 50 bp, homo sapien
aaataaacttttactcaactctttayacatcattctttgacattctctct

SEQ ID NO: 72168 - DNA, 50 bp, homo sapien
gctgagggtaggaggatcagaaataygtaatacagaggggagatgatgag

SEQ ID NO: 72169 - DNA, 50 bp, homo sapien
cttaatgctgccacaagacaaagtgragaaaaccaaaagtacataattcc

SEQ ID NO: 72170 - DNA, 50 bp, homo sapien
ggtttcctggcttccttctcattccrctagctatcttcacagtgcacttc

SEQ ID NO: 72171 - DNA, 50 bp, homo sapien
accaaaagaaggcaatgcacacctarcttcctaaacatttaccttgcttg

SEQ ID NO: 72172 - DNA, 50 bp, homo sapien
accacaatattttacaatagcccaaygtagctgagttcagcatacctgga

SEQ ID NO: 72173 - DNA, 50 bp, homo sapien
cttatacaaccttcaggatagagcartaagcaacacttcaaacactgcaa

SEQ ID NO: 72174 - DNA, 50 bp, homo sapien
aggctgttggtgcatatttaatgtgragatgagttaaatgaagagattgg

SEQ ID NO: 72175 - DNA, 50 bp, homo sapien
gacagctcagaaccgcaaaattgacrcggctctggttcttaggagggccg

SEQ ID NO: 72176 - DNA, 50 bp, homo sapien
caaataattcttcaattccaccttayagataccaaggcaaacctgcagat

SEQ ID NO: 72177 - DNA, 50 bp, homo sapien
gtaacattcttcaaagacactgaaayaaataaataacaaatgattgtaat

SEQ ID NO: 72178 - DNA, 50 bp, homo sapien
ctttctctgtagatatattgtgaaaytaggaagaaataaaggttttatgt

SEQ ID NO: 72179 - DNA, 50 bp, homo sapien
aattatttttaaattagtaaatagaraatccgtggacatgagggcccttc

SEQ ID NO: 72180 - DNA, 50 bp, homo sapien
tgcaaatgttatgcattgttaaaaawtttcgcagggtcactgtcacatgg

SEQ ID NO: 72181 - DNA, 50 bp, homo sapien
tccatatactactgggcctaatcctygttattggcacattgaagcaacat

SEQ ID NO: 72182 - DNA, 50 bp, homo sapien
tcaactttttactaattatttacccraagattttgatactttaagacatg

SEQ ID NO: 72183 - DNA, 50 bp, homo sapien
taagttgaaaagttgtggccaaaagraaaaactcctaattatttaagtgt

SEQ ID NO: 72184 - DNA, 50 bp, homo sapien
caaattaaatgcaaagtatcagtatragctctaaatttctttatacatgt

SEQ ID NO: 72185 - DNA, 50 bp, homo sapien
aacctgagttttggctttgtttccaygcaattttcattctgaagaacttt

SEQ ID NO: 72186 - DNA, 50 bp, homo sapien
ttctgtatagacatcagaaaacaccmtttatagtcatgccacagactggg

SEQ ID NO: 72187 - DNA, 50 bp, homo sapien
cacacatatcccttatgataacctcrcttactacatctcaacaattcaac

SEQ ID NO: 72188 - DNA, 50 bp, homo sapien
aagaagaaaaagacaaactaacagaraaattggcaaaggatgcaaagaaa

SEQ ID NO: 72189 - DNA, 50 bp, homo sapien
ctgattctgtatttttgaggaagaartgccattaattgataacagtactt

SEQ ID NO: 72190 - DNA, 50 bp, homo sapien
gcgtgtttttctggaccaactactaygggagtttcagatgtaaaggagga

SEQ ID NO: 72191 - DNA, 50 bp, homo sapien
gaggaccatcagatagtcatatggaygtgtttattgttcctgcccttggg

SEQ ID NO: 72192 - DNA, 50 bp, homo sapien
agtgtgttggggaaagtttggtagayggctgtgaatgaaagaccccagct

SEQ ID NO: 72193 - DNA, 50 bp, homo sapien
cgtagatcaccttagcctttctgcamctttcggttttgtacatgctcatc

SEQ ID NO: 72194 - DNA, 50 bp, homo sapien
gagtccccaagctggaaattgttaaytattgaccaaattagaaataaata

SEQ ID NO: 72195 - DNA, 50 bp, homo sapien
ccagttcactgtcaagtattctagtraaggccactggtggaatggaaggc

SEQ ID NO: 72196 - DNA, 50 bp, homo sapien
tcatgctatctaagagttgctatccrtatgatcttgtaaccattatgcga

SEQ ID NO: 72197 - DNA, 50 bp, homo sapien
caagcccctactttcatgaataataragaacttagagggttgtatatgtg

SEQ ID NO: 72198 - DNA, 50 bp, homo sapien
cactctgctcttcttgccaattcagractaggaggcatcctatcctgcct

SEQ ID NO: 72199 - DNA, 50 bp, homo sapien
gcaacacattctttcatggatttacyggaattcgagggaactgccattgc

SEQ ID NO: 72200 - DNA, 50 bp, homo sapien
cttccaagcgttagtacataggtatyatacaaaatgccaggaactcagta

SEQ ID NO: 72201 - DNA, 50 bp, homo sapien
aaatgtaggccaaatttttttgtaaktatgcttggcctttttgtctttct

SEQ ID NO: 72202 - DNA, 50 bp, homo sapien
agttgttgaaggaatggtgatatacyggctgacacaagtctttacttact

SEQ ID NO: 72203 - DNA, 50 bp, homo sapien
agcactatacagaagaggataggaamaagaagtgctagagttgttggtgc

SEQ ID NO: 72204 - DNA, 50 bp, homo sapien
ttagtctttctagggatgactactaraactccaaatagtatggccttatt

SEQ ID NO: 72205 - DNA, 50 bp, homo sapien
aatatgttttcttaacttctgaatcrcttctttctgtgcatgttcaatca

SEQ ID NO: 72206 - DNA, 50 bp, homo sapien
acaattacctacttaatttcattgcwatagacaactgactcatctagacc

SEQ ID NO: 72207 - DNA, 50 bp, homo sapien
atttggaaatatacatgaaatatacsaagataaacaggctgtatcttgtt

SEQ ID NO: 72208 - DNA, 50 bp, homo sapien
tttaagttcatggcaagtttctggtmttcaacaaaatatccccctagatt

SEQ ID NO: 72209 - DNA, 50 bp, homo sapien
cctcatgaaaaaccagcagaccaatraggaatattctatttaaaagagga

SEQ ID NO: 72210 - DNA, 50 bp, homo sapien
gactctggtgttgaccattaggcttyatcctggttaccagttgtggagta

SEQ ID NO: 72211 - DNA, 50 bp, homo sapien
ttgtgtctagcttgactcatttaacrggaacaagatgtccatatgccaca

SEQ ID NO: 72212 - DNA, 50 bp, homo sapien
aacctctagagaaatgtaatccaaaygcttcatcttacacaggaaactcc

SEQ ID NO: 72213 - DNA, 50 bp, homo sapien
ttacgtattcatagcattgtaacaaytgatggtttttaaatttctctaca

SEQ ID NO: 72214 - DNA, 50 bp, homo sapien
atcagttgttacaatgctatgaataygtaagaataccaggagagggtatt

SEQ ID NO: 72215 - DNA, 50 bp, homo sapien
ttcattcgatttatacgatgaaaackatatgataaaaagggatgagctac

SEQ ID NO: 72216 - DNA, 50 bp, homo sapien
aatttgatccttttaagctgtgttaygtaggccggtactgcattcagtct

SEQ ID NO: 72217 - DNA, 50 bp, homo sapien
gatccttttatctgatctttgaataygatcacttgaaatttaagaaaatg

SEQ ID NO: 72218 - DNA, 50 bp, homo sapien
caagattaaatattttagaattaaakaacttgtctcctttattttaagag

SEQ ID NO: 72219 - DNA, 50 bp, homo sapien
tgaaaatttgcagcagagagtataargatgacaaacccttaacaccactt

SEQ ID NO: 72220 - DNA, 50 bp, homo sapien
taaaaagcaaagagatggaaggaaaytttttgcaagtggcagaaatggtt

SEQ ID NO: 72221 - DNA, 50 bp, homo sapien
gcgcgagagagctctttagaatttcycttacaaatctcagatcaataatg

SEQ ID NO: 72222 - DNA, 50 bp, homo sapien
ccaaagtaactatttaatgtaagcartctcttcaagaataagaaaataaa

SEQ ID NO: 72223 - DNA, 50 bp, homo sapien
gtgcccagtgctaatctcttaatcaytattttctactcactaactcaata

SEQ ID NO: 72224 - DNA, 50 bp, homo sapien
tgtggcatatacttacacagacatarataagatggagacctgccctcagt

SEQ ID NO: 72225 - DNA, 50 bp, homo sapien
aatttaaatcaaagaatagcttttayggaaggagacaatagactctgact

SEQ ID NO: 72226 - DNA, 50 bp, homo sapien
tgcttaaccaggtgccttctatgtayccgggtgatgaatgggaagagcta

SEQ ID NO: 72227 - DNA, 50 bp, homo sapien
aattgggcacccccttttcgtgggaygagagcagagggagatttgcctga

SEQ ID NO: 72228 - DNA, 50 bp, homo sapien
ttaggctgaaagagaattgtgtcacygatttcacttgcgctgtgggcaga

SEQ ID NO: 72229 - DNA, 50 bp, homo sapien
cagtggcagctgttggcataagagtytcagtctggatattggagtactgg

SEQ ID NO: 72230 - DNA, 50 bp, homo sapien
atacatgtactagaagagcagggaaragataataaccaatgatctaagca

SEQ ID NO: 72231 - DNA, 50 bp, homo sapien
ggtaatatatagacagcaaatgagargtaatagaaccaaaactcacggta

SEQ ID NO: 72232 - DNA, 50 bp, homo sapien
aagagatttaaaaatccaacggactstccagacaactctcaaagaaagag

SEQ ID NO: 72233 - DNA, 50 bp, homo sapien
tggttcttgggcctttggactcaggktttatactagcggcctcccatccc

SEQ ID NO: 72234 - DNA, 50 bp, homo sapien
gaaaacaactaatgtttgctttgctstctctgcctttaacatagatcagg

SEQ ID NO: 72235 - DNA, 50 bp, homo sapien
tagatgctttcaattaggacattaamtattgaagctattgggtacaggga

SEQ ID NO: 72236 - DNA, 50 bp, homo sapien
gaatctagaatctttctcctaatacrgaatgccacagtaggtttaaaaac

SEQ ID NO: 72237 - DNA, 50 bp, homo sapien
tatggtagagactatggccaattggraagaatgtgtctggaataaagagg

SEQ ID NO: 72238 - DNA, 50 bp, homo sapien
aaaattatgtttgattcttcaatgaragtatgaaatacaagagaataatc

SEQ ID NO: 72239 - DNA, 50 bp, homo sapien
cttcactcagtcaaaaaatttcatgytaagccagccaggtttacacatat

SEQ ID NO: 72240 - DNA, 50 bp, homo sapien
tattttcctcaaaataaccctaggcrataactactactatttttcccatt

SEQ ID NO: 72241 - DNA, 50 bp, homo sapien
aggatagttcttcctctgagctcccyaagtcactgtgcacataccattat

SEQ ID NO: 72242 - DNA, 50 bp, homo sapien
tagtaagtgacagatatgaacatggwacttagatctctgactcttattcc

SEQ ID NO: 72243 - DNA, 50 bp, homo sapien
actgtattgcagctatgaaaatgtayatctttaattcttctagacttaat

SEQ ID NO: 72244 - DNA, 50 bp, homo sapien
ttatgaagcaagaatgatattgttcyataacctgttaaagatagttaaca

SEQ ID NO: 72245 - DNA, 50 bp, homo sapien
agttctgtttatcatcaggatgtacrccttgaaggccctccgcaaagcca

SEQ ID NO: 72246 - DNA, 50 bp, homo sapien
gttgcactattcatattttataagascgaatcatactcagttttgtttcc

SEQ ID NO: 72247 - DNA, 32 bp, homo sapien
taattctgccagaccarggccttactcttgtg

SEQ ID NO: 72248 - DNA, 50 bp, homo sapien
attttgctaaccgtaacaaccataayagatttctcttaaggaacatgagt

SEQ ID NO: 72249 - DNA, 50 bp, homo sapien
ttggtgtcctttcctaccatcaggcyactgtcaagaccatcccaaatatt

SEQ ID NO: 72250 - DNA, 50 bp, homo sapien
aaataatattgagaagacggtcaacrgtactatgtgaaaggcactttttc

SEQ ID NO: 72251 - DNA, 50 bp, homo sapien
caaaatagggctctgacagtaaaaakgacccatggttagtatcaagaaag

SEQ ID NO: 72252 - DNA, 32 bp, homo sapien
agattgttggaagataraatcagataaaaaca

SEQ ID NO: 72253 - DNA, 50 bp, homo sapien
aaacttcaatttccacgattttcacyggtattatataacagagcttcaca

SEQ ID NO: 72254 - DNA, 50 bp, homo sapien
tggcaagccttgtaggtgactcacaygcacaatgaatttgagaccttctt

SEQ ID NO: 72255 - DNA, 50 bp, homo sapien
aaaatatcaaaatatcaatgagagawaagattgttggaagataaaatcag

SEQ ID NO: 72256 - DNA, 50 bp, homo sapien
agctatgttagaaactaaaagtaaaygcgtgattgtctctgaatttattt

SEQ ID NO: 72257 - DNA, 50 bp, homo sapien
tatatatatttctttaacacaaaaakttgatatagtataaagctgtctga

SEQ ID NO: 72258 - DNA, 50 bp, homo sapien
actatttcctacaaattctaagggayagcaatgccaatataagtagctcc

SEQ ID NO: 72259 - DNA, 50 bp, homo sapien
tttgtaaggtcccataaggagatacmactcaggatacagggattagatat

SEQ ID NO: 72260 - DNA, 50 bp, homo sapien
tttgtctactgctgtttgacatgaartattagacataatgcattttttgc

SEQ ID NO: 72261 - DNA, 32 bp, homo sapien
atgtgtttccttacctrttgcccattaggcac

SEQ ID NO: 72262 - DNA, 50 bp, homo sapien
atttaaattgctacagtaaaatggartaactacctgggctttttacattt

SEQ ID NO: 72263 - DNA, 50 bp, homo sapien
ggaagctctcttcactaccactctcytgatctttcagtggttttaaaccc

SEQ ID NO: 72264 - DNA, 50 bp, homo sapien
gtgatgccagcaaaaatctgtcaatkagtgtattaggagccaagaagagt

SEQ ID NO: 72265 - DNA, 50 bp, homo sapien
gctgagaccttagctgtgaagactcraaaactgaataacttcatgtatgg

SEQ ID NO: 72266 - DNA, 50 bp, homo sapien
cttcagagctagttggcattatcatkaatttatttggacttttgtggaaa

SEQ ID NO: 72267 - DNA, 50 bp, homo sapien
attcttccctctgtgctcatgaagayaacatggtttagaatttacaaaag

SEQ ID NO: 72268 - DNA, 50 bp, homo sapien
tattccactattggtataatcactargttgctagataaaaagtaaatagt

SEQ ID NO: 72269 - DNA, 50 bp, homo sapien
tttatgatttatcaatgcttactgayaacgtagagctaatgtagtttttg

SEQ ID NO: 72270 - DNA, 50 bp, homo sapien
agtgtaactaccatactcttttccayagaatctgttccattctgtgttcc

SEQ ID NO: 72271 - DNA, 50 bp, homo sapien
aataaaaatttacttacatgaaatarattaaactcttatggatgttgcag

SEQ ID NO: 72272 - DNA, 50 bp, homo sapien
tcctgaagagatacttgtacactcaygtttttagcaacactatttacagt

SEQ ID NO: 72273 - DNA, 50 bp, homo sapien
ttttgtttaaaatgtacaaccattayatgagatagatattgttcttatct

SEQ ID NO: 72274 - DNA, 50 bp, homo sapien
acatttccttatgctctcacatacaytgcggtgccctataaccattgggt

SEQ ID NO: 72275 - DNA, 50 bp, homo sapien
ctcgagcaaacacttgccttatataracccttcataatgacagcaaatca

SEQ ID NO: 72276 - DNA, 50 bp, homo sapien
gtattatcattagaactgtctgtatkttaactactttgtcaatattttat

SEQ ID NO: 72277 - DNA, 50 bp, homo sapien
actatttcaaaacattgattacctgrgttgcaaaaagaaatacatgtttg

SEQ ID NO: 72278 - DNA, 50 bp, homo sapien
ttcattaattataacaaatgcaccakcttgttgctagatattgatagctg

SEQ ID NO: 72279 - DNA, 50 bp, homo sapien
tcccacaacattcctgaaaccattayctttatttttagatctagaactga

SEQ ID NO: 72280 - DNA, 50 bp, homo sapien
gattattatttttaactacttttacrgcgagagtccagaggcctacatca

SEQ ID NO: 72281 - DNA, 50 bp, homo sapien
ttttatgaaacaactatggatttaawgtaattgctaatcacagtttggta

SEQ ID NO: 72282 - DNA, 50 bp, homo sapien
acaaatttgaaggtttctgtgatgcmctaaggtttgataatttgctagaa

SEQ ID NO: 72283 - DNA, 50 bp, homo sapien
caatgatggaaacactgattgatcawaatttctaacactatgttctaaaa

SEQ ID NO: 72284 - DNA, 50 bp, homo sapien
cacatttacattaatctatagtaaarttcaaaaacagaaaatcaagcctg

SEQ ID NO: 72285 - DNA, 50 bp, homo sapien
tggaacttattcacttagcataactkaaacattatcttttttgaagaatt

SEQ ID NO: 72286 - DNA, 50 bp, homo sapien
acaatctttacaactatgatttaggkaagagtatggtcttgctgtaaact

SEQ ID NO: 72287 - DNA, 50 bp, homo sapien
aggggcgattatggagtaatggagaygctacagtataaaaacagagtcct

SEQ ID NO: 72288 - DNA, 50 bp, homo sapien
gattgacagcctttattaatgaacasaatttgttttattttataaactga

SEQ ID NO: 72289 - DNA, 50 bp, homo sapien
acatttttacaaatctggtggccaakctgataattatacaatacataaaa

SEQ ID NO: 72290 - DNA, 50 bp, homo sapien
aaaatgccccagataaacaatcatgyattagaaacagaatctagaagccc

SEQ ID NO: 72291 - DNA, 50 bp, homo sapien
acataaacccagggattgaatctcasgttaataggacagtagaatctaag

SEQ ID NO: 72292 - DNA, 50 bp, homo sapien
tgttttgattaaagtgctttataacygctcaggctcttatccagtttcta

SEQ ID NO: 72293 - DNA, 50 bp, homo sapien
ttttgttgcaagataaaatgttagcstatcaatatttcatggattttgtc

SEQ ID NO: 72294 - DNA, 50 bp, homo sapien
ccatttgtatttatactatatttgcsctttgatactttctcttctttagt

SEQ ID NO: 72295 - DNA, 50 bp, homo sapien
cataggttatatgtaagtgctaagcmattttatattaagtacttgagcat

SEQ ID NO: 72296 - DNA, 50 bp, homo sapien
ttggaaggtgggtatgtatggttacyggacagctaaaggaactaaaaatg

SEQ ID NO: 72297 - DNA, 50 bp, homo sapien
ttctatgtttgcaattcagactgagwatttttttaatcagcttatcttta

SEQ ID NO: 72298 - DNA, 50 bp, homo sapien
acacttagcatgtacttcggaactaygtaaatattattctcctcattaat

SEQ ID NO: 72299 - DNA, 50 bp, homo sapien
aaaaagccaaagactggtattagaayctttgcaaaacacacatctaataa

SEQ ID NO: 72300 - DNA, 50 bp, homo sapien
ccttgcattaaaaaaaatagagacawctcttaaaactttacaataagaga

SEQ ID NO: 72301 - DNA, 50 bp, homo sapien
aggttattacaaacctgttgttttaygtatgaatggggacaaggtgaatg

SEQ ID NO: 72302 - DNA, 50 bp, homo sapien
gcaaaacagtgatcgtatttcttcarctgttttggagaaaggccttgctt

SEQ ID NO: 72303 - DNA, 50 bp, homo sapien
atgaaaaaaatgggataaagctgcaytgaaattcttttatttaaccgata

SEQ ID NO: 72304 - DNA, 50 bp, homo sapien
ccgagctgttacccaagctgcaagayataatcctctttaccctaccctct

SEQ ID NO: 72305 - DNA, 50 bp, homo sapien
ctaaagggttatagggttctaaatamacttcaaaagcaatctagaccaca

SEQ ID NO: 72306 - DNA, 50 bp, homo sapien
gaaatatgtatttttttgaattcttscaatatgttaaaagcccatttgtt

SEQ ID NO: 72307 - DNA, 50 bp, homo sapien
acataatttctgatacactgaatacyaagttatagggcgtatgagaaggt

SEQ ID NO: 72308 - DNA, 50 bp, homo sapien
atattcattttaaagacttgttctayggatatgaggtagaaggtaggact

SEQ ID NO: 72309 - DNA, 50 bp, homo sapien
gtcatcttgaccatattccaggatarcaattaattttactctagttccct

SEQ ID NO: 72310 - DNA, 50 bp, homo sapien
tgtactaaaactgagagactagcaaracttcttatttgagagcatttact

SEQ ID NO: 72311 - DNA, 50 bp, homo sapien
tataaagtgagtttaaaccatacaamcactgcctaaaagcaaaatattgc

SEQ ID NO: 72312 - DNA, 50 bp, homo sapien
caaatttgaaaaagtattatcagagrccctccatttagaaaacatattat

SEQ ID NO: 72313 - DNA, 50 bp, homo sapien
gtaataaatatattacactgagaaaraatgttaaaatagggcaaacggtg

SEQ ID NO: 72314 - DNA, 50 bp, homo sapien
gggttaagtatacatattttaaacayggataaacagaagacaatgaaaga

SEQ ID NO: 72315 - DNA, 50 bp, homo sapien
caattatcccaaagcttcatggtgtmaacttgcaaacgtttgctacttgt

SEQ ID NO: 72316 - DNA, 50 bp, homo sapien
ataattgcttacatggcaataaaaartatttaactatagggataatgcta

SEQ ID NO: 72317 - DNA, 50 bp, homo sapien
ggaaagtcaatgttctactctgtctkcagatttaaatgttaatatcatcc

SEQ ID NO: 72318 - DNA, 50 bp, homo sapien
tgtgggtgatactaagaaagcattaygtgttgtcctagatcatgtttttc

SEQ ID NO: 72319 - DNA, 50 bp, homo sapien
aaagaaaatgtactcctcaaagaagkttcagttggatatcaagagaggag

SEQ ID NO: 72320 - DNA, 50 bp, homo sapien
catatacaaggtagatctttccacawtggtcataaaagaagaagcttcag

SEQ ID NO: 72321 - DNA, 50 bp, homo sapien
ttattgtgaaaaattacagttgttakgagtatgaatatgcaacatgcaat

SEQ ID NO: 72322 - DNA, 50 bp, homo sapien
gagtcagctgtcaagaaatgatttcsaggatgggtggaacaatatggcaa

SEQ ID NO: 72323 - DNA, 50 bp, homo sapien
tactcataacaactgtaatttttcayaataagcagtagcaacaatttccc

SEQ ID NO: 72324 - DNA, 50 bp, homo sapien
tgagccaccacactgagcttttagcratgattttaacataaattgttcag

SEQ ID NO: 72325 - DNA, 50 bp, homo sapien
ccttaccactaagaaaggaatattcrcctataagagttccaactcttgta

SEQ ID NO: 72326 - DNA, 50 bp, homo sapien
tgtaacacagcaaatgaaactggaayacaatgaaaaaaaaaagaaaacaa

SEQ ID NO: 72327 - DNA, 50 bp, homo sapien
ttctcaaggacttactatctctctcygttgcatcatatgtttattttctc

SEQ ID NO: 72328 - DNA, 50 bp, homo sapien
aatacctgcaggggaatatgggaaamgacttagattgagggcttcaaata

SEQ ID NO: 72329 - DNA, 50 bp, homo sapien
tttgattcctggaccttggtggacaraacatatttaattctcaaatactg

SEQ ID NO: 72330 - DNA, 50 bp, homo sapien
agttcattttgtgattacgtttatcrcttttatacactgaaatttttaat

SEQ ID NO: 72331 - DNA, 50 bp, homo sapien
gctatgtagagaagaacaggctaaaytgaagtaacaaaaagaatatccaa

SEQ ID NO: 72332 - DNA, 50 bp, homo sapien
tattgacccaagggaatgcataaacracttctaccaatgtcatgtactag

SEQ ID NO: 72333 - DNA, 50 bp, homo sapien
taccttaactgaggttatggtatcaygggtgtacacttatatccaaactc

SEQ ID NO: 72334 - DNA, 50 bp, homo sapien
ataatactagcttataatttctacamgtaatgatgtattgacaagtgaaa

SEQ ID NO: 72335 - DNA, 50 bp, homo sapien
acataaatttgttataactataaggratttcatatgcaatatttcggtga

SEQ ID NO: 72336 - DNA, 50 bp, homo sapien
agaatatatttttaatctatgtaaawtgttatcttcagtcatgacacacc

SEQ ID NO: 72337 - DNA, 50 bp, homo sapien
tttttaaacaattgtgtactgattargtaagaagtcacttataatagcta

SEQ ID NO: 72338 - DNA, 50 bp, homo sapien
ttaaaaaattggtatttttgctggamaagccctcctaaagagtagtcagt

SEQ ID NO: 72339 - DNA, 50 bp, homo sapien
gtcagactgcaatgcatacttgaacmaatctttccaaatgaagaaggagg

SEQ ID NO: 72340 - DNA, 50 bp, homo sapien
gtaagccatggcaggggagactcaamgtttataaaaggaatggttacttt

SEQ ID NO: 72341 - DNA, 50 bp, homo sapien
gacttgggaatcatgagagagcaaaygttcaatattctatacaggacttg

SEQ ID NO: 72342 - DNA, 50 bp, homo sapien
atcaatcagatcttttccagcatagratatataatactgcaaataatctt

SEQ ID NO: 72343 - DNA, 50 bp, homo sapien
ttaggctttcagttgcaatctacaaygctaaagggtaaaagtaaaggcaa

SEQ ID NO: 72344 - DNA, 50 bp, homo sapien
tgaaatattaataaaagttgacaaaytaacagcgatatttatggtcaagt

SEQ ID NO: 72345 - DNA, 50 bp, homo sapien
ttgtaaggatatatcatgccaaatgmagtaaagtaaagcagttatcagca

SEQ ID NO: 72346 - DNA, 50 bp, homo sapien
atgtttcactctaacactcatttttwaaaaagcacaaatgttgggattat

SEQ ID NO: 72347 - DNA, 50 bp, homo sapien
aaatattttccaccagttttatccaygctttactgcacacagcacctgta

SEQ ID NO: 72348 - DNA, 50 bp, homo sapien
ttttcctctaaactctaagatacttytcttttattgtgcaataaatgcta

SEQ ID NO: 72349 - DNA, 50 bp, homo sapien
atactagcaatacttagaaaatatawgccttcattattccccacatagat

SEQ ID NO: 72350 - DNA, 50 bp, homo sapien
tgctggtgggctggatgaatacaggragaatacaacaagcatgactacgg

SEQ ID NO: 72351 - DNA, 50 bp, homo sapien
cactacccacacacacacactaacaygatacaactaaaacatgtaaacct

SEQ ID NO: 72352 - DNA, 50 bp, homo sapien
tggttatgaagacatctacaagtaaragtgatatagtttggatgtttgtc

SEQ ID NO: 72353 - DNA, 50 bp, homo sapien
gagccctccacacccttgtacctccrctataccatgcctcttcagggaca

SEQ ID NO: 72354 - DNA, 50 bp, homo sapien
gcctcaaatagaaatctgggtgttayactggcagcaattaatatttattg

SEQ ID NO: 72355 - DNA, 50 bp, homo sapien
gggcttcatgatagatcagtactttwcagccttcctacagcaatatgtgt

SEQ ID NO: 72356 - DNA, 50 bp, homo sapien
ttctgagtattatctaatcttacaamaacagaacctctgttcatcaacat

SEQ ID NO: 72357 - DNA, 50 bp, homo sapien
cataaactcttaaaatttacaggtcwcctatatgcatacattttccaaaa

SEQ ID NO: 72358 - DNA, 50 bp, homo sapien
catcagttcatcttttcatgcactarggatatggaaagaacattaggata

SEQ ID NO: 72359 - DNA, 50 bp, homo sapien
ttttaatgcaaaactatattaaaccrgatacttaagagacaacatgaatg

SEQ ID NO: 72360 - DNA, 50 bp, homo sapien
gaaatgattactgtattcaatagaargataaataagactaaaactcaaga

SEQ ID NO: 72361 - DNA, 50 bp, homo sapien
cactctttctcttctcatttttctaycactgtcatttaatgaatatttta

SEQ ID NO: 72362 - DNA, 50 bp, homo sapien
acacttacttaagaagcttagatatmaaagataagagaaataagacaata

SEQ ID NO: 72363 - DNA, 50 bp, homo sapien
tttcatcagtgttttatagttgtcartacagaggactttcacttctttgg

SEQ ID NO: 72364 - DNA, 50 bp, homo sapien
taagaaataaataaatggacctaacrctaaatcccagggagaactttaaa

SEQ ID NO: 72365 - DNA, 50 bp, homo sapien
ttatttgattgctgtaacaaagtttygctaattaagtagcataaatcaat

SEQ ID NO: 72366 - DNA, 50 bp, homo sapien
aatttgtagtgtcatatacagatttkaaaaagtgtagaaaaattttgaat

SEQ ID NO: 72367 - DNA, 50 bp, homo sapien
atattcatagtgtatcatatgctaaygaaatgcaaataacatcaattctg

SEQ ID NO: 72368 - DNA, 50 bp, homo sapien
aaaaaagttgttctaaataggttaasattccaaaataaattcagaggatt

SEQ ID NO: 72369 - DNA, 50 bp, homo sapien
atgtgccaattgttgtgccattcacygaatataaagcagtccagaataca

SEQ ID NO: 72370 - DNA, 50 bp, homo sapien
agtattagaattactttttggtgacyataacacaattgtaattctttttt

SEQ ID NO: 72371 - DNA, 50 bp, homo sapien
ttgcagaaccattagaccaaaagccraagtaagtgtgtgaactcacaata

SEQ ID NO: 72372 - DNA, 50 bp, homo sapien
agtataaactcagccttaacacttaygctcttgttgtcacaaatgacttt

SEQ ID NO: 72373 - DNA, 50 bp, homo sapien
gcagcatcaatctggcttcagaaaaygcaaatctggaaaagcacctgcac

SEQ ID NO: 72374 - DNA, 50 bp, homo sapien
taccaaacactcttacagacaacagmagaataaaattagaaatcaagact

SEQ ID NO: 72375 - DNA, 50 bp, homo sapien
ggagaaatctgatttcctgaagatartaaacaaatcctctcctgaaaaga

SEQ ID NO: 72376 - DNA, 50 bp, homo sapien
aatgggaggaatttgttctattgcayagtaagatgactgtagttaacaat

SEQ ID NO: 72377 - DNA, 50 bp, homo sapien
agccactaatgacaaaattccacacrgcaacaaaataactagaaacaata

SEQ ID NO: 72378 - DNA, 50 bp, homo sapien
atttgctaattaccctgaattgaccrtcacataatgtatacatgtattga

SEQ ID NO: 72379 - DNA, 50 bp, homo sapien
gacatcaatatggaaatcttcaataycaaaattacactttaaataactta

SEQ ID NO: 72380 - DNA, 50 bp, homo sapien
taaatatatgagaatgaatggaaatyatccttgatcagatattcatggaa

SEQ ID NO: 72381 - DNA, 50 bp, homo sapien
cctaaggtattggaccataattgaastagtgtctgattttttatttgcaa

SEQ ID NO: 72382 - DNA, 50 bp, homo sapien
attacttgacaaggtgttacattacygacaaaggactcctgtaattcaaa

SEQ ID NO: 72383 - DNA, 50 bp, homo sapien
acttttaatattatcatccagttaasagtagtacttcatttctatttttt

SEQ ID NO: 72384 - DNA, 50 bp, homo sapien
gacatttatgactttaaaaacttcaytattgaaatgtacaaatttaaatg

SEQ ID NO: 72385 - DNA, 50 bp, homo sapien
acttgaggaagtagaatgtccaagamaacatataagaaggccttaacact

SEQ ID NO: 72386 - DNA, 50 bp, homo sapien
ttccctagtgatgagaaacacttacycttcctgttatggtgacctgttag

SEQ ID NO: 72387 - DNA, 50 bp, homo sapien
ataggatttatcacacacacataaarttcggtatctattgatatgaaatg

SEQ ID NO: 72388 - DNA, 50 bp, homo sapien
ccaaatttggaaaagatagtataaayccgcatgtgtaagaaactcagatc

SEQ ID NO: 72389 - DNA, 50 bp, homo sapien
tttcttaatataatatcacatatcartaaggtgacctgggaaatgttaga

SEQ ID NO: 72390 - DNA, 50 bp, homo sapien
tgaccaaagatttaaatcacaatacracattccctttggatacattgaaa

SEQ ID NO: 72391 - DNA, 50 bp, homo sapien
taagaaatcatcacaaggtgtaaaasttactggtaatagtaagtacacaa

SEQ ID NO: 72392 - DNA, 50 bp, homo sapien
tcagttaatcataatgttgcctacasaactgtatgggtcagctgaagttc

SEQ ID NO: 72393 - DNA, 50 bp, homo sapien
taactagcattttctgtttcttcagkaacatctagctctctgaagtcttt

SEQ ID NO: 72394 - DNA, 50 bp, homo sapien
aaacggagagagaaactgattataaracactggaaaaaaatggtagttct

SEQ ID NO: 72395 - DNA, 50 bp, homo sapien
gatttgtgtttgatgtcaataaactwaatgagacacaatcttcccctcaa

SEQ ID NO: 72396 - DNA, 50 bp, homo sapien
gtactgtaccttggtatctgtaaaaygtaaagatatggagaaagttgtgt

SEQ ID NO: 72397 - DNA, 50 bp, homo sapien
tgtgtatgagaatggaagaatatacrgagagagaaaaacaaagaaggaag

SEQ ID NO: 72398 - DNA, 50 bp, homo sapien
ttaagtttattgacatcaaacacaartcctggtaattgtgtaatgtaata

SEQ ID NO: 72399 - DNA, 50 bp, homo sapien
gatgaatttataccactggttttcaraataacaagttatggtgtttcctt

SEQ ID NO: 72400 - DNA, 50 bp, homo sapien
tgtctctaagaaactgaagcttaacmgagatggtcagagatactgtgagg

SEQ ID NO: 72401 - DNA, 50 bp, homo sapien
caatctccagtgtccattccttaatyagctagatccaccataaatttcct

SEQ ID NO: 72402 - DNA, 50 bp, homo sapien
gcaggtgataacatgagatggaaatmatgccaaggctgtcactctactag

SEQ ID NO: 72403 - DNA, 50 bp, homo sapien
acaatacagcaacaactgagtattgstaacatacattaaacagaatgtgc

SEQ ID NO: 72404 - DNA, 50 bp, homo sapien
tagagatggaaagtttgcatcccctsaaaatttatttgttgaaatcctga

SEQ ID NO: 72405 - DNA, 50 bp, homo sapien
ttgcctcagtgaaaaatagtgcaaastttatgacctgaactatgcagtaa

SEQ ID NO: 72406 - DNA, 50 bp, homo sapien
tgatgaatttcactttagacagtaayagaaagtataaaataaaaaacata

SEQ ID NO: 72407 - DNA, 50 bp, homo sapien
tgtttctgctatgctgatagaacaartaaaatgtgtaaagaattaatttt

SEQ ID NO: 72408 - DNA, 50 bp, homo sapien
agggacttgtgacatagaagaatgaygagagaaacgcaatggtgccgctt

SEQ ID NO: 72409 - DNA, 50 bp, homo sapien
agactgtgtatcttagccctcatcamtaagttgtagcattggctgtggct

SEQ ID NO: 72410 - DNA, 50 bp, homo sapien
taaactatgagtcaattcaaaatgawgtagataatatgtctcatctgcat

SEQ ID NO: 72411 - DNA, 50 bp, homo sapien
atttatttggaggtatgtatcttagracattctttatagaaagggaaata

SEQ ID NO: 72412 - DNA, 50 bp, homo sapien
agacagatgacttcaggaagaaagcmgaatacaagataaagctcacctca

SEQ ID NO: 72413 - DNA, 50 bp, homo sapien
ttcaaaaagcacacatctatatacargctatctctggagactggggcctc

SEQ ID NO: 72414 - DNA, 50 bp, homo sapien
gaaaattggaatagaggctattgacygatttggaagaaacatatacatta

SEQ ID NO: 72415 - DNA, 50 bp, homo sapien
ttagccatacactgtaagtgataccrgccctagttaaatgtttttctgac

SEQ ID NO: 72416 - DNA, 50 bp, homo sapien
tattatgtgtcttggcttaaagggakaaacatcaatattaacaccactct

SEQ ID NO: 72417 - DNA, 50 bp, homo sapien
ttataggtaactaattcaagaacacrgtggaaatattaagcaagatatta

SEQ ID NO: 72418 - DNA, 50 bp, homo sapien
catctaacacagaagcggccaagaaractaatgggcaagacttcccagaa

SEQ ID NO: 72419 - DNA, 50 bp, homo sapien
aatttgaataattctgtttttatgayagcctcagtactatatacttctag

SEQ ID NO: 72420 - DNA, 50 bp, homo sapien
aataggctgactttcagataaaaaayagcagattatgaaaatcatggaat

SEQ ID NO: 72421 - DNA, 50 bp, homo sapien
tcaagaacattttcataacttagtcrtatttctcttgcattcatattcac

SEQ ID NO: 72422 - DNA, 50 bp, homo sapien
ttaggggaattggctcatacaattayggaggctgaaaattcccatgatag

SEQ ID NO: 72423 - DNA, 50 bp, homo sapien
gagaacatatgcattaaatgattcamgtcttcaggtcttattttaggtga

SEQ ID NO: 72424 - DNA, 50 bp, homo sapien
gctgttaaactgcctctctaacatamtaattgattccagctggtaccggt

SEQ ID NO: 72425 - DNA, 50 bp, homo sapien
tctctccctttattaccaaacaggaytattggcaattggaaatgaatacc

SEQ ID NO: 72426 - DNA, 50 bp, homo sapien
atataaatgtccagctttgagggaaktatttcgtcttgcaagtctagact

SEQ ID NO: 72427 - DNA, 50 bp, homo sapien
tgcggggaggtgtgccttatcatcaractcagtagctttccctgagtact

SEQ ID NO: 72428 - DNA, 50 bp, homo sapien
aatagtttacaaatctatttctccargtcttttctactatcccccaatgc

SEQ ID NO: 72429 - DNA, 50 bp, homo sapien
tttaataaactttcctagtgtcacartgaaagttcctcaatgactattcc

SEQ ID NO: 72430 - DNA, 50 bp, homo sapien
tatcctttaaatttttaccataagaytacagtaattcgtatcttcaagtt

SEQ ID NO: 72431 - DNA, 50 bp, homo sapien
aagacacacacacaaacatctttgcrataagcccttcttttaccttattc

SEQ ID NO: 72432 - DNA, 50 bp, homo sapien
gattaactcagtcacggcaattttasgtaggtttgtgagatataaccgag

SEQ ID NO: 72433 - DNA, 50 bp, homo sapien
ttcccttaagcccaaatctaatccartgcaagacactaactctcttcaat

SEQ ID NO: 72434 - DNA, 50 bp, homo sapien
tctttcctatttgtattatctctacraaatgtgttctctttatgtgtgtg

SEQ ID NO: 72435 - DNA, 50 bp, homo sapien
ccttaccaacactgaaatacctttayggcttgtcacagtttctggaaatg

SEQ ID NO: 72436 - DNA, 50 bp, homo sapien
agtaactatcctaagattacacaacsgtgagaacatccaaaaaaacaact

SEQ ID NO: 72437 - DNA, 50 bp, homo sapien
gtctgatcaaatcaggaactggtgcratcatttaggtgagacaagtcagt

SEQ ID NO: 72438 - DNA, 50 bp, homo sapien
accacctatcctgcagattttttcartagtttacttggtctaatttccca

SEQ ID NO: 72439 - DNA, 50 bp, homo sapien
ttagaaattattttaggagaagatayaatattgcaaaggccaaattttag

SEQ ID NO: 72440 - DNA, 50 bp, homo sapien
ggaataaaattattctattgctcaamtaagatcatacaggtagtttttgt

SEQ ID NO: 72441 - DNA, 50 bp, homo sapien
gtgttgatgggagtaacgatggaatractaataaaatccaagcttttcta

SEQ ID NO: 72442 - DNA, 50 bp, homo sapien
gggatttattatttctgttactttcyatgaggttttgagtgtgtaaactt

SEQ ID NO: 72443 - DNA, 50 bp, homo sapien
tccctggtgacagaaagaactagtgratctacgctaccagtgtgatgcta

SEQ ID NO: 72444 - DNA, 50 bp, homo sapien
atacttaattctccttttaatttccyagcatgtcctcatcctggacatca

SEQ ID NO: 72445 - DNA, 50 bp, homo sapien
gctttatctatgcttactaattataygaagtcctttgaaatgaattactt

SEQ ID NO: 72446 - DNA, 50 bp, homo sapien
cacaacaatttctttatctagaaaawtgtaattgcttttgacctaccttg

SEQ ID NO: 72447 - DNA, 50 bp, homo sapien
gattggcaggaacaagagatggacastaagccagggagcaaagagcacca

SEQ ID NO: 72448 - DNA, 50 bp, homo sapien
atcacaatttccctggcaacttacasgtagtaactgagtgaaaagggggt

SEQ ID NO: 72449 - DNA, 50 bp, homo sapien
cctgcttagttatggatttatagcaycaagagtccaccataagattaagc

SEQ ID NO: 72450 - DNA, 50 bp, homo sapien
agagagctatggtggtaatatcaaastaattttataactggtatatgagg

SEQ ID NO: 72451 - DNA, 50 bp, homo sapien
gtaacatataactgtatatttaaaaycttttctagtaaatccaatgtccg

SEQ ID NO: 72452 - DNA, 50 bp, homo sapien
atatctgaggcttttccttaatttayacatgcaaactaacctaaatcctt

SEQ ID NO: 72453 - DNA, 50 bp, homo sapien
tagttttggcttccaaaaacctcagratgtcaaagtaaccttgttccaga

SEQ ID NO: 72454 - DNA, 50 bp, homo sapien
taatatggagagattatcctatgtcrtatggcccaacgttacaaaagcaa

SEQ ID NO: 72455 - DNA, 50 bp, homo sapien
tggagataagctttttggagtttgasccactgttgtaggaatctgaactt

SEQ ID NO: 72456 - DNA, 50 bp, homo sapien
tgaactgaaatgaattgaacttcaartgtagagatcatttggaaagacca

SEQ ID NO: 72457 - DNA, 50 bp, homo sapien
tgtgtaagggagtataattatgcacygtctatacaaacccttccctaatg

SEQ ID NO: 72458 - DNA, 50 bp, homo sapien
aaataaatacatttttaaaactaaaygttcatcaacccatatgaaaacat

SEQ ID NO: 72459 - DNA, 50 bp, homo sapien
cctggagctgaatcttgaaagatgasaggaaagtagcaaggcaaacaagc

SEQ ID NO: 72460 - DNA, 50 bp, homo sapien
tgaggaaattgagggacagggagatyaagtgactgattcaaggtcagtac

SEQ ID NO: 72461 - DNA, 50 bp, homo sapien
acaatatggataccagtctcaacaayggctatttctaaaaaagtcttatt

SEQ ID NO: 72462 - DNA, 50 bp, homo sapien
tcgtaagactcattctttgaataaastgtttagatttgccgtcaggcatg

SEQ ID NO: 72463 - DNA, 50 bp, homo sapien
ttgttaaaaagtgcaaagtggaagcrgaatatcaaacaaaatagttatta

SEQ ID NO: 72464 - DNA, 50 bp, homo sapien
taatgtccctttacaatgtatagcarggatactgattagagagccatcat

SEQ ID NO: 72465 - DNA, 50 bp, homo sapien
agccatttttccacctgtctttcatyatattcagaatattggaagatgat

SEQ ID NO: 72466 - DNA, 50 bp, homo sapien
aaggtgctgtgcatttgtacatcttraaaattgacattatgccattactt

SEQ ID NO: 72467 - DNA, 50 bp, homo sapien
cactatgggtaaataatgcattgtasctactaggtgtatttgtttcctga

SEQ ID NO: 72468 - DNA, 50 bp, homo sapien
aacattaattacacattctatgaaargctctaagctcacaactacatgca

SEQ ID NO: 72469 - DNA, 50 bp, homo sapien
gaaggaccaagactcatgtgttaccraaaggtacttgatgtataagtgca

SEQ ID NO: 72470 - DNA, 50 bp, homo sapien
ttgtctatatatttcatttttaataygatatgatttagagctaatataac

SEQ ID NO: 72471 - DNA, 50 bp, homo sapien
gaaattgttacttttcaaggtaacartgtagatcccaaaagccctggtta

SEQ ID NO: 72472 - DNA, 50 bp, homo sapien
atagtcagtagttacatagtgtaaartgtgcaacaattattgtatccttt

SEQ ID NO: 72473 - DNA, 50 bp, homo sapien
attttacatgactgaaaaaagagtasggtctcattatatgttcccagggg

SEQ ID NO: 72474 - DNA, 50 bp, homo sapien
caccatattttaattgctttaaaaakgatacaataattgttgcacatttt

SEQ ID NO: 72475 - DNA, 50 bp, homo sapien
acgacatagcataattggttcaatcrtccgtctactattggaccttgaag

SEQ ID NO: 72476 - DNA, 50 bp, homo sapien
ttgataggatgtcatggaagtcaacraatataggaacttcctgtgttatt

SEQ ID NO: 72477 - DNA, 50 bp, homo sapien
gttctttctataaactcttcaattaygtagtctgtataagagaactctct

SEQ ID NO: 72478 - DNA, 50 bp, homo sapien
agaaattactttgcaaaattttctaygaaatcttccctaaatttcagact

SEQ ID NO: 72479 - DNA, 50 bp, homo sapien
gggcagcgtctaaaatttgagagcamacctcagctgacagtgaacaagga

SEQ ID NO: 72480 - DNA, 50 bp, homo sapien
ttttcaaagttaattattttttaccragatttctcaatttatttgcctat

SEQ ID NO: 72481 - DNA, 50 bp, homo sapien
tgggctgtgagagttaaaaaacttayagttggctttgtggtgacttttag

SEQ ID NO: 72482 - DNA, 50 bp, homo sapien
aatttccacagatctcttcttagtcrcatttaataggaaatatatattac

SEQ ID NO: 72483 - DNA, 50 bp, homo sapien
gaatgcattccattaaagaaaaaaaygagtataatacaagtgaactgatt

SEQ ID NO: 72484 - DNA, 50 bp, homo sapien
ttatgaacatatgagtaaaaataaaraattaggagtgctcattttaagat

SEQ ID NO: 72485 - DNA, 50 bp, homo sapien
acaataaatagaaattgctaatgaargatatgttgacttactggggatgg

SEQ ID NO: 72486 - DNA, 50 bp, homo sapien
gaagttggtacttcccatacgcacartagtagtttatttaagcttaaatt

SEQ ID NO: 72487 - DNA, 50 bp, homo sapien
agtcttttgtgatagatcttattatsaggcatatatgcataagaaccctt

SEQ ID NO: 72488 - DNA, 50 bp, homo sapien
gaagtaaaagcttgagttaaggtaasggggagtcatggaggccaaggttc

SEQ ID NO: 72489 - DNA, 50 bp, homo sapien
attgtaatataatgtaggtatataayggcaatgacactatttctggtttt

SEQ ID NO: 72490 - DNA, 50 bp, homo sapien
ggcaaaatgattagtcatgggtataratcattctgtgatacatgagtaat

SEQ ID NO: 72491 - DNA, 50 bp, homo sapien
aaaagctagctgaaaccaaggaagaygagagaagaaaccccaacccagga

SEQ ID NO: 72492 - DNA, 50 bp, homo sapien
tatacatccatataaaatattaataracatgcatagagatctgagaaatt

SEQ ID NO: 72493 - DNA, 50 bp, homo sapien
caaggtaggtaaggaattcaatcaaygcagagaactgaaagagtagtatc

SEQ ID NO: 72494 - DNA, 50 bp, homo sapien
aatgtagtgtttcgaaatggcttatmaatgtatcaggtttcttgtgtttc

SEQ ID NO: 72495 - DNA, 50 bp, homo sapien
attcatcttatgtggtgaaaaagtakgtatggaagtacctgcttttatat

SEQ ID NO: 72496 - DNA, 50 bp, homo sapien
ttcccctttgattcttttcatcttayatacacagtaggcttgattacttc

SEQ ID NO: 72497 - DNA, 50 bp, homo sapien
tgtgattgattatgtagaaattatayggaagactccctctggaatgctgc

SEQ ID NO: 72498 - DNA, 50 bp, homo sapien
gccaactggtacaggtgaaaaggatractgaaacggcagaggtcctccat

SEQ ID NO: 72499 - DNA, 50 bp, homo sapien
ctctgtttgcgcagagatcacaaaaygtgtcccgcagaagggagagaaaa

SEQ ID NO: 72500 - DNA, 50 bp, homo sapien
taagatgctaaaggaaggaatataaratgaaacactcactacagatacta

SEQ ID NO: 72501 - DNA, 50 bp, homo sapien
tcacaaaggacaatagggatgtaaaytagtcattgttctatcagtgttaa

SEQ ID NO: 72502 - DNA, 50 bp, homo sapien
ctacatgaagtttctggaattataayggttcccagaattacacattttgt

SEQ ID NO: 72503 - DNA, 50 bp, homo sapien
taccagcaagaaggacgtgttgctcraagttgaagagatcagtaatttat

SEQ ID NO: 72504 - DNA, 50 bp, homo sapien
atatcttcatgggtttttcaaaagayagtagatcaacaacttcaaacttg

SEQ ID NO: 72505 - DNA, 50 bp, homo sapien
gctctgggaagcacttctactactawgtcgaacagaagtggcgcataaat

SEQ ID NO: 72506 - DNA, 50 bp, homo sapien
aatgatttagagagtcacagtgttayaatgaatagtacagctatacaatt

SEQ ID NO: 72507 - DNA, 50 bp, homo sapien
gtcagtggattctagcttctgtaaargttggaagaaaaaaaaaatccact

SEQ ID NO: 72508 - DNA, 50 bp, homo sapien
taatcaggattgcccacctatcacaycaaattaccagtaaaaaatgcaaa

SEQ ID NO: 72509 - DNA, 50 bp, homo sapien
ccaacccccccgccgggacctagtawcttcagctatgaaacatatggctt

SEQ ID NO: 72510 - DNA, 50 bp, homo sapien
gaaacaatatagggaactttctaaaycataggaaatctaaaaaatcagct

SEQ ID NO: 72511 - DNA, 50 bp, homo sapien
ttctgtttttgcttcatatatttttsaaactacctccatgattatgtcct

SEQ ID NO: 72512 - DNA, 50 bp, homo sapien
tgctagatgagaatggaatagctgayggagccctcattttataaagtttt

SEQ ID NO: 72513 - DNA, 50 bp, homo sapien
ttgctgtgaatttttaaatatttcaygtaaaccatagactgactgtaatg

SEQ ID NO: 72514 - DNA, 50 bp, homo sapien
attttgaaaacctgtttataatgaaygaggtagaagaagcatatctcaca

SEQ ID NO: 72515 - DNA, 50 bp, homo sapien
atttgcttaccactttcatactcacrggatcaggttcaagtgtttcttta

SEQ ID NO: 72516 - DNA, 50 bp, homo sapien
ccattttaccatctccttacagtatyagtacccataaagacattacctgt

SEQ ID NO: 72517 - DNA, 50 bp, homo sapien
tcgggattgtttgatattcactcaaygtttttatgtcagctttacttttt

SEQ ID NO: 72518 - DNA, 50 bp, homo sapien
tcaatggtgaatgagccttgcgtatyaggacaaactgacttagtgtttgc

SEQ ID NO: 72519 - DNA, 50 bp, homo sapien
caagaactccacctggtttagtccaygaactccgaacactgaaggagtaa

SEQ ID NO: 72520 - DNA, 50 bp, homo sapien
aacacacacacgctctgtccttttamgtctgatgcgaaaatgatgtttac

SEQ ID NO: 72521 - DNA, 50 bp, homo sapien
atgctcaccattttcatagcagaaarctagttatactaaattgttctaat

SEQ ID NO: 72522 - DNA, 50 bp, homo sapien
tgaaaatattcaatctgtgcttctcmtaactactgggttataaaatggga

SEQ ID NO: 72523 - DNA, 50 bp, homo sapien
gatttctctatccaaatagccagcaratactactcacctgattgacagac

SEQ ID NO: 72524 - DNA, 50 bp, homo sapien
tctctagctttcatttttgtcctgayctttcaagaggaatgctgtcaaca

SEQ ID NO: 72525 - DNA, 50 bp, homo sapien
atgcatcatctctcattaacaatagyccaggatgaagaaacagcccatta

SEQ ID NO: 72526 - DNA, 50 bp, homo sapien
gcaatttgtggtaaaacttgagggcrcattatgatatgttgacagcattc

SEQ ID NO: 72527 - DNA, 50 bp, homo sapien
aaatgagatattttgtatttagtaaraaggcctcagctacatataagtgt

SEQ ID NO: 72528 - DNA, 50 bp, homo sapien
aattatctttagtctgttagcctcartatgtgtatatgtacctttacagc

SEQ ID NO: 72529 - DNA, 50 bp, homo sapien
gctctttgagacagacgtgaattgayagagatacagggaaagtgtatttg

SEQ ID NO: 72530 - DNA, 50 bp, homo sapien
cttctgtgcatatattattattgtcyacctgtaccatgaaatggaaagta

SEQ ID NO: 72531 - DNA, 50 bp, homo sapien
ttaataacaatggggagagttttcasggcagaggagatgacttttataaa

SEQ ID NO: 72532 - DNA, 50 bp, homo sapien
ctcttaggaggaacaagacagttgartatattaaggaatgttctagctgt

SEQ ID NO: 72533 - DNA, 50 bp, homo sapien
ggatatttgagctcatggtacattayaaaggagtatgtcaacatagagca

SEQ ID NO: 72534 - DNA, 50 bp, homo sapien
gggtgtatttgaccagttatgttaaytacaacatcctaaggaacaaaagt

SEQ ID NO: 72535 - DNA, 50 bp, homo sapien
gaaagacaaggctcaggttgccaagygccacccttccattgaaaaatgga

SEQ ID NO: 72536 - DNA, 50 bp, homo sapien
tatggaagctcttttttttgcacccrccagacacttcttccctgaacaaa

SEQ ID NO: 72537 - DNA, 50 bp, homo sapien
aatcctaacaggctattgataaagayaatgactgctcaagagagatttag

SEQ ID NO: 72538 - DNA, 50 bp, homo sapien
acaggtcccatgaatggaaatcagcwgagggaagcacagaacttgctgct

SEQ ID NO: 72539 - DNA, 50 bp, homo sapien
tggaggaaaagaggtagtttcacaamaagtagatttgaagatgggaagat

SEQ ID NO: 72540 - DNA, 50 bp, homo sapien
attcaaggaccttaataatggatacmcttcactttggttcaagctttgtt

SEQ ID NO: 72541 - DNA, 50 bp, homo sapien
ttgatgtaacatctgactgagaaatkatccttggactataaaatatttga

SEQ ID NO: 72542 - DNA, 50 bp, homo sapien
tctttagggtagtaataaagactaartaagtagtgtctgaatctatggca

SEQ ID NO: 72543 - DNA, 50 bp, homo sapien
aatcagaaaaaattggcagagataarcaattaaattcagcagggaaaatt

SEQ ID NO: 72544 - DNA, 50 bp, homo sapien
gcatggattgttgacaagattcacasacacagtaattcggtatggtgaga

SEQ ID NO: 72545 - DNA, 50 bp, homo sapien
taaaagaatccagtgattatattgamagatactggtgaaaacaaaaaaaa

SEQ ID NO: 72546 - DNA, 50 bp, homo sapien
aggtaactctggttaaaaaaaatccrcaagtcaggaatatcagctgtttg

SEQ ID NO: 72547 - DNA, 50 bp, homo sapien
ctttagacttgtaaatcacctctccrctactccttaggctccacaagaag

SEQ ID NO: 72548 - DNA, 50 bp, homo sapien
ctgggtattggttagagctctctacraatgtcttctgattttcttaaaga

SEQ ID NO: 72549 - DNA, 50 bp, homo sapien
tgttactgttttgccacaagatacayaccaaaattgaaagttaaaaaaaa

SEQ ID NO: 72550 - DNA, 50 bp, homo sapien
ctagaaatcagccctctactgtctcwctagtctaagataaaaagtcctta

SEQ ID NO: 72551 - DNA, 50 bp, homo sapien
aattctatgaattctgggccagtctstccacccagaatgtagtattctaa

SEQ ID NO: 72552 - DNA, 50 bp, homo sapien
catgccttttctcacattttacactyactgactgtgttgcttgtgaatta

SEQ ID NO: 72553 - DNA, 50 bp, homo sapien
gaggccattcatgttaaacccttcamgtcgttccattgaaacccttctca

SEQ ID NO: 72554 - DNA, 50 bp, homo sapien
agctttgagggaaagtccatcttttygaggccattcatgttaaacccttc

SEQ ID NO: 72555 - DNA, 50 bp, homo sapien
tcctctccacatgctgtctatctcartgatatacccagttgcccagccct

SEQ ID NO: 72556 - DNA, 50 bp, homo sapien
tggtctaactcctttggcatactccyaagaatctgtctcattgattttgt

SEQ ID NO: 72557 - DNA, 50 bp, homo sapien
aattttgaaagttatttaagggcaasatctggcaggagcaagtgattgga

SEQ ID NO: 72558 - DNA, 50 bp, homo sapien
accaaacagtatatttggcactgtarggagtaaaagattgagagattttt

SEQ ID NO: 72559 - DNA, 50 bp, homo sapien
ggtcagagagacaagaagagaacaaycaaacagtatatttggcactgtaa

SEQ ID NO: 72560 - DNA, 50 bp, homo sapien
aagggcacaaggaaacttggaatgaygaaaatgttggtatcttaatagtg

SEQ ID NO: 72561 - DNA, 50 bp, homo sapien
taagggcaaagaagtctttttatagraggtagtatttgaactgggtctta

SEQ ID NO: 72562 - DNA, 50 bp, homo sapien
agcagaaattctttcttctgcactcyatggatacaaataataacaccctc

SEQ ID NO: 72563 - DNA, 50 bp, homo sapien
agaagaagaaacttcaaacttacaascttagcaattttagtactttgtac

SEQ ID NO: 72564 - DNA, 50 bp, homo sapien
aagggtcaagaggaacagggaggaargagtaaattctatattaagaatga

SEQ ID NO: 72565 - DNA, 50 bp, homo sapien
gatttagataacagttctttgtagtytcataacaccctgaattgcagtag

SEQ ID NO: 72566 - DNA, 50 bp, homo sapien
gttttaggacaattcaatcaagacaractgtgaaaagaatttcattggat

SEQ ID NO: 72567 - DNA, 50 bp, homo sapien
agagagaaaaagacacagcaaaatasggtcagagagacaagaagagaaca

SEQ ID NO: 72568 - DNA, 50 bp, homo sapien
tgtaatcattctaacatgttacatasaccatgagaatgagaatgtgttta

SEQ ID NO: 72569 - DNA, 50 bp, homo sapien
gaggtcctgatggtcagagattgaawtgagttttatttattcacctagat

SEQ ID NO: 72570 - DNA, 50 bp, homo sapien
gatgtagggatgcaaaatgtgagtawctttactttcgctactgtcagata

SEQ ID NO: 72571 - DNA, 50 bp, homo sapien
aagccatccctataatttgaagaagsatatctgtaagtcacactcatatt

SEQ ID NO: 72572 - DNA, 50 bp, homo sapien
caacaggacacttagtgttggctacyatgcaaaggtaagtgtagatgaca

SEQ ID NO: 72573 - DNA, 50 bp, homo sapien
gggcaccatcatgggatagtttttasatgaaaatttggaatgggggttag

SEQ ID NO: 72574 - DNA, 50 bp, homo sapien
aacattttttagaaggaaagaacaaytctaccaactaattccgtctcagg

SEQ ID NO: 72575 - DNA, 50 bp, homo sapien
cacctagttcttttcaatcagggcasgatctgtctccaatttgtttccaa

SEQ ID NO: 72576 - DNA, 50 bp, homo sapien
tctaggatatttgcaatgttttttaraatgctagagatagtaatacctat

SEQ ID NO: 72577 - DNA, 50 bp, homo sapien
gttaattcctattaatatgatctaaygggacttaatttcctcagctatag

SEQ ID NO: 72578 - DNA, 50 bp, homo sapien
ttgtcaagatgaggggaatgttaaasacctcttgatcactgctccatttt

SEQ ID NO: 72579 - DNA, 50 bp, homo sapien
gcagtcagttacgtgaggtaggcctytttgtgtaataattgaaagggaat

SEQ ID NO: 72580 - DNA, 50 bp, homo sapien
gtaattaaaagccttctatataactwactccattctgatacataatttcc

SEQ ID NO: 72581 - DNA, 50 bp, homo sapien
tttttgctctggtagttcagcaagayctagttgcttaaaagagtatggca

SEQ ID NO: 72582 - DNA, 50 bp, homo sapien
tagggagtagctttcagcatgttaamgactaagctagactcctgataacc

SEQ ID NO: 72583 - DNA, 50 bp, homo sapien
tagtttctttaacaactctgtaggastagataccaacctgtagaaaactg

SEQ ID NO: 72584 - DNA, 50 bp, homo sapien
attcaaattgcatatgtaccctatargattcaacagtcatctgctggaaa

SEQ ID NO: 72585 - DNA, 50 bp, homo sapien
gacaggtggggcaaaaagtatatgcrcttggaaccgtgatagcaccaggg

SEQ ID NO: 72586 - DNA, 50 bp, homo sapien
aatacatgtatgttatacaggtgcartaacctaaaaacgaagtaactaga

SEQ ID NO: 72587 - DNA, 50 bp, homo sapien
atataatgatcgtatgtaaataagcrcagcataacttactgaaaagagaa

SEQ ID NO: 72588 - DNA, 50 bp, homo sapien
atcagttaccaaatttaatataaaartaatccttcttgacaaaaaacaaa

SEQ ID NO: 72589 - DNA, 50 bp, homo sapien
gcaaaggaaagatgtgtccgttttayagtgaacctttagacaggaaaagg

SEQ ID NO: 72590 - DNA, 50 bp, homo sapien
tcttattttccttgcaacagccatcrctatttaacacagaattagctcat

SEQ ID NO: 72591 - DNA, 50 bp, homo sapien
actatttattgattatgttgtttgastattcattttgctacttggtgaag

SEQ ID NO: 72592 - DNA, 50 bp, homo sapien
gctgggtattcttgttaattccaaartttatgcaagcaccattgccctcc

SEQ ID NO: 72593 - DNA, 50 bp, homo sapien
aaatttgttacagaaaagaactataytactcatattactcattcaccctc

SEQ ID NO: 72594 - DNA, 50 bp, homo sapien
gtgtagaaggaggtgggcccttaaaktctctggaaagtataatttgggaa

SEQ ID NO: 72595 - DNA, 50 bp, homo sapien
tgaaatcctaatccttcctaggagckaattattaacttgaatttgatgtt

SEQ ID NO: 72596 - DNA, 50 bp, homo sapien
aacattctcacagaataccaacctcrgacaagactactctgagaccacaa

SEQ ID NO: 72597 - DNA, 50 bp, homo sapien
ggggggataattttacacataactcrtagggttttcatgataatttaaaa

SEQ ID NO: 72598 - DNA, 50 bp, homo sapien
taacttagcaacattagatgatcagwcatagcttagggacattagcaact

SEQ ID NO: 72599 - DNA, 50 bp, homo sapien
gtgatatcattataaatatacctaaygtttggaggagccatttggaacag

SEQ ID NO: 72600 - DNA, 50 bp, homo sapien
acccccaactggcactagactttgaraggatatttctttaagcctggatt

SEQ ID NO: 72601 - DNA, 50 bp, homo sapien
aattttggctaatgtttatgtccaargaaccttagagtgccttaattttt

SEQ ID NO: 72602 - DNA, 50 bp, homo sapien
aatgtgacagccactgggatttccakcagtgctactattctggacctatt

SEQ ID NO: 72603 - DNA, 50 bp, homo sapien
aaaaaaaaaaaaaataatagttggtsaatctactggcttgttttaggagg

SEQ ID NO: 72604 - DNA, 50 bp, homo sapien
tatcattatgccttacatccttactraacgtgcctattaatatatttaga

SEQ ID NO: 72605 - DNA, 50 bp, homo sapien
gcagcaacttatatatgaaataaaargagaaagttataagttgtaatcct

SEQ ID NO: 72606 - DNA, 50 bp, homo sapien
taacagaaaaaagaaaaagaagaacracagataagatatttgtggtatct

SEQ ID NO: 72607 - DNA, 50 bp, homo sapien
catccccttttgctaaaccattaaawtatctgccccaatggccggtgtgc

SEQ ID NO: 72608 - DNA, 50 bp, homo sapien
acacttactttaaattagtatttccrcgatggttttgtgaaatattacac

SEQ ID NO: 72609 - DNA, 50 bp, homo sapien
gacttatcatttgctaatcagcatcrcgttaatctttgtccgtgaaagac

SEQ ID NO: 72610 - DNA, 50 bp, homo sapien
gattaacgtgatgctgattagcaaaygataagtcttttagggttccatct

SEQ ID NO: 72611 - DNA, 50 bp, homo sapien
taaaattattaagtgagatgctcaawgtcttaccagcaagttgtagtaaa

SEQ ID NO: 72612 - DNA, 50 bp, homo sapien
ccaagtactttacagggactacctcmattaatcctcattaattgtagcct

SEQ ID NO: 72613 - DNA, 50 bp, homo sapien
atagtccagatcctaactaggagtaraaatgtgaattgtgctgcctgatc

SEQ ID NO: 72614 - DNA, 50 bp, homo sapien
gtctatcaatggtgccaagttgaccrcaaccaaccaagtcatttgacact

SEQ ID NO: 72615 - DNA, 50 bp, homo sapien
gaccagagtgcggaaacctcattcayatatcattaacacacctggcatac

SEQ ID NO: 72616 - DNA, 50 bp, homo sapien
cttgcaggcatgttgttggactgtayttcctcactccttgcagttggact

SEQ ID NO: 72617 - DNA, 50 bp, homo sapien
gatgtacatcatatacatatgacaartcagaacagtaatgccactatatg

SEQ ID NO: 72618 - DNA, 50 bp, homo sapien
tctcatactagaaacaggatttagtyacccttgatgcaggctgaggcctt

SEQ ID NO: 72619 - DNA, 50 bp, homo sapien
tccaaaatatgttatcggaatatatyacaaccttaggacttcatgaatta

SEQ ID NO: 72620 - DNA, 50 bp, homo sapien
caacaaaaataaaatagctctttcayattcaaatacaaagcaagattatg

SEQ ID NO: 72621 - DNA, 50 bp, homo sapien
atacatcatgtcaatagaatgaaagraaaaacgatttcaactgacacaca

SEQ ID NO: 72622 - DNA, 50 bp, homo sapien
gaaagaattttgactgctctaggaartatttggtattgtggtgatagatc

SEQ ID NO: 72623 - DNA, 50 bp, homo sapien
tacttgtacctgtatggatggcatcrtttggttaaactgacttttttccc

SEQ ID NO: 72624 - DNA, 50 bp, homo sapien
taaaatgaaaaacaatgcccatttgraacttgagtaattcattttgacag

SEQ ID NO: 72625 - DNA, 50 bp, homo sapien
tgggcaagtttctttacttttctgawcctagttttgtcatagcttaaatt

SEQ ID NO: 72626 - DNA, 50 bp, homo sapien
cagacccttgaacacggtgacttgaycagtgcagggtcccctgtgaggcc

SEQ ID NO: 72627 - DNA, 50 bp, homo sapien
acacgatgacaacaaatcatttgggractagaacctgtagcattacctta

SEQ ID NO: 72628 - DNA, 50 bp, homo sapien
aatttgtgccaggcagtgaaaaagayagacatagtccctgtcctaacata

SEQ ID NO: 72629 - DNA, 50 bp, homo sapien
atttagagtatgtgtatagcatatawtagtaaaatgtgattgcatgttta

SEQ ID NO: 72630 - DNA, 50 bp, homo sapien
gaacagctcaagctcgtcatctctaygaagctttatctggctattcagtt

SEQ ID NO: 72631 - DNA, 50 bp, homo sapien
ctttctgtaatacaagtagtgtaaakgctgtctttggtctggtaactggt

SEQ ID NO: 72632 - DNA, 50 bp, homo sapien
tcgctcgttattttttgtgaatccayactttgatctggtatcttttttct

SEQ ID NO: 72633 - DNA, 50 bp, homo sapien
aaagcagataaagatgtgatcgagaygaaagagaaaaatggcatttggaa

SEQ ID NO: 72634 - DNA, 50 bp, homo sapien
agtaaaggtcacaagagatgtaaaaytggagacagagttggaattagtgt

SEQ ID NO: 72635 - DNA, 50 bp, homo sapien
aatttggtttaaaatatctttctcaygttgagtaacagtctttaagttat

SEQ ID NO: 72636 - DNA, 50 bp, homo sapien
gaggatgtggaaggagaacttagtcygagtaaaggtcacaagagatgtaa

SEQ ID NO: 72637 - DNA, 50 bp, homo sapien
cagtactctgaaactcagtggagcaratgataaatctgtcacaattttcc

SEQ ID NO: 72638 - DNA, 50 bp, homo sapien
caattttttaactaaattgataagaygctttaaatatcattacatagtgc

SEQ ID NO: 72639 - DNA, 50 bp, homo sapien
cctcccttccttttgtcctggtaaaytcttacatatgcttctagactcaa

SEQ ID NO: 72640 - DNA, 50 bp, homo sapien
atttgtttccagggagtgataccacrataaacgatattttctatcattat

SEQ ID NO: 72641 - DNA, 50 bp, homo sapien
aattacagggtaaatgagaagaggarattatagccattcttctttaaaag

SEQ ID NO: 72642 - DNA, 50 bp, homo sapien
agtcaatattagtttgcaatgataaygatgataattttcatgaacaagtt

SEQ ID NO: 72643 - DNA, 50 bp, homo sapien
atgatttcacatttctttattgaaayggcaactcctcataacttagggtt

SEQ ID NO: 72644 - DNA, 50 bp, homo sapien
ctagggctgaaacatttcatcaaaaragatatgctcatcaatctttccta

SEQ ID NO: 72645 - DNA, 50 bp, homo sapien
ttataaatgcctatggcaaataatgmattgagagacaagctatgtatgag

SEQ ID NO: 72646 - DNA, 50 bp, homo sapien
aactctttggactatggtgttttaaraatgtagaactacaatgtttctaa

SEQ ID NO: 72647 - DNA, 50 bp, homo sapien
acatttgattggcatgtgtatcctaraaaaattggcatagcactttgtta

SEQ ID NO: 72648 - DNA, 50 bp, homo sapien
acttgttttgagaatcttgaggcctrattactttcaattaaaaatctggg

SEQ ID NO: 72649 - DNA, 50 bp, homo sapien
ctagacttcaccagaaccaagaaaartagatcatgctttaaaaaattcat

SEQ ID NO: 72650 - DNA, 50 bp, homo sapien
aggcgagtcactgcgcccagtctcayaggattattgtttatgtgacagtg

SEQ ID NO: 72651 - DNA, 50 bp, homo sapien
cgaacaatcttattactcaatatcayaattaataaactgtttagcagcca

SEQ ID NO: 72652 - DNA, 50 bp, homo sapien
agtgggatgcaggtggcttagcttaygtttctgaaggacatcgtctctca

SEQ ID NO: 72653 - DNA, 50 bp, homo sapien
tagataatattgaacatattcctcarcaacagcatgcatgcttctaaata

SEQ ID NO: 72654 - DNA, 50 bp, homo sapien
tctttgtcttaacagttttgtaaaartaggtcattcttaaatatggtaca

SEQ ID NO: 72655 - DNA, 50 bp, homo sapien
agggcatgggctctgttacaatgcaygatgaaataccgtgtcataataca

SEQ ID NO: 72656 - DNA, 50 bp, homo sapien
tcttgatttctacaataaatccaaawcacagaaagaatggaattaattga

SEQ ID NO: 72657 - DNA, 50 bp, homo sapien
agcagagctccctagggaaggagatyaaatgaattcagaacttgatttag

SEQ ID NO: 72658 - DNA, 50 bp, homo sapien
tgaggtagcacatgaatagtatgaaytgaaaacaatccttgtggtctgtt

SEQ ID NO: 72659 - DNA, 50 bp, homo sapien
atgttttaaattaactgtcttcctasgtctatttataattgattggatat

SEQ ID NO: 72660 - DNA, 50 bp, homo sapien
tcttatgtctagatattgagattacrcacctgatggagagtttgaatctt

SEQ ID NO: 72661 - DNA, 50 bp, homo sapien
aaataaaaagaaaacacaggtgaaayaaattgagatattcctaaaactcc

SEQ ID NO: 72662 - DNA, 50 bp, homo sapien
atattgtatgaaaaacacagtcataygattccaagttgaaaagtgaatag

SEQ ID NO: 72663 - DNA, 50 bp, homo sapien
acgagctagctctgaatttgttaagrccggtagtttagtgcaaccacaca

SEQ ID NO: 72664 - DNA, 50 bp, homo sapien
gtttctggatccatgttgaaattgarcgcagatagcacaaccatattata

SEQ ID NO: 72665 - DNA, 50 bp, homo sapien
aaaccttaatgcttctgcttgtttayctgcaaaatcaatttgtttcatag

SEQ ID NO: 72666 - DNA, 50 bp, homo sapien
ggtggagaccccatgaatgggactarcgaatctataagaagaacggaggc

SEQ ID NO: 72667 - DNA, 50 bp, homo sapien
caccctcagtgaaggctaaggctccrcagaacacagtttgaaatccgcca

SEQ ID NO: 72668 - DNA, 50 bp, homo sapien
tttgattccagttcacagtagtccamctctaatgcagctaatgagggaaa

SEQ ID NO: 72669 - DNA, 50 bp, homo sapien
ttagtaccgaaagagtcagcagatasgaactctttcaaatctcagagtgc

SEQ ID NO: 72670 - DNA, 50 bp, homo sapien
ccagttgcacatgtgtgtgggcctcyaatagactttattccttagtctcc

SEQ ID NO: 72671 - DNA, 50 bp, homo sapien
gagcagagcagttggcttcaagacasatttaagagataagacggaaataa

SEQ ID NO: 72672 - DNA, 50 bp, homo sapien
ttagctaaggagatacctaatcaaaktgttgaaggagtggcttggttcct

SEQ ID NO: 72673 - DNA, 50 bp, homo sapien
aatattgagcagtggattcccaacaygtttctgtgctatcgggcataatg

SEQ ID NO: 72674 - DNA, 50 bp, homo sapien
caatatctatgggtatctcctccatyttgccatcataccaaattactttt

SEQ ID NO: 72675 - DNA, 50 bp, homo sapien
tgttctaacagaatataatgtgtccrgcaataattatatccaggtcaaat

SEQ ID NO: 72676 - DNA, 50 bp, homo sapien
ggacacttttccttttgaaagttgasatcccgttcagaggctgacagact

SEQ ID NO: 72677 - DNA, 50 bp, homo sapien
atttatcaagttctttcaattaaaamaatgcactcatgcatagttttatt

SEQ ID NO: 72678 - DNA, 50 bp, homo sapien
cccttggatgacatatgggttgttaratggtctgaggacaagattcccat

SEQ ID NO: 72679 - DNA, 50 bp, homo sapien
aatgaaggataagaagattcaacacygtgtactccacaaatgggattagg

SEQ ID NO: 72680 - DNA, 50 bp, homo sapien
cacagaatgagattaggagcccaaawgcatgaattcctaatcccatttgt

SEQ ID NO: 72681 - DNA, 50 bp, homo sapien
aaaaatatatttcacgaagagagccytgaaaaatctcatctctagtccca

SEQ ID NO: 72682 - DNA, 50 bp, homo sapien
tcaataaagtagcaggagaattacaraaagtcacaaatgaatccatcctt

SEQ ID NO: 72683 - DNA, 50 bp, homo sapien
ccctaaatcaatgtttgcccagctaraaagtacgttttgccccctcaatc

SEQ ID NO: 72684 - DNA, 50 bp, homo sapien
tgtaacagattgtgaacaatgagcckctttcttgttgttttatctctgac

SEQ ID NO: 72685 - DNA, 50 bp, homo sapien
ctacatctgcgggggaagcagcaccratacctctctaaattagtagctgg

SEQ ID NO: 72686 - DNA, 50 bp, homo sapien
tgtgtagcctctctcccgatattgarctatttaaataccaactactttta

SEQ ID NO: 72687 - DNA, 50 bp, homo sapien
taattccttattccttgtgatttagkaggaaataaagttgaaactggtgg

SEQ ID NO: 72688 - DNA, 50 bp, homo sapien
agtaaccatatgaattttacagaaaktgaaaaccatgtaaactaaagggt

SEQ ID NO: 72689 - DNA, 50 bp, homo sapien
gtgccatgtttaataaactcatcatygcatttgctttatagaaataggtg

SEQ ID NO: 72690 - DNA, 50 bp, homo sapien
ctcaagtcaaaatgaacaaataggaygcataatttattaaccagatttta

SEQ ID NO: 72691 - DNA, 50 bp, homo sapien
ctttacccagaagcaacacgtattayaatctcaatagctaataggttttg

SEQ ID NO: 72692 - DNA, 50 bp, homo sapien
cagattagaatatcacatgacagagrctctcaggaataaagaggtatgaa

SEQ ID NO: 72693 - DNA, 50 bp, homo sapien
ctcatattttagtaaatgtgattaaygtttcttgcagaggacttaatgtt

SEQ ID NO: 72694 - DNA, 50 bp, homo sapien
gcttttattaatattatcacctctaygaaaatctacatattcacctctgg

SEQ ID NO: 72695 - DNA, 50 bp, homo sapien
gtgcatggtgcagaggtggtgttctrtaaatattcattccctttccgcat

SEQ ID NO: 72696 - DNA, 50 bp, homo sapien
aagccactgcctaccatgtgagttaygatatactggcagatctgtagccc

SEQ ID NO: 72697 - DNA, 50 bp, homo sapien
atcaaggcttaatttatgacattaaytatgagactgaaatagctctactc

SEQ ID NO: 72698 - DNA, 50 bp, homo sapien
tctccaatgaactcatctgcctttcmactatggaccttttataatactgt

SEQ ID NO: 72699 - DNA, 50 bp, homo sapien
tcactgcaggctgtctccattggaarctgtactcagactacacagaaggg

SEQ ID NO: 72700 - DNA, 50 bp, homo sapien
atactgtattgattttggaaaggccrcaacacagtggaaagagaaattaa

SEQ ID NO: 72701 - DNA, 50 bp, homo sapien
aatcaaaagaagctactccattctcmattttcagtaagcaatgtttgtat

SEQ ID NO: 72702 - DNA, 50 bp, homo sapien
gaattaatatattatcaatcataacygtatctatatatatttaaaaaaag

SEQ ID NO: 72703 - DNA, 50 bp, homo sapien
tgacttctctaaataacacgacagargacaagtatgaatgtggtgcaagg

SEQ ID NO: 72704 - DNA, 50 bp, homo sapien
tgacataagtaaaatgggacattcaytccaatgagatttctagcaactcc

SEQ ID NO: 72705 - DNA, 50 bp, homo sapien
aggtactaactcatctttcatcaaargtgtatgcaatgttaagttgaatg

SEQ ID NO: 72706 - DNA, 50 bp, homo sapien
gacattgttaatacagatatttagcyatatgtgtgctttaggatttctgc

SEQ ID NO: 72707 - DNA, 50 bp, homo sapien
cttgtgggtttaaagccattctctckacttgggctaatggatatctcaga

SEQ ID NO: 72708 - DNA, 50 bp, homo sapien
ttttcacaaagccctgtaagcaccaytatctcaattaacaaatgaggaaa

SEQ ID NO: 72709 - DNA, 50 bp, homo sapien
tctttaagtaattgctcagtattcayagactaaaaataaaatgccttaaa

SEQ ID NO: 72710 - DNA, 50 bp, homo sapien
aaaagcatccaattctaactttataygcaccagagtgaccaaaccatcat

SEQ ID NO: 72711 - DNA, 50 bp, homo sapien
gacttctgaaaatgtcctgaaatcayaggtatgcaagaaataggcctgcc

SEQ ID NO: 72712 - DNA, 50 bp, homo sapien
atattttcccagtatcttcctttgasagtaatttttatatcatgaccctt

SEQ ID NO: 72713 - DNA, 50 bp, homo sapien
ttttagcatagtccttatcagtgacrgcacatttattctgcaaacagatt

SEQ ID NO: 72714 - DNA, 50 bp, homo sapien
agaaaaagaggattctcttattgatkactctggattccaactctaattcc

SEQ ID NO: 72715 - DNA, 50 bp, homo sapien
taactggagcattttattatgcaaaracatttaattggttttgtttaaac

SEQ ID NO: 72716 - DNA, 50 bp, homo sapien
tctcttatgactgcaagaaaaggaarcgtagtagaaacatgtagctggaa

SEQ ID NO: 72717 - DNA, 50 bp, homo sapien
aaaatattttaaaacaatgacataamagaacaagcattaatcagtgtcta

SEQ ID NO: 72718 - DNA, 50 bp, homo sapien
atgtttgctctagattcttaaggccrctgttcttttcagcatgattttac

SEQ ID NO: 72719 - DNA, 50 bp, homo sapien
ccaacatctagaagaggtttactgaygttatagtatagatttttatggtt

SEQ ID NO: 72720 - DNA, 50 bp, homo sapien
ttcatatgttcctctttctcccaaaygtaaagatcagaaaggcagattaa

SEQ ID NO: 72721 - DNA, 50 bp, homo sapien
atgccagcggcaaaggagaaatacayacacttcctatcatttaagagttt

SEQ ID NO: 72722 - DNA, 50 bp, homo sapien
tggccccacattttagccatggaaakgttaaattattctttacactgctg

SEQ ID NO: 72723 - DNA, 50 bp, homo sapien
ctgctcacccactcatgagaacacasctaaaagaatgtatttaacagtgt

SEQ ID NO: 72724 - DNA, 50 bp, homo sapien
caatgagtgggaaagtttatgcaaayatcagcagctacaatgccagcaca

SEQ ID NO: 72725 - DNA, 50 bp, homo sapien
agatcctggaaggtgctgaagctaawtacttggtgttgatctgaagttag

SEQ ID NO: 72726 - DNA, 50 bp, homo sapien
ctgtgtgccagcaatgtgtatctacraacattatgataaattatcccaac

SEQ ID NO: 72727 - DNA, 50 bp, homo sapien
gtaagccaaaatctttctatgtcaawgtgttttgtaattttcagatcaag

SEQ ID NO: 72728 - DNA, 50 bp, homo sapien
caagcagcgcactggttggtaaagaygaagatatgttacatcagaggagc

SEQ ID NO: 72729 - DNA, 50 bp, homo sapien
atgaagggtaagctaagtaggatacygcaagcccagagtgtgctgcattg

SEQ ID NO: 72730 - DNA, 50 bp, homo sapien
gattaaaagaaatgtcagttcaggtmaagaaaatagctaaagtaacatta

SEQ ID NO: 72731 - DNA, 50 bp, homo sapien
aaaaattatcttttgctttgtcatcrcagcagctgataagtaggagaact

SEQ ID NO: 72732 - DNA, 50 bp, homo sapien
aacaatcctcttccagatatttgacrtggcttcctccttcaccttctttg

SEQ ID NO: 72733 - DNA, 50 bp, homo sapien
caaccctggttctccttctacatatsagtctcggaccctgtaaccagctt

SEQ ID NO: 72734 - DNA, 50 bp, homo sapien
aataaatacataaataagcccattaracatcacgaatttaatgtgaggcc

SEQ ID NO: 72735 - DNA, 50 bp, homo sapien
atgtgcaattcttctcacacatataycaaaaactataaagccacaatcaa

SEQ ID NO: 72736 - DNA, 50 bp, homo sapien
gcaaagacatgccagaaataatatcraccaggattgactctcttttcaaa

SEQ ID NO: 72737 - DNA, 50 bp, homo sapien
gcttgtatactgtgagtctttaaaakgtatgtgtataactaccttttcca

SEQ ID NO: 72738 - DNA, 50 bp, homo sapien
ctgcccattcagacattattttatcrtttctgtcattttcttggtcgctg

SEQ ID NO: 72739 - DNA, 50 bp, homo sapien
taataataacattaataaaccagacyatcctcttttcaatccttaaattt

SEQ ID NO: 72740 - DNA, 50 bp, homo sapien
atgaagtctaccaggagtccatgaarcatttagcagagtggtatactcaa

SEQ ID NO: 72741 - DNA, 50 bp, homo sapien
tttaccagtctaagagggtgatgaargtctaagcatagagcatggcagtg

SEQ ID NO: 72742 - DNA, 50 bp, homo sapien
agagttggctaaaagggtcaggaaartaagcccaggtaaacagaactaat

SEQ ID NO: 72743 - DNA, 50 bp, homo sapien
gtgttccacattagctgagactatawgcatggagttccagtggtgggggg

SEQ ID NO: 72744 - DNA, 50 bp, homo sapien
tctccactgtgaagttgtatttatgsaaataaggaagtatgtatgcactg

SEQ ID NO: 72745 - DNA, 50 bp, homo sapien
cccacagagtcagcagaattccgagmagtgaacgtctacaaaagccaaag

SEQ ID NO: 72746 - DNA, 50 bp, homo sapien
caatgaacgtatgcattttatttcakgtatttgtgataaataccttgaaa

SEQ ID NO: 72747 - DNA, 50 bp, homo sapien
gcgctccagtggcaccagaatcgatragaagtataactaactgaggaaca

SEQ ID NO: 72748 - DNA, 50 bp, homo sapien
tgaactttggctggctggtcacagtrttaagatgtgcattctcaagcaat

SEQ ID NO: 72749 - DNA, 50 bp, homo sapien
gggtcagagagtaaaagaaggggaamtagcttaggaagatagttttgttt

SEQ ID NO: 72750 - DNA, 50 bp, homo sapien
tgtggatgctgttggaatgtgaggaratcatgtccaaaggtaggatctga

SEQ ID NO: 72751 - DNA, 50 bp, homo sapien
gagcaatgtgatggaagggagctaartgtggtccatcaagggacaaggag

SEQ ID NO: 72752 - DNA, 50 bp, homo sapien
tgcagtatggtattgctgaagagtawcatgcaaagtgaggattatgaaga

SEQ ID NO: 72753 - DNA, 50 bp, homo sapien
ttctttgctatgtgtatggtctcaarcagacttttaagaattacgcactt

SEQ ID NO: 72754 - DNA, 50 bp, homo sapien
gttgagcatattgccacaatgaatgmgattgaggttctctcaacaaaaat

SEQ ID NO: 72755 - DNA, 32 bp, homo sapien
aagacactgggagtaamccaagtattcgtcaa

SEQ ID NO: 72756 - DNA, 50 bp, homo sapien
accacaattaaaaaaataataactaygaagatgacgatggtaacaagttt

SEQ ID NO: 72757 - DNA, 50 bp, homo sapien
aattatacctgtaactggccttttayccttgcactcggatttttttcact

SEQ ID NO: 72758 - DNA, 50 bp, homo sapien
accctttcaatgtttttaaactcaaygatccttatatacccaattggttt

SEQ ID NO: 72759 - DNA, 50 bp, homo sapien
cctggcaatcagtaattacctatgtsttttctgcattttctttaccaata

SEQ ID NO: 72760 - DNA, 50 bp, homo sapien
cctaaataatttatgcaaactcatamaataaagtgttggaattgagccaa

SEQ ID NO: 72761 - DNA, 50 bp, homo sapien
tgaagagatgctttcttatataaaargacaagcaacttcatagctaggca

SEQ ID NO: 72762 - DNA, 50 bp, homo sapien
tttaatagcagatatttattgtgtakaagagtccctgtgaaagggagtgc

SEQ ID NO: 72763 - DNA, 50 bp, homo sapien
tgtttagtttgttgatgttttccgakaacttagaacaatatccagcatat

SEQ ID NO: 72764 - DNA, 50 bp, homo sapien
cacagagcagtcacagaccaaatgayggataattaagcattcttggtacc

SEQ ID NO: 72765 - DNA, 50 bp, homo sapien
ttcagaataagatacagcaggatcartattagaaactttagagatgatag

SEQ ID NO: 72766 - DNA, 50 bp, homo sapien
ctctgccctttaaaaggttggatagycattgatttaaagaagttaaaata

SEQ ID NO: 72767 - DNA, 50 bp, homo sapien
aatgtttttaccataacattaagaargcatttttattttatttttggttt

SEQ ID NO: 72768 - DNA, 50 bp, homo sapien
attataaatttgtaaagaagtcaacmaaattataatctggtaggaattat

SEQ ID NO: 72769 - DNA, 50 bp, homo sapien
ttatatccagtttataagacacagastatagtagacacttgggactccac

SEQ ID NO: 72770 - DNA, 50 bp, homo sapien
tgtctttgatcgctagagtttgcacrattaaattatttccactgtgagat

SEQ ID NO: 72771 - DNA, 50 bp, homo sapien
ggatctgcaagccaggactagaaccrtcactagaaacaaaattggctgga

SEQ ID NO: 72772 - DNA, 50 bp, homo sapien
ggctaacagaaattattaagtacacrctcaatactcaatacttgagaatc

SEQ ID NO: 72773 - DNA, 50 bp, homo sapien
agaacatgacgtttcaaatttttcartaatcataactctaaagtaatgtg

SEQ ID NO: 72774 - DNA, 50 bp, homo sapien
gaaatacaaaagtttagaacaaaaakctacggagctaacttaaaagacac

SEQ ID NO: 72775 - DNA, 50 bp, homo sapien
cctatttgtgtttattgttatgataytagttaaaagttctatgtgactgg

SEQ ID NO: 72776 - DNA, 50 bp, homo sapien
aactaagttttgtcatcatttaaaayaattactcgccaaaaatttacctg

SEQ ID NO: 72777 - DNA, 50 bp, homo sapien
caaatgtaataattctatatagaaamaagccttagcaaatttactgccat

SEQ ID NO: 72778 - DNA, 50 bp, homo sapien
gtctcagggtatcagaaggcaggtasaaattctgctgattgggatgccca

SEQ ID NO: 72779 - DNA, 50 bp, homo sapien
agatcctaaagggaaagacaaagacmcatgtattctgaatgctgggttgt

SEQ ID NO: 72780 - DNA, 50 bp, homo sapien
gacctggcgttgacaatttcaaaaartgtatgagttcttaagccatctcg

SEQ ID NO: 72781 - DNA, 50 bp, homo sapien
cagtgtcttgacaatcttttaccagmactttgaatactaaatgattagaa

SEQ ID NO: 72782 - DNA, 50 bp, homo sapien
tctaactgatggttttctgtggttargatgtgctttgaatctactaggcc

SEQ ID NO: 72783 - DNA, 50 bp, homo sapien
gggctctggtggttcagaggttaacrgctatcttcccagaaccttttcag

SEQ ID NO: 72784 - DNA, 50 bp, homo sapien
atagaaggaacactttggctttatasatttggaggcagtgacatgtagag

SEQ ID NO: 72785 - DNA, 50 bp, homo sapien
catacaaaagataaaaactgtacagwatgaatgataaagctagcataatc

SEQ ID NO: 72786 - DNA, 50 bp, homo sapien
aaggtaaaagtgggcaagttaaaaargtttcgtatcagagaagttagttg

SEQ ID NO: 72787 - DNA, 50 bp, homo sapien
ggtacatgctgggctaaagacctgaygaatgagaataagattatggagga

SEQ ID NO: 72788 - DNA, 50 bp, homo sapien
gagatacattattaaataaaacagakggaaatccttgccttggcaaaacg

SEQ ID NO: 72789 - DNA, 50 bp, homo sapien
atctgtccttctaacaagcttcccargagtatgtgtatctaacaaaatca

SEQ ID NO: 72790 - DNA, 50 bp, homo sapien
agaacaaaatcacaatttaccaagcrcagtaggatgagtctagacaagat

SEQ ID NO: 72791 - DNA, 50 bp, homo sapien
aactaagacctgtgcattgcttaaakaatgtgttttctgggtgttttcat

SEQ ID NO: 72792 - DNA, 50 bp, homo sapien
cttttattatagaaattcagggttasagcccttcttttttttctcccact

SEQ ID NO: 72793 - DNA, 50 bp, homo sapien
tttcctctccaaaagaataagaagcraatcaattgtgaagatggagcagg

SEQ ID NO: 72794 - DNA, 50 bp, homo sapien
tgggttgaggacacattcattttgckattagtggggtaccatcacttctg

SEQ ID NO: 72795 - DNA, 50 bp, homo sapien
cctggccaacctcattcattcttacyggagtctttgagttgacctctaag

SEQ ID NO: 72796 - DNA, 50 bp, homo sapien
tcattatttatataggcatttccaaygtagatctgtttgcaatgtttgtc

SEQ ID NO: 72797 - DNA, 50 bp, homo sapien
agagaactgtgtctgacaaggtctargttaatcttttactgggggctgag

SEQ ID NO: 72798 - DNA, 50 bp, homo sapien
ggcagaaagtagttgcagtcaaaatyaggttgtaccacttaatagtattg

SEQ ID NO: 72799 - DNA, 50 bp, homo sapien
aagaagataaatggaaagaatctacrctgggctctgaatatgacatgttt

SEQ ID NO: 72800 - DNA, 50 bp, homo sapien
ctaaagaaaattgaaatcaactgtascttaggaaattcaatatgttgaaa

SEQ ID NO: 72801 - DNA, 50 bp, homo sapien
gctatataactcttaatcaggtaaaygacttttgagttttcagttttctt

SEQ ID NO: 72802 - DNA, 50 bp, homo sapien
gggactgtaccatcaacaaggatccrcagtaggaaagacagccatcaacc

SEQ ID NO: 72803 - DNA, 50 bp, homo sapien
tgaaatccatctcctttcctccagcrattcgtgcaagtctcatgtctaga

SEQ ID NO: 72804 - DNA, 50 bp, homo sapien
cagccagaagacaaattttagagtargcaacggaagctgcagagaacatt

SEQ ID NO: 72805 - DNA, 50 bp, homo sapien
taaacaatttgtttaatgtctaaaaraaggaagatacccttagctggagt

SEQ ID NO: 72806 - DNA, 50 bp, homo sapien
aatgtatgaaaacccattacacatayagaattttcatgagtattatctga

SEQ ID NO: 72807 - DNA, 50 bp, homo sapien
aacaatgaagtaatagttaagaatayaatgcactcataagtttataatga

SEQ ID NO: 72808 - DNA, 50 bp, homo sapien
tgagcagtttcaaagtcgtgtcaacrggaagaatatgaatctccttgtgt

SEQ ID NO: 72809 - DNA, 50 bp, homo sapien
tgcctctgattttcatcaaaataatsacagggggttattaacttttcact

SEQ ID NO: 72810 - DNA, 50 bp, homo sapien
caaccttgttgaactaaagatttcawgatgatctgtggcagtaagtgaag

SEQ ID NO: 72811 - DNA, 50 bp, homo sapien
atgttttcagcttctgtctttgcttyaagatctgattaaaaggaacctta

SEQ ID NO: 72812 - DNA, 50 bp, homo sapien
cttgagacagcaatgaagggatgaargaatgaatgagtttatatttcaat

SEQ ID NO: 72813 - DNA, 50 bp, homo sapien
aaatgttgactatttgcaatggaacygaaagtgaaaatacacaaggagga

SEQ ID NO: 72814 - DNA, 50 bp, homo sapien
tcgttcgatgaaaaaaaggacttctsacatcataagcatgaatccagact

SEQ ID NO: 72815 - DNA, 50 bp, homo sapien
ctgggatagttgttctttttgttgayattattattcagatgtattactct

SEQ ID NO: 72816 - DNA, 50 bp, homo sapien
tggtagttctgtatcccaagccaaaytcaaaatccgaaattatctgttac

SEQ ID NO: 72817 - DNA, 50 bp, homo sapien
caagacgctactccagctttgcttayagggcctaagaaagaaagggcaat

SEQ ID NO: 72818 - DNA, 50 bp, homo sapien
accatcaaataaaaattgcatattawctttatacagtggttcttcccaaa

SEQ ID NO: 72819 - DNA, 50 bp, homo sapien
ttcccactattgtaattgtattaagwctggaattatggaccatagctatc

SEQ ID NO: 72820 - DNA, 50 bp, homo sapien
ataagcatccgaacatgatggtagcyaaatatgccgcaaactagtcaaga

SEQ ID NO: 72821 - DNA, 50 bp, homo sapien
gggtgaagggaataatagacagcagkagtgattcccaagctgaggtagca

SEQ ID NO: 72822 - DNA, 50 bp, homo sapien
taacctactgaaaaccttcctcttcrctcagtttgtataataatgcatgt

SEQ ID NO: 72823 - DNA, 50 bp, homo sapien
ttcaaggcttatctctgggaatgcayggcttttaaaaatgtaaatctttc

SEQ ID NO: 72824 - DNA, 50 bp, homo sapien
accatctctggctggccctggaatgrcattacagttttctgacacaatgc

SEQ ID NO: 72825 - DNA, 50 bp, homo sapien
aagcgatcctcccatctaagtgtctsaaagtgttgggataataggtgtga

SEQ ID NO: 72826 - DNA, 50 bp, homo sapien
tgaagggcggcaatttgtgttttcckctaggttgctttgggagctggaca

SEQ ID NO: 72827 - DNA, 50 bp, homo sapien
attaaagtctgtcaacaaacctggayggactcttgtcaccaaccattatc

SEQ ID NO: 72828 - DNA, 50 bp, homo sapien
taggccctaagtgtaatcacagggtycctataagagaagactaggaaggt

SEQ ID NO: 72829 - DNA, 50 bp, homo sapien
gaaaaggcaactgttttccaacagakggctttcaaaccattatgaaattt

SEQ ID NO: 72830 - DNA, 50 bp, homo sapien
ataatttttcaagaagagtctcacaytttctttcagggtatagctattag

SEQ ID NO: 72831 - DNA, 50 bp, homo sapien
gccacctcctaatggactaatatgcrccccactacaagctcagcaatttg

SEQ ID NO: 72832 - DNA, 50 bp, homo sapien
aatagggttcaaattatttttgcackgcttctttcaaatctaatgtgtat

SEQ ID NO: 72833 - DNA, 50 bp, homo sapien
gtgatacagcttcctaatccactgaraatacaaaccaagactggcaatac

SEQ ID NO: 72834 - DNA, 50 bp, homo sapien
atttctgtacacaaatctgaatttawtccatatgagcacggtgtgcgact

SEQ ID NO: 72835 - DNA, 50 bp, homo sapien
ttgccattctctaatgatgtcccacwattcttagagtaacatctcaaaat

SEQ ID NO: 72836 - DNA, 50 bp, homo sapien
aggagacactaaatattttgctaagragggcaaattgtcttgagtgagtt

SEQ ID NO: 72837 - DNA, 50 bp, homo sapien
attttggatcttccagtaatgtccamgtaatcaacatgagaccaggtgaa

SEQ ID NO: 72838 - DNA, 50 bp, homo sapien
gggacaggttggagggtccagccatktcatcgaatcgtctttgtgggcga

SEQ ID NO: 72839 - DNA, 50 bp, homo sapien
tgcaccaatgaggcagtcaagcttarcaagatgtatatgtgtatgtgtct

SEQ ID NO: 72840 - DNA, 50 bp, homo sapien
tttctccatttttttctagtaaaaaytgtgatccagggagatgttccgtt

SEQ ID NO: 72841 - DNA, 50 bp, homo sapien
gattaatttaacacgacatagtagamatttttaaaaacaacaaattgaaa

SEQ ID NO: 72842 - DNA, 50 bp, homo sapien
tatagcaatccttagcatgtgcaaaygattttaaatttctagaattttaa

SEQ ID NO: 72843 - DNA, 50 bp, homo sapien
gattgattaagggtgatgttatgaaytgcctttctaaaattttaagcctt

SEQ ID NO: 72844 - DNA, 50 bp, homo sapien
acttggattcataggtatcgtatctstgaatgccgcctcttttcttctcc

SEQ ID NO: 72845 - DNA, 50 bp, homo sapien
taacatattcagctaaaacactacgmagaatgattcacttctcctttcgg

SEQ ID NO: 72846 - DNA, 50 bp, homo sapien
cctcttaagtgcaaagatcacccaasacagctgagttctgctccaatctc

SEQ ID NO: 72847 - DNA, 50 bp, homo sapien
agcataacatttggtatttgtcaaartctgactcttaaccagctggtggc

SEQ ID NO: 72848 - DNA, 50 bp, homo sapien
actgccctggaagcagatttctcaaratgtggtgtgaggaccatcggctg

SEQ ID NO: 72849 - DNA, 50 bp, homo sapien
gtcttcaaatatgaaacattttcagyaagttcattagttgggttcatatc

SEQ ID NO: 72850 - DNA, 50 bp, homo sapien
ttttcccttcaactattttagcacakggagttcacaactcattccagcta

SEQ ID NO: 72851 - DNA, 50 bp, homo sapien
gtagatatttttattttcactcagcragataaagggggaggtgattgact

SEQ ID NO: 72852 - DNA, 50 bp, homo sapien
tttgaactttgttcatccctaatacyactctaatggaaaatcaggattac

SEQ ID NO: 72853 - DNA, 50 bp, homo sapien
tacagaagccacaggactccagtacmggtgagaaaatgagacagtattgg

SEQ ID NO: 72854 - DNA, 50 bp, homo sapien
taggagaagtcttgaaaatgttcatsaggtaaatagattttagagaacaa

SEQ ID NO: 72855 - DNA, 50 bp, homo sapien
gattgatgtctttataagaagagaaratccatagacacccagggagaagg

SEQ ID NO: 72856 - DNA, 50 bp, homo sapien
aacagttatttttgagtaaattacayctatgcctattggatcaactcatg

SEQ ID NO: 72857 - DNA, 50 bp, homo sapien
taaaagtcagtaacatttctctttayaattatcacctaaatcaatcaagg

SEQ ID NO: 72858 - DNA, 50 bp, homo sapien
gtctgggaaagggtgattgagagaakgctggatacactggagagggaatt

SEQ ID NO: 72859 - DNA, 50 bp, homo sapien
cagcagcttaactcttttcttaacawatggaagacttgaaattttatttt

SEQ ID NO: 72860 - DNA, 50 bp, homo sapien
tgctttcgcatattggtcaatcttcycattaatctcttgcctctctattc

SEQ ID NO: 72861 - DNA, 50 bp, homo sapien
gtctctccatagagatgttgctttcrcatattggtcaatcttctcattaa

SEQ ID NO: 72862 - DNA, 50 bp, homo sapien
accctctcggaaaatggaaaatccckaaggagtctacatcattcctctgc

SEQ ID NO: 72863 - DNA, 50 bp, homo sapien
atatcctcatcatgtctttcccagayagaacgttcactatagtccaccca

SEQ ID NO: 72864 - DNA, 50 bp, homo sapien
gccaggtgaaattcgaagtctgattrtcctgagcaggttcctgaggaaaa

SEQ ID NO: 72865 - DNA, 50 bp, homo sapien
tagcggcagtttatttgcaagatagraatggaacatctagaattaagtgg

SEQ ID NO: 72866 - DNA, 50 bp, homo sapien
tcttacctgcattatagcttatgccracggtatgtctccttgaggtcata

SEQ ID NO: 72867 - DNA, 50 bp, homo sapien
tgaagagaaaaaagtaattttcctawatcagacagcctgttaatgagaga

SEQ ID NO: 72868 - DNA, 50 bp, homo sapien
atacaaaatagtcgctggatgaaaayctgtaaaataaatgaatctggctg

SEQ ID NO: 72869 - DNA, 50 bp, homo sapien
gacaaggaataccaagtcactattayagagccaatccagatgaggcaagg

SEQ ID NO: 72870 - DNA, 50 bp, homo sapien
tatacaatgaacttaaattttgtaaytgaaaagacaagcatacagacata

SEQ ID NO: 72871 - DNA, 50 bp, homo sapien
ttagcgcatgtcaattcttgtcctcrtacacttttgaattactttgacaa

SEQ ID NO: 72872 - DNA, 50 bp, homo sapien
ccctagctactgctgcctggttctawcaccaacgttttaaatactggtat

SEQ ID NO: 72873 - DNA, 50 bp, homo sapien
attaaatgatttctttgatatcatgytggcattaactaggctgagtctac

SEQ ID NO: 72874 - DNA, 50 bp, homo sapien
ttttcagcatacttacacccgatacyaatttccttaacttggacctccgt

SEQ ID NO: 72875 - DNA, 50 bp, homo sapien
ccaggcccaagtctctctcatgtgamcaaacagatattgcaagactgtag

SEQ ID NO: 72876 - DNA, 50 bp, homo sapien
agttgtatggtgtttacttacaccargagaagggtatgtgtgtgttaaga

SEQ ID NO: 72877 - DNA, 50 bp, homo sapien
ttcatacctttgagcttcctacttarcatttgtcttaattattatatatg

SEQ ID NO: 72878 - DNA, 50 bp, homo sapien
gagaggaaaaaaaggagtaagtgackaatgcaactgaagtatccttcatg

SEQ ID NO: 72879 - DNA, 50 bp, homo sapien
gaaagtacatttcaacttttctcatyaacttagtgtattgaatcaacctt

SEQ ID NO: 72880 - DNA, 50 bp, homo sapien
tataaattgaattatgagattatatwactgaacttcatttattcataaga

SEQ ID NO: 72881 - DNA, 50 bp, homo sapien
agtattctttaataacaaactactakaacacaggacagataaatgagtgt

SEQ ID NO: 72882 - DNA, 50 bp, homo sapien
agtgtaaagacaaaggaaaaagataraacagtatgagagtaatttgatct

SEQ ID NO: 72883 - DNA, 50 bp, homo sapien
ggacctaatggaaatcctttgactgractggaaaacatgcttgtcaccag

SEQ ID NO: 72884 - DNA, 50 bp, homo sapien
aattagtttctttctttcattgtttmaaaatgcacacattccccaaagta

SEQ ID NO: 72885 - DNA, 50 bp, homo sapien
aagctgatacaaatgaatagggagtraatcacaatagatgtaattctaga

SEQ ID NO: 72886 - DNA, 50 bp, homo sapien
atgtaccctgttacttaatcaaacayggatctagttgttttgtaaatgtg

SEQ ID NO: 72887 - DNA, 50 bp, homo sapien
atgaacagaatgtgttaggttcagaragttgattcaaaggctatatggct

SEQ ID NO: 72888 - DNA, 50 bp, homo sapien
atcccgatgtcaagttgaccacaaawtcctgcccatggtctctgacctct

SEQ ID NO: 72889 - DNA, 50 bp, homo sapien
ggaccaaaatcagcattttgaatgargttgaatatgagaagctaagacac

SEQ ID NO: 72890 - DNA, 50 bp, homo sapien
attacttccctctatagatttccaaygaatttatgctagtatttaaattt

SEQ ID NO: 72891 - DNA, 50 bp, homo sapien
tgtttatgtctaactgagatttgatkaaaggattttactaagagctttcc

SEQ ID NO: 72892 - DNA, 50 bp, homo sapien
tacaccctcctgtaacgtaaattcaygtggaacacttaaattattccaaa

SEQ ID NO: 72893 - DNA, 50 bp, homo sapien
aaattgcaactcctttctcttttatmactatgaactaaccagtatggcaa

SEQ ID NO: 72894 - DNA, 50 bp, homo sapien
gccgggcagctcagatgcctgcttaycattttaatctatcaggtaattcc

SEQ ID NO: 72895 - DNA, 50 bp, homo sapien
ctgatgccaaatatttgcgataatakgtttaataaatgtttattgaactt

SEQ ID NO: 72896 - DNA, 50 bp, homo sapien
tccactctcttctgaaaaagtcatcsggtcctttgtcactaagagcaggc

SEQ ID NO: 72897 - DNA, 50 bp, homo sapien
tatgacagacccacagtgagtatcayactgaatagttaaaatctgaaagc

SEQ ID NO: 72898 - DNA, 50 bp, homo sapien
accatagctaacctagaaaataaacygaatgtttgtgggtagatgtcttt

SEQ ID NO: 72899 - DNA, 50 bp, homo sapien
atggtataaaattattaaggcccaarttcatgaggaaggtacttatttat

SEQ ID NO: 72900 - DNA, 50 bp, homo sapien
ttctccaattctgttcaatagtaaayggctaaaatggaccttatttgagt

SEQ ID NO: 72901 - DNA, 50 bp, homo sapien
atgtatggcaactggtctctcttccrgcataaagttattataatgtacaa

SEQ ID NO: 72902 - DNA, 50 bp, homo sapien
tgtttcatatccactaaatttgctgsaagttcagtctcaataaatccttc

SEQ ID NO: 72903 - DNA, 50 bp, homo sapien
gggaaaattccccatctactcttcgkatgctcatcattatcctctactaa

SEQ ID NO: 72904 - DNA, 50 bp, homo sapien
ttatagcaggacccattaacttaccrcagacataggggtagagctgatat

SEQ ID NO: 72905 - DNA, 50 bp, homo sapien
aaacccatcctaagttgaaaatatgrtcaatccaagatgcatttaataca

SEQ ID NO: 72906 - DNA, 50 bp, homo sapien
cctgtccttcatttaataaagttcarctatcgcaaatggaatcaaccacc

SEQ ID NO: 72907 - DNA, 50 bp, homo sapien
ctgttggagagacttgacaattaaakgtgatgagagaagagtattatgta

SEQ ID NO: 72908 - DNA, 50 bp, homo sapien
ctgtaatcccttaagaagcatgttcragaaataatttaggttcccacata

SEQ ID NO: 72909 - DNA, 50 bp, homo sapien
ggtaagcaatagccacttctgttacratatgtgttttaaactgacattct

SEQ ID NO: 72910 - DNA, 50 bp, homo sapien
tatatgaaaggaagcttgttaatgamatggaagactctgaggtcagagaa

SEQ ID NO: 72911 - DNA, 50 bp, homo sapien
aattccatctctacagtatttttgayagatgccaactgattgactcatta

SEQ ID NO: 72912 - DNA, 50 bp, homo sapien
actcttactaaccgatttttaacccrcgctgagtcttccatgtatcttag

SEQ ID NO: 72913 - DNA, 50 bp, homo sapien
aattgaaatggctgctctgacacacrctacaaagttggaacctgatgcaa

SEQ ID NO: 72914 - DNA, 50 bp, homo sapien
aatgttgataaaggtgacatcataasttagacacactgttatttcctagt

SEQ ID NO: 72915 - DNA, 50 bp, homo sapien
aagatgattttgcttatatgctgagragacatcatgttaggagtgattac

SEQ ID NO: 72916 - DNA, 50 bp, homo sapien
tgtcatcaatttgctctaaggactawgtctgaaaaaacttattgtgtgtc

SEQ ID NO: 72917 - DNA, 50 bp, homo sapien
atcatgttaatggtaaaatttttaaygtcaagagcagtataaaacaggtc

SEQ ID NO: 72918 - DNA, 50 bp, homo sapien
ctaactttaagtgtgtgatccccaawtatcattgttgtcttttcaaaagt

SEQ ID NO: 72919 - DNA, 50 bp, homo sapien
taatattaggtaatgtaaatgatgayaaatgagagatagcttatacccag

SEQ ID NO: 72920 - DNA, 50 bp, homo sapien
cttttaaatagccaaatattacaaamcaaccaaaatcagattcaataaat

SEQ ID NO: 72921 - DNA, 50 bp, homo sapien
atcaagtgagacctcctcaagcaaayggagagacccactcatcttagtgc

SEQ ID NO: 72922 - DNA, 50 bp, homo sapien
aataacaaaacattgggaagatataratgggataatggtaaaaatacgtg

SEQ ID NO: 72923 - DNA, 50 bp, homo sapien
ttatcacaaaacttcctcaaaagcartgaagttagaggagctagaggtaa

SEQ ID NO: 72924 - DNA, 50 bp, homo sapien
attgatcaacttaaattcttcagtgsagtggtatgtaatgtgatttctga

SEQ ID NO: 72925 - DNA, 50 bp, homo sapien
atagaaaaaaagataaaagctacctmtaaagttcaatatcctaaagaaca

SEQ ID NO: 72926 - DNA, 50 bp, homo sapien
tcaggaagcaccatggttcaacctcratattttggaactttgaagtttct

SEQ ID NO: 72927 - DNA, 50 bp, homo sapien
catctatacttacaaagaaacaataraatgaacacaagacttcctcttct

SEQ ID NO: 72928 - DNA, 50 bp, homo sapien
atcaatgttctctgtttgtaatacasatatggtgagattatttctacaga

SEQ ID NO: 72929 - DNA, 50 bp, homo sapien
tgcaatattttagctgataagctaayaagaatcaacatttactaatctag

SEQ ID NO: 72930 - DNA, 50 bp, homo sapien
gagatgctgatgcgtccttagaaackgtgtctcttctggtgttcagggga

SEQ ID NO: 72931 - DNA, 50 bp, homo sapien
atagataggaattggggacatttaaygggagcagaaagaagtcttctagg

SEQ ID NO: 72932 - DNA, 50 bp, homo sapien
ttcctgatgattccaaaagcattaaytcacctttcagaacacactgtggc

SEQ ID NO: 72933 - DNA, 50 bp, homo sapien
gaagagcccttgggccttaagggaayattgtttgtaggctggcagtactc

SEQ ID NO: 72934 - DNA, 50 bp, homo sapien
ggcacaggcagagtgtgacatgctaraacatactgaaatgtaagtggcaa

SEQ ID NO: 72935 - DNA, 50 bp, homo sapien
ctcgagatctgatggttttatattcrcttcattctcattatcacttgtct

SEQ ID NO: 72936 - DNA, 50 bp, homo sapien
cacaaggttgaggggataccacagaraggctcccactgtgatttgcattt

SEQ ID NO: 72937 - DNA, 50 bp, homo sapien
tgaccacatacaaagtctgcaattarcaacatccaattaaataaaactta

SEQ ID NO: 72938 - DNA, 50 bp, homo sapien
aatgaggtcttgcttcctaggttacyaaagacattgtgtctaatgtttct

SEQ ID NO: 72939 - DNA, 50 bp, homo sapien
atcctgggctctgcaagtctgtagaycagtggatgaagaaacaaaaaagg

SEQ ID NO: 72940 - DNA, 50 bp, homo sapien
tgtcaagacataaaactggtccacaraactgggataattatcctcatgat

SEQ ID NO: 72941 - DNA, 50 bp, homo sapien
agtacaacgacctgatttggaaaagkcagtgatagcttacttaagatcat

SEQ ID NO: 72942 - DNA, 50 bp, homo sapien
aattacaggtgtgagtcaccacaacygatagatatgcaggttttcctatt

SEQ ID NO: 72943 - DNA, 50 bp, homo sapien
tactaaagagaattccattttgaatyggtgctactttgaatttcttacat

SEQ ID NO: 72944 - DNA, 50 bp, homo sapien
gaaacagccatatacaccaagacacmatatgaacaaatacgtagccttta

SEQ ID NO: 72945 - DNA, 50 bp, homo sapien
cattcttttgagtagacaaattagamagttttaggaatggaatctaccac

SEQ ID NO: 72946 - DNA, 50 bp, homo sapien
aggttttatgaagttcttctatggcyggcatgactcagcaagaaagagtc

SEQ ID NO: 72947 - DNA, 50 bp, homo sapien
tagaagagttacctagaaacaaaacyatggatggcctctgttacagactg

SEQ ID NO: 72948 - DNA, 50 bp, homo sapien
attcattattttttaaattattctcrctgataacatggataggaatcaga

SEQ ID NO: 72949 - DNA, 50 bp, homo sapien
gggtgataagactatgaagttacatwaaaaaatgatgggaacacaattta

SEQ ID NO: 72950 - DNA, 50 bp, homo sapien
caattcttaggctctgggtagtttcmcattaaactgatgtgaccgtggct

SEQ ID NO: 72951 - DNA, 50 bp, homo sapien
ctagagactcagttaacacagctggraaatatttgaatattgtgttatca

SEQ ID NO: 72952 - DNA, 50 bp, homo sapien
ataaagcaaccccaaattcatgtaasagatactggttattaaaattcaac

SEQ ID NO: 72953 - DNA, 50 bp, homo sapien
ggattaccccaaatgaacaaatacartcttttaaaagtgatcactttgca

SEQ ID NO: 72954 - DNA, 50 bp, homo sapien
cggggatcataagaagaaaacatatyaagccgctgctcgggccacacatt

SEQ ID NO: 72955 - DNA, 50 bp, homo sapien
aagctaatgttaatacttctgaataragagattaaaaacaatatctgaag

SEQ ID NO: 72956 - DNA, 50 bp, homo sapien
caatggcaattataacaaaaaggtgractcgatgggataatatccaggaa

SEQ ID NO: 72957 - DNA, 50 bp, homo sapien
tggtgaaagcaccctgggaatcaagrcctctctgactcttaagcctatgc

SEQ ID NO: 72958 - DNA, 50 bp, homo sapien
gaatattctgtgtactaacaggattyaagggatggaagaacaaagcagaa

SEQ ID NO: 72959 - DNA, 50 bp, homo sapien
catcaacatatgattgctgtgtattyaacaacaaaactggaacaggaatc

SEQ ID NO: 72960 - DNA, 50 bp, homo sapien
aaagtaatggagacatagaaataatraaagcattgtgaaattcagtgatc

SEQ ID NO: 72961 - DNA, 50 bp, homo sapien
ttattactcttcttccattgaaatcraacagccaaattccacagtgcttc

SEQ ID NO: 72962 - DNA, 50 bp, homo sapien
ttatttctttaatttcaaatattcaygatgaacaataataggacattcta

SEQ ID NO: 72963 - DNA, 50 bp, homo sapien
ggataaaaacatgggaatgaagtgawtaattatggccagaggttgaactg

SEQ ID NO: 72964 - DNA, 50 bp, homo sapien
cttgtaattgagaatctataatataygcccaattatctagtgagaagaac

SEQ ID NO: 72965 - DNA, 50 bp, homo sapien
gtcaaatttatgcaggagattacaayaatagctacagtacctagttcatc

SEQ ID NO: 72966 - DNA, 50 bp, homo sapien
ctgagaaaatgatggtactataaacrggaagagaaatatcttgcaataat

SEQ ID NO: 72967 - DNA, 50 bp, homo sapien
ttaaatgttgaacaaacaggtatgartaacctcaaaaataatactttaaa

SEQ ID NO: 72968 - DNA, 50 bp, homo sapien
agcacagtctaattcttattgccgascattggatgggtttaatcttgact

SEQ ID NO: 72969 - DNA, 50 bp, homo sapien
gaaggggaaaaaggagacagctatgraccatttcttaaaacctgacttca

SEQ ID NO: 72970 - DNA, 50 bp, homo sapien
atgagtactaagatgattctgagtamgagtcctaattaatgccaccaaaa

SEQ ID NO: 72971 - DNA, 50 bp, homo sapien
ccccaaactcaacaacacaatactgyatgcatttccaattctttatatag

SEQ ID NO: 72972 - DNA, 50 bp, homo sapien
ctgtggggtaagtcaggcatcaagtyaatgtgtgttgaatgaaatatttt

SEQ ID NO: 72973 - DNA, 50 bp, homo sapien
gctccaaagttagtgtctgtgagtaraacaagcaggaaacaaaacataac

SEQ ID NO: 72974 - DNA, 50 bp, homo sapien
ctgacattgtgtctagttgttcccargaaatctaaatatataggcttgat

SEQ ID NO: 72975 - DNA, 50 bp, homo sapien
tgggggtgtgattcttcattttataygtcggcttgcctgggccatggatt

SEQ ID NO: 72976 - DNA, 50 bp, homo sapien
tgagcttgaatgtatgtgtggttgaycctaaaatattttgatgagtattc

SEQ ID NO: 72977 - DNA, 50 bp, homo sapien
attatttctgattgtgcttatttgartgttctctccctttttcttggtta

SEQ ID NO: 72978 - DNA, 50 bp, homo sapien
tatgctaaatgacatacatctataargccagcagtagaaagacaaattaa

SEQ ID NO: 72979 - DNA, 50 bp, homo sapien
gctaaattgtattaatatgatacaasagataagatgaaattctaaaataa

SEQ ID NO: 72980 - DNA, 50 bp, homo sapien
tcttatttatcagagtgtgtaaatgyagttatgcaagaatcacgttcatt

SEQ ID NO: 72981 - DNA, 50 bp, homo sapien
gtgtcatactaacaccaaataaccayaacgataacaacagcaatggtatt

SEQ ID NO: 72982 - DNA, 50 bp, homo sapien
actttactgtagtcactgcagattasaaccacacgcagtaacgtggatat

SEQ ID NO: 72983 - DNA, 50 bp, homo sapien
gaaaaattggagtaaacagaaaatayagagtatcagtaagagttattatt

SEQ ID NO: 72984 - DNA, 50 bp, homo sapien
aaaggaataacgtaattgtaaatatrggattaaagtgcaagtcccaattt

SEQ ID NO: 72985 - DNA, 50 bp, homo sapien
acagatagctgtgtaaatcaaggaaktagcagaaaaaaaatgtatacaat

SEQ ID NO: 72986 - DNA, 50 bp, homo sapien
ttgtgttccattaattgtaaattcarggaagattctagcattagtcatgt

SEQ ID NO: 72987 - DNA, 50 bp, homo sapien
acttgaaagacaaaagcgtttcctgraagtaggaggaatacatgagatgt

SEQ ID NO: 72988 - DNA, 50 bp, homo sapien
taaaatactttttaaaaattctaacygctagaccactagagaaaaatact

SEQ ID NO: 72989 - DNA, 50 bp, homo sapien
ttctaccatattctatcagttacacmctgtcatggagcaggctcttatgc

SEQ ID NO: 72990 - DNA, 50 bp, homo sapien
atatcaaattattatttttccttcakatgactatccacttttccaatttg

SEQ ID NO: 72991 - DNA, 50 bp, homo sapien
taagtgaccatttgaccttgagaaawtaaatcttcatgccatcagtttca

SEQ ID NO: 72992 - DNA, 50 bp, homo sapien
aggctacctaataaaaggatgaaacrgatgcaaattccgagaagtgtgca

SEQ ID NO: 72993 - DNA, 50 bp, homo sapien
aaacattcagaatgtgtactgacagscgtttacagatgtaatgaaaattt

SEQ ID NO: 72994 - DNA, 50 bp, homo sapien
atgatgattagttgatatttcagttraggttctcttggcacattgcatag

SEQ ID NO: 72995 - DNA, 50 bp, homo sapien
agtaaattggatgaagctgggaatawctgttcgttctgtataatcaagga

SEQ ID NO: 72996 - DNA, 50 bp, homo sapien
ccttgagttatagacacacaggcacsaagtatagagtttcacccaataga

SEQ ID NO: 72997 - DNA, 50 bp, homo sapien
tgaacagcgattatttaaaagcagayggaacgaaattgatctagaggtgg

SEQ ID NO: 72998 - DNA, 50 bp, homo sapien
tgtattgatgcttcagtggaatatgyatgtatatagacaaattttggctt

SEQ ID NO: 72999 - DNA, 50 bp, homo sapien
tgtcatcagatttgttcaacagaaargatgttaatattgctcaccattga

SEQ ID NO: 73000 - DNA, 50 bp, homo sapien
atttattgatctcttaccttatgcaraatactatctgtggcactgtagag

SEQ ID NO: 73001 - DNA, 50 bp, homo sapien
gaatataagaaaaattataaagtaargccaagaattgatctgaacacaaa

SEQ ID NO: 73002 - DNA, 50 bp, homo sapien
agcaactttatataaaatgtggttamgttcagctaaaactggaaataaat

SEQ ID NO: 73003 - DNA, 50 bp, homo sapien
ccagtgtacaaatctacagcaagcaraaaaggatacttggtgcagtttgc

SEQ ID NO: 73004 - DNA, 50 bp, homo sapien
tctatttacaaaaagacattctaaarggcagtttatttttcttacagctt

SEQ ID NO: 73005 - DNA, 50 bp, homo sapien
gtccatagtgaatactcagtaaataygtaatgattattataattatcgct

SEQ ID NO: 73006 - DNA, 50 bp, homo sapien
gggaagatacaagttcagaaaaaaayctgaggagagaataagtttacacc

SEQ ID NO: 73007 - DNA, 50 bp, homo sapien
aatttgagtgatgagattagctgcayggctgaggagattgctaatgattt

SEQ ID NO: 73008 - DNA, 50 bp, homo sapien
ttttaaaatgcaattaaggcctaaargattataagaatttgtgaccttgg

SEQ ID NO: 73009 - DNA, 50 bp, homo sapien
cattttggactagcagaagcatctcraatccggacatacagagtcacagg

SEQ ID NO: 73010 - DNA, 50 bp, homo sapien
gccgcttgcactaattaaatggtagmccttgcagtgttcctctccttatc

SEQ ID NO: 73011 - DNA, 50 bp, homo sapien
gtgcatcttcaattatatgtgataaragatcaattttgttttgtttccaa

SEQ ID NO: 73012 - DNA, 50 bp, homo sapien
attggatgggaacaataaaaatgtakcaaagcaagcataaataataagca

SEQ ID NO: 73013 - DNA, 50 bp, homo sapien
tctattgtcaaaaatgtcactgtgargctcttggttgcaccatcatctgc

SEQ ID NO: 73014 - DNA, 50 bp, homo sapien
aaatgatgtgactatttttggacttyaacttcctcatctattgtcaaaaa

SEQ ID NO: 73015 - DNA, 50 bp, homo sapien
aatcacagaaaaagtactgttggtargttcacagggatatacagaatagg

SEQ ID NO: 73016 - DNA, 50 bp, homo sapien
tattacaaagaattggcttacataaygtggcaaggtgtgtatgcaagtct

SEQ ID NO: 73017 - DNA, 50 bp, homo sapien
cctctacctcctagaagccatgctgracgtggggcatctagaagtaactt

SEQ ID NO: 73018 - DNA, 50 bp, homo sapien
tgatgataaaattataatttatataygcatgtgacaacaattgaatccaa

SEQ ID NO: 73019 - DNA, 50 bp, homo sapien
aaaagccacagtggatatattaaatragagtgtggtttaagaatgaaggc

SEQ ID NO: 73020 - DNA, 50 bp, homo sapien
aataattgattacgaatttgtagcaytatctgactttattttaaaatgca

SEQ ID NO: 73021 - DNA, 50 bp, homo sapien
tttggaacaaggaattaggcaagaayatattgtaggtatgattgtgtgaa

SEQ ID NO: 73022 - DNA, 50 bp, homo sapien
atctttagtggccaagggcacttctsacccatttaaacactccagctaag

SEQ ID NO: 73023 - DNA, 50 bp, homo sapien
agctcatgttttttactcttaaaaakttacataatgatctttgccttgca

SEQ ID NO: 73024 - DNA, 50 bp, homo sapien
gtcattttgtaccttcatttaaataratatctgcaatcatataatttttc

SEQ ID NO: 73025 - DNA, 50 bp, homo sapien
ggcctaaggttaagcatatcagtccratacctaatttgagaaaaattcca

SEQ ID NO: 73026 - DNA, 50 bp, homo sapien
ctttaagatctagaaagagatttcaygtctacgaacacagtgaattaaaa

SEQ ID NO: 73027 - DNA, 50 bp, homo sapien
ggcattttattgattacctatatatwaattgaagacatattttaggccca

SEQ ID NO: 73028 - DNA, 50 bp, homo sapien
atatgactttagtgaccatttgaagkctcattaggtggcattgtctgagg

SEQ ID NO: 73029 - DNA, 50 bp, homo sapien
tataaaattgcatatcccttaaacayctatcaagttgtttcatgtgaaaa

SEQ ID NO: 73030 - DNA, 50 bp, homo sapien
ggtgtttaagggatatgcaattttayaataccacgacaaaacaaacttct

SEQ ID NO: 73031 - DNA, 50 bp, homo sapien
ataaaatactctttagtcttcctaayaaccccataaatcaggttagccag

SEQ ID NO: 73032 - DNA, 50 bp, homo sapien
ccttccacaatactctcaagaaaacrccggccgggcacggtgcctcatgc

SEQ ID NO: 73033 - DNA, 50 bp, homo sapien
aaatgacttgaataattttaagtgcmacagggataccccatgttttaaga

SEQ ID NO: 73034 - DNA, 50 bp, homo sapien
ttggtgttgaaatgataaggcagaarctatacttttattttatagataat

SEQ ID NO: 73035 - DNA, 50 bp, homo sapien
ctcagaagccattttttaattttggyatcgttcggcatgtggagagttga

SEQ ID NO: 73036 - DNA, 50 bp, homo sapien
cttgcaatgcaggggcacactaaacrtaagcaatagtaattcatccattt

SEQ ID NO: 73037 - DNA, 50 bp, homo sapien
gaagtagttttttaagatgtccctaygtaaaatccccacagagaaaatgg

SEQ ID NO: 73038 - DNA, 50 bp, homo sapien
ttaatatagataaatctatgaataawatacactttctatttatttgggga

SEQ ID NO: 73039 - DNA, 50 bp, homo sapien
aacaacaactcctgaatccctcatawtatctgtactgcaaataaaacgga

SEQ ID NO: 73040 - DNA, 50 bp, homo sapien
tgtgaagccttaagtatagaaagctsagaagctgtattcttctactgagt

SEQ ID NO: 73041 - DNA, 50 bp, homo sapien
cacattaaacactaagctgatactcmaagatatgaattcatcttaaaaca

SEQ ID NO: 73042 - DNA, 50 bp, homo sapien
gcctagtaggtattgtgagaaatacraagaagatgtgccaagagaaaata

SEQ ID NO: 73043 - DNA, 50 bp, homo sapien
ataaaaacaaaaacaaaaatgatgamgatgcggcgctgacatgaacaagt

SEQ ID NO: 73044 - DNA, 50 bp, homo sapien
tcacatttcatgcaaggaattttaasattaatacttgtaaacaccactta

SEQ ID NO: 73045 - DNA, 50 bp, homo sapien
aaaatctacttcataggttttcaaargagcattcttctgagcaaatctga

SEQ ID NO: 73046 - DNA, 50 bp, homo sapien
atataatagatctactctatccttargtttacttcttgcatgttatagct

SEQ ID NO: 73047 - DNA, 50 bp, homo sapien
tcttaaactagtatgtgtgtatagamgttcactatgaaacactctaattg

SEQ ID NO: 73048 - DNA, 50 bp, homo sapien
actccactaatatatctcagggactyagtagtttaaagataatgaactta

SEQ ID NO: 73049 - DNA, 50 bp, homo sapien
gagtggcactctcagataattcgagrcaccaaaagagggagtctatttac

SEQ ID NO: 73050 - DNA, 50 bp, homo sapien
tttaaaaattctggatggtattcaamaggaaaagacttcagaacatattc

SEQ ID NO: 73051 - DNA, 50 bp, homo sapien
aattgcattttacattccataacatyttaatggttgggctggccatgaca

SEQ ID NO: 73052 - DNA, 50 bp, homo sapien
agttaattgagatcaaacatttataytcaacttgcctgttttaagcatgg

SEQ ID NO: 73053 - DNA, 50 bp, homo sapien
tacaactgaaaccaggttaaagataycctgagaccatggctgtttacaga

SEQ ID NO: 73054 - DNA, 50 bp, homo sapien
cattgtaactggaatatcaaactcargcaatattgaatcctgcttttaaa

SEQ ID NO: 73055 - DNA, 50 bp, homo sapien
tccctttgaccatggaaacccaggasgacaaactcagtcacaaaatgcat

SEQ ID NO: 73056 - DNA, 50 bp, homo sapien
tgtttcacttcaaattttctataacmctgagtctcagtaatgtttcatct

SEQ ID NO: 73057 - DNA, 50 bp, homo sapien
taacgcaaaactttttatgtaataaytacccgactctattataaaattca

SEQ ID NO: 73058 - DNA, 50 bp, homo sapien
gggggaactagatttgtagctttcaraccattttacagattcctaagggt

SEQ ID NO: 73059 - DNA, 50 bp, homo sapien
ggtaccaacatacctcatctcccaamatatctctacctcccttttctctt

SEQ ID NO: 73060 - DNA, 50 bp, homo sapien
tgttttatgctaactttgaggtccargaaaaatctttattcctacaagaa

SEQ ID NO: 73061 - DNA, 50 bp, homo sapien
tttccacttgtcttttatgtgcggcragatagtaaaccagcagattagct

SEQ ID NO: 73062 - DNA, 50 bp, homo sapien
ttactgggcttgcaatttaaaaaaayggttggcagttagaatggcgatca

SEQ ID NO: 73063 - DNA, 50 bp, homo sapien
ggcacagaaatcagcaaacggtacaygccagggccacccctcccagacag

SEQ ID NO: 73064 - DNA, 50 bp, homo sapien
aacatggggtatgtaatgctacaggsatctagtgagtagaggcagacctt

SEQ ID NO: 73065 - DNA, 50 bp, homo sapien
agaaaacaaaaagttctaggtaagasgatgaactgaggaagcaaatggga

SEQ ID NO: 73066 - DNA, 50 bp, homo sapien
tattgacctgaatttgtgtgaccgaygaaagcagaattaaaaactgcctg

SEQ ID NO: 73067 - DNA, 50 bp, homo sapien
gctgtatgatgacaggtaaatttccragttaggcagcttctattccctca

SEQ ID NO: 73068 - DNA, 50 bp, homo sapien
cctctcatcatcacagaaggaccacygcttactctttgttaatgaaatct

SEQ ID NO: 73069 - DNA, 50 bp, homo sapien
aatattccaaacaccgactcaaaacmaccaacaaaagaatgtgctatcta

SEQ ID NO: 73070 - DNA, 50 bp, homo sapien
tgtctttttaagtggttcatcagtaycttacacttatttttactcaaaac

SEQ ID NO: 73071 - DNA, 50 bp, homo sapien
tttacagtcttaaagtactaccagcraatacagttttccttctagaaaaa

SEQ ID NO: 73072 - DNA, 50 bp, homo sapien
agagtcctacagattctgtgtttcaragggtaattttgattgtggtctag

SEQ ID NO: 73073 - DNA, 50 bp, homo sapien
gcctggccttattcattctaccttcrccgaagagtcctacagattctgtg

SEQ ID NO: 73074 - DNA, 50 bp, homo sapien
ctattatcttcattttacagacagcrgaaactgtatcttgctctcagtac

SEQ ID NO: 73075 - DNA, 50 bp, homo sapien
tgcgcccccttgaccatgaaagttaygagttcaaagtaagaaaaatgatc

SEQ ID NO: 73076 - DNA, 50 bp, homo sapien
catagttcccagagaaaaggggctasatagacaattcaatactttttctt

SEQ ID NO: 73077 - DNA, 50 bp, homo sapien
ccaggtgcagctctcagctggggtgytcagaggacgcctgtgtcctcccc

SEQ ID NO: 73078 - DNA, 50 bp, homo sapien
gcaatgaattctacaccaggattccrcatgactttgggtaaggcctgtgc

SEQ ID NO: 73079 - DNA, 50 bp, homo sapien
tcaacattggactctacgaatataayggcttgagatccaaggaagaagtc

SEQ ID NO: 73080 - DNA, 50 bp, homo sapien
aagtgaggcggggtatttggaacaasctagcataaattaactatccaaat

SEQ ID NO: 73081 - DNA, 50 bp, homo sapien
tggggccacactctggtgttacctamatttcttgaggctctccttggagg

SEQ ID NO: 73082 - DNA, 50 bp, homo sapien
aggacacatagctatttcttataaamggaatcatttaagtgtatgttgcc

SEQ ID NO: 73083 - DNA, 50 bp, homo sapien
ttctgggacaataattataggaccartactcaacagtggctcttttcgta

SEQ ID NO: 73084 - DNA, 50 bp, homo sapien
ttgtcctatggcatagtagtaagacmaatttctccatgtgtataataact

SEQ ID NO: 73085 - DNA, 50 bp, homo sapien
atgtgtataataactagaaacataarctatggattaaaaagtgcctcaag

SEQ ID NO: 73086 - DNA, 50 bp, homo sapien
accttctgagacagttctaggcagastcagaactactttttaattgaatt

SEQ ID NO: 73087 - DNA, 50 bp, homo sapien
ggtatgtttatacaaatgcatattaygtgaatcatgtaattgcatgcaaa

SEQ ID NO: 73088 - DNA, 50 bp, homo sapien
aataggaatctgtatgaatattctakcctcatgctttatgtgtgattaaa

SEQ ID NO: 73089 - DNA, 50 bp, homo sapien
cgtgagagcaaggggatgccatgtayaccactggatttgctgtggtttgt

SEQ ID NO: 73090 - DNA, 50 bp, homo sapien
ccagaccttccaattgtctcatccascagagaaaggtcaacaggtgagtt

SEQ ID NO: 73091 - DNA, 50 bp, homo sapien
cagttttcatgtagtttagggcaaaytggaccccagagcaaaggcaagaa

SEQ ID NO: 73092 - DNA, 50 bp, homo sapien
tgataccacaggcactgaccaatccratctctttcttcagggctactccg

SEQ ID NO: 73093 - DNA, 50 bp, homo sapien
caagaaaaggcctacttctctattcrgtttatgattctataatcattgaa

SEQ ID NO: 73094 - DNA, 50 bp, homo sapien
aattttctgcttgtttccaaaataargaataatgtccaaaacaactaaaa

SEQ ID NO: 73095 - DNA, 50 bp, homo sapien
tgtgagaatggactaacaaaaataaycacctccagattggaaatatatga

SEQ ID NO: 73096 - DNA, 50 bp, homo sapien
cgtcttcctttaaaagctcactgtayaatcaggacgcaaaggccagggtt

SEQ ID NO: 73097 - DNA, 50 bp, homo sapien
ggcagggactagacttgtcagtttcyttatcacccaccccatgtcaagtg

SEQ ID NO: 73098 - DNA, 50 bp, homo sapien
ataaaaatacaaataaaatatgacawcaatttccattgtgtaggtatcat

SEQ ID NO: 73099 - DNA, 50 bp, homo sapien
atatttttctgcaactaggaggcaayggcgagggagctttaaccatgcca

SEQ ID NO: 73100 - DNA, 50 bp, homo sapien
aagaaggggtggaggtatctgtaaarctattctttctccctttgtaatga

SEQ ID NO: 73101 - DNA, 50 bp, homo sapien
gagagttgggggagtacaattacacmatcaatttagtattttcttttata

SEQ ID NO: 73102 - DNA, 50 bp, homo sapien
acagaagctcacatcagtaacctcasggccacttagcaactacagcataa

SEQ ID NO: 73103 - DNA, 50 bp, homo sapien
gaataaaccattcttataaataaaaygctatctgatacaatctgttagtg

SEQ ID NO: 73104 - DNA, 50 bp, homo sapien
gaatgcattctgttttcaataaaaaytacataactcaacagttttgcttt

SEQ ID NO: 73105 - DNA, 50 bp, homo sapien
cttactgaaccttcatcaagcttgamatcctctctgttcctgcccctgtt

SEQ ID NO: 73106 - DNA, 50 bp, homo sapien
aaagccaaacctcttatttctcatarcttgctgtggtcagcagataggca

SEQ ID NO: 73107 - DNA, 50 bp, homo sapien
gaaggttgagttatccttggctgaaygtctctatctacagcttggacctc

SEQ ID NO: 73108 - DNA, 50 bp, homo sapien
tatataatggaaactgagacttcagyagtgctgtctactagaactttctg

SEQ ID NO: 73109 - DNA, 50 bp, homo sapien
atgtcagttacctggtactatgaggwatagtgaaaagtgcaagaaagaaa

SEQ ID NO: 73110 - DNA, 50 bp, homo sapien
gatcattgctgtttctaatgaccttsaaatctacagggatgctgataatt

SEQ ID NO: 73111 - DNA, 50 bp, homo sapien
ctgtgtattttcgacttctcgttccyaacaaaaatcagtgtcgtagtgct

SEQ ID NO: 73112 - DNA, 50 bp, homo sapien
ttaccagctatgaatttataattgcrgagaagcatgtatatgtatctaaa

SEQ ID NO: 73113 - DNA, 50 bp, homo sapien
gcatgacttactttatttggaacaasgagacactgcttaactcccgattt

SEQ ID NO: 73114 - DNA, 50 bp, homo sapien
agagggcatatcctgccaaaggagayacaatgataataaggagatatgtg

SEQ ID NO: 73115 - DNA, 50 bp, homo sapien
atctatatccaattagctaaataaartattcaaataaccagaaaagaata

SEQ ID NO: 73116 - DNA, 50 bp, homo sapien
acagttgaaacctttctttgtgcaaygctttactaacttctcgtgcacac

SEQ ID NO: 73117 - DNA, 50 bp, homo sapien
aaaaaaaaaaagtaatctcattgtaraggaaagcagctgttcacaagagc

SEQ ID NO: 73118 - DNA, 50 bp, homo sapien
ataaaccattataagcacgataaagyctatcagtaagagtcttgtgaaaa

SEQ ID NO: 73119 - DNA, 50 bp, homo sapien
cacgttctcgttgtagccacattacrcctttgcattactcttttgccact

SEQ ID NO: 73120 - DNA, 50 bp, homo sapien
aggtttcaactgtcttgtttgtgaaygtaatatttacttggagagttgtt

SEQ ID NO: 73121 - DNA, 50 bp, homo sapien
ggcagatgaagtcaaggtccactcawatcagaatgtcccaacaggtaggt

SEQ ID NO: 73122 - DNA, 50 bp, homo sapien
tttcacaacatacctcctgagtcacmaaatctgttcagtgtttgccatgt

SEQ ID NO: 73123 - DNA, 50 bp, homo sapien
atgccagagaaaaatgccaatggaasgacaattttagtagaactacaaac

SEQ ID NO: 73124 - DNA, 50 bp, homo sapien
cacacatattgagttataacagaaaytcctgtctttgagcagtgagtaga

SEQ ID NO: 73125 - DNA, 50 bp, homo sapien
ctatataattaacttttaaatgctaygataagatagtttgaatagattat

SEQ ID NO: 73126 - DNA, 50 bp, homo sapien
atgtgtcatcacaaacatctcaaagwatattttagccatttattatggat

SEQ ID NO: 73127 - DNA, 50 bp, homo sapien
tttattacagccatttaaaatcttayagcagttgaattatatattgaaca

SEQ ID NO: 73128 - DNA, 50 bp, homo sapien
tgtatgtgtgtacatagcttatataygaagcagctagagaaaaacaatat

SEQ ID NO: 73129 - DNA, 50 bp, homo sapien
cagccttctccatcaaagtgccagaygtatgggtgaccagctcacaccag

SEQ ID NO: 73130 - DNA, 50 bp, homo sapien
tttattacgcagcagtagataacaaraaatgaattagtcacttggaagtt

SEQ ID NO: 73131 - DNA, 50 bp, homo sapien
aaagcagtctgtaggttttagccccraagcaaatattgaaaagacacacc

SEQ ID NO: 73132 - DNA, 50 bp, homo sapien
aagtgttttgaagcccaagatgaaakgatgtgatcacaagaggccgaagg

SEQ ID NO: 73133 - DNA, 50 bp, homo sapien
ggcatcagccaacctcacagggaacsgagatgtagatggcatgttggcat

SEQ ID NO: 73134 - DNA, 50 bp, homo sapien
gtgagatggagattgtaaggtgctaygctcagcttttaaaaactgatggt

SEQ ID NO: 73135 - DNA, 50 bp, homo sapien
cctgaggaaaggagcagagaccaaayggatccaggtggaaaggcagagct

SEQ ID NO: 73136 - DNA, 50 bp, homo sapien
ataagagtgtactgcctatattaccygataaaacttgctaaaataatttt

SEQ ID NO: 73137 - DNA, 50 bp, homo sapien
ttgaagtataaagattcaagttatayggagaaatgatacaactctaactc

SEQ ID NO: 73138 - DNA, 50 bp, homo sapien
tacattttcaggtaatgaacaaatgraaaatatgtttcccagcaaatctg

SEQ ID NO: 73139 - DNA, 50 bp, homo sapien
tgtggcatgtgatttctctctttggrtatcaaggtctggtagaacaaacg

SEQ ID NO: 73140 - DNA, 50 bp, homo sapien
atgtgaattattttaaaggcaaaacygtgctctttattttaaaaaacact

SEQ ID NO: 73141 - DNA, 50 bp, homo sapien
cttcctcttctggtactcccattacrcatgtcaaaccttttgaaattact

SEQ ID NO: 73142 - DNA, 50 bp, homo sapien
gggggtcttccaaaactctgtccackctttcagcccacattatggtggtg

SEQ ID NO: 73143 - DNA, 50 bp, homo sapien
aaaagatagaacagaattccgaggcyctgaacattcaggagggtaaaacg

SEQ ID NO: 73144 - DNA, 50 bp, homo sapien
gtgtgtgtgtgatctgccttgtgatmaaacttgcctgtacagacacttac

SEQ ID NO: 73145 - DNA, 50 bp, homo sapien
tcacaggtgatgtgctttaggtatcmctgtgagatgaaagggaaattaag

SEQ ID NO: 73146 - DNA, 50 bp, homo sapien
aatccaaaattgacaacttataaacygtcatctgcccatgcaaacttgaa

SEQ ID NO: 73147 - DNA, 50 bp, homo sapien
ttcaaatctctttctacactcaaaartcatgaggaacatgcaagtgaaag

SEQ ID NO: 73148 - DNA, 50 bp, homo sapien
cagtcagctctcatattaatatcaarcccagacaacatctttagagcagg

SEQ ID NO: 73149 - DNA, 50 bp, homo sapien
ctcacatcgccctccagttaaagtayaggttcttactctgttaaattttt

SEQ ID NO: 73150 - DNA, 50 bp, homo sapien
gtagtgttatgagtacatgtgataamtatgtttaagcgatttctggaatg

SEQ ID NO: 73151 - DNA, 50 bp, homo sapien
cagtaaactagagctagaattaggtyacaaatggatatcattgtgaaata

SEQ ID NO: 73152 - DNA, 50 bp, homo sapien
tttaattctccacatagtagtgatcmattaccatatttaaaaagatgtat

SEQ ID NO: 73153 - DNA, 50 bp, homo sapien
tcatttattagttaactcaaatttayattatctcaagtactagaagttta

SEQ ID NO: 73154 - DNA, 50 bp, homo sapien
  misc_feature (48)..(48): n is a, c, g, or t
ggatgtgaaggggtagtgcaaccaayaatgtttttgtaaacacaactnct

SEQ ID NO: 73155 - DNA, 50 bp, homo sapien
tttgacttatgtaaacattagtgtaratagagtgctctgaagtgttaggc

SEQ ID NO: 73156 - DNA, 50 bp, homo sapien
tttttatttgtatttgcccttacaasttacacatggtcataaccttaggg

SEQ ID NO: 73157 - DNA, 50 bp, homo sapien
gaaacaggaagctattttctggaggycttttctggaaacgattcagccac

SEQ ID NO: 73158 - DNA, 50 bp, homo sapien
caatgatggtggacggaaaataaaayaacttgatctggcaatgtttaaac

SEQ ID NO: 73159 - DNA, 50 bp, homo sapien
ctctggttgtccacgagggagacacygtaactctcaattgcagttatgaa

SEQ ID NO: 73160 - DNA, 50 bp, homo sapien
tgaggattgatcctcagaacactaaragggtaaagtagacttcgttctga

SEQ ID NO: 73161 - DNA, 50 bp, homo sapien
cttaatgcagtagatccatgattaayggagaaataaattatttagacaat

SEQ ID NO: 73162 - DNA, 50 bp, homo sapien
taaggcagatcccatagtctctgacmgtaagctgacaaaagatacagcta

SEQ ID NO: 73163 - DNA, 50 bp, homo sapien
gtgactacaatacatccatcctggcrttaaaaagtagaaaagaaaggatt

SEQ ID NO: 73164 - DNA, 50 bp, homo sapien
ctggttcttataatttccacttgaamctagagagcaaggggagtttcact

SEQ ID NO: 73165 - DNA, 50 bp, homo sapien
agggaaggggaaaaatgtatctctayaggaaaacaaaaggaatcttggct

SEQ ID NO: 73166 - DNA, 50 bp, homo sapien
taaggtagttatcacaggtttataamgaagagagtgatatgatgaaaaat

SEQ ID NO: 73167 - DNA, 50 bp, homo sapien
attagtaggaattcttaaatattagwcataaaactgaagagagctattac

SEQ ID NO: 73168 - DNA, 50 bp, homo sapien
catcttttggcaacacgggaattgasaggagagttgcttcaacttcttaa

SEQ ID NO: 73169 - DNA, 50 bp, homo sapien
ccttttcctgtatccccatcagttayctgcaatttactcttccaatcatc

SEQ ID NO: 73170 - DNA, 50 bp, homo sapien
agatgctgtttcaagaaaggagtaarcggtcctttcacaggtctcctggg

SEQ ID NO: 73171 - DNA, 50 bp, homo sapien
actaataggtgacttacgctataaaygtgcaagagatgttccagataaca

SEQ ID NO: 73172 - DNA, 32 bp, homo sapien
ttgacctcttgccttayaacctttgcttcttc

SEQ ID NO: 73173 - DNA, 50 bp, homo sapien
tgtagccttcctcactgaatataaasgtaaaaagtggattctgttctttc

SEQ ID NO: 73174 - DNA, 50 bp, homo sapien
cagaatttccaaacagagggaaaaaytaggtggacttgaaatagtaactc

SEQ ID NO: 73175 - DNA, 50 bp, homo sapien
tcaataattaatactttggctgtaartatatagcaatttaatttttgaga

SEQ ID NO: 73176 - DNA, 50 bp, homo sapien
ttctttgtcaccattggagtatatgracattatcaactcagggcttttcc

SEQ ID NO: 73177 - DNA, 50 bp, homo sapien
taagtggtcctataggggttgtaaastgttatgctatcacttgcagcaaa

SEQ ID NO: 73178 - DNA, 50 bp, homo sapien
tacaagtaagaaaaatgaggcttcargaagtctgtttccccagtggcctg

SEQ ID NO: 73179 - DNA, 50 bp, homo sapien
tcattcatttgttgattcatatatgkagcttgagagatgatattcaagca

SEQ ID NO: 73180 - DNA, 50 bp, homo sapien
aacctgtttctaaaatataatttccraagtgcatactaaatgacatcttt

SEQ ID NO: 73181 - DNA, 50 bp, homo sapien
gcttcatttttaaaatgagcattttsttttgccaaaaataatggttcttg

SEQ ID NO: 73182 - DNA, 50 bp, homo sapien
taggttcttgacctcaaatttaaacrcaagttcaatacaacaacatgcca

SEQ ID NO: 73183 - DNA, 32 bp, homo sapien
ctaaacagtggtaaaaygagattatgtacagg

SEQ ID NO: 73184 - DNA, 50 bp, homo sapien
tatgactgtcagatattggaccaagratagttttataagtcacatagtct

SEQ ID NO: 73185 - DNA, 50 bp, homo sapien
gtgttttcactctcttgcattttctycaatgaaaagctaagtacaggagt

SEQ ID NO: 73186 - DNA, 50 bp, homo sapien
cttaggagccgcaggaagccaacggyacttaccaatcagtgtggccaagc

SEQ ID NO: 73187 - DNA, 50 bp, homo sapien
tatattttaaaaattctcggttagcrcaattcatttaaatttatgctgtc

SEQ ID NO: 73188 - DNA, 50 bp, homo sapien
gcagtgtttccaaacataacgacaayggtcgggtgccataagcaacatct

SEQ ID NO: 73189 - DNA, 50 bp, homo sapien
ctaagaactcaagttcattgtcagamgtccattttttgtcactgagccgt

SEQ ID NO: 73190 - DNA, 50 bp, homo sapien
tttagagggttaaataatggttttawgttagatagaatatagttgaagat

SEQ ID NO: 73191 - DNA, 50 bp, homo sapien
ttttctcttgggctgatcagttttcycatagacaaattgtgcatcctgga

SEQ ID NO: 73192 - DNA, 50 bp, homo sapien
taatatgtttctcctttagtccgtakaaactcaatgctctagaaagatta

SEQ ID NO: 73193 - DNA, 50 bp, homo sapien
atgtttatatctcttccagaagacaytggtagctcccctcatttcctaca

SEQ ID NO: 73194 - DNA, 50 bp, homo sapien
aaaaatgtttccaacgagcctacaayatcttgttctaccagcaagtgcaa

SEQ ID NO: 73195 - DNA, 50 bp, homo sapien
agactgtagatagacattctaaaacratagttatttgagtaaaagcctca

SEQ ID NO: 73196 - DNA, 50 bp, homo sapien
agatataaacatcttcctgaagcacyagccttttgtaagacctgaccact

SEQ ID NO: 73197 - DNA, 50 bp, homo sapien
gccagacctgaaaggaagccaaggcrataaaataatcaaagatggagggt

SEQ ID NO: 73198 - DNA, 50 bp, homo sapien
gctccctccagctgagggagaaggaygttctgaaggttgacagtttccca

SEQ ID NO: 73199 - DNA, 50 bp, homo sapien
agttcatcaaccatgctgaccaaaartgctccttaaagatacgaacttca

SEQ ID NO: 73200 - DNA, 50 bp, homo sapien
acacggtagaccaaagatgctcaatwaaagcagcacagctgaatgactga

SEQ ID NO: 73201 - DNA, 50 bp, homo sapien
gctattcattcactcaacatttatcragtaccctccattgtcagttatca

SEQ ID NO: 73202 - DNA, 32 bp, homo sapien
cccccaacactgtgccyatttcatattatagc

SEQ ID NO: 73203 - DNA, 50 bp, homo sapien
tgtccagacccctcaaataaggtaayctgaccaagtttaatacattctta

SEQ ID NO: 73204 - DNA, 50 bp, homo sapien
catttactgatagtgttaattgctakaaaacatactgtggactaccaatt

SEQ ID NO: 73205 - DNA, 50 bp, homo sapien
ttcttcaagtggacctggcctcttcwtgaattgatcgatgctagatctga

SEQ ID NO: 73206 - DNA, 50 bp, homo sapien
attctaccagaaaaatgtgtattgakagttcaccattgaaacaataactg

SEQ ID NO: 73207 - DNA, 50 bp, homo sapien
gacattatccaattgtccctggaacyactgaattagacatatgaccttga

SEQ ID NO: 73208 - DNA, 50 bp, homo sapien
ctaatgactgctacccatcctcttawattccaggctcctactgttgtgac

SEQ ID NO: 73209 - DNA, 50 bp, homo sapien
tatactctagttatttacctggaagyagtgaaggtaggtgggactgatct

SEQ ID NO: 73210 - DNA, 50 bp, homo sapien
cagtaagtcactgttctaacaggaayaacttgtatgcctcctagatatga

SEQ ID NO: 73211 - DNA, 50 bp, homo sapien
agcccctgccagagggcactttatayagtagtcgactttgtacaaccaaa

SEQ ID NO: 73212 - DNA, 50 bp, homo sapien
tcatttttccatcgaataaatgcacragtaaaaatcaagaaaacataaac

SEQ ID NO: 73213 - DNA, 50 bp, homo sapien
atgactataggcctaaatgggacagratcacaatcacatttgtcaccagc

SEQ ID NO: 73214 - DNA, 50 bp, homo sapien
tctgaagagtcttttggaatatgcckcagacttttcctcctgcagggcat

SEQ ID NO: 73215 - DNA, 50 bp, homo sapien
tatggattaataccacagatcattgragaagtatgtggaatataaataat

SEQ ID NO: 73216 - DNA, 50 bp, homo sapien
tactgggctgactattgactgggaayaagccgagaatattgtgacccatt

SEQ ID NO: 73217 - DNA, 50 bp, homo sapien
ctctttattttcattatggaatgcargtaataattttatccctttaatta

SEQ ID NO: 73218 - DNA, 50 bp, homo sapien
acacagtgaatacagatttttttgaygacaagagggttacagcaattaag

SEQ ID NO: 73219 - DNA, 50 bp, homo sapien
cttctcaacttttcctcatatctgcyatggtagattgcttccagtgttgg

SEQ ID NO: 73220 - DNA, 50 bp, homo sapien
ttctaaaatttgcccaatatgccacygtaataatttacccagagttaatg

SEQ ID NO: 73221 - DNA, 50 bp, homo sapien
attctccccttggacagcatatctgrttggctacaaagtgtgaagacaaa

SEQ ID NO: 73222 - DNA, 50 bp, homo sapien
tccctgtgaaaatagtacttacagcrgttacacagtagttactatacatt

SEQ ID NO: 73223 - DNA, 50 bp, homo sapien
gttcttgtaagaaaggaaatccagayacagacatgtgcaccatgagagga

SEQ ID NO: 73224 - DNA, 50 bp, homo sapien
ataattcaaagcacgtatttcagaayagcatatgtatctccagcctgcca

SEQ ID NO: 73225 - DNA, 50 bp, homo sapien
gccctaatcctgagtgtgtgaggaartcaccttcggttaagcattgacca

SEQ ID NO: 73226 - DNA, 50 bp, homo sapien
ttgcttagcttttaagggctctccckcagattccagaagctaataaattg

SEQ ID NO: 73227 - DNA, 50 bp, homo sapien
ggcagagagaaggatttgggagatayttcagagggagaagcaagaggacg

SEQ ID NO: 73228 - DNA, 50 bp, homo sapien
atttgctgccacctaggatcttccayggtaattatcttgaccaaaaagcc

SEQ ID NO: 73229 - DNA, 50 bp, homo sapien
gccacttgagactttttactatactyagaggctgccttggtagtcaaatt

SEQ ID NO: 73230 - DNA, 50 bp, homo sapien
agcagaacagccttattgttgttgayacggggaaaatttcagtggttcta

SEQ ID NO: 73231 - DNA, 50 bp, homo sapien
ttaccacaaaaagaaataatttgacyaagttcgtaataattaagtctgcc

SEQ ID NO: 73232 - DNA, 50 bp, homo sapien
agcatataaatgtaaataatagctargataaatcgtgataactgataatg

SEQ ID NO: 73233 - DNA, 50 bp, homo sapien
tttcttcagactgctattcagtataygtaagagacagaggctgaaagtaa

SEQ ID NO: 73234 - DNA, 50 bp, homo sapien
cagaataggggtgatatataggttgrcttagctttgttcatctagggatc

SEQ ID NO: 73235 - DNA, 50 bp, homo sapien
tcagacacttagttacaatggactamtaaccatctttgtcctctccaaaa

SEQ ID NO: 73236 - DNA, 50 bp, homo sapien
gcctaaaatttccttttgccaattasaggtaaacgcagtccccaatttct

SEQ ID NO: 73237 - DNA, 50 bp, homo sapien
tggtcacacttttaagtaacagtaarcaatgaaaaaacaaatagaaaatg

SEQ ID NO: 73238 - DNA, 50 bp, homo sapien
ctcaagaagtttaaaaagcataggaytcaaggggagacgcttacaaaaag

SEQ ID NO: 73239 - DNA, 50 bp, homo sapien
aatgtagagacatacaaactcaaaamaagtctgaagaagagaagatgatc

SEQ ID NO: 73240 - DNA, 50 bp, homo sapien
tttaatctctttctttctaatgcaaygatcaaaacttagcagcatcccgt

SEQ ID NO: 73241 - DNA, 50 bp, homo sapien
ctatggactgggactcgagtgcatarcattttttacttgcaatgtacatt

SEQ ID NO: 73242 - DNA, 50 bp, homo sapien
atcttttaaggtaaaactccacggarataaagaattgagagaagataata

SEQ ID NO: 73243 - DNA, 50 bp, homo sapien
accaaatgagaagtgcaaccatggartacttgagtgggagtgaggggcat

SEQ ID NO: 73244 - DNA, 50 bp, homo sapien
acctatatatcacccctattctgatmaaaaatgtcttcagcattcctgaa

SEQ ID NO: 73245 - DNA, 50 bp, homo sapien
tcatccagaacagaaacattaaaackattcgactcctgcaggacatctta

SEQ ID NO: 73246 - DNA, 50 bp, homo sapien
tgggaaggtgattatggcattaacaktggtcttagccaggcagtgtgttg

SEQ ID NO: 73247 - DNA, 50 bp, homo sapien
aaatggcaatgttaagtattcccaayattcaaagctttctatcaaaatgg

SEQ ID NO: 73248 - DNA, 50 bp, homo sapien
gtttacacagaaagaaaatttgtcayaatcggtgatcctgtaatcagttg

SEQ ID NO: 73249 - DNA, 50 bp, homo sapien
cctgtgcaaatacaatctctcctaayctatttatacaattatgtgtctgc

SEQ ID NO: 73250 - DNA, 50 bp, homo sapien
caaagatgagcttgtttgtagcaccrccataattcacacagtccttcaga

SEQ ID NO: 73251 - DNA, 50 bp, homo sapien
agaaaaatctttatgtcattaaaackacgtagatcaatggaaatagaacc

SEQ ID NO: 73252 - DNA, 50 bp, homo sapien
ggatatatactttatgttcaatgaaracgtatttattgtatttatctggc

SEQ ID NO: 73253 - DNA, 50 bp, homo sapien
ttctagcatcatctgcataacttaayggtcagccaatgactggtcaaaga

SEQ ID NO: 73254 - DNA, 50 bp, homo sapien
ggtgggaggagaagaaaactcttaastggaaaagtcagaaaaaaagcaga

SEQ ID NO: 73255 - DNA, 50 bp, homo sapien
attttacttcttacaaaatagagagrcctttgctttggagtttgggttaa

SEQ ID NO: 73256 - DNA, 50 bp, homo sapien
actttattttagttggcaatattaayacccatttcagaaactcctttatc

SEQ ID NO: 73257 - DNA, 50 bp, homo sapien
ttcaaaataaatattagggctatagraactctttattttccatatttaag

SEQ ID NO: 73258 - DNA, 50 bp, homo sapien
cagactcttttattaaaatggataawctgaaatgaaatttgaagctggga

SEQ ID NO: 73259 - DNA, 50 bp, homo sapien
actgcagatatatattaagttttcamaaaatatatgtactcattatgaaa

SEQ ID NO: 73260 - DNA, 50 bp, homo sapien
aataacaacagtttttcatgatatartacaatagatataaatagaaacaa

SEQ ID NO: 73261 - DNA, 50 bp, homo sapien
gaccaatttcagaaacgaggactgcrctatctgctcacatttccttcttt

SEQ ID NO: 73262 - DNA, 50 bp, homo sapien
cttggcaaagacagatgagagaaaaygaaatgcaagaattcactaagatg

SEQ ID NO: 73263 - DNA, 50 bp, homo sapien
tgacattctctggtttattatgttcraatcactcttcttcagtccagtat

SEQ ID NO: 73264 - DNA, 50 bp, homo sapien
aagggaaataggaaattaagggagcraaaatgaggttatttaaatttcac

SEQ ID NO: 73265 - DNA, 50 bp, homo sapien
agcaaacagctttgatttgtttaagyctctgattttttggtctaactgat

SEQ ID NO: 73266 - DNA, 50 bp, homo sapien
tattgaaccactgattattcaggagyacattgtgtaatttccatgtgttt

SEQ ID NO: 73267 - DNA, 50 bp, homo sapien
taagagttgtgacaatatatgatacrcctagactctcagaaaatgctaat

SEQ ID NO: 73268 - DNA, 50 bp, homo sapien
aatggggttgttgctcaagttttgaygtgtagtggaatggagtggagtgg

SEQ ID NO: 73269 - DNA, 50 bp, homo sapien
tgaggacctgtttagcagtcttaaaygattgtgagaatgtctgacaaagg

SEQ ID NO: 73270 - DNA, 50 bp, homo sapien
acatctagatataaatagaataacaytgggagaacgtaaactgctttttt

SEQ ID NO: 73271 - DNA, 50 bp, homo sapien
tggctaatgacatatcaatcttcatyaactgcccatctcttctaacagca

SEQ ID NO: 73272 - DNA, 50 bp, homo sapien
ctcttgaattctaataggatccaagraacataattaggccttttcctgac

SEQ ID NO: 73273 - DNA, 50 bp, homo sapien
agaaattcctgatagccagtaacaargtaaacagaatggattttataact

SEQ ID NO: 73274 - DNA, 50 bp, homo sapien
tgcattaatcattgcctagaacttayagttgtctctagtttcaactccat

SEQ ID NO: 73275 - DNA, 50 bp, homo sapien
gaaaacttaatatatatctgcagtgmaatgcttctactttttaactttta

SEQ ID NO: 73276 - DNA, 50 bp, homo sapien
cagattcacctactctattttgatgrcaaaagtggattatttcttgaaga

SEQ ID NO: 73277 - DNA, 50 bp, homo sapien
tccagtacaaaagaattaaatctcasggaagtctgtgttgaagtttcctg

SEQ ID NO: 73278 - DNA, 50 bp, homo sapien
agagttggcataatttttttcatggragataagttgaaagatacttagag

SEQ ID NO: 73279 - DNA, 50 bp, homo sapien
aaaaactattaatgttgcataataasccacgaagacaaaatgagtagaat

SEQ ID NO: 73280 - DNA, 50 bp, homo sapien
cttaagtttttataattattgattargtaggtataggcaaacttatttat

SEQ ID NO: 73281 - DNA, 50 bp, homo sapien
tttaaagtagcataactcaagtaacrcaagtaactctcgccagccaagtg

SEQ ID NO: 73282 - DNA, 50 bp, homo sapien
taaacacgtgccatggtgatttgctrtatagatcaacctgtcacttaggt

SEQ ID NO: 73283 - DNA, 50 bp, homo sapien
aaattatgaacatgcagaacatggaratacaaataaccaagcatgatttc

SEQ ID NO: 73284 - DNA, 50 bp, homo sapien
gaatctagaggcctcctagattaagrcctgcctggaatggattgggggtg

SEQ ID NO: 73285 - DNA, 50 bp, homo sapien
gggaaaaatcgccttcttttttatcrcattcattgaaataccttctctta

SEQ ID NO: 73286 - DNA, 50 bp, homo sapien
taatcatcaatgcccaacacaggaamgagtgtaagtaaatgaaacctctg

SEQ ID NO: 73287 - DNA, 50 bp, homo sapien
gaaaatcacaatgagctggagaatcragagattggaattaagaattctga

SEQ ID NO: 73288 - DNA, 50 bp, homo sapien
aattgaatcagcttgggcaattggamaaactcaacagctatttaactcaa

SEQ ID NO: 73289 - DNA, 50 bp, homo sapien
ctgctcacatctgcattaacttttcyctatagacaatggggcagggacag

SEQ ID NO: 73290 - DNA, 50 bp, homo sapien
tgagcaaagcaaactctcaggtgatraatatagccaaaagaaaatgctgt

SEQ ID NO: 73291 - DNA, 50 bp, homo sapien
ccaaagaaagaagttccaaagacacygagatgttctgctgcctcctgttg

SEQ ID NO: 73292 - DNA, 50 bp, homo sapien
tccatcaatatcacaataaataccartagataaccaccagagatgctttt

SEQ ID NO: 73293 - DNA, 50 bp, homo sapien
tacaatgagctaccctaacacatgtwttagattgaccaaaattaaataac

SEQ ID NO: 73294 - DNA, 50 bp, homo sapien
gatggatgggaataaggttcattccygaagatgtttatattaagaagagc

SEQ ID NO: 73295 - DNA, 50 bp, homo sapien
aagtggagagaataagttcaggaaartttagtcgttaccaaaacatcaac

SEQ ID NO: 73296 - DNA, 50 bp, homo sapien
ccactttgtattaatgtttccatggyaatccgatacttgacattttattt

SEQ ID NO: 73297 - DNA, 50 bp, homo sapien
ctttggtgacatttaaggacaagacrcagttgattgataataatgctgac

SEQ ID NO: 73298 - DNA, 50 bp, homo sapien
ttactactttctaaggcataataaaygtaactactggaataaatgtatca

SEQ ID NO: 73299 - DNA, 50 bp, homo sapien
aatatcattttattctgctatatgakgtataaaatttcattctgggctta

SEQ ID NO: 73300 - DNA, 50 bp, homo sapien
gtagcacacatgctggcttgctggcraaagtgcttttagacaaatatgaa

SEQ ID NO: 73301 - DNA, 50 bp, homo sapien
taatggtaccatagtgattacactaygtttttctaaccactttcaaggcc

SEQ ID NO: 73302 - DNA, 50 bp, homo sapien
aaaaaataataaggaacatagttgargattgaactttgaggaactccaac

SEQ ID NO: 73303 - DNA, 50 bp, homo sapien
tagtaaaaattttattttcacatatraagcataattgtaaatttttcctc

SEQ ID NO: 73304 - DNA, 50 bp, homo sapien
tctcttcgtgtctctttgcatcttayagagatatttgaaaggtcttatat

SEQ ID NO: 73305 - DNA, 50 bp, homo sapien
tctaactatataatgaatttaatcayggagtctcaagaaaattgggcaaa

SEQ ID NO: 73306 - DNA, 50 bp, homo sapien
aaaattgggcaaaccaaggctgaatwacttaaagagagatagagcctggg

SEQ ID NO: 73307 - DNA, 50 bp, homo sapien
tatacctttggcagcacagaatgaartaagacaggtgtactttttttatt

SEQ ID NO: 73308 - DNA, 50 bp, homo sapien
tcttttagcttcagaagtttctaaaraccaatttaatgtgcatgagtaaa

SEQ ID NO: 73309 - DNA, 50 bp, homo sapien
atcagtctcaacttgtcatagccagmaagagtttatgcttctcccattgc

SEQ ID NO: 73310 - DNA, 50 bp, homo sapien
agggaaatggctaaacacacactcckacattagttaccccataccagcct

SEQ ID NO: 73311 - DNA, 50 bp, homo sapien
cttatattctacataatgtttcaatwaaaaaagtgaaatggagacaaaca

SEQ ID NO: 73312 - DNA, 50 bp, homo sapien
attaataattacctagtttatatagscagttaactgtgaactaaaactaa

SEQ ID NO: 73313 - DNA, 50 bp, homo sapien
ctcgtgatggattgcagaagagggargtttcaataaggtacttgataatc

SEQ ID NO: 73314 - DNA, 50 bp, homo sapien
atgactggtctagaacaatctcctckgaaatagattccctacatctctag

SEQ ID NO: 73315 - DNA, 32 bp, homo sapien
tatacaggatatgaackgagtattcaaggcgt

SEQ ID NO: 73316 - DNA, 50 bp, homo sapien
aggtaaaaaacatggagggagaaaakatttaatgaataatgtggaaagag

SEQ ID NO: 73317 - DNA, 50 bp, homo sapien
tcaatttcgattggtaaattaattakattggaggtgtaacaagatggcta

SEQ ID NO: 73318 - DNA, 50 bp, homo sapien
caggaacccaagcctatgaagtgaaytgtaggatgtggtatcagccagta

SEQ ID NO: 73319 - DNA, 50 bp, homo sapien
ctttggacagtatgttaattacggaygcaaacaaggcctgaaaacaaatt

SEQ ID NO: 73320 - DNA, 50 bp, homo sapien
gtcttctaaaacaaactcagaaattsaagtgatatatggtgatagacagc

SEQ ID NO: 73321 - DNA, 50 bp, homo sapien
cctaaatcatttctacacagtttaartcaatattcatcacatgcgaaaat

SEQ ID NO: 73322 - DNA, 50 bp, homo sapien
gatgatctccatgtctcctacacaaygcctttgctggcagatagtgaacc

SEQ ID NO: 73323 - DNA, 50 bp, homo sapien
tgggtgtatagcataccaaaacttayaaaaatgtacacactaagtatgtg

SEQ ID NO: 73324 - DNA, 50 bp, homo sapien
ctgttttagcgttccttgattcacaraatatttatggaacacctattaca

SEQ ID NO: 73325 - DNA, 50 bp, homo sapien
attctaactggtttattgaacatacyggtgtttgtgaggtgcaagcagta

SEQ ID NO: 73326 - DNA, 50 bp, homo sapien
ccttattggtgagggaggaagttggkatctatctattctaactggtttat

SEQ ID NO: 73327 - DNA, 50 bp, homo sapien
tctagggagattctcattatccttcyagcaatctggtttcctttattgcc

SEQ ID NO: 73328 - DNA, 50 bp, homo sapien
aattagggaggatataattaaagaartaagcaagataaatctttattcat

SEQ ID NO: 73329 - DNA, 50 bp, homo sapien
ttacattcttctgagactctgtgagracaataaagttgctgcagatgtta

SEQ ID NO: 73330 - DNA, 50 bp, homo sapien
tataaactatgacctcgagttgttayggaaatgaggattatagtagctat

SEQ ID NO: 73331 - DNA, 50 bp, homo sapien
ataaattacagttatttgatggatgragatcttgtgctaagacttgggct

SEQ ID NO: 73332 - DNA, 50 bp, homo sapien
ttggcccccaattccaacagttaccragattgctatttcttccccaaatc

SEQ ID NO: 73333 - DNA, 50 bp, homo sapien
aaagcagcatgccaaaaagcctccartaagcaggtgaagtgattaagttg

SEQ ID NO: 73334 - DNA, 50 bp, homo sapien
aaacttttatccataacatattttgragtagaaaacattatttgataggg

SEQ ID NO: 73335 - DNA, 50 bp, homo sapien
aaatttcaaaaagattatcattgaarattgtggagtcttcactgcttcac

SEQ ID NO: 73336 - DNA, 50 bp, homo sapien
ataatttctcataggtcaaagacaaygttattactgggtacatctagaat

SEQ ID NO: 73337 - DNA, 50 bp, homo sapien
caaattaaatgtgtcaaagtagaatkagagatggcattgcacctcccatg

SEQ ID NO: 73338 - DNA, 50 bp, homo sapien
ataaagtctacactataatcaggtaygtagtaaacaaaaaactcaaatac

SEQ ID NO: 73339 - DNA, 50 bp, homo sapien
aacacctagggctgccaatcactgarataaagggcagtattggcaggttc

SEQ ID NO: 73340 - DNA, 50 bp, homo sapien
gcctgctttgggatcagtaatagtartaataatagtagttgtggtattta

SEQ ID NO: 73341 - DNA, 50 bp, homo sapien
tactttcaatactaacttgtggtgayaaatgtctattaataaaaaatata

SEQ ID NO: 73342 - DNA, 50 bp, homo sapien
atgtcaccaatgagacatgcatatasaggctacttcaatggcattgctct

SEQ ID NO: 73343 - DNA, 50 bp, homo sapien
ctaaatcttgcttcattgattataaraaatacacaacgctaattcacaat

SEQ ID NO: 73344 - DNA, 50 bp, homo sapien
cggttttaggcaagttgttcacttaygttattggcattttcaagtatctg

SEQ ID NO: 73345 - DNA, 50 bp, homo sapien
agaaagtagaaattctctccatcaawaaaaccttcagaaataaaccaggt

SEQ ID NO: 73346 - DNA, 50 bp, homo sapien
tgggcacgtaaccaatggaggctaaygtctctaaagacatacttatccat

SEQ ID NO: 73347 - DNA, 50 bp, homo sapien
agctatggcgaagctttagttaggayctcagtgtaaattatattcagcca

SEQ ID NO: 73348 - DNA, 50 bp, homo sapien
tcatgtataaacaatgtgtttgcaasctaaaggagtgaatagatggctct

SEQ ID NO: 73349 - DNA, 50 bp, homo sapien
gatcaattagaatatgggaagaaagrtttggtttctaaaatattaataag

SEQ ID NO: 73350 - DNA, 50 bp, homo sapien
tgttatgactgtataataccctatgmaattcagcaataaataacaacatg

SEQ ID NO: 73351 - DNA, 50 bp, homo sapien
gtgacgtgacatcacttgaaaacackaaagcctcatcatttaccaggttg

SEQ ID NO: 73352 - DNA, 50 bp, homo sapien
aaggaatttgaagtcacgaaaatttraaacttatgcttggcaaaacaaca

SEQ ID NO: 73353 - DNA, 50 bp, homo sapien
gcacaatctagaacaaatttcttcaytcatattagattgcctaaatctct

SEQ ID NO: 73354 - DNA, 50 bp, homo sapien
cccacattcatgcatactcactgacycatgcttctaggctcttcttgcct

SEQ ID NO: 73355 - DNA, 50 bp, homo sapien
aaagaatctaagatgttgtgaaaacraagacgcttgacaagcacaagggc

SEQ ID NO: 73356 - DNA, 50 bp, homo sapien
atttgttccaccctgtggtgtggaaragtacacatcatctggcagaggat

SEQ ID NO: 73357 - DNA, 50 bp, homo sapien
aatggaatccatgactgtgcttctcratccaacaccactgatgtggcagg

SEQ ID NO: 73358 - DNA, 50 bp, homo sapien
tgataacctctctaatttgtttctckcatttacaccgatgtagtacattt

SEQ ID NO: 73359 - DNA, 50 bp, homo sapien
caggaaaatgtcatacgtggtagaamttcaatgcatattttacctagaag

SEQ ID NO: 73360 - DNA, 50 bp, homo sapien
cctataaatgctgtccccttgccagygaaaacttggggctgagaggagtg

SEQ ID NO: 73361 - DNA, 50 bp, homo sapien
actttaagctcttgtgtagttatgtsaagttgcatcaaatatgacgagat

SEQ ID NO: 73362 - DNA, 50 bp, homo sapien
gtttcatacctcttattgctttttcrtgggaatgtagagtataagaaata

SEQ ID NO: 73363 - DNA, 50 bp, homo sapien
gaactctctgaattcagctggctaamaaagaagaaagagaagatggagaa

SEQ ID NO: 73364 - DNA, 50 bp, homo sapien
tacaaagatattgctattaccaaaayggagaggcatactgtgacaaatag

SEQ ID NO: 73365 - DNA, 50 bp, homo sapien
tagaggattttcagattgcaagggtyaacaaataacagttaaaatggaat

SEQ ID NO: 73366 - DNA, 50 bp, homo sapien
ttccatcagctcctttgaaagacaamgtgctaccatttcttccttttttc

SEQ ID NO: 73367 - DNA, 50 bp, homo sapien
gggtactttgtctgtattcacacagwagcctaatatttccttaattatca

SEQ ID NO: 73368 - DNA, 50 bp, homo sapien
aataactaaaaattttccaagtgatragaaataataccacacaaggtaaa

SEQ ID NO: 73369 - DNA, 50 bp, homo sapien
atccacagtaaaaatcaagcagaaaygtgtaatacagaagctattcagaa

SEQ ID NO: 73370 - DNA, 50 bp, homo sapien
aataaaaaaattggagttgattttamgacgagacatcatagtccctttgt

SEQ ID NO: 73371 - DNA, 50 bp, homo sapien
ctctttcggctccaaatgatgtgccragcatgggaaacagcgttttgcct

SEQ ID NO: 73372 - DNA, 50 bp, homo sapien
gaggggagatgatacataaggaaaawtttatagtccctctactgtgtata

SEQ ID NO: 73373 - DNA, 50 bp, homo sapien
gagatgcatctgcgggtcggtgacaytgatttctatgaattgttttattc

SEQ ID NO: 73374 - DNA, 50 bp, homo sapien
ataattctacaggtggtgagagtgaygaaatagaatacaattttgttatg

SEQ ID NO: 73375 - DNA, 50 bp, homo sapien
aaactctaagttgttgaaattatcawtgaggttagaatcaaggtacttag

SEQ ID NO: 73376 - DNA, 50 bp, homo sapien
ttggttttaacagcatttcaggtggwaagtgtattttagaacaaacaagt

SEQ ID NO: 73377 - DNA, 50 bp, homo sapien
catgaatgtcttcagcgctcttgaayctcaagtgaaactagctttttgta

SEQ ID NO: 73378 - DNA, 50 bp, homo sapien
tgtggaaatcatgtgtgcatgtccaratcagattgttcagtgcctgcatg

SEQ ID NO: 73379 - DNA, 50 bp, homo sapien
tcttgaacctgtctaattcagaggaycgtacacaaatgatgacagtcaca

SEQ ID NO: 73380 - DNA, 50 bp, homo sapien
ctagaagataaagataacatggtaawtattgacagaggataaccgttatc

SEQ ID NO: 73381 - DNA, 50 bp, homo sapien
accacgaaatttcttgaagctttagyataaacacatatgaagaagacaga

SEQ ID NO: 73382 - DNA, 50 bp, homo sapien
aaataagtaaagttcttcacacacawtatcatgaagaggtcaatattttc

SEQ ID NO: 73383 - DNA, 50 bp, homo sapien
gtttcccccataatgtgctttaagayatgaaacacctaagcaaaaggcca

SEQ ID NO: 73384 - DNA, 50 bp, homo sapien
ttatattctgagggtgcatggtctcragtacctttggaatgaataaatca

SEQ ID NO: 73385 - DNA, 50 bp, homo sapien
atccaccctcagcattcctcttgacmaccgcctgagctgacctgatggcc

SEQ ID NO: 73386 - DNA, 50 bp, homo sapien
gaaaaacataatttgctaaatattaracgcaaagagccagaaaaaaatct

SEQ ID NO: 73387 - DNA, 50 bp, homo sapien
gagtttggctcccccagcactaccayggaaaaaactgaaaagtgggagag

SEQ ID NO: 73388 - DNA, 50 bp, homo sapien
tttattaatgaatgtcaatgcgaaaygtataagtgaaatgcaatataaaa

SEQ ID NO: 73389 - DNA, 50 bp, homo sapien
acgagggatttattattctaaattcygaaggaccgttttgcagtaggtag

SEQ ID NO: 73390 - DNA, 50 bp, homo sapien
tgttattgagatgttttctttcataytagttattgtttttaaactaaaag

SEQ ID NO: 73391 - DNA, 32 bp, homo sapien
aaaaacaataattcaayggtatagtgaaggga

SEQ ID NO: 73392 - DNA, 50 bp, homo sapien
ttaaataacaggtctggaaggaaacrgaagatatctgtgaaaaacaattc

SEQ ID NO: 73393 - DNA, 50 bp, homo sapien
catcaggaattctagttgttaccacyattaaatgaacctggagtcagaaa

SEQ ID NO: 73394 - DNA, 50 bp, homo sapien
gaaaaactgctgtctctgctatctcratttctgtgacatacctgaggccc

SEQ ID NO: 73395 - DNA, 50 bp, homo sapien
atttttggaaaacaatttgacatcartgataattttaaatgttcctaccc

SEQ ID NO: 73396 - DNA, 50 bp, homo sapien
cagagccccaaacttttcagaataamaatttcggcatttgcttggcattt

SEQ ID NO: 73397 - DNA, 50 bp, homo sapien
tatatctagaccatcagtctacatamtaacagctacagatatcaggaaat

SEQ ID NO: 73398 - DNA, 50 bp, homo sapien
tattccctaacacacatttttacaakaatattttactgcccagagatttt

SEQ ID NO: 73399 - DNA, 50 bp, homo sapien
gacctctctatacagcacagccttasagtcatcagaaagccagttttaaa

SEQ ID NO: 73400 - DNA, 50 bp, homo sapien
agctttctcttttggccttcaattargtttaaagtaaaaagaatgaagta

SEQ ID NO: 73401 - DNA, 50 bp, homo sapien
gaagttattattctaagttataggartacaagattgagtgaaaaaaaaaa

SEQ ID NO: 73402 - DNA, 50 bp, homo sapien
aactgtttaagacatgctgcattcaytaaggttatatgtgctgccaacaa

SEQ ID NO: 73403 - DNA, 50 bp, homo sapien
gtgtttaggagaaagagaatattaaragtgtgaattattaccaaaaaaaa

SEQ ID NO: 73404 - DNA, 50 bp, homo sapien
gggattatatgcatggaaaggaaacrcttttatttgcactttgtttcatg

SEQ ID NO: 73405 - DNA, 50 bp, homo sapien
tctccaaaagatagtatagcattcamtaggtagcaagtgggacattttat

SEQ ID NO: 73406 - DNA, 50 bp, homo sapien
gggctataaaagaatctagtacttayagaccaatataccaaagagaagca

SEQ ID NO: 73407 - DNA, 50 bp, homo sapien
aacttgaaaggctttgcctccgatarcattgatttttttctgaagtaaga

SEQ ID NO: 73408 - DNA, 50 bp, homo sapien
taaatagataatgaccagatgggcamgaagccaaaattaaatataaataa

SEQ ID NO: 73409 - DNA, 50 bp, homo sapien
cacagaagcaagctttattgagcttsaaacttgattttctcacaagatct

SEQ ID NO: 73410 - DNA, 50 bp, homo sapien
gaagaaaataagcattgtgtaataawaggcaagacactaagagaacgctt

SEQ ID NO: 73411 - DNA, 50 bp, homo sapien
gggtctggccaattacaagtacagargtccttcagaatcctgcaaattta

SEQ ID NO: 73412 - DNA, 50 bp, homo sapien
gcctgttctaataatccctctttcaygttttcttggaaataatctatagg

SEQ ID NO: 73413 - DNA, 50 bp, homo sapien
aaagcagaggcctctttaatgaaaargtagcagatatggggtaggattag

SEQ ID NO: 73414 - DNA, 50 bp, homo sapien
gtgggtcacactctactagtttccartgatggtacacatttttacgttat

SEQ ID NO: 73415 - DNA, 50 bp, homo sapien
gcctgagggcaagagcaaccattgayagaatgagcagtgcccaaaattat

SEQ ID NO: 73416 - DNA, 50 bp, homo sapien
gattgttctggcaagtacttccctaygttaaaaaggagctgtgagagtgg

SEQ ID NO: 73417 - DNA, 50 bp, homo sapien
agatagatttatcgtaaatatggcascgtatgtctaatctagatcaaagt

SEQ ID NO: 73418 - DNA, 50 bp, homo sapien
aagtctatatttggcattttttaacragaaatttataacatagaataaga

SEQ ID NO: 73419 - DNA, 50 bp, homo sapien
taccatgactgcatttgtcaaggaakaaatgggttaatgttaggaagcca

SEQ ID NO: 73420 - DNA, 50 bp, homo sapien
ggagattggcattgaacccaagacawccttaatttctcaatatctctata

SEQ ID NO: 73421 - DNA, 50 bp, homo sapien
agaaccagtactttaaaatctagccratacaggatgtatgacagtgtaat

SEQ ID NO: 73422 - DNA, 50 bp, homo sapien
acaagagtatctgaagagatttgaaytgtctattttgtaccacttaaatg

SEQ ID NO: 73423 - DNA, 50 bp, homo sapien
cattcattctccaattcctaaaatayggcttctgtctgggttacttctct

SEQ ID NO: 73424 - DNA, 50 bp, homo sapien
attttcagaaagatgtagtggtgaayagaagcgaacactacaaaaagatg

SEQ ID NO: 73425 - DNA, 50 bp, homo sapien
gattttaataagatagtttatgtgaragttaatcgcagtgagcaggaata

SEQ ID NO: 73426 - DNA, 50 bp, homo sapien
atgtacatacatgggtgctaaaatgraggaaattaatatgttgaagaact

SEQ ID NO: 73427 - DNA, 50 bp, homo sapien
aaggagagaaaggaattttataccayatgagacattagtaaagatcttgg

SEQ ID NO: 73428 - DNA, 50 bp, homo sapien
caatctacaaccctttctatggcaaycttgacagctcagtcattttcctc

SEQ ID NO: 73429 - DNA, 50 bp, homo sapien
aaaacctaaaagcgatcttccctgtktcataagtaagctcatgattgtaa

SEQ ID NO: 73430 - DNA, 50 bp, homo sapien
tttcaatattagcctccattttgccraaaccttctcaaaggggcaggtga

SEQ ID NO: 73431 - DNA, 50 bp, homo sapien
atgccacataaaggacaaggcacttygtagcacaatgatattaaaacttt

SEQ ID NO: 73432 - DNA, 50 bp, homo sapien
atctagtttaatagtacttctacaarcattatctcataccagtgggatgt

SEQ ID NO: 73433 - DNA, 50 bp, homo sapien
atttttcttttaagatataacaatgwcaaatcatgcaggccactgaatat

SEQ ID NO: 73434 - DNA, 50 bp, homo sapien
taaagccattctagtaatcccctagyagtggactgatgctcccaggctta

SEQ ID NO: 73435 - DNA, 50 bp, homo sapien
gggatcattccttctctgagtttccraacattgtattaactgtgctagta

SEQ ID NO: 73436 - DNA, 50 bp, homo sapien
atgagaaatcacttacctccactaaycacacatttattttataacaacag

SEQ ID NO: 73437 - DNA, 50 bp, homo sapien
tgcaggacatgtagagaaaccaaacygggaaatcttacaaggagttgaaa

SEQ ID NO: 73438 - DNA, 50 bp, homo sapien
ggtttcctcacaatggtacccactcragagcttgttttaagaattaaaag

SEQ ID NO: 73439 - DNA, 50 bp, homo sapien
ttggctttcagaattgatatgagaaytaaggcaccatctaaaacatagac

SEQ ID NO: 73440 - DNA, 50 bp, homo sapien
ttaacatataattcaaactctttaaygtgctctaatggatctgacatgat

SEQ ID NO: 73441 - DNA, 50 bp, homo sapien
actaaccaatctcttctcagggaccrctgggttatctcttaatcattgtc

SEQ ID NO: 73442 - DNA, 50 bp, homo sapien
tgcccaaaggttattcaaggttttarcaataaagctagtcggtagtgtca

SEQ ID NO: 73443 - DNA, 50 bp, homo sapien
tttgtaaagaaaccaggtatctttcmataacctcatttttttcatattag

SEQ ID NO: 73444 - DNA, 50 bp, homo sapien
tttaggatttagcagttagtaatagractgtgcctaaccaaacagaaaaa

SEQ ID NO: 73445 - DNA, 50 bp, homo sapien
cttgtaacttataggaactacaccarcttggcttttatcctttcctgcta

SEQ ID NO: 73446 - DNA, 50 bp, homo sapien
aagttgaggaacttgaggaaataaasttgagactctgtaatgctgctgga

SEQ ID NO: 73447 - DNA, 50 bp, homo sapien
agacctgggagtagagagtggaagcrctagttttgcataaaacaaaacaa

SEQ ID NO: 73448 - DNA, 50 bp, homo sapien
atggcacacatagttcaacatctcaraggaaatgattctgcttcagtaag

SEQ ID NO: 73449 - DNA, 50 bp, homo sapien
aagatgttaagtacaaaaatagtgamtacttagacgggatgttagtggtg

SEQ ID NO: 73450 - DNA, 50 bp, homo sapien
aaaaatgcaagtatgtgtgggaaaascatttgaagcagaaggaaaagaca

SEQ ID NO: 73451 - DNA, 50 bp, homo sapien
gttggattttatttgtactttggaamttcattatattttgaacaacacac

SEQ ID NO: 73452 - DNA, 50 bp, homo sapien
gattaaaaaactgaccatgtttcaaycatttgcagaaactgaaaacctgt

SEQ ID NO: 73453 - DNA, 50 bp, homo sapien
tagagtcctggtctttagagtagtgkaacattctgaaggattcctctagg

SEQ ID NO: 73454 - DNA, 50 bp, homo sapien
aattctggtttgtcactgacagaaayagtttgcaatatagtttgtatatt

SEQ ID NO: 73455 - DNA, 50 bp, homo sapien
gcctccatcacaagtctgggcctcaktaaatgtactaatttatctacaaa

SEQ ID NO: 73456 - DNA, 50 bp, homo sapien
caccattagcccattccaacacagaygtatagagctagctgatctagaac

SEQ ID NO: 73457 - DNA, 50 bp, homo sapien
aaggaaaatataattcaattaaacamaatgcaaagcttctcagacatgga

SEQ ID NO: 73458 - DNA, 50 bp, homo sapien
gataatattttaaaaaatcgatccaygtctgagaagctttgcattttgtt

SEQ ID NO: 73459 - DNA, 50 bp, homo sapien
ttgaataatggtctataacctctaaytgccagacatttgccataccagtt

SEQ ID NO: 73460 - DNA, 50 bp, homo sapien
tggaatctgagtatgaagtaggtcamattcagtctccctgatagtgccct

SEQ ID NO: 73461 - DNA, 50 bp, homo sapien
cactaaactcattcaaaaataaaacyatcacggaccagatgtaaatcaag

SEQ ID NO: 73462 - DNA, 50 bp, homo sapien
atttggggaatttgtactgttttgcmctagattctaaggactggtacaga

SEQ ID NO: 73463 - DNA, 50 bp, homo sapien
tctggcctctccatcagtaaacatastcaagtctctattttcacccccaa

SEQ ID NO: 73464 - DNA, 50 bp, homo sapien
ttattcaagataaaagaggaattggmaacctatcccaggcttgtttttgc

SEQ ID NO: 73465 - DNA, 50 bp, homo sapien
taatccattttggtagtgcatttaayaaaaatcatattactggcaggaca

SEQ ID NO: 73466 - DNA, 50 bp, homo sapien
taattaaagaatttaaaccctaatgratattgaatgaggaacagagaagg

SEQ ID NO: 73467 - DNA, 50 bp, homo sapien
tgaaccggatttcacattgggagagwccttcaagatatttatcaataaaa

SEQ ID NO: 73468 - DNA, 50 bp, homo sapien
taatgtgtttgaaagtgatgtaatamtacggacaaatacagatactgtaa

SEQ ID NO: 73469 - DNA, 50 bp, homo sapien
agattttaattctaagtatgacaccsgaaataggctgccacatgacatca

SEQ ID NO: 73470 - DNA, 50 bp, homo sapien
tttcctagatatattaggtaaagaayagcataaacacaagtatgatcacc

SEQ ID NO: 73471 - DNA, 50 bp, homo sapien
cctgtaaattctgcctggcttctcartctcttagctaccacttactgttt

SEQ ID NO: 73472 - DNA, 50 bp, homo sapien
atgatccagaggcaatcattgctatmaatttcatatacatccttccagag

SEQ ID NO: 73473 - DNA, 50 bp, homo sapien
ctaatcacgggttatagatcaatcamtactgaacagataaagtagatctt

SEQ ID NO: 73474 - DNA, 50 bp, homo sapien
tgccaccaaagtctgaaagttgttamatcaagtcgcattgtgttagtaac

SEQ ID NO: 73475 - DNA, 50 bp, homo sapien
ttggtaggcaagattgtgttgttctkgctgtcaataatcaaaggatttta

SEQ ID NO: 73476 - DNA, 50 bp, homo sapien
tgcaaccagacctcgttggttgtcaygtcatttttaatactgataaaatg

SEQ ID NO: 73477 - DNA, 50 bp, homo sapien
taaatgaagccatggaaactacagaraattggactccccctaaagcagag

SEQ ID NO: 73478 - DNA, 50 bp, homo sapien
tccaaaaatgacaattgcaaaaatamgattaaatcagtgatttattttgt

SEQ ID NO: 73479 - DNA, 50 bp, homo sapien
tataacaagtggaccaaatagatacratgttcacacactaatgctcttat

SEQ ID NO: 73480 - DNA, 50 bp, homo sapien
atttcactggacaagtctttgatgasagagttacacattgtctttattta

SEQ ID NO: 73481 - DNA, 50 bp, homo sapien
tcagctatctagaatacacgggtaamaaatgagactccatagttacattt

SEQ ID NO: 73482 - DNA, 50 bp, homo sapien
agcaatgaggcttgtagaagtttcargtgtgaattagatatgactttcat

SEQ ID NO: 73483 - DNA, 50 bp, homo sapien
tcctaaattttaccagggtatgacckaaaagcaaccatagtagaaacttt

SEQ ID NO: 73484 - DNA, 50 bp, homo sapien
taaaggaacttttgaggtagcattcmatctggactctgcctcacaaaaac

SEQ ID NO: 73485 - DNA, 50 bp, homo sapien
attaaaaagccttcctggaagcatamctaagtaaaggcaaatacatcaca

SEQ ID NO: 73486 - DNA, 50 bp, homo sapien
aaagatggacagtatcgtcttccaayacaaacactaatcaaaatgcttta

SEQ ID NO: 73487 - DNA, 50 bp, homo sapien
actcgtgagggaccttggagtctccyaaaatatggagttctgttttctag

SEQ ID NO: 73488 - DNA, 50 bp, homo sapien
cccttttaagatttccctagtggcayagtttccttacagttaaataattt

SEQ ID NO: 73489 - DNA, 50 bp, homo sapien
ttgtgatttctggtgatttctataamacgttagacatcaggctcttggtg

SEQ ID NO: 73490 - DNA, 50 bp, homo sapien
gaattacctgggccagtatagaaatraaattttcagattcttctaggcct

SEQ ID NO: 73491 - DNA, 50 bp, homo sapien
gagggcgaggggagagatttgataartgtgaacttcattacagtttttga

SEQ ID NO: 73492 - DNA, 50 bp, homo sapien
cctagggcagtgtgattatctgtgasgttagtagcatctacacagttagt

SEQ ID NO: 73493 - DNA, 50 bp, homo sapien
acaaatgtctgttttctaggagtggwacttcaacattacaatcttctaga

SEQ ID NO: 73494 - DNA, 50 bp, homo sapien
aatagaatcagctccctgaatggcaracttgtgttacaaccactcttgtc

SEQ ID NO: 73495 - DNA, 50 bp, homo sapien
ggacactcgattctgggatcaaaagsctcctccagtgattcccaggaagg

SEQ ID NO: 73496 - DNA, 50 bp, homo sapien
atttgtttcattcttggtccccaaayagtttcagcttgcctatagtctct

SEQ ID NO: 73497 - DNA, 50 bp, homo sapien
ctcatgggcagagactgattcagtaygaacactggaaatactcaaaaagt

SEQ ID NO: 73498 - DNA, 50 bp, homo sapien
gacaggtggacatcaaccctagggaraacagacaacttcaatgctgccta

SEQ ID NO: 73499 - DNA, 50 bp, homo sapien
tttctatgagaggtctgtgcaggagycctaattgttgcttctctggtgtt

SEQ ID NO: 73500 - DNA, 50 bp, homo sapien
ctcctacttaattcacaatagatgcycgaaatagtgaagggaaattctat

SEQ ID NO: 73501 - DNA, 50 bp, homo sapien
catacatatatgtcaagtctccctarctcaattgtaagccctacaatggt

SEQ ID NO: 73502 - DNA, 50 bp, homo sapien
attaataaaagacttcattttaaaastccttttctgatactgaaagcctg

SEQ ID NO: 73503 - DNA, 50 bp, homo sapien
cagaaaatagtgaatgagaagggtargagacttaggactcagcgaattct

SEQ ID NO: 73504 - DNA, 50 bp, homo sapien
tattctttaggtggttagagcacagsatgaaggaagcagggttgattggt

SEQ ID NO: 73505 - DNA, 50 bp, homo sapien
gggctatgttttatgcattttggctyagagataaaatattgcagatagta

SEQ ID NO: 73506 - DNA, 50 bp, homo sapien
cactgagtcctaaaatatcgcttaayggccctgggttcgcagctgacaag

SEQ ID NO: 73507 - DNA, 50 bp, homo sapien
atacaacgtgctggttgtgagggaaraataagctgaatatgatcacaaag

SEQ ID NO: 73508 - DNA, 50 bp, homo sapien
atatattttatgacatatttatgtasctattgcaagctattctgcttaat

SEQ ID NO: 73509 - DNA, 50 bp, homo sapien
ttgtattaatttctgagtcatgactraactccataatgattatcccatta

SEQ ID NO: 73510 - DNA, 50 bp, homo sapien
tgttaagcatttagtctcatcacaawttctgttttagaaaaaaacaacag

SEQ ID NO: 73511 - DNA, 50 bp, homo sapien
cagacaagtttgggatatgtaggccrcttactgtatttggaaaaggtagc

SEQ ID NO: 73512 - DNA, 50 bp, homo sapien
ccccttgtggtagagttctctattaygctgctcgctcgtgcctgatttgc

SEQ ID NO: 73513 - DNA, 50 bp, homo sapien
atgttccactaattaaactttggaakcatttaagactgtcttcaatgtgt

SEQ ID NO: 73514 - DNA, 50 bp, homo sapien
actttttgtattttctaatgcaatarcttcatcacaatttaatcagcaca

SEQ ID NO: 73515 - DNA, 50 bp, homo sapien
ttcacatttactgcatattcatgtgwaactattcctataggactgacaag

SEQ ID NO: 73516 - DNA, 50 bp, homo sapien
tataaatattacggtatattacatargtaacaaataaatacattcgtgat

SEQ ID NO: 73517 - DNA, 50 bp, homo sapien
gctttcttgaatggcaaatataaacrgctaatggggttagtgtggaatat

SEQ ID NO: 73518 - DNA, 50 bp, homo sapien
atgatcgcatccccagccattcagcratactgactccctcgtcccctgcc

SEQ ID NO: 73519 - DNA, 50 bp, homo sapien
tgctcactgccttctttccacgtctytcagtttctgtgtcaacactggac

SEQ ID NO: 73520 - DNA, 50 bp, homo sapien
taaatgtgctattaaaagttattccraaattgtataagattcctaaaatt

SEQ ID NO: 73521 - DNA, 50 bp, homo sapien
catattccatctaattgtgcattgawctggctagtttaatttagtatgtt

SEQ ID NO: 73522 - DNA, 50 bp, homo sapien
cccacaaatttgcgcaaataaaaaartaaaatactctattaatctcacca

SEQ ID NO: 73523 - DNA, 50 bp, homo sapien
tattatattcatgggccctaacaaaygagtgctggatttatcttctcagg

SEQ ID NO: 73524 - DNA, 50 bp, homo sapien
ccagaggcatggctaatgattataastagaattttggaaaaagcctctat

SEQ ID NO: 73525 - DNA, 50 bp, homo sapien
gaatacataaattaactacttcatamatgggttcatgcacagctatatag

SEQ ID NO: 73526 - DNA, 50 bp, homo sapien
tgtattttgaggtcatggttttctayatagctgtgcatgaacccatgtat

SEQ ID NO: 73527 - DNA, 50 bp, homo sapien
tctctgggaaaattagagattgcacrgtctttcaaatactaataatcata

SEQ ID NO: 73528 - DNA, 50 bp, homo sapien
attatcttaatcaatgactattctcyatgggtttatgtgccaataattta

SEQ ID NO: 73529 - DNA, 50 bp, homo sapien
tactttattgcagttgcccacaaaaycaattactacttattacagacaca

SEQ ID NO: 73530 - DNA, 50 bp, homo sapien
aaattataaaaccacctaattagtcycagtaaatacaaagagctatggga

SEQ ID NO: 73531 - DNA, 50 bp, homo sapien
acaataaataaatcaccagaaaataygtttctacctaaacattccattat

SEQ ID NO: 73532 - DNA, 50 bp, homo sapien
gcaactttccactttacaaaactaartgtaattccagccttgctttgctt

SEQ ID NO: 73533 - DNA, 50 bp, homo sapien
taaaaaaaaccctcccattattaagragacaattttagctcactaaatct

SEQ ID NO: 73534 - DNA, 50 bp, homo sapien
aattccaaattccatccttcctttawgttatacatttgaccaagttgaga

SEQ ID NO: 73535 - DNA, 50 bp, homo sapien
atttgccagatcctaagatagatgcyaggaatggatacaaagaacagttt

SEQ ID NO: 73536 - DNA, 50 bp, homo sapien
tgaattatatttggtatagaagtatytgaattttattctgtggatgatga

SEQ ID NO: 73537 - DNA, 50 bp, homo sapien
tgcattagttgcccttcatacaaaamcgaaactgctatggtacacagctg

SEQ ID NO: 73538 - DNA, 50 bp, homo sapien
tagtgatttatatacaatttacttcrattttatgaccttatttgttcttg

SEQ ID NO: 73539 - DNA, 50 bp, homo sapien
gttgctttgttttgtgttgtgcttakgtagtgctgttcagacaatagaat

SEQ ID NO: 73540 - DNA, 50 bp, homo sapien
ttaagaattaataaaggctttagcartgaacttttaagatagctaaagct

SEQ ID NO: 73541 - DNA, 50 bp, homo sapien
agcctgcttacagtgcctgttgatamggtctttaaactcagataagggcc

SEQ ID NO: 73542 - DNA, 50 bp, homo sapien
tgcatcactcatattaaatggctacygaacaagagggcttggaggcaaag

SEQ ID NO: 73543 - DNA, 50 bp, homo sapien
aaccttcaaggcaggagagttaggcraatacagcatctttgaacacttta

SEQ ID NO: 73544 - DNA, 50 bp, homo sapien
gtccctctgcctgaatgctcttccayactcttttcatggttcccttgttt

SEQ ID NO: 73545 - DNA, 50 bp, homo sapien
tttcaaagttgacagacaatcataasgttacatgtcaaatagtaatagta

SEQ ID NO: 73546 - DNA, 50 bp, homo sapien
agaggtgctcaacatgtagtataacygtctttctgttccacattaatctc

SEQ ID NO: 73547 - DNA, 50 bp, homo sapien
gaaatagtagtgtggtctttctgtamaatgttcaactgtgagtcagggct

SEQ ID NO: 73548 - DNA, 50 bp, homo sapien
ttttgctgaccaaatttgatggtaamctcataaagcctcgggagctggaa

SEQ ID NO: 73549 - DNA, 50 bp, homo sapien
aaaaaacaaatccctgtttcacatgrcagccctttatactttaagacagc

SEQ ID NO: 73550 - DNA, 50 bp, homo sapien
catatatgctcagatacccaaacaasaagtagtaaattgagtgccatcaa

SEQ ID NO: 73551 - DNA, 50 bp, homo sapien
tcaaaaccacttcaacttgattcagragcattattaatacactattagtg

SEQ ID NO: 73552 - DNA, 50 bp, homo sapien
ttctaaggtcatcagtttaatcaaaycaacaagcatttattgagcacagt

SEQ ID NO: 73553 - DNA, 50 bp, homo sapien
tccaatgaaatggtttaattgtataygatgtgctcattagcactgagttc

SEQ ID NO: 73554 - DNA, 50 bp, homo sapien
aacagacaatccctatgattaatccrtcttctatctacagataatatggt

SEQ ID NO: 73555 - DNA, 50 bp, homo sapien
accctaaaatttatcagatacaacartgacctctaaaaatccaacaaggg

SEQ ID NO: 73556 - DNA, 50 bp, homo sapien
atagtgtttttaatttagaaaaggarcgatataacatattattaattaca

SEQ ID NO: 73557 - DNA, 50 bp, homo sapien
ctcaaatagattgcaattataggaasgtaacttttagtagtagggggaaa

SEQ ID NO: 73558 - DNA, 50 bp, homo sapien
ttggattaccctgacacatactctcrtcttctgacaaaaccatttagaga

SEQ ID NO: 73559 - DNA, 50 bp, homo sapien
tgtgactctgccattcctatgactaytactgagccagggggtctgtgcct

SEQ ID NO: 73560 - DNA, 50 bp, homo sapien
ccaggatatcttcatggttatttcarctctgactttagtatcaccttatc

SEQ ID NO: 73561 - DNA, 50 bp, homo sapien
tgcttacatgcagcactttatttcartaacacataaaaatggggtaagag

SEQ ID NO: 73562 - DNA, 50 bp, homo sapien
tttgcatataacttagtatccaaacrggaccttttttgttgttgttgttg

SEQ ID NO: 73563 - DNA, 50 bp, homo sapien
acaatagaatttgtataaatccagamctgaaacattttagaataaagaaa

SEQ ID NO: 73564 - DNA, 50 bp, homo sapien
tagtcaaaagaattggaaagacctaygtccaatctttgctctgccatttg

SEQ ID NO: 73565 - DNA, 50 bp, homo sapien
tgttaactctctcctttaaaggtacyctatcaatcatttaacattgaagt

SEQ ID NO: 73566 - DNA, 50 bp, homo sapien
gtcagcacggtcaaaacttcagaagratcttgtgctctgaggctttccaa

SEQ ID NO: 73567 - DNA, 50 bp, homo sapien
ccaatgtttcatcattatggaaattstagcactcttaagaattatgctaa

SEQ ID NO: 73568 - DNA, 50 bp, homo sapien
taacaagttaatctttaggttcatayggaaatcaaaggatatcgaataac

SEQ ID NO: 73569 - DNA, 50 bp, homo sapien
ccataacctgggacatttgccagacraccaagaaaggacacaaaagaaat

SEQ ID NO: 73570 - DNA, 50 bp, homo sapien
gaccactggaagtacaagtgagatcraacctggagcaaagacataatatt

SEQ ID NO: 73571 - DNA, 50 bp, homo sapien
gccgtaataccataaaagcctcccasaaaatcagagttgggtattccaaa

SEQ ID NO: 73572 - DNA, 50 bp, homo sapien
gctaaacacaaagaaaattgaataayaatggtagctaagccctatttaac

SEQ ID NO: 73573 - DNA, 50 bp, homo sapien
ctcacagataaacacagaaaagcackgttggctgtagccatccaccctca

SEQ ID NO: 73574 - DNA, 50 bp, homo sapien
aaatatggaagttacaaatgtaagaratactgcttttgcttttatcttcc

SEQ ID NO: 73575 - DNA, 50 bp, homo sapien
agagcagaagagggtcagcatggacraacatcggagcaggaagaccagga

SEQ ID NO: 73576 - DNA, 50 bp, homo sapien
tggataaatattcattgactgaacarcgaatgaagagttagtagaaagct

SEQ ID NO: 73577 - DNA, 50 bp, homo sapien
tagtttttgtgaactgagtaggtagraaaaaaattgagagtctaaattta

SEQ ID NO: 73578 - DNA, 50 bp, homo sapien
acgaaagcatggtgtttaatcctggkttagcaaaaatggggggaatacaa

SEQ ID NO: 73579 - DNA, 50 bp, homo sapien
gcccaaatcagacccaacttctttakacattgtgattcccaacccttcac

SEQ ID NO: 73580 - DNA, 50 bp, homo sapien
ttggttctcttcactctttgctatcycagaacaattctgagttttcttgc

SEQ ID NO: 73581 - DNA, 50 bp, homo sapien
actctagtcaaatgcgagtaacattkaaaagtatcaatattcaaaagcat

SEQ ID NO: 73582 - DNA, 50 bp, homo sapien
atggtctatcaaagaaattatagcaraaagtattggacatttcagcatac

SEQ ID NO: 73583 - DNA, 50 bp, homo sapien
aactatacctttagtttcttaaaatytcattgaatcttacagtattgcag

SEQ ID NO: 73584 - DNA, 50 bp, homo sapien
acatttattaattacataaagaaaawgagtaaaccctggtagataatact

SEQ ID NO: 73585 - DNA, 50 bp, homo sapien
acagaattctactcatatcaaacaaygagtggagtttcagaaggcaaaca

SEQ ID NO: 73586 - DNA, 50 bp, homo sapien
tgaatataccatgtggcttttgtctyaattaactagcactctaattcttg

SEQ ID NO: 73587 - DNA, 50 bp, homo sapien
atgacgtttacagtctaatagaggaratagacaataaacaaatcattgca

SEQ ID NO: 73588 - DNA, 50 bp, homo sapien
tgtaataattatttgtattagctcargtaggtagaaataaactaaaagac

SEQ ID NO: 73589 - DNA, 50 bp, homo sapien
atccagacccaaccatttggaaattrtgttttactcatttttgtttttaa

SEQ ID NO: 73590 - DNA, 50 bp, homo sapien
acgaaaagatacttttctctatgacratgtgatgcttctacttgataatt

SEQ ID NO: 73591 - DNA, 50 bp, homo sapien
attagtacataaagctaacaactgcmattccaggagacataggaaaatta

SEQ ID NO: 73592 - DNA, 50 bp, homo sapien
gatgaaaaaaagttggcattcttaarccttgactaaatgtgtaagagttc

SEQ ID NO: 73593 - DNA, 50 bp, homo sapien
gtgcccagtgaatgttgttgaagaartgagtatttggtaataatcaaaat

SEQ ID NO: 73594 - DNA, 50 bp, homo sapien
aataataggtagtcttcattgtgtcrtcttcattgaaaaagggaagattt

SEQ ID NO: 73595 - DNA, 50 bp, homo sapien
gctttccctctagagatcaagaacartaacaaagtcaatgtaaagtcatt

SEQ ID NO: 73596 - DNA, 50 bp, homo sapien
aaaagaagagtctttccttgagtgaytgacctctcttagccttttaatct

SEQ ID NO: 73597 - DNA, 50 bp, homo sapien
agggcttaaaaactgctaaactctgmagttgtacaatttgtgcaaattaa

SEQ ID NO: 73598 - DNA, 50 bp, homo sapien
atataaatagacatttggagaagagsaatatgatcctagaaccagtaact

SEQ ID NO: 73599 - DNA, 50 bp, homo sapien
cagagcagaaacttagattgtcttcrccagatcatttgtatttatctgtt

SEQ ID NO: 73600 - DNA, 50 bp, homo sapien
agtgctttgggatccatttggttgaraggttgttaattatgatgatttat

SEQ ID NO: 73601 - DNA, 50 bp, homo sapien
tctgtggtcttagcataattattaawagcatcttctttcactctcagagt

SEQ ID NO: 73602 - DNA, 50 bp, homo sapien
actctaaacagagggaatggtatcartaaagagatgaaggcatcaagtgt

SEQ ID NO: 73603 - DNA, 50 bp, homo sapien
caggtgacagggctgctgtgtagaaytgataatatggactttgtgtgagg

SEQ ID NO: 73604 - DNA, 50 bp, homo sapien
gcatttctagaagagtatgtgaaaayaggggtcacaacataaaaaatctg

SEQ ID NO: 73605 - DNA, 50 bp, homo sapien
agcaatcaaacaaagcagaccttccrcagttgaagaaggctcatgaccag

SEQ ID NO: 73606 - DNA, 50 bp, homo sapien
atctactcataagaatctaagcataygtgctccaaggtccagaaagagaa

SEQ ID NO: 73607 - DNA, 50 bp, homo sapien
aatttaaagctaaagggcagtggtcsaattaaactgtcttcaataaaagc

SEQ ID NO: 73608 - DNA, 50 bp, homo sapien
tatggttatatcaaaaggaatctgaygaaatttactatccattcacaaaa

SEQ ID NO: 73609 - DNA, 50 bp, homo sapien
acataatcgttgcaaagtctttttamagtaacagctgcaaaacttctaaa

SEQ ID NO: 73610 - DNA, 50 bp, homo sapien
acttccatagtacccttctctgaacrcttacaacacctacagttatttat

SEQ ID NO: 73611 - DNA, 50 bp, homo sapien
acaattaaataacatttcagtaaaakgaaagagtaagccaagaaagggtc

SEQ ID NO: 73612 - DNA, 50 bp, homo sapien
atataacctaggaatgaccctaaaaygaagagaaaataatcttacttttt

SEQ ID NO: 73613 - DNA, 50 bp, homo sapien
tgtgtgctgtaaacataaaatgctgraatgaatgtgtgaaaatttatatg

SEQ ID NO: 73614 - DNA, 50 bp, homo sapien
gagccttaaaagtgacttagaaaccrgtttagagaactgcatcaacttta

SEQ ID NO: 73615 - DNA, 50 bp, homo sapien
atactggcactttctttacagttcayaaattcagattagaaccttgtgtc

SEQ ID NO: 73616 - DNA, 50 bp, homo sapien
ggaaggctcacctaattatttctgcsaggacctcatcaagttacaaagaa

SEQ ID NO: 73617 - DNA, 50 bp, homo sapien
taatttcagttaagaaaatatagaarttactcccacgtatgaaaagcagt

SEQ ID NO: 73618 - DNA, 50 bp, homo sapien
aaaaataacaaaatcaaacaggagarcaacgttacacagaatcatagttg

SEQ ID NO: 73619 - DNA, 50 bp, homo sapien
tttttaggtaaaactctttcaataarcacagtcattataccgttaaaaaa

SEQ ID NO: 73620 - DNA, 50 bp, homo sapien
tagcttgacatgacttcttagcttcrtaatgcaatgttttatacctgggt

SEQ ID NO: 73621 - DNA, 50 bp, homo sapien
tattaaggacattacttgtaatagcraaatgtccttcactttatttgagc

SEQ ID NO: 73622 - DNA, 50 bp, homo sapien
aggattctagacatagacacaaatamaacttctcaattctttagttgaga

SEQ ID NO: 73623 - DNA, 50 bp, homo sapien
tagttttgattggttcttctcaatakaaatgtattttggactagtcacta

SEQ ID NO: 73624 - DNA, 50 bp, homo sapien
ttgcaaaataaggaacaataaattaycttcaactatatctatttcaacca

SEQ ID NO: 73625 - DNA, 50 bp, homo sapien
actaatttgcagtataaaaattaccraagtcatagggtgcgaatgagctg

SEQ ID NO: 73626 - DNA, 50 bp, homo sapien
attaataagctgaaagtatggcacaycaatatttagataggtcatccaaa

SEQ ID NO: 73627 - DNA, 50 bp, homo sapien
ggtgggatacggaaaatccacctaascaagaaggctgcttggcagaggac

SEQ ID NO: 73628 - DNA, 50 bp, homo sapien
taaaatccaaatgattacagatagcmcttaaattagttgacctgtttggg

SEQ ID NO: 73629 - DNA, 50 bp, homo sapien
cttctttcttacacaaaagatgacasaaaattttttacatcttgtttttt

SEQ ID NO: 73630 - DNA, 50 bp, homo sapien
ttcagtgtaagcacatagtgtaacawcttgtctaatgtattttgggctat

SEQ ID NO: 73631 - DNA, 50 bp, homo sapien
agctacatcaattgtatggtaaatgwaattatgtgggtcagagacaccac

SEQ ID NO: 73632 - DNA, 50 bp, homo sapien
agaaaccagaaatgatctagtaagaytaaattgtgcctaaagtaatggaa

SEQ ID NO: 73633 - DNA, 50 bp, homo sapien
atagttcctgataaaaacttacacaktcatgcagtctggatgatccatat

SEQ ID NO: 73634 - DNA, 50 bp, homo sapien
tgtcatcagcaatcttcttcagggartatgctcttaatgacactcagatt

SEQ ID NO: 73635 - DNA, 50 bp, homo sapien
agttgaaccacttactaactcagagrcaaaatacttataatgactataat

SEQ ID NO: 73636 - DNA, 50 bp, homo sapien
acaggcctctaatacatgtgtaccaytccatttctaaagtacgaatatat

SEQ ID NO: 73637 - DNA, 50 bp, homo sapien
ctggcatggtcttatgcaagtataawataatgtgctacaatttgattagg

SEQ ID NO: 73638 - DNA, 50 bp, homo sapien
tgccaaaaggcagaagcaactctgaygatggttacataggtaaactaaat

SEQ ID NO: 73639 - DNA, 50 bp, homo sapien
ttctgtagttatagttgtatatctaygtatcagtaaatcactcacgctgt

SEQ ID NO: 73640 - DNA, 50 bp, homo sapien
ctgtaatttaattacagcaacattgycttccagtgtgcatctgcagtata

SEQ ID NO: 73641 - DNA, 50 bp, homo sapien
ttttcaaaaggaatttactatccaaraggttgagtttgggaaacgagcca

SEQ ID NO: 73642 - DNA, 50 bp, homo sapien
aactatggcaatgtgatatttcacaytataaagcatatactacatgcatg

SEQ ID NO: 73643 - DNA, 50 bp, homo sapien
ggtagtgggaaaagacatagttcccraattcttctggagtctatagtgta

SEQ ID NO: 73644 - DNA, 50 bp, homo sapien
gtgggaagatgctgaataccatccaygtatttgaggcattcctcttcaga

SEQ ID NO: 73645 - DNA, 50 bp, homo sapien
catgagaatcacatttccctttgtgsatctctgagaattggagaataaga

SEQ ID NO: 73646 - DNA, 50 bp, homo sapien
tgggactcaggctaggtcatcctcgyagtagctgtaaagttttctgaatt

SEQ ID NO: 73647 - DNA, 50 bp, homo sapien
aaatgtagtctagaaagtaattgtgragttttctcatgtttgaattaatg

SEQ ID NO: 73648 - DNA, 50 bp, homo sapien
ttttttgaaattcagttcataagaayggtggctaagttagtgcaggaaca

SEQ ID NO: 73649 - DNA, 50 bp, homo sapien
taataatgcatgcttcgtaagtgaaragtaaagaaagagaagataagaac

SEQ ID NO: 73650 - DNA, 50 bp, homo sapien
gaggtggtggggacagttaggaagayggctctcgcactaggcctcagtgt

SEQ ID NO: 73651 - DNA, 50 bp, homo sapien
caataacaacttctccctgaaatcckaactgttcagagcagggtgaaagt

SEQ ID NO: 73652 - DNA, 50 bp, homo sapien
tttttgacatatttcgacattttacygacttaagagaaagcgaatgaaat

SEQ ID NO: 73653 - DNA, 50 bp, homo sapien
gatttcaccactctactcagaaaagmatgcaacataaaacatatagttta

SEQ ID NO: 73654 - DNA, 50 bp, homo sapien
actaataatagtgaaatttactgaakggtcattgtatgctatgcatgccc

SEQ ID NO: 73655 - DNA, 50 bp, homo sapien
ctttacctaatttctccagtacttamctttatcatttgtaaaaatttcct

SEQ ID NO: 73656 - DNA, 50 bp, homo sapien
ctttatatacttgtaactgtattccrctaaaagatatagagatatagtta

SEQ ID NO: 73657 - DNA, 50 bp, homo sapien
tgacagtaaaagctacttaatccctsaatctcagttaaggtggtatgttg

SEQ ID NO: 73658 - DNA, 50 bp, homo sapien
ttttgcatctgcctaaattattctgyatcttgcattccctgaatgaacca

SEQ ID NO: 73659 - DNA, 50 bp, homo sapien
tagctgtgccttttataagagttgamcatattagtgattttcctgccaca

SEQ ID NO: 73660 - DNA, 50 bp, homo sapien
agagaactaggttgcacaataatgcrctaaaaagttgtttccaagttaat

SEQ ID NO: 73661 - DNA, 50 bp, homo sapien
ttttcttctaagtactttgtttttayagaggcactgtcacaatcaatcta

SEQ ID NO: 73662 - DNA, 50 bp, homo sapien
cataaattaactgagcatgacttaaytgagagcaaaaataggaacaggtt

SEQ ID NO: 73663 - DNA, 50 bp, homo sapien
catttggatctagagttggtattctsacaaataaatttacttccttttcg

SEQ ID NO: 73664 - DNA, 50 bp, homo sapien
agaagacaaatgacacctggctgtaraacttaacaagatatgttgtccat

SEQ ID NO: 73665 - DNA, 50 bp, homo sapien
cttggagagcagacagaaactcaaaygggtcagtaggctgcacagcatag

SEQ ID NO: 73666 - DNA, 50 bp, homo sapien
acagaaggcagtggaatgatgcaaartactgaaattaaaaataatctgtc

SEQ ID NO: 73667 - DNA, 50 bp, homo sapien
aactgttgaagctgtgtgaaaccacygagagagtatggaaagtgggatga

SEQ ID NO: 73668 - DNA, 50 bp, homo sapien
tgaattttagggggatgcagttcaartcataaaagtgagtgtaccatcaa

SEQ ID NO: 73669 - DNA, 50 bp, homo sapien
tcattttattgtttatttagtatgarctttgcatatgtaggttgtagagg

SEQ ID NO: 73670 - DNA, 50 bp, homo sapien
aacagaatctgttaggaggactcaaygaatctatattataaatatattcc

SEQ ID NO: 73671 - DNA, 50 bp, homo sapien
cccaaaaattccttcttgggattacraaaaatgactaactgattataaat

SEQ ID NO: 73672 - DNA, 50 bp, homo sapien
cagtaagaaaaaggtttgattccaartgctctggaaagaaaattagatcc

SEQ ID NO: 73673 - DNA, 50 bp, homo sapien
acgatgagagcaaagttgtccattasggaaaagatctgtggattattgga

SEQ ID NO: 73674 - DNA, 50 bp, homo sapien
agcagcaagtaccaacagaactaaasaaattgaaagtggccattttctaa

SEQ ID NO: 73675 - DNA, 50 bp, homo sapien
atcggggagatgtctttccccaaacyacttgttacctgcttcacaatatg

SEQ ID NO: 73676 - DNA, 50 bp, homo sapien
tctatatttcacaacatacaacttayaccactattgactgaaaatggggc

SEQ ID NO: 73677 - DNA, 50 bp, homo sapien
cattctaactttaatcagtgatttayagcaggaaatataaagcatttgta

SEQ ID NO: 73678 - DNA, 50 bp, homo sapien
catctccttaccttgatagtgtaggwatttatcacgtgttatcctatgaa

SEQ ID NO: 73679 - DNA, 50 bp, homo sapien
actattttttcaaataggctgataawtccaccaaaaggaaatatatcaaa

SEQ ID NO: 73680 - DNA, 50 bp, homo sapien
tggacagggaagcactacaatcaaaygtgtggagatatgagggaacagat

SEQ ID NO: 73681 - DNA, 50 bp, homo sapien
gaagttaccatttttttctatcctakctaatcttcctcttaattttcatg

SEQ ID NO: 73682 - DNA, 50 bp, homo sapien
aatatctaaaaaattggaattccaartaaagatggcacagtgaaatccga

SEQ ID NO: 73683 - DNA, 50 bp, homo sapien
attccaagtaaagatggcacagtgamatccgaacaccaaaatctacttat

SEQ ID NO: 73684 - DNA, 50 bp, homo sapien
aaaaggcgacttgtagtgtatgttasgcaaaaagagggtggggtggagtg

SEQ ID NO: 73685 - DNA, 50 bp, homo sapien
ctgaggaaactgtaatatcctgaaarcctcataaatttccctaagaggag

SEQ ID NO: 73686 - DNA, 50 bp, homo sapien
ttcaaccctgaatagatagtaatggrcatgacaaatgctcactgttaaga

SEQ ID NO: 73687 - DNA, 50 bp, homo sapien
ggtgtataaattagttgtctcaatamataagtcaaaacatactaaacatc

SEQ ID NO: 73688 - DNA, 50 bp, homo sapien
tgataacatctttcctatatatttcmaacacaactttagaaatcttcacc

SEQ ID NO: 73689 - DNA, 50 bp, homo sapien
gaactactagaaatttttcttggtasagagcccttagtttttctaacatt

SEQ ID NO: 73690 - DNA, 50 bp, homo sapien
tagctgagaccaagagaatattgtayagaccttgttagaataactcttag

SEQ ID NO: 73691 - DNA, 50 bp, homo sapien
ctagtataatcttgcaaaaatgatamaaataaggcactaacaagatacca

SEQ ID NO: 73692 - DNA, 50 bp, homo sapien
ttaaatagcagattttctctttcctraagtgcctcagattaatttcttaa

SEQ ID NO: 73693 - DNA, 50 bp, homo sapien
attcaactgactatgttgaagttaamctggagttatgaataaaatattga

SEQ ID NO: 73694 - DNA, 50 bp, homo sapien
ttcctttcagaatatgttttgctcaratttattaaatgttactcgctttt

SEQ ID NO: 73695 - DNA, 50 bp, homo sapien
tacaaaaattagagataaaatgttaragcttactctgttctacattataa

SEQ ID NO: 73696 - DNA, 50 bp, homo sapien
gctattaaggaactagagttgataartaaatgtgtataggttccttttgc

SEQ ID NO: 73697 - DNA, 50 bp, homo sapien
tgcaaatgtcctatacaatcgtcatraaaaatttacatcatttataaagt

SEQ ID NO: 73698 - DNA, 50 bp, homo sapien
ttacaaccagttggccataaatccartccaagaaaaatactgagggaagg

SEQ ID NO: 73699 - DNA, 50 bp, homo sapien
gccaactttcaaatacaaggagagaygcaggctggcaaattgaagatgac

SEQ ID NO: 73700 - DNA, 50 bp, homo sapien
ttatatatttttaagtcttcctacarattgtctaaacttgacaaaactag

SEQ ID NO: 73701 - DNA, 50 bp, homo sapien
gatcatatatctgatttacctgggayagtctactttatattttgttagat

SEQ ID NO: 73702 - DNA, 50 bp, homo sapien
attggaaccaccttcttagttggacmtttccactcagacaccttagttga

SEQ ID NO: 73703 - DNA, 50 bp, homo sapien
tatggcaagacatttttagtagttgkaagtctattgcctgaatctgctga

SEQ ID NO: 73704 - DNA, 50 bp, homo sapien
ccacatgcagaaaactgaagctagayctctaccttataccatataaaaaa

SEQ ID NO: 73705 - DNA, 50 bp, homo sapien
caacaaaaatcttaatgggtaattcyaatgtacaactaagttttaatatc

SEQ ID NO: 73706 - DNA, 50 bp, homo sapien
ctcactgatcatcttcctctcaaaaycttccattatgctttctggaggac

SEQ ID NO: 73707 - DNA, 50 bp, homo sapien
gatgctacaaatctcagaggaatgaygctgcaaatctcatatgaagatgc

SEQ ID NO: 73708 - DNA, 50 bp, homo sapien
aatccgagtctggccaagattaaatractcttcttagggtcacacattca

SEQ ID NO: 73709 - DNA, 50 bp, homo sapien
agattatctttgtcatcataattacyatctaatctttcattgcttttata

SEQ ID NO: 73710 - DNA, 50 bp, homo sapien
attcctttgtaggtaaagacattaarattgttaccttttactgcatttat

SEQ ID NO: 73711 - DNA, 50 bp, homo sapien
atgcaagggaagagctgacaagacaragctaatagaaaataaatgcagta

SEQ ID NO: 73712 - DNA, 50 bp, homo sapien
tcacatttgaagcatgtttttgcacrctacttgcaccctctattttaaat

SEQ ID NO: 73713 - DNA, 50 bp, homo sapien
tcctcctttgtgtgattgttttataygactttgagttttatatttttgtg

SEQ ID NO: 73714 - DNA, 50 bp, homo sapien
cgagagaaaagtccaatgtctctcastataaatcaaaaactagacatgat

SEQ ID NO: 73715 - DNA, 50 bp, homo sapien
ccttgaacattttcacctaaagttcwatttaagattccattcaaatgtta

SEQ ID NO: 73716 - DNA, 50 bp, homo sapien
atccatgaatatagagatatatgaaktatggctatgtttatatttgtttt

SEQ ID NO: 73717 - DNA, 50 bp, homo sapien
ccctcagccatggtccagtagcatcmatttccctatcccagcttttcctt

SEQ ID NO: 73718 - DNA, 50 bp, homo sapien
cccattaaatcagtcttttacagaamcttttgggagctagtattctgaag

SEQ ID NO: 73719 - DNA, 50 bp, homo sapien
tgcttaaaacaatcaattaatgtaawctaccaaatcaacagactaaagaa

SEQ ID NO: 73720 - DNA, 50 bp, homo sapien
actgaggatgaaacaattccctctcmatattgcacatactttacaaggtg

SEQ ID NO: 73721 - DNA, 50 bp, homo sapien
agtattctgaaggatacataatgaaraagaaatactgtgcttagatgtct

SEQ ID NO: 73722 - DNA, 50 bp, homo sapien
ccccagaacagcacaatgtagtcgamaaagcagattcacaaagataaagt

SEQ ID NO: 73723 - DNA, 50 bp, homo sapien
cctgtaacaaagtttcactaagtaastgttcatccaatgaaagaatatat

SEQ ID NO: 73724 - DNA, 50 bp, homo sapien
aagtactgaggagatgaagtgttcartaatcgtccacttacatcttattg

SEQ ID NO: 73725 - DNA, 50 bp, homo sapien
attaatgatcctaagataagtaacawcagtgaattgaaaataaagcaact

SEQ ID NO: 73726 - DNA, 50 bp, homo sapien
tcctggaaatatgtattccaaaacamactagttaagttctgcctgctttt

SEQ ID NO: 73727 - DNA, 50 bp, homo sapien
aatgagccttagcagccttcacctasatttcagaggatgaaatctctgaa

SEQ ID NO: 73728 - DNA, 50 bp, homo sapien
ggcttgactgatttttgctactcaayggatttcagcctgccacttaacca

SEQ ID NO: 73729 - DNA, 50 bp, homo sapien
atatcattctgtatgtatcttgtaarttgagacagctctattttaattat

SEQ ID NO: 73730 - DNA, 50 bp, homo sapien
gaagaactatcattgagctgagaaargtttacaagaatctcaaacacaca

SEQ ID NO: 73731 - DNA, 50 bp, homo sapien
ccactggccagataaacagattataragaaaacatttaatccatcacaaa

SEQ ID NO: 73732 - DNA, 50 bp, homo sapien
gcctattatgagaacttgcagattakacagtttactcaatctactgaagg

SEQ ID NO: 73733 - DNA, 50 bp, homo sapien
taattaggtttgagagtcactgtcayagaggtagcagaagttctgaatat

SEQ ID NO: 73734 - DNA, 50 bp, homo sapien
tttaggtgcagtcatacactcatackgaagaaaaggaactgcctcgcaga

SEQ ID NO: 73735 - DNA, 50 bp, homo sapien
aaaagtttgtggtgtaatacagtacmggtatgttttaaatgactacaatt

SEQ ID NO: 73736 - DNA, 50 bp, homo sapien
tgaggaaaatgttcatcttgctttcyaggactttcaatcaatatttcttg

SEQ ID NO: 73737 - DNA, 50 bp, homo sapien
tcgcatagcacttggcatcaatccaygaagaacagtacctacagccagag

SEQ ID NO: 73738 - DNA, 50 bp, homo sapien
gccttctcacatatacctatttatamgctaaatctgactcacaaacatag

SEQ ID NO: 73739 - DNA, 50 bp, homo sapien
acgaattataaataaacatgcaaaamagtttatgtaagttagagcaaaaa

SEQ ID NO: 73740 - DNA, 50 bp, homo sapien
gctgtggtattcagtgtagtacaaartcctgagaaggttttgtaatggaa

SEQ ID NO: 73741 - DNA, 50 bp, homo sapien
ggacttggcttatgcttagagtaagyacttaattggatcaataagaaaag

SEQ ID NO: 73742 - DNA, 50 bp, homo sapien
tggcaacaattgtaatttaccttagycatttgttgcaacttaatatgtgt

SEQ ID NO: 73743 - DNA, 50 bp, homo sapien
ggaagagacacgaacactctttaaamagctgatcaatgttagtctttgta

SEQ ID NO: 73744 - DNA, 50 bp, homo sapien
tcaagactaggttcgtattagaatcrcctgaggagtttaaaaactgctaa

SEQ ID NO: 73745 - DNA, 50 bp, homo sapien
tctgggagcacagtgttgaggatcamggaaactttttaaggcccagtggg

SEQ ID NO: 73746 - DNA, 32 bp, homo sapien
tcacctctagataaaastatttaattgccgct

SEQ ID NO: 73747 - DNA, 50 bp, homo sapien
gccaacaatctgtatcttacacaacrccattcttgactgcatgcattgta

SEQ ID NO: 73748 - DNA, 50 bp, homo sapien
tcatgcctgtaatctcaacactttgraaacccaaggcaggaggattgctt

SEQ ID NO: 73749 - DNA, 50 bp, homo sapien
ctattgtaagtctactctttctatakaattcctggaaattatacaatgtc

SEQ ID NO: 73750 - DNA, 50 bp, homo sapien
cataatttgtaatttaacaagtgacrgaatattttgacattagtaaatga

SEQ ID NO: 73751 - DNA, 50 bp, homo sapien
ttaaaacattctctgggaatgagggwataaagttataggatagaccgcca

SEQ ID NO: 73752 - DNA, 50 bp, homo sapien
cccagtgtgtcagagattaagatacyataccacgctatttcatgaattcc

SEQ ID NO: 73753 - DNA, 50 bp, homo sapien
caaagagtgtcttctgagtgtcctamaccacttaattagcaaagtgtcat

SEQ ID NO: 73754 - DNA, 50 bp, homo sapien
ttttactttgtgagttgaaagagtamaaacactaagtcagaaaactgctt

SEQ ID NO: 73755 - DNA, 50 bp, homo sapien
tgacaccagctggcaacagctctcarcatttaaggactcaattatattag

SEQ ID NO: 73756 - DNA, 50 bp, homo sapien
tagccacttaagaattgtgttgccaytgagtttctatttcaaaatataaa

SEQ ID NO: 73757 - DNA, 50 bp, homo sapien
atctagttaaagctaacaaagtggayggtgcaacccctcaagatatttga

SEQ ID NO: 73758 - DNA, 50 bp, homo sapien
acacagacatcccatatagagcctaygattagctaaagatgccttcagag

SEQ ID NO: 73759 - DNA, 50 bp, homo sapien
aaccagctgaggctagcccaaattgytgacccataaaatcataaacaaat

SEQ ID NO: 73760 - DNA, 50 bp, homo sapien
agtgcttttataaacatacagatatmagacatggcagttcatagagtacc

SEQ ID NO: 73761 - DNA, 50 bp, homo sapien
atcccttttccacaaaatataacaartctttctgtcatatttgtacttgt

SEQ ID NO: 73762 - DNA, 50 bp, homo sapien
ttatctggagtgaaaatcagattgtmaaatgaaatgaagtgcacttttca

SEQ ID NO: 73763 - DNA, 50 bp, homo sapien
taattatctaaagcccaaatcaactraagaagtcaaggatgcatagaaat

SEQ ID NO: 73764 - DNA, 50 bp, homo sapien
tttaaactttagtatacaagaaataycactaggttgtgttaagatgtaag

SEQ ID NO: 73765 - DNA, 50 bp, homo sapien
atattaaaaaatcaagatgtattagraaacacaatgatgggtttttttca

SEQ ID NO: 73766 - DNA, 50 bp, homo sapien
ctgattttactgtaataacatcaaaytttatattctaaccatttgcaagg

SEQ ID NO: 73767 - DNA, 50 bp, homo sapien
ccttctccgttcttcattcctacacyctaaacttatatacctttggtgga

SEQ ID NO: 73768 - DNA, 50 bp, homo sapien
ccatttcttcagcaaaaattggctaygtcacattttcatgctccatcaaa

SEQ ID NO: 73769 - DNA, 50 bp, homo sapien
agagtttaaaagtaatttaagaacgwaacaaattagagacagggaacttt

SEQ ID NO: 73770 - DNA, 50 bp, homo sapien
tatataacttaaatgttatgaaataytaaagttatgagatactattgtta

SEQ ID NO: 73771 - DNA, 50 bp, homo sapien
aattttaatgcatttctacttcataygaggaactgtgattacataaacat

SEQ ID NO: 73772 - DNA, 50 bp, homo sapien
tgctacaattgctgttattttgataytataaaaatgagcaaatgtataaa

SEQ ID NO: 73773 - DNA, 50 bp, homo sapien
atttgcttggcaaattcactaattcycttgacatctgcatgcaaatcttg

SEQ ID NO: 73774 - DNA, 50 bp, homo sapien
cattatcaacatttcataggaataargctaaagagtacactggtttatga

SEQ ID NO: 73775 - DNA, 50 bp, homo sapien
gaaagcaaggttacagaagtataaakaaaatgtctatctctaacaaataa

SEQ ID NO: 73776 - DNA, 50 bp, homo sapien
ataaagtcccttgttgctcaatccaytctctagtcaccgtcagcccttat

SEQ ID NO: 73777 - DNA, 50 bp, homo sapien
acctaataaataacattttctcttawaggtttgtgtaattagatcaacca

SEQ ID NO: 73778 - DNA, 50 bp, homo sapien
cttttcctgctgggctggccattagrcgtgttcaaagagcaagtgttcta

SEQ ID NO: 73779 - DNA, 50 bp, homo sapien
gataattggtcttagaggaaatatgragctaggttcctgcgagccctctg

SEQ ID NO: 73780 - DNA, 50 bp, homo sapien
ccctgctgatcaccatagaattatasaagtcagattttctgctagttcat

SEQ ID NO: 73781 - DNA, 50 bp, homo sapien
gcaatgtggtcatatgttcctaagawgcacaattattgaaaactttaatt

SEQ ID NO: 73782 - DNA, 50 bp, homo sapien
ttcccatctttgcccaccctcacttstgtggctactgttctctcggcttt

SEQ ID NO: 73783 - DNA, 50 bp, homo sapien
acttcctttttagattaaataaaccraagtgattactttcaagtaagaat

SEQ ID NO: 73784 - DNA, 50 bp, homo sapien
tcatgtaagcatatgtataggcaaakaaaaatgtaaataaaggttaagtg

SEQ ID NO: 73785 - DNA, 50 bp, homo sapien
ctttttatattttgttgcattataasaaacacaaaaatgtataagcaaaa

SEQ ID NO: 73786 - DNA, 50 bp, homo sapien
tgcggtgaaaatggaatgaattttasaaccagacatataatgggttcctt

SEQ ID NO: 73787 - DNA, 50 bp, homo sapien
tatggtatacatttaagcagacacaktaagcaaattggccagggcaataa

SEQ ID NO: 73788 - DNA, 50 bp, homo sapien
agtttttgataatcaaggtattaagraaaatgtccaattgttcattctgt

SEQ ID NO: 73789 - DNA, 50 bp, homo sapien
ttatataaaaattagatactgataartggtaagtgtcagaaaggaaaagt

SEQ ID NO: 73790 - DNA, 50 bp, homo sapien
tctgcaagcatataaacttaaagaamacatacaaggagtgttttaattac

SEQ ID NO: 73791 - DNA, 50 bp, homo sapien
ttcctagatcaagccatactcacaamgactaagacactgtgacagagact

SEQ ID NO: 73792 - DNA, 50 bp, homo sapien
tcagttagacttatattttaaaccckattactcattactattattgtttt

SEQ ID NO: 73793 - DNA, 50 bp, homo sapien
ttcttggtatctgagaacattttcckccttgacacagagctcttgagaca

SEQ ID NO: 73794 - DNA, 50 bp, homo sapien
ctgcttcattgcagttgtgagaaaawagcctaattagagaagtttcaaca

SEQ ID NO: 73795 - DNA, 50 bp, homo sapien
aggataaaatgctgagatagatccartgaactccactctagttgaacaat

SEQ ID NO: 73796 - DNA, 50 bp, homo sapien
atttctgtgcttcccacggctcgtgraccactctcactgcagtcagggga

SEQ ID NO: 73797 - DNA, 50 bp, homo sapien
tccagtgtaatgccttgaccaaacayggaaatagcaatgatagggaatca

SEQ ID NO: 73798 - DNA, 50 bp, homo sapien
cctccacacacaaacaggaagtacayctgcctgcttaccgtacacagaca

SEQ ID NO: 73799 - DNA, 50 bp, homo sapien
aaataaactgaattctggggataatycagctaagcagataccctccacac

SEQ ID NO: 73800 - DNA, 50 bp, homo sapien
tagactctaatcatgttatttctcamgatgttaaactgtttccttctttt

SEQ ID NO: 73801 - DNA, 50 bp, homo sapien
tatatgtcattcattcattccaggarcttctactgagcagttatcatgcc

SEQ ID NO: 73802 - DNA, 50 bp, homo sapien
gagtgtctctagacagaagataaacrccacagattgtctccttttgagag

SEQ ID NO: 73803 - DNA, 50 bp, homo sapien
tgattttgcaggctcataggtaaaakactttgtactgtggacttttgagt

SEQ ID NO: 73804 - DNA, 50 bp, homo sapien
ctgtcttttattctggctgaatctaytaacaaccttgtcataaaattttc

SEQ ID NO: 73805 - DNA, 50 bp, homo sapien
cacattttcatctcccctttcctgtraaatcagcatatatgtatgtgtaa

SEQ ID NO: 73806 - DNA, 50 bp, homo sapien
atatttcagcacaacacaaccggacrgctaactaagattatgttttgacc

SEQ ID NO: 73807 - DNA, 50 bp, homo sapien
ataagaaaaaataaatttatttttamaggcaacataatctcgaaagattt

SEQ ID NO: 73808 - DNA, 50 bp, homo sapien
tactaattagtctgtgatatatgagrattacaaaatctgcaatgaatata

SEQ ID NO: 73809 - DNA, 50 bp, homo sapien
cagcacaggtcacaaaagatcctackcattgtagccttcaaagactcaag

SEQ ID NO: 73810 - DNA, 50 bp, homo sapien
gcaaaatatgtgtgctttaaatgaamatactgaaatctttttagaagctt

SEQ ID NO: 73811 - DNA, 50 bp, homo sapien
ggcatgatgactaaaagttctacatwactctcgaatactaatttcaaaat

SEQ ID NO: 73812 - DNA, 50 bp, homo sapien
actctccttagtctgtggaaaacagrgattgtatcttatgtacatttcac

SEQ ID NO: 73813 - DNA, 50 bp, homo sapien
agcaggtttaaaatggcaaaaatgargggagtaattgctctcaatttaag

SEQ ID NO: 73814 - DNA, 50 bp, homo sapien
gttagaaaagaatgtgatatactacmgagagctttcaaatcattttagac

SEQ ID NO: 73815 - DNA, 50 bp, homo sapien
tagttgagctctctttggtggaaacrttgctaacactgcatattggcatc

SEQ ID NO: 73816 - DNA, 50 bp, homo sapien
tactagggattgcctttaaataacartgaccatgattccttgcattctta

SEQ ID NO: 73817 - DNA, 50 bp, homo sapien
ttggcaggtcggtctaagggtcctcratagtagatgctagtggtggctat

SEQ ID NO: 73818 - DNA, 50 bp, homo sapien
attccattcagagaatagtttgttaygttgagaataatttaactcagacc

SEQ ID NO: 73819 - DNA, 50 bp, homo sapien
gtaggtgggaaaaggatgaacgatakgaagaagaaggacccagaaaacta

SEQ ID NO: 73820 - DNA, 50 bp, homo sapien
gaaaacatgaatcaggtggctacaaytattactatagtgctctgggtcct

SEQ ID NO: 73821 - DNA, 50 bp, homo sapien
atgagtaacagattttatttcttcargcagagatatttttaaaaggttga

SEQ ID NO: 73822 - DNA, 50 bp, homo sapien
aggtaggcattcaataaagaactatmatagcatacattttttcaaccttt

SEQ ID NO: 73823 - DNA, 50 bp, homo sapien
tgcctcagatacctgttgaggtaaaygtgagacccaataaataatcaggt

SEQ ID NO: 73824 - DNA, 50 bp, homo sapien
caggtatctgaggcagttttactcaycttaattgcataaagccaagacca

SEQ ID NO: 73825 - DNA, 50 bp, homo sapien
atcctctagagtttacttaaaaataygcagcaggtgattatctgattagg

SEQ ID NO: 73826 - DNA, 50 bp, homo sapien
gatagctagcaggttaatttactccrgttcctccaaatgaaaaaccatga

SEQ ID NO: 73827 - DNA, 50 bp, homo sapien
caaaaaagatataaatgccacttacyaagtctttatgaatagtgcttgag

SEQ ID NO: 73828 - DNA, 50 bp, homo sapien
tctttccagtgatgaaggtgattaayggtagtccatgacatgcagtggca

SEQ ID NO: 73829 - DNA, 50 bp, homo sapien
atgtcacaaaatgctgaacagtaaaygaggccatgtgcctgttcgtgttc

SEQ ID NO: 73830 - DNA, 50 bp, homo sapien
aatctatcagtttaacatacactcawtattaaaaattactaatgaaatat

SEQ ID NO: 73831 - DNA, 50 bp, homo sapien
gttttgttgagggtttttgcacaaakgtttatcaatgatattggcctgat

SEQ ID NO: 73832 - DNA, 50 bp, homo sapien
tcaagctctaaggacaaatcctaaaytcattggcatggctttcaaggccc

SEQ ID NO: 73833 - DNA, 50 bp, homo sapien
acacaaaatagaatgttagcatccartgatttaattcatattcatattcc

SEQ ID NO: 73834 - DNA, 50 bp, homo sapien
ccacgttctgcacatgtacaaaaaakaattagggagagatactttctcag

SEQ ID NO: 73835 - DNA, 50 bp, homo sapien
ttgtaggatattaatcagctccttgmagtaatgtatatcttgtttgatga

SEQ ID NO: 73836 - DNA, 50 bp, homo sapien
tggcatgtccccaagatacttcattygaccattttaattaagcaatatat

SEQ ID NO: 73837 - DNA, 50 bp, homo sapien
aaaaggataatatccagaatctatamaaaaacaaatttacaagaaacaag

SEQ ID NO: 73838 - DNA, 50 bp, homo sapien
ttctcaaagcacacagacacatcaaygctaaccatgcaatcaaatggaca

SEQ ID NO: 73839 - DNA, 50 bp, homo sapien
tgtgtagttgtaatccctatgtatcygacattatcatatcaacatgaaag

SEQ ID NO: 73840 - DNA, 50 bp, homo sapien
tagaataagaggcctggagtgtttaygaaaaatccctcatcagggaacct

SEQ ID NO: 73841 - DNA, 50 bp, homo sapien
tacctctttactctctcttcagacawgcatttactgtgatgactttatca

SEQ ID NO: 73842 - DNA, 50 bp, homo sapien
ggagacaatatgatcataagcagtayatggacgttaagcattggtaagga

SEQ ID NO: 73843 - DNA, 50 bp, homo sapien
agtgggctattggagaaaggatagaycaaaagattaatgaaacagaatag

SEQ ID NO: 73844 - DNA, 50 bp, homo sapien
aaatgaaaatgacagttattgcctcragtaattaataatctaacaggagc

SEQ ID NO: 73845 - DNA, 50 bp, homo sapien
tagtagtctagtaaccaactgtgaargaagtggaaatcaacaaattgcct

SEQ ID NO: 73846 - DNA, 50 bp, homo sapien
tcagtttgagtctaatggcaggaaaraaactgatatcacagtttgaaggc

SEQ ID NO: 73847 - DNA, 50 bp, homo sapien
tttgaatacctcctatagaatgatarcttactcatctgcagccagacttc

SEQ ID NO: 73848 - DNA, 50 bp, homo sapien
atccaaactatttttcttcaataccratgaataattattaaaacataatt

SEQ ID NO: 73849 - DNA, 50 bp, homo sapien
tcagagcaaaggcatttgtcaaaagractggaagacgtgtgtattataag

SEQ ID NO: 73850 - DNA, 50 bp, homo sapien
taatatgcctgaaactctaaaacacwcactggtagtcccagaaaatatat

SEQ ID NO: 73851 - DNA, 50 bp, homo sapien
tgaaagaaaaaaatgaagccataacygtaataaagaatatatcccaattt

SEQ ID NO: 73852 - DNA, 50 bp, homo sapien
aaagataagaattctagttaagacayaattctgtatatgaaatgtgccag

SEQ ID NO: 73853 - DNA, 50 bp, homo sapien
tcaactgaacagatatttattgagamcctagtgtgtacaaagtatgctgc

SEQ ID NO: 73854 - DNA, 50 bp, homo sapien
agaagttgcttttgcctctgaggacmtatgccaatgaaggaaaggtggat

SEQ ID NO: 73855 - DNA, 32 bp, homo sapien
aaggtgatgtgaagatsaaagtggggttagag

SEQ ID NO: 73856 - DNA, 50 bp, homo sapien
actctgctttcctctatcttgacttytactcttgagcagctcaaaactta

SEQ ID NO: 73857 - DNA, 50 bp, homo sapien
tgacaccaaattcacatgtgacaaargaaaagaattgataaatggaactt

SEQ ID NO: 73858 - DNA, 50 bp, homo sapien
tggataagagactggacccattcgasgcaatcagagagcatctcctggag

SEQ ID NO: 73859 - DNA, 50 bp, homo sapien
ctaaggcatcacaagttacacatccraactcttcaatggtacaatatttt

SEQ ID NO: 73860 - DNA, 50 bp, homo sapien
ttatcaatgaatcaccagctagtttyacctatacccacccaacgacttct

SEQ ID NO: 73861 - DNA, 50 bp, homo sapien
ctgtgtaatgatgatcatatatcaaygttactttcctcacgtaagctgga

SEQ ID NO: 73862 - DNA, 50 bp, homo sapien
gccgtgatattgtttctagtatccayggcagagaggatgatattactccc

SEQ ID NO: 73863 - DNA, 50 bp, homo sapien
ccagcctccatctaagtagcttaaartatcaaccatttaattttctcagg

SEQ ID NO: 73864 - DNA, 50 bp, homo sapien
aggccatctggaactaactacctaaytcttgtgaaacttctagattgtga

SEQ ID NO: 73865 - DNA, 50 bp, homo sapien
cacattagaaattagaaggattggamggcaggtcttctgactacactgct

SEQ ID NO: 73866 - DNA, 50 bp, homo sapien
agtcctagttacctccctttttctcrttgactggtgtggattccttatat

SEQ ID NO: 73867 - DNA, 50 bp, homo sapien
taccttgtctcaaacaatgaagaaarctctacaaaagtcaacacataggg

SEQ ID NO: 73868 - DNA, 50 bp, homo sapien
caaaagtcctgcacatttcctagtasctttatgcctaagtcatctatatt

SEQ ID NO: 73869 - DNA, 50 bp, homo sapien
ccatgggaaattaaacttctcaaaaygatcctaaagttctgcaagaacaa

SEQ ID NO: 73870 - DNA, 50 bp, homo sapien
atggtatgtttacattccaaggcatraacttgttaaaattacaattaatc

SEQ ID NO: 73871 - DNA, 50 bp, homo sapien
ttaatattttcttcctatcgtgttcyaggattaaattgtatagtagccct

SEQ ID NO: 73872 - DNA, 50 bp, homo sapien
aataactttattgtattgcttcaccrtcaattaatgttgtgggtatagat

SEQ ID NO: 73873 - DNA, 50 bp, homo sapien
gtctgcctataaacacactgatggcygaaaatggaatacaactcagtcca

SEQ ID NO: 73874 - DNA, 50 bp, homo sapien
ctgttttactggcttgaaaaatcagragataaaattgtagtcactactgc

SEQ ID NO: 73875 - DNA, 50 bp, homo sapien
taaactggatgttatagggataccaytagaacactggatacaggccaggt

SEQ ID NO: 73876 - DNA, 50 bp, homo sapien
ccacacgactttacagcagctactcraaccagttttacatttatcctgtg

SEQ ID NO: 73877 - DNA, 50 bp, homo sapien
aggtataagaaaggatttagatatayatggagagtattcataagttcagt

SEQ ID NO: 73878 - DNA, 50 bp, homo sapien
aaacattgtttggactactccagaarattaggctgtgaatggcagcagag

SEQ ID NO: 73879 - DNA, 50 bp, homo sapien
ttttaaatctgaaagttaaaatctasgtcaactatcaactcatttctgaa

SEQ ID NO: 73880 - DNA, 50 bp, homo sapien
caaactttttcttcaggtaatacaakaaattaatagcctggatttttttg

SEQ ID NO: 73881 - DNA, 50 bp, homo sapien
tatgagttgactggcaaattttatawgtagttttatcaggaatatttgaa

SEQ ID NO: 73882 - DNA, 50 bp, homo sapien
gatagtctaagataaggagagtataygctaacaaaaaagaaacttataat

SEQ ID NO: 73883 - DNA, 50 bp, homo sapien
ttttcttcaatgttgcaaggcttaartattctagtcacatggaatacagg

SEQ ID NO: 73884 - DNA, 50 bp, homo sapien
cagaaaaagagctccctaagcacagratcaaaacatttgggggaagaaat

SEQ ID NO: 73885 - DNA, 50 bp, homo sapien
atgataaacaaacttggaattattayattcatttacaaacaactttggtt

SEQ ID NO: 73886 - DNA, 50 bp, homo sapien
gcaattgtcttattgaccttaaaaayggcacaataattactttaaaaatt

SEQ ID NO: 73887 - DNA, 50 bp, homo sapien
gtgtctcttagatcagtagttctcargttagacagtttggcctggctgta

SEQ ID NO: 73888 - DNA, 50 bp, homo sapien
atcctggtttcctcattctcaggccrccattcttttcccttttccacact

SEQ ID NO: 73889 - DNA, 50 bp, homo sapien
ttttccaacacagcactttatgaagkagaactggagcattaagataaaat

SEQ ID NO: 73890 - DNA, 50 bp, homo sapien
ccattgcacctggcttatacctttascttatagagactacatcacacact

SEQ ID NO: 73891 - DNA, 50 bp, homo sapien
tgagttgaacaatcctaagtcagggycaatctgtacttcatacaatatgt

SEQ ID NO: 73892 - DNA, 50 bp, homo sapien
aaaaccactaatcttatttgtatcamcagagagtaattttacctatttta

SEQ ID NO: 73893 - DNA, 50 bp, homo sapien
attgtagcttttgaagcaaactttayatcaaacttaactgaactatacaa

SEQ ID NO: 73894 - DNA, 50 bp, homo sapien
agctactgccttactgattgaatctkaactattagaataccatattttga

SEQ ID NO: 73895 - DNA, 50 bp, homo sapien
tctagaaatcatataatcatgttgargtttgaattttgatttgaggaact

SEQ ID NO: 73896 - DNA, 50 bp, homo sapien
gaaagattactcgatttcttctcaawaattgtatttgttctggcacattc

SEQ ID NO: 73897 - DNA, 50 bp, homo sapien
gtttgatgtaaagtttgcttcaaaarctacaataaccaagtacctaatat

SEQ ID NO: 73898 - DNA, 50 bp, homo sapien
cctaaattcctaaaggcttaatatartaacataacagaaagttgtattat

SEQ ID NO: 73899 - DNA, 50 bp, homo sapien
aggaaaaacaaatgcctagaagctcytccaaatgaagctcattcaaaaga

SEQ ID NO: 73900 - DNA, 50 bp, homo sapien
ataacagatggactagtggatcccartattttagccagcttatgagttgc

SEQ ID NO: 73901 - DNA, 50 bp, homo sapien
agatgataaggatatgtatggaatcrcttcgtatattacagaaggctgta

SEQ ID NO: 73902 - DNA, 50 bp, homo sapien
tgattagctttaggtcattttagtargcccaacaattataaacaaattat

SEQ ID NO: 73903 - DNA, 50 bp, homo sapien
gcacttgtaagttgctggctgcatcrccctgcctctttttacttagataa

SEQ ID NO: 73904 - DNA, 50 bp, homo sapien
ccattgctggcaaaatcaagtcccartacctgcttaacatttaaggccct

SEQ ID NO: 73905 - DNA, 50 bp, homo sapien
atccagcatcctcaccaaaccagacygggactgagaaccgggaagtaagg

SEQ ID NO: 73906 - DNA, 50 bp, homo sapien
aatcagaaataagagagagtgagtasaggagactgagccagaggaaaaac

SEQ ID NO: 73907 - DNA, 50 bp, homo sapien
ggaaggaaattttcattatgtcaagmaagtaatagaggaaaaggttttaa

SEQ ID NO: 73908 - DNA, 50 bp, homo sapien
actgtcctctttcaaaatgtgttcayggttgttacataatgctggatctt

SEQ ID NO: 73909 - DNA, 50 bp, homo sapien
tctagctaatttagggatttatttcraggtagtaatttaaaggatttctg

SEQ ID NO: 73910 - DNA, 50 bp, homo sapien
gaaaaacagaggacagcttttcaaayaatgtgtaaattagtctaccccct

SEQ ID NO: 73911 - DNA, 50 bp, homo sapien
aggtaatctggctttgaagtccacartaatatttcaacagaaccattaaa

SEQ ID NO: 73912 - DNA, 50 bp, homo sapien
gccttgagcaggaagaacaccatttratctttaaaacaagcaagaatgac

SEQ ID NO: 73913 - DNA, 50 bp, homo sapien
gccacttctatggtatcctctgctaygatgaatcctttcattacatgaat

SEQ ID NO: 73914 - DNA, 50 bp, homo sapien
tccctgcagcttaaaaacggtcacartcccactcatgagggcttcaccct

SEQ ID NO: 73915 - DNA, 50 bp, homo sapien
cattccacaatgctcctggcaattamtaggaaccaagcactctacttgcc

SEQ ID NO: 73916 - DNA, 50 bp, homo sapien
aagaattagcacagctaaaaaatcaratattgagtgaatcttagtaagaa

SEQ ID NO: 73917 - DNA, 50 bp, homo sapien
ccggtttagagacataaagggatcaygcttcagacttaaacaagaaccat

SEQ ID NO: 73918 - DNA, 50 bp, homo sapien
ggcccaggagaaaggtgacggtgaayggatatcatgtttagggagaaagt

SEQ ID NO: 73919 - DNA, 50 bp, homo sapien
tacaaggaatataggtagctgatgaycttcacctttaggatccaccacaa

SEQ ID NO: 73920 - DNA, 50 bp, homo sapien
ggagctctcactggccttcccaaaayttgttcaagacagcactatggtca

SEQ ID NO: 73921 - DNA, 50 bp, homo sapien
atggaacttgtttggacctgaattcsaacaagccaactgtaagatgacat

SEQ ID NO: 73922 - DNA, 50 bp, homo sapien
ggccggcataagaaagccagctgaayagcatttcccagtacactgctgca

SEQ ID NO: 73923 - DNA, 50 bp, homo sapien
tcaggaaaacatgagctcaccaaacrtactaaatgaggtaccattgacca

SEQ ID NO: 73924 - DNA, 50 bp, homo sapien
atagtggctattatatgaaaactacragagggtcttcaaaaccaccccta

SEQ ID NO: 73925 - DNA, 50 bp, homo sapien
tttaggattctttctttgttcttaamgtttgagagtttgattattaaacg

SEQ ID NO: 73926 - DNA, 50 bp, homo sapien
taagccactgtttctaccaaatgccmaattacctggaaatatctagccaa

SEQ ID NO: 73927 - DNA, 50 bp, homo sapien
aagagggagggcgtaagatgcacatrttgtagcttgggaactattccaca

SEQ ID NO: 73928 - DNA, 50 bp, homo sapien
tttacttatcagaacagggagaatarcttcatggtaccaaaaaggaaaaa

SEQ ID NO: 73929 - DNA, 50 bp, homo sapien
atggacaaaagaggactgaattacamaagccggaagaaaagagaatgttg

SEQ ID NO: 73930 - DNA, 50 bp, homo sapien
taaaatacttagtaatttagatctcwgtaaaaagaaataccacctattta

SEQ ID NO: 73931 - DNA, 50 bp, homo sapien
actgcaatcaaatgattaatcggaartatgcttggtgagcaaagggactt

SEQ ID NO: 73932 - DNA, 50 bp, homo sapien
taccaaggagacaaggaaatgagaaytgtttcagatgtgtatagagggtg

SEQ ID NO: 73933 - DNA, 50 bp, homo sapien
taggaaaataaacacttctttggaaygctggcctagtactttacaattct

SEQ ID NO: 73934 - DNA, 50 bp, homo sapien
atctgttcacatctctttggccagaytatatgatatacataattgaaagt

SEQ ID NO: 73935 - DNA, 50 bp, homo sapien
ataggctataaatttgtaagctataygaagaatggcttgtgtttttgtct

SEQ ID NO: 73936 - DNA, 50 bp, homo sapien
atcaggtagaacttggctccaagaamaatatagctcaatgcacttctatg

SEQ ID NO: 73937 - DNA, 50 bp, homo sapien
cagttactcagagttaattaatatakagcatcacccctagcacccaccac

SEQ ID NO: 73938 - DNA, 50 bp, homo sapien
tctgctctactggtctgtcaaattcrcaaattctgcttatcaatgcatat

SEQ ID NO: 73939 - DNA, 50 bp, homo sapien
aaaatctactttggaagcaaataaasttgaacagaatacagatgttaaaa

SEQ ID NO: 73940 - DNA, 50 bp, homo sapien
ctcctgttccatgtactgtgctgaaygactaaatcctggtatttcattta

SEQ ID NO: 73941 - DNA, 50 bp, homo sapien
agaaggtctggacagatgtggaggcratattaaatacaatatcagaagtg

SEQ ID NO: 73942 - DNA, 50 bp, homo sapien
tcatatttaatcctcgaattcttaayaactagcaccatgcctggcagaga

SEQ ID NO: 73943 - DNA, 50 bp, homo sapien
actttgtcttcagcatagtatgagcsagaagggagtgaaacagggcagtt

SEQ ID NO: 73944 - DNA, 50 bp, homo sapien
tgtggttagcttctgtttagaatgargatggttgctaggtacactactgg

SEQ ID NO: 73945 - DNA, 50 bp, homo sapien
gtttggctacatcaagaagaaataayatagtagtatccttcataagttag

SEQ ID NO: 73946 - DNA, 50 bp, homo sapien
aatatgttgacagggtagaaaatcaratcccaggagaccagttaatgtac

SEQ ID NO: 73947 - DNA, 50 bp, homo sapien
ccttgatgatgtgagtgaccttcagragacctggtgcactcacttggcac

SEQ ID NO: 73948 - DNA, 50 bp, homo sapien
attttttagtagttagcataagtacmggtataatgagtggtaggaactga

SEQ ID NO: 73949 - DNA, 50 bp, homo sapien
tcttactcattcttacatttccagcrcctcctatagtgtttcttaataca

SEQ ID NO: 73950 - DNA, 50 bp, homo sapien
ttgtcattcacatacacttgcaatgycaaataaatgtatgttgaagagaa

SEQ ID NO: 73951 - DNA, 50 bp, homo sapien
atttcatttcattctccagtttacaygtttagaaataagagtcctgaaga

SEQ ID NO: 73952 - DNA, 50 bp, homo sapien
gcttggccacagtggagtagagcacktagcagtatcctggggtcctgatt

SEQ ID NO: 73953 - DNA, 50 bp, homo sapien
cacaaagccaaattcagccatgtaaytaagctacataaacgttaatgagg

SEQ ID NO: 73954 - DNA, 50 bp, homo sapien
tcttagattatgaaaagtacactaawaagaagtctctaacaaccaggctt

SEQ ID NO: 73955 - DNA, 50 bp, homo sapien
cttggataccatccccaagacatctsagtatgtatatgcaaatatttcaa

SEQ ID NO: 73956 - DNA, 50 bp, homo sapien
gatgcatgactatattagaggacatyaattatcatctaacataatcttgc

SEQ ID NO: 73957 - DNA, 50 bp, homo sapien
tatctagcacagaagtcactcaatawaggctctttctaaaaagtattaaa

SEQ ID NO: 73958 - DNA, 50 bp, homo sapien
caggtacctttcattcatcttcatcratatccctagtatctaccctcttg

SEQ ID NO: 73959 - DNA, 50 bp, homo sapien
gatcagactaatacattgtgtaacayatgaaattgagttttatagaaatg

SEQ ID NO: 73960 - DNA, 50 bp, homo sapien
taggaaggaaaatttgctgtaaaagyagtaaatgcaactaacacaaaata

SEQ ID NO: 73961 - DNA, 50 bp, homo sapien
ggggtgtgggccaggacctgagcgaygtcaaatattcctcagcggtctca

SEQ ID NO: 73962 - DNA, 50 bp, homo sapien
gcaggcccagatattcggaccatagmaactaccttattcacaaatatcca

SEQ ID NO: 73963 - DNA, 50 bp, homo sapien
ttggcctcctcttgactcaagattcwcctaatgagtattgttcccactac

SEQ ID NO: 73964 - DNA, 50 bp, homo sapien
tgatctgtgccagatctgcttttctracgtcttttctgccaacctcttga

SEQ ID NO: 73965 - DNA, 50 bp, homo sapien
tacatacaataagaaataaaatacaytccaattctatattatgtccagct

SEQ ID NO: 73966 - DNA, 50 bp, homo sapien
ccaaatcagatgttccactaataaamggaattcagagataatcctccaga

SEQ ID NO: 73967 - DNA, 50 bp, homo sapien
aaaagtaacaatcttttcacaaactractgatctaaatttttgttagcac

SEQ ID NO: 73968 - DNA, 50 bp, homo sapien
tgcttaggaaaaaaataaaaatgcaygatctactttgtttcagaacctaa

SEQ ID NO: 73969 - DNA, 50 bp, homo sapien
ttcctgaatctgccatatcagtgtcrcctaccttaacatgaaataaatat

SEQ ID NO: 73970 - DNA, 50 bp, homo sapien
atagaagtgaaaagggagtctgttaygtgcatgtatttacttttatttat

SEQ ID NO: 73971 - DNA, 50 bp, homo sapien
tgtttatttccaaaagtattgtaaasagcattttttctagcctctttaat

SEQ ID NO: 73972 - DNA, 50 bp, homo sapien
tttagtgatgggtagtggcctgagaktattgatgtatccaaagaaaatga

SEQ ID NO: 73973 - DNA, 50 bp, homo sapien
acgattactaggaattgctacaaackccaatgccttcagggtcaggaagt

SEQ ID NO: 73974 - DNA, 50 bp, homo sapien
ttgagtctggtatagcttgaaatgtsaaacaaccccactgtgaatttttg

SEQ ID NO: 73975 - DNA, 50 bp, homo sapien
tgactatagacatgcctaagaggaaraaagtcaggactggttataagagt

SEQ ID NO: 73976 - DNA, 50 bp, homo sapien
cttttttttacactatgaagcaacartgttctctaaatagcagggtgctt

SEQ ID NO: 73977 - DNA, 50 bp, homo sapien
ctttggctctctgagtatataacagrctataactgtgtgggtcctggtgt

SEQ ID NO: 73978 - DNA, 50 bp, homo sapien
gtgaatatacaaagtgatagaattaraccaactgtaagaatgaacagatc

SEQ ID NO: 73979 - DNA, 50 bp, homo sapien
caatcaagaccctggacacaaatgayggtctttgcatatcattttagcct

SEQ ID NO: 73980 - DNA, 50 bp, homo sapien
gacattttttccatataaaatttaamctcattttgttatattgcaaaaag

SEQ ID NO: 73981 - DNA, 50 bp, homo sapien
acccaaatcattaaaaaaaattcctyagaccaagcaaattgcaccttcag

SEQ ID NO: 73982 - DNA, 50 bp, homo sapien
gggaaaaaaatgccttttctcaaccrcaaatctcgtgtactcaggaaaca

SEQ ID NO: 73983 - DNA, 50 bp, homo sapien
atacattttttcttttaaaaaatgamgagtctgtcaaaacctggcctacg

SEQ ID NO: 73984 - DNA, 50 bp, homo sapien
tacaaaaatataactgaacaaagagraatatatattcactacagaagcca

SEQ ID NO: 73985 - DNA, 50 bp, homo sapien
atctgatttagctaagatgctttacygacaggatatcctgtatctagtta

SEQ ID NO: 73986 - DNA, 50 bp, homo sapien
aaatcaaattatttaaacccttcgaygattctactgtgcccattgtacag

SEQ ID NO: 73987 - DNA, 50 bp, homo sapien
agttataaacaattatcaggtaactraagagtcaaagtaccctaggccaa

SEQ ID NO: 73988 - DNA, 50 bp, homo sapien
gaaatccccccactgatactgtagawatgaatgttaaaaagcagtggtga

SEQ ID NO: 73989 - DNA, 50 bp, homo sapien
tgctatatcatgttagagagtttccwactaaaataactaatactttttca

SEQ ID NO: 73990 - DNA, 50 bp, homo sapien
attgtatggtacatgttaagagatayaggaattaaaaacaaagcaggatg

SEQ ID NO: 73991 - DNA, 50 bp, homo sapien
gttaaatgtaagtatatagtgataasagtaatagcttataattattaagt

SEQ ID NO: 73992 - DNA, 50 bp, homo sapien
acacatagcaagtaaagcaagcagcraaggtaaacaccttttgtgtctat

SEQ ID NO: 73993 - DNA, 50 bp, homo sapien
tagaattttgtttcctaaaggaccaygctagaaacacagatacatttgtt

SEQ ID NO: 73994 - DNA, 50 bp, homo sapien
aataacaactttaggtagttgcaacsaaaatgctaaacacatgtaataaa

SEQ ID NO: 73995 - DNA, 50 bp, homo sapien
caaatgtttaaagctaatgtcttaayggtatgtactaaatcaagctacta

SEQ ID NO: 73996 - DNA, 50 bp, homo sapien
gaaaactgtagcatcttacaaaataygttgaaaatgaggttgtatttacc

SEQ ID NO: 73997 - DNA, 50 bp, homo sapien
gctgtttcattgttactaatgataartggtttctaagcaccattccaaac

SEQ ID NO: 73998 - DNA, 50 bp, homo sapien
ttgctggtgatggcctcatttcccaygtgtgtacaaggtggtttgattga

SEQ ID NO: 73999 - DNA, 50 bp, homo sapien
ctctgtgagcttgtgacccaaataaycaaaggtcccagtggaagagaaag

SEQ ID NO: 74000 - DNA, 50 bp, homo sapien
taattgtccaatctaaaaccttacartaacgaatgcagaggaatttggga

SEQ ID NO: 74001 - DNA, 50 bp, homo sapien
tcaaaaccttttgctctcgaatacaractaatactgagataaggaataat

SEQ ID NO: 74002 - DNA, 50 bp, homo sapien
ggttcttgttaccagggatgtaaatratgaaaataaaatttttgcctttt

SEQ ID NO: 74003 - DNA, 50 bp, homo sapien
ttactaccatcatattctgaggatamagattaaggatttttgttttattt

SEQ ID NO: 74004 - DNA, 50 bp, homo sapien
gtaacaagaaccagctgctaggaaayaggtcccagttatgtatgaaactc

SEQ ID NO: 74005 - DNA, 50 bp, homo sapien
gattttaccatacctcagagtttcaraatcattcatctgagtctagattt

SEQ ID NO: 74006 - DNA, 50 bp, homo sapien
cattatcggcttcttgatgtgcagcrataaggacccagactagagaagag

SEQ ID NO: 74007 - DNA, 50 bp, homo sapien
caaatgctcaacctcaaccaattctrtgaaaacaagcgatcctgccctct

SEQ ID NO: 74008 - DNA, 50 bp, homo sapien
gcaggaggatgaaatagcaaggtaarcataggaacattctgatggacatg

SEQ ID NO: 74009 - DNA, 50 bp, homo sapien
aaactgcaattatttcgcaccaaccrgatacattgggtataatgactcaa

SEQ ID NO: 74010 - DNA, 50 bp, homo sapien
acaaaacaagattcttgctgtaaacyggccaaggacatacttaacatcac

SEQ ID NO: 74011 - DNA, 50 bp, homo sapien
ttgttcatatatatttaaaatatggycaaatctacctgaaaagtagcact

SEQ ID NO: 74012 - DNA, 50 bp, homo sapien
ctgtatgggtctttactctggacaaycgattctttactgtttgctctgag

SEQ ID NO: 74013 - DNA, 50 bp, homo sapien
tagttctcctcgtagtgatttttgcytcctacttagctagattcctagct

SEQ ID NO: 74014 - DNA, 50 bp, homo sapien
ctatcagaattttacatgaaataaaygaatttaacttggtataactgtga

SEQ ID NO: 74015 - DNA, 50 bp, homo sapien
acattttatatttattcaggttttaygttgtcattagtgtaaaactttga

SEQ ID NO: 74016 - DNA, 50 bp, homo sapien
cttagctgcaatataaccatcaagaraacttgactaccaccaccagaata

SEQ ID NO: 74017 - DNA, 50 bp, homo sapien
ttcagaatcacatgcttcactcttaygaactgaattttcttaataaagcc

SEQ ID NO: 74018 - DNA, 50 bp, homo sapien
tacatatgacagattacaaatagaargttcttatgttcacatgtcaggtt

SEQ ID NO: 74019 - DNA, 50 bp, homo sapien
atagtggaaccttattccagacagaygttagcgaacaagcaatgtcatgt

SEQ ID NO: 74020 - DNA, 50 bp, homo sapien
taataactactgcatgtagtgtaaarggtagaattttaagatattcaatt

SEQ ID NO: 74021 - DNA, 50 bp, homo sapien
ctcttcccagcttctgatttaacackaatctctttgtttctctctgctta

SEQ ID NO: 74022 - DNA, 50 bp, homo sapien
gaggaaatctgtatgagttatgaaamaaacagtgttaaaatcgcaaaatt

SEQ ID NO: 74023 - DNA, 50 bp, homo sapien
ggtgtggagatgagaaaaaggaggaygtgtaagaaataaggttgccattt

SEQ ID NO: 74024 - DNA, 50 bp, homo sapien
taactgcaatactacaaaataaacartagagtgaagtaaataaattagtt

SEQ ID NO: 74025 - DNA, 50 bp, homo sapien
ttcattataacagctgacataattamgaagaaaagttagaagtcacatca

SEQ ID NO: 74026 - DNA, 50 bp, homo sapien
ctattatctctctgaggtgagatackaaatcatcaacttgaatgcagaaa

SEQ ID NO: 74027 - DNA, 50 bp, homo sapien
gaggttatttggcatattccactcayctaaaagcatttttccttcataca

SEQ ID NO: 74028 - DNA, 50 bp, homo sapien
aaataattccatccaataaggctackcttacaagaactaatttcacagtt

SEQ ID NO: 74029 - DNA, 50 bp, homo sapien
cctaaacagttatgtaaataaacaaytaaaagcccaacaattcagcaagc

SEQ ID NO: 74030 - DNA, 50 bp, homo sapien
aaagaagccatgttacatacaattasaaagaaagaataggagtaatgaca

SEQ ID NO: 74031 - DNA, 50 bp, homo sapien
aaatccagaaggaaggacattaatasgcagtcttagccttctcttccttg

SEQ ID NO: 74032 - DNA, 50 bp, homo sapien
taccttcttatctgtttttatcccaygcggtcctgccttcagtcattcat

SEQ ID NO: 74033 - DNA, 50 bp, homo sapien
gagtatgtggtcacatgaaaacacgsatgaatgaataaaacactctttgg

SEQ ID NO: 74034 - DNA, 50 bp, homo sapien
acctctaaagaatgtataagagaggyaattaaatagtaatggtagggaaa

SEQ ID NO: 74035 - DNA, 50 bp, homo sapien
caatcattctgaatggctaatgaacygggtttctgtaccagagtaatgaa

SEQ ID NO: 74036 - DNA, 50 bp, homo sapien
tttgctaagaaggtcaaatggatgaygaaggatgttgttgagcactcatt

SEQ ID NO: 74037 - DNA, 50 bp, homo sapien
gttaatgatgaccatggatcgtttcraagggcctatagcttcccttttat

SEQ ID NO: 74038 - DNA, 50 bp, homo sapien
gtggtcaacgcacttccactgaagargttgagttttggtttggggacttt

SEQ ID NO: 74039 - DNA, 50 bp, homo sapien
tacataactcttctgattattaacayatttttcctctgaatatagccttg

SEQ ID NO: 74040 - DNA, 50 bp, homo sapien
actccatcctcactgatttgtcactwtttgacctgtctggcagatccctg

SEQ ID NO: 74041 - DNA, 50 bp, homo sapien
gtttgtggttcttattttgatacacracctttatcaatttagagattagg

SEQ ID NO: 74042 - DNA, 50 bp, homo sapien
ccatttctactgtacttcagggtaarccttctgggactacagaatgctct

SEQ ID NO: 74043 - DNA, 50 bp, homo sapien
gtttccatccagggtttggtctgaayggaatacaaagttgggaggacagg

SEQ ID NO: 74044 - DNA, 50 bp, homo sapien
tgtctggtatcctagagcagatccasgttgccatttgaaatcattgatgt

SEQ ID NO: 74045 - DNA, 50 bp, homo sapien
gtagttacttcacttaatatgtatcrccataattctcttctcagaaagtt

SEQ ID NO: 74046 - DNA, 50 bp, homo sapien
tgtcttgtcaaacacaccaatagaamgttgaacgtaactgaagcaatcat

SEQ ID NO: 74047 - DNA, 50 bp, homo sapien
atggccctcctttgttcaagtatcasaagaaataaacccacagctccaga

SEQ ID NO: 74048 - DNA, 50 bp, homo sapien
taacagagtccctccttgaaaccaaycctaagtgagaagagaagagaaag

SEQ ID NO: 74049 - DNA, 50 bp, homo sapien
gtatatttttgataaattgcacatayggactcttcagtgttatctttttt

SEQ ID NO: 74050 - DNA, 50 bp, homo sapien
tagaagtcctatgtcatttccaacaytcactttaaaaggcctctggattt

SEQ ID NO: 74051 - DNA, 50 bp, homo sapien
ggccatggaatagttcccagggccamgcataccagtaattatttgtggct

SEQ ID NO: 74052 - DNA, 50 bp, homo sapien
ggttgcaagagtcacaggacattagmagtgaaaaatcttggaggaaaaat

SEQ ID NO: 74053 - DNA, 50 bp, homo sapien
agccttctgtttcaacatctaaaaartaagggttataataatgccaacct

SEQ ID NO: 74054 - DNA, 50 bp, homo sapien
taataatgccaacctcatgaaataaygtatataaggctcacacaggccta

SEQ ID NO: 74055 - DNA, 50 bp, homo sapien
gaaagatggtccatggcttctaccasattctcaaagagctcgttacccta

SEQ ID NO: 74056 - DNA, 50 bp, homo sapien
tgtgcattcaaatcaggtttccccastataaaaatgtagaggaggataca

SEQ ID NO: 74057 - DNA, 50 bp, homo sapien
attcttcttgatgtagcagtttacartattacacctttagggaaaataac

SEQ ID NO: 74058 - DNA, 50 bp, homo sapien
ttcaagagaactctgctgcctttcaygctcttagaagtctgaactcagac

SEQ ID NO: 74059 - DNA, 50 bp, homo sapien
ggatgtcacacctccagagaatatcraaactactggttcttcctaaatgt

SEQ ID NO: 74060 - DNA, 50 bp, homo sapien
taaggaagcacaaagactcattgcartaggcacatcaagttttagagatg

SEQ ID NO: 74061 - DNA, 50 bp, homo sapien
atacaaatagcaattctagtgcatayacagttattattacaaaatctagc

SEQ ID NO: 74062 - DNA, 50 bp, homo sapien
aattgaacaaaagggccagaaggtaraatatatggtaagtccttaattca

SEQ ID NO: 74063 - DNA, 50 bp, homo sapien
tcagtgattctcagtggaggacatayaccccttttggagtggggagagga

SEQ ID NO: 74064 - DNA, 50 bp, homo sapien
acatgataaattgccataatcttackcagtagtcaatgggagagccgttg

SEQ ID NO: 74065 - DNA, 50 bp, homo sapien
cttcctactagtgatataaagctagsattaattttccatccaaaaagaat

SEQ ID NO: 74066 - DNA, 50 bp, homo sapien
gctctgtgctctcactgcttctctawaggacttcccaaatcaccagtgct

SEQ ID NO: 74067 - DNA, 50 bp, homo sapien
ctcttgttgcagttccctagtttagragtgaaatgagacagtgtttgcct

SEQ ID NO: 74068 - DNA, 50 bp, homo sapien
agtcctactatatagttagccttagragaaatcatattgctttatagaga

SEQ ID NO: 74069 - DNA, 50 bp, homo sapien
taacagtagcactgactaataagacrctgaccaagggggatcaatttcag

SEQ ID NO: 74070 - DNA, 50 bp, homo sapien
ttttgttgggtttcctgacttttgayggaagggttcactaggttgtgtag

SEQ ID NO: 74071 - DNA, 50 bp, homo sapien
tttccctggtgctgttgtccacatckgaatacttcgagttagaaaggcct

SEQ ID NO: 74072 - DNA, 50 bp, homo sapien
ttgccctggtatctctcttcagtcaktatatggcaagtcattattccagt

SEQ ID NO: 74073 - DNA, 50 bp, homo sapien
ttcatatacacttactgattatgtgsatcaaagtaatttaaatttcagtt

SEQ ID NO: 74074 - DNA, 50 bp, homo sapien
tcatttgagtgttagcaattatgtgraagaggtaattgtttagaaagtag

SEQ ID NO: 74075 - DNA, 50 bp, homo sapien
aaatgcatcacaattagcaggggaartaattatatggctggactacccaa

SEQ ID NO: 74076 - DNA, 50 bp, homo sapien
ctgaagcacatcacatataatctaakagcagaggaactttaatgtgattg

SEQ ID NO: 74077 - DNA, 50 bp, homo sapien
ccaggatatttgcttgttgaacaaaygataatctacatccctaaggtttt

SEQ ID NO: 74078 - DNA, 50 bp, homo sapien
tgatacttgttagatgcgacacttaygattaactttatacctctgacgac

SEQ ID NO: 74079 - DNA, 50 bp, homo sapien
atcaagatgggtatcgttcagtcgakgccagtttggacaaaggatggcac

SEQ ID NO: 74080 - DNA, 50 bp, homo sapien
atcccagtaccctttatatgtgctayaactgtatgataatcctctgttct

SEQ ID NO: 74081 - DNA, 50 bp, homo sapien
agcatactttactaagttctcaacamatagtatatttctcaaatgtgccc

SEQ ID NO: 74082 - DNA, 50 bp, homo sapien
tcctaatatatcagcagggggaacartatggtaaccatagatcacagatt

SEQ ID NO: 74083 - DNA, 50 bp, homo sapien
atgtagctgaacttgatgttctaaaygtgacttttcaaaataaaataatt

SEQ ID NO: 74084 - DNA, 50 bp, homo sapien
ggtgctgagggaaaacactaagaaakaaatccataccaactaattggatg

SEQ ID NO: 74085 - DNA, 50 bp, homo sapien
tttgtctgttctttattgtgtagacygagtaaatagctcaggcctttttt

SEQ ID NO: 74086 - DNA, 50 bp, homo sapien
atgtttgtgctattcctaatctaacrcaaagagcctaagactgtgggtga

SEQ ID NO: 74087 - DNA, 50 bp, homo sapien
tttattttggtgtgaagaaacatagwcacccaaaattttattgcttgacc

SEQ ID NO: 74088 - DNA, 50 bp, homo sapien
tctcaaaagttcttttttgacaaagwacagcaattaagaaagtacaggat

SEQ ID NO: 74089 - DNA, 50 bp, homo sapien
caactctgaagttagttagcctggtwaatctcatggttatttaataatct

SEQ ID NO: 74090 - DNA, 50 bp, homo sapien
tatatatgatatatatattttataaygtgtatctccaaatcagaatgctt

SEQ ID NO: 74091 - DNA, 50 bp, homo sapien
gcctaagttgaatatttggtaataastgtttcttaaaattacttttattt

SEQ ID NO: 74092 - DNA, 50 bp, homo sapien
taatgcttccaaagattcatattgaygtgataatacatggagcatatcat

SEQ ID NO: 74093 - DNA, 50 bp, homo sapien
tttggaaagctcctgtatgaatcaayggttttcagtggaggctgtactac

SEQ ID NO: 74094 - DNA, 50 bp, homo sapien
tttctgcccataaatgttatctgacmatgtggtagccccaggagttcctc

SEQ ID NO: 74095 - DNA, 50 bp, homo sapien
aaatctagagtttaattaattataaygcaccagtgttggtttcttcattt

SEQ ID NO: 74096 - DNA, 50 bp, homo sapien
tattttgaaattgttaaaaaaaccaragtatctcctcattagctggtctt

SEQ ID NO: 74097 - DNA, 50 bp, homo sapien
tgcatgtttagtgcctagtatatgcraggcgtggtactagatggtatgga

SEQ ID NO: 74098 - DNA, 50 bp, homo sapien
aattgcccagttatattttaacctartaacatttatactgtaataaagtg

SEQ ID NO: 74099 - DNA, 50 bp, homo sapien
aattataccttgatctatgttttatsatttatcagttgggaaatacctgg

SEQ ID NO: 74100 - DNA, 50 bp, homo sapien
agagctattgagcatggttaactaaytacatgctaagagttcgggcaacc

SEQ ID NO: 74101 - DNA, 50 bp, homo sapien
tttaagcattctcaacttaataaaarctgtcttctaatcctactgcccct

SEQ ID NO: 74102 - DNA, 50 bp, homo sapien
ctagggatttttaaagtatatttcartaagcacatgttgataggtggact

SEQ ID NO: 74103 - DNA, 50 bp, homo sapien
aaagaggtaatttcttcacaacacayggaaataagagtatctctaggaat

SEQ ID NO: 74104 - DNA, 50 bp, homo sapien
ctggtgcacacatgaataaaaaagckaaacagccttattggtgatgagga

SEQ ID NO: 74105 - DNA, 50 bp, homo sapien
aaatatttgttgagtaaattaatgartaaatgaacatctattcacacagt

SEQ ID NO: 74106 - DNA, 50 bp, homo sapien
agttctgtttgttttgcccatcacastaatttatggttaggttataatga

SEQ ID NO: 74107 - DNA, 50 bp, homo sapien
catatacattgataggaaccaaagayagatatctgatagattaataaata

SEQ ID NO: 74108 - DNA, 50 bp, homo sapien
gacatgtttaatggcaagccttataycagtgctgtacacaagtatctcac

SEQ ID NO: 74109 - DNA, 50 bp, homo sapien
taagtctgtcatacttctgttgacastgcattttataaatctgtggcaat

SEQ ID NO: 74110 - DNA, 50 bp, homo sapien
aatgctatttttaaaataatgacccrcataagaagcgtaatagctttctt

SEQ ID NO: 74111 - DNA, 50 bp, homo sapien
gttgtttggtcttatttttgccaacrtttaagggaggtagaagttaaata

SEQ ID NO: 74112 - DNA, 50 bp, homo sapien
gctcatgttcaaatcaagtattgcaygtttatatgatgtttatgaacata

SEQ ID NO: 74113 - DNA, 50 bp, homo sapien
atcgggcagaagaaacatttatatcraactggctttctcaatatgactac

SEQ ID NO: 74114 - DNA, 50 bp, homo sapien
aaggtttattctgggtttatgtttaygtcgatccttttctggagagtgga

SEQ ID NO: 74115 - DNA, 50 bp, homo sapien
ggcatgtggtcctgttatttcttccyattttgatggctacacttactcaa

SEQ ID NO: 74116 - DNA, 50 bp, homo sapien
agccagacttctttgtttgccaagartagctatcacagactaaaatgcta

SEQ ID NO: 74117 - DNA, 50 bp, homo sapien
ccttaaaatgtgaataccaagtaacyggcaagatggccaaataggaacag

SEQ ID NO: 74118 - DNA, 50 bp, homo sapien
gtctatcacactgccagaatttctaygtgctgttatgaaataattagtta

SEQ ID NO: 74119 - DNA, 50 bp, homo sapien
gcatggtaaatatgactctagcctartaaacctcatgactcctgttaggg

SEQ ID NO: 74120 - DNA, 50 bp, homo sapien
aagggaatagaaccttgatgtcacargtatttctcggaagcctgccacat

SEQ ID NO: 74121 - DNA, 50 bp, homo sapien
gttctatctcttgtgtgcttaaatgrtgcgggctcatgaggaaagggaag

SEQ ID NO: 74122 - DNA, 50 bp, homo sapien
gccctataactttcagatggctatgyaataggttccctttagccacctct

SEQ ID NO: 74123 - DNA, 50 bp, homo sapien
aggaaatgggaaaagtactttgaccraataatttataagtttcagtatca

SEQ ID NO: 74124 - DNA, 50 bp, homo sapien
tgaggctgtccagaaaacgtaatgargatgaagattcaccaaataagcta

SEQ ID NO: 74125 - DNA, 50 bp, homo sapien
aaattacctttactgggttttcataygcaatgtttgacactcctattttt

SEQ ID NO: 74126 - DNA, 50 bp, homo sapien
actgtaaaaaccaaaccactctgacygattaaaatttcttgtcttcctgc

SEQ ID NO: 74127 - DNA, 50 bp, homo sapien
ctgatggactctgtcatgactcaaarttcactttttagaggaaaaaaagg

SEQ ID NO: 74128 - DNA, 50 bp, homo sapien
tcatgctgactgtcctggacccacamatcaattatcagtgccagggattt

SEQ ID NO: 74129 - DNA, 50 bp, homo sapien
taaataactgtagatttacagtaaayggcaaaaccactatgtaaggactt

SEQ ID NO: 74130 - DNA, 50 bp, homo sapien
atttattttattgataatgtgtttayatgcattaaatcctttgacagcca

SEQ ID NO: 74131 - DNA, 50 bp, homo sapien
taataattcccacgtctttaataatkgctacttgatccacaggacctaaa

SEQ ID NO: 74132 - DNA, 50 bp, homo sapien
gggccatgtctagaggatactgcccratcacattaggttgctgatcacag

SEQ ID NO: 74133 - DNA, 50 bp, homo sapien
atctgaggtaatgtgtggctatgacygaaaacacctcatgcctagagcct

SEQ ID NO: 74134 - DNA, 50 bp, homo sapien
cagcttataacatgaacagcctgtayaaaattttccttttccaaatcatt

SEQ ID NO: 74135 - DNA, 50 bp, homo sapien
agaatttatgcaaaagcttcaactaygaataaatagcacccatctgcttg

SEQ ID NO: 74136 - DNA, 50 bp, homo sapien
atttctactacttggtgagaagaatractacacattttctaatgcttcat

SEQ ID NO: 74137 - DNA, 50 bp, homo sapien
ctagagtctatcattaacacattackatacttgctttatgcatagctacc

SEQ ID NO: 74138 - DNA, 50 bp, homo sapien
tctcttcccctaggaatgacagaatygggtatgtgagacttcctcagaac

SEQ ID NO: 74139 - DNA, 50 bp, homo sapien
tggatactcatgatcaactttagagrcattccaatcaagtactgcttgat

SEQ ID NO: 74140 - DNA, 50 bp, homo sapien
ccagaaatctgaccactgtatgactyagaatcatggctggatagattaat

SEQ ID NO: 74141 - DNA, 50 bp, homo sapien
atttacatctcatgcatacttattcyatcatcttccctgtaataaaatta

SEQ ID NO: 74142 - DNA, 50 bp, homo sapien
tcttgctataaaagtcctatataacrtcttccaatataagattgtttcat

SEQ ID NO: 74143 - DNA, 50 bp, homo sapien
agaagagggagaaggaaagaacacaytaattcggcaaggttttttaagta

SEQ ID NO: 74144 - DNA, 50 bp, homo sapien
atatttaaaagtcaaaattctgtcaycaataatatttaagcagttctaaa

SEQ ID NO: 74145 - DNA, 50 bp, homo sapien
tttatttagacataatgcaatctcayacttactagactatactatagtgc

SEQ ID NO: 74146 - DNA, 50 bp, homo sapien
ttattcagagcaaaagtctaaagagsctacattttgtagaatgatttttg

SEQ ID NO: 74147 - DNA, 50 bp, homo sapien
cccttacatcaatctcaagagattaraaacctccaaaatgttccgttttc

SEQ ID NO: 74148 - DNA, 50 bp, homo sapien
tactagttctgtccttggacagatcrtataatctcttttagctctagttt

SEQ ID NO: 74149 - DNA, 50 bp, homo sapien
cttttgtgcttcagagaataccataragaaagtgaaagcacaatcaacag

SEQ ID NO: 74150 - DNA, 50 bp, homo sapien
agcacatatgtgaaagtcatagacaraacaaaaacttttaagtttgttta

SEQ ID NO: 74151 - DNA, 50 bp, homo sapien
ggagttctctggggctacaatttgarctatgaattattctgtgggaggaa

SEQ ID NO: 74152 - DNA, 50 bp, homo sapien
ggttctctacacataaatttcctaayggactgaagtttgtattcttatgg

SEQ ID NO: 74153 - DNA, 50 bp, homo sapien
aaacaaacatttgagtagactctatkagaataatgctttgtaatttataa

SEQ ID NO: 74154 - DNA, 50 bp, homo sapien
tacaaagaggtaaaataattgattcrcaggactgtttattagcactataa

SEQ ID NO: 74155 - DNA, 50 bp, homo sapien
ctttcaagtaaccgtcactaatgaamgtgcagaggatgtacatgaggttg

SEQ ID NO: 74156 - DNA, 50 bp, homo sapien
tttagagtttcctcaaagagcatacratacttccatcatattgttcttgg

SEQ ID NO: 74157 - DNA, 50 bp, homo sapien
tgcttcaaaatatagatgaatggacrgataaatagctacatagagataca

SEQ ID NO: 74158 - DNA, 50 bp, homo sapien
ggtggatttccctggtaagtgccaargtcatggatctaccactcggctat

SEQ ID NO: 74159 - DNA, 50 bp, homo sapien
catcaacacttctagggacactcaartaaaaacaagtagcaaagcagatg

SEQ ID NO: 74160 - DNA, 50 bp, homo sapien
gatttatacttggatttccttcatakatttcaagaaagttgagacaggga

SEQ ID NO: 74161 - DNA, 50 bp, homo sapien
atgatgtgatggccttgaggttagtraattttctatcaagaaagggattt

SEQ ID NO: 74162 - DNA, 50 bp, homo sapien
ctttcagtctctttcaagtgaagtaraaacctaaagacacctgtaaagca

SEQ ID NO: 74163 - DNA, 50 bp, homo sapien
cacaaaacactcctgcaatacaaaartacaatacataaatttcactcaag

SEQ ID NO: 74164 - DNA, 50 bp, homo sapien
ttatttgctctggctagcaattccartaccacgttgcatagaagtggtga

SEQ ID NO: 74165 - DNA, 50 bp, homo sapien
gggtagttggtagaccatttatatcrgaagcagtttgttgaaatacagaa

SEQ ID NO: 74166 - DNA, 50 bp, homo sapien
ggtcacatccttgggtggtgcttacmggagctccatgaataggtgctaag

SEQ ID NO: 74167 - DNA, 50 bp, homo sapien
gtccagccctagacttatagctaaamccagatcacacacacacatgcaca

SEQ ID NO: 74168 - DNA, 50 bp, homo sapien
tatttaacagccatttaaaaacaagrcaagcgtaatgtttgcaccaatat

SEQ ID NO: 74169 - DNA, 50 bp, homo sapien
ccatgagtgtggttgcgtgatattayacctacctgtatctttttggacat

SEQ ID NO: 74170 - DNA, 50 bp, homo sapien
ctcatttcttaaagatgtcaaagtgyaattttaaatgtcatattaagtag

SEQ ID NO: 74171 - DNA, 50 bp, homo sapien
gatagcatttaaaatattttgtgacrccttagagataaatgctcaccctg

SEQ ID NO: 74172 - DNA, 50 bp, homo sapien
aactaatgttcttccatttttgtccyattccttgtaatgtagtttagctt

SEQ ID NO: 74173 - DNA, 50 bp, homo sapien
ccccttctgagcagaattgcttgcasagtacatcaggaagaaagcttttc

SEQ ID NO: 74174 - DNA, 50 bp, homo sapien
tctcacattcccaaagctgatttaartaaatttctgagttgttttaattg

SEQ ID NO: 74175 - DNA, 50 bp, homo sapien
aatcaccatttctttctacgtttaastctttccattgttggtgaaggtgt

SEQ ID NO: 74176 - DNA, 50 bp, homo sapien
agtaacaagggtagggtagacctgayagcaactggaactctcatacaata

SEQ ID NO: 74177 - DNA, 50 bp, homo sapien
atcttccttttgcaccttctctatcyactctctatgttcccctgccttct

SEQ ID NO: 74178 - DNA, 50 bp, homo sapien
acagcagcaataggaaactaatccartcacaatcacatcatgtcagattt

SEQ ID NO: 74179 - DNA, 50 bp, homo sapien
tccaaaaaattgaaataacaacatcsaaaaacattttatctgagagtttt

SEQ ID NO: 74180 - DNA, 50 bp, homo sapien
tttacccaactatagaatataattaragtttgacactcacctcccctttg

SEQ ID NO: 74181 - DNA, 50 bp, homo sapien
acattaatttgtaagcagccactggrcaggactaagctatccatgcaatt

SEQ ID NO: 74182 - DNA, 50 bp, homo sapien
agttcattttagataatatttgaaayggaagaagtagctgaggacagaag

SEQ ID NO: 74183 - DNA, 50 bp, homo sapien
caaagtgttgttaaaaatcaagttayagaacagttttatagtatgttgct

SEQ ID NO: 74184 - DNA, 50 bp, homo sapien
gaagttatacctcattcttttaaacrgccaaagaatattatgcatttcgc

SEQ ID NO: 74185 - DNA, 50 bp, homo sapien
cagcatactaacctgatgtttcccayaaacgttgcgcatggaatttcccc

SEQ ID NO: 74186 - DNA, 50 bp, homo sapien
tatcaacaaaagtaattaagcctcakctcaaatcttttatccttggtaag

SEQ ID NO: 74187 - DNA, 50 bp, homo sapien
tttgctacaaggagattatggcacarcatatggagtccttactctccagg

SEQ ID NO: 74188 - DNA, 50 bp, homo sapien
ccatttaggactgatttaatgtaacyagtatcaaaatagggtcagaggta

SEQ ID NO: 74189 - DNA, 50 bp, homo sapien
attaacatacctcaataagcaaaaaygagatcaaacatcaatgaaaacac

SEQ ID NO: 74190 - DNA, 50 bp, homo sapien
gtcttccttcaccaccctttgtcggmcagagcctgatattcatactcagg

SEQ ID NO: 74191 - DNA, 50 bp, homo sapien
atcagggaaaatcaatagcctgagasgaagttgtacatacacacacccag

SEQ ID NO: 74192 - DNA, 50 bp, homo sapien
taaaagattacagctaattatgtagrcacactggcccttagacctatctt

SEQ ID NO: 74193 - DNA, 50 bp, homo sapien
atgatacctataatattattttgtaygtaacagacagtaatcatgtaaaa

SEQ ID NO: 74194 - DNA, 50 bp, homo sapien
agctagtcatggttgcccagagataragaatgaataggatgtgtatatat

SEQ ID NO: 74195 - DNA, 50 bp, homo sapien
aatagacactggtgcctacatactckatatgttagatgatcatatgccat

SEQ ID NO: 74196 - DNA, 50 bp, homo sapien
atttgaaagcagtgaactatagaagragaaaataggattaaaaagccgtc

SEQ ID NO: 74197 - DNA, 50 bp, homo sapien
aaccaccaaccacaggatatatatcrttctcagctggacaagaaacatac

SEQ ID NO: 74198 - DNA, 50 bp, homo sapien
atcaaaccctaaggacttaaaccagycagtcagcaagcatctcataactg

SEQ ID NO: 74199 - DNA, 50 bp, homo sapien
ccaaggtctctaaggcacagatgcarattctctctcctcctgggacctag

SEQ ID NO: 74200 - DNA, 50 bp, homo sapien
tctctcagctctgcgtctgactttayggacttgcatccatccaaatacaa

SEQ ID NO: 74201 - DNA, 50 bp, homo sapien
accaatacgattaaattgtgattccmaataagacttgttgattctccaac

SEQ ID NO: 74202 - DNA, 50 bp, homo sapien
agcagcaccttcttctgtactcttaycataatttgtttacatccgttgac

SEQ ID NO: 74203 - DNA, 50 bp, homo sapien
taagactctccctctcttaataactsaataatagtaataatacctttttt

SEQ ID NO: 74204 - DNA, 50 bp, homo sapien
agtaagagctgacaccagtgacaagractcacggtactaggaaagcctcc

SEQ ID NO: 74205 - DNA, 50 bp, homo sapien
acattaagtgctttccattatttcaytcaaccttcacaacagtcctgtga

SEQ ID NO: 74206 - DNA, 50 bp, homo sapien
tcatctgtcctcttttgtcagcctcyataatggcaaaactgggtgtcatc

SEQ ID NO: 74207 - DNA, 50 bp, homo sapien
tctaaagcccagttgttcattgttarggatgttagaaaaggagagaccca

SEQ ID NO: 74208 - DNA, 50 bp, homo sapien
ctagggatttaggcttccacattcartctatagcctatagttattcattt

SEQ ID NO: 74209 - DNA, 50 bp, homo sapien
tatatactttaaatagaaatcagtamatttcatccacacttagcttcaaa

SEQ ID NO: 74210 - DNA, 50 bp, homo sapien
tgtcattggttttgataggatggaaygagaggattgaggtagtgtccttt

SEQ ID NO: 74211 - DNA, 50 bp, homo sapien
gataaccagggttctcaatgaagcawtctacaattctaaatggcataaaa

SEQ ID NO: 74212 - DNA, 50 bp, homo sapien
tattggattagaagtaaagacatcckgaacgttctctaggagtgtgtgta

SEQ ID NO: 74213 - DNA, 50 bp, homo sapien
acaacaacaaaacacacttaaattgratggccaaagaaataaggcataaa

SEQ ID NO: 74214 - DNA, 50 bp, homo sapien
ctcaaaacaaccaaaagttctgatayggtctaaaacacctaaaagaaaaa

SEQ ID NO: 74215 - DNA, 50 bp, homo sapien
caaataaaaagcgtgctgtatgtcakaaaatactgggaagatactcatcg

SEQ ID NO: 74216 - DNA, 50 bp, homo sapien
aaattatttgctttttagaaaattayatgttctttacacagtgcaaatgt

SEQ ID NO: 74217 - DNA, 50 bp, homo sapien
cgcactggcttaaaacagggccataytacctcatgcatgatttccacttt

SEQ ID NO: 74218 - DNA, 50 bp, homo sapien
aaacagcccatgatcccgttggagargctacaaagaaatgctatagaaat

SEQ ID NO: 74219 - DNA, 50 bp, homo sapien
agtctgggtctaatgcttacaaattraacaaaggagtgagtctcttgttg

SEQ ID NO: 74220 - DNA, 50 bp, homo sapien
ctctcattccatcctatcaaaaccartgacaacttccatcaactatgaaa

SEQ ID NO: 74221 - DNA, 50 bp, homo sapien
cggaggtgtaagtcagaggttaggamaaacgttatgtggtgggattggtt

SEQ ID NO: 74222 - DNA, 50 bp, homo sapien
ctcaccagctgaatttccagactaaragaaaatgtgcctggagctttctg

SEQ ID NO: 74223 - DNA, 50 bp, homo sapien
accttttttcatgtcagcaaacacarattttcatcatttttaatgttgaa

SEQ ID NO: 74224 - DNA, 50 bp, homo sapien
gcaaggaaatgtgaaccacataggaygaattctgcatatgagaggaggtg

SEQ ID NO: 74225 - DNA, 50 bp, homo sapien
cctactatgtgccataagcatttacragggactatgatttgaaatgcatt

SEQ ID NO: 74226 - DNA, 50 bp, homo sapien
tctcaatcagtgttttaaatgtgtaygtggatgagtaagctatgactaga

SEQ ID NO: 74227 - DNA, 50 bp, homo sapien
aggtaaaatgtgacataagcggatamtataaaatagcaataaattgtgca

SEQ ID NO: 74228 - DNA, 50 bp, homo sapien
gatactatccagctcacagagttcaygttagaatcaaatggaaaccaaag

SEQ ID NO: 74229 - DNA, 50 bp, homo sapien
gtgactgtaactcaacctctgtagcrccactaaaacgttaaactaagatt

SEQ ID NO: 74230 - DNA, 50 bp, homo sapien
ttttgtactaaaattatagcagaaakatacaacttaacgagaaatgaaaa

SEQ ID NO: 74231 - DNA, 50 bp, homo sapien
aacctaatcctaactgatacaggaawgttcccagaaaagagatgtgaagg

SEQ ID NO: 74232 - DNA, 50 bp, homo sapien
ctggctgcaaaacctgtgatgttagracctgctaacggaagttaactttg

SEQ ID NO: 74233 - DNA, 50 bp, homo sapien
acgcactttgcccatttcttttctawacattgttaactgtattaggattc

SEQ ID NO: 74234 - DNA, 50 bp, homo sapien
caattgcagaggctgcagggtatgaygagactgaaacagggtgtggaatc

SEQ ID NO: 74235 - DNA, 50 bp, homo sapien
aaggatctagaactggacttttaatmaatagttctgctgccactgaactc

SEQ ID NO: 74236 - DNA, 50 bp, homo sapien
tgaaaaaacaaatgggtgagtaaacygcctaagtgatgaacaggtgaaca

SEQ ID NO: 74237 - DNA, 50 bp, homo sapien
ttagtgttttaaagtgaaatgatggktagagtctaaaagaggaaagatta

SEQ ID NO: 74238 - DNA, 50 bp, homo sapien
tgctgattttgatggaaaggacatcrcaaggctcaacctgctttaaaaca

SEQ ID NO: 74239 - DNA, 50 bp, homo sapien
ttgaatgtctactatgtatcagccargtacagtcatccctcagtagctgt

SEQ ID NO: 74240 - DNA, 50 bp, homo sapien
acaagaaagctggtttctttgatttracagacaatgtatagaccatttgg

SEQ ID NO: 74241 - DNA, 50 bp, homo sapien
cacttactttttttgtggttatatamaataagtaatccaacctataatta

SEQ ID NO: 74242 - DNA, 50 bp, homo sapien
ggagattggcattagaattgatggaytaagcaagaaagagccacccacaa

SEQ ID NO: 74243 - DNA, 50 bp, homo sapien
cttcatccttgaccctgagaaatctkaagtaactttatggataagaagac

SEQ ID NO: 74244 - DNA, 50 bp, homo sapien
tttgatcttatgtaaaaattgttcarctatacagagagttcccatatatc

SEQ ID NO: 74245 - DNA, 50 bp, homo sapien
ctaaatgcaaagattctctctctacrccgtgtggccactcccagggaatt

SEQ ID NO: 74246 - DNA, 50 bp, homo sapien
tcaaagcagtcaaggaaacaagtgaygtagggtaagagatgatttatgcc

SEQ ID NO: 74247 - DNA, 50 bp, homo sapien
ctgtaggtgctacaggtaggtatgargaaaaagaacatgcaattaagaga

SEQ ID NO: 74248 - DNA, 50 bp, homo sapien
ttttacacagatgagctgtttcacayaattcctctagtgagaaacagaat

SEQ ID NO: 74249 - DNA, 50 bp, homo sapien
actcttataagaattcacaatgtaayaggactaaggaaggagtcttgagt

SEQ ID NO: 74250 - DNA, 50 bp, homo sapien
gtgctattttgttattcttatgtccrccaagttatattaactcacaatgt

SEQ ID NO: 74251 - DNA, 50 bp, homo sapien
ctttgtgcatttgctgtacatacacygtgaaaagccctgtgccagcccaa

SEQ ID NO: 74252 - DNA, 50 bp, homo sapien
ctgtaaagtaaggaaatacctcaatycttatgcttcaggctgtgcaaaac

SEQ ID NO: 74253 - DNA, 50 bp, homo sapien
cccacttgaaatgcaggctccagtcraaccctaagggacacagcaaggtg

SEQ ID NO: 74254 - DNA, 50 bp, homo sapien
gcactgccatccaatgggcactaaaygttagtatcaaaacaacagaatta

SEQ ID NO: 74255 - DNA, 50 bp, homo sapien
aaggtaattaagctgtcactgcaaasgagaacgattagctccacctgact

SEQ ID NO: 74256 - DNA, 50 bp, homo sapien
tatggaaattacctctatgactgtarcctcattagcattattctccttga

SEQ ID NO: 74257 - DNA, 50 bp, homo sapien
agagcatctcttgctacctccattcraagagactgatgttttctgtgtaa

SEQ ID NO: 74258 - DNA, 50 bp, homo sapien
tgaacaacattagacttttaaagtaygtagaacaatttatataggtgaga

SEQ ID NO: 74259 - DNA, 50 bp, homo sapien
ctaaaatatggccttggtgtattaaragactcagtaaaaataaactattg

SEQ ID NO: 74260 - DNA, 50 bp, homo sapien
aatttaaacttaaaaataaaacgtawgacttgatctgtataagcagaaga

SEQ ID NO: 74261 - DNA, 50 bp, homo sapien
ttaatagcacctacaatatttaagargcgaagagtacctgaggtcccaaa

SEQ ID NO: 74262 - DNA, 50 bp, homo sapien
ctattaatatttaccactcaacagayggattaacaagtctgtttctcatt

SEQ ID NO: 74263 - DNA, 50 bp, homo sapien
tggccaagctgagaatcacttataawaagctgtcaaatttaatgaccaca

SEQ ID NO: 74264 - DNA, 50 bp, homo sapien
aaagtctactggtccaaagaggctaycccagagagataaggaaagtgagt

SEQ ID NO: 74265 - DNA, 50 bp, homo sapien
cagtttcagtggataaagaaccaatsaaaacaagtgttcaggtgataaca

SEQ ID NO: 74266 - DNA, 50 bp, homo sapien
acatctagaatactcaatacaaatcrgaaaaagataaaactaaaaggcaa

SEQ ID NO: 74267 - DNA, 50 bp, homo sapien
agttggagatccagagataaaaaaawtatacagccctggccttcaagaga

SEQ ID NO: 74268 - DNA, 50 bp, homo sapien
gctaggaaaatataaaacaggactcraggggaatgtaaaacaggaggctc

SEQ ID NO: 74269 - DNA, 50 bp, homo sapien
caccatactgtgtaatagatcacaakagcttatcccttttgcctaactga

SEQ ID NO: 74270 - DNA, 50 bp, homo sapien
aggcacttcataactatttgctaacygacaaccaaatgaataacaaaagt

SEQ ID NO: 74271 - DNA, 32 bp, homo sapien
aagaggggatatggctytaagtcagagtaata

SEQ ID NO: 74272 - DNA, 50 bp, homo sapien
caaactaacagccaaaatcacagtamaggaagggtctggttaaacatcgc

SEQ ID NO: 74273 - DNA, 50 bp, homo sapien
ctcactgtggctgcagcttgggaatracatccagagcttacccacctgca

SEQ ID NO: 74274 - DNA, 50 bp, homo sapien
tattacacctatagcttatttcttaygcaggtgggtaagctctggatgtc

SEQ ID NO: 74275 - DNA, 50 bp, homo sapien
gaaggacacgtggtattatctatccraaagatcaacaaagatgaaaaaag

SEQ ID NO: 74276 - DNA, 50 bp, homo sapien
gaacatacaaggcggttttcaataaytaaactgtctatggtaggcaaaaa

SEQ ID NO: 74277 - DNA, 50 bp, homo sapien
taaaaggtctatatctactcaaagasgaaaactaggataaggtaggagtg

SEQ ID NO: 74278 - DNA, 50 bp, homo sapien
atgaaaattgtactaacctcctcaarcaaataagatctgttcttactttg

SEQ ID NO: 74279 - DNA, 50 bp, homo sapien
tcgtggtgccaggccaattactaccwcaagcactgaagtcacttttcaaa

SEQ ID NO: 74280 - DNA, 50 bp, homo sapien
tgtccttgccgcgaagcaggagtacygccttacttggctgcatgagtggt

SEQ ID NO: 74281 - DNA, 50 bp, homo sapien
aagtagttgactttgataatgaaaargtatcatcatgattatcgtcatgc

SEQ ID NO: 74282 - DNA, 50 bp, homo sapien
cagacagagcccttttaagaaatcawatagcttctggggcaattaatatt

SEQ ID NO: 74283 - DNA, 50 bp, homo sapien
aaactagattttctgcctggatctaygagtgtaaggcaaaatgttatgtg

SEQ ID NO: 74284 - DNA, 50 bp, homo sapien
tatgctgtctggcatgtgtaggaacrgaaagaataaattgaagtacagtg

SEQ ID NO: 74285 - DNA, 50 bp, homo sapien
tactggagtaggcctcgtttcgaacrcatcagtaagtaggtaggtctctg

SEQ ID NO: 74286 - DNA, 32 bp, homo sapien
ttctgatttttggacayggtctcattttctaa

SEQ ID NO: 74287 - DNA, 50 bp, homo sapien
ttccttattttctaagagagcaggaygttttatatcttacatggtctggt

SEQ ID NO: 74288 - DNA, 50 bp, homo sapien
aagaatttgctacaaatcatgctagraatcagtgacaaataatagatgaa

SEQ ID NO: 74289 - DNA, 50 bp, homo sapien
taagttgttatcaacctacctgtgckatctaatcattacctccattcctt

SEQ ID NO: 74290 - DNA, 50 bp, homo sapien
gtctccaagagggaggaatgacatgygtgacatattccccttgctcgttc

SEQ ID NO: 74291 - DNA, 50 bp, homo sapien
aagttttaaaaacatgatggtttccyacttagccacagggaagatttgtc

SEQ ID NO: 74292 - DNA, 50 bp, homo sapien
ttccattttaactaagcccatgacaraggaggtagaacatagttgttaag

SEQ ID NO: 74293 - DNA, 50 bp, homo sapien
aagatcttttagatattagttgttaytcatttgtgagaaaactcacatcg

SEQ ID NO: 74294 - DNA, 50 bp, homo sapien
tacctctaggaatccagagtaagagyccgtacctcctttgtttttcctcc

SEQ ID NO: 74295 - DNA, 50 bp, homo sapien
tgcatcccaagtggcagagaaacctsagcagttatccagcacttttagag

SEQ ID NO: 74296 - DNA, 50 bp, homo sapien
ctacacctgcacaccagctgagttgsaggaaaaggaaaagcaagatggat

SEQ ID NO: 74297 - DNA, 50 bp, homo sapien
taaaattatcacatgaattttgaatyattatgtgttcaacatacacttat

SEQ ID NO: 74298 - DNA, 50 bp, homo sapien
tttttcctccaaggccccaatgttargaaaaatgttctacaattaaaaat

SEQ ID NO: 74299 - DNA, 50 bp, homo sapien
gatagatatcagaaactagttcggamctcaactggaccctccttgggcta

SEQ ID NO: 74300 - DNA, 50 bp, homo sapien
cttgttacgatccttttccaaatccyagtaaacatcgcaaatgcattctg

SEQ ID NO: 74301 - DNA, 50 bp, homo sapien
agcacacaagtgcacatgtgcttcartagtagtagcttacccagcattgg

SEQ ID NO: 74302 - DNA, 50 bp, homo sapien
aaaatatatttaactgccctgagagragatatattagaaaatgatgacac

SEQ ID NO: 74303 - DNA, 50 bp, homo sapien
tagttgttttctttaagtacttacaygtggagacactgtctgaagaatgt

SEQ ID NO: 74304 - DNA, 50 bp, homo sapien
ttaaatttttcactgttataaacaaytctgtgataaatgaaggaatcttt

SEQ ID NO: 74305 - DNA, 50 bp, homo sapien
ggtttggccaggttcccaggagaccrcagtgaggaaggattagggaggat

SEQ ID NO: 74306 - DNA, 50 bp, homo sapien
gagatcttactcctggaatgcttacygaaagctgcagtttaaggaatccc

SEQ ID NO: 74307 - DNA, 50 bp, homo sapien
gatgccaactcctttaggagtgacaygactcatccttaactttttataaa

SEQ ID NO: 74308 - DNA, 50 bp, homo sapien
ttatgtctgaatcactaggtaaagcrgaaagattaatgaccaagtgaact

SEQ ID NO: 74309 - DNA, 50 bp, homo sapien
catttgagactatccagagtatgctwctttccgaggcaatggaaccatgt

SEQ ID NO: 74310 - DNA, 50 bp, homo sapien
ttgataaaagaatgatttatgtatgyagtatctgcttctatgactgacac

SEQ ID NO: 74311 - DNA, 50 bp, homo sapien
gaaggttcagaggctggacagtcaaraaatcctgaactgttcactacatt

SEQ ID NO: 74312 - DNA, 50 bp, homo sapien
gttttgtatcccaatttatgtctacrgaatacaaaagttctttgcaatgg

SEQ ID NO: 74313 - DNA, 50 bp, homo sapien
gtcatttcctatcttaactacttgargaatgactttccaatgcttaaagg

SEQ ID NO: 74314 - DNA, 50 bp, homo sapien
ccggaggcctggcaaagcacctcctsagcactcactacccagtcccaggc

SEQ ID NO: 74315 - DNA, 50 bp, homo sapien
gagaataccagtccttcaggattaargccccattcttataactttattta

SEQ ID NO: 74316 - DNA, 50 bp, homo sapien
gagtcactttttttataaataatatraggaccaagatttttaaaaatatg

SEQ ID NO: 74317 - DNA, 50 bp, homo sapien
gctctaccttctttttcagctcagaygtgttaccaatgcagatgcagtta

SEQ ID NO: 74318 - DNA, 50 bp, homo sapien
atgtctttcccatctcaattacaccractccatctgtttagtggttcagg

SEQ ID NO: 74319 - DNA, 50 bp, homo sapien
gttaaaatagacttacttcaactgastataaaataactaaatctagagtt

SEQ ID NO: 74320 - DNA, 50 bp, homo sapien
caaccatgtgccctcttgagtctatycttgtctctgtaatgattagcagg

SEQ ID NO: 74321 - DNA, 50 bp, homo sapien
tatattcgtatttgcataacatctaytaaaagtatactttttttgttgtt

SEQ ID NO: 74322 - DNA, 50 bp, homo sapien
ccaggttatcctcccagaaatccaasaaagaatggaaataattgattttt

SEQ ID NO: 74323 - DNA, 50 bp, homo sapien
gacaatactgccccactggatgactsaaaaggatacttgtgcaaccaggc

SEQ ID NO: 74324 - DNA, 50 bp, homo sapien
tattcagtataatgtagaaactcaamaggtattactctactaagttactg

SEQ ID NO: 74325 - DNA, 50 bp, homo sapien
gtaaaatgaggtttctaatagtactycatcatagagttattaggagggtt

SEQ ID NO: 74326 - DNA, 50 bp, homo sapien
tctgagcatctctttgggtatacaamataatggcatatgctgtatatatt

SEQ ID NO: 74327 - DNA, 50 bp, homo sapien
agtccaggaggtaaactttagtccaygttcagttctttcttctgtgggag

SEQ ID NO: 74328 - DNA, 50 bp, homo sapien
atgtcaatgagtgagaaaatgtaggscttttaattccatatgtggttttt

SEQ ID NO: 74329 - DNA, 50 bp, homo sapien
gagtaaggcaaacaggcatatttctraagattgagatgttcaaatccagt

SEQ ID NO: 74330 - DNA, 50 bp, homo sapien
agtttaccccttcagttctgatttgyaatatccaatattcttttgaaata

SEQ ID NO: 74331 - DNA, 50 bp, homo sapien
ttagggagcatggaggaacacaatayagcagagttgtgaagtctctgtca

SEQ ID NO: 74332 - DNA, 50 bp, homo sapien
tcgtacacataccctataaagacacsaggtaattaaaaaacaattgaacc

SEQ ID NO: 74333 - DNA, 50 bp, homo sapien
aggaaggaaagcaaagaaagaatcargtaaaggtacaagtaaaagggaat

SEQ ID NO: 74334 - DNA, 50 bp, homo sapien
tccaaatactggagcccataataaastggtctgcattacatgatagaaag

SEQ ID NO: 74335 - DNA, 50 bp, homo sapien
cgtggttaaccttaaacacagatatyacattgtctaacttctagcaggga

SEQ ID NO: 74336 - DNA, 50 bp, homo sapien
atgaagaagttgttttcaagaaatasgaaggttacaggccaggcgtggtg

SEQ ID NO: 74337 - DNA, 50 bp, homo sapien
ttatgtggcacatgactatatgtggmaaagcacgaacaagctggttttcc

SEQ ID NO: 74338 - DNA, 50 bp, homo sapien
actcttcatatgttcattggacataygagtcctgccttctgcgaactgct

SEQ ID NO: 74339 - DNA, 50 bp, homo sapien
tcactctaggggtacaaagtttctaygtgtactttgtcaaaagaggcaaa

SEQ ID NO: 74340 - DNA, 50 bp, homo sapien
tacaatgaataactgaacacattatsactgttttttaaacctagtctttc

SEQ ID NO: 74341 - DNA, 50 bp, homo sapien
ccacaggatctgactttcagcaggcratgcttatttatacactgcatatg

SEQ ID NO: 74342 - DNA, 50 bp, homo sapien
agaaagaagaaagagatagattttaygtatagtatatatcacttaacacg

SEQ ID NO: 74343 - DNA, 50 bp, homo sapien
caaaacatcacattgtgcattataartatatccaatttttatttgtcaat

SEQ ID NO: 74344 - DNA, 50 bp, homo sapien
actgtgtctagtgaacatctttccaygttaaaaaatgttgatttctgcgt

SEQ ID NO: 74345 - DNA, 50 bp, homo sapien
aggcaaattcttatttgtatatccayggctaggtctaaagaggtatcctg

SEQ ID NO: 74346 - DNA, 50 bp, homo sapien
aactaaagtactgttcatcagcttcragtaacaaacataccatagacaaa

SEQ ID NO: 74347 - DNA, 50 bp, homo sapien
gcatattgacaaggatagaataaaamatgcgtgtgaatcaaatgctttgc

SEQ ID NO: 74348 - DNA, 50 bp, homo sapien
aaaacccagaaccagcagaaaagagwcccaacaaagaaatgactgttggt

SEQ ID NO: 74349 - DNA, 50 bp, homo sapien
tcttattagagccctgcaattaagaraagatttaagagttaacatttaca

SEQ ID NO: 74350 - DNA, 50 bp, homo sapien
tacctcttccctttacatatgaaagmaacctggagtaataaactctgaaa

SEQ ID NO: 74351 - DNA, 50 bp, homo sapien
cactataattttgcaccttgactaaragaaaggtaatacatagccttgtt

SEQ ID NO: 74352 - DNA, 50 bp, homo sapien
ttcaatggactaccaaaaatcagccrctataaaacccaatgaagtcctca

SEQ ID NO: 74353 - DNA, 50 bp, homo sapien
tagataggtcaaattgctgagaaaayaagtaagttacagtttctctcact

SEQ ID NO: 74354 - DNA, 50 bp, homo sapien
tcagcagcttgaagactttaaaacayaggacagagcagtaagacaaacag

SEQ ID NO: 74355 - DNA, 50 bp, homo sapien
caaggaccctgaatcatcccggaacygtcttggtgctgtggtagacaggc

SEQ ID NO: 74356 - DNA, 50 bp, homo sapien
cctagaatttgcagagtgctgctcaygtaagccctgaaccccactccaga

SEQ ID NO: 74357 - DNA, 50 bp, homo sapien
cgaattttctatctctgaaattataraggaggagaaataaattcaggagg

SEQ ID NO: 74358 - DNA, 50 bp, homo sapien
aaaaaaaaccgacaatttatagtcastaagcatctactatggtaccatgg

SEQ ID NO: 74359 - DNA, 50 bp, homo sapien
gtataagatccaaagtacatgtcaamcttttctgtgtattttcctttaag

SEQ ID NO: 74360 - DNA, 50 bp, homo sapien
catagcacgtccataacacaaatagmcctcaggaggaatcgtgacatcca

SEQ ID NO: 74361 - DNA, 50 bp, homo sapien
atctcaatattgagaactatgtagamataaaactactgttaattatagac

SEQ ID NO: 74362 - DNA, 50 bp, homo sapien
aattataaaaaaaaaagaatgaatcraccatcgagacagcgaaaagacaa

SEQ ID NO: 74363 - DNA, 50 bp, homo sapien
tcatcaagtatactggaagtcagaawggctcctcctccatgatgcccctg

SEQ ID NO: 74364 - DNA, 50 bp, homo sapien
attttccctctacttttgttctaatsaccctattggcagatactacttta

SEQ ID NO: 74365 - DNA, 50 bp, homo sapien
atgggtactattcaaaaaggaatgckccgcgagtgttatcatggcaaaac

SEQ ID NO: 74366 - DNA, 50 bp, homo sapien
ggaatggcccagtgcagtcctagtcragatggccacacctcccccaactc

SEQ ID NO: 74367 - DNA, 50 bp, homo sapien
ctagaagctgcttgtctttagctttsaaagtagatcttgcctcctttttg

SEQ ID NO: 74368 - DNA, 50 bp, homo sapien
gaattcttcctagagttgaaagagamataactttgattctttccagatgc

SEQ ID NO: 74369 - DNA, 50 bp, homo sapien
tcagactaagtggttttacactatgrattccagaatgaggtctcaattca

SEQ ID NO: 74370 - DNA, 50 bp, homo sapien
gtgtgtaatagaatgatggaagaatkattaaggaaaacatgtcatttctg

SEQ ID NO: 74371 - DNA, 50 bp, homo sapien
aatttaaaaaccagaaatcaggctayggttccagctacacatttattggt

SEQ ID NO: 74372 - DNA, 50 bp, homo sapien
cttgtccaaatcttcaaattagtacrgctcatattcttggcctcatatcc

SEQ ID NO: 74373 - DNA, 50 bp, homo sapien
actgaggctaaaactgttgtttattraagttatggggaaaaaagttcatg

SEQ ID NO: 74374 - DNA, 50 bp, homo sapien
taggtggaataaatagtgacttacckcttaaccacagtgaaaaacccatc

SEQ ID NO: 74375 - DNA, 50 bp, homo sapien
tatcacaaaagaaaaggccaattaamgccctgaatgagagagagttctgt

SEQ ID NO: 74376 - DNA, 50 bp, homo sapien
atgctttggaaatgggtgtgcaacaytgggttttgctttaaagtgcaatg

SEQ ID NO: 74377 - DNA, 50 bp, homo sapien
atgtgcctttatgatataacgtttcmctcggtataatggatatttgtcag

SEQ ID NO: 74378 - DNA, 50 bp, homo sapien
tcccaagcccagcaagcagagtatgygataagagatagaaacagggacag

SEQ ID NO: 74379 - DNA, 50 bp, homo sapien
ataggtaaacaaaaaatagtagtccratagagggaagcctaacatatagc

SEQ ID NO: 74380 - DNA, 50 bp, homo sapien
gtatacagtgagcatgacatgttccrgaggattgctaaggaagaaactgt

SEQ ID NO: 74381 - DNA, 50 bp, homo sapien
cccagtttattagtcagggtctatckcctaggtcactctcatgaatctgg

SEQ ID NO: 74382 - DNA, 50 bp, homo sapien
taaagctattttttgctctggctttygcaacatcccataatttttgatag

SEQ ID NO: 74383 - DNA, 50 bp, homo sapien
tcttagtagcaggaggtggaagataytataatttgtcgtttactttggag

SEQ ID NO: 74384 - DNA, 50 bp, homo sapien
cgttatcatgccctttattactctarccttataggatgtttgaatattta

SEQ ID NO: 74385 - DNA, 50 bp, homo sapien
attgatcaatggtatgggctagaaartcttgaaaccaaagattttataat

SEQ ID NO: 74386 - DNA, 50 bp, homo sapien
gcatatttctgtttttaccccttaayaatgagacagcaacccaaataaca

SEQ ID NO: 74387 - DNA, 50 bp, homo sapien
tattataatgttagcaatgttctaayagttcaaattaagcttatatttgt

SEQ ID NO: 74388 - DNA, 50 bp, homo sapien
cttgttcctccgataaatgggaaacrgtggagaatatagaggtggaagac

SEQ ID NO: 74389 - DNA, 50 bp, homo sapien
aaggaatagaatatatacattttcartcctcagagatggaaattctacca

SEQ ID NO: 74390 - DNA, 50 bp, homo sapien
aaggaggaagtgaaggagtaatacaygtccttttataacactccctatct

SEQ ID NO: 74391 - DNA, 50 bp, homo sapien
caagacctagaattgtagattatagycagaatgcagcaaagaggttctcc

SEQ ID NO: 74392 - DNA, 50 bp, homo sapien
aaaggttgagttgcggatgagaaatmaatcggagctgcttgtgaggccgc

SEQ ID NO: 74393 - DNA, 50 bp, homo sapien
atgtccggagtggtgatgggcaccaygtgatcaataaggtttctatcacc

SEQ ID NO: 74394 - DNA, 50 bp, homo sapien
aagtcatgcatttccaaagtacgttsaaagcctctgaatcaccatcctta

SEQ ID NO: 74395 - DNA, 50 bp, homo sapien
tctgaatcaccatccttagggaacayatttttctcgaacaaagagacatc

SEQ ID NO: 74396 - DNA, 50 bp, homo sapien
agcatcatgcctatagatggtactcratgatgccacttcattaactgcct

SEQ ID NO: 74397 - DNA, 50 bp, homo sapien
ccattctaccaaaaacaatgtttatyacgtgtaacaagaatcctggttaa

SEQ ID NO: 74398 - DNA, 50 bp, homo sapien
agctccactttctgattgttgctgaygtattataacacaactgattttat

SEQ ID NO: 74399 - DNA, 50 bp, homo sapien
gagggtgatgaaaatgttctaaaatkgattaccaggatgattgtacaact

SEQ ID NO: 74400 - DNA, 50 bp, homo sapien
caaagcatgctcccttgtgaaaaaayattaagttaccagctggcacaaat

SEQ ID NO: 74401 - DNA, 50 bp, homo sapien
aagggcctcaaataccaactaaaccrcttatccacttctcgtagccgctt

SEQ ID NO: 74402 - DNA, 50 bp, homo sapien
gcattatggacaaaatgtcttgtaarattcaatgacttttatcttaaagt

SEQ ID NO: 74403 - DNA, 50 bp, homo sapien
aggagttttggactatagtgtattaygctgatacatacttagtgtgagaa

SEQ ID NO: 74404 - DNA, 50 bp, homo sapien
gctggagaccttggaaaatccacttmacttcctgaagactcagtttcctc

SEQ ID NO: 74405 - DNA, 50 bp, homo sapien
tgaaaaatatgaagtccaagtcttaygacagcatttattacatcttaagc

SEQ ID NO: 74406 - DNA, 50 bp, homo sapien
tcttgtgttgttgtatattcaaagayagatagagctgaaaagaagcaagt

SEQ ID NO: 74407 - DNA, 50 bp, homo sapien
cttagagatagtagccaaaatatccratggttatgaactatagattggga

SEQ ID NO: 74408 - DNA, 50 bp, homo sapien
tttcaccaaatggcaagtgatccaayaactaagtctaatattaaaaatct

SEQ ID NO: 74409 - DNA, 50 bp, homo sapien
aaaggtttatttataaattaggcacrgtatagatgaacaataataactaa

SEQ ID NO: 74410 - DNA, 50 bp, homo sapien
gcaaagtggtaagctgtgattgggakacagtcaaggaaggataaaaattt

SEQ ID NO: 74411 - DNA, 50 bp, homo sapien
agcgtttgctgacaaagtctctaatkatctcaggaccagtcagggtaatt

SEQ ID NO: 74412 - DNA, 50 bp, homo sapien
tgtttttgaaaatggaaagtcaatcrcaaattatgactagaggaatatat

SEQ ID NO: 74413 - DNA, 50 bp, homo sapien
aaatacatttcttattttgattaggmataacacagggaagaggtcctgcc

SEQ ID NO: 74414 - DNA, 50 bp, homo sapien
gatgaaaactgacgtcaggcaaagarcttcttacacgctccccatggcag

SEQ ID NO: 74415 - DNA, 50 bp, homo sapien
ctgatcaagtactgtaaggttttaasaactcaatgttagtattatagcag

SEQ ID NO: 74416 - DNA, 50 bp, homo sapien
taggcctctagaaggaagataaacaygtgatagagtcaaggggtaagcaa

SEQ ID NO: 74417 - DNA, 50 bp, homo sapien
tgccttatgagatcctaagtgatacrgaccagagactgctgcattgctcc

SEQ ID NO: 74418 - DNA, 50 bp, homo sapien
ctttgcttcagagaaattaattataycctgtattgagctattggattcct

SEQ ID NO: 74419 - DNA, 50 bp, homo sapien
ccatagctctgagcaaccattccacygcggagtatatatcttaaagtctc

SEQ ID NO: 74420 - DNA, 50 bp, homo sapien
tcttagtgggagggacaattcctctyagagagttatcagtgaagctgtga

SEQ ID NO: 74421 - DNA, 50 bp, homo sapien
tcacattgcaagacttgaagacttgyaactcaaaatggtatatttttttc

SEQ ID NO: 74422 - DNA, 50 bp, homo sapien
agtcttgggactgaggagtgcattasgaaaacaaaagagaaagcccaggt

SEQ ID NO: 74423 - DNA, 50 bp, homo sapien
gctcagtatctaagggagtatataaytaattcaccattgtttttttaaaa

SEQ ID NO: 74424 - DNA, 50 bp, homo sapien
tctgaagaggctaaacgagaaaggaygtgggctcaaaggaaactggtgta

SEQ ID NO: 74425 - DNA, 50 bp, homo sapien
ggaaatattgcaggacttaacacagrattgtttttctcttcatttctcta

SEQ ID NO: 74426 - DNA, 50 bp, homo sapien
gaagtcaagaaggctccaactgcacygagttagctctactcagactggga

SEQ ID NO: 74427 - DNA, 50 bp, homo sapien
acttagtacagtaagcatgaacatayagtatacagctaggcacagcagta

SEQ ID NO: 74428 - DNA, 50 bp, homo sapien
ccctctctttctaattttcagccacrtttatttactgtctgtttctccct

SEQ ID NO: 74429 - DNA, 50 bp, homo sapien
aacatgctttcctctttttcattgcycttaactatatctctttgtatatc

SEQ ID NO: 74430 - DNA, 50 bp, homo sapien
gatgaagataactgtgactacacatragtttgcaggcatcaggacaggaa

SEQ ID NO: 74431 - DNA, 50 bp, homo sapien
gaggaagaattacatgttcccagtakatcagtaaaagtacacaaaacttt

SEQ ID NO: 74432 - DNA, 50 bp, homo sapien
agttttttttgtacaatcagcataaygtggtttcagggtccattcaaatc

SEQ ID NO: 74433 - DNA, 50 bp, homo sapien
accaatgatgataatgacccattaaygagcttgtaagaatgagtagctca

SEQ ID NO: 74434 - DNA, 50 bp, homo sapien
ggtgatatgaaagaagactattttakgtagaagacaaaggtctggagtca

SEQ ID NO: 74435 - DNA, 50 bp, homo sapien
ctcatctccaacccctttcaaagcaycacccatacggtgaaagagcatct

SEQ ID NO: 74436 - DNA, 50 bp, homo sapien
gtgttcctttacaactgaacgattayaaaccagaccatacctagcaggcc

SEQ ID NO: 74437 - DNA, 50 bp, homo sapien
aattctgttttcatcaaatgaaaccraaaggaattacagccaaataatgc

SEQ ID NO: 74438 - DNA, 50 bp, homo sapien
agcactggttataaatggtatgatcmaaggtgtattatatgccagttagc

SEQ ID NO: 74439 - DNA, 50 bp, homo sapien
tggaagaaaatcataaagtgcatcaktataaaacaaataaaggtaattag

SEQ ID NO: 74440 - DNA, 50 bp, homo sapien
gcgcagcctgcgttttctccggtacrggttgaggctactaaggtacattt

SEQ ID NO: 74441 - DNA, 50 bp, homo sapien
gcacatctgccatctttggtcagcarccctccaggactgccttcttcaca

SEQ ID NO: 74442 - DNA, 50 bp, homo sapien
aatttaatagatacaaaatatgttascgatgaaagccacgtgactgtttc

SEQ ID NO: 74443 - DNA, 50 bp, homo sapien
ctctcatgttaatgagaaaggatcgyatcattgtagctattatttataat

SEQ ID NO: 74444 - DNA, 50 bp, homo sapien
tattaaagatattccagtggaaaaaytggcgaagctccaacctgtggtga

SEQ ID NO: 74445 - DNA, 50 bp, homo sapien
tattatatacatattagagctccaakacaaaatggtttattcctagtacc

SEQ ID NO: 74446 - DNA, 50 bp, homo sapien
ataaaagcaaaatcttcccgtattargaaccagtgatgcagggccagtgg

SEQ ID NO: 74447 - DNA, 50 bp, homo sapien
ggattaggacatagacatatgaagaraaagggcattattttgcttcccat

SEQ ID NO: 74448 - DNA, 50 bp, homo sapien
gggatttctagaggtgtcaaataaawgtgtgttctgagtggagaattttt

SEQ ID NO: 74449 - DNA, 50 bp, homo sapien
ttatttttaaacaaagtaaaaaagasctttggcatgttataatggccatg

SEQ ID NO: 74450 - DNA, 50 bp, homo sapien
atgctttataacttactctagttaasatgttctctacaaattgtcatgaa

SEQ ID NO: 74451 - DNA, 50 bp, homo sapien
gagagttattataaagatggagatawagggcctgcctcagtgcctggcat

SEQ ID NO: 74452 - DNA, 50 bp, homo sapien
acaggtaagaaatgcattgctgttgraaaaaagagctctcttcagccaat

SEQ ID NO: 74453 - DNA, 50 bp, homo sapien
ggggctttctttttactgctaggaawacttacaaagtccataatgcaagg

SEQ ID NO: 74454 - DNA, 50 bp, homo sapien
tcacactctctcacagagcacactcraattgtttcatcaaccagctaaaa

SEQ ID NO: 74455 - DNA, 50 bp, homo sapien
tttaatataaacaacctggttcaaartagaatgatattaaaatttactgg

SEQ ID NO: 74456 - DNA, 50 bp, homo sapien
aaaatgtgtaatagaagtaatatgcyaagtgtggaagactattctcggag

SEQ ID NO: 74457 - DNA, 50 bp, homo sapien
ttagtatcagtgactctctatggcasgatattttttatcagagcagggga

SEQ ID NO: 74458 - DNA, 50 bp, homo sapien
agcgtagtgcatgtgtatgctctgayaaactcctccgtggtttgcctctg

SEQ ID NO: 74459 - DNA, 50 bp, homo sapien
catcttctgtttctattggtctccarcttacatggattctcctttcagtg

SEQ ID NO: 74460 - DNA, 50 bp, homo sapien
tggaaaacaagaaaaattggagaacrataactgacatgtaaaaacattgt

SEQ ID NO: 74461 - DNA, 50 bp, homo sapien
aaacattgggatgtaaggaaggggcraatcatatagtgagtcacaagata

SEQ ID NO: 74462 - DNA, 50 bp, homo sapien
tgaaaaatttatagtcactgatattraagactgaacaaataaattcaatg

SEQ ID NO: 74463 - DNA, 50 bp, homo sapien
tacaaggattcacctctaacagtaasgactattgtcaccagatcatagag

SEQ ID NO: 74464 - DNA, 50 bp, homo sapien
gaaatacaacttgctgaaaatggacraatagcatcattttcctacaaaga

SEQ ID NO: 74465 - DNA, 50 bp, homo sapien
tcagttaatattgtaactatatatcraaattaattggcactgtgtagcag

SEQ ID NO: 74466 - DNA, 50 bp, homo sapien
aagttaaagaactaacttacagtcayactgctaaagagtggtaaagttgg

SEQ ID NO: 74467 - DNA, 50 bp, homo sapien
ctggactcagggaagagcacatatamccactcctgtgtgcacacacagca

SEQ ID NO: 74468 - DNA, 50 bp, homo sapien
actctggggagagtgtttatacatamaaatgaaggacagggcttcactgg

SEQ ID NO: 74469 - DNA, 50 bp, homo sapien
aaaaaaataggttaatgggactcagyaattagtgaaacatacagaataat

SEQ ID NO: 74470 - DNA, 50 bp, homo sapien
gtctagataacccatctctaagaatsatgcttattaaattgcgataaaga

SEQ ID NO: 74471 - DNA, 50 bp, homo sapien
ggaagaagatatggtaaggcattaartgacattaagaccacaaaatttgc

SEQ ID NO: 74472 - DNA, 50 bp, homo sapien
actagttttttatcctttctgttaamctctaatgtgccccaatattgata

SEQ ID NO: 74473 - DNA, 50 bp, homo sapien
accaagatattatacaaactgaaaaygcaaataagtttgaggaaggttta

SEQ ID NO: 74474 - DNA, 50 bp, homo sapien
ctgcagaaagctcaaggggcaaaccyaatgttagacagagaggggctcct

SEQ ID NO: 74475 - DNA, 50 bp, homo sapien
atattcacagagaattgtcttccaamagggactcttaggtgtgaagtgag

SEQ ID NO: 74476 - DNA, 50 bp, homo sapien
cttaggcggttagggtgtgatcttaygaaaagaattggcaggccttctga

SEQ ID NO: 74477 - DNA, 50 bp, homo sapien
aaattggattagggcccattctaackatttcattttaacttgatcatctc

SEQ ID NO: 74478 - DNA, 50 bp, homo sapien
ttgattactatgagcaacactgttaygtgtaataattgccattcttgcat

SEQ ID NO: 74479 - DNA, 50 bp, homo sapien
tccagcggtccctgtgctatatgcargaatggcaattattacacgtaaca

SEQ ID NO: 74480 - DNA, 50 bp, homo sapien
tcatctgtttgggaatccttattaakaattgttacttaggaatattgctt

SEQ ID NO: 74481 - DNA, 50 bp, homo sapien
gaggggactcaagagttcaagggagrctaaactggatgacctttcaggaa

SEQ ID NO: 74482 - DNA, 50 bp, homo sapien
ttctcctagctcacaattcaaaagcrcattgctgggattccttgggggct

SEQ ID NO: 74483 - DNA, 50 bp, homo sapien
caatgtgtttagggataaatcagttyagatctaatatttagaaaacttat

SEQ ID NO: 74484 - DNA, 50 bp, homo sapien
taagtggcatcgcctataatgagcascgtgttctcctaccaccttagctg

SEQ ID NO: 74485 - DNA, 50 bp, homo sapien
gcaacattatatttcataaagaccayggtgtagagtaaatcaagttttcc

SEQ ID NO: 74486 - DNA, 50 bp, homo sapien
gagctggttttcttctaaaccacatsacaaaagagcacgatgctgtgaac

SEQ ID NO: 74487 - DNA, 50 bp, homo sapien
ccactgtggaatactcctgagcatasagcagacatactgataggtaagga

SEQ ID NO: 74488 - DNA, 50 bp, homo sapien
ggtgaaactaaaagtgaaatgaagaytccatcaaccatcaaaagtcatcc

SEQ ID NO: 74489 - DNA, 50 bp, homo sapien
aaaatacaatctatagaacactatamtaaaagagatatgtaataactcac

SEQ ID NO: 74490 - DNA, 50 bp, homo sapien
ttttgctgccttattaaagttgtcargaccttcagtataatgttgaataa

SEQ ID NO: 74491 - DNA, 50 bp, homo sapien
tcaggttaagtaactaataagtaaargagcaagttatcctgcctgagtcc

SEQ ID NO: 74492 - DNA, 50 bp, homo sapien
ctggtatccagcaccctctttgactyattaatgctgcatctgctacagga

SEQ ID NO: 74493 - DNA, 50 bp, homo sapien
gtgatgaaagggaacgcttcttgacmgggtaaagagtcattcagtaggaa

SEQ ID NO: 74494 - DNA, 50 bp, homo sapien
tttcctgtttaggaaaaaaagcaackgtaatgagccaaaaaaaaaaaaag

SEQ ID NO: 74495 - DNA, 50 bp, homo sapien
attagtttcctaaggctgctgtaatrtcacacactgggtgacttaaaata

SEQ ID NO: 74496 - DNA, 50 bp, homo sapien
aggtcttaacactgtctacaagagartccttatgttttggaacatttgag

SEQ ID NO: 74497 - DNA, 50 bp, homo sapien
aacttttgtgtgtagggttgctttgmagtattcttttattgcctttcatt

SEQ ID NO: 74498 - DNA, 50 bp, homo sapien
aacctgcatcctcactctacatgtarctttgaaatgataagagcaagatc

SEQ ID NO: 74499 - DNA, 50 bp, homo sapien
agaagagtccagagaaagtaagctaygcccatggcaggatccccacctgt

SEQ ID NO: 74500 - DNA, 50 bp, homo sapien
tgaatgttattccaagtgatcatcamaatacaactaaaggatcaaattat

SEQ ID NO: 74501 - DNA, 50 bp, homo sapien
aagaggacagctccaaaaagactgaragcatctgaagagaacctgtgtct

SEQ ID NO: 74502 - DNA, 50 bp, homo sapien
gcaatcgtgtcatctgtgacaaagayggttttacttcttttgatatctag

SEQ ID NO: 74503 - DNA, 50 bp, homo sapien
ctgtggatagtactgaactctatagrcgctatgttttttccatacataca

SEQ ID NO: 74504 - DNA, 50 bp, homo sapien
cactaccccatcaaagcaacagtaayggagaatcagaaattttgccactg

SEQ ID NO: 74505 - DNA, 50 bp, homo sapien
gtcctgaatgaggaatctttggggcragaagggtcctgtcctatttatta

SEQ ID NO: 74506 - DNA, 50 bp, homo sapien
gggaggcacagtaggtagagcacagwtagaggagcctgaggacaccaaat

SEQ ID NO: 74507 - DNA, 50 bp, homo sapien
cattgtgattcacatggtggacctgrcaacagcaggcttcccgccctctg

SEQ ID NO: 74508 - DNA, 50 bp, homo sapien
gaggtgtgtgtatgtgtcatgctaaraagtccaaaacagaaatttcaaca

SEQ ID NO: 74509 - DNA, 50 bp, homo sapien
caatagagtggtttctatacactccrcaaataactgcttcttcatgaacc

SEQ ID NO: 74510 - DNA, 50 bp, homo sapien
tcacattatttccattcttacaccckacttcatgtttgtacactattttc

SEQ ID NO: 74511 - DNA, 50 bp, homo sapien
agtatctgtgtcaccccagagtctcsaaagtcttcatcaccgcactctgg

SEQ ID NO: 74512 - DNA, 50 bp, homo sapien
agagctacttaaactaaaagcaataygggtgcaggaagttggtgtaatat

SEQ ID NO: 74513 - DNA, 50 bp, homo sapien
ttttaagcatctacttgaaggaagartacttttacatcctaattatatat

SEQ ID NO: 74514 - DNA, 50 bp, homo sapien
ccactgacgtctgtctgtgattgacrcttccttacaactgacagcattta

SEQ ID NO: 74515 - DNA, 50 bp, homo sapien
cagtattccatgctgcagtaccacakggtgtgcacgtgtgcatgcaggac

SEQ ID NO: 74516 - DNA, 50 bp, homo sapien
tgtgactcccacaggttttgctctamacttgtcattctggcaaagaaatc

SEQ ID NO: 74517 - DNA, 50 bp, homo sapien
attgacgccattcttcaaattttaayggactctcaatatacaacacaaat

SEQ ID NO: 74518 - DNA, 50 bp, homo sapien
cgtgctgcagcagtgccagaataacwatctcattcaaggcatcacgacgt

SEQ ID NO: 74519 - DNA, 50 bp, homo sapien
tttccacctcttctcttcttcctgcyattcatccctaaatctaacacact

SEQ ID NO: 74520 - DNA, 50 bp, homo sapien
ctggactcaattctgattgacagaaygaaatggcaaaggtaagaggtaga

SEQ ID NO: 74521 - DNA, 50 bp, homo sapien
gcaataattaaagttaccatctgtcsagcacttatgcttcacaacaaccc

SEQ ID NO: 74522 - DNA, 50 bp, homo sapien
tactgcatgtgttgttaggtgctaawcccattacttaataaaagtacaag

SEQ ID NO: 74523 - DNA, 50 bp, homo sapien
tagaagaaaagatccaggaaactgaygttgaagtagcaaaatccttagac

SEQ ID NO: 74524 - DNA, 50 bp, homo sapien
tattattacatttcttaaggtgaaaktgacttgactttgcccacatatgc

SEQ ID NO: 74525 - DNA, 50 bp, homo sapien
cagccaacaagtacttactgactcckatgaaactatgtttgaaaagttat

SEQ ID NO: 74526 - DNA, 50 bp, homo sapien
ttgatagtggagaaaactattgctcmatccaaagagagctggtatttctg

SEQ ID NO: 74527 - DNA, 50 bp, homo sapien
cacacttgggcatggcattctgagcrggtatacaagaaaccactgggcag

SEQ ID NO: 74528 - DNA, 50 bp, homo sapien
cagccagatcatatttattctgcagyatagacaaaagtctaccttctgtc

SEQ ID NO: 74529 - DNA, 50 bp, homo sapien
agtctgtgcgccactgctgtcaaggkaaggatgaagcaacagtgctggct

SEQ ID NO: 74530 - DNA, 50 bp, homo sapien
tctctgacagatggaaattggttgasaacaggtaatggtacagagtcttc

SEQ ID NO: 74531 - DNA, 50 bp, homo sapien
gaactgccatcttccagtaatttgcraaaatgacgaagacaaagggaaag

SEQ ID NO: 74532 - DNA, 50 bp, homo sapien
actgcgtccagctgacaatatcatcyctcttacagatgcgcatatacatg

SEQ ID NO: 74533 - DNA, 50 bp, homo sapien
ccgagatagcttcctgaaacgtgtastaaaatgatcagaaaaagaaccca

SEQ ID NO: 74534 - DNA, 50 bp, homo sapien
gtagatttgacttgctcttgcctcaytcgacctccaaagtgggactgaag

SEQ ID NO: 74535 - DNA, 50 bp, homo sapien
catctcctggatgttactgtgaaaayattacaaaacaaactgaccacaaa

SEQ ID NO: 74536 - DNA, 50 bp, homo sapien
gattttttagcttttacttttagcaracaggattcccagtgtctcactgc

SEQ ID NO: 74537 - DNA, 50 bp, homo sapien
cccaccacacccagctacaaacttayagttgaatcatcatatctcagagt

SEQ ID NO: 74538 - DNA, 50 bp, homo sapien
cagtatctatcagctaaggttgtagycacaatggagatacaacctgccaa

SEQ ID NO: 74539 - DNA, 50 bp, homo sapien
tctattgtggaaaataataagagagwcataaattgcagtgaacttcccat

SEQ ID NO: 74540 - DNA, 50 bp, homo sapien
atcctggtaaaagtcacaaggtcagyctactaaagcagggaaactaaagg

SEQ ID NO: 74541 - DNA, 50 bp, homo sapien
tggtgactggtcacaccttgcctaawctggtagccaccatgcatcctctc

SEQ ID NO: 74542 - DNA, 50 bp, homo sapien
ctcttctttctttctcttgagtacayagatggtgactggtgcatggctca

SEQ ID NO: 74543 - DNA, 50 bp, homo sapien
catgtggaaatgtgttctaacagtargtcatcaaattttcttttttaaaa

SEQ ID NO: 74544 - DNA, 50 bp, homo sapien
tttcatgggaaaagacagaaactaawcaagcgcctgatcccacagagggt

SEQ ID NO: 74545 - DNA, 50 bp, homo sapien
ctatttttctgttcaccttactcacrctatgattttagagatctagccgg

SEQ ID NO: 74546 - DNA, 50 bp, homo sapien
gattgggtttgattgtattaatgtcycaaattcttcactctccccatctc

SEQ ID NO: 74547 - DNA, 50 bp, homo sapien
cttacagtccccatgcctcactttaytcctctgtaaagtggaaatggcaa

SEQ ID NO: 74548 - DNA, 50 bp, homo sapien
agactgaagtcacttggcagccacaygttttagactgaggtaactcccca

SEQ ID NO: 74549 - DNA, 50 bp, homo sapien
caaggtgtaaaaattacacaagacgrcagtagcctcactagcagctatct

SEQ ID NO: 74550 - DNA, 50 bp, homo sapien
taagacctaagacaaagtgtaaaaargaattcagtgatcaccctcatgct

SEQ ID NO: 74551 - DNA, 50 bp, homo sapien
ctatttataaaagttttacattagayattaacttgaaattgagtaaaaga

SEQ ID NO: 74552 - DNA, 50 bp, homo sapien
gtaggtacattctttaagaggatcayggaaagatggcaaggcagatttat

SEQ ID NO: 74553 - DNA, 50 bp, homo sapien
ttattatgaagtacatgaataaatcrccacccaaatacagtaaatgcatt

SEQ ID NO: 74554 - DNA, 50 bp, homo sapien
gacaagttgctatgagaaaagatacsaagaaggacttaatcgtgttagga

SEQ ID NO: 74555 - DNA, 50 bp, homo sapien
gccctatccagtaataccatacaggraacatacttctgcagtgttccttt

SEQ ID NO: 74556 - DNA, 50 bp, homo sapien
aaataaaaaggtctttatgggccagrcaggtttagaatacaggtatgatc

SEQ ID NO: 74557 - DNA, 50 bp, homo sapien
tgagagtagcatctgccttgaggacrccaggtattacaggctcagcatgt

SEQ ID NO: 74558 - DNA, 50 bp, homo sapien
cttttcaccaaatgtctgagtgagaragtgattatcttatagaacaaaca

SEQ ID NO: 74559 - DNA, 50 bp, homo sapien
ggcttcagtgatacattggcagaaasctgtttgaagagattcctcagaga

SEQ ID NO: 74560 - DNA, 50 bp, homo sapien
gggaatatctgctgaggttctaccaygggcaaagatgctgtatcaggtgt

SEQ ID NO: 74561 - DNA, 50 bp, homo sapien
ccgcctttccctgagctcagatccaygtaaacttgtatttctcttgaatt

SEQ ID NO: 74562 - DNA, 50 bp, homo sapien
cagaattcacatagcaatttctgccrctaaggacatgaatgaaaaaattt

SEQ ID NO: 74563 - DNA, 50 bp, homo sapien
caagaattgcactattacacttcctracaaacctttcatgtgacttatcc

SEQ ID NO: 74564 - DNA, 50 bp, homo sapien
agtgtttcattgaaggaagtaaatayactgttgttcgttaaccccaaagt

SEQ ID NO: 74565 - DNA, 50 bp, homo sapien
ttggtccaatacaaaaagccaataawtcaaagtcaggagcctagatccga

SEQ ID NO: 74566 - DNA, 50 bp, homo sapien
tagaataccataggatattacttcarctaggattatctaaaccaaagcca

SEQ ID NO: 74567 - DNA, 50 bp, homo sapien
agcatatggaagaaaagcaagagacraagttgttcattagatgtgagctc

SEQ ID NO: 74568 - DNA, 50 bp, homo sapien
tggaaggaagcatttgctgggacgcrgtatgaccaggacccagaagggaa

SEQ ID NO: 74569 - DNA, 50 bp, homo sapien
gacttcacacttctgttcctgtccaygttattctaattacttaaacaggc

SEQ ID NO: 74570 - DNA, 50 bp, homo sapien
agagacactggaagctgggtcttgargagcacataaaaatctgccagatg

SEQ ID NO: 74571 - DNA, 50 bp, homo sapien
aaacctattgaattctacataaccaygccccattcttatcacatttagca

SEQ ID NO: 74572 - DNA, 50 bp, homo sapien
tagaaagagagaagaatgctgtacgyagaggcagatgcagagagaggagc

SEQ ID NO: 74573 - DNA, 50 bp, homo sapien
ataaaccctagagattaggcaagtgraaagaattatgaaataaaacaaag

SEQ ID NO: 74574 - DNA, 50 bp, homo sapien
caagcagttctgatatctctgcagcragacagcatggggaggcccattca

SEQ ID NO: 74575 - DNA, 50 bp, homo sapien
atattttattgttgctctcgatcaasatgcgttcttaaaatattggacta

SEQ ID NO: 74576 - DNA, 50 bp, homo sapien
gctggaagcactccctacgatgggaytctctcaactgtccctatttgcat

SEQ ID NO: 74577 - DNA, 50 bp, homo sapien
aacttcctgtcaatcctaaaatttartaaggcaaatgtttggcttcgagc

SEQ ID NO: 74578 - DNA, 50 bp, homo sapien
gttaaagactggaaagtaacctcacmaaagaagagttttagggcctgagt

SEQ ID NO: 74579 - DNA, 50 bp, homo sapien
ccactctttctttggcatatggcttycaatttgagctccctgaggtgaag

SEQ ID NO: 74580 - DNA, 50 bp, homo sapien
agagtctcagttcatatacatccacmaactctggcaaatggcccatgaac

SEQ ID NO: 74581 - DNA, 50 bp, homo sapien
aaaggtatgtctaattttagctacaygtttctattggacatcccccactc

SEQ ID NO: 74582 - DNA, 50 bp, homo sapien
attgatgttctatttatttctatgcrctcactttgtttttgaccaagtta

SEQ ID NO: 74583 - DNA, 50 bp, homo sapien
ccaggagaatgtcaaaatagccataraagtgatagaaagaaggccggcat

SEQ ID NO: 74584 - DNA, 50 bp, homo sapien
gagaaacgtaacttagggccctttargtgcaaaacaactgtttaaatata

SEQ ID NO: 74585 - DNA, 50 bp, homo sapien
atattttaaaatcttaggaatttaargaagcttagagataattaatccaa

SEQ ID NO: 74586 - DNA, 50 bp, homo sapien
agggaatttccttgaggacaatctgmaaacattaaaaaatttgcaaatat

SEQ ID NO: 74587 - DNA, 50 bp, homo sapien
accacagaagtcccttacataaaagkctccaacaaattaatagagaagac

SEQ ID NO: 74588 - DNA, 50 bp, homo sapien
ttcttcctttttgaaaacaaaaacaytctcagatcactgcatttttttct

SEQ ID NO: 74589 - DNA, 50 bp, homo sapien
ctagaatatcatttttaatgcctaartagtgttctatcttattgatatat

SEQ ID NO: 74590 - DNA, 50 bp, homo sapien
cacttccagcaagctcagggatgaargaactttgcaggggtgaggttcca

SEQ ID NO: 74591 - DNA, 50 bp, homo sapien
tttttaccaaatacattaaacactayggcttaaaaagagaatattagtga

SEQ ID NO: 74592 - DNA, 50 bp, homo sapien
agtcacagagtccatagatgtgaacmaaaccaagagaaaggaagcaacca

SEQ ID NO: 74593 - DNA, 50 bp, homo sapien
aatctctgtcttatgttcactataartgttttaagtcaacataatgctag

SEQ ID NO: 74594 - DNA, 50 bp, homo sapien
ggtgaagaaaattgattccttaagaytaaaacacaccatattaaacttgg

SEQ ID NO: 74595 - DNA, 50 bp, homo sapien
tatgctgatatagatggccattttarcagtgtatacaaagcatttatatc

SEQ ID NO: 74596 - DNA, 50 bp, homo sapien
tttattcatgacttagtatattccawgtattatgctatgcatgatccagc

SEQ ID NO: 74597 - DNA, 50 bp, homo sapien
gaatgaatattcagattttgctattyagtatttataattctggttggtag

SEQ ID NO: 74598 - DNA, 50 bp, homo sapien
acagagcgagactccgtgtcaaaaawgaaagatttaatgttggtcaaatt

SEQ ID NO: 74599 - DNA, 50 bp, homo sapien
gttaagtgagaaaggtaaggtaaaartggtttatgacctataactgtgtg

SEQ ID NO: 74600 - DNA, 50 bp, homo sapien
tacaagtaaactatgactgtttttamacctatcacagatattccagatct

SEQ ID NO: 74601 - DNA, 50 bp, homo sapien
actctgaaatgtacatccctgattgwttataactctccaacttccttgct

SEQ ID NO: 74602 - DNA, 50 bp, homo sapien
acctctagttgctggcactagagtasagaattacatagagaaaaaaccca

SEQ ID NO: 74603 - DNA, 50 bp, homo sapien
atcccattgcattccagataaaagcrgaagtccttagagtactgcagttt

SEQ ID NO: 74604 - DNA, 50 bp, homo sapien
tgctgcaaagtccattagaaggcacragtagcttatagtaactggtgaat

SEQ ID NO: 74605 - DNA, 50 bp, homo sapien
ttgactgtttattagtgtcgacttakgagtgagatcaaactctttcactc

SEQ ID NO: 74606 - DNA, 50 bp, homo sapien
ttaatttaacagagtcggttcagcaytatttccctagtacttgcaggtaa

SEQ ID NO: 74607 - DNA, 50 bp, homo sapien
aggagatgggcgaagaggcaaattgyagaatctaatccttctacccacat

SEQ ID NO: 74608 - DNA, 50 bp, homo sapien
tcaatgttaaataacattttataatratcacatgctgagtcaaaggcaaa

SEQ ID NO: 74609 - DNA, 50 bp, homo sapien
aggtttgataaactctggccaagagraagttgtttttgttttatattttc

SEQ ID NO: 74610 - DNA, 50 bp, homo sapien
gaggagtcaagctggattttccactraagagccaggggacacttgaggaa

SEQ ID NO: 74611 - DNA, 50 bp, homo sapien
aaagaaagaaagaaatcactaataartatcaaaggaaggtctagaaaaca

SEQ ID NO: 74612 - DNA, 50 bp, homo sapien
ggggttcagtctgaggttaaactctkttaatatgtttacaaactgcaact

SEQ ID NO: 74613 - DNA, 50 bp, homo sapien
aagtcatatcacataagtaacgtgcrccaccttatacgggtcacaccagc

SEQ ID NO: 74614 - DNA, 50 bp, homo sapien
ctaccacagacaataattgagaaccrgaccttaaacataagtggaaaccc

SEQ ID NO: 74615 - DNA, 50 bp, homo sapien
atgggatagttctgcagttaagaacrcaggacttcagagtgtctcaggct

SEQ ID NO: 74616 - DNA, 50 bp, homo sapien
tgggtgatgcttacatcaacaccacrctataaactttttgagcctttgtt

SEQ ID NO: 74617 - DNA, 50 bp, homo sapien
agttatctatttctgtataacaaacycacaaactataattgcttacaact

SEQ ID NO: 74618 - DNA, 50 bp, homo sapien
ggtccaacaatctgttgcatggtaargcttgagaaccatgagtataatga

SEQ ID NO: 74619 - DNA, 50 bp, homo sapien
aattgttgagcacaatgtgaagtaayaaaaaacaccctgcattctgttca

SEQ ID NO: 74620 - DNA, 50 bp, homo sapien
catatttcttattcttgttacatacraatagagctgtagtatcaaataat

SEQ ID NO: 74621 - DNA, 50 bp, homo sapien
ccagctttgggacaaccctcaggacrgcattttcacgaccacgcacccat

SEQ ID NO: 74622 - DNA, 50 bp, homo sapien
atttgataaaagaaacgagtcctgckgctgattgcttagacacttgttag

SEQ ID NO: 74623 - DNA, 50 bp, homo sapien
tttatggatgtcaactttttaaccayacgctgtgagcagcaatttttctt

SEQ ID NO: 74624 - DNA, 50 bp, homo sapien
caatgctagaggcaaggtcacttgcmaacaggaagcagaatccgtctcag

SEQ ID NO: 74625 - DNA, 50 bp, homo sapien
agcttcttttcaggtccatttcataygtagaggtatttgcctggatttat

SEQ ID NO: 74626 - DNA, 50 bp, homo sapien
atcagcacctggcatgcaaccttcamgtgattcctaccctgagaacttca

SEQ ID NO: 74627 - DNA, 50 bp, homo sapien
aataaattgtaacagttataaaacayccatggcagaatctgcaggcagcc

SEQ ID NO: 74628 - DNA, 50 bp, homo sapien
tggagaaaaatactactaatcaacartatctccttgatcacaaatacatt

SEQ ID NO: 74629 - DNA, 50 bp, homo sapien
cttctttcaggtcatggcctcacaarctcttactgtcttggttgcttttc

SEQ ID NO: 74630 - DNA, 50 bp, homo sapien
gcataggagaaagcagtgtgaaagawaataaatgttctaaccttccaacc

SEQ ID NO: 74631 - DNA, 50 bp, homo sapien
ctatgctcatcaaaagcatctgacarttggcctaacaggaagacaggtgc

SEQ ID NO: 74632 - DNA, 50 bp, homo sapien
tactaccatcaaataaagtaccaaayagtaaagttgtatagataacttca

SEQ ID NO: 74633 - DNA, 50 bp, homo sapien
tctcagggaccggtgtccagtgtctraaaactgttgtgtcatgtattctg

SEQ ID NO: 74634 - DNA, 50 bp, homo sapien
gaattcctcttgttccttaaacacartatgaactttgaagccccgtgcct

SEQ ID NO: 74635 - DNA, 50 bp, homo sapien
gcaacaggacatggaagaataataartgctttgctggatagtcctaagtt

SEQ ID NO: 74636 - DNA, 50 bp, homo sapien
tgggccagagttgctgagaagctaaraaaactcaagctgcagggacctgc

SEQ ID NO: 74637 - DNA, 50 bp, homo sapien
cttgtcttcctcctccctaaaagaawttaagtttggctgtcctgaacatg

SEQ ID NO: 74638 - DNA, 50 bp, homo sapien
tcatccagattcacatttccatcaaygtcccagagtcactggagctggca

SEQ ID NO: 74639 - DNA, 50 bp, homo sapien
ctgatcactcatgcctcaagccaatraaagcccgaaaggtatgagttctc

SEQ ID NO: 74640 - DNA, 50 bp, homo sapien
tacatttatatgtcttcttgacctargttgcaaaagcaatatcttggttt

SEQ ID NO: 74641 - DNA, 50 bp, homo sapien
acaagtaattttattgcaaaatatcragaatgttctgacctctatgtgaa

SEQ ID NO: 74642 - DNA, 50 bp, homo sapien
gccgatgctcagctctctaatggtawctctcaagactcagactgacagag

SEQ ID NO: 74643 - DNA, 50 bp, homo sapien
tgaagaagcatacaaggggatatgayagcaagtaatagagttagggaggc

SEQ ID NO: 74644 - DNA, 50 bp, homo sapien
aattttcctctcggttacatccaaasattcatatttttaacctgtctgaa

SEQ ID NO: 74645 - DNA, 50 bp, homo sapien
tgtgttaagtataaaattaacgattwaagcatcatgaatcaaatagataa

SEQ ID NO: 74646 - DNA, 50 bp, homo sapien
tctcccatatgcctaggagccataamcgtaggcccagggaagcacaggag

SEQ ID NO: 74647 - DNA, 50 bp, homo sapien
taactaccacctaaaatcaaatggawatgccagtaatttattggtttgga

SEQ ID NO: 74648 - DNA, 50 bp, homo sapien
tatagattcattaaagggtcttaaamtaggagctaggctgtgctgcaggc

SEQ ID NO: 74649 - DNA, 50 bp, homo sapien
atgaaccagcaaaagagactgtgaargaacagctagagaaataggaagaa

SEQ ID NO: 74650 - DNA, 50 bp, homo sapien
aattgaagtcttgtagccaaaagtcmaaatcatattcttctaaaattcac

SEQ ID NO: 74651 - DNA, 50 bp, homo sapien
agtgttctaagccaactgctggaaaraattatcagggaaactctatccta

SEQ ID NO: 74652 - DNA, 50 bp, homo sapien
cttatccacctgaaaatcttgacagraaaacctcacagtggtaatctaaa

SEQ ID NO: 74653 - DNA, 50 bp, homo sapien
actctcaagtgattatgagtaaaaamgaaagagaatattctgaatattga

SEQ ID NO: 74654 - DNA, 50 bp, homo sapien
tggccaagattcagtaatggttaccraagctaatctcccactgtgaactg

SEQ ID NO: 74655 - DNA, 50 bp, homo sapien
tagctgatacaagtcagtgaagctcyagtacatgagagaggcagagagcc

SEQ ID NO: 74656 - DNA, 50 bp, homo sapien
ttaggaggagaaacattcaaggcacraaaggaatagagaaaaagcattgt

SEQ ID NO: 74657 - DNA, 50 bp, homo sapien
ttttcaggatgtaactgcaatgtgcygattgagaatagaatctaatatgc

SEQ ID NO: 74658 - DNA, 50 bp, homo sapien
tcaatgaactcttcagaacatttaayaaaaggagctctataagcaatggg

SEQ ID NO: 74659 - DNA, 50 bp, homo sapien
gtaccgactactcatgagagactaaraactgatcatctggctgctggcaa

SEQ ID NO: 74660 - DNA, 50 bp, homo sapien
aaaaatgcttttaaaaagagctaaartagaattgcattgtgagtaataca

SEQ ID NO: 74661 - DNA, 50 bp, homo sapien
aatattaattaatattgcaaatacawcaaatttacacgttgatgaaaaca

SEQ ID NO: 74662 - DNA, 50 bp, homo sapien
acttaatactctctctgaagcttaayagaactgcagacctattgccacag

SEQ ID NO: 74663 - DNA, 50 bp, homo sapien
attttaaaataattcactcagggtargtttattgagaaactatgttgtgc

SEQ ID NO: 74664 - DNA, 50 bp, homo sapien
ctgttaagcttcagagagagtattawgtttcctgtccctttgaacaaaat

SEQ ID NO: 74665 - DNA, 50 bp, homo sapien
tatttttattctgtttattcttttcrctggacattcctgtaatgcttttc

SEQ ID NO: 74666 - DNA, 50 bp, homo sapien
ggccattttcagacagaatttggtayggctagttcagaaaaagtcactga

SEQ ID NO: 74667 - DNA, 50 bp, homo sapien
gtccttgccctttcctttgctatacrgcttgggttgcctgttcctcctct

SEQ ID NO: 74668 - DNA, 50 bp, homo sapien
ttgttctgaattgttctgcagcctaratacttgaaagcaattttttccct

SEQ ID NO: 74669 - DNA, 50 bp, homo sapien
caaagtcacctgaatagtttaccgarcaagtctgccttgatggagtcagt

SEQ ID NO: 74670 - DNA, 50 bp, homo sapien
tcagaataaagcctccaaaaggacarggacttatttcctaccaaacccca

SEQ ID NO: 74671 - DNA, 50 bp, homo sapien
aaggaaatcttataacttatgcttgsaatgactctacgagataagcatta

SEQ ID NO: 74672 - DNA, 50 bp, homo sapien
atcatgctgagtcctacttcacaaarttattattgctacgttgtttacta

SEQ ID NO: 74673 - DNA, 50 bp, homo sapien
tagccaagttgatacataaaatgaamcaacataaaaatctagaagtcatc

SEQ ID NO: 74674 - DNA, 50 bp, homo sapien
taactatacaaaaaggctagttgcaraaatgtaactatagtataatgcca

SEQ ID NO: 74675 - DNA, 50 bp, homo sapien
atttggctatgttgtataagaaagamattcaagcctcaggaggacaagtc

SEQ ID NO: 74676 - DNA, 50 bp, homo sapien
gtgcttcaaggactggctagtgacaygttgttccgaggagaagaagtcca

SEQ ID NO: 74677 - DNA, 50 bp, homo sapien
taactacaaggtgttgttaagttaayggtgcattctatctaaactcaaat

SEQ ID NO: 74678 - DNA, 50 bp, homo sapien
aatatattgatttgaaaacctttaarcctggtagatccatgatcaaaagt

SEQ ID NO: 74679 - DNA, 50 bp, homo sapien
tctccaagcatggtttatcaatcaaraaaaatagaaatgaagtgatcttg

SEQ ID NO: 74680 - DNA, 50 bp, homo sapien
aaatgaactaaacagtaacataacaraataaagatgtagaagcagaatga

SEQ ID NO: 74681 - DNA, 50 bp, homo sapien
acttttcactaagaaggcatatgtaycagatttgtaaaatgcatctgtaa

SEQ ID NO: 74682 - DNA, 50 bp, homo sapien
gatgccagttgtgactggtgacttasagccgtggtagctttgacttgcat

SEQ ID NO: 74683 - DNA, 50 bp, homo sapien
gatgctgttcttgtatgattccaggytaagattggacaaaagagaaactt

SEQ ID NO: 74684 - DNA, 50 bp, homo sapien
ttccctcaataagtcttctaacttaytattcacacatgctacaatctcat

SEQ ID NO: 74685 - DNA, 50 bp, homo sapien
aagccctgcaggattggggatctgayctaagaaaggatatgagctgaatc

SEQ ID NO: 74686 - DNA, 50 bp, homo sapien
tttcatttcccctctccttgtaagcrcacttgaaaggaaggaaggtgcat

SEQ ID NO: 74687 - DNA, 50 bp, homo sapien
tggagcatttttgtactgttttcaawccttaaagcctctgttttaaatgc

SEQ ID NO: 74688 - DNA, 50 bp, homo sapien
tgctgggagacaaagctgtcaattayaaagcaatctggctttctgttcca

SEQ ID NO: 74689 - DNA, 50 bp, homo sapien
tttctgtgatagaacagctaattcargtaattcactagcaaaactaattt

SEQ ID NO: 74690 - DNA, 50 bp, homo sapien
tcagagctgcagcatccaaattcaartggtggtgtaatcaactctagatt

SEQ ID NO: 74691 - DNA, 50 bp, homo sapien
tcctctatatcgctctccttttactyggtgactcttcctctggtctctag

SEQ ID NO: 74692 - DNA, 50 bp, homo sapien
tctcaatgtgttcctactaacaaaasaataactgttgtctaccgtatttt

SEQ ID NO: 74693 - DNA, 50 bp, homo sapien
gtaataattttcatagcataatagasgactaaaatgcaaagctatttaac

SEQ ID NO: 74694 - DNA, 50 bp, homo sapien
tacccagcagctcattagatgtttaragtgtaaccatctgatttatggta

SEQ ID NO: 74695 - DNA, 50 bp, homo sapien
gctaccatgtgaacatttctctttcrctattttgtttgtatatctgttca

SEQ ID NO: 74696 - DNA, 50 bp, homo sapien
acctgtctagactttagagaaactayatgcattttgttaacaatctttct

SEQ ID NO: 74697 - DNA, 50 bp, homo sapien
gtgaaagacgaacagaacaatttgcygaagatgatgaggatgttgaggat

SEQ ID NO: 74698 - DNA, 50 bp, homo sapien
tgcttttctggactcctgaaaatacygcaaaagaaacatgcattgtctgc

SEQ ID NO: 74699 - DNA, 50 bp, homo sapien
aaacaaactgagactgcaagactgcragaaatacctaagtcttcaatacc

SEQ ID NO: 74700 - DNA, 50 bp, homo sapien
cttagtgggcatggagttgtcaacaycagcttaagacagagagatccagc

SEQ ID NO: 74701 - DNA, 50 bp, homo sapien
aggattgcattagaaacattagttamagtaaaccgcaaggacagttttgt

SEQ ID NO: 74702 - DNA, 50 bp, homo sapien
ttgatgatatatattttacaacggayctatatagtgctatggttattttt

SEQ ID NO: 74703 - DNA, 50 bp, homo sapien
gtaaaaaactacattaacacaaagcygaaacgggtaaccaaactttaagg

SEQ ID NO: 74704 - DNA, 50 bp, homo sapien
taactgtggtctatgatgtgtgaccraatctgttggtaaagttatctatt

SEQ ID NO: 74705 - DNA, 50 bp, homo sapien
cctcactgcccttgtaatgcaaaaamtaagaataaaaatggtctgtttgg

SEQ ID NO: 74706 - DNA, 50 bp, homo sapien
tgatgttggcaatgggggcatagaarctacagtacactttttaggagttg

SEQ ID NO: 74707 - DNA, 50 bp, homo sapien
caaaataagaaaaccactacaaaaaytattgtgataagtgaatctgccaa

SEQ ID NO: 74708 - DNA, 50 bp, homo sapien
taatatatgaaacctatgcatttggratctttgaatgcatccattcatgc

SEQ ID NO: 74709 - DNA, 50 bp, homo sapien
aaaatgcacacagaaatagataactrgataaacaaagtctcatttttaaa

SEQ ID NO: 74710 - DNA, 50 bp, homo sapien
tgaagatatccccattgttggaaaaygtacatagcttaatactaacatag

SEQ ID NO: 74711 - DNA, 32 bp, homo sapien
ttctcttggctatgacygctcactgcagaatg

SEQ ID NO: 74712 - DNA, 50 bp, homo sapien
actccgagaaattcatgctgttaaartggctgagtatatacccaaactgc

SEQ ID NO: 74713 - DNA, 50 bp, homo sapien
atattttatttcagtatagtaatctkttacgctctgtatgtatcccataa

SEQ ID NO: 74714 - DNA, 50 bp, homo sapien
attaaaaacaaaggtaaaaaggaacraagtcacaggatgctctcttcaca

SEQ ID NO: 74715 - DNA, 50 bp, homo sapien
ttttcagctgctgatttcaaattcaygtaataacacgagttacaggtaaa

SEQ ID NO: 74716 - DNA, 50 bp, homo sapien
ttcagctgcaaatgcaattttaaacrgaactccgatgagattacttgctg

SEQ ID NO: 74717 - DNA, 50 bp, homo sapien
acctgaatatgtgtgctgtttcctarcatagaatcccatgaaaatgtgtg

SEQ ID NO: 74718 - DNA, 50 bp, homo sapien
tcatgataattgaacagctttaccaraactcacataggttgaggctataa

SEQ ID NO: 74719 - DNA, 50 bp, homo sapien
agtaaatttctaggaaagtcactagsagatatatgcaagggagggggctg

SEQ ID NO: 74720 - DNA, 50 bp, homo sapien
tttaccaaatagagtacagtgcttayaggcagtttcttttgcccttactc

SEQ ID NO: 74721 - DNA, 50 bp, homo sapien
acatgaattaagctgagttactaatkaaatgccataaggctaactgatgg

SEQ ID NO: 74722 - DNA, 50 bp, homo sapien
ttgtcccataacagcttgctgtgggwtgtcactttttaatatcaggcctt

SEQ ID NO: 74723 - DNA, 50 bp, homo sapien
gtaaagattgctatcctcgtaaagastcaagttaaaggacctcaccaagt

SEQ ID NO: 74724 - DNA, 50 bp, homo sapien
gtggttgatcagaatttgatgggtakagagcaaaaaatgactgagctatg

SEQ ID NO: 74725 - DNA, 50 bp, homo sapien
ctgtacttctatctgggtcagctttstctcccattctggcattgttcccc

SEQ ID NO: 74726 - DNA, 50 bp, homo sapien
cttaaccactatgtcatatgcaccayaagatataccagctccatctgcct

SEQ ID NO: 74727 - DNA, 50 bp, homo sapien
tctacacctacattgtacaatctaaragaaaatccttaagctcactctcc

SEQ ID NO: 74728 - DNA, 50 bp, homo sapien
attttagagcagtatcatgttctcastaggggatatgcacaactgaagaa

SEQ ID NO: 74729 - DNA, 50 bp, homo sapien
tattttactcccctggtagtatttgyttttgtaataaaggctcttacgaa

SEQ ID NO: 74730 - DNA, 50 bp, homo sapien
ctggggaacaggaagagggtataacrgaaagtctatagcttggcacctat

SEQ ID NO: 74731 - DNA, 50 bp, homo sapien
atttctgagtaagtctactccttaayggcacagaattcctcaaactcaca

SEQ ID NO: 74732 - DNA, 50 bp, homo sapien
atctattaattatttgggtctgacayggtattggatgcaaagaataagac

SEQ ID NO: 74733 - DNA, 50 bp, homo sapien
gttggtcttgatttcaggaaaataasctatgaataaatatatcctttcac

SEQ ID NO: 74734 - DNA, 50 bp, homo sapien
tagaaaagaagtacttactgtgcacrctctcttgagcaacatctaggact

SEQ ID NO: 74735 - DNA, 50 bp, homo sapien
tcctcaggggtatattgaagggttcyctattagtcagcctgcttttttaa

SEQ ID NO: 74736 - DNA, 50 bp, homo sapien
gaagcatgttcttgggcactgattaygtgagtaggtagcttttcctgatt

SEQ ID NO: 74737 - DNA, 50 bp, homo sapien
ttcctgatccaatagagcagtagtayaatctctcataaatttttcccctc

SEQ ID NO: 74738 - DNA, 50 bp, homo sapien
agagcagcagtagagtgggatgtcamagtacatatgactgacaaaaaatt

SEQ ID NO: 74739 - DNA, 50 bp, homo sapien
taatagccctaggctttttgaaatgstaaataaacactgaattcagctta

SEQ ID NO: 74740 - DNA, 50 bp, homo sapien
ttccaccaaagtgcctgacccaggaragctattcagcaaatactacgtaa

SEQ ID NO: 74741 - DNA, 50 bp, homo sapien
attactggaactatgaatatccacarattagggatgctgatttccaatgc

SEQ ID NO: 74742 - DNA, 50 bp, homo sapien
gctgttaacttttattttcaacttaygtgttttctcctaaaccctcggta

SEQ ID NO: 74743 - DNA, 50 bp, homo sapien
tctgccatagccataaagcaataaayggctcgctttatgctttgttttct

SEQ ID NO: 74744 - DNA, 50 bp, homo sapien
actaagggcaagatcaagtggtagargcaatagtgaaattcagaaatctt

SEQ ID NO: 74745 - DNA, 50 bp, homo sapien
gcttttatgatgtagcgtaggttacracatgatcagaatgaggtcagagg

SEQ ID NO: 74746 - DNA, 50 bp, homo sapien
cacatcatatatttagagattcatayagttgattttgatttttaaaatat

SEQ ID NO: 74747 - DNA, 50 bp, homo sapien
ctgtcagatgatcagttgctacaacmaaaggcaagagcaaagtaagataa

SEQ ID NO: 74748 - DNA, 50 bp, homo sapien
cagtgctctgaaaaaaacatcacaasgcctaggtcagaaaaagctgggca

SEQ ID NO: 74749 - DNA, 50 bp, homo sapien
agagtaccttgtcaacttgcaaaaaycagaattcaattatttaaaaatat

SEQ ID NO: 74750 - DNA, 50 bp, homo sapien
tgggggatcattttctgcttcttctkaagttgtataagaatattgtctgt

SEQ ID NO: 74751 - DNA, 50 bp, homo sapien
atccagaattggctgaaaaacataaygatggattgtctgttaaagacttg

SEQ ID NO: 74752 - DNA, 50 bp, homo sapien
gatggcaaagaagaaggatatactarctattgtgtatggcattatccaga

SEQ ID NO: 74753 - DNA, 50 bp, homo sapien
acagtgttccctacacaaagtctacygattagaagttttaattatatctg

SEQ ID NO: 74754 - DNA, 50 bp, homo sapien
atgttcttgtgtccccagtcactgamgaataaaagccattgtctttgaag

SEQ ID NO: 74755 - DNA, 50 bp, homo sapien
actgtagatgagaaagatgctaaaawtaactaacttaattacaggcacac

SEQ ID NO: 74756 - DNA, 50 bp, homo sapien
ctaaaagaacaccagaaatatttctyactacgattgtctcatatatctga

SEQ ID NO: 74757 - DNA, 50 bp, homo sapien
atactctacttttcgatagcctctayatgtttccggttagtattaaccct

SEQ ID NO: 74758 - DNA, 50 bp, homo sapien
acatgagaaaccgctgccaggatccrgtaacctcccaccaggccccacct

SEQ ID NO: 74759 - DNA, 50 bp, homo sapien
gttatactaacatagccaactgataygtagttccctggacatggtcccct

SEQ ID NO: 74760 - DNA, 50 bp, homo sapien
attatttctatttttcctattcaatragaaggcaaattgttacctggaac

SEQ ID NO: 74761 - DNA, 50 bp, homo sapien
agactgcaagtttatgacatgacatsaaatttttggtgaaatcacccaac

SEQ ID NO: 74762 - DNA, 50 bp, homo sapien
cttaagtttactgtaactactgtaawtagtcctctctgatgcatctctgt

SEQ ID NO: 74763 - DNA, 50 bp, homo sapien
ttgctctctctctattccacaagaawcatctgtctatcacataagtgaag

SEQ ID NO: 74764 - DNA, 50 bp, homo sapien
tttttagctgtacattgataaggtcraggtagaatatatcttctgcttga

SEQ ID NO: 74765 - DNA, 50 bp, homo sapien
actgctgagccaagatggacttgaartgtgatggggaataaaccttggct

SEQ ID NO: 74766 - DNA, 50 bp, homo sapien
tgagtgtaagcatttaatgaagtcasagtcatgagctcagtatgggccag

SEQ ID NO: 74767 - DNA, 50 bp, homo sapien
taatacaatgtattgctgtttctcawtgattctcacaacacatggaagat

SEQ ID NO: 74768 - DNA, 50 bp, homo sapien
ttgcttaaacatttacaacttaaacrggcttctattaacactgtgttagt

SEQ ID NO: 74769 - DNA, 50 bp, homo sapien
gaagggaacctcagataactatgcaragaaagcctgactttggccattaa

SEQ ID NO: 74770 - DNA, 50 bp, homo sapien
tgctgggacatgaggcagacagtagkaatttacagtgtcatttatcggtt

SEQ ID NO: 74771 - DNA, 50 bp, homo sapien
ctagaatctgttgatgttaattctckagtgctttcagatactttactgtg

SEQ ID NO: 74772 - DNA, 50 bp, homo sapien
aaacttgtgctgtccaaattcaggargtaggtagttgtgggtagcaagga

SEQ ID NO: 74773 - DNA, 50 bp, homo sapien
gattttcattgaaatgaacactatawgattgcatgtaataatttaggatt

SEQ ID NO: 74774 - DNA, 50 bp, homo sapien
aattcaattaaatctgccacatggartagaagttataaactggtggtctt

SEQ ID NO: 74775 - DNA, 50 bp, homo sapien
cttaatatctttctaaaagcaataarctcatttgcaacagaacttggaga

SEQ ID NO: 74776 - DNA, 50 bp, homo sapien
ctttgctgagtactattccattttaygaccacatgtgactatactacaat

SEQ ID NO: 74777 - DNA, 50 bp, homo sapien
tcgcataacaagagttatcttcttawacccaccaacattatcaagaaggt

SEQ ID NO: 74778 - DNA, 50 bp, homo sapien
gacacggaagcccttggaaagagacraccatggaattaccggattttcaa

SEQ ID NO: 74779 - DNA, 50 bp, homo sapien
cctctgggattttgccactctaaacmagcctacaagaatacagaagggta

SEQ ID NO: 74780 - DNA, 50 bp, homo sapien
gtaaaattaacctccaacttatgtamagagcattggttaacttattctta

SEQ ID NO: 74781 - DNA, 50 bp, homo sapien
taactcaccattaatgtgtcacttaygaatttaactcttcttataagact

SEQ ID NO: 74782 - DNA, 50 bp, homo sapien
gacagaactgagttgcaaggagttayaatatttaggaatcttatgataga

SEQ ID NO: 74783 - DNA, 50 bp, homo sapien
tatttttgactcacctactaatttayatgcccataagtctacaatataat

SEQ ID NO: 74784 - DNA, 50 bp, homo sapien
aattgtgtattaaaatgttagttagsaaaaggatgttcatctccttagct

SEQ ID NO: 74785 - DNA, 50 bp, homo sapien
aaaattttagactttaaggtactggraaaggtaatcattttgaaatcacc

SEQ ID NO: 74786 - DNA, 50 bp, homo sapien
agtaataatgaaaataatttaaatcrtatagcatgccatattttacagta

SEQ ID NO: 74787 - DNA, 50 bp, homo sapien
tatagaaagtcacaaattgccatctkaaaaactaaaacacttagagttac

SEQ ID NO: 74788 - DNA, 50 bp, homo sapien
atacaaagtgttagaaagacagctaygattaatatattggactggcccat

SEQ ID NO: 74789 - DNA, 50 bp, homo sapien
gggtttacaaattcaagatttctcarcacgattagccctaatagtatgct

SEQ ID NO: 74790 - DNA, 50 bp, homo sapien
aaaggtgcaaaccctgagttcttaaytgctacacttcggtgtaagacaac

SEQ ID NO: 74791 - DNA, 50 bp, homo sapien
tgtcactacattagaaatgaaagatsaaagtaaataaataagtcatagtc

SEQ ID NO: 74792 - DNA, 50 bp, homo sapien
aaagaaaatcaatgctgagtacatamctgaaatatgcaaaggtcagtcct

SEQ ID NO: 74793 - DNA, 50 bp, homo sapien
tatgaatatgccctactatttccaaraagaaaagtgatacatgagcttaa

SEQ ID NO: 74794 - DNA, 50 bp, homo sapien
taatacagaaagagattcatggtcaytgagttccttggagccaccatctt

SEQ ID NO: 74795 - DNA, 50 bp, homo sapien
acgggatagtggaaatatttagtagmaagtgcttttggcataaagacttg

SEQ ID NO: 74796 - DNA, 50 bp, homo sapien
aaatgaaacctgaaaaaaattgataytaatgcaatggagaaaattgcttg

SEQ ID NO: 74797 - DNA, 50 bp, homo sapien
cactgagaggcactggcattagtgamattgcttcctgatttttgagcatt

SEQ ID NO: 74798 - DNA, 50 bp, homo sapien
gattatttatgcctcccttttttagrccacctagtgtagcttcctgacat

SEQ ID NO: 74799 - DNA, 50 bp, homo sapien
taacaaaaacatgaacaaagcataargagtctttcaactagttgacattg

SEQ ID NO: 74800 - DNA, 50 bp, homo sapien
gaaaaatacaacaaatttggccaaarcaccctgatcactgtggaggaaac

SEQ ID NO: 74801 - DNA, 50 bp, homo sapien
tttcccttggaagaaaggcacgttayggttctaaggtggcaaacattaaa

SEQ ID NO: 74802 - DNA, 50 bp, homo sapien
caaaagttgaccttcggaacaataarcatcatcctcatcatcacagtagc

SEQ ID NO: 74803 - DNA, 50 bp, homo sapien
aattttgtgaattgttatcataaaakttgttcaagtgcaaggcatttgtt

SEQ ID NO: 74804 - DNA, 50 bp, homo sapien
taccatagtctacagagaagaaatamagatataacgagaaagaaagaagg

SEQ ID NO: 74805 - DNA, 50 bp, homo sapien
atgattttacctttctgaacgcttgyatgattgcttctttgcctgtttgc

SEQ ID NO: 74806 - DNA, 50 bp, homo sapien
cccaggaaaggtgtcctactgttacygcactatctactataggtccttca

SEQ ID NO: 74807 - DNA, 50 bp, homo sapien
tctgactttttaagccaaagctatayctttttattggaagaccaatcctt

SEQ ID NO: 74808 - DNA, 50 bp, homo sapien
tgtatccttatcatttgtggctaaaytgatcttaccattatttgtcataa

SEQ ID NO: 74809 - DNA, 50 bp, homo sapien
tggtaacatctacagaaaggttgaayaagatttatgcatctcttgcataa

SEQ ID NO: 74810 - DNA, 50 bp, homo sapien
gttgataatggtattctggtaaataygaattttttagtattggattacat

SEQ ID NO: 74811 - DNA, 50 bp, homo sapien
agagtgaacagatttataagaactasggtttatgcaggtcatcaagggat

SEQ ID NO: 74812 - DNA, 50 bp, homo sapien
ggcatgctggggagatccctagatartatcacagcaactgccataggtac

SEQ ID NO: 74813 - DNA, 50 bp, homo sapien
ggtgaagggtggcactgtattttaaygtaaaacatgcaggactagataca

SEQ ID NO: 74814 - DNA, 50 bp, homo sapien
ttttgctctgttcatccttaatacayaaacacaagtgcagctccaccttg

SEQ ID NO: 74815 - DNA, 50 bp, homo sapien
aggcatgtaaacacattaatatcctwgtacctctccatcagagctcttgg

SEQ ID NO: 74816 - DNA, 50 bp, homo sapien
ggttgctaaaactattgttgtgttakaaaggcatgtaaacacattaatat

SEQ ID NO: 74817 - DNA, 50 bp, homo sapien
ccaatctcttctggcttataaagtawctgatgagaaatctgttgttagcc

SEQ ID NO: 74818 - DNA, 50 bp, homo sapien
tttctttaaaactaacttaggattaygagtgtttaccagggatagtgata

SEQ ID NO: 74819 - DNA, 50 bp, homo sapien
agcatgctctgactggttgcctcaaytaataaaacagtcaggaaatctcg

SEQ ID NO: 74820 - DNA, 50 bp, homo sapien
tctggcaatccacacacagacagtaygtacccatgtatttatatctggta

SEQ ID NO: 74821 - DNA, 50 bp, homo sapien
cgcccgcccaatagtagatttataawggtgaaaataaatgaggaagaaca

SEQ ID NO: 74822 - DNA, 50 bp, homo sapien
aatgatctttagtggtgattgtaaawtatggcatgctcactagagcttat

SEQ ID NO: 74823 - DNA, 50 bp, homo sapien
taagtgatatttggtgaaagaaagartcagataatctggatcatcttcaa

SEQ ID NO: 74824 - DNA, 50 bp, homo sapien
gtattactaacctacactttactaaygaatattgcatgtctataactagg

SEQ ID NO: 74825 - DNA, 50 bp, homo sapien
ctccaggcttttgctagtacttttakagttttgagtcttatgtttaagtc

SEQ ID NO: 74826 - DNA, 50 bp, homo sapien
tacttgacccaccatttttagtatgscacttaaggctttccatagtctag

SEQ ID NO: 74827 - DNA, 50 bp, homo sapien
ttaaaaattcataatcataacaacartgtaaataccagctgccttttatt

SEQ ID NO: 74828 - DNA, 50 bp, homo sapien
atgaacatgttttataaggtgactaytacaattcattgcaagcttgaact

SEQ ID NO: 74829 - DNA, 50 bp, homo sapien
agagataagacacaggattcatccartattcaatccttcagtggagagag

SEQ ID NO: 74830 - DNA, 50 bp, homo sapien
atatcatatattaggcactatgctakgtttttacacattatctcattttt

SEQ ID NO: 74831 - DNA, 50 bp, homo sapien
aaatataaaacatttaaaagaagaaytgaacataattgttactcagagag

SEQ ID NO: 74832 - DNA, 50 bp, homo sapien
agtaaattgaattgaatacttgttaycaagattaagtagtatgatgatgt

SEQ ID NO: 74833 - DNA, 50 bp, homo sapien
cgtggaactcaaccttcctacaaaayaaagcagagtaggaggaggaagag

SEQ ID NO: 74834 - DNA, 50 bp, homo sapien
atattatatatggaaaaaaatgaccragaatagccaacacaatattaagg

SEQ ID NO: 74835 - DNA, 50 bp, homo sapien
ttatgaaagttcagcatactggggcyatcaatcatatgcctatatctgtt

SEQ ID NO: 74836 - DNA, 50 bp, homo sapien
acatgcattctcatcattcatctttrttctcaatctaattcaccactgcc

SEQ ID NO: 74837 - DNA, 50 bp, homo sapien
tccatccgtggagctgctacactcaraaacttacagaaagaaagctggtt

SEQ ID NO: 74838 - DNA, 50 bp, homo sapien
aatattaaggaaaacaataagctgtrgaacgaacattactcaacttcaaa

SEQ ID NO: 74839 - DNA, 50 bp, homo sapien
gtataataggatggatctcttaaackcgggactgatatataaaacttctc

SEQ ID NO: 74840 - DNA, 50 bp, homo sapien
cattggaacactgaatcagaatagayaataatggtgggctgttggggtag

SEQ ID NO: 74841 - DNA, 50 bp, homo sapien
ggaagaagcgctgtctttcgcctggrattagcagagacttaaatttattc

SEQ ID NO: 74842 - DNA, 50 bp, homo sapien
tggctttcccctggacctgtcaatamaaaccctgagagtttgattgaaca

SEQ ID NO: 74843 - DNA, 50 bp, homo sapien
aatcaattaggataaactactacackaaagaggctgatattttctcagca

SEQ ID NO: 74844 - DNA, 50 bp, homo sapien
agagatgctttaggtaggatgttaawtacagaccttttcttcctttgcaa

SEQ ID NO: 74845 - DNA, 50 bp, homo sapien
aatttgtttaatgttaatgaaagtawctgtacttagataagcaggttggt

SEQ ID NO: 74846 - DNA, 50 bp, homo sapien
tgggacctctgcttttccttaatttyctcactgccataattagcatggat

SEQ ID NO: 74847 - DNA, 50 bp, homo sapien
catcagaagtttaacaaatctgactsagagatctcaacttcttctacatg

SEQ ID NO: 74848 - DNA, 50 bp, homo sapien
attttcctttgcttttggcagttacratctatcagtgttatttgtaaaat

SEQ ID NO: 74849 - DNA, 50 bp, homo sapien
tgtagcccttcaaataattttatgaygttttgccctatctgtagaatttg

SEQ ID NO: 74850 - DNA, 50 bp, homo sapien
cactatctcctatgaggatttccatraaggctcagcaggaggagggaagc

SEQ ID NO: 74851 - DNA, 50 bp, homo sapien
tgtcctcctagtatccctgtagtaaytgtcttacctccattacttttttt

SEQ ID NO: 74852 - DNA, 50 bp, homo sapien
ttaggatacaaaaataggcatctagyaggataacattaacaatgtcaagc

SEQ ID NO: 74853 - DNA, 50 bp, homo sapien
gatcctcccagactaggaattaatgracgcagacatcatagggtcctttt

SEQ ID NO: 74854 - DNA, 50 bp, homo sapien
aagaacacatgacatatattgaggakaaagataaatcaatggaaactgac

SEQ ID NO: 74855 - DNA, 50 bp, homo sapien
atcatcttatttctcaaaacaactgragccggtattattatccccattta

SEQ ID NO: 74856 - DNA, 50 bp, homo sapien
ttgtgcctgctcttgcctagacctgracttacttattggcctctcttctc

SEQ ID NO: 74857 - DNA, 50 bp, homo sapien
agaattgaccttctagttttacacaygccattaaaagtttgaggattgat

SEQ ID NO: 74858 - DNA, 50 bp, homo sapien
acatttggattatggttctacatacrgccagttatacattttgtattgtg

SEQ ID NO: 74859 - DNA, 50 bp, homo sapien
tccaaggagactgattctgttttaartgccaccagagacataaaagtatt

SEQ ID NO: 74860 - DNA, 50 bp, homo sapien
cttttctcttcctgatagggttacarattcccccagttgctctaggaact

SEQ ID NO: 74861 - DNA, 50 bp, homo sapien
tgaagatactttcaagcagtttaaamaatgatactttgcgaagaaacccc

SEQ ID NO: 74862 - DNA, 50 bp, homo sapien
aagaatggaatgagacacattataaytggtaaagaggcagtagtcattca

SEQ ID NO: 74863 - DNA, 50 bp, homo sapien
cctctatgtccccaaactcctgtgayggcagcaaaggagctgctcctgaa

SEQ ID NO: 74864 - DNA, 50 bp, homo sapien
ttctgtaaattacacatttcaaggarcttttatgcaagaatgcatcaaga

SEQ ID NO: 74865 - DNA, 50 bp, homo sapien
cacctaaattacaatacaatgtgtcwaatactatactcacattgtggtca

SEQ ID NO: 74866 - DNA, 50 bp, homo sapien
tagatgttgtttcccagcaacctgargataaggcacctctggattcagcc

SEQ ID NO: 74867 - DNA, 50 bp, homo sapien
gtctctgttgttttcattgcttaaaytgcatattattttgaggaacttta

SEQ ID NO: 74868 - DNA, 50 bp, homo sapien
tgctatattgcttgagatatatacaytccttgttagtgtttttgttagtt

SEQ ID NO: 74869 - DNA, 50 bp, homo sapien
gggtcagtgatgaatgtatgatgaaygatttccctgtttccacgatctcc

SEQ ID NO: 74870 - DNA, 50 bp, homo sapien
tcatccctcatcccaaacttctataygctgataacaagattttattgtca

SEQ ID NO: 74871 - DNA, 50 bp, homo sapien
ttttatcttagttgtatgttacctcraaggtctgataaaaatattttgtc

SEQ ID NO: 74872 - DNA, 50 bp, homo sapien
tctttccttgagtcccttgattctcyacctacaggcaatttctatccatg

SEQ ID NO: 74873 - DNA, 50 bp, homo sapien
aattggctttctgtttgatgtgtagwcctataaaccagttaaagattgga

SEQ ID NO: 74874 - DNA, 50 bp, homo sapien
tataatcacaaggttgtatttcataygtatcagaataatgctcatatggc

SEQ ID NO: 74875 - DNA, 50 bp, homo sapien
ggaaagatcttaagaaataacactayaaaatgattccaaaccttacacca

SEQ ID NO: 74876 - DNA, 50 bp, homo sapien
ggaacccccagatgaagtaggtgacragcactcttagaagttaccataaa

SEQ ID NO: 74877 - DNA, 50 bp, homo sapien
aacagtaccttccctggctcattaaktctggcctaaatttgctactgtca

SEQ ID NO: 74878 - DNA, 50 bp, homo sapien
ctttaattttctaattttggaattaytaaagaatgtgttcttatgcatgc

SEQ ID NO: 74879 - DNA, 50 bp, homo sapien
ggagcagagatgtcagagctggaaarattgtagatcataacaagtgtgtt

SEQ ID NO: 74880 - DNA, 50 bp, homo sapien
tggttaacaaatgataatgaatgaaygactgctgtacagatttaactaag

SEQ ID NO: 74881 - DNA, 32 bp, homo sapien
ctttcacattactgtakgaacccaacctgaat

SEQ ID NO: 74882 - DNA, 50 bp, homo sapien
ctcaaataactaaaattcaaagtagsagctggtatattatcactgaatgg

SEQ ID NO: 74883 - DNA, 50 bp, homo sapien
aagtaaatgtgattcaaggctgcaayggccagatatttagcaaatggtcg

SEQ ID NO: 74884 - DNA, 50 bp, homo sapien
tgtctagaaaatcctgacattctcaraccagtcggttacattaaagtaca

SEQ ID NO: 74885 - DNA, 50 bp, homo sapien
cccacaatttattttccctcgtgtcyaactcacacatttataagaaagga

SEQ ID NO: 74886 - DNA, 50 bp, homo sapien
catcatctcaactgcaggtaatttasatgcttctacagctaagatggccc

SEQ ID NO: 74887 - DNA, 50 bp, homo sapien
acctgtgtatttcaggactgtttatwaatcatcatggccaaaaaaggaca

SEQ ID NO: 74888 - DNA, 50 bp, homo sapien
cctttcatccttccttggattgactragtgtttatgatcttcattttttt

SEQ ID NO: 74889 - DNA, 50 bp, homo sapien
ccaactactgcttaggtgctttgaayacagtaatgaacaagtcagattac

SEQ ID NO: 74890 - DNA, 50 bp, homo sapien
ctgtttttattttctttttacgataractgcaatgctcagcctggggcac

SEQ ID NO: 74891 - DNA, 50 bp, homo sapien
acagatcaaataggaaggcctatatraagtttttcaagtccttaaccata

SEQ ID NO: 74892 - DNA, 50 bp, homo sapien
aatcaataaccccagggatagaaacmgtaataataatgactcggaggcct

SEQ ID NO: 74893 - DNA, 50 bp, homo sapien
aacagaagtcatttcactggagaaastacagcaacaaagtatacaaatat

SEQ ID NO: 74894 - DNA, 50 bp, homo sapien
acccgttcatactcaaaactaaagakactgggaaaacgccatgactccta

SEQ ID NO: 74895 - DNA, 50 bp, homo sapien
tattcaaattagaaaaaaagctggamaatatgctgaacatcctagcaata

SEQ ID NO: 74896 - DNA, 50 bp, homo sapien
caccttatgttaagacacaaagccckgccactctaaaggacaaccaggag

SEQ ID NO: 74897 - DNA, 50 bp, homo sapien
caatgttttatagcaatgtctcccaratttataaagacaatgatgtcttt

SEQ ID NO: 74898 - DNA, 50 bp, homo sapien
ttttaaaaaaacaaaaggttaaacaytcacttactgaggaaagttaagct

SEQ ID NO: 74899 - DNA, 50 bp, homo sapien
ggtactggcatctctgccttgttggrattctggtgtctcctggaactgaa

SEQ ID NO: 74900 - DNA, 50 bp, homo sapien
ctgataaataataatcaatttagaaygatggctgactattaagtcaatat

SEQ ID NO: 74901 - DNA, 50 bp, homo sapien
acagagaactattcgtggaagatagraggctagagttaaaagagaggact

SEQ ID NO: 74902 - DNA, 50 bp, homo sapien
aatttgtgttgcatctttattattayaggcatgactagctcaatacaact

SEQ ID NO: 74903 - DNA, 50 bp, homo sapien
ctctcaactgtatttttataatatcrcaatcccaaagttagactaaataa

SEQ ID NO: 74904 - DNA, 50 bp, homo sapien
agacctctgacaatctaacccttgayactgtagtgatgttgccatgacag

SEQ ID NO: 74905 - DNA, 50 bp, homo sapien
aaatgtatttttttctttccactagycaattggtgacatgtttgctgttt

SEQ ID NO: 74906 - DNA, 50 bp, homo sapien
aaataggaacaaacataaatgataaracaccttctgatgaagggaggcct

SEQ ID NO: 74907 - DNA, 50 bp, homo sapien
ccagctttttgtctagtctcctttayagcaaatacatgttctcatagcat

SEQ ID NO: 74908 - DNA, 50 bp, homo sapien
aagagacttgggtacattgaccacawccatatatatatagtcacataatc

SEQ ID NO: 74909 - DNA, 50 bp, homo sapien
tttcatttgctgatattacagagaarctaatcagaaatagggaaacatat

SEQ ID NO: 74910 - DNA, 50 bp, homo sapien
gacaaggaaaataaacaaatgggtcyattccctgcatcttattgtaacac

SEQ ID NO: 74911 - DNA, 50 bp, homo sapien
aatggctggtccagagtatagctaakgtctatgtatggtcttcatattcg

SEQ ID NO: 74912 - DNA, 50 bp, homo sapien
ctaccattctttgtcattttttttaycctgcatgattatctcacacccca

SEQ ID NO: 74913 - DNA, 50 bp, homo sapien
gaggggagagttaggcttggacagaygattgatgaacggcactgagggaa

SEQ ID NO: 74914 - DNA, 50 bp, homo sapien
gatgagtcaaggttggtaatgtttcragttgtactgtaatccagccattt

SEQ ID NO: 74915 - DNA, 50 bp, homo sapien
attgtttgttaggctctatccctctyatttttcaggcagctcgtggagga

SEQ ID NO: 74916 - DNA, 50 bp, homo sapien
taggtatacaaatagatgacgctaayaaggcaaaatgtttacaatcattg

SEQ ID NO: 74917 - DNA, 50 bp, homo sapien
tatattttcgatgagcactaaagtaygagaagaatgatatttcttcagtt

SEQ ID NO: 74918 - DNA, 50 bp, homo sapien
aagatacatgaaggtatacaaggaaragtggataccagattggagaagac

SEQ ID NO: 74919 - DNA, 50 bp, homo sapien
ggacgctgtatacactgggattgaawcaagagacacaggaatgtattttt

SEQ ID NO: 74920 - DNA, 50 bp, homo sapien
ttctatggcataattgatgttaaaayaaggagattacctaggtgggctga

SEQ ID NO: 74921 - DNA, 50 bp, homo sapien
gagggactctcttgtttctaagggcratgatctgccagaaattcagtctt

SEQ ID NO: 74922 - DNA, 50 bp, homo sapien
aaggttagacgttcactttttgagaygcttgagtagcttttcacttaatt

SEQ ID NO: 74923 - DNA, 50 bp, homo sapien
ttactttggtcttttggctcccagaygttttgcttttttcagtccctggt

SEQ ID NO: 74924 - DNA, 50 bp, homo sapien
ttacagtcacatagctagaaattcamgactagagacgaggtccactgctc

SEQ ID NO: 74925 - DNA, 50 bp, homo sapien
cactctttatttcataagtcttcccratgctgtcagatttcaagattctt

SEQ ID NO: 74926 - DNA, 50 bp, homo sapien
cagcacaacacaaaggtcttgcattkctccctccaaaaggtgagacatgc

SEQ ID NO: 74927 - DNA, 50 bp, homo sapien
gatgttaagtgggtctaaggagaacyaggtagtgtgaggtggaatttgat

SEQ ID NO: 74928 - DNA, 50 bp, homo sapien
ctgggtaaggcactgtggcttaccayggagcatcagggagaagtgaggag

SEQ ID NO: 74929 - DNA, 50 bp, homo sapien
gacattaagctagccctattgaaaargaaataaatgagcctctacagttt

SEQ ID NO: 74930 - DNA, 50 bp, homo sapien
aagaccaaccctttaaagcatcgtgraagactggaacacctgggtggtat

SEQ ID NO: 74931 - DNA, 50 bp, homo sapien
ttgtgcagtgtacaatgcttaagaartcagaaaaatcagttgttcttctc

SEQ ID NO: 74932 - DNA, 50 bp, homo sapien
agtgcttttggctgttacatcttaawattttcaaacttaattctcaaatt

SEQ ID NO: 74933 - DNA, 50 bp, homo sapien
cagaatggtgttattttaagcagaaraagaaggaccataaaggcataaat

SEQ ID NO: 74934 - DNA, 50 bp, homo sapien
agttaagagcagaattgcaataacastaccatacctacaatcagctaaaa

SEQ ID NO: 74935 - DNA, 50 bp, homo sapien
ctactgagacctcatgttgcatccayattaagcaaattttgacatataat

SEQ ID NO: 74936 - DNA, 50 bp, homo sapien
gctgcaatttgaatatttgacatggraagtctaggtattttattcatcac

SEQ ID NO: 74937 - DNA, 50 bp, homo sapien
tcattccacacaaacagaaatcaaamgttttaggagtaagtaaacttata

SEQ ID NO: 74938 - DNA, 50 bp, homo sapien
aaaccagctatgacaatttatactaracaaattgaactagaacccatttg

SEQ ID NO: 74939 - DNA, 50 bp, homo sapien
attattcagtaatagtcctagtatayaaaaacgtggcattcatctacagc

SEQ ID NO: 74940 - DNA, 50 bp, homo sapien
aactggctgatctcttgtcctcaagrtttcaaaagctaaaagaggtccat

SEQ ID NO: 74941 - DNA, 50 bp, homo sapien
gatacagttaaattgagatgctagaratcacttgctaggaagtttatttt

SEQ ID NO: 74942 - DNA, 50 bp, homo sapien
ccaagctagagacaaaattggccacygaaacatatttttctgaaatgtaa

SEQ ID NO: 74943 - DNA, 50 bp, homo sapien
ctaaaactgttgttgcttagggtgaytatgagaattgaaatctgtggccc

SEQ ID NO: 74944 - DNA, 50 bp, homo sapien
taccaaagaaagaacatggagtgcaygtcatagccacttgccttcacgtg

SEQ ID NO: 74945 - DNA, 50 bp, homo sapien
aaaggactggtttcagaatatttagraataaggaatccatatgacaatat

SEQ ID NO: 74946 - DNA, 50 bp, homo sapien
ttctttagtccatgggactcactcaygtttccaagagaatatttcatttc

SEQ ID NO: 74947 - DNA, 50 bp, homo sapien
atgttaagaaagaattatgtttcagrccaggtgtaagaatttggggctct

SEQ ID NO: 74948 - DNA, 50 bp, homo sapien
gtgttagttttctgacagtttttacmctttaaagctatgagtaaaacctt

SEQ ID NO: 74949 - DNA, 50 bp, homo sapien
catttccaacattcgttctgtacaaktcataacctagcagatggcaccat

SEQ ID NO: 74950 - DNA, 50 bp, homo sapien
taaagaaattctattatcagtaatakgtactctcgatttggtttgctgat

SEQ ID NO: 74951 - DNA, 50 bp, homo sapien
ttatgtttctatgggcatatacataratctccctcccattgttaacagaa

SEQ ID NO: 74952 - DNA, 50 bp, homo sapien
ggagttcttctgaagatccatattaygaagaggtaaaaagtgaaattgta

SEQ ID NO: 74953 - DNA, 50 bp, homo sapien
aaggaaaaacaagacatagactagargagaaaaaaaggagcagagaagag

SEQ ID NO: 74954 - DNA, 50 bp, homo sapien
atgtgctgtctcctgctgtcaaatgytttagggctgtcccagtggcactc

SEQ ID NO: 74955 - DNA, 50 bp, homo sapien
gctgccatcaagcaactatttgagargatataaagcaaatgtggcatttt

SEQ ID NO: 74956 - DNA, 50 bp, homo sapien
ggaagggagacatatccttaagtaayctatccatttgtatttcttggtgc

SEQ ID NO: 74957 - DNA, 50 bp, homo sapien
aagcagggatgatggaaagtttgtamccgattagagcataaagcctttta

SEQ ID NO: 74958 - DNA, 50 bp, homo sapien
ggagatagcttctgaaactgcgagaygttaaaaagccatattcaaatcac

SEQ ID NO: 74959 - DNA, 50 bp, homo sapien
ccctcttatgctgtgctactgaaagmcaagaaaaactagatctcaacaaa

SEQ ID NO: 74960 - DNA, 50 bp, homo sapien
tgcacatgcatgtgtacacatacatyactgtcatagctcttcatgcagaa

SEQ ID NO: 74961 - DNA, 50 bp, homo sapien
aggtgggtcaattaattttggagcasagaatatattgcaccttatgtttg

SEQ ID NO: 74962 - DNA, 50 bp, homo sapien
tctcttcggtgacccaaaacagagasacttaggaagaagtatcagacagg

SEQ ID NO: 74963 - DNA, 50 bp, homo sapien
gattccacctgagaagcctgattgarcctgaattgataataccttcgtgt

SEQ ID NO: 74964 - DNA, 50 bp, homo sapien
ctagagaatttcttccagactagtakaaattaatggaagcacatgcaaaa

SEQ ID NO: 74965 - DNA, 50 bp, homo sapien
ctgtttgatagatgaggaagcaggcragaatatgtgggtggttttcaaaa

SEQ ID NO: 74966 - DNA, 50 bp, homo sapien
agaggagaagcagccactctggcaaktcaaagaacatcatcccatggctt

SEQ ID NO: 74967 - DNA, 50 bp, homo sapien
aatcagccaagcaactagcaggttcygaaaatgagtgtagtagtctgttt

SEQ ID NO: 74968 - DNA, 50 bp, homo sapien
gtgctgtctgtaggtttcctatcaaygaatggagtggagggatgtggttc

SEQ ID NO: 74969 - DNA, 50 bp, homo sapien
gtgaatccgtaaatttattgatgtargaaagctatatttaacaagatgtt

SEQ ID NO: 74970 - DNA, 50 bp, homo sapien
tgtcaaaaaaatcaaactcttcaggkaaaatagcagatgaaacaagtcta

SEQ ID NO: 74971 - DNA, 50 bp, homo sapien
gaaggaagcagcttttgcggatgatragtatcttcattaccttgattgtt

SEQ ID NO: 74972 - DNA, 50 bp, homo sapien
agccctagagaaatcatttggatacyatgatacaggcctggtagcacaca

SEQ ID NO: 74973 - DNA, 50 bp, homo sapien
attaaactgtgtatggattcatggayctggaaaatttaaacagtccaatt

SEQ ID NO: 74974 - DNA, 50 bp, homo sapien
ataagttagctttttgcatattaaamttctaaaagaaataattaaatcaa

SEQ ID NO: 74975 - DNA, 50 bp, homo sapien
aaactgctgagttctgctatcaaaaygaatcccaggccgggcacagtggc

SEQ ID NO: 74976 - DNA, 50 bp, homo sapien
gctgacctcggcaggtgtgtgtctayctcagaaactgctgagttctgcta

SEQ ID NO: 74977 - DNA, 50 bp, homo sapien
ttctaataaaaaacaactgacgcaakgtacttcacacttctctgcactcc

SEQ ID NO: 74978 - DNA, 50 bp, homo sapien
tctgcacacaatggggtctcaataartatttttgacaattgttgaaacat

SEQ ID NO: 74979 - DNA, 50 bp, homo sapien
gagcataataatgacattttagatakaacatcagaagtacaattcatgaa

SEQ ID NO: 74980 - DNA, 50 bp, homo sapien
aaataaaaggcataataaaaatccartgcaaagcacaaaagccaagaaca

SEQ ID NO: 74981 - DNA, 50 bp, homo sapien
atcaaaaacataaaatcaaaggattsttgtcttcattattattaatctag

SEQ ID NO: 74982 - DNA, 50 bp, homo sapien
aaacatgcattattggagttcttgcrtttaagcctgtttcacacatgtgc

SEQ ID NO: 74983 - DNA, 50 bp, homo sapien
taacttctttctttgcagaatttacyactgttgtcataaatctaaaactg

SEQ ID NO: 74984 - DNA, 50 bp, homo sapien
tttaatgaccaaatttgtacataaayatccaggtcttatttcaggcccac

SEQ ID NO: 74985 - DNA, 50 bp, homo sapien
agtgaaagagctctatatccaatggwcaaatttaagttctcctcgaaccc

SEQ ID NO: 74986 - DNA, 50 bp, homo sapien
catccagcctaatggctttaaatacyatcttgtcattgacaattcccaaa

SEQ ID NO: 74987 - DNA, 50 bp, homo sapien
actttatctctccattattttgtacsattggtttagaaagacaggtgaca

SEQ ID NO: 74988 - DNA, 50 bp, homo sapien
ccttaattaggatacataaactgcargtagcttaatattgaaatgcagaa

SEQ ID NO: 74989 - DNA, 50 bp, homo sapien
tgagagacagggtaaattctgcttcmatgaaagtgagcgtatctttatta

SEQ ID NO: 74990 - DNA, 50 bp, homo sapien
ggacaaaatttcttatcaacacattkattctctaacgctaacaaatcttg

SEQ ID NO: 74991 - DNA, 50 bp, homo sapien
tctgcaaaggggcaaaatgttaccaygcctcgacagcccctgaggacatc

SEQ ID NO: 74992 - DNA, 50 bp, homo sapien
cagttagaccacaaatgtgcagctaygttggatttggtttgtagtactaa

SEQ ID NO: 74993 - DNA, 50 bp, homo sapien
tagttctgcatttaactgaaaagtaycaaaagcttctcagtgaaaataaa

SEQ ID NO: 74994 - DNA, 50 bp, homo sapien
tgtataagttagggagaatcacttamcctttgagttgttagtttttattt

SEQ ID NO: 74995 - DNA, 50 bp, homo sapien
caaggcaggaagacagaaatcttccsgataaggctggctttccgagggtc

SEQ ID NO: 74996 - DNA, 50 bp, homo sapien
gaaaaatattgtttgtttttgttaayaggactctagtgtggacagagaaa

SEQ ID NO: 74997 - DNA, 50 bp, homo sapien
tcctgcactcacagtctggtatagaycatgagatttttttagatgtgttt

SEQ ID NO: 74998 - DNA, 50 bp, homo sapien
gttgaactttcaataagggagataasatgtctacatataataaaaacaag

SEQ ID NO: 74999 - DNA, 50 bp, homo sapien
gattcagcctgtcactggggcaacaytattttttatattaacttattccc

SEQ ID NO: 75000 - DNA, 50 bp, homo sapien
ccagtcagtgcaggtcattaaactcragcaaaagttcactgaagcaaaga

SEQ ID NO: 75001 - DNA, 50 bp, homo sapien
tgaagaagcataaattggtaatccaygttgagttcagttgctctagaggc

SEQ ID NO: 75002 - DNA, 50 bp, homo sapien
taattgcagcagttcaggctagagayggtgatattggtggaggtacaacg

SEQ ID NO: 75003 - DNA, 50 bp, homo sapien
ccagaagtaagccatatagccacccrcaggtttgaggaattctagaaaat

SEQ ID NO: 75004 - DNA, 50 bp, homo sapien
atccagcaggaaggaagtttccacakatgagaacaggagcaggttagcat

SEQ ID NO: 75005 - DNA, 50 bp, homo sapien
atagtggacaatatatttctcgaggkccggttctttatcatctctgactc

SEQ ID NO: 75006 - DNA, 50 bp, homo sapien
ccacctgtcccaagaacacacaacakatactcaatacttattgaactcaa

SEQ ID NO: 75007 - DNA, 50 bp, homo sapien
taacattagatgcatacatttatgaytatcagtattttagaaagaatata

SEQ ID NO: 75008 - DNA, 50 bp, homo sapien
gttttgtgggagagagggttaatgayatcccccaaactccactaccagat

SEQ ID NO: 75009 - DNA, 50 bp, homo sapien
ttaacccctgggtcctgagatttaawaagatagataaaagcaacaaaatg

SEQ ID NO: 75010 - DNA, 50 bp, homo sapien
atgtagataatgaagtgattttaatsgtatgtccatgaaacttacagctc

SEQ ID NO: 75011 - DNA, 50 bp, homo sapien
gacattgttaataggaactggaattyttagactgaaaggaaaaatgtaga

SEQ ID NO: 75012 - DNA, 50 bp, homo sapien
tgtgtctccgtatggactttattttytttatcccgcatgggacgtgttgg

SEQ ID NO: 75013 - DNA, 50 bp, homo sapien
tttcttattgaaaactgaagagaatktcctactcagcttacctgccagga

SEQ ID NO: 75014 - DNA, 50 bp, homo sapien
agtcacctggcttttcttctttagcrattatatagcgaattacactgatt

SEQ ID NO: 75015 - DNA, 50 bp, homo sapien
ttggatattatgcaggcaacgtaagycatctagtccttaaagtataccta

SEQ ID NO: 75016 - DNA, 50 bp, homo sapien
aattaatcatagtggcttaacttaamgtacaacagtaatggtgaaaaaag

SEQ ID NO: 75017 - DNA, 50 bp, homo sapien
ttactggttgcaattttattcactcrtatcgaattgggcttgcagttttt

SEQ ID NO: 75018 - DNA, 50 bp, homo sapien
agacttgaagaagtcaagctgtgcaragtcaattcaactttgctggtgca

SEQ ID NO: 75019 - DNA, 50 bp, homo sapien
ggtctagactgactgtctgcccctcyataaattgccttaggattaccaga

SEQ ID NO: 75020 - DNA, 50 bp, homo sapien
caacccattattgaaattgggattgyattaaaaccagtcaataaatttga

SEQ ID NO: 75021 - DNA, 50 bp, homo sapien
ttctaataccaccatctatgtggcargtaatgcttagaaagtgaggtaac

SEQ ID NO: 75022 - DNA, 50 bp, homo sapien
ctgcctatttacaaatggttatagckctctctgaatggccaggtggatcc

SEQ ID NO: 75023 - DNA, 50 bp, homo sapien
aaaaggcgtatctagcatgtaagatraataatgaatctaaacaatcccaa

SEQ ID NO: 75024 - DNA, 50 bp, homo sapien
attctcacactctgtgtgtccatacratatttgaccagactcaaatgaca

SEQ ID NO: 75025 - DNA, 50 bp, homo sapien
ggatatatcagttgttcataacgaayttattctcaaggatgatgatattg

SEQ ID NO: 75026 - DNA, 50 bp, homo sapien
agaatgttacagcatttctgccaaastgaaacatatagccaaatgatcac

SEQ ID NO: 75027 - DNA, 50 bp, homo sapien
tctttgcacatctgatttgacttaaygttgaactcagaaatctctccatt

SEQ ID NO: 75028 - DNA, 50 bp, homo sapien
tagcaaaatggttactttgagaaackgaatttgaatagattgctttgtca

SEQ ID NO: 75029 - DNA, 50 bp, homo sapien
tagtcattcatgtcatatcttggaaraagaaaataaaggtgatgtttatc

SEQ ID NO: 75030 - DNA, 50 bp, homo sapien
atcttcagttttgtgaaaataccaawcaagaattacagaatttcaaaatg

SEQ ID NO: 75031 - DNA, 50 bp, homo sapien
aagagattttctattattccctgaartcctttgacagatcatttcaagac

SEQ ID NO: 75032 - DNA, 50 bp, homo sapien
tttggttcagtcctgcccatggcackctagttgaccccattatgcaagtg

SEQ ID NO: 75033 - DNA, 50 bp, homo sapien
ataaaccatccacgccgagaaacccrctgaccgtacttatctgcatatta

SEQ ID NO: 75034 - DNA, 50 bp, homo sapien
tagagaaggcatttgccaaaattcastacacatcatgataaaactacact

SEQ ID NO: 75035 - DNA, 50 bp, homo sapien
caacctaatatattgtctggttttgrcaatcatagtatctttaactgcat

SEQ ID NO: 75036 - DNA, 50 bp, homo sapien
tcctcttaactgggactagaatctamaagctggctggcaaaggcgcctgt

SEQ ID NO: 75037 - DNA, 50 bp, homo sapien
agatcaagaagtacagtctatactaygaaattaaagttactagcacagta

SEQ ID NO: 75038 - DNA, 50 bp, homo sapien
gcatgccctatgtatccctaggtgckctttctcgactgtcttgtggtcat

SEQ ID NO: 75039 - DNA, 50 bp, homo sapien
ttttgcaattgcagcagggatgaaarcaaaattaatttactttctctggt

SEQ ID NO: 75040 - DNA, 50 bp, homo sapien
acctgccaaatatcttcaagagtgayatgcacagagattatttatatatt

SEQ ID NO: 75041 - DNA, 50 bp, homo sapien
attagaattatcacttttttttgcaktgcatttattcattcatcatatgt

SEQ ID NO: 75042 - DNA, 50 bp, homo sapien
caactctgccaagacctactgaggcrcaaactctaaggtgaggcccacag

SEQ ID NO: 75043 - DNA, 50 bp, homo sapien
tcattgtattgtgtatctgtaatccyttgtatcacattgagctactttaa

SEQ ID NO: 75044 - DNA, 50 bp, homo sapien
actgtgattcgactggccttttccartagatgaaatgctgcagcttcagc

SEQ ID NO: 75045 - DNA, 50 bp, homo sapien
atgcctttctactgcctctgatttaraatcctgcttctgcaaaattcact

SEQ ID NO: 75046 - DNA, 50 bp, homo sapien
gtaaaagacaaggacatcctagttayaccattttttcctgagcgttccgg

SEQ ID NO: 75047 - DNA, 50 bp, homo sapien
tagtaggacagagacaataaagaaamgataaaatccagatcgaaaagtag

SEQ ID NO: 75048 - DNA, 50 bp, homo sapien
gctataaggaaatattaaacgtgtgractactgccattatgaatgatgga

SEQ ID NO: 75049 - DNA, 50 bp, homo sapien
atcctttaaaaagttggaatatcaaygtgattgcatagctagtgctggaa

SEQ ID NO: 75050 - DNA, 50 bp, homo sapien
acccatgatatttatttctctcctgycaaaaagtaagcccatattattaa

SEQ ID NO: 75051 - DNA, 50 bp, homo sapien
aaaattttactcaaatgagtcatcartcttctgtcaaagacatttagttc

SEQ ID NO: 75052 - DNA, 50 bp, homo sapien
ccagctcatactccactgaaaatgaygggaaggactatctatctttcttt

SEQ ID NO: 75053 - DNA, 50 bp, homo sapien
atgcatactcagtatgtctggaaacygatgagacatccagctctgttaat

SEQ ID NO: 75054 - DNA, 50 bp, homo sapien
gaacttttagccccaaaagaacaccrccctgtctctggggagccagtcct

SEQ ID NO: 75055 - DNA, 50 bp, homo sapien
tcaggatgtggtctgacttctaagcrccacagggaatgtttctatgaaag

SEQ ID NO: 75056 - DNA, 50 bp, homo sapien
aatgccttatttctcagtgttattamaagattaaaaagagattctgcctg

SEQ ID NO: 75057 - DNA, 50 bp, homo sapien
ccaatattgtctttttcttggtgttkgtgctggtagcactggtgttattc

SEQ ID NO: 75058 - DNA, 50 bp, homo sapien
tccctaaacaaaagctaaatagttayagttaatggtaactggcaagggat

SEQ ID NO: 75059 - DNA, 50 bp, homo sapien
aaaaagggatgggaacaatgacttasaactaagattgctcataaaagacc

SEQ ID NO: 75060 - DNA, 50 bp, homo sapien
caaggagaggaatacgttcaactaawcttttgctcagaagcaacatttgc

SEQ ID NO: 75061 - DNA, 50 bp, homo sapien
aaactgttgtaaaagaactgctgccratatacatgctttccataatggat

SEQ ID NO: 75062 - DNA, 50 bp, homo sapien
tacgaaccatcctgttacactgccaractcactcaagtgacatgaagcct

SEQ ID NO: 75063 - DNA, 50 bp, homo sapien
cagtttcctaaaaggaccaatttcaratatgcaaaattcataggtttttt

SEQ ID NO: 75064 - DNA, 50 bp, homo sapien
tcccagttgctgcaacttggagcctygtgagtgctggctggttagcctgg

SEQ ID NO: 75065 - DNA, 50 bp, homo sapien
aagctattcttaaatcattggaagamaccatatcagaaattttatcaaca

SEQ ID NO: 75066 - DNA, 50 bp, homo sapien
atcctttcctggataagtcatcaaarttcctactctctgagaaatacaca

SEQ ID NO: 75067 - DNA, 50 bp, homo sapien
ttcacatgcacgtgtgtatcccgtayaagcagtatccaatatatgtatat

SEQ ID NO: 75068 - DNA, 50 bp, homo sapien
taatctatttagtgtgctttctcacrgtaaatcaagtccagaaagctgtg

SEQ ID NO: 75069 - DNA, 50 bp, homo sapien
gagcaacattaatcaataatacatamcttaaagccccatcaccttgctct

SEQ ID NO: 75070 - DNA, 50 bp, homo sapien
tcggaatcaacatctttaatttccargttgagagaccaacacttaagaga

SEQ ID NO: 75071 - DNA, 50 bp, homo sapien
tagtcctttcctagagatcctacccyaagttggtataatgacctgagcaa

SEQ ID NO: 75072 - DNA, 50 bp, homo sapien
agaattcatccaagttgatactgctsacccagtagtaaagcattttttga

SEQ ID NO: 75073 - DNA, 50 bp, homo sapien
agattcttcttggtccactggaatcrcaataagacacttgttagtaagaa

SEQ ID NO: 75074 - DNA, 50 bp, homo sapien
tgatgccaggtaagatcaccagaaaygtaagagtgtccctgagagccagg

SEQ ID NO: 75075 - DNA, 50 bp, homo sapien
caaaccaaaaattctatgcatcctayggtcaatcatactcttatactcag

SEQ ID NO: 75076 - DNA, 50 bp, homo sapien
tcccactgataggtcaaggcctagaytatttagaagcgatttacccagca

SEQ ID NO: 75077 - DNA, 50 bp, homo sapien
acagctccttagaaggccaataatamagttggaaaaaagggagtttccac

SEQ ID NO: 75078 - DNA, 50 bp, homo sapien
ctgcatatgtttgcagttttccatcracttcttcataaacaaacattttc

SEQ ID NO: 75079 - DNA, 50 bp, homo sapien
agataaattaataacatctactcaaycttctaatcatttcaatgtgtata

SEQ ID NO: 75080 - DNA, 50 bp, homo sapien
agattttcagcctagagggaaaacaycaagacaaaaatgaaatttagcca

SEQ ID NO: 75081 - DNA, 50 bp, homo sapien
gagaacatggtacattagggaagaayactctggtgcctcaacctccaccc

SEQ ID NO: 75082 - DNA, 50 bp, homo sapien
accttcatgatccagcagtaaaggtsagcagctgagggggatctccccag

SEQ ID NO: 75083 - DNA, 50 bp, homo sapien
cttgtatatggtattcatggaaacaytgattgtattaatagtatcaaaaa

SEQ ID NO: 75084 - DNA, 50 bp, homo sapien
tggcaagacttgaaacattggaaagmatttactccagaaagactctcaga

SEQ ID NO: 75085 - DNA, 50 bp, homo sapien
ttgtattcacaaaaatgtatcctaarataagccaacacataaaagtgcat

SEQ ID NO: 75086 - DNA, 50 bp, homo sapien
tcctcttgttctgctgggtctactargaatggagaatgagcattgacaac

SEQ ID NO: 75087 - DNA, 50 bp, homo sapien
atattatgtgtcgcaaatcgcatcartcgtgccctactctggctcctttt

SEQ ID NO: 75088 - DNA, 50 bp, homo sapien
tttctagaaatgcattctccaaggcyatgagctctggaaaagtgggaagt

SEQ ID NO: 75089 - DNA, 50 bp, homo sapien
tcaaagcacattgagagccaaaatargaaaagagcaattatttccaggga

SEQ ID NO: 75090 - DNA, 50 bp, homo sapien
ctgtccaagtgaactgacactgtttsgttccacacggtatctgctaggag

SEQ ID NO: 75091 - DNA, 50 bp, homo sapien
aagaaggagccgcgggaagaaatcarcaaaggatgcacgggaaggcagcc

SEQ ID NO: 75092 - DNA, 50 bp, homo sapien
tggctgtgtgtaaaataaagataaaygagtacagtggatctcatgatttg

SEQ ID NO: 75093 - DNA, 50 bp, homo sapien
ccaaattccttgattgaattttaacrgtaaccatatttaaaagacatttt

SEQ ID NO: 75094 - DNA, 50 bp, homo sapien
aaccgggcatgaacttggcaactgayctctctgagctcactgtaagataa

SEQ ID NO: 75095 - DNA, 50 bp, homo sapien
tctgaagtgtgtgctcctaaccatcrcattaggccacctctcttgaagcc

SEQ ID NO: 75096 - DNA, 50 bp, homo sapien
aagtggcttactcaggagaaaaggaytagcatgaaggggtgctgtgatga

SEQ ID NO: 75097 - DNA, 50 bp, homo sapien
cccatatttgtttcctaaggctgccrtaaaaaatcaccacaaattgggtg

SEQ ID NO: 75098 - DNA, 50 bp, homo sapien
ttctgctgccatgttcttcctaataygcttcctcccacaaggagtcccct

SEQ ID NO: 75099 - DNA, 50 bp, homo sapien
tggtgtttctactgatgacaggaaasagagaattgaatagtagggcatct

SEQ ID NO: 75100 - DNA, 50 bp, homo sapien
gaagatttttacctgggcaggtaaargttgtaattctatagctgagtgtg

SEQ ID NO: 75101 - DNA, 50 bp, homo sapien
aggagaaatcaaagaactaataaagraggagatgtctcatgttcattgct

SEQ ID NO: 75102 - DNA, 50 bp, homo sapien
ttaaacagatccataagtaagcataycattatacaattttagaacaccaa

SEQ ID NO: 75103 - DNA, 50 bp, homo sapien
cctataaggtaagaacaagatgctaygtaaaaggaacaatcatttaacaa

SEQ ID NO: 75104 - DNA, 50 bp, homo sapien
cttcagctctagctttcgaagaagcrcagatgtccagaaagagggacctc

SEQ ID NO: 75105 - DNA, 50 bp, homo sapien
ttgatgttccaaagccaagataacamctctatcatttgataaagatcaag

SEQ ID NO: 75106 - DNA, 50 bp, homo sapien
aggatcccgaagctttgtgtaaattyaaactaagcccgtggtgttgccaa

SEQ ID NO: 75107 - DNA, 50 bp, homo sapien
atatactcaggctttagataactgamaacctgtttgaaaagtggttctat

SEQ ID NO: 75108 - DNA, 50 bp, homo sapien
ccatagttagtcccatgtaggaatayagtgaaattttaacaagcaaggca

SEQ ID NO: 75109 - DNA, 50 bp, homo sapien
gcatttcccttcaccaagttggctcrctgatgggcgtgtgatcatcggct

SEQ ID NO: 75110 - DNA, 50 bp, homo sapien
agctggatctgtctaaaggcctccamatcttcaactggagggttcttgga

SEQ ID NO: 75111 - DNA, 50 bp, homo sapien
cttatcacttggcctaggcaagcacrgaatgcccatgttccagggagctg

SEQ ID NO: 75112 - DNA, 50 bp, homo sapien
ttgagtcttgcttatttttctgtttrtttaaggctgattggaagttttgt

SEQ ID NO: 75113 - DNA, 50 bp, homo sapien
attgtggaaaagtggaaatgacgtcwcagtggtttaatgatttgctgaca

SEQ ID NO: 75114 - DNA, 50 bp, homo sapien
gaaagaaatgaggctgcatttgcaaytgaacttggacactaagtcatcgg

SEQ ID NO: 75115 - DNA, 50 bp, homo sapien
gtgcctccactagacacttcataccrctggcactaaattatcttttcaag

SEQ ID NO: 75116 - DNA, 50 bp, homo sapien
tggagaaaatgggatcattatgcaargcaaagccatgttgactcatagat

SEQ ID NO: 75117 - DNA, 50 bp, homo sapien
atacccagacttgtgtattcgattayaataactcatctaaaattaaatgc

SEQ ID NO: 75118 - DNA, 50 bp, homo sapien
gcttaaatgtcacttctttgcaataycttatcacactggaccttttcccc

SEQ ID NO: 75119 - DNA, 50 bp, homo sapien
tgaggccacaccccttgatttgacaygtgaagtagcagtacccaactccc

SEQ ID NO: 75120 - DNA, 50 bp, homo sapien
ggatcattgttcctgatttctaaagscccaagactccaggcacagaaaac

SEQ ID NO: 75121 - DNA, 50 bp, homo sapien
aagttcagtggggtttctaggaaaarcaaatgaatagaagagagcacagg

SEQ ID NO: 75122 - DNA, 50 bp, homo sapien
taaaaatgggaaaaaaataatgttayggaagcacagggaaatatgtgctt

SEQ ID NO: 75123 - DNA, 50 bp, homo sapien
gtacagcttgatgccttttcattgayggaacacacctgtgtaactggcat

SEQ ID NO: 75124 - DNA, 50 bp, homo sapien
attctcagaccacatcatgaagcaaktacccaaaactctacccttatcag

SEQ ID NO: 75125 - DNA, 50 bp, homo sapien
tgcagttatcatctcaaatatacagrccattcattcactgaacactaact

SEQ ID NO: 75126 - DNA, 50 bp, homo sapien
tgttgactgaaagtttacctagagawgtgcactccaggaattatgaatta

SEQ ID NO: 75127 - DNA, 50 bp, homo sapien
gtgttccctcatgaatgtattgactragaaggaaacatgcagtttaggat

SEQ ID NO: 75128 - DNA, 50 bp, homo sapien
attcattccagccgagcacatgagaragaggtgtggaactggatggtggc

SEQ ID NO: 75129 - DNA, 50 bp, homo sapien
agtaaggcacagtaactgccttgaartagtccacagtctggctgtattat

SEQ ID NO: 75130 - DNA, 50 bp, homo sapien
acttttatggacaacagtttgggaartctctcctagacaattctagactc

SEQ ID NO: 75131 - DNA, 50 bp, homo sapien
tagtggaaatgagagggattgagagwctcaccatgcctgcaatgaatggg

SEQ ID NO: 75132 - DNA, 50 bp, homo sapien
gcctctggtccacggcctgtatccawccagaggcagtatgaagtgactta

SEQ ID NO: 75133 - DNA, 50 bp, homo sapien
tgaggacttcctgggactgaagggamctgctcatccagagcccactcctc

SEQ ID NO: 75134 - DNA, 50 bp, homo sapien
ctcctcagcagtcacccacctcaccrtgttagagaaaagaaaaatagatt

SEQ ID NO: 75135 - DNA, 50 bp, homo sapien
ttaatacaaaaagaaaagacatctamcctgaaacagtgccacttcaaatg

SEQ ID NO: 75136 - DNA, 50 bp, homo sapien
tctgcactcagcccagctgaccagasgaacaacccaggatgacctagact

SEQ ID NO: 75137 - DNA, 50 bp, homo sapien
gggattcaagacaattttgcagaggraaactagaagtgaagtctgaaagt

SEQ ID NO: 75138 - DNA, 50 bp, homo sapien
ggcagcccctgggtgagcaatttctkgcaggcatccagcccataaagtgt

SEQ ID NO: 75139 - DNA, 50 bp, homo sapien
ggaggcatcttctggaccttccttcrtaatagactcagtaatgaccccca

SEQ ID NO: 75140 - DNA, 50 bp, homo sapien
agcttccattttttgctgaaatcaakttaggagcaagaaaaaaaatgaat

SEQ ID NO: 75141 - DNA, 50 bp, homo sapien
agtggcaaacatttgtctcttgcacycagttcacacagacttcaggttag

SEQ ID NO: 75142 - DNA, 50 bp, homo sapien
aattttgacacaaatctgaaactcakggatataagatagacaaaaatact

SEQ ID NO: 75143 - DNA, 50 bp, homo sapien
ttcactaagaggcactctcctatggraatccaaaacttaacagatctctg

SEQ ID NO: 75144 - DNA, 50 bp, homo sapien
gaatctcgtatcatttcggtactacyatgagggaattaaatttgtcacta

SEQ ID NO: 75145 - DNA, 50 bp, homo sapien
gcagacaagatgatcctctcagtcaktaaacagttagggcccaggctctg

SEQ ID NO: 75146 - DNA, 50 bp, homo sapien
cctaaatctttttttagtggaattamagaagttacgaaagattaggtggg

SEQ ID NO: 75147 - DNA, 50 bp, homo sapien
cctattctaggtagtgaggaaatcgyagtcaacaaaacagaaaaggatcc

SEQ ID NO: 75148 - DNA, 50 bp, homo sapien
ttcacctttgggttctttgctttacygcacagctttctgttttgttttgt

SEQ ID NO: 75149 - DNA, 50 bp, homo sapien
caaaatgcatttttttcaagcacttyaaacttcataaacttgggtgtaca

SEQ ID NO: 75150 - DNA, 50 bp, homo sapien
aagtggctcaggagtatgccagaaartaggacactcctcctccttctaga

SEQ ID NO: 75151 - DNA, 50 bp, homo sapien
cagcagcacatttcatgctgaaaaamagtattgctgccatgaaagacagt

SEQ ID NO: 75152 - DNA, 50 bp, homo sapien
actgggcaaaagttcctaagattcawcttcctctgtttaaatatctagaa

SEQ ID NO: 75153 - DNA, 50 bp, homo sapien
catttctccattgacagacttggtcrttaaggttattggatcaaaaagag

SEQ ID NO: 75154 - DNA, 50 bp, homo sapien
gtgcagcatgattagaagtaaaggamtccaagatggtacaaggtcaaaat

SEQ ID NO: 75155 - DNA, 50 bp, homo sapien
tgtgccacaatcatcaaagatagttwaaagtgccagagttgggagtttca

SEQ ID NO: 75156 - DNA, 50 bp, homo sapien
atcttcaggatgctgtcaattggaamgatagtatcatatagaagaaaaaa

SEQ ID NO: 75157 - DNA, 50 bp, homo sapien
attttggaattccttgctgaatactkttttttttgcggcacacagaagaa

SEQ ID NO: 75158 - DNA, 50 bp, homo sapien
gggtggattgtttctactggtctacycaggttcttaggttaaacttgatc

SEQ ID NO: 75159 - DNA, 50 bp, homo sapien
tctagagtaagatgtgatggtaacasgtggatgaacacacattttggaat

SEQ ID NO: 75160 - DNA, 50 bp, homo sapien
tactgagtttactcacctctagagtmagatgtgatggtaacaggtggatg

SEQ ID NO: 75161 - DNA, 50 bp, homo sapien
tgcttgttagcttttcttcaaaccartatcacaaatggatgctgtcttca

SEQ ID NO: 75162 - DNA, 32 bp, homo sapien
ggaatgattaaactgarctaattaacaaatgc

SEQ ID NO: 75163 - DNA, 50 bp, homo sapien
accctgggtgaccacagccatcctcrgtagactttaaacaacaacctact

SEQ ID NO: 75164 - DNA, 50 bp, homo sapien
cccacgtactttgggcacccggtggyactatatatttctgcattgaaaca

SEQ ID NO: 75165 - DNA, 50 bp, homo sapien
taccagactaaaaactgccagatgaygaccctcgagtccaatttctcgtt

SEQ ID NO: 75166 - DNA, 32 bp, homo sapien
catttaccgtggctttkgtacatgctccttcg

SEQ ID NO: 75167 - DNA, 50 bp, homo sapien
tcaagaacatgtaaaggaatataaarttatccggcacctacaaaataaaa

SEQ ID NO: 75168 - DNA, 50 bp, homo sapien
tggctttttgcagaagctggtttaayaagttgctgagggatgggcaggca

SEQ ID NO: 75169 - DNA, 50 bp, homo sapien
acacaagggaagcaccaccacaaacygaaagctatgggacacacctgcca

SEQ ID NO: 75170 - DNA, 50 bp, homo sapien
aatgacgttacaacatcactgttaartatattttgatgaacataagtatt

SEQ ID NO: 75171 - DNA, 50 bp, homo sapien
gataaattatctatcaaaataataayggccttcttcacagaaataagaaa

SEQ ID NO: 75172 - DNA, 50 bp, homo sapien
caggtaaatttccaccaagtgcacaytgactaaatgggttagcccatctc

SEQ ID NO: 75173 - DNA, 50 bp, homo sapien
ctaaagttctacagcttctaacttcwcttaaaactgaaattatgaataag

SEQ ID NO: 75174 - DNA, 50 bp, homo sapien
atgcaccagattcatgaaaagctgaratgttatggagtatcaggcaggac

SEQ ID NO: 75175 - DNA, 50 bp, homo sapien
gctgtttctgccttgcccccttacartctattcttgatgcgtcaaccaga

SEQ ID NO: 75176 - DNA, 50 bp, homo sapien
gcatattcttaaatccgtcttgactsagcttcatttgtgaaatgaaggat

SEQ ID NO: 75177 - DNA, 50 bp, homo sapien
aactatattgggaagatgaggctgcragctttccatgaagaaagtgaaag

SEQ ID NO: 75178 - DNA, 50 bp, homo sapien
gcccatgtacaagcttttcatttagrccagcaacaattcgttttgttgga

SEQ ID NO: 75179 - DNA, 50 bp, homo sapien
gtgcctattcctctcattctccttcyaatatttcagcatgagacctagag

SEQ ID NO: 75180 - DNA, 50 bp, homo sapien
caatggacagggcagcctctcactamccagttccaaatggccatggtgca

SEQ ID NO: 75181 - DNA, 50 bp, homo sapien
agcaaaaactgactcagattttaaamctgcttggctgagaagacaggaaa

SEQ ID NO: 75182 - DNA, 50 bp, homo sapien
atgagtggaccttatcttacttaaaygctcataaaattactttattttat

SEQ ID NO: 75183 - DNA, 50 bp, homo sapien
actgttaagtgtgcctggatgagaarggggctttttttgtacttttatag

SEQ ID NO: 75184 - DNA, 50 bp, homo sapien
ttttattggaaacaacaatagtaacrataacttaattacagcttatattt

SEQ ID NO: 75185 - DNA, 50 bp, homo sapien
gctctgccgaggacggtgttcagtayggacagagctgcccaaggcagtga

SEQ ID NO: 75186 - DNA, 50 bp, homo sapien
tgattctcctcctcccacagaagcgkgtagatctgctggagcaggtggcc

SEQ ID NO: 75187 - DNA, 50 bp, homo sapien
aatgctatcatcctagagagcaaccracagtggtctgagtgggactgtca

SEQ ID NO: 75188 - DNA, 50 bp, homo sapien
accaggagcagattaaaatgaggtayatgtggaaggtaaagtatcagatc

SEQ ID NO: 75189 - DNA, 50 bp, homo sapien
ctaaacatcccacagtgcagagaacwaacagtgacccatgtaaaatgtca

SEQ ID NO: 75190 - DNA, 50 bp, homo sapien
gctgtgaaagtgggaaaggtggattktctgtcactgaacacacaccctca

SEQ ID NO: 75191 - DNA, 50 bp, homo sapien
tagctggaaagaacaactgtcctcaygatccatggctgtgatgaagccat

SEQ ID NO: 75192 - DNA, 50 bp, homo sapien
taggtgccaagcaatgatagttttamatgggcagcttgcatagcactata

SEQ ID NO: 75193 - DNA, 50 bp, homo sapien
caggaagtttattaagattctatcaytcgaagttatcaccaactatagga

SEQ ID NO: 75194 - DNA, 50 bp, homo sapien
atatgggtgcttcatttcttttttaygactgaatactgttccattgtatg

SEQ ID NO: 75195 - DNA, 50 bp, homo sapien
aattaaaaataaatacataagtaaaygaaaagaaagtgcaaatctgcttt

SEQ ID NO: 75196 - DNA, 50 bp, homo sapien
aaccactggagaaagcaacaatgaaygctcattaggaccagctgaaacac

SEQ ID NO: 75197 - DNA, 50 bp, homo sapien
tactctcacctgtaggattgcaggartaacaaatgacacttaatcacagg

SEQ ID NO: 75198 - DNA, 50 bp, homo sapien
ctttgctttaaaacaaaatattctcrcttagcttgcacccactggaacta

SEQ ID NO: 75199 - DNA, 50 bp, homo sapien
tcactccatgatatcttttgtacgargttttggctttagaaggccgggat

SEQ ID NO: 75200 - DNA, 50 bp, homo sapien
aaacgatggagaaacgggaacaagascatctaagcacccgagcctccctt

SEQ ID NO: 75201 - DNA, 50 bp, homo sapien
tattgaatttttcagcataacatatsaaagtcttaaaatattctgctgtg

SEQ ID NO: 75202 - DNA, 50 bp, homo sapien
tgtctagtgccaggtcctggggatasagaaatggagaagccccatgcctt

SEQ ID NO: 75203 - DNA, 50 bp, homo sapien
attcactgcctcttgtattcattgartggctattactgagcacttactgt

SEQ ID NO: 75204 - DNA, 50 bp, homo sapien
tggggtcctagcacttcccatgaaaygcaagagagcttcatgcgtgagat

SEQ ID NO: 75205 - DNA, 50 bp, homo sapien
aaatgcaagagagcttcatgcgtgaratcatgcgtgagaacagatagttg

SEQ ID NO: 75206 - DNA, 50 bp, homo sapien
agagcagctcatcccgtgatacaacsataattgtgtggccaactatctgt

SEQ ID NO: 75207 - DNA, 50 bp, homo sapien
cctgcaagctcatctcaccctggtcrctggccaagaagccacggccagtc

SEQ ID NO: 75208 - DNA, 50 bp, homo sapien
atgaatgaatgaagcccaagatctasctatttgagagagaggcccgcttg

SEQ ID NO: 75209 - DNA, 50 bp, homo sapien
ggtcaccacagtatgccatgacttaygatgctacaaaatcacattgctcc

SEQ ID NO: 75210 - DNA, 50 bp, homo sapien
ccaagaataggacttagtatttacaytacagtccagggggctgacctctg

SEQ ID NO: 75211 - DNA, 50 bp, homo sapien
ctaatccaaatcccattccactgackgatgttcacccagttgtgattcta

SEQ ID NO: 75212 - DNA, 50 bp, homo sapien
gccattaataagcaccagctgtgtaygtgacattaaaacttactttttag

SEQ ID NO: 75213 - DNA, 50 bp, homo sapien
attcacatacaagtctttgtgcagamgtgtttttatttctcctgaataga

SEQ ID NO: 75214 - DNA, 50 bp, homo sapien
ttttttttttagttctctgttttaawatccaatggtgcaagttgcccctt

SEQ ID NO: 75215 - DNA, 50 bp, homo sapien
aacaattatcttaagagcaaatggcraaagtgctaaactgtaactcatgt

SEQ ID NO: 75216 - DNA, 50 bp, homo sapien
aaaagcctgttatggcattctgaagrccacaaagagggaggtaaacctct

SEQ ID NO: 75217 - DNA, 50 bp, homo sapien
cactagcaggcgtgaaggaggaggartcattaattactttgaagagcagg

SEQ ID NO: 75218 - DNA, 50 bp, homo sapien
gagatcctggaagagacaaagcacasattagatggacaccagggaaattt

SEQ ID NO: 75219 - DNA, 50 bp, homo sapien
gaaagttttatgctttgagttcaaayctatgatctacatagtaataatta

SEQ ID NO: 75220 - DNA, 50 bp, homo sapien
attctcaaataagtatgctcagaaamataaggcttgtctctctattgttt

SEQ ID NO: 75221 - DNA, 50 bp, homo sapien
gcagacctatttccaaagatgcagargctgagaatattttccttcaatag

SEQ ID NO: 75222 - DNA, 50 bp, homo sapien
agaacggtatataacatgtacaaacraagggagaattgcaatggaaatag

SEQ ID NO: 75223 - DNA, 50 bp, homo sapien
taaatctcagaccaagaagacgcaayggttttgaggtagagatcctagga

SEQ ID NO: 75224 - DNA, 50 bp, homo sapien
tcttgcgatgctctctgtggtggaaytgaaccatctttgtaacgccatag

SEQ ID NO: 75225 - DNA, 50 bp, homo sapien
actaatgccctggccagttacagccratatgaacacacaggtccaagtaa

SEQ ID NO: 75226 - DNA, 50 bp, homo sapien
atagcctactgtgtgacaaacacgaygcatattatgttatttacttctta

SEQ ID NO: 75227 - DNA, 50 bp, homo sapien
gtttgggaaaaacaatgcagacacarcaaacatttctgctaagactttct

SEQ ID NO: 75228 - DNA, 50 bp, homo sapien
agaatttcatcaatatccagtaagaytctaagatcgtgctttctgtgaga

SEQ ID NO: 75229 - DNA, 50 bp, homo sapien
acaagcaactatagtgagttgcaccraataagtccatggctagtgccaga

SEQ ID NO: 75230 - DNA, 50 bp, homo sapien
gagtgtggagtctcctctgcaggaarcaagcgcctccactgtgtggctgg

SEQ ID NO: 75231 - DNA, 50 bp, homo sapien
aaaattaagatggaattaggacatayactatcaaatcgacaatattaata

SEQ ID NO: 75232 - DNA, 50 bp, homo sapien
agtctagaaacaagtaatctaatcgycaaggggaccaatcgccaggcaaa

SEQ ID NO: 75233 - DNA, 50 bp, homo sapien
caaggccctgaggattccattattcmaaagcagctactcacaatcttgac

SEQ ID NO: 75234 - DNA, 50 bp, homo sapien
attcccccaaagcaactgttttcaaygaggtttgattagttgctggctca

SEQ ID NO: 75235 - DNA, 50 bp, homo sapien
atccttctgattagagatggaacaayggggaaggccatcggaggtggcac

SEQ ID NO: 75236 - DNA, 50 bp, homo sapien
aagggaagaaaaaataccctggatawgaattcactgtcaactctaacaca

SEQ ID NO: 75237 - DNA, 50 bp, homo sapien
gtaatatttgcagacaagttttaggrattaggacacgagcatatctcttt

SEQ ID NO: 75238 - DNA, 50 bp, homo sapien
catctttcccacccttttggccaagyaaaatactcagaagccttgcttca

SEQ ID NO: 75239 - DNA, 50 bp, homo sapien
acgtcttgagagtttggactccaaasaagcaaattttaatgtgtgctgaa

SEQ ID NO: 75240 - DNA, 50 bp, homo sapien
tatgctgtttattttctaccttaacrgcggtctatttttactaggttgta

SEQ ID NO: 75241 - DNA, 50 bp, homo sapien
gactctaacctttcggtaaagaaacyatgcatttgtctggtgtgtagatc

SEQ ID NO: 75242 - DNA, 50 bp, homo sapien
aagttaacagtgtctatacagcaggwtaagcaataaagctccacttcttt

SEQ ID NO: 75243 - DNA, 50 bp, homo sapien
acttgctgggaggataaaaatactcwattctgagctgtccaatatggcac

SEQ ID NO: 75244 - DNA, 50 bp, homo sapien
aggtctgtagggcagagaggaaaacrcagttccaggtgacctcacgggcc

SEQ ID NO: 75245 - DNA, 50 bp, homo sapien
actcaaggcctactcaagtcaagaaytgttcagtattaaggaaaatctca

SEQ ID NO: 75246 - DNA, 50 bp, homo sapien
gcccttgctttctttctacttactcrcttattacctactttagccttgct

SEQ ID NO: 75247 - DNA, 50 bp, homo sapien
ttggcaaaaaatgtgttgattgtaaygtttcctattttgataaagatgtg

SEQ ID NO: 75248 - DNA, 50 bp, homo sapien
tgaaggtttttaccaaactaatactsaacagaatcggtactccttgggct

SEQ ID NO: 75249 - DNA, 50 bp, homo sapien
aagagaccctggtgttcattcagaakggaaaataagagtgcatcatgcac

SEQ ID NO: 75250 - DNA, 50 bp, homo sapien
atacacaaacatcaccaagtttctcytaaaaacacagaagaccaccctta

SEQ ID NO: 75251 - DNA, 50 bp, homo sapien
tgctgtgttttgacgtttgacaagcragaagatatatcagatgtctttca

SEQ ID NO: 75252 - DNA, 50 bp, homo sapien
ttttaatcctctactaacacaagggraataattttacataatttacttca

SEQ ID NO: 75253 - DNA, 50 bp, homo sapien
aactgcaggaagcacaatttagtcasaattagcaataaaaaaaataacac

SEQ ID NO: 75254 - DNA, 50 bp, homo sapien
tcatttttatatgcttaaaaagccartctcaattttcaaattaagtggat

SEQ ID NO: 75255 - DNA, 50 bp, homo sapien
aaatctgacttctcctacttcaatayagacaacctttcatcatggagaag

SEQ ID NO: 75256 - DNA, 50 bp, homo sapien
gaaaaagacattcctaccaccaatamcttaattagcttcatgcaaaaaga

SEQ ID NO: 75257 - DNA, 50 bp, homo sapien
tcacagatcacatctgttaacgtcartattgtgagcccatgaatattcta

SEQ ID NO: 75258 - DNA, 50 bp, homo sapien
tttccttggtttttctatattttcaygagacaaggcagttctactcttgg

SEQ ID NO: 75259 - DNA, 50 bp, homo sapien
tggcataaagaataagccatttatayaaggtgtggtgattcctaatattc

SEQ ID NO: 75260 - DNA, 50 bp, homo sapien
ggtgtggtttgtgtgtctttctgcayggttctatcataaggaagaatacc

SEQ ID NO: 75261 - DNA, 50 bp, homo sapien
gctttatatgctacatgtttaatgawgtgtgtaattattccactgtgtgg

SEQ ID NO: 75262 - DNA, 50 bp, homo sapien
aaatagagactcgggtgatgcttaaytgacagagactggactggaactca

SEQ ID NO: 75263 - DNA, 50 bp, homo sapien
ctataataatctgtctcagtagttaygtgaattaatgactacctgcatct

SEQ ID NO: 75264 - DNA, 50 bp, homo sapien
atagactatttaaagactaggcaaaratgtatactcattagctaagcaag

SEQ ID NO: 75265 - DNA, 50 bp, homo sapien
taaagggaaacttctactaatctacyatttggtcacccagtggtagacac

SEQ ID NO: 75266 - DNA, 50 bp, homo sapien
agttcaataaggttgttgtatattamgtaaaaataaaaatgaattgtatt

SEQ ID NO: 75267 - DNA, 50 bp, homo sapien
tggagctgacgcttcctcaatcatasggtgaaccgtcccagggtagctgg

SEQ ID NO: 75268 - DNA, 50 bp, homo sapien
ttttattatatgtgagaactgttaamgctcaaagagaacttagacaccta

SEQ ID NO: 75269 - DNA, 50 bp, homo sapien
tagctgtttgatcaacaaccctcacyatataacctgtacccccataccat

SEQ ID NO: 75270 - DNA, 50 bp, homo sapien
atgcctttctttcaacgtcatatcgkcaagccttgtggatctatttgcgc

SEQ ID NO: 75271 - DNA, 50 bp, homo sapien
gtctttttatttgtgacattaattayctagcaggatattgttaggccatg

SEQ ID NO: 75272 - DNA, 50 bp, homo sapien
agagagaaaaggcagaatgtcaaacrggagataaaaatcaaccacagtgt

SEQ ID NO: 75273 - DNA, 50 bp, homo sapien
ataagaaaaccattaaaggcaagatsatctaaagcacaccacagcttggg

SEQ ID NO: 75274 - DNA, 50 bp, homo sapien
gaattgtcctaatttttgtcttttamcagtgtgagttagttacctattgc

SEQ ID NO: 75275 - DNA, 50 bp, homo sapien
acccgacaaagacttacgaaaatgargaatcctgggcaaagagctttcca

SEQ ID NO: 75276 - DNA, 50 bp, homo sapien
tatgccagggaggcaaattaatataygtaaaagaaaatacagaagagtgt

SEQ ID NO: 75277 - DNA, 50 bp, homo sapien
tacagagaggtgaacttaactgcccratttgtgttctgcccactacacta

SEQ ID NO: 75278 - DNA, 50 bp, homo sapien
ccacaacccagataccaaaaggtgargggaaatatctctgagacctcagg

SEQ ID NO: 75279 - DNA, 50 bp, homo sapien
agcatgaaaatataacccagaatacrgaagtacatcggtgaatcaaaaaa

SEQ ID NO: 75280 - DNA, 50 bp, homo sapien
tttttccttgtgaatagaatataaastcttttgaagtaggattatataat

SEQ ID NO: 75281 - DNA, 50 bp, homo sapien
gggtggagatattataaagtgatgcyagtaaaattttggtggggacgaat

SEQ ID NO: 75282 - DNA, 50 bp, homo sapien
agctactcttaaaaccaggtcccaamaagagattatgaatagcccctaaa

SEQ ID NO: 75283 - DNA, 50 bp, homo sapien
cttatttattcttgtcatattccaaytttgtgtttctactccgtaaaacg

SEQ ID NO: 75284 - DNA, 50 bp, homo sapien
tagacaaagaacagacaaataaagamtactactctggaagtgcaggaaag

SEQ ID NO: 75285 - DNA, 50 bp, homo sapien
atagtttcttattagactagcccaarggattgatgttgcatgggcttcgg

SEQ ID NO: 75286 - DNA, 50 bp, homo sapien
ttcattgccgcacggctctgaaggcragagtgtgaaaccaggtgttggcc

SEQ ID NO: 75287 - DNA, 50 bp, homo sapien
gtttgtgcatccacagaaactttatraacattcagagagtagaggccctt

SEQ ID NO: 75288 - DNA, 50 bp, homo sapien
tgctttacagtggcagacagaaaaawttaaaactaatgaatgacagcaca

SEQ ID NO: 75289 - DNA, 50 bp, homo sapien
gcactgtttgtcttttatttgaagarggtcagcttttttccttgctttct

SEQ ID NO: 75290 - DNA, 50 bp, homo sapien
cataagtcactgctacttacctcaamcaagagaacatatgactttttcac

SEQ ID NO: 75291 - DNA, 50 bp, homo sapien
ctacatgtataagggtatatttggcrcaatggaggtaggattgtctgtgt

SEQ ID NO: 75292 - DNA, 50 bp, homo sapien
taaaaaagaagtatcaggatgttccraaaacaaactcttggcccttattt

SEQ ID NO: 75293 - DNA, 50 bp, homo sapien
tgcactaatttgagaacactaatacrgaaacatgactcaaaataaatatt

SEQ ID NO: 75294 - DNA, 50 bp, homo sapien
caggctgttgcataggcctgattaarttaaacaagcctatattgagcact

SEQ ID NO: 75295 - DNA, 50 bp, homo sapien
cctcctttatgagaaggtatcccaamtaattgcacttttgctcctaagca

SEQ ID NO: 75296 - DNA, 50 bp, homo sapien
ctctctttccactccaggaaacctakatttctgccgatctgggtaaccgt

SEQ ID NO: 75297 - DNA, 50 bp, homo sapien
cacaggtgaaattgtgtattatcaayctgcctttccattgttcttacatt

SEQ ID NO: 75298 - DNA, 50 bp, homo sapien
gttaagaagagttgagtttgtgggamtagatgcagattgaaaagtcttta

SEQ ID NO: 75299 - DNA, 50 bp, homo sapien
gtccactcggtaacattgtgaggtasatcaactttgtcttcagcatccta

SEQ ID NO: 75300 - DNA, 50 bp, homo sapien
atcttttcagatgcgttcagcaaacragcaacaggaagcccaactcaggt

SEQ ID NO: 75301 - DNA, 50 bp, homo sapien
gagaaaatcaaggctgtaggaactgsaatagctaaccaatcaggtgagct

SEQ ID NO: 75302 - DNA, 50 bp, homo sapien
cttccagcctgagaggagctgtggakactgttttttcttatccccacaac

SEQ ID NO: 75303 - DNA, 50 bp, homo sapien
aagattgtattcaagcgtactaagayggcttttctggtgagcagttatta

SEQ ID NO: 75304 - DNA, 50 bp, homo sapien
agtgcagtggctatgtccagctgctrtcatcacacactacactaccacct

SEQ ID NO: 75305 - DNA, 50 bp, homo sapien
agcaggaaggaaaggagtcagagaarcgtaacaataacttagaaaatata

SEQ ID NO: 75306 - DNA, 50 bp, homo sapien
tcagttccttgtctctgttcttaacrccaggcctttccactgtatcggca

SEQ ID NO: 75307 - DNA, 50 bp, homo sapien
agagaactggatgcccattcaacgaygtcctcttcagcagcacagccaga

SEQ ID NO: 75308 - DNA, 50 bp, homo sapien
tttcactgctctactgtctactgcamgaaagagaaaataggtgtatgaaa

SEQ ID NO: 75309 - DNA, 50 bp, homo sapien
aggttacttaaagaaagggaatcaargtccatacacaatgtaccctttat

SEQ ID NO: 75310 - DNA, 50 bp, homo sapien
cacatggacaatgaggcagtgttaaycaatcctgcttacccattccataa

SEQ ID NO: 75311 - DNA, 50 bp, homo sapien
aggctggtttatgacagtggaaaaamttcttcaacagctttttcaaggca

SEQ ID NO: 75312 - DNA, 50 bp, homo sapien
atttgtgtaatatttcatagttgcayacccaaataaacaaaagcccaaaa

SEQ ID NO: 75313 - DNA, 50 bp, homo sapien
ggtagtaaccttagccagccatcaargaattattttatttatgcactgtg

SEQ ID NO: 75314 - DNA, 50 bp, homo sapien
ctgggctccttgactaaacacacacycgctcttaagcaaggacgttttga

SEQ ID NO: 75315 - DNA, 50 bp, homo sapien
ccttcatcttcagtataacttttaasccatttgcaatctggcctttatcc

SEQ ID NO: 75316 - DNA, 50 bp, homo sapien
gctgctgcattctccttttgtgttgkaatgtggtgttactagtttcccat

SEQ ID NO: 75317 - DNA, 50 bp, homo sapien
ttctgatgagctgaccagaagaattyggctttataggcagagaaggcctg

SEQ ID NO: 75318 - DNA, 50 bp, homo sapien
ccataataactttatttagacttccraattctgtttttcttgtttatgtt

SEQ ID NO: 75319 - DNA, 50 bp, homo sapien
aaaatttatgttgaagaaaatgaatrtaagtgtggtatgggaacaagagt

SEQ ID NO: 75320 - DNA, 50 bp, homo sapien
gtgaagttgcagtcaagacgtcagcsagaactacaggcacctatacttaa

SEQ ID NO: 75321 - DNA, 50 bp, homo sapien
taatgttttgagtaggttttgttgartaactagtaggcttgacccttggc

SEQ ID NO: 75322 - DNA, 50 bp, homo sapien
tccccaacgatgatggcccttcttarcccaagcctcactttatggtttct

SEQ ID NO: 75323 - DNA, 50 bp, homo sapien
tactgccctttatatcgacctttcawctttgtcagaatatctctgaaggg

SEQ ID NO: 75324 - DNA, 50 bp, homo sapien
aaagtttacagtcctgagctggtaaytggactatcacatggctggaatga

SEQ ID NO: 75325 - DNA, 50 bp, homo sapien
ttgtattgttttattataggctccaytcagtcattttcttcttaattttc

SEQ ID NO: 75326 - DNA, 50 bp, homo sapien
cagcatcggcttccaaattctacggyagtcactgcagtgggcacttctaa

SEQ ID NO: 75327 - DNA, 50 bp, homo sapien
acgtaattagtcaccctacagttgaratatggtatggaagaagggagaca

SEQ ID NO: 75328 - DNA, 50 bp, homo sapien
actttttatgtataaaaatgaaatamatatttgagaatgagaaggcaaaa

SEQ ID NO: 75329 - DNA, 50 bp, homo sapien
attattttaaattccaatatcaaggratagcggctagttagatctggttt

SEQ ID NO: 75330 - DNA, 50 bp, homo sapien
atctggtttagatattacctttagarcctgcagccttgtgccaaagttgg

SEQ ID NO: 75331 - DNA, 50 bp, homo sapien
catgtctttttcacagtatttttaaytagtgagcttttgctctcgcttat

SEQ ID NO: 75332 - DNA, 50 bp, homo sapien
gaaaaggcaagatagatgcttatttrtgaccttttaattcatcattttac

SEQ ID NO: 75333 - DNA, 50 bp, homo sapien
atcatgttcttgcaccttgttctcaygtcttctaagagattcacttgacc

SEQ ID NO: 75334 - DNA, 50 bp, homo sapien
tgctttgctaatagggttgttctgcraggattttttttcacatatctggc

SEQ ID NO: 75335 - DNA, 50 bp, homo sapien
acaagacagggctatatataggcaamtgggatggttcaatggaagccaaa

SEQ ID NO: 75336 - DNA, 50 bp, homo sapien
acttaatatattaggttggtacaaargtaatttcgaagaaccacaattac

SEQ ID NO: 75337 - DNA, 50 bp, homo sapien
gccatgcttcatgtctcagattcaaygatatcctgttctggtttgtgact

SEQ ID NO: 75338 - DNA, 50 bp, homo sapien
ggttcatactggatgtttgttttacyatgagaatgagttacatacagtca

SEQ ID NO: 75339 - DNA, 50 bp, homo sapien
cacaataataatagtaatgatgaagsctgtttagtgcctagttaaaacat

SEQ ID NO: 75340 - DNA, 50 bp, homo sapien
tatctttagcatcctttagaccagarcttagtatgttttaactaggcact

SEQ ID NO: 75341 - DNA, 50 bp, homo sapien
atcacagatgattatccgaaaagtaraaattcactctatagcattctgat

SEQ ID NO: 75342 - DNA, 50 bp, homo sapien
aaagtgaccacactgcttctaagtcraggtgaaagtgctgacagtgaatt

SEQ ID NO: 75343 - DNA, 50 bp, homo sapien
cactagaaatggtacccaagaattamcacgatgacttcaagagctctgat

SEQ ID NO: 75344 - DNA, 50 bp, homo sapien
tcgctattagttctcagatgatagtyaatgcttcaaaggaaaatgtggga

SEQ ID NO: 75345 - DNA, 50 bp, homo sapien
cagacttgcagcttgctttgactaayagaatatcataaaagtgatgctgt

SEQ ID NO: 75346 - DNA, 50 bp, homo sapien
gtggagaattagtgcttcaaattaargaaagtgaacaggcaaacatctac

SEQ ID NO: 75347 - DNA, 50 bp, homo sapien
ttttctagagaagtgaataagtccaragtgagagagaaaacaaccacctt

SEQ ID NO: 75348 - DNA, 50 bp, homo sapien
taagtacttttgcttgactgaaagcyctttttttgttgatagggctgaaa

SEQ ID NO: 75349 - DNA, 50 bp, homo sapien
ggcttaaaatagcatatatttattarcccatgatttctatggatcaggag

SEQ ID NO: 75350 - DNA, 50 bp, homo sapien
catttattcttaattgcccagcagtwacattgtgcttttctctagaagga

SEQ ID NO: 75351 - DNA, 50 bp, homo sapien
agtccatgggaggaacattttaaagrcctctcacatctgcaagtgaattc

SEQ ID NO: 75352 - DNA, 50 bp, homo sapien
agcctgggaagcctgaccacaaaccrgcatctccaaggcatgaataatta

SEQ ID NO: 75353 - DNA, 50 bp, homo sapien
catttaaatgccttataattgagctkaaacacccggagcgatgccagatt

SEQ ID NO: 75354 - DNA, 50 bp, homo sapien
gcttccagaggctgcattatcttccyagatgtcgtgttgaggtgaggtta

SEQ ID NO: 75355 - DNA, 50 bp, homo sapien
aaagtggacattaaacttgctagaaytcctcagtactaatatgctttcaa

SEQ ID NO: 75356 - DNA, 50 bp, homo sapien
attcactaaacatacatttgtatttkcagtcttctgctttatctttggaa

SEQ ID NO: 75357 - DNA, 50 bp, homo sapien
cggttaaatcatctttattcaaagckaaatggactatgtgggtgtgacat

SEQ ID NO: 75358 - DNA, 50 bp, homo sapien
ggaaagccatgcttggcatatcacargttctccaaacgtgataagtatta

SEQ ID NO: 75359 - DNA, 50 bp, homo sapien
tggcactatcctgccactttctatgygtatatggtcaacatggtcagttt

SEQ ID NO: 75360 - DNA, 50 bp, homo sapien
tataaacacagtgatggaattggtaygacacctttatttcactaatacta

SEQ ID NO: 75361 - DNA, 50 bp, homo sapien
gtccacccctgacatccaaggaggaragatttttagccttctatccacca

SEQ ID NO: 75362 - DNA, 50 bp, homo sapien
tgtgtgctcaagtgagtttgagatayactgcattaaatataagaagttgc

SEQ ID NO: 75363 - DNA, 50 bp, homo sapien
cagaagggctgggagacgtgcatcaktagtaagaactgtgagctcagaaa

SEQ ID NO: 75364 - DNA, 50 bp, homo sapien
tgactggtaataggatgctttggtcygacatctagtgttctgattaatag

SEQ ID NO: 75365 - DNA, 50 bp, homo sapien
aaaatgtgggtagtccaaactgagayatggtatatgtaaaatatatatat

SEQ ID NO: 75366 - DNA, 50 bp, homo sapien
accctccttaccctccttaccctcaygcacaacaaagaattatctggccc

SEQ ID NO: 75367 - DNA, 50 bp, homo sapien
cagaatagagtactgatgatggtaawgttgttcctcagcaactacgcttg

SEQ ID NO: 75368 - DNA, 50 bp, homo sapien
aggattgctttaaactcatgaccatmaaacaaatctccaagggtaggggc

SEQ ID NO: 75369 - DNA, 50 bp, homo sapien
ctcccgcactactggctaaccatcarcttaggtgccttgcttagctttct

SEQ ID NO: 75370 - DNA, 50 bp, homo sapien
tctctcacatactaaacacatggtgratctgactaaaaggtatagaagaa

SEQ ID NO: 75371 - DNA, 50 bp, homo sapien
gtgaatcgtactttacagtttacaamgatgtgagcatccaggatcacgac

SEQ ID NO: 75372 - DNA, 50 bp, homo sapien
ctggtgttcgtcatctctgcaaatasctagtactgttggacttttaaatt

SEQ ID NO: 75373 - DNA, 50 bp, homo sapien
tgtaaataagatttctctagtagaawccatctttgtaaggcttgtaaaac

SEQ ID NO: 75374 - DNA, 50 bp, homo sapien
tccttcattctaagtcactgttttasaagccttacaaagatggattctac

SEQ ID NO: 75375 - DNA, 50 bp, homo sapien
ctttctgtaactattacactgctcaygtgacttaaaaagaaaacaaacaa

SEQ ID NO: 75376 - DNA, 50 bp, homo sapien
acaggaaataaaaattatgatatcargaagtgtatctggaaagactaaat

SEQ ID NO: 75377 - DNA, 50 bp, homo sapien
tagtttcagtataatctatatttaakaaactgccttaggggactttggaa

SEQ ID NO: 75378 - DNA, 50 bp, homo sapien
atttattttggtttttgatacagtayagtcagccttccttaaccatgcgt

SEQ ID NO: 75379 - DNA, 50 bp, homo sapien
tttcctgctcttatccactctgttgytagatcacagaagcagcgccatga

SEQ ID NO: 75380 - DNA, 50 bp, homo sapien
tactttctggcatttcttctaaatcrctaagcctctcttcagcttccagt

SEQ ID NO: 75381 - DNA, 50 bp, homo sapien
cttctggatatctaaggacaataacrgtgatttctaatgttattgtctgt

SEQ ID NO: 75382 - DNA, 50 bp, homo sapien
aatggggaaaatgtctccaaggcatrtcattgacctttgcagtagcccct

SEQ ID NO: 75383 - DNA, 50 bp, homo sapien
gtgtctttggtgaaaaataaatgatycctaaggagaacagataggagata

SEQ ID NO: 75384 - DNA, 50 bp, homo sapien
tttccagcctggatatttagaaaaaygtgactgaattgacagaaaagggg

SEQ ID NO: 75385 - DNA, 50 bp, homo sapien
gagtgtcgcagaggagtttaatttgyaaaagtgcagtatgcaaatttgag

SEQ ID NO: 75386 - DNA, 50 bp, homo sapien
caaagagagaagtcagtggaggggamtatagcaatgtctctctcaatgta

SEQ ID NO: 75387 - DNA, 50 bp, homo sapien
atgaacttatgcttgccttaataaayatacaaatagacatgcagtaacag

SEQ ID NO: 75388 - DNA, 50 bp, homo sapien
aagtccgtgaacatgttgacaaatcmaaattagtatttcttataaataat

SEQ ID NO: 75389 - DNA, 50 bp, homo sapien
gatgctcaggagcttccaggttcaayagatgcgtgagatccatagcagaa

SEQ ID NO: 75390 - DNA, 50 bp, homo sapien
attcaaaagcagagactgggatacaraaaacaatgaagaaagaagtccgt

SEQ ID NO: 75391 - DNA, 50 bp, homo sapien
catttgaatattaaaaaaaaaactawagcttgatcttcaggaaaaatgga

SEQ ID NO: 75392 - DNA, 50 bp, homo sapien
cacacagggattctgaaagtgtaaasacgagtcccaggccctcatttgaa

SEQ ID NO: 75393 - DNA, 50 bp, homo sapien
atgaggtaaacttgtcctatgcagtsaacatacattcccagttagtctca

SEQ ID NO: 75394 - DNA, 50 bp, homo sapien
attgatgcaggatttccacaagaatraggaaggcttcgatttgaagaaga

SEQ ID NO: 75395 - DNA, 50 bp, homo sapien
ttatggagataatgagggaacaccargcctagatgcaataggagaaggaa

SEQ ID NO: 75396 - DNA, 50 bp, homo sapien
agaattctgggtttactcagttgacracaaacctacatgatggttctggg

SEQ ID NO: 75397 - DNA, 50 bp, homo sapien
gagtttctcccctattactcttccakaggcagaaattgtgagatccaagc

SEQ ID NO: 75398 - DNA, 50 bp, homo sapien
tttatttccaagtcatatttcctatyataacaaatgaatccctcttacgg

SEQ ID NO: 75399 - DNA, 50 bp, homo sapien
acagatggactcctgcttgacgccaygagaggaaaactaaaaatgaaatc

SEQ ID NO: 75400 - DNA, 50 bp, homo sapien
tagatcatcagtagagaaaacaagartaagttgtgtgttaattacctgct

SEQ ID NO: 75401 - DNA, 50 bp, homo sapien
agttctgtaatatccaatagctcaargacattgatattggtgttcagatc

SEQ ID NO: 75402 - DNA, 50 bp, homo sapien
tcaggtagcatttaatgagaacaacrcttagtttttatattcagttatta

SEQ ID NO: 75403 - DNA, 50 bp, homo sapien
tttattagttttcaatcacacttcaraatgatgcaggtcacagtgtgtct

SEQ ID NO: 75404 - DNA, 50 bp, homo sapien
acgatgtccctttaacatgtattgarcaaattgtcacaggtacgtagtat

SEQ ID NO: 75405 - DNA, 50 bp, homo sapien
ccaaacgttggttgtgaggctacccyaatcgactactgtttcccctaatg

SEQ ID NO: 75406 - DNA, 50 bp, homo sapien
gacacttctaatgtttcatacagcastcaagttcctagtcctcttttaat

SEQ ID NO: 75407 - DNA, 50 bp, homo sapien
gttgagctatctgggaaagaatctasgagagataaggatattggcaaaaa

SEQ ID NO: 75408 - DNA, 50 bp, homo sapien
cttataagtcattgtgtgctagcatyagaaattttaaaaattaagtaaag

SEQ ID NO: 75409 - DNA, 50 bp, homo sapien
aaagctgggatatacaagatatcccraggctaccagagagcagttgctat

SEQ ID NO: 75410 - DNA, 50 bp, homo sapien
cagcaaagttacacgttgtctgggayggaattccaaggtaggatgggagg

SEQ ID NO: 75411 - DNA, 50 bp, homo sapien
tatttcaattaaatatactttactakgtctgcggtggttcagtgcttcat

SEQ ID NO: 75412 - DNA, 50 bp, homo sapien
tatgatcagtagagatcacactagaraagactagaaccttgtttacagat

SEQ ID NO: 75413 - DNA, 50 bp, homo sapien
caggagcatataatatctatttcackcttagtctgctgtggaggcatgtc

SEQ ID NO: 75414 - DNA, 50 bp, homo sapien
aaggatatcttgttccgcctctagcrctcttttgcctgcccaggatctga

SEQ ID NO: 75415 - DNA, 50 bp, homo sapien
cctataggaaaattggttgagtttaygctcccaccaacagggacagagct

SEQ ID NO: 75416 - DNA, 50 bp, homo sapien
ttcattccacatctcctttctgcacrtgtctgagttgtgcgtagttttcc

SEQ ID NO: 75417 - DNA, 50 bp, homo sapien
aattcagtgacatgtccagtgattcratcttgtcaacataatgaatcccc

SEQ ID NO: 75418 - DNA, 50 bp, homo sapien
tggaggaggtataaatgaagggatargattcataagctgtatttttacat

SEQ ID NO: 75419 - DNA, 50 bp, homo sapien
atctccatggacttatttaaaacggractaaagcaacttagttggtagga

SEQ ID NO: 75420 - DNA, 50 bp, homo sapien
ctgctttttcctacttcctcgaacarcaagaatcaaccaaaccccagcag

SEQ ID NO: 75421 - DNA, 50 bp, homo sapien
tacccaccaaattatctttaaaaacrctaatccttgaatgctcagggagg

SEQ ID NO: 75422 - DNA, 50 bp, homo sapien
cttcaggtattaacttgttagggccyattgtctacgtctgtctaaatggt

SEQ ID NO: 75423 - DNA, 50 bp, homo sapien
cccagtggctcttgttcatcactccygattgctctcagattagctgctcc

SEQ ID NO: 75424 - DNA, 50 bp, homo sapien
tcagagtaaactaaatcagtatacartgggaaatcatgccttctccacat

SEQ ID NO: 75425 - DNA, 50 bp, homo sapien
tgggagtggcaccattcactattackcgtagtaaccactaggacattgtt

SEQ ID NO: 75426 - DNA, 50 bp, homo sapien
tattgactacctgtgtaaagtaagamcggtttgccattggagacacaatg

SEQ ID NO: 75427 - DNA, 50 bp, homo sapien
ataaatattaaaggtaaaacataaayactgtgcagacggtgatagatatg

SEQ ID NO: 75428 - DNA, 50 bp, homo sapien
ctgttgttctttttttccttcaggayagagtttcgcccttgttgctcagg

SEQ ID NO: 75429 - DNA, 50 bp, homo sapien
gcagtatagctaatctcttttgtaaytcatgtattaattgcctaattcat

SEQ ID NO: 75430 - DNA, 50 bp, homo sapien
aaaactattaatgggttctcatcacraattcaactaaattcaaacttcgg

SEQ ID NO: 75431 - DNA, 50 bp, homo sapien
ttttcaggggacaagattgccttacwatttatagagactagagaaaactt

SEQ ID NO: 75432 - DNA, 50 bp, homo sapien
ttatgtttttttaagagacagaggasatcaagagttaaatttgatgctta

SEQ ID NO: 75433 - DNA, 50 bp, homo sapien
aaataagatactggatgtgtgaaaastactagagctgctatctggaatat

SEQ ID NO: 75434 - DNA, 50 bp, homo sapien
gaagttaatcaatgttacgtgactamtaaaccaagtaaaagttaaggctt

SEQ ID NO: 75435 - DNA, 50 bp, homo sapien
atttctcatcttcccataaacaatcrgaatcagaatttgagaaacaaaca

SEQ ID NO: 75436 - DNA, 50 bp, homo sapien
caatcagaaaacttcatgtactctayctggaaaccttattctagcttcta

SEQ ID NO: 75437 - DNA, 50 bp, homo sapien
gtcaggaatgtgcctgtttactagcscacaaaagatcaagaaactcggat

SEQ ID NO: 75438 - DNA, 50 bp, homo sapien
gtctagagttagccaagcatgtaggwcattcaactgtgaagcacagtgga

SEQ ID NO: 75439 - DNA, 50 bp, homo sapien
gacttcatgaagaatagtgattccaytgaaatttagaaaggttagagact

SEQ ID NO: 75440 - DNA, 50 bp, homo sapien
ttgaagaggcaagggagaaaagtccyagaaatcaaaagacagtttatatt

SEQ ID NO: 75441 - DNA, 50 bp, homo sapien
gttgaggctgaggttgagaaacagtmaacaagtagagtgctctccaagac

SEQ ID NO: 75442 - DNA, 50 bp, homo sapien
ctcaagttctctctgacattctctayaccctttttgcccagtcatcatcc

SEQ ID NO: 75443 - DNA, 50 bp, homo sapien
agatactgtggacagcagacgtaagrctgaagaatgccttatgaggacta

SEQ ID NO: 75444 - DNA, 50 bp, homo sapien
cacaagaacttcatggaacctaatayacacataaacttaacaaaggaagg

SEQ ID NO: 75445 - DNA, 50 bp, homo sapien
gacctttgtctccaaacccatgataygcatgtaccccacatcgcttttgt

SEQ ID NO: 75446 - DNA, 50 bp, homo sapien
ctaagtgggtaagggtcctttatcayagtaggaattggaatcctaggaat

SEQ ID NO: 75447 - DNA, 50 bp, homo sapien
aaaccatactggttctgcagagggaraggatttgctaagtaggatgcttc

SEQ ID NO: 75448 - DNA, 50 bp, homo sapien
atataatgtgctagtgcctagcacayggaaaatgctcatcaatgtatatg

SEQ ID NO: 75449 - DNA, 50 bp, homo sapien
taaaaaattagtctttgcctcccaayggacaggatttcctagatagcctt

SEQ ID NO: 75450 - DNA, 50 bp, homo sapien
gggtgcccgcctgtcctttcattcayagcttggatgcggctctgcaaatt

SEQ ID NO: 75451 - DNA, 50 bp, homo sapien
tttgagaaatttctatttaaggacartattttcccagattgagtaacttc

SEQ ID NO: 75452 - DNA, 50 bp, homo sapien
gaaaggactaatacaatatacctacscaatatacatcacatggcctttac

SEQ ID NO: 75453 - DNA, 50 bp, homo sapien
gcaataggaggtgcctgatcccgatraggtgctcactgaatgcttgttct

SEQ ID NO: 75454 - DNA, 50 bp, homo sapien
ccttacctgaccctgctccttcaccrcgtttggttgatctagaggtatgc

SEQ ID NO: 75455 - DNA, 50 bp, homo sapien
tctacttctactttgtattcagagasattacctataagcagagttggtag

SEQ ID NO: 75456 - DNA, 50 bp, homo sapien
tgagcattcaagagaaatttctcaartgttagcaacctctgcgtgttcgt

SEQ ID NO: 75457 - DNA, 50 bp, homo sapien
ataaaacataattccaaataagggamatgcccattactcagactttccct

SEQ ID NO: 75458 - DNA, 50 bp, homo sapien
tgccagggccccccatggtcatgcartatgagactttcccttagatccct

SEQ ID NO: 75459 - DNA, 50 bp, homo sapien
tgataactttgagactccatcaaaakaatcagattttacaatatataaaa

SEQ ID NO: 75460 - DNA, 50 bp, homo sapien
tgtacaacattgtgcttatacgtaayaatactgtaacgtacactaaagga

SEQ ID NO: 75461 - DNA, 50 bp, homo sapien
acaaatttctagttgtagacacttaygtgagtacattgattacagatatg

SEQ ID NO: 75462 - DNA, 50 bp, homo sapien
tcgcaggattcctttgttttccttargtcattaaactgagtaattgctgc

SEQ ID NO: 75463 - DNA, 50 bp, homo sapien
tcagaacccatactctgcgggccttraaatggaaaatctctcctctagac

SEQ ID NO: 75464 - DNA, 50 bp, homo sapien
ctcagggttatgggttggtaaataaragaagacaaaacaacctagaccac

SEQ ID NO: 75465 - DNA, 50 bp, homo sapien
ttctcagtgaaagtaaaagtcaaaawcatgctgagaatgagagggtgatc

SEQ ID NO: 75466 - DNA, 50 bp, homo sapien
tttaatactattacgtttttaataaygatagataatgacacatttcttgt

SEQ ID NO: 75467 - DNA, 50 bp, homo sapien
ctctgttttatatgtttttggtatcyacattctgataaaatcttgatgaa

SEQ ID NO: 75468 - DNA, 50 bp, homo sapien
acaaaacattgcatctaaccacaaaytaatgaacaaaggcagaacactag

SEQ ID NO: 75469 - DNA, 50 bp, homo sapien
ctaaatagactctacttagctctgasaatgtctcatttatactcctagtt

SEQ ID NO: 75470 - DNA, 50 bp, homo sapien
caaaagggagaaccactagggcagarcgtcatactgaaatttgcatttac

SEQ ID NO: 75471 - DNA, 50 bp, homo sapien
aagttttttgaggagagcagagagawtcccatgtcttatacccttaatga

SEQ ID NO: 75472 - DNA, 50 bp, homo sapien
gcataggataccaggagaggttggayagaagcaagatttatcagaattag

SEQ ID NO: 75473 - DNA, 50 bp, homo sapien
ttgctctagagcagacctcctgtgtrtccttcaccactttctcctgtccc

SEQ ID NO: 75474 - DNA, 50 bp, homo sapien
agacagctctcaatgggaattactamatgactcttgcttttaaaaattcc

SEQ ID NO: 75475 - DNA, 50 bp, homo sapien
gatgaattcctttctgcccatcctayaagtggcttttcctattttgtatt

SEQ ID NO: 75476 - DNA, 50 bp, homo sapien
attgtggttcacagaggcaataaaartgtgttatgttactagatcctgaa

SEQ ID NO: 75477 - DNA, 50 bp, homo sapien
ggcaaggtaaaattccctaatgcacscatgcttctaaaggactctgccca

SEQ ID NO: 75478 - DNA, 50 bp, homo sapien
caccaacagctgcagtataaaatcayggaatctgctgctgtttacccttt

SEQ ID NO: 75479 - DNA, 50 bp, homo sapien
gggtgaggaactgactagggataaakaagtgaaattgatcaggaaagggt

SEQ ID NO: 75480 - DNA, 50 bp, homo sapien
gtgtcctggatttgactgcaaactcyaccactaactagctgtgtgacttg

SEQ ID NO: 75481 - DNA, 50 bp, homo sapien
gctgtcaaattctgcttgtcttttcmaatcagattcctatccttaatttt

SEQ ID NO: 75482 - DNA, 50 bp, homo sapien
tcatcctgctcccacatggctgtgarcactctttttttttgtcttacaca

SEQ ID NO: 75483 - DNA, 50 bp, homo sapien
tttgataagcatccttctttactcaktctgtcattcagctgcattttgac

SEQ ID NO: 75484 - DNA, 50 bp, homo sapien
attccaagaatcctttgaacttgtasaacatctgggagtccacttccctg

SEQ ID NO: 75485 - DNA, 50 bp, homo sapien
ctgttcccctcctgtttctgaaatayaagtttatgacgttctttcacaaa

SEQ ID NO: 75486 - DNA, 50 bp, homo sapien
ccttaagcaaatttttgaagaaagartaggagttggccaggaggagggct

SEQ ID NO: 75487 - DNA, 50 bp, homo sapien
cgatggttgcagaatttaatacttaygctggctacagtagggagaggggc

SEQ ID NO: 75488 - DNA, 50 bp, homo sapien
tctgtctgtaaactgcatgccaatawctctacctaaatgtttgaaaattt

SEQ ID NO: 75489 - DNA, 50 bp, homo sapien
ctgtaaggggcaccttcctatttaartggtgtatggtcctacctaaaggc

SEQ ID NO: 75490 - DNA, 50 bp, homo sapien
gcaaacactcattgagtaattcttaygtggcagtcactaagcagacagat

SEQ ID NO: 75491 - DNA, 50 bp, homo sapien
tcatctccaatctacttgcattacayctatgggtcttaaaattaatttgc

SEQ ID NO: 75492 - DNA, 50 bp, homo sapien
cttaaaagtctatggtatttgctatraccaatatttttcaactagtgaat

SEQ ID NO: 75493 - DNA, 50 bp, homo sapien
aaacgaaaaatatctagcacagatgytatatctctagttttaactgctct

SEQ ID NO: 75494 - DNA, 50 bp, homo sapien
caaagtttacaatgttcaatatttayctgattatatagcactctgttcac

SEQ ID NO: 75495 - DNA, 50 bp, homo sapien
tcaccatgtctgtgtccaccctctargaagacaatgccagtttattgctc

SEQ ID NO: 75496 - DNA, 50 bp, homo sapien
aaaagatatgttggagttctaacctstggtacctcagaatgtgaccctat

SEQ ID NO: 75497 - DNA, 50 bp, homo sapien
ctctttttgaataaaattcttaccamactagagagagaaggaaatgtcct

SEQ ID NO: 75498 - DNA, 50 bp, homo sapien
aacccaatacccagtagtcctgcacmgagtggacctaattggatcccaga

SEQ ID NO: 75499 - DNA, 50 bp, homo sapien
ccctcacacacagagtggaacccagrccgtccacaaagggcaatccccac

SEQ ID NO: 75500 - DNA, 50 bp, homo sapien
tgtgtgagggagctgccttctgaacrctgttggcagcacaggtctcccag

SEQ ID NO: 75501 - DNA, 50 bp, homo sapien
atgcatattgctggaggaagtaatamcaatgatgcaaatttgcctggaaa

SEQ ID NO: 75502 - DNA, 50 bp, homo sapien
gaatgggagaggggcttccttgcgaragaaggctgtactcaatgcatgaa

SEQ ID NO: 75503 - DNA, 50 bp, homo sapien
agggcctggcagacatgtgcatacasagtgtagagcaaatgagggaggca

SEQ ID NO: 75504 - DNA, 50 bp, homo sapien
agtcttccttctgatatgattcaaascgtaggctatagatgtaatttctt

SEQ ID NO: 75505 - DNA, 50 bp, homo sapien
atgacaaagcattcactaaataccartaagcttctgatatccctggggca

SEQ ID NO: 75506 - DNA, 50 bp, homo sapien
ttcacaacaatcctgtgaggaagtaycattattgtcccactttacaaagg

SEQ ID NO: 75507 - DNA, 50 bp, homo sapien
aagctgagtgttcaggacttgatccracagggaacgctttgttggttcct

SEQ ID NO: 75508 - DNA, 50 bp, homo sapien
ggttcctgggcagaggacgacggcasagtagaaaaagtgtctgggaagaa

SEQ ID NO: 75509 - DNA, 50 bp, homo sapien
aaaaattcccgaaattcatcgccatrtccaggctcctgggtcatctccca

SEQ ID NO: 75510 - DNA, 50 bp, homo sapien
ccccttctaaaaaccaatggagttaygctatacttatttctatgcttgtt

SEQ ID NO: 75511 - DNA, 50 bp, homo sapien
cctttggattaaagtttaaattctcycgtgatgttgaatgtagtttttcc

SEQ ID NO: 75512 - DNA, 50 bp, homo sapien
aattacctgtattggtgcttgctgcrgaaagttataaggacttcatcatg

SEQ ID NO: 75513 - DNA, 50 bp, homo sapien
tgtatgttctcttctttgttcataarctgactaagaactcctggaagttt

SEQ ID NO: 75514 - DNA, 50 bp, homo sapien
tgctgttgtacagcttgtaagagcarggctaacaagagggccagtcttat

SEQ ID NO: 75515 - DNA, 50 bp, homo sapien
gagaggaggtcttcagtactattgarggagacattgatcttctggatgta

SEQ ID NO: 75516 - DNA, 50 bp, homo sapien
aatgtttacgatcatgattcctgtasattgaaaagtctgttaatagtata

SEQ ID NO: 75517 - DNA, 50 bp, homo sapien
tcaagagatgctggtttagccttcakacagaaccaacaagggcaagtcta

SEQ ID NO: 75518 - DNA, 50 bp, homo sapien
gtgagttattcaaggatggattggcmattttatctttgaattgacagtgt

SEQ ID NO: 75519 - DNA, 50 bp, homo sapien
agaacacttagagatgtccagataaraatgacttcccctctcaggctttg

SEQ ID NO: 75520 - DNA, 50 bp, homo sapien
gtatcagaattttagaacaaaaactycaaaagtgaaatggagaagcaaga

SEQ ID NO: 75521 - DNA, 50 bp, homo sapien
ctactaaagtgcactgtttattcacygagaaggcttttaaaggaaagcta

SEQ ID NO: 75522 - DNA, 50 bp, homo sapien
gaaccctgtagacttacagactcagkaaacataatacttctttaaaaaaa

SEQ ID NO: 75523 - DNA, 50 bp, homo sapien
ctttcaaaaataaggattatgattcyatcccagaaaagatcaccttctct

SEQ ID NO: 75524 - DNA, 50 bp, homo sapien
ccactgtctaataagagatagaagasagacaagcattatgagaaagagca

SEQ ID NO: 75525 - DNA, 50 bp, homo sapien
gaaccatgccaccggggatatcttaygtgctgaacatggggggaaactct

SEQ ID NO: 75526 - DNA, 50 bp, homo sapien
cagtctgcaaactgagtgtttggctyacacaattacctgtggatctgtgc

SEQ ID NO: 75527 - DNA, 50 bp, homo sapien
aggatctggaagctatagaaacacayggcgatttctcatcttaagcaggt

SEQ ID NO: 75528 - DNA, 50 bp, homo sapien
gtctacaggcaagggataactcttayagctgacttggcctaattgtggta

SEQ ID NO: 75529 - DNA, 50 bp, homo sapien
ttgtgtggcccatcattttgtagaaytgaatttttatacacaactagagg

SEQ ID NO: 75530 - DNA, 50 bp, homo sapien
gcattagaaattaagcctcaaaggamtatacatataataagtgatcacag

SEQ ID NO: 75531 - DNA, 50 bp, homo sapien
tgatgcagttgctacctcccaccgtsaaaaataataaagacatgtaaata

SEQ ID NO: 75532 - DNA, 50 bp, homo sapien
agcgtattgggagctagtcaagtccrcttgggagctagtcaagtccactt

SEQ ID NO: 75533 - DNA, 50 bp, homo sapien
caaacagaagcagatcagagttaacraataagttcaataaatcacttctt

SEQ ID NO: 75534 - DNA, 50 bp, homo sapien
ttagcaccaggctcagagtttgacayacaataggcacttaataaaaatgc

SEQ ID NO: 75535 - DNA, 50 bp, homo sapien
taacctagtgtttacagaacgcatakaacagttgtgaggctgaaatgact

SEQ ID NO: 75536 - DNA, 50 bp, homo sapien
actaaacctctgtgcctcaaacttaygtgtgaaataacagcactcactta

SEQ ID NO: 75537 - DNA, 50 bp, homo sapien
cttgactctggaattctaatggaacyaatccttgagcattctaagaaaat

SEQ ID NO: 75538 - DNA, 50 bp, homo sapien
tgagaatgtgattggctgccagtaayagtggcttaaacagtaaagagttt

SEQ ID NO: 75539 - DNA, 50 bp, homo sapien
agaatctgctctggtaatgagtaaaygtaggtcctattaacctcgtgatc

SEQ ID NO: 75540 - DNA, 50 bp, homo sapien
atcagataagaggacttgcagaaagractctcagtaaatattagtgtaaa

SEQ ID NO: 75541 - DNA, 50 bp, homo sapien
ctaatatcaggtgtgttcattgaaayggtgatactttgaactctagctga

SEQ ID NO: 75542 - DNA, 50 bp, homo sapien
gagaatgtaattttttctgggataaytgctttagaggatgaggtttggct

SEQ ID NO: 75543 - DNA, 50 bp, homo sapien
ttaaaatagggtatagcttttcttaygatctagtaatgttcattgaaata

SEQ ID NO: 75544 - DNA, 50 bp, homo sapien
tgtctgaaaagtcaaagtaacgtatsacagggtccatgggattaggatgt

SEQ ID NO: 75545 - DNA, 50 bp, homo sapien
attattaactaaagggactcttttcraagtgtatttataatacctgagcg

SEQ ID NO: 75546 - DNA, 50 bp, homo sapien
agcagtcttaaaacatcacgcttaartgaactgttcccagacttatttag

SEQ ID NO: 75547 - DNA, 50 bp, homo sapien
gcttccaaactattggcgtaacatayatactattgattaatgcacagtta

SEQ ID NO: 75548 - DNA, 50 bp, homo sapien
ggaatgacttgttattagattgaaaytgttcactgtgttgagcaggaaag

SEQ ID NO: 75549 - DNA, 50 bp, homo sapien
cttatatggcagcactttcacttgartatataaaaatatctaaatgaaat

SEQ ID NO: 75550 - DNA, 50 bp, homo sapien
aggagaattgttgtctaggagagtakaatagtaaatgaatcagggaaatg

SEQ ID NO: 75551 - DNA, 50 bp, homo sapien
gaaatttcggatttcaacaagagaascattctcctggataatgatgttga

SEQ ID NO: 75552 - DNA, 50 bp, homo sapien
gtctgtattcctgattttgtattaargtttgttggtaaatgtctttcatg

SEQ ID NO: 75553 - DNA, 50 bp, homo sapien
gaatttaaagggagacctgtcagtayggatgaatgtcttcttctagctcc

SEQ ID NO: 75554 - DNA, 50 bp, homo sapien
cttgttcacatctaacaaccagctaytaagataattaagaaatgatgcat

SEQ ID NO: 75555 - DNA, 50 bp, homo sapien
tttataataaaggaaactattagcaygattgaatattctatcaaaaatcc

SEQ ID NO: 75556 - DNA, 50 bp, homo sapien
tagctgatggcttagaaaggagcaascgatagaatatctcaggggaatac

SEQ ID NO: 75557 - DNA, 50 bp, homo sapien
tgtagctggggtagctatacttgcayggtgacatttgagcaaacacttgc

SEQ ID NO: 75558 - DNA, 50 bp, homo sapien
ggtggtcttctctgaatgatacacarctgagaaaagttctgtatcttaca

SEQ ID NO: 75559 - DNA, 50 bp, homo sapien
aattatgcagaacatttctatatcaygggtcaaaaagaatcacaagggaa

SEQ ID NO: 75560 - DNA, 50 bp, homo sapien
ggcaaagttaggcctagtctggttckacaaatggtcagtcctgacaaatt

SEQ ID NO: 75561 - DNA, 50 bp, homo sapien
gcttattacaaaatacaagtgttgcyaagtgcaaaaaacagatgataaaa

SEQ ID NO: 75562 - DNA, 50 bp, homo sapien
tccaactttcccattaatcctgtgamaaattctccaaaacattttctttt

SEQ ID NO: 75563 - DNA, 50 bp, homo sapien
aaaggtacagttgttaatatttatayggagccattaagtgtacactagaa

SEQ ID NO: 75564 - DNA, 50 bp, homo sapien
tcttggcttctgttttgctgtcctasgcttctttgaaaacagacaataac

SEQ ID NO: 75565 - DNA, 50 bp, homo sapien
attgtgtgtgagagactatgatttaygaaattcacatatatgagtaagat

SEQ ID NO: 75566 - DNA, 50 bp, homo sapien
ccatgagcaaaccgcattaagatgawagtgaagagtgaggtttgggtgag

SEQ ID NO: 75567 - DNA, 50 bp, homo sapien
taaaagtttttgtttaattcacagtygaaataggatccttaaagagattt

SEQ ID NO: 75568 - DNA, 50 bp, homo sapien
attttcataaagaggtaatttttctraaactaatccacttctagagtttt

SEQ ID NO: 75569 - DNA, 50 bp, homo sapien
ttttctacaaagtttaagtgaatgaygctaaagggtaatttctactctag

SEQ ID NO: 75570 - DNA, 50 bp, homo sapien
aatactttttcatttacagttcaaakaatttcaatatatactcatctcac

SEQ ID NO: 75571 - DNA, 50 bp, homo sapien
taatgggattgaacttattaacagcmacattggaagttaggagacaatgg

SEQ ID NO: 75572 - DNA, 50 bp, homo sapien
ccaatactagatggggacatagtgaygctaagaacagctgagaatgattt

SEQ ID NO: 75573 - DNA, 50 bp, homo sapien
acagatacgaaaactcaagttctcawtaaaaagtttgcccaaaatcaggc

SEQ ID NO: 75574 - DNA, 50 bp, homo sapien
ttgggctgttgcttaatttgcaggawcacgaacatagtttgaatgctaat

SEQ ID NO: 75575 - DNA, 50 bp, homo sapien
ttcccaatatctttatacaccatacracgggtgcttcagtgcacaggaaa

SEQ ID NO: 75576 - DNA, 50 bp, homo sapien
atatttaacctcccagaggcaccaaygtgtgtgatcaattttataattgt

SEQ ID NO: 75577 - DNA, 50 bp, homo sapien
ggctaaagctggtataaccgctagarcatattttctcttatttgacatat

SEQ ID NO: 75578 - DNA, 50 bp, homo sapien
actcaaagttctttgttctatataaragtcaggagtgtagggagatacca

SEQ ID NO: 75579 - DNA, 50 bp, homo sapien
acagagcgagacagaggaggatacasactggattcatgaacgggatggga

SEQ ID NO: 75580 - DNA, 50 bp, homo sapien
attccttctttgcactctctgtcaamagccttgttcacttcctaagattc

SEQ ID NO: 75581 - DNA, 50 bp, homo sapien
aataatgtttagaagtgcgtttaatktagaggtgactttatgaaagtttt

SEQ ID NO: 75582 - DNA, 50 bp, homo sapien
agaaagtaaatgaattcagtaactaragagaattgtaaacatgtacatga

SEQ ID NO: 75583 - DNA, 50 bp, homo sapien
gcttgagtctgtgcaggataatgtaygtgagttttcttttttggccttag

SEQ ID NO: 75584 - DNA, 50 bp, homo sapien
ggaaatgaagctaaaaatataaatartatcggaagctataacattgacct

SEQ ID NO: 75585 - DNA, 50 bp, homo sapien
tcatttactttctacattacaatcamcttaaacatttactgaggaatcag

SEQ ID NO: 75586 - DNA, 50 bp, homo sapien
gattaactctctatggactgctaaaygatattatcccttcccatgccaga

SEQ ID NO: 75587 - DNA, 50 bp, homo sapien
gctttgttcacacatagatacagacygatgtcaatgtttataaaaaataa

SEQ ID NO: 75588 - DNA, 50 bp, homo sapien
tccattcctggaactcccaagaagargatattactgcactccagctgagc

SEQ ID NO: 75589 - DNA, 50 bp, homo sapien
tacataacatgctctatgacggtccygaagtacacttataagctaatcaa

SEQ ID NO: 75590 - DNA, 50 bp, homo sapien
ataatatataaaaagagagaaacaaycttcatggatatattttgctttcc

SEQ ID NO: 75591 - DNA, 50 bp, homo sapien
tctggaactctggaatacagcaatcrcctattagtattggtagttttttg

SEQ ID NO: 75592 - DNA, 50 bp, homo sapien
tttaattcactacttatttttaagamccatgagctcatttctgggagtat

SEQ ID NO: 75593 - DNA, 50 bp, homo sapien
ttctaggcatggaggatactgtgggmcaaagaaccattggttacctcatt

SEQ ID NO: 75594 - DNA, 50 bp, homo sapien
ttgtacataaacatttatgtaaatcwcagaccatagttaagactagcaga

SEQ ID NO: 75595 - DNA, 50 bp, homo sapien
cctattgtagtgatctcccagtgagmaaaggtttcatggattaaaacagt

SEQ ID NO: 75596 - DNA, 50 bp, homo sapien
atgagtgcctacagttttgagaaccratattaagtctccaattcttcctt

SEQ ID NO: 75597 - DNA, 50 bp, homo sapien
aagtattgttattatcctagttttasgtacaaagaaagggatgctctgac

SEQ ID NO: 75598 - DNA, 50 bp, homo sapien
tcaggcctagaagtaatatctcttaraggtctcctacaatcccacttttg

SEQ ID NO: 75599 - DNA, 50 bp, homo sapien
accactatttttacttgtatttgctyggtgaagtgaaatgtttttatatc

SEQ ID NO: 75600 - DNA, 50 bp, homo sapien
tttttatttattatttagctggaaayataccactatttttacttgtattt

SEQ ID NO: 75601 - DNA, 50 bp, homo sapien
catcaagcgcatcctcagcccttgcratctccagtttagcggatgcagcc

SEQ ID NO: 75602 - DNA, 50 bp, homo sapien
gtaacaaaagccagggataacgtgcyatggaacgatatcgtgccttattt

SEQ ID NO: 75603 - DNA, 50 bp, homo sapien
atacactattgatgggaatttaaatragtataacctctatggaaaaaata

SEQ ID NO: 75604 - DNA, 50 bp, homo sapien
atcactacaatcttacattgtcaatyaaacatcaccaaacctataatgca

SEQ ID NO: 75605 - DNA, 50 bp, homo sapien
tcaccaaacctataatgcacttagaragtataaagctatacatgatcaac

SEQ ID NO: 75606 - DNA, 32 bp, homo sapien
ttataaacccagatgayatcttagctgggaat

SEQ ID NO: 75607 - DNA, 50 bp, homo sapien
tccatcagctactggctgcttcatcyataaggagtccaatatttgaagct

SEQ ID NO: 75608 - DNA, 50 bp, homo sapien
tttcaactatgtcctgaaagactgaraagtgttgttttcatggaaaatta

SEQ ID NO: 75609 - DNA, 50 bp, homo sapien
ggaaggactggggaaacacattctcygaattcactctctttcctctttct

SEQ ID NO: 75610 - DNA, 50 bp, homo sapien
tcttcagttcagtttggattcaagcrcagcttttcttggttccaggcaaa

SEQ ID NO: 75611 - DNA, 50 bp, homo sapien
gaaatgaattgtctcaatgttaaagscaaaactcaaaattgaggagcctt

SEQ ID NO: 75612 - DNA, 50 bp, homo sapien
gaaatgaaatgatacataatttatasgagaatgaataaatagcattttct

SEQ ID NO: 75613 - DNA, 50 bp, homo sapien
tgcatttgtgacaagtggaaaattaygtagctagggagatgcctgtgatg

SEQ ID NO: 75614 - DNA, 50 bp, homo sapien
gaatagatgatcctatagtatcaaaytcctgagaactgttttggaggaag

SEQ ID NO: 75615 - DNA, 50 bp, homo sapien
gttgctctcacaagtgttaacttgcyctgtttgttggaaccgagtagttg

SEQ ID NO: 75616 - DNA, 50 bp, homo sapien
ttctctagagaaacaaaaccaatagsatgtagattatgaagcagagattt

SEQ ID NO: 75617 - DNA, 50 bp, homo sapien
gactttacagttttctccagttaatratcagcaagtactttttattaacg

SEQ ID NO: 75618 - DNA, 50 bp, homo sapien
gggagcacgagggaataaacgtagcyggtaagcctgagtatcactggcca

SEQ ID NO: 75619 - DNA, 50 bp, homo sapien
agccatagaagaaacccaaggaatgrattggacagttaattcagttaatg

SEQ ID NO: 75620 - DNA, 50 bp, homo sapien
tttaggatttttgtaattcaaaggtracctactcattacaaaattaaaac

SEQ ID NO: 75621 - DNA, 50 bp, homo sapien
acatgatgcagttagtaattttaaayaggcatggttaggtcctgtacaga

SEQ ID NO: 75622 - DNA, 50 bp, homo sapien
ttaatgaactacatacaatagagacyatcaacaaaggaaaaatatttatc

SEQ ID NO: 75623 - DNA, 50 bp, homo sapien
ctttcattttttcattctttgtcaayttatctcaatctatatacatgcct

SEQ ID NO: 75624 - DNA, 50 bp, homo sapien
taggatttcctttgtaggacaattcragaagtcggaatttttaggacagt

SEQ ID NO: 75625 - DNA, 50 bp, homo sapien
gatagtagaagtcccatggagaagartatcaaatgatgagactgaaaggt

SEQ ID NO: 75626 - DNA, 50 bp, homo sapien
gttcatattggaaatgtattcaattytcttatacttgattaatagcaggg

SEQ ID NO: 75627 - DNA, 50 bp, homo sapien
ccacaacagtaccaaagaactgcctsaaggtggcgctcaagggcgatagt

SEQ ID NO: 75628 - DNA, 50 bp, homo sapien
attctgaatcttaccctttgaatatsgtgtactttatttctctggatgca

SEQ ID NO: 75629 - DNA, 50 bp, homo sapien
atactaaacttcttattaaagttacmataatttagagagtgtacatgcat

SEQ ID NO: 75630 - DNA, 50 bp, homo sapien
caccaggaaaccactcccatgatgaygaacccacttccgaaggtattaat

SEQ ID NO: 75631 - DNA, 50 bp, homo sapien
tccttttgtgcactcctcacgaacaytcaatataattaaggcataatatt

SEQ ID NO: 75632 - DNA, 50 bp, homo sapien
attgctcaagtaaaaaactgtgatcrataatatcagaaaaagatgagggg

SEQ ID NO: 75633 - DNA, 50 bp, homo sapien
aatctgaactcgggaaggccaggacrctaccccaaggcaaagtaaattaa

SEQ ID NO: 75634 - DNA, 50 bp, homo sapien
tacaatgctgtaataacacaagctamctttttgcaacattttgctttata

SEQ ID NO: 75635 - DNA, 50 bp, homo sapien
agaagagaacccactctctggtggcrtaaaacagaaagaagccaagtctg

SEQ ID NO: 75636 - DNA, 50 bp, homo sapien
gacaaaaagaacagaaccatacttcratcatccctagaattttacagagg

SEQ ID NO: 75637 - DNA, 50 bp, homo sapien
ttcctaaataagtgagtattaaagaygaaagtgatttagacaatctattg

SEQ ID NO: 75638 - DNA, 50 bp, homo sapien
aacttgaagtctgttttgtctgatayctttctagctgatactgttcactt

SEQ ID NO: 75639 - DNA, 50 bp, homo sapien
aacatgttatcccattcttcataaasctgtggaagtcattctaattatat

SEQ ID NO: 75640 - DNA, 50 bp, homo sapien
tttgttctacttggatgtagtagtakagtttcttcagctgtaattcacaa

SEQ ID NO: 75641 - DNA, 50 bp, homo sapien
acttgttgaaattttaaaaacgatayacattttcaactttaaagaaaggg

SEQ ID NO: 75642 - DNA, 50 bp, homo sapien
acaggcagagtcaaccagcagataasaaacaagcttctatttgagcaatc

SEQ ID NO: 75643 - DNA, 50 bp, homo sapien
taagacagtgtgactatttgatgtartaattaagcattactgaaagttgg

SEQ ID NO: 75644 - DNA, 50 bp, homo sapien
aatgaggagaacagatcactataaakcttgctcattacattgagcttctc

SEQ ID NO: 75645 - DNA, 50 bp, homo sapien
ttgtgaagagctgattgtggggtaaragtctgctcaacatttgtaggata

SEQ ID NO: 75646 - DNA, 50 bp, homo sapien
gaattggtgactactaaaaatggtayctgctctcacgttcaatgttcttt

SEQ ID NO: 75647 - DNA, 50 bp, homo sapien
cctggaagtaaaagagctagatgtaycacagtaattatagggaaagaatc

SEQ ID NO: 75648 - DNA, 50 bp, homo sapien
acatgtgcacaaataactctaatgtmaattgtgctgtgcttgaaaataga

SEQ ID NO: 75649 - DNA, 50 bp, homo sapien
tgaggtttttaattcctaaggatcayaaagcgctggaactggaagggacc

SEQ ID NO: 75650 - DNA, 50 bp, homo sapien
aatccaacgaagggatggctttaggyacacttactgaccagagattctaa

SEQ ID NO: 75651 - DNA, 50 bp, homo sapien
ccaatataaatttggtctcatcttcrcattaatacatttggggttcaggt

SEQ ID NO: 75652 - DNA, 50 bp, homo sapien
tcctggcatcaacttacatggccacrattcttgaagggtgtggtagagac

SEQ ID NO: 75653 - DNA, 50 bp, homo sapien
cacagtaaatagatttgagctgagaratccaggcactttaattgccactg

SEQ ID NO: 75654 - DNA, 50 bp, homo sapien
caataataaagctggaagaaaatcaygtcaataatgaagtgtaaatacaa

SEQ ID NO: 75655 - DNA, 50 bp, homo sapien
tgttggcctatataaaataagaggcwaacaactacaactaataattaatg

SEQ ID NO: 75656 - DNA, 32 bp, homo sapien
tggcatgaattatccaraaaaatatcagaatt

SEQ ID NO: 75657 - DNA, 50 bp, homo sapien
tctacccagtcttttctctcacaaayttatgttgtaagcatgttcttttt

SEQ ID NO: 75658 - DNA, 50 bp, homo sapien
tgcctgcttctatgaagaccgtctayacacactgaaggaactcaatttag

SEQ ID NO: 75659 - DNA, 50 bp, homo sapien
caatttctatgagtgatgagaaagcraatacctttatttcacatagcatt

SEQ ID NO: 75660 - DNA, 50 bp, homo sapien
aaaactactgtatatatttatttacragaagtctgaaacaaacacatgtg

SEQ ID NO: 75661 - DNA, 50 bp, homo sapien
agccaaaatctttgaagccttgtgayatcaatagattttctagggtggca

SEQ ID NO: 75662 - DNA, 50 bp, homo sapien
ttgaaaggttataaaaagtcaaaggyaatgagaccaactcacctcagacc

SEQ ID NO: 75663 - DNA, 50 bp, homo sapien
ttggagactttagcttattttacacmaagttatgacagccttgtatccta

SEQ ID NO: 75664 - DNA, 50 bp, homo sapien
gttaaaccctcttgttagggtcaaaytggtatacaggggcgctgatctct

SEQ ID NO: 75665 - DNA, 50 bp, homo sapien
gaccagtgtatccccaaagacaaaastggagccggccacagtgtagttca

SEQ ID NO: 75666 - DNA, 50 bp, homo sapien
tgatgtgctagtacaaaattctggcyctttacctaaatcaggaaatttct

SEQ ID NO: 75667 - DNA, 50 bp, homo sapien
ttttagagtctgctttgtggggtcawttccagtatcaactgttgcagatc

SEQ ID NO: 75668 - DNA, 50 bp, homo sapien
agtacatgtaaagggtagaaggataraggttcatttatttctgtggtatc

SEQ ID NO: 75669 - DNA, 50 bp, homo sapien
agtaaggtggctgccacagagtacaygctcaataagtatatggtctatca

SEQ ID NO: 75670 - DNA, 50 bp, homo sapien
cagaggggacttcagaaaggaaagamtcgccagctgcggatgcactggat

SEQ ID NO: 75671 - DNA, 50 bp, homo sapien
tgtaattaaattgcattttagagacsgcatagagacggcgtatttttttt

SEQ ID NO: 75672 - DNA, 50 bp, homo sapien
aaaatgcaatttaattacatagtacsgaagaatgttacaatttgtgggtg

SEQ ID NO: 75673 - DNA, 50 bp, homo sapien
aggctcaccacagggtaactgtagarcttcaatatggatattatgatagg

SEQ ID NO: 75674 - DNA, 50 bp, homo sapien
gcgaatttcatgtaagtctatttcayaaagatacacttacatatttagca

SEQ ID NO: 75675 - DNA, 50 bp, homo sapien
tgggcgctcaatgaatacttgtggamacattcttttttctttttgagatg

SEQ ID NO: 75676 - DNA, 50 bp, homo sapien
ttgcccaagtttggccaataaaagamctgtatgtgaactctgggcatttc

SEQ ID NO: 75677 - DNA, 50 bp, homo sapien
cccctcctccaacatcgatccaggcractatgttgaaatgaatgattcaa

SEQ ID NO: 75678 - DNA, 50 bp, homo sapien
tccatccttcaccatagttaatatcrattagagctttgtggagttgtttt

SEQ ID NO: 75679 - DNA, 50 bp, homo sapien
gatgtgtgcctacaaatcacattatrtacatgacacattcctctccttgc

SEQ ID NO: 75680 - DNA, 50 bp, homo sapien
taacttgagacaactccatcacctcrgaagaattccaatattagactttc

SEQ ID NO: 75681 - DNA, 50 bp, homo sapien
gagttgaaaccagcttaagaaatcarctactgagttttcattgtcatatt

SEQ ID NO: 75682 - DNA, 50 bp, homo sapien
tgtacagcatctcacctccattttaratagcccttcataagcgagacatc

SEQ ID NO: 75683 - DNA, 50 bp, homo sapien
tgctctagtgaaagtcaactatcaaytgttccttatatgtaatccccagt

SEQ ID NO: 75684 - DNA, 50 bp, homo sapien
aaagtgaattagggatggggtttgawctcatctctgaaaatccagaaggc

SEQ ID NO: 75685 - DNA, 50 bp, homo sapien
agcagcatctcacagctaaaatagaygcacacagtcaagagggtgtctgg

SEQ ID NO: 75686 - DNA, 50 bp, homo sapien
atctagagtaggtcttgtggtggaargagtaagtgcagcatcctcttggt

SEQ ID NO: 75687 - DNA, 50 bp, homo sapien
tatcattgagagaatttgcaggagaygttcaattatttatgctttaaaac

SEQ ID NO: 75688 - DNA, 50 bp, homo sapien
tatggaaaaaagtgagtgagctatamtaggccttaaaagaccagattttg

SEQ ID NO: 75689 - DNA, 50 bp, homo sapien
aaggagccatcaaagctgtttggcartcctacccagttctctgatctctt

SEQ ID NO: 75690 - DNA, 50 bp, homo sapien
ggctctgtttccgggccaattccaarcagacctgcctgatatgccagaga

SEQ ID NO: 75691 - DNA, 50 bp, homo sapien
ataaaagccaggaagcactcaattaratttctgtcttcaggcacttgttt

SEQ ID NO: 75692 - DNA, 50 bp, homo sapien
taagtaaaaaaactgtaaaaagaatsaaagatggtcattatataatgata

SEQ ID NO: 75693 - DNA, 50 bp, homo sapien
agttgaagttctcttgtacaccttcraattcctgttgcctggctcacagt

SEQ ID NO: 75694 - DNA, 50 bp, homo sapien
gtaggtattctcctcattttatcaargagagacctgaaattcagctagat

SEQ ID NO: 75695 - DNA, 50 bp, homo sapien
aagtgtcatagagcagaagatgatcrccaaactcagacttttggcagcac

SEQ ID NO: 75696 - DNA, 50 bp, homo sapien
ttacaggagacaacaagtaggaaagsactgagagaattgtgaagtactgg

SEQ ID NO: 75697 - DNA, 50 bp, homo sapien
gtgatgtgaaagccaaaaaattcaaygctgaaaatgatgaacgcactgtc

SEQ ID NO: 75698 - DNA, 50 bp, homo sapien
ccaggtgcacggtacaagctgtaggyggatctaccattctggggtctgga

SEQ ID NO: 75699 - DNA, 50 bp, homo sapien
gtcttcagaaaacaaatttttgagtwaacatatttaatagtatgccttga

SEQ ID NO: 75700 - DNA, 50 bp, homo sapien
aaaactacccacaattataataccartcaagcaacctcaaaggttccact

SEQ ID NO: 75701 - DNA, 50 bp, homo sapien
actagtttccaagaagcaaagcctartaatgtgataagccaagctgaaca

SEQ ID NO: 75702 - DNA, 50 bp, homo sapien
aatttttcaacctcatctacaccacrctaagaccaaagttctctaaaaat

SEQ ID NO: 75703 - DNA, 50 bp, homo sapien
ccccaggaacctccagagagtgaccyaaacatctggtatagcctctaatc

SEQ ID NO: 75704 - DNA, 50 bp, homo sapien
gtgctgtttttttgattaaaatgccraaacaaaacacagtacttacacgt

SEQ ID NO: 75705 - DNA, 50 bp, homo sapien
tattattgagctacatcaaatgaacragattttaatggaagaaaaacagg

SEQ ID NO: 75706 - DNA, 50 bp, homo sapien
gggaccataaacttctcatcccgaawcttttatcagcttcctagttgacc

SEQ ID NO: 75707 - DNA, 50 bp, homo sapien
tcagtttctgggcgagggccacaagrtcagataagtgagtttatcaatct

SEQ ID NO: 75708 - DNA, 50 bp, homo sapien
tgtagtcttacatgcttacgtagacratcaaagcaagaatactcaataaa

SEQ ID NO: 75709 - DNA, 50 bp, homo sapien
gaattgttagcctgagttccccagartagagcttaaggaagagtttgaat

SEQ ID NO: 75710 - DNA, 50 bp, homo sapien
gttattttgtaaaattctaatagtgraaatatgacttgatgtggtcttat

SEQ ID NO: 75711 - DNA, 50 bp, homo sapien
tagaatctctcatccagtggctagascgatactaagatgagcattacggt

SEQ ID NO: 75712 - DNA, 50 bp, homo sapien
taactttcctgctaatagaaggacarttctactcagtgaaatgtttgcat

SEQ ID NO: 75713 - DNA, 50 bp, homo sapien
cagtgctaggaattaatctatgaatragaaagacccaaggtctgccctct

SEQ ID NO: 75714 - DNA, 50 bp, homo sapien
ctgctacctccaatttcagcacttaygtattttctggtactgtgcagtag

SEQ ID NO: 75715 - DNA, 50 bp, homo sapien
tctgcaacctcttttcttgtaactastaagccataagtgttgttcttccc

SEQ ID NO: 75716 - DNA, 50 bp, homo sapien
aataggctaaatgccacagggtaaaygcctcagcaaaaagcaggctattt

SEQ ID NO: 75717 - DNA, 50 bp, homo sapien
gacagtagtgataaaggtgcttccayaaagggtggagtagaaagcaaaga

SEQ ID NO: 75718 - DNA, 50 bp, homo sapien
gataaaatcttgagatattaactcartcgctccttttcccactactacta

SEQ ID NO: 75719 - DNA, 50 bp, homo sapien
tgagaatctcttgacagtggattacraggccacaccatgagtcccacaac

SEQ ID NO: 75720 - DNA, 50 bp, homo sapien
gcagacagccgtaaagggtttcatgwaaggctcaataacccagagctaac

SEQ ID NO: 75721 - DNA, 32 bp, homo sapien
ttacatcaattgttcasgatccatgtagtttt

SEQ ID NO: 75722 - DNA, 32 bp, homo sapien
tcgggagacagtgccaygtaaagttctttgat

SEQ ID NO: 75723 - DNA, 50 bp, homo sapien
cttcctatctcctgccagcgctactyggtgaccaaacccaactgggagct

SEQ ID NO: 75724 - DNA, 50 bp, homo sapien
cagtgaggtaatgttagcagaaggaygttgcataaagtcaaggacacatt

SEQ ID NO: 75725 - DNA, 50 bp, homo sapien
cttagttttggattcagacaatagastaagatatccttgaaagtatatat

SEQ ID NO: 75726 - DNA, 50 bp, homo sapien
aggagtgtcgggtgtccactggactwagcagaatgagaatttttgtaatg

SEQ ID NO: 75727 - DNA, 50 bp, homo sapien
tcaaaagcagtagtagtccaagaccyatgtcggagagaaaaagaggagga

SEQ ID NO: 75728 - DNA, 50 bp, homo sapien
aactaacgatatcatagaagatgacrctcctgatttgtgggttaatcttt

SEQ ID NO: 75729 - DNA, 50 bp, homo sapien
ttatcttgaggagtcaaattcatatyaagaacgctgtattagtttcctag

SEQ ID NO: 75730 - DNA, 50 bp, homo sapien
tctctgtgcactggtatcccccaatratggttgcagtagttatgttcttg

SEQ ID NO: 75731 - DNA, 50 bp, homo sapien
cataatcataaatcatcttctctackaaaaaatctcatttgcattcctac

SEQ ID NO: 75732 - DNA, 50 bp, homo sapien
caagcagcaaagattcagtctctacrataatttcaagcatctttttgcac

SEQ ID NO: 75733 - DNA, 50 bp, homo sapien
attttcaggaagcatctcaaataaartatttcaaaactcagcctcatcat

SEQ ID NO: 75734 - DNA, 50 bp, homo sapien
ttcaccactattcagagagaatatgrcataagacccagtttcagtaagca

SEQ ID NO: 75735 - DNA, 50 bp, homo sapien
taactggaagaagaagaagagcgcasattttgtttgcagaggagccacta

SEQ ID NO: 75736 - DNA, 50 bp, homo sapien
aaagtctcactgaagaactgagatasacaattcaaccattaccaaaaaca

SEQ ID NO: 75737 - DNA, 50 bp, homo sapien
cttatgaaataccagaattttccaaygcccatatatgttttcctactacc

SEQ ID NO: 75738 - DNA, 50 bp, homo sapien
atagtcttcacaaatactataaagaycagtaagtctatgtctagactata

SEQ ID NO: 75739 - DNA, 50 bp, homo sapien
attgaagtaatcatacatacagaaamgtgtataaataataagggtatagc

SEQ ID NO: 75740 - DNA, 50 bp, homo sapien
cttggcatctgactcagagctggaayggtgtactaagttaactacagagc

SEQ ID NO: 75741 - DNA, 50 bp, homo sapien
ctcaataggcagggttttaatatgayatttgtgtgcctgtttttctgtat

SEQ ID NO: 75742 - DNA, 50 bp, homo sapien
gcctgtttttctgtataacttgtccraaaattgatcaaaactggctgctt

SEQ ID NO: 75743 - DNA, 50 bp, homo sapien
gagactgggcattgcctttgattccrctctgtttccaggtgtgaaaggac

SEQ ID NO: 75744 - DNA, 50 bp, homo sapien
gaaaagtttcactatccagtttagayagagtctgcttttctcccagtaga

SEQ ID NO: 75745 - DNA, 50 bp, homo sapien
tatttgccaggcacttacataatcayccattttaccttttggaattgagc

SEQ ID NO: 75746 - DNA, 50 bp, homo sapien
ataacaagaagtcaccagtctttcaygatgtagattcttatgtcaactac

SEQ ID NO: 75747 - DNA, 50 bp, homo sapien
accttccaaaacctgccagttcttakaaagctactaaatattcatttcct

SEQ ID NO: 75748 - DNA, 50 bp, homo sapien
aagccctgagcccacaatcaaaacckgatgtaaggaggagctgagtgggc

SEQ ID NO: 75749 - DNA, 50 bp, homo sapien
attgagatttttttcagtttttttcsagatatgctatatttcagaattaa

SEQ ID NO: 75750 - DNA, 50 bp, homo sapien
ttctagaattctccacaacaattgamctgtcccttaagtagaccccactg

SEQ ID NO: 75751 - DNA, 50 bp, homo sapien
atcaatcactaaagattgctatgtcsaaagaaatacctttatttcctttg

SEQ ID NO: 75752 - DNA, 50 bp, homo sapien
actgatgatctagcataggacatggrccacattagtgacaagaacaccag

SEQ ID NO: 75753 - DNA, 50 bp, homo sapien
ttttataactgacgatggacctaccsagaaattcagtaaagagtatttgt

SEQ ID NO: 75754 - DNA, 50 bp, homo sapien
aatgctaactatataaccttcaatawatcattcactctgtatttctttta

SEQ ID NO: 75755 - DNA, 50 bp, homo sapien
ggacacacatccaaactatatcacaygtattgagtaattcttgcttatca

SEQ ID NO: 75756 - DNA, 50 bp, homo sapien
aaaagataatggtagatgatgagggractcctaggtctttacatccagac

SEQ ID NO: 75757 - DNA, 50 bp, homo sapien
aaaaaaggtattctgtttgctaatgyatatgtacaagcatgtgttaactg

SEQ ID NO: 75758 - DNA, 50 bp, homo sapien
cctggggcaagagtctgttcttaaaytgaattgaataatggcatctaatg

SEQ ID NO: 75759 - DNA, 50 bp, homo sapien
gagaaaagttctgtgggaaaactccyaattgcataagaccgtcagaggga

SEQ ID NO: 75760 - DNA, 50 bp, homo sapien
tatatttcaaaaaatgctctgaaaaygagacttggagatgaagtttgatc

SEQ ID NO: 75761 - DNA, 50 bp, homo sapien
taaatcctgccatctttgtagtggcrataggaaagattccagaaggttgg

SEQ ID NO: 75762 - DNA, 50 bp, homo sapien
cagcaaaaaagagcagctgcacttcratttctgatgtcttttctccaggc

SEQ ID NO: 75763 - DNA, 50 bp, homo sapien
gaatgacctcacccagaaaggacaasaacaaagagaggtgaggaaaggac

SEQ ID NO: 75764 - DNA, 50 bp, homo sapien
ttatcatctaaaccatgtccagatayaataaacttcctcagttactgttt

SEQ ID NO: 75765 - DNA, 50 bp, homo sapien
gacagagagcactgtaaaatctccaractcctaggaatgaaccccgggaa

SEQ ID NO: 75766 - DNA, 50 bp, homo sapien
ttctcacacttcccttattaaaagcwaccctctaggattttcacatgaag

SEQ ID NO: 75767 - DNA, 50 bp, homo sapien
tatatctatcaatgttccaatgagayggttacaagatatatttatcagaa

SEQ ID NO: 75768 - DNA, 50 bp, homo sapien
attcactaccacaataattcaagccyggaactaatagccatttttaaact

SEQ ID NO: 75769 - DNA, 50 bp, homo sapien
ttgccttgattcatttttagccaaaytggtgaagttctttggttgggaag

SEQ ID NO: 75770 - DNA, 50 bp, homo sapien
tttacaaaatcatcagagaaaagtayggaccaatcaaaaggcgaataaga

SEQ ID NO: 75771 - DNA, 50 bp, homo sapien
agtagaaaaagtggttacacggttamagtggctaaagagcattttagggt

SEQ ID NO: 75772 - DNA, 50 bp, homo sapien
cattcagataggacaaccatgaaaakagatgacctatcttttctttttat

SEQ ID NO: 75773 - DNA, 50 bp, homo sapien
tgtccacctaaattattattacaagraatactttttgaaagccttatatc

SEQ ID NO: 75774 - DNA, 50 bp, homo sapien
ttcttctggagctgtgtgcatttggkagtttcttaactgatcactattcc

SEQ ID NO: 75775 - DNA, 50 bp, homo sapien
ttaagacagatttcaaagatagaacygacaaaacatgataagagattaat

SEQ ID NO: 75776 - DNA, 50 bp, homo sapien
gaaatacaccatagttttaatgtacragaaaactaacattgtaaatatgt

SEQ ID NO: 75777 - DNA, 50 bp, homo sapien
ccattaataattataaattctggtakgggtaacttctaattataaataaa

SEQ ID NO: 75778 - DNA, 50 bp, homo sapien
tattacctaactgtctcaaggtcttyaaattacagcttgaattttcattc

SEQ ID NO: 75779 - DNA, 50 bp, homo sapien
gaaatgtgagccctgtggatataaaraataattggtgaaggactttgagg

SEQ ID NO: 75780 - DNA, 50 bp, homo sapien
atgggagattgaagatggaaaactayggaagcattagaaagagaaaaccc

SEQ ID NO: 75781 - DNA, 50 bp, homo sapien
ctttgcatatattgaactctaggcakgatgaggtccctggggctcagcat

SEQ ID NO: 75782 - DNA, 50 bp, homo sapien
aaattctggcatatttagagttccartgaatccaagatttattgccattc

SEQ ID NO: 75783 - DNA, 50 bp, homo sapien
aaccatgaagtgtgattaagaacgamaccgtggaggaattcctctcaccc

SEQ ID NO: 75784 - DNA, 50 bp, homo sapien
cccctggcatctatgatcaaaacaakctcgttactataaacccctagacc

SEQ ID NO: 75785 - DNA, 50 bp, homo sapien
gtcagtctccaatatgacatctatayacacaaagagtatgacttaatatt

SEQ ID NO: 75786 - DNA, 50 bp, homo sapien
caaaattctctctgcctttgagttasaggagaatgtgaacctaagtagtg

SEQ ID NO: 75787 - DNA, 50 bp, homo sapien
ttttgcctattatttatttcctacaraactgctaagagcttttataagca

SEQ ID NO: 75788 - DNA, 50 bp, homo sapien
caaccaaccaagccagagggcccaaytatctgtgttatccttctatttga

SEQ ID NO: 75789 - DNA, 50 bp, homo sapien
gttttgtaggaaataaataataggcraaatatttactcacatagttattt

SEQ ID NO: 75790 - DNA, 50 bp, homo sapien
gtggagcccctggatacggaaggccmgctgtactttgaatgacaaataac

SEQ ID NO: 75791 - DNA, 50 bp, homo sapien
cttacgtgtagtctgattaactacaytcattttctcgaaaggttcctatg

SEQ ID NO: 75792 - DNA, 50 bp, homo sapien
gaatagacagtattttttaaattacygagctggattctttagaatgggtc

SEQ ID NO: 75793 - DNA, 50 bp, homo sapien
actgggctcaactggctctgaactcrgaagataccaatttccagccatct

SEQ ID NO: 75794 - DNA, 50 bp, homo sapien
tagataaattattggcaagactaacmagaaataatatgcaaattaacaaa

SEQ ID NO: 75795 - DNA, 50 bp, homo sapien
gatgtaaataattgctgaataagaargttaaaaaattgccaagattgata

SEQ ID NO: 75796 - DNA, 50 bp, homo sapien
aaaattcataataacatagcaagtaraagatttattaacaactctacatg

SEQ ID NO: 75797 - DNA, 50 bp, homo sapien
aattctcatgaaatattaacttaccraatgtagtgtcaatcgtacagttt

SEQ ID NO: 75798 - DNA, 50 bp, homo sapien
ctaaactatgattttgcttcaaaagratagcaggttttagatttcaataa

SEQ ID NO: 75799 - DNA, 50 bp, homo sapien
acacaagggaaaaaaaccaatccaawtgtactcataaatcttccaaagtt

SEQ ID NO: 75800 - DNA, 50 bp, homo sapien
agaaaagttcccggattccatttctkctgtatatccattggctaaaccac

SEQ ID NO: 75801 - DNA, 50 bp, homo sapien
aactaccacatcctctaagtaacagsctgaaagaacacagaaagaatggg

SEQ ID NO: 75802 - DNA, 50 bp, homo sapien
cactgctttgccaaccctagggtatrgttcttgctcttatggactgaaat

SEQ ID NO: 75803 - DNA, 50 bp, homo sapien
gggaggaggaggatgaaagacctggratgtcactctaatcaaaattttgt

SEQ ID NO: 75804 - DNA, 50 bp, homo sapien
aaggctcatgcaacagaaatcctccrcattcaccgtctccttgcttcttg

SEQ ID NO: 75805 - DNA, 50 bp, homo sapien
cgtttcattgtcaatactttttcagytctgaagtttcatagaaaggaaag

SEQ ID NO: 75806 - DNA, 50 bp, homo sapien
ctgtacttcctaactcttccatttayattaccattaaagtaactagacac

SEQ ID NO: 75807 - DNA, 50 bp, homo sapien
ttaaatggccattttgtcttctaccrcctgtatcattttattgtattcct

SEQ ID NO: 75808 - DNA, 50 bp, homo sapien
gaaataacactgctctttaagctgartattgaggtgccgagtgagagaaa

SEQ ID NO: 75809 - DNA, 50 bp, homo sapien
ccaaggggagatgatcttagactcartattcagtaggtcttcagacatgt

SEQ ID NO: 75810 - DNA, 50 bp, homo sapien
atcagtctttgagccatgaagagtcyttcctcagcttggtctattctgca

SEQ ID NO: 75811 - DNA, 50 bp, homo sapien
attttacttctcctgctagctccaakccatatttactagtatcttaaaaa

SEQ ID NO: 75812 - DNA, 50 bp, homo sapien
atggagcaatacagcctatattctartacttgtcagacttctgccaggca

SEQ ID NO: 75813 - DNA, 50 bp, homo sapien
atctcattatgtttaagacaatccayagtaattctccaagataagttcaa

SEQ ID NO: 75814 - DNA, 50 bp, homo sapien
tctcaacaattaggttaacaacaatmctggaagctgcaagagatgtgatc

SEQ ID NO: 75815 - DNA, 50 bp, homo sapien
gacttgaaatcaaatattggtaaatkagtagggacatgaaatataggtat

SEQ ID NO: 75816 - DNA, 50 bp, homo sapien
aaaaaatgtacatatgaagtagatawgaatagaattacgatcacaattag

SEQ ID NO: 75817 - DNA, 50 bp, homo sapien
gaatttcaggtttctcggtcctaaarattgagacataggaaaagagaaca

SEQ ID NO: 75818 - DNA, 50 bp, homo sapien
atgttttaatcagatgtgaacaaaaycaaatagttgttagacacttttat

SEQ ID NO: 75819 - DNA, 50 bp, homo sapien
caggttttatcatgatcagtaaaaakgttccaaatgcttctgctccatta

SEQ ID NO: 75820 - DNA, 50 bp, homo sapien
actttctctgtatttgctcagtcaayttcttttttctcacctaaatttgt

SEQ ID NO: 75821 - DNA, 50 bp, homo sapien
atactggagatatagaaattgttcarctcgggagattccatatgtacagt

SEQ ID NO: 75822 - DNA, 50 bp, homo sapien
attggtctccctggaagagagtaaaytcctttagtgcaagccatgtcatc

SEQ ID NO: 75823 - DNA, 50 bp, homo sapien
aattctgctcctcctgttgtagctayggactaccttaaggagatgttttc

SEQ ID NO: 75824 - DNA, 50 bp, homo sapien
aatacaggtcctgactcacagatcayatatcggcagagaacgtgttctct

SEQ ID NO: 75825 - DNA, 50 bp, homo sapien
cagactacttcatttttctaactcaraataatccagctttgacgactctc

SEQ ID NO: 75826 - DNA, 50 bp, homo sapien
attactttgtactccatgatatgtaygactactgcctgtcaataaaaaga

SEQ ID NO: 75827 - DNA, 50 bp, homo sapien
agaattctaagtagtttctcagaatraagataataacacagcaagaaatc

SEQ ID NO: 75828 - DNA, 50 bp, homo sapien
gatcttttccagccaccaggcaaaascacattctacaattgctaagttca

SEQ ID NO: 75829 - DNA, 50 bp, homo sapien
aaaaggcatgtgttcatcaccaggakaagttatctttcattccaagtatt

SEQ ID NO: 75830 - DNA, 50 bp, homo sapien
aagaaaaataaaacaataaatcacayaggctgtaaccttcagagtctgaa

SEQ ID NO: 75831 - DNA, 50 bp, homo sapien
aacaaaaatgaaagctttatctacckggaacattagcatttcaaggaatc

SEQ ID NO: 75832 - DNA, 50 bp, homo sapien
ctcaattcaaatatgcattttaacawtgtaaacatatggttacaatttcc

SEQ ID NO: 75833 - DNA, 50 bp, homo sapien
gcttggcagcaggagccattgactgsagattcactcagaagaaagtgggg

SEQ ID NO: 75834 - DNA, 50 bp, homo sapien
agagtgtcagttatgtatcttaataycatatcatactctacatagtcaca

SEQ ID NO: 75835 - DNA, 50 bp, homo sapien
gagtttcataaatctgtttatcttaycaaagccaaaaataagctagttag

SEQ ID NO: 75836 - DNA, 50 bp, homo sapien
ttcaggaattggtgagttcaatttgsagttcaagcttgatattaccccca

SEQ ID NO: 75837 - DNA, 50 bp, homo sapien
gctattatgttgggctgtgcgatagrcataggctgcaggtcacgctatgg

SEQ ID NO: 75838 - DNA, 50 bp, homo sapien
ctgttttccacatcttttagcaatastacatttgatcaatatccctcctg

SEQ ID NO: 75839 - DNA, 50 bp, homo sapien
tggatatccttgtaaattacaaagaygtgaaactgaaatatccatgaata

SEQ ID NO: 75840 - DNA, 50 bp, homo sapien
tgtaagtacttgcctaaacaatttaraagttatagagaagaatcacctat

SEQ ID NO: 75841 - DNA, 50 bp, homo sapien
ttggtcattgtcttcaaggaacttaygatttcaaggttgaatgattcaca

SEQ ID NO: 75842 - DNA, 50 bp, homo sapien
ccccccaggtccctccctcaacacaygcggattatagtttcagatgagaa

SEQ ID NO: 75843 - DNA, 50 bp, homo sapien
catcctgaactgtattgttcacttayatttgaaggaaatataataaattc

SEQ ID NO: 75844 - DNA, 50 bp, homo sapien
gcaacccaaatcttgtagcattaaarctgttatcacctgtagtttcaaag

SEQ ID NO: 75845 - DNA, 50 bp, homo sapien
tcacctctcggtcaaatctcccgggyctacgcagcgctgggtctagagcg

SEQ ID NO: 75846 - DNA, 50 bp, homo sapien
caaagcttagtatatagcctgtagayggtatttgaacttgctggagaaat

SEQ ID NO: 75847 - DNA, 50 bp, homo sapien
atgggacttagtacactggtgactaygattaaaagggaaagagctttaaa

SEQ ID NO: 75848 - DNA, 50 bp, homo sapien
tgagtctacaaagccagtctatcaartgaggctaaaattggctaccttgg

SEQ ID NO: 75849 - DNA, 50 bp, homo sapien
aagcagtaaagactccctaaagccargtatactctgctattcctttccag

SEQ ID NO: 75850 - DNA, 50 bp, homo sapien
cagctactgactgctgtggtctatawaaattacttagaagtctgacaatg

SEQ ID NO: 75851 - DNA, 50 bp, homo sapien
ttatgcatattttaattatggtatayccaagcctgatttttcatccagtg

SEQ ID NO: 75852 - DNA, 50 bp, homo sapien
gaaataataaaatccatttaacacartataatacatagctcaacaaatga

SEQ ID NO: 75853 - DNA, 50 bp, homo sapien
gtgataagtagtgatgagaaagccamgtatggacttgcaggatggaggtg

SEQ ID NO: 75854 - DNA, 50 bp, homo sapien
tccctgacctacaagagaaagtccartctcctcagcataagatacacagt

SEQ ID NO: 75855 - DNA, 50 bp, homo sapien
tgatgaacagaaggtctcatacttamactgtttccttagcaatgaattag

SEQ ID NO: 75856 - DNA, 50 bp, homo sapien
gttaaaagcacagacacagcaagacrgcctggattttaatttggcttgaa

SEQ ID NO: 75857 - DNA, 50 bp, homo sapien
taggataaggaaatacgggtgaccaytgctcttgtattccattaggtaat

SEQ ID NO: 75858 - DNA, 50 bp, homo sapien
ttcatctctgtagtccctcctttcartaagagttttagtaacaccccctg

SEQ ID NO: 75859 - DNA, 50 bp, homo sapien
ttgtgttgtttgtaaatagcttactsaaatatattttttaatttaaaggg

SEQ ID NO: 75860 - DNA, 50 bp, homo sapien
aagttgaaactaggcatatactcatstgtacaaacaaggccttaagacca

SEQ ID NO: 75861 - DNA, 50 bp, homo sapien
taattttttaaatctctgacactctyaattagtcatgagctaattctgta

SEQ ID NO: 75862 - DNA, 50 bp, homo sapien
ggatacaaattcactatggtattacrgagatcaatttattagctaccacg

SEQ ID NO: 75863 - DNA, 50 bp, homo sapien
tgctacaccagttgtctcatttattraaggtaaaaattccaggtgttctg

SEQ ID NO: 75864 - DNA, 50 bp, homo sapien
gtaaaaattccaggtgttctgaacartgcagtttatgatactcaaaatca

SEQ ID NO: 75865 - DNA, 50 bp, homo sapien
tattcccttttgatattgaaacctayaatttttgatcaattagaggctgg

SEQ ID NO: 75866 - DNA, 50 bp, homo sapien
aaagagttaaggaagcgcacccagawtaaaatgggatcccaactttttat

SEQ ID NO: 75867 - DNA, 50 bp, homo sapien
ccttcatgccactagacctagagagyacctggctataggaatgctttctt

SEQ ID NO: 75868 - DNA, 50 bp, homo sapien
actgtctagatcataaattgggaaaygacaaccagtgcatcacctctagt

SEQ ID NO: 75869 - DNA, 50 bp, homo sapien
tacaacctacattaatgaccggtaaytatcttcagggaatagagacttga

SEQ ID NO: 75870 - DNA, 50 bp, homo sapien
acagaataaacaatgaacccacttasacatattgactaaaagagtcaggt

SEQ ID NO: 75871 - DNA, 50 bp, homo sapien
attggatcccggaaattggaaaggaygagagtgtaaagaacggtgaaatc

SEQ ID NO: 75872 - DNA, 50 bp, homo sapien
ctgataaaatctgtgtgtctggaaastattttgagatatgaatctatggc

SEQ ID NO: 75873 - DNA, 50 bp, homo sapien
tactgaagaactgaaaagattttaargaactagcaggccaaaatccaagg

SEQ ID NO: 75874 - DNA, 50 bp, homo sapien
acaacaatgaatagcactgtagatgwatttttctatgaggcgtgtcatca

SEQ ID NO: 75875 - DNA, 50 bp, homo sapien
ttcttttacattcatgcgtggatacrgaatcttagcaaaagttgtttttg

SEQ ID NO: 75876 - DNA, 50 bp, homo sapien
ttttccatgaacagaaaatggtatcrccaaaggcaaagatgtaggaatga

SEQ ID NO: 75877 - DNA, 50 bp, homo sapien
cccaggtttaccctcttacctttgaygtcagaggccacatcatttatctg

SEQ ID NO: 75878 - DNA, 50 bp, homo sapien
cacagtccagggcctaccacgttctsacacaaatatgtgctaccatgaaa

SEQ ID NO: 75879 - DNA, 50 bp, homo sapien
gtagagccacaagttgaatttcataygtcctagccagctcatttcttagc

SEQ ID NO: 75880 - DNA, 50 bp, homo sapien
aaaactgactgcacagaggccttaamccaacaataattatgcagcagtct

SEQ ID NO: 75881 - DNA, 50 bp, homo sapien
atgtcatttatacttaaattccagaygagttgaaaattcaaatgcaaaaa

SEQ ID NO: 75882 - DNA, 50 bp, homo sapien
cagacagaggagacagccttgagctwacaagatgatgggtttatattggg

SEQ ID NO: 75883 - DNA, 50 bp, homo sapien
tctcatttcaattataacctcttcamatccaggaagaatatttgccactt

SEQ ID NO: 75884 - DNA, 50 bp, homo sapien
agcatgatctctgggagcagaagacsaagatgctaaatgctggccctcca

SEQ ID NO: 75885 - DNA, 50 bp, homo sapien
ctttcaccatccagagaacaagcccragaatcctgttttatagtcctgca

SEQ ID NO: 75886 - DNA, 50 bp, homo sapien
tatacacaaggtatgtcagaccagargtatgaaaatgaggcattttggcc

SEQ ID NO: 75887 - DNA, 50 bp, homo sapien
aggtactggaaaatatttgtcataaraaggagatttggacctggtaggtt

SEQ ID NO: 75888 - DNA, 50 bp, homo sapien
tttaagggcacagatttggcgacatyagagaggaaggtgtaggtgaagta

SEQ ID NO: 75889 - DNA, 50 bp, homo sapien
tcggtaggaggaagaggtggaaagtsactatctactaagtccctcctcag

SEQ ID NO: 75890 - DNA, 50 bp, homo sapien
ctgaagaccacacggacaaactttasagaagactagtaacatgattctgg

SEQ ID NO: 75891 - DNA, 50 bp, homo sapien
tctaaaaatacttttagaacttttgyataaattcactgctaatcattttt

SEQ ID NO: 75892 - DNA, 50 bp, homo sapien
ttacaagttgctgcaataaacacgaytactgatttgataacacatgcaat

SEQ ID NO: 75893 - DNA, 50 bp, homo sapien
aaacctagagccctcctattcctatkcttctacctatggaaatggtcaaa

SEQ ID NO: 75894 - DNA, 50 bp, homo sapien
accccataagtatatgcaactgttayatacccatactaattaaaaactta

SEQ ID NO: 75895 - DNA, 50 bp, homo sapien
tatcttagaagaaaaataagttcacrgcatcagcttaaaagctacaaagt

SEQ ID NO: 75896 - DNA, 50 bp, homo sapien
agcatagcaaccttggcccaagacartccagtgaatagaaaacatacttg

SEQ ID NO: 75897 - DNA, 50 bp, homo sapien
atctgtcaatggggtaggttttataygaggcatcttacagactggtgagg

SEQ ID NO: 75898 - DNA, 50 bp, homo sapien
tagtttaccaaatctcgcacatcagratatggatcacctcatggagccac

SEQ ID NO: 75899 - DNA, 50 bp, homo sapien
acttaaacaattattgatggacaagrcctatctcattagatgtgcctgtg

SEQ ID NO: 75900 - DNA, 50 bp, homo sapien
tattttaagcgcaacatatactgacracaataataaacttttccataatt

SEQ ID NO: 75901 - DNA, 50 bp, homo sapien
cttcagaatgatgtggaaacacttaygtaaatgcattttgttggacttct

SEQ ID NO: 75902 - DNA, 50 bp, homo sapien
ccattatacattaattcatggtagawataagaaacattctaattggctta

SEQ ID NO: 75903 - DNA, 50 bp, homo sapien
gaggcagtagtggtgcaggaggttargcagagattaattcaatctagtta

SEQ ID NO: 75904 - DNA, 50 bp, homo sapien
gaacatactcatagatctaggccagrattctacgtagatcaatcagagag

SEQ ID NO: 75905 - DNA, 50 bp, homo sapien
gataccttttatctctatgatccagyaacaatttcctaatattgaaatct

SEQ ID NO: 75906 - DNA, 50 bp, homo sapien
cgctgttctttctctcttctttcctyaaatgtgagtacattgagtggcac

SEQ ID NO: 75907 - DNA, 50 bp, homo sapien
aacattcagcattcctgatcataaastgagatactatccttacaagatta

SEQ ID NO: 75908 - DNA, 50 bp, homo sapien
aaaagtgctctgatttgtttttccartgaaccctctaagaacagaagcgt

SEQ ID NO: 75909 - DNA, 50 bp, homo sapien
atgattgtataccctctgctctaggycacttcatggtaccgtggatgcac

SEQ ID NO: 75910 - DNA, 50 bp, homo sapien
ttcagatctttgcccatagtgatctractccaaaagagaaactaggggtt

SEQ ID NO: 75911 - DNA, 50 bp, homo sapien
cactgaataaattacatttttatagrccaaatcatatcataaatttacta

SEQ ID NO: 75912 - DNA, 50 bp, homo sapien
gaaaataatggggcaagcctagtagsagtaataatttccagtgaataaag

SEQ ID NO: 75913 - DNA, 50 bp, homo sapien
tggacagaaaatatctgtcagcttgsaattgtatatccaacaaaaacact

SEQ ID NO: 75914 - DNA, 50 bp, homo sapien
ttcatgaaaacacaaccatctttacrtcctccaggcctctagaatgaact

SEQ ID NO: 75915 - DNA, 50 bp, homo sapien
tgcttggcaatgccactatgggtccmactcgaggctgtctctcattcctc

SEQ ID NO: 75916 - DNA, 50 bp, homo sapien
atttatatacacccattcacacacaygcgattctggtcaacaatagcata

SEQ ID NO: 75917 - DNA, 50 bp, homo sapien
aagtagctaatacacaaacctgaaakataagagagtacttcctgcaaaat

SEQ ID NO: 75918 - DNA, 50 bp, homo sapien
gaaccaaggtgtggtacatacttcargaagagttgatatggtccagtaat

SEQ ID NO: 75919 - DNA, 50 bp, homo sapien
aaaaactccaccttggcttttcacartatagtatcccctggaaactctgt

SEQ ID NO: 75920 - DNA, 50 bp, homo sapien
ttcattaatctatctgatggaagcayatactatcagatgtggtagaatca

SEQ ID NO: 75921 - DNA, 50 bp, homo sapien
ataagaagtcaattaaggtgtattayagttggtgttataatgaagctcat

SEQ ID NO: 75922 - DNA, 50 bp, homo sapien
tttaattgtattctaatgtaaactcygaagcaccaaatcatgccagtttg

SEQ ID NO: 75923 - DNA, 50 bp, homo sapien
ttgtgtcttgggtgaatgtctgtcartcaatgagaacttccacatattca

SEQ ID NO: 75924 - DNA, 50 bp, homo sapien
tcctcacctttgttttataaaatcckaaacattcttctcttttttttccg

SEQ ID NO: 75925 - DNA, 50 bp, homo sapien
agtgcaccatgctccatcctagtgamgttttccaagtaccttccttattt

SEQ ID NO: 75926 - DNA, 50 bp, homo sapien
agcaccagcaggcccaccagttggastaaaagtgacattaatagaggatg

SEQ ID NO: 75927 - DNA, 50 bp, homo sapien
tgcaagacaaaaatcatctacaaaaytattacgcaaatcattttgcataa

SEQ ID NO: 75928 - DNA, 50 bp, homo sapien
tacctgagagcctcatcatagattcmcataagttaatcaggtaatgaaaa

SEQ ID NO: 75929 - DNA, 50 bp, homo sapien
gacaggccccacctgcctggaaagayggagtggctagggtttgtggactg

SEQ ID NO: 75930 - DNA, 50 bp, homo sapien
ttccgatactgaatccactggtgaaracaaatggaataagatcaatttac

SEQ ID NO: 75931 - DNA, 50 bp, homo sapien
gcttttgtttttattgttgctttgartagtccatgtggtagaatcttttt

SEQ ID NO: 75932 - DNA, 50 bp, homo sapien
ctagaatacacttccctataattcaratttctcaaatataacacgagcta

SEQ ID NO: 75933 - DNA, 50 bp, homo sapien
tccactaacagtcagggctgtttaawgccaagaggttccaacagtaggat

SEQ ID NO: 75934 - DNA, 50 bp, homo sapien
attgcagccgacatcacaactcaaaygaaaactagctgagcaggtgggtt

SEQ ID NO: 75935 - DNA, 50 bp, homo sapien
ttatttgaatgacatcaaagtggtaygttagctacttaaaaacatattga

SEQ ID NO: 75936 - DNA, 50 bp, homo sapien
atctgttcctaaatgccattagtacygaggttgagaaataatattctaga

SEQ ID NO: 75937 - DNA, 50 bp, homo sapien
tgtgatttaagcatagtatgggttaraacatttgccatgaattggcctgt

SEQ ID NO: 75938 - DNA, 50 bp, homo sapien
gagtaactttttaaatgagagataargggtaactattaaaaagattattt

SEQ ID NO: 75939 - DNA, 50 bp, homo sapien
ctgactactcatgaaaggatacactmaatttgccaaatccatgagaacca

SEQ ID NO: 75940 - DNA, 50 bp, homo sapien
ggcaactgaatagaataaaccactgyagtaccagaccaaagccaaacaaa

SEQ ID NO: 75941 - DNA, 50 bp, homo sapien
ttgtgtgtgtattttcctgtcaaaayaaagtactgtcaaagcacaagatt

SEQ ID NO: 75942 - DNA, 50 bp, homo sapien
tttttggcagcccagaaagtaattgyaaagaagtgtaaatcttgtgcttt

SEQ ID NO: 75943 - DNA, 50 bp, homo sapien
agataggttacctgctcaacttgtawcttctttgagtcttggaaaaaaaa

SEQ ID NO: 75944 - DNA, 50 bp, homo sapien
cacttcaatacaacgctaatgtttayctctatgtctacaatatacttgga

SEQ ID NO: 75945 - DNA, 50 bp, homo sapien
ggagaagcagagataaactgttatcratgatagaccaaatgtagcctctt

SEQ ID NO: 75946 - DNA, 50 bp, homo sapien
atgctttatttcactgaacttaaacyacatattctgaaaatcacaatgca

SEQ ID NO: 75947 - DNA, 50 bp, homo sapien
ctgtaagcactgtattaaaatccaartgcctgcaggacaagcgactttgc

SEQ ID NO: 75948 - DNA, 50 bp, homo sapien
tcttctagtttattgcaaaggcttamgcacatagaaacttcatgaaaagt

SEQ ID NO: 75949 - DNA, 50 bp, homo sapien
catgaaaaatttgtgtctgaagaagsaagaaattcaaataagactgcttg

SEQ ID NO: 75950 - DNA, 50 bp, homo sapien
cctgggagtagaacccatagtctaaytccatactctttcctctgcaaact

SEQ ID NO: 75951 - DNA, 50 bp, homo sapien
ttaaaaacggttcaggtggtgaaaayaatgatgtgtatgtacttatgata

SEQ ID NO: 75952 - DNA, 50 bp, homo sapien
accaagttctgcttgttacattttamgagtgacaagcaggttttgttgtg

SEQ ID NO: 75953 - DNA, 50 bp, homo sapien
atggattgttattttgcctaagaaawttggaagttgtgtgtttgtgtttc

SEQ ID NO: 75954 - DNA, 50 bp, homo sapien
tatctataaaattggactaccttacrggctttttgtagagaccaaagttg

SEQ ID NO: 75955 - DNA, 50 bp, homo sapien
ttagaaaaatttttagaactacagayaagtaaagacaaaaaaatcttgaa

SEQ ID NO: 75956 - DNA, 50 bp, homo sapien
gtgtaaaatttgatgagtttggatayatggaaacacccatgataccatca

SEQ ID NO: 75957 - DNA, 50 bp, homo sapien
tcccctgaaatcctgttaaacctggkaaatggagagtaaggaggaattgg

SEQ ID NO: 75958 - DNA, 50 bp, homo sapien
ccagtgctgaaataccatatgtagaygatacctgaagtggctttatggtc

SEQ ID NO: 75959 - DNA, 50 bp, homo sapien
acaagaatggaagaatctgtatttcraagcagaatataaatgtcaaaata

SEQ ID NO: 75960 - DNA, 50 bp, homo sapien
tgtatctagcacaatgctagagattsaaaaacatactcaaaaaatccctg

SEQ ID NO: 75961 - DNA, 50 bp, homo sapien
attgacatttagcatacaaatgaaaycaaaaggtcaggaaatgaaaactg

SEQ ID NO: 75962 - DNA, 50 bp, homo sapien
tctagcacactggtttcacctcttcwtcattcagaatttgttcctcttct

SEQ ID NO: 75963 - DNA, 50 bp, homo sapien
gcaggagaaacactgctgtaaaaagygagttaagaaggaaaatagtctga

SEQ ID NO: 75964 - DNA, 50 bp, homo sapien
agtttcacaacaacaataatggcgartaaaagaaatcctcaggaatttat

SEQ ID NO: 75965 - DNA, 50 bp, homo sapien
cagaagggtatgtcttattaatagcraagagttgatgagcatatcaattt

SEQ ID NO: 75966 - DNA, 50 bp, homo sapien
ctctgtggagactatatattgcataygaaaggaagtcaaattgcgtaagc

SEQ ID NO: 75967 - DNA, 50 bp, homo sapien
tttattgtgaagggtccacgaagtcrccgcagggcttcagctggatgagt

SEQ ID NO: 75968 - DNA, 50 bp, homo sapien
tttcaataagaaatgataagcattcrgaatctcagagcatcacagtagtt

SEQ ID NO: 75969 - DNA, 50 bp, homo sapien
aaagaaaaacagggagctgaaataasaatgttacgtgatctcagaaacca

SEQ ID NO: 75970 - DNA, 50 bp, homo sapien
gctaagtgaaataagccagtaaaaargaggacaagtattctatgattcca

SEQ ID NO: 75971 - DNA, 50 bp, homo sapien
cataaaagatgggcttccctttcaartattttcttgtctccctacatttt

SEQ ID NO: 75972 - DNA, 50 bp, homo sapien
gctacttacctggtattttcattccwaagaagtccagttagatttcaagg

SEQ ID NO: 75973 - DNA, 50 bp, homo sapien
atctgtagcttttgagaatgcaaaakactgatcaccggttctataatctc

SEQ ID NO: 75974 - DNA, 50 bp, homo sapien
atttgcaatggttttaatatttcacrctcactgcatttgatcctcacttc

SEQ ID NO: 75975 - DNA, 50 bp, homo sapien
tgttacagatgtctcatgaatatcasatccaaaacctagtatctgatcat

SEQ ID NO: 75976 - DNA, 50 bp, homo sapien
aatacctgttaagatggaaagaaackgacttgcttacaacttagattatc

SEQ ID NO: 75977 - DNA, 50 bp, homo sapien
ctgggcatattagaaaaactaagtcmacatactctctctccaatttgtac

SEQ ID NO: 75978 - DNA, 50 bp, homo sapien
actacgctatacagcacagaggatakaaattaagccaccaaagcttccaa

SEQ ID NO: 75979 - DNA, 50 bp, homo sapien
gacttgggggtagattcgtgagacarctttggtgcttgactcttcattct

SEQ ID NO: 75980 - DNA, 50 bp, homo sapien
ctaatgtataattgcacttttcttgragacagcagccagcatggctactc

SEQ ID NO: 75981 - DNA, 50 bp, homo sapien
cagtgtgggacagatcaatatccctrcatggaactcttggaagtccaaga

SEQ ID NO: 75982 - DNA, 50 bp, homo sapien
ttcttgtttcatttcttaagatagayggagtttcatggtttgagggtccg

SEQ ID NO: 75983 - DNA, 50 bp, homo sapien
gagaacttgggtcccaatgggcggamactggagtgagatgagcctttagg

SEQ ID NO: 75984 - DNA, 50 bp, homo sapien
ggagcagcatacccacaaatcatgaycgtaggacacagcaagtgtcagga

SEQ ID NO: 75985 - DNA, 50 bp, homo sapien
acgccaaaagtgtcaggtcattacaygggttgtctgccctcaggccaggg

SEQ ID NO: 75986 - DNA, 50 bp, homo sapien
ttgtctataaaacacataaaatagartcatgaggattaaacaagaggacg

SEQ ID NO: 75987 - DNA, 50 bp, homo sapien
taaggagaaactccaagaacttacaygacaattttcagacagactatggc

SEQ ID NO: 75988 - DNA, 50 bp, homo sapien
ttgattttaagatattaaacacaagkataatgaatcaggaactataattg

SEQ ID NO: 75989 - DNA, 50 bp, homo sapien
tctcctggcttttaaatattgacagmaattcaaaaaagttctttttttgt

SEQ ID NO: 75990 - DNA, 50 bp, homo sapien
aggtggtcatctactacatggtatakgccaaaaaggggaagttagatcct

SEQ ID NO: 75991 - DNA, 50 bp, homo sapien
ggaaaataaaacttcgagggtagaakagctgtattgataaaaatttcaaa

SEQ ID NO: 75992 - DNA, 50 bp, homo sapien
tctcatatcctcctgaagcctgaaawcttttggttagcatccatgcctct

SEQ ID NO: 75993 - DNA, 50 bp, homo sapien
tgtcttccactgatgagaagataagwcaaacttgcatctacctgcagttt

SEQ ID NO: 75994 - DNA, 50 bp, homo sapien
cacctaccaatttatagattatgagrcctgatagaaaccttagagatact

SEQ ID NO: 75995 - DNA, 50 bp, homo sapien
gaatggttatgaaaacatccgggtaractgaggggcatacgcacgaagca

SEQ ID NO: 75996 - DNA, 50 bp, homo sapien
gagcagtggtctcacaccaagttttrtgggttctccctgtgttgtaactc

SEQ ID NO: 75997 - DNA, 50 bp, homo sapien
aatgtgagtctcccatgcataaagargagagaatagtccttccatttccc

SEQ ID NO: 75998 - DNA, 50 bp, homo sapien
ctcaggcagccttcccctcttcctawcaaagcatccaatctgctttattt

SEQ ID NO: 75999 - DNA, 50 bp, homo sapien
cgctgtatcaagctaccactcgtttwaaaaagctagaatgtaaactttaa

SEQ ID NO: 76000 - DNA, 50 bp, homo sapien
atgtttttatgaacattctcgtataygtctcctggtacatatgagttccc

SEQ ID NO: 76001 - DNA, 50 bp, homo sapien
aatgttggacacgttaaatttggacraagccatctgactttttgaaaagc

SEQ ID NO: 76002 - DNA, 50 bp, homo sapien
ataccaaaagccataggctagccagyaagctatgatgtggtctggcttaa

SEQ ID NO: 76003 - DNA, 50 bp, homo sapien
tcgaggtaaaaatgtgtgtatactaygcgactatttaaggaagaagggct

SEQ ID NO: 76004 - DNA, 50 bp, homo sapien
aaggtagagattgcctgtatgagtasaagattccttcctgttcagagggt

SEQ ID NO: 76005 - DNA, 50 bp, homo sapien
acgagagagagagaagagaacttgargagacaataaaggacacaatttgc

SEQ ID NO: 76006 - DNA, 50 bp, homo sapien
taactattctttcttttattgcaatkaatcttctcattctaacaaaagaa

SEQ ID NO: 76007 - DNA, 50 bp, homo sapien
tggaaaaactttaaaatagaagaaarctgacgtggaatcaatcaaaactc

SEQ ID NO: 76008 - DNA, 50 bp, homo sapien
agattttccatttacctataaaaacractattctaataaaaatgtttcca

SEQ ID NO: 76009 - DNA, 50 bp, homo sapien
atatttattatattcttaatgtatayatgattcatagcagtaacctctct

SEQ ID NO: 76010 - DNA, 50 bp, homo sapien
agttctctacaaattaatctgtaaayccaatgtaattgcgatttatgagg

SEQ ID NO: 76011 - DNA, 50 bp, homo sapien
tttgtggtagccagctgccttgactsaatttcctcttctgaaactcactt

SEQ ID NO: 76012 - DNA, 50 bp, homo sapien
tttttattaccttcagtttggataaytgtccaagatctttagctgcaatg

SEQ ID NO: 76013 - DNA, 50 bp, homo sapien
ccctgtaatctacagttaccttttayaatgtctccattagcccctgtcta

SEQ ID NO: 76014 - DNA, 50 bp, homo sapien
tttaatgtggtgggacaggtgtaacmagcattgccatatgctctaattct

SEQ ID NO: 76015 - DNA, 50 bp, homo sapien
tcccatcatctgccttgtcgccataygcttggactttgtattggccagct

SEQ ID NO: 76016 - DNA, 50 bp, homo sapien
gtttggtcagtctgtgaaatgataaraataactcgtgatggtttagtata

SEQ ID NO: 76017 - DNA, 50 bp, homo sapien
acacacttgctatagatatcctcacrgtactcattctccttaagtgagat

SEQ ID NO: 76018 - DNA, 50 bp, homo sapien
aaattagttctggagactggcaacaytgagcttttgtctctacaaagtga

SEQ ID NO: 76019 - DNA, 50 bp, homo sapien
ccaagacattcatgagagaagacacrctctttggatagtatgcttctaat

SEQ ID NO: 76020 - DNA, 50 bp, homo sapien
cttctccaaaacattatgaaggatargattccaccatgatatagcttaag

SEQ ID NO: 76021 - DNA, 50 bp, homo sapien
ggcattaattttctcagagtcaaccrctaatgaaggacatagctaggact

SEQ ID NO: 76022 - DNA, 50 bp, homo sapien
ctatggcatctctcttccaatcctcyaggttctcataagcccaacttctt

SEQ ID NO: 76023 - DNA, 50 bp, homo sapien
gcttcaacatgttttctcagaggttrttaataccagctgggcagcacctc

SEQ ID NO: 76024 - DNA, 50 bp, homo sapien
tagcatcagaatacacactaagatasctgcctaggccatgaggaccccaa

SEQ ID NO: 76025 - DNA, 50 bp, homo sapien
tcaagcttaataaaagcatttttgargtgacaaacaaaataaccacttgc

SEQ ID NO: 76026 - DNA, 50 bp, homo sapien
ttgacgctatagctgggcataagacmttgggagaaagatccactcatgtt

SEQ ID NO: 76027 - DNA, 50 bp, homo sapien
tgcaaccatcctgggccccggcaccraatgccaggaacaacctcaaacat

SEQ ID NO: 76028 - DNA, 50 bp, homo sapien
tgggtgaacttcaactaatacaaaasaagagacaagagaaaggtaggcag

SEQ ID NO: 76029 - DNA, 50 bp, homo sapien
aaaatttaaaagggtacaagatcaayggtgtctcctaggatgttactgag

SEQ ID NO: 76030 - DNA, 50 bp, homo sapien
ttataaaaaaacaaaaataacaacaygcaaaaaatatggagttgagtcat

SEQ ID NO: 76031 - DNA, 50 bp, homo sapien
gatgcatagattgtgactgatttagraagtaccagaaagatcctctattc

SEQ ID NO: 76032 - DNA, 50 bp, homo sapien
tcctaaacatttacttaagctagaaygaaaacaaaggggagataagccaa

SEQ ID NO: 76033 - DNA, 50 bp, homo sapien
aaagaatggacactgctgatatagaygaactagggacaccttctcatcac

SEQ ID NO: 76034 - DNA, 50 bp, homo sapien
tagaacttatagtcacttggggaaaygggtattaatcaaatgattgctcc

SEQ ID NO: 76035 - DNA, 50 bp, homo sapien
ctgtaatcctagcaatttgcgaagcygaggaaggcagatcacttgaggtc

SEQ ID NO: 76036 - DNA, 50 bp, homo sapien
atgaacctctctgcatcttctgtgamctcatgggtgtggactatgaggag

SEQ ID NO: 76037 - DNA, 50 bp, homo sapien
taacatttaggatttataagtttccrcatcacaaaactctccttgctctt

SEQ ID NO: 76038 - DNA, 50 bp, homo sapien
ttgagagtgggttgaagagctatccyatacatcatttcccaaactaatga

SEQ ID NO: 76039 - DNA, 50 bp, homo sapien
agccaccgagcctggcctgatcacgraccttaatatgctaacatacgttg

SEQ ID NO: 76040 - DNA, 50 bp, homo sapien
tctgcatgtatcatgattgatggcastctacccaagagattggcagtttt

SEQ ID NO: 76041 - DNA, 50 bp, homo sapien
gtctctttttgggctacttcaaagcratgtatggataagaaatcatttgt

SEQ ID NO: 76042 - DNA, 50 bp, homo sapien
ccctcttcccacagttctccatctcrtcccttggtcttaaccttggaagt

SEQ ID NO: 76043 - DNA, 50 bp, homo sapien
gagtccatgagtgggatttcccttaygatatggagtctcagccttctcag

SEQ ID NO: 76044 - DNA, 50 bp, homo sapien
caacacatagctttcaccctgtgttwgacagcccaggaaactgtgccccc

SEQ ID NO: 76045 - DNA, 50 bp, homo sapien
aagtctgaaagacagaggccattgcyatgttcagcttggatgaagggagg

SEQ ID NO: 76046 - DNA, 50 bp, homo sapien
atggcaatcagatagatgcggctacygtgggataagaaacagtagaagat

SEQ ID NO: 76047 - DNA, 50 bp, homo sapien
ttatgtgctaggctgctggccatcaygctagaagacaggaaaagcattag

SEQ ID NO: 76048 - DNA, 50 bp, homo sapien
actctgcactttctcctcttccactwacaaactgtttataaacaagccag

SEQ ID NO: 76049 - DNA, 50 bp, homo sapien
gtaatagagggaaaatttggctttcrgaaaatggctgacctatctagagt

SEQ ID NO: 76050 - DNA, 50 bp, homo sapien
gccctggtggcaattttcttgcttayagaaccacctaaaagatactccct

SEQ ID NO: 76051 - DNA, 50 bp, homo sapien
gaacaagaacacaccaaggacctcartctaaatgatctctcttgcttagg

SEQ ID NO: 76052 - DNA, 50 bp, homo sapien
ttgtctctttttattatctccaacakaaggaacttgctgtttaggtttac

SEQ ID NO: 76053 - DNA, 50 bp, homo sapien
tcatattgtaagtgtcagagacagawtcaaagactaattttttggggggt

SEQ ID NO: 76054 - DNA, 50 bp, homo sapien
caataaatatttattgaatgagaacyataaatgaataagtgatagctaat

SEQ ID NO: 76055 - DNA, 50 bp, homo sapien
ggaatgcagaaggagcatgtgttccractggggatcagagaagacttgat

SEQ ID NO: 76056 - DNA, 50 bp, homo sapien
ggaatgacattattggcagacactaraggacttaagggagagcggcattt

SEQ ID NO: 76057 - DNA, 50 bp, homo sapien
aacaaatgggtttgggaacaagctgrctcttggtaagcacataattcagc

SEQ ID NO: 76058 - DNA, 50 bp, homo sapien
aattccattcttaatgtatgaaatarcacttggattccctctggttcttt

SEQ ID NO: 76059 - DNA, 50 bp, homo sapien
ttagtatgtattatagaactcaacaytaaatggcttaccattgtctggat

SEQ ID NO: 76060 - DNA, 50 bp, homo sapien
tctgatgaagtgtgaaatataattgytaaatatggttttgaaaatcaaaa

SEQ ID NO: 76061 - DNA, 50 bp, homo sapien
tcattccaaccaggatacatcttcamctgcagatatagggaacatcaatg

SEQ ID NO: 76062 - DNA, 50 bp, homo sapien
gcatttttacaaaaatgtgttgttaygaagtttgatgattaagaagatca

SEQ ID NO: 76063 - DNA, 50 bp, homo sapien
tttatccaaataacaatgcagaaackacacaaagattcccatccctgccc

SEQ ID NO: 76064 - DNA, 50 bp, homo sapien
aaataaaaaggtaatctgagagatcragaatcttaccttgagatatcaag

SEQ ID NO: 76065 - DNA, 50 bp, homo sapien
tattttgccaaggttaaagacattaycgtgacacagcctcaggaggtcct

SEQ ID NO: 76066 - DNA, 50 bp, homo sapien
tcatttcttgggccctctgactgagycggttgtctattctcagaagaggc

SEQ ID NO: 76067 - DNA, 50 bp, homo sapien
cagtttggttgatgaactggatcttkaactggtaatgataaactagagag

SEQ ID NO: 76068 - DNA, 50 bp, homo sapien
cactgaaaagttaaccttggcaataraagaccaaatagaagccggctgac

SEQ ID NO: 76069 - DNA, 50 bp, homo sapien
gccactggccagatgaggcaaatcayattacttggtgtcagtttccaatt

SEQ ID NO: 76070 - DNA, 50 bp, homo sapien
ataaaataggtgacattttatgatawccatgatgttgacaagttttacaa

SEQ ID NO: 76071 - DNA, 50 bp, homo sapien
tgaaaatgcccttacagttgagatayaaacgagggaagaggtgaagcttt

SEQ ID NO: 76072 - DNA, 50 bp, homo sapien
ttacctcaattccagaattagtgacyaaggttgataattacagtgaaaag

SEQ ID NO: 76073 - DNA, 50 bp, homo sapien
aatactgctatcaattgccttaaaayaatgaatgcctactaactatgatc

SEQ ID NO: 76074 - DNA, 50 bp, homo sapien
tgtttttgccttgtaagtctgtgtawcaacaaaacataaactattaaaca

SEQ ID NO: 76075 - DNA, 50 bp, homo sapien
gcatgacttgtatcttgtaccaaagmcaaatgattcagcagcccattgta

SEQ ID NO: 76076 - DNA, 50 bp, homo sapien
ccccttagctggtaaagctgtaagaktataccctaagtggagggacctct

SEQ ID NO: 76077 - DNA, 50 bp, homo sapien
cttgcttcatatcccactttggctascaatacgttaatgcacctgggcaa

SEQ ID NO: 76078 - DNA, 50 bp, homo sapien
taacttccattctggttatctggcaygtaactcatctccccatggagatt

SEQ ID NO: 76079 - DNA, 50 bp, homo sapien
tgaccagtgcctgtttttagcaacayggctagtaaatattgactctgtgg

SEQ ID NO: 76080 - DNA, 50 bp, homo sapien
atttattcattggaattacactgtcrgaagagctgtttcttctcccttct

SEQ ID NO: 76081 - DNA, 50 bp, homo sapien
ttggagaataggaaatctttggaaayattagtcagttccctagaatattt

SEQ ID NO: 76082 - DNA, 50 bp, homo sapien
cgccttttttccctcaaatcttaaaycttcttcacgcaatgcaggcctca

SEQ ID NO: 76083 - DNA, 50 bp, homo sapien
gacaagactgttgcttgctctgctcragatttttgtttttaatctcatgc

SEQ ID NO: 76084 - DNA, 50 bp, homo sapien
aatctttcatgcaaaagcaagaatcsactcttcaaagtgcagcatttagc

SEQ ID NO: 76085 - DNA, 50 bp, homo sapien
cagtaacgtgtacctgggaactagakgtaaagacacgggagaaagggctg

SEQ ID NO: 76086 - DNA, 50 bp, homo sapien
ccatggattagagattaggttggaamaggcttcagaattgggaaactccc

SEQ ID NO: 76087 - DNA, 50 bp, homo sapien
gtccagttgctatgaaaagcaatacrgaggtacctcaaaaaattaaaaat

SEQ ID NO: 76088 - DNA, 50 bp, homo sapien
gaatttccacatgctgggtacaaggratggatagtcaagtggctagttac

SEQ ID NO: 76089 - DNA, 50 bp, homo sapien
tcttcactgccaatgcattcagatayacatgaagatttccatcttgtcat

SEQ ID NO: 76090 - DNA, 50 bp, homo sapien
atgatagtggcctttatgtggttatkaggcacaaaactgaaacaactgga

SEQ ID NO: 76091 - DNA, 50 bp, homo sapien
ataaaagatataaaagaagtgaaacrggataaaatgagtagatcactcat

SEQ ID NO: 76092 - DNA, 50 bp, homo sapien
caaaactgaaacaactggagcgatcraagtttccactgaggagctgtttt

SEQ ID NO: 76093 - DNA, 50 bp, homo sapien
acacgtttggcatgtttacatttatrtgaaattcaataagaggcaaaact

SEQ ID NO: 76094 - DNA, 50 bp, homo sapien
tgttgcaggatagagacacttgtacracccaagaaacacagtactcagtg

SEQ ID NO: 76095 - DNA, 50 bp, homo sapien
gaatatgcaaacgtatttaggctctsaatttccactaccctgtgttgcag

SEQ ID NO: 76096 - DNA, 50 bp, homo sapien
ttaaggaaaaaacacgttagaagaamatgcacttaaataaattgctctgt

SEQ ID NO: 76097 - DNA, 50 bp, homo sapien
atactatgcctttttatataaggaamttgaacatctgaggattttggtat

SEQ ID NO: 76098 - DNA, 50 bp, homo sapien
catattccataggtttaggatttcascttctcatatgggcctactttttt

SEQ ID NO: 76099 - DNA, 50 bp, homo sapien
tgacttgtatcttgtaccaaacccaratgagttatcagtcctcctcaaca

SEQ ID NO: 76100 - DNA, 50 bp, homo sapien
atgataagtattatttgtcaaaaacsaacaccaaatattaccaatggtga

SEQ ID NO: 76101 - DNA, 50 bp, homo sapien
caatgcagatttactatgaagcgtckactccatgacaagcactatgtata

SEQ ID NO: 76102 - DNA, 50 bp, homo sapien
attctctgtgacgataaattccttamggtaggacagtatataaggtctaa

SEQ ID NO: 76103 - DNA, 50 bp, homo sapien
ggatcaagcattaaggctgctaaaaygtactcattgtgtaatttgggaat

SEQ ID NO: 76104 - DNA, 50 bp, homo sapien
gagccacaatgcacagacactatcaygatgctccggtgaagatgggtgat

SEQ ID NO: 76105 - DNA, 50 bp, homo sapien
gtcctctttaaatggtgtactttcaratagagatatgggttcctttgttt

SEQ ID NO: 76106 - DNA, 50 bp, homo sapien
tctctacaatagaagattctaaaaartgattttgtcaccagaaacccaca

SEQ ID NO: 76107 - DNA, 50 bp, homo sapien
gaaagcacccatgtatatcttccacrtgatagttatggcttaaaaaaaat

SEQ ID NO: 76108 - DNA, 50 bp, homo sapien
tcaaaagaacctaacgtaatttttayaccatcctcaaatacattttagga

SEQ ID NO: 76109 - DNA, 50 bp, homo sapien
ttaaagggtaactgatgatatgacasaatgtatgtattccctgtgcattt

SEQ ID NO: 76110 - DNA, 50 bp, homo sapien
ccaaggactctgtctttgaccacagsctggcacaggagttaaattcaagc

SEQ ID NO: 76111 - DNA, 50 bp, homo sapien
ggtttttctgcttagaaaagtaatasatgctggttgtaaaaaattcaaac

SEQ ID NO: 76112 - DNA, 50 bp, homo sapien
taaggatactgcctgaaatgtcatcrataaaaatgtgttgggcagcagaa

SEQ ID NO: 76113 - DNA, 50 bp, homo sapien
atgtgaagaccaatggtaactctgartatcacacaaactttgtatttcag

SEQ ID NO: 76114 - DNA, 50 bp, homo sapien
gaaagctgtaactccagacaagatarcgaagcttgttgggacccatcagc

SEQ ID NO: 76115 - DNA, 50 bp, homo sapien
tacttaaaaacataccaactttcackgaaaagaacaaagtcttgagccag

SEQ ID NO: 76116 - DNA, 50 bp, homo sapien
tctcaggtaataataacaagaccatmatgataacccagaggtggttgtaa

SEQ ID NO: 76117 - DNA, 50 bp, homo sapien
tttaccaattcctgggtcaggctgcrtgaatcactttcaagaccttgtat

SEQ ID NO: 76118 - DNA, 50 bp, homo sapien
tatggctttctccaccggtcagttayctctcattagtactacacactaaa

SEQ ID NO: 76119 - DNA, 50 bp, homo sapien
caaaataatgcagaagggagaaagtwaacagaggcataggggaaaataag

SEQ ID NO: 76120 - DNA, 50 bp, homo sapien
ttagattggtaagctgagcaattcartacaccaataggccaatgtgtgtg

SEQ ID NO: 76121 - DNA, 50 bp, homo sapien
tggtaggaatgtaagatggtataacsgatttggaaaacagtttggcagtt

SEQ ID NO: 76122 - DNA, 50 bp, homo sapien
cttactggtatctggatttaaacagsatataatagagaaaaatctacaga

SEQ ID NO: 76123 - DNA, 50 bp, homo sapien
aaggactaaatgtcaaagaaaacacygcgcaactactactttttaatgaa

SEQ ID NO: 76124 - DNA, 50 bp, homo sapien
caatggcttctcctttatgaatcttwctttaatttctcccccagctgctc

SEQ ID NO: 76125 - DNA, 50 bp, homo sapien
ggaggacttttcacttgctatgttasatatttctctaatgtttgaatttt

SEQ ID NO: 76126 - DNA, 50 bp, homo sapien
caatgtatattatgggtgatggagayactaaaagttcagacttcaccact

SEQ ID NO: 76127 - DNA, 50 bp, homo sapien
tactgtggtaggatggtgggacccayggcaaagcttttctttattcataa

SEQ ID NO: 76128 - DNA, 50 bp, homo sapien
tacattgtacccattaataaatttcytatcatttacacctacttctcacc

SEQ ID NO: 76129 - DNA, 50 bp, homo sapien
ttagacaattacttgtgaaaaactayctaaaaatctgtcaagtgaaccat

SEQ ID NO: 76130 - DNA, 50 bp, homo sapien
agcaggtatgtttttcctctttgctstgttatttatttatctaccatctg

SEQ ID NO: 76131 - DNA, 50 bp, homo sapien
aatgaaactcctaataaatctaagcmcattaaaccactcaaggtgacttg

SEQ ID NO: 76132 - DNA, 50 bp, homo sapien
caaacttctgcagtaaacatcaaccrcattttacaaatgaagaaactgag

SEQ ID NO: 76133 - DNA, 50 bp, homo sapien
cagctgtgaacttcaataaatttacmactttgtcctggacataaggtata

SEQ ID NO: 76134 - DNA, 50 bp, homo sapien
cctacaggaaaggggcttggtaatcyacaggagaaaaagaggtcgaagga

SEQ ID NO: 76135 - DNA, 50 bp, homo sapien
acgaatctaaccaagccatgattgasaaatatggtctaaacaaagagtaa

SEQ ID NO: 76136 - DNA, 50 bp, homo sapien
aagagagaaccaacacacatccaagstcccacagttatccatgaccaagc

SEQ ID NO: 76137 - DNA, 50 bp, homo sapien
ttgagcctgcaggtgacggggcacastatggtcatctggggatcattata

SEQ ID NO: 76138 - DNA, 50 bp, homo sapien
acagttatccatgaccaagctgacamtgaaatgaaatctactctgatgcc

SEQ ID NO: 76139 - DNA, 50 bp, homo sapien
cccaagccattgggttggtattcgtyacacatataaacacaagggggtgg

SEQ ID NO: 76140 - DNA, 50 bp, homo sapien
ttcaaagaggcttgcatattccacaygaattgcttctaagtcaaactaca

SEQ ID NO: 76141 - DNA, 50 bp, homo sapien
tagaatttagactcctcaggtgacasaaaaccttacaggaggttgaatga

SEQ ID NO: 76142 - DNA, 50 bp, homo sapien
agtctaaattctaagtatggcattcraggccttttacaatctggtcttaa

SEQ ID NO: 76143 - DNA, 50 bp, homo sapien
cttaatctttccactgctcttttcakgacttctcccatgcaggcagtgtt

SEQ ID NO: 76144 - DNA, 50 bp, homo sapien
ttgtaaacaatttaaaaaatgactcwctttcctgcctttttataagctgt

SEQ ID NO: 76145 - DNA, 50 bp, homo sapien
acacacattcgtttctatggaaaaaytggaagatgatatatataggtata

SEQ ID NO: 76146 - DNA, 50 bp, homo sapien
gatataactgcaagtcaattccaaastttacactggttttctacagctcc

SEQ ID NO: 76147 - DNA, 50 bp, homo sapien
cattccaaataggggatggtatcttsaaagtcatcctattgacattaaag

SEQ ID NO: 76148 - DNA, 50 bp, homo sapien
agctaagctaagctataatgaacaaygctagagaaccagaggactctaat

SEQ ID NO: 76149 - DNA, 50 bp, homo sapien
ttaagaaaatctggctaacaatcatwaattgaagactttagatcaataag

SEQ ID NO: 76150 - DNA, 50 bp, homo sapien
tcagagatccctggattcaagcctaygcctatgatgcatgcaaggtggcc

SEQ ID NO: 76151 - DNA, 50 bp, homo sapien
aactaatttttaccttttgacattcscataaaagaataagaaaaatataa

SEQ ID NO: 76152 - DNA, 50 bp, homo sapien
cccagtcaaggggaactgttttcacygctaagatgataagaaatcacaac

SEQ ID NO: 76153 - DNA, 50 bp, homo sapien
gggtaagatcttgggacgactcttaygttagaaccttggtaggaaattta

SEQ ID NO: 76154 - DNA, 50 bp, homo sapien
aatctggcagagagacagaatgagcsagggcctagaggaaaatttctaga

SEQ ID NO: 76155 - DNA, 50 bp, homo sapien
ggtcaaatatacaggaaacggattaygaaatgttatcaattacgtccacc

SEQ ID NO: 76156 - DNA, 50 bp, homo sapien
atatttttcatgagtaggattaacgyatgttttcttccaacttttaccca

SEQ ID NO: 76157 - DNA, 50 bp, homo sapien
tatgaaaaggctgtgaagctgaagaraaactaagaaatggatattgctgc

SEQ ID NO: 76158 - DNA, 50 bp, homo sapien
tatgaatgttgttgctgcccagagasagaagtccaggcttagttgcttga

SEQ ID NO: 76159 - DNA, 50 bp, homo sapien
acaaaaggagatatgattgtccttcragtggaatcaactgagaccaagga

SEQ ID NO: 76160 - DNA, 50 bp, homo sapien
taaatgaattatttcatataacacartccatatgacaaacaggaaggaca

SEQ ID NO: 76161 - DNA, 50 bp, homo sapien
aaagctgctctgctggaatccacaakgagtagtaatggtgacgaagaggg

SEQ ID NO: 76162 - DNA, 50 bp, homo sapien
agctcaaaattgtcatgaaacaaacragaccttcctttctttccactcta

SEQ ID NO: 76163 - DNA, 50 bp, homo sapien
tgttagttgggttttctcttgcttgmaactgaacatgtccttactaatac

SEQ ID NO: 76164 - DNA, 50 bp, homo sapien
ctagtaatttattttcatggttatargtttctgtaatatttgcaaaagtt

SEQ ID NO: 76165 - DNA, 50 bp, homo sapien
tcttcagaattgcagtgtgactgaayggtactgtgaaacactgccttttg

SEQ ID NO: 76166 - DNA, 50 bp, homo sapien
gcagaaagggaaaactcacacaaaaytactgcttcatcaactgtagcttt

SEQ ID NO: 76167 - DNA, 50 bp, homo sapien
tgatgataccacaatatacatcaaayggtttcaaaataacttcagtgtta

SEQ ID NO: 76168 - DNA, 50 bp, homo sapien
aatggtactaggcacggaacgggcargaaatcaaaagtcatcaaggaaag

SEQ ID NO: 76169 - DNA, 50 bp, homo sapien
ctacaacttccatgtttacaatagamtcctgagatacttcagaccttcac

SEQ ID NO: 76170 - DNA, 50 bp, homo sapien
gagctcatatttataaagcactaacrataggccaggcattatcttaacca

SEQ ID NO: 76171 - DNA, 50 bp, homo sapien
tcagtgaatgtacaaaatcaatacayacagatttcagcacatcccatgaa

SEQ ID NO: 76172 - DNA, 50 bp, homo sapien
cttaaagggctgaccatctgatgtayaggaaatggaaactactctctgaa

SEQ ID NO: 76173 - DNA, 50 bp, homo sapien
gcatatttaaggggactagaagacaractcacacaattgcctccctcttt

SEQ ID NO: 76174 - DNA, 50 bp, homo sapien
gcccaaacataatacctatgaataartaactttcaaacccttgtacattt

SEQ ID NO: 76175 - DNA, 50 bp, homo sapien
cggagaacacactctgctgtgagtcyaagcagtacccttcctcagtaatt

SEQ ID NO: 76176 - DNA, 50 bp, homo sapien
tgagtccaagcagtacccttcctcartaattctcaaataggcctctgaag

SEQ ID NO: 76177 - DNA, 50 bp, homo sapien
atcaacaaccttgtgggttagaacarctggcaaaagaggtagtacagatg

SEQ ID NO: 76178 - DNA, 50 bp, homo sapien
ctataggatagggtttgtggttaaakgtgaagatgtggttgaacattgtt

SEQ ID NO: 76179 - DNA, 50 bp, homo sapien
attctatcataaaaatcattatatamaacgcaacgggaagtacttttcag

SEQ ID NO: 76180 - DNA, 50 bp, homo sapien
ggctgataaagtttgggaaataggartaacaaattgtgggaaagtgatga

SEQ ID NO: 76181 - DNA, 50 bp, homo sapien
cttgtgttgtcctgtttcatgctcaygttgacttgttttcattacccact

SEQ ID NO: 76182 - DNA, 50 bp, homo sapien
ttaacatgtgttgaatatattcccasatcaagcagatttagctctttctt

SEQ ID NO: 76183 - DNA, 50 bp, homo sapien
cacttacatgatatggaatcctcaaygaaagttcagcagagagaattttt

SEQ ID NO: 76184 - DNA, 50 bp, homo sapien
ctgatagtccataggatgcaactgargaaattctgtctggggcagctttc

SEQ ID NO: 76185 - DNA, 50 bp, homo sapien
acctaccatctaatgctctttctacrcacccttgcatttgtttatttcct

SEQ ID NO: 76186 - DNA, 50 bp, homo sapien
ttctccaaaaatttcagcaaaagacraattgagtatcctggactctaact

SEQ ID NO: 76187 - DNA, 50 bp, homo sapien
aataatgggacataaattcccttccyacatacattacaaagatagctaaa

SEQ ID NO: 76188 - DNA, 50 bp, homo sapien
tgcgctattctgtaaatattcagtcyattgatgaagagctctgcaaacag

SEQ ID NO: 76189 - DNA, 50 bp, homo sapien
ctgagtatattaagaaaactctcaargctaagccagccatattaattaga

SEQ ID NO: 76190 - DNA, 50 bp, homo sapien
cctagaatcactttcatctcatgtcycagaaaagctgtctctcaatctac

SEQ ID NO: 76191 - DNA, 50 bp, homo sapien
cgtggcagctggttttcttcaggacragcaagacagcaagagggagcaag

SEQ ID NO: 76192 - DNA, 50 bp, homo sapien
tcccaagcccagtggaagagttaccsagagttctcagagttttcggcttc

SEQ ID NO: 76193 - DNA, 50 bp, homo sapien
tgtgtgggaaaggagctcatatacamagggtgtttcctggaactgtgggc

SEQ ID NO: 76194 - DNA, 50 bp, homo sapien
tcagtcattattttttgtccctttcrctctacttttgaaatcaatggatg

SEQ ID NO: 76195 - DNA, 50 bp, homo sapien
cagtaccacgctgtttttgttactaygacttatgtctatggccataccac

SEQ ID NO: 76196 - DNA, 50 bp, homo sapien
cttaagaacaaatactatgccactaygtcatctttacttttgtataacca

SEQ ID NO: 76197 - DNA, 50 bp, homo sapien
cagtatgttcaaatatcctgactcayaaaagttcatgtcatgtttagaaa

SEQ ID NO: 76198 - DNA, 50 bp, homo sapien
atcccataccattacctgaccatttwaaaaatctttatcctgtaggtgag

SEQ ID NO: 76199 - DNA, 50 bp, homo sapien
atatatatatagtctcacgatatgasgatacagggagaaggaggctgtct

SEQ ID NO: 76200 - DNA, 50 bp, homo sapien
tggtggcagcaggatgattgcgacastcagttccatgtgcccacgaccac

SEQ ID NO: 76201 - DNA, 50 bp, homo sapien
cacgaccaccttcccctttgtgagasgcttattggctaatagaaacctgc

SEQ ID NO: 76202 - DNA, 50 bp, homo sapien
aagtgcagacattcttctggctaaakctaaatctaagctgggagggcatg

SEQ ID NO: 76203 - DNA, 50 bp, homo sapien
tgaagcttggcatttgcaaaggagamattactgttagctttactaaaaat

SEQ ID NO: 76204 - DNA, 50 bp, homo sapien
gtccagataaagatgaacagatttargcaacatcaaatttttagtaaagc

SEQ ID NO: 76205 - DNA, 50 bp, homo sapien
tgttttaaaatactccagaaaaaaaytgtgggagtaagtgagacaagaac

SEQ ID NO: 76206 - DNA, 50 bp, homo sapien
tttgtggccttatgaatgtctttcartctgaccagagctgcaactccttc

SEQ ID NO: 76207 - DNA, 50 bp, homo sapien
aaaaaaaaaaaagttagaaatactcrcctaagatttttttgaaaataact

SEQ ID NO: 76208 - DNA, 50 bp, homo sapien
ctcgttcctctaacagcaacacatasatattggtgcctcatcaaacatgt

SEQ ID NO: 76209 - DNA, 50 bp, homo sapien
aagaatattaaactcctccactgaamtatgggactcactgggaaccttcg

SEQ ID NO: 76210 - DNA, 50 bp, homo sapien
agaacatagagatcatctggtctaamgccttgaatttacaaaagacctgt

SEQ ID NO: 76211 - DNA, 50 bp, homo sapien
agctaattttactaatccaaaaaaamataacatgaaaataataggagtga

SEQ ID NO: 76212 - DNA, 50 bp, homo sapien
ggatcccttggaggagtattcctacyggtttggatattgggactctcctg

SEQ ID NO: 76213 - DNA, 50 bp, homo sapien
gttccaaccacaatttcttttcaggrcattttacttttcaaataaaagat

SEQ ID NO: 76214 - DNA, 50 bp, homo sapien
aaaagcagctcaatctgcttctaacsagtccaagccagttccaacatcaa

SEQ ID NO: 76215 - DNA, 50 bp, homo sapien
atttactggtaccctgcattgtgctsaaaccccatgtcgatcatgagtaa

SEQ ID NO: 76216 - DNA, 50 bp, homo sapien
tttacagcaccacagtgaaatttctsaacttatgaaccagtcagtcatct

SEQ ID NO: 76217 - DNA, 50 bp, homo sapien
aaagaaggaaaatgggaagacaagtmggactgaaatcaatggaaaagtgg

SEQ ID NO: 76218 - DNA, 50 bp, homo sapien
agcagtcctctggagtctacagaacygagagtggggaagagggccaatgg

SEQ ID NO: 76219 - DNA, 50 bp, homo sapien
tatgaagtccactgcttagtaaacaytggcttagattagtatgtttgagt

SEQ ID NO: 76220 - DNA, 50 bp, homo sapien
gctctgatccttagtcctagggctaygaagtccactgcttagtaaacatt

SEQ ID NO: 76221 - DNA, 50 bp, homo sapien
aggaaaccacagctcctgcaaatgamtcagtaggtggttccgacttctct

SEQ ID NO: 76222 - DNA, 50 bp, homo sapien
tgtactgttttccaaatccttgtaawtattgctatggtgaaaaatgcaaa

SEQ ID NO: 76223 - DNA, 50 bp, homo sapien
tgtttagctgcagtgccaagttgagrcaatggcttaacatggctccctga

SEQ ID NO: 76224 - DNA, 50 bp, homo sapien
tagacatttcatataaatggaataaygacgtgtggtctatcgggtgtggc

SEQ ID NO: 76225 - DNA, 50 bp, homo sapien
cgagtccaagccagttccaacatcartcatctcaggatgtaaactggttc

SEQ ID NO: 76226 - DNA, 50 bp, homo sapien
agtaagaacttccggacaggacagaygtaagattgagcctctgccccaga

SEQ ID NO: 76227 - DNA, 50 bp, homo sapien
gtgtttttcattcaggaatccaggcraaaaagctgtggctacctcagtgt

SEQ ID NO: 76228 - DNA, 50 bp, homo sapien
agaagaatcatggttactccaactcrccttgtccacagagagctcatgtg

SEQ ID NO: 76229 - DNA, 50 bp, homo sapien
agttttcccacctagactcaaaaaayactactcgttagaaacaaagaaga

SEQ ID NO: 76230 - DNA, 50 bp, homo sapien
aggatttcctctccaatgtataaaaygttggattccaagcatcttaaaca

SEQ ID NO: 76231 - DNA, 50 bp, homo sapien
atcatatgcacattaaacattcttakattctgcagattgacaacttttct

SEQ ID NO: 76232 - DNA, 50 bp, homo sapien
tgactaacattagaagagtctcctayagatgttttgaaccactcaggact

SEQ ID NO: 76233 - DNA, 50 bp, homo sapien
gggctcccaagtttctggagtcaaaratggcaaagacgattatgaggagt

SEQ ID NO: 76234 - DNA, 50 bp, homo sapien
tggtaccgcaagctcctaaacacaaraatgggagaaggtggatcttaatt

SEQ ID NO: 76235 - DNA, 50 bp, homo sapien
ttggctccagagactgttatcttaayaccacactatcctgctaagctact

SEQ ID NO: 76236 - DNA, 50 bp, homo sapien
cttgctattgtgacagcttaactaayagagagcaaaagggcagctcttac

SEQ ID NO: 76237 - DNA, 50 bp, homo sapien
accaacatgcacaattatagtcacasatcagagttacacaggattacaaa

SEQ ID NO: 76238 - DNA, 50 bp, homo sapien
gaatgtctgatgtctaaaacactacrcgagacagtagaaaaagaacttgc

SEQ ID NO: 76239 - DNA, 50 bp, homo sapien
taaaatcatcataaaagtcggcaaasctttcggaaagtttagtagacctg

SEQ ID NO: 76240 - DNA, 50 bp, homo sapien
tcatgccagctcagtgatgcaagtarctcagatgtaatcttcccatttta

SEQ ID NO: 76241 - DNA, 50 bp, homo sapien
ggggcaagtggagtttctaaaggaawacaggagttaccatctccattcca

SEQ ID NO: 76242 - DNA, 50 bp, homo sapien
ggaagaggcattattctcacccataygttctaaagcagaagaaatggaaa

SEQ ID NO: 76243 - DNA, 50 bp, homo sapien
acacatgaccttagttccactagacratagagagtgctgtgggttatgtt

SEQ ID NO: 76244 - DNA, 50 bp, homo sapien
tgcattcgtttaatgctgaattggcyaactaactaaaaagcacactgatg

SEQ ID NO: 76245 - DNA, 50 bp, homo sapien
tgaagcccaggtctcctgactccaawtataagtctaaccaatattatatg

SEQ ID NO: 76246 - DNA, 50 bp, homo sapien
cactgttgtggctgagagtcaagtasagtacgtaatctctaccaccagag

SEQ ID NO: 76247 - DNA, 50 bp, homo sapien
ggacccagacagtctctcatcgcaayaagactcctcctccagtgattcct

SEQ ID NO: 76248 - DNA, 50 bp, homo sapien
cttggaaagtccttaatgaggacacrgtaaagcaattttctaagctgctt

SEQ ID NO: 76249 - DNA, 50 bp, homo sapien
gttggctttcaaaagcagtcactgaracaagttgttgatcaatagaacag

SEQ ID NO: 76250 - DNA, 50 bp, homo sapien
tctttaatcctttcctccaaaatacygagtgaggtctctctcctctgtac

SEQ ID NO: 76251 - DNA, 50 bp, homo sapien
gaaatgttcttattgtatcactgccrctaatatacgcttatagtctaaaa

SEQ ID NO: 76252 - DNA, 50 bp, homo sapien
tacttttgtattctaagaacgagacratcacacaaaaaaatgaaaacagt

SEQ ID NO: 76253 - DNA, 50 bp, homo sapien
tgaatgctggaaatgctacttaaaasgttgaccaggaatggcctggaggt

SEQ ID NO: 76254 - DNA, 50 bp, homo sapien
tgaaggtatgtgtcttttcactatakacttcttttcttttcttttttgtt

SEQ ID NO: 76255 - DNA, 50 bp, homo sapien
actctactgaacagtcctactttctyaccatgatctcctattttccaaca

SEQ ID NO: 76256 - DNA, 50 bp, homo sapien
ggattgttttttaatgactgtctccmaaggaagttgtgattcagcctcct

SEQ ID NO: 76257 - DNA, 50 bp, homo sapien
agcagttctcacttattactaggacmaaggaacagtaagtcttttccttt

SEQ ID NO: 76258 - DNA, 50 bp, homo sapien
ttgctgttctcaaagacaatgacaamacccatttttgatgcctgaaaaga

SEQ ID NO: 76259 - DNA, 50 bp, homo sapien
cttatactccctattcaatccaacckgaaatatatccagaatctacctcc

SEQ ID NO: 76260 - DNA, 50 bp, homo sapien
gcctgtagctatgtgccagtaactaygacagatactaaaagacagtccta

SEQ ID NO: 76261 - DNA, 50 bp, homo sapien
tctagtctctgtattaaggagataakgactggggtgtggtggggaggaaa

SEQ ID NO: 76262 - DNA, 50 bp, homo sapien
aagtcatttgcctgtattttcaacayagagaggagaacaccaaggtccag

SEQ ID NO: 76263 - DNA, 50 bp, homo sapien
gctttgaggatttcaggaaaaggaaytgtacatactgttgataaagcaaa

SEQ ID NO: 76264 - DNA, 50 bp, homo sapien
aaataacaaaaccaaaagactaaaarttagattgagggaagacctatttc

SEQ ID NO: 76265 - DNA, 50 bp, homo sapien
ttacagagaataaacatttagattgktgtaagcctttgactaatttctag

SEQ ID NO: 76266 - DNA, 50 bp, homo sapien
cttctttgtggtatccctctccatamctttgtaaaaagtatctttattaa

SEQ ID NO: 76267 - DNA, 50 bp, homo sapien
acagtacacgttgagatgaggatacygagataagcaagggcaagattatg

SEQ ID NO: 76268 - DNA, 50 bp, homo sapien
ctccccttttaacctcctggtatgamgtatggaagaatcagcagccaaca

SEQ ID NO: 76269 - DNA, 50 bp, homo sapien
ctgccttagatgggaactggactacrcttagatgtaaatgacttattggt

SEQ ID NO: 76270 - DNA, 50 bp, homo sapien
ctgctttgcaatatgacggtccactstttacttggaatcccatcccatcg

SEQ ID NO: 76271 - DNA, 50 bp, homo sapien
ggctgttcagagcctcttgggtagcwaacagatggcttctgttgtataca

SEQ ID NO: 76272 - DNA, 50 bp, homo sapien
aaggggacagatatgacaacaaatartttgatacgtaagacaacatgata

SEQ ID NO: 76273 - DNA, 50 bp, homo sapien
agttcttgatacatactagatacaaygcttttgttttgaattatgagaaa

SEQ ID NO: 76274 - DNA, 50 bp, homo sapien
ggaattttactgctctaccatttcasaccaacagtcatgtcagctacatt

SEQ ID NO: 76275 - DNA, 50 bp, homo sapien
tgcttactattgtatttcctatatckaatacagtacatagtacacagtag

SEQ ID NO: 76276 - DNA, 50 bp, homo sapien
gaacaaagaggaaagatggccaagaygaccacttgaattcctatgaaatg

SEQ ID NO: 76277 - DNA, 50 bp, homo sapien
tcacaaaggaagtattaaaatggtcrataataggagagtatgctcaggct

SEQ ID NO: 76278 - DNA, 50 bp, homo sapien
gggaggaggagaactcacaatgaatraatgacatagcttggtggtagagc

SEQ ID NO: 76279 - DNA, 50 bp, homo sapien
cagtacattcttgctattaagatacycgtgcaaaggcagagggtgtggga

SEQ ID NO: 76280 - DNA, 50 bp, homo sapien
gcccaacattggtagatttggcataycaagtttatgtaagcaatttaaat

SEQ ID NO: 76281 - DNA, 50 bp, homo sapien
actcagaagcttgaacctgaccagayggactcctaagacctagaccccat

SEQ ID NO: 76282 - DNA, 50 bp, homo sapien
agtccagttcccatctaaggcagaaragcttaacatggcattagagccac

SEQ ID NO: 76283 - DNA, 50 bp, homo sapien
ccatctcaggggaagaggaatggagrattaacaaatgtatatattaaaaa

SEQ ID NO: 76284 - DNA, 50 bp, homo sapien
ctcctgtcgggtcctggagtggagayggacaaagccactctgagaggaag

SEQ ID NO: 76285 - DNA, 50 bp, homo sapien
cccatttcttgcttccttcacctagwaacatacctgtgtcctcctcttta

SEQ ID NO: 76286 - DNA, 50 bp, homo sapien
actggcttattgatgtaaaggaaaarccacagtataagaactcattctta

SEQ ID NO: 76287 - DNA, 50 bp, homo sapien
tgacagagtgatttgtagggtgttaygaagaggataaatcaagcacttat

SEQ ID NO: 76288 - DNA, 50 bp, homo sapien
gtattaaaaaaactatctttacctgyagtctcttaattctagcaaattaa

SEQ ID NO: 76289 - DNA, 50 bp, homo sapien
aagagataaatatattttgtatgccraagcaaagtaagtcaatatttgtg

SEQ ID NO: 76290 - DNA, 50 bp, homo sapien
gaaaataatgtattgctttttcttcwcatattccccaaaagagtaaaaat

SEQ ID NO: 76291 - DNA, 50 bp, homo sapien
gaacgtgaatcctctctttggacttyagaagcaatccttgggttcctggg

SEQ ID NO: 76292 - DNA, 50 bp, homo sapien
gttcaaagaaaaccacatttaggcayatgtagtaaaactgctaaaaaaca

SEQ ID NO: 76293 - DNA, 50 bp, homo sapien
attaagggacactttccattcctccraaaaacatgaagactgatgcctgc

SEQ ID NO: 76294 - DNA, 50 bp, homo sapien
ggaggcttcctggccatttatgttcygacccaaaggacaaatggcccttc

SEQ ID NO: 76295 - DNA, 50 bp, homo sapien
tgcaaatgtgtagtatcgccatcgastcaagtgcttgttgggcttagtgc

SEQ ID NO: 76296 - DNA, 50 bp, homo sapien
ccattgtacaacagtattctaggccrccaacaaaagtgtgacagacacac

SEQ ID NO: 76297 - DNA, 50 bp, homo sapien
gagcaattcctggagagagacttgarctgagagccaccaacactcccaac

SEQ ID NO: 76298 - DNA, 50 bp, homo sapien
ggatatggcaattttaatttccagartctctttgatcgctccttttctat

SEQ ID NO: 76299 - DNA, 50 bp, homo sapien
aaatccagtccacgtgtttcatagayggaaggtttcagattacatttcag

SEQ ID NO: 76300 - DNA, 50 bp, homo sapien
ttttagaaataggttgaccttcagayttattttctcaatgggtagttagt

SEQ ID NO: 76301 - DNA, 50 bp, homo sapien
ccataatgtaggctcccataactgaygtatagtaaccactccaggggaag

SEQ ID NO: 76302 - DNA, 50 bp, homo sapien
ccaagaaatgtagaatgtagaatgamgcatattttatgcctgaaatttgc

SEQ ID NO: 76303 - DNA, 50 bp, homo sapien
caaactgagagatcctgcacagataygaaggcttactattttgtgagtta

SEQ ID NO: 76304 - DNA, 50 bp, homo sapien
ttcataagcattttcagttttcaaaktcgtctttttaattgctataaaat

SEQ ID NO: 76305 - DNA, 50 bp, homo sapien
gtcttaagtggttaattaatgaagcygccgtaacttttttgtttatttta

SEQ ID NO: 76306 - DNA, 50 bp, homo sapien
agtaaaacaagctcaaatacatttamaaatctaagcaaaaccaaatgaca

SEQ ID NO: 76307 - DNA, 50 bp, homo sapien
aagaggggtgagtttacattaaataraagacctatcttttctcctgttct

SEQ ID NO: 76308 - DNA, 50 bp, homo sapien
cctattcctaagcccccttccaccasgacatcttttgatcctaagcaaga

SEQ ID NO: 76309 - DNA, 50 bp, homo sapien
taacagaggaaacaaagatgttgtaygctcagggaaaggaaactattttt

SEQ ID NO: 76310 - DNA, 50 bp, homo sapien
tgaaaaaccactgtctaaatacaagraggaatacacaaatatacaatggt

SEQ ID NO: 76311 - DNA, 50 bp, homo sapien
aaatgatgagcatgagccagatttargaggaatgctgactctttttttaa

SEQ ID NO: 76312 - DNA, 50 bp, homo sapien
tcaatgcaataatgactctgaaagcycagctaaatgtagaacatactctt

SEQ ID NO: 76313 - DNA, 50 bp, homo sapien
taatgacaattcaggtaaataaatarggttatacaatgaacaacactata

SEQ ID NO: 76314 - DNA, 50 bp, homo sapien
agggaacgtgaaatgtcaagtagtaragcacattccataaagaaactgag

SEQ ID NO: 76315 - DNA, 50 bp, homo sapien
ataacatctttgggaagccattatcraatctgccacagagaataaagata

SEQ ID NO: 76316 - DNA, 50 bp, homo sapien
attaccaactatctatgcctgtaccwatataatgtttaatgttttagcat

SEQ ID NO: 76317 - DNA, 50 bp, homo sapien
tcccctcccctaaagagttcaaaccyatgtctttcaggttagtgtcctgt

SEQ ID NO: 76318 - DNA, 50 bp, homo sapien
gtggcctgggaaaaatgtacaataawaaccaatgtcagtagggccctgac

SEQ ID NO: 76319 - DNA, 50 bp, homo sapien
tctcttgttgttttggatactttttycagttgattctcttatatttttaa

SEQ ID NO: 76320 - DNA, 50 bp, homo sapien
agtctctagaaaaagaaagaagaacragcagagtctcagaatgcacatgg

SEQ ID NO: 76321 - DNA, 50 bp, homo sapien
ctttattggtccgacatatatatagrccttaggcattgtcacagagtggt

SEQ ID NO: 76322 - DNA, 50 bp, homo sapien
tcccacctgtgtttcttcccagttakgagaactatttaataagcctcagg

SEQ ID NO: 76323 - DNA, 50 bp, homo sapien
ggtagagcttatgttgatccaaagaytcaggaattaaaaagttatttgac

SEQ ID NO: 76324 - DNA, 50 bp, homo sapien
aatggaaaatgtagctgcctacagarttagagaactgcaggtgtatgtat

SEQ ID NO: 76325 - DNA, 50 bp, homo sapien
gtgaaatcttgtatagttatgtcccrgacgtaaatcattcctttgtccag

SEQ ID NO: 76326 - DNA, 50 bp, homo sapien
cgtttccttgtctggcccccttcacyacccacaatgcaaacccacactga

SEQ ID NO: 76327 - DNA, 50 bp, homo sapien
tacctttttttttggtaattgggatragacagtaaggaaagaaacatgac

SEQ ID NO: 76328 - DNA, 50 bp, homo sapien
gtaaaaattgaggcttgacatacaayaccttgcatatatttaaagtgtac

SEQ ID NO: 76329 - DNA, 50 bp, homo sapien
tgggttttaacctctgtgcctgtaartaaggttctggtcctgatccttac

SEQ ID NO: 76330 - DNA, 50 bp, homo sapien
tggacctacagacagataatggccaracagtaaggtcaaggctgaaggct

SEQ ID NO: 76331 - DNA, 50 bp, homo sapien
gttttccaaatgttcacttttaacaygggcatccatttatacaacaaagg

SEQ ID NO: 76332 - DNA, 50 bp, homo sapien
tgccagtgtgtctggcaggtggaagrcattgagacgcctttactgagcac

SEQ ID NO: 76333 - DNA, 50 bp, homo sapien
tttcctaggtaataaactctagtcamccattctcagttatctattcttgc

SEQ ID NO: 76334 - DNA, 50 bp, homo sapien
acagtggatagtgatactcttgatamtaatactattcctcatggttttcc

SEQ ID NO: 76335 - DNA, 50 bp, homo sapien
gcctcgaatgccaactaacacacgckataaccgaggtgactgcactctgg

SEQ ID NO: 76336 - DNA, 50 bp, homo sapien
agggatattcaacccatacacttcartaagtcctagtagtaagagcttga

SEQ ID NO: 76337 - DNA, 50 bp, homo sapien
aaagaatgagagtgtggccctagaayatttgtcatgcagtgtgctcagag

SEQ ID NO: 76338 - DNA, 50 bp, homo sapien
agcctgatagaaaatacaaaataggraagcataaatagttccaaatatat

SEQ ID NO: 76339 - DNA, 50 bp, homo sapien
gataggtctagcagtagagatcaacsaaggtgatgcacccaggagacatc

SEQ ID NO: 76340 - DNA, 50 bp, homo sapien
attgatcttgttctaggaatggacartgggtatagattgaacacattcta

SEQ ID NO: 76341 - DNA, 50 bp, homo sapien
ctgggatagaaagggcgggtgatatytgagtgtggcctgaaagacacagg

SEQ ID NO: 76342 - DNA, 50 bp, homo sapien
ggcccagtttgttgcaatccacattragataaggctgggagacctgaagg

SEQ ID NO: 76343 - DNA, 50 bp, homo sapien
caaagataaattgccatttgcacaaygatcttgcgcttaaaagtagctcg

SEQ ID NO: 76344 - DNA, 50 bp, homo sapien
gttgcatgggatgtaaatgtatcaayaaaatagcaaatgggtaaggaata

SEQ ID NO: 76345 - DNA, 50 bp, homo sapien
ttctctctgcttgtttctcagaaaarctatggtacagcttttatttactt

SEQ ID NO: 76346 - DNA, 50 bp, homo sapien
aatctatcatttattttaatactcaratggtactaaatgtggctctccaa

SEQ ID NO: 76347 - DNA, 50 bp, homo sapien
tggttggttggttgatttttttacarggaacatgtgtgattttttgcaat

SEQ ID NO: 76348 - DNA, 50 bp, homo sapien
ttattcaacaaaagtatcataagaaragtggcttagtctcaccctcctac

SEQ ID NO: 76349 - DNA, 50 bp, homo sapien
accttgagttctcaccctagaggccrctgtactttttctcccacagaagt

SEQ ID NO: 76350 - DNA, 50 bp, homo sapien
actgccactaaatcatggaaatgaamaagcatcttcctttgcctagaggg

SEQ ID NO: 76351 - DNA, 50 bp, homo sapien
ggggctggcagcaggaagtaggcagyagcaaatggaaaaggctggcctgg

SEQ ID NO: 76352 - DNA, 50 bp, homo sapien
gcttagaccctctcagaaaagatacrcaagaatgcagtaacactggttgt

SEQ ID NO: 76353 - DNA, 50 bp, homo sapien
agtgtgaaagtgcatacctctgtacraagacgtggcgtgttactaagtga

SEQ ID NO: 76354 - DNA, 50 bp, homo sapien
cttaccatgttgtttttgagatacaytaatcttgtgtgtatcattatttc

SEQ ID NO: 76355 - DNA, 50 bp, homo sapien
ttatgggcactgggactattgtgcartaataataataaaagatgagccat

SEQ ID NO: 76356 - DNA, 50 bp, homo sapien
tggagggagatggaagggaatggagrtccaggtttctgagaacacactcg

SEQ ID NO: 76357 - DNA, 50 bp, homo sapien
ctacagtaacaaatggatacaagcayataatggcacagccccataaaagt

SEQ ID NO: 76358 - DNA, 50 bp, homo sapien
gacccctaggtcaatctccaaaaaasatggtagatggcagccagcagctg

SEQ ID NO: 76359 - DNA, 50 bp, homo sapien
tctttttataccaacagactcgggamattcctgaaaacaaaaacagacgt

SEQ ID NO: 76360 - DNA, 50 bp, homo sapien
cttgaatttattctcttatagttccraaggccagaaatctgaaatcagtt

SEQ ID NO: 76361 - DNA, 50 bp, homo sapien
tgaagatcagtatccagaatgtttgragttatcactggtcatgaactata

SEQ ID NO: 76362 - DNA, 50 bp, homo sapien
ttttatgcctgttcatggtaatctakgtactgagatacatagctttaaca

SEQ ID NO: 76363 - DNA, 50 bp, homo sapien
gctgactgaaacttagcccttcatgkacttaaacttgtttccttttaaac

SEQ ID NO: 76364 - DNA, 50 bp, homo sapien
gcatgggtggaagctgtgcttggaamgtgaatgtgtttaggccaggtgtg

SEQ ID NO: 76365 - DNA, 50 bp, homo sapien
aataggagctgaatttacactaaaayggggagtataaagatccaaggact

SEQ ID NO: 76366 - DNA, 50 bp, homo sapien
ggacatcatcaaaattaaaaactcamattcttcaaagacactatttaaaa

SEQ ID NO: 76367 - DNA, 50 bp, homo sapien
gcactggggacacagctgtgaacagrtggataaggtctctgttccctgga

SEQ ID NO: 76368 - DNA, 50 bp, homo sapien
ttatttgtctttccttaccgaaacayaaggtccaacatggcaggaatgcg

SEQ ID NO: 76369 - DNA, 50 bp, homo sapien
atttaaagaccctttactcaatgaartgtctctttcgtattcttttgctt

SEQ ID NO: 76370 - DNA, 50 bp, homo sapien
gttgtattacacatactaatttatgyatggttagattatgcagatgcatc

SEQ ID NO: 76371 - DNA, 50 bp, homo sapien
gcataccttttaattatatgaaaaayagtttagtgtttccaagcctcatt

SEQ ID NO: 76372 - DNA, 50 bp, homo sapien
ataatatctaccagggttgttgcaargttcaaaacttgagcctatcataa

SEQ ID NO: 76373 - DNA, 50 bp, homo sapien
gacctgaaatgatgggaaagaagacmatattccagtattaatatgttttc

SEQ ID NO: 76374 - DNA, 50 bp, homo sapien
ctattccttctggacaccaagaaacraagcacaagttaaatcctcagtag

SEQ ID NO: 76375 - DNA, 50 bp, homo sapien
ttgcatttgttttattgtaactgtakatctgtgagcattataggaaaacc

SEQ ID NO: 76376 - DNA, 50 bp, homo sapien
acattctcccaataaatactcagaaytactatcagcttaggccaaggcat

SEQ ID NO: 76377 - DNA, 50 bp, homo sapien
ggctggactgcagcagaacacagtcratgaaaaaaagaatctcaatcatt

SEQ ID NO: 76378 - DNA, 50 bp, homo sapien
ttgggccttgaagttcatttagttasagatggtaaaagcatggcacacat

SEQ ID NO: 76379 - DNA, 50 bp, homo sapien
caaatgtctaggagtagggctacatycagacctggctgctagagaatgga

SEQ ID NO: 76380 - DNA, 50 bp, homo sapien
atttcaacatgagttttggcagagayattcaaaccgtagccatgggtgta

SEQ ID NO: 76381 - DNA, 50 bp, homo sapien
cacagtccttcactcagtacagacaktcttcatgcaaagaaagaggcctg

SEQ ID NO: 76382 - DNA, 50 bp, homo sapien
cccaaatctcatgtcaaattgtacartaattcccagtgttgggggaggga

SEQ ID NO: 76383 - DNA, 50 bp, homo sapien
aacaactgaccaaggactctggctgyctttgaaatatattatcatgtttg

SEQ ID NO: 76384 - DNA, 50 bp, homo sapien
catcctagggagaatttcaatcataygtaagtgcagacagaattaggtac

SEQ ID NO: 76385 - DNA, 50 bp, homo sapien
ttgtaattactttcaaagcagaatcrcaacatcagggactttaacgctaa

SEQ ID NO: 76386 - DNA, 50 bp, homo sapien
tctcatcagtgtgaatctgactactratgcagctaaatgtttgtcctgtc

SEQ ID NO: 76387 - DNA, 50 bp, homo sapien
ggagttgaaagcctgcctgtccttastaaaatgcagtactgcctgtcctt

SEQ ID NO: 76388 - DNA, 50 bp, homo sapien
actagcacattttgaaatatggtgamactaaaccagctacagggatagtg

SEQ ID NO: 76389 - DNA, 50 bp, homo sapien
tattcagcggtgaacaatggttgacmaggtagacaaggaggtaggtatga

SEQ ID NO: 76390 - DNA, 50 bp, homo sapien
aaaataagggcctcgacctaactcartgaaatgtcttatgctcaatcttc

SEQ ID NO: 76391 - DNA, 50 bp, homo sapien
tgaaacattagtggagttggttaaasacacgaagccggagctcactctag

SEQ ID NO: 76392 - DNA, 50 bp, homo sapien
aacttctctgagacttagtttttctyacctgaaatgtagagcaatgaggt

SEQ ID NO: 76393 - DNA, 50 bp, homo sapien
aggcagcaagtaggaatggaccctgsagttcacggattcaaagcacaatg

SEQ ID NO: 76394 - DNA, 50 bp, homo sapien
tgagaaacttaaatatggcatttagsatagcaaaaaaaaaaaaaaatcac

SEQ ID NO: 76395 - DNA, 50 bp, homo sapien
cacacatgctcacttgcctatatgaygcttcttagctccgcaacccagga

SEQ ID NO: 76396 - DNA, 50 bp, homo sapien
cctcttggaaaatgtctttcataaargctaatcattggggctttctggct

SEQ ID NO: 76397 - DNA, 50 bp, homo sapien
aggccagcatggacaaagaacaggaktacccaggaacatgacacactgag

SEQ ID NO: 76398 - DNA, 50 bp, homo sapien
agtgttctccatcttgagccataagraataagaggcttgcattcattagc

SEQ ID NO: 76399 - DNA, 50 bp, homo sapien
tagaagaatggtgcacatcaaaaatkaatgttacagataaatagttcaag

SEQ ID NO: 76400 - DNA, 50 bp, homo sapien
agactgtgagctgctgacagaggctyctctctactcaggctgtaacctta

SEQ ID NO: 76401 - DNA, 50 bp, homo sapien
cccccaatccctgtgctccttctggrcagactcacaacttccaggacaat

SEQ ID NO: 76402 - DNA, 50 bp, homo sapien
gcttacattctgtcatgtaataatawctggaatttgtacagcatcttcct

SEQ ID NO: 76403 - DNA, 50 bp, homo sapien
ctcccctgctggggtttcccttgacygtatgatgactgacactagaaagt

SEQ ID NO: 76404 - DNA, 50 bp, homo sapien
aagataatgggttttggaagacatcygacattctctggcatgggtgcacc

SEQ ID NO: 76405 - DNA, 50 bp, homo sapien
tagggtatacaaacagtgaattacaraccttacaattttatgagagacaa

SEQ ID NO: 76406 - DNA, 50 bp, homo sapien
tcactagctttgactcacacttgcaraagttcatctcattagcggagcct

SEQ ID NO: 76407 - DNA, 50 bp, homo sapien
atatcttaaaagtttctagtagtatraagttcccaggccaggcgcagtgg

SEQ ID NO: 76408 - DNA, 50 bp, homo sapien
atccatgttctctgggtaactgtagmaatcactttgtatttcagtccatc

SEQ ID NO: 76409 - DNA, 50 bp, homo sapien
aaaacgtttcccaggtaactaaagamaatattcaagggcagaaatatcag

SEQ ID NO: 76410 - DNA, 50 bp, homo sapien
aataggaaaagtcatttcttgcttayggtcagcactaacattgattccca

SEQ ID NO: 76411 - DNA, 50 bp, homo sapien
cgaggctttttctacttgttgataargcatggaactgaatggtacgctca

SEQ ID NO: 76412 - DNA, 50 bp, homo sapien
caagaaaagttcaagtccaaaaacayaagttcccttccctcgtaacttaa

SEQ ID NO: 76413 - DNA, 50 bp, homo sapien
acacttattacatttgcccactgaamtatcaaaacaaatgcaaactgtaa

SEQ ID NO: 76414 - DNA, 50 bp, homo sapien
atattcttgtaaagcaagtttctgaygccatacagtgtgattatagtgct

SEQ ID NO: 76415 - DNA, 50 bp, homo sapien
tggtaaagaaaagaggcctctagcarttgccaacaaatttcagtaacttg

SEQ ID NO: 76416 - DNA, 50 bp, homo sapien
gcccaactcactcctctgcaaggtasaagccataaacctttgtggcatcc

SEQ ID NO: 76417 - DNA, 50 bp, homo sapien
taagccagatatgttttctgtgttayggtgaaccttacaaaatctttagc

SEQ ID NO: 76418 - DNA, 50 bp, homo sapien
tacactgtattataggaattctacayagtacgtctgcatctgaaatgtga

SEQ ID NO: 76419 - DNA, 50 bp, homo sapien
tactgaagaataagaaagtgagggcragaacagaaaccatagacccgtga

SEQ ID NO: 76420 - DNA, 50 bp, homo sapien
tggaatgggtaagcaagtgggagaaygaataggagatgaaggactgagga

SEQ ID NO: 76421 - DNA, 50 bp, homo sapien
aaacaatgaataactttgtgcacttracccatctgtagaaaaccatctgt

SEQ ID NO: 76422 - DNA, 50 bp, homo sapien
tccaggtagctagttcttgggtcaakatccctagagaaggacagtaccca

SEQ ID NO: 76423 - DNA, 50 bp, homo sapien
atctatataaagtatttggcacatasaaaacctacaataagaatgttttt

SEQ ID NO: 76424 - DNA, 50 bp, homo sapien
taaagacgctattgtgaaaaatgaaygtcttacagcccactgagtagata

SEQ ID NO: 76425 - DNA, 50 bp, homo sapien
ggaatggagctgtgctaaaggagacragtgccgggaaggtcattcctctc

SEQ ID NO: 76426 - DNA, 50 bp, homo sapien
aagtatgtagtaagagaataagatasaaaagtcacctaagaaagtgtatg

SEQ ID NO: 76427 - DNA, 50 bp, homo sapien
ccaccacggcatcttctaatgcaccrgatacctccaacatcatgcagtct

SEQ ID NO: 76428 - DNA, 50 bp, homo sapien
agtgctctggtccatttggcaaatawattcctaaagtgaaagttgagttc

SEQ ID NO: 76429 - DNA, 50 bp, homo sapien
gtccaagtgccttagattttttagastatattatgatagagactgagaga

SEQ ID NO: 76430 - DNA, 50 bp, homo sapien
aaagggacgttgcagatgtaaattayggacctcgagaccgggagattatt

SEQ ID NO: 76431 - DNA, 50 bp, homo sapien
aatcatagactcaggggccatctgakaactgtactcacagggaggccacc

SEQ ID NO: 76432 - DNA, 50 bp, homo sapien
atttatcccctaatgcttatgattcragtatatggattcagatcatcctt

SEQ ID NO: 76433 - DNA, 50 bp, homo sapien
agtaaaacattaccaaaatgtagcayctttagacaaagttggagttggag

SEQ ID NO: 76434 - DNA, 50 bp, homo sapien
tatatgcaaacatatttatcagggayccatcaaagttcagcttcagctac

SEQ ID NO: 76435 - DNA, 50 bp, homo sapien
taaaggcagaggccagcaccacttaragaagagactgcaaaagggattca

SEQ ID NO: 76436 - DNA, 50 bp, homo sapien
gaaccataaatactactataaaacaraataaaagagattattagtgtata

SEQ ID NO: 76437 - DNA, 50 bp, homo sapien
agatcctactgctcatggtcgataamagatccttcttcacacatactcct

SEQ ID NO: 76438 - DNA, 50 bp, homo sapien
aactgaatcacctgtatatcctctamatgtttgatcaatataattttata

SEQ ID NO: 76439 - DNA, 50 bp, homo sapien
gcacttttataatggattggaatgtraaaatctctaatccagaaggaaga

SEQ ID NO: 76440 - DNA, 50 bp, homo sapien
catgttggtatggcactctctatgtyacagcacagagacctctactttgc

SEQ ID NO: 76441 - DNA, 50 bp, homo sapien
taataagtaaggattaaatgaggaakgaatttaattctgaacatatggta

SEQ ID NO: 76442 - DNA, 50 bp, homo sapien
tggtgggggaggagataagagtgttycttctcaaatcatctccccttctc

SEQ ID NO: 76443 - DNA, 50 bp, homo sapien
ggaggctgagaatctcagaattttgsaagtgcttcaggccggggttccag

SEQ ID NO: 76444 - DNA, 50 bp, homo sapien
agacaatagcacagggtattcatgarcaataaaattggagctgatattgc

SEQ ID NO: 76445 - DNA, 50 bp, homo sapien
cacatgtgtattacttggaaaataarctcaactgcatataacagacaccc

SEQ ID NO: 76446 - DNA, 50 bp, homo sapien
acacagaccaattcttctaggaaccraggtggccataaaaggctgggaca

SEQ ID NO: 76447 - DNA, 50 bp, homo sapien
tttcacaaaataatttcatacacaaygttccctggggaccctgctggagg

SEQ ID NO: 76448 - DNA, 50 bp, homo sapien
ccctctagagacctgtctggcactascaggctcatctgacagagagattc

SEQ ID NO: 76449 - DNA, 50 bp, homo sapien
attcaaggtgagagaggcctttggarcatactaatgaaactttgattttt

SEQ ID NO: 76450 - DNA, 50 bp, homo sapien
actcgtcacatacaagagatcctcargataaacactggatttctcatcag

SEQ ID NO: 76451 - DNA, 50 bp, homo sapien
gtacaactatggaaaagtacttttgwattctaagaacgagacgatcacac

SEQ ID NO: 76452 - DNA, 50 bp, homo sapien
ttttggtatctaggtatttgtgtcasagttacaagatggttccttatatc

SEQ ID NO: 76453 - DNA, 50 bp, homo sapien
aacaaaaacttgctttagaaatcaayacggaagagtccagaatccagatt

SEQ ID NO: 76454 - DNA, 50 bp, homo sapien
ttctcaaccctaattgcacattagaytcaactggggagcttttaaaacta

SEQ ID NO: 76455 - DNA, 50 bp, homo sapien
aattgagccctccaaatctttatcayctgtccttagcacatgcttagcta

SEQ ID NO: 76456 - DNA, 50 bp, homo sapien
ttctaactggcccacaaattgaggayaagaattcaggaacttgcatagca

SEQ ID NO: 76457 - DNA, 50 bp, homo sapien
ttggagggctcaatttttccatgaargagttcctggtgtaattgagacag

SEQ ID NO: 76458 - DNA, 50 bp, homo sapien
ttcagtgcatcatgaggctacaaatsagaggcatctcccactcactagga

SEQ ID NO: 76459 - DNA, 50 bp, homo sapien
tctagacaggactgattatggactcragatctaaaaaagaaaatgatacg

SEQ ID NO: 76460 - DNA, 50 bp, homo sapien
ttccctttcttgagtgtcattccacratctctttccagtgctgaccactc

SEQ ID NO: 76461 - DNA, 50 bp, homo sapien
acacaggaagccgtcctcatgatgamcgtgctatctaatacatagccact

SEQ ID NO: 76462 - DNA, 50 bp, homo sapien
ggctcttatatcctaaagacagcctsaatggattggtggaggagccttat

SEQ ID NO: 76463 - DNA, 50 bp, homo sapien
aggtgaggtcccacagttctaatgckatctattccaaggctcagaggaga

SEQ ID NO: 76464 - DNA, 50 bp, homo sapien
attctgagactcatttcaagggtatkaagttaatgaaaagtattgtgttt

SEQ ID NO: 76465 - DNA, 50 bp, homo sapien
cagataataacctaaacagaagaaarcgaaattgaataagatccaaaaat

SEQ ID NO: 76466 - DNA, 50 bp, homo sapien
atgacacatttcagtactggagttamaaggaaacaaacttatatagtact

SEQ ID NO: 76467 - DNA, 50 bp, homo sapien
acctagagttggaaaacgaggcaaargttctgcatatcctagacagctgt

SEQ ID NO: 76468 - DNA, 50 bp, homo sapien
tttcaagactctggacaaaacatacracaaactgaggagcactaattcat

SEQ ID NO: 76469 - DNA, 50 bp, homo sapien
caaaaaacaaacaaacaaacctgacmactgaagttagcaattcacactta

SEQ ID NO: 76470 - DNA, 50 bp, homo sapien
ttgatatatggaaactgagtaaaaartaactatggaagcttgaagtgaaa

SEQ ID NO: 76471 - DNA, 50 bp, homo sapien
cacagaatatctgacttccaagagakagtttggtcctatgtttcctccat

SEQ ID NO: 76472 - DNA, 50 bp, homo sapien
catccttctaaaatacacaccttaamacctgctgatgacttcctatggcc

SEQ ID NO: 76473 - DNA, 50 bp, homo sapien
gagagtcacatgactagcttgaggcsaaaggcagctggaagagtttgagg

SEQ ID NO: 76474 - DNA, 50 bp, homo sapien
aaaagttcctttaccctgagaaatayaagaatgcttttccaacatagtct

SEQ ID NO: 76475 - DNA, 50 bp, homo sapien
cactgtagagcatcaagcttaaagartcatgcttaagaatttttactgaa

SEQ ID NO: 76476 - DNA, 50 bp, homo sapien
aggtggctacgtgctcttcccaggcraccgttcattcgtttctctatttg

SEQ ID NO: 76477 - DNA, 50 bp, homo sapien
atgccattcactacttataatacagycaggctttctaatcacattccata

SEQ ID NO: 76478 - DNA, 50 bp, homo sapien
cagtcaactgagtgactagacacccragcacttacaattctgagtactaa

SEQ ID NO: 76479 - DNA, 50 bp, homo sapien
tgaacagaacctcacaatgaaggttyggattgtggcatcttgagtcacta

SEQ ID NO: 76480 - DNA, 50 bp, homo sapien
tgtctgatggcagatctaacatttayggccttcggtgcatcattgccaga

SEQ ID NO: 76481 - DNA, 50 bp, homo sapien
tggtctgcatttcttcacaattttayaccttcttccatctcaccagataa

SEQ ID NO: 76482 - DNA, 50 bp, homo sapien
ttgaactcccagttcacccagagcckgagattcctccacatctatcacca

SEQ ID NO: 76483 - DNA, 50 bp, homo sapien
gatggttgtaagcaagagaaactaaytatggagaatcaaacctgttaggg

SEQ ID NO: 76484 - DNA, 50 bp, homo sapien
cacacacacacacgtatgtaactcamtcatccgtgtattagtgcacacca

SEQ ID NO: 76485 - DNA, 50 bp, homo sapien
acaaagccccataaagagtatatacmgagaaaatatgaggatcaatgcca

SEQ ID NO: 76486 - DNA, 50 bp, homo sapien
ctttagtgaagtctgtgcagccgaaracgcatagaatgaatagcacattc

SEQ ID NO: 76487 - DNA, 50 bp, homo sapien
gaatagtccattggttttttggatgygaatggaatgggcagtctgttttc

SEQ ID NO: 76488 - DNA, 50 bp, homo sapien
ataacatgggatatattaaaaggacsatgacctatgttagccatcctctt

SEQ ID NO: 76489 - DNA, 50 bp, homo sapien
tccccagctgccttctcttcctcctyaataggtcactgtttctattagtt

SEQ ID NO: 76490 - DNA, 50 bp, homo sapien
tggtggcattaaccacacagagaaasgaataactttgaataatttaaaca

SEQ ID NO: 76491 - DNA, 50 bp, homo sapien
ataactccagacacaaaattttaaamgatgtgaacaaaaaaaagaaaaga

SEQ ID NO: 76492 - DNA, 50 bp, homo sapien
cttgtctatggaggaattgcttgaastgctgcctttaattctagagttag

SEQ ID NO: 76493 - DNA, 50 bp, homo sapien
atattttttcaaaattgttttactaytaatgattatatgttttgccatat

SEQ ID NO: 76494 - DNA, 50 bp, homo sapien
ggataagcatcagaaagttccagaamtacaattggtcagaaggtttctct

SEQ ID NO: 76495 - DNA, 50 bp, homo sapien
cttttgattaaaaagtcacaaacaarctgtaatagcaactgactatgtta

SEQ ID NO: 76496 - DNA, 50 bp, homo sapien
tggttgaattgaaacatggcatttgraaaaagaaccacaacctagtaaca

SEQ ID NO: 76497 - DNA, 50 bp, homo sapien
acatatgtccccggctaaaaacttcrcgttggtattccaaccttagagct

SEQ ID NO: 76498 - DNA, 50 bp, homo sapien
tgcatgcagtgcacacttgtaaagaygagtgatgttatcgttacagcgga

SEQ ID NO: 76499 - DNA, 50 bp, homo sapien
agataaagcaagcacttagcatcacrctctgcatgcagtgcacacttgta

SEQ ID NO: 76500 - DNA, 50 bp, homo sapien
aaacagccacctccccaacagatgcktccatcccagcttctccggaatgg

SEQ ID NO: 76501 - DNA, 50 bp, homo sapien
tcactcctaggccagaggatctctcraggttagcttcgtggaatgcagag

SEQ ID NO: 76502 - DNA, 50 bp, homo sapien
tgatgtccctcaagatttgaccttargtttgcttctcttcatgctctatc

SEQ ID NO: 76503 - DNA, 50 bp, homo sapien
acccaacccatctggttattatccayatgaggacaattggagcctcttct

SEQ ID NO: 76504 - DNA, 50 bp, homo sapien
cataacactgaatatctttctctccrggaaacaagcacctcctcttactg

SEQ ID NO: 76505 - DNA, 50 bp, homo sapien
attccaagactccaccttagcaacayggacgtatgatgaatagaaaagaa

SEQ ID NO: 76506 - DNA, 50 bp, homo sapien
aatatagtgggaagtagctcccacartctacaggggatgttatatgggaa

SEQ ID NO: 76507 - DNA, 50 bp, homo sapien
catccactttagttacagtttactamgtatggtgaaacctttaggcccaa

SEQ ID NO: 76508 - DNA, 50 bp, homo sapien
tattttttaaaggtttttatgttgayatgtgttttatttcttttaagtaa

SEQ ID NO: 76509 - DNA, 50 bp, homo sapien
ccaatcaaagacagcctacttttcawacttggttcaaataaggcaaatgc

SEQ ID NO: 76510 - DNA, 50 bp, homo sapien
actttgaacatttgcattactagccrgattcctggaaacattttaacgtg

SEQ ID NO: 76511 - DNA, 50 bp, homo sapien
aaaattcctcctaaacataagacaastaggaaataacacacaacccaata

SEQ ID NO: 76512 - DNA, 50 bp, homo sapien
atttttgaaagtaaatgcttaatcaratcttttaaggtgagaagtgtcta

SEQ ID NO: 76513 - DNA, 50 bp, homo sapien
gggcacctttgtaatgcagaagtaayaacgtccaccagagatgataaaag

SEQ ID NO: 76514 - DNA, 50 bp, homo sapien
caggtgaataagctgaggatgagagytgactgctgaactgagcaagtgga

SEQ ID NO: 76515 - DNA, 50 bp, homo sapien
gtttgaaagtgctagttcctacaackctctaaatcttgtcctgtttttgg

SEQ ID NO: 76516 - DNA, 50 bp, homo sapien
ccatccacatttgcattcccgtatgrcactgtacatgcctccgttcccct

SEQ ID NO: 76517 - DNA, 50 bp, homo sapien
tggtggctggggaaccaaatagtctsagaaaatacttgggtcagtgggag

SEQ ID NO: 76518 - DNA, 50 bp, homo sapien
ttttgttgccttataatcaggttcayatatttggttattaaatctctttt

SEQ ID NO: 76519 - DNA, 50 bp, homo sapien
ctcccagttggtagcttctggaacayggagtagagaaacctggaaaaact

SEQ ID NO: 76520 - DNA, 50 bp, homo sapien
ggtaggaaaaagaatttcagtgttayggtgataagagcttggggtaattt

SEQ ID NO: 76521 - DNA, 50 bp, homo sapien
cttatctctacttcagctcttctctyatggtaatacaatgacctcttggc

SEQ ID NO: 76522 - DNA, 50 bp, homo sapien
catctacttccttggcaaggtaaagrattcctttcaggaatcatcttcta

SEQ ID NO: 76523 - DNA, 50 bp, homo sapien
ccaccctccagctcccacacgcacascattttccatagcacatgaaacac

SEQ ID NO: 76524 - DNA, 50 bp, homo sapien
gagatgaccaccgagtttttaataartggtctgagagggtacaatttgat

SEQ ID NO: 76525 - DNA, 50 bp, homo sapien
gagtcatgagtgttatttatatcaakggtgcctccttttctctgaatgca

SEQ ID NO: 76526 - DNA, 50 bp, homo sapien
cctctgggaatcggatcattcaggamaagacaccggctgctcaacagact

SEQ ID NO: 76527 - DNA, 50 bp, homo sapien
aactcccagcattgtgcctagaacaygttgcgtgcttgatagacattttg

SEQ ID NO: 76528 - DNA, 50 bp, homo sapien
gggaagagcaaattcaaagacacggmggtatcagaaatacaacacacata

SEQ ID NO: 76529 - DNA, 50 bp, homo sapien
aaaaagtgtaacaatagcttttaaayaccacagatgaacatctagatatc

SEQ ID NO: 76530 - DNA, 50 bp, homo sapien
ccgtttctttcatgtgatcattcacyggtttattgaagaatgagttcatt

SEQ ID NO: 76531 - DNA, 50 bp, homo sapien
gctgatagatcagaatccttttcaaygtagaagctgaggaaccactccca

SEQ ID NO: 76532 - DNA, 50 bp, homo sapien
gatagaatccacatggatgtttacaragtcccagctgaattgtgctgagt

SEQ ID NO: 76533 - DNA, 50 bp, homo sapien
ataagccaagaacaggataactcaayggagaatgtaaactaactatcata

SEQ ID NO: 76534 - DNA, 50 bp, homo sapien
aaacaattgtatgtcactgttgaccyggatatttttatgtataggattgc

SEQ ID NO: 76535 - DNA, 50 bp, homo sapien
gcataaagtatataaaggaatgtgasgctatttcaacaaaaggatatatt

SEQ ID NO: 76536 - DNA, 50 bp, homo sapien
gaatcaatcgcatagttatcattaayaataaagaccacaagtggctaaga

SEQ ID NO: 76537 - DNA, 50 bp, homo sapien
tttttgtctgatatgtagatttgccragggagaggttaaaatccggcgtc

SEQ ID NO: 76538 - DNA, 50 bp, homo sapien
aaagatagcacgatttaaggaccggygttgctttctgactaggtctgtca

SEQ ID NO: 76539 - DNA, 50 bp, homo sapien
caatttttttcagcgtgttcttataygcccattactgagctggtccctgg

SEQ ID NO: 76540 - DNA, 50 bp, homo sapien
ggatcagcctgatgtcagagacaggractcaccagtggtctagagctgca

SEQ ID NO: 76541 - DNA, 50 bp, homo sapien
tagaacagtagacggagcttttacaratgaaacgcctgaaccttaccgta

SEQ ID NO: 76542 - DNA, 50 bp, homo sapien
caaaagggagtgaaggagtggttaayaggagtccagagagccactcttga

SEQ ID NO: 76543 - DNA, 50 bp, homo sapien
tcccagaaattccaatttgattggcyacggtaaggttcaggcgtttcatt

SEQ ID NO: 76544 - DNA, 50 bp, homo sapien
ccaacacaatgttgaagaagaagaasaagtcggaggactgatactaccca

SEQ ID NO: 76545 - DNA, 50 bp, homo sapien
cctgccctccaggagctcctcacagygtagtggaagagaaagcagtgcca

SEQ ID NO: 76546 - DNA, 50 bp, homo sapien
aggacaaaagagaaatcaatagagartaacttgaaacactatagactttc

SEQ ID NO: 76547 - DNA, 50 bp, homo sapien
aagagaagctgctgttgtttttgatrttaaaagcacaaatgcaaaaatgg

SEQ ID NO: 76548 - DNA, 50 bp, homo sapien
caaggcatgtgataggagttctcaayaaataataacccatgtccttcatg

SEQ ID NO: 76549 - DNA, 50 bp, homo sapien
gttccaaattgtcccagtcctgtagycagaagtgcagagatcagggattc

SEQ ID NO: 76550 - DNA, 50 bp, homo sapien
atttttatatataggcacacatacasatatattggaagcttaccaaagag

SEQ ID NO: 76551 - DNA, 50 bp, homo sapien
ctcatttgctcactctggaccggctyactggactcattcagcacagtgtt

SEQ ID NO: 76552 - DNA, 50 bp, homo sapien
ctgtgcaatggcccgtggcagccacygggtgtacacactggagcatagct

SEQ ID NO: 76553 - DNA, 50 bp, homo sapien
taacattttggtcagcaggtctacasgttcatagtattgttcaaagctca

SEQ ID NO: 76554 - DNA, 50 bp, homo sapien
caagtgtcctgagtgccttgctagtstcaccctgggctcaactctggtga

SEQ ID NO: 76555 - DNA, 50 bp, homo sapien
tgccctggctttagaatgacttcctygaagccagtgtttctcaggctttt

SEQ ID NO: 76556 - DNA, 50 bp, homo sapien
tttgtctaagtattaggctagaatawctctaaacatcctagctttcaaca

SEQ ID NO: 76557 - DNA, 50 bp, homo sapien
tagcaagacagaagtttcttggacamtatacttaaaaaaagaagaagaaa

SEQ ID NO: 76558 - DNA, 50 bp, homo sapien
gctctcctggacatacatagaccacrgcaactttggagaagccaagcggc

SEQ ID NO: 76559 - DNA, 50 bp, homo sapien
ggtctaataggtcttactaagtaaarcgatgaattctctaatcacgtgca

SEQ ID NO: 76560 - DNA, 50 bp, homo sapien
aggtggcccacctccactctctaggwaaatacatctccaactgcaaaatg

SEQ ID NO: 76561 - DNA, 50 bp, homo sapien
aaaaacttttattttaaagcatcccrccataggctgaggaacactggtag

SEQ ID NO: 76562 - DNA, 50 bp, homo sapien
aaagtccttctctttccaggccagartaaaaaaatactgggtcatgttta

SEQ ID NO: 76563 - DNA, 50 bp, homo sapien
tcctgtgcttccctatctgcatgtawgtgtgaaatggtcattaaggtgca

SEQ ID NO: 76564 - DNA, 50 bp, homo sapien
caaatatagcaacaattattattcartactatccctgctatatacaaaga

SEQ ID NO: 76565 - DNA, 50 bp, homo sapien
ttttctagatcttgttaggtttgctytattctttattattctttttcctt

SEQ ID NO: 76566 - DNA, 50 bp, homo sapien
cccaaatctctacctctagcctcaamttttcctttgaactctagggatga

SEQ ID NO: 76567 - DNA, 50 bp, homo sapien
ctacatttttctgtgtagctggcccrgaatttttatgagatgtatcatga

SEQ ID NO: 76568 - DNA, 50 bp, homo sapien
agaaggaagtactaatatataccacratatggataaatcttgaaaatatt

SEQ ID NO: 76569 - DNA, 50 bp, homo sapien
atagtacatgaatgtttatagcagcrttttaaaaagtagccagaaaagtg

SEQ ID NO: 76570 - DNA, 50 bp, homo sapien
gtttgagaagttatggcaggatttasaggtaaaggataaagagattaaga

SEQ ID NO: 76571 - DNA, 50 bp, homo sapien
aatcacttttttcgagatcttgaaascagtacagtaaggtaggactaaaa

SEQ ID NO: 76572 - DNA, 50 bp, homo sapien
cgtataaatttattgatgtgatcaargtatttagttggttcctcttactg

SEQ ID NO: 76573 - DNA, 50 bp, homo sapien
gggatagtgaagaaaagagtctgaaragataatgtggctgacccctatct

SEQ ID NO: 76574 - DNA, 50 bp, homo sapien
tgtatgtggaaactagtagataaaarttgtccagtatgactgtgcagact

SEQ ID NO: 76575 - DNA, 50 bp, homo sapien
ttatatgtaaactgaaattgaattayattagctttactaaacccagagtg

SEQ ID NO: 76576 - DNA, 50 bp, homo sapien
cacaccaagtatgatagattgaatgyaacttaattatctgtagaactgaa

SEQ ID NO: 76577 - DNA, 50 bp, homo sapien
accatcactacaggtagcctctgcamatcgtttaacctctcggagcctcg

SEQ ID NO: 76578 - DNA, 50 bp, homo sapien
agcacacagcacatgttatggaatayagaagagatctgccagtctagcct

SEQ ID NO: 76579 - DNA, 50 bp, homo sapien
aacaaacatattgatcataccgataygagatgtcagggacttaattcatg

SEQ ID NO: 76580 - DNA, 50 bp, homo sapien
gaaatactgctctaaacctcaatctycctgttatagaaagtgggaatcat

SEQ ID NO: 76581 - DNA, 50 bp, homo sapien
tccgctaagctatgctgcctctcagsaaacagtgaactatgccaaatgcc

SEQ ID NO: 76582 - DNA, 50 bp, homo sapien
aggtttagacatattataaagcactragagataacaatcttgaagaaaga

SEQ ID NO: 76583 - DNA, 50 bp, homo sapien
ttaggattgcaagtttcatcttctaygtattcgttttctttgacaagtct

SEQ ID NO: 76584 - DNA, 50 bp, homo sapien
taggagaggaaaaggtgataaatagkaaggcccgtgacagacaaaacctg

SEQ ID NO: 76585 - DNA, 50 bp, homo sapien
atttataagccctcctgatatatcayaaaaattcaacaaattaaataatg

SEQ ID NO: 76586 - DNA, 50 bp, homo sapien
acatctttcaacttttgatgcctcarcctaattatattaaaaatttccag

SEQ ID NO: 76587 - DNA, 50 bp, homo sapien
tgcacatgaaattctgagatgggatraagacagattaaagtttgggtatc

SEQ ID NO: 76588 - DNA, 50 bp, homo sapien
tagagatgggagactggttgggagaygatcacatgaatttcatgacttca

SEQ ID NO: 76589 - DNA, 50 bp, homo sapien
aatctagcaactgagcaagcaaatayagagtgccaactatgtgtcagtgt

SEQ ID NO: 76590 - DNA, 50 bp, homo sapien
gttatcagctattcacctataatcaratgaccaatcattaatcaatgaaa

SEQ ID NO: 76591 - DNA, 50 bp, homo sapien
atcttcgctgaaatggcattccaggytagctctgttacagcagtcattgt

SEQ ID NO: 76592 - DNA, 50 bp, homo sapien
taaaatggtagagaaaagaaaatttygatgaggttcctataatgaaggac

SEQ ID NO: 76593 - DNA, 50 bp, homo sapien
aatttaaagtaattgaaactagaaaytgtgactactcaaaacaaaaacca

SEQ ID NO: 76594 - DNA, 50 bp, homo sapien
agctggcaggatgcttcccgtcgaargttgatattaagaaaagttcagtt

SEQ ID NO: 76595 - DNA, 50 bp, homo sapien
tgtggctggcacatagcaagttctcrattagcatttgttgaatgcacgca

SEQ ID NO: 76596 - DNA, 50 bp, homo sapien
acatactgtgggaaacattcagggcrcaaaatcatccagcaagctgatgt

SEQ ID NO: 76597 - DNA, 50 bp, homo sapien
tattccacagtaactctcagttcaayagagtgaagttcagattttaattg

SEQ ID NO: 76598 - DNA, 50 bp, homo sapien
tgtagaaatgtttcttcaacaaggaygggcaacctctaaactaggatttc

SEQ ID NO: 76599 - DNA, 50 bp, homo sapien
ttgtaaaatctacagacaaaataacsaaaataatccatgtagcagatgac

SEQ ID NO: 76600 - DNA, 50 bp, homo sapien
ttgtctgtgtagatgacagatgctamtaaggacgtcatcatttattgatc

SEQ ID NO: 76601 - DNA, 50 bp, homo sapien
attgcccaacaaataaagctactcakagtttgtaagtaattgtcaaagga

SEQ ID NO: 76602 - DNA, 50 bp, homo sapien
tttcagcatttatatattgccgtgayactcctgtgaaatcttaaaggaaa

SEQ ID NO: 76603 - DNA, 50 bp, homo sapien
acatttctcctcctgacttttcctcyaggttaccaatctgttctgcttcc

SEQ ID NO: 76604 - DNA, 50 bp, homo sapien
tgcttgtgccaaggcagtggcattcrcttaaggacataggtcagcccact

SEQ ID NO: 76605 - DNA, 50 bp, homo sapien
tattattcgtatgattgcctgaagawaaaaactcatgctcataagataca

SEQ ID NO: 76606 - DNA, 50 bp, homo sapien
agtttttatcttcaggcaatcatacraataatacctgctcacgttatctc

SEQ ID NO: 76607 - DNA, 50 bp, homo sapien
atactcacccaccccacccaaccttygttctggtcacacccaagcggttc

SEQ ID NO: 76608 - DNA, 50 bp, homo sapien
ggaggaactttctaaaaactggtatraaatgagtaaaaaagcatagaacc

SEQ ID NO: 76609 - DNA, 50 bp, homo sapien
aaatagtttggagactatttgatgaygattggccctacagagtagtcagc

SEQ ID NO: 76610 - DNA, 50 bp, homo sapien
ggtgtgctgagaggctgggccagaaraatcccacaggaatatcccacagt

SEQ ID NO: 76611 - DNA, 50 bp, homo sapien
tgtgccatctctgacttctctattckctgttttttaacacatacacacac

SEQ ID NO: 76612 - DNA, 50 bp, homo sapien
gaggcatcatgcacatgtatacttaytgacctgctgccattcagtcacac

SEQ ID NO: 76613 - DNA, 50 bp, homo sapien
gtaagtttcaaagctaaattaaatakgatctgggtgctgattttatactt

SEQ ID NO: 76614 - DNA, 50 bp, homo sapien
cttagaatgtgcaaagagcttagaayagtgcctaatacattgtaagcagc

SEQ ID NO: 76615 - DNA, 50 bp, homo sapien
ttcaaaggtgcctttccctgtgcctyagaggaagggatggtcacccaagg

SEQ ID NO: 76616 - DNA, 50 bp, homo sapien
agaaacttaaggcacaaagggagaamgctatttgcaacatcagagaaggg

SEQ ID NO: 76617 - DNA, 50 bp, homo sapien
agataggcactccctcctccacactmatttctctaagtcttcgtgctctg

SEQ ID NO: 76618 - DNA, 50 bp, homo sapien
tatacgtatgatatgtgcacttttcmataagcaggctactcttccgcagg

SEQ ID NO: 76619 - DNA, 50 bp, homo sapien
ttcttatgttgtcaaatatatatttytcttaacgacctgtttttcacaac

SEQ ID NO: 76620 - DNA, 50 bp, homo sapien
ttgagtttaacagggtgtagcaaaarcatgagtacagtggcctaaccaaa

SEQ ID NO: 76621 - DNA, 50 bp, homo sapien
tgtgtgattaagtttgtggccaaccraaatctccatatgtttgttttacc

SEQ ID NO: 76622 - DNA, 50 bp, homo sapien
attcacccatttcagttttatggttygatacatttcagtaaatttataca

SEQ ID NO: 76623 - DNA, 50 bp, homo sapien
caaaagacatgcaataagaacctcaraaatatatctgtgctgtcatgttc

SEQ ID NO: 76624 - DNA, 50 bp, homo sapien
accaaggcagttgacagctagtatayaaatgccctaaaaattctttcaaa

SEQ ID NO: 76625 - DNA, 50 bp, homo sapien
tatatggacaatttaaagttcattayaactttgcaggataaactgatgaa

SEQ ID NO: 76626 - DNA, 50 bp, homo sapien
attggaaaaatgaagtgataaaagcrgatctctggaatttttgtgttaag

SEQ ID NO: 76627 - DNA, 50 bp, homo sapien
agtaagaaaaatttaagtacaggcarctaaagaatgatttgcaactacaa

SEQ ID NO: 76628 - DNA, 50 bp, homo sapien
tgtttcttttttgcaggagactgcayagacacaactcactactgtatgtt

SEQ ID NO: 76629 - DNA, 50 bp, homo sapien
gcaccttggtttcctttgttaatgcrgactataaatggaattctgactac

SEQ ID NO: 76630 - DNA, 50 bp, homo sapien
cacacagacctctgtgaactagaccrgccagaaaaatatagtttgatggg

SEQ ID NO: 76631 - DNA, 50 bp, homo sapien
gtcttggtatacattcaccagctacrggatcctccttccattcatgggtt

SEQ ID NO: 76632 - DNA, 50 bp, homo sapien
agtgtacataaagattattttaaacsaaagacacctgaaattcaacagat

SEQ ID NO: 76633 - DNA, 50 bp, homo sapien
agaactcaactcctgagtcctagcasatgtcaagaatgatggagtcgcca

SEQ ID NO: 76634 - DNA, 50 bp, homo sapien
gagatatctggctttttaagatccakattttttctttatctttgcctcac

SEQ ID NO: 76635 - DNA, 50 bp, homo sapien
aaaaaaaaaaaaacactctgataaaragctgaatagatacaaataaataa

SEQ ID NO: 76636 - DNA, 50 bp, homo sapien
agtaaaccatcatggaccatagaatwagtctgccactgaaaaggctgtat

SEQ ID NO: 76637 - DNA, 50 bp, homo sapien
acaaaagggatttctaggttcttccygaggtaatgagtttgagtctagtg

SEQ ID NO: 76638 - DNA, 50 bp, homo sapien
ggacatgcggatcctgggagccttayctcattctctgttgaagagaagat

SEQ ID NO: 76639 - DNA, 50 bp, homo sapien
tagcttaagagtagtttggacacaayagaagaaataatcagtgaccttga

SEQ ID NO: 76640 - DNA, 50 bp, homo sapien
gattattagttccttaaatccttccracaagctatcatttgactttctag

SEQ ID NO: 76641 - DNA, 50 bp, homo sapien
attacatgcacatataatgaagtggrattttattcattatgcttgtgtag

SEQ ID NO: 76642 - DNA, 50 bp, homo sapien
actgtgcattctttcatgagaggaaracatatttcataactccttatata

SEQ ID NO: 76643 - DNA, 50 bp, homo sapien
aaaagacaagctatgccattgttttrcttgttgttattgttttaatctag

SEQ ID NO: 76644 - DNA, 50 bp, homo sapien
agaatgtttctcagaggaactaatakatgagtctagctgtgataaatcca

SEQ ID NO: 76645 - DNA, 50 bp, homo sapien
attgtcctttttacaaatacctctayactttcccacaatccacacacagt

SEQ ID NO: 76646 - DNA, 50 bp, homo sapien
atgactgcaaaacctcagaagctacraaaatgtttatatactaaccaaat

SEQ ID NO: 76647 - DNA, 50 bp, homo sapien
cctaccaccacttcaaatcacaagastagctaacatatactgaatgctta

SEQ ID NO: 76648 - DNA, 50 bp, homo sapien
gagacaaagagtaggaatgtaaacastatatgcctgtgtctcatatccat

SEQ ID NO: 76649 - DNA, 50 bp, homo sapien
agtcatacatctaagaaatacattgmaattttagctaaaattcttcccac

SEQ ID NO: 76650 - DNA, 50 bp, homo sapien
tgtaggtgctcaataaatgttactgmatgttgaatgtgttccatgcccaa

SEQ ID NO: 76651 - DNA, 50 bp, homo sapien
caacaaataaataataaactaataarcccttcaaggtaagtatcatgtag

SEQ ID NO: 76652 - DNA, 50 bp, homo sapien
ttagcacagctctgtggcactcattwatagagtctgcactcatgtttgtt

SEQ ID NO: 76653 - DNA, 50 bp, homo sapien
gactgtggtccatcaagccagaatgwctctgaactttctgtagcaataca

SEQ ID NO: 76654 - DNA, 50 bp, homo sapien
ggcatgattaattcaatagtggcacyaccaaaaaaagagcaacaattact

SEQ ID NO: 76655 - DNA, 50 bp, homo sapien
ttttccagattaatttatgaacatcsgaatgaatgagtctgcgcactgat

SEQ ID NO: 76656 - DNA, 50 bp, homo sapien
tctgaaacgtttaggaactgtcaacrattaacttagggaaatacttcctc

SEQ ID NO: 76657 - DNA, 50 bp, homo sapien
ggggtgtcatttagagaattgggaaycactcaagggagttcgttctgtag

SEQ ID NO: 76658 - DNA, 50 bp, homo sapien
aaagatatggaggtatgagagttagsacatgaccattagatctactggcc

SEQ ID NO: 76659 - DNA, 50 bp, homo sapien
aaaattgttcaagtaacagaagaaamcgaatctgttctctagaaggcagg

SEQ ID NO: 76660 - DNA, 50 bp, homo sapien
atcaaaggaaaattattgcatcttgyaccttctgtcactaataagaaaga

SEQ ID NO: 76661 - DNA, 50 bp, homo sapien
cccctcccttagtttttacagtcaasccttgcagaaagtaaatgttcatc

SEQ ID NO: 76662 - DNA, 50 bp, homo sapien
agatgcgataatggaagcggaatcaragacagatttgaagatgctgctgt

SEQ ID NO: 76663 - DNA, 50 bp, homo sapien
ctagacagccgtggagccctatttcrcattgttgcttagttatccaccag

SEQ ID NO: 76664 - DNA, 50 bp, homo sapien
gtggtatacagacatgttccttttargcccacacctggggaacctcaaag

SEQ ID NO: 76665 - DNA, 50 bp, homo sapien
tctatatccttggactatttataaaygcaagctgtagttagaagacaaac

SEQ ID NO: 76666 - DNA, 50 bp, homo sapien
atgctttatcatcactaaatatccartcaatttacagagtaatgaggact

SEQ ID NO: 76667 - DNA, 50 bp, homo sapien
cccgaggccaccaggctgtctctcaytcttcaggattctcagagacagtc

SEQ ID NO: 76668 - DNA, 50 bp, homo sapien
gaacttggctcaaacgtggcaacackgcaggactgtggtccatcaagcca

SEQ ID NO: 76669 - DNA, 50 bp, homo sapien
tggtgattacgtagctaatggggtaytaacgcttcattaaggctttacag

SEQ ID NO: 76670 - DNA, 50 bp, homo sapien
tgttacaaaatgaacacactcttatyagacagtccagcaattgtgcaccc

SEQ ID NO: 76671 - DNA, 50 bp, homo sapien
tgcctctcattcttgaacaggtccasataaaaaagactctccattcaaac

SEQ ID NO: 76672 - DNA, 50 bp, homo sapien
aaaaggcaagataccaaaatatctgraaaacataggggaaagagaaagac

SEQ ID NO: 76673 - DNA, 50 bp, homo sapien
ttacaacagttttctttattcctgayattgttgtaaatcttgctgtaaaa

SEQ ID NO: 76674 - DNA, 50 bp, homo sapien
aagcaggctcttaagatctaggtccrcatggtgtctcgtcagaagtggat

SEQ ID NO: 76675 - DNA, 50 bp, homo sapien
ttgctctaatgcagcagaaaggctaygaaatgaaatgggaactccaagga

SEQ ID NO: 76676 - DNA, 50 bp, homo sapien
aatgtgtaccattaaagctacatgayatttgctgtattatagccaattta

SEQ ID NO: 76677 - DNA, 50 bp, homo sapien
tgcacagcagtatagggtaccagtcmgagtcatgaggccccctttccagg

SEQ ID NO: 76678 - DNA, 50 bp, homo sapien
agtctgagattgtgccataccctcaygcttctatttgatccttttgtgcc

SEQ ID NO: 76679 - DNA, 50 bp, homo sapien
agtttatctagtttatcatgctcccrttgtgaacttcatgccatccttac

SEQ ID NO: 76680 - DNA, 50 bp, homo sapien
ggtcctccaggatgctgctatgtcakgccccacagactggtaccctcaca

SEQ ID NO: 76681 - DNA, 50 bp, homo sapien
acaggaagccaaattaaaaattaggyaagcagtcactgtttgtttacatt

SEQ ID NO: 76682 - DNA, 50 bp, homo sapien
atacatactgcatatttaatctatarcccgtatcttgtctatctagaata

SEQ ID NO: 76683 - DNA, 50 bp, homo sapien
taccataagtagattaggaattgtcwaagagttttaatgtccttaagtgt

SEQ ID NO: 76684 - DNA, 50 bp, homo sapien
aattattcacatggtctggctaatakagagctcgtggtataccataagta

SEQ ID NO: 76685 - DNA, 50 bp, homo sapien
ggcatttgagatgatttctgcctaakaacataaaagcctctggtcatatc

SEQ ID NO: 76686 - DNA, 50 bp, homo sapien
ccagaaaacagaaaacaaattcgtgmacaatgtggaacagtcatctcttt

SEQ ID NO: 76687 - DNA, 50 bp, homo sapien
tttcttaatttgggccagactgatakgaccagaggcttttatgttcttag

SEQ ID NO: 76688 - DNA, 50 bp, homo sapien
attattgagatcctttgccgtaaaartgatttccttatattttctagaaa

SEQ ID NO: 76689 - DNA, 50 bp, homo sapien
aaaaacaggcattgcaagctgtagartaagcctcacatgggccttcagac

SEQ ID NO: 76690 - DNA, 50 bp, homo sapien
cagattcatgtgtgaaacttcagatkagctttcgggagccttgtgttaat

SEQ ID NO: 76691 - DNA, 50 bp, homo sapien
ttcagatatgtattattgctcctcayaagcttaaaatcccttatctggct

SEQ ID NO: 76692 - DNA, 50 bp, homo sapien
agtatggctgggtattattttgatasagattacaattactattactattt

SEQ ID NO: 76693 - DNA, 50 bp, homo sapien
tatttgaggtggtgctgcattttgtsaaacattcatgcgtgttagcccac

SEQ ID NO: 76694 - DNA, 50 bp, homo sapien
agccacgtgagcactggaggctagartacccacattgcagatgccactgg

SEQ ID NO: 76695 - DNA, 50 bp, homo sapien
atctgttgggagactgtcttcctatwcattttcagaaaggcagtttaaca

SEQ ID NO: 76696 - DNA, 50 bp, homo sapien
tctacttggaattttactatcctacygcaaacaagctgtcttttgtagat

SEQ ID NO: 76697 - DNA, 50 bp, homo sapien
tattctagaatgcaaggttggttcartatcagaaaatcatttagtgtagc

SEQ ID NO: 76698 - DNA, 50 bp, homo sapien
ccttatccatggttttgctttctgakattttgattacccacagtcaactg

SEQ ID NO: 76699 - DNA, 50 bp, homo sapien
ttaatggcagagagtagagtccagayataaattcatgcctataagggcaa

SEQ ID NO: 76700 - DNA, 50 bp, homo sapien
gttccccactctggaatgcgctgccyactggctccttcacaagggagggt

SEQ ID NO: 76701 - DNA, 50 bp, homo sapien
catgaatatactttgtctttgtgacwatcaaccagcttgtatgaaaatat

SEQ ID NO: 76702 - DNA, 50 bp, homo sapien
gtgcccctttctgggggagagataartggaagtaggatcactcagttttc

SEQ ID NO: 76703 - DNA, 50 bp, homo sapien
cacgttagggaggagggttacaagaygacaaaaatcctcagtttcttaat

SEQ ID NO: 76704 - DNA, 50 bp, homo sapien
gcccacaatgaggtaagtatagaaaytgagattaataagcacacaaatta

SEQ ID NO: 76705 - DNA, 50 bp, homo sapien
gaaagggaaatagatttgaggatctraagtacaagcaacatcacagagga

SEQ ID NO: 76706 - DNA, 50 bp, homo sapien
agacatttttggtagaagcttaactyaaaaggatttcagaaggaagtttt

SEQ ID NO: 76707 - DNA, 50 bp, homo sapien
taatatttctttaatgtttgcttcayctgtgatcattgtgcatccccaat

SEQ ID NO: 76708 - DNA, 50 bp, homo sapien
aaataatggtgaacttttgaggacaratattccgcagccataattagctt

SEQ ID NO: 76709 - DNA, 50 bp, homo sapien
ctgtgataagctagagagcatggacwatctgaagcaactaaacatcgttt

SEQ ID NO: 76710 - DNA, 50 bp, homo sapien
ctttgggagaatgggcagtaagtcaycattctgtaatatcatcccatatc

SEQ ID NO: 76711 - DNA, 50 bp, homo sapien
atgtgcatctgcataaagtctactamattaaagaccaaaagggctggctt

SEQ ID NO: 76712 - DNA, 50 bp, homo sapien
atacctagcagaattaacaatctcartcctaatcacatagttatcacacg

SEQ ID NO: 76713 - DNA, 50 bp, homo sapien
acaattcaggtcctcagaacagatcrcaggtatgggacgtgtgataacta

SEQ ID NO: 76714 - DNA, 50 bp, homo sapien
ccttttcatttctattgttcttggasgcataaacaaaaaatattcaaaga

SEQ ID NO: 76715 - DNA, 50 bp, homo sapien
aacagcatatatatgcaagattagayctcccctgtaaaggaggtagctgg

SEQ ID NO: 76716 - DNA, 50 bp, homo sapien
tacttttatccagtagaaacataaaygccataataattacatgagactga

SEQ ID NO: 76717 - DNA, 50 bp, homo sapien
acagagcatgtctcatgggattcctrtaagcattgtattggatgatgctg

SEQ ID NO: 76718 - DNA, 50 bp, homo sapien
aggcaaagattgagagtaactgttgrgactaaggtttagaaaaggtgatt

SEQ ID NO: 76719 - DNA, 50 bp, homo sapien
acaaaagttctgctgtaagtacatcracggcaaggatcacatcttctctg

SEQ ID NO: 76720 - DNA, 50 bp, homo sapien
ccacttagcaactgaatggctttaasgatcattttcatcaattgtaaaat

SEQ ID NO: 76721 - DNA, 50 bp, homo sapien
agtggtctctggacagcagaatgcaygtggatgttggagttgccagatct

SEQ ID NO: 76722 - DNA, 50 bp, homo sapien
gccactggcagctccatgttctacaytgtaaaaatttcaccaccaaatca

SEQ ID NO: 76723 - DNA, 50 bp, homo sapien
gagattggggcaaaatatgtgcctgmaagagccggaattagtgtcatcta

SEQ ID NO: 76724 - DNA, 50 bp, homo sapien
ctttcacctgcaacaccaggctttayctgtatcactcgtatttctcggac

SEQ ID NO: 76725 - DNA, 50 bp, homo sapien
caagacggagctgcgtttcaacagayggtgctttcaatctgtgctgactg

SEQ ID NO: 76726 - DNA, 50 bp, homo sapien
agaaaataactaataattcaaatgakaagcatccttgtgcaatggaaagg

SEQ ID NO: 76727 - DNA, 50 bp, homo sapien
tcctgaaaattatactttttaataaracctctgagaacaaatgctggttt

SEQ ID NO: 76728 - DNA, 50 bp, homo sapien
cttactagaaatggaaacaaacaaargcttactctacaaaaaggaggaaa

SEQ ID NO: 76729 - DNA, 50 bp, homo sapien
agataggtgtaatttagtcaattaayatggagagtcaaaaaagtaaccat

SEQ ID NO: 76730 - DNA, 50 bp, homo sapien
aattattttccactaacggtgaaacrctaaatggacgacttcttatttat

SEQ ID NO: 76731 - DNA, 50 bp, homo sapien
cgtgtttgatcttctaattgcctcargacatatacacaggtttgctttat

SEQ ID NO: 76732 - DNA, 50 bp, homo sapien
ctagagcaccactgtaagtatcccaygaagataaaaagtatctccctctc

SEQ ID NO: 76733 - DNA, 50 bp, homo sapien
ttaatagacatgttttctggtgacaygtattgcctctaacatcttaaagt

SEQ ID NO: 76734 - DNA, 50 bp, homo sapien
aaaataatgttatataatgatgatcycatgtgtgtaaaactctagaaaat

SEQ ID NO: 76735 - DNA, 50 bp, homo sapien
atgagcaggcatctgctttcaccaartcttgcatcgccaggggcagatgg

SEQ ID NO: 76736 - DNA, 50 bp, homo sapien
tttaataataattgtgggcaataacmatgctctttgaattttgaaaagta

SEQ ID NO: 76737 - DNA, 50 bp, homo sapien
acccttcagggagggctccagcgagkttctaaaccaagttcagctggtaa

SEQ ID NO: 76738 - DNA, 50 bp, homo sapien
tcagtaagaaaacatacatgtgaaaraagagaaatgatgagtccgaggcc

SEQ ID NO: 76739 - DNA, 50 bp, homo sapien
tctagtgagagacatcagattaaaartagctgccttcagaaataaaagaa

SEQ ID NO: 76740 - DNA, 50 bp, homo sapien
gcctatggaatatccagcgatgtgcyacttacaggaatggaaactcctgg

SEQ ID NO: 76741 - DNA, 32 bp, homo sapien
ttgaaagaatgaataayaaattgtgcaagaca

SEQ ID NO: 76742 - DNA, 50 bp, homo sapien
tttcaaccacctctttgtttgcctgsatcaagtaacaactcagtgtggtg

SEQ ID NO: 76743 - DNA, 50 bp, homo sapien
gttttggcagtgactgtactatgacyagcagacatcaaaacatccactga

SEQ ID NO: 76744 - DNA, 50 bp, homo sapien
caatatttccatttttattttctacygctatgtcaatcacaatgcatcta

SEQ ID NO: 76745 - DNA, 50 bp, homo sapien
gtttattgatctattagccgatatakaatccttttactcctttttgtttg

SEQ ID NO: 76746 - DNA, 50 bp, homo sapien
ataaaatggttttatgctgtgggatragactcactctttaaaaattttct

SEQ ID NO: 76747 - DNA, 50 bp, homo sapien
gtcagaactctgggaaattctggaakgttttatttgataatgctatagtc

SEQ ID NO: 76748 - DNA, 50 bp, homo sapien
tgctgggcttaatacctaggtgataygctgttaggtgcggcaaaccatca

SEQ ID NO: 76749 - DNA, 50 bp, homo sapien
ccttgccctcatctaatgcaaagtaycataaatttacaagactttaatga

SEQ ID NO: 76750 - DNA, 50 bp, homo sapien
tgtgaaaatatttctgccttgaaaawctatttttacttcaagtatatgat

SEQ ID NO: 76751 - DNA, 50 bp, homo sapien
taaggtcgactaggttggtaagtccmaaggagagaccggtttaataaaag

SEQ ID NO: 76752 - DNA, 50 bp, homo sapien
attctgctttctttatttttggcaascttttcctctttctcattagtttt

SEQ ID NO: 76753 - DNA, 50 bp, homo sapien
cactaatataaaacatccagaaaaasgtgtatccatagagacggaaagta

SEQ ID NO: 76754 - DNA, 50 bp, homo sapien
ccacctacccccaccatacttcctcytattctcttactcccctgcaacta

SEQ ID NO: 76755 - DNA, 50 bp, homo sapien
aataaatcattactcttcacctatawgtagaagttcttaagtatttgttg

SEQ ID NO: 76756 - DNA, 50 bp, homo sapien
ccaaaacacaaataacaagaaagtaygccaatatcaaatcataaaagaaa

SEQ ID NO: 76757 - DNA, 50 bp, homo sapien
cctttcaaacattgcacatgggagtraaaatgcatgtcctaatgaaaaac

SEQ ID NO: 76758 - DNA, 50 bp, homo sapien
attccgcagccataattagctttaaragaaatccatttggtatgcatttg

SEQ ID NO: 76759 - DNA, 50 bp, homo sapien
gtgtaatggattcttcttgcaaaaartactaaataatctggttgggctct

SEQ ID NO: 76760 - DNA, 50 bp, homo sapien
cattacttgtatttgttcaacaacawacttatcctgaatatctgttgtgt

SEQ ID NO: 76761 - DNA, 50 bp, homo sapien
agtgccagagactctctgtaacttayactggtccagattaaactctccag

SEQ ID NO: 76762 - DNA, 50 bp, homo sapien
acagcatcctctctaaacttgcctaygagtttcctagaagcctgaatcaa

SEQ ID NO: 76763 - DNA, 50 bp, homo sapien
catctcagatgactttaaggccaaamaaagtgggcaaggaaatctcacac

SEQ ID NO: 76764 - DNA, 50 bp, homo sapien
gctacagtagttctgtatgaactaaytgaaatgccagacgtcgagtcagt

SEQ ID NO: 76765 - DNA, 50 bp, homo sapien
aggtaggtcacatgttcacctgctcragttctgttacagtattgaaatat

SEQ ID NO: 76766 - DNA, 50 bp, homo sapien
accaccgactctctcactcagttaayggatcccaacaaatgaacaaaatt

SEQ ID NO: 76767 - DNA, 50 bp, homo sapien
ctgcactggccatgaagtagcatgayagcatgaaaatagcaaagaggaca

SEQ ID NO: 76768 - DNA, 50 bp, homo sapien
gagattggtatgtgatagtagagagsaactcagttgagaccaagtcctgt

SEQ ID NO: 76769 - DNA, 50 bp, homo sapien
cttccctctgagagctggctagaaayctttcctcagtcatctgcagcaat

SEQ ID NO: 76770 - DNA, 50 bp, homo sapien
tggagattatcttgttctgaagaacsaacattatgagttttatcattatt

SEQ ID NO: 76771 - DNA, 50 bp, homo sapien
acaaaataattcaaaaaaggaataartacctatcaaagtgagactgggta

SEQ ID NO: 76772 - DNA, 50 bp, homo sapien
ggaattctggagcaggaatgtaattyaaggaccaatgcatatctgtaggt

SEQ ID NO: 76773 - DNA, 50 bp, homo sapien
ttggcatttatgaagaaagtttcccraaagtttagatgattctgatgcga

SEQ ID NO: 76774 - DNA, 50 bp, homo sapien
acacagtcagtgccacagaaataaayggaagggaaacagagttctcggga

SEQ ID NO: 76775 - DNA, 50 bp, homo sapien
accatagtgaccccagatcgttctcrcttccaagtcccatgcaaaaaaga

SEQ ID NO: 76776 - DNA, 50 bp, homo sapien
tggtacctacagctaaaaatgtgaawgatagggccaaaatctagatgatg

SEQ ID NO: 76777 - DNA, 50 bp, homo sapien
agtaagttctttatttttatttaccrcactgattatataatatcccctat

SEQ ID NO: 76778 - DNA, 50 bp, homo sapien
aagggatttaaaagacttagtagaargagaagacttggagttttgtcttg

SEQ ID NO: 76779 - DNA, 50 bp, homo sapien
actgcgtaatgcaggcacaaagcaartctgtgagaaggtaggtaggtatg

SEQ ID NO: 76780 - DNA, 50 bp, homo sapien
gggcagcatctcagttgtatgtaaakcttcagaaagttcatgcaccccaa

SEQ ID NO: 76781 - DNA, 50 bp, homo sapien
gaagattgaaagacaaagacaaaccycaggaggaagattgaaagacaaag

SEQ ID NO: 76782 - DNA, 50 bp, homo sapien
agaaagaagaggggattaacaagcayggaagctaagtaacagcttcataa

SEQ ID NO: 76783 - DNA, 50 bp, homo sapien
tgtaggtaggaaaatgcttgggagtracctgattagaagagggtaggcct

SEQ ID NO: 76784 - DNA, 50 bp, homo sapien
attctatctcactaaagacattaagragcaacgttgcctaatgaaatcca

SEQ ID NO: 76785 - DNA, 50 bp, homo sapien
gggtttgtttcaatactgatccataraaggacatctggtatatttccact

SEQ ID NO: 76786 - DNA, 50 bp, homo sapien
caatattaaggctttccaactataawtacaagatgtctttccttttattt

SEQ ID NO: 76787 - DNA, 50 bp, homo sapien
aaagtgctgggttgatctctatttaygcttttcttaaacacacaaaatac

SEQ ID NO: 76788 - DNA, 50 bp, homo sapien
gaattcttatcctttatctaatcttkaacactctctctcatactggggag

SEQ ID NO: 76789 - DNA, 50 bp, homo sapien
tcaaagccactctacttgacatacayatgagcttgacaataaaattcctt

SEQ ID NO: 76790 - DNA, 50 bp, homo sapien
aagcatacataccacatcttctggtraacaactcagcctatctgtttttg

SEQ ID NO: 76791 - DNA, 50 bp, homo sapien
ggattaggaaaggtgaagtgaaaaasttattataatccaagattgtgaat

SEQ ID NO: 76792 - DNA, 50 bp, homo sapien
tttctcttgcatttccatgttaaccytactaccacattcttcccagaaag

SEQ ID NO: 76793 - DNA, 50 bp, homo sapien
aggccctaaaaacatgcactcatatracttttccatttcttagctcattt

SEQ ID NO: 76794 - DNA, 50 bp, homo sapien
catttttcctcttgatatattccaartgtaccccctgtcacatagaacaa

SEQ ID NO: 76795 - DNA, 32 bp, homo sapien
agtggattttaaatatrctacacctcagggac

SEQ ID NO: 76796 - DNA, 50 bp, homo sapien
attgatttcctagatttatttgaaarggaaggatagcactcaattagaca

SEQ ID NO: 76797 - DNA, 50 bp, homo sapien
cccctactgtattcacatttaagaayatagcgctaaatagatgcacaggc

SEQ ID NO: 76798 - DNA, 50 bp, homo sapien
tccccagagccttctcttgtgttcgscatctaccgcagcgggggctgctg

SEQ ID NO: 76799 - DNA, 50 bp, homo sapien
tttttttccagaattccactgttggraatgtgtcttaaggatatgtgaaa

SEQ ID NO: 76800 - DNA, 50 bp, homo sapien
atcttgagtctccaaatctgtgctayggagacttctttattttgaggtgc

SEQ ID NO: 76801 - DNA, 50 bp, homo sapien
tatgtacttttctatgttcttaatcygagtagatgatggcctgccacgac

SEQ ID NO: 76802 - DNA, 50 bp, homo sapien
tagcacgcccattcagtcgttgccakgttccacactcctccactctgaaa

SEQ ID NO: 76803 - DNA, 50 bp, homo sapien
ggggtgatcacatgatattattgcaygaaagggtaaatgaacagataaat

SEQ ID NO: 76804 - DNA, 50 bp, homo sapien
ctctctccagcacctctagccattcrccctactgatggctgcatcgtcct

SEQ ID NO: 76805 - DNA, 50 bp, homo sapien
ggaagaagagagggaagaaccaatayggtaatggcatgtgagttgagcct

SEQ ID NO: 76806 - DNA, 50 bp, homo sapien
agtagaggtggatttagttttctgaygtattgaaatttaagcagattgag

SEQ ID NO: 76807 - DNA, 50 bp, homo sapien
cagcactgaatataaacagcacttastaaaaaagtatgagtgatttcaat

SEQ ID NO: 76808 - DNA, 50 bp, homo sapien
agaatttctagatgtaatgaccctcyaagcatcttaatagttaatttggg

SEQ ID NO: 76809 - DNA, 50 bp, homo sapien
cataaatatgagttacactttcacaygctgctatagaaatttgattacta

SEQ ID NO: 76810 - DNA, 50 bp, homo sapien
ttgcaaatatttccacactggaatakatacttaacgtgaatttggatttg

SEQ ID NO: 76811 - DNA, 50 bp, homo sapien
gtggaaatatttgcaacctctatctyagacggatttcagagttattatcc

SEQ ID NO: 76812 - DNA, 50 bp, homo sapien
ctgagattgtaaggattatgtgtaartgtgaaagaagagataattatgtt

SEQ ID NO: 76813 - DNA, 50 bp, homo sapien
aactttctaattggaagagtccatckaatgctaagcaggataaatgaaaa

SEQ ID NO: 76814 - DNA, 50 bp, homo sapien
ctaaaactgtcccaggtgattttaakgcaggaggtcctgagtttgaaaat

SEQ ID NO: 76815 - DNA, 50 bp, homo sapien
aatatcatgactgaatataacaaaayaaatgtaggattagaatataaact

SEQ ID NO: 76816 - DNA, 50 bp, homo sapien
atggcttaaattaattccttgcaaamgcactttctgtacgtgacaaacag

SEQ ID NO: 76817 - DNA, 50 bp, homo sapien
tgcaggatctaaatcaacagtgaaawagggtactgctgtgattttactca

SEQ ID NO: 76818 - DNA, 50 bp, homo sapien
agatgtttcagcatctctgactctcrctgatatttattaacgtactaact

SEQ ID NO: 76819 - DNA, 50 bp, homo sapien
ttcaagatgatgctttgactttccargttggggattgaataagctcacag

SEQ ID NO: 76820 - DNA, 50 bp, homo sapien
ggtctagttgtggaaacattttccartctgaagatcacatttccttctct

SEQ ID NO: 76821 - DNA, 50 bp, homo sapien
tcattctctgggcaaccatgatgttygtgttgcaatttgtacttaggtct

SEQ ID NO: 76822 - DNA, 50 bp, homo sapien
attgtggtcactcatgtacttacacygtcgaagccacccccaacacaggg

SEQ ID NO: 76823 - DNA, 50 bp, homo sapien
tagtttctccttccttatacagataygtgaactgaaatgatgcctccatc

SEQ ID NO: 76824 - DNA, 50 bp, homo sapien
ccacttgaattgtgtttaaaagccaratatccaggttcctctcgcccatg

SEQ ID NO: 76825 - DNA, 50 bp, homo sapien
gcatgtaatctaatatttctgtaaamctaagttgctttcaaacttttgct

SEQ ID NO: 76826 - DNA, 50 bp, homo sapien
attgaataggaagagtgttcttcaargctgaacaaaagtgaaggtaaggg

SEQ ID NO: 76827 - DNA, 50 bp, homo sapien
ttaggaaattatctgaagtaacacayggtgaatggactcccaccttctaa

SEQ ID NO: 76828 - DNA, 50 bp, homo sapien
ggaacagtcatcatttttgatttggmcaatttaattgatatggtttcagt

SEQ ID NO: 76829 - DNA, 50 bp, homo sapien
cagattttgatcaacatgaattagtwaagccatataactattttttaggt

SEQ ID NO: 76830 - DNA, 50 bp, homo sapien
aaagcaattagcgtgaaagagaagasctaagatgaacaaatgtccagcat

SEQ ID NO: 76831 - DNA, 50 bp, homo sapien
aacagaaaaagacacctgtgtacagraatagaaatgttcagtatcacagg

SEQ ID NO: 76832 - DNA, 50 bp, homo sapien
ccacttccatgaatcaaagacagaarggagtcaagatggctgctgaaaga

SEQ ID NO: 76833 - DNA, 50 bp, homo sapien
ggttaaaagacttaacatagcaaaamtactaagcatcagagtgttcatcg

SEQ ID NO: 76834 - DNA, 50 bp, homo sapien
accatatttttctgtattactcttgyagttgtttacttgttgagtgttgt

SEQ ID NO: 76835 - DNA, 50 bp, homo sapien
caagtgaccatgggagtcaagagaargaacaatgtcagagctacttccca

SEQ ID NO: 76836 - DNA, 50 bp, homo sapien
gttggaaacccagatccactcctcawagctctccacagaggcctgactgc

SEQ ID NO: 76837 - DNA, 50 bp, homo sapien
caaacaagattaaactgtttctgtcratttctttctttcttttttctttt

SEQ ID NO: 76838 - DNA, 50 bp, homo sapien
ttccccttcctattaggccaacatgmgtgcactgatgcctctcccctgag

SEQ ID NO: 76839 - DNA, 50 bp, homo sapien
gtgagttttcaaaattttatcagtamcaggatgttgggtttcagataccc

SEQ ID NO: 76840 - DNA, 50 bp, homo sapien
tccaaatgcccccaaccatatgaaaygtgtaagtattataataaaaaatg

SEQ ID NO: 76841 - DNA, 50 bp, homo sapien
aatttttgtatattaaaccatgcaaygactatcttcagaatgtgcctctc

SEQ ID NO: 76842 - DNA, 50 bp, homo sapien
gttcattgctcattagttactaacamcttgccgcagggtgatcccatctc

SEQ ID NO: 76843 - DNA, 50 bp, homo sapien
gtcttttacttgttagagcaataaasattcttcaaactcaatgttcttct

SEQ ID NO: 76844 - DNA, 50 bp, homo sapien
ttgaaaaacactggctaaggtatgcyagaaaaatgaggtttttctaatca

SEQ ID NO: 76845 - DNA, 50 bp, homo sapien
aaactggtcatattattctctaaaamagtctccgttcattaattggcctg

SEQ ID NO: 76846 - DNA, 50 bp, homo sapien
tcttagatttggccctagtctctaakaattcccagagattcttgagatat

SEQ ID NO: 76847 - DNA, 50 bp, homo sapien
tgggcagcagctacagtctcagttcrggtcttctagctttagctgtgcta

SEQ ID NO: 76848 - DNA, 50 bp, homo sapien
attcatcaaaattaaaaacttttgcyctaagacagacactattcagagaa

SEQ ID NO: 76849 - DNA, 32 bp, homo sapien
attgaatttttgttttmgtaggcagctaattt

SEQ ID NO: 76850 - DNA, 50 bp, homo sapien
aaactaaaaattatacaacttagctractcatttaggaaattgcagccac

SEQ ID NO: 76851 - DNA, 50 bp, homo sapien
ctgtagttggaaatataataaagaaygaacatctgcatctgttactagtt

SEQ ID NO: 76852 - DNA, 50 bp, homo sapien
cctgacaccgacttcttagagaagckagtcttttttgaatggaggagcga

SEQ ID NO: 76853 - DNA, 50 bp, homo sapien
cagggacatcacctctctgatcttcrctcctctaaatgatctctaagggc

SEQ ID NO: 76854 - DNA, 50 bp, homo sapien
tttagtagctctgggtgcaaatgtaygatccaccattccgtgtgctactg

SEQ ID NO: 76855 - DNA, 50 bp, homo sapien
tgctattcttcacaatcaggatcacrcatatagagtacatcacaaacaat

SEQ ID NO: 76856 - DNA, 50 bp, homo sapien
tgagatatagaatgatgagcactctyaatatattttcacttggaatcttc

SEQ ID NO: 76857 - DNA, 50 bp, homo sapien
ctaacactaacatcttacccaactaygtgcatttatcggaacgaggaagg

SEQ ID NO: 76858 - DNA, 50 bp, homo sapien
tactatcaccaccatttcaaccactkaatagctctatctattcttgggtc

SEQ ID NO: 76859 - DNA, 50 bp, homo sapien
cactggactgtaggcaccaaggggayagttcctgacatttagaaggctta

SEQ ID NO: 76860 - DNA, 50 bp, homo sapien
tccatcaaggaagtggcaacggagckgacatcgtaaaggtgagaagtgga

SEQ ID NO: 76861 - DNA, 50 bp, homo sapien
atattgttgcctctagctcacaacarcttaccagtaattctgaagaagtg

SEQ ID NO: 76862 - DNA, 50 bp, homo sapien
ctgtcacttcctccatctccgaacayatccttacattctaagatccagct

SEQ ID NO: 76863 - DNA, 50 bp, homo sapien
tttaggatgagagaaggttgtaatcraagggctaaaggaatactagtgca

SEQ ID NO: 76864 - DNA, 50 bp, homo sapien
ataaggggccgtttcccagactacawagttacagtgttgaattaaacatt

SEQ ID NO: 76865 - DNA, 50 bp, homo sapien
aacctagtctttgctgaggacaagayatgttgacaaacccaggcacaagg

SEQ ID NO: 76866 - DNA, 50 bp, homo sapien
ggtggtacatatgaagcagaaatacrcagacctagcaggtgaatcagttc

SEQ ID NO: 76867 - DNA, 50 bp, homo sapien
tgacttccatgtaccaagacaaggaygctatagctagggtagtgagacct

SEQ ID NO: 76868 - DNA, 50 bp, homo sapien
cagcttcctactgactgctcacaacmaaagttcctttgttctacctctaa

SEQ ID NO: 76869 - DNA, 50 bp, homo sapien
tccggacctcagggtttggctgccasttgcttataaatagatatttgaca

SEQ ID NO: 76870 - DNA, 50 bp, homo sapien
tctcggacataggcttagcaatctgyagtttcacccctcgccaggtaatt

SEQ ID NO: 76871 - DNA, 50 bp, homo sapien
ttcaaccttggctgcacattgtattsaccttgggagctttaaaaaaaata

SEQ ID NO: 76872 - DNA, 50 bp, homo sapien
agagggttcttggctttgcccaggarataattcaagggtaagcagtggtg

SEQ ID NO: 76873 - DNA, 50 bp, homo sapien
agatggacttctttggaggggtcacrcatttattcagaaagtcagagagt

SEQ ID NO: 76874 - DNA, 50 bp, homo sapien
agctcataatgagtactttgccaaawtatagggattagaaaaaatattaa

SEQ ID NO: 76875 - DNA, 50 bp, homo sapien
ggactggcgtccaacagtagagacaygggctgtagtcggaagctgaaacg

SEQ ID NO: 76876 - DNA, 50 bp, homo sapien
gagaggtgtgggtcaaaccactttargcaatttttctcttcaccaaagaa

SEQ ID NO: 76877 - DNA, 50 bp, homo sapien
aattagtgcaacggagaagataccasgtaaaacagccatccctgcctttg

SEQ ID NO: 76878 - DNA, 50 bp, homo sapien
gtgattttaagggccacgtgcactaygcgaaaaagagttagctttgaaaa

SEQ ID NO: 76879 - DNA, 50 bp, homo sapien
gggggacacgttcaaaccatagcacsaggtatctgggccactgagccctc

SEQ ID NO: 76880 - DNA, 50 bp, homo sapien
aggctcaacatttcaatgttctaackcacacacaaataaaatggttttat

SEQ ID NO: 76881 - DNA, 50 bp, homo sapien
tattgtcacttctttcatatttcaastactattacagaactatttaggag

SEQ ID NO: 76882 - DNA, 50 bp, homo sapien
taatgggttatacatttaaatctgaygcaaaggttaatcgatgcacactt

SEQ ID NO: 76883 - DNA, 50 bp, homo sapien
gatacagtgctgagcattttacataygtgattattgactagccctgtgga

SEQ ID NO: 76884 - DNA, 50 bp, homo sapien
cagtttaatgaaaaactcattagaaygtagcatacggcataattaattct

SEQ ID NO: 76885 - DNA, 50 bp, homo sapien
ggttgaaagcttctgctcaaaggagrattaatttaatctatttaactact

SEQ ID NO: 76886 - DNA, 50 bp, homo sapien
ggtgcatcacactaagcacattataracattagcttgctaagcccacaac

SEQ ID NO: 76887 - DNA, 50 bp, homo sapien
ttctgtagcaagtgtgtccagggaasgtagctccccatcagcctctagag

SEQ ID NO: 76888 - DNA, 50 bp, homo sapien
aaaggggtggtgattggtgatgagcyaatttagtacctactgccaatgta

SEQ ID NO: 76889 - DNA, 50 bp, homo sapien
tgagcaggaaattgattcatgagacrgagcctgtgaacacacattcaaaa

SEQ ID NO: 76890 - DNA, 50 bp, homo sapien
ggaacacaggaatttacaagcctacrgaacttacagaacagggtgcaata

SEQ ID NO: 76891 - DNA, 50 bp, homo sapien
agtaagatgagaaggctctaaactayacagtgagtaggcttgtccaggct

SEQ ID NO: 76892 - DNA, 50 bp, homo sapien
gtacagtttcaatttgcttagaagcktaaggtttatccatagcctcctcc

SEQ ID NO: 76893 - DNA, 50 bp, homo sapien
agtttaacagaatgagagagaaatamccaccatggttctaacctgtttta

SEQ ID NO: 76894 - DNA, 50 bp, homo sapien
tatcagaagtatttcgagtcactatraacatttacgagctattcactttt

SEQ ID NO: 76895 - DNA, 50 bp, homo sapien
tgtttctccacatcctagtattccartaagataaaatcaaatatcttctt

SEQ ID NO: 76896 - DNA, 50 bp, homo sapien
ctaccagaacccattgcagaaagaamaaggtgcaattttagtactatatt

SEQ ID NO: 76897 - DNA, 50 bp, homo sapien
caaggattcttttcaaaagattaccsaaagaagattaacttgtttatcat

SEQ ID NO: 76898 - DNA, 50 bp, homo sapien
gtgtttgtcaattgagaatcagcaaygaagaggtgtaagagttgactgtt

SEQ ID NO: 76899 - DNA, 50 bp, homo sapien
gaagaaccaaacagaacatgaatgayggacatgtcaccaaagtacttcca

SEQ ID NO: 76900 - DNA, 50 bp, homo sapien
gaacccaatctgcagggttgctgaayagttgataatctgctcctaagtct

SEQ ID NO: 76901 - DNA, 50 bp, homo sapien
tttcttccactatttaaagttcctgyattacaccgtgagcgtaataccac

SEQ ID NO: 76902 - DNA, 50 bp, homo sapien
atggtagcttctattaatgaatatastaaatgcaatgatgaatgtgtttt

SEQ ID NO: 76903 - DNA, 50 bp, homo sapien
tgactaatacatctctttaaacatayattagagagaggtgcagagagtgt

SEQ ID NO: 76904 - DNA, 50 bp, homo sapien
cacaccattcccacattatgtcatastatcacattataaacactttcaca

SEQ ID NO: 76905 - DNA, 50 bp, homo sapien
ctgtttgtctctgcctaccttgagartcacctttgcctgcataggggtaa

SEQ ID NO: 76906 - DNA, 50 bp, homo sapien
aagtgaaaggctctgacacactctayggtggaaaacacattcatcattgc

SEQ ID NO: 76907 - DNA, 50 bp, homo sapien
ttcaagcagcctgatatacataattmaaggattcaaaggagagaaggggg

SEQ ID NO: 76908 - DNA, 50 bp, homo sapien
cagaatcaagcttccaagcccgataytatattgctggtcccaccagggag

SEQ ID NO: 76909 - DNA, 50 bp, homo sapien
gtaggtgctcaataagtgtttatggmatggttgaaagaacaaatgatatg

SEQ ID NO: 76910 - DNA, 50 bp, homo sapien
aaggttgtcgtgacaaagtaattaayggcattttttgactttcagatgac

SEQ ID NO: 76911 - DNA, 50 bp, homo sapien
tatggtactatgtctattgcaccacrgtaaacatttctatcacctatact

SEQ ID NO: 76912 - DNA, 50 bp, homo sapien
atgataatgatgaggataggatcacmataaaaagattgaggttcatacag

SEQ ID NO: 76913 - DNA, 50 bp, homo sapien
gcattaagtacatatgtaatatagaragttctacaaaccaaggtagaaaa

SEQ ID NO: 76914 - DNA, 50 bp, homo sapien
ttacctctaaaaagtacttatcacawcccagtctaagtgttttacaagta

SEQ ID NO: 76915 - DNA, 50 bp, homo sapien
ccaaggtaagtgacaggcccttccaracaattaagagcctgattattgag

SEQ ID NO: 76916 - DNA, 50 bp, homo sapien
tccacacagaagttgtataccagtckgaaactctgctttgccatctgaaa

SEQ ID NO: 76917 - DNA, 50 bp, homo sapien
gtaactttagtgggaggagaccgacwataaacaagtaaacaaataagata

SEQ ID NO: 76918 - DNA, 50 bp, homo sapien
catacccaccaggaggactagactcraatcaatggccatagggagcagtt

SEQ ID NO: 76919 - DNA, 50 bp, homo sapien
agaattggcaaatggagtcagattgraaaatattttacagctctttattc

SEQ ID NO: 76920 - DNA, 50 bp, homo sapien
atacttctgaggctaaattgagggayagaattaaatcaacggatgaaaag

SEQ ID NO: 76921 - DNA, 50 bp, homo sapien
gtcatttccttttctgttaatacaarttcatcactctttatgtggacatg

SEQ ID NO: 76922 - DNA, 50 bp, homo sapien
cactcacacacacacacttctaaaamctaggaaaccaggaacagtttttt

SEQ ID NO: 76923 - DNA, 50 bp, homo sapien
tacaggcatgagttaaactacagtcrcctccattgctgaacttggctatt

SEQ ID NO: 76924 - DNA, 50 bp, homo sapien
tcatgactaatagctgatcctataastaccctcttacatatacattactg

SEQ ID NO: 76925 - DNA, 50 bp, homo sapien
agtgaaattccagctccagaattcascgtctcggccccaggctcctgttc

SEQ ID NO: 76926 - DNA, 50 bp, homo sapien
gaaacatcagatgaaagggtttgaakgagcactagcatttactactttgg

SEQ ID NO: 76927 - DNA, 50 bp, homo sapien
cacacaaactctgccttaattgttaygctattctgatgccttctagaagt

SEQ ID NO: 76928 - DNA, 50 bp, homo sapien
catttactactttggatatagtcaarttcaagtattgaccttgttaaaag

SEQ ID NO: 76929 - DNA, 50 bp, homo sapien
gatgattcattccaataaccctgackccatgtctgaacaaatcagtctgt

SEQ ID NO: 76930 - DNA, 50 bp, homo sapien
gttttttgctgacctgtcttttacarcccaactcattgaatacttgagtg

SEQ ID NO: 76931 - DNA, 50 bp, homo sapien
ctggtacaaataccctggattgctastaaaaatgcagaataacacacact

SEQ ID NO: 76932 - DNA, 50 bp, homo sapien
tacagtatttttattcattaaggatktctaacaccaaactacatttctag

SEQ ID NO: 76933 - DNA, 50 bp, homo sapien
ttcttccacttcctagacatgtaagyacaaatttggaatgctgggtagaa

SEQ ID NO: 76934 - DNA, 50 bp, homo sapien
attacgacccatgcattcatttacasttactgacaacagaacctgattgg

SEQ ID NO: 76935 - DNA, 50 bp, homo sapien
aaccactcgtactaccttaagacaasaaaatatcctagaaggactcagag

SEQ ID NO: 76936 - DNA, 50 bp, homo sapien
gtattttcaggttcgacctctacgtyagcagttccatatactttgatgct

SEQ ID NO: 76937 - DNA, 50 bp, homo sapien
gctagggctgtgtgtcctggaaccaycttgtcaagtaccaaacaacgttt

SEQ ID NO: 76938 - DNA, 50 bp, homo sapien
aggaaggcaacatgcgctttctctcraattagagtgtttgaatgtgctgt

SEQ ID NO: 76939 - DNA, 50 bp, homo sapien
atacatgcccaaattcttaacaagaytcatggctcgtcccgtaagactcc

SEQ ID NO: 76940 - DNA, 50 bp, homo sapien
ccagcccaaattactttttaacagaycatgtggtatagacggaagtgctt

SEQ ID NO: 76941 - DNA, 50 bp, homo sapien
tagaaatcccaaatttccatgcaacrgtattcaacattcagccatgtgct

SEQ ID NO: 76942 - DNA, 50 bp, homo sapien
cagtcacatagtcacctgtgtggcasgggggtgtaagcatgtagccaacc

SEQ ID NO: 76943 - DNA, 50 bp, homo sapien
gagagaagaatgagtcatgggtcaaygtccttctccacaacatcatgaaa

SEQ ID NO: 76944 - DNA, 50 bp, homo sapien
actcctctcatcatcagattttccasatgataagtttttagcaggccctt

SEQ ID NO: 76945 - DNA, 50 bp, homo sapien
acaatgagccaaggattttagaaaasgttgttcattttggaaggtaggaa

SEQ ID NO: 76946 - DNA, 50 bp, homo sapien
acgagcacacagttaatgctcattaygttaactaagcttagaacttctat

SEQ ID NO: 76947 - DNA, 50 bp, homo sapien
acataacctctcttttgtgatctctsacatcaatgatactaacaaaagca

SEQ ID NO: 76948 - DNA, 50 bp, homo sapien
agcatcaacgtagaaaatgttacctytgatcccttattttataggtccta

SEQ ID NO: 76949 - DNA, 50 bp, homo sapien
cagatattgagaaagaataccttttkatagaagacacgtttaggggaaaa

SEQ ID NO: 76950 - DNA, 50 bp, homo sapien
tctacaaagcctgcttgggttttgaytgggattatgactataggtaagtt

SEQ ID NO: 76951 - DNA, 50 bp, homo sapien
aattactttttacttgtttgtttaaygctggctcctccaaataggctgca

SEQ ID NO: 76952 - DNA, 50 bp, homo sapien
ttccttctcaccaagctcattttcasgtgccctctgacaaccgccaagca

SEQ ID NO: 76953 - DNA, 50 bp, homo sapien
tgcccttcaaaagagttaaactgcasataagaataccacagtaggttata

SEQ ID NO: 76954 - DNA, 50 bp, homo sapien
tctcattacttacagtataaaaaggyaatagttgctgcagttatatttat

SEQ ID NO: 76955 - DNA, 50 bp, homo sapien
ctttaccaactccaggtagaattcartaatgggtcgggaggagtctgagg

SEQ ID NO: 76956 - DNA, 50 bp, homo sapien
gaggagaaatacgattaacagactcraacctgaattaggagaccagggca

SEQ ID NO: 76957 - DNA, 50 bp, homo sapien
tctttagacagcatgcattttcaaawtcactacagctgtccccactctgt

SEQ ID NO: 76958 - DNA, 50 bp, homo sapien
ccttgtaattgtcaaaagtaagaccrcaagagctggtatagggcatgcta

SEQ ID NO: 76959 - DNA, 50 bp, homo sapien
atccctgtcctcagagaactgaagamctctacctgccattaagcaaatgc

SEQ ID NO: 76960 - DNA, 50 bp, homo sapien
taccttcatctcaagggactgtagascactgcatacatctgtttttcact

SEQ ID NO: 76961 - DNA, 50 bp, homo sapien
cattctccacccaacttcctacctcrcctaaatcattgtactgtgtataa

SEQ ID NO: 76962 - DNA, 50 bp, homo sapien
agtttttcagccttgctctcctcacrcttatcatcatccccagtgtctat

SEQ ID NO: 76963 - DNA, 50 bp, homo sapien
tgggtggagaatgagcacacaattamaagttgaaaggtacatccttgttc

SEQ ID NO: 76964 - DNA, 50 bp, homo sapien
gggtttgagaatcacagctgtgaacrcaaaggtcatttgggcaaattgga

SEQ ID NO: 76965 - DNA, 50 bp, homo sapien
tgatcctaactactcaagagataacrcaagtggcataacactcatggatg

SEQ ID NO: 76966 - DNA, 50 bp, homo sapien
atcagcttttatgtgtcaatccaccrgaatttagggctttctcttaattg

SEQ ID NO: 76967 - DNA, 50 bp, homo sapien
tgtatgcaattcatactagggaaatragagttgtgtattaactcagtgta

SEQ ID NO: 76968 - DNA, 50 bp, homo sapien
taataagtgtaatgcatttatcacayggtcactaataatgctgtcctacc

SEQ ID NO: 76969 - DNA, 50 bp, homo sapien
aaatattggtggtaccaaaggttaaygtagtgtgcaatgctgtaaaatcc

SEQ ID NO: 76970 - DNA, 50 bp, homo sapien
tctttctgtatgcagctcacttccasagtaaaaaagaaaaaaaaaaaaaa

SEQ ID NO: 76971 - DNA, 50 bp, homo sapien
ttgttgtcttgaattgatttgaaggmgtcagacaggccgtggtctctgtg

SEQ ID NO: 76972 - DNA, 50 bp, homo sapien
gaaggtgtctgtcatcgttgaatttscaacatctcacttttttcggggga

SEQ ID NO: 76973 - DNA, 50 bp, homo sapien
ttttttttagaaatatcattttatasaaacatacctgggtttaaaatggg

SEQ ID NO: 76974 - DNA, 50 bp, homo sapien
caaggtaattagcacacatttgcacsgccatttttacaaagcagcattcc

SEQ ID NO: 76975 - DNA, 50 bp, homo sapien
attctccagactcctggcagcaaaakatccagttctccaaatagaggagc

SEQ ID NO: 76976 - DNA, 50 bp, homo sapien
aaaatgctaatttattaacatccaarcaaacttgcagtctatgtccatca

SEQ ID NO: 76977 - DNA, 50 bp, homo sapien
agcatggtttccttccagtaacacascacggaaatatgtccacactctcc

SEQ ID NO: 76978 - DNA, 50 bp, homo sapien
ctcatgcatgctcataattacctggwcattgataccaacatgttaagagg

SEQ ID NO: 76979 - DNA, 50 bp, homo sapien
tatatatgtatatatttatttgcatrttgtggttcaccccttctagactg

SEQ ID NO: 76980 - DNA, 50 bp, homo sapien
ttaattgggaaaactcaattcttcaragcagtagttcttaatgggggaat

SEQ ID NO: 76981 - DNA, 50 bp, homo sapien
aactattaaatgaatgcctttgagarccccatgataaaagacatgttttc

SEQ ID NO: 76982 - DNA, 50 bp, homo sapien
aaaaagtgagtagtttgagtaaaaarttgagtatcagagacagctctact

SEQ ID NO: 76983 - DNA, 50 bp, homo sapien
ccttggcttgtctcattctataccarctctttgcaggaactgactataat

SEQ ID NO: 76984 - DNA, 50 bp, homo sapien
gtaatacatattacgttcgtttggayggtcttaataaggagccacatacc

SEQ ID NO: 76985 - DNA, 50 bp, homo sapien
tgaacttatctttttggggccagtamacatgggacacagatgagtgccaa

SEQ ID NO: 76986 - DNA, 50 bp, homo sapien
gagcagaaagagccctgtgaattgawattataaacccacatgcctgtttt

SEQ ID NO: 76987 - DNA, 50 bp, homo sapien
tcacattttctcatttacattccaartacacttcctctgtttttacttta

SEQ ID NO: 76988 - DNA, 50 bp, homo sapien
caaaatgaatacagtcgccgtattaraagttcttctgctgtattgtcatc

SEQ ID NO: 76989 - DNA, 50 bp, homo sapien
tttgcattcttgagcaatggccctckttaattttatcagatagtttcacc

SEQ ID NO: 76990 - DNA, 50 bp, homo sapien
taacttgagacttttattatttgcastaagacgttcaataggaggttgtc

SEQ ID NO: 76991 - DNA, 50 bp, homo sapien
cctggcgcgtagtcagcacctagtamattttggttgatcacttaaaggtc

SEQ ID NO: 76992 - DNA, 50 bp, homo sapien
taagtgatacctagtcttacgtttamatgtttttgagatataattcacat

SEQ ID NO: 76993 - DNA, 50 bp, homo sapien
agggacttacataatcaggacaaccrgaagagatacatgcccaaattctt

SEQ ID NO: 76994 - DNA, 50 bp, homo sapien
tctgacagcactagtttcaccaccayggatcattaacaagttcacaatca

SEQ ID NO: 76995 - DNA, 50 bp, homo sapien
aaaagcaccctaaaaatctcagggamccctaattaactcttaccacttgt

SEQ ID NO: 76996 - DNA, 50 bp, homo sapien
tgcctatggtgttagaaaggattgcraaagatttacttggggaaaattag

SEQ ID NO: 76997 - DNA, 50 bp, homo sapien
aatcaaaggaccctaccagataaatsaatactagtgcataaacgtggtgt

SEQ ID NO: 76998 - DNA, 50 bp, homo sapien
tcacagacaggtgtgttcaactttgrcaaaataaactttctggattaact

SEQ ID NO: 76999 - DNA, 50 bp, homo sapien
atggatgtgttatgtctccctaggawgtgtaaaagccagttgtgttctga

SEQ ID NO: 77000 - DNA, 50 bp, homo sapien
acatccatcaatacgtgctggatgarcattggttcggtctggaaagacgg

SEQ ID NO: 77001 - DNA, 50 bp, homo sapien
agccaacttggctgactgtgaaatgsaaggtatattcatgagagaactgc

SEQ ID NO: 77002 - DNA, 50 bp, homo sapien
atttaatatgtaaaatatgttgtgartatctttcaaactctaagttgtta

SEQ ID NO: 77003 - DNA, 50 bp, homo sapien
ggacttttgatggctgctatattggwaactctgcccctaccattcttcct

SEQ ID NO: 77004 - DNA, 50 bp, homo sapien
gcttcagtgggcactgtagtttgaayacctggatgccaaaaacagaaaac

SEQ ID NO: 77005 - DNA, 50 bp, homo sapien
tgcctgtgaactcccttatctctacrcttgtggcatttagcaaagcaaga

SEQ ID NO: 77006 - DNA, 50 bp, homo sapien
gaggtgccatgggtctcagagtctayaaaggcagagggtttcatgggatg

SEQ ID NO: 77007 - DNA, 50 bp, homo sapien
agcagatgttaatcattaatccgacraacatttcgatgcctctgcccttt

SEQ ID NO: 77008 - DNA, 50 bp, homo sapien
cacacatcctgcccttagttgtcagrataatacataaatattaatagccc

SEQ ID NO: 77009 - DNA, 50 bp, homo sapien
gatgttacccctggagcaataagagkagaggtcatgggctctctgtatat

SEQ ID NO: 77010 - DNA, 50 bp, homo sapien
gactctgtctctgctgtagagaactwacatctttcttctcttctgaatcc

SEQ ID NO: 77011 - DNA, 50 bp, homo sapien
gctctgagaagtcctgcgctacagamacggtttaaacttatttcctgctg

SEQ ID NO: 77012 - DNA, 50 bp, homo sapien
tcagatgccctagtggggatagggamgtgacaggtatccacaaaggcaaa

SEQ ID NO: 77013 - DNA, 50 bp, homo sapien
ttggacctctgaattcttggagttgratatcttattaatcatttttccta

SEQ ID NO: 77014 - DNA, 50 bp, homo sapien
gaggagttgcgtcttatggaatgaasaaagagagtggtttattgggatgg

SEQ ID NO: 77015 - DNA, 50 bp, homo sapien
tgttaggtcatatgccatggactcasaggtaatcaaggaaaagaaatttc

SEQ ID NO: 77016 - DNA, 50 bp, homo sapien
gcctcctgaacagaatagcaataacyaggtgccatcaccggaaactgaag

SEQ ID NO: 77017 - DNA, 50 bp, homo sapien
aggcagaataatagttatttttcccrgaacagcgactacattgggtgcca

SEQ ID NO: 77018 - DNA, 50 bp, homo sapien
cagacttccacgcccactgagccacsagatcacgcttccgtggtgcgtcc

SEQ ID NO: 77019 - DNA, 50 bp, homo sapien
gagagataagcaaactgactttgcarcataaagcaaaaccatattctctg

SEQ ID NO: 77020 - DNA, 50 bp, homo sapien
gtcaggctacaaggcagaaatataastagcactctggtttttattaactt

SEQ ID NO: 77021 - DNA, 50 bp, homo sapien
cagttagagaaataataaaataacayctaaaatgggcatatattgataaa

SEQ ID NO: 77022 - DNA, 50 bp, homo sapien
tcttctgcaaaaaacagtgattttayggtaagacgatttggccttgaaag

SEQ ID NO: 77023 - DNA, 50 bp, homo sapien
gaatttctttatggagtggttaatastatgagtccttgctgccaaacagc

SEQ ID NO: 77024 - DNA, 50 bp, homo sapien
atccagcctagcaattccttaagtaycttgttcatcccttccaaggtcag

SEQ ID NO: 77025 - DNA, 50 bp, homo sapien
actccttctagacattagcttaggcraggattttatgatcatgaacccaa

SEQ ID NO: 77026 - DNA, 50 bp, homo sapien
ttgttctcattttagttaccacccaktccttcttgaaatggcctctctgt

SEQ ID NO: 77027 - DNA, 50 bp, homo sapien
aagttttgtaataagattcactatamaataaaatgctccctgggactttc

SEQ ID NO: 77028 - DNA, 50 bp, homo sapien
ttagcactactgacattttgagccarataaccctttgctgtggagggact

SEQ ID NO: 77029 - DNA, 50 bp, homo sapien
tagcctgagctatcatcttctcctgyctaaacaacagccacagcctccta

SEQ ID NO: 77030 - DNA, 50 bp, homo sapien
ttctcaggtcttgtgtgcacccggcrgaaatgattagcaaggtctttgtg

SEQ ID NO: 77031 - DNA, 50 bp, homo sapien
gggtgagctacattcactgtgcttayccagttgagagatataaagctaat

SEQ ID NO: 77032 - DNA, 50 bp, homo sapien
gaaaatggacatggcccattggttaygcacctgaaactgacatgaccaag

SEQ ID NO: 77033 - DNA, 50 bp, homo sapien
aaattgttctttattaggggccaagwatataaacatagaagaaaggaaaa

SEQ ID NO: 77034 - DNA, 50 bp, homo sapien
ttagatatgagtatcctcaggagtcraaacatctcttgccttaagttctg

SEQ ID NO: 77035 - DNA, 50 bp, homo sapien
ttttgaaaagtccataaatcgaaccytgtgttctgttctgcgtgctaatt

SEQ ID NO: 77036 - DNA, 50 bp, homo sapien
gcatggctgagattcatgtcacacckacaggctcgcattaacgtgcactt

SEQ ID NO: 77037 - DNA, 50 bp, homo sapien
tatgaaaaggaatgaggtactgaaayaggctacaccatgaatgaaccttg

SEQ ID NO: 77038 - DNA, 50 bp, homo sapien
acccagcacagtgtggaagaatggaygcttttattatttgcctacaggtg

SEQ ID NO: 77039 - DNA, 50 bp, homo sapien
cataaaagctgatgctaaagcagaayaatcttgtatatagcaactggaaa

SEQ ID NO: 77040 - DNA, 50 bp, homo sapien
tgttttgtttgttgctatatccttgsagtgcctttcacaaagtaggtact

SEQ ID NO: 77041 - DNA, 50 bp, homo sapien
gaagagattaatagaatgctaatcastcaaccaggatttattaaatggca

SEQ ID NO: 77042 - DNA, 50 bp, homo sapien
ccaaggtccaaacatgatctgatacyatcctatttggaccataacttcat

SEQ ID NO: 77043 - DNA, 50 bp, homo sapien
ctctggcaacccctgagctgtttacyctctctgtagttttacctttccca

SEQ ID NO: 77044 - DNA, 50 bp, homo sapien
tcaagttcaaatctctttgcttggarcttcttacataatactgcagctct

SEQ ID NO: 77045 - DNA, 50 bp, homo sapien
tatagaaagataaatcaaactgatayggcctcttttgaatagagaaagaa

SEQ ID NO: 77046 - DNA, 50 bp, homo sapien
tttgagctaagcagtctcatacctaytaactatgtcaccttaccagcacc

SEQ ID NO: 77047 - DNA, 50 bp, homo sapien
gtgggggaatgataaacaccaattgyagaagagtagttacctcttgggtc

SEQ ID NO: 77048 - DNA, 50 bp, homo sapien
gactaagaatggttttgaaaaccccrattctccatcatttagggctatga

SEQ ID NO: 77049 - DNA, 50 bp, homo sapien
gccaaaacaaaaaacaaaaaactccrcaggatgtgcaaaggccctgagac

SEQ ID NO: 77050 - DNA, 50 bp, homo sapien
cagcttggtctatttccaggtccatkttttcagaggccaggtttttgttg

SEQ ID NO: 77051 - DNA, 50 bp, homo sapien
cagtatgaaaattattaagcctttcmattcacatgatatgcacaccacct

SEQ ID NO: 77052 - DNA, 50 bp, homo sapien
tgtttggaacacagagtgtacgcagmaaatggtactatcatgatgattat

SEQ ID NO: 77053 - DNA, 50 bp, homo sapien
gttaatgcttgtattacatttgctcrgcatcttgcctgtgctaagccagg

SEQ ID NO: 77054 - DNA, 50 bp, homo sapien
gctgtgaaaagttaaaaggtaccacrctaatgagggtgatgtgatgaagc

SEQ ID NO: 77055 - DNA, 50 bp, homo sapien
cactgcacttggtacttcctagagayggccggagccaggcccaagacaca

SEQ ID NO: 77056 - DNA, 50 bp, homo sapien
cttcccattttgtcttgtttgttgcratggtgcccagtcatagcagctcc

SEQ ID NO: 77057 - DNA, 50 bp, homo sapien
aaggggccttgccagccagagactawagagtgggagctcaggggtaggaa

SEQ ID NO: 77058 - DNA, 50 bp, homo sapien
gaggcaggcatctcattccccgacayggcacttgctgatttgataaaacc

SEQ ID NO: 77059 - DNA, 50 bp, homo sapien
agccaccagactcattccccaggatmaactaagaggtgacagaaatgctt

SEQ ID NO: 77060 - DNA, 50 bp, homo sapien
tttacacatacaaattctgcctttarccatctgaaagggccccgaactat

SEQ ID NO: 77061 - DNA, 50 bp, homo sapien
attttagaaaatcaggctctttccartgctgcctctcgacacacaataat

SEQ ID NO: 77062 - DNA, 50 bp, homo sapien
cttgatcttgttcaaaatattatcamcaaaaatgtgtggccaagattgcc

SEQ ID NO: 77063 - DNA, 50 bp, homo sapien
atggccaactgtaaaatgaccaaaargtaaataagaaagtgaggaactag

SEQ ID NO: 77064 - DNA, 50 bp, homo sapien
ttgagttctgttctttgtcctatacstgtgaagatgagctataaatgtca

SEQ ID NO: 77065 - DNA, 50 bp, homo sapien
aaaagtcaggagttgacagaaatccragggaagacttgagatgcctcagg

SEQ ID NO: 77066 - DNA, 50 bp, homo sapien
ctacagttgtgacaaatttcatcccmatttctatacattttggagtgaat

SEQ ID NO: 77067 - DNA, 50 bp, homo sapien
aactagacatgcagagtagagtatcrctatatgtctataaatgttggagt

SEQ ID NO: 77068 - DNA, 50 bp, homo sapien
tgacacttgatgacaagtttctagcycaatttatgtgacaaaattggatg

SEQ ID NO: 77069 - DNA, 50 bp, homo sapien
tccaatttcatcttctcatctgtccraattgtaattagcagccgctccct

SEQ ID NO: 77070 - DNA, 50 bp, homo sapien
ctggtgagatcatcaatcaaagtgcmctgggctcacctaccaggctaagc

SEQ ID NO: 77071 - DNA, 50 bp, homo sapien
ctctgttcaaatgcaatctttccccraagtacaaccgaataaaacagaca

SEQ ID NO: 77072 - DNA, 50 bp, homo sapien
atacagtatgcatgtatatagtccaygactcgaaaaaggctggaaagcac

SEQ ID NO: 77073 - DNA, 50 bp, homo sapien
ctagatgaaaaatcaaagaagcaacygcagttcacagaggaaggagaaaa

SEQ ID NO: 77074 - DNA, 50 bp, homo sapien
aaaaaaaaaaagtaaaaataagcatwaatatttctgtcccagaatttcta

SEQ ID NO: 77075 - DNA, 50 bp, homo sapien
atatccggtgtgttacaacacatgcsattagcaaagatattcaaactcat

SEQ ID NO: 77076 - DNA, 50 bp, homo sapien
gcaggaggtggtctccaaacaagaartaaagctaacttattggatgcctg

SEQ ID NO: 77077 - DNA, 50 bp, homo sapien
atgtgtaatatacttggcacagcgaraaaatggatttaaaagacaaaaat

SEQ ID NO: 77078 - DNA, 50 bp, homo sapien
ggtttctcctttataatcagtttccrcttgaacttcaactaccacaaaaa

SEQ ID NO: 77079 - DNA, 50 bp, homo sapien
ccaagggctctgcacacctccataargaccttcacagactagagagcagc

SEQ ID NO: 77080 - DNA, 50 bp, homo sapien
gtgtgtattcatattttttaacatamattgtgacatgattctgtggaaca

SEQ ID NO: 77081 - DNA, 50 bp, homo sapien
cctggtgtgctcatcactcagatttratacattttaacattttgccatat

SEQ ID NO: 77082 - DNA, 50 bp, homo sapien
tagttctgtgaagaatggctttgatrgtttgatagaaataacattgaatc

SEQ ID NO: 77083 - DNA, 50 bp, homo sapien
atactagtctagtaaacagcaacaaytataagtacctttattttttagat

SEQ ID NO: 77084 - DNA, 50 bp, homo sapien
ggggcatgatatctcagaaacagccrggatacagtgaccaggagaagagt

SEQ ID NO: 77085 - DNA, 50 bp, homo sapien
gactgcacgtatgtccaggtctgaartcaatatggcacatgtcacagtac

SEQ ID NO: 77086 - DNA, 50 bp, homo sapien
tatggcttggaaagctatttggaaaygtagcaggaacattcaagtttctg

SEQ ID NO: 77087 - DNA, 50 bp, homo sapien
ggtacctgcctcattgggtttgtcargaagtagaattgtatgtaaaggta

SEQ ID NO: 77088 - DNA, 50 bp, homo sapien
gtgacatagttgagtttggggtcctsagatattatttccctttcacagta

SEQ ID NO: 77089 - DNA, 50 bp, homo sapien
ctggaaagttcattctgaaccaaaaytgtactaatcttcgaacatgatta

SEQ ID NO: 77090 - DNA, 50 bp, homo sapien
acgttttaaagcctcagcctgtgtcragttttctttagtcccattggtca

SEQ ID NO: 77091 - DNA, 50 bp, homo sapien
cagggtggttgtaatccataagacartgtcaccatagtgacctgcctcca

SEQ ID NO: 77092 - DNA, 50 bp, homo sapien
tcagggttggatggttcaccttgcayctttctaagtgatttcacacagtg

SEQ ID NO: 77093 - DNA, 50 bp, homo sapien
gttcaaattctggctctgtcatttcrcggttgtgcgagggtgtcacatgc

SEQ ID NO: 77094 - DNA, 50 bp, homo sapien
tatctggggagtgatcaatttgtaamactgttgtctggagtcaggggagc

SEQ ID NO: 77095 - DNA, 50 bp, homo sapien
ctttgctcctatgaagcccttgtacyggtgggagaagtgaaggaatttgg

SEQ ID NO: 77096 - DNA, 50 bp, homo sapien
catgatggtttttgttcacctacacyggtggattttcctttcctgctgga

SEQ ID NO: 77097 - DNA, 50 bp, homo sapien
gcccacactctgccacctgtccttasgatatcaaatattagcatacagat

SEQ ID NO: 77098 - DNA, 50 bp, homo sapien
atcataccaatttgttcctcaatcartaatgtataaaagagctttgtcct

SEQ ID NO: 77099 - DNA, 50 bp, homo sapien
tggcttttatatgcttacaaaattayaggaccaaatattctccacatctt

SEQ ID NO: 77100 - DNA, 50 bp, homo sapien
agccagagaaggcccaggaaagtccrtggagaagcccacacttctgcttc

SEQ ID NO: 77101 - DNA, 50 bp, homo sapien
catgaccacggaagatcatacaggcrtacacacaggagaccacatcttgc

SEQ ID NO: 77102 - DNA, 50 bp, homo sapien
ttctcatgtcaggccactggggtttsaatcagttccactgcctactctgt

SEQ ID NO: 77103 - DNA, 50 bp, homo sapien
gggaaactgcacacacaaggacatayaaaatctaagcctctgcctgggcc

SEQ ID NO: 77104 - DNA, 50 bp, homo sapien
gcaccgaacttgaccagccttatcamatctgactgtatttccctttctgt

SEQ ID NO: 77105 - DNA, 50 bp, homo sapien
gttacagcagcaattggaaactaacraagtcctgaagagcagctctcaac

SEQ ID NO: 77106 - DNA, 50 bp, homo sapien
aacatgttatttattgactaaatgasagaacataaatgaaagttctatgc

SEQ ID NO: 77107 - DNA, 50 bp, homo sapien
caccacggagcccgaccttgacgcamaacaaataccatcatcccctatgc

SEQ ID NO: 77108 - DNA, 50 bp, homo sapien
ctctttccagcagagaagcaaatgaraagtaggcaatatgagtcagcgga

SEQ ID NO: 77109 - DNA, 50 bp, homo sapien
gaattaacgtaagtggctgtcttcartctggttgttggccacagcctctc

SEQ ID NO: 77110 - DNA, 50 bp, homo sapien
caaaaagaaagcagcagacgcaaaasaaaagtaaaaacaaatttccctat

SEQ ID NO: 77111 - DNA, 50 bp, homo sapien
acccgcccagctgtacaactgagccraggcatcaataaggccaagaatgt

SEQ ID NO: 77112 - DNA, 50 bp, homo sapien
aatcagccataggttcccaaggaatraaattgataggaaaagctatctag

SEQ ID NO: 77113 - DNA, 50 bp, homo sapien
ttcaatgctgcattgtttgtaagagsaacaccaatgccaagtccccagga

SEQ ID NO: 77114 - DNA, 50 bp, homo sapien
atttttcatttaatcattcatctackcattgatgtattcacttgtttgtt

SEQ ID NO: 77115 - DNA, 50 bp, homo sapien
aattccctgccccttgttgcctccasggactatgaaggtgaagatgtacc

SEQ ID NO: 77116 - DNA, 50 bp, homo sapien
ttcatactccagctgataaggtacamaggcaattacttcacaaagcacag

SEQ ID NO: 77117 - DNA, 50 bp, homo sapien
tgctttagattcgacttaagctttcyaaaaacctcctgaagatgcttgtt

SEQ ID NO: 77118 - DNA, 50 bp, homo sapien
gaaagaggtgacatttcagcttccayagagaacattcctcagcactggga

SEQ ID NO: 77119 - DNA, 50 bp, homo sapien
cactgtaggaactaaacattgggtamctatggacataaagatgagaacaa

SEQ ID NO: 77120 - DNA, 50 bp, homo sapien
caacagaacttagaactttggtaacsaggcactcatatttctgaagacag

SEQ ID NO: 77121 - DNA, 50 bp, homo sapien
atctttgaattagtggaaggctgtcracatacctgtactgagttacccaa

SEQ ID NO: 77122 - DNA, 50 bp, homo sapien
aattcaaatgatgtcagtgtggtgayattaagaagcaaggcctttaaaat

SEQ ID NO: 77123 - DNA, 50 bp, homo sapien
acattaatctgtcaactctattgtawccattaatcatctatccatctgtt

SEQ ID NO: 77124 - DNA, 50 bp, homo sapien
tgagttttctgcagtgactgcacacwatagatactctgtaaatggcagca

SEQ ID NO: 77125 - DNA, 50 bp, homo sapien
gactttgaggactttgtgaaaaagaygctatgtgtggtttaagcagagct

SEQ ID NO: 77126 - DNA, 50 bp, homo sapien
cattaatattcagaaagaatacccaragaaaccatgaaatctttcctgaa

SEQ ID NO: 77127 - DNA, 50 bp, homo sapien
atactacctaagcaagaagcatctcratctcatacctcaacctctcaacc

SEQ ID NO: 77128 - DNA, 50 bp, homo sapien
actcaaatcatattaccgataatcaytactttgtgctgtgacacctgccc

SEQ ID NO: 77129 - DNA, 50 bp, homo sapien
gccttgtttaactcaattcataacastattaatccaaccataaaccttcc

SEQ ID NO: 77130 - DNA, 50 bp, homo sapien
ggccctgggaccaagccaaacaccawctcgtcattgctatagttgtgcaa

SEQ ID NO: 77131 - DNA, 50 bp, homo sapien
ctatgatgattgacgcatgattaaaygattgatttggagaggagattact

SEQ ID NO: 77132 - DNA, 50 bp, homo sapien
tagatgcggtttcaggttttaaatarctatgatgattgacgcatgattaa

SEQ ID NO: 77133 - DNA, 50 bp, homo sapien
tctcctacctcctcttagaccctgaygctaatgttcagatttacaggagg

SEQ ID NO: 77134 - DNA, 50 bp, homo sapien
gtattaggatgtggagcctttgggarctaattaatgaggttgtgagggtg

SEQ ID NO: 77135 - DNA, 50 bp, homo sapien
ggcacctttctctatggagaaaggayctttagaaggactatatagagaga

SEQ ID NO: 77136 - DNA, 50 bp, homo sapien
agcttgctaaaaatgcagacaactgkatcccacccttcgtgtttttgaat

SEQ ID NO: 77137 - DNA, 50 bp, homo sapien
ttgcaagataaagcaatgaaggtacmaaaatgacctgtgattgactctgg

SEQ ID NO: 77138 - DNA, 50 bp, homo sapien
aaatcagtactggattcagactaaaycaaaatttgttgagcatctacacg

SEQ ID NO: 77139 - DNA, 50 bp, homo sapien
acacaacttttctgccctttgtggamatgtagtattatttctgaatgtta

SEQ ID NO: 77140 - DNA, 50 bp, homo sapien
ggactttcattagagtgaggagacargttataagtaagaaaacaaagcat

SEQ ID NO: 77141 - DNA, 50 bp, homo sapien
cctgttgcacacctaaacattcaaarccaagatgctggctagaagtagat

SEQ ID NO: 77142 - DNA, 50 bp, homo sapien
ccatgttgctcatatcaaccttcaarctccacatagtctctctctcaaaa

SEQ ID NO: 77143 - DNA, 50 bp, homo sapien
cttcagctactgcaaatgattctatragttcgttcagatctgtgagtact

SEQ ID NO: 77144 - DNA, 50 bp, homo sapien
aatccatgccctgaaccaccctcgarccttccagccgaagctgctagttc

SEQ ID NO: 77145 - DNA, 50 bp, homo sapien
tttttgccaggtgggtgcatgaaaarataaaaggtggtaacataatggat

SEQ ID NO: 77146 - DNA, 50 bp, homo sapien
gtctgttgaaaacaggagggatcgcrgaaagaaggtggcttgaaggttga

SEQ ID NO: 77147 - DNA, 50 bp, homo sapien
taaaactcgaatggagagaaatgaakagggagtgacctcagtccatggag

SEQ ID NO: 77148 - DNA, 50 bp, homo sapien
gaaacataatttaaactacagaacasgtaggtaattgccattcattcatc

SEQ ID NO: 77149 - DNA, 50 bp, homo sapien
ccttccaaaatcttgctaagcaaaarcaactgtccctaagtgttcaggaa

SEQ ID NO: 77150 - DNA, 50 bp, homo sapien
aaaacaaccgatgaatgtccattaaygacgtaatgaaaacaaccgatgaa

SEQ ID NO: 77151 - DNA, 50 bp, homo sapien
caactccactccagaggctaatgtcraaatacctgctgaaagcaatgcca

SEQ ID NO: 77152 - DNA, 50 bp, homo sapien
gcctccagtttcctgatgtgtaaaaygggaatgatagttacctcatagag

SEQ ID NO: 77153 - DNA, 50 bp, homo sapien
aagcaccaagctctgaccatttcagsatctttgcataacctgttcctatc

SEQ ID NO: 77154 - DNA, 50 bp, homo sapien
gttgcacttcttaccttaaggctcargctccaagaatggaggttgagcaa

SEQ ID NO: 77155 - DNA, 50 bp, homo sapien
cgagctggcttaaaccaaagggaaaktgactaactcagaatgttgagaag

SEQ ID NO: 77156 - DNA, 50 bp, homo sapien
tatgttattgtatcctttctttgtayactcacaaatcctgagtagtttgg

SEQ ID NO: 77157 - DNA, 50 bp, homo sapien
acagaggcttaaggaaatatacccaygatcacaaaccagataagtggcag

SEQ ID NO: 77158 - DNA, 50 bp, homo sapien
gaagaaaactagaggagacagcccckcaggaattctgctctcacacatcc

SEQ ID NO: 77159 - DNA, 50 bp, homo sapien
gcaccagccttgtggtacgctgacayaacagaacaaaccaatttggttta

SEQ ID NO: 77160 - DNA, 32 bp, homo sapien
gatccaggtactcaaaygatggcctttggctt

SEQ ID NO: 77161 - DNA, 50 bp, homo sapien
cagtatacaacctggttgcaataacycgttgttcacgtgatgcaaagaat

SEQ ID NO: 77162 - DNA, 50 bp, homo sapien
cggtataagtatgggacaagtttaaytgaaatttgaatttcatctggcag

SEQ ID NO: 77163 - DNA, 50 bp, homo sapien
aattcattcactcaaccatgctacaratgtttattgagaacacctaatat

SEQ ID NO: 77164 - DNA, 50 bp, homo sapien
gccatggatggataaacatgtgttcyaccatatttgaagagttccatctg

SEQ ID NO: 77165 - DNA, 32 bp, homo sapien
taaagctacagagctaygaagtgatgaagtct

SEQ ID NO: 77166 - DNA, 50 bp, homo sapien
taggaaatactggagaatgaaaccartggtgaacaagccattttcttctt

SEQ ID NO: 77167 - DNA, 50 bp, homo sapien
catctctagtttgctgcctattctcratcaaacttttaaagatacttgtt

SEQ ID NO: 77168 - DNA, 50 bp, homo sapien
tgtagggctgtcttaaggaatgatayggcctcagtgcaatggatgtttac

SEQ ID NO: 77169 - DNA, 50 bp, homo sapien
cttgctgatgttaaaattgaattacrgatgccaaaccatggaagaacagg

SEQ ID NO: 77170 - DNA, 50 bp, homo sapien
aaaagagagctaagacagttataaasatatgaaaagcacacaatccatta

SEQ ID NO: 77171 - DNA, 50 bp, homo sapien
aacaaaccactaaaggcaaaaatgayccaactcagtcaacttgtctatga

SEQ ID NO: 77172 - DNA, 50 bp, homo sapien
ctctatgtcagggatttaaataaatyagctcttgcactttgggagaccaa

SEQ ID NO: 77173 - DNA, 50 bp, homo sapien
cagtgagctatgatcatgaaagggaygtgaaaagaactgatgagattaaa

SEQ ID NO: 77174 - DNA, 50 bp, homo sapien
taattttttagtccttgagcataatsattacagctgtagcactgttattg

SEQ ID NO: 77175 - DNA, 50 bp, homo sapien
caatttccccagcataagaaggcccragacttactttacaagtgcagagg

SEQ ID NO: 77176 - DNA, 50 bp, homo sapien
tagacttccctaatgcaagaaaccarcttactttataatacagatttcat

SEQ ID NO: 77177 - DNA, 50 bp, homo sapien
tctatacagcagttagaagactagtyacacagaaagcaatatggatacat

SEQ ID NO: 77178 - DNA, 50 bp, homo sapien
aatgtgtggctcatgattagttagamcttggatccaagaaaaaaaaaaga

SEQ ID NO: 77179 - DNA, 50 bp, homo sapien
gaaagagaattgggagtccagggaaygcttccgggactgccaaggaaggt

SEQ ID NO: 77180 - DNA, 50 bp, homo sapien
gctactgtataaatacttcatcagcrctaaaaaatatcaccttgtgaatt

SEQ ID NO: 77181 - DNA, 50 bp, homo sapien
tttttttaaagaagaggaaaactaaytgaaagccataaatatcaagaaga

SEQ ID NO: 77182 - DNA, 50 bp, homo sapien
tgaaaagagttgtttctgggatgtasgttccaagtgagaaagttcccagc

SEQ ID NO: 77183 - DNA, 50 bp, homo sapien
tgtccaccgtgctgagggggaacaaytcattaaagacatgcaagaaggca

SEQ ID NO: 77184 - DNA, 50 bp, homo sapien
caccaaccatgtgtccggcataggaytgtgacaattaatgaaatcaaggg

SEQ ID NO: 77185 - DNA, 50 bp, homo sapien
ggcatcatggagaaacatcacgcagkaaagtgggggaaggaagtgctcct

SEQ ID NO: 77186 - DNA, 50 bp, homo sapien
ggagaaactcaggaaatcagaatagrctatgacatgtagttaataacaat

SEQ ID NO: 77187 - DNA, 32 bp, homo sapien
aaatgtgagtatcatgmaataatttccttcaa

SEQ ID NO: 77188 - DNA, 50 bp, homo sapien
acatttgttccaactaatggaccagyattgacacattgttattaactaca

SEQ ID NO: 77189 - DNA, 50 bp, homo sapien
ggcagttgtgtacctgactacgaacraaaggagaacagatactggaagat

SEQ ID NO: 77190 - DNA, 50 bp, homo sapien
ttcttaggtcaaaaatgtgtttaaakctctggatatgtatggaaaatttg

SEQ ID NO: 77191 - DNA, 50 bp, homo sapien
tttcttggtcctgatgtctttgaaargtgttctgggcaagctcagtgtat

SEQ ID NO: 77192 - DNA, 50 bp, homo sapien
gcagccatggaaactatggaaactartatctttgaacatctccatctgag

SEQ ID NO: 77193 - DNA, 50 bp, homo sapien
gtgagccaccttgctcagcctgacckcatttttcaaagagctgcagagtg

SEQ ID NO: 77194 - DNA, 50 bp, homo sapien
tccaagttttctcttattataatgaytatggtaagtgtattagtcagggt

SEQ ID NO: 77195 - DNA, 50 bp, homo sapien
tttttgtcatgaatgttttcaaatayatacaacagtaaagaggacagtat

SEQ ID NO: 77196 - DNA, 50 bp, homo sapien
cacagtgaaccgtggaaggtcacaasgagtacaggttttatcctgaggga

SEQ ID NO: 77197 - DNA, 50 bp, homo sapien
tggcgaggctgttccagttagtccaytcattccctcacatattcattcaa

SEQ ID NO: 77198 - DNA, 50 bp, homo sapien
gagggagactgttgcctgggactctsaaattacccattgtggatctagac

SEQ ID NO: 77199 - DNA, 50 bp, homo sapien
tgctctgaaataaaaacaatgtcatwaactaggccaggagcggtggctca

SEQ ID NO: 77200 - DNA, 50 bp, homo sapien
atcaggggcagtgggacaattcctcragtcctttaatctgccccatacca

SEQ ID NO: 77201 - DNA, 50 bp, homo sapien
aattgtagaaggcatcccaaatatcktctagtgtaggttttgaagtgtgc

SEQ ID NO: 77202 - DNA, 50 bp, homo sapien
ctttgagtactctacatataagaggycacataaagttgtcccgcagttca

SEQ ID NO: 77203 - DNA, 50 bp, homo sapien
accaagatccataccagtatttctgsacgaaggatttaaaattttccaaa

SEQ ID NO: 77204 - DNA, 50 bp, homo sapien
gccttgcccctctacttgacagccartgaagagcacagacttgggagcca

SEQ ID NO: 77205 - DNA, 50 bp, homo sapien
gcctaaatattttgcctctaaggacrccaggctctgttatccatgctctc

SEQ ID NO: 77206 - DNA, 50 bp, homo sapien
aaaaggaggaaattttggcagaatargagtgaacaggtttctgtgactaa

SEQ ID NO: 77207 - DNA, 50 bp, homo sapien
atattttaactataggccatttaaarttgctctcatgatctataacatga

SEQ ID NO: 77208 - DNA, 50 bp, homo sapien
tcatgggtccccatatatgagaaccrcttgttatcagactcttagctggg

SEQ ID NO: 77209 - DNA, 50 bp, homo sapien
aatattccaggtaacgctcctaaaartttgtgaatatggaattatctttt

SEQ ID NO: 77210 - DNA, 50 bp, homo sapien
ggcctatcttttctctctcccaatayatacactgtgttcatggcatcttg

SEQ ID NO: 77211 - DNA, 50 bp, homo sapien
gcaggaatgtgctttgcagtcctcaytaccaccgattccccaacccctcc

SEQ ID NO: 77212 - DNA, 50 bp, homo sapien
atgaattttatttaatccttgaggamatggttcttttctcacacacataa

SEQ ID NO: 77213 - DNA, 50 bp, homo sapien
actttaaaaactgattcagagagcaratgtgaacagagaaaggagtaggc

SEQ ID NO: 77214 - DNA, 50 bp, homo sapien
agaaatcaatacttccctcatacaartggttagaaaaatgtttgtcgcat

SEQ ID NO: 77215 - DNA, 50 bp, homo sapien
gtagctaaatatggaatgcttatcaygcgacaaacatttttctaaccact

SEQ ID NO: 77216 - DNA, 50 bp, homo sapien
attccatatatgttagctacctttcratcactttagaaccttcaatactg

SEQ ID NO: 77217 - DNA, 50 bp, homo sapien
aacagaagatttcctttacacggacrattgcatggttatttcttgaatat

SEQ ID NO: 77218 - DNA, 50 bp, homo sapien
gagtacttttctttaaaggatttgayggagaaggaaagtggttgaatgaa

SEQ ID NO: 77219 - DNA, 50 bp, homo sapien
actgctcatttaccagtttctcttaygatattgtccagggctgcagacag

SEQ ID NO: 77220 - DNA, 50 bp, homo sapien
gactcagtgatgcttctctgagctayaataaacagtgtattggacccagg

SEQ ID NO: 77221 - DNA, 50 bp, homo sapien
gcgtatgctgtgtagcctgtgaagakactgagtggaagtgacccagtgta

SEQ ID NO: 77222 - DNA, 50 bp, homo sapien
ggtagctctctttccacaaaaagaaygagcttgccaagagagagacaaca

SEQ ID NO: 77223 - DNA, 50 bp, homo sapien
aatcacactggttctcccagaatgcraggtgagagagagaaaaatgcact

SEQ ID NO: 77224 - DNA, 50 bp, homo sapien
cattcatcatctgttactcaatagakgtttataaggcactgtagacgctt

SEQ ID NO: 77225 - DNA, 50 bp, homo sapien
ttgctcccagatcacccctgcaggaygtatgagttgatcatttttcctaa

SEQ ID NO: 77226 - DNA, 50 bp, homo sapien
ttctttgaagaatggacactggaaaygagggcgaaacaatgaatagaaat

SEQ ID NO: 77227 - DNA, 50 bp, homo sapien
taagaaccataagttgaatcctcaaygtcgttttaggacaagaacaagaa

SEQ ID NO: 77228 - DNA, 50 bp, homo sapien
gatatttaagataaaacagtctgaaygcttgtgaatgaactatgtaagtc

SEQ ID NO: 77229 - DNA, 50 bp, homo sapien
cttcctcggacctatgggaaaagagmacagatgtgatgggcctttctaga

SEQ ID NO: 77230 - DNA, 50 bp, homo sapien
agtgtgtgcatgagtgaagagctaartgaatgcatttgtgaaagtgcatg

SEQ ID NO: 77231 - DNA, 50 bp, homo sapien
cttatttaattggttagactccaaawtagtgtgtagctgtataaatgttt

SEQ ID NO: 77232 - DNA, 50 bp, homo sapien
gaaagggagttaggagcgaaagagartaaagagtcagctagagagagagg

SEQ ID NO: 77233 - DNA, 50 bp, homo sapien
ttaggaatgtattgccacaatctacrtgacagggatgttgcagaagagac

SEQ ID NO: 77234 - DNA, 50 bp, homo sapien
agaatcccatacagtgactagcgtaygcatatctagtttgttacagtccc

SEQ ID NO: 77235 - DNA, 50 bp, homo sapien
agaactaacctttttcaagctcttcrggaccaagcctgaaccagcctcag

SEQ ID NO: 77236 - DNA, 50 bp, homo sapien
catgagggaagagcctgcctaaaaaygaagccagtacagaataaagcagg

SEQ ID NO: 77237 - DNA, 50 bp, homo sapien
gaagggtttcctaatcttggatcaaycttcccggtgttaattgccttgtt

SEQ ID NO: 77238 - DNA, 50 bp, homo sapien
tacctacacccattcatttacatgtygtctgggctgctttcaagctacaa

SEQ ID NO: 77239 - DNA, 50 bp, homo sapien
atccaggatttgaccaggttaggccragttgagagtccttggatgatatt

SEQ ID NO: 77240 - DNA, 50 bp, homo sapien
ggatctatcccaccagtaagtactaygacctctgcccatccatttgtagg

SEQ ID NO: 77241 - DNA, 50 bp, homo sapien
gggcaggcctttagccatgagaatawgaagttttgctgtaggtctaaagg

SEQ ID NO: 77242 - DNA, 50 bp, homo sapien
agctcaacaagctcaagcaaaagacrcataaaaaagaacacttggccgag

SEQ ID NO: 77243 - DNA, 50 bp, homo sapien
tgttctcatcacacttcctagatgawaaaacagtttcaggaaggcctggc

SEQ ID NO: 77244 - DNA, 50 bp, homo sapien
catggaggaagatataaggtgttacyagctatgaaaccccagaggagaga

SEQ ID NO: 77245 - DNA, 50 bp, homo sapien
tggaaactggtgggatagatattgayggtgtatggtacatttcactgcaa

SEQ ID NO: 77246 - DNA, 50 bp, homo sapien
accaaaaagattacttataacttacyaataggacacaacccacagtttga

SEQ ID NO: 77247 - DNA, 50 bp, homo sapien
aagccatggaggggcccagctataayctaataccagcagtgagtatgggg

SEQ ID NO: 77248 - DNA, 50 bp, homo sapien
ataagtctatctgagagataccattmaacagagaaagagctagacaagct

SEQ ID NO: 77249 - DNA, 50 bp, homo sapien
aggcactgcgctagatgctgggttayagtaataaggaaaacagacaatga

SEQ ID NO: 77250 - DNA, 50 bp, homo sapien
tcagctagggtcattaatctaagaakgaaagttaaggctgaaaggaatta

SEQ ID NO: 77251 - DNA, 50 bp, homo sapien
gataatctctttcatgcctttgttaygacagggagattatggaattgaga

SEQ ID NO: 77252 - DNA, 50 bp, homo sapien
ctacccaaagcagtctacagattcartactatccctaccaatataccaat

SEQ ID NO: 77253 - DNA, 50 bp, homo sapien
caggcatcttctcagcatttggcaamagtgtttgttctgaagccaggaca

SEQ ID NO: 77254 - DNA, 50 bp, homo sapien
gaagctgaagtttctaaatccagacrgtattatgagacgcttccattatt

SEQ ID NO: 77255 - DNA, 50 bp, homo sapien
gagtgtctcataaaaaacagaaaggygttgcttacatttctggaggctga

SEQ ID NO: 77256 - DNA, 50 bp, homo sapien
gaacagggatacacagaagcttcaaytgtttgcaaatagaagaaatatct

SEQ ID NO: 77257 - DNA, 50 bp, homo sapien
gggaacagtcacctgggtgaaagccrtgtgctcttcctggtctgcgatgc

SEQ ID NO: 77258 - DNA, 50 bp, homo sapien
tcagagccttcacatttatccgttayactacttcccaactcaatgtgcta

SEQ ID NO: 77259 - DNA, 50 bp, homo sapien
cagctgccgaacccaatctttttcartaaccatgagtgacttgagtgcaa

SEQ ID NO: 77260 - DNA, 50 bp, homo sapien
tataaaaatcttaaggaaggaaagaractggcatgttataagaatatata

SEQ ID NO: 77261 - DNA, 50 bp, homo sapien
tattgtacccagcatgaaaactttargccctccatttactatgctgcctt

SEQ ID NO: 77262 - DNA, 50 bp, homo sapien
ttcactgttgttaacaattgacacayagtttagcgtacgctgagatattt

SEQ ID NO: 77263 - DNA, 50 bp, homo sapien
acagcatgctcatttacaatggaaarcaatgagatacttcaggagcatat

SEQ ID NO: 77264 - DNA, 50 bp, homo sapien
ggatggaagatgtcctttagcttcamtgtattcattactggtctaaatga

SEQ ID NO: 77265 - DNA, 50 bp, homo sapien
gggctagtgatgagggggagaaaccraaaagaatcaataggctcaagcca

SEQ ID NO: 77266 - DNA, 50 bp, homo sapien
atgactctcctcactcttagattacycttgctcttatactttccctgtac

SEQ ID NO: 77267 - DNA, 50 bp, homo sapien
atatccctagacattttggttattasagcaaatagacttctagtcctttg

SEQ ID NO: 77268 - DNA, 50 bp, homo sapien
tctgtaactgctacttactggttatrtaatcatagacaagttaattaagt

SEQ ID NO: 77269 - DNA, 50 bp, homo sapien
agccactgcctccgatcaggctacaygaaaaaaaggaatgcaacttcttc

SEQ ID NO: 77270 - DNA, 50 bp, homo sapien
ctgccctctgcagctataaatatacytttcagagtgaggagagagggttg

SEQ ID NO: 77271 - DNA, 50 bp, homo sapien
taatgaggtcctagatactgcctgcyattctccagggaactagggcatta

SEQ ID NO: 77272 - DNA, 50 bp, homo sapien
gtgggccctctgctaagtgtccaacrtgcattctctcattgtcatcacta

SEQ ID NO: 77273 - DNA, 50 bp, homo sapien
gagagaaatcagttgtgtttgtagcygatgctcaggtcttctgactggtt

SEQ ID NO: 77274 - DNA, 50 bp, homo sapien
actgtaagataatgcacttgttatakaataataaacgaatacagtttgga

SEQ ID NO: 77275 - DNA, 50 bp, homo sapien
tggtcatctgaacatcctttcctggratctgtctgaagtgtagacaagca

SEQ ID NO: 77276 - DNA, 50 bp, homo sapien
caggagtacggaggagctaaagtcaytgggaacagcccttagccaatgac

SEQ ID NO: 77277 - DNA, 50 bp, homo sapien
gaaccacacataccaacctattaacrgaggctacattaaagaactgagag

SEQ ID NO: 77278 - DNA, 50 bp, homo sapien
aaaggagagatcaaagagtaccaaamaccaatcttgctcactttggaaat

SEQ ID NO: 77279 - DNA, 50 bp, homo sapien
aaaaaaaaatagcacttgcatcacayagatactcctaggaaaatgcaaat

SEQ ID NO: 77280 - DNA, 50 bp, homo sapien
ttgaagcagaggataatgctgtgacygacttaactttatgctttctaaga

SEQ ID NO: 77281 - DNA, 50 bp, homo sapien
caaataaattttattcgtatttatcrattgcttgcaaactatgtgctagt

SEQ ID NO: 77282 - DNA, 50 bp, homo sapien
aactataaatcgattacattttgacsggaaatcatctatgtatagcacac

SEQ ID NO: 77283 - DNA, 50 bp, homo sapien
ggccttgggcaagttatttaacttayctgtacctcagtttactcatctgc

SEQ ID NO: 77284 - DNA, 50 bp, homo sapien
aaggggctctgtggggtacttttgaygcacttttgccttgtgcagcactt

SEQ ID NO: 77285 - DNA, 50 bp, homo sapien
aatttcttaaacagaagaagaagaakaattttgtgacatttcttatgaga

SEQ ID NO: 77286 - DNA, 50 bp, homo sapien
gctggcatttggcggcaagccacaamtgtatcatcactgatgtctgctgg

SEQ ID NO: 77287 - DNA, 50 bp, homo sapien
aagacttggtatttataaacgaaaaycagcacgctaggagagtttcctga

SEQ ID NO: 77288 - DNA, 50 bp, homo sapien
tgaattccagttggaacttcaaaaayagatgaggttaacagagtgcatgt

SEQ ID NO: 77289 - DNA, 50 bp, homo sapien
ctagggaggccatgaatacagaaaamagtgttgcataaatgtagagggtt

SEQ ID NO: 77290 - DNA, 50 bp, homo sapien
catgacctccccttttgtaaactcaygttgatggcctcaaaccaatcagt

SEQ ID NO: 77291 - DNA, 50 bp, homo sapien
actaagcaattgctgggttaattagkcctgtcaataattcagagggtgat

SEQ ID NO: 77292 - DNA, 50 bp, homo sapien
attctactacagaagagagaaagcartgtgacaacctcagcagagagaga

SEQ ID NO: 77293 - DNA, 50 bp, homo sapien
gagagactgccacagctgtccgtcartcataaaggtccccaagtcctaat

SEQ ID NO: 77294 - DNA, 50 bp, homo sapien
agcaattacatacaggagggatttcraatgcatgtcacacaaggactggt

SEQ ID NO: 77295 - DNA, 50 bp, homo sapien
ccactgtctttcaccagagatgaaaktaacaatgtactcaatgtcatcta

SEQ ID NO: 77296 - DNA, 50 bp, homo sapien
gtgaaaactaacagataggtgataaytggattgttggttttggaggaatg

SEQ ID NO: 77297 - DNA, 50 bp, homo sapien
cctgggggctggagagttggggtacrcctcttgccaccgctgagtgggag

SEQ ID NO: 77298 - DNA, 50 bp, homo sapien
ctcatctgagccttattataattcawgtctatacattgcaagtgacagtg

SEQ ID NO: 77299 - DNA, 50 bp, homo sapien
ttgatatttctatatctgatccttgyaagctattaatatggcacggccag

SEQ ID NO: 77300 - DNA, 50 bp, homo sapien
aattttattatccagtgtgtatttawcttgggtgcagcctaaaggtggtg

SEQ ID NO: 77301 - DNA, 50 bp, homo sapien
caataggttcatgtgttgattagaaratctcagtaaatgatgcaggtcaa

SEQ ID NO: 77302 - DNA, 50 bp, homo sapien
agtgggtgcttatagcaatactccartgcaattcaaccatcatatgataa

SEQ ID NO: 77303 - DNA, 50 bp, homo sapien
ttcttccatgaaggtggaatgctacraattatgtaagggaggtgggtgta

SEQ ID NO: 77304 - DNA, 50 bp, homo sapien
attattctgtacacttatattccacraagagaacaacttttaaaatccat

SEQ ID NO: 77305 - DNA, 50 bp, homo sapien
ttcagagactaagtgtctccagtacsacaaggtgcatttggttcctttga

SEQ ID NO: 77306 - DNA, 50 bp, homo sapien
gcagatctataccatgtatgtccacrgaatcccactagaataaaaacttt

SEQ ID NO: 77307 - DNA, 50 bp, homo sapien
agtaaatgtgcaaggaaattttataycagaggattagccttcaaggttat

SEQ ID NO: 77308 - DNA, 50 bp, homo sapien
aacaataggaaaactagtttaatgamgtatggttgcagaaaacaaaaaga

SEQ ID NO: 77309 - DNA, 50 bp, homo sapien
agagcctggtgctgagcccagcctaytactgacctgtgacaaatgttgaa

SEQ ID NO: 77310 - DNA, 50 bp, homo sapien
gctgttctgatagtttggctcgcacrccttgtaccagttcgtcaatactt

SEQ ID NO: 77311 - DNA, 50 bp, homo sapien
ggtcctgcccctggctgtaaacatgsaatggtgaagaataaggccaaggg

SEQ ID NO: 77312 - DNA, 50 bp, homo sapien
gaaaattttcaaattctaccaaaaarttgcaagctcatgtactgttcaac

SEQ ID NO: 77313 - DNA, 50 bp, homo sapien
gcatcttattgtggcgataacaaatsacaataacgaactgggcaggctaa

SEQ ID NO: 77314 - DNA, 50 bp, homo sapien
atcctttttcccaaatttcagataayggagtgtttggtatttcattaata

SEQ ID NO: 77315 - DNA, 50 bp, homo sapien
aattggcttgtttacaccacaattckcagtaccatacaggtaggggagat

SEQ ID NO: 77316 - DNA, 50 bp, homo sapien
tatattgcaaagaactgatacgaaaygttactgactacaaaagtaagacc

SEQ ID NO: 77317 - DNA, 50 bp, homo sapien
agcttactatgcttgacttcagttayattccccagtaccaagaacgcagg

SEQ ID NO: 77318 - DNA, 50 bp, homo sapien
tgaagttcaaaagaaaaaggcactcrattagttatcattatcttctgaat

SEQ ID NO: 77319 - DNA, 50 bp, homo sapien
gtgaaaaatagagtgcaatttatggkatgcccaggacctttgcctgctcc

SEQ ID NO: 77320 - DNA, 50 bp, homo sapien
agcgaattgcacatgtatctttttayctgaagcctccacacacgagaagg

SEQ ID NO: 77321 - DNA, 50 bp, homo sapien
cagagagacaaagaaaatacactgtktaagtccccatgtctgtaaaaggt

SEQ ID NO: 77322 - DNA, 50 bp, homo sapien
agagtccatggaccaaattaaaaggkatctcttcagcgtttgtacaaaaa

SEQ ID NO: 77323 - DNA, 50 bp, homo sapien
atggataactgagaggcatacgcaargtgcggcaatcagtttctagtaca

SEQ ID NO: 77324 - DNA, 50 bp, homo sapien
atccaccatctttcaaacaatcaacragtcatactgacagtactgtggat

SEQ ID NO: 77325 - DNA, 50 bp, homo sapien
gcataaaaatcatgtgcattatataygatggaaatacaacaaaataattg

SEQ ID NO: 77326 - DNA, 50 bp, homo sapien
gaatacagatttctgggtcccaaggmaggcttgctcagaatctcagaggg

SEQ ID NO: 77327 - DNA, 50 bp, homo sapien
atgtgacccaattctgctccatgaamctcggaggaaatctgagtgggaga

SEQ ID NO: 77328 - DNA, 50 bp, homo sapien
atctcttatcaaattaggttatctgsatgaacggaaggaagcaaggcatc

SEQ ID NO: 77329 - DNA, 50 bp, homo sapien
ttattagttcatactaattctcacartgcaaggaatttatacaaacattt

SEQ ID NO: 77330 - DNA, 50 bp, homo sapien
ccactgaaattaccaggttgttttgrtacttaagtgtgataatgtgttag

SEQ ID NO: 77331 - DNA, 50 bp, homo sapien
acaagaatggtaagattaatgcccartaagatacagcgaagtggattttt

SEQ ID NO: 77332 - DNA, 50 bp, homo sapien
accaaggctaagggagataaaccaascggtcagtggagccgggtaccgac

SEQ ID NO: 77333 - DNA, 50 bp, homo sapien
gcagaaaggcagtaggtcacaaggaktacacacattggcttagggtccca

SEQ ID NO: 77334 - DNA, 50 bp, homo sapien
aaaactttcctccattctggccacawctggaaggtggtctccatgccact

SEQ ID NO: 77335 - DNA, 50 bp, homo sapien
tagcaatgcttagtcatgaggtctcmagaaagaggtctctaaattagcta

SEQ ID NO: 77336 - DNA, 50 bp, homo sapien
cttaagtgagagcagatcgcattaaytgcctcgaaaagacccattttagg

SEQ ID NO: 77337 - DNA, 50 bp, homo sapien
ccacccctagcttctgactaattgamcttaagtgtgatttaggaatcaag

SEQ ID NO: 77338 - DNA, 50 bp, homo sapien
aaagttcaaattttgaagaccatttrcttacaagtgcaaaacaagaggga

SEQ ID NO: 77339 - DNA, 50 bp, homo sapien
tgaaatttaagtaacgtttgcatggracagtctcaaacttcagaaagatt

SEQ ID NO: 77340 - DNA, 50 bp, homo sapien
ccctgtgacatagcttactcttagakaattcaaactaaggtgttcagact

SEQ ID NO: 77341 - DNA, 50 bp, homo sapien
ctattctagaacggagagaaatagtraatggacaaataaatccagtacat

SEQ ID NO: 77342 - DNA, 50 bp, homo sapien
taagtacctaacagtgacaaattgakacactctgtgtcaggtaactgaca

SEQ ID NO: 77343 - DNA, 50 bp, homo sapien
ctacttttgactgaagtgaaggtacwctgatgacattctggaaacatact

SEQ ID NO: 77344 - DNA, 50 bp, homo sapien
atttccttttgcacatatctctctgyggctaaagtagaaacatcttgggt

SEQ ID NO: 77345 - DNA, 50 bp, homo sapien
tgttgattatgtgattcacatgacastatgatgtaagcttttaaaaactg

SEQ ID NO: 77346 - DNA, 50 bp, homo sapien
ttgacatcccttgttcttcatcttarggatcagcaatcagtatgtcattt

SEQ ID NO: 77347 - DNA, 50 bp, homo sapien
ttggccagctctcttgagtgcctttraagatttccggcttctctcatccg

SEQ ID NO: 77348 - DNA, 50 bp, homo sapien
atcagtcttattaagaagattacacrtggtgtattgagttgaataatgtt

SEQ ID NO: 77349 - DNA, 50 bp, homo sapien
cacaatgactaagtggggcttatccsaggaattcaaggttagtttaacat

SEQ ID NO: 77350 - DNA, 50 bp, homo sapien
gtatgcagaggtcatactggattagmgtaggccttaagtccaatatgact

SEQ ID NO: 77351 - DNA, 50 bp, homo sapien
cagctttctttacatattctctttamaaatttgctaatatcctctaaaca

SEQ ID NO: 77352 - DNA, 50 bp, homo sapien
ctattcagaatatccacttcctttcragtgagctttgatagtttgtgttt

SEQ ID NO: 77353 - DNA, 50 bp, homo sapien
tgatgtgatcatatggtagattacaytgatagattttaaaccagccctgc

SEQ ID NO: 77354 - DNA, 50 bp, homo sapien
tttgttatctggaatgacaagatatwctcatttgcctagtacattttctc

SEQ ID NO: 77355 - DNA, 50 bp, homo sapien
tgatttcttccacaaatacactgcawgataaaaaaagagaggagttttaa

SEQ ID NO: 77356 - DNA, 50 bp, homo sapien
tttatcctattttcaagactgttaartagccattgcctgatctaaaccct

SEQ ID NO: 77357 - DNA, 50 bp, homo sapien
tcccaagatcttcctccccagatccygaattaagaatgtatttccagatt

SEQ ID NO: 77358 - DNA, 50 bp, homo sapien
ctttttgttttccctggagccgctawtagccttgttttctgtgtattgtt

SEQ ID NO: 77359 - DNA, 50 bp, homo sapien
accaaacagatgagagctatccctamaccttgaggcaagaccgtccatgt

SEQ ID NO: 77360 - DNA, 50 bp, homo sapien
ctatctcctgtccacttacctttacyagacactgtattgtaacattttat

SEQ ID NO: 77361 - DNA, 50 bp, homo sapien
ctctctcttccctgttggccaagtcygagctgtgtcctggtgtccctatc

SEQ ID NO: 77362 - DNA, 50 bp, homo sapien
gctggagctaagggctctggttatayggaggaaagaggaaaattagctga

SEQ ID NO: 77363 - DNA, 50 bp, homo sapien
atgaggtcagtataacaatctataartattttccccagctgcataccaca

SEQ ID NO: 77364 - DNA, 50 bp, homo sapien
ctttttagagttgaaatggttcatcmaagttaaatgacatactagttaac

SEQ ID NO: 77365 - DNA, 50 bp, homo sapien
cagagttgacaagaggaaggaggacrcattaattatatgggctacaatgt

SEQ ID NO: 77366 - DNA, 50 bp, homo sapien
aagcgacatgtttctcaggttaacakctcatttgtgcttttggtcccaga

SEQ ID NO: 77367 - DNA, 50 bp, homo sapien
ctcccttcagactctctgtactctaygaatcttaccctcatcctgtcatt

SEQ ID NO: 77368 - DNA, 50 bp, homo sapien
tggcaaaccacagacggtctgctagyatcctcttctccagcataatcaga

SEQ ID NO: 77369 - DNA, 50 bp, homo sapien
agactagggatatgatggtccagatyagaagaggcagagcaggggagaaa

SEQ ID NO: 77370 - DNA, 50 bp, homo sapien
ttataaaaagggaagttgggagacayggttaagagttaatggaaaaaaca

SEQ ID NO: 77371 - DNA, 50 bp, homo sapien
tctcccaacttccctttttataagaygcagatatgagtgctcagtataga

SEQ ID NO: 77372 - DNA, 50 bp, homo sapien
ctctgtatgcctttgcatactcataktaatagcttagctcccacttataa

SEQ ID NO: 77373 - DNA, 50 bp, homo sapien
agaacttgtacgcaccactttttatkagagaaagctgaggtggtggattt

SEQ ID NO: 77374 - DNA, 50 bp, homo sapien
tcccagaaggtatttttaggtgttgrataaatgagtcaatccctgttaat

SEQ ID NO: 77375 - DNA, 50 bp, homo sapien
acccacactagcatcccttggtacayggagttggcacttcactataccta

SEQ ID NO: 77376 - DNA, 50 bp, homo sapien
agacttgtatttcttaacagtttcayccaagaaccagcaattttagagct

SEQ ID NO: 77377 - DNA, 50 bp, homo sapien
caattaaggacaagattagcagagakgaggaatttatggtgaaaatgcaa

SEQ ID NO: 77378 - DNA, 50 bp, homo sapien
gctgacctctgccaaattgaatgatrtattttcacatcctgacaaaagga

SEQ ID NO: 77379 - DNA, 50 bp, homo sapien
aaggccaaatctcaagttccaaggcyacattttgaatgacttacctcaac

SEQ ID NO: 77380 - DNA, 50 bp, homo sapien
tgatgcttaacctgtatgtattctgyaaatatttcaaaatctgaaaaaaa

SEQ ID NO: 77381 - DNA, 50 bp, homo sapien
caatcatgttctatcttcccgcctaygtgctcccgcttcaaatttctcag

SEQ ID NO: 77382 - DNA, 50 bp, homo sapien
gacgctaagataacattaaacatcayagcgtttttatgaatactccaaaa

SEQ ID NO: 77383 - DNA, 50 bp, homo sapien
gcagggactgttctcaggcttaaagyagggagcacagctggttgaggtta

SEQ ID NO: 77384 - DNA, 50 bp, homo sapien
gtaaatggatcatctagtattagacraataaatcattagagcaatgcttc

SEQ ID NO: 77385 - DNA, 50 bp, homo sapien
tactgtcctgacacataaacacctaraagcaggttttcaaaggttatttg

SEQ ID NO: 77386 - DNA, 50 bp, homo sapien
tgagcttttcttcaagataaagatcrcacagaattttgtgtttaccaggt

SEQ ID NO: 77387 - DNA, 50 bp, homo sapien
ctcaaattgacacccacctgattaakgtagactgttgcgctgtggccccc

SEQ ID NO: 77388 - DNA, 50 bp, homo sapien
gaacattccacaaagcttatcgaagmagagttcactgcattccaggacca

SEQ ID NO: 77389 - DNA, 50 bp, homo sapien
tgaaggtctcctgtagggtggccaayttgtcccagttttcctggggcttt

SEQ ID NO: 77390 - DNA, 50 bp, homo sapien
acccatagaattgtgagagacaataraatggttgttattttgagtcacta

SEQ ID NO: 77391 - DNA, 50 bp, homo sapien
gctaatgctggagcatttggaaacaygtgtataaatatttgaagcacaaa

SEQ ID NO: 77392 - DNA, 50 bp, homo sapien
acataaatattgaagatcttaaccayattgccaactggagcaacccagtc

SEQ ID NO: 77393 - DNA, 50 bp, homo sapien
tgtgaagtgaaatgagataatcctcrtaaatccctaagcactgcacctgg

SEQ ID NO: 77394 - DNA, 50 bp, homo sapien
aggcaaatcatctggggagattccasgctcatggctgcttttaaaagaca

SEQ ID NO: 77395 - DNA, 50 bp, homo sapien
ttaagcttgttgaagatagtggttaygtatttttatcaaagcactcgcct

SEQ ID NO: 77396 - DNA, 50 bp, homo sapien
attcattttgtttttaagatcttgawccaaatgccaattttaggaacaca

SEQ ID NO: 77397 - DNA, 50 bp, homo sapien
aactggcagcacaggagtgagtagaraatgaaaacacattgcttctgaag

SEQ ID NO: 77398 - DNA, 50 bp, homo sapien
ctagacctccttttcctattgcaaaygtaggtcaaagattcaagaagatg

SEQ ID NO: 77399 - DNA, 50 bp, homo sapien
agtttctcagtttgcagatagcttayggttgaggaccaaaggcgcctgtt

SEQ ID NO: 77400 - DNA, 50 bp, homo sapien
tgtgtgtgcctcaagggttgttctaygacgtgggcctaagccctttaggc

SEQ ID NO: 77401 - DNA, 50 bp, homo sapien
aaggagaaaaaaaatggtcttataawctccattttacagatcagaaaaca

SEQ ID NO: 77402 - DNA, 50 bp, homo sapien
cttagaatgttctggaagagaggttyaaatggactcttgaagaacttcac

SEQ ID NO: 77403 - DNA, 50 bp, homo sapien
actgaatcctatctccttgttttatkaatggaaactagtgaaggaaaggg

SEQ ID NO: 77404 - DNA, 50 bp, homo sapien
ctctggtgaaataatttcacatgtamccaacagccatattgggaaattcc

SEQ ID NO: 77405 - DNA, 50 bp, homo sapien
gcttctagttttaaataatagatacyacaataaaccttgattaaaccttg

SEQ ID NO: 77406 - DNA, 50 bp, homo sapien
gattttgttggctttagccctagtarataaggattcttgttgaatttagt

SEQ ID NO: 77407 - DNA, 50 bp, homo sapien
tttcagcccccacctgctgcccagcsaggtgtccttgttcaggccaccac

SEQ ID NO: 77408 - DNA, 50 bp, homo sapien
ttaaaaagaaattttagaaacttgckatctattaactcagggtaacaggg

SEQ ID NO: 77409 - DNA, 50 bp, homo sapien
cagatgtaagccatcacgccaggctkaattttatagtatttcattttatc

SEQ ID NO: 77410 - DNA, 50 bp, homo sapien
cctatgaattataaggtgggtatacmgaagagaatttccagaaaagtagg

SEQ ID NO: 77411 - DNA, 50 bp, homo sapien
acaagatgtgttctgtgtttttgaasagttttctgtcttttatttttatt

SEQ ID NO: 77412 - DNA, 50 bp, homo sapien
acctcacggagcccgtggtgctcacyttccagcaccagctacagccggtg

SEQ ID NO: 77413 - DNA, 50 bp, homo sapien
ctatgatttaaattattctggaagcmagaccaaagattcttgagtattta

SEQ ID NO: 77414 - DNA, 50 bp, homo sapien
ccttttaggtagttttaaggagttcraatgttgggctacatgaggtttta

SEQ ID NO: 77415 - DNA, 50 bp, homo sapien
tcctatctccttgttttatgaatggmaactagtgaaggaaagggacttgc

SEQ ID NO: 77416 - DNA, 50 bp, homo sapien
gtttttgttatttttaaatatttcaygagtctaatttctcttctgttgcc

SEQ ID NO: 77417 - DNA, 50 bp, homo sapien
tgaagacatttaatgtgcggttttawggatttaacatgttaagtgggaca

SEQ ID NO: 77418 - DNA, 50 bp, homo sapien
gtaagttttaagttatcccctctaartcagtcacaggcttcatgagccca

SEQ ID NO: 77419 - DNA, 50 bp, homo sapien
cttttttaaatgcacctttgttatayatccaagcagggaactattatgga

SEQ ID NO: 77420 - DNA, 50 bp, homo sapien
catggacccaaagtgggctggagaaygataccttaaccttggttgacagc

SEQ ID NO: 77421 - DNA, 50 bp, homo sapien
caaaagcccctttggggaaaatgacrctagctaaaatcacgtaaattaaa

SEQ ID NO: 77422 - DNA, 50 bp, homo sapien
taaagaagcaaataccaagtggaacyattatatcagttgaattctatctg

SEQ ID NO: 77423 - DNA, 50 bp, homo sapien
aactctttgtgcttattgttttagtsaattatgaaaccaaaacaaattag

SEQ ID NO: 77424 - DNA, 50 bp, homo sapien
ataagatttgttctgttgtttaaagwagcaaataccaagtggaactatta

SEQ ID NO: 77425 - DNA, 50 bp, homo sapien
ttccattgatttattcttgcttgtckctgaaacttcatgtgaaatgaaaa

SEQ ID NO: 77426 - DNA, 50 bp, homo sapien
ctgagatttatacatagtatttcatkaatcaatagtttggttattttaat

SEQ ID NO: 77427 - DNA, 50 bp, homo sapien
gggcatgggtctgttcaacaagtaayagtggtgactcggaacctctgttg

SEQ ID NO: 77428 - DNA, 50 bp, homo sapien
ctactgctgttgatgctggacacaaycctgggacacaaaggcagcagaaa

SEQ ID NO: 77429 - DNA, 50 bp, homo sapien
ctaatcctgatttttttgctgcccawtaaactccacaagtatctttctgt

SEQ ID NO: 77430 - DNA, 50 bp, homo sapien
aaaatgctttctacattgacattcaytcctattttactgggcacctatga

SEQ ID NO: 77431 - DNA, 50 bp, homo sapien
gcaaagtcagaggaggagaagaacargtgatgattagagtgatctacttt

SEQ ID NO: 77432 - DNA, 50 bp, homo sapien
tgtttaatgaatgtagttcataagcwcctcttgccataagattagttttg

SEQ ID NO: 77433 - DNA, 50 bp, homo sapien
gtcaattctggaagtgacagaagggwtgtatatgtaattttatggctacc

SEQ ID NO: 77434 - DNA, 50 bp, homo sapien
tgattctttttctcagtagtgtcaargagtttgcttttcctataaatata

SEQ ID NO: 77435 - DNA, 50 bp, homo sapien
acttcccctgggtgagattgccatawacctcttcttgtatctttcctcct

SEQ ID NO: 77436 - DNA, 50 bp, homo sapien
ttagaaaaggatctgcctaaagccaygtaaattactcgtccagacatttc

SEQ ID NO: 77437 - DNA, 50 bp, homo sapien
aatggaatagaaacatctaataaacraatttttcccttgttcagagtagt

SEQ ID NO: 77438 - DNA, 50 bp, homo sapien
actctgcccctagagcactcagaagraaatacagccctgttgaccccttg

SEQ ID NO: 77439 - DNA, 50 bp, homo sapien
agtggttttattttaactcataaaarttacaaataaaacattctacgttt

SEQ ID NO: 77440 - DNA, 50 bp, homo sapien
attttacctggctcaactttctaaawcaggacttctcaaaccgtgatatg

SEQ ID NO: 77441 - DNA, 50 bp, homo sapien
agaaatctagatcttatggatataawtctgtagtaatacagatgtgtcaa

SEQ ID NO: 77442 - DNA, 50 bp, homo sapien
gaattcaggatgcattcaacacccarattcaactacatgtgctctctttt

SEQ ID NO: 77443 - DNA, 50 bp, homo sapien
tcttccacactgaaggtacagatcckgcacttgccaggccaggacactga

SEQ ID NO: 77444 - DNA, 50 bp, homo sapien
ctgatacatactacaacatagataamccttgagaacattatgctaagtga

SEQ ID NO: 77445 - DNA, 50 bp, homo sapien
tttatccaggcatgtcttcttgtccmagtgttttaataatctaattttaa

SEQ ID NO: 77446 - DNA, 50 bp, homo sapien
ataagtcttacagtcataacagtcayaataagggaactctaactgagctt

SEQ ID NO: 77447 - DNA, 50 bp, homo sapien
aaaattgcccatgatcacactgtgarcaaaagaaggagccaagattcgtg

SEQ ID NO: 77448 - DNA, 50 bp, homo sapien
gctaagagaaaggcttaattcaatgrcaagttcaagggtttaattttacg

SEQ ID NO: 77449 - DNA, 50 bp, homo sapien
gttttacggctggtaaacaaacaaaygtccaatcctcataaaactttcat

SEQ ID NO: 77450 - DNA, 50 bp, homo sapien
agtttgaaaaggtctcaaaagggtcragaaggaatgtacaaaaacacaca

SEQ ID NO: 77451 - DNA, 50 bp, homo sapien
catagggggacatcttttttgatagraactaacagggttggggcaggtgc

SEQ ID NO: 77452 - DNA, 50 bp, homo sapien
agaactttatctccaactttcacgcyaactggttgaatccctccaccctt

SEQ ID NO: 77453 - DNA, 50 bp, homo sapien
ataaaaaagataccgagtatctgaayaagcccctgaggaagataaggtct

SEQ ID NO: 77454 - DNA, 50 bp, homo sapien
tctacttgtttttatctcaagtgaayctggagaagcaacaataatggacc

SEQ ID NO: 77455 - DNA, 50 bp, homo sapien
ttttaatatagaaaaaaatctagcayccaggaactaagacaaagaccaag

SEQ ID NO: 77456 - DNA, 50 bp, homo sapien
gcatccaggaactaagacaaagaccragtatcacatattgcaagtaaaaa

SEQ ID NO: 77457 - DNA, 50 bp, homo sapien
tgaagatctcatgtttgaaatcagaygtgttggttatgtgcttgtttaga

SEQ ID NO: 77458 - DNA, 50 bp, homo sapien
tatttccaatgggaacagattttaaytgataacactaacaaattgctaat

SEQ ID NO: 77459 - DNA, 50 bp, homo sapien
cctcataattacacattgttaacccrgagacaaaatgctaaagagagaaa

SEQ ID NO: 77460 - DNA, 50 bp, homo sapien
aaatttggataagaaaacgttctcargtttacagttaatatccctgacga

SEQ ID NO: 77461 - DNA, 50 bp, homo sapien
agacatgtgaccaaaaaagcaccaaygagagactgcttgatatttgaata

SEQ ID NO: 77462 - DNA, 50 bp, homo sapien
acagagacacaaaacttctgtgattraaacagaaccagaggcaggatcag

SEQ ID NO: 77463 - DNA, 50 bp, homo sapien
taatggaccttctcccctagtcaaakagcctgtggacctcccctcatagt

SEQ ID NO: 77464 - DNA, 50 bp, homo sapien
gctggcctggaaagcgtttgtaaagragagccagataagattcacttcca

SEQ ID NO: 77465 - DNA, 50 bp, homo sapien
taaaaattacctggaggatgattacractgaactgcaggatgattaagaa

SEQ ID NO: 77466 - DNA, 50 bp, homo sapien
ttctagatgatgttagattttggctstgttctcaacttcttccaacttca

SEQ ID NO: 77467 - DNA, 50 bp, homo sapien
tccatgtttcatggtattggtgttcyaagactaacaatccaaagagtgat

SEQ ID NO: 77468 - DNA, 50 bp, homo sapien
atgttttgactaagttagacaatctmaaaaagcatatatggtggagaggc

SEQ ID NO: 77469 - DNA, 50 bp, homo sapien
cagtactggatactcatcaaggaacyagtaacatgtgccaaaatgattcc

SEQ ID NO: 77470 - DNA, 50 bp, homo sapien
ataaaaaatttgttgaagaaatgaamaaagtaactctcctgttattaggc

SEQ ID NO: 77471 - DNA, 50 bp, homo sapien
atttcacagaaatattttttccttasactatgtgatcatgagggtcattg

SEQ ID NO: 77472 - DNA, 50 bp, homo sapien
gaaacatagactattatgtaaacaartatctcaaataactcaatatatag

SEQ ID NO: 77473 - DNA, 50 bp, homo sapien
tatgaatccaggcactttttctcaaygtatcaataactttgctgaataat

SEQ ID NO: 77474 - DNA, 50 bp, homo sapien
aaaatattttgcattgtaaaagatcraaaacataaaggcttacttgacaa

SEQ ID NO: 77475 - DNA, 50 bp, homo sapien
ccttgaagctgttaaccactcgatcyaatcttagggcagtgtcacattcc

SEQ ID NO: 77476 - DNA, 50 bp, homo sapien
cttaattagtatgcttgctcttactyaaaatgctccacgcaccttttgca

SEQ ID NO: 77477 - DNA, 50 bp, homo sapien
actatatttgtaaaaattcatagaartgtatggtaaaagagtaagtccca

SEQ ID NO: 77478 - DNA, 50 bp, homo sapien
aaagcaatttttataccactattcckaaattttcagtcacattccttttc

SEQ ID NO: 77479 - DNA, 50 bp, homo sapien
acagattaatgaaaaattgggatcartatatgacagagattcatgttgca

SEQ ID NO: 77480 - DNA, 50 bp, homo sapien
gagggtaaaaatgtgttaagaggtaragaagaagagagagagaacactaa

SEQ ID NO: 77481 - DNA, 50 bp, homo sapien
agatatttctgtaaatccattagacrctcatagtttataagcataatggc

SEQ ID NO: 77482 - DNA, 50 bp, homo sapien
gcatttataacatactttgctgcaaytaattttttccagccttctaggac

SEQ ID NO: 77483 - DNA, 50 bp, homo sapien
cttcaacaggaagacattataaagaytagtgaaaatacttgtgctatgca

SEQ ID NO: 77484 - DNA, 50 bp, homo sapien
ctaatggatttacagaaatatcttgratctctggaagaaaaagtcagaaa

SEQ ID NO: 77485 - DNA, 50 bp, homo sapien
tatacatgagatgagggagatggacrattcatcaggcctgaaaggcaagg

SEQ ID NO: 77486 - DNA, 50 bp, homo sapien
tgctctactatataatgcaacactgwgttttcctcaaaaggcaaagacta

SEQ ID NO: 77487 - DNA, 50 bp, homo sapien
tagatagttatataactgctcagtcmacaattttatctgcagtatatgct

SEQ ID NO: 77488 - DNA, 50 bp, homo sapien
ataaaaaattaggaacttaaggttasgtacagcagtcaggaaaggtgggc

SEQ ID NO: 77489 - DNA, 50 bp, homo sapien
ctcccctgagctttaaatcaatcgcraacaaatgttttcatagcctttgt

SEQ ID NO: 77490 - DNA, 50 bp, homo sapien
tccaaacactcagaccaacataaacygaaaggaagagaatcccagggaac

SEQ ID NO: 77491 - DNA, 50 bp, homo sapien
tctcaggcattaattctatcacttayaatctcatttcccttctaccaatt

SEQ ID NO: 77492 - DNA, 50 bp, homo sapien
taatatgcaatatattagagcaatamctggttaagagagtagacaaatgg

SEQ ID NO: 77493 - DNA, 50 bp, homo sapien
ctagaatgcatgcatctgaaatttcrcagtagttataaatgctcacattc

SEQ ID NO: 77494 - DNA, 50 bp, homo sapien
acattcattggaggcaatagaacgcrgatcagtggagtgagaaacaagat

SEQ ID NO: 77495 - DNA, 50 bp, homo sapien
gaatccatgtatcaggatctgcttgratatttgaggcacggtatgtgatg

SEQ ID NO: 77496 - DNA, 50 bp, homo sapien
gggccacaaggatctgtgagaacccrgcctatcctcaaagaggccaccat

SEQ ID NO: 77497 - DNA, 50 bp, homo sapien
tgcattaaggtcactttgttaataawtgttacatcctgtgcttctaccca

SEQ ID NO: 77498 - DNA, 50 bp, homo sapien
aaaatttaagaaacaagttgatatgyattttcagggagagaagagaaaag

SEQ ID NO: 77499 - DNA, 50 bp, homo sapien
atttttactctgtctctgatgagaaragtgtacaaaaggggcataaagta

SEQ ID NO: 77500 - DNA, 50 bp, homo sapien
tttactcaaacccaggtttagcgaayaatcaggattaaaatacacttgac

SEQ ID NO: 77501 - DNA, 50 bp, homo sapien
cttctagaacttgtctgtttgagatwactgatttgtcagagagagagaca

SEQ ID NO: 77502 - DNA, 50 bp, homo sapien
cactattatgactaagtacgtcatayacaacaatcaagaaaatgaagcaa

SEQ ID NO: 77503 - DNA, 50 bp, homo sapien
tcatctacaaattgcagatgaagaaractaaatgcagatgagttttaata

SEQ ID NO: 77504 - DNA, 50 bp, homo sapien
actgattgaggctccactgtgtgaayaactgtactttaacacacaataga

SEQ ID NO: 77505 - DNA, 50 bp, homo sapien
ttcaaatataatcacactgtcatggyagataggcttgtgttggtccagtt

SEQ ID NO: 77506 - DNA, 50 bp, homo sapien
ctcactaatattactttcttctccaytcagttatcaaaaacccatcccct

SEQ ID NO: 77507 - DNA, 50 bp, homo sapien
cttaacttatggagataatacatagracaactttatagggtggctgtgaa

SEQ ID NO: 77508 - DNA, 50 bp, homo sapien
tcaaagatagttaagtaacagggccygaaatataggagctaatgacctaa

SEQ ID NO: 77509 - DNA, 50 bp, homo sapien
cacagaatctgtggtgactcttctawactaaattaacaaggaattcttag

SEQ ID NO: 77510 - DNA, 50 bp, homo sapien
tagactttttgcagtttagcatccartatatatgtgtcaccatttaatat

SEQ ID NO: 77511 - DNA, 50 bp, homo sapien
ctgcactgacagatctcaaactccartgatggtcttcctaatacactgag

SEQ ID NO: 77512 - DNA, 50 bp, homo sapien
agcatctgcaaagcatggcaagccartcttacacaaatgctgattataag

SEQ ID NO: 77513 - DNA, 50 bp, homo sapien
gaaatgaggagataatatctcgaaamctttaatgtatgcttacctaaaag

SEQ ID NO: 77514 - DNA, 50 bp, homo sapien
tttaaaaagcctaaaagtttgtacaytgaagaaaaaaaaaatggataaat

SEQ ID NO: 77515 - DNA, 50 bp, homo sapien
gcagtcaatctctcttctcttcagartatctgttgttacttatatgggca

SEQ ID NO: 77516 - DNA, 50 bp, homo sapien
atttatatctctaaagaaataaacakcttaatgtctgtatatttgctata

SEQ ID NO: 77517 - DNA, 50 bp, homo sapien
gttcagccacacaaactgcaggctayccatttcttagcatgtcttgttat

SEQ ID NO: 77518 - DNA, 50 bp, homo sapien
ggaacaacctcacaaaggccagagamaaatgtgacctaagaaacttcgga

SEQ ID NO: 77519 - DNA, 50 bp, homo sapien
ttctagagccatagagatagagtacraaatagatgcaagccctgtagacc

SEQ ID NO: 77520 - DNA, 50 bp, homo sapien
aggaagaagggcaacagtacaactasaaagtcatcaaattgcctgtttat

SEQ ID NO: 77521 - DNA, 50 bp, homo sapien
agtatttattgcacaacttggaggawtaccaacagaatcaaaacacagtc

SEQ ID NO: 77522 - DNA, 50 bp, homo sapien
tctctaccctcaagttgttcccaaamcagaaagatataaaaagatgtgag

SEQ ID NO: 77523 - DNA, 50 bp, homo sapien
acaaaatctacaggaaagtaagacartaagtttgagaatagagtctcatc

SEQ ID NO: 77524 - DNA, 50 bp, homo sapien
gagatgctctgtgaaatatgctaacycttggaacagctgagtcggtgaca

SEQ ID NO: 77525 - DNA, 50 bp, homo sapien
agaagacttttgaaaatagtaaagtkaccatgaagtagtaaaaggggcat

SEQ ID NO: 77526 - DNA, 50 bp, homo sapien
aacaaccatatgacttacaaagtackattcagggcaataaaaatgaggaa

SEQ ID NO: 77527 - DNA, 50 bp, homo sapien
atgtagtagaatataccttaaggcamaaacactacaaaacaaaacctcat

SEQ ID NO: 77528 - DNA, 50 bp, homo sapien
tactttgtaagtcatatggttgtttyctttctatttgagagagcatttcc

SEQ ID NO: 77529 - DNA, 50 bp, homo sapien
aaggagaaatggatgggttttgctartacaatgacctcaaaaggcggtgt

SEQ ID NO: 77530 - DNA, 50 bp, homo sapien
tttctattgatgttttcatagcaaarattagtgtatctgtaattttctgt

SEQ ID NO: 77531 - DNA, 50 bp, homo sapien
aaacacacacccatttcccagggcaygttctggacccaggtgaccaagga

SEQ ID NO: 77532 - DNA, 50 bp, homo sapien
ggtggaaataataaacaatagacctytttggggagcagtttgcacttcta

SEQ ID NO: 77533 - DNA, 50 bp, homo sapien
tcacataggttcaaataactgggatygtgcatcacgtcatggaatgaatt

SEQ ID NO: 77534 - DNA, 32 bp, homo sapien
cataattagtaaaggawagaaagacgtgataa

SEQ ID NO: 77535 - DNA, 50 bp, homo sapien
aaaatatattcttctcacaggttagsctaaaattgattctccaagaaggc

SEQ ID NO: 77536 - DNA, 50 bp, homo sapien
ctttgtttaactgtctatatttacgycatttcagctgacccttccttctg

SEQ ID NO: 77537 - DNA, 50 bp, homo sapien
gcttggtggatagaggggtgtctccrcaagattctctgcagcaaagatac

SEQ ID NO: 77538 - DNA, 50 bp, homo sapien
tgacctttctgtccctccagcaacaygtattactctgagaaatgaacaca

SEQ ID NO: 77539 - DNA, 50 bp, homo sapien
aggtagggccaggggattgcgtggayatttgttgtttcattgtcctttca

SEQ ID NO: 77540 - DNA, 50 bp, homo sapien
ttacaagtacgtatcggttgttgaayacaatcgctttttaaaattcatta

SEQ ID NO: 77541 - DNA, 50 bp, homo sapien
taaactttatcatagcatatatgtayaggagaaaatgtagtgtatagagg

SEQ ID NO: 77542 - DNA, 50 bp, homo sapien
tgtttgttgtgcctatgcttgttagratgaaattatctactgcgtctttc

SEQ ID NO: 77543 - DNA, 50 bp, homo sapien
aatttgaaccatagaaaacagataarttaatgctaaagggatttgaattg

SEQ ID NO: 77544 - DNA, 50 bp, homo sapien
aggtaggaaggatttgcttaaggccraaacaagaaaactctcagatttga

SEQ ID NO: 77545 - DNA, 50 bp, homo sapien
aactagaacagcatatcttatgtacraatgagtttctattatgtgaacac

SEQ ID NO: 77546 - DNA, 50 bp, homo sapien
tgggcatgatggtagacttatcccaygtctcagatgctgtggcacggcgg

SEQ ID NO: 77547 - DNA, 50 bp, homo sapien
gaattgtttgcccaaataaatattayatgtgaaaagcacaaacattttta

SEQ ID NO: 77548 - DNA, 50 bp, homo sapien
atgacttgaacaactccagtttgatragtagatgagtttattaggaatta

SEQ ID NO: 77549 - DNA, 50 bp, homo sapien
taccaggttacttaagggtgcatttrtctgctgagtgaaacttgaaggcc

SEQ ID NO: 77550 - DNA, 50 bp, homo sapien
cattaataagaaagtgttaagttcaytccaaggcagagctgagccatttg

SEQ ID NO: 77551 - DNA, 50 bp, homo sapien
ttctttctttccttgaggcaactcayctctgactcagaacttttgctcat

SEQ ID NO: 77552 - DNA, 50 bp, homo sapien
acaatttaagacttgtacatctgaartccttaaaacaaacatctggtaaa

SEQ ID NO: 77553 - DNA, 50 bp, homo sapien
tatcactggataagatctgtgtttcraaagtattttccctggtatttctt

SEQ ID NO: 77554 - DNA, 50 bp, homo sapien
ggagagagtacagagaacaatccatytcatggagactagtacagttaagc

SEQ ID NO: 77555 - DNA, 50 bp, homo sapien
tatgcctcacaatttgcattaaaaastaaaaaacagatagagtgaacatg

SEQ ID NO: 77556 - DNA, 50 bp, homo sapien
acttgctttcttccttttgattgtawgcacctttgctagaaacttcccca

SEQ ID NO: 77557 - DNA, 50 bp, homo sapien
attggtgtcaggataggcatataaaycaaggagacagaaaagcaaatcaa

SEQ ID NO: 77558 - DNA, 50 bp, homo sapien
aacaggaagccaagcaaatgtagtcrgacaccaaggtcatgtagtgtatg

SEQ ID NO: 77559 - DNA, 50 bp, homo sapien
ccttgacatggacatgtattgttagwatattgtggagagcttcccagcac

SEQ ID NO: 77560 - DNA, 50 bp, homo sapien
aaagcaaaaccaaattaacggatacraatgtttaatataggtattttccc

SEQ ID NO: 77561 - DNA, 50 bp, homo sapien
tgggtacacatgttcttggctgaccraaatttaggcaatgaagaatcgct

SEQ ID NO: 77562 - DNA, 50 bp, homo sapien
cacacttctgtttgcatttcttttayatcttgacacaacacggagcatat

SEQ ID NO: 77563 - DNA, 50 bp, homo sapien
acttgaatcaattaaatgtgaggtcyattaatgtaagtatctttcctacc

SEQ ID NO: 77564 - DNA, 50 bp, homo sapien
aaagggagggtaaccccagctacacyattattatgttttaaagtcctggc

SEQ ID NO: 77565 - DNA, 50 bp, homo sapien
aatataagccaatcaaaaacactaaycacaacttttcaagacagagagag

SEQ ID NO: 77566 - DNA, 50 bp, homo sapien
agtaatttctgatacctgcaaaagtmaaaaacaccaggtaactgaatgca

SEQ ID NO: 77567 - DNA, 50 bp, homo sapien
tcatttgtaattacttcttttagttkctgagcttaatcattataaagcag

SEQ ID NO: 77568 - DNA, 50 bp, homo sapien
ctggacaccagaggtctattgcttcyactcttttgcatatggttgatgtg

SEQ ID NO: 77569 - DNA, 50 bp, homo sapien
tgtaagaccacgtaataagataatgyaaagtgcagtcatggtaaaaagga

SEQ ID NO: 77570 - DNA, 50 bp, homo sapien
ttccagaattcaagaaaccattgtcraaagtgaagaataatttgttaatt

SEQ ID NO: 77571 - DNA, 50 bp, homo sapien
ggtaaaaacttgatgttgtggataaygtgttcacttaacctctgctaagg

SEQ ID NO: 77572 - DNA, 50 bp, homo sapien
ttaagcataatttaggtttctgaatycataatggcatgagaaagcatttg

SEQ ID NO: 77573 - DNA, 50 bp, homo sapien
aaaagatggggttagtatggttgaaygtaatcttaaatgacaactttata

SEQ ID NO: 77574 - DNA, 50 bp, homo sapien
tgagaataggtctcagagcttgtcayggatgctacagctccatctgcctg

SEQ ID NO: 77575 - DNA, 50 bp, homo sapien
catggaactgaagaatgaacccaaaygcctaaagaaaaataaaatatagg

SEQ ID NO: 77576 - DNA, 50 bp, homo sapien
atattgagttggaaggtactgtagcrctaaattagatttgactagatctg

SEQ ID NO: 77577 - DNA, 50 bp, homo sapien
cgtcagatgagtaaagggaaattcaygtcctaggcattacagcattctaa

SEQ ID NO: 77578 - DNA, 50 bp, homo sapien
gggcccaatgcactaagcaaatcatraaagtggcatcagataatctgtat

SEQ ID NO: 77579 - DNA, 50 bp, homo sapien
agtaaactgaagagctgcctcctcayaacaggtcaagtgctacgtcgagg

SEQ ID NO: 77580 - DNA, 50 bp, homo sapien
catgaaactttttgactgcactgacyggctactaggcagtcatagaatgt

SEQ ID NO: 77581 - DNA, 50 bp, homo sapien
tcactctatactgagttattgtttcrcctagtcttcctcttcttactcat

SEQ ID NO: 77582 - DNA, 50 bp, homo sapien
tctcagcagttttcctgagagtaccrccaaagtctcatcatatttgagag

SEQ ID NO: 77583 - DNA, 50 bp, homo sapien
tgaagacgtctagaatcttagaagcraaggactatgtactcagggaaatt

SEQ ID NO: 77584 - DNA, 50 bp, homo sapien
actggcatgctaacctaatcaccacrgaacacttttaataatgaatacct

SEQ ID NO: 77585 - DNA, 50 bp, homo sapien
tagaactgatgaaaagagtttaaacrgaggatataagttaaaatgcctgg

SEQ ID NO: 77586 - DNA, 50 bp, homo sapien
gcacgcaaataaaaatatctattacrgaattctacaggataaattattta

SEQ ID NO: 77587 - DNA, 50 bp, homo sapien
aaatgggtgcttttaacagacaacaytctttgaacctgaatctgcttcag

SEQ ID NO: 77588 - DNA, 50 bp, homo sapien
taataagaattggctgatacttggartagctctgctcaaaaatacatgct

SEQ ID NO: 77589 - DNA, 50 bp, homo sapien
ggaaagtgtttagcataatagtagayggtgttgtcataatcagaagggag

SEQ ID NO: 77590 - DNA, 50 bp, homo sapien
tcctccctgagttctcacatttgcaracacggtactcacttttagcttga

SEQ ID NO: 77591 - DNA, 50 bp, homo sapien
caatctatttttctatttagaatgarggccattaggagcaaagacatttc

SEQ ID NO: 77592 - DNA, 50 bp, homo sapien
atttggatcagtagtctaaatactaygaagatgccaattctctgaaaatt

SEQ ID NO: 77593 - DNA, 50 bp, homo sapien
cagaatgtaagaatgatttccgggaragtaaccatgatagctacatcacc

SEQ ID NO: 77594 - DNA, 50 bp, homo sapien
tggaggagatcattaatagctatgtsaacaatctgtaagaatttttttaa

SEQ ID NO: 77595 - DNA, 50 bp, homo sapien
tctgaggaggtgacatttaactagarcaaaggtacatatgagggaaaagg

SEQ ID NO: 77596 - DNA, 50 bp, homo sapien
ttctcatgcagaaactgatcaataamccaggaagatttgagatgaagtaa

SEQ ID NO: 77597 - DNA, 50 bp, homo sapien
gacacgtgtataacattttattggasagaaatataatggattatctaaat

SEQ ID NO: 77598 - DNA, 50 bp, homo sapien
gaagcattataaaagattgacgtcayaaagataagaatttaactgggtca

SEQ ID NO: 77599 - DNA, 50 bp, homo sapien
aaaggtaaatcacaactaataataartggagccaatttttgaatagcata

SEQ ID NO: 77600 - DNA, 50 bp, homo sapien
gaactgtgtctccacttagagcaagrcaataagtactgacctgggctggt

SEQ ID NO: 77601 - DNA, 50 bp, homo sapien
gaggaaacaaagcaaatcacacaaawcttccaaagaaggcaatgaaaaag

SEQ ID NO: 77602 - DNA, 50 bp, homo sapien
aaatttttctgcctactgcctacaaygcaaagtaactagccctctttgtt

SEQ ID NO: 77603 - DNA, 50 bp, homo sapien
gtgatttttctttttaatgtagaaargccatattttatgaaggggttcag

SEQ ID NO: 77604 - DNA, 50 bp, homo sapien
aatggcccagcatagggtaaatgctwcttaactggtagttaccattgctc

SEQ ID NO: 77605 - DNA, 50 bp, homo sapien
ggtctctgctttctgtctctatcacygaatggtaagtcatatgggggcag

SEQ ID NO: 77606 - DNA, 50 bp, homo sapien
agcatttgaaataactcagaactackgaaggactaattgcttcactctgt

SEQ ID NO: 77607 - DNA, 50 bp, homo sapien
gaagtattatgtttctagagaaagcyaagaggacactattcaccgaagtc

SEQ ID NO: 77608 - DNA, 50 bp, homo sapien
agtgctggcctgcttagaagataacygctatgacacactgacacagattg

SEQ ID NO: 77609 - DNA, 50 bp, homo sapien
gaagccaccatcccagaaatgccaayggctacagacaaaaatccccaatt

SEQ ID NO: 77610 - DNA, 50 bp, homo sapien
aatagagagaaaaattatttttggaygttagtaatgcacaacaggattta

SEQ ID NO: 77611 - DNA, 50 bp, homo sapien
ttggttcttccactatttttgctagkattggaatatccaacacatgcaca

SEQ ID NO: 77612 - DNA, 50 bp, homo sapien
taaacaagaacgtaaacatattcaakaactggaaatatacaaattcaaaa

SEQ ID NO: 77613 - DNA, 50 bp, homo sapien
ccagcagataatctctagttatacawgaaaatgacaatttccactacatc

SEQ ID NO: 77614 - DNA, 50 bp, homo sapien
tgatagtccctgtttctttagtacgytccctgtctcactggtttggaggc

SEQ ID NO: 77615 - DNA, 50 bp, homo sapien
gcagagtcaatatagaattgaattaygatgcaagcatgactatttagcaa

SEQ ID NO: 77616 - DNA, 50 bp, homo sapien
ctattacatttatcagacagtgacawatttttatccaacattttggaacc

SEQ ID NO: 77617 - DNA, 50 bp, homo sapien
tatcatattagttttccaaaaggtcrtatcatactgcaagcaattcatct

SEQ ID NO: 77618 - DNA, 50 bp, homo sapien
ggaattctaccatgcaagaaagagartcatgttatttaattttttcttaa

SEQ ID NO: 77619 - DNA, 50 bp, homo sapien
tagtttgtaaagtgtatttttcacasagcatataaaatgaacatttagac

SEQ ID NO: 77620 - DNA, 50 bp, homo sapien
gaagagagtgttgtgattcttaagtyaacctaggcctaagaatccactta

SEQ ID NO: 77621 - DNA, 50 bp, homo sapien
acttacatatgtgatatttctcaccygatagattttcaagcattgaaacc

SEQ ID NO: 77622 - DNA, 50 bp, homo sapien
ttttttaaacaattgttttgaagaamagttgaagattaatcttaatggta

SEQ ID NO: 77623 - DNA, 50 bp, homo sapien
aaatgtttgggacaaatttctaggtwaaaagaactgcctgcaataactta

SEQ ID NO: 77624 - DNA, 50 bp, homo sapien
ttttttttttttaataaatgacatgmagttaggtaaaaggccactcgcct

SEQ ID NO: 77625 - DNA, 50 bp, homo sapien
atagaatagcccagagaggataaaaytgtagcggattttgcatcattttt

SEQ ID NO: 77626 - DNA, 50 bp, homo sapien
tttattctgaattgtgtgagagtatraggcacatgttatatgctaaataa

SEQ ID NO: 77627 - DNA, 50 bp, homo sapien
gaggcttatagctctctagctgtcakagtttgactccagtaatctcacct

SEQ ID NO: 77628 - DNA, 50 bp, homo sapien
cccataggccagtgaaatggatccartaagacataactaacttcagtttc

SEQ ID NO: 77629 - DNA, 50 bp, homo sapien
gctgccaaatgtaaccactaatacckgacctggcagactctcaggactat

SEQ ID NO: 77630 - DNA, 50 bp, homo sapien
aatgacacatttatgcttgttacaaractgtttacatttctctgagctta

SEQ ID NO: 77631 - DNA, 50 bp, homo sapien
gtcttctaggtgactcctaaacataygatgaacagggtcatgtgagtata

SEQ ID NO: 77632 - DNA, 50 bp, homo sapien
ggagctttcctctgccttcagaggawtccgatgaaagggtctgaggaaca

SEQ ID NO: 77633 - DNA, 50 bp, homo sapien
gggtcaatatggagaatactctcaartaatgtatttattaatacattttt

SEQ ID NO: 77634 - DNA, 50 bp, homo sapien
ccacagggaaggcagcttaattagcsaggtgtcctgcaggcagtaacagg

SEQ ID NO: 77635 - DNA, 50 bp, homo sapien
tcaattgcccttaacctcagactcasacttttatagataagaatttatca

SEQ ID NO: 77636 - DNA, 50 bp, homo sapien
ttcattagtaacactgtgacaaaaargaatatgaatggcattaggaaatt

SEQ ID NO: 77637 - DNA, 50 bp, homo sapien
agcctgacttgcgtggtaatggttaygacagctgttaagggataaaacga

SEQ ID NO: 77638 - DNA, 50 bp, homo sapien
tagagtgagtccctgtgtttataggscttcagtgtcagcaaacagattta

SEQ ID NO: 77639 - DNA, 50 bp, homo sapien
tggaacttttgttatataagtttaayaagagtcttcattttatcattggc

SEQ ID NO: 77640 - DNA, 50 bp, homo sapien
tcttcaagctctgttgtcactgtaamgctcaaagatggaaccaacagctt

SEQ ID NO: 77641 - DNA, 50 bp, homo sapien
gctggaggcaacatcttcttccccayagattccataattaggttgcacat

SEQ ID NO: 77642 - DNA, 50 bp, homo sapien
ttgtgtcaagagacacttacctgggkatgtaaagactatggtttggggtt

SEQ ID NO: 77643 - DNA, 50 bp, homo sapien
gaaatgcttctagaagaactgagackgagaagagaaagatagactgtttg

SEQ ID NO: 77644 - DNA, 50 bp, homo sapien
aactgacacaggacaatctgaaaaakaatctttcgtcaaggagccatttg

SEQ ID NO: 77645 - DNA, 50 bp, homo sapien
ggttagaataaaaacaaatcatacastaacagtaaatacacttgttattc

SEQ ID NO: 77646 - DNA, 50 bp, homo sapien
ttcctaaactgtctgggttttcttgyagcagatctgttgcaggtgtcctc

SEQ ID NO: 77647 - DNA, 50 bp, homo sapien
gtttatgttagttcttgtctgcattygttaaaggaaaactatagctttta

SEQ ID NO: 77648 - DNA, 50 bp, homo sapien
ttgagagttctaaattccccatttaycattcatacacgtttttatattca

SEQ ID NO: 77649 - DNA, 50 bp, homo sapien
caaacctttaattcattatcgaacaygtaataggtatctgatatatatca

SEQ ID NO: 77650 - DNA, 50 bp, homo sapien
agtaaataaaacatcagcattaggaragtcccttcagccttagtttttgg

SEQ ID NO: 77651 - DNA, 50 bp, homo sapien
gttttaaggaataagtgtgataatayatgtaaaagacatagcacagagct

SEQ ID NO: 77652 - DNA, 50 bp, homo sapien
tttcctctgctttttttaagcagacrgagctttgtcccctagccaccgca

SEQ ID NO: 77653 - DNA, 50 bp, homo sapien
ctctcccacctccaaagtcattgaargcaatataagagcagctgtgagcc

SEQ ID NO: 77654 - DNA, 50 bp, homo sapien
tttgtgcataatttataatgaaacargtagataggtaggtaggtaggctg

SEQ ID NO: 77655 - DNA, 50 bp, homo sapien
cccctgtactgacagccctagtaagygtggattcactgggtttattccct

SEQ ID NO: 77656 - DNA, 50 bp, homo sapien
ggtatttagaaaaaattgaacagtcraaggtgcgtgtaccatctacctac

SEQ ID NO: 77657 - DNA, 50 bp, homo sapien
caaagagatccctattgttagatgargacaaagacaagagatgaagtgca

SEQ ID NO: 77658 - DNA, 50 bp, homo sapien
ctgtcctatcttagttgagattagarataactgatgcagagaatgtcttg

SEQ ID NO: 77659 - DNA, 50 bp, homo sapien
gtgaaatgaaaatcatttgtacgaaytgactaacgaggattattatattt

SEQ ID NO: 77660 - DNA, 50 bp, homo sapien
tgtattgtccattggtctctaaagcrcgaggctgagcagaccattccaga

SEQ ID NO: 77661 - DNA, 50 bp, homo sapien
attgttattgttggctttagtgcttyaatctaaagaggacacaaattctg

SEQ ID NO: 77662 - DNA, 50 bp, homo sapien
aaatgcatattttcattctagagtarattatagaccaccaactatagcct

SEQ ID NO: 77663 - DNA, 50 bp, homo sapien
tctttgtttatccaaaaatgccgaasactctgtttgacccataatagctt

SEQ ID NO: 77664 - DNA, 50 bp, homo sapien
tggtgaatatcaataggcaaaagtamgaccaagtcaacctgccctggttg

SEQ ID NO: 77665 - DNA, 50 bp, homo sapien
atttttggataaacaaagaccaataygatctaggttatggctggaagatc

SEQ ID NO: 77666 - DNA, 50 bp, homo sapien
gtcctatttgcttatgagtttcatcraaggcatgtttcaaacccatgaag

SEQ ID NO: 77667 - DNA, 50 bp, homo sapien
tagctttgtagttctgcacccaaaaycattctcctcaggcgataaaatac

SEQ ID NO: 77668 - DNA, 50 bp, homo sapien
gagttcccccaaagatgagtacaaaytatctacagcagttttattcatta

SEQ ID NO: 77669 - DNA, 50 bp, homo sapien
gcctaccctatgttccaacaaacccrttcataggtatacaccacagagaa

SEQ ID NO: 77670 - DNA, 50 bp, homo sapien
tgttatgtccttggtctgctactccwaatattgtcattcagttgagttga

SEQ ID NO: 77671 - DNA, 50 bp, homo sapien
cttcactattctacacttgtttctawaaattgcaagcacatgaaatatta

SEQ ID NO: 77672 - DNA, 50 bp, homo sapien
caccaactttctgtgtatagcgaacygtctttaatgtgatgtcatagagg

SEQ ID NO: 77673 - DNA, 50 bp, homo sapien
gagcagttgacagaggagcttttcaygatggttatagggcctaaccttat

SEQ ID NO: 77674 - DNA, 50 bp, homo sapien
ttagtagataaacatatttttcccaygctaacctatgtagtaaaagatta

SEQ ID NO: 77675 - DNA, 50 bp, homo sapien
aagtgcagagcctggcgacaaaggaraatacgaaagactaagatccaggg

SEQ ID NO: 77676 - DNA, 50 bp, homo sapien
tagtgtttatgtccacatcacatggratattttatttttcaggcctcttc

SEQ ID NO: 77677 - DNA, 50 bp, homo sapien
aagatgatagacaactaacttaaaakaaagtaaatgagttcatgataggt

SEQ ID NO: 77678 - DNA, 50 bp, homo sapien
aaaggtctctcttgacatgttgtggygagactgaaatccaaatgcttctt

SEQ ID NO: 77679 - DNA, 50 bp, homo sapien
tgtgattacttgaatagattcaagcraagtgtaacaataagatgactaag

SEQ ID NO: 77680 - DNA, 50 bp, homo sapien
tagagagcaaacttgggcctatagcyattaattcagaaacaactgctaat

SEQ ID NO: 77681 - DNA, 50 bp, homo sapien
gagccataaaacaaatctcaaggagwataaattgatacttccatatagtt

SEQ ID NO: 77682 - DNA, 50 bp, homo sapien
tttcagataaaacgcaagtctgttgyagtatttcaagatattagagttca

SEQ ID NO: 77683 - DNA, 50 bp, homo sapien
caagatatctgcttataagcaacaayggaatgtgttctctttaaaagtga

SEQ ID NO: 77684 - DNA, 50 bp, homo sapien
acaaggaccagtttaatttctttaaytccctcatcacagtttctatttat

SEQ ID NO: 77685 - DNA, 50 bp, homo sapien
cagatcaaatacactatgagggcccrgaacaattaaaatggacttttgat

SEQ ID NO: 77686 - DNA, 50 bp, homo sapien
ttgactttctaaaactggttattgascctgaaagaccagggaagcattaa

SEQ ID NO: 77687 - DNA, 50 bp, homo sapien
agaccgggcagactgtgatctcatgmatttgtcagtgatgcgtttaggtc

SEQ ID NO: 77688 - DNA, 50 bp, homo sapien
gactgagattcattaaccattcgtcyatttcatgaatcaaggtttcatct

SEQ ID NO: 77689 - DNA, 50 bp, homo sapien
tgaagtcattgatttggaaagaaacrgagaatcctagtgtgactgtaacc

SEQ ID NO: 77690 - DNA, 50 bp, homo sapien
cttaaggaattatacaggggtgtgayacagaaaataaacgaaaacgatgt

SEQ ID NO: 77691 - DNA, 50 bp, homo sapien
gctaagcctgagtgtctctccagaayctgtctccaacagtttatagaatt

SEQ ID NO: 77692 - DNA, 50 bp, homo sapien
gctagttagaaaactatagcaagtascttttaatcgattgaataagaaac

SEQ ID NO: 77693 - DNA, 50 bp, homo sapien
tattttttcaaggaactggaccaacrggacccaagggagagtatcaaagg

SEQ ID NO: 77694 - DNA, 50 bp, homo sapien
acttcagcagggcaagaatggttcargccacattagaaagcagttacttt

SEQ ID NO: 77695 - DNA, 50 bp, homo sapien
gcatggtagcatgtacctgtagttcytgttacttaggaggccaaagtgaa

SEQ ID NO: 77696 - DNA, 50 bp, homo sapien
gtaatctaaagtttatttcaagtatragagagatgtatatagggtttatg

SEQ ID NO: 77697 - DNA, 50 bp, homo sapien
atcatctgatcactgaaatgcttaaygtgagttttcagaaaaagtagggc

SEQ ID NO: 77698 - DNA, 50 bp, homo sapien
ctgccttcagaggtgttactggttgygtgttaactggtatgttattttcc

SEQ ID NO: 77699 - DNA, 50 bp, homo sapien
ccatgtaagtgcatttcacactacarcatctttgacttcccactgagccc

SEQ ID NO: 77700 - DNA, 50 bp, homo sapien
tgaggtgacttgctcagaaacttcartgaaatgagggaacatgtattatt

SEQ ID NO: 77701 - DNA, 50 bp, homo sapien
attccctgcctcatcctacagtagayaaacatacccaatcaactttttag

SEQ ID NO: 77702 - DNA, 50 bp, homo sapien
ttttagtagaagtatatcgtaaacaytgccaggatgcacacagatacggt

SEQ ID NO: 77703 - DNA, 50 bp, homo sapien
ttaaaggttgaagcagcgggtagtayattctctgagaacaaaatgattat

SEQ ID NO: 77704 - DNA, 50 bp, homo sapien
aaccatgggtttacagtagccccatraggttcaatagtcattgaagagat

SEQ ID NO: 77705 - DNA, 50 bp, homo sapien
ggaaaggagggaggaggcaagtatawtagtcatgatatagggaattgaaa

SEQ ID NO: 77706 - DNA, 50 bp, homo sapien
ctaaacaagttaattccctttctcasggcatgatcaagttgagacaagcg

SEQ ID NO: 77707 - DNA, 50 bp, homo sapien
ctgcccagttcatccagtccataccyatgtttcctttagggctcatcctg

SEQ ID NO: 77708 - DNA, 50 bp, homo sapien
gtagtgtatattataatacatagtcrccaatatgccaattggctcgcaga

SEQ ID NO: 77709 - DNA, 50 bp, homo sapien
catcattatcagtggccaaatcattmaaatcgctgtttgcttcttctcgg

SEQ ID NO: 77710 - DNA, 50 bp, homo sapien
aataagagtaagcaagtaaggtaaayggcagtgcctgggtttggctttcc

SEQ ID NO: 77711 - DNA, 50 bp, homo sapien
cccaagcttgcttaacagaagtacarcaattttcctgattgatcactttt

SEQ ID NO: 77712 - DNA, 50 bp, homo sapien
acatgaagtaattatcttttcaacartctcagtctggggaattaaacaaa

SEQ ID NO: 77713 - DNA, 50 bp, homo sapien
aaccagtgagcctgtagtatcctgaygatgaccaaaagggaagtatgaga

SEQ ID NO: 77714 - DNA, 50 bp, homo sapien
agcagaaaaggacgagacggggactraacagacttgcttagttcctgaca

SEQ ID NO: 77715 - DNA, 50 bp, homo sapien
aaaagacataggtaatctaaaatacraaatagttggctgtctgaattaca

SEQ ID NO: 77716 - DNA, 50 bp, homo sapien
gatatccttgcacattatggatatgraaataattcagatgatacaacagg

SEQ ID NO: 77717 - DNA, 50 bp, homo sapien
ctcacatttcaggtactgtgctagaycttatataactctcatttatttct

SEQ ID NO: 77718 - DNA, 50 bp, homo sapien
ataaccatagtcttcctaaagataaygaccctaatgcaataggtagacac

SEQ ID NO: 77719 - DNA, 50 bp, homo sapien
gagcctagactgtttgggcttcgaaygtaactgacatctttgggaagacg

SEQ ID NO: 77720 - DNA, 50 bp, homo sapien
atataaggctagcatggtataaaaamttctctccaactatgatcaattta

SEQ ID NO: 77721 - DNA, 50 bp, homo sapien
agttttctgtgtgaattttataacartctatagtaatttgcctttctctt

SEQ ID NO: 77722 - DNA, 50 bp, homo sapien
taaaattttatttagcattaatagasaattttgagaagcttccttgtggc

SEQ ID NO: 77723 - DNA, 50 bp, homo sapien
ctttgttacttacatggatgtctaayagcagtctatgcactcatggagtt

SEQ ID NO: 77724 - DNA, 50 bp, homo sapien
gagcctgagaattgaacctatcacamgaaactaatgcttagcaaaaacag

SEQ ID NO: 77725 - DNA, 50 bp, homo sapien
gtttcagctttggtatgattcacgayggagaagggaatccctgcagaaag

SEQ ID NO: 77726 - DNA, 50 bp, homo sapien
gggagaatcagctggaataaacatamgtttgccattggaagactggtgat

SEQ ID NO: 77727 - DNA, 50 bp, homo sapien
aattgtgctccatagacctgcaaacraatactcagtggaaataccttttg

SEQ ID NO: 77728 - DNA, 50 bp, homo sapien
agtttagcgtatgtttgactaacaaraattccctacatcagagactctag

SEQ ID NO: 77729 - DNA, 50 bp, homo sapien
cagagccacaccctgaggttgtctaycaagaaaaaacagagtgtgcaggg

SEQ ID NO: 77730 - DNA, 50 bp, homo sapien
ggcctttaccacaaaatttgcattcmcgacaatcactttaggcatgtctc

SEQ ID NO: 77731 - DNA, 50 bp, homo sapien
gctgaggaagtgaaatgaggggccastattgaaaatggatgagagtgaaa

SEQ ID NO: 77732 - DNA, 50 bp, homo sapien
gtgcagataacccttgaagtgttccrcggagtccacaaaaaattatacac

SEQ ID NO: 77733 - DNA, 50 bp, homo sapien
tacaacttcatttacttatgcccacratgtatgctagtgacagaactgaa

SEQ ID NO: 77734 - DNA, 50 bp, homo sapien
acctaatgcctactgattggagttcrcaatagagaaggtaaagaaatggc

SEQ ID NO: 77735 - DNA, 50 bp, homo sapien
catcagaacaaatttcaaacccaagyataaatggaaatatatgccagata

SEQ ID NO: 77736 - DNA, 50 bp, homo sapien
ttaaatgtcatattttaaatgacaamatttggaagacttggccatgttat

SEQ ID NO: 77737 - DNA, 50 bp, homo sapien
gttttaaaaaacaagatctcacttasgatatcagtatttctgatctagat

SEQ ID NO: 77738 - DNA, 50 bp, homo sapien
ccagaaatatttctgagaatttcackaggacagacaaattaggactgtaa

SEQ ID NO: 77739 - DNA, 50 bp, homo sapien
aggatatgcaaaggctaaaccgatayagggaagctctcttgtaaaaggat

SEQ ID NO: 77740 - DNA, 50 bp, homo sapien
attttaatgcatcatatagaagaggwaaagaatgtaagtggggcagagcc

SEQ ID NO: 77741 - DNA, 50 bp, homo sapien
ccaagacttccctgtaatagatgctmataaacatttgggtaaatgaataa

SEQ ID NO: 77742 - DNA, 50 bp, homo sapien
ttaaaagcattttatatagctaccawcttctttggctatcatttggacat

SEQ ID NO: 77743 - DNA, 50 bp, homo sapien
tgtcctcgtgggtcaatatagattawaaaggtaggattgtgtgtgtgtgt

SEQ ID NO: 77744 - DNA, 50 bp, homo sapien
ttagtgaaatttctttgggaattgayacttttgatactttatttttaacc

SEQ ID NO: 77745 - DNA, 50 bp, homo sapien
agcacacacagtgcctggaacataawgttagagttcagtgaatattatat

SEQ ID NO: 77746 - DNA, 50 bp, homo sapien
ggaatatcgctcagctcaagtgataygatcagaatctgaagaggttcctc

SEQ ID NO: 77747 - DNA, 50 bp, homo sapien
ataagtattaaaatcaagatcaactwaacataggctgaatttccattagt

SEQ ID NO: 77748 - DNA, 50 bp, homo sapien
tgttggaacctactgccactcaagaraaattcttccctaatctgtgtggg

SEQ ID NO: 77749 - DNA, 50 bp, homo sapien
gtgaatctactttgcatactactacyagattaatcttctaaaaatgtcac

SEQ ID NO: 77750 - DNA, 50 bp, homo sapien
aggcattcacctatataatccagcawctatctcctaagaatgaggacatt

SEQ ID NO: 77751 - DNA, 50 bp, homo sapien
cctcctgtttggacttgacctgtaaraaaggctagagacaagaagggctg

SEQ ID NO: 77752 - DNA, 50 bp, homo sapien
tcaaccagagtttatcagacactgtracacttgaagacttgcggattagc

SEQ ID NO: 77753 - DNA, 50 bp, homo sapien
gtcttcaaactggggaaattttctamgggaagtcaagacagagatgggga

SEQ ID NO: 77754 - DNA, 50 bp, homo sapien
tatttgtagagtcagccaaactcaayagacaaccataaatgtcaaaaact

SEQ ID NO: 77755 - DNA, 50 bp, homo sapien
gaggccgggaaatggataactaaacrcatcattgcatccaagagttttgg

SEQ ID NO: 77756 - DNA, 50 bp, homo sapien
aggaatgacctaggaggtgaagaacsaataatggctttcccataaaaaga

SEQ ID NO: 77757 - DNA, 50 bp, homo sapien
ctgtggtcacccttaacatctatccraaagctgatgaaagcagcagcctg

SEQ ID NO: 77758 - DNA, 50 bp, homo sapien
tatacattcctcatggttagtatggrttggtgtatttctagttactgagt

SEQ ID NO: 77759 - DNA, 50 bp, homo sapien
aattacagttttccaataagagagascaactgcagctttgtagttttcat

SEQ ID NO: 77760 - DNA, 50 bp, homo sapien
tcttgtcttgttatcgccacttcaarttcccatttattttgtccagtgaa

SEQ ID NO: 77761 - DNA, 50 bp, homo sapien
tcaatcctgatgtgaaaagttgtgtmatcattgtgtttctttttatatgc

SEQ ID NO: 77762 - DNA, 50 bp, homo sapien
catgttgtgtgccgctgagattccasgattggttgctctattgctcactg

SEQ ID NO: 77763 - DNA, 50 bp, homo sapien
tctaatttgcctcttgttcacttcawtctaaaggattcattatgttattt

SEQ ID NO: 77764 - DNA, 50 bp, homo sapien
aatctgagttcataattttgatctcraaggaactagcatatgaacgactg

SEQ ID NO: 77765 - DNA, 50 bp, homo sapien
aaatatcttccccacgatttctactyagcttcaaactctcagtgggtcta

SEQ ID NO: 77766 - DNA, 50 bp, homo sapien
caccctggcatgtgctatcattaggsacagtaaaaagtgacacagcccag

SEQ ID NO: 77767 - DNA, 50 bp, homo sapien
attgaccttttgtttctgaagacaascaaatacataccttatttgcaaaa

SEQ ID NO: 77768 - DNA, 50 bp, homo sapien
tgaaatgctaaaatcactgtgggaamctactaaaatgaaaaatgctgttc

SEQ ID NO: 77769 - DNA, 50 bp, homo sapien
tgcaatctcatgaaagagaatgcaaytaaatggccaactttgagattaac

SEQ ID NO: 77770 - DNA, 50 bp, homo sapien
tacttatttgaccaagcaaattatascatatccttttgaagcaattactt

SEQ ID NO: 77771 - DNA, 50 bp, homo sapien
aaatgctggccccaaatgtttgcatmataaacccattgcctaattttaca

SEQ ID NO: 77772 - DNA, 50 bp, homo sapien
tgtggggagtcatagcactaacctcyatgtccataaaagtatcttctgta

SEQ ID NO: 77773 - DNA, 50 bp, homo sapien
aaaaatagcttctgggcatgtgacastattctcgggcctttaatgtcaga

SEQ ID NO: 77774 - DNA, 50 bp, homo sapien
aataaaatagtgtaagaatacatgcraaatggaatgagactatagattaa

SEQ ID NO: 77775 - DNA, 50 bp, homo sapien
taagtgcatagaatttactaaacctsacctctttggcattacagccattg

SEQ ID NO: 77776 - DNA, 50 bp, homo sapien
aaagagaaagatgagacaggatgaaygtggagagattaaactttttctta

SEQ ID NO: 77777 - DNA, 50 bp, homo sapien
gtaaacccaagattattcctaggacrccagttacgctttatcactttatt

SEQ ID NO: 77778 - DNA, 50 bp, homo sapien
agcttagagcaattttaaaatagcawccagtggaataaacacaccaatgg

SEQ ID NO: 77779 - DNA, 50 bp, homo sapien
tgtgatcatgttaatatacactgaaraggcattgccaaaatttagcagac

SEQ ID NO: 77780 - DNA, 50 bp, homo sapien
taaaaatagggctcaagaaaatccartcatggtgaatctcatgactcttt

SEQ ID NO: 77781 - DNA, 50 bp, homo sapien
gagcagttttgcagtacatgttataratgaatgaagtgtagcacttttta

SEQ ID NO: 77782 - DNA, 50 bp, homo sapien
tataatatgaaggcatgtacttgaastcgtttgttaacagaggggaaaaa

SEQ ID NO: 77783 - DNA, 50 bp, homo sapien
ttgctatctcaaatccttttttgaaygaggactacatgtacacactcctc

SEQ ID NO: 77784 - DNA, 50 bp, homo sapien
gcccagcatgtggcagaaactcaatraatacttgctagttgattaatagg

SEQ ID NO: 77785 - DNA, 50 bp, homo sapien
aacagtggctagaaaattttgcccaratgttatcagtaggtggtgcattt

SEQ ID NO: 77786 - DNA, 50 bp, homo sapien
aacaggccttttccatattgcttaamcaaaggacaaagtcagtgacctta

SEQ ID NO: 77787 - DNA, 50 bp, homo sapien
tgtacattttaatccttattgccaargtctcctaaaactgtgtatgaaac

SEQ ID NO: 77788 - DNA, 50 bp, homo sapien
ctgtagccccagagcctctcgatgasctatgaacaggaacagaaccagca

SEQ ID NO: 77789 - DNA, 50 bp, homo sapien
aaaagtacctctgaatcgtcctctcragcctgactattctatcatctgtt

SEQ ID NO: 77790 - DNA, 50 bp, homo sapien
ctgacacattcatgggaatagtgaawcttaacagcagtcctagtgttttg

SEQ ID NO: 77791 - DNA, 50 bp, homo sapien
taatgtccataaaagtattcataccratgatgatgatgtataaactgtgg

SEQ ID NO: 77792 - DNA, 50 bp, homo sapien
attggtggcaatcaattctggtccasagttaaaatgcagagtaacaaggc

SEQ ID NO: 77793 - DNA, 50 bp, homo sapien
ccctgacttgcagctgagcatttcamggtctccccgggcctccagtggac

SEQ ID NO: 77794 - DNA, 50 bp, homo sapien
tttaataattatccattgctctcaargtaaagtgttccttaaatggttta

SEQ ID NO: 77795 - DNA, 50 bp, homo sapien
tgatgaaccctactttgcaagtaaaygatgttgaaggccgggtgcggtgg

SEQ ID NO: 77796 - DNA, 50 bp, homo sapien
tggagtattcttccacgtagcaccaygagctgttcttctccaaaaggctt

SEQ ID NO: 77797 - DNA, 50 bp, homo sapien
taaattgagtcagtcccagagatcayggtcaacttactaataatgtaaac

SEQ ID NO: 77798 - DNA, 50 bp, homo sapien
cagagggtttggtgtcctactgtgamgattttgccttttaatcagcctga

SEQ ID NO: 77799 - DNA, 50 bp, homo sapien
aagtgaaaacacaatgtttaaatackgtataagacactcatttgtccacc

SEQ ID NO: 77800 - DNA, 50 bp, homo sapien
ttttcaatgatcaatgatcacattasaaaaaagatctcagcctcatctta

SEQ ID NO: 77801 - DNA, 50 bp, homo sapien
gagaatcttaacttggggtgcattckctttagcccatccatgttgccttt

SEQ ID NO: 77802 - DNA, 50 bp, homo sapien
ccaagtacctaactaaagaatcaaascagttcatttctcagattagtact

SEQ ID NO: 77803 - DNA, 50 bp, homo sapien
caaaattgccaaacaacgctatatasattgctataattattcttatagag

SEQ ID NO: 77804 - DNA, 50 bp, homo sapien
atttcatgaatagctatgaaaagcaygaaaaataaaaattgtgatgaggg

SEQ ID NO: 77805 - DNA, 50 bp, homo sapien
cctatttcatccatctaagactttayatcccatttcaggctgattaaaag

SEQ ID NO: 77806 - DNA, 50 bp, homo sapien
atggggattttcccaatgctagcgaratgtgtcaaatggttcaacctcaa

SEQ ID NO: 77807 - DNA, 50 bp, homo sapien
ggactccccggaaaagaatgtataarttgatgtgtttttgtatatgctta

SEQ ID NO: 77808 - DNA, 50 bp, homo sapien
ttaatctgagcagtttcgaaaccaarcccacattaattaatataaataat

SEQ ID NO: 77809 - DNA, 50 bp, homo sapien
agaaaagtgccttttgagaaatctaycaaacaacataaaaagccagaagc

SEQ ID NO: 77810 - DNA, 50 bp, homo sapien
gcaaaggcattttcactaatatgackattcaactgctgggtatagagaag

SEQ ID NO: 77811 - DNA, 50 bp, homo sapien
acagcccagcccttggtcaattgtcrcggtttattgaaccttaataggaa

SEQ ID NO: 77812 - DNA, 50 bp, homo sapien
ctatctcagattttcaagaatcctcrtacaaattgtccagggtttccacc

SEQ ID NO: 77813 - DNA, 50 bp, homo sapien
ttagtagtattattgtccccactaasagaagaatattttaaacaaaggca

SEQ ID NO: 77814 - DNA, 50 bp, homo sapien
gatttcaaccaagagaaagagtagcraggcaatttagtttaaaaaataat

SEQ ID NO: 77815 - DNA, 50 bp, homo sapien
tcagatctaaatagctactgggaaaraacaattacaatactcgcatggtt

SEQ ID NO: 77816 - DNA, 50 bp, homo sapien
catcagccagtttccttcagtactaycaagtatcacatcacaggtaacat

SEQ ID NO: 77817 - DNA, 50 bp, homo sapien
cagaccatcaccttcttatacctcaraatagtctgcagggtgactcagaa

SEQ ID NO: 77818 - DNA, 50 bp, homo sapien
caccatctttgaggtttgtgataaaygcattacagtgaaggtaaaaccag

SEQ ID NO: 77819 - DNA, 50 bp, homo sapien
cctcaaagatggtggaccagaaagaygcatggagagttgttgaatctctt

SEQ ID NO: 77820 - DNA, 50 bp, homo sapien
ggttctcattgcttctgtgggtctcyaggtttctatcattacacagatta

SEQ ID NO: 77821 - DNA, 50 bp, homo sapien
catggagagttgttgaatctcttcaktagctcatttacattacacctgaa

SEQ ID NO: 77822 - DNA, 50 bp, homo sapien
tcggaacagagtagaaatttcagaargagaaccacacttatatgatcaat

SEQ ID NO: 77823 - DNA, 50 bp, homo sapien
attctaatgatggctagtgtcatcaraaatgttactgtgaactcttggat

SEQ ID NO: 77824 - DNA, 50 bp, homo sapien
tggaaagaaaactcatgcaatctcawggccttatttccccttcctacata

SEQ ID NO: 77825 - DNA, 50 bp, homo sapien
tatgcctcctcaatagcaaatagaayggtgacaaaaatttggttatatat

SEQ ID NO: 77826 - DNA, 50 bp, homo sapien
ttatttggagatgctgttcctctcamgtgggaaaaatttggttatctcag

SEQ ID NO: 77827 - DNA, 50 bp, homo sapien
ctttcccctttcaactataattcctsacacatttgcatctacaatgtcaa

SEQ ID NO: 77828 - DNA, 50 bp, homo sapien
acaaatcagttacacaaactagtcckatttttgcgtcaaacttaacattt

SEQ ID NO: 77829 - DNA, 50 bp, homo sapien
gaatatccctggttcctccaacattraagggcctagttgaactctagaaa

SEQ ID NO: 77830 - DNA, 50 bp, homo sapien
aagactctggaatgggaagattaaamaccagagtccacatttcctttctg

SEQ ID NO: 77831 - DNA, 50 bp, homo sapien
cagagtgtaagagctcagcggtaaasttgatatgttttgtctaatgagaa

SEQ ID NO: 77832 - DNA, 50 bp, homo sapien
ttcgtggggagaaagacatgtaatayggaaaacagaagggcacacaggag

SEQ ID NO: 77833 - DNA, 50 bp, homo sapien
tatgtagcattcatttttattttacrctggcagggatagaggcctcttaa

SEQ ID NO: 77834 - DNA, 50 bp, homo sapien
gaaaattgtgaaatcatttacttacyactaagctaactcaatagggactt

SEQ ID NO: 77835 - DNA, 50 bp, homo sapien
tgggggaggtgtaagcacgtcgaaakaaggaagctgagagacattttgtg

SEQ ID NO: 77836 - DNA, 50 bp, homo sapien
ccaccacccaaagttataattaaaawcataggtcaataactagaaacacg

SEQ ID NO: 77837 - DNA, 50 bp, homo sapien
aagggggtggcaccttgccaagtacyggaggtctctccacagaggctcag

SEQ ID NO: 77838 - DNA, 50 bp, homo sapien
aaaaccttttgagtgcaagtgactcraacaaatatattaacagagcttac

SEQ ID NO: 77839 - DNA, 50 bp, homo sapien
attactggtatatagaatctttacaragtactcacatatgctgttacatt

SEQ ID NO: 77840 - DNA, 50 bp, homo sapien
cagaactggggcccatcttgctgtaygttagactctccactctgctgctt

SEQ ID NO: 77841 - DNA, 50 bp, homo sapien
aaggtctatgttctgaaaggaataayaggatactttgttaagtgaatggt

SEQ ID NO: 77842 - DNA, 50 bp, homo sapien
aagcctaaaaagagggcatttcaatraaggaaggtctatgttctgaaagg

SEQ ID NO: 77843 - DNA, 50 bp, homo sapien
tattgtcactgtaggaaataaggaaratgaatattgctatatgttagaga

SEQ ID NO: 77844 - DNA, 50 bp, homo sapien
tacttttggaggaaggcacttgggcrctgcttgtataatagagtttgaga

SEQ ID NO: 77845 - DNA, 50 bp, homo sapien
taacttattatcttatttctaccaaygaataggtgagaggcagagcagat

SEQ ID NO: 77846 - DNA, 50 bp, homo sapien
cattgcaggtctcagggtggattacmcaaaagtaggaatgttctggtgct

SEQ ID NO: 77847 - DNA, 50 bp, homo sapien
gttaaatcacattttacatctggtastaaattaatgggttgtatgttgtt

SEQ ID NO: 77848 - DNA, 50 bp, homo sapien
ggcatgtcatggtctggggctagaaytcattttacagtggcagcgatgag

SEQ ID NO: 77849 - DNA, 50 bp, homo sapien
accagttgtaggactttaagaaactsacttaattagccaggcatggtggc

SEQ ID NO: 77850 - DNA, 50 bp, homo sapien
atttagcccggttagcaaaatagaaygattggctgggaaaaagctgggaa

SEQ ID NO: 77851 - DNA, 50 bp, homo sapien
tttctgcagccactagtcctgagatmataagctataaacactgtaatcat

SEQ ID NO: 77852 - DNA, 50 bp, homo sapien
gtgctgggccctggggtatcatcgasgcaggaaacacttggtctttggcc

SEQ ID NO: 77853 - DNA, 50 bp, homo sapien
ggaggttcccatatattctccagcckctcctgtagttatgctggggccac

SEQ ID NO: 77854 - DNA, 50 bp, homo sapien
cctgcttacaaatgaagacaattacraagtcaacaattacaaaatatata

SEQ ID NO: 77855 - DNA, 50 bp, homo sapien
atggtgcttggatggcactttgacaraaccaaactatgtcaaggctgcct

SEQ ID NO: 77856 - DNA, 50 bp, homo sapien
gaaggttatggccctcttggtcaagsctatctatccttaggaggtaagga

SEQ ID NO: 77857 - DNA, 50 bp, homo sapien
atgtattctgtaaattacaaatacartgcacatagcatattataggtata

SEQ ID NO: 77858 - DNA, 50 bp, homo sapien
ggcagggtgccaagtccatgaagcaraagcaccgccatggtctaaaaggc

SEQ ID NO: 77859 - DNA, 50 bp, homo sapien
ttgatggtttcatgtaaatgctaaargtaaaacctgtattaagagtcact

SEQ ID NO: 77860 - DNA, 50 bp, homo sapien
ttggtttttaaatatggcaaaattayatatgagcttcccattttacaggt

SEQ ID NO: 77861 - DNA, 50 bp, homo sapien
agcatgaaaatgtgtgcacacatacsaagcactgatgtcaagaaagctgt

SEQ ID NO: 77862 - DNA, 50 bp, homo sapien
acaaacacacacacacatatatgcaygtataaggtaagtgtggacataca

SEQ ID NO: 77863 - DNA, 50 bp, homo sapien
tgcagtttgcaggttatcaggcctasaaaatgtggctggctcatctccaa

SEQ ID NO: 77864 - DNA, 50 bp, homo sapien
aagaccctctctgtaggctgaagacrctctctgtagggcccgaggactgt

SEQ ID NO: 77865 - DNA, 50 bp, homo sapien
taatagagccatcgatgaaaaaaatsataaactcattgtgagatgtaatc

SEQ ID NO: 77866 - DNA, 50 bp, homo sapien
ttgggagtggatgtgagcatagaagraaactcaggaatggggttaggttc

SEQ ID NO: 77867 - DNA, 50 bp, homo sapien
tttcatttcactgaatatccttacayaaaagctcctgaatgagccacatc

SEQ ID NO: 77868 - DNA, 50 bp, homo sapien
tgataacaggtgctcgattcctctaygtaaatcttcaccttttattaatc

SEQ ID NO: 77869 - DNA, 50 bp, homo sapien
tcctttttaaacaagttcgggagtayggcagagaacattgcccacataca

SEQ ID NO: 77870 - DNA, 50 bp, homo sapien
gctgtaaacttcctctcctgtgaatmataatactttgatgttatatttat

SEQ ID NO: 77871 - DNA, 50 bp, homo sapien
agtctctgacattttctcacattcasaagtctatggccttttaaccttct

SEQ ID NO: 77872 - DNA, 50 bp, homo sapien
ggatctcagaagtgtgttagaaaacrggtgatactgtgcaggtgtggggt

SEQ ID NO: 77873 - DNA, 50 bp, homo sapien
gaagaccaactcttgacatttgaccraaggctctaccggtgttggccctg

SEQ ID NO: 77874 - DNA, 50 bp, homo sapien
aaagaacaaggaaagacagagctaamgtctcagggccaagttcttttctt

SEQ ID NO: 77875 - DNA, 50 bp, homo sapien
ctttactgctttccatccccttaccraagttactgtgaatgaaattgaag

SEQ ID NO: 77876 - DNA, 50 bp, homo sapien
atgaggcctgtccatcaggaggtcawccttaccatccacggagtgttgcc

SEQ ID NO: 77877 - DNA, 50 bp, homo sapien
atttattaaagagtacaggtagccaktaggattgcccaaagtgccaagta

SEQ ID NO: 77878 - DNA, 50 bp, homo sapien
aagcctaacatgcagtttttatattsaagtatcctagcacgtcaactttt

SEQ ID NO: 77879 - DNA, 50 bp, homo sapien
agttatttatactcaagcttaggtcyacaaatcccgtcttttaatttatt

SEQ ID NO: 77880 - DNA, 50 bp, homo sapien
gtaagagaaaaagagtatgagtagaytaaacgaaatgtggtgagaatact

SEQ ID NO: 77881 - DNA, 50 bp, homo sapien
ttaggttgcacatcaaatatacaaayacaagcttttaaaaaaactcactg

SEQ ID NO: 77882 - DNA, 50 bp, homo sapien
acagcgaggtgagaaatggggcatcscgttctgctggagaagtaggcagg

SEQ ID NO: 77883 - DNA, 50 bp, homo sapien
atttcaaaaggatccttagctggaawagaggaaaggtccgtacatggttt

SEQ ID NO: 77884 - DNA, 50 bp, homo sapien
agctggctcagcaaggaaaagtccargaatgatcccacagtctggactga

SEQ ID NO: 77885 - DNA, 50 bp, homo sapien
aaaataaagtacagtctgagtgacayccttaaagagttttacaagttttc

SEQ ID NO: 77886 - DNA, 50 bp, homo sapien
ttatgacttctagctttaaattgaaracaccgtagcagcaggttacaaaa

SEQ ID NO: 77887 - DNA, 50 bp, homo sapien
tcggcaaaaccagattcacaaagatyataaaaaggataaaatattgtgct

SEQ ID NO: 77888 - DNA, 50 bp, homo sapien
cataatcatcactgtaattctacaaygctcatcaataatttagaagaaac

SEQ ID NO: 77889 - DNA, 50 bp, homo sapien
tatctgagatctgcactgagagcaascatgggccttacgaagaaccagga

SEQ ID NO: 77890 - DNA, 50 bp, homo sapien
ataatagcactgagaacatctgagamagtttgtgcctaataaaattctag

SEQ ID NO: 77891 - DNA, 50 bp, homo sapien
aaaaaaatctatgaataagtgctcarattcccattatagtcaattatgta

SEQ ID NO: 77892 - DNA, 50 bp, homo sapien
tactgaaaaataaaatttcaccctayatgcttgaccttcagggacttatt

SEQ ID NO: 77893 - DNA, 50 bp, homo sapien
gacaagaagcttatatttttctggastagatgtaacaaacgactttccaa

SEQ ID NO: 77894 - DNA, 50 bp, homo sapien
agggttgtgggcactggaatcacacmattttttgctaactaaacaaattt

SEQ ID NO: 77895 - DNA, 50 bp, homo sapien
tgaattgcatgtcaccttggagaackcagtgatggatgagagagatccag

SEQ ID NO: 77896 - DNA, 50 bp, homo sapien
catgaccctcatttgaagatagagayatgacaagtaaggtgacctgaccc

SEQ ID NO: 77897 - DNA, 50 bp, homo sapien
ctggaccctatactctactccaaaargaaatgtttcagggcatcagaggg

SEQ ID NO: 77898 - DNA, 50 bp, homo sapien
ctttttaaacattaagaaaatatcaytgaccaaaaattgggaaaattaaa

SEQ ID NO: 77899 - DNA, 50 bp, homo sapien
ccgtgctctgtgactcctgagtgcaygcttcctctgcatttgggctccta

SEQ ID NO: 77900 - DNA, 50 bp, homo sapien
taccacctggcctttcttaattgtcyacttggagtgtttgccaagcgaag

SEQ ID NO: 77901 - DNA, 50 bp, homo sapien
cagaaaaaaacacaaaataagcctasagacagaatgctaatagtcaggca

SEQ ID NO: 77902 - DNA, 50 bp, homo sapien
gcacataggaagagataaaagccaastgaagcgaaagctgcctgagccag

SEQ ID NO: 77903 - DNA, 50 bp, homo sapien
aaacctacattgactgaggatatacyagattctgctttgggctccattgt

SEQ ID NO: 77904 - DNA, 50 bp, homo sapien
acaaagagctcagtaaatgtaccctraccgttattgttttcacttgtacc

SEQ ID NO: 77905 - DNA, 50 bp, homo sapien
taagatgattttaaaactggatgaayctctgcataaaacacaaacatttc

SEQ ID NO: 77906 - DNA, 50 bp, homo sapien
gttgagaaatgattgatgctgaagargtggtattctattggtaaggctta

SEQ ID NO: 77907 - DNA, 50 bp, homo sapien
tttgaagcactcaaatatattgcacrgaatcctggaggactggataaata

SEQ ID NO: 77908 - DNA, 50 bp, homo sapien
caccagatcagacatacctaatatarataaacaggatggtataacccaaa

SEQ ID NO: 77909 - DNA, 50 bp, homo sapien
ggagaaatccaagactctgaaggaaygaataatgtttcttaaatatctct

SEQ ID NO: 77910 - DNA, 50 bp, homo sapien
tcacctgagactacccagctagtaartgactaagggcgattagacccaag

SEQ ID NO: 77911 - DNA, 50 bp, homo sapien
cacgcagttatgtttcctcagaatasctgggttgctaaacgagttggaaa

SEQ ID NO: 77912 - DNA, 50 bp, homo sapien
cgcatgtgcgtgctgctccagatagmcctacaaacatctgtcttcctggc

SEQ ID NO: 77913 - DNA, 50 bp, homo sapien
gcgaagaaaaaggtgttcctacaagrcagctcacagcttggactttagcc

SEQ ID NO: 77914 - DNA, 50 bp, homo sapien
tgcacagttgaagattagaaggacaytggaaaaaattgatgtttatggga

SEQ ID NO: 77915 - DNA, 50 bp, homo sapien
cgcagggcggagtgtggaccagatarcggtaagaatggatgtgggacagc

SEQ ID NO: 77916 - DNA, 50 bp, homo sapien
ctttttcttcgcacaaaagccctggyagttagctcaccaacccctaggcc

SEQ ID NO: 77917 - DNA, 50 bp, homo sapien
ctggtctcaaactcgtaagctcaaaycattcacctgccttggcctcccaa

SEQ ID NO: 77918 - DNA, 50 bp, homo sapien
aaatgcaaccgatacagaagtctctraagataaaaagtcttcaaagcttc

SEQ ID NO: 77919 - DNA, 50 bp, homo sapien
ccagtgattatgtgattaatgaacaycaaaaggctcattgcatcaaactg

SEQ ID NO: 77920 - DNA, 50 bp, homo sapien
catactcacatacgcgtaacgaaacrcacaaaacagacaaggcaagccac

SEQ ID NO: 77921 - DNA, 50 bp, homo sapien
gatttctgaacttttttccatgtgayacctgctgctttgaaggcactaaa

SEQ ID NO: 77922 - DNA, 50 bp, homo sapien
aagctgtttctccaattctgtcctaygtctgcaagaactctttgtattac

SEQ ID NO: 77923 - DNA, 50 bp, homo sapien
tagctcagtcccagtgactaaaatcrcccaaatcatgtgaacagtaaatc

SEQ ID NO: 77924 - DNA, 50 bp, homo sapien
gcagaccttaagtagacatagtatcyagctaaaaggtaattatgcttttt

SEQ ID NO: 77925 - DNA, 50 bp, homo sapien
aggctggctgttaagatgctattaarggagagatactgtttttcaaattg

SEQ ID NO: 77926 - DNA, 50 bp, homo sapien
agaattagcccctggagtctgaaaamtatgtttaactttacaaaattctc

SEQ ID NO: 77927 - DNA, 50 bp, homo sapien
tgtccttttacattcttgctaatacyggttaattaagcagaaagcaatgg

SEQ ID NO: 77928 - DNA, 50 bp, homo sapien
aattatttttatacagtacaacttaygaaaaatagtattatggaaaaatc

SEQ ID NO: 77929 - DNA, 50 bp, homo sapien
catttccaattgcatccttactggasgctaacaacaaagcctggaaaagc

SEQ ID NO: 77930 - DNA, 50 bp, homo sapien
actctcccagacatgagttgctaccmgctaagatggcactttcatttgaa

SEQ ID NO: 77931 - DNA, 50 bp, homo sapien
gaagcaattgtagaggtaattaaaartatgactgaggtagtcacaattga

SEQ ID NO: 77932 - DNA, 50 bp, homo sapien
ttttgcatagcagacacaggaacctragatattaaccctcatctactttc

SEQ ID NO: 77933 - DNA, 50 bp, homo sapien
aaacaaggttgtttttgtctttatcktttgttagagttatagatttatga

SEQ ID NO: 77934 - DNA, 50 bp, homo sapien
tttttaaactccaaattcctttatcraagcagctatctgctaatattact

SEQ ID NO: 77935 - DNA, 50 bp, homo sapien
acaaaacctcaagaattattaagaargttctgctgtagtgtccctggtct

SEQ ID NO: 77936 - DNA, 50 bp, homo sapien
ctctggaatggtttacaaggagccaycatatgtaagcatctagatcagat

SEQ ID NO: 77937 - DNA, 50 bp, homo sapien
tgacattcctgacatgaccacttatmagctgtcctaggcaaacactatga

SEQ ID NO: 77938 - DNA, 50 bp, homo sapien
tttgtaaagcaatcttagtttgagakaaggtatcatattttatataacaa

SEQ ID NO: 77939 - DNA, 50 bp, homo sapien
aagtccttattgctttgaagtcgatragggaacccttgatattcttccag

SEQ ID NO: 77940 - DNA, 50 bp, homo sapien
atttcttggtcactgctatttgtaawgcaatcttagtttgagagaaggta

SEQ ID NO: 77941 - DNA, 50 bp, homo sapien
gatctttgaggggaagagtcaacaargtttgaaggctccagagggatgaa

SEQ ID NO: 77942 - DNA, 50 bp, homo sapien
ttagaattgcggtgttttggaactasagtcttcaagatccctccagaact

SEQ ID NO: 77943 - DNA, 50 bp, homo sapien
agcattcataatgttttgaaagatasgccattcgcagtggctcatgcctg

SEQ ID NO: 77944 - DNA, 50 bp, homo sapien
agctttggtcattgataagaaaaaayttactggcaagatagcaggagaca

SEQ ID NO: 77945 - DNA, 50 bp, homo sapien
tctttctgggatggttttctttaaaygcagatgcctcatttcatcactaa

SEQ ID NO: 77946 - DNA, 50 bp, homo sapien
agctgttcttgagattttgcactcarcttgcgatggttaatacggagtgt

SEQ ID NO: 77947 - DNA, 50 bp, homo sapien
tggcctggagacagccgcttgctcastatgtcttcacagggcagagtgaa

SEQ ID NO: 77948 - DNA, 50 bp, homo sapien
ttcttgaaatcacccggattcgaaaygtccagtatcattcttggctcttc

SEQ ID NO: 77949 - DNA, 50 bp, homo sapien
gacttctaagtcggatgctcagtaaytctagctatctatcaaggagtaat

SEQ ID NO: 77950 - DNA, 50 bp, homo sapien
gtctggtgaagaactggtgggaagarcttttgattaagaggagatgggat

SEQ ID NO: 77951 - DNA, 50 bp, homo sapien
ggtagaaacaggaaaaatcacgcagratcagtttccaccccagagagagg

SEQ ID NO: 77952 - DNA, 50 bp, homo sapien
tgaaaaacatgcatgccttttcttayaaataaatacacatttacataatc

SEQ ID NO: 77953 - DNA, 50 bp, homo sapien
ctctatttgctattgataaaagcaaygtaactgaaattactctgtacctc

SEQ ID NO: 77954 - DNA, 50 bp, homo sapien
ctgttcctaggttggtgtcctcacaratgctgctgtttcaggcaatgtca

SEQ ID NO: 77955 - DNA, 50 bp, homo sapien
tcaacagaaaatgggctcttacctcrctctatgcaaccttcttggggatc

SEQ ID NO: 77956 - DNA, 50 bp, homo sapien
taggtaatacttcagagcactgttakgaggaatagatgagttccgaacct

SEQ ID NO: 77957 - DNA, 50 bp, homo sapien
tccagctagaggtgaaaaggtaacayaacacaatggccaccaagaagtgt

SEQ ID NO: 77958 - DNA, 50 bp, homo sapien
ggtcattgtgacaagactagtattgsaaaaatgaaagaactcccagcaat

SEQ ID NO: 77959 - DNA, 50 bp, homo sapien
ggagacccggatgagataaaagcaaygttatatttggaatcctcaccaat

SEQ ID NO: 77960 - DNA, 50 bp, homo sapien
ggccactggtttgtaaggctttgaamctttaattggcctctaacagcaga

SEQ ID NO: 77961 - DNA, 50 bp, homo sapien
gaggtggattccctattccagggtgrcagactcctagctaaggtttatcc

SEQ ID NO: 77962 - DNA, 50 bp, homo sapien
aacccttaaaaaataagggaacgcawcaagaaatcattgctggtattgaa

SEQ ID NO: 77963 - DNA, 50 bp, homo sapien
ttcaaaatcagttgtttaagaaaacsattacacctataccttcaatatca

SEQ ID NO: 77964 - DNA, 50 bp, homo sapien
ctatatcaaagatgggttgtaagtgyaacatgaggtaatgcctataaggg

SEQ ID NO: 77965 - DNA, 50 bp, homo sapien
aaaataataagcttttctaatactasagagtcataagattgagatgaata

SEQ ID NO: 77966 - DNA, 50 bp, homo sapien
ccataaacccacacttccttctacaygtgagcttttattaattccagaat

SEQ ID NO: 77967 - DNA, 50 bp, homo sapien
gtcatgctgaattgcaaatccctagycggaacatttgaacatcatctaga

SEQ ID NO: 77968 - DNA, 50 bp, homo sapien
attctgccggggtttcttgagtcacygagcatatggggcttcaggttgga

SEQ ID NO: 77969 - DNA, 50 bp, homo sapien
ggaagagagggcaagggttagagaaragcttgggccgcagcattgcctct

SEQ ID NO: 77970 - DNA, 50 bp, homo sapien
gctgggagacttactgaaacatatgraaatgctagtgctctgcgttttga

SEQ ID NO: 77971 - DNA, 50 bp, homo sapien
accctcacttacagagcccaagactsacatcatcactgcctcatgaaatg

SEQ ID NO: 77972 - DNA, 50 bp, homo sapien
cttcacaaatgacttaaggcaactcrctttcgggttgatggaagaaaaaa

SEQ ID NO: 77973 - DNA, 50 bp, homo sapien
ttcctctttttaaccagaatttttcrccggacaacaacaacaaattactt

SEQ ID NO: 77974 - DNA, 50 bp, homo sapien
gtcttctagatgcaattgttttctayagtctgtcttgtggccggttataa

SEQ ID NO: 77975 - DNA, 50 bp, homo sapien
tatttctccttccctctattttaaastcttgattctatcatctgcttgcc

SEQ ID NO: 77976 - DNA, 50 bp, homo sapien
acacatttatgaccaatatatggcaratgagagttctttgggggaaatta

SEQ ID NO: 77977 - DNA, 50 bp, homo sapien
cataaatgctgggctttcgcaaaagktactcgctgccaaaagaaaagagt

SEQ ID NO: 77978 - DNA, 50 bp, homo sapien
ggagggggaaatgtagattgtagaaytgaaaacatttgtgttagtatagt

SEQ ID NO: 77979 - DNA, 50 bp, homo sapien
caagcactggaactgtgataaatccyacgaaacaaagatgaataggacat

SEQ ID NO: 77980 - DNA, 50 bp, homo sapien
tcactgttgaaagaacctaatcctawctgccttatctacacagcagtaat

SEQ ID NO: 77981 - DNA, 50 bp, homo sapien
tgctccttgaggcaggtcaggaatawaaactgcataatggtttctcttta

SEQ ID NO: 77982 - DNA, 50 bp, homo sapien
ttatcttttaaagggaaaatgtacargctgcaagaaattctctgtactgg

SEQ ID NO: 77983 - DNA, 50 bp, homo sapien
attctggtatgtggcacttttcgtaygtgtgactttggacacacacctgg

SEQ ID NO: 77984 - DNA, 50 bp, homo sapien
aaaaccaagtactgtgtcaacagccrggatccaggtaaacataaataagt

SEQ ID NO: 77985 - DNA, 50 bp, homo sapien
atgcgtaacattcaagtagagacgasaacctgtgttaatattaggtcagc

SEQ ID NO: 77986 - DNA, 50 bp, homo sapien
cccgttagaaccatctctaggtgtayacgctccctttctgagcaaatgca

SEQ ID NO: 77987 - DNA, 50 bp, homo sapien
gggaagacaggagcgcaccagggccragattccttcctgcttctgtatac

SEQ ID NO: 77988 - DNA, 50 bp, homo sapien
gcaatccgtgcaggagccatagcccrgacacgtgacacttcggctcggaa

SEQ ID NO: 77989 - DNA, 50 bp, homo sapien
ctgtgtattaactcacatgatcttamgagtatttgcagaagggcagtagc

SEQ ID NO: 77990 - DNA, 50 bp, homo sapien
aatctctgtgtctggggtcatcagtsaaaaatcaaacagagcagaattga

SEQ ID NO: 77991 - DNA, 50 bp, homo sapien
cccctctcttccacactaaggagcaygtttcaaggattatatttcttttg

SEQ ID NO: 77992 - DNA, 50 bp, homo sapien
agcgtctgttttacctcccactgaasaaaagaaatataatccttgaaacg

SEQ ID NO: 77993 - DNA, 50 bp, homo sapien
tatgtgtgtagcaaataccagtttasggttagttatagaaattcccaaag

SEQ ID NO: 77994 - DNA, 50 bp, homo sapien
tgggcacctggatgtcccaaaggcawgtgaactcatcatatcaggagtca

SEQ ID NO: 77995 - DNA, 50 bp, homo sapien
attctctgactttctatgccttctcsatcagtgttagtttcaagttatct

SEQ ID NO: 77996 - DNA, 50 bp, homo sapien
tccttttaaatagaactcccacgcasctagctatcaccactaacaacatc

SEQ ID NO: 77997 - DNA, 50 bp, homo sapien
gttatcactacatacatgagcaaaawtatttcatggagacatacaaagtg

SEQ ID NO: 77998 - DNA, 50 bp, homo sapien
cttcatagaattgtcaggattaacasagctgctaaatgtaacatccttag

SEQ ID NO: 77999 - DNA, 50 bp, homo sapien
atgggctctaatgctctgcgattcaygattctgtttgcctgatcacatta

SEQ ID NO: 78000 - DNA, 50 bp, homo sapien
gacccagatgatacagagtctcagargttatgagttgggatttattctaa

SEQ ID NO: 78001 - DNA, 50 bp, homo sapien
tccttcattccatcttcttcagagcratttcccaaacaaatatcttatct

SEQ ID NO: 78002 - DNA, 50 bp, homo sapien
gttttcagttagcgttttctccagargcatgataccaagcatattccccg

SEQ ID NO: 78003 - DNA, 50 bp, homo sapien
tacatgccaggcacagtgctaaacayattgtacgattatctcacttaatc

SEQ ID NO: 78004 - DNA, 50 bp, homo sapien
gctgtgattatctagttatacctgartaaatggatcaaaggacctctcca

SEQ ID NO: 78005 - DNA, 50 bp, homo sapien
gtttatttttcttgtatttattgaaygtaaccacttctgtctgttctaga

SEQ ID NO: 78006 - DNA, 50 bp, homo sapien
ctggccttctctcttgatgctgttayaagccgcccgttttcactgttaga

SEQ ID NO: 78007 - DNA, 50 bp, homo sapien
aatgcatctgggaaggctagcattgygtctgacatgtaacagcccctgca

SEQ ID NO: 78008 - DNA, 50 bp, homo sapien
acggtcagctttccacacaggctacmagatattttatttacatttaaaaa

SEQ ID NO: 78009 - DNA, 50 bp, homo sapien
aacaacttgtgttaccgaggtaggaratttactcccaacacttttgcaat

SEQ ID NO: 78010 - DNA, 50 bp, homo sapien
ttgattttctacctctattctcttaytaaacttttggatacattccaaag

SEQ ID NO: 78011 - DNA, 50 bp, homo sapien
aaagacaaacatgtgtattgagcaasgtgtacaacttagtgaggtgtaaa

SEQ ID NO: 78012 - DNA, 50 bp, homo sapien
gcctccttgtcctcatctccttcaaygagcttgttgtccatccaccccct

SEQ ID NO: 78013 - DNA, 50 bp, homo sapien
gtgacaccagaagctgagaagcattyggctgattctccccctagggtctt

SEQ ID NO: 78014 - DNA, 50 bp, homo sapien
gcgagtttaagggatacagcagtaaytggaagaaccaaagaagacaggga

SEQ ID NO: 78015 - DNA, 50 bp, homo sapien
ttctgttccctttccatagacttaaytcacccaaaccaggtgagtctgtc

SEQ ID NO: 78016 - DNA, 50 bp, homo sapien
cattgtgtataaagctttggaaataraagaccctccatgcctgctctgta

SEQ ID NO: 78017 - DNA, 50 bp, homo sapien
agaggattgaaggacacatgggccartggcaaagatggaaacaacagaac

SEQ ID NO: 78018 - DNA, 50 bp, homo sapien
aaggaatagtaggtggtcagtaagcrctggatgttttatatccacgtatg

SEQ ID NO: 78019 - DNA, 50 bp, homo sapien
tgttctcaaccctcctgccttggttsttctcaaaccagagtgggggccat

SEQ ID NO: 78020 - DNA, 50 bp, homo sapien
gaaagtgcttgccttaaaacttcacraagaatgaagacgtatgtactact

SEQ ID NO: 78021 - DNA, 50 bp, homo sapien
ggaacctactcatgctaacaattctyattggttatctgaaattcaaactg

SEQ ID NO: 78022 - DNA, 50 bp, homo sapien
ggagcatcaggctgaaagaacattasgattaggaaaatctctgatggaaa

SEQ ID NO: 78023 - DNA, 50 bp, homo sapien
attggcaaatatattttgtcttttayatatgctagagactttactcatct

SEQ ID NO: 78024 - DNA, 50 bp, homo sapien
gtcaaaccaagtcacaaggataaccsaactgtaagaccatggcaaggtga

SEQ ID NO: 78025 - DNA, 50 bp, homo sapien
ttttaaaaaattcatacaattgaacygggtacaaaggatcacctgggttt

SEQ ID NO: 78026 - DNA, 50 bp, homo sapien
ctgtgactttttaaaatcacaattcratgaaaagttcaacacactaaaat

SEQ ID NO: 78027 - DNA, 50 bp, homo sapien
taaaaagtcacagtttagcccagaasgaggtatctccaagtttgtcagtt

SEQ ID NO: 78028 - DNA, 50 bp, homo sapien
tctgaaattcaaactggactgggtaytccctattgtttctggcaacccta

SEQ ID NO: 78029 - DNA, 50 bp, homo sapien
tacagccaccaagaaaaataagccaygttatgtaaaaagagaagttgtag

SEQ ID NO: 78030 - DNA, 50 bp, homo sapien
agaatgtattctcttacttcttgaayaatttaaataaccatatcaattaa

SEQ ID NO: 78031 - DNA, 50 bp, homo sapien
agcctcatcatttatattttctcgakcaactagcaaatttttcctttcct

SEQ ID NO: 78032 - DNA, 50 bp, homo sapien
tttacttgctgcttcttaaaatcaascacagggctgtatggaattgagtt

SEQ ID NO: 78033 - DNA, 50 bp, homo sapien
cacctcaggtggacacaccatctackactcttgctggggagagctccaag

SEQ ID NO: 78034 - DNA, 50 bp, homo sapien
ccagagatggccttattggcttcaarcaaaaataaacaagcctggatggg

SEQ ID NO: 78035 - DNA, 50 bp, homo sapien
tctggtcctcattaaaatgtgttcastaaattgatgtcaaaataattaat

SEQ ID NO: 78036 - DNA, 50 bp, homo sapien
gggatggaggacttcaaaggcatagraaacccattgactctgtcaccaca

SEQ ID NO: 78037 - DNA, 50 bp, homo sapien
tggtttgaatgtaaccaatgttcaartatgattgtagagtattaattatt

SEQ ID NO: 78038 - DNA, 50 bp, homo sapien
cagtgaatagactgtttagactacayacagggacatagcagggaatcaga

SEQ ID NO: 78039 - DNA, 50 bp, homo sapien
aaagtaactgaaagacctgaagtaaktgaccaaaacgtagcacagaaaaa

SEQ ID NO: 78040 - DNA, 50 bp, homo sapien
aggccatgatacctgttaagagtcamgtggaccacatcagggcggtcgtc

SEQ ID NO: 78041 - DNA, 50 bp, homo sapien
caggtctttcagttactttatgctcyctttagcaccacctaatctgctgt

SEQ ID NO: 78042 - DNA, 50 bp, homo sapien
gcaaataccttttcaagctataagamctgtcattgagattagtctctggc

SEQ ID NO: 78043 - DNA, 50 bp, homo sapien
tacaggcagatgtaatgggtagtaaygagcttatgtggctacgtggagaa

SEQ ID NO: 78044 - DNA, 50 bp, homo sapien
ttggttatagcctccagagagcactsacttattattccaacagggcactt

SEQ ID NO: 78045 - DNA, 50 bp, homo sapien
agtctgtcttctcttgactcagagaraaggatcgggattcctcatttccc

SEQ ID NO: 78046 - DNA, 50 bp, homo sapien
caggtgtctctcactcgttccttgcrccatattagacctgtgttaatttc

SEQ ID NO: 78047 - DNA, 50 bp, homo sapien
actctcaaattcaccctggttcttaygagttatcgtgtctcctgaaacct

SEQ ID NO: 78048 - DNA, 50 bp, homo sapien
ccagggtctttgcacaggattttccrcacacagtacaagtctgggtctcg

SEQ ID NO: 78049 - DNA, 50 bp, homo sapien
ggtttcttacagtaaatcagggatakcaattactgtgtagacatggtcaa

SEQ ID NO: 78050 - DNA, 50 bp, homo sapien
agacaaggatgcctgaatgcattaawaaaggttcaaatatacttcacttt

SEQ ID NO: 78051 - DNA, 50 bp, homo sapien
ttaaatagtgctcagaaatcaaagarctgaaaaaatgtaaatgggattca

SEQ ID NO: 78052 - DNA, 50 bp, homo sapien
tatccaacacacaggcattagggtcmacaacttagtgtctgggagggaga

SEQ ID NO: 78053 - DNA, 50 bp, homo sapien
acaaatgcatacacttaccaaaatayagaacattgccagcacccaaaaat

SEQ ID NO: 78054 - DNA, 50 bp, homo sapien
tcctgggctaacttaactaggattayggcctccaaatgcatccatgatgc

SEQ ID NO: 78055 - DNA, 50 bp, homo sapien
aactcataggaacagaaagcggaacrgtggttaccacaggcagagggtta

SEQ ID NO: 78056 - DNA, 50 bp, homo sapien
ccccactgtgaagggacctcatggasaaggcaattgtgactgtatttctg

SEQ ID NO: 78057 - DNA, 50 bp, homo sapien
gactgctctctagcaatgtgactccragctagttccctcatctcctggga

SEQ ID NO: 78058 - DNA, 50 bp, homo sapien
acgactctgtgttaattaaaagcgaygtgactgcctgattgtaactggac

SEQ ID NO: 78059 - DNA, 50 bp, homo sapien
gaaccccaggtaacattcaaacccakatgcctctgtagtaaaggatgggt

SEQ ID NO: 78060 - DNA, 50 bp, homo sapien
aggaaaaataagatttataaacacaytgctgatatttgaggctggttttt

SEQ ID NO: 78061 - DNA, 50 bp, homo sapien
ccattgagagcatttgccaattgacyaaaaggagtagaaaaagcacatta

SEQ ID NO: 78062 - DNA, 50 bp, homo sapien
agggaggtgaaaagtcatggctagcrgcatttccctttgcctggagtcag

SEQ ID NO: 78063 - DNA, 50 bp, homo sapien
gtattttccctttacttccacaacayctagtactttctaatgccccacag

SEQ ID NO: 78064 - DNA, 50 bp, homo sapien
ttttcactcaggtaagtgaactgaawgctcagtccaagtctagtgtcata

SEQ ID NO: 78065 - DNA, 50 bp, homo sapien
gcttccattctccaggttacttcatkgtctcaaatagctattctctatca

SEQ ID NO: 78066 - DNA, 50 bp, homo sapien
gaaaggggaagcgtttcaacgaccargtatctctggagggcagaagactg

SEQ ID NO: 78067 - DNA, 50 bp, homo sapien
tagccaacataaacaatgtgggagaygattaaaggccaccaggaaaatgt

SEQ ID NO: 78068 - DNA, 50 bp, homo sapien
atagtaaagagttcaacttcatgtaycatcaaataaataataattaaacc

SEQ ID NO: 78069 - DNA, 50 bp, homo sapien
gggactgccttctgctcttcatgccyataaggctgatccatgtggtggac

SEQ ID NO: 78070 - DNA, 50 bp, homo sapien
aaggaacaaaccacacgcacacatcrtgaatgactcaaaagcattaagct

SEQ ID NO: 78071 - DNA, 50 bp, homo sapien
ctttttttattaatctggagagcaamatgtcaggaggtaaagttttcaga

SEQ ID NO: 78072 - DNA, 50 bp, homo sapien
atccaaaatcctactggcaaaataaraaattgtacctcgatcaatcaagc

SEQ ID NO: 78073 - DNA, 50 bp, homo sapien
tataaaagttaaagttgccgtctatyagatacgtattttacagtttttac

SEQ ID NO: 78074 - DNA, 50 bp, homo sapien
ccatcagcattttgagttggctagaycctaatcctacaagagctggcaaa

SEQ ID NO: 78075 - DNA, 50 bp, homo sapien
tggtggaatgaattcggtggcctaartgtaccttcctcaaatgccacggc

SEQ ID NO: 78076 - DNA, 50 bp, homo sapien
cacatgcatacataggaacaggaaamgggtgtagaggaggagcacaccta

SEQ ID NO: 78077 - DNA, 50 bp, homo sapien
gtggggtcgtgtttgaatagcaaagrtgtgcgaacaaaccaaattaggaa

SEQ ID NO: 78078 - DNA, 50 bp, homo sapien
aggttgtctttttttctgagttatgyagttggaaccttggacgcaagttg

SEQ ID NO: 78079 - DNA, 50 bp, homo sapien
caaccaaatgagaggcatcacccaayagggctgtgagtcagaccaacatg

SEQ ID NO: 78080 - DNA, 50 bp, homo sapien
actgtattggtcaaataggctgcacygtactttgagatggaaagttatca

SEQ ID NO: 78081 - DNA, 50 bp, homo sapien
gaaagtgtacctgggaatgaacgccrgatcacactggacacttccccttc

SEQ ID NO: 78082 - DNA, 50 bp, homo sapien
gcttatacttttttgcttttactcaygattagatcacttagttaaggttt

SEQ ID NO: 78083 - DNA, 50 bp, homo sapien
tcatcaaagaaaacagcaacacaaaygagacacaatacctaccactcatg

SEQ ID NO: 78084 - DNA, 50 bp, homo sapien
ctttagaatgcgctccaatacgctcyctgttctgggattggaaatgtggc

SEQ ID NO: 78085 - DNA, 50 bp, homo sapien
tgctttttctaggtgtctccaacaasgaagtcatgcacgctatctgataa

SEQ ID NO: 78086 - DNA, 50 bp, homo sapien
ttgcaaaaactctactccttaaagcrccgaggagaagcagccctggtgct

SEQ ID NO: 78087 - DNA, 50 bp, homo sapien
aggatcgtatctggagcaagcagacsgattttcagaaacgcacattgggt

SEQ ID NO: 78088 - DNA, 50 bp, homo sapien
ataataatatgataacattataacaratcactaatgtattagtgtctcat

SEQ ID NO: 78089 - DNA, 50 bp, homo sapien
cacaggatgggagtcaggtgataagycctcattttggcaaggtagaccca

SEQ ID NO: 78090 - DNA, 50 bp, homo sapien
ccatgccaggccaatcacctcgaaawttatcctttctatagtccaggggt

SEQ ID NO: 78091 - DNA, 50 bp, homo sapien
tccttccattccttccatcttaccargtaatttgagcctgaggccagggc

SEQ ID NO: 78092 - DNA, 50 bp, homo sapien
aaacatggccctgagttttcacagcyttagaaatgagatgttgcatctcc

SEQ ID NO: 78093 - DNA, 50 bp, homo sapien
cataacatggcagttaaccaaaaacrccattctgtaggatgaagggagag

SEQ ID NO: 78094 - DNA, 50 bp, homo sapien
tggccctgcagagctcagagtgtaayggaggaaacagtcaaataaataag

SEQ ID NO: 78095 - DNA, 50 bp, homo sapien
ccttcaccatgtagagtccaccgtcytgatcccagatgtgagtctgtggc

SEQ ID NO: 78096 - DNA, 50 bp, homo sapien
gatgacctggctatactccttctaaycttggccgtccgtgaccccaagct

SEQ ID NO: 78097 - DNA, 50 bp, homo sapien
tgcatctaaaacaggacttactcaaygcttcatttcttcccaattttggt

SEQ ID NO: 78098 - DNA, 50 bp, homo sapien
tctctgggtgcttggagcatagttckctctttctgtgggtacttggaaca

SEQ ID NO: 78099 - DNA, 50 bp, homo sapien
atgcaaacttacatgccaatcaagargaaaggaggaggggtcacatttgt

SEQ ID NO: 78100 - DNA, 50 bp, homo sapien
cattctattccatgcccttttcaagrctcaacacactttgctcttgtgag

SEQ ID NO: 78101 - DNA, 50 bp, homo sapien
tggtcaataaatgttatttgtgaaaytctaaactggccacctcttaaatg

SEQ ID NO: 78102 - DNA, 50 bp, homo sapien
attcaagaaaaaatgctgactctcartaagaacagtgagttctgcagcat

SEQ ID NO: 78103 - DNA, 50 bp, homo sapien
gttctgaccatggctgccgaaagacrcccaggaggacaggtgagcctctg

SEQ ID NO: 78104 - DNA, 50 bp, homo sapien
tgcattgggtgtgctttcgaaattayaaagcagatcacgtagcgtccctg

SEQ ID NO: 78105 - DNA, 50 bp, homo sapien
tattttgatttaaattctttgcaatraatggaaccaatctcaaatgacag

SEQ ID NO: 78106 - DNA, 50 bp, homo sapien
ctgtatcagaattatctaactaaggkctatttgtgactcagcttcctggg

SEQ ID NO: 78107 - DNA, 50 bp, homo sapien
gtggctgaggcctctttcttcttaarcaccgggagcagagagaaaaaggc

SEQ ID NO: 78108 - DNA, 50 bp, homo sapien
tccatccctcctatcaatattgcaakcctatttttaagcctgttattccc

SEQ ID NO: 78109 - DNA, 50 bp, homo sapien
ctgaacatcagtaattaattagtcaygcacacaaataactgattcacagc

SEQ ID NO: 78110 - DNA, 50 bp, homo sapien
aaactcagcaaaaaatgcttacctamtagctaacttctggctactaacaa

SEQ ID NO: 78111 - DNA, 50 bp, homo sapien
gaaatgaaatgcatgcccaaatcacrgtatgcgatagtgcacatgacctc

SEQ ID NO: 78112 - DNA, 50 bp, homo sapien
cataaatagaattgtaaggggtgacracaaactggaaaacatttgcaatg

SEQ ID NO: 78113 - DNA, 50 bp, homo sapien
atctccaaattgtacattttttcacraatcctcgcaaagcaagcttctct

SEQ ID NO: 78114 - DNA, 50 bp, homo sapien
atcgaagtggatttaaggctctgtaygtgacctttcacaccctccaaatg

SEQ ID NO: 78115 - DNA, 50 bp, homo sapien
gtaaatggcatgcactgctgaatagwaattaaactgcttaataagggaaa

SEQ ID NO: 78116 - DNA, 50 bp, homo sapien
gtttctccaagtggagttctctgcawcatcgtgccctgtgattatcaagt

SEQ ID NO: 78117 - DNA, 50 bp, homo sapien
gacagccaccaatgaataaaatgaartgacagtctgtgagtgcggtctct

SEQ ID NO: 78118 - DNA, 50 bp, homo sapien
tgataatttcggctgtactggatctmatcttatttatgcaaaaatactca

SEQ ID NO: 78119 - DNA, 50 bp, homo sapien
ttcaaccctccaccacaggatctacrgaggacatccacatctgcaattac

SEQ ID NO: 78120 - DNA, 50 bp, homo sapien
taatagttcactcatctaaagtccaytatttagcagtatcacctgacctg

SEQ ID NO: 78121 - DNA, 50 bp, homo sapien
aagatagccatctgtttcagaaaacyggcattctggctgttgcctaaata

SEQ ID NO: 78122 - DNA, 50 bp, homo sapien
ctaccagagccaggtgacagcaaccmgaatggtctatgggatatttacat

SEQ ID NO: 78123 - DNA, 50 bp, homo sapien
gtaaaaattacattctgtagtgccaragaaaaagcccccagaaagacaga

SEQ ID NO: 78124 - DNA, 50 bp, homo sapien
ccattctggaagccaccaaaagctamgaacaagtggaccccaggggaagg

SEQ ID NO: 78125 - DNA, 50 bp, homo sapien
taagcaattaaaacacaacttaccargtgctgaaatagagatatgtataa

SEQ ID NO: 78126 - DNA, 50 bp, homo sapien
attaatacaatggcatattacgaatwatctggttgtctgtggctaatgag

SEQ ID NO: 78127 - DNA, 50 bp, homo sapien
aatatcaagaataaagattgtaaaarctcctaagaggaagaaaacagtca

SEQ ID NO: 78128 - DNA, 50 bp, homo sapien
ccttggtgagggaaattcttaaacarcacaaaaatcattaggaaaagatc

SEQ ID NO: 78129 - DNA, 50 bp, homo sapien
ggaccaaacaagaaggcaatagggamtataactacattctaaatgagaaa

SEQ ID NO: 78130 - DNA, 50 bp, homo sapien
tctccaccacctcctacctacctcartaattcaataacacatgttcttat

SEQ ID NO: 78131 - DNA, 50 bp, homo sapien
gaatccagattccagagtaactcatkaaagacacagtaattaccctggac

SEQ ID NO: 78132 - DNA, 50 bp, homo sapien
tagaaaagaggaaagttattatgackgaaaaaatatcctgcagaacatcc

SEQ ID NO: 78133 - DNA, 50 bp, homo sapien
gtcctgttttctttctctttatagartcctgttatctgtacagcttcctc

SEQ ID NO: 78134 - DNA, 50 bp, homo sapien
ttagaaaatttacagaagaaggaatkacgaaaaaacaactcattagccac

SEQ ID NO: 78135 - DNA, 50 bp, homo sapien
tgttttaataaattaataaaacaaaragatgcatagatgcaaaaaataca

SEQ ID NO: 78136 - DNA, 50 bp, homo sapien
agaaaatccctatggtaaaatgctaygcggccaatgaatgtgaatacaaa

SEQ ID NO: 78137 - DNA, 50 bp, homo sapien
aagcttgattttatatattatgtcaygagcaaaggctgtactgagtgcag

SEQ ID NO: 78138 - DNA, 50 bp, homo sapien
gggagggggactgcaccaccaagaayggctcgtgtcctcttttatttgtt

SEQ ID NO: 78139 - DNA, 50 bp, homo sapien
aatgaaaatcccagaggtatgcaggyttcaggcacagtttgatccagtag

SEQ ID NO: 78140 - DNA, 50 bp, homo sapien
gagaacacagggtaggtaattcaccrggtgttattctttcacgaggccgg

SEQ ID NO: 78141 - DNA, 50 bp, homo sapien
ctgagacagaatcatctgggatcaaycagtacatgagtatttctggagat

SEQ ID NO: 78142 - DNA, 50 bp, homo sapien
ccgactcaacaacaactccctagcaraaggagcctcgccctccctggcgc

SEQ ID NO: 78143 - DNA, 50 bp, homo sapien
actcaacaaaggccagccataaaaayctccacttgtgtaataaactgttg

SEQ ID NO: 78144 - DNA, 50 bp, homo sapien
gttccaaacacaattgtaagttttcyaataatcaagtatccatttttaaa

SEQ ID NO: 78145 - DNA, 50 bp, homo sapien
ctttaaaaatgacttagcgctagagscatgtatgtgggcctttggtattg

SEQ ID NO: 78146 - DNA, 50 bp, homo sapien
accacagccctgaacttgctcgcaaygcctgccactctggccaccaggac

SEQ ID NO: 78147 - DNA, 50 bp, homo sapien
cagcatgttggtagggctcatcctcrtattttctgttggagcgagataag

SEQ ID NO: 78148 - DNA, 50 bp, homo sapien
cagcttttgctcatctataatacaargatgttgaacaatatggtgttaaa

SEQ ID NO: 78149 - DNA, 50 bp, homo sapien
ccccctgtgtttgaaatatttagcayggtttctgtttttctggctggact

SEQ ID NO: 78150 - DNA, 50 bp, homo sapien
gagaactgtgtgcctggctgcgcatragattgtgggattatcaagaaaag

SEQ ID NO: 78151 - DNA, 50 bp, homo sapien
atgatgaggaaagattgatccaaaayactaaaattaactaaatcatatgc

SEQ ID NO: 78152 - DNA, 50 bp, homo sapien
ctacattctgtctcagggactgcaamtatgtattcaggtgaggaagcatg

SEQ ID NO: 78153 - DNA, 50 bp, homo sapien
aaagtacttgaggaagtattctagcrcaacaaaaaatgaattagagtaaa

SEQ ID NO: 78154 - DNA, 50 bp, homo sapien
attaaggaaactggcaagctagaatmaaaaatatggttctttgtaaatac

SEQ ID NO: 78155 - DNA, 50 bp, homo sapien
ccagactcttcatctttctccactgsatggccgtctttcaaaatgagagc

SEQ ID NO: 78156 - DNA, 50 bp, homo sapien
caaggcagtccttctattcctctaasatacctctgcccactcccattttt

SEQ ID NO: 78157 - DNA, 50 bp, homo sapien
cccttatctccagctgcacatatgcraagactcgataattcctggctgat

SEQ ID NO: 78158 - DNA, 50 bp, homo sapien
taaagtcttacaccttaggatccatraccatgctcacagttgttcttata

SEQ ID NO: 78159 - DNA, 50 bp, homo sapien
catgctctctagaccctgggtacacygactgactggccttctctcaaggt

SEQ ID NO: 78160 - DNA, 50 bp, homo sapien
catttgcctcatgggacttttgttckaagagttaaatgagataatgtatg

SEQ ID NO: 78161 - DNA, 50 bp, homo sapien
catttgtctgcataaaggcattctcrggtagcagcatggggttgacagca

SEQ ID NO: 78162 - DNA, 50 bp, homo sapien
agtcaaaaacatttgggaggaaagakagtaatgacggaaatttccagaat

SEQ ID NO: 78163 - DNA, 50 bp, homo sapien
gcttcgtagagtgggtgctgttcccraatgtacccattcgacaggtgagc

SEQ ID NO: 78164 - DNA, 50 bp, homo sapien
tgggttatgcctctcagggagaaaayctttgagtccacaaaaccgcttgt

SEQ ID NO: 78165 - DNA, 50 bp, homo sapien
caaggatgtcaatgaagtatgaagayctcaagtgcttagagagtgagaag

SEQ ID NO: 78166 - DNA, 50 bp, homo sapien
cacacttcagggacatcctcagggcytactgttcagcctgccaccagtgg

SEQ ID NO: 78167 - DNA, 50 bp, homo sapien
tctaagaagtcttgcttagctccaamtctcttatgaccacaacttatctt

SEQ ID NO: 78168 - DNA, 50 bp, homo sapien
tcttgtcttactgcattggatagaaygtcaaagtaatggtatatataata

SEQ ID NO: 78169 - DNA, 50 bp, homo sapien
ttaaatgtacccaatagggcttttargatatcagaaaagtaggttttaag

SEQ ID NO: 78170 - DNA, 50 bp, homo sapien
tgacacttactcacgtcattcaccartaaaaccctctatccttcctcctc

SEQ ID NO: 78171 - DNA, 50 bp, homo sapien
aggattacttttgaattacaaaacargaggcctgaaaaattcttagttct

SEQ ID NO: 78172 - DNA, 50 bp, homo sapien
cagtatacaacaagcagaagtttgcycttgaaaaactgtagtgtagttag

SEQ ID NO: 78173 - DNA, 50 bp, homo sapien
agtaacagtgaatcgccccttgcaaygtacaaccacagtacgctagcttc

SEQ ID NO: 78174 - DNA, 50 bp, homo sapien
ttttcagggactaggctttatttccraccttggccttctcaaggagacta

SEQ ID NO: 78175 - DNA, 50 bp, homo sapien
ctgaaatccaatccgtcataaattcsagccgcacaataaatgtgtagaga

SEQ ID NO: 78176 - DNA, 50 bp, homo sapien
acttaatggatacaaacaaaagttayattacaaatggaaattcaagggtg

SEQ ID NO: 78177 - DNA, 50 bp, homo sapien
accggacagctgttagaaacaaagawgtgctggtgtttagatgtagtgaa

SEQ ID NO: 78178 - DNA, 50 bp, homo sapien
gaagttgaaatttgtattccttctayagttattgcttttcttatatttga

SEQ ID NO: 78179 - DNA, 50 bp, homo sapien
aaagtaagtaacagcatgagaatgaygtgccattaaatactactattgga

SEQ ID NO: 78180 - DNA, 50 bp, homo sapien
gtgtccttgtcacaatacactttccratctccgaggcaggcagaggcttt

SEQ ID NO: 78181 - DNA, 50 bp, homo sapien
gctgggagatgtattaagagctgacygtataaacgatgaaaaacaagact

SEQ ID NO: 78182 - DNA, 50 bp, homo sapien
cttaggctcagaaggcttttgttaaktattactttctacagcttgaaata

SEQ ID NO: 78183 - DNA, 50 bp, homo sapien
ctgaatccgtatcttctctatcctcrctaccactggttttgccttctttt

SEQ ID NO: 78184 - DNA, 50 bp, homo sapien
gactttgtgttctgtggattccctayattgctaacctctcccttaccacc

SEQ ID NO: 78185 - DNA, 50 bp, homo sapien
ctttctctgcctacagtattataaaycaactcatgtcatacaccaatgtc

SEQ ID NO: 78186 - DNA, 50 bp, homo sapien
taaaagggatcagagctctgtccackgatagggtcgaacttctgggaaca

SEQ ID NO: 78187 - DNA, 50 bp, homo sapien
agataaggtctccctcacatgtgccmagggttaggacttgagcataacta

SEQ ID NO: 78188 - DNA, 50 bp, homo sapien
aattttgttggagaggaagttagaawctatgacctagagcagctttaccc

SEQ ID NO: 78189 - DNA, 50 bp, homo sapien
ttcctcttgcttcttgctttacataygcacaaagagactaagttggtttc

SEQ ID NO: 78190 - DNA, 50 bp, homo sapien
ctagagcagctttacccatgacttawtcatccagggtacccttttctcta

SEQ ID NO: 78191 - DNA, 50 bp, homo sapien
ccattttagcataaatgatataatgytgaattactggccacgaactgggt

SEQ ID NO: 78192 - DNA, 50 bp, homo sapien
aaatgaaatttgtttattaagttgaygtcttggtctgttttctgttgcta

SEQ ID NO: 78193 - DNA, 50 bp, homo sapien
tcaattattttatctttcaatatcakagatcttaatcaaatgaagacgaa

SEQ ID NO: 78194 - DNA, 32 bp, homo sapien
gaaactaaagttgcacratgggatgatttatc

SEQ ID NO: 78195 - DNA, 50 bp, homo sapien
caggtgagaaatgctgtttgttgtckcttttggcctgtacttctctgaag

SEQ ID NO: 78196 - DNA, 50 bp, homo sapien
agaaaaattgatggataataggagayaaatgaatttttaaaaaggcccca

SEQ ID NO: 78197 - DNA, 50 bp, homo sapien
taaaagcaacacatatcaaaatttgyaggatatggttgaagtggagatta

SEQ ID NO: 78198 - DNA, 50 bp, homo sapien
tggggctgtcaccctgcccactttcratggcgtggaagagtcttcaacac

SEQ ID NO: 78199 - DNA, 50 bp, homo sapien
ggcatttatgttacacgtttgtgaarggaaggatttatatcagagtttga

SEQ ID NO: 78200 - DNA, 50 bp, homo sapien
ttgagaatgtaccctgtcctccctayatacacgggcacaatttccctgta

SEQ ID NO: 78201 - DNA, 50 bp, homo sapien
ttggccatctgagataacagtcatamaagaaaggcaagataaatgctgga

SEQ ID NO: 78202 - DNA, 50 bp, homo sapien
cctcagtgtcctcaaatgtaaactamggatggcatccctcctgggccatt

SEQ ID NO: 78203 - DNA, 50 bp, homo sapien
tccttctgctttcctgctaagccagrctgagtaatattctttttatttac

SEQ ID NO: 78204 - DNA, 50 bp, homo sapien
cagtgagcttaatatgtttctcctgmagtttgactggcacggtggactgg

SEQ ID NO: 78205 - DNA, 50 bp, homo sapien
aatcctctaataatttgcctgtaccracatctttcctctgaatttattgt

SEQ ID NO: 78206 - DNA, 50 bp, homo sapien
tgtaaatggaaaaatgagaacaacgwccctattacaaagaaagcccaggg

SEQ ID NO: 78207 - DNA, 32 bp, homo sapien
gcgtgattgttagtgcrgatctgtggtactgc

SEQ ID NO: 78208 - DNA, 50 bp, homo sapien
aaacttggacttttaattaggatatragagccttcctttctctcccaaca

SEQ ID NO: 78209 - DNA, 50 bp, homo sapien
atggtgctggtccttcaagtttatayctctgggatcattggtttccaaac

SEQ ID NO: 78210 - DNA, 50 bp, homo sapien
aatccgtgaggcactatgaggaagayggtttttacactttgggctcacat

SEQ ID NO: 78211 - DNA, 50 bp, homo sapien
tctagaaagagaagaagacatatgasagttctatttttgccttaatatat

SEQ ID NO: 78212 - DNA, 50 bp, homo sapien
ttacatttcttagaagcttccccaawtgcatagttatcagggaaacctga

SEQ ID NO: 78213 - DNA, 50 bp, homo sapien
atatggtcaaacagcctaagttagaraagtttccatttgccagtggaatt

SEQ ID NO: 78214 - DNA, 50 bp, homo sapien
ctatgatcggacaatgtgaccctaamgtgatatctttttgaaattctttc

SEQ ID NO: 78215 - DNA, 50 bp, homo sapien
tgtgctcaatcttgcccatacataartctttgccgagagaccttggtcat

SEQ ID NO: 78216 - DNA, 50 bp, homo sapien
catccaccttgttgcgtgttcttcasgttgttagggagttagctgtatgt

SEQ ID NO: 78217 - DNA, 50 bp, homo sapien
ccccacttgtccctactacattatamaaatcctttccactttcaatttac

SEQ ID NO: 78218 - DNA, 50 bp, homo sapien
ctgctccaggctgttgaactacagarcaagataaatataggaaattacgc

SEQ ID NO: 78219 - DNA, 50 bp, homo sapien
tatgggagaaagggatgaaattacarctattcctctgggttgtgtaatta

SEQ ID NO: 78220 - DNA, 50 bp, homo sapien
ggaatttggcatctaactgtacaacwctcaagttataaagaaggtttcca

SEQ ID NO: 78221 - DNA, 50 bp, homo sapien
ggggccctgccctctgcctgtcttcyatgaaattttctaaggggtctggg

SEQ ID NO: 78222 - DNA, 50 bp, homo sapien
tgtaccaggcagcctggccaagaacmagggcagaagcacaaagagcgtga

SEQ ID NO: 78223 - DNA, 50 bp, homo sapien
tggcatatgcaatctcggctctggarcatttttcggaaaacttaaaaggg

SEQ ID NO: 78224 - DNA, 50 bp, homo sapien
ctgtcctgtttctagagctcgtgccrttcaacctgccaaagccctgctgc

SEQ ID NO: 78225 - DNA, 50 bp, homo sapien
ctcatcacagcatcatctggcactakcgtgtatgttgagaagtcagctgc

SEQ ID NO: 78226 - DNA, 50 bp, homo sapien
ctaagaagaccaaagcataacaggtyggatgacatgggatagtagtttga

SEQ ID NO: 78227 - DNA, 50 bp, homo sapien
agggcaccatttcttgaaaaatgtasagtaaatagtgaacgcattataat

SEQ ID NO: 78228 - DNA, 50 bp, homo sapien
ttcatcaatgttgaaaactactctaycatcatctatttaaagactgtttc

SEQ ID NO: 78229 - DNA, 50 bp, homo sapien
ctgtgtctcctgaataggccatttarcccatacagtcctgacatggatat

SEQ ID NO: 78230 - DNA, 50 bp, homo sapien
gcgcctgttccctcgttagcactcaygcagtatcagctattatcatcatg

SEQ ID NO: 78231 - DNA, 50 bp, homo sapien
acctcaaaacttttcctacactgcaytctttccaaaactcagccaaagaa

SEQ ID NO: 78232 - DNA, 50 bp, homo sapien
agtaattttagagagagtattaaagrgtcttgtcaatgcctatgtattga

SEQ ID NO: 78233 - DNA, 50 bp, homo sapien
ggaaaggatctgctcacattttttcygacctcaaaccttagacatttcac

SEQ ID NO: 78234 - DNA, 50 bp, homo sapien
cctcctacaactaacatagcttttamatgttcttcactttgtcctcagtt

SEQ ID NO: 78235 - DNA, 50 bp, homo sapien
tttcactgcttccatcatccaccagragaatgtgagtgggagagggagga

SEQ ID NO: 78236 - DNA, 50 bp, homo sapien
aaattctaggagatgaaattgtcagycaggctcttacccgactgatactt

SEQ ID NO: 78237 - DNA, 50 bp, homo sapien
ccatgagaataaattgcagaaagacrctgttaggtccctggtcacatttt

SEQ ID NO: 78238 - DNA, 50 bp, homo sapien
caactgcagtcagaactgttaacaargatgagactgtcaagagagtgttc

SEQ ID NO: 78239 - DNA, 50 bp, homo sapien
catgagattacaatatttcttgtaaragttcttaatgttatgttcaaagg

SEQ ID NO: 78240 - DNA, 50 bp, homo sapien
tacccatatccccatctatacactgyccaaactcagcaaatccatccaaa

SEQ ID NO: 78241 - DNA, 50 bp, homo sapien
aaaaaaaaaaaattcgtgacttagaytagttttgtttcctgtggaactcc

SEQ ID NO: 78242 - DNA, 50 bp, homo sapien
gtacttgagaagcaatgttttcagayaagaacctcactgcatttaaccca

SEQ ID NO: 78243 - DNA, 50 bp, homo sapien
ttaacccatacagtcctgacatggayatctgagtaccctttcttttcctg

SEQ ID NO: 78244 - DNA, 50 bp, homo sapien
ctaatagagtccagaaaaagattcawacgcagatagacaatagaattaca

SEQ ID NO: 78245 - DNA, 50 bp, homo sapien
aaggaaattctagaagactgaataaktatctccttgtttgaagagaagtc

SEQ ID NO: 78246 - DNA, 50 bp, homo sapien
caggcatactggactcattatataasactatctccaaggtgttgagcctt

SEQ ID NO: 78247 - DNA, 50 bp, homo sapien
aagatggaagattgtcctgctataakaagatggaagattgtcccgcagga

SEQ ID NO: 78248 - DNA, 50 bp, homo sapien
tgcagttgatgtctgaagccaccatyagatgttagtgaaagtagatggtc

SEQ ID NO: 78249 - DNA, 50 bp, homo sapien
ttgtgcccagggtaagatgtcagccraaggtcagaagcgggaataggggc

SEQ ID NO: 78250 - DNA, 50 bp, homo sapien
acgctccttcaggctttcaaacctaygagcctgcagctcagccagccaaa

SEQ ID NO: 78251 - DNA, 50 bp, homo sapien
aaaacagaaaaacagacaaaacaggycctgattaaatctacataaaaatg

SEQ ID NO: 78252 - DNA, 50 bp, homo sapien
tgccacgtagtgttaccatcctgccrttcagaggagggaagtggggcaca

SEQ ID NO: 78253 - DNA, 50 bp, homo sapien
aataataaaaagagtaagaatgacarctaactatcagtcaggagaggtta

SEQ ID NO: 78254 - DNA, 50 bp, homo sapien
aagcattcctcttgtccttgctgtayatgaaaaaactgagacccagagat

SEQ ID NO: 78255 - DNA, 50 bp, homo sapien
atacatgatataattatttacctagraaagccaacagaatcaacaaatat

SEQ ID NO: 78256 - DNA, 50 bp, homo sapien
tcttccagttgccaagatgtttctargtgttggtttctttttatttattt

SEQ ID NO: 78257 - DNA, 50 bp, homo sapien
actgaatatttgtcagtgtccaaaawtgtttttggttgtcatgactggag

SEQ ID NO: 78258 - DNA, 50 bp, homo sapien
cttattttctgtcctctattttgtgkcacataatgcatatttatatagac

SEQ ID NO: 78259 - DNA, 50 bp, homo sapien
gtcatgttgttaaaacgtttgaataygacaatctctttcccaggcaaagg

SEQ ID NO: 78260 - DNA, 50 bp, homo sapien
tcagtatgaagagattaacacgtcaraataacatgaattttctttcttaa

SEQ ID NO: 78261 - DNA, 50 bp, homo sapien
catcccttgactcaatgctctcactraggccaagcgccacgaggtgactg

SEQ ID NO: 78262 - DNA, 50 bp, homo sapien
actatgaacaatgcaagtataaatayaatggtagctatttctttgtgcat

SEQ ID NO: 78263 - DNA, 50 bp, homo sapien
tccttctctgctgaaattgtccagayttggctaaagaaaagaaactgaaa

SEQ ID NO: 78264 - DNA, 50 bp, homo sapien
atgggggaagaggctatgttcggcaygtcttcatttccacagactaggga

SEQ ID NO: 78265 - DNA, 50 bp, homo sapien
taaacatggaacaatggtttaaccaraaagtgtcctataattatattgga

SEQ ID NO: 78266 - DNA, 50 bp, homo sapien
ttaacattgttataagcctataaggkaagaaagggactatattacaaaag

SEQ ID NO: 78267 - DNA, 50 bp, homo sapien
ataagctatagattcagtagtactcragtgaatttacgttttaataatca

SEQ ID NO: 78268 - DNA, 50 bp, homo sapien
gctcaatggtgtttctcttagtcaasttaggagttccatgcctttggcct

SEQ ID NO: 78269 - DNA, 50 bp, homo sapien
tgctataaagatgtgtttatcattcrgaaaggactaattaacatgtacta

SEQ ID NO: 78270 - DNA, 50 bp, homo sapien
ccattattccctcatcagtgcccacracgatgtacccccttttatcattc

SEQ ID NO: 78271 - DNA, 50 bp, homo sapien
gcatttcaagtctctgggatgtagayaggaaatttttcagaaggaacaga

SEQ ID NO: 78272 - DNA, 50 bp, homo sapien
tacaaggaagaaccctatcttaaagragcagtttttgcacatgaaggtat

SEQ ID NO: 78273 - DNA, 50 bp, homo sapien
tggaaggattaaatagctgctcaagyaaaaacaagctcagggtgatgttt

SEQ ID NO: 78274 - DNA, 50 bp, homo sapien
aaattgagataaaatatgtgtataaygaggcacgaaacagagaggggtct

SEQ ID NO: 78275 - DNA, 50 bp, homo sapien
gcaaagcaatctccacttttgatggrcataaattcctcagtgactcttca

SEQ ID NO: 78276 - DNA, 50 bp, homo sapien
cacacatttttccggagggagagaaycgctaaaataaaggcctctagaga

SEQ ID NO: 78277 - DNA, 50 bp, homo sapien
tgagctttgccttgaccctgttggcratagagggcctgagctaacctttt

SEQ ID NO: 78278 - DNA, 50 bp, homo sapien
ccttcatttatttctgttcctatgcycccaattcagtttatttgatgaat

SEQ ID NO: 78279 - DNA, 50 bp, homo sapien
ctgcccctcaacgtcttcaatgcgargttccagcccctccttctagaagc

SEQ ID NO: 78280 - DNA, 50 bp, homo sapien
ctggatgatagaaatatgttgcatgrcataaaatgggcaaaagaaaaagg

SEQ ID NO: 78281 - DNA, 50 bp, homo sapien
agtctacacatgttcagtatagacarccatccaatttcatttctgaatat

SEQ ID NO: 78282 - DNA, 50 bp, homo sapien
caattctaggagtgcaaaaattgaayggtcagtagagactagtgcaagat

SEQ ID NO: 78283 - DNA, 50 bp, homo sapien
tagtcattaagttaatgtaggagtcratagtgatataaggccaggacatt

SEQ ID NO: 78284 - DNA, 50 bp, homo sapien
agaaagaaatcactacccattctaarcaactgaccttcaaatgaaatttc

SEQ ID NO: 78285 - DNA, 50 bp, homo sapien
gaatgtttctaattttcagccttacraacagtgctgtgataattatcctt

SEQ ID NO: 78286 - DNA, 50 bp, homo sapien
ccagtcccttatagttcaataagtcrccctacaaggagatgaggatggag

SEQ ID NO: 78287 - DNA, 50 bp, homo sapien
acaattgatcagcattgccagtgacrgtagataaagtagaaatcttagag

SEQ ID NO: 78288 - DNA, 50 bp, homo sapien
cagactctctccaaagttaaatcaargagaaatattgttttttccattat

SEQ ID NO: 78289 - DNA, 50 bp, homo sapien
cttaattctcagctccttgaaggccyaatatcctcttaaatgtccttctt

SEQ ID NO: 78290 - DNA, 50 bp, homo sapien
tcatctcaagcacccatttaccacawtatattcatacctgaatattctct

SEQ ID NO: 78291 - DNA, 50 bp, homo sapien
ccattcactcagaaccatcggatgckaaggcaaactgaggacgcgattca

SEQ ID NO: 78292 - DNA, 50 bp, homo sapien
ttctaccactacttcatttcaagcaygtatcattacttatgtggatcaat

SEQ ID NO: 78293 - DNA, 50 bp, homo sapien
aacaggagttgtggtggccactctakgactgcaaggtaccccacaggaca

SEQ ID NO: 78294 - DNA, 50 bp, homo sapien
gaacagtcagtatctacagaacctcrctgtgtttaactctgccctccagc

SEQ ID NO: 78295 - DNA, 50 bp, homo sapien
atgactgcaaggtaccccacaggacrcacgggagacacacttcagactga

SEQ ID NO: 78296 - DNA, 50 bp, homo sapien
tgggataattgttacatttatagaarcagccccaggattaaatgcttctt

SEQ ID NO: 78297 - DNA, 50 bp, homo sapien
tttcagtctttttctattgtgtatgwttttaactgtgggcttttcataca

SEQ ID NO: 78298 - DNA, 50 bp, homo sapien
gaagcaacatttagatcaactcttayacctaaacctcaagattagattca

SEQ ID NO: 78299 - DNA, 50 bp, homo sapien
atgctgtagtttgcaaatcattttawctattgagaacttgatactcaagc

SEQ ID NO: 78300 - DNA, 50 bp, homo sapien
tatttcttccctttactttcactggrcttattttgctatagtggaatgca

SEQ ID NO: 78301 - DNA, 50 bp, homo sapien
gccaccgtgcccggcggcctcttcaygctcttgatagtgccttaatgatg

SEQ ID NO: 78302 - DNA, 50 bp, homo sapien
ctaaccagaggttgcaggtgcataargctatttggttattactctcctag

SEQ ID NO: 78303 - DNA, 50 bp, homo sapien
accttacctacatttcaaccttagamccaaattctcagagattaatttgt

SEQ ID NO: 78304 - DNA, 50 bp, homo sapien
aaaaaaaaagtgtcacctagttccasaaaatagaggcaatggactcagac

SEQ ID NO: 78305 - DNA, 50 bp, homo sapien
ctcctccccaagcactctcctagtawggtaagagaataaactgaagtccc

SEQ ID NO: 78306 - DNA, 50 bp, homo sapien
ccgtagttgtgcggtaacaataaacyaaccagccgatttgtgtggaaagc

SEQ ID NO: 78307 - DNA, 50 bp, homo sapien
gattgtaatgaataaaacccattgartaaaataggaatccatgagtccat

SEQ ID NO: 78308 - DNA, 50 bp, homo sapien
aggaaagccagagctatcaccttgasgttcctgaatctgccctcctctcc

SEQ ID NO: 78309 - DNA, 50 bp, homo sapien
atgcgagtttctgagacaatgaacasaatccatgtccttatttaatgtgc

SEQ ID NO: 78310 - DNA, 50 bp, homo sapien
ctccagcctgaatcgaccaccactaygatggctgcctaatgttgattttt

SEQ ID NO: 78311 - DNA, 50 bp, homo sapien
aagtttacaggtctttaattttatargataactctcaactggggacaact

SEQ ID NO: 78312 - DNA, 50 bp, homo sapien
atagcattatgtgtagtaaatattayagaagcatactcttttcaatcata

SEQ ID NO: 78313 - DNA, 50 bp, homo sapien
tctgataactgggtaagagatatgarcatactagctttctgcccactaga

SEQ ID NO: 78314 - DNA, 50 bp, homo sapien
aagactgatgtttgctatgctaagcrgaagtttgaaataagcatcagctt

SEQ ID NO: 78315 - DNA, 50 bp, homo sapien
ttcagaaccatcagcaaataatcccrgaaggtctctatttctttccccag

SEQ ID NO: 78316 - DNA, 50 bp, homo sapien
ctcagcagacaggtaatttgcccgaractaaacagccaagaggtaaatag

SEQ ID NO: 78317 - DNA, 50 bp, homo sapien
ttacaagtatcatcaggacagtcgartaagtcttccagtaatactgttac

SEQ ID NO: 78318 - DNA, 50 bp, homo sapien
tacagaagtggcactaaaaagctcayctgttctctagtgctttgccaggg

SEQ ID NO: 78319 - DNA, 50 bp, homo sapien
tacaaccaccaagatgctagttaaaygaaaagtaaaagactgacaaatac

SEQ ID NO: 78320 - DNA, 50 bp, homo sapien
aaacacgtagctacagattgttaaamtacaaagggacattggagatctca

SEQ ID NO: 78321 - DNA, 50 bp, homo sapien
tgtcacctttgcagttctgttaagaygtgagttgtgaggggcagaggaaa

SEQ ID NO: 78322 - DNA, 50 bp, homo sapien
tcttatgtgccatggtactgcaaaaygtccttattaagggcagctggatg

SEQ ID NO: 78323 - DNA, 50 bp, homo sapien
ctgcttcccccatgtttcagagtccyagaatggaggcttatttgacctaa

SEQ ID NO: 78324 - DNA, 50 bp, homo sapien
agctaatggtgagagggtcattttckcattttatttttgttaagtctgag

SEQ ID NO: 78325 - DNA, 50 bp, homo sapien
cagacgggaatgcctggaagtgtccrcaatagctgtgctgaaatcagatg

SEQ ID NO: 78326 - DNA, 50 bp, homo sapien
ttttggggttataaaagtaattgacractctgggtgattaagacagaggc

SEQ ID NO: 78327 - DNA, 50 bp, homo sapien
ggaaatatgtataagaatggaattcragaagttggacttgggtggggtgg

SEQ ID NO: 78328 - DNA, 50 bp, homo sapien
atgtgtttccaacctgatgaatcacwacaaaggtttaactctgtgagata

SEQ ID NO: 78329 - DNA, 50 bp, homo sapien
cagcaacctccacaccattgtgaccrgaaagagacccaaggcttccttct

SEQ ID NO: 78330 - DNA, 50 bp, homo sapien
gcataatatggctttaaagtcagtargacatggtatatcagcaaatcacc

SEQ ID NO: 78331 - DNA, 50 bp, homo sapien
tgaagtaagtttagttaccaatgatsagcgctcagagagccagttttttt

SEQ ID NO: 78332 - DNA, 50 bp, homo sapien
gtccagaggtgaagaagtggatgtaygagaaactgtacgtgtaaaggccc

SEQ ID NO: 78333 - DNA, 50 bp, homo sapien
aatgactgccaatagttacttattamcctggaatggcatccttctgattg

SEQ ID NO: 78334 - DNA, 50 bp, homo sapien
tatatggctttctgaacagacacaargaactatactgagtccaaatgctg

SEQ ID NO: 78335 - DNA, 50 bp, homo sapien
ctctagagggacagaagtagttggaygaatgtatatatgaaggggagttt

SEQ ID NO: 78336 - DNA, 50 bp, homo sapien
tgcagggcatttgcaaccagaagccratggtccagaccatagatcctaga

SEQ ID NO: 78337 - DNA, 50 bp, homo sapien
agccacctataactagacagatatgratcagaataatttatacaatcatt

SEQ ID NO: 78338 - DNA, 50 bp, homo sapien
taaatttcacctcagctaagatagcycctccacctcctagaaggataata

SEQ ID NO: 78339 - DNA, 50 bp, homo sapien
cacgtgtacttgtgtattgaggcaayagatatatacagtttcagagtatc

SEQ ID NO: 78340 - DNA, 50 bp, homo sapien
ggacttgaacacagggggacctggayagagaggcccattgttcccaaatg

SEQ ID NO: 78341 - DNA, 50 bp, homo sapien
ctaatggtctttacatacagcctacmttttaactaactcttgcatgggct

SEQ ID NO: 78342 - DNA, 50 bp, homo sapien
tgccttcctctttttccaagaatgaygatgacctaagtttaactataacc

SEQ ID NO: 78343 - DNA, 50 bp, homo sapien
tgtaaaagttggagacatgtagaaakgaaagttgagggcaggttctagag

SEQ ID NO: 78344 - DNA, 50 bp, homo sapien
aaaccaaaatagaaaagagcatgaaraggtctgaaaaccagaacgagtga

SEQ ID NO: 78345 - DNA, 50 bp, homo sapien
cctgagtgagtgactggctccagatsaatttactgaatcatgtggctgcc

SEQ ID NO: 78346 - DNA, 50 bp, homo sapien
catgaaaaggtctgaaaaccagaackagtgacaacaagaacagacagcat

SEQ ID NO: 78347 - DNA, 50 bp, homo sapien
ctttaagagagtgaatcttaagatakgtgaattatagctcaacttaaaaa

SEQ ID NO: 78348 - DNA, 50 bp, homo sapien
tgggttgggtttacctgtctggcagyatatggtgtggctgtgacctgggt

SEQ ID NO: 78349 - DNA, 50 bp, homo sapien
tcccagggctacatcccaggttaaasatgaataggaagtaaaggagctct

SEQ ID NO: 78350 - DNA, 50 bp, homo sapien
tttaggattgagtgtgataaagagtyaagtgcctggtgcatattgagagc

SEQ ID NO: 78351 - DNA, 50 bp, homo sapien
ctgtgagaaagatgttgtcaccaccrtttcaagagggaggcactgacact

SEQ ID NO: 78352 - DNA, 50 bp, homo sapien
tattcaggtaagcattttgacagagytaatcacagggtgtcacagaagca

SEQ ID NO: 78353 - DNA, 50 bp, homo sapien
ttttgtgttttcatttcagatgtcartactttgtgtgctcttgaaatagg

SEQ ID NO: 78354 - DNA, 50 bp, homo sapien
gggcctcagtttccccattggtatckaaccctaagcattcttaagcttca

SEQ ID NO: 78355 - DNA, 50 bp, homo sapien
tagtcaggggcagaactgtattaaayccatgtctccttcattccagtttc

SEQ ID NO: 78356 - DNA, 50 bp, homo sapien
tgggcatcgaacaatgatgaaaagamaagatctggccagatgctgatggg

SEQ ID NO: 78357 - DNA, 50 bp, homo sapien
tgctacatagtaataggaaagactcrcctatcgctcctatttatcctgag

SEQ ID NO: 78358 - DNA, 50 bp, homo sapien
ccatgaaagtaggtccatcccatgasggggcatctgagaagacaggtggg

SEQ ID NO: 78359 - DNA, 50 bp, homo sapien
ttctctgagagtttcccaaattattygtcattggcagagcgcctccatgg

SEQ ID NO: 78360 - DNA, 50 bp, homo sapien
gccaggcagttacacatatgctttcraatccttacaacaaccccgcctat

SEQ ID NO: 78361 - DNA, 50 bp, homo sapien
ttagagagctcctgatggtcctcgcmacttctgagtcactccttctccca

SEQ ID NO: 78362 - DNA, 50 bp, homo sapien
gtagtacatactcagcagatattgaytacatgaatgaatatggtttatct

SEQ ID NO: 78363 - DNA, 50 bp, homo sapien
ggtcactttatttaccatcaaaatayaaagaagtctacttgcatcaccct

SEQ ID NO: 78364 - DNA, 50 bp, homo sapien
attttaaaatcaactttttgtcaaayatatgcattctctacaataaagtc

SEQ ID NO: 78365 - DNA, 50 bp, homo sapien
acagaaactgccattgaaaagataarccatattcattcatgtaatcaata

SEQ ID NO: 78366 - DNA, 50 bp, homo sapien
gtctggcatggttcaatggttgcacyaccttcaacaacctgtctagaagg

SEQ ID NO: 78367 - DNA, 50 bp, homo sapien
gatttccaataggtgcataaaaagarcattcataataaggctagcaataa

SEQ ID NO: 78368 - DNA, 50 bp, homo sapien
ggtagtctatagtcattcttcaggaycttgccaatttcttcaggggctag

SEQ ID NO: 78369 - DNA, 50 bp, homo sapien
cctttaggcatcagggaaccatctayatgtgcaagagtgaagaggccaga

SEQ ID NO: 78370 - DNA, 50 bp, homo sapien
tgcctctagaatcaatatttctaacyacaagatttttttctggtcacaat

SEQ ID NO: 78371 - DNA, 50 bp, homo sapien
cctctttgctgttgagatcattgaayagaaacgtacgtacaaagagctca

SEQ ID NO: 78372 - DNA, 50 bp, homo sapien
agacttcatttctttgcaaaaaaacyacaaagcacctcctgatccacctg

SEQ ID NO: 78373 - DNA, 50 bp, homo sapien
atcaaaaccccaaagtgtaaggaccratgacacagagttgaagcctgaca

SEQ ID NO: 78374 - DNA, 50 bp, homo sapien
gaaggtttaatgttgatacttttatktaattctctgtttttaaatattgt

SEQ ID NO: 78375 - DNA, 50 bp, homo sapien
agtggataagacaacagggtgagackgactttatcttgtgtctcacttaa

SEQ ID NO: 78376 - DNA, 50 bp, homo sapien
ttacacttgctgttgataaactcgayaactgctccttgtttaggtctcac

SEQ ID NO: 78377 - DNA, 50 bp, homo sapien
taccaaatgtatttgaaccacatacrctattcagtttacaattacattct

SEQ ID NO: 78378 - DNA, 50 bp, homo sapien
ggggaaaccatgatcatgacatttarcatgcaagaagtaggggacagccc

SEQ ID NO: 78379 - DNA, 50 bp, homo sapien
cagagagcttacagcttaaagttctraactggaagatcccaaacggaggc

SEQ ID NO: 78380 - DNA, 50 bp, homo sapien
tgcttctgttgcgtatctgaagtaamtggtggaaacttctctcccttgac

SEQ ID NO: 78381 - DNA, 50 bp, homo sapien
tagagtaagccctaaacaagtgcaarcaatctaataaccacctcattggt

SEQ ID NO: 78382 - DNA, 50 bp, homo sapien
aaggatgaaaccagatagccttccckcttataacattggaaatcacactg

SEQ ID NO: 78383 - DNA, 50 bp, homo sapien
cttcagacacttacacaattgtcctsaccaatctggagaaggggaaaaaa

SEQ ID NO: 78384 - DNA, 50 bp, homo sapien
cgtgactaagttcttttgaagaaaawttataccagatagagttaaacagg

SEQ ID NO: 78385 - DNA, 50 bp, homo sapien
gctataaatctatattttaatttaarcttggatctgtcttatctgagctc

SEQ ID NO: 78386 - DNA, 50 bp, homo sapien
cccagtttgtatagataataggagcygaaattccataggcaacaattaaa

SEQ ID NO: 78387 - DNA, 50 bp, homo sapien
agagggggattgatgaggcaataackgctaatagaataaacagccaaagg

SEQ ID NO: 78388 - DNA, 50 bp, homo sapien
ccctgcaaccggtttcactgccttcrttgctatccgactcagctctgttc

SEQ ID NO: 78389 - DNA, 50 bp, homo sapien
tctttggggcaatgtagggtacagamactcagtggtattgaggaggagga

SEQ ID NO: 78390 - DNA, 50 bp, homo sapien
aattctactcctacttaggcacccargagaaaatcttgcacatatgcact

SEQ ID NO: 78391 - DNA, 50 bp, homo sapien
tttatgatgctaattctttgacttamaggctgaacatgtggaaattggta

SEQ ID NO: 78392 - DNA, 50 bp, homo sapien
aatcaataaccagggaaatgcacatyacaaagacataccattttatacac

SEQ ID NO: 78393 - DNA, 50 bp, homo sapien
atagccctaaacaattagaaaagaasaacagctgaaaatcaacgatctaa

SEQ ID NO: 78394 - DNA, 50 bp, homo sapien
gcaggagaggccagcagcaaggatargaaaaaggagtattagaaagagca

SEQ ID NO: 78395 - DNA, 50 bp, homo sapien
cttactttctgttttgattcttgtakctaataggcagagtttgtgatgtc

SEQ ID NO: 78396 - DNA, 50 bp, homo sapien
cagaccacacagctcctaaataagargctaagccagcattcagacctgtc

SEQ ID NO: 78397 - DNA, 50 bp, homo sapien
aataagcaaaagtggaattacattasgcaaatgaaaacagcaaatgctaa

SEQ ID NO: 78398 - DNA, 50 bp, homo sapien
ctggaaagtgatcttttctgcttaasgttggaacttcctcttgcagttca

SEQ ID NO: 78399 - DNA, 50 bp, homo sapien
aatcccagcacaagcctataaaggargactatgatttttttaatttacag

SEQ ID NO: 78400 - DNA, 50 bp, homo sapien
ttgcggaggagccgtcattacaacartcgtgttctgagactaggagcaac

SEQ ID NO: 78401 - DNA, 50 bp, homo sapien
atatgaaggcatcgaaatgttcacarattaaaccttaaaagcagtttgtc

SEQ ID NO: 78402 - DNA, 50 bp, homo sapien
ttgcctgtcgctgggctttggagtasaaacgatcccatcatccaggtagt

SEQ ID NO: 78403 - DNA, 50 bp, homo sapien
aactgagatcctgatgatccttcccwaaccggctccttctccagtccttc

SEQ ID NO: 78404 - DNA, 50 bp, homo sapien
aagaacgatgctgaggactttccacrcattatttcatatacctcattttg

SEQ ID NO: 78405 - DNA, 50 bp, homo sapien
agcacatgaagccaaagtgacctaaygtgaattttcagaattagcatttg

SEQ ID NO: 78406 - DNA, 50 bp, homo sapien
tcaatgctgctagtttactgtgttcraagaaaccgagaggtaatccacct

SEQ ID NO: 78407 - DNA, 50 bp, homo sapien
aattttgaattgaaggtagaggttcyaatatggtcccacaaggaacattt

SEQ ID NO: 78408 - DNA, 50 bp, homo sapien
taaaaaagacttttaaatgtactgcygatttaagaaaatgagagggtcac

SEQ ID NO: 78409 - DNA, 50 bp, homo sapien
tctgagggacagcaagagagaccaamactcactgaacacttactatgagc

SEQ ID NO: 78410 - DNA, 50 bp, homo sapien
accctaggccttgagtgtgggttgasagccccaagtgtttctagatgctc

SEQ ID NO: 78411 - DNA, 50 bp, homo sapien
gaattccagatgaaaaggatagaaasaatggagtggaaacaatatttgaa

SEQ ID NO: 78412 - DNA, 50 bp, homo sapien
acaaagagagacttgcttttcagtayatgaaatttttgaattgtacacca

SEQ ID NO: 78413 - DNA, 50 bp, homo sapien
actcactcttcgtataggagagccaytatgtaggtgagggccaccagcac

SEQ ID NO: 78414 - DNA, 50 bp, homo sapien
ttaaaagttacatttggctctaataygtaattgagaacatttcaaattaa

SEQ ID NO: 78415 - DNA, 50 bp, homo sapien
gctcctttcaatactgttagctactyactctttgaagctctattcccctg

SEQ ID NO: 78416 - DNA, 50 bp, homo sapien
gtgatgcagtactaatgccttcatasatatcaaacacaaatctcagaaag

SEQ ID NO: 78417 - DNA, 50 bp, homo sapien
gaagtgctgaagaggtggcctacaargaatagccatagaatgaactcatt

SEQ ID NO: 78418 - DNA, 50 bp, homo sapien
atgggctggaaactgcacacttgttwccctaacactactctgttctgctg

SEQ ID NO: 78419 - DNA, 50 bp, homo sapien
gcgagtctggttaacacttaattgcycttcagaactcagctttaagcaaa

SEQ ID NO: 78420 - DNA, 50 bp, homo sapien
tcggcccactgaacggaagatgaaaygcctagagctcctccaaaaccaac

SEQ ID NO: 78421 - DNA, 50 bp, homo sapien
caaatatctgggtaccatgcctatcsaatttgacacatacaattaaccat

SEQ ID NO: 78422 - DNA, 50 bp, homo sapien
ttctagtgagctgtgctaacccctayagtcttatggtctggatcctattg

SEQ ID NO: 78423 - DNA, 50 bp, homo sapien
agaaaaggctttataagtttataggracggagcaaatagaaaaggtaaga

SEQ ID NO: 78424 - DNA, 50 bp, homo sapien
attaaacatgaaaactgtaatagtaraacatagatttctgttataaaagc

SEQ ID NO: 78425 - DNA, 50 bp, homo sapien
tactttgaataaggttcagccatcargaggcaacagcaagggggacaggt

SEQ ID NO: 78426 - DNA, 50 bp, homo sapien
gtggaccactaagctacctgccaaaytgagttgcagaaaccccaaaggag

SEQ ID NO: 78427 - DNA, 50 bp, homo sapien
caaaaatatttgccttgtatatgccrttttataaccttttttgatgcatg

SEQ ID NO: 78428 - DNA, 50 bp, homo sapien
gaaggaaggagggagggagtcctcamcttacaaatgagaaaatgatggga

SEQ ID NO: 78429 - DNA, 50 bp, homo sapien
tgtagtctctatctcactgccagtgkatctctccaacgtcctgaactgcc

SEQ ID NO: 78430 - DNA, 50 bp, homo sapien
tcaccactactgtatacatagctgamaatgctaagaacttttttgaaatg

SEQ ID NO: 78431 - DNA, 50 bp, homo sapien
tagattgtgttctagtttatagaagractttccatctatttcagctcaca

SEQ ID NO: 78432 - DNA, 50 bp, homo sapien
tgttctgttgacttggaaactcttcsctttggagcagcagcagatcagcc

SEQ ID NO: 78433 - DNA, 50 bp, homo sapien
tccagctcattagagcagttagagaygcactgagcacgtaataacagatc

SEQ ID NO: 78434 - DNA, 50 bp, homo sapien
gtcctggagactgtttcaaatcccayagtgagagaagatgaaacctcttg

SEQ ID NO: 78435 - DNA, 50 bp, homo sapien
gcacacccataactacacacaatgtracagtgcaacaagaatttcaacag

SEQ ID NO: 78436 - DNA, 50 bp, homo sapien
tacatattattactctttaattgcayactgatgttactatgatcaaaaat

SEQ ID NO: 78437 - DNA, 50 bp, homo sapien
aaacctttgtctatttacacataatragagctcagacaatattagtgggt

SEQ ID NO: 78438 - DNA, 50 bp, homo sapien
tggcagtcaccctcagagcccagaayagcagaatataacagaaaacagga

SEQ ID NO: 78439 - DNA, 50 bp, homo sapien
aaccaacctccctctttggccatcaytgatgagtgttttcattcctacaa

SEQ ID NO: 78440 - DNA, 50 bp, homo sapien
tactcaggctaaaagtcagtaaaaayacataactcactttgtgccattac

SEQ ID NO: 78441 - DNA, 50 bp, homo sapien
ggtgtccatgaagtctgaaaacttargtgaatgtacaaaatagcaataag

SEQ ID NO: 78442 - DNA, 50 bp, homo sapien
gtcatgcagttgtctttgtgaaacarggttgtgttggcaattaaaaatgt

SEQ ID NO: 78443 - DNA, 50 bp, homo sapien
gcatctccggaggaaaactgaagcgyatcagaaactttgcaaaagatgtt

SEQ ID NO: 78444 - DNA, 50 bp, homo sapien
taaacaatgagtagaaacttaaaaayctgaaattctgttcagttattcat

SEQ ID NO: 78445 - DNA, 50 bp, homo sapien
taaaaggcaacatcagtattagtgcygagacttaatttttttaccctgta

SEQ ID NO: 78446 - DNA, 50 bp, homo sapien
tgcaaaaagtcctcaacaaaatactygaaaattgcatttgacaacacaat

SEQ ID NO: 78447 - DNA, 50 bp, homo sapien
cctgggctgcaattgcaccacaataycaattctccctctccttagttcag

SEQ ID NO: 78448 - DNA, 50 bp, homo sapien
gtttaaaatcagtttacagtggagakcattacttttcaatttctggatgc

SEQ ID NO: 78449 - DNA, 50 bp, homo sapien
tgtgtgccatcagaaaacttaaacayctccaatgctttgtgcccacagtt

SEQ ID NO: 78450 - DNA, 50 bp, homo sapien
ctgacctgagcatccacttggagaaygtttttttgtgtgtggtctagggt

SEQ ID NO: 78451 - DNA, 50 bp, homo sapien
agtgcccggccggaatatttttagarctatgttggaactagatactttta

SEQ ID NO: 78452 - DNA, 50 bp, homo sapien
ttagatctgcttggagactataatawctagtaacataaagaagttctctt

SEQ ID NO: 78453 - DNA, 50 bp, homo sapien
caaaagctccttccttcaggttcacrgaaataccttgactacatgcagca

SEQ ID NO: 78454 - DNA, 50 bp, homo sapien
ttacttacaaatctatgagaaatcayggaaaaaagataaaaatgccagaa

SEQ ID NO: 78455 - DNA, 50 bp, homo sapien
aaagtgcagttcatgatgtcaaaagwaacttgccaactggttccagtcca

SEQ ID NO: 78456 - DNA, 50 bp, homo sapien
gtcttaattcctgctgccaagctacrgaacaacccagggaaaaataacca

SEQ ID NO: 78457 - DNA, 50 bp, homo sapien
acgtcacctgtgaactctgagaagaygaggttgggatctctggccacagt

SEQ ID NO: 78458 - DNA, 50 bp, homo sapien
ccataaagctctgagtgacgctaggraagatacttgcaaacattggtttg

SEQ ID NO: 78459 - DNA, 50 bp, homo sapien
gagtacatgattaaatgaggtaatayatggttagtgccagagcagtgctg

SEQ ID NO: 78460 - DNA, 50 bp, homo sapien
cttcccttctgatgaaaatgttttaygtatgccgttcagtacctcaaaac

SEQ ID NO: 78461 - DNA, 50 bp, homo sapien
tgggttgtttactgcaggtagaatayagaggtgaaaagaaatagaaatgg

SEQ ID NO: 78462 - DNA, 50 bp, homo sapien
tagtatatactcaacagttattggawgaatgaaatgaaatgaagtttgta

SEQ ID NO: 78463 - DNA, 50 bp, homo sapien
gaaagacactgttcttttctcccgartgatgggatctgtccagtatttag

SEQ ID NO: 78464 - DNA, 50 bp, homo sapien
gatggctgaactatgatttcaagacygaacaggagtttgtagtcatccca

SEQ ID NO: 78465 - DNA, 50 bp, homo sapien
acagagtagaaatttcaggaaagtaygtttggaacttaataggaggggat

SEQ ID NO: 78466 - DNA, 50 bp, homo sapien
gtccccactttgtgatccaagctgtmgtccacagatctacctgtgtgaca

SEQ ID NO: 78467 - DNA, 50 bp, homo sapien
catggtctgtggattcttcttctacratatcctttggctctttcccttct

SEQ ID NO: 78468 - DNA, 50 bp, homo sapien
agaaatactctatgagcgttaacagkacaaaagtaggagacatttctcat

SEQ ID NO: 78469 - DNA, 50 bp, homo sapien
cagccaagccaatgacaggcatccarataatgagcacccttagcatgtga

SEQ ID NO: 78470 - DNA, 50 bp, homo sapien
tcctagtactcagagcccttttaccractcttctctgaccctcaactctc

SEQ ID NO: 78471 - DNA, 50 bp, homo sapien
ttttaggatgacatgcccattatgarcaaggcactggctggggcttcgcc

SEQ ID NO: 78472 - DNA, 50 bp, homo sapien
caactggagaagatagttgccacaartatgatcaagggttaatgttattc

SEQ ID NO: 78473 - DNA, 50 bp, homo sapien
atcaggaggctctagcaaaattgacrgataagcaggacagagtgcatggt

SEQ ID NO: 78474 - DNA, 50 bp, homo sapien
ctacagactggacgctgttaaaaatyacccaattgtgaaaaacaacaatt

SEQ ID NO: 78475 - DNA, 50 bp, homo sapien
gtctctaggaggtttagttattgtcygaatgagatagtttccagacttct

SEQ ID NO: 78476 - DNA, 50 bp, homo sapien
aagactgaaatgacccagtgaatacyataaaaggccaagggagctaacaa

SEQ ID NO: 78477 - DNA, 50 bp, homo sapien
ggtttggaagttatagttagcagcaytaaggaatagaatattgatttcat

SEQ ID NO: 78478 - DNA, 50 bp, homo sapien
tacacaccaacttgctttcctaaaawccctgaggccctgcaatctggcta

SEQ ID NO: 78479 - DNA, 50 bp, homo sapien
caagtctgtggcgatggggtaaaccrctggacacgctggctgctccccac

SEQ ID NO: 78480 - DNA, 50 bp, homo sapien
tagaaattgttttacagttaaatcaygtggtagttcctataaaaagggaa

SEQ ID NO: 78481 - DNA, 50 bp, homo sapien
aattgctagggaaagactggcaccaragttccaccagcccaggcaatggg

SEQ ID NO: 78482 - DNA, 50 bp, homo sapien
ttggaccactgcagtcagctccctaygaacagttgctctctacccatcca

SEQ ID NO: 78483 - DNA, 50 bp, homo sapien
agtcgtatacatgacatgacttggarataatagcacaaacaaataacaaa

SEQ ID NO: 78484 - DNA, 50 bp, homo sapien
caggaaattacaaagattttagggayggtatgccaagaaccgaagatgaa

SEQ ID NO: 78485 - DNA, 50 bp, homo sapien
ggcagcaattaactgaaatttcctamaatgatctgctcatgtatagagcc

SEQ ID NO: 78486 - DNA, 50 bp, homo sapien
atcacctgctcagccaatcgaggaasaagtgagaaacctctctcctgctc

SEQ ID NO: 78487 - DNA, 50 bp, homo sapien
ctacaaaaccaagataaaatttgctmaatagagttaatggcctgaattta

SEQ ID NO: 78488 - DNA, 50 bp, homo sapien
tcgttgacctccattttgcactttasataaacccagttttgatgctggtg

SEQ ID NO: 78489 - DNA, 50 bp, homo sapien
gagcttcagtaagcactctctatacmgattcatactccttctacaaacac

SEQ ID NO: 78490 - DNA, 50 bp, homo sapien
tgccacccaccatgatgcaactcagkatcttttggggaagaggttgggac

SEQ ID NO: 78491 - DNA, 50 bp, homo sapien
ttcatacaaggtcatgttaaggataygttttctctttaatgcacatgctt

SEQ ID NO: 78492 - DNA, 50 bp, homo sapien
agaacaggaatgagaacatgacttayggggaagcctggcagatcagcttg

SEQ ID NO: 78493 - DNA, 50 bp, homo sapien
tctgaggggacattaccaaaaaccartacgatctacttaaaagagaagaa

SEQ ID NO: 78494 - DNA, 50 bp, homo sapien
agaaataatgtgggctgctttcacaytcctcttaagtaaaaatcccctgc

SEQ ID NO: 78495 - DNA, 50 bp, homo sapien
aaacaccattatgcttgagtaactayattccggggtctatatttcagaag

SEQ ID NO: 78496 - DNA, 50 bp, homo sapien
caaaatttttgcaactactgccttakactgagttgctttaagacattgta

SEQ ID NO: 78497 - DNA, 50 bp, homo sapien
agaattgaacagtctgtattaaaaawctgtaactgatacctaaatccaaa

SEQ ID NO: 78498 - DNA, 50 bp, homo sapien
tattattctcagtgccatttaatgastacagcaattatgggggactacac

SEQ ID NO: 78499 - DNA, 50 bp, homo sapien
tgatgttaaagagtgaatcctgggamgatccaaggcacagacattccaga

SEQ ID NO: 78500 - DNA, 50 bp, homo sapien
gcacaccctccacaattaccagtcaycactcagtcctcactcctgccgat

SEQ ID NO: 78501 - DNA, 50 bp, homo sapien
tgagtctgtaccaataatgtatatayaaaagaatcggcaggagtgaggac

SEQ ID NO: 78502 - DNA, 50 bp, homo sapien
ttattaggcttcacatctactgtaascatcaagcatctgctaattttttt

SEQ ID NO: 78503 - DNA, 50 bp, homo sapien
ctgccaactagtgactcaaaagccaytattaacgttcttcccccttggtt

SEQ ID NO: 78504 - DNA, 50 bp, homo sapien
cacttacaaaataaaagttctgtaargatatgcaccagccgatttactat

SEQ ID NO: 78505 - DNA, 50 bp, homo sapien
ttccttgagtccccagtgttcgttaygtcattcttacgcctttgcatcct

SEQ ID NO: 78506 - DNA, 50 bp, homo sapien
cttacacacatccatgaaaagtatayaagcagctgatattttatctcata

SEQ ID NO: 78507 - DNA, 50 bp, homo sapien
catgggctatcatgtcaccaaattargaagaggcactaggaaaaatatat

SEQ ID NO: 78508 - DNA, 50 bp, homo sapien
cctgcagtctagaatgtacttccagrcggaaaaccagggcagtcttagag

SEQ ID NO: 78509 - DNA, 50 bp, homo sapien
acttaactgaacaggtctatttccargacgttttactcatcatcagacct

SEQ ID NO: 78510 - DNA, 50 bp, homo sapien
cagtaacaaaatttgtgaaagcacaycctaatcatgttatttcttcaatc

SEQ ID NO: 78511 - DNA, 50 bp, homo sapien
tgtgccaggctgcgcacagcatttayggattaactcacggaatcattagg

SEQ ID NO: 78512 - DNA, 50 bp, homo sapien
ttggaaagtttcacttagggagatartaaaagtttaattgaggtagtagg

SEQ ID NO: 78513 - DNA, 50 bp, homo sapien
attctccatcgagcaatgctattacyggttgagtatcccttatcttaaat

SEQ ID NO: 78514 - DNA, 50 bp, homo sapien
catgactacagtttcaaaaaggacakaacgttccagaattaaaggttatt

SEQ ID NO: 78515 - DNA, 50 bp, homo sapien
atcagggtgagagctacctgcaaaaytagttcacgtctatgtctatggta

SEQ ID NO: 78516 - DNA, 50 bp, homo sapien
tgggagctggaagccaagactcggaraatgtgctgtctcatctttagttc

SEQ ID NO: 78517 - DNA, 50 bp, homo sapien
tctcttaagatctgattaattattargacttgggaagagggtctctttct

SEQ ID NO: 78518 - DNA, 50 bp, homo sapien
ctctaatgatttatgaggttaaaagrctccctcctcagtaggggtgagct

SEQ ID NO: 78519 - DNA, 50 bp, homo sapien
tgtccttctagatctttccacaaggyaaattccgcttgaaggtccaatcc

SEQ ID NO: 78520 - DNA, 50 bp, homo sapien
cctaattttgcaaggaagagttgtaytaataaacaggttttaggaaaact

SEQ ID NO: 78521 - DNA, 50 bp, homo sapien
gggcagatgggaaggaaggagagtaygacacagagatgatgacgcaaaga

SEQ ID NO: 78522 - DNA, 50 bp, homo sapien
tgatgtacttatgtcatttttaccaytgaattactgtatttagtaataga

SEQ ID NO: 78523 - DNA, 50 bp, homo sapien
tgcagatagccttttctcttacaccmatttgaggtattcatacccatata

SEQ ID NO: 78524 - DNA, 50 bp, homo sapien
actttagccatagggaaactttgatyaaactaataatacataaggaagtt

SEQ ID NO: 78525 - DNA, 50 bp, homo sapien
ttcaaaagtttcaggaaactgcttgmattagggtgaatctgatctaattt

SEQ ID NO: 78526 - DNA, 50 bp, homo sapien
caccaagaaccatttaaccttggtcrcgtatattggataactgaagcaat

SEQ ID NO: 78527 - DNA, 50 bp, homo sapien
tagtgacagcaacaattttgggaacyatgatcatttgacaccccccagta

SEQ ID NO: 78528 - DNA, 50 bp, homo sapien
ccatagagcacagaggatatgctcamtctgaactgaggataagaaggcag

SEQ ID NO: 78529 - DNA, 50 bp, homo sapien
atcagaagagctcaccatctaggaasgaaatatgacatgaattcctccca

SEQ ID NO: 78530 - DNA, 50 bp, homo sapien
ggaaaatctaacctagctattccaaratgagtccaaatttatcacccaga

SEQ ID NO: 78531 - DNA, 50 bp, homo sapien
actgataggctctgagtttttagaaygcctttcaacaagattaaaagcat

SEQ ID NO: 78532 - DNA, 50 bp, homo sapien
tcatatggaagatctgtttacgtgarcattactgaaggtcattcttctat

SEQ ID NO: 78533 - DNA, 50 bp, homo sapien
cacatactcccagaagatttcattaygtaattcctcaaacttaacttcaa

SEQ ID NO: 78534 - DNA, 50 bp, homo sapien
ataactactacttgtctattggaccyagagcttcaaattatgtcttcaaa

SEQ ID NO: 78535 - DNA, 50 bp, homo sapien
aagtgcttatatagcctctcttctaygtggtgtcacacaggtgggatgtt

SEQ ID NO: 78536 - DNA, 50 bp, homo sapien
atgttgagctgatgctgatttcatcraatgaattagggaggagtctctcc

SEQ ID NO: 78537 - DNA, 50 bp, homo sapien
agaaggagaccatgcaaatcttgaaygagcgccttgctaactacctgcaa

SEQ ID NO: 78538 - DNA, 50 bp, homo sapien
cccagtccagactgaaagcctccaargaggaagttctaccggcttctcca

SEQ ID NO: 78539 - DNA, 50 bp, homo sapien
gtggtggtggggcctttaacactgaygaatggaagccgggcagttctgtg

SEQ ID NO: 78540 - DNA, 50 bp, homo sapien
tttaaatggaggaaacctgataggaytttagccttttacctgatactttg

SEQ ID NO: 78541 - DNA, 50 bp, homo sapien
ctgatatttcattataattagttcaycttccctgtgaaacaagagaattg

SEQ ID NO: 78542 - DNA, 50 bp, homo sapien
tccaaatttcaaaatcatttccatawctttccaaggtaaacatcacatca

SEQ ID NO: 78543 - DNA, 50 bp, homo sapien
gttgggagaggcagttgaccgataamaaattcagctcacagtgactgctt

SEQ ID NO: 78544 - DNA, 50 bp, homo sapien
aggcaaggggtaaggagtaaatcacyaagtgcaaaaaaatacagtccaat

SEQ ID NO: 78545 - DNA, 50 bp, homo sapien
ctcctggccatctcctgtggaagtcragcccacatagtgtgttcccacac

SEQ ID NO: 78546 - DNA, 50 bp, homo sapien
ctgaactgtttgtatgtatgaaacarccttttacaattccaaagcaggtc

SEQ ID NO: 78547 - DNA, 50 bp, homo sapien
tgcaataagaggtacgaattgtttcyatagagatggagaaataaaaggac

SEQ ID NO: 78548 - DNA, 50 bp, homo sapien
tttgaaccaaattcaactaaagaaaytagccatatagatatactttttgt

SEQ ID NO: 78549 - DNA, 50 bp, homo sapien
aatttctatgcttgacatcgtaccastatttgccagccaaaataaatgcc

SEQ ID NO: 78550 - DNA, 50 bp, homo sapien
acccatgcctctatcaagatatagaytactccatcattccagaagttttc

SEQ ID NO: 78551 - DNA, 50 bp, homo sapien
tttctaaagtgtttgtttcactttamctgctcatccgtgagccagagggc

SEQ ID NO: 78552 - DNA, 50 bp, homo sapien
tcacttcattcctgaggatttgtgcyaatcaattataaccctgtttgatc

SEQ ID NO: 78553 - DNA, 50 bp, homo sapien
atatattttagtaaatgctgcttaaraaactattcgatcttgacatttgc

SEQ ID NO: 78554 - DNA, 50 bp, homo sapien
ccaacacattgtcttaggatccaacrcttcattctatttccagggcaagc

SEQ ID NO: 78555 - DNA, 50 bp, homo sapien
ttgaagagaagtctgtaattaaggcrgagaaagatttgtctaggattgag

SEQ ID NO: 78556 - DNA, 50 bp, homo sapien
cactttattcaagtcttcagggataycagccaaaataattgtaaattgag

SEQ ID NO: 78557 - DNA, 50 bp, homo sapien
atttggctggggaatactttactctyagaaatggggagatcataagtggt

SEQ ID NO: 78558 - DNA, 50 bp, homo sapien
atgattacttagttttatgggaaaayactccagaggacacgctctttggt

SEQ ID NO: 78559 - DNA, 50 bp, homo sapien
aaactaagtaatcatcacaccagctragaaccataagttccttgacccag

SEQ ID NO: 78560 - DNA, 50 bp, homo sapien
tgagaattacaaagagcattaagtayagcgtgtagttctctacaattatt

SEQ ID NO: 78561 - DNA, 50 bp, homo sapien
ctgtgtagaacactttgtagaagaayactttgtatgtgttatctaaattg

SEQ ID NO: 78562 - DNA, 50 bp, homo sapien
ctctagataacattttcagccttcayaaagaatgatcaacatcttagatt

SEQ ID NO: 78563 - DNA, 50 bp, homo sapien
ggcctaagtgtatcaccgcggagtamagaaagctggaggatcacacaata

SEQ ID NO: 78564 - DNA, 50 bp, homo sapien
ttaattaattaagtgatttttcccayggtgaattgtgttaagaaaggaaa

SEQ ID NO: 78565 - DNA, 50 bp, homo sapien
taaaaaggaacagaaatagatcagascaatttacaaaataccttaaaaca

SEQ ID NO: 78566 - DNA, 50 bp, homo sapien
tattattattcatatcattctaacastccgcaaatatctacccaaatctc

SEQ ID NO: 78567 - DNA, 50 bp, homo sapien
tgctcataactcttcccaggatccaygatttctgcctagtctcctcagtc

SEQ ID NO: 78568 - DNA, 50 bp, homo sapien
actttgcatatgttagggaacttatsaatgttatgcaagagatgaaattg

SEQ ID NO: 78569 - DNA, 50 bp, homo sapien
ttgaatttctgggatataagattacwaccaaaaatgactgtagtctttct

SEQ ID NO: 78570 - DNA, 50 bp, homo sapien
ccccagatgatgtgtttgttggttamgcgtatgtatggcacaagtatatg

SEQ ID NO: 78571 - DNA, 50 bp, homo sapien
attggtaagcttcctgatttttttcrcctgaattctcaatttgttattga

SEQ ID NO: 78572 - DNA, 50 bp, homo sapien
acaaagaatctgcaagtagcactgaytataatacctttatacccaaagga

SEQ ID NO: 78573 - DNA, 50 bp, homo sapien
gaagaatttaagagacatttttgaamctaacacatataacatgaaagctg

SEQ ID NO: 78574 - DNA, 50 bp, homo sapien
aatctgtgtgtctgctatgctgcacygaagccaatgatttgactccagtt

SEQ ID NO: 78575 - DNA, 50 bp, homo sapien
gattggatctattggttgtagaccgmatagaaaaagaatgatatgtgaac

SEQ ID NO: 78576 - DNA, 50 bp, homo sapien
ttcatagacatggctctttgagaacraacagtatagaaacagttaagcat

SEQ ID NO: 78577 - DNA, 50 bp, homo sapien
cagaaacccagtttagaatatccaaytcctggtgaacttttaaaaattaa

SEQ ID NO: 78578 - DNA, 50 bp, homo sapien
gataactctcagtgttcccctctgayggtaatgcctcttaaggtacagat

SEQ ID NO: 78579 - DNA, 50 bp, homo sapien
ttccaaacactccatgagtacctgcracatacacgccctatctcttgtaa

SEQ ID NO: 78580 - DNA, 50 bp, homo sapien
ctgctactccctaggaggagttaaasgccctgtgatgaaaggaaggcaac

SEQ ID NO: 78581 - DNA, 50 bp, homo sapien
ttctgcatgcaaaggcaacctgaccmgagggaaaactgatagctggaccc

SEQ ID NO: 78582 - DNA, 50 bp, homo sapien
atcaacttgagtctgcataaagtctsacctgagcaatgttggcttgagat

SEQ ID NO: 78583 - DNA, 50 bp, homo sapien
attcctatgggcatcttatagtaatraatttggctggtctttgtccccag

SEQ ID NO: 78584 - DNA, 50 bp, homo sapien
gtcaccatggactcttcaaagcttaygtccttagtttctcttacaagctc

SEQ ID NO: 78585 - DNA, 50 bp, homo sapien
attggactggggttctgactatatgrgtactaatagcagtttcagtctct

SEQ ID NO: 78586 - DNA, 50 bp, homo sapien
ttaaaactggatttgattataagacmaagtacattttaaaaagttatttt

SEQ ID NO: 78587 - DNA, 50 bp, homo sapien
atcagaactttctggcaaagtcggaraggaggctttggtaaaacaagatt

SEQ ID NO: 78588 - DNA, 50 bp, homo sapien
ttattaagtgttaacttacacgatcrcaaggaaacatccagcatgggaga

SEQ ID NO: 78589 - DNA, 50 bp, homo sapien
cactggtatgtgtaatctttgcagamctatttgatttatattagctcttc

SEQ ID NO: 78590 - DNA, 50 bp, homo sapien
gtcactccaaccttgctggctataaygatatttagaaccccttggcttct

SEQ ID NO: 78591 - DNA, 50 bp, homo sapien
gaaggagacttttcatcatttgtgaytaatattttgtgcattgtatttta

SEQ ID NO: 78592 - DNA, 50 bp, homo sapien
aatcctatattttctgcattagttayctccaaacctacaatttaattaaa

SEQ ID NO: 78593 - DNA, 50 bp, homo sapien
aaattagaaaaaggaattaaagaacrcatgaaagacagtgagatttcaga

SEQ ID NO: 78594 - DNA, 50 bp, homo sapien
ggaagacctagatttcatgtcctgcyagttactaattgtgtggtcctgag

SEQ ID NO: 78595 - DNA, 50 bp, homo sapien
ggcggccctgggttttggggttaacyagatgatcctttaatatacaaaga

SEQ ID NO: 78596 - DNA, 50 bp, homo sapien
catattagagatgaatagtgaaataygtagggttgaaaagatgtgaggtc

SEQ ID NO: 78597 - DNA, 50 bp, homo sapien
aacttttagcatctaatttaaagaayattgtgcatagaaaataaccatat

SEQ ID NO: 78598 - DNA, 50 bp, homo sapien
tgattccttcctctggcgctgtctargggttatttcacaccttaaatcag

SEQ ID NO: 78599 - DNA, 50 bp, homo sapien
aggcaaatcctcactatttcagttasacccagcatcttgagttcctgttt

SEQ ID NO: 78600 - DNA, 50 bp, homo sapien
tcttattgtgatcaactaaactcaasaggagagtgctgtgatcaattagt

SEQ ID NO: 78601 - DNA, 50 bp, homo sapien
ccttttacctattctgttccctcatsataaccttaccccaaccatgaagt

SEQ ID NO: 78602 - DNA, 50 bp, homo sapien
tcccagaaccagcacacactatcacragagctgctctcctaccaatgtgc

SEQ ID NO: 78603 - DNA, 50 bp, homo sapien
aaaaatcttgaatttattcatcatcraacataaccaattctcacaatttt

SEQ ID NO: 78604 - DNA, 50 bp, homo sapien
ccaatgaaaatttgtagaggttccaygaaaggtcacatctctcacttcca

SEQ ID NO: 78605 - DNA, 50 bp, homo sapien
gttagctatgattgtcatcaacaaaygttcaaagagcaaatgtactttgt

SEQ ID NO: 78606 - DNA, 50 bp, homo sapien
aggaattatggagtagacagataaarttcctgaagacctgaacttaattt

SEQ ID NO: 78607 - DNA, 50 bp, homo sapien
atggatggaggatagaaatgctgacmctgtatatatgcaatgtggaatat

SEQ ID NO: 78608 - DNA, 50 bp, homo sapien
cacagtaagcggccctggcaaccgcyatctcaaggtgagtgattatgatt

SEQ ID NO: 78609 - DNA, 50 bp, homo sapien
cccagtcagctactgagaaatcaaamaagttccaacgcacaatctccagg

SEQ ID NO: 78610 - DNA, 50 bp, homo sapien
gaagaagcaaggaattcacaaagaawcatatcttttaaaccaaatttgat

SEQ ID NO: 78611 - DNA, 50 bp, homo sapien
cagtctcccaggaatctgaattatargtggagtgaaatatgaatggaagg

SEQ ID NO: 78612 - DNA, 50 bp, homo sapien
gacctcctgcccgcatgactgccagraagagatgaggctcctagacttgg

SEQ ID NO: 78613 - DNA, 50 bp, homo sapien
gagaagaacaagcaactttggctacwatgataaagatcaatgatcaggga

SEQ ID NO: 78614 - DNA, 50 bp, homo sapien
cacatcccagcatcaggtcagatcaytgaaattaaaaaatgtgaattaag

SEQ ID NO: 78615 - DNA, 50 bp, homo sapien
aaggtggtcaattacaaggttggaayaatggtccaggtgagaaggatgaa

SEQ ID NO: 78616 - DNA, 50 bp, homo sapien
ggttaagttaggggccagtcagtgtraaaacaagtctcccatctaaatcc

SEQ ID NO: 78617 - DNA, 50 bp, homo sapien
gccttctgagtcttctggggaggtcraatcttctctgacccagcaggaga

SEQ ID NO: 78618 - DNA, 50 bp, homo sapien
cgcacttacgaaaacttgtctgagayctacaattagctccactcaagtca

SEQ ID NO: 78619 - DNA, 50 bp, homo sapien
aagtctttacttcatttaaatcctaytaaagcacaatcttctcaaatatc

SEQ ID NO: 78620 - DNA, 50 bp, homo sapien
taaaaaatgaaatctattccttctcytcctctttattcagtcttttcccc

SEQ ID NO: 78621 - DNA, 50 bp, homo sapien
acaggtgagaatttccaaaacttacmgaagacatcaagccagttcaaaag

SEQ ID NO: 78622 - DNA, 50 bp, homo sapien
aaattaaaagttaaaaaataaaaaaktagcattgcacaacagatttcatt

SEQ ID NO: 78623 - DNA, 50 bp, homo sapien
tagttagcaatttgtacattcactaytactgaaggcaagaatattagata

SEQ ID NO: 78624 - DNA, 50 bp, homo sapien
ggggagatgctgtcattgattgcccrgaaagaaagtaacagaaagacaac

SEQ ID NO: 78625 - DNA, 50 bp, homo sapien
agtagatgcttggtaaatatcaaatyagtggatgaatgactacctctaga

SEQ ID NO: 78626 - DNA, 50 bp, homo sapien
cacatatttatattgcacacataaayattctaaagacagtatcaccaatg

SEQ ID NO: 78627 - DNA, 50 bp, homo sapien
gaagtcagggagccaggacctgtaaygaaggaataaaaggagcttctaga

SEQ ID NO: 78628 - DNA, 50 bp, homo sapien
cactgattgatacatctttcagtaartgaattcggcacatccacagtgtc

SEQ ID NO: 78629 - DNA, 50 bp, homo sapien
ctgggacaaaaggagtggaaattaawcccacaggctgtctgcagcaggat

SEQ ID NO: 78630 - DNA, 50 bp, homo sapien
tgactatttgaccagtgaatcagaamgtcttccaagtcttaggaaggagg

SEQ ID NO: 78631 - DNA, 50 bp, homo sapien
gtcaaatagtcaagctcaatttgatyaaaaattcattggggttttttttt

SEQ ID NO: 78632 - DNA, 50 bp, homo sapien
gaactgctttcagggatggggtttarcaagaaactgaggagcaattaaga

SEQ ID NO: 78633 - DNA, 50 bp, homo sapien
tcagcagccctacacaagactcctgmaaaattagcttccaaatagccaaa

SEQ ID NO: 78634 - DNA, 50 bp, homo sapien
gtgatagggctaaatgagatatgaartgtattaagaggttctggctcatt

SEQ ID NO: 78635 - DNA, 50 bp, homo sapien
actatcagtcttctccatactattaracatacagtccttagcattttggg

SEQ ID NO: 78636 - DNA, 50 bp, homo sapien
gacttaaagataactttggaaagaaytgagccagcccagtgaggaaaatt

SEQ ID NO: 78637 - DNA, 50 bp, homo sapien
tgaaggaatttgttactattagaacmggcttacaagagacccttaaggga

SEQ ID NO: 78638 - DNA, 50 bp, homo sapien
ctctggatgtatttggagctcatttktctgacggtttttgaatgctatct

SEQ ID NO: 78639 - DNA, 50 bp, homo sapien
ccatttccaggcaacagaagtttcayaagcacctacctcacaccgggcac

SEQ ID NO: 78640 - DNA, 50 bp, homo sapien
atgctatcttccaccttctcttagawtatccctaactgaatatacatcca

SEQ ID NO: 78641 - DNA, 50 bp, homo sapien
cacttttatttccaggattccctgamctatttgcacaggtagcttatggt

SEQ ID NO: 78642 - DNA, 50 bp, homo sapien
ccctcttgccaggttgcgctaatcartgaccccagtgtgctgtgttgata

SEQ ID NO: 78643 - DNA, 50 bp, homo sapien
taactcacccttctccttctcttgayagtcactgctgaaaactgatcata

SEQ ID NO: 78644 - DNA, 50 bp, homo sapien
tctgccacatagtatagttggaaaayctctgggcatactcattgctggtc

SEQ ID NO: 78645 - DNA, 50 bp, homo sapien
gtagctataagaaggtgtcagggtcycttggggtatcagaatatttgtca

SEQ ID NO: 78646 - DNA, 50 bp, homo sapien
aggggagagaaagagaaagcatacakagtagaacttcaaccctatctgta

SEQ ID NO: 78647 - DNA, 50 bp, homo sapien
ttatcctcttatagttattcataaargtttatagcttcactggtatagat

SEQ ID NO: 78648 - DNA, 50 bp, homo sapien
atgatatttcgggagaccacaatgcraagttttatcctcttatagttatt

SEQ ID NO: 78649 - DNA, 50 bp, homo sapien
accagtgcagaaaagaaacacttcawgtggacagcttgggtggagtaact

SEQ ID NO: 78650 - DNA, 50 bp, homo sapien
gagaggccctagaatgatgaagtgaygtgttaagttccatagataacaac

SEQ ID NO: 78651 - DNA, 50 bp, homo sapien
taaaatgaaatagaaaaagagaaccyaataaagtctaatatgaatccatt

SEQ ID NO: 78652 - DNA, 50 bp, homo sapien
actgctatggaaattagctttcttayctgaaaatctgaatttaagttgct

SEQ ID NO: 78653 - DNA, 50 bp, homo sapien
caaaattgtcaaaactacaagaatgwcaagaaggaaaggaagttttacaa

SEQ ID NO: 78654 - DNA, 50 bp, homo sapien
tgccttgggcaatcagaataatttasaatcagagagctggaataaacctt

SEQ ID NO: 78655 - DNA, 50 bp, homo sapien
atccagctgaggagaatttggagagktataaaatgaggtctgtgccctag

SEQ ID NO: 78656 - DNA, 50 bp, homo sapien
ttccaaggatttcttatatcactgartagtagcattatccatccagttat

SEQ ID NO: 78657 - DNA, 50 bp, homo sapien
aagggagatatcaggcatctataaargcacctcatgtattacatgccttt

SEQ ID NO: 78658 - DNA, 50 bp, homo sapien
aagacaaactataatagaattcaggwactcagttgaagtattaaagagga

SEQ ID NO: 78659 - DNA, 50 bp, homo sapien
ctagcctgtgtggccatatgcagtarcactgaatagatttaaagtaattt

SEQ ID NO: 78660 - DNA, 50 bp, homo sapien
cagtggatcggtacattcttcttaartggttctctatatgcctcatatca

SEQ ID NO: 78661 - DNA, 50 bp, homo sapien
ccggggccaaccttttctctcccagrcaccttagagcaatagtgcctatt

SEQ ID NO: 78662 - DNA, 50 bp, homo sapien
gatgcatatatgttgctatataaaamcaaatcaagttggattaaacactt

SEQ ID NO: 78663 - DNA, 50 bp, homo sapien
agttatgatgaaaatggagttacacyaagttgaagcaaaaccatttacca

SEQ ID NO: 78664 - DNA, 50 bp, homo sapien
aatgatgtccccactgtgtctctgayggttacacaccaccagtgtaacaa

SEQ ID NO: 78665 - DNA, 50 bp, homo sapien
cttgagtgactttgtttaaaaaaagraatctgctgaaggtttttaagtgg

SEQ ID NO: 78666 - DNA, 50 bp, homo sapien
ctgaattttcatctaatgataaatcrgacaggatcaaggttagagctgct

SEQ ID NO: 78667 - DNA, 50 bp, homo sapien
ccattctgagtcaggcttggtcacaratgaaagctgaggatggatgaggc

SEQ ID NO: 78668 - DNA, 50 bp, homo sapien
gatgcaccaacatacttcagagatayaacctcattcagtggtttgcttag

SEQ ID NO: 78669 - DNA, 50 bp, homo sapien
cagctttacaccagttgatctgtaargcacaaaagaacatacttagctag

SEQ ID NO: 78670 - DNA, 50 bp, homo sapien
tgtggttactggattgatacttctawtaacagcaaatgtccacttcattt

SEQ ID NO: 78671 - DNA, 50 bp, homo sapien
ggggcagagattgaacccgttcaggrtgaaaagagccatgaattaggctg

SEQ ID NO: 78672 - DNA, 50 bp, homo sapien
tttgtcagtattattgattccgtcaygtataaatgctaaagccacttgac

SEQ ID NO: 78673 - DNA, 50 bp, homo sapien
ctaaagacagagctgaataataggaygaaatgatcttctcatactctctc

SEQ ID NO: 78674 - DNA, 50 bp, homo sapien
ttgttatggtaagagatagttttcayggttatctcataatacatttcata

SEQ ID NO: 78675 - DNA, 50 bp, homo sapien
cttgtgagatgttgggaaatttcaartaatatagtttaaagttataaaaa

SEQ ID NO: 78676 - DNA, 50 bp, homo sapien
gaatttcagagaagtgaacttagttyggagctaccttgagtatgacacta

SEQ ID NO: 78677 - DNA, 50 bp, homo sapien
actgcctcctcattttctacatatarctctgatagtggcagtgatagtgg

SEQ ID NO: 78678 - DNA, 50 bp, homo sapien
agttctacatccactacaaagattayggctttaggaaggcaaaaacttca

SEQ ID NO: 78679 - DNA, 50 bp, homo sapien
tatcatgcaatatattcataaaggamgagtcttgatataagtaagaaaat

SEQ ID NO: 78680 - DNA, 50 bp, homo sapien
atgtgaaaaatcaagagtacaccacrggttgcactttaggtcaggctgtt

SEQ ID NO: 78681 - DNA, 50 bp, homo sapien
atagctgagtaacaatgtcctctcayggaatttttacacatttctgatgc

SEQ ID NO: 78682 - DNA, 50 bp, homo sapien
taataatgataccgaactatgcaaaytcttaacttttaaaatgcactcta

SEQ ID NO: 78683 - DNA, 50 bp, homo sapien
tatgggtgatattccagctttgaaakgtaaaagtgttatgggattttata

SEQ ID NO: 78684 - DNA, 50 bp, homo sapien
gctttaaaaaaatgattcatataaayttaggtgtataagtgcagttttgt

SEQ ID NO: 78685 - DNA, 50 bp, homo sapien
aatgctcgtatgggagtgtatctaayatctaagttgggatccctctttca

SEQ ID NO: 78686 - DNA, 50 bp, homo sapien
taaccccctattggcatcaagagtaratctgagactcatatctgaagtaa

SEQ ID NO: 78687 - DNA, 50 bp, homo sapien
taatgcgccacatctcagatgggccratttttccatgacatcaaagcaga

SEQ ID NO: 78688 - DNA, 50 bp, homo sapien
gaaagaggaagaaaaaagagttactwcacaatggggaaacctgaccaaca

SEQ ID NO: 78689 - DNA, 50 bp, homo sapien
ccaagggattaaaaagtaagtaagakagtatcccacatagggtaaccaac

SEQ ID NO: 78690 - DNA, 50 bp, homo sapien
atctgatgttggatatactcttacartcaccattagtattaactgaaaat

SEQ ID NO: 78691 - DNA, 50 bp, homo sapien
ttatgagtccccgactaaagcctaaragaatcaactccaaagaaacatag

SEQ ID NO: 78692 - DNA, 50 bp, homo sapien
cagagtgggtgcttgaacagctatcmaactgaactgctttcccaaataac

SEQ ID NO: 78693 - DNA, 50 bp, homo sapien
ggtgcaaagaggcctaagaaggtaasaggtaatcaatcagtcagccaaac

SEQ ID NO: 78694 - DNA, 50 bp, homo sapien
aaaaacatctctttcctcaggcatasaaatttgcaaggtacaaatgtctt

SEQ ID NO: 78695 - DNA, 50 bp, homo sapien
taaaaacactgtaacgtttctgcaaygcattaatagtaacgggaaaaaat

SEQ ID NO: 78696 - DNA, 50 bp, homo sapien
aggttctgagttccatccaaagtaaktaagtaccaatttgggttattcat

SEQ ID NO: 78697 - DNA, 50 bp, homo sapien
ggagaactgcttcagtgaaaggataycttgtagaagacagatggctcttt

SEQ ID NO: 78698 - DNA, 50 bp, homo sapien
catatagaaatataccatttttgtaygattgctcagattttactagctat

SEQ ID NO: 78699 - DNA, 50 bp, homo sapien
gtcaatggttccaaagtgagagggasatgaaattaagaaaaggtgagaac

SEQ ID NO: 78700 - DNA, 50 bp, homo sapien
tatgactagaacatatgataaatgarccattataaaaaagccaaaagaag

SEQ ID NO: 78701 - DNA, 50 bp, homo sapien
aagaaaaccttttcagagacatgatsaaaggattaccgtgttcagtataa

SEQ ID NO: 78702 - DNA, 50 bp, homo sapien
gcagatgagagatcttaggaagcagraaactaggagagagctaataatag

SEQ ID NO: 78703 - DNA, 50 bp, homo sapien
accatgaagagactccaaggctgaarctagtattactgtcacttccatgg

SEQ ID NO: 78704 - DNA, 50 bp, homo sapien
ctttaccttcaactgtcttacaggayggtaacaagataggcatatacaca

SEQ ID NO: 78705 - DNA, 50 bp, homo sapien
ttattattgccacgttacagttgagragattaagccacagaaagtttaac

SEQ ID NO: 78706 - DNA, 50 bp, homo sapien
agcatctatctatggctttttgaaawtaaactataatgaaataaagataa

SEQ ID NO: 78707 - DNA, 50 bp, homo sapien
gctcactgatcctttttgtttctaartgtcctaacagacttgcctactcc

SEQ ID NO: 78708 - DNA, 50 bp, homo sapien
cactgcctaatgatgatgaacccatkacaagacaatgaaacatgctcatt

SEQ ID NO: 78709 - DNA, 50 bp, homo sapien
cagttcaaatgggcttttccactacygctcaaaatagtaataaaaccacc

SEQ ID NO: 78710 - DNA, 50 bp, homo sapien
aatgccacactgcctctctggattaygccgatattgagatcgagattcct

SEQ ID NO: 78711 - DNA, 50 bp, homo sapien
ataacaatgtacacttaccgggctaygtagaatctgtcactgtagttctt

SEQ ID NO: 78712 - DNA, 50 bp, homo sapien
ctttcactttcacagggctaaagccrgacgatatgtctattgtccaccac

SEQ ID NO: 78713 - DNA, 50 bp, homo sapien
taaatatctgctgttgttatttgtgraatcattcaggaagataggaggta

SEQ ID NO: 78714 - DNA, 50 bp, homo sapien
aatatgtgcactgtatgctaaatggyatcttagaaactgaaaataaaaaa

SEQ ID NO: 78715 - DNA, 50 bp, homo sapien
tcagatttaactactttttataaatkttgaacacgatcatctttcattca

SEQ ID NO: 78716 - DNA, 50 bp, homo sapien
caggggaagcctgtgtggacagctcrtcaataacacattacttggaacta

SEQ ID NO: 78717 - DNA, 50 bp, homo sapien
tagcatttatttaatgaataaataaraagcaggtataagcataagaatat

SEQ ID NO: 78718 - DNA, 50 bp, homo sapien
gtaataataggcatattgctcatagyatgttaatctcaataatcttaaca

SEQ ID NO: 78719 - DNA, 50 bp, homo sapien
actgagcccagctctaattctaaaamctttaatatgactttcaagatttt

SEQ ID NO: 78720 - DNA, 50 bp, homo sapien
catacttattctataacttaagaacrcatgatatcctggcatcttggtaa

SEQ ID NO: 78721 - DNA, 50 bp, homo sapien
tatagattcacaggaaattgtaaaartaatacagagaaattttgtgtatg

SEQ ID NO: 78722 - DNA, 50 bp, homo sapien
aacaaaaaatacaaatttgaaattayggttatggatgacaattagcatct

SEQ ID NO: 78723 - DNA, 50 bp, homo sapien
tgtccctagataataaattgaaaacrcttccatatttgaaagcagtttga

SEQ ID NO: 78724 - DNA, 50 bp, homo sapien
tggagtattaacatgtagaactaaaygctttcttgagtcctttgaaccaa

SEQ ID NO: 78725 - DNA, 50 bp, homo sapien
tcttgtctgcacagtgacatcagaaytcagttaaataattaaagactgtt

SEQ ID NO: 78726 - DNA, 50 bp, homo sapien
ctcactgtctctaattgctgagtaayaaagttccatttcattgactcatg

SEQ ID NO: 78727 - DNA, 50 bp, homo sapien
tacaggcacaaaattattactcgacrcagaatgagttggtgctttccaga

SEQ ID NO: 78728 - DNA, 50 bp, homo sapien
ttataatgttcttgctactgatattstcttccatagcactgacaatcctt

SEQ ID NO: 78729 - DNA, 50 bp, homo sapien
atattaaactagaaatgtattacgaygaatgcattaatatcttgcactac

SEQ ID NO: 78730 - DNA, 50 bp, homo sapien
gcctttatgtaatctttgtgctaagmatttgaatggtccgagatttttac

SEQ ID NO: 78731 - DNA, 50 bp, homo sapien
tctgtgcccctttagaaaaggagtasagtaaccaagttcaggaacactat

SEQ ID NO: 78732 - DNA, 50 bp, homo sapien
cttagcagagcaacaagaatacaatragactacacacaaaaaaaaagaaa

SEQ ID NO: 78733 - DNA, 50 bp, homo sapien
agcatatcaagggacttctcagtctscatagttatatgagccagttcaca

SEQ ID NO: 78734 - DNA, 50 bp, homo sapien
gatggtttattgtaattttaacttaygttgatcagtagttttcttgatac

SEQ ID NO: 78735 - DNA, 50 bp, homo sapien
tttcaaaggcagttaattgtgcagayagaattctaaatgttctataatac

SEQ ID NO: 78736 - DNA, 50 bp, homo sapien
aagttctattatacatgcatttttaragattggaaagcaccattctagac

SEQ ID NO: 78737 - DNA, 50 bp, homo sapien
tcaaaaaagaaaagtgaagtatatcragcagaaggaacctagaaacctaa

SEQ ID NO: 78738 - DNA, 50 bp, homo sapien
aaattgcaacatataaggttccatgmaagatgaacaacagtgacaatgtt

SEQ ID NO: 78739 - DNA, 50 bp, homo sapien
gatgtttacaccagaggttagagaartagctttaaattttgtaatggtca

SEQ ID NO: 78740 - DNA, 50 bp, homo sapien
aatttaaactcatctgatgctcaaartaccaattaaagcatcttatactt

SEQ ID NO: 78741 - DNA, 50 bp, homo sapien
gtgaggtatagtagtcagaatttcaraaagaatctccaagattccttgaa

SEQ ID NO: 78742 - DNA, 50 bp, homo sapien
tggaatgtaaataaggctacgcaaamcttactctcatataatgggatttt

SEQ ID NO: 78743 - DNA, 50 bp, homo sapien
tcttctctttacaaagctgattacaytgaaagattaccagatactcctcc

SEQ ID NO: 78744 - DNA, 50 bp, homo sapien
gttacacaaatttcagctctcatagyagtttcctttagacagcaccaaaa

SEQ ID NO: 78745 - DNA, 50 bp, homo sapien
cagtatatcaaaagatcacagtacarggaaaactgaataatttctttggt

SEQ ID NO: 78746 - DNA, 50 bp, homo sapien
aggaaattgaaacataatatgctagratggttaattggggagaagaaaac

SEQ ID NO: 78747 - DNA, 50 bp, homo sapien
ttgttttcactttttatagttatctraaacagcaataaatcatcatcatg

SEQ ID NO: 78748 - DNA, 50 bp, homo sapien
aatgaatgagtgttgtgatcaaatartcctcacgtatagggtgtgccaag

SEQ ID NO: 78749 - DNA, 50 bp, homo sapien
tgctcttaggctacaaaagccatgcratatgaattttttattctttctgt

SEQ ID NO: 78750 - DNA, 50 bp, homo sapien
aagcacaggagtgacagcataagatrgctcatttacaaagaccaccccgg

SEQ ID NO: 78751 - DNA, 50 bp, homo sapien
ctaccaattcacactctcataacacrgcaagaaattacttcccctaaacc

SEQ ID NO: 78752 - DNA, 50 bp, homo sapien
aaacaaaacactctgttgagataackgagatagaggctgatacacagatt

SEQ ID NO: 78753 - DNA, 50 bp, homo sapien
tttaaaagttaaaggacaagtaacasattgggagaatgttttttgaaaaa

SEQ ID NO: 78754 - DNA, 50 bp, homo sapien
gttccatgagtttgaaaaccagggayagaaatgtttgggtcaaaagaaac

SEQ ID NO: 78755 - DNA, 50 bp, homo sapien
ccactcctcttctctctgtacatacscgctgctagctgtcgctttcagtt

SEQ ID NO: 78756 - DNA, 50 bp, homo sapien
tgagtggagtcagaatctgcagacargagtgtgactaacaaaggaagaga

SEQ ID NO: 78757 - DNA, 50 bp, homo sapien
gcttgcatttgtgttttcttgattaygatatgacccacttttatcctttg

SEQ ID NO: 78758 - DNA, 50 bp, homo sapien
ctttatataagcaaaagtgaatggcraattttgaaaataggacacaagat

SEQ ID NO: 78759 - DNA, 50 bp, homo sapien
gttatagcaaaggctcaattccagawaattttgaatccaaaaccagtgtt

SEQ ID NO: 78760 - DNA, 50 bp, homo sapien
tccaaaaatcagtttatatgaaaccracttaacatacaccattttgggtt

SEQ ID NO: 78761 - DNA, 50 bp, homo sapien
gttgtacatatcaatgttggtttcartgtttgatttagaaatacaacatg

SEQ ID NO: 78762 - DNA, 50 bp, homo sapien
tacaaataactaatccacattacacygactaattctgtatctttctaggg

SEQ ID NO: 78763 - DNA, 50 bp, homo sapien
aaaaaaacttcccaactctgaatccyatttcatttattgtagcatttttc

SEQ ID NO: 78764 - DNA, 50 bp, homo sapien
aaattgatattaggcacgtatcatartaaaatggacatgagaaacaaaaa

SEQ ID NO: 78765 - DNA, 50 bp, homo sapien
tacatccagctgctgcagaaaaacayaccctgagaactcaggtgcaagtc

SEQ ID NO: 78766 - DNA, 50 bp, homo sapien
aactacttctctcgtgatgaatccargcaaataagctgggcatctcggaa

SEQ ID NO: 78767 - DNA, 50 bp, homo sapien
acaagtctcctgagaatccaaacatsagtagattatatactatctgtatt

SEQ ID NO: 78768 - DNA, 50 bp, homo sapien
atcataggcagcacaggtccgcatamccttctctgttccatttggcaatc

SEQ ID NO: 78769 - DNA, 50 bp, homo sapien
tgaaagttttcagagattagtaatamatttgaaaagttacagaattctag

SEQ ID NO: 78770 - DNA, 50 bp, homo sapien
ctctggcccatcttcagaaaacttgsaacatatacaacctcttttgaaaa

SEQ ID NO: 78771 - DNA, 50 bp, homo sapien
ccagtttaaaagataattatgaagaktaagtggcaacttgtgaaaatagt

SEQ ID NO: 78772 - DNA, 50 bp, homo sapien
aaaaaagatccaatatgtagctaagsagaccttcttccccattttattgc

SEQ ID NO: 78773 - DNA, 50 bp, homo sapien
ctcatattgttacatttcattctcayaataactctgcaaaacattgttaa

SEQ ID NO: 78774 - DNA, 50 bp, homo sapien
tatggtttggatgttttgtcctctcygaatctcacgttgaaatgtggcct

SEQ ID NO: 78775 - DNA, 50 bp, homo sapien
tgtaatattggtgtgtaaatcattcraatccttactatgaagggtaaaag

SEQ ID NO: 78776 - DNA, 50 bp, homo sapien
tctataaagcagatattttccatcaytgagattctttcaaattctgaaaa

SEQ ID NO: 78777 - DNA, 50 bp, homo sapien
ccaagcaatacataaacaatttatcrgagttctttggaaattcctcatag

SEQ ID NO: 78778 - DNA, 50 bp, homo sapien
aaaaaaaaatagaattatggaccaaktattctatacaaacataaatattc

SEQ ID NO: 78779 - DNA, 50 bp, homo sapien
agctatatttcaagttaacaaatacrgaaaaagcgatcttaagaattaat

SEQ ID NO: 78780 - DNA, 50 bp, homo sapien
tcctgtgatatagtccttacgtgtaragtagccttcctggggtttaatag

SEQ ID NO: 78781 - DNA, 50 bp, homo sapien
caggaggtcataatctggagaaagaygaaaagggtgaactgagcagagga

SEQ ID NO: 78782 - DNA, 50 bp, homo sapien
tctcggcaccaaaccttattgtaaasatttggcaacagttctccagctgt

SEQ ID NO: 78783 - DNA, 50 bp, homo sapien
atcctttaaaaaagcaagacatcagrctcaataaacagattcacctagtg

SEQ ID NO: 78784 - DNA, 50 bp, homo sapien
ttttctcctgaatgtttcttttttayggaatgttccaaagccaacgcaaa

SEQ ID NO: 78785 - DNA, 50 bp, homo sapien
atggtacaacatgtctagatgaataytcaccctgtatgtgtatgtgggtc

SEQ ID NO: 78786 - DNA, 50 bp, homo sapien
gttagccagccttatctttcaggacrcttctctatcctactttttttttt

SEQ ID NO: 78787 - DNA, 50 bp, homo sapien
tctccagcttgtttaaagttcattaygtccatgatgaggccaagctactt

SEQ ID NO: 78788 - DNA, 50 bp, homo sapien
aaatcagagcattaaatgtcatgaargaaaaatgatttcaatgccaatga

SEQ ID NO: 78789 - DNA, 50 bp, homo sapien
gcagggacagaagagagaaaagtgamtaatgactgactaacatgagacgt

SEQ ID NO: 78790 - DNA, 50 bp, homo sapien
gctggagattaccattcagagaccaygtactgagcagataaatgccaatc

SEQ ID NO: 78791 - DNA, 50 bp, homo sapien
ctgataccaagggatgactgtatacygagaagtaagattgctggattata

SEQ ID NO: 78792 - DNA, 50 bp, homo sapien
cccagctagcaagtggtataataacwatcaaatgtaaatttttttttatt

SEQ ID NO: 78793 - DNA, 50 bp, homo sapien
aaggcaggaaaataagcctgatttarcatgacaaaccttatttagcaata

SEQ ID NO: 78794 - DNA, 50 bp, homo sapien
cttcctcacaattgttcttagacaakgtgtgaagaggcctttttggtgcc

SEQ ID NO: 78795 - DNA, 50 bp, homo sapien
gggtcttctttaaaaatggtatttgyaaagagctcaggtagtgttttttt

SEQ ID NO: 78796 - DNA, 50 bp, homo sapien
aatcacaaagcggagaggctagcatraatctgacattttctagaagtgta

SEQ ID NO: 78797 - DNA, 50 bp, homo sapien
ggcacatctttgctttaatgaaatayggtggttctttctggtctccctgg

SEQ ID NO: 78798 - DNA, 50 bp, homo sapien
cattggctttgggtaagaaggagtgraaattagtgtgcgaacctgaaaac

SEQ ID NO: 78799 - DNA, 50 bp, homo sapien
atggcctcttaatcataggcttgaaktaaagggaatccgaccactcccat

SEQ ID NO: 78800 - DNA, 50 bp, homo sapien
gtagacagcagattcactaagctaaraagacatgagattcctgttgatct

SEQ ID NO: 78801 - DNA, 50 bp, homo sapien
ttagtttcaatgtttgactttactaragaaattaacaatttatgaaatat

SEQ ID NO: 78802 - DNA, 50 bp, homo sapien
actgctgaaaatcagaatttacagamcccaataccttgaaaacatacaat

SEQ ID NO: 78803 - DNA, 50 bp, homo sapien
gaaaagtaaaatgggtttaagaactractttgattggccagtaaatggac

SEQ ID NO: 78804 - DNA, 50 bp, homo sapien
tgcactcgtggaaaactgaaacgcartatattgggaaacaaggcttttta

SEQ ID NO: 78805 - DNA, 50 bp, homo sapien
aaaagatatgcacggtgatacaaaartgcatataaccttcacgtgcacta

SEQ ID NO: 78806 - DNA, 50 bp, homo sapien
gattacagtggccagaatttagttcycagctatggtggacagtgggaatc

SEQ ID NO: 78807 - DNA, 50 bp, homo sapien
atctgtgtcaggattttaaagatgartaaatgttgaagttactaaaagca

SEQ ID NO: 78808 - DNA, 50 bp, homo sapien
atcatagcacctgtaagactttataygtcactcactgttattcctcaaac

SEQ ID NO: 78809 - DNA, 50 bp, homo sapien
ttttgttccccatgcctacttttcaycgtcttagccacctgtacacatgc

SEQ ID NO: 78810 - DNA, 50 bp, homo sapien
cctttcaggccgcttttctccactcraggatagtgtataccaccataggg

SEQ ID NO: 78811 - DNA, 50 bp, homo sapien
cgtgtgcaaaggcattagtcccaagmatatgtctaacacatgataggtgc

SEQ ID NO: 78812 - DNA, 50 bp, homo sapien
ttcagaggatttccctatgctcaccwctttgataagttacttgaaaccaa

SEQ ID NO: 78813 - DNA, 50 bp, homo sapien
agagatagatatttagttgtagttakaggcatcccagaaaaaaaaaatac

SEQ ID NO: 78814 - DNA, 50 bp, homo sapien
ataagtggatttcaatttggtgattyaacctatagctttaaatctttaat

SEQ ID NO: 78815 - DNA, 50 bp, homo sapien
ataggtaggagtcaataatagttcaytagcaacaaggcttactggtgaga

SEQ ID NO: 78816 - DNA, 50 bp, homo sapien
gcatgaaaataaaagccatcgtgtaygtattcaaaggtctttattacaat

SEQ ID NO: 78817 - DNA, 50 bp, homo sapien
gctccctgtcccagctgacattggargaaggatggtgagggaggcaggga

SEQ ID NO: 78818 - DNA, 50 bp, homo sapien
ggagtcaggatgtgccactagtatayggatatgttcaccagccaggaagc

SEQ ID NO: 78819 - DNA, 50 bp, homo sapien
gcatagcacatcacattaatgtggcyctattgtttgcagttccatctgca

SEQ ID NO: 78820 - DNA, 50 bp, homo sapien
atcttttgctcccgaaacagtttcayaccctaagaatacaatgactattc

SEQ ID NO: 78821 - DNA, 50 bp, homo sapien
acataataaaagtctactacttggaratcattgttattatttctcctcct

SEQ ID NO: 78822 - DNA, 50 bp, homo sapien
aagcctggggagtgaaaatcacttayctgaaatgacacaattatttagta

SEQ ID NO: 78823 - DNA, 50 bp, homo sapien
caaaaaaatggttacaaagatgaacrgaaggcaaaatatgtagctcaaag

SEQ ID NO: 78824 - DNA, 50 bp, homo sapien
tagagtcagttctttcctctgtagayccataacacctaaggcaaactttt

SEQ ID NO: 78825 - DNA, 50 bp, homo sapien
ttgttaaagtcacatatgagagcccrataactgtgaataaacttttgcta

SEQ ID NO: 78826 - DNA, 50 bp, homo sapien
ctcagggcatgtcttctacaatattytatgtcatctagaccatttcaaat

SEQ ID NO: 78827 - DNA, 50 bp, homo sapien
tagtatgccatccaatgttctcaaakatcaaaccctgtctttcctgtcca

SEQ ID NO: 78828 - DNA, 50 bp, homo sapien
tcaggaggttgaaacaccgagagatsaaataaagccacagggctcacccc

SEQ ID NO: 78829 - DNA, 50 bp, homo sapien
aggacaactgcaatgaaaagctgccraattaaagttttgcttttgtttat

SEQ ID NO: 78830 - DNA, 50 bp, homo sapien
acggtgtcacacacatatttcaggtkgagcaaatgcttattttgtgaatg

SEQ ID NO: 78831 - DNA, 50 bp, homo sapien
tctcatgttgagccagagatatgacraaggccaccgtgaggtctcagact

SEQ ID NO: 78832 - DNA, 50 bp, homo sapien
cttactagattgagagctccttgtaraactgtatgtttagcattcacaat

SEQ ID NO: 78833 - DNA, 50 bp, homo sapien
aacgcatatccatataacgagcaaartattcagtccttcagagagggaag

SEQ ID NO: 78834 - DNA, 50 bp, homo sapien
caagctcactgctgtttcttggtcakagtttaatggtggagaatacagga

SEQ ID NO: 78835 - DNA, 50 bp, homo sapien
ccattcgataaaaataatctcttaaytgacattcatttgcttccagattt

SEQ ID NO: 78836 - DNA, 50 bp, homo sapien
ggtaatggagacaatatccagggttmcttctagccctcgaattgatggta

SEQ ID NO: 78837 - DNA, 50 bp, homo sapien
tttgataaatagaagttcaaatacaygcagaaggattgtagctgagtagc

SEQ ID NO: 78838 - DNA, 50 bp, homo sapien
acaagaattttttgaggcgctactaygtcttatgctttggaccagcttct

SEQ ID NO: 78839 - DNA, 50 bp, homo sapien
gcagaaaaataagttgagaagattaygaagaatacaaaagtctaccactc

SEQ ID NO: 78840 - DNA, 50 bp, homo sapien
gtgtctctcttgtgttctaatctatragtttcttcaagagcagacattat

SEQ ID NO: 78841 - DNA, 50 bp, homo sapien
ttcttccaggtagacatagctggcaytgagaatgaagagaaatgctactg

SEQ ID NO: 78842 - DNA, 50 bp, homo sapien
gtaacaagcatcatgatttcagaaayattaaagtgtgaattctagaatgc

SEQ ID NO: 78843 - DNA, 50 bp, homo sapien
gaccacttctcatccagagagtacayatttgttgccatgacctctagaag

SEQ ID NO: 78844 - DNA, 50 bp, homo sapien
aactgacgaaagtcaatcacaggagraaaaaaatgtatcccccatggcca

SEQ ID NO: 78845 - DNA, 50 bp, homo sapien
cagattgaagttgaacagagtaatarataagagatttggactgctaaagt

SEQ ID NO: 78846 - DNA, 50 bp, homo sapien
tatgtataacaatacctttttgatayactagcacgcacaaaagtgatagg

SEQ ID NO: 78847 - DNA, 50 bp, homo sapien
ctcagtcccatggaaacttaaactcraaggctgccccttcagctaggagg

SEQ ID NO: 78848 - DNA, 50 bp, homo sapien
agataaatacttcttcttcccttggkagtgttattcaaggagcagaatta

SEQ ID NO: 78849 - DNA, 50 bp, homo sapien
aaaaatcaatcaatcaatcaatcaawttccgaacatgagttagtgaggtg

SEQ ID NO: 78850 - DNA, 50 bp, homo sapien
aaccctaagtaataaaagtaaatgamcaatgatcaagtttctcttttaaa

SEQ ID NO: 78851 - DNA, 50 bp, homo sapien
tttaaaattttctttggctgaaatamaacagaagtgaattcagtcactgg

SEQ ID NO: 78852 - DNA, 50 bp, homo sapien
ccttaacagcagagctaaggagggcrctttcctctctgcagtctcagttc

SEQ ID NO: 78853 - DNA, 50 bp, homo sapien
tctccagcggctctcaacattaatcygaggctgatttgctggcctggagc

SEQ ID NO: 78854 - DNA, 50 bp, homo sapien
cttcctactactgtgacaatttagcratccttcaaatggaaaattcctaa

SEQ ID NO: 78855 - DNA, 50 bp, homo sapien
taagtttccaagccacttgtagaagwcgtagcacaccttgaggaaaagag

SEQ ID NO: 78856 - DNA, 50 bp, homo sapien
tgcatccagccctgtagccagaataygagtctaattacagtcgttgggct

SEQ ID NO: 78857 - DNA, 50 bp, homo sapien
tgaaaggtctttaatcactgtctaartaacctgaacttgagacagaaagg

SEQ ID NO: 78858 - DNA, 50 bp, homo sapien
acgttcagcactttgcaaactagaayatgccccagaggctccgggtgcaa

SEQ ID NO: 78859 - DNA, 50 bp, homo sapien
aggcattttctaaattgtttttccamgttgtggtacttgaagcccaacga

SEQ ID NO: 78860 - DNA, 50 bp, homo sapien
atgatgggaaatttgagcaactgtcragccaagaaaaaaagcccatgagg

SEQ ID NO: 78861 - DNA, 50 bp, homo sapien
ttttccgaaccctggtacagaaggawtcctggagcccacacctctgtctg

SEQ ID NO: 78862 - DNA, 50 bp, homo sapien
aaatcctgtctagtgcgacttaagargaaagttcctaggaatgttttttg

SEQ ID NO: 78863 - DNA, 50 bp, homo sapien
ataattcaactccttctcaaaattcyataagctaatgaaaaatgactatt

SEQ ID NO: 78864 - DNA, 50 bp, homo sapien
cctcctgcaatcccttttgctgatcrcttcatagaccatcatacacttcc

SEQ ID NO: 78865 - DNA, 50 bp, homo sapien
gttcagtatatgggagtaaacaaatyagtggaagagtcaggcaagaagca

SEQ ID NO: 78866 - DNA, 50 bp, homo sapien
agggcttcaacacccagctgtattgygtccatttaacattatactggaga

SEQ ID NO: 78867 - DNA, 50 bp, homo sapien
tataaaccagacaggataacaatacmatatctggactgtctgcaataaac

SEQ ID NO: 78868 - DNA, 50 bp, homo sapien
gcccgtcggtcacaggctgtttaaastctcaccaaatttacacatttctg

SEQ ID NO: 78869 - DNA, 50 bp, homo sapien
ctctgggcaattgagataattaagcmagaccggttatggtaacgccaggc

SEQ ID NO: 78870 - DNA, 50 bp, homo sapien
tttaagagtatgtctgagaggctaarccagaaatgtgtaaatttggtgag

SEQ ID NO: 78871 - DNA, 50 bp, homo sapien
tggcataaattcttggagcaaagtarcatacataaaatgtttctgtttgt

SEQ ID NO: 78872 - DNA, 50 bp, homo sapien
atgagatagtttactgtttccaggaygcttacattaccatcagatgtcac

SEQ ID NO: 78873 - DNA, 50 bp, homo sapien
caggtctagaccatggtacccaatarcaatttatatgactttatgttgtt

SEQ ID NO: 78874 - DNA, 50 bp, homo sapien
ctaaggcaatttgtttactcctcacrggatcatatgtcagaaggtatagt

SEQ ID NO: 78875 - DNA, 50 bp, homo sapien
ttatggacccatattacaggcagaarttagtttagcataaaattattaca

SEQ ID NO: 78876 - DNA, 50 bp, homo sapien
caaggtcctacagttggtatgtagakaaaccaggttccaacctcaggaaa

SEQ ID NO: 78877 - DNA, 50 bp, homo sapien
ttagagcccaacttctccgctatacmgaagacagtgaagggaggatgacg

SEQ ID NO: 78878 - DNA, 50 bp, homo sapien
cctgggtattttgcgtccgcattgayaatatgatagctgctgccgtaata

SEQ ID NO: 78879 - DNA, 50 bp, homo sapien
acagataagctggatttcattaaatyaaacattgctgctctttgatagac

SEQ ID NO: 78880 - DNA, 50 bp, homo sapien
cccctcagttaaacaaaaatctgagycttgcatatttaaagataaaaata

SEQ ID NO: 78881 - DNA, 50 bp, homo sapien
agttactgaagctatactttcgaacyggattgtctcatgaaataatctag

SEQ ID NO: 78882 - DNA, 50 bp, homo sapien
atgtcacttctcaaacccgcttcaasagagctcattaatcagccagcttg

SEQ ID NO: 78883 - DNA, 50 bp, homo sapien
gacacacctctccctcgttcagattygctccttgttcttcagcccgtgca

SEQ ID NO: 78884 - DNA, 50 bp, homo sapien
tagctggacagccagtccttccttcragggccgtgtggttgttgtaaggc

SEQ ID NO: 78885 - DNA, 50 bp, homo sapien
gtgtcagtctggaatcatccactcaraacaggcaatgctttccagagatc

SEQ ID NO: 78886 - DNA, 50 bp, homo sapien
ctttgaaggtaaagaaaaagagcttsaaaagattgatgaattcaagaaat

SEQ ID NO: 78887 - DNA, 50 bp, homo sapien
ggagagggatatctttccttgagacygaattttatttacagccaattctt

SEQ ID NO: 78888 - DNA, 50 bp, homo sapien
tggatcgtttcagtagcttatctgargagcctctgcctagctgaaggtca

SEQ ID NO: 78889 - DNA, 50 bp, homo sapien
cattatttcagtaatttattctttcratgagacgtcatcctaaactacac

SEQ ID NO: 78890 - DNA, 50 bp, homo sapien
tgctttactaaaagagggatatacaytgtagctaaagtgttgcccttttc

SEQ ID NO: 78891 - DNA, 50 bp, homo sapien
ctgaattttctgtcaccagactgcaytgaaatccactggcagctgctgag

SEQ ID NO: 78892 - DNA, 50 bp, homo sapien
gagaatgttaagtcttgcagtattgyttaaccctgaaggagtttgtgtta

SEQ ID NO: 78893 - DNA, 50 bp, homo sapien
acctggttccagagctttccatacaycgtctcattgaatcctcgaaacta

SEQ ID NO: 78894 - DNA, 50 bp, homo sapien
tagagaaacaggaggcaggcccatcraattgccactatcagcagcaaaaa

SEQ ID NO: 78895 - DNA, 50 bp, homo sapien
cgcccctgtacagtagattcttttarcaccacctcagaacacactgaaca

SEQ ID NO: 78896 - DNA, 50 bp, homo sapien
atctgggcagatctgcccaacttccrcatcgagaatgttcctctttgggc

SEQ ID NO: 78897 - DNA, 50 bp, homo sapien
gggattaagcagcccctgtagctcascaatttataggactgggccagtgg

SEQ ID NO: 78898 - DNA, 50 bp, homo sapien
gggctgagaaatgaaacatcatgtamgtgtatgtatatgtgtgtgtatat

SEQ ID NO: 78899 - DNA, 50 bp, homo sapien
ctcacagcctgaacctccctggccgyacctcaagcattagagcaagattg

SEQ ID NO: 78900 - DNA, 50 bp, homo sapien
gactggaaggagactggcagtggctraagcgcctgagctgatgacttctg

SEQ ID NO: 78901 - DNA, 50 bp, homo sapien
attgatcactttcagatgataccagrctaacctaataaataaaacaaaaa

SEQ ID NO: 78902 - DNA, 50 bp, homo sapien
tcatattttttgttaaattgaactgwaaaattgaagcgctttgtatctaa

SEQ ID NO: 78903 - DNA, 50 bp, homo sapien
gggaaaataaaagattatctaaaacrgatgaagattaagctggaaaacat

SEQ ID NO: 78904 - DNA, 50 bp, homo sapien
gcatgtaccatattccaggaacatcragctaagcacaacacaaacgtgac

SEQ ID NO: 78905 - DNA, 50 bp, homo sapien
ttttaatgtgcatattacaggtcaargaagttttagggaaaataaaagat

SEQ ID NO: 78906 - DNA, 50 bp, homo sapien
gaaaggtaaatgtttgattttgcccraccagaatgtggaccaaaagggag

SEQ ID NO: 78907 - DNA, 50 bp, homo sapien
atactgaaattttccctttgaaaaakaatttgtcaagaacatgaagtcaa

SEQ ID NO: 78908 - DNA, 50 bp, homo sapien
aggaggaggattattatactataaaygcttactgtgtactaagtgccagt

SEQ ID NO: 78909 - DNA, 50 bp, homo sapien
ccagtctaattccattgcagttcccygtaaatagggtgactgtatgtcct

SEQ ID NO: 78910 - DNA, 50 bp, homo sapien
gaaagcaaaggtggatgtatcatcartctaattttgcggaaaggaactga

SEQ ID NO: 78911 - DNA, 50 bp, homo sapien
ggagggacaaagatgtactcctgaaytgatttttcagtctatctcaccaa

SEQ ID NO: 78912 - DNA, 50 bp, homo sapien
ggtggtgaatgctattagttctccaygtgtagacaattgtaacaaccgag

SEQ ID NO: 78913 - DNA, 50 bp, homo sapien
tctccctattcctttgctcttttggycacctggtagaatgtttattcctt

SEQ ID NO: 78914 - DNA, 50 bp, homo sapien
agggtcatgcctgcacctcgggaagmctccttagattttgtgccctacgt

SEQ ID NO: 78915 - DNA, 50 bp, homo sapien
gctcacatttactctgttaaccagaygataaagtcaagtaaaacctcatt

SEQ ID NO: 78916 - DNA, 50 bp, homo sapien
atctcaaaaaagcaataactcctgamgaattgttgaggtgacattttttt

SEQ ID NO: 78917 - DNA, 50 bp, homo sapien
gctccactagaaaaaaatactgaagragagtagttcagggtgggagagga

SEQ ID NO: 78918 - DNA, 50 bp, homo sapien
ttttgaggcagtaaactcagatctayctcacatttaaaactgtgttggaa

SEQ ID NO: 78919 - DNA, 50 bp, homo sapien
tcagttgagttcttaagttcataggwcacatttttgtttctagactgttg

SEQ ID NO: 78920 - DNA, 50 bp, homo sapien
tgttggaaaacattcataaatgtcaygtgcagatttgtattactactttg

SEQ ID NO: 78921 - DNA, 50 bp, homo sapien
gtattactcaatctaatgattcagcrtagttcactacttgccagtgcttt

SEQ ID NO: 78922 - DNA, 50 bp, homo sapien
gttaaaatgagaaatgtgttgactcragacacaagctataggttacctgt

SEQ ID NO: 78923 - DNA, 50 bp, homo sapien
aatcattaggggtcctctctcgctargttcaatcatggccacctctaagc

SEQ ID NO: 78924 - DNA, 50 bp, homo sapien
agcaccttgagctagggagcgtatcstgggttattcatgtgggtccaatc

SEQ ID NO: 78925 - DNA, 50 bp, homo sapien
agtgatgcttcaccccaccttaaaayggacacatcctaatctttggaagt

SEQ ID NO: 78926 - DNA, 50 bp, homo sapien
gtcttagaacataaattattcaaaarcaggattatttaactggaagttaa

SEQ ID NO: 78927 - DNA, 50 bp, homo sapien
gacttccccagtcctccctgggctaycatttttctgtttcctcaaatgaa

SEQ ID NO: 78928 - DNA, 50 bp, homo sapien
aattgtgaaaagaaaatccttctaaygtatgcataaacaaaaccagcttt

SEQ ID NO: 78929 - DNA, 50 bp, homo sapien
caccccagattccttcgttgcagaaytgaatgcacttcctctcccaccct

SEQ ID NO: 78930 - DNA, 50 bp, homo sapien
ctcatatctaataatcctgttgaaakacctttaataatatggtcttcgta

SEQ ID NO: 78931 - DNA, 50 bp, homo sapien
ctaatcaaaatcatgattttatccaytgaagcatttaaaaatgtgattat

SEQ ID NO: 78932 - DNA, 50 bp, homo sapien
cagctggggtcaacttgtgacgaccwagcagctgggcccaggacaaacag

SEQ ID NO: 78933 - DNA, 50 bp, homo sapien
gcaagctttttctgtaaaggaccacrgagtaaacattttcaactttgtgg

SEQ ID NO: 78934 - DNA, 50 bp, homo sapien
aaaggttttatcatgttgggaataaytgtaaaatcaatcccattaacgta

SEQ ID NO: 78935 - DNA, 50 bp, homo sapien
aagcctaacataatcataagggtctrtaaaagtagaaaagagtcagaaag

SEQ ID NO: 78936 - DNA, 50 bp, homo sapien
agaaaagagtcagaaaggaaggtcasagtgattgtcacatgaggagctct

SEQ ID NO: 78937 - DNA, 50 bp, homo sapien
gcttctagaaacagtctgcatggctkgattcacagaccccttcctccacc

SEQ ID NO: 78938 - DNA, 50 bp, homo sapien
gtttaactttatattctggatttcakcaaagcactgcctaacacattgcg

SEQ ID NO: 78939 - DNA, 50 bp, homo sapien
gacttggaaaaggaggcatttcttcyatttttatcacaacacttttttgg

SEQ ID NO: 78940 - DNA, 50 bp, homo sapien
gacctaatttctttaagacttagacrcacaagtatggtccttttccctgc

SEQ ID NO: 78941 - DNA, 50 bp, homo sapien
gaaaataacaactcaggtctcataargaaggaaatcataattttgtgaat

SEQ ID NO: 78942 - DNA, 50 bp, homo sapien
agcatcttagctgattcctaaagcaygtgtggactatagatgtttcctag

SEQ ID NO: 78943 - DNA, 50 bp, homo sapien
gttgttcttgataaacctaatgtaaragattcagaaaataaagcatatgg

SEQ ID NO: 78944 - DNA, 50 bp, homo sapien
agaagtcactgttttttctgcaatartgtaataatagttcattttgtatg

SEQ ID NO: 78945 - DNA, 50 bp, homo sapien
gctgagtctcccagcacaagactccraattttgaacatctgcctgacggg

SEQ ID NO: 78946 - DNA, 50 bp, homo sapien
tacttatgcatggtctaatgaattcyctttcttcttgtttgtgcaatggc

SEQ ID NO: 78947 - DNA, 50 bp, homo sapien
gttattctccagctctggggtatccraaaaattgtctgccttgtactgga

SEQ ID NO: 78948 - DNA, 50 bp, homo sapien
tgagaaagtgcctattgctttactarcctgttcattttcatgaaattaga

SEQ ID NO: 78949 - DNA, 50 bp, homo sapien
tcttttaactgagtgctgaactgtaygtgtaaaaggagaaaacagcccag

SEQ ID NO: 78950 - DNA, 50 bp, homo sapien
attgttagccaactttcattctgtaycattttccttagtttttataatga

SEQ ID NO: 78951 - DNA, 50 bp, homo sapien
gactctcctgaatttctgacaatgayggcaagaaaaatgaaagacacaca

SEQ ID NO: 78952 - DNA, 50 bp, homo sapien
cacttgaattgcttacatatttcccyatcattttgctaattacactgtgg

SEQ ID NO: 78953 - DNA, 50 bp, homo sapien
aagtctgaaaccatgtctctgttackatgaagcacagacttggcccctgc

SEQ ID NO: 78954 - DNA, 50 bp, homo sapien
acacagaaaatgtgtaagtaatataycatcccccgagaaactacttatgt

SEQ ID NO: 78955 - DNA, 50 bp, homo sapien
gtaagcaggaaggtgattaataatawaaaccaactgaaatgatgatgtat

SEQ ID NO: 78956 - DNA, 50 bp, homo sapien
atctcagatcagacatctcgtgaacrgtcatttagtaggtggatggatct

SEQ ID NO: 78957 - DNA, 50 bp, homo sapien
tttctaaaacatattttgacaccgtraatacactgggtttatattaatga

SEQ ID NO: 78958 - DNA, 50 bp, homo sapien
ttagtctccttgtactgatttccaargagttaatttatgattaaagatgt

SEQ ID NO: 78959 - DNA, 50 bp, homo sapien
ttggagaaatgctcagtgcaactgaygttatgatttgacctgttactttt

SEQ ID NO: 78960 - DNA, 50 bp, homo sapien
actcttttccacagtgctagaaactsaattgtaagaaagtaatcacaatg

SEQ ID NO: 78961 - DNA, 50 bp, homo sapien
ttgctcttgggaccctgagatttaascagctgaccagagcaagacccact

SEQ ID NO: 78962 - DNA, 50 bp, homo sapien
ctgaggtggcaagtaagtgactttcycaaattgcagcaatgacagataag

SEQ ID NO: 78963 - DNA, 50 bp, homo sapien
tgtggacacatctcaaaggtaaacamaaagtagcacatcttcttcatgtt

SEQ ID NO: 78964 - DNA, 50 bp, homo sapien
tgactttctcaaattgcagcaatgayagataaggcagaaatgtaagtaag

SEQ ID NO: 78965 - DNA, 50 bp, homo sapien
tgtcctccaccaattgttcttaactraaaggattatcaagggaataagtc

SEQ ID NO: 78966 - DNA, 50 bp, homo sapien
aaggctgtgggagatactcctattakgaaaacaaagaagtgggcagtaga

SEQ ID NO: 78967 - DNA, 50 bp, homo sapien
ttttactaaatttacaccagcctgakgtttataacgccatttaggggata

SEQ ID NO: 78968 - DNA, 50 bp, homo sapien
ttatctttaaacaccttttgaaataytactcttcctggtgtctgaattag

SEQ ID NO: 78969 - DNA, 50 bp, homo sapien
tcatttcctatcccaattatggatayagcagactgaagaatattttcaaa

SEQ ID NO: 78970 - DNA, 50 bp, homo sapien
taacttgatgtcatttcaaattaaayaatgtatctaagatgatgtctatt

SEQ ID NO: 78971 - DNA, 50 bp, homo sapien
ggatgggacctggaagaatcagagargacctcgtggagttactgaaactt

SEQ ID NO: 78972 - DNA, 50 bp, homo sapien
ttgggaaactgagactggttctccakaaaagcaatgctgtgaattctggt

SEQ ID NO: 78973 - DNA, 50 bp, homo sapien
ttgcattcggctctgtgttgggcgayggaaagaatttcaacacctggctg

SEQ ID NO: 78974 - DNA, 50 bp, homo sapien
aggttgttttatctgtaacaacacaytagttcaagttacttccaataatt

SEQ ID NO: 78975 - DNA, 50 bp, homo sapien
ggatattgccagtggggctcaagagraagtaagaaatctgttatcggaaa

SEQ ID NO: 78976 - DNA, 50 bp, homo sapien
ttcttattgggtgctggtatattctrtcatttagagaggtctgagagaag

SEQ ID NO: 78977 - DNA, 50 bp, homo sapien
ttcagtaacctctgagccaccatcawgagaatttgtgtaacctacaagag

SEQ ID NO: 78978 - DNA, 50 bp, homo sapien
tatgtcaaaacttagcacatgtaggyatgttaaaatttctatcatttata

SEQ ID NO: 78979 - DNA, 50 bp, homo sapien
ggctagccttgtttctgatgagtgayaatatagttattgccatcacagtt

SEQ ID NO: 78980 - DNA, 50 bp, homo sapien
ttcttctttatgttgacaatttcccrctattttgaaggacattactaacg

SEQ ID NO: 78981 - DNA, 50 bp, homo sapien
tgacgtgagtggccgccttggtcacygcacaggaacagggagtgtggacc

SEQ ID NO: 78982 - DNA, 50 bp, homo sapien
tccctgcaactagcccctcggcggawcctcagaatgatttggaaacaata

SEQ ID NO: 78983 - DNA, 50 bp, homo sapien
tatgtaaatactttgtttttcttaasgtcaactatctagtaggcattttg

SEQ ID NO: 78984 - DNA, 50 bp, homo sapien
aaggttttaatgaaaaaatgtgttamgtaatagacaaagtccaaggatcc

SEQ ID NO: 78985 - DNA, 50 bp, homo sapien
aatatacttcaattgtcatattactsagaaaattaaacaaaaaagcccag

SEQ ID NO: 78986 - DNA, 50 bp, homo sapien
tacaggattgttcaattgcagtctaygtggatagcagtatcagaattgtt

SEQ ID NO: 78987 - DNA, 50 bp, homo sapien
ataaagagatccggtttcttaagcaragtctcccagatcatacgcccacc

SEQ ID NO: 78988 - DNA, 50 bp, homo sapien
agaagatgctgctctcagtatttcayggtacagagagaagtctcacaatt

SEQ ID NO: 78989 - DNA, 50 bp, homo sapien
ttgtattttgtctcatttttcagtaytaataaaacatccatgtggcctca

SEQ ID NO: 78990 - DNA, 50 bp, homo sapien
gccagctatttggtggaagattgatwatattagactccttctacactgct

SEQ ID NO: 78991 - DNA, 50 bp, homo sapien
tagttaagaatagcctttcattgttmttctccagtgcattgatggtgcac

SEQ ID NO: 78992 - DNA, 50 bp, homo sapien
cctggcatatttcttgagcaaggccratgaggaagaagaaaattgtttcc

SEQ ID NO: 78993 - DNA, 50 bp, homo sapien
tgaaaaagctcttatgtcttgataaytgtgatagtgctgaagccctagat

SEQ ID NO: 78994 - DNA, 50 bp, homo sapien
ttgctcatctcagcagttggaaaccrctttggtctttactgaattttaaa

SEQ ID NO: 78995 - DNA, 50 bp, homo sapien
tcttcttgtttgtaggaatttgaaawcttaagttacaggaaatggatagc

SEQ ID NO: 78996 - DNA, 50 bp, homo sapien
cctttgtcctagatacaaatacagawcaatctcaactcattggcatgggc

SEQ ID NO: 78997 - DNA, 50 bp, homo sapien
tattactacagatatgcaaatatccrcacaactaatttgcctttggcagt

SEQ ID NO: 78998 - DNA, 50 bp, homo sapien
ataagaatgaattgcttgcggaacgygttataaatgaatattttcagcac

SEQ ID NO: 78999 - DNA, 50 bp, homo sapien
gccagggcctgtgagggaaccaagaygtgtaagacatggcctctcattag

SEQ ID NO: 79000 - DNA, 50 bp, homo sapien
ggaagggaagggcctatccaaagtcsaagagagtgctatttaacccacgt

SEQ ID NO: 79001 - DNA, 50 bp, homo sapien
ttctagctcctatgggtatgaaagamcaccaggagtagtgtgagaaacgt

SEQ ID NO: 79002 - DNA, 50 bp, homo sapien
caggttcttatttgagttacagggasaagaagcctttggattgcaggttt

SEQ ID NO: 79003 - DNA, 50 bp, homo sapien
agtaggttgcactgcagttatttcaytcaccactatccttaggagtggct

SEQ ID NO: 79004 - DNA, 50 bp, homo sapien
agaggagcggcggccgcttccggcaraacatggaatcctgacgcagccca

SEQ ID NO: 79005 - DNA, 50 bp, homo sapien
ggacaaaagctccccataaattgtamagcaagttttagtcatctgtttat

SEQ ID NO: 79006 - DNA, 50 bp, homo sapien
ttgtctacacattaatttgaagttamagtcatatattatgctaataactt

SEQ ID NO: 79007 - DNA, 50 bp, homo sapien
gggatcggaatggataagacactctraacttgtatgatggaaaatctaga

SEQ ID NO: 79008 - DNA, 50 bp, homo sapien
agaataaaggaataaacaaggattcytaaatctcaaaatgtcagacttta

SEQ ID NO: 79009 - DNA, 50 bp, homo sapien
aactactaagaaatatatgcatcaakttagtcattacaagttagaacaag

SEQ ID NO: 79010 - DNA, 50 bp, homo sapien
ttcagaaaactcctgaagctgttagratttttagtgtgagttccttccaa

SEQ ID NO: 79011 - DNA, 50 bp, homo sapien
tacttacttgaccatccaattggcaygaaccctgtaatggttaatttcac

SEQ ID NO: 79012 - DNA, 50 bp, homo sapien
acccaaggcagcaggaaaaggctcaygcttcagtagaacggaattccgct

SEQ ID NO: 79013 - DNA, 50 bp, homo sapien
ttcttctatgctagtagtttctgcaragtagagctaaaccttcaggatga

SEQ ID NO: 79014 - DNA, 50 bp, homo sapien
tatccttgataaagaagtgaataacmaaagtccttgggcaagaaatatga

SEQ ID NO: 79015 - DNA, 50 bp, homo sapien
tattttactgagtaccaattgttacmgccaaagtacagtatgagcctata

SEQ ID NO: 79016 - DNA, 50 bp, homo sapien
tatctttgcctctagaacctcactgygaataaggaagatcaatatgttcc

SEQ ID NO: 79017 - DNA, 50 bp, homo sapien
tttggggcctgttgatatgaacatayaaataagaaaagtacaataatagg

SEQ ID NO: 79018 - DNA, 50 bp, homo sapien
cctttatcacatcaattgaaattcgsttccggtgccaggtgagagtacca

SEQ ID NO: 79019 - DNA, 50 bp, homo sapien
atgctcatttaaaaatattaacataractatccctactatcatattctgt

SEQ ID NO: 79020 - DNA, 50 bp, homo sapien
ggcaaacgctacacgtcaagcaccasagaccagagccgttgttatttttt

SEQ ID NO: 79021 - DNA, 50 bp, homo sapien
agacgtgtctgccacaggtctcaggrtaacagatgccctgtccactgaga

SEQ ID NO: 79022 - DNA, 50 bp, homo sapien
caaattcctataaccctcttgactayacctctggggcctcagtgcatcct

SEQ ID NO: 79023 - DNA, 50 bp, homo sapien
cttcacttgtgagtcacggcatagarcacggggaaaggtcagtcagtact

SEQ ID NO: 79024 - DNA, 50 bp, homo sapien
taacatgtttgatttattcactttaycattctcatcatcattagtggcag

SEQ ID NO: 79025 - DNA, 50 bp, homo sapien
agctctatctcatgttcaacgataaygtgctcctgaaaaattgtatgtaa

SEQ ID NO: 79026 - DNA, 50 bp, homo sapien
caacaaggctgttggaacattaatcraactgtcatttcttcatccattgc

SEQ ID NO: 79027 - DNA, 50 bp, homo sapien
ggatgttcatttaaaataacatcgcrggaaactactttgacatttaaaat

SEQ ID NO: 79028 - DNA, 50 bp, homo sapien
atgagggtaattctaggcagactaamgaatgcaaagggaattggcttgta

SEQ ID NO: 79029 - DNA, 50 bp, homo sapien
tatcactcatttctttgaagaggtgmataatatagtatgaaccctagaaa

SEQ ID NO: 79030 - DNA, 50 bp, homo sapien
aaaaaaattacaaaacttatatacayggccagagaaagacaaagaataga

SEQ ID NO: 79031 - DNA, 50 bp, homo sapien
agcaatcagtgagaaatctcttaaasaccagataaaaaaagaagatatag

SEQ ID NO: 79032 - DNA, 50 bp, homo sapien
aagtcctttaatgtccaagcgacatyaggtgttttagtacagagaaaaag

SEQ ID NO: 79033 - DNA, 50 bp, homo sapien
tggtagaaaaaccaaaaaaggaacasactgcatctatatgtggcaagagt

SEQ ID NO: 79034 - DNA, 50 bp, homo sapien
ggcagatggtgtggaagagtaggaamgtgatgttaaaacaaacacagatt

SEQ ID NO: 79035 - DNA, 50 bp, homo sapien
actgatacagtctccttatctctcaygtttgttaattctataagtactta

SEQ ID NO: 79036 - DNA, 50 bp, homo sapien
atttgtggtcatgccttgccgtgaasgtgacagggtaatcaataggaaag

SEQ ID NO: 79037 - DNA, 50 bp, homo sapien
cttttcatgctatacacatgctttaygcactcacatatacacagaaacac

SEQ ID NO: 79038 - DNA, 50 bp, homo sapien
aaccttccagaagtgtagagttctcygaccattgtgtttatattgcgtgt

SEQ ID NO: 79039 - DNA, 50 bp, homo sapien
tttgtatgagcaattttattctctcyctaggtttctctcatcaaatacca

SEQ ID NO: 79040 - DNA, 50 bp, homo sapien
agagagctacttgggaatatctatcwaaaggcttaaataacagatactct

SEQ ID NO: 79041 - DNA, 50 bp, homo sapien
tgccaggaacagacaacacaaccaaygcagtcaaatataaccctaaatat

SEQ ID NO: 79042 - DNA, 50 bp, homo sapien
gcctcgccaaacatccctacgcagckatgttggctcccttattttctttc

SEQ ID NO: 79043 - DNA, 50 bp, homo sapien
gatccttggcaggtacctttctatcygaatgaattaaaggagggacatta

SEQ ID NO: 79044 - DNA, 50 bp, homo sapien
gtggtctcctctgtaaataatgagamggcaaaaaaggtgtcaggggatat

SEQ ID NO: 79045 - DNA, 50 bp, homo sapien
atatgatgcatacaaacatggttaartagaagacataggaagagatgcaa

SEQ ID NO: 79046 - DNA, 50 bp, homo sapien
ccaagaaaatggggtatagtgtactwaacactgaagcctaatgagagtaa

SEQ ID NO: 79047 - DNA, 50 bp, homo sapien
gccagtgttccttttctgagaattakatagaccacctctatcatcactca

SEQ ID NO: 79048 - DNA, 50 bp, homo sapien
agtgatgaatgcttaagattaaagaytaggagtggccatggtggctgtaa

SEQ ID NO: 79049 - DNA, 50 bp, homo sapien
tgctcaggagccagctaatttataaygtcatatgggctagactggaagac

SEQ ID NO: 79050 - DNA, 50 bp, homo sapien
taatcttcattattcattttcttacrgcctactgacaccaatgaataaaa

SEQ ID NO: 79051 - DNA, 50 bp, homo sapien
tgtcccattcaatatacctttccaayattatcatccattgctcttgtcct

SEQ ID NO: 79052 - DNA, 50 bp, homo sapien
aagtagtgtgtttgaggcagttgagwatatgttcctttcactacaaaatt

SEQ ID NO: 79053 - DNA, 50 bp, homo sapien
taggcaaattacaaagttatctcacrgaaaaattgatcttttgattttta

SEQ ID NO: 79054 - DNA, 50 bp, homo sapien
attttaattcttgaatatgtgatagwagtgagtgaagaacttataaatat

SEQ ID NO: 79055 - DNA, 50 bp, homo sapien
tacacaactctttacctgagaaccayacttggataagtcactattcatta

SEQ ID NO: 79056 - DNA, 50 bp, homo sapien
attaatatttatttcacttgtaaaayagaatctcaactggttttaatttc

SEQ ID NO: 79057 - DNA, 50 bp, homo sapien
ttgtcatggctccctaaacaatacawtataataagtacttacatagcatt

SEQ ID NO: 79058 - DNA, 50 bp, homo sapien
cctactaaactcaccaatcaaaggcrcgagaacaagagggaggccctagg

SEQ ID NO: 79059 - DNA, 50 bp, homo sapien
cacatcacagtgccttatattcaccrctgtttctgatcattaacccttca

SEQ ID NO: 79060 - DNA, 50 bp, homo sapien
attttaagatgcctacacattaaaaytatttcatctgaaggacagtagca

SEQ ID NO: 79061 - DNA, 50 bp, homo sapien
tgagccaacgcggatgggggtggcartaatagaatgtactatttgggaat

SEQ ID NO: 79062 - DNA, 50 bp, homo sapien
ctaagaataatgtagctgctacacaytaacttctgcatgaagacaactgt

SEQ ID NO: 79063 - DNA, 50 bp, homo sapien
actctgtaaaattatgctttatatargaatgctattattaccacctcagg

SEQ ID NO: 79064 - DNA, 50 bp, homo sapien
actcttgcctaacattaaacagaagratagtcattagctgtaacttcggc

SEQ ID NO: 79065 - DNA, 50 bp, homo sapien
agtatctttgattttggtcattaatkagtggtaaggtattcagctagctg

SEQ ID NO: 79066 - DNA, 50 bp, homo sapien
cataacagagagaagctaggtatgayaacagagacaaagggtctgtaaag

SEQ ID NO: 79067 - DNA, 50 bp, homo sapien
tcagtgaaaaatagattgaaaatgaraagagagaagtgggcagaagaggc

SEQ ID NO: 79068 - DNA, 50 bp, homo sapien
gcattcatagcatggcagtccagcaytctctaacagaccctggggcagca

SEQ ID NO: 79069 - DNA, 50 bp, homo sapien
gggtcagagggtggtacgctgaggayattgagtgatctaagagaggctga

SEQ ID NO: 79070 - DNA, 50 bp, homo sapien
aactcccttttttcttagcttattaygcacactgatccttaactcaattt

SEQ ID NO: 79071 - DNA, 50 bp, homo sapien
atgaacaccatatatcatattgtaakgaggaagaaaatgaatgtatttaa

SEQ ID NO: 79072 - DNA, 50 bp, homo sapien
ttggttacttaaaacagtcacatggycatattatgtgggttatcaaaagg

SEQ ID NO: 79073 - DNA, 50 bp, homo sapien
actagagggagatatcttacatgccmattttattaggattatattttcaa

SEQ ID NO: 79074 - DNA, 50 bp, homo sapien
tggaaaagggagggaacagtgggaargactttgacttgtgagtaccagct

SEQ ID NO: 79075 - DNA, 50 bp, homo sapien
aaattcctaggagaattgctggttcracttttaggaacgatttttttttc

SEQ ID NO: 79076 - DNA, 50 bp, homo sapien
accttaagaacaactagaactgcaartaaattctaagccatgtttgataa

SEQ ID NO: 79077 - DNA, 50 bp, homo sapien
tttctttttgggctaaagtatgagaygagtaggtgacagcattctttata

SEQ ID NO: 79078 - DNA, 50 bp, homo sapien
cttttatcattatattaaggactcamaccaaagatctaaatatgcccttt

SEQ ID NO: 79079 - DNA, 50 bp, homo sapien
tgggctacgcagtgctacatttcccractaggcaacatgcactctgctgg

SEQ ID NO: 79080 - DNA, 50 bp, homo sapien
atctgataagaaaccatagatatcawcaaataattaagtgttagaatata

SEQ ID NO: 79081 - DNA, 50 bp, homo sapien
caccaaggactcaaagaataaatcakatcacagggatgaggtggaaagtg

SEQ ID NO: 79082 - DNA, 50 bp, homo sapien
gatgacagagttgattcttcttctayggttccactaatttccaaatttct

SEQ ID NO: 79083 - DNA, 50 bp, homo sapien
tcattagccacgctgaaattcgttgwctcgtactgtgctaaggttgctgc

SEQ ID NO: 79084 - DNA, 50 bp, homo sapien
ggagttaactattggctaacataaayttgggctttatctgtgaatcataa

SEQ ID NO: 79085 - DNA, 50 bp, homo sapien
gttatgagtttctccttctgacttayagtgcatgcattaaaacaaaaaca

SEQ ID NO: 79086 - DNA, 50 bp, homo sapien
cctgacatcacgagctgctgagctarccaacggtggaaattcccactact

SEQ ID NO: 79087 - DNA, 50 bp, homo sapien
cttaaatgtaattgtacaactaacartcatcacacatatgagggtagcca

SEQ ID NO: 79088 - DNA, 50 bp, homo sapien
caaacctgaggtcaagactactgagragaaggaactatctgaattaaaac

SEQ ID NO: 79089 - DNA, 50 bp, homo sapien
accaagtaaacaagtggtaatgctaygttgtttctaggcaaaattttctt

SEQ ID NO: 79090 - DNA, 50 bp, homo sapien
agtttttatgtttccttcaagtcttkgagcatgcttataatagctttttt

SEQ ID NO: 79091 - DNA, 50 bp, homo sapien
gaatagtgaagtgaaaagcatgatamaatgatgaaagatagctttgaaat

SEQ ID NO: 79092 - DNA, 50 bp, homo sapien
accagcaacaatgtacaagatattcrgttcctcagccacaaaatccacac

SEQ ID NO: 79093 - DNA, 50 bp, homo sapien
gtgccatacatgttgctgggtattaygaaagcttcaaaagcataattcct

SEQ ID NO: 79094 - DNA, 50 bp, homo sapien
ctcacttcacatgggtgttaccaacygcaactgtgcatcatcttagggac

SEQ ID NO: 79095 - DNA, 50 bp, homo sapien
cctccctactccttgttctcttggcmagttcatagtcattttgccagaat

SEQ ID NO: 79096 - DNA, 50 bp, homo sapien
gtgccacattggctatcagccacccracttgcgtggtctatgacagagga

SEQ ID NO: 79097 - DNA, 50 bp, homo sapien
gaataagtgtcatagatcataaaagyaagagcaaatatgtagaaagataa

SEQ ID NO: 79098 - DNA, 50 bp, homo sapien
aaataagcccttgaagtcttttaggrcagcatgttcagagagaatgtcta

SEQ ID NO: 79099 - DNA, 50 bp, homo sapien
tccataatgtgacctgtagtaagcaytcacaactttgatatcatggcccc

SEQ ID NO: 79100 - DNA, 50 bp, homo sapien
ttacccaagatttgtaagaataagartggtacgtagaacacctgccattt

SEQ ID NO: 79101 - DNA, 50 bp, homo sapien
tagcacccaggcttcaaacactgacrttggtgctagactccacctcaggt

SEQ ID NO: 79102 - DNA, 50 bp, homo sapien
atgagtacccaatacatgcaataaastaatcttcaattcaaacaataact

SEQ ID NO: 79103 - DNA, 50 bp, homo sapien
aaccctattcaaatcctgcttgtcastcttactgtttgcaaacgtgcgtg

SEQ ID NO: 79104 - DNA, 50 bp, homo sapien
tttgttgtttgtttgtgatacggtasattagttttttattgctgctgtaa

SEQ ID NO: 79105 - DNA, 50 bp, homo sapien
ccttgtctgtaaaatagacataatartacctatgttgcatatttactgtg

SEQ ID NO: 79106 - DNA, 50 bp, homo sapien
aaattgaatgaatgaacaaggttgartaaaatatatcttattagaaagtt

SEQ ID NO: 79107 - DNA, 50 bp, homo sapien
acatgtatcgaacaaaggagcttcartgaataaaacttttctagtttgtt

SEQ ID NO: 79108 - DNA, 50 bp, homo sapien
agtgactgtctatagttgtgaaatayaaaaaatggtatgtttgatcagaa

SEQ ID NO: 79109 - DNA, 50 bp, homo sapien
aaaattaacacaggacaaatctatamgactttgagtttggtgataagata

SEQ ID NO: 79110 - DNA, 50 bp, homo sapien
tcacagagcctacattttctcattasggttatgatgctcagtatctttcc

SEQ ID NO: 79111 - DNA, 50 bp, homo sapien
gaggcacaaaggtaccaatgcaaacrggaagctcatgctgcctgctgtgc

SEQ ID NO: 79112 - DNA, 50 bp, homo sapien
tatgccaaaagaggactgacagatayataagttttaagcttagggatgag

SEQ ID NO: 79113 - DNA, 50 bp, homo sapien
caaaactaaatttatttaccaaataycacatatacataacacatggagac

SEQ ID NO: 79114 - DNA, 50 bp, homo sapien
tttttgatgctcaagagctaataaamagagtgcttgtcaatggtctaatc

SEQ ID NO: 79115 - DNA, 50 bp, homo sapien
agaaacattcagtccagagtatcacsggtttggattttgtataaattcct

SEQ ID NO: 79116 - DNA, 50 bp, homo sapien
atactctccaatccaaatcacttatraaacaattaaacgaactcttaaaa

SEQ ID NO: 79117 - DNA, 50 bp, homo sapien
tacagaatagagttgcagtgagtaartgaaatgtgagtggcactccctgg

SEQ ID NO: 79118 - DNA, 50 bp, homo sapien
ttcaaatttctaactccatgagtgakattatgatgtacattggttttcat

SEQ ID NO: 79119 - DNA, 50 bp, homo sapien
gagatgctttgattaaaagtcgagasagtaattaaataccaattcagcct

SEQ ID NO: 79120 - DNA, 50 bp, homo sapien
ggcactttgatagtaagaaactagayattttgaaatggcaatacgggtct

SEQ ID NO: 79121 - DNA, 50 bp, homo sapien
tttcccgcccgaacatgaagaaaaaygacctgaccctgtagagagaacac

SEQ ID NO: 79122 - DNA, 50 bp, homo sapien
ataggctggtgttaactggcccaagractgacattaaaagcttggttaga

SEQ ID NO: 79123 - DNA, 50 bp, homo sapien
tttctatttcataattcgggatatayaaaaatgctaatcactaccagaat

SEQ ID NO: 79124 - DNA, 50 bp, homo sapien
ttgggataagatgagcctcctgggaygcaaacactcctgaattagagtca

SEQ ID NO: 79125 - DNA, 50 bp, homo sapien
catagggtgttgagttttctcagacraacctctctcttcggcctaaattt

SEQ ID NO: 79126 - DNA, 50 bp, homo sapien
tgttaccagaactggtggttctgaayactggagttgaatttctcgcagag

SEQ ID NO: 79127 - DNA, 50 bp, homo sapien
atctagaggccttctctggctataarcaaccttgatcacttaccccaatg

SEQ ID NO: 79128 - DNA, 50 bp, homo sapien
aggaaacggccctgctgttaagccaygtgaaggctcaagactggcaaagg

SEQ ID NO: 79129 - DNA, 50 bp, homo sapien
aatttaataatgcaaggtctttatawacttggttacagaaaaactgactt

SEQ ID NO: 79130 - DNA, 50 bp, homo sapien
tttaaaggcagggaggttggttatargcaatgcatgaaggctatacatta

SEQ ID NO: 79131 - DNA, 50 bp, homo sapien
ttggttaagagagcaaagctttatckaaaacttggggtcagcagaaagga

SEQ ID NO: 79132 - DNA, 50 bp, homo sapien
tagagtggctgcgttgccaggtttasagatcctgaaggccaaggctgact

SEQ ID NO: 79133 - DNA, 50 bp, homo sapien
atcttttattctcctattatttatamcacttagaagatatagtgattatt

SEQ ID NO: 79134 - DNA, 50 bp, homo sapien
tgctcaggagtgtgactgctggtgcrtatggtaagtgtggtttctttttt

SEQ ID NO: 79135 - DNA, 50 bp, homo sapien
gagttaaagcaacatattgaaccatsatactcacttattcaacaaatatt

SEQ ID NO: 79136 - DNA, 50 bp, homo sapien
actattgatgttaccattggaggaaytgggtgaaaggaaagtaggacctc

SEQ ID NO: 79137 - DNA, 50 bp, homo sapien
aatgggacaggcttctatacttgttycctggccagccttcccacaaaggc

SEQ ID NO: 79138 - DNA, 50 bp, homo sapien
caacacccaaaacaaatgttacttcscttacagttgtgcccattagatgt

SEQ ID NO: 79139 - DNA, 50 bp, homo sapien
ccactgcctcacgtttttagactccrcagcttcgctccctggaggggaac

SEQ ID NO: 79140 - DNA, 50 bp, homo sapien
tcaatatctgacaaatttttgatacragagccacaacaacacttctttgg

SEQ ID NO: 79141 - DNA, 50 bp, homo sapien
atcttggactaggattcccttccaarttatgtaataaaatagctgcacaa

SEQ ID NO: 79142 - DNA, 50 bp, homo sapien
cacaactgagggccatggaaatgccrcttagcctctccagatctcagttg

SEQ ID NO: 79143 - DNA, 50 bp, homo sapien
ttttttcagggcctgctatctgttaygtgatgccatcctagagtcaggct

SEQ ID NO: 79144 - DNA, 50 bp, homo sapien
acaatcagatctggctgagcaacttraacgggaacctgcagcatgccagg

SEQ ID NO: 79145 - DNA, 50 bp, homo sapien
aacttcattgtctgtaatctctctaygcaccctactgaaacacaatgatt

SEQ ID NO: 79146 - DNA, 50 bp, homo sapien
acaccagccatgcgcctaatcagcaragatcaatcaaggcagcaggaaac

SEQ ID NO: 79147 - DNA, 50 bp, homo sapien
acctgctgcctcttttcctcttctcmaaagtacctggcataggttgcatt

SEQ ID NO: 79148 - DNA, 50 bp, homo sapien
gattaggaaaatgaagttatcggaamaaatggtctcttcagacaaacaat

SEQ ID NO: 79149 - DNA, 50 bp, homo sapien
gtaggagagccatcccgggcagccamtagtatgtgcaaacgcttgcaaac

SEQ ID NO: 79150 - DNA, 50 bp, homo sapien
ccctcaagggtcccatttatcactcwcagtcctgaatttggtgtttccct

SEQ ID NO: 79151 - DNA, 50 bp, homo sapien
aggctgttgctatgccattaatcaarggaacccatctaattttaggttta

SEQ ID NO: 79152 - DNA, 50 bp, homo sapien
ttgttttccaggtacaaagtgtaccragaaagcctcacagtgctaatgct

SEQ ID NO: 79153 - DNA, 50 bp, homo sapien
tcccccaaatgaaggaactcaagtasatttctaaggtcccttcctttgac

SEQ ID NO: 79154 - DNA, 50 bp, homo sapien
gagtttttcttaccaaaattgaaaaygtgtcaagacctccaaaagcattc

SEQ ID NO: 79155 - DNA, 50 bp, homo sapien
ctttaaggttttttgctagtatagayaatttgtaaatatggcacaatttt

SEQ ID NO: 79156 - DNA, 50 bp, homo sapien
tttgaataaatgctatatacagatcyctttggtgcattccattatattcg

SEQ ID NO: 79157 - DNA, 50 bp, homo sapien
atttaatatttatctaacctgaatarcccaaccgataatcatttagaaaa

SEQ ID NO: 79158 - DNA, 50 bp, homo sapien
ttttcttcatccaaggaaaacaaacsctttgctatcatttctctatcctt

SEQ ID NO: 79159 - DNA, 50 bp, homo sapien
tacctctgctcacctgcagaatgaayccagaattatatggcagtcctgtc

SEQ ID NO: 79160 - DNA, 50 bp, homo sapien
ctcttcaggaggtgggacatttgaamatctcagagtgcttcttggaatat

SEQ ID NO: 79161 - DNA, 50 bp, homo sapien
atattgagatgttctaaaaactataygaagacagacatttttcagtcggg

SEQ ID NO: 79162 - DNA, 50 bp, homo sapien
tgctgctcacctctgaggaagttacragactacaggatttcatcaatgga

SEQ ID NO: 79163 - DNA, 50 bp, homo sapien
tctgcctctggaactccattgagacrgtagttagacttggtactcacccc

SEQ ID NO: 79164 - DNA, 50 bp, homo sapien
ctgttgcccaagctttcatctgaaayttacttacctggtcttctctcact

SEQ ID NO: 79165 - DNA, 50 bp, homo sapien
cttctttcatttaagtaaactagtcrctgaacttaaacatatatctgtaa

SEQ ID NO: 79166 - DNA, 50 bp, homo sapien
agctatgcatccagctataaactacrctatgtaaagccatgaaaaataca

SEQ ID NO: 79167 - DNA, 50 bp, homo sapien
aaacctgttctcgttacagggatatraattgaactcaaagtaaagttgga

SEQ ID NO: 79168 - DNA, 50 bp, homo sapien
tatgcacaagaaatgcaatgtagaaragacacacttggtttacttggagc

SEQ ID NO: 79169 - DNA, 50 bp, homo sapien
gatggagtcaattcagatatgttcargcagatacgagggtgggtaggaga

SEQ ID NO: 79170 - DNA, 50 bp, homo sapien
ctctgatttcaaatagtgatttgaayggacatgctgcctaactattttag

SEQ ID NO: 79171 - DNA, 50 bp, homo sapien
attgaataatgattaataataatacrgcttaaaatactgcaatgataatc

SEQ ID NO: 79172 - DNA, 50 bp, homo sapien
cccacctgcctgtctgtttctcccaygcgaaaattaatgttaactaacac

SEQ ID NO: 79173 - DNA, 50 bp, homo sapien
attatgggactgctatcttagcctastagaatggaatcagcatggggatc

SEQ ID NO: 79174 - DNA, 50 bp, homo sapien
cccgttttccgtttactgactgaaamgcacgtgttctatgacaatgcaag

SEQ ID NO: 79175 - DNA, 50 bp, homo sapien
agggaaaaaagcttacaatcctacargcaatttacagaaagcttagtaag

SEQ ID NO: 79176 - DNA, 50 bp, homo sapien
atttactctgaattattggcatccarcatgggattttgtacagagtagat

SEQ ID NO: 79177 - DNA, 50 bp, homo sapien
tgggtagccactgaggaaaccatgargagacggaggcctgcctggaggaa

SEQ ID NO: 79178 - DNA, 50 bp, homo sapien
ttcctgaaagagagagcctaatagaytcaccatatatcaccattatcctt

SEQ ID NO: 79179 - DNA, 50 bp, homo sapien
cttcatattacaactcagatattggraaaatccagtatactccagttatt

SEQ ID NO: 79180 - DNA, 50 bp, homo sapien
gccaaccgttttggagaaccaaccaycaataccaaacgagttccgctgga

SEQ ID NO: 79181 - DNA, 50 bp, homo sapien
tatcactgcagtgaaattattgtacmaaaggatatgctcgtaaattttga

SEQ ID NO: 79182 - DNA, 50 bp, homo sapien
agcagtattccgagtggctgcaatawgctattaaagatgtcgaacttcaa

SEQ ID NO: 79183 - DNA, 50 bp, homo sapien
aggaagtcaggaaacaatgtacaccrgcctgttcatgggctgaactctag

SEQ ID NO: 79184 - DNA, 50 bp, homo sapien
tcatagagagtcgttcagggccacaractatatttcctgcagtccttttt

SEQ ID NO: 79185 - DNA, 50 bp, homo sapien
aatttcttcatagtttctatgcttayatttcagctatattgctttaattg

SEQ ID NO: 79186 - DNA, 50 bp, homo sapien
tgtagaggccagttatgtaatgtcayggcgattttgagaatctgattcag

SEQ ID NO: 79187 - DNA, 50 bp, homo sapien
gccagctacagctaatataattgaaraatagtcagatagggtcaggagtg

SEQ ID NO: 79188 - DNA, 50 bp, homo sapien
ataacaatattctgaagaagaggcaycactggtctttcaaaatgtaggca

SEQ ID NO: 79189 - DNA, 50 bp, homo sapien
gtaaggaaacagcagctgggttgccrcacactcctttagcattgagtgat

SEQ ID NO: 79190 - DNA, 50 bp, homo sapien
ggcatactgtggtgaataagttaagrccaagcactttaaaaagatgacag

SEQ ID NO: 79191 - DNA, 50 bp, homo sapien
aaaaataagtataaagctaggcttamagttgctagtcctgattttttctc

SEQ ID NO: 79192 - DNA, 50 bp, homo sapien
aaatagtaaacattattctgtatgcyaaaaggttcattcattcttgcttt

SEQ ID NO: 79193 - DNA, 50 bp, homo sapien
agcactgttttgaaaaagtgcattaracgattctgttcatatttatgcag

SEQ ID NO: 79194 - DNA, 50 bp, homo sapien
gaagaaaaacacagacagataggtaragagtaaatggatgaaataagata

SEQ ID NO: 79195 - DNA, 50 bp, homo sapien
agccattctactttcttttactcaaytggctcatcaggcactttaaagca

SEQ ID NO: 79196 - DNA, 50 bp, homo sapien
tcaatttcaggtatacgtccatgaaygaaaaaaatttttgcaacttttgg

SEQ ID NO: 79197 - DNA, 50 bp, homo sapien
caggcacctcttccattcaaggttayattcttctctaattagatgtccca

SEQ ID NO: 79198 - DNA, 50 bp, homo sapien
taatatatagatgtgttttataataygttttcagaaaggcagtttttttt

SEQ ID NO: 79199 - DNA, 50 bp, homo sapien
gctacagatctcattgatagctatgktaaaataaggaaatgttataaaca

SEQ ID NO: 79200 - DNA, 50 bp, homo sapien
ctctttttgaaaagtctagggtatayacagtagcattgctttgaagagga

SEQ ID NO: 79201 - DNA, 50 bp, homo sapien
ctttcaaagtagattagtagacccayaaaggattggaaggcaaatggact

SEQ ID NO: 79202 - DNA, 50 bp, homo sapien
ccaacatattttcctattgtctttcyattgatttcaagtgtaatttcgtg

SEQ ID NO: 79203 - DNA, 50 bp, homo sapien
tacaaaaattacaaatacctaacaayctaagacttgcataagaaaaaatt

SEQ ID NO: 79204 - DNA, 50 bp, homo sapien
agcaaacaaatattcacaatacaatwatcttttcatctttggagcttttg

SEQ ID NO: 79205 - DNA, 50 bp, homo sapien
gataagatattgccaaagaactaccraattattgggaaaagaatagctgg

SEQ ID NO: 79206 - DNA, 50 bp, homo sapien
gagcagcccctgaccccccagaaaargatcttccataagttaatcaattc

SEQ ID NO: 79207 - DNA, 50 bp, homo sapien
ccttctgtaaagattagtccaaacarcacttcctctatggagaatccatt

SEQ ID NO: 79208 - DNA, 50 bp, homo sapien
ataatggcatgtttctttatgtgtaycatgagtttatatatatgaacaat

SEQ ID NO: 79209 - DNA, 50 bp, homo sapien
tgttcccagttagaggtgtaacaacmaaactcagtgccacatttccaagc

SEQ ID NO: 79210 - DNA, 50 bp, homo sapien
gaaaagccaaatcttgtatagaagamgataatatggtcctaaacttctat

SEQ ID NO: 79211 - DNA, 50 bp, homo sapien
aagttgagtcactgcatttggacccrcaggtaataggtggcagtgtggcc

SEQ ID NO: 79212 - DNA, 50 bp, homo sapien
tccgagtattatattgccactatttmtttttctgatagcactttgtatac

SEQ ID NO: 79213 - DNA, 50 bp, homo sapien
ctcttggtacgttcctgggccttctwaagagttattaaatatttggaata

SEQ ID NO: 79214 - DNA, 50 bp, homo sapien
gtttgatttaggttccaatgttacayatgaaatgcaaggatctacatgtt

SEQ ID NO: 79215 - DNA, 50 bp, homo sapien
tgaaaatcacaactagaaattatcargtgtgagaaagaaagaaaagactg

SEQ ID NO: 79216 - DNA, 50 bp, homo sapien
ttagcttccttcagcacagctgaaasggtgttggagtgttctcagtccca

SEQ ID NO: 79217 - DNA, 50 bp, homo sapien
gtaggaagtatctttccttgttgaartgcaacccttattttgttcaggct

SEQ ID NO: 79218 - DNA, 50 bp, homo sapien
gaaattttgattcactctgtacttayactgtaggtttataaaactattaa

SEQ ID NO: 79219 - DNA, 50 bp, homo sapien
aaaatgttttaaaattccagattaaktgcacatttacttctttttttttc

SEQ ID NO: 79220 - DNA, 50 bp, homo sapien
atggttccatcaattagaagaagaakgcagtaattaggatgatactagtt

SEQ ID NO: 79221 - DNA, 50 bp, homo sapien
tgaaggatccctgggagtgattgtgyacctgagctgtggcttttgtctaa

SEQ ID NO: 79222 - DNA, 50 bp, homo sapien
ctatcagataaatcacttatctgtgrcaggtatacccttacaaaatatat

SEQ ID NO: 79223 - DNA, 50 bp, homo sapien
ctggactgtgccatctcgttacccaytggacttttcttaagagaaggaga

SEQ ID NO: 79224 - DNA, 50 bp, homo sapien
attcttggatccctaatgaatgtccraagtattcaatgtgttctcttaac

SEQ ID NO: 79225 - DNA, 50 bp, homo sapien
gttcatatcataaatgtagtaatgargatcatccttacaaaaatagaaaa

SEQ ID NO: 79226 - DNA, 50 bp, homo sapien
gaacgtatagagaagagtgcttttayagttttataccggatcagccatga

SEQ ID NO: 79227 - DNA, 50 bp, homo sapien
cttttcctttagactactctctacargtattttctgacgctatttaacaa

SEQ ID NO: 79228 - DNA, 50 bp, homo sapien
aatgaagactattcaccagtaatatytaaactatgcattattaattgcag

SEQ ID NO: 79229 - DNA, 50 bp, homo sapien
caatgggatgtgtaccttttatagtyaaaatagaagttattccaatgaac

SEQ ID NO: 79230 - DNA, 32 bp, homo sapien
gataagaggcttatttytaaactccttatctg

SEQ ID NO: 79231 - DNA, 50 bp, homo sapien
acccatgtctgttctctatttaatargtcgataagattaggaggtactaa

SEQ ID NO: 79232 - DNA, 50 bp, homo sapien
tagctcagatcttaacaaagggttaygacttacagacttttccacttaag

SEQ ID NO: 79233 - DNA, 50 bp, homo sapien
cttcacccacctcttcttacaaacawatattcagagattcacttgaattt

SEQ ID NO: 79234 - DNA, 50 bp, homo sapien
cttttacttttatgttgaacttttgygttccttcttggatagaagttctc

SEQ ID NO: 79235 - DNA, 50 bp, homo sapien
agggccgaagtaaacaaatgaccaasctataacattgaaagagaaattct

SEQ ID NO: 79236 - DNA, 50 bp, homo sapien
atcactcttccttttactgagtcttraaaataaggaaagcttctattgct

SEQ ID NO: 79237 - DNA, 50 bp, homo sapien
ctcaccacgttgttggagcttcctcrtctcccatttcgccttcttctaca

SEQ ID NO: 79238 - DNA, 50 bp, homo sapien
tagcctatgggaaaattgatttcatyatacatcatttcacttaatgttgc

SEQ ID NO: 79239 - DNA, 50 bp, homo sapien
aaagtggcacataaatgacaagtgaytcaataaataaatataaaataaat

SEQ ID NO: 79240 - DNA, 50 bp, homo sapien
tttcaaattatcacatgtacttgaaygaatctttagagcaagaactgcca

SEQ ID NO: 79241 - DNA, 50 bp, homo sapien
aaaaacccataactctctttaattcmcagaatcttaaggcattccctttt

SEQ ID NO: 79242 - DNA, 50 bp, homo sapien
tgcgcaccaatagcaacctaatacaygatgaattgaagatctacacttaa

SEQ ID NO: 79243 - DNA, 50 bp, homo sapien
tctgggatggagttagctttgtaacratttaggcgctacctcatccctag

SEQ ID NO: 79244 - DNA, 50 bp, homo sapien
gggaggattcctgccttcccgcaaawggcttcaagccaccaatggagagg

SEQ ID NO: 79245 - DNA, 50 bp, homo sapien
aaaaataaagcaataaagtgttcacrgaaaatcacagagtatattggtga

SEQ ID NO: 79246 - DNA, 50 bp, homo sapien
ctctcagatggatatgagctggaatycgacttttcttgcccttttcttgc

SEQ ID NO: 79247 - DNA, 50 bp, homo sapien
tgccattgccttggctctccagtgtrtgtaatgctggtgacataaataat

SEQ ID NO: 79248 - DNA, 50 bp, homo sapien
ccaaatgacttctcaaatttcaaacractacccagacttgcaaaattggt

SEQ ID NO: 79249 - DNA, 50 bp, homo sapien
gatctggattcctatgggtagatcayagtaacattatttgaaaaagaaag

SEQ ID NO: 79250 - DNA, 50 bp, homo sapien
atgaacaacaaacaagtaaacaacaygcaaacaagataattccagatgtg

SEQ ID NO: 79251 - DNA, 50 bp, homo sapien
attgctgaaatatgctatgatgttayggtgtttggaatgatagttgctat

SEQ ID NO: 79252 - DNA, 50 bp, homo sapien
agatccctctgctggtacagaagacratccattatctcacttccagacca

SEQ ID NO: 79253 - DNA, 50 bp, homo sapien
ttcacgcatcttgaatatcagcaatyaccaatgaacactcactttaacat

SEQ ID NO: 79254 - DNA, 50 bp, homo sapien
atttttttccagctacctctcttgamgtatttattattgagagtaattca

SEQ ID NO: 79255 - DNA, 50 bp, homo sapien
caaagggatccctaaaagggtgtcaygatttccaaaacatatttgataca

SEQ ID NO: 79256 - DNA, 50 bp, homo sapien
ttcattccattaatgttgattgagarccgactttgtgctacatttggaat

SEQ ID NO: 79257 - DNA, 50 bp, homo sapien
acagtcacagtacctggcaaatatasgcatttccacaaatgtttaccagt

SEQ ID NO: 79258 - DNA, 50 bp, homo sapien
gtttcgataattgcctaaatctgtayaacacaaacccctatcaaggcata

SEQ ID NO: 79259 - DNA, 50 bp, homo sapien
tagtcctcattttacagtttttctawatcttctgatatggggcctatact

SEQ ID NO: 79260 - DNA, 50 bp, homo sapien
aatgagacaaatgagaaagtgaataygatgtgatttaagtccctaggaac

SEQ ID NO: 79261 - DNA, 50 bp, homo sapien
gctatcaacaaacaaaggaatgagcraattttgacccatgtatacaacag

SEQ ID NO: 79262 - DNA, 50 bp, homo sapien
taaactatactttacctctctctgaygctcaatacttcttgtcccccatc

SEQ ID NO: 79263 - DNA, 50 bp, homo sapien
ctgtgttctgtaaagttggcttcacstttgggctggctttcctcatggga

SEQ ID NO: 79264 - DNA, 50 bp, homo sapien
caaaacttccagtttttgatgggacwtggctgcctagaataaagatattt

SEQ ID NO: 79265 - DNA, 50 bp, homo sapien
agatgcctctgtacacgagtcctcaygaagattgcaacctgactcagaca

SEQ ID NO: 79266 - DNA, 50 bp, homo sapien
acatgtcaagggaatcctcagggtayggtgagaaaactgactgatacctc

SEQ ID NO: 79267 - DNA, 50 bp, homo sapien
cctcttctgttcaacaggagtcaackgctaaagggccaacagcactgcat

SEQ ID NO: 79268 - DNA, 50 bp, homo sapien
caaggcaatcagagaggcttaagggyatcatgtgagatgtaaggaataaa

SEQ ID NO: 79269 - DNA, 50 bp, homo sapien
cctgccgttgatggtctgttgaaccrctccccgtctcactattccatgag

SEQ ID NO: 79270 - DNA, 50 bp, homo sapien
atgtgagatgtaaggaataaatagayagtagatcaggtggagagcagatc

SEQ ID NO: 79271 - DNA, 50 bp, homo sapien
aaacttgtgagtagatgttagcagartctctgtttaatttataaagattt

SEQ ID NO: 79272 - DNA, 50 bp, homo sapien
ctgaggaaggcacctcgagaaccacrgcactagagaaggccactcttatc

SEQ ID NO: 79273 - DNA, 50 bp, homo sapien
cctcccacacgactgttttgtcgcayctcggggtgtatttaatagaacca

SEQ ID NO: 79274 - DNA, 50 bp, homo sapien
cgaatgagagtggcactcctcattgrcattattaatttttgatatgaagt

SEQ ID NO: 79275 - DNA, 50 bp, homo sapien
atgctttctcataaaattggaacacygggtctcttgttggtgatggtggg

SEQ ID NO: 79276 - DNA, 50 bp, homo sapien
ctaagtgctacattcattgaagacawatctctttctccctactctagttt

SEQ ID NO: 79277 - DNA, 50 bp, homo sapien
tcagtgtgtgcagagtcattgaaaasaagtctggaagggtttgatgctat

SEQ ID NO: 79278 - DNA, 50 bp, homo sapien
aataactctaggaacttttttgggcrgcaaactctgactttttcttaaca

SEQ ID NO: 79279 - DNA, 50 bp, homo sapien
caaaaatagtgcaaagaattcctaartatccttcacccatattatgttaa

SEQ ID NO: 79280 - DNA, 50 bp, homo sapien
ctccacccttctgtactctcacgacrcattgtatgtatccagctctactg

SEQ ID NO: 79281 - DNA, 50 bp, homo sapien
agattttgggtaaagaactggcaatraagacaattctaaacggactaggg

SEQ ID NO: 79282 - DNA, 50 bp, homo sapien
attctaaacggactagggcattagayagattacccacaaggggcaggaca

SEQ ID NO: 79283 - DNA, 50 bp, homo sapien
gcattgtgggaagctagacacttgcrgcaagcacttaaacttcattttct

SEQ ID NO: 79284 - DNA, 50 bp, homo sapien
gctctcctgccagcatacctctgccrccttcatttgttcagtaaatattt

SEQ ID NO: 79285 - DNA, 50 bp, homo sapien
aaggggggtcagacactcctcattayaccttcttccctttggaattcagg

SEQ ID NO: 79286 - DNA, 50 bp, homo sapien
aaaaatcacaaaaccattgcaaataycaacaccagcgatggcttccaacc

SEQ ID NO: 79287 - DNA, 50 bp, homo sapien
aggtgactgaaaatggcagggttaamtatattttgtgaattacaaaaatg

SEQ ID NO: 79288 - DNA, 50 bp, homo sapien
agcctgggttgtccactcaagccgaygggctcacctaacagttccaggtt

SEQ ID NO: 79289 - DNA, 50 bp, homo sapien
agagtagtcaggaaactataagccamggtttacatggttattgggcctca

SEQ ID NO: 79290 - DNA, 50 bp, homo sapien
gctggcaggtggaggaggtgtcacaygttttggtaaactccaagagggga

SEQ ID NO: 79291 - DNA, 50 bp, homo sapien
ctgtctgctcaattaaagatgtttgwatccaaaggaagtcaaggaagaaa

SEQ ID NO: 79292 - DNA, 50 bp, homo sapien
agcttcccgttcatttagctcagtgmgtcccaggatgtctctgtactgtt

SEQ ID NO: 79293 - DNA, 50 bp, homo sapien
catacattgcaggatgccttgggtcrttggtcccattccactacagtcat

SEQ ID NO: 79294 - DNA, 50 bp, homo sapien
tgacacatcagaggccagtgtatgawctccagattaaaaatccctgcctt

SEQ ID NO: 79295 - DNA, 50 bp, homo sapien
aaaaagtctcaaataaacagtctaamctcatacctcaaggaactagaaca

SEQ ID NO: 79296 - DNA, 50 bp, homo sapien
aacctcctgctgcaatctttgtaatsacctctcttagggaccttgggaaa

SEQ ID NO: 79297 - DNA, 50 bp, homo sapien
acaaatgaaagtagactaatggatamaataaggcagatgatcagttgaac

SEQ ID NO: 79298 - DNA, 50 bp, homo sapien
aaaagtttgacttatgccattcaagrataaaaatgattagaggtacgtga

SEQ ID NO: 79299 - DNA, 50 bp, homo sapien
ctacaatctgtgaggagagttttgcraaggtgagaattcacttcccagaa

SEQ ID NO: 79300 - DNA, 50 bp, homo sapien
cataagttctctatttttggcagatratataaccaagaagaaaagctaat

SEQ ID NO: 79301 - DNA, 50 bp, homo sapien
tttaaaacacagaaatgacacatatraaagtgattataccctcactgtaa

SEQ ID NO: 79302 - DNA, 50 bp, homo sapien
acagaaccaggctcaaatatgatatraaagttagaatctaagaccaagaa

SEQ ID NO: 79303 - DNA, 50 bp, homo sapien
cagtggtgatcatctatttttatccwtcttccttcatttgttaattggaa

SEQ ID NO: 79304 - DNA, 50 bp, homo sapien
ataatggagacacaaccatgacacartgtaaaatgtggaaatcctctcaa

SEQ ID NO: 79305 - DNA, 50 bp, homo sapien
ttagtcactagagaatgccagttacwcctataatgagataatacctcacc

SEQ ID NO: 79306 - DNA, 50 bp, homo sapien
acttttcctttatatgctgtgtaagkcctgttcctctttccctacaacag

SEQ ID NO: 79307 - DNA, 50 bp, homo sapien
gaatgcttttatggctaatttgacaratctgtttgatgttaatctctgta

SEQ ID NO: 79308 - DNA, 50 bp, homo sapien
cactgctgttggggccttttccaaaygccatatatctaacataatgatat

SEQ ID NO: 79309 - DNA, 50 bp, homo sapien
gttttctgaatatgactgagttctcrcaccgtagcaagaagcaatcattt

SEQ ID NO: 79310 - DNA, 50 bp, homo sapien
ttgccattttgtggctattttataakaaggtatcttcagtgcagaaaatc

SEQ ID NO: 79311 - DNA, 50 bp, homo sapien
acaaataaaaaagaactagtcagccyatatgtaacacatattcaacaaat

SEQ ID NO: 79312 - DNA, 50 bp, homo sapien
agaattccatgtttgctccatggccrctgagctgcttttctcctgaacga

SEQ ID NO: 79313 - DNA, 50 bp, homo sapien
tgtcaacactttctaattttaataaygctgtataatgaagagagaacaca

SEQ ID NO: 79314 - DNA, 50 bp, homo sapien
gctgagcaattttgggcaggacctaytagcaaagctcaaaatccatcttg

SEQ ID NO: 79315 - DNA, 50 bp, homo sapien
gtcccagttcatctctttgaggaaayaaagggctctaggggtgaaggaag

SEQ ID NO: 79316 - DNA, 50 bp, homo sapien
caagggaaaaatgtcaagaatcaaaraatgatcaaccctgtcataccaca

SEQ ID NO: 79317 - DNA, 50 bp, homo sapien
ggcaaaatatagcctgaaatagaaaycacataataaaaaaaaaattaatc

SEQ ID NO: 79318 - DNA, 50 bp, homo sapien
taatttttccccctcactgttaaaawgaaatgatgtcaaaggaaaggatg

SEQ ID NO: 79319 - DNA, 50 bp, homo sapien
cagtgactgattatctggagtcaggrttcttctttagcagtggaatgcag

SEQ ID NO: 79320 - DNA, 50 bp, homo sapien
aaatccaaggtcaaagaagactgaayagccagataattgttttgagcaga

SEQ ID NO: 79321 - DNA, 50 bp, homo sapien
tgtctcctatcttggaatatttaatyacccgtttataactagattgtaaa

SEQ ID NO: 79322 - DNA, 50 bp, homo sapien
atggtagatgctcaggattcactaarttaaactggagaatggtctcaatt

SEQ ID NO: 79323 - DNA, 50 bp, homo sapien
tcaggtgatgcctccatatcttgcartacctggtctaaaacaggcctaag

SEQ ID NO: 79324 - DNA, 50 bp, homo sapien
ccttctccgtagtaactgtttatgakcagtgcttttatttaaccaggaaa

SEQ ID NO: 79325 - DNA, 50 bp, homo sapien
ttctgttcaaagatgaccctacttaygggaaacagatggaattttctccc

SEQ ID NO: 79326 - DNA, 50 bp, homo sapien
taagactcccttttttgtctgatccragtttatcttgcttcaatttaaat

SEQ ID NO: 79327 - DNA, 50 bp, homo sapien
gcacttagataccacagtgatagacrccatctaaatacatagacagatag

SEQ ID NO: 79328 - DNA, 50 bp, homo sapien
gtttcaaatgcgtaattttttgatasactacatttgaaatgcaacattgc

SEQ ID NO: 79329 - DNA, 50 bp, homo sapien
tctaaatttacaaaataagccttatraaacaaaattagccaatttcacta

SEQ ID NO: 79330 - DNA, 50 bp, homo sapien
atagttacacatcaccgtattgcacrggagaacatattccatatactctt

SEQ ID NO: 79331 - DNA, 50 bp, homo sapien
tttgaagtggaatacagtaactaaayagaattaaaatgtggggaaaataa

SEQ ID NO: 79332 - DNA, 50 bp, homo sapien
tggcccataaaggtttgagtcagctyactaaaaaaaaatgtaatatttaa

SEQ ID NO: 79333 - DNA, 50 bp, homo sapien
attgccgggcaatccagagagaccaktacaggagagtcacagggtgaaag

SEQ ID NO: 79334 - DNA, 50 bp, homo sapien
ttttgaagttaaatttaaatcagaartattagcttcactcatgattttga

SEQ ID NO: 79335 - DNA, 50 bp, homo sapien
cttctagacagcagcagacctgtaargagatggaactttaacctcattca

SEQ ID NO: 79336 - DNA, 50 bp, homo sapien
ttttaaaaatctaccaaacaattctsaaaaattattatgtcacactattt

SEQ ID NO: 79337 - DNA, 50 bp, homo sapien
gccatattattctgcttttgccactkaggtgttaatagtgtttaaaaata

SEQ ID NO: 79338 - DNA, 50 bp, homo sapien
tgaggagacagaaagatgttctgcaygtgagctctcttagtagatagtgg

SEQ ID NO: 79339 - DNA, 50 bp, homo sapien
taatgaatctcattcagctgttacamtggaattcagaaacacaagagagt

SEQ ID NO: 79340 - DNA, 50 bp, homo sapien
tttcctactattaaaaggctgaaagragaggccataaagttcacaatata

SEQ ID NO: 79341 - DNA, 50 bp, homo sapien
atcactgttgagtatgctgtgcagcrgttatccctttatgtgaggcatat

SEQ ID NO: 79342 - DNA, 50 bp, homo sapien
tatatgtggttctattttagtgcaayagtggttttgtaaaccgggtctgt

SEQ ID NO: 79343 - DNA, 50 bp, homo sapien
aatttcatcctatcatttaggtcaaygatagaaacatacaagcactcaga

SEQ ID NO: 79344 - DNA, 50 bp, homo sapien
tagagtaaagttaaagtcaccataasccggcaatagccattcattggctt

SEQ ID NO: 79345 - DNA, 50 bp, homo sapien
ccgttttctctcttcctgctcttgaraattaacagtccataggaagcaaa

SEQ ID NO: 79346 - DNA, 50 bp, homo sapien
ggtgtagattgttccacttcttgaaytgtaaagcccaacctctagaaagg

SEQ ID NO: 79347 - DNA, 50 bp, homo sapien
taggccaagaaacttggtacccaggkattttgctaagtcagtttttgtat

SEQ ID NO: 79348 - DNA, 50 bp, homo sapien
gttgatcccattttccagtagttcartaatcattcataagtccggaaaga

SEQ ID NO: 79349 - DNA, 50 bp, homo sapien
tcaaggagtatcatccaggaataaamagatttagagtcagacctgcattt

SEQ ID NO: 79350 - DNA, 50 bp, homo sapien
accttccagtacatgggacttgaaayggatgtacatgggtgttcatgtgt

SEQ ID NO: 79351 - DNA, 50 bp, homo sapien
ttggcacttccatgtttaatagaggmacctacaggatgttacctatgtga

SEQ ID NO: 79352 - DNA, 50 bp, homo sapien
tcttgctttaccgcagactgaccgargtgcctagagaggaatatgccctc

SEQ ID NO: 79353 - DNA, 50 bp, homo sapien
gaaatgtcaggaagccattcttgagstaagtaagaagtagtaagttcatg

SEQ ID NO: 79354 - DNA, 50 bp, homo sapien
atttatgtttatatttcagtagaacmaatggtatcaacccctctgtttcg

SEQ ID NO: 79355 - DNA, 50 bp, homo sapien
tgtgggatgcattcttgatactggayactgaggacgcaaaggccatggag

SEQ ID NO: 79356 - DNA, 50 bp, homo sapien
gtaggcgctcatattctgagaaacarcaaacttgaatctcattctcctct

SEQ ID NO: 79357 - DNA, 50 bp, homo sapien
tcacttgcaacagaaagagaactaayaatttcacacacagtgggacttac

SEQ ID NO: 79358 - DNA, 50 bp, homo sapien
cctgagagcagccccaggttctaaayaagtcatcatccaactcagccaga

SEQ ID NO: 79359 - DNA, 50 bp, homo sapien
tagcagaatgttttcatattctgctrtaaattaaacagtacagaggggca

SEQ ID NO: 79360 - DNA, 50 bp, homo sapien
agactattaaaattacttatcatcaraagtcagaggaaaccagaacaact

SEQ ID NO: 79361 - DNA, 50 bp, homo sapien
tcaattagcaggcagaggcttcagcrtaagatcccacagcttttagggaa

SEQ ID NO: 79362 - DNA, 50 bp, homo sapien
tgactcacttttgccttttacattcraataaattgttttgtactccaaga

SEQ ID NO: 79363 - DNA, 50 bp, homo sapien
tttcctccatggagctacaacttacsatatcttccttcccccattctctg

SEQ ID NO: 79364 - DNA, 50 bp, homo sapien
gtgattggatggggttggctcctagyacgtagaactacagttattatcat

SEQ ID NO: 79365 - DNA, 50 bp, homo sapien
tttggactgcttcatcgtagctagasaaattttgctcagttaattccagg

SEQ ID NO: 79366 - DNA, 50 bp, homo sapien
gtagggggctgatagccaatctcaamacgcagatctctgtctttattgga

SEQ ID NO: 79367 - DNA, 50 bp, homo sapien
gatatggcctgaactaaggtgagcarctggaatagaaagaagtgaagggt

SEQ ID NO: 79368 - DNA, 50 bp, homo sapien
ttaatattctgcctggcagtaaagastaaattttcttcccactccagatc

SEQ ID NO: 79369 - DNA, 50 bp, homo sapien
ctgctctacctggcagtgttcatcayctcttgaacttgctttgacaaact

SEQ ID NO: 79370 - DNA, 50 bp, homo sapien
caccctgtgcttcagtacaatatgargtgcttgggccagatccaaatgtc

SEQ ID NO: 79371 - DNA, 50 bp, homo sapien
tagaaggaggggatagtcagatactmggcaagaaccaggaaccctaagga

SEQ ID NO: 79372 - DNA, 50 bp, homo sapien
tcaatgtaactatttattataagaamaccagtgtacacaaaagtgctaat

SEQ ID NO: 79373 - DNA, 50 bp, homo sapien
cattctagtttccaaacaggataacrattgacacttaacatttattttat

SEQ ID NO: 79374 - DNA, 50 bp, homo sapien
aaagcttttattttcaaatcttaagkcagcattttctccagatgggacct

SEQ ID NO: 79375 - DNA, 50 bp, homo sapien
ttagtgtcatcatcagatttatttaygttacgttattgtgaaagactctg

SEQ ID NO: 79376 - DNA, 50 bp, homo sapien
cagagaggaggaggtaaatgagagakaagtaggactggcaaaattagaga

SEQ ID NO: 79377 - DNA, 50 bp, homo sapien
agaaggcttgaataaacactaaataygaaaatgagacataaccagagatg

SEQ ID NO: 79378 - DNA, 50 bp, homo sapien
cttgaaagtgcaagtttcgcaattaygaaaaattggatatcctcatggtc

SEQ ID NO: 79379 - DNA, 50 bp, homo sapien
gcacttagtccccaattattcttccrattattctgtagtaccgacagtct

SEQ ID NO: 79380 - DNA, 50 bp, homo sapien
gagattattagttgacataagctccrataaaggtacagaaatgaaaatat

SEQ ID NO: 79381 - DNA, 50 bp, homo sapien
ggatgactttggagctatgtagatcygagtagtaattcacgagtttccta

SEQ ID NO: 79382 - DNA, 50 bp, homo sapien
cagcaccagtgcttgctgcttacaaycaagaaactctacagaagacataa

SEQ ID NO: 79383 - DNA, 50 bp, homo sapien
aacaatgaagaatggtttgtatctgkttattaaaagttactcaactgcta

SEQ ID NO: 79384 - DNA, 50 bp, homo sapien
tgactcaaagacaggcgattatagargctcatagggcaactgcgtttgtg

SEQ ID NO: 79385 - DNA, 50 bp, homo sapien
taccagtttttctttcattgtgggarttttaagcattttatcttgttaaa

SEQ ID NO: 79386 - DNA, 50 bp, homo sapien
tttcccagtttggtgatacaacaacrcttggagaattcaaagcctcttat

SEQ ID NO: 79387 - DNA, 50 bp, homo sapien
tcatcaaactacatcctagtcaacaygttttattttagctacttacataa

SEQ ID NO: 79388 - DNA, 50 bp, homo sapien
ggttttgattacctatgactgacacyggcccaaatgacttggtatggaca

SEQ ID NO: 79389 - DNA, 50 bp, homo sapien
ttccaaaaagcaaaacttcaacttamcacgtgccgagtaccatgttaaat

SEQ ID NO: 79390 - DNA, 50 bp, homo sapien
gcagtgtcaaggccttgggatctccractcaatttctgtcttttctgtca

SEQ ID NO: 79391 - DNA, 50 bp, homo sapien
atccgaatggaggaccaagtaatcayacagcggttacatcgctgacgtcc

SEQ ID NO: 79392 - DNA, 50 bp, homo sapien
ttaacatgtgcaatgcatatacatgygggagaaactcagagatgagtaat

SEQ ID NO: 79393 - DNA, 50 bp, homo sapien
agacatactaaagcttttaaaacaakccatgtgttagtctcatgaccagg

SEQ ID NO: 79394 - DNA, 50 bp, homo sapien
agctactaaagccttttataactaawccacaaaggctgcttactgatgaa

SEQ ID NO: 79395 - DNA, 50 bp, homo sapien
gaccacagagtaccttgaaagtcacrgtaaggagccattggagggacttc

SEQ ID NO: 79396 - DNA, 50 bp, homo sapien
gtgtgaacgactcccctattcaagcrcaagttctgagtcaacttctcaat

SEQ ID NO: 79397 - DNA, 50 bp, homo sapien
ggtttatattcagaatatacaaagayctataaaccaatgagaaaaagact

SEQ ID NO: 79398 - DNA, 50 bp, homo sapien
aaaggatgggccagtgagatgctatygatgttgctagttgctttgggcca

SEQ ID NO: 79399 - DNA, 50 bp, homo sapien
ggcacctcattatggttttaatttgygtccctaatagctaatgattttgg

SEQ ID NO: 79400 - DNA, 50 bp, homo sapien
ttggttaaaaatgacaaaaagacttmaaatggacttgtcaggagtgtgct

SEQ ID NO: 79401 - DNA, 50 bp, homo sapien
caattggaaaacgggataaaagatakgaagagacactacaccagagagtg

SEQ ID NO: 79402 - DNA, 50 bp, homo sapien
ttgtttaaaaaggctgaatgtttcaraagacgctttcattgaattagaag

SEQ ID NO: 79403 - DNA, 50 bp, homo sapien
aagatactagtaaaccgtaatgtccrcacatggatgcatctaatccttac

SEQ ID NO: 79404 - DNA, 50 bp, homo sapien
ctccacacactctgtactttttgaaytgggttgtttccatttaaggaagg

SEQ ID NO: 79405 - DNA, 50 bp, homo sapien
taggatattcatgcctttcctataayaatgttttctgaagttatgtaata

SEQ ID NO: 79406 - DNA, 50 bp, homo sapien
ttcctacagttaaaggcaattattgraaaggaactcagctgttaggagtc

SEQ ID NO: 79407 - DNA, 50 bp, homo sapien
caatcaaaggacttctaattcatgcwcttatcgtctgaccgaaataaagc

SEQ ID NO: 79408 - DNA, 50 bp, homo sapien
tgttattatgttccttgaatgagtayagggctttattttagtgcttatgt

SEQ ID NO: 79409 - DNA, 50 bp, homo sapien
acatttgggagccatggtggtaagcrgatttaagagtctgaggtctggtc

SEQ ID NO: 79410 - DNA, 50 bp, homo sapien
ctgtaccctgcagcgccagcacaaarctaagtctgtcttaatggccggat

SEQ ID NO: 79411 - DNA, 50 bp, homo sapien
caatttaaaaacagttaaatgcataraacaaagcagtagcacaaataaaa

SEQ ID NO: 79412 - DNA, 50 bp, homo sapien
cagagagttgaataagggagaaaaartctttggagagcttgaaattcttt

SEQ ID NO: 79413 - DNA, 50 bp, homo sapien
gcacttggacatcacctcctcacacyggaacagccaggctggcttagggt

SEQ ID NO: 79414 - DNA, 50 bp, homo sapien
gttcagctattttgccacagccatarcgccatcaccaagaacagctctgc

SEQ ID NO: 79415 - DNA, 50 bp, homo sapien
agggagaaagtcttgaatagacttakaatatgacccagtgaagaaatttt

SEQ ID NO: 79416 - DNA, 50 bp, homo sapien
tgtggttgaagattgggaatttttaygtacctgtgtggtagcacatagcc

SEQ ID NO: 79417 - DNA, 50 bp, homo sapien
catcgaagtctcaaatgtagtgtccmagatgagaaatgtcattcaggaat

SEQ ID NO: 79418 - DNA, 50 bp, homo sapien
aacatgaaacaataaaatgaggccayggaagaactttagaaggtcataat

SEQ ID NO: 79419 - DNA, 50 bp, homo sapien
caatacaaatggaagctacttttacygatcatccatcaggcatttttgga

SEQ ID NO: 79420 - DNA, 50 bp, homo sapien
cttggttggattataatatctctctsaaggaaaaataagaatattaggat

SEQ ID NO: 79421 - DNA, 50 bp, homo sapien
cagttccaaatgtggattcaaagtakagttaaacacacagcaatagtttt

SEQ ID NO: 79422 - DNA, 50 bp, homo sapien
aaggaaaatgtctgaaaaacgcaggyaattggaaattaagattgtggatg

SEQ ID NO: 79423 - DNA, 50 bp, homo sapien
gatgttgaaggagatgcagaaactaycagaggccgttcagctaattgaga

SEQ ID NO: 79424 - DNA, 50 bp, homo sapien
gcctagaatcatggtggttctggaakaattcaaatcaagatcaaattcta

SEQ ID NO: 79425 - DNA, 50 bp, homo sapien
ataattctcacttacttttcatatcractctaagatgtaggttttattat

SEQ ID NO: 79426 - DNA, 50 bp, homo sapien
gtgtagtagtgttgtgtctgaaaacmatgtacataccttaatttaaaaat

SEQ ID NO: 79427 - DNA, 50 bp, homo sapien
tcttccaacccaacttgtacaggaayaccatagcagtttttccaaaatac

SEQ ID NO: 79428 - DNA, 50 bp, homo sapien
gctgggatgccaaggggttattataraagtatgaggttgtattcctctag

SEQ ID NO: 79429 - DNA, 50 bp, homo sapien
actccacaggccactgcaccacctcrgaggcgatcactttgctcattccc

SEQ ID NO: 79430 - DNA, 50 bp, homo sapien
tgtgaatgaaacacattacgtggcgrtcccaattcagaatggttgcactt

SEQ ID NO: 79431 - DNA, 50 bp, homo sapien
tttctatttgcttctcataatactcracacttagacatactatactttta

SEQ ID NO: 79432 - DNA, 50 bp, homo sapien
cataaagcacacttttattaacatcragaaatggatcattaaatacatac

SEQ ID NO: 79433 - DNA, 50 bp, homo sapien
tgaatggtgttaccctctaaaactayagacagttcctgaaaggagatcaa

SEQ ID NO: 79434 - DNA, 50 bp, homo sapien
atcaaacatacagaacaggttgtgaygagttttatgtctgcttgcttgtg

SEQ ID NO: 79435 - DNA, 50 bp, homo sapien
tatacacggtcagtgaataagttacrtatacatggcgattaaaacagtac

SEQ ID NO: 79436 - DNA, 50 bp, homo sapien
tctttaaactcttcatgtggagatamcaaaatgagtacagcttcaatgat

SEQ ID NO: 79437 - DNA, 50 bp, homo sapien
tattgtaatctctacagcaatcacawaaagaatagagaagggatatgtaa

SEQ ID NO: 79438 - DNA, 50 bp, homo sapien
ttattccctgcacgatcatgctttayctaggatcattttcttttgccaaa

SEQ ID NO: 79439 - DNA, 50 bp, homo sapien
gctttccattcttcccccatctttayggagctctttattcatcgtgtgtg

SEQ ID NO: 79440 - DNA, 50 bp, homo sapien
ccttttgactttcctgaagatactcyaattatgtatgctagacctgccat

SEQ ID NO: 79441 - DNA, 50 bp, homo sapien
agcgtttctgatacttagtccatgaytttcccttgcttggatatttgtcc

SEQ ID NO: 79442 - DNA, 50 bp, homo sapien
gccattgaaggaagcaaagaaaataytcagttaattataaggacaaatat

SEQ ID NO: 79443 - DNA, 50 bp, homo sapien
ataacctgcaaatcatgcagaaaaartataatcatccctcagtatccagg

SEQ ID NO: 79444 - DNA, 50 bp, homo sapien
ggagatgcttctttcttctgtaaaaktatcacctataatgcacactgtca

SEQ ID NO: 79445 - DNA, 50 bp, homo sapien
ccttgctcgtagtagctgcctttcayagactacattccctgtgtcattca

SEQ ID NO: 79446 - DNA, 50 bp, homo sapien
atgcacttatttatttatttaactcyatacaaagaacattttctgaagag

SEQ ID NO: 79447 - DNA, 50 bp, homo sapien
gaaatggtgactagccccagcataaygtttcttcaattttttaaaaacca

SEQ ID NO: 79448 - DNA, 50 bp, homo sapien
tttcctttctctctttgactctgackactcttgatatataaacgagatac

SEQ ID NO: 79449 - DNA, 50 bp, homo sapien
tatggtggaaacataccgggcagtcrgaatcagaggacatggggacagtg

SEQ ID NO: 79450 - DNA, 50 bp, homo sapien
agaactgatgcttcaagaagatgaasaaagtttgagcaacagtgtgcagt

SEQ ID NO: 79451 - DNA, 50 bp, homo sapien
tgttacaccaaatgccactgaaggcrcgagttagggaagccacccatcaa

SEQ ID NO: 79452 - DNA, 50 bp, homo sapien
ctcttgccccattgtcaaagagacayctatcatttatcaaagtactatta

SEQ ID NO: 79453 - DNA, 50 bp, homo sapien
atatggctcatttatcaaaatgtcaraagcacaattaactcaaactttca

SEQ ID NO: 79454 - DNA, 50 bp, homo sapien
agagggaggtatataaaaatactgarcttgaaggacataaaaatgtgttg

SEQ ID NO: 79455 - DNA, 50 bp, homo sapien
ctaccagacagaagtcgcaacaaacragttgagttccagacaatatggct

SEQ ID NO: 79456 - DNA, 50 bp, homo sapien
aatggagccttgaaataaaacatgayctggctggtatttattgaagctgt

SEQ ID NO: 79457 - DNA, 50 bp, homo sapien
tttgcattaatatatattataaactsaatgatttcttaaatgatgtcaaa

SEQ ID NO: 79458 - DNA, 50 bp, homo sapien
ttttttatgtcataagtggtataacygtatgatgtcagtaggttttgaac

SEQ ID NO: 79459 - DNA, 50 bp, homo sapien
agaaaggagacgttaagactggccamaattgatgtcaattatcttgggac

SEQ ID NO: 79460 - DNA, 50 bp, homo sapien
aagaactgctttatttcctgctcaaracaatattaagtagtgatcagatt

SEQ ID NO: 79461 - DNA, 50 bp, homo sapien
tcacatcttgtgaaatacacatgtamgtgcagtatcgtgatgtaaaatgt

SEQ ID NO: 79462 - DNA, 50 bp, homo sapien
cttaatagtttttccatttcacaatwacttattctaaagcaatactaggt

SEQ ID NO: 79463 - DNA, 50 bp, homo sapien
ggtttccttttgaaaaggtttattakatcattaatggtaccttagcacag

SEQ ID NO: 79464 - DNA, 50 bp, homo sapien
attctgacatgacagttgttgggaaytaaacagagattttccctctttaa

SEQ ID NO: 79465 - DNA, 50 bp, homo sapien
gaataagtattcctatggttttcaayaagcctcattactatctattgcta

SEQ ID NO: 79466 - DNA, 50 bp, homo sapien
tacaaggtgatttgtcattatttcargtcattagttcttaagtgtttaaa

SEQ ID NO: 79467 - DNA, 50 bp, homo sapien
ttcaagaatggaaaacaatcaaaaartggcttatgaactagaggcgcagg

SEQ ID NO: 79468 - DNA, 50 bp, homo sapien
gggcttagaatgtctctcaactgtaygtcagaagtcccacttgttaaatt

SEQ ID NO: 79469 - DNA, 50 bp, homo sapien
tttgttggttttctttcttcctgccrtctttttggaattttaatttataa

SEQ ID NO: 79470 - DNA, 50 bp, homo sapien
ctttttgacatgaaattactatatawtagaactgcagccttcaatctttc

SEQ ID NO: 79471 - DNA, 50 bp, homo sapien
ttagtaactgggtcagcatgttgacsataacagcagagatgctgtaaacc

SEQ ID NO: 79472 - DNA, 50 bp, homo sapien
acatgctaaagagttttaattataaygcttagatagtgcaacttccatat

SEQ ID NO: 79473 - DNA, 50 bp, homo sapien
taactctgcaacagctttacaattayagagattagagaaccattagaatt

SEQ ID NO: 79474 - DNA, 50 bp, homo sapien
tataaatatcacaattatatcactasagtaaactttagatttcttttccc

SEQ ID NO: 79475 - DNA, 50 bp, homo sapien
attggcggaagtatgtattctctgargtatgaatgtctaggacttatcca

SEQ ID NO: 79476 - DNA, 50 bp, homo sapien
ctggatgctaagaacctaactgacartgtagcagagatttacctccaggt

SEQ ID NO: 79477 - DNA, 50 bp, homo sapien
gccaaccagcttttattactagggcragggtacccagcatctatttttaa

SEQ ID NO: 79478 - DNA, 50 bp, homo sapien
aatttctgctcttaaatgtagaggaygtcttagaaagaatgagtgtggta

SEQ ID NO: 79479 - DNA, 50 bp, homo sapien
gaagaaaaaaattctaaagcttaaayctgttgaatagatgcttaattgct

SEQ ID NO: 79480 - DNA, 50 bp, homo sapien
gtagcccacctatggagacacaagargtaaagttgccaggtgacagagaa

SEQ ID NO: 79481 - DNA, 50 bp, homo sapien
tggtaaatacttaatgaatttcaccyaacgctagaaaaatgggaaaggaa

SEQ ID NO: 79482 - DNA, 50 bp, homo sapien
actctttcttaccttttggtttataygagtgaaggaaatcttcaatacaa

SEQ ID NO: 79483 - DNA, 50 bp, homo sapien
aggttaaagggtatatctcacatacrcttcttcttttctgacatttcaaa

SEQ ID NO: 79484 - DNA, 50 bp, homo sapien
attgcatggactcctcattataagcygagtgctacagtaaaactgtggaa

SEQ ID NO: 79485 - DNA, 50 bp, homo sapien
agtgtgcagaactactttgctccaartgttttgtcaataatttaaacatg

SEQ ID NO: 79486 - DNA, 50 bp, homo sapien
ttaggctgagtgtaaattgttccaaraatattatacatgttgggatttca

SEQ ID NO: 79487 - DNA, 50 bp, homo sapien
aagtggaatggaagtcagttaattaraagcctcactacaaatacatgggt

SEQ ID NO: 79488 - DNA, 50 bp, homo sapien
aattagtcttgtggagtatttctaartggcttaattctcgtttttcacca

SEQ ID NO: 79489 - DNA, 50 bp, homo sapien
ttcacatagagtacctatccttttawttgcttatagtgtggtttccaaga

SEQ ID NO: 79490 - DNA, 50 bp, homo sapien
ggaacaactgaatatgttaatagaaygagaaaaccttatcaaattcctaa

SEQ ID NO: 79491 - DNA, 50 bp, homo sapien
tctcccattgttagcaattaggcaargacattagtgacagaggggcatcc

SEQ ID NO: 79492 - DNA, 50 bp, homo sapien
aacagtccagctgctatggaaaacaytacacggaactactcaaaaaatta

SEQ ID NO: 79493 - DNA, 50 bp, homo sapien
aagtgtccattcacatttaatataaycatagttacggctgggtttacatc

SEQ ID NO: 79494 - DNA, 50 bp, homo sapien
ctacagtacatcagttaatgagagayattttccgaagcttggcagaacag

SEQ ID NO: 79495 - DNA, 50 bp, homo sapien
tagagtgcggtagaatcttcgaggarcttaacgaatgattgccccgggaa

SEQ ID NO: 79496 - DNA, 50 bp, homo sapien
aataaaaatgaaaataaatgtataarataacttctcattctagtacagtt

SEQ ID NO: 79497 - DNA, 50 bp, homo sapien
tccaaatcctctccctgagagcagargtgataatcaaataataactggca

SEQ ID NO: 79498 - DNA, 50 bp, homo sapien
ttctacaatcatcctgtacagggacragaaatggaaccagcctgcatcag

SEQ ID NO: 79499 - DNA, 50 bp, homo sapien
tgtgaaaaacacataggcaagataastagcccaatctagggaatttgaca

SEQ ID NO: 79500 - DNA, 50 bp, homo sapien
ttccaaatatttctcaggctacctayggtcagtgaattggatgaaatcaa

SEQ ID NO: 79501 - DNA, 50 bp, homo sapien
caaagcagtcgtttgatatttatagraaacattaatttaggtattattct

SEQ ID NO: 79502 - DNA, 50 bp, homo sapien
aattacccaccctgagaaagtgtcaygagatcggcaactgggatgcgcag

SEQ ID NO: 79503 - DNA, 50 bp, homo sapien
gggttcttaaaggaactgttaaccaytatgcattttggctatctctcttt

SEQ ID NO: 79504 - DNA, 50 bp, homo sapien
ttaacagggcatactaaaactaatgractgaggaccaatatacacttcta

SEQ ID NO: 79505 - DNA, 50 bp, homo sapien
aagcattaggtttattccgttaagcracaataatgatcgtgatctcaaaa

SEQ ID NO: 79506 - DNA, 50 bp, homo sapien
aaatgaatctgagctttcactgatcrataaccacacacaaatgtttgatt

SEQ ID NO: 79507 - DNA, 50 bp, homo sapien
taaattagttgctgaatttaaaatakctctctcagttccaaggttgaaag

SEQ ID NO: 79508 - DNA, 50 bp, homo sapien
gactaaaacgtaatttcctcatagawgaatacagcagattaggtaaaagt

SEQ ID NO: 79509 - DNA, 50 bp, homo sapien
ctgctaacattctgcaagtaataaaytcctacttatgcatctgtggatat

SEQ ID NO: 79510 - DNA, 50 bp, homo sapien
tgggtgtctgagaaagatgaagagaraggcatcgtttattctgagaatgt

SEQ ID NO: 79511 - DNA, 50 bp, homo sapien
ataccgattagttgccataaaataaycaagaaagagagagaagaaagagt

SEQ ID NO: 79512 - DNA, 50 bp, homo sapien
aagattagaaatggagtcactaaacracagtgcaaaggaactgcgaaaac

SEQ ID NO: 79513 - DNA, 50 bp, homo sapien
atgtttgtcatatatttctgtattayatcctttgtcaattttagtaagtt

SEQ ID NO: 79514 - DNA, 50 bp, homo sapien
aaaaagtgctctccagatgtaaaggyattagtccatacattttaggtcat

SEQ ID NO: 79515 - DNA, 50 bp, homo sapien
agtttcctgagccataaatagctaayactcaaaatcctctttcattataa

SEQ ID NO: 79516 - DNA, 50 bp, homo sapien
aattctctgataatgcaaatatctaygacctaaaatgtatggactaatgc

SEQ ID NO: 79517 - DNA, 50 bp, homo sapien
tctaacatacactcaaattttttgcwctttttcatgaccagtgattgtgc

SEQ ID NO: 79518 - DNA, 50 bp, homo sapien
tctgggaaactgaaaaataataatamgccatgaatacctctatttttatg

SEQ ID NO: 79519 - DNA, 50 bp, homo sapien
gcagtaccttgagttacttggtagaraagaccagataaatgtagtaactg

SEQ ID NO: 79520 - DNA, 50 bp, homo sapien
aagagactgaaaaaggcgtatcaaargaaaacaagagtagttattcaaac

SEQ ID NO: 79521 - DNA, 50 bp, homo sapien
ctccaagttgaacctagtggcaccawcaggattgtcagagccaaaatcta

SEQ ID NO: 79522 - DNA, 50 bp, homo sapien
agttaaaatctgtacttgtcttgaasgtcatccttggtcagctctggggt

SEQ ID NO: 79523 - DNA, 50 bp, homo sapien
agagtgggtttttaatgcaagaaaayactactatgatgtgtttagctgag

SEQ ID NO: 79524 - DNA, 50 bp, homo sapien
aggagggtgaagtaagtgaacactaygagaaataccctttaaaataggct

SEQ ID NO: 79525 - DNA, 50 bp, homo sapien
atggcattctccctgtgtcatgtctktgtccagatgtccactttttataa

SEQ ID NO: 79526 - DNA, 50 bp, homo sapien
atattggactatgacccaccctatcytagtatgacttcaccttgattaat

SEQ ID NO: 79527 - DNA, 50 bp, homo sapien
taataagtgagttcacattcagttasgtcaaatgaaatctggttgtttaa

SEQ ID NO: 79528 - DNA, 50 bp, homo sapien
atttccttgagttattattaagcaaygtgaagtaggactagaaagctata

SEQ ID NO: 79529 - DNA, 50 bp, homo sapien
gatctccacatatgggccctacaccragagtatcaccattccccagggaa

SEQ ID NO: 79530 - DNA, 50 bp, homo sapien
aaataactcctttgtgttaaaagaaraaagcacaggacatagatccattc

SEQ ID NO: 79531 - DNA, 50 bp, homo sapien
tattttaagtagcaaagatggtaatwaagtggttgtcgaaaactttaaac

SEQ ID NO: 79532 - DNA, 50 bp, homo sapien
atgatgaaaagaccaaaaaatgtacrgaggaaggattacagagattcaac

SEQ ID NO: 79533 - DNA, 50 bp, homo sapien
gtggtggtggtggtggtggtgaatayattgctgctgcaaagccaagctgt

SEQ ID NO: 79534 - DNA, 50 bp, homo sapien
ataatttccatattaatgttaagtaygttgagatataaatgtataaagta

SEQ ID NO: 79535 - DNA, 50 bp, homo sapien
catgattatctggttgtttataagaytcaggcgagtggttactcctgaag

SEQ ID NO: 79536 - DNA, 50 bp, homo sapien
gatgctgtgttaatatgcacacaaaygggagccttccagaagtaaagaca

SEQ ID NO: 79537 - DNA, 50 bp, homo sapien
aataaaaatgtatatggttgtatcaytaaggttcctattgaatatggtat

SEQ ID NO: 79538 - DNA, 50 bp, homo sapien
aaataatagacaggaaacataaacaygaatgaataacaaacatacgaaac

SEQ ID NO: 79539 - DNA, 50 bp, homo sapien
gtataaacagacctttcttatggaaygtaagtaaatctaaggggtggcaa

SEQ ID NO: 79540 - DNA, 50 bp, homo sapien
agccactaatacggacaaattacgayaaaggagaggaaagtgatccaaga

SEQ ID NO: 79541 - DNA, 50 bp, homo sapien
gacaaattaaacaagtggtagaaaartggacctggaaaacaaactctttt

SEQ ID NO: 79542 - DNA, 50 bp, homo sapien
ctttttattggattcttgggtaggcwactcaaatgttcaatgactgtgtg

SEQ ID NO: 79543 - DNA, 50 bp, homo sapien
aatcatttacccaggaaatctctaamtgccaggaaacctcttatgtgagg

SEQ ID NO: 79544 - DNA, 50 bp, homo sapien
tttagggaaataggtgctgatcaacrgtgtgaggctatggaaaagaaaca

SEQ ID NO: 79545 - DNA, 50 bp, homo sapien
ggagagccacttttgtgtagcttgcycaaaaacattgtgtggcttattgg

SEQ ID NO: 79546 - DNA, 50 bp, homo sapien
gccaagcaaattcaccaaatatctgratctagtaaacatagattcggatt

SEQ ID NO: 79547 - DNA, 50 bp, homo sapien
tttgctgctgtagacatttacgtagwcgtttttgtgtgaacatgtttttg

SEQ ID NO: 79548 - DNA, 50 bp, homo sapien
tgtcatgtcacaattaaatacagaarttaaaactaacaattgatgttacc

SEQ ID NO: 79549 - DNA, 50 bp, homo sapien
tttaaaaaataaatgcataatttcawctaagactgaatatataacactgg

SEQ ID NO: 79550 - DNA, 50 bp, homo sapien
cgatggtcattctgaaatagtagaartgcctgaaagatgcatagttttct

SEQ ID NO: 79551 - DNA, 50 bp, homo sapien
ttctatggagcttatggaaaatgatygtttaaatttagtttttaacaaag

SEQ ID NO: 79552 - DNA, 50 bp, homo sapien
gaaatcccttgccaggtacacatgartcagaattagtgtttaattagaat

SEQ ID NO: 79553 - DNA, 50 bp, homo sapien
gtataataattaaaaaaactccgtcratttgtcattttcaatgtgtactc

SEQ ID NO: 79554 - DNA, 50 bp, homo sapien
acaggttttggaatcatctcaccaargtaggacaggttagtgtgcttgcc

SEQ ID NO: 79555 - DNA, 50 bp, homo sapien
gtacacagtgcatacctctgaagaayggtactaggaaatgcagacagcag

SEQ ID NO: 79556 - DNA, 50 bp, homo sapien
actgcctctacctaggaaaataatcraccaacagcaataccacgtttctg

SEQ ID NO: 79557 - DNA, 50 bp, homo sapien
gcagaggaagctagaacaatggaaawctaagctatttatgtgaggtacag

SEQ ID NO: 79558 - DNA, 50 bp, homo sapien
gactttttataggatgaattgtagcycgctatatggcaaagagcaaggga

SEQ ID NO: 79559 - DNA, 50 bp, homo sapien
tattctgtagaacacatatttctaarggtctaataatattcattgttggt

SEQ ID NO: 79560 - DNA, 50 bp, homo sapien
ccatcagattcagtcaatctcaatayattaggtttaacattctaaaactc

SEQ ID NO: 79561 - DNA, 50 bp, homo sapien
atctctttgtgtttaagctagttctytccagtacagggattgcatttctc

SEQ ID NO: 79562 - DNA, 50 bp, homo sapien
tagatcagcaagggatgatctttcawggtatcgttgggagtggattattt

SEQ ID NO: 79563 - DNA, 50 bp, homo sapien
gaagtttgtatgtcattgcttacagyccaagaatttactgagtttttgat

SEQ ID NO: 79564 - DNA, 50 bp, homo sapien
gtacacagatactgaaaatgcacacrctgcactcggcatcttcagcgcct

SEQ ID NO: 79565 - DNA, 50 bp, homo sapien
aaatacttttctaataattttgtgargtaattgatctattgccttattat

SEQ ID NO: 79566 - DNA, 50 bp, homo sapien
gtcaaacaaactaatgtaaagatagyatggtgtgaaatattttgaaaagt

SEQ ID NO: 79567 - DNA, 50 bp, homo sapien
gacaagaaatattaacattgagataytaaaagttatgaccaccataagaa

SEQ ID NO: 79568 - DNA, 50 bp, homo sapien
tggttgtacactggtcttaagccacrattttattccttaatcctttgcag

SEQ ID NO: 79569 - DNA, 50 bp, homo sapien
gttttatctgacacaaatcttcttayggtggtcataacttttaatatctc

SEQ ID NO: 79570 - DNA, 50 bp, homo sapien
cagtatctccaagttaggaaaggccratagcacagataacagagaaagtt

SEQ ID NO: 79571 - DNA, 50 bp, homo sapien
gttatatttggatatcaagtttatayggacattgcaatgtgaacagagat

SEQ ID NO: 79572 - DNA, 50 bp, homo sapien
gtatctgggtccaaaaagagatcaawtcctaaagaaacagcctacagttg

SEQ ID NO: 79573 - DNA, 50 bp, homo sapien
cctattctggtctcctcccatctcaycttgaaggaagtcttggaaatgcc

SEQ ID NO: 79574 - DNA, 50 bp, homo sapien
tattcttgttagtgaaggaacttccmgattactgatcattctagacattc

SEQ ID NO: 79575 - DNA, 50 bp, homo sapien
tggaggtgacatgagagaaatcttayaatgttaatggctacacatttgtg

SEQ ID NO: 79576 - DNA, 50 bp, homo sapien
taatcatttctcatgaccaatgtgaytaatatggtccaaatcacccttca

SEQ ID NO: 79577 - DNA, 50 bp, homo sapien
ctctctcctagtctctccatcatcakgtttatgccttgatattccttcac

SEQ ID NO: 79578 - DNA, 50 bp, homo sapien
cctttgccgacataaaggcaccaaawcatccacaaatgttaatcatttct

SEQ ID NO: 79579 - DNA, 50 bp, homo sapien
agcccacctgttcacaagtcacaacsatgcagccagaattgccaagttat

SEQ ID NO: 79580 - DNA, 50 bp, homo sapien
gttaactaatttaaaattatgatttyggttagtaatgtactaactaattt

SEQ ID NO: 79581 - DNA, 50 bp, homo sapien
ctccaagcgattacacaaaataaatmactgaagaaatttctacttaccat

SEQ ID NO: 79582 - DNA, 50 bp, homo sapien
atcttaccatgagaacagcattggaytaagagagaagtcaacttggtaac

SEQ ID NO: 79583 - DNA, 50 bp, homo sapien
tttcttcccctttctttctggacccragtcatgccagtcttctctcaatt

SEQ ID NO: 79584 - DNA, 50 bp, homo sapien
aggtagattttaaatgttcataccamaaaaataaaaaggaaatggtaact

SEQ ID NO: 79585 - DNA, 50 bp, homo sapien
tttaataactgacacccatcacttgwcaagaatctctaagaggccatgac

SEQ ID NO: 79586 - DNA, 50 bp, homo sapien
gaggatctatgctgatgttcaaatayggacaaggacatgggataaaagaa

SEQ ID NO: 79587 - DNA, 50 bp, homo sapien
tgaaaatgccttttctaatcatgagkagtcacttccactagagccggaac

SEQ ID NO: 79588 - DNA, 50 bp, homo sapien
tatgttacatcagttactcctttcartatagattaggtttttaagtcctc

SEQ ID NO: 79589 - DNA, 50 bp, homo sapien
ttaggtttgtctacatggcttaaatrtctctagctaatacctctttattt

SEQ ID NO: 79590 - DNA, 50 bp, homo sapien
atgaaagaatttaaggcaaattcaaygctgataatgaacattaatgtaca

SEQ ID NO: 79591 - DNA, 50 bp, homo sapien
agcacttgtaatttcctgagcaatastggtgctaagtatatcttttgttc

SEQ ID NO: 79592 - DNA, 50 bp, homo sapien
cttcttcttactcccttcatttcagscactttagcttctttgccatttct

SEQ ID NO: 79593 - DNA, 50 bp, homo sapien
tgtaataggagataagttcatcaaartagccagggaaaaattatatggaa

SEQ ID NO: 79594 - DNA, 50 bp, homo sapien
cattgcctttcatttttgaagacccrgcttttgatagtgatgataccaat

SEQ ID NO: 79595 - DNA, 50 bp, homo sapien
gcagttaagcttaagtatctaagaargaagtcgggtttttaatttgtaac

SEQ ID NO: 79596 - DNA, 50 bp, homo sapien
aggaggttatgttaggattaacttcsattgtgcaagtttactgttgactg

SEQ ID NO: 79597 - DNA, 50 bp, homo sapien
tattctatctgatttcatcacatcamtattcgtgcaaaaactaagcaatt

SEQ ID NO: 79598 - DNA, 50 bp, homo sapien
ttagtccttccatccgaatgtttccygaagctgttccagctgctccatcc

SEQ ID NO: 79599 - DNA, 50 bp, homo sapien
ttaaaaataaaatatttggctcaatmacctgaattgcttcaagtaaactg

SEQ ID NO: 79600 - DNA, 50 bp, homo sapien
ctctctgttccttaacttcccaaatkaaagtcaaaatccagaaagtaata

SEQ ID NO: 79601 - DNA, 50 bp, homo sapien
ggggaaaaataagcaaactcagaaayagttcattaaatagctgactgtaa

SEQ ID NO: 79602 - DNA, 50 bp, homo sapien
gcctttctggaattactgaactagayaaattgctttaaaatctatatcaa

SEQ ID NO: 79603 - DNA, 50 bp, homo sapien
aagagagaataattgttgctaccctmaattcttgtgatctagagcttaag

SEQ ID NO: 79604 - DNA, 50 bp, homo sapien
gtgaacaaaaatacagtctactagaktcagcctagagtcaataacatttg

SEQ ID NO: 79605 - DNA, 50 bp, homo sapien
tatcagcctcacctttgtttttctaygtctaaccatgtttacggcactta

SEQ ID NO: 79606 - DNA, 50 bp, homo sapien
aagtgatataatatgttcacggagaygtactattaaaaagtgccacaaaa

SEQ ID NO: 79607 - DNA, 50 bp, homo sapien
tgtttttacctttatgtgtacttaaygttaattgtgaaatctaagcagga

SEQ ID NO: 79608 - DNA, 50 bp, homo sapien
gcttaagaaaaatttttaggctagcyattacatgtacctgaatgccaccc

SEQ ID NO: 79609 - DNA, 50 bp, homo sapien
ttgtttgcagaatcattttttataawctgtcaatgactaaagatataaat

SEQ ID NO: 79610 - DNA, 50 bp, homo sapien
ctcttacaggcacatatttagaatgraaagtaatgttattctaactacaa

SEQ ID NO: 79611 - DNA, 50 bp, homo sapien
tttgtttgtttgtttccaagaaaggkatattatcatttttgtctcaaagt

SEQ ID NO: 79612 - DNA, 50 bp, homo sapien
cctggactgttaagtgaaaggaaaaycaacctctatttatcagtaaaatc

SEQ ID NO: 79613 - DNA, 50 bp, homo sapien
gctgttgtgccagcccatttattcamagacctgtttattcctgatatgaa

SEQ ID NO: 79614 - DNA, 50 bp, homo sapien
ctatccttctagaaggcatttaacargctactatcacttcagagactcac

SEQ ID NO: 79615 - DNA, 50 bp, homo sapien
tattcctcataatctcaattagacamcttctctctttaacttaaaccaat

SEQ ID NO: 79616 - DNA, 50 bp, homo sapien
tgtttgagcaatccaacgacttcaakgaaaagaaaaagtatcgttttgct

SEQ ID NO: 79617 - DNA, 50 bp, homo sapien
gccaaacctgcagatcggtcagttayaaattttgctgcatatccttgaaa

SEQ ID NO: 79618 - DNA, 50 bp, homo sapien
ctagtaatttctctctctatctttckcatgtacttttgcaaataaaaaca

SEQ ID NO: 79619 - DNA, 50 bp, homo sapien
atggtacagaggcaatatggtataamaatttggaacatgaactgcagtta

SEQ ID NO: 79620 - DNA, 50 bp, homo sapien
taaaaaactgctgccatttttattayctattcatggcactagggtgaagc

SEQ ID NO: 79621 - DNA, 50 bp, homo sapien
cttttaaaaatattgttttccacaayggtatttggctacactttacattt

SEQ ID NO: 79622 - DNA, 50 bp, homo sapien
ggagagaatgtaaatccaaataataygcctcacctaaaacaaaactctct

SEQ ID NO: 79623 - DNA, 50 bp, homo sapien
atcaggtttacatcttgttgctatayctcacttaatgaattttactaatt

SEQ ID NO: 79624 - DNA, 50 bp, homo sapien
aaagtaagagatcagtgttttaaccygacatccaatggattacatttaag

SEQ ID NO: 79625 - DNA, 50 bp, homo sapien
attatggttcttacagcaccatgcawtagaaaagatttgagagactccac

SEQ ID NO: 79626 - DNA, 50 bp, homo sapien
gagaacatgatgattttatataagayatgtagactctaagcatataatat

SEQ ID NO: 79627 - DNA, 50 bp, homo sapien
ttttctaatgagctcttttgtactcwgctggtcataaaatcaggctaggt

SEQ ID NO: 79628 - DNA, 50 bp, homo sapien
tgtataagaatgcggttcagtgaacwcgtggttggtatctgatagcacta

SEQ ID NO: 79629 - DNA, 50 bp, homo sapien
gaaatttttcctggagtttataggcygattatattagtctgttctcacac

SEQ ID NO: 79630 - DNA, 50 bp, homo sapien
ccttcctttatagaatgaatttgaawgagtagttaacaaatacgtaaatg

SEQ ID NO: 79631 - DNA, 50 bp, homo sapien
acttggtctttgctaagtaaacttcyatttccagaccaattcttcaaatg

SEQ ID NO: 79632 - DNA, 50 bp, homo sapien
agtccagcctctgttaatttcaaacwactctctccgccttgaggaacaaa

SEQ ID NO: 79633 - DNA, 50 bp, homo sapien
tggccatttatgctaaagattataaygcctttcaactccagcaaaagtta

SEQ ID NO: 79634 - DNA, 50 bp, homo sapien
aaataagtggagggacgtacataaaytggaagacaacatagtcaagatgt

SEQ ID NO: 79635 - DNA, 50 bp, homo sapien
caacggaggcagttctagatcttgtrctttaaactctggcctgcctttcc

SEQ ID NO: 79636 - DNA, 50 bp, homo sapien
gaccaacaagtagtgttttcccattygtattgcttatcataaaatgagag

SEQ ID NO: 79637 - DNA, 50 bp, homo sapien
taaacagtggagctgtgagcactaaygctttaaccccttaattcccaaac

SEQ ID NO: 79638 - DNA, 50 bp, homo sapien
gctatctttgcaaaataggtaactasaactccagaagaagattctctgat

SEQ ID NO: 79639 - DNA, 50 bp, homo sapien
tcatataagctatgacaggaagagartcaatgcttgatgtttataatata

SEQ ID NO: 79640 - DNA, 50 bp, homo sapien
gatgtgcagatatattccaaactgcmagctgaattttcctttgccaacaa

SEQ ID NO: 79641 - DNA, 50 bp, homo sapien
gatctagaaattaggcctatatttaycctcatggctaggtattaaaaaca

SEQ ID NO: 79642 - DNA, 50 bp, homo sapien
aaactttaaaatcatttagcaagaamatccttctactccatttctcatgt

SEQ ID NO: 79643 - DNA, 50 bp, homo sapien
cagagatgatctggtctgtgtgtatkctttgaactgcaattctttctccc

SEQ ID NO: 79644 - DNA, 50 bp, homo sapien
caacatattttatcttgcactgtgayattgagtaacaattttagaaatac

SEQ ID NO: 79645 - DNA, 50 bp, homo sapien
gatatttcctttcgtaggtatcaacrtattttatcttgcactgtgacatt

SEQ ID NO: 79646 - DNA, 50 bp, homo sapien
cttctcccaaaatctataataaatargtcagtagtcaagatgtgaaaagt

SEQ ID NO: 79647 - DNA, 50 bp, homo sapien
ccatgctttttaatgaaataagcacrgtcctttacttttcacatcttgac

SEQ ID NO: 79648 - DNA, 50 bp, homo sapien
acacagctacagtgtgttggagcaargatttgaactcaggcatttgactt

SEQ ID NO: 79649 - DNA, 50 bp, homo sapien
ccctcccctggctgagcccgatctamagggagtgtgaaagtacaccaggg

SEQ ID NO: 79650 - DNA, 50 bp, homo sapien
aaataccaaggagaggtctgatcccrctattgaaataaaaagaaccatga

SEQ ID NO: 79651 - DNA, 50 bp, homo sapien
gaaccacatgaagaaatacagactaragattaagacaattttttaaacac

SEQ ID NO: 79652 - DNA, 50 bp, homo sapien
ttggacttcatttgggagcaagggasagcgtagcttttatttttggtttt

SEQ ID NO: 79653 - DNA, 50 bp, homo sapien
ttaagcagtagtgcactcctggcaaygcattaggacacgaaacagaaagg

SEQ ID NO: 79654 - DNA, 50 bp, homo sapien
ttgcaaacacctgcttgttgtatgaygttatgcaaaataatccttgagct

SEQ ID NO: 79655 - DNA, 50 bp, homo sapien
attttttttctgttagtctataaaaygaatatgaacagattacttccagt

SEQ ID NO: 79656 - DNA, 50 bp, homo sapien
tcaatatccccaatgacataatatcmgaccttaaaaaaatgacccaagtt

SEQ ID NO: 79657 - DNA, 50 bp, homo sapien
gggaaagtaacatttcagagtttaaygtggtattgctctcctttataata

SEQ ID NO: 79658 - DNA, 50 bp, homo sapien
atggttgcataactctgtgacaatawtaaataccactgaatcagacactt

SEQ ID NO: 79659 - DNA, 50 bp, homo sapien
tggactggctgaaggtcacccttgawagaagaggctggaagcataagaat

SEQ ID NO: 79660 - DNA, 50 bp, homo sapien
ggccccaaccagaggaaattggagcyatgctttcttaaaaagtgttcctc

SEQ ID NO: 79661 - DNA, 50 bp, homo sapien
ctttagaacttttcaaggtacaaccyacagggagagataaattatccaac

SEQ ID NO: 79662 - DNA, 50 bp, homo sapien
ccagccactttggaccattaaatcayccagtaaatacatttaaagtttct

SEQ ID NO: 79663 - DNA, 50 bp, homo sapien
aaatgcccatgcagaggagatgcccragtcaggctttcggatagaacaaa

SEQ ID NO: 79664 - DNA, 50 bp, homo sapien
aacataattcagcataaccatgttargtttctttcctatgttttcttgtc

SEQ ID NO: 79665 - DNA, 50 bp, homo sapien
tttctcatgaacaataaagtaactasagataattgaaacttgaagaggta

SEQ ID NO: 79666 - DNA, 50 bp, homo sapien
ttctcagttttaaatcctttagtccmagacggttaaggcactctaaatca

SEQ ID NO: 79667 - DNA, 50 bp, homo sapien
cttttcaaattttaaaagcacatgaygaaatgctgacagtttttatctac

SEQ ID NO: 79668 - DNA, 50 bp, homo sapien
aagaatgcccaattcagccaggttcyaattatggtggtaatgtcacgtgt

SEQ ID NO: 79669 - DNA, 50 bp, homo sapien
catattgagaaaacctgaccatcaaygtatcgaaactccttaacatttct

SEQ ID NO: 79670 - DNA, 50 bp, homo sapien
tcatcatgttgttccaacaagcataytttccagagatcaaagcagattcc

SEQ ID NO: 79671 - DNA, 50 bp, homo sapien
tcttagtttattcaaggaaatataargccagttgaatagaatgagagcca

SEQ ID NO: 79672 - DNA, 50 bp, homo sapien
gcatgtatgtgtatagttctgagatrtcaatgcaattaatgttgcccctc

SEQ ID NO: 79673 - DNA, 50 bp, homo sapien
gtattttaaaaagccgtggtagaaargctaacacacaggcatttgcctga

SEQ ID NO: 79674 - DNA, 50 bp, homo sapien
cttaaaacatactgatttactcaggmatgaaatatgtaacgctgttgaat

SEQ ID NO: 79675 - DNA, 50 bp, homo sapien
gtgacccctgtctacagccaactacmggattcctaaatgggcacagcggg

SEQ ID NO: 79676 - DNA, 50 bp, homo sapien
gtgacatattttctcatgtaaaccargaccattttgagagcaaaagcatg

SEQ ID NO: 79677 - DNA, 50 bp, homo sapien
gaatgaataggataggcactagaaaraagtaatgagagaatgccggttag

SEQ ID NO: 79678 - DNA, 50 bp, homo sapien
agtgttatccctgtcatttgtaagckctacggtcaggggtgatatggttt

SEQ ID NO: 79679 - DNA, 50 bp, homo sapien
cctacagggaatccttgtatgatggratttaaagaagatgccgatttatg

SEQ ID NO: 79680 - DNA, 50 bp, homo sapien
aaacctctgctctttaaataagatcragagaggattcctgccaacccttg

SEQ ID NO: 79681 - DNA, 50 bp, homo sapien
gtttgcaatttgaattgcctcaaaamtttcctatgggcaagggttggcag

SEQ ID NO: 79682 - DNA, 50 bp, homo sapien
gatgaaacaggtaagaagctggagayaagagtatttagaaagagccggcc

SEQ ID NO: 79683 - DNA, 50 bp, homo sapien
ctgaggcaggaacctagctaaacaayttaaggcggtgacttgcccctgga

SEQ ID NO: 79684 - DNA, 50 bp, homo sapien
actgaggttggtcagagagattataycgtccttgatttaaaataataacc

SEQ ID NO: 79685 - DNA, 50 bp, homo sapien
tccatcatttcagttacataccagamgaatacagtaaatagcaatagtca

SEQ ID NO: 79686 - DNA, 50 bp, homo sapien
tgaagtacgaacaacatattcagaaytccttggtcatgtattttagcaaa

SEQ ID NO: 79687 - DNA, 50 bp, homo sapien
cctcagcagaattacataatgcacartatctgcagctgtatatggcagcc

SEQ ID NO: 79688 - DNA, 50 bp, homo sapien
atcattcataaatagtgcacactacmaaagcaggctaattacattttttt

SEQ ID NO: 79689 - DNA, 50 bp, homo sapien
tgttgtttagtaatagtgtaagaagraatctctgagttttcttccaaact

SEQ ID NO: 79690 - DNA, 50 bp, homo sapien
cagaaataaaaacaaacaatctttakgaagctaaactaaggtataaccat

SEQ ID NO: 79691 - DNA, 50 bp, homo sapien
tcaaatcacatctaaagaaggataarttaaatagtaaatgaggagtttac

SEQ ID NO: 79692 - DNA, 50 bp, homo sapien
actttagccaaaccggaaaaccctawtactgacaatcatatgccccgact

SEQ ID NO: 79693 - DNA, 50 bp, homo sapien
atcatcccccaatcctcacaaaaaaktaagtctaactataaaacatagac

SEQ ID NO: 79694 - DNA, 50 bp, homo sapien
gcttattctatattatcttgtagtakcttctaggtcttattcacaaaact

SEQ ID NO: 79695 - DNA, 50 bp, homo sapien
ggatccaggaggtagcttacaaataygggtgaattgctttttctccatat

SEQ ID NO: 79696 - DNA, 50 bp, homo sapien
gggtgtcagtaaaactctattataawtagtcctatcacgacaactgttat

SEQ ID NO: 79697 - DNA, 50 bp, homo sapien
tttatgaagaaatggactttagccaygaccttaggctacgtgtctttagt

SEQ ID NO: 79698 - DNA, 50 bp, homo sapien
agcttgtgacctaagcctagtaacakaagtagttggagtctacggttctt

SEQ ID NO: 79699 - DNA, 50 bp, homo sapien
atctgcaactaatgggaatcagcaastatctgtactaaaaagctcccagc

SEQ ID NO: 79700 - DNA, 50 bp, homo sapien
gaatcaaattaaaatgttggaaatayagtcatcattaacatttttaaatg

SEQ ID NO: 79701 - DNA, 50 bp, homo sapien
tctctggcctaagttctaagagaaamatgattgtgctataagctagggac

SEQ ID NO: 79702 - DNA, 50 bp, homo sapien
accgatgacaaagctgaggttcagayagatcaagtcttgggtcaaccaaa

SEQ ID NO: 79703 - DNA, 50 bp, homo sapien
actttgtgaaaatccttattcctaaratgacaacaactacattatgttga

SEQ ID NO: 79704 - DNA, 50 bp, homo sapien
attaagatagtaatattttaattagkcctccattcattctacaaatattt

SEQ ID NO: 79705 - DNA, 50 bp, homo sapien
cactgcaatttgttcctctcaacacracatggattgagtcttacataaga

SEQ ID NO: 79706 - DNA, 50 bp, homo sapien
aacaaattgcagtggattcaaggatraatgactgagactatcagactatc

SEQ ID NO: 79707 - DNA, 50 bp, homo sapien
taggtattatttccatattattactragaactactcaaacaatgacactt

SEQ ID NO: 79708 - DNA, 50 bp, homo sapien
ccatttcttcatctctcaatgagaawcattatctaaactacatattgaac

SEQ ID NO: 79709 - DNA, 50 bp, homo sapien
agaggagttaatgagttaaaataggwaaagtgcctagaagagtatttggc

SEQ ID NO: 79710 - DNA, 50 bp, homo sapien
gccaatgatttaatcaatcatatccrcataatggaagctttagaaaaatc

SEQ ID NO: 79711 - DNA, 50 bp, homo sapien
gtgtcttcctgacccttgcactcccraattccttaattgcaggtgctctt

SEQ ID NO: 79712 - DNA, 50 bp, homo sapien
ctctctgctcctgttgttgcatgaakagtaaatccctgtatcacattcat

SEQ ID NO: 79713 - DNA, 50 bp, homo sapien
attacagattccctctatatcagtcraagtcctcacgtgaaaggtgcttg

SEQ ID NO: 79714 - DNA, 50 bp, homo sapien
aagaattcttagaattacattggtgmactcggataacttagaatgatctc

SEQ ID NO: 79715 - DNA, 50 bp, homo sapien
accatggaccaaatccaaataatccytgaataacatattttgatggtcaa

SEQ ID NO: 79716 - DNA, 50 bp, homo sapien
tatctaggcattatcaggcttgaaartaaaggagatatgtaacgtggtga

SEQ ID NO: 79717 - DNA, 50 bp, homo sapien
aagggaaaaaatatgtgattgtaaakgttactatttctatttaaagtgtg

SEQ ID NO: 79718 - DNA, 50 bp, homo sapien
agagcctcgctcacaggaggaccatyacgaacacttgattgaatgaattt

SEQ ID NO: 79719 - DNA, 50 bp, homo sapien
tggaaattaaagtagccagctggacraacattcataagtattattttagg

SEQ ID NO: 79720 - DNA, 50 bp, homo sapien
ccagtatacacatttgattaacagcycatatggattttcatgcttggaaa

SEQ ID NO: 79721 - DNA, 50 bp, homo sapien
cttaattatatctaggtctaatacargcatggctagagtttaagtgggca

SEQ ID NO: 79722 - DNA, 50 bp, homo sapien
tttaaaaatatctacaaattaaacamatgtcattttaataattagcaact

SEQ ID NO: 79723 - DNA, 50 bp, homo sapien
tcaaattggtatattctaagttatgyattcacaaatggcagtatattcat

SEQ ID NO: 79724 - DNA, 50 bp, homo sapien
gagttcatcacctagttaacacttgwataataatgcagacaacatagaag

SEQ ID NO: 79725 - DNA, 50 bp, homo sapien
ataaaatttccaataatgagaaatargtgagtgggcattcaggtattaaa

SEQ ID NO: 79726 - DNA, 50 bp, homo sapien
aaaagagaaaacgagtatgactatamatttggccacattatctttaaaga

SEQ ID NO: 79727 - DNA, 50 bp, homo sapien
agcgaaacgattgaatgttgaaggamgcatcagtaaaacaagaatcctag

SEQ ID NO: 79728 - DNA, 50 bp, homo sapien
gctataaaaagagaacattttagaartatataactggcctcacagacaag

SEQ ID NO: 79729 - DNA, 50 bp, homo sapien
aaatataaacatttttagtaaccaaytcagaatggcattcataggccagc

SEQ ID NO: 79730 - DNA, 50 bp, homo sapien
gtgtcaaataatctatatgaggtgamgattgacaatcagtgaatctcaga

SEQ ID NO: 79731 - DNA, 50 bp, homo sapien
atttcataaattaacaacagaagatkaattagagaagaaaaatagcctat

SEQ ID NO: 79732 - DNA, 50 bp, homo sapien
atcagacattaatttttgtcaatccrtaatctgataggtgtgaaacagta

SEQ ID NO: 79733 - DNA, 50 bp, homo sapien
ttctattttaaaaccaatatattaamactagaaatttgaggtattaatgt

SEQ ID NO: 79734 - DNA, 50 bp, homo sapien
atgcacaatcaaaccagttataaccrtgccaagtggagctccatcccact

SEQ ID NO: 79735 - DNA, 50 bp, homo sapien
gaagtaacggtaactgctacatatawcttcagcttaaaaaacattgtatc

SEQ ID NO: 79736 - DNA, 50 bp, homo sapien
agatcttaggtgtgtatgcgttcatragggatggaatattttgtattcag

SEQ ID NO: 79737 - DNA, 50 bp, homo sapien
actctgagctgaggataaatcgtgarttggaaggagtccgccacagcctc

SEQ ID NO: 79738 - DNA, 50 bp, homo sapien
aagctcagtctgggttgtatgaaagycattgtcacattctgacacaatga

SEQ ID NO: 79739 - DNA, 50 bp, homo sapien
aagactatttctctgatggctataaraaaggatagtgtatatgataatca

SEQ ID NO: 79740 - DNA, 50 bp, homo sapien
atacatgctaacttcagcctcctaayatagtgaagactggatgaaataca

SEQ ID NO: 79741 - DNA, 50 bp, homo sapien
ctttccccccaaaataaaatagcctraaccttatatgttcttcatgtggc

SEQ ID NO: 79742 - DNA, 50 bp, homo sapien
aatatcttggttttgttcaataagcratagaggctgtcatcaaaaatgat

SEQ ID NO: 79743 - DNA, 50 bp, homo sapien
ttcctggcatgcttagtatttaggtsaaactgttctattgcagggattga

SEQ ID NO: 79744 - DNA, 50 bp, homo sapien
gattaggggcatcattcatacaaaarttatagcagattaacctggggaag

SEQ ID NO: 79745 - DNA, 50 bp, homo sapien
ttttccatgcatgcttagatgtgaargactaggcgggctcattcttgaac

SEQ ID NO: 79746 - DNA, 50 bp, homo sapien
caagaacaaatagcagatttcatacrcatatttttggggggaggcatcta

SEQ ID NO: 79747 - DNA, 50 bp, homo sapien
tctctgttgctgtaacactttaccascttcaagacagcaaaggaggtgtg

SEQ ID NO: 79748 - DNA, 50 bp, homo sapien
gcaagatgagaaacaagctttctggyaattgttgttactcttaagcacac

SEQ ID NO: 79749 - DNA, 50 bp, homo sapien
cttaaaatacaccagatagatatgcwctatgttttctttcctttttgggc

SEQ ID NO: 79750 - DNA, 50 bp, homo sapien
ttatgatttgtagctctagtgaatawgaattttatattgagttgtgtgta

SEQ ID NO: 79751 - DNA, 50 bp, homo sapien
taatgagtttagaaattaatgacaartataagttttgaaacatgattcat

SEQ ID NO: 79752 - DNA, 50 bp, homo sapien
tctctgaatctgttgaaatctctgcyctaatgtaactagtccttaaggat

SEQ ID NO: 79753 - DNA, 50 bp, homo sapien
ctgaaaggacttgtgagtagaacgtyacttgatccttggatctctgaggt

SEQ ID NO: 79754 - DNA, 50 bp, homo sapien
tcatgttctgatgcttttgaccaacraaaatggaatttcttatgtagaat

SEQ ID NO: 79755 - DNA, 50 bp, homo sapien
gtaatgacctggctctgattattcaytagaaagcctcctgttacatcttc

SEQ ID NO: 79756 - DNA, 50 bp, homo sapien
gggaaatttgctttgttactcagtayatcacctttctttgctcttctgat

SEQ ID NO: 79757 - DNA, 50 bp, homo sapien
tcatagaggtacatcaagataaataragcaatatccatattttacagtct

SEQ ID NO: 79758 - DNA, 50 bp, homo sapien
ggctggttgctccattttgggtcccrgaattgatattttttaaagagtca

SEQ ID NO: 79759 - DNA, 50 bp, homo sapien
tccaagtcacctgatgggataagaartgaaagtagagattcagagatatc

SEQ ID NO: 79760 - DNA, 50 bp, homo sapien
gccattagtttctgagttctgaaaayaggaaacagaagtcttctattata

SEQ ID NO: 79761 - DNA, 50 bp, homo sapien
aagaagttttaactgtgaatacatayccattcttatatgtagattctgtc

SEQ ID NO: 79762 - DNA, 50 bp, homo sapien
tgcttttataatctcaactaatactstgcttttggttaagaacagtctag

SEQ ID NO: 79763 - DNA, 50 bp, homo sapien
ccattttagtacctgaagacaagaasaggttgataagtattattattgag

SEQ ID NO: 79764 - DNA, 50 bp, homo sapien
catctagacctagacctagaactgaragtccagccagacacggatcccct

SEQ ID NO: 79765 - DNA, 50 bp, homo sapien
gagaaagacatcccatctaacgaaarccattgaattacatcatgtgttct

SEQ ID NO: 79766 - DNA, 50 bp, homo sapien
cacattttctagagctctggaaacgrttactagttagtattgcactattt

SEQ ID NO: 79767 - DNA, 50 bp, homo sapien
gtacaagcactccttcaagtagtcgrtaattggacctgattcaaattccc

SEQ ID NO: 79768 - DNA, 50 bp, homo sapien
agaaaaaatgtagttaccaaccatasgtcaactaatcactaaaaataaaa

SEQ ID NO: 79769 - DNA, 50 bp, homo sapien
ttttattgcagcttttaatggcgtcrcttcagtttatcaggaagcactac

SEQ ID NO: 79770 - DNA, 50 bp, homo sapien
atatttttttagtcatggaaaaatawccaaagaagaaaatactagaggac

SEQ ID NO: 79771 - DNA, 50 bp, homo sapien
gaatagtttacttcattttttctatkaatggactaaggattatagagttt

SEQ ID NO: 79772 - DNA, 50 bp, homo sapien
agaggccccagtgccactgtcctaamtatgtttcctgctgctgtgtacca

SEQ ID NO: 79773 - DNA, 50 bp, homo sapien
tcacatgtcagcatgcctaagggaaraacttgaggaattttgagagtccg

SEQ ID NO: 79774 - DNA, 50 bp, homo sapien
tctgtgaatgccagggtctgcagtayatacaatttgagtagcatatatta

SEQ ID NO: 79775 - DNA, 50 bp, homo sapien
cctaattctgtatctcattttaaagyacaatagttagtcctcacttctcc

SEQ ID NO: 79776 - DNA, 50 bp, homo sapien
tcctttctgcttcaagcttgtattcyaatgaatgatacagaccaaaaaac

SEQ ID NO: 79777 - DNA, 50 bp, homo sapien
ctttctgggatcttcttgttttcaaygatgggcactgtggaggcaccaac

SEQ ID NO: 79778 - DNA, 50 bp, homo sapien
gtaataggtaatacttagtgtaataygtgctaggaactgttatcagtatt

SEQ ID NO: 79779 - DNA, 50 bp, homo sapien
acaaacatatcccagagtactacatyaaacattttaaaacatggctgaca

SEQ ID NO: 79780 - DNA, 50 bp, homo sapien
accaaaacccttgatagaggtaccaycattatccctattttcagacataa

SEQ ID NO: 79781 - DNA, 50 bp, homo sapien
ttttggagctgggatcctgggtccamaggaaaaataatgagaacattaag

SEQ ID NO: 79782 - DNA, 50 bp, homo sapien
gtttttccaacaggctcttatcggckctgaaagttgagcttgtctcctta

SEQ ID NO: 79783 - DNA, 50 bp, homo sapien
aaatgtctctatgagattgagtacamcagcaactaaagggactgaggtca

SEQ ID NO: 79784 - DNA, 50 bp, homo sapien
acagaatgctcggagctaaattgtawgttccaacctaagagttatacttc

SEQ ID NO: 79785 - DNA, 50 bp, homo sapien
atgttcaaacctgtgcattggattargtttttagtaccctgcacccaaaa

SEQ ID NO: 79786 - DNA, 50 bp, homo sapien
cttcaaagagactacatgttgatccrtaaaaaatctaatcaatccatcga

SEQ ID NO: 79787 - DNA, 50 bp, homo sapien
ctctagagaagcatcttaggagcagraggtttttcactcttatgcactct

SEQ ID NO: 79788 - DNA, 50 bp, homo sapien
acatatttgtatgaatctccatcagyacatgttcaaacaaatgttttcta

SEQ ID NO: 79789 - DNA, 50 bp, homo sapien
aaaagattgacaaatttggtcaaatracactataaaaagattaaaaaggc

SEQ ID NO: 79790 - DNA, 50 bp, homo sapien
ccccgtactgtgatcatcgttcaggratgaagtaaaggagatgaaaacta

SEQ ID NO: 79791 - DNA, 50 bp, homo sapien
gctatgagttctatcttggtcattaygcagaacacaaggattaaagggaa

SEQ ID NO: 79792 - DNA, 50 bp, homo sapien
tgaagattttgatagagtaagtctartaaagcgtggacatgtatgtttac

SEQ ID NO: 79793 - DNA, 50 bp, homo sapien
agtaattatccaggaccagaacaaakcagtcttaatggaagtataaatca

SEQ ID NO: 79794 - DNA, 50 bp, homo sapien
aggtcaagtcttcctcagttatccamgaactttgaaaggcttcaaagaca

SEQ ID NO: 79795 - DNA, 50 bp, homo sapien
aagcttagaaagtggtttacattagwataagtgcaaacaactaatagaaa

SEQ ID NO: 79796 - DNA, 50 bp, homo sapien
tgcacattctttgcttgtttcttaawtgggttgcttttttattgttgaat

SEQ ID NO: 79797 - DNA, 50 bp, homo sapien
cctaagcctcacagaatggacaaatracttaaaaagattgaaataacatg

SEQ ID NO: 79798 - DNA, 50 bp, homo sapien
caaatattatagccacacagaatgawctttaaaatatggggctgagcagg

SEQ ID NO: 79799 - DNA, 50 bp, homo sapien
gtataccgatacgtttgtttaagacrgtaaccacgaactcgggagcagtt

SEQ ID NO: 79800 - DNA, 50 bp, homo sapien
tgatagagaattagtggctatatcamaatatttaaattgatttggtttta

SEQ ID NO: 79801 - DNA, 50 bp, homo sapien
tagcaactttgtctctgtctctcaaytagataattcctactgacaaatag

SEQ ID NO: 79802 - DNA, 50 bp, homo sapien
gtcatatgcttactaactattcatakaacttattttgcgaactgtgtatt

SEQ ID NO: 79803 - DNA, 50 bp, homo sapien
ttatccttttaaaatgtacagtttartgggttatgttatattcacaaagt

SEQ ID NO: 79804 - DNA, 50 bp, homo sapien
tattgtaagggaattctcctgaataragtatataaatgtgatggttaatt

SEQ ID NO: 79805 - DNA, 50 bp, homo sapien
ttcttactacatacaagttcttaatyagttatcgttttttaaataaccac

SEQ ID NO: 79806 - DNA, 50 bp, homo sapien
aaatctgagccaactatggtccataycagctgacactgaagaagttcctc

SEQ ID NO: 79807 - DNA, 50 bp, homo sapien
taatttagctgtgaatgtggtattcragcagtctccaacttaagagcagg

SEQ ID NO: 79808 - DNA, 50 bp, homo sapien
gcattctatacttcttcagcttccayctactgcagttatccagttgtctc

SEQ ID NO: 79809 - DNA, 50 bp, homo sapien
agttgtatcatgcatgttcttcttayccacagttggcttgcattttagcc

SEQ ID NO: 79810 - DNA, 50 bp, homo sapien
caagatcattcagctatgtaaaaaartattaacagcttagacttatattg

SEQ ID NO: 79811 - DNA, 50 bp, homo sapien
aacagctcaggcttgttgttgcaatyataatgtcaggaaaagaatccttg

SEQ ID NO: 79812 - DNA, 50 bp, homo sapien
gaccaactttcagctgcaatattcartatctcccacaaatgtttaaatga

SEQ ID NO: 79813 - DNA, 50 bp, homo sapien
aagaactacctggctatgattttgarctgacagcattataggtagctggg

SEQ ID NO: 79814 - DNA, 50 bp, homo sapien
acaaaattttaaaaacagtgctgaayagcatctcagagtccatgcctggg

SEQ ID NO: 79815 - DNA, 50 bp, homo sapien
ttcattttcgtctcccaactttataycagattcatcaaaggtagtagttg

SEQ ID NO: 79816 - DNA, 50 bp, homo sapien
gcagaagatgatgattcaatgttaayggtgatggtctcccaaaattatgt

SEQ ID NO: 79817 - DNA, 50 bp, homo sapien
tgctttgatttaagaaatccatgaaracgaagcttatacatctagaaaaa

SEQ ID NO: 79818 - DNA, 50 bp, homo sapien
agatggaaattgacttcaggattcayagttcagctaattgggaagaggac

SEQ ID NO: 79819 - DNA, 50 bp, homo sapien
cagataaatgatggaagtcttaatayagggaacaacatgtaatgtcagaa

SEQ ID NO: 79820 - DNA, 50 bp, homo sapien
ttcatccaaaggaatgtcgaactaargaaagtgatgaaactaagatatga

SEQ ID NO: 79821 - DNA, 50 bp, homo sapien
cctggaaatttataagcctctggtcyatgaagtagttaggagatagagag

SEQ ID NO: 79822 - DNA, 50 bp, homo sapien
cagtgatcatacagacaataaacagkatctacctctgagaaacgtgactt

SEQ ID NO: 79823 - DNA, 50 bp, homo sapien
ctgtgtggctttcctgaaaccattayaggacaaacatagactagaacaag

SEQ ID NO: 79824 - DNA, 50 bp, homo sapien
atcaaggttaggcatgaataataatyacctagcctacttgagtgtagcac

SEQ ID NO: 79825 - DNA, 50 bp, homo sapien
ttgagagtgcaaaatgatagctgcartagaaagtaaagctcagctcagta

SEQ ID NO: 79826 - DNA, 50 bp, homo sapien
tggtgtataattttctttatattcamggatatttttattgtcaaatacta

SEQ ID NO: 79827 - DNA, 50 bp, homo sapien
tatctttatagttctatatataaaayaggcaaatgtcccaggtcatgcct

SEQ ID NO: 79828 - DNA, 50 bp, homo sapien
cctcattgctaatttgatttgaagaygtagaatcagtccatgcctaatat

SEQ ID NO: 79829 - DNA, 50 bp, homo sapien
gggttaagaacaaccagtgtcattayctcattgaagggacaagaggaggg

SEQ ID NO: 79830 - DNA, 50 bp, homo sapien
tactactataaactattagttcatakcttaaaacttctcgttttgcctca

SEQ ID NO: 79831 - DNA, 50 bp, homo sapien
atttgttttcctgtgctagatttccragtatgccaaaggcatttgttaaa

SEQ ID NO: 79832 - DNA, 50 bp, homo sapien
aaaaaatttctcagtgttgttttctyacccactgttgtgatgatgattca

SEQ ID NO: 79833 - DNA, 50 bp, homo sapien
ctaaattttaacagctttaagtctawgtagaagcgacgtagcagagtggg

SEQ ID NO: 79834 - DNA, 50 bp, homo sapien
gtcaattttttttctgaaaaagcgcwaagtcgttcttcttcatatgacca

SEQ ID NO: 79835 - DNA, 50 bp, homo sapien
aacctacaagagatgaaccaaaacartaatcagcgttagagcagggttag

SEQ ID NO: 79836 - DNA, 50 bp, homo sapien
aaaagggggctacatttgaggcatgyacaatactctgatcaagatttcct

SEQ ID NO: 79837 - DNA, 50 bp, homo sapien
tccctttctgatactgacatcaagasctaaggtaatttatctcccgggtg

SEQ ID NO: 79838 - DNA, 50 bp, homo sapien
agaagaaggaactggtcatttagagsagaaatatgttttaatgcacatgc

SEQ ID NO: 79839 - DNA, 50 bp, homo sapien
ggtgtctttaaatggaaatacacacwagactatgttatatactgatcagt

SEQ ID NO: 79840 - DNA, 50 bp, homo sapien
tgtcctaaaatacaacatctgaatakagactgtaatgcatagcaaaattt

SEQ ID NO: 79841 - DNA, 50 bp, homo sapien
gagtcactactgagagacaccctgartacttgaggttgagaatgaccatg

SEQ ID NO: 79842 - DNA, 50 bp, homo sapien
tgtatttaccaatcagagcacatcarcctagtaagaatcttaagaaatta

SEQ ID NO: 79843 - DNA, 50 bp, homo sapien
gttcttgatgcttgatatgtgtactygtttcctggattgaagaaaacact

SEQ ID NO: 79844 - DNA, 50 bp, homo sapien
aactttttttaaaaaagggagtcagmaaatgccatacactctccattttg

SEQ ID NO: 79845 - DNA, 50 bp, homo sapien
gcttttattgacatgtaagtaagaamgagaactgagaagaccttagatct

SEQ ID NO: 79846 - DNA, 50 bp, homo sapien
atgtgcagtgttagaagtctaacagraagaggaaaatgcaaggtgggtgg

SEQ ID NO: 79847 - DNA, 50 bp, homo sapien
ggaacttctcttaatctttgcatcaygggaaggctatagaagtaagaata

SEQ ID NO: 79848 - DNA, 50 bp, homo sapien
tgatgaggagaccatccacatggcaraggtatggtggccaagatggaaga

SEQ ID NO: 79849 - DNA, 32 bp, homo sapien
acactgtgggcccttamtacttatggaatgaa

SEQ ID NO: 79850 - DNA, 50 bp, homo sapien
ggtaccacagggagcatatatttccrctgatttagtacccagtgcagaat

SEQ ID NO: 79851 - DNA, 50 bp, homo sapien
cctcagccgtggttacagtggagaargagtgttagccatatttatttaat

SEQ ID NO: 79852 - DNA, 50 bp, homo sapien
tgaaacccttttaactaactctcacrattttagattctcggtctctattt

SEQ ID NO: 79853 - DNA, 50 bp, homo sapien
agtccctaccactatttagaaggatwacctgactcacatgaacaaagcaa

SEQ ID NO: 79854 - DNA, 50 bp, homo sapien
ggtctctatttctacattatctggayggtcactcttgagccttttggtag

SEQ ID NO: 79855 - DNA, 50 bp, homo sapien
gatacttttatcctcatactataaargaagagtttattctgatcatgcaa

SEQ ID NO: 79856 - DNA, 50 bp, homo sapien
gaaagatatggggctgggggatagtyaatgttgttattacatcaaggtaa

SEQ ID NO: 79857 - DNA, 50 bp, homo sapien
gaattttgtgactgacagctctgatsaatcctttccggtctgctaagtca

SEQ ID NO: 79858 - DNA, 50 bp, homo sapien
ttttttttacttcctctgaatttgcygatttcattcatttctcaaactcc

SEQ ID NO: 79859 - DNA, 50 bp, homo sapien
gaagtgaggcttaattgctaaacacrggctatgaacattctagttggtta

SEQ ID NO: 79860 - DNA, 50 bp, homo sapien
gcctttaggaggtccatccttccaaygcctgagcaataatttcagaagat

SEQ ID NO: 79861 - DNA, 50 bp, homo sapien
tcaacaggagtgtttattatttagartatcgattagctaaaattatttac

SEQ ID NO: 79862 - DNA, 50 bp, homo sapien
cagaaagggaagctgagactctaagwagtaaaatgaattattcaatcagt

SEQ ID NO: 79863 - DNA, 50 bp, homo sapien
ttctctttgcctcctcttaatcaaaytgacagaaactaaagcacattcca

SEQ ID NO: 79864 - DNA, 50 bp, homo sapien
gacacaatataactaattcatccacmagacttcattgaacgttgacagta

SEQ ID NO: 79865 - DNA, 50 bp, homo sapien
ctttttttacccattttattgttgayggatattttgattatttctaggtt

SEQ ID NO: 79866 - DNA, 50 bp, homo sapien
gaaatttatgtgactgttcctaatgycataaatcatattctgacaagaaa

SEQ ID NO: 79867 - DNA, 50 bp, homo sapien
aaggagtcaagtattatagatgaacsagtatccattttacatttgacaag

SEQ ID NO: 79868 - DNA, 50 bp, homo sapien
ttactctagagggtccaacaaatgaygagaaaattgaactgaataaagca

SEQ ID NO: 79869 - DNA, 50 bp, homo sapien
ggcctcaggaacttgagtcctttccraacagagtcaaccatccactcagg

SEQ ID NO: 79870 - DNA, 50 bp, homo sapien
aaaatgtactcatacctagacatatyatagtccaatttcagaagaccaaa

SEQ ID NO: 79871 - DNA, 50 bp, homo sapien
gagattcacagaatattacaatttaygcaaacgaaactgcatacacacta

SEQ ID NO: 79872 - DNA, 50 bp, homo sapien
ttactttgagctttactgtttggcarctattttatgttcagattcccaaa

SEQ ID NO: 79873 - DNA, 50 bp, homo sapien
tttattctccaaagatggagttggaygagaatctttggtgacctcagatt

SEQ ID NO: 79874 - DNA, 50 bp, homo sapien
tggcattttggcttttgtcacttctraaatgtcttcaaaaagctagtaac

SEQ ID NO: 79875 - DNA, 50 bp, homo sapien
gttgcctttgtaggcagtgagtttcyaatagctggctggaagttccagaa

SEQ ID NO: 79876 - DNA, 50 bp, homo sapien
gagtgagatcacgtctgtttacttargctctgtagggtatgcaaaagaac

SEQ ID NO: 79877 - DNA, 50 bp, homo sapien
aggactcaccagaagccaacctggascatctttctgatgagtttccttga

SEQ ID NO: 79878 - DNA, 50 bp, homo sapien
agcaacatggactaaatcctctgcayctataccaacactctttcttggga

SEQ ID NO: 79879 - DNA, 50 bp, homo sapien
ttgaacacactaggctcattaccacmatatataacttattctcttgaaca

SEQ ID NO: 79880 - DNA, 50 bp, homo sapien
taaggactcctggaagcatgagatcraccaggaaacccaattcccaggcc

SEQ ID NO: 79881 - DNA, 50 bp, homo sapien
ttctagctttaaaagtctgtcccaarcctcaaaggaacctgcgtttcaat

SEQ ID NO: 79882 - DNA, 50 bp, homo sapien
agctagcatgtgattgcatttgagayactgggaacccctctggtaatccc

SEQ ID NO: 79883 - DNA, 50 bp, homo sapien
ggaaacagtggtgattaatggcctaycttccagggtaatgaaatctctgc

SEQ ID NO: 79884 - DNA, 50 bp, homo sapien
gtgtttctgtccccagctgaaaaaayactgctctgaagactgctggaccc

SEQ ID NO: 79885 - DNA, 50 bp, homo sapien
tgttaaccatgattacttcttagcaytacacttagtgattggctcatttt

SEQ ID NO: 79886 - DNA, 50 bp, homo sapien
tttccagcttttttgttgttgtaaakgtgtgggcaatgttctttccagat

SEQ ID NO: 79887 - DNA, 50 bp, homo sapien
ggaagctgccagaggagcattcatgmcactgaaaccagagtaaaccagaa

SEQ ID NO: 79888 - DNA, 50 bp, homo sapien
cgcatgcacacacacacacatgctamagaaggacaaagcacagatggaca

SEQ ID NO: 79889 - DNA, 50 bp, homo sapien
gcttaccacacttttcttagtatackcattgccaaagtgggattcctgtc

SEQ ID NO: 79890 - DNA, 50 bp, homo sapien
gtagtgaatatttgctactttgaacsatccacctttcattctgccttcct

SEQ ID NO: 79891 - DNA, 50 bp, homo sapien
gaattattccaattgtactcatgaaycataagacaaaaaagagccatgta

SEQ ID NO: 79892 - DNA, 50 bp, homo sapien
cctcgaactgtgattgttacttcatyaggctcataaaaaagtttatttta

SEQ ID NO: 79893 - DNA, 50 bp, homo sapien
attttctagaagagttgccattggargtagatattaaaggatgaagaaat

SEQ ID NO: 79894 - DNA, 50 bp, homo sapien
tatcacaagcttccctgattatagaygaatgtcctgacctgggctgagaa

SEQ ID NO: 79895 - DNA, 50 bp, homo sapien
ccccctgggctcccaggaagcaatamagatactaattttaaagaaacaga

SEQ ID NO: 79896 - DNA, 50 bp, homo sapien
tgagaaatgagataggctccatagasactttgaagacttgaggatggtgg

SEQ ID NO: 79897 - DNA, 50 bp, homo sapien
aatatttctcacttcttgtgtctatyagttccagattaactgatatagct

SEQ ID NO: 79898 - DNA, 50 bp, homo sapien
aattggaaactgggggctatttcttygtgtactagtagtggaagttgttc

SEQ ID NO: 79899 - DNA, 50 bp, homo sapien
ccttaatatttaacccaattctctcyaatatatccttctacagtaggttg

SEQ ID NO: 79900 - DNA, 50 bp, homo sapien
tggggaaaggagcacaaaaagagtcsaaggtataacaactgaaacttttc

SEQ ID NO: 79901 - DNA, 50 bp, homo sapien
tgccatgccaagccatattggaaackaattttgacaagatgtttcagatg

SEQ ID NO: 79902 - DNA, 50 bp, homo sapien
ttgcctctgctacctttccactagcrcatccagttatcttctgtctccct

SEQ ID NO: 79903 - DNA, 50 bp, homo sapien
aaacaaaaccctctccttaagacacygcaatagacaacttagtatcaaaa

SEQ ID NO: 79904 - DNA, 50 bp, homo sapien
gacaggcaaatttgcagacattgcckcaggataacaacctcgtttgacag

SEQ ID NO: 79905 - DNA, 50 bp, homo sapien
atcgaatattgatcaacacttatacmatattcatgaaataatttggaaat

SEQ ID NO: 79906 - DNA, 50 bp, homo sapien
ggcaacaaggaacctatcaccattargattcttgaaattgtatgagaagg

SEQ ID NO: 79907 - DNA, 50 bp, homo sapien
gacttcagatcagatgttatctataktacaggtattcactaagacctaag

SEQ ID NO: 79908 - DNA, 50 bp, homo sapien
gcttcatttttgagttttcattagarctgttttctttgtttttaagtgaa

SEQ ID NO: 79909 - DNA, 50 bp, homo sapien
cctggcaaccacttggcaagaagtayagcgtgatctactttcccatgtaa

SEQ ID NO: 79910 - DNA, 50 bp, homo sapien
acaagcatcaggcagaaaatctgtaragacacagttgaatttaacaacac

SEQ ID NO: 79911 - DNA, 50 bp, homo sapien
gtacccattcctgatagtaagcaagyagctgatttggaagttggaaaaat

SEQ ID NO: 79912 - DNA, 50 bp, homo sapien
aggggagaatccctgcaatagaatgratgagtgggcagtgatagaaaaag

SEQ ID NO: 79913 - DNA, 50 bp, homo sapien
ttgcccaaggctcttccagaacttasagattcactttttggtacttgaac

SEQ ID NO: 79914 - DNA, 50 bp, homo sapien
ctgaggcacgttcttctctttcaaartatttccacatccattatctcagt

SEQ ID NO: 79915 - DNA, 50 bp, homo sapien
gagaacccatttgtttacaatgttaygctggacctacaacccttctttgt

SEQ ID NO: 79916 - DNA, 50 bp, homo sapien
gagcataaaatcctacctaaaaaacygacagtgatgtgtttttctagatt

SEQ ID NO: 79917 - DNA, 50 bp, homo sapien
ttataacttgttaggaaggataatcrgagttaaagcattcttaggtattt

SEQ ID NO: 79918 - DNA, 50 bp, homo sapien
tagaatcatttctgcagctcaaagaraaaactgggtccagaattacaaac

SEQ ID NO: 79919 - DNA, 50 bp, homo sapien
ttatattttatgtaagttgattatayagtttgtgaatagtttatcatgat

SEQ ID NO: 79920 - DNA, 50 bp, homo sapien
gaataattgggcaaagtttcatttamaacctgatggatgatctgtaaaag

SEQ ID NO: 79921 - DNA, 50 bp, homo sapien
agtttgaggccattggaaagacatcrgaaataccaagaggaaagaattat

SEQ ID NO: 79922 - DNA, 50 bp, homo sapien
tggctgggcctatggaagcaaccagwacaactgcagctctgagacacagg

SEQ ID NO: 79923 - DNA, 50 bp, homo sapien
tctgaagtcatcagtttcaaacgtaytaacagtgtggattcttgctgccc

SEQ ID NO: 79924 - DNA, 50 bp, homo sapien
tctttttaactttctcaatacacaamatactggttcagattatatcagtc

SEQ ID NO: 79925 - DNA, 50 bp, homo sapien
gcataggaatatatttttatattccratccagtgcctcacatacccataa

SEQ ID NO: 79926 - DNA, 50 bp, homo sapien
aatgggaaggcaagtactggtcaaamaattattcatatttttgcaaataa

SEQ ID NO: 79927 - DNA, 50 bp, homo sapien
gatttttctaatatcaacagctttakaaaagtatcattgtccattattct

SEQ ID NO: 79928 - DNA, 50 bp, homo sapien
agaaatggtagtcctgtgtaatcaargggcaatgcaagaatgagctaatt

SEQ ID NO: 79929 - DNA, 50 bp, homo sapien
tcatctgctaagatttaaaaatgtcratacctgcccctgccccctgtgat

SEQ ID NO: 79930 - DNA, 50 bp, homo sapien
agagcaatttttatatatcacgctaygtgctttgggtgtaaatgacagca

SEQ ID NO: 79931 - DNA, 50 bp, homo sapien
aaatattgtcatgccttagttgaaayggaatggaaggattcgtttgcaaa

SEQ ID NO: 79932 - DNA, 50 bp, homo sapien
ttatctgttcctcaagtggactctargtaatctctccctttagtaataga

SEQ ID NO: 79933 - DNA, 50 bp, homo sapien
tctaggaagttactctattaaataawcatggatgtgtgcaaagtttcagg

SEQ ID NO: 79934 - DNA, 50 bp, homo sapien
aggattttgtgtagatttgcacgtcygtcttttttcttcctttctctttc

SEQ ID NO: 79935 - DNA, 50 bp, homo sapien
aatctttggttatctcaaaacaaaasaaaatgtcctgttattgtcatcca

SEQ ID NO: 79936 - DNA, 50 bp, homo sapien
cttttagatttaggagaaattactawgacaaaatgtgacaaaaaccaact

SEQ ID NO: 79937 - DNA, 50 bp, homo sapien
gtgaaggaaattatacaacagaagcrcagtgaagggatatcgtttttcac

SEQ ID NO: 79938 - DNA, 50 bp, homo sapien
atgttacataaaaatgcccatgtacyggtaacaaaagaagatcttaaatc

SEQ ID NO: 79939 - DNA, 50 bp, homo sapien
ttaaaaaattataggattgtattaayagctaaaccataacaagagtgggt

SEQ ID NO: 79940 - DNA, 50 bp, homo sapien
ccactagctggatcctctctgtaaayattaggtttctcatctgtaatata

SEQ ID NO: 79941 - DNA, 50 bp, homo sapien
ttcagggaaattgtattgagaatagkcccaatttgtttgtagaaagactt

SEQ ID NO: 79942 - DNA, 50 bp, homo sapien
gtggagctattgatacaatcaagaamaattctgatagtaacatcactcac

SEQ ID NO: 79943 - DNA, 50 bp, homo sapien
tacaacataatcagagagaaatctawcaggaaacaaaatttccaggcatt

SEQ ID NO: 79944 - DNA, 50 bp, homo sapien
gtcaggtgtgttcctctaatggctcrtggggaaaaacaatctctctgttt

SEQ ID NO: 79945 - DNA, 50 bp, homo sapien
ctctggaaagcaaattcactacaaargattgaagcaaaaaggaagagtta

SEQ ID NO: 79946 - DNA, 50 bp, homo sapien
gatggtttggactaatctgactctckcgtgcatgttgttttcatcctcta

SEQ ID NO: 79947 - DNA, 50 bp, homo sapien
tgccttgtgcaactgattaagactcractccatagagctgtcctgaaaag

SEQ ID NO: 79948 - DNA, 50 bp, homo sapien
ggaaagccagttggaccttctgaggyaattcaattctgttcttttcagga

SEQ ID NO: 79949 - DNA, 50 bp, homo sapien
tgctgtagttctgttttgattattamccttttgagatgttgttacctgtt

SEQ ID NO: 79950 - DNA, 50 bp, homo sapien
gccatgctcacattctcctgctttayaagatgggaaaaaaagatattgta

SEQ ID NO: 79951 - DNA, 50 bp, homo sapien
ctctactgactcttctatcttcacaytctatcatttctttcctgtcctgg

SEQ ID NO: 79952 - DNA, 50 bp, homo sapien
ggccagtggtatcagtgtggctagakcgagactttaaagggacagacact

SEQ ID NO: 79953 - DNA, 50 bp, homo sapien
tagcttgtgttatctaatgctatcaygtcatctacagatctacagagaaa

SEQ ID NO: 79954 - DNA, 50 bp, homo sapien
ccaggcaaaacttgtatagggctgaycctggaagcgtgcctgtagataag

SEQ ID NO: 79955 - DNA, 50 bp, homo sapien
tcaaaacataagagcctgaaaggatytcccacaatcatctggtctagctt

SEQ ID NO: 79956 - DNA, 50 bp, homo sapien
ttttgggctttgaaaattatgagtakgaaattgggaataatagaacgtgg

SEQ ID NO: 79957 - DNA, 50 bp, homo sapien
caggatagttgctactcctatagaayataaacccatgcatttgattctca

SEQ ID NO: 79958 - DNA, 50 bp, homo sapien
aaaatgcttaaaatcttgctgcaggkattagacttagtcatttgaaagct

SEQ ID NO: 79959 - DNA, 50 bp, homo sapien
caaacctattgcggagcaattgggcmaaataataatccttgattaacagc

SEQ ID NO: 79960 - DNA, 50 bp, homo sapien
ttctaatccagagtgctctctactaycatattttatttctcaaaaagagc

SEQ ID NO: 79961 - DNA, 50 bp, homo sapien
agagaagggaaagagagcttaaaagsaagttttggaatggaactttgaca

SEQ ID NO: 79962 - DNA, 50 bp, homo sapien
tcatccgataagatcttgtttgaaasacaggtacgttatgaagtattctg

SEQ ID NO: 79963 - DNA, 50 bp, homo sapien
atgtagtaaacaggaaatttagatgyatgaagaatttgtatttaatcgag

SEQ ID NO: 79964 - DNA, 50 bp, homo sapien
tgtaaatatgactgtacccttacttkaccactctgattagagtgaaggac

SEQ ID NO: 79965 - DNA, 50 bp, homo sapien
tgaaaatatttggatataattgaaastaaaaaggaaatcccatgaccact

SEQ ID NO: 79966 - DNA, 50 bp, homo sapien
aggacacctgatgtaggaaaagcaastccattacataggcttagccaatc

SEQ ID NO: 79967 - DNA, 50 bp, homo sapien
agatacagtggttgtgtttgagttaygctgaaatacagtagcaagtaatc

SEQ ID NO: 79968 - DNA, 50 bp, homo sapien
tattgtttcagagtgctatcaagaaygtatatgaattaggagtaattgtt

SEQ ID NO: 79969 - DNA, 50 bp, homo sapien
gattgcctatatttctgatcttacartcatcttggtaccaagtgagacca

SEQ ID NO: 79970 - DNA, 50 bp, homo sapien
taactcttctacagaatggatcagaytctatttctaacaagtctggcatt

SEQ ID NO: 79971 - DNA, 50 bp, homo sapien
caattctcaaagctttgaccagtcayaaggggaggttaagtaatcaatca

SEQ ID NO: 79972 - DNA, 50 bp, homo sapien
tgtgattttttaaacagatttttcayctaaactgtaattcatcatatata

SEQ ID NO: 79973 - DNA, 50 bp, homo sapien
aaacacctaccattgcaggagtaaakaatccaaaaccaggaggtcaaaaa

SEQ ID NO: 79974 - DNA, 50 bp, homo sapien
atgttatagaaagaaaaagaagtgayaagattagagaagtatgttgggaa

SEQ ID NO: 79975 - DNA, 50 bp, homo sapien
atttcatattaggtgatatttgacascatccaggatacatgaatcctttt

SEQ ID NO: 79976 - DNA, 50 bp, homo sapien
actcatttaagcagttttgttactamccatcatttcaacctgcttagttg

SEQ ID NO: 79977 - DNA, 50 bp, homo sapien
agctgatgataaaggccggaacctcrcttctcttccctaggttgtttttt

SEQ ID NO: 79978 - DNA, 50 bp, homo sapien
acaatatagtaagttggtttttagayacgatgacattgagcttacgggct

SEQ ID NO: 79979 - DNA, 50 bp, homo sapien
aatcaaattttacccattctttaagkcctgtcatgtggcccaattatttc

SEQ ID NO: 79980 - DNA, 50 bp, homo sapien
ttttttttagaaccgtgaccattaarccgttaattcccactgttatggac

SEQ ID NO: 79981 - DNA, 50 bp, homo sapien
gccttgccttcaccatacagcatacrcatatttctttaccctgcctcctt

SEQ ID NO: 79982 - DNA, 50 bp, homo sapien
taatatctgtctattttatgtaagastatatataatccagtaatttttga

SEQ ID NO: 79983 - DNA, 50 bp, homo sapien
caggtttgtgatttgtgttttattaraagattgagttagtgtcatgatac

SEQ ID NO: 79984 - DNA, 50 bp, homo sapien
tttaactcctttcctcctgagcaacrtgactgagtattccataggcaggg

SEQ ID NO: 79985 - DNA, 50 bp, homo sapien
tggcaatggcactactggtacaagarcaatatgccaagcagctggtggca

SEQ ID NO: 79986 - DNA, 50 bp, homo sapien
tcagaacgagaacatgatagtctccyatgtcgtgaaagggtttataaaca

SEQ ID NO: 79987 - DNA, 50 bp, homo sapien
ttctacccacatatttgccaaataartgtataaataaataaataaatgaa

SEQ ID NO: 79988 - DNA, 50 bp, homo sapien
tcaccaccacacacacccactggatragccttctcgttatttgtcatcct

SEQ ID NO: 79989 - DNA, 50 bp, homo sapien
atcttgctcaccaatgcgctttctamtgtctgagtgaaaagtatgccctc

SEQ ID NO: 79990 - DNA, 50 bp, homo sapien
tcaggtgagattattatactgtacawccagcaagtagagtctagtcttct

SEQ ID NO: 79991 - DNA, 50 bp, homo sapien
tagaaaacaattatcaggatggaatyatgagttgaatgtcccatttgtct

SEQ ID NO: 79992 - DNA, 50 bp, homo sapien
acctttgggacttcagggcattccamtgaaaactttaatctctctttccc

SEQ ID NO: 79993 - DNA, 50 bp, homo sapien
cctctgaaggaattggtctatgctgracaactggtaactccactgtggtc

SEQ ID NO: 79994 - DNA, 50 bp, homo sapien
gcacaagtgaaactgccattgcaaartttactactgagacagtgaaagtg

SEQ ID NO: 79995 - DNA, 50 bp, homo sapien
ggctaaaattagactttttagaacartatacaacattgggttgtgtgaaa

SEQ ID NO: 79996 - DNA, 50 bp, homo sapien
tagaaatttctgcataatctgccacrtaattaaaagtaggtataaatatg

SEQ ID NO: 79997 - DNA, 50 bp, homo sapien
gttaattgaatcatgtacacgcgacrctccagtggacatggggctgtaga

SEQ ID NO: 79998 - DNA, 50 bp, homo sapien
gctctcattttccatgtgttgaatakctgtgtcttagaggtcattatcag

SEQ ID NO: 79999 - DNA, 50 bp, homo sapien
aaagatcacctttccctactacaaayatcaagcaggcccagtattttggt

SEQ ID NO: 80000 - DNA, 50 bp, homo sapien
aatgctccctcaaaacaggacaatcwcctaacatggaagtgcttgaatgc

SEQ ID NO: 80001 - DNA, 50 bp, homo sapien
tgcatcttctagaagactgtgaagasattgcactgggccaaccatacttg

SEQ ID NO: 80002 - DNA, 50 bp, homo sapien
tgagtctcacagcaagtctatgagayggactaacacccatggtcaatttt

SEQ ID NO: 80003 - DNA, 50 bp, homo sapien
agggatagttttgtatttgagcataygtggaactcatcctccttgtgtgt

SEQ ID NO: 80004 - DNA, 50 bp, homo sapien
ccatgaactctactcttttgaccacsagtacctgctgaaagttgctggaa

SEQ ID NO: 80005 - DNA, 50 bp, homo sapien
aaaataagaagtagagttaaaaaaargatagcaggagcccattttcagga

SEQ ID NO: 80006 - DNA, 50 bp, homo sapien
ccacttctttgctgttgtttgggcakaaccctggatttggatgttggttt

SEQ ID NO: 80007 - DNA, 50 bp, homo sapien
caagcttctcttttcccttaccttayaaacatgactccttcttttctctt

SEQ ID NO: 80008 - DNA, 50 bp, homo sapien
gctctcagcattcatataacatagamcttcactcaaagttggagcatcca

SEQ ID NO: 80009 - DNA, 50 bp, homo sapien
actcagaaacccaatgtgtgcaaccratgagagtatcatggctttatcag

SEQ ID NO: 80010 - DNA, 50 bp, homo sapien
ttcttgagccttacatgctatgccamaaacatgcactaggcattgatttt

SEQ ID NO: 80011 - DNA, 50 bp, homo sapien
taaaccaggaataagtgattctcaarttccacacagcatatatgcacagg

SEQ ID NO: 80012 - DNA, 50 bp, homo sapien
cagtcccagtaggttcactgattgaygcatagctgttttgcacagctttt

SEQ ID NO: 80013 - DNA, 50 bp, homo sapien
gtttaatagatctttggttgtaatakcatttggtatattcttctatgtta

SEQ ID NO: 80014 - DNA, 50 bp, homo sapien
ttgatgtctttttataaggatgtagraaacagagcagccttctcttcaaa

SEQ ID NO: 80015 - DNA, 50 bp, homo sapien
caaaggaaaaagcaaaaattcaggcyatgttatgcctcacatgtaaaata

SEQ ID NO: 80016 - DNA, 50 bp, homo sapien
atttttgctttttcctttggatttaygaatgactacaaacttcctaaaga

SEQ ID NO: 80017 - DNA, 50 bp, homo sapien
tttattttgtctttaatacttcatargtggcttttgatatgcaattactt

SEQ ID NO: 80018 - DNA, 50 bp, homo sapien
tcccccaaccctagtttgcacagttygaggctcaaaaagagatcccttcc

SEQ ID NO: 80019 - DNA, 50 bp, homo sapien
ttgctaaattctgtctgaatcactcraatcttctcaattttggaaatctt

SEQ ID NO: 80020 - DNA, 50 bp, homo sapien
ctgggtttgcacattaatactctaargtttaagctcacacatatgcatgt

SEQ ID NO: 80021 - DNA, 50 bp, homo sapien
acatgggcaaagtacagtccacaaayatgagtgtctatttcttgagaatc

SEQ ID NO: 80022 - DNA, 50 bp, homo sapien
tagtatctcagattgttattcgatckattcatttaaaaatactatttggt

SEQ ID NO: 80023 - DNA, 50 bp, homo sapien
aatattataaaagcttaagattatayaagaacttgaaagatcatgtgggt

SEQ ID NO: 80024 - DNA, 50 bp, homo sapien
aaacttgacatgtgtctctggaaagycctgcttcatggtgtatcattcca

SEQ ID NO: 80025 - DNA, 50 bp, homo sapien
gaaagttgtgtgtgcagtggctataragaagagtcacctccagctatgtt

SEQ ID NO: 80026 - DNA, 50 bp, homo sapien
taaggtggaaacagaagaaaacaatsataatgcttgaccaagaaatgtca

SEQ ID NO: 80027 - DNA, 50 bp, homo sapien
tgtcacctctttcgtggtacagtacragggactagtgttgacaagctatg

SEQ ID NO: 80028 - DNA, 50 bp, homo sapien
tgagcctaaaaccactcaactcatcrctgtgaagtagtacccagttctca

SEQ ID NO: 80029 - DNA, 50 bp, homo sapien
tataaatgtcagtctttctgtctcakatgtgctttgtgtatcagaggaga

SEQ ID NO: 80030 - DNA, 50 bp, homo sapien
tagcttatataatttcaatatcaccrattagagaaaagccaaagatttgt

SEQ ID NO: 80031 - DNA, 50 bp, homo sapien
aactcaataagccccaaatcaatttkcttctctgtgtaatcagaaaagtt

SEQ ID NO: 80032 - DNA, 50 bp, homo sapien
tatcataaatacaaaactaatattcragaaacgacagaattgagtttcac

SEQ ID NO: 80033 - DNA, 50 bp, homo sapien
tttaaactgttagtcaggcctaaaamgttgaaaatgttcattctgaaatt

SEQ ID NO: 80034 - DNA, 50 bp, homo sapien
ccagttctttgctcataggaaattarcagtggatcaactattgtatcata

SEQ ID NO: 80035 - DNA, 50 bp, homo sapien
gctgtagttcaaatgcctgacaaaaytactggaaaagaatgagtacacag

SEQ ID NO: 80036 - DNA, 50 bp, homo sapien
acccagaagcctggacctccaaaccrgagctattaatcacagcggtcatg

SEQ ID NO: 80037 - DNA, 50 bp, homo sapien
agtcaaatcacagtgttgactcaacwgaagtttaccaaaatcctcagcca

SEQ ID NO: 80038 - DNA, 50 bp, homo sapien
ttcacatgctgcagcttgaattgaakgcttgggtcactaagtcattttct

SEQ ID NO: 80039 - DNA, 50 bp, homo sapien
tgttattcaattttataggcttaggytcaaaatactacctttactcagtc

SEQ ID NO: 80040 - DNA, 50 bp, homo sapien
aagctgaagcacatgataaaaatgayactattgaataagaaaacttcaga

SEQ ID NO: 80041 - DNA, 50 bp, homo sapien
ttctcattgttcccctctcttcagcrcactcccattcatgaccatatttc

SEQ ID NO: 80042 - DNA, 50 bp, homo sapien
tttctttcttttgaatgcattaaacrcacattgaagaagtaagcctgtgt

SEQ ID NO: 80043 - DNA, 50 bp, homo sapien
tgataaaaacaaagaactggatcaamactggaaaggagaacgctcagagg

SEQ ID NO: 80044 - DNA, 50 bp, homo sapien
tcacaggaaactgagatctaaagcartactctccaaccatgttcatgtca

SEQ ID NO: 80045 - DNA, 50 bp, homo sapien
aaaataatccccaagccaggtccttwacttcccggaggatctgattcagc

SEQ ID NO: 80046 - DNA, 50 bp, homo sapien
accctcattataccttgcctggctawactttattctcttcttgtcttctg

SEQ ID NO: 80047 - DNA, 50 bp, homo sapien
caggcctggggatagggcctggtatmcctattttgaaagatctcattaag

SEQ ID NO: 80048 - DNA, 50 bp, homo sapien
tttttaacctattttatctattttcrcctttgatttatccttttagtcta

SEQ ID NO: 80049 - DNA, 50 bp, homo sapien
agatcagtctagaggagggtgcataygtaaagcagtattaggagcaaggg

SEQ ID NO: 80050 - DNA, 50 bp, homo sapien
tcttacctgatctgtccactttgtgygccagaattgagcctgcaggtata

SEQ ID NO: 80051 - DNA, 50 bp, homo sapien
gaaaaacttgaattggagtttattgragttataagagatcttgtagacca

SEQ ID NO: 80052 - DNA, 50 bp, homo sapien
caatatatagttattaactctaatcrccacaatatacaatggatctcttg

SEQ ID NO: 80053 - DNA, 50 bp, homo sapien
cttcagttctgtcttgctaggtcatsaaaccagagagagaagaaagactc

SEQ ID NO: 80054 - DNA, 50 bp, homo sapien
tgaggtcaggagaagtaagggtgacmaatccagaactatctccactacat

SEQ ID NO: 80055 - DNA, 50 bp, homo sapien
gccctccgctatgcctttccctactsactgttcagagttctagctaaccc

SEQ ID NO: 80056 - DNA, 50 bp, homo sapien
ttattaaggaaaagaaaacaaattaygtgatgtgttatccccctttatcc

SEQ ID NO: 80057 - DNA, 50 bp, homo sapien
tttccagcatgagaagagcccagagkatagcgacggctgtgggatctcac

SEQ ID NO: 80058 - DNA, 50 bp, homo sapien
atagggaggagaaaacagaaaccgasaagaatatttctttgcatttgcct

SEQ ID NO: 80059 - DNA, 50 bp, homo sapien
gcattagaaataaatatccaaataayatcagagactgcctttaagtggca

SEQ ID NO: 80060 - DNA, 50 bp, homo sapien
gggactaagtgaaaggcaggcaaacyggttggtgagatcccacagccgtc

SEQ ID NO: 80061 - DNA, 50 bp, homo sapien
tgccaacaagacaggaggaaatatgrataggttaacccccaaggacagca

SEQ ID NO: 80062 - DNA, 50 bp, homo sapien
gatattttctattttcttatagtcarataggccaatgttttccataattt

SEQ ID NO: 80063 - DNA, 50 bp, homo sapien
cataaacttctgcttagagagacaaygtaaaggcattcagctacttgtga

SEQ ID NO: 80064 - DNA, 50 bp, homo sapien
tgtggtattggtgtcaagtcaaatarataaatagaccaaaatgaataatt

SEQ ID NO: 80065 - DNA, 50 bp, homo sapien
ctaataatgataattaatggtttctyaactggacatatgtaagtatgaaa

SEQ ID NO: 80066 - DNA, 50 bp, homo sapien
atacttcatttttgtctcattttaakaaattttgtcacagccatcccaat

SEQ ID NO: 80067 - DNA, 50 bp, homo sapien
caaaaagcagccagaaggccaataamagatatgcagggcatttggtagaa

SEQ ID NO: 80068 - DNA, 50 bp, homo sapien
atcagcctgtcagattgtttactgcygaaatcctagcctaacattcatct

SEQ ID NO: 80069 - DNA, 32 bp, homo sapien
agagaaaggtaagtgasaaatatataaaattc

SEQ ID NO: 80070 - DNA, 50 bp, homo sapien
gagggtgctgaagagttggaaagtcratcttggtgcctcatcctgagggg

SEQ ID NO: 80071 - DNA, 50 bp, homo sapien
cagcaaccttctgttcatgctcagartagatggcattggctggtccacct

SEQ ID NO: 80072 - DNA, 50 bp, homo sapien
tacatatacaaagaactccaatccargatagaatgatagaaattccttaa

SEQ ID NO: 80073 - DNA, 50 bp, homo sapien
ctacaacttaattagttggctggaayataaaggatacatttacagaatgc

SEQ ID NO: 80074 - DNA, 50 bp, homo sapien
acacctagttatagatgttgttaggractttattcatcttgataaagaag

SEQ ID NO: 80075 - DNA, 50 bp, homo sapien
atgacccatccacttgtctcactcayggaacactcccctgtggctgggac

SEQ ID NO: 80076 - DNA, 50 bp, homo sapien
aatgtctaaatttttaaaattgcaaracagataaataggctttgttgact

SEQ ID NO: 80077 - DNA, 50 bp, homo sapien
ggataatgtttatgccccatttacasgacaaaacaaaattaagaacattg

SEQ ID NO: 80078 - DNA, 50 bp, homo sapien
ctactacaagagcctagtgtggcagyattgagaaaggaaagagagggata

SEQ ID NO: 80079 - DNA, 50 bp, homo sapien
gatatagatatggcaaagcattataygtagcattaaattattgttacctt

SEQ ID NO: 80080 - DNA, 50 bp, homo sapien
tctagaaatatttctatgagatccayacgcaaaaactggaggcatgggat

SEQ ID NO: 80081 - DNA, 50 bp, homo sapien
gtgagaaaccgttcatcaaatagaamacatacagatatcgaactaatatg

SEQ ID NO: 80082 - DNA, 50 bp, homo sapien
gtgttaggctgaacactggatactayggtgaagactgttagttactttaa

SEQ ID NO: 80083 - DNA, 50 bp, homo sapien
gcaagcacattctaggtaggttaaartctctaaatgaaaccaaagcttta

SEQ ID NO: 80084 - DNA, 50 bp, homo sapien
aacagggaaggaccctgagtgctcamacgttctactgcattctgtgagtg

SEQ ID NO: 80085 - DNA, 50 bp, homo sapien
atgcaggaactaatagcttatgatgrtgcctagagattatagccaggtgc

SEQ ID NO: 80086 - DNA, 50 bp, homo sapien
tactgaaagacatccatcacattccrctaagcgatttccccaccctccac

SEQ ID NO: 80087 - DNA, 50 bp, homo sapien
cacatcatcacatggccctaaaaaayttgtatatgtgtgctcctctgagg

SEQ ID NO: 80088 - DNA, 50 bp, homo sapien
attaattccaaaagaaatccatgtarggtgacaagtttgactttgacatc

SEQ ID NO: 80089 - DNA, 50 bp, homo sapien
agtgctgtccaattcaatcatctttygctcaaataaattctgctaaattt

SEQ ID NO: 80090 - DNA, 50 bp, homo sapien
gagtcaaaagacttttggatgacttsaaggatactggaccctgacagtgg

SEQ ID NO: 80091 - DNA, 50 bp, homo sapien
tagcataaaaatgactatttgcatastataagagaacaaggaagaaaatc

SEQ ID NO: 80092 - DNA, 50 bp, homo sapien
ccccagtcctacttgaaattcatcakgcagatcaagttgcccttaatcag

SEQ ID NO: 80093 - DNA, 50 bp, homo sapien
agaagaaccacctgccaaatctcacsgtaagtcactgcttaatgcagggc

SEQ ID NO: 80094 - DNA, 50 bp, homo sapien
cataaaagatgcaaaagagacaagaygggggactcaccacaaggcctatc

SEQ ID NO: 80095 - DNA, 50 bp, homo sapien
tgtcatcatgaatatgtactttcaamtatgggtaaacattctagatgtta

SEQ ID NO: 80096 - DNA, 50 bp, homo sapien
aatttgaaacttctaaaagtcatacyttgattttcaatacttcattctct

SEQ ID NO: 80097 - DNA, 50 bp, homo sapien
cactggtaaggtgtgtgtttatgcaycctgccaacaggtctttttttcct

SEQ ID NO: 80098 - DNA, 50 bp, homo sapien
caggaggcagaaactgttaccagcaytagcggatgtgaaaaatggggcag

SEQ ID NO: 80099 - DNA, 50 bp, homo sapien
aagcagtgcatcatatttggagacaytaattttgagtcaagtagaagtct

SEQ ID NO: 80100 - DNA, 50 bp, homo sapien
aaatcctaacatcttcggtagcatasaagaccgttcctgagcctggcccc

SEQ ID NO: 80101 - DNA, 50 bp, homo sapien
gtataacaagaaagcaggtggtctaygtgtcaaaaattggacatggaatt

SEQ ID NO: 80102 - DNA, 50 bp, homo sapien
ggctggaataggtcttttgaaaccamggaaatgagataatttcctgtaat

SEQ ID NO: 80103 - DNA, 50 bp, homo sapien
ttaaaaagcataacaccacgtgcatsataagctctcaataaatacaggct

SEQ ID NO: 80104 - DNA, 50 bp, homo sapien
gcatctggaggcagagttctcactamaacctttccaagagctgtttcaat

SEQ ID NO: 80105 - DNA, 50 bp, homo sapien
tactatactgtattataattttcacrgcatggcatgtgatatactaattt

SEQ ID NO: 80106 - DNA, 50 bp, homo sapien
cccacctcaggtccttcaatagtggraataatttttacaaacacctgacc

SEQ ID NO: 80107 - DNA, 50 bp, homo sapien
atcctaggctccacaattagagagayggaaagcttagtctggatttagaa

SEQ ID NO: 80108 - DNA, 50 bp, homo sapien
aagttctagaaataaattattgaaaygtgtgtaaaaggcaaaatataatt

SEQ ID NO: 80109 - DNA, 50 bp, homo sapien
tcctattaattatgtaaatataaacmaaattgtcatggcttaatgagcta

SEQ ID NO: 80110 - DNA, 50 bp, homo sapien
tgaagtagctatgatgttgggtaaaytctaaatgtcaggttagggagaac

SEQ ID NO: 80111 - DNA, 50 bp, homo sapien
agccacaggaacatcatttgtgagaygcacaattcacagaggaacacaga

SEQ ID NO: 80112 - DNA, 50 bp, homo sapien
cagggatttgaatggctattgtttgraagactggggaaacagttactgcc

SEQ ID NO: 80113 - DNA, 50 bp, homo sapien
aacggagccattcactactaatgaartggagtgtggcccagagtttagca

SEQ ID NO: 80114 - DNA, 50 bp, homo sapien
tacttttccttccactaaaacataarcatcatgtgggcagtaactgtttc

SEQ ID NO: 80115 - DNA, 50 bp, homo sapien
tgaagaaaagtagggctgagtccaakaacagcgattagaaggtgctacct

SEQ ID NO: 80116 - DNA, 50 bp, homo sapien
gtgattttttaactttatctaaaatsaaaaggcattggatgttctactcc

SEQ ID NO: 80117 - DNA, 50 bp, homo sapien
gagaccaggtgctctaaacctgtgamatacaaaacctgtgaaattaacca

SEQ ID NO: 80118 - DNA, 50 bp, homo sapien
ctggtatctgcaagactgataaatgrgaaaacatgtcataaactgaccat

SEQ ID NO: 80119 - DNA, 50 bp, homo sapien
aaacatttctcactaagcatgttttkacctgattttcttcccggtaatac

SEQ ID NO: 80120 - DNA, 50 bp, homo sapien
gaatacttgcatggcttgatatagargagtcatgccaataaatggaataa

SEQ ID NO: 80121 - DNA, 50 bp, homo sapien
atggaaggatgaagattgaatgtgamtatgcaagtgagagaggaaaatat

SEQ ID NO: 80122 - DNA, 50 bp, homo sapien
ggagaaacaaagaaatgggacgaaamcagataatactcatctgtggaata

SEQ ID NO: 80123 - DNA, 50 bp, homo sapien
ttacattctaaggtggaacacatcarataaatacatatttaaataagtca

SEQ ID NO: 80124 - DNA, 50 bp, homo sapien
gtcttttttcagtgaaattacagtcratgaataaagatcaaccatgaatt

SEQ ID NO: 80125 - DNA, 50 bp, homo sapien
actttgaaaggctgcaacagattaartgtggctagatgaaaagtgaacgt

SEQ ID NO: 80126 - DNA, 50 bp, homo sapien
aaggctgattcagcatgtaacagaaygtgcaaccttatatttttctaacc

SEQ ID NO: 80127 - DNA, 50 bp, homo sapien
tcagaaggcagcgactctcacttaawggtgcctcagctactctggggagc

SEQ ID NO: 80128 - DNA, 50 bp, homo sapien
tttctcatctgtataataggatcacygatttctaccttgcaaatggacag

SEQ ID NO: 80129 - DNA, 50 bp, homo sapien
gctgggcattgacacaaaatcaagaygagagccactcctccacagagaag

SEQ ID NO: 80130 - DNA, 50 bp, homo sapien
agcctggattcacattttactgaaayatgttgcattgactctcagtctga

SEQ ID NO: 80131 - DNA, 50 bp, homo sapien
caaacaggttgtgatgagctcttgayggggaaatgtaatgaaggagcagg

SEQ ID NO: 80132 - DNA, 50 bp, homo sapien
caagcaagtattagcttctaggtgtkcctgctgagtagatgacgggtctg

SEQ ID NO: 80133 - DNA, 50 bp, homo sapien
aacttgctatgaaaattcagtattaygctactattattgttataattatt

SEQ ID NO: 80134 - DNA, 50 bp, homo sapien
tcctgtgggtccagcaaatcccataractccagtgagtatttgaagcaag

SEQ ID NO: 80135 - DNA, 50 bp, homo sapien
gaaaatccacaggaagtgtgtcatasgctgccaagtttgatcagtattgc

SEQ ID NO: 80136 - DNA, 50 bp, homo sapien
gtctgatggtagaatttgatgtaagraaattatgtgagttgtgcacatat

SEQ ID NO: 80137 - DNA, 50 bp, homo sapien
tacatcttatgtccaatagatgacasaaaagaattgcatcggaaccccat

SEQ ID NO: 80138 - DNA, 50 bp, homo sapien
tcagatctaacttagctggacctatragcctctaaatcaagcaaaggcat

SEQ ID NO: 80139 - DNA, 50 bp, homo sapien
acaggaccagcctcttcttcagataygatgcctccatgagcacagcctaa

SEQ ID NO: 80140 - DNA, 50 bp, homo sapien
ctttcaaggtagtatccaaaaaactyacatagattgtcctataccctacc

SEQ ID NO: 80141 - DNA, 50 bp, homo sapien
aattccatgattcctgaaatagattraagaggtttctgttctcaacaact

SEQ ID NO: 80142 - DNA, 50 bp, homo sapien
gaaataggtcaggttattgaagtggycatctagcagttaagtctaaggat

SEQ ID NO: 80143 - DNA, 50 bp, homo sapien
tttgctgtactttccaaagggaagamgcaagttgaggcaggctcatcagg

SEQ ID NO: 80144 - DNA, 50 bp, homo sapien
ctacttccttaataaagttttgtgakgatgcaccccaggctagcacatca

SEQ ID NO: 80145 - DNA, 50 bp, homo sapien
tggcttcccctgcttatgacaaagasgagccctcaactctattcttttct

SEQ ID NO: 80146 - DNA, 50 bp, homo sapien
tctttgtcataagcaggggaagccaygtaatagaaaggtctagaaaggag

SEQ ID NO: 80147 - DNA, 50 bp, homo sapien
tgtgccagacaccaattctagcctayaacttagagcagagacttcaggca

SEQ ID NO: 80148 - DNA, 50 bp, homo sapien
ccgtggtgttagctagttaagatcckgaagtgctatcacacaggatggga

SEQ ID NO: 80149 - DNA, 50 bp, homo sapien
gagaatagtgttaactagtatcttgyagaaaataatggcattgtatctat

SEQ ID NO: 80150 - DNA, 50 bp, homo sapien
cagcccaaggaactaaggcatacagwcattaccatggcccaaactgcttt

SEQ ID NO: 80151 - DNA, 50 bp, homo sapien
atgtttctagctcatttatctgaaaytagagttcgtatgtaaggatgaaa

SEQ ID NO: 80152 - DNA, 50 bp, homo sapien
aggcattaacccattgtttggtggaytatgagaaagttctgggaatcata

SEQ ID NO: 80153 - DNA, 50 bp, homo sapien
cagtgcttatctttacttctttccaytatttatgtctggccatgtacggg

SEQ ID NO: 80154 - DNA, 50 bp, homo sapien
cacatggaagtgaaaggataataaaytcaagtggatgacagccatacatt

SEQ ID NO: 80155 - DNA, 50 bp, homo sapien
actttattagttactatgtctgtcayaaccaggaaagaacagccagccat

SEQ ID NO: 80156 - DNA, 50 bp, homo sapien
acatgtattttaatcaagctgtagartcatttttggtaggaaaagccatt

SEQ ID NO: 80157 - DNA, 50 bp, homo sapien
atattcagagattgcttattatcaargaagatagggttaatgtttatctc

SEQ ID NO: 80158 - DNA, 50 bp, homo sapien
tccccagttgggactgtgaatatgayggattttactcccgaggttaggtc

SEQ ID NO: 80159 - DNA, 50 bp, homo sapien
acacaccaggaagaattcaagctaawctgtgtggtgataccaaccgatgc

SEQ ID NO: 80160 - DNA, 50 bp, homo sapien
cttaatgatcttgtactgtcaccacyagataacaacaaacggattatggt

SEQ ID NO: 80161 - DNA, 50 bp, homo sapien
caaagtgtctttttgatcatgattcytgagaaatattgcacctcaagtgg

SEQ ID NO: 80162 - DNA, 50 bp, homo sapien
ctgaaatcacacaatgttgaaagcartcaaagacaacagtgtagccaaat

SEQ ID NO: 80163 - DNA, 50 bp, homo sapien
ctcacagtcattgtcccagcagataytaaacatgccgttttatgctgaag

SEQ ID NO: 80164 - DNA, 50 bp, homo sapien
attctaacatcagggagctcattaaytcacaaggtagccctgcactttct

SEQ ID NO: 80165 - DNA, 50 bp, homo sapien
agtctgttgttaatcctcctgcagamagtaaatggtccaggtaagggctt

SEQ ID NO: 80166 - DNA, 50 bp, homo sapien
aaacaactggagtaaaaaggaagacygctcacatctcaaggggtcatact

SEQ ID NO: 80167 - DNA, 50 bp, homo sapien
agcccagaagtactcagtaagacaaytgctatcacaaaaaaaaaagttac

SEQ ID NO: 80168 - DNA, 50 bp, homo sapien
ctggagtttatgtagcataacttaastagacataacatctgtctaattca

SEQ ID NO: 80169 - DNA, 50 bp, homo sapien
acagggggatcagaagacaccaaatyagatgaaatccaaggaacagagga

SEQ ID NO: 80170 - DNA, 50 bp, homo sapien
tgaaaggatagcaacatgtaataaaytatcttctccaagtaccactttga

SEQ ID NO: 80171 - DNA, 50 bp, homo sapien
aatgtttacatatgtaacaatttagkccattagtatgtatatgttggaat

SEQ ID NO: 80172 - DNA, 50 bp, homo sapien
agtttgcccacactctcctcttaagmatctatgttttttgtcctgagagt

SEQ ID NO: 80173 - DNA, 50 bp, homo sapien
tacttttcatctccctttttatttayacttcacagccacatttctgctct

SEQ ID NO: 80174 - DNA, 50 bp, homo sapien
acaatttgaaatcaactctgctgaaygttagcgaacaggaagaacagtga

SEQ ID NO: 80175 - DNA, 50 bp, homo sapien
aatactaaatatactttgcaaccctmagatttatgatacttgagttttta

SEQ ID NO: 80176 - DNA, 50 bp, homo sapien
taacttatcttctccaactttacaayttcagaccttttgtatttgccact

SEQ ID NO: 80177 - DNA, 50 bp, homo sapien
aagaagcaccgaccgagagtgacgaygttttatccgtagaggcacccact

SEQ ID NO: 80178 - DNA, 50 bp, homo sapien
catttgttgatagcactgattcctarcagggttattttcattcctggctt

SEQ ID NO: 80179 - DNA, 50 bp, homo sapien
ttctagagaagagctgggaaaagaastgacaatcagtaacatcccttcca

SEQ ID NO: 80180 - DNA, 50 bp, homo sapien
tgccaggagctaagtgatgggagaaygggacgttagtgtttaataagtaa

SEQ ID NO: 80181 - DNA, 50 bp, homo sapien
ttttttgttgtttgatttagtgctarcatagaatagtccaaatcacaatg

SEQ ID NO: 80182 - DNA, 50 bp, homo sapien
cagtttcaggctaggttcttgccctrtatgtgtgacttcaggttgggctt

SEQ ID NO: 80183 - DNA, 50 bp, homo sapien
ttgggtgcagttagattatgtggtcrgtgatccaggaagcagaggtaggg

SEQ ID NO: 80184 - DNA, 50 bp, homo sapien
attattagctgttcagtgttcccaasaaaatcagtgacagcagcccctga

SEQ ID NO: 80185 - DNA, 50 bp, homo sapien
tcaggcaaggtcaggacacttgtccwcagtaaagagctaataaaatagtg

SEQ ID NO: 80186 - DNA, 50 bp, homo sapien
tgcattgtgcatagtcacttgatccraaagatgaaaataagaaatccaag

SEQ ID NO: 80187 - DNA, 50 bp, homo sapien
gggtggtgatcacaaataaggcgtcrctctatcatgaggaactcagtgga

SEQ ID NO: 80188 - DNA, 50 bp, homo sapien
tctggggcagctctgccctagccacrctctggtaatgtattattcttagt

SEQ ID NO: 80189 - DNA, 50 bp, homo sapien
gtgaaaaatgtaaaattgctagagawcatctaattcagttatttccaacc

SEQ ID NO: 80190 - DNA, 50 bp, homo sapien
gtgtttagttaccaggcaagcaggamgccacaatggtgactcagtgtgtg

SEQ ID NO: 80191 - DNA, 50 bp, homo sapien
gactggtttactggttgatcaaaaarcacctgagttggtaattatttctg

SEQ ID NO: 80192 - DNA, 50 bp, homo sapien
tgagatgaagtaaattaattcctccrgcatgattcactttaggtacaagc

SEQ ID NO: 80193 - DNA, 50 bp, homo sapien
agataccagcctgggagctacataamgatgatgagaaccacgtctatctc

SEQ ID NO: 80194 - DNA, 50 bp, homo sapien
aaaaataaggaatatgatgataaackgaccaatgaagcaaaaataatcca

SEQ ID NO: 80195 - DNA, 50 bp, homo sapien
gttagctagcacattttacgctgacmaacccaatctaagatgcacacttt

SEQ ID NO: 80196 - DNA, 50 bp, homo sapien
atgtaaaacaattatgcttactatgytcatgcagctaaaagctcaacata

SEQ ID NO: 80197 - DNA, 50 bp, homo sapien
aaggcagtcacattagaaactttgakaaagacaatattttacatccttgt

SEQ ID NO: 80198 - DNA, 50 bp, homo sapien
tcatacattccttatttcactaaacrccaagcatctgctatgaggtgcta

SEQ ID NO: 80199 - DNA, 50 bp, homo sapien
agtccttacgaagtgagatggaaacmcttagagggtgtgtgcatggggag

SEQ ID NO: 80200 - DNA, 50 bp, homo sapien
atggctcttgtgacaagattataaargtcaaagatgctttatcccaatat

SEQ ID NO: 80201 - DNA, 50 bp, homo sapien
tagttccttttgtcaacgtatattaratatcaaaggagctgctgctaatt

SEQ ID NO: 80202 - DNA, 50 bp, homo sapien
aaacaaacttatccctgaactaaaamctgggcatggactcactgaccctg

SEQ ID NO: 80203 - DNA, 50 bp, homo sapien
gtttgtgttttttaaacaaaaatgaygactggtgacagaaaaattaggtt

SEQ ID NO: 80204 - DNA, 50 bp, homo sapien
tcctggtaagtgagtaagtcttacaygagctaatggttttataaatggga

SEQ ID NO: 80205 - DNA, 50 bp, homo sapien
tagacttcatatattggtgggatttwaatcaaaccagtaggaagtctatt

SEQ ID NO: 80206 - DNA, 50 bp, homo sapien
tcattgcagaaactagacaagaccartgaagatcaggaagtgcagcaacc

SEQ ID NO: 80207 - DNA, 50 bp, homo sapien
aaagctgcatttttcactctgtttayagtcattaggtcccatgaacagaa

SEQ ID NO: 80208 - DNA, 50 bp, homo sapien
ctttaaaatgcttatgttgtagcttkaaatctcttatgatgagtaattta

SEQ ID NO: 80209 - DNA, 50 bp, homo sapien
tcaatatttctgagtaattttaaatsatcaaaaacttattttagcatata

SEQ ID NO: 80210 - DNA, 50 bp, homo sapien
ttcatgctgccacaaaatgaataacsagttgccttttgattgctcatttg

SEQ ID NO: 80211 - DNA, 50 bp, homo sapien
tttttactttactatcatgtattaakatttctgccagatatagaggtatg

SEQ ID NO: 80212 - DNA, 50 bp, homo sapien
ttagctgaaaatggaacacaggtcargagttttatggtgaaaaagtgaag

SEQ ID NO: 80213 - DNA, 50 bp, homo sapien
tgttttagcttttctagtttaaaaayctgcatactgggaaaataaggaaa

SEQ ID NO: 80214 - DNA, 50 bp, homo sapien
gaaaagctaaaacatgagaattataycaaaaatcacatttggccagggaa

SEQ ID NO: 80215 - DNA, 50 bp, homo sapien
gaccgaaggcagagtggtatgggctsaaacagatctcagcagctagtcac

SEQ ID NO: 80216 - DNA, 50 bp, homo sapien
aaaaaggaaggtatttattataaacmaaaaggctagacatcctttactaa

SEQ ID NO: 80217 - DNA, 50 bp, homo sapien
tcctgaaatatacactaaaaagtaargtatcagcagactctgctactagc

SEQ ID NO: 80218 - DNA, 50 bp, homo sapien
acagcagcagacaaggtcttcttccygaaccaggtagtctcaactagggg

SEQ ID NO: 80219 - DNA, 50 bp, homo sapien
caaacaaggccatctgagaaagcaaragaggataacattttaaatcctct

SEQ ID NO: 80220 - DNA, 50 bp, homo sapien
gcaagaccaaacatcaaatttatgaygaagtgtggagagaagaattgtga

SEQ ID NO: 80221 - DNA, 50 bp, homo sapien
ctcctcccttttgcagttttgataayacagttaagcagaaaatcagtgag

SEQ ID NO: 80222 - DNA, 50 bp, homo sapien
ccatggtactaacccattctcttcartaaaagcatagtcagcctgaccta

SEQ ID NO: 80223 - DNA, 50 bp, homo sapien
gggccattacaaccataaatcctgayactactgagcaaaattcatcaaaa

SEQ ID NO: 80224 - DNA, 50 bp, homo sapien
cagtgctgaatatcctgctctgtaaygaagatggctatagagacaaatac

SEQ ID NO: 80225 - DNA, 50 bp, homo sapien
gaaagagatttcaaaagtatggaatragtcttctgcaccatgaacacttt

SEQ ID NO: 80226 - DNA, 50 bp, homo sapien
atgtccatcaacagtattagattgaytaaaagcatggtgcatccacacaa

SEQ ID NO: 80227 - DNA, 50 bp, homo sapien
acatttcttgaaacataacaccttgwcaccaggatgtggctgattgattg

SEQ ID NO: 80228 - DNA, 50 bp, homo sapien
catgttcataaacactgtataataaygtgtgacagaaaaagtccttggta

SEQ ID NO: 80229 - DNA, 50 bp, homo sapien
agctacctccctgcagtttttcttayaccatctcagtctcttcccactgg

SEQ ID NO: 80230 - DNA, 50 bp, homo sapien
tggacagatctcaacattaaaatgamggttttggaaaattgtttaaagat

SEQ ID NO: 80231 - DNA, 50 bp, homo sapien
ttagtcccaatcctctttagaggaarcttgttaatgaggctttttgtatg

SEQ ID NO: 80232 - DNA, 50 bp, homo sapien
taggtgccagatattgttctgaaaaygttattacgccatggaattctctc

SEQ ID NO: 80233 - DNA, 50 bp, homo sapien
ctaaaaagttcagttgttgtttaatkaactagtcctttctacatatatat

SEQ ID NO: 80234 - DNA, 50 bp, homo sapien
ttctgaataaaaattaaaatatatargagagtgagttacaaatggttgct

SEQ ID NO: 80235 - DNA, 50 bp, homo sapien
cagcagaaccaccttttttggataaytgatgatgcacggtaataaaatga

SEQ ID NO: 80236 - DNA, 50 bp, homo sapien
ttgaccttgagttcttctaatccaayggttcatttgtcgtatgaataagc

SEQ ID NO: 80237 - DNA, 50 bp, homo sapien
caatcctttgttactataattggtgrttcctatcatccctctttcttgaa

SEQ ID NO: 80238 - DNA, 50 bp, homo sapien
cccagaacatgagcttattagaaaaygtctgtactgaggtgtgcacccct

SEQ ID NO: 80239 - DNA, 50 bp, homo sapien
aatatatgatcaatactcttgcataraattcacctttggccaaaaagcat

SEQ ID NO: 80240 - DNA, 50 bp, homo sapien
caaaccattctatttaatgaagaaastttcaaaagcatgcagcagaaata

SEQ ID NO: 80241 - DNA, 50 bp, homo sapien
agtactccgaggcaagagggttccaygatcaaataaatttgagaaacact

SEQ ID NO: 80242 - DNA, 50 bp, homo sapien
caataatagaacaacagactacacargatgttgcttcaagggtttctcct

SEQ ID NO: 80243 - DNA, 50 bp, homo sapien
accattttcccataaagacagtcaargtaaaatacaattgagtagaacta

SEQ ID NO: 80244 - DNA, 50 bp, homo sapien
tgattttgtgtatgtgtgtttcctascttgcaaatgtaatctttggcttt

SEQ ID NO: 80245 - DNA, 50 bp, homo sapien
ttattctctccaggtccagaattcaygtttcttcaactcaagaacctgtt

SEQ ID NO: 80246 - DNA, 50 bp, homo sapien
gctaagaatctaggttaggcagcaaygggaaataagacgcctcctttgag

SEQ ID NO: 80247 - DNA, 50 bp, homo sapien
ctgagggaggagaggatgcacatgarcttgatgtaagaccttcgctggag

SEQ ID NO: 80248 - DNA, 50 bp, homo sapien
tcacagcttattacctaactcgttawtaacatggcatagtaaattaattt

SEQ ID NO: 80249 - DNA, 50 bp, homo sapien
attaccacagattaaaaaaggaacaytaacatgagtacctactgaacatg

SEQ ID NO: 80250 - DNA, 50 bp, homo sapien
aaacttgcgtggaggtcatcgaatarggtacctgaccacagcgtggtaaa

SEQ ID NO: 80251 - DNA, 50 bp, homo sapien
agagaagtttatgtggggttcgagawacaatgatgacaacagtactggaa

SEQ ID NO: 80252 - DNA, 50 bp, homo sapien
gtggcagaaggtgctcagtacatcartaataaagttaagcaccatattca

SEQ ID NO: 80253 - DNA, 50 bp, homo sapien
ctactctgaaccttgacggccaacaytagtttcaacttgggccaggtgca

SEQ ID NO: 80254 - DNA, 50 bp, homo sapien
agcccaccatatatgtggttgaaaaygtgttaataaagatggtgctacct

SEQ ID NO: 80255 - DNA, 50 bp, homo sapien
aatggagcatctgggggcataaatgracagtcgttaactggcaagctcaa

SEQ ID NO: 80256 - DNA, 50 bp, homo sapien
catgggtagtatatgatttgtatgayagaaatgtgagagaaaaggagaac

SEQ ID NO: 80257 - DNA, 50 bp, homo sapien
ttgtttctcctcttctatctcctaastattgacagagaacttgccaccag

SEQ ID NO: 80258 - DNA, 50 bp, homo sapien
tatggattgactgttctgaggttccyactaaatacatttgttgttcaaca

SEQ ID NO: 80259 - DNA, 50 bp, homo sapien
aaccttgacaatcaagtgctaattcrttataaggttattacaatttatat

SEQ ID NO: 80260 - DNA, 50 bp, homo sapien
attacaatttatattttatagcaacmataatagaatgatagctgctattt

SEQ ID NO: 80261 - DNA, 50 bp, homo sapien
gttgcaaggattcttttgatgaaaaraagagctgtccaacaagagattat

SEQ ID NO: 80262 - DNA, 50 bp, homo sapien
ttaaataattgcgtcttcgcacagcycggttgcatatcactgctttaatg

SEQ ID NO: 80263 - DNA, 50 bp, homo sapien
tttttattctattactttcagtgtakatgcaacttgtatttgttgaatac

SEQ ID NO: 80264 - DNA, 50 bp, homo sapien
aagaaaaacaggaaattaaataatayaggatcagtggaaatcagcaagaa

SEQ ID NO: 80265 - DNA, 50 bp, homo sapien
agggtatcattataaatcctctctgmagacgtgtcctactaccattttca

SEQ ID NO: 80266 - DNA, 50 bp, homo sapien
ataggaccttaccaaatacttccagrtccttatggagcaccctgggataa

SEQ ID NO: 80267 - DNA, 50 bp, homo sapien
atagggctgataagaaagtcatcctyaatgttctattgcaccatatgcat

SEQ ID NO: 80268 - DNA, 50 bp, homo sapien
tgctgaaatccctcttttgttttttyatgactgcgtactattccttgatt

SEQ ID NO: 80269 - DNA, 50 bp, homo sapien
atactcagggaaaatgatcttttacraaacatttctattaagtataagaa

SEQ ID NO: 80270 - DNA, 50 bp, homo sapien
ccgtttaacatgacaacatatcaaayacccatttaacttgacaacatggc

SEQ ID NO: 80271 - DNA, 50 bp, homo sapien
aagacacttacctagtgaaaaaaaakgtcatgactgtgtttctatagttt

SEQ ID NO: 80272 - DNA, 50 bp, homo sapien
ttaaattctcaggatcctctggaccrgaaatcattgtataatgcctaaga

SEQ ID NO: 80273 - DNA, 50 bp, homo sapien
actagttggagtaaggataatatcaraggtagaaaaaaaagataagcttt

SEQ ID NO: 80274 - DNA, 50 bp, homo sapien
gatggcaagaaaagtagaaaactgcrgagaaccttgtagctggggcagaa

SEQ ID NO: 80275 - DNA, 50 bp, homo sapien
aggagtgattatgcattggtttatgycaagtaaaaataaagaataagatg

SEQ ID NO: 80276 - DNA, 50 bp, homo sapien
tgatagtgtaagagcattaaatttgyattagtttctgttatttttcctta

SEQ ID NO: 80277 - DNA, 50 bp, homo sapien
ttcttattatgcataagataaccaastgcattttatttttcggcagattt

SEQ ID NO: 80278 - DNA, 50 bp, homo sapien
tcttatgcataataagaaaaagaaamggatgatctgccacaaactgtggg

SEQ ID NO: 80279 - DNA, 50 bp, homo sapien
catgttcattctagctcaccaagaartgcttgaaattataggtaaatata

SEQ ID NO: 80280 - DNA, 50 bp, homo sapien
caagtgagaacctcagaggcccggawaaaggccatgtttgtgagaatgct

SEQ ID NO: 80281 - DNA, 50 bp, homo sapien
actaaataatgggtataaagttgaayaagctaataacatcagagtaccca

SEQ ID NO: 80282 - DNA, 50 bp, homo sapien
atatgtatatacatactggactaaawgtaaaatatattttggaacatggg

SEQ ID NO: 80283 - DNA, 50 bp, homo sapien
tgacaacatgattagggtgtaatgakcccaaacataggttataataagtc

SEQ ID NO: 80284 - DNA, 50 bp, homo sapien
atggcacggttcctggcccatagtamgaactaaacaagtgttttagaatt

SEQ ID NO: 80285 - DNA, 50 bp, homo sapien
acaccagacatctcacagaatcaacraagaacagaaattaagatagtctt

SEQ ID NO: 80286 - DNA, 50 bp, homo sapien
ttttaccattagttagaatagaaaaygacagtcagtagagttttcttttt

SEQ ID NO: 80287 - DNA, 50 bp, homo sapien
tgcctaaaatttagatttagaaaaaygtcatgagaattttaacacttaat

SEQ ID NO: 80288 - DNA, 50 bp, homo sapien
acctattttttaatctttcagaggcrcagagtttgtttcacagttcaaac

SEQ ID NO: 80289 - DNA, 50 bp, homo sapien
aacagcagtaacaacaaagtaggcayagtccttgcattttagaaatttta

SEQ ID NO: 80290 - DNA, 50 bp, homo sapien
gtttcatatttgcattgctcatgaaygtaaacaaaatgtcgatatgtgtg

SEQ ID NO: 80291 - DNA, 50 bp, homo sapien
ctatttgtatgcatgagattatgtasagttttttttaacctagtatacta

SEQ ID NO: 80292 - DNA, 50 bp, homo sapien
tccccacttttgaaaatgttggtagwattataggaatgtctgtttgatta

SEQ ID NO: 80293 - DNA, 50 bp, homo sapien
tagagaggcaaataaaatgttacacratagctccttcacaccagtttcga

SEQ ID NO: 80294 - DNA, 32 bp, homo sapien
gcaataccatacaatcrgtagattttaaacaa

SEQ ID NO: 80295 - DNA, 50 bp, homo sapien
gagaatctgagaagcgcacctcagtrttatgtgtatgaagttgaggaagg

SEQ ID NO: 80296 - DNA, 50 bp, homo sapien
cgtttcttgccatttgagatagtccratggcatttatgatattttaaaaa

SEQ ID NO: 80297 - DNA, 50 bp, homo sapien
ataaatgaacttgtgcagaatgggasatgtgaatcactgtgtctgatcca

SEQ ID NO: 80298 - DNA, 50 bp, homo sapien
gagaggatacaactgcatgtggttgrataagcttagcaaacataatgaga

SEQ ID NO: 80299 - DNA, 50 bp, homo sapien
gcttagaaggttgaagggagatcaayatgaaatgaacagaatctattcat

SEQ ID NO: 80300 - DNA, 50 bp, homo sapien
ctgttgagggaaggtgttatttaacwaaagcatagcggctgaaattcatg

SEQ ID NO: 80301 - DNA, 50 bp, homo sapien
cagcctgagaacgcatcctgggcccracacctttacatgagctctgctcg

SEQ ID NO: 80302 - DNA, 50 bp, homo sapien
acgactgttggaatcaatcaaaacartagatgaaagtcaggtggctgtcc

SEQ ID NO: 80303 - DNA, 50 bp, homo sapien
gcgggtctggcttgctgtcccagcayacttttttttgagatggagtctcg

SEQ ID NO: 80304 - DNA, 50 bp, homo sapien
aagatatacactattaagtggacacratggaattaaaatccacattacag

SEQ ID NO: 80305 - DNA, 50 bp, homo sapien
atcccgttctagattcattttacaartaggggaccataaatacagcaact

SEQ ID NO: 80306 - DNA, 50 bp, homo sapien
accaaattcagagcacaagtggaccrgaacctggaaaaatgtccaaatgg

SEQ ID NO: 80307 - DNA, 50 bp, homo sapien
ggcctcagaagcctaagtacccaacractctcatgctatgcgggcctaca

SEQ ID NO: 80308 - DNA, 50 bp, homo sapien
tagttgtccaatcttatttttgttaygtcctggcttgaatcccacactcc

SEQ ID NO: 80309 - DNA, 50 bp, homo sapien
agttttgcattagcttttgctaaccrcacataattaaaggagttggtatt

SEQ ID NO: 80310 - DNA, 50 bp, homo sapien
tacatgtgatctaaatctgcttaaargaatacttaccaaatttcactaaa

SEQ ID NO: 80311 - DNA, 50 bp, homo sapien
acataaacacttaataaaaatgctaygatgtgggtatagacaaacgaatt

SEQ ID NO: 80312 - DNA, 50 bp, homo sapien
ttaggaaaactagttagcataatgargaataggaaaggatactggaatgc

SEQ ID NO: 80313 - DNA, 50 bp, homo sapien
gggaaaacttagagaacttaagaaayttgtccaagatatacactattaag

SEQ ID NO: 80314 - DNA, 50 bp, homo sapien
gtactgggctgccctttggtcagaaraaatgaaataaaggaagttctcca

SEQ ID NO: 80315 - DNA, 50 bp, homo sapien
cacactggcattactctgtagagccsatcaatagatattagctttaaaaa

SEQ ID NO: 80316 - DNA, 50 bp, homo sapien
ctctgctaatcctcttaaggatctaygtccaaatcttcactttctttttt

SEQ ID NO: 80317 - DNA, 50 bp, homo sapien
taatttgatgcattaaaaatgtgtcmgaatttgtgaatttgtatcaactc

SEQ ID NO: 80318 - DNA, 50 bp, homo sapien
aaagttaaaatacaaaaaggaaggaygataattacaaaccatttgtcttt

SEQ ID NO: 80319 - DNA, 50 bp, homo sapien
ttactttggcttctccagatggaagwtgttctttaagggatggcgcatct

SEQ ID NO: 80320 - DNA, 50 bp, homo sapien
cttagtaagtcagctttaaaaagtasctgccaaccagaaccttccatatt

SEQ ID NO: 80321 - DNA, 50 bp, homo sapien
attgctgactgctaatttaaaatgcmagttcttagcctcatttcgcatat

SEQ ID NO: 80322 - DNA, 50 bp, homo sapien
gccttactattttgttattaaggacsagatcgtgcgttttctatcctccc

SEQ ID NO: 80323 - DNA, 50 bp, homo sapien
atgtttaaacatttttttccttcaartgagtactttgtgttttcagttta

SEQ ID NO: 80324 - DNA, 50 bp, homo sapien
gtactcatacctttgctcgagtccayagccgagtgagaaatggccaagct

SEQ ID NO: 80325 - DNA, 50 bp, homo sapien
agttgtcatgctgtattactgcggcrcaaatagccctctttggaccctca

SEQ ID NO: 80326 - DNA, 50 bp, homo sapien
tataattgggttatagaaatatagayaaaatatgaagatctgaactttag

SEQ ID NO: 80327 - DNA, 50 bp, homo sapien
caaaaaaaaaaaaagaaaccactaarcgataaataattgaggacaaaagt

SEQ ID NO: 80328 - DNA, 50 bp, homo sapien
gtaaaagagaagtccagtttatccargtccaagaagtagtaagtcttgaa

SEQ ID NO: 80329 - DNA, 50 bp, homo sapien
aaagagaagggaacttaatcattacrgttgtggggaatgttactggggcc

SEQ ID NO: 80330 - DNA, 50 bp, homo sapien
aatagttattcccaaattttgttgcrcgttagaatccagacccttaggat

SEQ ID NO: 80331 - DNA, 50 bp, homo sapien
ggagggagaacacctgccttgaaagyctaagaaaaaggagacagatccaa

SEQ ID NO: 80332 - DNA, 50 bp, homo sapien
agccagcgctaggatgagactctccrcaggaaacaccctcacagacatac

SEQ ID NO: 80333 - DNA, 50 bp, homo sapien
gtgctcaatcattgaccaaaaggackctcctatctcttttctctggaata

SEQ ID NO: 80334 - DNA, 50 bp, homo sapien
gtgcaattctgacttatatagaaaaytagacacaattctggagtagttta

SEQ ID NO: 80335 - DNA, 50 bp, homo sapien
ataatacattccttccattagatgaygtgtgatcagagagtgcattctag

SEQ ID NO: 80336 - DNA, 50 bp, homo sapien
tccagggaattcagaggcagagccaygcttgggaactcctggtgtaactt

SEQ ID NO: 80337 - DNA, 50 bp, homo sapien
gaagttaatcaatgatttgaccagarcccttgctagaaatatgcttttat

SEQ ID NO: 80338 - DNA, 50 bp, homo sapien
catgtcctcgcctgtgaaatgaaaasttacaccaggagttcccaagcatg

SEQ ID NO: 80339 - DNA, 50 bp, homo sapien
ataaatctttctttgactggaaaagragtatatttgttctcatattccca

SEQ ID NO: 80340 - DNA, 50 bp, homo sapien
catggagaaaataattttgtaagtargacatggtaatagttaagcagctt

SEQ ID NO: 80341 - DNA, 50 bp, homo sapien
aaaatttacaaaactattaaacctayagagaagttgtgtccattccaagc

SEQ ID NO: 80342 - DNA, 50 bp, homo sapien
gaacactttgtaacctaagagatgcyggatgttcctatcaaacatcagta

SEQ ID NO: 80343 - DNA, 50 bp, homo sapien
ttcttaacaaccaccgtatgtccaayagattaactgacttttaaaatcag

SEQ ID NO: 80344 - DNA, 50 bp, homo sapien
ctagtgacagacagagaccagacgayaggtaaatgaagacagggtaaaag

SEQ ID NO: 80345 - DNA, 50 bp, homo sapien
ctgctatgcctgtggaaattgtgacmactccttctagcctaagactaaga

SEQ ID NO: 80346 - DNA, 50 bp, homo sapien
tttcttactaatgacagcaatcaccrcctaatggttctctctagatgcaa

SEQ ID NO: 80347 - DNA, 50 bp, homo sapien
gccattagaagcagcagcactcactrtaatttctgatattgcttttctgt

SEQ ID NO: 80348 - DNA, 50 bp, homo sapien
gagtagaggcaaacataaaggtagarcatgatataatgattctttttttt

SEQ ID NO: 80349 - DNA, 50 bp, homo sapien
gtaaatccaaatgtgaattagacaarccattaataccggtatattatatg

SEQ ID NO: 80350 - DNA, 50 bp, homo sapien
cagcatcccagagggaggatgtcctsaaagttccagtagcacagcatctt

SEQ ID NO: 80351 - DNA, 50 bp, homo sapien
aaaagttgttaatttctgatatcaartgcaatgaactagatccagatttt

SEQ ID NO: 80352 - DNA, 50 bp, homo sapien
gcccagcaaataaaaagcgataaagycctttcactgaaattattcatgtg

SEQ ID NO: 80353 - DNA, 50 bp, homo sapien
ctttcaaaagcatcatggaattaggraatactaaactggaaagggttgtt

SEQ ID NO: 80354 - DNA, 50 bp, homo sapien
taatacatttgtgctttaaaatgaaygtgagagctatagttacatatgct

SEQ ID NO: 80355 - DNA, 50 bp, homo sapien
cagttacaacttggtacaacaaggayacgtgctgtaaggcccagaagtga

SEQ ID NO: 80356 - DNA, 50 bp, homo sapien
tattcacttttaaggaatagtaaacraggaagagagagagtttgttgctc

SEQ ID NO: 80357 - DNA, 50 bp, homo sapien
agaaaaggcctgggcagtgcttggasataaaagacctgaacgatcagacc

SEQ ID NO: 80358 - DNA, 50 bp, homo sapien
tttctgtgtgtggtaatgcccattcytggttcatgagagtcagaatgata

SEQ ID NO: 80359 - DNA, 50 bp, homo sapien
ggaggaaagtacacctgatccaacaygaatttttttcagctgctttctag

SEQ ID NO: 80360 - DNA, 50 bp, homo sapien
gcagttctgaaaaaaactgagaaatyacagtgaggagtttgggaatgaaa

SEQ ID NO: 80361 - DNA, 50 bp, homo sapien
gtgataaataaaaatctggcttaaaytgattgaatcatgtaattttcaaa

SEQ ID NO: 80362 - DNA, 50 bp, homo sapien
ctcaaactcctgacctcaagtgatgyaccggtctcggcctcccaaagtgc

SEQ ID NO: 80363 - DNA, 50 bp, homo sapien
aagcctatttcagacgaattataaarctgtaagattaacgaaaaagcttg

SEQ ID NO: 80364 - DNA, 50 bp, homo sapien
aagaattcattccgagtttggtgtckaattctctcaaatcaaccagccag

SEQ ID NO: 80365 - DNA, 50 bp, homo sapien
aagggctgaggtatttgattaaatgrccacatgaaaaatggagatgtaga

SEQ ID NO: 80366 - DNA, 50 bp, homo sapien
caatattttcaaagaatttatagtayggttagttgcccaaaaagtgtctt

SEQ ID NO: 80367 - DNA, 50 bp, homo sapien
ataaatatatgctcataacttctacracataatacttatcatattgcttc

SEQ ID NO: 80368 - DNA, 50 bp, homo sapien
cctaaagttacgtgtccacaaaatawgtagctcatgaactggggctccac

SEQ ID NO: 80369 - DNA, 50 bp, homo sapien
ataaacttacacatggtttcactgaygtttcagaaattctagaatatgtt

SEQ ID NO: 80370 - DNA, 50 bp, homo sapien
tatagacttaaaatgaatagttaggraagtgttagacgcagaaggctaag

SEQ ID NO: 80371 - DNA, 50 bp, homo sapien
ggaagggaatacgtaatgcctaaaayacgtgctgtaaaaatggaactcga

SEQ ID NO: 80372 - DNA, 50 bp, homo sapien
aaatcagtcacttaggggaagataaygaatccacaaagtgaaaaagggaa

SEQ ID NO: 80373 - DNA, 50 bp, homo sapien
ctcctctagaaatgccattctgcaaygagctgaccagaggaatgtccctt

SEQ ID NO: 80374 - DNA, 50 bp, homo sapien
acgggctatggagagcctgttgataycatcatttggtaggcagatatcca

SEQ ID NO: 80375 - DNA, 50 bp, homo sapien
cctagattccaaggaataaaaataaratgtagttattcatagttttacca

SEQ ID NO: 80376 - DNA, 50 bp, homo sapien
attggataatcggctgactgacaggratgtggacttagaaccttcccagc

SEQ ID NO: 80377 - DNA, 50 bp, homo sapien
gaggataccataaaacatggtgcacragtgtaatttaatataggggagaa

SEQ ID NO: 80378 - DNA, 50 bp, homo sapien
agagtgattttgaaccatcttttggsaaaaggatcagagatagttcaaaa

SEQ ID NO: 80379 - DNA, 50 bp, homo sapien
gtttttaaaagaggaaagtaaggtcmacctcatatccagaggaaaaaaaa

SEQ ID NO: 80380 - DNA, 50 bp, homo sapien
caagctccttgctgttattacgcaaygtgttatttcaggacaaatttatg

SEQ ID NO: 80381 - DNA, 50 bp, homo sapien
ctatgttcctggagtaaatggtagayggcatatactctttgtgtgtctgc

SEQ ID NO: 80382 - DNA, 50 bp, homo sapien
ttctctaagcagacctgcctatataygtcaatcaaaactgaaactgaagg

SEQ ID NO: 80383 - DNA, 50 bp, homo sapien
cttctagttgatgctcatagtttaaycatctgtgtgactctaacttagcc

SEQ ID NO: 80384 - DNA, 50 bp, homo sapien
ttcaaagtcagcatccttggtaaaayatagcatctcctacttttttagct

SEQ ID NO: 80385 - DNA, 50 bp, homo sapien
tcactaagcctttgctaaacagtcayatgagtgaagaattcactccttca

SEQ ID NO: 80386 - DNA, 50 bp, homo sapien
gacagagtataagacttcagtgaaayctttagcctgctttagggaataga

SEQ ID NO: 80387 - DNA, 50 bp, homo sapien
gtttttgagcagaggagtacctaacyaactgatatttaaaaaatactagt

SEQ ID NO: 80388 - DNA, 50 bp, homo sapien
aaagcaattagcttaccatacttctyagaaaaagggctgagccagctacc

SEQ ID NO: 80389 - DNA, 50 bp, homo sapien
ataaagctgatgttatgttaattggmagggctgtataagcagaaagtcct

SEQ ID NO: 80390 - DNA, 50 bp, homo sapien
agccagacacaaaaggctacatatcrtctaattctgtttgtgtgacattt

SEQ ID NO: 80391 - DNA, 50 bp, homo sapien
attataatcggggttttctattaaartctccactaattgcatgattctca

SEQ ID NO: 80392 - DNA, 50 bp, homo sapien
cccttccctgtatagtacattacacyaaggtctttgttttgtttttatgt

SEQ ID NO: 80393 - DNA, 50 bp, homo sapien
tggagttgggtcttcatgtcacctaktcagaagttcatatcatctttctg

SEQ ID NO: 80394 - DNA, 50 bp, homo sapien
cactcataagcactgtaatcacatakgcaatcagaacagctcattccact

SEQ ID NO: 80395 - DNA, 50 bp, homo sapien
tcgataacacaccattgagtgaattsattacccaatcctggatctgccct

SEQ ID NO: 80396 - DNA, 50 bp, homo sapien
acccttgttcactagggccagttagyccacttactccacattcacctttc

SEQ ID NO: 80397 - DNA, 50 bp, homo sapien
tgctaattctgcctcttggtcctgasgttgttgcaccctgccctacctat

SEQ ID NO: 80398 - DNA, 50 bp, homo sapien
ttttaattactttgtcacttaaaaawttctccttatgatccactatgtga

SEQ ID NO: 80399 - DNA, 50 bp, homo sapien
tagtaaatccagcaaaaatatccctsaagcctgaaagagaaataaagact

SEQ ID NO: 80400 - DNA, 50 bp, homo sapien
tagacaggcagagcttctgaatttayatctcaacctgaatttacaacagc

SEQ ID NO: 80401 - DNA, 50 bp, homo sapien
ggttaatggtggagcatggagaaaawagtatggctgaagatcaggcaaag

SEQ ID NO: 80402 - DNA, 50 bp, homo sapien
atatggcataaaccaggcacaataaragaaggttaatggtggagcatgga

SEQ ID NO: 80403 - DNA, 50 bp, homo sapien
cctttagctggtatgatcaacgatayggcagaagtatgcacaggtcatag

SEQ ID NO: 80404 - DNA, 50 bp, homo sapien
tttggtagacacttctatgcaaacarctctaagatgtgtttttccaaact

SEQ ID NO: 80405 - DNA, 50 bp, homo sapien
ttcccacagatatcggataatttaaraatggtcgttgagcctggatttag

SEQ ID NO: 80406 - DNA, 50 bp, homo sapien
ataatatctggcacataggtacatamaaattgttagcattaaggattact

SEQ ID NO: 80407 - DNA, 50 bp, homo sapien
cagccttgggagttaggaccgagaayatggctgacggttccccagcacac

SEQ ID NO: 80408 - DNA, 50 bp, homo sapien
agagactcaggggtccagagatactrtgtgcaaaatatcagctactacct

SEQ ID NO: 80409 - DNA, 50 bp, homo sapien
gttctttgcacatactggatacctaygttgcaagtaacttctactatttt

SEQ ID NO: 80410 - DNA, 50 bp, homo sapien
ctattcttccatcttgtattgaaccrgaataacatatttcaacgttcaag

SEQ ID NO: 80411 - DNA, 50 bp, homo sapien
aatacttctagaaaggactaccagcraattggcaaccacataaacctagt

SEQ ID NO: 80412 - DNA, 50 bp, homo sapien
tgttttgcagccatgaaaaatgacayctctgaaagatatttaacaacatg

SEQ ID NO: 80413 - DNA, 50 bp, homo sapien
aggcttggaaagggagtgatagaaaygtaaatctaaagctgcctctagat

SEQ ID NO: 80414 - DNA, 50 bp, homo sapien
agtgttctgtttgaaaactttttaayatctgaagctgaatataaacagtt

SEQ ID NO: 80415 - DNA, 50 bp, homo sapien
tacaatgagttcaagcaacacgataraggcatttgagggagttaacacag

SEQ ID NO: 80416 - DNA, 50 bp, homo sapien
tagttgatgaaactcttaagtaaaartgaaactgaagactatgtgtaata

SEQ ID NO: 80417 - DNA, 50 bp, homo sapien
aatactactctcctatgtgatgaaasaatccgagagttggaacaggactg

SEQ ID NO: 80418 - DNA, 50 bp, homo sapien
aatggacaacacattacagatttatyaactgcatgaccgtgaaaatatct

SEQ ID NO: 80419 - DNA, 50 bp, homo sapien
agactagcactatctagggatgaagkacttattaatagaagagagagaga

SEQ ID NO: 80420 - DNA, 50 bp, homo sapien
caataccaggaaactgacgttagtawtaggccttaaacagatttcaccat

SEQ ID NO: 80421 - DNA, 50 bp, homo sapien
ggtcatcttcgagaaatgtgccaaaygctccatatatatattattaatcc

SEQ ID NO: 80422 - DNA, 50 bp, homo sapien
attgtctggctttagtagatgctcasctcttgatgatcacacaatagaga

SEQ ID NO: 80423 - DNA, 50 bp, homo sapien
atcatagtgttaacatattcatcgcycagacaaaaacctcttttggtcat

SEQ ID NO: 80424 - DNA, 50 bp, homo sapien
cggccacaagtagacaactgaaagaygacattgggactgcatcagacttc

SEQ ID NO: 80425 - DNA, 50 bp, homo sapien
cagcctgctgcaaacaaaaatatgaygaaaagaggcattaaaacacattt

SEQ ID NO: 80426 - DNA, 50 bp, homo sapien
cttttcttcctgaacgttccgcaaakaattgttgtggggcctgataagac

SEQ ID NO: 80427 - DNA, 50 bp, homo sapien
tgtgctctataatagatattgcatamattaaaaatgatttcctgtgaatt

SEQ ID NO: 80428 - DNA, 50 bp, homo sapien
ccagtcacaagatggtcactgttacrggttgaatatgttgaagtcccgac

SEQ ID NO: 80429 - DNA, 50 bp, homo sapien
ccttggggaattggcagaaccttgamatagctcgctggccaaaagcgccc

SEQ ID NO: 80430 - DNA, 50 bp, homo sapien
aacagagttctctctggttccaaaayttatgaccctcagaaatgtagagt

SEQ ID NO: 80431 - DNA, 50 bp, homo sapien
agtgtaaggaagaattgcttatgctygaattgatttgttctgtatcccaa

SEQ ID NO: 80432 - DNA, 50 bp, homo sapien
aatatttatatgcaagactcatgcamgttctataggtttcatcattagtc

SEQ ID NO: 80433 - DNA, 50 bp, homo sapien
tatcaagcaagtcatattagtgatgrttcaatgcattttttcattatata

SEQ ID NO: 80434 - DNA, 50 bp, homo sapien
ggaagttaaagttccaagaattaaaygtctggcatcagaacagtcagcta

SEQ ID NO: 80435 - DNA, 50 bp, homo sapien
ctgtctttatttgactatcttgctayaacccatccttctttgtggctgct

SEQ ID NO: 80436 - DNA, 50 bp, homo sapien
ctgttctgagcactgcatattgtacygaaaaacgtcatggcctttgatgt

SEQ ID NO: 80437 - DNA, 50 bp, homo sapien
cagcctttcagtggtgcctgcttacygaatctgagaaggttaaggaaccc

SEQ ID NO: 80438 - DNA, 50 bp, homo sapien
cttcaattactgcaataaaatattasacgctcttaattcggttggcgttg

SEQ ID NO: 80439 - DNA, 50 bp, homo sapien
agtaaaagcctgcagtatgaaattaygtaatagctcatctttgcaaatgc

SEQ ID NO: 80440 - DNA, 50 bp, homo sapien
gaaaaggataacagaagggcaaagcratgaaaagtaaatataaatggaaa

SEQ ID NO: 80441 - DNA, 50 bp, homo sapien
atatatttcatttggctcttctatamaaactaaatctgacctaaaccata

SEQ ID NO: 80442 - DNA, 50 bp, homo sapien
attttataggggtagaacctgacaamaggagagtccatggatctttagga

SEQ ID NO: 80443 - DNA, 50 bp, homo sapien
gcaaacaaggctcagtaaaagattcraactgtgtccaccatgagcttatt

SEQ ID NO: 80444 - DNA, 50 bp, homo sapien
cactttgctggctttgtaatggaaartagatggtttttgttgtttgtttt

SEQ ID NO: 80445 - DNA, 50 bp, homo sapien
catgctggtcacaatcacaattgtcycaggttagaatttctttcagaagt

SEQ ID NO: 80446 - DNA, 50 bp, homo sapien
ttctgctccactatcctataattccragatgtcattgtatctatttttct

SEQ ID NO: 80447 - DNA, 50 bp, homo sapien
tttatttattcaacacaaatttatcraacactcaccatgtgaattgctta

SEQ ID NO: 80448 - DNA, 50 bp, homo sapien
tgctggatgaatatcaagtatgatgmatgttatggtacagctgtgtccct

SEQ ID NO: 80449 - DNA, 50 bp, homo sapien
gtcacatgagaaaataacacctcctytttgtaatgctttcacattgcaat

SEQ ID NO: 80450 - DNA, 50 bp, homo sapien
cttgagaattcagacatgtggatgargtgttatagatggaaagccccaat

SEQ ID NO: 80451 - DNA, 50 bp, homo sapien
atcatggaataaacatgctggagctyacaattatttgatcaatgaggata

SEQ ID NO: 80452 - DNA, 50 bp, homo sapien
gctttgttcccatcagcaaaaataartcaactgagtatctctatgcaggc

SEQ ID NO: 80453 - DNA, 50 bp, homo sapien
tgttattcttataaagcattttgatyaactggtttctatgtaatacgtat

SEQ ID NO: 80454 - DNA, 50 bp, homo sapien
tattggcaaactcctagtattatacrgagaaagtcaggagaagatactga

SEQ ID NO: 80455 - DNA, 50 bp, homo sapien
aagttgagggatcctgctcttagtgratatcattgtgaccctaatatata

SEQ ID NO: 80456 - DNA, 50 bp, homo sapien
aaaaattatattaatcactaaaggaragcaattaacagcggagatgccac

SEQ ID NO: 80457 - DNA, 50 bp, homo sapien
aatatatgtatcaaattttgtgtcaygtaaagtgctattaatgaaataga

SEQ ID NO: 80458 - DNA, 50 bp, homo sapien
ttttcttaaatgttctgtttaatgakagtgatgcagtagggtgagttgct

SEQ ID NO: 80459 - DNA, 50 bp, homo sapien
gataaaaagataaaattgaatcctaygaaattacagtagatcacacctct

SEQ ID NO: 80460 - DNA, 50 bp, homo sapien
aaaaggagagcatattcaatagttcratgcattaatataactttaattat

SEQ ID NO: 80461 - DNA, 50 bp, homo sapien
ttttttcttatctggacactcaaackctgctagtcgcatgacacctgata

SEQ ID NO: 80462 - DNA, 50 bp, homo sapien
ctgaagaacatagaaaataagcataygttagatttactataaatgagcgt

SEQ ID NO: 80463 - DNA, 50 bp, homo sapien
aaaataaagtgtctttctgagcaaarctatatgttatatttgactacccc

SEQ ID NO: 80464 - DNA, 50 bp, homo sapien
cctcaagtctttcatctggtaattcratccagtatcttttatataggata

SEQ ID NO: 80465 - DNA, 50 bp, homo sapien
caaaggcgacatatttcaattgtaawgtttcagaaataaatgattaacaa

SEQ ID NO: 80466 - DNA, 50 bp, homo sapien
accttcataggtacctttggatgtaygtaagagtgagcatttttgtgttt

SEQ ID NO: 80467 - DNA, 50 bp, homo sapien
gataaccttaacattgattctgaaargtaagcctgctccctttgtgggta

SEQ ID NO: 80468 - DNA, 50 bp, homo sapien
tccccactgtggtgtcagaagaggcyacatcaggaggagtaggtagacat

SEQ ID NO: 80469 - DNA, 50 bp, homo sapien
tgccttatttaataatgttgtaaacyaaagaggaggataagattaagaaa

SEQ ID NO: 80470 - DNA, 50 bp, homo sapien
ataatgtctagatgcaatgtgtgtaygttattgaattgtcaaagtgttag

SEQ ID NO: 80471 - DNA, 50 bp, homo sapien
ctcacagcagttattggccaaggacktcgtagttggaggagtgggaatgg

SEQ ID NO: 80472 - DNA, 50 bp, homo sapien
cttactccatactgttaccttcttcwtctatgcacactcctaacaaaatc

SEQ ID NO: 80473 - DNA, 50 bp, homo sapien
gagaggagctcaatatcccagaaggwactagctaattttgactggtttta

SEQ ID NO: 80474 - DNA, 50 bp, homo sapien
aaactatgactccaataggatttacrtctacatatgcagaagaggtgttt

SEQ ID NO: 80475 - DNA, 50 bp, homo sapien
actcctgggagtcctgataccaagarccgcttataagagaagcagcttat

SEQ ID NO: 80476 - DNA, 50 bp, homo sapien
aagctcctgccacttgttaccaaaaygtgttgtaataataatgtggcatt

SEQ ID NO: 80477 - DNA, 50 bp, homo sapien
agtagtggaacattccagaagaatcracaaaagaattattaagggtcttt

SEQ ID NO: 80478 - DNA, 50 bp, homo sapien
ctatgaacaaggagctgttcactgasatataggattgctcagagctgccc

SEQ ID NO: 80479 - DNA, 50 bp, homo sapien
agttcaacagtgtggcttaggttctrgtggtacatggaagcagctccagc

SEQ ID NO: 80480 - DNA, 50 bp, homo sapien
aaagtaaggctgttcataacctccayacaagctgtgctaaatctactccc

SEQ ID NO: 80481 - DNA, 50 bp, homo sapien
ctacattttacaatatatgatataaytactgctgattaacctggaaaatg

SEQ ID NO: 80482 - DNA, 50 bp, homo sapien
catggagggaaaagctgaaaaggaaytgtattatgaaactacgtttcata

SEQ ID NO: 80483 - DNA, 50 bp, homo sapien
gactataaaaacaacatacagacatrgaagaaacaccctattgcatagag

SEQ ID NO: 80484 - DNA, 50 bp, homo sapien
gcttaaacatcctgtgtgtcatccartcataacaggactttccagtttaa

SEQ ID NO: 80485 - DNA, 50 bp, homo sapien
atggcacatggtcaagactatgtgaygatgaaactacaatgaggcaaaga

SEQ ID NO: 80486 - DNA, 50 bp, homo sapien
gaaatctgaataatgtagtctagctsaaggagaaagcattcaagaagaaa

SEQ ID NO: 80487 - DNA, 50 bp, homo sapien
tccatttgagtggataaatttgcttygcgtttggagagttttacttttca

SEQ ID NO: 80488 - DNA, 50 bp, homo sapien
taacaaacagctcaaaaaagcacagmtagtcctctgaattgtaggtcacc

SEQ ID NO: 80489 - DNA, 50 bp, homo sapien
tgctctagagattacattgtgccttktcaacatattagtctgcttaaagt

SEQ ID NO: 80490 - DNA, 50 bp, homo sapien
cctgcttaatctggaagctaattgamagctagaaatttggaaagacatag

SEQ ID NO: 80491 - DNA, 50 bp, homo sapien
tataaagcagactaaagtgctcatcraagtaaattgaaaataatgataaa

SEQ ID NO: 80492 - DNA, 50 bp, homo sapien
aaaattgatcaagatcccattgaaayagattatgctgtaattatagaggg

SEQ ID NO: 80493 - DNA, 50 bp, homo sapien
catattaaattctataattccttcaraccagagtcaacctaataaaaatt

SEQ ID NO: 80494 - DNA, 50 bp, homo sapien
atgcattagccacactcatcctaaaygaaatcagttcaccgtgcttatga

SEQ ID NO: 80495 - DNA, 50 bp, homo sapien
tgttggggtgagtggtagcaataaaygttgagatgcttgtttccatctga

SEQ ID NO: 80496 - DNA, 50 bp, homo sapien
tcttagatattcattagtcataaaayttaccccagaactttgctgctttt

SEQ ID NO: 80497 - DNA, 50 bp, homo sapien
aggctggggcactaggaaataaccaytgggtctctgagttcctctcaaag

SEQ ID NO: 80498 - DNA, 50 bp, homo sapien
tgtttaatatttcattttgagcccawgtctttacctgtcaaatggtaaca

SEQ ID NO: 80499 - DNA, 50 bp, homo sapien
tgtatgtaatgcataattactaaacrcttgcatatttgaaaatacatttg

SEQ ID NO: 80500 - DNA, 50 bp, homo sapien
aagaaggagcagcagacatgccaaayatgtaggcaaatatttttaaatat

SEQ ID NO: 80501 - DNA, 50 bp, homo sapien
aaattactcttccgcatttatcttamaaaagacaaagattctagcctaac

SEQ ID NO: 80502 - DNA, 50 bp, homo sapien
gctgtgtcccctccctgggaatctgmagcgacatttgggaagagaaaatg

SEQ ID NO: 80503 - DNA, 50 bp, homo sapien
ttggagttaaaaggcttaacttagartagcattagtctttattctttgtc

SEQ ID NO: 80504 - DNA, 50 bp, homo sapien
ccaaagttcagattctctcgcagtaygcaaaatcaaagaatgaaacagca

SEQ ID NO: 80505 - DNA, 50 bp, homo sapien
cactccagttagaatagcgatctcaraaagttaaaagataacaagtgttg

SEQ ID NO: 80506 - DNA, 50 bp, homo sapien
tggctataatcaggcatataactgaragtcttccactctgtccaactttt

SEQ ID NO: 80507 - DNA, 50 bp, homo sapien
aagggtggggtccagagaagtaagtsaatgttctgaagacatagatgcta

SEQ ID NO: 80508 - DNA, 50 bp, homo sapien
gagaaaacagtgtaaaattgtagaarataagcaaatgatttcatattgga

SEQ ID NO: 80509 - DNA, 50 bp, homo sapien
taaatccagaaagatgagataaaacsaactcaaaaaggccgaaaattcca

SEQ ID NO: 80510 - DNA, 50 bp, homo sapien
acatcaaataacttcaatattctagsctactcaagaaacaagcatatgag

SEQ ID NO: 80511 - DNA, 50 bp, homo sapien
cattggtggtctgtagcttaattacrgatatacagaggcaaagctggcct

SEQ ID NO: 80512 - DNA, 50 bp, homo sapien
ggctctcattgtgtacacgagcaggraactgacattggaaccatttgtgg

SEQ ID NO: 80513 - DNA, 50 bp, homo sapien
cagatgccagatataatttcacatcygaggtttaaaaatttaagaggtca

SEQ ID NO: 80514 - DNA, 50 bp, homo sapien
atatgagtatttttcagatggaggaracagaaaagcaaaagcatgtggtc

SEQ ID NO: 80515 - DNA, 50 bp, homo sapien
cttttaatggatttcctccattatcraaccatgccattacaattctgcag

SEQ ID NO: 80516 - DNA, 50 bp, homo sapien
ctgaaaaatactcatataaatgaaasgtgcatgtggttttatggtgctat

SEQ ID NO: 80517 - DNA, 50 bp, homo sapien
  misc_feature (6)..(6): n is a, c, g, or t
  misc_feature (8)..(8): n is a, c, g, or t
tagaangntattgtgctaaagttaargcaatatgcaatctggaattctaa

SEQ ID NO: 80518 - DNA, 50 bp, homo sapien
acacttcttaattcacgacttgtcarcttgatggtcactttctctaaaaa

SEQ ID NO: 80519 - DNA, 50 bp, homo sapien
ttttaaaataatgataaaaatccccrgaattacagtgtcaaagcaagtag

SEQ ID NO: 80520 - DNA, 50 bp, homo sapien
agttactaaacttcatgaaatatagrctacattccaaatatattttgcaa

SEQ ID NO: 80521 - DNA, 50 bp, homo sapien
ttgagatctaaacaatactttcaaaratgtcaaattattacttttatatg

SEQ ID NO: 80522 - DNA, 50 bp, homo sapien
aagaaatgatgatagacagacatgasaaaagatagacagatagattaaaa

SEQ ID NO: 80523 - DNA, 50 bp, homo sapien
aactacactgtcttccgtggagtgcygaatttttgacaggtctctgtcct

SEQ ID NO: 80524 - DNA, 50 bp, homo sapien
atacaataaatcaagtaatttatccrgccatatataatgaataaagccta

SEQ ID NO: 80525 - DNA, 50 bp, homo sapien
cctatgtatatcattgtcactaatayggaagttgatatgagaatatattt

SEQ ID NO: 80526 - DNA, 50 bp, homo sapien
taatcagattaaagagagggaagaamgcatattaaaaaagaacagtgtgt

SEQ ID NO: 80527 - DNA, 50 bp, homo sapien
ggaaattaatttgtgcatcaaaaaaytaaaattgagtgacatgggaaatg

SEQ ID NO: 80528 - DNA, 50 bp, homo sapien
taaaataaaagtgtatgctgtttgaraggcataaattgagaattaatctg

SEQ ID NO: 80529 - DNA, 50 bp, homo sapien
aacaaattccatcttactcaaattckacattttacaccatattaaggagg

SEQ ID NO: 80530 - DNA, 50 bp, homo sapien
gttttgttagatttccttttacaaayttacagaaactgaataagtattta

SEQ ID NO: 80531 - DNA, 50 bp, homo sapien
aaaacaaatttccaggtctcaaggtyaacttactaaattagatttctaaa

SEQ ID NO: 80532 - DNA, 50 bp, homo sapien
tcatcatttcctttgcgaagttagayaagcagtgtccgcctcagatacat

SEQ ID NO: 80533 - DNA, 50 bp, homo sapien
ttataagatacattcttgacttacaygttacctcttaaataacataattt

SEQ ID NO: 80534 - DNA, 50 bp, homo sapien
ccatagagaaatagtgttagactcawgcattacatattttaactatgtta

SEQ ID NO: 80535 - DNA, 50 bp, homo sapien
ggacagctggtgtgccagagaattaygcaagaattatcaatccagaaaag

SEQ ID NO: 80536 - DNA, 50 bp, homo sapien
ctgtgactgtgtggcaccccgagtcytgccattactactcattgaatgtc

SEQ ID NO: 80537 - DNA, 50 bp, homo sapien
catggaaaaacaattagtgcttacamgtgctaattttcatgctacagaga

SEQ ID NO: 80538 - DNA, 50 bp, homo sapien
tgtctaatagttacctcctcaatgtrggacttcatatttcagagcgctaa

SEQ ID NO: 80539 - DNA, 50 bp, homo sapien
ctctgctttgcagttttcacttcctrttggagtcttttggtgaacagaag

SEQ ID NO: 80540 - DNA, 50 bp, homo sapien
ttcactgttttaagcaatttcattawaacggatactgatctgtgggttta

SEQ ID NO: 80541 - DNA, 50 bp, homo sapien
tttgaagaggatcaaaacaagacacsaattgtccccaaatgacaaaatgt

SEQ ID NO: 80542 - DNA, 50 bp, homo sapien
acctctattttgcttttgtcactcaytcttcctgaaaactgtcaaatgac

SEQ ID NO: 80543 - DNA, 50 bp, homo sapien
aagagtgagtgacaaaagcaaaataraggtgtgatagtagctctatgctt

SEQ ID NO: 80544 - DNA, 50 bp, homo sapien
acatgttgcctgagtatactactaaycataggcaggaaactgaatttctc

SEQ ID NO: 80545 - DNA, 50 bp, homo sapien
ttgccaacaaattttggaaacctcayggctgaatttttctcgtctcttta

SEQ ID NO: 80546 - DNA, 50 bp, homo sapien
agtgtccatacagtcttgattagtayggcattagaaacaacagagggctg

SEQ ID NO: 80547 - DNA, 50 bp, homo sapien
aacctggcttgcaaatagaatctccygaagttcaagaaaaatgatagcct

SEQ ID NO: 80548 - DNA, 50 bp, homo sapien
gtccaggaggaggttatacatggaaragtggatctcagagtggtccgtga

SEQ ID NO: 80549 - DNA, 50 bp, homo sapien
tgtggcttttgattgcttttctctaygacattgagttccatatgtttgga

SEQ ID NO: 80550 - DNA, 50 bp, homo sapien
acaattaccattgaggttatggcttyccttacataagaaaaaaatacaat

SEQ ID NO: 80551 - DNA, 50 bp, homo sapien
attgttctaatttaggggaataaaamtcctctgtcaatatattcttacct

SEQ ID NO: 80552 - DNA, 50 bp, homo sapien
gtgtgtctgctttgcgttttacaagractagaagtcaaggagaagaaagg

SEQ ID NO: 80553 - DNA, 50 bp, homo sapien
caacagagctgccactattcatgtckattaaggagtatacatatttttga

SEQ ID NO: 80554 - DNA, 50 bp, homo sapien
gaaatcacattcaaaaatacacatascttaatgaaattcagtcatttcaa

SEQ ID NO: 80555 - DNA, 50 bp, homo sapien
tttatttcattatattcctacacaayaaggacaaagaggtgtataggttg

SEQ ID NO: 80556 - DNA, 50 bp, homo sapien
gatctcttctaccctatactgtacgyccatacatttctaaaatagttcaa

SEQ ID NO: 80557 - DNA, 50 bp, homo sapien
ctataaacattattaaccatctttcyaagaaaattcaatgatgataatgt

SEQ ID NO: 80558 - DNA, 50 bp, homo sapien
atataaacttccaaatgtgatgaaartattagatgcttctaagatggagt

SEQ ID NO: 80559 - DNA, 50 bp, homo sapien
ttctctagaggcttcctaattaacasagcttgtagatctttgtcttctga

SEQ ID NO: 80560 - DNA, 50 bp, homo sapien
tctatcaaagaccttaacatactgaycattttattttattcatcacttat

SEQ ID NO: 80561 - DNA, 50 bp, homo sapien
cataaagaaattatccaccagcaaakaatacactagatttttaaatttaa

SEQ ID NO: 80562 - DNA, 50 bp, homo sapien
acatagtgacattactgaagctgttyttagcctcttaattttagaaatca

SEQ ID NO: 80563 - DNA, 50 bp, homo sapien
tgttgcttactaggtaatcaagctcygaataaaagagtacagttttcaaa

SEQ ID NO: 80564 - DNA, 50 bp, homo sapien
tcccagtctgcagcttgccttttcaktttcataacagtgttttttgaaga

SEQ ID NO: 80565 - DNA, 50 bp, homo sapien
atgcaaactgtgtttcaaataaaacwagtatgagaatgtatatgttctta

SEQ ID NO: 80566 - DNA, 50 bp, homo sapien
tttctttgccttactaaacagaggamaatagatataaccatcctgtggct

SEQ ID NO: 80567 - DNA, 50 bp, homo sapien
cacaaaatccaccctatttgttaaawctacattcagtgccatttgtcagc

SEQ ID NO: 80568 - DNA, 50 bp, homo sapien
taaatgccaagtccataaaaaagaaratgaagtagatgcaacaagttctc

SEQ ID NO: 80569 - DNA, 50 bp, homo sapien
gccacagtaactttggttcttaaccrcaggaccattgtgcagattaaatg

SEQ ID NO: 80570 - DNA, 50 bp, homo sapien
taaaaccagataagcattttagctamctaaggagataatagacactacca

SEQ ID NO: 80571 - DNA, 50 bp, homo sapien
ttgaagtgtccatctcgccacagaawcattgaaaaaatcaaggaaaaaca

SEQ ID NO: 80572 - DNA, 50 bp, homo sapien
aagggataacttcagatttctaatcrctaaatcagcctgtttcatacctc

SEQ ID NO: 80573 - DNA, 50 bp, homo sapien
aataagaagcctcaaagattccatasagaaaacatagggcaacctccata

SEQ ID NO: 80574 - DNA, 50 bp, homo sapien
gtgtcagggaaaacaacctagctccragttcatgtactgcaaaaataacc

SEQ ID NO: 80575 - DNA, 50 bp, homo sapien
ttactaaacatctacttaatacctaygatttgcaatgcattctggagcca

SEQ ID NO: 80576 - DNA, 50 bp, homo sapien
taccctgggcaaaatgagattgattrtaaacctatgtattagatcttact

SEQ ID NO: 80577 - DNA, 50 bp, homo sapien
gatttatatttaaacatttctttcgsataagaggataatgatgaaaaaag

SEQ ID NO: 80578 - DNA, 50 bp, homo sapien
cacttcaggagaaagcattcatttcrcaaatgtaacattgatataaatag

SEQ ID NO: 80579 - DNA, 50 bp, homo sapien
ttttaacattaaaagtatatgatgckctacaaaatatgtacccaatatta

SEQ ID NO: 80580 - DNA, 50 bp, homo sapien
atttctcaaaatatgatatataaatsaccatcaagtatatgaagggatgc

SEQ ID NO: 80581 - DNA, 50 bp, homo sapien
aaactatgaaataattacttacaackggctcatataccttatttttcaaa

SEQ ID NO: 80582 - DNA, 50 bp, homo sapien
agaaaaaaagagagaaataaagataygtaagctgaaattctaatggtcag

SEQ ID NO: 80583 - DNA, 50 bp, homo sapien
gcaacaaagtttaattgagtacataktaattcatgactactccattgatt

SEQ ID NO: 80584 - DNA, 50 bp, homo sapien
aggaagagagtatatttctcctcacygatttgggcttgaaatggccagca

SEQ ID NO: 80585 - DNA, 50 bp, homo sapien
ggaactggtaaaatttataaacaacmacatgtcagcataaacttgataaa

SEQ ID NO: 80586 - DNA, 50 bp, homo sapien
aagaaagaggaaaagcaaatgcctgraaagttcctgccattactgttgct

SEQ ID NO: 80587 - DNA, 50 bp, homo sapien
gttaaattacctaaactttcttataycctcttcaatattttgatgtgcta

SEQ ID NO: 80588 - DNA, 50 bp, homo sapien
ccactacacccagcctggttttatawagtgataatcgattatgttattct

SEQ ID NO: 80589 - DNA, 50 bp, homo sapien
ttttcttttttttttttttttatgamgtgccacataagtaggagataaag

SEQ ID NO: 80590 - DNA, 50 bp, homo sapien
acatacacagacacgctcacacatckgtattcaaattcttataaccatga

SEQ ID NO: 80591 - DNA, 50 bp, homo sapien
gtgtgagcgtgtctgtgtatgttaaygtatatatatgcatgtgtgtgtgt

SEQ ID NO: 80592 - DNA, 50 bp, homo sapien
aaaatggctaataagcttatgaaaargagtattgtccttgctttgggagg

SEQ ID NO: 80593 - DNA, 50 bp, homo sapien
gaggacaaagagaccacagatgaaasattactgtagatgagtcttagctg

SEQ ID NO: 80594 - DNA, 50 bp, homo sapien
ttcattacgtaggtatgactgacaaycttgtagaaatgggactgggcaaa

SEQ ID NO: 80595 - DNA, 50 bp, homo sapien
aatagttttggccttttaaaatgtcygaattgaatatagactacaccctt

SEQ ID NO: 80596 - DNA, 50 bp, homo sapien
gaatatggatgtcagaaatccacaaytgtaagttccctcagagagggatc

SEQ ID NO: 80597 - DNA, 50 bp, homo sapien
aggctttcctcatgcttgcctaaacraaatttagaaacggaaagggttag

SEQ ID NO: 80598 - DNA, 50 bp, homo sapien
tgaagcccattctttgtaagtaagasagattactgggaactttgtttgga

SEQ ID NO: 80599 - DNA, 50 bp, homo sapien
cttatcagagaaatggtcttttatamccctatgagatcaaatatttacat

SEQ ID NO: 80600 - DNA, 50 bp, homo sapien
tttacttagattccacagttatttargtcatgatcaaacttatttaatct

SEQ ID NO: 80601 - DNA, 50 bp, homo sapien
aacatgatattcagagtgttcagtaygcaatcaaatgttactaatgcaca

SEQ ID NO: 80602 - DNA, 50 bp, homo sapien
ttttctccaaggtcatattctctcasctgctttgaaaggtatttactata

SEQ ID NO: 80603 - DNA, 50 bp, homo sapien
tacctgcagagccaaagagtcaaagmagtttgcaatatttatgattttta

SEQ ID NO: 80604 - DNA, 50 bp, homo sapien
attttaaaatatatataacattctcrcagacttctaacagtattattata

SEQ ID NO: 80605 - DNA, 50 bp, homo sapien
agaaacaatctaagtatagaaacacygacagaaagaatcaggaggcccag

SEQ ID NO: 80606 - DNA, 50 bp, homo sapien
aggtagctgcctattttctcgcacayatctattttccctaataaaatcca

SEQ ID NO: 80607 - DNA, 50 bp, homo sapien
ttattaagtgggagtggcttgaattrgatggtgatatctggataaagaaa

SEQ ID NO: 80608 - DNA, 50 bp, homo sapien
tgatttcaaataaaagtacagataaratcatcttttagagatatgttgtc

SEQ ID NO: 80609 - DNA, 50 bp, homo sapien
taaatatttctgaatgattacagatyaagtttattttcaaacctctgttc

SEQ ID NO: 80610 - DNA, 50 bp, homo sapien
gcaggggacagagttcagtctataasctgcaataacagttctataaagat

SEQ ID NO: 80611 - DNA, 50 bp, homo sapien
aaatcttcacctcaaacccatacaayctttgagctcaatcccattttagg

SEQ ID NO: 80612 - DNA, 50 bp, homo sapien
agaatgtaccaggaagaatgtgatayaaaaaaaaggttagttaggaaggt

SEQ ID NO: 80613 - DNA, 50 bp, homo sapien
acttcagcaaaaatgtccatggaaayaatttacaaagaattgtaaataaa

SEQ ID NO: 80614 - DNA, 50 bp, homo sapien
tatggattttaatttgttggaaaccrcagtaaagacaatctttcccacta

SEQ ID NO: 80615 - DNA, 50 bp, homo sapien
ctgattactttgctaatttatttgaygtatcctgcttcttcttcaagctc

SEQ ID NO: 80616 - DNA, 50 bp, homo sapien
ttacatcatctgaaataggcgagtcragatagaaaagattttttgataat

SEQ ID NO: 80617 - DNA, 50 bp, homo sapien
gtgatctcaactcttgttgattaaaygcctctagaaaatgagtctttatt

SEQ ID NO: 80618 - DNA, 50 bp, homo sapien
tctacaattagccttggcactgatargatatgtgtgtgtgtgtgtgtgtg

SEQ ID NO: 80619 - DNA, 50 bp, homo sapien
ttactctttgaaatgtcttgaatgartcaaatagtttatttttaagggct

SEQ ID NO: 80620 - DNA, 50 bp, homo sapien
tcagtcctatttattttatacactartaccagatagcacttcctaaaata

SEQ ID NO: 80621 - DNA, 50 bp, homo sapien
accaaaatgaaaggagacaaacttcrcaattcacgaatcatgtgctagtg

SEQ ID NO: 80622 - DNA, 50 bp, homo sapien
cgttctatttataacacttggatgawcccctctctagttttctgataatt

SEQ ID NO: 80623 - DNA, 50 bp, homo sapien
ctagactgaagggatagaaagtaaawgtgagagccagacaagaatataat

SEQ ID NO: 80624 - DNA, 50 bp, homo sapien
aaacagagagcaactgagacttagayaaaccatccaatagcctaggagga

SEQ ID NO: 80625 - DNA, 50 bp, homo sapien
ttgataagtgggcacagatgtcttamaaaatctaacaagaattgacattg

SEQ ID NO: 80626 - DNA, 50 bp, homo sapien
taatggctagtaataggctgagcaamctttcctgtggccaaagagaatgg

SEQ ID NO: 80627 - DNA, 50 bp, homo sapien
cctgctttcttttgcatcaacatagraagaccactttatattatccatac

SEQ ID NO: 80628 - DNA, 50 bp, homo sapien
cctgtattgtttgagaaactattcaycacatatgtcatttgttttgctaa

SEQ ID NO: 80629 - DNA, 50 bp, homo sapien
agggtcttatctcagactcggtttcyaatggtttcaatttaaaacataag

SEQ ID NO: 80630 - DNA, 50 bp, homo sapien
gaaacagaaaattatgaatttacacraaatctcttatattaaagacattc

SEQ ID NO: 80631 - DNA, 50 bp, homo sapien
ttttaatgtactttaaaccaccaatraatactgcaatgcttttcctaaaa

SEQ ID NO: 80632 - DNA, 50 bp, homo sapien
ttatatttgtagatttgaagatttasaaggcatgattctcttaataattt

SEQ ID NO: 80633 - DNA, 50 bp, homo sapien
gtgagatttgatggtatgagtcacawctatccctttaaaaaatttttggt

SEQ ID NO: 80634 - DNA, 50 bp, homo sapien
aattctgttgtgtctcagactgttaytaaagctgtccatcctattgtcgg

SEQ ID NO: 80635 - DNA, 50 bp, homo sapien
ttgccttgatagcatgtttaggttgygctaaaatttacattattttcttg

SEQ ID NO: 80636 - DNA, 50 bp, homo sapien
agttacctaaggaataataagtggcrgaatgttgttcgtatttacattat

SEQ ID NO: 80637 - DNA, 50 bp, homo sapien
ttatcttttgacgattatatttttayagctgaacattcgttagtggtact

SEQ ID NO: 80638 - DNA, 50 bp, homo sapien
gtaactttacaatattttttgcatgwcacaatcataaagcatcaaattga

SEQ ID NO: 80639 - DNA, 50 bp, homo sapien
aaatctaaaaaacaggaaggttcatkagtcccatgttgcaaattggaggt

SEQ ID NO: 80640 - DNA, 50 bp, homo sapien
atctgcaaaggcagatgggccagaaygaattgggcttgtgaccaggatgt

SEQ ID NO: 80641 - DNA, 50 bp, homo sapien
caagttatccagaagatctagccaakataagtggtgatgatggctacatt

SEQ ID NO: 80642 - DNA, 50 bp, homo sapien
tttacactgaaaatctcttatttaaygtagccatcatcaccacttatctt

SEQ ID NO: 80643 - DNA, 50 bp, homo sapien
tgatatgacacagacattgggattaycagtgaatttaaagtaattacaaa

SEQ ID NO: 80644 - DNA, 50 bp, homo sapien
gataaacttccactctatgaaaaacrcattaagataatcaaatagcaaga

SEQ ID NO: 80645 - DNA, 50 bp, homo sapien
ttttaactaaatatgcgtagcttaartacaaaataagtttcaaaaatgaa

SEQ ID NO: 80646 - DNA, 50 bp, homo sapien
actacttataaaacaggaggctaaaraagataaactacagcaggagatat

SEQ ID NO: 80647 - DNA, 50 bp, homo sapien
ttttatcttcttattgtattacctargcctactctccattactacatctc

SEQ ID NO: 80648 - DNA, 50 bp, homo sapien
cttttttgatccatttcttttaaaawctcattgtgatgtcagtaccattt

SEQ ID NO: 80649 - DNA, 50 bp, homo sapien
gaagtgaaagtgaatatggcgtggayactcagtctgagattttgggtgtc

SEQ ID NO: 80650 - DNA, 50 bp, homo sapien
tcattggttttgaagaagcctttggractagataagaattcagggaaagg

SEQ ID NO: 80651 - DNA, 50 bp, homo sapien
aactggaaaactgtttgcaacataaycacagctgaattcttacaaagtgt

SEQ ID NO: 80652 - DNA, 50 bp, homo sapien
ggctctggtgtggccacagctacgakatctccaaaggagaatgttcgcct

SEQ ID NO: 80653 - DNA, 50 bp, homo sapien
gtgcttgccctctcttcagaagtaaygcttagaatacactgtaaactttt

SEQ ID NO: 80654 - DNA, 50 bp, homo sapien
tgctgttattcctgctctcctaatcrtctgcccaggaatctgtgctgcat

SEQ ID NO: 80655 - DNA, 50 bp, homo sapien
ttgccctgtctaaatgtgagtaatgrcatgctgaagactggcatgaatat

SEQ ID NO: 80656 - DNA, 50 bp, homo sapien
cattgatgattaagttccttacctaygagacatattagacaagaaataaa

SEQ ID NO: 80657 - DNA, 50 bp, homo sapien
aactatgggcaaacaaatatatgagkaagttttcaactggaagtacacac

SEQ ID NO: 80658 - DNA, 50 bp, homo sapien
ctcccaggaatgttggctcttcctakaataatctatatgttcttgaggaa

SEQ ID NO: 80659 - DNA, 50 bp, homo sapien
gccactaagggcttccaggatgttaygactacaaccataggtgcagagat

SEQ ID NO: 80660 - DNA, 50 bp, homo sapien
ggtacaagaagctcaaagaactcagkcacaagaaacatgaagaaaactac

SEQ ID NO: 80661 - DNA, 50 bp, homo sapien
ggatgtttgttaacagcagtgggaaygtgttactgttagaatatcactga

SEQ ID NO: 80662 - DNA, 50 bp, homo sapien
tacttatcgcaactcagttgagagayagtatcattacagagataacctgc

SEQ ID NO: 80663 - DNA, 50 bp, homo sapien
gtatttccttctcaagtgttctcccrtagaaataaaatataaaggtatgc

SEQ ID NO: 80664 - DNA, 50 bp, homo sapien
aggcttccttatctctgcccatatcyaagtatgtttcggtcttactttct

SEQ ID NO: 80665 - DNA, 50 bp, homo sapien
gtttataacaaaattcagaaactaayagatgggtctcaaatgtgcaattc

SEQ ID NO: 80666 - DNA, 50 bp, homo sapien
ggcacttccacatgtaactggttaayagcaatatgaaacgtaaagacttg

SEQ ID NO: 80667 - DNA, 50 bp, homo sapien
cacatgtccccaggagtgaggctacygctgagtgaccagtagaaccccac

SEQ ID NO: 80668 - DNA, 50 bp, homo sapien
cattgacgcgagagcctagaatccaytgagaattgatttactcctaaaat

SEQ ID NO: 80669 - DNA, 50 bp, homo sapien
tgaaaactatacacctaaccattgaygcgagagcctagaatccattgaga

SEQ ID NO: 80670 - DNA, 50 bp, homo sapien
aaagctcatcttcttgtagctgtcayggatgtaaaaatcctggcagcaaa

SEQ ID NO: 80671 - DNA, 50 bp, homo sapien
gtaacaaaaatgccttaatagaagaragatgttcaatgtatgatttgctc

SEQ ID NO: 80672 - DNA, 50 bp, homo sapien
taatataatgttaccaaatgaatcakatctggtataccttattgcttaat

SEQ ID NO: 80673 - DNA, 50 bp, homo sapien
aagtccctcttcttagataaattcayagttagtgcagagaaattttctaa

SEQ ID NO: 80674 - DNA, 50 bp, homo sapien
aataattaaggtaaacacacatgtaytaatgctcatattagctgctctcc

SEQ ID NO: 80675 - DNA, 50 bp, homo sapien
aagacaaaatatagatgtttccaacratactttcatcaacatttcaagat

SEQ ID NO: 80676 - DNA, 50 bp, homo sapien
aaacaatttgctagactgatcatagratgatttaccagccaattaaagaa

SEQ ID NO: 80677 - DNA, 50 bp, homo sapien
tctggcttaaaagccaagtgcattawaagtcagatgctgtcggtccttag

SEQ ID NO: 80678 - DNA, 50 bp, homo sapien
gagttttgacagaaagctcgaagacmagaatagaataggtccaagtactc

SEQ ID NO: 80679 - DNA, 50 bp, homo sapien
aattatttagatatcgattctaacayattagagaccatagaaatgaaata

SEQ ID NO: 80680 - DNA, 50 bp, homo sapien
catttctctctctcaaaaaatgacckacatgtctctgttacaatatttct

SEQ ID NO: 80681 - DNA, 50 bp, homo sapien
agggctttaagagcagtggttgttamgttttcatttatgtaggagacaaa

SEQ ID NO: 80682 - DNA, 50 bp, homo sapien
acgtaacaaccactgctcttaaagcycttatttctcagtggcttttcttc

SEQ ID NO: 80683 - DNA, 50 bp, homo sapien
aacatggcagaatatatagaaaataycaaagtgcaaaaaagcataagtaa

SEQ ID NO: 80684 - DNA, 50 bp, homo sapien
ggagaatgtgccctttgactttctcrgactgatgcctgaccatagaaagc

SEQ ID NO: 80685 - DNA, 50 bp, homo sapien
attaccagatgccacaatctacagascctcgtaaaaagcggtactcaagt

SEQ ID NO: 80686 - DNA, 50 bp, homo sapien
attcagaatcttacaatccaaattaygtgatgatgcagctttcattttta

SEQ ID NO: 80687 - DNA, 50 bp, homo sapien
accagggccaccttttgaatggacarccacttgggctccaactcagtgtt

SEQ ID NO: 80688 - DNA, 50 bp, homo sapien
agccagaatacaggagagattttaakaagaggtaataccttgactagatt

SEQ ID NO: 80689 - DNA, 50 bp, homo sapien
attctagccagaatgattccattcastccattacaccagttatatcttct

SEQ ID NO: 80690 - DNA, 50 bp, homo sapien
taatgagccctacaagtgttaaaatrtacctacaaatgcaaacattttat

SEQ ID NO: 80691 - DNA, 50 bp, homo sapien
catgtttagatcaagtatccataaakatccagtaagtttctggtagcaaa

SEQ ID NO: 80692 - DNA, 50 bp, homo sapien
taatgaactcaatgactccatcaaaytggccggtcttgggtcagaatatt

SEQ ID NO: 80693 - DNA, 50 bp, homo sapien
ttctagaaggagatacagaatgccaygctaggtttaaaactcctgagaat

SEQ ID NO: 80694 - DNA, 50 bp, homo sapien
tcaggggtacacaaaggatagcaacraaatctgtgcatgcgctttttcct

SEQ ID NO: 80695 - DNA, 50 bp, homo sapien
gaggaaactgagacttgcagtgtgawagtagtaatttactctcccaaagt

SEQ ID NO: 80696 - DNA, 50 bp, homo sapien
tgggggctgataaaggagtgaaaaawtaatgtagaaccctaaataggatc

SEQ ID NO: 80697 - DNA, 50 bp, homo sapien
gtcatagcacatagtatttctttccratatatccattttgaaagagtctg

SEQ ID NO: 80698 - DNA, 50 bp, homo sapien
tttggcataagtttcatctttttcaygttctgtctcatcttgtatctcag

SEQ ID NO: 80699 - DNA, 50 bp, homo sapien
atccagcttttactcagagacattcrcttaataccatgctggcccagcca

SEQ ID NO: 80700 - DNA, 50 bp, homo sapien
tctgaagattttagcatcgtatacaytataacctcagagcttacagagca

SEQ ID NO: 80701 - DNA, 50 bp, homo sapien
ctagcgaacacttcctttgagcatcraaagtttccatttatttcttttga

SEQ ID NO: 80702 - DNA, 50 bp, homo sapien
ccaggattccgcagtccacgggcatraataaagtcgaatagcggtgcaat

SEQ ID NO: 80703 - DNA, 50 bp, homo sapien
acatcctaacaggctatgagatccarctccacgaaatggccttccatgag

SEQ ID NO: 80704 - DNA, 50 bp, homo sapien
ttgatatttctcaacttcgatgccarcagattgttttcttttagtggtaa

SEQ ID NO: 80705 - DNA, 50 bp, homo sapien
ttttagctagtggtatgattctggarcactaacaatgccattaaatgatt

SEQ ID NO: 80706 - DNA, 50 bp, homo sapien
actttatatatatttttgtcagctaygaaaacattaaacgctctctacta

SEQ ID NO: 80707 - DNA, 50 bp, homo sapien
acatgtgtgtccagtcatttaaaccraagtcataaaatactaactcaaca

SEQ ID NO: 80708 - DNA, 50 bp, homo sapien
cagtggtctatgccaggcttcttaamctcgggatagcgacaccctgcaca

SEQ ID NO: 80709 - DNA, 50 bp, homo sapien
gctggtttcaggggtgtatttgaaaytctgttcatttgttaagagggaga

SEQ ID NO: 80710 - DNA, 50 bp, homo sapien
tagtaagtttgacaacataaaagacycagtgaatttgaaagtaagtcagt

SEQ ID NO: 80711 - DNA, 50 bp, homo sapien
ggaatgccagcactcttagtaacacragaaataattaccactacggcacc

SEQ ID NO: 80712 - DNA, 50 bp, homo sapien
aggatatctttattgttcagttagaygtgaaaacatgacaattcagtagg

SEQ ID NO: 80713 - DNA, 50 bp, homo sapien
catttcctcacccaataacattttakctcccaccttgtttatactatatt

SEQ ID NO: 80714 - DNA, 50 bp, homo sapien
tggaaagctgactatgacaatcagarggcttctaaggcagtgttaaaaac

SEQ ID NO: 80715 - DNA, 50 bp, homo sapien
ttaaacagaatctgggcttaattcaytcatcccgttttacaaagcaaagg

SEQ ID NO: 80716 - DNA, 50 bp, homo sapien
aatacaatggctagtaagagactgayagttcatcttctgcaagcaaagat

SEQ ID NO: 80717 - DNA, 50 bp, homo sapien
ctggtagaaaataactgctgtaagaygaatgtgaagagaatgtcataaac

SEQ ID NO: 80718 - DNA, 50 bp, homo sapien
ccatgtactgaattgtgtatgagagraagagttgagcagagacctttaaa

SEQ ID NO: 80719 - DNA, 50 bp, homo sapien
ttacttttgtttaagtaagagtaccwcaatattgtaacaacaaaattcat

SEQ ID NO: 80720 - DNA, 50 bp, homo sapien
atacaaatagtataaaaatattccamcaaaacaaagatgaaatattttcc

SEQ ID NO: 80721 - DNA, 50 bp, homo sapien
cttccctgaggtcatttcaagtatcrgaaaatcttgctctttgctgtgga

SEQ ID NO: 80722 - DNA, 50 bp, homo sapien
gaggttttggctcaatagagctacgmgtctctgtattctcctgtctgtct

SEQ ID NO: 80723 - DNA, 50 bp, homo sapien
ccatgttatttgtttttaacagatamacagttgttccaggaatatttgat

SEQ ID NO: 80724 - DNA, 50 bp, homo sapien
tggccagtgctgctattcagaaacaygagagtccaggcaggcttcccatg

SEQ ID NO: 80725 - DNA, 50 bp, homo sapien
atacagcctattttttaagtattgascataacagttgatctcaaagcata

SEQ ID NO: 80726 - DNA, 50 bp, homo sapien
agagaatggatctaaaacatggtccrgaagattgtgaagagcggagactc

SEQ ID NO: 80727 - DNA, 50 bp, homo sapien
tattgcaattgtataaattctttaasagaaagttcctcagtagtagccat

SEQ ID NO: 80728 - DNA, 50 bp, homo sapien
ctgcctccctgcatgatgattgtacyggccaagagggaagtgtgtgtgca

SEQ ID NO: 80729 - DNA, 50 bp, homo sapien
tcctccatgtcagcaaataaaggccrctcttccttccaggaacttctata

SEQ ID NO: 80730 - DNA, 50 bp, homo sapien
tcaaaggtgctgagatttctctatastaaatgtagtagtacactatcagt

SEQ ID NO: 80731 - DNA, 50 bp, homo sapien
ggtgcttatttatcagccagtattgwaatttgtcaatatatcaaaaacga

SEQ ID NO: 80732 - DNA, 50 bp, homo sapien
aatttaacaccaaacctgaaaactaraaatattacactccagacattgat

SEQ ID NO: 80733 - DNA, 50 bp, homo sapien
tggaagaaaacatattgtaggacaamgagtgtatgcttagtgttgaatac

SEQ ID NO: 80734 - DNA, 50 bp, homo sapien
aatcagattacctcattttcactacyaccacaattggttctagagtggtt

SEQ ID NO: 80735 - DNA, 50 bp, homo sapien
aaataatttcatctatagttttatargttttctccattagacattggact

SEQ ID NO: 80736 - DNA, 50 bp, homo sapien
gttgaatacactgatgtggaacctayggatacatgagccaattctattct

SEQ ID NO: 80737 - DNA, 50 bp, homo sapien
tcgttggaatttcacgttttgagaasctattggtgtagtaaaagaaagga

SEQ ID NO: 80738 - DNA, 50 bp, homo sapien
ctctttttgcagggctcaagtgtccyagtgaaatgctaagcctgcatatt

SEQ ID NO: 80739 - DNA, 50 bp, homo sapien
caccacctatgtctactttgcaagayaatgcttaaaattggtatgtatat

SEQ ID NO: 80740 - DNA, 50 bp, homo sapien
ttaaggccagaagtttgaaggttacyatggtcctttcacaagttgcatgg

SEQ ID NO: 80741 - DNA, 50 bp, homo sapien
catgccttgctctaaaaatacctgckcaaatcgctatcactggccacctc

SEQ ID NO: 80742 - DNA, 50 bp, homo sapien
ttataaagtgcccttatatgatgacyaaaaccatactgaaaagcaggtat

SEQ ID NO: 80743 - DNA, 50 bp, homo sapien
ctattaggtaaaaatttatattagcmgaattagggctgtttgtgttggaa

SEQ ID NO: 80744 - DNA, 50 bp, homo sapien
gtgtctgatgtgtagaaagaacaaayatgaagttacactacaggactgaa

SEQ ID NO: 80745 - DNA, 32 bp, homo sapien
aatttacctacctaaakacttcagagttatcc

SEQ ID NO: 80746 - DNA, 50 bp, homo sapien
cttttttctacaatacagtaggaacrcttccagagaatagcagagagtag

SEQ ID NO: 80747 - DNA, 50 bp, homo sapien
tggattaagtggtccatatgtaacastattggtgacatctagaagacctt

SEQ ID NO: 80748 - DNA, 50 bp, homo sapien
tgaatcttattccttgtgtaagttasgttgcatttgtatttaaaaccaca

SEQ ID NO: 80749 - DNA, 50 bp, homo sapien
ctatggagcttttgtcatcagagtcrcgttgtatgtgttgagaatattat

SEQ ID NO: 80750 - DNA, 50 bp, homo sapien
gttaataagagtgggaatctcagaamaaggcatagaaaagaggcactaag

SEQ ID NO: 80751 - DNA, 50 bp, homo sapien
atcattaaagaagaaatgtagggaartatacaattgaaagggttaataag

SEQ ID NO: 80752 - DNA, 50 bp, homo sapien
tatagtgacatcaatatctaaagtayatgaagtattccacctgttcttct

SEQ ID NO: 80753 - DNA, 50 bp, homo sapien
ccaaaagaattaccagtctggagcaycacattcagaacaagagctgctca

SEQ ID NO: 80754 - DNA, 50 bp, homo sapien
ttgacaacggaaacgtttatgactcmagttgtgtggagaattcagaaagg

SEQ ID NO: 80755 - DNA, 50 bp, homo sapien
ttccgttgtcaaagcattggctggayggctttattcaaggctattgcaat

SEQ ID NO: 80756 - DNA, 50 bp, homo sapien
attaggtaaaataaaatgataatgcraagtaaaatgaagactcattgttt

SEQ ID NO: 80757 - DNA, 50 bp, homo sapien
tttggtattacttcagatgaaacgartcactctaactcttatgaggaatg

SEQ ID NO: 80758 - DNA, 50 bp, homo sapien
atattttgaaaacggaatctgaaaascgcaatattaaatcactaactatt

SEQ ID NO: 80759 - DNA, 50 bp, homo sapien
attaagaactacaagggaaggaaaaygctgacccatagactaaagcagag

SEQ ID NO: 80760 - DNA, 50 bp, homo sapien
caccttttcccatggtatatatttargagcagaaaaatatctgtgaaatt

SEQ ID NO: 80761 - DNA, 50 bp, homo sapien
atccagctcgttttaaaacttcaaaygatggatcccaaaagaagtaatgg

SEQ ID NO: 80762 - DNA, 50 bp, homo sapien
cttctttgataaacatttatcttcamgtaacttatccaacccaaacctca

SEQ ID NO: 80763 - DNA, 50 bp, homo sapien
cagtcaacaggaattaaaatacacamacagatgtgcttggtatattaaat

SEQ ID NO: 80764 - DNA, 50 bp, homo sapien
ctgtggtttttaaatgtttgtaatasctgcaatgcactttgacgttcagt

SEQ ID NO: 80765 - DNA, 50 bp, homo sapien
taactaaacagaatgtatatgtgcckcaatcaattaaatagggaacttta

SEQ ID NO: 80766 - DNA, 50 bp, homo sapien
cacaatttaaaaaattaagatcgctwaatgtcttagattgtcaaaaaaca

SEQ ID NO: 80767 - DNA, 50 bp, homo sapien
accacaggctcttgataaagtgtctmtcaagtgcatgagcgaaagaggag

SEQ ID NO: 80768 - DNA, 50 bp, homo sapien
gagttctaaaacaatgttctaaattygtcgtgcgatggggaactcaactt

SEQ ID NO: 80769 - DNA, 50 bp, homo sapien
gcgcttgagtatcctttacaaaagaygctgataaagagcaataattgagc

SEQ ID NO: 80770 - DNA, 50 bp, homo sapien
gtggttttatccaattggtgggtgaratgagtgaatttttttgacctctc

SEQ ID NO: 80771 - DNA, 50 bp, homo sapien
cagttctgggccatcttttgctttartagtaaggtgaaagccaagtaaca

SEQ ID NO: 80772 - DNA, 50 bp, homo sapien
acatgtgtggagcgactgtggaagckagtagatgaacagagtgcagtagg

SEQ ID NO: 80773 - DNA, 50 bp, homo sapien
accagaattagttattcaaagtgatwacctaaaattatgaaaatgagaaa

SEQ ID NO: 80774 - DNA, 50 bp, homo sapien
taattatagatgcatgtgcttttaaraatacagtaatttctcaaaatgaa

SEQ ID NO: 80775 - DNA, 50 bp, homo sapien
atggaattggggcataaataataaaygcggttcttacattctcttccaat

SEQ ID NO: 80776 - DNA, 50 bp, homo sapien
gttccaggagcccaggcttgtgtgawtataacaaaggcagaaccagaggt

SEQ ID NO: 80777 - DNA, 50 bp, homo sapien
agaaaaaaaatgaagggcagtaagawgtaattagttataaggcattcatg

SEQ ID NO: 80778 - DNA, 50 bp, homo sapien
aatttcatccatcatgtccataaaakgttttcttatgagagggaggagtc

SEQ ID NO: 80779 - DNA, 50 bp, homo sapien
tatgtttagtccattaaatttcagarggtcaagccatttagtataatttt

SEQ ID NO: 80780 - DNA, 50 bp, homo sapien
tagttataaggcattcatgtgttagmcccacaataaggtaacaatggcag

SEQ ID NO: 80781 - DNA, 50 bp, homo sapien
ataatgaatagttggcaaaggaaaasatcaggaatacattcaaactgaca

SEQ ID NO: 80782 - DNA, 50 bp, homo sapien
ttgtgatgatggcaggtcacttgacraggaaaagatggtcaataatgaat

SEQ ID NO: 80783 - DNA, 50 bp, homo sapien
ctacgtaatgacttcatcaataacaytcaccagtctggaaggtcactgga

SEQ ID NO: 80784 - DNA, 50 bp, homo sapien
tacccactcgcagagagcgtgacgamctgtcctcctgtcaacaacgcacc

SEQ ID NO: 80785 - DNA, 50 bp, homo sapien
gtacctctaattctgctcttctcaamcctttaggccataggatggatcta

SEQ ID NO: 80786 - DNA, 50 bp, homo sapien
aactgctatgaaacatgcatctacamatcttcttgtgaaagtacgttttc

SEQ ID NO: 80787 - DNA, 50 bp, homo sapien
ctgaattggcatcccaacatcaaacwctaaacgtaccaaagcactataag

SEQ ID NO: 80788 - DNA, 50 bp, homo sapien
acagtgcaatcaaaatggcaatcaakactaagaaatttgttcaaaaccat

SEQ ID NO: 80789 - DNA, 50 bp, homo sapien
aacagtgaagctgaggatagttcttsaaaatatattgcaggtacctgatg

SEQ ID NO: 80790 - DNA, 50 bp, homo sapien
aacattggttagctttcaaatactcmagctgtcatttaataagggagcca

SEQ ID NO: 80791 - DNA, 50 bp, homo sapien
ggagatttcaagctacactgtacagraaagaagcagctttgtttgggaag

SEQ ID NO: 80792 - DNA, 50 bp, homo sapien
tcacatctgcaaagtctcttttaccrcatgaaatgacatattcacaagtt

SEQ ID NO: 80793 - DNA, 50 bp, homo sapien
agagctgggggtttgtgatcatacawctcctttaagtgaagatctcaagc

SEQ ID NO: 80794 - DNA, 50 bp, homo sapien
agtaatgcatcaagagaaaatttacrggaaggagatgttttaaaatgtaa

SEQ ID NO: 80795 - DNA, 50 bp, homo sapien
attggctaacaggccaacattccaamtcctgtggccaatcatctgttacc

SEQ ID NO: 80796 - DNA, 50 bp, homo sapien
attagatcactgaaggatctataaarcagatggtaacaggcattactatc

SEQ ID NO: 80797 - DNA, 50 bp, homo sapien
tgggaggaacaccatcacttctccaygctctaattggctaacaggccaac

SEQ ID NO: 80798 - DNA, 50 bp, homo sapien
tattaatattcaattatggttaagayatgaatcgtgtacttcgatgaatc

SEQ ID NO: 80799 - DNA, 50 bp, homo sapien
caaaatcattagtcagtactacacastcacttatgacctatggacacaaa

SEQ ID NO: 80800 - DNA, 50 bp, homo sapien
cactggaagtctgatgggatttgtarcagaacaattacaaagttaattcc

SEQ ID NO: 80801 - DNA, 50 bp, homo sapien
ttcaggaatactaaaatcaagttaaygtttgagtggtatgttaatgtgta

SEQ ID NO: 80802 - DNA, 50 bp, homo sapien
ggaagtcaaaagatatttcaagtaayattgtaactcagatagtgatgctc

SEQ ID NO: 80803 - DNA, 50 bp, homo sapien
aggttactattgtgcaggtagtcaargtattagtaattctgatgatataa

SEQ ID NO: 80804 - DNA, 50 bp, homo sapien
gtgtctttataacaagttgcactgasattgaactagaaggaatattgagt

SEQ ID NO: 80805 - DNA, 50 bp, homo sapien
ggtcccaaaggatcacatctcaggarcagagtttaaccccaagcaaaggt

SEQ ID NO: 80806 - DNA, 50 bp, homo sapien
gcaccagagtgctaacaacatcaaamgattattagacaagtttcagaagg

SEQ ID NO: 80807 - DNA, 50 bp, homo sapien
gcaaagaaagaatttcagagacctawacaagtttccacccagaccatgct

SEQ ID NO: 80808 - DNA, 50 bp, homo sapien
agggtaccaaataaaagctactcaamgcatggtgcaaggatgggtcgtca

SEQ ID NO: 80809 - DNA, 50 bp, homo sapien
aggattttaccatcacaggtgactaygctaatgagtcaggtagctagtca

SEQ ID NO: 80810 - DNA, 50 bp, homo sapien
gtttccaacgctcacgtcaccggcaratagaaaggagaggcaccagtgtg

SEQ ID NO: 80811 - DNA, 50 bp, homo sapien
ctggttcctgctggtagaattcttaygcctggaagtgccatgtggaataa

SEQ ID NO: 80812 - DNA, 50 bp, homo sapien
agcagagtgaggagtgacaatgtgcragagaattttcagtcaacacttgt

SEQ ID NO: 80813 - DNA, 50 bp, homo sapien
tttagtaagctgggaattgaagataygacttaggtaagtgcatttttata

SEQ ID NO: 80814 - DNA, 50 bp, homo sapien
cctcaagtaaccagggagtagcaacrctctgcaggtttggtgtgtttggg

SEQ ID NO: 80815 - DNA, 50 bp, homo sapien
gtgctcagcttagggttagctgtaartaactaatgtgtttgactaatttg

SEQ ID NO: 80816 - DNA, 50 bp, homo sapien
gaatctactggaggcaaaccttatarataggccaatttcattcagaaatg

SEQ ID NO: 80817 - DNA, 50 bp, homo sapien
attttttctttttctttgcacctttyaaaaattaatgactgatgtactta

SEQ ID NO: 80818 - DNA, 50 bp, homo sapien
cttcttcccagagtaacactgcatarttgacctgattcaaggctgagtga

SEQ ID NO: 80819 - DNA, 50 bp, homo sapien
tgaatacaaatacacaattttcagayagaagtagtataagaaaaggaaat

SEQ ID NO: 80820 - DNA, 50 bp, homo sapien
aaaatttctgtcatatgtttagtgtyggtaagatctatattgatgttact

SEQ ID NO: 80821 - DNA, 50 bp, homo sapien
atagcactcactgctttatgtatcamctagacaactatttcagaatgcag

SEQ ID NO: 80822 - DNA, 50 bp, homo sapien
aaactgcattccctttggactggtawaattgtagcctggtggtcaagaaa

SEQ ID NO: 80823 - DNA, 50 bp, homo sapien
tatgtatcataatatattttttcaamccaaagttataataaatttgccag

SEQ ID NO: 80824 - DNA, 50 bp, homo sapien
ggatgtgaacagtaaattctcataamtgtgactcgtgtttggattaagta

SEQ ID NO: 80825 - DNA, 50 bp, homo sapien
aacattctcttctaaacatgaaccamatctgtagggtcaaatcaatagat

SEQ ID NO: 80826 - DNA, 50 bp, homo sapien
tgtgtgtggatcaagaagtgaagccratggaatgtagccaggacaatgag

SEQ ID NO: 80827 - DNA, 50 bp, homo sapien
ctctgttctttgctgtcactttccaytattcaaagcaggtagccaaacaa

SEQ ID NO: 80828 - DNA, 50 bp, homo sapien
gctgggttagattgattcacagaaaygatgggcaggactttggccgtcat

SEQ ID NO: 80829 - DNA, 50 bp, homo sapien
aaccactaagactccaaggttgccasacagcaataactaatacatggact

SEQ ID NO: 80830 - DNA, 50 bp, homo sapien
gacggggagtctagcctctggatgcrctgatctaatttcgagttgtcctt

SEQ ID NO: 80831 - DNA, 50 bp, homo sapien
ttactggtttcagatgcccgttcaarcctaaattactgtaataattggga

SEQ ID NO: 80832 - DNA, 50 bp, homo sapien
taatgaaatccacacttctggtataraaatgaaaaagcaagactcaaaga

SEQ ID NO: 80833 - DNA, 50 bp, homo sapien
agtacatgattaccaaaatattcaartcttcccatctctatttcttgtat

SEQ ID NO: 80834 - DNA, 50 bp, homo sapien
agtccaaagagaagcagcgatactayggccctgtaattattgagcccggg

SEQ ID NO: 80835 - DNA, 50 bp, homo sapien
ttggtacaaagcagtagtatttgcaygtatcaactagttaatagagtgga

SEQ ID NO: 80836 - DNA, 50 bp, homo sapien
aaatcaatggactttggataattcaytctgtggtgttctcagtacaaatg

SEQ ID NO: 80837 - DNA, 50 bp, homo sapien
aaaactaagatacagctgaatgaatsatagcacttattttttaaataatg

SEQ ID NO: 80838 - DNA, 50 bp, homo sapien
tgctgttcctatttgttattacaccyagcagttaattataaatgatgtta

SEQ ID NO: 80839 - DNA, 50 bp, homo sapien
atgggttctaaaacagatggttacaygaaaacatacatggatgtgctata

SEQ ID NO: 80840 - DNA, 50 bp, homo sapien
tcattcacttcttgtaaaacctgccsaagttatagttaaaaatatcatac

SEQ ID NO: 80841 - DNA, 50 bp, homo sapien
tccttctgctgttgagatttcaggarcttttaataaattaaacctgcatt

SEQ ID NO: 80842 - DNA, 50 bp, homo sapien
agagctttgagataggtaactatacygaaaatgaaacgaattgatttttt

SEQ ID NO: 80843 - DNA, 50 bp, homo sapien
aaatttgaatgcagtatgcttacccrctaggaaaattagaaggcccctag

SEQ ID NO: 80844 - DNA, 50 bp, homo sapien
ggttaatgtcaaccggagatacttayacctggaacatgaagggagagaga

SEQ ID NO: 80845 - DNA, 50 bp, homo sapien
caaattaagtttaaagtgttactaaygtagtgattctttgtagctaaggc

SEQ ID NO: 80846 - DNA, 50 bp, homo sapien
aatgaagcattgggtcatcagattayggtaatgcaaaataaaagatttgt

SEQ ID NO: 80847 - DNA, 50 bp, homo sapien
acccaagaaatggaatctgttataawtgaaaagagaaggagtgtctagaa

SEQ ID NO: 80848 - DNA, 50 bp, homo sapien
catggtgatggaataaatgttttgastacttaaatgtctgaagtctatga

SEQ ID NO: 80849 - DNA, 50 bp, homo sapien
tgctctattgtggtttgattttaaaktccttgattcatattctgttacat

SEQ ID NO: 80850 - DNA, 50 bp, homo sapien
gattcttccctacatctctcataccmaattgagtaacaaattttattccc

SEQ ID NO: 80851 - DNA, 50 bp, homo sapien
atccaggatgatgttctaattcaagyccatgggtcattagaggatcaagc

SEQ ID NO: 80852 - DNA, 50 bp, homo sapien
gaagattctccttgaagctttatcaytaaaaaataaacccacatattctg

SEQ ID NO: 80853 - DNA, 50 bp, homo sapien
aaggactatggcatctcactgaagargatttgtttatgctccagaacaaa

SEQ ID NO: 80854 - DNA, 50 bp, homo sapien
actaccaaagggaaactggggtactrctatacaactgaggcaaaaagaat

SEQ ID NO: 80855 - DNA, 50 bp, homo sapien
cagctcaggatgccatgttcaaatcmagagagttggtctgtgagcctcac

SEQ ID NO: 80856 - DNA, 50 bp, homo sapien
tcttgatgataggaattgaaacggaygctttcactagaccaatagctgtt

SEQ ID NO: 80857 - DNA, 50 bp, homo sapien
ttcacttacaaagaaaagcacagtawgtgttcatataaataaaagtcaca

SEQ ID NO: 80858 - DNA, 50 bp, homo sapien
cacccaatgtgatgatattaggagayggaatttgggggaggtgattaaga

SEQ ID NO: 80859 - DNA, 50 bp, homo sapien
aacttgcaattctgtatgtacacgtkaagtcaatgtgaggtttaattaag

SEQ ID NO: 80860 - DNA, 50 bp, homo sapien
tattcttctagaaaatggctatcccratgcccacatttatatgaactcac

SEQ ID NO: 80861 - DNA, 50 bp, homo sapien
gttgattgtcttggaagaatatctaygactcctgggtctagggcacccta

SEQ ID NO: 80862 - DNA, 50 bp, homo sapien
aaagaaaaataaggaggtgagagggwataatctattaactgaagggatta

SEQ ID NO: 80863 - DNA, 50 bp, homo sapien
gctgctaaaaactccttgaagcgacsgcatgttacaatctggaatatttt

SEQ ID NO: 80864 - DNA, 50 bp, homo sapien
ccaaatgtaggtaattttttaaacamccaaagcagtatttgctataagtc

SEQ ID NO: 80865 - DNA, 50 bp, homo sapien
ggaaaatggattgattgactccttayaggtcaggtgtctactgtggggca

SEQ ID NO: 80866 - DNA, 50 bp, homo sapien
ggatctccaaagggatgtctttttgyaggctaaggattgactgatggctg

SEQ ID NO: 80867 - DNA, 50 bp, homo sapien
gggaaactgaggcaggtcccagaaasagccagttgcagggtgggtgcaga

SEQ ID NO: 80868 - DNA, 50 bp, homo sapien
aggagatcttcactcttgagaagacrcagcaggggatgcctctggacctc

SEQ ID NO: 80869 - DNA, 50 bp, homo sapien
atgggttttattaagaaaggcagaarctaattatttaaaacctgtaataa

SEQ ID NO: 80870 - DNA, 50 bp, homo sapien
catggaacccaagtgtggaatttcayctgcgcgtcagggtggggttatga

SEQ ID NO: 80871 - DNA, 50 bp, homo sapien
tccccgaggccacctctgcgacaagmactgactcatgcccgagccaccag

SEQ ID NO: 80872 - DNA, 50 bp, homo sapien
aacattctaaataatattttaccttwaaaaagctgacacaacatgaacat

SEQ ID NO: 80873 - DNA, 50 bp, homo sapien
gtctcagaaataatgactccttttckcacatttagggaggttttctgtcc

SEQ ID NO: 80874 - DNA, 50 bp, homo sapien
aaaattttaccttaatgggataaaamacaagaaagccttactatcagaat

SEQ ID NO: 80875 - DNA, 50 bp, homo sapien
ttccctcatgtccaacagctacatargatagggtttaataaagagttctt

SEQ ID NO: 80876 - DNA, 50 bp, homo sapien
ttttctctgagtatgaaattctctckgacaatcattttctctttcattat

SEQ ID NO: 80877 - DNA, 50 bp, homo sapien
tcccctgaggtagaccagagaagatrttgaagccatggaggggcaacaaa

SEQ ID NO: 80878 - DNA, 50 bp, homo sapien
cggtcatttggattacacaaagaaaygaagctctggaaatggtaaaatac

SEQ ID NO: 80879 - DNA, 50 bp, homo sapien
tcctatttcctcttctgtggccatakgttaggcactgtgggcacccgacc

SEQ ID NO: 80880 - DNA, 50 bp, homo sapien
aaggctgagaaatcctgagctaaggkcagtggtcaggagaagaggacagc

SEQ ID NO: 80881 - DNA, 50 bp, homo sapien
cacatcaaaaaaaaaatctggacccraaatgtcaatggttccaaggctga

SEQ ID NO: 80882 - DNA, 50 bp, homo sapien
ttcgaaatagccctggataacatatkaatagcttggatcattttaaatgc

SEQ ID NO: 80883 - DNA, 50 bp, homo sapien
gttgagtgggtaatgaattcctaaaygctggaaatgacaagatgtgtaaa

SEQ ID NO: 80884 - DNA, 50 bp, homo sapien
tttacgggctggaacactgaaaaccrgcggcagaatggcacagcgtgagg

SEQ ID NO: 80885 - DNA, 50 bp, homo sapien
attctagaactcttcttcaaggatarcatccctttgctgtgcatgaattc

SEQ ID NO: 80886 - DNA, 50 bp, homo sapien
atggaccatttaaaatgttttcttayaagtatgtctggtcatgcatgaag

SEQ ID NO: 80887 - DNA, 50 bp, homo sapien
aagggcccagaatttactgaatgccrctcacatgccaggactgtgctggg

SEQ ID NO: 80888 - DNA, 50 bp, homo sapien
aacacatggtgggcagtcaggaatcrctggagggactcactaatcacgta

SEQ ID NO: 80889 - DNA, 50 bp, homo sapien
ttgctttatcaccactatcttctcckacactgatgcctttcctggggcca

SEQ ID NO: 80890 - DNA, 50 bp, homo sapien
acactgccttggcttaatgatccatrtactgtcacggcaccttctaaagg

SEQ ID NO: 80891 - DNA, 50 bp, homo sapien
agggcattgtgagctgcagcgcttakgaccaagcatgaagattcccgttt

SEQ ID NO: 80892 - DNA, 50 bp, homo sapien
gggtcacagatggcaaaggttccagyccaatcatcacggatttgggaagt

SEQ ID NO: 80893 - DNA, 50 bp, homo sapien
gagtccatgagactgattctgtccartgaaatgtgatgtccaaaagtgat

SEQ ID NO: 80894 - DNA, 50 bp, homo sapien
tgtgaaagacttgggggccatgaaakagttcccacagaggaggagtaagg

SEQ ID NO: 80895 - DNA, 50 bp, homo sapien
gaatgtgagattagacactcgagtayactgataaataagacagacatctc

SEQ ID NO: 80896 - DNA, 50 bp, homo sapien
taaaaaagagtgtaaggaatactgawcttgtctacctcccaagttttcta

SEQ ID NO: 80897 - DNA, 50 bp, homo sapien
gctacaaggatacctggggaatgaawcttctagccacaggaaggagaata

SEQ ID NO: 80898 - DNA, 50 bp, homo sapien
tggagcttgctgcccagtgaagacamagacattgaacaattaatcccaac

SEQ ID NO: 80899 - DNA, 50 bp, homo sapien
acacatgctcagtggctaagaaatayacaaatgttgcaagtctgaccctc

SEQ ID NO: 80900 - DNA, 50 bp, homo sapien
catgtaggaaatttaaagtttcgacratagccatacaaagacactacaat

SEQ ID NO: 80901 - DNA, 50 bp, homo sapien
aaataactgcaaaacacggttttacraatttctcagactgcataacaatg

SEQ ID NO: 80902 - DNA, 50 bp, homo sapien
atccgagaacaaagagactgatgggwatcccagtaagagatcgctgacac

SEQ ID NO: 80903 - DNA, 32 bp, homo sapien
tatcagaaacagcaagmcttctttcctctcta

SEQ ID NO: 80904 - DNA, 50 bp, homo sapien
gggtaagttcctgtgggcccctgagscgttgctaacaaataactatgctg

SEQ ID NO: 80905 - DNA, 50 bp, homo sapien
agtaattctttggtgctgcatttgtytataaatttagaatcagtctgtcc

SEQ ID NO: 80906 - DNA, 50 bp, homo sapien
cacctaggctttacgtccagcaatamcttgcaataacccctgagaggaga

SEQ ID NO: 80907 - DNA, 50 bp, homo sapien
tcagagttgtgaatctgagagtcacmaacccacctgtgaatgagatccag

SEQ ID NO: 80908 - DNA, 50 bp, homo sapien
cagagagttacatcacctgggtatcrgactcagctacatgtcaaaatggc

SEQ ID NO: 80909 - DNA, 50 bp, homo sapien
ggattttctctagaagaatctgtggycaaatctcttatccaatggaggta

SEQ ID NO: 80910 - DNA, 50 bp, homo sapien
gcaatgaagtaattatgctaatgccrctagaaaagtatttgcataagaaa

SEQ ID NO: 80911 - DNA, 50 bp, homo sapien
ccttggcaacaaccttaggataaaaracatttccagagaagttgtcacac

SEQ ID NO: 80912 - DNA, 50 bp, homo sapien
ctggtgcccagctccttcctgtacayaccagcttgagcagttgacagctg

SEQ ID NO: 80913 - DNA, 50 bp, homo sapien
gttgcctcgccctgaaagactaaaaycatcctcagttttcatccacatcc

SEQ ID NO: 80914 - DNA, 50 bp, homo sapien
tctcgtgtaactgacaaagataatayattaagttaggagctaatgctact

SEQ ID NO: 80915 - DNA, 50 bp, homo sapien
gtttaactagccttccacattctctwaataacttgtaagattcacctaac

SEQ ID NO: 80916 - DNA, 50 bp, homo sapien
tgcaagaggccttagataacctgtamgcaactgggcatggctgtgtccta

SEQ ID NO: 80917 - DNA, 50 bp, homo sapien
ggggatacgaggaggactccggatamgaggctggacctgcgtcctagctc

SEQ ID NO: 80918 - DNA, 50 bp, homo sapien
agcaaccaggggtcacatgggcatayggctgagcctggacccatccacct

SEQ ID NO: 80919 - DNA, 50 bp, homo sapien
acgtccgggtatcctcatgctccctkaaaggcacctacagtgaggaccgg

SEQ ID NO: 80920 - DNA, 50 bp, homo sapien
acaaagcatttgatcaaatctaacaycacttatgataaaaactatcagta

SEQ ID NO: 80921 - DNA, 50 bp, homo sapien
tggacaatgaggaactttactggacracgtatcccacatgaaaagaccac

SEQ ID NO: 80922 - DNA, 50 bp, homo sapien
gataactagcagcaagattgagcaamagtgcttaaccacgagtcttttat

SEQ ID NO: 80923 - DNA, 50 bp, homo sapien
ggatccacagagtcaccagactcttycttgggtgacagtgtccttggttc

SEQ ID NO: 80924 - DNA, 50 bp, homo sapien
attatctgcagcataatatattgcaycaagtcaggtaaattggataactt

SEQ ID NO: 80925 - DNA, 50 bp, homo sapien
cagctcttattactttgtcaactaargagaaacccagaagtagcagcatg

SEQ ID NO: 80926 - DNA, 50 bp, homo sapien
gttgcttctgttcttgaccttggctrtctctgtctactcctccgggtcag

SEQ ID NO: 80927 - DNA, 50 bp, homo sapien
attttacgcaggaaagtgacttaacrgaatgtgtattttaaaaagatgat

SEQ ID NO: 80928 - DNA, 50 bp, homo sapien
atctgtgggaaagagtcctgaatgakgcattagtagctctgagggtttat

SEQ ID NO: 80929 - DNA, 50 bp, homo sapien
atctgagttctaaaaattggcattcraggccctttataatcagatttcat

SEQ ID NO: 80930 - DNA, 50 bp, homo sapien
ttgaggttgagttggtaacactaagkctggaaagatgaaatctgattata

SEQ ID NO: 80931 - DNA, 50 bp, homo sapien
gcctgacctcctcataaccctggccrgcaagctgtgatgaatgggaggtc

SEQ ID NO: 80932 - DNA, 50 bp, homo sapien
ccctgttgccataaatttgttttacyagtccctgaaaatcatgtaaatgg

SEQ ID NO: 80933 - DNA, 50 bp, homo sapien
aattttggcaacatgctaaacctaasaacaattaattcactcagaaataa

SEQ ID NO: 80934 - DNA, 50 bp, homo sapien
tttggccattcttctcatattatccygcgtcaggtggtgtatgtgtgtgc

SEQ ID NO: 80935 - DNA, 50 bp, homo sapien
gtcccatgttcaaaaaaaagaattayctcaattggtggaagctttaaata

SEQ ID NO: 80936 - DNA, 50 bp, homo sapien
ggttgcaaagcctgtgtttttaggcyaagcgttacatgggagcctaatct

SEQ ID NO: 80937 - DNA, 50 bp, homo sapien
gccttgtgtttaaagaaatagaaaakaatcttctcaataaacacacagag

SEQ ID NO: 80938 - DNA, 50 bp, homo sapien
ctgagtgggaggatgttgctacacgsagttttgttgatggcatctgtagt

SEQ ID NO: 80939 - DNA, 50 bp, homo sapien
tcattttttttctcttgctaaataaygtaaataacatgctaaatagaaca

SEQ ID NO: 80940 - DNA, 50 bp, homo sapien
tccccatgtttataagattaattacractcctggcccactaatctcacta

SEQ ID NO: 80941 - DNA, 50 bp, homo sapien
gaaataaaagccacctgtggcacttyagcgactattcaatatcacccatt

SEQ ID NO: 80942 - DNA, 50 bp, homo sapien
atgcccttgagatctgcccaagttgytgtaggtatccatagtccattcat

SEQ ID NO: 80943 - DNA, 50 bp, homo sapien
aaaaattatgagaatcttgagtccartgaaataacgttaatattctttaa

SEQ ID NO: 80944 - DNA, 50 bp, homo sapien
gtagagtacgcccagaatctatcaasttaaggattaaacttaaatctact

SEQ ID NO: 80945 - DNA, 50 bp, homo sapien
atcacatcgcctcaggagggttccargaatatgtcaaaaggcctactgtg

SEQ ID NO: 80946 - DNA, 50 bp, homo sapien
attcttctgcctgggccctttttcarggtgtgttatgccatatttttggg

SEQ ID NO: 80947 - DNA, 50 bp, homo sapien
gcagtacccattatgaaaaaatccgragactccatcctttatagcttctt

SEQ ID NO: 80948 - DNA, 50 bp, homo sapien
gtctttgcaggacaccttgtatgacycttagagaaaggagcagtgcttct

SEQ ID NO: 80949 - DNA, 50 bp, homo sapien
ttgagggatggtcatgtattcatcakatttcaataaatcctttccaatgt

SEQ ID NO: 80950 - DNA, 50 bp, homo sapien
acggaaagggaagctggggtggatgygaacatgaaaagcaaaatgcagga

SEQ ID NO: 80951 - DNA, 50 bp, homo sapien
aaagatgtgttatttagtggaatagsagcaagttttcaggatgatgttaa

SEQ ID NO: 80952 - DNA, 50 bp, homo sapien
actttcacagcctccatgtctgagaytcagaacctcaacagtgggatatg

SEQ ID NO: 80953 - DNA, 50 bp, homo sapien
tgagagagacacgtatgggccctttygtcacctggacttctccacttccg

SEQ ID NO: 80954 - DNA, 50 bp, homo sapien
ggaggactagattatttggatcaacyctcagaacacacaaaaaaggaaag

SEQ ID NO: 80955 - DNA, 50 bp, homo sapien
aattattccagattttccagtactcrccataacttatacccaacattatg

SEQ ID NO: 80956 - DNA, 50 bp, homo sapien
gtggagcagaggtttctctggccaasctagaagtagtgtgtgtaacttct

SEQ ID NO: 80957 - DNA, 50 bp, homo sapien
tccataggtttatagcacaactgaartattttacaacttaaaataataga

SEQ ID NO: 80958 - DNA, 50 bp, homo sapien
attttattgctactattatcttattraacactatggatattattgtgcat

SEQ ID NO: 80959 - DNA, 50 bp, homo sapien
ctttacaattaagcgccaggaataargttcaccctgaacaaaagcagttt

SEQ ID NO: 80960 - DNA, 50 bp, homo sapien
agaagtcccgggattggaggctcaaygataatgggtccaattaaactaac

SEQ ID NO: 80961 - DNA, 50 bp, homo sapien
tttgggaggagattcggctaaagtcyacgagggccacgtatttatatata

SEQ ID NO: 80962 - DNA, 50 bp, homo sapien
actggtacaaaaacaaactcataggycaatgcaacagaatagggagccca

SEQ ID NO: 80963 - DNA, 50 bp, homo sapien
ttctgatcacagatgatgaagagtaygcagataattttggcaaggccacc

SEQ ID NO: 80964 - DNA, 50 bp, homo sapien
tctgggctttggacatgtgtttctcrctaaggttaatcactcctagcttt

SEQ ID NO: 80965 - DNA, 50 bp, homo sapien
cccaaatcctcactccattgagtccracaacaccaaaagcgagacctggc

SEQ ID NO: 80966 - DNA, 50 bp, homo sapien
aaccatatacaacacatagtcagaartattcagaaatgtaagagttaaaa

SEQ ID NO: 80967 - DNA, 50 bp, homo sapien
cactcagaatgtcacttagatcgacraagcagaactgcactttttttgca

SEQ ID NO: 80968 - DNA, 50 bp, homo sapien
ttcttgtaaaatctatgatatgtgayagccttacctgttctgtcttctct

SEQ ID NO: 80969 - DNA, 50 bp, homo sapien
tttggcactgagaagtgaggcactgsaattaaaaacaaacaaacaaataa

SEQ ID NO: 80970 - DNA, 50 bp, homo sapien
atacaaaggcatactttattaagtgyatgagcaatcctttttattagaac

SEQ ID NO: 80971 - DNA, 50 bp, homo sapien
aacccttctgagaatagatctaacaytggactgctttgaaggtttgatat

SEQ ID NO: 80972 - DNA, 50 bp, homo sapien
aggacattatatattaataaaagggycaagtcatcaataaaatataacaa

SEQ ID NO: 80973 - DNA, 50 bp, homo sapien
acagaagcgcatcaaggttactatayaccacaaccaacgggaattgtttc

SEQ ID NO: 80974 - DNA, 50 bp, homo sapien
ttacctctttggtttattgtgaataytacataagtgagtacgagaaaatc

SEQ ID NO: 80975 - DNA, 50 bp, homo sapien
aacatatcaaaagaaatatacaggayggagaaaaaataataggaagtgat

SEQ ID NO: 80976 - DNA, 50 bp, homo sapien
gagttctgctttcagtaatggtaaartagctcctttgcactaattttctc

SEQ ID NO: 80977 - DNA, 50 bp, homo sapien
tagggtggaaggaaagagaaaaaggrcataccacttctcaaccttccttt

SEQ ID NO: 80978 - DNA, 50 bp, homo sapien
attggaatcccagaatgaaaagacarggaaagtggaacagaaaatatact

SEQ ID NO: 80979 - DNA, 50 bp, homo sapien
gtatagaagtttaggttcatttatayagacaaagttgaaggaagtttaac

SEQ ID NO: 80980 - DNA, 50 bp, homo sapien
ttcttgcttaaaagagtaggcagtarcccttttcctttcaaacttgatgt

SEQ ID NO: 80981 - DNA, 50 bp, homo sapien
agagaaacttaaatcgcatagtttaygtaactttcatctatttttgccac

SEQ ID NO: 80982 - DNA, 50 bp, homo sapien
attagcaactgaaaccaatagaaagwcctttgtaataagccacctacact

SEQ ID NO: 80983 - DNA, 50 bp, homo sapien
aatagccctttccaatttgcattcaygtagtacttactacagtatatagt

SEQ ID NO: 80984 - DNA, 50 bp, homo sapien
gagaagagatggcttcactgataaayagactcacctgtccatccacctat

SEQ ID NO: 80985 - DNA, 50 bp, homo sapien
atacggctacctacctagtacacatyatctacaatataacattttctttt

SEQ ID NO: 80986 - DNA, 50 bp, homo sapien
tagggaagtatgacaagaaaaaacawctgtacatattcagtacagacaca

SEQ ID NO: 80987 - DNA, 50 bp, homo sapien
atggaaggaattattagtaatcctamacatttgtatgccaatatttttgg

SEQ ID NO: 80988 - DNA, 50 bp, homo sapien
atctcaccttccactgtgtagataayaccgacttcacttagttattatct

SEQ ID NO: 80989 - DNA, 50 bp, homo sapien
gttggtcaacacgtctgcataagaarcacctcgtgacgaatcacaggtga

SEQ ID NO: 80990 - DNA, 50 bp, homo sapien
aactataattatatgctgaacaataycctacttttctccaaatacagaat

SEQ ID NO: 80991 - DNA, 50 bp, homo sapien
aaaatcttccaacttttcaacccaaygtgatgaatatttgattttgttct

SEQ ID NO: 80992 - DNA, 50 bp, homo sapien
gggacgcgagttcgagtgcacccccrgagaggattctgtcagctctcttt

SEQ ID NO: 80993 - DNA, 50 bp, homo sapien
gggagaactgatgcctttttttcctsagagtcagtgcaacacatcaacgg

SEQ ID NO: 80994 - DNA, 50 bp, homo sapien
ttttattttcattactaatgacttaygaacttgaatcagattgggcaaat

SEQ ID NO: 80995 - DNA, 50 bp, homo sapien
gcccaaaaggtgagctgcttaataayctggctgtgggactttgatgaagt

SEQ ID NO: 80996 - DNA, 50 bp, homo sapien
cccgacactctgaatccctttatccwgcttcctcttcctgctatttgaca

SEQ ID NO: 80997 - DNA, 50 bp, homo sapien
ttttcagcattaatatttccaaaagwactggggacattttctggtggcat

SEQ ID NO: 80998 - DNA, 50 bp, homo sapien
tcccagcaatcttataagagggttcraaaattatccctattttaaaatat

SEQ ID NO: 80999 - DNA, 50 bp, homo sapien
ctgcacaagtggatctcagtgtggaygtgaactctaagatataggggcat

SEQ ID NO: 81000 - DNA, 50 bp, homo sapien
tatgttcttgtttctaaggactccartataacattaatctcttcgggaat

SEQ ID NO: 81001 - DNA, 50 bp, homo sapien
caacttgtttcctgggactgttggtmaagccaggtaaggacaatctctag

SEQ ID NO: 81002 - DNA, 50 bp, homo sapien
ttgtagtcccagctactcggaatgckgaagtttgagcctgggaggtcaag

SEQ ID NO: 81003 - DNA, 50 bp, homo sapien
gtttcagtctgacatgttaaggagasagaggaataaaactgaaaaataaa

SEQ ID NO: 81004 - DNA, 50 bp, homo sapien
gtgtgtgagataggatgtataggcaytgaaacgtaccatcttagttatac

SEQ ID NO: 81005 - DNA, 50 bp, homo sapien
aataagaatgaataagcaatttccaraggttccaaagtgtagcacccagt

SEQ ID NO: 81006 - DNA, 50 bp, homo sapien
taaaaaatggaagccatcattaattyaaaacaggattaagtgccaaaagt

SEQ ID NO: 81007 - DNA, 50 bp, homo sapien
ccaaccagagtatccaatgctagcarcagcttctaatacttcactgatgc

SEQ ID NO: 81008 - DNA, 50 bp, homo sapien
tttccccttcctcctcttggtaaacygctcacaaatgttcaggtaacatc

SEQ ID NO: 81009 - DNA, 50 bp, homo sapien
atgtgaaattctgactaattgtctcrcctggattcatcgcaaatccctaa

SEQ ID NO: 81010 - DNA, 50 bp, homo sapien
attttgaaattaaacatgactcttcyaaggtaaacactcaaaaacctcta

SEQ ID NO: 81011 - DNA, 50 bp, homo sapien
gcagtcagttgaactcaactgtttarcaagaaggaatttttcatctcagt

SEQ ID NO: 81012 - DNA, 50 bp, homo sapien
cccaattctaggtataagagtcaacrcttcctatattttgggtctaagca

SEQ ID NO: 81013 - DNA, 50 bp, homo sapien
ccaatccccaacctgtaggccatgarcatcacgtcagtttttaaagcccc

SEQ ID NO: 81014 - DNA, 50 bp, homo sapien
tggctctcccaggaggttttcatgaygtaacctgccaatttgataaatct

SEQ ID NO: 81015 - DNA, 50 bp, homo sapien
tgaacatgtcctcagagtccagtgasctccagttatcacccctgcactct

SEQ ID NO: 81016 - DNA, 50 bp, homo sapien
tgagtctctagaattctcagggaaaytaaaactcattacttgatcagaat

SEQ ID NO: 81017 - DNA, 50 bp, homo sapien
actccatctcaagcatcgatgtcaaygggggcaaccggaagaccatcttg

SEQ ID NO: 81018 - DNA, 50 bp, homo sapien
agtgaagtttggagtcaacccagtaraggcggccactgaggagatctaga

SEQ ID NO: 81019 - DNA, 50 bp, homo sapien
cctgcctggtcactgccctcagagayggttgcaaatatctctggcacagc

SEQ ID NO: 81020 - DNA, 50 bp, homo sapien
ataattacatctacacctctctgtcraagaattgtgatgaatgaaaaaga

SEQ ID NO: 81021 - DNA, 50 bp, homo sapien
acccaacagacagcatacatggtcamcactatccaggactctccataata

SEQ ID NO: 81022 - DNA, 50 bp, homo sapien
tcttacactgagacagaagaaaaaaycattcttgtcagcctgacacaatt

SEQ ID NO: 81023 - DNA, 50 bp, homo sapien
ttgatttgtgatctcatgacaattcyctgacttctctccagaaagagata

SEQ ID NO: 81024 - DNA, 50 bp, homo sapien
ttactaagatgctttgacagtctcarcttacgtggtcattgctgtggtct

SEQ ID NO: 81025 - DNA, 50 bp, homo sapien
tccttccactcttaaattctactgcraacgtgtgaaatgacgctgtcatg

SEQ ID NO: 81026 - DNA, 50 bp, homo sapien
tgaggctttctttggagacctatacrcagatgaatattatgtagacgtac

SEQ ID NO: 81027 - DNA, 50 bp, homo sapien
taatgccagaagtgaacttcaaagasagcataaatggagttatcaaagaa

SEQ ID NO: 81028 - DNA, 50 bp, homo sapien
agtagttcattcactcatctgtccaytccttaattcattcagcagttgct

SEQ ID NO: 81029 - DNA, 50 bp, homo sapien
cttggtgtagtaggagttaaaaatayatcttcctgaggcctttgggtgtg

SEQ ID NO: 81030 - DNA, 50 bp, homo sapien
gtcgcttttccttccacctgatttcycagtctggataatccaaatacaca

SEQ ID NO: 81031 - DNA, 50 bp, homo sapien
tttcctttcatcctacccataacggyaagtgtgcaaatccctacatagca

SEQ ID NO: 81032 - DNA, 50 bp, homo sapien
ggtattgttttgtcctagcattactsagaccatcctcatttctatccagg

SEQ ID NO: 81033 - DNA, 50 bp, homo sapien
agtcttaagatctaacagttattgarcactagctaccaggatcctaatta

SEQ ID NO: 81034 - DNA, 50 bp, homo sapien
atgcaaagtggctcagctccataaakaaaactttgacataatcttacagc

SEQ ID NO: 81035 - DNA, 50 bp, homo sapien
gttagagggtgaatgaaatgtcacaygccgcaaggacaaggacccaggga

SEQ ID NO: 81036 - DNA, 50 bp, homo sapien
aggaaaagccagttaactgagagatyattaagcatcactcttagggcaag

SEQ ID NO: 81037 - DNA, 50 bp, homo sapien
ccatcagcccagggtcactggaaatwccctcacaatcacctgggtgtctt

SEQ ID NO: 81038 - DNA, 50 bp, homo sapien
gtggtgacccaaacccacagctggaragataaacccaagcacactcttca

SEQ ID NO: 81039 - DNA, 50 bp, homo sapien
gaaagaaagaaaatacaaaagcgatraaactggttattgttggtatccgc

SEQ ID NO: 81040 - DNA, 50 bp, homo sapien
gcaggaggcatgccctccctgctgayggcgactcctttcctccacccagg

SEQ ID NO: 81041 - DNA, 50 bp, homo sapien
aaacaagaaagaagcacatccctcaragtttttgtactgccattcctcct

SEQ ID NO: 81042 - DNA, 50 bp, homo sapien
ctggataaataattgaattgtgcatygtatggttggcacaatatatagat

SEQ ID NO: 81043 - DNA, 50 bp, homo sapien
tctctagacctggtggagcagacaawcagggcaagtccccaggatagaag

SEQ ID NO: 81044 - DNA, 50 bp, homo sapien
gtgtgtttaaaaattcacctgctggmtaattgtaacatagagtgtatttg

SEQ ID NO: 81045 - DNA, 50 bp, homo sapien
tcactctatgatatgggtgtaatgayagttagtttattcattgagaggca

SEQ ID NO: 81046 - DNA, 50 bp, homo sapien
gaggctgggaaatgtagtctctaccytgaccatgtgccttgttttaaaac

SEQ ID NO: 81047 - DNA, 50 bp, homo sapien
atattagtctgtgagactaaagacaygggtaactgcgtccaagcatggca

SEQ ID NO: 81048 - DNA, 50 bp, homo sapien
ttttttatcaaaagcaaccaactcaratttgctaatccaacagttactaa

SEQ ID NO: 81049 - DNA, 50 bp, homo sapien
aagctatgtccaccccagccaatagrgatcaatctagctatattaaatca

SEQ ID NO: 81050 - DNA, 50 bp, homo sapien
attgaacctatcacacacgattggakataaacatttaaattggtatatgt

SEQ ID NO: 81051 - DNA, 50 bp, homo sapien
actcccctgcttcctgtcatgcaaargagctttcatttctctagatgtca

SEQ ID NO: 81052 - DNA, 50 bp, homo sapien
ctaggcagaggttgttctttctcgayagctgttccaagagtgctatcctg

SEQ ID NO: 81053 - DNA, 50 bp, homo sapien
gcgcccggcctcaacctttatatcgyaagtagctcacactgaccccagcc

SEQ ID NO: 81054 - DNA, 50 bp, homo sapien
ctacaaaatgaaaacttacagatacratgaaggctgctttgatataaaga

SEQ ID NO: 81055 - DNA, 50 bp, homo sapien
agaggtaggcatgaaatgcttagaawcctgagaactgcaggggcggagag

SEQ ID NO: 81056 - DNA, 50 bp, homo sapien
agtaaagggttttaagcaggtaaacsggacgaaaagcgtctacgtggccc

SEQ ID NO: 81057 - DNA, 50 bp, homo sapien
atggcgtgtggccatataagatgtcraaggatgagttataaagtgagatt

SEQ ID NO: 81058 - DNA, 50 bp, homo sapien
atataattaacgtatcataaattcayccttctaaagtgcataattcattg

SEQ ID NO: 81059 - DNA, 50 bp, homo sapien
aaccatttcatattgttactgacatkatgccccttcacccccaaaatagc

SEQ ID NO: 81060 - DNA, 50 bp, homo sapien
ggccttacctggtagcgagctcagaytacaccctggtgttcaaagcgtgc

SEQ ID NO: 81061 - DNA, 50 bp, homo sapien
acctgataataattgtacctataaaktcacaacgctgtaatcataattat

SEQ ID NO: 81062 - DNA, 50 bp, homo sapien
atcaaatacattattttttaaataartggcactgaatagattacatagca

SEQ ID NO: 81063 - DNA, 50 bp, homo sapien
actacttgagccggaagagaagagamattaccaactctaaggatatgggg

SEQ ID NO: 81064 - DNA, 50 bp, homo sapien
tgagctaaaaaaaaaaaaaatcgcaracaaatctcataatgttttaagaa

SEQ ID NO: 81065 - DNA, 50 bp, homo sapien
cacaagatgctatcaggtgctatgargaaaactgaatagagtgatgtgat

SEQ ID NO: 81066 - DNA, 50 bp, homo sapien
aagaatgaggaagctgcgctaataayacaaagtgacaaaaagcaaaattc

SEQ ID NO: 81067 - DNA, 50 bp, homo sapien
ccaatcatttcctcttcaggaatacygcatttaacaacaatctacaggaa

SEQ ID NO: 81068 - DNA, 50 bp, homo sapien
ctcatctagacaaggacagagcctaycactttccctgggactcagcctgg

SEQ ID NO: 81069 - DNA, 50 bp, homo sapien
ggccccagaggagtgggtctggagcrtccatgtggctgaatttatggagc

SEQ ID NO: 81070 - DNA, 50 bp, homo sapien
acccacacatcagaaaacacacgaarccatttcatgtccagagatgcggg

SEQ ID NO: 81071 - DNA, 50 bp, homo sapien
gattttaatgaccgagtatggaaaaygcatgtcaaagaccttattcgtaa

SEQ ID NO: 81072 - DNA, 50 bp, homo sapien
cagcttcacaggttgtctgaaaagawactaagcacgtgcaccggcagggt

SEQ ID NO: 81073 - DNA, 50 bp, homo sapien
aatcaagaaatgagacaatccataargaggaactgctatgattagcttct

SEQ ID NO: 81074 - DNA, 50 bp, homo sapien
cagacaaaacgtaattaaagagttamgagataacagtaaacagggaactc

SEQ ID NO: 81075 - DNA, 50 bp, homo sapien
ctgaaatgaaagagatttgactcaayttcccggttgctgggtggcggagg

SEQ ID NO: 81076 - DNA, 50 bp, homo sapien
agatgaaggaacccattcaacttgarattactgaaaaaagacatgggact

SEQ ID NO: 81077 - DNA, 50 bp, homo sapien
aatccccaagtttcttataaatacakaagtttcaggttcattgtcctggg

SEQ ID NO: 81078 - DNA, 50 bp, homo sapien
ccctccccgcctcctccctccagtckgtaaaatgtcttagcatctcagat

SEQ ID NO: 81079 - DNA, 50 bp, homo sapien
tccacctcaccagccatgcaggggaygataaaagctcagcagttggatca

SEQ ID NO: 81080 - DNA, 32 bp, homo sapien
aaaaaaaaaagcatgaytgtgacacctggaaa

SEQ ID NO: 81081 - DNA, 50 bp, homo sapien
tgacaaaatcaacctcacagacttamaatcatgctcttaaaaacttcaca

SEQ ID NO: 81082 - DNA, 50 bp, homo sapien
taggtgactatgtggttatggagaaytcagtcatgagaagatgggcctta

SEQ ID NO: 81083 - DNA, 50 bp, homo sapien
cagcctgtggcagcacctttccgtgractctaggggaccaaattcttctc

SEQ ID NO: 81084 - DNA, 50 bp, homo sapien
acagactagccatctccctagacagrcaatagacataacgcataaatcac

SEQ ID NO: 81085 - DNA, 50 bp, homo sapien
tccatgaaaatgaaatgtctttccayatattgatattgcatttaatttct

SEQ ID NO: 81086 - DNA, 50 bp, homo sapien
caagatcagtcgacaaggccattgamccagacagaaagagttcagactta

SEQ ID NO: 81087 - DNA, 50 bp, homo sapien
actggtaagccatgaacctgtgaacsgtcttaatacagagttgggcagga

SEQ ID NO: 81088 - DNA, 50 bp, homo sapien
accttccctggctctcactgccctcracttagcacagttccttggaagaa

SEQ ID NO: 81089 - DNA, 50 bp, homo sapien
ctctgatctcctcgaccttgatgtaygtagaccctctcctcaaaaaccag

SEQ ID NO: 81090 - DNA, 50 bp, homo sapien
agttgaactctaacatcgtctatagraccatttcccgtctccagttaggt

SEQ ID NO: 81091 - DNA, 32 bp, homo sapien
aggcccacaaactatgraaggacagaatatac

SEQ ID NO: 81092 - DNA, 50 bp, homo sapien
aaaaatagaaggctatgaacaacaaytgagtcaaagaagaaattaaaaca

SEQ ID NO: 81093 - DNA, 50 bp, homo sapien
tctaggaatttagcccgaggacagtsaagaggcacaaggccatgcgtggc

SEQ ID NO: 81094 - DNA, 50 bp, homo sapien
atttggtattcacttgaggactgcakgttcaagtaatgggctgttgaagt

SEQ ID NO: 81095 - DNA, 50 bp, homo sapien
tagctgacatttgaatatttcttgamtaaatcacacagcagaaaaagcta

SEQ ID NO: 81096 - DNA, 50 bp, homo sapien
atactaaaaagcaccacctcttctayaacgcagtactcttgctcaggccc

SEQ ID NO: 81097 - DNA, 50 bp, homo sapien
agagcagagctttacaaaaataagaytcgacagtccagctcttggaacca

SEQ ID NO: 81098 - DNA, 50 bp, homo sapien
aagttcaataatgtgtaatgcatagraagtggctaagaacctcattggtt

SEQ ID NO: 81099 - DNA, 50 bp, homo sapien
ataaggatgtacatatagatgaatgmaatagagttgacagtctagaaaac

SEQ ID NO: 81100 - DNA, 50 bp, homo sapien
aggcagctggctagtatcatgtgaarataggttgggacttcactgtgggg

SEQ ID NO: 81101 - DNA, 50 bp, homo sapien
tttctataaaattgcaataataaaartgtcttctttgtaaggatatttgg

SEQ ID NO: 81102 - DNA, 50 bp, homo sapien
ctctctgttcttctctctcagctcarcagaattgaacagaattttttggt

SEQ ID NO: 81103 - DNA, 50 bp, homo sapien
caatgaggcagttcgccaaaagtaaratactattaccagagcaagggtag

SEQ ID NO: 81104 - DNA, 50 bp, homo sapien
gtatatgagggtggatggtactcccraagatgctaataatagaatgaata

SEQ ID NO: 81105 - DNA, 50 bp, homo sapien
gcaatctcttctccaatgacattcaracccggaaaacttgaatcccaggg

SEQ ID NO: 81106 - DNA, 50 bp, homo sapien
aagtaagggactataaatgtcagtargtttgatttaacaactgcaaatta

SEQ ID NO: 81107 - DNA, 50 bp, homo sapien
cctgctcatcctcattgcctggaaaygaatgaataaggcaggaaagctgc

SEQ ID NO: 81108 - DNA, 50 bp, homo sapien
agactcaccttcatgaaagactgaawcgtagcgtcagttcgaacttgcag

SEQ ID NO: 81109 - DNA, 50 bp, homo sapien
taaccataaggttgcaatcaatgaamaagatacaagttgactctggaaac

SEQ ID NO: 81110 - DNA, 50 bp, homo sapien
cactcagatgtgtcttatcagaatayggaatcaccagctactttaatgga

SEQ ID NO: 81111 - DNA, 50 bp, homo sapien
gcagcaagaaataaagtagggtcaarcatgaatgaacaacactcagatcc

SEQ ID NO: 81112 - DNA, 50 bp, homo sapien
tgttgttaaactgctgacggttgatraaggggcactgagacagcaacaat

SEQ ID NO: 81113 - DNA, 50 bp, homo sapien
gggttgattgaagttggtttctaggrcaacaccaggtgggtaggaaggga

SEQ ID NO: 81114 - DNA, 50 bp, homo sapien
tgtgctggaactcaagtgaacactcrgctcaaagtccattgctgttctct

SEQ ID NO: 81115 - DNA, 50 bp, homo sapien
cctaaaccaattcatatcctcctcasgttaactagcatctatttttgttg

SEQ ID NO: 81116 - DNA, 50 bp, homo sapien
aagcaatcagttgaactaacagggamgactctggagccaggaagcctgag

SEQ ID NO: 81117 - DNA, 50 bp, homo sapien
acattcccaacgccatttgctcttaygaaatcgtggattagaactagaat

SEQ ID NO: 81118 - DNA, 50 bp, homo sapien
agtttagtgcagtggtggagaaaagwatccctttgaatgatacctgatta

SEQ ID NO: 81119 - DNA, 50 bp, homo sapien
ccacattattgaatgactgctaagarcatggtagaatttcactttgtaca

SEQ ID NO: 81120 - DNA, 50 bp, homo sapien
gcctggccgagttgtcctttcttgasagttcctatgaaagaaaataactt

SEQ ID NO: 81121 - DNA, 50 bp, homo sapien
ccagggaatgtgtcagatgcctaagraccttcacagcaattctagcaatt

SEQ ID NO: 81122 - DNA, 50 bp, homo sapien
acaatgtgagatattcagagctttayatttagtaagggattcacttggtt

SEQ ID NO: 81123 - DNA, 50 bp, homo sapien
agtgacagactagcacctgagattaraaggtctgctcttccagtttgcag

SEQ ID NO: 81124 - DNA, 50 bp, homo sapien
agaacattatagcttgcttagctaamcattatatttccaaatccatttcc

SEQ ID NO: 81125 - DNA, 50 bp, homo sapien
atttctatatgaacctcaggaacaamgaactactttccagcaccttctga

SEQ ID NO: 81126 - DNA, 50 bp, homo sapien
gaacattttcgtgataaacgggagasagaagtgtatgttaatccccacct

SEQ ID NO: 81127 - DNA, 50 bp, homo sapien
accgtcatgaagcactaacactaccrcctcagtaaagctgtttcttccac

SEQ ID NO: 81128 - DNA, 50 bp, homo sapien
gtgagatcacttttccacagctggascaccttgagaatggggctaaaaat

SEQ ID NO: 81129 - DNA, 50 bp, homo sapien
ttcctaactctgaaatttattcttamcattcttctccccactccgccctc

SEQ ID NO: 81130 - DNA, 50 bp, homo sapien
gtagccatatcaggtagtaaaacatkataaatctacaatacttaaaacag

SEQ ID NO: 81131 - DNA, 50 bp, homo sapien
gtgatttattaaggaagtgctttcartaagaggggtaagagaatggagga

SEQ ID NO: 81132 - DNA, 50 bp, homo sapien
gtcttctcccagagaaagaaaaagaycaccgttattcctaggggaacctc

SEQ ID NO: 81133 - DNA, 50 bp, homo sapien
ttcctgcctcacactggtctaaacaygtaggtctctgaactcaaagcctt

SEQ ID NO: 81134 - DNA, 50 bp, homo sapien
tggaaaagactttctttcctaatgargagagctctgccaacagagtctct

SEQ ID NO: 81135 - DNA, 50 bp, homo sapien
ccaaagagggattctgcacattatcratattaacagctccaggcacatct

SEQ ID NO: 81136 - DNA, 50 bp, homo sapien
gctgtcgagtgccaaactgataaaawggattcactgaataactctcaact

SEQ ID NO: 81137 - DNA, 50 bp, homo sapien
agtaaaatgtagtaaatatacacaakgaattactacacaaatgttagaag

SEQ ID NO: 81138 - DNA, 50 bp, homo sapien
tgtcggttcaggttcgctgttattartgtactccgtggcgtgttagctgg

SEQ ID NO: 81139 - DNA, 50 bp, homo sapien
gcctgggcaacatggtgaaacctcaygtgtccaaaaatacaaaggttacc

SEQ ID NO: 81140 - DNA, 50 bp, homo sapien
aagaaagtgaaaagacaaccaatccrctgaataagagagactatttacaa

SEQ ID NO: 81141 - DNA, 50 bp, homo sapien
tagatgactatccaagactcgctccrgaagttcatagagtcagagtcaat

SEQ ID NO: 81142 - DNA, 50 bp, homo sapien
ctctcccctgtccccaggactcttaygggtcacacaaaactagatgctag

SEQ ID NO: 81143 - DNA, 50 bp, homo sapien
ttcgtagcatctaatttggtaatgawgaatgagtaatagaatcttttggt

SEQ ID NO: 81144 - DNA, 50 bp, homo sapien
ttaatttgcttgattggttgaaaacrgtaccatgaagtggcctattctgt

SEQ ID NO: 81145 - DNA, 50 bp, homo sapien
tcgcacaaaaagcaacgtggagactsagaagcaagcgcagcgtcaaggaa

SEQ ID NO: 81146 - DNA, 50 bp, homo sapien
cacctctagatgtgagaaaaaatcayatgggcttacaccacgcaggactg

SEQ ID NO: 81147 - DNA, 50 bp, homo sapien
tttgaagagttttatagtgttagctyctataggatttaggtcagtgatgt

SEQ ID NO: 81148 - DNA, 50 bp, homo sapien
cttttctgcattgcagatgaaagacraaagtacctctgattggtcccctc

SEQ ID NO: 81149 - DNA, 50 bp, homo sapien
aggaatggcctaacatattaatatayctgaagagagagacagatgcagta

SEQ ID NO: 81150 - DNA, 50 bp, homo sapien
accatggttttttatgtaggaagatyagcaattaaagtatttacagacat

SEQ ID NO: 81151 - DNA, 50 bp, homo sapien
cttctcctgtaggttactgcaggaartagttctcaaaggatgatccctga

SEQ ID NO: 81152 - DNA, 50 bp, homo sapien
atgttctacttagcttttcagtctaygcttggaatcagcaacctgtttca

SEQ ID NO: 81153 - DNA, 50 bp, homo sapien
gtgctggtaaaatatcttgaggaagraaaagagaaatctggtaggtattt

SEQ ID NO: 81154 - DNA, 50 bp, homo sapien
gctgcccatctgctttcagaacctakgctgagttcgagatttatggagga

SEQ ID NO: 81155 - DNA, 50 bp, homo sapien
ttgtttttatatgtcactcataaaaytataccttccacatgggcaggaag

SEQ ID NO: 81156 - DNA, 50 bp, homo sapien
acccgccacattctgggattcaaacrctgggttgaagtctgctcatagcg

SEQ ID NO: 81157 - DNA, 50 bp, homo sapien
caagcaacagtaaatatgccctgaaraaggataatgtgacccagagctta

SEQ ID NO: 81158 - DNA, 50 bp, homo sapien
ccatggacagcccccacaagatgccrataagttcagaaaccaagacttgt

SEQ ID NO: 81159 - DNA, 50 bp, homo sapien
catctatggaaggggtcaggagttcsgagagacacccaggcttgcaagag

SEQ ID NO: 81160 - DNA, 50 bp, homo sapien
caattcaaatgacttcttcttgtaawctatggagacttgaagaccagaag

SEQ ID NO: 81161 - DNA, 50 bp, homo sapien
aaaaatctaaatattgagttctttargtatccacatataagtgcatattt

SEQ ID NO: 81162 - DNA, 50 bp, homo sapien
cctgtcttcgttcaccacctgaaaayagtggcctcatttggttcatccag

SEQ ID NO: 81163 - DNA, 50 bp, homo sapien
aattccttgagggcattgacttttamaaaagagggagcagcaatggccta

SEQ ID NO: 81164 - DNA, 50 bp, homo sapien
gatggttacatgataatatttatagkccattttcatttataagtatagct

SEQ ID NO: 81165 - DNA, 50 bp, homo sapien
cagcagccgttgcactcacaaaggaygtgtctctcacagtacaaagtaat

SEQ ID NO: 81166 - DNA, 50 bp, homo sapien
aagataaatggtgatttggaactgarattggcttttattttaatgtgacc

SEQ ID NO: 81167 - DNA, 50 bp, homo sapien
aaatacctgtgaagatcattgcaggraaggaagaaaccattctgtgacag

SEQ ID NO: 81168 - DNA, 50 bp, homo sapien
cgaaactccatatcaatcaatcaatmaataaatcccagaatgcagatcct

SEQ ID NO: 81169 - DNA, 50 bp, homo sapien
agttatggagacctggtgcctttgaygaagaagctattagataagagatt

SEQ ID NO: 81170 - DNA, 50 bp, homo sapien
ccagaaccaagagccctataatccartatgaaacagacctgtagaggctg

SEQ ID NO: 81171 - DNA, 50 bp, homo sapien
cctctccattctcaccaattgtgtarctaaatcaagaccttcactggact

SEQ ID NO: 81172 - DNA, 50 bp, homo sapien
ctgcacagcttgtccttgaacttcaytcccttagcaaacatcagccactc

SEQ ID NO: 81173 - DNA, 50 bp, homo sapien
tgcatctctctgatccagctgggaargtgttgggaaaaagctgagggtta

SEQ ID NO: 81174 - DNA, 50 bp, homo sapien
agaatatgtgacggactgtgcttgayggtgaggtattgttcctcacagga

SEQ ID NO: 81175 - DNA, 50 bp, homo sapien
aatatgttcacccaaattccaattayaccttggtttcatttccacattgt

SEQ ID NO: 81176 - DNA, 50 bp, homo sapien
tgcacaatcacacaaccattagtaayaccaccagaaataaaattcctttt

SEQ ID NO: 81177 - DNA, 50 bp, homo sapien
cagtggttctaatcctgctcaactcscgacctaaccctgcccccagcacc

SEQ ID NO: 81178 - DNA, 50 bp, homo sapien
accataagttaattttgctgtttccyacgttcttcataacgttcatcttt

SEQ ID NO: 81179 - DNA, 50 bp, homo sapien
ggcttatataggatatgaacttaccrccatttagggaggtgtgcagaagg

SEQ ID NO: 81180 - DNA, 50 bp, homo sapien
tgtcttatgaagagattttggcgtamgattttattgaaaaaatacgttat

SEQ ID NO: 81181 - DNA, 50 bp, homo sapien
cctaggactgggataccatcaagtaraggtaacaataaaattttattcca

SEQ ID NO: 81182 - DNA, 50 bp, homo sapien
ggcagccttgaatatagttaccagasagaagcagagcaaatggattaagt

SEQ ID NO: 81183 - DNA, 50 bp, homo sapien
tgatcatttgggtaagctggtaaccrccgtaagtccattgtaaagattta

SEQ ID NO: 81184 - DNA, 50 bp, homo sapien
attcctgagagttagtacttccggcygcaaatcacgtagtttcccaaaca

SEQ ID NO: 81185 - DNA, 50 bp, homo sapien
aatccttgggcttgtgggttaatgcyaaaaactcaagaagcaatttcaca

SEQ ID NO: 81186 - DNA, 50 bp, homo sapien
caaaacaaacaaaaagattaaacaaraaagatgatcgataataacttggc

SEQ ID NO: 81187 - DNA, 50 bp, homo sapien
gctgttaatatcatcctgtgaccaayttgaggacccagacacacacgagg

SEQ ID NO: 81188 - DNA, 50 bp, homo sapien
tctagaggtggcgatggatgcagaarcgggtaacaatgcacgaggtgggc

SEQ ID NO: 81189 - DNA, 50 bp, homo sapien
tagaaacagctgcctttaatgacagsaagatgtaagacaagtgtttatta

SEQ ID NO: 81190 - DNA, 50 bp, homo sapien
agtcacctaagcctaacctgtaatayggcaactgcacaagtccccttggc

SEQ ID NO: 81191 - DNA, 50 bp, homo sapien
cagcactgccccagaatgctttgtgyacctcatccagagcccagaatctg

SEQ ID NO: 81192 - DNA, 50 bp, homo sapien
agctggccagtatggtgaaactctaygtccatctctgccagggtccaacc

SEQ ID NO: 81193 - DNA, 50 bp, homo sapien
catcaaattgctgattaagtaaaagycatttcaatcgatattgaagacct

SEQ ID NO: 81194 - DNA, 50 bp, homo sapien
aaccaggtgagccctgccatacctaygacaacgttccttctgggagtaaa

SEQ ID NO: 81195 - DNA, 50 bp, homo sapien
gtgatgataatgaagatggtagtaayaatggctaacattgatcagatttt

SEQ ID NO: 81196 - DNA, 50 bp, homo sapien
gtgttcagctttttacttgttgttargatagagtgataaccatcaagctt

SEQ ID NO: 81197 - DNA, 50 bp, homo sapien
gcggcagcgtcaggacgcgaacccaygtctttcagctttccagagaggac

SEQ ID NO: 81198 - DNA, 50 bp, homo sapien
tggttactcagcaagtatatggtagyaccaggttttgaacgtagacattt

SEQ ID NO: 81199 - DNA, 50 bp, homo sapien
gaatgaacagatatatcacgtggcaygcatttcttctcagtggtgcaggt

SEQ ID NO: 81200 - DNA, 50 bp, homo sapien
gatctgaacaaaagggggaacagccrtgtcttctgaaacactccttctca

SEQ ID NO: 81201 - DNA, 50 bp, homo sapien
ggacctattataagtagcagcaaaartgtcagcagagcttacattcgagt

SEQ ID NO: 81202 - DNA, 50 bp, homo sapien
agagatgtttaattctaccatattgraacaggaagtcctctatgctgtat

SEQ ID NO: 81203 - DNA, 50 bp, homo sapien
tagagcttgatgcctatagttcacamagatggagtatttcttatgcctac

SEQ ID NO: 81204 - DNA, 50 bp, homo sapien
gtactttttgttggagataagaaacrggaactgctatctctgggtttctt

SEQ ID NO: 81205 - DNA, 50 bp, homo sapien
tggaattgctgagtcatctggtaacygtgtgtttaataatagtttgagga

SEQ ID NO: 81206 - DNA, 50 bp, homo sapien
gactcagcaattccactcccagataygtacccaagagaaatgacggcaaa

SEQ ID NO: 81207 - DNA, 50 bp, homo sapien
cagggctcagtgacttctgtattccyttgcagatcctgagctcccagagt

SEQ ID NO: 81208 - DNA, 50 bp, homo sapien
taatcaatttttaaatacgtatgaaygatacagtttacttttgttttggt

SEQ ID NO: 81209 - DNA, 50 bp, homo sapien
cgtgtcagggtccgcaatcaggtggygaacatcccgtccttcattgtccg

SEQ ID NO: 81210 - DNA, 50 bp, homo sapien
tccacatttctctgaagcctgaaaaygatccttcttaatgaccatgaatg

SEQ ID NO: 81211 - DNA, 50 bp, homo sapien
aaacctctcatatatttacaccttayaggagtagagacacatcatctgaa

SEQ ID NO: 81212 - DNA, 50 bp, homo sapien
acatttctgttggggtaagagttgastcatcattggaggactctggagtc

SEQ ID NO: 81213 - DNA, 50 bp, homo sapien
gtgccatataaagctctaacaatccrctttacaccgcaattcacagctga

SEQ ID NO: 81214 - DNA, 50 bp, homo sapien
tgaaatctgttctgtattttacacayatagcctgttacaaaatggactag

SEQ ID NO: 81215 - DNA, 50 bp, homo sapien
gatagcctaacgcactactgggagakaaagaatgcatctggtgtttttgt

SEQ ID NO: 81216 - DNA, 50 bp, homo sapien
tgcggctgcggctgcggcaagtggarcggcttatcttggcccatgcgcgg

SEQ ID NO: 81217 - DNA, 50 bp, homo sapien
gcctctcccttgttgctgataagaayttcctttacctctctatgtacaga

SEQ ID NO: 81218 - DNA, 50 bp, homo sapien
tttctctactccacacttttttttcraagtcaacatggatccttaaaaaa

SEQ ID NO: 81219 - DNA, 50 bp, homo sapien
atatataaaaaattttcacaacacartaattttaaaacacaatgaaaaat

SEQ ID NO: 81220 - DNA, 50 bp, homo sapien
ttcatcactctgagatataggattcraaagcaaaatacaaattaacagtt

SEQ ID NO: 81221 - DNA, 50 bp, homo sapien
tcttaatattggatccatttgaacaratcagtaattgaactttgggaaaa

SEQ ID NO: 81222 - DNA, 50 bp, homo sapien
ataataatagaaggaaacaacaaagrccctagtccaccttaattgtaatt

SEQ ID NO: 81223 - DNA, 50 bp, homo sapien
tggtttggttgcaggtgctcaaggargcattgaactgtcttgcgagaaat

SEQ ID NO: 81224 - DNA, 50 bp, homo sapien
tacaattacctttgcttctaggtcaygagaacattttctttccttggcct

SEQ ID NO: 81225 - DNA, 50 bp, homo sapien
ggacaatgcatctctcagagtggtgraaccttgggaatagatatggtgat

SEQ ID NO: 81226 - DNA, 50 bp, homo sapien
ttcgggcctgccacaattaaatgacsgcaagaaagaagtctatgctaagc

SEQ ID NO: 81227 - DNA, 50 bp, homo sapien
gggcagagacccctctgggaaataayagatactcatcattgtctgcctaa

SEQ ID NO: 81228 - DNA, 50 bp, homo sapien
cttcacccgggctgattacttctacrgacacgaccaactcaccatgcaga

SEQ ID NO: 81229 - DNA, 50 bp, homo sapien
tcctcccatgtgtggatccaatggtsaccctttaggcagtggtgcaatgg

SEQ ID NO: 81230 - DNA, 50 bp, homo sapien
atattacaacccaaacactggtttcyatattggtacaaaaaggatactcc

SEQ ID NO: 81231 - DNA, 50 bp, homo sapien
acaaactcttgattatatatattccygaagtacctactctgcgtaggtcc

SEQ ID NO: 81232 - DNA, 50 bp, homo sapien
tctgaagagaaaaattactggactgmaaggtataaaaagagattatgcag

SEQ ID NO: 81233 - DNA, 50 bp, homo sapien
aaaagagattatgcagaatgcaattmaaaaagacaaatgagcagatgtac

SEQ ID NO: 81234 - DNA, 50 bp, homo sapien
ctgacctctgtgacctctttgtccarcatccctaggccaacacccccagg

SEQ ID NO: 81235 - DNA, 50 bp, homo sapien
tttgaagctggctttggagttgcacmtgctattcattataaagaggtgca

SEQ ID NO: 81236 - DNA, 50 bp, homo sapien
ggtgcaacgtaaccccagtgactaayccacttggctggggtgacagttga

SEQ ID NO: 81237 - DNA, 50 bp, homo sapien
atggaggtaccaagttgatataagayggtcaactaaaatctcttaatgtg

SEQ ID NO: 81238 - DNA, 50 bp, homo sapien
gagagctggcctagccctactggacrctctgttcttgacacttatcatct

SEQ ID NO: 81239 - DNA, 50 bp, homo sapien
aaaaggtgctcaatggttgctattayacaaaggaagagaaatacgctcaa

SEQ ID NO: 81240 - DNA, 50 bp, homo sapien
cctaacaacataatgaatctaggcawtgatcatcagtgaatgcatgacat

SEQ ID NO: 81241 - DNA, 50 bp, homo sapien
taagagctttatcctctaagctcaaygtgtagatcttgtttaaactctaa

SEQ ID NO: 81242 - DNA, 50 bp, homo sapien
ttcctattattagtattttactttaytcaccattgtatacataaggagag

SEQ ID NO: 81243 - DNA, 50 bp, homo sapien
catttgcagtgtgttggtgatccacraaaggaaaatcacggaagtaggat

SEQ ID NO: 81244 - DNA, 50 bp, homo sapien
caaggaactggtcagtgtagggaaascacacattttcttgaccagaagta

SEQ ID NO: 81245 - DNA, 50 bp, homo sapien
ggctcctcatcccgtatggtcatgaygacatccccagtacctagaagatg

SEQ ID NO: 81246 - DNA, 50 bp, homo sapien
atctaaggacagccattgcagttccrctttgccccacaatgagccaggaa

SEQ ID NO: 81247 - DNA, 50 bp, homo sapien
tgatttattctttcctcctctgaaaytcaacacggtagtaaacactgaac

SEQ ID NO: 81248 - DNA, 50 bp, homo sapien
ctttccacaggcaggcggtcaacacragccacttgtaacacatatacgca

SEQ ID NO: 81249 - DNA, 50 bp, homo sapien
cactaacataaggtgacttacctgamgggtcccgttccttctgactgagg

SEQ ID NO: 81250 - DNA, 50 bp, homo sapien
tggaggtgtctagagaacctatacasaaaaaggcaatgagcaatgcaatc

SEQ ID NO: 81251 - DNA, 50 bp, homo sapien
cctcgtcattaaattcactttcactragatcctctggctgcatatcccaa

SEQ ID NO: 81252 - DNA, 50 bp, homo sapien
gaaggtcacacaactctgccatgatragtacagctgagtccacagtcagc

SEQ ID NO: 81253 - DNA, 50 bp, homo sapien
tggacacatggcctacgattcaccaytatgacatgcccaatttagatttt

SEQ ID NO: 81254 - DNA, 50 bp, homo sapien
tagcaacatacaaaatggaatgaaakaaacttcttggaattattataatt

SEQ ID NO: 81255 - DNA, 50 bp, homo sapien
ggacgcacacaggagagagaccttaygaatgtcacgaatgcttaaaaggc

SEQ ID NO: 81256 - DNA, 50 bp, homo sapien
ttgcccaggatgagtactatggtgtratactagatccctgcagcagcctt

SEQ ID NO: 81257 - DNA, 50 bp, homo sapien
taagtggaaaatacgttttatgcacsgaacttactgcacatcatagctta

SEQ ID NO: 81258 - DNA, 50 bp, homo sapien
ctagtcctgtgttgtccaatacggtrtccaccagccatatggagctacta

SEQ ID NO: 81259 - DNA, 50 bp, homo sapien
aggttatgctggagtctctctattcrctgaacacagtttacctctccacg

SEQ ID NO: 81260 - DNA, 50 bp, homo sapien
atcctgatttgtctccaaatttcaastcacacagaaaaaaataggtcaaa

SEQ ID NO: 81261 - DNA, 50 bp, homo sapien
tacctcttaatactcattttgtagayagaaataagcttttttttttcttt

SEQ ID NO: 81262 - DNA, 50 bp, homo sapien
gcttaggtgtttaagttgagacgtckaatcatgctgtgggaaaaggattg

SEQ ID NO: 81263 - DNA, 50 bp, homo sapien
aggaatcatggagatgacctcatcaygcatttcttagagtggatgggact

SEQ ID NO: 81264 - DNA, 50 bp, homo sapien
aaatttctacatctgccgttgaagamagtagttcagctggctgcctctgt

SEQ ID NO: 81265 - DNA, 32 bp, homo sapien
ttactttggattgatcyatttcattagtcata

SEQ ID NO: 81266 - DNA, 50 bp, homo sapien
attaacttttatacatagtcattaayctagcattttatagtcctaaaatc

SEQ ID NO: 81267 - DNA, 50 bp, homo sapien
ggtgattgatcccctgaccttgggckcattaactttatcctctcatgaat

SEQ ID NO: 81268 - DNA, 50 bp, homo sapien
gagggaaagaaagctgactgaaataygctcttttgagatcctagaaattc

SEQ ID NO: 81269 - DNA, 50 bp, homo sapien
tggaaggagtgtttgctgtgggacaratcacaagactgggggcggataac

SEQ ID NO: 81270 - DNA, 50 bp, homo sapien
tccagatggagattttgtggatcatrggcccccagcaaggggaggctgtc

SEQ ID NO: 81271 - DNA, 50 bp, homo sapien
ccacttttgtctggtgcctgtaagamgatgatctaggtctcactgcaaag

SEQ ID NO: 81272 - DNA, 50 bp, homo sapien
acaggcaccagacaaaagtggcaagractctagtgggtgagttggcaggc

SEQ ID NO: 81273 - DNA, 50 bp, homo sapien
tgttttacacattgagcaatattagraaaattagaggtcagttcctgggg

SEQ ID NO: 81274 - DNA, 50 bp, homo sapien
attacccggtctgtgatattatttayagtagtacaaaatgaagtaagaca

SEQ ID NO: 81275 - DNA, 50 bp, homo sapien
cttgctgatcaccagctgtgtcctaygatgtgcttcacacaacatttcca

SEQ ID NO: 81276 - DNA, 50 bp, homo sapien
aagaatgtaaattttgaggataaaastgatctgaaattgaatttctgctc

SEQ ID NO: 81277 - DNA, 50 bp, homo sapien
agctgatattggccctatattaatcrcaatctctgcataatgttttgttt

SEQ ID NO: 81278 - DNA, 50 bp, homo sapien
gcggggaaaagagaaccatttgggaytcagacaaccttgattctcattca

SEQ ID NO: 81279 - DNA, 50 bp, homo sapien
acttaacatcatagcctagagcacaraatatggaggaaaatggcccaaag

SEQ ID NO: 81280 - DNA, 50 bp, homo sapien
ggagtccttcaatccatgaatctaayacatttctacattgatttgagtct

SEQ ID NO: 81281 - DNA, 50 bp, homo sapien
gctagtaattatttggtattatctgmaaactattattcaataaataaaag

SEQ ID NO: 81282 - DNA, 50 bp, homo sapien
ctctggtgcttttctatgtgagggaytaaaaaaacctgagtaacagagtg

SEQ ID NO: 81283 - DNA, 50 bp, homo sapien
ctgtgcacaggagcacaattttaackggatcaaactgtggagcaatttat

SEQ ID NO: 81284 - DNA, 50 bp, homo sapien
agtgaacaaagtacttaatcttcctsaatcaaatctgtaaaataaaaaat

SEQ ID NO: 81285 - DNA, 50 bp, homo sapien
catttttgcagcactggatacaccaygtggaaggtacgggagatgtccgg

SEQ ID NO: 81286 - DNA, 50 bp, homo sapien
tcctgactgctagggtcaatatacawctcctgataacctttagatccagg

SEQ ID NO: 81287 - DNA, 50 bp, homo sapien
gatctccagaaccactttctatcccmatgttatgcatgactttcctttac

SEQ ID NO: 81288 - DNA, 50 bp, homo sapien
tttatgggatttctcctcattggcasaatatgcagggctcagggttgtag

SEQ ID NO: 81289 - DNA, 50 bp, homo sapien
attttactgcactgatttgtttacasgattctgttcctcttgctggactg

SEQ ID NO: 81290 - DNA, 50 bp, homo sapien
ctcattatgtcgaatgacccatctcwacatgtttgtttctcatctccagg

SEQ ID NO: 81291 - DNA, 50 bp, homo sapien
cacaagccgattgttataaaaataaygctacggttcagggtgttttgctc

SEQ ID NO: 81292 - DNA, 50 bp, homo sapien
cctagttccttccctggagtagtcargattttcagctgcatgaatccagt

SEQ ID NO: 81293 - DNA, 50 bp, homo sapien
cctcctcggatttgctcttggattcrccaagcactcatcctatttttcac

SEQ ID NO: 81294 - DNA, 50 bp, homo sapien
agattcagtagttggggatgcacacragaatttgcatcttcaacaagctc

SEQ ID NO: 81295 - DNA, 50 bp, homo sapien
cagaggtgaatttatttgctggacaytcatagcctagtagaatctactgg

SEQ ID NO: 81296 - DNA, 50 bp, homo sapien
atagcattcatatcaatgttgcatamatacaggaaaatatacaacccaat

SEQ ID NO: 81297 - DNA, 50 bp, homo sapien
aaagttggcacctggattttaaaaaygaagtcgtcaaagaattaatctag

SEQ ID NO: 81298 - DNA, 50 bp, homo sapien
gacatttttgttcacttcctttcatyacaagtccctatttttccacatac

SEQ ID NO: 81299 - DNA, 50 bp, homo sapien
acctaatcttcgttgatgtttcacamgactgctcttacaaaacctggttg

SEQ ID NO: 81300 - DNA, 50 bp, homo sapien
gggcaatggtcaaaactgattgcacrgtaatctcaaaatgagaatgacca

SEQ ID NO: 81301 - DNA, 50 bp, homo sapien
gttcctgcccgtgtgattgtccaggygaacttgtgggaactgaggaagtt

SEQ ID NO: 81302 - DNA, 50 bp, homo sapien
ccttgcttttctcttgctgcacctamaggcagaggtatcctcgtagtgac

SEQ ID NO: 81303 - DNA, 50 bp, homo sapien
ccttaatatcagaggatttctagtayagtagcaagcataaattaagttag

SEQ ID NO: 81304 - DNA, 50 bp, homo sapien
attgacttcccagtaactgtgggaaygttatcaaagctctgagcctcaat

SEQ ID NO: 81305 - DNA, 50 bp, homo sapien
gaagaaagatctggggaaagcatcasagatttggtcgtgaactcctctac

SEQ ID NO: 81306 - DNA, 50 bp, homo sapien
ctgcactccgagtgcatcagcaccgsatgttttatctgaactatatttac

SEQ ID NO: 81307 - DNA, 50 bp, homo sapien
acagaagaagatatggcctaaaaagsatcaacacagttgaaatggtttag

SEQ ID NO: 81308 - DNA, 50 bp, homo sapien
gaaaggcatcttcttcagctgggacrgttgtcactattcacatttggtag

SEQ ID NO: 81309 - DNA, 50 bp, homo sapien
gtcactgaaactcatttgtcctgaaytaagtggttgtgaataggacggaa

SEQ ID NO: 81310 - DNA, 50 bp, homo sapien
cacgtggtgaaactccttggactcayggtgactattccgctcatcattgc

SEQ ID NO: 81311 - DNA, 50 bp, homo sapien
taagaatgattaaagtgaataataaragaatcatagagctatatattaaa

SEQ ID NO: 81312 - DNA, 50 bp, homo sapien
gctacatcgtctaaagtgccttccayaatacctggcatacagtaagaact

SEQ ID NO: 81313 - DNA, 50 bp, homo sapien
agctgatcctttactgactcagcaaytatttttttgacaacctattatgt

SEQ ID NO: 81314 - DNA, 50 bp, homo sapien
ttatgagtaagcaaaggcatacagartaaaataatagactttagagactc

SEQ ID NO: 81315 - DNA, 50 bp, homo sapien
ttagatcacagggattttccaaactsagtttccctctccaatttgtaaat

SEQ ID NO: 81316 - DNA, 50 bp, homo sapien
tgagaagtgtctcaccgcaatgagaygggtcatggagaagcccaatcctc

SEQ ID NO: 81317 - DNA, 50 bp, homo sapien
tgtttctcttgtgtgaaccatcctcratcacttcagttagtgctgatgtc

SEQ ID NO: 81318 - DNA, 50 bp, homo sapien
aaattatgtgttgatgatattccaargaaagatgagaacttgtgccataa

SEQ ID NO: 81319 - DNA, 50 bp, homo sapien
acaataaagctgttgaattttaacargagtattagtacataaattttcta

SEQ ID NO: 81320 - DNA, 50 bp, homo sapien
attgtgtaccctaaaggagatatgcratcacatcgattttaatattaatt

SEQ ID NO: 81321 - DNA, 50 bp, homo sapien
agatagctgtctggggagctacatasagacacagcactagcttggtaccc

SEQ ID NO: 81322 - DNA, 50 bp, homo sapien
ttcagttctcatttctaccattccartatagctttgtctttttctcccac

SEQ ID NO: 81323 - DNA, 50 bp, homo sapien
gtcacttattttggaaagtggaatcrgaaaagagtaatataagaaaggaa

SEQ ID NO: 81324 - DNA, 50 bp, homo sapien
gtctgatgtacaacagtggtagacaygaaaatgggaaggttttttaaagg

SEQ ID NO: 81325 - DNA, 50 bp, homo sapien
caaaataataaatcactgttgttagracgcaaagtttggtagtggtttgt

SEQ ID NO: 81326 - DNA, 50 bp, homo sapien
ttatagaaatgtactgtataagtgamagtcagcatttccattacacaaca

SEQ ID NO: 81327 - DNA, 50 bp, homo sapien
gtgagacggagtcccatttctacacragtaattaagcgcagttacaacaa

SEQ ID NO: 81328 - DNA, 50 bp, homo sapien
aatgttcattgaattgcagtcaaccraaattcttctgtgcaccccagttt

SEQ ID NO: 81329 - DNA, 50 bp, homo sapien
aaaaaaaagaacaatcgatgaaaaawtaaggtttattggaagaattatgg

SEQ ID NO: 81330 - DNA, 50 bp, homo sapien
tatttcctcagcagagagagactgcmagataagagagtgctctgaagtgg

SEQ ID NO: 81331 - DNA, 50 bp, homo sapien
aatggtatttaagttgtatagacggkattagtactaattagtaatattgt

SEQ ID NO: 81332 - DNA, 50 bp, homo sapien
tgtgcaatatattgcatgttgattayacctcagtgaacctataaaaagtt

SEQ ID NO: 81333 - DNA, 50 bp, homo sapien
cagatgtttccaagaacatatgataygataatcctaccaattttcaagaa

SEQ ID NO: 81334 - DNA, 50 bp, homo sapien
ttgattgcatattgatcaataggttmaatgtgattacaatgaaaatcatt

SEQ ID NO: 81335 - DNA, 50 bp, homo sapien
cctgcctcacaccccagagactaagmatgacagtgaaggtagaacaaggg

SEQ ID NO: 81336 - DNA, 50 bp, homo sapien
atatattgcttttttaacattttcaygcttccaaggagatccctcaaacc

SEQ ID NO: 81337 - DNA, 50 bp, homo sapien
tttggtgaaactcactaggtgacatyatactaagaaataaaaccaaagct

SEQ ID NO: 81338 - DNA, 50 bp, homo sapien
ttgatgtggcctctcacccaagtcaygtttgaggaaacaaggtcctaggt

SEQ ID NO: 81339 - DNA, 50 bp, homo sapien
acaaaacatttgtatactgaagccaygattttcacaacaaatgtatggag

SEQ ID NO: 81340 - DNA, 50 bp, homo sapien
caggcctaaaactgcttattaaacaygagatcctgaccttctctaacaca

SEQ ID NO: 81341 - DNA, 50 bp, homo sapien
gccatgaaataaatttctcccacgamctctatgtatatgtttaccatttg

SEQ ID NO: 81342 - DNA, 50 bp, homo sapien
ttaccatttgtgcaaatataccaccraatagtgattgcagacaattttta

SEQ ID NO: 81343 - DNA, 50 bp, homo sapien
agaaatagcctgagatagttgtaaakagcaaaagaaatgtctgtgtctca

SEQ ID NO: 81344 - DNA, 50 bp, homo sapien
agaagcagaggcactggccaaatgaytataattgacccagacagcaatca

SEQ ID NO: 81345 - DNA, 50 bp, homo sapien
ggtcaaatttttatattcactcttasattttaactcattctgctcattat

SEQ ID NO: 81346 - DNA, 50 bp, homo sapien
aatcttctgactgccccatagcaaamaaaattgtaacctataaaagcatc

SEQ ID NO: 81347 - DNA, 50 bp, homo sapien
aataattgaggcagatactttgtaaygtctcagatgtgaaaactggttat

SEQ ID NO: 81348 - DNA, 50 bp, homo sapien
agcaaccaaggaaagcatgaaaagargtaaggagatgacgtttacatgtg

SEQ ID NO: 81349 - DNA, 50 bp, homo sapien
acctggaacaagaaatagtttcaaartggaaatatagaaatcgcagtaaa

SEQ ID NO: 81350 - DNA, 50 bp, homo sapien
attctatggaatatactatgaaacaycagatttacctaaaacacaaatgc

SEQ ID NO: 81351 - DNA, 50 bp, homo sapien
ctcgtgactgctatggctgactgccmaaatgaccagtagcagaaaatgat

SEQ ID NO: 81352 - DNA, 50 bp, homo sapien
ccaacgctggactctgtaagtgcttraaatataactgcaacttctcctgg

SEQ ID NO: 81353 - DNA, 50 bp, homo sapien
ctttcaatcagcaatgctctgctaartaataaatatcggaaacagctaaa

SEQ ID NO: 81354 - DNA, 50 bp, homo sapien
ccaaataaagccagctgcctatttcrcacatacagaagacatacaacttc

SEQ ID NO: 81355 - DNA, 50 bp, homo sapien
actggcttggttgagattttctaagkaatccactgtgcttggaggctctt

SEQ ID NO: 81356 - DNA, 50 bp, homo sapien
tccatattgacttgaaagtagctaaytacagccaggcagagggactatct

SEQ ID NO: 81357 - DNA, 50 bp, homo sapien
gagaaattttctggatagttgaacargctcactaagaaaagacaactttc

SEQ ID NO: 81358 - DNA, 50 bp, homo sapien
ggacgaaactcctcagatctttgtasatttttgaatgaggcatacaagat

SEQ ID NO: 81359 - DNA, 50 bp, homo sapien
gttcagattcaattaagttgttcaawtgcctgattaagtggcgaacatgt

SEQ ID NO: 81360 - DNA, 50 bp, homo sapien
ctgctgttgagtaattgtcagctacyggtaacaagtgggaagtggagaag

SEQ ID NO: 81361 - DNA, 50 bp, homo sapien
catgattcctcaaagtagtgtacctkaaacctaggaagtaaacatcaaga

SEQ ID NO: 81362 - DNA, 50 bp, homo sapien
gctgcacgtttgaccagataatttaygctaacaatatgattcatggtgga

SEQ ID NO: 81363 - DNA, 50 bp, homo sapien
ggagaaggaagacaaatgcctcctayggactgattccctcgtggcaggaa

SEQ ID NO: 81364 - DNA, 50 bp, homo sapien
ggcacagatgctagtgcctctctaaytcatgtcactcctgctcgggctcc

SEQ ID NO: 81365 - DNA, 50 bp, homo sapien
tgatgtatacacgtatacaaaaaatraatatcaaaacttcacattgttca

SEQ ID NO: 81366 - DNA, 50 bp, homo sapien
agaggtttaacatatgcaaataagtraacacattagcaaaatcacagaca

SEQ ID NO: 81367 - DNA, 50 bp, homo sapien
tgtgttttatatttgctttaggtatmaactgtattctaatagccgcaagg

SEQ ID NO: 81368 - DNA, 50 bp, homo sapien
tgtaaccaaaagttcaagttcaacayacctattagcaatttttgaaagta

SEQ ID NO: 81369 - DNA, 50 bp, homo sapien
actttgggtcctggattaagtcacaytttccattgtcttttctgcattgt

SEQ ID NO: 81370 - DNA, 50 bp, homo sapien
atgagagaatttagcgatcatgtatraaaacattacactcacccaaacgt

SEQ ID NO: 81371 - DNA, 50 bp, homo sapien
gattatattatctgtaatccttgcayagagatatacatggtctgaacatc

SEQ ID NO: 81372 - DNA, 50 bp, homo sapien
aatataatcatcatcactatcatcastataatcattacctacataaaaga

SEQ ID NO: 81373 - DNA, 50 bp, homo sapien
gaagtgaaacacgggggtcttccaamgtatccagctgagctcctggctcc

SEQ ID NO: 81374 - DNA, 50 bp, homo sapien
ctaaattaatctaggtatttaccacratcaaacttaaaatgctaaggggc

SEQ ID NO: 81375 - DNA, 50 bp, homo sapien
accagactagagtgcatgactgtgasaaggaaaattaatagttttggctg

SEQ ID NO: 81376 - DNA, 50 bp, homo sapien
ctaagaatgaccctaaatgtagatakgaaagtacaatatgaagaaaactt

SEQ ID NO: 81377 - DNA, 50 bp, homo sapien
aacatagcacaagtcaagaccatctsaaaaggaatagtaagtaccttgcc

SEQ ID NO: 81378 - DNA, 50 bp, homo sapien
ttgagtgaccttagataagtctttcratttcctcgagcatcagtttcttt

SEQ ID NO: 81379 - DNA, 50 bp, homo sapien
cgataagtaaccatagctcaatacamaagtgaaaatagatggataatttg

SEQ ID NO: 81380 - DNA, 50 bp, homo sapien
gtaagtgcaatattagcaataggcaycaagtgtttagggcacataaagga

SEQ ID NO: 81381 - DNA, 50 bp, homo sapien
agccagtcaaacctacataatctgcytactatcagcactccctatttaca

SEQ ID NO: 81382 - DNA, 50 bp, homo sapien
atctagtaggtcttgatatcattgasagtgatcatgcaactcgtccacat

SEQ ID NO: 81383 - DNA, 50 bp, homo sapien
taacaaagatcccattcatgatttcmacaatacttatacaactctagaaa

SEQ ID NO: 81384 - DNA, 50 bp, homo sapien
gtaagatacaggaagggaaggtagawcctgtgctgtagatcagagtgaaa

SEQ ID NO: 81385 - DNA, 50 bp, homo sapien
gttcagagttactcagggctaaccartatgtggatcaatactagtaacta

SEQ ID NO: 81386 - DNA, 50 bp, homo sapien
tatggattctgttaaaatgtcttccrtttgcattttaaatagatttcttt

SEQ ID NO: 81387 - DNA, 50 bp, homo sapien
ccacagatgcattttctggcataaargaattttccacactggtcttccca

SEQ ID NO: 81388 - DNA, 50 bp, homo sapien
gaaaggcatctagacctgcacattayacatttctaccaattttaatcatt

SEQ ID NO: 81389 - DNA, 50 bp, homo sapien
taggactgccatagcaacttaacacraacttaatgaaataaagcaatgga

SEQ ID NO: 81390 - DNA, 50 bp, homo sapien
tggaaatgggtgtctcaacatcattsgctatgctgagctgcttccaagaa

SEQ ID NO: 81391 - DNA, 50 bp, homo sapien
cctgtgttcatatattctaaatccarctagtcttctataaaaagttgaat

SEQ ID NO: 81392 - DNA, 50 bp, homo sapien
ccaaaatctttaaagactttcaatarcttacaacctgtgttcatatattc

SEQ ID NO: 81393 - DNA, 50 bp, homo sapien
caccctggaactcacagcaaattgtraatattggaaatggtccctgaatg

SEQ ID NO: 81394 - DNA, 50 bp, homo sapien
acgatgctcttgtttattttccacaygaatatcactactggagcagagcc

SEQ ID NO: 81395 - DNA, 50 bp, homo sapien
atactgtttaaacaagccaagtatcrcattccttttgtctgaatagctgt

SEQ ID NO: 81396 - DNA, 50 bp, homo sapien
ctggcacagggaacttaggagtccamatcctgttaaaaatgaagaattag

SEQ ID NO: 81397 - DNA, 50 bp, homo sapien
aggctgtgtggactgaatgcttagaygaatcattatttatttttagacct

SEQ ID NO: 81398 - DNA, 50 bp, homo sapien
gtagctatgtgtgagtttataaatasgtacaatagaggatagagggtgag

SEQ ID NO: 81399 - DNA, 50 bp, homo sapien
agatctgaaactctacccattaaacracttcccatcttcccatccccaca

SEQ ID NO: 81400 - DNA, 50 bp, homo sapien
ttgttgattgagaataaagcataaasgaaactaaaaccatcgtgcattta

SEQ ID NO: 81401 - DNA, 50 bp, homo sapien
acctttggctagccatgtgtggaaaragagagtaactcatacaaatactt

SEQ ID NO: 81402 - DNA, 50 bp, homo sapien
ctcatggcagtgaaagatgacggcartgaccaagctgatctgagactatg

SEQ ID NO: 81403 - DNA, 50 bp, homo sapien
tgttttgtcctaaggagaccaactamcttctgtcctgttcttgccaaccc

SEQ ID NO: 81404 - DNA, 50 bp, homo sapien
tcttctttattttacagatagtctcragtgaacaaatacactcctaattt

SEQ ID NO: 81405 - DNA, 50 bp, homo sapien
gacacaggatcacatcgtgttagacycatttatttatgtgtcatttaact

SEQ ID NO: 81406 - DNA, 50 bp, homo sapien
cacagattttctctctctccattgtytttactgggctgtgtccccactat

SEQ ID NO: 81407 - DNA, 50 bp, homo sapien
agttgtgaccttgaaatcccgcagartatctaccatcccttccagcttct

SEQ ID NO: 81408 - DNA, 50 bp, homo sapien
cacagttactaccttttgatacagcrgagaaaaaattccttctctcctat

SEQ ID NO: 81409 - DNA, 50 bp, homo sapien
aaatcagattttgtcatgagaaaccytgatagaaggaagaaagcaccaca

SEQ ID NO: 81410 - DNA, 50 bp, homo sapien
gtagaaggagagcagagtggcttatkaagtagttgcattagtcagggttc

SEQ ID NO: 81411 - DNA, 50 bp, homo sapien
catgtccagttaagggatatagaatsaaaaacacctggattcacatacta

SEQ ID NO: 81412 - DNA, 50 bp, homo sapien
agtggaggaggggagggcactaaccrtcttgacttgagttctatgtcttt

SEQ ID NO: 81413 - DNA, 50 bp, homo sapien
ttcagcaaatttcaagtgtacactgyagcattgttgactgtagccaccat

SEQ ID NO: 81414 - DNA, 50 bp, homo sapien
gccaagagcagccacctgagacgccrgagttgcccatgtagccatgcctg

SEQ ID NO: 81415 - DNA, 50 bp, homo sapien
agtacagaatcttgcccatctagtargcaataatgtgtaaactttagatc

SEQ ID NO: 81416 - DNA, 50 bp, homo sapien
aaaatcatcactaagacaagaagaayaaacacctgaggaacaagagtcct

SEQ ID NO: 81417 - DNA, 50 bp, homo sapien
gtgtttattcttcttgtcttagtgaygatttttcttgtgattgtcccatc

SEQ ID NO: 81418 - DNA, 50 bp, homo sapien
tttttgccaaaggaaatctcaagackggtacagagttaaaaatgaagtac

SEQ ID NO: 81419 - DNA, 50 bp, homo sapien
ttatttttgtggatctttaaatatcmgagtataaggtttaaaataatcct

SEQ ID NO: 81420 - DNA, 50 bp, homo sapien
agggagatgtctaggcaatatcaacrctggattttgttttcccgggacag

SEQ ID NO: 81421 - DNA, 50 bp, homo sapien
gcatttcctgaaacctgtctttagakgatcacattcaaggtgttcactta

SEQ ID NO: 81422 - DNA, 50 bp, homo sapien
gactcctgaataatttatcattttgyaagtataagtgatcactaataata

SEQ ID NO: 81423 - DNA, 50 bp, homo sapien
actcctgagactaacaccacacaggwcagagtaaagtagaagatgaccta

SEQ ID NO: 81424 - DNA, 50 bp, homo sapien
tagtgctgtgatattcatgttcttgwctggtttagttacctgctcttact

SEQ ID NO: 81425 - DNA, 50 bp, homo sapien
gcattcccttactctcttctcacctrcaagaatttataacctcttctgag

SEQ ID NO: 81426 - DNA, 50 bp, homo sapien
ctgctccttgagctatcctaacacartaagagaggaaaagcagcagtgtc

SEQ ID NO: 81427 - DNA, 50 bp, homo sapien
atgctgctgatgctgatgtatttacwatattgagccacttttcaggccac

SEQ ID NO: 81428 - DNA, 50 bp, homo sapien
tggttatctttacagagttaaataaygtgcttttaatattgttttagatg

SEQ ID NO: 81429 - DNA, 50 bp, homo sapien
caggcactgccaagagccagatccaytcctttaatccattgaccctggag

SEQ ID NO: 81430 - DNA, 50 bp, homo sapien
atttctggaggctgggaactctacartcgaagtgctggcaggttatgtgt

SEQ ID NO: 81431 - DNA, 50 bp, homo sapien
gggtctggaataaaaacgtgtggaasgaatcaatcaacaaaaatccccta

SEQ ID NO: 81432 - DNA, 50 bp, homo sapien
actcatttgtacaagatttaaactayaccatgatgcttattttctttttt

SEQ ID NO: 81433 - DNA, 50 bp, homo sapien
tcaggaaagaggcatgaggttaaagmaaaactgtggcaagggtagcagag

SEQ ID NO: 81434 - DNA, 50 bp, homo sapien
ataatgctgagcaaaataagcaagaygtaaaacagtatgtccaatttcat

SEQ ID NO: 81435 - DNA, 50 bp, homo sapien
gctaaaggattttcaaacttatatcwctgtattcatttcgataatccagt

SEQ ID NO: 81436 - DNA, 50 bp, homo sapien
caggtgctctcacttgactctatatygaatgcacagacttggggaatact

SEQ ID NO: 81437 - DNA, 50 bp, homo sapien
ctagtgagtaccctattgggcagtayaaatatagataaagaagagctata

SEQ ID NO: 81438 - DNA, 50 bp, homo sapien
ccttgatttgcttgcttaatatgaaktacttaaaatttaattttcttctc

SEQ ID NO: 81439 - DNA, 50 bp, homo sapien
aacatcacagtacttaaggtctacamatctctagcaacagtcagactgga

SEQ ID NO: 81440 - DNA, 50 bp, homo sapien
agaaagggtgagagagaatcactaarccagctgaaaatccttgatttgct

SEQ ID NO: 81441 - DNA, 50 bp, homo sapien
catttgtactgttagccaattcccayagtgtaaatattccattagggcca

SEQ ID NO: 81442 - DNA, 50 bp, homo sapien
aatatgaacttagttttctgatctayggtttcaagttaaacagggacatc

SEQ ID NO: 81443 - DNA, 50 bp, homo sapien
gatatctagactcaaccctaaacaasaggatggattgcaagaatagaggt

SEQ ID NO: 81444 - DNA, 50 bp, homo sapien
gagcttcaggtacattgtctcagaamcagtcttcagtaatcatccctcta

SEQ ID NO: 81445 - DNA, 50 bp, homo sapien
ccaatgggatagagtgctttgaaaawattaacctatgctggcatctatta

SEQ ID NO: 81446 - DNA, 50 bp, homo sapien
tcagtctaatttaatcgaatgtcaaygtgagataaagaatgctgtatccg

SEQ ID NO: 81447 - DNA, 50 bp, homo sapien
ttggcagaagaaagaactgagatttwaaaaattagataaattaaaaagta

SEQ ID NO: 81448 - DNA, 50 bp, homo sapien
tccgatatctgaataagtttctgaaygacatagggaaaggaggggtctga

SEQ ID NO: 81449 - DNA, 50 bp, homo sapien
cctaaaattttcataaacattgttcragtctttatcaaaatgaatatggc

SEQ ID NO: 81450 - DNA, 50 bp, homo sapien
gtcatgcaactctaaataggtctgtrtgtaaccacctgtattttaagcaa

SEQ ID NO: 81451 - DNA, 50 bp, homo sapien
aaaatgaaagtaaaatattctcctayaactttcattcaaaaatattgctt

SEQ ID NO: 81452 - DNA, 50 bp, homo sapien
cctgtaccacctactgtctaatatcygacaacatctgctttatgtttccc

SEQ ID NO: 81453 - DNA, 50 bp, homo sapien
atgtgacacataaatggctcaaataygcattctggggctctctggaggaa

SEQ ID NO: 81454 - DNA, 50 bp, homo sapien
agtgtgttcctttttgagaatttgaraactaagaggtcaatgtactaccc

SEQ ID NO: 81455 - DNA, 50 bp, homo sapien
gctcctgcttaattgataagaataaygtacagaagaaatcagtgggggaa

SEQ ID NO: 81456 - DNA, 50 bp, homo sapien
aaaaaaagctactcagtacctttaasacctagtgctctgttaactgtggt

SEQ ID NO: 81457 - DNA, 50 bp, homo sapien
ttttcagataacaaaagtgcaaataytatctatgttttaagatttttaat

SEQ ID NO: 81458 - DNA, 50 bp, homo sapien
ttcctataggtttgtcttttccagartattatacagtttgaattgtatac

SEQ ID NO: 81459 - DNA, 50 bp, homo sapien
tttaaaagtctcacaccatcgagagyactaacgagaatgtgaaacgagag

SEQ ID NO: 81460 - DNA, 50 bp, homo sapien
tttttcctctacctaatctatgtgcygatacttaatgttcttcctctttg

SEQ ID NO: 81461 - DNA, 50 bp, homo sapien
gacatagattccaggtattaggttayaggcatccttgggagaccattttt

SEQ ID NO: 81462 - DNA, 50 bp, homo sapien
agcagccttctaaaagctgtaaaagkcaagaaaatgaattctccccagag

SEQ ID NO: 81463 - DNA, 50 bp, homo sapien
ctgctcactgacctcagctcatgtayactttcatcagtctctgaagccag

SEQ ID NO: 81464 - DNA, 50 bp, homo sapien
acatggcttttgaggatagatcttayaggtaggtcatttttctaaggccc

SEQ ID NO: 81465 - DNA, 50 bp, homo sapien
tcctggagtcagacctagattgaccygttagctctcccacttactagttg

SEQ ID NO: 81466 - DNA, 50 bp, homo sapien
tctcctatattattcctgtttcttcractggttccaaatgcctaaagcaa

SEQ ID NO: 81467 - DNA, 50 bp, homo sapien
tcatgtgatgaattgggcctccttgracgataaccctggcctgaaaaaaa

SEQ ID NO: 81468 - DNA, 50 bp, homo sapien
ccaaaattcataaattcttcagtacyaatattcaatgtttgaaacaaaca

SEQ ID NO: 81469 - DNA, 50 bp, homo sapien
gagactgggtatttttcccctgcaaycatcactaagacagggaaaccccc

SEQ ID NO: 81470 - DNA, 50 bp, homo sapien
cccaccaacccttgatattttgagtsaaaaagtaacttcggttatgtcgt

SEQ ID NO: 81471 - DNA, 50 bp, homo sapien
ccatgacccttgcaataggtgaagaygagctattactttttctcccctac

SEQ ID NO: 81472 - DNA, 50 bp, homo sapien
aggtagcattcaccactgatgtaatmaaaagtcatggactgcagatgctc

SEQ ID NO: 81473 - DNA, 50 bp, homo sapien
tgaaatactcatcacaccgaagaagsctggagtaaaatgaatgagtcgca

SEQ ID NO: 81474 - DNA, 50 bp, homo sapien
agggcagactgcctagctctggacayggtatcccactgggcacagcttcc

SEQ ID NO: 81475 - DNA, 50 bp, homo sapien
atatgcaagggctacacaggccaacractttaaacctagatatgctctag

SEQ ID NO: 81476 - DNA, 50 bp, homo sapien
cttccgtatggtttacttaggcatasaatggggaaaaggagattctagag

SEQ ID NO: 81477 - DNA, 50 bp, homo sapien
tctgttctaacactctaacatgatakattttgaccaacctatcttctaga

SEQ ID NO: 81478 - DNA, 50 bp, homo sapien
tttatttcatttagtgacagtgagayaatttattgctgcaaagaacttat

SEQ ID NO: 81479 - DNA, 50 bp, homo sapien
ttaagatagcaacaccaatagtttcratctttcctggacatatattcaac

SEQ ID NO: 81480 - DNA, 50 bp, homo sapien
atggggataataacaataccctttcrgaggagactgtaaaacttaaatta

SEQ ID NO: 81481 - DNA, 50 bp, homo sapien
catttaagaaggtaaggtaagtcacrcctaagggactcttatcctatttg

SEQ ID NO: 81482 - DNA, 50 bp, homo sapien
gtatagcagaagacaatatttagaayagagcataatggaaataatgaatg

SEQ ID NO: 81483 - DNA, 50 bp, homo sapien
tcattattctcccctagaaacatcamacagagtcagacaactttatgaaa

SEQ ID NO: 81484 - DNA, 50 bp, homo sapien
tagaaatggcattgttccttgagtamaaacgaattaaatttgtatttaga

SEQ ID NO: 81485 - DNA, 50 bp, homo sapien
agacctgacatgctacattaagtgcmatcacagaggcaaatgaagtacta

SEQ ID NO: 81486 - DNA, 50 bp, homo sapien
attaatagggtgtgtagttttcccartgcaaagtcgaattgttgttctaa

SEQ ID NO: 81487 - DNA, 50 bp, homo sapien
cacagtgaaaggatatagattaaatkagagaaggtaataggtgcataaaa

SEQ ID NO: 81488 - DNA, 50 bp, homo sapien
gatgatttttaaaaggttatagcaaygaaggctctataatactgcagtgt

SEQ ID NO: 81489 - DNA, 50 bp, homo sapien
aaggtgtctgaacagtgcttgcaaakgtaactggcattctgccggctgct

SEQ ID NO: 81490 - DNA, 50 bp, homo sapien
ataacatccaatttaccattttaaastgtccgattcagtggcatttggta

SEQ ID NO: 81491 - DNA, 50 bp, homo sapien
acagaagtctgaactagaactgagarccaaaaacgctgaggtcgggaaaa

SEQ ID NO: 81492 - DNA, 50 bp, homo sapien
cgtggcagaagagtgcaagcttgaasaaagagcccttgacacaaactacc

SEQ ID NO: 81493 - DNA, 50 bp, homo sapien
ctttttcatatattacagagttcacrgtattcatatttagtttagaattt

SEQ ID NO: 81494 - DNA, 50 bp, homo sapien
tgatgtccttctacaggctacctgamggaacagtgaggaaaagttgtttc

SEQ ID NO: 81495 - DNA, 50 bp, homo sapien
tcacagccttcagtgataaccttggycatataggagagtatactcaagag

SEQ ID NO: 81496 - DNA, 50 bp, homo sapien
tcaattgcagttgaaatgcattagtyaagtattttaaagtgctttagcaa

SEQ ID NO: 81497 - DNA, 50 bp, homo sapien
ctctcaccttcctgcactagctagayctctcaggattaagaaaaagcaat

SEQ ID NO: 81498 - DNA, 50 bp, homo sapien
gatttccatgaaatagaaccaaatayagtaggaaagttatgcagcaaaaa

SEQ ID NO: 81499 - DNA, 50 bp, homo sapien
ccaatgcacgtactattgcttaatayattctcaagggtggcagttagtct

SEQ ID NO: 81500 - DNA, 50 bp, homo sapien
tcactttaactgagaataagtgataytaaatgagaagcttaaggtcatac

SEQ ID NO: 81501 - DNA, 50 bp, homo sapien
ttgtgtgttgttttaattttagccarccaaatctattttttctagtatgg

SEQ ID NO: 81502 - DNA, 50 bp, homo sapien
ccatcctatcacagctccttctccastcaactgcattcacaacccaccct

SEQ ID NO: 81503 - DNA, 50 bp, homo sapien
ttactcatgtgatatttctctgagaygctttgatctgtgaattcattttg

SEQ ID NO: 81504 - DNA, 50 bp, homo sapien
gttttcaaagcaatttagtggaagaratgaagcttgagaacaacatattt

SEQ ID NO: 81505 - DNA, 50 bp, homo sapien
gaggtcagaacagagccaggttgtargcctaaactaaggtgacatggtta

SEQ ID NO: 81506 - DNA, 50 bp, homo sapien
ctgcttagaactctgagaaggtctgraatcagagaactgttaactaagct

SEQ ID NO: 81507 - DNA, 50 bp, homo sapien
agatctctctatcttctctaacagakcattagtatatcaaaaaagaaaat

SEQ ID NO: 81508 - DNA, 50 bp, homo sapien
tcccgtttattttttttcatttctaycacatccaagacaaattgtttcag

SEQ ID NO: 81509 - DNA, 50 bp, homo sapien
gtaaatagtgactttggtcaatttarcctcccctagtgtccatttttctc

SEQ ID NO: 81510 - DNA, 50 bp, homo sapien
atcccagcctcaccctcaaggactcrctctctactaagcagggcatgccg

SEQ ID NO: 81511 - DNA, 50 bp, homo sapien
agtagctaccatattccgtaacgcargtagagtacactcagagtgagaaa

SEQ ID NO: 81512 - DNA, 50 bp, homo sapien
gactcctagaactgccaaagctttargagagcccaaatgccacaattcac

SEQ ID NO: 81513 - DNA, 50 bp, homo sapien
agtgttaggaatagcctgtgatgaartagtactcactaactgaattgtat

SEQ ID NO: 81514 - DNA, 50 bp, homo sapien
tcaaataaatttaacaaagacattawaataatcaaaaagaatcaagcaga

SEQ ID NO: 81515 - DNA, 50 bp, homo sapien
agacagcaatttctattaaagtggcmatgcaccatgcacaacagcagagg

SEQ ID NO: 81516 - DNA, 50 bp, homo sapien
aaaatacagctggattgggttatgartatttacgtttttgtaaattaatc

SEQ ID NO: 81517 - DNA, 50 bp, homo sapien
ccataggtaactaacagcaggaatayctattttttgaggacagattacag

SEQ ID NO: 81518 - DNA, 50 bp, homo sapien
acattaagagataaagtaaagatccratttcagtgtttgtcctgtagtta

SEQ ID NO: 81519 - DNA, 50 bp, homo sapien
agaaattgatgatgccctgactctgmagctactatgggaaaagtatttga

SEQ ID NO: 81520 - DNA, 50 bp, homo sapien
acaagcttgcataggtatctatttcmactaagcaatggtgatttcataca

SEQ ID NO: 81521 - DNA, 50 bp, homo sapien
aaagagaaccagcaaattaagaatgmaatccaacactgttggtgggattg

SEQ ID NO: 81522 - DNA, 50 bp, homo sapien
aggagcacatcaattgcagagacaaycaccaatagtgagggtacagccca

SEQ ID NO: 81523 - DNA, 50 bp, homo sapien
gaattatatcatacagagaattggartcagaagaagaacgcataactata

SEQ ID NO: 81524 - DNA, 50 bp, homo sapien
aggcgagccaagcatggcaaagaacsagctgggcacgaagatgccagacc

SEQ ID NO: 81525 - DNA, 50 bp, homo sapien
attaaagatataacaatgcatattcwctctaggagtttttagagtactat

SEQ ID NO: 81526 - DNA, 50 bp, homo sapien
ggcgatttagtttgcaacctattgamgagaagaaatagaggtggcagttg

SEQ ID NO: 81527 - DNA, 50 bp, homo sapien
agaggagaggatttatatggtttaayaaatctgtagaggaaaaaaactaa

SEQ ID NO: 81528 - DNA, 50 bp, homo sapien
gagtgaatgggagatctcgcttgacygatgaagccagtttcataactggt

SEQ ID NO: 81529 - DNA, 50 bp, homo sapien
cccctgaagaatcatgtcctctgacrgaaagaacacatcggggcatccag

SEQ ID NO: 81530 - DNA, 50 bp, homo sapien
tttctcatatatagcttggtcaaaaytttcaactaatgagtgtcctttag

SEQ ID NO: 81531 - DNA, 50 bp, homo sapien
gagttgtatctgaaatctacttatayggccagttatttttaatatggtga

SEQ ID NO: 81532 - DNA, 50 bp, homo sapien
gagacagagaagctaaaaacaagacrgcatagaaaagtggggttttttgt

SEQ ID NO: 81533 - DNA, 50 bp, homo sapien
ctttagttctccactggtcaaatgamggattccagtgggtcagagagctc

SEQ ID NO: 81534 - DNA, 50 bp, homo sapien
cagggaagagcctagttcaaggtcamacactaaagcttcaatcctcccaa

SEQ ID NO: 81535 - DNA, 50 bp, homo sapien
attctaccaactgtctccttagaccrcaagtgtacctttgctacatggtt

SEQ ID NO: 81536 - DNA, 50 bp, homo sapien
tccgcattttaaaatgtctattacakatcagatactgcactagccgtgtc

SEQ ID NO: 81537 - DNA, 50 bp, homo sapien
cttattttgaaagtcagagaaatcaygtaactgaaacctcttagagaatg

SEQ ID NO: 81538 - DNA, 50 bp, homo sapien
tgtcaatggaaacttgaattgtttcyctatctttttgttgttaataatgc

SEQ ID NO: 81539 - DNA, 50 bp, homo sapien
gtggaggttatcggaggatttgagaygggaaaattattctggattatgtg

SEQ ID NO: 81540 - DNA, 50 bp, homo sapien
ataagattagttatcacaacaatcaktcttcttcacttatttgcctcctc

SEQ ID NO: 81541 - DNA, 50 bp, homo sapien
tcatgtgtagccttggctagcgagcsactgttcttctgatataaactctt

SEQ ID NO: 81542 - DNA, 50 bp, homo sapien
ccaaccttattctagctggaaacacmgaagtgtaaacaacaactcatcag

SEQ ID NO: 81543 - DNA, 50 bp, homo sapien
tgtatgttattgtttctcttccttargcataaacaagttatagaaaagat

SEQ ID NO: 81544 - DNA, 50 bp, homo sapien
actagaacttattctttcaatttaastgcatttttgtaccctctcttcat

SEQ ID NO: 81545 - DNA, 50 bp, homo sapien
atatatttattacacataaactacaycttcagaaaaatgttcattcacac

SEQ ID NO: 81546 - DNA, 50 bp, homo sapien
ctgatctgatttgggtgttttaagaygcacgcaaataatagaacaaactc

SEQ ID NO: 81547 - DNA, 50 bp, homo sapien
aattatggtaagcaaaacgtgtagcrctataaataagaaatattgaattt

SEQ ID NO: 81548 - DNA, 50 bp, homo sapien
ggttttggtaacagttcattctccaktttacatctccatatctagtaaag

SEQ ID NO: 81549 - DNA, 50 bp, homo sapien
gggggtcattattcagcctaccacargcatagaaagtcatctccattttt

SEQ ID NO: 81550 - DNA, 50 bp, homo sapien
ctcaggaagatagggaatggagccasgctactcaatgcagtgttatcctt

SEQ ID NO: 81551 - DNA, 50 bp, homo sapien
cctctttggctcttttgccaatagartatgtggattttcacttcttgtgc

SEQ ID NO: 81552 - DNA, 50 bp, homo sapien
ataggggttcatactgggtgctctartacaaacaatacctattgaactat

SEQ ID NO: 81553 - DNA, 50 bp, homo sapien
gattgaatatttggagatttagaaastgtaggattacataaaacctcctt

SEQ ID NO: 81554 - DNA, 50 bp, homo sapien
cctcaggaaatggagagagtgactaygtcaggcagcaagcaagtggagaa

SEQ ID NO: 81555 - DNA, 50 bp, homo sapien
aaaagccttcctctcctttggccacygagatatctccaggactaccatgg

SEQ ID NO: 81556 - DNA, 50 bp, homo sapien
tgcagagaggatatcccagttgatcrcgataggaaacggcagcactacaa

SEQ ID NO: 81557 - DNA, 50 bp, homo sapien
ggtaggagagtcaaatatttgttgawggaaaaagcttcaaggtgcgttta

SEQ ID NO: 81558 - DNA, 50 bp, homo sapien
ctcctaccaatcagtcaattgggtaygtgcccagccctgtggattgttgc

SEQ ID NO: 81559 - DNA, 50 bp, homo sapien
gtgatagacagtctccacttctgaaygagatgaagttagagatcattgta

SEQ ID NO: 81560 - DNA, 50 bp, homo sapien
taatttataaaaatactgaggtcaartcaatgtatcctttgaataaaaat

SEQ ID NO: 81561 - DNA, 50 bp, homo sapien
atgtatctgcaggcttaccataacastgtacaagcagccctcagcatgct

SEQ ID NO: 81562 - DNA, 50 bp, homo sapien
aaactttccaaggaggaagtgatacyagagggtgagttagaaggaccata

SEQ ID NO: 81563 - DNA, 50 bp, homo sapien
attggcccttcatgccaagagaatawcagaccacagaattttaaagtaca

SEQ ID NO: 81564 - DNA, 50 bp, homo sapien
gtatgtgcactgtgtagcctgtgagyagacctggttggctttgtgacctc

SEQ ID NO: 81565 - DNA, 50 bp, homo sapien
ttatatttattattactcaggctaakttaccataacagaaataccagagt

SEQ ID NO: 81566 - DNA, 50 bp, homo sapien
agcataaagattttacttttaaaatwctagtgctacaaagaagagactag

SEQ ID NO: 81567 - DNA, 50 bp, homo sapien
agaggatagtctcaacatccttcaasgtgacatttctttaaagatattaa

SEQ ID NO: 81568 - DNA, 50 bp, homo sapien
gcctaatccaatatgactattgttcrcttaataagaggagatcaagagag

SEQ ID NO: 81569 - DNA, 50 bp, homo sapien
tagtcccctggagaccttgctaagaygtgggttctgattcatcgggtctg

SEQ ID NO: 81570 - DNA, 50 bp, homo sapien
attttgtggttgggtgggaccatacrctgaattagtaaatgagtggtaga

SEQ ID NO: 81571 - DNA, 50 bp, homo sapien
atccactgaacatcagtaggtttgcygagcctttaacacaaaaaacatac

SEQ ID NO: 81572 - DNA, 50 bp, homo sapien
cctctaacaactccctaatgtatgaycggttattacccttatttagagat

SEQ ID NO: 81573 - DNA, 50 bp, homo sapien
caaagaattgtcttatctacagagamcttaatctcatcacgcacttgtct

SEQ ID NO: 81574 - DNA, 50 bp, homo sapien
atttttattgcactagctccacgaartagggaagatgctgtggaaacagt

SEQ ID NO: 81575 - DNA, 50 bp, homo sapien
ggacctgtgggagaggatgatgtaaygaaagcctttcccctagtctctgt

SEQ ID NO: 81576 - DNA, 50 bp, homo sapien
ggtgtccaccaccacctatagtgtaygcctgcctaattttttgcattttt

SEQ ID NO: 81577 - DNA, 50 bp, homo sapien
cctggatagaagatcaaagcagccayaacatttctttaagccaaaagcct

SEQ ID NO: 81578 - DNA, 50 bp, homo sapien
cttgtgtttttccctccagtttttayccgattccaagcatatagtcagta

SEQ ID NO: 81579 - DNA, 50 bp, homo sapien
catataggcaatcaggtattggaaakgaatttgcatatagatgcaaaaca

SEQ ID NO: 81580 - DNA, 50 bp, homo sapien
caacttgtcgcttcttgagccaagasatttaggacatgagaccaaatgag

SEQ ID NO: 81581 - DNA, 50 bp, homo sapien
tctgaattcctgttccacaaaagctrggagtaataataaatgtttattgt

SEQ ID NO: 81582 - DNA, 50 bp, homo sapien
tgaacaagctctttcctcttcaccargccttatcaataatgtccaacttg

SEQ ID NO: 81583 - DNA, 50 bp, homo sapien
ttgtagaggtagctcctgagaaacartgccttgtacagcttgaggaactg

SEQ ID NO: 81584 - DNA, 50 bp, homo sapien
tcagttgcagtccctgggtattgaaragcatgaacagaaatgaagacaaa

SEQ ID NO: 81585 - DNA, 50 bp, homo sapien
ccaacttttatgggtcaatatgatcsctgtaaagcatagactgatcagtt

SEQ ID NO: 81586 - DNA, 50 bp, homo sapien
taagaaagtttttaaaaagggaagtyattatccactcctctcagtcagat

SEQ ID NO: 81587 - DNA, 50 bp, homo sapien
aagtttcagactcactgcactggaargaaggcagcgtatcctttccacca

SEQ ID NO: 81588 - DNA, 50 bp, homo sapien
aaatgttcttgctttactgctttaaygagtaatttgaaatttggagtttt

SEQ ID NO: 81589 - DNA, 50 bp, homo sapien
gtgggccctgatccaacataactgaygtccttacataaaggggaaatttg

SEQ ID NO: 81590 - DNA, 50 bp, homo sapien
tgctgagattttaaaaacagatccaygtatgtattcatttgtttaggtat

SEQ ID NO: 81591 - DNA, 50 bp, homo sapien
ttctgaaatgttgaacaaggaagatwatcttttttaagcttttaagattc

SEQ ID NO: 81592 - DNA, 50 bp, homo sapien
ttgcttttgccaaatcactcactaaytggcaagtagtaatagggtcaaaa

SEQ ID NO: 81593 - DNA, 50 bp, homo sapien
aacggaactgaaagtgaaaaacacartggttgcatgagtactcaaagtac

SEQ ID NO: 81594 - DNA, 50 bp, homo sapien
atttctcatgtaatttactgaaaackgaactgaaagtgaaaaacacaatg

SEQ ID NO: 81595 - DNA, 50 bp, homo sapien
gaggcttggtggttgatttgagcaamgagctcctgtactagctggtgggg

SEQ ID NO: 81596 - DNA, 50 bp, homo sapien
ttattgggatgtaatcacattgtaartcaaggcacatcttcaattgtatt

SEQ ID NO: 81597 - DNA, 50 bp, homo sapien
cttagctagtaggaaggagtaatgargccatgtcacagacaaagaagact

SEQ ID NO: 81598 - DNA, 50 bp, homo sapien
gaggccaagctgaccttgactatcasatgtaacggtatgttacagaggtt

SEQ ID NO: 81599 - DNA, 50 bp, homo sapien
tcttcaaatactgatacttagaaaaktgggcagtttactttcggaggccg

SEQ ID NO: 81600 - DNA, 50 bp, homo sapien
acatttcttgaggtggagagtaagamtcagttttcataagccattgagat

SEQ ID NO: 81601 - DNA, 50 bp, homo sapien
aactatgcttggaagataaaagacamtcagttgctgaagaacacctagag

SEQ ID NO: 81602 - DNA, 50 bp, homo sapien
agcttattcccagctgcggagcaagrcatggctacccaagctgaaggact

SEQ ID NO: 81603 - DNA, 50 bp, homo sapien
cctcctgcttataataaatcatcaartatcagtacctccagtgtttcctt

SEQ ID NO: 81604 - DNA, 50 bp, homo sapien
cttatttttatttcattacatattcyatttgccatctaaattttaaaact

SEQ ID NO: 81605 - DNA, 50 bp, homo sapien
agaggtttgtaatacacctacacacrgaatcataaagatacagtttttat

SEQ ID NO: 81606 - DNA, 50 bp, homo sapien
agttgttgatctttcctggtgggtasatatttttagtccctcatttctgt

SEQ ID NO: 81607 - DNA, 50 bp, homo sapien
aattctttttagtcttactaatttcracatttctatttctttacattttg

SEQ ID NO: 81608 - DNA, 50 bp, homo sapien
gtatttccccccaaagtgtatttatragaggtttcgtgtaagataaaagt

SEQ ID NO: 81609 - DNA, 50 bp, homo sapien
tttttgaaggaattctgttcaagtcraaaagtgagaatattgggaacagg

SEQ ID NO: 81610 - DNA, 50 bp, homo sapien
tggatatatgacaagaagttactaartgtctaagtaatgtcttttccttt

SEQ ID NO: 81611 - DNA, 50 bp, homo sapien
tgttcaactctttctcatcaaattaygttttatgctaaatgttcatatgc

SEQ ID NO: 81612 - DNA, 50 bp, homo sapien
aatgtcttatcatattgtcaaacatragtggctccaaattgtgagtaatt

SEQ ID NO: 81613 - DNA, 50 bp, homo sapien
tgtgagtttaacatatatgaaaacastgaaaatcaaggctgaaaagatag

SEQ ID NO: 81614 - DNA, 50 bp, homo sapien
ttgctactggagtcctttaacaacayctataacgataaaaaattcctaat

SEQ ID NO: 81615 - DNA, 50 bp, homo sapien
tgaaacactactttgctgctgtaagratgagattaccatcattttttttt

SEQ ID NO: 81616 - DNA, 50 bp, homo sapien
tatgacttccaaagaattgaggaaargtaaagtccacccatctctgctct

SEQ ID NO: 81617 - DNA, 50 bp, homo sapien
gttgatcaacagcattctgatcttcwccctgaatgagtaaaaagaaaaga

SEQ ID NO: 81618 - DNA, 50 bp, homo sapien
tttctaaagtgtgaatcagctttccyagaagtcttggataattggttaca

SEQ ID NO: 81619 - DNA, 50 bp, homo sapien
atctttccatcagaaagtgaagcaaygactctgctcttattctaagttta

SEQ ID NO: 81620 - DNA, 50 bp, homo sapien
atggctttgggtgcagccacctagamgtcagaggatgcagccccagcgtg

SEQ ID NO: 81621 - DNA, 50 bp, homo sapien
tattttgcaacccctaagataataaytaattcaggcaagtatcattgaga

SEQ ID NO: 81622 - DNA, 50 bp, homo sapien
aatcaacagaaagtcagtggtttaargcatttagacaactatgtgaatct

SEQ ID NO: 81623 - DNA, 50 bp, homo sapien
tcaacctaggcaaatggacttgaaasaaaccttagcacatactaagttat

SEQ ID NO: 81624 - DNA, 50 bp, homo sapien
ttcgtgatcttgaccacacaataaasgctggtatctctcaaactgacatc

SEQ ID NO: 81625 - DNA, 50 bp, homo sapien
atgtaccacagtttatttattcatcraactactgaaggatgtcttggttg

SEQ ID NO: 81626 - DNA, 50 bp, homo sapien
tgtcttggttgttcaaattttgacamgtatgaataaagctgctataaaca

SEQ ID NO: 81627 - DNA, 50 bp, homo sapien
ggacacgtcagagaagtatttcagayggaaaactgataggacctggtgtg

SEQ ID NO: 81628 - DNA, 50 bp, homo sapien
taacctaaaggattagaggaatccamataaggaaaataaaaaataataaa

SEQ ID NO: 81629 - DNA, 50 bp, homo sapien
aaagccaaccaggttgaacccaaagractgtgtcaggttagagttgtacg

SEQ ID NO: 81630 - DNA, 50 bp, homo sapien
aaaaattaagtgatctaacatttgawagtgatttgaaaaattgaacgtgt

SEQ ID NO: 81631 - DNA, 50 bp, homo sapien
gcattttttttttcagtgtaaatccrccctttattgcctccaaaaagata

SEQ ID NO: 81632 - DNA, 50 bp, homo sapien
gggaagcaagacaaaataagaaccaytgagtattataatcagtatggaac

SEQ ID NO: 81633 - DNA, 50 bp, homo sapien
tatcattttggttaaactagaccatsaatctgtgagttaaacatttttat

SEQ ID NO: 81634 - DNA, 50 bp, homo sapien
aataacagattctctctaggtggtaygaggacaaatttttttctaatttg

SEQ ID NO: 81635 - DNA, 50 bp, homo sapien
ttctacttatcgtactccaatgaacyaataaggtgaccttcaaatttgat

SEQ ID NO: 81636 - DNA, 50 bp, homo sapien
cacgtacagcattagctgtctttcaratcacaaactcttctgcctgtcaa

SEQ ID NO: 81637 - DNA, 50 bp, homo sapien
gataaaatagaaatgtctccaggcaytgaaaagtttgacaggcagaagag

SEQ ID NO: 81638 - DNA, 50 bp, homo sapien
gcttcacactatatgcacccaaataygcagtttcctgtagatgtggttta

SEQ ID NO: 81639 - DNA, 50 bp, homo sapien
gggaattagagaattggcaactggcrgaaagctttcaaatgaaggacata

SEQ ID NO: 81640 - DNA, 50 bp, homo sapien
atttctggttgacctttgaaggaaaktgacgcaaacatattctgaaaaac

SEQ ID NO: 81641 - DNA, 50 bp, homo sapien
aggcactgctgctgagaagatgaatrtatacaaatctatgaactaaagaa

SEQ ID NO: 81642 - DNA, 50 bp, homo sapien
caatgtccatttgaaccacaaaaaayagattatctgaaatgggccttggc

SEQ ID NO: 81643 - DNA, 50 bp, homo sapien
agatcatcctccactatgttactccygatgagtttttcagagctatgccc

SEQ ID NO: 81644 - DNA, 50 bp, homo sapien
taattgtcttaacaagttaatcaccyggcacttattacaatctctacatt

SEQ ID NO: 81645 - DNA, 50 bp, homo sapien
tgggttgcattctcaattctttggarattggctacctgcttattgattta

SEQ ID NO: 81646 - DNA, 50 bp, homo sapien
cagataaaactgatccaggtagcaartagttgggttggtatctagtcctc

SEQ ID NO: 81647 - DNA, 50 bp, homo sapien
acaatgaagaaatcgtctgatacaayagcaattaaagaaatttctattcc

SEQ ID NO: 81648 - DNA, 50 bp, homo sapien
aacgtaatggaactgcaaattactamggtttaacaagctcttcaggtgat

SEQ ID NO: 81649 - DNA, 50 bp, homo sapien
tctctgtgaaataaaagatgctccayaaaaatgagagggtaatccaggaa

SEQ ID NO: 81650 - DNA, 50 bp, homo sapien
ccaacaagagaattgttttgccgaaytgaagaaccaaggaattagatttc

SEQ ID NO: 81651 - DNA, 50 bp, homo sapien
attgcattaacatagctatatattamatactcaaatagaaatatcaagtg

SEQ ID NO: 81652 - DNA, 50 bp, homo sapien
atacaaagccatttcacataaatacmactgtaatagtttttcctcatgag

SEQ ID NO: 81653 - DNA, 50 bp, homo sapien
acaaagcctaatatggaaatagataycaaacaacatcaatgtgtccagaa

SEQ ID NO: 81654 - DNA, 50 bp, homo sapien
gaaatccactcgctttactgaaaaayagctgtgcacttttgaaaattata

SEQ ID NO: 81655 - DNA, 50 bp, homo sapien
tgtttctgaagttcttcataataaartgactgttagggggacaatggagt

SEQ ID NO: 81656 - DNA, 50 bp, homo sapien
gctgtagctcatcctatgctggaaartagagaaaatgtgaggtctcctgc

SEQ ID NO: 81657 - DNA, 50 bp, homo sapien
tgtatacttgggattagctctttaaktacttgttttctaatcactctacc

SEQ ID NO: 81658 - DNA, 50 bp, homo sapien
ctcttctattttctgaacctagtagracatgatggagctgaagagattcc

SEQ ID NO: 81659 - DNA, 50 bp, homo sapien
ctactgacttgttggaacttactgamagagagaggagaattccccttctt

SEQ ID NO: 81660 - DNA, 50 bp, homo sapien
ttagggactgacctagtggtgttctstctctactgcactttgagctactt

SEQ ID NO: 81661 - DNA, 50 bp, homo sapien
ttttttttttttaggttacctaacawcataccattgccctggttatttat

SEQ ID NO: 81662 - DNA, 50 bp, homo sapien
tctctgtggcttgactatcatccagrcaacgaccttttaacctgccagca

SEQ ID NO: 81663 - DNA, 50 bp, homo sapien
cagacattacataatctgcaaacacygcaaagcctcctaaaaggcatgct

SEQ ID NO: 81664 - DNA, 50 bp, homo sapien
agctcttctgctctataattcttcarctaaggtgtttatgattccatttc

SEQ ID NO: 81665 - DNA, 50 bp, homo sapien
ggtgagctggcaggtagctggtttasacgggacactgtggctggttctac

SEQ ID NO: 81666 - DNA, 50 bp, homo sapien
atacataataaactatgttgactacraaacatttctccaaattatgcaga

SEQ ID NO: 81667 - DNA, 50 bp, homo sapien
ctcctgcctgagtggaacggagtaartaaagtattctggctgtaattttc

SEQ ID NO: 81668 - DNA, 50 bp, homo sapien
ccactgtgctgcagtctgtctcttamcttgctaatttgtctgactttaga

SEQ ID NO: 81669 - DNA, 50 bp, homo sapien
gtctttccaaccattcaaacgcccartgagggaacagcagcctctctggt

SEQ ID NO: 81670 - DNA, 50 bp, homo sapien
attgattctaaagaccttgaagtcartagctagatagacttctttggtat

SEQ ID NO: 81671 - DNA, 50 bp, homo sapien
aatagcaaactcttctagtacattcraaatcaaatgcttgatttgcctgc

SEQ ID NO: 81672 - DNA, 50 bp, homo sapien
ataaatgatcaagaaatgcatgctamaaagatccagccattagtcctgtg

SEQ ID NO: 81673 - DNA, 50 bp, homo sapien
agtaggaggaataaccagagttttaygataacatctccaggactctatcc

SEQ ID NO: 81674 - DNA, 50 bp, homo sapien
agagccaggattctcatagagtttgsagactagtgagaaagctagacatt

SEQ ID NO: 81675 - DNA, 50 bp, homo sapien
cccttttggggtgtttgggagtctayctttcttattctaaagcatgctaa

SEQ ID NO: 81676 - DNA, 50 bp, homo sapien
catatttcacactataccattccacyatattttggagatcgcatggaaca

SEQ ID NO: 81677 - DNA, 50 bp, homo sapien
atcattaaaagctcactaatcaacaraataagtagtgtgcattttatacg

SEQ ID NO: 81678 - DNA, 50 bp, homo sapien
tcctgctaagaatttaaggcgataakgtaaggaaactccagcaaccaggg

SEQ ID NO: 81679 - DNA, 50 bp, homo sapien
atacctgcccagctcttcaggtgtaygcccacactaaaaagttacataat

SEQ ID NO: 81680 - DNA, 50 bp, homo sapien
cgctccctcctaatggatctcttaayaagcttacgtaaagatcaccaatt

SEQ ID NO: 81681 - DNA, 50 bp, homo sapien
aacaggatatttagtcgcagttatayactaagaagctggactataagact

SEQ ID NO: 81682 - DNA, 50 bp, homo sapien
aagctagaaagcctatgattccaatwacctagtgcggacacttcctaact

SEQ ID NO: 81683 - DNA, 50 bp, homo sapien
atgaagttatattttaaagaattgaygaaggaaaattacaaacaaaatta

SEQ ID NO: 81684 - DNA, 50 bp, homo sapien
aagtgtggttcatttacattaccccragaaaggaagctctaccttagatt

SEQ ID NO: 81685 - DNA, 50 bp, homo sapien
attctgttgcaaatgtagagccagtraaacattacaatctgataagctct

SEQ ID NO: 81686 - DNA, 50 bp, homo sapien
cttgtgaactatgtttctgccgttascagtgttggacccgccttcctctt

SEQ ID NO: 81687 - DNA, 50 bp, homo sapien
aaaagtgaatgaatgaggtacttctkactgccatatactgtgcaaaagca

SEQ ID NO: 81688 - DNA, 50 bp, homo sapien
tgagcagtgaagggttctgtcaaccraaacaacgcttttagagagcagtg

SEQ ID NO: 81689 - DNA, 50 bp, homo sapien
tggttggagttaaataatctttcacygtccagatatgaaacgtgctattg

SEQ ID NO: 81690 - DNA, 50 bp, homo sapien
tagaagagaatgaaggtatcagggakcaagaaagaaattagcactgatag

SEQ ID NO: 81691 - DNA, 50 bp, homo sapien
gggatagttttgtaaagtggaagaastatctaggtccttttctattctta

SEQ ID NO: 81692 - DNA, 50 bp, homo sapien
ttcgccggtgcgcttgcgcggcctcyagcgacgagagtcccgggaggtaa

SEQ ID NO: 81693 - DNA, 50 bp, homo sapien
ggtactacgtggaaataacaagctaygaactgtgcagggaggtgttggca

SEQ ID NO: 81694 - DNA, 50 bp, homo sapien
ggcaaaacatattatacttaaggcaytgcccctattttcctgataattgc

SEQ ID NO: 81695 - DNA, 50 bp, homo sapien
actaggctcctagtatcatcggtaasaaacttatgtatgtatactgtggg

SEQ ID NO: 81696 - DNA, 50 bp, homo sapien
ccaccctcacactgccccctactagygttactgtgtccacatttttacca

SEQ ID NO: 81697 - DNA, 50 bp, homo sapien
aatctgttagcagaaaagaatctgamgctaggtatgcctgacaagatggc

SEQ ID NO: 81698 - DNA, 50 bp, homo sapien
catccagttgtaccctcttgccaagkttgatggatatatctgatgtcatt

SEQ ID NO: 81699 - DNA, 50 bp, homo sapien
aggaatggataaccaagtgccaatayggtggaaattgtgagtgtggaaag

SEQ ID NO: 81700 - DNA, 50 bp, homo sapien
aagcctttgttacagcttgtactacracaagattccactccttatatcag

SEQ ID NO: 81701 - DNA, 50 bp, homo sapien
gatgggcagaaaactagtatgaaaaygtcaacttaaagacagtcaataaa

SEQ ID NO: 81702 - DNA, 50 bp, homo sapien
gcaataattcccataggagagtgtcycaactagatcatagaggggtgagt

SEQ ID NO: 81703 - DNA, 50 bp, homo sapien
aaggttaccatggtctactatatgaktcagctgtgagtattgttgatgta

SEQ ID NO: 81704 - DNA, 50 bp, homo sapien
catggagttttctagccaggaaaaarccctatctctggacacaggactct

SEQ ID NO: 81705 - DNA, 50 bp, homo sapien
agttaagctatttaaaactagatgaygggatatattgcaagcaatttgat

SEQ ID NO: 81706 - DNA, 50 bp, homo sapien
ctggcaccatcccaggcagatcagaragtttttacatacattcacacata

SEQ ID NO: 81707 - DNA, 50 bp, homo sapien
cttgttaaatgaggaaatgaataaaygaattgccaaataaccaaacaaat

SEQ ID NO: 81708 - DNA, 50 bp, homo sapien
atccaatctaattggcctgctgaaayagcagtgaacacaagatttaagaa

SEQ ID NO: 81709 - DNA, 50 bp, homo sapien
cagatgaccctctttgccaaacttaragcccagcactggtttggagatca

SEQ ID NO: 81710 - DNA, 50 bp, homo sapien
gagtgtcagtggctttacttctaccrcatgataccctttaaagatgagac

SEQ ID NO: 81711 - DNA, 50 bp, homo sapien
atagcctttgcctgtggtccccatasagatatgctgcttgtttctttagt

SEQ ID NO: 81712 - DNA, 50 bp, homo sapien
ctgtcagtggtacattttctaggttscacattcgtctcccatgacacaac

SEQ ID NO: 81713 - DNA, 50 bp, homo sapien
gatacagatatttagaaaaacttaaraagacatgatagacatatttgaag

SEQ ID NO: 81714 - DNA, 50 bp, homo sapien
agagtagagtatcattggatagttaygaatattaaataaaaaatagtaag

SEQ ID NO: 81715 - DNA, 50 bp, homo sapien
tcacttttttaaaatgtagcactgargttagatttggggagcattcatga

SEQ ID NO: 81716 - DNA, 50 bp, homo sapien
tggatccaatcctgttgcaaccacamtacgaattcagagagcagatgata

SEQ ID NO: 81717 - DNA, 50 bp, homo sapien
ggcttgtagcagctattcagtaaaayagtcattgaatgaagaaataattg

SEQ ID NO: 81718 - DNA, 50 bp, homo sapien
gagaagggctggatttgaagactgayatgtgtaaatgcattgaaccatta

SEQ ID NO: 81719 - DNA, 50 bp, homo sapien
tacagcagctgcacagtcaagacaaygggagctctaaggagaaatggacc

SEQ ID NO: 81720 - DNA, 50 bp, homo sapien
cggggctcaggatccagtggctctcytacctccttttccttcacgtgggt

SEQ ID NO: 81721 - DNA, 50 bp, homo sapien
acaactacaccaatctgatcttataygaaactgacaaaaacaagcaatgg

SEQ ID NO: 81722 - DNA, 50 bp, homo sapien
tctagacaatggaaggatgacaggaygtatttcccagatttcagtaattc

SEQ ID NO: 81723 - DNA, 50 bp, homo sapien
tcaaactaaaaagatttaggacaaaygttgcaaaaagaggatgaaagcct

SEQ ID NO: 81724 - DNA, 50 bp, homo sapien
acaggtgattctgatacatactcctwacactcagatgcagtagagctgcg

SEQ ID NO: 81725 - DNA, 50 bp, homo sapien
ctattctgcagaaatgagacttcaartaactctaaaataggcttggaaga

SEQ ID NO: 81726 - DNA, 50 bp, homo sapien
gaggtacttcattctgttgtcaatcmctggactgccagttactcaaaagt

SEQ ID NO: 81727 - DNA, 50 bp, homo sapien
atagacctgcatcacaattgcaatgkaatctgtaagtaagcactgtggtc

SEQ ID NO: 81728 - DNA, 50 bp, homo sapien
ttagaaagtgatgaattagtaaactsaagaaacaaatgcaacagtcccag

SEQ ID NO: 81729 - DNA, 50 bp, homo sapien
aacaaatattttatgaaatgcaattsaaccacagtgatttgagctttgct

SEQ ID NO: 81730 - DNA, 32 bp, homo sapien
gaagtgatgtttaagartaattttcaattaca

SEQ ID NO: 81731 - DNA, 50 bp, homo sapien
ctgcaaaatacgaatgatgataatamcaacctcagagagttgctgaggca

SEQ ID NO: 81732 - DNA, 50 bp, homo sapien
atatctgataagatcttcaccaaaawaatacagatcaatagttttcatga

SEQ ID NO: 81733 - DNA, 50 bp, homo sapien
tagctgtccatttggtagtagttcartaataaacatagaactccttcagt

SEQ ID NO: 81734 - DNA, 50 bp, homo sapien
ttcaatgaatctttttgtgcaacatyggtgcagtttggcaagttatctct

SEQ ID NO: 81735 - DNA, 50 bp, homo sapien
tcacatgacaggttaagcttctaaaygaatgaattgcaaagtgctctgat

SEQ ID NO: 81736 - DNA, 50 bp, homo sapien
ctatcacattggtcattaagtttcartagctgagttttagagaggacacg

SEQ ID NO: 81737 - DNA, 50 bp, homo sapien
atggaatagcctaggactcatgttcragatacataaaataaatttgttaa

SEQ ID NO: 81738 - DNA, 50 bp, homo sapien
agttttagagaggacacgttgaaacsatagcagcagacctccattttccc

SEQ ID NO: 81739 - DNA, 50 bp, homo sapien
tgcacattagaaaaagagtttatacrgccctcacatgagcacgcctggct

SEQ ID NO: 81740 - DNA, 50 bp, homo sapien
ttccctgtgcctcaaagtattttcayaagatctcatcactgttacttgtg

SEQ ID NO: 81741 - DNA, 50 bp, homo sapien
gctctgaatgtatcaatcatttttargctaattacaataaagtctaatta

SEQ ID NO: 81742 - DNA, 50 bp, homo sapien
ctgtgccaaaacattactgaaaacaytactggacccttgtttgcattcat

SEQ ID NO: 81743 - DNA, 50 bp, homo sapien
gaactgcgggcacaaaaccatttctytgtcaagggaaaatgatctaggaa

SEQ ID NO: 81744 - DNA, 50 bp, homo sapien
gcaagatagctcttctcagtctggaygtaggagttggcattacctttttg

SEQ ID NO: 81745 - DNA, 50 bp, homo sapien
atgtgtgcatgtatgagagacagtcrctgcaaaatgtgcaacaagagctg

SEQ ID NO: 81746 - DNA, 50 bp, homo sapien
aagatttcatggggtagtacagctaygttagaaacaggtatcttagacac

SEQ ID NO: 81747 - DNA, 50 bp, homo sapien
attaaagagagaataaggcttataaktaaggaaactagcagactcagaaa

SEQ ID NO: 81748 - DNA, 50 bp, homo sapien
ccattgcaggtattgctgggactcartcaagatggtgttccctaccatgt

SEQ ID NO: 81749 - DNA, 50 bp, homo sapien
acacctcctggacaatgcacagaaayggatggtcttcaatgtgtaggtca

SEQ ID NO: 81750 - DNA, 50 bp, homo sapien
tgccttcgcaactagttcatgagaaraatacctgccttaaaccacttgaa

SEQ ID NO: 81751 - DNA, 50 bp, homo sapien
tctctaagtcctcacttaagttacaytggtgttgtgccactcttttctga

SEQ ID NO: 81752 - DNA, 50 bp, homo sapien
ataggttaaatttgggaaattatgtwaaatgagattgagtcattgacaaa

SEQ ID NO: 81753 - DNA, 50 bp, homo sapien
ctcataacgaagaaatctactacgtracaggtagcgcatacagcataaag

SEQ ID NO: 81754 - DNA, 50 bp, homo sapien
ggcccctggaataaaagtaagtgaayatgcctataggagcaaaggtgtct

SEQ ID NO: 81755 - DNA, 50 bp, homo sapien
agtctgatcttgtttcacatttcctyatagtttcaccacccacaaacaac

SEQ ID NO: 81756 - DNA, 50 bp, homo sapien
cggttgcaagtaactgaaaaatgacygacaaatttaagcaaagggtaatt

SEQ ID NO: 81757 - DNA, 50 bp, homo sapien
ggtcccaaatgacgggagtgaacaartaagagaagcaggattgaacagaa

SEQ ID NO: 81758 - DNA, 50 bp, homo sapien
ctttccccatccactgtgaaatattraaactcagctgtgatgtagcattt

SEQ ID NO: 81759 - DNA, 50 bp, homo sapien
tttaactccatgtaaaagaagcaacmatggggtaattgtaaacaagtatc

SEQ ID NO: 81760 - DNA, 50 bp, homo sapien
tggtaatcttaaatggcaattgttayacagagaggcatctaagggataca

SEQ ID NO: 81761 - DNA, 50 bp, homo sapien
attactgtacagatatttggcttaayaggaaaattctgaaaacattttaa

SEQ ID NO: 81762 - DNA, 50 bp, homo sapien
gacttaggaaagccaatccagtgcayagcagaataaaagtaaaaaatata

SEQ ID NO: 81763 - DNA, 50 bp, homo sapien
gaaggaaaagagtctgtgtttacacygagtgatgtgtcctcagaaagccc

SEQ ID NO: 81764 - DNA, 50 bp, homo sapien
aatataactacaagggtttgtgtaaracggacacaggagggtcagaatca

SEQ ID NO: 81765 - DNA, 50 bp, homo sapien
gggagttgcccctctcctttaatgayatgtaactgaattttgaacatcag

SEQ ID NO: 81766 - DNA, 50 bp, homo sapien
taaagaaaacgtggtatacataaacrgtgaaatattatgcaaccacaaaa

SEQ ID NO: 81767 - DNA, 50 bp, homo sapien
acagaataagttccttcttaatcacratcattgtacctgcagttcccctt

SEQ ID NO: 81768 - DNA, 50 bp, homo sapien
cttgtgtcttttgtacatacttttayggagcaatgagttgtcctttgtct

SEQ ID NO: 81769 - DNA, 50 bp, homo sapien
ggaaatgatgtccaagaaagcataayggctaaatgtttggacttagtaga

SEQ ID NO: 81770 - DNA, 50 bp, homo sapien
ttcagaattattgaaatgattaaacraggtaatgtatagtaaagtatttt

SEQ ID NO: 81771 - DNA, 50 bp, homo sapien
aactgctttgtaacactagggactcygaacaataattttactttgaagca

SEQ ID NO: 81772 - DNA, 50 bp, homo sapien
ttctgcacaaaactagctaaaaatcytttaaatcagttaccagaggcaat

SEQ ID NO: 81773 - DNA, 50 bp, homo sapien
tttctccacggcttccgatcacttayctgtttgttctgactcctgaagag

SEQ ID NO: 81774 - DNA, 50 bp, homo sapien
atatctaatttttaattctagcttayagaaggactgcagggaagaaagtc

SEQ ID NO: 81775 - DNA, 50 bp, homo sapien
atgattttataaagaacagctgaaarttataaagttccatggggcagaaa

SEQ ID NO: 81776 - DNA, 50 bp, homo sapien
ccaaagacttagggtcaatgaaatcmagacattttggtagtgattggaaa

SEQ ID NO: 81777 - DNA, 50 bp, homo sapien
agcacctagcacaattcttggcataycttagggagttaataactaataac

SEQ ID NO: 81778 - DNA, 50 bp, homo sapien
tagaagtttatgtttttgatacttaycctaatgtcggttatgtatattgc

SEQ ID NO: 81779 - DNA, 50 bp, homo sapien
gctcagttccaagtccacatttctaygctctgctgtgtgacaccagggct

SEQ ID NO: 81780 - DNA, 50 bp, homo sapien
taagaacaactgtgcccattattacrccagtgttgctcagttccaagtcc

SEQ ID NO: 81781 - DNA, 50 bp, homo sapien
aatagacaaaaaagtagcctatataktaatgagtgctttggagaaaaaaa

SEQ ID NO: 81782 - DNA, 50 bp, homo sapien
agacaactctaccggaccgtcctagytccagagctcccagtgaatgcctt

SEQ ID NO: 81783 - DNA, 50 bp, homo sapien
atagataagcaggtcaacagataaaygatagatagaaatatagatttaag

SEQ ID NO: 81784 - DNA, 50 bp, homo sapien
ccaatatagctttaaaacaaattgcsaggattccaatcacttgtgattcc

SEQ ID NO: 81785 - DNA, 50 bp, homo sapien
aagaactgttccttcaacgttcgacrcagccaagctggtgttacatgatg

SEQ ID NO: 81786 - DNA, 50 bp, homo sapien
aaagcatatggtgacagacagaagaygtaggctatgaaagtctggaggga

SEQ ID NO: 81787 - DNA, 50 bp, homo sapien
agaacagaagggatcttccaagctaygttaagaagtatagatttcactct

SEQ ID NO: 81788 - DNA, 50 bp, homo sapien
tccagtgtgtattcttgacataagcyctcctgaggcaggaagtgtctgtc

SEQ ID NO: 81789 - DNA, 50 bp, homo sapien
tagcaatactaattcaaaagataaaygatactctttgcagaaaaatattt

SEQ ID NO: 81790 - DNA, 50 bp, homo sapien
tgtgtccaccatcagaatcatccagsactacttgtagaaagtacttgatc

SEQ ID NO: 81791 - DNA, 50 bp, homo sapien
gtctgtcaccatatgctttaggaaaygtatgaagtgtaaatcaaattaac

SEQ ID NO: 81792 - DNA, 50 bp, homo sapien
actttgtattttgaacctatcttgastagagctttgcacatagtctgtgt

SEQ ID NO: 81793 - DNA, 50 bp, homo sapien
atacacctaacaagttaagatatcaragtacaattggaaaagtatagaaa

SEQ ID NO: 81794 - DNA, 50 bp, homo sapien
catgaatcaaaaggaggagacagaaycacaagtgtaggagcagggagtgt

SEQ ID NO: 81795 - DNA, 50 bp, homo sapien
taaaaattttcaataatcaataatarctgctggagaggggacaacaggta

SEQ ID NO: 81796 - DNA, 50 bp, homo sapien
cctgatgggtgggagctgtgcccagrtccgagccagagaaaagcagaaag

SEQ ID NO: 81797 - DNA, 50 bp, homo sapien
agggctcagcaaacacgaaagcaatraagtcaagacagtgggtgacagca

SEQ ID NO: 81798 - DNA, 50 bp, homo sapien
caagttccgtccagtttttgaaaggrccagatttatgaaataaatggagt

SEQ ID NO: 81799 - DNA, 50 bp, homo sapien
ttggatgggaaaagaggagtggctayggaaaagagaatgagaatttatta

SEQ ID NO: 81800 - DNA, 50 bp, homo sapien
ctgaccacacagactaatgccccagwacggttcttgcaccaattgcgaag

SEQ ID NO: 81801 - DNA, 50 bp, homo sapien
aatggagaagagtggcatggttgtgsttgaatgatagaggatgagtgagg

SEQ ID NO: 81802 - DNA, 50 bp, homo sapien
attccacagcaagttctgtaggcccractgccaaacatatctggattctc

SEQ ID NO: 81803 - DNA, 50 bp, homo sapien
gcccaggcaggagctggcttagaaaygccaacatagttttgggagtctta

SEQ ID NO: 81804 - DNA, 50 bp, homo sapien
ctcacttagtatgcttttttacctayacttatctcatacttatctgaccc

SEQ ID NO: 81805 - DNA, 50 bp, homo sapien
agcattaggaccaatgctaaaacccragtctcatgaaatccctgcaggag

SEQ ID NO: 81806 - DNA, 50 bp, homo sapien
ttctggctctgagctcagcccaacaygaggaattgcctaggaattacagt

SEQ ID NO: 81807 - DNA, 50 bp, homo sapien
cataatagctactgaaatggagaaaktactttttattatttttcagcatt

SEQ ID NO: 81808 - DNA, 50 bp, homo sapien
tagttaggcatacacctataaataargcaatagttttaaaaataaccaat

SEQ ID NO: 81809 - DNA, 50 bp, homo sapien
tatttagttctgctataactaagaaytcacagtgcaaaaattactgaata

SEQ ID NO: 81810 - DNA, 50 bp, homo sapien
ttcttgaacgaaatcgtggtacgtcyaggatattaagttctacttatttt

SEQ ID NO: 81811 - DNA, 50 bp, homo sapien
acatatttcacaacattatgttgtaygtgataaataaatataaatgtgtt

SEQ ID NO: 81812 - DNA, 50 bp, homo sapien
ttctttgcagtggaaccaggattccrgagattacagtgaaatagacttgg

SEQ ID NO: 81813 - DNA, 50 bp, homo sapien
gggtcctcctgtcctgcagaagatayaatgactgtcacctgttggttatc

SEQ ID NO: 81814 - DNA, 50 bp, homo sapien
ttggcagggatgggaaatgtattgartatcctacaagaagggctctaaga

SEQ ID NO: 81815 - DNA, 50 bp, homo sapien
attattttactagcagaaaatgaaaygttaaaagactatatacttgatta

SEQ ID NO: 81816 - DNA, 50 bp, homo sapien
actgtagacatcacaaatttcaaccrcagacatctttcaaaagactggaa

SEQ ID NO: 81817 - DNA, 50 bp, homo sapien
tatagtctaagttactagaaccagayagccaggtgttaagttgaagaatt

SEQ ID NO: 81818 - DNA, 50 bp, homo sapien
ggtaggggacccctcctatcaccaarcatagtcctgggcacacatcaaga

SEQ ID NO: 81819 - DNA, 50 bp, homo sapien
catccctgtaactaggttgagtcagrgattgcttctaaactttctgcaaa

SEQ ID NO: 81820 - DNA, 50 bp, homo sapien
ccctatcaaagaagggtgcagaaaaygatgtgtactccatggaatgcaca

SEQ ID NO: 81821 - DNA, 50 bp, homo sapien
tatcgtaatcttggaagtgattctcyttcacttttgctgtattctatttg

SEQ ID NO: 81822 - DNA, 50 bp, homo sapien
ttgttgcaaaatggtcattgcagaayggtactttcactttttactcaaaa

SEQ ID NO: 81823 - DNA, 50 bp, homo sapien
cagccagtattgctctgattgggaaygttgggtactaaagtgtactttat

SEQ ID NO: 81824 - DNA, 50 bp, homo sapien
aaaaggaccctatgtttagcctaacratatagttcctgacaatctctctc

SEQ ID NO: 81825 - DNA, 50 bp, homo sapien
tggtccagggaatgtaataagcacaragtataaagggtcattctagagca

SEQ ID NO: 81826 - DNA, 50 bp, homo sapien
aatacatttctaaatttatctgccayagttgtatttcatgagttgtttca

SEQ ID NO: 81827 - DNA, 50 bp, homo sapien
ccaccaacacttcttcccatcctagwactcattgacctctccttccttcc

SEQ ID NO: 81828 - DNA, 50 bp, homo sapien
ttctcctaccttccttattcccccartggacagtgaaactaatgactaga

SEQ ID NO: 81829 - DNA, 50 bp, homo sapien
cttcatgatccaaaggcttgtgaaakagagagagaattatctcctctctt

SEQ ID NO: 81830 - DNA, 50 bp, homo sapien
cccactaatctatggaaattcttgakattaaaaagcatagctaaataaaa

SEQ ID NO: 81831 - DNA, 50 bp, homo sapien
ccattcaatggattctctctcttaayctcttttgtttatgtcaacaagtt

SEQ ID NO: 81832 - DNA, 50 bp, homo sapien
actgactggatttttcttggcaacaraatctagtcctgagctctaattat

SEQ ID NO: 81833 - DNA, 50 bp, homo sapien
ctaattaaacaattatgtcaccctamgccaattgcgagataccttttcca

SEQ ID NO: 81834 - DNA, 50 bp, homo sapien
tggattcttctttaacactcgtattkaacagtcaaaacagtaagcatgaa

SEQ ID NO: 81835 - DNA, 50 bp, homo sapien
tttagctaagataacttagaactaaktatgtaaatatgtaagaaaatcat

SEQ ID NO: 81836 - DNA, 50 bp, homo sapien
ctgttttgatgctgtaagttgtctcrttatgatttctcaccagcaataaa

SEQ ID NO: 81837 - DNA, 50 bp, homo sapien
atttccaaaggaatcttattattgawtatcacctataacatgacaataat

SEQ ID NO: 81838 - DNA, 50 bp, homo sapien
atgtttctatttgatagttgtaaaaycacctcttcatctttgctattgtc

SEQ ID NO: 81839 - DNA, 50 bp, homo sapien
gagtttgatcttttaatcgaatggcyatttaaataaaattttaaaaagca

SEQ ID NO: 81840 - DNA, 50 bp, homo sapien
cccattaatttaccgtaatgataaastatgtggattattttctttcttga

SEQ ID NO: 81841 - DNA, 50 bp, homo sapien
gatggcatttcctatctgtgtcccayggctccgggtttctgaatgtcacc

SEQ ID NO: 81842 - DNA, 50 bp, homo sapien
aagccaatacctcaacttgggtctamctgattacaaagtttatgttcttt

SEQ ID NO: 81843 - DNA, 50 bp, homo sapien
gtacattacatctgaatacagaaaaygctcctcagatgtagttttttgat

SEQ ID NO: 81844 - DNA, 50 bp, homo sapien
ttgaatcaatcttgcataccataagmcaaatcttacttggccatcattta

SEQ ID NO: 81845 - DNA, 50 bp, homo sapien
tccatttaggatgaaaatgattgacyaactagaaatagatgagagctttc

SEQ ID NO: 81846 - DNA, 50 bp, homo sapien
gcttgtgcttagcatcagataccagmataaagcctaattaaggtaatcta

SEQ ID NO: 81847 - DNA, 50 bp, homo sapien
atgcttctctttcttccttctttccrgatcaagctaatcttttaaaaaaa

SEQ ID NO: 81848 - DNA, 50 bp, homo sapien
agaccatttagaaagctcctgtctamaatgtttctcctacttgcttgtca

SEQ ID NO: 81849 - DNA, 50 bp, homo sapien
tacagcataccagagccttattcgaragcagtaaggatacaatgaagaac

SEQ ID NO: 81850 - DNA, 50 bp, homo sapien
tcatttagatttggaagtcctcaaartaagcagaaaattatttgaaaaat

SEQ ID NO: 81851 - DNA, 50 bp, homo sapien
gaccagaggtttcctgaaggctgaargatagctgcgagagacgtttataa

SEQ ID NO: 81852 - DNA, 50 bp, homo sapien
ttttctttgattctggcaaatacatraagccccagtctcagtgaaaatgt

SEQ ID NO: 81853 - DNA, 50 bp, homo sapien
tcatagaaaggaaaagattcaataamccatttgatatttgtaaacataat

SEQ ID NO: 81854 - DNA, 50 bp, homo sapien
tatggccttttctcaattggaaatakctgttctcccaaacctcacagagg

SEQ ID NO: 81855 - DNA, 50 bp, homo sapien
aagttaaagcgtgctactttttatcscatgcaagccagttgtgggttcat

SEQ ID NO: 81856 - DNA, 50 bp, homo sapien
aagtaaaatgaaacagacaacaataktacagttgcaaccctagctgtaag

SEQ ID NO: 81857 - DNA, 50 bp, homo sapien
tgttaaactgttgaggagactaagayggtacccaatgacacaaaaccatc

SEQ ID NO: 81858 - DNA, 50 bp, homo sapien
agtggatgcatatttagtgactaacyggcattgattagtgaggaaatggg

SEQ ID NO: 81859 - DNA, 50 bp, homo sapien
caataaaatatgaagatagaatataygtaaagttagatttaaatgcacta

SEQ ID NO: 81860 - DNA, 50 bp, homo sapien
ccagagatggcaccaactatgaagartatctttgaggaccacatgaagag

SEQ ID NO: 81861 - DNA, 50 bp, homo sapien
ttggcattctttggtgtacattttcrcattcacaaatataaacctatcat

SEQ ID NO: 81862 - DNA, 50 bp, homo sapien
tgttgtaacataggccctatctgaawcattctaatgaattctttattaag

SEQ ID NO: 81863 - DNA, 50 bp, homo sapien
ttcaaagtgtttatgaagttgcataytaatatattggttggtatatacaa

SEQ ID NO: 81864 - DNA, 50 bp, homo sapien
tttgtgagttaaagcttaatagccartgtgacagtattaagaggtggggt

SEQ ID NO: 81865 - DNA, 50 bp, homo sapien
tgagtcctggagttgcccacaaatgraatattgagtaatgagaatttaat

SEQ ID NO: 81866 - DNA, 50 bp, homo sapien
atttagagtaagatagagagtctccrcaaaataatattcatgaaatactg

SEQ ID NO: 81867 - DNA, 50 bp, homo sapien
gcagatactgccaacataaggacctktcactatcatttcaagtactaaat

SEQ ID NO: 81868 - DNA, 50 bp, homo sapien
agttgataccacgttttcttggacayactaaaaatattccaagtagatat

SEQ ID NO: 81869 - DNA, 50 bp, homo sapien
ctcgatgagggtgctctgggtccctsagtatcagagtcaacttagactct

SEQ ID NO: 81870 - DNA, 32 bp, homo sapien
ttaacctttgtcagtcrtcacctttgtcaact

SEQ ID NO: 81871 - DNA, 50 bp, homo sapien
ttttcccacatctgctaaatttatasagttatgcatgggttatccctaag

SEQ ID NO: 81872 - DNA, 50 bp, homo sapien
ttcctctactcacttccaaacttccrcaaactaacctgtttatgctgtta

SEQ ID NO: 81873 - DNA, 50 bp, homo sapien
ccttgacaggtgggtttatttcttayggaatcagaccttttggctacagt

SEQ ID NO: 81874 - DNA, 50 bp, homo sapien
ctttaaactgtttagagagaaaagcrgcaacttctatcttgattgactac

SEQ ID NO: 81875 - DNA, 50 bp, homo sapien
gccagtcgcaatcatgtagactagarcaacactctacatcccagaggagt

SEQ ID NO: 81876 - DNA, 50 bp, homo sapien
actgcaactttggacaagatacttamactttccaaaccggagtttcttct

SEQ ID NO: 81877 - DNA, 50 bp, homo sapien
ggcattgcattgatttcattggaaarccttttcatcataaacaacaaata

SEQ ID NO: 81878 - DNA, 50 bp, homo sapien
cagttaaaaaagtattcaagagaccrataggtagaagtaacctttgcagg

SEQ ID NO: 81879 - DNA, 50 bp, homo sapien
ataactaagatatatgtaaacataakaaacactcacacaaaacatctgtc

SEQ ID NO: 81880 - DNA, 50 bp, homo sapien
aattaagaggataacaggcagtagcrgtcctgaagaacagtggtttgcaa

SEQ ID NO: 81881 - DNA, 50 bp, homo sapien
tcacctgaaggtttgttaaagcacasattgctgggcctcattcacagttt

SEQ ID NO: 81882 - DNA, 50 bp, homo sapien
cctctcaaggccaactataggctcckcttgccctgtacaaaactaagaaa

SEQ ID NO: 81883 - DNA, 50 bp, homo sapien
tttattctttccaatgattcaaagayggttagaggatttaaccttacccc

SEQ ID NO: 81884 - DNA, 50 bp, homo sapien
gtatacagtggcattctctatttctsacacttgactcagggagattctcc

SEQ ID NO: 81885 - DNA, 50 bp, homo sapien
ccttgttgctcctatttgtttatccrtgagttgtttaatctacgttagcc

SEQ ID NO: 81886 - DNA, 50 bp, homo sapien
gaaccactgaacaaatcagatcaaarcctgaaatgatcaaattgtttcca

SEQ ID NO: 81887 - DNA, 50 bp, homo sapien
aaactcatacaatacctaaaaccaayaagttctcacagatatttatatat

SEQ ID NO: 81888 - DNA, 50 bp, homo sapien
caaaatacatttaattcttttacacwctctataggtattttgatttcaac

SEQ ID NO: 81889 - DNA, 50 bp, homo sapien
cagggcagccgcactccatgtgatawctcagtggtattctcaagacaaag

SEQ ID NO: 81890 - DNA, 50 bp, homo sapien
actgtaaaaaaatttaggagtgttaygttctcattttgaatgaggaactc

SEQ ID NO: 81891 - DNA, 50 bp, homo sapien
gagcagtctgcttccaatttcaacasagcattaaggtaccctatagccat

SEQ ID NO: 81892 - DNA, 50 bp, homo sapien
ctcacctcatttgtttgccagttcartattctgttctgcagttcaatatg

SEQ ID NO: 81893 - DNA, 50 bp, homo sapien
cactcaaacccaactgacaggaccaytgcctattaaccaggatgaaaaca

SEQ ID NO: 81894 - DNA, 50 bp, homo sapien
aaaagacagctccaagcagtgcaaasataatctggactctactcccttct

SEQ ID NO: 81895 - DNA, 50 bp, homo sapien
taatatattaatatagtgctattgaygttattgattgacatattcttttt

SEQ ID NO: 81896 - DNA, 50 bp, homo sapien
gcttttgtcagaatgcctggactggycaacaaatgttttgaatacatgat

SEQ ID NO: 81897 - DNA, 50 bp, homo sapien
tttccagctgggatcctgattgatayggtcacattgagattttgattgag

SEQ ID NO: 81898 - DNA, 50 bp, homo sapien
aaaatggattaaagacttaaatctartaattcagcctatgaaacttctaa

SEQ ID NO: 81899 - DNA, 50 bp, homo sapien
cacacacacacagtgtaccaggatgsagcatgtttttagactcggccgtt

SEQ ID NO: 81900 - DNA, 50 bp, homo sapien
tcccatgtccaagctctaaacacagrttatatcctatttggagcctttaa

SEQ ID NO: 81901 - DNA, 50 bp, homo sapien
ttcactccttaagacctctttaagarcaagaactatgtggagagatcctc

SEQ ID NO: 81902 - DNA, 50 bp, homo sapien
tcttaataaactttctgaatgctaawctctatttcagagcctgctttcca

SEQ ID NO: 81903 - DNA, 50 bp, homo sapien
gttttattgaggctaggcagtaatamacagattatctcactgcttaccaa

SEQ ID NO: 81904 - DNA, 50 bp, homo sapien
gtaacaaaaataatagtacttcttaygtctggcactacacactttagtat

SEQ ID NO: 81905 - DNA, 50 bp, homo sapien
atctatttcttcagatgagctctaasagaattatagacttcaagtggtga

SEQ ID NO: 81906 - DNA, 50 bp, homo sapien
aaggcaacttttgaagaaattgtgayggatcatattatactcttccacct

SEQ ID NO: 81907 - DNA, 50 bp, homo sapien
taagaggtggggtcattaaaacgtgrttaagtcctgagggcagaggcctc

SEQ ID NO: 81908 - DNA, 50 bp, homo sapien
ttcatggatggcatgtgctgattacwagaagaaaaataatgacctctgac

SEQ ID NO: 81909 - DNA, 50 bp, homo sapien
cacatggacaggatgataatgattaygtgaaataaaatgatagctcactt

SEQ ID NO: 81910 - DNA, 50 bp, homo sapien
tttatcatcagtgaaacaggaataaygatagtactgtcccacaggcttgt

SEQ ID NO: 81911 - DNA, 50 bp, homo sapien
ttcccatcagccatcaagcagtaacmatttcgagcagttaggctttgaag

SEQ ID NO: 81912 - DNA, 50 bp, homo sapien
gagaaatctgggtcttgcattactaygtccattacagatgtacacttcaa

SEQ ID NO: 81913 - DNA, 50 bp, homo sapien
ggaaaagtaaggtcccacaaaaactraagaaagagagaaatataaagcaa

SEQ ID NO: 81914 - DNA, 50 bp, homo sapien
cacaaagttggaatttttttcataaytgtggttcaagacaaactacacct

SEQ ID NO: 81915 - DNA, 50 bp, homo sapien
catattcaaccaacaatttccatgasgtgtgaactctaagaatagattat

SEQ ID NO: 81916 - DNA, 50 bp, homo sapien
agaggatgttattgactaaaatcagktggtggaagtgagacagtagcatt

SEQ ID NO: 81917 - DNA, 50 bp, homo sapien
acatataaagacagaaatataattaygcccaaagtaatatttcattactt

SEQ ID NO: 81918 - DNA, 50 bp, homo sapien
gttcataaagagtgtaagccaattaraaccataaactaatattaccacag

SEQ ID NO: 81919 - DNA, 50 bp, homo sapien
aacaccatggtactggtacaatacaracacataaatcaatggaacagaat

SEQ ID NO: 81920 - DNA, 50 bp, homo sapien
cttaaaagggttaaaatgttttaaarttagctagtgagaatggtagcata

SEQ ID NO: 81921 - DNA, 50 bp, homo sapien
tgttttaagccatgctaatatacatsgcttggagtttgttagatctaggt

SEQ ID NO: 81922 - DNA, 50 bp, homo sapien
aaatagtagagtttccagcagaatakagagaatggaggggaggaaaccat

SEQ ID NO: 81923 - DNA, 50 bp, homo sapien
aaagcatatctggagggctagaaccragggcatctgggtgggcatcccta

SEQ ID NO: 81924 - DNA, 50 bp, homo sapien
tgaatatgaatgaatcagtcaatgtsaagtactttatcagcacagaccag

SEQ ID NO: 81925 - DNA, 50 bp, homo sapien
aatgttaaagttaccttgcaaattasaaaactcttggcacaaataaaaca

SEQ ID NO: 81926 - DNA, 50 bp, homo sapien
gtaaaactgacttaagcattaaagcrattccatttttttcctcactgggc

SEQ ID NO: 81927 - DNA, 50 bp, homo sapien
aaaatgaatgaaccacttaaaataaygtgtgaataacctaccaaatccag

SEQ ID NO: 81928 - DNA, 50 bp, homo sapien
gatctttagttcctgccaacctgtcrcaactcaaggattaaactaaacat

SEQ ID NO: 81929 - DNA, 50 bp, homo sapien
cagggcagaatgaatgctcacagaakatctgagaagaccctaagctttca

SEQ ID NO: 81930 - DNA, 50 bp, homo sapien
tcaactatcaaaaaagacagagggakgtttacaaatgcaaaaacaggtca

SEQ ID NO: 81931 - DNA, 50 bp, homo sapien
agagcagggcaatggaactgatttayccaacaacaattaaacttttcatt

SEQ ID NO: 81932 - DNA, 50 bp, homo sapien
tgggtgcctgatgtgctttcttccargggtctcctacaaaaatatcctct

SEQ ID NO: 81933 - DNA, 50 bp, homo sapien
atcttcaaattttatagttgacagayatctaaaaaccatcatttatttta

SEQ ID NO: 81934 - DNA, 50 bp, homo sapien
gagtttttgtgttgcttctacttgckgtcacttatactgtgcttcccttt

SEQ ID NO: 81935 - DNA, 50 bp, homo sapien
tgaattttaccaaatgttgaaaaaaragaatgagtactacttcacaaatt

SEQ ID NO: 81936 - DNA, 50 bp, homo sapien
agaaatgaaagatgtgccatctatamctcaagaatgcactaacaatgaca

SEQ ID NO: 81937 - DNA, 50 bp, homo sapien
ctgacttcaagacgtcattgatcttmaaaatgtgctgactttatgtgcaa

SEQ ID NO: 81938 - DNA, 50 bp, homo sapien
tggcctcagacaacatctgtgcaaayatgaaatgacagaacggatgtgca

SEQ ID NO: 81939 - DNA, 50 bp, homo sapien
tatgtcaatgttttaataaccagcaygattgtagctgtgtataccacctt

SEQ ID NO: 81940 - DNA, 50 bp, homo sapien
cgcctgcaagatttccactcttcacygactgtatcagcccagcctcatct

SEQ ID NO: 81941 - DNA, 50 bp, homo sapien
tatctgtgccacctgtgcctcctcamgtccttagcatgcccccagggaag

SEQ ID NO: 81942 - DNA, 50 bp, homo sapien
cagttaaagatatcctgttggaaacmatcctaaaaatcacatatatcatc

SEQ ID NO: 81943 - DNA, 50 bp, homo sapien
ttacctaatgaaacagtccaatcaartagttctctgcttaaacctcttca

SEQ ID NO: 81944 - DNA, 50 bp, homo sapien
gggagttgttagtgttgagtaccacratctcttcttggaaaatcttcttt

SEQ ID NO: 81945 - DNA, 50 bp, homo sapien
gtgctgtcataagaaagtgtgtagayctgaacaggagcatgtctgatgtc

SEQ ID NO: 81946 - DNA, 50 bp, homo sapien
atccttaatgtgtttgttcctagcartaaaatgcaagataggctaggtcc

SEQ ID NO: 81947 - DNA, 50 bp, homo sapien
gtttttaacaacagtcccgacaacartgttctatcatctgacctgtggat

SEQ ID NO: 81948 - DNA, 50 bp, homo sapien
tggagtgtctttgctaaaagctctgktctcaaagccccaaatataaaatt

SEQ ID NO: 81949 - DNA, 50 bp, homo sapien
ttgggaaatggaagaaagcatcatartaatgtgggtgatgagagatttag

SEQ ID NO: 81950 - DNA, 50 bp, homo sapien
gaaccctgtccacaattagagttcargtatacgcagacatgtttaaagac

SEQ ID NO: 81951 - DNA, 50 bp, homo sapien
ctgcatattttcccttgtattagtcrcctttatccacaataattctgcac

SEQ ID NO: 81952 - DNA, 50 bp, homo sapien
ggtccttcctttctttgtgagaacaygtcttgggtagcctctggatgaag

SEQ ID NO: 81953 - DNA, 50 bp, homo sapien
aatactctgcccatcttaagatctayatctgaaaagtccctttcatcaca

SEQ ID NO: 81954 - DNA, 50 bp, homo sapien
caacatttagaaggcacactctgaawttacccaatgctacatctatgtga

SEQ ID NO: 81955 - DNA, 50 bp, homo sapien
caactgattgtatgtgacagcataaragaggtgttagagacacttttctg

SEQ ID NO: 81956 - DNA, 50 bp, homo sapien
agtattattttaaaggactttgaggraagttgtgactagtgaagaaagat

SEQ ID NO: 81957 - DNA, 50 bp, homo sapien
tttttttcaacttgtatatcagagcrtcaagaacactgcatacatttagc

SEQ ID NO: 81958 - DNA, 50 bp, homo sapien
tcaggatatatcttccctggagatayattaagcttggagcatgtaaggca

SEQ ID NO: 81959 - DNA, 50 bp, homo sapien
gtcactcagggagtaattctcgcatsaccgagaacagtacctgacactta

SEQ ID NO: 81960 - DNA, 50 bp, homo sapien
agcaacaaacgtctcttaatacttaycagttcagctgttgtagctgaacc

SEQ ID NO: 81961 - DNA, 50 bp, homo sapien
atacattcaaccaatacatactgacrgcctaataagtgtcaggtactgtt

SEQ ID NO: 81962 - DNA, 50 bp, homo sapien
attctatttatgtctggaaatctatsctatggtctactttgaagtgctat

SEQ ID NO: 81963 - DNA, 50 bp, homo sapien
gtagttcaggacaggaaagggaataygtttgtgcctgttgagggtcatca

SEQ ID NO: 81964 - DNA, 50 bp, homo sapien
cttggtgaaaggaatgtagtgaatcrataatcattaacgagctgtctggt

SEQ ID NO: 81965 - DNA, 50 bp, homo sapien
atttccattggggatctatcttgcgkcataattagaactgtgaaggtgaa

SEQ ID NO: 81966 - DNA, 50 bp, homo sapien
gtgtatgtgtgcatgcatgtacagaygaactagatagaaacagtctgccc

SEQ ID NO: 81967 - DNA, 50 bp, homo sapien
ccgctggccttctttttttgttttayctgggcaaatatgattacttcaaa

SEQ ID NO: 81968 - DNA, 50 bp, homo sapien
tactataaacatttagctagaatcaytagtttagagaagatgagattttg

SEQ ID NO: 81969 - DNA, 50 bp, homo sapien
attacttcaacatcgtgttcaatagrctattaggaaacttctaattcatg

SEQ ID NO: 81970 - DNA, 50 bp, homo sapien
ctaaagtttttcttttaacggaacamatgaattagaagtttcctaatagc

SEQ ID NO: 81971 - DNA, 50 bp, homo sapien
tgaaatcaaaagagatgaaattcacractatttaattttgctgcttatgg

SEQ ID NO: 81972 - DNA, 50 bp, homo sapien
ccatgagagaggataaagtaagaaaycgtgagagaggataaagtaagaca

SEQ ID NO: 81973 - DNA, 50 bp, homo sapien
gtgacagagaccatatggcacacaastctaaaattttactatcttgccct

SEQ ID NO: 81974 - DNA, 50 bp, homo sapien
gaaggactgcttagcaaaaggagaamtgacacatcacctgtggaatcccc

SEQ ID NO: 81975 - DNA, 50 bp, homo sapien
tgatgtgctaatattgaaaagttackcctttaaagacaaagcaccttgca

SEQ ID NO: 81976 - DNA, 50 bp, homo sapien
gttttaatcactagtaatattaagakgctttatacacttcttatgctgtc

SEQ ID NO: 81977 - DNA, 50 bp, homo sapien
ttagatgatgagagtgggaaggggakaaaaaatgcaaggaagagggacag

SEQ ID NO: 81978 - DNA, 50 bp, homo sapien
tctgcagtggtggcagtacagatgasaagaagtggttaaattttgtatat

SEQ ID NO: 81979 - DNA, 50 bp, homo sapien
caagtatatggattcatggcaataaygaagataaatatcaagtttgtcat

SEQ ID NO: 81980 - DNA, 50 bp, homo sapien
agagtttcttataaagctaaccacawacctaccttatacacagaaattct

SEQ ID NO: 81981 - DNA, 50 bp, homo sapien
cctcttagagaagctgctgttggaaraactttataagcattccttcacag

SEQ ID NO: 81982 - DNA, 50 bp, homo sapien
caccctattttcttaatgcctttcasactaagatgcacacatcatgagta

SEQ ID NO: 81983 - DNA, 50 bp, homo sapien
aggttgatttatatttggtagtttarcttttcattataaactcaatattc

SEQ ID NO: 81984 - DNA, 50 bp, homo sapien
cttgagtggtacaattacatttaaastagattcagttatttacatcttta

SEQ ID NO: 81985 - DNA, 50 bp, homo sapien
gcacaagagacacagatgattattayaccttccaagacttactacacaat

SEQ ID NO: 81986 - DNA, 50 bp, homo sapien
tccaaagagatcaaaacttagaatgmtgtcacattgtccaaggcaacact

SEQ ID NO: 81987 - DNA, 50 bp, homo sapien
atgtgtttttcctctctaatttttcwaaacactttcatggaactctacgc

SEQ ID NO: 81988 - DNA, 50 bp, homo sapien
aatgttcttcagttttatttttatamcgcagaatgccaaaatttgaagag

SEQ ID NO: 81989 - DNA, 50 bp, homo sapien
tcttctttacctatcagtttgagaartattagtatcatatgatcaaaaat

SEQ ID NO: 81990 - DNA, 50 bp, homo sapien
accacatcaccacctccatctaatarcaactgcctccaacagttttggac

SEQ ID NO: 81991 - DNA, 50 bp, homo sapien
ctaaagtgctctctttgctgtttcawctgattcccctcgatatcatgttc

SEQ ID NO: 81992 - DNA, 50 bp, homo sapien
gacagcctcagctccttctgttcaascagaagttctgactcccagtgtcc

SEQ ID NO: 81993 - DNA, 50 bp, homo sapien
gcacatcattgaaggatttgtggaaraaacgaagcttgaaggcagtcatt

SEQ ID NO: 81994 - DNA, 50 bp, homo sapien
cataaagcccagctaaatcagaatasaggttgagaaaattgggaaaattt

SEQ ID NO: 81995 - DNA, 50 bp, homo sapien
atttctctgtctcagatctaggaagyaaaccctgcctctgctgtctctgt

SEQ ID NO: 81996 - DNA, 50 bp, homo sapien
gcacttagtaaactgtgaagtaccayataaatctataaaatgtgaattgt

SEQ ID NO: 81997 - DNA, 50 bp, homo sapien
gtactcactctggcaccacagattcytataaacaccaaaggaagcaggtt

SEQ ID NO: 81998 - DNA, 50 bp, homo sapien
ttcttccctgctcagtagatgggaawtaccctcattgtatagaatttctg

SEQ ID NO: 81999 - DNA, 50 bp, homo sapien
ggaagtcttgagtaatcttttagaartacatgaaattaaaaattttttaa

SEQ ID NO: 82000 - DNA, 50 bp, homo sapien
cagaaccaaaacacatgcctgaagastatgcatttaaggagtcatttctg

SEQ ID NO: 82001 - DNA, 50 bp, homo sapien
atagtaatagatgaagcataatagayggagtgtgtggttgcaattcacaa

SEQ ID NO: 82002 - DNA, 50 bp, homo sapien
cattatatgaagtagattgggatcaracttaccaatattagctgtggccg

SEQ ID NO: 82003 - DNA, 50 bp, homo sapien
ggttagtccctctgtctttaactcargtatagtaatagatgaagcataat

SEQ ID NO: 82004 - DNA, 50 bp, homo sapien
aatgtaaagtagccagttggtcaacrtgcagatgactagaaatactttga

SEQ ID NO: 82005 - DNA, 50 bp, homo sapien
tccaacaccaacaccaaagggattargtggatttttcctctgaaggccac

SEQ ID NO: 82006 - DNA, 50 bp, homo sapien
cctttctgcagcttccttgacgtcaytggctacaggctacagctgttgct

SEQ ID NO: 82007 - DNA, 50 bp, homo sapien
agccagtgacgtcaaggaagctgcaraaaggctgtgttaacagaagcagg

SEQ ID NO: 82008 - DNA, 50 bp, homo sapien
atccgggaccaccctttctgtctaaratatacaggaacttatttgtttta

SEQ ID NO: 82009 - DNA, 50 bp, homo sapien
tatagtggaaagaaaagtaggtaccrctggaagccaaattctgactctac

SEQ ID NO: 82010 - DNA, 50 bp, homo sapien
gaacataaaatcctaagctgaggagractgtaagagattgcctggtctgg

SEQ ID NO: 82011 - DNA, 50 bp, homo sapien
tgttgatcattttttttgctgtgaawacttaattttaaatctgcaaatga

SEQ ID NO: 82012 - DNA, 50 bp, homo sapien
gcaatcctagcttgtacaagagcagrcatattaaaattttaaaaattagt

SEQ ID NO: 82013 - DNA, 50 bp, homo sapien
taacgtcctcttcaccatatcaagcmaacctaggtgaaatgggagctagg

SEQ ID NO: 82014 - DNA, 50 bp, homo sapien
aaccatggtgcaaactatggtctctkagtgatagtgatgtgtcagctatg

SEQ ID NO: 82015 - DNA, 50 bp, homo sapien
cccaggaaaccaaaactcttaccacrgcatgcaaatgtcttcatggccta

SEQ ID NO: 82016 - DNA, 50 bp, homo sapien
agagcatgaattttcctatttatgcrgagaaaaacaatagacccttttca

SEQ ID NO: 82017 - DNA, 50 bp, homo sapien
gaaggtatgatggataccattctgasgtttatcgagaggagaaaatgtac

SEQ ID NO: 82018 - DNA, 50 bp, homo sapien
ctccaaggtgatgagtgttagagtcsagagatcatgggcctaagccccag

SEQ ID NO: 82019 - DNA, 50 bp, homo sapien
atcattcataaaaaatatataatacraaaaacgctatgtctatgaaagtt

SEQ ID NO: 82020 - DNA, 50 bp, homo sapien
gaggactgaatgcgttcctcatgcaytctgttgttagtgaaacctcagtg

SEQ ID NO: 82021 - DNA, 50 bp, homo sapien
aagattctctttcctgatcgaaatgsaattctcaaaatcttggaaacttg

SEQ ID NO: 82022 - DNA, 50 bp, homo sapien
aagttgtatgtttaacacaatttaasaaactcttggataagatgcagaac

SEQ ID NO: 82023 - DNA, 50 bp, homo sapien
gaaaagtggcttctaaaaaatagcaygaggaattttgttgtgatgtaact

SEQ ID NO: 82024 - DNA, 50 bp, homo sapien
tatttggctaaaacattgcctgataygagcaagagtatatacactttaaa

SEQ ID NO: 82025 - DNA, 50 bp, homo sapien
ctggtacatcatgtgatatgagaacyatggtaggcaatcaataatgcaga

SEQ ID NO: 82026 - DNA, 50 bp, homo sapien
cattttgaaatgattcagtgcacaayaaccttgtctgggttgggttaagg

SEQ ID NO: 82027 - DNA, 50 bp, homo sapien
gcttaaagggtgtatttatcttgctkagttctagtcgcagataacttaac

SEQ ID NO: 82028 - DNA, 50 bp, homo sapien
ttcattaactgccaatatttattaasctaacctgacgtttctttggtact

SEQ ID NO: 82029 - DNA, 50 bp, homo sapien
accttccgcagattagttacatgaaraagcttgttgaaatagttcaaagg

SEQ ID NO: 82030 - DNA, 50 bp, homo sapien
aaatgtaataaattgaaaataatacmagtgaaatcgaatcagaagtcttt

SEQ ID NO: 82031 - DNA, 50 bp, homo sapien
aatgaggttttatcctttgaatagartaatccacacagtctctgaaactc

SEQ ID NO: 82032 - DNA, 50 bp, homo sapien
gaatactagccctcaaacattcttcrttatgatcctcatgtagacaaagc

SEQ ID NO: 82033 - DNA, 50 bp, homo sapien
tgagatgaattcccacaacgggaagrcactatgagcgcccagtaacagaa

SEQ ID NO: 82034 - DNA, 50 bp, homo sapien
tatcttacctaaattaaaggttctcygaagtggtcactgaaattgcaaat

SEQ ID NO: 82035 - DNA, 50 bp, homo sapien
cctgatttatttcaattgtattaggragcaaactctatcccaacacctcc

SEQ ID NO: 82036 - DNA, 50 bp, homo sapien
gactctagtgatggttcctgcccccmatagctgtaaaccttggtatggag

SEQ ID NO: 82037 - DNA, 50 bp, homo sapien
ctgctctagagggaccacattagacraataacgcattcctgccctattac

SEQ ID NO: 82038 - DNA, 50 bp, homo sapien
ttgggatgagctaccacatgggttakagtgaggaatacgagctaacccat

SEQ ID NO: 82039 - DNA, 50 bp, homo sapien
gctgtgtgcagggcccagatggcacrcttgattttctttatttatttgga

SEQ ID NO: 82040 - DNA, 50 bp, homo sapien
aatctgctacctgcgagctggagacscgagaaagccagggttgtcattca

SEQ ID NO: 82041 - DNA, 50 bp, homo sapien
gccatagataatgccaagtagaaacratcaggtgaaggagagagagactt

SEQ ID NO: 82042 - DNA, 50 bp, homo sapien
cttgctggccttacacattttactcrttctttactgagttcttttctaag

SEQ ID NO: 82043 - DNA, 50 bp, homo sapien
aagtgccctctactgagggatgcaaygattcctatttctgtcactcctct

SEQ ID NO: 82044 - DNA, 32 bp, homo sapien
cttctctgggaatccaytgatgattgtggtgt

SEQ ID NO: 82045 - DNA, 50 bp, homo sapien
aaaccagcctcattagaattgttggmaaaatagaatagcctttgagtgag

SEQ ID NO: 82046 - DNA, 50 bp, homo sapien
cccaggcttgcacacgaggaatgagrataaccacagcttcacttatcaag

SEQ ID NO: 82047 - DNA, 50 bp, homo sapien
tcattgagaatccaatatatactacycagtggaaatggggagtaaaaact

SEQ ID NO: 82048 - DNA, 50 bp, homo sapien
taaatatgcaaagaaaagaccattaycaatcactacataagcacacttaa

SEQ ID NO: 82049 - DNA, 50 bp, homo sapien
gttgttccagaaactctgctgggaawtaggttgtgacctagaagtgaact

SEQ ID NO: 82050 - DNA, 50 bp, homo sapien
gttgtgacctagaagtgaactgacastaacagtgagaaggcagggtaaga

SEQ ID NO: 82051 - DNA, 50 bp, homo sapien
ttgaagtctacctggcattctattgyattaaaattgagctggggggactc

SEQ ID NO: 82052 - DNA, 50 bp, homo sapien
gaaaaacttagaaaaatggctagtaycttgaagaaactatcttaactgat

SEQ ID NO: 82053 - DNA, 50 bp, homo sapien
tctttaatggtgaggactttagaagraccggaagaaccagctacacctca

SEQ ID NO: 82054 - DNA, 50 bp, homo sapien
cagtgttgcatgggcagtagtttcaygatggttaggagagttgtctaggt

SEQ ID NO: 82055 - DNA, 50 bp, homo sapien
ctataacttcaataatgtgtcaaaayaaataattgaaaatataattccag

SEQ ID NO: 82056 - DNA, 50 bp, homo sapien
ggactatacagtcattcagtgtttgraaatttcttatccaggaaggtatg

SEQ ID NO: 82057 - DNA, 50 bp, homo sapien
agtgtatatgatcaggagaataacaytggaactgctggtagttatcacct

SEQ ID NO: 82058 - DNA, 50 bp, homo sapien
ataatggcagatctgctactcaacckctgatgcttgataggacctgtttt

SEQ ID NO: 82059 - DNA, 50 bp, homo sapien
tctctggactcaactgttccatcggwagaatgtaggatttatcaccttat

SEQ ID NO: 82060 - DNA, 50 bp, homo sapien
tactttttcatttcattgtaaccctsaaatattatctttctcctccttgg

SEQ ID NO: 82061 - DNA, 50 bp, homo sapien
aaattaaaagagagaggacaatattwaagctaaaggaatggatcttcaat

SEQ ID NO: 82062 - DNA, 50 bp, homo sapien
tttcttctgacttgtttaaagatcayctttctgtgtactatgttgaaata

SEQ ID NO: 82063 - DNA, 50 bp, homo sapien
tcttctattctttactgacatttaakatgtgaaatttatgagaaaatttt

SEQ ID NO: 82064 - DNA, 50 bp, homo sapien
gagtttaatgccaaatattggctaamaagttctgtctttctctctcccta

SEQ ID NO: 82065 - DNA, 50 bp, homo sapien
ttcagaggaacacctaggcaattaasaccaaattttataagtctagagaa

SEQ ID NO: 82066 - DNA, 50 bp, homo sapien
gctaaatcatgtgggcataattttgyaagaaggagccaatgggccttttt

SEQ ID NO: 82067 - DNA, 50 bp, homo sapien
atttgttttctctatgtcaaacttcrtatcacttgacatggagatgtgaa

SEQ ID NO: 82068 - DNA, 50 bp, homo sapien
agaataaggggaggtttgaagaaaayagccatagtgagtgacattctaaa

SEQ ID NO: 82069 - DNA, 50 bp, homo sapien
atttcactgttatgtagctgataatkatgatcctaagaggaaaagcggag

SEQ ID NO: 82070 - DNA, 50 bp, homo sapien
gggaacgttaccttctacattaagartccagagtggggcccaagcatgtg

SEQ ID NO: 82071 - DNA, 50 bp, homo sapien
tccaatactgtgttgaactgattaaytggacttacataagggaagccaca

SEQ ID NO: 82072 - DNA, 50 bp, homo sapien
gtttctcacagcagtattaaaatgcrgcactaacagtgaggagcctggat

SEQ ID NO: 82073 - DNA, 50 bp, homo sapien
taaagagaaatgaagaaccacagtakggagtacttttctgcattgggtag

SEQ ID NO: 82074 - DNA, 50 bp, homo sapien
gcagtagggaatcagacctttagtaracacggagctcttcaaatacagag

SEQ ID NO: 82075 - DNA, 50 bp, homo sapien
gcaacttgaaggtgctacagaccaawggaatataagggattcattattta

SEQ ID NO: 82076 - DNA, 50 bp, homo sapien
ataacaagctctatagacaataaacrcaattctcaaattctcattgtggt

SEQ ID NO: 82077 - DNA, 50 bp, homo sapien
ctgtaggtttaaaataaaatttgtaygtggtaagaaagcattgtgtcatg

SEQ ID NO: 82078 - DNA, 50 bp, homo sapien
agaaggaataatagtccgtattagcmagtttatattccatgggttctttc

SEQ ID NO: 82079 - DNA, 50 bp, homo sapien
gtcctgaacattttaaacattcctgraaggtcatcagactcgttccagag

SEQ ID NO: 82080 - DNA, 50 bp, homo sapien
tttctgaagcaaatctagtgacttaygacaatcacaactaagtcaatgga

SEQ ID NO: 82081 - DNA, 50 bp, homo sapien
tgagggaactctattagaagagaaawgtctgcctttgacaatgcttatta

SEQ ID NO: 82082 - DNA, 50 bp, homo sapien
gtgattataaatcagaacatctcttyttgttctcatggtttaaaaatctg

SEQ ID NO: 82083 - DNA, 50 bp, homo sapien
aaccaaaagaatgaatcagtgacgamcaaaggataggaccatatacccaa

SEQ ID NO: 82084 - DNA, 50 bp, homo sapien
gaaacaaggaaggggtgatagagcarcgaagatggatttgagagataatt

SEQ ID NO: 82085 - DNA, 50 bp, homo sapien
cagtcatttattactccatgacaaaygactccaaggtttaggacttgaaa

SEQ ID NO: 82086 - DNA, 50 bp, homo sapien
atttcttgctgggaagcttaatctartaaaaaatctttcaacatttctgc

SEQ ID NO: 82087 - DNA, 50 bp, homo sapien
gaagttaatatgatgttagatctctkacatacgttgattataaaggtgct

SEQ ID NO: 82088 - DNA, 50 bp, homo sapien
atttgagtgaaaaggataggccttawgccaacagttcagaaatgactcat

SEQ ID NO: 82089 - DNA, 50 bp, homo sapien
gccaagggaagtgtgtcatttatcartcaaactgggtagtagcagttgaa

SEQ ID NO: 82090 - DNA, 50 bp, homo sapien
cgctaggcaggcagaatgccgatcaygaagaacacaaagacagcatgcag

SEQ ID NO: 82091 - DNA, 50 bp, homo sapien
gtaaactctttaaatattagcgggtracattaattgaaattcaaaaacaa

SEQ ID NO: 82092 - DNA, 50 bp, homo sapien
atatctaacacataatagggtgttamggcacttctacttgtaatgtctac

SEQ ID NO: 82093 - DNA, 50 bp, homo sapien
tcttctacactggttcagagtatacmcaaaacaattcttaaagactgaaa

SEQ ID NO: 82094 - DNA, 50 bp, homo sapien
accaactattctgagagatgctaaamattttgctggcgggggaatggaat

SEQ ID NO: 82095 - DNA, 50 bp, homo sapien
aagtgtcttttttggaaataggcaartcaactatcaaataggagaagtca

SEQ ID NO: 82096 - DNA, 50 bp, homo sapien
tttttcaaaaaacagtttggctcccratggaaaaagtatagatactctta

SEQ ID NO: 82097 - DNA, 50 bp, homo sapien
gcaatatttaacaacacaattgatgratttagaaatacttagacttcgat

SEQ ID NO: 82098 - DNA, 50 bp, homo sapien
gtttataatgtacatatgtcagatgsagaataatttatgaactttgtacg

SEQ ID NO: 82099 - DNA, 50 bp, homo sapien
tatattgacaatgtgggcaataaccsaaaactttagtgaggaaataagta

SEQ ID NO: 82100 - DNA, 50 bp, homo sapien
ctcttgctaaaaatctgcctactacragagaatggccaatatgaatacca

SEQ ID NO: 82101 - DNA, 50 bp, homo sapien
ataacattttgcatacacttaaacarcatatactagtacttatttcctca

SEQ ID NO: 82102 - DNA, 50 bp, homo sapien
gagacagtgacctctgttaatagcaractggataatttaaaccaactttc

SEQ ID NO: 82103 - DNA, 50 bp, homo sapien
tgagtcgttttggaagcttaatgaawgcaaaaagaggtatcatatttagt

SEQ ID NO: 82104 - DNA, 50 bp, homo sapien
cccaaaaactgatgagctccaaagamgtgaaaaaggacagaccctgccag

SEQ ID NO: 82105 - DNA, 50 bp, homo sapien
aaaggtaagttcaattatgagagaargtatgagtatggtagaggataaag

SEQ ID NO: 82106 - DNA, 50 bp, homo sapien
ggaaagggtctgacaattgagttaaygtgaaatttgtcatagtaatgagg

SEQ ID NO: 82107 - DNA, 50 bp, homo sapien
tcatcatcatctgtgtactttctcayatcccaccgttgtactccaaaatc

SEQ ID NO: 82108 - DNA, 50 bp, homo sapien
atagctgacatttattgagtacttgyatgttaggcatcctgttaaatata

SEQ ID NO: 82109 - DNA, 50 bp, homo sapien
tgttcctgtcttctctggcttgttayggtgcttgtggccattcgccttta

SEQ ID NO: 82110 - DNA, 50 bp, homo sapien
attattaagtaatagttgaaataaayaagctagtatttgtggcatataaa

SEQ ID NO: 82111 - DNA, 50 bp, homo sapien
tctccaaaatgatctcaatattcaaygtatttccagttaaaacaccaaaa

SEQ ID NO: 82112 - DNA, 50 bp, homo sapien
tgaagtttaactctttctacttaacrattcaactttttgtggcttctaga

SEQ ID NO: 82113 - DNA, 50 bp, homo sapien
tcgcaatgatcatttccatcgcaaaygataaaatctctctcctttctatg

SEQ ID NO: 82114 - DNA, 50 bp, homo sapien
taataatggccagaccttttcggaartatgtgacatgtcaaaaggaatac

SEQ ID NO: 82115 - DNA, 50 bp, homo sapien
ccattcctcctctagttccatctgayattctgtaagttagggtttaaact

SEQ ID NO: 82116 - DNA, 50 bp, homo sapien
agagagccctctatataggctatatkgagagtttatttgaaccacacaag

SEQ ID NO: 82117 - DNA, 50 bp, homo sapien
aaagtggtgaattatcgtattttccratgtttgagtcccacctctccaag

SEQ ID NO: 82118 - DNA, 50 bp, homo sapien
tatgcaactgttactttttgacttgyagagcaatatcttctttccacggt

SEQ ID NO: 82119 - DNA, 50 bp, homo sapien
ggaggtaagcatgggaaaattgacartcaggtccaaggaaataaaaacaa

SEQ ID NO: 82120 - DNA, 50 bp, homo sapien
gataccccagtagcaattaacatackgattaaccagatcttggcttctaa

SEQ ID NO: 82121 - DNA, 50 bp, homo sapien
aaagtgtacacatccctgttcaaccsagatgtttattgtcatgggtgtgg

SEQ ID NO: 82122 - DNA, 50 bp, homo sapien
cttcaacccatactccaggaaattamcacataatattattaggcagatat

SEQ ID NO: 82123 - DNA, 50 bp, homo sapien
caacttattcaaggcatatttattayattatctccagctactatatggct

SEQ ID NO: 82124 - DNA, 50 bp, homo sapien
attctcattcttacagctaagcagaragataaagtggattatctaaggtc

SEQ ID NO: 82125 - DNA, 50 bp, homo sapien
tatgtcctgtaccagaatgaacttaygccaataacttgcaccttcattca

SEQ ID NO: 82126 - DNA, 50 bp, homo sapien
aacaggtgctggtctcttggtttacrctttatggtgattagcaggtcagg

SEQ ID NO: 82127 - DNA, 50 bp, homo sapien
catatttgtctacctggttcaatgamactaagcataggacttttttctta

SEQ ID NO: 82128 - DNA, 50 bp, homo sapien
gattgggggagaaaatatttgaagasataataattgataattgtccagat

SEQ ID NO: 82129 - DNA, 50 bp, homo sapien
tgtcagacttctgacatacaaactakaagatgataaatttgcattgtttt

SEQ ID NO: 82130 - DNA, 50 bp, homo sapien
ctctctcctgcaaccttgagaaccasaggtgggaaaacatgagcctgtct

SEQ ID NO: 82131 - DNA, 50 bp, homo sapien
cctaaagggggctttatgcagaggaygacaatacactgtgatagacactg

SEQ ID NO: 82132 - DNA, 50 bp, homo sapien
atgtaactggaagccagtggatacaraggtctagcaattgtaggttgcag

SEQ ID NO: 82133 - DNA, 50 bp, homo sapien
gtcccagctgattaatcagctatggmaactataaaccaaacatacctctc

SEQ ID NO: 82134 - DNA, 50 bp, homo sapien
ccttcgccagattctccaattgtaaygttttattgcatatgctccattgc

SEQ ID NO: 82135 - DNA, 50 bp, homo sapien
tgtgatacactttataaagcaataarataaagcaaattgtgataattaga

SEQ ID NO: 82136 - DNA, 50 bp, homo sapien
aagcgtaggtcttattaataaagaastgtaatgttgttaatggttgtagt

SEQ ID NO: 82137 - DNA, 50 bp, homo sapien
cacacatgtttatttatatgcttaaygctatcaccaatgttctagaaagt

SEQ ID NO: 82138 - DNA, 50 bp, homo sapien
gattcaaatcatgggttgcttgaaayttaatatttgttactatgtcgact

SEQ ID NO: 82139 - DNA, 50 bp, homo sapien
ctctaagaacacagtttggaaagagrcatttcagatacagagtcccatat

SEQ ID NO: 82140 - DNA, 50 bp, homo sapien
taggttcccagggattagtacaagtkcaaagccatgttcaataatttgtg

SEQ ID NO: 82141 - DNA, 50 bp, homo sapien
aaatttccaaggaaccaggatctgaygtggaaatatgtatggaagagagt

SEQ ID NO: 82142 - DNA, 50 bp, homo sapien
tttatagtttaaggaagtttgcttcycattttgatttccttctcttctta

SEQ ID NO: 82143 - DNA, 50 bp, homo sapien
tagtctgaataaattgtagtcatcaygttcatatgtgatatcacatcact

SEQ ID NO: 82144 - DNA, 50 bp, homo sapien
cttctgttttcatccagtgccactcraaaggaataatggtgatgctgtcc

SEQ ID NO: 82145 - DNA, 50 bp, homo sapien
tttgctaggtataatgccaggctaaygtcgtttattatacaacatatgcc

SEQ ID NO: 82146 - DNA, 50 bp, homo sapien
gtatattactgttgtggttatctaawgaccttaaacaattatacaattca

SEQ ID NO: 82147 - DNA, 50 bp, homo sapien
ccctctcttcatctgccattcttagraaagttgctaacaggcaccagaac

SEQ ID NO: 82148 - DNA, 50 bp, homo sapien
tgcggtataggtaggttcacaattayagtcctaggttttcagagtaaaga

SEQ ID NO: 82149 - DNA, 50 bp, homo sapien
ataataactcttattttaataatgcraagtccgtgagggcaaaaagaatc

SEQ ID NO: 82150 - DNA, 50 bp, homo sapien
agcgaacttgtggacgggtttgctayagcggtgttacacttagatgagga

SEQ ID NO: 82151 - DNA, 50 bp, homo sapien
aagacgggagtgcaatgtggagatgyatttacccaaatgtgtgtgggaag

SEQ ID NO: 82152 - DNA, 50 bp, homo sapien
cttaagatcagatttatctgaaaggrattttggcttatgcatctataaat

SEQ ID NO: 82153 - DNA, 50 bp, homo sapien
gtgtgttttcagggacagatgtaggwagagtaaatatttattcctaggtg

SEQ ID NO: 82154 - DNA, 50 bp, homo sapien
tcctcttccttggggaccaataataygacactttgcccgggagggggata

SEQ ID NO: 82155 - DNA, 50 bp, homo sapien
gaaaccttgggcctctttactatcasattttcagcttgcattaggatcat

SEQ ID NO: 82156 - DNA, 50 bp, homo sapien
cttcaaatcctttcctgaccagttaygctccgcacatgaattgcctggca

SEQ ID NO: 82157 - DNA, 50 bp, homo sapien
aaaatacaaaacataaactttatttstcagcacataattcatcaaggtca

SEQ ID NO: 82158 - DNA, 50 bp, homo sapien
gtacatcatctcctgcgttagaactrgagacaaacatacaactaattatt

SEQ ID NO: 82159 - DNA, 50 bp, homo sapien
gtcattacatattttgagcaagtaartaagtaaaggtcttctgtgtgctc

SEQ ID NO: 82160 - DNA, 50 bp, homo sapien
tttcaaaatcctcagtgggcaaaaasctaccaacacagccacaatttttt

SEQ ID NO: 82161 - DNA, 50 bp, homo sapien
ttcaaccaatgagtcgttcttggtasgtttacttcctctaactctctgtc

SEQ ID NO: 82162 - DNA, 50 bp, homo sapien
aatatttaacggtgagaatccaacaktagacatcaaggcgctttgggtat

SEQ ID NO: 82163 - DNA, 50 bp, homo sapien
gatacacttagcagatgagagaaatkatatactaaaggcatcaattgcat

SEQ ID NO: 82164 - DNA, 50 bp, homo sapien
ttaaacatgatgtggcatatagaatwatacaaaaagtgggtacctacagt

SEQ ID NO: 82165 - DNA, 50 bp, homo sapien
ttcaccttgtgatcctgtcagtcaayaatccttaataaactccccttcat

SEQ ID NO: 82166 - DNA, 50 bp, homo sapien
gatgcctcaaatcccccaaattggarccattctcaatccttccaacttcc

SEQ ID NO: 82167 - DNA, 50 bp, homo sapien
aaaaaattgaaataatgtgaacaaargtatttcctaacatagggcttcag

SEQ ID NO: 82168 - DNA, 50 bp, homo sapien
ttgagtttggaaaccactaagatcasattaatacataataatattgatta

SEQ ID NO: 82169 - DNA, 50 bp, homo sapien
cagatctaattacttattttggtaargtcacctaatttgggaaaaagctc

SEQ ID NO: 82170 - DNA, 50 bp, homo sapien
cctcaattttaatgatatatgtataygattgagcaggacattaccaacta

SEQ ID NO: 82171 - DNA, 50 bp, homo sapien
aacagtggtgcaggaaatagcacgtrtggctcccaggcaatccactgggg

SEQ ID NO: 82172 - DNA, 50 bp, homo sapien
agttttcatttaattaagaaggctawcctttagaatgacagtttatttat

SEQ ID NO: 82173 - DNA, 50 bp, homo sapien
acagtcaattccacttgcttgcaaasgaaaaaccaccactgtaacgcagc

SEQ ID NO: 82174 - DNA, 50 bp, homo sapien
ataacaaaagacaaatagtcaaggargaatcagcattctgtcagggataa

SEQ ID NO: 82175 - DNA, 50 bp, homo sapien
tctgacacccaatcacaccaaccaawtctatgacaccaattgggtgtccc

SEQ ID NO: 82176 - DNA, 50 bp, homo sapien
gggcctctctaatcaaccagacatcrcaaaccagacacagagactgcccc

SEQ ID NO: 82177 - DNA, 50 bp, homo sapien
agatatgatgacagcctcaaccaaasatataattgacaaataaatggcct

SEQ ID NO: 82178 - DNA, 50 bp, homo sapien
aaactaaaatcaaattacaaatccgrccattgtatggtgaacgttagaga

SEQ ID NO: 82179 - DNA, 50 bp, homo sapien
ttcatttttgcccatatctccacaaycttatctactccaactacacgtgg

SEQ ID NO: 82180 - DNA, 50 bp, homo sapien
attcaagtcctaaggtatataatttsaaaccatggtcacagttgctaaaa

SEQ ID NO: 82181 - DNA, 50 bp, homo sapien
tcttcatttctgacacacagctagawgacacttaccagctttcttgcagt

SEQ ID NO: 82182 - DNA, 50 bp, homo sapien
tacaccccaggggagtcactgggaaraaacgagggagctgaagggacact

SEQ ID NO: 82183 - DNA, 50 bp, homo sapien
aaagaaggggttttcatattgactamggatgccagaatttggggcacaga

SEQ ID NO: 82184 - DNA, 50 bp, homo sapien
gtgaataaaaaagttggcccaaccartaagaaggaccacagccctgcata

SEQ ID NO: 82185 - DNA, 50 bp, homo sapien
atgagttcttattcactccttactastacaatcatctcatcccatctttt

SEQ ID NO: 82186 - DNA, 50 bp, homo sapien
tggctaaaatgtagagtgaagagaargttttgaaaatacaatgactggga

SEQ ID NO: 82187 - DNA, 50 bp, homo sapien
tgttggcaccattcatcagaatgggkaatataatgatagtagcagcaagc

SEQ ID NO: 82188 - DNA, 50 bp, homo sapien
tgtgtttgtaataggtttttctttargcgccaattgaagtgatctatact

SEQ ID NO: 82189 - DNA, 50 bp, homo sapien
ccctctgagacacgtaaactcgaaayggcagcatagagaaggaaatgaag

SEQ ID NO: 82190 - DNA, 50 bp, homo sapien
atgttttccaaatgccaaatagggaygcatattctgatacgttatctgac

SEQ ID NO: 82191 - DNA, 50 bp, homo sapien
ccaatttagtgctacttaccttttcraagagctgaccaaaattcacgcaa

SEQ ID NO: 82192 - DNA, 50 bp, homo sapien
caggctaagctcgcagttctttccayggttagtaagcagtcattaactat

SEQ ID NO: 82193 - DNA, 50 bp, homo sapien
gactgttgcccacagtacaagaaagragctaaactgacatgccaactctc

SEQ ID NO: 82194 - DNA, 50 bp, homo sapien
cagaactagaacaagccaataataayaataattgaacatttaaaaataac

SEQ ID NO: 82195 - DNA, 50 bp, homo sapien
actcttagaactgtcattttggtaaygtactggtaactttgcataatgga

SEQ ID NO: 82196 - DNA, 50 bp, homo sapien
gagtgtaacctcacagtgaaattccycccaagtctttggctctgcaggaa

SEQ ID NO: 82197 - DNA, 50 bp, homo sapien
cattgagaaagtcatcccatcttacyatctctaacctatgtgggtgggat

SEQ ID NO: 82198 - DNA, 50 bp, homo sapien
tgaacaatgttttattgtctctttayatgttgactaagtacagatctatt

SEQ ID NO: 82199 - DNA, 50 bp, homo sapien
atacgtaattactagcaaagacaaastattatgaaagaaataaagagcga

SEQ ID NO: 82200 - DNA, 50 bp, homo sapien
tgagtcatgggagatgggaaaaaaarcgtagcaaccaacagagacttaag

SEQ ID NO: 82201 - DNA, 50 bp, homo sapien
atcaaaaaagatatgaacttatttakcttttgctattgctataatcatca

SEQ ID NO: 82202 - DNA, 50 bp, homo sapien
ctcaggcggtgaggttgaccacaaascatatagcattctaggaggtgaat

SEQ ID NO: 82203 - DNA, 50 bp, homo sapien
ttattggcacagaaatacaaaaacawtgacccatggaacagaatgaagat

SEQ ID NO: 82204 - DNA, 50 bp, homo sapien
gagataagaaagaaaggattttgcaygttcctgggaatctaggcacgttt

SEQ ID NO: 82205 - DNA, 50 bp, homo sapien
aacttaatatatctcaaaggtgcaaytgaagatcatcgtggaataaagag

SEQ ID NO: 82206 - DNA, 50 bp, homo sapien
ttagctgggctgaatgctggaagaargaccttgccaatcacagtccagag

SEQ ID NO: 82207 - DNA, 50 bp, homo sapien
gactcggtgcctacttataagttaaygtccgatgtttgtctgtcgttttt

SEQ ID NO: 82208 - DNA, 50 bp, homo sapien
catctgtagtgtttcgtctgcaagtraattaacatatgccctattcagca

SEQ ID NO: 82209 - DNA, 50 bp, homo sapien
catttgtcagacactgtcctgggtamctttgtgcttattgtttcatttaa

SEQ ID NO: 82210 - DNA, 50 bp, homo sapien
cactgctctttactcccagagtgccragtcagtggtagccagggattaag

SEQ ID NO: 82211 - DNA, 50 bp, homo sapien
tgttcatttataaaatcagtagctcragttggatgatttttaacacctgt

SEQ ID NO: 82212 - DNA, 50 bp, homo sapien
atagaacataatgttttattataagycataggtacagaacttagactgca

SEQ ID NO: 82213 - DNA, 50 bp, homo sapien
tcctctaatcatctggtccccttatyacccgtgccatcctaggagggagg

SEQ ID NO: 82214 - DNA, 50 bp, homo sapien
agaaagtaaaccccaaagctcatgawgccaaggtcagtgcattttattta

SEQ ID NO: 82215 - DNA, 50 bp, homo sapien
cacccatagatgtactgcagtctatratatataacccttgcattaaagaa

SEQ ID NO: 82216 - DNA, 50 bp, homo sapien
gaactttacaaaaaaaacttaatcayactttcttgaatactttctaaaac

SEQ ID NO: 82217 - DNA, 50 bp, homo sapien
agccagtgcaaacacgtatttgttgmatgttgttgaagagagtgtaaaat

SEQ ID NO: 82218 - DNA, 50 bp, homo sapien
attttgctgtggagactatattaacycacaaaacaaagaaccataaagaa

SEQ ID NO: 82219 - DNA, 50 bp, homo sapien
atctctgaaggaaacaaaatgtaagyctgtcttaatacctacactgttgg

SEQ ID NO: 82220 - DNA, 50 bp, homo sapien
caggctcatcttctacagttgcaacsaattaacaaaggtagagtttccta

SEQ ID NO: 82221 - DNA, 50 bp, homo sapien
caaaacaagaaagtcaactccgtaaygaagtggctattttacaggtaaaa

SEQ ID NO: 82222 - DNA, 50 bp, homo sapien
tgacaaaatgtggcaaagtatcctargtattttaagctcctggaatgaat

SEQ ID NO: 82223 - DNA, 50 bp, homo sapien
aaaatgacaaaatcagggcgagggtsaatgttcccatcaaagcagaaatg

SEQ ID NO: 82224 - DNA, 50 bp, homo sapien
aactgtctactacatctaacccttayttgaatctgttcccaattattcta

SEQ ID NO: 82225 - DNA, 50 bp, homo sapien
tggactaggctatatgcagagattcraacaagctatagataataggtgtg

SEQ ID NO: 82226 - DNA, 50 bp, homo sapien
aaatatatggtcaatttatttttaawgtttcatatgtgcttcaaagtatg

SEQ ID NO: 82227 - DNA, 50 bp, homo sapien
ggaggaggctcatgtgcccaaaatgsagtcagtaggagataaggtcagag

SEQ ID NO: 82228 - DNA, 50 bp, homo sapien
aaacacatgaaaagcattcaatatcrttgttcatcattcaaataaaaaca

SEQ ID NO: 82229 - DNA, 50 bp, homo sapien
tgcttattaataattttccatgtcaygtctgtcatcagagaaggaaggtc

SEQ ID NO: 82230 - DNA, 50 bp, homo sapien
aaagatagtcttgtattaaatttagwatgaaaatagcatagagacatcct

SEQ ID NO: 82231 - DNA, 50 bp, homo sapien
atatcagcaattaccttagatcttcycaataaactttcatttacatacat

SEQ ID NO: 82232 - DNA, 50 bp, homo sapien
gattctagagttgaatcaactgctamattaaaaattgagatcattacaaa

SEQ ID NO: 82233 - DNA, 50 bp, homo sapien
cagtccccagagacagtgattggtayggccaagtcgattacacagtaata

SEQ ID NO: 82234 - DNA, 50 bp, homo sapien
ttgtagtgcagcatattcctctccamtctgtgcccaggtagatctccagg

SEQ ID NO: 82235 - DNA, 50 bp, homo sapien
agtctcctgcttagaccagatttcayggcaatcccttgaaactcatttga

SEQ ID NO: 82236 - DNA, 50 bp, homo sapien
tatacactatccttttcaaaacagcratatagcttaagaaccggcaatat

SEQ ID NO: 82237 - DNA, 50 bp, homo sapien
taacaggtagaagatctgctaagcargtaagggaaataaatagactaggg

SEQ ID NO: 82238 - DNA, 50 bp, homo sapien
tggatgtctaagtaaaatatctccaygcaactgtgaacatttgtcaacaa

SEQ ID NO: 82239 - DNA, 50 bp, homo sapien
aagttgatttaaaatatgaaattacragaaatgaaaaatagaatttccta

SEQ ID NO: 82240 - DNA, 50 bp, homo sapien
aggcaatattgaaacttaatgatccyatagtcaccaaaaaacaataaaag

SEQ ID NO: 82241 - DNA, 50 bp, homo sapien
aatccttgtgtttcaaagcataaaawgataaccagctggagttaggaaaa

SEQ ID NO: 82242 - DNA, 50 bp, homo sapien
gacataaaattatattttggacagaraagaatcagtgggtaatatcaggt

SEQ ID NO: 82243 - DNA, 50 bp, homo sapien
agataagaaattttattgctattaayggtgtaagattcattcacagctta

SEQ ID NO: 82244 - DNA, 50 bp, homo sapien
aagaaccaaaatagtcaatgctgtaygtgaatatcaaaaactgaaaaaat

SEQ ID NO: 82245 - DNA, 50 bp, homo sapien
aaaaagcaggggataggataaggacygagtatggagagcagcaaaaatta

SEQ ID NO: 82246 - DNA, 50 bp, homo sapien
gaatataaatgaagcctacatacctraattattttactgaataaaatgcc

SEQ ID NO: 82247 - DNA, 50 bp, homo sapien
ttctttttctctttctattaatgtgmacctctagctatatttagtgttct

SEQ ID NO: 82248 - DNA, 50 bp, homo sapien
agaaacccaggaaatctaaactaaawtctgcagatctgtcttggttattc

SEQ ID NO: 82249 - DNA, 32 bp, homo sapien
taaaaaaatcaaataakagtaaccaattttaa

SEQ ID NO: 82250 - DNA, 50 bp, homo sapien
ttcagatgacctaaggctaccacaasgattaagtaatgacaatttcccca

SEQ ID NO: 82251 - DNA, 50 bp, homo sapien
aatcgagattaaatagaagctgctasagtgtattatattttacatttctg

SEQ ID NO: 82252 - DNA, 50 bp, homo sapien
ggaaatcaaggactgcttgtacttartaaatgttgcagtggataatagag

SEQ ID NO: 82253 - DNA, 50 bp, homo sapien
aataagtggacctttcaaagcaacamaaatttagcaaggtagcaaggggt

SEQ ID NO: 82254 - DNA, 50 bp, homo sapien
attgtataatagatagcaggagacasaggattcttacactgagatagcag

SEQ ID NO: 82255 - DNA, 50 bp, homo sapien
gcagcttctatgtgccagacactgcygagtgatttccataacctaccttt

SEQ ID NO: 82256 - DNA, 50 bp, homo sapien
ataacttcactgaccacatattatcmaaaacagcttgtcacgtggtttag

SEQ ID NO: 82257 - DNA, 50 bp, homo sapien
ttgctcaaaaaggtctttgcagttgratgaggagatgaacaaggcctata

SEQ ID NO: 82258 - DNA, 50 bp, homo sapien
tccccttgtaagataagacagtcaarttgggagcaggcatggctgcaccc

SEQ ID NO: 82259 - DNA, 50 bp, homo sapien
ttacttttttgtgactttcagtaagkagttcattagcgtgttacatactg

SEQ ID NO: 82260 - DNA, 50 bp, homo sapien
taggggtgacgcttcaaacaaatacyaacggcaaacagggaattttatcc

SEQ ID NO: 82261 - DNA, 50 bp, homo sapien
tcttcctccacgtcatgataccaacygaaattacctttaaatgaggaaga

SEQ ID NO: 82262 - DNA, 50 bp, homo sapien
gccccagccttgacatcttattacakagcaaatgctggctttttaatttc

SEQ ID NO: 82263 - DNA, 50 bp, homo sapien
gggaagctgaaggataatgacatgasaccaggataaactggcagagcata

SEQ ID NO: 82264 - DNA, 50 bp, homo sapien
ccagtgaactgaaaactcagcttcckgcttagaacagtccataaggatgg

SEQ ID NO: 82265 - DNA, 50 bp, homo sapien
tttctctagttgagaaatgaagtaayattgttgattcagggaaatcattt

SEQ ID NO: 82266 - DNA, 50 bp, homo sapien
ttcatgctgactagatatcagaggckctccacttttcagcaccttctttt

SEQ ID NO: 82267 - DNA, 50 bp, homo sapien
catcagatttgactaaactgggcatyttgagttttagcttcataaaatca

SEQ ID NO: 82268 - DNA, 50 bp, homo sapien
tcacgccagcttgaaaagtggctatyggccaggaatctgacataattaaa

SEQ ID NO: 82269 - DNA, 50 bp, homo sapien
aaaaaatgctaaatgatccagagagrcctaataaagtgactgtttaaagt

SEQ ID NO: 82270 - DNA, 50 bp, homo sapien
cttgggatcagtcaaactcaatgcawcagcaaatcttcactgaaggtgcc

SEQ ID NO: 82271 - DNA, 50 bp, homo sapien
cctattaaaaatgtttgttccgggcrgatggttgcttccagcagcctctg

SEQ ID NO: 82272 - DNA, 50 bp, homo sapien
tttcttcttctgtaaaaggagacaamaatagagctgttgggaagatcaag

SEQ ID NO: 82273 - DNA, 50 bp, homo sapien
aaactcaccaactaccaaatgtaagraacactttaaacagtcactttatt

SEQ ID NO: 82274 - DNA, 50 bp, homo sapien
atgattttcagaagtggactttttascttaatgtatgaaataactcaaaa

SEQ ID NO: 82275 - DNA, 50 bp, homo sapien
gccccatccgggcctcgcacggtgasctagtggaccaagcaatgcagaca

SEQ ID NO: 82276 - DNA, 50 bp, homo sapien
tcttatgttgtggatgagcaaccaaygatttgtgcctcatacaggcaatt

SEQ ID NO: 82277 - DNA, 50 bp, homo sapien
gcaattcagaagcttactgataagasagtctctggctaatgcacattgat

SEQ ID NO: 82278 - DNA, 50 bp, homo sapien
ggagtctaatggaagatacccactgraatttgagaccctagaaggtactt

SEQ ID NO: 82279 - DNA, 50 bp, homo sapien
attcatgccattaactattcattacygagccttttttgtttgtcttgttt

SEQ ID NO: 82280 - DNA, 50 bp, homo sapien
tccatttgcccaaagaaggtaagtaygtttatatatcaattcatccgagc

SEQ ID NO: 82281 - DNA, 50 bp, homo sapien
aattttggtataatgctgatggcagkaaaaaggcatggactcactgtata

SEQ ID NO: 82282 - DNA, 50 bp, homo sapien
ggttagaatttggacattaaggatasaatttgtggcgcgggcacggtggc

SEQ ID NO: 82283 - DNA, 50 bp, homo sapien
tctgcagctccaactacttgctccaytgctcggatgaattgatatataaa

SEQ ID NO: 82284 - DNA, 50 bp, homo sapien
gcatggactaatgtttttggcactasgattcatgttctctaactaaaaga

SEQ ID NO: 82285 - DNA, 50 bp, homo sapien
actatacacgtatgtatctggtgaaytaaaatgatagcttttccttacac

SEQ ID NO: 82286 - DNA, 50 bp, homo sapien
tccatgctagctatgtgactttggtsaattcagtcaatctttttgagtct

SEQ ID NO: 82287 - DNA, 50 bp, homo sapien
ttgtaattgggcatgtatgtgttccyatgtcagtacctacatatctacct

SEQ ID NO: 82288 - DNA, 50 bp, homo sapien
ctgtgtcggaggagaatgtaaggaarcagctttgtgcagagtgaagaaaa

SEQ ID NO: 82289 - DNA, 50 bp, homo sapien
aaggtcagtttcctacccctagtccracaattaacttctacatataacca

SEQ ID NO: 82290 - DNA, 50 bp, homo sapien
ttataatgaagaggtttcagaggaaktacatgtatcccttaaaagtgctt

SEQ ID NO: 82291 - DNA, 50 bp, homo sapien
cctatgtttccttctagtacttttayggctttatgttgtacatttatctt

SEQ ID NO: 82292 - DNA, 50 bp, homo sapien
agacaaattaatgtaatgtaaggaayatagcctagtcagcaagacttaaa

SEQ ID NO: 82293 - DNA, 50 bp, homo sapien
taaaccaagtcttcttatgctttccsaggtctctcttactgggtggggag

SEQ ID NO: 82294 - DNA, 50 bp, homo sapien
cttttatttgccacatatctcagcaytatattggagtctggcaaagcggg

SEQ ID NO: 82295 - DNA, 50 bp, homo sapien
acagtgagacactcacacataatggwacatctacgtgattaaaacatgta

SEQ ID NO: 82296 - DNA, 50 bp, homo sapien
cagctatactccactggaatccagtrtctgcctttggtggtagatgttcc

SEQ ID NO: 82297 - DNA, 50 bp, homo sapien
aagaatccaagaaagtatagctacarataaataaaatatttaggactatc

SEQ ID NO: 82298 - DNA, 50 bp, homo sapien
gttagtgtccaagaactttatggaaygcagatcttaagagcaatgaacta

SEQ ID NO: 82299 - DNA, 50 bp, homo sapien
tttccaaagctggaaaattttcagayggtattgttagagaaagacagcat

SEQ ID NO: 82300 - DNA, 50 bp, homo sapien
tggggtctacagtgaacaaaagagarcttagtagctttttgcagcaccaa

SEQ ID NO: 82301 - DNA, 50 bp, homo sapien
atgaatagttctattgaaagagatamgacaagtagttccatttgaatgat

SEQ ID NO: 82302 - DNA, 50 bp, homo sapien
tccctaaacgtatttgaccattgtarcatttcattcacaaacaaagtatt

SEQ ID NO: 82303 - DNA, 50 bp, homo sapien
aaaaagaaaggaatcaagcatacaasgatagaaaactcttaagttttatc

SEQ ID NO: 82304 - DNA, 50 bp, homo sapien
ctggaccacggaaaagttatcttacrgaagacagtgagttttatcaaaag

SEQ ID NO: 82305 - DNA, 50 bp, homo sapien
actcaaattacacttacaattttcamatatagtatctggcattcaatcaa

SEQ ID NO: 82306 - DNA, 50 bp, homo sapien
gtattcgaatgtctgaggccttcaayatggagagtgttaataaaagtaag

SEQ ID NO: 82307 - DNA, 50 bp, homo sapien
ttccacatatttggccaacatgtggkagttactgtcaggaaaacatcact

SEQ ID NO: 82308 - DNA, 50 bp, homo sapien
aaaagataaaatataacaagataaayggtcccaggcagtcttgtgtgctc

SEQ ID NO: 82309 - DNA, 50 bp, homo sapien
ttaagctagaaaccattctcaatcaytgattacacataaacaccactttt

SEQ ID NO: 82310 - DNA, 50 bp, homo sapien
aacctgaagtcagaagtcatagatasagtagcattaaatgctatcgcctt

SEQ ID NO: 82311 - DNA, 50 bp, homo sapien
aattcactgcccaagtgtaatttgaygtatttttgtttgtttgttttcag

SEQ ID NO: 82312 - DNA, 50 bp, homo sapien
cgaaaatgtccctgatagtcggagawctcatgccagttgcctctcaagcc

SEQ ID NO: 82313 - DNA, 50 bp, homo sapien
tttagaattacctgtttttgctagayagctgtggcacattttaaaatgca

SEQ ID NO: 82314 - DNA, 50 bp, homo sapien
acatgtgatagtcagcagtacctccratagaaacaagtgacatccattgc

SEQ ID NO: 82315 - DNA, 50 bp, homo sapien
gaatagttcatcatttttctttagartaggtgctttgatgcattttgagg

SEQ ID NO: 82316 - DNA, 50 bp, homo sapien
agaattgtttatatgtgtacacaaaygccctaattctagtaatacctaaa

SEQ ID NO: 82317 - DNA, 50 bp, homo sapien
gcctgcaagcctataataactaatcyactcctgtgataatggcattagtc

SEQ ID NO: 82318 - DNA, 50 bp, homo sapien
cgtgctttggaaaaacacagtaagartcccttcacattgaaactagactg

SEQ ID NO: 82319 - DNA, 50 bp, homo sapien
agatgtgttcctgtggtaagaaggayaaaacaatgggcctataacttgag

SEQ ID NO: 82320 - DNA, 50 bp, homo sapien
caaatcactaagatttttgttccagwataccttgttttacattgtgtatc

SEQ ID NO: 82321 - DNA, 50 bp, homo sapien
gaacactgtagaaagcagagaaaatwatagcaaacataagacttaaatat

SEQ ID NO: 82322 - DNA, 50 bp, homo sapien
accattttccctctatgactgcataytatcattacttctgttcatgtgta

SEQ ID NO: 82323 - DNA, 50 bp, homo sapien
gagtttacttatttcattcagtagamacttattgctggggaactgctggg

SEQ ID NO: 82324 - DNA, 50 bp, homo sapien
tttcattattacacggaagaacatcscgataaataagcttgaagctccga

SEQ ID NO: 82325 - DNA, 50 bp, homo sapien
cagcactctgagctcaaagctaacamgtaataaataataatatatccttg

SEQ ID NO: 82326 - DNA, 50 bp, homo sapien
cctagggaattaaatctgagaaagayatgatgcttccagaatgaatatgg

SEQ ID NO: 82327 - DNA, 50 bp, homo sapien
tggaaatatcccacttgatagtacamagtttagaaaaaaaattacacaag

SEQ ID NO: 82328 - DNA, 50 bp, homo sapien
gctgtaatggctgcaggtccagcagytatcttgggccataaggtgacctt

SEQ ID NO: 82329 - DNA, 50 bp, homo sapien
ttcatctctgtataataaaggccgayagtattatcattgtaggtggtatt

SEQ ID NO: 82330 - DNA, 32 bp, homo sapien
tccagatatgatttcakttgggccagttagat

SEQ ID NO: 82331 - DNA, 50 bp, homo sapien
tctctcatctgaattatttcatagcyccctaattggtctccctgcttcca

SEQ ID NO: 82332 - DNA, 50 bp, homo sapien
gcagagggtgctatgcatttcttaastatctccatgtggcatctataatt

SEQ ID NO: 82333 - DNA, 50 bp, homo sapien
ggaaaatatttgttctaataccatakgatttgtatcacattcacaggcta

SEQ ID NO: 82334 - DNA, 50 bp, homo sapien
tacaagaaagacaacacaaaattacrattagcaatacatccttagagagc

SEQ ID NO: 82335 - DNA, 50 bp, homo sapien
cctcccaaattattttcaatcagtaygctttttcttttagaggagcttca

SEQ ID NO: 82336 - DNA, 50 bp, homo sapien
agaggtttgattttatggttgctcaygttagatgttacaacacgctcttt

SEQ ID NO: 82337 - DNA, 50 bp, homo sapien
gagagcgagacaaaagggatactaargaatgctaatttatgtgatttaat

SEQ ID NO: 82338 - DNA, 50 bp, homo sapien
gtgattactatacatgaaattgatcmgaagtctaacaaatgattgaggta

SEQ ID NO: 82339 - DNA, 50 bp, homo sapien
ccaggggcaaagtggtataaagcaargctaaaaatactcaaggtctaggt

SEQ ID NO: 82340 - DNA, 50 bp, homo sapien
aaagaagtggagacaagaaagggaartatttgatgaggcaaagatctaga

SEQ ID NO: 82341 - DNA, 50 bp, homo sapien
tcgtaactgatattcaaagtagagcyaatatcatgcttgagtttaagaaa

SEQ ID NO: 82342 - DNA, 50 bp, homo sapien
atcaaaattgtagtagacttcttagyagacattgataagtttagcctaaa

SEQ ID NO: 82343 - DNA, 50 bp, homo sapien
ggggaaaatcttatgatgttacccaygttgaggaagatggattatgtccc

SEQ ID NO: 82344 - DNA, 50 bp, homo sapien
acttgtcttggttcttggggcagagratatggacaccttaccattaggag

SEQ ID NO: 82345 - DNA, 50 bp, homo sapien
ttggaaatttacatttgaggtggcartagaatagatatgtgacagtaact

SEQ ID NO: 82346 - DNA, 50 bp, homo sapien
ttgagccctgttcttccatgagataygtcatccctgaatataagtaagat

SEQ ID NO: 82347 - DNA, 50 bp, homo sapien
tagtaacatctacccgtgcatttatycttccagaaggtttgatggcttag

SEQ ID NO: 82348 - DNA, 50 bp, homo sapien
ctgctgcttccactgccgctgtctaygtgagatagagttcacagactgtg

SEQ ID NO: 82349 - DNA, 50 bp, homo sapien
tcaaaatcacactgagtttactgaaytgaaatgtatcttgattttcgtct

SEQ ID NO: 82350 - DNA, 50 bp, homo sapien
tcaaggtcttgctaagaaaatgttgraagtcactgaacaaggtaatctct

SEQ ID NO: 82351 - DNA, 50 bp, homo sapien
gctgagtgtgtgtctttcttaagggyagcgatcttttcttactcatctct

SEQ ID NO: 82352 - DNA, 50 bp, homo sapien
gaagattgttcttaaggtaagaatgraaggagaaggagacaattttatgc

SEQ ID NO: 82353 - DNA, 50 bp, homo sapien
agggatgagctttctccaggggccaytcaaaatagtccagattctcctgg

SEQ ID NO: 82354 - DNA, 50 bp, homo sapien
ttgcgatcatataaagtgcctggtgragctacagtggaagagcaaactgg

SEQ ID NO: 82355 - DNA, 50 bp, homo sapien
attcagtggacagtaagtgaatcatwaaggtcagtacatatatttatata

SEQ ID NO: 82356 - DNA, 50 bp, homo sapien
tggacagaaccctgtacaatcaaatsatattcttcctggccagcgctgtg

SEQ ID NO: 82357 - DNA, 50 bp, homo sapien
tcctatgtgtcaggtcagttacgtayagctgagtaaacatagtggtttag

SEQ ID NO: 82358 - DNA, 50 bp, homo sapien
actcttgggttctgactttagaaackaagtaattccaggacataagtgaa

SEQ ID NO: 82359 - DNA, 50 bp, homo sapien
catttgtgaacaaaacagatgtaackctctcccttgattgctaattgcta

SEQ ID NO: 82360 - DNA, 50 bp, homo sapien
ctgttttattttttaatgcagctaarttacatatgtggattgcgttctat

SEQ ID NO: 82361 - DNA, 50 bp, homo sapien
taaatgaatatctaaaaattctttcmaatgctataaggccattagtagat

SEQ ID NO: 82362 - DNA, 50 bp, homo sapien
gtcctgattttaacatgtatttcccyatatcaaattttaaaaatgcacca

SEQ ID NO: 82363 - DNA, 50 bp, homo sapien
ccttggtctccagtcctgactcttayaatgacctttctctccaccccacg

SEQ ID NO: 82364 - DNA, 50 bp, homo sapien
agtgatcataacaattcatataaaaytctaggttcaccaatcttagttct

SEQ ID NO: 82365 - DNA, 50 bp, homo sapien
caaaataataacgcataattggcaasgatgctgtaaggaatagagatgtt

SEQ ID NO: 82366 - DNA, 50 bp, homo sapien
ggttcagagtgaacacctaacatgasctgggttaatcacagtccttccct

SEQ ID NO: 82367 - DNA, 50 bp, homo sapien
gtcacagagaaaatacaaatgttacygacaatatgagttccatttaggga

SEQ ID NO: 82368 - DNA, 50 bp, homo sapien
tttgaatagatttctcgtgtgttcasattagtcttttcccagttagtttg

SEQ ID NO: 82369 - DNA, 50 bp, homo sapien
agttagtgcagagctgggaaccaaasactcctggcaccaagtccccagct

SEQ ID NO: 82370 - DNA, 50 bp, homo sapien
aggataactgcagaattcctcaatamcaaggccgtttgctagccatgtgg

SEQ ID NO: 82371 - DNA, 50 bp, homo sapien
aagagccactgtgcctgacctgaccrggatttttaatgcacacagctata

SEQ ID NO: 82372 - DNA, 50 bp, homo sapien
cagtagtaatactaaggttttctgarcaagaacttgatattttagtaaaa

SEQ ID NO: 82373 - DNA, 50 bp, homo sapien
ttaggtgtcaaacccagtcttgatargaaatatcccacttagtcattcct

SEQ ID NO: 82374 - DNA, 50 bp, homo sapien
agtgcaaaataaagccagagttacargagaacaggaaatatgggcttagg

SEQ ID NO: 82375 - DNA, 50 bp, homo sapien
ttcactatagtaagtacccaggaagycgatagtgaacaggacacatgcct

SEQ ID NO: 82376 - DNA, 50 bp, homo sapien
ctgcctggagtccccctcactgcatsatagcctagaaaccctctcaatgc

SEQ ID NO: 82377 - DNA, 50 bp, homo sapien
tatttaaaaggcttatagagcttaaygaaggaatagaaatcataataatc

SEQ ID NO: 82378 - DNA, 50 bp, homo sapien
cagtaaggatctaagattcaaggatsatcaaaattctataattgcattaa

SEQ ID NO: 82379 - DNA, 50 bp, homo sapien
aaaatctcatggtatatgttcattcraccttcaaatttcttgtttataaa

SEQ ID NO: 82380 - DNA, 50 bp, homo sapien
gcttagaagaggaaataatctctcayggaaatactaaaggggttgtcaca

SEQ ID NO: 82381 - DNA, 50 bp, homo sapien
ccaaggactgcaggtgagcccggcasagtgaagttcaaggacattgtcca

SEQ ID NO: 82382 - DNA, 50 bp, homo sapien
gaggactgaagaaaggttattgatasgtctaggatgcaacgaggtctcaa

SEQ ID NO: 82383 - DNA, 50 bp, homo sapien
tggtttattccagagcagaaagaaaktgtatttgcaggatttgacatcaa

SEQ ID NO: 82384 - DNA, 50 bp, homo sapien
ccatgtgtagtgcgatcatcacttasaaggtagagaaagcaatccaggga

SEQ ID NO: 82385 - DNA, 50 bp, homo sapien
aaatgcattcattttaactcttccayctgttactactaccacaatcaaga

SEQ ID NO: 82386 - DNA, 50 bp, homo sapien
atggaaagaaacaggcttgaagtgaktttcagtgatatcttcgaggttac

SEQ ID NO: 82387 - DNA, 50 bp, homo sapien
gttttaaatactacatctcagttaaytcacactgtatagacagggatact

SEQ ID NO: 82388 - DNA, 50 bp, homo sapien
aatctaattcatcatttcgccatagwagtagttttggattttcttacttg

SEQ ID NO: 82389 - DNA, 50 bp, homo sapien
caggaagtgtgaacagtccaagcaamaacatggtagtggagatttataag

SEQ ID NO: 82390 - DNA, 50 bp, homo sapien
tcttgttatcattaagcctatgctarctccttataactgccaattctgcc

SEQ ID NO: 82391 - DNA, 50 bp, homo sapien
taaaaatcaaagttttccgtagctaycatcaatcactcttttaagacaat

SEQ ID NO: 82392 - DNA, 50 bp, homo sapien
tttacctcccatattggggcctacaraacaaattatatcagaaagcaaga

SEQ ID NO: 82393 - DNA, 50 bp, homo sapien
tgctattatatatcttcagacaaacygatactgggcctttcatcaagaga

SEQ ID NO: 82394 - DNA, 50 bp, homo sapien
agcaatgattattttgtttttttcaygtatattgctcgtcccagaaaatg

SEQ ID NO: 82395 - DNA, 50 bp, homo sapien
ttaaattttgttcattaaatcttggyatgttagagtaataactagctatt

SEQ ID NO: 82396 - DNA, 50 bp, homo sapien
tggcaattgggtttgggagaggcgamcagaccattccagatgttatttca

SEQ ID NO: 82397 - DNA, 50 bp, homo sapien
ttatcaggccatctggatttgatagsactcaagaagggatgcctcctttc

SEQ ID NO: 82398 - DNA, 50 bp, homo sapien
gcaatagttgcaagatgtaagatcayccaaagagtatgcagagggaaatg

SEQ ID NO: 82399 - DNA, 50 bp, homo sapien
agtagattgtttcagtgaactgaccraaaatttcctgttacataggtcaa

SEQ ID NO: 82400 - DNA, 50 bp, homo sapien
aatacaaatctctttcaaattgttamaatgtagacactacacatttcttt

SEQ ID NO: 82401 - DNA, 50 bp, homo sapien
attagatagtatcaagagttaagccraggattgaactggtttagtgatag

SEQ ID NO: 82402 - DNA, 50 bp, homo sapien
taccagtcaggacaggaaaattcaargacaaccaccttcttggccttggc

SEQ ID NO: 82403 - DNA, 50 bp, homo sapien
ctgcctgagcccactcggcaagaacygacctgttggagtattagggctct

SEQ ID NO: 82404 - DNA, 50 bp, homo sapien
tctagactgatcaaatctgaatttgkaggaattgagcccaaacacaggat

SEQ ID NO: 82405 - DNA, 50 bp, homo sapien
tctagaaactcctttgtacccagccrataacagtgactttggggggacat

SEQ ID NO: 82406 - DNA, 50 bp, homo sapien
ggatgggtaacgaagattatcaggaytatccaatattaaacattagagaa

SEQ ID NO: 82407 - DNA, 50 bp, homo sapien
agcatgtgctatactccctgcaagamatatactgacatgaacaggcagtt

SEQ ID NO: 82408 - DNA, 50 bp, homo sapien
gttaggcagtgatatcacaacaaatraaaaacagatattttaaatccttt

SEQ ID NO: 82409 - DNA, 50 bp, homo sapien
atatggtctttctaggccacagtcarattacaggtatatttgtcatggct

SEQ ID NO: 82410 - DNA, 50 bp, homo sapien
tcagcagaggagatcaaagttttgcytgagctataggaggaaaactagtg

SEQ ID NO: 82411 - DNA, 50 bp, homo sapien
ttctgcatccctgtgtttccatatcwaaggtgtctggccagaaggatctg

SEQ ID NO: 82412 - DNA, 50 bp, homo sapien
actccacttcgaagacttggtgttayggctttgtttttgaaccttgtcta

SEQ ID NO: 82413 - DNA, 50 bp, homo sapien
aatgattcagaataattaaatttgaygtgtcttatcttgggacataatct

SEQ ID NO: 82414 - DNA, 50 bp, homo sapien
tattttatgatgctctgtgatataaytggttactttttgtctgctatttt

SEQ ID NO: 82415 - DNA, 50 bp, homo sapien
tggccaatctccaaagtggtcctccrtgatctccacatcctgacattcag

SEQ ID NO: 82416 - DNA, 50 bp, homo sapien
tctataaaaatattagttcataacaratcagaaatttaaaataactggcc

SEQ ID NO: 82417 - DNA, 50 bp, homo sapien
ccttcagtccatgatttttacattcrccctatgactatgtatccatgtcg

SEQ ID NO: 82418 - DNA, 50 bp, homo sapien
aactaaatattagactgtggtaacaygaaagatagaagcaaaagtcaaag

SEQ ID NO: 82419 - DNA, 50 bp, homo sapien
cagaaggaaagcagaatcgtgactayatagtgataactacaaaaccctag

SEQ ID NO: 82420 - DNA, 50 bp, homo sapien
ggggtatgcatcttccttctgtgttmctgattgggaggctgagcccacag

SEQ ID NO: 82421 - DNA, 50 bp, homo sapien
aataaataaaatttaaaaattgtaamcatcaatcccaatcataggccctg

SEQ ID NO: 82422 - DNA, 50 bp, homo sapien
gtcttgagaaattttccagaaataamcaggcaaatttctcaagagcaggc

SEQ ID NO: 82423 - DNA, 50 bp, homo sapien
ccatccttcgagttcatctagagagwacagttgtatgccccactactaaa

SEQ ID NO: 82424 - DNA, 50 bp, homo sapien
tgtctcctctgactgtatattttcamaaagactgtcttcaagctcacaaa

SEQ ID NO: 82425 - DNA, 50 bp, homo sapien
gaacagaagtgatctgagctgcttawataggagctaagataagagaacta

SEQ ID NO: 82426 - DNA, 50 bp, homo sapien
cctctttattttccttctcttcaaayagttcagtcagggtgcaagaaggt

SEQ ID NO: 82427 - DNA, 50 bp, homo sapien
aattccaggtgacgctacatcataasgttgagagccactggggtaagttg

SEQ ID NO: 82428 - DNA, 50 bp, homo sapien
gaaggagctttgaaaaaattgtggawtaaattctgccttcagtttttata

SEQ ID NO: 82429 - DNA, 50 bp, homo sapien
agcaggcacagtgctaaatgctctgyatgggtaatctcactaatggcttt

SEQ ID NO: 82430 - DNA, 50 bp, homo sapien
aacgtgatctacatgatcgacaataygacaacaagctaatactcaatgaa

SEQ ID NO: 82431 - DNA, 50 bp, homo sapien
catgaatcaataaagtgagaaggcaraacctagcaatttggttaaatggt

SEQ ID NO: 82432 - DNA, 50 bp, homo sapien
tcaaagttgtcaaatatataattgartaaagcaaaagactgcatttccat

SEQ ID NO: 82433 - DNA, 50 bp, homo sapien
cagtcaatttagtacacactcaaacrcgtctttgtttgcagcactcaggc

SEQ ID NO: 82434 - DNA, 50 bp, homo sapien
cccaagtagtcaaaatgaacttaccrccatttccatgttctagatcatgg

SEQ ID NO: 82435 - DNA, 50 bp, homo sapien
gatgccttcccatcaagactaagtcraatcccccattctatgctgtctcc

SEQ ID NO: 82436 - DNA, 50 bp, homo sapien
ctgtgggtataggaaaggagtattasaattgtcagaagtctgtggtgctg

SEQ ID NO: 82437 - DNA, 50 bp, homo sapien
tcatcattttcctttctaaaactcamgtgcttcctctactgtgggtatag

SEQ ID NO: 82438 - DNA, 32 bp, homo sapien
agctgcaagtgtagcargcagtgatgccagag

SEQ ID NO: 82439 - DNA, 50 bp, homo sapien
ccattggttttaatcactgtgattcraaacacttctgtatgttccttgcc

SEQ ID NO: 82440 - DNA, 50 bp, homo sapien
tttgtattgtttgttttattagcaaytcccaaaacacacatggccccaga

SEQ ID NO: 82441 - DNA, 50 bp, homo sapien
tattccagaagggataggataaagaraagaaatcagttatactcccagtg

SEQ ID NO: 82442 - DNA, 50 bp, homo sapien
tgtatctttttctgggtagaagacasaaattgccatgttcttctaagaac

SEQ ID NO: 82443 - DNA, 50 bp, homo sapien
agtccacatgcaagctgatcctccaygcaatctcggtgcctggtgtgcgg

SEQ ID NO: 82444 - DNA, 50 bp, homo sapien
acacaataacagaagttggttgttartaaatcacatcctagtctttcagc

SEQ ID NO: 82445 - DNA, 50 bp, homo sapien
tctgaaagcatcaaggagccactaargaatattaatcaagggagaagtag

SEQ ID NO: 82446 - DNA, 50 bp, homo sapien
cagtctccagaatcaagtacagctgratactgggataaggtttacataag

SEQ ID NO: 82447 - DNA, 50 bp, homo sapien
tgtggttttggaaacaaatatctgcmcagagtaggataagtaagacagaa

SEQ ID NO: 82448 - DNA, 50 bp, homo sapien
tgatttctaaaagctgttaggtttckcaatagttaattttacgtgccagg

SEQ ID NO: 82449 - DNA, 50 bp, homo sapien
catttaaggtgtgttttagggaaatsaagctcatgataatctgtaggtgg

SEQ ID NO: 82450 - DNA, 50 bp, homo sapien
aacttggaatgtaggcatctttattmaactgtaactcctgatattaatat

SEQ ID NO: 82451 - DNA, 50 bp, homo sapien
gacaagttgatgggcataaagaaaayagtaatagtaatgaattgtattaa

SEQ ID NO: 82452 - DNA, 50 bp, homo sapien
ttcaaaagctcattatttgcatagtrtactcatttgagcaagaggaaagt

SEQ ID NO: 82453 - DNA, 50 bp, homo sapien
ttgagaaagctcgtttatattcaccmaacaaataaatggcatttactaca

SEQ ID NO: 82454 - DNA, 50 bp, homo sapien
atttacaaatcatagtaaaataaccratattctttatggtaaattccgta

SEQ ID NO: 82455 - DNA, 50 bp, homo sapien
tcaaaaaagacgggaatttgaggtaygaggaagaaaaatcatcagaaaaa

SEQ ID NO: 82456 - DNA, 50 bp, homo sapien
ttctgtcaatgaaccttttatgaaaygtaagaaatgacggctggatgtca

SEQ ID NO: 82457 - DNA, 50 bp, homo sapien
catctctcctgttttctcttctacawgccttaaagctcttctcatgtttt

SEQ ID NO: 82458 - DNA, 50 bp, homo sapien
taaaaagtacccactgagtgcccaamaaaatgaatttaaaaagccccaca

SEQ ID NO: 82459 - DNA, 50 bp, homo sapien
gaactttctctttggtaagagcctayagtacatgcccatatgatctgtcc

SEQ ID NO: 82460 - DNA, 50 bp, homo sapien
tttgtacttcagtatgattgtcttcratgtaagcagttataaatactatt

SEQ ID NO: 82461 - DNA, 50 bp, homo sapien
taaaatactattttcattcacctacrgatacagattatcagatggaaact

SEQ ID NO: 82462 - DNA, 50 bp, homo sapien
gaaaggtaacaacattaaaactactraatggtagctctcaatcgctgttt

SEQ ID NO: 82463 - DNA, 50 bp, homo sapien
atgacatatttaagagagtgtcagaygaagagaacagtgggccgggataa

SEQ ID NO: 82464 - DNA, 50 bp, homo sapien
aatgtaaattgaaataaaaaacaaasatagagaaggttgatgaggagggc

SEQ ID NO: 82465 - DNA, 50 bp, homo sapien
agtagctcagtctatatgaagaatascacaaaccatctggtgtttaggcc

SEQ ID NO: 82466 - DNA, 50 bp, homo sapien
tgaattgataaaacagtaacactgayaaaaatacatacacacattcacac

SEQ ID NO: 82467 - DNA, 50 bp, homo sapien
gaatgtggtgtttatcccagcttaayattttaacccagccaaatttgagt

SEQ ID NO: 82468 - DNA, 50 bp, homo sapien
agttgatgttgtcagcccactttaaracatgaaacattactattcaattc

SEQ ID NO: 82469 - DNA, 50 bp, homo sapien
ccctcaagatcagtgattcgatctayatcctgcaccaaaatatctgatct

SEQ ID NO: 82470 - DNA, 50 bp, homo sapien
aactaggactattttcttttccttgrgtaatgaatgcaatgaatataagt

SEQ ID NO: 82471 - DNA, 50 bp, homo sapien
gtaaccctgctaatctaactggcttygtattgcacttttaaggatattca

SEQ ID NO: 82472 - DNA, 50 bp, homo sapien
atctgaatagaagaagtaataaccastggtatcacaaccttagcacaaca

SEQ ID NO: 82473 - DNA, 50 bp, homo sapien
tcttgttttatttgagaagagacgcrttggtaattgtgtacaagtaactt

SEQ ID NO: 82474 - DNA, 50 bp, homo sapien
caggatatcaatgtggtgaaaagtgyacaaagggtatctggatctgcctt

SEQ ID NO: 82475 - DNA, 50 bp, homo sapien
aacaccactaggcctttccattccaygtctttctctattccccacactta

SEQ ID NO: 82476 - DNA, 50 bp, homo sapien
aagaccaatagctctcctacttaaaygtcatggaagtaagcatgtcattt

SEQ ID NO: 82477 - DNA, 50 bp, homo sapien
cctttggctcccaaatgaggattgarcatggaactggaactgatttgttg

SEQ ID NO: 82478 - DNA, 50 bp, homo sapien
cctggaaaaataatgataagtttaayagagaaagtggaaaaattaattat

SEQ ID NO: 82479 - DNA, 50 bp, homo sapien
taatctagagaagtattcatgtgaaygtcctggaaaaataatgataagtt

SEQ ID NO: 82480 - DNA, 50 bp, homo sapien
gaaggaagtcactcagtataagcagraagggaatatggatttgacagagt

SEQ ID NO: 82481 - DNA, 50 bp, homo sapien
ttgttcttaatatgttttatcatcayagttgttcatcattgttatactag

SEQ ID NO: 82482 - DNA, 50 bp, homo sapien
agcttggcaaatgactcaaaatcatyttcagacagctaatgactgctatc

SEQ ID NO: 82483 - DNA, 50 bp, homo sapien
atgttctcagcctaacttattgaaasctgttctactcagtcttttaagga

SEQ ID NO: 82484 - DNA, 50 bp, homo sapien
caaatggaaggctaacatattgaaamtcagagtcatcttagatttctgca

SEQ ID NO: 82485 - DNA, 50 bp, homo sapien
tactaaaaccacaagttgctattgawacctccaattctaatttaatacca

SEQ ID NO: 82486 - DNA, 50 bp, homo sapien
acagaatcttggccaatctagggtgstatatgcttaggatagggccaatg

SEQ ID NO: 82487 - DNA, 50 bp, homo sapien
catatcaggtggaaattttaaaacastaatcaagaagacagaacccttcc

SEQ ID NO: 82488 - DNA, 50 bp, homo sapien
cataatgtcatgcatatagttgatamaaaaaaatagaaatctgtgtgcta

SEQ ID NO: 82489 - DNA, 50 bp, homo sapien
aaatgcaacagagataatctatttayggacaactgtatgttcctgatatc

SEQ ID NO: 82490 - DNA, 50 bp, homo sapien
atgcacaaagaaatgcttcacagatwatcaaggagataaaaaactaatag

SEQ ID NO: 82491 - DNA, 50 bp, homo sapien
gaaatgattaatcacatgaacctctwagactattgtaaaatctattagcc

SEQ ID NO: 82492 - DNA, 50 bp, homo sapien
tccttcaggacaaaataaaaaataaycagacacacaaacaaacaaaatat

SEQ ID NO: 82493 - DNA, 50 bp, homo sapien
gttctgactgatttattaatctcaamtgacatctgtcggcacaccaagag

SEQ ID NO: 82494 - DNA, 50 bp, homo sapien
ctcattgtacctttggactcattccsaaaatacaatgaataaaggggtaa

SEQ ID NO: 82495 - DNA, 50 bp, homo sapien
aagtaaattccttaaacacactagaratttagaaagctaattgtggtagg

SEQ ID NO: 82496 - DNA, 50 bp, homo sapien
acatgtatacatgtatttctggttcscaatgatcttgaccaagagagtat

SEQ ID NO: 82497 - DNA, 50 bp, homo sapien
aaattcacaggttgtcaatacatacyacgggagatgaacaaaagaggaga

SEQ ID NO: 82498 - DNA, 50 bp, homo sapien
ctcttcactctggataaccactcagmaccgtgcatatcctggctcttgtc

SEQ ID NO: 82499 - DNA, 50 bp, homo sapien
ttgattcaatgacccattgatagatygaagcctatagtgtcttatggtcc

SEQ ID NO: 82500 - DNA, 50 bp, homo sapien
tgtagttatctcagtattcctctttratttatctgactttcacaatatga

SEQ ID NO: 82501 - DNA, 50 bp, homo sapien
gatagaatgtgtaaaagcctgactargatccacccttttcctaatgtttc

SEQ ID NO: 82502 - DNA, 50 bp, homo sapien
agtgattggtaccagcctgttcatasatgccttcatttaggtacttcaga

SEQ ID NO: 82503 - DNA, 50 bp, homo sapien
gaggaccataaaattagccaagtaayctggagagttaaaacagtctagag

SEQ ID NO: 82504 - DNA, 50 bp, homo sapien
gaggattcacgttttctgcctgagawactgaaaagctacagcagcaatta

SEQ ID NO: 82505 - DNA, 50 bp, homo sapien
gctcactaaagtctttagtgtttaayatctgtgagtttatctagtctttc

SEQ ID NO: 82506 - DNA, 50 bp, homo sapien
tatatgacccaaatcctaaccaacartattttctccttaagagaggcatt

SEQ ID NO: 82507 - DNA, 50 bp, homo sapien
aaatggatttgaccaactacaattaygttagactgttctccatttctaaa

SEQ ID NO: 82508 - DNA, 50 bp, homo sapien
ttaactaaaacatgatgatggaggaraaaatagtcgattaaaaggtattc

SEQ ID NO: 82509 - DNA, 50 bp, homo sapien
gaatgccaaaataatagagccatgargaaaggggtgaagaaagttcacat

SEQ ID NO: 82510 - DNA, 50 bp, homo sapien
agtgtcttcagagtggacactaagaygacaaagttagccaactggcagat

SEQ ID NO: 82511 - DNA, 50 bp, homo sapien
ttaaaaaaaaaattaaccctggagtygagtttcacaaagatacctggcag

SEQ ID NO: 82512 - DNA, 50 bp, homo sapien
atgttaggtgtacagaatctgataartgaaagtcaaagaccatgtgaatt

SEQ ID NO: 82513 - DNA, 50 bp, homo sapien
tccttgctccattctcttctctctgwaaatattaccaaataaatttgcac

SEQ ID NO: 82514 - DNA, 50 bp, homo sapien
cagaatcatcaccaatcacacgttcyctgaggttaacaagctttctttct

SEQ ID NO: 82515 - DNA, 50 bp, homo sapien
acatattagactttagtgaggataastacattttctttgatttagaacat

SEQ ID NO: 82516 - DNA, 50 bp, homo sapien
ccctttcaaagaaaatgttcttctaycttctctacatgtcctgagatttt

SEQ ID NO: 82517 - DNA, 50 bp, homo sapien
gaatctgggcaggtataacaggaacygaagacttaagcagaaagctgaca

SEQ ID NO: 82518 - DNA, 50 bp, homo sapien
tggtgctggggaggctgtaagccaasgaatctgggcaggtataacaggaa

SEQ ID NO: 82519 - DNA, 50 bp, homo sapien
taaacactcatcctaggcactcagargagcaatattagtgtcagtgaaga

SEQ ID NO: 82520 - DNA, 50 bp, homo sapien
atagtcttgtaaggtttatggagcaragaccagagtagcaggcagactcc

SEQ ID NO: 82521 - DNA, 50 bp, homo sapien
gtttgaagcaatatgactaatagacraatccagtctgttttagaggttta

SEQ ID NO: 82522 - DNA, 50 bp, homo sapien
tatgagcagtactgccggattactgytgatactaccttaaggtccaaagg

SEQ ID NO: 82523 - DNA, 50 bp, homo sapien
actcatagaatatttataggataaaytatgtcttcaaattgtaaattcac

SEQ ID NO: 82524 - DNA, 50 bp, homo sapien
tggcccacttgccccacagctgacaraccttaaaaggcagtccgccctgg

SEQ ID NO: 82525 - DNA, 50 bp, homo sapien
tttcaactcagaggcaaagaaataasatggcaggatatagtgaatgaaac

SEQ ID NO: 82526 - DNA, 50 bp, homo sapien
ttaaaaaaatagttgccaagacaaaytgagctttggaatttcagcattct

SEQ ID NO: 82527 - DNA, 50 bp, homo sapien
ccaaagggaagttatttgctgcttasaaacaaattctattattaaagtct

SEQ ID NO: 82528 - DNA, 50 bp, homo sapien
gctgtaaatagattcatggattccartaaaacaaatcaccttcagagagg

SEQ ID NO: 82529 - DNA, 50 bp, homo sapien
cactctcctagcaaagttctgcgcaygtaaagacctccccatctttgtgc

SEQ ID NO: 82530 - DNA, 50 bp, homo sapien
gtagaatatcaacattattaagtaayctatgaaaatatcccacaatataa

SEQ ID NO: 82531 - DNA, 50 bp, homo sapien
ctcaggaacaatacagaaactgcctwactaagtatagtcaataaaccact

SEQ ID NO: 82532 - DNA, 50 bp, homo sapien
tgactttgtatatttaaatgtttaastgtgcttctatgacatttcaaata

SEQ ID NO: 82533 - DNA, 50 bp, homo sapien
attaatagcaataattgcctgggaawtaaagaagtcttgaagaaaaatac

SEQ ID NO: 82534 - DNA, 50 bp, homo sapien
caaatgtaccattcaaataagttaaygaggtaaaggtggacaccctattg

SEQ ID NO: 82535 - DNA, 50 bp, homo sapien
aattagttttgttttaaagagaagaygaggtacccttgacaacatgatcc

SEQ ID NO: 82536 - DNA, 50 bp, homo sapien
gaatacagttctgtcttactaccaaraaggttcagtgcccgattttctta

SEQ ID NO: 82537 - DNA, 50 bp, homo sapien
agaaatcatggaaaaaatagaaaaasgtaaggcaattgctcatcatagca

SEQ ID NO: 82538 - DNA, 50 bp, homo sapien
tagaataaatcttacatattttcacygaatacattattccttatctcagc

SEQ ID NO: 82539 - DNA, 50 bp, homo sapien
tgatacttctactgttattggagaasatttagtctataaactacattatg

SEQ ID NO: 82540 - DNA, 50 bp, homo sapien
gataggatagtcagtggacatagtargatattcaatgaatgtttgtcctt

SEQ ID NO: 82541 - DNA, 50 bp, homo sapien
acatgtttaagttacgatgtgttgasgattatttaactgataatgactta

SEQ ID NO: 82542 - DNA, 50 bp, homo sapien
tctaactctcagcacatattcatagwaaaccaaagttgcaatactgtaaa

SEQ ID NO: 82543 - DNA, 50 bp, homo sapien
taaacttgcacaaataaagctcatgrcatagcatctggcacatagcaggt

SEQ ID NO: 82544 - DNA, 50 bp, homo sapien
atattcacatgactattacattcacrcgactattatagctattcacaata

SEQ ID NO: 82545 - DNA, 50 bp, homo sapien
atttattttttctattgccgtatcaygaggtagctttcctaattcttata

SEQ ID NO: 82546 - DNA, 50 bp, homo sapien
taatttattatgttatatttcctgaygttacgatcgtctcctctaaaata

SEQ ID NO: 82547 - DNA, 50 bp, homo sapien
atcaatgtatttagtgtttcaaattyccagaagaccttactatcaagcta

SEQ ID NO: 82548 - DNA, 50 bp, homo sapien
ttcacatagtaaagtgagaaattaaygaatctaaagagaaaaagcaaata

SEQ ID NO: 82549 - DNA, 50 bp, homo sapien
tcttattttctttcttttgctaatamatcactgcattcagcctttaagtt

SEQ ID NO: 82550 - DNA, 50 bp, homo sapien
ctttaggaaatgaagttattaagatragctccctaaaaaggtaatataaa

SEQ ID NO: 82551 - DNA, 50 bp, homo sapien
tacaatagagaggagcaacgaaacgraagactaataaaactggtaactat

SEQ ID NO: 82552 - DNA, 50 bp, homo sapien
ctggagatgggaggtgtgatacagargtaaggacaaaaagaagaagtgga

SEQ ID NO: 82553 - DNA, 50 bp, homo sapien
tatctgtttggcgatctcttcgcttyctgtaaatagatgtttaaatttct

SEQ ID NO: 82554 - DNA, 50 bp, homo sapien
atttcagtgaaagaatcaagtaaaaycaattgcttccttatttgtaaacc

SEQ ID NO: 82555 - DNA, 50 bp, homo sapien
aggtaatctgtgaaactattgtgctsaatcaaagtaatcaagtcagttaa

SEQ ID NO: 82556 - DNA, 50 bp, homo sapien
tgaatattggctttgaaaacaagcastaacccaggggaatctgactttct

SEQ ID NO: 82557 - DNA, 50 bp, homo sapien
tagcagtgatggaacaatgctttggratacaagtagtttgcactggtgtt

SEQ ID NO: 82558 - DNA, 50 bp, homo sapien
ccatttgaactcgagaatggaaaccwaagtgtacagccaacaaatagtgt

SEQ ID NO: 82559 - DNA, 50 bp, homo sapien
tttcggccaaatcttgctattgggcyatacaccttcccttggatgtttta

SEQ ID NO: 82560 - DNA, 50 bp, homo sapien
atcatgtttctatactaacaagtaaygagaaaccaaatagtaaatcctga

SEQ ID NO: 82561 - DNA, 50 bp, homo sapien
agcagagttaagaaatctaaattaastaaattgcaaatgctataactaaa

SEQ ID NO: 82562 - DNA, 50 bp, homo sapien
gatgattaatatttgaactgtaaagsatatatgtctgaaatttaattatt

SEQ ID NO: 82563 - DNA, 50 bp, homo sapien
ccatccattgaaaataaaagctcaamatcaacaaaaattggctaaaggct

SEQ ID NO: 82564 - DNA, 50 bp, homo sapien
acaagtgggttagaggatgtcttatsactagaatggtgtttataatgcag

SEQ ID NO: 82565 - DNA, 50 bp, homo sapien
tgaaagcctaaacgattcctcacaawtagagttaatgtttaattagacaa

SEQ ID NO: 82566 - DNA, 50 bp, homo sapien
agtatgcaaggtcataaagatataarcttgtgtcatatgactgttataat

SEQ ID NO: 82567 - DNA, 50 bp, homo sapien
ttgaaattctgtatcgtcatacttasgtcagtcttctgggaagtcttttc

SEQ ID NO: 82568 - DNA, 50 bp, homo sapien
ctgcgcccggccgaaacacagttttwaaaaagccattgaaaggtgttttg

SEQ ID NO: 82569 - DNA, 50 bp, homo sapien
tcaaagatttattctctcaattaccmatcaaaataactaataaaaggaga

SEQ ID NO: 82570 - DNA, 50 bp, homo sapien
caactagaagccatatgttttctatmacctaatttcatatgccctgccta

SEQ ID NO: 82571 - DNA, 50 bp, homo sapien
gttgggagcacagacagaacaaaaayagagaaaaggcaaatatgttgatc

SEQ ID NO: 82572 - DNA, 50 bp, homo sapien
cctttggccttggaatgagaattacwtcatctgcttctctcattctaagg

SEQ ID NO: 82573 - DNA, 50 bp, homo sapien
gtttcttaaggcattggaatgtcaayggactaccctagtgaaggcagcta

SEQ ID NO: 82574 - DNA, 50 bp, homo sapien
catagctctaccacaaaaagttctcwctatatatacctttagagcattaa

SEQ ID NO: 82575 - DNA, 50 bp, homo sapien
aatctctttgatgtttggcttaagasagctagattctcacaactacttct

SEQ ID NO: 82576 - DNA, 50 bp, homo sapien
tcacaaaacaaatattactagatcaraagagcgagagactctaatacaat

SEQ ID NO: 82577 - DNA, 50 bp, homo sapien
accaaagaacacatatgaatgcctartatgcacatgaaaagatgctcaat

SEQ ID NO: 82578 - DNA, 50 bp, homo sapien
aaatatttagcattactctatataayctaacaaatgtgtgccatattttc

SEQ ID NO: 82579 - DNA, 50 bp, homo sapien
tattttggatgagaatgcataagtcraaactacatccaataaaatgtcag

SEQ ID NO: 82580 - DNA, 50 bp, homo sapien
tttctgattgatagatcatataaagsctttctactccgctgcctaccttt

SEQ ID NO: 82581 - DNA, 50 bp, homo sapien
tagtattgtgttctggaagtcttaartaaatgataataaatgatcctttt

SEQ ID NO: 82582 - DNA, 50 bp, homo sapien
tccataaatgaataatgaaaatctcrgtaagaaaaaagagttttgtgaca

SEQ ID NO: 82583 - DNA, 50 bp, homo sapien
tatgtagcttatatgataaatactayggactaataaggattgccttaatg

SEQ ID NO: 82584 - DNA, 50 bp, homo sapien
tgattgttatcttcaaggtaaccaaygaactgagagtgggagtgggaaca

SEQ ID NO: 82585 - DNA, 50 bp, homo sapien
atctcagatctgcagccaaagagctrgttctcctcagtttcatcttgcat

SEQ ID NO: 82586 - DNA, 50 bp, homo sapien
tccaatgatcacaacacaaagtcatsagcaatttaaataaaatggttcta

SEQ ID NO: 82587 - DNA, 50 bp, homo sapien
attatcagtggacaatgccttgccartattgaaataaaattgtaactgtt

SEQ ID NO: 82588 - DNA, 50 bp, homo sapien
acaataaatgctgattatctgcttasggtttctcccacagaacactgcag

SEQ ID NO: 82589 - DNA, 50 bp, homo sapien
gcaaaatgcacattatacccaaactsaaaagcagaattctaaatggggag

SEQ ID NO: 82590 - DNA, 50 bp, homo sapien
tccccaacttctctggatttctttcratgtaaaagtgaagttatttacac

SEQ ID NO: 82591 - DNA, 50 bp, homo sapien
gacaggcccaatttttttcaggctakaatcagactctcataagaaatggt

SEQ ID NO: 82592 - DNA, 50 bp, homo sapien
ttccatacttaaggtctgagattcartgaaaatcattctaccccttacat

SEQ ID NO: 82593 - DNA, 50 bp, homo sapien
ctatgctctagagccatggtgaaccraagagtagagacttaattcaaaat

SEQ ID NO: 82594 - DNA, 50 bp, homo sapien
tatgtaagtctttgctcatttctaaratacacacaaaaaatgtttggaca

SEQ ID NO: 82595 - DNA, 50 bp, homo sapien
tgaactacaaatggtaaagagagaartgaaatcctactaggtttatcctt

SEQ ID NO: 82596 - DNA, 50 bp, homo sapien
gtttcacataaaaataactagctcartataaggaaagactgaagaatgtt

SEQ ID NO: 82597 - DNA, 50 bp, homo sapien
acaagttctggcatgtgattctaacygacccaaaagaatccttcctctga

SEQ ID NO: 82598 - DNA, 50 bp, homo sapien
caaaataaagtatatgcatacagtgsaaaactactcaacaataaaacaaa

SEQ ID NO: 82599 - DNA, 50 bp, homo sapien
tgtaattctattttattttcagttgmcttctcaattttctatattgcaat

SEQ ID NO: 82600 - DNA, 50 bp, homo sapien
aattaatgatagggttcaatggaaargtgtccaaatatttaagtttgact

SEQ ID NO: 82601 - DNA, 50 bp, homo sapien
gactgatgtaaacagcattctaacayctacaaagagtctctacttcagac

SEQ ID NO: 82602 - DNA, 50 bp, homo sapien
gttcagttcctgaaagtgggaagcaygtgagccaatgtttcctaacatca

SEQ ID NO: 82603 - DNA, 50 bp, homo sapien
agtcaaaaagctcaagatggtctcartcaataactttgcaactaccaact

SEQ ID NO: 82604 - DNA, 50 bp, homo sapien
atattttgctaaatcatctattcagragtcctctagtttctttatgaccc

SEQ ID NO: 82605 - DNA, 50 bp, homo sapien
atttataaaaggagaacaccaaataktatttcatgaaacagactcaataa

SEQ ID NO: 82606 - DNA, 50 bp, homo sapien
gctaaatgcatatagattgatacacyaatattctcaccattgtcaagaag

SEQ ID NO: 82607 - DNA, 50 bp, homo sapien
ttctcaccattgtcaagaagttgacmggtgagttccataaacgttccata

SEQ ID NO: 82608 - DNA, 50 bp, homo sapien
gatgatttctaaagggatttttgaaytgcatattttatgactcagataca

SEQ ID NO: 82609 - DNA, 50 bp, homo sapien
acagccaattctgaccagaaacacayagtactgcaataattgcataaatt

SEQ ID NO: 82610 - DNA, 50 bp, homo sapien
agatctgaactattatttcatcagtycctgttagctctatggtgaatgta

SEQ ID NO: 82611 - DNA, 50 bp, homo sapien
aaagtaatgagttctcagtacacaakgaacccaatatcttagtaaaaata

SEQ ID NO: 82612 - DNA, 50 bp, homo sapien
aagttaactaagaatctacatagaaycatacttttgtaacagtgttgtag

SEQ ID NO: 82613 - DNA, 50 bp, homo sapien
agttgaatgtgagaccctttaaaaasaccagttcagcataatcagtataa

SEQ ID NO: 82614 - DNA, 50 bp, homo sapien
acccactgtctaaccaatgccaataygatgaaccaggtatctcagtcagt

SEQ ID NO: 82615 - DNA, 50 bp, homo sapien
ctgagaggtgtgtaatgtgaacagakaagtgaccacagaatctgccatat

SEQ ID NO: 82616 - DNA, 50 bp, homo sapien
gaaaatatctatgaaactttactatstgaatgtgtactacctgggcacac

SEQ ID NO: 82617 - DNA, 50 bp, homo sapien
gtccttattatctaatgactaagaartagatggagtcaggattttcttga

SEQ ID NO: 82618 - DNA, 50 bp, homo sapien
caagctcgagtttcttcacacaataygattcccagaatcttcaccattcc

SEQ ID NO: 82619 - DNA, 50 bp, homo sapien
gggaagcatctgtgtcttgcctgtgratttagagatatgttcagatccag

SEQ ID NO: 82620 - DNA, 50 bp, homo sapien
atttcaacatttactcatgtgtaaartcaaaaatataatacataaatgtt

SEQ ID NO: 82621 - DNA, 50 bp, homo sapien
taaaagtcagaaagtgttagtcatcrcagatattcataatgacaaatatc

SEQ ID NO: 82622 - DNA, 50 bp, homo sapien
tatctccagcccttcgtttggaattmtcttctagtataaaagcgatcaat

SEQ ID NO: 82623 - DNA, 50 bp, homo sapien
tcccctctcatttggaatatctaacrcaatctcttatttttttttttttt

SEQ ID NO: 82624 - DNA, 50 bp, homo sapien
taagagagatgggcacatgaaccaamcattgaagtgtggtgtgataaaaa

SEQ ID NO: 82625 - DNA, 50 bp, homo sapien
aagtgtggtgtgataaaaacctcaaygaaaggaataactaaatgctcagg

SEQ ID NO: 82626 - DNA, 50 bp, homo sapien
gtcatttgggccttttagcctcccayggatcagctcggcaatggccctcc

SEQ ID NO: 82627 - DNA, 50 bp, homo sapien
gataagcatcgcatcacatagataaytggctttgaatttttaactctcag

SEQ ID NO: 82628 - DNA, 50 bp, homo sapien
ctcaggggagtcaccattgtcatcaratgttttattaatcatctgctctg

SEQ ID NO: 82629 - DNA, 50 bp, homo sapien
ctagatgactcaggttaggtcctacygaatgaaaagtcttgtggaggaca

SEQ ID NO: 82630 - DNA, 50 bp, homo sapien
ggtcagtatagtacaattatttaaarcaaatgatggatccatctcatata

SEQ ID NO: 82631 - DNA, 50 bp, homo sapien
atttcacgttagctggatgaaaataraaccaaattccttctagtcagaaa

SEQ ID NO: 82632 - DNA, 50 bp, homo sapien
acatatactgtatgtttttaatgaakacgtgattacagtatatatacgaa

SEQ ID NO: 82633 - DNA, 50 bp, homo sapien
ttcttcagttacattatgggcattcragaggttggggaaaaatcagaagg

SEQ ID NO: 82634 - DNA, 50 bp, homo sapien
gtttatactatctgagctagagaaasaaaaaggagctttaggagtgtaga

SEQ ID NO: 82635 - DNA, 50 bp, homo sapien
tgttcttagcttgctgtattgttcckctaatgttggctcacttgccattt

SEQ ID NO: 82636 - DNA, 50 bp, homo sapien
ttttgagttactagtacaaaagaaastaatcttcttgatgggattcagtt

SEQ ID NO: 82637 - DNA, 50 bp, homo sapien
tagctaagggtagtgacacaacgccragataagcagaatcattgttaggt

SEQ ID NO: 82638 - DNA, 50 bp, homo sapien
atttaaggctctctcttgtgtaatamctgtcaatgtttaagtattgtcta

SEQ ID NO: 82639 - DNA, 50 bp, homo sapien
tatattttttcctatgaactactcgyatatgggacaaggttcagagttaa

SEQ ID NO: 82640 - DNA, 50 bp, homo sapien
agcttaagcatctaacataggcaaawtataagactatcagaacacatagc

SEQ ID NO: 82641 - DNA, 50 bp, homo sapien
gaaactcagataagctgaggacaaamattaaatcagcagtggaattataa

SEQ ID NO: 82642 - DNA, 50 bp, homo sapien
tgcgactgtaatcagttcgtatgccrctataggcctcagattatttttat

SEQ ID NO: 82643 - DNA, 50 bp, homo sapien
tatgatatgtagttacaagtatccaragaactagctacctataaatggat

SEQ ID NO: 82644 - DNA, 50 bp, homo sapien
gctgtgctcaaaattgtacaaggaamtgttttaatgaccaattaattcag

SEQ ID NO: 82645 - DNA, 50 bp, homo sapien
tatgacattagtcaggaacttataayctagtcaaagaagatagacaagtg

SEQ ID NO: 82646 - DNA, 50 bp, homo sapien
tgcactgctctagatcctagtattgscaagagaaataagacctcattatt

SEQ ID NO: 82647 - DNA, 50 bp, homo sapien
tgagggttttggtaggtgtcaagtarctgtgatattagcatgtctcttta

SEQ ID NO: 82648 - DNA, 50 bp, homo sapien
gaaaccagagaagctttggagacaawtatacttaaaatgggcaaggataa

SEQ ID NO: 82649 - DNA, 50 bp, homo sapien
cctcactagattgtgggtcattagayagatatttaggttaagtattttgc

SEQ ID NO: 82650 - DNA, 50 bp, homo sapien
aaatctcagaggagaattgtgtctgraataaagaaatagctaaattgata

SEQ ID NO: 82651 - DNA, 50 bp, homo sapien
tgtaagaatcaataagagaaactagscaactgtaaagttgggaaaacagt

SEQ ID NO: 82652 - DNA, 50 bp, homo sapien
tttccttggtctcaaacaaggtacamtaaatgtatctaactttttcttga

SEQ ID NO: 82653 - DNA, 50 bp, homo sapien
ttttctctccttctgtactatcaaastatccatagtcattctgcactgat

SEQ ID NO: 82654 - DNA, 50 bp, homo sapien
aactcttctcccttcagtatcccaayctggctaactaggatcttactact

SEQ ID NO: 82655 - DNA, 50 bp, homo sapien
tttctagactgatacaagaacatcartgcagaatgactatggatactttg

SEQ ID NO: 82656 - DNA, 50 bp, homo sapien
aattgcatctaaatatttgtaaggcyaccaggtgttattgtagctgtgga

SEQ ID NO: 82657 - DNA, 50 bp, homo sapien
agaattccaaagtaattaaagatcaraatgactctgtgtttagttaaata

SEQ ID NO: 82658 - DNA, 50 bp, homo sapien
gttgctgagaggtaaaagtgagataygaagacagataattggccactgga

SEQ ID NO: 82659 - DNA, 50 bp, homo sapien
attgtgcttcggtttcagctatttaygcttctcttaaaaacaaaaacaaa

SEQ ID NO: 82660 - DNA, 50 bp, homo sapien
atacagaatgaagtaagacatggagkatttgatccagaaaactcttgaga

SEQ ID NO: 82661 - DNA, 50 bp, homo sapien
cactttcttgtcactcatagttacaytgaataagtacatagaggtagaca

SEQ ID NO: 82662 - DNA, 50 bp, homo sapien
gagctggggggaaatagagttgactsaagaaaattatatgatataaaacc

SEQ ID NO: 82663 - DNA, 50 bp, homo sapien
tcaattttgttctaagagatcaaaascatacattcttacatgaaatcctt

SEQ ID NO: 82664 - DNA, 50 bp, homo sapien
cagggagggtttctaaggagatctgracttatagagtagtcttagacttt

SEQ ID NO: 82665 - DNA, 50 bp, homo sapien
ttcactttccagtctcttcagtgtaygcctaggccagaaaaaatatgcta

SEQ ID NO: 82666 - DNA, 50 bp, homo sapien
aaaacaaagtcattttacatcttgaygccagctgcagctccaaagcaaag

SEQ ID NO: 82667 - DNA, 50 bp, homo sapien
gttagatacatctttcaacatttagyaaaattaaactcagtctttcctaa

SEQ ID NO: 82668 - DNA, 50 bp, homo sapien
cagatttgccaaacaagtcgggccargtggactttcaatacatatgagtt

SEQ ID NO: 82669 - DNA, 50 bp, homo sapien
agctggaagataggagatgaaaatayatgtgttattcagtggtattgagg

SEQ ID NO: 82670 - DNA, 50 bp, homo sapien
agttatgtttttaagatgtttgttaygttttatgatgttctattatataa

SEQ ID NO: 82671 - DNA, 50 bp, homo sapien
ggtgctatgttttagaagaaaagackccatgttataacaatatcaattca

SEQ ID NO: 82672 - DNA, 50 bp, homo sapien
gggcagaatctgcatgatcataaackgtagctttggaaaaagaaatctaa

SEQ ID NO: 82673 - DNA, 50 bp, homo sapien
gccagatggccccagatgctttctgstctatctttaggttttgcgcgcac

SEQ ID NO: 82674 - DNA, 50 bp, homo sapien
attcacacagaatcattggttgaaamtggaacaagagcttaagaactggg

SEQ ID NO: 82675 - DNA, 50 bp, homo sapien
ttcttgaatttttattgttgcataayacagtttttagttgctttaagaaa

SEQ ID NO: 82676 - DNA, 50 bp, homo sapien
gagaaagatcaccctgaagaaggccrgaagtctatagttttgctcttgag

SEQ ID NO: 82677 - DNA, 50 bp, homo sapien
ttgtattcctagcatcgattttaccratacctcatagagtaacattcatg

SEQ ID NO: 82678 - DNA, 50 bp, homo sapien
atgtagatcgtaaacatggaaattaygggtagaaattgagatagaagatt

SEQ ID NO: 82679 - DNA, 50 bp, homo sapien
tggtaaatttaattcctagagaaaayatatggtgttaaatagaaaataat

SEQ ID NO: 82680 - DNA, 50 bp, homo sapien
cccagttttgaatcatgtggtactcyatatccagtttgcctttttcatgg

SEQ ID NO: 82681 - DNA, 50 bp, homo sapien
acactattctatgacactatttctartacaaagcaattttattttttaga

SEQ ID NO: 82682 - DNA, 50 bp, homo sapien
ctaggaaaaaacagtttgtgtaaaayattatatggaatgatttgtagcta

SEQ ID NO: 82683 - DNA, 50 bp, homo sapien
ttgtaggaaaaataggcttttcagamgaacaaagcaaagagtgatatcaa

SEQ ID NO: 82684 - DNA, 50 bp, homo sapien
ataattttaaattgcagaatagaaaygctgatggaacaaggcaaagcagg

SEQ ID NO: 82685 - DNA, 50 bp, homo sapien
atatgctatgtattcatcaaatagawcttctgccaatcagggaaatagca

SEQ ID NO: 82686 - DNA, 50 bp, homo sapien
tcttataattaactatctggtttgasgtttggctaagacatatttcaaaa

SEQ ID NO: 82687 - DNA, 50 bp, homo sapien
agcactgattggccagggcaaatcarggcctatccttggaactggaagtt

SEQ ID NO: 82688 - DNA, 50 bp, homo sapien
gagctttggagtgaagtggaccttgrtgtgactcctggttctaatactta

SEQ ID NO: 82689 - DNA, 50 bp, homo sapien
tagtgttatttattcaaagctgtaawtatttggatatcttctgaaaacct

SEQ ID NO: 82690 - DNA, 50 bp, homo sapien
aacattaagaaaagatcataaatggraacatcatatgctgatgtggaaga

SEQ ID NO: 82691 - DNA, 50 bp, homo sapien
tttaatagtgaaaagttaccatagaraagtgacaggagtatgtagttctt

SEQ ID NO: 82692 - DNA, 50 bp, homo sapien
caccactgggccaatctgtctatgaraaagtccaaatcttcttatcagac

SEQ ID NO: 82693 - DNA, 50 bp, homo sapien
aaaatagcagctctgtgtatgtacayggtggtaacagcagaagaaatggg

SEQ ID NO: 82694 - DNA, 50 bp, homo sapien
ggccatgtgactttattataagtacyctaacagtgcagatgtccagaatg

SEQ ID NO: 82695 - DNA, 50 bp, homo sapien
attaaaatattttggtactgatccargaactgaaaattaacctgagtaac

SEQ ID NO: 82696 - DNA, 50 bp, homo sapien
acttttttctagaagttgaagattamctgagctttaaacaaaagaaaaat

SEQ ID NO: 82697 - DNA, 50 bp, homo sapien
tgttcggttcataacagttttaccawtctctctcagaagcctgaagagtc

SEQ ID NO: 82698 - DNA, 50 bp, homo sapien
taaaagtatattttcaatgtcataaygtactttaagtagagcaaagatat

SEQ ID NO: 82699 - DNA, 50 bp, homo sapien
attgaataagtccatggagcctacamctataaaattcactcttgacataa

SEQ ID NO: 82700 - DNA, 50 bp, homo sapien
ttgttcaggatactgggtcataatgratgttaaatggaacagttagaggt

SEQ ID NO: 82701 - DNA, 50 bp, homo sapien
tttaggtgtcctaagataacttttcyagctgaagtgacttgcatttcaag

SEQ ID NO: 82702 - DNA, 50 bp, homo sapien
tttcatgtgaaaaaactagatatgasgacaaacagcttgttcaggatact

SEQ ID NO: 82703 - DNA, 50 bp, homo sapien
ttgtctgcattggctttccttccagstgatgaaattccagaagctttttt

SEQ ID NO: 82704 - DNA, 50 bp, homo sapien
tgactattaagaatctttaatattaygctaatgcctattacaggagatta

SEQ ID NO: 82705 - DNA, 50 bp, homo sapien
aggattaaatagcataatacacatayagtacctaattcaataaatgttac

SEQ ID NO: 82706 - DNA, 50 bp, homo sapien
gtcttgtacaaactagaccttgagayacaactagaaaaataggaaaaact

SEQ ID NO: 82707 - DNA, 50 bp, homo sapien
acccgggaccctgaactgaataaacragtaaatcattatcttactagttt

SEQ ID NO: 82708 - DNA, 50 bp, homo sapien
tcctttatagtcatgtgaattcaaasgacaatacatatgtataggttcta

SEQ ID NO: 82709 - DNA, 50 bp, homo sapien
tatgtctttctgatttagataaagascacacttaaagctgttgttgattc

SEQ ID NO: 82710 - DNA, 50 bp, homo sapien
acggaaaaacatttattaaatctgcrattccaggagcaactgctagaatc

SEQ ID NO: 82711 - DNA, 50 bp, homo sapien
agtgcatgaaccatcaaattctatgraactcaaaagtgctagagggagtg

SEQ ID NO: 82712 - DNA, 50 bp, homo sapien
ttggtgctgttaatacaggttatttyccatggagcaaaattgcctaatcc

SEQ ID NO: 82713 - DNA, 50 bp, homo sapien
ttttccaagtgggctcttcttttacrtgtcatcttagaggaagactcttt

SEQ ID NO: 82714 - DNA, 50 bp, homo sapien
aacctgacttaaatgtggaaatctgrcaaagtgcacctaacctgcagaaa

SEQ ID NO: 82715 - DNA, 50 bp, homo sapien
aggactcagagatattgagatctcakgtcactctatgaaagactcgtctt

SEQ ID NO: 82716 - DNA, 50 bp, homo sapien
tgaataccacctacaaatgaatatamgatacagtagtgcctatgatactt

SEQ ID NO: 82717 - DNA, 50 bp, homo sapien
tagagaccaacaggaagaagtgtcarggatgatttctaagtttctgcttg

SEQ ID NO: 82718 - DNA, 50 bp, homo sapien
acaatagaataaggcatataatgacraagacaattaggagataattctga

SEQ ID NO: 82719 - DNA, 50 bp, homo sapien
gacttgaaaccaacttgaaaccaatsaacctctttctcttctaggggtga

SEQ ID NO: 82720 - DNA, 50 bp, homo sapien
tggtttcaagtcacatttgggaatayagaacttactgacctccttctcta

SEQ ID NO: 82721 - DNA, 50 bp, homo sapien
tctgattctgggtcatgaaaaggaakagtagaagcaaggcctatcaccaa

SEQ ID NO: 82722 - DNA, 50 bp, homo sapien
cctcaaaacagtacaatataaaacawtaccactaatacagacaggtgtaa

SEQ ID NO: 82723 - DNA, 50 bp, homo sapien
atacatgtataatgcatatataaaartcatgttgtatgtgtataaatata

SEQ ID NO: 82724 - DNA, 50 bp, homo sapien
gtggaacatactgagcttttcttcawctctctgagacctattgaaaataa

SEQ ID NO: 82725 - DNA, 50 bp, homo sapien
tggtatttgtctttgtaaatattaarccatgatcattttgaggatgtgtt

SEQ ID NO: 82726 - DNA, 50 bp, homo sapien
aaagtaaaacttgtgaaattttccaygagtttcattgatcttatcagtct

SEQ ID NO: 82727 - DNA, 50 bp, homo sapien
gaaatcagcaagatttcaataaaagsatagatgggcagtagagagagttt

SEQ ID NO: 82728 - DNA, 50 bp, homo sapien
ttatacaggtctcctgagtaaagtayacaggactgagatggtgaatgcag

SEQ ID NO: 82729 - DNA, 50 bp, homo sapien
accagtctcattttcagcagaaatckaagtgaggaattcttattttcttt

SEQ ID NO: 82730 - DNA, 50 bp, homo sapien
atacaataatgaaaatggatatcacyaaagataaagagatgattttaaaa

SEQ ID NO: 82731 - DNA, 50 bp, homo sapien
aaatattaactcatttaattcccacrtgaactctatgcaatataatagtg

SEQ ID NO: 82732 - DNA, 50 bp, homo sapien
gctagcttactacagtcatgatatcraaggcgagattcatgtgtgtgaca

SEQ ID NO: 82733 - DNA, 50 bp, homo sapien
tttgggaaggacaccttgctactcamaatagtccgccgtttgcactgctc

SEQ ID NO: 82734 - DNA, 50 bp, homo sapien
gggctgaagaaggctacctcaggtawagagaccgtccatgtcctgggtca

SEQ ID NO: 82735 - DNA, 50 bp, homo sapien
aaatgtgaggctggaaggcagtacgwaatttatgaggccttttgttgtaa

SEQ ID NO: 82736 - DNA, 50 bp, homo sapien
agggcaggccatactggtacaaggakcatctgagtacaccgctccacttg

SEQ ID NO: 82737 - DNA, 50 bp, homo sapien
ctcacttactctgaaagactttaatyttaacctctaatatgttttctcca

SEQ ID NO: 82738 - DNA, 50 bp, homo sapien
aaagtgacatgacgtttttctttcaygctaacacaacttcctttgtctct

SEQ ID NO: 82739 - DNA, 50 bp, homo sapien
taatacttgttcttcgaaaaatatasagaattagaaattagaaataggat

SEQ ID NO: 82740 - DNA, 50 bp, homo sapien
ataattgaaggtagtaattttcttcragtatattaacaaaacaaatgtct

SEQ ID NO: 82741 - DNA, 50 bp, homo sapien
tgtttttctgcttcagagttgtagayggatgtgacttaagccctaactgg

SEQ ID NO: 82742 - DNA, 50 bp, homo sapien
aacaacatactttactagtcttgacsaaaatgtacagtgtgttacaaaac

SEQ ID NO: 82743 - DNA, 50 bp, homo sapien
ttgctgatttttgaggttcattgaawttatatggtcccaaaggtgaccta

SEQ ID NO: 82744 - DNA, 50 bp, homo sapien
ttaacttcactagtactgaaaaccamagtgagttccttaataaccagcga

SEQ ID NO: 82745 - DNA, 50 bp, homo sapien
aatgttttaaaagactgagttcttcrcattatactattaacaaaaaatag

SEQ ID NO: 82746 - DNA, 50 bp, homo sapien
ttcaaaagttttattttctgacacayaggattgcagaatgagtttccaaa

SEQ ID NO: 82747 - DNA, 50 bp, homo sapien
acatgactgtatttacctttactaartacgtaactcaggcatttcaatgc

SEQ ID NO: 82748 - DNA, 50 bp, homo sapien
catctgggtgagatgcctttcatcasgttccaaaaatatcagcatcttga

SEQ ID NO: 82749 - DNA, 50 bp, homo sapien
tcaggatttcttcaggtttaaataarttatcatgtatcatctctaattta

SEQ ID NO: 82750 - DNA, 50 bp, homo sapien
ccatctgtgtttgtggaaattcctasattatattaacgtaaagccaaatt

SEQ ID NO: 82751 - DNA, 50 bp, homo sapien
gcattagattgctgctagataaaacrctactttaacttagttggaatctg

SEQ ID NO: 82752 - DNA, 50 bp, homo sapien
actgtactgatccatgtcaaagttaragctacagaaccaatgctgacgag

SEQ ID NO: 82753 - DNA, 50 bp, homo sapien
aaaatagctatgctgtactagtgaastctgtaaaactacccaacccttgt

SEQ ID NO: 82754 - DNA, 50 bp, homo sapien
ctgtatctggaggatgggagaggtastaaatcagttgataagtataaaat

SEQ ID NO: 82755 - DNA, 50 bp, homo sapien
gggaaagtttgctgggaagatgacartaagtaacaatgaatgtttacgac

SEQ ID NO: 82756 - DNA, 50 bp, homo sapien
cagagtgatactttgaaatgtaatcraatgaagagagctttaacataccc

SEQ ID NO: 82757 - DNA, 50 bp, homo sapien
aatgcagcatctcatttgaacttaasagctgaacagtcccttctataggt

SEQ ID NO: 82758 - DNA, 50 bp, homo sapien
acaggtgtaaaatgattttttttaaygtcatacttgctttgtcttctaaa

SEQ ID NO: 82759 - DNA, 50 bp, homo sapien
ctattgtactacaatatccctgtcaygctgttaacgatcttcttgggacc

SEQ ID NO: 82760 - DNA, 50 bp, homo sapien
tttcatcaggttccaaaaatatcagyatcttgacattcttgtaaaatctt

SEQ ID NO: 82761 - DNA, 50 bp, homo sapien
tgactgtgatctttcactcttgtcartaaataaagttgataaataaaata

SEQ ID NO: 82762 - DNA, 50 bp, homo sapien
ctactgttttgtctactacagatgcmattaaccaagcttctagaatctaa

SEQ ID NO: 82763 - DNA, 50 bp, homo sapien
tagcagagtttgaacagcattaatayggaagaaagtttggctctgacatt

SEQ ID NO: 82764 - DNA, 50 bp, homo sapien
gtaattgtaggatcataaactgggaycttcatagataaatgagactgggc

SEQ ID NO: 82765 - DNA, 50 bp, homo sapien
gctgatgaattacgggtgccgattayataagaaagagaatatggaaatgc

SEQ ID NO: 82766 - DNA, 50 bp, homo sapien
taacttctgttatctaatgttgccayaggtgcattggttacaatttctgc

SEQ ID NO: 82767 - DNA, 50 bp, homo sapien
aaactagatataagctgataatgcasgtaatacaggaaatggaggggcag

SEQ ID NO: 82768 - DNA, 50 bp, homo sapien
gtaaatagcatttagtgtttatatasaaaaatgcctctatttttcatctg

SEQ ID NO: 82769 - DNA, 50 bp, homo sapien
ttcaaggatcgactgtatactgaaayaatccgatgaaagggtgttcctat

SEQ ID NO: 82770 - DNA, 50 bp, homo sapien
tatatacattactgtactactctacwaattatatgatagtatttataact

SEQ ID NO: 82771 - DNA, 50 bp, homo sapien
aattgacatactagagagtatatcasagtcttttaatagaataattgatc

SEQ ID NO: 82772 - DNA, 50 bp, homo sapien
agtatcattcagttttctctatgacrcccttttgaagtacatttaaatct

SEQ ID NO: 82773 - DNA, 50 bp, homo sapien
agcacccagatatataaagcaaacaytattaaagctaaagtgagagatag

SEQ ID NO: 82774 - DNA, 50 bp, homo sapien
acaaatccatcacttacaactgtaaytcttagcctttctgtgcctaatga

SEQ ID NO: 82775 - DNA, 50 bp, homo sapien
tttttatttgaagaaatgtttttgcrtatggcttccaaaagtatctatga

SEQ ID NO: 82776 - DNA, 50 bp, homo sapien
tctctaacagataagttctgccatcytgaggctaattttatataccaaaa

SEQ ID NO: 82777 - DNA, 50 bp, homo sapien
attcaagcaaaatattctgcatagasaaatctgttcagaaagagcccatc

SEQ ID NO: 82778 - DNA, 50 bp, homo sapien
tgatgagcaagaaatgttctccttcyatggttcttcactcacaattatga

SEQ ID NO: 82779 - DNA, 50 bp, homo sapien
agttaacccaggaaatctttaaggarcactggagaacctcagcttcactc

SEQ ID NO: 82780 - DNA, 50 bp, homo sapien
gtacccagtgtttagctcccattttkaagagagaacattggtatttggtt

SEQ ID NO: 82781 - DNA, 50 bp, homo sapien
acataacagtactgtgtgttaaccakgctataattaaagagtgaagctga

SEQ ID NO: 82782 - DNA, 50 bp, homo sapien
gagttggccaggaaatggagctgtcytctgacctaccaaagagggagaaa

SEQ ID NO: 82783 - DNA, 50 bp, homo sapien
ggaggaccgggttttggggaaattaktttgattttctattagataatttg

SEQ ID NO: 82784 - DNA, 50 bp, homo sapien
catcgaatatgggaaatggctgaagsaactagaaaggttaggctggaaaa

SEQ ID NO: 82785 - DNA, 50 bp, homo sapien
aaaactgcaacatccaaattgggtakagagtttgagaaaaagctgctatg

SEQ ID NO: 82786 - DNA, 50 bp, homo sapien
tatttaaggttattaaggagactgascaagtaaagataataaacacgcaa

SEQ ID NO: 82787 - DNA, 50 bp, homo sapien
atatagtgaagactggagataaatasgaagaatttcttcaatcaaacaga

SEQ ID NO: 82788 - DNA, 50 bp, homo sapien
tagagggtatctaacaatttcctagwccccttcctcaacagctgtggtcg

SEQ ID NO: 82789 - DNA, 50 bp, homo sapien
tgtaaaacaccatagtatttgtttayaacttacgtatatcctctcatata

SEQ ID NO: 82790 - DNA, 50 bp, homo sapien
gttttcttttgttttgttgatgctawgcttgcatgtaaatagtgattcac

SEQ ID NO: 82791 - DNA, 50 bp, homo sapien
ttaatttttttagaagttaaattatytgtttatatcatccaggtacagtc

SEQ ID NO: 82792 - DNA, 50 bp, homo sapien
ttcttcctctctaatttatgtgtcamctgtaacctagacagtagactagt

SEQ ID NO: 82793 - DNA, 50 bp, homo sapien
gtccctccatttagctttatgttcartcataatcagatccaacacacctc

SEQ ID NO: 82794 - DNA, 50 bp, homo sapien
cagacaggctctatttgggcaagctyagaaagagactacacatatgagaa

SEQ ID NO: 82795 - DNA, 50 bp, homo sapien
aacagagaacctacaattctgtaaayaaatcatactcagttatttaattt

SEQ ID NO: 82796 - DNA, 50 bp, homo sapien
acgcagccataagaaacaacaaagtsacattatttgcagcaatatggatg

SEQ ID NO: 82797 - DNA, 50 bp, homo sapien
ttatgtcaaggagataaaatgatgakgttattcttatacatgtatttggg

SEQ ID NO: 82798 - DNA, 50 bp, homo sapien
acaggatgagacacaatgcatttagsagaaaagtactatgatggctaatt

SEQ ID NO: 82799 - DNA, 50 bp, homo sapien
tagttgggagtttttcaactgcaaaygaaatgactctgaaaaagtgataa

SEQ ID NO: 82800 - DNA, 50 bp, homo sapien
tacattcttcgcagatgttttattamagggatgtatggaaatcgattgtt

SEQ ID NO: 82801 - DNA, 50 bp, homo sapien
tgtctctacctcttttgatagaaaayggccaatctctttttgatttgtgg

SEQ ID NO: 82802 - DNA, 50 bp, homo sapien
gagcctccctcacatcattcatgcascaagagtagtagtggtaatagtta

SEQ ID NO: 82803 - DNA, 50 bp, homo sapien
ttgttagaaaaactacttgaaataaygacaggcagtagaaagatttttca

SEQ ID NO: 82804 - DNA, 50 bp, homo sapien
agatttactccccatatcagaaataygttaaaaaaaagtataaataggcc

SEQ ID NO: 82805 - DNA, 50 bp, homo sapien
gataattatttcatctgtgctattcmcaaaaagtaaccatctatgggaac

SEQ ID NO: 82806 - DNA, 50 bp, homo sapien
tcagttagctgtgctcacacacaacsatgatttccactgtcacctttgtg

SEQ ID NO: 82807 - DNA, 50 bp, homo sapien
ccagggtaccctccttatgacagtaygtttgtaagacaaggacttttaat

SEQ ID NO: 82808 - DNA, 50 bp, homo sapien
ttttgactgaatgacttgaaagcatwaaaaaagatgcgcgcgcgcgcaca

SEQ ID NO: 82809 - DNA, 50 bp, homo sapien
tgttataagagataaaccctgattastaaattccaacactttgtaatacc

SEQ ID NO: 82810 - DNA, 50 bp, homo sapien
acttggccactagcactcaagttaamcaattattttcctcaggaaagtct

SEQ ID NO: 82811 - DNA, 50 bp, homo sapien
tcactagtctgaatgtcagagatagyagtaccttgcatcaactctgaata

SEQ ID NO: 82812 - DNA, 50 bp, homo sapien
taaataaataaataaagagtgtataygaggaaaattatctggaagactat

SEQ ID NO: 82813 - DNA, 50 bp, homo sapien
acagtcaaacttggtgaagacttacrgaatgattatgacacttgtcctaa

SEQ ID NO: 82814 - DNA, 50 bp, homo sapien
aaaaaaacaaacaaagaactcgagargtacaccacagagaaaacagtacc

SEQ ID NO: 82815 - DNA, 50 bp, homo sapien
caaatattatagtcagagtggcttcracaacagcaatgtaacaatttatt

SEQ ID NO: 82816 - DNA, 50 bp, homo sapien
gtgaggtttcagtggaggtcagacgycaagtagaaaacctggacttctat

SEQ ID NO: 82817 - DNA, 50 bp, homo sapien
ttcatatttagtagaaagacatcccraaactcacttcatactaggtccca

SEQ ID NO: 82818 - DNA, 50 bp, homo sapien
aagaaatgatatgcccattgaagtcrccaaagaaacatatgaaaatgtat

SEQ ID NO: 82819 - DNA, 50 bp, homo sapien
cagacaggctattgtaacttcctcgragagatggactttgcctcatgcag

SEQ ID NO: 82820 - DNA, 50 bp, homo sapien
ttaaattctggattaagtcaaggtawctttcattcagcaaataagttaga

SEQ ID NO: 82821 - DNA, 50 bp, homo sapien
ggcataatttaccttaaattcctgcsagctgtgagcctgtgaaatcaaac

SEQ ID NO: 82822 - DNA, 50 bp, homo sapien
gactttatgcctcatctatctataawgcatacatttgaagttaatccatt

SEQ ID NO: 82823 - DNA, 50 bp, homo sapien
acactctcagaaataactgatgggayagtgacagtagctgatttctagta

SEQ ID NO: 82824 - DNA, 50 bp, homo sapien
aatggcaaacactagcttatgaatamgagattagccacgtagaactgtct

SEQ ID NO: 82825 - DNA, 50 bp, homo sapien
aagattatactctaaagatctggatractgcccgggagtggtggcccatg

SEQ ID NO: 82826 - DNA, 50 bp, homo sapien
ttacttcaacaccaacattctgaacmgtaccatttagatgtttgttttca

SEQ ID NO: 82827 - DNA, 50 bp, homo sapien
ctgttcttcgaacacacattggagartaatgctactaaaaatgtgcattg

SEQ ID NO: 82828 - DNA, 50 bp, homo sapien
tgaagtgctaagtagccacatgatcmgatataaaacattcccttcactgc

SEQ ID NO: 82829 - DNA, 50 bp, homo sapien
tatactcatactctagtctggacaayagagttgaggagagttgagaacca

SEQ ID NO: 82830 - DNA, 50 bp, homo sapien
ctcactgagccagagagaatttggarctatttgtggcctctagctccttg

SEQ ID NO: 82831 - DNA, 50 bp, homo sapien
ctcagcactgagtcagatagtccagsgttaaatgcctcctctgctaccta

SEQ ID NO: 82832 - DNA, 50 bp, homo sapien
gactttgagctccttgctcaaattayggattttaatgtttaatgattagt

SEQ ID NO: 82833 - DNA, 50 bp, homo sapien
atctgaacccaaatgtaatatcatcyagcatatccaagctcagacaaaat

SEQ ID NO: 82834 - DNA, 50 bp, homo sapien
gtccccttagctttagatctttagcsataaacatgccagcattcttgatt

SEQ ID NO: 82835 - DNA, 50 bp, homo sapien
tctgttgagcaaagtagtgtaaaaayggatcatcttttctaccaatttta

SEQ ID NO: 82836 - DNA, 50 bp, homo sapien
attaaatttggaaaggctcctagaamatcatctaagctccgaacattact

SEQ ID NO: 82837 - DNA, 50 bp, homo sapien
ataaatatatggatgtaagagataartagtgaataatgtatctaataaaa

SEQ ID NO: 82838 - DNA, 50 bp, homo sapien
ttcaaaatttttgagtagaggtagayctttatgctttcaaagtgggtaga

SEQ ID NO: 82839 - DNA, 50 bp, homo sapien
ctggctgtggttccctatgaattcamcacaagtagtccctattaccctac

SEQ ID NO: 82840 - DNA, 50 bp, homo sapien
atggatattctggctttgggagtgcragaaccactgacattgaggaatgt

SEQ ID NO: 82841 - DNA, 50 bp, homo sapien
ggaaaactgtatttgggttcttctcrctataaaagggtatttttagcttc

SEQ ID NO: 82842 - DNA, 50 bp, homo sapien
ctaggtaaaataaagaataataattsaatggttaaatcatgggcagagac

SEQ ID NO: 82843 - DNA, 50 bp, homo sapien
gtgcatgtgttctttctagtccttaygatgttcccacctggatgccccag

SEQ ID NO: 82844 - DNA, 50 bp, homo sapien
ctcctcattcacctggctaattactmactatccttcaaaacttagctcaa

SEQ ID NO: 82845 - DNA, 50 bp, homo sapien
gcacatatgcagagtgattgcgggarataatcagctttctctgccaaatt

SEQ ID NO: 82846 - DNA, 50 bp, homo sapien
acatggagtttgaaatagtgaatatwaagttagattacaatattataaac

SEQ ID NO: 82847 - DNA, 50 bp, homo sapien
atttaaagaactcgccaattctttcracatgaatcctaaaaatggcattt

SEQ ID NO: 82848 - DNA, 50 bp, homo sapien
gctactcctcaaatgtgcatcattamaaaaatctactggattatgaataa

SEQ ID NO: 82849 - DNA, 50 bp, homo sapien
agttgaacgaatagtatgtagaaagrcctagagccatgaaatatcatgat

SEQ ID NO: 82850 - DNA, 50 bp, homo sapien
cacagataatgccccagtagtaaaayttcatcggtttggatccactgaca

SEQ ID NO: 82851 - DNA, 50 bp, homo sapien
gcttcatactgaccatctattgcacrgattattgtttaaagtgctaccag

SEQ ID NO: 82852 - DNA, 50 bp, homo sapien
tcctattaagctgtgtggttgcagasagtttgttctcaatatatatgtat

SEQ ID NO: 82853 - DNA, 50 bp, homo sapien
tgcagtggtttattaagatcaatggmaaggtccaaactgatgtaacctac

SEQ ID NO: 82854 - DNA, 50 bp, homo sapien
ccttatatgtcatattatttgaatarccttggcattaactccataatgcc

SEQ ID NO: 82855 - DNA, 50 bp, homo sapien
ggctaaaccagctgtggcccttcaamtattcatgtgttggaataatcata

SEQ ID NO: 82856 - DNA, 50 bp, homo sapien
gggtcaataaggattataaatctcartcagactcttggtttatagaaccc

SEQ ID NO: 82857 - DNA, 50 bp, homo sapien
tggcagatgaggaaaatgcaggaaaygctgaggctttgaagatgtgctag

SEQ ID NO: 82858 - DNA, 50 bp, homo sapien
caagaactttcacatatatgatctcrcttgttcctcataacacccctttg

SEQ ID NO: 82859 - DNA, 50 bp, homo sapien
aaaggtcgcagaagccaaaagaggasaatttcaagagttcccgacaaggt

SEQ ID NO: 82860 - DNA, 50 bp, homo sapien
agagtatattagttttcttttctcargccaaagataaaagaactgatgcc

SEQ ID NO: 82861 - DNA, 50 bp, homo sapien
ccattaagaaaaaaacagagaataaygaagcatcaacatgaagataaatg

SEQ ID NO: 82862 - DNA, 50 bp, homo sapien
aagaaggctgtttctgatacaaactyaacctctctggagtatttttgcct

SEQ ID NO: 82863 - DNA, 50 bp, homo sapien
cactacatagtctatataatctcaawagccattagcttctattgtgtgat

SEQ ID NO: 82864 - DNA, 50 bp, homo sapien
aaattcatccatttaaaacatgcaaytcaatgatattcaaagaattttac

SEQ ID NO: 82865 - DNA, 50 bp, homo sapien
actgcttaacttaagcaaaatcagawcaaattaaggctgaaatctctttc

SEQ ID NO: 82866 - DNA, 50 bp, homo sapien
tgtagaagattaagagatacaataarctaggaagaatagatcaagcaaca

SEQ ID NO: 82867 - DNA, 50 bp, homo sapien
cctgccactttcaatgtttatccagkcatttctatatagggtatattatc

SEQ ID NO: 82868 - DNA, 50 bp, homo sapien
atttggtgctgactccgtgggagccraattttcagcaggctaccaactca

SEQ ID NO: 82869 - DNA, 50 bp, homo sapien
ggcccataatgagacaaacgtgaaayagttgaggtgatctagagacatct

SEQ ID NO: 82870 - DNA, 50 bp, homo sapien
attctttagtagccatgtattcccaragttctccttacaccacaatccca

SEQ ID NO: 82871 - DNA, 50 bp, homo sapien
gtatgattgcaaatgaattctgtccratagaaatgatagctccacaggtt

SEQ ID NO: 82872 - DNA, 50 bp, homo sapien
atgactgaaagccagctgaagactcraatacaaggtttattctggaatat

SEQ ID NO: 82873 - DNA, 50 bp, homo sapien
gactctaaaatcctgtaggcttgaaygtttccttgttttaaataatgacc

SEQ ID NO: 82874 - DNA, 50 bp, homo sapien
tgagagaatggtaagaccacccaccrcttttggctgaggcaggctttggt

SEQ ID NO: 82875 - DNA, 50 bp, homo sapien
aactgatcattttaagacgtaataaracagatgtcacgtaagtaacacaa

SEQ ID NO: 82876 - DNA, 50 bp, homo sapien
agttgcaatgtggcatctaaaactayataagtggatttttaataccctgt

SEQ ID NO: 82877 - DNA, 50 bp, homo sapien
catttgatgtatttgtacccgcggaytaatataccacagctcagattcag

SEQ ID NO: 82878 - DNA, 50 bp, homo sapien
gtgttcaacagacagctgattctcartatagaaaaggaaggaaagaacat

SEQ ID NO: 82879 - DNA, 50 bp, homo sapien
attaagcttaaaataacaaataatcrattcaaatggtgtcacatgacagc

SEQ ID NO: 82880 - DNA, 50 bp, homo sapien
accttgctatggcaatattgtagggraccggcttcatttagaaaacgcca

SEQ ID NO: 82881 - DNA, 50 bp, homo sapien
agaagtctagctaagcctgatcataytaactgccaattcacctaaatagc

SEQ ID NO: 82882 - DNA, 50 bp, homo sapien
gcagacctcagatatgagccctttcyggtaaaaagcaagtggacttttat

SEQ ID NO: 82883 - DNA, 50 bp, homo sapien
tcttgaaatgaacaacaggtcatccratttcactaaaattattaatacca

SEQ ID NO: 82884 - DNA, 50 bp, homo sapien
ttttaagttttacattacctatttgragttaatatttgtatacattttgg

SEQ ID NO: 82885 - DNA, 50 bp, homo sapien
gaaatatttaaatatttcagttaagsatagtaatgactactatcattgca

SEQ ID NO: 82886 - DNA, 50 bp, homo sapien
agttgtaaattgcccaaaatgaaacmatgaacagcatttgaagtagccta

SEQ ID NO: 82887 - DNA, 50 bp, homo sapien
ggatgagatatacaatatgagttgcyctctctgaaggataagcaaagagt

SEQ ID NO: 82888 - DNA, 50 bp, homo sapien
caaatcttctgcatcctttgttgaartctgaatgtagctaatttgtgaac

SEQ ID NO: 82889 - DNA, 50 bp, homo sapien
ctggcaacatctgattatctttatcrattacattttgcttctttatgcat

SEQ ID NO: 82890 - DNA, 50 bp, homo sapien
tattccctctgttctctattcagaarttcaggctagaatccaatgttttg

SEQ ID NO: 82891 - DNA, 50 bp, homo sapien
atgagacattgaaaggttggaattaygtatggcagaagacaattatgcaa

SEQ ID NO: 82892 - DNA, 50 bp, homo sapien
ctatttctctctctcttagaatttcragggttgttgagtctgagcaaagg

SEQ ID NO: 82893 - DNA, 50 bp, homo sapien
ccaacccaatcagcttctccaagatsaaattatgccatacactgggattc

SEQ ID NO: 82894 - DNA, 50 bp, homo sapien
agctaaggcactgtaataaacacacsgagatttggattctttttttcaga

SEQ ID NO: 82895 - DNA, 50 bp, homo sapien
acttttgagcaactattatggactaracattgggtcaagcagttcacaaa

SEQ ID NO: 82896 - DNA, 50 bp, homo sapien
cttgcctatctttcgttgaaacacartagcattacaagggtaattattag

SEQ ID NO: 82897 - DNA, 50 bp, homo sapien
tggcacatgccacatgcccgttacarcaacttgaggaactcatactgact

SEQ ID NO: 82898 - DNA, 50 bp, homo sapien
aggaggggatgaacattttcacatgsagtcagtatgagttcctcaagttg

SEQ ID NO: 82899 - DNA, 50 bp, homo sapien
gcttaggtttactctttattgtcacractaaatatgctctgaagattaag

SEQ ID NO: 82900 - DNA, 50 bp, homo sapien
acctattgcggagtagcctaatagcrcagttgatgagcaagagcccttct

SEQ ID NO: 82901 - DNA, 50 bp, homo sapien
aagagaaattaggcaatgggcctcaraaaaggcaatcactgccacctcgg

SEQ ID NO: 82902 - DNA, 50 bp, homo sapien
catttgacagacattctttctgttascaatttgacaactctttccccagt

SEQ ID NO: 82903 - DNA, 50 bp, homo sapien
gattcttagattgaaggctgagggarctaattgcaggtacaaaaattgca

SEQ ID NO: 82904 - DNA, 50 bp, homo sapien
agccagaattcacagaattagtccasacaggtagccaacaaacaaaacac

SEQ ID NO: 82905 - DNA, 50 bp, homo sapien
ccatagatgtgtcctgctataacttygtagtcctggatgctgtaataagg

SEQ ID NO: 82906 - DNA, 50 bp, homo sapien
tcttcctccagagaagctcaccacaraagacccctgtagctctacaggta

SEQ ID NO: 82907 - DNA, 50 bp, homo sapien
tctctgtctcctagataataataaaycccttgaaatcagaatccatgtca

SEQ ID NO: 82908 - DNA, 50 bp, homo sapien
gccaggtaagtgttgtaggaaatagraagacaaatatgacatggattctg

SEQ ID NO: 82909 - DNA, 50 bp, homo sapien
tttcttctattttcagataacgtaaytgtgtatatagaaaagtcccccca

SEQ ID NO: 82910 - DNA, 50 bp, homo sapien
gtgaggcttccctttggggctgtgawtacaacttatctggcttctaaaga

SEQ ID NO: 82911 - DNA, 50 bp, homo sapien
tttgagagtaggaattcactataaakttgagaggcaaacttctggccact

SEQ ID NO: 82912 - DNA, 50 bp, homo sapien
aaataaaaagaaaatgaatgactcaragaagttctagcaagagtccagaa

SEQ ID NO: 82913 - DNA, 50 bp, homo sapien
cctaatttttcataaacacgtaacargagtgctcccatatcagtgcattc

SEQ ID NO: 82914 - DNA, 50 bp, homo sapien
atatctgaaggactgtatgtacagakggactcaattcaatctttcttata

SEQ ID NO: 82915 - DNA, 50 bp, homo sapien
ttatggctgtgagtaagtcacttccrctctatgttctacttcctctagaa

SEQ ID NO: 82916 - DNA, 50 bp, homo sapien
aaacaaaacaaaacaaaacaaaacaktggatctggtgcaaagaagatgga

SEQ ID NO: 82917 - DNA, 50 bp, homo sapien
attcccttctcctcttttcctcaaargttctgtatgtgtttatttgaaga

SEQ ID NO: 82918 - DNA, 50 bp, homo sapien
ccatcttcccagagtcaaattgaacrcactggaacagagaggtatcaaat

SEQ ID NO: 82919 - DNA, 50 bp, homo sapien
aggctggggcatacccttgggcaggwaatctctaagagaaagaagtgatg

SEQ ID NO: 82920 - DNA, 50 bp, homo sapien
aaccatttgaagccagaattaaagascgcagccaaagagtgttgctacgg

SEQ ID NO: 82921 - DNA, 50 bp, homo sapien
tagagtgagatgacttgaggctaggmaaagaacaataacaggcagttcca

SEQ ID NO: 82922 - DNA, 50 bp, homo sapien
cacccttccacagatcctgaagcaaygctgggaaatagtaactaaatttg

SEQ ID NO: 82923 - DNA, 50 bp, homo sapien
gagcagcaatttcaaagaacatagcmaaggctttcagcaatatgtaacgg

SEQ ID NO: 82924 - DNA, 50 bp, homo sapien
acctcacaaatgcaggctatttgacraagccagtgaagtagccaccattc

SEQ ID NO: 82925 - DNA, 50 bp, homo sapien
atttttagtgatgattcaaagaacasgtagaagcaacttctaggggactt

SEQ ID NO: 82926 - DNA, 50 bp, homo sapien
agaacatgggtatggataattttagkagtcaatttggcatttgctaaaaa

SEQ ID NO: 82927 - DNA, 50 bp, homo sapien
ataaaggcatggattagaataagcargcatgtatatacataaccaaagaa

SEQ ID NO: 82928 - DNA, 50 bp, homo sapien
cctctagtttctgtagtcttatcctyagaagctgtattcactctgggctc

SEQ ID NO: 82929 - DNA, 50 bp, homo sapien
ctggttgcacacaccaaagaatgtcyatgtgggatggagaagacagtact

SEQ ID NO: 82930 - DNA, 50 bp, homo sapien
tagctagtgagtataatgtcataaayagagaaatggatctgaaacatttt

SEQ ID NO: 82931 - DNA, 50 bp, homo sapien
catataaatgtggtctcctttatcaracattaccctgttgttgacagtta

SEQ ID NO: 82932 - DNA, 50 bp, homo sapien
aagccttccacacagtttagtaacgragatccattatgccctccctcagg

SEQ ID NO: 82933 - DNA, 50 bp, homo sapien
gctttggaaagtgagtctcctgtttytgattgtagctgggcaaagatcta

SEQ ID NO: 82934 - DNA, 50 bp, homo sapien
aaaaacatgatctttcctgcataaartgtttttcagcattatgtttagaa

SEQ ID NO: 82935 - DNA, 50 bp, homo sapien
tatttttgaaaaaatagtcaagaacraagcagtgccttgcttgcaggaat

SEQ ID NO: 82936 - DNA, 50 bp, homo sapien
gatgtgtttcttaaacagttctttakatgggcaaatacagcagcttgatt

SEQ ID NO: 82937 - DNA, 50 bp, homo sapien
attaattaggtggctatttaactcarggttacacaaataaatgcttgctg

SEQ ID NO: 82938 - DNA, 50 bp, homo sapien
cccaaggcaatgtattctagtcttawgagagcactgcagcaatttttttg

SEQ ID NO: 82939 - DNA, 50 bp, homo sapien
attttctaagaaaatgtagactaccraaattatatccaaaagttgaacaa

SEQ ID NO: 82940 - DNA, 50 bp, homo sapien
cataaaaagtgtggttttttacaacygtagaatcaaaccaaaaaaacatt

SEQ ID NO: 82941 - DNA, 50 bp, homo sapien
aaaccagaaacttcataaacaatagmatggcaaagaaaccaaggaatgtc

SEQ ID NO: 82942 - DNA, 50 bp, homo sapien
tcaaggttcatccatgttatagcgtsaatcaatgcttcattcatttttat

SEQ ID NO: 82943 - DNA, 50 bp, homo sapien
aatcaaatacagtatctcctagtaayagtgtacaatttagtggtttttag

SEQ ID NO: 82944 - DNA, 50 bp, homo sapien
ttctataaaaacttcccagattgtayggtttagatacagttcaaactact

SEQ ID NO: 82945 - DNA, 50 bp, homo sapien
aacagtataaagtaaacaagagaaargattaccacagaagagtagtatgt

SEQ ID NO: 82946 - DNA, 50 bp, homo sapien
aacagaactccaaaattactactcaraatgaccatctcaaaaatgccaca

SEQ ID NO: 82947 - DNA, 50 bp, homo sapien
tgaagtcttcataaggtagttccacratgcagtttcaaacattctgaatg

SEQ ID NO: 82948 - DNA, 50 bp, homo sapien
taagctatgtgacttttgattttgarattttgaatcatgtgtcttttgaa

SEQ ID NO: 82949 - DNA, 50 bp, homo sapien
atctccaggaaaatgttgccttcttrttggtaaggagtggcacagtcaag

SEQ ID NO: 82950 - DNA, 50 bp, homo sapien
attttagtcctaattgttcctctaaygagatgattgaatttgtgcaaatt

SEQ ID NO: 82951 - DNA, 50 bp, homo sapien
aaataaaatgtcaaatatgataatascaccaaagcctgaaggggatggga

SEQ ID NO: 82952 - DNA, 50 bp, homo sapien
caggtttgtttatggttttctcagasacattaagaagaaccagagggaac

SEQ ID NO: 82953 - DNA, 50 bp, homo sapien
taaaacattcaacattttaacattcyaaacatgaatcagttcacaatctg

SEQ ID NO: 82954 - DNA, 50 bp, homo sapien
atggcttcttataaaaagtgaaatayctcatgcaacttgatagttgtata

SEQ ID NO: 82955 - DNA, 50 bp, homo sapien
aagaagaaccagagggaactcgtagyagtgattagaaaagtaactaccta

SEQ ID NO: 82956 - DNA, 50 bp, homo sapien
ttcttccctgactaggtctacaaaayaccagctatctgtaagcacgatta

SEQ ID NO: 82957 - DNA, 50 bp, homo sapien
cttttttttgatctggattattaaayttgtatcaatatagttaatcttat

SEQ ID NO: 82958 - DNA, 50 bp, homo sapien
tttagcagttcttttcagttcaagaygcaatcatttcttccctgactagg

SEQ ID NO: 82959 - DNA, 50 bp, homo sapien
aattttaaaaactgtctgaggtaaamgtttctaggtgacttggaagttaa

SEQ ID NO: 82960 - DNA, 50 bp, homo sapien
tagcctctgcatggcattgcaagcgwcctagattctaacttctctctaaa

SEQ ID NO: 82961 - DNA, 50 bp, homo sapien
tccatatagacttttaaagcattacraaactcttcatgtgttattatgct

SEQ ID NO: 82962 - DNA, 50 bp, homo sapien
acccctaagtaatgaaaatctagtcrctcaaggtcacagtttgacttatt

SEQ ID NO: 82963 - DNA, 50 bp, homo sapien
ttttcggaagaaaagttgctccttcrcaggcatgaggtaagggcttggga

SEQ ID NO: 82964 - DNA, 50 bp, homo sapien
aactgcaattacaaccatattcaaamaagttttgtctaattcctcttctt

SEQ ID NO: 82965 - DNA, 50 bp, homo sapien
gagggctggcaatctccaagcaacayggtttcccagagcttgacccttcc

SEQ ID NO: 82966 - DNA, 50 bp, homo sapien
tacatagggttttactatatttgaayaaatgccactcaataaacacaaat

SEQ ID NO: 82967 - DNA, 50 bp, homo sapien
attgctgtagttataataaggataartgatagcatggcatccataagaca

SEQ ID NO: 82968 - DNA, 50 bp, homo sapien
gctccctagatcaagccctagagaaktggtgaaaccttagatttgtagca

SEQ ID NO: 82969 - DNA, 50 bp, homo sapien
ctgcaaatgttattctgaaaaaaatrattcctagttcatgggtcatacaa

SEQ ID NO: 82970 - DNA, 50 bp, homo sapien
aaaaattgatacaaaaatatgaaccyaatttgtggtagtatcagtcactt

SEQ ID NO: 82971 - DNA, 50 bp, homo sapien
cttagggtagagctgataaacacccyacaatccaaatccatagcagtata

SEQ ID NO: 82972 - DNA, 50 bp, homo sapien
gtttactacattcaaggataaaagaygcatttgtgataattaatattgaa

SEQ ID NO: 82973 - DNA, 50 bp, homo sapien
accaattcatggatatataacacccrctaagtagcaagcatttgggaaac

SEQ ID NO: 82974 - DNA, 50 bp, homo sapien
cattccaaattcctgggaaaagagcrcattggcccaatttgggtcagctc

SEQ ID NO: 82975 - DNA, 50 bp, homo sapien
tttgatttctgccttaatgcccaaartaattcaagagtaagttgtttaat

SEQ ID NO: 82976 - DNA, 50 bp, homo sapien
agaacaaaagacagcaccctggagtrcttcaacatttagagatttgttag

SEQ ID NO: 82977 - DNA, 50 bp, homo sapien
tttttgtatttttcagtagttttatsagtagcagtcttttgtaatttttg

SEQ ID NO: 82978 - DNA, 50 bp, homo sapien
aagcatagtccaaaaggctggaacamaatcttggtagtaagcactctgca

SEQ ID NO: 82979 - DNA, 50 bp, homo sapien
tctgcaaaaataggcagccgggatamaattcagcaatgtgacatataaac

SEQ ID NO: 82980 - DNA, 50 bp, homo sapien
caaagaaaaggaatcctcagttatamataggaaacacctctaatcttgag

SEQ ID NO: 82981 - DNA, 50 bp, homo sapien
taatttggcttagtgtaataaatgarcttgggtatctactctaagcaaga

SEQ ID NO: 82982 - DNA, 50 bp, homo sapien
attaaaggagcgcagattcaacatcwccttaaccaaaaggaaaaatgaaa

SEQ ID NO: 82983 - DNA, 50 bp, homo sapien
gagcatggttcaaactccctggcctrgtatttaaggtgttctataatctg

SEQ ID NO: 82984 - DNA, 50 bp, homo sapien
accaaccattaactgacgatgaacartaacttattttccagcagtagaga

SEQ ID NO: 82985 - DNA, 50 bp, homo sapien
ttcacctatttttatgcctgggatartatagtattttataaccagaccac

SEQ ID NO: 82986 - DNA, 50 bp, homo sapien
gtggaagcattctgaattgaactacygaactggactactgaacttaaagg

SEQ ID NO: 82987 - DNA, 50 bp, homo sapien
tggtcttcaaataaaaattgccttayacatacagtgggtcccatctgtaa

SEQ ID NO: 82988 - DNA, 50 bp, homo sapien
ttgttttaaaggtgttagttgaaaayatcaaaaccagccaaacattctgt

SEQ ID NO: 82989 - DNA, 50 bp, homo sapien
aacataggcccacctacacacgttaygaggtgcttaagtgaaagaactgt

SEQ ID NO: 82990 - DNA, 50 bp, homo sapien
tacatttccttccatcttagggaagragttaaataaatctcaagctccaa

SEQ ID NO: 82991 - DNA, 50 bp, homo sapien
aaggagctggggctgtgctgagtaawtaacctttttggttcgtggttaca

SEQ ID NO: 82992 - DNA, 50 bp, homo sapien
ttttaagttccttgaaggtggaagcratgtatcatgtttgtttctttctc

SEQ ID NO: 82993 - DNA, 50 bp, homo sapien
cctctccctcaagaaagttaaattayaggtgtggcctgatgtttctagct

SEQ ID NO: 82994 - DNA, 50 bp, homo sapien
tttctaatgcattgagtctggttatytctatttaaatggagctctataat

SEQ ID NO: 82995 - DNA, 50 bp, homo sapien
aatcaacactgaaatctagctcaaaytacaaaagcaaaataaaattattg

SEQ ID NO: 82996 - DNA, 50 bp, homo sapien
agtgcatttgactgtgtgattcaagsagttaagccttcttgcactaaaac

SEQ ID NO: 82997 - DNA, 50 bp, homo sapien
atttgggaatcaatataacaaaataygtgcattacctctacaaggaaaac

SEQ ID NO: 82998 - DNA, 50 bp, homo sapien
aggaagagaaggatctggaatatagrcctcaggactcagagtctggtgct

SEQ ID NO: 82999 - DNA, 50 bp, homo sapien
acagacattctttcaactccataaaygctaagagaggctctttggtgatt

SEQ ID NO: 83000 - DNA, 50 bp, homo sapien
acacttaaaccaccactgagtccaaygatttccacatcagtggggaggca

SEQ ID NO: 83001 - DNA, 50 bp, homo sapien
atattgataaattacttttgacttasaaagcccagatcgtaactcccgaa

SEQ ID NO: 83002 - DNA, 50 bp, homo sapien
tctagtcaccgggaatgacagacatmatcaacagttagccaggaaatcac

SEQ ID NO: 83003 - DNA, 50 bp, homo sapien
ttatgaaaaagcattattatgaacayctaagtaacctagaatagctccaa

SEQ ID NO: 83004 - DNA, 50 bp, homo sapien
tttatagaacccgtttcaaatgaggkatagaacaaaagaatgtgtgattg

SEQ ID NO: 83005 - DNA, 50 bp, homo sapien
gtgcataggtaacaaaagataagtaygaaagttggagaagactatggcct

SEQ ID NO: 83006 - DNA, 50 bp, homo sapien
aattgatgggagtaaatactacaaargtacagtctaacctggagtgggat

SEQ ID NO: 83007 - DNA, 50 bp, homo sapien
aacagtcacagtcagaaattgtatcyatcacacagacgttttgtttacaa

SEQ ID NO: 83008 - DNA, 50 bp, homo sapien
ttccaacatattcctaaaaacctaamaggccacatatgtgtgtagggctg

SEQ ID NO: 83009 - DNA, 50 bp, homo sapien
aagcactggacagttaatgtcttcasgagcaaaaaagagttggtggatgg

SEQ ID NO: 83010 - DNA, 50 bp, homo sapien
tatttacctattagttgcctactttraaagaagtgttatagctctttctc

SEQ ID NO: 83011 - DNA, 50 bp, homo sapien
tccagaaaagctaggcaatttacackcctatcatctgtatttaagtatcc

SEQ ID NO: 83012 - DNA, 50 bp, homo sapien
atagacctttgagaactaaggctgaygatgcaaagactacctataagcag

SEQ ID NO: 83013 - DNA, 50 bp, homo sapien
aaccttgagtcagcagatcaaacaaytataaacatctccttatgaataaa

SEQ ID NO: 83014 - DNA, 50 bp, homo sapien
tgcagtagaaagaacactggattaartatcatgagctcttcatgttaacc

SEQ ID NO: 83015 - DNA, 50 bp, homo sapien
ttccaactgcctcacgaatagtcaaytaggtggttttctctcacttccat

SEQ ID NO: 83016 - DNA, 50 bp, homo sapien
atttagtagatcagtttataatgcartctatttggatcatgtatttaatt

SEQ ID NO: 83017 - DNA, 50 bp, homo sapien
tttggtgaatagcctcaaatgataayaaggcttaacagagagcagaacac

SEQ ID NO: 83018 - DNA, 50 bp, homo sapien
aagtctcactgtggcaatctccttargattcaaacccagagttaaggctg

SEQ ID NO: 83019 - DNA, 50 bp, homo sapien
aggtagataaaggtattcagtgactyaaggaaattaattatagaggaaaa

SEQ ID NO: 83020 - DNA, 50 bp, homo sapien
tcagacagaaaaataaactattatgraggcacatcttttaacatttactt

SEQ ID NO: 83021 - DNA, 50 bp, homo sapien
cttcccaggtgtgagattctatacarctcattacaccatctagaaaaaaa

SEQ ID NO: 83022 - DNA, 50 bp, homo sapien
gcaccaagagggacttgtacaaatasacactgatcttcccccagcactgt

SEQ ID NO: 83023 - DNA, 50 bp, homo sapien
caaatttaatttcttagcaagtgtaygtgatggtaattgaagccagaata

SEQ ID NO: 83024 - DNA, 50 bp, homo sapien
ccaaatgatacagatactacacttayacattaccatgtcagtattcactg

SEQ ID NO: 83025 - DNA, 50 bp, homo sapien
aaaggtataatgtgaagcaagattasggcaatggagttgtagaacactac

SEQ ID NO: 83026 - DNA, 50 bp, homo sapien
tgtacagagggaactgcttgacctgmaaactgtataagaggcaagaggga

SEQ ID NO: 83027 - DNA, 50 bp, homo sapien
taacagtgaggggatccggctagagyaacccaagtacagtcgattcatta

SEQ ID NO: 83028 - DNA, 50 bp, homo sapien
tcagttcccacattcaaatacagacrccgagtcgaaaatacttcagcata

SEQ ID NO: 83029 - DNA, 50 bp, homo sapien
cagaatacttgctaaattgatgtacygctattgttaagagttcagtcaac

SEQ ID NO: 83030 - DNA, 50 bp, homo sapien
tatggtgataaacttcattgataaamggaaagtgaaacttaaaacattaa

SEQ ID NO: 83031 - DNA, 50 bp, homo sapien
tactatatcatacacacatttgtgcrtaaatacacaggcataaatgaaaa

SEQ ID NO: 83032 - DNA, 50 bp, homo sapien
ttctttcctcttctgtttctacacawctttctccctctctcccctcctcc

SEQ ID NO: 83033 - DNA, 50 bp, homo sapien
cagcaatgcaaatcaaaaagtatacrcatattttgaaacaagacaaagcc

SEQ ID NO: 83034 - DNA, 50 bp, homo sapien
gtcaaggtaaagtaatgttgtagtartaagtccagtgcttctggttttga

SEQ ID NO: 83035 - DNA, 50 bp, homo sapien
tgaagcactgaggtaagaggaatatyagttgtaacttcttttggctgcaa

SEQ ID NO: 83036 - DNA, 50 bp, homo sapien
cttggccaacagaggttcaaacacamcatgaaatatgtgagcaccagaat

SEQ ID NO: 83037 - DNA, 50 bp, homo sapien
aacaatgtcatatcccatggcatcaytattcctcttcttcagattaaagg

SEQ ID NO: 83038 - DNA, 50 bp, homo sapien
ccctttcttatatgttcttatatgayctcctatttgtagaaaaatagcaa

SEQ ID NO: 83039 - DNA, 50 bp, homo sapien
gagggatgagtttctctttaacttayaaaaacgcattcagtatcctgctt

SEQ ID NO: 83040 - DNA, 50 bp, homo sapien
cttagcttccatttttgccttttagycaacctcttttcatttactcaggt

SEQ ID NO: 83041 - DNA, 50 bp, homo sapien
ggctgggtcacaataatgttaaaaamctggtctggtctgtatgtgcaatt

SEQ ID NO: 83042 - DNA, 50 bp, homo sapien
ttgaattaaaatcagggcattgagtmaaaattatggagccacctggccaa

SEQ ID NO: 83043 - DNA, 50 bp, homo sapien
ttgctggtggccatgtttccagccawacggagaaatgtctgctctgagaa

SEQ ID NO: 83044 - DNA, 50 bp, homo sapien
ccctttgtcgccacttcttcgccaastcctttttctacttctggagactt

SEQ ID NO: 83045 - DNA, 50 bp, homo sapien
gttcttactaagctctctggagtccrcagttaggagcagagtcctgaatc

SEQ ID NO: 83046 - DNA, 50 bp, homo sapien
cgttcttctcagcacacactatttaygtatctttcactacggtacagatt

SEQ ID NO: 83047 - DNA, 50 bp, homo sapien
ttatcctgtctagagccagctctccraaggtgaaattttaccttattcct

SEQ ID NO: 83048 - DNA, 50 bp, homo sapien
agggactttcaaacccatctaggtcraaattgtttacatgcatatatctg

SEQ ID NO: 83049 - DNA, 50 bp, homo sapien
atatgtatgtatgtatatgagtacaygagtgagaaaagtattccaaatct

SEQ ID NO: 83050 - DNA, 50 bp, homo sapien
tcaccccataaatgccctaatgcatsagacgttggtctacatggaaattt

SEQ ID NO: 83051 - DNA, 50 bp, homo sapien
acctggaagtactttatactcagacraatttaataggcttaagatggtaa

SEQ ID NO: 83052 - DNA, 50 bp, homo sapien
tgctgtataagttttaccaaggaagwctcagtgttgtctaaggaggcaag

SEQ ID NO: 83053 - DNA, 50 bp, homo sapien
aaaggaaaataacaagtttgggcaastccatgaagatattgtgttagtgt

SEQ ID NO: 83054 - DNA, 50 bp, homo sapien
gaaaatttgtaagtgtggaattttgmagtatgttaaattctagattctcc

SEQ ID NO: 83055 - DNA, 50 bp, homo sapien
gctacatatgtaagcaataaaggtawctatcttaatgggtatacagctat

SEQ ID NO: 83056 - DNA, 50 bp, homo sapien
tttaaaacaaataacaactgacaaarttctctcataaaaaatatttattg

SEQ ID NO: 83057 - DNA, 50 bp, homo sapien
ctttatcttgtgaaattgttagggtsaagagtagctcttggggttaatat

SEQ ID NO: 83058 - DNA, 50 bp, homo sapien
ctcttcccggagagagcaaacactargatgttggttgcagcataaattgc

SEQ ID NO: 83059 - DNA, 50 bp, homo sapien
gacaaaacttctcaggtgaggttaarcttggacaatggtcagtgggcctg

SEQ ID NO: 83060 - DNA, 50 bp, homo sapien
ggtgggcagaggtggtagacaggaayaacaatgcaatagaatgtatactt

SEQ ID NO: 83061 - DNA, 50 bp, homo sapien
gaatagcaagatggtagatttaagcycaatcatactgaaaattacattca

SEQ ID NO: 83062 - DNA, 50 bp, homo sapien
aataaagaagaattgctacacacgcygaacttattagtttcctcccagga

SEQ ID NO: 83063 - DNA, 50 bp, homo sapien
agagcctcatagataccgaactctaygccaatcctttccacatacatttc

SEQ ID NO: 83064 - DNA, 50 bp, homo sapien
ggcactgatctggggattattccaamaattacagtcctctattttcctac

SEQ ID NO: 83065 - DNA, 50 bp, homo sapien
tcacaggaccttcatcaaaattaaakggtacatcataagaaagcatctat

SEQ ID NO: 83066 - DNA, 50 bp, homo sapien
tttaacccttaaactctaaatccaarttctgagctctttccactacaact

SEQ ID NO: 83067 - DNA, 50 bp, homo sapien
aaaacccataataattgacttggaaygattactagtaagaggctcttagt

SEQ ID NO: 83068 - DNA, 50 bp, homo sapien
acaataaacagggattaaggcatacratgtaagttttaaatgacaatatt

SEQ ID NO: 83069 - DNA, 50 bp, homo sapien
aatatggagtgcttaggggaatataycaggaggatgcaggctgccttgct

SEQ ID NO: 83070 - DNA, 50 bp, homo sapien
atagcaacaccctgttcacactagaygtgcctccaccctgaatccaagtc

SEQ ID NO: 83071 - DNA, 50 bp, homo sapien
tgataacctgtctggacccagatttygtgccaagaatgggagcttgccat

SEQ ID NO: 83072 - DNA, 50 bp, homo sapien
gccagaggagcctcaaattcactatsagaaattccaaagtgtgatgtatt

SEQ ID NO: 83073 - DNA, 50 bp, homo sapien
tttctcctgttaccttgacatttttrtagctaaatctctttctaaatttg

SEQ ID NO: 83074 - DNA, 50 bp, homo sapien
tgattataaaatgcacataaaaaagyaaagattcaagaagagaagaaaaa

SEQ ID NO: 83075 - DNA, 50 bp, homo sapien
tgactatgtataatacactgtgctaycaatgtgtggatattaaagtaata

SEQ ID NO: 83076 - DNA, 50 bp, homo sapien
taaagcttgtctctggtagtctttakctgattaggctttaacagcaagat

SEQ ID NO: 83077 - DNA, 50 bp, homo sapien
atccttccttagtagtctcttcccawgtgtgaaaccatctttgtggagga

SEQ ID NO: 83078 - DNA, 50 bp, homo sapien
gaggagaattttctcacctcatcatratactgccctaatttatagccctt

SEQ ID NO: 83079 - DNA, 50 bp, homo sapien
gaccttcttggctcatactcctacarataccctgcacgtaagcaacatac

SEQ ID NO: 83080 - DNA, 50 bp, homo sapien
accttttttttcactttgcctcaaaygagtagatggtctcgggtcaagat

SEQ ID NO: 83081 - DNA, 50 bp, homo sapien
tcagaatcccctctgtagacctttgraatgcaatttcctccactctacta

SEQ ID NO: 83082 - DNA, 50 bp, homo sapien
ttaacaataccaaactctcataaaasatatgtacttaaaacaaaaatctg

SEQ ID NO: 83083 - DNA, 50 bp, homo sapien
cccggccactgccatacaatttcaasggcagcttcctcctgttcctcaag

SEQ ID NO: 83084 - DNA, 50 bp, homo sapien
atctttgccttttgaatttgcataarcggttgagttttacatgcagaaat

SEQ ID NO: 83085 - DNA, 50 bp, homo sapien
gcatcagaaaataaagttttaaatcsattgtattcatctattaaaatata

SEQ ID NO: 83086 - DNA, 50 bp, homo sapien
aaggaagactctttaaaacatgacartagagagacacaataaaggagtat

SEQ ID NO: 83087 - DNA, 50 bp, homo sapien
atcctctctattcttggaaaaatgayaatgaactggtatcagtatcatcc

SEQ ID NO: 83088 - DNA, 50 bp, homo sapien
gatggaattattatctctctcttagmaaacaaaaagccatggctcagaaa

SEQ ID NO: 83089 - DNA, 50 bp, homo sapien
gatagaatattagaatttgcatgaargttacaatgctaaagaatttagag

SEQ ID NO: 83090 - DNA, 50 bp, homo sapien
ataagacagataacctgatacaaaartgggcaaaatgtttgaatagaaag

SEQ ID NO: 83091 - DNA, 50 bp, homo sapien
aagaaagatggagtcacttatgtcasatttctctcactgttataattttt

SEQ ID NO: 83092 - DNA, 50 bp, homo sapien
gatataaattcccactaattatgaasgtactgatttttatcacaatttga

SEQ ID NO: 83093 - DNA, 50 bp, homo sapien
taggcagacaaaaactcaagccacartattcacattatttgtcatatgga

SEQ ID NO: 83094 - DNA, 50 bp, homo sapien
tcaattaagaagtgtcctacatttcsaacaagatataatccttattggct

SEQ ID NO: 83095 - DNA, 50 bp, homo sapien
tttaagaaagcgtattttaaacatcsagaagtagaaaggacctatcctta

SEQ ID NO: 83096 - DNA, 50 bp, homo sapien
gctctgttgttcctacatcaacagcratccttttatgcatagtcaatggc

SEQ ID NO: 83097 - DNA, 50 bp, homo sapien
gacatattcaaagttatcatttgtcraaacttgaaatctcacaaggaaat

SEQ ID NO: 83098 - DNA, 50 bp, homo sapien
tctaatcagctgtggccagataacaytaacgataatagctaataaaaagt

SEQ ID NO: 83099 - DNA, 50 bp, homo sapien
tgcactccagcctgggtgacaccaaraaaagaagaagaaagacgaaagaa

SEQ ID NO: 83100 - DNA, 50 bp, homo sapien
agtttggggataaaaccacatacacycatttgtgtttactttaaagaatg

SEQ ID NO: 83101 - DNA, 50 bp, homo sapien
gacagtacctcctttggttgcctgarcacacaagagagtgatgttactga

SEQ ID NO: 83102 - DNA, 50 bp, homo sapien
gatattgtttagaataaatcctatamcttaattctgactagtgagttttg

SEQ ID NO: 83103 - DNA, 50 bp, homo sapien
aaaatagaaatcacctgtaattactragcatcgccaatctagaaatattt

SEQ ID NO: 83104 - DNA, 50 bp, homo sapien
aaatgaacgtgagctgacagcttccyatcattaaaaacaaacaaacaaac

SEQ ID NO: 83105 - DNA, 50 bp, homo sapien
tgtctcactcatatctgttagatgargttaaatactacttgaaatcctta

SEQ ID NO: 83106 - DNA, 50 bp, homo sapien
ggaagaattggttttaatgttgactyactaacactatgtaacaattgttt

SEQ ID NO: 83107 - DNA, 50 bp, homo sapien
caaccctgtgtgccactctttcgcaytgagtaaaagtatgtgcatttcat

SEQ ID NO: 83108 - DNA, 50 bp, homo sapien
tcttgtactcactcgggacctttgaygaaagcatcttgcatgctgcgtcc

SEQ ID NO: 83109 - DNA, 50 bp, homo sapien
tttatcaaaatgcatatatccttagragaagtaacattgacctagtatca

SEQ ID NO: 83110 - DNA, 50 bp, homo sapien
taaaatctagtgctctatatttgcaytaatggccttgtagtaatctggat

SEQ ID NO: 83111 - DNA, 50 bp, homo sapien
cttttgagccttctgagggccaaaaycttccatcatctcaaacactattt

SEQ ID NO: 83112 - DNA, 50 bp, homo sapien
accaggaaggcctgagtgaagagaayaattatagaaccaataaataaaga

SEQ ID NO: 83113 - DNA, 50 bp, homo sapien
gtgaagaatgaggagggggtttacargcatacatcagagtaaaaggaagg

SEQ ID NO: 83114 - DNA, 50 bp, homo sapien
gtggataataatgccttaaaagtcartattttccctagacttaaatgctt

SEQ ID NO: 83115 - DNA, 50 bp, homo sapien
ttttctgaacatctcctgaaaaccamtataaataaaatccgtatttgcta

SEQ ID NO: 83116 - DNA, 50 bp, homo sapien
gtgagtctttaattccttacctttaraagttctctccctcaagcattagt

SEQ ID NO: 83117 - DNA, 50 bp, homo sapien
attagctgttgatttgtccattttarcactattctacatctccatggtca

SEQ ID NO: 83118 - DNA, 50 bp, homo sapien
ggatggcgtagggttgacttcctaaygtatgtgtggaccctgtgatgttc

SEQ ID NO: 83119 - DNA, 50 bp, homo sapien
acaaatgcatgtatatatcagtaagwcccaactcatattttcccagttac

SEQ ID NO: 83120 - DNA, 50 bp, homo sapien
attctatatgttaatggaaacagaayaacatggagcttgccctagcagta

SEQ ID NO: 83121 - DNA, 50 bp, homo sapien
atctggagcaaagttcccaagcacargaaatgttaatgtgctttgtttag

SEQ ID NO: 83122 - DNA, 50 bp, homo sapien
tcatttactttttaaattttgttcayagattatcttctcttcctaacttt

SEQ ID NO: 83123 - DNA, 50 bp, homo sapien
aagtaaatgatggctttagcacaaastcgatggttgctgttttttatttg

SEQ ID NO: 83124 - DNA, 50 bp, homo sapien
gactttaaggccttgtctttaccttyatcctgcaattaaaaacaccacat

SEQ ID NO: 83125 - DNA, 50 bp, homo sapien
atgtttatgctttcccaaagtgcatyagatcaaggttaccaaaccctcct

SEQ ID NO: 83126 - DNA, 50 bp, homo sapien
gcagcttgtcttccactcctttctcycttagattataagaacattgtagc

SEQ ID NO: 83127 - DNA, 50 bp, homo sapien
ttcaatcatgtcctatcaatttggtraaaagatctgtccagctcctttta

SEQ ID NO: 83128 - DNA, 50 bp, homo sapien
tcaagcttcttgaaatctcaatgcartatcactaaagtatagcattttgc

SEQ ID NO: 83129 - DNA, 50 bp, homo sapien
atttatatccttaatatgtaaaatamactcacacaccaataacaaaaatt

SEQ ID NO: 83130 - DNA, 50 bp, homo sapien
gtctctaatatatatttaggttaaaragactttgtaatcaaatgctgctt

SEQ ID NO: 83131 - DNA, 50 bp, homo sapien
ggaggaaaaatcaaatttgtactaaygtagagcgtatacacgagttggtc

SEQ ID NO: 83132 - DNA, 50 bp, homo sapien
ttatcatcaataaagggtatgtaacracaaaagattcaaatatgtttata

SEQ ID NO: 83133 - DNA, 50 bp, homo sapien
aagggtatatattggcacaggaagamgagatggatcaatggactggaaga

SEQ ID NO: 83134 - DNA, 50 bp, homo sapien
tgttgggttaacaagtcataactacracccttttacatgtttcttaatca

SEQ ID NO: 83135 - DNA, 50 bp, homo sapien
tttccaaacactgtgttttcacttcratgctcccagaattctccattcag

SEQ ID NO: 83136 - DNA, 50 bp, homo sapien
gctcatggctgtcttgtactaggctsaaacatgatatgtgcagagggtaa

SEQ ID NO: 83137 - DNA, 50 bp, homo sapien
ggatgtttattgtatactactaagtkaaatggcaagtgtgcataaaccca

SEQ ID NO: 83138 - DNA, 50 bp, homo sapien
ttttcaatatgtctacagtacacaakaattgattttgaaaattaataatg

SEQ ID NO: 83139 - DNA, 50 bp, homo sapien
tctgcttattctgttctcacccaagrcatttgagtaaaatatggaacttg

SEQ ID NO: 83140 - DNA, 50 bp, homo sapien
gactagtaattaggaactattatcaygttttttcccagaattttggagat

SEQ ID NO: 83141 - DNA, 50 bp, homo sapien
tctagattaatctgtgtaaaataacrattgaaatttaaattatacgtaga

SEQ ID NO: 83142 - DNA, 50 bp, homo sapien
taattcactagaaccattcatataastcaggaaagcactatgcttatgat

SEQ ID NO: 83143 - DNA, 50 bp, homo sapien
tgataggacatgattgaaatattccracttaaaacagaccagatagcatc

SEQ ID NO: 83144 - DNA, 50 bp, homo sapien
tttccatgaataaataaaggtaactsagatgacagtaacaaagatgaacg

SEQ ID NO: 83145 - DNA, 50 bp, homo sapien
tcactgaggcaaagtagttaagacartccctgaccataaaaaacatagta

SEQ ID NO: 83146 - DNA, 50 bp, homo sapien
ttttgaataaagaaatactgtaaccrgagaaagcccagagatcactccac

SEQ ID NO: 83147 - DNA, 50 bp, homo sapien
ctctggtgctctcacactatctgtayagctaaatattaatttcccaagcc

SEQ ID NO: 83148 - DNA, 50 bp, homo sapien
atataaatttatcttaaattcagtcrgagcggaaaaaacagattccctat

SEQ ID NO: 83149 - DNA, 50 bp, homo sapien
ccagtaagggttagtgtcaggagaargtctggctgcccagacacactgtg

SEQ ID NO: 83150 - DNA, 50 bp, homo sapien
cccagacacactgtgctacctgttakaggccgatgggatgaaaacgactg

SEQ ID NO: 83151 - DNA, 50 bp, homo sapien
ctgctggctttctcaaggagactgamggttcctacctttctctgagccaa

SEQ ID NO: 83152 - DNA, 50 bp, homo sapien
gagagagtttaaagtatcatccaagraactgaggatttaggagaacaaag

SEQ ID NO: 83153 - DNA, 50 bp, homo sapien
tttctagaatctgttcccttcaagcraccctgtaattgtgcattttgttt

SEQ ID NO: 83154 - DNA, 50 bp, homo sapien
tctgagttttgtacagatgattttgsttgtccttagataaaagcccttca

SEQ ID NO: 83155 - DNA, 50 bp, homo sapien
tcctggaatgaacggctaaatgaatmataaattagattaataaaatactc

SEQ ID NO: 83156 - DNA, 50 bp, homo sapien
gtgtagttatctaatgactttggagraaatctgcttcgttttgattcttg

SEQ ID NO: 83157 - DNA, 50 bp, homo sapien
atctattgacaaataaactgatttamattaagtgagtgctgcttcgtgtt

SEQ ID NO: 83158 - DNA, 50 bp, homo sapien
tagatattgtatggcatattctcacrcttcattcactggccacctgatgt

SEQ ID NO: 83159 - DNA, 50 bp, homo sapien
ttaatccacatagagctttaattgayactactatttttaacatgaaagac

SEQ ID NO: 83160 - DNA, 50 bp, homo sapien
atttcagtccccctgccatctctacyagaactggtgtgggtacccacggc

SEQ ID NO: 83161 - DNA, 50 bp, homo sapien
cagaatcaatgaagctggggaatgaygttgtggactgagtgagctatgtg

SEQ ID NO: 83162 - DNA, 50 bp, homo sapien
gaaacatgtttatttttattatttarggttccaaagactggggtaggtaa

SEQ ID NO: 83163 - DNA, 50 bp, homo sapien
aatttggtgtcagccagaatacattraaaatggtctctatttgtcgtttt

SEQ ID NO: 83164 - DNA, 50 bp, homo sapien
acaaatgaggaaatagaggatcacakcataaatcgctctgaagcacacag

SEQ ID NO: 83165 - DNA, 50 bp, homo sapien
tttaattctatattcccctgtgctayagttttttgaatttgcttaatttg

SEQ ID NO: 83166 - DNA, 50 bp, homo sapien
caatcacttttgtcatagcactgtamctatttcaccattatctccaacag

SEQ ID NO: 83167 - DNA, 50 bp, homo sapien
tctagatcaatacttattgataggtyaaaagatgaaatctaaacctgaaa

SEQ ID NO: 83168 - DNA, 50 bp, homo sapien
tttacagtgagactttatttttgtawgagtgtcaacccactcctcaagcc

SEQ ID NO: 83169 - DNA, 50 bp, homo sapien
taaaaggattagcacaaccatatcargaaaaccatattaccaaaccaata

SEQ ID NO: 83170 - DNA, 50 bp, homo sapien
gccatgcaggggaaatgaatgttcaygggttggaagataggaaaaagcag

SEQ ID NO: 83171 - DNA, 50 bp, homo sapien
tagtggtgctgtgagggtaggaaagragcgaatgagccgctagtaacatc

SEQ ID NO: 83172 - DNA, 50 bp, homo sapien
taagagataattctcaacccactaamatctgattcaggaatctactaatg

SEQ ID NO: 83173 - DNA, 50 bp, homo sapien
ggctactgctaaaggcatcagtgctrttgtagagttggggcaagtggagg

SEQ ID NO: 83174 - DNA, 50 bp, homo sapien
agaaaactactaggaaagattgacamacttacaataataaagggtaattt

SEQ ID NO: 83175 - DNA, 50 bp, homo sapien
taatttcatattttttaaggcttagyaatttgttcctgctaattatatta

SEQ ID NO: 83176 - DNA, 50 bp, homo sapien
tctcagcatctgagggtaggacatayatctcatacatctcatcatagcct

SEQ ID NO: 83177 - DNA, 50 bp, homo sapien
tggtatgtcaatttttttcatgttcyatgggtgcttaaaaaagagtgctt

SEQ ID NO: 83178 - DNA, 50 bp, homo sapien
gatgttctagacctgttttagcattmttatgtattatctgttatgaagac

SEQ ID NO: 83179 - DNA, 50 bp, homo sapien
cagatgataaccagagaaaccaatcragaaacaagggaagtgcaggggag

SEQ ID NO: 83180 - DNA, 50 bp, homo sapien
agggctggaagcagtggttacagaaygaagcatgtgtttctaacattata

SEQ ID NO: 83181 - DNA, 50 bp, homo sapien
tgtgtttccttgccctttagaaaatsaattgttcactacaattagagaat

SEQ ID NO: 83182 - DNA, 50 bp, homo sapien
cattttagtaaattattaagactaasaagaggagttgctttttcagtact

SEQ ID NO: 83183 - DNA, 50 bp, homo sapien
aatcttcttttgctttttaagaaaastaaccatccaatcacaaactagcc

SEQ ID NO: 83184 - DNA, 50 bp, homo sapien
gttttgctgttataaacagagcaaaytgtaagtcagaagatattttttac

SEQ ID NO: 83185 - DNA, 50 bp, homo sapien
ttcatttacaatgtagtactttataygctaggatacattgctgctttata

SEQ ID NO: 83186 - DNA, 50 bp, homo sapien
tgagaaccacagctgttaacatataygctctaccttataatttcatctct

SEQ ID NO: 83187 - DNA, 50 bp, homo sapien
acttgtcaaatacaggaaacacttgsaaataagtgaagtgaggggcagag

SEQ ID NO: 83188 - DNA, 50 bp, homo sapien
gacttattttactacatagcactttsaaaattatgttaaataagaaggga

SEQ ID NO: 83189 - DNA, 50 bp, homo sapien
aagttttccttatttatagcagtccmaagctttattcccttagagatgtc

SEQ ID NO: 83190 - DNA, 50 bp, homo sapien
aaaaccttcagacatcattccaaacmgagactagcaggtgcaaaggcaca

SEQ ID NO: 83191 - DNA, 50 bp, homo sapien
tttgaccctgtagtttttctaacacyaagtacagggaagccagtgaagtc

SEQ ID NO: 83192 - DNA, 50 bp, homo sapien
ggatttagattccccttctctagtaycaactaaaagttccttttctcttc

SEQ ID NO: 83193 - DNA, 50 bp, homo sapien
tctgcaccaacctgatagattctcartgaaagtcaaatacatagatgaaa

SEQ ID NO: 83194 - DNA, 50 bp, homo sapien
gagagagaggagagagaaacagaacrattcctagtctgaggttgctgagc

SEQ ID NO: 83195 - DNA, 50 bp, homo sapien
cacctatctacagacgaagagtaacygagatggtatatgactgcactagc

SEQ ID NO: 83196 - DNA, 50 bp, homo sapien
tcctgaaagctcagacttctgaggaygggagtaagccagacaaggtatct

SEQ ID NO: 83197 - DNA, 50 bp, homo sapien
aatcgtgtaggagctgaaaagtcgargagagacctacaaatccagagaca

SEQ ID NO: 83198 - DNA, 50 bp, homo sapien
aaggacggcctgcagcaggacggagrcgaccaggaccagcgtcaggcaga

SEQ ID NO: 83199 - DNA, 50 bp, homo sapien
ccgttccccaagggctacttcccaaygtcgtttattaactagtcaatacc

SEQ ID NO: 83200 - DNA, 50 bp, homo sapien
ccagtcctttctctctggattgtcakaatttaatctgaagcctagacata

SEQ ID NO: 83201 - DNA, 50 bp, homo sapien
aaatattgtgaggagacttcttagartaatatcttcatttaccgttgcat

SEQ ID NO: 83202 - DNA, 50 bp, homo sapien
ctactttctataaacatctgttaacraaatagacccaaggcatatacgaa

SEQ ID NO: 83203 - DNA, 50 bp, homo sapien
taaatactggaaagatcctcaataamttataaaactagttaactatagag

SEQ ID NO: 83204 - DNA, 50 bp, homo sapien
gggggagggaagttggagtgaaagcrgatatactcagagtgtaccttttg

SEQ ID NO: 83205 - DNA, 50 bp, homo sapien
atacagtaaaagaattatgtggaacratgtggagccagctgacagctctg

SEQ ID NO: 83206 - DNA, 50 bp, homo sapien
gaagcattctctgtattctcattgtkaattctgggacccaggggatgatc

SEQ ID NO: 83207 - DNA, 50 bp, homo sapien
actgtagaagtagaaagtgtgagtayaaaacaaagttcagaaagatggaa

SEQ ID NO: 83208 - DNA, 50 bp, homo sapien
gacttctccagatcagctccaaaaakatatagactattaatgggggaaat

SEQ ID NO: 83209 - DNA, 50 bp, homo sapien
ttgggaaatgcttggtaaattaaacrggacttctcaggacaatgaattta

SEQ ID NO: 83210 - DNA, 50 bp, homo sapien
ccaggtagaggttgtcactatattcraggaattgttcttaagtctttagt

SEQ ID NO: 83211 - DNA, 50 bp, homo sapien
gttagcaattcagtggtggccttcamgatgatttgccatggactgatggt

SEQ ID NO: 83212 - DNA, 50 bp, homo sapien
aaaaacaataatgcattacttaaacrcatcatccaaacaatggcaaatgc

SEQ ID NO: 83213 - DNA, 50 bp, homo sapien
ttttatctataatttttctagggtaygttgtgagatgtaactcattttca

SEQ ID NO: 83214 - DNA, 50 bp, homo sapien
agtctactttttcataggtggaaacraaattaagattggattagaggtgt

SEQ ID NO: 83215 - DNA, 50 bp, homo sapien
aaagcatattgtgtctcattttaaaytgctagtagggcagaactgagatt

SEQ ID NO: 83216 - DNA, 50 bp, homo sapien
ccaattaactagaagttaaagctgargctatttgccagaagggagggagg

SEQ ID NO: 83217 - DNA, 50 bp, homo sapien
aagcaaatggttaaatagcagataakacacaattaaagagaaagaaccaa

SEQ ID NO: 83218 - DNA, 50 bp, homo sapien
taatttaagtgtttcttgaccacaargagagtattaagcaaagtcaaaag

SEQ ID NO: 83219 - DNA, 50 bp, homo sapien
tcatcaaataaggaaaatgtattcamagtgatggagtatattgctattgg

SEQ ID NO: 83220 - DNA, 50 bp, homo sapien
aactccaaaacacacactcttctaaktattatactgcctcaaaacaagtt

SEQ ID NO: 83221 - DNA, 50 bp, homo sapien
aggtaaaacttttaaaactctgaackgtatcctttttcaaacaatctttg

SEQ ID NO: 83222 - DNA, 50 bp, homo sapien
cacaatcatttcagagacaccagagkattatgtttggcagtggaatctga

SEQ ID NO: 83223 - DNA, 50 bp, homo sapien
tgtctaatttacttataaaagcacartcatttcagagacaccagaggatt

SEQ ID NO: 83224 - DNA, 50 bp, homo sapien
gtgactgtatattaagcataagatayggtctataggtaaacatctttgtc

SEQ ID NO: 83225 - DNA, 50 bp, homo sapien
gtagttaatgccaatttatcaagacrggaaatgaatctgatcttatttct

SEQ ID NO: 83226 - DNA, 50 bp, homo sapien
actataaactaaataatatatcaacractactctacagccaatgttatgc

SEQ ID NO: 83227 - DNA, 50 bp, homo sapien
taaattatatcaaaactattttgccrtctatcaaggtatgtttttgtcct

SEQ ID NO: 83228 - DNA, 50 bp, homo sapien
catttttttaaaataattcatgacaytcactgatcagataagaaaagaaa

SEQ ID NO: 83229 - DNA, 50 bp, homo sapien
gcatctcgacttcactcagactttgsaatgtataatcaatgttaatattc

SEQ ID NO: 83230 - DNA, 50 bp, homo sapien
ctttatatcttactcaagtgattaargtatgttaatttcagatagtgaag

SEQ ID NO: 83231 - DNA, 50 bp, homo sapien
accaaccagttatgtaagggggaaaycagatgtacatagaattctagcca

SEQ ID NO: 83232 - DNA, 50 bp, homo sapien
gccgtgaggcattctttagtatgtcmattgaatttttcagctctagaatt

SEQ ID NO: 83233 - DNA, 50 bp, homo sapien
ctgagatctacttatgttcttcaaartatggtcatcacttttccttagaa

SEQ ID NO: 83234 - DNA, 50 bp, homo sapien
gcctgtttttcaggattagggatgascaattttgccaataatgtctattc

SEQ ID NO: 83235 - DNA, 50 bp, homo sapien
aacaaatgctttgctaaagatgtctsaagatgtagtaggggtgcccagaa

SEQ ID NO: 83236 - DNA, 50 bp, homo sapien
gataccgctcacctcggtggccgacstattcctggctactagcctggctc

SEQ ID NO: 83237 - DNA, 50 bp, homo sapien
ccctttgctagaagcagccaagtgaragattgtgaattgcgatctcagtg

SEQ ID NO: 83238 - DNA, 50 bp, homo sapien
tgcgatctcagtggttcagagggtgrattacttgttttcaggtctttgaa

SEQ ID NO: 83239 - DNA, 50 bp, homo sapien
attcaatttatatttacataaaacayggctgtagctactccactgataga

SEQ ID NO: 83240 - DNA, 50 bp, homo sapien
aggctaattattccttagcagtacayggtttgttttgatatttacatata

SEQ ID NO: 83241 - DNA, 50 bp, homo sapien
atttcttactacatactgtgctaaaycctaggtgacctcttatttttggt

SEQ ID NO: 83242 - DNA, 50 bp, homo sapien
ttcctttccacctatgtgaattcaayctgtcctctaagatccaactcaag

SEQ ID NO: 83243 - DNA, 50 bp, homo sapien
agttcatgcttttaatccattcttcsattcatagatttcatggttgcaaa

SEQ ID NO: 83244 - DNA, 50 bp, homo sapien
aagaaaacttctggggcagtacattraagagtgtaaaactcaggaaataa

SEQ ID NO: 83245 - DNA, 50 bp, homo sapien
tttgcatctttttgattattcattarcttcatctttttatataattgtta

SEQ ID NO: 83246 - DNA, 50 bp, homo sapien
aggactggataactaaattagctaargagatcaaagaaggagtcaaggat

SEQ ID NO: 83247 - DNA, 50 bp, homo sapien
ttatctatcacccctggttcaagtcrattaaagacatacagactgatcat

SEQ ID NO: 83248 - DNA, 50 bp, homo sapien
actctgcttgagaagtttcctagcartaaatgaatagtctcttaggtgat

SEQ ID NO: 83249 - DNA, 50 bp, homo sapien
tgttccctagctactaaatacgtacyacaatggcatctaacaaccatcag

SEQ ID NO: 83250 - DNA, 50 bp, homo sapien
gagcatgagtttaggtgaatagggayactctccagagagggccagctttt

SEQ ID NO: 83251 - DNA, 50 bp, homo sapien
gagagaagaacacctacatatttacmcagagaagggactaactgcccatt

SEQ ID NO: 83252 - DNA, 50 bp, homo sapien
aacaatccctgtatgcagaaatagtmaatttgacaacattaaacacattt

SEQ ID NO: 83253 - DNA, 50 bp, homo sapien
gtcaatactgcccttcttttcacatrgttaaccaatcaatcaaattatca

SEQ ID NO: 83254 - DNA, 50 bp, homo sapien
tgaaattacctggctttcttctggtygaattgggaataaattcaagtttc

SEQ ID NO: 83255 - DNA, 50 bp, homo sapien
aaatatattgccatgtcttagaaccraagaggtacatatgacaaataaaa

SEQ ID NO: 83256 - DNA, 50 bp, homo sapien
agcctttggactctgtaaagtatcawtgacctttcttgtaatgcctttgt

SEQ ID NO: 83257 - DNA, 50 bp, homo sapien
aataggtcttaagaattgctcacaartaagcctgaaatcagaattcacaa

SEQ ID NO: 83258 - DNA, 50 bp, homo sapien
taataagtatattcatcttcttttawctttgtgagagtacccagttatgc

SEQ ID NO: 83259 - DNA, 50 bp, homo sapien
acaaaggaatgcttgccatagatagwcaatttgccttaagatacctcatt

SEQ ID NO: 83260 - DNA, 50 bp, homo sapien
atgtaaatatactgaaaactacagaragtaagtagatcaagtcactaaaa

SEQ ID NO: 83261 - DNA, 50 bp, homo sapien
aagaaaataaaagttgaaaagaattmaatggaacaaggagacatgtttat

SEQ ID NO: 83262 - DNA, 50 bp, homo sapien
tatttctgagaagggttgtccttaaratttcagagtggaaatgaaagtgg

SEQ ID NO: 83263 - DNA, 50 bp, homo sapien
gcaatatgtttatttctctagcttascactctgatggtcagagatactcc

SEQ ID NO: 83264 - DNA, 50 bp, homo sapien
gacaaataaacctttgctgttttaasctactgaggtcttgggactggttg

SEQ ID NO: 83265 - DNA, 50 bp, homo sapien
aaaggatttctttaaaggtatgaaastattagcagagtaaattttacata

SEQ ID NO: 83266 - DNA, 50 bp, homo sapien
ctacatgtcctggcaacgtctaaagycacagcaattccttgtcctctttt

SEQ ID NO: 83267 - DNA, 50 bp, homo sapien
agttcaatatgtatattggtatgtarctaaataagatgtgcatattaaac

SEQ ID NO: 83268 - DNA, 50 bp, homo sapien
ttggatagagttcccacatttagcaycagcagtcagtctcattcctggct

SEQ ID NO: 83269 - DNA, 50 bp, homo sapien
tcaataaatggaatccaattgtcaartatcttcaagagccacgttatttc

SEQ ID NO: 83270 - DNA, 50 bp, homo sapien
aatttttctaggctctagtaaaggasaatcatcaagtcaactgcatacca

SEQ ID NO: 83271 - DNA, 50 bp, homo sapien
ctctttttcaactgaaaatgtttccyatttcaaagataaggcccttaata

SEQ ID NO: 83272 - DNA, 50 bp, homo sapien
tcaagtgaatgtgggaacctaatagrcaaaatgtggtatacaaggcacag

SEQ ID NO: 83273 - DNA, 50 bp, homo sapien
gtagctgaactaattatacttaaaawctaagatggatagagaagaaggaa

SEQ ID NO: 83274 - DNA, 50 bp, homo sapien
tgtatatgtattaatcttcagttggytgggataaaaactcatctaattag

SEQ ID NO: 83275 - DNA, 50 bp, homo sapien
taggtgtgggctcccagaattttcaytgacagaaagatagaaaggaagca

SEQ ID NO: 83276 - DNA, 50 bp, homo sapien
ttatttacaacttaactgaagccacragatttaatcgccttcctggaagc

SEQ ID NO: 83277 - DNA, 50 bp, homo sapien
tacactggaaagatatagcagttacraactttgaagaacttaacaaatgc

SEQ ID NO: 83278 - DNA, 50 bp, homo sapien
tgaccatctcaattgatgcacaaaamgcatttgacagaatctagaatcct

SEQ ID NO: 83279 - DNA, 50 bp, homo sapien
taggtagataaggtagaattggtcaraaacatactaatgtaataaaacct

SEQ ID NO: 83280 - DNA, 50 bp, homo sapien
taacacagtctctcggttttgaaaaytgattatgttagactatatgtata

SEQ ID NO: 83281 - DNA, 50 bp, homo sapien
actaaaaacttcaaaaatgtgtctgsaaatataaagttacaggttcaaga

SEQ ID NO: 83282 - DNA, 50 bp, homo sapien
aggtaccaagtgtgactcaggaagargtgcactatactccaaaagaacta

SEQ ID NO: 83283 - DNA, 50 bp, homo sapien
attctcctgaactaaagtattaacayggagacaaagtggccagctctcaa

SEQ ID NO: 83284 - DNA, 50 bp, homo sapien
acagttagaaaaggaattgttcccawgataaccaaataatttacgcagtt

SEQ ID NO: 83285 - DNA, 50 bp, homo sapien
gagcatagaatcaagaactgagtccrgatactccagcagttagagaggtc

SEQ ID NO: 83286 - DNA, 50 bp, homo sapien
aggctcaggtctatttcactggaaamcctctactcatgtctttaaacaca

SEQ ID NO: 83287 - DNA, 50 bp, homo sapien
gccaactaaaaataaaatgacactckggtgattacaaatggtacatcatt

SEQ ID NO: 83288 - DNA, 50 bp, homo sapien
tggaggataggtgatggatgatcgakgacagctaactagatagataataa

SEQ ID NO: 83289 - DNA, 50 bp, homo sapien
ctctgtagattgtagtgaatcatcaygcattaatttactccagtttacta

SEQ ID NO: 83290 - DNA, 50 bp, homo sapien
gctgatccaaagataaagggactaawttaggtgaaaataatcaaatatcc

SEQ ID NO: 83291 - DNA, 50 bp, homo sapien
gcaggagcgtggaggtgataagcaaygaaaaacgtactgtgtaaatatag

SEQ ID NO: 83292 - DNA, 50 bp, homo sapien
ggagacattattggtgatatcgtacygagcttctatcagcacacaatact

SEQ ID NO: 83293 - DNA, 50 bp, homo sapien
caataaatgatatgattattatactyaaagattatctgagagacagggac

SEQ ID NO: 83294 - DNA, 50 bp, homo sapien
ttttcatatacatggtgaaccaagartaaaagtgctagctggggtcagta

SEQ ID NO: 83295 - DNA, 50 bp, homo sapien
tttagatgtgtgtggggtagtaagcragggtgagaaaaagaaaattatgc

SEQ ID NO: 83296 - DNA, 50 bp, homo sapien
ggtgctgcaatacttggatggtttcratagcactgtttaatgagcctaag

SEQ ID NO: 83297 - DNA, 50 bp, homo sapien
aaagggcatggttccggaggggtgaygacaatgaaaaaagacaagaagtt

SEQ ID NO: 83298 - DNA, 50 bp, homo sapien
gtaagccacatagcacttgttattayggctatcctcattcggactccttg

SEQ ID NO: 83299 - DNA, 50 bp, homo sapien
gaatcagttatttgcaagacagcaaygttcaagaaaattaggataacaat

SEQ ID NO: 83300 - DNA, 50 bp, homo sapien
attagtccctttatctttggatcagsagaacataacgatgtctgtctcct

SEQ ID NO: 83301 - DNA, 50 bp, homo sapien
atatgaactgtgattacgaggataaracacattaagagaggagtcacaga

SEQ ID NO: 83302 - DNA, 50 bp, homo sapien
tgcacaacaagtacttattatgtgaraagttaagcatgcacagttgagac

SEQ ID NO: 83303 - DNA, 50 bp, homo sapien
ggtatttttcttaaggttgaatatcraagtatatatctaaatgatataaa

SEQ ID NO: 83304 - DNA, 50 bp, homo sapien
tctcctaccatgagttcctatcacaraagtttatcatggtgagcttaaca

SEQ ID NO: 83305 - DNA, 50 bp, homo sapien
aacactaagtgagaggaatgatctayacttcacaatgatagaaatatttg

SEQ ID NO: 83306 - DNA, 50 bp, homo sapien
ctgtgactagagatcaaatgataatwcaagctcataaaagagaaaaaagc

SEQ ID NO: 83307 - DNA, 50 bp, homo sapien
tttataatgtgtttatagttttaatktttaatgagcttagccatggggac

SEQ ID NO: 83308 - DNA, 50 bp, homo sapien
actaattttaggtcataatactaacrgagtttgaggatctagcaattgtt

SEQ ID NO: 83309 - DNA, 50 bp, homo sapien
aattttcagtagcaacttgactttaygatttgtgtcttgaaatttgtgga

SEQ ID NO: 83310 - DNA, 50 bp, homo sapien
tacatgacttgatcatgtgcagaatkatagggaaatatatttccaacaca

SEQ ID NO: 83311 - DNA, 50 bp, homo sapien
tgagaacagaagctcagctctttagraatacaatgtaagaatcaggtaga

SEQ ID NO: 83312 - DNA, 50 bp, homo sapien
tgaatttgccattgtatggaactcgsaaaatgcattcaattcggggttgg

SEQ ID NO: 83313 - DNA, 50 bp, homo sapien
atacaccaatgtagggagacagatamtataaacatgcctacctaaacaag

SEQ ID NO: 83314 - DNA, 50 bp, homo sapien
agaaaattgcttcaattcttttagascattagttggcaagctacagctgg

SEQ ID NO: 83315 - DNA, 50 bp, homo sapien
ggactatagctaagaaccgtagggcrcagagaatttagaattcagatttt

SEQ ID NO: 83316 - DNA, 50 bp, homo sapien
ttagtctatatgcaggtcattagtcragtccaataccgtatacaaaaaat

SEQ ID NO: 83317 - DNA, 50 bp, homo sapien
tccttccctgtgacagtgatattcakatttttccttctgtcttatctgga

SEQ ID NO: 83318 - DNA, 50 bp, homo sapien
aacatttgcatcttgggtcattgtcyaataaactttcagaaagtgaatac

SEQ ID NO: 83319 - DNA, 50 bp, homo sapien
ttttggcacctttccaaggatcacastgagacatcttatgtggtttataa

SEQ ID NO: 83320 - DNA, 50 bp, homo sapien
gcttttacatttctgtgtgtggtaamgagataacttggaagtacagagag

SEQ ID NO: 83321 - DNA, 50 bp, homo sapien
agagatgagagagtattaaagcccayagagaatcaagtttctttatcaaa

SEQ ID NO: 83322 - DNA, 50 bp, homo sapien
taagaataaaggccaggaatgtgtaygtttaaccaaggagtgtttgcaat

SEQ ID NO: 83323 - DNA, 50 bp, homo sapien
agagtttataaagcactttcacctgkgttatctcattcgatcttggcaaa

SEQ ID NO: 83324 - DNA, 50 bp, homo sapien
aattcatagctaacttcaaaagaaartaatagaatgataagcctggatat

SEQ ID NO: 83325 - DNA, 50 bp, homo sapien
aattgcctggctcactgtaggttctyaatacatttttggtggccacatgt

SEQ ID NO: 83326 - DNA, 50 bp, homo sapien
tctctggaataatttagtcaaagaargattaaaggagaaattttaaaaca

SEQ ID NO: 83327 - DNA, 50 bp, homo sapien
ttgaaggcagggaccatcatgttctmaacttgcatgttcaatgccgaaca

SEQ ID NO: 83328 - DNA, 50 bp, homo sapien
aaagaagcagcaactaaacaccatarcaaagaaacgtgatagagccaaat

SEQ ID NO: 83329 - DNA, 50 bp, homo sapien
gcacgtgcagtaccaccacctgaagkcagggcatgaagccaaaaaggatt

SEQ ID NO: 83330 - DNA, 50 bp, homo sapien
tctgttgcagacacagagctctacaygtatcatcttatttgatcctcatt

SEQ ID NO: 83331 - DNA, 50 bp, homo sapien
ttctaacagcttgccaatgtagagamggaaagagataaagtcatacttag

SEQ ID NO: 83332 - DNA, 50 bp, homo sapien
ggtgagatttcttgtactatggttgyaatactaggagaatgcattggata

SEQ ID NO: 83333 - DNA, 50 bp, homo sapien
agacagatgggtgttaccagatcttygcatgtttttcagatatcagattg

SEQ ID NO: 83334 - DNA, 50 bp, homo sapien
atagctgctggctgattgtgttgtayatgaaatctttaagttagttaata

SEQ ID NO: 83335 - DNA, 50 bp, homo sapien
tgcagacaaataaacacgtaaatgartaagtaaaatatttttaaagtatt

SEQ ID NO: 83336 - DNA, 50 bp, homo sapien
ctacatgaaatagacaagccattagyaatgcataaacagcaatagatgtt

SEQ ID NO: 83337 - DNA, 50 bp, homo sapien
catggaagcagaatgtcctgacttcrcctatgacttgactctgagagtcg

SEQ ID NO: 83338 - DNA, 50 bp, homo sapien
tatactatgctgctgtccatttgtarggagctatatttcccagttgtaaa

SEQ ID NO: 83339 - DNA, 50 bp, homo sapien
tcctcccacatcccacagatgtacayattaggtgaattggctgtctacat

SEQ ID NO: 83340 - DNA, 50 bp, homo sapien
tcaaagttctaaaaactacaacatartatacatcttgaaagaaaccagag

SEQ ID NO: 83341 - DNA, 50 bp, homo sapien
atagtatccatcatcagcaatctaaygtgtatatgactttacagaaaagg

SEQ ID NO: 83342 - DNA, 50 bp, homo sapien
cccacttgattccatgacctggccamgaaaatatcagaatggttctagag

SEQ ID NO: 83343 - DNA, 50 bp, homo sapien
gggtaaagcaacacaatatgtggaaytgggaacatcagtgtgaatttgat

SEQ ID NO: 83344 - DNA, 50 bp, homo sapien
agtttgtcccttctcattggtacctwaactcaaattaggtcatcagatgc

SEQ ID NO: 83345 - DNA, 50 bp, homo sapien
gtcattgtgacccttgttctggagckgcatccatagagtttcaaattaca

SEQ ID NO: 83346 - DNA, 50 bp, homo sapien
aactaggtacttttattccaagattyaaggctgattttctaaatgttggc

SEQ ID NO: 83347 - DNA, 50 bp, homo sapien
cataatagatttctaaattagatcaygaattagactaaagagacttccaa

SEQ ID NO: 83348 - DNA, 50 bp, homo sapien
gactgccttttatattttatttacaraaagtgcatagttgagaatataag

SEQ ID NO: 83349 - DNA, 50 bp, homo sapien
aagagttgatggcttctgaaaactckaaaacagccattctccaccttttg

SEQ ID NO: 83350 - DNA, 50 bp, homo sapien
tctttcttcttccagatcatcttgayaagttataccggggattaaatgta

SEQ ID NO: 83351 - DNA, 50 bp, homo sapien
agattttaagttttttgaaaatcaamctccattcatttatttctgcttca

SEQ ID NO: 83352 - DNA, 50 bp, homo sapien
gaaaatgtgaatgtgaagatccttgmaagggagaaaagttacaaaataag

SEQ ID NO: 83353 - DNA, 50 bp, homo sapien
ctcctgaaacttataaaagcataacygatggaggctgttctgcattgaag

SEQ ID NO: 83354 - DNA, 50 bp, homo sapien
attgctactgcatggcactaaaaaarttcatcatgacaggtgtgggaaga

SEQ ID NO: 83355 - DNA, 50 bp, homo sapien
ttttttgtaaggatatgttaaataaygcatgaaagcagttagcaaactgg

SEQ ID NO: 83356 - DNA, 50 bp, homo sapien
ctctatgtttctcatttcaagaagargcctattattttaccccagcatat

SEQ ID NO: 83357 - DNA, 50 bp, homo sapien
ttatgctctttaaaggatcttggccrtattctgagccacctatacctact

SEQ ID NO: 83358 - DNA, 50 bp, homo sapien
gaacatgctactgcagtgtttcacartcatcttctaactctgctcctcct

SEQ ID NO: 83359 - DNA, 50 bp, homo sapien
agcatacttattagaaggttaaattrtaggtcaagaatgaatagctgaag

SEQ ID NO: 83360 - DNA, 50 bp, homo sapien
ctgttttattctatcacatggattcragtgttgctttccattaaatgtgt

SEQ ID NO: 83361 - DNA, 50 bp, homo sapien
gaggagagattaacagtggacctgaytatatagactatgttgcataagta

SEQ ID NO: 83362 - DNA, 50 bp, homo sapien
tgataaatagaaaattgaaattcaasgtaatttggatataaacagttcca

SEQ ID NO: 83363 - DNA, 50 bp, homo sapien
tcatggatagaatacggtatgatgasaaaatgagcttcaactttgtttta

SEQ ID NO: 83364 - DNA, 50 bp, homo sapien
cccagaatgaatcaaagtttgtgaartactagaaacattgttcacataca

SEQ ID NO: 83365 - DNA, 50 bp, homo sapien
tttccagcccaaaaaagaagtatcarggtatatatgaagagaaggagcca

SEQ ID NO: 83366 - DNA, 50 bp, homo sapien
ctcaatgaatgataccatcatatacmcagggactgaagcatgacacctgg

SEQ ID NO: 83367 - DNA, 50 bp, homo sapien
tacttctttaaagtaatatgccttayaatgaaacttaatgattttttaac

SEQ ID NO: 83368 - DNA, 50 bp, homo sapien
caaaggaggtaaggcaacttggagaragtcagtttacatatgtgaaagtg

SEQ ID NO: 83369 - DNA, 50 bp, homo sapien
caccaagcacccaaatgttttcttawctacaatgtcatgattacctcttt

SEQ ID NO: 83370 - DNA, 50 bp, homo sapien
tataaagagtgatagacttaattaamaaaatgctgaatataagtatggac

SEQ ID NO: 83371 - DNA, 50 bp, homo sapien
ttttacaaaatgtacatacagagatkaattttatttgctgcattatataa

SEQ ID NO: 83372 - DNA, 50 bp, homo sapien
ctggcacatctgagtgatacatagamtacaatgaaaatggtgccccctgc

SEQ ID NO: 83373 - DNA, 50 bp, homo sapien
ggaaagaaaatcaaaggtctgtagtsaatatgagaaaagcaaaggaaata

SEQ ID NO: 83374 - DNA, 50 bp, homo sapien
gcaaaaaatctcatgaaatctggtayagcaaacactataaatgggctaaa

SEQ ID NO: 83375 - DNA, 50 bp, homo sapien
tcaaaactcaacaaatgctgaaaaawttctctccaagatgctaatttgaa

SEQ ID NO: 83376 - DNA, 50 bp, homo sapien
tgagcttttcaaccgagaaagtagartaagagagatattaaaagtactaa

SEQ ID NO: 83377 - DNA, 50 bp, homo sapien
tactagatttgtgtatatagacacaycataaaaacatcatttctctctaa

SEQ ID NO: 83378 - DNA, 50 bp, homo sapien
gaaaagcccttactttactcaatacrcagaaaatagactcaaaatggatg

SEQ ID NO: 83379 - DNA, 50 bp, homo sapien
cgtgtttttatttactataattgacsatgaaccaattcagaggttattat

SEQ ID NO: 83380 - DNA, 50 bp, homo sapien
tacagtgtagtttctatgtgatttckccagctataatcagcttcagcagt

SEQ ID NO: 83381 - DNA, 50 bp, homo sapien
tgaggatgttaattttaacctgaccyatcataaattaataggatctagcc

SEQ ID NO: 83382 - DNA, 50 bp, homo sapien
cccaagacatagcactgaactatgaygaacaaaaggaacattacaaggtg

SEQ ID NO: 83383 - DNA, 50 bp, homo sapien
caatttgggagaagactttctaaccrcttcttttagatagctacataatc

SEQ ID NO: 83384 - DNA, 50 bp, homo sapien
agtaaagtaaaaaataaagggatcartatattcacacaatattgaaaact

SEQ ID NO: 83385 - DNA, 50 bp, homo sapien
actgatacatttcaagagataagggycacaaggagattttcactcaagtt

SEQ ID NO: 83386 - DNA, 50 bp, homo sapien
tattgactgacttagaaggtcaaacragctggataaaatttaagagatta

SEQ ID NO: 83387 - DNA, 50 bp, homo sapien
gatctgtatcctttaatttcagggarctatgctaggtttgacattaaggt

SEQ ID NO: 83388 - DNA, 50 bp, homo sapien
taacacacatgaacctgtaacagccrgaacacagtccatattctaaacac

SEQ ID NO: 83389 - DNA, 50 bp, homo sapien
aacctggggaaagaaaacacataacyatgctatatagacactacccaagc

SEQ ID NO: 83390 - DNA, 50 bp, homo sapien
aaccacagtatacatataagggtaarcaatggatgcagaaacagcaaatg

SEQ ID NO: 83391 - DNA, 50 bp, homo sapien
caaataaaggaaaccatataatatcyaacatggagtcaacttatataata

SEQ ID NO: 83392 - DNA, 50 bp, homo sapien
aagtttgggctgtgatctactagacrgtgcttaagcataatggtcagtag

SEQ ID NO: 83393 - DNA, 50 bp, homo sapien
taagatataaactcattgcatgtcayagatactaaaaatatttttccaat

SEQ ID NO: 83394 - DNA, 50 bp, homo sapien
aggcccttgctcagccacttggctcygctgtatttcctcacaaatgcacc

SEQ ID NO: 83395 - DNA, 50 bp, homo sapien
gctagatatgcttctatgtgctatgrattgaacaatgagaaatttagaaa

SEQ ID NO: 83396 - DNA, 50 bp, homo sapien
aggagcaggtgatggctacaaggaamgaagagctatcctagagtccgggg

SEQ ID NO: 83397 - DNA, 50 bp, homo sapien
ataaaatttactagaaaactatccaygttgctatctataatgccatgtgt

SEQ ID NO: 83398 - DNA, 50 bp, homo sapien
ctcataaaggcaagatctgttcatcrcttttgggaattaacaaaggtgtc

SEQ ID NO: 83399 - DNA, 50 bp, homo sapien
gtaattctatttaggtcagttgatamgttacctctgttagaactgaggga

SEQ ID NO: 83400 - DNA, 50 bp, homo sapien
caagagacttaactaacagcagctayagaaataagttgtacattttgtct

SEQ ID NO: 83401 - DNA, 50 bp, homo sapien
gaatattatattactattcaaatggractctagccaagcctaatttgtct

SEQ ID NO: 83402 - DNA, 50 bp, homo sapien
aataatggataactaataacgaaggwaaggctgaataattcaaacaacac

SEQ ID NO: 83403 - DNA, 50 bp, homo sapien
gaacatggtaactccaagcagtcaayttcctcattcaaggctagataccc

SEQ ID NO: 83404 - DNA, 50 bp, homo sapien
ttgtggccaagctccccttttaatgsagtggaagtgtacctgttgctgtt

SEQ ID NO: 83405 - DNA, 50 bp, homo sapien
gtcatacttttgcaaaatgatggggyagaactttgactgcagcttcagtg

SEQ ID NO: 83406 - DNA, 50 bp, homo sapien
cagttctcgtcatcttaaaatctaaytcaagtcatggttgtctatgtgac

SEQ ID NO: 83407 - DNA, 50 bp, homo sapien
aagttggtgtttatctgctacagcaycttatttacattacgaatattctc

SEQ ID NO: 83408 - DNA, 50 bp, homo sapien
tttttttgtatgtttattggccacasaaatgccttctcttgataactgtt

SEQ ID NO: 83409 - DNA, 50 bp, homo sapien
cttctctctgctcccagatcaactayattatgtgcaatttgtaattgttt

SEQ ID NO: 83410 - DNA, 50 bp, homo sapien
gtatgatttaatgtatttttgatagratggtggatattgtctcttgtctc

SEQ ID NO: 83411 - DNA, 50 bp, homo sapien
atcgtgtgtgcagtagattcagtgargcctagaattggtcttatttgaaa

SEQ ID NO: 83412 - DNA, 50 bp, homo sapien
tgtctaccatacatgacggtggatamcttaatgacaggcaccctgagcat

SEQ ID NO: 83413 - DNA, 50 bp, homo sapien
tgaagcaattaccagaaatctaaggkaaaagttagaacaaagtcatcgag

SEQ ID NO: 83414 - DNA, 50 bp, homo sapien
ttgtaatcagccatttatttgaggasacttggtttcccataatggaaaac

SEQ ID NO: 83415 - DNA, 50 bp, homo sapien
acctgcctgtagacatttctgaggaytccagggatctcgagcatatccct

SEQ ID NO: 83416 - DNA, 50 bp, homo sapien
aaattcgctctcccatccttgtcaaygttcaccacgtgttacaacctgac

SEQ ID NO: 83417 - DNA, 50 bp, homo sapien
aattgagaagctagacaataatacgrcttgattagttctttaggaagata

SEQ ID NO: 83418 - DNA, 50 bp, homo sapien
gagcagtaccagcaatgatattaacrcataatcaatcctatttgagatcc

SEQ ID NO: 83419 - DNA, 50 bp, homo sapien
tcctggcacataagacatcaggaaawgactggtaaattaatgaagagcaa

SEQ ID NO: 83420 - DNA, 50 bp, homo sapien
ggggagaatggaacaagaaaaaggayagtatacggaatgaggacacagtg

SEQ ID NO: 83421 - DNA, 50 bp, homo sapien
agcacatatttattttatagcaaaartgttgacaatgtaaattaccatgg

SEQ ID NO: 83422 - DNA, 50 bp, homo sapien
tatgcaactcatttttctttgccaartaaggtaacaaattcacaggttcc

SEQ ID NO: 83423 - DNA, 50 bp, homo sapien
tgtgtcagacttctgatctccagaastatacaataatgaatctgtgttgt

SEQ ID NO: 83424 - DNA, 50 bp, homo sapien
ttggctatatcctgacacttgggtasactaagacagcttctttggcaaat

SEQ ID NO: 83425 - DNA, 50 bp, homo sapien
gtcaggaatgtcagagagaaaaatcmttactatcttcacatgttctgaca

SEQ ID NO: 83426 - DNA, 50 bp, homo sapien
acagacaaaatctctacattgagacrctagtttgctccacaataagaaat

SEQ ID NO: 83427 - DNA, 50 bp, homo sapien
gtgcacatattttctgattatgaagrcctcctgatatcaatggagagagt

SEQ ID NO: 83428 - DNA, 50 bp, homo sapien
ctggcagctcttgttatagtatttckcagttttcaatgaagtgtccatgc

SEQ ID NO: 83429 - DNA, 50 bp, homo sapien
ttattttttaactaactgagccagargaatggattatacatatttgttgt

SEQ ID NO: 83430 - DNA, 50 bp, homo sapien
ttaaatacgttttttaattatagtaygttaaagttatcataggtttatga

SEQ ID NO: 83431 - DNA, 50 bp, homo sapien
ggattttcccatctaccaaaaattgyactgaatcacctcaataaatgttt

SEQ ID NO: 83432 - DNA, 50 bp, homo sapien
cagctttattttcagaatatatcccraatctaaccactcctcaccactcc

SEQ ID NO: 83433 - DNA, 50 bp, homo sapien
tattctgaaaataaagctgtcaggaytatttgtggattgcatagaggttt

SEQ ID NO: 83434 - DNA, 50 bp, homo sapien
cttcccctgctgcattttaatgttargatatttgcaaaaaagttggcggt

SEQ ID NO: 83435 - DNA, 50 bp, homo sapien
cagtcgtatatattgtcttcaaaacrtctgcattaagttatttttttctg

SEQ ID NO: 83436 - DNA, 50 bp, homo sapien
gaagcagcagcctcagaaattatcartaagaaaaactaggaacacgctat

SEQ ID NO: 83437 - DNA, 50 bp, homo sapien
tcatacccaggcctttatttcaatarcgtgttcactctgcatgtgtttcc

SEQ ID NO: 83438 - DNA, 50 bp, homo sapien
ataatccccacttctcttacataaarggatcttacactctgaatctcttt

SEQ ID NO: 83439 - DNA, 50 bp, homo sapien
gtgagaccctgtctcgaaaaaaaaarttctatgaagtctaagctggacaa

SEQ ID NO: 83440 - DNA, 50 bp, homo sapien
cttgtaatcattacaacaactctggrattagtaagcacatggatttgcac

SEQ ID NO: 83441 - DNA, 50 bp, homo sapien
ttctagtgtgagtcacattacactayacaatatctggcttttgtcctttg

SEQ ID NO: 83442 - DNA, 50 bp, homo sapien
aataacatttcattgaatatttacasagcatgtacacaaactaataaatt

SEQ ID NO: 83443 - DNA, 50 bp, homo sapien
gtgatttaaggaaagatgggtcatartaataataaaagctgagatgtatt

SEQ ID NO: 83444 - DNA, 50 bp, homo sapien
gagccaccttgactctctattatcartattccttaccaagtcctaaatgt

SEQ ID NO: 83445 - DNA, 50 bp, homo sapien
ttaatgtttcctgggtctaaattctyctgaaatcctttatcaactgtgtg

SEQ ID NO: 83446 - DNA, 50 bp, homo sapien
aaacacaccacccagagttaccatcragaagagagaacagacccaggctg

SEQ ID NO: 83447 - DNA, 50 bp, homo sapien
tatttttgaccaccagttgccaggawcacttttagatgttgaactcttaa

SEQ ID NO: 83448 - DNA, 50 bp, homo sapien
gattgtttctttttggtgctgtaaaractcagatttcccagaacctctga

SEQ ID NO: 83449 - DNA, 50 bp, homo sapien
taaaagacattaccagactcatgaargtgctgtataaaggtaaatatata

SEQ ID NO: 83450 - DNA, 50 bp, homo sapien
cccacatctcattaatgccagacacragttttctttcaatctgaatgctc

SEQ ID NO: 83451 - DNA, 50 bp, homo sapien
ttccttgtagattctggatacatgcrccaaatatacatccagaatctata

SEQ ID NO: 83452 - DNA, 50 bp, homo sapien
catacagctctttgatggccatgtcsagtttgccttctttgtcttccctg

SEQ ID NO: 83453 - DNA, 50 bp, homo sapien
tgtacagctatccgctgtatctcctsacagaaaaaagtgaaggcatatag

SEQ ID NO: 83454 - DNA, 50 bp, homo sapien
tcaagaagtacagaatcccttgaaawgtgcagagattcaaggctagagcc

SEQ ID NO: 83455 - DNA, 50 bp, homo sapien
tgtaaggatggaaagtgtcattttayagtagcagaagctttgccttcttt

SEQ ID NO: 83456 - DNA, 50 bp, homo sapien
ttttagaattgaatactaaagattawgaattttgcattattgaatgttag

SEQ ID NO: 83457 - DNA, 50 bp, homo sapien
tgtacttcttgattactaaaacatayggaaattgtacaaatccagcatga

SEQ ID NO: 83458 - DNA, 50 bp, homo sapien
ataagtttatcagtaaattgtgtaaratggacttaattattcttaaaatt

SEQ ID NO: 83459 - DNA, 50 bp, homo sapien
tattaaaccagaaccaacacacaaaygatctgtgcaaagaggtcagcaaa

SEQ ID NO: 83460 - DNA, 50 bp, homo sapien
ctctgtttcttgttgccattattcawcctgggaggcatccggctgcacct

SEQ ID NO: 83461 - DNA, 50 bp, homo sapien
gccattgctcagtttttctcagtacrctatgtctatgtcaaaacatttcc

SEQ ID NO: 83462 - DNA, 50 bp, homo sapien
tagaggccatgcgaagacagctgatyagtgacccaaggcagagccacatg

SEQ ID NO: 83463 - DNA, 50 bp, homo sapien
tttaactgaataataaaaatcagtcktacttagttggctggagttttatt

SEQ ID NO: 83464 - DNA, 50 bp, homo sapien
ctttcacaatgtagacatctaaacaytctcctttagaagtacccattgcg

SEQ ID NO: 83465 - DNA, 50 bp, homo sapien
tgccctctcaatatcctgcaacctakgctctcagtttcagtgttagtact

SEQ ID NO: 83466 - DNA, 50 bp, homo sapien
aaaattatgctgtaagtaaggtgacyccacagagtttgtttgggctgcat

SEQ ID NO: 83467 - DNA, 50 bp, homo sapien
ccccattaagactgtaataaacacaycaaaggtttccaagggctagagta

SEQ ID NO: 83468 - DNA, 50 bp, homo sapien
gtatatgttttgggaagaaatcttckaatgtatcagtcctagtttctgat

SEQ ID NO: 83469 - DNA, 50 bp, homo sapien
tttgaaatgaccaattctgaatagaraaagtgctacagtaaagtaaggga

SEQ ID NO: 83470 - DNA, 50 bp, homo sapien
aatgaaaacatctcgtggtctctcargtcggacacagaagtgcttttgag

SEQ ID NO: 83471 - DNA, 50 bp, homo sapien
cctactcctgagttcctgtgaatacratatgttacatggcaaaaggaacc

SEQ ID NO: 83472 - DNA, 50 bp, homo sapien
tccacaagtctgccgttttcagcacmctcgtggatggtctggaggcattc

SEQ ID NO: 83473 - DNA, 50 bp, homo sapien
attcaggacataggcatgggcagaamcttaatgactaaaacaccaaaagc

SEQ ID NO: 83474 - DNA, 50 bp, homo sapien
ctgagagggctgggaaagagagacayattgagctagagatgccttcatga

SEQ ID NO: 83475 - DNA, 50 bp, homo sapien
aggcaacccattccacctttgaatakttgccatctttgacattcaatgta

SEQ ID NO: 83476 - DNA, 50 bp, homo sapien
ttaactcaaaacagtgttaagttccyatgctgttagtactgtatcttgtc

SEQ ID NO: 83477 - DNA, 50 bp, homo sapien
gacccttgctgtcagccaatcatccmagcctgtgcaaattcctggccctt

SEQ ID NO: 83478 - DNA, 50 bp, homo sapien
acttcaaggttaagttctcatctcaktagtgtgtttttttccttgaaaag

SEQ ID NO: 83479 - DNA, 50 bp, homo sapien
gaggatacccaaagcacaaggtcccraactattagatgataattagaatg

SEQ ID NO: 83480 - DNA, 50 bp, homo sapien
atttcccaatctattctaacactaasaagaatctgtctaattaattgtga

SEQ ID NO: 83481 - DNA, 50 bp, homo sapien
tttccttgtcttgaccaaaaggatawcaggagaatatctgtcagctgttc

SEQ ID NO: 83482 - DNA, 50 bp, homo sapien
agtggtgttgtgcattctgtaggaartacttgtctttactgacagatttc

SEQ ID NO: 83483 - DNA, 50 bp, homo sapien
ttattcaggtatgctttccttgagayacgaccaataattatcaaagccaa

SEQ ID NO: 83484 - DNA, 50 bp, homo sapien
ccggcatcctggcgtgagtacaaacyaaggatcaagtcacatagtaatag

SEQ ID NO: 83485 - DNA, 50 bp, homo sapien
ggtatttaaatctacagcttgaaaastctctaattatctaggccggaggt

SEQ ID NO: 83486 - DNA, 50 bp, homo sapien
gtcctgcgaaatcacagtacttgccwcttagcatctatctacaccaggaa

SEQ ID NO: 83487 - DNA, 50 bp, homo sapien
ctgttggattctttttgccctgccgraacagcaatgcgtaaactccaacc

SEQ ID NO: 83488 - DNA, 50 bp, homo sapien
tgggaagattaagtgaaataatgtakgtgaaccccacatgtatgctctta

SEQ ID NO: 83489 - DNA, 50 bp, homo sapien
gggaactttggaagtgacagaaatayatgaaaattaaataacatggtctc

SEQ ID NO: 83490 - DNA, 50 bp, homo sapien
ataggtatatcatgctcattttatamgttcaaagaggctgagtatataaa

SEQ ID NO: 83491 - DNA, 50 bp, homo sapien
aaccaaaaatactcccgcttgtattkaaaactcacttaggttatagctaa

SEQ ID NO: 83492 - DNA, 50 bp, homo sapien
atggattgcaacaaactgggaagacratttcatcaaatatgggtttatat

SEQ ID NO: 83493 - DNA, 50 bp, homo sapien
ccggggacccagctatgctgtgtccrattcatagaaactgtgagacaaaa

SEQ ID NO: 83494 - DNA, 50 bp, homo sapien
agcctgaaatgtctgccatcaggagwtaataaaaagttctaatttggtct

SEQ ID NO: 83495 - DNA, 50 bp, homo sapien
ttggctagtatggaccactccaaagygtgtgggttgctagaaaccctcgc

SEQ ID NO: 83496 - DNA, 50 bp, homo sapien
tcttggatctgtttacaaaatttcartcaaagacccaaagattcaccagc

SEQ ID NO: 83497 - DNA, 50 bp, homo sapien
tgggggagagtagatataaaacatawccaatgaacgtcaatctctaatgt

SEQ ID NO: 83498 - DNA, 50 bp, homo sapien
atgtttgtcttatatcctaaattcaytgaactcatttactagctctagta

SEQ ID NO: 83499 - DNA, 50 bp, homo sapien
ttttctcaaagccctttcccttacawgatccctctcattttaccaaagat

SEQ ID NO: 83500 - DNA, 50 bp, homo sapien
gaacaatacttgttgaattagtgaarggattagaatgtcatttttttggg

SEQ ID NO: 83501 - DNA, 50 bp, homo sapien
atgttgactaatctgtctcaagcaaycttaaaatacagaagtacaggaat

SEQ ID NO: 83502 - DNA, 50 bp, homo sapien
tgttattttataataaagaacatcaraatttatgggtatattatatttgt

SEQ ID NO: 83503 - DNA, 50 bp, homo sapien
tcacatttctaccagacactctaagsctccttttgctaaagagagaatag

SEQ ID NO: 83504 - DNA, 50 bp, homo sapien
atactcctttgctatgcttcaaatarattttctttactgtgtcaactgac

SEQ ID NO: 83505 - DNA, 50 bp, homo sapien
aaggaactggctgtgaattaaagagratatggtgatcctgagagtaaaac

SEQ ID NO: 83506 - DNA, 50 bp, homo sapien
gatcttgcaagtatagatgactcackggagaagtttgtagctaagggttg

SEQ ID NO: 83507 - DNA, 50 bp, homo sapien
ataatataacactgtaattatgataygtaagcttctcctcatttaagtag

SEQ ID NO: 83508 - DNA, 50 bp, homo sapien
atagagaagatctgtaagtaatccaytgagaaacatgttttagagtcaca

SEQ ID NO: 83509 - DNA, 50 bp, homo sapien
tatatggtcaatctctggaacattckcagatttaacagccgagtcctggc

SEQ ID NO: 83510 - DNA, 50 bp, homo sapien
gcctcatctttcattaaagtaaaacyacctactgcttccagttgtaacag

SEQ ID NO: 83511 - DNA, 50 bp, homo sapien
ggattacacataagggactgtggccyatcatcctagacacaagacggtaa

SEQ ID NO: 83512 - DNA, 50 bp, homo sapien
aaattatagacaaaatttgaggttcrctaacattatcatcctccacagag

SEQ ID NO: 83513 - DNA, 50 bp, homo sapien
gaggacagaaacaaaagtatctatamgaatgccctttcagatgactcatc

SEQ ID NO: 83514 - DNA, 50 bp, homo sapien
aaaatttagcagcttaacaccacaamactttctattgtacaattctatag

SEQ ID NO: 83515 - DNA, 50 bp, homo sapien
tgaattttaatattttctgctaggtrgtaatttctagcactccccatatc

SEQ ID NO: 83516 - DNA, 50 bp, homo sapien
cagtgcttgaaacatacaagttcaawacatatttgataaactactgcatg

SEQ ID NO: 83517 - DNA, 50 bp, homo sapien
ataccaatggcattaatgtaatcccrcgtaagtttcgaaaaacctttcca

SEQ ID NO: 83518 - DNA, 50 bp, homo sapien
actgaataacattacaaaactaagaraagagtgccattttttgaatgttg

SEQ ID NO: 83519 - DNA, 50 bp, homo sapien
gtgccatgtatttaaagatgtgcaayagtaaatgagaaatcttgggcctc

SEQ ID NO: 83520 - DNA, 50 bp, homo sapien
atttctgggattttccagatgttctyacctgtgtggataacactatacag

SEQ ID NO: 83521 - DNA, 50 bp, homo sapien
gattcagctctatgtggttgtggacraaggtcttcttgctggctgttgac

SEQ ID NO: 83522 - DNA, 50 bp, homo sapien
caggatttccaatctaggtgaaagaygggagttcaggcaggtgtagctag

SEQ ID NO: 83523 - DNA, 50 bp, homo sapien
tttctttctgatgttcccttttataygtggtgtcacagggtgatgtgggt

SEQ ID NO: 83524 - DNA, 50 bp, homo sapien
aaaaacatagtctatcatattgttaygaattaatgtcctagtgaagtcag

SEQ ID NO: 83525 - DNA, 50 bp, homo sapien
atctcacactgaacttagtggaagawtcatcttgtagaaagcacaaaccc

SEQ ID NO: 83526 - DNA, 50 bp, homo sapien
gatcctgtttgatatttctggaaacygaaagaatacctgctaaaatctag

SEQ ID NO: 83527 - DNA, 50 bp, homo sapien
tagaaacaaaatctcccctgagtccraagtacagtctcacaccagcaagc

SEQ ID NO: 83528 - DNA, 50 bp, homo sapien
ttccaaccccggtctacataagcaayatctaatgacaatatctgatgttc

SEQ ID NO: 83529 - DNA, 50 bp, homo sapien
ctcagtatgaaatgtgaagtatagtmaacttttgccatctaaaatgattt

SEQ ID NO: 83530 - DNA, 50 bp, homo sapien
aaactgtcttctgaccaaaatattayatatccgtatactgcaaaacgtga

SEQ ID NO: 83531 - DNA, 50 bp, homo sapien
aatttctgaaaacagaatctctcaaytaggaccttccccatgtgtgtgcc

SEQ ID NO: 83532 - DNA, 50 bp, homo sapien
cacttaggacccatttggctaatacyagaagtagtcatcaagttaactgt

SEQ ID NO: 83533 - DNA, 50 bp, homo sapien
gaaattatcttgaaatacaaaagaaygtctgttggtcctgagagtgaaaa

SEQ ID NO: 83534 - DNA, 50 bp, homo sapien
aaccccaccaatactacatcccagaraagaggctccacacaagggcctgg

SEQ ID NO: 83535 - DNA, 50 bp, homo sapien
gttctgaaaatggacggagctgggaraattattgaaactctctggatctc

SEQ ID NO: 83536 - DNA, 32 bp, homo sapien
tgacttcaaagacgaasgaagggacaagatct

SEQ ID NO: 83537 - DNA, 50 bp, homo sapien
aagagatattgcattatgtattttgragccaaactgctgtgttgatttat

SEQ ID NO: 83538 - DNA, 50 bp, homo sapien
ccctaaagcagatacagctttgatcraaacactcaaatcctttggaaggc

SEQ ID NO: 83539 - DNA, 50 bp, homo sapien
gaagagtgacctgaatgaaatggaaygtagttgaatgagccgtggaaggt

SEQ ID NO: 83540 - DNA, 50 bp, homo sapien
cctttcatgttttcttatgctgtccraaataggatataaactccttgact

SEQ ID NO: 83541 - DNA, 50 bp, homo sapien
atgtattaagaagtaaaatctaaaargtaatttcttcctaaagtgtcaca

SEQ ID NO: 83542 - DNA, 50 bp, homo sapien
gagctccatggcctcctgctataaayggggctggcactcaccagatgcca

SEQ ID NO: 83543 - DNA, 50 bp, homo sapien
aatcaaaaacgtggaaagagaattgycaacaccttacaaagccaccacaa

SEQ ID NO: 83544 - DNA, 50 bp, homo sapien
aaaccccagcgacatattcgtgaacygagagagttagcgggtgaaagctt

SEQ ID NO: 83545 - DNA, 50 bp, homo sapien
agaaagataggatagagtagacaacrcagtataattctgagctagttgaa

SEQ ID NO: 83546 - DNA, 50 bp, homo sapien
ttgtattatgtaccaggtgggtttayatgtataatctcagcaaccctatg

SEQ ID NO: 83547 - DNA, 50 bp, homo sapien
tggggaggagggggatgagaaattcyagttaatcgttttcccagggagat

SEQ ID NO: 83548 - DNA, 50 bp, homo sapien
gcctcctggatactgcaatttgtaastcttagatttatggccggttcctt

SEQ ID NO: 83549 - DNA, 50 bp, homo sapien
tcttctctgaaccctatggaggataygttgtcttggactgagccctggca

SEQ ID NO: 83550 - DNA, 50 bp, homo sapien
atgacagctttataaatgcagaaccyatgacaaatgttatgctaaagtca

SEQ ID NO: 83551 - DNA, 50 bp, homo sapien
tttggtgctgatgctggtagcgggartatctgtctaatcctgaagcttct

SEQ ID NO: 83552 - DNA, 50 bp, homo sapien
attttactgcagctttagatttatgrcagaacgggagtgtgtaaagtgaa

SEQ ID NO: 83553 - DNA, 50 bp, homo sapien
tggagtattgtgtgaccgtaatgtcrataagcttcatttgcatcagttgt

SEQ ID NO: 83554 - DNA, 50 bp, homo sapien
aagtgtgaattgactgagtttgtcartaccctacaaagacaaagtaatgg

SEQ ID NO: 83555 - DNA, 50 bp, homo sapien
cccccactgtcttctcaacaagtcasagttcttctggggcatccgaggcc

SEQ ID NO: 83556 - DNA, 50 bp, homo sapien
ttattcactgatttagataattcaayttatgtgtgcgttaccaggttgca

SEQ ID NO: 83557 - DNA, 50 bp, homo sapien
gtcagtcagtcaatgaacatttattmtctctgggctgtgccctgtggccc

SEQ ID NO: 83558 - DNA, 50 bp, homo sapien
gattggcaaatatggcaaaatagcaragatcaataaaagccattttagta

SEQ ID NO: 83559 - DNA, 50 bp, homo sapien
gaaacaactagtccctggaatttcaytacctgtgccatgattaagcaagc

SEQ ID NO: 83560 - DNA, 50 bp, homo sapien
ttttctggtcactaatacttctgccrctaacaaaataaggtatttaatag

SEQ ID NO: 83561 - DNA, 50 bp, homo sapien
agattctgaaagcagcatttcctaaytaagaaggcccaagaaggtgacag

SEQ ID NO: 83562 - DNA, 50 bp, homo sapien
gcagatcaccattcgtctgctattaygcgatatgttgtttcttctcctgc

SEQ ID NO: 83563 - DNA, 50 bp, homo sapien
aaagctttacctattcagaagtacawcatcaggttagcccctaaacatag

SEQ ID NO: 83564 - DNA, 50 bp, homo sapien
atttgcaggtttaagcagtctcataraactcaaagaagaattacataact

SEQ ID NO: 83565 - DNA, 50 bp, homo sapien
gaactcataacaacttatcatttaayggtttcttcatatcttattccaaa

SEQ ID NO: 83566 - DNA, 50 bp, homo sapien
attctctaaaattaagcaaattatayaaaagttcctaaagtgatgtgata

SEQ ID NO: 83567 - DNA, 50 bp, homo sapien
tttagtccctatatgacactattgayggaaagtaagatactccagcagtg

SEQ ID NO: 83568 - DNA, 50 bp, homo sapien
tttgtttatattaattacatacagaygctagaaggtgatagcataagatt

SEQ ID NO: 83569 - DNA, 50 bp, homo sapien
caccccagcttttccaatgatccgcyacatggtggttgtaaatggctcta

SEQ ID NO: 83570 - DNA, 50 bp, homo sapien
aagctaaacatttcgattcctttatsaagtattcactcccactcccaaag

SEQ ID NO: 83571 - DNA, 50 bp, homo sapien
cttatgggtcagatctggaaagttayaaaaaggtgcaaaccatcagggtt

SEQ ID NO: 83572 - DNA, 50 bp, homo sapien
aattttgtcacttcaacaatgttacrtaaaaggaatcacatggtatgtga

SEQ ID NO: 83573 - DNA, 50 bp, homo sapien
acaagaagctgtgtgtgaatgaagaracatttaagattagagtttaaaaa

SEQ ID NO: 83574 - DNA, 50 bp, homo sapien
agtccccgctatcatgtacaagaaargacatagccacagacagccctcag

SEQ ID NO: 83575 - DNA, 50 bp, homo sapien
aaaatagtttttgtaaacatagtaayctgagtttgatatcaaatatgggt

SEQ ID NO: 83576 - DNA, 50 bp, homo sapien
taaaatgcacagcaacaagttgacasgatgtttaacagtagagagtgctt

SEQ ID NO: 83577 - DNA, 50 bp, homo sapien
actcacctataaaaatatgtcattaygtgggcaaaatagaagctacagga

SEQ ID NO: 83578 - DNA, 50 bp, homo sapien
ttattgtttttgacatgtaggtaacmcatacttttccaaaatatgtgcat

SEQ ID NO: 83579 - DNA, 50 bp, homo sapien
gggggctggggagacaaataataaaycataaatatgtgatatgtcaggta

SEQ ID NO: 83580 - DNA, 50 bp, homo sapien
ttggtggtttttattgtttatttgtrggcattattgtagaagccgtttat

SEQ ID NO: 83581 - DNA, 50 bp, homo sapien
catgagagtttaaattgctccatacrcttaccatgatttagtggtattgg

SEQ ID NO: 83582 - DNA, 50 bp, homo sapien
attttgtagatacactacacataaaycctaagtaagcctggcgtggggta

SEQ ID NO: 83583 - DNA, 50 bp, homo sapien
ataattacaacaacaacagcactaaygccgtgtacatattatatgtccag

SEQ ID NO: 83584 - DNA, 50 bp, homo sapien
ggatagctgaaagacctgccatcaayaacagtgtaggggatgaagcaaaa

SEQ ID NO: 83585 - DNA, 50 bp, homo sapien
acaaagatttttattctctttgaaasgtactgatagagtagcacagttga

SEQ ID NO: 83586 - DNA, 50 bp, homo sapien
cgaagggtctgatcataatgatcaaratgtctaaatccaacatctagtga

SEQ ID NO: 83587 - DNA, 50 bp, homo sapien
tgttacagggctttcaaagcaggtgratgatgagacgttatttacattta

SEQ ID NO: 83588 - DNA, 50 bp, homo sapien
cagccttccagaaaacagctattgaygggcctcctcagattctggaatgt

SEQ ID NO: 83589 - DNA, 50 bp, homo sapien
caacatctatatggatgtgacacagracatgagcgagaagcaggatttga

SEQ ID NO: 83590 - DNA, 50 bp, homo sapien
ttggagaccttcaggctgtacctacrctaagtaaagagagaaaccaaagc

SEQ ID NO: 83591 - DNA, 50 bp, homo sapien
ataaaactttttggatgtatttatayggcaccctctcatgccatccaaaa

SEQ ID NO: 83592 - DNA, 50 bp, homo sapien
ctcagtcatctgtccaaagggagtayctcacacagtgccactgacaagaa

SEQ ID NO: 83593 - DNA, 50 bp, homo sapien
caactctgctctctggaaagggaacrgtcacaacatagatatctagttgt

SEQ ID NO: 83594 - DNA, 50 bp, homo sapien
agccctgcctttattccttgctgcawtcccatgaagtaaaaattattgtt

SEQ ID NO: 83595 - DNA, 50 bp, homo sapien
gttttcctcagaagaagcattgatayaaggaactatcctaaaatatgagg

SEQ ID NO: 83596 - DNA, 50 bp, homo sapien
tgaagaaagaatatcgcttttgcgcyctttgattcatgaactgggactaa

SEQ ID NO: 83597 - DNA, 50 bp, homo sapien
acttttatgtccaataagactctctytacgtaattttaggctgtacactg

SEQ ID NO: 83598 - DNA, 50 bp, homo sapien
tgaacagtctttggtgtattacatayggataatttatgttggtcattgtg

SEQ ID NO: 83599 - DNA, 50 bp, homo sapien
gcagtggaaaaattccttcctttggkacgctataaattgcagttgggttc

SEQ ID NO: 83600 - DNA, 50 bp, homo sapien
caacatttagtttttgtaggattagmaaccgcttgtttttttcttttcaa

SEQ ID NO: 83601 - DNA, 50 bp, homo sapien
gaaactgtggttcaaaatgtaaattsaattgtgccactgtcttgctgaaa

SEQ ID NO: 83602 - DNA, 50 bp, homo sapien
aaaaaaaaaaagctatagtaatcaasacaatatggtactggcagaaggaa

SEQ ID NO: 83603 - DNA, 50 bp, homo sapien
ctggtcaaatgattgctaacagagargtgtgaggagaaccatctgccttg

SEQ ID NO: 83604 - DNA, 50 bp, homo sapien
agatgtcaccagctggaagcggctarcagcaagtcccctgggacgttctc

SEQ ID NO: 83605 - DNA, 50 bp, homo sapien
cgagcatctcacaattccaaaggatraatactctactccccttcagaact

SEQ ID NO: 83606 - DNA, 50 bp, homo sapien
cagattcacaactcacaaggcacatrgtatcctcagctttcatgcaacag

SEQ ID NO: 83607 - DNA, 50 bp, homo sapien
tatattaacaactatcttagataaamactaatttgtgatacagtagaaaa

SEQ ID NO: 83608 - DNA, 50 bp, homo sapien
atgccctaaaatagttggtaagaaaygactttccctgttactgggaaagc

SEQ ID NO: 83609 - DNA, 50 bp, homo sapien
tttgtttattaagtaaaaatcataamgttattgtagcacgtggtttaaat

SEQ ID NO: 83610 - DNA, 50 bp, homo sapien
agatgctaaataaatgtctgttgaasgatgaagttgtgaataatctattt

SEQ ID NO: 83611 - DNA, 50 bp, homo sapien
ccatgaactgagcccacgttgtatcrcagaaagtaccccatactcttgac

SEQ ID NO: 83612 - DNA, 50 bp, homo sapien
ttgagggctaagatccaactttgcaytattaacatatatttatgtgtgtg

SEQ ID NO: 83613 - DNA, 50 bp, homo sapien
aaataggataggataaatatcttgcrcataagaattaaaataatttacgt

SEQ ID NO: 83614 - DNA, 50 bp, homo sapien
attgaggaatgtgttagtttcaaaartcttaatgtagattatattttgaa

SEQ ID NO: 83615 - DNA, 50 bp, homo sapien
ggatgaaatcttaaataaaataccartgaactaaatctttagagcagtgt

SEQ ID NO: 83616 - DNA, 50 bp, homo sapien
catttatatcaggtctcttcacaaaygtggggtagagccatgggcagtgt

SEQ ID NO: 83617 - DNA, 50 bp, homo sapien
tgttttagtagcagtcatctgtagamctcctctgtttccagcagcctcac

SEQ ID NO: 83618 - DNA, 50 bp, homo sapien
tcagagtaggtcatcttactcagaarttatagaggaaaatgaaaataaag

SEQ ID NO: 83619 - DNA, 50 bp, homo sapien
acccccgttgatctagcagaggaaawcacctaatgtcaaagtcctgttgt

SEQ ID NO: 83620 - DNA, 50 bp, homo sapien
ttccatattggactctgactgataaygctcttgtactattttatgcacta

SEQ ID NO: 83621 - DNA, 50 bp, homo sapien
tgaaacagaaagggacatcctaaaasagcttatggacgtggagagccctg

SEQ ID NO: 83622 - DNA, 50 bp, homo sapien
aagctgtgatttggtctcatgtgccrattaaggaagggtggtgcacaata

SEQ ID NO: 83623 - DNA, 50 bp, homo sapien
gatgtggctgtaaaagagcaacacasgattcttgcggctttggaaaggca

SEQ ID NO: 83624 - DNA, 50 bp, homo sapien
aaacctattgcatcaactctaacaayagtcctttactggtataattatct

SEQ ID NO: 83625 - DNA, 50 bp, homo sapien
tggtgaacactcattgtaacatttargactttgtacaatttaatcacatt

SEQ ID NO: 83626 - DNA, 50 bp, homo sapien
attagggcctagagttatagacaaaygtttacagaagtgtctttaagttc

SEQ ID NO: 83627 - DNA, 50 bp, homo sapien
tcatcctttctaaaattggtttcacrgataaactcattccttttaaataa

SEQ ID NO: 83628 - DNA, 50 bp, homo sapien
ggtgggagtggtcatccttttcttakgtccaatcttagcacaaaagcctt

SEQ ID NO: 83629 - DNA, 50 bp, homo sapien
atttgcccatgtgctggataagagaygatgatgggtatgtggattattac

SEQ ID NO: 83630 - DNA, 50 bp, homo sapien
aaagtgagaaaattcagctcctgatyaagttgggcaattaaaagagctta

SEQ ID NO: 83631 - DNA, 50 bp, homo sapien
aataaatgggtccttaaataagataytaccagtgatgtaaacatttttgc

SEQ ID NO: 83632 - DNA, 50 bp, homo sapien
aatagtaactgcatgacagcagtcargaaccatacagaggttagaaggta

SEQ ID NO: 83633 - DNA, 50 bp, homo sapien
gaggtgcagccctgccagaatctcamgagtagaaagagtaaggcctattc

SEQ ID NO: 83634 - DNA, 50 bp, homo sapien
ttactctgtttttgagggattgcctraaatatcattgatggcacttaagc

SEQ ID NO: 83635 - DNA, 50 bp, homo sapien
aaacactctgagatggttaaaatcartatgcctgaccgggcgcggtggtt

SEQ ID NO: 83636 - DNA, 50 bp, homo sapien
ctcaaactgcctcaaacttgtgtttyatgaatcctctcttagttaccagt

SEQ ID NO: 83637 - DNA, 50 bp, homo sapien
tcaagcaaaatgggactcagtgagaytaagtaacctgcttaatcacaacc

SEQ ID NO: 83638 - DNA, 50 bp, homo sapien
tgtacttgacaaatagctcccagtamaatttaagggcagaaagcgtatgc

SEQ ID NO: 83639 - DNA, 50 bp, homo sapien
gctgtacatgttaattaatgtctaamaaatagaatatgacagaggtggtg

SEQ ID NO: 83640 - DNA, 50 bp, homo sapien
ttcatgcttaatacaattgtgattargagatatttgcttgttaatggtaa

SEQ ID NO: 83641 - DNA, 50 bp, homo sapien
aaaaaaaaaaaagaaaagtcgaccayattattactttctagtcacatttt

SEQ ID NO: 83642 - DNA, 50 bp, homo sapien
aaaagatctgtttacctataggacaygattttagattcctgtcttattca

SEQ ID NO: 83643 - DNA, 50 bp, homo sapien
ttcctttttctgtatctgggtcttayatgagtattcctcagtctctgtct

SEQ ID NO: 83644 - DNA, 50 bp, homo sapien
tgtcaggtcagaagagcttagtgaargacccttatgagctaaattagggt

SEQ ID NO: 83645 - DNA, 50 bp, homo sapien
tactttttttttttttcaatcagccrcaagctttcatatcactttctgtt

SEQ ID NO: 83646 - DNA, 50 bp, homo sapien
ttggaggaaccatatttattgaacaygataactgacaattgatttacaag

SEQ ID NO: 83647 - DNA, 50 bp, homo sapien
cgcactgaaaatggcaattgaatgayatttctctataaatgttcaaatgg

SEQ ID NO: 83648 - DNA, 50 bp, homo sapien
cttcccttaaactttcctagtgagcraggagtagaattacactagcatac

SEQ ID NO: 83649 - DNA, 50 bp, homo sapien
agctgtgttgagtcagctgaaggaarttcaagatatatttaaaaaaagaa

SEQ ID NO: 83650 - DNA, 50 bp, homo sapien
gggaacgggttactctgctacaaaawaaaaatatgaccacgggggtactt

SEQ ID NO: 83651 - DNA, 50 bp, homo sapien
cctcttccccacactttactaacaascatattaatagggatgaagtataa

SEQ ID NO: 83652 - DNA, 50 bp, homo sapien
gggccctttttgattttcatgctaayataggtaggctgttcatgcccaat

SEQ ID NO: 83653 - DNA, 50 bp, homo sapien
cttagaatgaagtcaacatttttcayaattaggtatatgatgggcctttg

SEQ ID NO: 83654 - DNA, 50 bp, homo sapien
cttattctattcatgcaaagccaacyggtaagctttattattgtcatatg

SEQ ID NO: 83655 - DNA, 50 bp, homo sapien
atttcaaagcccaaattatcatgtcygacaaatgttctccaatattaaat

SEQ ID NO: 83656 - DNA, 50 bp, homo sapien
atctcagcctccctgagcacaggaamggaaatagctgtactgctgggttt

SEQ ID NO: 83657 - DNA, 50 bp, homo sapien
ttatcaacgttatcacaaatataaastgaagcctggtgatctgatttccc

SEQ ID NO: 83658 - DNA, 50 bp, homo sapien
ctggctagagcagagtaagttaaaaytagttatactgaatgaggttcgaa

SEQ ID NO: 83659 - DNA, 50 bp, homo sapien
gagaggtaggagcctgatcataaacrcactagtatgattgatatgcagag

SEQ ID NO: 83660 - DNA, 50 bp, homo sapien
gctttctggaaaatcaatctgataaygccatttctctgttgacctttttt

SEQ ID NO: 83661 - DNA, 50 bp, homo sapien
atgtttatgtttaataacttggcacstatttatatattatgttcagtaga

SEQ ID NO: 83662 - DNA, 50 bp, homo sapien
cacacctttaataatggaataagtcrccttggatatactaaatttttatt

SEQ ID NO: 83663 - DNA, 50 bp, homo sapien
ggccctccctgtttggcagtaaggcrgagagagaggacagcttatgccat

SEQ ID NO: 83664 - DNA, 50 bp, homo sapien
acaacttgttcttaatgccttttgaktaaacaaaattatggtgtaataaa

SEQ ID NO: 83665 - DNA, 50 bp, homo sapien
aatatctcctaaagaaggaaagagaygcgttgaaaatcaatatgacattt

SEQ ID NO: 83666 - DNA, 50 bp, homo sapien
tgtaggcacaagtgattaaactactraacctgtgattaatctcaacctcc

SEQ ID NO: 83667 - DNA, 50 bp, homo sapien
ccaacttacctctactctcaattcartctcttctgagtgttccttctcct

SEQ ID NO: 83668 - DNA, 50 bp, homo sapien
gagaagataagcagaaatagaatggkaattattaaccttgggacaagtga

SEQ ID NO: 83669 - DNA, 50 bp, homo sapien
agagggcagctggaaattgagtcatmaaggaagacctagacgtcagttat

SEQ ID NO: 83670 - DNA, 50 bp, homo sapien
ttcaaatgccacattctctatgagamcctacttcgttaccttgtataata

SEQ ID NO: 83671 - DNA, 50 bp, homo sapien
aagtcctctggaccctaagtactaastcatcttacaccccaagtccttgt

SEQ ID NO: 83672 - DNA, 50 bp, homo sapien
tgaggctactactatatcaatgaatsaactttttcaactctagaagaact

SEQ ID NO: 83673 - DNA, 50 bp, homo sapien
gagaaccccttattcagtcttgcagragatggctaaagcaagtggccaga

SEQ ID NO: 83674 - DNA, 50 bp, homo sapien
ataaaaaaagacactacatttctacmgactgttcagaggttagggaggct

SEQ ID NO: 83675 - DNA, 50 bp, homo sapien
attgtgacattgtttagtttgcaccrttgttcctgttgttggggctattg

SEQ ID NO: 83676 - DNA, 50 bp, homo sapien
cagagcctgggacatctagctcactrtgttctccatgggggaggtactgc

SEQ ID NO: 83677 - DNA, 50 bp, homo sapien
ccaccttcttttaaagaggaagacartcaagtccagaaaataacactgat

SEQ ID NO: 83678 - DNA, 50 bp, homo sapien
cctttcctcatgtgaaaagtaaatcrgattctatggtaataacccaaagc

SEQ ID NO: 83679 - DNA, 50 bp, homo sapien
gtgcagtgcacagaaggcacctatcrcgttgttgtaaaattaaatgggca

SEQ ID NO: 83680 - DNA, 50 bp, homo sapien
agtgagtggaaggcacaggtgcctcraaagacttctgaatgcctgaaaag

SEQ ID NO: 83681 - DNA, 50 bp, homo sapien
ccattcctcttcagtatagtattgamgtcttggacatggcaatcaggcaa

SEQ ID NO: 83682 - DNA, 50 bp, homo sapien
acataacaaagactttatcacttcargagcacctcaaaagcacaccaagg

SEQ ID NO: 83683 - DNA, 50 bp, homo sapien
atacccaacatgataactgttcatcycatgaaatttaatgtctctcaaaa

SEQ ID NO: 83684 - DNA, 50 bp, homo sapien
acaggttagttttgctggtaggcctrtaacaagattcaattatcattaat

SEQ ID NO: 83685 - DNA, 50 bp, homo sapien
tgtgtggatgtatgtaagaaatatayattatgtcaaatctggaatatagt

SEQ ID NO: 83686 - DNA, 50 bp, homo sapien
tcttgttggttgctagaaaccggaayaaaacttggcgcatattagactct

SEQ ID NO: 83687 - DNA, 50 bp, homo sapien
accagacttgctgggactttgatccyggagttcgtagcctgcagagttat

SEQ ID NO: 83688 - DNA, 50 bp, homo sapien
atttctagataacattatcatcctcrgaaaaaatagtttgggattggatc

SEQ ID NO: 83689 - DNA, 50 bp, homo sapien
gggccctcttaaaaggctaagtgacygcttttagtttaggtgagatataa

SEQ ID NO: 83690 - DNA, 50 bp, homo sapien
caggggaggaggatccagcaggactrggtaccaaagccatgaggggagag

SEQ ID NO: 83691 - DNA, 50 bp, homo sapien
ccagtggagatgtgagaaaagtgccragcatctattgaaattacacactg

SEQ ID NO: 83692 - DNA, 50 bp, homo sapien
tagaaagtttacctttattcaagccrcttcagaacttagtgatgatgtgg

SEQ ID NO: 83693 - DNA, 50 bp, homo sapien
tccatatacggacagaggatttttcyttgcactttatcttatgataagac

SEQ ID NO: 83694 - DNA, 50 bp, homo sapien
gagatagggtattcaaagtggtatcyagttaaaatgaattcattagggtt

SEQ ID NO: 83695 - DNA, 50 bp, homo sapien
gagaaattacattacttgtttttacrctaattcacaaatatttctcatgt

SEQ ID NO: 83696 - DNA, 50 bp, homo sapien
caagtacagggggagaaggtgaccastcctcgggaatagagtgtaggctc

SEQ ID NO: 83697 - DNA, 50 bp, homo sapien
tttccaattgaggtaactgggtcacmgagaatgaagcctcgcaaccatgg

SEQ ID NO: 83698 - DNA, 50 bp, homo sapien
aaaactatactgggccctatcacacrgattttatgagaattgaatgagat

SEQ ID NO: 83699 - DNA, 50 bp, homo sapien
ctccctcttgcctctaaagcttgtayggaaccaggaaaaaagagtgagta

SEQ ID NO: 83700 - DNA, 50 bp, homo sapien
ggaatgctacagaatttcaattgtgsatatatcaaaaatagttttaaatg

SEQ ID NO: 83701 - DNA, 50 bp, homo sapien
ggatcgcccaagagttgcggcgtatyggagacgagtttaacgcttactat

SEQ ID NO: 83702 - DNA, 50 bp, homo sapien
gtgattataacagtgcacatgagatragagtgttgtaaacaaagggaata

SEQ ID NO: 83703 - DNA, 50 bp, homo sapien
ggttaaagtaccaagtaagtaaggcragaagggattctgtttttaaaatc

SEQ ID NO: 83704 - DNA, 50 bp, homo sapien
cccttagcgagactctcagattacaracaagagtaaaggtggtccacagc

SEQ ID NO: 83705 - DNA, 50 bp, homo sapien
tgaaagagattttccactcgcctcaygtagtatggtgttttgttttgttt

SEQ ID NO: 83706 - DNA, 50 bp, homo sapien
ttgagtcgaataccaagacaaccgasatctccagtgtgaggaaagagaca

SEQ ID NO: 83707 - DNA, 50 bp, homo sapien
ctatggcccaaaacatcagacgatgraacttgatcgaaatctcctacatt

SEQ ID NO: 83708 - DNA, 50 bp, homo sapien
gctctgggaatcctgggcaaggtcaragtggtctaggaacaagtctgtgg

SEQ ID NO: 83709 - DNA, 50 bp, homo sapien
cctcatgagaaggatcatacttgcaygtctacagaggaattacagaaagg

SEQ ID NO: 83710 - DNA, 50 bp, homo sapien
tggaggatagttcaggccattaacargaaggcaaaagaaaacacagacaa

SEQ ID NO: 83711 - DNA, 50 bp, homo sapien
caaacaaacaaatattccatgttagraagataaccattagagtaatcctg

SEQ ID NO: 83712 - DNA, 50 bp, homo sapien
gtggtggctagatgtgctttgtttcrtgtgctgtgcatttcagtgctagt

SEQ ID NO: 83713 - DNA, 50 bp, homo sapien
cctcacttctccaataaatgagaaaycttgcttcattatccattgttaac

SEQ ID NO: 83714 - DNA, 50 bp, homo sapien
ttgaagctcttacattcaattcattwaaaaaaaggcgtggagtgctgggt

SEQ ID NO: 83715 - DNA, 50 bp, homo sapien
aaacattgcatttagcgtaataatartactgggtgtcttgtggagtccca

SEQ ID NO: 83716 - DNA, 50 bp, homo sapien
aggacagtcttgcagtgcaaaactayattttagtcagcaagggaccaaat

SEQ ID NO: 83717 - DNA, 50 bp, homo sapien
ttatttattaattttgccccatgacmaattgattttagagttcatctctt

SEQ ID NO: 83718 - DNA, 50 bp, homo sapien
ggaagtattactcattcctaaacatraaatagcacttagagttgtgtgtg

SEQ ID NO: 83719 - DNA, 50 bp, homo sapien
ccagataatgaaagaccttctgagaragaattttactgtccaaagttagg

SEQ ID NO: 83720 - DNA, 50 bp, homo sapien
ttcaaaatgtataataggagttggasagctaactcaggtttataaatatg

SEQ ID NO: 83721 - DNA, 50 bp, homo sapien
attttttagcagctttggaaaattayggattgctttttaggtcccaggga

SEQ ID NO: 83722 - DNA, 50 bp, homo sapien
tttttcctggatcctggaggccaatsaatatcttactttgctcttaaggc

SEQ ID NO: 83723 - DNA, 50 bp, homo sapien
ggcaccagaatttctcaacaaccaawgtttgaacaactagagcagcaaaa

SEQ ID NO: 83724 - DNA, 50 bp, homo sapien
aatgctaatttggaagcattataccraagtgttagatcagattagcccca

SEQ ID NO: 83725 - DNA, 50 bp, homo sapien
ggtcatcagggtttctaggtctaaayatgagttctaccgtttactccctg

SEQ ID NO: 83726 - DNA, 50 bp, homo sapien
agaataaactgtaagaaagcaattcraaggatgagctttgtagaatataa

SEQ ID NO: 83727 - DNA, 50 bp, homo sapien
ggatgagctttgtagaatataaagcrgagaggtatcaaatttgcttggaa

SEQ ID NO: 83728 - DNA, 50 bp, homo sapien
aagacagttgacatgcaaggatgtaygtaaggtaaagaagaccaagtgaa

SEQ ID NO: 83729 - DNA, 50 bp, homo sapien
aactcattataaatatttcatcttcygaaagtactctttgattacctctg

SEQ ID NO: 83730 - DNA, 50 bp, homo sapien
gaagacattgcatcttgaaaagaaasacatagctttatcaaagatgttgg

SEQ ID NO: 83731 - DNA, 50 bp, homo sapien
tttctataatgtcaactgagagtgtyaagcttttgaaatagccaatggtg

SEQ ID NO: 83732 - DNA, 50 bp, homo sapien
attatagaaagaaaaataaattgcartatcataactgaaatatacaaaga

SEQ ID NO: 83733 - DNA, 50 bp, homo sapien
ataaaggtaaagttatgtcattatgyatttgaagagtcatagcatctgtt

SEQ ID NO: 83734 - DNA, 50 bp, homo sapien
catctgcttcaaagaacacatcgacracaggggagccccttgcactcact

SEQ ID NO: 83735 - DNA, 50 bp, homo sapien
cccatgagtctcacaggctgccaagratgtaattgggctgaaatggaagg

SEQ ID NO: 83736 - DNA, 50 bp, homo sapien
ttttgatgaatgtatgccctagatcwaataaaaatcaactagtgtttact

SEQ ID NO: 83737 - DNA, 50 bp, homo sapien
gcttgccatctaatccgtaaggaacscagtcacagagcaatgtaaaggaa

SEQ ID NO: 83738 - DNA, 50 bp, homo sapien
tgtctcaaatgaaaatggagccaaarttcataggcaaagtcactctccca

SEQ ID NO: 83739 - DNA, 50 bp, homo sapien
aggagagtggctactttactggtcamccacaatcagcaaatcattggcct

SEQ ID NO: 83740 - DNA, 50 bp, homo sapien
gcatgaagcattttaagacactggartatgaatttcacaaaagcccatgc

SEQ ID NO: 83741 - DNA, 50 bp, homo sapien
tatcccctaaaatacccttgatgcaygcggagacttcctctatccatttc

SEQ ID NO: 83742 - DNA, 50 bp, homo sapien
tcttaatgccaactcgtaaatcacaygcaaaatttcacaaaggtagaaga

SEQ ID NO: 83743 - DNA, 50 bp, homo sapien
gccctttttgctccacttgatgtaarcagggatactggccatttcttaaa

SEQ ID NO: 83744 - DNA, 50 bp, homo sapien
tcacacagttcttaaattgttgttayaagaatggtatgtcagaccaagtt

SEQ ID NO: 83745 - DNA, 50 bp, homo sapien
ctatgcagaatttgtgaggtgaaaargatgaaggatgttggagtcaccaa

SEQ ID NO: 83746 - DNA, 50 bp, homo sapien
cacgaaatgaaatgcgatatttcaakgatatgatttcattaacttctcaa

SEQ ID NO: 83747 - DNA, 50 bp, homo sapien
agacagaaaatttttcaaaggaagawtctgttagtacacatgtgcagtaa

SEQ ID NO: 83748 - DNA, 50 bp, homo sapien
aatgatcagagggatatgtgtaaagwccctaccagcacctgatatttaaa

SEQ ID NO: 83749 - DNA, 50 bp, homo sapien
aaggtgtgtggtgaaacagcacacargtatagtcactaaggagacaaaag

SEQ ID NO: 83750 - DNA, 50 bp, homo sapien
ttcatagtctccaataaggaaaatascataaataatcttgaatgtgtttc

SEQ ID NO: 83751 - DNA, 50 bp, homo sapien
agaaaccaattagtatcaaaaatcayagcctagcagaccaatggtgcagc

SEQ ID NO: 83752 - DNA, 50 bp, homo sapien
agatggaaattaattcctacaactgracagtaatagtgacacaagctatt

SEQ ID NO: 83753 - DNA, 50 bp, homo sapien
ctgtcaaatttcagagatgaggaagraatacagaatgtctgtatctataa

SEQ ID NO: 83754 - DNA, 50 bp, homo sapien
tcaagtagaaatgtcaagttggtaaytgatatatgtgaatctggaactca

SEQ ID NO: 83755 - DNA, 50 bp, homo sapien
tctaaggttctgatacgtaccaatarccattgactctcatgcaatcattc

SEQ ID NO: 83756 - DNA, 50 bp, homo sapien
aaatgtaaataaaaaatagatgatayagcataagtcattgtaacttagat

SEQ ID NO: 83757 - DNA, 50 bp, homo sapien
ataagtcattgtaacttagatgccartaggtctaaaatgtatttaggagt

SEQ ID NO: 83758 - DNA, 50 bp, homo sapien
cagcaagacttgggagccaaaaagcraggtgataaaaagctcaacttcag

SEQ ID NO: 83759 - DNA, 50 bp, homo sapien
ggttccaggacgcggaccgtaaagargtgccagggagctctgctcggtcc

SEQ ID NO: 83760 - DNA, 50 bp, homo sapien
cacaacattatcacggttaaggaaakaagctggttaataaaacatctttt

SEQ ID NO: 83761 - DNA, 50 bp, homo sapien
aaaaaaattgctataataattcaaarcttaatgattcaaatcaataaaat

SEQ ID NO: 83762 - DNA, 50 bp, homo sapien
atcaactaaaggacacacatgcatamactcaatgtgcaatgatggagtaa

SEQ ID NO: 83763 - DNA, 50 bp, homo sapien
agttgtgtaatttttccagaaataargaaatacttgagtccctgagttga

SEQ ID NO: 83764 - DNA, 50 bp, homo sapien
gtagaagaactagtaatgagaggaamtacagatgaaagttatgtgaagtt

SEQ ID NO: 83765 - DNA, 50 bp, homo sapien
gcctccaaaactgtgtaagaataaaygtctgttggtataagccacccagt

SEQ ID NO: 83766 - DNA, 50 bp, homo sapien
tcttaacatttcctggttgtgtgaaygtagaaaagtaacttaagttttct

SEQ ID NO: 83767 - DNA, 50 bp, homo sapien
catgtatcttgcaactgtggtcctgmaatgagtatccacattttgcacat

SEQ ID NO: 83768 - DNA, 50 bp, homo sapien
tgttctctaagtgaaaacaaaaatarccactgacttgggctctgactata

SEQ ID NO: 83769 - DNA, 50 bp, homo sapien
tatctttggataatgcctccttttarcccactgaagttcttttccttcat

SEQ ID NO: 83770 - DNA, 50 bp, homo sapien
ttccagcatgacacacacggtgccasatgggccaccaagcaacttactcc

SEQ ID NO: 83771 - DNA, 50 bp, homo sapien
caggggcattgctggaaggatggaayaattacaggcttttgcagggaaga

SEQ ID NO: 83772 - DNA, 50 bp, homo sapien
ttatgaataataagctcctcacaacmgatataagattgtcagccatggta

SEQ ID NO: 83773 - DNA, 50 bp, homo sapien
tgtggttactctgaatgcctgtaacygtctttaaaacatgatctagaaat

SEQ ID NO: 83774 - DNA, 50 bp, homo sapien
gatatttgggtgtgaatgccaaatastaataaccacctatatctcatgta

SEQ ID NO: 83775 - DNA, 50 bp, homo sapien
ttttttttttgagtttcagttcttawagaaaggaatacagtgtgttatgc

SEQ ID NO: 83776 - DNA, 50 bp, homo sapien
aagttaaatcacagataaggaaataygtagaagacaagggaaagatgagg

SEQ ID NO: 83777 - DNA, 50 bp, homo sapien
cgtaaataaaataacacgaaatatawctgccagaagaaacgtaaaaagaa

SEQ ID NO: 83778 - DNA, 50 bp, homo sapien
agtcaaagctaccagatctccttgcsctagcctaggaaatcttactcagt

SEQ ID NO: 83779 - DNA, 50 bp, homo sapien
aaggacatgggctttacattctggamcttgaatgatctctcttgatggtc

SEQ ID NO: 83780 - DNA, 50 bp, homo sapien
cttggacagaaatatgcctagattarcattcctctgtcatattctctacc

SEQ ID NO: 83781 - DNA, 50 bp, homo sapien
tgttaaatggatgaattatgaaatgsagagagagaaactcaaactgttca

SEQ ID NO: 83782 - DNA, 50 bp, homo sapien
atatctgcaagagaatgaatcatcawctttcattccaaatacttgtttga

SEQ ID NO: 83783 - DNA, 50 bp, homo sapien
ccttttattgttttattgctaattayagtcttcatgctgtacaccaaatc

SEQ ID NO: 83784 - DNA, 50 bp, homo sapien
accatacaaaatgtcaaagaaagtasagagaatcaaaaatgtgtaagaaa

SEQ ID NO: 83785 - DNA, 50 bp, homo sapien
gtgtcagcccccatatttctgccacractaagaggaagctggcttcctca

SEQ ID NO: 83786 - DNA, 50 bp, homo sapien
ttttgttagttttgattaaagggaaygaggagctctgagtagggcagcaa

SEQ ID NO: 83787 - DNA, 50 bp, homo sapien
tgtaaggataatatttgcgtggatayaatgaagagggcatgaataattaa

SEQ ID NO: 83788 - DNA, 50 bp, homo sapien
aaaaaatccataacaaaaagctttakataactggcaggtgacgttttcca

SEQ ID NO: 83789 - DNA, 50 bp, homo sapien
caatagcaacgtttttgaatcagagragtgattttgaacacactgtacat

SEQ ID NO: 83790 - DNA, 50 bp, homo sapien
gaccagcagcatcacatcaccacaamgcttgttagaaatgtaactttcta

SEQ ID NO: 83791 - DNA, 50 bp, homo sapien
tgcatccttctctaacatattctggraccttcaataaactaagataaagc

SEQ ID NO: 83792 - DNA, 50 bp, homo sapien
cttttatatactctgatattgctaawcttctggtattgtttctctagatt

SEQ ID NO: 83793 - DNA, 50 bp, homo sapien
atcgatgtgaaggctgggttagcaakttgaagtttatcgtttcgaagctg

SEQ ID NO: 83794 - DNA, 50 bp, homo sapien
tccgacgagatttataaactccttgyagaaagctcccaagtcttatactg

SEQ ID NO: 83795 - DNA, 50 bp, homo sapien
ttctagagaggcctccaaatatgcargatatcagtgagaaaaaaatgcta

SEQ ID NO: 83796 - DNA, 50 bp, homo sapien
tcccaactgtcttctacaatgaaatrtctatgcaaatcagccccagaccc

SEQ ID NO: 83797 - DNA, 50 bp, homo sapien
catgaatgagaatataggcatacaamtatacttgcaaatttcaagtttta

SEQ ID NO: 83798 - DNA, 50 bp, homo sapien
gatttggataaggaattctcatttgratgactacatgagtgacaggtccc

SEQ ID NO: 83799 - DNA, 50 bp, homo sapien
gtatgagtgatggaatgaacagatayaattaatccaggtctggtaagtga

SEQ ID NO: 83800 - DNA, 50 bp, homo sapien
gaaaggaggaaagctatttcttcagkaagttcgtaacaataagttcagtt

SEQ ID NO: 83801 - DNA, 50 bp, homo sapien
agtcttaacttgtaatagcttcaacrtaaaagtccagagtctcatctaaa

SEQ ID NO: 83802 - DNA, 50 bp, homo sapien
aagtgaagactgtatcaaataaaaasagaggcagggcgtacacagcagct

SEQ ID NO: 83803 - DNA, 50 bp, homo sapien
taaagggtttttttcctcattgagcrcaaatctttccagttgtctcaggc

SEQ ID NO: 83804 - DNA, 50 bp, homo sapien
tatctcagttgatattagacattagraatgaaggctgcggctatatttta

SEQ ID NO: 83805 - DNA, 50 bp, homo sapien
agagctgctttgtctccctgtttcayacaattatgttaggatcattcatt

SEQ ID NO: 83806 - DNA, 50 bp, homo sapien
tgcctttcattcctagtagatcaacyatatgagaagataaaggctgttag

SEQ ID NO: 83807 - DNA, 50 bp, homo sapien
caatatagagtttaccaaaaaatatraccttcttgattttgcagtctttg

SEQ ID NO: 83808 - DNA, 50 bp, homo sapien
tatgtctgtaagaattgttgaggtamatatccagaaaattgcaatacaat

SEQ ID NO: 83809 - DNA, 50 bp, homo sapien
caaagtagcattgcttgataatgtamaattaattccatttgctttcccta

SEQ ID NO: 83810 - DNA, 50 bp, homo sapien
ggcagactacttaacttgcacttaayatgaaaggagaaaaaacataaagc

SEQ ID NO: 83811 - DNA, 50 bp, homo sapien
ttattttctatgaacatagctactgmaaataagcttacatatgctgggtt

SEQ ID NO: 83812 - DNA, 50 bp, homo sapien
tcagtgccaatgtgatgtgtttaaakgtaagccaggaactttatctcagc

SEQ ID NO: 83813 - DNA, 50 bp, homo sapien
tctcttttgtgacttgccaagagcayggagaaattccatcagggagcttc

SEQ ID NO: 83814 - DNA, 50 bp, homo sapien
acctaaaatcagagcaactgctacamatttcgacacagtagtaagcattt

SEQ ID NO: 83815 - DNA, 50 bp, homo sapien
tatgtggttataaaatcaaatgggaraaaacgactgcaatggtggaaaag

SEQ ID NO: 83816 - DNA, 50 bp, homo sapien
tgtatatggattcctacagtaatgtwaaaaagtaatgtaattcctaaaaa

SEQ ID NO: 83817 - DNA, 50 bp, homo sapien
ttaccatctagaatataacattagamctatgtgtacaatgattttattgt

SEQ ID NO: 83818 - DNA, 50 bp, homo sapien
aactttttagaaaaagactaccagakaatcttttaccttgatttagacaa

SEQ ID NO: 83819 - DNA, 50 bp, homo sapien
ccctgaactcaaaatgtcttatcatrtcttactctcccatctaaaatgta

SEQ ID NO: 83820 - DNA, 50 bp, homo sapien
cacagaaatgaagcagtttaagggayggcctccagaacctgaacgcatgc

SEQ ID NO: 83821 - DNA, 50 bp, homo sapien
aagaacatatattcctcatatgcaartgtatacatatacgtccaggcatg

SEQ ID NO: 83822 - DNA, 50 bp, homo sapien
cctaagaaataatctaatcgaaacawctatttaacagatgaaaaactaag

SEQ ID NO: 83823 - DNA, 50 bp, homo sapien
caactacagggggagtatttgtaccrgaaaatctgcaaatgctctcccac

SEQ ID NO: 83824 - DNA, 50 bp, homo sapien
gtgcagtgtgagcaactgcaggattygggcagccaggatctgttcatcct

SEQ ID NO: 83825 - DNA, 50 bp, homo sapien
actgttttcagagtcagtgagtcatscaatgccctataactgccaccctc

SEQ ID NO: 83826 - DNA, 50 bp, homo sapien
atataaaatgtattgacaagtaaacraattaagtcttctatttggtcttc

SEQ ID NO: 83827 - DNA, 50 bp, homo sapien
tatcttcctagttgaaggggtaatayacatgctcagaagctacagatcag

SEQ ID NO: 83828 - DNA, 50 bp, homo sapien
ctgggtttaagtgggaagagagtaargtttaaatgccgaccaatctaggt

SEQ ID NO: 83829 - DNA, 50 bp, homo sapien
aaaccaaaataagcaaagatccctcrcttggagatgtggtagaagacttg

SEQ ID NO: 83830 - DNA, 50 bp, homo sapien
actatttttatcagcaacgacaaaayacagtaacatagcacattatgagt

SEQ ID NO: 83831 - DNA, 50 bp, homo sapien
ctatccaggatcacatttgctattakaattacagggtgtcatgactgctg

SEQ ID NO: 83832 - DNA, 50 bp, homo sapien
tatgggtctacaaatgaagcatggasgtagtaagctaagatagtggttat

SEQ ID NO: 83833 - DNA, 50 bp, homo sapien
attgtcaagaattagtagttaattamagcaggttaccagaaataataaat

SEQ ID NO: 83834 - DNA, 50 bp, homo sapien
tatttaacttatgtctcctaactccrcaagagattatgtctgatactgta

SEQ ID NO: 83835 - DNA, 50 bp, homo sapien
tcaaaataatagcagcaatggtcacraatttatttatatacaaccataat

SEQ ID NO: 83836 - DNA, 50 bp, homo sapien
tcagtcccttcagctaactctgattwaaaaagtcatagtgactccaaaaa

SEQ ID NO: 83837 - DNA, 50 bp, homo sapien
tactggcctggaagccttcttgacayagatgatacagaatgatggaagct

SEQ ID NO: 83838 - DNA, 50 bp, homo sapien
tatccttcccctaattatccagcatraaatagtgtttctgcctctgttcc

SEQ ID NO: 83839 - DNA, 50 bp, homo sapien
agacagactacttaacctttcacaaygcttatctatgtgtaaaacaaact

SEQ ID NO: 83840 - DNA, 50 bp, homo sapien
agtgagactttctaaggagatcaagsctaggcacacataaagtaaggtcc

SEQ ID NO: 83841 - DNA, 50 bp, homo sapien
gagaaggaacaaaatagtacttccaygttacttaccttaggatacggata

SEQ ID NO: 83842 - DNA, 50 bp, homo sapien
catgctgcataaaagagattggtgaratgttttaatttttattcctgtta

SEQ ID NO: 83843 - DNA, 50 bp, homo sapien
attcacccatctatccaaacttattkaacaccttgactgttgtaggcctt

SEQ ID NO: 83844 - DNA, 50 bp, homo sapien
taggatagcggttgcctctgtcagcragaagatttgtcagaattttgatg

SEQ ID NO: 83845 - DNA, 50 bp, homo sapien
taaccaacagagagatttatttaagrccaaaatgtcagaggtaatcaaac

SEQ ID NO: 83846 - DNA, 50 bp, homo sapien
ctgtcaattctctgagtaggaattaygtcttctacctcttggtactgggt

SEQ ID NO: 83847 - DNA, 50 bp, homo sapien
gccattaggtcttgggcttttacttwttattacagcttcaatctcgttac

SEQ ID NO: 83848 - DNA, 50 bp, homo sapien
aatgtttgctagaatttagtagtgaygccattaggtcttgggcttttact

SEQ ID NO: 83849 - DNA, 50 bp, homo sapien
aaaaagtaatgtatgactgaaagaakagattgcagtataaaattgtataa

SEQ ID NO: 83850 - DNA, 50 bp, homo sapien
atcaagcccccatgaatgagccgttraaagaatctaaaagagaattgaaa

SEQ ID NO: 83851 - DNA, 50 bp, homo sapien
ttgaatgaatatagaaatctctagtyaactgcttttgatctaaaattcta

SEQ ID NO: 83852 - DNA, 50 bp, homo sapien
tgggaaatgctaagtcttaccctcaygaaaagacaagaaattgcaacatg

SEQ ID NO: 83853 - DNA, 50 bp, homo sapien
atcatggaaatgtttgttcaagtatraaagagatagctatgagctcttct

SEQ ID NO: 83854 - DNA, 50 bp, homo sapien
gaggataaaccttagcaactctacartcctgcccactctgtatcttctct

SEQ ID NO: 83855 - DNA, 50 bp, homo sapien
tcacactgtttgcattttcacgggtktaggttttctcatctcttcacttt

SEQ ID NO: 83856 - DNA, 50 bp, homo sapien
aaaacgctgaaagaaattttaagacrgagatggcagatttcacaaataca

SEQ ID NO: 83857 - DNA, 50 bp, homo sapien
caatacaaactctttctctcctaackctaatgcacaagtaggttagagac

SEQ ID NO: 83858 - DNA, 50 bp, homo sapien
gtattgcatttgccatattttcaaawtggatatgatatacaggagtgatg

SEQ ID NO: 83859 - DNA, 50 bp, homo sapien
aaactctgacggctaaaggagacacrggtgatccagcacctctctgggct

SEQ ID NO: 83860 - DNA, 50 bp, homo sapien
catcttcccttcttatctcatcatcrgaaggaaatcagacaagagagcat

SEQ ID NO: 83861 - DNA, 50 bp, homo sapien
ttggtctttaattataatgtgatacygatttcaagtagctctgaacattt

SEQ ID NO: 83862 - DNA, 50 bp, homo sapien
aactaacagccatcctatctaagagragtgtgacaagttggctcagcaag

SEQ ID NO: 83863 - DNA, 50 bp, homo sapien
ggacctcttactcaaatcccattcartcaaagcctatctgtgcagaattt

SEQ ID NO: 83864 - DNA, 50 bp, homo sapien
tattctaaatatatacataccaaacrctggagcatttagagtcataaaac

SEQ ID NO: 83865 - DNA, 50 bp, homo sapien
agttcctatcagagaaagagcatcaratgtgctttgaacataagaaaatt

SEQ ID NO: 83866 - DNA, 32 bp, homo sapien
acttaccaatttttttrtgtgtcagccagtta

SEQ ID NO: 83867 - DNA, 50 bp, homo sapien
ttgtggctgtttgtccaccttgatayccagggcagaactgctctcacatt

SEQ ID NO: 83868 - DNA, 50 bp, homo sapien
gctgtcttaaatatactcaagtgttsaaagaatattgttttagaggtttc

SEQ ID NO: 83869 - DNA, 50 bp, homo sapien
tgtttcgagcttctgtgctttcaagwctacagtaatttatcttgtgcaca

SEQ ID NO: 83870 - DNA, 50 bp, homo sapien
ccagccaacccactgccaaaaatcckacaacatgacacaatttggctaga

SEQ ID NO: 83871 - DNA, 50 bp, homo sapien
tttttccaagaagagttttggcaacrgcctttcccaaagctctggaaccc

SEQ ID NO: 83872 - DNA, 50 bp, homo sapien
tatacttgagaaactataatatgcasctaacattgtacatcacaagaaga

SEQ ID NO: 83873 - DNA, 50 bp, homo sapien
taaaacttctatcagtgagtataaayttggttgggaattgtggatttaaa

SEQ ID NO: 83874 - DNA, 50 bp, homo sapien
gggagacagacgtgtagccaagtaastccagtgtgcaatgagtgaggctc

SEQ ID NO: 83875 - DNA, 50 bp, homo sapien
cagatataaaagtatttagtttatargtgaactctgacaacgctttttat

SEQ ID NO: 83876 - DNA, 50 bp, homo sapien
tacctattacaaaccgtaaaatgagkactaagagtcatgaacaagtccca

SEQ ID NO: 83877 - DNA, 50 bp, homo sapien
aaactcaataagtaaacaaatataamgatggctaattgagctataaaaga

SEQ ID NO: 83878 - DNA, 50 bp, homo sapien
ccatagttaattgtttaagtttatakgatgtctgtttgcaatccatgtta

SEQ ID NO: 83879 - DNA, 50 bp, homo sapien
gatagatctgattgttattaaagaamcttttagctatttccccttctttt

SEQ ID NO: 83880 - DNA, 50 bp, homo sapien
actgtcccagaaatagttctttaaawactacaccatgaatatttgtaaat

SEQ ID NO: 83881 - DNA, 50 bp, homo sapien
tatctgtaactgtaggattacacacsaatctagtaaaacctgttacggtt

SEQ ID NO: 83882 - DNA, 50 bp, homo sapien
ctaaatagtggtttccaaaagcagaytaaagcattaaacaaagcattaaa

SEQ ID NO: 83883 - DNA, 50 bp, homo sapien
atccatttggaagcaagagcatagaygtaagtagaaggcaattaaaaaaa

SEQ ID NO: 83884 - DNA, 50 bp, homo sapien
aagaagcagcactacatcaaaagaakataccacctggcctgccagcatgg

SEQ ID NO: 83885 - DNA, 50 bp, homo sapien
ctgggcctccagtttggccaagagaktctaacttcaggaaccctaactcc

SEQ ID NO: 83886 - DNA, 50 bp, homo sapien
tctgtggagctacgtctacatgaagsacggtgtttcaagggctgtctctc

SEQ ID NO: 83887 - DNA, 50 bp, homo sapien
cagagtcaggggcagtgagaaccgasgtctaatgcctggcatgcgtccaa

SEQ ID NO: 83888 - DNA, 50 bp, homo sapien
catttagaattcctttcttcattttktgagttttcttagtttacgctatt

SEQ ID NO: 83889 - DNA, 50 bp, homo sapien
ggaaagcagttcacagagaattaaaragctttcaccatttacccagaatt

SEQ ID NO: 83890 - DNA, 50 bp, homo sapien
ggatcccagagggtcattggtcagtwaccttttgtgagaaggtgaaggag

SEQ ID NO: 83891 - DNA, 50 bp, homo sapien
ataaaaagaaaaatgcctattcgtaygtgcaaaatgaaaatagaaacaaa

SEQ ID NO: 83892 - DNA, 50 bp, homo sapien
atgttgaatcaacagggttagaacaragataataatctgaaagtcagaga

SEQ ID NO: 83893 - DNA, 50 bp, homo sapien
cacataatttcaggtctacgtctaaktattataaaatgatttctacgttt

SEQ ID NO: 83894 - DNA, 50 bp, homo sapien
cagccagggcaaatagtcagcaagtwactattgaatgtttactccatacc

SEQ ID NO: 83895 - DNA, 50 bp, homo sapien
tggctagacactcccaaatttaaagrcacacatacaaatgtccactatat

SEQ ID NO: 83896 - DNA, 50 bp, homo sapien
agagagatgaaggtaaaaatcagacsagactttgttttccaaaatcactc

SEQ ID NO: 83897 - DNA, 50 bp, homo sapien
accagcagtggcattgtgctaggtgycctggaggaatacaaattattgtg

SEQ ID NO: 83898 - DNA, 50 bp, homo sapien
aaagtcactcttctattctatggaastgtatgtaagagctataagattaa

SEQ ID NO: 83899 - DNA, 50 bp, homo sapien
tctgcttcaaccaatctctgaataartggcggtcatctgtgatgagctgg

SEQ ID NO: 83900 - DNA, 50 bp, homo sapien
ctgcaaggagcagatgctctatttaygaccacagagcatgcctattacat

SEQ ID NO: 83901 - DNA, 50 bp, homo sapien
atgtcttttatcaatctaaacataartcctcatttttttctagttgttct

SEQ ID NO: 83902 - DNA, 50 bp, homo sapien
actgctctagagataacaacatgaayattataaaatgtttagttttccct

SEQ ID NO: 83903 - DNA, 50 bp, homo sapien
tctgaaaattctagggcccttaagawgtatgctgatataatctacttgtg

SEQ ID NO: 83904 - DNA, 50 bp, homo sapien
aaccctggataatcttcccatctcartatcttgcaatcgcatctgcaaag

SEQ ID NO: 83905 - DNA, 50 bp, homo sapien
tttatctcatttaactataccaaccyggagcatactttacaatcctcttt

SEQ ID NO: 83906 - DNA, 50 bp, homo sapien
tatttagctaccttagatttcactayaacatatctgggttaatctttttt

SEQ ID NO: 83907 - DNA, 50 bp, homo sapien
ctttttggttaacgttcctcactcartctcatttgggctgtgttgtttat

SEQ ID NO: 83908 - DNA, 50 bp, homo sapien
ggtcaatgttgttgtatagaagtgasactgatttttgtatgttgattttg

SEQ ID NO: 83909 - DNA, 50 bp, homo sapien
atcactgctgtatctgaactcctaaytccactatatatacgttaatgtca

SEQ ID NO: 83910 - DNA, 50 bp, homo sapien
aaaaaacaaaaacagaaactgaggckctagtattttccatgcatgtaaat

SEQ ID NO: 83911 - DNA, 50 bp, homo sapien
cagtcatttggagtcctccctctcastcattcacagcttacttgtcactg

SEQ ID NO: 83912 - DNA, 50 bp, homo sapien
tggatgggcaccatgttctcagaaawcacatagctctttttgagttggct

SEQ ID NO: 83913 - DNA, 50 bp, homo sapien
ggttgatcaggcttatgacgttcacrgacccggggcagtgagtgtatgtg

SEQ ID NO: 83914 - DNA, 50 bp, homo sapien
cccaaataaattctcctactgtcaamgtttagaaaatcaaataagaccct

SEQ ID NO: 83915 - DNA, 50 bp, homo sapien
acaaccccagaacttgaccttagcartattaccttttctttattcttacc

SEQ ID NO: 83916 - DNA, 50 bp, homo sapien
ctacttatcactagaatccttcaatmacctctaacaaacatgtcaaggat

SEQ ID NO: 83917 - DNA, 50 bp, homo sapien
agctcaggttgaccctggatttgacraaagctcgctcccactttcaggtt

SEQ ID NO: 83918 - DNA, 50 bp, homo sapien
ttatattctcctacaaaaactcacamaatgcccaaagaatcatttaagtt

SEQ ID NO: 83919 - DNA, 50 bp, homo sapien
tcatacaacccagtttgctttggacwatcctgttttatacctgttttcct

SEQ ID NO: 83920 - DNA, 50 bp, homo sapien
cacttgaggaagtggccttaggtagraatgtctggctgaggtgtcaggat

SEQ ID NO: 83921 - DNA, 50 bp, homo sapien
cctataccctgaatgagcacttaaayttcaggaaacctgtgaaatggagg

SEQ ID NO: 83922 - DNA, 50 bp, homo sapien
tacctctggccacccagaaaagcatyagatctgggaaaagggagaaacaa

SEQ ID NO: 83923 - DNA, 50 bp, homo sapien
acttatagaagttcatctgtgtatargcattaaagagtatttattgtagt

SEQ ID NO: 83924 - DNA, 50 bp, homo sapien
ttgactgaacaacctgagaaaaaacrgcatacttaaatatcagattcatt

SEQ ID NO: 83925 - DNA, 50 bp, homo sapien
ccacccctgccccttgccaaaagaarcacatccactactcacttctttat

SEQ ID NO: 83926 - DNA, 50 bp, homo sapien
tacctgaatatagtgcagagggaaayttgagggagtaaacataagggcaa

SEQ ID NO: 83927 - DNA, 50 bp, homo sapien
atggtggccggcaagaaattgaccawctctaaatattggtatagcttagt

SEQ ID NO: 83928 - DNA, 50 bp, homo sapien
tctttccccgcaaattagattggatsaagatcattttctccagcttataa

SEQ ID NO: 83929 - DNA, 50 bp, homo sapien
acccgagggaaagatcagctagaccsaaaagaggctttgagcatatctaa

SEQ ID NO: 83930 - DNA, 50 bp, homo sapien
gccaagagcagaacatcgactcgaarcaccaattctcaaccttggtaatc

SEQ ID NO: 83931 - DNA, 50 bp, homo sapien
tgatgatttctgagaagatatgactygtaactttccaataacacttttct

SEQ ID NO: 83932 - DNA, 50 bp, homo sapien
actcccttttccgtgctcccacaacrgaatgtctatgtttctagggatca

SEQ ID NO: 83933 - DNA, 50 bp, homo sapien
acactgcagaaatatggagcaaagayacactacagtgaagcaagaggctt

SEQ ID NO: 83934 - DNA, 50 bp, homo sapien
aaactcaaagagatttttcaacatcygataacctgcatacagttctttca

SEQ ID NO: 83935 - DNA, 50 bp, homo sapien
ccatgtgttttgacaagtttatttayactaagtcatattcctaatgcatt

SEQ ID NO: 83936 - DNA, 50 bp, homo sapien
tttgtttcttacttgataggccttgragatgacttagttgttgagttcag

SEQ ID NO: 83937 - DNA, 50 bp, homo sapien
gctagctcatttcttgggtggtcttraagaaatgtgacaggactcaagag

SEQ ID NO: 83938 - DNA, 50 bp, homo sapien
tctatatttgatttttttcaaattaygctccaacctatagactaaatgga

SEQ ID NO: 83939 - DNA, 50 bp, homo sapien
agaaccatggcacgctctttctgcgsactcaccagcactgagcatgtttg

SEQ ID NO: 83940 - DNA, 50 bp, homo sapien
ctgattgttaaattatgcatgcctargagtgacgacacagagcccagcat

SEQ ID NO: 83941 - DNA, 50 bp, homo sapien
gaaattttaacttatgcctcaattamagtaatagcatctcacattcaata

SEQ ID NO: 83942 - DNA, 50 bp, homo sapien
cttggattctccagttgttttctcaygactcattgttcttctagcatgct

SEQ ID NO: 83943 - DNA, 50 bp, homo sapien
gctttaattttgaaaggcgtggatayattaatgagtgttaaacttgcaga

SEQ ID NO: 83944 - DNA, 50 bp, homo sapien
cctaatggctggaagcctagatgagwcatgtgattgaagaacacaacaat

SEQ ID NO: 83945 - DNA, 50 bp, homo sapien
agtctctaattgtataagcacatcamtaaatatggattgtaaaatatctt

SEQ ID NO: 83946 - DNA, 50 bp, homo sapien
aaagacgtcaatgattgttagatatmaaagcagcatacagaacaatgttt

SEQ ID NO: 83947 - DNA, 50 bp, homo sapien
gcaatctgatccagaatatatccaamtctgaacatccttttccaaaaagt

SEQ ID NO: 83948 - DNA, 50 bp, homo sapien
tgcaaactcaaagcaatgaaatttaygtgtaattcaaatgaaaagttccg

SEQ ID NO: 83949 - DNA, 50 bp, homo sapien
tgggaaagcacaaagaaaccaggtcracagctgccaccaagcacttccag

SEQ ID NO: 83950 - DNA, 50 bp, homo sapien
tcaatagttttaatattacattacamtctcacagctaagtaagaacatgt

SEQ ID NO: 83951 - DNA, 50 bp, homo sapien
atgaaacatgatgcaagttgtagttyttctgtagattgtcttcattaagg

SEQ ID NO: 83952 - DNA, 50 bp, homo sapien
tgaaactaactctcagtggttgaaaygttgatttatttcctacaaactgc

SEQ ID NO: 83953 - DNA, 50 bp, homo sapien
atatggttttataaaacaaaatatamcaaatattcaaacaattaacacca

SEQ ID NO: 83954 - DNA, 50 bp, homo sapien
ggcgagaaagtagactgaaacatcgytaaaatgattttcaatgacataga

SEQ ID NO: 83955 - DNA, 50 bp, homo sapien
agtcctctatttttccatccttaaakacagaataggattggctttatgcc

SEQ ID NO: 83956 - DNA, 50 bp, homo sapien
aatagaaatccatacacactatcttyctcattttcctgttaccaactggt

SEQ ID NO: 83957 - DNA, 50 bp, homo sapien
agcagggagtgatgtggccaacacamacttaaggattaccctgtcctgga

SEQ ID NO: 83958 - DNA, 50 bp, homo sapien
ttcttaaataaaacaatgcataaatwataagttaaaaaaggaataataaa

SEQ ID NO: 83959 - DNA, 50 bp, homo sapien
atcaattccatttatgtaattagagsaacagagacatgaaaagtgaaaaa

SEQ ID NO: 83960 - DNA, 50 bp, homo sapien
tattgctgctctctagccttgattargtctctaactgtcagatcagctta

SEQ ID NO: 83961 - DNA, 50 bp, homo sapien
cagacaaaattcttgaaacagccaartgttgggtctgtgatttgcctgct

SEQ ID NO: 83962 - DNA, 50 bp, homo sapien
tctctttcccttcccctgaaaaagckacaaggaaatatttctctggtcct

SEQ ID NO: 83963 - DNA, 50 bp, homo sapien
tttaatgttatttttgtgtataatamgtacatatgaaaaacttaaaccac

SEQ ID NO: 83964 - DNA, 50 bp, homo sapien
ggaattaacttaattattactctgargaatttgaaccaaagatgttagac

SEQ ID NO: 83965 - DNA, 50 bp, homo sapien
ttcaaacaagccactctgccattacyagaaatcatatgtcttatgtgact

SEQ ID NO: 83966 - DNA, 50 bp, homo sapien
atggtaatgcatgcagtctacttagyacagtgtggaatacataataagag

SEQ ID NO: 83967 - DNA, 50 bp, homo sapien
tcgttggtttcttgcagttttattaygatgtagttaggtgtagatttctt

SEQ ID NO: 83968 - DNA, 50 bp, homo sapien
tcatgagactttgattaaccagacayctattattaagcccattattaact

SEQ ID NO: 83969 - DNA, 50 bp, homo sapien
acgtataatcctctttggcaattacraatgttaaaaatacctttcatttt

SEQ ID NO: 83970 - DNA, 50 bp, homo sapien
catccatcctaaagcactaacacagrcatggccatattattctgtcaaga

SEQ ID NO: 83971 - DNA, 50 bp, homo sapien
catacagaagaaagtgatctggtaartattcgactttgggtagttcttca

SEQ ID NO: 83972 - DNA, 50 bp, homo sapien
aaatgtgctgttgctgaatataagayaagagctgtttatagataggagct

SEQ ID NO: 83973 - DNA, 50 bp, homo sapien
agagcctctttctgttattcattacyattaccaggtagctgtgtccctaa

SEQ ID NO: 83974 - DNA, 50 bp, homo sapien
agatgaaaatataaaataataagtaraaaacacataataccatacctatc

SEQ ID NO: 83975 - DNA, 50 bp, homo sapien
agttattggaaactctacaactctamaatgttttagtctgaatgcccaat

SEQ ID NO: 83976 - DNA, 50 bp, homo sapien
tgattattatgtttttggtataatgyataaagtacagcagctgacccact

SEQ ID NO: 83977 - DNA, 50 bp, homo sapien
agctagaatttgtaactgtcaggaasttagaacagaagacactagggtat

SEQ ID NO: 83978 - DNA, 50 bp, homo sapien
acatgtgggactttttgtacataaaygaatggtgtagtttttatgtaaat

SEQ ID NO: 83979 - DNA, 50 bp, homo sapien
tcctgcaatatcttcagctttatcartacatggacccaaacaggccaatc

SEQ ID NO: 83980 - DNA, 50 bp, homo sapien
ggcattcctaccactgggaaatagargagaattttaaattatatacacat

SEQ ID NO: 83981 - DNA, 50 bp, homo sapien
ataattaatccttaatctgtttgaamctctaatctcaccatttctaaaac

SEQ ID NO: 83982 - DNA, 50 bp, homo sapien
atgtctatttctcctttcaattatastaatatttgtttcatatactttgg

SEQ ID NO: 83983 - DNA, 50 bp, homo sapien
gccctgacattcttaagctggaaaaytagccaaccctcgaaccaaccgtg

SEQ ID NO: 83984 - DNA, 50 bp, homo sapien
ttgacagctattggcatggcaaaaaractagaagacttcaaaagccacaa

SEQ ID NO: 83985 - DNA, 50 bp, homo sapien
tctatatcctcaaagtgccttgctakaattttgatagaaattgtgttaaa

SEQ ID NO: 83986 - DNA, 50 bp, homo sapien
aacttttagaataaaatataggagaygatattaagcctgaagccaaatgc

SEQ ID NO: 83987 - DNA, 50 bp, homo sapien
ctcatcccctctccaaaagacataasgtaaagccctattcagctattgca

SEQ ID NO: 83988 - DNA, 50 bp, homo sapien
ctatggtcagcccatgggggaaaatyatgcacttttaggaccatcagcta

SEQ ID NO: 83989 - DNA, 50 bp, homo sapien
aagtaattccttagaaactacaacasattatgaaaatcaagtaattccag

SEQ ID NO: 83990 - DNA, 50 bp, homo sapien
aggtggccgtgaaatagcctagccartgatttttacgccaatgcccctga

SEQ ID NO: 83991 - DNA, 50 bp, homo sapien
cccaggaatctcttctatttcttccragatcttactgtacttaagataaa

SEQ ID NO: 83992 - DNA, 50 bp, homo sapien
ctctactgggaaataactatttcatragcattttgatcagtgtctcacta

SEQ ID NO: 83993 - DNA, 50 bp, homo sapien
ggctcatccacaaggaaacctgttaygcaaatgaatactaaaatgagtag

SEQ ID NO: 83994 - DNA, 50 bp, homo sapien
tgaactctttggatcccaatcttaartctaatcaaatcaaaataaatata

SEQ ID NO: 83995 - DNA, 50 bp, homo sapien
aggaggctgtagaagataccaggaaygacggctaatcaggagttaggtgc

SEQ ID NO: 83996 - DNA, 50 bp, homo sapien
atttgcttccagaattctgctgttcmaataagtgtcatgttgtcctttaa

SEQ ID NO: 83997 - DNA, 50 bp, homo sapien
gagcaaagtagaagtatggacactamccaactctacaacttactataaag

SEQ ID NO: 83998 - DNA, 50 bp, homo sapien
tgataatcacctcatgattttctctkcaatttaacattcatatatacatt

SEQ ID NO: 83999 - DNA, 50 bp, homo sapien
gactacatcttttacagtctaccaargaagtgctaaccagaaagggagaa

SEQ ID NO: 84000 - DNA, 50 bp, homo sapien
agttgccagctcttctacagaagaamggagcttttatgctgatcttgagg

SEQ ID NO: 84001 - DNA, 50 bp, homo sapien
caggcttattagactgtgggatcaayctctttaagaaagcattttgcaga

SEQ ID NO: 84002 - DNA, 50 bp, homo sapien
gaaaaaatttaatggcattcgcaacytaagcccactctctcccgcttttt

SEQ ID NO: 84003 - DNA, 50 bp, homo sapien
tagagaaatgtctttacattccaaaragcagagtgagaattcaggattct

SEQ ID NO: 84004 - DNA, 50 bp, homo sapien
aaagcagttttatggtgctcaatccygaatcactaaaatctggattttca

SEQ ID NO: 84005 - DNA, 50 bp, homo sapien
cagcacattacaaattgaactggtaraataacttcatatggaactcatca

SEQ ID NO: 84006 - DNA, 50 bp, homo sapien
tattttattttcctaattggcatacyttttattttgttttcttgtataat

SEQ ID NO: 84007 - DNA, 50 bp, homo sapien
tgaataaaaccaagcagctccagaaygactctctttgaatgattatgtaa

SEQ ID NO: 84008 - DNA, 50 bp, homo sapien
caatgatataaaaagactggttgacyaactgatgacctgaaaactatgaa

SEQ ID NO: 84009 - DNA, 50 bp, homo sapien
ttgatttatttttctcacaattttgsatcattgagtggttcctgattctg

SEQ ID NO: 84010 - DNA, 50 bp, homo sapien
tgagtgcactgtgaaatatagatgcmatagcaaacaatggggttctgctt

SEQ ID NO: 84011 - DNA, 50 bp, homo sapien
agagaacactcatactaaatcctaamcctgtgcagttttctttgtaaaca

SEQ ID NO: 84012 - DNA, 50 bp, homo sapien
tgtgaagtgagggttattattgtagsaaaggccaagtggaagccactata

SEQ ID NO: 84013 - DNA, 50 bp, homo sapien
gaatggataatggtgaatggtggtayatccaataatagaatattggctca

SEQ ID NO: 84014 - DNA, 50 bp, homo sapien
gcaccttgtgtctaatgtttagctayaacaaacctcggtatacttatttc

SEQ ID NO: 84015 - DNA, 50 bp, homo sapien
cttatgagaattttctgtatggacartggaatattgtgttaggcgtttag

SEQ ID NO: 84016 - DNA, 50 bp, homo sapien
tgacataaaaagccaatttaagggakgcgaactacgcttattccacatgc

SEQ ID NO: 84017 - DNA, 50 bp, homo sapien
acattgcatcatcaatcagtgaccakgaggatagtacagcttttaaaaaa

SEQ ID NO: 84018 - DNA, 50 bp, homo sapien
gctgctatactgtaaagcaactcacyagttacccgatcatggttatgacc

SEQ ID NO: 84019 - DNA, 50 bp, homo sapien
tgtgaaaagagttatgttgaacaaasttgctgacctggtgcttcaccaat

SEQ ID NO: 84020 - DNA, 50 bp, homo sapien
ctctgcatatttccctgaaacagaasacattgcatcatcaatcagtgacc

SEQ ID NO: 84021 - DNA, 50 bp, homo sapien
gtatgtactacatgggaattaaaaaygttgatcttatcgaggtaaagagt

SEQ ID NO: 84022 - DNA, 50 bp, homo sapien
cttgtttttgttgtttttgtaatgaycttggatagtcatttaatgactat

SEQ ID NO: 84023 - DNA, 50 bp, homo sapien
gaaaactatcttgataaaacagtcargtattacaggatttgtgaaaactc

SEQ ID NO: 84024 - DNA, 50 bp, homo sapien
tatttcatgccaatagagacttaaawagagcaacagtagctataattaca

SEQ ID NO: 84025 - DNA, 50 bp, homo sapien
caatgaaatactattcagcgcttaaraaatgagcttgcaagccatgaaaa

SEQ ID NO: 84026 - DNA, 50 bp, homo sapien
attcacaacaataattacacataatsatagagtaataagatgaaacattg

SEQ ID NO: 84027 - DNA, 50 bp, homo sapien
atgaatgtgtttaggtttaatattgsatcaaggagtttttaacttggatg

SEQ ID NO: 84028 - DNA, 50 bp, homo sapien
tgaggccagcaatatggcaagtcacrctaggagacaaggtttaaaataca

SEQ ID NO: 84029 - DNA, 50 bp, homo sapien
gtgtttattagggtttttagtggaaygttattgaatgtttagatcaattt

SEQ ID NO: 84030 - DNA, 50 bp, homo sapien
ctgggaggtccactcaatcatcttaycttcattggcgcatctgcttgaaa

SEQ ID NO: 84031 - DNA, 50 bp, homo sapien
aacattcactgactctacactatatrtaccagactctgtgctaaaggccc

SEQ ID NO: 84032 - DNA, 50 bp, homo sapien
atttgagaatgttgatttcaatctcyatacaaatgagaactgcagattgc

SEQ ID NO: 84033 - DNA, 50 bp, homo sapien
actggtaatgtgaactagggcttgaratagatctttctatatatgaattc

SEQ ID NO: 84034 - DNA, 50 bp, homo sapien
gactatgtaagtagtaagatgtacarccaggactataaattgtttttagc

SEQ ID NO: 84035 - DNA, 50 bp, homo sapien
aaacctcaagtcatatgattgacaakggagtgacataatttgcatatgga

SEQ ID NO: 84036 - DNA, 50 bp, homo sapien
cttaggggggcaattgttctttcccmactaagtatgatgttagctgtagg

SEQ ID NO: 84037 - DNA, 50 bp, homo sapien
tctttttattacaccggcatctaacmaaatgaatttgatagaatatgaat

SEQ ID NO: 84038 - DNA, 50 bp, homo sapien
ctgaaaaacaggtgacctttagcaamtagcttgaactaaggtggaaagat

SEQ ID NO: 84039 - DNA, 50 bp, homo sapien
tctggagagaggatgagcaaactgargaacagcaaacctgcttttgatac

SEQ ID NO: 84040 - DNA, 32 bp, homo sapien
cctctggattggaagtrctctgcatcttgaat

SEQ ID NO: 84041 - DNA, 50 bp, homo sapien
gtaaggttggtggctggttctgatgstatactattgttttacaaaatgtt

SEQ ID NO: 84042 - DNA, 50 bp, homo sapien
ccttccacaggtcctgagccatttcycgtggagactcatcagacagtggg

SEQ ID NO: 84043 - DNA, 50 bp, homo sapien
atagtttgcgaggtatatcaggtcartataatacactcgtagaatacata

SEQ ID NO: 84044 - DNA, 50 bp, homo sapien
tatttctcttatgtctgttccattayaatttcataattctgtggtgtatc

SEQ ID NO: 84045 - DNA, 50 bp, homo sapien
ttccagacttagctcctactagtcayggactcattttctggacatttcgt

SEQ ID NO: 84046 - DNA, 50 bp, homo sapien
gaaaattgaacttttacaatctttcsatcacactctgtggacgtcaaagg

SEQ ID NO: 84047 - DNA, 50 bp, homo sapien
ggctagtgcatgctgtaggcatgatsttgtggtctgaaccagcagcctcc

SEQ ID NO: 84048 - DNA, 50 bp, homo sapien
tccttgaagagattatgtccctgaaragttttaacagtattttatttagt

SEQ ID NO: 84049 - DNA, 50 bp, homo sapien
tctcttgtgttataaatatgtcatcycatcttactgtgtgtttgttcatt

SEQ ID NO: 84050 - DNA, 50 bp, homo sapien
catttttaaccctgagaaaagagtawccttggagtctacttccattctag

SEQ ID NO: 84051 - DNA, 50 bp, homo sapien
taggagaaaaatgttaatgaacttcrattaaaattcctttccaggcttgc

SEQ ID NO: 84052 - DNA, 50 bp, homo sapien
tttatattctgcttacttcactgggmaaatactcacaggttcctaacaat

SEQ ID NO: 84053 - DNA, 50 bp, homo sapien
aagaaattctcattccagatttgtcmaggtacatctataaatgataacag

SEQ ID NO: 84054 - DNA, 50 bp, homo sapien
aaaacagaaaggaatagaataatcayggctgaaaatgtaatcattgaaat

SEQ ID NO: 84055 - DNA, 50 bp, homo sapien
taaatacatagatgtgtaacacgacygtatactcctgtacagagctgaat

SEQ ID NO: 84056 - DNA, 50 bp, homo sapien
gcagctaggggtgaatatgtgatacraatctggctaatgggaagcaagag

SEQ ID NO: 84057 - DNA, 50 bp, homo sapien
cagaggagttaagacttcctaaaatraccattgatcaataagaactggat

SEQ ID NO: 84058 - DNA, 50 bp, homo sapien
ctcctaaaatcactgatagtgttcargagactaataaattagaggttatg

SEQ ID NO: 84059 - DNA, 50 bp, homo sapien
tgtgtgctagcaccaggtcatgctcyaaggataaaaattatctaagtgac

SEQ ID NO: 84060 - DNA, 50 bp, homo sapien
ctaagcacagggtgctcctctatgcrccacagatgaaaggcattctgatc

SEQ ID NO: 84061 - DNA, 50 bp, homo sapien
tgagatgattagttgcattagaaccrgacccttttgtcctactaaagtga

SEQ ID NO: 84062 - DNA, 50 bp, homo sapien
gggagtcttttttacagctgaaccgkcccagaagagagaatgaggtgtga

SEQ ID NO: 84063 - DNA, 50 bp, homo sapien
actgtcagttatctcaatcccaccartctctacagtggcagtcacctaca

SEQ ID NO: 84064 - DNA, 50 bp, homo sapien
cactggagcaggtcagctttcattaycaaaatgcccctgagtttgcccac

SEQ ID NO: 84065 - DNA, 50 bp, homo sapien
ctgtcatctttcaaacgtattctcayctacagaaaagaggataattttta

SEQ ID NO: 84066 - DNA, 50 bp, homo sapien
aggtttttactcctctgagttggtargttctgacataatctgtatttcaa

SEQ ID NO: 84067 - DNA, 50 bp, homo sapien
gctttgttcattctataattcctaaytctaatatcatcgtctccaggatt

SEQ ID NO: 84068 - DNA, 50 bp, homo sapien
aaatatttagaatcttacatcgcagmaaatgttaatgagtaattaagtat

SEQ ID NO: 84069 - DNA, 50 bp, homo sapien
ctcaccagtacattcccattcataaktcctcttaccttttccaccatgac

SEQ ID NO: 84070 - DNA, 50 bp, homo sapien
caaaaaataatcacattacaaatagracatggggttaccacttgataaga

SEQ ID NO: 84071 - DNA, 50 bp, homo sapien
gagaaaagccatgagagtcaccgatraacaccaattcaggcagcagccag

SEQ ID NO: 84072 - DNA, 50 bp, homo sapien
tgaataaatgaaattataaagatgartagagaaataaataataaaagaga

SEQ ID NO: 84073 - DNA, 50 bp, homo sapien
tattgcaagagcattggtgctattaycttacatttttttacactaaagca

SEQ ID NO: 84074 - DNA, 50 bp, homo sapien
gttatccaggcaggtgaaattaagartagaggcagttgtccatgtaattc

SEQ ID NO: 84075 - DNA, 50 bp, homo sapien
aagattgcaagctgatctgaaattayctaaagcagccaaaagactaggac

SEQ ID NO: 84076 - DNA, 50 bp, homo sapien
cggagtaattgggtttcactaatatytgattttccctttcaaatgaaatg

SEQ ID NO: 84077 - DNA, 50 bp, homo sapien
attcctatttccttttgtcaagagayacttacaagatgaccaaaaactac

SEQ ID NO: 84078 - DNA, 50 bp, homo sapien
caaatgatacaatatattaaatacaygattaagacaaacagattaaagaa

SEQ ID NO: 84079 - DNA, 50 bp, homo sapien
agtctgttttgagggttcataatacratgagctcactttatgtcaacctt

SEQ ID NO: 84080 - DNA, 50 bp, homo sapien
caagttatatcagaaacttgaagacyccttagaatttataacatggattt

SEQ ID NO: 84081 - DNA, 50 bp, homo sapien
aatgtaatattcataatatttctaarctatgcatgtatattcataatgta

SEQ ID NO: 84082 - DNA, 50 bp, homo sapien
tcttttttccctgtataaattccaakaaaatttgcaagaacatgtttgac

SEQ ID NO: 84083 - DNA, 50 bp, homo sapien
gaaatttttgattttgtgttttggcyactttattatttagaaagtatttg

SEQ ID NO: 84084 - DNA, 50 bp, homo sapien
aatctctgatacattaatccagtgcraaaccagtgattttcttaaactca

SEQ ID NO: 84085 - DNA, 50 bp, homo sapien
tgatacataaaactgtaaacacatayagagcagaaatcctggttttcaac

SEQ ID NO: 84086 - DNA, 50 bp, homo sapien
catttgtttggtatttaatttttaaygtatggttacacgcagaaaagcgt

SEQ ID NO: 84087 - DNA, 50 bp, homo sapien
gagccaaaagcaaatactgcaagccratgaggtccacagccagtcacctg

SEQ ID NO: 84088 - DNA, 50 bp, homo sapien
agagattatgatagaggatcaatgarcttatgagaagaatacagctttta

SEQ ID NO: 84089 - DNA, 50 bp, homo sapien
gaatcacactatcgaatgaattgaayaaagctctaagctataggatgcat

SEQ ID NO: 84090 - DNA, 50 bp, homo sapien
ttgactgacagaagacagggtacaawtatctgattccttgccctggcagg

SEQ ID NO: 84091 - DNA, 50 bp, homo sapien
tcagtctctcaggagtacttacttakgcaatagtcttatctggtttgtga

SEQ ID NO: 84092 - DNA, 50 bp, homo sapien
ggcccatgctcatgttctcagacaasaggtgtaatagagcaaaacgtcaa

SEQ ID NO: 84093 - DNA, 50 bp, homo sapien
gcaggtttttatattgctttatggaytacaataaaagttataaattccaa

SEQ ID NO: 84094 - DNA, 50 bp, homo sapien
ctggcagactgctgctcactttggaygtagaactttggcaggagccccag

SEQ ID NO: 84095 - DNA, 50 bp, homo sapien
tattaaaaacatcattaccctgctasgaaaaataaaatttattacattat

SEQ ID NO: 84096 - DNA, 50 bp, homo sapien
accatatagcctccaagatctgatawgtaatgatacacgtttaatcactt

SEQ ID NO: 84097 - DNA, 50 bp, homo sapien
tttcttcttcaggttaatctgcatgraaatccaaactattaattagaagg

SEQ ID NO: 84098 - DNA, 50 bp, homo sapien
gctctgttcaaattcatttgtttctkagaccaggaaataactgatatacc

SEQ ID NO: 84099 - DNA, 50 bp, homo sapien
ctctccatttcacaaagcattaatargccaagttctaaaaaaacaaaaga

SEQ ID NO: 84100 - DNA, 50 bp, homo sapien
tggggatggagctaaaagccatctcragaaacgaataggaaaagatgtta

SEQ ID NO: 84101 - DNA, 50 bp, homo sapien
ctgctggaaaaaaacatacactttcwttactgagatctctgctatatggt

SEQ ID NO: 84102 - DNA, 50 bp, homo sapien
tgtaaaggtcttgcggtaaagactgmattgaaaagctttggttccagaga

SEQ ID NO: 84103 - DNA, 50 bp, homo sapien
gtcctgaaccaaatgctatggaaaaraaataagttattagatcaatcaga

SEQ ID NO: 84104 - DNA, 50 bp, homo sapien
aactatactacttttgaaagtcagasataaattacatagttaattctctt

SEQ ID NO: 84105 - DNA, 50 bp, homo sapien
tctgatttgctagccctttactagartatggtgattatgttcaatcttgg

SEQ ID NO: 84106 - DNA, 32 bp, homo sapien
gttgtccttttaaagakgtaaatgcatttaga

SEQ ID NO: 84107 - DNA, 50 bp, homo sapien
tggataaagtgggactattgattacrgaaagctactgtgaagtgcaaatg

SEQ ID NO: 84108 - DNA, 50 bp, homo sapien
ctcaagcctgtaattatagcaaacawtatgttagtcagtgatatttattt

SEQ ID NO: 84109 - DNA, 50 bp, homo sapien
tctctggagcagtgattcatgtaacwccagtataagaatcacctttagac

SEQ ID NO: 84110 - DNA, 50 bp, homo sapien
ccatcttagggattctatgttgtctragctaatcataaaaattccactgt

SEQ ID NO: 84111 - DNA, 50 bp, homo sapien
tataggattctagacatggaaagaamctaatactccacagtcagaggtga

SEQ ID NO: 84112 - DNA, 50 bp, homo sapien
ccaaagatacacagacaaatctgccrttgtaaagagattcagttctgtta

SEQ ID NO: 84113 - DNA, 50 bp, homo sapien
taaatttcaccttgtcgctacataargcaatccttagagctgtaagtttc

SEQ ID NO: 84114 - DNA, 50 bp, homo sapien
tttgcctcagggaattcatgtccacrgaacttggccagcttgatcagctg

SEQ ID NO: 84115 - DNA, 50 bp, homo sapien
cccttagaaaatactgtgtaatataycactaaacttgggccatacagagg

SEQ ID NO: 84116 - DNA, 50 bp, homo sapien
ctgcaaactttttaatctaaagtatmataagatcctgtaattagatcctg

SEQ ID NO: 84117 - DNA, 50 bp, homo sapien
ggggtcttatgacctatagcaaacawgacaggtcagataatttccttatg

SEQ ID NO: 84118 - DNA, 50 bp, homo sapien
aagaaaaatactggaaagtccattargtcagctttaaaatagttactgtg

SEQ ID NO: 84119 - DNA, 50 bp, homo sapien
gtgtgacctggagaggagctacttarcagctagtcaatcaatctattcat

SEQ ID NO: 84120 - DNA, 50 bp, homo sapien
agtattgctaataaatcaaagtagaraatggaacaaagcagagatagctg

SEQ ID NO: 84121 - DNA, 50 bp, homo sapien
gtcaactcctgtagttatggaaaaamcctgataatatgtaggagtcaaac

SEQ ID NO: 84122 - DNA, 50 bp, homo sapien
tgagttccccttcctacaaaatgaarcggatcttcctcagcctggcaatg

SEQ ID NO: 84123 - DNA, 50 bp, homo sapien
agtttatgctctgataatgttcagayatccagttatagagctatcagtat

SEQ ID NO: 84124 - DNA, 50 bp, homo sapien
ttagtagaatagcagattggtcttcycttggtatgacaatgaagacagat

SEQ ID NO: 84125 - DNA, 50 bp, homo sapien
cttcccttggtatgacaatgaagacmgatagcaaacatagtattctatta

SEQ ID NO: 84126 - DNA, 50 bp, homo sapien
ggtgactaaaatggtacaaggttcasaatactgaattaataatgatgtga

SEQ ID NO: 84127 - DNA, 50 bp, homo sapien
ttttaagtcttttgaatctttccttraacgatctacacctgcattttatg

SEQ ID NO: 84128 - DNA, 50 bp, homo sapien
tttatgatttttcccctagtggtacyaattgttaataacctttaggcaaa

SEQ ID NO: 84129 - DNA, 50 bp, homo sapien
tgctcagcaagtatagtaaggacaawgtataaggtcatggattagaacat

SEQ ID NO: 84130 - DNA, 50 bp, homo sapien
aaccaaacactatgactgtgtaccaygcactatggattaaatatgattca

SEQ ID NO: 84131 - DNA, 50 bp, homo sapien
ttgactcatggactcttgagaaatcyagtatatgatccagtgtcttcaca

SEQ ID NO: 84132 - DNA, 50 bp, homo sapien
aaataaattttaaagcagaataaaamagtatttgactcatggactcttga

SEQ ID NO: 84133 - DNA, 50 bp, homo sapien
tctctcttcctgattccatcatagamaaaactgaaagaagccacagaaca

SEQ ID NO: 84134 - DNA, 50 bp, homo sapien
tcaaatacaatgaaacacaaagaaargcaatttgcaagtttcagcagcag

SEQ ID NO: 84135 - DNA, 50 bp, homo sapien
gagactatggattggactttgaagasctggacttattcaataatgaaagc

SEQ ID NO: 84136 - DNA, 50 bp, homo sapien
tgacagtgtcttagattcgaagaagwactattcatagctgttaaaatctt

SEQ ID NO: 84137 - DNA, 50 bp, homo sapien
aattcccagccccaactgacaagtargactcaaaaacaataccccaaaat

SEQ ID NO: 84138 - DNA, 50 bp, homo sapien
tttatggtaacttgcaaggagttaaygtactgtgaattcattcttgtaca

SEQ ID NO: 84139 - DNA, 50 bp, homo sapien
aaaattctacttcaataactgactaygttatgataagattctttgtattc

SEQ ID NO: 84140 - DNA, 50 bp, homo sapien
taggagtaaaggtgtagtgaacagaytaaagtaatttctttttctttttc

SEQ ID NO: 84141 - DNA, 50 bp, homo sapien
cactaagaaacacaatggaaatggartatatgatttggctggctggcttg

SEQ ID NO: 84142 - DNA, 50 bp, homo sapien
tgatctatttattattatatagttaycttcttcgtctccttttactgttt

SEQ ID NO: 84143 - DNA, 50 bp, homo sapien
acacaaaaatatttagcaagaagggwattaaatgcagcattgtccatgtg

SEQ ID NO: 84144 - DNA, 50 bp, homo sapien
tctttctgcttcaacaatgtatataycaaaagaactttcacattccagcc

SEQ ID NO: 84145 - DNA, 50 bp, homo sapien
aaacgtaaaggaggaggttatgaaargtgcctttaagcaaatcagtaaag

SEQ ID NO: 84146 - DNA, 50 bp, homo sapien
aggactggtatagttacattgatccrctacttgccattccctgcagcagc

SEQ ID NO: 84147 - DNA, 50 bp, homo sapien
ttttcatctgccttttatctgaggcratgccaatggttttacagtacgca

SEQ ID NO: 84148 - DNA, 50 bp, homo sapien
ccttcatcaggacaaaaataatgtcytggaatttgttagatctttattaa

SEQ ID NO: 84149 - DNA, 50 bp, homo sapien
acccaaccatttcaagtgagatgcarattcaacatttacatgttatgtat

SEQ ID NO: 84150 - DNA, 50 bp, homo sapien
ttgtttgagagtcagagaatcataakctaactatacaggtgttgataaca

SEQ ID NO: 84151 - DNA, 50 bp, homo sapien
gtcccatttgatcgtccatggcaacrgtaatttttattagttagtatact

SEQ ID NO: 84152 - DNA, 50 bp, homo sapien
aacacacatctagaggcctttaggcycaggctgaatctacactccctccc

SEQ ID NO: 84153 - DNA, 50 bp, homo sapien
aagaataagaatccatgtcataggakagttgaaatcaaataggaaaaatt

SEQ ID NO: 84154 - DNA, 50 bp, homo sapien
agaaaaatacagtaactccttagcasggtgttaagaagcatgaaggatga

SEQ ID NO: 84155 - DNA, 50 bp, homo sapien
gcttggttcaaatctgctccatccayaggttcctgtcctcaggattcttc

SEQ ID NO: 84156 - DNA, 50 bp, homo sapien
gcatctactttagggacaaaagtcarcatgaggaacttgttaaatgatta

SEQ ID NO: 84157 - DNA, 50 bp, homo sapien
ctcaacaaatgacctgtggtttacayctgtaataatacacaagctgaaca

SEQ ID NO: 84158 - DNA, 50 bp, homo sapien
cccaggcgctggggacctccagtcaygatgaaatgttaggctgtcttaat

SEQ ID NO: 84159 - DNA, 50 bp, homo sapien
tgagccacaggcctttaaacctacaratgacaaggggccaaagtttcgat

SEQ ID NO: 84160 - DNA, 50 bp, homo sapien
gctcccagtgacatctctcttcaccratttgcccaagtcagtttgctgag

SEQ ID NO: 84161 - DNA, 50 bp, homo sapien
ggttattcctcattcctcatcacaasttattcctgaacatttggaaactg

SEQ ID NO: 84162 - DNA, 50 bp, homo sapien
cataatggactgtcaactcaaagaastggctccaagataggaactgcatg

SEQ ID NO: 84163 - DNA, 50 bp, homo sapien
gggcctctcgagagtctctttttacraactgtgcttatcccatttatgag

SEQ ID NO: 84164 - DNA, 50 bp, homo sapien
cagggcaaagggatctttgtcttgcrcattctttaatgaaggttatttgg

SEQ ID NO: 84165 - DNA, 50 bp, homo sapien
gtccctttccaaggccactctattaygtatgagtcttcctttgttctctt

SEQ ID NO: 84166 - DNA, 50 bp, homo sapien
gcattcacaactacaaatccccttayacagaacttgacctgcagtggtat

SEQ ID NO: 84167 - DNA, 50 bp, homo sapien
tcttctagagagttagggagaaaggycatatacacacttaaaacactttt

SEQ ID NO: 84168 - DNA, 50 bp, homo sapien
atcctaggaagaggagtgagggaaakaactttgagagtgacttagggaaa

SEQ ID NO: 84169 - DNA, 50 bp, homo sapien
ttccttgtctgagaaaagtgaatacycataaagtgatccccatgcctacc

SEQ ID NO: 84170 - DNA, 50 bp, homo sapien
gtgtactaataaacgttctcagtaayaccagaaaatcaaattcaattata

SEQ ID NO: 84171 - DNA, 50 bp, homo sapien
agtgcaagaatttaggacctggcctygatactaaattctgcttcagggaa

SEQ ID NO: 84172 - DNA, 50 bp, homo sapien
ctaccacctggccttgtatgtaaaaytttaggcatgtgtgcatttttctg

SEQ ID NO: 84173 - DNA, 50 bp, homo sapien
aactttgcttcatagctagagaccargaccttttaaaatttgtagtagag

SEQ ID NO: 84174 - DNA, 50 bp, homo sapien
agctgctgggccacctcctagggaamcatagatgacgttggaccctaaat

SEQ ID NO: 84175 - DNA, 50 bp, homo sapien
gagagatctttgttggataatctaayaggttgcatttcctgcataaatgt

SEQ ID NO: 84176 - DNA, 50 bp, homo sapien
ataccctgtttaaaatatgcataaaytcatctaataaaataaggaaggga

SEQ ID NO: 84177 - DNA, 50 bp, homo sapien
tacctattatgtgtcacacaatgtcraaatggagccaaaggctcaaatca

SEQ ID NO: 84178 - DNA, 50 bp, homo sapien
tctctaaagcaaacaaataaaggtcsaattatttttccagcaatctgagt

SEQ ID NO: 84179 - DNA, 50 bp, homo sapien
gtcatatttcagaatacttaagttaraagaatctctcaaaatgaaagagc

SEQ ID NO: 84180 - DNA, 50 bp, homo sapien
cagtacaaagtcaaagtgcaatatayagtaaaagagggattggtcaaatt

SEQ ID NO: 84181 - DNA, 50 bp, homo sapien
aacttgattcaactttgctgttaacrcaattcctctggattactaaaaat

SEQ ID NO: 84182 - DNA, 50 bp, homo sapien
ttgccttttatttccaaattctttarcccttgactttgctgagagtctat

SEQ ID NO: 84183 - DNA, 50 bp, homo sapien
gtgaagtgctagcacaaaggcattayatacatgctggtgggattcaaagc

SEQ ID NO: 84184 - DNA, 50 bp, homo sapien
aaaatcctatagttctgcgttcaacsgcttagtctctcaaaaaggcattg

SEQ ID NO: 84185 - DNA, 50 bp, homo sapien
attggaaaacaaaaatctttgatggwcacttaaaaatactaggaatcttt

SEQ ID NO: 84186 - DNA, 50 bp, homo sapien
tgggaactgctcagtgaatgggaaayggaattaaatatatctattagttt

SEQ ID NO: 84187 - DNA, 50 bp, homo sapien
agggtgcctagcctgcagaagatgamaatatactgaaaattctcactaat

SEQ ID NO: 84188 - DNA, 50 bp, homo sapien
ggaattattttgtcttgagtaacaasagtaagatggcactgatagtctga

SEQ ID NO: 84189 - DNA, 50 bp, homo sapien
tcatataagtgtaggtgctttaggcmttccctggttgatggacatttggg

SEQ ID NO: 84190 - DNA, 50 bp, homo sapien
acctttagttcacaggattcttacayaggactctttttagctccctatag

SEQ ID NO: 84191 - DNA, 50 bp, homo sapien
agagtggcctaagcacactaatttaygtgagttttatattttcttaagac

SEQ ID NO: 84192 - DNA, 50 bp, homo sapien
gctgccctagttcatgttctcagaaygttaccacactttatattttcaaa

SEQ ID NO: 84193 - DNA, 50 bp, homo sapien
tatcctttttcatttataattcaccractacatgaagtactctgcatttc

SEQ ID NO: 84194 - DNA, 50 bp, homo sapien
gtaattcagtttaatgatgacaaackctgcttttgtaatttcaattttct

SEQ ID NO: 84195 - DNA, 50 bp, homo sapien
tttctcaccacttaaccaccactaaygatgtgtttattgtaaacttttta

SEQ ID NO: 84196 - DNA, 50 bp, homo sapien
agttttagatttggtttcaaagatasaaggaatcagagaaaatgtagatg

SEQ ID NO: 84197 - DNA, 50 bp, homo sapien
taattagccttctacaatataaacaragagagtgtatttgactaagtaag

SEQ ID NO: 84198 - DNA, 50 bp, homo sapien
atgtgaagtctgttgaagacactacrctctaaactgcttatgtggggacc

SEQ ID NO: 84199 - DNA, 50 bp, homo sapien
ttgacacatcgttttgttgagcaaartaaggatatgattcgagtccacaa

SEQ ID NO: 84200 - DNA, 50 bp, homo sapien
caagcaaggaagaaaactgaataaayggaagaaactattcccaagaagag

SEQ ID NO: 84201 - DNA, 50 bp, homo sapien
taaaagtagactggacacagaaactraaatttattgacttcaaataaggt

SEQ ID NO: 84202 - DNA, 50 bp, homo sapien
ttttgaaattcgtatggaatattacwaatgcaatgttagtcaaaaccact

SEQ ID NO: 84203 - DNA, 50 bp, homo sapien
taaaataaaacctttcactggaaaaygttctcatccttcccaaagaactc

SEQ ID NO: 84204 - DNA, 50 bp, homo sapien
tagcaaatccactggcaacctctaaygtacgtgcctaagcgggacaccca

SEQ ID NO: 84205 - DNA, 50 bp, homo sapien
tacctcactggattttttatgaggcrcatgtgggacaatatgtttagcaa

SEQ ID NO: 84206 - DNA, 50 bp, homo sapien
caggcaaaaacctctcatgaagaagyaaggctcagcttaaaaacacatgt

SEQ ID NO: 84207 - DNA, 50 bp, homo sapien
agaaatgcaaagctttggagaaggaycaagttaacgttattttataatag

SEQ ID NO: 84208 - DNA, 50 bp, homo sapien
agtctagatcatttggaatttgatgycaaataactcctccaagatagtct

SEQ ID NO: 84209 - DNA, 50 bp, homo sapien
atctatggctaggttcttagacatarcactataaccatgatccatgaaaa

SEQ ID NO: 84210 - DNA, 50 bp, homo sapien
atttaccaatgaaaaaatagaggccrcagctctgctttaagccagctagt

SEQ ID NO: 84211 - DNA, 50 bp, homo sapien
aactgccctccataaccccagattcsatatttttgtgttcaccaaaagtc

SEQ ID NO: 84212 - DNA, 50 bp, homo sapien
ttccctcttatatttcagttggaagkcccaggcactagattgggcagcat

SEQ ID NO: 84213 - DNA, 50 bp, homo sapien
ctttcatctagatttgctatgtaacrcttctttgttagttgaataagaaa

SEQ ID NO: 84214 - DNA, 50 bp, homo sapien
actcaagcatctgtcaacagactaayggaaaattaatgcctggaccatgg

SEQ ID NO: 84215 - DNA, 50 bp, homo sapien
ggtacaggcttgttagtagtgttgaycttttcaaagaactggcttttgat

SEQ ID NO: 84216 - DNA, 50 bp, homo sapien
tcgacttagtatgcattttgaattayagtttaaaagatgatattatgact

SEQ ID NO: 84217 - DNA, 50 bp, homo sapien
agtgcacattcactcaattcaatacracacaatcattaaagatgaacttt

SEQ ID NO: 84218 - DNA, 50 bp, homo sapien
tagtatttcagttagtaatataccayaagttaattttgctgtttcccaca

SEQ ID NO: 84219 - DNA, 50 bp, homo sapien
ttcccactgttgaagatgtatataakccatgacttttgtaatcagatgac

SEQ ID NO: 84220 - DNA, 50 bp, homo sapien
aaaagcaatctattttttctaaataygctccattatttccaaatagttcc

SEQ ID NO: 84221 - DNA, 50 bp, homo sapien
tctacattaggatcttgcattcccaygtgcaccgagtacagaccaggtcc

SEQ ID NO: 84222 - DNA, 50 bp, homo sapien
ttttaatagttcaatttccacttgtyaaaggtatctgatgtcagcaactt

SEQ ID NO: 84223 - DNA, 50 bp, homo sapien
ggaaaaaggcaagtgcaagtaagtartacagtgaagtttaagagcatttg

SEQ ID NO: 84224 - DNA, 50 bp, homo sapien
ctgataagagccaagagagttattargctaactgaagctaggatgcccag

SEQ ID NO: 84225 - DNA, 50 bp, homo sapien
gcacttaccagtctgaaacagattasaaattcagtcaaacgggccctccg

SEQ ID NO: 84226 - DNA, 50 bp, homo sapien
aaaagagagtggagtttgttaatgaytagaaaagaaagaaaaagtaaata

SEQ ID NO: 84227 - DNA, 50 bp, homo sapien
agaagcataaaagtaaagattgaaasccacattttagaatcagatgatgg

SEQ ID NO: 84228 - DNA, 50 bp, homo sapien
ctggaattgtgactctcagacatctkactggtaaacctggactcattgtt

SEQ ID NO: 84229 - DNA, 50 bp, homo sapien
tactctcaacatgccaacttggccaytaatcttcaccacctggcgtggtt

SEQ ID NO: 84230 - DNA, 50 bp, homo sapien
agtgtggccatgtggcctaaccaatraaatgaaggtggaagtgattgttg

SEQ ID NO: 84231 - DNA, 50 bp, homo sapien
aagatggctgtagactgttggagtcrattgccaataaatggaagaagctg

SEQ ID NO: 84232 - DNA, 50 bp, homo sapien
tgaggaaggatggctaaactcacaaygagaagcccagagtcagctggcat

SEQ ID NO: 84233 - DNA, 50 bp, homo sapien
tggttctaagcttcactttcttaccrtacacgacagggttgtggctaaag

SEQ ID NO: 84234 - DNA, 50 bp, homo sapien
atggtaagaaagtgaagcttagaacyaaggttgtaagggcaaggagatct

SEQ ID NO: 84235 - DNA, 50 bp, homo sapien
caaattcaggggtgaggtatataggraacatgcagtccttagggctgtgc

SEQ ID NO: 84236 - DNA, 50 bp, homo sapien
tgatcactcacacaaaatagattaaygaatcagctaacaaaagaaaactt

SEQ ID NO: 84237 - DNA, 50 bp, homo sapien
tcatccatacaaacactgatgtaaaygtacaaaattcaggggtgagggta

SEQ ID NO: 84238 - DNA, 50 bp, homo sapien
ggatggctcatatctacagaaaagcrctggatactaggaaggaaacaatt

SEQ ID NO: 84239 - DNA, 50 bp, homo sapien
agattctgtcatcattcacaagatayacattgcctgaacctttgatccat

SEQ ID NO: 84240 - DNA, 50 bp, homo sapien
ttgttatgaaggtaggaacagggaakgtagtagctagaagtaaaagtgga

SEQ ID NO: 84241 - DNA, 50 bp, homo sapien
aagatgctcttttatttccagtcaaragaataaattatgtgtctactctt

SEQ ID NO: 84242 - DNA, 50 bp, homo sapien
aaaagcgtattgcttaaatttgaccragcttttcctaaatcctatcagtt

SEQ ID NO: 84243 - DNA, 50 bp, homo sapien
tagggagttgcttctcagctggtagkaaattacaattatgcaggaagaat

SEQ ID NO: 84244 - DNA, 50 bp, homo sapien
tttttgaagggcttttatagaaaaartaggtaaatttcatgtagtctgta

SEQ ID NO: 84245 - DNA, 50 bp, homo sapien
tcccctattaaaaataaacattcccraaatcaaatctttacatagcttct

SEQ ID NO: 84246 - DNA, 50 bp, homo sapien
aaccaaagaccttgaagatcagtaaygtaggataaacctccaggactcat

SEQ ID NO: 84247 - DNA, 50 bp, homo sapien
ttggaagaccaggctccttaaatacragtcctagcaaaagaatgaacttg

SEQ ID NO: 84248 - DNA, 50 bp, homo sapien
actgacatgcatcacaggcaaagcamccagaagaggtgacaacattcctc

SEQ ID NO: 84249 - DNA, 50 bp, homo sapien
accatgggctttggcaagattgttarctgaggaatgttgtcacctcttct

SEQ ID NO: 84250 - DNA, 50 bp, homo sapien
acactatatctagattttgaggttgyaatagggttccatcaaatgaaatt

SEQ ID NO: 84251 - DNA, 50 bp, homo sapien
actgggagaagatacgtataccttayggaccaggcattttggaggccatt

SEQ ID NO: 84252 - DNA, 50 bp, homo sapien
ttagcaaaatgggtgctgtaaaaccrggattcccatgtattgctaatata

SEQ ID NO: 84253 - DNA, 50 bp, homo sapien
tgctctccttcacatactcatatttwaaaaaaaacacaaacaaaaggttt

SEQ ID NO: 84254 - DNA, 50 bp, homo sapien
gacttgagaaaatttaaaatatagcrctaaaagggaaaagaccttcccca

SEQ ID NO: 84255 - DNA, 50 bp, homo sapien
aaaagaccttccccaataaattatckcacacattttgagacagaaggaat

SEQ ID NO: 84256 - DNA, 50 bp, homo sapien
gagagtcaatggggacagagtctcartgaagtccaaaagtgttgcagagg

SEQ ID NO: 84257 - DNA, 50 bp, homo sapien
aatttatgactgcgtttgtgaattarctatctgcaacaatgtaatatgaa

SEQ ID NO: 84258 - DNA, 50 bp, homo sapien
caaaactgtctgcaagacttgtaaayggaaagatgaaaatggaaaatgaa

SEQ ID NO: 84259 - DNA, 50 bp, homo sapien
ccaccacagattcccatgatgataartagtatgctctttgtcttcaccag

SEQ ID NO: 84260 - DNA, 50 bp, homo sapien
agatttctagaagtcaaaagtataaytccacacaaaaagatgttaattag

SEQ ID NO: 84261 - DNA, 50 bp, homo sapien
aagagctagaagaggtctggaaaaasagaatgagaaagacagaaaggcat

SEQ ID NO: 84262 - DNA, 50 bp, homo sapien
catttccattcaaagaaccccctcargctctcttctagtactgatctggt

SEQ ID NO: 84263 - DNA, 50 bp, homo sapien
tcaaaatacaattgaaagccttaacmatagattagaccaagcagaagaaa

SEQ ID NO: 84264 - DNA, 50 bp, homo sapien
attgaatgtatacaatgaatatagakagattacatataacataaatgtag

SEQ ID NO: 84265 - DNA, 50 bp, homo sapien
ttatgccactttcctcaagttgatcraaattgtgaaagtcaggggctttg

SEQ ID NO: 84266 - DNA, 50 bp, homo sapien
tttatttacttacttgcttacttaaytatcatgtatcttctatcagaata

SEQ ID NO: 84267 - DNA, 50 bp, homo sapien
tcaagctttgcatcttaccattcctraagacatccttgatcatatttagc

SEQ ID NO: 84268 - DNA, 50 bp, homo sapien
gtttttatttagtggatgactattargaacctgcaatgtgataagtgctt

SEQ ID NO: 84269 - DNA, 50 bp, homo sapien
tctaaaagtctagactgattgttccrgacctacatttatcttcttcacac

SEQ ID NO: 84270 - DNA, 50 bp, homo sapien
aaagataaaaatacccagtgagaacmatttattaaactcagtgggcacaa

SEQ ID NO: 84271 - DNA, 50 bp, homo sapien
agctctgctccttactaattcaaagytgtagtttttgtgactagactaag

SEQ ID NO: 84272 - DNA, 50 bp, homo sapien
tacagaaaaaaaggcaaccacattgraaggatattgatgaagtataagtg

SEQ ID NO: 84273 - DNA, 50 bp, homo sapien
cgtgtgcataattgaatgttctttargttgatgatcagagtaaacctctc

SEQ ID NO: 84274 - DNA, 50 bp, homo sapien
acttgtggtcatgtgacaaggtccamctaatagaatgtgagaagagatgt

SEQ ID NO: 84275 - DNA, 50 bp, homo sapien
ttgtatgtttcttgtgggttcatgaygtcaaaataaagtatttcctgtgt

SEQ ID NO: 84276 - DNA, 50 bp, homo sapien
tgttccaggaatgtgggaaaaaacaytgcactgcgtgctgcttaagatta

SEQ ID NO: 84277 - DNA, 50 bp, homo sapien
tcatatttctaattgaggcacattargtgttttagagagactattttaag

SEQ ID NO: 84278 - DNA, 50 bp, homo sapien
cttgaatcctgctctctaggaaaacraaattcagaaaagtaagaagaaat

SEQ ID NO: 84279 - DNA, 50 bp, homo sapien
taaaagtgttctggatatctgacctmaaaaataattggattccgatggtc

SEQ ID NO: 84280 - DNA, 50 bp, homo sapien
tgacaaattaaatatcacttcaataragtcagaatatggtgagtatatta

SEQ ID NO: 84281 - DNA, 50 bp, homo sapien
tgtagagataatgtcgcatcattccrcattccttttcttcttgtctcaaa

SEQ ID NO: 84282 - DNA, 50 bp, homo sapien
attcgcttgggtgcccatatatgaartgacatactccacaaacttggcat

SEQ ID NO: 84283 - DNA, 50 bp, homo sapien
ataactttctcttttgtctacttaaygtatgcctactcaagctaacagcc

SEQ ID NO: 84284 - DNA, 50 bp, homo sapien
atctagaaacagaggaaaagagtgamgtgcgagctttattcgcaatgtct

SEQ ID NO: 84285 - DNA, 50 bp, homo sapien
cataaagattagctgtaaaagtatcyaataacaccatataaggttaaact

SEQ ID NO: 84286 - DNA, 50 bp, homo sapien
caatgttttatgtagattttgcttcratagtactttaacttgggtgatac

SEQ ID NO: 84287 - DNA, 50 bp, homo sapien
ttctgttcatttcaaactatacttaygttgttcattagaaagaaagctaa

SEQ ID NO: 84288 - DNA, 50 bp, homo sapien
tgactcaaacagtaaacctatataamgtcttgaaatcttgtatttttttt

SEQ ID NO: 84289 - DNA, 50 bp, homo sapien
ggaataaaggaaactgaggctagcamgcaaaacacctcagtcatcacttt

SEQ ID NO: 84290 - DNA, 50 bp, homo sapien
ttaaatttgaggtgtctgtagggcakccttgagtaaatgtgtaatgataa

SEQ ID NO: 84291 - DNA, 50 bp, homo sapien
gatccaatcgaatagctaacaaaacrcttgtctttattatgtatattaaa

SEQ ID NO: 84292 - DNA, 50 bp, homo sapien
ttattccattattacatgccaatackacatacttttcatatatcctttta

SEQ ID NO: 84293 - DNA, 50 bp, homo sapien
tgtcttttttctttttcactcacaakattttaaccacagttaagcatgac

SEQ ID NO: 84294 - DNA, 50 bp, homo sapien
aataggaaagcatttcatggagacarggaattttagaaccaggattctta

SEQ ID NO: 84295 - DNA, 50 bp, homo sapien
tttaaaaagtactccaccagattgamaggaagtccacattttaattatca

SEQ ID NO: 84296 - DNA, 50 bp, homo sapien
gtgatttcataaacctgaattaaaasttgaaaattttcagcttctcattg

SEQ ID NO: 84297 - DNA, 50 bp, homo sapien
gaaaaaaatttagacacaattaaagraactatagaaaatcatcttaaatt

SEQ ID NO: 84298 - DNA, 50 bp, homo sapien
ctgatagaaataatgaggtataacasggttaagtgattgttgactatatt

SEQ ID NO: 84299 - DNA, 50 bp, homo sapien
caaggatcccagagagctgctccagmacaaaggaattagactaagggaag

SEQ ID NO: 84300 - DNA, 50 bp, homo sapien
acatttccttataataggggtatackcgagttatgatagaaacagggaag

SEQ ID NO: 84301 - DNA, 50 bp, homo sapien
ccaactagcagaaggagaaaaatackgaagatatattgacataactggat

SEQ ID NO: 84302 - DNA, 50 bp, homo sapien
agaagcaataaattataatggcttamacttatattatgctttcccagatg

SEQ ID NO: 84303 - DNA, 50 bp, homo sapien
ggaagtttccttaaaattggacacaratacatatatacacgtgtgcatgt

SEQ ID NO: 84304 - DNA, 50 bp, homo sapien
atttaagatgaaaatatcactttacyataactacggatatttaagaaagg

SEQ ID NO: 84305 - DNA, 50 bp, homo sapien
aaatattttccactcatgaacaaatwagtctagctgttgagatttaagca

SEQ ID NO: 84306 - DNA, 50 bp, homo sapien
atatgtcttcagatcatcaatttccrctactcagtcattatcaagatcaa

SEQ ID NO: 84307 - DNA, 50 bp, homo sapien
atgcttccaaagacgacatgttttaycttatgtgtagcttaccctaaaca

SEQ ID NO: 84308 - DNA, 50 bp, homo sapien
caggtaacaatgaaggagaaagtcartagcctctaataaaacaccaaact

SEQ ID NO: 84309 - DNA, 50 bp, homo sapien
agaatctgctacaatatgtttctccratgagtcaggcctgtttagggtaa

SEQ ID NO: 84310 - DNA, 50 bp, homo sapien
ttcaattccttcctgcatgttatgartactccggagatagtttatcttgg

SEQ ID NO: 84311 - DNA, 50 bp, homo sapien
taactaacaactccagttaggttacycaatcagaaggactgtgtactaaa

SEQ ID NO: 84312 - DNA, 50 bp, homo sapien
gtcctatctagaacttctaataacakaatgtaaatcactgctgtccagta

SEQ ID NO: 84313 - DNA, 50 bp, homo sapien
catactttaagattctattttaaacscacaattcatggaagtagaacata

SEQ ID NO: 84314 - DNA, 50 bp, homo sapien
ctaagttatacatgaagatttctaamgtaccattaacctgattttaagtg

SEQ ID NO: 84315 - DNA, 50 bp, homo sapien
ttaaatatttctatctgtatagtggragatagtatcaggatatttttata

SEQ ID NO: 84316 - DNA, 50 bp, homo sapien
ataaaagtaaaacacttttggtaccratttcatcaatagtaaattattca

SEQ ID NO: 84317 - DNA, 50 bp, homo sapien
tctagatgaatctttctacatcctaycacttgtacttttatttagcatat

SEQ ID NO: 84318 - DNA, 50 bp, homo sapien
caatgtttataaatcatagtagcaaracacatatgctaaataaaagtaca

SEQ ID NO: 84319 - DNA, 50 bp, homo sapien
attggatattactataatacagtcawcatgctaagccaattttatttatt

SEQ ID NO: 84320 - DNA, 50 bp, homo sapien
tctgtttttaaagtaactaggtagcrataatcagaggaagtgcaaaactg

SEQ ID NO: 84321 - DNA, 50 bp, homo sapien
attgtattatgattcaatttaatcaygttttgtgttggaacccctcccca

SEQ ID NO: 84322 - DNA, 50 bp, homo sapien
aactgattgaaatgtacattttctcracctcctctgtttgggaaaactgc

SEQ ID NO: 84323 - DNA, 50 bp, homo sapien
tggaagctacctgatttctctattamattaggataaatgtacagtgcaaa

SEQ ID NO: 84324 - DNA, 50 bp, homo sapien
tttaaactaaactaaacagactaaayggattaaaaattaattataaaatc

SEQ ID NO: 84325 - DNA, 50 bp, homo sapien
tatccaagctattccaagatgattaygatctttcttgtcttatgtatgag

SEQ ID NO: 84326 - DNA, 50 bp, homo sapien
tggaggaagccatttcgagtggaatsaacagcaaatgatatactttgatt

SEQ ID NO: 84327 - DNA, 50 bp, homo sapien
gaaatgataattaaaatatatattaygatgttactgattatccctttgta

SEQ ID NO: 84328 - DNA, 50 bp, homo sapien
gaaagaagattaaaaatgtcaaaaamggtgctagactgtgaagatgatat

SEQ ID NO: 84329 - DNA, 50 bp, homo sapien
tgatagtaaatccttcactgctttckattgaaggttctattctgtagtga

SEQ ID NO: 84330 - DNA, 50 bp, homo sapien
gaagactgatggcttagaacatttargtagatgtatttgaaggtccttga

SEQ ID NO: 84331 - DNA, 50 bp, homo sapien
ggggctcaacagtttctactttcaaygaggcattcaattggcattagtcc

SEQ ID NO: 84332 - DNA, 50 bp, homo sapien
cataaaaatgtgaatgccctcatctmaaaggaatatatgaataataaatt

SEQ ID NO: 84333 - DNA, 50 bp, homo sapien
gctttagaaatacaatttccatgttsctataaaaatggggttaaaagtca

SEQ ID NO: 84334 - DNA, 50 bp, homo sapien
actctgttattttccactctaaacaytgtactacttcttttttaaataaa

SEQ ID NO: 84335 - DNA, 50 bp, homo sapien
actgagatataaaggataagaaaaaygttgataagtaggaatagagggtg

SEQ ID NO: 84336 - DNA, 50 bp, homo sapien
gtagtgaaacgaatgtgacaaggaaygaacagatgtttagtccaactcca

SEQ ID NO: 84337 - DNA, 50 bp, homo sapien
ttttcagacattggacaacgtgcaayataggactctgattcttgaaagaa

SEQ ID NO: 84338 - DNA, 50 bp, homo sapien
tgttgtgggtatgcaaacattcagaygatagtaccttatctctaaataca

SEQ ID NO: 84339 - DNA, 50 bp, homo sapien
cagttcaaacatattaaaaatgctayggtaacaaattatcattgaagttt

SEQ ID NO: 84340 - DNA, 50 bp, homo sapien
aatggtggaaaagagtaacttctaayatgtcagaggaagtagaaattagc

SEQ ID NO: 84341 - DNA, 50 bp, homo sapien
cattaatcagtagtagaattagatgratctagtaaatttactgagaattt

SEQ ID NO: 84342 - DNA, 50 bp, homo sapien
aaacacctggcaggtttcttgacackgaattggtgcttggcataccattg

SEQ ID NO: 84343 - DNA, 50 bp, homo sapien
aaaccaaagtatattttcatgaatcraatgttcaaatagtaagatttaag

SEQ ID NO: 84344 - DNA, 50 bp, homo sapien
tttttacctatttatccaaatgtcartaatcagttggaaattaactcatg

SEQ ID NO: 84345 - DNA, 50 bp, homo sapien
gattctatgaatatttagtgctttaygtaggagctgacctactttcccat

SEQ ID NO: 84346 - DNA, 50 bp, homo sapien
tttaggactttgccaggtggactgaygctgatttccaagattgtctggcc

SEQ ID NO: 84347 - DNA, 50 bp, homo sapien
gtctgtgacagatgctttattcaaaygactggttggggtgctttctggct

SEQ ID NO: 84348 - DNA, 50 bp, homo sapien
gccaaaataaacagaaacaatgaccrcagaagaaggaaagagagcaggta

SEQ ID NO: 84349 - DNA, 50 bp, homo sapien
acacagacaaatgagtcttccccaaraaatagtcaactagtgaaatgctt

SEQ ID NO: 84350 - DNA, 50 bp, homo sapien
atcaaaaagatttaaaatagcagtcmaaaaaatcaagacagaagtaaaca

SEQ ID NO: 84351 - DNA, 50 bp, homo sapien
aagaaataaatatacacaatcaaccrctggaccaaaggctttctcaaggg

SEQ ID NO: 84352 - DNA, 50 bp, homo sapien
catgttattttcttcatttgtcaaarttattgggatgtagcaaatacttg

SEQ ID NO: 84353 - DNA, 50 bp, homo sapien
tatttagactttactagtgaaatacyggtaccttcattcacagcatattt

SEQ ID NO: 84354 - DNA, 50 bp, homo sapien
agtatatcttgaaaatgagagttgartatttggaaaatgttaattctatc

SEQ ID NO: 84355 - DNA, 50 bp, homo sapien
aacatccgtggtaagtaataagagtsacaaccactattcttcccagttat

SEQ ID NO: 84356 - DNA, 50 bp, homo sapien
gcatttttgattgttgctatacttayctacttgcttaaagatactttaaa

SEQ ID NO: 84357 - DNA, 50 bp, homo sapien
gctgtacttccttgtaagaatgtackggcattgaagcactgacactgaac

SEQ ID NO: 84358 - DNA, 50 bp, homo sapien
aaggtatagctagataaaatgtcacraaataaatcagaaacattttctaa

SEQ ID NO: 84359 - DNA, 50 bp, homo sapien
attagtgttctgagtctctgattaayatagttgtctaccaacaggaccat

SEQ ID NO: 84360 - DNA, 50 bp, homo sapien
tgttttcattttttagtagctttgasgatatacacaaacacagtcttaaa

SEQ ID NO: 84361 - DNA, 50 bp, homo sapien
ttttttttcaattatagagacatccragaaagttatatttcaccgaactg

SEQ ID NO: 84362 - DNA, 50 bp, homo sapien
tctgggctgtagaccttcaaatagaygcaaacatgcaaagcttttaaaag

SEQ ID NO: 84363 - DNA, 50 bp, homo sapien
ttttataggctgagataactagcaamttattgccaaggtactagtacaat

SEQ ID NO: 84364 - DNA, 50 bp, homo sapien
ctgttagttagatgtgagaataaagmaatcactctaaatttcctgacatc

SEQ ID NO: 84365 - DNA, 50 bp, homo sapien
ttcatatgtacatgaataagtaagcycttgttaacatgtgtgatacatag

SEQ ID NO: 84366 - DNA, 50 bp, homo sapien
tcatctcgcttatctttcatctggcygaatgattgactgagagtcccatc

SEQ ID NO: 84367 - DNA, 50 bp, homo sapien
atttttggaataataatgcagaaagwctcacaaaactggagttcctcgtt

SEQ ID NO: 84368 - DNA, 50 bp, homo sapien
gaaagtcaagccatgaaacagtggcrcatgaagaagacatacaggtgaaa

SEQ ID NO: 84369 - DNA, 50 bp, homo sapien
aacttgtcattgacacaatgcacacratcttattttgaggctccttacat

SEQ ID NO: 84370 - DNA, 50 bp, homo sapien
ggcctgtataattatacggctgacawtggatttattcaaatgctaatctt

SEQ ID NO: 84371 - DNA, 50 bp, homo sapien
ggacatttatttgtaatttgaaagawacatttgaggtgaatatcatactt

SEQ ID NO: 84372 - DNA, 50 bp, homo sapien
taataatccttacttttgctatccaytgaattgttaccatcagattattc

SEQ ID NO: 84373 - DNA, 50 bp, homo sapien
tcatttataattttggaattattcaygtttttcttctcatgttggtatac

SEQ ID NO: 84374 - DNA, 50 bp, homo sapien
ttatctcagttttgtaaatatccaamctgagagtaaagaaagaaaacaaa

SEQ ID NO: 84375 - DNA, 50 bp, homo sapien
actatttaagtgaaaataccaaataygatttcagtgtgaaatatcctcga

SEQ ID NO: 84376 - DNA, 50 bp, homo sapien
ggattattcttgacctgaatgtcaamaattctaatatgggtagttatttt

SEQ ID NO: 84377 - DNA, 50 bp, homo sapien
tatacaactcaatcataactctttayatgttgtagtgtaactgttttctt

SEQ ID NO: 84378 - DNA, 50 bp, homo sapien
agctgaatgaatcattgcaggtataragatagtggcatttaaaatataca

SEQ ID NO: 84379 - DNA, 50 bp, homo sapien
tcttcttagtcctaacaccagataayggaacatgtctatcaaggcaatct

SEQ ID NO: 84380 - DNA, 50 bp, homo sapien
actcaggtttgtatgactagtaaatragaaatgggaaaaaaaatataaaa

SEQ ID NO: 84381 - DNA, 50 bp, homo sapien
ggtcctcattgtaaccataatttctsaaggaagaatatcacccatataga

SEQ ID NO: 84382 - DNA, 50 bp, homo sapien
cagtttctatttatgacagtggacaygatacttgaatcattgtgtcattt

SEQ ID NO: 84383 - DNA, 50 bp, homo sapien
aaaaggtaaacagaagaatcatatastacagaatgcacttttttccaatt

SEQ ID NO: 84384 - DNA, 50 bp, homo sapien
tgataagacagaaaataccagagaartaaagttagaattaaatacagaga

SEQ ID NO: 84385 - DNA, 50 bp, homo sapien
atttgccaattgagaaagaattttaraacattgtactcagtaacaatatg

SEQ ID NO: 84386 - DNA, 50 bp, homo sapien
tttagaaaatgtaaggtttgtgccamatattaatagctttatgcaaggta

SEQ ID NO: 84387 - DNA, 50 bp, homo sapien
cttaaaaaaatcaatactataactargacttcaaccaaatgggttctgaa

SEQ ID NO: 84388 - DNA, 50 bp, homo sapien
ttagaagtatttatgctttccttgarcgtgtttatattgtgcaacaaaaa

SEQ ID NO: 84389 - DNA, 50 bp, homo sapien
agtgtgttcgtttggatataagctgraattaaatggatcttgagtgacaa

SEQ ID NO: 84390 - DNA, 50 bp, homo sapien
agccacccgtaacctactgcaattcrctgtaaatagattccaaatatttg

SEQ ID NO: 84391 - DNA, 50 bp, homo sapien
tttactatgatagacaacatataaakggtagtatctctgtgggataagta

SEQ ID NO: 84392 - DNA, 50 bp, homo sapien
actatatgtaatacaagctgacaagraaaaagcatttcaaatgaggctac

SEQ ID NO: 84393 - DNA, 50 bp, homo sapien
tacagtgctcagcttcagtttcttayagaatggtcaaatgatatttatga

SEQ ID NO: 84394 - DNA, 50 bp, homo sapien
ataaatgctactaaattactgattcraggcaaggacatgaagcctgattt

SEQ ID NO: 84395 - DNA, 50 bp, homo sapien
tataggggcttaagatttttagacgrtaaagtgctaggagactcctcacc

SEQ ID NO: 84396 - DNA, 50 bp, homo sapien
tgtgaaacaacaagctataaaccaamgaagcatctacagagcatactcaa

SEQ ID NO: 84397 - DNA, 50 bp, homo sapien
ccctgtctttaataaaattacaaaarttagtcctgcatggtggcacatga

SEQ ID NO: 84398 - DNA, 50 bp, homo sapien
ttcttttgaatgatttgctttttacmcttactgctctgttttcttatctg

SEQ ID NO: 84399 - DNA, 50 bp, homo sapien
agtcaataatgtacctagccatcaakgtatattttaaatgccactatctt

SEQ ID NO: 84400 - DNA, 50 bp, homo sapien
gatcattacacaccaccaccgtgaartataaaaaggcacttagcattttt

SEQ ID NO: 84401 - DNA, 50 bp, homo sapien
ggtaaattgaatagcatttctcctcmattgcaggacaaacaactccatct

SEQ ID NO: 84402 - DNA, 50 bp, homo sapien
ctgggtgccagtaacactatgctacratgtgcagagagggaaatgaaggc

SEQ ID NO: 84403 - DNA, 50 bp, homo sapien
agtaagaacacgacgtattcctgagrctagaactttgattgtaactttta

SEQ ID NO: 84404 - DNA, 50 bp, homo sapien
atgataaagaagcacagcaaggtaartcacactaatgaatttgtgccagg

SEQ ID NO: 84405 - DNA, 50 bp, homo sapien
atttttaaagaaatccttatatgtasgaactatttttacaagctcatcag

SEQ ID NO: 84406 - DNA, 50 bp, homo sapien
aactcttgtacactgctggtagtcaygtaaattagtacaacagttttgga

SEQ ID NO: 84407 - DNA, 50 bp, homo sapien
attcataggatccctagatttagcaytgaaattgtctaggtgacaccctt

SEQ ID NO: 84408 - DNA, 50 bp, homo sapien
ctctctactccctgtacttttaggayagctccttattggctgatgttttg

SEQ ID NO: 84409 - DNA, 50 bp, homo sapien
tgtagtttttaattcaagttttaatsaagaatcactcatcgcagttgttt

SEQ ID NO: 84410 - DNA, 50 bp, homo sapien
agcaaaatatctaaattcaaaataarcctctaacttagctttcaagccta

SEQ ID NO: 84411 - DNA, 50 bp, homo sapien
actttctcctataataggcactcaayggcaatttgccttactgttgatta

SEQ ID NO: 84412 - DNA, 50 bp, homo sapien
taaaaattattttcagtgttggaaawgtgctatctaaaactattaatact

SEQ ID NO: 84413 - DNA, 50 bp, homo sapien
tgaaattatgtgttcattaatttgcrgaatgtctaaggagacatttaatt

SEQ ID NO: 84414 - DNA, 50 bp, homo sapien
agcaataaatgcctacatcagaaaakaaagatttcaaataaattatgtaa

SEQ ID NO: 84415 - DNA, 50 bp, homo sapien
ctccatgcattttaagagaaggttaragcaggtttcgaattacaatgata

SEQ ID NO: 84416 - DNA, 50 bp, homo sapien
cagacgtacccttttctgaaggactrtgaagcttggctcggggcagtgct

SEQ ID NO: 84417 - DNA, 50 bp, homo sapien
gcaaatatacaggagatttatcctasaggtctttaaagcagagtctgtta

SEQ ID NO: 84418 - DNA, 50 bp, homo sapien
aattaacatcttatggttgttatgcraggttagaatattcaatataagct

SEQ ID NO: 84419 - DNA, 50 bp, homo sapien
agcaagcagcatttattgaacatacyaattgagagcgctgcctgcacatc

SEQ ID NO: 84420 - DNA, 50 bp, homo sapien
cttttctcttctcctgtatcttatgmaatccaagaagggtacactccctc

SEQ ID NO: 84421 - DNA, 50 bp, homo sapien
caaggaagtacttaccagagagaaasgagaataagcaggtaggcagaaac

SEQ ID NO: 84422 - DNA, 50 bp, homo sapien
gacagatctacacaatctatgacaaratttttctggcagttctgagaata

SEQ ID NO: 84423 - DNA, 50 bp, homo sapien
gcgaagcaattcctgcaaatattcargtattcaccttttgagaaacctta

SEQ ID NO: 84424 - DNA, 50 bp, homo sapien
gacagagttggaaatgatcactattwaaatgacaaagtattagaaagtca

SEQ ID NO: 84425 - DNA, 50 bp, homo sapien
ttgagaaaatgaaagaattttagaawggttgcaataaggtataagataga

SEQ ID NO: 84426 - DNA, 50 bp, homo sapien
aggcttatgaccttgacctctttaayacctcagaaccaatacgtattttt

SEQ ID NO: 84427 - DNA, 50 bp, homo sapien
tctgtacttactggaaccagggagartaagctgtacaggtatacttctga

SEQ ID NO: 84428 - DNA, 50 bp, homo sapien
tattagcatgagatgtctactaaaastaatgccgtatgaagaccgtattg

SEQ ID NO: 84429 - DNA, 50 bp, homo sapien
catattcacatattagataaaataaygtgtcatagcaacatctctggtat

SEQ ID NO: 84430 - DNA, 50 bp, homo sapien
tggagtagaaaaagtgtgaactttaragcggactctcaggagaacagcaa

SEQ ID NO: 84431 - DNA, 50 bp, homo sapien
ctaagtctctcaaggtggattgtttmcctgtctgttttgtaattttgaat

SEQ ID NO: 84432 - DNA, 50 bp, homo sapien
ggaagggccatttgatgactaagaasagagagggtgacagtcccagggcc

SEQ ID NO: 84433 - DNA, 50 bp, homo sapien
tggttggcaggtccaggtggagccaytcgattgttagaaatataaaaacc

SEQ ID NO: 84434 - DNA, 50 bp, homo sapien
ccagacccaaatatgtatcattaaakaagtaaacctaattcaaacctgat

SEQ ID NO: 84435 - DNA, 50 bp, homo sapien
catactcactttgttcttccattcaycttgataatttgacaccatactaa

SEQ ID NO: 84436 - DNA, 50 bp, homo sapien
gtgaaggatgagtgactattgggtayatctcaatgccatatgtattattg

SEQ ID NO: 84437 - DNA, 50 bp, homo sapien
aataataaagaaactgatgtcaagcratttatctgattcagattacagtc

SEQ ID NO: 84438 - DNA, 50 bp, homo sapien
tcctagaaggaaagtgtcaaaaagarcatcctcttgattatctttcaatg

SEQ ID NO: 84439 - DNA, 50 bp, homo sapien
tgatgaaaagactgtaatgaaaatgmagcttgagagctgggtgaagaggt

SEQ ID NO: 84440 - DNA, 50 bp, homo sapien
tgaagctgtaaaaggtgcaagatgayggattagagacattttctgtctac

SEQ ID NO: 84441 - DNA, 50 bp, homo sapien
ccctttggaagtcatttcttgagcasaatacctacaaaagtttttctatt

SEQ ID NO: 84442 - DNA, 50 bp, homo sapien
gaattttctactgttgtaagaaataycttccttggtttgcaaaacacttg

SEQ ID NO: 84443 - DNA, 50 bp, homo sapien
tgaccagtttcctttgagaacccaaytgttatgagtaacacacatatatc

SEQ ID NO: 84444 - DNA, 50 bp, homo sapien
aatcttaagtatgttttgctctgacyctgtagtttacaatattaaagaca

SEQ ID NO: 84445 - DNA, 50 bp, homo sapien
aagttactgaggcatcaaagtaaagkaccaaagagccagatattttgatc

SEQ ID NO: 84446 - DNA, 50 bp, homo sapien
agaagttcaaggctaagggcactctmaaaaagagtagcagttgtggtgaa

SEQ ID NO: 84447 - DNA, 50 bp, homo sapien
caaaagagatggagcatgatgactaraacagagaagaaaacttcacagaa

SEQ ID NO: 84448 - DNA, 50 bp, homo sapien
ccaataagttacatcacatgctatayctgtagaagaattataatattcta

SEQ ID NO: 84449 - DNA, 50 bp, homo sapien
ttgtcctcagtgagagttatacaatmataacaatgttttcatcatttttg

SEQ ID NO: 84450 - DNA, 50 bp, homo sapien
ctatccttctgccatcttcaagagayctatctgacataatgacacccata

SEQ ID NO: 84451 - DNA, 50 bp, homo sapien
aaattgcctaatagtgataataatgwcataaggtgctgtaacaagttctt

SEQ ID NO: 84452 - DNA, 50 bp, homo sapien
tctctccatattataagaacacttgwatattgctactggaacatagtcct

SEQ ID NO: 84453 - DNA, 50 bp, homo sapien
tcagataggtcattgacactcatgcyaatcacctatgaaatgtggtggtt

SEQ ID NO: 84454 - DNA, 50 bp, homo sapien
catttaatttaaaaatatatcaatawtaacaatctattcagtcattataa

SEQ ID NO: 84455 - DNA, 50 bp, homo sapien
aatctcccctgcccggttcattttayagtaactcttttttcttccagtgc

SEQ ID NO: 84456 - DNA, 50 bp, homo sapien
gaggtcataagatttaaaggcataargagttagaggatgtatgatcttct

SEQ ID NO: 84457 - DNA, 50 bp, homo sapien
catatttctgagaaatagcaatagcrcaaagaataaaaattatgctagtt

SEQ ID NO: 84458 - DNA, 50 bp, homo sapien
tttctcagaaatatgtgctagcccawgtatttttacaaatcaaatagctc

SEQ ID NO: 84459 - DNA, 50 bp, homo sapien
gtaaggaaacgactcaaaaatatgarctggacctactggggtcttacatt

SEQ ID NO: 84460 - DNA, 50 bp, homo sapien
tttgtttaaaatactttaagtgccaytgaaaggttgtctgcaatttggga

SEQ ID NO: 84461 - DNA, 50 bp, homo sapien
tctgtactctaagaaacttgatagasgcattaaatatttgatcaaattaa

SEQ ID NO: 84462 - DNA, 50 bp, homo sapien
tgttttcatttttctgcctcaatacmaagaacttagagatggaatgaaat

SEQ ID NO: 84463 - DNA, 50 bp, homo sapien
agaactcgagtcctctgccaaagttstaagttttcatgaaaacaaaagaa

SEQ ID NO: 84464 - DNA, 50 bp, homo sapien
tacaatgatacagacaaatcagtgcyacagttgcaccaatctttattagc

SEQ ID NO: 84465 - DNA, 50 bp, homo sapien
gggacacacacaggcgagattgggckcattcctactcctgacacttggac

SEQ ID NO: 84466 - DNA, 50 bp, homo sapien
actcagggccaagcaggactttaatwatcagagcacggaattcagatttt

SEQ ID NO: 84467 - DNA, 50 bp, homo sapien
catatccagatccaacttataaggartagaacaacttgggtcaatagttt

SEQ ID NO: 84468 - DNA, 50 bp, homo sapien
tgtctgttccaacaccacagttgatrgtagtacatagtctgagagccttc

SEQ ID NO: 84469 - DNA, 50 bp, homo sapien
gaggcagagcctagagagatgatggycaaactcattttctctttttcctg

SEQ ID NO: 84470 - DNA, 50 bp, homo sapien
ccagctgataccaaagacctgactargaagtaagatcaagatgattataa

SEQ ID NO: 84471 - DNA, 50 bp, homo sapien
tcagactctcttacttcatcttcgtktttcagcttactaacccttctcct

SEQ ID NO: 84472 - DNA, 50 bp, homo sapien
taagaagttcatttgtaagtccacaygctcaggtttgcctaaaatataag

SEQ ID NO: 84473 - DNA, 50 bp, homo sapien
ctgaacagtgaacaaacataaggacraaaccaaagaaaaagtatttgaag

SEQ ID NO: 84474 - DNA, 50 bp, homo sapien
agggaccttgtcaattcagctgtgcratttctcctttcttctttcagaac

SEQ ID NO: 84475 - DNA, 50 bp, homo sapien
gaaagggacatagaaaagtacatagkttaatgacaagtggaacatgattg

SEQ ID NO: 84476 - DNA, 50 bp, homo sapien
tttggggatactgaagtgaaatccartagttttgaaggaacctgactgcc

SEQ ID NO: 84477 - DNA, 50 bp, homo sapien
gatcatggaatatgttactgttttgyatgctatttttttagaagaaaagt

SEQ ID NO: 84478 - DNA, 50 bp, homo sapien
ttctttttattatttaagcgggtacmagttggcttccaaactaacacatt

SEQ ID NO: 84479 - DNA, 50 bp, homo sapien
gtgttgtttttttaaagaggtgattsaagtaccgttgctaagctgtcaac

SEQ ID NO: 84480 - DNA, 50 bp, homo sapien
cctcacagagttgtggtgaggactaygtgagacaaaatatgaaaggtttt

SEQ ID NO: 84481 - DNA, 50 bp, homo sapien
tatccctgttctctcaaggctgaacmacagtctactgaagaacaaatttg

SEQ ID NO: 84482 - DNA, 50 bp, homo sapien
cccgctcctggtggcccaaggaccartcagtgtgcactttctcccttctt

SEQ ID NO: 84483 - DNA, 50 bp, homo sapien
ttgcctgaaatgccctctccactgayactcacgttaatgctatgaagctc

SEQ ID NO: 84484 - DNA, 50 bp, homo sapien
caggaatatctagaaggatttcctaragtgatgaaagaggtcaccccccc

SEQ ID NO: 84485 - DNA, 50 bp, homo sapien
ctctgcaagcacacagtttaatgtartaattatgagatctagagaataaa

SEQ ID NO: 84486 - DNA, 32 bp, homo sapien
gagacagttaagtcagwaaagattctcttaga

SEQ ID NO: 84487 - DNA, 50 bp, homo sapien
tctcaacataccatgcaggagcatargaagcaatgttaaacctgagtatt

SEQ ID NO: 84488 - DNA, 50 bp, homo sapien
tactggctggtggctggaaggagacragtacaaagattgataagttctct

SEQ ID NO: 84489 - DNA, 50 bp, homo sapien
ttcaggagatagacatagatattgayaagcattagtgattaataagaaaa

SEQ ID NO: 84490 - DNA, 50 bp, homo sapien
ttactcattcccctaaacacatcaamttatcagactcaaacttgtgctgt

SEQ ID NO: 84491 - DNA, 50 bp, homo sapien
catgactctttttgatattccctgascttcttgaatatatggtttgttgt

SEQ ID NO: 84492 - DNA, 50 bp, homo sapien
ccaacttatgcagaagatgtacagaycattagttttgcaggcacagccag

SEQ ID NO: 84493 - DNA, 50 bp, homo sapien
accgcaggttatttgctctacagaamgaacacatgaaagcagacaaaaca

SEQ ID NO: 84494 - DNA, 50 bp, homo sapien
gatcagatttcactcactattatgaraatgtctatttgttggctaataag

SEQ ID NO: 84495 - DNA, 50 bp, homo sapien
caatatttgtggaaaattactgttamcaaccttagaaatgttcaaaaact

SEQ ID NO: 84496 - DNA, 50 bp, homo sapien
attgatgattgatagtgattcaaaargaatggactctaagtacctgatga

SEQ ID NO: 84497 - DNA, 50 bp, homo sapien
catcagtgagttagaaatcattttcraaatctttctcctttgctaatttg

SEQ ID NO: 84498 - DNA, 50 bp, homo sapien
aacaacagccttctacaaacaaagaktatgagttaaatagtcaaatgtta

SEQ ID NO: 84499 - DNA, 50 bp, homo sapien
aggcatttgctttataatcagtaaakgactacatctcaaaaatctagact

SEQ ID NO: 84500 - DNA, 50 bp, homo sapien
aggacatttctgtctaattgggagarccgatgtgtacacaaaattctaac

SEQ ID NO: 84501 - DNA, 50 bp, homo sapien
ataaaaattcatcagttttctacaayacaaagaatagtctattttttagc

SEQ ID NO: 84502 - DNA, 50 bp, homo sapien
ctgactgggtatctgtcatgtgataygtctaagtgtttcaaccccgatgg

SEQ ID NO: 84503 - DNA, 50 bp, homo sapien
tagtctaggttacagccataacatayctttcagtgtttttacttggtgga

SEQ ID NO: 84504 - DNA, 50 bp, homo sapien
tcctttaaatgattatattgttagcrgcagataagacaaagtgtatgtcc

SEQ ID NO: 84505 - DNA, 50 bp, homo sapien
tacatctaaaggaaatggaggttcargaatattgcataacttgaccaatt

SEQ ID NO: 84506 - DNA, 50 bp, homo sapien
ctggccatctcatcttcctagagcarctatagcttgattgttatttaaca

SEQ ID NO: 84507 - DNA, 50 bp, homo sapien
gtgggaggaagagaggagttttatcragaaagactttgctgaatagttaa

SEQ ID NO: 84508 - DNA, 50 bp, homo sapien
aaatagaaatcaatatcaagaataaycccataaacaagcaattacacaga

SEQ ID NO: 84509 - DNA, 50 bp, homo sapien
cagtcttttaaagcagtgtagattgrcaacagattctagttcaacaattt

SEQ ID NO: 84510 - DNA, 50 bp, homo sapien
ttcttatctacctgcggttaggaagkttgtcaaaatgagacgttatgact

SEQ ID NO: 84511 - DNA, 50 bp, homo sapien
gctggcgctgtgctcaagcactttaygtggattatttaacttagccacac

SEQ ID NO: 84512 - DNA, 50 bp, homo sapien
ccactctctctcctgtgcttgctgascagccttgggcatgttcctcaatt

SEQ ID NO: 84513 - DNA, 50 bp, homo sapien
ttacaaactgtgacaagtaaactgaragtaaaagaaactgacagaaatat

SEQ ID NO: 84514 - DNA, 50 bp, homo sapien
gtcatttcaatataatatttagaacrctgtactcacaagcatgaaaaaat

SEQ ID NO: 84515 - DNA, 50 bp, homo sapien
tttgcttaatgtttgcctttctatcrgagcaagatttatgtaagcagtaa

SEQ ID NO: 84516 - DNA, 50 bp, homo sapien
gacagaaaggtataaaatctaaatckccagaaacaaaatgtaagttaaga

SEQ ID NO: 84517 - DNA, 50 bp, homo sapien
aatttgaaaaacgtggcctaaagaayatgctatccatccaattcactaat

SEQ ID NO: 84518 - DNA, 50 bp, homo sapien
gggctcctgttcctcaaagtcataayttaatttaacaaccaaagctggaa

SEQ ID NO: 84519 - DNA, 50 bp, homo sapien
cttgcaaaattcatcaaggctttcamaatacctcccacaaaaatttccaa

SEQ ID NO: 84520 - DNA, 50 bp, homo sapien
ctttgttacctctcagcaaacagaayggactgctttttggacatacgtca

SEQ ID NO: 84521 - DNA, 50 bp, homo sapien
atatttcttttcgatcatctctttawatatcttttcacctatttataatc

SEQ ID NO: 84522 - DNA, 50 bp, homo sapien
aatgttaccaagttttgtccactctyaaacatctgtcattttcctgccca

SEQ ID NO: 84523 - DNA, 50 bp, homo sapien
aagtctggacggctcagcttaccatrttttcagagttatctcaaaaaaat

SEQ ID NO: 84524 - DNA, 50 bp, homo sapien
agttaccataattaagcttattatcrcatctatcacctcatacaattgcc

SEQ ID NO: 84525 - DNA, 50 bp, homo sapien
aaccatcaacgtatggcacagtatgrcaaacggtaggcattaagcaggtt

SEQ ID NO: 84526 - DNA, 50 bp, homo sapien
gaaagttagtcaaagctaataagackcaatgtgtactagaaaactccctt

SEQ ID NO: 84527 - DNA, 50 bp, homo sapien
caagagtatctatgctcaaaacatayctgaaagtttaaaatgactattga

SEQ ID NO: 84528 - DNA, 50 bp, homo sapien
aaggaggtaaataactttaggccggratacctgctggccaatgtcaatct

SEQ ID NO: 84529 - DNA, 50 bp, homo sapien
ccttcttaatgtcctcttccaaacayattcacacatctactcccactcct

SEQ ID NO: 84530 - DNA, 50 bp, homo sapien
cagtatcatgtccgttgttctttcartatctcagctgcattctccttctc

SEQ ID NO: 84531 - DNA, 50 bp, homo sapien
gcaaggaggtggagaagtaccctcaygtgaaaatacttaaagaattaaat

SEQ ID NO: 84532 - DNA, 50 bp, homo sapien
acactgagaaacgagaaagagagatsataaattgttgcaattagcaagta

SEQ ID NO: 84533 - DNA, 50 bp, homo sapien
aatgtcacagccatgttacttattaygagtctatagtctttcattttgcc

SEQ ID NO: 84534 - DNA, 50 bp, homo sapien
attataactaaatggaaactggtcayattaaactccttatgtgttgttag

SEQ ID NO: 84535 - DNA, 50 bp, homo sapien
aaaatgtcttcagcatttcattccargaagtacagcttatattaaaaact

SEQ ID NO: 84536 - DNA, 50 bp, homo sapien
ccatgtccactaaagttcctatatawatcatgcctgtaacagtagcttgc

SEQ ID NO: 84537 - DNA, 50 bp, homo sapien
ttccttcttaccattgaatcacatarcaaataattataggctctcaaatg

SEQ ID NO: 84538 - DNA, 50 bp, homo sapien
tctatggatgatgacagaaaaatcaytcataattgctgagccacaggaaa

SEQ ID NO: 84539 - DNA, 50 bp, homo sapien
aggagagggtcaggagatttcttaaygcaaaattgaacattgaaatcttg

SEQ ID NO: 84540 - DNA, 50 bp, homo sapien
gaattattttttattccctctgaaargtttataacacaacaaatatctaa

SEQ ID NO: 84541 - DNA, 50 bp, homo sapien
aaattatttaggaatgtcaaggctaygagagatttaacacacaattaagt

SEQ ID NO: 84542 - DNA, 50 bp, homo sapien
agtctatgagtctaactcatgaatakcgtgaggatgtttttatgtatttt

SEQ ID NO: 84543 - DNA, 50 bp, homo sapien
acagaaggccttgggaaggaacacartggattttccctggaaattctaga

SEQ ID NO: 84544 - DNA, 50 bp, homo sapien
atatgaagaaaaaggtaaagaagcakaaattaaaaggataacttgaagaa

SEQ ID NO: 84545 - DNA, 50 bp, homo sapien
tctcaaaatccatgcaatgttcagargtatttctattttttggaaaataa

SEQ ID NO: 84546 - DNA, 50 bp, homo sapien
tgacaatttgaggagagacaaacggwattgatatgggaggggggcaggga

SEQ ID NO: 84547 - DNA, 50 bp, homo sapien
gaaaggaagaattctctgaaagtgcmaacaaggaccaatccattccatcg

SEQ ID NO: 84548 - DNA, 50 bp, homo sapien
cttctgcattcatacacgtaaatctyaatctggaaggaagatagaatcta

SEQ ID NO: 84549 - DNA, 50 bp, homo sapien
cttaatttggtttctctattttccaygcctggtacttggtaggcactgta

SEQ ID NO: 84550 - DNA, 50 bp, homo sapien
aggttaggtgacatacaagaacatgyggttccacagcagtcctgtcattc

SEQ ID NO: 84551 - DNA, 50 bp, homo sapien
cccccagaacgcccagaattgaactratggtggcttgtatttgctactct

SEQ ID NO: 84552 - DNA, 50 bp, homo sapien
agtcaaaacagaatgttaggagcacrgcttttgagtcgagaaatttgatt

SEQ ID NO: 84553 - DNA, 50 bp, homo sapien
tttccttgaacctagaggaatgtgcygaaacagtagtaggtgttggttaa

SEQ ID NO: 84554 - DNA, 50 bp, homo sapien
aacaagacatggatgcccgctttcaycaagtctattcaacatagtacaga

SEQ ID NO: 84555 - DNA, 50 bp, homo sapien
gatttcaaagaaataaaaaatttgartagagaacaaaactttcttggaac

SEQ ID NO: 84556 - DNA, 50 bp, homo sapien
atcaatcaatatgatatttaggaaaytatgtgctaagacatctgtctact

SEQ ID NO: 84557 - DNA, 50 bp, homo sapien
tgcttccacttttataggatgttgtsaattctggcctgaggacacagcct

SEQ ID NO: 84558 - DNA, 50 bp, homo sapien
gtataatgtgttcactgacctagaarcgatgggcttgaatttctaataag

SEQ ID NO: 84559 - DNA, 50 bp, homo sapien
cacttaatgatacatagtaggtaggraagatttagatataaaacctcata

SEQ ID NO: 84560 - DNA, 50 bp, homo sapien
catcggatgggtagtaactagatacwctaatgcaaaagttggggatacag

SEQ ID NO: 84561 - DNA, 50 bp, homo sapien
tttctttgcctttattgtggtgttaygtatggaaatgggaagattgacaa

SEQ ID NO: 84562 - DNA, 50 bp, homo sapien
gaagcaggagtagcatacaatcagargaggctggaaaacgggaagacaag

SEQ ID NO: 84563 - DNA, 50 bp, homo sapien
ggagatttactgaatatttgtataaygaacaatgacacacagagaccaca

SEQ ID NO: 84564 - DNA, 50 bp, homo sapien
ccttgccctttggcgagaccataaaytaaatacgcaaatcatctttgcct

SEQ ID NO: 84565 - DNA, 50 bp, homo sapien
ctctctaacacacacacatacatacrcagtgaactttatgctgatattat

SEQ ID NO: 84566 - DNA, 50 bp, homo sapien
cattgctttatgaagggctccataayagttaatgaaggtaagtctgtatg

SEQ ID NO: 84567 - DNA, 50 bp, homo sapien
atctttccttcttcaaacagacctargctattagagcatcttcctaaagc

SEQ ID NO: 84568 - DNA, 50 bp, homo sapien
ttttataattgttctgtctctgttaratttgttctatccctgttagcttt

SEQ ID NO: 84569 - DNA, 50 bp, homo sapien
cccacgtttagatgctacttcacacygaggaagatggctattatcttaaa

SEQ ID NO: 84570 - DNA, 50 bp, homo sapien
aaccactgaaaagtatgtcctttaayaaaagaagtctctaacttatgaga

SEQ ID NO: 84571 - DNA, 50 bp, homo sapien
cctacaacctagactcaagccataarattaaagattcaaatctcagagtt

SEQ ID NO: 84572 - DNA, 50 bp, homo sapien
gtgtgtggaaaccagatcagcaaagygctgtaactatggcctaccatgga

SEQ ID NO: 84573 - DNA, 50 bp, homo sapien
cctcaggttatgtctctgcaaactcrgaggtataaagtgaagttttaaat

SEQ ID NO: 84574 - DNA, 50 bp, homo sapien
aatatcattaagatggccatactacyagaaacagtttacagattcaatgc

SEQ ID NO: 84575 - DNA, 50 bp, homo sapien
agataagcacacaaatgagattgggyaatgctatcaagggaggagaaaga

SEQ ID NO: 84576 - DNA, 50 bp, homo sapien
taaggacttcgtatttcataaaacayggtgagccaatcagtcatatggag

SEQ ID NO: 84577 - DNA, 50 bp, homo sapien
ttactggaaattttttctagcaaaawataagctcatgagaataatcaatc

SEQ ID NO: 84578 - DNA, 50 bp, homo sapien
ataactcctgttcacagaagctcaawgcatttttctagtattcacttact

SEQ ID NO: 84579 - DNA, 50 bp, homo sapien
acattcaaaccatagcaatctcctcraggccaagtgatggctttctgtac

SEQ ID NO: 84580 - DNA, 50 bp, homo sapien
cttgagaagttctaaatttataaaastctactcaaatttatgggactaaa

SEQ ID NO: 84581 - DNA, 50 bp, homo sapien
gctctagggttggcacatggatgaawgattgcagtaaccgtggtaaggga

SEQ ID NO: 84582 - DNA, 50 bp, homo sapien
atatagagcttttagtcaacaaaagyctctaaatttgggtggatgctgtt

SEQ ID NO: 84583 - DNA, 50 bp, homo sapien
gcgtgctctggctatttgggagggayggtactaaacagactgcataacaa

SEQ ID NO: 84584 - DNA, 50 bp, homo sapien
tttagatgactatgtctaaagagggragaaaataattgacaagtttactc

SEQ ID NO: 84585 - DNA, 50 bp, homo sapien
aaaaagcaacttgatatttcttataygcccagctatgggtttgacagata

SEQ ID NO: 84586 - DNA, 50 bp, homo sapien
acatacttctccagaacaaagatgayagttaagaaaaataaagtgtttgg

SEQ ID NO: 84587 - DNA, 50 bp, homo sapien
ataggcttgtggtaaacatggaacayacttatctgtgtaaagtacataac

SEQ ID NO: 84588 - DNA, 50 bp, homo sapien
ctgatctcttggggctgatttgtaastctattatttcagccagcctggtt

SEQ ID NO: 84589 - DNA, 50 bp, homo sapien
ttcaaacaaaagaatactgcaatgargcgttccaaaaggaaacagtgagc

SEQ ID NO: 84590 - DNA, 50 bp, homo sapien
aaaattaagactcttattaggaaagwccatcatctaaattgtgaacaatt

SEQ ID NO: 84591 - DNA, 50 bp, homo sapien
agcattttaactgataggaaagaccrcatattggtgaaaaaggtctacag

SEQ ID NO: 84592 - DNA, 50 bp, homo sapien
aatatgcggtctttcctatcagttawaatgctttagttgtgattaataaa

SEQ ID NO: 84593 - DNA, 50 bp, homo sapien
agcataaatccaaatagcatcgatayaagcgagaatgttatatagcagta

SEQ ID NO: 84594 - DNA, 50 bp, homo sapien
gcctcagccatctcaagaccacaacrggaacatagccaagtcagagaagg

SEQ ID NO: 84595 - DNA, 50 bp, homo sapien
caatgttggtagtttatagaccattkaaagatccctgtctcaagaggctg

SEQ ID NO: 84596 - DNA, 50 bp, homo sapien
gcattctttctcagctttgtatctckgacttgttcaatgttatttgtagg

SEQ ID NO: 84597 - DNA, 50 bp, homo sapien
gtagtggtgtcatttgattcctttckcttcctcctttgtgtgacttcttt

SEQ ID NO: 84598 - DNA, 50 bp, homo sapien
tgaatcaaacaaaattcttcttcacsattgtattagtcaggtttttccag

SEQ ID NO: 84599 - DNA, 50 bp, homo sapien
ttaatcaaaggttaagcatcaaagaytcataaatcaaagcatccataatc

SEQ ID NO: 84600 - DNA, 50 bp, homo sapien
atcctaggtttttctccaaagtaacraatctttcatacaatttaatcctc

SEQ ID NO: 84601 - DNA, 50 bp, homo sapien
ttgccatggtgtattatggtgcacgyacatagccaccagaaacatttttc

SEQ ID NO: 84602 - DNA, 50 bp, homo sapien
caaagtgtcatagttacgcaaaacayggctccggaggtaaaaattcacca

SEQ ID NO: 84603 - DNA, 50 bp, homo sapien
cagagtaatgagcaggttcaaggaartgatatctaaggtctgtttcagct

SEQ ID NO: 84604 - DNA, 50 bp, homo sapien
atttcacatctcagaaattgaaagasagtctgatgactttagtaattggc

SEQ ID NO: 84605 - DNA, 50 bp, homo sapien
atttccctgtggagaacacccttgaraaatggagtaagtactagggagaa

SEQ ID NO: 84606 - DNA, 50 bp, homo sapien
agcaagtatgttctttgattacagaytaattttctagccccagagttgga

SEQ ID NO: 84607 - DNA, 50 bp, homo sapien
agttagcttttatcacaatgttgaaraagtttggttataaagattataaa

SEQ ID NO: 84608 - DNA, 50 bp, homo sapien
catgaaaaaccaaggcaatatgacaygaacaaaggaatgtaataactctc

SEQ ID NO: 84609 - DNA, 50 bp, homo sapien
caaaggaaatcaatacgtagacataygacaaaggacaaaaatgttcacat

SEQ ID NO: 84610 - DNA, 50 bp, homo sapien
ctaaccctagttcagaaatccagcayagaaaacagattttaccttgaaag

SEQ ID NO: 84611 - DNA, 50 bp, homo sapien
tactcagccacaatatcaatcaaatktcagtaaacaataaagacatcttc

SEQ ID NO: 84612 - DNA, 50 bp, homo sapien
atcatctctatgattctgtttataartgccacgtgattcatgatggggaa

SEQ ID NO: 84613 - DNA, 50 bp, homo sapien
ctgcctatcaacttctatatttaccrcctttctgtgtgaatacaaacata

SEQ ID NO: 84614 - DNA, 50 bp, homo sapien
cgcattcattcaaagtctttaacaaktagtttgccttttcatgagtagca

SEQ ID NO: 84615 - DNA, 50 bp, homo sapien
ttttttctctgctgtggatgttcaaygttgcaatactggtttgttgaaaa

SEQ ID NO: 84616 - DNA, 50 bp, homo sapien
gcaattaatgagtctggtaaacctayaaaaacttgcaaatcaaaactccc

SEQ ID NO: 84617 - DNA, 50 bp, homo sapien
ttacaatttttatctccttgagtttwaaaaattaatcatcatgccctgat

SEQ ID NO: 84618 - DNA, 50 bp, homo sapien
gagtgaagataacataacattgcccwattacacgcaagggccaccaacca

SEQ ID NO: 84619 - DNA, 50 bp, homo sapien
ggttgtcatatttgtaaaatactatsaggtgctaggtaactttttctgga

SEQ ID NO: 84620 - DNA, 50 bp, homo sapien
atctcctgatcccttatagtcttcamgtccttgcagtaatgtctacattc

SEQ ID NO: 84621 - DNA, 50 bp, homo sapien
ctatactgtctcttcacaacatccawacaggtgagcaaaagaaactagga

SEQ ID NO: 84622 - DNA, 32 bp, homo sapien
gaagcagtcgttgatcratatacactgaattt

SEQ ID NO: 84623 - DNA, 50 bp, homo sapien
tagcagctacaatctaatttcattgraagtctcctccaaatcacagaagt

SEQ ID NO: 84624 - DNA, 50 bp, homo sapien
tagagggatagtgttatggacatackgctcattttccagaggtactattg

SEQ ID NO: 84625 - DNA, 50 bp, homo sapien
gttttctcatgcaagatgttgacaaraacagacaaaagtttccatgcaat

SEQ ID NO: 84626 - DNA, 50 bp, homo sapien
ttatttacctttgctaggatagtgargaagttcttttgtttttaaattcc

SEQ ID NO: 84627 - DNA, 50 bp, homo sapien
actgtctctttcagataaatcttcastcttctgcagccatgctccatgcc

SEQ ID NO: 84628 - DNA, 50 bp, homo sapien
gtcttctaatttgtttcttgttcacyatcttttcttgaaagttcccataa

SEQ ID NO: 84629 - DNA, 50 bp, homo sapien
tcaggaaggggcaaatatgtgactargtaaaagaaattcatcagtattgg

SEQ ID NO: 84630 - DNA, 50 bp, homo sapien
ccatatctagaatctaatgctccaargtaggtaaaacagatccctagaat

SEQ ID NO: 84631 - DNA, 50 bp, homo sapien
attctaaattactggggatcattcartaaggaaatggtaagctctgatgg

SEQ ID NO: 84632 - DNA, 50 bp, homo sapien
attgaaaaacaagcaatgaaacaccsaggagagactatgggtcaaatatt

SEQ ID NO: 84633 - DNA, 50 bp, homo sapien
cacattcaacttcaaagctatatcaygggcctttgattttagttcctatt

SEQ ID NO: 84634 - DNA, 50 bp, homo sapien
tggttatttaagggtgtgtaatagamtcctactccaacaggaatttggat

SEQ ID NO: 84635 - DNA, 50 bp, homo sapien
attattgatctgtctcatttgagcayacatttccatgttactcttattct

SEQ ID NO: 84636 - DNA, 50 bp, homo sapien
acacagaagatatgttgcctagagcycgatgctatccaagattatctatc

SEQ ID NO: 84637 - DNA, 50 bp, homo sapien
tgaaagagaaaagaaaacttgaaaamggaactctctagctccagagatag

SEQ ID NO: 84638 - DNA, 50 bp, homo sapien
gttctgtctacttatagtttacatakggatttgacatgtaaaacagatta

SEQ ID NO: 84639 - DNA, 50 bp, homo sapien
acagtggtgctcctcttactcataartggcttattcctttctagaattca

SEQ ID NO: 84640 - DNA, 50 bp, homo sapien
gcatttagcaggtaatagatgcctcraaaattcactttagctacatttag

SEQ ID NO: 84641 - DNA, 50 bp, homo sapien
tttaaagacaatgtgagtggcataasagattattatatgaattctaaaca

SEQ ID NO: 84642 - DNA, 50 bp, homo sapien
tatcccctatgctacctggctcaaaygctgtaaaaacccaaaatgattag

SEQ ID NO: 84643 - DNA, 50 bp, homo sapien
tcccaaggagttaattattagactgyggcaaagccaggattcaagctcaa

SEQ ID NO: 84644 - DNA, 50 bp, homo sapien
gggttaaatagcttgcccaatgttaygcaggtgctttgggcagaaggagg

SEQ ID NO: 84645 - DNA, 50 bp, homo sapien
atgaatcagctgcctttttgtgatcwaagagaactgcactaaattaacct

SEQ ID NO: 84646 - DNA, 50 bp, homo sapien
ttaccgtgaaggaattgcaaaaatgraagcttagaaatatagactctaga

SEQ ID NO: 84647 - DNA, 50 bp, homo sapien
ctatttatattccctgataatgtaartgcttatatgaactcattccaatt

SEQ ID NO: 84648 - DNA, 50 bp, homo sapien
cagaaagttaggggaaagcttaaacrttagctactctacctcctacaaat

SEQ ID NO: 84649 - DNA, 50 bp, homo sapien
agggaattatgctcaaagcagaggcrctaaaaatagcctagtgtctcatc

SEQ ID NO: 84650 - DNA, 50 bp, homo sapien
tgatggagaacattactgaatgtaaraggagagaagacagaagtgactgg

SEQ ID NO: 84651 - DNA, 50 bp, homo sapien
ctagcctgctaaacttgaaaactaaygagaagtataccaaaaattgcttc

SEQ ID NO: 84652 - DNA, 50 bp, homo sapien
ggaaagcatttgttagtggataaacragcaagaaggcagtgggattgtgt

SEQ ID NO: 84653 - DNA, 50 bp, homo sapien
gtgaagcagtgagggtgacagggaasagatggtacaaaccaagctcttag

SEQ ID NO: 84654 - DNA, 50 bp, homo sapien
tctcttgaatttgatttataatacaygaggtagcttatccttgagaaaga

SEQ ID NO: 84655 - DNA, 50 bp, homo sapien
gggagattttatttcactagctttawgactaagtataccttttagtagat

SEQ ID NO: 84656 - DNA, 50 bp, homo sapien
ttcatatagatatactgcatatcaayaaattacatataacgtgtctagaa

SEQ ID NO: 84657 - DNA, 50 bp, homo sapien
atatctatatgaaagattcatattawcagatgggtttatttctttttttt

SEQ ID NO: 84658 - DNA, 50 bp, homo sapien
agaagagttattgttttaaacctcargatatatttaggaagacatttgag

SEQ ID NO: 84659 - DNA, 50 bp, homo sapien
agaattagatggcacatagttcacaratttatcttcattatgtctgtgtg

SEQ ID NO: 84660 - DNA, 50 bp, homo sapien
tccatttctgctttatcgtgaactcmgaagagaccatgtttagtgattaa

SEQ ID NO: 84661 - DNA, 50 bp, homo sapien
ttaacctttaaatacataaactcaayagaaataatttaactgccttctct

SEQ ID NO: 84662 - DNA, 50 bp, homo sapien
cctgttcctagtttcacaattacccraaaaataaatagattgtattagtc

SEQ ID NO: 84663 - DNA, 50 bp, homo sapien
ctgcatgaaattcactaagaagcacrcttttctgacatagtcattcatga

SEQ ID NO: 84664 - DNA, 50 bp, homo sapien
ctgttgaacattcttatttgtatccygagctatgcttcaaactcaccatg

SEQ ID NO: 84665 - DNA, 50 bp, homo sapien
tctctcaacgatattgtctagttccsagagtgtatttgcctcttgaacag

SEQ ID NO: 84666 - DNA, 50 bp, homo sapien
gttatctcctctacctagaatcataktacttaaactaccaatataacaca

SEQ ID NO: 84667 - DNA, 50 bp, homo sapien
attgtaggatgaattaatggatgaamagtgaatggaactgtccttaggga

SEQ ID NO: 84668 - DNA, 50 bp, homo sapien
tgacaaaccaatgatcaccaatggcyactaaaatcatcagctggaaaggt

SEQ ID NO: 84669 - DNA, 50 bp, homo sapien
tttcattcagagactataaagagaaracatgtaagtagactgagagtctc

SEQ ID NO: 84670 - DNA, 50 bp, homo sapien
tgataaataactctccgtagatgaaytgtgcttgtttttaccagtcaata

SEQ ID NO: 84671 - DNA, 50 bp, homo sapien
acaaatttaaattatctcacttttcrctctgtttagacttgtgttttttt

SEQ ID NO: 84672 - DNA, 50 bp, homo sapien
acaggcatgagccaccgaaaccggaygatgcctccttcttaatttccagt

SEQ ID NO: 84673 - DNA, 50 bp, homo sapien
agaaattgtgatttttagctaattartaagattcgggccaatgccagctg

SEQ ID NO: 84674 - DNA, 50 bp, homo sapien
tgaatgaggtattataaaatcattcraaaacaaaaaatcaaagattaaac

SEQ ID NO: 84675 - DNA, 50 bp, homo sapien
ttcctcaaatgttatatttcaacaaygttaaactaaggccgggcgcggtg

SEQ ID NO: 84676 - DNA, 50 bp, homo sapien
gggcctgtatttccctctgagttctrtctaccttctttacatttccattt

SEQ ID NO: 84677 - DNA, 50 bp, homo sapien
tggttacacaaccagcaagggagcarcatggcaccccagaagttttgcat

SEQ ID NO: 84678 - DNA, 50 bp, homo sapien
acaatggaatggctaaacagtttaaygtctatgatataaatatacaagag

SEQ ID NO: 84679 - DNA, 50 bp, homo sapien
tattggtgggttagttgtctgtaatkatttagttttaattttttagtgta

SEQ ID NO: 84680 - DNA, 50 bp, homo sapien
cccttgcagttgcccagctccttaartcactttttcttctatgctttaaa

SEQ ID NO: 84681 - DNA, 50 bp, homo sapien
tagaaaggaaagaaaactaagatagyagctagaaaatttttgagaaaaga

SEQ ID NO: 84682 - DNA, 50 bp, homo sapien
atcctgttatgctctgaacagttccyattatttgttccttaagcagttcc

SEQ ID NO: 84683 - DNA, 50 bp, homo sapien
acagtatttaataaaacttacacgaygtacttatgttatcagaagaaaga

SEQ ID NO: 84684 - DNA, 50 bp, homo sapien
tgctccttcccaggatggactcgaakctgtgtgcaggtttgtggtctggc

SEQ ID NO: 84685 - DNA, 50 bp, homo sapien
taacataaactctggagctccgtaarctgaacgagttagtcttggaagag

SEQ ID NO: 84686 - DNA, 50 bp, homo sapien
tgcagtactggcatgaggtgagatayatgtgaagcttggcagagcctggc

SEQ ID NO: 84687 - DNA, 50 bp, homo sapien
gtactgtttccaaactatcttaagasactggagaagaatacactgtataa

SEQ ID NO: 84688 - DNA, 50 bp, homo sapien
tgggggctcacttccatttctctgaygtgtgttgtttccccaagtgtgga

SEQ ID NO: 84689 - DNA, 50 bp, homo sapien
ctcagttgatagtgtgggtgggtaamtaattcaaggctaaacattatttt

SEQ ID NO: 84690 - DNA, 50 bp, homo sapien
cttttacttgagtataaagtcttcaygcctggagttttcttcagtttctc

SEQ ID NO: 84691 - DNA, 50 bp, homo sapien
tcagagcctgtgagaattatgtaaawtgtaattagttagggtacttgctt

SEQ ID NO: 84692 - DNA, 50 bp, homo sapien
ataaaataagatgtaattaaaaaacwcattaggatgtagagacccaaaat

SEQ ID NO: 84693 - DNA, 50 bp, homo sapien
ggtgactaatcggacttcagaagtawgtttctatgttaggtttccatttt

SEQ ID NO: 84694 - DNA, 50 bp, homo sapien
tatggggaattgagacaacaaggacrgaaattcttaggagcagcttttgt

SEQ ID NO: 84695 - DNA, 50 bp, homo sapien
atgatcaatccatgtacaattgagaytccttgcatttctcttcaaattgt

SEQ ID NO: 84696 - DNA, 50 bp, homo sapien
gtagctgtatccatgtcattgcatayaccttacctgcaccaagatttcaa

SEQ ID NO: 84697 - DNA, 50 bp, homo sapien
tgtgctttgttcgtcatgtatttccraattagttctgattttgtaaaaaa

SEQ ID NO: 84698 - DNA, 50 bp, homo sapien
cttctttttaaaccagtgatactaamggtgtatttaagcctgttttgagt

SEQ ID NO: 84699 - DNA, 50 bp, homo sapien
caactatataaccggggattctcatrataaacaacagtaaggccgggtgc

SEQ ID NO: 84700 - DNA, 50 bp, homo sapien
cagcatgtgttttatcctcctagcaytagttgtctgacaagaggtggcct

SEQ ID NO: 84701 - DNA, 50 bp, homo sapien
tatgtataatttgggaatagtataasctctcaatttcattgttaggatta

SEQ ID NO: 84702 - DNA, 50 bp, homo sapien
atagcagcccgaataaactaagagasgatacaattttaaaaaacaaatcc

SEQ ID NO: 84703 - DNA, 50 bp, homo sapien
aactcaatgtatgactgcacagatcraaagtgtcgaactcacaagaggca

SEQ ID NO: 84704 - DNA, 50 bp, homo sapien
tatatgtgtccaataattctaccaastgaacagtaaaatatgcatgtcta

SEQ ID NO: 84705 - DNA, 50 bp, homo sapien
acgtggtaatacagacaaaatttccrcttcacgatcttaactcatcctcc

SEQ ID NO: 84706 - DNA, 50 bp, homo sapien
aactgcgggtgaatttctgaagtcaygttacatagctgtcacaactagta

SEQ ID NO: 84707 - DNA, 50 bp, homo sapien
gcaaacaagttctatgaaaggagagratgttttaactttatttgtatttc

SEQ ID NO: 84708 - DNA, 50 bp, homo sapien
actaagggagtaaattatgtacgcaygagataaaacctggccaagcacag

SEQ ID NO: 84709 - DNA, 50 bp, homo sapien
gctcaagagggttgagacgcattcaractagtcattgtggtagtgatcac

SEQ ID NO: 84710 - DNA, 50 bp, homo sapien
taccagaaatacgaaataattgaacmaaccataactattggttagaccta

SEQ ID NO: 84711 - DNA, 50 bp, homo sapien
tcaaagaaagatgttctgagttgaawttcagttagatcccaagcacagta

SEQ ID NO: 84712 - DNA, 50 bp, homo sapien
gtcagtggagtgttaaagtccctaaktattatcgtgtgggtatctctttt

SEQ ID NO: 84713 - DNA, 50 bp, homo sapien
acgtataaaaccgtggatactgttaycatgtgtgtaaaagaaaaattgta

SEQ ID NO: 84714 - DNA, 50 bp, homo sapien
aggtttctaccaatcctgaattccaracagagagagttatttttaacttc

SEQ ID NO: 84715 - DNA, 50 bp, homo sapien
catacaacctaccaagattgaaataygaagacatggaaaacctaagcagg

SEQ ID NO: 84716 - DNA, 50 bp, homo sapien
ctcaaagtctttatgaataatttaargttatgccaataaaaatacagaga

SEQ ID NO: 84717 - DNA, 50 bp, homo sapien
gctgtctgtgaagctttgcaagttamgacaattgtagaaataggccagtt

SEQ ID NO: 84718 - DNA, 50 bp, homo sapien
tattattgtttagtgtaatttattcsagtatcagtatgtccatttaaaat

SEQ ID NO: 84719 - DNA, 50 bp, homo sapien
agtcccaagacctcatcttgaaaaamctctggaaatgaattagtgtaaat

SEQ ID NO: 84720 - DNA, 50 bp, homo sapien
aattatatccatagggcaaacgattwtgagattgattttcaggttgattt

SEQ ID NO: 84721 - DNA, 50 bp, homo sapien
cagcaaacctgatgagtcgagctggwatatcaggttttctttcctgttta

SEQ ID NO: 84722 - DNA, 50 bp, homo sapien
agcaggaataagggaggaaattgtaygtaacagattaacaagatacttta

SEQ ID NO: 84723 - DNA, 50 bp, homo sapien
tttgtgaaagtcttaaggcataatayctctgacttcttatctgtaaagta

SEQ ID NO: 84724 - DNA, 50 bp, homo sapien
agccaccacggccggctgatatggayaatttattacatgagaaaggtgac

SEQ ID NO: 84725 - DNA, 50 bp, homo sapien
gaagatgtgaaaaaagagattgtcargtagtggcctgaacaggaatacct

SEQ ID NO: 84726 - DNA, 50 bp, homo sapien
aaaaaagcaaaagcttctcactcacyaatagcttagaaaagtttcacatc

SEQ ID NO: 84727 - DNA, 50 bp, homo sapien
tacaacaatcaaaagcaaaaaggtaragcaatgaacatggagacagtgta

SEQ ID NO: 84728 - DNA, 50 bp, homo sapien
tgagaaacagaactagaaggacataygtatcattccaagtaattggctta

SEQ ID NO: 84729 - DNA, 50 bp, homo sapien
cacttattaaatgcttatctcactcraaaatcccatacctaggaggtagg

SEQ ID NO: 84730 - DNA, 50 bp, homo sapien
tgcactcatttttcctttatgtccartaataagatggtggtcactgacat

SEQ ID NO: 84731 - DNA, 50 bp, homo sapien
ttcaactgacaggctttaacctttakactgctgaagttataaaatgtata

SEQ ID NO: 84732 - DNA, 50 bp, homo sapien
tgtgcttttcatttcaaagcatgatraataagaaatggagatcaataagt

SEQ ID NO: 84733 - DNA, 50 bp, homo sapien
gaatttcataaataccaacatgatayacaatagttccttagcatttgtca

SEQ ID NO: 84734 - DNA, 50 bp, homo sapien
aaccgaaacatgaaactttcaaaacscgaggatactaagacaggtgatgt

SEQ ID NO: 84735 - DNA, 50 bp, homo sapien
cataggcaacaagtgaaatctacatwacgaattaataagaaccgaaacat

SEQ ID NO: 84736 - DNA, 50 bp, homo sapien
agcactgggactcataacgtaccaayggtcacatgctagtaagttaggaa

SEQ ID NO: 84737 - DNA, 50 bp, homo sapien
ataatggcaatgaaataaaaaacagrtgaacaatgtaaaagtcaatgaaa

SEQ ID NO: 84738 - DNA, 50 bp, homo sapien
gcattttgttctgtaaagaataaaarttgcatctataataattcttaaag

SEQ ID NO: 84739 - DNA, 50 bp, homo sapien
taaaaaggaaatcttgaaggtagcaragtagaagcaaatacgacatacaa

SEQ ID NO: 84740 - DNA, 50 bp, homo sapien
aatggaggaaaaatgagatgattcayaagtgacttaattaccaaaaacaa

SEQ ID NO: 84741 - DNA, 50 bp, homo sapien
ttctgaggcatgctaagatagggcaygaccgaacttggtttgcctggctg

SEQ ID NO: 84742 - DNA, 50 bp, homo sapien
tctttattaagaataactaatgtccragaacacattttgatgcatattgt

SEQ ID NO: 84743 - DNA, 50 bp, homo sapien
ttggttaagtatataaaatatctaayaaatggtggaacaagcagagctta

SEQ ID NO: 84744 - DNA, 50 bp, homo sapien
gcttaacaaagtttcttattgtaagrccaaagttataaccaagaaggttt

SEQ ID NO: 84745 - DNA, 50 bp, homo sapien
atttaggtattcttgctcaaatctayaaaaggagaatcaaattggcaagt

SEQ ID NO: 84746 - DNA, 50 bp, homo sapien
gaatagaagggagctaagctaaagcraagaaagtagtctttatcattctt

SEQ ID NO: 84747 - DNA, 50 bp, homo sapien
aagcatgagtgtaaatacagacccaraagagtatagctcgatttcttcaa

SEQ ID NO: 84748 - DNA, 50 bp, homo sapien
aatgtgagggacatgatgatcttcargattggagtctatctatggaacca

SEQ ID NO: 84749 - DNA, 50 bp, homo sapien
ttccatattattcttgataaaacgaygataaaaacatatccattgaaccc

SEQ ID NO: 84750 - DNA, 50 bp, homo sapien
attaactggccctactttactactayaagcttaaatccaggacagcaata

SEQ ID NO: 84751 - DNA, 50 bp, homo sapien
aaccttcatatgattctttatctcaraacattcagtttacaaactctaat

SEQ ID NO: 84752 - DNA, 50 bp, homo sapien
agaaatttggataagggaatgcttgytcatatggaaagtctgtccatgat

SEQ ID NO: 84753 - DNA, 50 bp, homo sapien
tagatcacaagcaaattagtctgacrccatgaactctccccctcactcca

SEQ ID NO: 84754 - DNA, 50 bp, homo sapien
gcccacctggggccagtgtgtcaaarttagagtagaggaggtttgagtca

SEQ ID NO: 84755 - DNA, 50 bp, homo sapien
tatacaatagagtatagagcaaggcrtggctaaaatacaagcacagcaag

SEQ ID NO: 84756 - DNA, 50 bp, homo sapien
gataaataggcatcttacaggcttgraagcaggctaaaaatatccgctaa

SEQ ID NO: 84757 - DNA, 50 bp, homo sapien
tctctagaatataggtgcttacaaayaattttgattatgatgaatatatt

SEQ ID NO: 84758 - DNA, 50 bp, homo sapien
ttgatttgccctatgtagtcactaaygtcttagagtttggtagaaagttg

SEQ ID NO: 84759 - DNA, 50 bp, homo sapien
aagattgagatattcaaattgttcaktctttttcagaacttaaaggaaaa

SEQ ID NO: 84760 - DNA, 50 bp, homo sapien
ttgaaatccttttgcatctctctgawctattgcacaaaaatttaaatctt

SEQ ID NO: 84761 - DNA, 50 bp, homo sapien
caagccccatgccaaggtacaaagamgtatactccgcccaccagggggct

SEQ ID NO: 84762 - DNA, 50 bp, homo sapien
gtatataggggagatgaataagacayggatgaactggaaaatgagttaat

SEQ ID NO: 84763 - DNA, 50 bp, homo sapien
ggaataaacatgatacagtattagaygaagtttataaatcaaataattta

SEQ ID NO: 84764 - DNA, 50 bp, homo sapien
acacctttctagcttcagccatgtgratgaaataaaggaatttcttcact

SEQ ID NO: 84765 - DNA, 50 bp, homo sapien
tacatgagaatcaaacagccttctarggaattgaatatgtaggagactat

SEQ ID NO: 84766 - DNA, 50 bp, homo sapien
ggtagtttgcatttcaagtagggtaygttagtttagagagttctgagaac

SEQ ID NO: 84767 - DNA, 50 bp, homo sapien
ctcattaggggtttcttcacttatakctgggatagtcctataaaaagcta

SEQ ID NO: 84768 - DNA, 50 bp, homo sapien
gaactgggttaatgtcagtgaaatcrgaagcttgttcatcagcatgatgg

SEQ ID NO: 84769 - DNA, 50 bp, homo sapien
actgttttaagaaatagcagagataytaccaagatggaaattcaacacac

SEQ ID NO: 84770 - DNA, 50 bp, homo sapien
gacagactaaacttcagaatttttaygacgtataaccatgcttttctttg

SEQ ID NO: 84771 - DNA, 50 bp, homo sapien
tttggatctcaattcactggtcaatraactagattcttcagaggtatttt

SEQ ID NO: 84772 - DNA, 50 bp, homo sapien
tacatgacataattatgttctaacaracgaaaacacactaatttttctgc

SEQ ID NO: 84773 - DNA, 50 bp, homo sapien
gttatccatgaataatacatttcctkttgtggaagcaggaggagaagaaa

SEQ ID NO: 84774 - DNA, 50 bp, homo sapien
tttgttgttgtcctgatgggttacayaataatgacaataatgacactaat

SEQ ID NO: 84775 - DNA, 50 bp, homo sapien
ggagtaatttcacaacagagacactraaacagccaatatcacagtctgtg

SEQ ID NO: 84776 - DNA, 50 bp, homo sapien
aatgtgtcttacctccataattccartgctacaagtatttaaatatatca

SEQ ID NO: 84777 - DNA, 50 bp, homo sapien
tctccattctattctcttggggagaygccacttgcttcttgtgtatctaa

SEQ ID NO: 84778 - DNA, 50 bp, homo sapien
attataaccattgagatgaatactcyaaggcacctgaaaattttaataga

SEQ ID NO: 84779 - DNA, 50 bp, homo sapien
agactgtatctgggatctgaaatcartactaagaaaaccacttagctttg

SEQ ID NO: 84780 - DNA, 50 bp, homo sapien
agatatgaaatttgattcagctgackggatagtatcaagataatttatat

SEQ ID NO: 84781 - DNA, 50 bp, homo sapien
tagccacagctaaactactgtgccawtgtattaaccagtatctaattaca

SEQ ID NO: 84782 - DNA, 50 bp, homo sapien
actggtaaagtaaaacagaatggtaragaatatcataatattcttagtta

SEQ ID NO: 84783 - DNA, 50 bp, homo sapien
tttacattttacaatgagtttatccmgacataatcctatcataagtccag

SEQ ID NO: 84784 - DNA, 50 bp, homo sapien
cattgtgtaaacaccatagagtataygtacacaaacttagatggtaaacc

SEQ ID NO: 84785 - DNA, 50 bp, homo sapien
gatcagaaaaaaggatccttatagamgagactgagaggtaggaagggaac

SEQ ID NO: 84786 - DNA, 50 bp, homo sapien
aacttgcatcactccccttgtgtcckcttaacaaacaatcacatcactgc

SEQ ID NO: 84787 - DNA, 50 bp, homo sapien
caaaagctgaattgggcaaaaaacaygacatccccacccattttgtttag

SEQ ID NO: 84788 - DNA, 50 bp, homo sapien
gggtacgagggtggagattagcaacsagaaatgaaccagagatttacata

SEQ ID NO: 84789 - DNA, 50 bp, homo sapien
cttgtaagtggaattaaatttatgaygcaaacatgtaaaaaatgtagttt

SEQ ID NO: 84790 - DNA, 50 bp, homo sapien
atctgagccctttcaaactcaaggakaaatacaggtgggctcagtcccct

SEQ ID NO: 84791 - DNA, 50 bp, homo sapien
acatgatgccaatattttagtgttcmaacttccaattaggaaagtaacat

SEQ ID NO: 84792 - DNA, 50 bp, homo sapien
aacaaacatttctctgttcctcatayacaagtttcagacataggttcttt

SEQ ID NO: 84793 - DNA, 50 bp, homo sapien
gatactgaatagtttacagacttgartaattattgggagaggtggagtca

SEQ ID NO: 84794 - DNA, 50 bp, homo sapien
atgtatatgatgcagaggagtcacaygtatgaaaaaactgactcttatga

SEQ ID NO: 84795 - DNA, 50 bp, homo sapien
tactttgctttaattttctatgttcratgatgattattaataagaaaagt

SEQ ID NO: 84796 - DNA, 50 bp, homo sapien
gttgattgacaggaagagagtatgakaacacattttgtggtaataaaaat

SEQ ID NO: 84797 - DNA, 50 bp, homo sapien
agcagtgttacacttctgtattaaartcacaagaaaagcaaatgatctat

SEQ ID NO: 84798 - DNA, 50 bp, homo sapien
ttaaacaatgagcagtctgggttgaytaataacactggggctgatgttgt

SEQ ID NO: 84799 - DNA, 50 bp, homo sapien
cctctactatccctacagtagtggasctaataagagtcttgctcttgctc

SEQ ID NO: 84800 - DNA, 50 bp, homo sapien
cctcagttttagctttcagtttacayacataatattctctcccaagtgac

SEQ ID NO: 84801 - DNA, 50 bp, homo sapien
cttgaatatcagtttggtagattaaygtggaagtaagtgaagggaaagtt

SEQ ID NO: 84802 - DNA, 50 bp, homo sapien
tgagaaaaactctggagagcttcagracttaaaatgtgatcagaaaaaag

SEQ ID NO: 84803 - DNA, 50 bp, homo sapien
acagacactggatgccctgaatgacrcactggagaaggtgagccgtgggc

SEQ ID NO: 84804 - DNA, 50 bp, homo sapien
aacctcaattgttttgagattcaaaygtaacacagggaatagtataccag

SEQ ID NO: 84805 - DNA, 50 bp, homo sapien
atgcatgaataaatggaaaaatggastcatctcaaaactaacataaatcc

SEQ ID NO: 84806 - DNA, 50 bp, homo sapien
gaatggggggagttctaacagtctaycacaccagtgtttcttaatattgt

SEQ ID NO: 84807 - DNA, 50 bp, homo sapien
gaatataaagagtgtgaaattgaaamggtattcctagcttaacagcacac

SEQ ID NO: 84808 - DNA, 50 bp, homo sapien
ttactgtagcatgcactaggacaaaygatcaggccatcccaagggcccag

SEQ ID NO: 84809 - DNA, 50 bp, homo sapien
aagggctgaggaaccttctctatgaygttcagttgacctagaggtgactc

SEQ ID NO: 84810 - DNA, 50 bp, homo sapien
ggagacaaactaggacgatacttgasgattgtgtgggggaccctgagtag

SEQ ID NO: 84811 - DNA, 50 bp, homo sapien
ggctatatatcgatatgtgccaataygaaaaaaatgtataaaatgcaatc

SEQ ID NO: 84812 - DNA, 50 bp, homo sapien
gcaaatgttgccaaaatacagacacyggatgccctgaatgacgcactgga

SEQ ID NO: 84813 - DNA, 50 bp, homo sapien
ccataagagtatgaaacagattaaartgagatctatgaactaatcatggt

SEQ ID NO: 84814 - DNA, 50 bp, homo sapien
ctatcaaagtcctcaaccttgatcayatctgaaaaatctttctttttttt

SEQ ID NO: 84815 - DNA, 50 bp, homo sapien
tgccccctgactcccttcttccgttrtcaaaactagcaatagcagggggt

SEQ ID NO: 84816 - DNA, 50 bp, homo sapien
tttcaggtatattactaaactagcargaatgataatctttctacagacat

SEQ ID NO: 84817 - DNA, 50 bp, homo sapien
gtgtccctggattaattattatacawctttgactgttatgaagtcatcat

SEQ ID NO: 84818 - DNA, 50 bp, homo sapien
ctttgcctgcaatactattcctccasatattcacttgggttgagtcctca

SEQ ID NO: 84819 - DNA, 50 bp, homo sapien
cattcttctctgtgagttagaagaamctttatcacagttttacacaaaga

SEQ ID NO: 84820 - DNA, 50 bp, homo sapien
gaggttttcatataatatgatcctargtattgcccatgaaatagcagaaa

SEQ ID NO: 84821 - DNA, 50 bp, homo sapien
aaaacaactttattctctgtccgtaycaatccaatctatcctgacttttg

SEQ ID NO: 84822 - DNA, 50 bp, homo sapien
tttattccaaataagacaacttttayacattctaaggagaggccaggtgc

SEQ ID NO: 84823 - DNA, 50 bp, homo sapien
caaaggaaatcctgaaatgaagatawgatcaaattgaacacaaagcaata

SEQ ID NO: 84824 - DNA, 50 bp, homo sapien
aagtgaacttagatttgtaatgcaargaagaaaagataatgcaatagttg

SEQ ID NO: 84825 - DNA, 50 bp, homo sapien
gggaaaggccatttcagctcattgayaggtagtagaggattaacgtaatt

SEQ ID NO: 84826 - DNA, 50 bp, homo sapien
aattagaaataatatttgtggagtaygatattgataagactatactagag

SEQ ID NO: 84827 - DNA, 50 bp, homo sapien
taaaatggtattcaaaagaaagggaygatcaaaggaagcaactgcagacg

SEQ ID NO: 84828 - DNA, 50 bp, homo sapien
tagcaggacattttaaagtaagtcayggagaaaaatcatcagatagcaga

SEQ ID NO: 84829 - DNA, 50 bp, homo sapien
caaagtcagtgaaattttcaacaagrcagcgtaacatccatcactaacct

SEQ ID NO: 84830 - DNA, 50 bp, homo sapien
tgtcttccaacaggtactttaaatawgtctcattcaagtggtaatttctt

SEQ ID NO: 84831 - DNA, 50 bp, homo sapien
ccaatgtgtgtttcccttatgcttcygaaattgctgagttagagcctaca

SEQ ID NO: 84832 - DNA, 50 bp, homo sapien
ctgggcagacctgatgatgatcctckatctttattcttatttcttcctca

SEQ ID NO: 84833 - DNA, 50 bp, homo sapien
aatcgtctggctgctgttcctctacsatttttatggcccaccccttacat

SEQ ID NO: 84834 - DNA, 50 bp, homo sapien
ctatactgtaatgaaaaatccacaaygaggaaagtaaactatttgtgctc

SEQ ID NO: 84835 - DNA, 50 bp, homo sapien
gagcatatttccaaatggttgtagcrcatcagagaaaaatgtcacaaatc

SEQ ID NO: 84836 - DNA, 50 bp, homo sapien
aacgtcagaattcaggataaaattamggatgaaagtcatatttatagttg

SEQ ID NO: 84837 - DNA, 50 bp, homo sapien
tttaaggatgttcagtacttcatcaktcactagtatttattgaataccta

SEQ ID NO: 84838 - DNA, 50 bp, homo sapien
atctatgtatggactaggtattgacragtattagggaattatcctcattt

SEQ ID NO: 84839 - DNA, 50 bp, homo sapien
tggaagtattcatcaaaagtaactawcacacttgttcatcaatgagattc

SEQ ID NO: 84840 - DNA, 50 bp, homo sapien
tttgagctagaaccaacagaacttayccaacaattaggaaggaaaggcaa

SEQ ID NO: 84841 - DNA, 50 bp, homo sapien
attcagtctgtgatgcactcttcccyacatatattgcatgatttttaaaa

SEQ ID NO: 84842 - DNA, 50 bp, homo sapien
atcattgtctgggttttacagatagraaaatttaggtacatagaattatc

SEQ ID NO: 84843 - DNA, 50 bp, homo sapien
gctgcatcctaacaaggcagagggcrtcagattgtgagacagagcaagtg

SEQ ID NO: 84844 - DNA, 50 bp, homo sapien
tgagggccaggcacattttatattcrcgctttgaggaagtgctgaacatg

SEQ ID NO: 84845 - DNA, 50 bp, homo sapien
cagttactggagggatacccactgamataattagtaaagtcattttaaat

SEQ ID NO: 84846 - DNA, 50 bp, homo sapien
ttggaaccacttgtcacctagccaakcagaatgaaggccactggctctct

SEQ ID NO: 84847 - DNA, 50 bp, homo sapien
ttctttcattttgagaatgtgtgatratagtaaaggtggagaacctgtgc

SEQ ID NO: 84848 - DNA, 50 bp, homo sapien
ctccctactcggccagttatccaagmatttgaaattgactttcacaggac

SEQ ID NO: 84849 - DNA, 50 bp, homo sapien
gccgggtgttccgcaggtgtgaaacratttgctttctggctttgtcatct

SEQ ID NO: 84850 - DNA, 50 bp, homo sapien
ttcaggtagggctcattttatcacamgtatacacaagctactgttactag

SEQ ID NO: 84851 - DNA, 50 bp, homo sapien
ttcacacaacttacagatttttgaamgaaagtcatttgactatttttaaa

SEQ ID NO: 84852 - DNA, 50 bp, homo sapien
tgaaaatttctgtttcccacgaaacratgacttctcttctcagaaaaatg

SEQ ID NO: 84853 - DNA, 50 bp, homo sapien
ctgtgtcctagctaaccctagctaaragcaaggaatattcactgaccacc

SEQ ID NO: 84854 - DNA, 50 bp, homo sapien
ccattgagacgtcacatgaaagaccrctcatttaacttgaggccaagtgc

SEQ ID NO: 84855 - DNA, 50 bp, homo sapien
agctaggacacagcagatggctaagyacatcagaagtaaggatacttggg

SEQ ID NO: 84856 - DNA, 50 bp, homo sapien
ggttagtagaatcctacagtgtgaartgttgcatagagtgcaacacacag

SEQ ID NO: 84857 - DNA, 50 bp, homo sapien
gtgttggccatccaccttagtcaccrcattagctggcctgtctggtaaaa

SEQ ID NO: 84858 - DNA, 50 bp, homo sapien
tgttaacaccacacctaccttcttaygaacacagcttgctatgtcaggtc

SEQ ID NO: 84859 - DNA, 50 bp, homo sapien
aatcagcagtgtagaactaaaaacaytgagctctctcatgacaaacactt

SEQ ID NO: 84860 - DNA, 50 bp, homo sapien
ttgaaacctcaagtaagcccaatgayatagtaagaaacagaacacaggag

SEQ ID NO: 84861 - DNA, 50 bp, homo sapien
ttggtagaaagaatctataagaggarcgttgccatggaatgccttcagtg

SEQ ID NO: 84862 - DNA, 50 bp, homo sapien
cagatcaattatataagcaattttasgggttagtgaagtatctttcacct

SEQ ID NO: 84863 - DNA, 50 bp, homo sapien
ttttagttgaaggcaagttatcaaaragatagtctgaagaaaccaagtga

SEQ ID NO: 84864 - DNA, 50 bp, homo sapien
gtttctctttataacatatatttcartagactcatggaagactcataata

SEQ ID NO: 84865 - DNA, 50 bp, homo sapien
tgatgcagaagaagatatagtgacasgaatatgctaaaagtgaacagaat

SEQ ID NO: 84866 - DNA, 50 bp, homo sapien
tctgcataccatctactatgaattgrcaatttgtagcctttgcatatgtc

SEQ ID NO: 84867 - DNA, 50 bp, homo sapien
atgctaggattctgtaagattatgcrgatttggaacaatctctagacaat

SEQ ID NO: 84868 - DNA, 50 bp, homo sapien
tgcagataagacctattagattgcayggtatttctcctgtaatatacaga

SEQ ID NO: 84869 - DNA, 50 bp, homo sapien
actacacttctagcctccaatgagamaatgtattccctttgtttttcttt

SEQ ID NO: 84870 - DNA, 50 bp, homo sapien
aatgtattattttttagttttcttayctacagcattttccttcagcatta

SEQ ID NO: 84871 - DNA, 50 bp, homo sapien
ataagaattccccctcttcacatgasgtattttttttttttttttttaac

SEQ ID NO: 84872 - DNA, 50 bp, homo sapien
atccctatagaatatgaaatccaccrcactggctgtcaataagctggcag

SEQ ID NO: 84873 - DNA, 50 bp, homo sapien
tttacagatgagaaaactacagagasattagatgatttgtgttggcacag

SEQ ID NO: 84874 - DNA, 50 bp, homo sapien
tgtagtgggaattggaaaaatgtatraggatgatttaagatgggtatttt

SEQ ID NO: 84875 - DNA, 50 bp, homo sapien
tgacaatacatctttgtcttttagayctcaaaggagccatgctgatttta

SEQ ID NO: 84876 - DNA, 50 bp, homo sapien
taatttgtgagtataggggagtatgsactttcatatagagactcaatatg

SEQ ID NO: 84877 - DNA, 50 bp, homo sapien
tcaagcaggtttaggggaaaacaaaytgtagtcagaaggtttcttgctga

SEQ ID NO: 84878 - DNA, 50 bp, homo sapien
gataagatatgattctgatttaggcraatatggcattaaaaccaagagct

SEQ ID NO: 84879 - DNA, 50 bp, homo sapien
taaaaggtgggtggttctgtaccacrggcattaaagtcacagataaaatg

SEQ ID NO: 84880 - DNA, 50 bp, homo sapien
ctgatctgtaaagatgaatgttgaarttaaagtaacagatataatgtttg

SEQ ID NO: 84881 - DNA, 50 bp, homo sapien
aagtaataagtgaaaccccatgagartatgagcctaactacaagaatgta

SEQ ID NO: 84882 - DNA, 50 bp, homo sapien
tttccaacattgccagtttctagtamagtaataatcttgtttttcagttg

SEQ ID NO: 84883 - DNA, 50 bp, homo sapien
ttattttactgtttgataatttacartgattctatactttaatttgaaaa

SEQ ID NO: 84884 - DNA, 50 bp, homo sapien
aagactagtattttaatctgtagacygagtgaaaataaaattgccctaac

SEQ ID NO: 84885 - DNA, 50 bp, homo sapien
caagtacacagtctcacattcttcartaaacttggcacaggtttaaagtc

SEQ ID NO: 84886 - DNA, 50 bp, homo sapien
gccctaaccaatgtaatgggcataayccaatctgttaagggcctaaatag

SEQ ID NO: 84887 - DNA, 50 bp, homo sapien
gatctgccacctgcaaactggagacygaggatagcctgtgatagatatag

SEQ ID NO: 84888 - DNA, 50 bp, homo sapien
aacaacccagcaaactagaagaacamcataagaatgcgtaattattattc

SEQ ID NO: 84889 - DNA, 50 bp, homo sapien
ggagagattcttaatgttcaaattawaaatctacttgctattatcagatg

SEQ ID NO: 84890 - DNA, 50 bp, homo sapien
tggtaaaatttaagctttctgataaytagatgtcaggaatacccaggttt

SEQ ID NO: 84891 - DNA, 50 bp, homo sapien
atcccagtcaggcatacgtggtgcawtaactgatcacgttcagcatctgg

SEQ ID NO: 84892 - DNA, 50 bp, homo sapien
ggaagtaaaggacgctagtataaaaygattgtgctgaccttgaaggagaa

SEQ ID NO: 84893 - DNA, 50 bp, homo sapien
aagaagaatgtgccctctatttaggyaactgatagtttggcttaagacaa

SEQ ID NO: 84894 - DNA, 50 bp, homo sapien
tgcacctagtttttctccttcagtcycacattatggtttacctacttatt

SEQ ID NO: 84895 - DNA, 50 bp, homo sapien
tataaatatgtgattttctacctatwaccacattacataaacttaccagg

SEQ ID NO: 84896 - DNA, 50 bp, homo sapien
agacaataaaagttgggaattcatasaggatgttttatgcatggttgcat

SEQ ID NO: 84897 - DNA, 50 bp, homo sapien
cattccacctgaaatacatgtgatcrtaagaagcaacaatagttaatgtt

SEQ ID NO: 84898 - DNA, 50 bp, homo sapien
agactttttatactgtccagactatyacatgcaagagacatgaactcatt

SEQ ID NO: 84899 - DNA, 50 bp, homo sapien
gtgggttctatattcacagattcaaycggctggatagaaaatatttgaga

SEQ ID NO: 84900 - DNA, 50 bp, homo sapien
aatacataagtaatatgcagagtttyacaacataaatgacaaaatgtcca

SEQ ID NO: 84901 - DNA, 50 bp, homo sapien
ctgtgaaacaaaagcatactagcaamatatattacaaagaacatggataa

SEQ ID NO: 84902 - DNA, 50 bp, homo sapien
acaaaaaacaacaaattaatctcaaygccagcagaagaaaagaaataact

SEQ ID NO: 84903 - DNA, 50 bp, homo sapien
gagtcattgagttctatctaacctcyagtctacaacttttggctcttaat

SEQ ID NO: 84904 - DNA, 50 bp, homo sapien
cctctttaacaaactacccaagtgaygaactatatccaaatgtaacttag

SEQ ID NO: 84905 - DNA, 50 bp, homo sapien
attatattatcttcaccttatattaycttctaataacctcaaataaagct

SEQ ID NO: 84906 - DNA, 50 bp, homo sapien
atatgagacagagctgcctgcatgaragtagtaaagccaggtactgtaat

SEQ ID NO: 84907 - DNA, 50 bp, homo sapien
gttctcacatagaatgtaaaaaaaaytaatgaagtacattgccaggattg

SEQ ID NO: 84908 - DNA, 50 bp, homo sapien
gggctgttttgggcagtagatgaaayagcttgtgaggcatctggcacaga

SEQ ID NO: 84909 - DNA, 50 bp, homo sapien
gaatgtttagtcattagtgttattargaaatcatagttatttaatttatg

SEQ ID NO: 84910 - DNA, 50 bp, homo sapien
actaacattttaaaacctgtgctctwaaacagtggttctcaacaatggtt

SEQ ID NO: 84911 - DNA, 50 bp, homo sapien
ccagctctcttccagcattggttgamtatttaaaatcttgatttcattta

SEQ ID NO: 84912 - DNA, 50 bp, homo sapien
aggaggaaactcaagctgttgcctaytaagatccatgacttactttttaa

SEQ ID NO: 84913 - DNA, 50 bp, homo sapien
gcaacgatgattccatgactctgagsatgaactagtaggtagagaacatc

SEQ ID NO: 84914 - DNA, 50 bp, homo sapien
atccttcagattatacattttatcaygagaaagcttgtgaggaaaccaca

SEQ ID NO: 84915 - DNA, 50 bp, homo sapien
tgtgcctctcctttgtagacacttcragtccattctatttcattcaaaaa

SEQ ID NO: 84916 - DNA, 50 bp, homo sapien
tgggagcaggcacagaaaggtaggaygacctagcttaaatccatatttca

SEQ ID NO: 84917 - DNA, 50 bp, homo sapien
attaacatatctctctaatgtataawtgtgcagaaaattgaagttgaaaa

SEQ ID NO: 84918 - DNA, 50 bp, homo sapien
aatgtatttcttctaacactgtggcraaataggtggtgttcacaccatct

SEQ ID NO: 84919 - DNA, 50 bp, homo sapien
ctttgccttctctcatacttagaaaygtcatatgacttgttctttacacc

SEQ ID NO: 84920 - DNA, 50 bp, homo sapien
tctagaagtaacgagaggtattttayaggcagaatttcacctaatagaat

SEQ ID NO: 84921 - DNA, 50 bp, homo sapien
attatgtaccactatgcacatctaaragaaaaagcctgcagtatagccaa

SEQ ID NO: 84922 - DNA, 50 bp, homo sapien
atggcaattctaatagctatctgtayaatgcaaactttactaagctacta

SEQ ID NO: 84923 - DNA, 50 bp, homo sapien
aggatggaacagtttggagggctcgraagaacacaggaaaatgtgagaaa

SEQ ID NO: 84924 - DNA, 50 bp, homo sapien
acatattagttacaggtctttcacaratttcttttataatattgaggatg

SEQ ID NO: 84925 - DNA, 50 bp, homo sapien
tgcttgtgtggctctccactttatgraaatgggaatagtgataggtactg

SEQ ID NO: 84926 - DNA, 50 bp, homo sapien
atttatgatttaaagaatgactagastagtgtaaagggatgttagcaagg

SEQ ID NO: 84927 - DNA, 50 bp, homo sapien
agaattggaaaggaagaaatagtcartaatacgtcttttattttttcctt

SEQ ID NO: 84928 - DNA, 50 bp, homo sapien
acataacctgaattactaaggacctsacatttttactcattattctagag

SEQ ID NO: 84929 - DNA, 50 bp, homo sapien
aaaacttttaagctattgacataacrcaactattcaagataaaataatat

SEQ ID NO: 84930 - DNA, 50 bp, homo sapien
aattgaaaaatcaaccattgtcaacractttacatctgggaaaggcaaca

SEQ ID NO: 84931 - DNA, 50 bp, homo sapien
tctattttattattttgtgaccttayctcctaaaattaaataatgtatat

SEQ ID NO: 84932 - DNA, 50 bp, homo sapien
tttatcatctcacacagtttcttctytgtgcatgtgataaaagcagctaa

SEQ ID NO: 84933 - DNA, 50 bp, homo sapien
ctgctccagagtcacgctcttaaccrctacactaaatcttaatagtgtct

SEQ ID NO: 84934 - DNA, 50 bp, homo sapien
aataaaaaatcaactgaaattgttargtaatgtctatacagcttttccta

SEQ ID NO: 84935 - DNA, 50 bp, homo sapien
aagaatatagtaatgactgtcattgyaagtaaattatttaagttaacctc

SEQ ID NO: 84936 - DNA, 50 bp, homo sapien
attgtcattaaagagtaagaccatgratagttcacataataaatcatgtg

SEQ ID NO: 84937 - DNA, 50 bp, homo sapien
ctgagagttattggcaagtataccawaaagctctggtatagattaaaatt

SEQ ID NO: 84938 - DNA, 50 bp, homo sapien
tttctagccttgactgtctcttatayagctctacgtactttgtacctaca

SEQ ID NO: 84939 - DNA, 50 bp, homo sapien
aaatgtaagcaattctgaaaatacastgatggtcctgcacaaagctatta

SEQ ID NO: 84940 - DNA, 50 bp, homo sapien
actcaaaattcatgccccaggacaaktaacaaattactgtaagttgttag

SEQ ID NO: 84941 - DNA, 50 bp, homo sapien
gtttctcatatgaatagtcaaaaatygtgtgttctaaaagcaattcattt

SEQ ID NO: 84942 - DNA, 50 bp, homo sapien
tctttcataggagacaatgttgttakaatctgtctctaggggaaagttga

SEQ ID NO: 84943 - DNA, 50 bp, homo sapien
aagaacatttagctccactttgcaarcctgtttttaactctctgtattat

SEQ ID NO: 84944 - DNA, 50 bp, homo sapien
ttttatcacttgagcattgagagctrtatcttttcatagctctttctaac

SEQ ID NO: 84945 - DNA, 50 bp, homo sapien
atttttttcccaatatttatgatccrgaggtagagtcattacaaataaag

SEQ ID NO: 84946 - DNA, 50 bp, homo sapien
tgtttatttctagacattagaaaaaytatacggcttgggaaaaaagtctc

SEQ ID NO: 84947 - DNA, 50 bp, homo sapien
tttcttttaatactaatacagcaacygaaaagagtaaaaccttgacatgc

SEQ ID NO: 84948 - DNA, 50 bp, homo sapien
atttgacgcaaatactaaaacctgayattgacaaaatatgtattttagag

SEQ ID NO: 84949 - DNA, 50 bp, homo sapien
tcatattctggatgtatcatgtgacyctacctaatctttttcccgaaatt

SEQ ID NO: 84950 - DNA, 50 bp, homo sapien
ccaaggatggtatataactaatcccwttctagctacatataagtaaatgt

SEQ ID NO: 84951 - DNA, 50 bp, homo sapien
actcttctattctagttaaatataaygttgaatttcagttatacataaat

SEQ ID NO: 84952 - DNA, 50 bp, homo sapien
caaataatttttttgatgaatacacragtttgaaaataaagttttattat

SEQ ID NO: 84953 - DNA, 50 bp, homo sapien
ttgcttcaggcgcagatttcatcatyaccgtcataaacagcaagtataaa

SEQ ID NO: 84954 - DNA, 50 bp, homo sapien
atacctacagaagggtcagattatamcctacagaaggggtcagatagtaa

SEQ ID NO: 84955 - DNA, 50 bp, homo sapien
aaaagtgaagagttaatcaaaggaamctagtgcttcattccttaaatttg

SEQ ID NO: 84956 - DNA, 50 bp, homo sapien
acgaagtttctctgaatccttggacmatggctgttgcattcacatcatgt

SEQ ID NO: 84957 - DNA, 50 bp, homo sapien
aaccatgatctggttcagaatagtawcatttacctgggaacccaattcag

SEQ ID NO: 84958 - DNA, 50 bp, homo sapien
ttgagcatgaaatcttccagcatcckaataaaacatttcactttgaaaag

SEQ ID NO: 84959 - DNA, 50 bp, homo sapien
tcccattcaaacctcacaaaggagaygaaaatttgattgggtctgccagt

SEQ ID NO: 84960 - DNA, 50 bp, homo sapien
aagaattgcatgatcatcacatgtawggttgctctttacaacattcttga

SEQ ID NO: 84961 - DNA, 50 bp, homo sapien
tcacctctcttagtatctattcaagscttttttattttgggggacacatc

SEQ ID NO: 84962 - DNA, 50 bp, homo sapien
ttagtttttgtctcagttatatagasagcattcgatcttcttaaaaacac

SEQ ID NO: 84963 - DNA, 50 bp, homo sapien
tcaactgaattaggcagtcttggatyagataaattacatgtgatactttg

SEQ ID NO: 84964 - DNA, 50 bp, homo sapien
ttcatccataaaacaatcgtgcaacwatacagcacagtaaactcttcctt

SEQ ID NO: 84965 - DNA, 50 bp, homo sapien
aatacatacttatgtgaagtaagtakgtgaactcaaatacaaagccacat

SEQ ID NO: 84966 - DNA, 50 bp, homo sapien
ctaccaatcaacgaagtgccaaataycagaataaggtgatccaatagtat

SEQ ID NO: 84967 - DNA, 50 bp, homo sapien
aaaacgtgttggtctgtttcttaccyagagatgagcctcaaatatatttt

SEQ ID NO: 84968 - DNA, 50 bp, homo sapien
gcctggccaaaacgatttttctaccratcaacgaagtgccaaatatcaga

SEQ ID NO: 84969 - DNA, 50 bp, homo sapien
ctttcatactatcaggcaggaataamagattctcttgggatcatctagtg

SEQ ID NO: 84970 - DNA, 50 bp, homo sapien
gtatataatggttatgtttgttgagyaatgtttgttgatggactacacta

SEQ ID NO: 84971 - DNA, 50 bp, homo sapien
agaaaatacagctagaggcaaaatarcttgagatacttttggagacgtcc

SEQ ID NO: 84972 - DNA, 50 bp, homo sapien
tcctttatttcttagatcgcaacatratgtaaaattaactatgtcttcta

SEQ ID NO: 84973 - DNA, 50 bp, homo sapien
gttcaggcagcaaccaagtacctgamcaagaaagtcaatctcctataaaa

SEQ ID NO: 84974 - DNA, 50 bp, homo sapien
ctgtttcacccaccgacaaggatgcyagtaaaagacccagagactcctgg

SEQ ID NO: 84975 - DNA, 50 bp, homo sapien
aaaggacaatcgaagcaactcttgaracattctaaggttaaaaatattca

SEQ ID NO: 84976 - DNA, 50 bp, homo sapien
agggcctgatttagaccatgagaaaycctcactttattatgcagctagaa

SEQ ID NO: 84977 - DNA, 50 bp, homo sapien
cgtgttttccttcccattacagcttraaaacgtagtagtgtggtgttcac

SEQ ID NO: 84978 - DNA, 50 bp, homo sapien
gagatgatactgttgtctttgaaaaygtagtaaggggccataagccaatg

SEQ ID NO: 84979 - DNA, 50 bp, homo sapien
tgagatagttaaacaacttatatagrcgtaaattttcttcccgtttttta

SEQ ID NO: 84980 - DNA, 50 bp, homo sapien
ctgtggcactattgtctgaaatctgmaaacaaatactaaggagaataaag

SEQ ID NO: 84981 - DNA, 50 bp, homo sapien
cagtcatgtcttttttggtctttacsatcagcaatcactactaacagtca

SEQ ID NO: 84982 - DNA, 50 bp, homo sapien
cattatttattcactaaaaccttcawtgaagaaaatgtgttgtttttcat

SEQ ID NO: 84983 - DNA, 50 bp, homo sapien
tagacttaatcttcaagtcaacattrtttattcactaaaaccttcaatga

SEQ ID NO: 84984 - DNA, 50 bp, homo sapien
tctatttcctgatcccttaggcatgsaagatggatacctatctcaagggc

SEQ ID NO: 84985 - DNA, 50 bp, homo sapien
gcaattgatcaaatagcccagtaaasttagaggtatatagatgctgtagt

SEQ ID NO: 84986 - DNA, 50 bp, homo sapien
gaaatacaaagcagttgctaactacrataggattcaaattgtgaaagtgg

SEQ ID NO: 84987 - DNA, 50 bp, homo sapien
gtggatggactcgatgttttaattckcaaaaaagtctctacatccagagt

SEQ ID NO: 84988 - DNA, 50 bp, homo sapien
tgaggcaaatctgcattcaaaactakgagtacacaactattttgacagtt

SEQ ID NO: 84989 - DNA, 50 bp, homo sapien
aatttctgtagattgttcaatgtgaygtacctattgatccatactgtatt

SEQ ID NO: 84990 - DNA, 50 bp, homo sapien
taaaaatgaattactgtattcaaacratcatactaaaatgtgcaaaagaa

SEQ ID NO: 84991 - DNA, 50 bp, homo sapien
tcccactccaccctacaatgtctacrgatgccagaactgtggcagggagc

SEQ ID NO: 84992 - DNA, 50 bp, homo sapien
ctcacgaaaccactttctttgcttawcaatcagaagcaactcctcatcca

SEQ ID NO: 84993 - DNA, 50 bp, homo sapien
ctatatttacctttggtgcaattcarctcaactttcctcttttaaaagtc

SEQ ID NO: 84994 - DNA, 50 bp, homo sapien
tacctggaagaagtttgaaaataaastcagggataatatgaatgtagagg

SEQ ID NO: 84995 - DNA, 50 bp, homo sapien
agccttgaatacatcttcattttaartctgcatcttgaacactgaaaacc

SEQ ID NO: 84996 - DNA, 50 bp, homo sapien
atgtgttttaactcctttaatgccgyagtatattctcattacacaaacgt

SEQ ID NO: 84997 - DNA, 32 bp, homo sapien
ctagctgacagatcttmaagtggctgagcaat

SEQ ID NO: 84998 - DNA, 50 bp, homo sapien
gtaattttgcttttagaagaatatcrtcttgaagagtaccatctcatgaa

SEQ ID NO: 84999 - DNA, 50 bp, homo sapien
cccaacccatataattcacaatgtcrtagaatgctaaatgcgagttaaat

SEQ ID NO: 85000 - DNA, 50 bp, homo sapien
aataaatgacaagttaatgggttggraatagattaacacgtatatgatta

SEQ ID NO: 85001 - DNA, 50 bp, homo sapien
tcaagatatttttcagtccaatatcyaaactggaacccatcattttcgtt

SEQ ID NO: 85002 - DNA, 50 bp, homo sapien
cgtgagcagtccatctaaaacctgargcaaatcattaaaagtggaaaagg

SEQ ID NO: 85003 - DNA, 50 bp, homo sapien
aatatcactcacttttgaatgaataygaaataccacattttgtagagtag

SEQ ID NO: 85004 - DNA, 50 bp, homo sapien
gtaattgagcgggaagtccaatgaasaagtctttgggatttagaactaca

SEQ ID NO: 85005 - DNA, 50 bp, homo sapien
taattgtaataatcaatgaaatcatwagacaggaatggttttctacattc

SEQ ID NO: 85006 - DNA, 50 bp, homo sapien
tcacaccttgagaaccagcgtgttaraattactctatccagtatggcagc

SEQ ID NO: 85007 - DNA, 50 bp, homo sapien
aatcctcctgaaaggcagtggcatarcaccataaaaaggacgcgaattta

SEQ ID NO: 85008 - DNA, 50 bp, homo sapien
aacatttttaagacaggcaatgaaasgtactatagtcacaacaatgtgat

SEQ ID NO: 85009 - DNA, 50 bp, homo sapien
aaacttagtatgagtaagaactaaargaagagagtcttggaaaatgaaga

SEQ ID NO: 85010 - DNA, 50 bp, homo sapien
tccttttatttatcattggtgtcaasgtttaaaggcatcaaaagccatgt

SEQ ID NO: 85011 - DNA, 50 bp, homo sapien
aaggttttgtttgagtaggtggtaasgtctgacacctgagaggcaggcag

SEQ ID NO: 85012 - DNA, 50 bp, homo sapien
catagcaataactttagtcagctagyaggattccttcaatagttttaccc

SEQ ID NO: 85013 - DNA, 50 bp, homo sapien
tatctcttccaattctgaaatcctayggttctctttttcctaaaagccta

SEQ ID NO: 85014 - DNA, 50 bp, homo sapien
atggtgcttcctgtaaaaatgttgayggtaaaatagctgttagcagttac

SEQ ID NO: 85015 - DNA, 50 bp, homo sapien
aaacaaatgccagttcacacaaatawcgtttacttcagggtaagagtgac

SEQ ID NO: 85016 - DNA, 50 bp, homo sapien
ctttacccatcctagcagcacatacmaggttagtatcctcaaataacgga

SEQ ID NO: 85017 - DNA, 50 bp, homo sapien
atctccattacatttgatttttttamcgtaagatttcgtattatcattaa

SEQ ID NO: 85018 - DNA, 50 bp, homo sapien
aaaacttggtgtgagactaaacctgkattccttttagatggttataaata

SEQ ID NO: 85019 - DNA, 50 bp, homo sapien
ctattttttctcaggctgacgaagasagagtaaagcatgaaatagttttc

SEQ ID NO: 85020 - DNA, 50 bp, homo sapien
acaggtaggtagaaaacatttaaaartatgcatacaagttcaggacttga

SEQ ID NO: 85021 - DNA, 50 bp, homo sapien
cattatagtttatttatgtataataygacttggctttagtatactgttca

SEQ ID NO: 85022 - DNA, 50 bp, homo sapien
acatccatgtggtatatttcacatcrccaccagcaatgatttcttgatca

SEQ ID NO: 85023 - DNA, 50 bp, homo sapien
tgcacccacatgttatgcaaaattcrctctaccacttccaaaaccctttt

SEQ ID NO: 85024 - DNA, 50 bp, homo sapien
acctcatatccagatgaacaactacrggatgaataaacaagcaataaaat

SEQ ID NO: 85025 - DNA, 50 bp, homo sapien
attcattgtttgtacatatgagttamaagggacagtgaggggccatgggc

SEQ ID NO: 85026 - DNA, 50 bp, homo sapien
catgcctgaataaatactgactgtakgaaggattatttttctgagatcat

SEQ ID NO: 85027 - DNA, 50 bp, homo sapien
tatcaattgttcaagccttagatgaraacatttactgattttacagtgta

SEQ ID NO: 85028 - DNA, 50 bp, homo sapien
gacttttagatttagaatcacatacmaacattgagagtgctttggtttca

SEQ ID NO: 85029 - DNA, 50 bp, homo sapien
gcttctaccaaaactaccattggagkacttacagaataccttatccatca

SEQ ID NO: 85030 - DNA, 50 bp, homo sapien
gccatttgtatatccttttttgagasaactgtttaagtccctggccaatt

SEQ ID NO: 85031 - DNA, 50 bp, homo sapien
gcagcggactggtttgtgatcaaagwctagtgaacctgtactgagatttg

SEQ ID NO: 85032 - DNA, 50 bp, homo sapien
acctaggctacaaatctgtaaagcargttactataatgattaggccattt

SEQ ID NO: 85033 - DNA, 50 bp, homo sapien
accaagtggacttagcattttacacyacttgtcctatttgtgtatttgct

SEQ ID NO: 85034 - DNA, 50 bp, homo sapien
ttatttcttatccattcattaacctkagagtcatatgaaaaatgctttac

SEQ ID NO: 85035 - DNA, 50 bp, homo sapien
ttaaccttggacaaattattaaatakcttagtccctgtcaactggaaaaa

SEQ ID NO: 85036 - DNA, 50 bp, homo sapien
aaagaagtttcttactctcatggackctaaagcaaaatccacacagaaaa

SEQ ID NO: 85037 - DNA, 50 bp, homo sapien
ttaactgtgaagtcagcttctcttcrctattctctgcacactaagccctg

SEQ ID NO: 85038 - DNA, 50 bp, homo sapien
tgccttaggaggtacttatttcccaygttcaaccaaaggcagaatgacca

SEQ ID NO: 85039 - DNA, 50 bp, homo sapien
aaactagttgatctacagttgatacrataacttaattcgtgaatgtcttt

SEQ ID NO: 85040 - DNA, 50 bp, homo sapien
atgggctggagtgtgaggataatcargatggtactgtttgtacctccgtg

SEQ ID NO: 85041 - DNA, 50 bp, homo sapien
aaccatgatctagtatatagcttatytaggaatactgtttacattatcat

SEQ ID NO: 85042 - DNA, 50 bp, homo sapien
gtaaagttagtgataatgacaggtastaacataatctttcaaaaaggtat

SEQ ID NO: 85043 - DNA, 50 bp, homo sapien
ttaagagatttatgcattccctgagkaacatcaatagatcgcctaaagat

SEQ ID NO: 85044 - DNA, 50 bp, homo sapien
gtttagattaaattatacacgtaacrcacagtaagcattaaatgtcttta

SEQ ID NO: 85045 - DNA, 50 bp, homo sapien
attaagaaactcctttaacatgacaytgatcatttgatagcaacagatac

SEQ ID NO: 85046 - DNA, 50 bp, homo sapien
ctctcaatgatattatcacaaatcartctggtaggtattatgcacatcag

SEQ ID NO: 85047 - DNA, 50 bp, homo sapien
aatgatgaactggaaataacaaaacrctggagaattacagctagctattt

SEQ ID NO: 85048 - DNA, 50 bp, homo sapien
attctctgaatgagcggtgcaaatakgggtaccaaaaattactcccattt

SEQ ID NO: 85049 - DNA, 50 bp, homo sapien
ggctctgtggtgaagggatatggccyaacaggaaaactaatgagggtaac

SEQ ID NO: 85050 - DNA, 50 bp, homo sapien
cttttctagattactttagtgaaaartgaataggtttaaagttaatatta

SEQ ID NO: 85051 - DNA, 50 bp, homo sapien
tttctcatcgtgaataggcaacaacrgtcttgaaaaagaaaaagataatg

SEQ ID NO: 85052 - DNA, 50 bp, homo sapien
ctgttgtctttatgcaaccatgtacrctattcagctaaaacttcatggta

SEQ ID NO: 85053 - DNA, 50 bp, homo sapien
ttagctgtgtttgtttgatccctatraaaacaggtccatgatttctctcc

SEQ ID NO: 85054 - DNA, 50 bp, homo sapien
tttatttcagtatttatcacttgaartaggaaaaaatagcaataattgga

SEQ ID NO: 85055 - DNA, 50 bp, homo sapien
aaataatctcagagctcagggtgtamgttaggactgattacaaggaaata

SEQ ID NO: 85056 - DNA, 50 bp, homo sapien
agacacagggtggggcatttgcacargacagagggtacatgcattagtga

SEQ ID NO: 85057 - DNA, 50 bp, homo sapien
tccatgtaaacacagcctaaaaatayagtatcaaatcaattttccataaa

SEQ ID NO: 85058 - DNA, 50 bp, homo sapien
caatatcacttctgctgaaggaaacratgtctgtaactgagaggcgtgta

SEQ ID NO: 85059 - DNA, 50 bp, homo sapien
aaagttgactacaggctatttgtcawaaaacttattctatttcctgcaat

SEQ ID NO: 85060 - DNA, 50 bp, homo sapien
tgttcttatgttattccgtccaaaamacctccaaggcatacaatcttcta

SEQ ID NO: 85061 - DNA, 50 bp, homo sapien
atatggccacacataaagatttatargtcagagattcattagtcagggga

SEQ ID NO: 85062 - DNA, 50 bp, homo sapien
aatgactatgactttgatgatagcamcctgagcttttaattttaccgtaa

SEQ ID NO: 85063 - DNA, 50 bp, homo sapien
cattatcatctccatgtttgtgcaaygtaatcataaagatacgttgtact

SEQ ID NO: 85064 - DNA, 50 bp, homo sapien
cttggttagaattgagtacttgagaractatatgaataattgcttgttga

SEQ ID NO: 85065 - DNA, 50 bp, homo sapien
aagatcactgagggaaaaggcaagarggtcttatggaatgctagtttatc

SEQ ID NO: 85066 - DNA, 50 bp, homo sapien
tgtcagtcactattatttattagtcragatcagatattcctcatagaaca

SEQ ID NO: 85067 - DNA, 50 bp, homo sapien
gatctttatataaaggactgttctawgaggaatatctgatcttgactaat

SEQ ID NO: 85068 - DNA, 50 bp, homo sapien
caacttttaagtactttaaacattcycccatataacaatattcatgccat

SEQ ID NO: 85069 - DNA, 50 bp, homo sapien
gtgctaatggaggttatcggtgcacrgatcaaaagggagatgccatgaaa

SEQ ID NO: 85070 - DNA, 50 bp, homo sapien
tattgaaacagtatagatcttctcgycactgcagtaccctaataccattt

SEQ ID NO: 85071 - DNA, 50 bp, homo sapien
ctgtctctaaagaacaagaagggaamcaaaccacaatcagaagccagcat

SEQ ID NO: 85072 - DNA, 50 bp, homo sapien
agatgtggaaattacaaggctggacrgacaacatggggtctcagatgagt

SEQ ID NO: 85073 - DNA, 50 bp, homo sapien
tttcttaaaggaagctattgtggtcraataaaggtttggaggtctgagct

SEQ ID NO: 85074 - DNA, 50 bp, homo sapien
ggtgtacagcatgcttacttcaaaayggctctgagaaacaaggcaacgat

SEQ ID NO: 85075 - DNA, 50 bp, homo sapien
ggtcactctgaaaggaggaggaagastaacggacaccttctcctcccctc

SEQ ID NO: 85076 - DNA, 50 bp, homo sapien
tctaagtatatcaggaatcacaggaraaataaggctttgattacgtgatt

SEQ ID NO: 85077 - DNA, 50 bp, homo sapien
ttattgagtagctagactcagagtcraggccatttggaaacagttgcttg

SEQ ID NO: 85078 - DNA, 50 bp, homo sapien
tagatagccaaataatttccttagcygcaaatatattccatgatctggaa

SEQ ID NO: 85079 - DNA, 50 bp, homo sapien
aggggaagtcattccttataatgcarcggataataattctgtagctgtgc

SEQ ID NO: 85080 - DNA, 50 bp, homo sapien
accctttgccctctcttgatacctarggtcctgaatgcagaaggtaagtg

SEQ ID NO: 85081 - DNA, 50 bp, homo sapien
ctccataagtagcaatacagacacargttttaatcttgaatcattacaaa

SEQ ID NO: 85082 - DNA, 50 bp, homo sapien
aatccattttgttgatctatagtaaygcttaggaaaaaagctagaaacag

SEQ ID NO: 85083 - DNA, 50 bp, homo sapien
actagatactttatactctatcattyaaacttcagaagaatgccaagggt

SEQ ID NO: 85084 - DNA, 50 bp, homo sapien
cagcatgaaagatgagaaatgaaagyattgatagtaattcagtttgattg

SEQ ID NO: 85085 - DNA, 50 bp, homo sapien
ccacagggacttgtataaagatctcraggcagaatgactgcatgtcatgg

SEQ ID NO: 85086 - DNA, 50 bp, homo sapien
tgtactgtagataattagacatccgyaccattaaagaatccttaaagtca

SEQ ID NO: 85087 - DNA, 50 bp, homo sapien
tgaatctttgtgatatggtagagaamgtttgataaagtgttcttgtgcct

SEQ ID NO: 85088 - DNA, 50 bp, homo sapien
tggtagtcattgatctgcattcataycttcagaggaaatgccactgaatt

SEQ ID NO: 85089 - DNA, 50 bp, homo sapien
ctcagctgcacatatctccaatgttyagcagcttgcatccccaaccactt

SEQ ID NO: 85090 - DNA, 50 bp, homo sapien
ctgaagttagcagcgtctattcgtartttctgacactcagctgcatggat

SEQ ID NO: 85091 - DNA, 50 bp, homo sapien
ttttgttttttcaatttagcaacttmaactgagtaagaattgctggcatc

SEQ ID NO: 85092 - DNA, 50 bp, homo sapien
ataaaacaatttatttccttttaaastatgaaaatccaagagagatttct

SEQ ID NO: 85093 - DNA, 50 bp, homo sapien
tgtaatagttatcatcaatgtcatcrctctttggggccgcccagatgaaa

SEQ ID NO: 85094 - DNA, 50 bp, homo sapien
tttctggcataaacaatatcaataaygcttttgtaatttctaggtttcta

SEQ ID NO: 85095 - DNA, 50 bp, homo sapien
ttatgagttttactccaacattacaraattgcacaaaatgagctttttat

SEQ ID NO: 85096 - DNA, 50 bp, homo sapien
gttttgtttaccccaacacctaatamacttctgacttcgctgatgtctac

SEQ ID NO: 85097 - DNA, 50 bp, homo sapien
aaaactgattactatgcttggaaackcttggtaatacaggatgaaaataa

SEQ ID NO: 85098 - DNA, 50 bp, homo sapien
cgtccaaatccaggatgatagttcaygtaactcctaacagagttatcatt

SEQ ID NO: 85099 - DNA, 50 bp, homo sapien
gaacactgctgttgtagagatggagragacatttcctatgtgctggatgt

SEQ ID NO: 85100 - DNA, 50 bp, homo sapien
aagccagctttggtattaaattaacwcattcctaacaactaaaagaagac

SEQ ID NO: 85101 - DNA, 50 bp, homo sapien
tacccaggtttgcaattactttgtgwcttccatatgctaagcactgggga

SEQ ID NO: 85102 - DNA, 50 bp, homo sapien
gcccagttcttacctgttagcccaawctataagcacatggaaattactat

SEQ ID NO: 85103 - DNA, 50 bp, homo sapien
atgtttttctcatcaggttacaagaygagaagaaaggtgatggcgttaga

SEQ ID NO: 85104 - DNA, 50 bp, homo sapien
aagttgtagatgagtagctaaaaackaaagtcagctcctgaaataaacag

SEQ ID NO: 85105 - DNA, 50 bp, homo sapien
catccaaacattttccttaatcatamagtgttgttgttgtggggtgtttt

SEQ ID NO: 85106 - DNA, 50 bp, homo sapien
cttgtaactcaacgtcgtagtcaatraaaacatctgtcattgtgccaaaa

SEQ ID NO: 85107 - DNA, 50 bp, homo sapien
gatggcaccatgtggctttagttacyggccattgctaacagttttctttt

SEQ ID NO: 85108 - DNA, 50 bp, homo sapien
ttcatctccaagagatgttgatgccrggagatcttcctttcctttaaaac

SEQ ID NO: 85109 - DNA, 50 bp, homo sapien
ggtctagacccggtgaaacagcgttyggtggccactgaccggtttccaga

SEQ ID NO: 85110 - DNA, 50 bp, homo sapien
acctaatagaagatgaagatccttayaggaaacggttctcacaatacata

SEQ ID NO: 85111 - DNA, 50 bp, homo sapien
aacatatatatttaagctttatgaaygcagatgaaagtcaactgacattt

SEQ ID NO: 85112 - DNA, 50 bp, homo sapien
caccatgatatgacttctctactgamacttaaaagaaaccagtaaaatat

SEQ ID NO: 85113 - DNA, 50 bp, homo sapien
ataagttactatgtataaagcactarcctagagccattttgtcctacctc

SEQ ID NO: 85114 - DNA, 50 bp, homo sapien
gggcactccagaatgtttggtgatayggcttgtcaagagtcacatagctg

SEQ ID NO: 85115 - DNA, 50 bp, homo sapien
aaaactgaaaaaaatttaagtggtayatcagtgacctctgggacaatact

SEQ ID NO: 85116 - DNA, 50 bp, homo sapien
taataagaccttttattgatctgtarcttgattcttaatagctacattat

SEQ ID NO: 85117 - DNA, 50 bp, homo sapien
ctgcccttcatctccacaggctcaaktaataaaagttatgcataactcat

SEQ ID NO: 85118 - DNA, 50 bp, homo sapien
ttagatctccaaatcagtcaccaaartaaggaaaatagttttttttataa

SEQ ID NO: 85119 - DNA, 50 bp, homo sapien
ggatcatttctctcccacacagtgaygtgattctgaggtcactccctctt

SEQ ID NO: 85120 - DNA, 50 bp, homo sapien
tagtttccttccaggttattctgaartgattctttgggactgataaaatg

SEQ ID NO: 85121 - DNA, 50 bp, homo sapien
aacagaagaaggcattgtgatggacygaagcctgggaggagtctctggaa

SEQ ID NO: 85122 - DNA, 50 bp, homo sapien
ttttgtgagtttgctgggagaaggtraaatcatagtctggagagtagaag

SEQ ID NO: 85123 - DNA, 50 bp, homo sapien
atctctattaattaaggaccaagaaytacaaaataaagttgtaagaggca

SEQ ID NO: 85124 - DNA, 50 bp, homo sapien
gaattacagaataaataataggccargtttccttagagagttgagaactc

SEQ ID NO: 85125 - DNA, 50 bp, homo sapien
ttgaagactgccttgcacattgtcartactatgctagtgttagccattat

SEQ ID NO: 85126 - DNA, 50 bp, homo sapien
caattttaaaaaacaatgattaagarcagttaactacagggaccctgagt

SEQ ID NO: 85127 - DNA, 50 bp, homo sapien
accttgcatgtaaaactctttttccmgtggactcaagtacatgttacact

SEQ ID NO: 85128 - DNA, 50 bp, homo sapien
cacattctactttccttctatacctygcaaccttgcatgtaaaactcttt

SEQ ID NO: 85129 - DNA, 50 bp, homo sapien
tacatgatgccaggctttttgaggaygaacaaaattagaaatccagatcc

SEQ ID NO: 85130 - DNA, 50 bp, homo sapien
aaaaagaagtagacagacatagtacrattacagaaagagtcctgcccaaa

SEQ ID NO: 85131 - DNA, 50 bp, homo sapien
acaactctgacaccaagttacatgaygccaggctttttgaggatgaacaa

SEQ ID NO: 85132 - DNA, 50 bp, homo sapien
tgactcctatgaattcaactcattayccagattagaaagccaccttctgc

SEQ ID NO: 85133 - DNA, 50 bp, homo sapien
gtgcacataccaaagaaagtataaayggtaggcactgcttaaaataacat

SEQ ID NO: 85134 - DNA, 50 bp, homo sapien
attctctagacctcatttatgccacrggtagtatcatgacctttatccat

SEQ ID NO: 85135 - DNA, 50 bp, homo sapien
agaaaaacaagcagaaacttattaayacatgctatacccatcacatggga

SEQ ID NO: 85136 - DNA, 50 bp, homo sapien
aggagttcattgcaaggtgtatatcscaattcagtggcaatatatttcag

SEQ ID NO: 85137 - DNA, 50 bp, homo sapien
tgggctcacccagtttgaatttcccrgaggcttcgtttatactgtgatgg

SEQ ID NO: 85138 - DNA, 50 bp, homo sapien
ctgcaggtgccacccagcagaaaaayggatcatcctggcctcaatgccat

SEQ ID NO: 85139 - DNA, 50 bp, homo sapien
tgcttatgaaggagtctccttaacaytggattaacaacacctttccctgg

SEQ ID NO: 85140 - DNA, 50 bp, homo sapien
ctagcccttaatgttttcaagaatcwaatagcattcagtgcaatcataca

SEQ ID NO: 85141 - DNA, 50 bp, homo sapien
tgcaaactgttctaaaagtcactcaycaagggcgtgattactaatttgga

SEQ ID NO: 85142 - DNA, 50 bp, homo sapien
aggccaattcagtcatcaattacaawgtttacaaatggcatttggttttt

SEQ ID NO: 85143 - DNA, 50 bp, homo sapien
aagttaacagtagaaaagatctatamgaagcaacgactccagaaatttct

SEQ ID NO: 85144 - DNA, 50 bp, homo sapien
tccaagtgctcaaacagtgagaaaaygctaattgccaagttataagagaa

SEQ ID NO: 85145 - DNA, 50 bp, homo sapien
ggtttataatccacaatgataataayatgtgcttccaagaaattatagat

SEQ ID NO: 85146 - DNA, 50 bp, homo sapien
atctgaatccttacccttgattctgragaccaatagtaggaaaagagagt

SEQ ID NO: 85147 - DNA, 50 bp, homo sapien
agccaccaggccaatccatttacacraagtagagagagcgtattctggtt

SEQ ID NO: 85148 - DNA, 50 bp, homo sapien
ctgagaagttttttaatacatcctasaaaacttgtattaaaaacatagaa

SEQ ID NO: 85149 - DNA, 50 bp, homo sapien
tgtctggattatagtgcttgctacarttcaacaccattcagagatatttg

SEQ ID NO: 85150 - DNA, 50 bp, homo sapien
tgacctttaatgtctctgcatggtcrttatccttttaccacaaacttatc

SEQ ID NO: 85151 - DNA, 50 bp, homo sapien
atgacataaaaaacatgataaaagcygaacaattattagtcactttctat

SEQ ID NO: 85152 - DNA, 50 bp, homo sapien
caattatctctaagggaaagaatccratcataagaaagtattaatagcac

SEQ ID NO: 85153 - DNA, 50 bp, homo sapien
cactctatttttagtgaatcaaagaytaggagtccctgaaatctgtgttt

SEQ ID NO: 85154 - DNA, 50 bp, homo sapien
acatatcttacaaggtcattcttgayagaaacattaacagtatctacctt

SEQ ID NO: 85155 - DNA, 50 bp, homo sapien
ttaggtgttcctattgaaaagttcaragttagttcagatttccattatta

SEQ ID NO: 85156 - DNA, 50 bp, homo sapien
atggagctggtttcagatagttccakctttgccagtggttatgtttgtga

SEQ ID NO: 85157 - DNA, 50 bp, homo sapien
tttccttccatctgcattcaagataytagaaaagttccaataatgagaca

SEQ ID NO: 85158 - DNA, 50 bp, homo sapien
agagtggttatggaggctccgctacrtaggcatgcttgattaaatcattg

SEQ ID NO: 85159 - DNA, 50 bp, homo sapien
ctttcctacctcgggtctctcctaastctaggttcacaccatatcccatc

SEQ ID NO: 85160 - DNA, 50 bp, homo sapien
tgtacccaatctgaattcctaacccrgagaatctgtgagcataataaaat

SEQ ID NO: 85161 - DNA, 50 bp, homo sapien
gatggcgaattaataataatcataamcacaacaataaacacataccaaaa

SEQ ID NO: 85162 - DNA, 50 bp, homo sapien
ttgtgctctgaatactggagagaaargatttggttacaagggttgctgct

SEQ ID NO: 85163 - DNA, 50 bp, homo sapien
gttcattttgtgtgtaaacactctcmatttcccagatttaaagtgtggac

SEQ ID NO: 85164 - DNA, 50 bp, homo sapien
agtttgacttgtgttttatcttaacyactggaccattccttctgcagctc

SEQ ID NO: 85165 - DNA, 50 bp, homo sapien
attcaaatgttccaggcttgtagaaktagcttccagctctaaatatattg

SEQ ID NO: 85166 - DNA, 50 bp, homo sapien
catagctagtatggtatgagtatggwatcaagaaatggattcagatgctc

SEQ ID NO: 85167 - DNA, 50 bp, homo sapien
ctaacagctgtcctctgtattaaggycatctttagcttgtcttgcaaata

SEQ ID NO: 85168 - DNA, 50 bp, homo sapien
ataaatgacaaataagctaatatagycaggcattttattagttgcaattt

SEQ ID NO: 85169 - DNA, 50 bp, homo sapien
gattggaaaaacacataataagctawgagactaaatttcaacttgtacca

SEQ ID NO: 85170 - DNA, 50 bp, homo sapien
cactgccccctctcggtacctatackgattttcattttggtagccattcc

SEQ ID NO: 85171 - DNA, 50 bp, homo sapien
acatggcatcaaattctgagtaacarcctaagagacaagtgggcaggcag

SEQ ID NO: 85172 - DNA, 50 bp, homo sapien
tgtaacaagcaataatggatatacartagactcttatgtcagtcaacaag

SEQ ID NO: 85173 - DNA, 50 bp, homo sapien
gacaccagatggttagccagatctayaggaaggaaagaagatcactggaa

SEQ ID NO: 85174 - DNA, 50 bp, homo sapien
cttagaaaagccttccttcctccagwaatatgatcagggccattttcttc

SEQ ID NO: 85175 - DNA, 50 bp, homo sapien
acaatgccattcaactacatcttcawacatttttaaatagttgagagtag

SEQ ID NO: 85176 - DNA, 50 bp, homo sapien
ataaagacacagcctatatcataacrgtaacaagaaacaggctctttcag

SEQ ID NO: 85177 - DNA, 50 bp, homo sapien
tataatttctgatttagtaaagggaraaataatgaagcaaaagtctgaaa

SEQ ID NO: 85178 - DNA, 50 bp, homo sapien
tatttgcagtttaggcctataataartgaagccgctaggaacatttatgt

SEQ ID NO: 85179 - DNA, 50 bp, homo sapien
atcattgctccagtggattcaatcayaggttaaactgaaaggtacatagc

SEQ ID NO: 85180 - DNA, 50 bp, homo sapien
tacatttggactttcttacctaggayaataagtgagaaaactaaaacaga

SEQ ID NO: 85181 - DNA, 50 bp, homo sapien
agattttttattttcagaaccagaayatgatgataatttgctttattagg

SEQ ID NO: 85182 - DNA, 50 bp, homo sapien
cacgtggcttgatttcctagaggagsctacaacctcttagtgcttgccac

SEQ ID NO: 85183 - DNA, 50 bp, homo sapien
gctgtttttctctgctgagctctttrtttctatacacttattccccaaca

SEQ ID NO: 85184 - DNA, 50 bp, homo sapien
aaatttcagtttgtgtattgtattcratttctaagagaacagaacttttc

SEQ ID NO: 85185 - DNA, 50 bp, homo sapien
caattagagcagatttgcttgtatayaccaaaatcatttccaacacagcc

SEQ ID NO: 85186 - DNA, 50 bp, homo sapien
tcttctgtacacatctacactacacmgtatctctcagtaacaaggtgact

SEQ ID NO: 85187 - DNA, 50 bp, homo sapien
catgctcacttcaatttgggaaacakatcatagtgtatttctcttttgaa

SEQ ID NO: 85188 - DNA, 50 bp, homo sapien
ttgtctttcagatgtgcaaaatcatraacaataagtaaccacattgttaa

SEQ ID NO: 85189 - DNA, 50 bp, homo sapien
gggcaagtcaaagcatgcacacttgrataattagtgtttcctgagctccc

SEQ ID NO: 85190 - DNA, 50 bp, homo sapien
gttgtagggaacagctctcttgccasatatgattggataaatgaggcatt

SEQ ID NO: 85191 - DNA, 50 bp, homo sapien
cactatgtaaaatccttggtataaastatatttgctcttagtggattatt

SEQ ID NO: 85192 - DNA, 50 bp, homo sapien
gaaatagttatgttaaaggaagagamcattttcccatgaagcaattggtt

SEQ ID NO: 85193 - DNA, 50 bp, homo sapien
aagaagataaaaatcctactgtaaakagatgtgtcagaaagaatgagatg

SEQ ID NO: 85194 - DNA, 50 bp, homo sapien
atttggtagaccttaagattaattaygtttcatctcttttctctttgtaa

SEQ ID NO: 85195 - DNA, 50 bp, homo sapien
aatcccaaaatgtataaaagatgaasaaaaaatctacattctgaacaggc

SEQ ID NO: 85196 - DNA, 50 bp, homo sapien
gggtcctgggataacctgttgaagasgaatttgagaaggccaaaatggta

SEQ ID NO: 85197 - DNA, 50 bp, homo sapien
atgtctgtggccctgaaattttgtcrattagattcagctcatctgctaga

SEQ ID NO: 85198 - DNA, 50 bp, homo sapien
tttgggcattacagaatcaggactcrgaaaactgactgcaaggatttcag

SEQ ID NO: 85199 - DNA, 50 bp, homo sapien
ttgggagaaactaggaaaaataagamtagcaccagagggaacattctctg

SEQ ID NO: 85200 - DNA, 50 bp, homo sapien
accgtaaaatcaggtacaatccaaartaaaagtgtctcatgaaaagaact

SEQ ID NO: 85201 - DNA, 50 bp, homo sapien
taagcctctgaaagttagtgatacaycttatttgtgtttgaatcaacttg

SEQ ID NO: 85202 - DNA, 50 bp, homo sapien
ttggtgttgaagatacaaaggtttcraattgttggagtttatgataaaag

SEQ ID NO: 85203 - DNA, 50 bp, homo sapien
cagtgctgtctatttccttgctttaygattcatcagggcagattgaaata

SEQ ID NO: 85204 - DNA, 50 bp, homo sapien
tatatgagacccctaatgtcatagaytaaaactgaatgagagttttctta

SEQ ID NO: 85205 - DNA, 50 bp, homo sapien
aagaaaaaaaacctccaggacaatayagcatttcagtgtacattttttaa

SEQ ID NO: 85206 - DNA, 50 bp, homo sapien
tttcagagactaatggcacgggaaaytgttcacatgtacggttaagtgga

SEQ ID NO: 85207 - DNA, 50 bp, homo sapien
aattttcttgagtgaaatttattccyagttagctgtagattgctttaaaa

SEQ ID NO: 85208 - DNA, 50 bp, homo sapien
tggctagttgagagttgactatacaygaagaaaaaatggttcaattcagc

SEQ ID NO: 85209 - DNA, 50 bp, homo sapien
aaaaggtaatttcctttctataaaastgtcttgaggaagtagctgacaaa

SEQ ID NO: 85210 - DNA, 50 bp, homo sapien
cagaaaatcccaggaccaaattttgsaatgattttaggcactttctagac

SEQ ID NO: 85211 - DNA, 50 bp, homo sapien
aaattttataattgtaataagacacmctagtgcatgaattatggggtact

SEQ ID NO: 85212 - DNA, 50 bp, homo sapien
aaattggtgactctaaaaatgatacygcacatggcaaatggaagagcagg

SEQ ID NO: 85213 - DNA, 50 bp, homo sapien
gtctagagaggtgattcaattcacarcagatggtgcttctcttatattgg

SEQ ID NO: 85214 - DNA, 50 bp, homo sapien
aaatgaaacttcagaaaataaccaawtcataccaagataaattatagtgt

SEQ ID NO: 85215 - DNA, 50 bp, homo sapien
caaacattatggtaaaagagagtcastaatattttccatgccaaatgtct

SEQ ID NO: 85216 - DNA, 50 bp, homo sapien
tcaatagctggcctctacccacaatygattccttctccaattagctctaa

SEQ ID NO: 85217 - DNA, 50 bp, homo sapien
tggaatgtttctcaaatagagaaaarttcagaattagaagccagagtcag

SEQ ID NO: 85218 - DNA, 50 bp, homo sapien
ataatggatttgaccacaggtaccaraatgattcactagttttccctcca

SEQ ID NO: 85219 - DNA, 50 bp, homo sapien
catggcaatgtcacttgctataaaaygtctaggcatgtacttaccagttc

SEQ ID NO: 85220 - DNA, 50 bp, homo sapien
tttagttgggaatttagcaaacccamgtgatcatttagtgtctttattct

SEQ ID NO: 85221 - DNA, 50 bp, homo sapien
agcatgactgtgtttccaagttcaartcttgtgttgccacagcctgtgac

SEQ ID NO: 85222 - DNA, 50 bp, homo sapien
acttgagaagaagagcaataaaactsacgaggacatcattggtatcagat

SEQ ID NO: 85223 - DNA, 50 bp, homo sapien
atgtggaaacagctggagaagtcccragaatagaactgtttctaaagctg

SEQ ID NO: 85224 - DNA, 50 bp, homo sapien
catacatatagaaagtgcatcataartggttattgaatcaaggaatgaac

SEQ ID NO: 85225 - DNA, 50 bp, homo sapien
cgtttaaaacataatgatccttctaygtaaatattcagtataaaccttct

SEQ ID NO: 85226 - DNA, 50 bp, homo sapien
tgaatacactaccttcatactttttkgtttcctggcttctatcaaacaaa

SEQ ID NO: 85227 - DNA, 50 bp, homo sapien
aatttaaaactttatttaaataatcrcttttcctaatatgccaaatgtat

SEQ ID NO: 85228 - DNA, 50 bp, homo sapien
tagtatctgtctcctctgtgttcaartcaatatagatgtcattcaatgtt

SEQ ID NO: 85229 - DNA, 50 bp, homo sapien
tctacagtacttaataaagaattacrcaaacaaactgatcttttaaagta

SEQ ID NO: 85230 - DNA, 50 bp, homo sapien
attaaagtaactataacacaaagcargatgtgataagtattataagaaag

SEQ ID NO: 85231 - DNA, 50 bp, homo sapien
gaaaaagagagagcagtggaagttasagctagaaaagaagattaggacca

SEQ ID NO: 85232 - DNA, 50 bp, homo sapien
ggatgtgacctggggttgctgactgmatgttgagttgttctgatttgtag

SEQ ID NO: 85233 - DNA, 50 bp, homo sapien
atatcttaaaagttacagcaaacaaytcaaagaagataacgctatagaaa

SEQ ID NO: 85234 - DNA, 50 bp, homo sapien
ctagactttccaaagcttttaggccraaacactcgagttccaggaagaaa

SEQ ID NO: 85235 - DNA, 50 bp, homo sapien
aaataacttctgggtctaataacaartatcagctgagggaagccatgaac

SEQ ID NO: 85236 - DNA, 50 bp, homo sapien
ctatagtgagaaattagtctcattcmatttaaggaaaatttaataaataa

SEQ ID NO: 85237 - DNA, 50 bp, homo sapien
attgaaaatattccttcctttcatgyactgtcttgtatgttttgtgttgc

SEQ ID NO: 85238 - DNA, 50 bp, homo sapien
gccaacagagttctggattccaaaaktaactttcagtatggcagcactgc

SEQ ID NO: 85239 - DNA, 50 bp, homo sapien
catcttacttttaaaagcttgtgaartctccttggttttcaaattgtttt

SEQ ID NO: 85240 - DNA, 50 bp, homo sapien
aaacataaataagacgtccagtaaawtacaaagattctcatggtgttagt

SEQ ID NO: 85241 - DNA, 50 bp, homo sapien
cagtagagaaaataatactgaatccraagaagcatcttacttttaaaagc

SEQ ID NO: 85242 - DNA, 50 bp, homo sapien
atacacacacaccttctcatataaascattacatggcctacagtactgta

SEQ ID NO: 85243 - DNA, 50 bp, homo sapien
attaatcttctgaacttagaaaaccraatttctctcttctcggacactgt

SEQ ID NO: 85244 - DNA, 50 bp, homo sapien
aagtattcttagatgtccttttaaartctgatctgcaaaaagtactttag

SEQ ID NO: 85245 - DNA, 50 bp, homo sapien
ggtggggcactttctgcttgtcacarcgatccgtggaacaggactctgct

SEQ ID NO: 85246 - DNA, 50 bp, homo sapien
tgaaaatagttccttgctcacttatrttataaactagtgcatcaaatgac

SEQ ID NO: 85247 - DNA, 50 bp, homo sapien
gcttaaaaatatgtttgttattaacrgaaagaaacatatttaggtaaaag

SEQ ID NO: 85248 - DNA, 50 bp, homo sapien
acagcaaagaatactgtgactcctawaaataactctttgtttttatttta

SEQ ID NO: 85249 - DNA, 50 bp, homo sapien
actagtattcctgctctcttccagamacagtgcattggacctgtaaggcc

SEQ ID NO: 85250 - DNA, 50 bp, homo sapien
ccctgtactcttctcttctgagctgragaacattttctatatatccacat

SEQ ID NO: 85251 - DNA, 50 bp, homo sapien
gaaatgtttaatcagatccactcagraagaatgtattattaagcccccgt

SEQ ID NO: 85252 - DNA, 50 bp, homo sapien
tgggacaagcttgtgctagaattttwaaaagtgtagtggtgcagcattca

SEQ ID NO: 85253 - DNA, 50 bp, homo sapien
ggtgtagagatatgtttatgtcaagwaataaaatgtctaggactggaata

SEQ ID NO: 85254 - DNA, 50 bp, homo sapien
aaataaaagaaaaaccagcaaacaayggtgtagagatatgtttatgtcaa

SEQ ID NO: 85255 - DNA, 50 bp, homo sapien
gtaaacaaaaatagctgtcacagatwaatattgtgctgccaggtgtactg

SEQ ID NO: 85256 - DNA, 50 bp, homo sapien
gaatttgccttattgcttttgatacmgactccttcattcatctgatcact

SEQ ID NO: 85257 - DNA, 50 bp, homo sapien
ttgtgataaaatgcccaatttattawggtttatctatcatttcctctcat

SEQ ID NO: 85258 - DNA, 50 bp, homo sapien
ttttcaaaatttgattttatgtcaaygatttattagctattaaaaaaact

SEQ ID NO: 85259 - DNA, 50 bp, homo sapien
attatgtgctgtgaagccctagtgayacttactgaaagtcagagaaagga

SEQ ID NO: 85260 - DNA, 50 bp, homo sapien
tttgatcatgacatacacagtagacrgacttctaaaaaggcctccaagat

SEQ ID NO: 85261 - DNA, 50 bp, homo sapien
agtgactgcatttgttcaagaacctraagttggagaaacagcacctggat

SEQ ID NO: 85262 - DNA, 50 bp, homo sapien
tttacttttctgccttctgctggtgrttagagctcattcgattttatcag

SEQ ID NO: 85263 - DNA, 50 bp, homo sapien
cagctataaccagtattctaaaaaamacagtgctgtaacaggggttgcct

SEQ ID NO: 85264 - DNA, 50 bp, homo sapien
cttttttcctctggtatagatcaaaygcagctataaccagtattctaaaa

SEQ ID NO: 85265 - DNA, 50 bp, homo sapien
aatcggagccaattgttgcgagacayccatttggtaagtgtcttaaattc

SEQ ID NO: 85266 - DNA, 50 bp, homo sapien
tctaatttgatgttagcacataaaasttatctgatccagaaaaggttatc

SEQ ID NO: 85267 - DNA, 50 bp, homo sapien
ggtaatgcttgatggcatattacaasaaatacatgagatcagaaaaaaaa

SEQ ID NO: 85268 - DNA, 50 bp, homo sapien
agtaaaatttcaaatgtgttaagcaygaaaagtaagaagcagagaagctt

SEQ ID NO: 85269 - DNA, 50 bp, homo sapien
attttccatttttctcagtgtaaacrtcaaagatcttataaggccacctt

SEQ ID NO: 85270 - DNA, 50 bp, homo sapien
agtatttaaagaaaaggtatttcaayagaatagcccagacaattattcaa

SEQ ID NO: 85271 - DNA, 50 bp, homo sapien
acaattactttacagctcagtgcaaygtagtatttaaagaaaaggtattt

SEQ ID NO: 85272 - DNA, 50 bp, homo sapien
tctttttctatgttgactactttgasgtttctcaaacaaaggtttcttaa

SEQ ID NO: 85273 - DNA, 50 bp, homo sapien
tgcattaatacttaaattggactaaytccatgtgaatcctcgtaagaaat

SEQ ID NO: 85274 - DNA, 50 bp, homo sapien
tagaatcacaatttcaagaaaataaragggtcaaaatactcctgtctctt

SEQ ID NO: 85275 - DNA, 50 bp, homo sapien
ggtccaatcattttttaaagcccaarcatgagaataatagaggtcactat

SEQ ID NO: 85276 - DNA, 50 bp, homo sapien
gtctttatctctttaactttagcccraatgactgggataaaagacaagaa

SEQ ID NO: 85277 - DNA, 50 bp, homo sapien
ggggtgtgttccattgttctcgaaargtgctagtggtcaaattcattctg

SEQ ID NO: 85278 - DNA, 50 bp, homo sapien
tagcatgacatgcctgtccctagcawaactataccaccatcaaaaactcc

SEQ ID NO: 85279 - DNA, 50 bp, homo sapien
acctctcctctctgacctcattttcyactattctccccctcacttactcc

SEQ ID NO: 85280 - DNA, 50 bp, homo sapien
gatttcattaacaatactcttacackgattacatgttgaaatgacaatat

SEQ ID NO: 85281 - DNA, 50 bp, homo sapien
tagtgttcactctgttgctgagatayacagtattaaccattaagatctat

SEQ ID NO: 85282 - DNA, 50 bp, homo sapien
atttcacactatatagtactgtataygatttgccgtaattttgatgaata

SEQ ID NO: 85283 - DNA, 50 bp, homo sapien
ataaataagcccacagaatttgacayaaaaacctagtagccattaggttt

SEQ ID NO: 85284 - DNA, 50 bp, homo sapien
aaatgttttaaagtatagaatgaagsattagtggaataaaaagagtttct

SEQ ID NO: 85285 - DNA, 50 bp, homo sapien
gtagttggaacagtcatatctctacsacatcttactggaatgaaccatag

SEQ ID NO: 85286 - DNA, 50 bp, homo sapien
cactgcttagtaaccaatgctgaacrgtcaaaaataatttcagtaaaata

SEQ ID NO: 85287 - DNA, 50 bp, homo sapien
tcatagtgcttttttctaacctacartaagatgcactatcacacaaggaa

SEQ ID NO: 85288 - DNA, 50 bp, homo sapien
ataaaagactccagatttagtgaaaytacatgttaacttgtacctttctc

SEQ ID NO: 85289 - DNA, 50 bp, homo sapien
aagttatcttggtgtagctctgtgaytatttatataacctactcctagct

SEQ ID NO: 85290 - DNA, 50 bp, homo sapien
cccttgggccaaatatgaaaagcctmacattgcacatggagcccttgggt

SEQ ID NO: 85291 - DNA, 50 bp, homo sapien
cagatatgcaaataactacaatggcraagtgtcaagagcaagggactagc

SEQ ID NO: 85292 - DNA, 50 bp, homo sapien
attttcaacagatacttagaaaccaygaaacactatagattcaaatcagt

SEQ ID NO: 85293 - DNA, 50 bp, homo sapien
tcaaatcaaaaacattctctataaaytatgacccacgagtctttcaaaca

SEQ ID NO: 85294 - DNA, 50 bp, homo sapien
aaggtcctagtgatcagacttcttaygttgggcactaacaacatgatttg

SEQ ID NO: 85295 - DNA, 50 bp, homo sapien
gacatatctttatataaagaacttaycaacttaactgataaactttgttt

SEQ ID NO: 85296 - DNA, 50 bp, homo sapien
agatgggaggactcactagagtcatkaatttctggtctggttgggagctt

SEQ ID NO: 85297 - DNA, 50 bp, homo sapien
gataagtttctggaaggaaataaaayggtaatattgcaaaaggtagcgtc

SEQ ID NO: 85298 - DNA, 50 bp, homo sapien
ggcgggcctttaatatcacacaaatragcttggaactttttctgcacttc

SEQ ID NO: 85299 - DNA, 50 bp, homo sapien
ccaaaattctttgtttagcttatgayggatgatacataaatgctgatgat

SEQ ID NO: 85300 - DNA, 50 bp, homo sapien
aaaactttagtgcatctcttttaacsatggccaattgaatacatgtattt

SEQ ID NO: 85301 - DNA, 50 bp, homo sapien
tcttagattctgtgtattactccacyataactaatgttcttttacttttg

SEQ ID NO: 85302 - DNA, 50 bp, homo sapien
tccatcagactcattgttacctacayaattaaggccacagtttcttactt

SEQ ID NO: 85303 - DNA, 50 bp, homo sapien
tcaatcattcattagttacctacgaytagaacttgagaaggaaaggcaaa

SEQ ID NO: 85304 - DNA, 50 bp, homo sapien
tacatatatcacacttctgtcaaackgaaaccttataagatttcatgttt

SEQ ID NO: 85305 - DNA, 50 bp, homo sapien
tgttaacaaagtcagagctaaggtaygaatccagtctctgtggatgttgt

SEQ ID NO: 85306 - DNA, 50 bp, homo sapien
atgtggagtaaaggcagcatgaatargaagatggcagaaggagaaaccca

SEQ ID NO: 85307 - DNA, 50 bp, homo sapien
gtaaagttttcaagagctcattcctygggatttaataagtttgctgttcc

SEQ ID NO: 85308 - DNA, 50 bp, homo sapien
gttttctgaaaactctaaaaatcagrctacattctttatatgccattgtg

SEQ ID NO: 85309 - DNA, 50 bp, homo sapien
tcaatttatatagataaataccaagraacacaattgctggatcatatggt

SEQ ID NO: 85310 - DNA, 50 bp, homo sapien
aggaaagtgaagtcatttgagaagargtttatgttttcctctgtctaact

SEQ ID NO: 85311 - DNA, 50 bp, homo sapien
ttgtttttgcctctctttcttgggaygaatttccagatattcaaagaact

SEQ ID NO: 85312 - DNA, 50 bp, homo sapien
agttgtaaggaagttcttttgttccrctagacattttattaagagaacaa

SEQ ID NO: 85313 - DNA, 50 bp, homo sapien
gtttagggtgtttaaggttatgtgaygaactttaagagatccaacggcaa

SEQ ID NO: 85314 - DNA, 50 bp, homo sapien
aaaagcctggagactgcttatgcgawctaaagtgccttctccatcctcat

SEQ ID NO: 85315 - DNA, 50 bp, homo sapien
tgggtgtcacaatacatgattcctgraagtgacagaatttgttccagctg

SEQ ID NO: 85316 - DNA, 50 bp, homo sapien
accactttattagacttacagcaaaygaaagaaacgtctaactttaatgt

SEQ ID NO: 85317 - DNA, 50 bp, homo sapien
cctttctttgtatatgtaaagaatcyaggtagtgggaatttgttgtattt

SEQ ID NO: 85318 - DNA, 50 bp, homo sapien
aagtgcacttgtatgcatacaaagaraaacttctggacatctcatatcca

SEQ ID NO: 85319 - DNA, 50 bp, homo sapien
agccattaattgatactcagatttgrtataagaggacagaaggaatggca

SEQ ID NO: 85320 - DNA, 50 bp, homo sapien
gtcatagctaaaaatcaattaaccaycttctacacttagtactgctgacg

SEQ ID NO: 85321 - DNA, 50 bp, homo sapien
tattatcccattttagagctaagtaygttggatccctgacttccttgata

SEQ ID NO: 85322 - DNA, 50 bp, homo sapien
tggagacaagaattttagttaattgkaatgttgaatttgtaaaaggctat

SEQ ID NO: 85323 - DNA, 50 bp, homo sapien
tatttggtaagcatggatcagaacartaagagctagcaagatgacctaca

SEQ ID NO: 85324 - DNA, 50 bp, homo sapien
aattaaaattttagaataagaaagaktcctcaaaagatactaaatgcatc

SEQ ID NO: 85325 - DNA, 50 bp, homo sapien
ctgcaagagtggtattcattgcttaycttactaaatcacacaaaagtagc

SEQ ID NO: 85326 - DNA, 50 bp, homo sapien
ccattaaagcatgattcagagcccawtacaggatttctaactactgcaag

SEQ ID NO: 85327 - DNA, 50 bp, homo sapien
aaccaaaagtttgattaagctatackaatactccagggttggtaaatttt

SEQ ID NO: 85328 - DNA, 50 bp, homo sapien
tttaaggtaaacctacagtaaagctraactccgtctaagctgtaaaaagc

SEQ ID NO: 85329 - DNA, 50 bp, homo sapien
tgcctttgtaaatgtttccagtttamagccacagatacataaaacttgta

SEQ ID NO: 85330 - DNA, 50 bp, homo sapien
agagaacagagggctgccagaagggyttctccaggaatgctctttattaa

SEQ ID NO: 85331 - DNA, 50 bp, homo sapien
caattgctttggctattcatttccaraaacgaaaaagaagccacagttta

SEQ ID NO: 85332 - DNA, 50 bp, homo sapien
ttttgtattgtcaaaattactaatgsaaagtggccagtcaagtttaggac

SEQ ID NO: 85333 - DNA, 50 bp, homo sapien
atgaatctatctcctgaatcaaatayactgcaaaggagaattttcaactt

SEQ ID NO: 85334 - DNA, 50 bp, homo sapien
tcactcacatttggtattgtcaggayttggattctagccatagtaatagg

SEQ ID NO: 85335 - DNA, 50 bp, homo sapien
aaggtctatgaatcaaaagttatcaratagaatcacatgataggaagaga

SEQ ID NO: 85336 - DNA, 50 bp, homo sapien
tagaaaatattaataatatatgagcmaaaaaattagttgtaacatcatta

SEQ ID NO: 85337 - DNA, 50 bp, homo sapien
cctctgcttactttgattcaaaaaasagttcagagcagtgtctcaaaaaa

SEQ ID NO: 85338 - DNA, 50 bp, homo sapien
tcagttaacctaaatacgaacttccyagtgtaaacagaacatgaaactaa

SEQ ID NO: 85339 - DNA, 50 bp, homo sapien
ttcccagaatccatgcccagagattkgatttaggtgatgtgggatggcca

SEQ ID NO: 85340 - DNA, 50 bp, homo sapien
ttctttctgtgcttttttgagaataygggtagaagtagttgagtttatga

SEQ ID NO: 85341 - DNA, 50 bp, homo sapien
taaaggaaaaattgtttatcttatcrcctcaattaacaccttataattaa

SEQ ID NO: 85342 - DNA, 50 bp, homo sapien
acttgctaattattgtgagacattgraatattagcactctccattcagat

SEQ ID NO: 85343 - DNA, 50 bp, homo sapien
aatatgtctaataatagactgtagcragtgatctaagaataccagggtga

SEQ ID NO: 85344 - DNA, 50 bp, homo sapien
tcatattatttaaataagtcattacygatgtatttcaagctccatttgta

SEQ ID NO: 85345 - DNA, 50 bp, homo sapien
tcataaacatgcctgtttatttgtcyatataactgctttttatatcatta

SEQ ID NO: 85346 - DNA, 50 bp, homo sapien
taaaattccataatgacttaaaaackgaaatcttatttgcatttttaatt

SEQ ID NO: 85347 - DNA, 50 bp, homo sapien
attgaagtattgatagcaggtacaayagttatttgaggcagtacgttact

SEQ ID NO: 85348 - DNA, 50 bp, homo sapien
tgtgcttgtcagttttcaaatgggtwaacgatgttgttcaaaggggtaac

SEQ ID NO: 85349 - DNA, 50 bp, homo sapien
ccttatgctttaattgctaagaaacrcacttgggaaaccaacattattct

SEQ ID NO: 85350 - DNA, 50 bp, homo sapien
tgtggtaagtaaaacatgatttttcsaaaaggaatctaattgagggaagt

SEQ ID NO: 85351 - DNA, 50 bp, homo sapien
gtggttcaaagttaaacatttcaatragaacgtccctcagaacagtgact

SEQ ID NO: 85352 - DNA, 50 bp, homo sapien
aattacctgcatatgatatagtaggycatttttctcaattatcatatatg

SEQ ID NO: 85353 - DNA, 50 bp, homo sapien
tggactggaaccagctccttaatcaytatggatattgtgtctaagaggaa

SEQ ID NO: 85354 - DNA, 50 bp, homo sapien
ttccatttcctgtaaaaatgaaaacygcattattattccggataaaagac

SEQ ID NO: 85355 - DNA, 50 bp, homo sapien
tccctttcttgttaggatgcatacaygtttccaggcgaggtgtgctccat

SEQ ID NO: 85356 - DNA, 50 bp, homo sapien
gattagagctaggtaaccctgatgaytagttgggcagcattttacatcca

SEQ ID NO: 85357 - DNA, 50 bp, homo sapien
tatcatatttctgcagacagatttcragagagaagcagagaatagggaaa

SEQ ID NO: 85358 - DNA, 50 bp, homo sapien
ttaagacatcagtatggggaatacayggtgaataatatggaaagctgtac

SEQ ID NO: 85359 - DNA, 50 bp, homo sapien
ttatagaagggaaacttgctagatayaaaagttgcttgtttataattatt

SEQ ID NO: 85360 - DNA, 50 bp, homo sapien
tagtttattccagggtaattattgaractactaggcatctctctctgaag

SEQ ID NO: 85361 - DNA, 50 bp, homo sapien
atgaatcctcagcttctctataagawctggtagaataattataaacaagc

SEQ ID NO: 85362 - DNA, 50 bp, homo sapien
attcttagaaacagtttaaagtgaargagatctatatatattaatgtctc

SEQ ID NO: 85363 - DNA, 50 bp, homo sapien
gggctgtgggcccagtggctgatcayactcaatttgtccagctcagtttc

SEQ ID NO: 85364 - DNA, 50 bp, homo sapien
ttagggcataggcaactatattcatyatcctagtgaccagtgtttaatga

SEQ ID NO: 85365 - DNA, 59 bp, homo sapien
  misc_feature (51)..(51): n is a, c, g, or t
  misc_feature (53)..(53): n is a, c, g, or t
  misc_feature (59)..(59): n is a, c, g, or t
acagctgtgatggcttagcatttatraggaacatgttctgctacttgagandnahmsan

SEQ ID NO: 85366 - DNA, 50 bp, homo sapien
aaaagcttatagtggaaatgaaccayagatattgaccatgaaaaggtatg

SEQ ID NO: 85367 - DNA, 50 bp, homo sapien
ggaaagaaaataaatactcatcaatwaagaggaatggcagaatattcact

SEQ ID NO: 85368 - DNA, 50 bp, homo sapien
tcattaaattcccaagccttatcaargaagaataaaaaaacattttatct

SEQ ID NO: 85369 - DNA, 50 bp, homo sapien
ttgcctaagtcatttaaatgcaagcygacttcttagcaggtgctgaaact

SEQ ID NO: 85370 - DNA, 50 bp, homo sapien
atgaaattgataccaaattctgacartgcaagttcaaaaaggaaaactag

SEQ ID NO: 85371 - DNA, 50 bp, homo sapien
accacctctgaaatccctccttgaarcatcatactttggccacttcccaa

SEQ ID NO: 85372 - DNA, 50 bp, homo sapien
acatggatcaattatgaggatagacyatatattaggttccaaaaaaagtc

SEQ ID NO: 85373 - DNA, 50 bp, homo sapien
tgactccaaaagcctcaaaacatcgmaactgtgcaagaacagatgttcct

SEQ ID NO: 85374 - DNA, 50 bp, homo sapien
ctcaacactgcagtaaggtgtgagawacccattgttactagtgtgccagt

SEQ ID NO: 85375 - DNA, 50 bp, homo sapien
atttgggatccaggcaacagagccaycttgaagcacagccagtgaggccg

SEQ ID NO: 85376 - DNA, 50 bp, homo sapien
catacttggagttcttcatatgtgasctgattacaactcagaatggtgct

SEQ ID NO: 85377 - DNA, 50 bp, homo sapien
aaaggtgcaatgaagaaagctcttgmattcgtttcctagggctgctgtaa

SEQ ID NO: 85378 - DNA, 50 bp, homo sapien
ttgctcctgactgacagacttaaaaycttagttatgaaaacaatgatcac

SEQ ID NO: 85379 - DNA, 50 bp, homo sapien
acaataaaagaacacacctaagttayagccaggacttttgtcattctatg

SEQ ID NO: 85380 - DNA, 50 bp, homo sapien
agttttgaaaccaaaagacccaggasagcaattgaatgtttggtaatttg

SEQ ID NO: 85381 - DNA, 50 bp, homo sapien
gttttattctctttgtctattgtacmatttatcttctcctctattaattc

SEQ ID NO: 85382 - DNA, 50 bp, homo sapien
aattgggcaatggcagtaatttaaaratagaatagtggaagaacaggcat

SEQ ID NO: 85383 - DNA, 50 bp, homo sapien
agtaccaggtaagaagtttcaaaacrgggccactccagtctagctgctta

SEQ ID NO: 85384 - DNA, 50 bp, homo sapien
gcttctgggaaaatctctttaaggargtatgcgaataacggtaaaaaaaa

SEQ ID NO: 85385 - DNA, 50 bp, homo sapien
caagccactgttgatgattgagcaaygagaggtcaaactgatgttagaat

SEQ ID NO: 85386 - DNA, 50 bp, homo sapien
acatgttagacactcaattaaatatwagtatgaagcctgtaatcccagca

SEQ ID NO: 85387 - DNA, 50 bp, homo sapien
ttaatgtaatggttgctagcttgacygcaaagtttagagatgacttttta

SEQ ID NO: 85388 - DNA, 50 bp, homo sapien
aattttaattaagaaaacaatagaartaaagaaatctgacaatcaagaga

SEQ ID NO: 85389 - DNA, 50 bp, homo sapien
tttcttattgagttcatgtgatttaygtagccctggcaggaatgtgacaa

SEQ ID NO: 85390 - DNA, 50 bp, homo sapien
agctgctgttgggactgagacatgartggactgtactccctgcagctttt

SEQ ID NO: 85391 - DNA, 50 bp, homo sapien
cagagagtgaccctgcaacactctaygtaccagaaattttaaaataccag

SEQ ID NO: 85392 - DNA, 50 bp, homo sapien
ttaagccctctgtcctacttccttcratcttaatttcccttagtctctag

SEQ ID NO: 85393 - DNA, 50 bp, homo sapien
actgcttatcaaatacaattcagagmccttactgtggcatgtaggagcct

SEQ ID NO: 85394 - DNA, 50 bp, homo sapien
atgttctttatataaatattttaagractcacaataatttctttacactt

SEQ ID NO: 85395 - DNA, 50 bp, homo sapien
ccatgcaaagtggatgtgcttaggayacttcattagtacttaaattcctg

SEQ ID NO: 85396 - DNA, 50 bp, homo sapien
tagtcttttctaattttctcacaacygtagcatttattttctcgttgaca

SEQ ID NO: 85397 - DNA, 50 bp, homo sapien
ctaatgagatattcctgaagataaamaggcaattcctatctagaaatgca

SEQ ID NO: 85398 - DNA, 50 bp, homo sapien
atttattccctgtgagtttgaagtayggtgggtatgcccaagtacaaaat

SEQ ID NO: 85399 - DNA, 50 bp, homo sapien
tgtgactcacttgtgccttcttagtrtcgtaactgtttctgttattaaga

SEQ ID NO: 85400 - DNA, 50 bp, homo sapien
gagcctgattttctcctctctaaaaygggttgataatgcacatacctggt

SEQ ID NO: 85401 - DNA, 50 bp, homo sapien
ctgaagttagaagaccaatagccaaygtcatatagtacttcaggcttgtt

SEQ ID NO: 85402 - DNA, 50 bp, homo sapien
cttccttctgtgttcaccattatagsttgattatttgtttttcaaagcaa

SEQ ID NO: 85403 - DNA, 50 bp, homo sapien
ccagcagctgggttccaagaggtaaytgtggtcaactaataagcacaaac

SEQ ID NO: 85404 - DNA, 50 bp, homo sapien
gtatgactcttcaacattatattcawcatgaaaccctaacttccaaatta

SEQ ID NO: 85405 - DNA, 50 bp, homo sapien
ggacttgattgtttcttcggttttayctatttgaatgacagaatttccag

SEQ ID NO: 85406 - DNA, 50 bp, homo sapien
taggactttaattgattaataacctraggatttaagatgtggcatatagc

SEQ ID NO: 85407 - DNA, 50 bp, homo sapien
ttttttcctcacatttccaaaatagstgcctaaaatgaagattcaagtga

SEQ ID NO: 85408 - DNA, 50 bp, homo sapien
tcattttaagttaacacaaagcttarggtgtttcagatatattgctcact

SEQ ID NO: 85409 - DNA, 50 bp, homo sapien
tccaaattaggtaggctgtgttatckattcattttcccttctccgtttat

SEQ ID NO: 85410 - DNA, 50 bp, homo sapien
tctagaaaaggcaagcttattgatamagagagcaaatcagtagttgccta

SEQ ID NO: 85411 - DNA, 50 bp, homo sapien
taaatattgttcagattaaaaattaygctttatccattataaattaaaga

SEQ ID NO: 85412 - DNA, 50 bp, homo sapien
cagaggtttggagtatgtacaatcamgaaagttgcaccctttatagaatt

SEQ ID NO: 85413 - DNA, 50 bp, homo sapien
agcaggttataattggaatctaacaygagaactgtcgtatattctttata

SEQ ID NO: 85414 - DNA, 50 bp, homo sapien
ttaaaaacggacatcgattgaaaccrcctcctccatttgcttgttgtatg

SEQ ID NO: 85415 - DNA, 50 bp, homo sapien
ttatttctgtattctggagtacacayggtgggaaacttttagtcataaag

SEQ ID NO: 85416 - DNA, 50 bp, homo sapien
ctcatgttagattccaattataaccygctaagaaactgtcaataacttct

SEQ ID NO: 85417 - DNA, 50 bp, homo sapien
tttttaagtaacattgcaaaagtccrataaaatcaaagatctagaacaaa

SEQ ID NO: 85418 - DNA, 50 bp, homo sapien
gtcatatagctcttttgcctgactaraataataaattggtatagttagca

SEQ ID NO: 85419 - DNA, 50 bp, homo sapien
aagcttacattggtaaagtttttcaratccaataatgagctttagaactg

SEQ ID NO: 85420 - DNA, 50 bp, homo sapien
ctaggtgcctaaatataattccccaragtgagccttgacttctttctctg

SEQ ID NO: 85421 - DNA, 50 bp, homo sapien
aggggatttttttggttatgttgaargaaattttttataagtgtgaggag

SEQ ID NO: 85422 - DNA, 50 bp, homo sapien
atggtgtgcttcagagccacaacttsaactaaggcctatcttactccaga

SEQ ID NO: 85423 - DNA, 50 bp, homo sapien
attaaaggaactccatcagggaacartgaggtaacatgtttggtgacagc

SEQ ID NO: 85424 - DNA, 50 bp, homo sapien
atgttaaaatagttaaacacttgcaytcatctcatcctattaaaggaact

SEQ ID NO: 85425 - DNA, 50 bp, homo sapien
agtttaatgttgatagatcaaggtaycaaaatttgagctccatggatatg

SEQ ID NO: 85426 - DNA, 50 bp, homo sapien
tgtatagaacttttaggcatcagtaycattctgtctaatgacataaacat

SEQ ID NO: 85427 - DNA, 50 bp, homo sapien
cgaaacttcacactacgtaaagttcsatagattctctggagagaaaaata

SEQ ID NO: 85428 - DNA, 50 bp, homo sapien
taggaaaatgttatttatattatgawagcaacaaatctcttctgtttaga

SEQ ID NO: 85429 - DNA, 50 bp, homo sapien
agagagaatttcttcctatcctagcrcaggtcatgagtagtagaaagaat

SEQ ID NO: 85430 - DNA, 50 bp, homo sapien
gtcaagaaatataatactgaaaatakaatcaatagcatcagatggaaatc

SEQ ID NO: 85431 - DNA, 50 bp, homo sapien
tctagatttcctgagtacttaattcraacagtagtggattgatggggctt

SEQ ID NO: 85432 - DNA, 50 bp, homo sapien
agtggttcaatgatcactctgcaagrtattgtaggaaatatctgcaccca

SEQ ID NO: 85433 - DNA, 50 bp, homo sapien
tttcaggatttgagctcatcaattaygttaaatttcctatattctgttac

SEQ ID NO: 85434 - DNA, 50 bp, homo sapien
agagacttacatatcaatagataaaygttaatagtggctgtaaatccatt

SEQ ID NO: 85435 - DNA, 50 bp, homo sapien
gcagtgatggtgaggaatgttctgaratttgcgaaggcatttgagtagtg

SEQ ID NO: 85436 - DNA, 50 bp, homo sapien
aggagaatttttaaaaaatgaatgasaaaataaggaatagcagagaacag

SEQ ID NO: 85437 - DNA, 50 bp, homo sapien
tgagtgttgcactttacctgatacaygctgatttagaaaatacagaaacc

SEQ ID NO: 85438 - DNA, 50 bp, homo sapien
aaaattaaaaactgtaaaatgtagasagatggaggcagttaacaatgggg

SEQ ID NO: 85439 - DNA, 50 bp, homo sapien
gtgggaaatgatgtgttggtaggcargaagaaggataaagcagaacaaat

SEQ ID NO: 85440 - DNA, 50 bp, homo sapien
tcattttcattggaataggaattaaragtcattttgcaaataaggtaagt

SEQ ID NO: 85441 - DNA, 50 bp, homo sapien
gccatggtggaacttgttcagatagyccttaaaacagaagatgggcaata

SEQ ID NO: 85442 - DNA, 50 bp, homo sapien
aaagctttaaatatcattttctcacrgtatattggaggccagactagttt

SEQ ID NO: 85443 - DNA, 50 bp, homo sapien
ctctattgttttattgatcagttaarcaattagatggaacactagaagca

SEQ ID NO: 85444 - DNA, 50 bp, homo sapien
tataataatgtttgggatagagtaayggcttaagttttgtcagtcattaa

SEQ ID NO: 85445 - DNA, 50 bp, homo sapien
ggtctttccccaaagcatctctctaygtcaataatagaccctatccttgg

SEQ ID NO: 85446 - DNA, 50 bp, homo sapien
gtgaagatggtatttgcagtccttcraggcagatgaaattgtttgtgtct

SEQ ID NO: 85447 - DNA, 50 bp, homo sapien
gctctgagtccctgaaggtaagaacygtgtcctatctgcttgtacattac

SEQ ID NO: 85448 - DNA, 50 bp, homo sapien
ttaataccagactaaatggtcaacargataataaaaataatcagtgaaaa

SEQ ID NO: 85449 - DNA, 50 bp, homo sapien
ccatttctagacctacttgtaacaaytccctggtgaaagtatgagagcac

SEQ ID NO: 85450 - DNA, 50 bp, homo sapien
tgtgctttggtgaccaatttaaccaygtattactgtagaaaaggtgtctt

SEQ ID NO: 85451 - DNA, 50 bp, homo sapien
ttcccactgttctttctacttggacygaccagatgcttggagcagcagct

SEQ ID NO: 85452 - DNA, 50 bp, homo sapien
agccatgtcctgttgcttcctaacasctcttgtgggtccatctcacccat

SEQ ID NO: 85453 - DNA, 50 bp, homo sapien
tgcacatttgagttccctcgttgacmcttagctaagcaaaaacccttttt

SEQ ID NO: 85454 - DNA, 50 bp, homo sapien
tacttggtctcagcatttcaagttgkaaaaggaagttaaatgattttcat

SEQ ID NO: 85455 - DNA, 50 bp, homo sapien
gctgagaccaagtacatgtggatgartaagaagacagaaaaaaaaaatac

SEQ ID NO: 85456 - DNA, 50 bp, homo sapien
gcacacataggaaatgtgtgtaaaaytggaatattgtacaagattataca

SEQ ID NO: 85457 - DNA, 50 bp, homo sapien
tttcctattagatttttaggaattamcataccaagctggaaatgtagggg

SEQ ID NO: 85458 - DNA, 50 bp, homo sapien
tgcctggtaagaggaaaaacaagacycaagttcagatggttaggtccata

SEQ ID NO: 85459 - DNA, 50 bp, homo sapien
aaatccaaattcaatatgcactttcsttaataaaaatgtacaaatatggg

SEQ ID NO: 85460 - DNA, 50 bp, homo sapien
tgtagaggagggattaggtaggtggmaattggatatgtatattctaaagc

SEQ ID NO: 85461 - DNA, 50 bp, homo sapien
gtgacataatgatcgatagacttgcmgatcctttcagtagacagaagaga

SEQ ID NO: 85462 - DNA, 50 bp, homo sapien
ccacactgatgagtagggaatgcaarcatgctgaaggcaggatggttcaa

SEQ ID NO: 85463 - DNA, 50 bp, homo sapien
tctaagtactttctatgagcatttcyataaagcagtaggaattctcactc

SEQ ID NO: 85464 - DNA, 50 bp, homo sapien
tccctggtgtaattagcaggcatagracaaagccaagtatcattaatgcc

SEQ ID NO: 85465 - DNA, 50 bp, homo sapien
tatataaaagggggcatattatgaarcaaatccagacttaaccatttcag

SEQ ID NO: 85466 - DNA, 50 bp, homo sapien
aatacctacgatcttgaaaacagacrgctttgggcgaatgccttcttgag

SEQ ID NO: 85467 - DNA, 50 bp, homo sapien
gcaaccacagacccaagggaggtaaraactctggatgaatccatgcagaa

SEQ ID NO: 85468 - DNA, 50 bp, homo sapien
ctcatcaggttggaagattatccaaytacttgcatatttgatcatacctc

SEQ ID NO: 85469 - DNA, 50 bp, homo sapien
atacaattacctaaaatattttcaartgatgtggtattgtctagattggg

SEQ ID NO: 85470 - DNA, 50 bp, homo sapien
gttgaaactggaaaggactatgaagwctaggtataatattataaaacttt

SEQ ID NO: 85471 - DNA, 50 bp, homo sapien
taaactctgatttcaatagcaggackaagataaccaatttacacacagtg

SEQ ID NO: 85472 - DNA, 50 bp, homo sapien
cagcagttctgtgatacataattcaktctctatgtcccatcaattcctat

SEQ ID NO: 85473 - DNA, 50 bp, homo sapien
atttttacatttcaaatcacttttgsaagaaagaggatatctaccataag

SEQ ID NO: 85474 - DNA, 50 bp, homo sapien
ttcttgataagaaggcagcttgagargtttggaattaaatatacatatag

SEQ ID NO: 85475 - DNA, 50 bp, homo sapien
aatgaaaacacaagttgtgagatacraaacaataaagtagaaagtttaag

SEQ ID NO: 85476 - DNA, 50 bp, homo sapien
gagacagctgaaggttcagtgtttcmataacaggcataggagaataactg

SEQ ID NO: 85477 - DNA, 50 bp, homo sapien
caagaaaagctgctatattttctcckaggtacaatgcctatgtcatatga

SEQ ID NO: 85478 - DNA, 50 bp, homo sapien
cttcttgctggtagagttaaggaccrcacttcttttgagtctctttgctc

SEQ ID NO: 85479 - DNA, 50 bp, homo sapien
agaagccttgctcactgatatttaartcttgccaatcaaaatacacattg

SEQ ID NO: 85480 - DNA, 50 bp, homo sapien
ggtactttgatatcccctagcacaaraaagaaagccacttatgacagccc

SEQ ID NO: 85481 - DNA, 50 bp, homo sapien
agaaagccacttatgacagcccagasaggtcatggaaactgaggtgttca

SEQ ID NO: 85482 - DNA, 32 bp, homo sapien
atcctccttacaacttyatttctccctgcaga

SEQ ID NO: 85483 - DNA, 50 bp, homo sapien
tgcaaggaagatagggagagatataygggtaaagagaaggctagaaggtt

SEQ ID NO: 85484 - DNA, 50 bp, homo sapien
tgtccagaaggctttagggatcttcratttcctggtaataatatgtcacc

SEQ ID NO: 85485 - DNA, 50 bp, homo sapien
gccataactttgttgtagctgtccaraatgttctaagggatgttatatct

SEQ ID NO: 85486 - DNA, 50 bp, homo sapien
ctgaaggctagccttatgtattaaakgaaatgggacattgcacattacaa

SEQ ID NO: 85487 - DNA, 50 bp, homo sapien
aacatattgtatgaatggaccattasgttgttgcttctaacatcctattt

SEQ ID NO: 85488 - DNA, 50 bp, homo sapien
gtaacaattctggcttatattaatcwatatttcaagtaggaagctgtaca

SEQ ID NO: 85489 - DNA, 50 bp, homo sapien
ttctagaacccggagcctcatcaatwatatatgaataacagtcaatggca

SEQ ID NO: 85490 - DNA, 50 bp, homo sapien
cctcttagcccaaatctagtcttcaytgtccttcttgtgatactgccaga

SEQ ID NO: 85491 - DNA, 50 bp, homo sapien
tgtcatccagttgccggaattcataytaggcattttcgcaagtataatct

SEQ ID NO: 85492 - DNA, 50 bp, homo sapien
tgaaaacttgaacctataaagcaaamaatcagtggaaataatggatattt

SEQ ID NO: 85493 - DNA, 50 bp, homo sapien
agaccccatttccaaggataatgaastgttagtatgtgagggctggaact

SEQ ID NO: 85494 - DNA, 50 bp, homo sapien
ctctgaaaaacgtgttcaaaaatgcrataaggattagaagtttagtttca

SEQ ID NO: 85495 - DNA, 50 bp, homo sapien
tagcctcctaatcatcagtttagaayagtaaatgagatatgtatctagta

SEQ ID NO: 85496 - DNA, 50 bp, homo sapien
ggttagtggatgccagtcattgctaycataaaatataataactctattcc

SEQ ID NO: 85497 - DNA, 50 bp, homo sapien
tcaacctaaatatttgtgctcaaaakcttatacaatgatgctttacccag

SEQ ID NO: 85498 - DNA, 50 bp, homo sapien
gcaacctccttctgtaagaaaggcaycaaagtcgtcacacccatcatccc

SEQ ID NO: 85499 - DNA, 50 bp, homo sapien
agtacttctaattattagccgtacayaactctccttgatcatactcaatt

SEQ ID NO: 85500 - DNA, 50 bp, homo sapien
cagaaatttattttttcatagttacrgaggctacaagtctgaaataaagc

SEQ ID NO: 85501 - DNA, 50 bp, homo sapien
catataggcaatttaaaatcactacrattaacatgttacatgctaatgaa

SEQ ID NO: 85502 - DNA, 50 bp, homo sapien
cttaacagctttcaatttccagtgawgatctaaaatatactgctaatttc

SEQ ID NO: 85503 - DNA, 50 bp, homo sapien
ataactaaaaccaaggacttgctgamaatgtagggaaagccttgaataag

SEQ ID NO: 85504 - DNA, 50 bp, homo sapien
tatgctaaatctatactgattcttakgtactttgttaataagagggctca

SEQ ID NO: 85505 - DNA, 50 bp, homo sapien
ttttacagcatgcttaagtgtctctragaatattatgtaacaaggatgac

SEQ ID NO: 85506 - DNA, 50 bp, homo sapien
tttggtgtttggtgacagcttgcttrctgactcatagatagtgccttctc

SEQ ID NO: 85507 - DNA, 50 bp, homo sapien
cattcatattctttttccattttaamacccagcttaatactttggaatgt

SEQ ID NO: 85508 - DNA, 50 bp, homo sapien
gtattttacagtcagtgagaaacatyatagagaagtgtgaactcaataga

SEQ ID NO: 85509 - DNA, 50 bp, homo sapien
gtcttgaagctaatgggataagatargtcctagaggttccttctgcttgg

SEQ ID NO: 85510 - DNA, 50 bp, homo sapien
tttgggctaaaaatcatggtcatagraagaactgtatgttggtcaaatgt

SEQ ID NO: 85511 - DNA, 50 bp, homo sapien
attgaatgaaatcatgtgtgttgaartacttaaagcagagtagatggctc

SEQ ID NO: 85512 - DNA, 50 bp, homo sapien
aacccccttaaatgcaggtgtcggayatttagctcacaacaacatagtcc

SEQ ID NO: 85513 - DNA, 50 bp, homo sapien
gttggaagaaacaaagaaaagaaccyagatactctggaggaaatgtaatg

SEQ ID NO: 85514 - DNA, 50 bp, homo sapien
catgattggggttcacatagtatgcrattaacgtctctgagtaatcagga

SEQ ID NO: 85515 - DNA, 50 bp, homo sapien
attatgtttcccagaatgtatcattkttgcatttgattgtccatttaaaa

SEQ ID NO: 85516 - DNA, 50 bp, homo sapien
acattttcagagtcaaaacttggagrattcctcatattttccttgcttta

SEQ ID NO: 85517 - DNA, 50 bp, homo sapien
gcttgtttaattcataagtatgaaayatgaggtgaagtttcaaaggcagt

SEQ ID NO: 85518 - DNA, 50 bp, homo sapien
catacctaggacaatatctgccacarggtaggcactcaaatattcattga

SEQ ID NO: 85519 - DNA, 50 bp, homo sapien
ccaccataggccattctttctctaasagtccgatttaatttgtccatgac

SEQ ID NO: 85520 - DNA, 50 bp, homo sapien
tgtgagggtgcatttgtgacaagaasaacaaatagatgtgcaaagaaaaa

SEQ ID NO: 85521 - DNA, 50 bp, homo sapien
cagagcctgtgaataaggcattgttytacctttcagtgctcaagctcaag

SEQ ID NO: 85522 - DNA, 50 bp, homo sapien
aataaagataattaattgagcaaaasattatcagtggatgctagactcaa

SEQ ID NO: 85523 - DNA, 50 bp, homo sapien
acttttcttcttttgttttcaccaartaaataaattcatgtggtttattc

SEQ ID NO: 85524 - DNA, 50 bp, homo sapien
tattttaaaacactactcagtcttarcaaacatattgtaaattagaactg

SEQ ID NO: 85525 - DNA, 50 bp, homo sapien
agtgtggctgtgggaaaggaataaayctgatgtacttaagctgggtgaaa

SEQ ID NO: 85526 - DNA, 50 bp, homo sapien
ccaccaccaccatccctactgtctcycagatcgatttttaggatattggt

SEQ ID NO: 85527 - DNA, 50 bp, homo sapien
catggagatatattacatagagatayaattgatctaggtttttaggtaga

SEQ ID NO: 85528 - DNA, 50 bp, homo sapien
gcatacataatagctaatattattawcatcaaacctattttttaattttt

SEQ ID NO: 85529 - DNA, 50 bp, homo sapien
tccttttcaaactctttttaggctayggtagacaacttgccatcaaatta

SEQ ID NO: 85530 - DNA, 50 bp, homo sapien
aactacaaatataataacatgttaayacaatcttcaggatagttactggg

SEQ ID NO: 85531 - DNA, 50 bp, homo sapien
tttttaatttttttattttttttgcmatctcttcggagtatcatatctga

SEQ ID NO: 85532 - DNA, 50 bp, homo sapien
catattatgttattgccaaaaaaggkagtaacacaactcaaaccagctat

SEQ ID NO: 85533 - DNA, 50 bp, homo sapien
agaaacagtaatgaaatagactgcartgagacaaaactgaataaaatgga

SEQ ID NO: 85534 - DNA, 50 bp, homo sapien
tagattcaacataaaagctaaattasataattggcatggacagctcttag

SEQ ID NO: 85535 - DNA, 50 bp, homo sapien
tctagatatagaggtcattgaaatayaagtgattattgatagaaatatgt

SEQ ID NO: 85536 - DNA, 50 bp, homo sapien
tacatttataaatatcagttacaaayggaaataagaataaaaagatgttt

SEQ ID NO: 85537 - DNA, 50 bp, homo sapien
atctctagacctgaaagatgaagcaragtagatatcccaaaggtaataat

SEQ ID NO: 85538 - DNA, 50 bp, homo sapien
gaaaagaattatctattactcatackatttgcttaactctctcttttcca

SEQ ID NO: 85539 - DNA, 50 bp, homo sapien
taaataaatgtgtccttatctaaccrcaaaactgctaagcctttcatttg

SEQ ID NO: 85540 - DNA, 50 bp, homo sapien
gaataggtaaaagatcttcctgttamactaaatgttgagttatttgtctt

SEQ ID NO: 85541 - DNA, 50 bp, homo sapien
tagcacttacatctgaggatttcaasaagactgaaacattcattgttttc

SEQ ID NO: 85542 - DNA, 50 bp, homo sapien
gtggggggcagacagacattcagacwataacattagattatacctaaaga

SEQ ID NO: 85543 - DNA, 50 bp, homo sapien
gaacagtaacattttgaaagcagtcyttcctttctgagaagttggtctca

SEQ ID NO: 85544 - DNA, 50 bp, homo sapien
tggggtcagctgggatccatggtaaragcctccaaaatgactccttcaat

SEQ ID NO: 85545 - DNA, 50 bp, homo sapien
gctcaggaagggggtcctttccaatrgagtgagcagttgtccaagtaagg

SEQ ID NO: 85546 - DNA, 50 bp, homo sapien
tctcaaagccaaccctgagttctgamaggaggaataatccaattctggca

SEQ ID NO: 85547 - DNA, 50 bp, homo sapien
agtaacattttagggctccatttacytctcgtatattgttcttttctgta

SEQ ID NO: 85548 - DNA, 50 bp, homo sapien
ttccttgaccctaataatgtatcacyctgaattgctatttttatttatgc

SEQ ID NO: 85549 - DNA, 50 bp, homo sapien
taacacagcagtgaattgtaagtacragtgtcagccatcctgtttgcaat

SEQ ID NO: 85550 - DNA, 50 bp, homo sapien
attctttagccttttcttaaagtaasctgctaagtatttacaggttaatt

SEQ ID NO: 85551 - DNA, 50 bp, homo sapien
tgagatgatttggagatatatagacsatcaataatttttacagactctag

SEQ ID NO: 85552 - DNA, 50 bp, homo sapien
gccagggtgtctaggctgagagttcyaaaagaaagcagctggtacagatg

SEQ ID NO: 85553 - DNA, 50 bp, homo sapien
tgaagaactcctgcctgacatcagargaaagtaaaagagtaaggttagtc

SEQ ID NO: 85554 - DNA, 50 bp, homo sapien
ctacaattattgatcataagccttayaggtaacatgaactgtctattaac

SEQ ID NO: 85555 - DNA, 50 bp, homo sapien
catttaatttactttacaaaaaggcratataagttgactcttagtggaac

SEQ ID NO: 85556 - DNA, 50 bp, homo sapien
atctatgagatatgttgaaatgttayggtgattaatcatgtaaaaggggg

SEQ ID NO: 85557 - DNA, 50 bp, homo sapien
gcaatgacattagcattatgaggaaraatgaatacttataaagtacttag

SEQ ID NO: 85558 - DNA, 50 bp, homo sapien
aaaaggaactgtcaaccaagaatacygtatctatcagaactatactcaga

SEQ ID NO: 85559 - DNA, 50 bp, homo sapien
ggctatttgatgaacatgactttcaytcccttttaggctcctatgatata

SEQ ID NO: 85560 - DNA, 50 bp, homo sapien
tctagtggttgttctcagtcttaackgcattttagaaccacctggagtgt

SEQ ID NO: 85561 - DNA, 50 bp, homo sapien
gacaaaaatttgagttaccctaagasagatgatttgggaaccaaaaaaaa

SEQ ID NO: 85562 - DNA, 50 bp, homo sapien
tagaattatgtaccgacattagatawatcccaattacttatattttatca

SEQ ID NO: 85563 - DNA, 50 bp, homo sapien
tgcttttctgtccagggtaagccacraggcattgtcatctcagggtagtg

SEQ ID NO: 85564 - DNA, 50 bp, homo sapien
cccatttaacagattaggagagtaaracagaataattcagtcagtcattt

SEQ ID NO: 85565 - DNA, 50 bp, homo sapien
caaatattccttccactaagtacaastaaaatccctggacattatgtata

SEQ ID NO: 85566 - DNA, 50 bp, homo sapien
ctgcataagaggattgcagctgataygtgtaataaaggaaatcattgcag

SEQ ID NO: 85567 - DNA, 50 bp, homo sapien
tatttctatctcattatgtttcaatragaaagagacagaagtagtaagag

SEQ ID NO: 85568 - DNA, 50 bp, homo sapien
aaattaactctcctatatgagttcaraaatacatattttaaagggtgttc

SEQ ID NO: 85569 - DNA, 50 bp, homo sapien
ctcctagaagtcacaacaatatctcratgcactccttggctctgattaca

SEQ ID NO: 85570 - DNA, 50 bp, homo sapien
caaaagcagtagaatactgttcttcwacttgataaatacttttattgagg

SEQ ID NO: 85571 - DNA, 50 bp, homo sapien
tcctttcaattcattgttaatcatayagtatctgaaaacttcataagtat

SEQ ID NO: 85572 - DNA, 50 bp, homo sapien
ctaattgacacaaggagatgcttcaragatcctaagaaagtgtactgcaa

SEQ ID NO: 85573 - DNA, 50 bp, homo sapien
ttctttattatctatgtggtatgcamaacttttctaagcctatttccttt

SEQ ID NO: 85574 - DNA, 50 bp, homo sapien
gtttcctatctgctctcctttcagaytccaagggccctacataaggaaca

SEQ ID NO: 85575 - DNA, 50 bp, homo sapien
gtgaaaatgtcatgtaagtaatagckgaccattcaatattagttttcttt

SEQ ID NO: 85576 - DNA, 50 bp, homo sapien
aataaacaagtaaagttgattatgcygattttattcaatttgctcaacta

SEQ ID NO: 85577 - DNA, 50 bp, homo sapien
tgactttgtgccagggtgaaattcayatcagtaggactctctttctagat

SEQ ID NO: 85578 - DNA, 50 bp, homo sapien
attcctaacacagaaaacaacctaamagagcaacaaagattgagcctttg

SEQ ID NO: 85579 - DNA, 50 bp, homo sapien
gatcttgctggtgaactcagtagtargtgagttgagatgcttggatctgt

SEQ ID NO: 85580 - DNA, 50 bp, homo sapien
aaaagataatattgacccttcaagaygaggtctcatgggtatagaatggt

SEQ ID NO: 85581 - DNA, 50 bp, homo sapien
aaacttactattttacctaattttakattcacatgtagttataaaaaaaa

SEQ ID NO: 85582 - DNA, 50 bp, homo sapien
catgccatctccgggccacagtcaayggtttgagaagggagtgtgactcc

SEQ ID NO: 85583 - DNA, 50 bp, homo sapien
ttatataagagctacttatgctaagraactatatcatgttcatcagatat

SEQ ID NO: 85584 - DNA, 50 bp, homo sapien
aaaataaatacattgcttccttagaygaaattttgaagagaaaactctta

SEQ ID NO: 85585 - DNA, 50 bp, homo sapien
cttttacaaaaggatcatactatacrcattactttacaatctcttgtttc

SEQ ID NO: 85586 - DNA, 50 bp, homo sapien
accttgtgcagttctcacataatgcygaaatgattgaaatgttggcagtt

SEQ ID NO: 85587 - DNA, 50 bp, homo sapien
aaatggccaccaatagtggaaactgraacaggttaaccacgaattcaaaa

SEQ ID NO: 85588 - DNA, 50 bp, homo sapien
gagcaataaatcctatagttacttayctctgttgtctcacctgttatttc

SEQ ID NO: 85589 - DNA, 50 bp, homo sapien
cccaatattttcactgaaatagttaygaaaatacagaatacatataaaaa

SEQ ID NO: 85590 - DNA, 50 bp, homo sapien
ctttattctcaaagattataaatacmgaactctaatatgttaacaattaa

SEQ ID NO: 85591 - DNA, 50 bp, homo sapien
tatacaatttatatatttcaaagagyctataatacaaatcaaaaatcttg

SEQ ID NO: 85592 - DNA, 50 bp, homo sapien
aaagctgctactagcattcatatgcrattttgtgtaggagtaagttttca

SEQ ID NO: 85593 - DNA, 50 bp, homo sapien
cttggtttcctcaattagtatcatcygaatgtcccaggtgaagaagctaa

SEQ ID NO: 85594 - DNA, 50 bp, homo sapien
tttgccatgtagtaaaggtaattggycaaacagcacctcagaatcaacct

SEQ ID NO: 85595 - DNA, 50 bp, homo sapien
ttttttttttaacgttccagataccrcataatgtctaattctgaggaaat

SEQ ID NO: 85596 - DNA, 50 bp, homo sapien
ttggaagctcaatctaaacagtcccrtgagtaagaacagaaacagtaagt

SEQ ID NO: 85597 - DNA, 50 bp, homo sapien
tcccagattaatttagagctttatcrcttgatgaggtaattgatgaatct

SEQ ID NO: 85598 - DNA, 50 bp, homo sapien
ctccatccaaggcttggaataaacawgtgccttatgcttcccttttcaca

SEQ ID NO: 85599 - DNA, 50 bp, homo sapien
ggtccaggctggagacataaatttgraagtgttgggttatagatgacatt

SEQ ID NO: 85600 - DNA, 50 bp, homo sapien
acatctttccccttaaggcaatacawatgattgtgctaaaaaaattatac

SEQ ID NO: 85601 - DNA, 50 bp, homo sapien
ccttggtgagctcatcaggtctcgargctttaaatgtcatctataaccca

SEQ ID NO: 85602 - DNA, 50 bp, homo sapien
ttcaagaatgtcaactggtggtagamgtaaaaattgatcaattgcacatt

SEQ ID NO: 85603 - DNA, 50 bp, homo sapien
ttagtgaatgcagaatgaagagaaarttggtggaaaatagataagaaagt

SEQ ID NO: 85604 - DNA, 50 bp, homo sapien
tatttgactgtaggggagatttctcyacctttagctgcctatatagaccc

SEQ ID NO: 85605 - DNA, 50 bp, homo sapien
ggacgagtaagcacttttctttaackgcatgacctttaaggaagaaacca

SEQ ID NO: 85606 - DNA, 50 bp, homo sapien
tttaagttttcatttaaagaaattgraaataaacactctcactgaggaaa

SEQ ID NO: 85607 - DNA, 50 bp, homo sapien
aaatatttttcaatgttttgttgtargtccacttttttattattgttcta

SEQ ID NO: 85608 - DNA, 50 bp, homo sapien
aaaccctcaacttttctcaaagatayggtacaaatcagagtctgggtttc

SEQ ID NO: 85609 - DNA, 50 bp, homo sapien
agatattaaattgacagcatcaaaayggagggaacctggatcctgagtca

SEQ ID NO: 85610 - DNA, 50 bp, homo sapien
acaacagtggagtttctattccggayggaggagtgtattgtcaggggaac

SEQ ID NO: 85611 - DNA, 50 bp, homo sapien
aatgctatacaaaaaaagcgcacacygtatgattccattttatatgaatt

SEQ ID NO: 85612 - DNA, 50 bp, homo sapien
tttatttaaagaggacgtatattcaygcctaaataaataaaccaaaatca

SEQ ID NO: 85613 - DNA, 50 bp, homo sapien
aatcatcagttcacaccacacttcarataagtactcaatttcttgactat

SEQ ID NO: 85614 - DNA, 50 bp, homo sapien
tcttcttcagcttgatgttaatttcratgaaatcttccaagatgtatctt

SEQ ID NO: 85615 - DNA, 50 bp, homo sapien
aaaatataacttatgcaaataataakaatctactcaagtaatagaatata

SEQ ID NO: 85616 - DNA, 50 bp, homo sapien
tatgtgaggatgtgcataggatacascactttatatcatcagggacttga

SEQ ID NO: 85617 - DNA, 50 bp, homo sapien
aattttatctgagcaagaaataatcrtctgtgtactaagtcatgcaattt

SEQ ID NO: 85618 - DNA, 50 bp, homo sapien
tgctaagagagtatagagggtgtgcmataaactaaatctgcaggtattaa

SEQ ID NO: 85619 - DNA, 50 bp, homo sapien
atgactctggaataatttgcagaagraaaagatggaatcatttgtgaacc

SEQ ID NO: 85620 - DNA, 50 bp, homo sapien
gttaatcaaatttttgaagatgtacyattttacccctaaatcttttagca

SEQ ID NO: 85621 - DNA, 50 bp, homo sapien
atttggaaatgaagtatggcttaaasagatgtgtatggctacaaagttga

SEQ ID NO: 85622 - DNA, 50 bp, homo sapien
gccataatctcgaatatggaaatccraaaaggtcaatatccctaaagtct

SEQ ID NO: 85623 - DNA, 50 bp, homo sapien
tccatgtatgaagacatatttctccrcatgttcaggacaagtcattcctt

SEQ ID NO: 85624 - DNA, 50 bp, homo sapien
acttatagactgatttctgcaggaarattaagaaaaacatatgtgttggc

SEQ ID NO: 85625 - DNA, 50 bp, homo sapien
atgtaatcacattctatacaaggaasatttaaccaaatagagctgccaca

SEQ ID NO: 85626 - DNA, 50 bp, homo sapien
caataaatattgattaatggagttaygaattagatgaatgataatggatt

SEQ ID NO: 85627 - DNA, 50 bp, homo sapien
ttctcccaaaaggcctttgactcacraaatgctacaaatcactcctccat

SEQ ID NO: 85628 - DNA, 50 bp, homo sapien
ttgatttagagagagcttaccgatawaagtaagctgtctcactgtgtatc

SEQ ID NO: 85629 - DNA, 50 bp, homo sapien
caggactgactgggcttggatccagracatgtatggtacgtgtatgtttt

SEQ ID NO: 85630 - DNA, 50 bp, homo sapien
aaatatgagtttctctgaaagaatasaaaaaatagaaacacctggaaaca

SEQ ID NO: 85631 - DNA, 50 bp, homo sapien
caaggcaatttaaatagtactggaartatcaaggcttacatttgcagctg

SEQ ID NO: 85632 - DNA, 50 bp, homo sapien
attacaatagtatgaattagaaagtrtaagtgaagagataaaaatgacac

SEQ ID NO: 85633 - DNA, 50 bp, homo sapien
tgggtaaacatgtaagaaatgccacrggtaagctaagagcaatgttctga

SEQ ID NO: 85634 - DNA, 50 bp, homo sapien
gcataataataggtacatattgagayagacaaaattaaaatgattgataa

SEQ ID NO: 85635 - DNA, 50 bp, homo sapien
gtataaagatactttctaaagtttargtgacattcttgagttgggtacag

SEQ ID NO: 85636 - DNA, 50 bp, homo sapien
gattttaactcccctacactgaaacrattttactgggttttgtgatacag

SEQ ID NO: 85637 - DNA, 50 bp, homo sapien
tagaagctttagacaatgaggaaaayggaaataagattggttgagatctt

SEQ ID NO: 85638 - DNA, 50 bp, homo sapien
gtgtcacagtcacagacgtattacakgactgacttacagcatgactttaa

SEQ ID NO: 85639 - DNA, 50 bp, homo sapien
aagctctggaaggaaccattcatgamcaaaggtagaagacgtgacttgcc

SEQ ID NO: 85640 - DNA, 50 bp, homo sapien
tacataatatcccaattatgtatgcraccacaaaatagtcgcgttagaat

SEQ ID NO: 85641 - DNA, 50 bp, homo sapien
tttagtctctattttgttttaaggasagagattattttgacagattgatg

SEQ ID NO: 85642 - DNA, 50 bp, homo sapien
ttgaacacctttagatatccataacraactaaggaactatacaagtttgc

SEQ ID NO: 85643 - DNA, 50 bp, homo sapien
ttgaaaccaggggcctagatgactamccacatactaacaaaatatgttgt

SEQ ID NO: 85644 - DNA, 50 bp, homo sapien
agaatttgtatctacacagcattggycaaaactatgtcatatggccatct

SEQ ID NO: 85645 - DNA, 50 bp, homo sapien
ttattcaacatatgtaaaatgcatgmcatacagcaaataattcattgttt

SEQ ID NO: 85646 - DNA, 50 bp, homo sapien
agggtcacctattaaggaatctattwttatcttcatgttgtagctgaatc

SEQ ID NO: 85647 - DNA, 50 bp, homo sapien
gaagtctgaatctcatagtcacgggwaaagtctgtagcagataaggtagt

SEQ ID NO: 85648 - DNA, 50 bp, homo sapien
agagagtgagtttaatgagtgagcamcaaaagttaggcaacctaccatta

SEQ ID NO: 85649 - DNA, 50 bp, homo sapien
agtttctagcatattctgagtcagcrattcctgtctccacactcagggaa

SEQ ID NO: 85650 - DNA, 50 bp, homo sapien
tcatatagatgactctgatatcgaayacaatgtgaatgggctccctggag

SEQ ID NO: 85651 - DNA, 50 bp, homo sapien
gtagctcttctccctacaagtttcastataaactcattcaatataaagtc

SEQ ID NO: 85652 - DNA, 50 bp, homo sapien
gggtggttttcacgtaatctgcatakagcaaggcaaacaaataatgatct

SEQ ID NO: 85653 - DNA, 50 bp, homo sapien
aatcaagagataatttctacctaagkgtaatcttctacaacgaaggcact

SEQ ID NO: 85654 - DNA, 50 bp, homo sapien
caattcaattattatgtcaattccaygaaaaaaatatgctactgatgtca

SEQ ID NO: 85655 - DNA, 50 bp, homo sapien
ttcctctacagcaatctcattcctamatatgacttctggtttcaacaaca

SEQ ID NO: 85656 - DNA, 50 bp, homo sapien
aagccccatttctatttgctaaatamacttggctggcttaaaattcctct

SEQ ID NO: 85657 - DNA, 50 bp, homo sapien
cagaaaatgtacaataattgcaccayataagagactagtaatcacaacag

SEQ ID NO: 85658 - DNA, 50 bp, homo sapien
tttcattatactggttttgctattasggtaatgctagcttcataagatgc

SEQ ID NO: 85659 - DNA, 50 bp, homo sapien
tatgaagatttagccttttaccatckgataattgtctcactaagatatcc

SEQ ID NO: 85660 - DNA, 50 bp, homo sapien
ttagggttttaaatgattgtcaagtkgtcataatactaagccacaggatg

SEQ ID NO: 85661 - DNA, 50 bp, homo sapien
cttcggcttcaaccactgattgtccrgaattcagaccacaaaagtggctc

SEQ ID NO: 85662 - DNA, 50 bp, homo sapien
acattctcttcctggaaagcatcccracttctttaaataactgttcatgg

SEQ ID NO: 85663 - DNA, 50 bp, homo sapien
atattgtgtggcttcaaaaatactamgctctcatctagcaattatagttc

SEQ ID NO: 85664 - DNA, 50 bp, homo sapien
acttatgcatattgcttagtgccaaygggactcttagaaatgtatttgag

SEQ ID NO: 85665 - DNA, 50 bp, homo sapien
aaattcacaggggagaccaaattcgsaggatgaattccatcaagttagaa

SEQ ID NO: 85666 - DNA, 50 bp, homo sapien
agggtcattgtgagcagtaagtcctyaatctcagggcaggtaggcccccc

SEQ ID NO: 85667 - DNA, 50 bp, homo sapien
atggttgaactaatttactaaagaamaaacatgttgtggagtctcactgc

SEQ ID NO: 85668 - DNA, 50 bp, homo sapien
atgtgcaaacaaaacataacagatamcaggccattcagaaactgttactg

SEQ ID NO: 85669 - DNA, 50 bp, homo sapien
catgatttctcaatattcaagggctraatccttttcctgaccacattttc

SEQ ID NO: 85670 - DNA, 50 bp, homo sapien
accaatcccattgtagtgacagcaaycacggaagcaaacaaaaccattag

SEQ ID NO: 85671 - DNA, 50 bp, homo sapien
tgctacgtaattaagatacaggtgargatccaaaaataagtcaagtcgaa

SEQ ID NO: 85672 - DNA, 50 bp, homo sapien
actatttaattcttcggtcattctartaattgtgtagtgatatctcattg

SEQ ID NO: 85673 - DNA, 50 bp, homo sapien
aacagggctggccggtctctccctamggttgtagaattaaaagtaccttt

SEQ ID NO: 85674 - DNA, 50 bp, homo sapien
aagatctggaacctgtaatcttcacsatcaaggtaaacagggctggccgg

SEQ ID NO: 85675 - DNA, 50 bp, homo sapien
atatgagtaaatgacaattcaataamgtaatgacgatgaggaccgactct

SEQ ID NO: 85676 - DNA, 50 bp, homo sapien
ctccaatgtggttactattgctaaamagcgacatctaagacagcagccac

SEQ ID NO: 85677 - DNA, 50 bp, homo sapien
aacctactgcatgttagcaataacayggatttgtgaaaaataattatgtt

SEQ ID NO: 85678 - DNA, 50 bp, homo sapien
accacgtggtagatgaataaaaccaygtgactagaagtcataaaaccaca

SEQ ID NO: 85679 - DNA, 50 bp, homo sapien
agctaggtgggccctaagaagggaaytggtctttcttctaagaggaatgc

SEQ ID NO: 85680 - DNA, 50 bp, homo sapien
gccctcaggagttgtagagaaggagraagatatcatagagaagggaactg

SEQ ID NO: 85681 - DNA, 50 bp, homo sapien
catatgcttaatcccaagaagaccaygattttagagctaaattattgcca

SEQ ID NO: 85682 - DNA, 50 bp, homo sapien
ggcaatatcatggtggatttacaagraccaacaattccgttgactcctga

SEQ ID NO: 85683 - DNA, 50 bp, homo sapien
gaggcagagaaggcttgagtcaaatmaccctgattctcaggggaaaggca

SEQ ID NO: 85684 - DNA, 50 bp, homo sapien
agctgtgttagtggctctattaggamcaactgcaggtacaagaaagcctg

SEQ ID NO: 85685 - DNA, 50 bp, homo sapien
agaataaatactttgagtatacttamattttctgataggctgtaaacctc

SEQ ID NO: 85686 - DNA, 50 bp, homo sapien
tttctgacatacatgctattgttacraaacctggattctcagcacatcta

SEQ ID NO: 85687 - DNA, 50 bp, homo sapien
ttattgttggtctccaaaattagaaytgattcctcacaaatttaacagtg

SEQ ID NO: 85688 - DNA, 50 bp, homo sapien
gaaaatgttcagctacatgttggaastctcctaaactggcaattttccat

SEQ ID NO: 85689 - DNA, 50 bp, homo sapien
aatacccattttgacgtgaatatctraagtgttatgaaaccaactacata

SEQ ID NO: 85690 - DNA, 50 bp, homo sapien
agggcactaaagtaagaaaaatgctstagtctcattcttgaaatattaac

SEQ ID NO: 85691 - DNA, 50 bp, homo sapien
ccaacctttcaattaattttcatcayccattatatttttctaatcttggg

SEQ ID NO: 85692 - DNA, 50 bp, homo sapien
gatagtactatgaaattgaagtgcaygtaaattgaaacttcctctccatg

SEQ ID NO: 85693 - DNA, 50 bp, homo sapien
agttactcaggaataaagatatctcrccaggcaagagaggatttaatgtt

SEQ ID NO: 85694 - DNA, 50 bp, homo sapien
tgaggggacttttcaaagaaataagscacatttacaatagcaagcttgta

SEQ ID NO: 85695 - DNA, 50 bp, homo sapien
atcccaagttctttgagtggagccayattgagtccttctgggtggatttt

SEQ ID NO: 85696 - DNA, 50 bp, homo sapien
gccatcatttctcatcaggttactgrgactatgtgagcttttcagtgtac

SEQ ID NO: 85697 - DNA, 50 bp, homo sapien
gaaaaagacctatgaaaacataagcragagagtctactaaattactctaa

SEQ ID NO: 85698 - DNA, 50 bp, homo sapien
cttttcaagtgaccaccttagtagayggcagcagagttgaatttatcctt

SEQ ID NO: 85699 - DNA, 50 bp, homo sapien
gaagaggcacctgtcctgaagtagaytaacatatcaaagtggttctatga

SEQ ID NO: 85700 - DNA, 50 bp, homo sapien
aatatttgccatattacattaagaaraacagatttaataattgtttagta

SEQ ID NO: 85701 - DNA, 50 bp, homo sapien
caaacttaatgaaccctattaatcawctcagctcctcctcctaattcctt

SEQ ID NO: 85702 - DNA, 50 bp, homo sapien
acagccgaatcaccatctttcactcmacaattattttatgagagtctatt

SEQ ID NO: 85703 - DNA, 50 bp, homo sapien
agtctgggaatcaaaagcggtaacarctacactttaacgacaggacacac

SEQ ID NO: 85704 - DNA, 50 bp, homo sapien
atcttagcacttttctgcataaaagscttcagtagatcttcatcaccttc

SEQ ID NO: 85705 - DNA, 50 bp, homo sapien
ttatatacgactctgggaagtgggcrttatggtctttataactggaaagt

SEQ ID NO: 85706 - DNA, 50 bp, homo sapien
cagcccactcagatgcaacaaaatakcagcgtgtgtgtatgctggaggca

SEQ ID NO: 85707 - DNA, 50 bp, homo sapien
atatagagttcagatgagataagagwcagcattttatagccctgtgaatg

SEQ ID NO: 85708 - DNA, 50 bp, homo sapien
gttaacagactagtgaataaaaaagrtaatgcaggtactgtagtgtggtg

SEQ ID NO: 85709 - DNA, 50 bp, homo sapien
taagttgcatgcatctttacattcartcatagccctccccaatatacatg

SEQ ID NO: 85710 - DNA, 50 bp, homo sapien
cctatatgtcactttctatgccatamaacttcctagctttttgttgtttc

SEQ ID NO: 85711 - DNA, 50 bp, homo sapien
tcaaaaagaatttccaaacttttccrcagtaattgtatcattttaaattt

SEQ ID NO: 85712 - DNA, 50 bp, homo sapien
cactttagtctttgtttagtacagaygaaatccaagtgataataggtggg

SEQ ID NO: 85713 - DNA, 50 bp, homo sapien
agtgggcaccaaataagtagctgtcraataaatgtatatacattccttat

SEQ ID NO: 85714 - DNA, 50 bp, homo sapien
accaagaagtcaatgcttttttgccmaactgagcgttttctgaagagtaa

SEQ ID NO: 85715 - DNA, 50 bp, homo sapien
cagcactttcagataggtgaaaaaarcagcttataggctgtgtctggtcg

SEQ ID NO: 85716 - DNA, 50 bp, homo sapien
gcatttcacaaagtaatagaggtaartgtcatacttgcagatgggacctt

SEQ ID NO: 85717 - DNA, 50 bp, homo sapien
cattgctctctccccaccttgattgmaccttcatagcaatgtaagctctt

SEQ ID NO: 85718 - DNA, 50 bp, homo sapien
gaatgggcatggtgattatccaaaartggccaagatgaggattctgccct

SEQ ID NO: 85719 - DNA, 50 bp, homo sapien
aaaatgaagtatctcctatcttctcygaattctctcaagcagcactcaaa

SEQ ID NO: 85720 - DNA, 50 bp, homo sapien
aagcaaatggacagtggattacctargccaagttggagggaagaaagaag

SEQ ID NO: 85721 - DNA, 50 bp, homo sapien
cagtgttagtatttctgataacttayccttgaatacagtgtaaagctcag

SEQ ID NO: 85722 - DNA, 50 bp, homo sapien
aaaactcttgaatctctgaattataygttacaggtagctaaattcatgtt

SEQ ID NO: 85723 - DNA, 50 bp, homo sapien
ccaagtgtactatcagagtaatttawaatatctcacatggagatctgctt

SEQ ID NO: 85724 - DNA, 50 bp, homo sapien
ctgaaaagatgagccactgcagaacyatagaatcgaaacctagttttttt

SEQ ID NO: 85725 - DNA, 50 bp, homo sapien
tttacaaatgtaccaagtttaataaragtcatcttgttttaaatgatctg

SEQ ID NO: 85726 - DNA, 50 bp, homo sapien
caggcttcgaagccccttcattacasattgacacgagtgctcccagaatt

SEQ ID NO: 85727 - DNA, 50 bp, homo sapien
gcttacatactaattcctctgatcawcaatctcacttctttcacatttca

SEQ ID NO: 85728 - DNA, 50 bp, homo sapien
tatttcctgaaccagggaacacttargaaagagcatatctggagaagggg

SEQ ID NO: 85729 - DNA, 50 bp, homo sapien
gccaaattacttctctgtttctcaayttccacctctgtaaaatggaaata

SEQ ID NO: 85730 - DNA, 50 bp, homo sapien
tcgtaatgacagctggataaaaacaratatttctaatgactactcaaggt

SEQ ID NO: 85731 - DNA, 50 bp, homo sapien
taatcttatttacactggttaattcwcttagcaatttttaaaaaaattct

SEQ ID NO: 85732 - DNA, 50 bp, homo sapien
ttaactccttcataaaatatccagaygagtagccttagtaaaccttctcc

SEQ ID NO: 85733 - DNA, 50 bp, homo sapien
tgggaattcaaatggagaattactgmaaatgctacctcaataaatttata

SEQ ID NO: 85734 - DNA, 50 bp, homo sapien
tcaagggttatttaatcttttactargtcagttgggggtgatttggagag

SEQ ID NO: 85735 - DNA, 50 bp, homo sapien
gacagaacccatcagaagagcattgratctgaactgtccactaaggcaag

SEQ ID NO: 85736 - DNA, 50 bp, homo sapien
tgcactccagcctgggtgatagagcrgaaccctttttcaaaaaacaaaca

SEQ ID NO: 85737 - DNA, 50 bp, homo sapien
attatgtaaactacaaccagccagartactagtgaaatattgaatagtac

SEQ ID NO: 85738 - DNA, 50 bp, homo sapien
tctcactctgcagagagactttaccrcttctacagtcctcgtggcacaat

SEQ ID NO: 85739 - DNA, 50 bp, homo sapien
aaattgagttagccagcttatattaycggcaatagttttttagtctgaaa

SEQ ID NO: 85740 - DNA, 50 bp, homo sapien
atcatctcccaaattatgctcaactygagtgcctttactggctcatcaat

SEQ ID NO: 85741 - DNA, 50 bp, homo sapien
tctaaactgggcctgtagcaatgagwagatggaatgatgagcaagaagga

SEQ ID NO: 85742 - DNA, 50 bp, homo sapien
caggtataacttatttttccatctcyatatgctatatctaaatttcaatt

SEQ ID NO: 85743 - DNA, 50 bp, homo sapien
gattctttggcgttacattactagcmctttaacagcagtgtgtggctcag

SEQ ID NO: 85744 - DNA, 50 bp, homo sapien
agcttctcagagagttgcaagcacargacatgaatcagtggtatcataag

SEQ ID NO: 85745 - DNA, 50 bp, homo sapien
gtcagctggtacagtttaccagttcyattgggacttcagcatgattagtt

SEQ ID NO: 85746 - DNA, 50 bp, homo sapien
gtgacatattgaaaatgaggttttaygaatgattcccctagacaccatct

SEQ ID NO: 85747 - DNA, 50 bp, homo sapien
tgaagtagggaaaataatagctgaakaatgagtaatgtttaaattaagta

SEQ ID NO: 85748 - DNA, 50 bp, homo sapien
agactttgcttcaagactctcttctsttttatagatgtaattccactcaa

SEQ ID NO: 85749 - DNA, 50 bp, homo sapien
tcttccaggaccaaacaaaactgaayaggaactcaagtcactcaagtaac

SEQ ID NO: 85750 - DNA, 50 bp, homo sapien
tacatacgtttccaatttgtctactragaaataaatgttctagaaatcaa

SEQ ID NO: 85751 - DNA, 50 bp, homo sapien
atgccattttatgatttcttctccamaaaatattttattccaactaaaac

SEQ ID NO: 85752 - DNA, 50 bp, homo sapien
agcacaccagggggctagtagcaaarcccttgatcaaataccctcttgga

SEQ ID NO: 85753 - DNA, 50 bp, homo sapien
cattaatcatcttaatacattccatratgctaaacaactttcagggagtc

SEQ ID NO: 85754 - DNA, 50 bp, homo sapien
gtcctgtaaccattttgctatcttaygtgttgttttaaatgcattttttt

SEQ ID NO: 85755 - DNA, 50 bp, homo sapien
taaccaagaaaatccagaattgttaygacagagtggatgaagttagaaga

SEQ ID NO: 85756 - DNA, 50 bp, homo sapien
tgtgttggttggaagtggtagaagasagagaaaatagagttccctttatt

SEQ ID NO: 85757 - DNA, 50 bp, homo sapien
ggatgtgagcagggctaattgctatrtatggttatgtaggttggacatgg

SEQ ID NO: 85758 - DNA, 50 bp, homo sapien
cttttgtattgaacattgtatttcawaatgattgtatatttctctgaatt

SEQ ID NO: 85759 - DNA, 50 bp, homo sapien
tttgcagctcaggtaagaacaattcyaacttccagatgagattagagcct

SEQ ID NO: 85760 - DNA, 50 bp, homo sapien
cccctggcgcctcctaagttagaacratatccactgagttgccaccaagt

SEQ ID NO: 85761 - DNA, 50 bp, homo sapien
gagcttgaagatcacttaaaagcaamgatggcatgtttggaactctaaaa

SEQ ID NO: 85762 - DNA, 50 bp, homo sapien
gtactttaaagaatagatgtaattamgcaaagctattcaataggaatttt

SEQ ID NO: 85763 - DNA, 50 bp, homo sapien
atctggagagaatactatgacaatakatagcatttcctggagagggagag

SEQ ID NO: 85764 - DNA, 50 bp, homo sapien
agaatgaatttttttataatcaacayacagctttaacagttatcaatact

SEQ ID NO: 85765 - DNA, 50 bp, homo sapien
ttgaggacccaagaccagctaaggayaaaatgtaactttcctcctatatg

SEQ ID NO: 85766 - DNA, 50 bp, homo sapien
atttcatatgcaagtcagtaattcaraggaaacgctaggggtggaagtca

SEQ ID NO: 85767 - DNA, 50 bp, homo sapien
atcatttgggaatctggggttctttsgttctgaaacagctagacgaatcg

SEQ ID NO: 85768 - DNA, 50 bp, homo sapien
atatggtggaaagactatatcacackattgtaaacaccctgggatcaaga

SEQ ID NO: 85769 - DNA, 50 bp, homo sapien
aaaacaacattcctgcctgttgtgawgtcttaatctacttatctccaagc

SEQ ID NO: 85770 - DNA, 50 bp, homo sapien
taaataaagcaagctacaaaattgaygaattccttcacaaaccatttcta

SEQ ID NO: 85771 - DNA, 50 bp, homo sapien
gtttattataaacataaagtgcacayctgaagtaagcaggctagaatgac

SEQ ID NO: 85772 - DNA, 50 bp, homo sapien
ttatctccaagcatcttatttcttayggtgacatgttttgcaaagaatgt

SEQ ID NO: 85773 - DNA, 50 bp, homo sapien
attctatcaggatgactaatctcaarcattttttataattatcacacata

SEQ ID NO: 85774 - DNA, 50 bp, homo sapien
acaatgtaaaccacgtatctcttatraggctgacaagaatataagtgaaa

SEQ ID NO: 85775 - DNA, 50 bp, homo sapien
tccaattatttactaaaacagaatcyactggagagaaatgcaaaggcagg

SEQ ID NO: 85776 - DNA, 50 bp, homo sapien
caacagagatgaacatgaacctttasctactagcaccatccattcactat

SEQ ID NO: 85777 - DNA, 50 bp, homo sapien
acaattatgcgtgtcagaacaccagraataatttagtattaaccaaaata

SEQ ID NO: 85778 - DNA, 50 bp, homo sapien
actcctaattgatgtgactataataygatgaatgaagttgtttcgcttgg

SEQ ID NO: 85779 - DNA, 50 bp, homo sapien
tgtccctggatgtcagagaaggagaygccaagagacaaaagatggagaca

SEQ ID NO: 85780 - DNA, 50 bp, homo sapien
cacaggctacatcaagagtcaaagamacgtaggccgggcatggtggctca

SEQ ID NO: 85781 - DNA, 50 bp, homo sapien
ttctataaaaaaactaatatcatagraaatcgcctgaagaaaagtgttgg

SEQ ID NO: 85782 - DNA, 50 bp, homo sapien
catggaaacagaaaaatggactaggraagaacaagtaatgaactatcgtg

SEQ ID NO: 85783 - DNA, 50 bp, homo sapien
tgttagaggctaatgtagctgctgaytttaaattgaagccaatgctcatt

SEQ ID NO: 85784 - DNA, 50 bp, homo sapien
caaaaggtatttcccattgcaagaargagatgatgcgttcctggtgagat

SEQ ID NO: 85785 - DNA, 50 bp, homo sapien
aaactttaaactatattttgacaaaytatttacctggcagaattgagttt

SEQ ID NO: 85786 - DNA, 50 bp, homo sapien
gctaaatcagcaaaggcaaaatttaygtgggtggagaaattaggaaagag

SEQ ID NO: 85787 - DNA, 50 bp, homo sapien
gactgacaggttttgaatgaggcatractataatacaaggcacttagttt

SEQ ID NO: 85788 - DNA, 50 bp, homo sapien
ttatttatctgctcaaatctttgaaktccacgtaccatgatcactcatgc

SEQ ID NO: 85789 - DNA, 50 bp, homo sapien
gagcacatattcatttattaattcaycacttaggcatgtattaaggccca

SEQ ID NO: 85790 - DNA, 50 bp, homo sapien
ctataaaaaatttctatcctgattayaacattgaatgatcaggaattatg

SEQ ID NO: 85791 - DNA, 50 bp, homo sapien
tttttttggcttttatacacagatayggatacacctagaagtaaaagtgg

SEQ ID NO: 85792 - DNA, 50 bp, homo sapien
catgagccaaggaacatgaatagtckctaaaaactggaaaggccaaggaa

SEQ ID NO: 85793 - DNA, 50 bp, homo sapien
ttgatgctttttctctccattattgycaacatttctgtctgtattagctt

SEQ ID NO: 85794 - DNA, 50 bp, homo sapien
ttatgacacacgtccagcaggatacrgcatgtggtatttatattctttcc

SEQ ID NO: 85795 - DNA, 50 bp, homo sapien
atgactttgtgctgaacaatacaacyatgaagtcaaataagagacgaccc

SEQ ID NO: 85796 - DNA, 50 bp, homo sapien
agtcctcagcatgtttgcatgcttaygggaaagaaacaggagatgtggac

SEQ ID NO: 85797 - DNA, 50 bp, homo sapien
tactatatatggtagtacttgtgaasgtgtaatttgtagagactatgatt

SEQ ID NO: 85798 - DNA, 50 bp, homo sapien
gtgtgtttgtgactgctgttcgccartcttcatggattattgaaataaag

SEQ ID NO: 85799 - DNA, 50 bp, homo sapien
ttctgagggagtctgtccttcccaaygtctctctgagcatcttcagaagt

SEQ ID NO: 85800 - DNA, 50 bp, homo sapien
ctcctctagaacggaaattccacccrccaaggagaagcagtttggaccca

SEQ ID NO: 85801 - DNA, 50 bp, homo sapien
gagcaccaccatctgagcccatttcsattagtatctttgataattttatg

SEQ ID NO: 85802 - DNA, 50 bp, homo sapien
ggattaagtgaaaacatatatgtacrgagcccagacacagtaaatagtaa

SEQ ID NO: 85803 - DNA, 50 bp, homo sapien
tttgatgaatctgtaaatgagtttcrgaagagttgttattttcacaatct

SEQ ID NO: 85804 - DNA, 50 bp, homo sapien
agcagaagtgatggtcttggacattraaataggactgcttccctcagcct

SEQ ID NO: 85805 - DNA, 50 bp, homo sapien
tgtttggaaaggaatgtgtaggggaragttgtctaaaatgctgtaacagc

SEQ ID NO: 85806 - DNA, 50 bp, homo sapien
ttggtgaagataaaatgaaataagaygtgaagagcttatattgcatatag

SEQ ID NO: 85807 - DNA, 50 bp, homo sapien
gaagaatcgcctcatgccctgtatarctttcaaatgtcccactgaactat

SEQ ID NO: 85808 - DNA, 50 bp, homo sapien
atatattattaaaaagaggcccgtasagctttgaaaaacatatttcatgc

SEQ ID NO: 85809 - DNA, 50 bp, homo sapien
ctagagagagagagaattaaagagamgacttcacaaagcaaagtgtgtac

SEQ ID NO: 85810 - DNA, 50 bp, homo sapien
tgatttgaaaactggtatctcctcarctgtatcaagttacttgcatgccc

SEQ ID NO: 85811 - DNA, 50 bp, homo sapien
tttgattattttaaattactccttcratcctcatatactaataggattga

SEQ ID NO: 85812 - DNA, 50 bp, homo sapien
tgttaaataatgtttgtccatatggyaattatactagccaagataagaaa

SEQ ID NO: 85813 - DNA, 50 bp, homo sapien
taacatgcaaattattctcaactgaygtagctaaacttgacaaatgtagg

SEQ ID NO: 85814 - DNA, 50 bp, homo sapien
ggataaacagtgattgggaaagcccrctagccaaaacagagtctaggctt

SEQ ID NO: 85815 - DNA, 50 bp, homo sapien
agaaaggtaataaagtggagtctatyagcaacctaactttaaaagtttag

SEQ ID NO: 85816 - DNA, 50 bp, homo sapien
tagcatttagttgaagaattacaggwatactgccaccatagaaaaatctt

SEQ ID NO: 85817 - DNA, 50 bp, homo sapien
cataactgctggtcatggaagattamgtttgtttatcccagttctcccat

SEQ ID NO: 85818 - DNA, 50 bp, homo sapien
aaaatatccaagcaagtgcagtatayagttctacaaataggagatatgtg

SEQ ID NO: 85819 - DNA, 50 bp, homo sapien
tctaaatcttttatagaagagtgtakgatgtagataggaaataaataaaa

SEQ ID NO: 85820 - DNA, 50 bp, homo sapien
atccagtttaaagcaggatatcaagsatggtccacggcctggcttttctc

SEQ ID NO: 85821 - DNA, 50 bp, homo sapien
tagaagtggtgatgaaccattcctawcccatagctggactccactgcatg

SEQ ID NO: 85822 - DNA, 50 bp, homo sapien
aaccccagccctggagttgtgataaygtaggtctctggtggttttgcttt

SEQ ID NO: 85823 - DNA, 50 bp, homo sapien
gagactgttaaactcacttccaggarcctcatctcacagaacgactgtga

SEQ ID NO: 85824 - DNA, 50 bp, homo sapien
gtcctgtcttatctctctgacttgawatctcctgatagatttctctacat

SEQ ID NO: 85825 - DNA, 50 bp, homo sapien
tgaacaagatttggttcaattcttaygacaattagttttttctcctcaaa

SEQ ID NO: 85826 - DNA, 50 bp, homo sapien
aaggaaggtatgaaattttaatagamgtccatttaaataaaatataaaat

SEQ ID NO: 85827 - DNA, 50 bp, homo sapien
agtgagtgaggggacatgctgaaacygagggtagaggaaggccagattct

SEQ ID NO: 85828 - DNA, 50 bp, homo sapien
caaacaagggatgttctacaaaacamctgcttctaatcttcaaaagtgtc

SEQ ID NO: 85829 - DNA, 50 bp, homo sapien
tagagggactgttcttagaaaatcarattaatgccttccttagcttctca

SEQ ID NO: 85830 - DNA, 50 bp, homo sapien
aatatacataacagtaatgaaataamctttttagctgaagcagggaagta

SEQ ID NO: 85831 - DNA, 50 bp, homo sapien
taacataatcaaaatcattcacaaamataatgtaatgagaaaaaaatatt

SEQ ID NO: 85832 - DNA, 50 bp, homo sapien
actttagaaaatttactaatctatasaactaattgagtaggatataggaa

SEQ ID NO: 85833 - DNA, 50 bp, homo sapien
gagaaagatatatcactttataatcragggctaaattgtatgatagtatc

SEQ ID NO: 85834 - DNA, 50 bp, homo sapien
gccctatgtttatatttgggaacaaytctttggcagggctgggagaattt

SEQ ID NO: 85835 - DNA, 50 bp, homo sapien
ttctacagctgtctactcaacctcakgcatggccacagagaccctcactg

SEQ ID NO: 85836 - DNA, 50 bp, homo sapien
ccaagaattacattaagctgaggcaytctaacttctatctatctttttgt

SEQ ID NO: 85837 - DNA, 50 bp, homo sapien
gagtttacattttcctgtgcctaatraatacaattgtaaaaactactaga

SEQ ID NO: 85838 - DNA, 50 bp, homo sapien
atttgagctaaaatgcttggataaarcctcattttcaaatagaaaattaa

SEQ ID NO: 85839 - DNA, 50 bp, homo sapien
ggacacttcagtgcatctctaatttkggaaatgatcaatggtcaacagag

SEQ ID NO: 85840 - DNA, 50 bp, homo sapien
gatgtgcaccaccatggccaggaaakattttaatatcttaagaggagtca

SEQ ID NO: 85841 - DNA, 50 bp, homo sapien
tacgtgaaaaccaccctcagagtaaraacttcatctagggttgagatgta

SEQ ID NO: 85842 - DNA, 50 bp, homo sapien
acactctatatgctgacggctcccamatttatatttccagcccagccctc

SEQ ID NO: 85843 - DNA, 50 bp, homo sapien
ataaatattgaagtgctatcgcttayaggagaaaatgcaaatgcctcagt

SEQ ID NO: 85844 - DNA, 50 bp, homo sapien
cttgtgttaattagcaatgtgctcayacaaataatgaaaagtcatacagt

SEQ ID NO: 85845 - DNA, 50 bp, homo sapien
gctgcatcatatccatctgatctccrcagggtaaggacagagttacctgt

SEQ ID NO: 85846 - DNA, 50 bp, homo sapien
aaaatcatctggtcagttgttttgayaatattcacatatcataattgtgt

SEQ ID NO: 85847 - DNA, 50 bp, homo sapien
ttgagaactagaaactcaggtcagamattctaaatattcactttgctacc

SEQ ID NO: 85848 - DNA, 50 bp, homo sapien
cattccctcagacttttttcatggayactcctttcctcagctcctttggc

SEQ ID NO: 85849 - DNA, 50 bp, homo sapien
aaactttgagtgaactataggtgtgytagaatgtactcattttaatgcag

SEQ ID NO: 85850 - DNA, 50 bp, homo sapien
aagtattccaatcagatggtgaaggycctgctttttgagggatagtccac

SEQ ID NO: 85851 - DNA, 50 bp, homo sapien
cccaaagaatgagaccagggctagarcatcaccagaaactgtaccctgct

SEQ ID NO: 85852 - DNA, 50 bp, homo sapien
ttgttacatgaatgaatgtttgcccractttaagaattcaggccatggca

SEQ ID NO: 85853 - DNA, 50 bp, homo sapien
tcagagtagttagggttaaggttttrtcatattgtacatgtggcattgta

SEQ ID NO: 85854 - DNA, 50 bp, homo sapien
gcacttttctgcatagagttatttcraaaacaaactttactgaagcaaat

SEQ ID NO: 85855 - DNA, 50 bp, homo sapien
accacacttgccttgttaccaatctkatgaggaaagcatttagtctttca

SEQ ID NO: 85856 - DNA, 50 bp, homo sapien
tttgtttataactgactcaatcccaraagtactaattttatatgatgaaa

SEQ ID NO: 85857 - DNA, 50 bp, homo sapien
aaagccctggaaagaaaattctttcrtgggctaagctccactttggggct

SEQ ID NO: 85858 - DNA, 50 bp, homo sapien
ggtctcaagagttttacaatatctargtgaaataatcctgtttgggggat

SEQ ID NO: 85859 - DNA, 50 bp, homo sapien
cattaaaaattgaaaataaatattaygcacttgagttattttcccttcaa

SEQ ID NO: 85860 - DNA, 50 bp, homo sapien
gcttggcaataaggcaagtcttaatraattcgaaaattgaaaccatatca

SEQ ID NO: 85861 - DNA, 50 bp, homo sapien
attagttatttttcagatgaaataamccaaatcatatcaacatgactgaa

SEQ ID NO: 85862 - DNA, 50 bp, homo sapien
cctatcactaatcattggattagtaygagaggtaaccaataaaataaaat

SEQ ID NO: 85863 - DNA, 50 bp, homo sapien
ttggttttagtttctgtgattaagargtattagtgaaatccatttatatt

SEQ ID NO: 85864 - DNA, 50 bp, homo sapien
gtttgatctctaagtcccatgtctamaacttaagatcatggctgacataa

SEQ ID NO: 85865 - DNA, 50 bp, homo sapien
atagtttattcaaacatacagagaaytatttcaacaagtatacctgcttg

SEQ ID NO: 85866 - DNA, 50 bp, homo sapien
gctactatttactcttcattataacrgcttaagaaatataacatttactg

SEQ ID NO: 85867 - DNA, 50 bp, homo sapien
ctacagtgtggcaggcactgtactasgaaatagagataagcctgacagag

SEQ ID NO: 85868 - DNA, 50 bp, homo sapien
gttaacatatgtcttacaaaggttargcctataagcatagcacagagggt

SEQ ID NO: 85869 - DNA, 50 bp, homo sapien
atccagacgcagtcaataatttatasaactaaagcctgtagttgagatat

SEQ ID NO: 85870 - DNA, 50 bp, homo sapien
atactctgttcaaacaatccagtaaycacatctttgacaaaaatgaaaaa

SEQ ID NO: 85871 - DNA, 50 bp, homo sapien
agagtagtgggaagctactgagtcaragctattatttaatcaataagtaa

SEQ ID NO: 85872 - DNA, 50 bp, homo sapien
ttttttttttcctaaggtggttgtcygagtgcccaaaggacagtgagatg

SEQ ID NO: 85873 - DNA, 50 bp, homo sapien
acattaaaagctaaagaaaaatatcragactagaaaactgatatcatcaa

SEQ ID NO: 85874 - DNA, 50 bp, homo sapien
gatgggggagtgcttttatggcaaamgtcgatatttaagaagtttgttct

SEQ ID NO: 85875 - DNA, 50 bp, homo sapien
taacattggtcaaagtgttcttcaayattcatactacttttaccacccat

SEQ ID NO: 85876 - DNA, 50 bp, homo sapien
atgtgctcaagtctgttttgaataakgaagttggactctgggaagtcttg

SEQ ID NO: 85877 - DNA, 50 bp, homo sapien
aaggcatttctgatacaagccatgamaccattctctctgcaccttccccc

SEQ ID NO: 85878 - DNA, 50 bp, homo sapien
tttctaattttttatgatccatttayattccttttgaaataaaagtttat

SEQ ID NO: 85879 - DNA, 50 bp, homo sapien
ggaaaaacagaaatacacagtgggtsaacttaaataaagagattgttgtg

SEQ ID NO: 85880 - DNA, 50 bp, homo sapien
ttatgcttttcttcaccttgccaacygtaagtcatatcaaatgcaaatcc

SEQ ID NO: 85881 - DNA, 50 bp, homo sapien
tgttaataattcagatcattcaacaygcaattggtatcacagaaacaaag

SEQ ID NO: 85882 - DNA, 50 bp, homo sapien
ggcctttcctgtaaatctcatttccrgacttgcttcaaattagggtaaag

SEQ ID NO: 85883 - DNA, 50 bp, homo sapien
gttgtgtgtttaagtgtgatagatgraacattaacaaatacaacaaatat

SEQ ID NO: 85884 - DNA, 50 bp, homo sapien
gcaatgcaaagtcatgaaaatgctgyaattctatcctggactgtcatctt

SEQ ID NO: 85885 - DNA, 50 bp, homo sapien
atctaagtagaagtctagtaaataaygaaatgtctccactgtatccatta

SEQ ID NO: 85886 - DNA, 50 bp, homo sapien
cccttactaattccaaaggtgcaaayatctttacaggcccaaatgaaatc

SEQ ID NO: 85887 - DNA, 50 bp, homo sapien
tgattaagcttttgcatggtgtagaraaatggggcacaggtacctggctt

SEQ ID NO: 85888 - DNA, 50 bp, homo sapien
atcatagttctttctccgtacccatsaaattctgataattgccatttcct

SEQ ID NO: 85889 - DNA, 50 bp, homo sapien
gcacagtaaatggagttatggagatwaatgataagataaatgagtactct

SEQ ID NO: 85890 - DNA, 50 bp, homo sapien
ataaaggaaaccaaataggagtaaartaattagccgaagatcacaaaagt

SEQ ID NO: 85891 - DNA, 50 bp, homo sapien
tacagcaaataaaatattttaaaagkaactcttggataagtcttttaacc

SEQ ID NO: 85892 - DNA, 50 bp, homo sapien
cttctaggaaaacactttctagggawtaaagttatctgcaattggaatga

SEQ ID NO: 85893 - DNA, 50 bp, homo sapien
gaacattatttgtcttcacccaatakgaaagctgactttttaaaagttga

SEQ ID NO: 85894 - DNA, 50 bp, homo sapien
ctattaggttttcccatgtatgtaaytgactacctttattttgcttgaac

SEQ ID NO: 85895 - DNA, 50 bp, homo sapien
tttagatatgactttacccataggaycatttctttccaaggaaacgttaa

SEQ ID NO: 85896 - DNA, 50 bp, homo sapien
cataaaaaagacaatctggaacaaartgatttgaggaacgtgtaccatct

SEQ ID NO: 85897 - DNA, 50 bp, homo sapien
gaagttgtcttcagatgctgaagtcrgagtctacataaatagctgggata

SEQ ID NO: 85898 - DNA, 50 bp, homo sapien
aaatgtttaaataagcttcttgaaawctcatggaacattcaatcacaact

SEQ ID NO: 85899 - DNA, 50 bp, homo sapien
aactagagcagaaaagggtccaaaarcagatgaatctaccaatttatttg

SEQ ID NO: 85900 - DNA, 50 bp, homo sapien
tttgttaatatgtggtattccaatayagtcagaaactcagttatgaccat

SEQ ID NO: 85901 - DNA, 50 bp, homo sapien
tctacctagatgcatataactttcawtcaatggcccagaagcaagggatt

SEQ ID NO: 85902 - DNA, 50 bp, homo sapien
tgcagctaacatgttttgagttggcragagttacataaaagtgaccatta

SEQ ID NO: 85903 - DNA, 50 bp, homo sapien
caaagccaatcagattcatcagcaaktcttgatatttccacatcctaaat

SEQ ID NO: 85904 - DNA, 50 bp, homo sapien
acaatgcaatggtatcaagcatcaaygtgaagggtcaagaggaacctaag

SEQ ID NO: 85905 - DNA, 50 bp, homo sapien
ctctctctctctcattcttttaccawtttccccttatcaatagtaaatct

SEQ ID NO: 85906 - DNA, 50 bp, homo sapien
ggaaggaagggagacttgggcatcarggatactatcttttgctcgtgaat

SEQ ID NO: 85907 - DNA, 50 bp, homo sapien
tcaaatcctcccaacctctcctacarctgttaaattatagggaatctccc

SEQ ID NO: 85908 - DNA, 50 bp, homo sapien
ggtgtattttggactctagcacagarcaatgttaatcatttgtttgtgta

SEQ ID NO: 85909 - DNA, 50 bp, homo sapien
ttggattcctaaaatttttatctacsacaaaggtggcaaactaagattta

SEQ ID NO: 85910 - DNA, 50 bp, homo sapien
tgtaagtgcggccagcagccatcgamcatatgctgtgatgccacaacaag

SEQ ID NO: 85911 - DNA, 50 bp, homo sapien
attaaaaacatctatgtccaattatsagagaagagcatctgatcaatttg

SEQ ID NO: 85912 - DNA, 50 bp, homo sapien
tttcaaatttttgactgacatcattraaaaattagctattcgttttgata

SEQ ID NO: 85913 - DNA, 50 bp, homo sapien
aaaatagcaacaaacaccacagtaaytgcaaccactgactgagtactttc

SEQ ID NO: 85914 - DNA, 50 bp, homo sapien
cgtctgaagatgttagatatttttaygttcatttgctaaacattttaaat

SEQ ID NO: 85915 - DNA, 50 bp, homo sapien
ggaaccctttactacaatggtataarcgatgaggattatttaaaaaataa

SEQ ID NO: 85916 - DNA, 50 bp, homo sapien
ctatctagaaccacctatgtaaaaayctggcaacagaatggaaagcactg

SEQ ID NO: 85917 - DNA, 50 bp, homo sapien
ttctgagagaagagctccatcaccargaatataatgtagaggtacagtgg

SEQ ID NO: 85918 - DNA, 50 bp, homo sapien
aatcaggaaacaaaaagtctgcttgraaacccatcaaaggctgacacagt

SEQ ID NO: 85919 - DNA, 50 bp, homo sapien
tgctgttagttcaggtaaacagacartaatgaagtaggcagggcaaagaa

SEQ ID NO: 85920 - DNA, 50 bp, homo sapien
aacttattgagtttcctgtaacatcrccttgagcaactaactgaagtcat

SEQ ID NO: 85921 - DNA, 50 bp, homo sapien
ttagagtaatattttttttagattcmaacagctagacctttttctgaacc

SEQ ID NO: 85922 - DNA, 50 bp, homo sapien
taaatcccagcctctccatgtcctcratcttttaacgtagcttaaaattc

SEQ ID NO: 85923 - DNA, 50 bp, homo sapien
agatggattagttggtcctgaacaaraaagacatatattaacatatctaa

SEQ ID NO: 85924 - DNA, 50 bp, homo sapien
atcatatctgagcagagagtgactgracagtggcaccccaatattttgtc

SEQ ID NO: 85925 - DNA, 50 bp, homo sapien
agagagagagatagaagtatgatgaracagtattgctgatacaaagactg

SEQ ID NO: 85926 - DNA, 50 bp, homo sapien
tctgtatcagttagcttttattgcamaacatacctctcttaatgattctg

SEQ ID NO: 85927 - DNA, 50 bp, homo sapien
aactcagtgtatttgtctgttaaacragggtgagcttattaataaatcca

SEQ ID NO: 85928 - DNA, 50 bp, homo sapien
tgtggggtctgctacattgcagtggrtgagaaataaatggaagtgaagaa

SEQ ID NO: 85929 - DNA, 50 bp, homo sapien
aagagctgagaagccaaacaatggawggtgagataatccaaagaattgtg

SEQ ID NO: 85930 - DNA, 50 bp, homo sapien
catcttttatctaatttcctatatcyaagcatttgctaataactgcctgt

SEQ ID NO: 85931 - DNA, 50 bp, homo sapien
gtgaagtgattctggacagcagtgargaagatttcattcgttccctctcc

SEQ ID NO: 85932 - DNA, 50 bp, homo sapien
gttaatatctctttgatggtaaggcycagaaatctgacttggtttaattt

SEQ ID NO: 85933 - DNA, 50 bp, homo sapien
ctctgaaatctgaataaatcctaagyctcatgtagtccagtctattcaga

SEQ ID NO: 85934 - DNA, 50 bp, homo sapien
tatttttcctgatcctcttttctacraagtgtttaaatagagtaaaaaat

SEQ ID NO: 85935 - DNA, 50 bp, homo sapien
tcttttctacataaaatattcccaargaggtcttcaattggcctcatgta

SEQ ID NO: 85936 - DNA, 50 bp, homo sapien
gaaataaatacaggaaaaatgtgaamatggtacttacaaatttttatcta

SEQ ID NO: 85937 - DNA, 50 bp, homo sapien
tgtatggctgaaatgtgtttcaccaygtaaatataaaagtagtgctacag

SEQ ID NO: 85938 - DNA, 50 bp, homo sapien
aaccattcagtaatatatgtgttcgrctttatatctgcctttaccaatta

SEQ ID NO: 85939 - DNA, 50 bp, homo sapien
ataattatcctgggcactcagtcaarttctttacacaatatctagactat

SEQ ID NO: 85940 - DNA, 50 bp, homo sapien
tgagtagataaaggtaatggcaatartaaagagataattaaagtagcaaa

SEQ ID NO: 85941 - DNA, 50 bp, homo sapien
accttatgtaaaattgagatgtgccraaatcaacctgggagatgccatag

SEQ ID NO: 85942 - DNA, 50 bp, homo sapien
taattttattgaatgcttacaacaarcctgtaaagtgaatattgtttcca

SEQ ID NO: 85943 - DNA, 50 bp, homo sapien
cagcttccacctgaaactgtgtcacygtaaaatatgccacccactagacc

SEQ ID NO: 85944 - DNA, 50 bp, homo sapien
ggtgggacgtggtttgactgtaatayacctgacttccgtgataataaggt

SEQ ID NO: 85945 - DNA, 50 bp, homo sapien
aattctggaacaactgatatctatayggaaaaaaataatcagtaatacct

SEQ ID NO: 85946 - DNA, 50 bp, homo sapien
gtagaattgtcgtgtaaaccaaaacsgaatattaactcagctaccagagc

SEQ ID NO: 85947 - DNA, 50 bp, homo sapien
agatccaaaaagattcatattatacraagttctctctctaaattaatgca

SEQ ID NO: 85948 - DNA, 50 bp, homo sapien
gctcgagggtttaagttcctagttgragttctgtggttgcattcttttgc

SEQ ID NO: 85949 - DNA, 50 bp, homo sapien
atttatcacaattccaatgaaaataycaccaaactttcctatggagccaa

SEQ ID NO: 85950 - DNA, 50 bp, homo sapien
ctctcccctgaattataacaagtacragtgcttacctccttgctgtttct

SEQ ID NO: 85951 - DNA, 50 bp, homo sapien
atgatgtgtcacaatgcagatataaygtaatataaaacttctaaatacaa

SEQ ID NO: 85952 - DNA, 50 bp, homo sapien
agatacacttaaaacaattctggtamgtgggcacagattcactctagaat

SEQ ID NO: 85953 - DNA, 50 bp, homo sapien
ttatttttttctttctaggagcataygtaagtaactgtttgaagagagag

SEQ ID NO: 85954 - DNA, 50 bp, homo sapien
gctgcatatcgtatgaaatgtccagracgcgaatgcatggagacagaatg

SEQ ID NO: 85955 - DNA, 50 bp, homo sapien
ccacaagaaaatgagacaattctaaygtgtaactttgcaatcacttttct

SEQ ID NO: 85956 - DNA, 50 bp, homo sapien
tgtcaaaatgcctcccgatgactaayttcaacagctaaatggaaaatggt

SEQ ID NO: 85957 - DNA, 50 bp, homo sapien
agccaaggaaatccaatccacaagasagaaggtaagtcatatgattctag

SEQ ID NO: 85958 - DNA, 50 bp, homo sapien
aattacccagtctggggtatgagaaygaactaatataggaatcaatttaa

SEQ ID NO: 85959 - DNA, 50 bp, homo sapien
cttaaaattaagtataatcagaaaaygtcttatttctaaagaagtttaga

SEQ ID NO: 85960 - DNA, 50 bp, homo sapien
tctgtaaactggttgtttcatttaartaaaagatcagaaggacaattagt

SEQ ID NO: 85961 - DNA, 50 bp, homo sapien
aaaacaataaaattcaatgataacaygcttagaatctagttagatgtacg

SEQ ID NO: 85962 - DNA, 50 bp, homo sapien
atgtttcagggccaaaaagaggtacygagatttcctcaccaaatgccacc

SEQ ID NO: 85963 - DNA, 50 bp, homo sapien
atatatttaaacacatgcaggtacamggttttcagttaagtttgtgttgg

SEQ ID NO: 85964 - DNA, 50 bp, homo sapien
atccagaaataaacctacatgtctayggtaaattggttttcaacaaaagt

SEQ ID NO: 85965 - DNA, 50 bp, homo sapien
aagctctagtttagtttctacaggcraaggatttttcacccctcggaacc

SEQ ID NO: 85966 - DNA, 50 bp, homo sapien
acacaatttatagtaacagtactaaygccaccaatttctaaactacattc

SEQ ID NO: 85967 - DNA, 50 bp, homo sapien
catagggaaatagtggtaggttatasgatgtaatagaaattctaatagac

SEQ ID NO: 85968 - DNA, 50 bp, homo sapien
gagtccagacagggacacgtgtgacygctgaaattaacatctcacctggc

SEQ ID NO: 85969 - DNA, 50 bp, homo sapien
agtattagccaaggacaaagcactayactggctctcgtgtagcttagata

SEQ ID NO: 85970 - DNA, 50 bp, homo sapien
gagttgctgtttctaagaaagtaaaygagtgacaagtagactacaggact

SEQ ID NO: 85971 - DNA, 50 bp, homo sapien
gtaagaataaatatttgagtacaaamccagaatatatttaggaaaaaata

SEQ ID NO: 85972 - DNA, 50 bp, homo sapien
atacgttcaaggccaaccaaattgaytatggaaagaattaagaattttaa

SEQ ID NO: 85973 - DNA, 50 bp, homo sapien
tacaaaagccctaaaatagatagtgkcaatgggaatgaaaacaagagagt

SEQ ID NO: 85974 - DNA, 50 bp, homo sapien
ttagacaaattctcttacagcatagmactctctgactcaatggatatgac

SEQ ID NO: 85975 - DNA, 50 bp, homo sapien
caaggtcatgccagaaaattaattcmaatcaaatcatgagccagatcaac

SEQ ID NO: 85976 - DNA, 50 bp, homo sapien
tgggaattaaaacatggggatattayctatagcaggccttcaccatttgt

SEQ ID NO: 85977 - DNA, 50 bp, homo sapien
tgcttcggtgatgcagagaaagggascttaaaaagatcatctgttgattg

SEQ ID NO: 85978 - DNA, 50 bp, homo sapien
aaaattgaaataaaaattctgaagayggtctgacaaaatatgttactgat

SEQ ID NO: 85979 - DNA, 50 bp, homo sapien
tgagtacatgtgaatggccaatttaraagtttaagtcattcttttgtaat

SEQ ID NO: 85980 - DNA, 50 bp, homo sapien
gtttcttatacaactcagagctttaygttatttagactgtctgaacactg

SEQ ID NO: 85981 - DNA, 50 bp, homo sapien
caacaaaaatcttagcatactcttasgagcattttaatacactaatattg

SEQ ID NO: 85982 - DNA, 50 bp, homo sapien
acatttagtgaatgtttactgacaartagttatggccagttaaataatca

SEQ ID NO: 85983 - DNA, 50 bp, homo sapien
aatcctaatcccaattcctgtgtcayacagtttttacaatactaaacaga

SEQ ID NO: 85984 - DNA, 50 bp, homo sapien
aaaaatgatcatgtttcatatcacamctttacaggatttttttttgttca

SEQ ID NO: 85985 - DNA, 50 bp, homo sapien
cttacttcttgttcttcttggccaaygaaatagaaattccaacctgtctg

SEQ ID NO: 85986 - DNA, 50 bp, homo sapien
aggaacagcagggaatggtaagtgartaggaagttcaggctaagtatcag

SEQ ID NO: 85987 - DNA, 50 bp, homo sapien
ttcttctggaaacttctccaacatastagtacctattaaaactcactgat

SEQ ID NO: 85988 - DNA, 50 bp, homo sapien
tacatactacatgattcaatttataygacattttagaaaagccaaaacta

SEQ ID NO: 85989 - DNA, 50 bp, homo sapien
tcatcccccaaatttaggttttcaamaatcaagcagaaaaggaggctcct

SEQ ID NO: 85990 - DNA, 50 bp, homo sapien
tacagataaatcttgatttgacatasccgtaagttacagcttctaggctt

SEQ ID NO: 85991 - DNA, 50 bp, homo sapien
tttgaactaaaattataaaggaagastagaaatcacttacctaaatcact

SEQ ID NO: 85992 - DNA, 50 bp, homo sapien
atttcatctgtaatccactgtttttrtactggagttctgttgatgtgatg

SEQ ID NO: 85993 - DNA, 50 bp, homo sapien
ctacagggaaaatcactttgtcagakccttatcccagctggaggaaagaa

SEQ ID NO: 85994 - DNA, 50 bp, homo sapien
attgagaaatatatccagagccttcyctataacaaaggtcaactctacag

SEQ ID NO: 85995 - DNA, 50 bp, homo sapien
atttcaaatggcccttggataagtamaggacgaaacgagagagttaaagc

SEQ ID NO: 85996 - DNA, 50 bp, homo sapien
catgtggaagacatgtagctggttaycagagagccaggaaaagaagtctg

SEQ ID NO: 85997 - DNA, 50 bp, homo sapien
atacttttctttattgtatagatgarattgaagctcagagaagctaaata

SEQ ID NO: 85998 - DNA, 50 bp, homo sapien
aattaatccatattgtgtctggacaktctacctgaggtcacttttttacc

SEQ ID NO: 85999 - DNA, 50 bp, homo sapien
aacaatgtactggggcatagcacaaycaaccacaaacaagtcattccaga

SEQ ID NO: 86000 - DNA, 50 bp, homo sapien
gattcatcctacatagctctctttaygtcctctgggttgcaagcgagaaa

SEQ ID NO: 86001 - DNA, 50 bp, homo sapien
atgaatcaaatacatgcaggaaggtraagtttgtctaagggacccaaatc

SEQ ID NO: 86002 - DNA, 50 bp, homo sapien
gaataacaaagagctatattaacacsgagtagaaaagattaccatgggtt

SEQ ID NO: 86003 - DNA, 50 bp, homo sapien
aatctagactagaatataaatcaacwacagtactaagcacagagttaatt

SEQ ID NO: 86004 - DNA, 50 bp, homo sapien
aagaatgttacatgtgttaaaaagaygagaaattaattcatataccattt

SEQ ID NO: 86005 - DNA, 50 bp, homo sapien
ccctcttcctcccatttgtataagckgcctaggttgccgtatctgttctt

SEQ ID NO: 86006 - DNA, 50 bp, homo sapien
tagaatttttaaacatagaacattayaatcttaggcctggaaaatgctaa

SEQ ID NO: 86007 - DNA, 50 bp, homo sapien
cttccacctctactctgttaacaaaytccttcctacttctctagaatcca

SEQ ID NO: 86008 - DNA, 50 bp, homo sapien
aaagctacagtttggtgaaaatagcmaacccaagtcccaggaggacagag

SEQ ID NO: 86009 - DNA, 50 bp, homo sapien
agcattacttcgatgcatttcatatyacaaaatcacttcctgtgttcatt

SEQ ID NO: 86010 - DNA, 50 bp, homo sapien
ctattgatggatgtccaaaattggargtatagtgagtaactttcagggga

SEQ ID NO: 86011 - DNA, 50 bp, homo sapien
ccattggactggattatgtctgttcygaaaatagtgatgttcatttccgt

SEQ ID NO: 86012 - DNA, 50 bp, homo sapien
ttcaataaaccactcaagcttctgawcaaatatattatgggaacactata

SEQ ID NO: 86013 - DNA, 50 bp, homo sapien
atttctagatagtgaatacatcatcrgaagagagctaatatatttccgtg

SEQ ID NO: 86014 - DNA, 50 bp, homo sapien
aacaaaaccagaatatccacactgartaggtaagaaaagcaatttcattt

SEQ ID NO: 86015 - DNA, 50 bp, homo sapien
ctctaaagtccagatcattcatgtaygccaaaattaaaatatcttctttc

SEQ ID NO: 86016 - DNA, 50 bp, homo sapien
gtaagtatgtaacaggcatacttgarcctaacacaggagagtttggtttg

SEQ ID NO: 86017 - DNA, 50 bp, homo sapien
aatcgctagaatagtaacgcctgaaktatacacaaggaatatatgtccaa

SEQ ID NO: 86018 - DNA, 50 bp, homo sapien
cagcaaccaagattatcggagcaagratatttggatcagagtccacaaat

SEQ ID NO: 86019 - DNA, 50 bp, homo sapien
aaaaattcacctaccatcatgataamggtaaggaattcacaagtccagca

SEQ ID NO: 86020 - DNA, 50 bp, homo sapien
agtttgacttcttttcctaattggaygctaatatcgtttggctgcatccc

SEQ ID NO: 86021 - DNA, 50 bp, homo sapien
ttccttttccataaaagatggcccayacttccaactaagtaactgtctgt

SEQ ID NO: 86022 - DNA, 50 bp, homo sapien
actggtgaatctttaaaaatgattakcagagtctattgaaatgttggtgc

SEQ ID NO: 86023 - DNA, 50 bp, homo sapien
aggtggaagcggtcctgaacagagakacagtcgtctgtgagctctgacat

SEQ ID NO: 86024 - DNA, 50 bp, homo sapien
tacccacgtcagcgtagcttagcacygggagagaacagcccagcttgtga

SEQ ID NO: 86025 - DNA, 50 bp, homo sapien
ttcataaggtagaactttttgcacaytatttttagtagaatttaaaagtt

SEQ ID NO: 86026 - DNA, 50 bp, homo sapien
cattcacagtcacatctgacataatsaaggaatatttctactcatcttcc

SEQ ID NO: 86027 - DNA, 50 bp, homo sapien
tatacatgtaagcagcaggtagttayggtcatcagtggtggcaattcgtt

SEQ ID NO: 86028 - DNA, 50 bp, homo sapien
tgcaattgcacttgactatattaaartgttctggtggcattggttgaagc

SEQ ID NO: 86029 - DNA, 50 bp, homo sapien
tacttttcaatgttggaatctctccrgaaggaagttgtcaccttacaagc

SEQ ID NO: 86030 - DNA, 50 bp, homo sapien
gagaacataactgctttgactccaayaagggtagagaaagtgggaagggg

SEQ ID NO: 86031 - DNA, 50 bp, homo sapien
aattggagaagctgaagccaaccacracttcataaagataagacatttac

SEQ ID NO: 86032 - DNA, 50 bp, homo sapien
tgcaggctgaggtcacctaattatayatttcaaatccaggctcctatctt

SEQ ID NO: 86033 - DNA, 50 bp, homo sapien
ctgaaagaaacaaggatctcagaaarctaaaataagatgagagtaaaaaa

SEQ ID NO: 86034 - DNA, 50 bp, homo sapien
aagtctagctgggccaatatttcaayaacttgttcctttattttgctgat

SEQ ID NO: 86035 - DNA, 50 bp, homo sapien
tcctttctgctaggaagacttcctcygacttcatttaccatgtgtatcct

SEQ ID NO: 86036 - DNA, 50 bp, homo sapien
agttaaaagaagtattatggtccaaygctctcggtagcaaattgggaata

SEQ ID NO: 86037 - DNA, 50 bp, homo sapien
caacattttcaaggaaggtattatgmtctttacactaaaggaggtaataa

SEQ ID NO: 86038 - DNA, 50 bp, homo sapien
tctggaaaaggatgagcagtctaggrttctgatgaatggggtacacatta

SEQ ID NO: 86039 - DNA, 50 bp, homo sapien
attataagaagattgatgttattgaraagaaggaaagagtcagttaaatg

SEQ ID NO: 86040 - DNA, 50 bp, homo sapien
ggatacatctaaaccttgaattttaygatgttaaggtattaacatctttg

SEQ ID NO: 86041 - DNA, 50 bp, homo sapien
aagggtaaaacattttcagtacacaytaagaactacatatttttaagttt

SEQ ID NO: 86042 - DNA, 50 bp, homo sapien
taattttcctttgtcatgtaacaaawtatttacacaagtactgggggttg

SEQ ID NO: 86043 - DNA, 50 bp, homo sapien
atagaattatcatttttatgagaatyatattttattagatgtaacatggt

SEQ ID NO: 86044 - DNA, 50 bp, homo sapien
tcttgttgagttgaatactttatcaytacacaatgcccttctttgtcctt

SEQ ID NO: 86045 - DNA, 50 bp, homo sapien
tcctcactctacatttgtgtttcccraagtttaaagcatatgtggctgtc

SEQ ID NO: 86046 - DNA, 50 bp, homo sapien
atatgtaagcctgggtctggttgaaytagtgaagacagatggcatgattg

SEQ ID NO: 86047 - DNA, 50 bp, homo sapien
tttagccaaatcattttgattcaacrggatatatcatagctgcttctatt

SEQ ID NO: 86048 - DNA, 50 bp, homo sapien
tatattttttagaatactgaacatayggattatcagtgtttttccagaaa

SEQ ID NO: 86049 - DNA, 50 bp, homo sapien
catattgttcttttccaaatcagtcraactctccctctatcaggtagcaa

SEQ ID NO: 86050 - DNA, 50 bp, homo sapien
cccaaaaaaacctttttctgggagastgttccctattgagtaatgcagta

SEQ ID NO: 86051 - DNA, 50 bp, homo sapien
taattatattgcagatagtcagagayagctttcttactgcatgagaaaga

SEQ ID NO: 86052 - DNA, 50 bp, homo sapien
ttgagatcgaatcttctagtgtagawcctgtgaatattgttgaaatgaca

SEQ ID NO: 86053 - DNA, 50 bp, homo sapien
aaaaattacaagaccatagaatgccrcagaaccattccacttaccaggaa

SEQ ID NO: 86054 - DNA, 50 bp, homo sapien
ttgctgagttttccaaacgtgcctasataaacccattaaaaaagaggagg

SEQ ID NO: 86055 - DNA, 50 bp, homo sapien
aacttctttttatgtgagtgccaccrattgtatggcattaatgggattag

SEQ ID NO: 86056 - DNA, 50 bp, homo sapien
ataatatttccaacgtgactctaccrtgaccctagaataaatgtagttct

SEQ ID NO: 86057 - DNA, 50 bp, homo sapien
agtcaaggggttataatgccttcttyggttgacaagttctaacccgcttc

SEQ ID NO: 86058 - DNA, 50 bp, homo sapien
ctctaggtgattacagtatgatgccyaaattgagaaccattgttgtaaat

SEQ ID NO: 86059 - DNA, 50 bp, homo sapien
atgttagctgcagctctggctgtgcrcaaattctttttgcaacaaggtga

SEQ ID NO: 86060 - DNA, 50 bp, homo sapien
ctctaatgactggttgtaagagagaygtcaggaaattagatctcagacag

SEQ ID NO: 86061 - DNA, 50 bp, homo sapien
atgctccacttaaccactaaaatgartaatctgcttgtgttataaatagg

SEQ ID NO: 86062 - DNA, 50 bp, homo sapien
caagtattggcatctgtgaatataaktgaaccctgaaatatcagggatgt

SEQ ID NO: 86063 - DNA, 50 bp, homo sapien
aacaaaatggggtgacctatttgtcmagtattggcatctgtgaatataat

SEQ ID NO: 86064 - DNA, 50 bp, homo sapien
ggcaggagactacaataaataaggakaaaaattcatgaagtaattttgtt

SEQ ID NO: 86065 - DNA, 50 bp, homo sapien
gcctctaaaattacgctccacaagasaaactcatccactcctccgtcttc

SEQ ID NO: 86066 - DNA, 50 bp, homo sapien
agtatatgcaaacccaacatcaggamcattcttgggaagaactaaatgtg

SEQ ID NO: 86067 - DNA, 50 bp, homo sapien
ggaaggtgtcagagaaggttctctgyagaacaaggcagatctagggaagc

SEQ ID NO: 86068 - DNA, 50 bp, homo sapien
tgacattaaaatctgagagcagtagwataaagaactgaccttctagaaat

SEQ ID NO: 86069 - DNA, 50 bp, homo sapien
aatctcatgaaaatcctccctgatamaatagaaggcatggatttacgttc

SEQ ID NO: 86070 - DNA, 50 bp, homo sapien
tggagtggtgaaccaaaacctcatgwtggcctgcagaggcaagtcagcct

SEQ ID NO: 86071 - DNA, 50 bp, homo sapien
tgccagattaaacaccataaaaaatytaccagttagtggatattttactt

SEQ ID NO: 86072 - DNA, 50 bp, homo sapien
agaaacaccttcaaggatagaatgcrctgaagtcaaaattagcagctctt

SEQ ID NO: 86073 - DNA, 50 bp, homo sapien
gataaagcttagtagttttggttaaytgaagcgtttgattttcttcacaa

SEQ ID NO: 86074 - DNA, 50 bp, homo sapien
tgacctcattaagatgatatttaaaraaagacttgaagaagagagttagt

SEQ ID NO: 86075 - DNA, 50 bp, homo sapien
aaacaggaatggccttcatcacttaygtctgtgtcaacttgttttttggc

SEQ ID NO: 86076 - DNA, 50 bp, homo sapien
tgccttcctcttattcatatttcagyctacagaaagttaaaagaagtcaa

SEQ ID NO: 86077 - DNA, 50 bp, homo sapien
gtaagtgtgtgtgacacataggtgartaatgtacagtgttgcaattaagg

SEQ ID NO: 86078 - DNA, 50 bp, homo sapien
atttttacctgtatcttgagcctcawcaatttgattctttcttttattag

SEQ ID NO: 86079 - DNA, 50 bp, homo sapien
caaaagtcagtttttctcagaacttraaaagaattgcaccatagactgtt

SEQ ID NO: 86080 - DNA, 50 bp, homo sapien
tctgttccttctgccagttgcaatayactcctctgtcaaccattactata

SEQ ID NO: 86081 - DNA, 50 bp, homo sapien
ctcagaagaacttgaggtagcttacrgcacaaatataaacaaacaataaa

SEQ ID NO: 86082 - DNA, 50 bp, homo sapien
gctccaaggtcatgtgagtccacacygtaaaatgaaaaaccctacaaatg

SEQ ID NO: 86083 - DNA, 50 bp, homo sapien
caagaaatctttgtgctctgagagayaataggtataactttaaaactcat

SEQ ID NO: 86084 - DNA, 50 bp, homo sapien
aaatggccacagatagtaaagaataygagtaaacataaaatggatggttt

SEQ ID NO: 86085 - DNA, 50 bp, homo sapien
tgttggggggggggctgttctatgargtgtaagatgtttagtgtacttct

SEQ ID NO: 86086 - DNA, 50 bp, homo sapien
tttttctggatgcttgaacctaatgyatcttagtttttcagacatgcata

SEQ ID NO: 86087 - DNA, 50 bp, homo sapien
agccttttacacaggggatctactcrctcagaattttacaaatcagtgga

SEQ ID NO: 86088 - DNA, 50 bp, homo sapien
ggtgtgctgagggacagctcatgaargtaggagggactccaaggagaagc

SEQ ID NO: 86089 - DNA, 50 bp, homo sapien
atcaatggtgataaccacagatagarcaaaggagctggattatcaatact

SEQ ID NO: 86090 - DNA, 50 bp, homo sapien
acaagcactttcaactgtgagcttcrataataacactatgagatctgtac

SEQ ID NO: 86091 - DNA, 50 bp, homo sapien
aacttaaccaaaggcttacatcaacycaaggagcacttattcaagaaaaa

SEQ ID NO: 86092 - DNA, 50 bp, homo sapien
acaagcatttactctctccccacaaygaagccttaaagtgcaaaagttca

SEQ ID NO: 86093 - DNA, 50 bp, homo sapien
gagttgatgtaagcctttggttaagytcctgtgttccaaaaaagtggatt

SEQ ID NO: 86094 - DNA, 50 bp, homo sapien
aacagctggaaacatctgtgctaccyatgaattacagacgatttgagaaa

SEQ ID NO: 86095 - DNA, 50 bp, homo sapien
ggaagggatgtgatgagagtgttaaytgaaaataaggacttggatgcaga

SEQ ID NO: 86096 - DNA, 50 bp, homo sapien
cctagtttggagaattctgcagacartcatattcctttcactatccacac

SEQ ID NO: 86097 - DNA, 50 bp, homo sapien
ttattgcatattttggcactatgcartagagtatgttgtcaagtaatgat

SEQ ID NO: 86098 - DNA, 50 bp, homo sapien
tagaatagactggcctcacggaagayattctccaacctaccagcctatca

SEQ ID NO: 86099 - DNA, 50 bp, homo sapien
atgcccagcctatagttattctttayactgaacatatttgtgtatgtttt

SEQ ID NO: 86100 - DNA, 50 bp, homo sapien
acatcaggcatgaagagatataatarctacactaccatagtgggtgaagg

SEQ ID NO: 86101 - DNA, 50 bp, homo sapien
gtcattcagaactaaatagagtgtcracctctgaaccaatctataatata

SEQ ID NO: 86102 - DNA, 50 bp, homo sapien
cagtaggaggtttaggtagagaccaytgagaggagaaagaaaggagaacg

SEQ ID NO: 86103 - DNA, 50 bp, homo sapien
taccaggataaacctagagtatcacrgactgattcaggttcttaggagcc

SEQ ID NO: 86104 - DNA, 50 bp, homo sapien
aggtgaccaataatcccagtgacgasagcttcaatcttcatctgtcctag

SEQ ID NO: 86105 - DNA, 50 bp, homo sapien
aacattaacacagaagttggggaacsgaccgagaagaggttgatctagaa

SEQ ID NO: 86106 - DNA, 50 bp, homo sapien
caaaaacaacaaacattgtccctacrcctttacatctattcaccttttta

SEQ ID NO: 86107 - DNA, 50 bp, homo sapien
aaaatgaagagtagagagtatccaargatttttccagctcttatattctg

SEQ ID NO: 86108 - DNA, 50 bp, homo sapien
tacacaaaattgttcccatcagaaarcatattttgtaataacagagaaga

SEQ ID NO: 86109 - DNA, 50 bp, homo sapien
tggaaccccagataactctgcaatcygaataactggacatacagcatcca

SEQ ID NO: 86110 - DNA, 50 bp, homo sapien
attcaaaatctcatagaggcagaaayattaaaaagggctgggggagggat

SEQ ID NO: 86111 - DNA, 50 bp, homo sapien
caagcaacaaacatattataacttckcctcaaaattcagtagagattact

SEQ ID NO: 86112 - DNA, 50 bp, homo sapien
ttgatagttctctaaaatgttgtcargaagggcctaagatctttgtgatc

SEQ ID NO: 86113 - DNA, 50 bp, homo sapien
agaatggcatgagacgatcattcagrttgaggtagcagcaggtgcagaac

SEQ ID NO: 86114 - DNA, 50 bp, homo sapien
ttggatgatgggaacagcctcctgakaagtacctgaaagtgacatcctca

SEQ ID NO: 86115 - DNA, 50 bp, homo sapien
tataggaattactttgggtagccacratcccacaaaaagtaacatgccat

SEQ ID NO: 86116 - DNA, 50 bp, homo sapien
tgtaaagattgtgtatatgaacccargtactgttacaataattgtagaca

SEQ ID NO: 86117 - DNA, 50 bp, homo sapien
gaggtggctctgctgcagaggcacamctgatggcaagctatgggagtact

SEQ ID NO: 86118 - DNA, 50 bp, homo sapien
gccaaaaagaactgtttgtggtaatyaatctgtaattttctgtttgacat

SEQ ID NO: 86119 - DNA, 50 bp, homo sapien
tgcctacgtcagtctcttaaactcaytctcattcccatttacctgcctgt

SEQ ID NO: 86120 - DNA, 50 bp, homo sapien
attttatgaggctgtttatgttacartaattcctatgtcacagttgtgtt

SEQ ID NO: 86121 - DNA, 50 bp, homo sapien
acaattttataaattggtatgtttcratgtttttgttaggaaaaaaatgt

SEQ ID NO: 86122 - DNA, 50 bp, homo sapien
tagaccccagggcaagtgtccaagaraacaaggcaaaagctacaatgtct

SEQ ID NO: 86123 - DNA, 50 bp, homo sapien
atgacctcattttaccttgattaccrctgcaaagatcatatcttcaaata

SEQ ID NO: 86124 - DNA, 50 bp, homo sapien
cccacacactacacttctttaaataygccagataaaatcatttaatcaag

SEQ ID NO: 86125 - DNA, 50 bp, homo sapien
  misc_feature (3)..(3): n is a, c, g, or t
ttntgcaattttcccttatcttgtcytgactaatggctggataccaactc

SEQ ID NO: 86126 - DNA, 50 bp, homo sapien
gttaacatagaaacaccatttcttaycaatatgagcctaagtttttcttg

SEQ ID NO: 86127 - DNA, 50 bp, homo sapien
gaaatactcaagcctctgaggttgawactaagctcaagtctgtatttcat

SEQ ID NO: 86128 - DNA, 50 bp, homo sapien
ctatattaaagaaaaacaaaacttayctcaatcattcagaagtagccaac

SEQ ID NO: 86129 - DNA, 50 bp, homo sapien
aatccttctctggagatttataactygtaatgaatgttaagcatgtagac

SEQ ID NO: 86130 - DNA, 50 bp, homo sapien
tgtgtgaatcctagttctctattaayggaaagaattaaaaaccttcagag

SEQ ID NO: 86131 - DNA, 50 bp, homo sapien
tttagacagagtacatgttaacagastctatgatggatttaaaaagaaat

SEQ ID NO: 86132 - DNA, 50 bp, homo sapien
ggtcacatccagaaatcagaaactasaagtcccaatcattttactcttca

SEQ ID NO: 86133 - DNA, 50 bp, homo sapien
ccaagtaaaagcaccaagtaagccayaaattccaggaaaagggatcagca

SEQ ID NO: 86134 - DNA, 50 bp, homo sapien
gtagaggtgtcagaatgctaatccartcacaccaatgccctggttaacat

SEQ ID NO: 86135 - DNA, 50 bp, homo sapien
gagcaactctttaccagatttgtgaytgtgaattatttattaaactcaaa

SEQ ID NO: 86136 - DNA, 50 bp, homo sapien
caattttatctttaacaaatactcargtttcctgaatgaacttttaatac

SEQ ID NO: 86137 - DNA, 50 bp, homo sapien
aaaattgcaacccttaaagcagagaygacaagatcttaattaggcattat

SEQ ID NO: 86138 - DNA, 50 bp, homo sapien
ttctaagtgtttttctaaggaaacartaagaaattaagacattcattgca

SEQ ID NO: 86139 - DNA, 50 bp, homo sapien
ttgcatgaatacaattgttctctcayctgtatagtttcatattccatagc

SEQ ID NO: 86140 - DNA, 50 bp, homo sapien
ctatttaacaatatggaaagataccratggactattaattagaaaaaagt

SEQ ID NO: 86141 - DNA, 50 bp, homo sapien
tttacttggcagaaacttagttatasagaagggcctagcttcactggagg

SEQ ID NO: 86142 - DNA, 50 bp, homo sapien
caaattctatgtgaactcttttttawgattggttcacagcatcctggttt

SEQ ID NO: 86143 - DNA, 50 bp, homo sapien
taaagatagatagaatttgagatacsagatttaaatccatttcaatccaa

SEQ ID NO: 86144 - DNA, 50 bp, homo sapien
gaaatttcagaaagaatgtatagaayggaacagagaaaacattttaatat

SEQ ID NO: 86145 - DNA, 50 bp, homo sapien
tcttcattctccctttcaagaggaaygcataaataggtcccatggtgtta

SEQ ID NO: 86146 - DNA, 32 bp, homo sapien
attgaaagctctaaaakgtggcaatcattgtt

SEQ ID NO: 86147 - DNA, 50 bp, homo sapien
ttgcaatagtgctgtaacagaaatayatactatgtcccataaccagtaaa

SEQ ID NO: 86148 - DNA, 50 bp, homo sapien
acgtgaacgttgctagacctatgtgraatgttttcctattaaaaaagtaa

SEQ ID NO: 86149 - DNA, 50 bp, homo sapien
attttgccagggaaaccagagttgcrcgatttctatgaacttgaaagtta

SEQ ID NO: 86150 - DNA, 50 bp, homo sapien
aatatgaaaaatattttacagagatyacatttgacgcagctgcttcctga

SEQ ID NO: 86151 - DNA, 50 bp, homo sapien
gagttatattcagcaaaattaagtgraagagatggaataaaaaagtcaag

SEQ ID NO: 86152 - DNA, 50 bp, homo sapien
aaatataaaaggttacacaagtacaytaacatgataaaataatgatgaga

SEQ ID NO: 86153 - DNA, 50 bp, homo sapien
tagaaagtgttaaatatggtctacaycagagtgaatttataaaccttgcc

SEQ ID NO: 86154 - DNA, 50 bp, homo sapien
aactgctaaaatctgcaaagtggacragcttaatcaactgtgaatgagtg

SEQ ID NO: 86155 - DNA, 50 bp, homo sapien
tccactgaaatcagcctgagaaactraagaaccagagtctgtgcatccct

SEQ ID NO: 86156 - DNA, 50 bp, homo sapien
tgaatagtggctgggttttgagcccragttaagacctggaagagaaaaga

SEQ ID NO: 86157 - DNA, 50 bp, homo sapien
ccctattagctatatattaaatacaratactcgtgttaggcttatgagtg

SEQ ID NO: 86158 - DNA, 50 bp, homo sapien
ctagtcactatttgcagcagatagaratacagtcatgaatcctttaatga

SEQ ID NO: 86159 - DNA, 50 bp, homo sapien
ttctccttctttacaaaataatttckctgcctaagggcatggtcataaca

SEQ ID NO: 86160 - DNA, 50 bp, homo sapien
tagttttccaattcttgtcacttcckccagaacatcattgcagaactcaa

SEQ ID NO: 86161 - DNA, 50 bp, homo sapien
aaatctgatgggataaatagagtacmagattaagtgacaagtagaagaaa

SEQ ID NO: 86162 - DNA, 50 bp, homo sapien
gattattacagtgaaatcggcacacrgatctcaagatgaaagtttgctgt

SEQ ID NO: 86163 - DNA, 50 bp, homo sapien
taaattgattcatgcagtgaataggwcaaggcagattaatacaaagagca

SEQ ID NO: 86164 - DNA, 50 bp, homo sapien
tcttaatttgtttgtgcaaatgagamggaaattgtgcattcatctggaaa

SEQ ID NO: 86165 - DNA, 50 bp, homo sapien
tttgaatttgatcatgaaagttgtamatttgaagaaggtgaaatttgcat

SEQ ID NO: 86166 - DNA, 50 bp, homo sapien
tggagccctgtggtccactgccgatytaaactatttcttctagtaataat

SEQ ID NO: 86167 - DNA, 50 bp, homo sapien
aaagagtcagctacattagacttcartatatcaaaaatgcatgagtacac

SEQ ID NO: 86168 - DNA, 50 bp, homo sapien
ccctgtcacccatagctcatcatttwaaaaaaattactttccacttgaat

SEQ ID NO: 86169 - DNA, 50 bp, homo sapien
gactaatataatgaatttattttgawctataacatactgtttgatatgtt

SEQ ID NO: 86170 - DNA, 50 bp, homo sapien
caccgtgctggaaattgtggacactsaactatgtgatgacttaaagtact

SEQ ID NO: 86171 - DNA, 50 bp, homo sapien
gggcattcattctgaggtttttaagyccttcaattcttcatccctattcc

SEQ ID NO: 86172 - DNA, 50 bp, homo sapien
taacgaagtagctggaaaggtaaaaycaatatttcatgcataaaggaaac

SEQ ID NO: 86173 - DNA, 50 bp, homo sapien
ttaatatttatggaacagatacattsaactgcttacttgttaagaccact

SEQ ID NO: 86174 - DNA, 50 bp, homo sapien
atatacttttgatatctacagctttwaaaaaatcatagtggaaaaacacc

SEQ ID NO: 86175 - DNA, 50 bp, homo sapien
tgagaattaaatgataaggtgtccayaaagatactccataaattataagg

SEQ ID NO: 86176 - DNA, 50 bp, homo sapien
tcatccatatatattcttttagaaaktatgccttgttcatattggactca

SEQ ID NO: 86177 - DNA, 50 bp, homo sapien
cccaggtcatccatcatgaagtccargaattgtaaatgtgaggaagtgca

SEQ ID NO: 86178 - DNA, 50 bp, homo sapien
ttgagtactcccaaacacaccttcaygcaattacttgtgcgtgtgaatta

SEQ ID NO: 86179 - DNA, 50 bp, homo sapien
agatgctctagagacaaagttatggratttatcagccattgggtgtttca

SEQ ID NO: 86180 - DNA, 50 bp, homo sapien
cattgccccaggtcaaggtgctctaycaagcaatagtcttacccccagtt

SEQ ID NO: 86181 - DNA, 50 bp, homo sapien
agatgattgaataaactctgccttasaatgaattaattgtaatattttca

SEQ ID NO: 86182 - DNA, 50 bp, homo sapien
acataatttctgtcctctccctgcarcaaaccgggtcttcatcatgcccc

SEQ ID NO: 86183 - DNA, 50 bp, homo sapien
tggtagaaataatttatttacagtarcaacaaagaaaattaatttaacaa

SEQ ID NO: 86184 - DNA, 50 bp, homo sapien
tcaccctaagccttcttaaaggagayagcaacctcaacacaacatattta

SEQ ID NO: 86185 - DNA, 50 bp, homo sapien
ccatctattagctaatgattttatasgtcagagtccaggtaggctcaact

SEQ ID NO: 86186 - DNA, 50 bp, homo sapien
acatacatattttttagaagactgayattgcattaccacatagaagctgt

SEQ ID NO: 86187 - DNA, 50 bp, homo sapien
ataacaatcatgtaatcttgttgatrataatggtacttgatgtttgtgta

SEQ ID NO: 86188 - DNA, 50 bp, homo sapien
agttttaaagatcaaactaagataaygtacaataggttactttgcagact

SEQ ID NO: 86189 - DNA, 50 bp, homo sapien
aaaaaataattcttagctctttggawgtaattttaacaggtacattctag

SEQ ID NO: 86190 - DNA, 50 bp, homo sapien
cctaatttctctaggccccagtttaygcactaatatagtaaaggaatctt

SEQ ID NO: 86191 - DNA, 50 bp, homo sapien
aaagaatataggtaatttgagaagawctggggtaggtcatgaaaaatatg

SEQ ID NO: 86192 - DNA, 50 bp, homo sapien
aagtgttttcaggtttttggaagacrcccattatctaaaactattcatat

SEQ ID NO: 86193 - DNA, 50 bp, homo sapien
acctctctcccaccttctttagccaygacgtgcttgtgacctgggatacc

SEQ ID NO: 86194 - DNA, 50 bp, homo sapien
catgatatcattaaactagacacttmaacatatttctgatgatccagttt

SEQ ID NO: 86195 - DNA, 50 bp, homo sapien
gaataatccaaatatagaagtaatawccatatctgtctaataacaaataa

SEQ ID NO: 86196 - DNA, 50 bp, homo sapien
taaaataattaagttcaaaaactaartgcaaggttgtaagataaattgtt

SEQ ID NO: 86197 - DNA, 50 bp, homo sapien
taaatgtgggaaaactgaacattggyagttaacgagcaaggaacatgcaa

SEQ ID NO: 86198 - DNA, 50 bp, homo sapien
atcttccatcctccctgacactaggrataaaaaaaatgaagatactcttt

SEQ ID NO: 86199 - DNA, 50 bp, homo sapien
agaatcatttaccaatatctcggaaygactgtgattatacaaaacaccga

SEQ ID NO: 86200 - DNA, 50 bp, homo sapien
gctaaaatcttcaagcctaaacatayattttaatccaatctctgtccact

SEQ ID NO: 86201 - DNA, 50 bp, homo sapien
aagcttgacaatgtcaaagagcttayatgcaattggcaagggaaccaaaa

SEQ ID NO: 86202 - DNA, 50 bp, homo sapien
attcctaaaatgcagaaatgggtacrctgacaaattttgcaattcaagat

SEQ ID NO: 86203 - DNA, 50 bp, homo sapien
gagaaaagtagggtggaagaggaaaygatgctgaagactgaggaggcagg

SEQ ID NO: 86204 - DNA, 50 bp, homo sapien
tagtgacaatttgaaaacatttaaawctagcatggtgaaactgaattcat

SEQ ID NO: 86205 - DNA, 50 bp, homo sapien
aggtcaccacaaatttaatccgccaygttaagagaaaatttaagatgtga

SEQ ID NO: 86206 - DNA, 50 bp, homo sapien
agcttaattttttcttagtataaacrgtaatgcacactcattctaaaaag

SEQ ID NO: 86207 - DNA, 50 bp, homo sapien
ataaaatctttgtcagaaaattcacrgacttggttatgcatgcattgtta

SEQ ID NO: 86208 - DNA, 50 bp, homo sapien
tgtcctttctcaaatcttaggataawttacattagcagaactaatataag

SEQ ID NO: 86209 - DNA, 50 bp, homo sapien
ctgtttagtataatgtctaaatacargaaatactctcaataattatacaa

SEQ ID NO: 86210 - DNA, 50 bp, homo sapien
gtattccttcacatgtaggcttgccraaaattgggtaaaatgtgattaca

SEQ ID NO: 86211 - DNA, 50 bp, homo sapien
gaagaggctgatttatacgcaaaaaytggtaacacaagcagactatgcta

SEQ ID NO: 86212 - DNA, 50 bp, homo sapien
aggcaacctacactagctgcctatayaagttaacctactcttcttgtcag

SEQ ID NO: 86213 - DNA, 50 bp, homo sapien
ctgcatcatacaactcttagtcgaarggaattgatccaacctggttccct

SEQ ID NO: 86214 - DNA, 50 bp, homo sapien
tattttcaggtacaaagttaaacatsaagattagtgacacctggataaaa

SEQ ID NO: 86215 - DNA, 50 bp, homo sapien
tttccttaatttgggctttgctaaamacaactttttgtgtcctctgacaa

SEQ ID NO: 86216 - DNA, 50 bp, homo sapien
ttttatttgctctctttgttagtggracagttgattgtcttattgatttt

SEQ ID NO: 86217 - DNA, 50 bp, homo sapien
gatttcgtagttcaaatagctgaaaragaatctagttgtactaattcacc

SEQ ID NO: 86218 - DNA, 50 bp, homo sapien
tgggcaatcactctaagtaaggactmaattactggctatggaacagttag

SEQ ID NO: 86219 - DNA, 50 bp, homo sapien
gcccccaaaagtagattaataaaaasgtgactgtaagaagagacttaaaa

SEQ ID NO: 86220 - DNA, 50 bp, homo sapien
aattaatctgactgaaaagtagacayggacgataaatgtgcagtacaccc

SEQ ID NO: 86221 - DNA, 50 bp, homo sapien
gtaagaatgaagtcaccacatgacarctgtaagagagtgttctatctggg

SEQ ID NO: 86222 - DNA, 50 bp, homo sapien
ttgatgttttcagaataaataaatgyacgtttaaatttcaggaacggaaa

SEQ ID NO: 86223 - DNA, 50 bp, homo sapien
gtatactgtgttcactggctgtacaygcatctcataacacattttgcctt

SEQ ID NO: 86224 - DNA, 50 bp, homo sapien
ctggcagaagattataatgtcttgamaaaattcagatctgcaaactttga

SEQ ID NO: 86225 - DNA, 50 bp, homo sapien
tcctatatgtgtccgtagtgtcactraacgaagctctaacttcttagaag

SEQ ID NO: 86226 - DNA, 50 bp, homo sapien
aactctgatggagatgtatgaagaarttaatgttgttttcatgcctgcta

SEQ ID NO: 86227 - DNA, 50 bp, homo sapien
cctggactctttctcaagttttgttrtcaatattatacaaacatcataaa

SEQ ID NO: 86228 - DNA, 50 bp, homo sapien
tcaggagagttgtcttaaactacaaytaacatcagttctgatatcagaat

SEQ ID NO: 86229 - DNA, 50 bp, homo sapien
cattcacagctccctcagggcgccaraaactttattgccagtagtagttc

SEQ ID NO: 86230 - DNA, 50 bp, homo sapien
ttataagatccttagaatgaaggaaygcacaaactgcaaaaaattactcc

SEQ ID NO: 86231 - DNA, 50 bp, homo sapien
ggctcctcacttcttccaaaaactcyagtatgtactgtcacctggataat

SEQ ID NO: 86232 - DNA, 50 bp, homo sapien
ggagctcatacgttcttctttggtaygtccgagtatacttctagcagttg

SEQ ID NO: 86233 - DNA, 50 bp, homo sapien
agaacgtatggctatacagtatctayaatctgatcagagtcacagcatgt

SEQ ID NO: 86234 - DNA, 50 bp, homo sapien
ttcagtgtggtacatggctccaaaarataaataaccgatattctaaaaag

SEQ ID NO: 86235 - DNA, 50 bp, homo sapien
gctgtcactcaatgtctaaagctcarctcatcatattcacacacaaccaa

SEQ ID NO: 86236 - DNA, 50 bp, homo sapien
gagaaggctgatagggccacaagaayggacagacatcaagtaaaatttga

SEQ ID NO: 86237 - DNA, 50 bp, homo sapien
tctgtcttttctacttcttcatctaygtaattcctcttagcttttcatat

SEQ ID NO: 86238 - DNA, 50 bp, homo sapien
gctgataccactttttttctccacawtattctcctttttccttgattata

SEQ ID NO: 86239 - DNA, 50 bp, homo sapien
ataaacgtcacttctaataaattcargattagtttgtgggcaactgcttt

SEQ ID NO: 86240 - DNA, 50 bp, homo sapien
catgaaaaatttagcatgcaattgasaaggaatgtataattaataacttc

SEQ ID NO: 86241 - DNA, 50 bp, homo sapien
gaaagaagaattcctggttaaataaygcctcacgcgtgaattcttatttt

SEQ ID NO: 86242 - DNA, 50 bp, homo sapien
gcaaatgtgtaactttccctggagaygaactgcttggatgccaatgtgta

SEQ ID NO: 86243 - DNA, 50 bp, homo sapien
ataaaatttaagtattttcctttccsaaacttatagagactttagtaaat

SEQ ID NO: 86244 - DNA, 50 bp, homo sapien
gcctccttcaacagaaatcaagagaragcttatgagctcagtgcgagaac

SEQ ID NO: 86245 - DNA, 50 bp, homo sapien
gagcaagaattttgtgtcaggaggaycgtgatttcaatttcagctctgtc

SEQ ID NO: 86246 - DNA, 50 bp, homo sapien
cagagggactgctacatatgaactayggtataacacgtctgaaaccaagt

SEQ ID NO: 86247 - DNA, 50 bp, homo sapien
aaggaatggaggtccttagtagtagkagctaaagctgaaaagtcataatg

SEQ ID NO: 86248 - DNA, 50 bp, homo sapien
gcagcaacacatagtttagaaaaaargactacagaataatttgcttaact

SEQ ID NO: 86249 - DNA, 50 bp, homo sapien
tttcgagaatgataagtatcgtcagraaaagagaaaagagtaaaactgca

SEQ ID NO: 86250 - DNA, 50 bp, homo sapien
tattaaggaggtaaatatttaaggaytaggagagcctggttcttttccct

SEQ ID NO: 86251 - DNA, 50 bp, homo sapien
actttgggactccattcagagctgaytagcttcacagaactggcttaaac

SEQ ID NO: 86252 - DNA, 50 bp, homo sapien
aattataggcacatctgcagtcaatyatattttctgaggattgaatggaa

SEQ ID NO: 86253 - DNA, 50 bp, homo sapien
taggaatcttaagtgattgggtcatwacccattagaaaaaaggactggat

SEQ ID NO: 86254 - DNA, 50 bp, homo sapien
atacttcagacaataccaacattaaratgcagccaatttctctgtaattg

SEQ ID NO: 86255 - DNA, 50 bp, homo sapien
ctagaaaatcaccgtttgactcccartgaagtaataaatgttgcaggcaa

SEQ ID NO: 86256 - DNA, 50 bp, homo sapien
tttaaagaacatgtatatctgactayctgttttcaatttattaacagcta

SEQ ID NO: 86257 - DNA, 50 bp, homo sapien
taataatgctgtaagcaagctgtaarccctctgagaacaggatgcatatc

SEQ ID NO: 86258 - DNA, 50 bp, homo sapien
ttgtatatggtgatattttcagcaarggattttttgtataattgaaccta

SEQ ID NO: 86259 - DNA, 50 bp, homo sapien
ctctatgggaaagaaccctggcttgyagatgtcaggcatttcaggtataa

SEQ ID NO: 86260 - DNA, 50 bp, homo sapien
acaactatgaacgatattgaggtgaytgataaagtttgaatttggattaa

SEQ ID NO: 86261 - DNA, 50 bp, homo sapien
gacttctagctcaaggtggtgcgtgsagtacatttttttagctatctctt

SEQ ID NO: 86262 - DNA, 50 bp, homo sapien
gcacttttgaattaggattctttgamgcatgaagataaattgattccagg

SEQ ID NO: 86263 - DNA, 50 bp, homo sapien
aattcgtctgaaaatgtaagccagartaaccgttctagtgctaaaaaatc

SEQ ID NO: 86264 - DNA, 50 bp, homo sapien
tgtgagttgccccagtgagttctaargcaacagagactcacttcattcat

SEQ ID NO: 86265 - DNA, 50 bp, homo sapien
caccttgaatgaatttagtcctaatyatctctacttttatctgaattagg

SEQ ID NO: 86266 - DNA, 50 bp, homo sapien
ttggattggtattatgagacagcaaktatgagacatgtaatatcactgct

SEQ ID NO: 86267 - DNA, 50 bp, homo sapien
tgacttctgcactttccaaaggcagktggttctaaagaaggacttaggga

SEQ ID NO: 86268 - DNA, 50 bp, homo sapien
gatctctccatcaatctcaagttacyattgactcaaggttcattctaact

SEQ ID NO: 86269 - DNA, 50 bp, homo sapien
taagaagagaccagtaagaaagaacragatcaggacagtaggtcaaagag

SEQ ID NO: 86270 - DNA, 50 bp, homo sapien
aagcttaacattcaacattgtgcttraacaaaacttaccactactcaatt

SEQ ID NO: 86271 - DNA, 50 bp, homo sapien
aatatcacagctgctgagtttactcsatagctttcaaaccttttttattt

SEQ ID NO: 86272 - DNA, 50 bp, homo sapien
tggtgggaaaattgtaaagcatttargctcttcatcattaaaagattctc

SEQ ID NO: 86273 - DNA, 50 bp, homo sapien
ctgcacttcttaaatagaacagaagyatccctgaaaaaaatatagatctg

SEQ ID NO: 86274 - DNA, 50 bp, homo sapien
tttcaggtgaaaatcatgttccatgraagaagagttagctcagcctgcaa

SEQ ID NO: 86275 - DNA, 50 bp, homo sapien
gcaataaagggagaagcggtttagarctgcaccatcataataacaggtga

SEQ ID NO: 86276 - DNA, 50 bp, homo sapien
ttgtggttaggattaaatgaacttaygtgtcttatgtgacatgatgtcta

SEQ ID NO: 86277 - DNA, 50 bp, homo sapien
tacaatggatatggtcttctaaatargcagatgtatatacaacaaaaact

SEQ ID NO: 86278 - DNA, 50 bp, homo sapien
gttttctaaaatagggcaactattamatctatatgcattctttaggcatc

SEQ ID NO: 86279 - DNA, 50 bp, homo sapien
ttctgttctgcataaggccagcccasacaaattttccattgtcccaagta

SEQ ID NO: 86280 - DNA, 50 bp, homo sapien
acagaagtgagatgagagccaataaytgaacaatcaagagttgaaactct

SEQ ID NO: 86281 - DNA, 50 bp, homo sapien
caatactaactagatggaattttcamagttaaaggtatagcgcttctcta

SEQ ID NO: 86282 - DNA, 50 bp, homo sapien
tcatcccacgtcatgctggttctacrcagagtttcaactcttgattgttc

SEQ ID NO: 86283 - DNA, 50 bp, homo sapien
agaaacaaaggatatatgggcacccrcttgagattctgaccttggagtac

SEQ ID NO: 86284 - DNA, 50 bp, homo sapien
agcactggctaatctccatttttaayaatccttggagaagtaagagtgtc

SEQ ID NO: 86285 - DNA, 50 bp, homo sapien
tctggattctgttcttctgcagaacygttttctccttgatcatctagtga

SEQ ID NO: 86286 - DNA, 50 bp, homo sapien
atgttcaagaatgttctaatggaaartcagtgtagattaaaggaaaaaag

SEQ ID NO: 86287 - DNA, 50 bp, homo sapien
ttatagacctatacagactctatgaraaaaaaatatattaccatagatca

SEQ ID NO: 86288 - DNA, 50 bp, homo sapien
gttccgaatctcttaaaaagtgagakcttgccttgcagtctaaacagtgt

SEQ ID NO: 86289 - DNA, 50 bp, homo sapien
taatttaattttaatttgacctgaayaatttgacatacatctacatgtac

SEQ ID NO: 86290 - DNA, 50 bp, homo sapien
agaaaaaatagcataagcaaagttcmaagagtgtgaaaggcaagatatgc

SEQ ID NO: 86291 - DNA, 50 bp, homo sapien
gtattatctgactgaattattaaaamatttctgagaggtaaatatgtctg

SEQ ID NO: 86292 - DNA, 50 bp, homo sapien
ttcattcaattaccatcaagacaacygtgcattctatctatacagtcttt

SEQ ID NO: 86293 - DNA, 50 bp, homo sapien
agcagcagaaatgtaattaactgcarctttggtaatattctagagtgaaa

SEQ ID NO: 86294 - DNA, 50 bp, homo sapien
ttgtaccactgattatgttatgttayacgcacagttgaccttaaggtagg

SEQ ID NO: 86295 - DNA, 50 bp, homo sapien
aaaatcactacacataaatgtcctayctttagctcacccaataggaattc

SEQ ID NO: 86296 - DNA, 50 bp, homo sapien
atcccaggaggtgtaactctaagaaraatgtagggtcacagaggttgaca

SEQ ID NO: 86297 - DNA, 50 bp, homo sapien
ttactttgagaaactgggaagctaamactaatgagaactttcagtgaagg

SEQ ID NO: 86298 - DNA, 50 bp, homo sapien
cccaattagccatcttgaaatcttaygaccaaacatctctgggctccagt

SEQ ID NO: 86299 - DNA, 50 bp, homo sapien
cataagaattataagctttttgaaaytccatgcatgttcaaggatggcat

SEQ ID NO: 86300 - DNA, 50 bp, homo sapien
ctaggtctctcaaagccccttccaastgtgtaaattgtatcatcgtcttc

SEQ ID NO: 86301 - DNA, 50 bp, homo sapien
gaacaagactgtgtctccaataatarcaaaaaaatgcagtatcctccaac

SEQ ID NO: 86302 - DNA, 50 bp, homo sapien
ttttttttttttaaacagcagtagcmctctacgttttcttacgcaatgac

SEQ ID NO: 86303 - DNA, 50 bp, homo sapien
ttggtgtgtgtgctcagcagcaacawctgtgtaagaatgagggaagcagg

SEQ ID NO: 86304 - DNA, 50 bp, homo sapien
tataatacatggatgctaggttaagycatgaagtgtgttattatttctca

SEQ ID NO: 86305 - DNA, 50 bp, homo sapien
aacagctaggggtttgtggcattaaragaactttggattttcctctgaaa

SEQ ID NO: 86306 - DNA, 50 bp, homo sapien
aactgtgacccattcagaagttctayctcctaagactttcccaaaggtga

SEQ ID NO: 86307 - DNA, 50 bp, homo sapien
ttgaggatatggggatgaaggcctaygatggcttggttattcagaatgcg

SEQ ID NO: 86308 - DNA, 50 bp, homo sapien
tctcgaaaaagatgcaagtctacaayggaacagaggattaaaatgatatt

SEQ ID NO: 86309 - DNA, 50 bp, homo sapien
atccctaacaactcaaaactccaatrattatggccaaatccgattggaga

SEQ ID NO: 86310 - DNA, 50 bp, homo sapien
gtaatatcttccatcttaaaaacaasttccatgacctgaaaatttccttt

SEQ ID NO: 86311 - DNA, 50 bp, homo sapien
tcaactagtatatattactctcaacygtaaaatgatgctagtaataactc

SEQ ID NO: 86312 - DNA, 50 bp, homo sapien
ttattatccaggttttggaacatgaytatacctgtaaaaaaatcagaatg

SEQ ID NO: 86313 - DNA, 50 bp, homo sapien
tagattttgtaaggttctgataaatyactcatctggttacaacacacatt

SEQ ID NO: 86314 - DNA, 50 bp, homo sapien
catttctaactcaatactcacaacawgggtctattccaaccactattttt

SEQ ID NO: 86315 - DNA, 50 bp, homo sapien
taacaacacaattcttgatactagcrgtagaggattcagaagagtattgc

SEQ ID NO: 86316 - DNA, 50 bp, homo sapien
gggatctttgtggagcaaataaaacygatacaagcaattattcatctcta

SEQ ID NO: 86317 - DNA, 50 bp, homo sapien
ccctaggagttctttgaagtgaagaracatgtaactcattattaaattct

SEQ ID NO: 86318 - DNA, 50 bp, homo sapien
tctgattaggtaaaatgaaatctcastgaacagagggctgagtactacct

SEQ ID NO: 86319 - DNA, 50 bp, homo sapien
acaagcaagcaaagttataattttcwattgtggtacttgcagaaaccttc

SEQ ID NO: 86320 - DNA, 50 bp, homo sapien
gaaactaacagcaggtgttctctggraagtaaaataaactgtgaataatg

SEQ ID NO: 86321 - DNA, 50 bp, homo sapien
aatccaacctttctaactctaaagcyatcctctccccttccattcttgcc

SEQ ID NO: 86322 - DNA, 50 bp, homo sapien
acaggatgttatgggataaaataccyatcttgtgatgcatacaaaaggca

SEQ ID NO: 86323 - DNA, 50 bp, homo sapien
ggtaactcaagataagcaaagataarcctctaattgattatgaacttatt

SEQ ID NO: 86324 - DNA, 50 bp, homo sapien
ggtctgcattgaacaacatcattgcytgggttgcagtcttctaatagcct

SEQ ID NO: 86325 - DNA, 50 bp, homo sapien
taaatgtgaactccaccttttgtggmaggaaggactattcaagataacaa

SEQ ID NO: 86326 - DNA, 50 bp, homo sapien
gtggtttagggcattggacaaaagaygataatgtttatttagatttggga

SEQ ID NO: 86327 - DNA, 50 bp, homo sapien
gacataaacttgacttaatatctaasagtcaaaatgcagtcaagtttttg

SEQ ID NO: 86328 - DNA, 50 bp, homo sapien
aaaggaaatatgaagctaaatgtcayggtaaacactctttctttgtttct

SEQ ID NO: 86329 - DNA, 50 bp, homo sapien
attcccccctgcttaaatatttggcyaaggttttatctatgtaaatgtat

SEQ ID NO: 86330 - DNA, 50 bp, homo sapien
attgcattcatccttgttacgcacaraaggacacttgtactgcattcccc

SEQ ID NO: 86331 - DNA, 50 bp, homo sapien
ctggggtgagaaaaaatatgctacartagtaaccaaatcagcatgatact

SEQ ID NO: 86332 - DNA, 50 bp, homo sapien
ttctggatccatcatcttatttaacrcttaaaacagctgtggttagaact

SEQ ID NO: 86333 - DNA, 50 bp, homo sapien
tttaagtagtcagttcccagtcacartaattgagtgttaattggtagagc

SEQ ID NO: 86334 - DNA, 50 bp, homo sapien
ttttatcttgggggtatttgctacayggatggatttgaacctcaattatc

SEQ ID NO: 86335 - DNA, 50 bp, homo sapien
taaaccttgagtatggtaaaatagaygtatttcgatataaatggagatgt

SEQ ID NO: 86336 - DNA, 50 bp, homo sapien
agctccaaaccaaataagagcttccraccgatggggcctttcttctcatt

SEQ ID NO: 86337 - DNA, 50 bp, homo sapien
attagacatatggtgagtatgaagasgaataacatatggtcccactagcc

SEQ ID NO: 86338 - DNA, 50 bp, homo sapien
tgtttgttgatatctgggcttattayaaaaggtgtgatgtgaacagacct

SEQ ID NO: 86339 - DNA, 50 bp, homo sapien
aaacaaacctgaaaatgaatcaaccyagtcaaatgagtaggaatccatag

SEQ ID NO: 86340 - DNA, 50 bp, homo sapien
tctaggcatagaaagagcatacctcraaataataaatgtcatatatgaca

SEQ ID NO: 86341 - DNA, 50 bp, homo sapien
ctaaacaataaggaaacaagaagcaktaaattactttttccccccaaata

SEQ ID NO: 86342 - DNA, 50 bp, homo sapien
gggtaagttcattatctgcctactgytcaaactcagcgataaaaatagtg

SEQ ID NO: 86343 - DNA, 50 bp, homo sapien
atccacttgccttacagctcttggamaaaaggtctgttttactggtaaat

SEQ ID NO: 86344 - DNA, 50 bp, homo sapien
tggtgattctaacagtataaagttcmcaatgttcgatgtccctagcttat

SEQ ID NO: 86345 - DNA, 50 bp, homo sapien
cttgggttaaaaatccaaccaaccayaaaattccacagaaactgaagtac

SEQ ID NO: 86346 - DNA, 50 bp, homo sapien
caaataatctaagcagtagaatcaartatcaagtaatctaagcaaattta

SEQ ID NO: 86347 - DNA, 50 bp, homo sapien
tcatggtcaggctgctggggcttaayatgaagaaccctgctccagctggt

SEQ ID NO: 86348 - DNA, 50 bp, homo sapien
aagaagcagtcaacatgaaattaaaygaaatccataggaagtgaactaat

SEQ ID NO: 86349 - DNA, 50 bp, homo sapien
tattgaagatttatttggataattcrattacatctgcctgaggaaaataa

SEQ ID NO: 86350 - DNA, 50 bp, homo sapien
tgtactactattaatgttttatcaartggtcacaaactgtgtattatttt

SEQ ID NO: 86351 - DNA, 50 bp, homo sapien
agtttttgagtttgtaattgtttacycatatgttgccaatggcagttttt

SEQ ID NO: 86352 - DNA, 50 bp, homo sapien
tgggaggtgagcttggtggctgagasaatcaggagagccccaggcagggt

SEQ ID NO: 86353 - DNA, 50 bp, homo sapien
attaaataattactggtggagaagarattgaagaccaaagttacaaatga

SEQ ID NO: 86354 - DNA, 50 bp, homo sapien
ctcatgaactagaggaacacattttyaactggctgccaagcataggtcac

SEQ ID NO: 86355 - DNA, 50 bp, homo sapien
tatcaagcatattgaagataatgaayggacctatcggatcatatcttagt

SEQ ID NO: 86356 - DNA, 50 bp, homo sapien
tagtctgttattgcagcaacagaaayctattaagatcctttgtatctctg

SEQ ID NO: 86357 - DNA, 50 bp, homo sapien
atgtataaattataaatcacaaatgrcatgcaggagaaataccaagtcag

SEQ ID NO: 86358 - DNA, 50 bp, homo sapien
cagccttacaggtgagcctttcatargaccacatccacaaaagggaacag

SEQ ID NO: 86359 - DNA, 50 bp, homo sapien
ccctctgtacgtcaaccagggctgckctaattagattgcttcatattttg

SEQ ID NO: 86360 - DNA, 50 bp, homo sapien
aaaataagtctaaatagaataatatmaaaaggcaatgattccagaaagtc

SEQ ID NO: 86361 - DNA, 50 bp, homo sapien
agagcatgagaatctaatcagtctaytactattgttgcctcttggagccc

SEQ ID NO: 86362 - DNA, 50 bp, homo sapien
atagaaacatggttttacagtaggakaatataaaaagagaaatgacgatt

SEQ ID NO: 86363 - DNA, 50 bp, homo sapien
gaatcactgaatcttgagttgtaaaygattgtgacctctatgccaggagc

SEQ ID NO: 86364 - DNA, 50 bp, homo sapien
cactgtcttttcttctctattcaaaytctatccttcctttttttcctact

SEQ ID NO: 86365 - DNA, 50 bp, homo sapien
tgtggttcatatgtccatccaagacsaaataactgctgacagtggtggcc

SEQ ID NO: 86366 - DNA, 50 bp, homo sapien
ttgtgtcacatagcaccataatatgraaaagaggacaagtgaatccctga

SEQ ID NO: 86367 - DNA, 50 bp, homo sapien
tctcatcaagtagtcacaataggacrctcagctaatgacttttcaggatt

SEQ ID NO: 86368 - DNA, 50 bp, homo sapien
aaaagatgcacaaatctccatgttgratattcccagtgcacattaatacc

SEQ ID NO: 86369 - DNA, 50 bp, homo sapien
caaactgctgtcagaatgaatactaygttttagcttttcaaataactgga

SEQ ID NO: 86370 - DNA, 50 bp, homo sapien
aggatcagagatcacagttctataamcaacctgaagaactgtgagctaaa

SEQ ID NO: 86371 - DNA, 50 bp, homo sapien
caagtgtcagcaagaatgagcataargagacctcttgctctatatttaag

SEQ ID NO: 86372 - DNA, 50 bp, homo sapien
tgcgtcacaggggcagatcccttacraatggcttggtgctgtcctcgcaa

SEQ ID NO: 86373 - DNA, 50 bp, homo sapien
agtaaaagctgtttggcagaaagacragtgaattagatatgcagagtgtg

SEQ ID NO: 86374 - DNA, 50 bp, homo sapien
ttggtatataaaagagcaaggtctayatccaagggaatcaatcaagctgt

SEQ ID NO: 86375 - DNA, 50 bp, homo sapien
gagcgcattgctataggcacataaartattgaacaacgagcttcctcttt

SEQ ID NO: 86376 - DNA, 50 bp, homo sapien
agttcaggccagattctaccatggawgtttcctttgtgatgtgtttctaa

SEQ ID NO: 86377 - DNA, 50 bp, homo sapien
gagtacaaaatattaaactgtcctcrgaggaattccaaataggctctaag

SEQ ID NO: 86378 - DNA, 50 bp, homo sapien
ggccactgcgatttgtttgacaccaytaaagttattttgctttctctgac

SEQ ID NO: 86379 - DNA, 50 bp, homo sapien
gagaaagaatgaggagcacttagaawaggaagcggagttcattagttcat

SEQ ID NO: 86380 - DNA, 50 bp, homo sapien
tggaagagggctaaccttagattacracccttagattacaacagtaatgt

SEQ ID NO: 86381 - DNA, 50 bp, homo sapien
acatttccaaagtatctggatagtayaaagtcagacaacactaaatcttg

SEQ ID NO: 86382 - DNA, 50 bp, homo sapien
agtcccagttttgaggcttgcctgcrctgtgtcactaccatttcttattt

SEQ ID NO: 86383 - DNA, 50 bp, homo sapien
ggatttcacatccagaatccctggcrcggatcaaagcagagtctgataga

SEQ ID NO: 86384 - DNA, 50 bp, homo sapien
acagtagaaaaagcattccattttayaatcagacagttcagattgagaga

SEQ ID NO: 86385 - DNA, 50 bp, homo sapien
gtattttgtggagactctattgtcckctaaagcaaaatttggttcaaata

SEQ ID NO: 86386 - DNA, 50 bp, homo sapien
ctgccaaaacatgtcttttgaatcaygtaggcttgtgctaacagaaaaag

SEQ ID NO: 86387 - DNA, 50 bp, homo sapien
gaggcttagttcccttagctgtaaargttgtgttaggcactttctagatg

SEQ ID NO: 86388 - DNA, 50 bp, homo sapien
gtgcattttacgttgttaattttacmattcagtctttgcaattaaaaagt

SEQ ID NO: 86389 - DNA, 50 bp, homo sapien
aatctaatgaatctgttctcagtttkggagagaatatgattttcaaggtt

SEQ ID NO: 86390 - DNA, 50 bp, homo sapien
ttaaaaccacaatgagatgtcactayatgtccagatgaatggctaatact

SEQ ID NO: 86391 - DNA, 50 bp, homo sapien
cagctcatcaagacatactgcagaayccaaccggacagaaactggaagaa

SEQ ID NO: 86392 - DNA, 50 bp, homo sapien
atcccaactcaactcagttaaatggwaatacatactcccagacacacaat

SEQ ID NO: 86393 - DNA, 50 bp, homo sapien
ggtattaatatatttgctacgtttgracatcccaactcaaagattgataa

SEQ ID NO: 86394 - DNA, 50 bp, homo sapien
tgtttgataatctattgaatgcctaygaatcagacattgtgttgggtact

SEQ ID NO: 86395 - DNA, 50 bp, homo sapien
tgtggaagtgagtgtaggcatctcaygaacatacagtgtgctaagagttg

SEQ ID NO: 86396 - DNA, 50 bp, homo sapien
aattttagacacattacctcatttgkctataaagttgtacagtagaaaaa

SEQ ID NO: 86397 - DNA, 50 bp, homo sapien
gagaaaagtctagaaagaaatgtgcmatcattggccaaaaattgtaattg

SEQ ID NO: 86398 - DNA, 50 bp, homo sapien
agggtgtcaatttgtgagaagaaatyaaaggaccaatggtctagacgtct

SEQ ID NO: 86399 - DNA, 50 bp, homo sapien
atccatgatactgtcttataataaawcatttccctggattcactggtgct

SEQ ID NO: 86400 - DNA, 50 bp, homo sapien
gggtggatggcattccatattcagcratcagtctcttttccagttttaca

SEQ ID NO: 86401 - DNA, 50 bp, homo sapien
atcaccaactgcaaaaccaaaggacygaggtaagtctaatcaaataagga

SEQ ID NO: 86402 - DNA, 50 bp, homo sapien
acataaaataattgttattagaaaamtgcgtgaacacgttgattgggggc

SEQ ID NO: 86403 - DNA, 50 bp, homo sapien
catcaccaaaacacacttacttaaarcagtctgacttgcccccaatcaac

SEQ ID NO: 86404 - DNA, 50 bp, homo sapien
atctagtacgtttaatcccgatagcmattggcaccatacctagaactaat

SEQ ID NO: 86405 - DNA, 50 bp, homo sapien
aaaaactactctggtaacagtgctcrgaagtcaaggtggcaaaatgacag

SEQ ID NO: 86406 - DNA, 50 bp, homo sapien
gaagattattacttgtggtagtaagyatagcaatacctcaactttttagt

SEQ ID NO: 86407 - DNA, 50 bp, homo sapien
tttacaaaaaatgcctgtaaaataaygtagagacttctaatagtttctaa

SEQ ID NO: 86408 - DNA, 50 bp, homo sapien
ttcggtggaaacccaatgtcgattcsaccggtgctgtgtgactgtgttgt

SEQ ID NO: 86409 - DNA, 50 bp, homo sapien
tcattgtagaaatttggagaatgcaraaaaatcaaaatggcaaaatccta

SEQ ID NO: 86410 - DNA, 50 bp, homo sapien
tttgtcgttactggtatttatttatsaagaaacaaaataagaactttttc

SEQ ID NO: 86411 - DNA, 50 bp, homo sapien
gcactcgctacctcagaaggaaagargttaaggtcaccttgacagtggtt

SEQ ID NO: 86412 - DNA, 50 bp, homo sapien
cgtaacatagaaaacctatactcacrctctactttatactttggattttt

SEQ ID NO: 86413 - DNA, 50 bp, homo sapien
ctacaggttaatatcagcaaagttayatttcacccccctcacccctgctg

SEQ ID NO: 86414 - DNA, 50 bp, homo sapien
ggtgggaggaggtagggcaagtgtayagatgcacctgggacttgtctcaa

SEQ ID NO: 86415 - DNA, 50 bp, homo sapien
tcgctcctcctgagctcaatgatgcwatctgctcccttttgcggggctta

SEQ ID NO: 86416 - DNA, 50 bp, homo sapien
gatttaagaatcaattatttagatcragactttggttcagcaaccacata

SEQ ID NO: 86417 - DNA, 50 bp, homo sapien
gcactgggggaaagtttctttctaayagttctcaagtgtgtaagctggag

SEQ ID NO: 86418 - DNA, 50 bp, homo sapien
agttgaattcaataagcaattgattygaaaacctgtgtaatctctagatc

SEQ ID NO: 86419 - DNA, 50 bp, homo sapien
ctgttgttgaatgcattattccacaragaaagttgacatccttctattaa

SEQ ID NO: 86420 - DNA, 50 bp, homo sapien
caagacagcttaaaacataaagaaargttgacactgaaaaaggtaataga

SEQ ID NO: 86421 - DNA, 50 bp, homo sapien
tcaacctgggcttaaaactctccagrccttcatgcggcttgtccaatttc

SEQ ID NO: 86422 - DNA, 50 bp, homo sapien
agcataccaatggcttgtgaagggaygggctttcttttcatttgtggaca

SEQ ID NO: 86423 - DNA, 50 bp, homo sapien
ttttgtggaaaaagaggaaagactayaatgcagagtagaaaaaaaataca

SEQ ID NO: 86424 - DNA, 50 bp, homo sapien
tcaaatgagattaaatattaaaaggracacttaatggacattcactaaat

SEQ ID NO: 86425 - DNA, 50 bp, homo sapien
ggagttgagctcaaaaacctatctcygaaactgattcatactccagtgta

SEQ ID NO: 86426 - DNA, 50 bp, homo sapien
acctctcatattatatccctgtggcrttaacagtgatgatcaaaatcctg

SEQ ID NO: 86427 - DNA, 50 bp, homo sapien
gaaactaatatttacactttcttcaytaaaagtatgatttaaaaagttta

SEQ ID NO: 86428 - DNA, 50 bp, homo sapien
tcaataaatgttgccctagaaaatcraaatatactatctacatattgact

SEQ ID NO: 86429 - DNA, 50 bp, homo sapien
caactgatactagtcactagaagaamactatgtatgatgctgaaacccaa

SEQ ID NO: 86430 - DNA, 50 bp, homo sapien
ctgttcaagtttacttttacttttgraagataatgttctaacacggtgaa

SEQ ID NO: 86431 - DNA, 50 bp, homo sapien
tccctcccaggcccatgtgtgtttayggtctcttagagtaaaacctgttt

SEQ ID NO: 86432 - DNA, 50 bp, homo sapien
tgctgagtatgcatttagattaggamatgaccatttattgtgacaaccaa

SEQ ID NO: 86433 - DNA, 50 bp, homo sapien
atttcaatctctttgccaaatttgtytaatgggaatctctcccttcaggg

SEQ ID NO: 86434 - DNA, 50 bp, homo sapien
tcatgggaagtgttaatttccttgayacaagtgagatagtgataaacaag

SEQ ID NO: 86435 - DNA, 50 bp, homo sapien
cacaactgtatcttcttggtccatawgttttaactaacagattacatcag

SEQ ID NO: 86436 - DNA, 50 bp, homo sapien
gctgtaaattagtcatggatcacaayaggaaagggaaagaagagagtttg

SEQ ID NO: 86437 - DNA, 50 bp, homo sapien
ttcatagcaaaagcagtctgataaamaggactttaaatgaagaaggaaaa

SEQ ID NO: 86438 - DNA, 50 bp, homo sapien
tttaatgtatttagaagcataaataycaaacctgtgctccaaagttaaca

SEQ ID NO: 86439 - DNA, 50 bp, homo sapien
cacacaaaatgtttatatgtttgacygcataagtattattttaggtcata

SEQ ID NO: 86440 - DNA, 50 bp, homo sapien
ctgcaaaaatcatgtcatctcttcaktaactgttaaagtgtaattctctg

SEQ ID NO: 86441 - DNA, 50 bp, homo sapien
ttgatagtacataattacaatgctayacaggtgactctagcataccttta

SEQ ID NO: 86442 - DNA, 50 bp, homo sapien
aatggattttctctcagtagactgaytatcccatactttattggatgatc

SEQ ID NO: 86443 - DNA, 50 bp, homo sapien
acttgaaaagtaccataatgagacargagagtaggatctggaggcagaga

SEQ ID NO: 86444 - DNA, 50 bp, homo sapien
tactcctactagaactggcttagtcraatcaaggttgtgtcttatcagct

SEQ ID NO: 86445 - DNA, 50 bp, homo sapien
aagtatgcaggaacacatacagaagmatgtttaagctagcatttttgaaa

SEQ ID NO: 86446 - DNA, 50 bp, homo sapien
acctcacaatataaggtgattgggaygagcttttcaacctacgtggaccc

SEQ ID NO: 86447 - DNA, 50 bp, homo sapien
gaactctgtgtgaactggaaaagacraaagaatgatgagcttctgggtga

SEQ ID NO: 86448 - DNA, 50 bp, homo sapien
cctgaagaagcttagacactgtactyaaaacacaaagattttaaaacaag

SEQ ID NO: 86449 - DNA, 50 bp, homo sapien
gttttattttatttccacactaccasaaatttagctacaccttttaaaat

SEQ ID NO: 86450 - DNA, 50 bp, homo sapien
tttccagctatcacacaaaaacttayctacctgaagtggcagtctcttga

SEQ ID NO: 86451 - DNA, 50 bp, homo sapien
ctttttaattttacttgtgctaagaygttaataggtaaccattgtttcat

SEQ ID NO: 86452 - DNA, 50 bp, homo sapien
taaactatttaggtttgctcttactsactctaaaaatggttgtgaattta

SEQ ID NO: 86453 - DNA, 50 bp, homo sapien
acatggagagattgctgaatatcgamccatccttacattcctgggataaa

SEQ ID NO: 86454 - DNA, 50 bp, homo sapien
gtaacagtgactgggtctaagtcaaygtagagccattaaacctaaatggg

SEQ ID NO: 86455 - DNA, 50 bp, homo sapien
caggatgcggttaaatatgtaaccamatgtctcagtagagaagtaacccc

SEQ ID NO: 86456 - DNA, 50 bp, homo sapien
actgccttagaaggtgcctgcttcayggttggttgcctttcattggcaca

SEQ ID NO: 86457 - DNA, 50 bp, homo sapien
acacatttaggcatagtaaaagtgamaaagatgcttccaagaaaattacc

SEQ ID NO: 86458 - DNA, 50 bp, homo sapien
caataaaataaacattaataagtggrtgtcctcatttatccaaggagaga

SEQ ID NO: 86459 - DNA, 50 bp, homo sapien
agtggctttgcttcattctcattacyctgtattagttaagcagtgccgcc

SEQ ID NO: 86460 - DNA, 50 bp, homo sapien
gatggaggaagagaccacaagcaaastagttcgggcagcctctggaggct

SEQ ID NO: 86461 - DNA, 50 bp, homo sapien
tttcactgttgcattttccttattgyaagagagattgttgtcccagcttg

SEQ ID NO: 86462 - DNA, 50 bp, homo sapien
gaacttagggtatatggccctaatgmaaagtgaccagtgtctaacacaag

SEQ ID NO: 86463 - DNA, 50 bp, homo sapien
tagattggaacagttaagtaagagarctttgagactctgtagaaggaaaa

SEQ ID NO: 86464 - DNA, 50 bp, homo sapien
ttttcttaattggcatatggagctastactggagccttaacgttgaccag

SEQ ID NO: 86465 - DNA, 50 bp, homo sapien
gggatggggaaattgcacttttagayccaacactcagggaagttctcagc

SEQ ID NO: 86466 - DNA, 50 bp, homo sapien
tggctatttatttggacacaccgatyaacacatagatacatgcttccaag

SEQ ID NO: 86467 - DNA, 50 bp, homo sapien
agaggccagctagtaagtttaatgaygtgtgtttcaaggtcccaaaatga

SEQ ID NO: 86468 - DNA, 50 bp, homo sapien
agttttgggggtgcagttgccctgartacctgcctgattggcccttgtag

SEQ ID NO: 86469 - DNA, 50 bp, homo sapien
cctcaagccattgttttttgactacygtccagagtttctagctgtcctct

SEQ ID NO: 86470 - DNA, 50 bp, homo sapien
caacgtcctagatgaacacttcaaamtttacttagagagagaagacatca

SEQ ID NO: 86471 - DNA, 50 bp, homo sapien
aacaaagacaaaaaatacacttagaytcctctgcaagaactgatatgtct

SEQ ID NO: 86472 - DNA, 50 bp, homo sapien
gttgtcatgactgtttcctgcgacaycaaactctcacatatgcccagtag

SEQ ID NO: 86473 - DNA, 50 bp, homo sapien
tagataaaacatgtagagaagaatcrcatttttggagacacaaaccagtt

SEQ ID NO: 86474 - DNA, 50 bp, homo sapien
attactttatcaagctgggcaaacaytgatggacatcctcctccatctgt

SEQ ID NO: 86475 - DNA, 50 bp, homo sapien
agattccagctgagaggtcattaccragagctcatgacctcccagctcag

SEQ ID NO: 86476 - DNA, 50 bp, homo sapien
ctgttaggaagaagactgagattagkaaagtccctaccagaaggaaaaga

SEQ ID NO: 86477 - DNA, 50 bp, homo sapien
tggggcggaccctctgctgtgagcarcctgcgagtagagctgtggcaggg

SEQ ID NO: 86478 - DNA, 50 bp, homo sapien
cagaaattcccgtgtaagaatgacayggaaagtactgagggtctggtgga

SEQ ID NO: 86479 - DNA, 50 bp, homo sapien
tcttgagcacatctcacgtactccaygttacccaggaagcaactgtgacc

SEQ ID NO: 86480 - DNA, 50 bp, homo sapien
atatgtatttgcatatgattgaagcrgaaagagtaaaactaagcaaacta

SEQ ID NO: 86481 - DNA, 50 bp, homo sapien
caatatcagttctccccctttgctamgtaatagaaccctccaaatattag

SEQ ID NO: 86482 - DNA, 50 bp, homo sapien
ctcatattctgcagtatcatttatcmtgagaagtgctgggtgagttctat

SEQ ID NO: 86483 - DNA, 50 bp, homo sapien
gctcttggttctcaggcttttggacyctaaggcttatatcaatagcctcc

SEQ ID NO: 86484 - DNA, 50 bp, homo sapien
tcagctcattggtcaaattagaatgyaacccagctggatgagtttgtagc

SEQ ID NO: 86485 - DNA, 50 bp, homo sapien
tagatagcgtatacaagatttgaaargaaattgtggaaattttaaagagc

SEQ ID NO: 86486 - DNA, 50 bp, homo sapien
tgggatacccagatctatggtaaaaygttatttcagagtgtgtctgtgag

SEQ ID NO: 86487 - DNA, 50 bp, homo sapien
gcctgggaacttgcttgcctctttayagagctggattttattcccatgca

SEQ ID NO: 86488 - DNA, 50 bp, homo sapien
aaatagaaatgggacagttactagcrgcaaattttggggctatgttaggg

SEQ ID NO: 86489 - DNA, 50 bp, homo sapien
aaaatactacttagaaacaagagaartgagtaggaatggaaatggcagtt

SEQ ID NO: 86490 - DNA, 50 bp, homo sapien
gcctagctcactcagagcagggcacsgatttttaaactggagaaggtgat

SEQ ID NO: 86491 - DNA, 50 bp, homo sapien
agatggatgagtgtaactgacttagsagtcctgagaaagctgaatcctga

SEQ ID NO: 86492 - DNA, 50 bp, homo sapien
aacagtcttgcaaggtatgaagagcrgatattttcatcatcgccatttca

SEQ ID NO: 86493 - DNA, 50 bp, homo sapien
atcagattttctgctgaatatattgrcaaaggaatttcatatggggctgg

SEQ ID NO: 86494 - DNA, 50 bp, homo sapien
acatacagccagtgtttacctaaggrcagcaaaaacagcaatactgcaat

SEQ ID NO: 86495 - DNA, 50 bp, homo sapien
ctgttcgaaagctgtgtttgtgagartcctcttttacattcttgcctgtc

SEQ ID NO: 86496 - DNA, 50 bp, homo sapien
actaagacttctatacctgataagaycatcattcaaaaatatgggataaa

SEQ ID NO: 86497 - DNA, 50 bp, homo sapien
aggctctaaaggtaatgatgtacacygtacgttttgagtaagaaagcagg

SEQ ID NO: 86498 - DNA, 50 bp, homo sapien
agaaactattcttatggtaaacacakataagaggggtgttgactttctgc

SEQ ID NO: 86499 - DNA, 50 bp, homo sapien
ctctgctcccattgcttttccctacraccgtcgtcaccagatacccaata

SEQ ID NO: 86500 - DNA, 50 bp, homo sapien
tctgatcttgaccctgccatacaacrggctatgagagcttgaacaaattg

SEQ ID NO: 86501 - DNA, 50 bp, homo sapien
agccaccatagtaagagctgtagagratttaaaaagaaaaagagcctatg

SEQ ID NO: 86502 - DNA, 50 bp, homo sapien
gaattttgctttctaacaattccatratctacagtgaagacttacattcc

SEQ ID NO: 86503 - DNA, 50 bp, homo sapien
gctgtacaaatgctttctcgaggatkactcgcagggggtaccctgccagg

SEQ ID NO: 86504 - DNA, 50 bp, homo sapien
cttgggtttgatacatgctacccgcrcaatccaggaactctcaggcccca

SEQ ID NO: 86505 - DNA, 50 bp, homo sapien
agagtgtatatcaagatgtcagttgsataagcagagaggggctcagatag

SEQ ID NO: 86506 - DNA, 50 bp, homo sapien
gatttcttttgaacttcattttatcygaccatctctccctgtccaggaaa

SEQ ID NO: 86507 - DNA, 50 bp, homo sapien
cattcttgggcaaggactgactctcsaagggttttgttcttggctttgga

SEQ ID NO: 86508 - DNA, 50 bp, homo sapien
ctacccagtctaccaattaaggtgarctattatagcagggaagtgtttag

SEQ ID NO: 86509 - DNA, 50 bp, homo sapien
ggatttgtgcttgccagagctaagcrttgttgggctataaaatggctttc

SEQ ID NO: 86510 - DNA, 32 bp, homo sapien
tggacacaatttaaggragaaaatagtgaagc

SEQ ID NO: 86511 - DNA, 50 bp, homo sapien
acttagtctgaagtcttattttaaarcaattaatcagtcttatacctaag

SEQ ID NO: 86512 - DNA, 50 bp, homo sapien
taagtgaatgaaggaataaatgaccrgcaataaagtccacccttggctct

SEQ ID NO: 86513 - DNA, 50 bp, homo sapien
ggccacatgggctatagaacaaggasagtgggtattatcaagcaatggac

SEQ ID NO: 86514 - DNA, 50 bp, homo sapien
cattttcttctagatctagctcttayagattgtttaccaattttgagtta

SEQ ID NO: 86515 - DNA, 50 bp, homo sapien
ttttgggtctcaccattttcaagccratagtggcaaagactctctgcttg

SEQ ID NO: 86516 - DNA, 50 bp, homo sapien
ccaacctatgtgtccatcagtggtckattgaataaagaatatgtggtaca

SEQ ID NO: 86517 - DNA, 50 bp, homo sapien
gaagatcaaacaaattcatgagtgtraatcagcttggataatttttgaca

SEQ ID NO: 86518 - DNA, 50 bp, homo sapien
aacttcacaacaaatttgttgtgaaratcaaacaaattcatgagtgtaaa

SEQ ID NO: 86519 - DNA, 50 bp, homo sapien
gcaggcagtattgcttatccagcaasggatgatgtgcttttgaatttcgt

SEQ ID NO: 86520 - DNA, 50 bp, homo sapien
gacatgtgctgaagtgagaactccargtagaagcaggcagtattgcttat

SEQ ID NO: 86521 - DNA, 50 bp, homo sapien
ttgtctcttgaaccccaaaatgatcmgataatatttctgtcttcttagac

SEQ ID NO: 86522 - DNA, 50 bp, homo sapien
catgtcggtagttgttttcctgaaawgatattagaggttaatgaaaatat

SEQ ID NO: 86523 - DNA, 50 bp, homo sapien
ggagcagtcattttctgttacaattrttaattcacaaaagggacattctg

SEQ ID NO: 86524 - DNA, 50 bp, homo sapien
gctcttggtcagaacagccagtgcakatcctcagaagaactctgaaagca

SEQ ID NO: 86525 - DNA, 50 bp, homo sapien
tgcatccttaatctttggtagaaaartttcagtagcatagggaaagggat

SEQ ID NO: 86526 - DNA, 50 bp, homo sapien
tcatgatggagcctcggtcatgaaasagcccaaggcaggcagttgccccc

SEQ ID NO: 86527 - DNA, 50 bp, homo sapien
actgtggccctaagtatctatatgtkaaacaaaattgtcctgacatttgt

SEQ ID NO: 86528 - DNA, 50 bp, homo sapien
tatataaaatatttatataagaataygaagaagctaaacaaacacccata

SEQ ID NO: 86529 - DNA, 50 bp, homo sapien
agtacatctaatgggacaaagaatawgctttttttgagcaagtcataagt

SEQ ID NO: 86530 - DNA, 50 bp, homo sapien
accctggtcttacaggaaccttggcraagtgtatacagactgaggatgga

SEQ ID NO: 86531 - DNA, 50 bp, homo sapien
acgatgccatcatatctgcagaacasaggaactatttacccctggcaata

SEQ ID NO: 86532 - DNA, 50 bp, homo sapien
atgtgtgccccaatttcacctttcamatttcacagaaaattgaatgcttt

SEQ ID NO: 86533 - DNA, 50 bp, homo sapien
ttcatggaggctgctttgaggcaaartttatgcgttctgtttaacagatg

SEQ ID NO: 86534 - DNA, 50 bp, homo sapien
tacaggttacatgaacttacaagcaygaagcacaaagttcatcgtagaag

SEQ ID NO: 86535 - DNA, 50 bp, homo sapien
agaaattgttaggcttgtatatccayctttgacatctttggtatgtagaa

SEQ ID NO: 86536 - DNA, 50 bp, homo sapien
aatgtcttaagtctttgtggaagtayattggacagaatacattataacaa

SEQ ID NO: 86537 - DNA, 50 bp, homo sapien
catcatctcaaaaagatgcagcagcsgatagatctaacatgacactagcg

SEQ ID NO: 86538 - DNA, 50 bp, homo sapien
aaagggctctagacagctgagaggamctgatcatgtagggagggacgggg

SEQ ID NO: 86539 - DNA, 50 bp, homo sapien
gaggccaggagggtgatgtggaagaygatgggttacagaagacagataaa

SEQ ID NO: 86540 - DNA, 50 bp, homo sapien
ttcttttagctttgacatagattggwccaagtcacatagaattactctag

SEQ ID NO: 86541 - DNA, 50 bp, homo sapien
tagagttcactttggatgtttactaktaatggcgaaaaggatttgaggtt

SEQ ID NO: 86542 - DNA, 50 bp, homo sapien
aaacaccatgatttaagatacattargaatgctcacttagcctatgtgag

SEQ ID NO: 86543 - DNA, 50 bp, homo sapien
accaaagattttattcttgaattgcsaatgttacattttttattttgtca

SEQ ID NO: 86544 - DNA, 50 bp, homo sapien
ggcagacacagttctggcaactgagratacagataatcctcccccacccc

SEQ ID NO: 86545 - DNA, 50 bp, homo sapien
gaacgtgttgatttgcctgactataktaaccatttcacaacatgtatcaa

SEQ ID NO: 86546 - DNA, 50 bp, homo sapien
ctaggtgttggatttcaaaagaaaasttctcttcatttgatcacttggct

SEQ ID NO: 86547 - DNA, 50 bp, homo sapien
gcaaagggtaagtaattctctatgcrgcacattctatactctctatgcct

SEQ ID NO: 86548 - DNA, 50 bp, homo sapien
gcagtagctctagacaatggtaagcratgaagactaaaagttgaaaggtt

SEQ ID NO: 86549 - DNA, 50 bp, homo sapien
ggacatccctgtgcaaagatcaggayggaagcaaggctgtccccagccag

SEQ ID NO: 86550 - DNA, 50 bp, homo sapien
gctcagggttagctccttccagtgaraagtgtagacatttacagacctgg

SEQ ID NO: 86551 - DNA, 50 bp, homo sapien
accaacaattgtttgacctaaaatayagactgagcaaagaggtcttcttc

SEQ ID NO: 86552 - DNA, 50 bp, homo sapien
tggattatcttgtgtttattgatcgyataagggagtgttccacgaaagac

SEQ ID NO: 86553 - DNA, 50 bp, homo sapien
actttgggaaaagccacttggaaaasagaaaagccaataaaactcttaat

SEQ ID NO: 86554 - DNA, 50 bp, homo sapien
tccaaacttaaacatgcagaaaaaarctgtgaatacatacagtgctatag

SEQ ID NO: 86555 - DNA, 50 bp, homo sapien
cattctttctagacagcatgtttgayaggagtgaagtggaagtgagcagg

SEQ ID NO: 86556 - DNA, 50 bp, homo sapien
tcctagaaaaggctaagagtcaacamaactttaaagaactactaacgaat

SEQ ID NO: 86557 - DNA, 50 bp, homo sapien
agtctgggttttatttcgaagttgcrtgtattgtgttaatttgctggtaa

SEQ ID NO: 86558 - DNA, 50 bp, homo sapien
ggggggtgacactaatgagaaaaacrggactactgtgatgaatacaaata

SEQ ID NO: 86559 - DNA, 50 bp, homo sapien
agtgccattctctatcttcagaagtyacaggatatacctaaataggcttt

SEQ ID NO: 86560 - DNA, 50 bp, homo sapien
agaaatatgaagatcttacggccgarcaagtgcagacccacacgcttata

SEQ ID NO: 86561 - DNA, 50 bp, homo sapien
aagagctcttaggcacaaataacagratccactatggctagcttaaacag

SEQ ID NO: 86562 - DNA, 50 bp, homo sapien
tccaaactggttccatgaaaaccaaygctttgtctctgaaatcagaaata

SEQ ID NO: 86563 - DNA, 50 bp, homo sapien
gacatctacatttcttcaagagcacrggatgacataacattgataacaac

SEQ ID NO: 86564 - DNA, 50 bp, homo sapien
gggcatcatgacatgggatcggagayaatttttgaatttgcagacactgt

SEQ ID NO: 86565 - DNA, 50 bp, homo sapien
ggggccattgtcttatttggataaayggcccctgattttgcaaagccaag

SEQ ID NO: 86566 - DNA, 50 bp, homo sapien
caaatttcccattgtctagcctaagyaaagaatggagcatttggattaaa

SEQ ID NO: 86567 - DNA, 50 bp, homo sapien
gacagacattcaagattagagtagcracttaatattttcaaaataactct

SEQ ID NO: 86568 - DNA, 50 bp, homo sapien
aaagttaaatgcagaaataaaactayggccaattctaaggtaagacgtgt

SEQ ID NO: 86569 - DNA, 50 bp, homo sapien
aaaaagaaaaaaccttgcacattgamgctattgttaacaagaaaggaaca

SEQ ID NO: 86570 - DNA, 50 bp, homo sapien
tccactttaaattaatttgtacacaygatacattaattggttttgaatgt

SEQ ID NO: 86571 - DNA, 50 bp, homo sapien
gacatagctttagggacctctcttcraacttgctttgtacattctgagca

SEQ ID NO: 86572 - DNA, 50 bp, homo sapien
gttatgccacttgcttgctcacaacragaacatattacttgtgtggacca

SEQ ID NO: 86573 - DNA, 32 bp, homo sapien
tcttccaagggctcaamgtgtaagcaggctgg

SEQ ID NO: 86574 - DNA, 50 bp, homo sapien
tgtgtggaccaaggattcttagcccsatgtccctgtatagaaattcaggg

SEQ ID NO: 86575 - DNA, 50 bp, homo sapien
ccaccggcaccggagaccagtacagkagtgaacagatgagtagatagaat

SEQ ID NO: 86576 - DNA, 50 bp, homo sapien
cctgaccctgatataagcttttataratcactagctttgacatttccctg

SEQ ID NO: 86577 - DNA, 50 bp, homo sapien
tatggttacttttgggtagaggcaakttagtttcatcatctttcttaaat

SEQ ID NO: 86578 - DNA, 50 bp, homo sapien
cccctacgaactcaatcagtagctayaataaacatatctgtacttgccaa

SEQ ID NO: 86579 - DNA, 50 bp, homo sapien
gaatcactctaagatggtcatgaaawtttcacttggaaaggcatgtggaa

SEQ ID NO: 86580 - DNA, 50 bp, homo sapien
aatttatcttctttcaaagaattagycattgatacaagaagaaagctatc

SEQ ID NO: 86581 - DNA, 50 bp, homo sapien
acacactagcccattttacagattargcattgggaactcagagaggtgaa

SEQ ID NO: 86582 - DNA, 50 bp, homo sapien
ttggaatgttttgtcaatatctcatkaattctgttccttcttttccccct

SEQ ID NO: 86583 - DNA, 50 bp, homo sapien
ttatgtaaacttcaaacatagtaaastaattttggctaagggattcggac

SEQ ID NO: 86584 - DNA, 50 bp, homo sapien
aaaaatttagcaaatgttaaatttaktaaagcccaatggtgataacgatg

SEQ ID NO: 86585 - DNA, 50 bp, homo sapien
attaatattgaccggtagaactaagraaacgtgtcgtaatctagacatgg

SEQ ID NO: 86586 - DNA, 50 bp, homo sapien
ataggcatgactgattaaatcatagrccttaggtgataaactcaatcttc

SEQ ID NO: 86587 - DNA, 50 bp, homo sapien
aaccttgagagtcgacagttttacasaacattctgaatcttattcttgcc

SEQ ID NO: 86588 - DNA, 50 bp, homo sapien
aagcaaggggttggactggatgaaaytgaaggtcacggctaaccttgaga

SEQ ID NO: 86589 - DNA, 50 bp, homo sapien
aagtaatgtacggtttataacaacayacacagaaataaaatatagaacaa

SEQ ID NO: 86590 - DNA, 50 bp, homo sapien
tctaacttgggtccacatttctttcrctaagttatcacatgggcattcct

SEQ ID NO: 86591 - DNA, 50 bp, homo sapien
cttcctgaatcctactaaaatgggayaaggactgacccagggcctgagac

SEQ ID NO: 86592 - DNA, 50 bp, homo sapien
gatattaggcgtacagaaaacatgargggattctatagtgaaaaatacag

SEQ ID NO: 86593 - DNA, 50 bp, homo sapien
tgccagattaaattatccattgaccratttatgtcattaaacttaaatgc

SEQ ID NO: 86594 - DNA, 50 bp, homo sapien
ttttttcagggactttatcacagagsctctcaaaggatgttgtggaacac

SEQ ID NO: 86595 - DNA, 50 bp, homo sapien
ggttttaataattcatttccagagamaattgagtcaaccctgaggaactg

SEQ ID NO: 86596 - DNA, 50 bp, homo sapien
catctgctcaatagcataacaatacyagtcaacattaaatgttataataa

SEQ ID NO: 86597 - DNA, 50 bp, homo sapien
aatagctctaaagtaattaagctacsctgacaatagttattcattagttt

SEQ ID NO: 86598 - DNA, 50 bp, homo sapien
acaagctaataagttactgatataarggtcccaaggtgcttggaggggcc

SEQ ID NO: 86599 - DNA, 50 bp, homo sapien
caatagttattcattagtttgccaayattttatacgtatactaagtaaca

SEQ ID NO: 86600 - DNA, 50 bp, homo sapien
tgccaatattttatacgtatactaartaacagccccagtgctggagagtg

SEQ ID NO: 86601 - DNA, 50 bp, homo sapien
gtgatgatcagcacgcagggtttatygtatcgtgaacatctaaatgttat

SEQ ID NO: 86602 - DNA, 50 bp, homo sapien
gttgtttataaggaagttgcaaatayacaagaaagcctatatactataaa

SEQ ID NO: 86603 - DNA, 50 bp, homo sapien
aaaggtgctccctttataacttccaygttgaactaggcccacaaagcata

SEQ ID NO: 86604 - DNA, 50 bp, homo sapien
tctaatgttctctcatgattagatcragattagacattattgggaaagat

SEQ ID NO: 86605 - DNA, 50 bp, homo sapien
aagaacattataatgtttatttagcyattcttatctcctcccttcagatc

SEQ ID NO: 86606 - DNA, 50 bp, homo sapien
tttatctttatctggaagacaagtcraaatactactacactgaaatctaa

SEQ ID NO: 86607 - DNA, 50 bp, homo sapien
actgagaatgttatttacattacacrttgcggtgccatagggcctgtcat

SEQ ID NO: 86608 - DNA, 50 bp, homo sapien
tgaaaattgggccttttgcagaaaayaattggccaagttatgaatgcaaa

SEQ ID NO: 86609 - DNA, 50 bp, homo sapien
tatgaaccccacattggctaggaaartgaatatttactttgagaaaatca

SEQ ID NO: 86610 - DNA, 50 bp, homo sapien
agagagcacaaggcaccttgggtaastgttccatccaactgtattcaatg

SEQ ID NO: 86611 - DNA, 50 bp, homo sapien
caagagcaaggattttagggttatasataaagcagggatcagaactgggc

SEQ ID NO: 86612 - DNA, 50 bp, homo sapien
acatataactctgccataataaagaygctcatgtttccatttgttgcctt

SEQ ID NO: 86613 - DNA, 50 bp, homo sapien
tctgagcacatcggcttccttgacaktgaccaggttgctggggcaaaaac

SEQ ID NO: 86614 - DNA, 50 bp, homo sapien
actaaggaattccaaaggactacccrgaaattcacatcgaagactagaag

SEQ ID NO: 86615 - DNA, 50 bp, homo sapien
atcatttttccataacagaccttggrattcttagagagtgagtaggtgct

SEQ ID NO: 86616 - DNA, 50 bp, homo sapien
cacaagcagatccgaagtatcctgtraaaaaacacatgagagcttaaaaa

SEQ ID NO: 86617 - DNA, 50 bp, homo sapien
taaaaagaaacttcttatttacaagygattagtttgctgtgaattaagtt

SEQ ID NO: 86618 - DNA, 50 bp, homo sapien
cagtgacttacagtaaattgataaawatgcttagcctgtgatgagattaa

SEQ ID NO: 86619 - DNA, 50 bp, homo sapien
actaccaccactagcagtataacaaygatgttcttagcaaccaaggattc

SEQ ID NO: 86620 - DNA, 50 bp, homo sapien
cttctttacctaaacagcgagccacrcctggatcacagtagcacttgaat

SEQ ID NO: 86621 - DNA, 50 bp, homo sapien
aagctccctgaatgacacgggactcygccatcaagcgtggcatggggagt

SEQ ID NO: 86622 - DNA, 50 bp, homo sapien
ttgcctgctacatctatcccaaaaaygtatcaatcaggctcttaaagaac

SEQ ID NO: 86623 - DNA, 50 bp, homo sapien
aatgctcccaggggattctactgtasagcaagttgagaaccacttgtaag

SEQ ID NO: 86624 - DNA, 50 bp, homo sapien
caaacattttatttgtgatgagttcmcgatcgcggaggccctcaaggaat

SEQ ID NO: 86625 - DNA, 50 bp, homo sapien
acagcctaaggaaaaaggacaccaartgaaaatggtcatcaagattctga

SEQ ID NO: 86626 - DNA, 50 bp, homo sapien
gaacttattcctgccattctgttaamatttctctggttgttttgttgatc

SEQ ID NO: 86627 - DNA, 50 bp, homo sapien
cagcaggccagccttaccagggcaartgtctgaggccagtgggacctcta

SEQ ID NO: 86628 - DNA, 50 bp, homo sapien
ggctgtcaatgtgattagcagaaagwaatgtgagacacatgactggtaaa

SEQ ID NO: 86629 - DNA, 50 bp, homo sapien
ttttcctcttaagtagtaaaaaggtsaatcattggaaagatctcggagag

SEQ ID NO: 86630 - DNA, 50 bp, homo sapien
cactggagtttcttgggaagcaatcrccttgttacaacaccacagacaac

SEQ ID NO: 86631 - DNA, 50 bp, homo sapien
gctgatcaagaaaaagccttggaacyaagtgatacaaaagtccttgggta

SEQ ID NO: 86632 - DNA, 50 bp, homo sapien
gcagaagcatcttagtaactcatgamagtgcccttccacatggactcaga

SEQ ID NO: 86633 - DNA, 50 bp, homo sapien
caggattcatgggggtaattcgccasgtaactgctctatttgggcaactg

SEQ ID NO: 86634 - DNA, 50 bp, homo sapien
actttgggtgatcatgatgtattgaygtaggtttatctattgtaacaaat

SEQ ID NO: 86635 - DNA, 50 bp, homo sapien
cttacctctctccaattcttatccayagggtcaccaactttatctacacc

SEQ ID NO: 86636 - DNA, 50 bp, homo sapien
gtcttcaagcattgcctcagggacaygccaagggaacggaaaccagtccc

SEQ ID NO: 86637 - DNA, 50 bp, homo sapien
tggactgatgacaatgatggtcaacrcttaggctggacctgccacgtgcc

SEQ ID NO: 86638 - DNA, 50 bp, homo sapien
gaggtctgcctatacccttaaagacyctttctgctccaagattcttggat

SEQ ID NO: 86639 - DNA, 50 bp, homo sapien
tcaatgatgatattcctatgcttaayatggatgagtatggatttcagggg

SEQ ID NO: 86640 - DNA, 50 bp, homo sapien
actttggttcaactaccaccttgaakattttgtcttggtggaactggatg

SEQ ID NO: 86641 - DNA, 50 bp, homo sapien
cttcaaggaaatttcattaaaaggcrgacttcaaggcactggtgggttat

SEQ ID NO: 86642 - DNA, 32 bp, homo sapien
ccctcaactgaccagayaatggccagaaattg

SEQ ID NO: 86643 - DNA, 50 bp, homo sapien
atcccacattcatttctatatccacragaaatgcacatgtagaagctttt

SEQ ID NO: 86644 - DNA, 50 bp, homo sapien
ctgcttgttgtgccatttgtcttgcratttcccccagggaggtggcatca

SEQ ID NO: 86645 - DNA, 50 bp, homo sapien
atacttgcaatttacaaatactattwaaaaaatgaacatgaaaccaacat

SEQ ID NO: 86646 - DNA, 50 bp, homo sapien
ggaaaagaaatgagtttggcaggacraatgttcccctgacaagtctgagg

SEQ ID NO: 86647 - DNA, 50 bp, homo sapien
tagaaagtaataaaaaatgtacttcyctaacattctaagaaatctaatat

SEQ ID NO: 86648 - DNA, 50 bp, homo sapien
catgttattgtgctgatggacctcartagtgccagatgacttgtgtggcg

SEQ ID NO: 86649 - DNA, 50 bp, homo sapien
ttcaggttttgttaactggttggagwcagactggagaatttcatttctat

SEQ ID NO: 86650 - DNA, 50 bp, homo sapien
gccacatctgccccagttggtacatraacagtctttttttattcactact

SEQ ID NO: 86651 - DNA, 50 bp, homo sapien
atatatattaagtccaactttgaacrataaggaataggaccgtgagtcct

SEQ ID NO: 86652 - DNA, 50 bp, homo sapien
acacttctctactgccgaattttccygaatgtgacttagccaccagggag

SEQ ID NO: 86653 - DNA, 50 bp, homo sapien
tgcaattacttgaaaagagaatttaygatgaccaaaactttgcagtagca

SEQ ID NO: 86654 - DNA, 50 bp, homo sapien
aagaaaaaaagaaaaagataagtatmagctaacatttatttcactgcatt

SEQ ID NO: 86655 - DNA, 50 bp, homo sapien
ataaaaataaaaaaagcacattcaarttaaagagaaaacctaacattcct

SEQ ID NO: 86656 - DNA, 50 bp, homo sapien
gtgtttgttgtcatagtattcctcakgcttttcatatactttacaaatag

SEQ ID NO: 86657 - DNA, 50 bp, homo sapien
aggcaagcataggtacctttctaaarcctatcagaatggctaaagtaaaa

SEQ ID NO: 86658 - DNA, 50 bp, homo sapien
ttttattcttcttaagacatggtaargttgcctgtgacattgggctaact

SEQ ID NO: 86659 - DNA, 50 bp, homo sapien
tgattcagtatttggatctacttagyattttgcctacctcgtccttgact

SEQ ID NO: 86660 - DNA, 50 bp, homo sapien
cctgtctctttattttccttgtatayatatcttgtgcagacattactgaa

SEQ ID NO: 86661 - DNA, 50 bp, homo sapien
tcagtgtttttcagaagctaaaaagmagtataatagatgtaccagcaatt

SEQ ID NO: 86662 - DNA, 50 bp, homo sapien
ttcttgaactggtattaatgtacaargaaggtccagaagatattttagtt

SEQ ID NO: 86663 - DNA, 50 bp, homo sapien
tgacatctttgcctatataggaaaaycattgtgtgaactgtcatgaaact

SEQ ID NO: 86664 - DNA, 50 bp, homo sapien
cacctctcttctgtttataagagcamagattatgaaggtctgaaaccaca

SEQ ID NO: 86665 - DNA, 50 bp, homo sapien
tgaggagaactgggagtgattaaaaktatgtctaggtacatggttctata

SEQ ID NO: 86666 - DNA, 50 bp, homo sapien
agaccttgtttgagttcttgtctgaratatactggtcacctaagtgcata

SEQ ID NO: 86667 - DNA, 50 bp, homo sapien
agtacaatatatgtataagcaataaycgaggaatacaaaattaacaaaag

SEQ ID NO: 86668 - DNA, 50 bp, homo sapien
actatgtacttttaatacgatttcasctccttgatgtgttctagaggatt

SEQ ID NO: 86669 - DNA, 50 bp, homo sapien
attctttgaccttagtcttataatamctaatggatacagcatcacgttgc

SEQ ID NO: 86670 - DNA, 50 bp, homo sapien
taacatatttagttgtttccttccamaagagaaatgaaaacatgtcaact

SEQ ID NO: 86671 - DNA, 50 bp, homo sapien
atgcttagaatcaagatgattagcawggtacaaaagggtctcagaccact

SEQ ID NO: 86672 - DNA, 50 bp, homo sapien
gtagattgttcatttccattgctgcrgagagactactcagtggattcaag

SEQ ID NO: 86673 - DNA, 50 bp, homo sapien
agtaaccatgacctaactaactggayggctgttttctgaagtggatagtt

SEQ ID NO: 86674 - DNA, 50 bp, homo sapien
gctatgtgatatgcttttgaaaccaytaaaatcattgaggagaagacaga

SEQ ID NO: 86675 - DNA, 50 bp, homo sapien
ttaaaattacctctctccttcactcwttgtatgttacctttgcttagatg

SEQ ID NO: 86676 - DNA, 50 bp, homo sapien
agaggacactttcagctaaatagagrcgttgcaggagaccccaaggaaat

SEQ ID NO: 86677 - DNA, 50 bp, homo sapien
tatgtagatgttttcatcctcacacmgtgaaaaagtccccagtagcatgg

SEQ ID NO: 86678 - DNA, 50 bp, homo sapien
gttaactcctatttcataaccttagkaattgtttctagttcacggtgttg

SEQ ID NO: 86679 - DNA, 50 bp, homo sapien
gaaggtgatccctggataactctctrtaactccttcaagtggttggaaga

SEQ ID NO: 86680 - DNA, 50 bp, homo sapien
taatgaagaagactaattcacaatargagttccattttctttctgtcatt

SEQ ID NO: 86681 - DNA, 50 bp, homo sapien
cttttctttttcttaatctctcaaaygaatagatatgcaacacatacaca

SEQ ID NO: 86682 - DNA, 50 bp, homo sapien
cttcatttcgacatatcaccctatgraggtaatctattgttcactttatt

SEQ ID NO: 86683 - DNA, 50 bp, homo sapien
cacatctaatatgtcgtattagagaycctgaatccaaacaaagccaagct

SEQ ID NO: 86684 - DNA, 50 bp, homo sapien
gagagtaatgcaactggtgccaaaaygatgaatattctaagaccccaaag

SEQ ID NO: 86685 - DNA, 50 bp, homo sapien
aatgtaatgggtatgtcacattcaarggcaaaaagagttacttcttttgt

SEQ ID NO: 86686 - DNA, 50 bp, homo sapien
ctttcttaaagattgctccttataayaaaatgaccaaaaaagccaacaaa

SEQ ID NO: 86687 - DNA, 50 bp, homo sapien
actaaccatagccctattaattttcrcaaaataagcaacaaacctcttca

SEQ ID NO: 86688 - DNA, 50 bp, homo sapien
acttttccttttggcttcaattcgayggttagttattcagccttattgtt

SEQ ID NO: 86689 - DNA, 50 bp, homo sapien
taacttcccttaattatgccaaagcyctgcaagttagtctagagtattct

SEQ ID NO: 86690 - DNA, 50 bp, homo sapien
ggatttaatcatagcaaataatatcyaggacactatgaattaagcatgta

SEQ ID NO: 86691 - DNA, 50 bp, homo sapien
tccaaacaacaacatacagttttaargtgccttgttatttatatggatat

SEQ ID NO: 86692 - DNA, 50 bp, homo sapien
taaaatcttgttacagtgcaagaaayggcagtcatcaaactaagatgagg

SEQ ID NO: 86693 - DNA, 50 bp, homo sapien
accaaacattccagctgcgtaaaatsatctctgtatttaatctctcttgt

SEQ ID NO: 86694 - DNA, 50 bp, homo sapien
aagagctatctctttgtgatttcccragggtgactacgccaataagctat

SEQ ID NO: 86695 - DNA, 50 bp, homo sapien
tatgtgtttgtttattttctcacaaktaaagataggtcagatgttgccaa

SEQ ID NO: 86696 - DNA, 50 bp, homo sapien
gctttcaaaataggtcagcttgatarcttattggcgtagtcacccttggg

SEQ ID NO: 86697 - DNA, 50 bp, homo sapien
ctgtccagctttccagtaatactcayaacattgccttgatttcatatgac

SEQ ID NO: 86698 - DNA, 50 bp, homo sapien
cacagtgaaaaagtccccagtagcayggcaatcaaatattccaccagaca

SEQ ID NO: 86699 - DNA, 50 bp, homo sapien
caaataattcaacaataaatattctsacctttccaccaccaaagaccctt

SEQ ID NO: 86700 - DNA, 50 bp, homo sapien
ataaacaagaacatctataaactcaycctttctataatcataaatttcaa

SEQ ID NO: 86701 - DNA, 50 bp, homo sapien
atagccagagaggctggaattcaaasttaagcagcattacaccataaaag

SEQ ID NO: 86702 - DNA, 50 bp, homo sapien
actgtagcacaaaggcatagtcacartgatctaaactttcatttaagttc

SEQ ID NO: 86703 - DNA, 50 bp, homo sapien
gcccaatttccttgttttgtacatargagaattgaagtgtgatgaagaaa

SEQ ID NO: 86704 - DNA, 50 bp, homo sapien
ctaacataatgttaatgttgtcatcraacacagttcatagggatgttggt

SEQ ID NO: 86705 - DNA, 50 bp, homo sapien
gctcactttgaggcctggtgatcgayggaatggtcttgccaagctgagga

SEQ ID NO: 86706 - DNA, 50 bp, homo sapien
atttctagaaaaacagacactcatcmagtaaactacaggtataccttgga

SEQ ID NO: 86707 - DNA, 50 bp, homo sapien
tttaatgactcgttcaagcttgatayctatcataaatacacaggacagag

SEQ ID NO: 86708 - DNA, 50 bp, homo sapien
aatggatgttaaaggtgtttaataayagtggaaggaatgtaaagttaagt

SEQ ID NO: 86709 - DNA, 50 bp, homo sapien
acctggtgatactgaaagatgagtcmaatagtgtaatacaatagggcaat

SEQ ID NO: 86710 - DNA, 50 bp, homo sapien
aggtattcagtaaatggatacttacyatgacaggatctaaccactggtga

SEQ ID NO: 86711 - DNA, 50 bp, homo sapien
tgcacagccactgaagagtcagctcrctttaagttctcaaagaatttttc

SEQ ID NO: 86712 - DNA, 50 bp, homo sapien
gaactcatcaattacgtcaaactcaracataggtttcaaaaccaggactt

SEQ ID NO: 86713 - DNA, 50 bp, homo sapien
gataccaaggtatggtgcctcacacmaagtaggaattctgtacctatggg

SEQ ID NO: 86714 - DNA, 50 bp, homo sapien
aacataaaacctatgagcatagtaaygttatcaatctgaagcatttctag

SEQ ID NO: 86715 - DNA, 50 bp, homo sapien
ttaagcttcataatgggaaatattarctatagaactgagcactggatgca

SEQ ID NO: 86716 - DNA, 50 bp, homo sapien
aaatttggatgttactataattgtastgaggaatcattgcagatttttaa

SEQ ID NO: 86717 - DNA, 50 bp, homo sapien
gcttgaggcttgggcttatctaggargagacccattaatattgcttcagt

SEQ ID NO: 86718 - DNA, 50 bp, homo sapien
ttctcattttttgtacactaatctaygcatgaattccaacataatttatc

SEQ ID NO: 86719 - DNA, 50 bp, homo sapien
ctgtgacaagtcacttaaaggaaaayttattcaacttaaaatatctttct

SEQ ID NO: 86720 - DNA, 50 bp, homo sapien
atgactactactatggctttggctgyaataagttctgccgccccagagat

SEQ ID NO: 86721 - DNA, 50 bp, homo sapien
aaaagataacctagttctgtacaaayttagctcactaaaccagaaagaac

SEQ ID NO: 86722 - DNA, 50 bp, homo sapien
ggggattcagtattgaaccaagagaytaatgagtaaggtaggtgatatgg

SEQ ID NO: 86723 - DNA, 50 bp, homo sapien
catctaaggtaatattcactctttgrcatgtagggcaaaattcgcaggga

SEQ ID NO: 86724 - DNA, 50 bp, homo sapien
gtgccataattccatactttttaaayattagacagtttcaaaaaaatccc

SEQ ID NO: 86725 - DNA, 50 bp, homo sapien
gggaaaccagtgggatggtggtgccrttagtcaggatgacagacataaag

SEQ ID NO: 86726 - DNA, 50 bp, homo sapien
aaatatgcctaagttccattattcawtaaggtcacagcagcaattctgat

SEQ ID NO: 86727 - DNA, 50 bp, homo sapien
gcaacagctgaggtttcttacagtcycaagagaaccatttttaaaactca

SEQ ID NO: 86728 - DNA, 50 bp, homo sapien
atcagcctttgttagagacctggtakaaacaagcaatatttagagaaata

SEQ ID NO: 86729 - DNA, 50 bp, homo sapien
tctcttattgggacaggcttaaatamatgcaagaacttcattaagtcatt

SEQ ID NO: 86730 - DNA, 50 bp, homo sapien
agatatagacaatattgaaaagcagrttccaaagttatcttgcaaaggca

SEQ ID NO: 86731 - DNA, 50 bp, homo sapien
gatacatgttaaaggctattgccaaygtttccagagctttcaacccatcc

SEQ ID NO: 86732 - DNA, 50 bp, homo sapien
gttccctcctattcaatgtctattayaaaaaatgcagcattggataatga

SEQ ID NO: 86733 - DNA, 50 bp, homo sapien
gtttatgtactgtcatttacttggarattatcactttgcgtatttcagat

SEQ ID NO: 86734 - DNA, 50 bp, homo sapien
ttattaacttctttaatgacaaaaawtatgggtctaatacagattttcaa

SEQ ID NO: 86735 - DNA, 50 bp, homo sapien
aaaaagtaatttcatttcttatagcyacagacaaaattaaatacctagga

SEQ ID NO: 86736 - DNA, 50 bp, homo sapien
aaaacagctggaacctccacagttayggatgaaggaggaacaaattgtta

SEQ ID NO: 86737 - DNA, 50 bp, homo sapien
atcctattggtaccagccagtataarcctctattacctctcaaatatcta

SEQ ID NO: 86738 - DNA, 50 bp, homo sapien
caggtgacagagagggagaggaaaargagatgtatttaaagaaatggcag

SEQ ID NO: 86739 - DNA, 50 bp, homo sapien
agtaaaaagtacagcttgaactatargagcaaaaagggtatgggcattaa

SEQ ID NO: 86740 - DNA, 50 bp, homo sapien
aaaagaagagtttaagtacatttgaytaatatctcataagaaacagaatt

SEQ ID NO: 86741 - DNA, 50 bp, homo sapien
tgcgcagtttgctgagcatccatackataatgttccataaggcatttcta

SEQ ID NO: 86742 - DNA, 50 bp, homo sapien
aaaataatatatacaaacctggaatsaaaaagagaaaacatgaataacag

SEQ ID NO: 86743 - DNA, 50 bp, homo sapien
tttacccttctaaaaggcatatttgyatctctaaaggaatcttcacgtct

SEQ ID NO: 86744 - DNA, 50 bp, homo sapien
atgttctcattacatcccatcaaaasataaaggtcagtttgttccattgt

SEQ ID NO: 86745 - DNA, 50 bp, homo sapien
gtgcaagctcttgatcaatcatataycattttagtcttcatatgccagtg

SEQ ID NO: 86746 - DNA, 50 bp, homo sapien
cagcccctgatactgaccctacaaascggtcaaatgtgttctccagtcgt

SEQ ID NO: 86747 - DNA, 50 bp, homo sapien
ataaagcatctttggtttaatggagyccttctaacaaatgatactgtgga

SEQ ID NO: 86748 - DNA, 50 bp, homo sapien
tgcttctacctgaatagaggtaataygcctttttctccaagactgacccc

SEQ ID NO: 86749 - DNA, 50 bp, homo sapien
atctcatgcctctgtttgctcattcraaaaaataaaatgattgcacagtg

SEQ ID NO: 86750 - DNA, 50 bp, homo sapien
acggttaattctcagagttcacgtamaatcatgcttttcatttgtagacc

SEQ ID NO: 86751 - DNA, 50 bp, homo sapien
accacactaggctatactggctatayggactattttaaatgatcaagtat

SEQ ID NO: 86752 - DNA, 50 bp, homo sapien
aagagtgaaattggaatgttcctaaygtaaagaaataataaatgcttgat

SEQ ID NO: 86753 - DNA, 50 bp, homo sapien
cttatcctgtcttcctttctgatctkatcttgtgctgctcctctttgcct

SEQ ID NO: 86754 - DNA, 50 bp, homo sapien
catgggctgtatgattttaggctatkcatttaaatctctctgggcatcta

SEQ ID NO: 86755 - DNA, 50 bp, homo sapien
caattttgctttctaatttaccctaygagaagaaacccagccaagcctaa

SEQ ID NO: 86756 - DNA, 50 bp, homo sapien
gaaacagctttatcaagtagaatacrgtacttatgtgcagttcttttcac

SEQ ID NO: 86757 - DNA, 50 bp, homo sapien
gccaatgggttgcctgagtaggagaytggaaggaaggagaagagtattgc

SEQ ID NO: 86758 - DNA, 50 bp, homo sapien
aagaatgggccagctgtggacttgawctaccagtgatgctttaggcagaa

SEQ ID NO: 86759 - DNA, 50 bp, homo sapien
tacattattaatcatgttggccaaaragaagcctgtttatatatttgcaa

SEQ ID NO: 86760 - DNA, 50 bp, homo sapien
tctcctcagaatacatcttatttagraaaaaatcttatacattattaatc

SEQ ID NO: 86761 - DNA, 50 bp, homo sapien
gccttattgctgtaattttgcctacrgtaatacagtagtaaattagacat

SEQ ID NO: 86762 - DNA, 50 bp, homo sapien
acctggtgcaatgctgactggtagtracatttggtcaatgttggatgatc

SEQ ID NO: 86763 - DNA, 50 bp, homo sapien
ttcagaagtgtgtctatgggaactgmaaaaaaatatgagagacaaggata

SEQ ID NO: 86764 - DNA, 50 bp, homo sapien
aatgctgccgacgtcccatgacacasctattgatatgtggcaaggagcca

SEQ ID NO: 86765 - DNA, 50 bp, homo sapien
ctggatcccctaaaataatttgacargctatcaataggtatataaaaaaa

SEQ ID NO: 86766 - DNA, 50 bp, homo sapien
agctttccttcaaaacagtgtacaayatttccctttctaataaaagcccc

SEQ ID NO: 86767 - DNA, 50 bp, homo sapien
gccaggtccattactaaggggtgccraggggcaagaattacacaaggtaa

SEQ ID NO: 86768 - DNA, 50 bp, homo sapien
gcatatcctagaccttggctttgaayatccagagttctttttctctttaa

SEQ ID NO: 86769 - DNA, 50 bp, homo sapien
aggcttaaagaatataggataacaargaactattactctcctgaaaaaat

SEQ ID NO: 86770 - DNA, 50 bp, homo sapien
ggggagattttgagttgtcaagaaargaagaactctgaacttttggcaca

SEQ ID NO: 86771 - DNA, 50 bp, homo sapien
acaaatcttgagtttagatagaaatsattcaaataccagtcctatcaaat

SEQ ID NO: 86772 - DNA, 50 bp, homo sapien
attatgccaaattagctgccagttayctggattcaaaactcagtcataag

SEQ ID NO: 86773 - DNA, 50 bp, homo sapien
gccacgcatttcatctcttcctaaasaactacttatacatacatcaggga

SEQ ID NO: 86774 - DNA, 50 bp, homo sapien
ctcctgatattttcaggttctccaaygattatatacacatatatatagat

SEQ ID NO: 86775 - DNA, 50 bp, homo sapien
gacactggagtaagacctaaaaacaycaaagaatctcctacttgaaacaa

SEQ ID NO: 86776 - DNA, 50 bp, homo sapien
aaaaaatgtatccaaactttgtcatraatacattagtttactttttaact

SEQ ID NO: 86777 - DNA, 50 bp, homo sapien
atatggttttacctttcatttcttasaacatttcaggccagtagtatgta

SEQ ID NO: 86778 - DNA, 50 bp, homo sapien
gatttgctaattgagccctcacataygaaaagaattagactactcctcac

SEQ ID NO: 86779 - DNA, 50 bp, homo sapien
tgtctgttttacagggtttcttttgkatatcaaattaatataaaagacat

SEQ ID NO: 86780 - DNA, 50 bp, homo sapien
ggctggcgtagtccaaaaaatagagycaataggtacctgggttccctggt

SEQ ID NO: 86781 - DNA, 50 bp, homo sapien
tcattttactctaggttctttgatarcacttcttgaaatttagatcatca

SEQ ID NO: 86782 - DNA, 50 bp, homo sapien
ctcttttcttactaatacttgctggkatcatctacatgggatggaatcag

SEQ ID NO: 86783 - DNA, 50 bp, homo sapien
attacacctctcccactaattctagkaaatcctattgttgaatatactct

SEQ ID NO: 86784 - DNA, 50 bp, homo sapien
gggtcagcttcagaagatgttcaaaygtgaagcaattttgatttcctttc

SEQ ID NO: 86785 - DNA, 50 bp, homo sapien
tgtatagtggcatatagcatgcattyaatacctagtaaatattttattac

SEQ ID NO: 86786 - DNA, 50 bp, homo sapien
cacatggcatggacaagagtataaaraggaaaaagtagaccacctaggac

SEQ ID NO: 86787 - DNA, 50 bp, homo sapien
cttctagacttatgaaaggctttgayggccacacattaatagtgggggac

SEQ ID NO: 86788 - DNA, 50 bp, homo sapien
tcaacatttgaccaattggctctaayatacatctacagaacactccaccc

SEQ ID NO: 86789 - DNA, 50 bp, homo sapien
agagtcaggcaaaagttcccaacaamcttctaaatctataatcaatccaa

SEQ ID NO: 86790 - DNA, 50 bp, homo sapien
aaagatactgtgctaacttcctggaratatgaactatattattgacttta

SEQ ID NO: 86791 - DNA, 50 bp, homo sapien
ttagtttttttaccttgcattgtagyagttttgcaagccccatcttttgt

SEQ ID NO: 86792 - DNA, 50 bp, homo sapien
ttaaactaaaaacaaattcaaatgaygtacttgctgccacaaaaactgga

SEQ ID NO: 86793 - DNA, 50 bp, homo sapien
aggatggtgtatttgcgtggcaggayattgggtacagctttagcagtgaa

SEQ ID NO: 86794 - DNA, 50 bp, homo sapien
cacctctggacaaatatacaagaaarttgactgatattacctgcagagaa

SEQ ID NO: 86795 - DNA, 50 bp, homo sapien
cctctaggcaaatctggtgtatagaygtttactcatagattatttacaag

SEQ ID NO: 86796 - DNA, 50 bp, homo sapien
agagcaattaagttttaaatgattcsaatgagtctaggaatgtaaatctt

SEQ ID NO: 86797 - DNA, 50 bp, homo sapien
ggaatattattcaactattaaaaaarttaagtaatgacactgccaccata

SEQ ID NO: 86798 - DNA, 50 bp, homo sapien
taaacccaagtgaattgaaaacatayatctacaggaaaatttgtacataa

SEQ ID NO: 86799 - DNA, 50 bp, homo sapien
agttaagttgaattttgagatcctgracatggccccatctgaaatatttt

SEQ ID NO: 86800 - DNA, 50 bp, homo sapien
ctatctatttggatcacgctcatttkttcaaagcacagcagccatttgct

SEQ ID NO: 86801 - DNA, 50 bp, homo sapien
aggttggctccatggaattaactgaygtcccttcagtgttctagatcctt

SEQ ID NO: 86802 - DNA, 50 bp, homo sapien
catgttttctagcaatgagatattcrattcagtccttgagtgtatgtggg

SEQ ID NO: 86803 - DNA, 50 bp, homo sapien
cagttaacttctactcatcctctaaytctcaaactcatcgtcagtttctc

SEQ ID NO: 86804 - DNA, 50 bp, homo sapien
ggtcatggattaaattattaagttgraactgtcagagtgaaggagcaagt

SEQ ID NO: 86805 - DNA, 50 bp, homo sapien
aaactttatctcagtacctggcacayagatattgaatgaatggtacccac

SEQ ID NO: 86806 - DNA, 50 bp, homo sapien
ctcatggaccatatcattggctaggmatagatcttcaggaacactgccac

SEQ ID NO: 86807 - DNA, 50 bp, homo sapien
tggatatccaaacagagaatatgcamctccttattaataagccacttttt

SEQ ID NO: 86808 - DNA, 50 bp, homo sapien
agaaaagacaaaatgaggacatgtcraaatcacaatttaatgctttgctc

SEQ ID NO: 86809 - DNA, 50 bp, homo sapien
gccatggaatacatgaaataactacmagtaaatcactcataatgaacgga

SEQ ID NO: 86810 - DNA, 50 bp, homo sapien
tgttggtaacttgaaataagacacartgggaatatttacttcattgaaag

SEQ ID NO: 86811 - DNA, 50 bp, homo sapien
aggcagtaaaataatgataaaataartgttggtactctaaaatagaaata

SEQ ID NO: 86812 - DNA, 50 bp, homo sapien
tttgcagctctgtagcattctgcaasattttttttaatctagaagaattt

SEQ ID NO: 86813 - DNA, 50 bp, homo sapien
ttttggtaggcatactgtgtagatamcattaggtccctttctcagtgtat

SEQ ID NO: 86814 - DNA, 50 bp, homo sapien
aaccttaactcaaatcaaatgtcccraagttatctataagtttagatatt

SEQ ID NO: 86815 - DNA, 50 bp, homo sapien
aaggattaccttgcctgttatatagmgcaatcatgaatcatctcctgtgg

SEQ ID NO: 86816 - DNA, 50 bp, homo sapien
ggctgttcttccaagggaaaaaaaakagcaagtctaatgaggagagtgtg

SEQ ID NO: 86817 - DNA, 50 bp, homo sapien
aagggcaatgttctatctttttaccraggtgaggaatgcaaggctattca

SEQ ID NO: 86818 - DNA, 50 bp, homo sapien
ataatagaatatcataacataatcartttagatgcagacatgcaaagatg

SEQ ID NO: 86819 - DNA, 50 bp, homo sapien
ccttttatgcactgctataggtaaakggacatactaatttgtgaagctgt

SEQ ID NO: 86820 - DNA, 50 bp, homo sapien
ttctggctgaactacattagaataaytgagctttcatcaagtagttattt

SEQ ID NO: 86821 - DNA, 50 bp, homo sapien
atcatccaaacaagagcttaaaagarcctggcctgtaggtgtcatggcat

SEQ ID NO: 86822 - DNA, 50 bp, homo sapien
agtgtacaacatgcctggattgcctracctgaaaggcaaggaagctggag

SEQ ID NO: 86823 - DNA, 50 bp, homo sapien
atttttcacattaacaatagcacgartagctaaaaatatagtttaagtca

SEQ ID NO: 86824 - DNA, 50 bp, homo sapien
aagtgatcatagctaagtttttgcasacaccaaaagtatgtataggctac

SEQ ID NO: 86825 - DNA, 50 bp, homo sapien
ggagttagaagatgtggattgtacaygctttcctggagactaacatctaa

SEQ ID NO: 86826 - DNA, 50 bp, homo sapien
aatttaaaacatagaaggttacctayatcattgccttgacctatatattc

SEQ ID NO: 86827 - DNA, 50 bp, homo sapien
atgatgaaagcacggcaacgattaartctggtttcttggtctttcttggc

SEQ ID NO: 86828 - DNA, 50 bp, homo sapien
ggactaatcatatacctagattcaarcagaacaattaagtaacatgttaa

SEQ ID NO: 86829 - DNA, 50 bp, homo sapien
aatagtttccaaatgtttaatgtcaratccaacaatcttacacacagaaa

SEQ ID NO: 86830 - DNA, 50 bp, homo sapien
ctatgagacaatatcaagcagtctamcatacctaaaattggagcctgtat

SEQ ID NO: 86831 - DNA, 50 bp, homo sapien
ataaccagaagaaaaaaaaatctgcsaatagaaatagtaaaaataaagat

SEQ ID NO: 86832 - DNA, 50 bp, homo sapien
ttcttctagaaagagacaaaaaaaamgaacgacagcacaacagttttatc

SEQ ID NO: 86833 - DNA, 50 bp, homo sapien
gtggaatttcccagccctaggcataycaaaagatcctttgagctttgaag

SEQ ID NO: 86834 - DNA, 50 bp, homo sapien
agagaggtgttcagagaaaaaccttsgatttatgtccatttcaactattt

SEQ ID NO: 86835 - DNA, 50 bp, homo sapien
ccccatgtcataacatgcatgccagragacctaaataatctgagttttgt

SEQ ID NO: 86836 - DNA, 50 bp, homo sapien
gttgtaaacagatgtgctgccattcrgactgttgttttatttatagagca

SEQ ID NO: 86837 - DNA, 50 bp, homo sapien
taggcagcttcaaagacatctgttaygattaaagaatgatcaagaaagtg

SEQ ID NO: 86838 - DNA, 50 bp, homo sapien
aaccaagcagaactcaccaatagaaygtctttgagctagtgttctcaaac

SEQ ID NO: 86839 - DNA, 50 bp, homo sapien
gaaaatatcttagactgcctttagasgtttatgtaaataatgtaaatgat

SEQ ID NO: 86840 - DNA, 50 bp, homo sapien
cagcaaacagtagaatcaaatacacwctccatgaaatacatccaacatga

SEQ ID NO: 86841 - DNA, 50 bp, homo sapien
aacaaacaaacaaaaccaccagagarcaaggctgataggggtccaagtct

SEQ ID NO: 86842 - DNA, 50 bp, homo sapien
gaggagaggtttatgcttcaagaacyaagaacaccagtgttgttgctagc

SEQ ID NO: 86843 - DNA, 50 bp, homo sapien
acttttttatccctttaagagaaccratgattctttaggaactttgaata

SEQ ID NO: 86844 - DNA, 50 bp, homo sapien
cctatttagctctgcatcttttagaytggtggttgtcaataaatatttgt

SEQ ID NO: 86845 - DNA, 50 bp, homo sapien
tcttcaagtgccaagattttttagartactgtatcaatcttttcttttct

SEQ ID NO: 86846 - DNA, 50 bp, homo sapien
ttgtaatcttggctacttactacaaycaggttaagcttttcaaaaatcca

SEQ ID NO: 86847 - DNA, 50 bp, homo sapien
gctcgagcttcatctttttcttcccractaaagccctgtttgtatttcac

SEQ ID NO: 86848 - DNA, 50 bp, homo sapien
agaacaaggacatttattcttaccaygtctattaacatcatattggaatt

SEQ ID NO: 86849 - DNA, 50 bp, homo sapien
atttaattcctgtgtggtcagaaaaygtatttggtatgattctaatcttc

SEQ ID NO: 86850 - DNA, 50 bp, homo sapien
tttctagccatttagccttttaatamaaatctacaaggcaacttattagg

SEQ ID NO: 86851 - DNA, 50 bp, homo sapien
atctccagctgtggtaggtcatagcscaagtcacaatctttcacttttag

SEQ ID NO: 86852 - DNA, 50 bp, homo sapien
cttacggtgactgctccaacggtatkagagctgctttgcttatacaggga

SEQ ID NO: 86853 - DNA, 50 bp, homo sapien
ggttggttcaaaccttgaaatgggamgataaggacaatgagacaggcacg

SEQ ID NO: 86854 - DNA, 50 bp, homo sapien
gactgtatagacttgtcatcctcaayagtcagtcaagaaaaataaacaag

SEQ ID NO: 86855 - DNA, 50 bp, homo sapien
agaaacaaggaccctaagaaaatagwcaagaaagtaatgcttagatagag

SEQ ID NO: 86856 - DNA, 50 bp, homo sapien
aaaatttaagaaagcagggcttcagyacataggagacacccagtaaatat

SEQ ID NO: 86857 - DNA, 50 bp, homo sapien
ttgcaggagagggcactgaacttctsaaagacactgaaaaaaatatcttt

SEQ ID NO: 86858 - DNA, 50 bp, homo sapien
agaccatgaaatggaaactgcttcargagaaatatggagcagtgagactg

SEQ ID NO: 86859 - DNA, 50 bp, homo sapien
cagatcatagtagtggtagtccttaygcattatggtaaatgctttccacg

SEQ ID NO: 86860 - DNA, 50 bp, homo sapien
acagattgagttcccctcatgcttcracacccttctccttcttccagctt

SEQ ID NO: 86861 - DNA, 50 bp, homo sapien
caaatgctaacaatttcttggaagcycagatgtaggagaggtatgtgtaa

SEQ ID NO: 86862 - DNA, 50 bp, homo sapien
caccatataacataactccttgtaastgctttctcatatttgatttagtt

SEQ ID NO: 86863 - DNA, 50 bp, homo sapien
aattagaatctaactcctcaaattayattttagcacaacaaaactatcct

SEQ ID NO: 86864 - DNA, 50 bp, homo sapien
tgaagtttcctcctaaatctccgcaytgaataggactcaaggttaagtgg

SEQ ID NO: 86865 - DNA, 50 bp, homo sapien
ctaaaacctgtaatgatccacacaayctgggaacacatgacttgggtttg

SEQ ID NO: 86866 - DNA, 50 bp, homo sapien
tcagagacagagtcccaattcaagaygaaaagcaaagtgacaagaaaaaa

SEQ ID NO: 86867 - DNA, 50 bp, homo sapien
taaaagcggccaaagagccctggaarataatagaagctatattcagattc

SEQ ID NO: 86868 - DNA, 50 bp, homo sapien
cctgcttataagtgaatttgcttgaktagactagacatcatattgagaag

SEQ ID NO: 86869 - DNA, 50 bp, homo sapien
atttacattattttgagcataggagratagcttacattcttagagtaaat

SEQ ID NO: 86870 - DNA, 50 bp, homo sapien
aagttttaaaaatggaaattgattasaatggttatgacattgagccaaaa

SEQ ID NO: 86871 - DNA, 50 bp, homo sapien
atgagcttagaaacactggaaccacygatatacaaaagtatttttatcat

SEQ ID NO: 86872 - DNA, 50 bp, homo sapien
aatattactctgcaaaaacagtggayacagtgacttggataataggtttg

SEQ ID NO: 86873 - DNA, 50 bp, homo sapien
tgggaaagcatcattacggtatagtktaccgtggactcagcttctcttca

SEQ ID NO: 86874 - DNA, 50 bp, homo sapien
tgcttgtctcattcatgaataacatmaaacaatattgtacaatgactttt

SEQ ID NO: 86875 - DNA, 50 bp, homo sapien
tgatgaaggaaatgtaacataatctraaatgtaaaatctactcatttttg

SEQ ID NO: 86876 - DNA, 50 bp, homo sapien
agctctaaagctgagatgattgtttmaaaatggttccaagttggtgtgag

SEQ ID NO: 86877 - DNA, 50 bp, homo sapien
ggggtcatgtgaagttaaaataaggyaagtgttcaaaagcatcttataaa

SEQ ID NO: 86878 - DNA, 50 bp, homo sapien
tgttaaagctgtcagcactcactgaygggataaaatggcaccagctgcac

SEQ ID NO: 86879 - DNA, 50 bp, homo sapien
cagcccacacagaacgttgtttctaygagtagagctcagacacctggcat

SEQ ID NO: 86880 - DNA, 50 bp, homo sapien
cagcagagggagctactaggattgamatcacagtggataatggcaccaac

SEQ ID NO: 86881 - DNA, 50 bp, homo sapien
ctgtttgtgcatctctatatcgttcraagtgttacgcccgtgatattaac

SEQ ID NO: 86882 - DNA, 50 bp, homo sapien
tagtagaggcctataattgatgatgrcaagaataagaatatttaaccttt

SEQ ID NO: 86883 - DNA, 50 bp, homo sapien
aatgggagttaacaactctggttaarattatgctcattttcaaatgcttt

SEQ ID NO: 86884 - DNA, 50 bp, homo sapien
gaaagcctataaacaataatttgacrctgcctctatttcatttgctttgt

SEQ ID NO: 86885 - DNA, 50 bp, homo sapien
ggatgtcaggcactgattagatcacmatgtatttctgcctaaatgcatat

SEQ ID NO: 86886 - DNA, 50 bp, homo sapien
ttagtctcccatttgtccttaaagtraaaataacaatgtcaacctttcat

SEQ ID NO: 86887 - DNA, 50 bp, homo sapien
taaggataaagtaacaaaatgctcaygcttctatggacatacacaaacaa

SEQ ID NO: 86888 - DNA, 50 bp, homo sapien
cttaaattcctccaattccattaagrctgccatgtgaaacttagcagagc

SEQ ID NO: 86889 - DNA, 50 bp, homo sapien
tgcatgcattccatatgcaccaagayccttttaatctcctggtctgtcac

SEQ ID NO: 86890 - DNA, 50 bp, homo sapien
cacgttttcattacatagcatatgaygtacgagctgcagaaatggttgca

SEQ ID NO: 86891 - DNA, 50 bp, homo sapien
agagtagaagacacataatcagactyaataccgagcagactggaataaac

SEQ ID NO: 86892 - DNA, 50 bp, homo sapien
ttcatgctcacctgtacttcctgaaygtagccctgctgtggtacagcatc

SEQ ID NO: 86893 - DNA, 50 bp, homo sapien
cagagacagcccctccaggaagagcraccaggccttgagaggacatggcc

SEQ ID NO: 86894 - DNA, 50 bp, homo sapien
taagtcaacatcaaccttggtaataygaacatttttgaaactacggtttt

SEQ ID NO: 86895 - DNA, 50 bp, homo sapien
aggaattaatctatggttccattgaygtaaaggaagattttcattttaat

SEQ ID NO: 86896 - DNA, 50 bp, homo sapien
taatatttatccagttactttactaygagccaaataaagtgctgttttaa

SEQ ID NO: 86897 - DNA, 50 bp, homo sapien
ccttcataatttttgtcactctcaaygagattcttagaatgctgaggagc

SEQ ID NO: 86898 - DNA, 50 bp, homo sapien
actctagaacctcaattgctaaccaytcttctttgcccaattactttcct

SEQ ID NO: 86899 - DNA, 50 bp, homo sapien
atgaacatgtttttcaaatacaaatygacaatccagagcctatacctcag

SEQ ID NO: 86900 - DNA, 50 bp, homo sapien
gtctcctagcttatctcctttctctyggatcaattacagaggccggactc

SEQ ID NO: 86901 - DNA, 50 bp, homo sapien
gaatctgtatagtaacaagcattagyatattagatttaattaaaatctct

SEQ ID NO: 86902 - DNA, 50 bp, homo sapien
aaattagtgtgggtgaaacagaaacygggtctccggacaacaagctcagt

SEQ ID NO: 86903 - DNA, 50 bp, homo sapien
aggacaaacacaggttccacctgaargcattaacaatgaaagagtgccct

SEQ ID NO: 86904 - DNA, 50 bp, homo sapien
aagtatagctaaagcttctcacttcrccaactgatagaaccctataacag

SEQ ID NO: 86905 - DNA, 50 bp, homo sapien
aacctgaggtaccatctattctacaytggaccaagagcagatggttttat

SEQ ID NO: 86906 - DNA, 50 bp, homo sapien
acagcactgttagcaatgttatccaygtgcttaaaattaaacacaacccc

SEQ ID NO: 86907 - DNA, 50 bp, homo sapien
ctaccagcacatttctaagaactgargtaattatctgggatgggaattct

SEQ ID NO: 86908 - DNA, 50 bp, homo sapien
agcaaagcaaagtgaaaaatgaaacrgcaatacctgctactggcaaggat

SEQ ID NO: 86909 - DNA, 50 bp, homo sapien
ttttacagttggtttgttggatcagyggccaagcagggtccacataagtg

SEQ ID NO: 86910 - DNA, 50 bp, homo sapien
ggagacaagcctttccctagagatgwaattttgtgcattaagatatcaaa

SEQ ID NO: 86911 - DNA, 50 bp, homo sapien
tgaaggtacatacctcaaaataatamcagttacatgtgacaaacccatag

SEQ ID NO: 86912 - DNA, 50 bp, homo sapien
tttgacctctctccttctccaaaaaktgtaatgaacacagctctcttctc

SEQ ID NO: 86913 - DNA, 50 bp, homo sapien
ctacagttagctttattatttggaaktattgctattatcaatacctggaa

SEQ ID NO: 86914 - DNA, 50 bp, homo sapien
aggtagaggcttatagataactcctmaatgttccgccagaaaaattacaa

SEQ ID NO: 86915 - DNA, 50 bp, homo sapien
caatttaaagggtctgaataaaatcrataaaaagttaaagcaaatgtaga

SEQ ID NO: 86916 - DNA, 50 bp, homo sapien
tcagattttttctgccagaatataayatgaatgtaagcagtgtgcaggga

SEQ ID NO: 86917 - DNA, 50 bp, homo sapien
cctcaatatgtgttagaaataccaarattgttagaaatagataatcggtg

SEQ ID NO: 86918 - DNA, 50 bp, homo sapien
ataacagtacacactagtaagaacaragactatttaacaaatgaaaacaa

SEQ ID NO: 86919 - DNA, 50 bp, homo sapien
tgacaatgctattttcaacatccaarcagcaaaatcagatgcttatgtat

SEQ ID NO: 86920 - DNA, 50 bp, homo sapien
gttatagctcaccgacacatatttakcgtttcccaaatattcagagttct

SEQ ID NO: 86921 - DNA, 50 bp, homo sapien
cactaccatttgctcccacattcaasgcaacgatgtcatttccagatgaa

SEQ ID NO: 86922 - DNA, 50 bp, homo sapien
atatctccaagcaacaaaagaagccrcaagactaatatcttaaagatgct

SEQ ID NO: 86923 - DNA, 50 bp, homo sapien
aacaacaatataattttattgcttgyagattattagatgctcaagttttc

SEQ ID NO: 86924 - DNA, 50 bp, homo sapien
atacaaagttaaagcatttctaaaaytgcaccttttcctcatgccccgaa

SEQ ID NO: 86925 - DNA, 50 bp, homo sapien
tgaaaaaactcagtgtatgataaaasttgcaattcacaatgtgactataa

SEQ ID NO: 86926 - DNA, 50 bp, homo sapien
tgtttcttccctgcctcctcaatccrggtctctgcaggctggctttgtcc

SEQ ID NO: 86927 - DNA, 50 bp, homo sapien
tctttgtctaaggaaagcctgaaaayatctgtatgcttttgtctatcact

SEQ ID NO: 86928 - DNA, 50 bp, homo sapien
attaaaaatgttgagagaatcttgayaatggaagattgaattgctcaact

SEQ ID NO: 86929 - DNA, 50 bp, homo sapien
tcccatcccatcagctttatcatccratgcttgattagtggaaatgcagg

SEQ ID NO: 86930 - DNA, 50 bp, homo sapien
gaaaaccacaatgggatggtaccacygaggattttataaaattgggggag

SEQ ID NO: 86931 - DNA, 50 bp, homo sapien
aggaggaaaagcaagggcctgccacmgtacctgggacccacagtcctgaa

SEQ ID NO: 86932 - DNA, 50 bp, homo sapien
ctgaaaaacatacataattggtcaayctttaatgttataaaatagtggta

SEQ ID NO: 86933 - DNA, 50 bp, homo sapien
acaaaatgcccttcctcacaagggcrcacaaggaaaactaatgattttgc

SEQ ID NO: 86934 - DNA, 50 bp, homo sapien
aattgcaggacaagacttacttataygggcttatctgggggacccaaagt

SEQ ID NO: 86935 - DNA, 50 bp, homo sapien
gcaatgggggtgttcactgtgaacaygtttcttgtgtatccttttagagt

SEQ ID NO: 86936 - DNA, 50 bp, homo sapien
tgctttgaaaatacaaacctaacaasaagatattaaactttaaaatagca

SEQ ID NO: 86937 - DNA, 50 bp, homo sapien
ctgaaccctcttaacatcaaccgtgmaatgattaagaagatatattttgt

SEQ ID NO: 86938 - DNA, 50 bp, homo sapien
gccctactgttgagtagccataggayctctgcaaggtgcacccctttggg

SEQ ID NO: 86939 - DNA, 50 bp, homo sapien
cagtacagagcacaaatgctaatgamggaggaagctatctctgagttttc

SEQ ID NO: 86940 - DNA, 50 bp, homo sapien
tcgatggttagtccccggtagctcartaacgtagtctcctgctttcttag

SEQ ID NO: 86941 - DNA, 50 bp, homo sapien
agctctgcaatttgtgtttcaatgasaactctagggcaggagcctccaac

SEQ ID NO: 86942 - DNA, 50 bp, homo sapien
aaactgctatctgtgacagtgtataygaaagaggtgaaggatagagctgt

SEQ ID NO: 86943 - DNA, 50 bp, homo sapien
tgctgtcttcttgtatctcacagggyagaaaaagagtgagctagctctct

SEQ ID NO: 86944 - DNA, 50 bp, homo sapien
ctaaatatatcctctgaaataattayagttgtttgttacatccctttagt

SEQ ID NO: 86945 - DNA, 50 bp, homo sapien
taatggaagatcatctatgaaaatcrgaaaatggaagaggaccttctaca

SEQ ID NO: 86946 - DNA, 50 bp, homo sapien
ttatacttgaattttagataaacacygaacaatatttcaacataaacata

SEQ ID NO: 86947 - DNA, 50 bp, homo sapien
ttcagatttagttcaacctcatccartatgtttcctttctaagtaacaga

SEQ ID NO: 86948 - DNA, 50 bp, homo sapien
tttctactctagcacatattttctcyaaaggtggcagtcaaatgcatctc

SEQ ID NO: 86949 - DNA, 50 bp, homo sapien
aaggaactggtcatacggagatatcraatctattgacattatctagactt

SEQ ID NO: 86950 - DNA, 50 bp, homo sapien
gggtagaaattaggacagcaccgtayagtgaaaggagcaaggatttcata

SEQ ID NO: 86951 - DNA, 50 bp, homo sapien
agaggagaaaagaagtgtttttaccrcacagatgctacccattttactgg

SEQ ID NO: 86952 - DNA, 50 bp, homo sapien
tccaagtttctaatagacaaaatcayggactgcaacaaaatggttgttgt

SEQ ID NO: 86953 - DNA, 50 bp, homo sapien
cctttttattatattttgccttaccmatttatcccttgggaaattgtatt

SEQ ID NO: 86954 - DNA, 50 bp, homo sapien
tgaaccacatgtccctcttaggtaamcaattagtagagagttttagaaac

SEQ ID NO: 86955 - DNA, 50 bp, homo sapien
ctcattaatcagtctctaaagtaacyggataagctgccactaactggaat

SEQ ID NO: 86956 - DNA, 50 bp, homo sapien
gcttacatagctggtcctgtatcaaygatagtccttgaccaagaaccaca

SEQ ID NO: 86957 - DNA, 50 bp, homo sapien
aagtggctgccagtgactattaagargcataaccactttgcttggcacga

SEQ ID NO: 86958 - DNA, 50 bp, homo sapien
tctacactgcctgcaagaatgttcgwccctagcagctgagggtgacactg

SEQ ID NO: 86959 - DNA, 50 bp, homo sapien
gaagataatccatagacgtccaatgmaccaaggcaaatacaggatttata

SEQ ID NO: 86960 - DNA, 50 bp, homo sapien
gagtgaagaatttgttgctgtcatcyaaatataaaacaggaaacacatta

SEQ ID NO: 86961 - DNA, 50 bp, homo sapien
tccctttactgcgcctctggctgtayggacctaatgagatgccttgtgtt

SEQ ID NO: 86962 - DNA, 50 bp, homo sapien
gccccactgcacaaataaagaccacrgcattgcggtaaagaaagagttta

SEQ ID NO: 86963 - DNA, 50 bp, homo sapien
aaaatgctttggaataaagatttggycagattcaaggtttaaactccaca

SEQ ID NO: 86964 - DNA, 50 bp, homo sapien
ctttggctagagactaacaagatacraggcttggaaacaaaaataagagt

SEQ ID NO: 86965 - DNA, 50 bp, homo sapien
ccctgctgcccttttccagagattgmactgaactaagaggggaaaacatg

SEQ ID NO: 86966 - DNA, 50 bp, homo sapien
cacatatcagatgctttgatgtgtamcattgaaaagaaggaaggaagaaa

SEQ ID NO: 86967 - DNA, 50 bp, homo sapien
attccattaccacttcattaaaaaayatgctgtccccggtgctgaaactg

SEQ ID NO: 86968 - DNA, 50 bp, homo sapien
gacaatcagatgagaagcagtctagyataatatgattgaatacagcttat

SEQ ID NO: 86969 - DNA, 50 bp, homo sapien
gcaaacaattgtttaaagaacgacasattcataagcagtatcaattctca

SEQ ID NO: 86970 - DNA, 50 bp, homo sapien
cctctcaatacgaagtctgatttaartaaaaaactaagtgagaattgata

SEQ ID NO: 86971 - DNA, 50 bp, homo sapien
aggtttcacccacgtagccaacagcragaattacatcctaccaatgttta

SEQ ID NO: 86972 - DNA, 50 bp, homo sapien
ttaaactcttagaactatcttagctsacctcaccctgaatagaaggataa

SEQ ID NO: 86973 - DNA, 50 bp, homo sapien
atttcagcccaatggagcatattcaytatcagatcaaagtgataggattt

SEQ ID NO: 86974 - DNA, 50 bp, homo sapien
gtcttttgagtactgattggttttgratttccatacttttattttaattt

SEQ ID NO: 86975 - DNA, 50 bp, homo sapien
ataaatatatgtgtgatgggtaaatragacctaaacagagagaagacctg

SEQ ID NO: 86976 - DNA, 50 bp, homo sapien
ttcagatctttcactcatttttaatrttttttccaattattgagttttaa

SEQ ID NO: 86977 - DNA, 50 bp, homo sapien
attagccaagctcatggatgcagtcraatcttgtaaatttaatagtattt

SEQ ID NO: 86978 - DNA, 50 bp, homo sapien
cttcaaaaagaaatgctatcttgtasatggtaagcctcaggctggtgaat

SEQ ID NO: 86979 - DNA, 50 bp, homo sapien
ttgaagccttcaaagaaagataataraaataacagaagatgaagtcagac

SEQ ID NO: 86980 - DNA, 50 bp, homo sapien
acactgatctaggggctgaaagagaragcaataggcttaaagtcttaaaa

SEQ ID NO: 86981 - DNA, 50 bp, homo sapien
taatttatatggctctaccttgtatygttctatggaaatttttgttttac

SEQ ID NO: 86982 - DNA, 50 bp, homo sapien
cttagctaaagagaattagagtaagygtacatctaaagtgctgggatcct

SEQ ID NO: 86983 - DNA, 50 bp, homo sapien
aggcctctcctcacgttctttatgaygttcagtaacaattttgattagca

SEQ ID NO: 86984 - DNA, 50 bp, homo sapien
ttattcatgtggtacctcagttcctraaacagcaagatggcaagccccaa

SEQ ID NO: 86985 - DNA, 50 bp, homo sapien
taatgaaatacattgtccacagttgkagttattagatggggaaacagaat

SEQ ID NO: 86986 - DNA, 50 bp, homo sapien
tctctttctttagacttgcagcatayaatgatattcgatacatatgatgt

SEQ ID NO: 86987 - DNA, 50 bp, homo sapien
ggaacagaggactgaatttgaggtcrctgccctaggatttctatttccca

SEQ ID NO: 86988 - DNA, 50 bp, homo sapien
tgtctttttgttaatattatatcaayggcttcatagaatatgagacgggc

SEQ ID NO: 86989 - DNA, 50 bp, homo sapien
gtctcagatgtatttgggacatttaygaaaaatgaatttgtgaagatatg

SEQ ID NO: 86990 - DNA, 50 bp, homo sapien
tgtagaagttcgtgttgcatcaggayggagactgaaatgggcaactgagc

SEQ ID NO: 86991 - DNA, 50 bp, homo sapien
ccctctcagagttttggaatacctaygagctttcagccataaagccaaga

SEQ ID NO: 86992 - DNA, 50 bp, homo sapien
tctaagggccgctgtcatcatacccrgacatggttgcctttactgcacta

SEQ ID NO: 86993 - DNA, 50 bp, homo sapien
gcacatgcgacatcacatttgatgaygggccgagatgcccttgccagcca

SEQ ID NO: 86994 - DNA, 50 bp, homo sapien
aaaagcagccttcaagtttattagartatttactgcagggataaatgggc

SEQ ID NO: 86995 - DNA, 50 bp, homo sapien
gccaataaagcctaaagggtataatragaagagaagtaaaagttaaaaat

SEQ ID NO: 86996 - DNA, 50 bp, homo sapien
aatctcagccttgccaaaagctacakggatgagccctcccgctctgatac

SEQ ID NO: 86997 - DNA, 50 bp, homo sapien
aggtcaaacttcctctctatattgcyaaaccctatggtagatgcttggta

SEQ ID NO: 86998 - DNA, 50 bp, homo sapien
ccatatccctaacttactggtctcayggtaccctctcaagaaacgatcct

SEQ ID NO: 86999 - DNA, 50 bp, homo sapien
ggtttgggttgtgttgactctaccaycagattcattttccttgcctggct

SEQ ID NO: 87000 - DNA, 50 bp, homo sapien
gcatgtcagtttattgtgcatgtccrtcctccatatttattcaaagtaac

SEQ ID NO: 87001 - DNA, 50 bp, homo sapien
ccccgaagtcacaaggtgtttttgcrtagcttgtcccatttgccggaaaa

SEQ ID NO: 87002 - DNA, 50 bp, homo sapien
catgcaggggccaaaagattgatacmgcctgaaaggagagtggtcctgac

SEQ ID NO: 87003 - DNA, 50 bp, homo sapien
tgtacagttagctttttagtacttaygactatctaatggatcttgacaaa

SEQ ID NO: 87004 - DNA, 50 bp, homo sapien
gatatttcctcagtggaaattgataycattgttgccattgggaaaacgag

SEQ ID NO: 87005 - DNA, 50 bp, homo sapien
gattttttgagaatgcgtagatatayatgatggaggaataataaaaacac

SEQ ID NO: 87006 - DNA, 50 bp, homo sapien
atatccatagttctcccttgactcakggaacaaaaccagctttgactaca

SEQ ID NO: 87007 - DNA, 50 bp, homo sapien
tgatttagccgtgtatggatcatgcktgtcatattgatcagcacagcaca

SEQ ID NO: 87008 - DNA, 50 bp, homo sapien
caccaccagctaaatgccatataccrgctagggaagggatactggtataa

SEQ ID NO: 87009 - DNA, 50 bp, homo sapien
ctcattttacattattaacctcataytaaaaaacctcaataattatacca

SEQ ID NO: 87010 - DNA, 50 bp, homo sapien
caaatggaaactccattgatttggastaatttaaaagagtgaaagaaaat

SEQ ID NO: 87011 - DNA, 50 bp, homo sapien
gttccaatcaataacagaaagtatcrataaattacattgttgagtatctg

SEQ ID NO: 87012 - DNA, 50 bp, homo sapien
cttcacatacagaggttgacaactcraaagccctacagcagtcagtgcag

SEQ ID NO: 87013 - DNA, 50 bp, homo sapien
tttcctatgctataaatcttagcatraattagaaattaacaaatattcaa

SEQ ID NO: 87014 - DNA, 50 bp, homo sapien
gtaaaggacttgataggtgcggtacratatgatgagttaaaactgaaagc

SEQ ID NO: 87015 - DNA, 50 bp, homo sapien
ggttttgacttttgaataggctatcmgttgcccaatagccattatgtgtt

SEQ ID NO: 87016 - DNA, 50 bp, homo sapien
ataccctgctaagctgcagaaatgayacggttgaggagtttccattaaaa

SEQ ID NO: 87017 - DNA, 50 bp, homo sapien
ttttataggatattcaagaccatacrggaataagacatgtactctttcac

SEQ ID NO: 87018 - DNA, 50 bp, homo sapien
agcaaattctacagctccatttccargccactgctacctagtctcctccc

SEQ ID NO: 87019 - DNA, 50 bp, homo sapien
gttatggacagtagtctttaaagcawccactggctcttatatatgactgg

SEQ ID NO: 87020 - DNA, 50 bp, homo sapien
ttacattataatatgcttagtgctarcctggaaataaaacaccacccata

SEQ ID NO: 87021 - DNA, 50 bp, homo sapien
aattcatttactcattcaacaaatayatatccaatgaggaccctgtgtgt

SEQ ID NO: 87022 - DNA, 50 bp, homo sapien
accctgtgtgtactggcctctgctamataccagatacaaatatgtacaag

SEQ ID NO: 87023 - DNA, 50 bp, homo sapien
aggaggagacaatggcttatgtgacytatgagacagcatagagcaaccaa

SEQ ID NO: 87024 - DNA, 50 bp, homo sapien
aaaaatcctctttgcaactccattgmattgtacataaacaagtcaagaaa

SEQ ID NO: 87025 - DNA, 50 bp, homo sapien
gtcgcccacggtggtcacatgatcartcctggtctttataccattacttc

SEQ ID NO: 87026 - DNA, 50 bp, homo sapien
ccatccagaatcaaaaccaaaacacyctactcaactgacactctagacat

SEQ ID NO: 87027 - DNA, 50 bp, homo sapien
caattagatgacaatgatggaatgayatataattaggaatcaccaaaaat

SEQ ID NO: 87028 - DNA, 50 bp, homo sapien
agtctgcagcactggagccttagtcrcccacggtggtcacatgatcagtc

SEQ ID NO: 87029 - DNA, 50 bp, homo sapien
aaccaagtcaatgaacttcaaattcscagtgtttggagaggtaatcctta

SEQ ID NO: 87030 - DNA, 50 bp, homo sapien
ctaactgtgacacacactagtataamgttgtacaggccacttaacatttc

SEQ ID NO: 87031 - DNA, 50 bp, homo sapien
gagatacttgaatatttttaagttaygtctactgtattggaaaatgtgtt

SEQ ID NO: 87032 - DNA, 50 bp, homo sapien
aatttgagagaggttgtccttcttgyagagcatttggtgctggtgcaacc

SEQ ID NO: 87033 - DNA, 50 bp, homo sapien
acatgaattaaaatcccttcaaaggwccatcaagagaataattttttaat

SEQ ID NO: 87034 - DNA, 50 bp, homo sapien
tatattgtcaaactgatttctttaamtatatgtatgtattgttggtgtgt

SEQ ID NO: 87035 - DNA, 50 bp, homo sapien
aatctgcttaaagaaaactgactcaygtttgggagcccactttttttcat

SEQ ID NO: 87036 - DNA, 50 bp, homo sapien
taatgctttcgtttagttcagggtcrcaaaagaaacaaagctcttgggtt

SEQ ID NO: 87037 - DNA, 50 bp, homo sapien
aattatatgatgaccctctatcgacratgatcagaaactgcagcatgcac

SEQ ID NO: 87038 - DNA, 50 bp, homo sapien
agctatacaaggtcatgaaagtagaygagatcaccaagaaagtgagttta

SEQ ID NO: 87039 - DNA, 50 bp, homo sapien
atctattatgtgccaggcctgatacrcatattatctcaaggataccttgc

SEQ ID NO: 87040 - DNA, 50 bp, homo sapien
taagatgtataataaagctcttgtgyagccctttgacaaaaatgagtaat

SEQ ID NO: 87041 - DNA, 50 bp, homo sapien
aaataggctgttttactcttgcagcraaataatatctaaatgcaagagcc

SEQ ID NO: 87042 - DNA, 50 bp, homo sapien
tggacaatgaacaatgcagtaataawgtgggcgttcatagccacatgtaa

SEQ ID NO: 87043 - DNA, 50 bp, homo sapien
tggatgccaagttgaataatttttayggcaaagtagtttatcagagagct

SEQ ID NO: 87044 - DNA, 50 bp, homo sapien
tgcaacagcacagaggatattgggartaaaaaagctacaaatgatccatg

SEQ ID NO: 87045 - DNA, 50 bp, homo sapien
tgccattagctaaggacaattagagratgaatgcctaggtccagtaaagg

SEQ ID NO: 87046 - DNA, 50 bp, homo sapien
tatcctcagtcatgatacgtgctaaygaagggaaatgtaggttgtaggtg

SEQ ID NO: 87047 - DNA, 50 bp, homo sapien
ttccttcttctcctacatatatccartatcctcatggtttctttctaatc

SEQ ID NO: 87048 - DNA, 50 bp, homo sapien
atagtgtttgatctgctttccctcaygtataaaatgaagggttaaacgaa

SEQ ID NO: 87049 - DNA, 50 bp, homo sapien
tttggtcagttttaattacaactaakagtgagtcctatgaggtaaacctt

SEQ ID NO: 87050 - DNA, 50 bp, homo sapien
tgaaactttttaaaagtgaaaatgayagtatgacacaaattcactttctg

SEQ ID NO: 87051 - DNA, 50 bp, homo sapien
ttctataagtgtaaaactgagcttascttgaaagcaggacagagaagaga

SEQ ID NO: 87052 - DNA, 50 bp, homo sapien
aagcaccgaacacctgaggactccawgtatttatgatttaggcccaaatt

SEQ ID NO: 87053 - DNA, 50 bp, homo sapien
ctgcagcacccctgcagtggatgtarcaatcagtttttgagactcttccc

SEQ ID NO: 87054 - DNA, 50 bp, homo sapien
ctaggactaacaacaaggctagaacrctgtctgaggtaacaataaatgag

SEQ ID NO: 87055 - DNA, 50 bp, homo sapien
attacaagtttagattaagtgattaygagttccaaattggacttcacaga

SEQ ID NO: 87056 - DNA, 50 bp, homo sapien
cttacacaatttcaaatcatgggaartcttcacaaagcatactaaaattc

SEQ ID NO: 87057 - DNA, 50 bp, homo sapien
aaaaggaaactgaagaggacttttaygtcttagaaatgcactcatctgcg

SEQ ID NO: 87058 - DNA, 50 bp, homo sapien
ctctgaacatcagtttctgcatatawaaaatagagccaataaactcttcc

SEQ ID NO: 87059 - DNA, 50 bp, homo sapien
aatgcaatatgcactcagtagaaacygtacatcaagtacccatgcaacca

SEQ ID NO: 87060 - DNA, 50 bp, homo sapien
taactttgtgaacaattagggaaacratatggttatggagggtgctaggt

SEQ ID NO: 87061 - DNA, 50 bp, homo sapien
tgaatttttggaaatgcatagggaayaaaacaactataaatagaacccaa

SEQ ID NO: 87062 - DNA, 50 bp, homo sapien
aaaaattttaattttaaaggagatasacaagaaatgagcatgtgtgaaag

SEQ ID NO: 87063 - DNA, 50 bp, homo sapien
agttgtcatggtctgacaattgcatyatcacatacaccgaaatgtcacaa

SEQ ID NO: 87064 - DNA, 50 bp, homo sapien
ttgatggagcaaacatgatgttcttrttccaatccatcatgattcttaca

SEQ ID NO: 87065 - DNA, 50 bp, homo sapien
cttttccctagcagaacaattctaarcagatgtagttgaaacccaggttt

SEQ ID NO: 87066 - DNA, 50 bp, homo sapien
tcaccctgaccctgaaattaaagaamgcggaagcccgaacccataagatg

SEQ ID NO: 87067 - DNA, 50 bp, homo sapien
gttggcataggatggtccctggatarccccaattctcaaagtgggatccc

SEQ ID NO: 87068 - DNA, 50 bp, homo sapien
acatttccaatattctacacaaatastaaacattcctctttaagtgcata

SEQ ID NO: 87069 - DNA, 50 bp, homo sapien
aagcatggctcttcctatcatcttawgctttagaggaagtcattcttttt

SEQ ID NO: 87070 - DNA, 50 bp, homo sapien
taaatccatggtttgtagagtgaaarttgagcaaatctgcatacaggcca

SEQ ID NO: 87071 - DNA, 50 bp, homo sapien
cagcaggctgtaccaggctgccctgyttgtgccttagtgggaagcccagt

SEQ ID NO: 87072 - DNA, 50 bp, homo sapien
ctcagcaaacgtgggcttctgatccratggaagttcaaataccgcacctg

SEQ ID NO: 87073 - DNA, 50 bp, homo sapien
ctggtctataatgacaaccaaacaaygtaatataatataatgtttcctct

SEQ ID NO: 87074 - DNA, 50 bp, homo sapien
cattctataatggctgtgtctattayagtatattacagtaactgcaggtg

SEQ ID NO: 87075 - DNA, 50 bp, homo sapien
tgctagtcctatctgaccgtgcatcsactcaccttatctgtcaaacacct

SEQ ID NO: 87076 - DNA, 50 bp, homo sapien
tccacaggcggttcacgtccggataygtgggaatcccctcaaactgaccc

SEQ ID NO: 87077 - DNA, 50 bp, homo sapien
ttttttatccctcacatatctgaggyaatgaagtgtttaatgagggaact

SEQ ID NO: 87078 - DNA, 50 bp, homo sapien
caatattgcttgtcagttgatattcrcgcatgctggtggattgtggtagt

SEQ ID NO: 87079 - DNA, 50 bp, homo sapien
aattcttcttgacagacgtggacaakgatttattattattattattatac

SEQ ID NO: 87080 - DNA, 32 bp, homo sapien
ttataaatgtacacacwcttaacaacggagcc

SEQ ID NO: 87081 - DNA, 50 bp, homo sapien
caggaattaactcacacgaccttgcraatctgtataaaacactttgcagg

SEQ ID NO: 87082 - DNA, 50 bp, homo sapien
aagaggaaaaataccagcaaacaacmatttcttccgtgaatttctagaca

SEQ ID NO: 87083 - DNA, 50 bp, homo sapien
tccccagcacccatctcaatgttcamcataaaatgactttctttccctgc

SEQ ID NO: 87084 - DNA, 50 bp, homo sapien
gtaagaagggcagtattatattaacyctgatggctcctactgtaatccat

SEQ ID NO: 87085 - DNA, 50 bp, homo sapien
gagagcctctgttttacccttgctayaaaagccgttaagtcttttttttt

SEQ ID NO: 87086 - DNA, 50 bp, homo sapien
gcttaatcagcattttagtctctcaytcttaaaaattaacaaatatcagc

SEQ ID NO: 87087 - DNA, 50 bp, homo sapien
gcaccaaaatcaccttttcataagaytcgcccaccaatgtcgtgacagtt

SEQ ID NO: 87088 - DNA, 50 bp, homo sapien
agatgtctgcaatgcaatggcatgcrctgggatttggggagagattcagg

SEQ ID NO: 87089 - DNA, 50 bp, homo sapien
acaattgttcatctgtttactctgcratactcagtaaattgatggatagc

SEQ ID NO: 87090 - DNA, 50 bp, homo sapien
actatgtcagtgaataaaagttcctsaatgccaagcaatggcttacacct

SEQ ID NO: 87091 - DNA, 50 bp, homo sapien
aaaaccaaagacacaacaggttatascatcaccaaatattgtcacatcaa

SEQ ID NO: 87092 - DNA, 50 bp, homo sapien
aattgtttgccaacatatcacatagyattgcctgtcagcgcaggagaaaa

SEQ ID NO: 87093 - DNA, 50 bp, homo sapien
tgtctggcacagagctgctgagttaygtagcttgaaggaataccatttat

SEQ ID NO: 87094 - DNA, 50 bp, homo sapien
aactacaataacaaataaactcaccrctagatctcaatttacttagaaaa

SEQ ID NO: 87095 - DNA, 50 bp, homo sapien
ccccccatgaggttcactaagatcarcctattatacaaatgagcgactga

SEQ ID NO: 87096 - DNA, 50 bp, homo sapien
gcagcgaaagaattttgttctgataractccaaaatgaaattctggagca

SEQ ID NO: 87097 - DNA, 50 bp, homo sapien
atagcaataacgcctgcatcatgggrttaagaaaaaaaacaaggtaaaag

SEQ ID NO: 87098 - DNA, 50 bp, homo sapien
ccgaaggaagagtgaaaatgcgtaasacctgggatcccgtctagtacagc

SEQ ID NO: 87099 - DNA, 50 bp, homo sapien
tttaaagagccagagagtgaagatasattacctacacaggaatggtgttt

SEQ ID NO: 87100 - DNA, 50 bp, homo sapien
cctaatggatatttttcatacaacaragaaattctggttcttgtgactga

SEQ ID NO: 87101 - DNA, 50 bp, homo sapien
catttctatttctctgaaataaccarcgttagcagcttagagtgtccttt

SEQ ID NO: 87102 - DNA, 50 bp, homo sapien
aactattttaaaaggaaaagttttawcccagtgactaagtggctctgtta

SEQ ID NO: 87103 - DNA, 50 bp, homo sapien
ggaatcacaaaaacaagctcagtaaygtgggaccttgaacttaacacaca

SEQ ID NO: 87104 - DNA, 50 bp, homo sapien
aattgcaagctactgttgaaagaacraaggatacccatgtccaaaagtat

SEQ ID NO: 87105 - DNA, 50 bp, homo sapien
cgccattcccaaagaataaaaattasaagatcaagaaggagcagattcag

SEQ ID NO: 87106 - DNA, 50 bp, homo sapien
ctgaccattctccagtaacctaccaytgaagccaaaattactccctcaat

SEQ ID NO: 87107 - DNA, 50 bp, homo sapien
aagggctgaggcttgtggctgatggwcatattattaaggtatccctcatg

SEQ ID NO: 87108 - DNA, 50 bp, homo sapien
ctgtaattgccaaaacatcttttatyaagaaacaaaaacaaagaagaaac

SEQ ID NO: 87109 - DNA, 50 bp, homo sapien
gcagtcagtgttaatgttgaaactarggcttttatttattctactgcaaa

SEQ ID NO: 87110 - DNA, 50 bp, homo sapien
tacatgcaacaaattaacatttaccyggaaagtctgtcatggtgtatatg

SEQ ID NO: 87111 - DNA, 50 bp, homo sapien
agttagcaaagggagcctcagacgaygtagccggttggaccatcccaatg

SEQ ID NO: 87112 - DNA, 50 bp, homo sapien
atacaaatatgctgttggcattaagmagcattgagacacaatatgttttt

SEQ ID NO: 87113 - DNA, 50 bp, homo sapien
tcatacagagcagaacaagcaaaaayggacctaggatggtggaggaaatg

SEQ ID NO: 87114 - DNA, 50 bp, homo sapien
aatgaaaacaaaatataaaataaackagctgggcatagtagtgcacacct

SEQ ID NO: 87115 - DNA, 50 bp, homo sapien
gaaaatatagaatttcatagtagtayaaaaggacaggtggcaagcaccac

SEQ ID NO: 87116 - DNA, 50 bp, homo sapien
caagacaggaaggtttgttctgagayggaaatgagctaatctggtgtaag

SEQ ID NO: 87117 - DNA, 50 bp, homo sapien
taccattaggttctgacctacaaaamcacatcagagagacctgagctcac

SEQ ID NO: 87118 - DNA, 50 bp, homo sapien
attaaaattagttatcagccacttamatttttccctttccaagataaatg

SEQ ID NO: 87119 - DNA, 50 bp, homo sapien
ggtccctgctgtgtctcggcactgayggcaatgtgtacaaagcaacaagt

SEQ ID NO: 87120 - DNA, 50 bp, homo sapien
gtagaatgagctgttgattgccagcrggtcagaaccctgtgagtgacaac

SEQ ID NO: 87121 - DNA, 50 bp, homo sapien
agtagaaaaaaacttatcgaaagaaraagttgcaaatgcctttatttttg

SEQ ID NO: 87122 - DNA, 50 bp, homo sapien
tatatgcatagaaaaaaggttttaartgtcagacagaagaggagaatggt

SEQ ID NO: 87123 - DNA, 50 bp, homo sapien
tcagctctccattcctggttttatcratgtggctcgaacagggtccctga

SEQ ID NO: 87124 - DNA, 50 bp, homo sapien
tccctggtagaaattctgtatttgayggaatttggtgaaatgcattctgt

SEQ ID NO: 87125 - DNA, 50 bp, homo sapien
cctgttgaattgactattcttttccractgaattgtctttgcacccttgt

SEQ ID NO: 87126 - DNA, 50 bp, homo sapien
accatgtttcaggatcaggctcaggwtgaaatcgagtctcccctcaccag

SEQ ID NO: 87127 - DNA, 50 bp, homo sapien
gtctgcccacaactaggaagttataycacgatcaggaaattttaaaaccc

SEQ ID NO: 87128 - DNA, 50 bp, homo sapien
cctttcagtactgcaatgtactaaaygctgacctatatgtagttgtcata

SEQ ID NO: 87129 - DNA, 50 bp, homo sapien
aagcctcatgatcaaattttggcacsatctcttcaaagggaatccccctg

SEQ ID NO: 87130 - DNA, 50 bp, homo sapien
tccttccagaggggctctagtcatarattagaaacaagggcataagtagc

SEQ ID NO: 87131 - DNA, 50 bp, homo sapien
tcgagggagtctcttgtttaaaggakctcagtgttttcaggctagaaagg

SEQ ID NO: 87132 - DNA, 50 bp, homo sapien
catttctactttcttcagaataaaayaggactagtgtactcatgtccatg

SEQ ID NO: 87133 - DNA, 50 bp, homo sapien
tagatgacagctacttgattttttcrgttaccggcattctccattgaatt

SEQ ID NO: 87134 - DNA, 50 bp, homo sapien
ggccaaataatatttcagaaaaagcratagtactaacaatcttcctgttt

SEQ ID NO: 87135 - DNA, 50 bp, homo sapien
agaatgactcctgagtttttggcccraggatggaggatgggaggatggag

SEQ ID NO: 87136 - DNA, 50 bp, homo sapien
gtattctctagaatagctgctatcaytatccagttctcaacccccttctc

SEQ ID NO: 87137 - DNA, 50 bp, homo sapien
aagtggacaggaagtaggaggaaaargtttcacttcattcttatgttaga

SEQ ID NO: 87138 - DNA, 50 bp, homo sapien
ccacgtgatgtgcctttcagagatcrctgagagaatcacaaacaaaaact

SEQ ID NO: 87139 - DNA, 50 bp, homo sapien
actgatggagagctaacaccttcccragcatgcagcacatgtcttctgaa

SEQ ID NO: 87140 - DNA, 50 bp, homo sapien
ttctaaactagtgggaagcaatggamctgtttttaaggaatgatacgaac

SEQ ID NO: 87141 - DNA, 50 bp, homo sapien
cctggttaaagtcagtaaaatttcaygggtgagctgatcttttcataggg

SEQ ID NO: 87142 - DNA, 50 bp, homo sapien
agtatagtacattgtagtaaatgtgyaagaggaagtcctggtggtggata

SEQ ID NO: 87143 - DNA, 50 bp, homo sapien
ctgcggagacccagctaaagctcagmcaagggcctattacaaaatcccca

SEQ ID NO: 87144 - DNA, 50 bp, homo sapien
gcagatgtccgacaaaaaacctcccratatcatcagtgttttctttcatt

SEQ ID NO: 87145 - DNA, 50 bp, homo sapien
ctggtcctgggctgatcttggtgccsgagcaaagcagttcctgcaaatgg

SEQ ID NO: 87146 - DNA, 50 bp, homo sapien
aactaaactcctgtctctcaccataygcaaaaaatcaactcaaaatgtat

SEQ ID NO: 87147 - DNA, 50 bp, homo sapien
ttcctctacaatggagctgcagcacrcatgaatttgaggtatgtaaattc

SEQ ID NO: 87148 - DNA, 50 bp, homo sapien
cataaactgcattcacaaagaacggwaagagaaatgcatataattgtaac

SEQ ID NO: 87149 - DNA, 50 bp, homo sapien
ttctcattaggtctcttggagtaaaygatttttgcaggatagagtggaaa

SEQ ID NO: 87150 - DNA, 50 bp, homo sapien
ttgagtttaacccaatggactataayaacaacgaataccctggaatataa

SEQ ID NO: 87151 - DNA, 50 bp, homo sapien
gttagaaagaggtacattttgaatasgtacagtgttacctaacagctgtt

SEQ ID NO: 87152 - DNA, 50 bp, homo sapien
agaggtagggccaggattagatagaraacgagtaaaaaacttcagggcat

SEQ ID NO: 87153 - DNA, 50 bp, homo sapien
gagacatttttatgcttacaaaggcraattgtattcctctttttttacac

SEQ ID NO: 87154 - DNA, 50 bp, homo sapien
aaatttgagggtatgaacactgctaygttttctttgactccttctttgtc

SEQ ID NO: 87155 - DNA, 50 bp, homo sapien
ttgaaactaaaagaaaaaaattatgraagtgtctagagaataacaccttt

SEQ ID NO: 87156 - DNA, 50 bp, homo sapien
attcatttggtaaatcaattgtttayagtaacacatttaaggaaaatcac

SEQ ID NO: 87157 - DNA, 50 bp, homo sapien
tataagcaataactataaattattgrtgagtaaagagaaatcatcttaga

SEQ ID NO: 87158 - DNA, 50 bp, homo sapien
accccccaaaaagggagtttgtacakatttaccaagaaactattattatt

SEQ ID NO: 87159 - DNA, 50 bp, homo sapien
cacgtatcagagtttcacgcttagamaaaaactcccgcccgcacctgtgt

SEQ ID NO: 87160 - DNA, 50 bp, homo sapien
tagctgggataatctgctgcaataartggaagtggtttctacacctcacc

SEQ ID NO: 87161 - DNA, 50 bp, homo sapien
ctcaggtagggtcaaggcagtgaaaytatattatcagttagagtacttag

SEQ ID NO: 87162 - DNA, 50 bp, homo sapien
gaattgaattaaatgccctgtaataygataaggaaggactcagaggctgg

SEQ ID NO: 87163 - DNA, 50 bp, homo sapien
tggagccacggcactagcgtctgcaycttttagtgtcgtgtgatgacctg

SEQ ID NO: 87164 - DNA, 50 bp, homo sapien
tagacccatcttgttcttactgatcrtttataaaaggtgttacctttttc

SEQ ID NO: 87165 - DNA, 50 bp, homo sapien
tccaggcagatccagacattaaaccragaaggaagtccagaactaggcca

SEQ ID NO: 87166 - DNA, 50 bp, homo sapien
atcttgacatctcagtctaaaatcckagataaactctgcaacaacatgtt

SEQ ID NO: 87167 - DNA, 50 bp, homo sapien
tttgtaatatttatataatctcatarggggtaccttcataatgatcaaag

SEQ ID NO: 87168 - DNA, 50 bp, homo sapien
gcagggagcagggctcgaaagtcgcygagcgccgagtgcgaggagctgtt

SEQ ID NO: 87169 - DNA, 50 bp, homo sapien
gttatgcaggaaaagctaactgatgkaagacccaaggtttgattatttct

SEQ ID NO: 87170 - DNA, 50 bp, homo sapien
ctgtgtcccagcttagcaatccaaasagaaaagggagactctttttcttc

SEQ ID NO: 87171 - DNA, 50 bp, homo sapien
actgacccagtatggaggcagagacragtatagaccacaccgtcaagagg

SEQ ID NO: 87172 - DNA, 50 bp, homo sapien
agagcactggtgtttggtatatataygtttacaatggttataactttttg

SEQ ID NO: 87173 - DNA, 50 bp, homo sapien
atataaccttttggttagatttgtamgaatatgtggactataacagtttt

SEQ ID NO: 87174 - DNA, 50 bp, homo sapien
cttcctcagaagtagatttgtagaarggttgttggttggtttgtttagtt

SEQ ID NO: 87175 - DNA, 50 bp, homo sapien
tcttttaatccttacaactaccaagygaggcagagatgatgatccccgtc

SEQ ID NO: 87176 - DNA, 50 bp, homo sapien
gcctgaccttccccatcctctaactyacaagatttcaaatgaaagtaggc

SEQ ID NO: 87177 - DNA, 50 bp, homo sapien
aaaaatcacttttcaacgtggctaaytgacaagtttacagactaaaatga

SEQ ID NO: 87178 - DNA, 50 bp, homo sapien
tggacttctggtgaggaaaatgcatyatgattaaaacctttcctggattc

SEQ ID NO: 87179 - DNA, 50 bp, homo sapien
aaggattacttatgcttgctttggawagtattctgacagaaaaatataga

SEQ ID NO: 87180 - DNA, 50 bp, homo sapien
cctttgccccagaacaattagtatgyattaagtgcccaactccagtaaac

SEQ ID NO: 87181 - DNA, 50 bp, homo sapien
accaagcagtaatttccaattatacyagacagaatcgtaaaaatggaatg

SEQ ID NO: 87182 - DNA, 50 bp, homo sapien
gcctttattgctctagtttaaatctkaattcctgcaaccctcactgactg

SEQ ID NO: 87183 - DNA, 50 bp, homo sapien
ctagatacaaatgaatgagaaatacraaaccagaatatgaggctagtacc

SEQ ID NO: 87184 - DNA, 50 bp, homo sapien
ctgtggcataagttctcttgtccaamtaaaattattaataagatctatat

SEQ ID NO: 87185 - DNA, 50 bp, homo sapien
tagctgaggttgcttattagcttccraaccagttttatagtatgaaaggt

SEQ ID NO: 87186 - DNA, 50 bp, homo sapien
tctaaaatatgtaacacactcaacgrcctctgctttgttgattctgggaa

SEQ ID NO: 87187 - DNA, 50 bp, homo sapien
agttaacacccaagagcatccttcartaaggacagatgggaattggaggg

SEQ ID NO: 87188 - DNA, 50 bp, homo sapien
cataggttgtcaaggttgttaccacmaaagcaggtatcgtacactcccca

SEQ ID NO: 87189 - DNA, 50 bp, homo sapien
aagccacaaatggattcctggcccamaaagataataaatatttgttgtat

SEQ ID NO: 87190 - DNA, 50 bp, homo sapien
agaatatttgaaacaattttcaaacwatatacaatgaatgtggacttgac

SEQ ID NO: 87191 - DNA, 50 bp, homo sapien
gttagtgggtttcatttcttgcctamaacatttccaccagaccctgcccc

SEQ ID NO: 87192 - DNA, 50 bp, homo sapien
ttccaacaaatggctgatcacagttyaaagtggattgcaaccattttgca

SEQ ID NO: 87193 - DNA, 50 bp, homo sapien
gctgtgatggactttgattggttcarccgatgagaagtctcgggccaaag

SEQ ID NO: 87194 - DNA, 50 bp, homo sapien
caacaccagagatgtggtccagtcaygaagataacacaggcaggattcag

SEQ ID NO: 87195 - DNA, 50 bp, homo sapien
aacattacttcccaaatcagattaarccaaagggggaacagaccttcaca

SEQ ID NO: 87196 - DNA, 50 bp, homo sapien
tccttaagtagtgaaatcacatctgrtacagaagctgcaattggagtcaa

SEQ ID NO: 87197 - DNA, 50 bp, homo sapien
gcatgctgggaagtgggaagctcgcrgcctactgagaaggtgggtgttaa

SEQ ID NO: 87198 - DNA, 50 bp, homo sapien
tgatctgtcttcaaatttgctgataytttcttccgcctgctcagatctgc

SEQ ID NO: 87199 - DNA, 50 bp, homo sapien
gtctcacccccacagcgcgggttccrcctcagtcctgtgtctcctacctc

SEQ ID NO: 87200 - DNA, 50 bp, homo sapien
tctctgcatactctagggggacaaakatagagtcaggagtggatcccagg

SEQ ID NO: 87201 - DNA, 50 bp, homo sapien
cctaatcaccccataaaggccttcgmtgcgttgaggatgaggtttcagca

SEQ ID NO: 87202 - DNA, 50 bp, homo sapien
gtctggagtcaatgcctattctcaartcaactctattgtgcacaccaatc

SEQ ID NO: 87203 - DNA, 50 bp, homo sapien
catggccataatcaaaatcatggacrcaatcgaatcacaaagcatgtctt

SEQ ID NO: 87204 - DNA, 50 bp, homo sapien
ccctccccaccttcccgtgttgggaycatccagctaaggctaccgtgttg

SEQ ID NO: 87205 - DNA, 50 bp, homo sapien
ttgcctcattaaatacttgtactgayggggatatcaaagcttgcactcca

SEQ ID NO: 87206 - DNA, 50 bp, homo sapien
acacgggaaggtggggagggctataytaaaatcagtccttccaccagtga

SEQ ID NO: 87207 - DNA, 50 bp, homo sapien
caagaggacaggagccatgcttcackactctggaggtggcagttctcggc

SEQ ID NO: 87208 - DNA, 50 bp, homo sapien
agaaagatgcaggaagccataggcaygaatggaaactggggagacctcca

SEQ ID NO: 87209 - DNA, 50 bp, homo sapien
aagctgagtgtgtgagctatgaggasaacaccacaagaaagagtatccag

SEQ ID NO: 87210 - DNA, 50 bp, homo sapien
gcctttattttcaacaagtttatcayatgtctagactaattatatatttt

SEQ ID NO: 87211 - DNA, 50 bp, homo sapien
agactggcaacgaacaagatcaatarccagtgtgatgtcagtggtgacag

SEQ ID NO: 87212 - DNA, 50 bp, homo sapien
gactttcagacagaggaaacagtacrtgcagaggccacaggccagagcct

SEQ ID NO: 87213 - DNA, 50 bp, homo sapien
gttgtggtttatgtttcacttcgacytggaggccagtggaggatttgagc

SEQ ID NO: 87214 - DNA, 50 bp, homo sapien
gtagctgcgcatccattgatgattcyaaggtgaaactgcacagtgtggtt

SEQ ID NO: 87215 - DNA, 50 bp, homo sapien
cgcagtctttctctcatgctcttgamgttcgtgatgagtactcattagtc

SEQ ID NO: 87216 - DNA, 50 bp, homo sapien
gtaggaggaattaacattccttattmtacaagagaggcccttccttggaa

SEQ ID NO: 87217 - DNA, 50 bp, homo sapien
ggcttgatgtttccctccagtcttcrcctccatcttcacatggtgttaat

SEQ ID NO: 87218 - DNA, 50 bp, homo sapien
tttgaaaaggaaggaaactcatataratgtaggaggaattaacattcctt

SEQ ID NO: 87219 - DNA, 50 bp, homo sapien
tcaatcatctatgcctgttcttgtaygaaccaaatgaagacttctactgg

SEQ ID NO: 87220 - DNA, 50 bp, homo sapien
ttgttttgattctgtgttacaacgamcaagcctatatcttgatagacaag

SEQ ID NO: 87221 - DNA, 50 bp, homo sapien
aaaccactattattagtcatatccarggacagcttagagcattgttgggc

SEQ ID NO: 87222 - DNA, 50 bp, homo sapien
tcccttttctagagctctaaggccaygtaaaccaagcttcgccaatagct

SEQ ID NO: 87223 - DNA, 50 bp, homo sapien
ctgctgttccaataatgtctctaacyaccttacatgctcagtaaatgtct

SEQ ID NO: 87224 - DNA, 50 bp, homo sapien
tccaatcctcagggtgcattgtttcmaactaaacagtaatcatttcaata

SEQ ID NO: 87225 - DNA, 50 bp, homo sapien
taaggcaaactatattaagtgtctamgtataactgaactttgtaggttaa

SEQ ID NO: 87226 - DNA, 50 bp, homo sapien
agataaattcacaaatgaaatggaamatgatatctgtgtatatccaagaa

SEQ ID NO: 87227 - DNA, 50 bp, homo sapien
tggtaggaatcacatgaataaccaartatcacataaaagcctttataaga

SEQ ID NO: 87228 - DNA, 50 bp, homo sapien
aaaaatagtcaattcaagtaaagaarcatgatgggccagtgatcagagcc

SEQ ID NO: 87229 - DNA, 50 bp, homo sapien
gggcccagcgtcagggacctacttamccttgcagagacactgagaggaca

SEQ ID NO: 87230 - DNA, 50 bp, homo sapien
ggagatgaggtgaggaagcctaaaarttagcattttgttttctgctgaca

SEQ ID NO: 87231 - DNA, 50 bp, homo sapien
gggagattataggctgtgcagttcayaggaaagttttgatttctgatact

SEQ ID NO: 87232 - DNA, 50 bp, homo sapien
gtttatatcaggcatttaatacatgycaaattttccaattaagattactt

SEQ ID NO: 87233 - DNA, 50 bp, homo sapien
atgttggtcatgagcttgacaatgawccctacagccacagatcagagggg

SEQ ID NO: 87234 - DNA, 50 bp, homo sapien
tcctcaggaatccacagagcttcagmcatttacactgtttccagagatgt

SEQ ID NO: 87235 - DNA, 50 bp, homo sapien
acctaaacacgtggctctgactctckgagactactctgtttctcagcatc

SEQ ID NO: 87236 - DNA, 50 bp, homo sapien
gctatttgctgggctccccaggcaamaagaaggcataataattgtcaata

SEQ ID NO: 87237 - DNA, 50 bp, homo sapien
taggccaggttaatttcattggctcratcaggtatggccatggcccacca

SEQ ID NO: 87238 - DNA, 50 bp, homo sapien
ttgtgatctcctcacacagaggctaytaagagttggcagactgcattatc

SEQ ID NO: 87239 - DNA, 50 bp, homo sapien
tccttattaaatgtcaccaatagaartctgagtaagtgaaaacctatact

SEQ ID NO: 87240 - DNA, 50 bp, homo sapien
aatgtagtatatgctatttttgacaytgaattggcattttcacattttca

SEQ ID NO: 87241 - DNA, 50 bp, homo sapien
accacttatgaaaaaggttcactcayaatagaactgacaatatcccagag

SEQ ID NO: 87242 - DNA, 50 bp, homo sapien
gagtctagagtagacgagttaccctktcttcttccatgtaccaggagtag

SEQ ID NO: 87243 - DNA, 50 bp, homo sapien
gatatgataatttagaaaatctaagraaatcaagtgacaaattattagaa

SEQ ID NO: 87244 - DNA, 50 bp, homo sapien
ctgagttggcttgagcatgccttatrttccagcgagggcaagtagaatag

SEQ ID NO: 87245 - DNA, 50 bp, homo sapien
tcaggcctgagaatgtgtgtttcaartaagttcccacgtgatgctgatgc

SEQ ID NO: 87246 - DNA, 50 bp, homo sapien
tggaagtcacatcctctcttggagcrgctattcaagctgaaagcctttgc

SEQ ID NO: 87247 - DNA, 50 bp, homo sapien
agaaatcatctagagacttcataccragagactggttaagtaaattccta

SEQ ID NO: 87248 - DNA, 50 bp, homo sapien
cattaatttgtacatctggaaaaaawtatccatcatttgttattgtagga

SEQ ID NO: 87249 - DNA, 50 bp, homo sapien
actagagcaacagatactgcagttcracattgaaaaacacattctactta

SEQ ID NO: 87250 - DNA, 50 bp, homo sapien
ccattcgcaggacaaattcattgacygaaactatccctgaggaagcccaa

SEQ ID NO: 87251 - DNA, 50 bp, homo sapien
tcttgaactcttttattaattctaayagtctgcacatcttctagaatttt

SEQ ID NO: 87252 - DNA, 50 bp, homo sapien
aaggtatcttggtcaccttgattagmactctaaatgtgtttaatgtgtgt

SEQ ID NO: 87253 - DNA, 50 bp, homo sapien
ccaatcccattcctgaagatactaaratccctaaagtgaatatgacctca

SEQ ID NO: 87254 - DNA, 50 bp, homo sapien
attttcacttaatctttctgtgactrttacctgcctgacaaactcctatt

SEQ ID NO: 87255 - DNA, 50 bp, homo sapien
gtaaaccctggaatgatagagtaaargtcatgtccagtgattttcatttc

SEQ ID NO: 87256 - DNA, 50 bp, homo sapien
aaataaatagataatgtctgcaatcrataactttaaaatagcacattatg

SEQ ID NO: 87257 - DNA, 50 bp, homo sapien
tttctctttcagctctgaaagcaacrctaggtatgtgaaaagggaacgta

SEQ ID NO: 87258 - DNA, 50 bp, homo sapien
aatacaatcacacataagttaccccrcttggctgacagccaagaaaaatg

SEQ ID NO: 87259 - DNA, 50 bp, homo sapien
atttgttttttcctatctcacacaayggtcatctctctacccttgacttc

SEQ ID NO: 87260 - DNA, 50 bp, homo sapien
gtcttgcgctgctttctgaattcacyggttacctcggcactgtcttcttt

SEQ ID NO: 87261 - DNA, 50 bp, homo sapien
cctgtggggttaaattcatcagggtmaaagttttgtcctaactaagcaac

SEQ ID NO: 87262 - DNA, 50 bp, homo sapien
cacagaacccaaacaactaaggcatratcaataaaataatagatgcatat

SEQ ID NO: 87263 - DNA, 50 bp, homo sapien
agcagaggaaaaagataattttcatragaaccagatatgatctatttctt

SEQ ID NO: 87264 - DNA, 50 bp, homo sapien
cctctgcacaacctcagcttagaagragtatattagtcagcgttcttcag

SEQ ID NO: 87265 - DNA, 50 bp, homo sapien
tattacaccatttgtatagaaaattraatcttatgcatattataaaaaag

SEQ ID NO: 87266 - DNA, 50 bp, homo sapien
aaataactctggcaagagatgtccayaaactggggctaaaaaataatccc

SEQ ID NO: 87267 - DNA, 50 bp, homo sapien
ccatgtcctgagtcaagaactggccragctaagacaagaccaacacagct

SEQ ID NO: 87268 - DNA, 50 bp, homo sapien
tgaccgcaatctgcatgaagctaaayggttatgtgatgacatactggttt

SEQ ID NO: 87269 - DNA, 50 bp, homo sapien
tttaacatcatgtatgagtatatctkaaaattatcttcctaacaaaacca

SEQ ID NO: 87270 - DNA, 50 bp, homo sapien
atggcttgtctcacaaaatgctcacygaataagctgttatcactgtttat

SEQ ID NO: 87271 - DNA, 50 bp, homo sapien
ccttctttatgttactagcttctaaytcaaaatctgagtgcttcatctga

SEQ ID NO: 87272 - DNA, 50 bp, homo sapien
aaaagggtcttgagctttagaattayactgtcccaagtacagatctaagc

SEQ ID NO: 87273 - DNA, 50 bp, homo sapien
cttcttgctgaaccagctgaatctarggactgagtagtaaccggccacac

SEQ ID NO: 87274 - DNA, 50 bp, homo sapien
ctcagggtaaattccttactccacartcacatttatctgatcttccagac

SEQ ID NO: 87275 - DNA, 50 bp, homo sapien
ggccagaatcatcggaatgcgatgaygtgtactttcaaaaattttccagg

SEQ ID NO: 87276 - DNA, 50 bp, homo sapien
aaagcttagaagttgctgcttaaagwcttggtaagaagaatgacagcaaa

SEQ ID NO: 87277 - DNA, 50 bp, homo sapien
tcaaagctacatacaactggttctcraattcttttttttttatacagagt

SEQ ID NO: 87278 - DNA, 50 bp, homo sapien
atgaagtgtccagaaagttctctcckcttcactaagcactaaatgtaatg

SEQ ID NO: 87279 - DNA, 50 bp, homo sapien
agtaatttttttttctcccttggaaktgatcaaagctacatacaactggt

SEQ ID NO: 87280 - DNA, 50 bp, homo sapien
gttccaaaaggtttccttggacaggkaagtagcaactcacaagccccaca

SEQ ID NO: 87281 - DNA, 50 bp, homo sapien
ctcactccattacttgccgaatacaytgggagaaacacgccccttctctt

SEQ ID NO: 87282 - DNA, 50 bp, homo sapien
cctactatcctcttctttagtaacasaatctccttttttttagctgggta

SEQ ID NO: 87283 - DNA, 50 bp, homo sapien
tgcagtaacacaaggtaagtggagcratgtctctatgtcagagaagttat

SEQ ID NO: 87284 - DNA, 50 bp, homo sapien
ttgcagcaatgtgcttgaaaaaccayaatctctacctggataaatatctt

SEQ ID NO: 87285 - DNA, 50 bp, homo sapien
aaatgctgacatctgaccgcttgttyactttatgtgtcaactcctgggct

SEQ ID NO: 87286 - DNA, 50 bp, homo sapien
gctggtgacattgctactgagtcccraaagaaggaagaaagcaaactggt

SEQ ID NO: 87287 - DNA, 50 bp, homo sapien
tgtttccacccacctatttactaacyattcaatccctttactcacctatc

SEQ ID NO: 87288 - DNA, 50 bp, homo sapien
ttatgatggttagactttgagcaacrctgggattcttctctgggtcctat

SEQ ID NO: 87289 - DNA, 50 bp, homo sapien
tgtttttgaaatcaagagagcccaasaaatcttagggaagtgctggctga

SEQ ID NO: 87290 - DNA, 50 bp, homo sapien
tggttagagacctctggagaaataaygatgagatcactgcatcttttgtt

SEQ ID NO: 87291 - DNA, 50 bp, homo sapien
ggggacctctttgagggtaataacakaattggaaccatgccactcttgag

SEQ ID NO: 87292 - DNA, 50 bp, homo sapien
cggcagcatagtggtcagaagtgacragataagtgtgaagcaaggatgat

SEQ ID NO: 87293 - DNA, 50 bp, homo sapien
cataaggggtgcatgtgtgtgtatayagtaaggcaagtttatcctaaaat

SEQ ID NO: 87294 - DNA, 50 bp, homo sapien
atgccagacgaggtgagtccttggcygccggacagggcataatagctctt

SEQ ID NO: 87295 - DNA, 50 bp, homo sapien
tcatgaaagaaaccatgagggggtamatttcagttcagtgtacaaataac

SEQ ID NO: 87296 - DNA, 50 bp, homo sapien
actcagtggtagcaccctctctaaaycttgccacagtccccactactccc

SEQ ID NO: 87297 - DNA, 50 bp, homo sapien
aattgcagtttacttccgtgctcccraagaaacccagtgttaattcatcc

SEQ ID NO: 87298 - DNA, 50 bp, homo sapien
gcggctttatttttcttgcctatgaraaaaggtagcagacagtacatttt

SEQ ID NO: 87299 - DNA, 50 bp, homo sapien
ggttaacaaccattattgagtacctrttgatatgtgtggtgtactgagtt

SEQ ID NO: 87300 - DNA, 50 bp, homo sapien
cagagatgccctcagctgtcaatacratggaactatattcacaggtcatc

SEQ ID NO: 87301 - DNA, 50 bp, homo sapien
cctcattcttgatcgcatgtaaaacragggcccatcatttggtcaatcaa

SEQ ID NO: 87302 - DNA, 50 bp, homo sapien
tcaattcattcatgtaattaaccagraggaattgtgatataagaaaagaa

SEQ ID NO: 87303 - DNA, 50 bp, homo sapien
attccctggcgttcctctcattcaasatgatcaaaatcatggaggcagga

SEQ ID NO: 87304 - DNA, 50 bp, homo sapien
ccctcctgcatccctcttataggaamccttgtgattacactgagccttct

SEQ ID NO: 87305 - DNA, 50 bp, homo sapien
ccttgggttgtatattcctatccttytgtggacagtgaaacccctgccat

SEQ ID NO: 87306 - DNA, 50 bp, homo sapien
attttgatgcaggaatgttaactccracgtctatgaatatctgccagcag

SEQ ID NO: 87307 - DNA, 50 bp, homo sapien
gcctgaccccagagctttacggtgartcacagcctgtccctgtccctgga

SEQ ID NO: 87308 - DNA, 50 bp, homo sapien
gttttccctactgggtgccagatacrtacaaagccagagaaactcttcaa

SEQ ID NO: 87309 - DNA, 50 bp, homo sapien
tattagatctcttaaaatcgtcctayagatcactaatgcttttctccatt

SEQ ID NO: 87310 - DNA, 50 bp, homo sapien
caacaaaagaagccattcagtagacwggggtaaactgccagcaaagtaag

SEQ ID NO: 87311 - DNA, 50 bp, homo sapien
aagaaagagagagggagcgtgctctsgaattgaatgccatgaagggttca

SEQ ID NO: 87312 - DNA, 50 bp, homo sapien
ctcattgtcagtttaattactggtayatacaggacggaagagacagagag

SEQ ID NO: 87313 - DNA, 50 bp, homo sapien
atttgaaaagcaaacagtagcaacartattcttttaaaatggcttttatt

SEQ ID NO: 87314 - DNA, 50 bp, homo sapien
actggatgccaggtttccagatgcaygtagccaggcacttcataggtgag

SEQ ID NO: 87315 - DNA, 50 bp, homo sapien
atgttggaaattctactagctaccaygaagagtaaaactgcccacatggt

SEQ ID NO: 87316 - DNA, 50 bp, homo sapien
ctatttaactactataccagcagtayatgattttgtgtttatgatgaaaa

SEQ ID NO: 87317 - DNA, 50 bp, homo sapien
atcaataaatagtagctgctcttaawcattctatttcttaaccaataaga

SEQ ID NO: 87318 - DNA, 50 bp, homo sapien
gtcagtttagtaaaatagttaataarcatctaaaaatgtgatcaacttca

SEQ ID NO: 87319 - DNA, 50 bp, homo sapien
aggagacagagttgactgaatgaacycttctattatcaacatatgatatc

SEQ ID NO: 87320 - DNA, 50 bp, homo sapien
caagtatttcccggggaaatcactcygacaaataagctttcctgggggca

SEQ ID NO: 87321 - DNA, 50 bp, homo sapien
actgtcagaaaccttttggtatgtcwcatcttactcacctttatacgttc

SEQ ID NO: 87322 - DNA, 50 bp, homo sapien
tgtaactgtctcagcagtctgtatgrcctctaattcttatcctgcaggca

SEQ ID NO: 87323 - DNA, 50 bp, homo sapien
ctcatctacagcccagagaattcctraaagagttggccaccatctcttca

SEQ ID NO: 87324 - DNA, 50 bp, homo sapien
tcaggaccatagcttttgggtagtarcattccttcaactcaagactctgc

SEQ ID NO: 87325 - DNA, 50 bp, homo sapien
gtcttggatgattaatgtgcaaagaytaccaccctaaattgatggccatg

SEQ ID NO: 87326 - DNA, 50 bp, homo sapien
ttaaatgaatcaaatagatctcttcracctttagagaaccttccacagtg

SEQ ID NO: 87327 - DNA, 50 bp, homo sapien
taggtatgtaccacatttgagtttasagtactgctttttattagggttta

SEQ ID NO: 87328 - DNA, 50 bp, homo sapien
gcttgggtccagattcagataccccratggttctgactgggttctggttc

SEQ ID NO: 87329 - DNA, 50 bp, homo sapien
catacctaattttaacctactggaaygtatagcctattaactgccttgga

SEQ ID NO: 87330 - DNA, 50 bp, homo sapien
gaacagtaagagcagacaaaacggasgattctggtgtaccgggtgggggg

SEQ ID NO: 87331 - DNA, 50 bp, homo sapien
gagggctctgaagtctgataatacgraagggaataattctcattggagtt

SEQ ID NO: 87332 - DNA, 50 bp, homo sapien
acagaggagaggaatggtttagactsaacacttagccaggagctgagcct

SEQ ID NO: 87333 - DNA, 50 bp, homo sapien
ttaagactgaaccagtgaactctaartatgtagtagtagaaaatatcact

SEQ ID NO: 87334 - DNA, 50 bp, homo sapien
ctaataactttctaatgggtatatcmaggagcttaattccaacaacaatc

SEQ ID NO: 87335 - DNA, 50 bp, homo sapien
aggagcttaattccaacaacaatctkactgtgtactgttcttaaactggt

SEQ ID NO: 87336 - DNA, 50 bp, homo sapien
aacagatgtttgttctaaaacactgraatgttacagggtgacctaattta

SEQ ID NO: 87337 - DNA, 50 bp, homo sapien
aaaaaagattcagaaacagaccccartacacagttttgtatgtaacaatg

SEQ ID NO: 87338 - DNA, 50 bp, homo sapien
attgaatcagttccttttaaagttayccatattttctgctctttagtcaa

SEQ ID NO: 87339 - DNA, 50 bp, homo sapien
ctcagagcgtagcccaaggcgtgcawatgtaaacacctgtaatgtaatga

SEQ ID NO: 87340 - DNA, 50 bp, homo sapien
gattctggatatgtggaccattcagkatgaccttttgttaaggactcaga

SEQ ID NO: 87341 - DNA, 50 bp, homo sapien
ctggaaatttacaagaagtgttttcrattttgacagccattcactcatta

SEQ ID NO: 87342 - DNA, 50 bp, homo sapien
taggagttattagaaaacatccgaargaaaagatgaacagatttgatgac

SEQ ID NO: 87343 - DNA, 50 bp, homo sapien
atgtttagaagaactgagtaaatgayggagatcacgtttccattagagga

SEQ ID NO: 87344 - DNA, 50 bp, homo sapien
ctctcctgctgaggaattcctgataygaactgtcaaacatccacatcctt

SEQ ID NO: 87345 - DNA, 50 bp, homo sapien
ccatcatttactcagttcttctaaayattgggccctaaatatgtggatta

SEQ ID NO: 87346 - DNA, 50 bp, homo sapien
gtcatctctatccccatctcttggcytcaacctgtcctggcccatggggc

SEQ ID NO: 87347 - DNA, 50 bp, homo sapien
gccatggggctgcagattgaagtccyggaagaaaaaatgagaaggaggcc

SEQ ID NO: 87348 - DNA, 50 bp, homo sapien
gaatgagtctggcacctgtgaagatraggaatagatatctctgaatagat

SEQ ID NO: 87349 - DNA, 50 bp, homo sapien
atcaataaagctggcaaaaaaggaakgtattcacctatgtaccagatgct

SEQ ID NO: 87350 - DNA, 50 bp, homo sapien
gtcaataacagatatgtttttgtaayagaatgttgaagggtggtaactgg

SEQ ID NO: 87351 - DNA, 50 bp, homo sapien
atgtaatttcaaccttcagagaaagrcattcttcctatcttacagataag

SEQ ID NO: 87352 - DNA, 50 bp, homo sapien
tgggctacgctctgagaagagcaaasagatttcagtgaaaaagcctccat

SEQ ID NO: 87353 - DNA, 50 bp, homo sapien
atgaagaaaaaaatgtgaaatagcasgttacaaaacagcgtacatagaat

SEQ ID NO: 87354 - DNA, 50 bp, homo sapien
taagagcccagtgccatcagtggaawagtaaagaggcccgcatttattga

SEQ ID NO: 87355 - DNA, 50 bp, homo sapien
atggcagagctgaactttaatgatarcaaactgattaaaaagcattggct

SEQ ID NO: 87356 - DNA, 50 bp, homo sapien
ggttaatgcgcagctgcaattgccamcccaaagggatacccatgatgctt

SEQ ID NO: 87357 - DNA, 50 bp, homo sapien
acgagtgcccttttgttacccagaartatggtggcatccctccaccttca

SEQ ID NO: 87358 - DNA, 50 bp, homo sapien
cacactccaaattgtgcaccaaagtrtcatcctagttttgtgaggatggt

SEQ ID NO: 87359 - DNA, 50 bp, homo sapien
gtgacaaactgcacgacaatggctcyaggtcctgactgatcccttatgtt

SEQ ID NO: 87360 - DNA, 50 bp, homo sapien
cctgctggagcatgagaggctcatgwagaactcagttgccctggctgcct

SEQ ID NO: 87361 - DNA, 50 bp, homo sapien
tgcttccacctactctgagggatcayaaaggacctgtctctaacagatcc

SEQ ID NO: 87362 - DNA, 50 bp, homo sapien
cagtaccttggattaacaaaaattcygaaagtcttgctagcaatctaatt

SEQ ID NO: 87363 - DNA, 50 bp, homo sapien
gggcctcctgagccttttgtttcaargacatggaatgggttttctcagcc

SEQ ID NO: 87364 - DNA, 50 bp, homo sapien
tagggttactagcatcccaggtttcratgtcaacaagacctggattacaa

SEQ ID NO: 87365 - DNA, 50 bp, homo sapien
tacacacgtgcacacaaaatacgtaygaaatgcacatcatggcccccaaa

SEQ ID NO: 87366 - DNA, 50 bp, homo sapien
caaatgacttcctctttgccagatcsatttactttggtttgaccttcctc

SEQ ID NO: 87367 - DNA, 50 bp, homo sapien
tccaggttgttcctgcaatgttatgyaatgtgagtggagctttctaacaa

SEQ ID NO: 87368 - DNA, 50 bp, homo sapien
tttctgatggcatagcttttggatcratcattctctttttttgctctgtc

SEQ ID NO: 87369 - DNA, 50 bp, homo sapien
aaaaaaaaaaaaaaaaaaagcctccraaagaatgcccaagaaattggtaa

SEQ ID NO: 87370 - DNA, 50 bp, homo sapien
agaagtttctagattctttactgcayggtgcccacagaagaggccaataa

SEQ ID NO: 87371 - DNA, 50 bp, homo sapien
ggtggtggatcaagtgtagttttaaraagcatattcgaaaattacttttt

SEQ ID NO: 87372 - DNA, 50 bp, homo sapien
gaattgacccaaatcatttctcctaygagcaagctgtgactgaactctcg

SEQ ID NO: 87373 - DNA, 50 bp, homo sapien
gggtgggtcctctggaggaaaaatcrtctttccaaatggaaagatgaatg

SEQ ID NO: 87374 - DNA, 50 bp, homo sapien
ttatcagttggttttcacttttaagkagtttctgtatttcacattatatt

SEQ ID NO: 87375 - DNA, 50 bp, homo sapien
ctaatagtcttttttttcaacctagkagtctcattatttgtttaggatca

SEQ ID NO: 87376 - DNA, 50 bp, homo sapien
actgtcccctttactgccctgaagaktcagcctgcggaagacagggggtt

SEQ ID NO: 87377 - DNA, 50 bp, homo sapien
tctttgaaaatggtctcttgattgasattgcccttggtctttcctgcata

SEQ ID NO: 87378 - DNA, 50 bp, homo sapien
tagcagaaatagtagtgctaatctaytaagtaacaagcatacattgagta

SEQ ID NO: 87379 - DNA, 50 bp, homo sapien
gctagtaccgtacaagagtcattcaragaacatactaaatatagattcct

SEQ ID NO: 87380 - DNA, 50 bp, homo sapien
ttaaaaatatcaattactgaaaaacygatacgcttttcagtgtatttgta

SEQ ID NO: 87381 - DNA, 50 bp, homo sapien
aagggtcaatgaaactgatcaagcayatactatagaccagagctgcctaa

SEQ ID NO: 87382 - DNA, 50 bp, homo sapien
gcggactcgccaccgataatattctsactacaaaagtgttactgaaaaga

SEQ ID NO: 87383 - DNA, 50 bp, homo sapien
aactgcattggttcttgggatttgawtaaagtggctatttctagagttgg

SEQ ID NO: 87384 - DNA, 50 bp, homo sapien
gtcatcatttgcttctattttgagcsttttttgactttcttttagtcttt

SEQ ID NO: 87385 - DNA, 50 bp, homo sapien
tacaaccaggaaaggaatccctaacrcacaacttctctctgtggagagga

SEQ ID NO: 87386 - DNA, 50 bp, homo sapien
gagttggagctgttacctttcaggakgaagagttcagtcctgcaaccagt

SEQ ID NO: 87387 - DNA, 50 bp, homo sapien
aggatcataaacatttattttaaacsaatttcaagatttttattaagcat

SEQ ID NO: 87388 - DNA, 50 bp, homo sapien
cccacttcaatcactttaacactgayacaatattttaaccaatccattct

SEQ ID NO: 87389 - DNA, 50 bp, homo sapien
cttcctaacactgaatctgcgtctcrgaaacaaagataccatcttttgtc

SEQ ID NO: 87390 - DNA, 50 bp, homo sapien
attacgaatatttcctagccgattcmaatacacggggagacactcttaat

SEQ ID NO: 87391 - DNA, 50 bp, homo sapien
agaatggcaatacctggcataagatwagtactcaggaagtaagtgttgaa

SEQ ID NO: 87392 - DNA, 50 bp, homo sapien
aatatgagaacaggtccattctcatraggttcactagatttacttgtttg

SEQ ID NO: 87393 - DNA, 50 bp, homo sapien
ctactccacaattatcgataaaatasacattaggtgaagtgcaattgcta

SEQ ID NO: 87394 - DNA, 50 bp, homo sapien
gtatgtttactgaggcttcatgcccraagaatcaaatccaataactgaaa

SEQ ID NO: 87395 - DNA, 50 bp, homo sapien
ttttaggaatggtgtgttggttactraaaagtctgtttatttaaccaaaa

SEQ ID NO: 87396 - DNA, 50 bp, homo sapien
attgatctatctgcattagttgagartatagcttgtggtttgttctccaa

SEQ ID NO: 87397 - DNA, 50 bp, homo sapien
gatatcaataatgattgcctttacayacactgatgcattacatggatagg

SEQ ID NO: 87398 - DNA, 50 bp, homo sapien
tctgtcttgaaattcaagtctctgarctctaagacctggacgcaggccaa

SEQ ID NO: 87399 - DNA, 50 bp, homo sapien
ccagtaatctaagaatgaccaaatawcaccttagatgagctctctccttc

SEQ ID NO: 87400 - DNA, 50 bp, homo sapien
atagatctgagctggccagacccacrgcttgaatagagatgctctgctaa

SEQ ID NO: 87401 - DNA, 50 bp, homo sapien
caaaagcaattccaaactctcaaaakcaattatgcatcatattatatcct

SEQ ID NO: 87402 - DNA, 50 bp, homo sapien
cagtatctttctgaaggaactaatakaacctaggccatgccccttacagc

SEQ ID NO: 87403 - DNA, 50 bp, homo sapien
tgagagctgttattattactgtcacrcagcaaggacaaataacattctca

SEQ ID NO: 87404 - DNA, 50 bp, homo sapien
tagcgatgaaaactcaacagttcacrataaaactgacttttaaaatgctc

SEQ ID NO: 87405 - DNA, 50 bp, homo sapien
taatcatctgactttaatttattctsaaggccaggaagatagaaggagaa

SEQ ID NO: 87406 - DNA, 50 bp, homo sapien
gttcagtggcattaaatatgttcacrccattatgcagccatcaccagcag

SEQ ID NO: 87407 - DNA, 50 bp, homo sapien
atctctagattacaagtcaagtaaarcatttcttaggcaaataaaatcat

SEQ ID NO: 87408 - DNA, 50 bp, homo sapien
ttccactcctaaccaaatcttaaccygagactgactcattcaatctatct

SEQ ID NO: 87409 - DNA, 50 bp, homo sapien
aatatcttgtctatttatggttataycacctttctcttttttaatatgtt

SEQ ID NO: 87410 - DNA, 50 bp, homo sapien
tatgatttttagctttatttggaaaraaataacatgatatacccatacaa

SEQ ID NO: 87411 - DNA, 50 bp, homo sapien
ggcccaaagctgcatagcggattaaygacacacacaagattgagcttttc

SEQ ID NO: 87412 - DNA, 50 bp, homo sapien
ctggcctttcttttcatattcaaatrctctgcttggttccgcattgccaa

SEQ ID NO: 87413 - DNA, 50 bp, homo sapien
gtgattggctttgtctacattgttamataattgcaactgatcatacatgt

SEQ ID NO: 87414 - DNA, 50 bp, homo sapien
gaactgagatttgaacctaggctgcytggcttcagggtctatgctcttaa

SEQ ID NO: 87415 - DNA, 50 bp, homo sapien
ccaggtcaggggtctaagagaaggarcaaaatgaaacagaacctgtacct

SEQ ID NO: 87416 - DNA, 50 bp, homo sapien
atgttgggcttcatcttgcttggaawaccttgtctgagagctgagccgac

SEQ ID NO: 87417 - DNA, 50 bp, homo sapien
caagatcatttttaaaacaaaaggargtatggagttctatctaaaataga

SEQ ID NO: 87418 - DNA, 50 bp, homo sapien
aaacagatcatcatgtacctaattayatcattgcaattgtggtaattgct

SEQ ID NO: 87419 - DNA, 50 bp, homo sapien
agacacgttctattttacctaagaakgagcaatcatagaagtccaatgat

SEQ ID NO: 87420 - DNA, 50 bp, homo sapien
attacaaatatatgtatcaggtcaaygaaagtgcaattatctggataaat

SEQ ID NO: 87421 - DNA, 50 bp, homo sapien
tagtcctcatacaatcactttgcatsaaaagtaaacctaagtcactcttc

SEQ ID NO: 87422 - DNA, 50 bp, homo sapien
ataggttggcagttgttgaagatgayggagtgagttggtgtggagggaag

SEQ ID NO: 87423 - DNA, 50 bp, homo sapien
gtgatcagagtcagggatcagtatgyaactagggttaaggatcagtgtgt

SEQ ID NO: 87424 - DNA, 50 bp, homo sapien
gctcatttcatacattcattcatcaratagtcactgaaaatatattttaa

SEQ ID NO: 87425 - DNA, 50 bp, homo sapien
gtaacctagctaacagtgttttacaratgtcagtcttctggtttttatat

SEQ ID NO: 87426 - DNA, 50 bp, homo sapien
gcatgcacttgcctaagtactttaaytgtagctttcaagccttctggact

SEQ ID NO: 87427 - DNA, 50 bp, homo sapien
ggtaaaaatagtgaccatgaactcaratccatactagtgaaagagctaag

SEQ ID NO: 87428 - DNA, 50 bp, homo sapien
caaaaataccatataaaactttgaarggtaatgagaatgtggcaaaaaaa

SEQ ID NO: 87429 - DNA, 50 bp, homo sapien
ggtttggccatgtcaccgcgaactargtccgagcccagagagttggactg

SEQ ID NO: 87430 - DNA, 50 bp, homo sapien
tctcccctcagtgggacgattctgayttgcgtcctggaagacttgacatc

SEQ ID NO: 87431 - DNA, 50 bp, homo sapien
ctaccccatactaggtgccttacatwaattatttttaatcttcacagtaa

SEQ ID NO: 87432 - DNA, 50 bp, homo sapien
ccttcggcggtaggaactatggcacyctcagagtttatcacctatgtaac

SEQ ID NO: 87433 - DNA, 50 bp, homo sapien
gtctcaagccagttgtgtgtgttccyactgataactcaaaccttagtcta

SEQ ID NO: 87434 - DNA, 50 bp, homo sapien
ccttcattcctcaatctccaaaacaraataatgtctaactttcctcacag

SEQ ID NO: 87435 - DNA, 50 bp, homo sapien
tatccagtaactattggctttcctakagatttgtttcacaaaaacaaaaa

SEQ ID NO: 87436 - DNA, 50 bp, homo sapien
aaaatattgcgttaattaaaatgcamacaggttataaacaattttttgtt

SEQ ID NO: 87437 - DNA, 50 bp, homo sapien
aactgtgattcaacactgagtgctcrcttggaaaggaggtggagctcaac

SEQ ID NO: 87438 - DNA, 50 bp, homo sapien
ctgtaggtctgctttgggaagaaaaygtctgtattgaaaggactgggttt

SEQ ID NO: 87439 - DNA, 50 bp, homo sapien
aattcatgaataaatgaactcaagtraattaagggaaattagcccatagt

SEQ ID NO: 87440 - DNA, 50 bp, homo sapien
tatacagtgtcctattaaggagaaawtatagcagagtaagggggtggaga

SEQ ID NO: 87441 - DNA, 50 bp, homo sapien
ggatatctaatcagaaataaaataayatgcaacaggcaaacaatgcctta

SEQ ID NO: 87442 - DNA, 50 bp, homo sapien
aatgccacaaagttccagctcagagyacccaactaagtgaagcaatctgc

SEQ ID NO: 87443 - DNA, 50 bp, homo sapien
cctgattttgtcttgttctctttccrtctgggtctaggttctactgcagg

SEQ ID NO: 87444 - DNA, 50 bp, homo sapien
ttagtgtaggtatgggaaatttcttyaaaaatcaacaatattcttgtctg

SEQ ID NO: 87445 - DNA, 50 bp, homo sapien
gcaggagaagtagagagaaccgtgtrggagactcctgcagtcatttgggg

SEQ ID NO: 87446 - DNA, 50 bp, homo sapien
gtctagacctacccacctggcaaaaytttagttgggtcatctttttactg

SEQ ID NO: 87447 - DNA, 50 bp, homo sapien
aacttctgatttcatagatcaaaagwaatgaggtcagataggataataca

SEQ ID NO: 87448 - DNA, 50 bp, homo sapien
tccacagtgagctaatcattcttgasaggttgggatatatttctttgatt

SEQ ID NO: 87449 - DNA, 50 bp, homo sapien
tctgaaaaatgggcagtttggattaragaatcgcaaacgcccaactaact

SEQ ID NO: 87450 - DNA, 50 bp, homo sapien
ctcctctccttctttgcttccatccrtcaacccatttgctgaagaagaaa

SEQ ID NO: 87451 - DNA, 50 bp, homo sapien
ccagtgcatagaaaggtgtctgacamgtacatagttgagatgtaataaat

SEQ ID NO: 87452 - DNA, 50 bp, homo sapien
gtccctgcctgtgtcctgacaaagtwacaacagtggggaccctcacggtt

SEQ ID NO: 87453 - DNA, 50 bp, homo sapien
ctgagagtcccaacactaaattcacyattaggtacctttggggctcagct

SEQ ID NO: 87454 - DNA, 50 bp, homo sapien
atttttttaattcagttttcagtaayggatacttttctaggcatttttcc

SEQ ID NO: 87455 - DNA, 50 bp, homo sapien
tcaaggagaaactccatctgaatcaygttagcacagaccattgcagagga

SEQ ID NO: 87456 - DNA, 50 bp, homo sapien
ttcagaatgggtattgagtcctataygtaccaggaactgcacactgtcac

SEQ ID NO: 87457 - DNA, 50 bp, homo sapien
agttttgtgttttacattgaaatctrtaacccattttgagttaattgtta

SEQ ID NO: 87458 - DNA, 50 bp, homo sapien
atcaaagggagcaggatcacaaagayggcggtaaaaagatggcaccatct

SEQ ID NO: 87459 - DNA, 50 bp, homo sapien
acctaaatccccagtgcgctttctcrctaatgaaacacctgtgagttcca

SEQ ID NO: 87460 - DNA, 50 bp, homo sapien
cccttgaacaggagttgtttgggaaytcagaacgcagaagtgctccagat

SEQ ID NO: 87461 - DNA, 50 bp, homo sapien
gaatctaagctctcttatctcctaaygtcatagaataactgccttgaagt

SEQ ID NO: 87462 - DNA, 50 bp, homo sapien
agcgccaaagaagtaaataagataaygacacactgtgctaagtacttggg

SEQ ID NO: 87463 - DNA, 50 bp, homo sapien
ggaggagaaggaaatgagacctgatragtcaaagtgtacaaacttgcaag

SEQ ID NO: 87464 - DNA, 50 bp, homo sapien
actgactcaggatacactggatagayacttttctgtgtatgtgatttaaa

SEQ ID NO: 87465 - DNA, 50 bp, homo sapien
tgagaaaagcgctggtaaataacacrccatgatgatgcggaactcatttg

SEQ ID NO: 87466 - DNA, 50 bp, homo sapien
ttcatggccgcagtaggatttagaasaaacccaggatctgaactgaaacc

SEQ ID NO: 87467 - DNA, 50 bp, homo sapien
attcattctgacagcctcattttaaygtaatgaactctttaaagacctta

SEQ ID NO: 87468 - DNA, 50 bp, homo sapien
tggcctcatgaagaaaggaaaagaaycatccagataaatctcctccaaaa

SEQ ID NO: 87469 - DNA, 50 bp, homo sapien
agagttcctcttgctccatatttttkccagtatgtagtggtgtccatgtt

SEQ ID NO: 87470 - DNA, 50 bp, homo sapien
aatttacttatatgtgtttcatggaygagtatacacaaagcatccatgaa

SEQ ID NO: 87471 - DNA, 50 bp, homo sapien
agattctttcattttataactgtcaytattatcaagttgggagtgaattt

SEQ ID NO: 87472 - DNA, 50 bp, homo sapien
tgagtgtgtctgaacaataacaaaayttggcagtccttaagcgtaggtta

SEQ ID NO: 87473 - DNA, 50 bp, homo sapien
attatcatggcatcttttttttttaycaacagatgtggaaaccgaggctc

SEQ ID NO: 87474 - DNA, 50 bp, homo sapien
gtcttcttcaattccttgacattccygatattaagccccttcttgggcca

SEQ ID NO: 87475 - DNA, 50 bp, homo sapien
tccttttggtgtaagtccttatgagycaatttagtagttattatagctca

SEQ ID NO: 87476 - DNA, 50 bp, homo sapien
taagaatacttgccattgccacctaygaagagaagtccctcaaatcaact

SEQ ID NO: 87477 - DNA, 50 bp, homo sapien
gaaattattgatgattaggtgctgayagacctttaatgcctctctgtcta

SEQ ID NO: 87478 - DNA, 50 bp, homo sapien
ttctgacacagaggctctcattagayggtgcgctgaagtcaggtgtgact

SEQ ID NO: 87479 - DNA, 50 bp, homo sapien
gtatataattacaagccctgctaaaygctatgaaaaaaaaaaggccgtag

SEQ ID NO: 87480 - DNA, 50 bp, homo sapien
atggtagattttaaggagctagaaaygcaagacataaatatgttccaatt

SEQ ID NO: 87481 - DNA, 50 bp, homo sapien
caaattataatcattatcaaataccrgcttaatccttctaacatttgtaa

SEQ ID NO: 87482 - DNA, 50 bp, homo sapien
taagctttcattcagggagaatttgraccctagaaatcacagaatttcct

SEQ ID NO: 87483 - DNA, 50 bp, homo sapien
gggggaaatgggtagaagaaaagcayggaaaccaaatagaattgaaaggc

SEQ ID NO: 87484 - DNA, 50 bp, homo sapien
aagttaccaatagaagccggatgcaraggaataaagccagcagtttaatt

SEQ ID NO: 87485 - DNA, 50 bp, homo sapien
tttgtgtccctagtggccaagcccartaggaagctggagggcaaaatgtc

SEQ ID NO: 87486 - DNA, 50 bp, homo sapien
gttgctctgcaggttattaatgtccyagaataacctaataaggagaacag

SEQ ID NO: 87487 - DNA, 50 bp, homo sapien
tgacaacagctgagtcaccccgtgcrgatataacaagttcgtaagatgtg

SEQ ID NO: 87488 - DNA, 50 bp, homo sapien
cgaagtgagaattgttatatgatgcyatctaagtcacacattcagcaggt

SEQ ID NO: 87489 - DNA, 50 bp, homo sapien
gctgtccataattatttgagtaatcsattaaatgcactaaaaatttcttt

SEQ ID NO: 87490 - DNA, 50 bp, homo sapien
ccaaatacactaaatcctcatttaaygttgttgatagattctgtggcttt

SEQ ID NO: 87491 - DNA, 50 bp, homo sapien
caaagatgagttaggattggtagacrgatataggaattatctatttcctt

SEQ ID NO: 87492 - DNA, 50 bp, homo sapien
tcagatcacacctcctggcatcacckgatgggaacagccaatcagatcac

SEQ ID NO: 87493 - DNA, 50 bp, homo sapien
atccagcctagtctcctgagttaacyggtcaagggactatatatcctcat

SEQ ID NO: 87494 - DNA, 50 bp, homo sapien
tattataaatttggtttactctcaasaggcttttgataagtcatgcagac

SEQ ID NO: 87495 - DNA, 50 bp, homo sapien
aaggaaaaaagccaacaagtgcagaygagtttagaagcaccagaggaaca

SEQ ID NO: 87496 - DNA, 50 bp, homo sapien
gcctgttttttttcctgttgtaagayactgcttctatttgctcattaaaa

SEQ ID NO: 87497 - DNA, 50 bp, homo sapien
tgctcattaaaattgagttgattgayggataaaagatgcccatgaaagtc

SEQ ID NO: 87498 - DNA, 50 bp, homo sapien
attagtcagacactggttaataccaygaacacgtaatgaaccaaatggta

SEQ ID NO: 87499 - DNA, 50 bp, homo sapien
acatatttctagatggctattcagargtcctgtgaacctaaggctagccc

SEQ ID NO: 87500 - DNA, 50 bp, homo sapien
gctctctgtgtgctgagctctacacmaagcactttattaatattaactca

SEQ ID NO: 87501 - DNA, 50 bp, homo sapien
acaataaaacacacaaattactaccrctaatgaaaaacatcagcccaaac

SEQ ID NO: 87502 - DNA, 50 bp, homo sapien
agataatattacattgttcaaagatrtacgcatgagatgttcatcacagg

SEQ ID NO: 87503 - DNA, 50 bp, homo sapien
taagctgttttattttcatcatcacrtttgtcaccattgaacattatctt

SEQ ID NO: 87504 - DNA, 50 bp, homo sapien
ctctctaaattttggtagtctgataraagagagcacttgggaatgaattt

SEQ ID NO: 87505 - DNA, 50 bp, homo sapien
cagagctgtgtataaaggtctttgcwatgtttagctttatgtgaaatcaa

SEQ ID NO: 87506 - DNA, 50 bp, homo sapien
aaacatgaactctaagctttagtatsaggaatgcaactggagctcagaga

SEQ ID NO: 87507 - DNA, 50 bp, homo sapien
catgtttgtttcatttgtgggtagayactaacttgttttggctccctttg

SEQ ID NO: 87508 - DNA, 50 bp, homo sapien
gccttttgtgtctggcttctttttcktagtataataatgttgagattcat

SEQ ID NO: 87509 - DNA, 50 bp, homo sapien
acctcagtgttagtggactctttaaygattgttagcagctgttgtgatca

SEQ ID NO: 87510 - DNA, 50 bp, homo sapien
agggatttttgtatattgactaattraactatcagccttatgagatggat

SEQ ID NO: 87511 - DNA, 50 bp, homo sapien
agggcttgatggttgtaagcaacagraactgataccggccactggcagca

SEQ ID NO: 87512 - DNA, 50 bp, homo sapien
agctagtttggcatgtgatacttaaytatgatgatctttaattttagctt

SEQ ID NO: 87513 - DNA, 50 bp, homo sapien
taacaaacaatccccacattgcagtracttaacacaacaaaggggtgttt

SEQ ID NO: 87514 - DNA, 50 bp, homo sapien
cagactttcttatgatgggttggaaytacttgatgggtagagaaggaact

SEQ ID NO: 87515 - DNA, 50 bp, homo sapien
aaagcaacctatttttctaaaggtarcgatttgcaccacactttgtagag

SEQ ID NO: 87516 - DNA, 50 bp, homo sapien
agctcagtaaaggacggcgagtgtcraaagccatgtctccaagcacatgc

SEQ ID NO: 87517 - DNA, 50 bp, homo sapien
caatttacacatgtaattcattttaraagttacagactatgaaaaataca

SEQ ID NO: 87518 - DNA, 50 bp, homo sapien
ggtgtgctgcgtttgtctgatgtaargttcctattttttccatttccata

SEQ ID NO: 87519 - DNA, 50 bp, homo sapien
tttttggcacatggtatgatacagayattcgactcttttagtctgtagat

SEQ ID NO: 87520 - DNA, 50 bp, homo sapien
tagattattctatttaattcctgaaragatcatttggatatgttttcttg

SEQ ID NO: 87521 - DNA, 50 bp, homo sapien
tatcacgttgcctttctctgatcctyttccttgtttcgtctgtctctgac

SEQ ID NO: 87522 - DNA, 50 bp, homo sapien
tgatgaatactgtgagaaacagtccraggttcaaatttaacagcacggga

SEQ ID NO: 87523 - DNA, 50 bp, homo sapien
aggactgatattcctcctaaggacaractcaaaaatttctgcaagcttaa

SEQ ID NO: 87524 - DNA, 50 bp, homo sapien
ctgaattgccagcatcaataatctckccctttgggcccactattaagtaa

SEQ ID NO: 87525 - DNA, 50 bp, homo sapien
tttatctcagcttaaacctaatggarctagagccatctcattttcatgag

SEQ ID NO: 87526 - DNA, 50 bp, homo sapien
ctttggagtacctagattgtaagaamtgttagccacaaagaaatcataac

SEQ ID NO: 87527 - DNA, 50 bp, homo sapien
ttaacactgttctcatgcctgccaaygcaacatccattctgcagcccaaa

SEQ ID NO: 87528 - DNA, 50 bp, homo sapien
ttccccccagagcctccagaaggaaygccacccagtgaacaccttggttt

SEQ ID NO: 87529 - DNA, 50 bp, homo sapien
tgggagaaagcattttttcaactgtraagagccatctaaaagtaataggt

SEQ ID NO: 87530 - DNA, 50 bp, homo sapien
atcttgagttgcctttccctaaggaygccagtatgaaaaaaataccttct

SEQ ID NO: 87531 - DNA, 50 bp, homo sapien
aacgatagaatttgctgcaatcacaytgaagatgatagaaactcccattt

SEQ ID NO: 87532 - DNA, 50 bp, homo sapien
ctgcctgggctttgatgtggaaacayggagatgacattagctgagtatga

SEQ ID NO: 87533 - DNA, 50 bp, homo sapien
ggtttcttttactgtgtttctctctmtatatatgcacatctatataaata

SEQ ID NO: 87534 - DNA, 50 bp, homo sapien
gcccttctctgagatgcaaggtaaamtttacaaccctatgatctctctag

SEQ ID NO: 87535 - DNA, 50 bp, homo sapien
caaaattgtgggtaatttgagagtcragacaagtatttattcacaccaat

SEQ ID NO: 87536 - DNA, 50 bp, homo sapien
gctttgagttagatgattttgtccamatataagctaatggaagtaaaaca

SEQ ID NO: 87537 - DNA, 50 bp, homo sapien
tttcttcatcattcataagattttayccccatgcacatagcccaaaacgg

SEQ ID NO: 87538 - DNA, 50 bp, homo sapien
tgtgtattttgcttgtattacatgasagaagtttagaattttaatgtaag

SEQ ID NO: 87539 - DNA, 50 bp, homo sapien
tcgtgactgttgtgtaattttgcccraagagagaggaatagggtaggcac

SEQ ID NO: 87540 - DNA, 50 bp, homo sapien
ttttcttttcaagatgctacatagtsaaacagaactgggttggtctttta

SEQ ID NO: 87541 - DNA, 50 bp, homo sapien
gtccaaatatctaaatacttaaaaaytgcacgtgctctttaagaaaattt

SEQ ID NO: 87542 - DNA, 50 bp, homo sapien
gtcctatgccagattcagcatctaayatgtgtttcttaagccactcagtg

SEQ ID NO: 87543 - DNA, 50 bp, homo sapien
cttccaaccacatgtaccttataaawtaataattttcagatgtagcgctg

SEQ ID NO: 87544 - DNA, 50 bp, homo sapien
tgtcctgggatctcaaatcataatcrccaagagtaaccctaaacatccat

SEQ ID NO: 87545 - DNA, 50 bp, homo sapien
cctggtgcattgcccagttgccagckgataccctgatcaaagccaaacca

SEQ ID NO: 87546 - DNA, 50 bp, homo sapien
atataacagatgaatggccagaattsaaaatatataaagaattctcttac

SEQ ID NO: 87547 - DNA, 50 bp, homo sapien
tacaggtcctagagaatgtcattatyaagtccagtagaattctgatttcc

SEQ ID NO: 87548 - DNA, 50 bp, homo sapien
tatttgaatagtatctgtattgtgarctagaccaagctactcagatacag

SEQ ID NO: 87549 - DNA, 50 bp, homo sapien
tttagcccttctcatacaaagggtcrctataaaatgagtcaccctccctt

SEQ ID NO: 87550 - DNA, 50 bp, homo sapien
aggagcaggaaaatgatgtaaaactyaaaatatggacattgcaaaattga

SEQ ID NO: 87551 - DNA, 50 bp, homo sapien
tcttagcgaaaatatttccagattgraagaataactagtggtgagggctg

SEQ ID NO: 87552 - DNA, 50 bp, homo sapien
ttacagaaataaccaatgtatttccrgtgcagtgttctatcttagctgac

SEQ ID NO: 87553 - DNA, 50 bp, homo sapien
ttctgctgaatatttcttctgaaggktattctgctgttaagaaaaaggag

SEQ ID NO: 87554 - DNA, 50 bp, homo sapien
ctccctcctgtctgaagccttaacaytgaaaattctgtttagtgtttgag

SEQ ID NO: 87555 - DNA, 50 bp, homo sapien
gtttttaattatttttctttaagtgratattgttaaactctactcatgtc

SEQ ID NO: 87556 - DNA, 50 bp, homo sapien
cttgggtgaaagtacagtgtgataamgctataaggggcttctgggggcat

SEQ ID NO: 87557 - DNA, 50 bp, homo sapien
gaaaaaatagagacagaaagttgagwcacggtgctactacaatagtctgg

SEQ ID NO: 87558 - DNA, 50 bp, homo sapien
gtggaagacagaaaaataggctaagsaaagaagtactagtgaagacaaca

SEQ ID NO: 87559 - DNA, 50 bp, homo sapien
tgaaaattaaaatggaaagaggtatstaaaatctcccactgtatcgtatc

SEQ ID NO: 87560 - DNA, 50 bp, homo sapien
actttggatatgggatggaagttaartatatgaggaactattgcctattt

SEQ ID NO: 87561 - DNA, 50 bp, homo sapien
ggaacattctgcaagaaaactaacaygatcttttcaacaggcaggaatca

SEQ ID NO: 87562 - DNA, 50 bp, homo sapien
cagttggttggggggaattaagatamgtggagtggtggtgattgaaggct

SEQ ID NO: 87563 - DNA, 50 bp, homo sapien
attgaaacacattataggtatcggcmaatgtgccctacacaacacgaggt

SEQ ID NO: 87564 - DNA, 50 bp, homo sapien
tccatcctaggatggcctgattaggkacattccaccaaggagattccaat

SEQ ID NO: 87565 - DNA, 50 bp, homo sapien
ttaaataaatatgtggatgtgatacraatatagataagacaaaagaaaag

SEQ ID NO: 87566 - DNA, 50 bp, homo sapien
ttcagggcacctacacccaaaaagtraacaggtgtgtaaatgagtgtggt

SEQ ID NO: 87567 - DNA, 50 bp, homo sapien
aaaaccccaaccaatgtctactggaytcatcgtacaccactgtctaggct

SEQ ID NO: 87568 - DNA, 50 bp, homo sapien
gccctcggagattatttgaaaatcaracttgcagtggacatgaaattata

SEQ ID NO: 87569 - DNA, 50 bp, homo sapien
tgtaatttgcaagtctctacagacaratagattacggatagacagataaa

SEQ ID NO: 87570 - DNA, 50 bp, homo sapien
tgccaataatcatgtaagcctggaastgtatcctttctcactcaagcttt

SEQ ID NO: 87571 - DNA, 50 bp, homo sapien
ctctgatgaagcagcttgttttgackagaatatttggtactttgaaaatg

SEQ ID NO: 87572 - DNA, 50 bp, homo sapien
tattgtcatggataagttgccaagartaagatagtaaggggacaggtggt

SEQ ID NO: 87573 - DNA, 50 bp, homo sapien
actcttccatagtagggctggaaatyaataggttatccacatattacaag

SEQ ID NO: 87574 - DNA, 50 bp, homo sapien
tttaataataacaaaacactcttaayaagcttgagataaaagtcaacttc

SEQ ID NO: 87575 - DNA, 50 bp, homo sapien
ttcttctttccctgccgtactttcaygaggtgattaaccccaatcaggta

SEQ ID NO: 87576 - DNA, 50 bp, homo sapien
ctgttttatcatgcaatacaaggcayaggttatgtagtatgtagagccca

SEQ ID NO: 87577 - DNA, 50 bp, homo sapien
tggctttatgggcaatctttgctcarggaattcctgtcaaccttgccaag

SEQ ID NO: 87578 - DNA, 50 bp, homo sapien
tcacaacaatcccgtgaaactgacastgtaactattcctctttcacagat

SEQ ID NO: 87579 - DNA, 50 bp, homo sapien
tatcacttttgatgtcctattaaaasaattttggcaactattaattgaat

SEQ ID NO: 87580 - DNA, 50 bp, homo sapien
actgtgcaaaataatggcagtagaayaagaggaggaggaacttagggtat

SEQ ID NO: 87581 - DNA, 50 bp, homo sapien
tctcatcatgagtttattttaactcyaaagcctctttgccttatgttctt

SEQ ID NO: 87582 - DNA, 50 bp, homo sapien
ctgaccctccatccctggcctctggsataaacagattaagccaccctctt

SEQ ID NO: 87583 - DNA, 50 bp, homo sapien
tgcatacaaacaaggccaatttaccrgcaatcagtcatactggctagggg

SEQ ID NO: 87584 - DNA, 50 bp, homo sapien
ctgccctcccctccccctgcaattamactgtgaacatcaagatgcaaagg

SEQ ID NO: 87585 - DNA, 50 bp, homo sapien
ttccaagatgggtaggattagaaaaygagccaactggacggggaagtttg

SEQ ID NO: 87586 - DNA, 50 bp, homo sapien
tgtttgcaatgatggcacatcctcayaatcttgaacccctaccatttctc

SEQ ID NO: 87587 - DNA, 50 bp, homo sapien
tagataatgaatagataaaccaagaragaatgttcctaactacttaaatc

SEQ ID NO: 87588 - DNA, 50 bp, homo sapien
ggaagcgtggctcaagagttaaacayatctctgcaaagggatgcaactcg

SEQ ID NO: 87589 - DNA, 50 bp, homo sapien
attagttgtaaatgtatattgcaaasacataataattcttaatgtatata

SEQ ID NO: 87590 - DNA, 50 bp, homo sapien
ttatttggaaataggttttgacagargttgttagttaagaagagatcata

SEQ ID NO: 87591 - DNA, 50 bp, homo sapien
gacgactctagacatctacaaaacasattccaggacgagacggacagggc

SEQ ID NO: 87592 - DNA, 50 bp, homo sapien
atcacattgatttaagggaaaaaaamcatattgagtggtgtaaccaagaa

SEQ ID NO: 87593 - DNA, 50 bp, homo sapien
gttcaagtcagcaactagtgtaaagyattcacattattattctgggttca

SEQ ID NO: 87594 - DNA, 50 bp, homo sapien
tcaatttcactcttatagtatgctaygttaggttaggtttcattatgttt

SEQ ID NO: 87595 - DNA, 50 bp, homo sapien
ttgttatttggaagaataatgatgakaatttgagaagtctttcagatgga

SEQ ID NO: 87596 - DNA, 50 bp, homo sapien
aacttcaggcaggaacaatgataagmaaattgactccgtaaagacaagaa

SEQ ID NO: 87597 - DNA, 50 bp, homo sapien
actttgaatttatattttggtgagaycattgactgataaagtggtaagcc

SEQ ID NO: 87598 - DNA, 50 bp, homo sapien
agaaatggagatgggtgaggtcaaayatccttaccaacaacgccacaaat

SEQ ID NO: 87599 - DNA, 50 bp, homo sapien
agaacacaaaggtcggggctgaaagyagcaaattatctccttgacacagc

SEQ ID NO: 87600 - DNA, 50 bp, homo sapien
gagccagctgaaattctcctttcaawtgtcaactgctatcagtgggtctc

SEQ ID NO: 87601 - DNA, 50 bp, homo sapien
tgtagttgtattagggtgggtgtccraactggtggtgttagtaatggaat

SEQ ID NO: 87602 - DNA, 50 bp, homo sapien
catcaattgtcactaaaagagatcaragttaatttagaagagacagatag

SEQ ID NO: 87603 - DNA, 50 bp, homo sapien
ggacagcctgttgatcaatagaatgraattgagagtccagaaataaagtc

SEQ ID NO: 87604 - DNA, 50 bp, homo sapien
ggtaagatggcaatatgagaaaatastacaatggaaaaagtatagctttc

SEQ ID NO: 87605 - DNA, 50 bp, homo sapien
tttaaaagcaacactcaactttaagmagcaatagactggatagagaaact

SEQ ID NO: 87606 - DNA, 50 bp, homo sapien
aatcatccttggctttccttttaaasgctattttgaaatggtcttttcac

SEQ ID NO: 87607 - DNA, 50 bp, homo sapien
agctcaaatcaaattcatgtacagcwaaaagataagttactgcacctcta

SEQ ID NO: 87608 - DNA, 50 bp, homo sapien
gtcttatctattaatagtgcaactcraccaggatagaagtccctgtcttg

SEQ ID NO: 87609 - DNA, 50 bp, homo sapien
gattaataaaatcccatgaaagttayatagtctattgtgaaagagagaca

SEQ ID NO: 87610 - DNA, 50 bp, homo sapien
tcagatcctcttggtcaccaacttayaacaactgatttatgacactattt

SEQ ID NO: 87611 - DNA, 50 bp, homo sapien
tgtttcacaacatgattttacatagmatacgggccaacattttttttctt

SEQ ID NO: 87612 - DNA, 50 bp, homo sapien
cacaagagacagcacagtgagtacartgagagtaagaactcggacgtgac

SEQ ID NO: 87613 - DNA, 50 bp, homo sapien
aaactacactttgtatattatgagarttagtggtcactgttgagcaaaac

SEQ ID NO: 87614 - DNA, 50 bp, homo sapien
tgtgagccacatctgcctgcgacagrataatctatgccaagtcttctgaa

SEQ ID NO: 87615 - DNA, 50 bp, homo sapien
ttctcagcttagaaatgtgcatatargaaagttcagggactcactgaggt

SEQ ID NO: 87616 - DNA, 50 bp, homo sapien
aacaaagaataaaacgaaatgcatcsattattctattactgaaagtcaac

SEQ ID NO: 87617 - DNA, 50 bp, homo sapien
caggcagcatggggctcaaatttctracagatggaaaggagtggagtcat

SEQ ID NO: 87618 - DNA, 50 bp, homo sapien
gttaggcgtagcttcaggacggcccrctttggaatccaatcaatgggagc

SEQ ID NO: 87619 - DNA, 50 bp, homo sapien
cttttaacctctttgatgtatgtctsaaaaatggctgacccaaaacacta

SEQ ID NO: 87620 - DNA, 50 bp, homo sapien
atattcatttacattaatgaagcaamatttcctagagaaaaagccatcca

SEQ ID NO: 87621 - DNA, 50 bp, homo sapien
ccaataatctctctcctaagaaatarctcttgaaaagtatcatcattgcg

SEQ ID NO: 87622 - DNA, 50 bp, homo sapien
cagtgagtaaaatctaagttttgaayagaatctaagtgttggatagaaaa

SEQ ID NO: 87623 - DNA, 50 bp, homo sapien
acaacttgtttcatactgcctcttayaggaataacaccaaggacaacccc

SEQ ID NO: 87624 - DNA, 50 bp, homo sapien
gcattctagattctgtcacggaaatkattctgataaaccaccaagtttat

SEQ ID NO: 87625 - DNA, 50 bp, homo sapien
ttcatcactaactgctaaggagacarggacgttattctctaccatggact

SEQ ID NO: 87626 - DNA, 50 bp, homo sapien
gggatgagttcttggtccacctcatrtcagatgaacataagccaagttgt

SEQ ID NO: 87627 - DNA, 50 bp, homo sapien
cctccaccttcaaagttagtagcacrgcatcttgcagtctttctcacacc

SEQ ID NO: 87628 - DNA, 50 bp, homo sapien
aagatagatttggatgaaaacattasactctatggatgagggcagaggca

SEQ ID NO: 87629 - DNA, 50 bp, homo sapien
ttcagtctccaccttttagaattcaraccattatctgcggttttggataa

SEQ ID NO: 87630 - DNA, 50 bp, homo sapien
ttcaaatgagtcattctcaccaattraaggctgatttgttgctaactgca

SEQ ID NO: 87631 - DNA, 50 bp, homo sapien
taaattaagaaatttgctaaaccaaraaacataatagatacaaagaagaa

SEQ ID NO: 87632 - DNA, 50 bp, homo sapien
attgatataaacattgtcagtggaasctttcacattctttttttgcatat

SEQ ID NO: 87633 - DNA, 50 bp, homo sapien
agcctagatgtcaaagcccttcaaaktgggttgtttggacgggcttccca

SEQ ID NO: 87634 - DNA, 50 bp, homo sapien
tcccaccgccttcatcctgatgaccrctaagacctgtacctaacacccaa

SEQ ID NO: 87635 - DNA, 50 bp, homo sapien
tatttgcaagagaacagttaagcagrccctacagaaaaatcatagaaatg

SEQ ID NO: 87636 - DNA, 50 bp, homo sapien
tgcctgtatttaataatgtttgttcraaagaggacagcaagcaacagcct

SEQ ID NO: 87637 - DNA, 50 bp, homo sapien
tcccaatgacagaatcctcccaaaakatgttcaaagagggaaaagtacac

SEQ ID NO: 87638 - DNA, 50 bp, homo sapien
gtcatctgaagttgtctctttatggkatgttctttcatatgtccgtacat

SEQ ID NO: 87639 - DNA, 50 bp, homo sapien
taatgtcatctgtacagaactatagkgtgcctttcattaaaatactccac

SEQ ID NO: 87640 - DNA, 50 bp, homo sapien
tgactagggaactcatataagtggartaataatagtatttgtcctttcgt

SEQ ID NO: 87641 - DNA, 50 bp, homo sapien
tgaaccaccttttttcccagctatcratactaaatatcattaaatatgta

SEQ ID NO: 87642 - DNA, 50 bp, homo sapien
gcagatatcattgttaccattgttaycgttgttggtggtgctataaattc

SEQ ID NO: 87643 - DNA, 50 bp, homo sapien
actggccatagttaagaagaattgayatcagaaggaaagaaaaccataca

SEQ ID NO: 87644 - DNA, 50 bp, homo sapien
cttctttttgcatagttcaggcggayatacaggtaggtggatatcaacag

SEQ ID NO: 87645 - DNA, 50 bp, homo sapien
aagtctcttttcaggaaaggcaaaayttttcttcacctgcaatccatgga

SEQ ID NO: 87646 - DNA, 50 bp, homo sapien
gtgagaagtggtcagactcaagataygtttgaccatagaaccagcgagat

SEQ ID NO: 87647 - DNA, 50 bp, homo sapien
tcatggcaatctaaaaatattcatgyaattgctggttgatcacgaactac

SEQ ID NO: 87648 - DNA, 50 bp, homo sapien
acttgaggattccatttctactactracaggaatgttccttttggatcaa

SEQ ID NO: 87649 - DNA, 50 bp, homo sapien
cattggaagaagaattgtctcaggcygcatataaaatacaccaacgatag

SEQ ID NO: 87650 - DNA, 50 bp, homo sapien
cagtcgtgagccccagcgcccagccragttttaggttaagatagagttgg

SEQ ID NO: 87651 - DNA, 50 bp, homo sapien
aagaggaacccatgtttcaaaccaayggattgtttagcaggtaaaatagt

SEQ ID NO: 87652 - DNA, 50 bp, homo sapien
ccatgtcttatttattcatggaacasatacaatatcatcacctgtgctta

SEQ ID NO: 87653 - DNA, 50 bp, homo sapien
tggttaggttgagttgaaccagtctycgggacatggaagtgaatgtgtga

SEQ ID NO: 87654 - DNA, 50 bp, homo sapien
tttgaggctagtaacacaatttagamcagaataggttttcatatatcaaa

SEQ ID NO: 87655 - DNA, 50 bp, homo sapien
ttacaacaaagctagaattctgactygctgatttatcgtgctagctgggc

SEQ ID NO: 87656 - DNA, 50 bp, homo sapien
gccctttcagtactaatttccaccaygaacatttccctaactagtttcta

SEQ ID NO: 87657 - DNA, 50 bp, homo sapien
tttaaattctgatgtaaccaccgcartgaatttgtttatacaacttagca

SEQ ID NO: 87658 - DNA, 50 bp, homo sapien
ctaagtaagtcatgagtgctctaaawtacgtaaacatgtagggaaaccta

SEQ ID NO: 87659 - DNA, 50 bp, homo sapien
ttacttaaaagcggaaacagcaaatyatattggccaaatgttctaaaggt

SEQ ID NO: 87660 - DNA, 50 bp, homo sapien
agttctaaacataatatgaatatacratctctgcactaatgccaataaaa

SEQ ID NO: 87661 - DNA, 50 bp, homo sapien; identical to SEQ ID NO: 70484

SEQ ID NO: 87662 - DNA, 50 bp, homo sapien
taaatagttaattcttaaaagttgarcaaacatcgatcccttttgccttt

SEQ ID NO: 87663 - DNA, 50 bp, homo sapien
taagtatcctaatggctagaaattaygcatttgtccatacagagtatcct

SEQ ID NO: 87664 - DNA, 50 bp, homo sapien
gaagtcttgtagtaacatcaaattgmaaatcatacaatggatacacaaaa

SEQ ID NO: 87665 - DNA, 50 bp, homo sapien
ttttctttagctttggctgctcttcyaatcggcaatctccctctctcagt

SEQ ID NO: 87666 - DNA, 50 bp, homo sapien
cataaagacagatatattaagtggamcaaaataaagagaccagatgtaaa

SEQ ID NO: 87667 - DNA, 50 bp, homo sapien
aacaagatttcttcttgcttaagatwactacaaaagcagttttgcaacaa

SEQ ID NO: 87668 - DNA, 50 bp, homo sapien
ttaatatgagtggagtactcaaataytattctttaaacccaagcaaccat

SEQ ID NO: 87669 - DNA, 50 bp, homo sapien
taaggagttgtgcactctggggagarcatttcatatccaagtcctcatga

SEQ ID NO: 87670 - DNA, 50 bp, homo sapien
aaccagccaatcactataatttgtartaaatctaagcccctttatgtaag

SEQ ID NO: 87671 - DNA, 50 bp, homo sapien
ctccccagagtgcacaactccttacragaatattcagagtacagtgtgtt

SEQ ID NO: 87672 - DNA, 50 bp, homo sapien
tttttttttttttttctgtatataamcttccatgctattagcaggtggat

SEQ ID NO: 87673 - DNA, 50 bp, homo sapien
tctctaagtataacaggagagggaarcaaatgaccaaataggtcgtgata

SEQ ID NO: 87674 - DNA, 50 bp, homo sapien
atagtaatgttaattgtctccctcaragcaaggccattaagccgcttact

SEQ ID NO: 87675 - DNA, 50 bp, homo sapien
tagccaagtcactgaatgcccatagragaataagataattattttaaaca

SEQ ID NO: 87676 - DNA, 50 bp, homo sapien
gaccgtaattgaaactataaagtcasacactcttggattgacccttcatc

SEQ ID NO: 87677 - DNA, 50 bp, homo sapien
tttcccttacatctgtattataaaaytcccttcacagaggtatagaagaa

SEQ ID NO: 87678 - DNA, 50 bp, homo sapien
gaaaacagaaaacgcactttcttcakcggccctcactgagcacagacacg

SEQ ID NO: 87679 - DNA, 50 bp, homo sapien
aattttttttttcgattaacaagaaraaccgtgagtactagggatgtctg

SEQ ID NO: 87680 - DNA, 50 bp, homo sapien
gttgtccttttcctaacataagtccmataatagcaaaggcattgtctctt

SEQ ID NO: 87681 - DNA, 50 bp, homo sapien
ataatgagatgagagtaatgagttgsaagtaatggttgggaggctggata

SEQ ID NO: 87682 - DNA, 50 bp, homo sapien
cagacacagtccgctgagatgagaaygtcacagaatacagaaaaggaagc

SEQ ID NO: 87683 - DNA, 50 bp, homo sapien
tcaatggcacagaatctaacatcccygagctaaggttcagcaggagctca

SEQ ID NO: 87684 - DNA, 50 bp, homo sapien
gaacattgagaatttcttcttttcaygtcttagaggcatttaaaaatttg

SEQ ID NO: 87685 - DNA, 50 bp, homo sapien
aattagagacatacatgtaactcaartctgtaaccaacacagtttattgg

SEQ ID NO: 87686 - DNA, 50 bp, homo sapien
aacacaaggtgcttaaaatactgagmatacaatgttccgcaaatgttagc

SEQ ID NO: 87687 - DNA, 50 bp, homo sapien
gaagcactttccctttgcaagaacgsattgtttttgttattcatatttgt

SEQ ID NO: 87688 - DNA, 50 bp, homo sapien
aaccataactgtaggccatttaagarcctactaaattacagcaccacgtt

SEQ ID NO: 87689 - DNA, 50 bp, homo sapien
aaatcatagatgcttgaaaaatgtayagtttctgtttatagggtacaagt

SEQ ID NO: 87690 - DNA, 50 bp, homo sapien
ctacatatatttcttatactttatayctgtgttagtatcaaagccaagaa

SEQ ID NO: 87691 - DNA, 50 bp, homo sapien
atcctgcagtttaaacagcagtcacygaattgaaacataaaactaccatt

SEQ ID NO: 87692 - DNA, 50 bp, homo sapien
gaggtagattaatttggaaattacaytgagtagaccgaaaatgatcaaac

SEQ ID NO: 87693 - DNA, 50 bp, homo sapien
aggaaagacaatggcttttttcagasagaggtgttgcatttatttgagtt

SEQ ID NO: 87694 - DNA, 50 bp, homo sapien
acactagcctgattttatgtcaaagrttagatcaagcacttcagttacag

SEQ ID NO: 87695 - DNA, 50 bp, homo sapien
cagacaggtatttatttatatgtaamtcctgcaaatatggagatgtctaa

SEQ ID NO: 87696 - DNA, 50 bp, homo sapien
catgggaaggccaatgaaatcacatmaaccttagcacccagatcttccag

SEQ ID NO: 87697 - DNA, 50 bp, homo sapien
tctcaatatggttgtactgtataaamatggaatcaaatgaaagaagccag

SEQ ID NO: 87698 - DNA, 50 bp, homo sapien
aaaaagcagaggactcatccagtcgyccatcttctactggtcaagcattg

SEQ ID NO: 87699 - DNA, 50 bp, homo sapien
agatcttttttgatgtagactaaaayattatacattcaaaatgggagaga

SEQ ID NO: 87700 - DNA, 50 bp, homo sapien
ttagcagcttcttaaagagagcagcrttagccagacctttggggcaatag

SEQ ID NO: 87701 - DNA, 50 bp, homo sapien
gggtgttggcagataggtacctcccragaatgtatacaagatgtgaaaat

SEQ ID NO: 87702 - DNA, 50 bp, homo sapien
ggccttggaggaaggcgttttattcrcatcagttgttttgcacattgctt

SEQ ID NO: 87703 - DNA, 50 bp, homo sapien
gatagctttctcagtcatgactatcrgtaatttacaccccccttaagttc

SEQ ID NO: 87704 - DNA, 50 bp, homo sapien
aatcgagaactttaacttgattctgratcgagactggaattgtgaacagt

SEQ ID NO: 87705 - DNA, 50 bp, homo sapien
tttataactgtattaccatctttacrgcttataaatgggagacattaatc

SEQ ID NO: 87706 - DNA, 50 bp, homo sapien
tatacacttgatatacacttgatacygatacctaaaagtctagggaattg

SEQ ID NO: 87707 - DNA, 50 bp, homo sapien
aatcatgagctgtgtaaattagttayataaagctattgacagctatcaca

SEQ ID NO: 87708 - DNA, 50 bp, homo sapien
ccctttgtcactatcagtgttgccartctcatgtatgtatgagaaggaac

SEQ ID NO: 87709 - DNA, 50 bp, homo sapien
gtagcctagcacaatggagtagaaaygagggtcagaaaatatttaaacca

SEQ ID NO: 87710 - DNA, 50 bp, homo sapien
ctgaggcactgaagttaccaatgttycactggttgacctgcggggctatc

SEQ ID NO: 87711 - DNA, 50 bp, homo sapien
gttaaaatatgagaggtatggcttasaggaatattaaaaatgaatggaac

SEQ ID NO: 87712 - DNA, 50 bp, homo sapien
gtggtgttggtttcatttttgctcaygtaaggtccagttggaggtggtgg

SEQ ID NO: 87713 - DNA, 50 bp, homo sapien
ctcattctgcccattcttcttgaatyatcctacccacacccatggtttca

SEQ ID NO: 87714 - DNA, 50 bp, homo sapien
agcatttaaccctaggtagtgttcgycacccacataaaaggcctttcccc

SEQ ID NO: 87715 - DNA, 50 bp, homo sapien
acaccttaatagttaaaacagctgayacatgaataaacagactagccaag

SEQ ID NO: 87716 - DNA, 50 bp, homo sapien
attgcatatatggtatgattctaatwatatcaactatatatagcagaaaa

SEQ ID NO: 87717 - DNA, 50 bp, homo sapien
catgtggcttctccaggctcaaaaamacaccgagtcttcctgctgccggg

SEQ ID NO: 87718 - DNA, 50 bp, homo sapien
taattgaatgtgggcagacaccatcsaatcagctaagggcctagatagaa

SEQ ID NO: 87719 - DNA, 50 bp, homo sapien
tgaactaatgcactgggaatggaaaygagagaacaggcaaaacatttgag

SEQ ID NO: 87720 - DNA, 50 bp, homo sapien
aacttcttcacactaagttgtaaacrattgctaagtgttatgatataatt

SEQ ID NO: 87721 - DNA, 50 bp, homo sapien
accttaggcaagtcacgaaacttctsaaccaaaatttcatcacatatgaa

SEQ ID NO: 87722 - DNA, 50 bp, homo sapien
ttatgattacaatcacacaactaatyatgatcatagcaggacttaggcac

SEQ ID NO: 87723 - DNA, 50 bp, homo sapien
ttttaaattaaagacttagaaaaatsaatgagagttatctagacagtatt

SEQ ID NO: 87724 - DNA, 50 bp, homo sapien
cagtgtcttttgaacaccaaaacgarcctgaaattatctctctgcttcat

SEQ ID NO: 87725 - DNA, 50 bp, homo sapien
tttcatattttgtacacacagaggcratatatttcattagctctgtatat

SEQ ID NO: 87726 - DNA, 50 bp, homo sapien
cctgtcttttttctcttctcaatgtsaattagaatatacttttttccagt

SEQ ID NO: 87727 - DNA, 50 bp, homo sapien
aagctcaatatcttattaaatttcayagctcaaaaactttttgatttgaa

SEQ ID NO: 87728 - DNA, 50 bp, homo sapien
ttgaatgtctgtaggatttagctcastgaagacaaatatcaaggaatttt

SEQ ID NO: 87729 - DNA, 50 bp, homo sapien
tgggtacaaacgtaaagggctgataraccatatgactctcatccactgtg

SEQ ID NO: 87730 - DNA, 50 bp, homo sapien
ctatacatctatatgtaagcaatacygtatgccaggaacaagtttctatt

SEQ ID NO: 87731 - DNA, 50 bp, homo sapien
caagatgccatactttctttcaaccractttaacatcttatctgtaagca

SEQ ID NO: 87732 - DNA, 50 bp, homo sapien
gtagttttacattgaaaaattataakgtgatgacctctgaagaataggat

SEQ ID NO: 87733 - DNA, 50 bp, homo sapien
tcagctgttctctgtgtgattgtcamctttgattaaccaagttgttgttg

SEQ ID NO: 87734 - DNA, 50 bp, homo sapien
atgaatccctcactgatttatcttayagtcagtcttctgatgtgtagctt

SEQ ID NO: 87735 - DNA, 50 bp, homo sapien
gtaaagagcccccaaacagactctaygtagaatatgatgtatgacaaata

SEQ ID NO: 87736 - DNA, 50 bp, homo sapien
atcatcaatcagaaggctgacaaaakgtaagttgatgccaggttatagaa

SEQ ID NO: 87737 - DNA, 50 bp, homo sapien
tgtgaatggcattcatcaaccactakgagaaagtagatgggagcacatgt

SEQ ID NO: 87738 - DNA, 50 bp, homo sapien
gtgtgtgtgtgtatgtgtatagtatyaatgtcccttttctacatatctgt

SEQ ID NO: 87739 - DNA, 50 bp, homo sapien
tctggcaatttctattgcaaattcamcaaatcccttgcttttgttactac

SEQ ID NO: 87740 - DNA, 50 bp, homo sapien
aaggattagcaagcccttcgaagagsaacatcagacctgctacaagactc

SEQ ID NO: 87741 - DNA, 50 bp, homo sapien
gtgcctgaggcatacaagacagccgrattctttagtaacaaaaggaaaat

SEQ ID NO: 87742 - DNA, 50 bp, homo sapien
gtagtgtcttacttaatcagtagtamccccaattatcctcttttctgagc

SEQ ID NO: 87743 - DNA, 50 bp, homo sapien
accttttgtaggcttgataaggtcayccaaaaatgtccatattctaatcc

SEQ ID NO: 87744 - DNA, 50 bp, homo sapien
cctgttgcccctagatacttcagcaygtatttcctaagaatgggatatac

SEQ ID NO: 87745 - DNA, 50 bp, homo sapien
aaatttcagatttcagatattgtagsaattcttatcactaaaataacatt

SEQ ID NO: 87746 - DNA, 50 bp, homo sapien
caagaactttgtgacgataaaaagawtaatttagaccgaatggatctgca

SEQ ID NO: 87747 - DNA, 50 bp, homo sapien
tagttaatgaatcataattatatacrgaatacaaacaataaatggcatac

SEQ ID NO: 87748 - DNA, 50 bp, homo sapien
aaaagaaatcctgggaggaagctcastttataaaacagggaagggcagct

SEQ ID NO: 87749 - DNA, 50 bp, homo sapien
tggtggaaacctattttgaaatataygcttgatgtacacacttagggcaa

SEQ ID NO: 87750 - DNA, 50 bp, homo sapien
tggccagcgcctgtaacttttaaccrcagagcgctcactcataggctcac

SEQ ID NO: 87751 - DNA, 50 bp, homo sapien
ctgggtggataatgaatcctcacacrcaaaagggaagtcggaggacggag

SEQ ID NO: 87752 - DNA, 50 bp, homo sapien
gattttagtctttgaaaatattatayacatggttagatcaccttttccag

SEQ ID NO: 87753 - DNA, 50 bp, homo sapien
tggggaaagatgtcactatagactcragttaaaaatgccagtgggataaa

SEQ ID NO: 87754 - DNA, 50 bp, homo sapien
agtggtttgatatgtcatcatatcaygtaaggctgaagagattttgtata

SEQ ID NO: 87755 - DNA, 50 bp, homo sapien
tatctatcagtacaactacaccgaamaaaagatgcccttcgatattataa

SEQ ID NO: 87756 - DNA, 50 bp, homo sapien
aggtgaatattccatgtccatttgcraacatattttactcttattactta

SEQ ID NO: 87757 - DNA, 50 bp, homo sapien
tgagaaagaaattctaaaacttacaratggaaacagaatccagacagctt

SEQ ID NO: 87758 - DNA, 50 bp, homo sapien
cctgtaagtgtttgtccgctgagacsagcattcagcagtcggcctcactg

SEQ ID NO: 87759 - DNA, 50 bp, homo sapien
tctcatgaagatgcttaaattaaaamgaacatagacgctaattttattta

SEQ ID NO: 87760 - DNA, 50 bp, homo sapien
agttacataacactataaataggtayaattgcactttatctctaaatgtg

SEQ ID NO: 87761 - DNA, 50 bp, homo sapien
tttctcactattcttgaacctattaraagaggaaaaagcaaacatgttgg

SEQ ID NO: 87762 - DNA, 50 bp, homo sapien
ggactgagaaggtagatactaacacyatgccagaaagcgaaaagcaaatt

SEQ ID NO: 87763 - DNA, 50 bp, homo sapien
aacaaaaacaaaaatcccgaagaaayaaaactagtgtcttaattatatgc

SEQ ID NO: 87764 - DNA, 50 bp, homo sapien
ttgggtactataactaggagaacaaytaaattggcaaaggaagctgcagg

SEQ ID NO: 87765 - DNA, 50 bp, homo sapien
attttttcatatttcctttcctctckttctaatggcaaagtaaaatgaag

SEQ ID NO: 87766 - DNA, 50 bp, homo sapien
ggagaaataactcagcatttgcttakaattcatttattttcggttggggt

SEQ ID NO: 87767 - DNA, 50 bp, homo sapien
gttttattttagccaacaggagcaaygtgctatctttatggaatttcttc

SEQ ID NO: 87768 - DNA, 50 bp, homo sapien
tcacatcttccttagttaactttttycttgcatactattccattccatgt

SEQ ID NO: 87769 - DNA, 50 bp, homo sapien
cattattttgtaaagccctatgaacsagtgaaattacacacagttacaaa

SEQ ID NO: 87770 - DNA, 50 bp, homo sapien
atttcccattagttttataagtagartcactgaaaatcatgcattaaaat

SEQ ID NO: 87771 - DNA, 50 bp, homo sapien
atttggtgttgtccccataatgctayaccatctaaatgttatcaatacaa

SEQ ID NO: 87772 - DNA, 50 bp, homo sapien
tttgttcaaacaaagaagacctacayatgggtaagaaatatcaacaaata

SEQ ID NO: 87773 - DNA, 50 bp, homo sapien
gagagtgtgaaaagctggagtagacrggacagaaaacagggtgcagcgtc

SEQ ID NO: 87774 - DNA, 50 bp, homo sapien
aagtgaataaagagtttgaacaagawgtttagaaagtagtaataatacaa

SEQ ID NO: 87775 - DNA, 50 bp, homo sapien
aagacataagcagatcaagacagacrattaggatatacgcagcaagacta

SEQ ID NO: 87776 - DNA, 50 bp, homo sapien
caagtcagaaaaatctaatatttacrggtccttttactggtttcttccat

SEQ ID NO: 87777 - DNA, 50 bp, homo sapien
catatattcactgaaaatctgaaatkacttgaacttgatggtgatctaga

SEQ ID NO: 87778 - DNA, 50 bp, homo sapien
ccttggctataagacagagatgtccracttaaattataatgtggttcttg

SEQ ID NO: 87779 - DNA, 50 bp, homo sapien
aaatccagctgggagtcagtgtatcyattttatgtcatttgcagtaaatt

SEQ ID NO: 87780 - DNA, 50 bp, homo sapien
aaaagccttcatccaatgtcagttawatcagagtaaaaagcctcaacagt

SEQ ID NO: 87781 - DNA, 50 bp, homo sapien
cttcatggagataacattccagtaaraagatatacattataattgtatgg

SEQ ID NO: 87782 - DNA, 50 bp, homo sapien
tttaatgagcgtccattatattctargcaccataatctcagtttctctac

SEQ ID NO: 87783 - DNA, 50 bp, homo sapien
ttgcaaatatttacacatacaaggaragtataaagaaaaataaagtgaac

SEQ ID NO: 87784 - DNA, 50 bp, homo sapien
ggctaagctattaaaaatatcagtayatcagtaactactcattatattga

SEQ ID NO: 87785 - DNA, 50 bp, homo sapien
gagattcctcataggtattatagcasagcattaaacactagccagtttca

SEQ ID NO: 87786 - DNA, 50 bp, homo sapien
aacacccaaatgtccaagagcaagakaataaataaataaattatgctatg

SEQ ID NO: 87787 - DNA, 50 bp, homo sapien
aaatattggtagccgttaagatctayaccgtaagtcatcacttacccagt

SEQ ID NO: 87788 - DNA, 50 bp, homo sapien
tagtccaagcaggtggttgatgaacmctggtaaggacagggctttttgtt

SEQ ID NO: 87789 - DNA, 50 bp, homo sapien
caaccagctaaatttaatttcattaygatttgccaaaggttaactgagaa

SEQ ID NO: 87790 - DNA, 50 bp, homo sapien
tgaaatttaacctagtgtatgtctcrctaaaccagagctgcctggcaaaa

SEQ ID NO: 87791 - DNA, 50 bp, homo sapien
tctcctactcagaggaattcactacwatctgttcatcttcctagttccct

SEQ ID NO: 87792 - DNA, 50 bp, homo sapien
acccatagagtattaaaaatgacaarcgggtagggagaagaaagggataa

SEQ ID NO: 87793 - DNA, 50 bp, homo sapien
tggggattaaggctgggctgtatagmagttgaaacaagagactggacaag

SEQ ID NO: 87794 - DNA, 50 bp, homo sapien
agataaatagctttcagtcagaatarcctaacctgcaatatgcatctttt

SEQ ID NO: 87795 - DNA, 50 bp, homo sapien
ttttccatacatgttgtattttttarctagatcctttaacattttgatca

SEQ ID NO: 87796 - DNA, 50 bp, homo sapien
aactgctgaaaaccaatgattaccayaaatcttgaattcagtcacagaaa

SEQ ID NO: 87797 - DNA, 50 bp, homo sapien
gtggaccagtaacacatttagaatasatttaaaaggaagatgaataattg

SEQ ID NO: 87798 - DNA, 50 bp, homo sapien
gccttgagcctgggcagaattcggasgcaaccatctcctggccgcctgtt

SEQ ID NO: 87799 - DNA, 50 bp, homo sapien
catatgttaggctaatgtcatccaaygcaatatcactcaggatcttgttt

SEQ ID NO: 87800 - DNA, 50 bp, homo sapien
gggacatattttgtatagtaaagcaytatatgataaagaggacattttaa

SEQ ID NO: 87801 - DNA, 50 bp, homo sapien
aaacagaataattataagaacagaaytaagttgaaacacaatttttaaaa

SEQ ID NO: 87802 - DNA, 50 bp, homo sapien
ccccagcctgccaggctggtcacccrggaaggatggataaatattcaaga

SEQ ID NO: 87803 - DNA, 50 bp, homo sapien
tttttgttgctttcttttgtaaatayagatataatgcttctgttttatgt

SEQ ID NO: 87804 - DNA, 50 bp, homo sapien
atgaattctctgatagagagattgaraacaggaaggtcacctggagatct

SEQ ID NO: 87805 - DNA, 50 bp, homo sapien
gatgctgctgtgaacaattaattaamcaagttagcaaaataaattgagcc

SEQ ID NO: 87806 - DNA, 50 bp, homo sapien
gtcctgaaaaaacagatacactaggratgagtaatttctcttttcactct

SEQ ID NO: 87807 - DNA, 50 bp, homo sapien
agcctcccctttttaaaacaattgargcgatatttcatcctttcttgagc

SEQ ID NO: 87808 - DNA, 50 bp, homo sapien
gtttcttgacttctggtacttcaacrcttcaacaatttctccctctttga

SEQ ID NO: 87809 - DNA, 50 bp, homo sapien
caatgacaaaatcaaataaactacaygacaacctgagcaataaggcaaaa

SEQ ID NO: 87810 - DNA, 50 bp, homo sapien
ctagaaaatttagttgaagaaatgamtaatgttgaggaatataacttatt

SEQ ID NO: 87811 - DNA, 50 bp, homo sapien
attcctgggccccattccgaagaaartctgaggggtgtgggggagagagg

SEQ ID NO: 87812 - DNA, 50 bp, homo sapien
aaacttaatatattcagcaattggaraattataaaataaagaatgataga

SEQ ID NO: 87813 - DNA, 50 bp, homo sapien
ttgtttgagaataattgaggactcaygtagtaaggtgtgccagtgagggt

SEQ ID NO: 87814 - DNA, 50 bp, homo sapien
gtatgtgttgcacaagagggtaggcyctgtccgtgaagtgtgttcacagc

SEQ ID NO: 87815 - DNA, 50 bp, homo sapien
caaggcatgattttttaaatcccaartaatagtaataacagtaataattg

SEQ ID NO: 87816 - DNA, 50 bp, homo sapien
ccttggtagtaattgttccttgatarataataaccagataacaattagcc

SEQ ID NO: 87817 - DNA, 50 bp, homo sapien
tggactcttcccaatagcattcaaaygtgcttcatgttattcatctttac

SEQ ID NO: 87818 - DNA, 50 bp, homo sapien
aaaagatcactaccaggatgctattsaaaaaagttggtcggtttccacca

SEQ ID NO: 87819 - DNA, 50 bp, homo sapien
agctgggttttcatgtaatacctatraagctccatctggcaaatacctat

SEQ ID NO: 87820 - DNA, 50 bp, homo sapien
gaaaattttacagctagaaaggaacygataggtcatctgatttgataact

SEQ ID NO: 87821 - DNA, 50 bp, homo sapien
tttgtagctggcaagtcactggcgakaactgaagttttggaaggggctga

SEQ ID NO: 87822 - DNA, 50 bp, homo sapien
ggtcatctgatttgataactcaatcrcatcgaaagaaactaagagccagt

SEQ ID NO: 87823 - DNA, 50 bp, homo sapien
tttggaaggggctgacagcagttacratgaatggttattactgcagaggg

SEQ ID NO: 87824 - DNA, 50 bp, homo sapien
gcctacttgattctcaaacttttcaygtccaaccgaacacctgacttccc

SEQ ID NO: 87825 - DNA, 50 bp, homo sapien
ctcctttacagactaagcggataaamggctgcagatgaaaaggccttcac

SEQ ID NO: 87826 - DNA, 50 bp, homo sapien
attgcaattaatatgagtgtgcatawtctcttccagatcctgttttcaat

SEQ ID NO: 87827 - DNA, 50 bp, homo sapien
taccacattttctttatctagttaaytgtcaatggatatttaggttgttt

SEQ ID NO: 87828 - DNA, 50 bp, homo sapien
tgacctccactgatatcttcctggcragaaaaaatggagtagtttgttgc

SEQ ID NO: 87829 - DNA, 50 bp, homo sapien
gctaaatctcttggtgtccactgaartctttggtagcacaagaatatatg

SEQ ID NO: 87830 - DNA, 50 bp, homo sapien
tccatagcactgacaatcctttccayaaattaccatgcataatgagcttt

SEQ ID NO: 87831 - DNA, 50 bp, homo sapien
atcaaacaaatcatgaaagagatagyggatatggcaaaaatgatgtgttg

SEQ ID NO: 87832 - DNA, 50 bp, homo sapien
ggcagatacacttgggttatgaaaakacatcctaactgatgtctaattgc

SEQ ID NO: 87833 - DNA, 50 bp, homo sapien
gtattcctatatgtattacatcacawctagtgaattcaacagaacacaat

SEQ ID NO: 87834 - DNA, 50 bp, homo sapien
aaatcctttgaatatgtactcgcaaygaataaacataatgaattattact

SEQ ID NO: 87835 - DNA, 50 bp, homo sapien
ttattgtactttaatatgctatctaygttataccccaaaagtcatcagta

SEQ ID NO: 87836 - DNA, 50 bp, homo sapien
tgatcatttttaccattatttttagkatgtgtatttcatttatttatggc

SEQ ID NO: 87837 - DNA, 50 bp, homo sapien
cttttcgctcttttgtctacctcaarctgccattgtgggtcttttccaag

SEQ ID NO: 87838 - DNA, 50 bp, homo sapien
gacctagacatacagaccagtatagsagctgaagaacctgcctagaaaaa

SEQ ID NO: 87839 - DNA, 50 bp, homo sapien
tttatgaacactcatttctttataartcagtttggtaccatgtggacaac

SEQ ID NO: 87840 - DNA, 50 bp, homo sapien
ttaaaaatttttgtttggttatatcraaatagttacaggcactaaagtta

SEQ ID NO: 87841 - DNA, 50 bp, homo sapien
tatcatcacctgcctttcaaaataarcatactcattacatgtgagggcaa

SEQ ID NO: 87842 - DNA, 50 bp, homo sapien
agagtacatgcagctatgaatagtaraagatgagaatccagatgctggtg

SEQ ID NO: 87843 - DNA, 50 bp, homo sapien
caagagcctataggagcatatttaarcagctacaatttgatgtatgcatt

SEQ ID NO: 87844 - DNA, 50 bp, homo sapien
tgaaacctggacatcttaggtattakgtatgaggttctaattcttattta

SEQ ID NO: 87845 - DNA, 50 bp, homo sapien
aaacctcacttggcatgtaaaccagraaatgaaatattgtgaatggttac

SEQ ID NO: 87846 - DNA, 50 bp, homo sapien
aggaacttacaaataattatgaaaamccttaacttctcagagttgctgaa

SEQ ID NO: 87847 - DNA, 50 bp, homo sapien
ttattctcctctgatctgcccaataytattagaaaaagccaccctgctac

SEQ ID NO: 87848 - DNA, 50 bp, homo sapien
tactatttttctaaggtagcaaacaytggatttacccaaattttgccttc

SEQ ID NO: 87849 - DNA, 50 bp, homo sapien
attcagcaaatatcttgaaatctacyataatgaaaataaatgttatttat

SEQ ID NO: 87850 - DNA, 50 bp, homo sapien
atctaaggtgttagtagggcatgaartgtatgtactcttgaatgaatgag

SEQ ID NO: 87851 - DNA, 50 bp, homo sapien
gtattttgcatttagaagaaaaaaawtcatacattacaaaaatagcaatg

SEQ ID NO: 87852 - DNA, 50 bp, homo sapien
gaagtctcagattgacagtgccaaartataactacaaagaaaaccactct

SEQ ID NO: 87853 - DNA, 50 bp, homo sapien
attaatagtctattttttaaatgaasgtcaagaggtaagtgggtaaattc

SEQ ID NO: 87854 - DNA, 50 bp, homo sapien
tgttgtcttcttttaaatatgtctayccatttgtatgaaagatcttaact

SEQ ID NO: 87855 - DNA, 50 bp, homo sapien
gaaacactttttcacattgtcctaaytgattctatttagaaattaaattc

SEQ ID NO: 87856 - DNA, 50 bp, homo sapien
caagttgattgcctttatctatatcyactgaatcaaaatatttgactttt

SEQ ID NO: 87857 - DNA, 50 bp, homo sapien
aaccccagcaggtgactctaatgcamatgatctataaatcacactttgag

SEQ ID NO: 87858 - DNA, 50 bp, homo sapien
gttttcgttatttcatttttccctawctacaaagtatgttgtaaataaac

SEQ ID NO: 87859 - DNA, 50 bp, homo sapien
acctataaccacttgtcttaaaatayatgtactcatgaaacatagtgaaa

SEQ ID NO: 87860 - DNA, 50 bp, homo sapien
gatgtcattactgattttggttaaayacttgtttgcttctggactcttta

SEQ ID NO: 87861 - DNA, 50 bp, homo sapien
gcgtttaacctggacaaaagctatasagtccaaaaaacccaaatctctgt

SEQ ID NO: 87862 - DNA, 50 bp, homo sapien
atctaagattacaaactcacttatcratggctacaattattcttttttcc

SEQ ID NO: 87863 - DNA, 50 bp, homo sapien
gtcctagaaattcatccatcctacaytgataatatttttaatagatatag

SEQ ID NO: 87864 - DNA, 50 bp, homo sapien
accacctggaagtctttttttaacaygattttgagacccatccatatttt

SEQ ID NO: 87865 - DNA, 50 bp, homo sapien
gttttcttatatttaaaactgaaaartcagatgaatcttaactgtatcag

SEQ ID NO: 87866 - DNA, 50 bp, homo sapien
ccaacagatttctcttcctgaataascctgatgtcctttacacattgtat

SEQ ID NO: 87867 - DNA, 50 bp, homo sapien
tttaaaatgctatatatcaaaataamgtgtaatctttcaaaatagcatta

SEQ ID NO: 87868 - DNA, 50 bp, homo sapien
ggctatctagggtaactgccaatagktaagttcttactcaaccatgtggc

SEQ ID NO: 87869 - DNA, 50 bp, homo sapien
agacccagagtagccaacttattacygaaggagagcaaagttctactaga

SEQ ID NO: 87870 - DNA, 50 bp, homo sapien
gagaaagaattagcacaagaacttargcggttcaaaaggccagagtgttc

SEQ ID NO: 87871 - DNA, 50 bp, homo sapien
aaaatcagataaatggttgtctgaayaagtaagtgtgaacacctacagct

SEQ ID NO: 87872 - DNA, 50 bp, homo sapien
gaagtattaatggcagaagagacaakctgagaaaagaatctcaggagctt

SEQ ID NO: 87873 - DNA, 50 bp, homo sapien
aaaatccgaaattttgtaaagagaawaatctatgactcattgacattatt

SEQ ID NO: 87874 - DNA, 50 bp, homo sapien
acattttgtactttcagaaaccaaakcataattttaatggactttaatgc

SEQ ID NO: 87875 - DNA, 50 bp, homo sapien
tgatttgcattaactaaaattgctargatacagtttaataaacaatagta

SEQ ID NO: 87876 - DNA, 50 bp, homo sapien
tgagacagaatgtttctgactgacawctttaaacttaatttgatgaaaag

SEQ ID NO: 87877 - DNA, 50 bp, homo sapien
gcctttgtcccaggaatcagcctaargtgtgtatttaaggtcttctcagg

SEQ ID NO: 87878 - DNA, 50 bp, homo sapien
aatcagtgaacagagacaaatacccratctttggagaatagcatcatttt

SEQ ID NO: 87879 - DNA, 50 bp, homo sapien
ataactttcacttgactttcatttcyatgccaataagttcattctagtaa

SEQ ID NO: 87880 - DNA, 50 bp, homo sapien
cagtgattttggatcagtcatttccyaagtgttattatgcaaaaaactac

SEQ ID NO: 87881 - DNA, 50 bp, homo sapien
tttttaaatgtaaaattcagtggtayaggtaattcacatttttgttcaat

SEQ ID NO: 87882 - DNA, 50 bp, homo sapien
tgtcactttcagcataggtagttaawtaatgcagtaaagtaacagagaaa

SEQ ID NO: 87883 - DNA, 50 bp, homo sapien
taagggaagattatatgtgtttttaygtctaccattataaatttgtatgc

SEQ ID NO: 87884 - DNA, 50 bp, homo sapien
attcgtcttttcattcacttaacaaygtttgcagagcataaatttttaat

SEQ ID NO: 87885 - DNA, 50 bp, homo sapien
tagcttcagaatgtttggtatacaartaggtctggctaaatataagtgtt

SEQ ID NO: 87886 - DNA, 50 bp, homo sapien
tatttttaataacttccctgtatttsttggtttcagtattaattaatctc

SEQ ID NO: 87887 - DNA, 50 bp, homo sapien
cagtcatatatgagttgcatgacacrggttcgtatttatgagctgtaccc

SEQ ID NO: 87888 - DNA, 50 bp, homo sapien
agtagggaacaacctttctcaaaatytcctttaccacatgaagcaaaatt

SEQ ID NO: 87889 - DNA, 50 bp, homo sapien
ataataaatataaatgctcaggaaawtatgatagttttattgtaagagag

SEQ ID NO: 87890 - DNA, 50 bp, homo sapien
aagactgtgcactcttgggtggaaaygaaattatatagaaagaaaagatt

SEQ ID NO: 87891 - DNA, 50 bp, homo sapien
gagtactatggcattaaaaatgatarcatccagtaaatagctccatctat

SEQ ID NO: 87892 - DNA, 50 bp, homo sapien
caggccttttggtatgaaaagactawaaattacaggacacaagcattcat

SEQ ID NO: 87893 - DNA, 50 bp, homo sapien
cataattaatttaatctttactacaytcctggcagatagatgattttaca

SEQ ID NO: 87894 - DNA, 50 bp, homo sapien
cacattttgaagtatttaataaaaayggatgctagaattgcaaccctgga

SEQ ID NO: 87895 - DNA, 50 bp, homo sapien
acctagggagatcaggcatttccagytgactcacagtgggctatctttta

SEQ ID NO: 87896 - DNA, 50 bp, homo sapien
atttattttcagaaataatttcaccyatgttactgtattttgggaatagc

SEQ ID NO: 87897 - DNA, 50 bp, homo sapien
taagcatctcccagttccaagaatcragagctatctttgggcattaccaa

SEQ ID NO: 87898 - DNA, 50 bp, homo sapien
cctgagctttttgttcagtaaatagyattggctagctctaccattgcctg

SEQ ID NO: 87899 - DNA, 50 bp, homo sapien
tctgtttatacaaaggtttgcctcayggtacattaattcctctgcactgc

SEQ ID NO: 87900 - DNA, 50 bp, homo sapien
atgaaaaagaaaagtattacataacrataaaggtttcaactcaacaagaa

SEQ ID NO: 87901 - DNA, 50 bp, homo sapien
ttggctataagaaaagtaggcagaarcagttactaagaaacatgagccat

SEQ ID NO: 87902 - DNA, 50 bp, homo sapien
ggatcctttcctttgaatctccatayaacggtagaattgggagtacaaaa

SEQ ID NO: 87903 - DNA, 50 bp, homo sapien
tgaaatcccaactttatgtgaattaycttaattgtgaaatgttggcaatt

SEQ ID NO: 87904 - DNA, 50 bp, homo sapien
atgtttgatatggtaaagaatgatgrcactaacctaataacaaagaaatt

SEQ ID NO: 87905 - DNA, 50 bp, homo sapien
gctccatgtaaaggactttacatctmactttgtgttgaatgtacggtcac

SEQ ID NO: 87906 - DNA, 50 bp, homo sapien
tggcagcaaaaacaaaaaagaaagayctgctttataagttacttccttgt

SEQ ID NO: 87907 - DNA, 50 bp, homo sapien
tagcccaacaataagtaaaaactcaraggtataggtgtgctagaaactgc

SEQ ID NO: 87908 - DNA, 50 bp, homo sapien
atagagttgaagtttaaaactgatcraaaactgaatactagaatggtttt

SEQ ID NO: 87909 - DNA, 50 bp, homo sapien
atccttttctgttttgctatatctayggtgatgcagtttcaattgtataa

SEQ ID NO: 87910 - DNA, 50 bp, homo sapien
cattcaacaattatttaatacttacrataagctaggcatgtttaaaccaa

SEQ ID NO: 87911 - DNA, 50 bp, homo sapien
tgacacacaaaatcatttcttctgaygctacttctatacattccagtaaa

SEQ ID NO: 87912 - DNA, 50 bp, homo sapien
cataatttcctgggagtccaggatascttcttcctaaatgagaaagtttt

SEQ ID NO: 87913 - DNA, 50 bp, homo sapien
acattaatcattactatttaattcastaagcttttgaataattctaaccc

SEQ ID NO: 87914 - DNA, 50 bp, homo sapien
tgtgtgtgtgttggttcagtaagaaragtgtgcacacagtagaaaaagtg

SEQ ID NO: 87915 - DNA, 50 bp, homo sapien
ataaaactattttgaaaaagtaatartaaatcaaagatgcaggatataat

SEQ ID NO: 87916 - DNA, 50 bp, homo sapien
tttgtctgcatgtgtcgtaattgtaycgcagctgaggggccccagaaagc

SEQ ID NO: 87917 - DNA, 50 bp, homo sapien
tcatcttaaattcactgtgatagaawcttagtaatgtcttcagatctgtt

SEQ ID NO: 87918 - DNA, 50 bp, homo sapien
gtctagttggttatttaattcaacawctgagacaaaatgttctttggtat

SEQ ID NO: 87919 - DNA, 50 bp, homo sapien
cttagtaatgtcttcagatctgttcrccaaataattaagtaattaacaac

SEQ ID NO: 87920 - DNA, 50 bp, homo sapien
caaattaaaccccatcggtttttcargagaagatactgtgatccagaggt

SEQ ID NO: 87921 - DNA, 50 bp, homo sapien
accagtttgcttgttttatccacgastactttcagacaccattatgtgta

SEQ ID NO: 87922 - DNA, 50 bp, homo sapien
gaagactgtaggaaaaaagattctcraaaatgaagtttcctgcttctcct

SEQ ID NO: 87923 - DNA, 50 bp, homo sapien
ataccatataccatatgtagtctaartatcaaattgcagatcagttcact

SEQ ID NO: 87924 - DNA, 50 bp, homo sapien
ttcagagactacataacaaaatcaaracgttgaaatttagcggctgtcct

SEQ ID NO: 87925 - DNA, 50 bp, homo sapien
taggaattggtagctgtactgagaarttaggtctcacattcaaaataaca

SEQ ID NO: 87926 - DNA, 50 bp, homo sapien
aagaatatgaagaccacatagaatastatacagtttgaaaatacaaacat

SEQ ID NO: 87927 - DNA, 50 bp, homo sapien
agaatgtccttcattgctttaattcsattcatcatacaaccccaggttgt

SEQ ID NO: 87928 - DNA, 50 bp, homo sapien
aaacagtaaagactttagactaaaayataggagtttaccttcaggctaga

SEQ ID NO: 87929 - DNA, 50 bp, homo sapien
tctaaaggcatttccttttccaaagrcttcattgctcaaaatctctagat

SEQ ID NO: 87930 - DNA, 50 bp, homo sapien
ttgctgaatgctgtcccatgtctaaygcaatctaaatttctcacatctga

SEQ ID NO: 87931 - DNA, 50 bp, homo sapien
acaaaattaatagtctaaaaattacygagaacagatgtcttcaaatccta

SEQ ID NO: 87932 - DNA, 50 bp, homo sapien
aagtttttattgtctgtagtcttcaygcactccaatattttgacatctca

SEQ ID NO: 87933 - DNA, 50 bp, homo sapien
acacattgtagatgactacagactayccttctggtcaggaaatatgcttt

SEQ ID NO: 87934 - DNA, 50 bp, homo sapien
tttttgtagttgtttactgacttaamtggtatagaatgtagttcatttat

SEQ ID NO: 87935 - DNA, 50 bp, homo sapien
atttgctgcatggggtctattcaccrcctttcctaccatctgttacctat

SEQ ID NO: 87936 - DNA, 50 bp, homo sapien
ctacaaacttcatgagacaatagtcsagaagaaaggcagtcagatgtgaa

SEQ ID NO: 87937 - DNA, 50 bp, homo sapien
taaagtatcatttatctttaaaatayctgcagcaactttaaatgcgcctt

SEQ ID NO: 87938 - DNA, 50 bp, homo sapien
tcattatctactatgcaagtatgtakgaggatattttttaaatacactta

SEQ ID NO: 87939 - DNA, 50 bp, homo sapien
gtttaacactgatttatttgtaggayataatttgctagcactgaattagt

SEQ ID NO: 87940 - DNA, 50 bp, homo sapien
cagttctataatcctgagccataagyaactagtacagcaattctctagta

SEQ ID NO: 87941 - DNA, 50 bp, homo sapien
aaccctttacctgctctttctggaarcatagctataccacattctcagtc

SEQ ID NO: 87942 - DNA, 50 bp, homo sapien
aataaaataaaagcaattacaaaackattacaaaacctatcaagaccatt

SEQ ID NO: 87943 - DNA, 50 bp, homo sapien
aacttaacttctctctacctctctamgcacattaccaacactggtcttct

SEQ ID NO: 87944 - DNA, 50 bp, homo sapien
tgcattcaccacatctcagcgcctgwagagtgaatatttcttggttgaaa

SEQ ID NO: 87945 - DNA, 50 bp, homo sapien
cagataagctgaggaagtatagtcayatctgagtgggccaggtcagacaa

SEQ ID NO: 87946 - DNA, 50 bp, homo sapien
tctcctgtttacgcttcgatttgatsagactttgaatgtgtgtgaacatg

SEQ ID NO: 87947 - DNA, 50 bp, homo sapien
ttgtcagaagtgggctaagaacagaytccccctctcctgagttttgggag

SEQ ID NO: 87948 - DNA, 50 bp, homo sapien
cagcatataagtatcacttcagggastaggagaatatggagttctttttg

SEQ ID NO: 87949 - DNA, 50 bp, homo sapien
tattttcaataactgttaactgacaractagatcaagaccgcaaagttaa

SEQ ID NO: 87950 - DNA, 50 bp, homo sapien
ctactgcagaggtttttaaaaatacygaagatataattgtccttatttat

SEQ ID NO: 87951 - DNA, 50 bp, homo sapien
gaacctggacaccctcctcctttaayagaatgatttgatttattttactt

SEQ ID NO: 87952 - DNA, 50 bp, homo sapien
acaggccacagtgccagacaggactkaatggcaaagtgaggattccctga

SEQ ID NO: 87953 - DNA, 50 bp, homo sapien
atcgccttttcctctatgtcaactayctcttctgttctcagaggttaatt

SEQ ID NO: 87954 - DNA, 50 bp, homo sapien
aatattagcatcaggaattagaagamtatgaaaggcaaataataaatgtc

SEQ ID NO: 87955 - DNA, 50 bp, homo sapien
aattggaaatgtattaagttgtcaaragtcacaatgttggtccttcaggc

SEQ ID NO: 87956 - DNA, 50 bp, homo sapien
agagagatcaagcgtgatcaaacatmaaatgcactataaatctataaaaa

SEQ ID NO: 87957 - DNA, 50 bp, homo sapien
ccgaaaattttcctttagtgataaartgcactccaagttaaacatgttca

SEQ ID NO: 87958 - DNA, 50 bp, homo sapien
tttttagtacacctctgagaagtagraatatgaaggttgcatttttagta

SEQ ID NO: 87959 - DNA, 50 bp, homo sapien
accccttaaattttcattttctctcraagtctcctctaaatttagtatat

SEQ ID NO: 87960 - DNA, 50 bp, homo sapien
gaacaattagtttagagttaaattarccttgcttattaaaagctacacat

SEQ ID NO: 87961 - DNA, 50 bp, homo sapien
tattaagcatacaacatgataaaagsttgcttatttaagatgaactttta

SEQ ID NO: 87962 - DNA, 50 bp, homo sapien
tataatacattttttctcaaaattayggcttaagtgcccaaactttcatg

SEQ ID NO: 87963 - DNA, 50 bp, homo sapien
gccgttgttttggactaagttcatgyactaggtctcaacaaaccaagcca

SEQ ID NO: 87964 - DNA, 50 bp, homo sapien
tttaagcatcttgacagttaaaagarattaggaaaagtagatagacatgg

SEQ ID NO: 87965 - DNA, 50 bp, homo sapien
aaaaatatatatatagtgtgtgttargaatggaatacattctaaatagtt

SEQ ID NO: 87966 - DNA, 50 bp, homo sapien
agtttgtaagccaaaggaatacttayattagagctacattatgtagagga

SEQ ID NO: 87967 - DNA, 50 bp, homo sapien
tatgtagaggagaaataatgttaaartaaacccaattgttactctaaata

SEQ ID NO: 87968 - DNA, 50 bp, homo sapien
agaaagacagggagagtctccaggarctataagaatgtaatcaacttgag

SEQ ID NO: 87969 - DNA, 50 bp, homo sapien
agagctaatgatgaattgttgaaaaygcttaggaaataaaatgactattt

SEQ ID NO: 87970 - DNA, 50 bp, homo sapien
ggaggacactgaaagtattattcaaytcaaggcgctgtgtctctgagaga

SEQ ID NO: 87971 - DNA, 50 bp, homo sapien
ttttggtacagttattatcatacacwatacacaatactacatgtaattat

SEQ ID NO: 87972 - DNA, 50 bp, homo sapien
atgatacactgatcatgttttaaaawtctcattatatatttctaaatata

SEQ ID NO: 87973 - DNA, 50 bp, homo sapien
ttaatttggaaatactattgaaatakatatgagaatgcaattgatcttac

SEQ ID NO: 87974 - DNA, 50 bp, homo sapien
gaacagctgcatctagataactctgyaattaagtggagcatcatgaaaca

SEQ ID NO: 87975 - DNA, 50 bp, homo sapien
tgcattactatcaagcctagttactyttggcccaccactctgtggcagaa

SEQ ID NO: 87976 - DNA, 50 bp, homo sapien
aagaaagacaaagtatcatgaaggarccgcaggacctaaacaacatgtac

SEQ ID NO: 87977 - DNA, 50 bp, homo sapien
cttgaagccatcaagtcagaggttcrtccaaggcgctcgatttaggacct

SEQ ID NO: 87978 - DNA, 50 bp, homo sapien
ccttggcaagaatttcagtcataccrgcatcctgctcatcttctcttccc

SEQ ID NO: 87979 - DNA, 50 bp, homo sapien
tgaaactaattgcactctaatcatgrgaataattgtaaagtctatcttca

SEQ ID NO: 87980 - DNA, 50 bp, homo sapien
catatgtgtgtgtggagtatggggaygtacctgttatgcaacccaattaa

SEQ ID NO: 87981 - DNA, 50 bp, homo sapien
aaaaaataaattttataactttccartcagatgcaccaaaatatagcatg

SEQ ID NO: 87982 - DNA, 50 bp, homo sapien
tgatttctcctgtgcagcttcatagrcaccgcacaattttagagatattt

SEQ ID NO: 87983 - DNA, 50 bp, homo sapien
agtatgcatgtccacatataatacayctatactctcctttaatttattta

SEQ ID NO: 87984 - DNA, 50 bp, homo sapien
tttacaccttcttctcttaacaagaycaagtcaaaaactaaatgttctct

SEQ ID NO: 87985 - DNA, 50 bp, homo sapien
acaaatacagcagagtctatgagagraagtgtccctacaaaaatgccaga

SEQ ID NO: 87986 - DNA, 50 bp, homo sapien
tgaggacaaatatatatctgaacaasagtccaaataaattattttatctg

SEQ ID NO: 87987 - DNA, 50 bp, homo sapien
tctgcccttcccatgaaagttgttcyatgaatgagtgggtcagagcgtct

SEQ ID NO: 87988 - DNA, 50 bp, homo sapien
aaaaaacaccttcttacagacattarctaaatcccagtctcaaacatagt

SEQ ID NO: 87989 - DNA, 50 bp, homo sapien
ttttaaacgcatttctccagtaaaasgacaaaagatcttcaattctttgt

SEQ ID NO: 87990 - DNA, 50 bp, homo sapien
gccaaattgaatgttttttagtaaakttataatgagtagtaacaaaaatt

SEQ ID NO: 87991 - DNA, 50 bp, homo sapien
atttctatcccctttcttgccctaartacaaagtttataaaatcttactt

SEQ ID NO: 87992 - DNA, 50 bp, homo sapien
taaataactgctatagaaaataatamggtaagggaataagtatattatgc

SEQ ID NO: 87993 - DNA, 50 bp, homo sapien
ctgcagaacacacaaaaaagtatagragctgatgaagaatcagagagcat

SEQ ID NO: 87994 - DNA, 50 bp, homo sapien
ccatgtacattgtctcatttgattgwaaactaaaagaattccacggctat

SEQ ID NO: 87995 - DNA, 50 bp, homo sapien
aaaagtttaattaatttgctgagtayacatatatcttgttagttgctagg

SEQ ID NO: 87996 - DNA, 50 bp, homo sapien
atatggattgcaacaaaaatagagarcagtcattgtacatattctaatct

SEQ ID NO: 87997 - DNA, 50 bp, homo sapien
cttcaagataaacatggataaaatayattcgttcagtcaacaaatgctta

SEQ ID NO: 87998 - DNA, 50 bp, homo sapien
catcttacctgacacctgtagatacraccataatccacatctaaaaattc

SEQ ID NO: 87999 - DNA, 50 bp, homo sapien
tgacagaaaaagttgatgtcacctartgtaaaaaaaagggagttgctaca

SEQ ID NO: 88000 - DNA, 50 bp, homo sapien
atccttcacttggattctcctagtastaacatcttgcataactatagtgc

SEQ ID NO: 88001 - DNA, 50 bp, homo sapien
tggagggaagttggaatggaatcatragttatttcagaaagattacttcg

SEQ ID NO: 88002 - DNA, 50 bp, homo sapien
atgtttttactcacagatactttgaratagatacagccgggcgcggtggc

SEQ ID NO: 88003 - DNA, 50 bp, homo sapien
gaaaccaagattgagcttagtataawtaacataggtatataaggaaagtt

SEQ ID NO: 88004 - DNA, 50 bp, homo sapien
ccaggtaggttgtaaatgaatgttaygttttatgcatcaaacacaataat

SEQ ID NO: 88005 - DNA, 50 bp, homo sapien
agaagtccattccctaatcttaagcragtaatatctccctaaatgacatg

SEQ ID NO: 88006 - DNA, 50 bp, homo sapien
atggaaatccagacaagagcatggamtcaagaaaagggtagggttatatt

SEQ ID NO: 88007 - DNA, 50 bp, homo sapien
taaagttaattttattattacacccyatgagtaccaccaattaaatattg

SEQ ID NO: 88008 - DNA, 50 bp, homo sapien
tatccacattccagatggccttataygctacatgttcctgggaaacgttc

SEQ ID NO: 88009 - DNA, 50 bp, homo sapien
gtgaatttcttacttatatatgaggmcaattttatcgagcatttttcatg

SEQ ID NO: 88010 - DNA, 50 bp, homo sapien
tgatcaggaggtagtggttcatttcyaccctatttcctcttacctttcat

SEQ ID NO: 88011 - DNA, 50 bp, homo sapien
ggagagagagaaagaacgagggggamgttccatacagttttaaaccatca

SEQ ID NO: 88012 - DNA, 50 bp, homo sapien
tccactatacatgtagaagagaatayaactggtgggaattcaaaaaaatt

SEQ ID NO: 88013 - DNA, 50 bp, homo sapien
aggttattgttggggtgaacagaccsaacaccaggtcgtgggggtgacaa

SEQ ID NO: 88014 - DNA, 50 bp, homo sapien
ttggcatgttaaaaaggaggccttasgtatgctgccgtggggaggtgctg

SEQ ID NO: 88015 - DNA, 50 bp, homo sapien
tatcgttgttgtcaacttaaaatcartgagttgggtgaaaacaatcaagt

SEQ ID NO: 88016 - DNA, 50 bp, homo sapien
tagccatatttactcaacaagatacwtatttactcaacaaggtattccaa

SEQ ID NO: 88017 - DNA, 50 bp, homo sapien
accctgtctcccctgctgtcaataaycttcgagttccctagacctcattt

SEQ ID NO: 88018 - DNA, 50 bp, homo sapien
cgaaccccatggccccctattaacawgggtgagagccactttgacaccga

SEQ ID NO: 88019 - DNA, 50 bp, homo sapien
atgtgtaataaaactatcacaaataygacagcaaaagaatcaaatttcaa

SEQ ID NO: 88020 - DNA, 50 bp, homo sapien
catggattaaatcattgtggtaaaakttgaacaaacgtttacattaaagt

SEQ ID NO: 88021 - DNA, 50 bp, homo sapien
atcctctcaagttataaaagaccaamcacttttacctctgatatgaatca

SEQ ID NO: 88022 - DNA, 50 bp, homo sapien
aattatggtctttcttcctatcaaartgtgtatttctttatgaacttgta

SEQ ID NO: 88023 - DNA, 50 bp, homo sapien
gttacaatattgtttaactgtcaacraagtgtattttcttgctaactgag

SEQ ID NO: 88024 - DNA, 50 bp, homo sapien
gcaacagtcacagtctaacatttctracataacttaactcctcgaatcct

SEQ ID NO: 88025 - DNA, 50 bp, homo sapien
ctcctgacctgagaatatgaggatasagtctttcttctaagagactttgc

SEQ ID NO: 88026 - DNA, 50 bp, homo sapien
tctctaccaagaaagtagactgagcrtgtggaaataaggagctgatagat

SEQ ID NO: 88027 - DNA, 50 bp, homo sapien
aattatccacctttgcttgactatgyatcctttctagtacagaaaaccaa

SEQ ID NO: 88028 - DNA, 50 bp, homo sapien
ctaccacgtatccaactctttgacaycaggttatttctagccttatttac

SEQ ID NO: 88029 - DNA, 50 bp, homo sapien
aaagtgcagggacataggccctttaraagactaagatataatcataagat

SEQ ID NO: 88030 - DNA, 50 bp, homo sapien
gacataacccattttctggtcctctraatcttaagagtgcctaacatata

SEQ ID NO: 88031 - DNA, 50 bp, homo sapien
ggaaatactcttagtagagattctakgctagatcaaggactcagtgaaat

SEQ ID NO: 88032 - DNA, 50 bp, homo sapien
tattttcaatttctgtaaaatatacracactataagatagctcgcattcc

SEQ ID NO: 88033 - DNA, 50 bp, homo sapien
tttttttcagatatgtgttcaattargttaaggatttagtatgcaactgt

SEQ ID NO: 88034 - DNA, 50 bp, homo sapien
aaagagtttttcaatttctttaaaasttatgcctaccttatgacccagca

SEQ ID NO: 88035 - DNA, 50 bp, homo sapien
tgttctcagattcaaggcttacccaygtactgaccgagtttcacatcagt

SEQ ID NO: 88036 - DNA, 50 bp, homo sapien
ctttttcatttagttctacaatctarcttaatttcatcaccatatatata

SEQ ID NO: 88037 - DNA, 50 bp, homo sapien
gcacaaactcctaatcaaatcataaycctctgcataactcatggtcaaat

SEQ ID NO: 88038 - DNA, 50 bp, homo sapien
actcgggtgtctctgtcactctaaayagcctgtaggagccacacatgtga

SEQ ID NO: 88039 - DNA, 50 bp, homo sapien
ctttctttggaaatgtggctttatartaaatgtaacacaagcaaagactt

SEQ ID NO: 88040 - DNA, 50 bp, homo sapien
aataaaagtagaagtgctggtttctsacccataaaatatttacttcttat

SEQ ID NO: 88041 - DNA, 50 bp, homo sapien
tagagaaagatctaaaatgaatatgragaagaatatttgatttgattaga

SEQ ID NO: 88042 - DNA, 50 bp, homo sapien
atacatttgttgattattactgtgayccatgtactcttgtaggtgtttag

SEQ ID NO: 88043 - DNA, 50 bp, homo sapien
aatagatattaatgcatagacattamaagataagtattatactaagaaac

SEQ ID NO: 88044 - DNA, 50 bp, homo sapien
ctcttgtaggtgtttagcatagttcratgaataaagaagcccctgtactt

SEQ ID NO: 88045 - DNA, 50 bp, homo sapien
ggatgaagcaacttagcctgctatayagacctaagagacttgacaaggct

SEQ ID NO: 88046 - DNA, 50 bp, homo sapien
tcaaagattgaaggaacataaggaaygttaagtccaaaaagatgagaaag

SEQ ID NO: 88047 - DNA, 50 bp, homo sapien
tcacaacatagattagctgttgtcarcccttaaaaaatctggatcctgtt

SEQ ID NO: 88048 - DNA, 50 bp, homo sapien
atcagaaatatcaagatgaggatacraagcagagcatggagtactgaaat

SEQ ID NO: 88049 - DNA, 50 bp, homo sapien
gcagtgtgcatgtcagcagattacasaattatggctcccagtggtctaac

SEQ ID NO: 88050 - DNA, 50 bp, homo sapien
tcaaagataatagctacggtgcaaakcttataaattgagaatatacattt

SEQ ID NO: 88051 - DNA, 50 bp, homo sapien
aacagaaaatacattttatagaaagsctatgatatggtttggctctgggt

SEQ ID NO: 88052 - DNA, 50 bp, homo sapien
agatatggaaaagatacttgaaaaaktttatatgaatagctacactaatt

SEQ ID NO: 88053 - DNA, 50 bp, homo sapien
aaggattttaatataaaatgcagtcmatgtaaataaataaaatcttgcaa

SEQ ID NO: 88054 - DNA, 50 bp, homo sapien
taaggaaataaataaaatattaaccwctacttaaacaatgcatccaacta

SEQ ID NO: 88055 - DNA, 50 bp, homo sapien
taattatgcacagtcctataattgakcctggtttgcattgtaggaatatt

SEQ ID NO: 88056 - DNA, 50 bp, homo sapien
gtccccgttctgtcccttggtgacarcatcactatttatatgcgacttaa

SEQ ID NO: 88057 - DNA, 50 bp, homo sapien
attacaagaaatctaaaaaaagtagsataattactcactcatttcccgaa

SEQ ID NO: 88058 - DNA, 50 bp, homo sapien
gtaacatgtaaaccttctacttggaraaactcctttgcagacatttaaaa

SEQ ID NO: 88059 - DNA, 50 bp, homo sapien
ttgttccaagacctaggctactcagractggtttagaacatcagaaaatg

SEQ ID NO: 88060 - DNA, 50 bp, homo sapien
tcaaagattattttatagggctccamggttcattccacctctcacaagaa

SEQ ID NO: 88061 - DNA, 50 bp, homo sapien
ctagataataagaattttaggtaatkagaatagaagtgcctcttcagatg

SEQ ID NO: 88062 - DNA, 50 bp, homo sapien
tttttttcttgctctattcttcataytagtttccaaaattacactaagat

SEQ ID NO: 88063 - DNA, 50 bp, homo sapien
gtgtgatttttcctctactatgaatyacttctaagcactttcccaatctt

SEQ ID NO: 88064 - DNA, 50 bp, homo sapien
tgaaaaagtctgttagggcttcataraattgtatgtgctttagcatttga

SEQ ID NO: 88065 - DNA, 50 bp, homo sapien
cagaatgaaacagctattgattataraaatggaagtaaaaaaataggagg

SEQ ID NO: 88066 - DNA, 50 bp, homo sapien
cactgcaatgttgacccactcggaaygtagagcatgggcaaaaaaaagaa

SEQ ID NO: 88067 - DNA, 50 bp, homo sapien
aaatttgtaccttagtaggagggctraaatatccttggagtgaatctctt

SEQ ID NO: 88068 - DNA, 50 bp, homo sapien
ctttatgcttgacacattctttagaygtttagaacgataatttagatgga

SEQ ID NO: 88069 - DNA, 50 bp, homo sapien
ttccatgcctcctgcctctatcaacmggaaaacatattcatgaagtgcaa

SEQ ID NO: 88070 - DNA, 50 bp, homo sapien
ttcaagaagcctgaggtctaatttawgaaatactattaatcttttctcta

SEQ ID NO: 88071 - DNA, 50 bp, homo sapien
ggacacataagaggtactaatgaaargttattagaatctcttatgggtcc

SEQ ID NO: 88072 - DNA, 50 bp, homo sapien
cccccatgataaatactattccaaaracaatgcccgcaattgcagtgccc

SEQ ID NO: 88073 - DNA, 50 bp, homo sapien
gctattttgttttgttctatggacayataagaggtactaatgaaaggtta

SEQ ID NO: 88074 - DNA, 50 bp, homo sapien
tctaaaaatcatttcacaggactcartaatatacgtcaaatctcattttt

SEQ ID NO: 88075 - DNA, 50 bp, homo sapien
gagaatgatgttaacctcacgtttargaatgctactgttaaatcaagttt

SEQ ID NO: 88076 - DNA, 50 bp, homo sapien
tataaagagattacctgaactgaagmagattgtgttatgtaggtatgaag

SEQ ID NO: 88077 - DNA, 50 bp, homo sapien
ttgctagcacattttacgtggaaggraacatatttaattgatttaatcag

SEQ ID NO: 88078 - DNA, 50 bp, homo sapien
tttaattattttttcgattcaaccgrcctgctttctaagaccatgtccat

SEQ ID NO: 88079 - DNA, 50 bp, homo sapien
ttatgtctagagctcataactcttamacatatttggctaggtctatgcag

SEQ ID NO: 88080 - DNA, 50 bp, homo sapien
ataatttagttctttgtagctctaawcatgggtcgctcctttgcctcaaa

SEQ ID NO: 88081 - DNA, 50 bp, homo sapien
ttttgtggcttgatgatttcctatcrcagtatgctttgaatcctttcttt

SEQ ID NO: 88082 - DNA, 50 bp, homo sapien
tcaactcatacgttgactgtaaataygcagccattaaattagcactattg

SEQ ID NO: 88083 - DNA, 50 bp, homo sapien
aagaatgtgaagttcactcaactgawatagtttacaatgtcttttggctt

SEQ ID NO: 88084 - DNA, 50 bp, homo sapien
tgagaagagagaaatgatttagagayaagctttgtaatgaaaaggattga

SEQ ID NO: 88085 - DNA, 50 bp, homo sapien
aaaattctcagccaggctatgtaaakaatgaaaaagcatgttttggaggg

SEQ ID NO: 88086 - DNA, 50 bp, homo sapien
gacacctgctcaagcgatttgagtgyagtatagaactgaaaactttgtca

SEQ ID NO: 88087 - DNA, 50 bp, homo sapien
taaatcttattatgacatacacagaycatttataacatgcttagactttc

SEQ ID NO: 88088 - DNA, 50 bp, homo sapien
aagaccacatcttggtggacattaayggaatcacacactgtattaatcac

SEQ ID NO: 88089 - DNA, 50 bp, homo sapien
atcttcattaaatattggtgttctaygctttttaagcaaaattgcttaga

SEQ ID NO: 88090 - DNA, 50 bp, homo sapien
ttgaatgcaggatctgaatggtccaytaaaaggaagtggtgggaaattgg

SEQ ID NO: 88091 - DNA, 50 bp, homo sapien
actatattacatgagaacttttcacrcaataaactttagtttaaaatata

SEQ ID NO: 88092 - DNA, 50 bp, homo sapien
gtttcacaaagggatacagattccayggtgataaagaaacactgggttga

SEQ ID NO: 88093 - DNA, 50 bp, homo sapien
attttttttattaagagaaagaacayacgctgttttgacgatatttttaa

SEQ ID NO: 88094 - DNA, 50 bp, homo sapien
ggttaacaagttaaacaaagttctcyattgtataaaaggacttattggag

SEQ ID NO: 88095 - DNA, 50 bp, homo sapien
atgtatgtcattaataaacaggctgygaatctgtgtcttttcccattaag

SEQ ID NO: 88096 - DNA, 50 bp, homo sapien
ggagatggaggaaaggggagttgccrttttattggtgccactgtttagtt

SEQ ID NO: 88097 - DNA, 50 bp, homo sapien
aaattaaaagttttgttacaaaagayagtaatgctgtaatggcaaagaga

SEQ ID NO: 88098 - DNA, 50 bp, homo sapien
attactaacagttctgttttcctccktgttctctaacctggtatcagatc

SEQ ID NO: 88099 - DNA, 50 bp, homo sapien
atagaaggaagctacttgctacttaycaagacattaggagaatgacctcg

SEQ ID NO: 88100 - DNA, 50 bp, homo sapien
ttatttgctccatggaaaccaactayagcttagtgcttaaagcaatcaat

SEQ ID NO: 88101 - DNA, 50 bp, homo sapien
gaggcaggctgcctcaacctacattkagaagtacgcctcagagagccttg

SEQ ID NO: 88102 - DNA, 50 bp, homo sapien
ctgggagcagagaaaaaataagacaygatgtgaaatataaagaaatatga

SEQ ID NO: 88103 - DNA, 50 bp, homo sapien
ttttcatgtattgttttttaaatatyacattaacactgtttaatacatac

SEQ ID NO: 88104 - DNA, 50 bp, homo sapien
gttctccaattcatattgtctcttayggtcagtggtctctgttcaattat

SEQ ID NO: 88105 - DNA, 50 bp, homo sapien
tcaactgttactgagttgccataatsagaacataatatttgattgcattg

SEQ ID NO: 88106 - DNA, 50 bp, homo sapien
agcgctgatattatcaacacataaargagtatcaaggaaatcagctgtta

SEQ ID NO: 88107 - DNA, 50 bp, homo sapien
tatagaatagattaaaacggcttaayagacttcatgctgatagaatcaac

SEQ ID NO: 88108 - DNA, 50 bp, homo sapien
ctgcctcaacatacttagatctctaygttctctagtctaaaacagttccc

SEQ ID NO: 88109 - DNA, 50 bp, homo sapien
aagaaaacctgattactttcttcttyggtgccaattagaatctctgtcct

SEQ ID NO: 88110 - DNA, 50 bp, homo sapien
aagaaagtaatcaggttttcttattkgttttcatagttatagaaagcaga

SEQ ID NO: 88111 - DNA, 50 bp, homo sapien
acttgctggattaacgtttattggaraaaattgatgtgctcaaggacagc

SEQ ID NO: 88112 - DNA, 50 bp, homo sapien
aagcctcaggaaatgagagcctatgraaatatatgcctacatgcaaccac

SEQ ID NO: 88113 - DNA, 50 bp, homo sapien
ttgcctttctttacatttcttcttarcacaggtaatcaacatatctagaa

SEQ ID NO: 88114 - DNA, 50 bp, homo sapien
gccagccatgaggtcacacaacgcastagtccacagcacgcaagctgcct

SEQ ID NO: 88115 - DNA, 50 bp, homo sapien
gatgaagaaacaaaactttttggcawtatcgtctagtctaagctaactaa

SEQ ID NO: 88116 - DNA, 50 bp, homo sapien
tatttgttaacattgggttacttacrgatgataacagcaagaattgtgtt

SEQ ID NO: 88117 - DNA, 50 bp, homo sapien
gctgatgagttggatgatgtttcacragttggatgagtagggaataaaca

SEQ ID NO: 88118 - DNA, 50 bp, homo sapien
gtagagacaatcactgtgaagaataygaatgtacaatatccaggtcatta

SEQ ID NO: 88119 - DNA, 50 bp, homo sapien
taccaagttgatcacattgttgatawaaaggatttagtaaaattaatgta

SEQ ID NO: 88120 - DNA, 50 bp, homo sapien
ccttgttcagttagctgtagaatacraaaagaatggtttcatgctgactg

SEQ ID NO: 88121 - DNA, 50 bp, homo sapien
aggaggagggaacagaatactgagtyacaatggaatatagagtagaaatg

SEQ ID NO: 88122 - DNA, 50 bp, homo sapien
tatccattatgttttcttatcactcrcttagtatgtaaaataatacaaat

SEQ ID NO: 88123 - DNA, 50 bp, homo sapien
gtagtgagctttactgacaattacamggatgcaaacaaacaaaattcaga

SEQ ID NO: 88124 - DNA, 50 bp, homo sapien
ctccaaaattcatgtctacctataasctcagaatgtgaacttatttagga

SEQ ID NO: 88125 - DNA, 50 bp, homo sapien
tttttattcctcttattaccatcaaytccactctattttttacaaaataa

SEQ ID NO: 88126 - DNA, 50 bp, homo sapien
acaaatagtacaagcttcttatccaytgactgttattactaatctggatg

SEQ ID NO: 88127 - DNA, 50 bp, homo sapien
agcagacatcctctgatactgcaaakaactcataaaatgcacctaatcat

SEQ ID NO: 88128 - DNA, 50 bp, homo sapien
gaaaatcagtgctcaaagcattcaayagatgaggaattttctcctaacca

SEQ ID NO: 88129 - DNA, 50 bp, homo sapien
tttcctctgttaattcttatctgttyaatgtgactagtagaaaattttaa

SEQ ID NO: 88130 - DNA, 50 bp, homo sapien
taagacatctacatcatgtctgagaktctagcttattttaggtcatggaa

SEQ ID NO: 88131 - DNA, 50 bp, homo sapien
aaccaaagagggtggcagaaaatgasagtcaataggagatgcgaagatgg

SEQ ID NO: 88132 - DNA, 50 bp, homo sapien
ttgaatatgtttggataggtaaatakagtttgcatgtggaatgaatgtga

SEQ ID NO: 88133 - DNA, 50 bp, homo sapien
gcttttgacttaattcttccatgtarcatctataatattatatcaagtat

SEQ ID NO: 88134 - DNA, 50 bp, homo sapien
tggtccatactgctgatgtctgtaayaactcaacatgaaaattaatgttt

SEQ ID NO: 88135 - DNA, 50 bp, homo sapien
gagagatagagggaaatggtaactaraagactaagatattgagtattgtt

SEQ ID NO: 88136 - DNA, 50 bp, homo sapien
atttattttattaaagacaagaataygtttataatcaaaaatacttggta

SEQ ID NO: 88137 - DNA, 50 bp, homo sapien
ttcctagcctgaaatcttgaatcaaytgttaaatctcgtatatttttgca

SEQ ID NO: 88138 - DNA, 50 bp, homo sapien
ctgaggagaagtgggtttgtattgamtagtgcataaggaagaagatgaat

SEQ ID NO: 88139 - DNA, 50 bp, homo sapien
aaattttccttccacgattttatccyattacttttagttccgatttaaaa

SEQ ID NO: 88140 - DNA, 50 bp, homo sapien
atctcttacggagtcagatatatacygaacaacaacaaaaatgtttgtta

SEQ ID NO: 88141 - DNA, 50 bp, homo sapien
tcatcttctcatgggaaagacaactraataataacaggtgtagtaaagga

SEQ ID NO: 88142 - DNA, 50 bp, homo sapien
gtctaactgccatctcttatactcaygttgaaataaattaggaagaacat

SEQ ID NO: 88143 - DNA, 50 bp, homo sapien
agcagaagatggaagagtgagattargattgacagttgacccttgaacaa

SEQ ID NO: 88144 - DNA, 50 bp, homo sapien
ataagaaaagactcatattttagaaytgtggtgtccaatatggtagccta

SEQ ID NO: 88145 - DNA, 50 bp, homo sapien
tttattcacttattatagataataayttcctagtctacatttcattacag

SEQ ID NO: 88146 - DNA, 50 bp, homo sapien
tctgctccagaatccagaggataagraatccatgatgtagcagcatgctg

SEQ ID NO: 88147 - DNA, 50 bp, homo sapien
cagcagcgggttcacatgaccatgargtgggttcacataaccacatgttt

SEQ ID NO: 88148 - DNA, 50 bp, homo sapien
aatgaacacaaatggttatccaaaaraaaatcaaaatctttagacatatt

SEQ ID NO: 88149 - DNA, 50 bp, homo sapien
tggtctatttgctgacattttccccratatcacaaatcttatttactata

SEQ ID NO: 88150 - DNA, 50 bp, homo sapien
ttaaagaggacaaggaagtgtaattygcctgcctagctaggagaggagaa

SEQ ID NO: 88151 - DNA, 50 bp, homo sapien
ctttggttataaaacaaaaaggcccrgacccatctagattagagaagaag

SEQ ID NO: 88152 - DNA, 50 bp, homo sapien
tgttggtaaatttagtgataaatgaygctgattaatctaaaatctaccat

SEQ ID NO: 88153 - DNA, 50 bp, homo sapien
gccttttgcctgtatcacactgtctygactaatgtacctttatgtaattt

SEQ ID NO: 88154 - DNA, 50 bp, homo sapien
gtgtctctaatcttccttggatcaayggatttgccaaggcatattcttct

SEQ ID NO: 88155 - DNA, 50 bp, homo sapien
agtatgtacacatttgtcctcatggycaatcttcttcataaatgtctatt

SEQ ID NO: 88156 - DNA, 50 bp, homo sapien
agagaatgatattgggaagaatgaargattagaaatgacaatcaaatatc

SEQ ID NO: 88157 - DNA, 50 bp, homo sapien
tatctcaacatagacaaatgtattcyaggaactatgagacacacaggaaa

SEQ ID NO: 88158 - DNA, 50 bp, homo sapien
catccgtatattttattgtagatgcragactctggaaagttgtcaattat

SEQ ID NO: 88159 - DNA, 50 bp, homo sapien
tctagaaagctttgttaaaaacaccrctaggatgatttgctgtctacttt

SEQ ID NO: 88160 - DNA, 50 bp, homo sapien
taagatcaattttcatgcagtctaargataaaatgatattccacaacaaa

SEQ ID NO: 88161 - DNA, 50 bp, homo sapien
agaaatgcccaaagatagaatgcacrgtctggagagccagtgaatatctc

SEQ ID NO: 88162 - DNA, 50 bp, homo sapien
agatcaaagtgcatttgctcccatayactgttgaaacctctgtattgaac

SEQ ID NO: 88163 - DNA, 50 bp, homo sapien
tctgccatgccactttctcctggatyaaacacaaaccgtccactgtccag

SEQ ID NO: 88164 - DNA, 50 bp, homo sapien
gacattaagcaggagtgtgagtgaasaacacgtctatggactgactataa

SEQ ID NO: 88165 - DNA, 50 bp, homo sapien
actactcatttagactggataaaacraccgttgcaaatctgttaagaaaa

SEQ ID NO: 88166 - DNA, 50 bp, homo sapien
atcaagaataaacaggcctatcctawcttatctgaaccagaaataatttt

SEQ ID NO: 88167 - DNA, 50 bp, homo sapien
catggataaatttcaaaacctagtaygctgaatgaaggaaaccaggcaca

SEQ ID NO: 88168 - DNA, 50 bp, homo sapien
tttagaaatattcaaatcttcagagsaatcacttcatggtagtcaaattc

SEQ ID NO: 88169 - DNA, 50 bp, homo sapien
agtaccacttagaagttgccatatcyatttctgtgatgctaaaggaaaat

SEQ ID NO: 88170 - DNA, 50 bp, homo sapien
ttaattttactttaattctaggtcaycacgcctctagcctacagtcatgc

SEQ ID NO: 88171 - DNA, 50 bp, homo sapien
aacatatttcctgtctatttctgtawctgtctatttatctctccattcat

SEQ ID NO: 88172 - DNA, 50 bp, homo sapien
attgtggcaaatctttttagctttcratcacaggagactatctttaatca

SEQ ID NO: 88173 - DNA, 50 bp, homo sapien
aatgactatcatttcttcaagttagyatcactaccaaatggtgaaaacaa

SEQ ID NO: 88174 - DNA, 50 bp, homo sapien
gttgatgtgcatgttacaagcttgcraaaatggatatggattattttctt

SEQ ID NO: 88175 - DNA, 50 bp, homo sapien
tacaggcaaaaattattgtgttgtgyaccaagttgatgttttgtgataaa

SEQ ID NO: 88176 - DNA, 50 bp, homo sapien
ggttcttattccaacttttcacctcyagtggcaccagaacatttttgttt

SEQ ID NO: 88177 - DNA, 50 bp, homo sapien
gttaaagacactggttgttaccatcrattaaaaatattattttattaaga

SEQ ID NO: 88178 - DNA, 50 bp, homo sapien
atgtgtactattagcacgttcaatgsaataaatcttcattggttggttct

SEQ ID NO: 88179 - DNA, 50 bp, homo sapien
gaatccaattaataaggctcatgatyatcaataaaaaagtatataaagga

SEQ ID NO: 88180 - DNA, 50 bp, homo sapien
gagaaaaagttgttaccttcagaagwaccaagccattgcaaatatgtccc

SEQ ID NO: 88181 - DNA, 50 bp, homo sapien
gtgaaacttgttaaataagaagaaaytgaatggaagagtgtaaatttaat

SEQ ID NO: 88182 - DNA, 50 bp, homo sapien
ggggctgtgagtaaatagaaaggtarctcagtctgtgccttgaggaattc

SEQ ID NO: 88183 - DNA, 50 bp, homo sapien
gggactggtaacctgagtcaaattarggctcaatccaatagttcttccgt

SEQ ID NO: 88184 - DNA, 50 bp, homo sapien
agctaagattctccgtgagcgattasagtaggcttttgggatttgcttac

SEQ ID NO: 88185 - DNA, 50 bp, homo sapien
ctaaaagtacagaagcattaacaacmattggggcaagctttcatagtgag

SEQ ID NO: 88186 - DNA, 50 bp, homo sapien
acgactaaggcttttaccagttttawcattctgtgaccatgtagatctct

SEQ ID NO: 88187 - DNA, 50 bp, homo sapien
ttgtgtacatcatgagaaatagaacygtatgatgtaagatttgtgcttta

SEQ ID NO: 88188 - DNA, 50 bp, homo sapien
ttaagaacaagcctgactggataaayagctaactcatttagaaaaagact

SEQ ID NO: 88189 - DNA, 50 bp, homo sapien
atttaacgatagaaatgcatcattaracttattattaattcatctgttga

SEQ ID NO: 88190 - DNA, 50 bp, homo sapien
ctgctgtaacctaatgtaagtagctraagaatgcttaatttctaagtttc

SEQ ID NO: 88191 - DNA, 50 bp, homo sapien
atgcattacaatctatttcacaaagkaatcttgcaaaactgcctcaagaa

SEQ ID NO: 88192 - DNA, 50 bp, homo sapien
ctaatacagttcttggattttaacamgcttcaaatgagtgctagctagta

SEQ ID NO: 88193 - DNA, 50 bp, homo sapien
ttcgcctgataaatattgcaaactgrttttgggcaaaatttgaaaagcta

SEQ ID NO: 88194 - DNA, 50 bp, homo sapien
aagttatttgaagagacctttgaaakatgtgactacatgcacttccttca

SEQ ID NO: 88195 - DNA, 50 bp, homo sapien
ctgaagtaggcttttcatcaattagktttttttgtttatagtacagacat

SEQ ID NO: 88196 - DNA, 50 bp, homo sapien
actaagaaatgtggccagctgaaagmatataaatctagctttaatcacat

SEQ ID NO: 88197 - DNA, 50 bp, homo sapien
ttggcttaatttttcagtttgtaaawcaatcagaaccactcagcggctct

SEQ ID NO: 88198 - DNA, 50 bp, homo sapien
tattgaggaaaggacaaaaccgcacsgatactaattgctttggtttataa

SEQ ID NO: 88199 - DNA, 50 bp, homo sapien
gagaaagctctgattctcatggttaygtgaatatggactatcatgagatc

SEQ ID NO: 88200 - DNA, 50 bp, homo sapien
tggatttggctctttgttggtgaaawtaaatcttgtattccagcctcaaa

SEQ ID NO: 88201 - DNA, 50 bp, homo sapien
tgccaaagtgtaggaaaggataagaktaaggcgtgaaataattcatgtga

SEQ ID NO: 88202 - DNA, 50 bp, homo sapien
atataatgatttagtcagcaagagamcacatatacgatgatggtcccata

SEQ ID NO: 88203 - DNA, 50 bp, homo sapien
gtgtgttctagactcagaattgctaratcgaatttggcctttcaaatggt

SEQ ID NO: 88204 - DNA, 50 bp, homo sapien
gcctaggtagactagttttaagagamcatagaactaaaaaaatgtggaaa

SEQ ID NO: 88205 - DNA, 50 bp, homo sapien
aaccatggctacagtattgagttggraatttttgtttatttctcaaataa

SEQ ID NO: 88206 - DNA, 50 bp, homo sapien
catatttgctgtttattaatctaaakatatcctagtcacatggctaaatt

SEQ ID NO: 88207 - DNA, 50 bp, homo sapien
caatgaacgaacaactggagcctcaktatcaacattaaaaatgtcttcaa

SEQ ID NO: 88208 - DNA, 50 bp, homo sapien
tgtctttgatactgattttgacgaayggaactagagagggcataaaagta

SEQ ID NO: 88209 - DNA, 50 bp, homo sapien
tctgtacagcaatgttgaaatagacmacattccgcttttctgtcctcaaa

SEQ ID NO: 88210 - DNA, 50 bp, homo sapien
tgttaaacataggagactatcaaaamaccattccatccacctgtgccttg

SEQ ID NO: 88211 - DNA, 50 bp, homo sapien
tagtctcctatgtttaacataggcaygagaagagaaagcaaaggagatca

SEQ ID NO: 88212 - DNA, 50 bp, homo sapien
atagtaaaatagttctgcaattcacragtttttctaaatagcatgctttt

SEQ ID NO: 88213 - DNA, 50 bp, homo sapien
atctgtgagagagttttatgacacayggttacaactgatcacaggatcaa

SEQ ID NO: 88214 - DNA, 50 bp, homo sapien
tgtctagtttgagaatacttttaagmctgctgagctcttttggggcattt

SEQ ID NO: 88215 - DNA, 50 bp, homo sapien
tactttaacaaacagttatcttttargtcattttagaatcagagaaataa

SEQ ID NO: 88216 - DNA, 50 bp, homo sapien
tattttactcagattaaaagatacgsatcggtaatgtaatcatagttttc

SEQ ID NO: 88217 - DNA, 50 bp, homo sapien
agtactttattttctgagccgtgaamccttttctccctttgtctttgcac

SEQ ID NO: 88218 - DNA, 50 bp, homo sapien
atttctggattccaaaatctctctcrattattttcttatttacatgattt

SEQ ID NO: 88219 - DNA, 50 bp, homo sapien
caacgaaggccaaaaccttctgtagraatatagtgtcagtatatttctca

SEQ ID NO: 88220 - DNA, 50 bp, homo sapien
ggagttcttaagttaggagcgacatraagggtagaatcagtctggcagga

SEQ ID NO: 88221 - DNA, 50 bp, homo sapien
ttctgtccttggactgggatttataycatcgactcccctggctctcagac

SEQ ID NO: 88222 - DNA, 50 bp, homo sapien
attctaactccacttcttctttttaygtgcgataggaatgtgtaaaacac

SEQ ID NO: 88223 - DNA, 50 bp, homo sapien
gttgtttttcttattgagaaatccaratagtagtgccttgtattttgcta

SEQ ID NO: 88224 - DNA, 50 bp, homo sapien
tgcatatttaacattaagattgtgasgtattcccaattattcaggttcat

SEQ ID NO: 88225 - DNA, 50 bp, homo sapien
agggaaaaaaaggacttcctcaaatyagaatgcctaagatatcgaacctg

SEQ ID NO: 88226 - DNA, 50 bp, homo sapien
atctttctcagatgtttaaccatggycataaatttccaagttaagaaaca

SEQ ID NO: 88227 - DNA, 50 bp, homo sapien
gaaatcttttttactcaagattttcratgagtttggacaaattatttaag

SEQ ID NO: 88228 - DNA, 50 bp, homo sapien
gagataagaatattgacaataggtgyaaaagagtaattttagtgatggcc

SEQ ID NO: 88229 - DNA, 50 bp, homo sapien
taactaatgtggacctaatcacagamgtatttgagaaagggtagaaatta

SEQ ID NO: 88230 - DNA, 50 bp, homo sapien
atattccactataggaacttaagacyactcattaattctacaacgacttt

SEQ ID NO: 88231 - DNA, 50 bp, homo sapien
aattcaaagacacaaataggagctarggtacaaattggttatttatcatg

SEQ ID NO: 88232 - DNA, 50 bp, homo sapien
aggaactaaaggtgcccatcgttcartagaagtagtgatgattcattgta

SEQ ID NO: 88233 - DNA, 50 bp, homo sapien
ttatgttattataccaaagtagatcmaagtattgttattcatcttaaggc

SEQ ID NO: 88234 - DNA, 50 bp, homo sapien
gttgagcctaattgaagtttccctayatacagtaagttcagagaaacact

SEQ ID NO: 88235 - DNA, 50 bp, homo sapien
taaagtttgcctctctaatgcagaarggataattaacctgccaaagataa

SEQ ID NO: 88236 - DNA, 50 bp, homo sapien
tatatttaaaggcttattcaccaaartaattttaaatcatggtcaacata

SEQ ID NO: 88237 - DNA, 50 bp, homo sapien
ggtcacatttcaggaaatatatttamaggcttattcaccaaagtaatttt

SEQ ID NO: 88238 - DNA, 50 bp, homo sapien
cctttagcctgtctaaagaaagtgasgtttatctaagaaacagataatta

SEQ ID NO: 88239 - DNA, 50 bp, homo sapien
ttttaatttttagtgaaaaaagaagwatttgggatctactccagtttatg

SEQ ID NO: 88240 - DNA, 50 bp, homo sapien
cttagttaaatagattagtttagaarataagtttatgtgtcttaaaagca

SEQ ID NO: 88241 - DNA, 50 bp, homo sapien
ctctcattccccccaaagatagccamgatacagatttttacaccattact

SEQ ID NO: 88242 - DNA, 50 bp, homo sapien
ttattcttacccatttagtggatcawtgagaaagttcagtgccaagagat

SEQ ID NO: 88243 - DNA, 50 bp, homo sapien
atggagtttactttgttcatcttaawgatagcagagcaattccggattgt

SEQ ID NO: 88244 - DNA, 50 bp, homo sapien
cccagcatcagttttactaaatttgwttgttcctggactcaatagaagct

SEQ ID NO: 88245 - DNA, 50 bp, homo sapien
cattttacatgtctatcagtgtaacyaagttcaaaatggctttttaggca

SEQ ID NO: 88246 - DNA, 50 bp, homo sapien
aacatgatgtatgcagtagcaaatayagtgtctgaagtaatcaggactca

SEQ ID NO: 88247 - DNA, 50 bp, homo sapien
ggccaggagactttaagcaatgagartacctaatgcaaatgtgtgatgaa

SEQ ID NO: 88248 - DNA, 50 bp, homo sapien
cagcttaccttttgactatagtaaargacatttaagtgatcttattttga

SEQ ID NO: 88249 - DNA, 50 bp, homo sapien
acaaaggttattatattttttaggamaggtggaattcaggtataaatcca

SEQ ID NO: 88250 - DNA, 50 bp, homo sapien
tcctgttacgtggcaccaccacctayctagctgtttagaccagaattctg

SEQ ID NO: 88251 - DNA, 50 bp, homo sapien
cacaggcagcaaacagagctactagsacaaggattggaaaaatgccagag

SEQ ID NO: 88252 - DNA, 50 bp, homo sapien
tctccaacaaagaaatattccatgayggcaaaataatcactcttccatta

SEQ ID NO: 88253 - DNA, 50 bp, homo sapien
tttccccacttttctatcttggaacwggttataaagaaattctctgacct

SEQ ID NO: 88254 - DNA, 50 bp, homo sapien
ctcaagtgcatatgttacagaaaatmatacatagaaattgataaaggaga

SEQ ID NO: 88255 - DNA, 50 bp, homo sapien
atattagaattaagtacagagataawttacaaatcacaacaggagaacct

SEQ ID NO: 88256 - DNA, 50 bp, homo sapien
ttcatgtgggccagagtattagtcaracttaaacttctattctttttttt

SEQ ID NO: 88257 - DNA, 50 bp, homo sapien
aaatcacctttctagtgtacctaagyctgaaacaagaagaataacaatgt

SEQ ID NO: 88258 - DNA, 50 bp, homo sapien
ttttgttttgtttttcttttaatcckagagtcttgttctgatcgcatata

SEQ ID NO: 88259 - DNA, 50 bp, homo sapien
ggtacactaaagaatcaaaacatatyacctcagtgaacaaacctttgatc

SEQ ID NO: 88260 - DNA, 50 bp, homo sapien
taacttagtgacaaagaattttgaargacgaacttcttttgcttaaaaat

SEQ ID NO: 88261 - DNA, 50 bp, homo sapien
tcatactgcttttaaataaacgtagrttggagtaagttctttttcatttg

SEQ ID NO: 88262 - DNA, 50 bp, homo sapien
ggagcaattaataaatcatgagttayataatatccacacagtgaaaagcc

SEQ ID NO: 88263 - DNA, 50 bp, homo sapien
tctggacatttcctttgagggttgamtagaactattttgttttcctctgc

SEQ ID NO: 88264 - DNA, 50 bp, homo sapien
atgcttctgatctcatgttaaccaayggtgcctagtggaacctcattacc

SEQ ID NO: 88265 - DNA, 50 bp, homo sapien
tgtctttgaccaaagttgatgattakaccagggaaaatgatcacaaaacc

SEQ ID NO: 88266 - DNA, 50 bp, homo sapien
tgcatgtgagaaggttccatgggccragactcgaagttgtgtgcaacact

SEQ ID NO: 88267 - DNA, 50 bp, homo sapien
gaaggagcatttctctaagtttagtyaccctcaaagtcgattttcttata

SEQ ID NO: 88268 - DNA, 50 bp, homo sapien
tatatacagccagaccgttacaatcrcatagacatcttttttcccctctg

SEQ ID NO: 88269 - DNA, 50 bp, homo sapien
gggcaaggaacctcacaccagggaaraaccgtcctcctacatcagccccc

SEQ ID NO: 88270 - DNA, 50 bp, homo sapien
gagactttaaccaacttgatggcaawcctaacaaaagatgtctaccaatt

SEQ ID NO: 88271 - DNA, 50 bp, homo sapien
tccagctgtttgaaccatctgaaccrgaagagtggaaaggaattgaggtg

SEQ ID NO: 88272 - DNA, 50 bp, homo sapien
atttggctaaactattgccggagatragttagaaggccaaagacagataa

SEQ ID NO: 88273 - DNA, 50 bp, homo sapien
tatgtttggaaaagttaagtgttcaraacatgaaggactttgaaaactaa

SEQ ID NO: 88274 - DNA, 50 bp, homo sapien
tgactttaatcatgatagaaacataktacttgaaacacagaacaaacaga

SEQ ID NO: 88275 - DNA, 50 bp, homo sapien
actatgtgcactttagcctgaaagcmatgagatgcaattaaaagatttta

SEQ ID NO: 88276 - DNA, 50 bp, homo sapien
caaaagcaagaagaggcaataataargctggttcaaaagagctccctgaa

SEQ ID NO: 88277 - DNA, 50 bp, homo sapien
gagcacattgtcactttttccagcawcttgggtatattacatatcttatt

SEQ ID NO: 88278 - DNA, 50 bp, homo sapien
cagtatgtgaattttggaaggatacrattcaattcatagcccacagtctg

SEQ ID NO: 88279 - DNA, 50 bp, homo sapien
ttatgcctaacatctggcatggtaarctatacagatttggtgtacaataa

SEQ ID NO: 88280 - DNA, 50 bp, homo sapien
gcttaaaagctctatacccgtctaaytgtagctatacattacagcattca

SEQ ID NO: 88281 - DNA, 50 bp, homo sapien
ccttctagagtgaatgtttccctcgrgcccttggatatttttattctatt

SEQ ID NO: 88282 - DNA, 50 bp, homo sapien
ttcactaacaatttataacagactaycatttgtaaagtatgttatgtcta

SEQ ID NO: 88283 - DNA, 50 bp, homo sapien
aggcacatggcagtggcaggggatgyaaacgggcctaagactgcttctcc

SEQ ID NO: 88284 - DNA, 50 bp, homo sapien
cttgggacaagtcaacgatataataygatttcttaaagtctaattgaatc

SEQ ID NO: 88285 - DNA, 50 bp, homo sapien
gaatgtttttaattgctgcagaaaakactttactaagaagataggtaaca

SEQ ID NO: 88286 - DNA, 50 bp, homo sapien
tgtcctattgccccaagcaagcttcrccacctcattttagataataaaag

SEQ ID NO: 88287 - DNA, 50 bp, homo sapien
gaatccgatcattcagtatcatcgakaatctcacgcaaatatcatacata

SEQ ID NO: 88288 - DNA, 50 bp, homo sapien
gccacacaaaatctctgatataacayctttttttgatatttaattcaaaa

SEQ ID NO: 88289 - DNA, 50 bp, homo sapien
cacatgttgtataatactagtataaktaaagaacacaatgaaatgtttct

SEQ ID NO: 88290 - DNA, 50 bp, homo sapien
actactccaatttcttcctattacastatcaccaaacatttaattagaat

SEQ ID NO: 88291 - DNA, 50 bp, homo sapien
agacttcttattcatcatttagtcawccgcctagctgtaaaggtaatttt

SEQ ID NO: 88292 - DNA, 50 bp, homo sapien
gttactcagaagaatgacctcctaamcaacaaagtgcaggctgtgaggaa

SEQ ID NO: 88293 - DNA, 50 bp, homo sapien
aaggaatgaattttttgtgtgataargtcaaacagcacgtggaattagcc

SEQ ID NO: 88294 - DNA, 50 bp, homo sapien
tggctatgttgcaagcaatcacagargtggaactagtaaaccattaaaat

SEQ ID NO: 88295 - DNA, 50 bp, homo sapien
tgaagtgttatttctccataagactkactgtagaacatatatagtaggta

SEQ ID NO: 88296 - DNA, 50 bp, homo sapien
tttcatgtgggtttttggcagttacyctttgtcaagttaagacagtgtga

SEQ ID NO: 88297 - DNA, 50 bp, homo sapien
gcgaaggggtagtgaaatgaaggaaragcccaagaggcaatcggcatggc

SEQ ID NO: 88298 - DNA, 50 bp, homo sapien
ttcttagcagagcctggcaaagagargtccttgaagaaatattagttgaa

SEQ ID NO: 88299 - DNA, 50 bp, homo sapien
atattcagcattaccaaagtggctartaattgagaatccaagatcctgaa

SEQ ID NO: 88300 - DNA, 50 bp, homo sapien
gaaagaagtgtctgattattcaaaayttaatgtaggcttataaatatgaa

SEQ ID NO: 88301 - DNA, 50 bp, homo sapien
aaaatcaagtaataattattgcgcaycaagtaattttatattttcagatt

SEQ ID NO: 88302 - DNA, 50 bp, homo sapien
atagtacattgccctgtaatttgctyaaataaataaatcttcatattaca

SEQ ID NO: 88303 - DNA, 50 bp, homo sapien
tctctaaatttgatttcttagctaartaatttgatatcataagacattta

SEQ ID NO: 88304 - DNA, 50 bp, homo sapien
tcatgagatagaagcttgttccacaycacgttgtttttgcttttatttct

SEQ ID NO: 88305 - DNA, 50 bp, homo sapien
tcaatgaggaaaaaaaaaccattcgycattatatcagattgttaataaca

SEQ ID NO: 88306 - DNA, 50 bp, homo sapien
ggtgatagatgctttctctaatattwaataatcaatctgtttcttctgtc

SEQ ID NO: 88307 - DNA, 50 bp, homo sapien
agtccatggtttgattcacatgctayaattgctgacaagtttccacatga

SEQ ID NO: 88308 - DNA, 50 bp, homo sapien
tcaggaaaaggcagacagtgctgaartggtcaacagttctgcctttgaaa

SEQ ID NO: 88309 - DNA, 50 bp, homo sapien
aggttgccaaaggcatcagaatcaayggaaatgacatcaatattcaatag

SEQ ID NO: 88310 - DNA, 50 bp, homo sapien
agggatgtctcctatttacactccartctgtgaaggatcctttgcttttc

SEQ ID NO: 88311 - DNA, 50 bp, homo sapien
caatttctggtaactataataaaggwacatcagttaattcttctcacttc

SEQ ID NO: 88312 - DNA, 50 bp, homo sapien
gataaaatatgtacaaagtgttaggwaaataataagcacccaattaataa

SEQ ID NO: 88313 - DNA, 50 bp, homo sapien
ttatatgtataaagatttgtgtatayagtgaggcaggagaataggatctg

SEQ ID NO: 88314 - DNA, 50 bp, homo sapien
ttttatacttcatcaaggccgtatcyctgatataaccagaatatgattta

SEQ ID NO: 88315 - DNA, 50 bp, homo sapien
atattggtgactcttaagctccttaygggttggaattgaaaccagaaatc

SEQ ID NO: 88316 - DNA, 50 bp, homo sapien
aaaaaaaaaacccttttagagacctwacaattttgtccggacctaaacac

SEQ ID NO: 88317 - DNA, 50 bp, homo sapien
tcatagctgattgttaatagctaaayggaacaatattacattgaatgaaa

SEQ ID NO: 88318 - DNA, 50 bp, homo sapien
acatgacttctcacctctggcctaartaacctattcaaagcaatagcatt

SEQ ID NO: 88319 - DNA, 50 bp, homo sapien
tttttaaattgaggcaaaattcacayaatgtaaaatcaaccattttaaca

SEQ ID NO: 88320 - DNA, 50 bp, homo sapien
tgcatgaaatctgttgaactacatcygaagtactgggggagaatccacat

SEQ ID NO: 88321 - DNA, 50 bp, homo sapien
gaataaaacatactcttcttagaaaygtcagaattgcacattttgggagg

SEQ ID NO: 88322 - DNA, 50 bp, homo sapien
aggaggcagaagatgtccaagacagmataagtgaagacagacgccactgg

SEQ ID NO: 88323 - DNA, 50 bp, homo sapien
ggataatgtggtcaagaaaagagaargataacgcatacatgacaaaatca

SEQ ID NO: 88324 - DNA, 50 bp, homo sapien
cagaaatgaatttaagtaattacgcygaaaatttccttaaacatgattta

SEQ ID NO: 88325 - DNA, 50 bp, homo sapien
aatggagtgtgatgtattatacttaygctttatgaaattctcattaggga

SEQ ID NO: 88326 - DNA, 50 bp, homo sapien
tagctaacatgaaatttatgttgacraaatagaaaatattttgactatca

SEQ ID NO: 88327 - DNA, 50 bp, homo sapien
tgtagagctatggtttgagtggcagsctccatcgtactgtaatgctttca

SEQ ID NO: 88328 - DNA, 50 bp, homo sapien
gatgttggcttttttacaaaagtcartcaaaggataactatttcatatta

SEQ ID NO: 88329 - DNA, 50 bp, homo sapien
agctaacatcagctaaggaaagaagmacatagagcggaacccagagagta

SEQ ID NO: 88330 - DNA, 50 bp, homo sapien
attgtttcttctcattttcttttcaygggcagccttcttctgtctatatt

SEQ ID NO: 88331 - DNA, 50 bp, homo sapien
gaaaaaacgtgtagcgtatctcaaamttaagtcggcatctctatatgata

SEQ ID NO: 88332 - DNA, 50 bp, homo sapien
gcccctggttgcctttgcttttctcragtaacgatcaggaccagctctct

SEQ ID NO: 88333 - DNA, 50 bp, homo sapien
acagtgaccacaggaatgactattaygcctggcaatttattcagatatca

SEQ ID NO: 88334 - DNA, 50 bp, homo sapien
aacgctcatagaaatgttgaaggacrtcagtcaatctttaataagatgag

SEQ ID NO: 88335 - DNA, 50 bp, homo sapien
gttctctacagcttagttcaaggacrgcagttgaatccatatttgagact

SEQ ID NO: 88336 - DNA, 50 bp, homo sapien
tgcaaccacaaagtctcgcaaggatkttcaaatgccactgggaggatagc

SEQ ID NO: 88337 - DNA, 50 bp, homo sapien
cagaatattcaggcaaagaaaaactwaaggagagattgttgaaggccatc

SEQ ID NO: 88338 - DNA, 50 bp, homo sapien
tttaaaaaatacataccaacagaacyactctcccaaggaaaatattgcca

SEQ ID NO: 88339 - DNA, 50 bp, homo sapien
tcgacatactctacagataaatgatyaataacagtgtcaattgtggaaat

SEQ ID NO: 88340 - DNA, 50 bp, homo sapien
ctgaggtttttagcctgagatgatakgtcaaaaccagggaggtgctcatg

SEQ ID NO: 88341 - DNA, 50 bp, homo sapien
tgacattaggaaaaatgttttcttcratcttcttacacacacaaaatttg

SEQ ID NO: 88342 - DNA, 50 bp, homo sapien
cctgaatcatcagcaatgattagatraggatagaaacatattttattcac

SEQ ID NO: 88343 - DNA, 50 bp, homo sapien
ttcaaaccccaaaactatgtgatackgacacctacagttttaaattccca

SEQ ID NO: 88344 - DNA, 50 bp, homo sapien
caagcagcttaatgaatatcactggwatcagactaatttgcatatgagtt

SEQ ID NO: 88345 - DNA, 50 bp, homo sapien
atgatatgagccaaaattagtgagamagggaatcataaacagtgagatca

SEQ ID NO: 88346 - DNA, 50 bp, homo sapien
gcagccatggactgtcaaaggaaagrgtgcaatcagaggataaatgtaat

SEQ ID NO: 88347 - DNA, 50 bp, homo sapien
gagaaatcaccctaaaatatctaaaygtctgtgaaattcaacttttaaac

SEQ ID NO: 88348 - DNA, 50 bp, homo sapien
aaagtggcttttaaccaagaatgtgyatcagaatgctatatttgtgaaat

SEQ ID NO: 88349 - DNA, 50 bp, homo sapien
tacatttttagatccaaaaacttatyaatgcaggatcgaaactcagcatc

SEQ ID NO: 88350 - DNA, 50 bp, homo sapien
tcctcctttgcatcctagcctagtakcactttctcagggaaccttccctg

SEQ ID NO: 88351 - DNA, 50 bp, homo sapien
ttcctttcatggatcagtaatcaacrcataagtccaccttcatctggttg

SEQ ID NO: 88352 - DNA, 50 bp, homo sapien
ttctttttttaaagaacacgctatcrgaacagttctttgaaactaatggg

SEQ ID NO: 88353 - DNA, 50 bp, homo sapien
ggcccataactcagtttacagttggytaaatatggcatttgtgatttttt

SEQ ID NO: 88354 - DNA, 50 bp, homo sapien
ttgactgtctgttatctttacctaastgcaagccagtgacacacactatc

SEQ ID NO: 88355 - DNA, 50 bp, homo sapien
aatcttcatcatttaaacattgtctytgctgggtgtgatatctaacagga

SEQ ID NO: 88356 - DNA, 50 bp, homo sapien
taaactggctggaaccagtccatacrcagcggtcgtcttatcaggagaaa

SEQ ID NO: 88357 - DNA, 50 bp, homo sapien
ctaaatagtggctttctcatatatartaccatagttcagagacaaatgcc

SEQ ID NO: 88358 - DNA, 50 bp, homo sapien
tttataacctgcttttcttcattaayatgttgtgtgccttctcctgtatc

SEQ ID NO: 88359 - DNA, 50 bp, homo sapien
ggtcaattatgttgctctatttaaawgaattctcccattcgcctacccaa

SEQ ID NO: 88360 - DNA, 50 bp, homo sapien
ttaataatcacttaatagcatctaayacccagattatactcaaatctccc

SEQ ID NO: 88361 - DNA, 50 bp, homo sapien
aatctgggagagctcatgtgtaatayatatctgttttgtggccttctaga

SEQ ID NO: 88362 - DNA, 50 bp, homo sapien
ttattcaagactgttgtaatatagawatccaattagactattttcttaat

SEQ ID NO: 88363 - DNA, 50 bp, homo sapien
cacctccacttattcattttactggracaaatttatgattgataattctc

SEQ ID NO: 88364 - DNA, 50 bp, homo sapien
gttatgtgagcctattcacccttaakctgctttaacatttgactgaaggt

SEQ ID NO: 88365 - DNA, 50 bp, homo sapien
agtcacttaattacaaaatatatcayccttcacaaactaagttagactgc

SEQ ID NO: 88366 - DNA, 50 bp, homo sapien
catatctctccagtgttaactcccayattctcttattcacataccaacga

SEQ ID NO: 88367 - DNA, 50 bp, homo sapien
acataagcaaagcccaactatgaaaytgattccacaggaactgtttgatc

SEQ ID NO: 88368 - DNA, 50 bp, homo sapien
agggaaagctagaggcatttgcagayaaagtagaagaaggcagtagaggg

SEQ ID NO: 88369 - DNA, 50 bp, homo sapien
tgttctacgtcacactccttccatcrctctccatttgaagcatagtgttt

SEQ ID NO: 88370 - DNA, 50 bp, homo sapien
tacagccttcagtctgtagccaaagrcccgcgagctcctggcacaccact

SEQ ID NO: 88371 - DNA, 50 bp, homo sapien
attaaataaaattacgaatctatggycattctcataattgtttctgccta

SEQ ID NO: 88372 - DNA, 50 bp, homo sapien
ggagattcttacagctcctatacatsaatctttttgaaacatatcaaggg

SEQ ID NO: 88373 - DNA, 50 bp, homo sapien
gcatacaattcctgatcagagcccaygttccttacctaaaagaaggtgga

SEQ ID NO: 88374 - DNA, 50 bp, homo sapien
cttttctcttataatggagacaataygggctaagcatggaagtgtgggaa

SEQ ID NO: 88375 - DNA, 50 bp, homo sapien
tgcccctcagcacatgaagggaagartcagagctaaaggtggataacagc

SEQ ID NO: 88376 - DNA, 50 bp, homo sapien
accacaggtgttatgcttattggtgyacggtagtatgaaattaaaacagt

SEQ ID NO: 88377 - DNA, 50 bp, homo sapien
agaactgtatttgtatgaggtttcaraaaagtctctcttgtgttcttgtg

SEQ ID NO: 88378 - DNA, 50 bp, homo sapien
ttcccaagttgtcagaattaggaagyatgtttaattctaagcagagaaaa

SEQ ID NO: 88379 - DNA, 50 bp, homo sapien
taccaagtgggaaaatacaggatccratagggagtaaacaaagggagttc

SEQ ID NO: 88380 - DNA, 50 bp, homo sapien
taacgcctaatattgttttcatcaartacaagcagataaatacaaaaata

SEQ ID NO: 88381 - DNA, 50 bp, homo sapien
ctagataggactaccaataaagagcrgatttctcaaggaaacaagcacag

SEQ ID NO: 88382 - DNA, 50 bp, homo sapien
aataatttgtacaactcttaggaacrctcttttgaatgtatgacaggttt

SEQ ID NO: 88383 - DNA, 50 bp, homo sapien
gtttagaagataatctcttggacacraagagcacatttgtgcctgatgga

SEQ ID NO: 88384 - DNA, 50 bp, homo sapien
gagggagcagaggggaatggctaacraactcgacatatttgatgatttac

SEQ ID NO: 88385 - DNA, 50 bp, homo sapien
aatttgacacacttaactattgattwaaaaagtacatacattcttcaata

SEQ ID NO: 88386 - DNA, 50 bp, homo sapien
aaagaagcttcatacccattagcggycactttccattccttcttccccac

SEQ ID NO: 88387 - DNA, 50 bp, homo sapien
ttcttatgttctactaacatgttacrgatgtcaaatttgatttaattcac

SEQ ID NO: 88388 - DNA, 50 bp, homo sapien
atcaagagaggccatgtattttctamgcatctaagccttagccatcaagg

SEQ ID NO: 88389 - DNA, 50 bp, homo sapien
ctccctaatggcatgtgacattaacraaactactttaactttctaaaatg

SEQ ID NO: 88390 - DNA, 50 bp, homo sapien
ttactcaaatacagattctactgatsacttatttccattacggaaaggaa

SEQ ID NO: 88391 - DNA, 50 bp, homo sapien
agaaacagtttacattgaaaacaaakatcatatttcactaatttttattt

SEQ ID NO: 88392 - DNA, 50 bp, homo sapien
attcactgaccttacaaatatatgcracaagataatgaggttttcttttt

SEQ ID NO: 88393 - DNA, 50 bp, homo sapien
atctctgaatatagatttcattgcaygtataaatataaattaaaaattag

SEQ ID NO: 88394 - DNA, 50 bp, homo sapien
ttacagctagcagttaattattatakgatgggaattgtaatcaaagtaac

SEQ ID NO: 88395 - DNA, 50 bp, homo sapien
acagacatgttgctatcgtattctayaatttacatggtgattgagaatag

SEQ ID NO: 88396 - DNA, 50 bp, homo sapien
gatattcccaacctcatctctatagsccaaagcattagcaaactcatatc

SEQ ID NO: 88397 - DNA, 50 bp, homo sapien
gtgaaacttcagaaagcgggtctagsaaatcattctcacctggtgattct

SEQ ID NO: 88398 - DNA, 50 bp, homo sapien
atctgttatctcattttagccttacrgaactcctatggggctgggcagac

SEQ ID NO: 88399 - DNA, 50 bp, homo sapien
acaatttagctttactgctagttcaygtcatggtctgaagcagactggca

SEQ ID NO: 88400 - DNA, 50 bp, homo sapien
gatgtgcgtgcccaggtcctactacsaatctttgaatactggtctggttt

SEQ ID NO: 88401 - DNA, 50 bp, homo sapien
gcagaatattacctctaggttcttcracaaagtagatagtcattatgttg

SEQ ID NO: 88402 - DNA, 50 bp, homo sapien
cgtgtctccacttggattccacttgscaagataaattcaggggcagcttc

SEQ ID NO: 88403 - DNA, 50 bp, homo sapien
gtctcaagtggaacagctagcacagwagaaagaacttttctcaacacatt

SEQ ID NO: 88404 - DNA, 50 bp, homo sapien
atctgatattctccatttaaaaaatrattgcaggcttgattgttttaaaa

SEQ ID NO: 88405 - DNA, 50 bp, homo sapien
agcaactagaatagcaaagcgaaaasagccatggacagtatccacaacag

SEQ ID NO: 88406 - DNA, 50 bp, homo sapien
gaaagtacaagattctttcctaagayatttcaacatgtgatctcgaatag

SEQ ID NO: 88407 - DNA, 50 bp, homo sapien
tccatgtgttcacaattgattaagakaacatttctgcatcattttcccca

SEQ ID NO: 88408 - DNA, 50 bp, homo sapien
gcctgattgacagccagcaaggaaaygagggccactatgctacagcccca

SEQ ID NO: 88409 - DNA, 50 bp, homo sapien
ttgcaaaataaaccactttcaaatasagagaggccctctctgtctttgtc

SEQ ID NO: 88410 - DNA, 50 bp, homo sapien
ttcagccttaagctttcttgttctgyattgagagttatgttgatatttca

SEQ ID NO: 88411 - DNA, 50 bp, homo sapien
gatgtatccatgactagatgttcagygtatttgggagagaacccaagggg

SEQ ID NO: 88412 - DNA, 50 bp, homo sapien
gtaatcgttttttggatagctaagckgaaattgtaattcaaaattaatct

SEQ ID NO: 88413 - DNA, 50 bp, homo sapien
cactagaatctcctggggagcaatasaaaataccaaggcttggctctact

SEQ ID NO: 88414 - DNA, 50 bp, homo sapien
aagataactaagctttatacttctayactatcaatgaaattacatttttt

SEQ ID NO: 88415 - DNA, 50 bp, homo sapien
tctgtggaataccacagtaggctctkaccagtcttgattctttccttctt

SEQ ID NO: 88416 - DNA, 50 bp, homo sapien
cgggatccttgcaaaagctcaatgaytatgatgtgtgaatatcatcatga

SEQ ID NO: 88417 - DNA, 50 bp, homo sapien
cccagagttatcattgctttcaatgyaaacagtaaggatatgtttcaaac

SEQ ID NO: 88418 - DNA, 50 bp, homo sapien
ccagaagaaaattgcatagacactawcttgagtcatctccctctggaatt

SEQ ID NO: 88419 - DNA, 50 bp, homo sapien
taaaggccccaccatccttcagtcamcctgatcagaagcccttggctgct

SEQ ID NO: 88420 - DNA, 50 bp, homo sapien
tagggtcatcatttgtgcttcttcayggtacggtcaagtttactagagag

SEQ ID NO: 88421 - DNA, 50 bp, homo sapien
gatcagacagaaaataaattggtaasgatacagattgaacactacccaaa

SEQ ID NO: 88422 - DNA, 50 bp, homo sapien
tcttggatctgctgggttccatttasaaagacaaagagcctctgctctgg

SEQ ID NO: 88423 - DNA, 50 bp, homo sapien
agtagggaagtgagtattgaaaggaygagacatgtactcttcagtcatct

SEQ ID NO: 88424 - DNA, 50 bp, homo sapien
ctcacatcaggctacatttatagaaraacaaaactattttaatcatctct

SEQ ID NO: 88425 - DNA, 50 bp, homo sapien
aatacctgagttttgtcagaataacrggtagataacatattaagaaaaga

SEQ ID NO: 88426 - DNA, 50 bp, homo sapien
ttagtattgaataggctacatttcarctaggactgttcaaagactctcta

SEQ ID NO: 88427 - DNA, 50 bp, homo sapien
gatatgaggggcaacaatataaggaygagtctaaatgtagatgaatttgt

SEQ ID NO: 88428 - DNA, 50 bp, homo sapien
ctcctttagtccttaaaagattacaytgaacacagataaatgaatgggaa

SEQ ID NO: 88429 - DNA, 50 bp, homo sapien
tggttaggaggtagagagacaactgsatcctaagtactaattcactattt

SEQ ID NO: 88430 - DNA, 50 bp, homo sapien
ttctttatataaattttcaaattcartagctttttgttccatttttacat

SEQ ID NO: 88431 - DNA, 50 bp, homo sapien
ttaaaatggaaataaaatagttatcrccttagaatttgaaataaacttac

SEQ ID NO: 88432 - DNA, 50 bp, homo sapien
aaaattactgcaagtcagtaaggtcyagtggaatgagtttgtctagttgt

SEQ ID NO: 88433 - DNA, 50 bp, homo sapien
caattaatgagacggatgtagcacaytgaatgagaggattgaagtaccta

SEQ ID NO: 88434 - DNA, 50 bp, homo sapien
cacattatttcactctgtcagtgttktgaaaggaaatacctgttacagat

SEQ ID NO: 88435 - DNA, 50 bp, homo sapien
tgtccatgattctactgaataactckctcatccaatgatttgttcattta

SEQ ID NO: 88436 - DNA, 50 bp, homo sapien
actttaggggcagaggatgtataacrgatgattttcctcttagccatatg

SEQ ID NO: 88437 - DNA, 50 bp, homo sapien
caggaggaataagtgtgaatgacagyatctaaattaaaatctgttgccac

SEQ ID NO: 88438 - DNA, 50 bp, homo sapien
aaaaggggttcacaggtatttctcaygtggataactggtgactcatctat

SEQ ID NO: 88439 - DNA, 50 bp, homo sapien
ggccaatatgtgaggtggaaaatgamgtagaaaattgaacacccaaagaa

SEQ ID NO: 88440 - DNA, 50 bp, homo sapien
tgattaagtcatgaattctcactgaygatgtgattagctggatagtatgc

SEQ ID NO: 88441 - DNA, 50 bp, homo sapien
cccgccccatgggccatagtttaccraactctgctctagtggaaggtaat

SEQ ID NO: 88442 - DNA, 50 bp, homo sapien
catagtaaatggctttaattttttarcgaaatctcactactgcaaatgca

SEQ ID NO: 88443 - DNA, 50 bp, homo sapien
caatattaaagtaaggatgatttagragaactgaggttaaaatctgccta

SEQ ID NO: 88444 - DNA, 50 bp, homo sapien
acaggctgactctcagatgatagcarcgaggatcctggttaagaatgtga

SEQ ID NO: 88445 - DNA, 50 bp, homo sapien
aatctagaaaaatgtattttctccargaagacctaaattgctgaatgttg

SEQ ID NO: 88446 - DNA, 50 bp, homo sapien
atgtgtatgtatgatccagtcttcaycgcttatttgctgcatggcttcga

SEQ ID NO: 88447 - DNA, 50 bp, homo sapien
ggtttcaactttgtgaccatcatacygtggtttgacttgttggtaaagag

SEQ ID NO: 88448 - DNA, 50 bp, homo sapien
taaagaggaaaaatggggacatgcgkaacactgaaaacattttaaattta

SEQ ID NO: 88449 - DNA, 50 bp, homo sapien
tgtcttgtttctggccagattttccyatatgatgtctatgttctctcgtg

SEQ ID NO: 88450 - DNA, 50 bp, homo sapien
tatctgagggtcatgttttgctatgyatttaatggatattacttctgcct

SEQ ID NO: 88451 - DNA, 50 bp, homo sapien
gacctaagagagccaaaaagggcaartctcagcctagttgttagaatgct

SEQ ID NO: 88452 - DNA, 50 bp, homo sapien
agcctggtgtttgaaataaaatggtwaagtgtctacaatcagttctgttt

SEQ ID NO: 88453 - DNA, 50 bp, homo sapien
agagaaagaaaaatggcaatatctaygttgatcaacttccaaccatttat

SEQ ID NO: 88454 - DNA, 50 bp, homo sapien
tttgcaggaaaaaaaaaatgtctacrgaaattcaaaggcagtaaagggaa

SEQ ID NO: 88455 - DNA, 50 bp, homo sapien
acaggtttcaaaagtgaggttctaayttaagccttgcagggtctctaatg

SEQ ID NO: 88456 - DNA, 50 bp, homo sapien
ggctggtcagcactggcaataaatawtagtcctatgagaggacagagagg

SEQ ID NO: 88457 - DNA, 50 bp, homo sapien
gtgggggaacaattgaaaactctcayagaagcaggtcttgcctggggaaa

SEQ ID NO: 88458 - DNA, 50 bp, homo sapien
atgtgtctttctctgtggccggtttytgtaatccgggaagaccccatgtg

SEQ ID NO: 88459 - DNA, 50 bp, homo sapien
aagttgtatgatcttgaaagtaatcractaaaatgtgacactattgcaca

SEQ ID NO: 88460 - DNA, 50 bp, homo sapien
gtttaagcagctctgctttttaggasaactcaatgtggctaggcttaagg

SEQ ID NO: 88461 - DNA, 50 bp, homo sapien
ggagatttttgttcactggtaaccamaggtagagagtgctgtattccccc

SEQ ID NO: 88462 - DNA, 50 bp, homo sapien
ctctaccatgtactcaacactctaayatattctgcacatttggttctatg

SEQ ID NO: 88463 - DNA, 50 bp, homo sapien
acagctagctgtgctctctaacatcyattaaggttgggttctaaatttct

SEQ ID NO: 88464 - DNA, 50 bp, homo sapien
ggattcttaaaaaatcattatcctgyataaaatgtagacctatgcttggc

SEQ ID NO: 88465 - DNA, 50 bp, homo sapien
atgcttgaaaaagtacctaaaatgcraagttttcatacactaatgcaact

SEQ ID NO: 88466 - DNA, 50 bp, homo sapien
ggccagcgcctttgttgggagaatgragagtaagtaaatctcaggtaaaa

SEQ ID NO: 88467 - DNA, 50 bp, homo sapien
cacattttcccttcctccttcatgcrctaagtcctatggggcaggcaccc

SEQ ID NO: 88468 - DNA, 50 bp, homo sapien
gacatccattatttcctctttcagcrcatgggtgtcagcctgaaaaaaaa

SEQ ID NO: 88469 - DNA, 50 bp, homo sapien
aaaaatcccataagaaaccatttcamgtccttcacgaatctctggccttg

SEQ ID NO: 88470 - DNA, 50 bp, homo sapien
ctctgaaaacacaaattgaacctgayaatattcaaaattttaagcttaca

SEQ ID NO: 88471 - DNA, 50 bp, homo sapien
cttctcagaaagaagcttgggtccartaaacaatacccatctttgctact

SEQ ID NO: 88472 - DNA, 50 bp, homo sapien
ttggcctgtgtgctttctttctcacrcctttttgttcacttgatgaggat

SEQ ID NO: 88473 - DNA, 50 bp, homo sapien
aaaaaagcagcgttagaatagaatcrataatccagtggtcctcaaggtgt

SEQ ID NO: 88474 - DNA, 50 bp, homo sapien
cacttaccagagccaggattttgtaygtggatgagattcttccaagcaga

SEQ ID NO: 88475 - DNA, 50 bp, homo sapien
caaacctgcggttattcaagagaagyccatatttagagctgagtgaatag

SEQ ID NO: 88476 - DNA, 50 bp, homo sapien
agatgttttcctttctttgcaccaartcacaaggctctgtctgcaaatgc

SEQ ID NO: 88477 - DNA, 50 bp, homo sapien
tgcatctgtgcctgcagtttttgttmctattgtttattaatgtgatcttt

SEQ ID NO: 88478 - DNA, 50 bp, homo sapien
tcaattttgtattacactgcacactygtgaaacagttcctaacaagccta

SEQ ID NO: 88479 - DNA, 50 bp, homo sapien
tttcttcactgggtacaaggaattaragtaagaagttatttttttttttt

SEQ ID NO: 88480 - DNA, 50 bp, homo sapien
agaatactgtctcaaatcaagaaaamgagaaatcaaatgaagttcaaccc

SEQ ID NO: 88481 - DNA, 50 bp, homo sapien
aaactcatagaaaccgaggctaaaartatcttcagaaaatgtatgaaatc

SEQ ID NO: 88482 - DNA, 50 bp, homo sapien
tgttactgtgtttccctacatctgargtagaattcaagtcagacccattc

SEQ ID NO: 88483 - DNA, 50 bp, homo sapien
tacatgtgtattaatattgctcttgwagttaataaacacacccaaatctg

SEQ ID NO: 88484 - DNA, 50 bp, homo sapien
ggtgtcgtctctcccttaagcatgartcaaactgatcaccctctgttaac

SEQ ID NO: 88485 - DNA, 50 bp, homo sapien
aaattatacatggagtggcattaacyattaaccactcttaggtttaaaac

SEQ ID NO: 88486 - DNA, 50 bp, homo sapien
tttttcacctgccatggccctaaaaygactctcttcttgaattgtctggt

SEQ ID NO: 88487 - DNA, 50 bp, homo sapien
tcactattcacactaagtgaaataastaaagatctgcttcatattagttc

SEQ ID NO: 88488 - DNA, 50 bp, homo sapien
aggtaagtacaccacttgcatttgakgggtatgtaacaaattcatactgt

SEQ ID NO: 88489 - DNA, 50 bp, homo sapien
tacagattttctaattttgaaaaccwactttgcgtttcttaaataaacta

SEQ ID NO: 88490 - DNA, 50 bp, homo sapien
cagaccatgtattaatacttgaactsaagaaaaacttccttgctaatgct

SEQ ID NO: 88491 - DNA, 50 bp, homo sapien
gttctattccttatttggctttgacrcaagtgtagtttagaaaccaaggg

SEQ ID NO: 88492 - DNA, 50 bp, homo sapien
gattggaagaggaagggccagaaacwcatggaaagctctagaagtgtcag

SEQ ID NO: 88493 - DNA, 50 bp, homo sapien
tacggaagactatctacggtaggtcrttaagcagccaatgatgtaaataa

SEQ ID NO: 88494 - DNA, 50 bp, homo sapien
gaacacagagaaattcataagtagcmaaacagagggtgctgagtgacatc

SEQ ID NO: 88495 - DNA, 50 bp, homo sapien
gtgggataccaaccccgccagaaaascgttagagagaagcccttggtctc

SEQ ID NO: 88496 - DNA, 50 bp, homo sapien
catgaggacagtcaattacatttttsaaagtgcacacattggttggttgt

SEQ ID NO: 88497 - DNA, 50 bp, homo sapien
actcactgccaatatagacgaaagayaggaatttttatatattttataat

SEQ ID NO: 88498 - DNA, 50 bp, homo sapien
aacatttttaccttccctgtatgaaygactcctcagagtaaccaaatcgt

SEQ ID NO: 88499 - DNA, 50 bp, homo sapien
tcatatcctatactatcaatttctawctttataaaacaataaaagtactc

SEQ ID NO: 88500 - DNA, 50 bp, homo sapien
gaatttatgatatgggattgagtgakaacatataaagacatatatacaaa

SEQ ID NO: 88501 - DNA, 50 bp, homo sapien
tttgcatcaacagtcagcaggggacratcaccaggatttatttgaccaga

SEQ ID NO: 88502 - DNA, 50 bp, homo sapien
tcatattgatttttttgagtcttggmaaaacagacattttgaaaccttaa

SEQ ID NO: 88503 - DNA, 50 bp, homo sapien
agtaaaaatgaaaaacagtcgaagcrgaagatataatttccttgtttctg

SEQ ID NO: 88504 - DNA, 50 bp, homo sapien
gtgcatgacctcatttcatcttcackagggctccccaggtcactaggtcc

SEQ ID NO: 88505 - DNA, 50 bp, homo sapien
agttctacaatgacttgttgcactcyatcacattaaaataattgaactat

SEQ ID NO: 88506 - DNA, 50 bp, homo sapien
atcactgcatatatatatcatgaacraagaggtgataacatttcatatag

SEQ ID NO: 88507 - DNA, 50 bp, homo sapien
taattcctagctcaaactgtgaatastaaggattgaaaagtaaagtatgt

SEQ ID NO: 88508 - DNA, 50 bp, homo sapien
ggtgagaatgactgtgcccttctcayctgaatctgacagtgatataagtc

SEQ ID NO: 88509 - DNA, 50 bp, homo sapien
gggctttagttggagctacgaaagcrgcataagtatacagaggagtctag

SEQ ID NO: 88510 - DNA, 50 bp, homo sapien
ttctttctgcttagtccttgaaaatsacaagagatgtgcattagctggaa

SEQ ID NO: 88511 - DNA, 50 bp, homo sapien
tgatcaagtgcttctgacaggtgtakgcacatgcttgttggtttcactcg

SEQ ID NO: 88512 - DNA, 50 bp, homo sapien
accatttgcatagcacggatagggcrcgtcatgaacggatggcgctgctc

SEQ ID NO: 88513 - DNA, 50 bp, homo sapien
atcaatagactgaataaaactgattkcccttattcaatctgctgaagccc

SEQ ID NO: 88514 - DNA, 50 bp, homo sapien
actgggtagccaactgaggcatacarcggcttcttatctcctaaaatgga

SEQ ID NO: 88515 - DNA, 50 bp, homo sapien
ctaccttctccaaagggcttctttawgttatgtaaatagagactgttttt

SEQ ID NO: 88516 - DNA, 50 bp, homo sapien
tgggccatgtccaaatatggttgatyctaaattgaccagttaggtaatga

SEQ ID NO: 88517 - DNA, 50 bp, homo sapien
gcagttaaattagaatttctgataarctacaaataattttttggtaaaaa

SEQ ID NO: 88518 - DNA, 50 bp, homo sapien
acatacataaaggctaaaacggaagsctcaaccaatttcaaatgcttgat

SEQ ID NO: 88519 - DNA, 50 bp, homo sapien
cagcatgactggattagaagaggagwttctgacacagacacacaggcaca

SEQ ID NO: 88520 - DNA, 50 bp, homo sapien
tgcatttactttatagagtacggtayctctgtatttagtaatatctggca

SEQ ID NO: 88521 - DNA, 50 bp, homo sapien
aaaacggtaaatcagtgttgctaccrgagtatcttaggcgttaagaagtg

SEQ ID NO: 88522 - DNA, 50 bp, homo sapien
atggattttgaagatttcatatagaraaaaaataaagtcaaatatctcat

SEQ ID NO: 88523 - DNA, 50 bp, homo sapien
aaatttcaagactctctttggataaytgatgtattcatatttaacatgca

SEQ ID NO: 88524 - DNA, 50 bp, homo sapien
tatctactcaaattttctccacaccrccagtaaggtagtttcactttctt

SEQ ID NO: 88525 - DNA, 50 bp, homo sapien
gcctggactcaagttccaggaccacratttgcttgctgtttcaccttgag

SEQ ID NO: 88526 - DNA, 50 bp, homo sapien
gggctgctataaggattaagcataaygataaatgaaggtacacactggca

SEQ ID NO: 88527 - DNA, 50 bp, homo sapien
aagccctctcgagacaattcagagtkaaatgttgggcaagacccagcatt

SEQ ID NO: 88528 - DNA, 50 bp, homo sapien
attggacaatgacacaaggcaatacrggatctggtctaagtaaacagcta

SEQ ID NO: 88529 - DNA, 50 bp, homo sapien
aaggccttctcttaatacgcagccartaagcctcgcaggactcagcactc

SEQ ID NO: 88530 - DNA, 50 bp, homo sapien
caggcatgtgtgcagtgctgtgacakagtgaactgtttctattgcctctt

SEQ ID NO: 88531 - DNA, 50 bp, homo sapien
ggtagacatggtggacgtggatgcargatagcaggcatcaggcagatgtg

SEQ ID NO: 88532 - DNA, 50 bp, homo sapien
gcagagacccttgatactatcttacracacagaaaacacactgttgctta

SEQ ID NO: 88533 - DNA, 50 bp, homo sapien
ttctttctgtgtttgcctgagatcaygcaattatcaataacagtagttat

SEQ ID NO: 88534 - DNA, 50 bp, homo sapien
ctacagtaggtgctccctgagtttaygtgggtctctcagccacatgtaca

SEQ ID NO: 88535 - DNA, 50 bp, homo sapien
ccaatagaaacttcacgtagagtcaragacccactcacatctcacacctc

SEQ ID NO: 88536 - DNA, 50 bp, homo sapien
acaaccctgggggtaagcacgatgaycaccttcttacagatgaggggatg

SEQ ID NO: 88537 - DNA, 50 bp, homo sapien
agcatctgggttgacatcctctcgayctatcattgtttatcagtgtttct

SEQ ID NO: 88538 - DNA, 50 bp, homo sapien
ttacgtctggagagtttcaccataartcatataggcaaggcatggaaaca

SEQ ID NO: 88539 - DNA, 50 bp, homo sapien
ccaagagtacatttcagccatttcgyacccgcagatacccaacctgagaa

SEQ ID NO: 88540 - DNA, 50 bp, homo sapien
atctgagctctctatgagcacatttyattgcaagactgggcatgggatct

SEQ ID NO: 88541 - DNA, 50 bp, homo sapien
accttcctacttctgttgtgtcttayatagtataattattctgttgcctt

SEQ ID NO: 88542 - DNA, 50 bp, homo sapien
ataatgtgttttcatagatgagatamatttgagttaccccagttataaga

SEQ ID NO: 88543 - DNA, 50 bp, homo sapien
cttaaatggctggcctgaaattagcraagggtagcaaattgaacacaatg

SEQ ID NO: 88544 - DNA, 50 bp, homo sapien
tagcctggggcctgggaattaacaaygacttttgcagaaataagggagag

SEQ ID NO: 88545 - DNA, 50 bp, homo sapien
tcacatttacatactgtatgtcgaayctgaaaggaagctatgttcgaata

SEQ ID NO: 88546 - DNA, 50 bp, homo sapien
gatttgggatttagagaggaaaatasgtttggagagtggtaaggaaggag

SEQ ID NO: 88547 - DNA, 50 bp, homo sapien
aacacatctgttcattgtgccattgwctatgttggttaataaaaagggag

SEQ ID NO: 88548 - DNA, 50 bp, homo sapien
aaaatgtggctttactacttttgacrctgcttttaggtcccctctaggtg

SEQ ID NO: 88549 - DNA, 50 bp, homo sapien
aggcttcagttcggtgtaattactayggtttctaaaggagtttctgtgta

SEQ ID NO: 88550 - DNA, 50 bp, homo sapien
gggcatgtgcctggatccatcgaacrgtgattgattggaagcaactgatg

SEQ ID NO: 88551 - DNA, 50 bp, homo sapien
aaagaatgtttacttacaatataggraagattagaaatgaaatttggaat

SEQ ID NO: 88552 - DNA, 50 bp, homo sapien
aggttggaaggtgacgctacagacayggtaaattgtgaaggcctgctggt

SEQ ID NO: 88553 - DNA, 50 bp, homo sapien
taactaatctagtccttcattgagawatagttccaagttttcgtcctaga

SEQ ID NO: 88554 - DNA, 50 bp, homo sapien
ttcaggctcagagctctttcttagasgcgcactggaataaagcagtttct

SEQ ID NO: 88555 - DNA, 50 bp, homo sapien
gaatagattttttttaatggcttggmtcttttgaatatttaatctctgct

SEQ ID NO: 88556 - DNA, 50 bp, homo sapien
cgtatagcttcatcctcataatgaaygtctacttcccttctgctgataat

SEQ ID NO: 88557 - DNA, 50 bp, homo sapien
aactcttcacacttttcatccctaaytgatggcttttgttggtttagcga

SEQ ID NO: 88558 - DNA, 50 bp, homo sapien
gcagaatgggatatttaagagcagaygagaaaagttagcaactgctgagt

SEQ ID NO: 88559 - DNA, 50 bp, homo sapien
ctcacatattcagtgcttattcaccraactatgacttgctttcttcctag

SEQ ID NO: 88560 - DNA, 50 bp, homo sapien
agagaaaactaccagctatcgctaarccaacaaaagccatcagttaggga

SEQ ID NO: 88561 - DNA, 50 bp, homo sapien
ctcttacaccaccctcactctcactragctgttttctattgcactcacag

SEQ ID NO: 88562 - DNA, 50 bp, homo sapien
cttgagaatatagaagggcttttaaytcagtctcatattcctccctatca

SEQ ID NO: 88563 - DNA, 50 bp, homo sapien
ataccaaggagagttgacagataaartatatcctaagcaaaatctgccta

SEQ ID NO: 88564 - DNA, 50 bp, homo sapien
atgagcctggtgatgccatgtgttartaaattataaaggaaaataacctc

SEQ ID NO: 88565 - DNA, 50 bp, homo sapien
ccaagccaaacaggctcactgtagargcggaatctattctgcaagtgcag

SEQ ID NO: 88566 - DNA, 50 bp, homo sapien
cagggagtgaataagtcatttctaayaaggctggttttataggcatcaca

SEQ ID NO: 88567 - DNA, 50 bp, homo sapien
catggaaaactccagaagtttgcatragtctgtccattcagttccagttt

SEQ ID NO: 88568 - DNA, 50 bp, homo sapien
aaatgaaatctgtggcttaactaatmaaatgatgaaggtgctttgctcat

SEQ ID NO: 88569 - DNA, 50 bp, homo sapien
ataggagcagcttcagccagcgacaytggtatccccacttggggctgaca

SEQ ID NO: 88570 - DNA, 50 bp, homo sapien
aaagtgcatgcagttggaacgatgaygtgagagctcattacaggaaatgg

SEQ ID NO: 88571 - DNA, 50 bp, homo sapien
ctttctcagcccacacctgccctgarctagtcaattaccaacgttgagaa

SEQ ID NO: 88572 - DNA, 50 bp, homo sapien
aggaatgaaaattacccgtatttaamcagcaatccaaaggacagaaggta

SEQ ID NO: 88573 - DNA, 50 bp, homo sapien
tgcaaagcatttcgagtctgaataayactaagcacattcaagattcattc

SEQ ID NO: 88574 - DNA, 50 bp, homo sapien
tggaaagtgatcattggaaagacacrataaagagaatagggaaagcaaaa

SEQ ID NO: 88575 - DNA, 50 bp, homo sapien
gtatgttaaggtaacagatactaccyggacaatagggcatacctgtgagg

SEQ ID NO: 88576 - DNA, 50 bp, homo sapien
acaaagttgtcacttgagcaatgtcrcactgctagtgagtggtagagggg

SEQ ID NO: 88577 - DNA, 50 bp, homo sapien
gatttgtggtcaaataaatttgggcwattctacagaacatgtgtcttttt

SEQ ID NO: 88578 - DNA, 50 bp, homo sapien
accatatttgaattatgttatcaaaragacagacgtggattcagttctga

SEQ ID NO: 88579 - DNA, 50 bp, homo sapien
ctccctctcccccaggcgccattacrccatatttgaattatgttatcaaa

SEQ ID NO: 88580 - DNA, 50 bp, homo sapien
aaaatgattgatgaagctcaagtacyggagttcccaatggtagtaaagaa

SEQ ID NO: 88581 - DNA, 50 bp, homo sapien
tcagttggccctgggacatctgctcrctttgggactctttgtgaacatta

SEQ ID NO: 88582 - DNA, 50 bp, homo sapien
ggacatttcaagagttggctggccayggtgttcctctgccggatactttc

SEQ ID NO: 88583 - DNA, 50 bp, homo sapien
catgcaaaatcttctctgctaagtayggtttttagtctcctggcatctgt

SEQ ID NO: 88584 - DNA, 50 bp, homo sapien
cttttgaagtctgtttgagaatacakacctaactgttgatgtctgtttgc

SEQ ID NO: 88585 - DNA, 50 bp, homo sapien
agagtcctggtagaaaacatgacacwctcaagtgaagcaaccgaggacac

SEQ ID NO: 88586 - DNA, 50 bp, homo sapien
aatggaatgtaatactaggttaaaayggaaattccaagatgatcgtctca

SEQ ID NO: 88587 - DNA, 50 bp, homo sapien
atgggattaagacgcactcattaaaycatcctcaactagaaggagttgtt

SEQ ID NO: 88588 - DNA, 50 bp, homo sapien
aaaggggaaaacataaatatcccaaytgtctacaagatgactccagaaat

SEQ ID NO: 88589 - DNA, 50 bp, homo sapien
ccaacagtgacttttcagttacattracggctcaaagtttgaccacaaag

SEQ ID NO: 88590 - DNA, 50 bp, homo sapien
gcctttggttcagcacaaattaggckcacttttgagggaatgttcttaaa

SEQ ID NO: 88591 - DNA, 50 bp, homo sapien
aagacatgtgggcttgtgcttgttayctggaattgaaaagagctcttggc

SEQ ID NO: 88592 - DNA, 50 bp, homo sapien
gaattttccatgaatataatacctcraatatcagggaaggttaaatagga

SEQ ID NO: 88593 - DNA, 50 bp, homo sapien
ctgcttgagtaaggtctccatgaagwatttgacagtgataggaattcagc

SEQ ID NO: 88594 - DNA, 50 bp, homo sapien
taggactgaaaaacttgttctcacartgataaatttgcatagccccatgc

SEQ ID NO: 88595 - DNA, 50 bp, homo sapien
tgtgttctttcagaaattctttacaygtacaacaaacaatatatattttg

SEQ ID NO: 88596 - DNA, 50 bp, homo sapien
gttgttaaacaacatggtaagaccamtacccaaatttaagttaggtgtaa

SEQ ID NO: 88597 - DNA, 50 bp, homo sapien
aagctcacctggacatgttttcccaygaagaaagcaagtggaaacacatg

SEQ ID NO: 88598 - DNA, 50 bp, homo sapien
gaaaatgagagcatcccatgggaatraaaggcatagtgtccgatgtctca

SEQ ID NO: 88599 - DNA, 50 bp, homo sapien
tatatttgatgggtttttaaatcaaytctcactcagattttgaatagtca

SEQ ID NO: 88600 - DNA, 50 bp, homo sapien
cccatcaaatatacatttctaccaaycacagggctagcaagtcagaccat

SEQ ID NO: 88601 - DNA, 50 bp, homo sapien
ttccacctgtccctaatgtaaggtckgaactacaataataattctatctt

SEQ ID NO: 88602 - DNA, 50 bp, homo sapien
gtttgagcccacctatatgaggagcraaaatagtgaaactcacagaagca

SEQ ID NO: 88603 - DNA, 50 bp, homo sapien
gtgaaaagggtcagcatttcttaaamaacaaatagggcaacaatctagaa

SEQ ID NO: 88604 - DNA, 50 bp, homo sapien
caggcatctcccaattttctactccygattttctataggtcagtgtgtgt

SEQ ID NO: 88605 - DNA, 50 bp, homo sapien
cgttcctaaggctggtcaggtggtaygtgggacattgcccaaagatgtct

SEQ ID NO: 88606 - DNA, 50 bp, homo sapien
tggaggcaaacccgctaatcctgtcraaaatctacctattcttctagagc

SEQ ID NO: 88607 - DNA, 50 bp, homo sapien
aaggtcgtaagttttctcaacgttcraatgtttccaatgttttgtaaaac

SEQ ID NO: 88608 - DNA, 50 bp, homo sapien
ccctggcacatacacaaggttagtgyatgagtaacaattcgggtccactg

SEQ ID NO: 88609 - DNA, 50 bp, homo sapien
cctcttcaaagcctctgagttagacrgagttataggtatccattcactcg

SEQ ID NO: 88610 - DNA, 50 bp, homo sapien
cccgtggcatcctcctctgccctcarggaactttaactatcaacgggtgg

SEQ ID NO: 88611 - DNA, 50 bp, homo sapien
attttccatgacatttgccttcttcracattatttttaatgcctgtcgtt

SEQ ID NO: 88612 - DNA, 50 bp, homo sapien
caaatatataataatgataaacttayatgtacctaataacatagccttga

SEQ ID NO: 88613 - DNA, 50 bp, homo sapien
tggagtttttttgagtttcttaaatwggtaggtattgaagtctttcatca

SEQ ID NO: 88614 - DNA, 50 bp, homo sapien
agctgagatcacaaccaaggctctaygttctcagtgggagcacagttggt

SEQ ID NO: 88615 - DNA, 50 bp, homo sapien
gactacgtacttgattgcttgcctcrtaagacttccaaggtacttgacca

SEQ ID NO: 88616 - DNA, 50 bp, homo sapien
acataggtgagtagagaataaagtaygcgtgggcaaggccaggcaagcac

SEQ ID NO: 88617 - DNA, 50 bp, homo sapien
ttttgataaaatagtagctcagaaargctcgtgcatcttagaagcttgcc

SEQ ID NO: 88618 - DNA, 50 bp, homo sapien
gtttaaagatattttaaaaatatgakaaaggaacaagatgttaacaaaaa

SEQ ID NO: 88619 - DNA, 50 bp, homo sapien
catttgaccacatgtctgctgcacayatagagagttgaacacgttctagg

SEQ ID NO: 88620 - DNA, 50 bp, homo sapien
agcacattaattgtattgtaattgaygccatgatgtgtgggctgtgacag

SEQ ID NO: 88621 - DNA, 50 bp, homo sapien
gttctctttacttcctacttcccaamgttacgcattaagaatatctatta

SEQ ID NO: 88622 - DNA, 50 bp, homo sapien
atggttgttattatactactttgaaygtactactgcactggtacaaagaa

SEQ ID NO: 88623 - DNA, 50 bp, homo sapien
tgaaaaatgataagcaaaaaataccwatcatgtttatccatatctagtga

SEQ ID NO: 88624 - DNA, 50 bp, homo sapien
atgaatggttgaattaacttatgtamattttagctgctggctgctctctc

SEQ ID NO: 88625 - DNA, 50 bp, homo sapien
tctattgtaccctcccatgaagccartatagtgtataatcaattaaaaaa

SEQ ID NO: 88626 - DNA, 50 bp, homo sapien
aggcctcctgctagtgctactttctyaccttgtgtttctaacattgcact

SEQ ID NO: 88627 - DNA, 50 bp, homo sapien
accatacaactgatatgcaacaggaygaaagacaattgcaagtgactact

SEQ ID NO: 88628 - DNA, 50 bp, homo sapien
gggacgtgcataaaccaccttggacrcactatgataggcacaagaaggaa

SEQ ID NO: 88629 - DNA, 50 bp, homo sapien
tgtttcacagaaaagctgatgtggawagaaccactggctccctctggtgt

SEQ ID NO: 88630 - DNA, 50 bp, homo sapien
ttccaagaaggaggaagtgccaggaycatctttcttgagagccgaccaag

SEQ ID NO: 88631 - DNA, 50 bp, homo sapien
ctgtccaagacactcataagcctgcraaaataagatttaacatcttgcat

SEQ ID NO: 88632 - DNA, 50 bp, homo sapien
ctccatgggttttttttgaagatatsataaagggagctatagaaatataa

SEQ ID NO: 88633 - DNA, 50 bp, homo sapien
tatgggggctattatgagcaagtagmaacactttatgatggctgtgatat

SEQ ID NO: 88634 - DNA, 50 bp, homo sapien
gaggaaactgaggtcccaagaagccragaaatgttactcaaagtcccaca

SEQ ID NO: 88635 - DNA, 50 bp, homo sapien
gttttccctgtgttattgggagtcarcaaattaagagcgtgagccagagt

SEQ ID NO: 88636 - DNA, 50 bp, homo sapien
taaaaaatatatttttgaaaaagcayattgtacttaactctatttataaa

SEQ ID NO: 88637 - DNA, 50 bp, homo sapien
cctctctttgtcctgtgccttaactyactgtcagtgcattttcctggctg

SEQ ID NO: 88638 - DNA, 50 bp, homo sapien
gtctaggtttctattttttcatttaygttgaatgcaatgtgctttaggac

SEQ ID NO: 88639 - DNA, 50 bp, homo sapien
taacaaaaaaatacacaacatgtaarcttatttagatggctggctataca

SEQ ID NO: 88640 - DNA, 50 bp, homo sapien
acacagcccagtcaatgcttcattamagtgttgtgtgactctaatcagag

SEQ ID NO: 88641 - DNA, 50 bp, homo sapien
tagttaaggaagtaaccgcaccaaaygataaactgactcatccaaattcc

SEQ ID NO: 88642 - DNA, 50 bp, homo sapien
aatctgttgcttctccttagttaccrgtaagactgcttttattttaaatt

SEQ ID NO: 88643 - DNA, 50 bp, homo sapien
ggcatacacatttaaaaaaagtagartaaatagcatctcatgaagtgggg

SEQ ID NO: 88644 - DNA, 50 bp, homo sapien
aatgaaggctaacaacccaatccaargtgaaggcttcttttacttcttat

SEQ ID NO: 88645 - DNA, 50 bp, homo sapien
caaaaaatataaataaaagatataasaactacaagtgatttaaaatatat

SEQ ID NO: 88646 - DNA, 50 bp, homo sapien
aatccactttggaaaaatatcttccrgcatctaggaggtgcttggttaat

SEQ ID NO: 88647 - DNA, 50 bp, homo sapien
tccattcagaaagaaagctcctgccrtgtgttcactctatttaaatgatg

SEQ ID NO: 88648 - DNA, 50 bp, homo sapien
gaacctgtaattgtagcagaccaaaraatatatgagttatttgtgagcat

SEQ ID NO: 88649 - DNA, 50 bp, homo sapien
gaggaaataatcattcatagctgaartgggtcttgtagatatcagtgatt

SEQ ID NO: 88650 - DNA, 50 bp, homo sapien
ataaaacaaaaaccactaaattacakgaggcatctgggactccatctcta

SEQ ID NO: 88651 - DNA, 50 bp, homo sapien
aacccacagggtcccctaacagaccrataatcacaggtagggcccacact

SEQ ID NO: 88652 - DNA, 50 bp, homo sapien
tttcttcattacaattcatacctagmgagctcagtaaccatgatcacaat

SEQ ID NO: 88653 - DNA, 50 bp, homo sapien
tggccactaaggaaacacagtgacayattacaagatcaaacctttcctac

SEQ ID NO: 88654 - DNA, 50 bp, homo sapien
tcggtgtcgctagaaaactcgcagakattggagctgagaaaaggcgggca

SEQ ID NO: 88655 - DNA, 50 bp, homo sapien
ctttttggagaggatctgcagatacyaacattttcagggtttcctcaggt

SEQ ID NO: 88656 - DNA, 50 bp, homo sapien
cctctggctgtgggatttcttttaarcattggttctccttagctatacaa

SEQ ID NO: 88657 - DNA, 50 bp, homo sapien
ggaaaatatgttccaaatttcaaacmatcaacttaaaattttttggaaca

SEQ ID NO: 88658 - DNA, 50 bp, homo sapien
agccattttttctctgactagagaartattaagttagtggggtaaattgc

SEQ ID NO: 88659 - DNA, 50 bp, homo sapien
agagactcaaagaaattgtgaatgcrtagaaattaatcagaggggccatt

SEQ ID NO: 88660 - DNA, 50 bp, homo sapien
tgaagataatttcttcctttgtgacmacccatactcttggtttactttgc

SEQ ID NO: 88661 - DNA, 50 bp, homo sapien
cagcttatgttaataaatgttagatsactgaatggatagatgaatggatg

SEQ ID NO: 88662 - DNA, 50 bp, homo sapien
ctgaagcaacagaaacaagactggartacaaaaatagagactcaaagaaa

SEQ ID NO: 88663 - DNA, 50 bp, homo sapien
tgtgagcatctaaatggttgttttayaccactgagttccggggcaatctg

SEQ ID NO: 88664 - DNA, 50 bp, homo sapien
agaatggagttatgtgttaatattayagtgaaagagtttttagaaacgta

SEQ ID NO: 88665 - DNA, 50 bp, homo sapien
acgtggtctatgttaagtgttatgayctaaaacaatactgctgttttttt

SEQ ID NO: 88666 - DNA, 50 bp, homo sapien
gtcgtcagtctagtgttaaagataarattatgtatgtttaagaggggcag

SEQ ID NO: 88667 - DNA, 50 bp, homo sapien
acgtatttgtaaattcagaggatacrctattgaatgaatggagctgactc

SEQ ID NO: 88668 - DNA, 50 bp, homo sapien
tgttgtgcttatagagaattttaaasactctaagctgggttgccctgagg

SEQ ID NO: 88669 - DNA, 50 bp, homo sapien
tctgagtcagagatcaggattgaackggaacccttaaaagcagtaaaata

SEQ ID NO: 88670 - DNA, 50 bp, homo sapien
ttgcctctagaagcactgcttcctaygctccttaggaccactgcccgcat

SEQ ID NO: 88671 - DNA, 50 bp, homo sapien
atgtgttttgctcttgtgtgtaaaaygactgtgaatttagccactgcctt

SEQ ID NO: 88672 - DNA, 50 bp, homo sapien
tgcaaaatcaaataaagagatactaycagattctaacccacccaagaact

SEQ ID NO: 88673 - DNA, 50 bp, homo sapien
agtttggctcagtctaacttacttarcatctgaagacaagataattttta

SEQ ID NO: 88674 - DNA, 50 bp, homo sapien
attgtatctcttggcatctcagttcmacgtcttctgtttctctctctttc

SEQ ID NO: 88675 - DNA, 50 bp, homo sapien
gtgtagttctacactccacttttctraataaatctccactttatttgaaa

SEQ ID NO: 88676 - DNA, 50 bp, homo sapien
cagcacttctattatagcaacaacaytagctgtctctagttcctaaaata

SEQ ID NO: 88677 - DNA, 50 bp, homo sapien
agctcctcacctgaattccagaaatyagtggggtgaaccgcacacaggta

SEQ ID NO: 88678 - DNA, 50 bp, homo sapien
taaggcaatgggcaagagttgtaacraggaagggaaagaagagagtatgg

SEQ ID NO: 88679 - DNA, 50 bp, homo sapien
atattgaataatgccatcactattayaggatcaccaccatcatcttcatt

SEQ ID NO: 88680 - DNA, 50 bp, homo sapien
atcattaaggagaatattgcaagacragttataaagctcatgtcacaaac

SEQ ID NO: 88681 - DNA, 50 bp, homo sapien
cagttcttaaagtacccaaaatgcamgctgaatttccatttgctgagtaa

SEQ ID NO: 88682 - DNA, 50 bp, homo sapien
gtggcagagttgtatagttttacctsttatatttcattcttggttccact

SEQ ID NO: 88683 - DNA, 50 bp, homo sapien
catactcttaatagaaagagaaacgyccaacagtgaggtcttcccatgag

SEQ ID NO: 88684 - DNA, 50 bp, homo sapien
tctttcaattttctgacctgtctagyacagtaatattccagctcacacct

SEQ ID NO: 88685 - DNA, 50 bp, homo sapien
attatcaccgtcttcccaaatatcamagaactgtaagtgagttgcatagg

SEQ ID NO: 88686 - DNA, 50 bp, homo sapien
tatgggaattacatggaacatcttamagttatcttattattttaaacaga

SEQ ID NO: 88687 - DNA, 50 bp, homo sapien
taacagattgaaacactacctttgaygattatggtttcatttttatccca

SEQ ID NO: 88688 - DNA, 50 bp, homo sapien
ctatctcattctgggtgtattacaayggagctaagaggaaaatgacatcc

SEQ ID NO: 88689 - DNA, 50 bp, homo sapien
ctttacttgtttgatggtttattaayaacaggaattcatttctcacattt

SEQ ID NO: 88690 - DNA, 50 bp, homo sapien
cctaccattatgactccaacactccyagagattaaacagagagagaggtg

SEQ ID NO: 88691 - DNA, 50 bp, homo sapien
aaaaaaaagacttgataatctaaacmaacataggaagtgttcatgtgtta

SEQ ID NO: 88692 - DNA, 50 bp, homo sapien
ttccttggcatctttaatgaaaatcrgtagaccatgttggagagggaagg

SEQ ID NO: 88693 - DNA, 50 bp, homo sapien
agcttagtaaacatttcatttctgtkttgggtcactttccttggggcatt

SEQ ID NO: 88694 - DNA, 50 bp, homo sapien
cctgacttctgctggtaccaataagsatatttttttggcaatgcatctcc

SEQ ID NO: 88695 - DNA, 50 bp, homo sapien
gtgatttccaggcttgctgattttaygcaattttccttcatgatgtttca

SEQ ID NO: 88696 - DNA, 50 bp, homo sapien
tgcatggtggtaatttagttctccaraggccagaagtaggaggagcagtt

SEQ ID NO: 88697 - DNA, 50 bp, homo sapien
taattacaatgcagcggcacttacaraggaattagtttcatcacatcctc

SEQ ID NO: 88698 - DNA, 50 bp, homo sapien
aggctgcagggcaggatgacctaacragggccctgctatggcaacaagaa

SEQ ID NO: 88699 - DNA, 50 bp, homo sapien
ccctgtaggtgccatgtgcacggacygaaacctccatgtgctgactcctt

SEQ ID NO: 88700 - DNA, 50 bp, homo sapien
aggcacctgccatggaaggtagggaygttctgagcaaagcttccggctac

SEQ ID NO: 88701 - DNA, 50 bp, homo sapien
tctcaatgaatatttcacaacatatwaacaaaccgtgacaacactaaaac

SEQ ID NO: 88702 - DNA, 50 bp, homo sapien
atcagctgtgcccaggagaccctcasagaaacaagcacggacaaagagca

SEQ ID NO: 88703 - DNA, 50 bp, homo sapien
tccattctggttttgttcatgctgcrattttctttattcctttttagggt

SEQ ID NO: 88704 - DNA, 50 bp, homo sapien
gggagtgtgatgaaaccagcagtaartagaaaggacagaaacagggagtt

SEQ ID NO: 88705 - DNA, 50 bp, homo sapien
cttttccttttaaatatctgggttarcttgttatttgctccaactgttat

SEQ ID NO: 88706 - DNA, 50 bp, homo sapien
taatagcatcttctaacagctgtcakattaacataccataagacgaaatt

SEQ ID NO: 88707 - DNA, 50 bp, homo sapien
gagagggttggagccccatttccacrgaattgtcattatttgaccgctct

SEQ ID NO: 88708 - DNA, 50 bp, homo sapien
ttggagaactaaagacagtttgaaartaagagctctgatatctttaagac

SEQ ID NO: 88709 - DNA, 50 bp, homo sapien
tcactgatttatgcaacaaacattgmacctttctggtaagagttctgtgg

SEQ ID NO: 88710 - DNA, 50 bp, homo sapien
aataaaatggactaaattggagaacsaaaatcaaaaacattcctttctag

SEQ ID NO: 88711 - DNA, 50 bp, homo sapien
aaactgacactttgcctataagtcaraaaagatgccgtggaattccttgt

SEQ ID NO: 88712 - DNA, 50 bp, homo sapien
ttgtcaccactgtactaattttaacygcataagagctgatgctctgttta

SEQ ID NO: 88713 - DNA, 50 bp, homo sapien
gattgtacatttggttgtttctgctsacttacccatggtggccggcttcc

SEQ ID NO: 88714 - DNA, 50 bp, homo sapien
ctctcttatttctgtaaatatgttarccgtcattactgtatactctgcct

SEQ ID NO: 88715 - DNA, 50 bp, homo sapien
agagaaaacattaagactctcgaaakaatgttctggaatcctatatgagg

SEQ ID NO: 88716 - DNA, 50 bp, homo sapien
tcaaccacagcctcgttcaaaatagsctgtctctggaacacactgtccag

SEQ ID NO: 88717 - DNA, 50 bp, homo sapien
taaagaatgaaatcaagtgactttaycctggataccaggccacgttagct

SEQ ID NO: 88718 - DNA, 50 bp, homo sapien
tggaaaaagacactatcaacaaagascagtggactaaaattcagcatcaa

SEQ ID NO: 88719 - DNA, 50 bp, homo sapien
tggctcttttttattctgaagtgtaratttgaacattatatctcaaaata

SEQ ID NO: 88720 - DNA, 50 bp, homo sapien
aggcaagcctcctaatagcaccctcrcatctcactgtgtacagctttcct

SEQ ID NO: 88721 - DNA, 50 bp, homo sapien
cacagagcgccggtgcatagcgcacrgatcagcctaattcttgtggacgg

SEQ ID NO: 88722 - DNA, 50 bp, homo sapien
gtgacaaaggaacaagatgttatcaraaatgaaatacaattagaaattaa

SEQ ID NO: 88723 - DNA, 50 bp, homo sapien
gaaagataataaggtagccagtgagsaccctaggaggaaggtgactagta

SEQ ID NO: 88724 - DNA, 50 bp, homo sapien
tcatgaattatctttcaagtgtgtcraatttgctattcatgtttctaatt

SEQ ID NO: 88725 - DNA, 50 bp, homo sapien
atatttaattattttaacaaattccrtgattgtcagttacctcctgttgc

SEQ ID NO: 88726 - DNA, 50 bp, homo sapien
tgtttcctgttctttgcccactgtckatggccaaaggcatgggatggaag

SEQ ID NO: 88727 - DNA, 50 bp, homo sapien
aaacacttatatataaaacatattayccaattcctaagtcacactaatgt

SEQ ID NO: 88728 - DNA, 50 bp, homo sapien
ctttgttttctgcaggttcaccatcrctctccaaatgtgggtttcttttg

SEQ ID NO: 88729 - DNA, 50 bp, homo sapien
tgctgctcttttatgggtcatctgcsttttctctcctgggactcagcatc

SEQ ID NO: 88730 - DNA, 50 bp, homo sapien
actggaggacgcatctagtctatcargctatttactgagtgcctcaaaac

SEQ ID NO: 88731 - DNA, 50 bp, homo sapien
agtcacttgtcctgcctgccacagascgaatcagtggaagggctaggctt

SEQ ID NO: 88732 - DNA, 50 bp, homo sapien
cgttgtttcctttctgcaagagataygtgcctgtactgaaaagaacatag

SEQ ID NO: 88733 - DNA, 50 bp, homo sapien
tcctaaatcatgatagtaatcacaawggtaataacaacaactagtcaaaa

SEQ ID NO: 88734 - DNA, 50 bp, homo sapien
tgagggattgtggctgttgatgtcamgactggcgtttaccttaggcctga

SEQ ID NO: 88735 - DNA, 50 bp, homo sapien
cagctgcataatattccattatatcyattcttctattgttagaaacatga

SEQ ID NO: 88736 - DNA, 50 bp, homo sapien
gaccgttctagctaattgcgataccwctcagttgcttactacttatgttg

SEQ ID NO: 88737 - DNA, 50 bp, homo sapien
cagtcttccggtagctgtttttctcmatgctgaagtggacattgaccaca

SEQ ID NO: 88738 - DNA, 50 bp, homo sapien
gtcttttttttttttactctgggtaygaatctttgccacttgcatgtatt

SEQ ID NO: 88739 - DNA, 50 bp, homo sapien
aaaaattgaggaactgttaccatgaraagagggcctggatttccattata

SEQ ID NO: 88740 - DNA, 50 bp, homo sapien
tctagaagcaacagaaaatgaaaacraatttagtagatcaagcaagatta

SEQ ID NO: 88741 - DNA, 50 bp, homo sapien
gagccctattaccaaaactttctgaygggtagtaagcagcacaccatact

SEQ ID NO: 88742 - DNA, 50 bp, homo sapien
atactacataattcgaaccactttayctttattatgatttgtttaatggc

SEQ ID NO: 88743 - DNA, 50 bp, homo sapien
acaggaatttgtttccatcctttcayggtcacaaataataaaaagcagct

SEQ ID NO: 88744 - DNA, 50 bp, homo sapien
ggggtattggtcaaaacggtatgtgsaatgggaaactttagcctgttagc

SEQ ID NO: 88745 - DNA, 50 bp, homo sapien
atgcgatgcctcgttaagttcagtarattaagtgaaatctgatttaactg

SEQ ID NO: 88746 - DNA, 50 bp, homo sapien
gagcttcatgttctggaaagttcccygaggttgtagtgtgaagatatggt

SEQ ID NO: 88747 - DNA, 50 bp, homo sapien
ccagaaaatctgggctgtgtttggayctattctaagcatctccctctttc

SEQ ID NO: 88748 - DNA, 50 bp, homo sapien
aatctactgaacttaacgaggcatcrcatgagtacacaagaaggtagtct

SEQ ID NO: 88749 - DNA, 50 bp, homo sapien
attataatagctcattgctccttacrtgtcagaagcacctctgggctgtg

SEQ ID NO: 88750 - DNA, 50 bp, homo sapien
cacagggaatccagggcatgtaagaycactggaagcagagaaggagcaag

SEQ ID NO: 88751 - DNA, 50 bp, homo sapien
gcactggctacgtaatttacacttaycaagcccaaacaacctgaggaatg

SEQ ID NO: 88752 - DNA, 50 bp, homo sapien
acactatttgcaaaactgcaccatasggttcaacatcttcagctgtcata

SEQ ID NO: 88753 - DNA, 50 bp, homo sapien
cctctggggacattaatttgactctsaccatgcactggtgctgggctggg

SEQ ID NO: 88754 - DNA, 50 bp, homo sapien
agacctgtgggggtgcaaatgcgaaygtgtgaggggtgctccgggacagc

SEQ ID NO: 88755 - DNA, 50 bp, homo sapien
attaatattataagaaaatagacaayaccggctccagctaagcactctgt

SEQ ID NO: 88756 - DNA, 50 bp, homo sapien
ggtttctgcctggtgtgtgagtctgrgaaagtcagttcctttccttgagc

SEQ ID NO: 88757 - DNA, 50 bp, homo sapien
aatctgaacctctagctccaactacyggcacaggcttattgtgtttgagc

SEQ ID NO: 88758 - DNA, 50 bp, homo sapien
aaggcaaacaatttcatagagaggcrgaattagttcccaagtagcctcag

SEQ ID NO: 88759 - DNA, 50 bp, homo sapien
tgtgatgtatgaaaagtgctagcccraagaggcctatgattatgaaaagc

SEQ ID NO: 88760 - DNA, 50 bp, homo sapien
ttttcccttttcatggcccttaatargaactgctttagatgaaaagctga

SEQ ID NO: 88761 - DNA, 50 bp, homo sapien
agtgttttaaatgttgcaaggtgaaraaggctcaaaagttttcacaaacg

SEQ ID NO: 88762 - DNA, 50 bp, homo sapien
tgctcactacagcccttacggttcarcaagcttcccctaacaaaactcac

SEQ ID NO: 88763 - DNA, 50 bp, homo sapien
tcatttcagttgccacgaatctcaaygtccccactggttgcaaatcctgt

SEQ ID NO: 88764 - DNA, 50 bp, homo sapien
ctggagtccaagaataccactgctcsaagaggttacctgcctgcctaaaa

SEQ ID NO: 88765 - DNA, 50 bp, homo sapien
ttcctttttcttgttctcatatggaycccctgttgttccagtaccatttg

SEQ ID NO: 88766 - DNA, 50 bp, homo sapien
gtgattttcacacaagtctctaggargtctctgagtgaacaaaggcacct

SEQ ID NO: 88767 - DNA, 50 bp, homo sapien
cctgtgagagccaaggatggcaccastcattgaaatcctgaccatgggaa

SEQ ID NO: 88768 - DNA, 50 bp, homo sapien
gatgggttgagaatttctattcttaygtggtagaacgcttttcataattc

SEQ ID NO: 88769 - DNA, 50 bp, homo sapien
actcatctgtgagcaaatacacaaakgttcacagtgagcaaatccacaaa

SEQ ID NO: 88770 - DNA, 50 bp, homo sapien
ccaagcccccagatattccctttgcygatggttgggatggcaggaaactt

SEQ ID NO: 88771 - DNA, 50 bp, homo sapien
tgttcgtaacctcttaaggccaatcsataaaaaacaaacttcttatttca

SEQ ID NO: 88772 - DNA, 50 bp, homo sapien
gtgtgtctgtcaccaggagagcaaaytgacaagccatggtgcatttgtac

SEQ ID NO: 88773 - DNA, 50 bp, homo sapien
ccctttcctctatgaagttggagagratttctgatgttgacttcccctgt

SEQ ID NO: 88774 - DNA, 50 bp, homo sapien
gaaatcaaatttcatgtcattctgcrctgggtagactcaggatttgcctg

SEQ ID NO: 88775 - DNA, 50 bp, homo sapien
gtaagtgtctatatgtgtagttttartaagtcttaactttttataaacca

SEQ ID NO: 88776 - DNA, 50 bp, homo sapien
aggtcatcctcaagagattacttccrcctcaattcacacaggacaggtga

SEQ ID NO: 88777 - DNA, 50 bp, homo sapien
attgaggagattactagcatatttcrccaattacttgctcattccctctt

SEQ ID NO: 88778 - DNA, 50 bp, homo sapien
agcaaaatacaagaggggagtgacartcttatccagccctccctcttctg

SEQ ID NO: 88779 - DNA, 50 bp, homo sapien
tcttttcctctttttcacatttccgrcaaagttcttccttccctgcaccg

SEQ ID NO: 88780 - DNA, 50 bp, homo sapien
tggttctgtgccaaacccatgcaaargaggaactgcaaaattacctaact

SEQ ID NO: 88781 - DNA, 50 bp, homo sapien
ctagaaaaggaggggacatcttaagycatcattataatagcacaatcagc

SEQ ID NO: 88782 - DNA, 50 bp, homo sapien
aaccaaatgtatttcaattgatacartataactaacttgtagaacttgag

SEQ ID NO: 88783 - DNA, 50 bp, homo sapien
tctttcattcagttatgataaatccracctctacatatgtagatatgaca

SEQ ID NO: 88784 - DNA, 50 bp, homo sapien
tgagagtggtttttatagctttaaayggttacattgtaactggagttata

SEQ ID NO: 88785 - DNA, 50 bp, homo sapien
aaaactatcactaggttgtgattaartccagattactgtttgaagagaaa

SEQ ID NO: 88786 - DNA, 50 bp, homo sapien
tctcacttgatacttgtacgctaggmattttctcatggacctggttaatt

SEQ ID NO: 88787 - DNA, 50 bp, homo sapien
ctttcatatttctaatcgaaaaactraaacccaggtatgtgcaacttaaa

SEQ ID NO: 88788 - DNA, 50 bp, homo sapien
gcagccctagaaaaataacacaaaargtgctcagggaaaatccagactaa

SEQ ID NO: 88789 - DNA, 50 bp, homo sapien
aacttagagttccaaccaatatgaastaaaatctgggtgaattaggttac

SEQ ID NO: 88790 - DNA, 50 bp, homo sapien
tgcaacagcactagacctgtgagaartagatatgaataacatatttctgt

SEQ ID NO: 88791 - DNA, 50 bp, homo sapien
ggaataaccttcctaaggcaaagaayggttggtggatttgattttttttt

SEQ ID NO: 88792 - DNA, 50 bp, homo sapien
cagagcacaattaggaataaataacygaaagatagctgcaaaatccccaa

SEQ ID NO: 88793 - DNA, 50 bp, homo sapien
agtttcaaggaccattgatttgtaawcttaagactattatagtgttgtgg

SEQ ID NO: 88794 - DNA, 50 bp, homo sapien
ctataataaaatgctaactgtagaawtgaggaggtatatgagtattcact

SEQ ID NO: 88795 - DNA, 50 bp, homo sapien
ctggtccctgctgacatccagtccaygttgttggccacatcagctcctct

SEQ ID NO: 88796 - DNA, 50 bp, homo sapien
gcagcgtggggccaaagacagtggcraggttgtgcagggacaccttattg

SEQ ID NO: 88797 - DNA, 50 bp, homo sapien
gccaaaagaaaatgcctttttgtccyacatcagaaatggtaggatacctc

SEQ ID NO: 88798 - DNA, 50 bp, homo sapien
gaggtgaagtgttatttgactaacaygtggaatatctgaaagtataaatc

SEQ ID NO: 88799 - DNA, 50 bp, homo sapien
tttattgtagactttcagaagatgcycattggatgaaccaaaaactctgt

SEQ ID NO: 88800 - DNA, 50 bp, homo sapien
ctctggccctgacagtgagaacaccratggcttagacaatgctcgtgagg

SEQ ID NO: 88801 - DNA, 50 bp, homo sapien
actataaatgctagactttattggaratgtagtccttgtcctgccccgcg

SEQ ID NO: 88802 - DNA, 50 bp, homo sapien
ctccattttatttctcattatctaawgttactgttttaatcctgaggctt

SEQ ID NO: 88803 - DNA, 50 bp, homo sapien
aaggtttcctgtaatatatcaagatkagttttaatagtttcaaggaccat

SEQ ID NO: 88804 - DNA, 50 bp, homo sapien
tcaacaagctcctggacttggggaayaaaagtacatcttcttggatttct

SEQ ID NO: 88805 - DNA, 50 bp, homo sapien
ctgaagccaaaatttctaactaggaytaatgcaaagatttcaagagaaac

SEQ ID NO: 88806 - DNA, 50 bp, homo sapien
cttctgtggtccaggtgaagctctcratcatagtgctctgtccctctccc

SEQ ID NO: 88807 - DNA, 50 bp, homo sapien
aacggcaccaaatcataaactttgcrcttataatgattaagacagtacag

SEQ ID NO: 88808 - DNA, 50 bp, homo sapien
tctctacacactgcggtggaagacayggcccttcctgccaacgtgcacct

SEQ ID NO: 88809 - DNA, 50 bp, homo sapien
actttcttcctaacagaagaatcaarttaatgaaactggaagtccctagt

SEQ ID NO: 88810 - DNA, 50 bp, homo sapien
caggagtagcctctgggaatcaaaaygggccttcatatttggggtgtcat

SEQ ID NO: 88811 - DNA, 50 bp, homo sapien
agataaataacaggatctaggagaaytggactcccgggaaggagagattg

SEQ ID NO: 88812 - DNA, 50 bp, homo sapien
cccaaagtgatcaccaagatccttamatgtgaaagaggaggcggaagagg

SEQ ID NO: 88813 - DNA, 50 bp, homo sapien
aagagaaaagcagagccaggattgarattaggaagcgacataaagaggcc

SEQ ID NO: 88814 - DNA, 50 bp, homo sapien
gctacaactttgttgcttcgagtttkactttgaaatgtgctctagagata

SEQ ID NO: 88815 - DNA, 50 bp, homo sapien
agagaaaaagatataaattgtcttayctttggttacaggttgattttaaa

SEQ ID NO: 88816 - DNA, 50 bp, homo sapien
gtggcaaagaagaatgtcatacttgmatatgtgcttacactggccactga

SEQ ID NO: 88817 - DNA, 50 bp, homo sapien
ataagctttggagcctattgataacmgcattagcaccacgatcaggaatg

SEQ ID NO: 88818 - DNA, 50 bp, homo sapien
agctgaacagctcatgtcacccaaartaccagagacagcctgcttcagct

SEQ ID NO: 88819 - DNA, 50 bp, homo sapien
tgcatttcaccagtgaatatgtaccrctcattcaacttgtttttttgctg

SEQ ID NO: 88820 - DNA, 50 bp, homo sapien
ggttgaagggcagctggggttgttcraaaggacagtgaagaatgagaatt

SEQ ID NO: 88821 - DNA, 50 bp, homo sapien
aacagaagggacaggaagagaaagcrtaggacaaggcccattattaaaca

SEQ ID NO: 88822 - DNA, 50 bp, homo sapien
attgtaatattccctttatcaaaaayctataactgaaatttataggtaag

SEQ ID NO: 88823 - DNA, 50 bp, homo sapien
tgctaaggttgtataagttgcaaaaytgttgaatcattttatttattcaa

SEQ ID NO: 88824 - DNA, 50 bp, homo sapien
gctgagtaacatgacatgaatgagartaatatgcaatgaaaagtgatcgc

SEQ ID NO: 88825 - DNA, 50 bp, homo sapien
atgatcatctcaatagatacagagamaacatttgacaaaattcagtatta

SEQ ID NO: 88826 - DNA, 50 bp, homo sapien
tgaaatgggaagaatcattttatccrgtgttaaggcttactatgtcgcta

SEQ ID NO: 88827 - DNA, 50 bp, homo sapien
tcctctaagggctagtagttcccacwcactcttctgaatgtactgcctat

SEQ ID NO: 88828 - DNA, 50 bp, homo sapien
gctcagcaatgcctccttgccagacyggtagcctgagattcagtcctgga

SEQ ID NO: 88829 - DNA, 50 bp, homo sapien
tgatgaccattcagacacttggaatmattacttggctaaataacattgtt

SEQ ID NO: 88830 - DNA, 50 bp, homo sapien
tgggagctaaaaatatgcatgtacawtactcattctcattaagagttact

SEQ ID NO: 88831 - DNA, 50 bp, homo sapien
aaggaaacaaaataagagcagctaaycattaggacataaatcaattgtaa

SEQ ID NO: 88832 - DNA, 50 bp, homo sapien
agctaaccattaggacataaatcaaytgtaagtgtttggatttgtgatta

SEQ ID NO: 88833 - DNA, 50 bp, homo sapien
tctcaaaacccagtaataagatgttraacaactcagtaaaaatgtgcata

SEQ ID NO: 88834 - DNA, 50 bp, homo sapien
ctttatgtccaggtttcttgttgacygaagactgtcacagggcatctctt

SEQ ID NO: 88835 - DNA, 50 bp, homo sapien
gccactgaaaacccaacagagatgaygagccccaaatggagtcactctcc

SEQ ID NO: 88836 - DNA, 50 bp, homo sapien
attggatatttagggacttccacaaratattataataaaataattctcag

SEQ ID NO: 88837 - DNA, 50 bp, homo sapien
tagcaccagtattaatcaaagatacmatggaaaaaagttccagagttaag

SEQ ID NO: 88838 - DNA, 50 bp, homo sapien
ctccgccccatttcctctccgtcatyagcctattttcagcctgtattaat

SEQ ID NO: 88839 - DNA, 50 bp, homo sapien
tttagggaaaatagataaatgtaacrctacaggagagaaaacaaggaggt

SEQ ID NO: 88840 - DNA, 50 bp, homo sapien
ggggttggaatgggaactgtctgcamatagacataagaatctttttggaa

SEQ ID NO: 88841 - DNA, 50 bp, homo sapien
gtgtctggtacatgtgtatgtgtaayagggaaacgcattctagattcaaa

SEQ ID NO: 88842 - DNA, 50 bp, homo sapien
tctaaagctattttgaagccaaatakaattttttattcatatttcctttt

SEQ ID NO: 88843 - DNA, 50 bp, homo sapien
ttctccttagctatacaatgggagtrgtgatcaggacatttttgcaggta

SEQ ID NO: 88844 - DNA, 50 bp, homo sapien
tttgtcctctttggctgtcttctcaygtgaatcctaaataggttttccaa

SEQ ID NO: 88845 - DNA, 50 bp, homo sapien
ttaaatcttttacatcaataactaaytcatacattacttatgtaatgata

SEQ ID NO: 88846 - DNA, 50 bp, homo sapien
gtcttgtgggtgaattagatacaaargcaaatattgaaaacacccatggc

SEQ ID NO: 88847 - DNA, 50 bp, homo sapien
tttgttctgtgtctgaattattgtayaccttggaaaacctatttaggatt

SEQ ID NO: 88848 - DNA, 50 bp, homo sapien
aagttactcatttattcagtaaatcrgattcgacaggcaacattctcaga

SEQ ID NO: 88849 - DNA, 50 bp, homo sapien
tggctgcacctaatgatcattgggaytcacctatcatgtcccatcttact

SEQ ID NO: 88850 - DNA, 50 bp, homo sapien
cctgcactctgatttccttccatatraaactgagcttttaaaattagttt

SEQ ID NO: 88851 - DNA, 50 bp, homo sapien
tggtttctagtcttggtgagttagcrgatatgggcttctttctagttgca

SEQ ID NO: 88852 - DNA, 50 bp, homo sapien
tacttttcacacaacataccctctayatcaaacctatgacttcattagat

SEQ ID NO: 88853 - DNA, 50 bp, homo sapien
cttgtgtcccttatacctgctaacgsaatctagctaatacctacagcttt

SEQ ID NO: 88854 - DNA, 50 bp, homo sapien
aggttggcatgggatccttagctgasgaatttgaccaaggtgggtggagg

SEQ ID NO: 88855 - DNA, 50 bp, homo sapien
aagccaagattttttattgttggagmgaaaggttacagacaagcaagggg

SEQ ID NO: 88856 - DNA, 50 bp, homo sapien
taatgaacctactgctatttttttayagttgtgagatgaaaaacagagag

SEQ ID NO: 88857 - DNA, 50 bp, homo sapien
tacttgtcttttctttaaccagtacyactgtcatgattactgtagcctta

SEQ ID NO: 88858 - DNA, 50 bp, homo sapien
attagactcactaatgcaaatgttcratgtttaagtagtttttgtgccac

SEQ ID NO: 88859 - DNA, 50 bp, homo sapien
cgtcagacactgtgggacgtaaaacractgtagaaaaatgaagatgttaa

SEQ ID NO: 88860 - DNA, 50 bp, homo sapien
tgtgaatattcaagatcgtgcgtgcratacttgagcatatacgcttaggt

SEQ ID NO: 88861 - DNA, 50 bp, homo sapien
agacataatggtccaagatggacaasttggaatcttctacaggctttctg

SEQ ID NO: 88862 - DNA, 50 bp, homo sapien
ctgacagaaagctacaccaagaacaygcttccttgtagctcctggtgagc

SEQ ID NO: 88863 - DNA, 50 bp, homo sapien
atgtcctggctgcctaagctcagaayaaataaagtgtggacttcttttct

SEQ ID NO: 88864 - DNA, 50 bp, homo sapien
gagcactttctagaactctcataacyctggatggattgcacatgtgacct

SEQ ID NO: 88865 - DNA, 50 bp, homo sapien
tgtctaacacgattttgagatcatayctggtatccactctagaactgaag

SEQ ID NO: 88866 - DNA, 50 bp, homo sapien
gattgtgcgttcgatggaggatatasagcattttatcccagacctactag

SEQ ID NO: 88867 - DNA, 50 bp, homo sapien
gtagtgcctctttctgctccacacartgctattggagtctgctgctggca

SEQ ID NO: 88868 - DNA, 50 bp, homo sapien
gcgccaggcctatgctttgtaatcayataacgtgtcttgttatttttgta

SEQ ID NO: 88869 - DNA, 50 bp, homo sapien
aaaccttctccttgattttttattaygaacagttatatcctttaatgtcc

SEQ ID NO: 88870 - DNA, 50 bp, homo sapien
aggccagaatggtgggaaagacagayccagataatgctgggaagtgtggc

SEQ ID NO: 88871 - DNA, 50 bp, homo sapien
gatctgagctcaaccctagacctaarctcctgactccataccctgattag

SEQ ID NO: 88872 - DNA, 50 bp, homo sapien
aaggaatgcttgatgacacaatgtaygaatgcaaatacccctggccccca

SEQ ID NO: 88873 - DNA, 50 bp, homo sapien
cataatggatgactattcagcaggakaatgaatggagcattgataatttt

SEQ ID NO: 88874 - DNA, 50 bp, homo sapien
gtggatcaccaggctgtacatttcasaaggtctcctgggtccactgccag

SEQ ID NO: 88875 - DNA, 50 bp, homo sapien
tgtggaagcatccccacaaaagagaygatatgttgcacgattccatttat

SEQ ID NO: 88876 - DNA, 50 bp, homo sapien
tgggccacttgcaagtccataaaacygtcactatagatttccagtaagtg

SEQ ID NO: 88877 - DNA, 50 bp, homo sapien
tgcagggttgacatcattgtatagamgggtttccacatccacgtgacctt

SEQ ID NO: 88878 - DNA, 50 bp, homo sapien
aaaaatctagatgcatggcaacaaartgaaaaaagccctgcctgagtgga

SEQ ID NO: 88879 - DNA, 50 bp, homo sapien
gcttgtgtttgctataaagtgaagcrcgataaagaggtacttactgttgg

SEQ ID NO: 88880 - DNA, 50 bp, homo sapien
gcaacacttgctcaggctcaaacttmaaatttctcccttaggcctacaag

SEQ ID NO: 88881 - DNA, 50 bp, homo sapien
tatttccacacagtgtgaggtttccratgtcaactccacaggcagcaatg

SEQ ID NO: 88882 - DNA, 50 bp, homo sapien
atacggtacacctagccagagcagaygacttagaggaaaggaagacaaag

SEQ ID NO: 88883 - DNA, 50 bp, homo sapien
ccagtacagccccttctgtctgaccratgcagctgtacctttgtcttcct

SEQ ID NO: 88884 - DNA, 50 bp, homo sapien
cctcttggggttcaaatgaaccttamatactggcttaaaactttcccttc

SEQ ID NO: 88885 - DNA, 50 bp, homo sapien
aaaagaatctcttgaaaataaggaarattgtggtggtgggaaatcaaagg

SEQ ID NO: 88886 - DNA, 50 bp, homo sapien
aaagaactcccattcgaacatatgcyaatgaaatgtgtggaaagattaca

SEQ ID NO: 88887 - DNA, 50 bp, homo sapien
ataagaatagaacgactagtaacaaygtatccttttggcaacactgataa

SEQ ID NO: 88888 - DNA, 50 bp, homo sapien
tgaaaattcttttcttccatgagacygaactatatattccctttattttc

SEQ ID NO: 88889 - DNA, 50 bp, homo sapien
caaggtcaaaggggatataagcacaygctctttctttataaacacaggtc

SEQ ID NO: 88890 - DNA, 50 bp, homo sapien
cccttgaggtaagcaccgaagttagratcagaacatttgagtcctatctc

SEQ ID NO: 88891 - DNA, 50 bp, homo sapien
ttgagagctcttggtgggtaggggamtcatcatggaatctgaaaggcagc

SEQ ID NO: 88892 - DNA, 50 bp, homo sapien
cacctcattctattcttaacactttygtcactaagcacattgccagttta

SEQ ID NO: 88893 - DNA, 50 bp, homo sapien
cctttaccctgatgaaacatgtgcaraccttcctacctgggggtcatgtg

SEQ ID NO: 88894 - DNA, 50 bp, homo sapien
atgagagagaccgaaacaacgacagyccatccaatgtgaaatggagtcag

SEQ ID NO: 88895 - DNA, 50 bp, homo sapien
tagaggtggggcctttgggaagcaaytagaattagataaggtcatcaagg

SEQ ID NO: 88896 - DNA, 50 bp, homo sapien
ggggctgtagggggtagaggtttgcytatgtgattaaatgaaggacctag

SEQ ID NO: 88897 - DNA, 50 bp, homo sapien
ggcacaggaacgcatctatctttccygaccgttgtatccccggtctgcag

SEQ ID NO: 88898 - DNA, 50 bp, homo sapien
taggagggtttaaacaggaaagagayaagcagtcagattcatagtttaga

SEQ ID NO: 88899 - DNA, 50 bp, homo sapien
gaggttttacatagcactgagacacsagggaaatccttttaacctttaga

SEQ ID NO: 88900 - DNA, 50 bp, homo sapien
tagatcactgtgtattccaatgcaargtgttagactagcaggaagatatt

SEQ ID NO: 88901 - DNA, 50 bp, homo sapien
acacctcctataatggctagtttcaygagtcaacttggctaggccacagt

SEQ ID NO: 88902 - DNA, 50 bp, homo sapien
gcattttattgaggtataatttacakaaactgccaagtgcatctgcacag

SEQ ID NO: 88903 - DNA, 50 bp, homo sapien
aatgggtgtcactgtcaaagtcagargagacgaccttgtgctcagtacag

SEQ ID NO: 88904 - DNA, 50 bp, homo sapien
ccttatgtgttaagtggattaatatraaacaacctcacaacaatcctgag

SEQ ID NO: 88905 - DNA, 50 bp, homo sapien
tgaaggttacaagacagaaacaaagsaaaagtatctatctctgtaatctt

SEQ ID NO: 88906 - DNA, 50 bp, homo sapien
tttgacagtgacacccattcttccaycttcaatgctggggctggcattgc

SEQ ID NO: 88907 - DNA, 50 bp, homo sapien
tcttgctattcttcagtttctctcamaatttacttcaaaattgaccatct

SEQ ID NO: 88908 - DNA, 50 bp, homo sapien
ggttcatgaagttccaggaaaaaacyggcttattctgggtgaaccacaga

SEQ ID NO: 88909 - DNA, 50 bp, homo sapien
tatatgcatcagcaatgtgacatcayggtatacaaagcgccatggagata

SEQ ID NO: 88910 - DNA, 50 bp, homo sapien
aaacaatcagaccttcaagccagagragcccttataaattcactgggcag

SEQ ID NO: 88911 - DNA, 50 bp, homo sapien
ctttgttgttggagacaatacattayagcgaacagagacttctttttcta

SEQ ID NO: 88912 - DNA, 50 bp, homo sapien
ctcttgagttttatactgtgctacakgtctataacaatttatagtatatt

SEQ ID NO: 88913 - DNA, 50 bp, homo sapien
cagggaaggtgacaagtctataaaaygtctgtgcatgtcagaaataaaga

SEQ ID NO: 88914 - DNA, 50 bp, homo sapien
cttcagccaactgacacttgtcctcrcagaacatatatgcctgcagcccc

SEQ ID NO: 88915 - DNA, 50 bp, homo sapien
tactggacactttgtatgttttgtcrcatcgaaaaattgacaagaatgca

SEQ ID NO: 88916 - DNA, 50 bp, homo sapien
aataaagacttgctgataacttcccraaaaccctagctttgctcaggaga

SEQ ID NO: 88917 - DNA, 50 bp, homo sapien
tcagacattattatgactaacttgawatatgtgatataaatggaggcttt

SEQ ID NO: 88918 - DNA, 50 bp, homo sapien
gttcagagaagggaaagcacatggaraattagggagaaaggcgagatact

SEQ ID NO: 88919 - DNA, 50 bp, homo sapien
aagagctcttaagaaccatatgatcycatgtggcaagaaggaatttatgg

SEQ ID NO: 88920 - DNA, 50 bp, homo sapien
cataattggcgagttcttattcttakaatcaaatgaagaggtagctctgc

SEQ ID NO: 88921 - DNA, 50 bp, homo sapien
aggctgctaacaacatagcgtaaacrgaacgggtcataaacagaaattta

SEQ ID NO: 88922 - DNA, 50 bp, homo sapien
catcttgttggggattcattttcaargatgtgactcaaggttatgaacgt

SEQ ID NO: 88923 - DNA, 50 bp, homo sapien
catgcaggagccatgcttaatatacyggttcttcaggaacacccagagaa

SEQ ID NO: 88924 - DNA, 50 bp, homo sapien
gacatggttgtccatgtttcaatcaygcctgtgcaaagtagtctccacaa

SEQ ID NO: 88925 - DNA, 50 bp, homo sapien
tccaaaaggacctatccaatatttcrctgcttcctgcttttgttcatgct

SEQ ID NO: 88926 - DNA, 50 bp, homo sapien
aagctgatgacttggggtccagtcasattgagttggaggtgatgatgaga

SEQ ID NO: 88927 - DNA, 50 bp, homo sapien
ggggcagaatgttgaccacagattgraagttaggtgaaagctgatttccg

SEQ ID NO: 88928 - DNA, 50 bp, homo sapien
aattccccatgttaattctcaaaaaytgttaaaggaacagtcctattatc

SEQ ID NO: 88929 - DNA, 50 bp, homo sapien
tgatgaaggtggagatgctttaaagkaatttatggaatttatgcctgtta

SEQ ID NO: 88930 - DNA, 50 bp, homo sapien
tagtaaccagggattcaccgccttckactcagccagattacataacctat

SEQ ID NO: 88931 - DNA, 50 bp, homo sapien
aacaggactgaagagccacatattcwcccattactagtatttgacattca

SEQ ID NO: 88932 - DNA, 50 bp, homo sapien
ttcctttgaagctgcacacaggttaygaatacaaacgatgatgacaaaat

SEQ ID NO: 88933 - DNA, 50 bp, homo sapien
agagaagcaatgcagttgcaagaaarttgactataatcatagataagctg

SEQ ID NO: 88934 - DNA, 50 bp, homo sapien
atacagtctgaatcatgggaaggaayggtcctctgcctgactaacaggaa

SEQ ID NO: 88935 - DNA, 50 bp, homo sapien
ctgttttcttctttgtacttcctgtyagtcaggcagaggaccattccttc

SEQ ID NO: 88936 - DNA, 50 bp, homo sapien
gtcttctcctctcaagcacttgtaargaaacacaaggggtggggtgactt

SEQ ID NO: 88937 - DNA, 50 bp, homo sapien
aaaccttaaatttattgatgtataartatgcgtccctgttttccaatatt

SEQ ID NO: 88938 - DNA, 50 bp, homo sapien
tatcacaaaaatatgatacaatacasagaatttaatacaaaaacattaag

SEQ ID NO: 88939 - DNA, 50 bp, homo sapien
atggaagtctctggaaaccgacatargcgcccacggtggtccccgctgga

SEQ ID NO: 88940 - DNA, 50 bp, homo sapien
cttgtgatcgtgactgttataaccasaaagtacatggaagtgataaatcc

SEQ ID NO: 88941 - DNA, 50 bp, homo sapien
aaagaattacatgaacccaaaagaaygttgcttggaagagcagaggctga

SEQ ID NO: 88942 - DNA, 50 bp, homo sapien
tgaaaatggcagcaccaaaaatcgartgtagctctgattgcccggaagcc

SEQ ID NO: 88943 - DNA, 50 bp, homo sapien
acattcttgaaattctgcttagctasactgttatgtgcaagttgattctg

SEQ ID NO: 88944 - DNA, 50 bp, homo sapien
gtacctgctatgtgttaggaactggsaatacagaaattggataccacccc

SEQ ID NO: 88945 - DNA, 50 bp, homo sapien
cctccagagcaaagagcaactccaartcagggttaagaaggaaaactctg

SEQ ID NO: 88946 - DNA, 50 bp, homo sapien
gataagcctgcctttcccatgcaatmattcgtagtggattcaggcagaac

SEQ ID NO: 88947 - DNA, 50 bp, homo sapien
tacatatgcacgcacatacatgcacrtccacaatccatgttcctatgcac

SEQ ID NO: 88948 - DNA, 50 bp, homo sapien
agaagttcagcagcaagggtatttasagtgccacatgcagtctcattttc

SEQ ID NO: 88949 - DNA, 50 bp, homo sapien
agagatcatttatcttattaaaacartaggcaagagtcatcaaagtggaa

SEQ ID NO: 88950 - DNA, 50 bp, homo sapien
tgacctcaaaacacctgactattaarccatgtagtctcttgattagatac

SEQ ID NO: 88951 - DNA, 50 bp, homo sapien
tgtgctgatcacaggaacctcatccyaaggcaggaacttcaccttctttc

SEQ ID NO: 88952 - DNA, 50 bp, homo sapien
actgaatacactgagataaagcagcraatagatcttcctcatcaccttct

SEQ ID NO: 88953 - DNA, 50 bp, homo sapien
aattgcaaatacttttatgatatgcycaagaaaacaagctgttgaaagtg

SEQ ID NO: 88954 - DNA, 50 bp, homo sapien
accatttctctgacatttagcaaacrgtgccggccgcccctcctcaggta

SEQ ID NO: 88955 - DNA, 50 bp, homo sapien
tgatcacggtctgctctctatcaggwatccttatgaatcctggagaagtg

SEQ ID NO: 88956 - DNA, 50 bp, homo sapien
tgtccatatttcattagacataaacmcagaacatgcaacgttttagcttt

SEQ ID NO: 88957 - DNA, 50 bp, homo sapien
accaccgaacatggaggtccaatgcygattcatgaccctgagagctccat

SEQ ID NO: 88958 - DNA, 50 bp, homo sapien
taacccaacctggatcctattaagtmacctgtaaaaacaagccacaccac

SEQ ID NO: 88959 - DNA, 50 bp, homo sapien
tgacattcaaatatattcacatctasgtttttgaaaacttccccagttga

SEQ ID NO: 88960 - DNA, 50 bp, homo sapien
tttttggtttttgtttttttcatcamagtggttagttagcatgaattgta

SEQ ID NO: 88961 - DNA, 50 bp, homo sapien
ggcccattcccaccacgatgtagtargcagtttcagaactttctctaagg

SEQ ID NO: 88962 - DNA, 50 bp, homo sapien
tgcattcagtgataagaaaaagagastaggaatcacatggccatagatac

SEQ ID NO: 88963 - DNA, 50 bp, homo sapien
ttgtgacctctcaccctgagctgcasaccttctgtttcgtgatccgcgtg

SEQ ID NO: 88964 - DNA, 50 bp, homo sapien
gccgctgccctcagcttcatagcaamctttttagatggaggttgtttttg

SEQ ID NO: 88965 - DNA, 50 bp, homo sapien
catgatgagctgtgttggaataacakggaacaacttaatagtattaaatc

SEQ ID NO: 88966 - DNA, 50 bp, homo sapien
tatcatgtcccctatctcccaattayggtcttttctttgtgcctccttcc

SEQ ID NO: 88967 - DNA, 50 bp, homo sapien
catcatgtggattcctttccatagtygtcatgagctaacacacttcgccc

SEQ ID NO: 88968 - DNA, 50 bp, homo sapien
ctttttttattactaaacagtattarcaattatatgtaattggctcttat

SEQ ID NO: 88969 - DNA, 50 bp, homo sapien
cttattcatatgcactaataatccarctgtcagatgtgaatgctaagctg

SEQ ID NO: 88970 - DNA, 50 bp, homo sapien
cctgacacatggttgctacttgataraggtgaccaagtgaagaataagct

SEQ ID NO: 88971 - DNA, 50 bp, homo sapien
tttaagtacccaaaacaatagagaayggtgaggactgaagtggagagaaa

SEQ ID NO: 88972 - DNA, 50 bp, homo sapien
atctcttttactagattgtgtattcyaagaaggcaagtttctatcttact

SEQ ID NO: 88973 - DNA, 50 bp, homo sapien
actgaaaacaaatcaagcggttttamagctatggcttcataatgaaaata

SEQ ID NO: 88974 - DNA, 50 bp, homo sapien
ttgtctgctaacctttgtaggtttcscttcaccacaaaactaacagcaga

SEQ ID NO: 88975 - DNA, 50 bp, homo sapien
attatgggaacaatcaaatcagttargatatagtgtctgttttctttgga

SEQ ID NO: 88976 - DNA, 50 bp, homo sapien
ccaagaggagcctcaggaagcgtgaygactaaatgtcacgtgggattctg

SEQ ID NO: 88977 - DNA, 50 bp, homo sapien
aaaagcagcattaggaatgacctcaraaaagtggacactttcacagagaa

SEQ ID NO: 88978 - DNA, 50 bp, homo sapien
ctcagcaagacagctcgagagatccrgcctcccccaatgtctaaactgct

SEQ ID NO: 88979 - DNA, 50 bp, homo sapien
aatagaagcttgtaaagttgtgatascttaaattttgccaagttatgagg

SEQ ID NO: 88980 - DNA, 50 bp, homo sapien
atacatgtatctataaatagctctgyatgtaactgtatggatctctagta

SEQ ID NO: 88981 - DNA, 50 bp, homo sapien
ttaaaaacagaccgtgatgcttttayatacagacccacactgtccatgac

SEQ ID NO: 88982 - DNA, 50 bp, homo sapien
aacttagtagctgtctgaaaaaaagratacatataaattgaagggaaaaa

SEQ ID NO: 88983 - DNA, 50 bp, homo sapien
aagtcctctttcacataacactacaycacttcacaggttgtacatgtatc

SEQ ID NO: 88984 - DNA, 50 bp, homo sapien
gactcatcacgtacatgttgagattrgaaaggtgagcaccaagacgctag

SEQ ID NO: 88985 - DNA, 50 bp, homo sapien
gcacttcatcttggtaaggagcacartggagcgtccagacagccagaggt

SEQ ID NO: 88986 - DNA, 50 bp, homo sapien
tattttagaatttgtatctttataamctgacagtctctctgggctgttat

SEQ ID NO: 88987 - DNA, 50 bp, homo sapien
catccaaggtgaccgtttctactgasatagttgattggatccatgagtca

SEQ ID NO: 88988 - DNA, 50 bp, homo sapien
tccagtcggcctgcactgcgttcctraaaaggccacaatatgggtgcaag

SEQ ID NO: 88989 - DNA, 50 bp, homo sapien
tagttagaagcaatgtacaattgctsaagatatgaatattagtaactttg

SEQ ID NO: 88990 - DNA, 50 bp, homo sapien
gatagaatgttagaattaaattgttktgagaccaccaaattcccattgct

SEQ ID NO: 88991 - DNA, 50 bp, homo sapien
tctctgcatgtccaaaaccgaactcrccgtccagtgctattcactctacg

SEQ ID NO: 88992 - DNA, 50 bp, homo sapien
tttttgatctatttttgtctctacayggacgtaaagcaccgaatcctatt

SEQ ID NO: 88993 - DNA, 50 bp, homo sapien
gatcagatttaacacattttggtcayggtccattttcttttagctgggga

SEQ ID NO: 88994 - DNA, 50 bp, homo sapien
atcagagaaatatacctcttattacmacctggaaattaccaccctggatt

SEQ ID NO: 88995 - DNA, 50 bp, homo sapien
ttcccctaactctgcctgggaaatgmatcatagctgggtatagctctgta

SEQ ID NO: 88996 - DNA, 50 bp, homo sapien
agagtaagaggtcaagaaaacattcraacttgagttgtaaagctcatgct

SEQ ID NO: 88997 - DNA, 50 bp, homo sapien
tgtctgtcttagttggctcaggctgycacaacaaaataccacagactagg

SEQ ID NO: 88998 - DNA, 50 bp, homo sapien
tgtgtgtaaaataactatagtctgayacacttaatgaaaaagcttagagt

SEQ ID NO: 88999 - DNA, 50 bp, homo sapien
ttagtaatgtatagtaaaaataaaarttactgagtttccttttttaaact

SEQ ID NO: 89000 - DNA, 50 bp, homo sapien
gcaagagaggaagctaaatggattakgttgtgaggagcctagaatggcag

SEQ ID NO: 89001 - DNA, 50 bp, homo sapien
gtcctgctcactctggacaatgtaawcctagctctaatgctccgtgtaga

SEQ ID NO: 89002 - DNA, 50 bp, homo sapien
agaaaataacagcaacctatttatayacataagccactttcatacctgcc

SEQ ID NO: 89003 - DNA, 50 bp, homo sapien
aggaatataggtcaaatttagactcrgaagtaaggtgtgcatcttaaaat

SEQ ID NO: 89004 - DNA, 50 bp, homo sapien
tatcataaagaaataccatttgtaayagaaggagaagtccctgtgaggat

SEQ ID NO: 89005 - DNA, 50 bp, homo sapien
ataattgcgttttctcaaccaacatygaccctttgagcaggggtgggtaa

SEQ ID NO: 89006 - DNA, 50 bp, homo sapien
tagcagactggcattgtctgtactamaactcatcctctctgtcagtggag

SEQ ID NO: 89007 - DNA, 50 bp, homo sapien
ggatggaaattctcattctaatttaygtaaagattttgctcctaacaagt

SEQ ID NO: 89008 - DNA, 50 bp, homo sapien
cgttagcattctctctaaaatagttytctaagttgctctcctttttttct

SEQ ID NO: 89009 - DNA, 50 bp, homo sapien
ttgcaagtgccaccctagcacacgaygttccaccagatctcactgtggca

SEQ ID NO: 89010 - DNA, 50 bp, homo sapien
caggcttcttcattttacatcagcartctattcctgaaaatcagacattc

SEQ ID NO: 89011 - DNA, 50 bp, homo sapien
actgccttgctgacttcatcacatckccaaagcagaattcatggatgagg

SEQ ID NO: 89012 - DNA, 50 bp, homo sapien
gccactttactccctttccattcccrgaggagagaaaccattttggagct

SEQ ID NO: 89013 - DNA, 50 bp, homo sapien
ggatggaggtgctacgccatgtaccktaggatgcttagcagcacgggggc

SEQ ID NO: 89014 - DNA, 50 bp, homo sapien
aaatatttctcatcaataaaaaggartaagccatgttgatatgcacaaca

SEQ ID NO: 89015 - DNA, 50 bp, homo sapien
actgactccctcatagagctatttcragcattaaatgaatttatatatat

SEQ ID NO: 89016 - DNA, 50 bp, homo sapien
catgagaccttatgcccaaactgacmgccattccaggcccatcactcact

SEQ ID NO: 89017 - DNA, 50 bp, homo sapien
ccttctctttggccaggctttaagarcaagatgggtccactcattactga

SEQ ID NO: 89018 - DNA, 50 bp, homo sapien
cagaaaagcttggatttcatgcttayctaaagggaaggtgcccacgtgct

SEQ ID NO: 89019 - DNA, 50 bp, homo sapien
acttaattgttctgccataagaatayactgattgagttgcttttgaaaat

SEQ ID NO: 89020 - DNA, 50 bp, homo sapien
tatatcaatgtctatgtctaccttayagttcatttatagtaagtgctata

SEQ ID NO: 89021 - DNA, 50 bp, homo sapien
aagaggcacttcagctacccattatyaattaccttctttaggtgatcaat

SEQ ID NO: 89022 - DNA, 50 bp, homo sapien
tctcagaaatcctctcactttcctckaagtaggagtaatctcttttaatg

SEQ ID NO: 89023 - DNA, 50 bp, homo sapien
gccaagtgtaaagattattatcagawccaaattccatccttggttattgc

SEQ ID NO: 89024 - DNA, 50 bp, homo sapien
atgtgtatgccagagattatggtcaraaatctgaatcagtaatctcagtg

SEQ ID NO: 89025 - DNA, 50 bp, homo sapien
cattgggaatgcttatcgaaggactyagtatccgagcgaggcagctcctg

SEQ ID NO: 89026 - DNA, 50 bp, homo sapien
gagagtaggtatatagctaaaggtgrcctctgcaaccactttgcagtggc

SEQ ID NO: 89027 - DNA, 50 bp, homo sapien
catagagaccaaattttggactccartaaattttgcagaatcacagatga

SEQ ID NO: 89028 - DNA, 50 bp, homo sapien
taattcttaaggtatgtttagggaaycacctatataggctcgattggagt

SEQ ID NO: 89029 - DNA, 50 bp, homo sapien
atccagatttggacttaaagccaccrctaaaatcaattggaagcaatttc

SEQ ID NO: 89030 - DNA, 50 bp, homo sapien
gccaccacaaaagcacacttaagtayaccattgacgccatgaagcaacta

SEQ ID NO: 89031 - DNA, 50 bp, homo sapien
agacagatgtttgcactttgcacacyatcagattactaagaatggttctt

SEQ ID NO: 89032 - DNA, 50 bp, homo sapien
ctttttgctttacacttctcatttcrcaaatacaatggtataatttcact

SEQ ID NO: 89033 - DNA, 50 bp, homo sapien
tgacagggccgaggcctggcactacrgaattactgacggacagatcaatc

SEQ ID NO: 89034 - DNA, 50 bp, homo sapien
aagcccaagtgttcagctttttagaygtaagaatgctacttatggcgttg

SEQ ID NO: 89035 - DNA, 50 bp, homo sapien
tcagcctctactcaaatctgtttgtsaaaccaaaaggtgcttcgtgttta

SEQ ID NO: 89036 - DNA, 50 bp, homo sapien
gacccaaatgttgtttcgccttaaaytactttctttttaatattttcttt

SEQ ID NO: 89037 - DNA, 50 bp, homo sapien
gtaatttggaaaaacaaacagggaaytcaattgtcaggcaacaatctgaa

SEQ ID NO: 89038 - DNA, 50 bp, homo sapien
acatgtaagaatgttacacgcccacraaattaacaatgctgaattcagga

SEQ ID NO: 89039 - DNA, 50 bp, homo sapien
gtggtcagggaggccctggggaccaygcacaaacttcgagcaagagcgtc

SEQ ID NO: 89040 - DNA, 50 bp, homo sapien
aaaaaaaaattttaagtacaaaccaygagaggatttggttttcaaatatt

SEQ ID NO: 89041 - DNA, 50 bp, homo sapien
gtttgtatgtgaatataagatttccwagagtaaatacccaagaatgcaac

SEQ ID NO: 89042 - DNA, 50 bp, homo sapien
gttgtacagatttctcatttacagtkaagttcatgaatcatttccagttc

SEQ ID NO: 89043 - DNA, 50 bp, homo sapien
ttatgaaggaccatacgaggcattasagcgcgcgccctttccatgtaaag

SEQ ID NO: 89044 - DNA, 50 bp, homo sapien
tgaatgatatgcagtggccattatcmaacaattgaaggttcacacctcca

SEQ ID NO: 89045 - DNA, 50 bp, homo sapien
aatctgggatccacagggagaaaatmattcatcaagcatcagttataaaa

SEQ ID NO: 89046 - DNA, 50 bp, homo sapien
tgaaggaatcaagtgatgcaacaaayagtctggataaaaccatagtctag

SEQ ID NO: 89047 - DNA, 50 bp, homo sapien
tgctctagagtctggtggcctccaamaccactatctgggtagcctcaggc

SEQ ID NO: 89048 - DNA, 50 bp, homo sapien
atcctgaggtctctactatgaaaaayacgtgaaatatcaatccactccta

SEQ ID NO: 89049 - DNA, 50 bp, homo sapien
acctcaggatgcttggcccatggtasagcattaatactcattgaatgaat

SEQ ID NO: 89050 - DNA, 50 bp, homo sapien
agagcgagactccgtttcaaaaaaarggataagtcagttgagcaagagat

SEQ ID NO: 89051 - DNA, 50 bp, homo sapien
ttgtgtgaaaagtactactttgaaawattagataacttcagagtcacaac

SEQ ID NO: 89052 - DNA, 50 bp, homo sapien
cctccacactcaccgtggtgtcgtcytcagcacccaggccaaagaacacc

SEQ ID NO: 89053 - DNA, 50 bp, homo sapien
tcctcagcacccaggccaaagaacayctcatttattatattgactcaagc

SEQ ID NO: 89054 - DNA, 50 bp, homo sapien
agcgttggacggactgatggcaaaaygggtcatggcaatggagcccgtta

SEQ ID NO: 89055 - DNA, 50 bp, homo sapien
tatcttgggcagagctttttgtgggkatatcaaactgttaatggatagaa

SEQ ID NO: 89056 - DNA, 50 bp, homo sapien
atggaatatagagatatatcacagaygctccaagtcccagcattaggaag

SEQ ID NO: 89057 - DNA, 50 bp, homo sapien
aatttttaaaaatccctacaaagacrcaattattcaggtatagatgagga

SEQ ID NO: 89058 - DNA, 50 bp, homo sapien
cctggatcttcttgccaggaaaccaracttccatggaaaacaggtgaatc

SEQ ID NO: 89059 - DNA, 50 bp, homo sapien
catccattcaataaattgttacagarcacctaatatgggccagacgtgtc

SEQ ID NO: 89060 - DNA, 50 bp, homo sapien
aggtttcaagccttgcctctccgtamgtcctctgttaaaatgccaatgta

SEQ ID NO: 89061 - DNA, 50 bp, homo sapien
tctataaataaatagtgatatatgasaatcagttggtagttctttttctg

SEQ ID NO: 89062 - DNA, 50 bp, homo sapien
ttttttttctgtgattattaaagctyagttttttgctgtagacagaactc

SEQ ID NO: 89063 - DNA, 50 bp, homo sapien
aatttcccatgctgatcaaagtgagsaaagttgtcctgagtctgggattt

SEQ ID NO: 89064 - DNA, 50 bp, homo sapien
attatcagatatttagggtaaagcayggaatctttcagaaactgggaaca

SEQ ID NO: 89065 - DNA, 50 bp, homo sapien
cttttgagaattcttagcacacagcrcttaataatgctaattgtttttat

SEQ ID NO: 89066 - DNA, 50 bp, homo sapien
tgtccccacgtatcagtggtgataamtggatcagaagaaagttgatcaaa

SEQ ID NO: 89067 - DNA, 50 bp, homo sapien
tttttgcctacagtctactgggctcracttattcacaatacaacagtgcc

SEQ ID NO: 89068 - DNA, 50 bp, homo sapien
taaggttaaggactgatttctaaaaytatgcaactcccatgacaagctgg

SEQ ID NO: 89069 - DNA, 50 bp, homo sapien
acactaaacttctccaacatataatsacagaaacaacacaatagttacaa

SEQ ID NO: 89070 - DNA, 50 bp, homo sapien
atgtttgacataggggatagaaagawctggtttgtctagtggtaaagagg

SEQ ID NO: 89071 - DNA, 50 bp, homo sapien
tcagcagcgtttttagcaactcaacsctactgtttccaaaacattcatag

SEQ ID NO: 89072 - DNA, 50 bp, homo sapien
tttaatggagtcaaaagggcagaaamagagtacgcacggttttgtataaa

SEQ ID NO: 89073 - DNA, 50 bp, homo sapien
tacattaactctctctcaaagctcasgaaatgacctcgcatgatcaattt

SEQ ID NO: 89074 - DNA, 50 bp, homo sapien
atttttggttaatattcccaatgtgsacttagaaaactaggactcaagat

SEQ ID NO: 89075 - DNA, 50 bp, homo sapien
agcagactggtacctgggagctaaarcattcctcttgttgaaagaaagag

SEQ ID NO: 89076 - DNA, 50 bp, homo sapien
ttctcaatgtggtaatgaagtggccraggctacgactacacatttttgaa

SEQ ID NO: 89077 - DNA, 50 bp, homo sapien
agatttatcctgtcttcctctttgargtttattgctttgattttgtatgt

SEQ ID NO: 89078 - DNA, 50 bp, homo sapien
tgtgatggaaacacgtctttcaaaartgtgtagtcgtagcctcggccact

SEQ ID NO: 89079 - DNA, 50 bp, homo sapien
caatgcctaattcatcaagcgataaygaaaatgctactgacacacgctca

SEQ ID NO: 89080 - DNA, 50 bp, homo sapien
tattttactaccaattttctttttayacggtgaaatgaaaatagtgcact

SEQ ID NO: 89081 - DNA, 50 bp, homo sapien
atctcttagaatctgataccattcaraattttaatagagtcacagggtac

SEQ ID NO: 89082 - DNA, 50 bp, homo sapien
tgtatttttataccatatttttttaygctctcaatagtgatcaaataaat

SEQ ID NO: 89083 - DNA, 50 bp, homo sapien
ctgtgctgtatttgttacaatcgatragccaatatgaatgcatgcatatt

SEQ ID NO: 89084 - DNA, 50 bp, homo sapien
ggttgatgagattgcctagtgcagcraaagttgtaatataagaaattcac

SEQ ID NO: 89085 - DNA, 50 bp, homo sapien
tgtcacactgaacaataacagcaackgcggctgctactattgctgtattc

SEQ ID NO: 89086 - DNA, 50 bp, homo sapien
cttatgacttctataaaagttaccamaaatgttatggcttaaaacagtac

SEQ ID NO: 89087 - DNA, 50 bp, homo sapien
atcagagaagtcggcttaagttatayagctggtaagtcaacaagcaatag

SEQ ID NO: 89088 - DNA, 50 bp, homo sapien
agcaacaagatgaactaactgcctcrtgttctgtggcttaacctagtaca

SEQ ID NO: 89089 - DNA, 50 bp, homo sapien
ggagagccaagagttttgagttaggygagaacagtggtgtaggaagagtt

SEQ ID NO: 89090 - DNA, 50 bp, homo sapien
aaaatttcctgttccaatattgaaartgatgctgcgtgaattattgaaac

SEQ ID NO: 89091 - DNA, 50 bp, homo sapien
gattaatgttttgctctgataaaaayagattttggttcttaagggaaatc

SEQ ID NO: 89092 - DNA, 50 bp, homo sapien
gaggaaagctgaggctcagggaagtsaagtggctaaccaaaaagttatat

SEQ ID NO: 89093 - DNA, 50 bp, homo sapien
agcaattttcaaatccaggtactcaytgaacagattacacaaatgatcaa

SEQ ID NO: 89094 - DNA, 50 bp, homo sapien
tgaaagtgtacttttggtctgctcartcaaactgggcttgtcaataaagc

SEQ ID NO: 89095 - DNA, 50 bp, homo sapien
gcatttatcttggggctacaatagamgcatggaatctttcttcaaagagg

SEQ ID NO: 89096 - DNA, 50 bp, homo sapien
tctgagttggcccagtacagctcaastccctgcaaactggttaaagaagt

SEQ ID NO: 89097 - DNA, 50 bp, homo sapien
ttagaataactgtttcacctatggartaaaattttgcaccccctcccttt

SEQ ID NO: 89098 - DNA, 50 bp, homo sapien
ctctctgggagattctttatgcgtasaaagaatacacaaatgcatattga

SEQ ID NO: 89099 - DNA, 50 bp, homo sapien
ccagagagccagttaaaaatgaggaytataggattccgtggcctttccca

SEQ ID NO: 89100 - DNA, 50 bp, homo sapien
gtgtttcttgttactatgattgttakgacagaaaatgcttttagagatgg

SEQ ID NO: 89101 - DNA, 50 bp, homo sapien
ctagatcatttatacctcctattaawcagaaaaatatatccctatgagca

SEQ ID NO: 89102 - DNA, 50 bp, homo sapien
attaaaaatatattcacaccttataygaaaatagtttacagaaaactgta

SEQ ID NO: 89103 - DNA, 50 bp, homo sapien
tattgtttctatttatatcttcttawactgactgtgtcttaaaaagttgt

SEQ ID NO: 89104 - DNA, 50 bp, homo sapien
actttcttgtgggcctggactatacratccagtttaaattataagaacac

SEQ ID NO: 89105 - DNA, 50 bp, homo sapien
catgccacatgatactgttttctgaycctcatttataaactccctccctc

SEQ ID NO: 89106 - DNA, 50 bp, homo sapien
cgccactgtgagatttatttgatttygcagtctggctaattaattttttc

SEQ ID NO: 89107 - DNA, 50 bp, homo sapien
tgtatggtactcaaaacattttcaarttctaactgtatccgtgcattttt

SEQ ID NO: 89108 - DNA, 50 bp, homo sapien
caaataaaaatgttgcttgcatatamggaggtttacaattttgattgttg

SEQ ID NO: 89109 - DNA, 50 bp, homo sapien
aagaaataggagatatgttttacgasgactaggatatatggctatgttgt

SEQ ID NO: 89110 - DNA, 50 bp, homo sapien
ccctattgtaattttgttcttcttcrcgatgtggaatcatttaccctctt

SEQ ID NO: 89111 - DNA, 50 bp, homo sapien
tagagcaaggaagccagtatgaaaartatccctatgaactaagctgcata

SEQ ID NO: 89112 - DNA, 50 bp, homo sapien
cagcttgtttgggctattcctgtcamatattgggcttcacaacaatgaat

SEQ ID NO: 89113 - DNA, 50 bp, homo sapien
tgggaagatctctctagctataagaytcaagcacctttggagggattggt

SEQ ID NO: 89114 - DNA, 50 bp, homo sapien
agttttttgtgattgttgttcttaasgttactttgaagctgtcctgatgg

SEQ ID NO: 89115 - DNA, 50 bp, homo sapien
cattcagaaattggactcaaacatgsaaagaatataattcgttaaaaaga

SEQ ID NO: 89116 - DNA, 50 bp, homo sapien
tgttggattcattaccttcaatatcrccctctttcttctgtcctatcctg

SEQ ID NO: 89117 - DNA, 50 bp, homo sapien
tccttaatatgctgcccttattgacyaagttactatcactagttaatgta

SEQ ID NO: 89118 - DNA, 50 bp, homo sapien
gacattcagaggcacagcattgataycatccggtgcaaggattttctgtc

SEQ ID NO: 89119 - DNA, 50 bp, homo sapien
tccaagacagggagataaaagttgaraacaatcggtgcaacagagtaaaa

SEQ ID NO: 89120 - DNA, 50 bp, homo sapien
atcaaaactccacttcactgcagaayttaaatgcagaaaagcaaagctgc

SEQ ID NO: 89121 - DNA, 50 bp, homo sapien
caatctgaatatcactgacaatagcsgaaacttaccagttacatcctaca

SEQ ID NO: 89122 - DNA, 50 bp, homo sapien
caaattacgctacatattaagatatyagtcctttccgttgctctttatta

SEQ ID NO: 89123 - DNA, 50 bp, homo sapien
gaaagggggtgttttccaacatttaraacagagatggaactgaaattgcc

SEQ ID NO: 89124 - DNA, 50 bp, homo sapien
acattaaaaattgactgacctaggaygctaaaagaagtttgtggcagaat

SEQ ID NO: 89125 - DNA, 50 bp, homo sapien
ttcttggagaatgttgaatcccagaygagcttttagtcccctgatgttca

SEQ ID NO: 89126 - DNA, 50 bp, homo sapien
ttttataacactttaccatttacaargaaatttcatatactgtattctat

SEQ ID NO: 89127 - DNA, 50 bp, homo sapien
tatagctgtactcagaactaggagaygttggcccctaatcacacattagg

SEQ ID NO: 89128 - DNA, 50 bp, homo sapien
acatcacaaagtttaatgttctgaarcttctttggtgaataggatctaga

SEQ ID NO: 89129 - DNA, 50 bp, homo sapien
caactctgttgagagtagaatatagmaagtctttatcaataagttctggt

SEQ ID NO: 89130 - DNA, 50 bp, homo sapien
attctgtattaatctcccagactgcyatgtcaaagtttcacaaattgggt

SEQ ID NO: 89131 - DNA, 50 bp, homo sapien
catgtcaaagtttcacaaattgggtsgctgaaaacaatagacatgtattg

SEQ ID NO: 89132 - DNA, 50 bp, homo sapien
caatagacatgtattgctcatagtastggaggcaagaaatctgagctcaa

SEQ ID NO: 89133 - DNA, 50 bp, homo sapien
tctggcttcattaaaatgagttgggwagaagttctctcctatctgttttc

SEQ ID NO: 89134 - DNA, 50 bp, homo sapien
gttttctgcatgcaaatgctaatatractgagcttctcatgtatgtgaaa

SEQ ID NO: 89135 - DNA, 50 bp, homo sapien
ataagatataattatttttaaccackaagatgaacacccaaatgccatta

SEQ ID NO: 89136 - DNA, 50 bp, homo sapien
atgtaatgtacatgagaatgtaaaaragaaacaagatgacaactcaaaaa

SEQ ID NO: 89137 - DNA, 50 bp, homo sapien
aggattcgtcactaccaaaaaacccracgtattcaggcaacaattagcat

SEQ ID NO: 89138 - DNA, 50 bp, homo sapien
aatacgtcgggttttttggtagtgaygaatcctctcagaatttgtttgtc

SEQ ID NO: 89139 - DNA, 50 bp, homo sapien
aaagcaaacacaggaaaatcaaagckaatactctgaaataaaccttggac

SEQ ID NO: 89140 - DNA, 50 bp, homo sapien
ttcagcgtttctaaactttccagaaygaaatagtctgctccagaacaaaa

SEQ ID NO: 89141 - DNA, 50 bp, homo sapien
taatactctgaaataaaccttggacmgagaaaagcaggcaaacgaacaag

SEQ ID NO: 89142 - DNA, 50 bp, homo sapien
cagaagaaaatatcatttgtattaasacctattgacaggcacaataaaaa

SEQ ID NO: 89143 - DNA, 50 bp, homo sapien
aaggaattgtttggagataagtgtcraaatctaaatttgaggactgtggt

SEQ ID NO: 89144 - DNA, 50 bp, homo sapien
catctgaatttctcttaaaaatcaakgtgacacttcagataagagatact

SEQ ID NO: 89145 - DNA, 50 bp, homo sapien
atgattctaatttaccatttaactcragattttcaggcaaatgcactgtc

SEQ ID NO: 89146 - DNA, 50 bp, homo sapien
tttgcatttgtataactgggataaaytagatgctcctaaggtttcttcca

SEQ ID NO: 89147 - DNA, 50 bp, homo sapien
gaaaagttgtaagttactaacgtaayagagccaaaaaaagaaaaaagatt

SEQ ID NO: 89148 - DNA, 50 bp, homo sapien
cgtagctgccaaagtcccagtctcasatcgaagtaagcccctaaattgga

SEQ ID NO: 89149 - DNA, 50 bp, homo sapien
acgttttcaaccctgtccagtacatyataactgtttaagatagactgact

SEQ ID NO: 89150 - DNA, 50 bp, homo sapien
caggaaaaagatcagtggttgtccaraactggggagaaggaaggactaac

SEQ ID NO: 89151 - DNA, 50 bp, homo sapien
gtactggacagggttgaaaacgtaaygaggatctgcagtccagagcttgc

SEQ ID NO: 89152 - DNA, 50 bp, homo sapien
tgagacatcttgtcagaaaacctaamaatcttacagcatcaaggaattct

SEQ ID NO: 89153 - DNA, 50 bp, homo sapien
tgtctattgccaccacagagactacrcggaaaggtcaatgacaggtttgc

SEQ ID NO: 89154 - DNA, 50 bp, homo sapien
gtggaaacatggagatcttgcatcartgaaatatagcaatttaagaaaca

SEQ ID NO: 89155 - DNA, 50 bp, homo sapien
acactattctactggtaacataacawagagcctgtcagtaattttatttt

SEQ ID NO: 89156 - DNA, 50 bp, homo sapien
agccaggaacttttataggttcttaytttattgcactgaagaaaccagtc

SEQ ID NO: 89157 - DNA, 50 bp, homo sapien
acaatactgactatcagtcaggaacycatcagcagaaaagaaatctccgt

SEQ ID NO: 89158 - DNA, 50 bp, homo sapien
aatcaatctcattatacttttccacygaatccaaacataacctcagaatt

SEQ ID NO: 89159 - DNA, 50 bp, homo sapien
gagaaaacaaacaaatttcagagtawaaaaatgaattctaaaagcataat

SEQ ID NO: 89160 - DNA, 50 bp, homo sapien
aggtagcaccactgcaccagctaaayaatcaggggccaaagtgcaggtag

SEQ ID NO: 89161 - DNA, 50 bp, homo sapien
gccagttaaacaggggcagacccacrctttccaatttctttgaaactgac

SEQ ID NO: 89162 - DNA, 50 bp, homo sapien
gtgataaattttgacagacactcaawgctgattcaattttaacagaataa

SEQ ID NO: 89163 - DNA, 50 bp, homo sapien
ataatagagctctgactggcaactaygattcccaaccatcactgcaacta

SEQ ID NO: 89164 - DNA, 50 bp, homo sapien
cagccaggaactgccagatagaatawaattcagatagatttaattcattt

SEQ ID NO: 89165 - DNA, 50 bp, homo sapien
attcaccaataaataaatcgtggcastgagtttaaatcatttggtgatag

SEQ ID NO: 89166 - DNA, 50 bp, homo sapien
aacaaatgaagaagagattcctttayttattccatattttgttggacact

SEQ ID NO: 89167 - DNA, 50 bp, homo sapien
aaacttattagatgttatgattttaycaaagagtcatggttggttcactg

SEQ ID NO: 89168 - DNA, 32 bp, homo sapien
caaatgttaccaaaaartgtagacatcataaa

SEQ ID NO: 89169 - DNA, 50 bp, homo sapien
tgaatgcgtagttatgcaaaattaaraagcaatgatactgtctattgaga

SEQ ID NO: 89170 - DNA, 50 bp, homo sapien
cagaagataactagtcctttgactaygaacccaaagtattgcattctttc

SEQ ID NO: 89171 - DNA, 50 bp, homo sapien
gccaagtcatatcatttgcataacayaatttctggaatattcttgctaat

SEQ ID NO: 89172 - DNA, 50 bp, homo sapien
gttttacctcggggctacattcaggsacctgctacatattaggtgtgcaa

SEQ ID NO: 89173 - DNA, 50 bp, homo sapien
taattagaaataaatggaaagatatrtatgcatctttgtggtcacataaa

SEQ ID NO: 89174 - DNA, 50 bp, homo sapien
agtattagttccctggtagtgggtgraaatttttgtctggctcacttacg

SEQ ID NO: 89175 - DNA, 50 bp, homo sapien
agtagtacaatagtctctttgttatyacttccatttcttagacggggaaa

SEQ ID NO: 89176 - DNA, 50 bp, homo sapien
acctctcccattcaacagatcctcaycaagtgcttaccaaaaagaatgat

SEQ ID NO: 89177 - DNA, 50 bp, homo sapien
tgccttttgttcagctgtcgcacaaygccaagaggtgaacagtgcagtgt

SEQ ID NO: 89178 - DNA, 50 bp, homo sapien
ttcaggcctttcattcggccaaagcracaattgatgtggtattttctaat

SEQ ID NO: 89179 - DNA, 50 bp, homo sapien
tcatctatacaagtggcatttttcargttctcccagatcattagcatttt

SEQ ID NO: 89180 - DNA, 50 bp, homo sapien
tatgcacataggtgtacatttcataraaggctgactagtcatttgtgttg

SEQ ID NO: 89181 - DNA, 50 bp, homo sapien
atttaacacaaaagataatcattgargtaggtcctattatcattccctct

SEQ ID NO: 89182 - DNA, 50 bp, homo sapien
aaatctagaggcaattattcaaaaastttgttagcacagcaattcctagt

SEQ ID NO: 89183 - DNA, 50 bp, homo sapien
gggagagttcacacatgtgcatctgwaagccaaactagcaaaacagactg

SEQ ID NO: 89184 - DNA, 50 bp, homo sapien
tttatttgcacttttcttgggaatakaatcaaatcttccctgccccccct

SEQ ID NO: 89185 - DNA, 50 bp, homo sapien
tagacatatactaatgttgccaaaakatatacggaaattctacacaccaa

SEQ ID NO: 89186 - DNA, 32 bp, homo sapien
ggacagaggtataaacrggtctattctatctg

SEQ ID NO: 89187 - DNA, 50 bp, homo sapien
agcaatactgtcagttcttggcttawgtgagtagctcaaagttatatgaa

SEQ ID NO: 89188 - DNA, 50 bp, homo sapien
tgtaactgagatgaaggctgggaagkagagatccatggtgtagagtttat

SEQ ID NO: 89189 - DNA, 50 bp, homo sapien
taattcccagcttcaacacttactcrctggattccatttcccaaactgca

SEQ ID NO: 89190 - DNA, 50 bp, homo sapien
aaggctcctccgtgtgctgtattcastatctcacatggagacccatctca

SEQ ID NO: 89191 - DNA, 50 bp, homo sapien
tatctttccctgaccattcaatttcygtacttccaccagagcccaacttc

SEQ ID NO: 89192 - DNA, 50 bp, homo sapien
atggaaaaataacttcaattcaataygccaaatgctaatgataaagatat

SEQ ID NO: 89193 - DNA, 50 bp, homo sapien
acaatcaataacaccaagaggtatayggatcctaatagatatgttgacta

SEQ ID NO: 89194 - DNA, 50 bp, homo sapien
aagcaaggtccactgaggtaattaamaactttgtctaatgagaagacacc

SEQ ID NO: 89195 - DNA, 50 bp, homo sapien
gtagatcaaaacttttattaccattytgtagcagaacctatattgcaaac

SEQ ID NO: 89196 - DNA, 50 bp, homo sapien
gattttcccctgtaactgcaaccacrgaccttactaagtacttcattaac

SEQ ID NO: 89197 - DNA, 50 bp, homo sapien
aagtacttcattaacaggtgttgtaygtataaatgtaaagatatgaatgt

SEQ ID NO: 89198 - DNA, 50 bp, homo sapien
gaaaaaaaatccacatataaatggaygcatgcagttgaaacccatgtttt

SEQ ID NO: 89199 - DNA, 50 bp, homo sapien
attgttgcaaatctccaaaaactttsccaatgtatttattgaaaaaaaat

SEQ ID NO: 89200 - DNA, 50 bp, homo sapien
gagagtaatacaaaagtagcttgcayctgtagagtgtgagggagggagaa

SEQ ID NO: 89201 - DNA, 50 bp, homo sapien
aggaggagcttgaggctatgaagatsataagagcattaaatgtaaggttt

SEQ ID NO: 89202 - DNA, 50 bp, homo sapien
tttatgctgagaggaagagctgtcargttaattaatctatctcttatcta

SEQ ID NO: 89203 - DNA, 50 bp, homo sapien
agaggatgtgggtcaactatttaagmaggctactttgcacctaaaagcat

SEQ ID NO: 89204 - DNA, 50 bp, homo sapien
ttcagagtcacaagttaccagtttcyaaaccagaggtaccaggtggttgt

SEQ ID NO: 89205 - DNA, 50 bp, homo sapien
catctgtgtatcatgaagttgttatsaggtaagccttacctagatagaca

SEQ ID NO: 89206 - DNA, 50 bp, homo sapien
gcatttcagtcttaacttggccaaartatgattgttgatttttcctgtgt

SEQ ID NO: 89207 - DNA, 50 bp, homo sapien
tctgacggccaatcgggtgacccaayggctgtcaaccgctagggtcaggg

SEQ ID NO: 89208 - DNA, 50 bp, homo sapien
ttcaatgagatcactacagtaacacratagctaacactcactgactgctt

SEQ ID NO: 89209 - DNA, 50 bp, homo sapien
ctggagtataaatcatagtgatttayggtatgagttctggagtcagtttg

SEQ ID NO: 89210 - DNA, 50 bp, homo sapien
catccagaatccctgcctcttgtaaygatggaaacctctgtttgagctta

SEQ ID NO: 89211 - DNA, 50 bp, homo sapien
atgactcccaccatattccctaaagwaaaggctgaatgaaactttttaga

SEQ ID NO: 89212 - DNA, 50 bp, homo sapien
tagtggttttggggaacttggtgaaygcccatgcagtttttgatacagtg

SEQ ID NO: 89213 - DNA, 50 bp, homo sapien
acctagagcctagtgaacgagccacyttttccatgaagaggtccttgatc

SEQ ID NO: 89214 - DNA, 50 bp, homo sapien
tcactttagtattatctgtaaacaaygagagaggcgatgaagggaactgc

SEQ ID NO: 89215 - DNA, 50 bp, homo sapien
ccgtaaaggttacaagaattgttaaygtggagacagatgagcaaaggaca

SEQ ID NO: 89216 - DNA, 50 bp, homo sapien
gctagctgatctattttggactccargtgacctacaaactctgttctgct

SEQ ID NO: 89217 - DNA, 50 bp, homo sapien
ttgaatgccaatacaacagacttaamaatttatctctttgatctggacct

SEQ ID NO: 89218 - DNA, 50 bp, homo sapien
gaaattaccttatgtactgtgttcartctttggttactctgtcctttaag

SEQ ID NO: 89219 - DNA, 50 bp, homo sapien
ctccactgtattttctctgtaaaacyagcatgccattgtggtgattacca

SEQ ID NO: 89220 - DNA, 50 bp, homo sapien
tctatgatgtatgaagtttagactamtagctcttaggagatgaatttgat

SEQ ID NO: 89221 - DNA, 50 bp, homo sapien
gttgacataacaactcattgcagcaratatgttacttcaacagggagcat

SEQ ID NO: 89222 - DNA, 50 bp, homo sapien
aaaatatggttgggaaatagatgtarcctgaaggatatcagtttgtggct

SEQ ID NO: 89223 - DNA, 50 bp, homo sapien
taacggtctacacacataattgtagyccaatgattacatgaattatgtaa

SEQ ID NO: 89224 - DNA, 50 bp, homo sapien
atggttgactcaaagaataaggtaartactgttttaacacatccccttta

SEQ ID NO: 89225 - DNA, 50 bp, homo sapien
cataaatgatgttatagtcatctaaracctatcacaacctgacactaaaa

SEQ ID NO: 89226 - DNA, 50 bp, homo sapien
tggcattgggtcatctcagcaaacasaattattatagtgatgactttcct

SEQ ID NO: 89227 - DNA, 50 bp, homo sapien
tttacgtggataaccctgaccaacaytggagtcttacttttcttatttgt

SEQ ID NO: 89228 - DNA, 50 bp, homo sapien
tggaacacacacaagcctgtactgaraatcacctgtgagaagccaaacag

SEQ ID NO: 89229 - DNA, 50 bp, homo sapien
attctgtgtgggatttgagaggacartaagtacaggcactggctttgctt

SEQ ID NO: 89230 - DNA, 50 bp, homo sapien
tctacctctacttagcataggaaaayggtaaggttactgataatagtttg

SEQ ID NO: 89231 - DNA, 50 bp, homo sapien
aaaatagtgatatctggggagccaaygggcagtatgacagggtgtccttc

SEQ ID NO: 89232 - DNA, 50 bp, homo sapien
aagaatgacaaagaatgcaacttacyggctggttatcagaatccaaatta

SEQ ID NO: 89233 - DNA, 50 bp, homo sapien
tttaaaatttatttagaagagatgtyacatgttgcattgagacaacagta

SEQ ID NO: 89234 - DNA, 50 bp, homo sapien
aacaaaaatttaaaaatatgtatgcyaaattgctaataattgttgaatct

SEQ ID NO: 89235 - DNA, 50 bp, homo sapien
tttctgttctgtacagtcacaaatayacgatacatcttgattcaactgta

SEQ ID NO: 89236 - DNA, 50 bp, homo sapien
tgcctggctcataccaattgctatcyatatgaaggcttgctattactaaa

SEQ ID NO: 89237 - DNA, 50 bp, homo sapien
tgttattaagtgctgtgacacagcayaattaatgtaaagaccttacaaga

SEQ ID NO: 89238 - DNA, 50 bp, homo sapien
tgaaattgtaataactgtggtctaasagccattcatgttaccataaggat

SEQ ID NO: 89239 - DNA, 50 bp, homo sapien
agcattaggcttttgatggtttgacyatggagtattagtttatgttaatt

SEQ ID NO: 89240 - DNA, 50 bp, homo sapien
tcaggtggatgaagaaacgttttctrtatttgcaccaacacccggtgcta

SEQ ID NO: 89241 - DNA, 50 bp, homo sapien
gattttatgtttcatggagattagasgtttaacaaaatgataatagggat

SEQ ID NO: 89242 - DNA, 50 bp, homo sapien
gctttataacacacaacttgatcaaygaaatattaaacatcctactgccc

SEQ ID NO: 89243 - DNA, 50 bp, homo sapien
atcacaactttagaccaactccacamaggctctgtaaaacaatcggatag

SEQ ID NO: 89244 - DNA, 50 bp, homo sapien
ttttacttctgatattctaaaacacmgctttaagatgaatcagtgtaaaa

SEQ ID NO: 89245 - DNA, 50 bp, homo sapien
tcaccacacccctcttccgaaaatamtacataagagaactcttactttac

SEQ ID NO: 89246 - DNA, 50 bp, homo sapien
ttaaaatgggaggtccaacctgttayaagaattagaattttctctgtcaa

SEQ ID NO: 89247 - DNA, 50 bp, homo sapien
cccttggcaggtaaccttgagagggratccaatacaacttagctaaattt

SEQ ID NO: 89248 - DNA, 50 bp, homo sapien
tagaaaagcaatatagaattaggacygggactgaactttgaagaattcta

SEQ ID NO: 89249 - DNA, 50 bp, homo sapien
ccatggtcaatggtagtccatcacaytagataatatagtgtcagtgccaa

SEQ ID NO: 89250 - DNA, 50 bp, homo sapien
gttttctgatgagtggcctcttatgragcttgtcccatgactgacacttc

SEQ ID NO: 89251 - DNA, 50 bp, homo sapien
taaagtgtgcaacagtcaccatttcraaaaagtacatgattggtttacat

SEQ ID NO: 89252 - DNA, 50 bp, homo sapien
agaaaagtttttttaattagttgaamctctcttgaatatcattgatggct

SEQ ID NO: 89253 - DNA, 50 bp, homo sapien
aagatgataatgaatacagaggacartaagtataagaggaaataggtgca

SEQ ID NO: 89254 - DNA, 50 bp, homo sapien
aagaagttaagaaatcatgtagaaaktggccatggtagactttttggcag

SEQ ID NO: 89255 - DNA, 50 bp, homo sapien
ctaaacaactggataactggctggayggaaacagcagagccaaggggcat

SEQ ID NO: 89256 - DNA, 50 bp, homo sapien
tctccactttacaaatgagaaaagasacacggaaactaagtaaggtaccc

SEQ ID NO: 89257 - DNA, 50 bp, homo sapien
aatactaatgacagcttaagaaacaygaattagtgctaactttaaaaaag

SEQ ID NO: 89258 - DNA, 50 bp, homo sapien
ctcaacgtctgccagatgatactccyaaaacttaggtatattttttctaa

SEQ ID NO: 89259 - DNA, 50 bp, homo sapien
tgacattttagaaggggcatggcaastgattatgcgtgatgggtcttgaa

SEQ ID NO: 89260 - DNA, 50 bp, homo sapien
ttgggaatcggaatcgggcgggcagraatacttgtctctcccctggaaga

SEQ ID NO: 89261 - DNA, 50 bp, homo sapien
tccagctgaaaagatgtattttaccyaaattgtgtaattcagaggggcta

SEQ ID NO: 89262 - DNA, 50 bp, homo sapien
cagcaagttcttccttctggaatccrccacttgggcctaaggggaggctg

SEQ ID NO: 89263 - DNA, 50 bp, homo sapien
ttgcaagtgacagaaacccactctgycacaaatagcaggagtacaggttt

SEQ ID NO: 89264 - DNA, 50 bp, homo sapien
tttgaacccagctcttcaaattagamactgtgatatgaacaaattatacc

SEQ ID NO: 89265 - DNA, 50 bp, homo sapien
tcatttctctcctgtcttgcagatascgggtcaagtgtgatggtgaggga

SEQ ID NO: 89266 - DNA, 50 bp, homo sapien
tctttctaggtatgagttagcagtcycagaatgttactggactcacaggc

SEQ ID NO: 89267 - DNA, 50 bp, homo sapien
aattcacaaaggtctgataatatccygagaaccactgtcttagaagtgta

SEQ ID NO: 89268 - DNA, 50 bp, homo sapien
ggtgttggtggttttgctgccaggaytcccctccgcttctggaaatggca

SEQ ID NO: 89269 - DNA, 50 bp, homo sapien
agtagaaaagcaaaccagtggttgaygtctataatctaaatgagaaaaca

SEQ ID NO: 89270 - DNA, 50 bp, homo sapien
aggtactgaagcttagacggctggamtaggcattagttaacaactcctat

SEQ ID NO: 89271 - DNA, 50 bp, homo sapien
tggttttctcaaaatacttcttaaartagcaatccccataatttcttcca

SEQ ID NO: 89272 - DNA, 50 bp, homo sapien
tgggaaaaacaattatggctaagaamaattaagtccactggtagaaagat

SEQ ID NO: 89273 - DNA, 50 bp, homo sapien
accacaggtcagtcaagcttagttamatttgagtattcaagagttttgtt

SEQ ID NO: 89274 - DNA, 50 bp, homo sapien
agcatcactggattgattctagttaygttcactggagctatattgagtct

SEQ ID NO: 89275 - DNA, 50 bp, homo sapien
gaggaggaagatgcagaataggcacraaaggagtagaaaaaactagaaga

SEQ ID NO: 89276 - DNA, 50 bp, homo sapien
gagttaatggagcataatctcatttrcaatctctgagaaccacatagatt

SEQ ID NO: 89277 - DNA, 50 bp, homo sapien
gagtagaatgagctaggagtcttaascagttgcggatagaatgtgttgct

SEQ ID NO: 89278 - DNA, 50 bp, homo sapien
taatatgatatcactcccggcaaggwtcttaaacagatttgttaaggaca

SEQ ID NO: 89279 - DNA, 50 bp, homo sapien
tcccctcttgacccttacactggcaytaaggaatacaaaagctgaggaag

SEQ ID NO: 89280 - DNA, 50 bp, homo sapien
aaagtcttctcacatacttaacatcrgaaaggcaatccagaacctcccat

SEQ ID NO: 89281 - DNA, 50 bp, homo sapien
gaagagaaaggccactttcaaagagrcaataaatctgccagcattttggc

SEQ ID NO: 89282 - DNA, 50 bp, homo sapien
tatgtatagatttaacattattccartaaaaatctcagagggattattga

SEQ ID NO: 89283 - DNA, 50 bp, homo sapien
gttaagtatgtgagaagactttgaamgtgtttgtgtgagagggagctatg

SEQ ID NO: 89284 - DNA, 50 bp, homo sapien
tgctatcttaatgttctgtctgctasgaaagtgaacaaaacttgattgtt

SEQ ID NO: 89285 - DNA, 50 bp, homo sapien
atcatttctctgtgttttattaaagycaaagtcatatcatggcttcagaa

SEQ ID NO: 89286 - DNA, 50 bp, homo sapien
caaacttatctctccttaattatgcrgagtaatttagagagcatcctgcc

SEQ ID NO: 89287 - DNA, 50 bp, homo sapien
tataatgtgtttttaatgctacaacygattaaacctctttcttaatgtat

SEQ ID NO: 89288 - DNA, 50 bp, homo sapien
ataatggaaagaaaactgaagtctaygttggaaaacctttgtcctaatcc

SEQ ID NO: 89289 - DNA, 50 bp, homo sapien
tatgttagagacccctttcaggagayggaagcaggtataggaaaacaaaa

SEQ ID NO: 89290 - DNA, 50 bp, homo sapien
cttctattttatacctgtgacttcasgaatcagctttattcatgtcatgc

SEQ ID NO: 89291 - DNA, 50 bp, homo sapien
cattaagttgaaataaaatccagaartaagtaagctattgtttagaaact

SEQ ID NO: 89292 - DNA, 50 bp, homo sapien
attttctgcactgaatgaataaagaygaaaggatgagtttgcaaaatcat

SEQ ID NO: 89293 - DNA, 50 bp, homo sapien
aagagacaaagatgcatagtataaaygagaaataaatcacacacattctg

SEQ ID NO: 89294 - DNA, 50 bp, homo sapien
gaaatgtgttgtataaacgtacagcrctattattaaaagtcttaaggctt

SEQ ID NO: 89295 - DNA, 50 bp, homo sapien
atagtttagtcagggagcaatcaagrcatggtaataggttctacggcctg

SEQ ID NO: 89296 - DNA, 50 bp, homo sapien
cataaagctttttacccataataaastcattagcatagaacagcgatatt

SEQ ID NO: 89297 - DNA, 50 bp, homo sapien
ttctcccgccatgaacccttaaacaytcttagtctgtaagagagaatgct

SEQ ID NO: 89298 - DNA, 50 bp, homo sapien
gaaatagtccattctcatttatctascttaggttatgggctcttctttta

SEQ ID NO: 89299 - DNA, 50 bp, homo sapien
ggaaatcatttaacattcctgaaccrcaattcccttctttatttaaaaaa

SEQ ID NO: 89300 - DNA, 50 bp, homo sapien
gagaaaaagaaaagattatgcaggartaagatcagttagagtaagcagat

SEQ ID NO: 89301 - DNA, 50 bp, homo sapien
atttgatgctctttaagtgacctggrataacagagaggtcaacaaataat

SEQ ID NO: 89302 - DNA, 50 bp, homo sapien
aagaaaatgaaaatatatagactaaygtaagattaataatgctttttttt

SEQ ID NO: 89303 - DNA, 50 bp, homo sapien
gttgctggatgtcgcatccctatcgyatttgcatgcatgtcagaggtatc

SEQ ID NO: 89304 - DNA, 50 bp, homo sapien
ccacaataaaataaccaactcaacartggaagttacagttttgaagaatg

SEQ ID NO: 89305 - DNA, 50 bp, homo sapien
aaatacaaaatcttccttggagaackatttcagttgttttatgacacctt

SEQ ID NO: 89306 - DNA, 50 bp, homo sapien
atattgtccttccctgtgagttagarattatctccattttacaaatagaa

SEQ ID NO: 89307 - DNA, 50 bp, homo sapien
gtatctggtgcttaagaatgttttasctagcagcctggtaacacaagaag

SEQ ID NO: 89308 - DNA, 50 bp, homo sapien
gctaagtggaaaacaaagataaatcraagttagttaatcacttttttaaa

SEQ ID NO: 89309 - DNA, 50 bp, homo sapien
tggatagagtttcgagtcagattccraacaggacctctgggctttaaatg

SEQ ID NO: 89310 - DNA, 50 bp, homo sapien
catatggaactcataactggtcaacrtatccatcactccatttgtgattt

SEQ ID NO: 89311 - DNA, 50 bp, homo sapien
ctgttgaacagactacttcagaataytaaatcccagagatgctggccaca

SEQ ID NO: 89312 - DNA, 50 bp, homo sapien
agcccttcctgaaattcccatgcaamctcagatctaagaggaggcagcag

SEQ ID NO: 89313 - DNA, 50 bp, homo sapien
aaacaggtctgaatatgtatctgcakaataaaaacaagggacagagagtt

SEQ ID NO: 89314 - DNA, 50 bp, homo sapien
gaagaataacattccaggaagcagaytgtggacttagttgtcctgtgtct

SEQ ID NO: 89315 - DNA, 50 bp, homo sapien
tatcgatctgatacctgtttggtgckaaagtacaaaattctaaaacacct

SEQ ID NO: 89316 - DNA, 50 bp, homo sapien
atacaacagtgggttagccttccgaygtgaagatggcctcccaggctgtc

SEQ ID NO: 89317 - DNA, 50 bp, homo sapien
ctctttcatcctttctcattcattgwatacatcctttttgacaaacagga

SEQ ID NO: 89318 - DNA, 50 bp, homo sapien
taatgatttggcagaatctcccaaaygcttttggtctgagcttctcagct

SEQ ID NO: 89319 - DNA, 50 bp, homo sapien
agagttgcccggtttcctatgggacwatatgtgcttttggaggaagcaag

SEQ ID NO: 89320 - DNA, 50 bp, homo sapien
gggaacctgttccaattacaaattcmcaggctttacacaaactgactaag

SEQ ID NO: 89321 - DNA, 50 bp, homo sapien
agcatttgggagattctgccaaatcrttagctctctcttccccttgattt

SEQ ID NO: 89322 - DNA, 50 bp, homo sapien
tccttaaaaaaataaaatcagcaaaygaggtatagaaggaaactttttaa

SEQ ID NO: 89323 - DNA, 50 bp, homo sapien
gtaattcaatggcttttaatacagtyacagatctgtacaaattttaccac

SEQ ID NO: 89324 - DNA, 50 bp, homo sapien
gttgatattatgaccatctttcaaaygcttcagggcaatgcaaatgtttc

SEQ ID NO: 89325 - DNA, 50 bp, homo sapien
gccaatggcacattgggagctgatayctcacccttgctctgcttttgaag

SEQ ID NO: 89326 - DNA, 50 bp, homo sapien
agcatttgcaaaatgttgctaggcayctgtatctctttgatatctcttgg

SEQ ID NO: 89327 - DNA, 50 bp, homo sapien
tcagatatccctaaataagaaaggastcataatcattgcaatacatagtt

SEQ ID NO: 89328 - DNA, 50 bp, homo sapien
tttaaactgtacaaattctatgttgycatactcccataacgtgttctaaa

SEQ ID NO: 89329 - DNA, 50 bp, homo sapien
caatccttagtttcctgatctgtgaygtaggaataacaaaacacctattt

SEQ ID NO: 89330 - DNA, 50 bp, homo sapien
tggccaaacactttggatctacagaracttcagagatgagaaattagcaa

SEQ ID NO: 89331 - DNA, 50 bp, homo sapien
agaatcattattctggctctcctgcraagaatattgttggagaataagac

SEQ ID NO: 89332 - DNA, 50 bp, homo sapien
ataccagtgggaaagctgagccttayagaggttaaatcaccttccaaagg

SEQ ID NO: 89333 - DNA, 50 bp, homo sapien
caaaggagagtttcagaggagcattraagtaggaacatccctgcatttat

SEQ ID NO: 89334 - DNA, 50 bp, homo sapien
tgaacctacttgagaagctgaaggaktcacaccagggctcaggggagagg

SEQ ID NO: 89335 - DNA, 50 bp, homo sapien
cagggcttactgtgatgctgaggatygaaaacagaactaacagagatcta

SEQ ID NO: 89336 - DNA, 50 bp, homo sapien
atcctgtctctctcgaaactcccacrtgtccttcttttctggatcccttc

SEQ ID NO: 89337 - DNA, 50 bp, homo sapien
gttaatgcgttttccatctacaaccrcttttttgtcctatcattcaacta

SEQ ID NO: 89338 - DNA, 50 bp, homo sapien
cagctagaaagatacctggctcaatmcattactggaaagagtgctgtatt

SEQ ID NO: 89339 - DNA, 50 bp, homo sapien
cgacccttcccttgggttatggctcrctaaatcaagcatcagatgaacgc

SEQ ID NO: 89340 - DNA, 50 bp, homo sapien
ggtactcccctgaagatacaatcagyacggccttcactatggccagagtg

SEQ ID NO: 89341 - DNA, 50 bp, homo sapien
tctggaatggatctgccattaacacrctttctgattaaacaatgactttt

SEQ ID NO: 89342 - DNA, 50 bp, homo sapien
cagttttcttattgtttaagaggaaratgaaattcagagaagaaaagtca

SEQ ID NO: 89343 - DNA, 50 bp, homo sapien
ggaaaatgtggagatattaattttcsaagtccatgtcaatttaaaacaat

SEQ ID NO: 89344 - DNA, 50 bp, homo sapien
ggacttacatgttaagttattgcacrtgagataaagatgattaactgaag

SEQ ID NO: 89345 - DNA, 50 bp, homo sapien
tagatgtcactaacaatgtatctagkccagtggcacatggctctttgaaa

SEQ ID NO: 89346 - DNA, 50 bp, homo sapien
gtagattcatgggggcatcgaggtarcacaaacgttgccctaaagtacac

SEQ ID NO: 89347 - DNA, 50 bp, homo sapien
ttgacatcccattcctctcttctatmaaatgggataacaactatatatta

SEQ ID NO: 89348 - DNA, 50 bp, homo sapien
accccacagtctaattggctggcaartcttgttgtatctattttctgtct

SEQ ID NO: 89349 - DNA, 50 bp, homo sapien
ggccctggtaattcaactttaataayctattggtgcctttctccctttac

SEQ ID NO: 89350 - DNA, 50 bp, homo sapien
gactaggccttcgagacgccttccarggtgtagagtggtagttttcaaca

SEQ ID NO: 89351 - DNA, 50 bp, homo sapien
gaattattatggccacctttttcaayctgctaagtgttcaataaatctca

SEQ ID NO: 89352 - DNA, 50 bp, homo sapien
caacagttctctatattttagtgacygaacgtgaagaaaagtttcatttc

SEQ ID NO: 89353 - DNA, 50 bp, homo sapien
gtttattttctattacttgctatagrcattattatccttgctactagact

SEQ ID NO: 89354 - DNA, 50 bp, homo sapien
acatcctgattcatcctgaaaaccarcctgatctacttacgaacctagag

SEQ ID NO: 89355 - DNA, 50 bp, homo sapien
atcaaatcagtattaatactcttgayggaatttgtgtaagtaatgaattt

SEQ ID NO: 89356 - DNA, 50 bp, homo sapien
atcaaattgaattcacttgatctcaytatactatcccaggacataaaagt

SEQ ID NO: 89357 - DNA, 50 bp, homo sapien
gaatgtttctgcacttcatctccaakaataagtctcatttgtcttgacta

SEQ ID NO: 89358 - DNA, 50 bp, homo sapien
gatcattaacattatagactcttaayggacacttattgtcaaatgttctt

SEQ ID NO: 89359 - DNA, 50 bp, homo sapien
tatatatacatgagaggagtcataartatttttgtaagaaccagtccagg

SEQ ID NO: 89360 - DNA, 50 bp, homo sapien
actctgttcttggccctaggacctawcaatcaagatttcagttcttgtta

SEQ ID NO: 89361 - DNA, 50 bp, homo sapien
gatgaggatgtggatacattggaacycttgcgcaccgttggtggaaatgt

SEQ ID NO: 89362 - DNA, 50 bp, homo sapien
gcaaggagaaccttatggattagaarcaggtaattagtgtgtccatttgt

SEQ ID NO: 89363 - DNA, 50 bp, homo sapien
gcacgatggcttgaatttctcttccygggtgcgattccttccacatcgtg

SEQ ID NO: 89364 - DNA, 50 bp, homo sapien
tgacgggtataagtcacgtcgtacayggccttgcatgggacatccagtga

SEQ ID NO: 89365 - DNA, 50 bp, homo sapien
caggaatggacaaggtgcattcctgragatggattcatggctagtgaaaa

SEQ ID NO: 89366 - DNA, 50 bp, homo sapien
tgggattcacacccataactaagaargtctgccctgaataaaatccactc

SEQ ID NO: 89367 - DNA, 50 bp, homo sapien
tcaagctggcccagaatttgttctayatcagtgtggcaaacaatacagca

SEQ ID NO: 89368 - DNA, 50 bp, homo sapien
cttcggatcaagttgagactagctgrtacagttaagcctaagtttctttt

SEQ ID NO: 89369 - DNA, 50 bp, homo sapien
cacctttattaaatacatggtatagygccaacattcgaagtacaatatgt

SEQ ID NO: 89370 - DNA, 50 bp, homo sapien
taacagttgtaaggagtatacattgsacttgatgtctattgtatccaaag

SEQ ID NO: 89371 - DNA, 50 bp, homo sapien
gggctcagttttatttcaaacaagayagaatgcttacatatttttatgcc

SEQ ID NO: 89372 - DNA, 50 bp, homo sapien
agaaggctgttgtgcccaagtgctcrctagtccagagactgagaaactaa

SEQ ID NO: 89373 - DNA, 50 bp, homo sapien
taaataccatatttttttaaatcagwagatcatacttcccccactccttt

SEQ ID NO: 89374 - DNA, 50 bp, homo sapien
agacccactggggtaggggctgacayatacacaaataagactggggtcac

SEQ ID NO: 89375 - DNA, 50 bp, homo sapien
acctataacaggttgttgcaaaaatwcatgagattatatgtacatataaa

SEQ ID NO: 89376 - DNA, 50 bp, homo sapien
ttggattccatcaatccttggataakggccagaactactgttataaaact

SEQ ID NO: 89377 - DNA, 50 bp, homo sapien
aaaactatgttaataagatgctacartacagatccccaacgccagttcaa

SEQ ID NO: 89378 - DNA, 50 bp, homo sapien
tctacttatgctgattgagcagaaasaaaattaccacagagaattaggta

SEQ ID NO: 89379 - DNA, 50 bp, homo sapien
tctgttttggtaaatcaagcaaataygtgaatgttttatcatttcccctt

SEQ ID NO: 89380 - DNA, 50 bp, homo sapien
gtcctcacataacagattgagacagwaagagagaatgggaatcttcctct

SEQ ID NO: 89381 - DNA, 50 bp, homo sapien
gaaatatttcatatctttcgggtaartgattcttctctaaagctctgttc

SEQ ID NO: 89382 - DNA, 50 bp, homo sapien
ccctcccagaacctcactttgacaaygtggctcactaattgctactgggt

SEQ ID NO: 89383 - DNA, 50 bp, homo sapien
acttctgcttaactattgctctaagycaactttaatggagggtggagctc

SEQ ID NO: 89384 - DNA, 50 bp, homo sapien
aacagctcctttctcagctataaggwcaatctgtaacttgaatgtttact

SEQ ID NO: 89385 - DNA, 50 bp, homo sapien
ctcgagtaagatttcaagacacctaragcaacgttctacccataggaggt

SEQ ID NO: 89386 - DNA, 50 bp, homo sapien
ttcactctgattggtgactcttgggkaatattaatcacagagatattgag

SEQ ID NO: 89387 - DNA, 32 bp, homo sapien
tatgtttattagaggtytagcagaaagtggaa

SEQ ID NO: 89388 - DNA, 50 bp, homo sapien
ttaattttttattattggcatatatwaagcccctttgaagctggaaaata

SEQ ID NO: 89389 - DNA, 50 bp, homo sapien
gtgtgactattgcttttgatctgatkagagtaactgccatttgcatattc

SEQ ID NO: 89390 - DNA, 50 bp, homo sapien
taagtaaagcacaatgtggaaaaatwatttaccaggatttgttaaatatc

SEQ ID NO: 89391 - DNA, 50 bp, homo sapien
cctgaatcccagctccagttccaaasgttgcttactaaacttcatcctca

SEQ ID NO: 89392 - DNA, 50 bp, homo sapien
agatcatatatttaaaattgtgggaygtgataggaactcaacagatatta

SEQ ID NO: 89393 - DNA, 50 bp, homo sapien
caccgtgaccctgcaataccacttcratgcatactgtagaagtatttgca

SEQ ID NO: 89394 - DNA, 50 bp, homo sapien
agtcaaaatctagagttaatgtcaartgagaggaatatacaacaaatgtt

SEQ ID NO: 89395 - DNA, 50 bp, homo sapien
gacaaaagcagttcaacggagtttgrgacaaaagctagactttaacaaga

SEQ ID NO: 89396 - DNA, 50 bp, homo sapien
agactttaacaagatgagggtgaatrgaaatgaagaactggagacatgtt

SEQ ID NO: 89397 - DNA, 50 bp, homo sapien
ttggcgataaataaactgtggcttawattaactcaaatacaaagaaaatg

SEQ ID NO: 89398 - DNA, 50 bp, homo sapien
aaggaaacttccccttagctttcaasgtcctctggtctgtctcctttgag

SEQ ID NO: 89399 - DNA, 50 bp, homo sapien
atcccctgtatagctgaaactcccgrattggaagtggcagagccatctct

SEQ ID NO: 89400 - DNA, 50 bp, homo sapien
ttgtttcctaattttcctcatttcarctttcacactgtgctatactgtat

SEQ ID NO: 89401 - DNA, 50 bp, homo sapien
atcattccacgtctccattctcttarcccaatgtcagctgcatccaaggc

SEQ ID NO: 89402 - DNA, 50 bp, homo sapien
atgtgttcaggtcttaacctctcaayatcactcatgagtgactcagggaa

SEQ ID NO: 89403 - DNA, 50 bp, homo sapien
aaggaaaataaatgccaggggttagyacacctcaaatcaacagggaaatc

SEQ ID NO: 89404 - DNA, 50 bp, homo sapien
tctgtatcatattgccagttatcaayagggttatggcaggtatgcaccaa

SEQ ID NO: 89405 - DNA, 50 bp, homo sapien
cccattccttcccatggaaattacartaaaagctctcgcccccattttcc

SEQ ID NO: 89406 - DNA, 50 bp, homo sapien
gaaacaatgttaatgctgaacattasgagaagggttcagtaagttatgtt

SEQ ID NO: 89407 - DNA, 50 bp, homo sapien
ttgagtgagaatactgaagataagayaattgaatgtgagtcagccagcgg

SEQ ID NO: 89408 - DNA, 50 bp, homo sapien
tttgaagttgtgaaaccacaatcacrattaagatatgcacaaaaaattcc

SEQ ID NO: 89409 - DNA, 50 bp, homo sapien
cactggaggaagtgattaagaaacayttctgccaccctccatccctactg

SEQ ID NO: 89410 - DNA, 50 bp, homo sapien
tcagatgttcaccacctggtaaatamactgtcaaatagctatacaataaa

SEQ ID NO: 89411 - DNA, 50 bp, homo sapien
aagcaagcattataggagaggattayagccattgaggaaaacagaaattg

SEQ ID NO: 89412 - DNA, 50 bp, homo sapien
ttcagtatcatccatattgttcctayattagcagttaatgtatcttaact

SEQ ID NO: 89413 - DNA, 50 bp, homo sapien
aaaacaaactagaatatatgagcaamtgaatccaagtatatacaatatat

SEQ ID NO: 89414 - DNA, 50 bp, homo sapien
atttaacaccagaaagcctacaatgraagagctactaaaagaaacaataa

SEQ ID NO: 89415 - DNA, 50 bp, homo sapien
caaagtctgcgcctctgactagccayatcagtatcattttaataaatttc

SEQ ID NO: 89416 - DNA, 50 bp, homo sapien
aaaaaaataaaaattataaagtttayactgagacaagtaaatttttagtg

SEQ ID NO: 89417 - DNA, 50 bp, homo sapien
gaatttgtctataactgttccacacmatgttcaaataatgaattccttgt

SEQ ID NO: 89418 - DNA, 50 bp, homo sapien
ataaagcaatcttcagggcattttgrtaaataaaggaaagcacaataact

SEQ ID NO: 89419 - DNA, 50 bp, homo sapien
tcaatccatgcacatgcttgccctasagaagtctcttatattaaagttca

SEQ ID NO: 89420 - DNA, 50 bp, homo sapien
gacaggtttcctggagcctgattcayactgtgcccttgtttaagactcat

SEQ ID NO: 89421 - DNA, 50 bp, homo sapien
cactgtgaaatgtagttctctagtamgttcttcagacttggctgcttctg

SEQ ID NO: 89422 - DNA, 50 bp, homo sapien
ggaacaagctggctcacagattaaarcgacagtctccaaagagctttgtc

SEQ ID NO: 89423 - DNA, 50 bp, homo sapien
taaatcaggccttcattctaactcaygattttgtgttttgttttgttttt

SEQ ID NO: 89424 - DNA, 50 bp, homo sapien
agtgctgtttggatcgtcatagaaaytatccttgggaagtgcatactctt

SEQ ID NO: 89425 - DNA, 50 bp, homo sapien
taacttactttccctctttctatgarcaatggcaaataatctgtatggtt

SEQ ID NO: 89426 - DNA, 50 bp, homo sapien
aaaatgttttaatataatgggtctaygctacataataaatgttttaaagg

SEQ ID NO: 89427 - DNA, 50 bp, homo sapien
cccataaggaaaaacatgcaatacasatggctcaaatgaaagattttaag

SEQ ID NO: 89428 - DNA, 50 bp, homo sapien
accttaatgggacatggttacctacrtatcagtttttcctcctatctgca

SEQ ID NO: 89429 - DNA, 50 bp, homo sapien
ggtcccagaccacaatgaagcaagtyacacgaattttgttggtttcccag

SEQ ID NO: 89430 - DNA, 50 bp, homo sapien
cagaatccaaacccaaatgaaacaaygagtaacaggaagaaggagcctat

SEQ ID NO: 89431 - DNA, 50 bp, homo sapien
gtaggtacctttcttcaggttatgtsagtttatttggaagcaatcaagtg

SEQ ID NO: 89432 - DNA, 50 bp, homo sapien
tgcctctttcagactgaagtttagcsaaatctatgaaaaaagagcttgct

SEQ ID NO: 89433 - DNA, 50 bp, homo sapien
acttcagagagattccctgaattcascacctgtgagaagttatttatctc

SEQ ID NO: 89434 - DNA, 50 bp, homo sapien
aatctatgaaaaaagagcttgctaarccaactaattatcagtacaaataa

SEQ ID NO: 89435 - DNA, 50 bp, homo sapien
tgagtgccttcataagtgctctaggrcataaccaataagcagccattacg

SEQ ID NO: 89436 - DNA, 50 bp, homo sapien
aacatcctctctttctccaactcagracagacgtaatggctgcttattgg

SEQ ID NO: 89437 - DNA, 50 bp, homo sapien
ctctcagttgctcacggaattcttarcctatgcactgttatttccattgc

SEQ ID NO: 89438 - DNA, 50 bp, homo sapien
agtacctgcctgacattcctttatarcatgcatacattctacttacccag

SEQ ID NO: 89439 - DNA, 50 bp, homo sapien
gaatggcctaatagaaaaaaaaagarctttgagatattgcccaacaaaga

SEQ ID NO: 89440 - DNA, 50 bp, homo sapien
catttctttatatctaacccacagaytaagctctattctgggtgctgtga

SEQ ID NO: 89441 - DNA, 50 bp, homo sapien
tgcctttccattacacacaataaaawcctaagtctactgtggcccataat

SEQ ID NO: 89442 - DNA, 50 bp, homo sapien
cagagtccatttttcctcctcctgawcctgaaactgtattcatcaggaaa

SEQ ID NO: 89443 - DNA, 50 bp, homo sapien
cagcactgtgctcaggactttgctckcattactattaccccttacataag

SEQ ID NO: 89444 - DNA, 50 bp, homo sapien
ggatttatgactaaatccaattatartccatttctcataccctaaaaatg

SEQ ID NO: 89445 - DNA, 50 bp, homo sapien
gttagagctaaacaaaaatgaaaaasttgtgattctgtaggttgctggct

SEQ ID NO: 89446 - DNA, 50 bp, homo sapien
gggtctaagttattttcccagggtargcaccagaatctgggttcgagtga

SEQ ID NO: 89447 - DNA, 50 bp, homo sapien
gaaactaattgttaactacttgacayctgagcatcaaaaattgcaagcaa

SEQ ID NO: 89448 - DNA, 50 bp, homo sapien
atggctagagaagcatgaacaaccartgagaaaataccagcgtgtataca

SEQ ID NO: 89449 - DNA, 50 bp, homo sapien
aacctctctaatttgatgatcactcraacccagattctggtgcttaccct

SEQ ID NO: 89450 - DNA, 50 bp, homo sapien
tattgagaatacacaaagaaaattaygtgccttctaaaactctggtataa

SEQ ID NO: 89451 - DNA, 50 bp, homo sapien
tagacacttcatgtaagaggaatcayatacatatacccttttgtacctgg

SEQ ID NO: 89452 - DNA, 50 bp, homo sapien
ctgtccaaccttgtctggtatttcayctctatttctaacagtggctcttg

SEQ ID NO: 89453 - DNA, 50 bp, homo sapien
caaagctaaagtaagagaaatgcaaragccactgttagaaatagagatga

SEQ ID NO: 89454 - DNA, 50 bp, homo sapien
ctctagagtggaagaaagtagcacayaagttcagataacagagcatttcc

SEQ ID NO: 89455 - DNA, 50 bp, homo sapien
taaacaatagtcttactacatcacaraactgacgcagctccaatatctcc

SEQ ID NO: 89456 - DNA, 50 bp, homo sapien
taaaattaattacacctgtatctttyttgctttgtagacaatttcaaatt

SEQ ID NO: 89457 - DNA, 50 bp, homo sapien
aaaagaaactttatgtggtggtcagraaaagacatacctatatacgtgat

SEQ ID NO: 89458 - DNA, 50 bp, homo sapien
ttaggagttattcaacaagccattaygcttacaaaaatttatgagtcaaa

SEQ ID NO: 89459 - DNA, 50 bp, homo sapien
tttaaagtattgactcactaatcttyaaattggtagaaggaggtcagtag

SEQ ID NO: 89460 - DNA, 50 bp, homo sapien
gttgctctttatgagacgaaataaarttggatgtcacttataaatggatt

SEQ ID NO: 89461 - DNA, 50 bp, homo sapien
agctataagaaaagaccatgtacacrcatatggttttaggacagagagtg

SEQ ID NO: 89462 - DNA, 50 bp, homo sapien
ttacgttacagtttactatgtatgcrgaaacttttaggccaaatttaaga

SEQ ID NO: 89463 - DNA, 50 bp, homo sapien
tagataaaaatatacttcacttccakattacactcagagacaaccaaagg

SEQ ID NO: 89464 - DNA, 50 bp, homo sapien
attttgttgctaagtcattttttatragtcattgcaaattcttttggaaa

SEQ ID NO: 89465 - DNA, 50 bp, homo sapien
cagactagcatgcacatcctataaakcctaacgaggtcaaaggactggtg

SEQ ID NO: 89466 - DNA, 50 bp, homo sapien
ctgagtctttaatggtgctatgaaasgaaaaacggcaaagttacatataa

SEQ ID NO: 89467 - DNA, 50 bp, homo sapien
ctaaataattagtagaaaacatacaygaatagcctatcttccaatgacga

SEQ ID NO: 89468 - DNA, 50 bp, homo sapien
ctgatcacactttaaatttattaccrcaaacctccagtgggccttccgag

SEQ ID NO: 89469 - DNA, 50 bp, homo sapien
ctgagaatctcttgctcctttaccasgctgtaggaatttggaaagacaga

SEQ ID NO: 89470 - DNA, 50 bp, homo sapien
aagaagaatggatttgcctttcaaamaaatgatacacgagagactgaggc

SEQ ID NO: 89471 - DNA, 50 bp, homo sapien
aaaaatggagtagtctgagtgatatsaaaagacataattaagaaaattag

SEQ ID NO: 89472 - DNA, 50 bp, homo sapien
aactactttagaaatcttctacaaaytcaattaccttatcttaccttttg

SEQ ID NO: 89473 - DNA, 50 bp, homo sapien
ggctcggtttgagagcagattgaagragccacttatggccaatgagaggc

SEQ ID NO: 89474 - DNA, 50 bp, homo sapien
aatcccttctaactagagagccatgsaagtacattttcacaatatcagat

SEQ ID NO: 89475 - DNA, 50 bp, homo sapien
ccagtgaaaagtgagagaaatattaygtgtcagtccactaaaaagctcta

SEQ ID NO: 89476 - DNA, 50 bp, homo sapien
atctatctctttaccactttatcacygctcctccttgtactttgacattg

SEQ ID NO: 89477 - DNA, 50 bp, homo sapien
tttcttgtggataaaacatatgcacragaaatttacacacttttattttt

SEQ ID NO: 89478 - DNA, 50 bp, homo sapien
aagagaataggcaccatgataaaatragcaaaaagaatcttggaactaga

SEQ ID NO: 89479 - DNA, 50 bp, homo sapien
cgacagagaaactacgaaatccaaaygcagggagagtggccttttaggaa

SEQ ID NO: 89480 - DNA, 50 bp, homo sapien
gccctacacaatttggaccatattcwtcttcatctttatttccttctact

SEQ ID NO: 89481 - DNA, 50 bp, homo sapien
agggtaaacaataggtgtttaataargtttgtaatgcagatttaagtcag

SEQ ID NO: 89482 - DNA, 50 bp, homo sapien
tattgattaaaacattctcccaggcsattctaacgtatggtcgggaatgg

SEQ ID NO: 89483 - DNA, 50 bp, homo sapien
gtaatggcatctcattgttatcttayattgcattctcctgaaaactaatg

SEQ ID NO: 89484 - DNA, 50 bp, homo sapien
gcccagtccagcccagaacagcccakgcttggaatattacttatattatt

SEQ ID NO: 89485 - DNA, 50 bp, homo sapien
tactttatggatggatatgattcaawttaagactgccaactgaaaaacca

SEQ ID NO: 89486 - DNA, 50 bp, homo sapien
ccagctgacttcaatttgattgtgcmaaatcagtaatgcttgtgaattaa

SEQ ID NO: 89487 - DNA, 50 bp, homo sapien
ttggggtgtgaaaagtaagaactcakaaaaagcttcatggagaaaatagt

SEQ ID NO: 89488 - DNA, 50 bp, homo sapien
gtgaattaatgtaaattatttattgraattctcatgccatgccttcagcc

SEQ ID NO: 89489 - DNA, 50 bp, homo sapien
agtactaccacatttgatcttgaaayaagcctgaactctttaaaagcaaa

SEQ ID NO: 89490 - DNA, 50 bp, homo sapien
aattgaaggatttggtgagaaaaggratggagctgttatagtcatccagc

SEQ ID NO: 89491 - DNA, 50 bp, homo sapien
agagggagtgcctatcggaggaagakatgaacacgtggcatttattcact

SEQ ID NO: 89492 - DNA, 50 bp, homo sapien
gttcccagtctaggggacatagaaamggtaatgccatgatcagagatagt

SEQ ID NO: 89493 - DNA, 50 bp, homo sapien
agaaattccaagacataattaataayacattggtacttctatccattagt

SEQ ID NO: 89494 - DNA, 50 bp, homo sapien
ttcttctgtgaatccacagccagctyagaatgaggccaactggatcccca

SEQ ID NO: 89495 - DNA, 50 bp, homo sapien
cgctcttaagtatgttttcttggtcmgggttgttgtcttagttaaggtta

SEQ ID NO: 89496 - DNA, 50 bp, homo sapien
tagaaacagcacttggattttaaaamcttttcacctatatagatggtttc

SEQ ID NO: 89497 - DNA, 50 bp, homo sapien
catttgatttgactatatgactagayatttacattttttttttttttttg

SEQ ID NO: 89498 - DNA, 50 bp, homo sapien
gaagtaggcattttcagaagaacackagagtaagagtaaagtccatattc

SEQ ID NO: 89499 - DNA, 50 bp, homo sapien
gtgggcctttctttctacacctcaamtctgaaatacacatacacacctac

SEQ ID NO: 89500 - DNA, 50 bp, homo sapien
gacttgcatctaaaacaatggcttawctacatatgggcaactcattggct

SEQ ID NO: 89501 - DNA, 50 bp, homo sapien
gggcaggattaaaccttaacttgcckcggtggagtttttctttaagggag

SEQ ID NO: 89502 - DNA, 50 bp, homo sapien
agtatagaaatagctcacaagacaaygataggaccaggatgggaatttct

SEQ ID NO: 89503 - DNA, 50 bp, homo sapien
gtgctcaatatataactgctggataratagatctagttctattttttgaa

SEQ ID NO: 89504 - DNA, 50 bp, homo sapien
cttgtctctgatcctctgttttaaaycttcccactgttcttgcgccattg

SEQ ID NO: 89505 - DNA, 50 bp, homo sapien
caccagactccacatgtttttaaacygtaaacttgatcttgtctctgatc

SEQ ID NO: 89506 - DNA, 50 bp, homo sapien
tgtgggtctatcttttcacacctaartggcccctcatgagattttgttaa

SEQ ID NO: 89507 - DNA, 50 bp, homo sapien
gtgacaaggtatttttacacataaayagcaagtcacgatattatatttcc

SEQ ID NO: 89508 - DNA, 50 bp, homo sapien
tatactacagaaaatccagcaggtaraaagtcacatcaggcagggataat

SEQ ID NO: 89509 - DNA, 50 bp, homo sapien
gattttctgtagtatacattgtctgrattatacatttatcttttattaca

SEQ ID NO: 89510 - DNA, 50 bp, homo sapien
gtaatggaggaatataggaagaaaawagatataagatgcagaaaataaat

SEQ ID NO: 89511 - DNA, 50 bp, homo sapien
caactgtttttcttttccagagatawaatgatgttttaataattccaagt

SEQ ID NO: 89512 - DNA, 50 bp, homo sapien
gatttgtagaagcatgaaggacaaaygattagttccacagaatgagatga

SEQ ID NO: 89513 - DNA, 50 bp, homo sapien
gattcttaatatagctgtttttccamgaggatttcatgtcttattattgt

SEQ ID NO: 89514 - DNA, 50 bp, homo sapien
gttccattttggacatgttatttgarcagccctgaactcagactataaaa

SEQ ID NO: 89515 - DNA, 50 bp, homo sapien
tgaaagcaacctaatttttgtgagasatatggattttagtagtgacatat

SEQ ID NO: 89516 - DNA, 50 bp, homo sapien
agtatggtcactggttagcttctgtkaaacctatatagttgcctactatt

SEQ ID NO: 89517 - DNA, 50 bp, homo sapien
cttcataaatgtaactatcaagcackttcatgaggagttacctgggagtt

SEQ ID NO: 89518 - DNA, 50 bp, homo sapien
agtgaagtctcatcatctgaatacaytgatataagaatggatgatactta

SEQ ID NO: 89519 - DNA, 50 bp, homo sapien
tggctgccagttgagatgtctatgcrctcctgatttaccttgtcacaatt

SEQ ID NO: 89520 - DNA, 50 bp, homo sapien
acctctaggtagactttaagtgaaaraaagagaagacctagataaaatca

SEQ ID NO: 89521 - DNA, 50 bp, homo sapien
gaaatgctgagagaacagaggataaygtgtgctttgttatcagcaaggga

SEQ ID NO: 89522 - DNA, 50 bp, homo sapien
accaaccaatgtgggaagaaggttgragttctgtaaataatttgcatgct

SEQ ID NO: 89523 - DNA, 50 bp, homo sapien
tgctaagaaacaaaagacaacacacrtagcaatttaagaaagataccatc

SEQ ID NO: 89524 - DNA, 50 bp, homo sapien
ttattcaattagcaacagggagcaastggccttctacagagttctgtaga

SEQ ID NO: 89525 - DNA, 50 bp, homo sapien
aaagtggttgagaagttttgtgctasaggcttgtaaagattatgggaata

SEQ ID NO: 89526 - DNA, 50 bp, homo sapien
ttaagctttccatctgttgttaggawgaataaatacgttaataaatccaa

SEQ ID NO: 89527 - DNA, 50 bp, homo sapien
cccccaaaataatgatgctaataatsaatcattgtgacatatatcgcata

SEQ ID NO: 89528 - DNA, 50 bp, homo sapien
tcccaaacaaatcagaagatacaaargtgaaatcctatatcacccacaga

SEQ ID NO: 89529 - DNA, 50 bp, homo sapien
aatgagttgacttctctttggataaygacagtgactaatgctgtacctat

SEQ ID NO: 89530 - DNA, 50 bp, homo sapien
taatctgcactcaaaaatttagggcygaaatctagtattaagtgttacgt

SEQ ID NO: 89531 - DNA, 50 bp, homo sapien
ttcctgaagtaatcagcataccgaartggcatattttggcacattctgaa

SEQ ID NO: 89532 - DNA, 50 bp, homo sapien
gaagtattactgatttatctttgaayagagtttggtcaagtagatattca

SEQ ID NO: 89533 - DNA, 50 bp, homo sapien
aagaaaatgccttcccaataataggragttgtactatggaagtaatatgg

SEQ ID NO: 89534 - DNA, 50 bp, homo sapien
atttattaaatatatactgagcgtcyactctgtgcctggctcattgtcag

SEQ ID NO: 89535 - DNA, 50 bp, homo sapien
taataataatagccaatttgcctatracttgaccaggatcattcagctag

SEQ ID NO: 89536 - DNA, 50 bp, homo sapien
ccacagtgaaaaggaaaagcatccayaagaacaggcccttgtcgggtgtg

SEQ ID NO: 89537 - DNA, 50 bp, homo sapien
cagggtttgctgtcagtattttaacrcccacattagtatatgcgtccagg

SEQ ID NO: 89538 - DNA, 50 bp, homo sapien
caaaattaaatctgtagccttgacaytgacatttaactttatttttcaaa

SEQ ID NO: 89539 - DNA, 50 bp, homo sapien
tctgtctgattcactctttgagttaygcctctgatcatggctaggtgcct

SEQ ID NO: 89540 - DNA, 50 bp, homo sapien
catcccgagaaattcctattcactamagttcaaagtggaggttgagacca

SEQ ID NO: 89541 - DNA, 50 bp, homo sapien
tatttcgatacttcctttttggcaaygaaaacctagaggaaaggaaagtt

SEQ ID NO: 89542 - DNA, 50 bp, homo sapien
gcaaccaacccaagacagaattggartttagtctcagtgtgtggaacttg

SEQ ID NO: 89543 - DNA, 50 bp, homo sapien
tgatacctcatgtttcctcttcttaygcagtctcatcctcttctacttga

SEQ ID NO: 89544 - DNA, 50 bp, homo sapien
tttcatagaagaaaccttaatgatgmaatagaagagtagaagttgtcaaa

SEQ ID NO: 89545 - DNA, 50 bp, homo sapien
tttaaaacatcatctcattgtaatamctgaacagtgatttgctacatgtg

SEQ ID NO: 89546 - DNA, 50 bp, homo sapien
tggaattaacccatggtccagaaatsatgggttgttaaatgaccaaaata

SEQ ID NO: 89547 - DNA, 50 bp, homo sapien
cctcagtgaaagcaaccagtgaaaaytgatacttcttccattgttctcat

SEQ ID NO: 89548 - DNA, 50 bp, homo sapien
agcctttctgagtgttgtcacactakattttaggtgtttgttcatatgct

SEQ ID NO: 89549 - DNA, 50 bp, homo sapien
aaattttgctgaaagtttactctcamttttgtctcccgcagcatccatta

SEQ ID NO: 89550 - DNA, 50 bp, homo sapien
tcccatatctcataacaagcagtggraaccataagtaagtgaatgaaaag

SEQ ID NO: 89551 - DNA, 50 bp, homo sapien
tctgtgtctaacacatagtagataawcaaggaaaattaactggggtatta

SEQ ID NO: 89552 - DNA, 50 bp, homo sapien
gtagattgtgatccaggcttccaaaygaattaggcaggactaaagggaga

SEQ ID NO: 89553 - DNA, 50 bp, homo sapien
gtccagggttggtatgcaggccaccracatatggctaattcagtcaacaa

SEQ ID NO: 89554 - DNA, 50 bp, homo sapien
ttgcatttcctatatgaggggccaaractacagatttcagatttttgatg

SEQ ID NO: 89555 - DNA, 50 bp, homo sapien
ggcaatttgttctcatagcagtagayacctgttttgggtgtgggtctacc

SEQ ID NO: 89556 - DNA, 50 bp, homo sapien
atgatgaatgctgactaatgtaaacyggctgagcattttgtctgtttgta

SEQ ID NO: 89557 - DNA, 50 bp, homo sapien
tttcactggtccaaattgaccctacrggccttaactcccctgaaagtgtt

SEQ ID NO: 89558 - DNA, 50 bp, homo sapien
caggcacttaaggaagtatttgttcrataattagttgttgagtgagtgaa

SEQ ID NO: 89559 - DNA, 50 bp, homo sapien
atagggagaagtttttcagggatacrattacagtgagataggaggaataa

SEQ ID NO: 89560 - DNA, 50 bp, homo sapien
tttgagagttgactgattaaagggartaaaagttcatagcctcatccagt

SEQ ID NO: 89561 - DNA, 50 bp, homo sapien
tttcaatgtatctttatacaaatgaracaggttgctcagcccttctgaag

SEQ ID NO: 89562 - DNA, 50 bp, homo sapien
ttggagattgtaagtttattactgtsaactgaacaaaatacatgagaagt

SEQ ID NO: 89563 - DNA, 50 bp, homo sapien
ctgaagcacagaagctttactggcarcatataacattcatctactcagat

SEQ ID NO: 89564 - DNA, 50 bp, homo sapien
acatacttaattcagagagtaaagaytaaacaatgagcaacgatgtgaag

SEQ ID NO: 89565 - DNA, 50 bp, homo sapien
gttatatcatcttttctttctttcayctgcatgtttacatatacaaatcc

SEQ ID NO: 89566 - DNA, 50 bp, homo sapien
tattatataccagatcctatgctacyggtgacaataaagtaaattagagt

SEQ ID NO: 89567 - DNA, 50 bp, homo sapien
tacataagtttgcaatattaacatamccaagaatctgtaactatttcacc

SEQ ID NO: 89568 - DNA, 50 bp, homo sapien
gtacttatgtgaataattacaacaarttaggacaatgtaaaaataagata

SEQ ID NO: 89569 - DNA, 50 bp, homo sapien
ttgtgtgcacattaaaacgttcatarcatttgtctatatctagagggata

SEQ ID NO: 89570 - DNA, 50 bp, homo sapien
caaatccagggatccgtgataagcarggatacaacgcagttcattattca

SEQ ID NO: 89571 - DNA, 50 bp, homo sapien
aatactgataatacaggagatagacscagttttattaaagtagaacattt

SEQ ID NO: 89572 - DNA, 50 bp, homo sapien
atgttgagaaaatgaacatattatamggtaaagattgatcatgcatttgc

SEQ ID NO: 89573 - DNA, 50 bp, homo sapien
tatggctagaaaatacatataaatarcagaggaagtcatcagatacagta

SEQ ID NO: 89574 - DNA, 50 bp, homo sapien
acaagagtccaagtaaggatcttcarctttagccagcagcaaccttctca

SEQ ID NO: 89575 - DNA, 50 bp, homo sapien
gagggagggagtggtattttctccamattaaagcattcctcttgaacgct

SEQ ID NO: 89576 - DNA, 50 bp, homo sapien
atgctgaaatatggttcatatgacargttaataatagattacgaatttga

SEQ ID NO: 89577 - DNA, 50 bp, homo sapien
actgtttcagattttattactctaargtttgtgttggctattgatcatat

SEQ ID NO: 89578 - DNA, 50 bp, homo sapien
gggtcgtctacaaatctctctaaccygaatctgtttcctatttgtaaaat

SEQ ID NO: 89579 - DNA, 50 bp, homo sapien
tatggccccagagggacacgtactgkctttggctttctgttctccctcat

SEQ ID NO: 89580 - DNA, 50 bp, homo sapien
ctagggtaaacattttatgtcttctsaattagattccctcataaacaatc

SEQ ID NO: 89581 - DNA, 50 bp, homo sapien
aaactggtcacacattttgtttcaayccaagtagctattttagctttatg

SEQ ID NO: 89582 - DNA, 50 bp, homo sapien
aacaagtgcccaccattcactataarcttccagattctgactaaattctc

SEQ ID NO: 89583 - DNA, 50 bp, homo sapien
aagaaagtaggaagttagaatcataycactttataactcttaaagaaata

SEQ ID NO: 89584 - DNA, 50 bp, homo sapien
tttgctagaaatttttgaccgccttkgcttgtagatgtatcaccctgagc

SEQ ID NO: 89585 - DNA, 50 bp, homo sapien
caaaggaaatctaaaatagaaagaaygcaaagccttagagagcaataaca

SEQ ID NO: 89586 - DNA, 50 bp, homo sapien
atttatgtttacctagaatgtctgcratctgtttaggtacatttaacact

SEQ ID NO: 89587 - DNA, 50 bp, homo sapien
aaataaattttgtaggatgaatgacyggtatttcctttatctaaggcact

SEQ ID NO: 89588 - DNA, 50 bp, homo sapien
ttctcttcctcactaccttcccacaytaattcatgcctaagtcttgttga

SEQ ID NO: 89589 - DNA, 50 bp, homo sapien
tctagtgggatgaacagcatatacartaaacagacacgtgagcagggcag

SEQ ID NO: 89590 - DNA, 50 bp, homo sapien
attagtatttattaagcactatataygaagcaatactctaatacttagat

SEQ ID NO: 89591 - DNA, 50 bp, homo sapien
ggagtctggacattgataaacagtaytaacaattaacataagcactcatt

SEQ ID NO: 89592 - DNA, 50 bp, homo sapien
caaaaacggactaatacaacaagcartctatcctacaattcttacagaag

SEQ ID NO: 89593 - DNA, 32 bp, homo sapien
gttgccaaggcagaagkcaagaacattatgga

SEQ ID NO: 89594 - DNA, 50 bp, homo sapien
agcaattacagttgctccctctgaartacaaatggtctattaacttcatt

SEQ ID NO: 89595 - DNA, 50 bp, homo sapien
acagccttccagctctaaactaacaygatgctctgaaaaacaggatgttt

SEQ ID NO: 89596 - DNA, 50 bp, homo sapien
ttggagcagttactgaaggatggagyatccaaatggcacccaaagctatc

SEQ ID NO: 89597 - DNA, 50 bp, homo sapien
aataatggtattagttatgacttcaraccaaaatattactaaatatgacc

SEQ ID NO: 89598 - DNA, 50 bp, homo sapien
actgagagaacaaagcaaatgataaytcaatggtagtattggtcctctct

SEQ ID NO: 89599 - DNA, 50 bp, homo sapien
tctctaaagctcagaattggccttgsagttgacagcctaataccaacagg

SEQ ID NO: 89600 - DNA, 50 bp, homo sapien
taaagtcgtagctttgtgcaccacawctaactgtttcaaaaatttcctaa

SEQ ID NO: 89601 - DNA, 50 bp, homo sapien
gccagcttcagaaacaagggtgaaawgtataacatctggagttgccaggc

SEQ ID NO: 89602 - DNA, 50 bp, homo sapien
gctcagttgtgctacatgttagaaamgggcagtgatactcttacttttca

SEQ ID NO: 89603 - DNA, 50 bp, homo sapien
gttactgccaaaaaaccgccaaagaygaatgaaagatgtgcatcccacca

SEQ ID NO: 89604 - DNA, 50 bp, homo sapien
gctttgcagatgtatgtgctttttcragatttgtttaccaagtttgggtt

SEQ ID NO: 89605 - DNA, 50 bp, homo sapien
tgataattcagttgatgtatttttcrattgcatagttaccatggacccag

SEQ ID NO: 89606 - DNA, 50 bp, homo sapien
tccttttgctgctcatcatatagacraaagtttgcctgctgcacataaaa

SEQ ID NO: 89607 - DNA, 50 bp, homo sapien
taccctcaaagaaaatagagctgatsaaagaagtggaacaatggggcagg

SEQ ID NO: 89608 - DNA, 50 bp, homo sapien
agagtatatatctgctgtgtgaagtraaagaaccctgatagtgttatagt

SEQ ID NO: 89609 - DNA, 50 bp, homo sapien
cattacttcgcattccttggttatargcacatcacaccaatgtctatctc

SEQ ID NO: 89610 - DNA, 50 bp, homo sapien
ataatattattgcacagttaataaastatggtataaacaacttttatatg

SEQ ID NO: 89611 - DNA, 50 bp, homo sapien
gtggtggctcaagtgcttcttcatakcatggtaagaagacatgcatttgc

SEQ ID NO: 89612 - DNA, 50 bp, homo sapien
aaatgtgactctcacctggtaatacraagtggctgtatcatcttttcctt

SEQ ID NO: 89613 - DNA, 50 bp, homo sapien
ttactctgtatgttgtaatattcaartgcccaactgctctgaaacttact

SEQ ID NO: 89614 - DNA, 50 bp, homo sapien
atacagggcagtagaaaacgaggtcyattgtggccactgtttcttttcct

SEQ ID NO: 89615 - DNA, 50 bp, homo sapien
gcttggtacagatatggctctgccaratttatttaagaaagcctatttta

SEQ ID NO: 89616 - DNA, 50 bp, homo sapien
cagcaaaacagattcaaagcgaacartccaatcagtgggtcatatgttta

SEQ ID NO: 89617 - DNA, 50 bp, homo sapien
aagaatgctgcaacttttttatgtcwcttagaggttaatcagagtatctg

SEQ ID NO: 89618 - DNA, 50 bp, homo sapien
cagaggacttatagggcagtgacackattctgtgtgatgctgtaatggtg

SEQ ID NO: 89619 - DNA, 50 bp, homo sapien
ccactgcatttgtatagaagactacwcaggaatatggaagatcaggttct

SEQ ID NO: 89620 - DNA, 50 bp, homo sapien
cctatgaaacattttgtctactgtaygctttgggcctaatctctagacct

SEQ ID NO: 89621 - DNA, 50 bp, homo sapien
ggttatgaatcagtaagcttactaamtgatgaaatatagaagcagtgtct

SEQ ID NO: 89622 - DNA, 50 bp, homo sapien
gtataattacaacttaacagtttccrgattagctggccatgctgtaagtc

SEQ ID NO: 89623 - DNA, 50 bp, homo sapien
ggcctatgctattttcagactaacargctaaagaaaaaagcattttaaaa

SEQ ID NO: 89624 - DNA, 50 bp, homo sapien
gggatgtaacaaatgacgtggtgtarcacaaaaggaagaataagaaatgt

SEQ ID NO: 89625 - DNA, 50 bp, homo sapien
cctggtaacacttgaaggtgaacttkgcatcagaaacaagatccccaggg

SEQ ID NO: 89626 - DNA, 50 bp, homo sapien
aattgcaactatcatgggaattttayagatcggtggattgagaatctaag

SEQ ID NO: 89627 - DNA, 50 bp, homo sapien
ctgcctggctatgtaggcaggtatargtgagttgtgtcagcaagaaagtt

SEQ ID NO: 89628 - DNA, 50 bp, homo sapien
ttcttagttcagggaaacttcttaaygtttcagagtacggaaaggaacca

SEQ ID NO: 89629 - DNA, 50 bp, homo sapien
catagaaatcactacatagtctaaawacaactcttttcatatctaattgc

SEQ ID NO: 89630 - DNA, 50 bp, homo sapien
cagggcacccctgtgaccaaacagawctctgaagtgggacattttatatg

SEQ ID NO: 89631 - DNA, 50 bp, homo sapien
tgaaatcatcctcaacttgctggccrcatcgacccctaacttattttact

SEQ ID NO: 89632 - DNA, 50 bp, homo sapien
tggtatttctcttttcttttaaagaygtctatgtaattgccatttgtaat

SEQ ID NO: 89633 - DNA, 50 bp, homo sapien
ccttaagccttaatgtgcactggaakgaaccaaggatctcctttaatata

SEQ ID NO: 89634 - DNA, 50 bp, homo sapien
aacggctctctagttattaactactyagcatttacaagccttttgtaaga

SEQ ID NO: 89635 - DNA, 50 bp, homo sapien
atggttacgtatataccaaccattayccagaatatttggttatagcacaa

SEQ ID NO: 89636 - DNA, 50 bp, homo sapien
attttaggaagggctaaaacacagcraaggtaattaatcagaccccatgg

SEQ ID NO: 89637 - DNA, 50 bp, homo sapien
tccagaagatcccactaccaatgtaygaagagccactcctggatcacctg

SEQ ID NO: 89638 - DNA, 50 bp, homo sapien
ataatcaaaaatattggcaactaatrtcaccatgagactcagggaaattc

SEQ ID NO: 89639 - DNA, 50 bp, homo sapien
actttgcatcctttcagctgttagtrtgatatgctgatatgaaatatgaa

SEQ ID NO: 89640 - DNA, 50 bp, homo sapien
gtaatgttagatgtttcagggacaamactgggcctaacatgagtgggaag

SEQ ID NO: 89641 - DNA, 50 bp, homo sapien
aactagctttaatttgctcccattcmatttctcttagtctaattccatta

SEQ ID NO: 89642 - DNA, 50 bp, homo sapien
atttctccccttctccctaaaatacyatatctcacctagattctaataag

SEQ ID NO: 89643 - DNA, 50 bp, homo sapien
agaaaatccctctggcaaccaatacygaccattacaatgaacagataatt

SEQ ID NO: 89644 - DNA, 50 bp, homo sapien
gagttggaaaggatattttaggtcayatttaaggaagcatgtatatatat

SEQ ID NO: 89645 - DNA, 50 bp, homo sapien
aataattaccaatgtgccatatccartcgtgttctatcttggcctaggag

SEQ ID NO: 89646 - DNA, 50 bp, homo sapien
cagttccttcaataaaagacaatgcracctactaatcttgtcctgcatgc

SEQ ID NO: 89647 - DNA, 50 bp, homo sapien
ttatagtgacttgcttatgtgtcttygtctttaacatcaaaggcaaggac

SEQ ID NO: 89648 - DNA, 50 bp, homo sapien
tgaaagtcatttttagaaaacagagscaatttacctgccctttggctgct

SEQ ID NO: 89649 - DNA, 50 bp, homo sapien
aaatgacaaatgtcttgaaaatccayatgaagctaagtgtcttttgtgga

SEQ ID NO: 89650 - DNA, 50 bp, homo sapien
ctagggtgtctaagtcaatgccaagwaaagtttggaaagactttgagaga

SEQ ID NO: 89651 - DNA, 50 bp, homo sapien
gccatgcaaatagtagcaaggactcyataggaattatgtatgttcttaat

SEQ ID NO: 89652 - DNA, 50 bp, homo sapien
ctttcctgctcttcctttaagaaaayctctgttctgtttgacaatgactc

SEQ ID NO: 89653 - DNA, 50 bp, homo sapien
ttatcacatacaaatccagaaaataygacaaactccattattcacaacta

SEQ ID NO: 89654 - DNA, 50 bp, homo sapien
catttaaccacaacatatcactcackcatttattgtagtctgacttgtac

SEQ ID NO: 89655 - DNA, 50 bp, homo sapien
tatataaaacaaatattattaataamacaagtgaagaaacaagtaaaaat

SEQ ID NO: 89656 - DNA, 50 bp, homo sapien
taagaacaaacacccaagatttttcracagctgtaatgctttgtgttaac

SEQ ID NO: 89657 - DNA, 50 bp, homo sapien
attccaatgtgcaatcaagtttgagmcccaccaatctagggcagctgttc

SEQ ID NO: 89658 - DNA, 50 bp, homo sapien
gtagaaaaaccatttccttgaaataytagtctaggctttatttgctgtaa

SEQ ID NO: 89659 - DNA, 50 bp, homo sapien
caccaatctagggcagctgttccacrcagagatgcacattcgaatcagct

SEQ ID NO: 89660 - DNA, 50 bp, homo sapien
tcccttgcacatagggacagagtaaraaggcatggctatggactgtgagc

SEQ ID NO: 89661 - DNA, 50 bp, homo sapien
cagttttagctatatacagatctcartgaactctttgcaatgtctagtaa

SEQ ID NO: 89662 - DNA, 50 bp, homo sapien
tcctcgcctcactctagttcctgaakcaattggtctgcagtggagtcctg

SEQ ID NO: 89663 - DNA, 50 bp, homo sapien
tgttacacatccacggtgcttcatayagctctagttaaaatactttttca

SEQ ID NO: 89664 - DNA, 50 bp, homo sapien
gacagaatgagtccttgtccccaacyatttgagctgaggattacaacaag

SEQ ID NO: 89665 - DNA, 50 bp, homo sapien
ccttttctacttccttcagatgaaayatgctcctacccatttgacataca

SEQ ID NO: 89666 - DNA, 50 bp, homo sapien
aaggataaagaaaactactgtatacraattagggccacgatgtgagctgt

SEQ ID NO: 89667 - DNA, 50 bp, homo sapien
agcttaaaatataaaataatttgggmagattgttagaaacaaggtgtgct

SEQ ID NO: 89668 - DNA, 50 bp, homo sapien
gagaaaccatcggaataacactactkctattcactttttgcttagagaag

SEQ ID NO: 89669 - DNA, 50 bp, homo sapien
ccagagatctacgaaccgaaagaacrgtggtatagcattgctaatataaa

SEQ ID NO: 89670 - DNA, 50 bp, homo sapien
tgtagtgtctctgcatatttaaagaygaaaatgttctttctggtgcttag

SEQ ID NO: 89671 - DNA, 50 bp, homo sapien
ggtcagtgatatcctccaaagatacrgacaaaatgaatgcctttgctgat

SEQ ID NO: 89672 - DNA, 50 bp, homo sapien
gaaattgtgagtttgttttggtagaygtaaagtgtaagaggtaaaaatgt

SEQ ID NO: 89673 - DNA, 50 bp, homo sapien
taatatacatctgcttactttatacygagcctagtggaggaacaagattt

SEQ ID NO: 89674 - DNA, 50 bp, homo sapien
cttggggttctaccggtggctaatcyatattgcatatacatctacacctc

SEQ ID NO: 89675 - DNA, 50 bp, homo sapien
ctatgtgctggaaaactgctatttaygttctttccatgcatctggaagat

SEQ ID NO: 89676 - DNA, 50 bp, homo sapien
gtcattttagtgaagttgttcagagrccattccatccccactgcagaggg

SEQ ID NO: 89677 - DNA, 50 bp, homo sapien
catcttggcaatttggcagaacctcyaaaataaactacctgcatcgtatc

SEQ ID NO: 89678 - DNA, 50 bp, homo sapien
ggggatatattaggtcaggccctccrcaagtaatacagggtcttctctta

SEQ ID NO: 89679 - DNA, 50 bp, homo sapien
tataataagcttgatgctatgatacrctatttactagggatttagagcag

SEQ ID NO: 89680 - DNA, 50 bp, homo sapien
aaccccaggcaagattcaactaatgraggccagaagccaatggagatatc

SEQ ID NO: 89681 - DNA, 50 bp, homo sapien
ctgtgcagccactcagggttaaaccractggctcaagtgattctctagtg

SEQ ID NO: 89682 - DNA, 50 bp, homo sapien
aatggagaagtaaaaggctacaccamctacataagcagctttcatatatc

SEQ ID NO: 89683 - DNA, 50 bp, homo sapien
tttataaatgtgtcttcaaggacccrcaatatattaattgctggaaatct

SEQ ID NO: 89684 - DNA, 50 bp, homo sapien
tctttctcttcttcacttgagatcasacttgcataatgatctgccagctc

SEQ ID NO: 89685 - DNA, 50 bp, homo sapien
tatttgaaagattgtggccaaggaaygggagatatgacaatacaaagacc

SEQ ID NO: 89686 - DNA, 50 bp, homo sapien
gtcagattatcactggaaattacacrgatgccaaccatagctgagaagct

SEQ ID NO: 89687 - DNA, 50 bp, homo sapien
tgccttactaggtactagactattcraaacactttacgtgtatcacctta

SEQ ID NO: 89688 - DNA, 50 bp, homo sapien
aggccttatggttacagctttaagayagtgcaagataagagtaggattga

SEQ ID NO: 89689 - DNA, 50 bp, homo sapien
tgaaagcatggatattcaaggttgaygagatgtcccagcccaactgcatc

SEQ ID NO: 89690 - DNA, 50 bp, homo sapien
tcattattgtgaggttcctagcggcratatttctttacatctggtgttga

SEQ ID NO: 89691 - DNA, 50 bp, homo sapien
tctgacatattaccctggttgaacawtaggctcttagattagtggtcctt

SEQ ID NO: 89692 - DNA, 50 bp, homo sapien
tattctgcctcttctttcatttgtayaatttccactcactgggggatgta

SEQ ID NO: 89693 - DNA, 50 bp, homo sapien
agtaacatacatgttttatttaatgyttggtattatgtgagtgtgatggt

SEQ ID NO: 89694 - DNA, 50 bp, homo sapien
ccacttgaattctaaccaagtactcygaatttagtaagtgaaacccatta

SEQ ID NO: 89695 - DNA, 50 bp, homo sapien
atccatgacattaactacaatgaccraagtttattactggcctgtactcc

SEQ ID NO: 89696 - DNA, 50 bp, homo sapien
ttattatacaatagataacctgaacmgcatagcatttcacttattgaaag

SEQ ID NO: 89697 - DNA, 50 bp, homo sapien
gaaatagggacctgcatttcaaaggmcatccttacccaaacagggagccc

SEQ ID NO: 89698 - DNA, 50 bp, homo sapien
tctatttaaagtagaaacagatataktcaaatgtttgtctccacggttta

SEQ ID NO: 89699 - DNA, 50 bp, homo sapien
aacagtgacatttaaaaaccttaagwctgatagtacattgactttatgtt

SEQ ID NO: 89700 - DNA, 50 bp, homo sapien
caaatagaatgcagagaagtaactawgtgtgatttagaagcctggcctca

SEQ ID NO: 89701 - DNA, 50 bp, homo sapien
tactctatcccgtccacctgcatcaratgagtaatagcgttttacaagta

SEQ ID NO: 89702 - DNA, 50 bp, homo sapien
ccaggaactacctaggaaccgatctstcatccccaactaccaagcttcca

SEQ ID NO: 89703 - DNA, 50 bp, homo sapien
tttggtagtcttagcccaactgcacytatgccctgctagaaaacctcagg

SEQ ID NO: 89704 - DNA, 50 bp, homo sapien
cctgttgtgaaatcacacatatagawcaaaacccatatcctccagcctgg

SEQ ID NO: 89705 - DNA, 50 bp, homo sapien
taaatgctgtaaaattgcttagtacmgaaaaaggatttctaccttcctaa

SEQ ID NO: 89706 - DNA, 50 bp, homo sapien
tccaggactaaacttcaatctgaacrgaggacatttctgtgagggtagga

SEQ ID NO: 89707 - DNA, 50 bp, homo sapien
tttttaaaagagtatttaaagtgaamttcaagctatttaaagtagaaatg

SEQ ID NO: 89708 - DNA, 50 bp, homo sapien
attctctctgtaaatatagtgatgawtagtctaacattcacttagaagaa

SEQ ID NO: 89709 - DNA, 50 bp, homo sapien
atttttgaaccattgtccagattcartaagtgatatttactattcttgtt

SEQ ID NO: 89710 - DNA, 50 bp, homo sapien
atctcagcaaatttagtcagattagsaaaaacctccctcaaaactcctag

SEQ ID NO: 89711 - DNA, 50 bp, homo sapien
actaataattctatattgtccaccakcaactatttgtttagttctggatc

SEQ ID NO: 89712 - DNA, 50 bp, homo sapien
aattgcatagttgcctatatatttcraaggagctttgttctgattaatgc

SEQ ID NO: 89713 - DNA, 50 bp, homo sapien
gcacaaaaaagatggagatgtaaaargatgtgatcaactctttctggatg

SEQ ID NO: 89714 - DNA, 50 bp, homo sapien
acctccatgccagcatcaggacttayaccaatattactgaccagcaagtt

SEQ ID NO: 89715 - DNA, 50 bp, homo sapien
tatgctgcccaggtgtgcttgccccrcaggagaacacaatcaccaaagct

SEQ ID NO: 89716 - DNA, 50 bp, homo sapien
gtcctgggttctgaaatattagaccrgcaattctccatccatggggaaat

SEQ ID NO: 89717 - DNA, 50 bp, homo sapien
tcagtcttcactcttctaagggatcractattgtctgagtctttcaagac

SEQ ID NO: 89718 - DNA, 50 bp, homo sapien
ccatattttcttccatttttttaatyagagaggagtatttgtctgtagtc

SEQ ID NO: 89719 - DNA, 50 bp, homo sapien
tgattgcacaggtaccttgcatgaayaggttaaatctggtgagcctagtc

SEQ ID NO: 89720 - DNA, 50 bp, homo sapien
gttttccttttcttcagtaattttayggctttatcttctcggcatgatca

SEQ ID NO: 89721 - DNA, 50 bp, homo sapien
tggcaaacaaagagtagagtatcctyaaaagagagaactgtacaaatgaa

SEQ ID NO: 89722 - DNA, 50 bp, homo sapien
ctgccctgtaggattgtgttcctctraaactgtcccctaaattatggtgc

SEQ ID NO: 89723 - DNA, 50 bp, homo sapien
gaggagaaaactaatggaaagaccgycagtcaaactttggatgaaatttt

SEQ ID NO: 89724 - DNA, 50 bp, homo sapien
ataaagaggctcaaaagtaatagaamaggatcttaagtcagcccctgttt

SEQ ID NO: 89725 - DNA, 50 bp, homo sapien
ctctgccgtttcttaggaagttgtgraagatattggtctttttgtgaata

SEQ ID NO: 89726 - DNA, 50 bp, homo sapien
agaggagctaaatatttaactctcarattattatgaacatggtccaaatg

SEQ ID NO: 89727 - DNA, 50 bp, homo sapien
ccagttgccaaactctggggataagratggacaaaatacagtctctgccc

SEQ ID NO: 89728 - DNA, 50 bp, homo sapien
gactcagacattgggccaccaaagaygatgtttacagcttgcttcctaga

SEQ ID NO: 89729 - DNA, 50 bp, homo sapien
atatatgtcaaatcttgtactccaamatgaaaaaggactccttcttaaat

SEQ ID NO: 89730 - DNA, 50 bp, homo sapien
tatctttgtacagtgctagtgaaaamaacatttagctgctgtggaaaact

SEQ ID NO: 89731 - DNA, 50 bp, homo sapien
aatcttttgtccattaggataaagaygagtgacctcaaaaatgttctttt

SEQ ID NO: 89732 - DNA, 50 bp, homo sapien
ttatcaatgggttatttttgcctcaktttatattagtcaagtgatttagc

SEQ ID NO: 89733 - DNA, 50 bp, homo sapien
tggtgagatttgtctttgtaatttcrattttcccagcattcagcaccttc

SEQ ID NO: 89734 - DNA, 50 bp, homo sapien
catttcccctcacagatctggggtartaaccaaaatgagtgacattctcc

SEQ ID NO: 89735 - DNA, 50 bp, homo sapien
tatgtgcatagctttcaaatctaacrctggtagcaatcaaacaagttaag

SEQ ID NO: 89736 - DNA, 50 bp, homo sapien
aatttccttgctatacactcctatcrctgaaaaacacatgataatgttaa

SEQ ID NO: 89737 - DNA, 50 bp, homo sapien
ggcctaaataagacgaagtatgatamagtacctaactatatccaccattc

SEQ ID NO: 89738 - DNA, 50 bp, homo sapien
acaaaatcatggtgatagtgaacatratggttttgacaaagttcaaggag

SEQ ID NO: 89739 - DNA, 50 bp, homo sapien
cagaaaagttaagtcatatgcttaaygtaaatactggagctaggattaaa

SEQ ID NO: 89740 - DNA, 50 bp, homo sapien
catgatggttttgacaaagttcaagragtgtgtaggtgtcaatgtcacaa

SEQ ID NO: 89741 - DNA, 50 bp, homo sapien
aagaaagggcagaagtgccagctaartagtaccttcaaattgacttacta

SEQ ID NO: 89742 - DNA, 50 bp, homo sapien
cttcagattcattaaaccattccacyatctattgtgacattgacacctac

SEQ ID NO: 89743 - DNA, 50 bp, homo sapien
ggtgataatatttatgtctatgaagsatgtttaatttgcaagggcataaa

SEQ ID NO: 89744 - DNA, 50 bp, homo sapien
ccccaagagaaggaggataacaccawgtcggcatctcagccactgatgca

SEQ ID NO: 89745 - DNA, 50 bp, homo sapien
attctttattactacctagaaagagrcattacagaaatacttgtctttat

SEQ ID NO: 89746 - DNA, 50 bp, homo sapien
tctcccaaccacacagccaccataayagtgcttagcagaattgtaagtgg

SEQ ID NO: 89747 - DNA, 50 bp, homo sapien
tttcatttcttcaatatttgaaaaaragagataagaccaaaaaaaaaaaa

SEQ ID NO: 89748 - DNA, 50 bp, homo sapien
aatttacttactaacacttgaagtcmatgtgatttagctaaaaaatataa

SEQ ID NO: 89749 - DNA, 50 bp, homo sapien
attaaaagatgatgctaactttccaraaacgaaatgcattatttaaatta

SEQ ID NO: 89750 - DNA, 50 bp, homo sapien
aagaatcctctttctactggagtgasagcccaattaaaagatgatgctaa

SEQ ID NO: 89751 - DNA, 50 bp, homo sapien
gtgtcattgtctattactgaattgtwaatagaatcctgataggacttaca

SEQ ID NO: 89752 - DNA, 50 bp, homo sapien
tgaagaataaaattgcaatatcaccrcttcctcctaatgaaggaaggatt

SEQ ID NO: 89753 - DNA, 50 bp, homo sapien
gatatttcacatcatgaatgtttagkcctggaaagtttgcttattttctc

SEQ ID NO: 89754 - DNA, 50 bp, homo sapien
tctgggtttatagcctatatacccartgaaaacctacttctctaagccca

SEQ ID NO: 89755 - DNA, 50 bp, homo sapien
tcttgatgagaacacatcaccacctwagaagccatccttaaacaatcaaa

SEQ ID NO: 89756 - DNA, 50 bp, homo sapien
aaacctaaattgctggattccacccraagagattctgattcagcaggtct

SEQ ID NO: 89757 - DNA, 50 bp, homo sapien
gaggtgacacatcgctaaataccagraactgtttgagtcgattctgaagc

SEQ ID NO: 89758 - DNA, 50 bp, homo sapien
agactattataggtaggatttagcasgaaatactgttttaattgccattg

SEQ ID NO: 89759 - DNA, 50 bp, homo sapien
gtcttacattcagaaaaattgctackacttgtaaaacgctattactcatc

SEQ ID NO: 89760 - DNA, 50 bp, homo sapien
gactgcagcttcatgaattctaacarggtgcacgatttctagacccactt

SEQ ID NO: 89761 - DNA, 50 bp, homo sapien
catgaacaatgggagtggagaacagyagcaaaaaactgtaagggtgccaa

SEQ ID NO: 89762 - DNA, 50 bp, homo sapien
aaatagtgggtctaactgacagtcawcaatgtacaaagacctgcccccaa

SEQ ID NO: 89763 - DNA, 50 bp, homo sapien
agcggagtgagcaactctggcgatayggtatgacatgaacaatgggagtg

SEQ ID NO: 89764 - DNA, 50 bp, homo sapien
tattacaagtaataaaatctccttgytgaatcctcgattatggtaaatgg

SEQ ID NO: 89765 - DNA, 50 bp, homo sapien
aatcgtaagagtaacttgtttctccraattactcataccaagtttttcca

SEQ ID NO: 89766 - DNA, 50 bp, homo sapien
cttttgtacagatataattaatcacragccactgacttagaataagtatt

SEQ ID NO: 89767 - DNA, 50 bp, homo sapien
taaaataaaaatgtagaggaaactargaatcatgcattataactaagagt

SEQ ID NO: 89768 - DNA, 50 bp, homo sapien
cctgatctgggaagactcaaagttcyggtggctctggtgtgcattttaaa

SEQ ID NO: 89769 - DNA, 50 bp, homo sapien
tgttatgggtctgttattggattgcrgaaaagttgaaactttctagaatt

SEQ ID NO: 89770 - DNA, 50 bp, homo sapien
ttggagtcctaaccctttcatccacygccatataaatgcaacctatttac

SEQ ID NO: 89771 - DNA, 50 bp, homo sapien
ttattgtccccaaagcttgtctgagkaaatcgacatcaggaaattatgtt

SEQ ID NO: 89772 - DNA, 50 bp, homo sapien
actaaagtacattactgaatgtatayctttgatggggttaaacatcttcc

SEQ ID NO: 89773 - DNA, 50 bp, homo sapien
ttgagtgagccttaatcagcatcgcraatatggagtatcttagtttcttt

SEQ ID NO: 89774 - DNA, 50 bp, homo sapien
cctgtgagtatgttaggctacatggmagatggaattaaggtttaagatca

SEQ ID NO: 89775 - DNA, 50 bp, homo sapien
cacagatccccttgaacaacttttakgtcttctgtgagcccctccccaga

SEQ ID NO: 89776 - DNA, 50 bp, homo sapien
tgagataaaaggggattttgacctgytgttgctgactttgaaaaggaacg

SEQ ID NO: 89777 - DNA, 50 bp, homo sapien
aatgcaacccacgagtaaattagaargagtctatgttatgttccaaaatg

SEQ ID NO: 89778 - DNA, 50 bp, homo sapien
gtctctggaggagctaagtatatgcrgataagaaaatgaacaaggtaagc

SEQ ID NO: 89779 - DNA, 50 bp, homo sapien
cattcctttgccttttgcagactctraagaggccacccatggtctttggt

SEQ ID NO: 89780 - DNA, 50 bp, homo sapien
acacacctctatttctgtcattacawctaattgtctgtgtgatggttaat

SEQ ID NO: 89781 - DNA, 50 bp, homo sapien
cttatttaaaatctctctttgtcaaygtgatattcaatcatgctactact

SEQ ID NO: 89782 - DNA, 50 bp, homo sapien
ttatgtacattaacagagtacaaacsattgaaaatacagcagttcatgag

SEQ ID NO: 89783 - DNA, 50 bp, homo sapien
agctccagctggcatcaggaaggagsaagccgcaatccttgctgtgctgc

SEQ ID NO: 89784 - DNA, 50 bp, homo sapien
attactgtcttaaattacctcagcakgttcagtacttagaaatgtgcttt

SEQ ID NO: 89785 - DNA, 50 bp, homo sapien
gaattgccacagggatttcatcctcyatcactcaaagaatccctctcata

SEQ ID NO: 89786 - DNA, 50 bp, homo sapien
gatggatgaatccagagataaacaawcattttctatttgaattctaaagg

SEQ ID NO: 89787 - DNA, 50 bp, homo sapien
ttctgccttcctttcatgtgaatacmactatgttacgatttgacggtgga

SEQ ID NO: 89788 - DNA, 50 bp, homo sapien
acaaacagaactagaacccctaatcratactgtttatagtgggatggaag

SEQ ID NO: 89789 - DNA, 50 bp, homo sapien
aaaggagaaataagaaatcaagccasggaaatgtgaaatggtgtagaaac

SEQ ID NO: 89790 - DNA, 50 bp, homo sapien
aagcctcttctgctattttttcatakgtgttcttctcttgtaggccaact

SEQ ID NO: 89791 - DNA, 50 bp, homo sapien
tacaaaacatacacctaagttcttayactttagagccccaagagaaaatt

SEQ ID NO: 89792 - DNA, 50 bp, homo sapien
ctaattaaatcaatcataaattccarcaaataacaggatagcaacagtat

SEQ ID NO: 89793 - DNA, 50 bp, homo sapien
aggcttaagcatagcgccttgtacawaggatgtcgataaatgcttgttga

SEQ ID NO: 89794 - DNA, 50 bp, homo sapien
cgaggttatccaacttcttcagttayctgagatggaccagtagtctttca

SEQ ID NO: 89795 - DNA, 50 bp, homo sapien
aattctagtcccatgtttgacccaayctgataaaccttcagtaacatatt

SEQ ID NO: 89796 - DNA, 50 bp, homo sapien
ccacttggacctgttgccagtgaatwatcagagcagtggcatgggaatcc

SEQ ID NO: 89797 - DNA, 50 bp, homo sapien
tatcaaattggataaataatgaatamctaactatgtactgtctacaagaa

SEQ ID NO: 89798 - DNA, 50 bp, homo sapien
ggataaggcaagtttatttgtgaaasagagctataatatatgaaaatagg

SEQ ID NO: 89799 - DNA, 50 bp, homo sapien
acgacatggatgacctttgaaaataytacgctaagtgaaagaagccagac

SEQ ID NO: 89800 - DNA, 50 bp, homo sapien
gccccatgtataagatttgggccaaragtatttgaagtggtgcacaagag

SEQ ID NO: 89801 - DNA, 50 bp, homo sapien
tcagtgaactcaactggaactcacamcaattcctgactctctgggtacaa

SEQ ID NO: 89802 - DNA, 50 bp, homo sapien
gtgggtggtacgtccaggaatccgcraagtggcttgtaggggccagggac

SEQ ID NO: 89803 - DNA, 50 bp, homo sapien
aatatttttgagggagtaataattasaagagggcaagaaggaagctctgc

SEQ ID NO: 89804 - DNA, 50 bp, homo sapien
acatattatacatgtgcatacatgarttttgtttatcgtctgtctcttcc

SEQ ID NO: 89805 - DNA, 50 bp, homo sapien
tgctctggctgactcatttcatggamcttcctgttaaatttttgcctagt

SEQ ID NO: 89806 - DNA, 50 bp, homo sapien
agatttcaagtccaaactctggaaargcataaaagtttttgtttgttcat

SEQ ID NO: 89807 - DNA, 50 bp, homo sapien
aatttacgtagagtatatttactacmatatgaagcacaaacttgacttag

SEQ ID NO: 89808 - DNA, 50 bp, homo sapien
ccctgtgacatttttaaggttggacycataggatgatacttacctaggga

SEQ ID NO: 89809 - DNA, 50 bp, homo sapien
ggtggcttgggatgcacacagactcragtaatgtcggtgttaagagtcaa

SEQ ID NO: 89810 - DNA, 50 bp, homo sapien
atgagaatgcacgtgcagacccttasacttctgagacactgcttttgttg

SEQ ID NO: 89811 - DNA, 50 bp, homo sapien
gtacagggacccttataagtagaagsatattgtggtagaccaaataatac

SEQ ID NO: 89812 - DNA, 50 bp, homo sapien
gcttagcaaaatttgagtattttaaraggtatttagttggtattaagaga

SEQ ID NO: 89813 - DNA, 50 bp, homo sapien
cagactgatacatgcgcatcctacaragcagtattcacaaatcaggataa

SEQ ID NO: 89814 - DNA, 50 bp, homo sapien
caggtggaattagataatagacccamgttaggttgcttcaagtcaggatt

SEQ ID NO: 89815 - DNA, 50 bp, homo sapien
atgagaaagggatgatttcctgtgamctactatgaatttaatacagaatt

SEQ ID NO: 89816 - DNA, 50 bp, homo sapien
ggtatgtatttaaaacatatgtttakaatcctgacttgaagcaacctaac

SEQ ID NO: 89817 - DNA, 50 bp, homo sapien
attgaaattaatttgttggctttcayccggaaggcagataaacactgccc

SEQ ID NO: 89818 - DNA, 50 bp, homo sapien
gtgccttcctaagaagagcgctgtgmataaaatctgtctcaaaatactga

SEQ ID NO: 89819 - DNA, 50 bp, homo sapien
tacgcacggtttcaagaggatatctwaaagttcattataaatcccctagg

SEQ ID NO: 89820 - DNA, 50 bp, homo sapien
tttacaagctacaagacttacgcctkggataccttttattcttcagttct

SEQ ID NO: 89821 - DNA, 50 bp, homo sapien
ttaacaaaaccagaacatggctctaycataacatgctggttgacggcaag

SEQ ID NO: 89822 - DNA, 50 bp, homo sapien
cctcctgttgacccgaagccttatcratgactaaacagtaagttaacaca

SEQ ID NO: 89823 - DNA, 50 bp, homo sapien
aactgacataaagtctatcagtgacrgcatcagttttgagagcttactat

SEQ ID NO: 89824 - DNA, 50 bp, homo sapien
agtaagtgaaagggttcagatctaayaagcatgcagcccacttcacaaga

SEQ ID NO: 89825 - DNA, 50 bp, homo sapien
ttaagctatgaattgctaaaaaggargaacatattgaagacattgtacaa

SEQ ID NO: 89826 - DNA, 50 bp, homo sapien
attctgtgcttacctctatcattccrcattagtaaatattgtcataagca

SEQ ID NO: 89827 - DNA, 50 bp, homo sapien
gagtgtaaaatactctctagttttayggtaacctgaagcctggaaacaca

SEQ ID NO: 89828 - DNA, 50 bp, homo sapien
cagtttaagtgtaaaaacgatagaamatattaaccattgtcaattgtcat

SEQ ID NO: 89829 - DNA, 50 bp, homo sapien
ttatgtggttgtcgaacaagagacaycattctcaggttaaattagtactt

SEQ ID NO: 89830 - DNA, 50 bp, homo sapien
atcactaatatctaaggaccgcaaayaattccttatcagtttgcaagtat

SEQ ID NO: 89831 - DNA, 50 bp, homo sapien
aaactttccagtttcagtagcctcamagtctgtattaaaaacaatcattt

SEQ ID NO: 89832 - DNA, 50 bp, homo sapien
attgcaattcttcattatgtgcacastctttgggaacaaacaccgtaggt

SEQ ID NO: 89833 - DNA, 50 bp, homo sapien
aaagtgcacttatgtgctatacttcratacaaatttactttaaaaaagca

SEQ ID NO: 89834 - DNA, 50 bp, homo sapien
ctggtaatatcacagaagactctacycaggaaagtttatctgatctgtcc

SEQ ID NO: 89835 - DNA, 50 bp, homo sapien
ggagtttcattgcattcactcttccrcctgtcacattgattcccttcttc

SEQ ID NO: 89836 - DNA, 50 bp, homo sapien
gtcctgagctatggtatatcccatcraaaggtagtcattgccactcacct

SEQ ID NO: 89837 - DNA, 50 bp, homo sapien
aacatttactgacttagcttgtgtcyctttgtaaaatcaaaattttaaac

SEQ ID NO: 89838 - DNA, 50 bp, homo sapien
attagatttgccttacatcacttccyagttagtttcagaggaagaataac

SEQ ID NO: 89839 - DNA, 50 bp, homo sapien
aaccactttgagcaattgaaatgtcrgaactgaatacagacatctgttac

SEQ ID NO: 89840 - DNA, 50 bp, homo sapien
aaatggggaagcaacctgtatttaaytgtctttataacatgcaagaactg

SEQ ID NO: 89841 - DNA, 50 bp, homo sapien
agaaatgccatgcttcagcagtgackactacaaatggttattgattaata

SEQ ID NO: 89842 - DNA, 50 bp, homo sapien
cacactctcatagataacaactgcgyattcaaaaaagaaaaggcaggatg

SEQ ID NO: 89843 - DNA, 50 bp, homo sapien
ttatggaaggcataatgaatttaaargttaaaagcatgatagcctcttaa

SEQ ID NO: 89844 - DNA, 50 bp, homo sapien
gttctgtatctctacctaactcgtaycctctttctggtacaagtcccaag

SEQ ID NO: 89845 - DNA, 50 bp, homo sapien
gaataaaatacatgaatatagtagamaagcggaggaatggttctggccta

SEQ ID NO: 89846 - DNA, 50 bp, homo sapien
agaagtaacaaagtgagaaatctackctgccgcttacagcaaaaatgttg

SEQ ID NO: 89847 - DNA, 50 bp, homo sapien
aaacactagaggctgcctacagcaaygtattataacttcctggcttcttt

SEQ ID NO: 89848 - DNA, 50 bp, homo sapien
agcatctagaactgactgagataatraatctatgcccaattttctccaat

SEQ ID NO: 89849 - DNA, 50 bp, homo sapien
ggcagataatacatattctaatttcrcagggttatttcgggaataaaatt

SEQ ID NO: 89850 - DNA, 50 bp, homo sapien
aactgctgcaggaccaaagttgcagsatgtattttaatttaaaggtttag

SEQ ID NO: 89851 - DNA, 50 bp, homo sapien
tgtgaattaaaaccctttgtattccwctgttttacatactgggagtcaga

SEQ ID NO: 89852 - DNA, 50 bp, homo sapien
ttgaacaaacaagagaatttgttggytcatataatggtaaagtccaggga

SEQ ID NO: 89853 - DNA, 50 bp, homo sapien
cctctaaaagtactcccttaataaawcattgcatataaatccttgcttag

SEQ ID NO: 89854 - DNA, 50 bp, homo sapien
tatatctagaagtagcagacaaatargcattgaataaatttcctaaagtt

SEQ ID NO: 89855 - DNA, 50 bp, homo sapien
aaacagctgtttcagttgttgaggarattgagctactgaaagtcatggag

SEQ ID NO: 89856 - DNA, 50 bp, homo sapien
ggtttctcttttattccatctgctartaaataattaaatgaggaaggaat

SEQ ID NO: 89857 - DNA, 50 bp, homo sapien
ccactgcacccggcggaactttcatrtgctgtactggcttgtgagttttt

SEQ ID NO: 89858 - DNA, 50 bp, homo sapien
ccagggctgagagttcaagtacatastatcactttcttactctaccactt

SEQ ID NO: 89859 - DNA, 50 bp, homo sapien
ggatggtttcagctagaagtgaccargccactataaatttagagttttgg

SEQ ID NO: 89860 - DNA, 50 bp, homo sapien
ggatgaccattttttcagtctccaasaattttgtcaccgctttttcagtc

SEQ ID NO: 89861 - DNA, 50 bp, homo sapien
tattgttctcttgttgactgtcttaktaaagttttggctagtattatagt

SEQ ID NO: 89862 - DNA, 50 bp, homo sapien
tggaaagaaaagtaagaaatatccasactaatatacatggaaagtaagaa

SEQ ID NO: 89863 - DNA, 50 bp, homo sapien
ttcagtattggtgtgctgatgtgtaygcacaggatttaatgtgatcagaa

SEQ ID NO: 89864 - DNA, 50 bp, homo sapien
tgggtgatttttatcaatttctttarcctaaacttgcagagtcatgtgaa

SEQ ID NO: 89865 - DNA, 50 bp, homo sapien
gggctctctcatatttaattctctcracagtcttgtcttagacatattat

SEQ ID NO: 89866 - DNA, 50 bp, homo sapien
actcaagtccttcagctacgttcaartgagtgacctactcactcaaggca

SEQ ID NO: 89867 - DNA, 50 bp, homo sapien
accaagttctttccatttcaaagtcrcgtaatttttcttctttcacaggg

SEQ ID NO: 89868 - DNA, 50 bp, homo sapien
gttgaggaaactatactatacatgamatctcctgtggttttgtcagccag

SEQ ID NO: 89869 - DNA, 50 bp, homo sapien
atatgctggtatgtctgtatctaccyatcacggcatttgacttcagagag

SEQ ID NO: 89870 - DNA, 50 bp, homo sapien
atctgatctggtccatgttaactccragaagagtagtgtcttcttgtctt

SEQ ID NO: 89871 - DNA, 50 bp, homo sapien
ttctaatttgagctgccatcagttargtttagcagaaataattttcagca

SEQ ID NO: 89872 - DNA, 50 bp, homo sapien
ctcactcttgaatagatgtacagaawgctaattaaaagtttggttcagaa

SEQ ID NO: 89873 - DNA, 50 bp, homo sapien
tctcactatgcttcagtgagtagccmagttgaaacattcttatttaacac

SEQ ID NO: 89874 - DNA, 50 bp, homo sapien
ctattcagagccgtgaagtccaccaygatgggtaatgttaaaataaaaaa

SEQ ID NO: 89875 - DNA, 50 bp, homo sapien
cttttaattggtacatttgatcagtyaatatttctaagagttctgaccag

SEQ ID NO: 89876 - DNA, 50 bp, homo sapien
gtgtaatgatacctacaaatgcctcygcataccagacaaaagcaatctgt

SEQ ID NO: 89877 - DNA, 50 bp, homo sapien
attggagcatattgaagtttctccaygacagagtatcaggatccaagttc

SEQ ID NO: 89878 - DNA, 50 bp, homo sapien
ttgcaggcataggttttgtaaattayccagaatctttttgtctgcaagaa

SEQ ID NO: 89879 - DNA, 50 bp, homo sapien
tgattcctgagtgtttgctcacagakattattcaattaatcaccaatcat

SEQ ID NO: 89880 - DNA, 50 bp, homo sapien
taccttgtctttatcataaccatcaytaattactgaaatattaagcatat

SEQ ID NO: 89881 - DNA, 50 bp, homo sapien
atctaactcttaccaaataattaagracaccagcaacaacaatttggcac

SEQ ID NO: 89882 - DNA, 50 bp, homo sapien
tccttttcttgttataagcttgttcwgaattattattaaaagataaaccg

SEQ ID NO: 89883 - DNA, 50 bp, homo sapien
caacagtactatttctcgaagccccrccatgttctagctcagtcttcacc

SEQ ID NO: 89884 - DNA, 50 bp, homo sapien
tcaatattcaagtatcagtcaaaagsctccaggacttaatagtgaaagca

SEQ ID NO: 89885 - DNA, 50 bp, homo sapien
gctgcaggcacacgatcacacaaackagatacctgtctgggacactgcaa

SEQ ID NO: 89886 - DNA, 50 bp, homo sapien
tatgcaacaagatgtagaggaagaarttaagcctggagtgtgtgttatag

SEQ ID NO: 89887 - DNA, 50 bp, homo sapien
gagaggttaagtgcctgatctgagaygatacctctgctatatggtcatgg

SEQ ID NO: 89888 - DNA, 50 bp, homo sapien
tgcaatatctggggaaacgcaagtayaaagaaattggagagaaaggaaga

SEQ ID NO: 89889 - DNA, 50 bp, homo sapien
ctccaggactaaagagatgttgaacragataagggtgactactctcatca

SEQ ID NO: 89890 - DNA, 50 bp, homo sapien
ctttttcagacaatgtcagttatgcraggtaaaaactgtactgctgtgaa

SEQ ID NO: 89891 - DNA, 50 bp, homo sapien
ctggaaatcctagctaaaacaatcasataggagaaaaaaataaaaagcat

SEQ ID NO: 89892 - DNA, 50 bp, homo sapien
aaaggataaaggaaaaggaaatcccwatttatcatataaatcaaaggaag

SEQ ID NO: 89893 - DNA, 50 bp, homo sapien
gcacacacgagtagcatgaaattagscatgttcatattaaggagcaatct

SEQ ID NO: 89894 - DNA, 50 bp, homo sapien
ccttcaaatggggtgatgcacacacragtagcatgaaattagccatgttc

SEQ ID NO: 89895 - DNA, 50 bp, homo sapien
gtacctaggcaatgaggccacaatarcaaataagacacagacctgttttc

SEQ ID NO: 89896 - DNA, 50 bp, homo sapien
gtatttcttaacagagcataaaaaawtggtgttctccatgtgccatattt

SEQ ID NO: 89897 - DNA, 50 bp, homo sapien
gcctcctaagttcatgaaagcctgaracacttaaatgcttccagtcgtat

SEQ ID NO: 89898 - DNA, 50 bp, homo sapien
atgttatatggtaataagtactacaragaaaaaataaagcaaggaaaggg

SEQ ID NO: 89899 - DNA, 50 bp, homo sapien
actcctgtataccatcctaaaaatargaaatccacactaaatttgccaag

SEQ ID NO: 89900 - DNA, 50 bp, homo sapien
agacctggcagatgctactgtaactmagtgaccaaacttagcaacactga

SEQ ID NO: 89901 - DNA, 50 bp, homo sapien
cagagatgacatattcataagggaamcataacttgcaactaataagttaa

SEQ ID NO: 89902 - DNA, 50 bp, homo sapien
gggtggaaaaaagtttgtcttaagcycaattttgtgcaccagggaggaat

SEQ ID NO: 89903 - DNA, 50 bp, homo sapien
tagaaacttaatttaaatcaaggcastactacagaagattagaaaaaaga

SEQ ID NO: 89904 - DNA, 50 bp, homo sapien
ccacttaatagttacatggatattgscaagtagcctgagttctcagaggc

SEQ ID NO: 89905 - DNA, 50 bp, homo sapien
actttttatcgtatactgttttgcaytgaatttattttacatcatccttg

SEQ ID NO: 89906 - DNA, 50 bp, homo sapien
aaagaaggaaaacaatgaagccaagracagaagtgactggacagaccctg

SEQ ID NO: 89907 - DNA, 50 bp, homo sapien
cgtaattgattagtggaagttaaatmatgttaaggataggaggcttgtcc

SEQ ID NO: 89908 - DNA, 50 bp, homo sapien
caaaacttggagtcgtgatcatcagmaaacgtcattgaaaatttgatatt

SEQ ID NO: 89909 - DNA, 50 bp, homo sapien
attctttccagttccatatcttattyaattcctggccattcattgtaacc

SEQ ID NO: 89910 - DNA, 50 bp, homo sapien
atatgcacattgcaagatgagaaccmagtcattgaggaaatgcaacaaaa

SEQ ID NO: 89911 - DNA, 50 bp, homo sapien
aatacactagctttttcaaagtctaygcaaatgtgaatcagaaaagaaac

SEQ ID NO: 89912 - DNA, 50 bp, homo sapien
gaacaaacatatcaaagcactcaatracggtctctttaaaactttcccac

SEQ ID NO: 89913 - DNA, 50 bp, homo sapien
tataaggagactttatctgttctgtycctacagtgatttatgctcttgga

SEQ ID NO: 89914 - DNA, 50 bp, homo sapien
aaagagaaaaaaagaatccgtatagwcatattgaaagtatgaaaccacca

SEQ ID NO: 89915 - DNA, 50 bp, homo sapien
gatttctaatttaagaattgtatcawcttgaagtagtgtgaaatgtgaga

SEQ ID NO: 89916 - DNA, 50 bp, homo sapien
caaatgttttttcttgtatacaatcraagataatcagtcagatgagaaga

SEQ ID NO: 89917 - DNA, 50 bp, homo sapien
tgatcagctgaaagacaggctatgartaagagacatccagttatttttct

SEQ ID NO: 89918 - DNA, 50 bp, homo sapien
aaagaactgtatttttcaatccaaartgttcgaaatattgaaacatataa

SEQ ID NO: 89919 - DNA, 50 bp, homo sapien
caatcccgatgcatagttgagaatakgtactttgagtctctgttttctca

SEQ ID NO: 89920 - DNA, 50 bp, homo sapien
acaaactccttagtagtatgacttamaactttgaaaacttatcttacaac

SEQ ID NO: 89921 - DNA, 50 bp, homo sapien
aggctgtcagtatggcctgagggtgraaactagaacagaggactcaacag

SEQ ID NO: 89922 - DNA, 50 bp, homo sapien
aacaatgggatgaactatagtgggaycaaagagagagaataaaatctcag

SEQ ID NO: 89923 - DNA, 32 bp, homo sapien
tcaactagcaccacaawactttatcaaattaa

SEQ ID NO: 89924 - DNA, 50 bp, homo sapien
accttggaattttccatcatttaaamtccacctcctgaaggtagaaggca

SEQ ID NO: 89925 - DNA, 50 bp, homo sapien
aatcgtctgtactttatagcaactcraaagagaaacagaagtggcttggc

SEQ ID NO: 89926 - DNA, 50 bp, homo sapien
aacccaatatcctcaagattgggaakagtgtccggagtcaataagggagg

SEQ ID NO: 89927 - DNA, 50 bp, homo sapien
ccgattgtctgatatagaaaagatamgtttactatgtgttcctttgcatg

SEQ ID NO: 89928 - DNA, 50 bp, homo sapien
ctgtgtgagggtcaagaagaacctasaggactccacagaggcttttcatt

SEQ ID NO: 89929 - DNA, 50 bp, homo sapien
tttctgaccacttaactactccaacracttctaatggcaaggcttcttgg

SEQ ID NO: 89930 - DNA, 50 bp, homo sapien
cccaaaatagcctctaataataccawctgtaacctccttaatctcttagc

SEQ ID NO: 89931 - DNA, 50 bp, homo sapien
tggacttgtatctctccctcctgatyaagctggaagcccaaaatagcctc

SEQ ID NO: 89932 - DNA, 50 bp, homo sapien
cttgaacttttttgatcagatgtgayattctccatttttactggcattat

SEQ ID NO: 89933 - DNA, 50 bp, homo sapien
aatatttggtattgatattattgtcyattgatgaacactaagatttccag

SEQ ID NO: 89934 - DNA, 50 bp, homo sapien
tgggcagtggtgtcaggtctaaaacmgagtgggtggatcctcaatgagtc

SEQ ID NO: 89935 - DNA, 50 bp, homo sapien
ccctgagaattcagtggtgactttakgaattgtcctcagaaattctaaat

SEQ ID NO: 89936 - DNA, 50 bp, homo sapien
tctaggagttttctggttttgcattktaaattaaagtctatgacccattt

SEQ ID NO: 89937 - DNA, 50 bp, homo sapien
gagctaattaatggtggtgttttaamcttctaaatttgtggaaatttgtt

SEQ ID NO: 89938 - DNA, 50 bp, homo sapien
aggtggagtcaattattctaaggcaraaaggtattgaagaaaaatgcagg

SEQ ID NO: 89939 - DNA, 50 bp, homo sapien
gatggctctaatggagctgaagtccrcacaagggctgttcctctttaagt

SEQ ID NO: 89940 - DNA, 50 bp, homo sapien
atgtaagaatgttcaattttaatcayaataactctaaactggaaacagcc

SEQ ID NO: 89941 - DNA, 50 bp, homo sapien
ttccttgataatttcggtctactaawtagaatgtagtttttaaaaacctt

SEQ ID NO: 89942 - DNA, 50 bp, homo sapien
gagaactctttcattctatccttcartcaccttctatgttcatattaatc

SEQ ID NO: 89943 - DNA, 50 bp, homo sapien
ttttagggcttttaattagtcatacyttcccataattgttgagggaggaa

SEQ ID NO: 89944 - DNA, 50 bp, homo sapien
gtgtatacttgtctatgaactgcaamtatacacaaagatggattttaagg

SEQ ID NO: 89945 - DNA, 50 bp, homo sapien
tctttctccagggaagctcacatccrataacaggttgatctgggttaaaa

SEQ ID NO: 89946 - DNA, 50 bp, homo sapien
gccactgctcatggctaatacatagmacgcaaatgcattgcctttattgc

SEQ ID NO: 89947 - DNA, 50 bp, homo sapien
attgagtctaagaacttattgtgaasatttgaccagaaaagtgacaaaaa

SEQ ID NO: 89948 - DNA, 50 bp, homo sapien
gtgattttggggactgggtgctaaaytatcccattaggactgaaaatagt

SEQ ID NO: 89949 - DNA, 50 bp, homo sapien
ggtaatgttcttttattaataaagcraggaagcatccaggaaattgccta

SEQ ID NO: 89950 - DNA, 50 bp, homo sapien
cagtccatatgcctaaaattgagacygagaggaagtagataaggcaatgt

SEQ ID NO: 89951 - DNA, 50 bp, homo sapien
tgagcctaggattagtgactacaaakataaggaggtaaaaacaaaagaag

SEQ ID NO: 89952 - DNA, 50 bp, homo sapien
actttgaaatgcaaattaagattgaygaatatagagagacagaggggtag

SEQ ID NO: 89953 - DNA, 50 bp, homo sapien
tataaaagcagaaatataccagcaaygctcacaacatctgcaacgacctc

SEQ ID NO: 89954 - DNA, 50 bp, homo sapien
ctgaccaaatctaagagtcaaatccwctaatatttagaaccttttgccca

SEQ ID NO: 89955 - DNA, 50 bp, homo sapien
ctaatagatgacagatagatgacagrataagaaacaagaatgttttgggg

SEQ ID NO: 89956 - DNA, 50 bp, homo sapien
taatacatgctacaacattgataaaycttgaaaatattattccaagtgaa

SEQ ID NO: 89957 - DNA, 50 bp, homo sapien
acttaatttaactgtctttcgactcratttctctcaattaaagaagagaa

SEQ ID NO: 89958 - DNA, 50 bp, homo sapien
tgatcttaattcctgccaaagaaaaratgaagtgtatatactagctgagg

SEQ ID NO: 89959 - DNA, 50 bp, homo sapien
gtgatgagataaggctagtgaaaatrataggtctaatatttcatgcctaa

SEQ ID NO: 89960 - DNA, 50 bp, homo sapien
accttttatagaaatatctagaatascatcagtaaatatcttgtaccacg

SEQ ID NO: 89961 - DNA, 50 bp, homo sapien
gtgagcacaaagatatgaagttgtartaagttatcagtgctgcacacaac

SEQ ID NO: 89962 - DNA, 50 bp, homo sapien
cctctgtctgattaacatgcagattygttttcacccttgagtttttattt

SEQ ID NO: 89963 - DNA, 50 bp, homo sapien
ctcctcttacagggccaagaactacrgaaactttcaatttagtcccccat

SEQ ID NO: 89964 - DNA, 50 bp, homo sapien
ttcttatcaactttgaactggagaaygatcagagataatgcttacttctt

SEQ ID NO: 89965 - DNA, 50 bp, homo sapien
cacttgaggcaactagcctattaaawctgaaatcaataaacactttcttc

SEQ ID NO: 89966 - DNA, 50 bp, homo sapien
tacaatggacttaatgatggttaaawggaactggtgaagaaattagcaaa

SEQ ID NO: 89967 - DNA, 50 bp, homo sapien
actctaaattacttaattatgacacraggtgaaatgatacaagtagaggc

SEQ ID NO: 89968 - DNA, 50 bp, homo sapien
ggaacactagagcagaaacaggttgraatcaatgtgtcctttggggtttg

SEQ ID NO: 89969 - DNA, 50 bp, homo sapien
ggggtttggttaggaaaagagagtcrctaaaaacattgcaggaaaaaaag

SEQ ID NO: 89970 - DNA, 50 bp, homo sapien
ttgagtaagctctaattcctctatgragtgctttttttcctgcaatgttt

SEQ ID NO: 89971 - DNA, 50 bp, homo sapien
aatggccattcatcacagaagaaacygtaatcataaaatgaacaattttc

SEQ ID NO: 89972 - DNA, 50 bp, homo sapien
tgaaacttggtttcatatacctccarttgtaaacacctaaatgattgggt

SEQ ID NO: 89973 - DNA, 50 bp, homo sapien
aacctgcatctttgctagcaggctgyattgaaacccacatagctcacatg

SEQ ID NO: 89974 - DNA, 50 bp, homo sapien
atggtttcccaaaaacatgactgacmatgggagcctcagaagtctctacg

SEQ ID NO: 89975 - DNA, 50 bp, homo sapien
tatgggctgaaaacatacataaaacygctataacattattttaaatgtct

SEQ ID NO: 89976 - DNA, 50 bp, homo sapien
tcttacttcttcttcccctgattaasgagaacactctacaccaagacaca

SEQ ID NO: 89977 - DNA, 50 bp, homo sapien
cctaggctgcttcctctgagataackggccatggataccagggacacagc

SEQ ID NO: 89978 - DNA, 50 bp, homo sapien
attgattctctcatctatccaacaaytgacgtaagattctaaagaagcac

SEQ ID NO: 89979 - DNA, 50 bp, homo sapien
agctgactgagtaaagtatatttagytcatttccaaatgaccaggcttta

SEQ ID NO: 89980 - DNA, 50 bp, homo sapien
taccaaacatttaaagacctaatacmaattctactcaaactgttcagaaa

SEQ ID NO: 89981 - DNA, 50 bp, homo sapien
aagaagacatttgcgaatgttttcargatgcattgtacaagatactgttt

SEQ ID NO: 89982 - DNA, 50 bp, homo sapien
ccttggcttaccatcttgttttccaygtacccaccttcagcagacaatct

SEQ ID NO: 89983 - DNA, 50 bp, homo sapien
agttgcaacgacatagcttggttcayactgaaataaatgtttcattgggt

SEQ ID NO: 89984 - DNA, 50 bp, homo sapien
atactcttggaagtcatattatccaygttaggttagatgcaaaggttaga

SEQ ID NO: 89985 - DNA, 50 bp, homo sapien
gaagcctatagtatttgtctcatacmagaagagtattggtagaggaagta

SEQ ID NO: 89986 - DNA, 50 bp, homo sapien
tttatcataccagtgacctaaaggamataagaccagctttacaccaatca

SEQ ID NO: 89987 - DNA, 50 bp, homo sapien
ttcacagctgaaatcttgttctgacrgagagcaggaattaatcaaaactt

SEQ ID NO: 89988 - DNA, 50 bp, homo sapien
atgtgtcagatgtagccaacgaattrtgtcagaagcagagagaaaaggcc

SEQ ID NO: 89989 - DNA, 50 bp, homo sapien
tattttctgagtaagatattaggctkccatatgatccagagatgcaaaga

SEQ ID NO: 89990 - DNA, 50 bp, homo sapien
acctcaaaggtagtctcaaaatccayaattatactaactgaacacagaga

SEQ ID NO: 89991 - DNA, 50 bp, homo sapien
gcttttataacatattgctaaaaaaygtcatacttgatgaagtcattcaa

SEQ ID NO: 89992 - DNA, 50 bp, homo sapien
caaaaactgagacagcagcatttgcragatacaggaaagaatagggctcg

SEQ ID NO: 89993 - DNA, 50 bp, homo sapien
cattgacccaatcctcagtgcattamgaggacaagaagatagagagggtg

SEQ ID NO: 89994 - DNA, 50 bp, homo sapien
tccttcttgaacacgatttgttcccycatcaaagtggaaacatgtcagta

SEQ ID NO: 89995 - DNA, 50 bp, homo sapien
tctccttctctgagtctgattctcayaaatggcctagcatactcttctat

SEQ ID NO: 89996 - DNA, 50 bp, homo sapien
tgaaattgaatccaccttgtaaatcyaatccctagagctttggtaaccat

SEQ ID NO: 89997 - DNA, 50 bp, homo sapien
atagatttaaaaaaacaatgtatgayatgagaccctttccttcaagaggc

SEQ ID NO: 89998 - DNA, 50 bp, homo sapien
ttatgcatttgttaaaacccatagamtatacaacatgatagtgagcctta

SEQ ID NO: 89999 - DNA, 50 bp, homo sapien
aggtgagatatgggcaaaggcgtaargaggtgagaaagtgagctaagggg

SEQ ID NO: 90000 - DNA, 50 bp, homo sapien
taatgacagcatgataaaaggtacasgaaaagaggcacagtgtattctaa

SEQ ID NO: 90001 - DNA, 50 bp, homo sapien
ttattttctcctatgtatatctctaygcttactgccaagactagcatttt

SEQ ID NO: 90002 - DNA, 50 bp, homo sapien
tggggaaagtttctagttatctgtcraatcccacattcttggcctaacac

SEQ ID NO: 90003 - DNA, 50 bp, homo sapien
gctgagtctagagaagtaatcctacrcaccttacttcacgtgaactgccc

SEQ ID NO: 90004 - DNA, 50 bp, homo sapien
ctcacagggcaaataagatgtactastagagagccaggcaagataaaaat

SEQ ID NO: 90005 - DNA, 50 bp, homo sapien
gagcatttagagaaatgcttattgtwaattctaaagagaaggtcagttgg

SEQ ID NO: 90006 - DNA, 50 bp, homo sapien
atcagggcacaagtgactttcatcarggttgaaactggcagaagaaaaag

SEQ ID NO: 90007 - DNA, 32 bp, homo sapien
atcttaaatgccacaayaagaatgattagtga

SEQ ID NO: 90008 - DNA, 50 bp, homo sapien
cttgaactccagacatctagtgccaytttccactccagcaactcacacca

SEQ ID NO: 90009 - DNA, 50 bp, homo sapien
tccagttctttaattgttaattttaycttagattcctagactggtaaccc

SEQ ID NO: 90010 - DNA, 50 bp, homo sapien
gatgaaaatctgccttctgtctttayagagttcttgagtcagaaaaatta

SEQ ID NO: 90011 - DNA, 50 bp, homo sapien
taagactattaacaaggacttagcayagtagagcaatttgagtggcaata

SEQ ID NO: 90012 - DNA, 50 bp, homo sapien
cctttaagattgttaacaaaggtcartaaacatcatttgattgttttttc

SEQ ID NO: 90013 - DNA, 50 bp, homo sapien
ctagagggtgtcactgatcctcacartagggaatgacatcactgcccctg

SEQ ID NO: 90014 - DNA, 50 bp, homo sapien
aatcaccattttttggaaagatataygaatgcattttaaaagtataggga

SEQ ID NO: 90015 - DNA, 50 bp, homo sapien
aaaaagaaatagagcatcttctttayggtgaatttctatgttaagaaaag

SEQ ID NO: 90016 - DNA, 50 bp, homo sapien
tgcttatttgcctgtcatgcataggyatttgatctcacaaaaggcctgtg

SEQ ID NO: 90017 - DNA, 50 bp, homo sapien
cagattaagggttttgttaggtagasattatgatgccatattttaatgta

SEQ ID NO: 90018 - DNA, 50 bp, homo sapien
tgttgttaattctatactaaataaaygcttggagtgcggagctgctcagg

SEQ ID NO: 90019 - DNA, 50 bp, homo sapien
ttctgtagtgaggcagtgctcctttygcgagggcattagctgcggggagt

SEQ ID NO: 90020 - DNA, 50 bp, homo sapien
gacttctagcctaaactgaactccarattcatatataaaattatctccac

SEQ ID NO: 90021 - DNA, 50 bp, homo sapien
ttcaggtatattgaataagctcaackattaaacatatttattttatcatt

SEQ ID NO: 90022 - DNA, 50 bp, homo sapien
atttagttcccctatatattaaacakaacagggcccatgagcagttttta

SEQ ID NO: 90023 - DNA, 50 bp, homo sapien
aaaatacaaatctactacctagagastacaataatatggaaatgattcat

SEQ ID NO: 90024 - DNA, 50 bp, homo sapien
gggagaacagtggatttggagggacraagtagaaagttctagaacacggg

SEQ ID NO: 90025 - DNA, 50 bp, homo sapien
cctgttatgtttaatatataggggawctaaatgaaaacaacaaaatagcc

SEQ ID NO: 90026 - DNA, 50 bp, homo sapien
gaataacctggcccctctcttcagaygcatgggtacttactcttttgtcc

SEQ ID NO: 90027 - DNA, 50 bp, homo sapien
atttcaagtgatcaaaatcatttacrcatacctcctgaaaatatgcagag

SEQ ID NO: 90028 - DNA, 50 bp, homo sapien
gagccaatttgttattgtcctaagargaatttgcataaattcaaaagaca

SEQ ID NO: 90029 - DNA, 50 bp, homo sapien
gaaacaataactttagcttgctctaygatgaatgttcaaataagtcaagt

SEQ ID NO: 90030 - DNA, 50 bp, homo sapien
tgactactgcaaaacacaccctaccrctataaagcttcacaaatttagga

SEQ ID NO: 90031 - DNA, 50 bp, homo sapien
agctctttgtaacacatttccagtcrctaatgctcaaatgtagaacattc

SEQ ID NO: 90032 - DNA, 50 bp, homo sapien
tccttgaaacacttgaacacttgatkactttagctttgaggagataccat

SEQ ID NO: 90033 - DNA, 50 bp, homo sapien
aatgtattataatattaatttctatragattccagatggtgtctttccat

SEQ ID NO: 90034 - DNA, 50 bp, homo sapien
ctctaggcattagtcattatgtctayagttttaacaacgttaatatttaa

SEQ ID NO: 90035 - DNA, 50 bp, homo sapien
atattataataacacatagttaggtwaaaactctctctcttttttttttt

SEQ ID NO: 90036 - DNA, 50 bp, homo sapien
ctgatacagtagaggagttaaactartaatttgcccatcaaaattatgga

SEQ ID NO: 90037 - DNA, 50 bp, homo sapien
ctcacaaggccaattccacaaaaagkcttaatgtcttctgttcctttgct

SEQ ID NO: 90038 - DNA, 50 bp, homo sapien
agtggttacaagcattggcgtagacyatcttgtgtaaaggtgaagggtca

SEQ ID NO: 90039 - DNA, 50 bp, homo sapien
tttcttgaatcatgtttgcgaactcraagaatgggcaggggaaaaacaag

SEQ ID NO: 90040 - DNA, 50 bp, homo sapien
tagcctaggtgtgaagtcagctataycatctgggtgtgtggaagtacatt

SEQ ID NO: 90041 - DNA, 50 bp, homo sapien
atcacaccttctccaattattttcarcctaccagcaaacacttctataac

SEQ ID NO: 90042 - DNA, 50 bp, homo sapien
tatagctactttggaaggccatttgrcataacaaaaactagatattctct

SEQ ID NO: 90043 - DNA, 50 bp, homo sapien
acaacactaaaagcacaatttatgamaaaagaaattggtaagttgtagtt

SEQ ID NO: 90044 - DNA, 50 bp, homo sapien
aaaagattaatgactgttgagtgtaratgtttagtatggcttccatccta

SEQ ID NO: 90045 - DNA, 50 bp, homo sapien
ccttacggctgtaagaacacattgamcagtggctacagaaaattctgggt

SEQ ID NO: 90046 - DNA, 50 bp, homo sapien
tcacaagactctaaaaagataggaaytaagaaaactacaggacaatgaag

SEQ ID NO: 90047 - DNA, 50 bp, homo sapien
tttcatgtgctcaagtttttatgtaygcaattcttgctaacaacaaggtg

SEQ ID NO: 90048 - DNA, 50 bp, homo sapien
atgacaactatgtaggaagcagataygaaactcctcctggttttcactac

SEQ ID NO: 90049 - DNA, 50 bp, homo sapien
gatttctttttttaacctttatgacratcctggtttctttgctcttctct

SEQ ID NO: 90050 - DNA, 50 bp, homo sapien
aataagaaaacttctgcaaaaataaygtcaatgctttttctgtaaggtaa

SEQ ID NO: 90051 - DNA, 50 bp, homo sapien
taatgaagacataagcaagccaagasagttatctaagttgaaaagtttgg

SEQ ID NO: 90052 - DNA, 50 bp, homo sapien
ctaaacccaacatgttatttgtaaaygagaggaggtatggcccctttttc

SEQ ID NO: 90053 - DNA, 50 bp, homo sapien
aacatctgactggttgtgtaaaacgmccaatcagaggctgaagttacaaa

SEQ ID NO: 90054 - DNA, 50 bp, homo sapien
agaataagtgcgtgcccaacagcaaygagagatactacggctacactggg

SEQ ID NO: 90055 - DNA, 50 bp, homo sapien
ctcattttaaagctgctaagtgtcaygtagtattgctgtactctcctttt

SEQ ID NO: 90056 - DNA, 50 bp, homo sapien
tgtttggggcccataactcaggaaaygtgatggcacctaatttcagagtg

SEQ ID NO: 90057 - DNA, 50 bp, homo sapien
atgccacctatagagaccatatatcmaagcttccaaatttttcttgattt

SEQ ID NO: 90058 - DNA, 50 bp, homo sapien
cttctgtttttctactttttaaatgwaagtgtctatagtggtgcttcttt

SEQ ID NO: 90059 - DNA, 50 bp, homo sapien
atcagactcaccaaagcttgatctakgctatcagacttttcaaggaacca

SEQ ID NO: 90060 - DNA, 50 bp, homo sapien
ctctgtggctgttctttatgctctcygaaccttcttccttttacataaga

SEQ ID NO: 90061 - DNA, 50 bp, homo sapien
gttttcttctttctatccagctgttmtttttgtatgtgggaatttggagc

SEQ ID NO: 90062 - DNA, 50 bp, homo sapien
aaactttttgtgatatagtccttaayctcacattgaagatgcatctttta

SEQ ID NO: 90063 - DNA, 50 bp, homo sapien
cagctcatggcaggcacctcctaaaktcatatgagtttgtgctagcttta

SEQ ID NO: 90064 - DNA, 50 bp, homo sapien
gcttccacttgggagtttgtagaaayacctagatttgcagggagggagtt

SEQ ID NO: 90065 - DNA, 50 bp, homo sapien
caaaatgtaaattctttggaaactaraggactcaaatcagaaaaacattg

SEQ ID NO: 90066 - DNA, 50 bp, homo sapien
cttccggatgtgctgtcgtttcaacrctggctttcattttctgtagcttt

SEQ ID NO: 90067 - DNA, 50 bp, homo sapien
tgatcttactgtaggtattttcataragccaagctgtccaggctctgcat

SEQ ID NO: 90068 - DNA, 50 bp, homo sapien
atctttcaaattctttcttctcatcmaatggactgggttttgtctggcct

SEQ ID NO: 90069 - DNA, 50 bp, homo sapien
ctagtatagaaaaatccatctatacratatgactttaaattatttctcat

SEQ ID NO: 90070 - DNA, 50 bp, homo sapien
agcctccagagagcttaatgtctcayaggcaaaaaaataggctactcaag

SEQ ID NO: 90071 - DNA, 50 bp, homo sapien
cggacaacctgagcaagacagtatascaggttccaatcacatgcttggtg

SEQ ID NO: 90072 - DNA, 50 bp, homo sapien
ctttgggtgcccattctataaatgamgatgatgctgtgctggtcccccga

SEQ ID NO: 90073 - DNA, 50 bp, homo sapien
tacttcatatgaagtcaacatgctcygaatttatgagtatgattataccc

SEQ ID NO: 90074 - DNA, 50 bp, homo sapien
tgtacatctgaacgagttttcacatrtgcatatacccctgtaaccaccac

SEQ ID NO: 90075 - DNA, 50 bp, homo sapien
gacaccctcttctgattttactatcratctcatgctaaccttgtctaccc

SEQ ID NO: 90076 - DNA, 50 bp, homo sapien
gaacagctggtagcgttaatgcttgrtgtatccgaaccagacctgatctt

SEQ ID NO: 90077 - DNA, 50 bp, homo sapien
aagaaaagcttattaaaatcaattamgagataccaagaggcttcagcatt

SEQ ID NO: 90078 - DNA, 50 bp, homo sapien
attaaatagcacatatcctcaaaatraaaatggctttgaaaacataccga

SEQ ID NO: 90079 - DNA, 50 bp, homo sapien
ggataaatcatcaagagccacaagayctacctgggtcagcagacctacat

SEQ ID NO: 90080 - DNA, 50 bp, homo sapien
aaactgcctaatgatgtgtatctcaraacagattgccgtagttacgtaat

SEQ ID NO: 90081 - DNA, 50 bp, homo sapien
gcaaaggagatattcgacatacttargacaagaaatgaaagggttcagat

SEQ ID NO: 90082 - DNA, 50 bp, homo sapien
cagttttatcattgtgtgaataccayagcttgtacttacacaaatctaga

SEQ ID NO: 90083 - DNA, 50 bp, homo sapien
tgtacctgagtcagggcctctaaacrgattctaataccaagaatcaggta

SEQ ID NO: 90084 - DNA, 50 bp, homo sapien
actgcttatggcattccagacaagayatttttttacagtcttaaagggct

SEQ ID NO: 90085 - DNA, 50 bp, homo sapien
ggtcttgcctttaagcttaagaaagygatctcaggaagcacattaggcag

SEQ ID NO: 90086 - DNA, 50 bp, homo sapien
aagtattcatcccacacttggggaaytgaactagaccatcataatcctgc

SEQ ID NO: 90087 - DNA, 50 bp, homo sapien
aaaggcagagaaaggacaaataatayaagagaaaaagaagacgaatcata

SEQ ID NO: 90088 - DNA, 50 bp, homo sapien
caatactgaaaaagataaaagtggasactcttccataattgaaagcagac

SEQ ID NO: 90089 - DNA, 50 bp, homo sapien
ttgctgcagttgaaaggtgactaccrgcctattctacaatgaagaggtgt

SEQ ID NO: 90090 - DNA, 50 bp, homo sapien
ttctcttcctgaaattaattacccartgctgagtggaacaatgggataca

SEQ ID NO: 90091 - DNA, 50 bp, homo sapien
catattctcttctaatcttggtattkttcatcaattttaattttagccat

SEQ ID NO: 90092 - DNA, 50 bp, homo sapien
tatcaattaggtcaagttggctgaakttattaaccaatctaaatataatc

SEQ ID NO: 90093 - DNA, 50 bp, homo sapien
aaaactttagaatctgttagaaaaayctgtaattcaagatggatgttttt

SEQ ID NO: 90094 - DNA, 50 bp, homo sapien
atggaataacataatttcttaaggaygtagactttcagacactgcttata

SEQ ID NO: 90095 - DNA, 50 bp, homo sapien
agatcatttaataattgttctcggtraaaatagacacaaaaagtacacat

SEQ ID NO: 90096 - DNA, 50 bp, homo sapien
taggagctcttgtataagcagtgtckgaaagtctacgtccttaagaaatt

SEQ ID NO: 90097 - DNA, 50 bp, homo sapien
gatggattttaagattaggtatttcragaaataggaaaggaagctgccca

SEQ ID NO: 90098 - DNA, 50 bp, homo sapien
tccaaccccttccttatttctcacaycaggatatccccatacgaggaaaa

SEQ ID NO: 90099 - DNA, 50 bp, homo sapien
gcagagtgttgatacaatgcgaagcsctaggttgccgggaggatgggcta

SEQ ID NO: 90100 - DNA, 50 bp, homo sapien
atctatctatctatcattatctttcratctcctccatatgatctctcccc

SEQ ID NO: 90101 - DNA, 50 bp, homo sapien
atggatacagagagaaatgtacttaycaactcttgggtagataaaaagat

SEQ ID NO: 90102 - DNA, 50 bp, homo sapien
aacgtatattcctttgacctcttcayatagtattctgaaactcatggcat

SEQ ID NO: 90103 - DNA, 50 bp, homo sapien
accagggaggtgccacaaattagatsaaaatgtgaaaattgagcagactg

SEQ ID NO: 90104 - DNA, 50 bp, homo sapien
catgcagggctaggctctgctgcatrtaacaagcctgtcattcagaaacc

SEQ ID NO: 90105 - DNA, 50 bp, homo sapien
caagcagattccctaagatgataaayagagcactttatgagaggtatgaa

SEQ ID NO: 90106 - DNA, 50 bp, homo sapien
ccctggttggcatttatgctgtctaycacctactgaagccaattccatgt

SEQ ID NO: 90107 - DNA, 50 bp, homo sapien
ataattagatttgggtttaaattcaktaagtaggcacagttgtatctagt

SEQ ID NO: 90108 - DNA, 50 bp, homo sapien
ccccagggcagtacaaaagccttcawtaacaagagtgggaaaaggaggcc

SEQ ID NO: 90109 - DNA, 50 bp, homo sapien
aaacttggtttaaaaacctgaagctragcaacctctccaaataaacatga

SEQ ID NO: 90110 - DNA, 50 bp, homo sapien
tctatgagaaagaaatattaagtaayactgcatgtctgacattgacatga

SEQ ID NO: 90111 - DNA, 50 bp, homo sapien
tcccaaagcgtaaccacaacatgacrcaggatgaggtagctttgaaaatg

SEQ ID NO: 90112 - DNA, 50 bp, homo sapien
ctagatgatcaaagtgccccaatacyggaagaggatttatatacctatgg

SEQ ID NO: 90113 - DNA, 50 bp, homo sapien
ttcactgtcccaacgccacctccctyaggaacgccgtcagtcttgccttc

SEQ ID NO: 90114 - DNA, 50 bp, homo sapien
tcctggtaaaatcaagagatgattaraagtaattaatggatacttctcaa

SEQ ID NO: 90115 - DNA, 50 bp, homo sapien
cattttgctagttatatatccttcastatttttatctctttgccccagct

SEQ ID NO: 90116 - DNA, 50 bp, homo sapien
gttcacatgtcatcaagattgaaagraacaatattcaaggaggtgcacct

SEQ ID NO: 90117 - DNA, 50 bp, homo sapien
gttcataaataatttaaaatatacaragttctggcttttcaacagagatt

SEQ ID NO: 90118 - DNA, 50 bp, homo sapien
acgtccattcctttaccagcattacygagccactagtgtattcaccctct

SEQ ID NO: 90119 - DNA, 50 bp, homo sapien
ctgtgatgtggtctccatcatgtccrctttttaaggctacataggcagag

SEQ ID NO: 90120 - DNA, 32 bp, homo sapien
ttcaaactcaaactggmatccataccattggc

SEQ ID NO: 90121 - DNA, 50 bp, homo sapien
catatatttatcccaacctctctackcgatgaaatagctgtgacatccat

SEQ ID NO: 90122 - DNA, 50 bp, homo sapien
tccttggtggcctggtatggggtcartctttaaatattccattgagtctt

SEQ ID NO: 90123 - DNA, 50 bp, homo sapien
acaacacagcatggaactgtgtcacragtgttagaaatgcaagcagaaac

SEQ ID NO: 90124 - DNA, 50 bp, homo sapien
taaaataacttgaacaattcaaactsagtatattatgtaaatatctacct

SEQ ID NO: 90125 - DNA, 50 bp, homo sapien
aaaggagatgtgatttacctgagatyagaacagtttttctagatggttgt

SEQ ID NO: 90126 - DNA, 50 bp, homo sapien
aaaagatagatgccaattatagaacmaaatttaagaaaactgttctaaat

SEQ ID NO: 90127 - DNA, 50 bp, homo sapien
aggctactttgttttataatatgtamctctgaggaagtcaaatattttta

SEQ ID NO: 90128 - DNA, 50 bp, homo sapien
aacagctgagtgctatttagattctyaagtaggactgagagctgaaatgc

SEQ ID NO: 90129 - DNA, 50 bp, homo sapien
gtggctgcagagtctgtgtgataccrcctttcggactgatgatcaaggaa

SEQ ID NO: 90130 - DNA, 50 bp, homo sapien
tttctgggaattccttccaagcagcrgaatcaaagggtagatgggttgag

SEQ ID NO: 90131 - DNA, 50 bp, homo sapien
ggcacgccccaaaaaattatcaactsaataaaacacacaagggagcagga

SEQ ID NO: 90132 - DNA, 50 bp, homo sapien
ccacccccctgctccagctactacartcattttgtacaactccttcctgc

SEQ ID NO: 90133 - DNA, 50 bp, homo sapien
ggtctgtatcattttctactttgtayggcaatcacatatatatctaatct

SEQ ID NO: 90134 - DNA, 50 bp, homo sapien
atgctctgatcatcggccaacatcartattttccaagaaccctgaccaaa

SEQ ID NO: 90135 - DNA, 50 bp, homo sapien
agatcaaagactccggctcattgtaygtacaggcattattaaacatcatg

SEQ ID NO: 90136 - DNA, 50 bp, homo sapien
attgggtactgagtaggttaagaagycaataggcagagatttgtcccagc

SEQ ID NO: 90137 - DNA, 50 bp, homo sapien
acgtattttctatatgtatcaaataytaaactcctaaaacaaggtgggtt

SEQ ID NO: 90138 - DNA, 50 bp, homo sapien
atttaaactaccacctgaggagtaaytctttttcctgagattggctagta

SEQ ID NO: 90139 - DNA, 50 bp, homo sapien
tctccattcgacctcctctgacactrttttatcaaggagagggaggtgta

SEQ ID NO: 90140 - DNA, 50 bp, homo sapien
aaggagcctgagaaggacagctagtkaagtaggaagagaatgaagagcat

SEQ ID NO: 90141 - DNA, 50 bp, homo sapien
ctagaagaaaaataacattaattttrtctgcagcatcctttgaaaatgtt

SEQ ID NO: 90142 - DNA, 50 bp, homo sapien
ttcactctgtctttaaagttttgcaytagaaatgggcttcagggtcttct

SEQ ID NO: 90143 - DNA, 50 bp, homo sapien
agatttcttgggccactggcaaatayaataagaacagcataataggatgt

SEQ ID NO: 90144 - DNA, 50 bp, homo sapien
aatattatagatgtaaggagacagayttgccctactctctgttcatgcct

SEQ ID NO: 90145 - DNA, 50 bp, homo sapien
ccttattattaagctggggacacaakattatagatgtaaggagacagatt

SEQ ID NO: 90146 - DNA, 50 bp, homo sapien
tggacagataagaacagtcgacttayaagcagcttctcagaagaggtaca

SEQ ID NO: 90147 - DNA, 50 bp, homo sapien
tagcgtgacagtcagaaaccgaccaycggagtgatattctcttatgtaaa

SEQ ID NO: 90148 - DNA, 50 bp, homo sapien
gggataagaggcatttccaagtaaamgtagctgccactcaagacacttat

SEQ ID NO: 90149 - DNA, 50 bp, homo sapien
atgaaattttcacttcatagaatcaygtacgcctttttgaacactccaac

SEQ ID NO: 90150 - DNA, 50 bp, homo sapien
ccatcatctaggaaactgagattccragggtatagtgattgtttgcaaaa

SEQ ID NO: 90151 - DNA, 50 bp, homo sapien
tttcatagtctcctccaaaccatagmcttcgtagtatgtattgacttggc

SEQ ID NO: 90152 - DNA, 50 bp, homo sapien
atggcacaaagacaccataggtaagracatttcacctgacttggcctctt

SEQ ID NO: 90153 - DNA, 50 bp, homo sapien
aatacctgttgaatgaataaagaaaytgagccataatccagggtcaccta

SEQ ID NO: 90154 - DNA, 50 bp, homo sapien
aactgtgacaaagccagcaagtaatsatagtccaaatactgttcaacact

SEQ ID NO: 90155 - DNA, 50 bp, homo sapien
gaggctggctgccaaaagggacgtcratgtagatggtgtcaggatattga

SEQ ID NO: 90156 - DNA, 50 bp, homo sapien
ggtctctcctgctttgattttagtamaagtggactctgccattctctgcc

SEQ ID NO: 90157 - DNA, 50 bp, homo sapien
tgaacagagcagtcccaggaaggagrtatgtgagagtgttaaaaatatgc

SEQ ID NO: 90158 - DNA, 50 bp, homo sapien
cacattcgacagtcttcatccataakgcatgaggccggagacccgtaaaa

SEQ ID NO: 90159 - DNA, 50 bp, homo sapien
caggtcctccaggtctgagctcaaasatcccaaggtcaaatgtcaatgcc

SEQ ID NO: 90160 - DNA, 50 bp, homo sapien
aggcagctggaataagaaggtgtcaytgaactagtattatgtaataccta

SEQ ID NO: 90161 - DNA, 50 bp, homo sapien
aaaaggaggggcaaaaatatactgaycataagggtttatacaattactgt

SEQ ID NO: 90162 - DNA, 50 bp, homo sapien
aaatggcctaggtgccattcctagaygggaaactgaaacaaatgtgcaat

SEQ ID NO: 90163 - DNA, 50 bp, homo sapien
ccaaagggttaatattcaatgaaccragagaccaaatagaagaaattaaa

SEQ ID NO: 90164 - DNA, 50 bp, homo sapien
catagagccagagataagtgaagtcrgaaatatcgaaaaggggccatgag

SEQ ID NO: 90165 - DNA, 50 bp, homo sapien
gtgggcccaagctcaaacgcccccaygaagcgaagcagcagggggtaggc

SEQ ID NO: 90166 - DNA, 50 bp, homo sapien
cagagccatgtcaggttctggtcaargtcctattctaaggtccagagctg

SEQ ID NO: 90167 - DNA, 50 bp, homo sapien
taggtgtgaggtccaagtccaaggtycacatcaaagttctcatagccata

SEQ ID NO: 90168 - DNA, 50 bp, homo sapien
agccggttaagcttcttgggctataycttccaaggcacgaacaacatacg

SEQ ID NO: 90169 - DNA, 50 bp, homo sapien
atcttccaaggcacgaacaacatacrgaaattaatgactgtctctaccct

SEQ ID NO: 90170 - DNA, 50 bp, homo sapien
agtgatactactttatttcaagactyactctaaagctacagtagtcaaga

SEQ ID NO: 90171 - DNA, 50 bp, homo sapien
aaacagcatttagttttggtgctccrctctagtatatgtttaccctctat

SEQ ID NO: 90172 - DNA, 50 bp, homo sapien
aaaagttgtcatcagaaaagtgagamattttattgtgagaattcagtggt

SEQ ID NO: 90173 - DNA, 50 bp, homo sapien
gtcttagtcataaagacagttctcaygaagcaccactttagggttgtgaa

SEQ ID NO: 90174 - DNA, 50 bp, homo sapien
acacactttctgacatactagttaaytcctacataccaaatatgtgagat

SEQ ID NO: 90175 - DNA, 50 bp, homo sapien
gaagttacgttgtcattttggccacrgtcagaatcccttcaccagggtct

SEQ ID NO: 90176 - DNA, 50 bp, homo sapien
accagaaacacaaaagtggagtaacrcacactgcaaagctgtgcttcctt

SEQ ID NO: 90177 - DNA, 50 bp, homo sapien
cttgttggctaacactttaaattgawtatcagcaagaaaaactcctgagg

SEQ ID NO: 90178 - DNA, 50 bp, homo sapien
ggactgtggcagtggccagttagctraagaggttcaggcacaccttggtg

SEQ ID NO: 90179 - DNA, 50 bp, homo sapien
acttcccgacctgctcctttcatacygccttacattttacttactgccca

SEQ ID NO: 90180 - DNA, 50 bp, homo sapien
atctctgctgtcagggacaacttaawcttttgaatccatattttcatagc

SEQ ID NO: 90181 - DNA, 50 bp, homo sapien
catttatttagtgtagaattaacaayggaagctttgagtcaacacacttg

SEQ ID NO: 90182 - DNA, 50 bp, homo sapien
aaaagaaaatggaagaataatccaaygatatatacaacttttttttaatt

SEQ ID NO: 90183 - DNA, 50 bp, homo sapien
gtcttcttcaccctcatgtctgatcratgaccatgggttgagagatttta

SEQ ID NO: 90184 - DNA, 50 bp, homo sapien
tgtaattaattcagcaaggcatgacrcaccagccattttacagatgagga

SEQ ID NO: 90185 - DNA, 50 bp, homo sapien
aaactgttaactgtgttgaggagaamcgactgatacatcttcgcatgaaa

SEQ ID NO: 90186 - DNA, 50 bp, homo sapien
tctattctaagtgagaaaaccaataraactaagataggacattgctagag

SEQ ID NO: 90187 - DNA, 50 bp, homo sapien
gttcaccttcactctgccatagtcaycttgcacatttcttttccttgaat

SEQ ID NO: 90188 - DNA, 50 bp, homo sapien
ttggctgagggccaaggaacctctgygaatgaagcacttccctatttttt

SEQ ID NO: 90189 - DNA, 50 bp, homo sapien
attgctgtttcacacagagtttgaayggttagggattttacagatttccc

SEQ ID NO: 90190 - DNA, 50 bp, homo sapien
aacctggagtgagttgtaacttaaartgttagtgttgcatgaagtgtgtt

SEQ ID NO: 90191 - DNA, 50 bp, homo sapien
ttgcagtaaggcgttggaatgaaacyatactctgtttgttctctagctca

SEQ ID NO: 90192 - DNA, 50 bp, homo sapien
gctagacatgaaattcttcataaacstgacctggacggtgtgaggaggag

SEQ ID NO: 90193 - DNA, 50 bp, homo sapien
gtttccttgcctattcatataaatcratgttctgaatgactgcatagtaa

SEQ ID NO: 90194 - DNA, 50 bp, homo sapien
cctttgaacctttgttgaaattccartgactatatatgtatacatctgat

SEQ ID NO: 90195 - DNA, 50 bp, homo sapien
tgtcctgcccttccaaactgctaggyagattcacccatttccttggcttc

SEQ ID NO: 90196 - DNA, 50 bp, homo sapien
taggcacaatcatatttagtagagcragttagggttcttatttctattct

SEQ ID NO: 90197 - DNA, 50 bp, homo sapien
gcccaaggattttgtcactgagataygtgagttctaaagtttgagaaaca

SEQ ID NO: 90198 - DNA, 50 bp, homo sapien
aagaacaagggcacaggtgagaaaawttaaagccgtctttactcttcctg

SEQ ID NO: 90199 - DNA, 50 bp, homo sapien
gtctttacatgatggaaggtcaaacrgattccctcaaacttattttataa

SEQ ID NO: 90200 - DNA, 50 bp, homo sapien
ctgactagaaatatgtgttacctccratagttgcttcagggtcagttgtt

SEQ ID NO: 90201 - DNA, 50 bp, homo sapien
gccacccccaaagcctgaatgtcacygccttaagtgaggaccacttcata

SEQ ID NO: 90202 - DNA, 50 bp, homo sapien
ctagaccagcctgacacaccactgcmatagctcctagtatccaggaggag

SEQ ID NO: 90203 - DNA, 50 bp, homo sapien
cccagctctgaacctggggttgctcraatgattgacgagtcccaccagca

SEQ ID NO: 90204 - DNA, 50 bp, homo sapien
gtacatttagatcatttctgcataayttgtgtgtgtgtctatatgtgcgt

SEQ ID NO: 90205 - DNA, 50 bp, homo sapien
aaggaaaacatatagtaggtgacaargtaataaaaattaaacagaaggaa

SEQ ID NO: 90206 - DNA, 50 bp, homo sapien
accatcacaacgtctatcataatacmatgaatgaaccgcgtactatttaa

SEQ ID NO: 90207 - DNA, 50 bp, homo sapien
tggaaatattaataaccaagataggratagcctctgcctttttacagagc

SEQ ID NO: 90208 - DNA, 50 bp, homo sapien
gaagcttggagacaggtttgtttcakgatccctagtatcagcagacaggg

SEQ ID NO: 90209 - DNA, 50 bp, homo sapien
ccacacctagacagacagagaaagakaaaatgtgacagtctaagaactta

SEQ ID NO: 90210 - DNA, 50 bp, homo sapien
cccttaatttcccaaatttgtgaaarggatagaaaaggtgggtaactaat

SEQ ID NO: 90211 - DNA, 50 bp, homo sapien
ataatgaaaccactattttgcatagsagccacagtgatatgtcataaaac

SEQ ID NO: 90212 - DNA, 50 bp, homo sapien
gtgggctatttcaagcaaaatctcgraaatctatgttccaggacaactca

SEQ ID NO: 90213 - DNA, 50 bp, homo sapien
gcactgaaaattgaaacatgaattarctgatgataatattgcaatcattt

SEQ ID NO: 90214 - DNA, 50 bp, homo sapien
aaaggtaagtgaagtctaagaaaaaraatcatgcttatttaaaaatgaat

SEQ ID NO: 90215 - DNA, 50 bp, homo sapien
tttaagaaaaacttgaaaaatagatsaaaatagtagcagaagttaaaaat

SEQ ID NO: 90216 - DNA, 50 bp, homo sapien
tgtcctagtttgaatttcaactaaawtaggtctaagcctcagtttccata

SEQ ID NO: 90217 - DNA, 50 bp, homo sapien
cagtcactacctactgtccctaggcrtgaagccattgcataggcaggact

SEQ ID NO: 90218 - DNA, 50 bp, homo sapien
ctccagaatctacaatggctgcctayggatttgagaccaagttgtgaagg

SEQ ID NO: 90219 - DNA, 50 bp, homo sapien
gatcatctttcagaaggaaaaactamgggaaatcataggtgggttagcac

SEQ ID NO: 90220 - DNA, 50 bp, homo sapien
cgtggtgccaccacccacttgtcaarctgcggaagaagtagacacaacga

SEQ ID NO: 90221 - DNA, 50 bp, homo sapien
cacatacactaagccccagtaaaacrcgagtaaatgtaagacttctttga

SEQ ID NO: 90222 - DNA, 50 bp, homo sapien
tactcttaagcatctgtacttaagayatgcatgatgtgtttgctacctgg

SEQ ID NO: 90223 - DNA, 50 bp, homo sapien
aaaactataccaatatgctgtttctyacttctcacactgcaaagatggaa

SEQ ID NO: 90224 - DNA, 50 bp, homo sapien
atcattactgtgtatctgtgtattgyactaaatggactgatgctgcgcac

SEQ ID NO: 90225 - DNA, 50 bp, homo sapien
tttctgggaggccagcttgctgggamtcagtctggaacgtgttaaccctt

SEQ ID NO: 90226 - DNA, 50 bp, homo sapien
tgcaaggtagtcatgttttttgttaygtagggacctgactgctcgccaaa

SEQ ID NO: 90227 - DNA, 50 bp, homo sapien
ctaggagaggcaagaaatttgacaaygatagcaacttcaaaaaaaatagc

SEQ ID NO: 90228 - DNA, 50 bp, homo sapien
tctatttttatgtcttttaacctggkagttcccatgcatttcaacaatgc

SEQ ID NO: 90229 - DNA, 50 bp, homo sapien
ctggcccaggtagattccagctctaygcctaaatcaagagtaaggctcct

SEQ ID NO: 90230 - DNA, 50 bp, homo sapien
aatgacaagggctgggtcttctggaycttactgagaagtatggggtggac

SEQ ID NO: 90231 - DNA, 50 bp, homo sapien
taaatacatctgacttttgaagttayatgaataggcaaaccctatttaca

SEQ ID NO: 90232 - DNA, 50 bp, homo sapien
ggtacatttttcttcttgcattgaawctgggtctaacttagcatatcaaa

SEQ ID NO: 90233 - DNA, 50 bp, homo sapien
tgaagtggcccctgcggacagatcakaactatttttaggttgcaagtgtt

SEQ ID NO: 90234 - DNA, 50 bp, homo sapien
tttaaccctaatgtttcttctctaaygtttcaacaaccatataatcttct

SEQ ID NO: 90235 - DNA, 50 bp, homo sapien
gcttgatggtagaaatgttcttacakaagagccaacatcaatgttagtgc

SEQ ID NO: 90236 - DNA, 50 bp, homo sapien
gacaaaatagactgcttgttgcaatmagataaccaatttataaacaagac

SEQ ID NO: 90237 - DNA, 50 bp, homo sapien
tgacccccgggattcatcagtatcgycaaggctcttttgttattgtcctg

SEQ ID NO: 90238 - DNA, 50 bp, homo sapien
atagaagagccccatctgggattaaytgaggagggttcagccctggtccc

SEQ ID NO: 90239 - DNA, 50 bp, homo sapien
ccttgccagccacctctatgtatcaygttttgttaatcattcatctgtgg

SEQ ID NO: 90240 - DNA, 50 bp, homo sapien
ggtactatcataagagctgaaaataraagcataatccagtccttgatctt

SEQ ID NO: 90241 - DNA, 50 bp, homo sapien
cccacagtaaattacttggtatcagmagacctggctttcgccctctgctg

SEQ ID NO: 90242 - DNA, 50 bp, homo sapien
gtgctgggtggggaaatcatgagacyctttttctgggacaggagtgtcac

SEQ ID NO: 90243 - DNA, 50 bp, homo sapien
ctgcaggaaaatggtcaggaaaggcyaattttacagctcacaaagtggga

SEQ ID NO: 90244 - DNA, 50 bp, homo sapien
agcctggctcttgatcttaacctcarttctgcttcttattaactgtgtga

SEQ ID NO: 90245 - DNA, 50 bp, homo sapien
aggaagactgaatcttgggtcctctkaatcagccagcagtctagacactg

SEQ ID NO: 90246 - DNA, 50 bp, homo sapien
ttcacttaattacatctgcagaaacsctttttccaaatgtggtcacattc

SEQ ID NO: 90247 - DNA, 50 bp, homo sapien
aacctctgtcagattcacttacccasaaacaaggaggcacgtttggcaca

SEQ ID NO: 90248 - DNA, 50 bp, homo sapien
tatgttgcattcatttattcacttaytaaagtagcctagtagagtaaaga

SEQ ID NO: 90249 - DNA, 50 bp, homo sapien
ctcactgaagccactctttgtacaayaaattacagggtcatagatctttg

SEQ ID NO: 90250 - DNA, 50 bp, homo sapien
catgtaaatatgcatgtcatacttakgttctgctcagtaagagtgacagc

SEQ ID NO: 90251 - DNA, 50 bp, homo sapien
cactgacctaactttcaatttggccrgatccttattagttcagagccaac

SEQ ID NO: 90252 - DNA, 50 bp, homo sapien
tgaatgtgttttctagctaaaaatcmtgatcactaagtggttgatacaat

SEQ ID NO: 90253 - DNA, 50 bp, homo sapien
gcggcaatggaggtgggtcattaackcataaccccataataaataaatgc

SEQ ID NO: 90254 - DNA, 50 bp, homo sapien
tctgcttgccggatcacaaggaaaamgtcatgtgcttctgcattcgggta

SEQ ID NO: 90255 - DNA, 50 bp, homo sapien
gttaaacaagaatcacaacgggagtraataatcatatcatgattaagaat

SEQ ID NO: 90256 - DNA, 50 bp, homo sapien
atatttttaagataccttagtgaatmaagcaatttttttaggatatcata

SEQ ID NO: 90257 - DNA, 50 bp, homo sapien
atcataacctttgagtccaatgagargagccaccattgattggctggaat

SEQ ID NO: 90258 - DNA, 50 bp, homo sapien
tgagataaataaaatgaataatgaayggcagacttaaaaattatgacatt

SEQ ID NO: 90259 - DNA, 50 bp, homo sapien
agataagaatgagaattttgacagtycatatgtggtgaaaaaatttgttc

SEQ ID NO: 90260 - DNA, 50 bp, homo sapien
tccatgacccaaagaaagagctcaasaagtgtcctggccatcagggaaaa

SEQ ID NO: 90261 - DNA, 50 bp, homo sapien
aaaatatgaaagacagcctctgttayagcacttgccatatccccccaggc

SEQ ID NO: 90262 - DNA, 50 bp, homo sapien
aaaattatctatgcttttatcattcmacctgtaatggtcatcattatcga

SEQ ID NO: 90263 - DNA, 50 bp, homo sapien
caaaaatacataatgatgctcatcaractgttatttataataatgaaaca

SEQ ID NO: 90264 - DNA, 50 bp, homo sapien
caaaatgacagttgaatttttctccygtaatgcataatcaggtcaggcca

SEQ ID NO: 90265 - DNA, 50 bp, homo sapien
tcaggaacttgctgagatattaacckgaaaatcatttgggtttcacttca

SEQ ID NO: 90266 - DNA, 50 bp, homo sapien
ctgtctaaccatatctgagaactacrgagagttttgtttcacagtcaaat

SEQ ID NO: 90267 - DNA, 50 bp, homo sapien
ttagcggttctcctcatagtagtaaygtgctctcattttcactggtctgg

SEQ ID NO: 90268 - DNA, 50 bp, homo sapien
tgaatccacgtttgatcttttttcamcttactttatgataatgaaatgaa

SEQ ID NO: 90269 - DNA, 50 bp, homo sapien
aaatggggcagtaatagctaccacaratacataggtacaacgcgcttagc

SEQ ID NO: 90270 - DNA, 50 bp, homo sapien
tgggcccaggtacatgtaggagtaaycactgtgaactctgcatccctggc

SEQ ID NO: 90271 - DNA, 50 bp, homo sapien
tatctaactaggaaaccgtcatttcraatacttcctcttactatctgaag

SEQ ID NO: 90272 - DNA, 50 bp, homo sapien
cagctgaaggatacaaaagagggacratgagatacgtttctccccggctt

SEQ ID NO: 90273 - DNA, 50 bp, homo sapien
tatgtgatgtgtggaaggtgaaagcsatgtggaggccatatttcagccct

SEQ ID NO: 90274 - DNA, 50 bp, homo sapien
tattttatatttcctgactccattcrcaaaatattcagttacatattgta

SEQ ID NO: 90275 - DNA, 50 bp, homo sapien
aaaatagtttgtatccctgctcttaygattctaggattgtcatctttaaa

SEQ ID NO: 90276 - DNA, 32 bp, homo sapien
cctgactgtatccagartagtcccacttagag

SEQ ID NO: 90277 - DNA, 50 bp, homo sapien
tgataatgtgatttggaatcagatgwaccttgaaatactggctctgtgat

SEQ ID NO: 90278 - DNA, 50 bp, homo sapien
gaggctagaacttcagattatgagcraaggagaagccaatgggggtcttt

SEQ ID NO: 90279 - DNA, 50 bp, homo sapien
gttggatggtccctcttttgagttgytggaacataaatcatttgagacat

SEQ ID NO: 90280 - DNA, 50 bp, homo sapien
tgaaagaatgacaaataactgctaaycagtccccagagttcttgcccaac

SEQ ID NO: 90281 - DNA, 50 bp, homo sapien
ctacagggctcgtgattggagtcacmatgcatagctgaggatgggtataa

SEQ ID NO: 90282 - DNA, 50 bp, homo sapien
aaaaaacacattccaatgatcaacartgagccacacaaatatttgaaaaa

SEQ ID NO: 90283 - DNA, 50 bp, homo sapien
agaaaaacggttacagagtgtaaaaytattttcaagcacaaagttaaaaa

SEQ ID NO: 90284 - DNA, 50 bp, homo sapien
taaagtgatgagatgaagtagtaagraatggagaggaccacaaggaggca

SEQ ID NO: 90285 - DNA, 50 bp, homo sapien
agatggctgtgtttttagctttgaartaatctcccaggctttgaggggag

SEQ ID NO: 90286 - DNA, 50 bp, homo sapien
ggagcataagagaaaagccatcgackattgtaggtcaaaatagtcttgca

SEQ ID NO: 90287 - DNA, 50 bp, homo sapien
ctttcacaaacattgtctcattttgwacttcctcatagtcttgtgaagta

SEQ ID NO: 90288 - DNA, 50 bp, homo sapien
tctctagcctgctaggaatgaacaasaggtactttaaaagaagagagttg

SEQ ID NO: 90289 - DNA, 50 bp, homo sapien
agaagacactactattttcaaatcamctgtcaaatgaataactttggtat

SEQ ID NO: 90290 - DNA, 50 bp, homo sapien
acagaggagccatgttggttctatcygagtaattcagttctagaacattc

SEQ ID NO: 90291 - DNA, 50 bp, homo sapien
accatgcagagttagagacaaagtcrcaagtcagtctcctttgctgaagc

SEQ ID NO: 90292 - DNA, 50 bp, homo sapien
ttacatggggatcagattatctcacygtatttcattggcctcacactgct

SEQ ID NO: 90293 - DNA, 50 bp, homo sapien
atctgcctggttttgaacaccatgcrgagttagagacaaagtcacaagtc

SEQ ID NO: 90294 - DNA, 50 bp, homo sapien
ctgtattcaagtcatctttactacaraaacaaaagacatggagccccttg

SEQ ID NO: 90295 - DNA, 50 bp, homo sapien
aactactatttttattccattactaygaaacacactagtttcttggtgat

SEQ ID NO: 90296 - DNA, 50 bp, homo sapien
taggcaaagctgccccaggatgccaytcgttctattgctgctctgattcc

SEQ ID NO: 90297 - DNA, 50 bp, homo sapien
atgaccaaataaggtgaacacctagmcataacttaaggaggaggcaggat

SEQ ID NO: 90298 - DNA, 50 bp, homo sapien
gtcacttgaacatttgatgggaaacrgaaatattgcacaaagaatactga

SEQ ID NO: 90299 - DNA, 50 bp, homo sapien
agtcacattgtgattcaaagggaccrgagagtgtctatttgcagatacac

SEQ ID NO: 90300 - DNA, 50 bp, homo sapien
aacataaaaggataagggtcgactayatgtgatgcaaatcagaggaggct

SEQ ID NO: 90301 - DNA, 50 bp, homo sapien
ccatgtgtagctttgttaagagctgsacttccatgaatgcccaaaggtct

SEQ ID NO: 90302 - DNA, 50 bp, homo sapien
ctgtaacatggacaacatggccatasgataggcagaccagatgtgggctt

SEQ ID NO: 90303 - DNA, 50 bp, homo sapien
gctaacaataattaagttgcttagayaattccaggtgactcaaatttcat

SEQ ID NO: 90304 - DNA, 50 bp, homo sapien
tgtgatacagtcttgatatttataargcagaaaaaatctctaaatgtgtt

SEQ ID NO: 90305 - DNA, 50 bp, homo sapien
ctcatatttgatggagggaataaaaygtcaaagaatatgtgaaaggtata

SEQ ID NO: 90306 - DNA, 50 bp, homo sapien
tagacaagtaaactaatcttatctgwaaggaggtgaaaatcaaaatgagg

SEQ ID NO: 90307 - DNA, 50 bp, homo sapien
aaatcaacaactgtgaagccatactrtcaataggagagtgaagatctcct

SEQ ID NO: 90308 - DNA, 50 bp, homo sapien
attggtattaattatgttgctccaartgaatttctaatgtagacaactaa

SEQ ID NO: 90309 - DNA, 50 bp, homo sapien
acaggcagaagtaagttcaaatcccrgtggcatctactaaccatatgata

SEQ ID NO: 90310 - DNA, 50 bp, homo sapien
gtctagaatttggtacactgggctcwatctgaaaatgtacaggtgtatac

SEQ ID NO: 90311 - DNA, 50 bp, homo sapien
ctactagcgggaacaaaagctggaaytgatggtctgcaaggtcatatgtc

SEQ ID NO: 90312 - DNA, 50 bp, homo sapien
ttgatattttcctggtaaacatacarctgaggtgatggaactagattgta

SEQ ID NO: 90313 - DNA, 50 bp, homo sapien
gcttcttcttgcttttgatgaggaamagaattcacttacacatttcactg

SEQ ID NO: 90314 - DNA, 50 bp, homo sapien
agtatcttagtccattcagattgcamtaacaaactaccatataccgggtg

SEQ ID NO: 90315 - DNA, 50 bp, homo sapien
tacttgctttacttcctgccaaaacrcaagatgcactttatgacaatact

SEQ ID NO: 90316 - DNA, 50 bp, homo sapien
tgctgttattgtttttttctgaataygttcaatgcatggagggccatctg

SEQ ID NO: 90317 - DNA, 50 bp, homo sapien
ggtcttttgtctagctcatagtacartacggccaggactagggtaaagca

SEQ ID NO: 90318 - DNA, 50 bp, homo sapien
tacagcctgtgctaagtttcaaagargaggcagataactttgaagatttt

SEQ ID NO: 90319 - DNA, 50 bp, homo sapien
atgagggtagaataaggttggagaaytcaaaaagtgcagaaaaaaaataa

SEQ ID NO: 90320 - DNA, 50 bp, homo sapien
ttttttttttaatgacctgggaagargtgagtaaatttgacatgtggcta

SEQ ID NO: 90321 - DNA, 50 bp, homo sapien
gagtgggttcttgcaactctaaacargaggacaaacatgtatcctttgtg

SEQ ID NO: 90322 - DNA, 50 bp, homo sapien
ggacattgcagtgaaacttgagtaaktatccatgttgtgtgtctgtaagt

SEQ ID NO: 90323 - DNA, 50 bp, homo sapien
ctgagaatgtgatacttggaaaccaygttcatcagaagagtgaaaggctt

SEQ ID NO: 90324 - DNA, 50 bp, homo sapien
tgccttccaaaaaagagttcaaaaarcatggttaccacataaagacttgc

SEQ ID NO: 90325 - DNA, 50 bp, homo sapien
cctaacagcattcaaactcattaaamaatactttacagtcacaataaagc

SEQ ID NO: 90326 - DNA, 50 bp, homo sapien
ttgctcgtatcttcccctattgttaycgtattccttagtaatattttggt

SEQ ID NO: 90327 - DNA, 50 bp, homo sapien
gcaggggtaggtttgggccaaactamaacatctggattttattcacaggc

SEQ ID NO: 90328 - DNA, 50 bp, homo sapien
caggtaaagtatggacctgtgactayagaacatttttcgtgaggggaagg

SEQ ID NO: 90329 - DNA, 50 bp, homo sapien
aaaacacatcaaaacatttgctagamgaattgtctttttttttttttact

SEQ ID NO: 90330 - DNA, 50 bp, homo sapien
tttacaaataaacataattctaattytcacagctaaacaattgagaaggg

SEQ ID NO: 90331 - DNA, 50 bp, homo sapien
agtatttgtgagatctgcattggacrcttggttctgattacaaatgacaa

SEQ ID NO: 90332 - DNA, 50 bp, homo sapien
tatggaagtttacctaaattcattayacacagaaaggcttttgggagtca

SEQ ID NO: 90333 - DNA, 50 bp, homo sapien
atttcagaaatgactttgaaataacrcttgactatttggtctcctaaagg

SEQ ID NO: 90334 - DNA, 50 bp, homo sapien
tagatcaactcttttcacacttcagwagttaaaaaaaatccatcatattc

SEQ ID NO: 90335 - DNA, 50 bp, homo sapien
tatttattgatcaagaactacgtggwgacaaaagtgctataaattttagt

SEQ ID NO: 90336 - DNA, 50 bp, homo sapien
gagcattccaaatgcacgatggagtraaaaatcttcatatgtgctctata

SEQ ID NO: 90337 - DNA, 50 bp, homo sapien
ttaattctttcctatccggaaggagraaaagcttaacaacccgctgtcaa

SEQ ID NO: 90338 - DNA, 50 bp, homo sapien
ggttgagatgatgagagggtacaacragtgtcagtaacagacacttcgct

SEQ ID NO: 90339 - DNA, 50 bp, homo sapien
gaaaaacattttttaatatactcaawttaaaacacatttaagaccagaat

SEQ ID NO: 90340 - DNA, 50 bp, homo sapien
gcatccgcaacatagggaacctcaaytaaattccaaccctaaatttcaaa

SEQ ID NO: 90341 - DNA, 50 bp, homo sapien
tgaaattaatcatcttcctgcatagrcattctcagactcatgttccaggt

SEQ ID NO: 90342 - DNA, 50 bp, homo sapien
ttccttacgtatgagtacagagaaayggagcatgattttaaccttggttt

SEQ ID NO: 90343 - DNA, 50 bp, homo sapien
tttttcgaactggtaaaaatgcccasgcttgatagtaatgtgtgactgtg

SEQ ID NO: 90344 - DNA, 50 bp, homo sapien
gatcctatgttttcaattttcctatwaaagaacgcaacaaacagtgctgc

SEQ ID NO: 90345 - DNA, 50 bp, homo sapien
ggataagggaagatgagatgagacastcaagcaatgaggtagaaaaaaag

SEQ ID NO: 90346 - DNA, 50 bp, homo sapien
cacatatcagacctggtttcttacarcattaggctcaaaatgcaagattt

SEQ ID NO: 90347 - DNA, 50 bp, homo sapien
ctaaaactcagttaagagggaagtgsatctacaaatcaagacagacctcc

SEQ ID NO: 90348 - DNA, 50 bp, homo sapien
gaaagaattgttgtctcaattgtgawcttagcccaagaataaatgttgcc

SEQ ID NO: 90349 - DNA, 50 bp, homo sapien
tactttctattagacagtgctggtamagaacttaaaaaaaatggtatgct

SEQ ID NO: 90350 - DNA, 50 bp, homo sapien
ttcctagttgagtaactattgctcakttattctcattcatgtgtagacat

SEQ ID NO: 90351 - DNA, 50 bp, homo sapien
ctaggaataccacctggctatgctayagaagacaagaagcttagattttg

SEQ ID NO: 90352 - DNA, 50 bp, homo sapien
catttaccaactagtttacagtacaraaaatataatgagccaactttaaa

SEQ ID NO: 90353 - DNA, 50 bp, homo sapien
aatatccatttgccgtctgtcctaartgtgttgtatagaggcagcagggg

SEQ ID NO: 90354 - DNA, 50 bp, homo sapien
gcaagtgagagggacaggttcaagayacattgggacatagagcccaaact

SEQ ID NO: 90355 - DNA, 50 bp, homo sapien
ttgcttagtgtcactcttatgtacayggattactggttaatgaagtctag

SEQ ID NO: 90356 - DNA, 50 bp, homo sapien
atctccgtttacaggaatgtttataratatcagactctgcttgatcttga

SEQ ID NO: 90357 - DNA, 50 bp, homo sapien
atgagtgaatttccatttagtgctasagaacatccagctgccaggtaata

SEQ ID NO: 90358 - DNA, 50 bp, homo sapien
tcaatctattgcttcccatgtgtatyagtcaaagttttgtggttgcaagt

SEQ ID NO: 90359 - DNA, 50 bp, homo sapien
atatccatgcccatgtcacttgattmgatgccctctgttcttttcctttt

SEQ ID NO: 90360 - DNA, 50 bp, homo sapien
agtacaatgcacatctcttcttatcyagtcaaaggtaaattgccttataa

SEQ ID NO: 90361 - DNA, 50 bp, homo sapien
tgatattgtccacccaggttctatcrcttcctgaaataaaaatagtctct

SEQ ID NO: 90362 - DNA, 50 bp, homo sapien
tcagatgtctacttggttctaccaaytcttactctacttttagactaaca

SEQ ID NO: 90363 - DNA, 50 bp, homo sapien
aaagcattttggagctctaacttaayagtgaacgaggcaaaaaaaaaaaa

SEQ ID NO: 90364 - DNA, 50 bp, homo sapien
aaatgcaaactgtggatatcattcawagaacctcaaacttgcccttgaag

SEQ ID NO: 90365 - DNA, 50 bp, homo sapien
ttctgtaaagaacacagcagggaacmaccttgtacatacatcttttaggc

SEQ ID NO: 90366 - DNA, 50 bp, homo sapien
tgtgatggtggtcatgggacaattayacactttatcagcaattcttcaag

SEQ ID NO: 90367 - DNA, 50 bp, homo sapien
tttgggagaattaaaagtgtgtgtaygtattaaaagcagcataatgatat

SEQ ID NO: 90368 - DNA, 50 bp, homo sapien
atcatcaaattaaaaattaattgccmcatatgttcaaataataacttata

SEQ ID NO: 90369 - DNA, 50 bp, homo sapien
atttagattatctgttataaagacaktaagatgggatgaaatatagatct

SEQ ID NO: 90370 - DNA, 50 bp, homo sapien
caaaaaatcaatcttctataaatctyagaggtgagtgctagggatggtgt

SEQ ID NO: 90371 - DNA, 50 bp, homo sapien
agttactcttggtgctagatgaacaytaactaccctctattattctgatt

SEQ ID NO: 90372 - DNA, 50 bp, homo sapien
ttttcagtcttatgttgaattgatcrcagttaaataaaggatgctatttg

SEQ ID NO: 90373 - DNA, 50 bp, homo sapien
atccataaacaaccagctgccatcartcattgtcatttctttatttcatg

SEQ ID NO: 90374 - DNA, 50 bp, homo sapien
aaggtttagactagtttccgcttgaragtgcacctgctctccgtaagtct

SEQ ID NO: 90375 - DNA, 50 bp, homo sapien
catttttccctgccctgatacccaamtgattcagcactatttaatgaaaa

SEQ ID NO: 90376 - DNA, 50 bp, homo sapien
aaaatgggagggaagatagagagaaraaacgacaagtaccagagtaggaa

SEQ ID NO: 90377 - DNA, 50 bp, homo sapien
atgggaaacaatatatttaaaggcaygtcagtcatgatcttaccaaacta

SEQ ID NO: 90378 - DNA, 50 bp, homo sapien
cctgaggcctgccatgcagaaaagcrcaataaatgttaactgataatagt

SEQ ID NO: 90379 - DNA, 50 bp, homo sapien
agtggaagctggggaactgtgctcawtctgtagtttgtctttgcttcctc

SEQ ID NO: 90380 - DNA, 50 bp, homo sapien
ggatagaaatttgattacttcttgayaggaaattaatattcactgttaca

SEQ ID NO: 90381 - DNA, 50 bp, homo sapien
tataaaaatcctattccacataccasctaaaattcactacacgttgtggt

SEQ ID NO: 90382 - DNA, 50 bp, homo sapien
taaaccgtcccttctttctgtagcaraagaaagttgggctgtgataaatt

SEQ ID NO: 90383 - DNA, 50 bp, homo sapien
gtggcagagcctggattcaaatccargtctttcctacttcaaactatgtg

SEQ ID NO: 90384 - DNA, 50 bp, homo sapien
gaatttgtccagggtttcatgattascaagtggcagagcctggattcaaa

SEQ ID NO: 90385 - DNA, 50 bp, homo sapien
atgctgctatgattattattattgcwaaattaaatcgtacttagaagttc

SEQ ID NO: 90386 - DNA, 50 bp, homo sapien
caattattataatactatgtggcaayaaatggtggaaactcagccctgtt

SEQ ID NO: 90387 - DNA, 50 bp, homo sapien
caaacaaggtggggcagatgatttayggccagcttttgtacagaaaagct

SEQ ID NO: 90388 - DNA, 50 bp, homo sapien
caatatttatgaagtatgctttctayataggacaatgaaataaaagtagt

SEQ ID NO: 90389 - DNA, 50 bp, homo sapien
gtcaccaacagaatcattattagaartagactgtctgaattatgaacatg

SEQ ID NO: 90390 - DNA, 50 bp, homo sapien
cctatagaggttcagggtgccttcargaaatgtttgagaagacagaatca

SEQ ID NO: 90391 - DNA, 50 bp, homo sapien
ggaggcccagaggaaattaagtgtcrgaagagatttcctagaggggatga

SEQ ID NO: 90392 - DNA, 50 bp, homo sapien
ctgtgaagtgttgacctgctctttgraaaatattaagaatgaaaattcca

SEQ ID NO: 90393 - DNA, 50 bp, homo sapien
gatatgacttcggtgtttattgtccrtctcctctgccattcctctggaat

SEQ ID NO: 90394 - DNA, 50 bp, homo sapien
atcaaatcaagccatatagtggacgmatttgttctttttctgccttttgt

SEQ ID NO: 90395 - DNA, 50 bp, homo sapien
aacacaaggaagaaatgcagaattgmaggactgtactctgttctcatgag

SEQ ID NO: 90396 - DNA, 50 bp, homo sapien
gtggttgaaaagggattaaggagctraagtgttatgctaagcatggttat

SEQ ID NO: 90397 - DNA, 50 bp, homo sapien
gagtttgttttggtttggtttttttrttgcccagaccatttctccttctc

SEQ ID NO: 90398 - DNA, 50 bp, homo sapien
tcttccttggcccccacaaacataaygcagaaggcttccaaaagaccagt

SEQ ID NO: 90399 - DNA, 50 bp, homo sapien
gcaaatgtttcaactcttagctaatyaaattaaggatgcaagctggagaa

SEQ ID NO: 90400 - DNA, 50 bp, homo sapien
taacatcagtccttttcttgtgatarcgttggatgacaccattaccttgg

SEQ ID NO: 90401 - DNA, 50 bp, homo sapien
tgtaagatagtttcaagttcttgtckaattgctatttttctggattatga

SEQ ID NO: 90402 - DNA, 50 bp, homo sapien
tcgggaggaatattgtaactccctaygtttccattccaaactctcaaata

SEQ ID NO: 90403 - DNA, 50 bp, homo sapien
cataagaaaaacttgacaataagtcrcaacttttgttctccctctcagta

SEQ ID NO: 90404 - DNA, 50 bp, homo sapien
tgtcaagatctccttttataatgaamccaatgcgcagttgggctccttgc

SEQ ID NO: 90405 - DNA, 50 bp, homo sapien
tcattactgcctttctatagtcaaakaaattaaagcagagaaaggttatc

SEQ ID NO: 90406 - DNA, 50 bp, homo sapien
ctagagtccaagcagctaccatgtcraccatgtttggagtaaaggtgtgt

SEQ ID NO: 90407 - DNA, 50 bp, homo sapien
gaatacaaagtggttagatccaaaaygtgagctaggaactaaattcaata

SEQ ID NO: 90408 - DNA, 50 bp, homo sapien
atctgaattagaaaaggaattataaraacagtcatatgttcagctcttat

SEQ ID NO: 90409 - DNA, 50 bp, homo sapien
gctgaacttgccatgggatctcctcraacatactttgcttttcctgtttt

SEQ ID NO: 90410 - DNA, 50 bp, homo sapien
gcttcactggccttctcgcttttctyggacacaccacactctttcttgtc

SEQ ID NO: 90411 - DNA, 50 bp, homo sapien
ggaaaaagggttgagaagcaccggaygtaatgtcattatgtgtgtgtgtg

SEQ ID NO: 90412 - DNA, 50 bp, homo sapien
gttgtagcactcatcagcaactgaartgatatgacttcggtgtttattgt

SEQ ID NO: 90413 - DNA, 50 bp, homo sapien
ggagcaaagtcgagagagtcagtaayagtggcacatcaaggctagttggt

SEQ ID NO: 90414 - DNA, 50 bp, homo sapien
tcaatgccaaataagagtaacattarctaaggagtataacctaaggatgg

SEQ ID NO: 90415 - DNA, 50 bp, homo sapien
atctagaagaagagatagacaataayagaaaataagtgtgcaaagcaatt

SEQ ID NO: 90416 - DNA, 50 bp, homo sapien
ttgtctgcagtaacagctcactgaaygtagcataaaaatgaaaacgaggg

SEQ ID NO: 90417 - DNA, 50 bp, homo sapien
tggtcagaaggaaagtttatgcctgraagattactgtgaccctcaggtaa

SEQ ID NO: 90418 - DNA, 50 bp, homo sapien
tgcttttttctaccttttgccaaacracaaaatctatgataagccatcta

SEQ ID NO: 90419 - DNA, 50 bp, homo sapien
tgacatgtttgtataaccctttggaygcaaatgtacctgacattatagaa

SEQ ID NO: 90420 - DNA, 50 bp, homo sapien
caatccaatttgatgttttcaggtcmattcagaggaatcaagagccaccc

SEQ ID NO: 90421 - DNA, 50 bp, homo sapien
aaatcgccaatgtagatgttcaggayatacttcaactcatttgcttaaac

SEQ ID NO: 90422 - DNA, 50 bp, homo sapien
catcacccgaatagcgtgtgatacaraatactttaagacctcttcaaggg

SEQ ID NO: 90423 - DNA, 50 bp, homo sapien
tggaggaaaactatttcaggaataartaagctgaactcaggtaaactgcc

SEQ ID NO: 90424 - DNA, 50 bp, homo sapien
tgagcgactacaaggagtagacatargtagtcctagctaacgttcttcta

SEQ ID NO: 90425 - DNA, 50 bp, homo sapien
tgtttcctaactgagtgtttcctaastccaagcctggcaacaagaagcag

SEQ ID NO: 90426 - DNA, 50 bp, homo sapien
ttcgcctgtagacacacaagcatagrccaaaaatgtggagaaattatcaa

SEQ ID NO: 90427 - DNA, 50 bp, homo sapien
tctcaaattatgagaaatagcttcartacagtccagagggactgatttag

SEQ ID NO: 90428 - DNA, 50 bp, homo sapien
ccttgcaaatagagatattttactarcctttgaacacgtttcaccagtcc

SEQ ID NO: 90429 - DNA, 50 bp, homo sapien
ccaagcaaacaggatccagaagtaartgtgtcttcatagcctatgtataa

SEQ ID NO: 90430 - DNA, 50 bp, homo sapien
tgtccaaactggaggtcaggacgtarattatgaagcctccactaacagtt

SEQ ID NO: 90431 - DNA, 50 bp, homo sapien
ttgttatgaggattaaatttgatgaygcatataaagtattaggcttactg

SEQ ID NO: 90432 - DNA, 50 bp, homo sapien
caaggtcatacagccagtcagcaacraagcttggatttgaactcaacatt

SEQ ID NO: 90433 - DNA, 50 bp, homo sapien
aaagaatgaagtggacctatacacaytgaaataaagatctccaagataca

SEQ ID NO: 90434 - DNA, 50 bp, homo sapien
cttcttatatatcattgctctctgaraaaaagtattatagaaaagccaaa

SEQ ID NO: 90435 - DNA, 50 bp, homo sapien
cgcctgctcagggatcagctatgacmaccctagggagagttccgtgatga

SEQ ID NO: 90436 - DNA, 50 bp, homo sapien
tatttaattgctttttcactctatcrcaagctaatacctggatgcccctg

SEQ ID NO: 90437 - DNA, 50 bp, homo sapien
ccaattattcttaggtttagttgttsaacatcatctcagacttcttggag

SEQ ID NO: 90438 - DNA, 50 bp, homo sapien
atgcacacttatgtttagtgcagcgycatttacaatagcaaagactcaga

SEQ ID NO: 90439 - DNA, 50 bp, homo sapien
agttccataaacatcacatccagccratatcctcttgtgggaaaaaagga

SEQ ID NO: 90440 - DNA, 50 bp, homo sapien
tttataatcatggtgttctgattagraatgagtgacattcttccaaattt

SEQ ID NO: 90441 - DNA, 50 bp, homo sapien
tcacctttttcaactccttaatctcyattctacttgtcagaagtagtaag

SEQ ID NO: 90442 - DNA, 50 bp, homo sapien
caatgtcaggcatatagtaaatgatsagtaaatacattgtccatctaccc

SEQ ID NO: 90443 - DNA, 50 bp, homo sapien
ggaaacaagtgaggggcactgtaacyatccagaggtaaaacagggagtgt

SEQ ID NO: 90444 - DNA, 50 bp, homo sapien
tggcaaaatgccattgttatcacacyatatcatgctaattttgatcactt

SEQ ID NO: 90445 - DNA, 50 bp, homo sapien
ttgctaaagagttggtttaattttckccatgtcttcgggtttcattttta

SEQ ID NO: 90446 - DNA, 50 bp, homo sapien
cagaatcaaattcaaaggcgaatagsatttcatattcctggattgttctt

SEQ ID NO: 90447 - DNA, 50 bp, homo sapien
aaaatgccaaggatctggtactcaaytgaagaaagggtcatctggaaagc

SEQ ID NO: 90448 - DNA, 50 bp, homo sapien
gggccatcagaattggaaggccaaastaattcctctatgcactgtattta

SEQ ID NO: 90449 - DNA, 50 bp, homo sapien
aaatcactgaatgactcatctaaaargtttcctgatgactttagaaaact

SEQ ID NO: 90450 - DNA, 50 bp, homo sapien
cttgaaatcaatcgggatggacaccsagtggattgctcaagatctgaggt

SEQ ID NO: 90451 - DNA, 50 bp, homo sapien
attcagatgtgaaatcaaacatcctsagaagtgcttgcccttgtcctcat

SEQ ID NO: 90452 - DNA, 50 bp, homo sapien
aataatgacttatactctttagacayctacagctgtctagtcatagatgg

SEQ ID NO: 90453 - DNA, 50 bp, homo sapien
ggacattagcttttttaatccacacraaatctgaggtacagtttttgcca

SEQ ID NO: 90454 - DNA, 50 bp, homo sapien
gatcacttatcccatttgtagattayactctgaaaccatttgacggtttt

SEQ ID NO: 90455 - DNA, 50 bp, homo sapien
tagacattggtgttacaaagatatayatggttacaaagaagatttcagtc

SEQ ID NO: 90456 - DNA, 50 bp, homo sapien
aactagtaactacattcattcatctraacactccaaaaatattatcctat

SEQ ID NO: 90457 - DNA, 50 bp, homo sapien
ggcaacaggcccctgaaatggtccargcaagagtttcctacttctagaaa

SEQ ID NO: 90458 - DNA, 50 bp, homo sapien
tcataataagccttctttatttaaamctctattagccaagaaaagattaa

SEQ ID NO: 90459 - DNA, 50 bp, homo sapien
cccagggctctgcctacaatggagartacttaatattgtcatcacagagt

SEQ ID NO: 90460 - DNA, 50 bp, homo sapien
atgtttcctcctgaatgcattcgggwaatacattcttgactggaatacta

SEQ ID NO: 90461 - DNA, 50 bp, homo sapien
tctgagcatcagacaccacttttaartaacagcaatattaatactgccta

SEQ ID NO: 90462 - DNA, 50 bp, homo sapien
tcttcaaccctagagaaacaaaatasatttagagcaggcccctctctaga

SEQ ID NO: 90463 - DNA, 50 bp, homo sapien
gcatccaaatgggaggatggttccarggaagtccagtggatcagggggaa

SEQ ID NO: 90464 - DNA, 50 bp, homo sapien
ttttcttcaatgcaaactgcactcartccatgttatttcaccacagacaa

SEQ ID NO: 90465 - DNA, 50 bp, homo sapien
atttgcgcagctgactcaagttgccraaaagagagcagcatagttgttcc

SEQ ID NO: 90466 - DNA, 50 bp, homo sapien
aaagaaatcgatttgtattttcaccyatgctccaaatttaagatgatccc

SEQ ID NO: 90467 - DNA, 50 bp, homo sapien
attgttttccatacatcctaccaatyagattttaagtttcagcaacctca

SEQ ID NO: 90468 - DNA, 50 bp, homo sapien
acataaatgccatatcaattataaaygtgcagtgcgattatatgggtcat

SEQ ID NO: 90469 - DNA, 50 bp, homo sapien
ttttcaacaattagaaataagcctcraaatagccctggtgaaaaagtgct

SEQ ID NO: 90470 - DNA, 50 bp, homo sapien
ccaagtctatttcattttgtaccaaygtttccttgttgaatatttccaag

SEQ ID NO: 90471 - DNA, 50 bp, homo sapien
gtgtcaagatctgtgtgtagaataayatgagctcttttaatcggcagacc

SEQ ID NO: 90472 - DNA, 50 bp, homo sapien
gaatggcccatcaacactgtttgcaygaggatgaaaggatcttggtgggc

SEQ ID NO: 90473 - DNA, 50 bp, homo sapien
ttcctttaccttcactgtcacctgartgagactatgagcacacaacctgc

SEQ ID NO: 90474 - DNA, 50 bp, homo sapien
gtccaagttagcattgacaatgacakgagatattggaattctgaccacag

SEQ ID NO: 90475 - DNA, 50 bp, homo sapien
accatatgagtcttaagtgagatgaygtaaatagtttattacactgtctg

SEQ ID NO: 90476 - DNA, 50 bp, homo sapien
cagacaagaggcagaaaagcaaatayaatatactcttgcctctctgatta

SEQ ID NO: 90477 - DNA, 50 bp, homo sapien
aaaattatgtctatttccaaaaacargtaataatacagatatactggcat

SEQ ID NO: 90478 - DNA, 50 bp, homo sapien
aaagcgtgctggatggtgtcctaatraagtagcaatccagcaaaggttcc

SEQ ID NO: 90479 - DNA, 50 bp, homo sapien
tagggtcacatatttcctactagctrtaagagtgttctggtccttaaagt

SEQ ID NO: 90480 - DNA, 50 bp, homo sapien
gtttctgtgctttggatgcagatgasagagtgtgtctaattaactggaca

SEQ ID NO: 90481 - DNA, 50 bp, homo sapien
cctggtagagagattcagagagtacmgatgtctaaagcttagagtgaatg

SEQ ID NO: 90482 - DNA, 50 bp, homo sapien
cttcttcatttcgctctcctcatcargttcctggtatagggaaataagtc

SEQ ID NO: 90483 - DNA, 50 bp, homo sapien
tgatgtaggcagatatgatggttacyaataagtttcattctctttctttt

SEQ ID NO: 90484 - DNA, 50 bp, homo sapien
ctgacaccctattttgccttctttakagcttcatatttatacctaaaacc

SEQ ID NO: 90485 - DNA, 50 bp, homo sapien
aggacataaaggagttattgtcagaragtgtgttggtcaacagatagata

SEQ ID NO: 90486 - DNA, 50 bp, homo sapien
ttttggcctcaggcaccagggcttcratgaaacggaattggcaacattct

SEQ ID NO: 90487 - DNA, 50 bp, homo sapien
tcaatgtgataactctgaaagacctyatatttctgcagggccacgaacca

SEQ ID NO: 90488 - DNA, 50 bp, homo sapien
atgttggttatatgaattaatcaacraagactactctagtttgtaggaaa

SEQ ID NO: 90489 - DNA, 50 bp, homo sapien
tgagacccaaggttacaactatataygtttatggccttcaggaaggttag

SEQ ID NO: 90490 - DNA, 50 bp, homo sapien
aatcattttgcagcagtgaatcttgsaaaatgaaacaattttaagatata

SEQ ID NO: 90491 - DNA, 50 bp, homo sapien
gtgtcttttgatttagctttttctaktactatcaactctatatttacttt

SEQ ID NO: 90492 - DNA, 50 bp, homo sapien
taaatgtgtttggttaacagaaggaygcagaattttaagaaaatgaagag

SEQ ID NO: 90493 - DNA, 50 bp, homo sapien
actttctgcaaaagtataagcagtargagaattccagatgaaaatgatgt

SEQ ID NO: 90494 - DNA, 50 bp, homo sapien
gcaaggatgtaatatattcagcattrttcaagcagctaattaaagacgaa

SEQ ID NO: 90495 - DNA, 50 bp, homo sapien
ggtgccatttagacaacaaatagaarcttaagggcataagtcaaaatgca

SEQ ID NO: 90496 - DNA, 50 bp, homo sapien
gatgactttagcagctgtcgatgaayggaggtactgttaaataggaaaca

SEQ ID NO: 90497 - DNA, 50 bp, homo sapien
tttaataaaagcatcagctgtgggaytaaaaaagagggaaaagtgatgta

SEQ ID NO: 90498 - DNA, 50 bp, homo sapien
caacacagggaggatccaaactgccrcttacacttaggtcttccaatagc

SEQ ID NO: 90499 - DNA, 50 bp, homo sapien
ttaatcatttctaatggaacttgtaytaaaatagtttgtcaacagtaacc

SEQ ID NO: 90500 - DNA, 50 bp, homo sapien
catctggcattgccatcccatcttcrcgacatatgccgtatctgcagacc

SEQ ID NO: 90501 - DNA, 50 bp, homo sapien
attgcccagtagactagatttggaascactagaaatttagtcctgtaaga

SEQ ID NO: 90502 - DNA, 50 bp, homo sapien
tctgggagacaattcctgaggatgcrcttttctttttcaaagagttgggg

SEQ ID NO: 90503 - DNA, 50 bp, homo sapien
agaggaggcacaagaggagttacgarcaaagtagctcaaactgtcaggga

SEQ ID NO: 90504 - DNA, 50 bp, homo sapien
ataacatatcttaaccatgtaaaaayaggcccttcatataagggaaatta

SEQ ID NO: 90505 - DNA, 50 bp, homo sapien
caaatttaaaaggggcaaggaaagasaatcccaacatgtacttaaaggaa

SEQ ID NO: 90506 - DNA, 50 bp, homo sapien
ttttttttaaattccaaaagaataaygatagtgtatagataaaatgtggt

SEQ ID NO: 90507 - DNA, 50 bp, homo sapien
cctgagacatccaggctatgattgayaattaccatgtaagagctcctaag

SEQ ID NO: 90508 - DNA, 50 bp, homo sapien
gttctaaatgaaactctaaattgtcmactgttaatggcagcatcttactt

SEQ ID NO: 90509 - DNA, 50 bp, homo sapien
gtgattcccaaacggataattgtgasaagcattcaggatactttttaaaa

SEQ ID NO: 90510 - DNA, 50 bp, homo sapien
tggtcttcacctaggagagtagaacrctttagaccaaaagacctgaacat

SEQ ID NO: 90511 - DNA, 50 bp, homo sapien
gacagtgctgtacttccaaaccagcraagaataccaatggatagccctca

SEQ ID NO: 90512 - DNA, 50 bp, homo sapien
taccaaaattgatacatctgaacaasgctctgcatttattccaatctctt

SEQ ID NO: 90513 - DNA, 50 bp, homo sapien
attcaattctgattatttgaggtatraagtcctaagctgaagatcttaaa

SEQ ID NO: 90514 - DNA, 50 bp, homo sapien
gcacaacagctgactttattcaagaygccacctacaaccacactacttca

SEQ ID NO: 90515 - DNA, 50 bp, homo sapien
tatgtatcttcttttgattcttctgmagtatgaaaatgaaagattggaac

SEQ ID NO: 90516 - DNA, 50 bp, homo sapien
ttgataaagcaagtgatgagaatackactaaaacagtgtttctcctaaaa

SEQ ID NO: 90517 - DNA, 50 bp, homo sapien
cgcaactggatatggtgggaagaacrctgaattaggagccaggggatcca

SEQ ID NO: 90518 - DNA, 50 bp, homo sapien
ttaaatctactgattcctaagataayagggtttgtaggcctcttgaatag

SEQ ID NO: 90519 - DNA, 50 bp, homo sapien
atagttcgttttcattctaaaaattyaagacttgactcagcaaacacatc

SEQ ID NO: 90520 - DNA, 50 bp, homo sapien
gcaacctaactgccacttataaaaaragaggatgcactgtgaggagcctg

SEQ ID NO: 90521 - DNA, 50 bp, homo sapien
tagtaacaacccaaataatgtagaargacttaagatgaaaaacaacagtc

SEQ ID NO: 90522 - DNA, 50 bp, homo sapien
agcccaagtaaattcagaagttataygcataaatagattaacaattatga

SEQ ID NO: 90523 - DNA, 50 bp, homo sapien
tacctcctctggttcttcaatcatayggtgatttctgccacatcaggcct

SEQ ID NO: 90524 - DNA, 50 bp, homo sapien
ggtggggaagaaagtacgactctaasaggatttttgctgaatggatattt

SEQ ID NO: 90525 - DNA, 50 bp, homo sapien
agatggcttcaaggggatattgaaakctataaggatgaatcagtggcaca

SEQ ID NO: 90526 - DNA, 50 bp, homo sapien
gagaatggatgagagggaggcatgcrcacaagtgtcagacaagaggctct

SEQ ID NO: 90527 - DNA, 50 bp, homo sapien
aggtctggaggtggaaataaacttcrctgttctgtctccaagcagagcaa

SEQ ID NO: 90528 - DNA, 50 bp, homo sapien
tactccatgaggccaacagtttatayggtgggaaagctctccaaaacagt

SEQ ID NO: 90529 - DNA, 50 bp, homo sapien
ttactattaccattggttgcatggcyatattgcttgctgtaagtctgtat

SEQ ID NO: 90530 - DNA, 50 bp, homo sapien
taggcagttgccagggaatataaccrattgctcttccaaatattctaaaa

SEQ ID NO: 90531 - DNA, 50 bp, homo sapien
ccacacatgacatctgtctttgccartgcttaactcaatatggtgctcag

SEQ ID NO: 90532 - DNA, 50 bp, homo sapien
aactctgtctacacagctagtaaatrgtagacccaggacttgaacccaag

SEQ ID NO: 90533 - DNA, 50 bp, homo sapien
ctgtacttgaatccaatctacagcaygaatccaagccttgcttagatcaa

SEQ ID NO: 90534 - DNA, 50 bp, homo sapien
ctcagagtgtgatggattgtacagamatgaggagtgacatgctatgaatt

SEQ ID NO: 90535 - DNA, 50 bp, homo sapien
agtaatatttttaacatttttaatarggaactgaatgatgtgatggaagc

SEQ ID NO: 90536 - DNA, 50 bp, homo sapien
gtcaaaaacattgtaaacagttatayctggatgcaagtaagagtttagat

SEQ ID NO: 90537 - DNA, 50 bp, homo sapien
tctgtagtttctcattttagaatacytcatgagattgaaaaactgaaatc

SEQ ID NO: 90538 - DNA, 50 bp, homo sapien
gctcataagcactctatctatttgaktatttgtcctacaatttggctgtg

SEQ ID NO: 90539 - DNA, 50 bp, homo sapien
aaagtctttatcttccttgctttcaygttgaggaggaagtagaagagttc

SEQ ID NO: 90540 - DNA, 50 bp, homo sapien
atgtaacgatatctgaattcctgaarctcagttaacagctgaacaggttt

SEQ ID NO: 90541 - DNA, 50 bp, homo sapien
tgtgagactgtctttatgactctcaygtacacacctatcagcatctttct

SEQ ID NO: 90542 - DNA, 50 bp, homo sapien
tgggtataaaaaggccaagatgagamtagtgaactttagctattttcctg

SEQ ID NO: 90543 - DNA, 50 bp, homo sapien
tcaagctccagacaactcaccaaccyataagcaaacaacaaatgtctcaa

SEQ ID NO: 90544 - DNA, 50 bp, homo sapien
cacttgcaatgactatgtcaagtgckctatgctttatttatttgtgcaac

SEQ ID NO: 90545 - DNA, 50 bp, homo sapien
ggggccagaacaatgacaatgataartaacaaatgactgtatgaaagcta

SEQ ID NO: 90546 - DNA, 50 bp, homo sapien
tgctttaaataataaatggcgctctkaaaattcagcctaaaagcaagctg

SEQ ID NO: 90547 - DNA, 50 bp, homo sapien
gttcaccaaaagaacatacatactayatcaggctggccaatagtctttaa

SEQ ID NO: 90548 - DNA, 50 bp, homo sapien
tgagagttactttgagctcgaggtakaatttaatgttctcagaagactaa

SEQ ID NO: 90549 - DNA, 50 bp, homo sapien
tcagattaaagcactattaatagcaracaagaatcgtgggctatcctatt

SEQ ID NO: 90550 - DNA, 50 bp, homo sapien
caactgagaaacttttcttaaaactyagatttcaagtctgtgcaatgaga

SEQ ID NO: 90551 - DNA, 50 bp, homo sapien
tgggtgtaaagatactgggagtttaygatgactgtaacttttgtatcatc

SEQ ID NO: 90552 - DNA, 50 bp, homo sapien
cctactggagctaatcagagggaagractagaagtacaaatgagccacaa

SEQ ID NO: 90553 - DNA, 50 bp, homo sapien
ctacttttatttctgaaataattaamgctaggcagtcattaaatgacacg

SEQ ID NO: 90554 - DNA, 50 bp, homo sapien
ctaccttgttttaggtacagtgtcamaatattccttctcttattccatcc

SEQ ID NO: 90555 - DNA, 50 bp, homo sapien
tattgattttcttcttgttgttgttycaaagttacaattaaattgtagct

SEQ ID NO: 90556 - DNA, 50 bp, homo sapien
gaggatggagtattgtttttctgcayagtatctattctatatcagttagg

SEQ ID NO: 90557 - DNA, 50 bp, homo sapien
ctgaaacagtaaaacttctggatcarctgggtaacactattggttccctg

SEQ ID NO: 90558 - DNA, 50 bp, homo sapien
gagttttttatttaactattttaacrggaaatgcataataaaatgccagc

SEQ ID NO: 90559 - DNA, 50 bp, homo sapien
tttagtattttttaaatttcgaacayccataaaattgtaaagaaagaatt

SEQ ID NO: 90560 - DNA, 50 bp, homo sapien
cagctctgtggccttggtcaggttaygtctcttcagtatcgtaactgtaa

SEQ ID NO: 90561 - DNA, 50 bp, homo sapien
gccacacactgggtaacaggcataamgagaggacaatgagcgaaaggtaa

SEQ ID NO: 90562 - DNA, 50 bp, homo sapien
gatcaaaacaatgaaagcacagaatsaatcaaaataaatgtttcattgaa

SEQ ID NO: 90563 - DNA, 50 bp, homo sapien
ctaaaataacatgatataaaaatgastaattaatacaaaagaactaggat

SEQ ID NO: 90564 - DNA, 50 bp, homo sapien
gatttttcaagctagtataactgcamgtattctgagtttgagttgcccta

SEQ ID NO: 90565 - DNA, 50 bp, homo sapien
gggctgggtaatcagaaaacaaatcsagtccatgctatcaggtttcatca

SEQ ID NO: 90566 - DNA, 50 bp, homo sapien
atcaaatcaacttcatagttaacaaytgctttcaaggaatgcccttttac

SEQ ID NO: 90567 - DNA, 50 bp, homo sapien
ttagtgaaaacaagagaggatactgraaggtttagtccaggtttagctgc

SEQ ID NO: 90568 - DNA, 50 bp, homo sapien
cacctttcttctttactcagccctasaggaagccttaaataccacacaat

SEQ ID NO: 90569 - DNA, 50 bp, homo sapien
tatctatgactaataagcaattatayggagactttcccactgacaaccat

SEQ ID NO: 90570 - DNA, 50 bp, homo sapien
ctattttctgctgcatcaaagagtayatcaaagaacagtaggttccagga

SEQ ID NO: 90571 - DNA, 50 bp, homo sapien
caagtgtttcaaagggaaaatatgargcagccaccttacagtcctgattt

SEQ ID NO: 90572 - DNA, 50 bp, homo sapien
taataatgtaaaaaagactgtattgwcatgaataaattcccaagaccccc

SEQ ID NO: 90573 - DNA, 50 bp, homo sapien
tataatgtataaattaaaattgtccrcgattactctccccccattgacta

SEQ ID NO: 90574 - DNA, 50 bp, homo sapien
ttataccaccccccacagggtatcayagatcttgttacatgtctaacaag

SEQ ID NO: 90575 - DNA, 50 bp, homo sapien
agaatggaaattcctaccaccaatcraccttgaaagaggcccgtcctaga

SEQ ID NO: 90576 - DNA, 50 bp, homo sapien
cattagagaaggccaggaaaggtatsaaggatcaagtgtgacttgaggct

SEQ ID NO: 90577 - DNA, 50 bp, homo sapien
actcaatatttcaatatgcttagaargaaacaactccaaatgagattcct

SEQ ID NO: 90578 - DNA, 50 bp, homo sapien
gtgtgtgtttaaagacctagaaatamgaacgtatcaaatagtgcaatgtt

SEQ ID NO: 90579 - DNA, 50 bp, homo sapien
aagtaccagtggttgtagtacatacmggtggcctaacagaaaataattgg

SEQ ID NO: 90580 - DNA, 50 bp, homo sapien
ttttttacgacagcctgagctaagasaagcacataatgtttcgtttatag

SEQ ID NO: 90581 - DNA, 50 bp, homo sapien
atcattagtgtaaatggtacaactaygaaacctgcataagcagctaataa

SEQ ID NO: 90582 - DNA, 50 bp, homo sapien
attgtatgtaatgtgtccatgcttayatataatttgagagctgaaggctt

SEQ ID NO: 90583 - DNA, 50 bp, homo sapien
ctagacgtggcaaagacaagaattaygctggcaaaggtaagtggtgaaat

SEQ ID NO: 90584 - DNA, 50 bp, homo sapien
agctctcagttctggtacaaaacatyaatattccatttctcagtttcata

SEQ ID NO: 90585 - DNA, 50 bp, homo sapien
cagcgacctccatactgcacaaccaytaagtttagactagataaccaaat

SEQ ID NO: 90586 - DNA, 50 bp, homo sapien
tgcggagtagatatggtttccagggytgtaatattatactttttccaaca

SEQ ID NO: 90587 - DNA, 50 bp, homo sapien
atgcatggccccattgaagcccttasagctacggagagaatggaaattcc

SEQ ID NO: 90588 - DNA, 50 bp, homo sapien
agacatacagcttaggtctgaaaaasgagatcagttatgctctccctctt

SEQ ID NO: 90589 - DNA, 50 bp, homo sapien
gctgggatttgaacccattactgacwgacttcagagtcactgactataaa

SEQ ID NO: 90590 - DNA, 50 bp, homo sapien
catctcattatcactcatcttttgarcagtgcagagtggcagacaattgt

SEQ ID NO: 90591 - DNA, 50 bp, homo sapien
agaaataacttacaggaaccccatcygaaattccaaatggattgaagtag

SEQ ID NO: 90592 - DNA, 50 bp, homo sapien
atttattatgtaagagggctaagaamagaaacaatagaaaatagtcatcc

SEQ ID NO: 90593 - DNA, 50 bp, homo sapien
gggttaattcattgaatgtctatatyagtgaagtcaaagaaagccaagaa

SEQ ID NO: 90594 - DNA, 50 bp, homo sapien
gtgtgtttcatgtggacattgttcayggctggcactttggcaacctttgt

SEQ ID NO: 90595 - DNA, 50 bp, homo sapien
ccctagttgcttcagtaatgtccttyatagtgaaaagatccagttacgaa

SEQ ID NO: 90596 - DNA, 50 bp, homo sapien
tctctttgagatattcctggagataygcacttagtgagctaattgacttc

SEQ ID NO: 90597 - DNA, 50 bp, homo sapien
tacacaatccccaaccacaatacaayggctaaataaatgttcataaaacc

SEQ ID NO: 90598 - DNA, 50 bp, homo sapien
atccttgccaacagcttgaaatatargagccaatagagaactgtggacca

SEQ ID NO: 90599 - DNA, 50 bp, homo sapien
tttataaatacaggacaaaagcaaaygtactcaagtgtctttctttaaga

SEQ ID NO: 90600 - DNA, 50 bp, homo sapien
ccatgcctgacctttcatggacatawcttctttggctctaggtgtctata

SEQ ID NO: 90601 - DNA, 50 bp, homo sapien
ccatctgcctcttaaaatccatgctsacaactactacatcacacagtctt

SEQ ID NO: 90602 - DNA, 50 bp, homo sapien
ttcaccttacagttttacgaggctasatataaaaagatgctgtgaataat

SEQ ID NO: 90603 - DNA, 50 bp, homo sapien
ccacaacatggcctaaaagtgttaayatatatccagcaataatgagatat

SEQ ID NO: 90604 - DNA, 50 bp, homo sapien
agcctgagacagacataggattccawcattagaagaagcttttttctcac

SEQ ID NO: 90605 - DNA, 50 bp, homo sapien
aagcctggactggctaaataactaaycaaaagctactcagctagtaagag

SEQ ID NO: 90606 - DNA, 50 bp, homo sapien
cttagggacgttaggtaacctgccaygatgacaggaatgggacttgaacc

SEQ ID NO: 90607 - DNA, 50 bp, homo sapien
agaggattccagtctttgaactacayaatttggattttttgttctgtttt

SEQ ID NO: 90608 - DNA, 50 bp, homo sapien
tgttcatagcatcatccacaaaaaawctaacactgtacctagaacacact

SEQ ID NO: 90609 - DNA, 50 bp, homo sapien
aaagaatatatcatcttcttgtaaaygtgaagtattactttgttaaagat

SEQ ID NO: 90610 - DNA, 50 bp, homo sapien
aagatgatatattctttcatctctaygctacaattttgggagggtaagaa

SEQ ID NO: 90611 - DNA, 50 bp, homo sapien
agaagctatgaatcgttttatggctkaatcatgctcctgatcccagtgaa

SEQ ID NO: 90612 - DNA, 50 bp, homo sapien
tctcacaccttgaccgcgtcccacayatacgggcatgccaagatccctgg

SEQ ID NO: 90613 - DNA, 50 bp, homo sapien
atccactgtttactctgctactaaartgctaatacatgcttgggccaaag

SEQ ID NO: 90614 - DNA, 50 bp, homo sapien
ctcccccagttctgctatttggagtyagtttctcccaccacatttcatgt

SEQ ID NO: 90615 - DNA, 50 bp, homo sapien
aatgtctaatttcagaattaagaaayggatacacagaggaaaaagaaaag

SEQ ID NO: 90616 - DNA, 50 bp, homo sapien
tatccagaataagcaaatctacagasagaggaaagacactagcagccagc

SEQ ID NO: 90617 - DNA, 50 bp, homo sapien
agtagtaacaccagcaattataaaaktacatactgtgataagttctataa

SEQ ID NO: 90618 - DNA, 50 bp, homo sapien
ccagatgttttgtgtcaagtagatayggctagttgttaattaactaaatc

SEQ ID NO: 90619 - DNA, 50 bp, homo sapien
acacttcctccagatgtttcatctayatgctgcctgacatctggtgtttt

SEQ ID NO: 90620 - DNA, 50 bp, homo sapien
tggggaaagggaagtgaggaagaaayaggtggaaaagcaaatacaaagtg

SEQ ID NO: 90621 - DNA, 50 bp, homo sapien
ttgcccaaatcagtgactggacccamaaaaagagctgggattatgtcttc

SEQ ID NO: 90622 - DNA, 50 bp, homo sapien
atgaacctacacaacgttttacgaaygtccagacttctccataataggcc

SEQ ID NO: 90623 - DNA, 50 bp, homo sapien
tacgaacgtccagacttctccataakaggccaggggtcagcagacttttt

SEQ ID NO: 90624 - DNA, 50 bp, homo sapien
taacaagaactgtctggttcctagtstgctagttgatatctggtatcatt

SEQ ID NO: 90625 - DNA, 50 bp, homo sapien
gagtggcctggccatggcattgtgtrtagttgctgatcatggtcttacac

SEQ ID NO: 90626 - DNA, 50 bp, homo sapien
ataaaaagggaatgtaatgtcaaaawgtaatgtaaaaaacatacatattt

SEQ ID NO: 90627 - DNA, 50 bp, homo sapien
agaaatgccagtaccaagatgtctcraaaatataattttagaaaaagggg

SEQ ID NO: 90628 - DNA, 50 bp, homo sapien
agcaaaggtcaactttacggcctcamtcaaaaaggagtgtaatggagata

SEQ ID NO: 90629 - DNA, 50 bp, homo sapien
aatattactcaccattgaatactatsagggaattgcaaatcaaaacaaaa

SEQ ID NO: 90630 - DNA, 50 bp, homo sapien
tcctttagggattcaaaaggcttaamatttctgtccttcttcacaaatgc

SEQ ID NO: 90631 - DNA, 50 bp, homo sapien
tacttcactgaaacatgtacatcacmaagagattgtaatacatgttttga

SEQ ID NO: 90632 - DNA, 50 bp, homo sapien
tttcaaaatgcaatacctggattcartaaatatcctgtataatcaattat

SEQ ID NO: 90633 - DNA, 50 bp, homo sapien
aaatatccactgtgctttgttcctaycaaacagaactaatatttggacta

SEQ ID NO: 90634 - DNA, 50 bp, homo sapien
ctaaagccttaatgcacacttatcamataaataaataaataagcagctcc

SEQ ID NO: 90635 - DNA, 50 bp, homo sapien
ggctttcaggcagggatagcatggcrgcatatacaataagttaccacagg

SEQ ID NO: 90636 - DNA, 50 bp, homo sapien
aaatcaattggcaagatcatttaaaragaagcaatgtggcaaatgtatcc

SEQ ID NO: 90637 - DNA, 50 bp, homo sapien
tattaacttccggataaatcagtgamcccaataaagatggagtcaatttt

SEQ ID NO: 90638 - DNA, 50 bp, homo sapien
cggtataaaccattacctgctattakgaaaactacttgaataaacttctt

SEQ ID NO: 90639 - DNA, 50 bp, homo sapien
gcagtcttgtgaatttcacagccaasggactgattgttattttgcaaact

SEQ ID NO: 90640 - DNA, 50 bp, homo sapien
gacaaagggattgaacagatgcaccyggtaggaatttgatttaaataggt

SEQ ID NO: 90641 - DNA, 50 bp, homo sapien
ctattagaatacaataggtaggtgtrctggaatgctcccatactcaaatt

SEQ ID NO: 90642 - DNA, 50 bp, homo sapien
ctaactgagtaggctcttctgtcatratttggaccttaagggtaaagtgt

SEQ ID NO: 90643 - DNA, 50 bp, homo sapien
agatcacgtagcggcttctttctgtraaaccctccaatacatgccaataa

SEQ ID NO: 90644 - DNA, 50 bp, homo sapien
tgtactcaatagatagttccaaatayagcatagctggcactcatgatact

SEQ ID NO: 90645 - DNA, 50 bp, homo sapien
agatttcaggagaacatgactatcaragatgattagatgagcagaacctg

SEQ ID NO: 90646 - DNA, 50 bp, homo sapien
actgatatttagcttgctcttactaygaatggttttaacaagcttgtttg

SEQ ID NO: 90647 - DNA, 50 bp, homo sapien
taattatatctgcaagggcttcttcytcaaatatgttatgattttcaggt

SEQ ID NO: 90648 - DNA, 50 bp, homo sapien
tggcagcaacacagcagtagtaaaartatataacagtaagccaatattta

SEQ ID NO: 90649 - DNA, 50 bp, homo sapien
tcagaggaatagaatagaatccagaratagatccatacatggtcaactga

SEQ ID NO: 90650 - DNA, 50 bp, homo sapien
gattaaagcctcttgtatgtgatgarctattctttttatataatgttgaa

SEQ ID NO: 90651 - DNA, 50 bp, homo sapien
tctgtaaaatgcttccttgaatgagyagtctgtgcaaaacagaggcataa

SEQ ID NO: 90652 - DNA, 50 bp, homo sapien
agactctgtctagaaaatggaaagcmattagagtaaaagaaccaaatgtt

SEQ ID NO: 90653 - DNA, 50 bp, homo sapien
atagctttaatttatctgtctcctamatgtaactgagaaatacaaatatt

SEQ ID NO: 90654 - DNA, 50 bp, homo sapien
tgtgagtttcttgactcccaatctcrttatctttccattttgccaactta

SEQ ID NO: 90655 - DNA, 50 bp, homo sapien
tatatctacaatactacctagcttayctatatgtaatccctttaaatttt

SEQ ID NO: 90656 - DNA, 50 bp, homo sapien
agcattacttagcaagaaaatccatraaggggtagattctagttaaaata

SEQ ID NO: 90657 - DNA, 50 bp, homo sapien
aggttgtagtgaataatcattatccwcctaggcaataattcacattcctc

SEQ ID NO: 90658 - DNA, 50 bp, homo sapien
attaggactgcccttatctataagcrgctaacctccaagccttgaaggga

SEQ ID NO: 90659 - DNA, 50 bp, homo sapien
cacatataacctctgtgtctgtatgmatatgagcgttgatctaaggcata

SEQ ID NO: 90660 - DNA, 50 bp, homo sapien
gtgcagcctacagtcccccttgttamgccatacatctcagtgtgacgcca

SEQ ID NO: 90661 - DNA, 50 bp, homo sapien
tcctttctgaaataattttaggataygaaaatctgtaaatgaaaaactac

SEQ ID NO: 90662 - DNA, 50 bp, homo sapien
agggctatttgtttttaattggtcaycttgttaattctggaaagtatgtc

SEQ ID NO: 90663 - DNA, 50 bp, homo sapien
gttttctctaaacataatgtattcaycatcccactagtcaaaaaaagcat

SEQ ID NO: 90664 - DNA, 50 bp, homo sapien
tggcaacaaaactgaattactttgakactatactactcttgagttctgaa

SEQ ID NO: 90665 - DNA, 50 bp, homo sapien
tcattacacttgggtgattgacccawcattggcttaaatcatcattggct

SEQ ID NO: 90666 - DNA, 50 bp, homo sapien
tcatgccaagaaagaagggaccaaaygtctgatgctgggttctgtgtttg

SEQ ID NO: 90667 - DNA, 50 bp, homo sapien
ggttctaaacgacaaggtagagagaygtgaatggaacccaaaaaagagaa

SEQ ID NO: 90668 - DNA, 50 bp, homo sapien
cagtggccccatctcaagtctctgcmaatagcctatcttcctcagaaatt

SEQ ID NO: 90669 - DNA, 50 bp, homo sapien
ttaaattcagtatacatggaacatcrgatgaaacaatgtgttgataaaaa

SEQ ID NO: 90670 - DNA, 50 bp, homo sapien
agccttgagactaaatgaagggtaasagaaattatgtgagagaaatgtat

SEQ ID NO: 90671 - DNA, 50 bp, homo sapien
ttcagtgatgttcttttcattcaccragccaactgtgacaaaaatcctaa

SEQ ID NO: 90672 - DNA, 50 bp, homo sapien
aacgcaataaataaaaaagcagaaargtacacatatgtattagttgctgt

SEQ ID NO: 90673 - DNA, 50 bp, homo sapien
tgtgtgaagttaagtttaatatgtaycctgggagtgtaggttaatatttc

SEQ ID NO: 90674 - DNA, 50 bp, homo sapien
acacacaacatccaaacacataaaamaactgaggaatgacaacgtttaat

SEQ ID NO: 90675 - DNA, 50 bp, homo sapien
agttgtatagcactgactgtgatgastaatataaaatccaatctgaattt

SEQ ID NO: 90676 - DNA, 50 bp, homo sapien
ggaaacaatatgagaagacattaaargatagaaaatagataatacaaatg

SEQ ID NO: 90677 - DNA, 50 bp, homo sapien
agtaatgaacttcccaggctttatayatctagctctcaagtgaattttga

SEQ ID NO: 90678 - DNA, 50 bp, homo sapien
tgactggctggatatatggaacctarcaacgtctcgccagcaggagaagg

SEQ ID NO: 90679 - DNA, 50 bp, homo sapien
aaatggagaccctaaggctacctggkaagatcattttgaggattccgtct

SEQ ID NO: 90680 - DNA, 50 bp, homo sapien
atgtgttgtggtacctgattgtcaarataacaaacaaatgaaaaagtgtg

SEQ ID NO: 90681 - DNA, 50 bp, homo sapien
tctatttaaccttgaatcctgagtawccacaaactagcacattcctgttc

SEQ ID NO: 90682 - DNA, 50 bp, homo sapien
gctcagtcttggagattcacaacacrcccaaacatttaaggcctgagaag

SEQ ID NO: 90683 - DNA, 50 bp, homo sapien
cccagaccaaagaataagctaaataygctgagactcagaggtcagaacag

SEQ ID NO: 90684 - DNA, 50 bp, homo sapien
ttttttaaagctatctccaccaatcrtgttatacctgggcatatacttag

SEQ ID NO: 90685 - DNA, 50 bp, homo sapien
aaaatgtatttatgcaacatgttcgyagtcttcagagtatatgcatgttt

SEQ ID NO: 90686 - DNA, 50 bp, homo sapien
actctagatcctgctttcaacctgcragtcactctgttctctctgtttat

SEQ ID NO: 90687 - DNA, 50 bp, homo sapien
tcacttgtaaagagagaaacatggasataaataaaaaactgtcatcaacc

SEQ ID NO: 90688 - DNA, 50 bp, homo sapien
taaacagaaacttctcttgatgagtraattagaagtatcacctgcaaaga

SEQ ID NO: 90689 - DNA, 50 bp, homo sapien
attgtaagcttgttttaaatatgttrtgatgatgtttgattggctttaaa

SEQ ID NO: 90690 - DNA, 50 bp, homo sapien
aagatatgcttaggctttatatgcaratgtacacaatagagagcaaaagc

SEQ ID NO: 90691 - DNA, 50 bp, homo sapien
aagctgggtgataatctcttgggaartatttagcacagacacctccacct

SEQ ID NO: 90692 - DNA, 50 bp, homo sapien
tcccctattttttctgtaacctcaakacattataaaagcctcaactatcc

SEQ ID NO: 90693 - DNA, 50 bp, homo sapien
taatttttaaaaactgaagaaataasgtagatgtgagttttcatattaca

SEQ ID NO: 90694 - DNA, 50 bp, homo sapien
cattttcaggtaacaggtgaaagaayggacattataaagatattgaatca

SEQ ID NO: 90695 - DNA, 50 bp, homo sapien
aaatgtgtcagtttgtatgaaatagmactccaaggcatcttgatgagtct

SEQ ID NO: 90696 - DNA, 50 bp, homo sapien
catatgcaaagtacaaatccctgaaraagaaactccccagtccacagtaa

SEQ ID NO: 90697 - DNA, 50 bp, homo sapien
actgtaagtgaattaaagtaataaamtcagacatgttccttttcttaatt

SEQ ID NO: 90698 - DNA, 50 bp, homo sapien
cctgaccatggaaaaatcattaagartatgccttcagtttaaaaacgtga

SEQ ID NO: 90699 - DNA, 50 bp, homo sapien
tttagacatacttctattgcacactmagctggttatattgtaatgtaaac

SEQ ID NO: 90700 - DNA, 50 bp, homo sapien
tcttctagagctggctgttgtttgtraaatcgagtattcgccactaaaat

SEQ ID NO: 90701 - DNA, 50 bp, homo sapien
gtggcctggagggatattatttactyagaacggcacttaattccatgtta

SEQ ID NO: 90702 - DNA, 50 bp, homo sapien
gagtaacaaacattagtaatgagtayataaaatttttactcttttctccc

SEQ ID NO: 90703 - DNA, 50 bp, homo sapien
aagtaatttttggcagacctaaataygtgagctagatcaatttcagacca

SEQ ID NO: 90704 - DNA, 50 bp, homo sapien
atacttcccaagagattatcacccarctttacaggcagaatgtcattagt

SEQ ID NO: 90705 - DNA, 50 bp, homo sapien
aaagctcaagcaaagaggatgtaaaraaaagctacagactgggaggatat

SEQ ID NO: 90706 - DNA, 50 bp, homo sapien
aatgagttatatgcttctgcttgacmaacatgcttttataatgaccttga

SEQ ID NO: 90707 - DNA, 50 bp, homo sapien
tcagcttcatattacttatagaagcracctacttacatattttgtcaagc

SEQ ID NO: 90708 - DNA, 50 bp, homo sapien
aaagagcttttagacttgacaccaaytgaatggtctttaaaaggaaggac

SEQ ID NO: 90709 - DNA, 50 bp, homo sapien
aggccattaagaaaaatcgtataccytgtgatgaaaactagaaacaagct

SEQ ID NO: 90710 - DNA, 50 bp, homo sapien
ttgcatagtaccaaatcctaataagyccatccaaataggttgtttgtcct

SEQ ID NO: 90711 - DNA, 50 bp, homo sapien
ttggtaaaggtgtaaataggtgtgcratgaaagttgattacctaataatt

SEQ ID NO: 90712 - DNA, 50 bp, homo sapien
aaaacaaaaagaaagaaagaaaaaargctttatcgcaattataaaagagc

SEQ ID NO: 90713 - DNA, 50 bp, homo sapien
cagacttaattgaacaactttattckatgcacaacttttcaggaacacat

SEQ ID NO: 90714 - DNA, 50 bp, homo sapien
aaaataactaatgatatgaactaggkccaaatgagtgacataaaccacaa

SEQ ID NO: 90715 - DNA, 50 bp, homo sapien
aggagggagaaaaaggcctatgagtraagagataccaattctgcccccag

SEQ ID NO: 90716 - DNA, 50 bp, homo sapien
gcaagggaatctagtccagtagcaartaacatggctaagtactacattct

SEQ ID NO: 90717 - DNA, 32 bp, homo sapien
tagctggttgaatgtcrctaattattttattt

SEQ ID NO: 90718 - DNA, 50 bp, homo sapien
atatccactctcactgaagaggtaaygttcatattctcgagggagcacag

SEQ ID NO: 90719 - DNA, 50 bp, homo sapien
ctgtcactgttgacctgccaaccagwacattgctatcaagatttcacagc

SEQ ID NO: 90720 - DNA, 50 bp, homo sapien
aaatttttacatttttttaatgacckccagatttcacctgaataaaaacc

SEQ ID NO: 90721 - DNA, 50 bp, homo sapien
cgaacataaataatggcgtaaagaawctaccaagtactttgtcagaataa

SEQ ID NO: 90722 - DNA, 50 bp, homo sapien
ttcatggaataataatggaaaactgyatttgaacttgcaggccaacaata

SEQ ID NO: 90723 - DNA, 50 bp, homo sapien
gatcataataggatgcatagctccaragaaaaatgcctagtgcatcagca

SEQ ID NO: 90724 - DNA, 50 bp, homo sapien
atctgaccatactgagctcatcatgraatactgtaatggagttgctgtga

SEQ ID NO: 90725 - DNA, 50 bp, homo sapien
ttgatcattcacattacaaaatgcasataataaaacacctactcatttta

SEQ ID NO: 90726 - DNA, 50 bp, homo sapien
gaattcaggaaagttaaatgtgtaartactgcggctcctgagaatattat

SEQ ID NO: 90727 - DNA, 50 bp, homo sapien
atatttgtgtggtctgacaaaagaasgttgaaagctcgagggcctccaat

SEQ ID NO: 90728 - DNA, 50 bp, homo sapien
acctaagccagggaattgactttccygattctcagcgtcttctttcttaa

SEQ ID NO: 90729 - DNA, 50 bp, homo sapien
ggttattataattacgcgacacttaygggaaggaggagggaaagcaggga

SEQ ID NO: 90730 - DNA, 50 bp, homo sapien
tgaggcaaacaccttagtctgagaawgtgtgggaattcttataatatgtg

SEQ ID NO: 90731 - DNA, 50 bp, homo sapien
tagaaaaattctaaactctaatgacwactactttggttggagaaatgaca

SEQ ID NO: 90732 - DNA, 50 bp, homo sapien
ttctactttaattatgaaaaattacraaagtacaaaatatctagataatt

SEQ ID NO: 90733 - DNA, 50 bp, homo sapien
atgggtactcttgaaatcaccataaraaactgtaggcctatccagctttg

SEQ ID NO: 90734 - DNA, 50 bp, homo sapien
gacagaagtattacagttgggattgmattactatcttccatatttgttaa

SEQ ID NO: 90735 - DNA, 50 bp, homo sapien
atctactgaggctaaaataagctcartataaagatgggaataaactatag

SEQ ID NO: 90736 - DNA, 50 bp, homo sapien
tagtatcttagatattaggccatgckaaattaaactggagtctttgctac

SEQ ID NO: 90737 - DNA, 50 bp, homo sapien
tcaccagtctatgaccctcagtacawtaatctgtagtctcagttctaggg

SEQ ID NO: 90738 - DNA, 50 bp, homo sapien
cagtgtaatgttactgtttataagaygcctacaataaagaacattgcttg

SEQ ID NO: 90739 - DNA, 50 bp, homo sapien
ataaactactgtaagtcctccagtayacatatgaagtctggtaagattaa

SEQ ID NO: 90740 - DNA, 50 bp, homo sapien
agagctaacatgagtgtttcttaacygattcccacaaagcagctaaaaat

SEQ ID NO: 90741 - DNA, 50 bp, homo sapien
caacagcagtcaataaataagaaacwcattggttacttaaaaattctctc

SEQ ID NO: 90742 - DNA, 50 bp, homo sapien
ctacagaaggccaatgtattaaagartcctgaaaatgtcagtatatgcag

SEQ ID NO: 90743 - DNA, 50 bp, homo sapien
tctttgtttatgcattttgtcatttygggatgagaagttgtactattcta

SEQ ID NO: 90744 - DNA, 50 bp, homo sapien
cttttccctttttattagaatcttaygttacccacagctaggtcttattc

SEQ ID NO: 90745 - DNA, 50 bp, homo sapien
tcaaaatgatctaaacagagactaamtgaaatatattaatatatataaat

SEQ ID NO: 90746 - DNA, 50 bp, homo sapien
tgaatcctagtaagccaagttgttamcctagtaatattttcaaataatga

SEQ ID NO: 90747 - DNA, 50 bp, homo sapien
ctacgatacagttgtattgtactacygaaatgctactacaaatacagtat

SEQ ID NO: 90748 - DNA, 50 bp, homo sapien
tgttaataatataaataggttaatawgtgtcaattatgttaatattaaat

SEQ ID NO: 90749 - DNA, 50 bp, homo sapien
gctttaaaagaaaagtagatattccmagctgtaaaagtattaagtggaac

SEQ ID NO: 90750 - DNA, 50 bp, homo sapien
atgaaaggcactgaaagataccctargcctagaaagttctctcaaatggc

SEQ ID NO: 90751 - DNA, 50 bp, homo sapien
tctaaggatggtttcttagcatttgwagggacccaatcttgaacacacat

SEQ ID NO: 90752 - DNA, 50 bp, homo sapien
tcggaagttcattctttgaatctaaygaaagtaaaagataaagtcacaga

SEQ ID NO: 90753 - DNA, 50 bp, homo sapien
ggggccattactcagcctactacggwcatatttaattttaagtggctgct

SEQ ID NO: 90754 - DNA, 50 bp, homo sapien
agggaacaactgttttgatgggtagmccacggatgtagaagaagattaaa

SEQ ID NO: 90755 - DNA, 50 bp, homo sapien
tgagatccctgttatacttccatcamgactcacaagtgatcacccagcct

SEQ ID NO: 90756 - DNA, 50 bp, homo sapien
accttaatcgtatagtctattccacygtaattgatggtttagttatccac

SEQ ID NO: 90757 - DNA, 50 bp, homo sapien
ctatgaataaataggtcagtttatgkcatactggagtatagatccacgtc

SEQ ID NO: 90758 - DNA, 50 bp, homo sapien
tatggcatactggagtatagatccaygtctctgttctcctagcccaacat

SEQ ID NO: 90759 - DNA, 50 bp, homo sapien
gaaagaaatattcttatgatatagcrcagcatgtttcatagctccagcta

SEQ ID NO: 90760 - DNA, 50 bp, homo sapien
acaattaaatggattttataggtcascgccattgaacaggaatatacatg

SEQ ID NO: 90761 - DNA, 50 bp, homo sapien
aattcacagactaatcgaggaatcakgtatacagccattctgtcatttat

SEQ ID NO: 90762 - DNA, 50 bp, homo sapien
agtgagtaatcctgaataaaattgayaaaatagtttgagaaaagtagaga

SEQ ID NO: 90763 - DNA, 50 bp, homo sapien
agaacaatgccagtgaactaatgcgraagtcttttagagaaatatattga

SEQ ID NO: 90764 - DNA, 50 bp, homo sapien
acaaaaacacttttgcaatttcagargaaactaaactcatctagaagctt

SEQ ID NO: 90765 - DNA, 50 bp, homo sapien
ggttgtgtctttcaaggtcttatcamaattgttttcagcaaaacactcca

SEQ ID NO: 90766 - DNA, 50 bp, homo sapien
taacacctgcaatgtgtcagataggmattatgtaccagatgacataatac

SEQ ID NO: 90767 - DNA, 50 bp, homo sapien
tttctaggttgtacatttcattcgamccttctgataaaaaccttaaagga

SEQ ID NO: 90768 - DNA, 50 bp, homo sapien
atgtgttcatactctatgtgatttaragatggtgaattctgtgatgatca

SEQ ID NO: 90769 - DNA, 50 bp, homo sapien
ttttgtttttatttaacaatacataygaaatttttggaaagcagatttta

SEQ ID NO: 90770 - DNA, 50 bp, homo sapien
aagacatgttaaaaatgtctttaccygaagagtgatgggatgacagtgaa

SEQ ID NO: 90771 - DNA, 50 bp, homo sapien
tttggtgtggaccccctaaagttaaytggatcacctttatgaacatgtaa

SEQ ID NO: 90772 - DNA, 50 bp, homo sapien
agtgcccatttaatgacagcataaargagcttccctcctagaaagagcca

SEQ ID NO: 90773 - DNA, 50 bp, homo sapien
tatgctgtcattaaatgggcacttaygattctccaatcatacatcagggt

SEQ ID NO: 90774 - DNA, 50 bp, homo sapien
ggagcaactgcaattctcatatatcrctgatgggaaagcaaaatggtaca

SEQ ID NO: 90775 - DNA, 50 bp, homo sapien
agtatttgttattatggttagcaaayattattgttaagagcacaaatgta

SEQ ID NO: 90776 - DNA, 50 bp, homo sapien
aatatattacaagctaagcatttgargagtgagaaactgaaaccctagat

SEQ ID NO: 90777 - DNA, 50 bp, homo sapien
tatatcagccagatttgattcttgakaggatttctggagaggacaagcca

SEQ ID NO: 90778 - DNA, 50 bp, homo sapien
ttcttaccaaactatcaataccacargtgtgtccgattaacataggcttt

SEQ ID NO: 90779 - DNA, 50 bp, homo sapien
acccagagtgaataattgcataaaakgtaacaatgagatatttataaata

SEQ ID NO: 90780 - DNA, 50 bp, homo sapien
acacattcctaactaatctagtacarctttttaactggctgtttacttaa

SEQ ID NO: 90781 - DNA, 50 bp, homo sapien
taaaccaatatgatgggtaaccttayaggaaagagaaatttggacactga

SEQ ID NO: 90782 - DNA, 50 bp, homo sapien
ttctcaacgtgcgtaaatcactcatyaattccacaactctctgttgaact

SEQ ID NO: 90783 - DNA, 50 bp, homo sapien
gtgtgaacattaattctccaacccayggtcttgagctgatccaacctatg

SEQ ID NO: 90784 - DNA, 50 bp, homo sapien
attgattatttgagtcattatcagamgttttaaaagatcaacaatactga

SEQ ID NO: 90785 - DNA, 50 bp, homo sapien
caacctaacgtggataaaaacctgcmaatacaggagagctaactctacta

SEQ ID NO: 90786 - DNA, 50 bp, homo sapien
tgaaaaaagtagaatttcaccaatayctttaaagtcttcatgaaattttt

SEQ ID NO: 90787 - DNA, 50 bp, homo sapien
aaaatgccttcagagttagcttaccrctctgatacttttaactcacatta

SEQ ID NO: 90788 - DNA, 50 bp, homo sapien
gtctgaaccacatagaattacacacygaagaggttttgttgtgactacca

SEQ ID NO: 90789 - DNA, 50 bp, homo sapien
ctttatcatctgatattttttcagaracactagtaaaaatgtaggtaatg

SEQ ID NO: 90790 - DNA, 50 bp, homo sapien
agaaatagtaaactggtatattaagraccaaaaataacagctgatgttgc

SEQ ID NO: 90791 - DNA, 50 bp, homo sapien
ctggaaatcttttcagaaaggagacsatcagttgagacaaacagaaacga

SEQ ID NO: 90792 - DNA, 50 bp, homo sapien
taaaaataattccattatttcactarggatttgacatttgaaagccccca

SEQ ID NO: 90793 - DNA, 50 bp, homo sapien
atatctgtaagtgtcctcatttacargttcttgattcttagagaacagag

SEQ ID NO: 90794 - DNA, 50 bp, homo sapien
cactatggacaaaagattcttcataygtaggcaaaaataactagagaaga

SEQ ID NO: 90795 - DNA, 50 bp, homo sapien
tggcttttcctgatccagctacttayctattcctatctttaaatgctggt

SEQ ID NO: 90796 - DNA, 50 bp, homo sapien
gagatactagataaagagataaacascaaataaatgcaacaaatggccaa

SEQ ID NO: 90797 - DNA, 50 bp, homo sapien
taaaatgtctttttcaatcatttcayaggtaaattggagtgtcccaggta

SEQ ID NO: 90798 - DNA, 50 bp, homo sapien
tgatgtatggcttatgtaagttttayaggatgaaaaagcattaaggaaaa

SEQ ID NO: 90799 - DNA, 50 bp, homo sapien
taaagctaatgataagagaatgcacratccagctgtcatacaaggaccta

SEQ ID NO: 90800 - DNA, 50 bp, homo sapien
atctctgaatttcttaatacctaatrtaatgtctgatactctgtggtgct

SEQ ID NO: 90801 - DNA, 50 bp, homo sapien
gctcatcctaaatttccataccacastctcttcactatttatatcttatc

SEQ ID NO: 90802 - DNA, 32 bp, homo sapien
cctaccctgcacatgcyatgaatgttgcatct

SEQ ID NO: 90803 - DNA, 50 bp, homo sapien
ttggtattcctgacaacactatgccytttcactctttgtctttctagaga

SEQ ID NO: 90804 - DNA, 50 bp, homo sapien
agcagtgctcatttcccgcttactcractatatcaagatattcaatttat

SEQ ID NO: 90805 - DNA, 50 bp, homo sapien
agaatcatgagcatggcttaatgtawcatcaaacttggaagaaatggtgg

SEQ ID NO: 90806 - DNA, 50 bp, homo sapien
caatgattagagttaccagtccttayggcatttgggtaagtcgggactct

SEQ ID NO: 90807 - DNA, 50 bp, homo sapien
atacatacaaacaaaattgttagaartgatcagctttctgtgtagaatac

SEQ ID NO: 90808 - DNA, 50 bp, homo sapien
aggtgaaaaattaaaaagtgggtcaratctcaaataaatcatgttgactt

SEQ ID NO: 90809 - DNA, 50 bp, homo sapien
caccgtattaagttcaagtcccagayctacaagaccagttggataataat

SEQ ID NO: 90810 - DNA, 50 bp, homo sapien
tagacaaaccgcttttctgccgttayaccttactcaccttacttaggcta

SEQ ID NO: 90811 - DNA, 50 bp, homo sapien
tgagacatcaaactctaatttctaayagcacaattgaacataaaggtaaa

SEQ ID NO: 90812 - DNA, 50 bp, homo sapien
tgaggctgtcagacatttccacttaygaatttagtgaaactcctaaatca

SEQ ID NO: 90813 - DNA, 50 bp, homo sapien
attactatagaagatttcttcaaacyatgaccttagaattatttaaaatt

SEQ ID NO: 90814 - DNA, 50 bp, homo sapien
actgagatcaaattgtttaataatamtaatcatccccttcaataaagagt

SEQ ID NO: 90815 - DNA, 50 bp, homo sapien
catagtgtctgtggctagggtacaaygtaatttatcagaggccaacattt

SEQ ID NO: 90816 - DNA, 50 bp, homo sapien
ctatatgtttatggtagtgttctatyatacctatatttaagcaatgaatt

SEQ ID NO: 90817 - DNA, 50 bp, homo sapien
gattaaggtctcgaaggttcctgcarttctaacatttgatctctctcctg

SEQ ID NO: 90818 - DNA, 50 bp, homo sapien
ggtgtcattttgacagccctgctatmatacctttactatgtttttgctaa

SEQ ID NO: 90819 - DNA, 50 bp, homo sapien
tctctttaatgagatttgagaagcayccttgtgtaatcattttcacattt

SEQ ID NO: 90820 - DNA, 50 bp, homo sapien
ttgtggtaatttgttacatatcaagraacaagagttatatatgaaatatt

SEQ ID NO: 90821 - DNA, 50 bp, homo sapien
tgaatctccaagatctctttatgctstcacatgctgcatctcagtgatat

SEQ ID NO: 90822 - DNA, 50 bp, homo sapien
ggatgattactgaatgggaagtcacyaatcttaataagacatgaattaaa

SEQ ID NO: 90823 - DNA, 50 bp, homo sapien
gatgcacgaagttttatgatttgaayagtcacctgtctccggaaactatg

SEQ ID NO: 90824 - DNA, 50 bp, homo sapien
gcaaatttctgaattcactacaccaytatgtcatttatttctatgtttct

SEQ ID NO: 90825 - DNA, 50 bp, homo sapien
ataggagttaatctgatcacaattasaggcctatcctttctctgacctga

SEQ ID NO: 90826 - DNA, 50 bp, homo sapien
actctcatacattactgatgggatayaaaatagtacagccactttgaata

SEQ ID NO: 90827 - DNA, 50 bp, homo sapien
cattacgagcccaaagagaacataaytgtggagaaagggtaaattttctc

SEQ ID NO: 90828 - DNA, 50 bp, homo sapien
aagaagaaaactggcatataccgaartgaatagcatggtaagctaatgag

SEQ ID NO: 90829 - DNA, 50 bp, homo sapien
ttcactctgagccttattatactacyggcctcagggtctgagtgatagga

SEQ ID NO: 90830 - DNA, 50 bp, homo sapien
cctacataaatgccaagtccagaggratagagctacgtggtaaacaagag

SEQ ID NO: 90831 - DNA, 50 bp, homo sapien
ctcaggaagaaaaagagcagggttayctaacaaaagacacgctcataaac

SEQ ID NO: 90832 - DNA, 50 bp, homo sapien
ccaaaaataaaaaataaagattctartaagcactcagtaaatatcaactg

SEQ ID NO: 90833 - DNA, 50 bp, homo sapien
taatttgcctgacttaaaaacctcayacatctcagtgccagatctttgta

SEQ ID NO: 90834 - DNA, 50 bp, homo sapien
gtaatttctgaatcaatgtagagagratacatcagtatgggaaatgagcc

SEQ ID NO: 90835 - DNA, 50 bp, homo sapien
aaggatggttctacttttgagttgastatgttacctagatataatgactc

SEQ ID NO: 90836 - DNA, 50 bp, homo sapien
ctggacttaagggacagagaccaacrctggcttacttacagggccttgta

SEQ ID NO: 90837 - DNA, 50 bp, homo sapien
ttctgggctttttcaaatactaggaragtgtggacagagcattctcatct

SEQ ID NO: 90838 - DNA, 50 bp, homo sapien
ataactagaaaacctctaatacataygctctaatcagcttcagtaacatg

SEQ ID NO: 90839 - DNA, 50 bp, homo sapien
taaggttacttggtcattagttctakgtaaaaattgataattgatatcct

SEQ ID NO: 90840 - DNA, 50 bp, homo sapien
aaattgactgttgattttatatatgscttcaagcttgatccactcatgat

SEQ ID NO: 90841 - DNA, 50 bp, homo sapien
aatagatgtggtaccttaatgggtaygttataattggctcataaccaatc

SEQ ID NO: 90842 - DNA, 50 bp, homo sapien
atgcgcgttgaaatttaattttcacrtcacagtaataagagttgggactt

SEQ ID NO: 90843 - DNA, 50 bp, homo sapien
tctgtgcttcctagagccataatgcraaataagcctaaataaaatctatg

SEQ ID NO: 90844 - DNA, 50 bp, homo sapien
agatactaaaggctgagaaatagcarcaaagatttctacatcatcctaat

SEQ ID NO: 90845 - DNA, 50 bp, homo sapien
gaatccttctctattcagtgctctargtagcttataaattgcaatctaac

SEQ ID NO: 90846 - DNA, 50 bp, homo sapien
tcaaattacaagaaatgatacaattsaattataccctgtgccttgcctag

SEQ ID NO: 90847 - DNA, 50 bp, homo sapien
tcatttctgcaagtgtattttttcayatttatatcatctctcataaagaa

SEQ ID NO: 90848 - DNA, 50 bp, homo sapien
tgacataagtatttgtaatgcttcaratatgtgggttaagtgggaaggtc

SEQ ID NO: 90849 - DNA, 50 bp, homo sapien
atacctacctgtatccatcttgtatmttttcaaaacactcattttattgt

SEQ ID NO: 90850 - DNA, 50 bp, homo sapien
aaccaccctaggtgtagcttaaagamtataaaatcatgtctgtaagtata

SEQ ID NO: 90851 - DNA, 50 bp, homo sapien
gagagagagcattttattatcaattsaagcttgtcaatactacgtggaat

SEQ ID NO: 90852 - DNA, 50 bp, homo sapien
gatttaaaaagttcaggattaaagtsacatgggaaatcttgaaattttag

SEQ ID NO: 90853 - DNA, 50 bp, homo sapien
cagatcgtcagaaagacacaaagtaygacaaagatttcaaggaatatgac

SEQ ID NO: 90854 - DNA, 50 bp, homo sapien
tgaagctgtaatttttctatagccawatttccaagataaatattttggaa

SEQ ID NO: 90855 - DNA, 50 bp, homo sapien
tcataatattatcaatgtaataaackaattttctcttataggaatcaagt

SEQ ID NO: 90856 - DNA, 50 bp, homo sapien
tattttctaacctgtatttagtagaygttcactgacaataattttctgtt

SEQ ID NO: 90857 - DNA, 50 bp, homo sapien
taaaataaactatttgtcacacataratctcatgtattttataatatttg

SEQ ID NO: 90858 - DNA, 50 bp, homo sapien
ctggagtccattagcctgagattaarctcttggaagcagtggattcttct

SEQ ID NO: 90859 - DNA, 50 bp, homo sapien
attgccaactataacactagtatttmagacactatttgcaaaatatgtta

SEQ ID NO: 90860 - DNA, 50 bp, homo sapien
ttaattacaccagcaggtggcactaygatacactgaaccagggaaaacaa

SEQ ID NO: 90861 - DNA, 50 bp, homo sapien
gaatgtctgttgaatccctggctccrattattcccattcctccattagta

SEQ ID NO: 90862 - DNA, 50 bp, homo sapien
taagaatttttaagactatttgaacrcaatttgtgcgatgcacactcatc

SEQ ID NO: 90863 - DNA, 50 bp, homo sapien
aagagaagaacatatatttgtaaacrgcgaacgatgattactacaggtac

SEQ ID NO: 90864 - DNA, 50 bp, homo sapien
tcatccacaaggattcaagtatagawgtatggagtccttctcaggccata

SEQ ID NO: 90865 - DNA, 50 bp, homo sapien
tttgcctattcttcctcatagaaaasacacgggtcagcatcttcaatagc

SEQ ID NO: 90866 - DNA, 50 bp, homo sapien
acaaacttgcagcacttttaagcaayctatgcatcatcatttgataatca

SEQ ID NO: 90867 - DNA, 50 bp, homo sapien
caaggacatataatgtgagcaagaartatcctatggttgtttgaagttac

SEQ ID NO: 90868 - DNA, 50 bp, homo sapien
caaatagttggctttttctgttctaygttctgagctacaccagtttctcc

SEQ ID NO: 90869 - DNA, 50 bp, homo sapien
cacctagtttccttctgaccactatytcttgccacttcagtgaatggagt

SEQ ID NO: 90870 - DNA, 50 bp, homo sapien
tagtagttcacctctaagggtgatawcctggttgtgaaagtttcagaatc

SEQ ID NO: 90871 - DNA, 50 bp, homo sapien
agacttaatcttctgaacattacaamcatactaaattggattaattagca

SEQ ID NO: 90872 - DNA, 50 bp, homo sapien
ggagtttattctagttttctttccayatttgtacttcccttttttgacaa

SEQ ID NO: 90873 - DNA, 50 bp, homo sapien
aatatgactctatttggagatagagsctttcaagaaatgactaagttaaa

SEQ ID NO: 90874 - DNA, 50 bp, homo sapien
tctaatttcttctttgtcagcacaamagtaaaccctcaaaatacattata

SEQ ID NO: 90875 - DNA, 50 bp, homo sapien
ttaacaaagggaaggggtacatgagrcaaagtcccaaggaatccaggtgc

SEQ ID NO: 90876 - DNA, 50 bp, homo sapien
tccatagtagttctttatgcaagcartagtctagtagaaattaaaaagat

SEQ ID NO: 90877 - DNA, 50 bp, homo sapien
ctattgaatttcttaggctatgttaygtaatattgttttagtcaaaaaca

SEQ ID NO: 90878 - DNA, 50 bp, homo sapien
attgttaatagcaagaattggcttayagtgacttaatgtttatgattctg

SEQ ID NO: 90879 - DNA, 50 bp, homo sapien
aatagtaccttatctattctgagtargtccatacacttgagaagatttta

SEQ ID NO: 90880 - DNA, 50 bp, homo sapien
tctgaaaaaaatactttggtcttcarctataaaggtcttgaaaatgatcc

SEQ ID NO: 90881 - DNA, 50 bp, homo sapien
ggaaaggctacaggcagccatagcamacttggaatcatatacgaaaaagt

SEQ ID NO: 90882 - DNA, 50 bp, homo sapien
ttcagatattcctatggtgttcttgsaaagtactggtgaaagatttatcc

SEQ ID NO: 90883 - DNA, 50 bp, homo sapien
agactaatcaaatcaaattctgtaayactaaagttggaaaagaactctct

SEQ ID NO: 90884 - DNA, 50 bp, homo sapien
tccttccccatgtctataaacagacrctccaattttagtgaatataccca

SEQ ID NO: 90885 - DNA, 50 bp, homo sapien
gcaacgctgttttgtaagagaatcgyattctgagtgagaaaatcaagata

SEQ ID NO: 90886 - DNA, 50 bp, homo sapien
gtgcctgcaaccctgccctctgggaygatcaactgatttgggcgagatgg

SEQ ID NO: 90887 - DNA, 50 bp, homo sapien
tttatctctgttttagatacttacasaacataacaaccaaattatctatt

SEQ ID NO: 90888 - DNA, 50 bp, homo sapien
atatgaatttatgtggaaaatgtcamatccaaaggaatgtaaggtcaaaa

SEQ ID NO: 90889 - DNA, 50 bp, homo sapien
cttttcttcacctttcagagccttaygtctattttttatataatggtcag

SEQ ID NO: 90890 - DNA, 50 bp, homo sapien
ggttctagaaactaaatatagaatcrcaatagaatgtagcatataacact

SEQ ID NO: 90891 - DNA, 50 bp, homo sapien
acaaagaagaaagagaaaattgtaawtgaagtagtatcaagctgattcaa

SEQ ID NO: 90892 - DNA, 50 bp, homo sapien
atcattcttccagttgttcacggaargagcattttaactagccctggcta

SEQ ID NO: 90893 - DNA, 50 bp, homo sapien
ttaaaatcataatcctgtttttgacratacttaagaatatgtaatgctta

SEQ ID NO: 90894 - DNA, 50 bp, homo sapien
acatgggtatgattactccagtcaasaattttataacttgccctgaaaat

SEQ ID NO: 90895 - DNA, 50 bp, homo sapien
acagggataaattaacacaggacctraggacagagataatttacaagctc

SEQ ID NO: 90896 - DNA, 50 bp, homo sapien
taaagacatcatttacatcagcggastaaagatgagaaattcattctaat

SEQ ID NO: 90897 - DNA, 50 bp, homo sapien
tattagtacttctttccctatgatamtataaggtattcttgggagctgct

SEQ ID NO: 90898 - DNA, 50 bp, homo sapien
gaaagtttgggtgtgtttgaggttaytgcacttgcattttgtagtgctct

SEQ ID NO: 90899 - DNA, 50 bp, homo sapien
aatgcctggattgccttatgtgacamctcactccatctaattgaacctta

SEQ ID NO: 90900 - DNA, 50 bp, homo sapien
caggctaatatagagtcacaaatgaratcaacttccctagaacagaaact

SEQ ID NO: 90901 - DNA, 50 bp, homo sapien
ccaattcaagatgtgcatttaaacayggcctctcaccttggcgctcagga

SEQ ID NO: 90902 - DNA, 50 bp, homo sapien
gacctaaaaaaatacgttaaaataargagtcacattttggcagggaagga

SEQ ID NO: 90903 - DNA, 50 bp, homo sapien
ttcagcatcttccagtcatgcttaamacataagacatgtcaaggtgtagc

SEQ ID NO: 90904 - DNA, 50 bp, homo sapien
cttacctctgagactcttgcagaagrcaatggatatcggcagttgaaagt

SEQ ID NO: 90905 - DNA, 50 bp, homo sapien
ttcgccattattctttgctcttggaktttttaagataattttctttgttt

SEQ ID NO: 90906 - DNA, 50 bp, homo sapien
ctcaatgctttagagtgtctagcaasctttgggctctccatagatgttgg

SEQ ID NO: 90907 - DNA, 50 bp, homo sapien
atttgagcatagcgtagaattggcarcattttttgtaagtcagggaataa

SEQ ID NO: 90908 - DNA, 50 bp, homo sapien
gtgtttttacaaatggaggcaatgaygtttagccatttacttggatacat

SEQ ID NO: 90909 - DNA, 50 bp, homo sapien
ggcctcatatgaggaggcgtactaaytgatacagtaaaactttttgatat

SEQ ID NO: 90910 - DNA, 50 bp, homo sapien
tagaatggaagtgctgtacaatgaayctgagactgacttcctctttgata

SEQ ID NO: 90911 - DNA, 50 bp, homo sapien
ttctgtagaattcttagcctttttgsgttctgaagtatgaaacagcttaa

SEQ ID NO: 90912 - DNA, 50 bp, homo sapien
tagatgatccactgggccagtgggayatctcttgataaagtgacacccaa

SEQ ID NO: 90913 - DNA, 50 bp, homo sapien
atacaattacatggagcagttaacawagcttggtatatcataggcactga

SEQ ID NO: 90914 - DNA, 50 bp, homo sapien
taaactggcaaatgaaacaataaagkcttgctaacaaggggctttgacta

SEQ ID NO: 90915 - DNA, 50 bp, homo sapien
catcagagaatattatgattacttayatgtgcataaactagaaaatctga

SEQ ID NO: 90916 - DNA, 50 bp, homo sapien
cttagaagattagacagaattaatamggcagtcaaaagaagtcatctttt

SEQ ID NO: 90917 - DNA, 50 bp, homo sapien
ataaaaataccagtcagcatacttaygtgtggagaagttagtaccttcat

SEQ ID NO: 90918 - DNA, 50 bp, homo sapien
catcatcattatgtaaaattcctatraagctttggaaaacagaactttgc

SEQ ID NO: 90919 - DNA, 50 bp, homo sapien
tgcttgaaatattcattttctgcgarcgtatgggccattgaggattacag

SEQ ID NO: 90920 - DNA, 50 bp, homo sapien
gtaacccatagaaaatgtgattggaycatagcactattgagatattttaa

SEQ ID NO: 90921 - DNA, 50 bp, homo sapien
atggattgatttgtgaattgaccaaygggtttaagaagttcaggaaatcc

SEQ ID NO: 90922 - DNA, 50 bp, homo sapien
actgtaacctatgcttcactaaacamaacacttatggtctaatttagatt

SEQ ID NO: 90923 - DNA, 50 bp, homo sapien
tatcattgctagaaatttctctttaygtcaaggtgacttttcccatagta

SEQ ID NO: 90924 - DNA, 50 bp, homo sapien
tttaaccctgtacagctaaaactaaytatgcactaggcttttccttgagc

SEQ ID NO: 90925 - DNA, 50 bp, homo sapien
atgcactaggcttttccttgagctamgcaatatgaagtactaactcaggc

SEQ ID NO: 90926 - DNA, 50 bp, homo sapien
agtctaaaatttcaagaatcctcacmtggctgtaaaaaccactaaaaatg

SEQ ID NO: 90927 - DNA, 50 bp, homo sapien
taaaagacacaaatggataataaaaytgaatggcctttaaataaaaggat

SEQ ID NO: 90928 - DNA, 50 bp, homo sapien
accatctttatacttctggaacttaycaaaaagttatagccaataagagt

SEQ ID NO: 90929 - DNA, 50 bp, homo sapien
aaatacttgtcttcattatatcagasagcaaagtattttttaaaaaaact

SEQ ID NO: 90930 - DNA, 50 bp, homo sapien
cttttcaggtcggcagtgctccccarcaaagagtatgaagaatgggtgag

SEQ ID NO: 90931 - DNA, 50 bp, homo sapien
ttataatcatcatagtctgttataaygaagagctactttggatgtacaat

SEQ ID NO: 90932 - DNA, 50 bp, homo sapien
aaataaaaatgatgagtgagttgcaygttgggataaaatagagtgacata

SEQ ID NO: 90933 - DNA, 50 bp, homo sapien
tggggcagtcacagcagcctgaggakatggaataagcccagctggggcat

SEQ ID NO: 90934 - DNA, 50 bp, homo sapien
ctttatcgtcaattattgaggtcaamtgaactgtcagcactcttgtgggc

SEQ ID NO: 90935 - DNA, 50 bp, homo sapien
tttctttatccaatccactgttgacrggcatttacattgatttcatgtcc

SEQ ID NO: 90936 - DNA, 50 bp, homo sapien
cagctctcttcattaaaattgccacrcttaaacactacactacacatctt

SEQ ID NO: 90937 - DNA, 50 bp, homo sapien
ggccattttctttagttcaactctcrctaaggcaggagacgaagtcccta

SEQ ID NO: 90938 - DNA, 50 bp, homo sapien
ttaaaaataatctagaaagtgtatgmataacaaaaataacatagccaaaa

SEQ ID NO: 90939 - DNA, 50 bp, homo sapien
gagagagagagagtttcaaaacttakattatcattttggcaatataataa

SEQ ID NO: 90940 - DNA, 50 bp, homo sapien
tgctgtctggaggacttaagccttascagtatcagagttctgaagattac

SEQ ID NO: 90941 - DNA, 50 bp, homo sapien
agcaaaaatacagcacttgagtagtsactggtaaagaggactgacacttt

SEQ ID NO: 90942 - DNA, 50 bp, homo sapien
ccctattgtgaagcgcgcatgcaatrgatccagggtgtatgctccttatg

SEQ ID NO: 90943 - DNA, 50 bp, homo sapien
tagcagccacagtagcagctctcaaytatgtccgcaagtggctaaaatgg

SEQ ID NO: 90944 - DNA, 50 bp, homo sapien
taggggaatgcaattcaacctattgyatatggcttccaatattcttagtg

SEQ ID NO: 90945 - DNA, 32 bp, homo sapien
aagtccttctccaagcrataaattgtcattta

SEQ ID NO: 90946 - DNA, 50 bp, homo sapien
gtatatatgtgtactcgttgtaggcrgatcagagcacaaaacgtttgctg

SEQ ID NO: 90947 - DNA, 50 bp, homo sapien
caggaatattacatctgctacttgtsaatatgaaagaatagagaaattag

SEQ ID NO: 90948 - DNA, 50 bp, homo sapien
tggaatagatggagagttgtccataraggaatcaggagggatagatggag

SEQ ID NO: 90949 - DNA, 50 bp, homo sapien
ttctaacccaatattctcttctaaaycaaaggacattatatgttttagcc

SEQ ID NO: 90950 - DNA, 50 bp, homo sapien
atcaggcagataaaaattatataaawgagcaataaacaacgctagatgta

SEQ ID NO: 90951 - DNA, 50 bp, homo sapien
aagccaaatgctaagttgaacctgtyaaattgagttctcctccaacgagt

SEQ ID NO: 90952 - DNA, 50 bp, homo sapien
tggataactgctacacaatatggaarttaacatataatttacttttatgt

SEQ ID NO: 90953 - DNA, 50 bp, homo sapien
catatgttggaccaaccttacatctyagaaataaagtctacttgattgag

SEQ ID NO: 90954 - DNA, 50 bp, homo sapien
gggacaaatatcagaaatgaagaagytgcataatgatgaagcttaaagaa

SEQ ID NO: 90955 - DNA, 50 bp, homo sapien
tagttacaatggatatgttcattttwtgtgagcaaatgggagatgcctac

SEQ ID NO: 90956 - DNA, 50 bp, homo sapien
tcctagcaatgttaagcaataaaacrggaaatacatttagactcagaaaa

SEQ ID NO: 90957 - DNA, 50 bp, homo sapien
tatcttgagccttttaagatcaatasaaaacttagattgtgtggttatct

SEQ ID NO: 90958 - DNA, 50 bp, homo sapien
cttactttgacatatatcttataaawcccaaactgatagcacaccaaaac

SEQ ID NO: 90959 - DNA, 50 bp, homo sapien
attagactatttcaggttttattgamcattccatcaattgcctactaacc

SEQ ID NO: 90960 - DNA, 50 bp, homo sapien
gaaaacagggacttgtatcatttacrctatttgtcccagaacattatcat

SEQ ID NO: 90961 - DNA, 50 bp, homo sapien
atcccagaagaaaaaagggacattaygaatatagcagattttttcaatgt

SEQ ID NO: 90962 - DNA, 50 bp, homo sapien
ctgttgtacctacctctatacatacrctataggaaatgttctgcattatg

SEQ ID NO: 90963 - DNA, 50 bp, homo sapien
ttaaaagactctgatgcattgtttcrtatgccaattgtatttttcagccc

SEQ ID NO: 90964 - DNA, 50 bp, homo sapien
gtcctgattactatatccacagaaasgaatggtatgtaggctttgaaata

SEQ ID NO: 90965 - DNA, 50 bp, homo sapien
gtaaaggagttcatagataaacagasagcaagcatagcttttctggaata

SEQ ID NO: 90966 - DNA, 50 bp, homo sapien
ttagtatcagtgtaatactagccacrtagaataagtttggaagcatatat

SEQ ID NO: 90967 - DNA, 50 bp, homo sapien
tgattctttctctctaaacttaaaaygcattgagataaaaagacagacct

SEQ ID NO: 90968 - DNA, 50 bp, homo sapien
ctataatccttcccgaggttttgacrcagtgggttcagaacagccttgat

SEQ ID NO: 90969 - DNA, 50 bp, homo sapien
aataaaatatcatctgaataggatcyatgtggaaatagccactaaacaat

SEQ ID NO: 90970 - DNA, 50 bp, homo sapien
tgagtctctcctattctgctgtgcaytaacactataattctctatctcca

SEQ ID NO: 90971 - DNA, 50 bp, homo sapien
gtattcccagggcctgtgatagacaygtaggttttctcctggtgcagttg

SEQ ID NO: 90972 - DNA, 50 bp, homo sapien
ccacatttatatctttcaagcgtacraaccttaatgccaaagagataatc

SEQ ID NO: 90973 - DNA, 50 bp, homo sapien
ctagtgagaatgggaaggcagactcrtgattattccaaagattcagatta

SEQ ID NO: 90974 - DNA, 50 bp, homo sapien
cacctacatatttcattatgcataamcttcgatcaagagatgagatgcag

SEQ ID NO: 90975 - DNA, 50 bp, homo sapien
agtcataggaccattatgagaccccraaattcaattgggcaacatgtgga

SEQ ID NO: 90976 - DNA, 50 bp, homo sapien
agaactagagggtatcactctatcasctaaatttttttctacagacattt

SEQ ID NO: 90977 - DNA, 50 bp, homo sapien
taagcaataaattttcatcttaaccyactaagtcagaaagagttttcaat

SEQ ID NO: 90978 - DNA, 50 bp, homo sapien
tattcagaagacagagacagaatcastgaataaagcaatattagcagact

SEQ ID NO: 90979 - DNA, 50 bp, homo sapien
tcattagcatattttaggattgaaarcatttgaagcttttagcatatcta

SEQ ID NO: 90980 - DNA, 50 bp, homo sapien
gtactgtgataagccctttgcatacracaacatccacattattatgttca

SEQ ID NO: 90981 - DNA, 50 bp, homo sapien
actggatcttgtccaaaacaataaargtagtaacctctatgagtctgcaa

SEQ ID NO: 90982 - DNA, 50 bp, homo sapien
aacagaaaagcatcaaatcacgtatkaaggaaccctcattagactgacag

SEQ ID NO: 90983 - DNA, 50 bp, homo sapien
aggagtctcttttgaagtcaatagcyctatagccaggggttaacggacga

SEQ ID NO: 90984 - DNA, 50 bp, homo sapien
ttgtcatttttgtgatgcagagagartattttcaatagcatgtttaaagc

SEQ ID NO: 90985 - DNA, 50 bp, homo sapien
tgagaacatttcccattgcctagaargtaaaatcatccctttcccatgtc

SEQ ID NO: 90986 - DNA, 50 bp, homo sapien
gctactaccatgacctgaataaaaarcactgaagttagcataagaagccc

SEQ ID NO: 90987 - DNA, 50 bp, homo sapien
gtctaaatcagatagtgagattactrggtttgcttttagtggattttatt

SEQ ID NO: 90988 - DNA, 50 bp, homo sapien
gaaattgattgaggttattagacatraaatacttcaatcaagttattcca

SEQ ID NO: 90989 - DNA, 50 bp, homo sapien
ttcccctcataagcctgtgaaaccaygaattatgtaaccttatcaacacc

SEQ ID NO: 90990 - DNA, 50 bp, homo sapien
attccttgaaacagttataattaccmagaaagcagctttaagaactcttt

SEQ ID NO: 90991 - DNA, 50 bp, homo sapien
tggcttcaggaaagctctttatatcyctattacagtaatgccatattgac

SEQ ID NO: 90992 - DNA, 50 bp, homo sapien
ataattctaagaatcattgtaatctraacttttaaaccaggttttaattg

SEQ ID NO: 90993 - DNA, 50 bp, homo sapien
tttcaagtaatactatgcacaaaaayttaagaaacagtgccaaatgaacc

SEQ ID NO: 90994 - DNA, 50 bp, homo sapien
ttttcttcttctccatatcaatttgraaggttgaccaggagcagctcatt

SEQ ID NO: 90995 - DNA, 50 bp, homo sapien
attggagctggaccaagagatgacasaattattttagagaagctgtctaa

SEQ ID NO: 90996 - DNA, 50 bp, homo sapien
tactagatcagctagtacatagataygaattaattgccaatcttttatgt

SEQ ID NO: 90997 - DNA, 50 bp, homo sapien
agctccctgccaagataccaataaasaggagaaaatgagcctctagagcc

SEQ ID NO: 90998 - DNA, 50 bp, homo sapien
atccaggaatgacaacgcctgtttgwatgagaatgtgcactctacgttgc

SEQ ID NO: 90999 - DNA, 50 bp, homo sapien
tttggaataattctgtcaatcataayggcatagataatagtcagaaagtt

SEQ ID NO: 91000 - DNA, 50 bp, homo sapien
ttagcatcaaatatgttaaccctaaygtcaagagtggcaaatatttcacc

SEQ ID NO: 91001 - DNA, 50 bp, homo sapien
ctaagtacttcatcttttatgctaastatcactgtggtgaaagctcacaa

SEQ ID NO: 91002 - DNA, 50 bp, homo sapien
agtaatgttaatttatggagtatgcrctatctgacaaaacatttgctaag

SEQ ID NO: 91003 - DNA, 50 bp, homo sapien
aaattaatctggcaaaatcaaaatamagtcaacttcaaaaataataaaat

SEQ ID NO: 91004 - DNA, 50 bp, homo sapien
tagatgaatttaagattgtatctaamcttcaaagtaccatatagatttga

SEQ ID NO: 91005 - DNA, 50 bp, homo sapien
tttgccgtctcacagactagagtgamatgttaaacttttgaagtatatct

SEQ ID NO: 91006 - DNA, 50 bp, homo sapien
tttgctgttcctcaacctgaggtcaygtgtgtgcattagacctcattcta

SEQ ID NO: 91007 - DNA, 50 bp, homo sapien
agacacattccgataaccagaaatawtatcacatttaaaacgtggttttc

SEQ ID NO: 91008 - DNA, 50 bp, homo sapien
cgattgtggcttcatgaaattaggaygctgacttgttcttttactctaca

SEQ ID NO: 91009 - DNA, 50 bp, homo sapien
gccccaatatacccttctgatcaccraatattttttcacctcgtttcctt

SEQ ID NO: 91010 - DNA, 50 bp, homo sapien
aatgtaggcttgctgccacaatcaartaagggagcaactaaatagaactc

SEQ ID NO: 91011 - DNA, 50 bp, homo sapien
agtatgtgagttatacatcaatagawctgttataaaaataaagaaattag

SEQ ID NO: 91012 - DNA, 50 bp, homo sapien
tttaactcacaaaactgaaagttcaygctctctaattagttaatgagact

SEQ ID NO: 91013 - DNA, 50 bp, homo sapien
ttaatataagaatgcagacttctccratgattaaagggagagacaggtaa

SEQ ID NO: 91014 - DNA, 50 bp, homo sapien
aaattcttgccttaaggacaatattrgacatctgctttcatcacttaaaa

SEQ ID NO: 91015 - DNA, 50 bp, homo sapien
ccaggcacatagctggctctccgtarttatctcttcaattaataaataag

SEQ ID NO: 91016 - DNA, 50 bp, homo sapien
ttaaaatacacttggtcagggttaayagtgagtcatttttaaggaagttt

SEQ ID NO: 91017 - DNA, 50 bp, homo sapien
cgaaatgtccagttctcttattccarggatatattatgattgtacttttc

SEQ ID NO: 91018 - DNA, 50 bp, homo sapien
gagcccttagatcttggttttcaacrccattcttcaatcaaagaaatgaa

SEQ ID NO: 91019 - DNA, 50 bp, homo sapien
tttaattttgtcaagcaaacagttawcaaactcctgtataaaaccctatt

SEQ ID NO: 91020 - DNA, 50 bp, homo sapien
ttccaataacaactgacataaatcargtattaccattgacttatattgtt

SEQ ID NO: 91021 - DNA, 50 bp, homo sapien
gatttagaaagggatggtactaatayaattaagctgtcaaagttataagg

SEQ ID NO: 91022 - DNA, 50 bp, homo sapien
cagtacctggttttaaccttgtatcrctgaaagaggcaataaagaagtta

SEQ ID NO: 91023 - DNA, 50 bp, homo sapien
gcataagcctaccacctctccactawcatacacagaaaatacacagtggc

SEQ ID NO: 91024 - DNA, 50 bp, homo sapien
gtgatttcaaaaatacatctcactcwcctaaactgaagcttttatactct

SEQ ID NO: 91025 - DNA, 50 bp, homo sapien
gtaagtggacaatgactatggcaaaygctagcaagcccaatgtgtcagtt

SEQ ID NO: 91026 - DNA, 50 bp, homo sapien
aatttttccttgctcaccgtatttayatctttcaagtatatgattcactt

SEQ ID NO: 91027 - DNA, 50 bp, homo sapien
aaattaattaacgtattttcagtgaygactacatataagtaaacagtaaa

SEQ ID NO: 91028 - DNA, 50 bp, homo sapien
ctgcctttccctctgactgtaaatcratatcatagtaacatctcataaat

SEQ ID NO: 91029 - DNA, 50 bp, homo sapien
gaaacactggttttcgagtataaaartgaagtgtcagaagcaatcctgtc

SEQ ID NO: 91030 - DNA, 50 bp, homo sapien
cagaaaaaaacataaaattggtgcartctatatagccctgtttcaggaag

SEQ ID NO: 91031 - DNA, 50 bp, homo sapien
tttgttggtagagcttgagaactaamtaactaacaatcctgaaacacttc

SEQ ID NO: 91032 - DNA, 50 bp, homo sapien
taaggaacactaaggaactagatcaytgagttaaaaagtcgtgttttaag

SEQ ID NO: 91033 - DNA, 50 bp, homo sapien
aaattgtgactctcatagtaacatgwaatgaacagttgtcaaagatttta

SEQ ID NO: 91034 - DNA, 50 bp, homo sapien
cacgtgtaatcttttaaaatacaaayatggttaagctacttagttgttga

SEQ ID NO: 91035 - DNA, 50 bp, homo sapien
ggaatgtgaattgatggtaggaataygcaaattaatgaattaaagctgtt

SEQ ID NO: 91036 - DNA, 50 bp, homo sapien
aaatatcaatggatagatctcatctyactaactttgaatgatctctagat

SEQ ID NO: 91037 - DNA, 50 bp, homo sapien
ttcattttgccctcctcaaccttcaytgaacgtccctttgacatgtgata

SEQ ID NO: 91038 - DNA, 50 bp, homo sapien
acttacatgaaacatccagaatatamaaatccatagaaatagaaaatagg

SEQ ID NO: 91039 - DNA, 50 bp, homo sapien
cctctcaaattaaataggaagtatayagtagaggtgagaatttgtagtta

SEQ ID NO: 91040 - DNA, 50 bp, homo sapien
atctctagaatcacacaaacctataygacacattcaatgatggttattcc

SEQ ID NO: 91041 - DNA, 50 bp, homo sapien
tcagtgagtcagggtttaaataaaartatgcgtcattctaatacatgcct

SEQ ID NO: 91042 - DNA, 50 bp, homo sapien
atagatttagaggttaacatttataygaaggtcaagtgctttggaaacaa

SEQ ID NO: 91043 - DNA, 50 bp, homo sapien
tgccatttacttattgctgtcatatraaaccatctaagacagtactgttc

SEQ ID NO: 91044 - DNA, 50 bp, homo sapien
aatattacaggaaatactttccaacrtcaattttgatttggactcatttg

SEQ ID NO: 91045 - DNA, 50 bp, homo sapien
catatgctacacatctgagtaaatayggagatttcagatttcctagggtt

SEQ ID NO: 91046 - DNA, 50 bp, homo sapien
ttttctttgcattgtgttatcagtargagtgatttaaaaaaattaaatgc

SEQ ID NO: 91047 - DNA, 50 bp, homo sapien
ccctcacttctctaagaggttatcawtaccctgaatactgagtgaaactt

SEQ ID NO: 91048 - DNA, 50 bp, homo sapien
ttcagtgttcttctatgcatcggaamagagaatggttaaagtgctttagg

SEQ ID NO: 91049 - DNA, 50 bp, homo sapien
gaaacaatttatgatgaagatcacayaagtaaatgcaacaaaataaaaaa

SEQ ID NO: 91050 - DNA, 50 bp, homo sapien
tttaaaatggcttagagttctgagasaaagtaaattccattgtttgtaat

SEQ ID NO: 91051 - DNA, 50 bp, homo sapien
ctacaagggagcctggaagtacagayctaccaagtgcttaagagaactaa

SEQ ID NO: 91052 - DNA, 50 bp, homo sapien
caaattaaaaaacaccatagggaatyacctttgatctaggcaataaagaa

SEQ ID NO: 91053 - DNA, 50 bp, homo sapien
taaatagatcaaaaagtttgacctamcatttagtagctgtgtgttatcta

SEQ ID NO: 91054 - DNA, 50 bp, homo sapien
agagccctagttttctcaaggaacargtgaatttccttttcatcttatag

SEQ ID NO: 91055 - DNA, 50 bp, homo sapien
agttcagttattggttatctaattckatttcacatcctttatcagcaaca

SEQ ID NO: 91056 - DNA, 50 bp, homo sapien
aacccatggaacagctatgaactgcyaggtaatttgaatgtgttatgtgt

SEQ ID NO: 91057 - DNA, 50 bp, homo sapien
tccagtgaagacacgcattataagawaggaaaacagacttattgctgata

SEQ ID NO: 91058 - DNA, 50 bp, homo sapien
acctttctcatctttagtgatcacasataaaggatgcatctagaggcagg

SEQ ID NO: 91059 - DNA, 50 bp, homo sapien
tggcttcttcccttatacctgataarccaaactctgatagcttcggactt

SEQ ID NO: 91060 - DNA, 50 bp, homo sapien
ggcagcaagaaataagggagaagcayggtgatttctgaattctgataaaa

SEQ ID NO: 91061 - DNA, 50 bp, homo sapien
accactacacacttattagaatagcyaaattcagaacactaataccacta

SEQ ID NO: 91062 - DNA, 50 bp, homo sapien
aagctttctccaatttctaaatatcwcatggcctttatttattgaatttc

SEQ ID NO: 91063 - DNA, 50 bp, homo sapien
caaaatgagttcagatttcctacackcttgaatgatacctgagggtctta

SEQ ID NO: 91064 - DNA, 50 bp, homo sapien
tacagacctgcaactacaattttcamtaacaaaatcagggcaaatggagg

SEQ ID NO: 91065 - DNA, 50 bp, homo sapien
ttaatcatagaatagtcctttaataygtatccctcatggacataaagagc

SEQ ID NO: 91066 - DNA, 50 bp, homo sapien
cccacccatacacacaatgctcttcyaagtttagggtaccagatattaca

SEQ ID NO: 91067 - DNA, 50 bp, homo sapien
tttcttagatgaggtatgatcagaartgtgaatttggacattttaatggc

SEQ ID NO: 91068 - DNA, 50 bp, homo sapien
attaacactcaactcactttcattcyatggaggttaaagtttaattcaaa

SEQ ID NO: 91069 - DNA, 50 bp, homo sapien
aggaaaatagaatgaaaggagacaaygtacggccttatagattttgtcaa

SEQ ID NO: 91070 - DNA, 50 bp, homo sapien
ttggattctaaagaggggccaataasagaagaactataacaattaaatcg

SEQ ID NO: 91071 - DNA, 50 bp, homo sapien
gcctaatttttggtctagtgatgaayagagtctgaataaaagaaaagaat

SEQ ID NO: 91072 - DNA, 50 bp, homo sapien
tggtgtcaccgtccatcaatggtaawtagtaggtctgtgtaataaagatc

SEQ ID NO: 91073 - DNA, 50 bp, homo sapien
aaggatgacaccctgtaagaattgarcactatcattcagggagtaacaga

SEQ ID NO: 91074 - DNA, 50 bp, homo sapien
agagaatatctgccagctcttaataygagaaaagatttttggtctaactt

SEQ ID NO: 91075 - DNA, 50 bp, homo sapien
tgttggtagcttgtgttagggaagayatacattggaagattcttaacaag

SEQ ID NO: 91076 - DNA, 50 bp, homo sapien
ttgctttattgaaaattgcaattaawgtgatttgtccatttttggatagg

SEQ ID NO: 91077 - DNA, 50 bp, homo sapien
caccttttcatcactttatatggaamgtaaaagccatccattgtaaaata

SEQ ID NO: 91078 - DNA, 50 bp, homo sapien
tccttcatttacaacataaaaagtamagaggcccaaataatatgtagatg

SEQ ID NO: 91079 - DNA, 50 bp, homo sapien
tttgactggatcttgtatgcatttcratttttcccatatgaaatgaagat

SEQ ID NO: 91080 - DNA, 50 bp, homo sapien
cattgtggtagtaggagatgaaagaygaatcagacctagaacctgcccct

SEQ ID NO: 91081 - DNA, 50 bp, homo sapien
ataaactaagcagagtaataggaaasaatggcagaacaaggttaaacaaa

SEQ ID NO: 91082 - DNA, 50 bp, homo sapien
ttcagttactgtaagaaaccaaaaartctgttcatctcaaaatgctatcc

SEQ ID NO: 91083 - DNA, 50 bp, homo sapien
agaatttcttcttcactgattaagcraaatcttctggaagtcttcatttg

SEQ ID NO: 91084 - DNA, 50 bp, homo sapien
aatcactatgttcactgattactaartctcagtaccaaattcattcagtt

SEQ ID NO: 91085 - DNA, 50 bp, homo sapien
attagtgattattaaattgcattaawcagtaaatatttgctatagtactt

SEQ ID NO: 91086 - DNA, 50 bp, homo sapien
cctcttctatttccaatggtgttgakgaagataataaaagctacaagata

SEQ ID NO: 91087 - DNA, 50 bp, homo sapien
tcccttcctctgtagtgaagtagatmaaaagtctcagagacatacgtgaa

SEQ ID NO: 91088 - DNA, 50 bp, homo sapien
tattcgcactttttgcttctccctgmaaaaaagcaagagcagagctccaa

SEQ ID NO: 91089 - DNA, 50 bp, homo sapien
aattgccctagtcccttattatgctsaatttctaatatagtgtggatgat

SEQ ID NO: 91090 - DNA, 50 bp, homo sapien
agtgggatccaatatgatgcaaaatmactagcctagagagagatgaggat

SEQ ID NO: 91091 - DNA, 50 bp, homo sapien
ataattctttagcactatgcctctcyactcgcaaagtcaaactttttttt

SEQ ID NO: 91092 - DNA, 50 bp, homo sapien
ctaaacttatctttgactgattacargtgtctttttcaaacttgagctgt

SEQ ID NO: 91093 - DNA, 50 bp, homo sapien
caccataaaatcaaaaagtatgagaygtagttgcagctgttaaggtgact

SEQ ID NO: 91094 - DNA, 50 bp, homo sapien
ccagaataagttcttctaactcaaayattaatgagagcttatacttcctg

SEQ ID NO: 91095 - DNA, 50 bp, homo sapien
agaggttggggaataaaaattgtaamtccaagtatgctgctccagaaaca

SEQ ID NO: 91096 - DNA, 50 bp, homo sapien
tatatcttttgaaaaactattaacayaactgcgatagttaaaagctttac

SEQ ID NO: 91097 - DNA, 50 bp, homo sapien
aagttaaggttaagtgatttgttccrtatagcagagcaagttaatggcac

SEQ ID NO: 91098 - DNA, 50 bp, homo sapien
tcctaggttttaacataacatattasatggtttgtgagtcatcatccaac

SEQ ID NO: 91099 - DNA, 50 bp, homo sapien
ggaatattaatttgaaaaactgcccraacatatttccagggcctctgcca

SEQ ID NO: 91100 - DNA, 50 bp, homo sapien
tttaaaagatttggaatgaacttgawgtattgagtggatactgttttgaa

SEQ ID NO: 91101 - DNA, 50 bp, homo sapien
tagcatgtctgtagattctcttggawattttaattaatcacagcaactgc

SEQ ID NO: 91102 - DNA, 50 bp, homo sapien
gcttgtgggaaattagaccattgatraaataactcacttgtgactagtaa

SEQ ID NO: 91103 - DNA, 50 bp, homo sapien
atatatttgagtaagtgtgtgaattraaagggaaatataaggaaaaataa

SEQ ID NO: 91104 - DNA, 50 bp, homo sapien
gctttatccagttaacttgtatagayaaataactgaccattactataggg

SEQ ID NO: 91105 - DNA, 50 bp, homo sapien
ttttagtgtatctgtttagatgctayactagtttgtttttttaaacatgt

SEQ ID NO: 91106 - DNA, 50 bp, homo sapien
gaaccttgactgatacgggccttggwaaatattgctgggacatggaatgc

SEQ ID NO: 91107 - DNA, 50 bp, homo sapien
tgtatagttggaaactctcaagtacrgcttaatcccacaaggaagcaagt

SEQ ID NO: 91108 - DNA, 50 bp, homo sapien
aggtttgaaacaaatgcagtaaagayagtaataataataaccttacataa

SEQ ID NO: 91109 - DNA, 50 bp, homo sapien
aatggacctcaggtgatcctgcggawgagctcccaatttgtgcatcactt

SEQ ID NO: 91110 - DNA, 50 bp, homo sapien
ctgtattctgaaaagagttctataayctgtaagtagcccatgtattattt

SEQ ID NO: 91111 - DNA, 50 bp, homo sapien
ctcaatcatgtggccacaactgagaygatcaagagaactataatctagct

SEQ ID NO: 91112 - DNA, 50 bp, homo sapien
cagcagttctgaacgatagataatasatgtaaaattagtaactgaggaaa

SEQ ID NO: 91113 - DNA, 50 bp, homo sapien
ctttatcccagtaactcaggtcaaartctcacattatatttacagacact

SEQ ID NO: 91114 - DNA, 50 bp, homo sapien
gattgaggagaaatggagggaataasacatctattgagtctagaaatagg

SEQ ID NO: 91115 - DNA, 50 bp, homo sapien
aagtaaaaatgaagtaaaataattarggactagtcaacatattcagaagt

SEQ ID NO: 91116 - DNA, 50 bp, homo sapien
tcagatctgcctcaagttggaataakgtgtctaaagatgcagccagaaat

SEQ ID NO: 91117 - DNA, 50 bp, homo sapien
ccggatactggatgctgtcttttagraacctaactctattaccagaaact

SEQ ID NO: 91118 - DNA, 50 bp, homo sapien
caaatcctagctcatgccactttagyaatgcctcggttatgacctaatga

SEQ ID NO: 91119 - DNA, 50 bp, homo sapien
ctctattggacagtagagttttacargattgaaactatacctgtatcact

SEQ ID NO: 91120 - DNA, 50 bp, homo sapien
tttgacctcctttcccagtccatacrcttaacaattgttttccacccaac

SEQ ID NO: 91121 - DNA, 50 bp, homo sapien
tgttacctcaatgagcataatttcasatctattacaactagagtgttttg

SEQ ID NO: 91122 - DNA, 50 bp, homo sapien
tttggaacaaatgcagtcaactctayacataaatatacccagatggtttc

SEQ ID NO: 91123 - DNA, 50 bp, homo sapien
ttcagcatcaaatttggtgtatctaygccagaaaatataccaggcattta

SEQ ID NO: 91124 - DNA, 50 bp, homo sapien
tgaaccaaaaacattcgataaacacyggttgatcaagaaaacattttcat

SEQ ID NO: 91125 - DNA, 50 bp, homo sapien
cagggcgcatgtacatttaggaacartagtggctcctttcccaaagtggt

SEQ ID NO: 91126 - DNA, 50 bp, homo sapien
accataagaagttaccgttaactgaytataaatggccattttataaggtt

SEQ ID NO: 91127 - DNA, 50 bp, homo sapien
tagtggacaaaacccacatgattcaygacctacactgacttatataatca

SEQ ID NO: 91128 - DNA, 50 bp, homo sapien
attttcccaatgatttctaatagcarcgaaacataagtgacatatagtaa

SEQ ID NO: 91129 - DNA, 50 bp, homo sapien
agactttactagctcactttgttacraaaagacatgccactcaagggtgc

SEQ ID NO: 91130 - DNA, 50 bp, homo sapien
agtctcaggtatatctttatcaagcrgcattaaaacagactaatatagtc

SEQ ID NO: 91131 - DNA, 50 bp, homo sapien
tttatccccttctaccactcagttarcattaaatagattttgaaattctc

SEQ ID NO: 91132 - DNA, 50 bp, homo sapien
agtagagaaatataataactactaaygcaaatacttatcattagttagct

SEQ ID NO: 91133 - DNA, 50 bp, homo sapien
acatgaaaatataaacaaattaagcragaattatctaaaaagcaactctt

SEQ ID NO: 91134 - DNA, 50 bp, homo sapien
tcctaaactacacatttaaagaacargattatgtaatcattagcaggtaa

SEQ ID NO: 91135 - DNA, 50 bp, homo sapien
tcagatatgactaccaaattaattayatagatagccacacatatatacac

SEQ ID NO: 91136 - DNA, 50 bp, homo sapien
gacccaaaggaaagtggcttctaaartcatcaatcctattattcttcatg

SEQ ID NO: 91137 - DNA, 50 bp, homo sapien
cctttctatcacattccagttcaaayattatacaagctttaaaaaatcat

SEQ ID NO: 91138 - DNA, 50 bp, homo sapien
cagtattaactgagggatgcataatrattttccgtgaagacagaataagg

SEQ ID NO: 91139 - DNA, 50 bp, homo sapien
cttattactaaatgattgtgtgttayagtgatttaatattaggcatttaa

SEQ ID NO: 91140 - DNA, 50 bp, homo sapien
acgcctaccactgtaaatttctgcargatttggcttccaattctaagaga

SEQ ID NO: 91141 - DNA, 50 bp, homo sapien
acttctaagtccaccaatcaagaggkacatgagaatttgcttttgttttg

SEQ ID NO: 91142 - DNA, 50 bp, homo sapien
gatttcttgacccagcacaactttgsagctatttatgaatcaaattctta

SEQ ID NO: 91143 - DNA, 50 bp, homo sapien
attttttaaaagttagcgatttaaargtgctaattactgaaatgagaatt

SEQ ID NO: 91144 - DNA, 50 bp, homo sapien
taaaataaactgcctaaattaactaracacacatacatttttagagcagc

SEQ ID NO: 91145 - DNA, 50 bp, homo sapien
aactagagaagagaagggtaaagcaycatagttgtcttgagaaggctaca

SEQ ID NO: 91146 - DNA, 50 bp, homo sapien
ctcacaccaactctaagtaacacagraagtattaagagacaagaataatt

SEQ ID NO: 91147 - DNA, 50 bp, homo sapien
atctgaaagataaaaatgatttaacyagttgggacattcatgtaaaaatc

SEQ ID NO: 91148 - DNA, 50 bp, homo sapien
tttatcctctttctgaacttcagacratggatatagaggagggggtttgg

SEQ ID NO: 91149 - DNA, 50 bp, homo sapien
agagaccccattgaatagaactagasaagccaatatccaggatgatttct

SEQ ID NO: 91150 - DNA, 50 bp, homo sapien
ctgaagaaacagttgtgaattaaaaygagcaaatatagtaaatattattt

SEQ ID NO: 91151 - DNA, 50 bp, homo sapien
agcacaggcaacaaaattaaaatacrcaggtaagactatattaaactaaa

SEQ ID NO: 91152 - DNA, 50 bp, homo sapien
agttattataagtactaagttagggratatctgtaaagcaaatacaattt

SEQ ID NO: 91153 - DNA, 50 bp, homo sapien
actatttttgagcatctctttgctaygtaaaattgtatttgctttacaga

SEQ ID NO: 91154 - DNA, 50 bp, homo sapien
gctactcacctgggttctcaactaarctttgacagtattaattgctttag

SEQ ID NO: 91155 - DNA, 50 bp, homo sapien
cattctcttatttcaacttgtgatawacggaacctttctctgatccagtt

SEQ ID NO: 91156 - DNA, 50 bp, homo sapien
aattacttaatatgaactatgaattraagcataaagcctttgtcatatgg

SEQ ID NO: 91157 - DNA, 50 bp, homo sapien
acggactctaaatggaatggaaaacyatctcatgcaacatatgatggtaa

SEQ ID NO: 91158 - DNA, 50 bp, homo sapien
acaccaccaacaaaacaacatttacsctgaggaaggaacactgagtatat

SEQ ID NO: 91159 - DNA, 50 bp, homo sapien
catgaactctcttttatttaggaagkattgcagaacaaaaatgaaactca

SEQ ID NO: 91160 - DNA, 50 bp, homo sapien
gatgaagaataattctctaatcctgraatgtgtgggtcctactagagaaa

SEQ ID NO: 91161 - DNA, 50 bp, homo sapien
tgatttgaaagcttgagagaccatcragaattggatttggggaagaggtg

SEQ ID NO: 91162 - DNA, 50 bp, homo sapien
atacttctatacgttattcttatacrctttatgctataaacaccttggga

SEQ ID NO: 91163 - DNA, 50 bp, homo sapien
aaggttcaaaatattcattaaagtargagagctacagggtccagaaaatg

SEQ ID NO: 91164 - DNA, 50 bp, homo sapien
agttgaaaaaccaatcatctgaatcyatgcagaaaaaaatagataatgta

SEQ ID NO: 91165 - DNA, 50 bp, homo sapien
tctgtgatcagtgatcattgacatcrctattgtaaaccacaaccatatac

SEQ ID NO: 91166 - DNA, 50 bp, homo sapien
aagtggtgtgttaattctgtcctacrgcatctaagtattggcctacagtt

SEQ ID NO: 91167 - DNA, 50 bp, homo sapien
cagaaactgtatcttaaatcattacracaacaaagaaaaactactcgctg

SEQ ID NO: 91168 - DNA, 50 bp, homo sapien
cacccagaggcagtctgtgtgacaayggtaagcttgggtgaccaatttgt

SEQ ID NO: 91169 - DNA, 50 bp, homo sapien
acaaatttatagcacaaaatataccrgattttctacagcctaagactagt

SEQ ID NO: 91170 - DNA, 50 bp, homo sapien
aataaatagctaagggaatataagargataatgatctcaatttcaacctt

SEQ ID NO: 91171 - DNA, 50 bp, homo sapien
ttaattaaaacattgcagaggagacraatggttaattttaccattcattc

SEQ ID NO: 91172 - DNA, 50 bp, homo sapien
gattggacagagaaactcatactgayaaggtgaggattgtcaggaaataa

SEQ ID NO: 91173 - DNA, 50 bp, homo sapien
gtacttttgtcttagtctgtagaagsaacatttgtctttgtactttccat

SEQ ID NO: 91174 - DNA, 50 bp, homo sapien
gcagcagttgcataggtgcttaaaaktctgagagaaaattctctctcacc

SEQ ID NO: 91175 - DNA, 50 bp, homo sapien
tacttagaagcaatgtaatgatgccrgacagttaataactagaaaatatc

SEQ ID NO: 91176 - DNA, 50 bp, homo sapien
ccacacggaatttgaaccaatcaaartgcaattagcaggggaaaatgttg

SEQ ID NO: 91177 - DNA, 50 bp, homo sapien
cttcagtagttactttccatttgagwtacagctctggattgttccttgtc

SEQ ID NO: 91178 - DNA, 50 bp, homo sapien
cttttctgcatagctatctgtgtaarctggattctattttttaaaggctt

SEQ ID NO: 91179 - DNA, 50 bp, homo sapien
atttttgagaattcaactaagtatamgagcagaactccataactattgtg

SEQ ID NO: 91180 - DNA, 50 bp, homo sapien
acatagcattgtttctattttactgsaataatgtagacctatgcatgctc

SEQ ID NO: 91181 - DNA, 50 bp, homo sapien
gtatttagagtttataatacatttcrtctttcataatctccatgaatacc

SEQ ID NO: 91182 - DNA, 50 bp, homo sapien
cattacaactcaacaacaatttatarcattgggcataatgtgtgaggtca

SEQ ID NO: 91183 - DNA, 50 bp, homo sapien
gaagtagaggctaaatgctagtggckttcagtggtttaacgtagagttga

SEQ ID NO: 91184 - DNA, 50 bp, homo sapien
gtggttggctgggggtaaccaagaayaggcaatagttcacttaatattga

SEQ ID NO: 91185 - DNA, 50 bp, homo sapien
taatgagaaagcatgttgattatgaygtagatcttgaaaggttttttatc

SEQ ID NO: 91186 - DNA, 32 bp, homo sapien
tcctctctcaagtcaaygtttgattggtgtgt

SEQ ID NO: 91187 - DNA, 50 bp, homo sapien
ctcacccagaatatcagtccaaacartctcttaaaaccatgttttctgag

SEQ ID NO: 91188 - DNA, 50 bp, homo sapien
tttaagaacttgaaatagcatgaccracactatcttcattagaacagaat

SEQ ID NO: 91189 - DNA, 50 bp, homo sapien
cttttcttcatctcatggaggatgaytattttaaggagagtgaacattac

SEQ ID NO: 91190 - DNA, 50 bp, homo sapien
gacattaatgatctcctactaacacrctgatgagaagaacgcaattgtta

SEQ ID NO: 91191 - DNA, 50 bp, homo sapien
ctttatttagacactctagcaaccayacacaattttacttcaaagatatt

SEQ ID NO: 91192 - DNA, 50 bp, homo sapien
gacattattctggtagaggaaataayatgcctaaaagaataaaactagaa

SEQ ID NO: 91193 - DNA, 50 bp, homo sapien
gtaactcatgtaactgataactatamcatttaaagcagtatattagatgg

SEQ ID NO: 91194 - DNA, 50 bp, homo sapien
atttagttgacatttcacatcttcarataaggataaagtatcaggagcta

SEQ ID NO: 91195 - DNA, 50 bp, homo sapien
tgttggaaaggatcttgggtcagtasatggcagtcataaatatgggcaag

SEQ ID NO: 91196 - DNA, 50 bp, homo sapien
agggctttttgactaaaatttgttayagcatgcgagcaacagagcatctc

SEQ ID NO: 91197 - DNA, 50 bp, homo sapien
atgtaattacctccatctctctcaawttactgccacttaactgcttcaag

SEQ ID NO: 91198 - DNA, 50 bp, homo sapien
atagatacacatttctattgcgatamatatctaaggtatgctcataacca

SEQ ID NO: 91199 - DNA, 50 bp, homo sapien
gaagctgactctgagccagagatcgrcatgcaggatatttatgagggtga

SEQ ID NO: 91200 - DNA, 50 bp, homo sapien
ctcaatggttgttgctggtgaatcamatacttgacccatttgttgtagac

SEQ ID NO: 91201 - DNA, 50 bp, homo sapien
tactaaaagatgaaaaaacggggacygtcatcatcataattttcaaaaca

SEQ ID NO: 91202 - DNA, 50 bp, homo sapien
aatatacaatgactgacaaattgcaygaacctaaatgtaaacaaggcacc

SEQ ID NO: 91203 - DNA, 50 bp, homo sapien
catagggtttatctactcagacatasgtgaaaaggctgatggcaacatgg

SEQ ID NO: 91204 - DNA, 50 bp, homo sapien
tgacaaatgcacgactgcaattccayaggaaagggatgattttcaaaatg

SEQ ID NO: 91205 - DNA, 50 bp, homo sapien
tgcagaaatggacaaactgatctgaygattaattgctagaggctcagaag

SEQ ID NO: 91206 - DNA, 50 bp, homo sapien
ctccatagactaaaatcataattaaycagcttgctttctccactattttt

SEQ ID NO: 91207 - DNA, 50 bp, homo sapien
taatatccacaattttttattctgcyctgtagtacatgaggtgcattctc

SEQ ID NO: 91208 - DNA, 50 bp, homo sapien
tctgagtagtcaaaaactatgaagakatttgtatcccatatgactgctca

SEQ ID NO: 91209 - DNA, 50 bp, homo sapien
ccattagccagcaatcaacaacttasgaaggtcacaaattcaaataagtt

SEQ ID NO: 91210 - DNA, 50 bp, homo sapien
tataaaaacactttcagttctactayatatctaagcatgctgggcaacat

SEQ ID NO: 91211 - DNA, 50 bp, homo sapien
ggaaaatgatatctaaagaaagtagratgtatcaattgctcaaataaagc

SEQ ID NO: 91212 - DNA, 50 bp, homo sapien
tttaagtaatgataagtaagcagaaytcatccactacttctgggtagaag

SEQ ID NO: 91213 - DNA, 50 bp, homo sapien
tttcatttataaagttgttcttccaragtagtagtattaacattgaatag

SEQ ID NO: 91214 - DNA, 50 bp, homo sapien
acccactttatggctagatgggtccraaagcatgcagttcattataggta

SEQ ID NO: 91215 - DNA, 50 bp, homo sapien
agctccacatttgacttatttgaacrctgtgaaccctcagcagtgtatga

SEQ ID NO: 91216 - DNA, 50 bp, homo sapien
tagagaatgcaacatgtcagagatasattttcaaacaagtttaaccacct

SEQ ID NO: 91217 - DNA, 50 bp, homo sapien
attctctcctctaagcaaatcctgcrgaactctccgtaatgaagtccatt

SEQ ID NO: 91218 - DNA, 50 bp, homo sapien
atttgagcagtaggagtagactctayggaacgagaactcagctaacttct

SEQ ID NO: 91219 - DNA, 50 bp, homo sapien
agcacaagcaaagattctgaactaaratacaaaagaatgtgtgcctgtag

SEQ ID NO: 91220 - DNA, 50 bp, homo sapien
tctatggggtctaatagagttcaaaraaatcaagatagcttattttcttg

SEQ ID NO: 91221 - DNA, 50 bp, homo sapien
cattcacactttggatggaaacttaygcaagagaatagcattttccacat

SEQ ID NO: 91222 - DNA, 50 bp, homo sapien
tgcacaagtattgtatttttctcacygatactactgctttattatgaatt

SEQ ID NO: 91223 - DNA, 50 bp, homo sapien
gtgcctcttttctaaactcaaatacrctgagtcatactccatttatgacg

SEQ ID NO: 91224 - DNA, 50 bp, homo sapien
aaataatgataaaaagtatagtatartaagtacataaaccagtaacattc

SEQ ID NO: 91225 - DNA, 50 bp, homo sapien
ctgctgctagctataaaatgaataaratatcaatgctgagctacaacctg

SEQ ID NO: 91226 - DNA, 50 bp, homo sapien
tattgtgaaaggtcttgtagcaaaaygaaaagggcattagacacatcact

SEQ ID NO: 91227 - DNA, 50 bp, homo sapien
catctccatggtcaatgcttaatcartaaaaggtagacattagtggatat

SEQ ID NO: 91228 - DNA, 50 bp, homo sapien
gtctttatgatattcttgccacataygagatgatcaataatatttgttaa

SEQ ID NO: 91229 - DNA, 50 bp, homo sapien
taaaaatgagaaatatatgtgccaasagaccaatcaattattatagcatt

SEQ ID NO: 91230 - DNA, 50 bp, homo sapien
tttgtacaaaacaacgaaggctaaartaaagaagtagataagaatatata

SEQ ID NO: 91231 - DNA, 50 bp, homo sapien
aatgtgggtttgttttttaattcatsacttaatgacaataatttgtctct

SEQ ID NO: 91232 - DNA, 50 bp, homo sapien
tggcttcagttaaacatgaaaagcasaatatgtatcgagccagtaaaaca

SEQ ID NO: 91233 - DNA, 50 bp, homo sapien
gaccacatacatcatggtgatcctayaagattataatgaagctgaaaaat

SEQ ID NO: 91234 - DNA, 50 bp, homo sapien
tcaataaattcaagtaggctttaaamagattcaaccaaagcctaacattg

SEQ ID NO: 91235 - DNA, 50 bp, homo sapien
ctttggcgtgacctgagtttctctargcaggcctccccagcagttgtgta

SEQ ID NO: 91236 - DNA, 50 bp, homo sapien
tctgtagttcttacaagttctttgaygtatgaattactatatttagtaat

SEQ ID NO: 91237 - DNA, 50 bp, homo sapien
agcttggttttattctcttgtgtagraatagaactcttgaattatttacc

SEQ ID NO: 91238 - DNA, 50 bp, homo sapien
gagctaagtcctgaacttaggcaggytatcccaagaaaaagcacttcacc

SEQ ID NO: 91239 - DNA, 50 bp, homo sapien
aagtttcctgaggctctgcagaaatkagtcaataaaacctctttccttta

SEQ ID NO: 91240 - DNA, 50 bp, homo sapien
ccaagttagagtgaaataaaatagcragtatgtctacacatgggtgtatc

SEQ ID NO: 91241 - DNA, 50 bp, homo sapien
aatatttacaagactagttggagggyacattgcctgaataaagaaaaatg

SEQ ID NO: 91242 - DNA, 50 bp, homo sapien
ttcttgaggcattttctaaattgaasgaaatgttactactaaatctagag

SEQ ID NO: 91243 - DNA, 50 bp, homo sapien
tttaaaccaagaagcaggtgacttaraaggaggtaacaggcaggaacttg

SEQ ID NO: 91244 - DNA, 50 bp, homo sapien
ttctgactttgaagtaatggatgaaytgtcatgtgcagtatatggaaata

SEQ ID NO: 91245 - DNA, 50 bp, homo sapien
aagagtatcacccatgaggagatgcrctacattcaaaaagaactgcttga

SEQ ID NO: 91246 - DNA, 50 bp, homo sapien
tgcatacaataaacgtaaaataacawggttcaagaatgggtggaaaaaaa

SEQ ID NO: 91247 - DNA, 50 bp, homo sapien
gggagttctgacgagtacacacggtmaagtttgagaagctcaccctgcaa

SEQ ID NO: 91248 - DNA, 50 bp, homo sapien
atggattaatgccaagtacattgcarggtgagcttctcaaactttaccgt

SEQ ID NO: 91249 - DNA, 50 bp, homo sapien
atggaattcccggtgctcagactacrattgtgggtgtcgttttgcctcaa

SEQ ID NO: 91250 - DNA, 50 bp, homo sapien
tttagaagttacagcagcatactgawcatacaggaatagttacatatact

SEQ ID NO: 91251 - DNA, 50 bp, homo sapien
cactgaaatctccatcatcagaaacratttaaaactgccagaactttagt

SEQ ID NO: 91252 - DNA, 50 bp, homo sapien
ctgaatcttgaaagatgagtgtaaaycctttggagattagtggcaggtag

SEQ ID NO: 91253 - DNA, 50 bp, homo sapien
ttttctatctatgttccacaacctcyatactctaccctgcaactacctgc

SEQ ID NO: 91254 - DNA, 50 bp, homo sapien
tgccctgggacatgtacaatagctawctcttctggcaactggagattgtc

SEQ ID NO: 91255 - DNA, 50 bp, homo sapien
acgatgtcaactttagtacagatacraaagttgaactcgagagaacagaa

SEQ ID NO: 91256 - DNA, 50 bp, homo sapien
attaatgcagtaaatcagttttaacsttgctagcctaatgtttacattat

SEQ ID NO: 91257 - DNA, 50 bp, homo sapien
gttttcaaatttggccttattgatasattttgactttaggcatatgcagg

SEQ ID NO: 91258 - DNA, 50 bp, homo sapien
aggctttctataaatatctgcaatartataaatcccagaacaccatccca

SEQ ID NO: 91259 - DNA, 50 bp, homo sapien
acaagcctacattgacatagctataycatttaccaactactgctcactcc

SEQ ID NO: 91260 - DNA, 50 bp, homo sapien
atttttgagtatgaacagttgttcarattgattcttctataagggtacaa

SEQ ID NO: 91261 - DNA, 50 bp, homo sapien
ttgccttaaactttcatcctttcacmttttgacacacaaaaaagaaagga

SEQ ID NO: 91262 - DNA, 50 bp, homo sapien
aatgtgagtggaattatgcaggtaawcgtgtgctagtcagttacagagct

SEQ ID NO: 91263 - DNA, 50 bp, homo sapien
ccatcaagtaggaggtgttataggakatttagcatgcaaaaatggcagta

SEQ ID NO: 91264 - DNA, 50 bp, homo sapien
cctagaatggtttttaaatatcaaartggctttcttacttcaggtggtaa

SEQ ID NO: 91265 - DNA, 50 bp, homo sapien
atgaccataattgatcagattacaakttctaaacagattaaacaggtaag

SEQ ID NO: 91266 - DNA, 50 bp, homo sapien
gattagaaattttggccaaggtgaaygaaagtagaaattagggataataa

SEQ ID NO: 91267 - DNA, 50 bp, homo sapien
gtggcacagtcacaaccctacagtayaatgttcatgtataggaggagaag

SEQ ID NO: 91268 - DNA, 50 bp, homo sapien
tcagtaattacttttttcatatctayacatgtacctaagaaggtatgaac

SEQ ID NO: 91269 - DNA, 50 bp, homo sapien
gaccgtacatccaaatagcagaaacrgagactcctggtttggtatgtctc

SEQ ID NO: 91270 - DNA, 50 bp, homo sapien
tattatttgaaaaatccaggaaacaratggttgaatcctagttagccaat

SEQ ID NO: 91271 - DNA, 50 bp, homo sapien
ccaatttttgtgcctcctactgttaygcccatttgattcttcaaactaag

SEQ ID NO: 91272 - DNA, 50 bp, homo sapien
aattttaagagctagaatacacaggwcatttaatagggcaagggaagttt

SEQ ID NO: 91273 - DNA, 50 bp, homo sapien
acttattttataggcctctaggaaamcagtgaatacatagggtcacagag

SEQ ID NO: 91274 - DNA, 50 bp, homo sapien
atgcataggtactctatataaattgkaaaaaaattcagactcccacctcc

SEQ ID NO: 91275 - DNA, 50 bp, homo sapien
atcctcatttcacttaatatcttccragttcttcttaattttagatatat

SEQ ID NO: 91276 - DNA, 50 bp, homo sapien
gtcatctttctgattttcagtgataycgccatacttttaacccatgatct

SEQ ID NO: 91277 - DNA, 50 bp, homo sapien
tcttcttaagtctaatccaaattacwctgttctagtttgaattattgtat

SEQ ID NO: 91278 - DNA, 50 bp, homo sapien
cctaaactcattcttttttgaatgartattaagtgaagtatgccagctca

SEQ ID NO: 91279 - DNA, 50 bp, homo sapien
tagatattattcatctcgcttttcarataaggacaccaaagctcaaagaa

SEQ ID NO: 91280 - DNA, 50 bp, homo sapien
ccaactttcaagttacagctccaaamtgaagagaatccagtacctttttg

SEQ ID NO: 91281 - DNA, 50 bp, homo sapien
gacttttcaaagtgctgtgcttcttkttgggcttaatgtttgtgagcaag

SEQ ID NO: 91282 - DNA, 50 bp, homo sapien
tctcaaacatttgtggaagctccaaktagtatttgaaattttctgtgaat

SEQ ID NO: 91283 - DNA, 50 bp, homo sapien
ccaaggaaggtggataaaaccatgaytattcatttaactaattggcaagc

SEQ ID NO: 91284 - DNA, 50 bp, homo sapien
ttggcaagctacttacctctgcatcrctctgatagagaaatgagtatctt

SEQ ID NO: 91285 - DNA, 50 bp, homo sapien
aagcatatttgctaacactctttacratgggtatttaaggccaattattt

SEQ ID NO: 91286 - DNA, 50 bp, homo sapien
atgtggagattttaaggtaagagtamgtgcactgatttaaattttatttt

SEQ ID NO: 91287 - DNA, 50 bp, homo sapien
agccatataggagagactatgcagcracagaaatatggaggctttaaatc

SEQ ID NO: 91288 - DNA, 50 bp, homo sapien
tcttaattaatattaatttcatcatsagtgtttgagctgtatcttgtagg

SEQ ID NO: 91289 - DNA, 50 bp, homo sapien
aaaactgatgagttcttacaactagyatgcctataaacatgatcaaagcc

SEQ ID NO: 91290 - DNA, 50 bp, homo sapien
ctattaatcttcctttaaacttctayctatacaggctcctttcaaatttt

SEQ ID NO: 91291 - DNA, 50 bp, homo sapien
ttcctttgtcagaatgttatataaayggagtaacacaatattagagcttc

SEQ ID NO: 91292 - DNA, 50 bp, homo sapien
tccagtatagttctaatgattggatrtaggttgaggggtagaataatgca

SEQ ID NO: 91293 - DNA, 50 bp, homo sapien
cagaaggtagaattgtgagaaagaaygctttaaaatgtatttgggtttag

SEQ ID NO: 91294 - DNA, 50 bp, homo sapien
aggcaagtggtaaaaatggaatagargccaagccagagtttcctataagt

SEQ ID NO: 91295 - DNA, 50 bp, homo sapien
tgaggggacaagagcatgggtctgaytaggtttagataactccagatatt

SEQ ID NO: 91296 - DNA, 50 bp, homo sapien
agttgaattattaccaaatttgagaytcagtgtttagattatttactgct

SEQ ID NO: 91297 - DNA, 50 bp, homo sapien
gctttccagtagtaggcttcagagarattaagttgtaaaatgtttcttat

SEQ ID NO: 91298 - DNA, 50 bp, homo sapien
tgaatcctgtgtaaaactgactcaaygttcccaactggattatggactga

SEQ ID NO: 91299 - DNA, 50 bp, homo sapien
agaaacacttcactcaacaatgccartataagtgaaccaacccttacctt

SEQ ID NO: 91300 - DNA, 50 bp, homo sapien
tgtgactattaatgagtctataacayggaagaaattcttaaaatatttta

SEQ ID NO: 91301 - DNA, 50 bp, homo sapien
gcagaaaacgtatatgaatccaccaygattagttctctttaaactcagat

SEQ ID NO: 91302 - DNA, 50 bp, homo sapien
tcctgctctcactcattgctgtaccraaatatttaattgagtgaaatatt

SEQ ID NO: 91303 - DNA, 50 bp, homo sapien
ccctctggggtctgcgattaatcaayacagaaatggattattcacacctc

SEQ ID NO: 91304 - DNA, 50 bp, homo sapien
tacccatatattatagttctcatcarcctctaaaatcatgttttgtatta

SEQ ID NO: 91305 - DNA, 50 bp, homo sapien
tgtctgatgttgtactgagcagataygaaggagtaggaaggagaaagaat

SEQ ID NO: 91306 - DNA, 50 bp, homo sapien
aaatacagaaacaaagaggaaagaaygtaagtatttatttagtgaaaact

SEQ ID NO: 91307 - DNA, 50 bp, homo sapien
gctattagaaataaaattgataagcrcattcatgtacaattatttatgtg

SEQ ID NO: 91308 - DNA, 50 bp, homo sapien
acccaaagctgagaaaaaaggctatragtatcccaacgctgaatccagtc

SEQ ID NO: 91309 - DNA, 50 bp, homo sapien
tgaacgagaactggctaagattacayccctgtggaccctctcctcgggta

SEQ ID NO: 91310 - DNA, 50 bp, homo sapien
aataaattatatcacaaaaataaaargctggtaagtgtcagatcacaaca

SEQ ID NO: 91311 - DNA, 50 bp, homo sapien
aaagacctttgaaatgtttcctatgyagagatttaagaaagttctggttt

SEQ ID NO: 91312 - DNA, 50 bp, homo sapien
gagtgacaaaaatcaatacttggatsaagaacagcatttaaactatattt

SEQ ID NO: 91313 - DNA, 50 bp, homo sapien
caataagagagggccctaagatccayggccgctttagtgaaaggacttat

SEQ ID NO: 91314 - DNA, 50 bp, homo sapien
aattttagataatagtcttaacagtsaagaattagtgcatgctttctgta

SEQ ID NO: 91315 - DNA, 50 bp, homo sapien
tcagatcatttcgtttcagcaaagcmctatgctaggtggtagatgaggca

SEQ ID NO: 91316 - DNA, 50 bp, homo sapien
aactgaaaattatgataaagggttaragcagatagagattaaaacattca

SEQ ID NO: 91317 - DNA, 50 bp, homo sapien
catatgttatgggccaaaaagttaayatttgagtgtccacagttgtattt

SEQ ID NO: 91318 - DNA, 50 bp, homo sapien
tagctgttacttacagagagcctaaygttacttacagagagcctaatgtg

SEQ ID NO: 91319 - DNA, 50 bp, homo sapien
gatgcacaatatttcccccatagaarcgatgattggtacacctgaatctc

SEQ ID NO: 91320 - DNA, 50 bp, homo sapien
ttatgcctctttcacagcacaagaamgaaaggttattcctccagcacagg

SEQ ID NO: 91321 - DNA, 50 bp, homo sapien
tggtgttttcaataagagttttacaygagctaattgatggaaacaattaa

SEQ ID NO: 91322 - DNA, 50 bp, homo sapien
cgtgggagggcagtggtaatgaaaamgaatgggaaatcagggaaacgagg

SEQ ID NO: 91323 - DNA, 50 bp, homo sapien
ttcatgtcttgtacatctctgcctckcattttactaatctgttctgcgaa

SEQ ID NO: 91324 - DNA, 50 bp, homo sapien
agcagcccatctcagtagacatcgayaaggcagtaaataaattttccact

SEQ ID NO: 91325 - DNA, 50 bp, homo sapien
tttataaagggtatttgttctaccaycttaatcaatgaataaaaatatgt

SEQ ID NO: 91326 - DNA, 50 bp, homo sapien
tattcatatttttgtgagtggtttayggaagaatagcctttgaatactat

SEQ ID NO: 91327 - DNA, 50 bp, homo sapien
aaaatcttctcagctggatgaccaamaaggcattgctcagtctgcattaa

SEQ ID NO: 91328 - DNA, 50 bp, homo sapien
gccatcccatgtattctaccttgcartaatccttcctttacaaggcatcc

SEQ ID NO: 91329 - DNA, 50 bp, homo sapien
gagctactgatgtacagtgagggtcratctcaaaaacattgtatgaaaga

SEQ ID NO: 91330 - DNA, 50 bp, homo sapien
accctaatttaatggacaggtgaaakgtcagcaacctagaaaattggagt

SEQ ID NO: 91331 - DNA, 50 bp, homo sapien
aatttgcatatagtgaaaaataacasgtcaaaatgcatttgcttagaagc

SEQ ID NO: 91332 - DNA, 50 bp, homo sapien
tggaacactactatgcagtaatgaartggatagagctactgatgtacagt

SEQ ID NO: 91333 - DNA, 50 bp, homo sapien
gattattccatggaaagatggaccaytattgaatcctttgtacttccagg

SEQ ID NO: 91334 - DNA, 50 bp, homo sapien
atggcatgtcctcctgctttggggayataaacgtcttgctctgcattcct

SEQ ID NO: 91335 - DNA, 50 bp, homo sapien
agaggcctcctgacaacgccaatgaragtgagatattcctctttgtcaac

SEQ ID NO: 91336 - DNA, 50 bp, homo sapien
ataatctagaaaagaaaataagacayacaaggcaatgaacgttatggcta

SEQ ID NO: 91337 - DNA, 50 bp, homo sapien
tcatgtaaacagctttgagctttgtsaagtgttaaatactgaactggtca

SEQ ID NO: 91338 - DNA, 50 bp, homo sapien
attccatgaaattcataaaaaatacsaaggtgctaaggctacaagtattc

SEQ ID NO: 91339 - DNA, 50 bp, homo sapien
gccgatgctaagcagagaaattagayggattgtgatctcaacatgcagtc

SEQ ID NO: 91340 - DNA, 50 bp, homo sapien
gtacattcccttagagtctaatacasagcttatcacagagtagatacaat

SEQ ID NO: 91341 - DNA, 50 bp, homo sapien
ctactataaatctaacataagcaacraagatgaggtgatctgatgggaga

SEQ ID NO: 91342 - DNA, 50 bp, homo sapien
atttttgatggagcacataatattgyaggcaagagaattttcataaaaat

SEQ ID NO: 91343 - DNA, 50 bp, homo sapien
gttggggtagaaagtagttgggtaargaaactgccaagccttcagtgcct

SEQ ID NO: 91344 - DNA, 50 bp, homo sapien
gcttcatataccagtgagttagcatraaggtgtctgacaaactgacagta

SEQ ID NO: 91345 - DNA, 50 bp, homo sapien
tactttacttatcaacagcagtatcyatctattgcctaatgacaattatt

SEQ ID NO: 91346 - DNA, 50 bp, homo sapien
atatcatccctatttgggtcacaagwatatgtggtgtaatatttaaaaaa

SEQ ID NO: 91347 - DNA, 50 bp, homo sapien
aaaattatgactcacacaaagaaaaraatacatcaagagaaactatctct

SEQ ID NO: 91348 - DNA, 50 bp, homo sapien
ctggctatttgccctcaaatcactawcctattaattggcaagaactgaag

SEQ ID NO: 91349 - DNA, 50 bp, homo sapien
tcacttaattttaagtagaagaatargaacatactaagacaatattcttg

SEQ ID NO: 91350 - DNA, 50 bp, homo sapien
ataggcttgtagcaaacctgataacrgtgcaaaatagctaggccaatcct

SEQ ID NO: 91351 - DNA, 50 bp, homo sapien
actcctaattccttagggaacggtakgttagagtgaagagagaagtgtta

SEQ ID NO: 91352 - DNA, 50 bp, homo sapien
tcatgtagacatagtctagtggaagsaagcacatgatgataatataatgt

SEQ ID NO: 91353 - DNA, 50 bp, homo sapien
taataatgccaccatttttatttctyacactcctcaacccccacctctga

SEQ ID NO: 91354 - DNA, 50 bp, homo sapien
aaagccagaatattaacttctatccrataacttatcaagaaatctgggag

SEQ ID NO: 91355 - DNA, 50 bp, homo sapien
tactctcagatcaccttgtgaacccractcccagaaaagcagccagagtt

SEQ ID NO: 91356 - DNA, 50 bp, homo sapien
gtagtgatttttaaattactcctgaraactatatggacccacagaggtgc

SEQ ID NO: 91357 - DNA, 50 bp, homo sapien
ttaaactgttattataggagacatcwcaggaggaaaacgcagtgagaaca

SEQ ID NO: 91358 - DNA, 50 bp, homo sapien
ctgacgttgacacagggccaggtgaygaggattttcaaggcattgctgtc

SEQ ID NO: 91359 - DNA, 50 bp, homo sapien
tgatgactgaatggataaatgaaacratactgcctggagttccctacttt

SEQ ID NO: 91360 - DNA, 50 bp, homo sapien
ttggatttatgtattgatggttgcgyattgcacatgtgttgtgatttggg

SEQ ID NO: 91361 - DNA, 50 bp, homo sapien
gaaatctatcgttcagattttaaaaktcctttatcagcttattttcttct

SEQ ID NO: 91362 - DNA, 50 bp, homo sapien
aacatagacaaatactgtattataaycatgtagggccactatcatatagg

SEQ ID NO: 91363 - DNA, 50 bp, homo sapien
tcaaactgaattatgttttctgttamaagacggtgaaatgtcttggatat

SEQ ID NO: 91364 - DNA, 50 bp, homo sapien
cttagaacaaatctggaacacataakgctgatttgtttatataggtgcac

SEQ ID NO: 91365 - DNA, 50 bp, homo sapien
acattttgcttttatgtctggtagascatttacctcctcttcagtgtctg

SEQ ID NO: 91366 - DNA, 50 bp, homo sapien
gacaacaaggagttcatcactgtacrcctaaattctactgtgggctagaa

SEQ ID NO: 91367 - DNA, 50 bp, homo sapien
ttccttagtttatacctatcgataartatgtgtgtggaggtagagaggag

SEQ ID NO: 91368 - DNA, 50 bp, homo sapien
atccttcatgaatggcttagcactaycctttttggtgctgttctcctgat

SEQ ID NO: 91369 - DNA, 50 bp, homo sapien
gaatcaccaaaagaaggaggtccaawgtccaatgttaggatgattatgct

SEQ ID NO: 91370 - DNA, 50 bp, homo sapien
gggattggtttaagtaatgaagtccrcaatcaattttacaagttaaggac

SEQ ID NO: 91371 - DNA, 50 bp, homo sapien
aatgtaaatgtgtgtcatactatacrcatttttgtaggcttgcttttgtc

SEQ ID NO: 91372 - DNA, 50 bp, homo sapien
tgtcttacttgctttgttatagttamaacagtgctaactccttcaagtgt

SEQ ID NO: 91373 - DNA, 50 bp, homo sapien
aacattaatggaagggggtcagaaayatttggatggaatgagttactgca

SEQ ID NO: 91374 - DNA, 50 bp, homo sapien
atccttagtcttttagattgtatcayctctttacactccaaccttcagag

SEQ ID NO: 91375 - DNA, 50 bp, homo sapien
ggctccctcgacgttttccatagtarcgcaaccacggagtttccccgaaa

SEQ ID NO: 91376 - DNA, 50 bp, homo sapien
tgattataagtgttgcctccaagtayataattaggtcatttccccgaggc

SEQ ID NO: 91377 - DNA, 50 bp, homo sapien
tatcattcatagagacaggagatgaytgacttctcagcttcactaagaat

SEQ ID NO: 91378 - DNA, 50 bp, homo sapien
ttcaaccctcaagcccttataccaawtgcttactattcaaggcaattatg

SEQ ID NO: 91379 - DNA, 50 bp, homo sapien
tattttctgaataaactttattggaygcataacacaggatcatgcacaac

SEQ ID NO: 91380 - DNA, 50 bp, homo sapien
cattctctcttgtcagtgaaaaaaawtatagcactaaagcaggcttgaca

SEQ ID NO: 91381 - DNA, 50 bp, homo sapien
acctcaggaatttaactcagtctgaraaagaagagtagtttcaaaactgt

SEQ ID NO: 91382 - DNA, 50 bp, homo sapien
gtacctggcttctgtttggctttcarcagcatgactaacagcaatgaagt

SEQ ID NO: 91383 - DNA, 50 bp, homo sapien
taacaagcttaatttttgaattggcratatagtcacatattatgaaattc

SEQ ID NO: 91384 - DNA, 50 bp, homo sapien
gaagatcatccccaaaaaatgcctayggaactgctctaggtgaggctggg

SEQ ID NO: 91385 - DNA, 50 bp, homo sapien
gacagatcctgggtcttgcgctttasaatcctgaatattaaaccatctag

SEQ ID NO: 91386 - DNA, 50 bp, homo sapien
agataaaaaatacttaagaggttgaractaaagaatacagatataatttg

SEQ ID NO: 91387 - DNA, 50 bp, homo sapien
agaatgttttccaagagttctttccygatggtttgtattttctccctttg

SEQ ID NO: 91388 - DNA, 50 bp, homo sapien
gctgaatgccagtggctaattatacraagggaaaccctcaactctgaaaa

SEQ ID NO: 91389 - DNA, 50 bp, homo sapien
tttgttttaccctatcaaaaaccatyacattgcctcggtcattttaattg

SEQ ID NO: 91390 - DNA, 50 bp, homo sapien
atatctgggagatgaagtgagggtasaacacattcataaggaaaagaatt

SEQ ID NO: 91391 - DNA, 50 bp, homo sapien
tttacatgttagtaataggacagaastatcattcaatactaaattaagaa

SEQ ID NO: 91392 - DNA, 50 bp, homo sapien
atctagcaagcatcacttgccattayggtgtttcaactctacttggcacc

SEQ ID NO: 91393 - DNA, 50 bp, homo sapien
acacacacaaacacatacatatggaygcttattatttcttaccttatatg

SEQ ID NO: 91394 - DNA, 50 bp, homo sapien
tcaaagtcagtttcctgtgagcagcragtaagctctggagagttttggag

SEQ ID NO: 91395 - DNA, 50 bp, homo sapien
atcagcagttgtcagaagagattaaytcaaacaggaggcagcaaaacact

SEQ ID NO: 91396 - DNA, 50 bp, homo sapien
aatgccagctcattcccaatatgtaygatggagtaagaacttgtaaatat

SEQ ID NO: 91397 - DNA, 50 bp, homo sapien
aaagctgttaggctacggcatgaccsagtacaaaagttttctgaatctct

SEQ ID NO: 91398 - DNA, 50 bp, homo sapien
ttattatgatcaaatttcttaatgcrataggagggcaacaaagcacagca

SEQ ID NO: 91399 - DNA, 50 bp, homo sapien
ctgacacacatgttctccactgaaayaatctcttccaaacagatgttttt

SEQ ID NO: 91400 - DNA, 50 bp, homo sapien
caaaccccagtaacagtccaaaagckgtctctcaaaaggagagtagttat

SEQ ID NO: 91401 - DNA, 50 bp, homo sapien
caaatttctgctctttataaattacscagactcaggtgttctgttatagc

SEQ ID NO: 91402 - DNA, 50 bp, homo sapien
aacaatgttcatagcatcatcaccaktagattttatctgaagaaaccact

SEQ ID NO: 91403 - DNA, 50 bp, homo sapien
tccacccacagtataattttaggtcraacattaagtgtaaattggatttt

SEQ ID NO: 91404 - DNA, 50 bp, homo sapien
cttagttttcagggcctttttaagamatagaggcaacatgaaaactgtcc

SEQ ID NO: 91405 - DNA, 50 bp, homo sapien
aatgtgggctagcatatgatatttargcacatggtttactaaactttttt

SEQ ID NO: 91406 - DNA, 50 bp, homo sapien
agttaaggagaattcatgagggaaaraaacagaccaatccacttgcaaga

SEQ ID NO: 91407 - DNA, 50 bp, homo sapien
attagagatcattctaaaagcatgamcaaagaaaagtatccttggtaaga

SEQ ID NO: 91408 - DNA, 50 bp, homo sapien
taccaacaactatgtgagcgggacastgagttcttccccagttgagcctc

SEQ ID NO: 91409 - DNA, 50 bp, homo sapien
aatgggaataggtctttaatggaaasgatgttggaccactaaagtcacct

SEQ ID NO: 91410 - DNA, 50 bp, homo sapien
tagcataaatgctaagctgcctcccraattattttctttctgtccttagt

SEQ ID NO: 91411 - DNA, 50 bp, homo sapien
ttaaatttagaaagtgtcattcatawaagtgtactgttaactactaattt

SEQ ID NO: 91412 - DNA, 50 bp, homo sapien
tgtgaaggaactgtctgacatagtaycctgaaatttcgggtaagtataat

SEQ ID NO: 91413 - DNA, 50 bp, homo sapien
ggtcctcaaagtgggtgtgccctaaracattctttggtttgaactagtct

SEQ ID NO: 91414 - DNA, 50 bp, homo sapien
gtctaaaccaaatccttgccttttaygtcactgctcagaggacacccatt

SEQ ID NO: 91415 - DNA, 50 bp, homo sapien
ttctcagatgaaaggtgattgacaartaaacttaatcatgttaatatgat

SEQ ID NO: 91416 - DNA, 50 bp, homo sapien
atttctcaatgcggttataagttagwaacaattgaactaaaggaccctag

SEQ ID NO: 91417 - DNA, 50 bp, homo sapien
tgggatccagccctatctgccttctrtaactccatatactcatgttcctt

SEQ ID NO: 91418 - DNA, 50 bp, homo sapien
aaaaagaagaaatcttaatttggatsaacttttcacttttctttagcccc

SEQ ID NO: 91419 - DNA, 50 bp, homo sapien
aactcacacccaacatacttacacayatagacaagaacacttatctgggg

SEQ ID NO: 91420 - DNA, 50 bp, homo sapien
aaaagtatacaaattatggctttcartaatgtcctcttttttgattccaa

SEQ ID NO: 91421 - DNA, 50 bp, homo sapien
atcttcttagggactccattagaccwctaacgaatatagcgaggaactct

SEQ ID NO: 91422 - DNA, 50 bp, homo sapien
gatcttgatctttagaagtcagacawtggcaaagtaaacattttaataaa

SEQ ID NO: 91423 - DNA, 50 bp, homo sapien
agccacaaagctacaaaccagacaaraagctttcactcaagtcatgggga

SEQ ID NO: 91424 - DNA, 50 bp, homo sapien
aggaggagggcatgagtggagaagtmgttaccttttaccttggttctctg

SEQ ID NO: 91425 - DNA, 50 bp, homo sapien
ccatgcatatattgctggtttgaagractttttagacaaaataaaacatt

SEQ ID NO: 91426 - DNA, 50 bp, homo sapien
taaaatattctgaaaggatacacaasaaactgttcacacttgctccttct

SEQ ID NO: 91427 - DNA, 50 bp, homo sapien
tggttgtaacctcacattaagtaaarattgacagtggtaaaattagtttt

SEQ ID NO: 91428 - DNA, 50 bp, homo sapien
tgggagaaaagtgttagctgctatarcgaattaaaagaaatggaaaggca

SEQ ID NO: 91429 - DNA, 50 bp, homo sapien
ttgtccagaaatatcccttggaagasagtggtagaaatgggggaagggtc

SEQ ID NO: 91430 - DNA, 50 bp, homo sapien
atattggaagtttacttctaaattcygaagtgctacagaaagaatggact

SEQ ID NO: 91431 - DNA, 50 bp, homo sapien
tttggaaaacagaagaaaaaccactsacttatgatgccagtgccccatca

SEQ ID NO: 91432 - DNA, 50 bp, homo sapien
caaagcccagaggtttaccttggacyctgacacagtagctatgtggcttg

SEQ ID NO: 91433 - DNA, 50 bp, homo sapien
aagggcagaaaaagagaaaagagaayaaagagcagatgagagatataaaa

SEQ ID NO: 91434 - DNA, 50 bp, homo sapien
ttattttagtgcttgctttcagatayataatttacatcttttacttgtat

SEQ ID NO: 91435 - DNA, 50 bp, homo sapien
cagatatcgaatgccagtctgggtckgcccaaagcaaacattttccagaa

SEQ ID NO: 91436 - DNA, 50 bp, homo sapien
gaactgagagcactgaactatgagastagcttaaggtttgacttaattgc

SEQ ID NO: 91437 - DNA, 50 bp, homo sapien
tgagaataggaagttccatgtataamtaaggttgttcccagtaaaaacct

SEQ ID NO: 91438 - DNA, 50 bp, homo sapien
agcatgccctgacacagtctctataycacaacgcagatgagaggaggagg

SEQ ID NO: 91439 - DNA, 50 bp, homo sapien
taaatgctctagctaaacacactcartgagaaaaggacattttcagaaac

SEQ ID NO: 91440 - DNA, 50 bp, homo sapien
attttggaaaacatgcaaaagtatascactcccatttttatttttagtaa

SEQ ID NO: 91441 - DNA, 50 bp, homo sapien
gcaccctccaaaatgtcaaagaccawtaagaactattttgtttgccaaca

SEQ ID NO: 91442 - DNA, 50 bp, homo sapien
tcctcatgtgaaatcattaccggtamcttgtacttaaaacataatatatt

SEQ ID NO: 91443 - DNA, 50 bp, homo sapien
ttctgaggcatgaaactttataggakattttgattccatgcccaatcgta

SEQ ID NO: 91444 - DNA, 50 bp, homo sapien
cagaggaaaaaaaccaaaactgatayggcataaaagacctttgttttcaa

SEQ ID NO: 91445 - DNA, 50 bp, homo sapien
agacaacaatggtgttcagcagctaycttttagttcatttacaaaatgtt

SEQ ID NO: 91446 - DNA, 50 bp, homo sapien
tcttgtctcctcctgtgcatagtcarcctgatgaccatcttgtactctgt

SEQ ID NO: 91447 - DNA, 50 bp, homo sapien
gctgttgggctctgtgctagtttctyatactacttgtctaatctctggac

SEQ ID NO: 91448 - DNA, 50 bp, homo sapien
gttaagcaaatactgtcagaattaasaaaaataagaggccagtagataaa

SEQ ID NO: 91449 - DNA, 50 bp, homo sapien
aaaaattaaagtttggagacgtgagraagaaattcatacactccttcaga

SEQ ID NO: 91450 - DNA, 50 bp, homo sapien
atgtgatacacattgagcagtcaagrgaaaaaatgttatttacaacacgg

SEQ ID NO: 91451 - DNA, 50 bp, homo sapien
gtatctttttaaaaattgctatgccrgaaattcagtgggcttgcaactca

SEQ ID NO: 91452 - DNA, 50 bp, homo sapien
taatattagagaagattttttaaackgagatcttgcaggtagcatttttc

SEQ ID NO: 91453 - DNA, 50 bp, homo sapien
gtaacacatggtccctgtacagaagratactcaatggatatttactaaag

SEQ ID NO: 91454 - DNA, 50 bp, homo sapien
ccaattaaacaaatacaaaaatagcycattgatggtaaaagagagaggtg

SEQ ID NO: 91455 - DNA, 50 bp, homo sapien
tttaagtatgtattctatctataagwcatggccttaagtatgaatcacct

SEQ ID NO: 91456 - DNA, 50 bp, homo sapien
aactaatttcctctgacatgtaagaygaatgatttaggtacgtcaaagca

SEQ ID NO: 91457 - DNA, 50 bp, homo sapien
agcataaagccatttaaagagattawcagtccaatatgaaccagttaagt

SEQ ID NO: 91458 - DNA, 50 bp, homo sapien
tctgtggccttgggtggatgaatcaracctcctagggttattctcctcac

SEQ ID NO: 91459 - DNA, 50 bp, homo sapien
cctttctttccctctgtgacaggcaytcaggctcaccagtttgcacaggg

SEQ ID NO: 91460 - DNA, 50 bp, homo sapien
ggaagtttaagattatcatctatggkaagtgtctaaggtacaggtgttct

SEQ ID NO: 91461 - DNA, 50 bp, homo sapien
tataggactcttattatcagtggacraatttgtaaatctcagaaataaag

SEQ ID NO: 91462 - DNA, 50 bp, homo sapien
tgtgacatatagcttagtctgaggaygattgagttatcttaggtaaaatg

SEQ ID NO: 91463 - DNA, 50 bp, homo sapien
agaaatgatctacgtgtgtaacatayagaagcaaacaggcatttattttc

SEQ ID NO: 91464 - DNA, 50 bp, homo sapien
tacactgacggcagctacaaagaagragatccagaacttgtggatggact

SEQ ID NO: 91465 - DNA, 50 bp, homo sapien
tttgtgaaatttactatcattggaamgaggaaaagtaatccaatagccac

SEQ ID NO: 91466 - DNA, 50 bp, homo sapien
gcacacacacctcaagaacgcttcaycgggcttcaacattgtatagcctt

SEQ ID NO: 91467 - DNA, 50 bp, homo sapien
gcagagcttgcctttcaatgagaacwggcccttttatataaatactctat

SEQ ID NO: 91468 - DNA, 50 bp, homo sapien
tcctctactgtcagcccacagtataygtctcttatagtatttttcacatt

SEQ ID NO: 91469 - DNA, 50 bp, homo sapien
ttggctctcctagtgaaatattccawcccggctatggcgtccggtcagtc

SEQ ID NO: 91470 - DNA, 50 bp, homo sapien
  misc_feature (40)..(40): n is a, c, g, or t
ctagatcagatggctttaatggaaawctctttcagtttcntgtttctgag

SEQ ID NO: 91471 - DNA, 50 bp, homo sapien
gtgtatatgactgttttttaaccaayccttcatatcattcattgatgagc

SEQ ID NO: 91472 - DNA, 50 bp, homo sapien
ttttgctgaatccaaagcagtgtcayctggtcagtttttgttttgctttt

SEQ ID NO: 91473 - DNA, 50 bp, homo sapien
gagcttcaaaacaatatcatatgaaracaaagtgaaggaatcggggctac

SEQ ID NO: 91474 - DNA, 50 bp, homo sapien
cccactgagccaggcacgagagagawtcgccttgtctgccggtttttaag

SEQ ID NO: 91475 - DNA, 50 bp, homo sapien
agccatgttattctgcagattacatmaaggtgaataatgaataaggccat

SEQ ID NO: 91476 - DNA, 50 bp, homo sapien
ataactggataaaaccggttcttgawtagatttaatttgactccagaaca

SEQ ID NO: 91477 - DNA, 50 bp, homo sapien
atttgacctagaatgactttgtaacrcttgccagacctgattgaaattta

SEQ ID NO: 91478 - DNA, 50 bp, homo sapien
aagtttgggatgtcaaagtattaacraagggtactgaaaacatactttta

SEQ ID NO: 91479 - DNA, 50 bp, homo sapien
atgatcttcctccttgctcccaacaygaatcttgcctggataaattctac

SEQ ID NO: 91480 - DNA, 50 bp, homo sapien
aggccagtaatgataaataatttacmaatttcacagtaagtggcagaacc

SEQ ID NO: 91481 - DNA, 50 bp, homo sapien
ccaagcaatgaaaatattagcaataygtaggtttctataagtggtatgga

SEQ ID NO: 91482 - DNA, 50 bp, homo sapien
ccaaaaatacagttaggaatattgargataggtttcagaaaaatgagcaa

SEQ ID NO: 91483 - DNA, 50 bp, homo sapien
cgttgttgagactcggccttattaayacacttgggattgtaaaggttttt

SEQ ID NO: 91484 - DNA, 50 bp, homo sapien
taactcacttttgggacaagaggtcrcttcagacttaccatgccactgtt

SEQ ID NO: 91485 - DNA, 50 bp, homo sapien
ctaggctctgctccagatgtttgaartatagaggtgaataagcaaaattc

SEQ ID NO: 91486 - DNA, 50 bp, homo sapien
taggagggatatttatgaggtttgakgatctggtttaaggcaggtatcca

SEQ ID NO: 91487 - DNA, 50 bp, homo sapien
ttgtccaggtatttgtgaaatacatkaactgcctttcctgaacttgaatt

SEQ ID NO: 91488 - DNA, 50 bp, homo sapien
gcttgtcagaatgctgctattctcaygtcttgatacttaagggagctaag

SEQ ID NO: 91489 - DNA, 50 bp, homo sapien
taaaggattagacagaacctacaacrcaaggactgataaggatgaaaaag

SEQ ID NO: 91490 - DNA, 50 bp, homo sapien
cctttgtttcccagatggtttttgaygagcctgacctggaaacgagtttg

SEQ ID NO: 91491 - DNA, 50 bp, homo sapien
cccagccagtaaaatgtccggccgaygtttctggggtaggagaatccaga

SEQ ID NO: 91492 - DNA, 50 bp, homo sapien
ggaaatatgtactaaaggagaacaaragacaggaataaaaaatgagaacc

SEQ ID NO: 91493 - DNA, 50 bp, homo sapien
gtaaggagttcattggcttaggctgracaccttacgcaagccaggaattg

SEQ ID NO: 91494 - DNA, 50 bp, homo sapien
aagtaaggataccttccaatttcaasatttaggactctatgaatagggta

SEQ ID NO: 91495 - DNA, 50 bp, homo sapien
tggattcaactattagttcaatgtcratagctcccaaatcaacattacca

SEQ ID NO: 91496 - DNA, 50 bp, homo sapien
ataggaaaggaccaatgaattgggayggagactagtacatgctgagtgcc

SEQ ID NO: 91497 - DNA, 50 bp, homo sapien
gacccatgtaccagttttaaaggcaycatctatactttatctacatgaag

SEQ ID NO: 91498 - DNA, 50 bp, homo sapien
cttgtgctcagcagctctgcctcacygtctttttgataatacataactgt

SEQ ID NO: 91499 - DNA, 50 bp, homo sapien
tttgagaagtactctcggtgtgaaaktagagtaataatgatctctctatc

SEQ ID NO: 91500 - DNA, 50 bp, homo sapien
gacaacaagccaagagttaacaccamgaggattgagaaaagcctatgtag

SEQ ID NO: 91501 - DNA, 50 bp, homo sapien
gctgtgctgggcaccagggataccamcaggaacaagacagatacagccct

SEQ ID NO: 91502 - DNA, 50 bp, homo sapien
cttattgtgcttttccttatcataascttctccatagcaaccacagaact

SEQ ID NO: 91503 - DNA, 50 bp, homo sapien
tctcatccactaacttgattttctcrctggatgtttcattttgggaatct

SEQ ID NO: 91504 - DNA, 50 bp, homo sapien
tacaaaagaaaaagtgtgttagcaaraaatattttcaagaagtaagaagt

SEQ ID NO: 91505 - DNA, 50 bp, homo sapien
tgggacacaatccaagtatagggccrttgaaaaacacacgtaaaaaatca

SEQ ID NO: 91506 - DNA, 50 bp, homo sapien
tcctatataagattaggttttactgracataaatttttgacatatatttt

SEQ ID NO: 91507 - DNA, 50 bp, homo sapien
ttatatacttttctataatgagaacrgaatacatataaaatacaccttac

SEQ ID NO: 91508 - DNA, 50 bp, homo sapien
taaattttattattaagaggttgtgsaaatttataccctcattaagaggt

SEQ ID NO: 91509 - DNA, 50 bp, homo sapien
gtctttcctttagaattatgtgctayattaaaagaaagcaggcacccaag

SEQ ID NO: 91510 - DNA, 50 bp, homo sapien
tcaaaatatacacaaaaatatacackgatagaaaataaaacagtagttac

SEQ ID NO: 91511 - DNA, 50 bp, homo sapien
cagacagggtttttcaggctggagamccgttttcagactggaatctgagt

SEQ ID NO: 91512 - DNA, 50 bp, homo sapien
tttagactgacaatactaaacgttgrtgagaatgtggagcaacaagaact

SEQ ID NO: 91513 - DNA, 50 bp, homo sapien
attctaagctggtgccccactgaatyttgtgtacctgtgactaaacaact

SEQ ID NO: 91514 - DNA, 50 bp, homo sapien
gcttcaagcaacagcaggagtagacrgaataaacacttgaaggtttcaga

SEQ ID NO: 91515 - DNA, 50 bp, homo sapien
ccatatacctgaaagatctgatgaarcccagcgtgtttttaaaagttcga

SEQ ID NO: 91516 - DNA, 50 bp, homo sapien
atgtgcccatgcttcacaataacatyggtatgacacaggagctaatacag

SEQ ID NO: 91517 - DNA, 50 bp, homo sapien
aggtctctgggatccaaatataaggyagtagtagtgactcagttcctgta

SEQ ID NO: 91518 - DNA, 50 bp, homo sapien
gacacaggagctaatacagaatgaayatttagagagcatcacggaatgtt

SEQ ID NO: 91519 - DNA, 50 bp, homo sapien
cattgtcatcattgatccatccgtcyatctccaaaaagttactcagggcc

SEQ ID NO: 91520 - DNA, 50 bp, homo sapien
tacatacaacagaatcttaaaatacrctacacatttaactagtgcttcag

SEQ ID NO: 91521 - DNA, 50 bp, homo sapien
aattcagagaaaatttaacaacctcyacttgtgctctcaaatcaatcctt

SEQ ID NO: 91522 - DNA, 50 bp, homo sapien
aaaccaattctactaataatggtaayaataacagcagctaatcagacttg

SEQ ID NO: 91523 - DNA, 50 bp, homo sapien
tggagaggaattctagaagctgtggraagaaaaagagggaggattttagc

SEQ ID NO: 91524 - DNA, 50 bp, homo sapien
ttgggcatatgttttatagaaatagraatttacgttcacattaaaaccgg

SEQ ID NO: 91525 - DNA, 50 bp, homo sapien
gcttaccaaaggcttagcttctctcratttatttatagaaatccacatat

SEQ ID NO: 91526 - DNA, 50 bp, homo sapien
cagaaggtgaataattgggtaaaacratctcaatttaaaatgagcagggc

SEQ ID NO: 91527 - DNA, 50 bp, homo sapien
aaataggagctctagtttattggaaygtgctttaacaataatctgatgtt

SEQ ID NO: 91528 - DNA, 50 bp, homo sapien
tgggttaagcaaatgcagatgaggcrattgagtgaagaatttctgttaag

SEQ ID NO: 91529 - DNA, 50 bp, homo sapien
gcaggaggcagcccagactggtgackctgagccagcatggccttagagcc

SEQ ID NO: 91530 - DNA, 50 bp, homo sapien
taagagaagaaagacctgagctagamtattagcacactctgctccctcac

SEQ ID NO: 91531 - DNA, 50 bp, homo sapien
gagccaaaaccaaaagctgctgttargtgataatagacttggaggattag

SEQ ID NO: 91532 - DNA, 50 bp, homo sapien
tcttgccctgtagaggccaggaataygtcccgcaaagatatgttttatca

SEQ ID NO: 91533 - DNA, 50 bp, homo sapien
acctccatgagaggacacttgaagcrtcacactaggaactctcatgggcc

SEQ ID NO: 91534 - DNA, 50 bp, homo sapien
tgaccctccagcatacctattgcacrcagtagctttgagcgaacgccttt

SEQ ID NO: 91535 - DNA, 50 bp, homo sapien
ctttgctagctgcttccttcgtcctrcagtcccaaggaggaacccatgat

SEQ ID NO: 91536 - DNA, 50 bp, homo sapien
tgccaggcaggcccaaatggttgaayttctttttcctctcacagtaaaat

SEQ ID NO: 91537 - DNA, 50 bp, homo sapien
caatgctgtacagtgcaggggttcayatgtaagaactttggtgaccaaaa

SEQ ID NO: 91538 - DNA, 50 bp, homo sapien
cacactgggtttcgaagacaatacaraaaagggcaaaatatctcaataat

SEQ ID NO: 91539 - DNA, 50 bp, homo sapien
atttcagtctgattaaaaggaacggragcatttccatcataaggtttttt

SEQ ID NO: 91540 - DNA, 50 bp, homo sapien
accctgtcaaaatgaataaaacttayagtgagttcaccagccatctttag

SEQ ID NO: 91541 - DNA, 50 bp, homo sapien
tcactaagaacatttgtgactcaatmacatgaacaacattttggaagaag

SEQ ID NO: 91542 - DNA, 50 bp, homo sapien
acttcttgagcaaatgtgattcatamgacctctagtcactctgtggcttt

SEQ ID NO: 91543 - DNA, 50 bp, homo sapien
tatgccagatttttcttaaggtgcastagccactgaggatatttttgctg

SEQ ID NO: 91544 - DNA, 50 bp, homo sapien
ttgtcaaatatggggagactggagaygaggtacagttttattttccaaca

SEQ ID NO: 91545 - DNA, 50 bp, homo sapien
aaactatagtaagctaaacagcatastactgaaataataataggcccata

SEQ ID NO: 91546 - DNA, 50 bp, homo sapien
ccattttcctacaaattgctctgaayggcttcatggttaaatataaaaaa

SEQ ID NO: 91547 - DNA, 50 bp, homo sapien
cattcttcaagtgaacaaggcaaaartaacttgcagaaaacaaagtactg

SEQ ID NO: 91548 - DNA, 50 bp, homo sapien
actttgtggcacgctgggtaaaacaraagatgacccttcaggaagacaat

SEQ ID NO: 91549 - DNA, 50 bp, homo sapien
ccactcaaccatagtattggtgaaaygaaattacttctatttgggaaaat

SEQ ID NO: 91550 - DNA, 50 bp, homo sapien
agggcaggcacacgacatttgaatastagagaggcacagcattctaacag

SEQ ID NO: 91551 - DNA, 50 bp, homo sapien
ggtgctctggcaaaggtagttgtgayagtaaagcagcagggagactgtgt

SEQ ID NO: 91552 - DNA, 50 bp, homo sapien
gactgaaacttgagataggtcagaastagatgtagagattcagaacttca

SEQ ID NO: 91553 - DNA, 50 bp, homo sapien
atatattaattcatactttcatagamtagaacaggacagaattcccattt

SEQ ID NO: 91554 - DNA, 50 bp, homo sapien
taagataatataagtataattcctayaatgtaagtgttcagatattgtaa

SEQ ID NO: 91555 - DNA, 50 bp, homo sapien
ctgccacaccaagttaaattttctcwcttccaacaaaacaagtaagcatc

SEQ ID NO: 91556 - DNA, 50 bp, homo sapien
taacattatcctcaatagagcctaargtatagaatacactcattttctca

SEQ ID NO: 91557 - DNA, 50 bp, homo sapien
agactcatagcaatgtgcccaatacyaataaaactgagaaggttgttgag

SEQ ID NO: 91558 - DNA, 50 bp, homo sapien
tgcattttctatttcagtgcatccastcaactaatagatgtagcatggct

SEQ ID NO: 91559 - DNA, 50 bp, homo sapien
agccttaccgttttctcctggatccratctcaagtggaatttaaacttgc

SEQ ID NO: 91560 - DNA, 50 bp, homo sapien
aggtaattgttcaatatatatccatyaggtcaaatttgctgattatatta

SEQ ID NO: 91561 - DNA, 50 bp, homo sapien
gacagaggccccaggcttaccgacakatgagcttccaaaaagagtttgat

SEQ ID NO: 91562 - DNA, 32 bp, homo sapien
aagctttcttactacartgtaaatgactggcc

SEQ ID NO: 91563 - DNA, 50 bp, homo sapien
aaacaggtggtactcgtgaagaactyaatagtagccaaatttcaaaggtc

SEQ ID NO: 91564 - DNA, 50 bp, homo sapien
tttgatcactataccagaccattatyataaagacgcttcgaaaaactaaa

SEQ ID NO: 91565 - DNA, 50 bp, homo sapien
tccaaacatttgctctttcttcataygctctggtttagctcaatggttca

SEQ ID NO: 91566 - DNA, 50 bp, homo sapien
caggaagagtactgataagtagaggrcagctgaaccaaggcccaagcacc

SEQ ID NO: 91567 - DNA, 50 bp, homo sapien
ggcacggaattctgctttagaattcrtttggctccctggctccacccaaa

SEQ ID NO: 91568 - DNA, 50 bp, homo sapien
cccacgggtttctggctctggcacayggagtagatcctgactgtgtggtc

SEQ ID NO: 91569 - DNA, 50 bp, homo sapien
attctaacaactatgctttacttaayattattcctgtgtagtattagtct

SEQ ID NO: 91570 - DNA, 50 bp, homo sapien
atctgcctgaactctctgtttacagraaccaatggctacttgagtgacca

SEQ ID NO: 91571 - DNA, 50 bp, homo sapien
gctccatttatacagataatagaacrcgggctctgtgctgctgctgaatg

SEQ ID NO: 91572 - DNA, 50 bp, homo sapien
gtttataatatcagacatctttattyaagctcccactgctatttcccctt

SEQ ID NO: 91573 - DNA, 50 bp, homo sapien
attcctctaccacttggctagattawgtgagaatggtagctttgtaggga

SEQ ID NO: 91574 - DNA, 50 bp, homo sapien
aagaaaccggcccgggaaaggaagasaaatggatgtaaggagaaggagag

SEQ ID NO: 91575 - DNA, 50 bp, homo sapien
taagaaaaaagtacttagggtacatragagatacataaagtgctttggga

SEQ ID NO: 91576 - DNA, 32 bp, homo sapien
tcttcgttccatatgargaagaactaataaag

SEQ ID NO: 91577 - DNA, 50 bp, homo sapien
agcttgatcataccaggcattcaatratagaaaacagaggccacaagaac

SEQ ID NO: 91578 - DNA, 50 bp, homo sapien
caagcccagagagtaaaacaaatgayggtaggctgctccccagtccctat

SEQ ID NO: 91579 - DNA, 50 bp, homo sapien
ttcttcttctaagcggaagaactgayaaggaataggactaagagtctcga

SEQ ID NO: 91580 - DNA, 50 bp, homo sapien
tgagcagggacctgtcttcagaatckaagaagcataatgtccttaatgct

SEQ ID NO: 91581 - DNA, 50 bp, homo sapien
cataaagtttatagtggacttatcartaggttgaatctctttattgttaa

SEQ ID NO: 91582 - DNA, 50 bp, homo sapien
tgttcaggattatatataaagagaarcagtaacctcagagtgagtgagtc

SEQ ID NO: 91583 - DNA, 50 bp, homo sapien
aggaagcaatcagatactacactgaygcatacttcaacatgaaataatcc

SEQ ID NO: 91584 - DNA, 50 bp, homo sapien
cacgactttttaagatagaacatgakacttcaaagcaattttgcacttac

SEQ ID NO: 91585 - DNA, 50 bp, homo sapien
tgttctatcttaaaaagtcgtggcawcctgttacatgatctccttctatt

SEQ ID NO: 91586 - DNA, 50 bp, homo sapien
ttttgtttgggttaaatctttcccayggtggccactgtaactcttatttt

SEQ ID NO: 91587 - DNA, 50 bp, homo sapien
gtctgagctatgctgtctgaactgayactgggtttggtttccagtcattt

SEQ ID NO: 91588 - DNA, 50 bp, homo sapien
ctattatttatgtttcttattgctcwctctcctgtggattcaaagaagca

SEQ ID NO: 91589 - DNA, 50 bp, homo sapien
ctagcttaggcatatgttttaaaaartgataacattgttatgagccctgc

SEQ ID NO: 91590 - DNA, 50 bp, homo sapien
tagttgcgcactttctctggaaaaaygtaggcccctgaaaacagatattg

SEQ ID NO: 91591 - DNA, 50 bp, homo sapien
gcacccagtgcgacttggttctcaamtctacctatggtaggtgaggtact

SEQ ID NO: 91592 - DNA, 50 bp, homo sapien
ggacctttccatgttaactgttaaayggtttgggcaggaattgcctgata

SEQ ID NO: 91593 - DNA, 50 bp, homo sapien
tcggaaaaaaatgtttggttattttytcatggcatgacaatgatctttca

SEQ ID NO: 91594 - DNA, 50 bp, homo sapien
atcaataagttagtttctttgctcaktaatattggtgctaattaaaatgt

SEQ ID NO: 91595 - DNA, 50 bp, homo sapien
taggcacagctacacaggcccttccrtacgagtccaggcttaaggtgggc

SEQ ID NO: 91596 - DNA, 50 bp, homo sapien
acactaagccaagatggaaacctaaytctgtatgaccccaaaagccaggg

SEQ ID NO: 91597 - DNA, 50 bp, homo sapien
aggcttattagtgacctacgaacaaygaagcaagtttgatggaatgaaat

SEQ ID NO: 91598 - DNA, 50 bp, homo sapien
gcatgaataattttaattaattaaawtcagaagcagagacaaccagaaat

SEQ ID NO: 91599 - DNA, 50 bp, homo sapien
caaacactaaaacactaaaatttgargatcacaggatttaataattgtgt

SEQ ID NO: 91600 - DNA, 50 bp, homo sapien
aatgaacagagccttcagggacctayggaactataagaaaagctcaaata

SEQ ID NO: 91601 - DNA, 50 bp, homo sapien
ttaaaataaaattctattctataacwgtaatcacgtaagtgctttcatga

SEQ ID NO: 91602 - DNA, 50 bp, homo sapien
agctaaagaactctgacaattaaaartataggaaataatagattttaaag

SEQ ID NO: 91603 - DNA, 50 bp, homo sapien
atggatataagatattttaggactcrcattctttgctttaaaatctatta

SEQ ID NO: 91604 - DNA, 50 bp, homo sapien
ctcttccgagctgctttgtgggctcmaggcctgtactcatcggcaggcgc

SEQ ID NO: 91605 - DNA, 50 bp, homo sapien
tgtattttgcgtggaaaataaatcasattaggttctggaaatggtggagt

SEQ ID NO: 91606 - DNA, 50 bp, homo sapien
aactaaaaataaaacacataacacaygactaggttacagttacacctaca

SEQ ID NO: 91607 - DNA, 50 bp, homo sapien
tatttagtttgaaaatcaatgtttcyagtttccaatgatcttttgtgggt

SEQ ID NO: 91608 - DNA, 50 bp, homo sapien
acatgatgaagaacaggattttatgsagtgaagatccttaacagcactct

SEQ ID NO: 91609 - DNA, 50 bp, homo sapien
tgctgctcccatgctcagctcccagmaccactgaagaggtcaagctttaa

SEQ ID NO: 91610 - DNA, 50 bp, homo sapien
gcacatttactccaagggacaccacrctaaaggcttacaaatgttggccc

SEQ ID NO: 91611 - DNA, 50 bp, homo sapien
tcataaagaacccactccctcaacartgacattaattcattcataaaggc

SEQ ID NO: 91612 - DNA, 50 bp, homo sapien
ctatttctgatgtaaatagtatgaaragaaaatctatatggaaacaacgt

SEQ ID NO: 91613 - DNA, 50 bp, homo sapien
ctgccttgcaggactattctattgtyaattcagttaggctgctgaattca

SEQ ID NO: 91614 - DNA, 50 bp, homo sapien
ttactatttctatttttctccaaatkagtgcctaacagacacttcagtga

SEQ ID NO: 91615 - DNA, 50 bp, homo sapien
atatatgattttgtaaatgatccaayggcttttaaaaagaagagttattc

SEQ ID NO: 91616 - DNA, 50 bp, homo sapien
ccagcctggacctcactcattcatayacagaggcggataatcaggattta

SEQ ID NO: 91617 - DNA, 50 bp, homo sapien
tcattctatgtctgagtctaatctawagatacgtacatcaaagtcattta

SEQ ID NO: 91618 - DNA, 50 bp, homo sapien
cattgtccccaaggagctcacaactkagtaatggagatgaatcagaaaca

SEQ ID NO: 91619 - DNA, 50 bp, homo sapien
taatcaattcctggccatgaaacaarttaatgagtctgtccttcgttgct

SEQ ID NO: 91620 - DNA, 50 bp, homo sapien
aatgtgtaacatctgaagcattcaasaagaaacacaacagcacagatcat

SEQ ID NO: 91621 - DNA, 50 bp, homo sapien
agagtcagtatggctagagtgtaggkcaaaggaaatatgtggaaggagat

SEQ ID NO: 91622 - DNA, 50 bp, homo sapien
ttaatttaatgggaaaaaatagatayagatgttctaaatgcataaggatt

SEQ ID NO: 91623 - DNA, 50 bp, homo sapien
taccaactcaacatcctttaccttascacttcagtcagacttaactttgt

SEQ ID NO: 91624 - DNA, 50 bp, homo sapien
cacccaggccttggacttggccttaygggtacattctccaggaccgcccc

SEQ ID NO: 91625 - DNA, 50 bp, homo sapien
ttggatgggaaagagccatggataastgatgggccacccaggcttttgtt

SEQ ID NO: 91626 - DNA, 50 bp, homo sapien
atcatggacagagcacatgtcaaaakaaagagcacttgaacttggagtca

SEQ ID NO: 91627 - DNA, 50 bp, homo sapien
aaaaatcttctgggtggaataagaamatttaagatggatgaatgtgatat

SEQ ID NO: 91628 - DNA, 50 bp, homo sapien
cactatcaagcagggtttattccaasaatgaaaaagtggcttaatatcag

SEQ ID NO: 91629 - DNA, 50 bp, homo sapien
gaaagatttatctggaagtagagatmaagatagaatgcaatcttcccaga

SEQ ID NO: 91630 - DNA, 50 bp, homo sapien
caaatgaattagttaaactgtagacyctttattggtagatttgtctggga

SEQ ID NO: 91631 - DNA, 50 bp, homo sapien
gctcccaggccacattcgggtctcaytctgtaacttgcatgagtctaggg

SEQ ID NO: 91632 - DNA, 50 bp, homo sapien
acgctgtggatgcaagagtcaatcaratgagtgtggtctctatccttgtg

SEQ ID NO: 91633 - DNA, 50 bp, homo sapien
agggaaaattgcatgattctttcttkcacccaagattttctctcctgttc

SEQ ID NO: 91634 - DNA, 50 bp, homo sapien
cactaagctcctaacactattagaaytatcttctttttctgtctgggaat

SEQ ID NO: 91635 - DNA, 50 bp, homo sapien
tttttaggtgtaacattgaagtaagyatgagttgaaactttagaaacaag

SEQ ID NO: 91636 - DNA, 50 bp, homo sapien
cagaatgtttctctgcaaatgaaacrctatattccctcatttgtgtgcac

SEQ ID NO: 91637 - DNA, 50 bp, homo sapien
gctgtaataagataacggagcagcaycttcgtagtgccaaggaaaagtaa

SEQ ID NO: 91638 - DNA, 50 bp, homo sapien
ccatgtgaaactgtgagtgcatcaarcctcttttttttctttttttataa

SEQ ID NO: 91639 - DNA, 50 bp, homo sapien
taggtaaatgtgacaggtaaaagaasagagctccagaacagcactgtcca

SEQ ID NO: 91640 - DNA, 50 bp, homo sapien
caggctttaatgtctgtctctctctsaataatgttgagcaccttttcacg

SEQ ID NO: 91641 - DNA, 50 bp, homo sapien
tttcaggagaaagaaagggctcgtayagagcgagagcaaagtattttaaa

SEQ ID NO: 91642 - DNA, 50 bp, homo sapien
acagcgcagttttggggaaaatgcartagttcactggtattctagaagga

SEQ ID NO: 91643 - DNA, 50 bp, homo sapien
actgatactcacaaacacttctcaayactgaaacaatgaaaagacgagtc

SEQ ID NO: 91644 - DNA, 50 bp, homo sapien
tgtgtttgagactgagagagtacaamgaaaattgaagggggtaactcctg

SEQ ID NO: 91645 - DNA, 50 bp, homo sapien
tacgcaggccttctttagtctgatayggagttcgaagttgctgtggcagg

SEQ ID NO: 91646 - DNA, 50 bp, homo sapien
aaaaatctaatcacagaaaaattaaytgatactcacaaacacttctcaat

SEQ ID NO: 91647 - DNA, 50 bp, homo sapien
tccaaagatcaagtttccccaaagaraaaaatcatgggattctctccttg

SEQ ID NO: 91648 - DNA, 50 bp, homo sapien
cttggttttttcaaaagcatgtcacyatctgttcacttactctgtagtaa

SEQ ID NO: 91649 - DNA, 50 bp, homo sapien
cagcaagcattgtttggagtgtggargaacagtaactatccttctctgct

SEQ ID NO: 91650 - DNA, 50 bp, homo sapien
gcattatccattgactctagtaacamgtcttgaaacctacctactaaata

SEQ ID NO: 91651 - DNA, 50 bp, homo sapien
ggtttcatttgtcttgaaactaacckggacaccatggtcaattattttag

SEQ ID NO: 91652 - DNA, 50 bp, homo sapien
gtctttataggcatggttcccttaaytgagctctctagggcaggggtcaa

SEQ ID NO: 91653 - DNA, 50 bp, homo sapien
gagcacagcctcagcgtggttaaccyggactcttgtaagcacatttgaaa

SEQ ID NO: 91654 - DNA, 50 bp, homo sapien
tatccaatattgttttagtgacaaartattcttatgacttccctctagcc

SEQ ID NO: 91655 - DNA, 50 bp, homo sapien
ttgttgttgttgtttttcgatctcartcattcactcttgtcttccctcta

SEQ ID NO: 91656 - DNA, 50 bp, homo sapien
gtacaaaagacagcttatataaaaaytctaagtatgcttttgaaagcagt

SEQ ID NO: 91657 - DNA, 50 bp, homo sapien
gcatgacacagagagcaaaactgtasacgctggtcatgttttcctctatt

SEQ ID NO: 91658 - DNA, 50 bp, homo sapien
ccagaaaagacaactggctactcttycaacgcaccatgacaacaagtcag

SEQ ID NO: 91659 - DNA, 50 bp, homo sapien
tagatacacatgtagatagttcagaytcatcttctgaggagaaagaagat

SEQ ID NO: 91660 - DNA, 50 bp, homo sapien
gctggtgtccatcagagggagttccratagtaatggaggaagtgatttga

SEQ ID NO: 91661 - DNA, 50 bp, homo sapien
agatctacattgaccccttcacttaygaggatcccaacgaagctgtccgg

SEQ ID NO: 91662 - DNA, 50 bp, homo sapien
aacatctgttatagtctgctttatamccctaatacaacagactacttgca

SEQ ID NO: 91663 - DNA, 50 bp, homo sapien
agctggtcagaaaactcggactgaaracagagtcagaagagtggagctgg

SEQ ID NO: 91664 - DNA, 50 bp, homo sapien
tggtgaagtaaaggatgttatggaastcataatttttaaaagtgtaactt

SEQ ID NO: 91665 - DNA, 50 bp, homo sapien
caatcaattgaaatttaaaagttacraagatgaatgcttttctgtttctg

SEQ ID NO: 91666 - DNA, 50 bp, homo sapien
gagaattacatgctactctaatcacsaaaggcatttgattctgtcttctt

SEQ ID NO: 91667 - DNA, 50 bp, homo sapien
tcaggtgaagaatattcagtgtaaayaataatatccatttccccagttta

SEQ ID NO: 91668 - DNA, 50 bp, homo sapien
agcatgtgtgaggctgttattaaccraacctcctggctgggcttggtggc

SEQ ID NO: 91669 - DNA, 50 bp, homo sapien
ctgtttctgaacaaggctggcttacrcaaagaaagagcagtagtgtgggc

SEQ ID NO: 91670 - DNA, 50 bp, homo sapien
ttgaagtcacctacgaccactaaaamaatctcatgcgcaatttgatcaca

SEQ ID NO: 91671 - DNA, 50 bp, homo sapien
tctagaggacagtggccctcatctcwtagctccactagacagtgtccctg

SEQ ID NO: 91672 - DNA, 50 bp, homo sapien
taaagtttccttttgcaaaccctcayattcagtttaaaaattcacactga

SEQ ID NO: 91673 - DNA, 50 bp, homo sapien
gtgctctaaacctcctggggtattcyacagctttaatgactatgtgtaac

SEQ ID NO: 91674 - DNA, 50 bp, homo sapien
gccatctgcacaaccacataagtaaytgacctgcagaaacatcagtccat

SEQ ID NO: 91675 - DNA, 50 bp, homo sapien
cctgctggatgcctcctgataaatamccgggatgcaccaccttgcccttt

SEQ ID NO: 91676 - DNA, 50 bp, homo sapien
ttgatatttttagattactcttcaayagttaggttgttacacctaatatt

SEQ ID NO: 91677 - DNA, 50 bp, homo sapien
gcagtaggttgttggtttacattcayctttgaccactataacctccagat

SEQ ID NO: 91678 - DNA, 50 bp, homo sapien
ggtgggggaactctacttaggctccygatatattaagcaaaagcagtagg

SEQ ID NO: 91679 - DNA, 50 bp, homo sapien
catgtcctatagacatggactatcayaatttcattcattcattcattctc

SEQ ID NO: 91680 - DNA, 50 bp, homo sapien
ttattggcattattcatgaaacaacrgccaggacagtgaccacaggagtt

SEQ ID NO: 91681 - DNA, 50 bp, homo sapien
atcctcttggtctctgaaggaggtcygaacaatatcaggctaacagtagc

SEQ ID NO: 91682 - DNA, 50 bp, homo sapien
cttgtatttttctgtaatattcaaartacaaacctggtgggactgtaaac

SEQ ID NO: 91683 - DNA, 50 bp, homo sapien
ccaattctgatttcaggcaataacarcaaccttctgatgattgtcttctc

SEQ ID NO: 91684 - DNA, 50 bp, homo sapien
attttattgtcatctgattgtctcaytgaaatctgcaattcttgtatttt

SEQ ID NO: 91685 - DNA, 50 bp, homo sapien
ttgctgttattgcctgaaatcagaaytgggtaactgagacagttaatggc

SEQ ID NO: 91686 - DNA, 50 bp, homo sapien
cctaaagatttgtttgtagctcgacmacttccctcctacaaacaaagcaa

SEQ ID NO: 91687 - DNA, 50 bp, homo sapien
catgagccagtcatttcagtcaaaartgtcatatattattgtttttaacc

SEQ ID NO: 91688 - DNA, 50 bp, homo sapien
ggattctaacctgacagatcatatcratgaatcaaaaaattgtatctgtc

SEQ ID NO: 91689 - DNA, 50 bp, homo sapien
ttcaatgtagccatgggtatgttcaygatatcactgattctttcttttct

SEQ ID NO: 91690 - DNA, 50 bp, homo sapien
atatcgtccagtgcttttactaacartgcctaaacatgtagtaaaagtat

SEQ ID NO: 91691 - DNA, 50 bp, homo sapien
aaaatgaaagtcgtctaatgacaccrcttgaagttcaaacactattgaca

SEQ ID NO: 91692 - DNA, 50 bp, homo sapien
cagttgttcttccattcacttgtagsaacttgtctgagggagatcagagt

SEQ ID NO: 91693 - DNA, 50 bp, homo sapien
agaaatgatttaaaattgtaaatcaygtagcaagttcaatagggtttagt

SEQ ID NO: 91694 - DNA, 50 bp, homo sapien
gcaagttgaacttgcttaggagaaarggcaaatttattgctcatgtcatt

SEQ ID NO: 91695 - DNA, 50 bp, homo sapien
ccagcaggctgggccctggaatgccragtattaagtgtaggaaagaaaag

SEQ ID NO: 91696 - DNA, 50 bp, homo sapien
agctgtaaatttcaacaccttcaacrcctaaaatcaagtgtaattatttg

SEQ ID NO: 91697 - DNA, 50 bp, homo sapien
ccatgaatcagtctatgcttctgacygagatgttaagtattctgctcagt

SEQ ID NO: 91698 - DNA, 50 bp, homo sapien
attttaggtgttgaaggtgttgaaayttacagctaaagtgggctgagttt

SEQ ID NO: 91699 - DNA, 50 bp, homo sapien
cgtaaagcttcagttaccaattctgytgaacgggataataatatctgccc

SEQ ID NO: 91700 - DNA, 50 bp, homo sapien
aggtctcacaatctactgggaataakcaaatatctcttatgaacaagcaa

SEQ ID NO: 91701 - DNA, 50 bp, homo sapien
ccatttggacatttccccatcaccasgaatagaaaactcattgtagtata

SEQ ID NO: 91702 - DNA, 50 bp, homo sapien
attaagcctcaatgggctacttttayaatcccatggaaggattaatttaa

SEQ ID NO: 91703 - DNA, 50 bp, homo sapien
ccatttaaattgtggagatagtcaaygtgcaacttacacgtgcagcaact

SEQ ID NO: 91704 - DNA, 50 bp, homo sapien
ttgcaccactgacatggtttttcacwctctcttaatactcattcatgcta

SEQ ID NO: 91705 - DNA, 50 bp, homo sapien
cttggaggctccagttcaatacaggrctgaaggacaaacagaacggctat

SEQ ID NO: 91706 - DNA, 50 bp, homo sapien
atcttggctgaaatcaccttcccaamtggcctgtctcctccagccttcct

SEQ ID NO: 91707 - DNA, 50 bp, homo sapien
tgccctgtgccgcaccagtggcccartccaacaggttatccaggccctgg

SEQ ID NO: 91708 - DNA, 50 bp, homo sapien
aaactgcagcacatccctgacaaaamcttagccaatgtgaaggggagctc

SEQ ID NO: 91709 - DNA, 50 bp, homo sapien
atgttattataatccaattcttataygttgaatagccctctcaaacccct

SEQ ID NO: 91710 - DNA, 50 bp, homo sapien
aaattgggccaggaagagaaataaaygagtaaaaatgttttcatgttaat

SEQ ID NO: 91711 - DNA, 50 bp, homo sapien
tatgcttgctatctgggtgatcgggycattcatatcccaaacctcagcat

SEQ ID NO: 91712 - DNA, 50 bp, homo sapien
tatcaaagcccagttccaatattacyaggccagatgagggctttcccttg

SEQ ID NO: 91713 - DNA, 50 bp, homo sapien
tgtatctgataattagcttatagccrcagtgataattgggccctacattt

SEQ ID NO: 91714 - DNA, 50 bp, homo sapien
tgccagatggtagggatacagtaaayagggccattgatagttacaatgga

SEQ ID NO: 91715 - DNA, 50 bp, homo sapien
ttagtgacaattctttagtcttgaawttaaatcagaattatcaatataaa

SEQ ID NO: 91716 - DNA, 50 bp, homo sapien
tgagtccattatgctaatcacttaasgtgttatctaattatttcaaccct

SEQ ID NO: 91717 - DNA, 50 bp, homo sapien
tctatactttatgggttctataagaycaaatggaagtcacctaacaacgc

SEQ ID NO: 91718 - DNA, 50 bp, homo sapien
agttcagggaaaatctgttcgaggartaagtcctgaagttgagacacaaa

SEQ ID NO: 91719 - DNA, 50 bp, homo sapien
agatcaagtcaggtattctatgacastgggctaacagagaaggagtatat

SEQ ID NO: 91720 - DNA, 50 bp, homo sapien
ttcctggaatgaattatgacagttakcttagtcttccttttggtcacaca

SEQ ID NO: 91721 - DNA, 32 bp, homo sapien
tgctcttttacttatawgccaaaacacaacat

SEQ ID NO: 91722 - DNA, 50 bp, homo sapien
gatattggcaaataaatgaacccatsatcaagcaattaaacttcaaataa

SEQ ID NO: 91723 - DNA, 50 bp, homo sapien
gctagaaatggagagtctttcttaayggaaaaaaagcagaacagaaacca

SEQ ID NO: 91724 - DNA, 50 bp, homo sapien
gccaactttaataagtatagccacckcctgggtgtagactcctgcaaaat

SEQ ID NO: 91725 - DNA, 50 bp, homo sapien
taagtatctccaataatgggaaagasgtgtcaataccaacatcaacacaa

SEQ ID NO: 91726 - DNA, 50 bp, homo sapien
tcaaaaaaagaaaaactacaaaaaarctacaacagagttgcaatattcat

SEQ ID NO: 91727 - DNA, 50 bp, homo sapien
accagccctttacagagactctaccrctgatatcaactaaccagtaatga

SEQ ID NO: 91728 - DNA, 50 bp, homo sapien
gatcatgtttagtgagaggaagcgaygagcctgaagctttccctctttct

SEQ ID NO: 91729 - DNA, 32 bp, homo sapien
agatcttgcatttcackatgtgcaaattttat

SEQ ID NO: 91730 - DNA, 50 bp, homo sapien
gatgggagtattttctacgtgggaargagagccaaacaaatatctattgg

SEQ ID NO: 91731 - DNA, 50 bp, homo sapien
ctcgataccattgatgacattgtacsagattttttgctatttggtctcac

SEQ ID NO: 91732 - DNA, 50 bp, homo sapien
acatataatacctccctggtaaacawcccagcagctacagtttaatacat

SEQ ID NO: 91733 - DNA, 50 bp, homo sapien
atccaacatgctgaacaatacaagarcttctaagagtgcagccacatcat

SEQ ID NO: 91734 - DNA, 50 bp, homo sapien
aaggaaaggacttggtccttgaaacmtttatcttctgctcaccaaagagc

SEQ ID NO: 91735 - DNA, 50 bp, homo sapien
tcagcagaacacctcagagccttccygagcaggtgaacagatttgagacc

SEQ ID NO: 91736 - DNA, 50 bp, homo sapien
ccccaatatcctttctaatcacatamaagctggtttggaaggttgatggg

SEQ ID NO: 91737 - DNA, 50 bp, homo sapien
attaaagtcacaggcacctcactagyagcggtcccgaaggtttctgtccc

SEQ ID NO: 91738 - DNA, 50 bp, homo sapien
tctctttctagggaggatggaaatakcaaacaaacaacaatgcaactttg

SEQ ID NO: 91739 - DNA, 50 bp, homo sapien
agtgactcctgcacccgatatcaaakaatccaaaatatcaagtgaattgt

SEQ ID NO: 91740 - DNA, 50 bp, homo sapien
atgatggggtcatgtttttcacacaycagttttattctaattgcctgttg

SEQ ID NO: 91741 - DNA, 50 bp, homo sapien
gacacggatagtgccaggaaaatcastctggaactctaggaagggcttct

SEQ ID NO: 91742 - DNA, 50 bp, homo sapien
gctgcctgctggtggaaatctgtacytgcattatactggagaagcccttc

SEQ ID NO: 91743 - DNA, 50 bp, homo sapien
taatatcttatgctaattcaacaaamatggatgagaaaactattacttgc

SEQ ID NO: 91744 - DNA, 50 bp, homo sapien
acctgccactgaccttccatgagcaktgactatgtggtttcaacattggt

SEQ ID NO: 91745 - DNA, 50 bp, homo sapien
taggaatgtggctaactggagaatayggaatttgtctaagggagtagctg

SEQ ID NO: 91746 - DNA, 50 bp, homo sapien
tacagcaatagatactgcaagtggcrcatggaaactgagacccactaatc

SEQ ID NO: 91747 - DNA, 50 bp, homo sapien
gaggcaccagatgcaagcatgaggcraaactccaatggttttacaagaga

SEQ ID NO: 91748 - DNA, 50 bp, homo sapien
tggcaccgtacttttggcagggagamaaatcatatcatcagcaagtcaac

SEQ ID NO: 91749 - DNA, 50 bp, homo sapien
tatcatcagcaagtcaaccatggtgkacctatactgcaacaccaggcaac

SEQ ID NO: 91750 - DNA, 50 bp, homo sapien
gcatgtttccttgtttctagcttagkcaaccagatttattcaatcaccca

SEQ ID NO: 91751 - DNA, 50 bp, homo sapien
gatggtttattttcactcattatcargtctttattgagtacccacactgt

SEQ ID NO: 91752 - DNA, 50 bp, homo sapien
cagaatcttagactttatgatgccaygaggcctacctcttcatgagagaa

SEQ ID NO: 91753 - DNA, 50 bp, homo sapien
ctccccaccttccatttcataacaaytcttcacatttcatcaggaacagt

SEQ ID NO: 91754 - DNA, 50 bp, homo sapien
aatattaaaataatgttctgaattarccaacaaatattaaagtggcagac

SEQ ID NO: 91755 - DNA, 50 bp, homo sapien
agtcactggatagtttggggagagayctaactggcttcagattgcatttg

SEQ ID NO: 91756 - DNA, 50 bp, homo sapien
tatcatttaggctttggatcaaatgyaatctgaagccagttaggtctctc

SEQ ID NO: 91757 - DNA, 50 bp, homo sapien
gtattgattactgtgtctttagagcragagttgaaatttagtaatgaaag

SEQ ID NO: 91758 - DNA, 50 bp, homo sapien
agaaggggcttattggtccaacttgraaggttgttggcctatctgaagaa

SEQ ID NO: 91759 - DNA, 50 bp, homo sapien
taactgatcttgctatcaattgaacrccctagtagtagttagaaagtaag

SEQ ID NO: 91760 - DNA, 50 bp, homo sapien
ccttccttgggctctgtggaaagaawtagtttactggccaatacacctat

SEQ ID NO: 91761 - DNA, 50 bp, homo sapien
catttagctcctgcttataagagcayagtatttcgtagcccaaaagcaaa

SEQ ID NO: 91762 - DNA, 50 bp, homo sapien
aaggaagcacattgtttttgcctaartcatgtttgctaacatctcactgg

SEQ ID NO: 91763 - DNA, 50 bp, homo sapien
ctctttttagcatcagaatagtcctkcaaagccagagtattgtgaacaca

SEQ ID NO: 91764 - DNA, 50 bp, homo sapien
gcaactcctcagtgataaagtctacrgaacataatcggggctagttgctg

SEQ ID NO: 91765 - DNA, 50 bp, homo sapien
agagaatatggataggatgattccaygtattgagtacaaaataggaattc

SEQ ID NO: 91766 - DNA, 50 bp, homo sapien
cttaccaaggtcagttttaaagatcracacttggaatcagaaaatggggc

SEQ ID NO: 91767 - DNA, 50 bp, homo sapien
ataattaaggaacactatgttaggcratgataacacaccgcctctgggtc

SEQ ID NO: 91768 - DNA, 50 bp, homo sapien
aaaagttctgtaccagctaatctctmaaatccccgttagccctaacactc

SEQ ID NO: 91769 - DNA, 50 bp, homo sapien
tatctatctccactaaaataacagcyattcatttgttgatctgtcttgct

SEQ ID NO: 91770 - DNA, 50 bp, homo sapien
tctccattcttgcatacagtgttcaragaaacataaaacaccatatgtat

SEQ ID NO: 91771 - DNA, 50 bp, homo sapien
gatcatgccatacccttctcctatgyatcatctcctgtttgtactaccct

SEQ ID NO: 91772 - DNA, 50 bp, homo sapien
gactcaacctaaggtgaggtgaaagyatgctggcaagatgggtccaggaa

SEQ ID NO: 91773 - DNA, 50 bp, homo sapien
aaagagggagcatatattagaccttyaagacctctttaagtcctctaaat

SEQ ID NO: 91774 - DNA, 50 bp, homo sapien
aatctgccctaccttttaccctgtargctctgcagacatctcccgtggcc

SEQ ID NO: 91775 - DNA, 50 bp, homo sapien
attcacaatacaactttaaccttccrtttctatgataagtgatctagcta

SEQ ID NO: 91776 - DNA, 50 bp, homo sapien
gtctcaattacaaaagcagttttcawgcaccgaatatgggtaaccaggga

SEQ ID NO: 91777 - DNA, 50 bp, homo sapien
gcaggcatcctgtataactactccasaccaatttaatgttaatttctcat

SEQ ID NO: 91778 - DNA, 50 bp, homo sapien
agccactatttctttaattattttawgccttctcccatcttttttctttc

SEQ ID NO: 91779 - DNA, 50 bp, homo sapien
tgaaagaaatcatagataacacaaaygaagagaaacacagcccatgctca

SEQ ID NO: 91780 - DNA, 50 bp, homo sapien
ttttcatatatttgtatgattttcaragttcctcttggtattaatttgtg

SEQ ID NO: 91781 - DNA, 50 bp, homo sapien
ttcaatgaaccataacagactttaarccagcgataatgcaacttgatatg

SEQ ID NO: 91782 - DNA, 50 bp, homo sapien
taagagatctgatacaatctttagaracttaaattcttcattaaactcag

SEQ ID NO: 91783 - DNA, 50 bp, homo sapien
cagtggcaaacagtactaggatctakgtcttttggttccaaatgcagtat

SEQ ID NO: 91784 - DNA, 50 bp, homo sapien
gtcaagttgaacatacacttaccagwatgacccagtaattctagatattt

SEQ ID NO: 91785 - DNA, 50 bp, homo sapien
ttacagctatcagcatacctataaaygtccacaaaagtttgtgtgacctc

SEQ ID NO: 91786 - DNA, 50 bp, homo sapien
aaatgcatttctcaaatcttagagartatttttgcatcataccttagagc

SEQ ID NO: 91787 - DNA, 50 bp, homo sapien
aggctcttcccaacccatgtgttgtyaacggctcctacatgtcatgcttg

SEQ ID NO: 91788 - DNA, 50 bp, homo sapien
aagtcacgtttttatcacacattaarcacttgcattaattttggagtctt

SEQ ID NO: 91789 - DNA, 50 bp, homo sapien
aatgtgaaccactgagaataacatgmagggtacctagtaagtgccactag

SEQ ID NO: 91790 - DNA, 50 bp, homo sapien
aattacatatattgtcctcttaccargtttattccacatgcctcaaaggc

SEQ ID NO: 91791 - DNA, 50 bp, homo sapien
aatttgctttactacttacagaaccragcacagaggactcagacaaaagg

SEQ ID NO: 91792 - DNA, 50 bp, homo sapien
tcaagcaagtagacagctagaggatygaaggccaacccactcatcctgcc

SEQ ID NO: 91793 - DNA, 50 bp, homo sapien
taaactcgagaagcttcccaaaaatkcatacaacatgaacaaaaaagaaa

SEQ ID NO: 91794 - DNA, 50 bp, homo sapien
tggtgagtaatacaaggctaggtaasaaatgagtgaggcaggtctgagtg

SEQ ID NO: 91795 - DNA, 50 bp, homo sapien
ataatgaaaatactagacaaaatcayataagctgagtatgttgatgagtg

SEQ ID NO: 91796 - DNA, 50 bp, homo sapien
cccaaatgacttttgcatttgggcckcaaagtaacaacaacaacaaaaaa

SEQ ID NO: 91797 - DNA, 50 bp, homo sapien
aagaactgtttgtttatattctccaygtttatattttcttgtagtttgtg

SEQ ID NO: 91798 - DNA, 50 bp, homo sapien
atgaagagttacgaatgtaagataamgtctgtttaatactacatctgtct

SEQ ID NO: 91799 - DNA, 50 bp, homo sapien
agttaaaattcccatttctctatccrtgtaccttaagcataggcacagag

SEQ ID NO: 91800 - DNA, 50 bp, homo sapien
atgaaaactaacagattaggatgccraggtagatggatctcttgagccca

SEQ ID NO: 91801 - DNA, 50 bp, homo sapien
tttttctgaagtgggtacatattagwaaaaagagctagtcagtacccagc

SEQ ID NO: 91802 - DNA, 50 bp, homo sapien
caaacgatatacaaagatattcagtyaaaagtcttgttcccatttttctc

SEQ ID NO: 91803 - DNA, 50 bp, homo sapien
tcctcctcagcctgtcaggtctgccratgacccaagcccagggtgatata

SEQ ID NO: 91804 - DNA, 50 bp, homo sapien
gtttttgtttttgtttttttgtggasagagtaccttgttggtattaataa

SEQ ID NO: 91805 - DNA, 50 bp, homo sapien
gtagatcaataccactctagtattayggcaagagatgcaatcttggtatt

SEQ ID NO: 91806 - DNA, 50 bp, homo sapien
tcaggaggcagagaaagcacagtgcmtttgagtaactgaaattgatttgc

SEQ ID NO: 91807 - DNA, 50 bp, homo sapien
ctggggagatcacctgggatcaacarcctgtagggtaagggcaggcagca

SEQ ID NO: 91808 - DNA, 50 bp, homo sapien
ccttcaggttttttttaattgaaagraagagctttttatcgagaaaaatc

SEQ ID NO: 91809 - DNA, 50 bp, homo sapien
gcttaataaatactcacactttcaawgtaaacgctcttcttttctatgtg

SEQ ID NO: 91810 - DNA, 50 bp, homo sapien
cgttagaagactcatacatttttcakcgtgtcagttgcatttttcaactc

SEQ ID NO: 91811 - DNA, 50 bp, homo sapien
ttaagcagagctgctccacaatgaaygtgtccttctgcttctgagaatca

SEQ ID NO: 91812 - DNA, 50 bp, homo sapien
gtgacccagcatccagactgcttccrttctgaggcttggccatctcaaca

SEQ ID NO: 91813 - DNA, 50 bp, homo sapien
aggaaggttccagaggtcactttaaycattatactttggagatattatga

SEQ ID NO: 91814 - DNA, 50 bp, homo sapien
tctaataaaatatagtgaaattgtawagagaatttgtaagctgctatggc

SEQ ID NO: 91815 - DNA, 50 bp, homo sapien
acttataaaaaccttgtacttgtagracttacaaaaaatatttctccttt

SEQ ID NO: 91816 - DNA, 50 bp, homo sapien
taagtcacattgcattttgaagatamtaagaattctttgctttgggccct

SEQ ID NO: 91817 - DNA, 50 bp, homo sapien
acagattggaggaacattctgtacasgatttgttttttaagaaatccatt

SEQ ID NO: 91818 - DNA, 50 bp, homo sapien
tccagagacaagatggacataattaycacaatgagcagcaacaatgaaat

SEQ ID NO: 91819 - DNA, 50 bp, homo sapien
aagtccaggaaaataactaacatcargagtggtccctggtcgtctagtgt

SEQ ID NO: 91820 - DNA, 50 bp, homo sapien
taatttttgtctatctatgattcaayctccacagtaaagtgtttgttcaa

SEQ ID NO: 91821 - DNA, 50 bp, homo sapien
atctctgagaaccccaaatctaacaygataggcttgtataattccatggc

SEQ ID NO: 91822 - DNA, 50 bp, homo sapien
aataattcgccctgtgacttttggcmggtcacatgtgctgtctgggtctt

SEQ ID NO: 91823 - DNA, 50 bp, homo sapien
taacctaggttctactcattaaacawatctcagcaaactatgtatgcttt

SEQ ID NO: 91824 - DNA, 50 bp, homo sapien
caaggccaatgtctacttggaatgayacttgtaaaacaagggttgaaaac

SEQ ID NO: 91825 - DNA, 50 bp, homo sapien
tccttcatctctctgcagattaatcyacttccatgctaccaccagtgagg

SEQ ID NO: 91826 - DNA, 50 bp, homo sapien
tgagtaggaccccaggtggagctcascgaatgttggattgctcctctcct

SEQ ID NO: 91827 - DNA, 50 bp, homo sapien
agaaggctcagctgagcagaaagagkttgggtcttagtgtcttactgacc

SEQ ID NO: 91828 - DNA, 50 bp, homo sapien
aataacctgtatttttctctcataaytctggagtccaaaaacctcatgtc

SEQ ID NO: 91829 - DNA, 50 bp, homo sapien
gatgtaattttgcttttctaaatacyctgtgttcacatctaaattctctg

SEQ ID NO: 91830 - DNA, 50 bp, homo sapien
tttgcagaaactgacttggaaagaaytgattacctgaaggaccgtgagga

SEQ ID NO: 91831 - DNA, 50 bp, homo sapien
actgcctcccctttcactgtcatgasgcaaatagatttctaaataggaaa

SEQ ID NO: 91832 - DNA, 50 bp, homo sapien
aagtgcattttctaccaagattgggycattaacaagccagaattcgtatt

SEQ ID NO: 91833 - DNA, 50 bp, homo sapien
ttgccagagtttatagccaatactaraataactgcaagcttttctcacac

SEQ ID NO: 91834 - DNA, 50 bp, homo sapien
ccccttccctatgccaagaaggagayagatttattctctgaagaaactgg

SEQ ID NO: 91835 - DNA, 50 bp, homo sapien
aacgcaaagataaattgtatcccaawtgttattctctttacactatttgt

SEQ ID NO: 91836 - DNA, 50 bp, homo sapien
agaaactttgtagtatatgttagaargaggagatgagaggtgggaataac

SEQ ID NO: 91837 - DNA, 50 bp, homo sapien
tttgcagctctgccaaatgatgctcraccccatagacttcgggcagagca

SEQ ID NO: 91838 - DNA, 50 bp, homo sapien
taataaaagcaataaggtactcacarataattcaattaaatcagtccata

SEQ ID NO: 91839 - DNA, 50 bp, homo sapien
ttctttgagctgtctgtcatgcacckagttgatggtcttctccttagttt

SEQ ID NO: 91840 - DNA, 50 bp, homo sapien
ccaaattgaacaacttgtccggaackactgagaaaatttctgaagcacag

SEQ ID NO: 91841 - DNA, 50 bp, homo sapien
aaggactcctatgagtctgtgctttsataggccactctagtggctgacaa

SEQ ID NO: 91842 - DNA, 50 bp, homo sapien
catgcgactaaaaatttgttcctacraggatcactattatttctcacgcc

SEQ ID NO: 91843 - DNA, 50 bp, homo sapien
gttttatagttttcattgtagagatmtttggttaattcctaggtatttta

SEQ ID NO: 91844 - DNA, 50 bp, homo sapien
aaaccatcttccataagttagaaccrcttgatttcaagtaacagaacccc

SEQ ID NO: 91845 - DNA, 50 bp, homo sapien
ttcagaatacctacaacttaaaggayattgcaggagaagcaatcagtttt

SEQ ID NO: 91846 - DNA, 50 bp, homo sapien
ttttactagttttctgagctggccawgattaccttaaaaaatattgccag

SEQ ID NO: 91847 - DNA, 50 bp, homo sapien
ataatcagatactcagctaacctcaraatagccataaatgctcttcctag

SEQ ID NO: 91848 - DNA, 50 bp, homo sapien
tcctacaaatattttgctgagctgargactaggatggctggtaaagacat

SEQ ID NO: 91849 - DNA, 50 bp, homo sapien
taatcataatcctctaaactcattaygtttaacatgcaagacaaagtaca

SEQ ID NO: 91850 - DNA, 50 bp, homo sapien
tgaatttgaagacagaccatgatgartagaagagagaccactgtttccag

SEQ ID NO: 91851 - DNA, 50 bp, homo sapien
aagattgtattaattaataaggtaaygtctttcttagtcactcttagtca

SEQ ID NO: 91852 - DNA, 50 bp, homo sapien
ggctcagccaagaaatggccacaacsgtgttttccatttggacaatctgt

SEQ ID NO: 91853 - DNA, 50 bp, homo sapien
caaaacctaatgaaacaaaatggcartattatccttgcttattgataatt

SEQ ID NO: 91854 - DNA, 50 bp, homo sapien
ggatatctgtccccacacaaatctcrcgttgaaatgtaagccccagtgtt

SEQ ID NO: 91855 - DNA, 50 bp, homo sapien
tgccttcgttcttgggttttgctcartgtagtcactttgtcttcccaaca

SEQ ID NO: 91856 - DNA, 50 bp, homo sapien
ggctcaatttaatctctcatcaatargccaatctcttgctctcatattct

SEQ ID NO: 91857 - DNA, 50 bp, homo sapien
gaatggatgctttaaggtatccatcragaaagactgccagatgaaacata

SEQ ID NO: 91858 - DNA, 50 bp, homo sapien
ggtgtttgaccaagcaattgtgcacygtaacccagggagattgatacata

SEQ ID NO: 91859 - DNA, 50 bp, homo sapien
caacaagtttggataaggagataaargtaccgactggatgattgctaata

SEQ ID NO: 91860 - DNA, 50 bp, homo sapien
aaccatgtataccttatgtgaaactsagtgtgtcatctgggtgcagaaga

SEQ ID NO: 91861 - DNA, 50 bp, homo sapien
acagagtttacatatttaatcaataygcagtgtgcttctcagtgatgtgt

SEQ ID NO: 91862 - DNA, 50 bp, homo sapien
ataaagacagatttatgctgagtacyatctacttttcttgtagctaaaga

SEQ ID NO: 91863 - DNA, 50 bp, homo sapien
aaccacctttatttaacttgttactkaattctcaatgtccaaattaaaaa

SEQ ID NO: 91864 - DNA, 50 bp, homo sapien
acctaaatatataaagcaaatattarcaagccataaaggtgagataaact

SEQ ID NO: 91865 - DNA, 50 bp, homo sapien
gacttcaaggtataacaagtatgtakgaccacctgctaagtaggtactaa

SEQ ID NO: 91866 - DNA, 50 bp, homo sapien
tgacttattttttacacaaactagamagtatttatggcattattggtgca

SEQ ID NO: 91867 - DNA, 50 bp, homo sapien
aatttgaacatgttagggaagatcckgctgagtaaacagcaagtgaaatt

SEQ ID NO: 91868 - DNA, 50 bp, homo sapien
acaccttcactcataggctgcagcayagaatctgtaatgagcttcatcta

SEQ ID NO: 91869 - DNA, 50 bp, homo sapien
aatatagctctctaggaagaaaggtyaatcttatcatgtgaaaaaccatt

SEQ ID NO: 91870 - DNA, 50 bp, homo sapien
tgcaacacgcagaagcagaataatayggagttggctgggtctgtctgagg

SEQ ID NO: 91871 - DNA, 50 bp, homo sapien
taaagagtgatctttttccctatgcmacaagaatcttttcaagtagttgt

SEQ ID NO: 91872 - DNA, 50 bp, homo sapien
tactgaactgaggtggtactctttakgccagcacaaccactccaggccag

SEQ ID NO: 91873 - DNA, 50 bp, homo sapien
tcttcctacttatctaccctataacsatagcacagacctaccctggtttc

SEQ ID NO: 91874 - DNA, 50 bp, homo sapien
tggttatagggtagataagtaggaaraatgataataaaagctttatcaac

SEQ ID NO: 91875 - DNA, 50 bp, homo sapien
ctacaggcaatttgacagtctcagakataaagcaacagaactatttcatc

SEQ ID NO: 91876 - DNA, 50 bp, homo sapien
atgcatatttgacaaatgtaaacaakgatgtcgaaataaggtgaaagtat

SEQ ID NO: 91877 - DNA, 50 bp, homo sapien
gctagtgaactacatttgagtcatgkacccatttttattatggtcagtac

SEQ ID NO: 91878 - DNA, 50 bp, homo sapien
agtatctggtgggtgatttgttctasggatccttgcagattccaaaatcc

SEQ ID NO: 91879 - DNA, 50 bp, homo sapien
gcctgaagaatgtttaagtttttccmgctgtatatagttgttaagtgtct

SEQ ID NO: 91880 - DNA, 50 bp, homo sapien
gaaccttgatattacataagcgggaraattttggcatcagacttcttcct

SEQ ID NO: 91881 - DNA, 50 bp, homo sapien
tttatatgtaggtagaaccttattgkaggtaatggtgaaagccagtgagc

SEQ ID NO: 91882 - DNA, 50 bp, homo sapien
actcccagaatgttgactttcttccratctatgttagcctttctcctgaa

SEQ ID NO: 91883 - DNA, 50 bp, homo sapien
tttcaggggatagagggatagaactsaaagagcctcctgaaagtcttagg

SEQ ID NO: 91884 - DNA, 50 bp, homo sapien
tgaagaagaagaaaagccacctgaaytacacagaaagaacactggtggta

SEQ ID NO: 91885 - DNA, 50 bp, homo sapien
tgagttttctgccaccctcagagtayggtttcatatcagatgtcattatt

SEQ ID NO: 91886 - DNA, 50 bp, homo sapien
tgatttgctgtatattcaaccttaasccattagcctttccacaaaaatta

SEQ ID NO: 91887 - DNA, 50 bp, homo sapien
agcattgttatgggggtgcaatggartcatctggtaagagcacccagact

SEQ ID NO: 91888 - DNA, 50 bp, homo sapien
tggcccacagtttcggtagtttctgmaagcaaataattcctacttgtggt

SEQ ID NO: 91889 - DNA, 50 bp, homo sapien
gtcatatgatccagttttagaggaaytctgcttgaggtaacttctggaaa

SEQ ID NO: 91890 - DNA, 50 bp, homo sapien
acagttgaatttaacagtcattgaayagcaactgagattgtgtttaacta

SEQ ID NO: 91891 - DNA, 50 bp, homo sapien
taaatgagtctcaagagcaattcaargattataaatggttacataactat

SEQ ID NO: 91892 - DNA, 50 bp, homo sapien
acacaaacatgaggaatggatggacrctatcttgatggctacatgcacca

SEQ ID NO: 91893 - DNA, 50 bp, homo sapien
agggtggggtttgatctcagggataytatatcatcagaaacaagcagatg

SEQ ID NO: 91894 - DNA, 50 bp, homo sapien
aatagaacttaaacattaaaagtaaygcaacggatatttaattatatggg

SEQ ID NO: 91895 - DNA, 50 bp, homo sapien
gagaaccagttgcatactcaaaaccrgaggaatgccctaaaatacagata

SEQ ID NO: 91896 - DNA, 50 bp, homo sapien
agggcttgatagaaattcaccttgargcagttagtcttctagacaggatc

SEQ ID NO: 91897 - DNA, 50 bp, homo sapien
tgtccatataataaactgttagaaawgaatatgtagagtgagtaaacaac

SEQ ID NO: 91898 - DNA, 50 bp, homo sapien
tggttgtcatgtttactgaatggtargagaaacaccctgtggattttaaa

SEQ ID NO: 91899 - DNA, 50 bp, homo sapien
aggtacttaacatccttgggacatayggaagcacccccttttatcaaaga

SEQ ID NO: 91900 - DNA, 50 bp, homo sapien
atttatttgaccaagtgtttggaccracattacaactgcagtagatacaa

SEQ ID NO: 91901 - DNA, 50 bp, homo sapien
cgattacaacaaaaatttgagatgcrgaataaattaaaagggaaaatatc

SEQ ID NO: 91902 - DNA, 50 bp, homo sapien
ttgaatgtgttcatttccctaacagratgtctctctcatgcagtcgtcag

SEQ ID NO: 91903 - DNA, 50 bp, homo sapien
taaaaatgttcttttttgtccatacrctcactgaaattgttattgcaatt

SEQ ID NO: 91904 - DNA, 50 bp, homo sapien
catttctccagtctcctaaaggtaaygccgcatgttctaggtttttgtta

SEQ ID NO: 91905 - DNA, 50 bp, homo sapien
cataaaatggtttcagagcattgtaygttgtcctctgttgtactagtttc

SEQ ID NO: 91906 - DNA, 50 bp, homo sapien
gctacctacccatcagctttggcacyaaggccagggagcctccaccagac

SEQ ID NO: 91907 - DNA, 50 bp, homo sapien
tctattacagtggattataaagaaamctcacctacattgtagtgatgatg

SEQ ID NO: 91908 - DNA, 50 bp, homo sapien
tcatgatgacaatgattatgctaaamttgtgcagtatggttactggtaga

SEQ ID NO: 91909 - DNA, 50 bp, homo sapien
aatcagcgcaaacgtaaatatcccamattaaacctacttgtcattgtgat

SEQ ID NO: 91910 - DNA, 50 bp, homo sapien
ataactatgtaagagagctggaatasactcagtggaacttaatcatatca

SEQ ID NO: 91911 - DNA, 50 bp, homo sapien
catcgtagttcactagtttccattayagaggtctttcacttccttagtta

SEQ ID NO: 91912 - DNA, 50 bp, homo sapien
tgaacacaggtgtctggcagtaaaakaattcaatatctgagatgtgagaa

SEQ ID NO: 91913 - DNA, 50 bp, homo sapien
ttaattatttctggggatcattactsaaacttaaagttccaactcacatt

SEQ ID NO: 91914 - DNA, 50 bp, homo sapien
atgcatggaaataggtaatgtacaarcgtggatatagaagtgtggtatgt

SEQ ID NO: 91915 - DNA, 50 bp, homo sapien
acttactcagtcttctctgtacttayatgaatttgattaagtatcttctt

SEQ ID NO: 91916 - DNA, 50 bp, homo sapien
gtttcataatttatggaagaataccrcagaactaaagtgatcttttcaat

SEQ ID NO: 91917 - DNA, 50 bp, homo sapien
gtacatttttctttaaccatacttaygttttcagttttctcaaattatct

SEQ ID NO: 91918 - DNA, 50 bp, homo sapien
gttgcttgagatgacaagacacctaraggagtgaagattatatgaattag

SEQ ID NO: 91919 - DNA, 50 bp, homo sapien
ggttttgaccaatcaaaggtaaccarctatccgaactgtgttcaaataag

SEQ ID NO: 91920 - DNA, 50 bp, homo sapien
tactttgaaacacagtgttactccaycaaaagctatttagaaggactaat

SEQ ID NO: 91921 - DNA, 50 bp, homo sapien
ttgataccctgggaaaaatgttctawagaggcagctgacttgccatgtga

SEQ ID NO: 91922 - DNA, 50 bp, homo sapien
ttttttcctctctggcatatgaaccrtttacttctaaaataaagctattt

SEQ ID NO: 91923 - DNA, 50 bp, homo sapien
gaagctggttagttgtgagcattaasatttttactagaacttcaaagcaa

SEQ ID NO: 91924 - DNA, 50 bp, homo sapien
atatgataggaacgtcttacacgtcrcagtagctactctaccataggata

SEQ ID NO: 91925 - DNA, 50 bp, homo sapien
tatatgtttctcttctaattggagcytcttaaattgaaggagtaaataat

SEQ ID NO: 91926 - DNA, 50 bp, homo sapien
ttaaataaaattcccaccaaaggcgrcataaggcactaggcagaagtagc

SEQ ID NO: 91927 - DNA, 50 bp, homo sapien
gttatgccaagaaaacagaaaattcwctggaaaaactattggtaacaata

SEQ ID NO: 91928 - DNA, 50 bp, homo sapien
aggggcatagagtggatatctggaayatttgtgttatactttcttgtgta

SEQ ID NO: 91929 - DNA, 50 bp, homo sapien
ttatggtgtatttgtttgaatgtggrtcaaaataaggtccatacactgca

SEQ ID NO: 91930 - DNA, 50 bp, homo sapien
taagagatactagtgtacgacaaagrctactccaataagtggcaacagga

SEQ ID NO: 91931 - DNA, 50 bp, homo sapien
tggatgcaacatgatatccaaggaastcagtgatatatacaaggggtatc

SEQ ID NO: 91932 - DNA, 50 bp, homo sapien
tatacttaattctgcatattcactasgaaaaattagaaacaagccaaatg

SEQ ID NO: 91933 - DNA, 50 bp, homo sapien
atttacaaatcagcatactttgcacygtagcatgacctagtagttcaatt

SEQ ID NO: 91934 - DNA, 50 bp, homo sapien
ggccatcccaagaaggactagtacamaaaagctcacaatgtgaaaactac

SEQ ID NO: 91935 - DNA, 50 bp, homo sapien
aataagccaggcttttactctactawccatgcaagttagagtcaatagtt

SEQ ID NO: 91936 - DNA, 50 bp, homo sapien
cataaaactgccagatgcaatttaakgtagagcctggactctgtaattcc

SEQ ID NO: 91937 - DNA, 50 bp, homo sapien
ttagctacacaatcaccacttcgtarctttccttgtatctcacatgtcca

SEQ ID NO: 91938 - DNA, 50 bp, homo sapien
ctatgagacattggttaaaaggataygttgagaattgccatagaaggcta

SEQ ID NO: 91939 - DNA, 50 bp, homo sapien
aaaagagagggaagagtaaaggaaamttcatcttgaaacttaggtaccag

SEQ ID NO: 91940 - DNA, 50 bp, homo sapien
atgtaattattaattttttgcaatayactttgaaagaaaaaattcataat

SEQ ID NO: 91941 - DNA, 50 bp, homo sapien
tctctctgattcctctttaagatcartaactcctagatttgtccttttga

SEQ ID NO: 91942 - DNA, 50 bp, homo sapien
ctttacctggaccattgcaacagtcyctgaactaggctccctgctcacct

SEQ ID NO: 91943 - DNA, 50 bp, homo sapien
acctctaaaataagcataagaacacsaacctccaagtttttcgtaaaaat

SEQ ID NO: 91944 - DNA, 50 bp, homo sapien
actttaaataaactattttcattcayatagtacctcaaacttggttatat

SEQ ID NO: 91945 - DNA, 50 bp, homo sapien
atgtgctggcccttgtaattcctgakgtacttttcctaattccaaatgtc

SEQ ID NO: 91946 - DNA, 50 bp, homo sapien
attaagtcataaacattttctaccaygctcccttacccacaatattataa

SEQ ID NO: 91947 - DNA, 50 bp, homo sapien
tcttgttttatcattttgtatttcayataccatggccatgtttttgggag

SEQ ID NO: 91948 - DNA, 50 bp, homo sapien
aatttattattatcatataaacaaaragaaacacatggaagagataatcc

SEQ ID NO: 91949 - DNA, 50 bp, homo sapien
ataccagcagctttctaaagctttcrcctgaataaaatagaaacagcaat

SEQ ID NO: 91950 - DNA, 50 bp, homo sapien
aaagcatgtggagtcatattgttaargtgtgtacagtgagagctattggt

SEQ ID NO: 91951 - DNA, 50 bp, homo sapien
atatccttatgtgttttctgtccccrgcaaggtacatactcaggatcaag

SEQ ID NO: 91952 - DNA, 50 bp, homo sapien
atgactcagcattgacatttacaccratcctagataagatgttcagaata

SEQ ID NO: 91953 - DNA, 50 bp, homo sapien
gatgtctatatttgacgctatctaaytctttttcattttcttctagaaat

SEQ ID NO: 91954 - DNA, 50 bp, homo sapien
gaggatttctaagaccttgggaaacscttgaaaccagtatctagaagtct

SEQ ID NO: 91955 - DNA, 50 bp, homo sapien
aaccatgtaagatatttttgatataygtttaaaagcatgatagccagatt

SEQ ID NO: 91956 - DNA, 50 bp, homo sapien
ttcttcttcttttttcaattaacaamtggtattgccaatagtatcacatt

SEQ ID NO: 91957 - DNA, 50 bp, homo sapien
tacatgggcactaacccagtggctgyacgttgtagttctactgagtcatc

SEQ ID NO: 91958 - DNA, 50 bp, homo sapien
accttcttcacagaagggtgaagaayatttaaggtgctcattcgtgcttg

SEQ ID NO: 91959 - DNA, 50 bp, homo sapien
gggcagcatattacaatggattgatrtgattattgggcctctttttatct

SEQ ID NO: 91960 - DNA, 50 bp, homo sapien
ggaagtcctagaaccaatctcctacraatactgtgggatgactgcactat

SEQ ID NO: 91961 - DNA, 50 bp, homo sapien
ggaatatgactctgggagacatgagraacatagaccaaacagcacttgta

SEQ ID NO: 91962 - DNA, 50 bp, homo sapien
ataaaactgtgattgctatggattaytcttcatcaaatattcatttcatt

SEQ ID NO: 91963 - DNA, 50 bp, homo sapien
gttctgagacttagtcctgcttaaartagtccatgtcctgaaaagaacct

SEQ ID NO: 91964 - DNA, 50 bp, homo sapien
gaaatcagattgaccataacctaccmaatatgttgatacctccatagaga

SEQ ID NO: 91965 - DNA, 50 bp, homo sapien
atagctaccaattagtaagcatttayatgtgtcaattacaaagccaaatg

SEQ ID NO: 91966 - DNA, 50 bp, homo sapien
actgttatatctcaggccaccacaayagggttccagttaataggagactt

SEQ ID NO: 91967 - DNA, 50 bp, homo sapien
ctgtacaaactaagttgtggattcaygtagctagcccatgctaaatatct

SEQ ID NO: 91968 - DNA, 50 bp, homo sapien
aaaaaaaagcaaacaaaacaccccaytagaccagaagcttttgtattatg

SEQ ID NO: 91969 - DNA, 50 bp, homo sapien
tcagacttctacccttcaaaactgakagaaataagcgtttgctgtttaag

SEQ ID NO: 91970 - DNA, 50 bp, homo sapien
aattagttcctcacttcagtattaaygggatgaccacaaggaaatatttt

SEQ ID NO: 91971 - DNA, 50 bp, homo sapien
aagtttctgtgagaatgtggggctcrattatgtcaattaaggtctttggc

SEQ ID NO: 91972 - DNA, 50 bp, homo sapien
tactcttaaggaagtcacattctaastggaaggagcggagagccaaaact

SEQ ID NO: 91973 - DNA, 50 bp, homo sapien
tcagactaatctgggcttgaatcatraaattgacacttactagctatgga

SEQ ID NO: 91974 - DNA, 50 bp, homo sapien
accacaggaaggaggtcagctcaagsaatagggatttaagtctgctgtga

SEQ ID NO: 91975 - DNA, 50 bp, homo sapien
gattaactgacatcaaagggcttgcmcaaaaatttacattgattgggtgc

SEQ ID NO: 91976 - DNA, 50 bp, homo sapien
tatgactttatgaattgttacctagrcacaatggattccccactatgatt

SEQ ID NO: 91977 - DNA, 50 bp, homo sapien
accctttagacttaattttgattcartagagagtgagattagtcagctga

SEQ ID NO: 91978 - DNA, 50 bp, homo sapien
cacacaatacatcctaatttgaccawatgattgaagacatctcaatctag

SEQ ID NO: 91979 - DNA, 50 bp, homo sapien
agcagtattatttatagcatatctcyaatggaattgaatcctgtcataga

SEQ ID NO: 91980 - DNA, 50 bp, homo sapien
ttcttcgcaagtcaaacgaagataasgtatttacaatttcatttttgctt

SEQ ID NO: 91981 - DNA, 50 bp, homo sapien
gggaactaaatgttagaatacaggcragtagagaaggtacagacattctt

SEQ ID NO: 91982 - DNA, 50 bp, homo sapien
tttccagctgtttgggcttttgctckcttaagttttgtttatctttcctc

SEQ ID NO: 91983 - DNA, 50 bp, homo sapien
aatcgcaaaatgagagctgttaaacraatcatctatttccagctgtttgg

SEQ ID NO: 91984 - DNA, 50 bp, homo sapien
tgagatccaagtgacagagcttctcracaagttagacttttatgtcctgc

SEQ ID NO: 91985 - DNA, 50 bp, homo sapien
tctggcagtggtgctgtagcaaggayatggcggtgacgttattaacagca

SEQ ID NO: 91986 - DNA, 50 bp, homo sapien
cctgcctaacgatgttgtgtgataartgaactagtcaatagataaataca

SEQ ID NO: 91987 - DNA, 50 bp, homo sapien
tttgcccatacaactacttaaagaayagtggagtcacatcatacatgtat

SEQ ID NO: 91988 - DNA, 50 bp, homo sapien
gaaatgcatcatatgtaaattactayatgaaactgaaactggaaagtgag

SEQ ID NO: 91989 - DNA, 50 bp, homo sapien
aaatttttaaaaatcacctttctcasgttgaatatactatttcagtttga

SEQ ID NO: 91990 - DNA, 50 bp, homo sapien
ggcagatcccagtctcactcctaccrctacaagagacacctggtgaatat

SEQ ID NO: 91991 - DNA, 50 bp, homo sapien
aattatacacctttgctgtttcaaaycatcgagatttaggggccaagtcc

SEQ ID NO: 91992 - DNA, 50 bp, homo sapien
gacctctgccaactgtaagacgcccrgatgtaaggagtgcccctcctctt

SEQ ID NO: 91993 - DNA, 50 bp, homo sapien
gaatgggaaatatgaataatactgargtacaatatctttaggaaaagcat

SEQ ID NO: 91994 - DNA, 50 bp, homo sapien
ctaaaagagggctgaacaaagcccarattaaactgcgtaaattccctgag

SEQ ID NO: 91995 - DNA, 50 bp, homo sapien
ttagaaatgacataaagcaataaaartgatgtcttaaacagttaaaataa

SEQ ID NO: 91996 - DNA, 50 bp, homo sapien
gatttgtttatgatcgttcatcacarggataaatagttgaggacagattg

SEQ ID NO: 91997 - DNA, 50 bp, homo sapien
aattataggataaagagataaatggyattgtacttttgtaagattacttg

SEQ ID NO: 91998 - DNA, 50 bp, homo sapien
cgagggtgacctgggatactcaactrcttcacatttcataattgaaaaga

SEQ ID NO: 91999 - DNA, 50 bp, homo sapien
tctggaactgtgggaaataaataccsagcataaggcattgtgttatagca

SEQ ID NO: 92000 - DNA, 50 bp, homo sapien
atatatttgggcctcagttttatggytgcagtatttaaacagtaacacca

SEQ ID NO: 92001 - DNA, 50 bp, homo sapien
gaccagatgtgttgtcagtgagtagyaatgttttgcaagagaccctaaca

SEQ ID NO: 92002 - DNA, 50 bp, homo sapien
agaaaaggactggcttagaagcgaaytcaataacgcagtagtatgcaata

SEQ ID NO: 92003 - DNA, 50 bp, homo sapien
tttctgctcttctactgtagtcaagkcagtgttgtccaggaaatcttgag

SEQ ID NO: 92004 - DNA, 50 bp, homo sapien
ctcggtcattccaatacatcactccrcttattcttttcttctcctgtggt

SEQ ID NO: 92005 - DNA, 50 bp, homo sapien
atggaaagccataggagagttttcawcagagtagtgaaatgatatgacct

SEQ ID NO: 92006 - DNA, 50 bp, homo sapien
aatgcatcatctactgaagagaagakcatcaagagacgggtaagtaagag

SEQ ID NO: 92007 - DNA, 50 bp, homo sapien
tctcattttctaagtcttcaatatayggaggttgcacctggtcatctctg

SEQ ID NO: 92008 - DNA, 50 bp, homo sapien
aaaaattccaaataattatttttcasaaagaacttgttaacatcctgtag

SEQ ID NO: 92009 - DNA, 50 bp, homo sapien
tgatggaaacatttttttagagggartatcctgcagggtcagtttttcag

SEQ ID NO: 92010 - DNA, 50 bp, homo sapien
tgagcctctagataccagtttcaaasaagtctttagatggagactggaaa

SEQ ID NO: 92011 - DNA, 50 bp, homo sapien
agttatacaaaaattatcttctctcrcaaaaataattagttagcaaatgt

SEQ ID NO: 92012 - DNA, 50 bp, homo sapien
tgcagatagaatgcagaaataaataygcaacaaacaagctttctatattt

SEQ ID NO: 92013 - DNA, 50 bp, homo sapien
tgataacttctttctctaacagaaakaaacttggttttcattatctataa

SEQ ID NO: 92014 - DNA, 50 bp, homo sapien
aaggacaggcaataaaaaatacttargagagtgtggagaaacaggaaccc

SEQ ID NO: 92015 - DNA, 50 bp, homo sapien
aattatcatttaaattaatacagatsaactatgaaaagacctcattgtga

SEQ ID NO: 92016 - DNA, 50 bp, homo sapien
atcatagttttattatacagacaaamaaatactttcagttcattaagctt

SEQ ID NO: 92017 - DNA, 50 bp, homo sapien
agtatttctaggttccagtatggaakgctaggacaacacctccctctcta

SEQ ID NO: 92018 - DNA, 50 bp, homo sapien
agaaggccaagtttaattcagttacratgtgggcagagctaatgaagtta

SEQ ID NO: 92019 - DNA, 50 bp, homo sapien
aatatctttgaacaaagaatttacarcaaagaatgatttagagtttaatg

SEQ ID NO: 92020 - DNA, 50 bp, homo sapien
aagcacacagattctctctccatacyatgtggcactgccaggagacgaag

SEQ ID NO: 92021 - DNA, 50 bp, homo sapien
ctgagtgctcacttttagtggtgccrgagaaagaaatgtggctggttgga

SEQ ID NO: 92022 - DNA, 50 bp, homo sapien
atatccagccctgaacaggagaaagrcactggctgcagctcagtctagaa

SEQ ID NO: 92023 - DNA, 50 bp, homo sapien
tgcatgcacccttacttgatatcaaygtaccagggactcggatctgtaac

SEQ ID NO: 92024 - DNA, 50 bp, homo sapien
aagaaaggtgtgaataaaacagaagrtatggaggtgaagacacacttgat

SEQ ID NO: 92025 - DNA, 50 bp, homo sapien
tttggagatggcaactctaagaaaamtaattcgcataaggtcataaacat

SEQ ID NO: 92026 - DNA, 50 bp, homo sapien
atacagtgtcttctatattatttcaragtttttccatcatagtttgtctc

SEQ ID NO: 92027 - DNA, 50 bp, homo sapien
atgaatgcatgcttctcatgaaagaytccaacaaggcaggaatattcagg

SEQ ID NO: 92028 - DNA, 50 bp, homo sapien
agagagggcagtgatgagaactgccrtaaccagaaaagattatgtttatg

SEQ ID NO: 92029 - DNA, 50 bp, homo sapien
tagtaccttgaagattttaagtaaakgaaggagtggatgagcaagtgata

SEQ ID NO: 92030 - DNA, 50 bp, homo sapien
tttcctatcacccatagtaatacatrggaaatcctggaggcctttcatag

SEQ ID NO: 92031 - DNA, 50 bp, homo sapien
agttttccattttgatgtgcaacccwattattaatgactatagcccttgg

SEQ ID NO: 92032 - DNA, 50 bp, homo sapien
gttttattaaaattactaaagataartctgcttctagtgaacatttcttc

SEQ ID NO: 92033 - DNA, 50 bp, homo sapien
tattcttaggagtcatagaataacartcagaaaaaataaagacataaatg

SEQ ID NO: 92034 - DNA, 50 bp, homo sapien
taagaagtatttaaaaaagagattgrcagtctaagcattcgtcagtgttt

SEQ ID NO: 92035 - DNA, 50 bp, homo sapien
acatatccatctcatctccacaattkttgctttaggaattcctcaatttt

SEQ ID NO: 92036 - DNA, 50 bp, homo sapien
ctatagcaaataattaccaaactaastggctgtcaataggaggctttatt

SEQ ID NO: 92037 - DNA, 50 bp, homo sapien
ctgatgagaagccctgaatgtttatyaggtagtttagatttgatcctaga

SEQ ID NO: 92038 - DNA, 50 bp, homo sapien
tggcaaatgaggtacttctcattaayatgcaatcatcaccaacattcatc

SEQ ID NO: 92039 - DNA, 50 bp, homo sapien
taaccattaaagtaagcattaaaaasctaaacaacatataaggcatataa

SEQ ID NO: 92040 - DNA, 50 bp, homo sapien
ttcactggcagcgtctccagaactcwaccccgtaacttagaacttgcttt

SEQ ID NO: 92041 - DNA, 50 bp, homo sapien
aatcccagttcttgaatttttctcayaataatgtgtcatttataattgag

SEQ ID NO: 92042 - DNA, 50 bp, homo sapien
agccttgtatcaattaaattctgtcsaaagagagaaccctgaggttatct

SEQ ID NO: 92043 - DNA, 50 bp, homo sapien
gagcattgtgtagaaagaatgtcaaygccaaagattcaatctgatttaga

SEQ ID NO: 92044 - DNA, 50 bp, homo sapien
attatgtctcttctgtgattaaaggycagaaaccaggttagatctatgct

SEQ ID NO: 92045 - DNA, 50 bp, homo sapien
agaaaggcagaagactgaagcgcacrtttgatctaattgtgtaagagctt

SEQ ID NO: 92046 - DNA, 50 bp, homo sapien
attttggcagttttgatgcaattgcrgatgagcctccagtttagggtggg

SEQ ID NO: 92047 - DNA, 50 bp, homo sapien
tctcttattcctttatgtaactcaakatgttatataagcttcaatcatct

SEQ ID NO: 92048 - DNA, 50 bp, homo sapien
aattgatactttaattattatccacyacaatcttatcattctaaactcct

SEQ ID NO: 92049 - DNA, 50 bp, homo sapien
ctttattaaaaattaaaagacctagkaggcatgaaatcaataagaatata

SEQ ID NO: 92050 - DNA, 50 bp, homo sapien
aaaaattaaaagcacggaatcaaaaygtactattagagagaagcacctaa

SEQ ID NO: 92051 - DNA, 50 bp, homo sapien
tcctgaggaagctcagctacagtgcragctaaaaacatactctgtgagat

SEQ ID NO: 92052 - DNA, 50 bp, homo sapien
taccagagaatacattcataagagamatttgggaggctgtgaatttcaag

SEQ ID NO: 92053 - DNA, 50 bp, homo sapien
aaataaattcccacctgcttaaaaasttccttccatttatgctataggca

SEQ ID NO: 92054 - DNA, 50 bp, homo sapien
tcctccatcttattccactttctaawatattgctgtaaggatttttctga

SEQ ID NO: 92055 - DNA, 50 bp, homo sapien
attaaacatggcaataagtattctcraaacagagcagaggaaagggctgt

SEQ ID NO: 92056 - DNA, 50 bp, homo sapien
tttaagggtaggagctgatccaaagkagatgagatcccctaaaatattca

SEQ ID NO: 92057 - DNA, 50 bp, homo sapien
tgatctgattaaaataacacagcaamtgatctttaagtttcagtttagtt

SEQ ID NO: 92058 - DNA, 50 bp, homo sapien
aaattggggggggggtggaattctcyaacattttctattttcctcctctt

SEQ ID NO: 92059 - DNA, 50 bp, homo sapien
ccatagccaggcttcaggacacttaygaaatttttgcaaacattatgcta

SEQ ID NO: 92060 - DNA, 50 bp, homo sapien
tagtggatacagatgtatatatccaygattttttttgaaaggtagtcatt

SEQ ID NO: 92061 - DNA, 50 bp, homo sapien
cttaaaagaactaaacttcctagcckcaatgttaggagaatcactggaat

SEQ ID NO: 92062 - DNA, 50 bp, homo sapien
gtttgcatgtttgttatatccatcaractgtgaccttaacagttccccct

SEQ ID NO: 92063 - DNA, 50 bp, homo sapien
tggatgatctagagtctggtctaacmaatggtaccaaggtttctggcttg

SEQ ID NO: 92064 - DNA, 50 bp, homo sapien
gtatttcgtatcacttcaaatgaaastgtcatctaccctgttcaagccag

SEQ ID NO: 92065 - DNA, 50 bp, homo sapien
ataagacttaaaaagatgcctcatcrcttctttctgtaactctataactc

SEQ ID NO: 92066 - DNA, 50 bp, homo sapien
ggttgctgtgttactctagcaatcamatgagttatagagttacagaaaga

SEQ ID NO: 92067 - DNA, 50 bp, homo sapien
ggtgtggctaggaagctgggagtgcygcgaatcagtgtagggaacggtgc

SEQ ID NO: 92068 - DNA, 50 bp, homo sapien
tgtgattgctagagtaacacagcaamctgagaggagcacacagggatgat

SEQ ID NO: 92069 - DNA, 50 bp, homo sapien
tttactaatggtctttgttcagttayatatttctcaaatttttctcgcct

SEQ ID NO: 92070 - DNA, 50 bp, homo sapien
gacccagggctttccatgtccttgargcttgtggaccctggctccatccc

SEQ ID NO: 92071 - DNA, 50 bp, homo sapien
aagtaagaaactcagaaatgacttaygtttgagaaagacaggaaaaagtg

SEQ ID NO: 92072 - DNA, 50 bp, homo sapien
gcaggtcacatgcaatacacagatgytctcctatttaatcacctgaatat

SEQ ID NO: 92073 - DNA, 50 bp, homo sapien
gccaccacagtgggccccaggagatyagaagattagaattcctcacaaac

SEQ ID NO: 92074 - DNA, 50 bp, homo sapien
atcccaaagtacaaaatgccaggttsatattcaaaataagttcaagattt

SEQ ID NO: 92075 - DNA, 50 bp, homo sapien
ctatgtaaatgaaattaaattttcaygtggctatcaaccttctcaaatca

SEQ ID NO: 92076 - DNA, 50 bp, homo sapien
agaaagtgatgctccctaattcatayagttgttgacatgccttggaatat

SEQ ID NO: 92077 - DNA, 50 bp, homo sapien
attcagttatgagttagggattcaayggcctagtgttataaaaatagtag

SEQ ID NO: 92078 - DNA, 50 bp, homo sapien
tcttttatagtatattacacacttcraaaacacaaaattattttttaacc

SEQ ID NO: 92079 - DNA, 50 bp, homo sapien
cagtgggtctttttcttaggccacaktcgttaggaatacagttaaggccc

SEQ ID NO: 92080 - DNA, 50 bp, homo sapien
atatatgtgacatgataactaagttwaactaatcagatcataggtgtttg

SEQ ID NO: 92081 - DNA, 50 bp, homo sapien
actctatcatcttgagagtacattayggaggtagttggagtctatttcct

SEQ ID NO: 92082 - DNA, 50 bp, homo sapien
taatattttactggtattataagcayggtataggaaagagaaatgtgatt

SEQ ID NO: 92083 - DNA, 50 bp, homo sapien
agaatgacaagcagttagtacacatsatacattgacaacgggatgatgtg

SEQ ID NO: 92084 - DNA, 50 bp, homo sapien
caaatttggcagaggacaatacttcyctattctaaatatgccagttcttc

SEQ ID NO: 92085 - DNA, 50 bp, homo sapien
ggtgatgctatatgccactccattcrcttatatggaacagccattcttaa

SEQ ID NO: 92086 - DNA, 50 bp, homo sapien
atgagtagagtaattttcaaatttgyaaaggtagagagataagtacaata

SEQ ID NO: 92087 - DNA, 50 bp, homo sapien
cagagatgcaaaaagagataattcastctatcacataatatttggacata

SEQ ID NO: 92088 - DNA, 50 bp, homo sapien
gggcacatatttttggctctggaaayaaagcttcaagccctaaaagtatg

SEQ ID NO: 92089 - DNA, 50 bp, homo sapien
aggattgtaaccataaaagaacagayggttatggcaggctattaggaatt

SEQ ID NO: 92090 - DNA, 50 bp, homo sapien
ggaggaaggtggaatgggatgtgacygctaatgagtatgggatttttttt

SEQ ID NO: 92091 - DNA, 50 bp, homo sapien
ttgttctgaggcatgctgtttaggamtagcctctaaggaagggtgtgagg

SEQ ID NO: 92092 - DNA, 50 bp, homo sapien
ctatttattttatctgttgctatgasagaggtattaaaatctccagttgt

SEQ ID NO: 92093 - DNA, 50 bp, homo sapien
gaagcttcacatatgttggcttgaamagaacctaggcacagaaaacactg

SEQ ID NO: 92094 - DNA, 50 bp, homo sapien
ccacatttagttggtctctgaggcawctgtagctgtcattctggatagac

SEQ ID NO: 92095 - DNA, 50 bp, homo sapien
aaatacattacctcattgatcttacraagaaaaacactggagagagagaa

SEQ ID NO: 92096 - DNA, 50 bp, homo sapien
ttccggaggctttagcaatggcatayattagtttaaatcattatcatctc

SEQ ID NO: 92097 - DNA, 50 bp, homo sapien
caccataaaacagggatgatttaccyaatgtctgaactctctcctagctt

SEQ ID NO: 92098 - DNA, 50 bp, homo sapien
agtaggtaattgataactatttgctragaatgagtgaatgaacaatacat

SEQ ID NO: 92099 - DNA, 50 bp, homo sapien
cttatctggactacttttaattggayactttgattctggttagacccatt

SEQ ID NO: 92100 - DNA, 50 bp, homo sapien
ctaaatgtggcagtggccagggtcaracaaaagtggtggggattctggtg

SEQ ID NO: 92101 - DNA, 50 bp, homo sapien
tttgaagatgcaaatatggcctaagraaatgcagttaaaatgtgagattt

SEQ ID NO: 92102 - DNA, 50 bp, homo sapien
ataagtgtgaggaagtggtgaccaaygagatgaagtaacctgttcaagga

SEQ ID NO: 92103 - DNA, 50 bp, homo sapien
agctggcttcacacactagccttccygaagaatgtttaaaccaagaattc

SEQ ID NO: 92104 - DNA, 50 bp, homo sapien
agcccctgagaaagaatgagcagaartaggagacctggggtgaatggagg

SEQ ID NO: 92105 - DNA, 50 bp, homo sapien
gtgtttatttggagcttctctattaycttctttattagtctagctagctc

SEQ ID NO: 92106 - DNA, 50 bp, homo sapien
ctgtttattagccttttataattccrcagaagtctggctaggcctgcaat

SEQ ID NO: 92107 - DNA, 50 bp, homo sapien
gtaactcaataaaaatttagctggamtacccaggacaacagcaaaagaaa

SEQ ID NO: 92108 - DNA, 50 bp, homo sapien
gtttatagcatacaacatatcataayacttcataattacaaagcaccttt

SEQ ID NO: 92109 - DNA, 50 bp, homo sapien
aaacttcggtaactctaacagttcasgagtattatagctcataaggctta

SEQ ID NO: 92110 - DNA, 50 bp, homo sapien
taaaatacaaacacaaagagtaccarcttcactttacccacaggatttca

SEQ ID NO: 92111 - DNA, 50 bp, homo sapien
aagaaaagaaaacaaatttccatacrtgtcaaacaaatgattaaattcaa

SEQ ID NO: 92112 - DNA, 50 bp, homo sapien
ttttctttttcttcaacaggtttggmaattacacattctagttctaatca

SEQ ID NO: 92113 - DNA, 50 bp, homo sapien
tggttgcactcaaatcaatcaactckatgatctaaacagagagagaaaga

SEQ ID NO: 92114 - DNA, 50 bp, homo sapien
tttacctctgtggtattctcccaaaytcataacctaagtctaaccctgag

SEQ ID NO: 92115 - DNA, 50 bp, homo sapien
ttgaaagatgggaaaatggtgcatascgattaagtgacctgtaagagcat

SEQ ID NO: 92116 - DNA, 50 bp, homo sapien
gtttgcttttgttttttaagcataayggatctcaacttgatgcagcaggt

SEQ ID NO: 92117 - DNA, 50 bp, homo sapien
cagttgtcattttgttttgctttgcyaattaaatgctccgcttgtctagc

SEQ ID NO: 92118 - DNA, 50 bp, homo sapien
ctcagcaaataaagatagcatcaacrctaaaagagataaaagcttaaatc

SEQ ID NO: 92119 - DNA, 50 bp, homo sapien
agagaatgaaccagaattacagctayctcaaaggagagaaaggagtctca

SEQ ID NO: 92120 - DNA, 50 bp, homo sapien
gactccacttcatatagccattaaasataacaattatgaaaactatgtac

SEQ ID NO: 92121 - DNA, 50 bp, homo sapien
tgatagatcctgggccatacactatkagttacgactcttggttgtgacta

SEQ ID NO: 92122 - DNA, 50 bp, homo sapien
agttttgtcagtaattacatggaacraaactatttttctccaaagtttga

SEQ ID NO: 92123 - DNA, 50 bp, homo sapien
gtggaaactgattttgaagcttgtamcagaaataggataaaataaaaata

SEQ ID NO: 92124 - DNA, 50 bp, homo sapien
gagctctgttggtcacagtagaaatkaaagtctcctcaagattttagtta

SEQ ID NO: 92125 - DNA, 50 bp, homo sapien
agaaaattgatgtgatgataaccacmgtggaagagtttatacgcccctga

SEQ ID NO: 92126 - DNA, 50 bp, homo sapien
cgtttccccttgtgaagcaatgcatratagagagataaccaatcacagat

SEQ ID NO: 92127 - DNA, 50 bp, homo sapien
aggctaatgagctttccagaagaaaygtaatacaatgatacatcactctc

SEQ ID NO: 92128 - DNA, 50 bp, homo sapien
tctcagggcttggtgctcagctttawcttcatctctagtctttctccaat

SEQ ID NO: 92129 - DNA, 50 bp, homo sapien
ctactgctgaaatgctaaaatactaygctctaaagtcatgaaataattct

SEQ ID NO: 92130 - DNA, 50 bp, homo sapien
ttagcagaattcagaagtcaaccttyaactgagaggcaggtgtaaagatg

SEQ ID NO: 92131 - DNA, 50 bp, homo sapien
ccttcaactgagaggcaggtgtaaaratgtataaagaactatgcataaga

SEQ ID NO: 92132 - DNA, 50 bp, homo sapien
gcatgactcaagaaaagttaagaacsactgatctaaagaataagactata

SEQ ID NO: 92133 - DNA, 50 bp, homo sapien
cccctcccctccattattcatcctakgctccaagcacttgaaatgcttca

SEQ ID NO: 92134 - DNA, 50 bp, homo sapien
tgtttctgtgttcttagcaaaacaayagccttaatattttagtgttgcta

SEQ ID NO: 92135 - DNA, 50 bp, homo sapien
tttaagagctctggcaagtcatcagragaatgttgcaggggctgagatct

SEQ ID NO: 92136 - DNA, 50 bp, homo sapien
gagtgtccactccacactggtgaagraacgctacaatagagtcagatcac

SEQ ID NO: 92137 - DNA, 50 bp, homo sapien
tatattctgctcaaagcactacacaygtcttatgcttggctttttattac

SEQ ID NO: 92138 - DNA, 50 bp, homo sapien
aatgaaatatacccaaatctttctgyctaacctgtattttgggtgttaca

SEQ ID NO: 92139 - DNA, 50 bp, homo sapien
gtatctcttatgtcttcctattccarcattctatggctattttggcaaag

SEQ ID NO: 92140 - DNA, 50 bp, homo sapien
caaaaagttcaaatacaatcagcctytctctttttatttctattttcttt

SEQ ID NO: 92141 - DNA, 50 bp, homo sapien
aaacaaaagcaaaaataactaaaaakatggcctactgctgaacaatcctt

SEQ ID NO: 92142 - DNA, 50 bp, homo sapien
ctgctgtggaataaactaggaagaaygtttgttaagcagcattgaggaac

SEQ ID NO: 92143 - DNA, 50 bp, homo sapien
agccaaaacaagccaaactgaataamgattttcctgagatttgtgattct

SEQ ID NO: 92144 - DNA, 50 bp, homo sapien
taacatgaacatgctcaaggacagcraaaatgagggataagatcagtaaa

SEQ ID NO: 92145 - DNA, 50 bp, homo sapien
tgcatagaattttgcaaagtacccarttcactacccatcttcatatgaag

SEQ ID NO: 92146 - DNA, 50 bp, homo sapien
tttactctttcacatcagtatgtcasaacacttccaaaattaaaaataaa

SEQ ID NO: 92147 - DNA, 50 bp, homo sapien
gggaaatgaagaataattgcttaacrgatgtgggggttccatttagggtg

SEQ ID NO: 92148 - DNA, 50 bp, homo sapien
taatgaggtaccagattgccataccrggaaagttccttctcttggtgcct

SEQ ID NO: 92149 - DNA, 50 bp, homo sapien
aaggcaacaggaatcgaagaacaacycaaggaaataaattgcctctgtca

SEQ ID NO: 92150 - DNA, 50 bp, homo sapien
atctaagcataacctatgtaagctgyagagtataacgggcactagagtca

SEQ ID NO: 92151 - DNA, 50 bp, homo sapien
atccctgcactacatacatcttcatrgagataaaagttgtggctcacaca

SEQ ID NO: 92152 - DNA, 50 bp, homo sapien
aacattattagctcatctgcttgackaaaatgaaacagtctgatggcagc

SEQ ID NO: 92153 - DNA, 50 bp, homo sapien
catccccaataacctttatatataaygaacatccatgactgactatgcct

SEQ ID NO: 92154 - DNA, 50 bp, homo sapien
taatactccattgtgtgactgttccrtaagttatgtattcatcttctgtg

SEQ ID NO: 92155 - DNA, 50 bp, homo sapien
ggtagataattctccaactttgagcmgatttttagaatagcattacaaaa

SEQ ID NO: 92156 - DNA, 50 bp, homo sapien
ttccagggcagcctccgttgttggcyattgactgataaggcaggacaaac

SEQ ID NO: 92157 - DNA, 50 bp, homo sapien
tataatgcaagaaaaaattctaaggsaaacttctatatgtatgttctgaa

SEQ ID NO: 92158 - DNA, 50 bp, homo sapien
agagtgaatcaggagagcacaatatwactacacacattagagacaagata

SEQ ID NO: 92159 - DNA, 50 bp, homo sapien
tctctcttcctaatctccactcttayataaaggacgacattgccctcaaa

SEQ ID NO: 92160 - DNA, 50 bp, homo sapien
ggcagtgagtattggacaagaccaartatggaaagtgtgggaaatcagct

SEQ ID NO: 92161 - DNA, 50 bp, homo sapien
ggtaaacaaactaaataaactaccarggaccaatactggagaaacagaga

SEQ ID NO: 92162 - DNA, 50 bp, homo sapien
tgatggaaaaatcatttggaggacawaacccttaataacttttaacaaga

SEQ ID NO: 92163 - DNA, 50 bp, homo sapien
ttgtatttgaacattagtcagtatawagttatgagttctaatgtctcttc

SEQ ID NO: 92164 - DNA, 50 bp, homo sapien
agaaaggatggccaataatcttatgwagaaaatgctgaatatcattagtc

SEQ ID NO: 92165 - DNA, 50 bp, homo sapien
ctcccagatttctaatttgggtgaawgacagtactatttacaaagaaaga

SEQ ID NO: 92166 - DNA, 50 bp, homo sapien
gtattaccttcatgttaaaaaaatayaatggtcaaatatgtttgggatat

SEQ ID NO: 92167 - DNA, 50 bp, homo sapien
caacattaattcagtgaagattataygtattttgtttgggacttcaccat

SEQ ID NO: 92168 - DNA, 50 bp, homo sapien
tttctgagactaaagtttgacatgaraaaagtgatatattagtacttttt

SEQ ID NO: 92169 - DNA, 50 bp, homo sapien
ctttggaatacccatgcagtgaatayaaactcattctcagaaaataaagg

SEQ ID NO: 92170 - DNA, 50 bp, homo sapien
tctttttccttcctccatgtaacaaytgccgatccttggttctggttgtc

SEQ ID NO: 92171 - DNA, 50 bp, homo sapien
ctaatctccacccccagaagcacccracgtctctcctactcgacctcaca

SEQ ID NO: 92172 - DNA, 50 bp, homo sapien
aattcattgagctgaacatttatcayttctacatttttatccattattgg

SEQ ID NO: 92173 - DNA, 50 bp, homo sapien
tctaatacatgataatggacaaccaygtgacaaagtactgtagtgtatgg

SEQ ID NO: 92174 - DNA, 50 bp, homo sapien
tatctgtacatacacgggtaaaaaawtgcaagagattgctctcagctgga

SEQ ID NO: 92175 - DNA, 50 bp, homo sapien
ggtatacatagcttattaaactaaamccatatttctattacagtcctttt

SEQ ID NO: 92176 - DNA, 50 bp, homo sapien
taataactaaataaatgaacgtacaygtccttcaagcctcaaggaatacc

SEQ ID NO: 92177 - DNA, 50 bp, homo sapien
agtattgaaccctatccaatttgttraaaacctacagttcttcatagtct

SEQ ID NO: 92178 - DNA, 50 bp, homo sapien
attggcaggaaaagccaaagtcttaragaaataaatgacattaaggcaaa

SEQ ID NO: 92179 - DNA, 50 bp, homo sapien
aaacaaatctttggtatgaccttggraagaaaaaacatatttcacatttg

SEQ ID NO: 92180 - DNA, 50 bp, homo sapien
gaatatcattttttctacttcagtayctttccaacagctggccccatggg

SEQ ID NO: 92181 - DNA, 50 bp, homo sapien
tattctgtgtcaaaagaggaacaacrgtatgtctattctaaatcagtccc

SEQ ID NO: 92182 - DNA, 50 bp, homo sapien
gtgtattgtagtttaaaacaaaaaaytatgctatacttgaaggccatttt

SEQ ID NO: 92183 - DNA, 50 bp, homo sapien
gtgtagaaataagtgaagctttgcgycaattgttaggtctaagcagaagt

SEQ ID NO: 92184 - DNA, 50 bp, homo sapien
aaattgttactaacttccatgaaggrcaatttgtagatgtatatacaaaa

SEQ ID NO: 92185 - DNA, 50 bp, homo sapien
ttgctggttgcaaaatgttgattgargtaaacaaaagtataaaatagaaa

SEQ ID NO: 92186 - DNA, 50 bp, homo sapien
aatatatgtgtataggtaatcaatayaaatgtctaatacacaaacaaatg

SEQ ID NO: 92187 - DNA, 50 bp, homo sapien
agtcagaaggctaatgtatgcacacragtctattaagctcttctctataa

SEQ ID NO: 92188 - DNA, 50 bp, homo sapien
atctagatttttaaaaattctgttayaatagcttgtctaatccagtgtct

SEQ ID NO: 92189 - DNA, 50 bp, homo sapien
accactgcttcccttcccagtgagawcccgatcaagctttatcatgcagc

SEQ ID NO: 92190 - DNA, 50 bp, homo sapien
attgtagcttctctttgccattgtcrctctttatctgtatctttatatct

SEQ ID NO: 92191 - DNA, 50 bp, homo sapien
tttttattagggagaaaatagcacamaaaaagtagggtacctcttaaaca

SEQ ID NO: 92192 - DNA, 50 bp, homo sapien
ttctattaaggtatgtttgacatacygtaacctgagcataaaaatctgaa

SEQ ID NO: 92193 - DNA, 50 bp, homo sapien
tatgttcccagagcatgcaactaacraagcacagttattaggcaagtttg

SEQ ID NO: 92194 - DNA, 50 bp, homo sapien
caaatctatagaaagtactacaccaygagtaatctctaatgtaaattatg

SEQ ID NO: 92195 - DNA, 50 bp, homo sapien
ggcgcaggcttcactgtacttaaacrgagtgccaaagctgacatcacctt

SEQ ID NO: 92196 - DNA, 50 bp, homo sapien
aggtcttgagggagtctaatactttsaggaagaaacaacaacaaagtgga

SEQ ID NO: 92197 - DNA, 50 bp, homo sapien
gacatttggttaaatattaccatcasaaaagtcccgttatggggaaaaac

SEQ ID NO: 92198 - DNA, 50 bp, homo sapien
tataaggtctgtggtctgggcaagcraattgattagaaaacaatgctaac

SEQ ID NO: 92199 - DNA, 50 bp, homo sapien
gacagcagatgtcaagacgatattamaataggctgagcctattctagttg

SEQ ID NO: 92200 - DNA, 50 bp, homo sapien
agtgcaatgatggcagtattgatacragaaagcctgaggttggggaaatt

SEQ ID NO: 92201 - DNA, 50 bp, homo sapien
aactaatggtacaactacaaatcctyaaatggtacactctcctgtgggac

SEQ ID NO: 92202 - DNA, 50 bp, homo sapien
aacctcttgtcttctttgaagatgcmacataataaaatagtccaataaca

SEQ ID NO: 92203 - DNA, 50 bp, homo sapien
gcattttgccactaaactagtgaacsagcccggtcttacaacatctaaaa

SEQ ID NO: 92204 - DNA, 50 bp, homo sapien
ggtgagtcttatccatcagttggagrcattaacagcaaaaattgagtttt

SEQ ID NO: 92205 - DNA, 50 bp, homo sapien
aggaatagaataaacaaaggtgaggwatcatagtttattagaaaaattaa

SEQ ID NO: 92206 - DNA, 50 bp, homo sapien
agtttggttttaagattatgggagaygatacctctggatgacctggatat

SEQ ID NO: 92207 - DNA, 50 bp, homo sapien
gaaccaggagacctgaggttaaataraagactgtggtgacatcaggtctg

SEQ ID NO: 92208 - DNA, 50 bp, homo sapien
ctacatacataatttataatcgccakaaaattctttaagttttcttttct

SEQ ID NO: 92209 - DNA, 50 bp, homo sapien
taaggcaaatgcctagttatagccartcaagtactacagtctctcctcat

SEQ ID NO: 92210 - DNA, 50 bp, homo sapien
agcactgagtaaaccaaccaagatgyaagttctaaggaaattcacattaa

SEQ ID NO: 92211 - DNA, 50 bp, homo sapien
ttttcacagcaccagttttactccartaatggtctcaaaacctcacaatt

SEQ ID NO: 92212 - DNA, 50 bp, homo sapien
agaagtgatcactcttccagataaamtgttaaatatgctttcttgaaaaa

SEQ ID NO: 92213 - DNA, 50 bp, homo sapien
ttaggggtcttttgcacagagaggayagttgaagctgtaaaaatgaatta

SEQ ID NO: 92214 - DNA, 50 bp, homo sapien
tagcataattttcctggttccatacygagtggttgagggggggcctcaat

SEQ ID NO: 92215 - DNA, 50 bp, homo sapien
atacaaaatcaataccaaaatacacrgtagaagtcaatctaataatctag

SEQ ID NO: 92216 - DNA, 50 bp, homo sapien
aaaatctgcattttaataagataccmatttgactcgtatgtacattaaaa

SEQ ID NO: 92217 - DNA, 50 bp, homo sapien
aacacttggatatttcatacacctcrtaaaaacttcagtggaatgaatgc

SEQ ID NO: 92218 - DNA, 50 bp, homo sapien
aagcaggttattcgaccattttaacrcatgatataaattaaattatagat

SEQ ID NO: 92219 - DNA, 50 bp, homo sapien
acagagattaaagcagttattgttayctccaatttatgtcttctgcacag

SEQ ID NO: 92220 - DNA, 50 bp, homo sapien
aaagggaaaatcactgaactgctaaragaaccaattattggcttttgaca

SEQ ID NO: 92221 - DNA, 50 bp, homo sapien
gaggggactcttgctactgaacactyagaaggtcccctggcattaaaaaa

SEQ ID NO: 92222 - DNA, 50 bp, homo sapien
atggatctgcacactgagttgattayctctttcataccatgaactctgtt

SEQ ID NO: 92223 - DNA, 50 bp, homo sapien
aaatcctaaaagctggcaagaatcaytagaatccttaggaatattagctc

SEQ ID NO: 92224 - DNA, 50 bp, homo sapien
atgtgctcatgcataggtaaatagayggatagtgataggaccaatcaaag

SEQ ID NO: 92225 - DNA, 50 bp, homo sapien
ggactctgttctaatgacttcaacasgcaaattcacccactgctggatta

SEQ ID NO: 92226 - DNA, 50 bp, homo sapien
agctgctaggattctctctttaaccmagaaatgctctgtttggcctccac

SEQ ID NO: 92227 - DNA, 50 bp, homo sapien
tttgaggggagtgccttggtcatagwaagttggaaaactgctaccttata

SEQ ID NO: 92228 - DNA, 50 bp, homo sapien
gtttttctacaatcttcttatattgwatgttgatgtctttctctaggttt

SEQ ID NO: 92229 - DNA, 50 bp, homo sapien
cagctgtggagagcctaggccaatasaaaagaaaacataacccaaagaac

SEQ ID NO: 92230 - DNA, 50 bp, homo sapien
ttcaggttggcagggagtaaaactasgacactaaacaataaatgtgttcc

SEQ ID NO: 92231 - DNA, 50 bp, homo sapien
gttaccaagtctctgccattttctaygttactattttgttcctggcgagg

SEQ ID NO: 92232 - DNA, 50 bp, homo sapien
ctaaacttttggctgtatttattgaygaagcattttccagggcagctaga

SEQ ID NO: 92233 - DNA, 50 bp, homo sapien
aaaaaagaccatctattgccaagcayaagtaaaataaggataaaaactaa

SEQ ID NO: 92234 - DNA, 50 bp, homo sapien
tttaaactaatgagaatttatttcaytatgctgtagaataaaatgtcaaa

SEQ ID NO: 92235 - DNA, 50 bp, homo sapien
tttcctcctttaagcagtaataaacrgtaagaatattcagtacttattct

SEQ ID NO: 92236 - DNA, 50 bp, homo sapien
taaacctagaataacactatgggacmaatacaaagtgccactggtgagga

SEQ ID NO: 92237 - DNA, 50 bp, homo sapien
gggtgtgtggacaagatgccgagacsaatgaaccctgatgtctctatgta

SEQ ID NO: 92238 - DNA, 50 bp, homo sapien
tttctacaaatgaccattctttaaarttgtgccaatgtgagaatttcacg

SEQ ID NO: 92239 - DNA, 50 bp, homo sapien
agatctctaggtaaaatgctagagcygaaaacttgccttctgaaatttta

SEQ ID NO: 92240 - DNA, 50 bp, homo sapien
ttgagatatgatttaaagcataggcycctaatggtgttgttttagactag

SEQ ID NO: 92241 - DNA, 50 bp, homo sapien
cctcgtcaccaaagcagtcaccctcrcttatataaatatttgttttatat

SEQ ID NO: 92242 - DNA, 50 bp, homo sapien
ctattttaaaaactcttggtcactayaaattagccacgttttaaataggt

SEQ ID NO: 92243 - DNA, 50 bp, homo sapien
tcttgtgtccttcagatatcctaaastcaattttactatcctactcatac

SEQ ID NO: 92244 - DNA, 50 bp, homo sapien
aagaaacagggttagtgaatgattarccaggctctagcacaagagacagg

SEQ ID NO: 92245 - DNA, 50 bp, homo sapien
cacattacctctaattctcatgaaawttaaccaaaaggatctaaacatta

SEQ ID NO: 92246 - DNA, 50 bp, homo sapien
aatattttagactttgtgggctgtaygttctccgtcccaactatttaaca

SEQ ID NO: 92247 - DNA, 50 bp, homo sapien
ctatagcttataactgaggaagaaayctaaaatgtggtgcctcaagcaga

SEQ ID NO: 92248 - DNA, 50 bp, homo sapien
tttagtctctcattatatcaaatacragtgactcaaatttagccaaaatt

SEQ ID NO: 92249 - DNA, 50 bp, homo sapien
atcattcagttctttcagttcatacracaaaataactctacaaggaaaaa

SEQ ID NO: 92250 - DNA, 50 bp, homo sapien
caccatagattgtaagatgcacaacygatttgataacagcttttcagaga

SEQ ID NO: 92251 - DNA, 50 bp, homo sapien
tgggaactccaaagatgaaatccatraaggtcagagcccaggccacaaag

SEQ ID NO: 92252 - DNA, 50 bp, homo sapien
gtgatgacaagatggaaacagtcctsaatacccaatatgatttaattccc

SEQ ID NO: 92253 - DNA, 50 bp, homo sapien
gcaggagagaaggaataatgggtaargagaatacaggagagggacaaatg

SEQ ID NO: 92254 - DNA, 50 bp, homo sapien
aattgacacataaaattgaccatcaygtggaggataaaaatgaaagaaag

SEQ ID NO: 92255 - DNA, 50 bp, homo sapien
ctgagaataaacatttcataacaagmagaataaattgtcctattattttt

SEQ ID NO: 92256 - DNA, 50 bp, homo sapien
tttaacaaacagagctccaaatccastaacttttacaccagatatggtcc

SEQ ID NO: 92257 - DNA, 50 bp, homo sapien
agcaaggttgctcaaatataaaatcrccttgcaaaaagttacagaaacac

SEQ ID NO: 92258 - DNA, 50 bp, homo sapien
ctttctcagtcagcccatagactacrattgaataggtatagcgctgactt

SEQ ID NO: 92259 - DNA, 50 bp, homo sapien
tatcttattctccatcacaagctcaragactagcatgctatctgacccat

SEQ ID NO: 92260 - DNA, 50 bp, homo sapien
aatataaaatgctgtggtaacagccrgaatgaaaactcagaatacttgat

SEQ ID NO: 92261 - DNA, 50 bp, homo sapien
ttgatgatggaggggagtaccagggmagattgtggagctaatggattgaa

SEQ ID NO: 92262 - DNA, 50 bp, homo sapien
caatgaccccaaagggatgcttgtcygaaatccttgttctcagcaaaggc

SEQ ID NO: 92263 - DNA, 50 bp, homo sapien
aggaaatacctcactccacattaaayactcttgacctttccaagacctgg

SEQ ID NO: 92264 - DNA, 50 bp, homo sapien
acatggatgtcatatagcagagaaayatatataactgaatatatgcttcc

SEQ ID NO: 92265 - DNA, 50 bp, homo sapien
ggaaattactaaataagagcctgaawgaatattttatggtcttgatcata

SEQ ID NO: 92266 - DNA, 50 bp, homo sapien
atctcatatatagttttagtatctgwatgaccttcctttttttttttttt

SEQ ID NO: 92267 - DNA, 50 bp, homo sapien
catcttcttctttcaatattctttgwaaccaaggtcagacctgctatgtc

SEQ ID NO: 92268 - DNA, 50 bp, homo sapien
aaatgaggtcgttttactgcaaagawtactctcctgattcctaattaata

SEQ ID NO: 92269 - DNA, 50 bp, homo sapien
taaagcagtcaagtaaaataatgtaygctgatgatgattattaacaatag

SEQ ID NO: 92270 - DNA, 50 bp, homo sapien
attcagcccatattttatcaagggcyatttctgtgtaagcactgtctcag

SEQ ID NO: 92271 - DNA, 50 bp, homo sapien
accaagaaggaaaggcttgtatccaytacatttggcagcaaagctgtatc

SEQ ID NO: 92272 - DNA, 50 bp, homo sapien
tgaccttcagcaggagagttaatgamtactcatgggtccaaacccttcca

SEQ ID NO: 92273 - DNA, 50 bp, homo sapien
agtcagaatcatggaatggtagataygactagctggaaattactctatgt

SEQ ID NO: 92274 - DNA, 50 bp, homo sapien
tgaaataacaccacagttacattcartgaatattttctccaagtctccct

SEQ ID NO: 92275 - DNA, 50 bp, homo sapien
attcagtttacagagcaatgagtaaygagctttactgtccttcctggaac

SEQ ID NO: 92276 - DNA, 50 bp, homo sapien
cgaggcaaagtaggaataattagcasaataggcagcaaatctagcatggc

SEQ ID NO: 92277 - DNA, 50 bp, homo sapien
ggaaataaatgtttcaaaagtgctargaatataaatatccagatatttaa

SEQ ID NO: 92278 - DNA, 50 bp, homo sapien
ttacgcaacttctgtcatgaattagycactgtattatgtacttttattat

SEQ ID NO: 92279 - DNA, 50 bp, homo sapien
gttttgtttcatgtagcataatcaartctattgctaattgtttagttaat

SEQ ID NO: 92280 - DNA, 50 bp, homo sapien
caattcaagccatcatcctattgcamcaaataatgacatattttcctaaa

SEQ ID NO: 92281 - DNA, 32 bp, homo sapien
gtaaagttagctaaggwcaaatattattattt

SEQ ID NO: 92282 - DNA, 50 bp, homo sapien
ttttttatctgtgaaatgtgagtaaractaatgtgaagacaaaaaaataa

SEQ ID NO: 92283 - DNA, 50 bp, homo sapien
acttaatgcagctggtggttttaaawtgaagctgatgttcatttactatc

SEQ ID NO: 92284 - DNA, 50 bp, homo sapien
ttcaccagaactatcacctttgtccyaattttatgaggctaacattagat

SEQ ID NO: 92285 - DNA, 50 bp, homo sapien
acaggctcctttagaggagtataaascttggccatgtcctttgagtttta

SEQ ID NO: 92286 - DNA, 50 bp, homo sapien
agttcttgttttgaatagctgattaygattggaactgatgaatggcaatg

SEQ ID NO: 92287 - DNA, 50 bp, homo sapien
tatacgggtaaaactactggagtgawcattcaacatagccattaatcatt

SEQ ID NO: 92288 - DNA, 50 bp, homo sapien
agtacctttcagagcaagtttcaacrgtaaggagcaggtagatttttcat

SEQ ID NO: 92289 - DNA, 50 bp, homo sapien
cactagatgctcaaattcaaattgarccaacttttacgcacatgtaccct

SEQ ID NO: 92290 - DNA, 50 bp, homo sapien
ttcagtgtttaaataacaaaattgaratagataatcattagaatatatac

SEQ ID NO: 92291 - DNA, 50 bp, homo sapien
tatttggagaattgaagattcataargttttcttcttgttctccctttct

SEQ ID NO: 92292 - DNA, 50 bp, homo sapien
catttttgaaattttgaaaggtcaamtgaggagactttgacaatctgggg

SEQ ID NO: 92293 - DNA, 50 bp, homo sapien
gtactcgtgttttttttcttggatamgcttgtattttattgaatcatatt

SEQ ID NO: 92294 - DNA, 50 bp, homo sapien
ccaagttcatgggcagtctaaacaamagctaaatctcaatgcacagggca

SEQ ID NO: 92295 - DNA, 50 bp, homo sapien
gccagtctgccggatgcctgggagayaattaggcgcctttatgttattca

SEQ ID NO: 92296 - DNA, 50 bp, homo sapien
atagtgttgtctgttaaatataatamaactcattagggcagtccttcatt

SEQ ID NO: 92297 - DNA, 50 bp, homo sapien
gacatgtggaggttctaccacattargcagtcaagataatttattaataa

SEQ ID NO: 92298 - DNA, 50 bp, homo sapien
gaaaagaattttaaaagtaatctaaytcacaatagccacacataatatta

SEQ ID NO: 92299 - DNA, 50 bp, homo sapien
ttatttcatacctccttcaacaaaasgcaaatacctacattgtcatctag

SEQ ID NO: 92300 - DNA, 50 bp, homo sapien
ttatccttggctacaaagatcaatartaaggatgacgccaatttgaggtt

SEQ ID NO: 92301 - DNA, 50 bp, homo sapien
cagatgtgagagagtgacagaaaaaygccaggacccaagagactgtagaa

SEQ ID NO: 92302 - DNA, 50 bp, homo sapien
acatttcatctgtggtaaggatttcrcataaatcaaatgaaacttctaaa

SEQ ID NO: 92303 - DNA, 50 bp, homo sapien
gaactgtaatgattctctttattcartaactagggaaatttaatgtgatg

SEQ ID NO: 92304 - DNA, 50 bp, homo sapien
gagaagagatctgcactagcaaccaytgcattgtattttaagcaaattct

SEQ ID NO: 92305 - DNA, 50 bp, homo sapien
ccaaagggaaataatatatacaaacscaatgatgtatttatctgttcaga

SEQ ID NO: 92306 - DNA, 50 bp, homo sapien
aactgaacattaaaaactgaacaaakgattgtttctccaaatcagctctt

SEQ ID NO: 92307 - DNA, 50 bp, homo sapien
tttctcataattataaactacctaartgcaggactgatatctgttctggc

SEQ ID NO: 92308 - DNA, 50 bp, homo sapien
  misc_feature (1)..(3): n is a, c, g, or t
nnngaattctatagcatttgtgcaaytgaattagtttttttaaatggctt

SEQ ID NO: 92309 - DNA, 50 bp, homo sapien
ttcttcatatgtctaatttaacaacmagtagacaaggcatggtcctaatt

SEQ ID NO: 92310 - DNA, 50 bp, homo sapien
tacaatttatttgatcttattagaaraaaatgagctataaaataaagatt

SEQ ID NO: 92311 - DNA, 50 bp, homo sapien
ctagctacctagcagacctttctaaycagtagtatagagatcagtatgca

SEQ ID NO: 92312 - DNA, 50 bp, homo sapien
gagtagaaatttatttctcacagtckgaaactctaagatctcatagtctg

SEQ ID NO: 92313 - DNA, 50 bp, homo sapien
ttctatcaatagttaatatataggtkacatctctaaacgaagtggaagca

SEQ ID NO: 92314 - DNA, 50 bp, homo sapien
ccacactacacacataacccgcttgwatctgcactaccacctccttgaac

SEQ ID NO: 92315 - DNA, 50 bp, homo sapien
gttcacaggagaaagaaataaagacraacaggacataattgtcatcgtcc

SEQ ID NO: 92316 - DNA, 50 bp, homo sapien
tgttaaaaagttcaatcaatgtcacrgatatattcttatatttatctttc

SEQ ID NO: 92317 - DNA, 50 bp, homo sapien
atctgattctgtacctgaagtgaaakattaatgtcccagactgggtgaag

SEQ ID NO: 92318 - DNA, 50 bp, homo sapien
aataaagaaaattcaccattttattsaagcaactggttaatttgaaattg

SEQ ID NO: 92319 - DNA, 50 bp, homo sapien
tgtggtttacactgaaatggatttaygttgctgcggattaactggagttt

SEQ ID NO: 92320 - DNA, 50 bp, homo sapien
gactacattcctgaggaaaacatggraagacgttcttgtgttccaatatt

SEQ ID NO: 92321 - DNA, 50 bp, homo sapien
tacagaactctctacaccaaatcaayggaatgtacattcttctcagcacc

SEQ ID NO: 92322 - DNA, 50 bp, homo sapien
gccctgtatattgaatttacctgatwagaatccatcagcatattcatgtc

SEQ ID NO: 92323 - DNA, 50 bp, homo sapien
aatagacaaggagtagaattgtaggraagaaattatgaagtatgaaggag

SEQ ID NO: 92324 - DNA, 50 bp, homo sapien
aatggatattcagtggcaaccatcayaaagtttgtttttgacagattttt

SEQ ID NO: 92325 - DNA, 50 bp, homo sapien
gcttattgacttcaaagtttacttayaagatgcaggaaatcagtatgcct

SEQ ID NO: 92326 - DNA, 50 bp, homo sapien
agaggcttcagctaaaagtgataacratacgaacagcagtaatttaggat

SEQ ID NO: 92327 - DNA, 50 bp, homo sapien
ttataacatatttgcatagctcaaaygtactcaggcacacacattcattg

SEQ ID NO: 92328 - DNA, 50 bp, homo sapien
gctgagctgaatcaaataaacatgasgaaccttatgccgatagactgggt

SEQ ID NO: 92329 - DNA, 50 bp, homo sapien
cagttggggtgctctaccctcctgamgcattgtgtattcactaaccagga

SEQ ID NO: 92330 - DNA, 50 bp, homo sapien
tagataaaatatttaacaagtattaractggaagtgatcatgtgaaatca

SEQ ID NO: 92331 - DNA, 50 bp, homo sapien
tatgagccaattgtatctacacaacyctgataggtgttctcactcctttt

SEQ ID NO: 92332 - DNA, 50 bp, homo sapien
tagtgtgaattttgtcatctgtttcragtagcttggttcacatgccaata

SEQ ID NO: 92333 - DNA, 50 bp, homo sapien
aatttctttaacttttcctcaaacakttcctgctaatgcagaaacatctt

SEQ ID NO: 92334 - DNA, 50 bp, homo sapien
gttgttgtttatgtgggtatacttaygttaaatatagacccatggatgga

SEQ ID NO: 92335 - DNA, 50 bp, homo sapien
cttgtatatctcctcatttattatasgatttttttgttatggaaagtcat

SEQ ID NO: 92336 - DNA, 50 bp, homo sapien
gttaaactgatacgtgacaccttatraaagtaatgtgaaaaggattttct

SEQ ID NO: 92337 - DNA, 50 bp, homo sapien
taattcccagccccagactggtttckcagtgaaatcgtcagcataaatta

SEQ ID NO: 92338 - DNA, 50 bp, homo sapien
attacataagtgctcaaaacctaaawttctttgctaatgacctaaaaata

SEQ ID NO: 92339 - DNA, 50 bp, homo sapien
tcagagttaacttcaatcctgcataygttattagacaaagcacaagagga

SEQ ID NO: 92340 - DNA, 50 bp, homo sapien
tattatcaatgttttgtctggtaaasatgatattataaaatctaaacgtg

SEQ ID NO: 92341 - DNA, 50 bp, homo sapien
aatatcttcaaagatgcccataaaaytaacaacagagctcaactttggga

SEQ ID NO: 92342 - DNA, 50 bp, homo sapien
ttacctgggtgtgtatgtttcaaacyatgtgcattttgtactgtgcttcc

SEQ ID NO: 92343 - DNA, 50 bp, homo sapien
ttaaaattctgaatagccagatgtayatttactaaaaacaaaacaaagct

SEQ ID NO: 92344 - DNA, 50 bp, homo sapien
tctcctctctcagtgtcacatgaccrtcccagttttctccctttttctct

SEQ ID NO: 92345 - DNA, 50 bp, homo sapien
taagccaaataggtgaaagtttcaaraagaagcttgtgaaaataagtttc

SEQ ID NO: 92346 - DNA, 50 bp, homo sapien
gctgacttctccctgtgtcttcatayaacagaaagagagagagagagaga

SEQ ID NO: 92347 - DNA, 50 bp, homo sapien
tggtctagaggaaatagcccaactcrattagtgaattctaccatatctat

SEQ ID NO: 92348 - DNA, 50 bp, homo sapien
atcaataaacacaggttatttcttasagcagggcattgtctctttcatac

SEQ ID NO: 92349 - DNA, 50 bp, homo sapien
tatcctttttcattccctgaagagcractgtaggtttctgagctgagcta

SEQ ID NO: 92350 - DNA, 50 bp, homo sapien
gagttatgtaagtttaacattacgcrataactgttagaaatccactaata

SEQ ID NO: 92351 - DNA, 50 bp, homo sapien
ttttgtctctttgaaagcttttacartaatttctctattctgtgtgttct

SEQ ID NO: 92352 - DNA, 50 bp, homo sapien
aggttagatttcaaatcagtataaaragtggttttcaaattatatttcat

SEQ ID NO: 92353 - DNA, 50 bp, homo sapien
attgataacttctggctggtaccaastcgttcaagtagaaacataaataa

SEQ ID NO: 92354 - DNA, 50 bp, homo sapien
acacacacacacacacacatgaatawacacagttggctttatatatccta

SEQ ID NO: 92355 - DNA, 50 bp, homo sapien
gctgttgttgttagtttatatgtcargtatgaaagctctaagtgccaatg

SEQ ID NO: 92356 - DNA, 50 bp, homo sapien
acagaaattttttgactgcttgcttyaactattaatagtgaataagcaca

SEQ ID NO: 92357 - DNA, 50 bp, homo sapien
agtagatgccgtacattaatcaatcyaatcaggtctcacaacagctctcc

SEQ ID NO: 92358 - DNA, 50 bp, homo sapien
tacaataacaccaggtataaagagartccgaaactattcattttgtttat

SEQ ID NO: 92359 - DNA, 50 bp, homo sapien
tgttaatgggagacagggataaggtraaataaagctcaagtaattaaact

SEQ ID NO: 92360 - DNA, 50 bp, homo sapien
ctggaaggactacactattgaaggtkctgtcattgttgtagaaaaaagtc

SEQ ID NO: 92361 - DNA, 50 bp, homo sapien
gtcaacttgattagattgaaggaagsaaaatattgttcctgggtgtgtct

SEQ ID NO: 92362 - DNA, 50 bp, homo sapien
tagattaatgtaggatatgacacagmaatggtaagcttgctagtttattt

SEQ ID NO: 92363 - DNA, 50 bp, homo sapien
tccagttgagtgtgatgatgttccastaaggatgggtgcagccactaacg

SEQ ID NO: 92364 - DNA, 50 bp, homo sapien
atttatgtacagccagtttattcacrtgtaatctcgtaattataacactt

SEQ ID NO: 92365 - DNA, 50 bp, homo sapien
cagtattttccactatttgtcagaarctaaaggattaaataactgtcaat

SEQ ID NO: 92366 - DNA, 50 bp, homo sapien
gctacgttgaaagaggcatctccaastacacagaaatgagggtaaaacat

SEQ ID NO: 92367 - DNA, 50 bp, homo sapien
tgatattgaaggctgaaaagatagasacctatgttacacaatggcaaaat

SEQ ID NO: 92368 - DNA, 50 bp, homo sapien
atctaagaaatctatgcatgtgtatyaagttaaaatagtgggtttaaata

SEQ ID NO: 92369 - DNA, 50 bp, homo sapien
agcaaaaaaaaaattgctgttgtaaytcaaaggtaatattatcattcctg

SEQ ID NO: 92370 - DNA, 50 bp, homo sapien
gccatttatgactactgcctagattrcttatgttttaggggtgcataatg

SEQ ID NO: 92371 - DNA, 50 bp, homo sapien
ttaaacttctggggaagtagcagcaracctaatgctctcttcttccacta

SEQ ID NO: 92372 - DNA, 50 bp, homo sapien
taataagtcctcattgcctcactcawcttatttgtacctcaaggtttaag

SEQ ID NO: 92373 - DNA, 50 bp, homo sapien
gtattaacttaggttatcaatttctsactatcaaaaatttgttatttaga

SEQ ID NO: 92374 - DNA, 50 bp, homo sapien
tgagacactgatgaccttaatctaaytagtacttgagccgggtcagtgct

SEQ ID NO: 92375 - DNA, 50 bp, homo sapien
aattcacctagaacttacatctgctyaaacccgctggtggaaatgctgct

SEQ ID NO: 92376 - DNA, 50 bp, homo sapien
aaagaataagaggttctgcacgaaarcatagaagactttagagagcaaga

SEQ ID NO: 92377 - DNA, 50 bp, homo sapien
taatcagtaaaacaatttgctgggartaaaagatcggtgaaaaacaaaca

SEQ ID NO: 92378 - DNA, 50 bp, homo sapien
aaccaagacacctacttggtaaagaygtctactaagaaggtaaagaaatg

SEQ ID NO: 92379 - DNA, 50 bp, homo sapien
aaatggtgcctttttctgattgtgawttttgagacctggttagtgttctt

SEQ ID NO: 92380 - DNA, 50 bp, homo sapien
caaattcttgttgtttctctatttaracctgctgaactgatggttttctc

SEQ ID NO: 92381 - DNA, 50 bp, homo sapien
tcaactatcaaacttagaacaagaasactaaccaggtctcaaaattcaca

SEQ ID NO: 92382 - DNA, 50 bp, homo sapien
aataattaataagattatcattaacrgagacactctatatctgttcctta

SEQ ID NO: 92383 - DNA, 50 bp, homo sapien
caatccagacacccagttctcattcrctctttaaataacagattatttca

SEQ ID NO: 92384 - DNA, 50 bp, homo sapien
atacttttatgtaacaatcaggtgtraattctgaaacagatgttcccaac

SEQ ID NO: 92385 - DNA, 50 bp, homo sapien
ttagaataaaaagagaataagacccrggaaaaatcgatgttgatgacctt

SEQ ID NO: 92386 - DNA, 50 bp, homo sapien
taagcaatgtttccccattttcagawtatagaagaatcataactgctttt

SEQ ID NO: 92387 - DNA, 50 bp, homo sapien
ttgatttcagtaatctctgatgggcyagaatactcagattaaaaaaatag

SEQ ID NO: 92388 - DNA, 50 bp, homo sapien
taaaactaactgcctccttgccacaytcctaataaggttctacatcttgc

SEQ ID NO: 92389 - DNA, 50 bp, homo sapien
ttgtgttgttaactataggaacaaarttatacaaatctctagaacttaac

SEQ ID NO: 92390 - DNA, 50 bp, homo sapien
tccccaaaattcttatgttgaaatasaaaacaccagtgtgactgtattac

SEQ ID NO: 92391 - DNA, 50 bp, homo sapien
agcccagagaggcttttcccttgccrcagaaataggtatctgtcttgtgt

SEQ ID NO: 92392 - DNA, 50 bp, homo sapien
atacaaagctaagctatttcaattcrctttccctctgtttatcactttat

SEQ ID NO: 92393 - DNA, 50 bp, homo sapien
ccagattttctattgcaaattcagartctataattatttgacctaaaact

SEQ ID NO: 92394 - DNA, 50 bp, homo sapien
aggagtccaccgcaatgctgtaaatmggagtcattaatctttatctgaaa

SEQ ID NO: 92395 - DNA, 50 bp, homo sapien
ttccagctacctccactcaataatartaatggttaatgtgttccattcgc

SEQ ID NO: 92396 - DNA, 50 bp, homo sapien
cagaataaaataattttccagatgarcaatcaatattttattttagacca

SEQ ID NO: 92397 - DNA, 50 bp, homo sapien
tacaatatttctagtgtctaaacaayggttggttctcaataggtagtcta

SEQ ID NO: 92398 - DNA, 50 bp, homo sapien
tctaaagataggtcaaagtagccgayattagatttctctttgatttttga

SEQ ID NO: 92399 - DNA, 50 bp, homo sapien
cttttcaaaaaactgactttagacaygtaactgtacgtacctataggtgt

SEQ ID NO: 92400 - DNA, 50 bp, homo sapien
aatattagactgtagtgaacactaargatataaataaacataaataagag

SEQ ID NO: 92401 - DNA, 50 bp, homo sapien
taatacaaaaaattggaaagacattycatgaacaaggattggaagaatca

SEQ ID NO: 92402 - DNA, 50 bp, homo sapien
ggtcaaaatcttaaatttgattaagkacatggatataaatatccaagaag

SEQ ID NO: 92403 - DNA, 50 bp, homo sapien
aaatataaaaagataaaaagaaaaastgtcataaatatatgatatatcat

SEQ ID NO: 92404 - DNA, 50 bp, homo sapien
cttgaataaagttataatcattaaartacatggttaataacaactatatt

SEQ ID NO: 92405 - DNA, 50 bp, homo sapien
atttatttgcatcaactataagaccyggagaaagatggtatttgaacaca

SEQ ID NO: 92406 - DNA, 50 bp, homo sapien
gctccttgaaacaaattacttcacasataatgaggtactaaagcattttt

SEQ ID NO: 92407 - DNA, 50 bp, homo sapien
gaaatgtattagaataaagccaagastatattcattatgtatatattata

SEQ ID NO: 92408 - DNA, 50 bp, homo sapien
taacagccctctgatgaattctacasgtctagttttgtgctctgggctct

SEQ ID NO: 92409 - DNA, 50 bp, homo sapien
aaaataaacatgatattaaacatcaraaaaacaaagtacaaatataaaac

SEQ ID NO: 92410 - DNA, 50 bp, homo sapien
acagaaaactgttttactatgaaaamagatcagcggggcatcttatgcac

SEQ ID NO: 92411 - DNA, 50 bp, homo sapien
cgatgttagtctgtatctttatctakgtacaaacaagcactaaatgaata

SEQ ID NO: 92412 - DNA, 50 bp, homo sapien
caatggccagagccaataattggacyctgtgatttggtttcttgatattt

SEQ ID NO: 92413 - DNA, 50 bp, homo sapien
gttctatccattatagcacagacgtyaaaacattttcacctattctttaa

SEQ ID NO: 92414 - DNA, 50 bp, homo sapien
ataaaagcaatgggagttgatgtaaragaagctagtacataaggcaatgt

SEQ ID NO: 92415 - DNA, 50 bp, homo sapien
ataaataaccatttaaagttcctggwaattgtcctaaggacatacagcat

SEQ ID NO: 92416 - DNA, 50 bp, homo sapien
aaatggtaacttggtcacgttatcamtctgtttccttatacttcagtctc

SEQ ID NO: 92417 - DNA, 50 bp, homo sapien
tttattttaattttctattgtcactyaatatttttccactgtaagctgat

SEQ ID NO: 92418 - DNA, 50 bp, homo sapien
agcacaatgcatgactcttacaagawgcttaatagtcatagtttgtcata

SEQ ID NO: 92419 - DNA, 50 bp, homo sapien
tcctttcatttaattccgcttggagractttgttacatttgcaagactgg

SEQ ID NO: 92420 - DNA, 50 bp, homo sapien
agataagtgagtaagtatgtaagtaygtcaacacataaatgcatgcgtgt

SEQ ID NO: 92421 - DNA, 50 bp, homo sapien
ttgtgctaggtgtgcctaaactaatraagaccatatgcctcccctgaaga

SEQ ID NO: 92422 - DNA, 50 bp, homo sapien
atgcaaagtaggctcactatcatttrcatagcttaaaaaagggaatatat

SEQ ID NO: 92423 - DNA, 50 bp, homo sapien
gcatgctatctaggggtttggagtcrtgcaaccaattcactatcattggc

SEQ ID NO: 92424 - DNA, 50 bp, homo sapien
tttgatttgtgttaactaattaacasaagcctagaatgtttttcccaact

SEQ ID NO: 92425 - DNA, 50 bp, homo sapien
tggctgtagggattgtttcagcctcwaatttaacttctgggatatttctg

SEQ ID NO: 92426 - DNA, 50 bp, homo sapien
acggcattattaaggaatgatgtaaygttaggttcttttgatgtattatg

SEQ ID NO: 92427 - DNA, 50 bp, homo sapien
cagctgtaagactttattagtgatcrgcacttatgagtgggggacaaggc

SEQ ID NO: 92428 - DNA, 50 bp, homo sapien
tatgtgcctgttatgggttatttcakcctgtatatgattgatttggaagg

SEQ ID NO: 92429 - DNA, 50 bp, homo sapien
tttcggaaaatagagaaacatctaaktgtggcactttacaagttcatatt

SEQ ID NO: 92430 - DNA, 50 bp, homo sapien
ccttaacccttttaaaatgtgcctaygtccttccaactgtattgtcaaac

SEQ ID NO: 92431 - DNA, 50 bp, homo sapien
agtggataagaagagtctccttttasagcaggttgatggaaagtgctaat

SEQ ID NO: 92432 - DNA, 50 bp, homo sapien
tgcctaccgaggtaaatacacacacyctgatgtagcattccaggttggaa

SEQ ID NO: 92433 - DNA, 50 bp, homo sapien
gccaacacagcatttacagtttagtyagagtcaagagcaagatgtgtgca

SEQ ID NO: 92434 - DNA, 50 bp, homo sapien
aatgcttaggtactcttaatgagtaycgaagtgaagctgaaatgcagtca

SEQ ID NO: 92435 - DNA, 50 bp, homo sapien
gaggtcaatgagtatggagaataaarcggtatacaaaagacaaagcccta

SEQ ID NO: 92436 - DNA, 50 bp, homo sapien
attaccacctaccatctctgctttaytgtgaaaatgtataaaataaaaat

SEQ ID NO: 92437 - DNA, 50 bp, homo sapien
agagaaaacactgatgacaatcataycggcagttccacttattttcctga

SEQ ID NO: 92438 - DNA, 50 bp, homo sapien
ggagctgtccatcttttggttggccyaatacagacactgagcttctttgt

SEQ ID NO: 92439 - DNA, 50 bp, homo sapien
ctctatcaacagatttgaggtataaytgaaatgtaatgattgcgtatgaa

SEQ ID NO: 92440 - DNA, 50 bp, homo sapien
cctgattctcctgcacaattctaacsagccttagaagaatttagaagatg

SEQ ID NO: 92441 - DNA, 50 bp, homo sapien
acaagtctcttttccttaatcactarcattattaaatatgcattttcctg

SEQ ID NO: 92442 - DNA, 50 bp, homo sapien
gctaaaaattaatcttaactcacacwatttgaaatgtacacctatcatat

SEQ ID NO: 92443 - DNA, 50 bp, homo sapien
ctctggaataatcttcctttactcayatgaactattatcaaccagaaagt

SEQ ID NO: 92444 - DNA, 50 bp, homo sapien
agatgattataataatatatgaccaygcggaaaattaatctctaatgcca

SEQ ID NO: 92445 - DNA, 50 bp, homo sapien
acagacgataacgaattctgtcaatkatgtagaaaacgtacaattatgta

SEQ ID NO: 92446 - DNA, 50 bp, homo sapien
ttttaaacatagtaaaagtctttcaygcagtaaatttttgtgcacaaaca

SEQ ID NO: 92447 - DNA, 50 bp, homo sapien
ggtcccatctatcctagtcccttcakaattaactcatttcagtcaacatt

SEQ ID NO: 92448 - DNA, 50 bp, homo sapien
ttgtccaacatttttatgtctgaaasaggtagaaggacattgccaatgtt

SEQ ID NO: 92449 - DNA, 50 bp, homo sapien
attgcaactattggatgttagggaaraaattcatatgtattgtgtttctc

SEQ ID NO: 92450 - DNA, 50 bp, homo sapien
tttttttttttttttggtattccttwaagatcagcattggcatcttccca

SEQ ID NO: 92451 - DNA, 50 bp, homo sapien
tgggttaatctaaaaatcacattcargtgaaagttaaagttgtccttaca

SEQ ID NO: 92452 - DNA, 50 bp, homo sapien
taaaccattagcaaaatgatttatayggaatgcctaacattattaaggta

SEQ ID NO: 92453 - DNA, 50 bp, homo sapien
ctatagaattatcctcataaagttakaggcatctggagacaacgactaca

SEQ ID NO: 92454 - DNA, 50 bp, homo sapien
gccagtgtttctagcatctgggttayagcaagagccaataatcccttttg

SEQ ID NO: 92455 - DNA, 50 bp, homo sapien
attacttgaaagtgccttataatcaygaagtcattaagggtgttatgaga

SEQ ID NO: 92456 - DNA, 50 bp, homo sapien
aaaaaactaggtgaaacctaactaartaagtctgattgagtaaacagacc

SEQ ID NO: 92457 - DNA, 50 bp, homo sapien
ttcagggcggatgaaactctcctacmaagaagggccaaaccggccgcagc

SEQ ID NO: 92458 - DNA, 50 bp, homo sapien
aaccatcttaagaaaaacagtacagwttattggtctatttattttgacac

SEQ ID NO: 92459 - DNA, 50 bp, homo sapien
atatagaaatgaattcactgtgtgcycttctcaggatatgcatttctagg

SEQ ID NO: 92460 - DNA, 50 bp, homo sapien
tagaaaaacattgaaaaattatgackgattagatgcatgtttcactcttt

SEQ ID NO: 92461 - DNA, 50 bp, homo sapien
aaaaatatatggggaactccaactcrgtagccaaacacactcaagtacgc

SEQ ID NO: 92462 - DNA, 50 bp, homo sapien
aaaggtacaatggatgactgtgaagrataattcatggtaaacttttatag

SEQ ID NO: 92463 - DNA, 50 bp, homo sapien
tttctgtattgattatttattcccaktctctactttttgactcccatgga
